United States Patent 11,369,692 (MATERIALS AND METHODS FOR TREATMENT OF DUCHENNE MUSCULAR DYSTROPHY) - sequence listing, part 6

SEQ ID NO: 168866 - DNA, 20 bp, Artificial Sequence
  chemically synthesized
taatcttaaggcttttaaag

SEQ ID NO: 168867 - DNA, 20 bp, Artificial Sequence
  chemically synthesized
gagtaatcttaaggctttta

SEQ ID NO: 168868 - DNA, 20 bp, Artificial Sequence
  chemically synthesized
aaaactactttaaaagcctt

SEQ ID NO: 168869 - DNA, 20 bp, Artificial Sequence
  chemically synthesized
gaagggaatgagtaatctta

SEQ ID NO: 168870 - DNA, 20 bp, Artificial Sequence
  chemically synthesized
tgaagggaatgagtaatctt

SEQ ID NO: 168871 - DNA, 20 bp, Artificial Sequence
  chemically synthesized
attttggagttgaagggaat

SEQ ID NO: 168872 - DNA, 20 bp, Artificial Sequence
  chemically synthesized
agtagcattttggagttgaa

SEQ ID NO: 168873 - DNA, 20 bp, Artificial Sequence
  chemically synthesized
aagtagcattttggagttga

SEQ ID NO: 168874 - DNA, 20 bp, Artificial Sequence
  chemically synthesized
gaagtagcattttggagttg

SEQ ID NO: 168875 - DNA, 20 bp, Artificial Sequence
  chemically synthesized
ttcatagaagtagcattttg

SEQ ID NO: 168876 - DNA, 20 bp, Artificial Sequence
  chemically synthesized
aattcatagaagtagcattt

SEQ ID NO: 168877 - DNA, 20 bp, Artificial Sequence
  chemically synthesized
cctaggaaaattcatagaag

SEQ ID NO: 168878 - DNA, 20 bp, Artificial Sequence
  chemically synthesized
tcccctaggaaaattcatag

SEQ ID NO: 168879 - DNA, 20 bp, Artificial Sequence
  chemically synthesized
tattcccctaggaaaattca

SEQ ID NO: 168880 - DNA, 20 bp, Artificial Sequence
  chemically synthesized
gctacttctatgaattttcc

SEQ ID NO: 168881 - DNA, 20 bp, Artificial Sequence
  chemically synthesized
ctacttctatgaattttcct

SEQ ID NO: 168882 - DNA, 20 bp, Artificial Sequence
  chemically synthesized
tacttctatgaattttccta

SEQ ID NO: 168883 - DNA, 20 bp, Artificial Sequence
  chemically synthesized
acttctatgaattttcctag

SEQ ID NO: 168884 - DNA, 20 bp, Artificial Sequence
  chemically synthesized
tttatctctgatattcccct

SEQ ID NO: 168885 - DNA, 20 bp, Artificial Sequence
  chemically synthesized
gtttatctctgatattcccc

SEQ ID NO: 168886 - DNA, 20 bp, Artificial Sequence
  chemically synthesized
gaattttcctaggggaatat

SEQ ID NO: 168887 - DNA, 20 bp, Artificial Sequence
  chemically synthesized
attttcctaggggaatatca

SEQ ID NO: 168888 - DNA, 20 bp, Artificial Sequence
  chemically synthesized
gggaatatcagagataaaca

SEQ ID NO: 168889 - DNA, 20 bp, Artificial Sequence
  chemically synthesized
gaatatcagagataaacaca

SEQ ID NO: 168890 - DNA, 20 bp, Artificial Sequence
  chemically synthesized
taaacacagagacctatgac

SEQ ID NO: 168891 - DNA, 20 bp, Artificial Sequence
  chemically synthesized
taattgaacattcttgtcat

SEQ ID NO: 168892 - DNA, 20 bp, Artificial Sequence
  chemically synthesized
ataattgaacattcttgtca

SEQ ID NO: 168893 - DNA, 20 bp, Artificial Sequence
  chemically synthesized
aatgttcaattatgtcactc

SEQ ID NO: 168894 - DNA, 20 bp, Artificial Sequence
  chemically synthesized
ttcgtttcactttttcgcca

SEQ ID NO: 168895 - DNA, 20 bp, Artificial Sequence
  chemically synthesized
attatgtcactctggcgaaa

SEQ ID NO: 168896 - DNA, 20 bp, Artificial Sequence
  chemically synthesized
atttcgtttcactttttcgc

SEQ ID NO: 168897 - DNA, 20 bp, Artificial Sequence
  chemically synthesized
tgaaacgaaatctccccaaa

SEQ ID NO: 168898 - DNA, 20 bp, Artificial Sequence
  chemically synthesized
agcagtttattctatttggg

SEQ ID NO: 168899 - DNA, 20 bp, Artificial Sequence
  chemically synthesized
aaagcagtttattctatttg

SEQ ID NO: 168900 - DNA, 20 bp, Artificial Sequence
  chemically synthesized
aaaagcagtttattctattt

SEQ ID NO: 168901 - DNA, 20 bp, Artificial Sequence
  chemically synthesized
taaaagcagtttattctatt

SEQ ID NO: 168902 - DNA, 20 bp, Artificial Sequence
  chemically synthesized
catatttcattatgtaaaag

SEQ ID NO: 168903 - DNA, 20 bp, Artificial Sequence
  chemically synthesized
caacatatttcattatgtaa

SEQ ID NO: 168904 - DNA, 20 bp, Artificial Sequence
  chemically synthesized
gaaatatgttgcgtccatta

SEQ ID NO: 168905 - DNA, 20 bp, Artificial Sequence
  chemically synthesized
tttcataatatttactttaa

SEQ ID NO: 168906 - DNA, 20 bp, Artificial Sequence
  chemically synthesized
ttaatatttttcagtgtaat

SEQ ID NO: 168907 - DNA, 20 bp, Artificial Sequence
  chemically synthesized
attaatatttttcagtgtaa

SEQ ID NO: 168908 - DNA, 20 bp, Artificial Sequence
  chemically synthesized
aatatgtcattaatattttt

SEQ ID NO: 168909 - DNA, 20 bp, Artificial Sequence
  chemically synthesized
aatatattaaaaataaatta

SEQ ID NO: 168910 - DNA, 20 bp, Artificial Sequence
  chemically synthesized
tgtatgcatattttacatat

SEQ ID NO: 168911 - DNA, 20 bp, Artificial Sequence
  chemically synthesized
tacatatcagtatcgacaca

SEQ ID NO: 168912 - DNA, 20 bp, Artificial Sequence
  chemically synthesized
atcagtatcgacacacagca

SEQ ID NO: 168913 - DNA, 20 bp, Artificial Sequence
  chemically synthesized
tcagtatcgacacacagcaa

SEQ ID NO: 168914 - DNA, 20 bp, Artificial Sequence
  chemically synthesized
cacacagcaaaggacatgaa

SEQ ID NO: 168915 - DNA, 20 bp, Artificial Sequence
  chemically synthesized
catgaatagatatttctcta

SEQ ID NO: 168916 - DNA, 20 bp, Artificial Sequence
  chemically synthesized
ccatttgtatgtttgcttta

SEQ ID NO: 168917 - DNA, 20 bp, Artificial Sequence
  chemically synthesized
agccatttgtatgtttgctt

SEQ ID NO: 168918 - DNA, 20 bp, Artificial Sequence
  chemically synthesized
ctctaaagcaaacatacaaa

SEQ ID NO: 168919 - DNA, 20 bp, Artificial Sequence
  chemically synthesized
caaacatacaaatggctaac

SEQ ID NO: 168920 - DNA, 20 bp, Artificial Sequence
  chemically synthesized
tttttttttcatatgcttgt

SEQ ID NO: 168921 - DNA, 20 bp, Artificial Sequence
  chemically synthesized
aaatgatcaacctcactaat

SEQ ID NO: 168922 - DNA, 20 bp, Artificial Sequence
  chemically synthesized
catttccctgctgattagtg

SEQ ID NO: 168923 - DNA, 20 bp, Artificial Sequence
  chemically synthesized
gcatttccctgctgattagt

SEQ ID NO: 168924 - DNA, 20 bp, Artificial Sequence
  chemically synthesized
tgatcaacctcactaatcag

SEQ ID NO: 168925 - DNA, 20 bp, Artificial Sequence
  chemically synthesized
gatcaacctcactaatcagc

SEQ ID NO: 168926 - DNA, 20 bp, Artificial Sequence
  chemically synthesized
atcaacctcactaatcagca

SEQ ID NO: 168927 - DNA, 20 bp, Artificial Sequence
  chemically synthesized
atttgcatttccctgctgat

SEQ ID NO: 168928 - DNA, 20 bp, Artificial Sequence
  chemically synthesized
cagcagggaaatgcaaatca

SEQ ID NO: 168929 - DNA, 20 bp, Artificial Sequence
  chemically synthesized
atgcaaatcaaagccaaaat

SEQ ID NO: 168930 - DNA, 20 bp, Artificial Sequence
  chemically synthesized
tataagatgatatcttattt

SEQ ID NO: 168931 - DNA, 20 bp, Artificial Sequence
  chemically synthesized
atagtcattctaacaggtat

SEQ ID NO: 168932 - DNA, 20 bp, Artificial Sequence
  chemically synthesized
agatatcatcttatacctgt

SEQ ID NO: 168933 - DNA, 20 bp, Artificial Sequence
  chemically synthesized
ttgataatagtcattctaac

SEQ ID NO: 168934 - DNA, 20 bp, Artificial Sequence
  chemically synthesized
tttgataatagtcattctaa

SEQ ID NO: 168935 - DNA, 20 bp, Artificial Sequence
  chemically synthesized
ttcttttgtctttttgataa

SEQ ID NO: 168936 - DNA, 20 bp, Artificial Sequence
  chemically synthesized
ttagaatgactattatcaaa

SEQ ID NO: 168937 - DNA, 20 bp, Artificial Sequence
  chemically synthesized
gactattatcaaaaagacaa

SEQ ID NO: 168938 - DNA, 20 bp, Artificial Sequence
  chemically synthesized
ttatcaaaaagacaaaagaa

SEQ ID NO: 168939 - DNA, 20 bp, Artificial Sequence
  chemically synthesized
aaaagacaaaagaaaagtgt

SEQ ID NO: 168940 - DNA, 20 bp, Artificial Sequence
  chemically synthesized
gacaaaagaaaagtgttggc

SEQ ID NO: 168941 - DNA, 20 bp, Artificial Sequence
  chemically synthesized
gaaaagtgttggccagaatg

SEQ ID NO: 168942 - DNA, 20 bp, Artificial Sequence
  chemically synthesized
aaagtgttggccagaatgtg

SEQ ID NO: 168943 - DNA, 20 bp, Artificial Sequence
  chemically synthesized
gttctcttttctccacattc

SEQ ID NO: 168944 - DNA, 20 bp, Artificial Sequence
  chemically synthesized
gttggccagaatgtggagaa

SEQ ID NO: 168945 - DNA, 20 bp, Artificial Sequence
  chemically synthesized
tggccagaatgtggagaaaa

SEQ ID NO: 168946 - DNA, 20 bp, Artificial Sequence
  chemically synthesized
ttcccatcaacattgtacaa

SEQ ID NO: 168947 - DNA, 20 bp, Artificial Sequence
  chemically synthesized
attcccatcaacattgtaca

SEQ ID NO: 168948 - DNA, 20 bp, Artificial Sequence
  chemically synthesized
cattcccatcaacattgtac

SEQ ID NO: 168949 - DNA, 20 bp, Artificial Sequence
  chemically synthesized
gaacccttgtacaatgttga

SEQ ID NO: 168950 - DNA, 20 bp, Artificial Sequence
  chemically synthesized
aacccttgtacaatgttgat

SEQ ID NO: 168951 - DNA, 20 bp, Artificial Sequence
  chemically synthesized
atgttgatgggaatgtaaat

SEQ ID NO: 168952 - DNA, 20 bp, Artificial Sequence
  chemically synthesized
gtaaattagtataattattg

SEQ ID NO: 168953 - DNA, 20 bp, Artificial Sequence
  chemically synthesized
agtataattattgtggaaaa

SEQ ID NO: 168954 - DNA, 20 bp, Artificial Sequence
  chemically synthesized
aattattgtggaaaacagta

SEQ ID NO: 168955 - DNA, 20 bp, Artificial Sequence
  chemically synthesized
tattgtggaaaacagtatgg

SEQ ID NO: 168956 - DNA, 20 bp, Artificial Sequence
  chemically synthesized
gttctatttttaatgttttg

SEQ ID NO: 168957 - DNA, 20 bp, Artificial Sequence
  chemically synthesized
gatccacaaaacattaaaaa

SEQ ID NO: 168958 - DNA, 20 bp, Artificial Sequence
  chemically synthesized
aagattgctaaatcatatgg

SEQ ID NO: 168959 - DNA, 20 bp, Artificial Sequence
  chemically synthesized
aatagaactaccatatgatt

SEQ ID NO: 168960 - DNA, 20 bp, Artificial Sequence
  chemically synthesized
gataagattgctaaatcata

SEQ ID NO: 168961 - DNA, 20 bp, Artificial Sequence
  chemically synthesized
tgatttagcaatcttatctc

SEQ ID NO: 168962 - DNA, 20 bp, Artificial Sequence
  chemically synthesized
gatttagcaatcttatctct

SEQ ID NO: 168963 - DNA, 20 bp, Artificial Sequence
  chemically synthesized
ttggatatatgcccagagat

SEQ ID NO: 168964 - DNA, 20 bp, Artificial Sequence
  chemically synthesized
ttcttttggatatatgccca

SEQ ID NO: 168965 - DNA, 20 bp, Artificial Sequence
  chemically synthesized
agttcttttggatatatgcc

SEQ ID NO: 168966 - DNA, 20 bp, Artificial Sequence
  chemically synthesized
atctctgggcatatatccaa

SEQ ID NO: 168967 - DNA, 20 bp, Artificial Sequence
  chemically synthesized
aatactgatttcagttcttt

SEQ ID NO: 168968 - DNA, 20 bp, Artificial Sequence
  chemically synthesized
atatccaaaagaactgaaat

SEQ ID NO: 168969 - DNA, 20 bp, Artificial Sequence
  chemically synthesized
tctcttcaaaatactgattt

SEQ ID NO: 168970 - DNA, 20 bp, Artificial Sequence
  chemically synthesized
gaactgaaatcagtattttg

SEQ ID NO: 168971 - DNA, 20 bp, Artificial Sequence
  chemically synthesized
actgaaatcagtattttgaa

SEQ ID NO: 168972 - DNA, 20 bp, Artificial Sequence
  chemically synthesized
ccgcagtaaacatgagaggg

SEQ ID NO: 168973 - DNA, 20 bp, Artificial Sequence
  chemically synthesized
gtgccgcagtaaacatgaga

SEQ ID NO: 168974 - DNA, 20 bp, Artificial Sequence
  chemically synthesized
agtgccgcagtaaacatgag

SEQ ID NO: 168975 - DNA, 20 bp, Artificial Sequence
  chemically synthesized
tagtgccgcagtaaacatga

SEQ ID NO: 168976 - DNA, 20 bp, Artificial Sequence
  chemically synthesized
aatagtgccgcagtaaacat

SEQ ID NO: 168977 - DNA, 20 bp, Artificial Sequence
  chemically synthesized
ctgccctctcatgtttactg

SEQ ID NO: 168978 - DNA, 20 bp, Artificial Sequence
  chemically synthesized
ggctattgcaaatagtgccg

SEQ ID NO: 168979 - DNA, 20 bp, Artificial Sequence
  chemically synthesized
tactgcggcactatttgcaa

SEQ ID NO: 168980 - DNA, 20 bp, Artificial Sequence
  chemically synthesized
catatcttggctattgcaaa

SEQ ID NO: 168981 - DNA, 20 bp, Artificial Sequence
  chemically synthesized
cggcactatttgcaatagcc

SEQ ID NO: 168982 - DNA, 20 bp, Artificial Sequence
  chemically synthesized
tatttgcaatagccaagata

SEQ ID NO: 168983 - DNA, 20 bp, Artificial Sequence
  chemically synthesized
tttaggttgattccatatct

SEQ ID NO: 168984 - DNA, 20 bp, Artificial Sequence
  chemically synthesized
tcatttattgatggacattt

SEQ ID NO: 168985 - DNA, 20 bp, Artificial Sequence
  chemically synthesized
ttcatttattgatggacatt

SEQ ID NO: 168986 - DNA, 20 bp, Artificial Sequence
  chemically synthesized
tttaaccgttcatttattga

SEQ ID NO: 168987 - DNA, 20 bp, Artificial Sequence
  chemically synthesized
aatgtccatcaataaatgaa

SEQ ID NO: 168988 - DNA, 20 bp, Artificial Sequence
  chemically synthesized
catcaataaatgaacggtta

SEQ ID NO: 168989 - DNA, 20 bp, Artificial Sequence
  chemically synthesized
atgaacggttaaagaaattg

SEQ ID NO: 168990 - DNA, 20 bp, Artificial Sequence
  chemically synthesized
attgcggtatataaacacaa

SEQ ID NO: 168991 - DNA, 20 bp, Artificial Sequence
  chemically synthesized
aaacacaatggaactctatt

SEQ ID NO: 168992 - DNA, 20 bp, Artificial Sequence
  chemically synthesized
ttctttcctaaggctgaata

SEQ ID NO: 168993 - DNA, 20 bp, Artificial Sequence
  chemically synthesized
ctttctttcctaaggctgaa

SEQ ID NO: 168994 - DNA, 20 bp, Artificial Sequence
  chemically synthesized
aatggaactctattcagcct

SEQ ID NO: 168995 - DNA, 20 bp, Artificial Sequence
  chemically synthesized
atggaactctattcagcctt

SEQ ID NO: 168996 - DNA, 20 bp, Artificial Sequence
  chemically synthesized
aactctattcagccttagga

SEQ ID NO: 168997 - DNA, 20 bp, Artificial Sequence
  chemically synthesized
caggatttctttctttccta

SEQ ID NO: 168998 - DNA, 20 bp, Artificial Sequence
  chemically synthesized
acaggatttctttctttcct

SEQ ID NO: 168999 - DNA, 20 bp, Artificial Sequence
  chemically synthesized
ctattcagccttaggaaaga

SEQ ID NO: 169000 - DNA, 20 bp, Artificial Sequence
  chemically synthesized
tccgtgttgttgcaaatgac

SEQ ID NO: 169001 - DNA, 20 bp, Artificial Sequence
  chemically synthesized
atccgtgttgttgcaaatga

SEQ ID NO: 169002 - DNA, 20 bp, Artificial Sequence
  chemically synthesized
tcctgtcatttgcaacaaca

SEQ ID NO: 169003 - DNA, 20 bp, Artificial Sequence
  chemically synthesized
tgcaacaacacggattgaac

SEQ ID NO: 169004 - DNA, 20 bp, Artificial Sequence
  chemically synthesized
aacaacacggattgaactgg

SEQ ID NO: 169005 - DNA, 20 bp, Artificial Sequence
  chemically synthesized
tcacttgacatcatgtcttc

SEQ ID NO: 169006 - DNA, 20 bp, Artificial Sequence
  chemically synthesized
gaactggaagacatgatgtc

SEQ ID NO: 169007 - DNA, 20 bp, Artificial Sequence
  chemically synthesized
gacatgatgtcaagtgaaat

SEQ ID NO: 169008 - DNA, 20 bp, Artificial Sequence
  chemically synthesized
tgatgtcaagtgaaataagc

SEQ ID NO: 169009 - DNA, 20 bp, Artificial Sequence
  chemically synthesized
gatgtcaagtgaaataagct

SEQ ID NO: 169010 - DNA, 20 bp, Artificial Sequence
  chemically synthesized
caagtgaaataagctaggca

SEQ ID NO: 169011 - DNA, 20 bp, Artificial Sequence
  chemically synthesized
agtatttgcctttctttgcc

SEQ ID NO: 169012 - DNA, 20 bp, Artificial Sequence
  chemically synthesized
tgaaataagctaggcaaaga

SEQ ID NO: 169013 - DNA, 20 bp, Artificial Sequence
  chemically synthesized
gaaataagctaggcaaagaa

SEQ ID NO: 169014 - DNA, 20 bp, Artificial Sequence
  chemically synthesized
cacatataagtgaaatcata

SEQ ID NO: 169015 - DNA, 20 bp, Artificial Sequence
  chemically synthesized
catttttagatttcacatat

SEQ ID NO: 169016 - DNA, 20 bp, Artificial Sequence
  chemically synthesized
ttctctgagtttgacatttt

SEQ ID NO: 169017 - DNA, 20 bp, Artificial Sequence
  chemically synthesized
aaatctaaaaatgtcaaact

SEQ ID NO: 169018 - DNA, 20 bp, Artificial Sequence
  chemically synthesized
atctaaaaatgtcaaactca

SEQ ID NO: 169019 - DNA, 20 bp, Artificial Sequence
  chemically synthesized
aaatgtcaaactcagagaaa

SEQ ID NO: 169020 - DNA, 20 bp, Artificial Sequence
  chemically synthesized
ccatttttctctgtttctct

SEQ ID NO: 169021 - DNA, 20 bp, Artificial Sequence
  chemically synthesized
atgtcaaactcagagaaaca

SEQ ID NO: 169022 - DNA, 20 bp, Artificial Sequence
  chemically synthesized
ctcagagaaacagagaaaaa

SEQ ID NO: 169023 - DNA, 20 bp, Artificial Sequence
  chemically synthesized
agagaaacagagaaaaatgg

SEQ ID NO: 169024 - DNA, 20 bp, Artificial Sequence
  chemically synthesized
cagagaaaaatggtggttat

SEQ ID NO: 169025 - DNA, 20 bp, Artificial Sequence
  chemically synthesized
aaatggtggttattagatcc

SEQ ID NO: 169026 - DNA, 20 bp, Artificial Sequence
  chemically synthesized
aatggtggttattagatcct

SEQ ID NO: 169027 - DNA, 20 bp, Artificial Sequence
  chemically synthesized
atggtggttattagatcctg

SEQ ID NO: 169028 - DNA, 20 bp, Artificial Sequence
  chemically synthesized
tggtggttattagatcctgg

SEQ ID NO: 169029 - DNA, 20 bp, Artificial Sequence
  chemically synthesized
tggttattagatcctggggg

SEQ ID NO: 169030 - DNA, 20 bp, Artificial Sequence
  chemically synthesized
ggttattagatcctgggggt

SEQ ID NO: 169031 - DNA, 20 bp, Artificial Sequence
  chemically synthesized
gttattagatcctgggggtg

SEQ ID NO: 169032 - DNA, 20 bp, Artificial Sequence
  chemically synthesized
tcccaaatcaccccaccccc

SEQ ID NO: 169033 - DNA, 20 bp, Artificial Sequence
  chemically synthesized
ctcccaaatcaccccacccc

SEQ ID NO: 169034 - DNA, 20 bp, Artificial Sequence
  chemically synthesized
atcctgggggtggggtgatt

SEQ ID NO: 169035 - DNA, 20 bp, Artificial Sequence
  chemically synthesized
tcctgggggtggggtgattt

SEQ ID NO: 169036 - DNA, 20 bp, Artificial Sequence
  chemically synthesized
ctgggggtggggtgatttgg

SEQ ID NO: 169037 - DNA, 20 bp, Artificial Sequence
  chemically synthesized
atttgggagatattgatgaa

SEQ ID NO: 169038 - DNA, 20 bp, Artificial Sequence
  chemically synthesized
gatgaaaagatacacaattt

SEQ ID NO: 169039 - DNA, 20 bp, Artificial Sequence
  chemically synthesized
gatacacaatttcagtttga

SEQ ID NO: 169040 - DNA, 20 bp, Artificial Sequence
  chemically synthesized
atacacaatttcagtttgac

SEQ ID NO: 169041 - DNA, 20 bp, Artificial Sequence
  chemically synthesized
acacaatttcagtttgacag

SEQ ID NO: 169042 - DNA, 20 bp, Artificial Sequence
  chemically synthesized
cacaatttcagtttgacagg

SEQ ID NO: 169043 - DNA, 20 bp, Artificial Sequence
  chemically synthesized
ttgacaggaggaataaatcc

SEQ ID NO: 169044 - DNA, 20 bp, Artificial Sequence
  chemically synthesized
ctgagttacaacagataact

SEQ ID NO: 169045 - DNA, 20 bp, Artificial Sequence
  chemically synthesized
cctgagttacaacagataac

SEQ ID NO: 169046 - DNA, 20 bp, Artificial Sequence
  chemically synthesized
gtagtcaccctgagttacaa

SEQ ID NO: 169047 - DNA, 20 bp, Artificial Sequence
  chemically synthesized
cctagttatctgttgtaact

SEQ ID NO: 169048 - DNA, 20 bp, Artificial Sequence
  chemically synthesized
ctagttatctgttgtaactc

SEQ ID NO: 169049 - DNA, 20 bp, Artificial Sequence
  chemically synthesized
tagttatctgttgtaactca

SEQ ID NO: 169050 - DNA, 20 bp, Artificial Sequence
  chemically synthesized
ttactaacagtagtcaccct

SEQ ID NO: 169051 - DNA, 20 bp, Artificial Sequence
  chemically synthesized
taactcagggtgactactgt

SEQ ID NO: 169052 - DNA, 20 bp, Artificial Sequence
  chemically synthesized
tacgttattgttactaacag

SEQ ID NO: 169053 - DNA, 20 bp, Artificial Sequence
  chemically synthesized
gtatacgttattgttactaa

SEQ ID NO: 169054 - DNA, 20 bp, Artificial Sequence
  chemically synthesized
tagtaacaataacgtatact

SEQ ID NO: 169055 - DNA, 20 bp, Artificial Sequence
  chemically synthesized
atctacttttagtaatttcc

SEQ ID NO: 169056 - DNA, 20 bp, Artificial Sequence
  chemically synthesized
gtatacttggaaattactaa

SEQ ID NO: 169057 - DNA, 20 bp, Artificial Sequence
  chemically synthesized
tacttggaaattactaaaag

SEQ ID NO: 169058 - DNA, 20 bp, Artificial Sequence
  chemically synthesized
gaacacttaaaatctacttt

SEQ ID NO: 169059 - DNA, 20 bp, Artificial Sequence
  chemically synthesized
aattactaaaagtagatttt

SEQ ID NO: 169060 - DNA, 20 bp, Artificial Sequence
  chemically synthesized
tacttattattttttgtggt

SEQ ID NO: 169061 - DNA, 20 bp, Artificial Sequence
  chemically synthesized
tacatacttattattttttg

SEQ ID NO: 169062 - DNA, 20 bp, Artificial Sequence
  chemically synthesized
ttcttaccacaaaaaataat

SEQ ID NO: 169063 - DNA, 20 bp, Artificial Sequence
  chemically synthesized
acaaaaaataataagtatgt

SEQ ID NO: 169064 - DNA, 20 bp, Artificial Sequence
  chemically synthesized
caaaaaataataagtatgta

SEQ ID NO: 169065 - DNA, 20 bp, Artificial Sequence
  chemically synthesized
aaggtaatgaatatgttcta

SEQ ID NO: 169066 - DNA, 20 bp, Artificial Sequence
  chemically synthesized
ggaatgactaaatcaagcta

SEQ ID NO: 169067 - DNA, 20 bp, Artificial Sequence
  chemically synthesized
atatgttctatagcttgatt

SEQ ID NO: 169068 - DNA, 20 bp, Artificial Sequence
  chemically synthesized
cattgcggaatgactaaatc

SEQ ID NO: 169069 - DNA, 20 bp, Artificial Sequence
  chemically synthesized
atattgtgaaataaacattg

SEQ ID NO: 169070 - DNA, 20 bp, Artificial Sequence
  chemically synthesized
taaaaattgtattattgtca

SEQ ID NO: 169071 - DNA, 20 bp, Artificial Sequence
  chemically synthesized
atttttatttgtcaattttt

SEQ ID NO: 169072 - DNA, 20 bp, Artificial Sequence
  chemically synthesized
aaaatttaaaaatttacaca

SEQ ID NO: 169073 - DNA, 20 bp, Artificial Sequence
  chemically synthesized
ttttcatatttgtgaatgat

SEQ ID NO: 169074 - DNA, 20 bp, Artificial Sequence
  chemically synthesized
ttagaaatacatgcacactt

SEQ ID NO: 169075 - DNA, 20 bp, Artificial Sequence
  chemically synthesized
tactcctttcaaggttacta

SEQ ID NO: 169076 - DNA, 20 bp, Artificial Sequence
  chemically synthesized
gcacactttagtaaccttga

SEQ ID NO: 169077 - DNA, 20 bp, Artificial Sequence
  chemically synthesized
cacactttagtaaccttgaa

SEQ ID NO: 169078 - DNA, 20 bp, Artificial Sequence
  chemically synthesized
cactttagtaaccttgaaag

SEQ ID NO: 169079 - DNA, 20 bp, Artificial Sequence
  chemically synthesized
aatttataatactcctttca

SEQ ID NO: 169080 - DNA, 20 bp, Artificial Sequence
  chemically synthesized
taatttataatactcctttc

SEQ ID NO: 169081 - DNA, 20 bp, Artificial Sequence
  chemically synthesized
aatatttttgtcccttttca

SEQ ID NO: 169082 - DNA, 20 bp, Artificial Sequence
  chemically synthesized
ctgagtggtaactttgaaaa

SEQ ID NO: 169083 - DNA, 20 bp, Artificial Sequence
  chemically synthesized
tctgagtggtaactttgaaa

SEQ ID NO: 169084 - DNA, 20 bp, Artificial Sequence
  chemically synthesized
ttctgagtggtaactttgaa

SEQ ID NO: 169085 - DNA, 20 bp, Artificial Sequence
  chemically synthesized
cccttttcaaagttaccact

SEQ ID NO: 169086 - DNA, 20 bp, Artificial Sequence
  chemically synthesized
tttcaaagttaccactcaga

SEQ ID NO: 169087 - DNA, 20 bp, Artificial Sequence
  chemically synthesized
catataatattctttctgag

SEQ ID NO: 169088 - DNA, 20 bp, Artificial Sequence
  chemically synthesized
aaacatataatattctttct

SEQ ID NO: 169089 - DNA, 20 bp, Artificial Sequence
  chemically synthesized
tatatgttttatatgttaaa

SEQ ID NO: 169090 - DNA, 20 bp, Artificial Sequence
  chemically synthesized
gttaaatagaaataaataat

SEQ ID NO: 169091 - DNA, 20 bp, Artificial Sequence
  chemically synthesized
aaatagaaataaataataag

SEQ ID NO: 169092 - DNA, 20 bp, Artificial Sequence
  chemically synthesized
aaataaataataagtagtac

SEQ ID NO: 169093 - DNA, 20 bp, Artificial Sequence
  chemically synthesized
aataataagtagtactggtt

SEQ ID NO: 169094 - DNA, 20 bp, Artificial Sequence
  chemically synthesized
aataagtagtactggtttgg

SEQ ID NO: 169095 - DNA, 20 bp, Artificial Sequence
  chemically synthesized
cagaggaatagccaccaaac

SEQ ID NO: 169096 - DNA, 20 bp, Artificial Sequence
  chemically synthesized
ttgctaatatttcagaggaa

SEQ ID NO: 169097 - DNA, 20 bp, Artificial Sequence
  chemically synthesized
tattgttgctaatatttcag

SEQ ID NO: 169098 - DNA, 20 bp, Artificial Sequence
  chemically synthesized
ttattgttgctaatatttca

SEQ ID NO: 169099 - DNA, 20 bp, Artificial Sequence
  chemically synthesized
tggctattcctctgaaatat

SEQ ID NO: 169100 - DNA, 20 bp, Artificial Sequence
  chemically synthesized
ttttattgttgctaatattt

SEQ ID NO: 169101 - DNA, 20 bp, Artificial Sequence
  chemically synthesized
gttgtaaacctaagttataa

SEQ ID NO: 169102 - DNA, 20 bp, Artificial Sequence
  chemically synthesized
ataaaattactattataact

SEQ ID NO: 169103 - DNA, 20 bp, Artificial Sequence
  chemically synthesized
taaaattactattataactt

SEQ ID NO: 169104 - DNA, 20 bp, Artificial Sequence
  chemically synthesized
ctgaaatatgttgtaaacct

SEQ ID NO: 169105 - DNA, 20 bp, Artificial Sequence
  chemically synthesized
cttaggtttacaacatattt

SEQ ID NO: 169106 - DNA, 20 bp, Artificial Sequence
  chemically synthesized
ttaggtttacaacatatttc

SEQ ID NO: 169107 - DNA, 20 bp, Artificial Sequence
  chemically synthesized
atatttcaggtacttcatga

SEQ ID NO: 169108 - DNA, 20 bp, Artificial Sequence
  chemically synthesized
tataagtaaaatccatcatg

SEQ ID NO: 169109 - DNA, 20 bp, Artificial Sequence
  chemically synthesized
tagaataagaaagtgaatat

SEQ ID NO: 169110 - DNA, 20 bp, Artificial Sequence
  chemically synthesized
ggatcatgggtagaataaga

SEQ ID NO: 169111 - DNA, 20 bp, Artificial Sequence
  chemically synthesized
cataggatcatgggtagaat

SEQ ID NO: 169112 - DNA, 20 bp, Artificial Sequence
  chemically synthesized
gtacttcataggatcatggg

SEQ ID NO: 169113 - DNA, 20 bp, Artificial Sequence
  chemically synthesized
tatgtacttcataggatcat

SEQ ID NO: 169114 - DNA, 20 bp, Artificial Sequence
  chemically synthesized
ttatgtacttcataggatca

SEQ ID NO: 169115 - DNA, 20 bp, Artificial Sequence
  chemically synthesized
attctacccatgatcctatg

SEQ ID NO: 169116 - DNA, 20 bp, Artificial Sequence
  chemically synthesized
gaaaatgttatgtacttcat

SEQ ID NO: 169117 - DNA, 20 bp, Artificial Sequence
  chemically synthesized
agaaaatgttatgtacttca

SEQ ID NO: 169118 - DNA, 20 bp, Artificial Sequence
  chemically synthesized
atatcctcacttgataattt

SEQ ID NO: 169119 - DNA, 20 bp, Artificial Sequence
  chemically synthesized
taacattttctaaaattatc

SEQ ID NO: 169120 - DNA, 20 bp, Artificial Sequence
  chemically synthesized
attttctaaaattatcaagt

SEQ ID NO: 169121 - DNA, 20 bp, Artificial Sequence
  chemically synthesized
ttttctaaaattatcaagtg

SEQ ID NO: 169122 - DNA, 20 bp, Artificial Sequence
  chemically synthesized
aattatcaagtgaggatatt

SEQ ID NO: 169123 - DNA, 20 bp, Artificial Sequence
  chemically synthesized
attatcaagtgaggatatta

SEQ ID NO: 169124 - DNA, 20 bp, Artificial Sequence
  chemically synthesized
acaatataaataatattcat

SEQ ID NO: 169125 - DNA, 20 bp, Artificial Sequence
  chemically synthesized
caatataaataatattcata

SEQ ID NO: 169126 - DNA, 20 bp, Artificial Sequence
  chemically synthesized
aataatattcataaggttac

SEQ ID NO: 169127 - DNA, 20 bp, Artificial Sequence
  chemically synthesized
atattcataaggttactagt

SEQ ID NO: 169128 - DNA, 20 bp, Artificial Sequence
  chemically synthesized
gtgccatctttgttacttac

SEQ ID NO: 169129 - DNA, 20 bp, Artificial Sequence
  chemically synthesized
aaggttactagtaagtaaca

SEQ ID NO: 169130 - DNA, 20 bp, Artificial Sequence
  chemically synthesized
ttactagtaagtaacaaaga

SEQ ID NO: 169131 - DNA, 20 bp, Artificial Sequence
  chemically synthesized
caaagatggcactaaatatc

SEQ ID NO: 169132 - DNA, 20 bp, Artificial Sequence
  chemically synthesized
aaagatggcactaaatatcc

SEQ ID NO: 169133 - DNA, 20 bp, Artificial Sequence
  chemically synthesized
gtcagtaaaacctggatatt

SEQ ID NO: 169134 - DNA, 20 bp, Artificial Sequence
  chemically synthesized
aatatgaagtcagtaaaacc

SEQ ID NO: 169135 - DNA, 20 bp, Artificial Sequence
  chemically synthesized
gaaagagtagaatatgaagt

SEQ ID NO: 169136 - DNA, 20 bp, Artificial Sequence
  chemically synthesized
gaaggaaagagtagaatatg

SEQ ID NO: 169137 - DNA, 20 bp, Artificial Sequence
  chemically synthesized
gggaagagggaaggaaagag

SEQ ID NO: 169138 - DNA, 20 bp, Artificial Sequence
  chemically synthesized
ggagggaagagggaaggaaa

SEQ ID NO: 169139 - DNA, 20 bp, Artificial Sequence
  chemically synthesized
tgggagggaagagggaagga

SEQ ID NO: 169140 - DNA, 20 bp, Artificial Sequence
  chemically synthesized
gttttgggagggaagaggga

SEQ ID NO: 169141 - DNA, 20 bp, Artificial Sequence
  chemically synthesized
tgttttgggagggaagaggg

SEQ ID NO: 169142 - DNA, 20 bp, Artificial Sequence
  chemically synthesized
gtatgttttgggagggaaga

SEQ ID NO: 169143 - DNA, 20 bp, Artificial Sequence
  chemically synthesized
agtatgttttgggagggaag

SEQ ID NO: 169144 - DNA, 20 bp, Artificial Sequence
  chemically synthesized
aagtatgttttgggagggaa

SEQ ID NO: 169145 - DNA, 20 bp, Artificial Sequence
  chemically synthesized
gaaagtatgttttgggaggg

SEQ ID NO: 169146 - DNA, 20 bp, Artificial Sequence
  chemically synthesized
ctggaaagtatgttttggga

SEQ ID NO: 169147 - DNA, 20 bp, Artificial Sequence
  chemically synthesized
actggaaagtatgttttggg

SEQ ID NO: 169148 - DNA, 20 bp, Artificial Sequence
  chemically synthesized
tactggaaagtatgttttgg

SEQ ID NO: 169149 - DNA, 20 bp, Artificial Sequence
  chemically synthesized
gatactggaaagtatgtttt

SEQ ID NO: 169150 - DNA, 20 bp, Artificial Sequence
  chemically synthesized
agatactggaaagtatgttt

SEQ ID NO: 169151 - DNA, 20 bp, Artificial Sequence
  chemically synthesized
ccctcccaaaacatactttc

SEQ ID NO: 169152 - DNA, 20 bp, Artificial Sequence
  chemically synthesized
caattttgaaagatactgga

SEQ ID NO: 169153 - DNA, 20 bp, Artificial Sequence
  chemically synthesized
atgtcaattttgaaagatac

SEQ ID NO: 169154 - DNA, 20 bp, Artificial Sequence
  chemically synthesized
ccagatgatgtcaattttga

SEQ ID NO: 169155 - DNA, 20 bp, Artificial Sequence
  chemically synthesized
ctttcaaaattgacatcatc

SEQ ID NO: 169156 - DNA, 20 bp, Artificial Sequence
  chemically synthesized
tttcaaaattgacatcatct

SEQ ID NO: 169157 - DNA, 20 bp, Artificial Sequence
  chemically synthesized
aaaattgacatcatctgggc

SEQ ID NO: 169158 - DNA, 20 bp, Artificial Sequence
  chemically synthesized
aaattgacatcatctgggcc

SEQ ID NO: 169159 - DNA, 20 bp, Artificial Sequence
  chemically synthesized
gtgagccaccgcgcccggcc

SEQ ID NO: 169160 - DNA, 20 bp, Artificial Sequence
  chemically synthesized
gacatcatctgggccgggcg

SEQ ID NO: 169161 - DNA, 20 bp, Artificial Sequence
  chemically synthesized
atcatctgggccgggcgcgg

SEQ ID NO: 169162 - DNA, 20 bp, Artificial Sequence
  chemically synthesized
caggcgtgagccaccgcgcc

SEQ ID NO: 169163 - DNA, 20 bp, Artificial Sequence
  chemically synthesized
agtgctgggattacaggcgt

SEQ ID NO: 169164 - DNA, 20 bp, Artificial Sequence
  chemically synthesized
gtggctcacgcctgtaatcc

SEQ ID NO: 169165 - DNA, 20 bp, Artificial Sequence
  chemically synthesized
ccccaaagtgctgggattac

SEQ ID NO: 169166 - DNA, 20 bp, Artificial Sequence
  chemically synthesized
tccccaaagtgctgggatta

SEQ ID NO: 169167 - DNA, 20 bp, Artificial Sequence
  chemically synthesized
cgcctgtaatcccagcactt

SEQ ID NO: 169168 - DNA, 20 bp, Artificial Sequence
  chemically synthesized
ctcggcctccccaaagtgct

SEQ ID NO: 169169 - DNA, 20 bp, Artificial Sequence
  chemically synthesized
gcctgtaatcccagcacttt

SEQ ID NO: 169170 - DNA, 20 bp, Artificial Sequence
  chemically synthesized
cctcggcctccccaaagtgc

SEQ ID NO: 169171 - DNA, 20 bp, Artificial Sequence
  chemically synthesized
cctgtaatcccagcactttg

SEQ ID NO: 169172 - DNA, 20 bp, Artificial Sequence
  chemically synthesized
tgtaatcccagcactttggg

SEQ ID NO: 169173 - DNA, 20 bp, Artificial Sequence
  chemically synthesized
gtaatcccagcactttgggg

SEQ ID NO: 169174 - DNA, 20 bp, Artificial Sequence
  chemically synthesized
cgcccgcctcggcctcccca

SEQ ID NO: 169175 - DNA, 20 bp, Artificial Sequence
  chemically synthesized
cccagcactttggggaggcc

SEQ ID NO: 169176 - DNA, 20 bp, Artificial Sequence
  chemically synthesized
ccagcactttggggaggccg

SEQ ID NO: 169177 - DNA, 20 bp, Artificial Sequence
  chemically synthesized
gcactttggggaggccgagg

SEQ ID NO: 169178 - DNA, 20 bp, Artificial Sequence
  chemically synthesized
cactttggggaggccgaggc

SEQ ID NO: 169179 - DNA, 20 bp, Artificial Sequence
  chemically synthesized
tttggggaggccgaggcggg

SEQ ID NO: 169180 - DNA, 20 bp, Artificial Sequence
  chemically synthesized
accttatgatccgcccgcct

SEQ ID NO: 169181 - DNA, 20 bp, Artificial Sequence
  chemically synthesized
ggccgaggcgggcggatcat

SEQ ID NO: 169182 - DNA, 20 bp, Artificial Sequence
  chemically synthesized
gccgaggcgggcggatcata

SEQ ID NO: 169183 - DNA, 20 bp, Artificial Sequence
  chemically synthesized
aggcgggcggatcataaggt

SEQ ID NO: 169184 - DNA, 20 bp, Artificial Sequence
  chemically synthesized
ggcgggcggatcataaggtc

SEQ ID NO: 169185 - DNA, 20 bp, Artificial Sequence
  chemically synthesized
cgggcggatcataaggtcag

SEQ ID NO: 169186 - DNA, 20 bp, Artificial Sequence
  chemically synthesized
gatcataaggtcaggagatc

SEQ ID NO: 169187 - DNA, 20 bp, Artificial Sequence
  chemically synthesized
tcaggagatcgagaccatcc

SEQ ID NO: 169188 - DNA, 20 bp, Artificial Sequence
  chemically synthesized
tttcaccgtgttagccagga

SEQ ID NO: 169189 - DNA, 20 bp, Artificial Sequence
  chemically synthesized
ggggtttcaccgtgttagcc

SEQ ID NO: 169190 - DNA, 20 bp, Artificial Sequence
  chemically synthesized
cgagaccatcctggctaaca

SEQ ID NO: 169191 - DNA, 20 bp, Artificial Sequence
  chemically synthesized
cggggtttcaccgtgttagc

SEQ ID NO: 169192 - DNA, 20 bp, Artificial Sequence
  chemically synthesized
gagacggggtttcaccgtgt

SEQ ID NO: 169193 - DNA, 20 bp, Artificial Sequence
  chemically synthesized
ttgtatttttagtagagacg

SEQ ID NO: 169194 - DNA, 20 bp, Artificial Sequence
  chemically synthesized
tttgtatttttagtagagac

SEQ ID NO: 169195 - DNA, 20 bp, Artificial Sequence
  chemically synthesized
ttttgtatttttagtagaga

SEQ ID NO: 169196 - DNA, 20 bp, Artificial Sequence
  chemically synthesized
aattttttgtatttttagta

SEQ ID NO: 169197 - DNA, 20 bp, Artificial Sequence
  chemically synthesized
ctaattttttgtatttttag

SEQ ID NO: 169198 - DNA, 20 bp, Artificial Sequence
  chemically synthesized
cggctaattttttgtatttt

SEQ ID NO: 169199 - DNA, 20 bp, Artificial Sequence
  chemically synthesized
ctactaaaaatacaaaaaat

SEQ ID NO: 169200 - DNA, 20 bp, Artificial Sequence
  chemically synthesized
taaaaatacaaaaaattagc

SEQ ID NO: 169201 - DNA, 20 bp, Artificial Sequence
  chemically synthesized
aaaaatacaaaaaattagcc

SEQ ID NO: 169202 - DNA, 20 bp, Artificial Sequence
  chemically synthesized
tacaaaaaattagccgggca

SEQ ID NO: 169203 - DNA, 20 bp, Artificial Sequence
  chemically synthesized
aaaaaattagccgggcatgg

SEQ ID NO: 169204 - DNA, 20 bp, Artificial Sequence
  chemically synthesized
caggtgcccaccaccatgcc

SEQ ID NO: 169205 - DNA, 20 bp, Artificial Sequence
  chemically synthesized
aaattagccgggcatggtgg

SEQ ID NO: 169206 - DNA, 20 bp, Artificial Sequence
  chemically synthesized
aattagccgggcatggtggt

SEQ ID NO: 169207 - DNA, 20 bp, Artificial Sequence
  chemically synthesized
ggcatggtggtgggcacctg

SEQ ID NO: 169208 - DNA, 20 bp, Artificial Sequence
  chemically synthesized
gtggtgggcacctgtagtcc

SEQ ID NO: 169209 - DNA, 20 bp, Artificial Sequence
  chemically synthesized
tccagagtagctgggactac

SEQ ID NO: 169210 - DNA, 20 bp, Artificial Sequence
  chemically synthesized
ctccagagtagctgggacta

SEQ ID NO: 169211 - DNA, 20 bp, Artificial Sequence
  chemically synthesized
cctcagcctccagagtagct

SEQ ID NO: 169212 - DNA, 20 bp, Artificial Sequence
  chemically synthesized
acctgtagtcccagctactc

SEQ ID NO: 169213 - DNA, 20 bp, Artificial Sequence
  chemically synthesized
gcctcagcctccagagtagc

SEQ ID NO: 169214 - DNA, 20 bp, Artificial Sequence
  chemically synthesized
ctgtagtcccagctactctg

SEQ ID NO: 169215 - DNA, 20 bp, Artificial Sequence
  chemically synthesized
tgtagtcccagctactctgg

SEQ ID NO: 169216 - DNA, 20 bp, Artificial Sequence
  chemically synthesized
tcctgcctcagcctccagag

SEQ ID NO: 169217 - DNA, 20 bp, Artificial Sequence
  chemically synthesized
ttctcctgcctcagcctcca

SEQ ID NO: 169218 - DNA, 20 bp, Artificial Sequence
  chemically synthesized
tcccagctactctggaggct

SEQ ID NO: 169219 - DNA, 20 bp, Artificial Sequence
  chemically synthesized
cccagctactctggaggctg

SEQ ID NO: 169220 - DNA, 20 bp, Artificial Sequence
  chemically synthesized
cattctcctgcctcagcctc

SEQ ID NO: 169221 - DNA, 20 bp, Artificial Sequence
  chemically synthesized
agctactctggaggctgagg

SEQ ID NO: 169222 - DNA, 20 bp, Artificial Sequence
  chemically synthesized
gctactctggaggctgaggc

SEQ ID NO: 169223 - DNA, 20 bp, Artificial Sequence
  chemically synthesized
tactctggaggctgaggcag

SEQ ID NO: 169224 - DNA, 20 bp, Artificial Sequence
  chemically synthesized
ttcacaccattctcctgcct

SEQ ID NO: 169225 - DNA, 20 bp, Artificial Sequence
  chemically synthesized
tggaggctgaggcaggagaa

SEQ ID NO: 169226 - DNA, 20 bp, Artificial Sequence
  chemically synthesized
gcaggagaatggtgtgaact

SEQ ID NO: 169227 - DNA, 20 bp, Artificial Sequence
  chemically synthesized
caggagaatggtgtgaactt

SEQ ID NO: 169228 - DNA, 20 bp, Artificial Sequence
  chemically synthesized
ggagaatggtgtgaacttag

SEQ ID NO: 169229 - DNA, 20 bp, Artificial Sequence
  chemically synthesized
gagaatggtgtgaacttagg

SEQ ID NO: 169230 - DNA, 20 bp, Artificial Sequence
  chemically synthesized
aatggtgtgaacttaggagg

SEQ ID NO: 169231 - DNA, 20 bp, Artificial Sequence
  chemically synthesized
cactgcaaactccacctcct

SEQ ID NO: 169232 - DNA, 20 bp, Artificial Sequence
  chemically synthesized
tggtgtgaacttaggaggtg

SEQ ID NO: 169233 - DNA, 20 bp, Artificial Sequence
  chemically synthesized
aacttaggaggtggagtttg

SEQ ID NO: 169234 - DNA, 20 bp, Artificial Sequence
  chemically synthesized
taggaggtggagtttgcagt

SEQ ID NO: 169235 - DNA, 20 bp, Artificial Sequence
  chemically synthesized
ggtggagtttgcagtgagcc

SEQ ID NO: 169236 - DNA, 20 bp, Artificial Sequence
  chemically synthesized
ggagtgcagtggcgcgatct

SEQ ID NO: 169237 - DNA, 20 bp, Artificial Sequence
  chemically synthesized
tcgcccaggcaggagtgcag

SEQ ID NO: 169238 - DNA, 20 bp, Artificial Sequence
  chemically synthesized
ctgtcgcccaggcaggagtg

SEQ ID NO: 169239 - DNA, 20 bp, Artificial Sequence
  chemically synthesized
cgcgccactgcactcctgcc

SEQ ID NO: 169240 - DNA, 20 bp, Artificial Sequence
  chemically synthesized
gcgccactgcactcctgcct

SEQ ID NO: 169241 - DNA, 20 bp, Artificial Sequence
  chemically synthesized
tcgctctgtcgcccaggcag

SEQ ID NO: 169242 - DNA, 20 bp, Artificial Sequence
  chemically synthesized
tctcgctctgtcgcccaggc

SEQ ID NO: 169243 - DNA, 20 bp, Artificial Sequence
  chemically synthesized
gtctcgctctgtcgcccagg

SEQ ID NO: 169244 - DNA, 20 bp, Artificial Sequence
  chemically synthesized
ctgcactcctgcctgggcga

SEQ ID NO: 169245 - DNA, 20 bp, Artificial Sequence
  chemically synthesized
ggagtctcgctctgtcgccc

SEQ ID NO: 169246 - DNA, 20 bp, Artificial Sequence
  chemically synthesized
gcactcctgcctgggcgaca

SEQ ID NO: 169247 - DNA, 20 bp, Artificial Sequence
  chemically synthesized
cggagtctcgctctgtcgcc

SEQ ID NO: 169248 - DNA, 20 bp, Artificial Sequence
  chemically synthesized
tcctgcctgggcgacagagc

SEQ ID NO: 169249 - DNA, 20 bp, Artificial Sequence
  chemically synthesized
ttttttttttttgtgagacg

SEQ ID NO: 169250 - DNA, 20 bp, Artificial Sequence
  chemically synthesized
ttttttttttttttgtgaga

SEQ ID NO: 169251 - DNA, 20 bp, Artificial Sequence
  chemically synthesized
ttttttttttttttttttgt

SEQ ID NO: 169252 - DNA, 20 bp, Artificial Sequence
  chemically synthesized
aaaaaaaaaaaaaaaaaaaa

SEQ ID NO: 169253 - DNA, 20 bp, Artificial Sequence
  chemically synthesized
aaaaaaaaaaaagaaaaaaa

SEQ ID NO: 169254 - DNA, 20 bp, Artificial Sequence
  chemically synthesized
aaaagacatcatttgataaa

SEQ ID NO: 169255 - DNA, 20 bp, Artificial Sequence
  chemically synthesized
ttgaaaagcataagtttaaa

SEQ ID NO: 169256 - DNA, 20 bp, Artificial Sequence
  chemically synthesized
aaataactattgaaaagcat

SEQ ID NO: 169257 - DNA, 20 bp, Artificial Sequence
  chemically synthesized
tttaaacttatgcttttcaa

SEQ ID NO: 169258 - DNA, 20 bp, Artificial Sequence
  chemically synthesized
tcacacaaataactattgaa

SEQ ID NO: 169259 - DNA, 20 bp, Artificial Sequence
  chemically synthesized
ttttcaatagttatttgtgt

SEQ ID NO: 169260 - DNA, 20 bp, Artificial Sequence
  chemically synthesized
gatactaagtattaagggta

SEQ ID NO: 169261 - DNA, 20 bp, Artificial Sequence
  chemically synthesized
ttaatgatactaagtattaa

SEQ ID NO: 169262 - DNA, 20 bp, Artificial Sequence
  chemically synthesized
caatctatacccttaatact

SEQ ID NO: 169263 - DNA, 20 bp, Artificial Sequence
  chemically synthesized
tttaatgatactaagtatta

SEQ ID NO: 169264 - DNA, 20 bp, Artificial Sequence
  chemically synthesized
ctttaatgatactaagtatt

SEQ ID NO: 169265 - DNA, 20 bp, Artificial Sequence
  chemically synthesized
tatattgctttaatgatact

SEQ ID NO: 169266 - DNA, 20 bp, Artificial Sequence
  chemically synthesized
cttaatacttagtatcatta

SEQ ID NO: 169267 - DNA, 20 bp, Artificial Sequence
  chemically synthesized
tcattaaagcaatatacatt

SEQ ID NO: 169268 - DNA, 20 bp, Artificial Sequence
  chemically synthesized
ttaaagcaatatacattgag

SEQ ID NO: 169269 - DNA, 20 bp, Artificial Sequence
  chemically synthesized
attgagaagtcaacttcaat

SEQ ID NO: 169270 - DNA, 20 bp, Artificial Sequence
  chemically synthesized
atttatattatttcttattg

SEQ ID NO: 169271 - DNA, 20 bp, Artificial Sequence
  chemically synthesized
aatataaatgaaatgcatgc

SEQ ID NO: 169272 - DNA, 20 bp, Artificial Sequence
  chemically synthesized
taaaattaacaaatggcaaa

SEQ ID NO: 169273 - DNA, 20 bp, Artificial Sequence
  chemically synthesized
gtccccataaaattaacaaa

SEQ ID NO: 169274 - DNA, 20 bp, Artificial Sequence
  chemically synthesized
tttgccatttgttaatttta

SEQ ID NO: 169275 - DNA, 20 bp, Artificial Sequence
  chemically synthesized
ttgccatttgttaattttat

SEQ ID NO: 169276 - DNA, 20 bp, Artificial Sequence
  chemically synthesized
tgccatttgttaattttatg

SEQ ID NO: 169277 - DNA, 20 bp, Artificial Sequence
  chemically synthesized
tttgttaattttatggggac

SEQ ID NO: 169278 - DNA, 20 bp, Artificial Sequence
  chemically synthesized
gttaattttatggggactag

SEQ ID NO: 169279 - DNA, 20 bp, Artificial Sequence
  chemically synthesized
ttttatggggactagaagaa

SEQ ID NO: 169280 - DNA, 20 bp, Artificial Sequence
  chemically synthesized
aagcattctaactgttcttc

SEQ ID NO: 169281 - DNA, 20 bp, Artificial Sequence
  chemically synthesized
atggggactagaagaacagt

SEQ ID NO: 169282 - DNA, 20 bp, Artificial Sequence
  chemically synthesized
aatccaaaaatgcatttgat

SEQ ID NO: 169283 - DNA, 20 bp, Artificial Sequence
  chemically synthesized
atgcttatcaaatgcatttt

SEQ ID NO: 169284 - DNA, 20 bp, Artificial Sequence
  chemically synthesized
tgataatttaaacatgattt

SEQ ID NO: 169285 - DNA, 20 bp, Artificial Sequence
  chemically synthesized
tatcatgatataattgtgat

SEQ ID NO: 169286 - DNA, 20 bp, Artificial Sequence
  chemically synthesized
acaagccaaccaaaatagag

SEQ ID NO: 169287 - DNA, 20 bp, Artificial Sequence
  chemically synthesized
gataagcatcttctctattt

SEQ ID NO: 169288 - DNA, 20 bp, Artificial Sequence
  chemically synthesized
atgacaagccaaccaaaata

SEQ ID NO: 169289 - DNA, 20 bp, Artificial Sequence
  chemically synthesized
agcatcttctctattttggt

SEQ ID NO: 169290 - DNA, 20 bp, Artificial Sequence
  chemically synthesized
aaatgacaagccaaccaaaa

SEQ ID NO: 169291 - DNA, 20 bp, Artificial Sequence
  chemically synthesized
tctattataaaataaatgac

SEQ ID NO: 169292 - DNA, 20 bp, Artificial Sequence
  chemically synthesized
gcttgtcatttattttataa

SEQ ID NO: 169293 - DNA, 20 bp, Artificial Sequence
  chemically synthesized
tgtcatttattttataatag

SEQ ID NO: 169294 - DNA, 20 bp, Artificial Sequence
  chemically synthesized
tttattttataatagaagca

SEQ ID NO: 169295 - DNA, 20 bp, Artificial Sequence
  chemically synthesized
aatagaagcatagataacat

SEQ ID NO: 169296 - DNA, 20 bp, Artificial Sequence
  chemically synthesized
agataacataagttgttata

SEQ ID NO: 169297 - DNA, 20 bp, Artificial Sequence
  chemically synthesized
ataaagattaaaaataataa

SEQ ID NO: 169298 - DNA, 20 bp, Artificial Sequence
  chemically synthesized
taaagattaaaaataataat

SEQ ID NO: 169299 - DNA, 20 bp, Artificial Sequence
  chemically synthesized
aaagattaaaaataataata

SEQ ID NO: 169300 - DNA, 20 bp, Artificial Sequence
  chemically synthesized
agggaattttcaattccaat

SEQ ID NO: 169301 - DNA, 20 bp, Artificial Sequence
  chemically synthesized
tcatgtaaattattacttat

SEQ ID NO: 169302 - DNA, 20 bp, Artificial Sequence
  chemically synthesized
taataatttacatgatattt

SEQ ID NO: 169303 - DNA, 20 bp, Artificial Sequence
  chemically synthesized
tttaatgtaaatgctgaatt

SEQ ID NO: 169304 - DNA, 20 bp, Artificial Sequence
  chemically synthesized
agtacagaagtttccgaatt

SEQ ID NO: 169305 - DNA, 20 bp, Artificial Sequence
  chemically synthesized
tctttattttttaagtacag

SEQ ID NO: 169306 - DNA, 20 bp, Artificial Sequence
  chemically synthesized
aagtctttattttttaagta

SEQ ID NO: 169307 - DNA, 20 bp, Artificial Sequence
  chemically synthesized
caatcaagtctttatttttt

SEQ ID NO: 169308 - DNA, 20 bp, Artificial Sequence
  chemically synthesized
acttctgtacttaaaaaata

SEQ ID NO: 169309 - DNA, 20 bp, Artificial Sequence
  chemically synthesized
aattaagttaaaattcaatc

SEQ ID NO: 169310 - DNA, 20 bp, Artificial Sequence
  chemically synthesized
tgagataggattttaaaatt

SEQ ID NO: 169311 - DNA, 20 bp, Artificial Sequence
  chemically synthesized
agttaggaattgtgtgagat

SEQ ID NO: 169312 - DNA, 20 bp, Artificial Sequence
  chemically synthesized
tagttaggaattgtgtgaga

SEQ ID NO: 169313 - DNA, 20 bp, Artificial Sequence
  chemically synthesized
tatttagttaggaattgtgt

SEQ ID NO: 169314 - DNA, 20 bp, Artificial Sequence
  chemically synthesized
cattcatctggtatttagtt

SEQ ID NO: 169315 - DNA, 20 bp, Artificial Sequence
  chemically synthesized
tcattcatctggtatttagt

SEQ ID NO: 169316 - DNA, 20 bp, Artificial Sequence
  chemically synthesized
cacaattcctaactaaatac

SEQ ID NO: 169317 - DNA, 20 bp, Artificial Sequence
  chemically synthesized
catttcattcatctggtatt

SEQ ID NO: 169318 - DNA, 20 bp, Artificial Sequence
  chemically synthesized
catgtaacatttcattcatc

SEQ ID NO: 169319 - DNA, 20 bp, Artificial Sequence
  chemically synthesized
gtaaaaaaattgaactataa

SEQ ID NO: 169320 - DNA, 20 bp, Artificial Sequence
  chemically synthesized
ccatattttcattactttta

SEQ ID NO: 169321 - DNA, 20 bp, Artificial Sequence
  chemically synthesized
ctataaaagtaatgaaaata

SEQ ID NO: 169322 - DNA, 20 bp, Artificial Sequence
  chemically synthesized
tataaaagtaatgaaaatat

SEQ ID NO: 169323 - DNA, 20 bp, Artificial Sequence
  chemically synthesized
taaaagtaatgaaaatatgg

SEQ ID NO: 169324 - DNA, 20 bp, Artificial Sequence
  chemically synthesized
aaaagtaatgaaaatatggg

SEQ ID NO: 169325 - DNA, 20 bp, Artificial Sequence
  chemically synthesized
ttaaattaaaattataagaa

SEQ ID NO: 169326 - DNA, 20 bp, Artificial Sequence
  chemically synthesized
ggcttttaaattaaaattat

SEQ ID NO: 169327 - DNA, 20 bp, Artificial Sequence
  chemically synthesized
ttcttataattttaatttaa

SEQ ID NO: 169328 - DNA, 20 bp, Artificial Sequence
  chemically synthesized
attttaatttaaaagccata

SEQ ID NO: 169329 - DNA, 20 bp, Artificial Sequence
  chemically synthesized
gaatgtaagtcattacttta

SEQ ID NO: 169330 - DNA, 20 bp, Artificial Sequence
  chemically synthesized
aaagtaatgacttacattca

SEQ ID NO: 169331 - DNA, 20 bp, Artificial Sequence
  chemically synthesized
ttttatactgctatgaatgt

SEQ ID NO: 169332 - DNA, 20 bp, Artificial Sequence
  chemically synthesized
gtaatgacttacattcatag

SEQ ID NO: 169333 - DNA, 20 bp, Artificial Sequence
  chemically synthesized
cttgtttgattttttatgta

SEQ ID NO: 169334 - DNA, 20 bp, Artificial Sequence
  chemically synthesized
ctttacataaaaaatcaaac

SEQ ID NO: 169335 - DNA, 20 bp, Artificial Sequence
  chemically synthesized
ataaaaaatcaaacaagcca

SEQ ID NO: 169336 - DNA, 20 bp, Artificial Sequence
  chemically synthesized
aatcaaacaagccaaagaaa

SEQ ID NO: 169337 - DNA, 20 bp, Artificial Sequence
  chemically synthesized
atcaaacaagccaaagaaaa

SEQ ID NO: 169338 - DNA, 20 bp, Artificial Sequence
  chemically synthesized
attgtttttgcctttttctt

SEQ ID NO: 169339 - DNA, 20 bp, Artificial Sequence
  chemically synthesized
tttatcttaagagtgtcaaa

SEQ ID NO: 169340 - DNA, 20 bp, Artificial Sequence
  chemically synthesized
ttcatctttttgacactctt

SEQ ID NO: 169341 - DNA, 20 bp, Artificial Sequence
  chemically synthesized
tgagaatgtttttatcttaa

SEQ ID NO: 169342 - DNA, 20 bp, Artificial Sequence
  chemically synthesized
tgtgagaatgtttttatctt

SEQ ID NO: 169343 - DNA, 20 bp, Artificial Sequence
  chemically synthesized
ataaaaacattctcacaaat

SEQ ID NO: 169344 - DNA, 20 bp, Artificial Sequence
  chemically synthesized
ctttttttctactgatttgt

SEQ ID NO: 169345 - DNA, 20 bp, Artificial Sequence
  chemically synthesized
aaaacattctcacaaatcag

SEQ ID NO: 169346 - DNA, 20 bp, Artificial Sequence
  chemically synthesized
ctcacaaatcagtagaaaaa

SEQ ID NO: 169347 - DNA, 20 bp, Artificial Sequence
  chemically synthesized
aagacaaatactcaattaaa

SEQ ID NO: 169348 - DNA, 20 bp, Artificial Sequence
  chemically synthesized
cctcattatcctttttaatt

SEQ ID NO: 169349 - DNA, 20 bp, Artificial Sequence
  chemically synthesized
agacaaatactcaattaaaa

SEQ ID NO: 169350 - DNA, 20 bp, Artificial Sequence
  chemically synthesized
actcaattaaaaaggataat

SEQ ID NO: 169351 - DNA, 20 bp, Artificial Sequence
  chemically synthesized
ctcaattaaaaaggataatg

SEQ ID NO: 169352 - DNA, 20 bp, Artificial Sequence
  chemically synthesized
ttaaaaaggataatgaggaa

SEQ ID NO: 169353 - DNA, 20 bp, Artificial Sequence
  chemically synthesized
ataatgaggaatagaccatt

SEQ ID NO: 169354 - DNA, 20 bp, Artificial Sequence
  chemically synthesized
taatgaggaatagaccattt

SEQ ID NO: 169355 - DNA, 20 bp, Artificial Sequence
  chemically synthesized
gaggaatagaccatttagga

SEQ ID NO: 169356 - DNA, 20 bp, Artificial Sequence
  chemically synthesized
agttatagttctttcctaaa

SEQ ID NO: 169357 - DNA, 20 bp, Artificial Sequence
  chemically synthesized
gcctatacataggtcagtta

SEQ ID NO: 169358 - DNA, 20 bp, Artificial Sequence
  chemically synthesized
taataggcctatacataggt

SEQ ID NO: 169359 - DNA, 20 bp, Artificial Sequence
  chemically synthesized
aactataactgacctatgta

SEQ ID NO: 169360 - DNA, 20 bp, Artificial Sequence
  chemically synthesized
actataactgacctatgtat

SEQ ID NO: 169361 - DNA, 20 bp, Artificial Sequence
  chemically synthesized
attttaataggcctatacat

SEQ ID NO: 169362 - DNA, 20 bp, Artificial Sequence
  chemically synthesized
aattttaataggcctataca

SEQ ID NO: 169363 - DNA, 20 bp, Artificial Sequence
  chemically synthesized
tgaagtcaaacaattttaat

SEQ ID NO: 169364 - DNA, 20 bp, Artificial Sequence
  chemically synthesized
gtgaagtcaaacaattttaa

SEQ ID NO: 169365 - DNA, 20 bp, Artificial Sequence
  chemically synthesized
ttaaaattgtttgacttcac

SEQ ID NO: 169366 - DNA, 20 bp, Artificial Sequence
  chemically synthesized
taaaattgtttgacttcact

SEQ ID NO: 169367 - DNA, 20 bp, Artificial Sequence
  chemically synthesized
ctgtttgaattttcctagtg

SEQ ID NO: 169368 - DNA, 20 bp, Artificial Sequence
  chemically synthesized
cctccctgtttgaattttcc

SEQ ID NO: 169369 - DNA, 20 bp, Artificial Sequence
  chemically synthesized
cttcactaggaaaattcaaa

SEQ ID NO: 169370 - DNA, 20 bp, Artificial Sequence
  chemically synthesized
ttcactaggaaaattcaaac

SEQ ID NO: 169371 - DNA, 20 bp, Artificial Sequence
  chemically synthesized
tcactaggaaaattcaaaca

SEQ ID NO: 169372 - DNA, 20 bp, Artificial Sequence
  chemically synthesized
actaggaaaattcaaacagg

SEQ ID NO: 169373 - DNA, 20 bp, Artificial Sequence
  chemically synthesized
ctaggaaaattcaaacaggg

SEQ ID NO: 169374 - DNA, 20 bp, Artificial Sequence
  chemically synthesized
taaatctttgttaaatcaat

SEQ ID NO: 169375 - DNA, 20 bp, Artificial Sequence
  chemically synthesized
ttaaatctttgttaaatcaa

SEQ ID NO: 169376 - DNA, 20 bp, Artificial Sequence
  chemically synthesized
ttgcacctattgatttaaca

SEQ ID NO: 169377 - DNA, 20 bp, Artificial Sequence
  chemically synthesized
tattgtattgcagtgcaaga

SEQ ID NO: 169378 - DNA, 20 bp, Artificial Sequence
  chemically synthesized
agactattgtattgcagtgc

SEQ ID NO: 169379 - DNA, 20 bp, Artificial Sequence
  chemically synthesized
tgtatgagactattgtattg

SEQ ID NO: 169380 - DNA, 20 bp, Artificial Sequence
  chemically synthesized
tatcttgcactgcaatacaa

SEQ ID NO: 169381 - DNA, 20 bp, Artificial Sequence
  chemically synthesized
aatacaatagtctcatacaa

SEQ ID NO: 169382 - DNA, 20 bp, Artificial Sequence
  chemically synthesized
ccacacaatttctgttgtat

SEQ ID NO: 169383 - DNA, 20 bp, Artificial Sequence
  chemically synthesized
ctcatacaacagaaattgtg

SEQ ID NO: 169384 - DNA, 20 bp, Artificial Sequence
  chemically synthesized
acagaaattgtgtggtgaat

SEQ ID NO: 169385 - DNA, 20 bp, Artificial Sequence
  chemically synthesized
cagaaattgtgtggtgaatt

SEQ ID NO: 169386 - DNA, 20 bp, Artificial Sequence
  chemically synthesized
tgcttgctatcagtaatgag

SEQ ID NO: 169387 - DNA, 20 bp, Artificial Sequence
  chemically synthesized
atttgcttgctatcagtaat

SEQ ID NO: 169388 - DNA, 20 bp, Artificial Sequence
  chemically synthesized
ttgggtcttctcattactga

SEQ ID NO: 169389 - DNA, 20 bp, Artificial Sequence
  chemically synthesized
gtcttctcattactgatagc

SEQ ID NO: 169390 - DNA, 20 bp, Artificial Sequence
  chemically synthesized
tcattttatttgcttgctat

SEQ ID NO: 169391 - DNA, 20 bp, Artificial Sequence
  chemically synthesized
caaataaaatgaaatatctc

SEQ ID NO: 169392 - DNA, 20 bp, Artificial Sequence
  chemically synthesized
aaataaaatgaaatatctct

SEQ ID NO: 169393 - DNA, 20 bp, Artificial Sequence
  chemically synthesized
ataaaatgaaatatctctgg

SEQ ID NO: 169394 - DNA, 20 bp, Artificial Sequence
  chemically synthesized
aaatgaaatatctctgggag

SEQ ID NO: 169395 - DNA, 20 bp, Artificial Sequence
  chemically synthesized
aatgaaatatctctgggagt

SEQ ID NO: 169396 - DNA, 20 bp, Artificial Sequence
  chemically synthesized
gacacccaaccccactccca

SEQ ID NO: 169397 - DNA, 20 bp, Artificial Sequence
  chemically synthesized
atgaaatatctctgggagtg

SEQ ID NO: 169398 - DNA, 20 bp, Artificial Sequence
  chemically synthesized
tcgacacccaaccccactcc

SEQ ID NO: 169399 - DNA, 20 bp, Artificial Sequence
  chemically synthesized
aatatctctgggagtggggt

SEQ ID NO: 169400 - DNA, 20 bp, Artificial Sequence
  chemically synthesized
atatctctgggagtggggtt

SEQ ID NO: 169401 - DNA, 20 bp, Artificial Sequence
  chemically synthesized
gagtggggttgggtgtcgat

SEQ ID NO: 169402 - DNA, 20 bp, Artificial Sequence
  chemically synthesized
agtggggttgggtgtcgatg

SEQ ID NO: 169403 - DNA, 20 bp, Artificial Sequence
  chemically synthesized
ggggttgggtgtcgatgagg

SEQ ID NO: 169404 - DNA, 20 bp, Artificial Sequence
  chemically synthesized
gggttgggtgtcgatgaggt

SEQ ID NO: 169405 - DNA, 20 bp, Artificial Sequence
  chemically synthesized
gtcgatgaggtaggtttttg

SEQ ID NO: 169406 - DNA, 20 bp, Artificial Sequence
  chemically synthesized
gtttttgtagttcatatcta

SEQ ID NO: 169407 - DNA, 20 bp, Artificial Sequence
  chemically synthesized
cactaaaatgttttagactt

SEQ ID NO: 169408 - DNA, 20 bp, Artificial Sequence
  chemically synthesized
ctaagtgcactaaaatgttt

SEQ ID NO: 169409 - DNA, 20 bp, Artificial Sequence
  chemically synthesized
atctaaagtctaaaacattt

SEQ ID NO: 169410 - DNA, 20 bp, Artificial Sequence
  chemically synthesized
ctaaaacattttagtgcact

SEQ ID NO: 169411 - DNA, 20 bp, Artificial Sequence
  chemically synthesized
acattttagtgcacttagac

SEQ ID NO: 169412 - DNA, 20 bp, Artificial Sequence
  chemically synthesized
attttagtgcacttagacca

SEQ ID NO: 169413 - DNA, 20 bp, Artificial Sequence
  chemically synthesized
aaaagtaaaatctctggtct

SEQ ID NO: 169414 - DNA, 20 bp, Artificial Sequence
  chemically synthesized
aattttaaaagtaaaatctc

SEQ ID NO: 169415 - DNA, 20 bp, Artificial Sequence
  chemically synthesized
aaatttttttgaaattttaa

SEQ ID NO: 169416 - DNA, 20 bp, Artificial Sequence
  chemically synthesized
aaagaagcacatattcattg

SEQ ID NO: 169417 - DNA, 20 bp, Artificial Sequence
  chemically synthesized
atgattttcttttttaaaag

SEQ ID NO: 169418 - DNA, 20 bp, Artificial Sequence
  chemically synthesized
aatatgtgcttcttttaaaa

SEQ ID NO: 169419 - DNA, 20 bp, Artificial Sequence
  chemically synthesized
ataatgattttcttttttaa

SEQ ID NO: 169420 - DNA, 20 bp, Artificial Sequence
  chemically synthesized
gaaaatcattattttaaata

SEQ ID NO: 169421 - DNA, 20 bp, Artificial Sequence
  chemically synthesized
aaaatcattattttaaatat

SEQ ID NO: 169422 - DNA, 20 bp, Artificial Sequence
  chemically synthesized
ggtacacatgtatacttcta

SEQ ID NO: 169423 - DNA, 20 bp, Artificial Sequence
  chemically synthesized
cacatgtatacttctataga

SEQ ID NO: 169424 - DNA, 20 bp, Artificial Sequence
  chemically synthesized
acataaacctctttctatag

SEQ ID NO: 169425 - DNA, 20 bp, Artificial Sequence
  chemically synthesized
catgtatacttctatagaaa

SEQ ID NO: 169426 - DNA, 20 bp, Artificial Sequence
  chemically synthesized
atgtatacttctatagaaag

SEQ ID NO: 169427 - DNA, 20 bp, Artificial Sequence
  chemically synthesized
catacataaacctctttcta

SEQ ID NO: 169428 - DNA, 20 bp, Artificial Sequence
  chemically synthesized
tagaaagaggtttatgtatg

SEQ ID NO: 169429 - DNA, 20 bp, Artificial Sequence
  chemically synthesized
agatatgttgggcacatttt

SEQ ID NO: 169430 - DNA, 20 bp, Artificial Sequence
  chemically synthesized
tagatatgttgggcacattt

SEQ ID NO: 169431 - DNA, 20 bp, Artificial Sequence
  chemically synthesized
atgttgttgatagatatgtt

SEQ ID NO: 169432 - DNA, 20 bp, Artificial Sequence
  chemically synthesized
gatgttgttgatagatatgt

SEQ ID NO: 169433 - DNA, 20 bp, Artificial Sequence
  chemically synthesized
ttgttattagatgttgttga

SEQ ID NO: 169434 - DNA, 20 bp, Artificial Sequence
  chemically synthesized
ctgtattatagagttgttat

SEQ ID NO: 169435 - DNA, 20 bp, Artificial Sequence
  chemically synthesized
ctaataacaactctataata

SEQ ID NO: 169436 - DNA, 20 bp, Artificial Sequence
  chemically synthesized
ataatactacctgtattata

SEQ ID NO: 169437 - DNA, 20 bp, Artificial Sequence
  chemically synthesized
taataacaactctataatac

SEQ ID NO: 169438 - DNA, 20 bp, Artificial Sequence
  chemically synthesized
caataatactacctgtatta

SEQ ID NO: 169439 - DNA, 20 bp, Artificial Sequence
  chemically synthesized
taacaactctataatacagg

SEQ ID NO: 169440 - DNA, 20 bp, Artificial Sequence
  chemically synthesized
acaggtagtattattgttcc

SEQ ID NO: 169441 - DNA, 20 bp, Artificial Sequence
  chemically synthesized
acaagtcacatgcgtacact

SEQ ID NO: 169442 - DNA, 20 bp, Artificial Sequence
  chemically synthesized
tacaagtcacatgcgtacac

SEQ ID NO: 169443 - DNA, 20 bp, Artificial Sequence
  chemically synthesized
tgtacgcatgtgacttgtac

SEQ ID NO: 169444 - DNA, 20 bp, Artificial Sequence
  chemically synthesized
gtacgcatgtgacttgtaca

SEQ ID NO: 169445 - DNA, 20 bp, Artificial Sequence
  chemically synthesized
acagctatctgaccttgtac

SEQ ID NO: 169446 - DNA, 20 bp, Artificial Sequence
  chemically synthesized
gcatgtgacttgtacaaggt

SEQ ID NO: 169447 - DNA, 20 bp, Artificial Sequence
  chemically synthesized
gtgacttgtacaaggtcaga

SEQ ID NO: 169448 - DNA, 20 bp, Artificial Sequence
  chemically synthesized
aaggtcagatagctgtgaaa

SEQ ID NO: 169449 - DNA, 20 bp, Artificial Sequence
  chemically synthesized
ctagcttggttaccatttca

SEQ ID NO: 169450 - DNA, 20 bp, Artificial Sequence
  chemically synthesized
atagctgtgaaatggtaacc

SEQ ID NO: 169451 - DNA, 20 bp, Artificial Sequence
  chemically synthesized
ctgtgaaatggtaaccaagc

SEQ ID NO: 169452 - DNA, 20 bp, Artificial Sequence
  chemically synthesized
tgtgaaatggtaaccaagct

SEQ ID NO: 169453 - DNA, 20 bp, Artificial Sequence
  chemically synthesized
cttgggttcaaatcctagct

SEQ ID NO: 169454 - DNA, 20 bp, Artificial Sequence
  chemically synthesized
aacttcttgggttcaaatcc

SEQ ID NO: 169455 - DNA, 20 bp, Artificial Sequence
  chemically synthesized
ccaagctaggatttgaaccc

SEQ ID NO: 169456 - DNA, 20 bp, Artificial Sequence
  chemically synthesized
agctaggatttgaacccaag

SEQ ID NO: 169457 - DNA, 20 bp, Artificial Sequence
  chemically synthesized
aggatttgaacccaagaagt

SEQ ID NO: 169458 - DNA, 20 bp, Artificial Sequence
  chemically synthesized
gcttcaaagcctaacttctt

SEQ ID NO: 169459 - DNA, 20 bp, Artificial Sequence
  chemically synthesized
ggatttgaacccaagaagtt

SEQ ID NO: 169460 - DNA, 20 bp, Artificial Sequence
  chemically synthesized
ggcttcaaagcctaacttct

SEQ ID NO: 169461 - DNA, 20 bp, Artificial Sequence
  chemically synthesized
acccaagaagttaggctttg

SEQ ID NO: 169462 - DNA, 20 bp, Artificial Sequence
  chemically synthesized
ggttaacaggataggcttca

SEQ ID NO: 169463 - DNA, 20 bp, Artificial Sequence
  chemically synthesized
agtacagtggttaacaggat

SEQ ID NO: 169464 - DNA, 20 bp, Artificial Sequence
  chemically synthesized
tagtacagtggttaacagga

SEQ ID NO: 169465 - DNA, 20 bp, Artificial Sequence
  chemically synthesized
aaaatagtacagtggttaac

SEQ ID NO: 169466 - DNA, 20 bp, Artificial Sequence
  chemically synthesized
taaaatagtacagtggttaa

SEQ ID NO: 169467 - DNA, 20 bp, Artificial Sequence
  chemically synthesized
tgagaggtaaaatagtacag

SEQ ID NO: 169468 - DNA, 20 bp, Artificial Sequence
  chemically synthesized
gaatgagaggtaaaatagta

SEQ ID NO: 169469 - DNA, 20 bp, Artificial Sequence
  chemically synthesized
aaagggaatgagaggtaaaa

SEQ ID NO: 169470 - DNA, 20 bp, Artificial Sequence
  chemically synthesized
atatagctaaagggaatgag

SEQ ID NO: 169471 - DNA, 20 bp, Artificial Sequence
  chemically synthesized
catatagctaaagggaatga

SEQ ID NO: 169472 - DNA, 20 bp, Artificial Sequence
  chemically synthesized
gtcatatagctaaagggaat

SEQ ID NO: 169473 - DNA, 20 bp, Artificial Sequence
  chemically synthesized
attttacctctcattccctt

SEQ ID NO: 169474 - DNA, 20 bp, Artificial Sequence
  chemically synthesized
ctcaaagtcatatagctaaa

SEQ ID NO: 169475 - DNA, 20 bp, Artificial Sequence
  chemically synthesized
tctcaaagtcatatagctaa

SEQ ID NO: 169476 - DNA, 20 bp, Artificial Sequence
  chemically synthesized
ttctcaaagtcatatagcta

SEQ ID NO: 169477 - DNA, 20 bp, Artificial Sequence
  chemically synthesized
tatattttctcaaagtcata

SEQ ID NO: 169478 - DNA, 20 bp, Artificial Sequence
  chemically synthesized
ccctttagctatatgacttt

SEQ ID NO: 169479 - DNA, 20 bp, Artificial Sequence
  chemically synthesized
tcatatagtatattttctca

SEQ ID NO: 169480 - DNA, 20 bp, Artificial Sequence
  chemically synthesized
tttgagaaaatatactatat

SEQ ID NO: 169481 - DNA, 20 bp, Artificial Sequence
  chemically synthesized
aaccttcttttgcactcata

SEQ ID NO: 169482 - DNA, 20 bp, Artificial Sequence
  chemically synthesized
aatatactatatgagtgcaa

SEQ ID NO: 169483 - DNA, 20 bp, Artificial Sequence
  chemically synthesized
atactatatgagtgcaaaag

SEQ ID NO: 169484 - DNA, 20 bp, Artificial Sequence
  chemically synthesized
tactatatgagtgcaaaaga

SEQ ID NO: 169485 - DNA, 20 bp, Artificial Sequence
  chemically synthesized
tgtgaaattgtgtaaacaaa

SEQ ID NO: 169486 - DNA, 20 bp, Artificial Sequence
  chemically synthesized
tttcacaaaataaattcctt

SEQ ID NO: 169487 - DNA, 20 bp, Artificial Sequence
  chemically synthesized
ttcacaaaataaattccttt

SEQ ID NO: 169488 - DNA, 20 bp, Artificial Sequence
  chemically synthesized
aagctccagtcagtacctaa

SEQ ID NO: 169489 - DNA, 20 bp, Artificial Sequence
  chemically synthesized
taagctccagtcagtaccta

SEQ ID NO: 169490 - DNA, 20 bp, Artificial Sequence
  chemically synthesized
aaattcctttaggtactgac

SEQ ID NO: 169491 - DNA, 20 bp, Artificial Sequence
  chemically synthesized
attcctttaggtactgactg

SEQ ID NO: 169492 - DNA, 20 bp, Artificial Sequence
  chemically synthesized
aaattgtagtaagctccagt

SEQ ID NO: 169493 - DNA, 20 bp, Artificial Sequence
  chemically synthesized
gaagaaattgtagtaagctc

SEQ ID NO: 169494 - DNA, 20 bp, Artificial Sequence
  chemically synthesized
agttatgaagaaattgtagt

SEQ ID NO: 169495 - DNA, 20 bp, Artificial Sequence
  chemically synthesized
tcaaagttatgaagaaattg

SEQ ID NO: 169496 - DNA, 20 bp, Artificial Sequence
  chemically synthesized
cacttactttcaaagttatg

SEQ ID NO: 169497 - DNA, 20 bp, Artificial Sequence
  chemically synthesized
caatttcttcataactttga

SEQ ID NO: 169498 - DNA, 20 bp, Artificial Sequence
  chemically synthesized
ttcttcataactttgaaagt

SEQ ID NO: 169499 - DNA, 20 bp, Artificial Sequence
  chemically synthesized
tatcatcccacttactttca

SEQ ID NO: 169500 - DNA, 20 bp, Artificial Sequence
  chemically synthesized
ttcataactttgaaagtaag

SEQ ID NO: 169501 - DNA, 20 bp, Artificial Sequence
  chemically synthesized
tcataactttgaaagtaagt

SEQ ID NO: 169502 - DNA, 20 bp, Artificial Sequence
  chemically synthesized
tttgaaagtaagtgggatga

SEQ ID NO: 169503 - DNA, 20 bp, Artificial Sequence
  chemically synthesized
tgaaagtaagtgggatgata

SEQ ID NO: 169504 - DNA, 20 bp, Artificial Sequence
  chemically synthesized
tgatagtggcaaggaaaata

SEQ ID NO: 169505 - DNA, 20 bp, Artificial Sequence
  chemically synthesized
ttgatagtggcaaggaaaat

SEQ ID NO: 169506 - DNA, 20 bp, Artificial Sequence
  chemically synthesized
tttgatagtggcaaggaaaa

SEQ ID NO: 169507 - DNA, 20 bp, Artificial Sequence
  chemically synthesized
aactgaatttgatagtggca

SEQ ID NO: 169508 - DNA, 20 bp, Artificial Sequence
  chemically synthesized
aaactgaatttgatagtggc

SEQ ID NO: 169509 - DNA, 20 bp, Artificial Sequence
  chemically synthesized
ttgaaaactgaatttgatag

SEQ ID NO: 169510 - DNA, 20 bp, Artificial Sequence
  chemically synthesized
ttccttgccactatcaaatt

SEQ ID NO: 169511 - DNA, 20 bp, Artificial Sequence
  chemically synthesized
gttttgaaaactgaatttga

SEQ ID NO: 169512 - DNA, 20 bp, Artificial Sequence
  chemically synthesized
gcaagagaatcaatgagtgg

SEQ ID NO: 169513 - DNA, 20 bp, Artificial Sequence
  chemically synthesized
taagcaagagaatcaatgag

SEQ ID NO: 169514 - DNA, 20 bp, Artificial Sequence
  chemically synthesized
ttttaagcaagagaatcaat

SEQ ID NO: 169515 - DNA, 20 bp, Artificial Sequence
  chemically synthesized
agtcacacaattttaagcaa

SEQ ID NO: 169516 - DNA, 20 bp, Artificial Sequence
  chemically synthesized
tcagtcacacaattttaagc

SEQ ID NO: 169517 - DNA, 20 bp, Artificial Sequence
  chemically synthesized
gaaatcagtcacacaatttt

SEQ ID NO: 169518 - DNA, 20 bp, Artificial Sequence
  chemically synthesized
agttggaggctattggaaat

SEQ ID NO: 169519 - DNA, 20 bp, Artificial Sequence
  chemically synthesized
attgtgtgactgatttccaa

SEQ ID NO: 169520 - DNA, 20 bp, Artificial Sequence
  chemically synthesized
ctaaagaagttggaggctat

SEQ ID NO: 169521 - DNA, 20 bp, Artificial Sequence
  chemically synthesized
aggcaggctaaagaagttgg

SEQ ID NO: 169522 - DNA, 20 bp, Artificial Sequence
  chemically synthesized
aaggcaggctaaagaagttg

SEQ ID NO: 169523 - DNA, 20 bp, Artificial Sequence
  chemically synthesized
ccaatagcctccaacttctt

SEQ ID NO: 169524 - DNA, 20 bp, Artificial Sequence
  chemically synthesized
taaaggcaggctaaagaagt

SEQ ID NO: 169525 - DNA, 20 bp, Artificial Sequence
  chemically synthesized
tagataaaggcaggctaaag

SEQ ID NO: 169526 - DNA, 20 bp, Artificial Sequence
  chemically synthesized
ttttagataaaggcaggcta

SEQ ID NO: 169527 - DNA, 20 bp, Artificial Sequence
  chemically synthesized
accattttttagataaaggc

SEQ ID NO: 169528 - DNA, 20 bp, Artificial Sequence
  chemically synthesized
aaccattttttagataaagg

SEQ ID NO: 169529 - DNA, 20 bp, Artificial Sequence
  chemically synthesized
aagaaccattttttagataa

SEQ ID NO: 169530 - DNA, 20 bp, Artificial Sequence
  chemically synthesized
taagaaccattttttagata

SEQ ID NO: 169531 - DNA, 20 bp, Artificial Sequence
  chemically synthesized
gcctgcctttatctaaaaaa

SEQ ID NO: 169532 - DNA, 20 bp, Artificial Sequence
  chemically synthesized
gattgttaagaaccattttt

SEQ ID NO: 169533 - DNA, 20 bp, Artificial Sequence
  chemically synthesized
gaagatagcgtcagattgtt

SEQ ID NO: 169534 - DNA, 20 bp, Artificial Sequence
  chemically synthesized
tgaagaatggaagatagcgt

SEQ ID NO: 169535 - DNA, 20 bp, Artificial Sequence
  chemically synthesized
aagatttgaagaatggaaga

SEQ ID NO: 169536 - DNA, 20 bp, Artificial Sequence
  chemically synthesized
taggaagatttgaagaatgg

SEQ ID NO: 169537 - DNA, 20 bp, Artificial Sequence
  chemically synthesized
tattaggaagatttgaagaa

SEQ ID NO: 169538 - DNA, 20 bp, Artificial Sequence
  chemically synthesized
tttgttattaggaagatttg

SEQ ID NO: 169539 - DNA, 20 bp, Artificial Sequence
  chemically synthesized
agaagtgctttgttattagg

SEQ ID NO: 169540 - DNA, 20 bp, Artificial Sequence
  chemically synthesized
ttcaaatcttcctaataaca

SEQ ID NO: 169541 - DNA, 20 bp, Artificial Sequence
  chemically synthesized
aaaagaagtgctttgttatt

SEQ ID NO: 169542 - DNA, 20 bp, Artificial Sequence
  chemically synthesized
caaaagaagtgctttgttat

SEQ ID NO: 169543 - DNA, 20 bp, Artificial Sequence
  chemically synthesized
taataacaaagcacttcttt

SEQ ID NO: 169544 - DNA, 20 bp, Artificial Sequence
  chemically synthesized
tcagaggaacagaccaaaag

SEQ ID NO: 169545 - DNA, 20 bp, Artificial Sequence
  chemically synthesized
atgtcagaggaacagaccaa

SEQ ID NO: 169546 - DNA, 20 bp, Artificial Sequence
  chemically synthesized
agtacacaatgtcagaggaa

SEQ ID NO: 169547 - DNA, 20 bp, Artificial Sequence
  chemically synthesized
ggcagagtacacaatgtcag

SEQ ID NO: 169548 - DNA, 20 bp, Artificial Sequence
  chemically synthesized
tggcagagtacacaatgtca

SEQ ID NO: 169549 - DNA, 20 bp, Artificial Sequence
  chemically synthesized
aatggcagagtacacaatgt

SEQ ID NO: 169550 - DNA, 20 bp, Artificial Sequence
  chemically synthesized
aagaagacattttaatggca

SEQ ID NO: 169551 - DNA, 20 bp, Artificial Sequence
  chemically synthesized
aaaagaagacattttaatgg

SEQ ID NO: 169552 - DNA, 20 bp, Artificial Sequence
  chemically synthesized
gggaaaagaagacattttaa

SEQ ID NO: 169553 - DNA, 20 bp, Artificial Sequence
  chemically synthesized
atattttattgagggaaaag

SEQ ID NO: 169554 - DNA, 20 bp, Artificial Sequence
  chemically synthesized
gagatattttattgagggaa

SEQ ID NO: 169555 - DNA, 20 bp, Artificial Sequence
  chemically synthesized
gaaaagagatattttattga

SEQ ID NO: 169556 - DNA, 20 bp, Artificial Sequence
  chemically synthesized
ggaaaagagatattttattg

SEQ ID NO: 169557 - DNA, 20 bp, Artificial Sequence
  chemically synthesized
aggaaaagagatattttatt

SEQ ID NO: 169558 - DNA, 20 bp, Artificial Sequence
  chemically synthesized
atatgtgtcgataaggaaaa

SEQ ID NO: 169559 - DNA, 20 bp, Artificial Sequence
  chemically synthesized
ttatatgtgtcgataaggaa

SEQ ID NO: 169560 - DNA, 20 bp, Artificial Sequence
  chemically synthesized
gagttttatatgtgtcgata

SEQ ID NO: 169561 - DNA, 20 bp, Artificial Sequence
  chemically synthesized
agagttttatatgtgtcgat

SEQ ID NO: 169562 - DNA, 20 bp, Artificial Sequence
  chemically synthesized
aaaacatgaaggattgggaa

SEQ ID NO: 169563 - DNA, 20 bp, Artificial Sequence
  chemically synthesized
ccaaaacatgaaggattggg

SEQ ID NO: 169564 - DNA, 20 bp, Artificial Sequence
  chemically synthesized
tacccaaaacatgaaggatt

SEQ ID NO: 169565 - DNA, 20 bp, Artificial Sequence
  chemically synthesized
ttacccaaaacatgaaggat

SEQ ID NO: 169566 - DNA, 20 bp, Artificial Sequence
  chemically synthesized
ttttattacccaaaacatga

SEQ ID NO: 169567 - DNA, 20 bp, Artificial Sequence
  chemically synthesized
cttcccaatccttcatgttt

SEQ ID NO: 169568 - DNA, 20 bp, Artificial Sequence
  chemically synthesized
cttttattacccaaaacatg

SEQ ID NO: 169569 - DNA, 20 bp, Artificial Sequence
  chemically synthesized
ttcccaatccttcatgtttt

SEQ ID NO: 169570 - DNA, 20 bp, Artificial Sequence
  chemically synthesized
cttcatgttttgggtaataa

SEQ ID NO: 169571 - DNA, 20 bp, Artificial Sequence
  chemically synthesized
taataaaagttccacctcct

SEQ ID NO: 169572 - DNA, 20 bp, Artificial Sequence
  chemically synthesized
agcaatcttctctgaggagg

SEQ ID NO: 169573 - DNA, 20 bp, Artificial Sequence
  chemically synthesized
ataaaagttccacctcctca

SEQ ID NO: 169574 - DNA, 20 bp, Artificial Sequence
  chemically synthesized
ttaagcaatcttctctgagg

SEQ ID NO: 169575 - DNA, 20 bp, Artificial Sequence
  chemically synthesized
aaagttccacctcctcagag

SEQ ID NO: 169576 - DNA, 20 bp, Artificial Sequence
  chemically synthesized
attaagcaatcttctctgag

SEQ ID NO: 169577 - DNA, 20 bp, Artificial Sequence
  chemically synthesized
ggattaagcaatcttctctg

SEQ ID NO: 169578 - DNA, 20 bp, Artificial Sequence
  chemically synthesized
gggattaagcaatcttctct

SEQ ID NO: 169579 - DNA, 20 bp, Artificial Sequence
  chemically synthesized
tatttccttccagagggatt

SEQ ID NO: 169580 - DNA, 20 bp, Artificial Sequence
  chemically synthesized
agaagattgcttaatccctc

SEQ ID NO: 169581 - DNA, 20 bp, Artificial Sequence
  chemically synthesized
agattgcttaatccctctgg

SEQ ID NO: 169582 - DNA, 20 bp, Artificial Sequence
  chemically synthesized
gattgcttaatccctctgga

SEQ ID NO: 169583 - DNA, 20 bp, Artificial Sequence
  chemically synthesized
aatcattatttccttccaga

SEQ ID NO: 169584 - DNA, 20 bp, Artificial Sequence
  chemically synthesized
gaatcattatttccttccag

SEQ ID NO: 169585 - DNA, 20 bp, Artificial Sequence
  chemically synthesized
agaatcattatttccttcca

SEQ ID NO: 169586 - DNA, 20 bp, Artificial Sequence
  chemically synthesized
atagaatcattatttccttc

SEQ ID NO: 169587 - DNA, 20 bp, Artificial Sequence
  chemically synthesized
taatgctagagtttattaga

SEQ ID NO: 169588 - DNA, 20 bp, Artificial Sequence
  chemically synthesized
taattaatgctagagtttat

SEQ ID NO: 169589 - DNA, 20 bp, Artificial Sequence
  chemically synthesized
tgattctatctaataaactc

SEQ ID NO: 169590 - DNA, 20 bp, Artificial Sequence
  chemically synthesized
agcccaggtaattaatgcta

SEQ ID NO: 169591 - DNA, 20 bp, Artificial Sequence
  chemically synthesized
gtagcccaggtaattaatgc

SEQ ID NO: 169592 - DNA, 20 bp, Artificial Sequence
  chemically synthesized
aaactctagcattaattacc

SEQ ID NO: 169593 - DNA, 20 bp, Artificial Sequence
  chemically synthesized
aactctagcattaattacct

SEQ ID NO: 169594 - DNA, 20 bp, Artificial Sequence
  chemically synthesized
ggtgtctaatgaagtagccc

SEQ ID NO: 169595 - DNA, 20 bp, Artificial Sequence
  chemically synthesized
cggtgtctaatgaagtagcc

SEQ ID NO: 169596 - DNA, 20 bp, Artificial Sequence
  chemically synthesized
aattacctgggctacttcat

SEQ ID NO: 169597 - DNA, 20 bp, Artificial Sequence
  chemically synthesized
actgacggtgtctaatgaag

SEQ ID NO: 169598 - DNA, 20 bp, Artificial Sequence
  chemically synthesized
ataactgacggtgtctaatg

SEQ ID NO: 169599 - DNA, 20 bp, Artificial Sequence
  chemically synthesized
gctacttcattagacaccgt

SEQ ID NO: 169600 - DNA, 20 bp, Artificial Sequence
  chemically synthesized
aagaaaaaagtaataactga

SEQ ID NO: 169601 - DNA, 20 bp, Artificial Sequence
  chemically synthesized
gaacagtaaaataaagaaaa

SEQ ID NO: 169602 - DNA, 20 bp, Artificial Sequence
  chemically synthesized
tggaagagaacagtaaaata

SEQ ID NO: 169603 - DNA, 20 bp, Artificial Sequence
  chemically synthesized
agacataagttggaagagaa

SEQ ID NO: 169604 - DNA, 20 bp, Artificial Sequence
  chemically synthesized
aaagaagacataagttggaa

SEQ ID NO: 169605 - DNA, 20 bp, Artificial Sequence
  chemically synthesized
agaaagaagacataagttgg

SEQ ID NO: 169606 - DNA, 20 bp, Artificial Sequence
  chemically synthesized
agaagaaagaagacataagt

SEQ ID NO: 169607 - DNA, 20 bp, Artificial Sequence
  chemically synthesized
caagagaagaaagaagacat

SEQ ID NO: 169608 - DNA, 20 bp, Artificial Sequence
  chemically synthesized
ggagagacaagagaagaaag

SEQ ID NO: 169609 - DNA, 20 bp, Artificial Sequence
  chemically synthesized
tggggagagacaagagaaga

SEQ ID NO: 169610 - DNA, 20 bp, Artificial Sequence
  chemically synthesized
cttttggggagagacaagag

SEQ ID NO: 169611 - DNA, 20 bp, Artificial Sequence
  chemically synthesized
tagcttttggggagagacaa

SEQ ID NO: 169612 - DNA, 20 bp, Artificial Sequence
  chemically synthesized
tctagcttttggggagagac

SEQ ID NO: 169613 - DNA, 20 bp, Artificial Sequence
  chemically synthesized
cttctcttgtctctccccaa

SEQ ID NO: 169614 - DNA, 20 bp, Artificial Sequence
  chemically synthesized
agtattctagcttttgggga

SEQ ID NO: 169615 - DNA, 20 bp, Artificial Sequence
  chemically synthesized
tgagtattctagcttttggg

SEQ ID NO: 169616 - DNA, 20 bp, Artificial Sequence
  chemically synthesized
tcttgtctctccccaaaagc

SEQ ID NO: 169617 - DNA, 20 bp, Artificial Sequence
  chemically synthesized
tgtgagtattctagcttttg

SEQ ID NO: 169618 - DNA, 20 bp, Artificial Sequence
  chemically synthesized
gtgtgagtattctagctttt

SEQ ID NO: 169619 - DNA, 20 bp, Artificial Sequence
  chemically synthesized
tgtgtgagtattctagcttt

SEQ ID NO: 169620 - DNA, 20 bp, Artificial Sequence
  chemically synthesized
gtgtgtatgtgtgagtattc

SEQ ID NO: 169621 - DNA, 20 bp, Artificial Sequence
  chemically synthesized
ttgtggctgtgtgtatgtgt

SEQ ID NO: 169622 - DNA, 20 bp, Artificial Sequence
  chemically synthesized
agaatactcacacatacaca

SEQ ID NO: 169623 - DNA, 20 bp, Artificial Sequence
  chemically synthesized
aaagatgtaaaattcaattg

SEQ ID NO: 169624 - DNA, 20 bp, Artificial Sequence
  chemically synthesized
aaagttactaacggtatata

SEQ ID NO: 169625 - DNA, 20 bp, Artificial Sequence
  chemically synthesized
tttacatctttatataccgt

SEQ ID NO: 169626 - DNA, 20 bp, Artificial Sequence
  chemically synthesized
catgtaagaaaagttactaa

SEQ ID NO: 169627 - DNA, 20 bp, Artificial Sequence
  chemically synthesized
aatgctatatcatgtaagaa

SEQ ID NO: 169628 - DNA, 20 bp, Artificial Sequence
  chemically synthesized
taacaaatgctatatcatgt

SEQ ID NO: 169629 - DNA, 20 bp, Artificial Sequence
  chemically synthesized
gtaacttttcttacatgata

SEQ ID NO: 169630 - DNA, 20 bp, Artificial Sequence
  chemically synthesized
tcaatcattcgctaataaaa

SEQ ID NO: 169631 - DNA, 20 bp, Artificial Sequence
  chemically synthesized
ccttctcttttctgttttat

SEQ ID NO: 169632 - DNA, 20 bp, Artificial Sequence
  chemically synthesized
cattcgctaataaaacagaa

SEQ ID NO: 169633 - DNA, 20 bp, Artificial Sequence
  chemically synthesized
ttcgctaataaaacagaaaa

SEQ ID NO: 169634 - DNA, 20 bp, Artificial Sequence
  chemically synthesized
gctaataaaacagaaaagag

SEQ ID NO: 169635 - DNA, 20 bp, Artificial Sequence
  chemically synthesized
ctaataaaacagaaaagaga

SEQ ID NO: 169636 - DNA, 20 bp, Artificial Sequence
  chemically synthesized
aagaacataagcgtttttag

SEQ ID NO: 169637 - DNA, 20 bp, Artificial Sequence
  chemically synthesized
acaagaacataagcgttttt

SEQ ID NO: 169638 - DNA, 20 bp, Artificial Sequence
  chemically synthesized
tacaagaacataagcgtttt

SEQ ID NO: 169639 - DNA, 20 bp, Artificial Sequence
  chemically synthesized
ttcaaagtgtacaagaacat

SEQ ID NO: 169640 - DNA, 20 bp, Artificial Sequence
  chemically synthesized
taagcgttttcaaagtgtac

SEQ ID NO: 169641 - DNA, 20 bp, Artificial Sequence
  chemically synthesized
taaggacataagcgttttca

SEQ ID NO: 169642 - DNA, 20 bp, Artificial Sequence
  chemically synthesized
aatgtcatgtataaggacat

SEQ ID NO: 169643 - DNA, 20 bp, Artificial Sequence
  chemically synthesized
agttggaaatgtcatgtata

SEQ ID NO: 169644 - DNA, 20 bp, Artificial Sequence
  chemically synthesized
gagttggaaatgtcatgtat

SEQ ID NO: 169645 - DNA, 20 bp, Artificial Sequence
  chemically synthesized
cctaaaatgggaaacagagt

SEQ ID NO: 169646 - DNA, 20 bp, Artificial Sequence
  chemically synthesized
atagcctaaaatgggaaaca

SEQ ID NO: 169647 - DNA, 20 bp, Artificial Sequence
  chemically synthesized
acatagcctaaaatgggaaa

SEQ ID NO: 169648 - DNA, 20 bp, Artificial Sequence
  chemically synthesized
tccaactctgtttcccattt

SEQ ID NO: 169649 - DNA, 20 bp, Artificial Sequence
  chemically synthesized
ccaactctgtttcccatttt

SEQ ID NO: 169650 - DNA, 20 bp, Artificial Sequence
  chemically synthesized
attcacacatagcctaaaat

SEQ ID NO: 169651 - DNA, 20 bp, Artificial Sequence
  chemically synthesized
tattcacacatagcctaaaa

SEQ ID NO: 169652 - DNA, 20 bp, Artificial Sequence
  chemically synthesized
tgaacttggatattcacaca

SEQ ID NO: 169653 - DNA, 20 bp, Artificial Sequence
  chemically synthesized
taggctatgtgtgaatatcc

SEQ ID NO: 169654 - DNA, 20 bp, Artificial Sequence
  chemically synthesized
gtgtgaatatccaagttcac

SEQ ID NO: 169655 - DNA, 20 bp, Artificial Sequence
  chemically synthesized
tctgactgtgctagtgaact

SEQ ID NO: 169656 - DNA, 20 bp, Artificial Sequence
  chemically synthesized
aatatccaagttcactagca

SEQ ID NO: 169657 - DNA, 20 bp, Artificial Sequence
  chemically synthesized
tccaagttcactagcacagt

SEQ ID NO: 169658 - DNA, 20 bp, Artificial Sequence
  chemically synthesized
aacacctgttctgactgtgc

SEQ ID NO: 169659 - DNA, 20 bp, Artificial Sequence
  chemically synthesized
gttcactagcacagtcagaa

SEQ ID NO: 169660 - DNA, 20 bp, Artificial Sequence
  chemically synthesized
ttcactagcacagtcagaac

SEQ ID NO: 169661 - DNA, 20 bp, Artificial Sequence
  chemically synthesized
cagtcagaacaggtgttact

SEQ ID NO: 169662 - DNA, 20 bp, Artificial Sequence
  chemically synthesized
tcagaacaggtgttacttgg

SEQ ID NO: 169663 - DNA, 20 bp, Artificial Sequence
  chemically synthesized
aacaggtgttacttggcggc

SEQ ID NO: 169664 - DNA, 20 bp, Artificial Sequence
  chemically synthesized
atttcactagtccagccgcc

SEQ ID NO: 169665 - DNA, 20 bp, Artificial Sequence
  chemically synthesized
gtgttacttggcggctggac

SEQ ID NO: 169666 - DNA, 20 bp, Artificial Sequence
  chemically synthesized
cacatcaaatttcactagtc

SEQ ID NO: 169667 - DNA, 20 bp, Artificial Sequence
  chemically synthesized
ttcctcacatcaaatttcac

SEQ ID NO: 169668 - DNA, 20 bp, Artificial Sequence
  chemically synthesized
ggactagtgaaatttgatgt

SEQ ID NO: 169669 - DNA, 20 bp, Artificial Sequence
  chemically synthesized
gactagtgaaatttgatgtg

SEQ ID NO: 169670 - DNA, 20 bp, Artificial Sequence
  chemically synthesized
gaaatttgatgtgaggaata

SEQ ID NO: 169671 - DNA, 20 bp, Artificial Sequence
  chemically synthesized
aatttgatgtgaggaataca

SEQ ID NO: 169672 - DNA, 20 bp, Artificial Sequence
  chemically synthesized
ttgatgtgaggaatacagag

SEQ ID NO: 169673 - DNA, 20 bp, Artificial Sequence
  chemically synthesized
atgtgaggaatacagagtag

SEQ ID NO: 169674 - DNA, 20 bp, Artificial Sequence
  chemically synthesized
gtgaggaatacagagtagaa

SEQ ID NO: 169675 - DNA, 20 bp, Artificial Sequence
  chemically synthesized
tgaggaatacagagtagaag

SEQ ID NO: 169676 - DNA, 20 bp, Artificial Sequence
  chemically synthesized
gaggaatacagagtagaaga

SEQ ID NO: 169677 - DNA, 20 bp, Artificial Sequence
  chemically synthesized
gaatacagagtagaagaggg

SEQ ID NO: 169678 - DNA, 20 bp, Artificial Sequence
  chemically synthesized
agaagagggtagaccctctt

SEQ ID NO: 169679 - DNA, 20 bp, Artificial Sequence
  chemically synthesized
gaagagggtagaccctcttg

SEQ ID NO: 169680 - DNA, 20 bp, Artificial Sequence
  chemically synthesized
aagagggtagaccctcttga

SEQ ID NO: 169681 - DNA, 20 bp, Artificial Sequence
  chemically synthesized
ctcttgactgaccctcaaga

SEQ ID NO: 169682 - DNA, 20 bp, Artificial Sequence
  chemically synthesized
cctcttgactgaccctcaag

SEQ ID NO: 169683 - DNA, 20 bp, Artificial Sequence
  chemically synthesized
tcctcttgactgaccctcaa

SEQ ID NO: 169684 - DNA, 20 bp, Artificial Sequence
  chemically synthesized
gggtagaccctcttgagggt

SEQ ID NO: 169685 - DNA, 20 bp, Artificial Sequence
  chemically synthesized
agtcctcttgactgaccctc

SEQ ID NO: 169686 - DNA, 20 bp, Artificial Sequence
  chemically synthesized
gaccctcttgagggtcagtc

SEQ ID NO: 169687 - DNA, 20 bp, Artificial Sequence
  chemically synthesized
ccctcttgagggtcagtcaa

SEQ ID NO: 169688 - DNA, 20 bp, Artificial Sequence
  chemically synthesized
cctcttgagggtcagtcaag

SEQ ID NO: 169689 - DNA, 20 bp, Artificial Sequence
  chemically synthesized
gagggtcagtcaagaggact

SEQ ID NO: 169690 - DNA, 20 bp, Artificial Sequence
  chemically synthesized
agggtcagtcaagaggacta

SEQ ID NO: 169691 - DNA, 20 bp, Artificial Sequence
  chemically synthesized
atatcaagaattttattcct

SEQ ID NO: 169692 - DNA, 20 bp, Artificial Sequence
  chemically synthesized
taactaacagaaaacatatc

SEQ ID NO: 169693 - DNA, 20 bp, Artificial Sequence
  chemically synthesized
attcttgatatgttttctgt

SEQ ID NO: 169694 - DNA, 20 bp, Artificial Sequence
  chemically synthesized
ttgatatgttttctgttagt

SEQ ID NO: 169695 - DNA, 20 bp, Artificial Sequence
  chemically synthesized
catgacatcaagctaactaa

SEQ ID NO: 169696 - DNA, 20 bp, Artificial Sequence
  chemically synthesized
tgttagttagcttgatgtca

SEQ ID NO: 169697 - DNA, 20 bp, Artificial Sequence
  chemically synthesized
gccccagaatccatgacatc

SEQ ID NO: 169698 - DNA, 20 bp, Artificial Sequence
  chemically synthesized
tagcttgatgtcatggattc

SEQ ID NO: 169699 - DNA, 20 bp, Artificial Sequence
  chemically synthesized
agcttgatgtcatggattct

SEQ ID NO: 169700 - DNA, 20 bp, Artificial Sequence
  chemically synthesized
gcttgatgtcatggattctg

SEQ ID NO: 169701 - DNA, 20 bp, Artificial Sequence
  chemically synthesized
gatgtcatggattctggggc

SEQ ID NO: 169702 - DNA, 20 bp, Artificial Sequence
  chemically synthesized
tgtcatggattctggggctg

SEQ ID NO: 169703 - DNA, 20 bp, Artificial Sequence
  chemically synthesized
cctagccctgtctccagccc

SEQ ID NO: 169704 - DNA, 20 bp, Artificial Sequence
  chemically synthesized
atggattctggggctggaga

SEQ ID NO: 169705 - DNA, 20 bp, Artificial Sequence
  chemically synthesized
tggattctggggctggagac

SEQ ID NO: 169706 - DNA, 20 bp, Artificial Sequence
  chemically synthesized
ggattctggggctggagaca

SEQ ID NO: 169707 - DNA, 20 bp, Artificial Sequence
  chemically synthesized
ttaatacctagccctgtctc

SEQ ID NO: 169708 - DNA, 20 bp, Artificial Sequence
  chemically synthesized
tctggggctggagacagggc

SEQ ID NO: 169709 - DNA, 20 bp, Artificial Sequence
  chemically synthesized
ctggggctggagacagggct

SEQ ID NO: 169710 - DNA, 20 bp, Artificial Sequence
  chemically synthesized
tcctgcaattaattaatacc

SEQ ID NO: 169711 - DNA, 20 bp, Artificial Sequence
  chemically synthesized
ggctaggtattaattaattg

SEQ ID NO: 169712 - DNA, 20 bp, Artificial Sequence
  chemically synthesized
gctaggtattaattaattgc

SEQ ID NO: 169713 - DNA, 20 bp, Artificial Sequence
  chemically synthesized
gtattaattaattgcaggac

SEQ ID NO: 169714 - DNA, 20 bp, Artificial Sequence
  chemically synthesized
ttaattaattgcaggactag

SEQ ID NO: 169715 - DNA, 20 bp, Artificial Sequence
  chemically synthesized
aattacacggatattaccac

SEQ ID NO: 169716 - DNA, 20 bp, Artificial Sequence
  chemically synthesized
tattgattgaattaattaca

SEQ ID NO: 169717 - DNA, 20 bp, Artificial Sequence
  chemically synthesized
taattcaatcaatatttacc

SEQ ID NO: 169718 - DNA, 20 bp, Artificial Sequence
  chemically synthesized
ttcaatcaatatttacctag

SEQ ID NO: 169719 - DNA, 20 bp, Artificial Sequence
  chemically synthesized
gctggaacaaaatagctact

SEQ ID NO: 169720 - DNA, 20 bp, Artificial Sequence
  chemically synthesized
ggctggaacaaaatagctac

SEQ ID NO: 169721 - DNA, 20 bp, Artificial Sequence
  chemically synthesized
gggcagcggctggaacaaaa

SEQ ID NO: 169722 - DNA, 20 bp, Artificial Sequence
  chemically synthesized
acctagtagctattttgttc

SEQ ID NO: 169723 - DNA, 20 bp, Artificial Sequence
  chemically synthesized
aagcaatacagggcagcggc

SEQ ID NO: 169724 - DNA, 20 bp, Artificial Sequence
  chemically synthesized
acagaagcaatacagggcag

SEQ ID NO: 169725 - DNA, 20 bp, Artificial Sequence
  chemically synthesized
actacagaagcaatacaggg

SEQ ID NO: 169726 - DNA, 20 bp, Artificial Sequence
  chemically synthesized
tcaactacagaagcaataca

SEQ ID NO: 169727 - DNA, 20 bp, Artificial Sequence
  chemically synthesized
gtcaactacagaagcaatac

SEQ ID NO: 169728 - DNA, 20 bp, Artificial Sequence
  chemically synthesized
agtcaactacagaagcaata

SEQ ID NO: 169729 - DNA, 20 bp, Artificial Sequence
  chemically synthesized
gctgccctgtattgcttctg

SEQ ID NO: 169730 - DNA, 20 bp, Artificial Sequence
  chemically synthesized
ccaacttcagtcaactacag

SEQ ID NO: 169731 - DNA, 20 bp, Artificial Sequence
  chemically synthesized
tggccaacttcagtcaacta

SEQ ID NO: 169732 - DNA, 20 bp, Artificial Sequence
  chemically synthesized
attgcttctgtagttgactg

SEQ ID NO: 169733 - DNA, 20 bp, Artificial Sequence
  chemically synthesized
cttctgtagttgactgaagt

SEQ ID NO: 169734 - DNA, 20 bp, Artificial Sequence
  chemically synthesized
agccatacaatggccaactt

SEQ ID NO: 169735 - DNA, 20 bp, Artificial Sequence
  chemically synthesized
gactgaagttggccattgta

SEQ ID NO: 169736 - DNA, 20 bp, Artificial Sequence
  chemically synthesized
acttacacgtagccatacaa

SEQ ID NO: 169737 - DNA, 20 bp, Artificial Sequence
  chemically synthesized
gccattgtatggctacgtgt

SEQ ID NO: 169738 - DNA, 20 bp, Artificial Sequence
  chemically synthesized
tggcattggagacttacacg

SEQ ID NO: 169739 - DNA, 20 bp, Artificial Sequence
  chemically synthesized
gtagagggatattggcattg

SEQ ID NO: 169740 - DNA, 20 bp, Artificial Sequence
  chemically synthesized
aggtagagggatattggcat

SEQ ID NO: 169741 - DNA, 20 bp, Artificial Sequence
  chemically synthesized
ttttcaaggtagagggatat

SEQ ID NO: 169742 - DNA, 20 bp, Artificial Sequence
  chemically synthesized
ttagctattttcaaggtaga

SEQ ID NO: 169743 - DNA, 20 bp, Artificial Sequence
  chemically synthesized
tttagctattttcaaggtag

SEQ ID NO: 169744 - DNA, 20 bp, Artificial Sequence
  chemically synthesized
atttagctattttcaaggta

SEQ ID NO: 169745 - DNA, 20 bp, Artificial Sequence
  chemically synthesized
ttatttagctattttcaagg

SEQ ID NO: 169746 - DNA, 20 bp, Artificial Sequence
  chemically synthesized
atatccctctaccttgaaaa

SEQ ID NO: 169747 - DNA, 20 bp, Artificial Sequence
  chemically synthesized
ctgttatttagctattttca

SEQ ID NO: 169748 - DNA, 20 bp, Artificial Sequence
  chemically synthesized
gctgttatttagctattttc

SEQ ID NO: 169749 - DNA, 20 bp, Artificial Sequence
  chemically synthesized
ccttgaaaatagctaaataa

SEQ ID NO: 169750 - DNA, 20 bp, Artificial Sequence
  chemically synthesized
attcagagtgcgctgttatt

SEQ ID NO: 169751 - DNA, 20 bp, Artificial Sequence
  chemically synthesized
atttgcctaaaatgcattca

SEQ ID NO: 169752 - DNA, 20 bp, Artificial Sequence
  chemically synthesized
atatttgcctaaaatgcatt

SEQ ID NO: 169753 - DNA, 20 bp, Artificial Sequence
  chemically synthesized
agcgcactctgaatgcattt

SEQ ID NO: 169754 - DNA, 20 bp, Artificial Sequence
  chemically synthesized
gcgcactctgaatgcatttt

SEQ ID NO: 169755 - DNA, 20 bp, Artificial Sequence
  chemically synthesized
tgatttttggttgggggcaa

SEQ ID NO: 169756 - DNA, 20 bp, Artificial Sequence
  chemically synthesized
gggaggtgatttttggttgg

SEQ ID NO: 169757 - DNA, 20 bp, Artificial Sequence
  chemically synthesized
ggggaggtgatttttggttg

SEQ ID NO: 169758 - DNA, 20 bp, Artificial Sequence
  chemically synthesized
gggggaggtgatttttggtt

SEQ ID NO: 169759 - DNA, 20 bp, Artificial Sequence
  chemically synthesized
tgggggaggtgatttttggt

SEQ ID NO: 169760 - DNA, 20 bp, Artificial Sequence
  chemically synthesized
aatttgggggaggtgatttt

SEQ ID NO: 169761 - DNA, 20 bp, Artificial Sequence
  chemically synthesized
tggtattactaatttggggg

SEQ ID NO: 169762 - DNA, 20 bp, Artificial Sequence
  chemically synthesized
ttggtattactaatttgggg

SEQ ID NO: 169763 - DNA, 20 bp, Artificial Sequence
  chemically synthesized
aaaaatcacctcccccaaat

SEQ ID NO: 169764 - DNA, 20 bp, Artificial Sequence
  chemically synthesized
aattggtattactaatttgg

SEQ ID NO: 169765 - DNA, 20 bp, Artificial Sequence
  chemically synthesized
taattggtattactaatttg

SEQ ID NO: 169766 - DNA, 20 bp, Artificial Sequence
  chemically synthesized
ttaattggtattactaattt

SEQ ID NO: 169767 - DNA, 20 bp, Artificial Sequence
  chemically synthesized
tttaattggtattactaatt

SEQ ID NO: 169768 - DNA, 20 bp, Artificial Sequence
  chemically synthesized
gtttacatgaattatttaat

SEQ ID NO: 169769 - DNA, 20 bp, Artificial Sequence
  chemically synthesized
ttttatccaaaagaagataa

SEQ ID NO: 169770 - DNA, 20 bp, Artificial Sequence
  chemically synthesized
tgtaaaccattatcttcttt

SEQ ID NO: 169771 - DNA, 20 bp, Artificial Sequence
  chemically synthesized
acgtgcattttatccaaaag

SEQ ID NO: 169772 - DNA, 20 bp, Artificial Sequence
  chemically synthesized
actacgtgcattttatccaa

SEQ ID NO: 169773 - DNA, 20 bp, Artificial Sequence
  chemically synthesized
tcttttggataaaatgcacg

SEQ ID NO: 169774 - DNA, 20 bp, Artificial Sequence
  chemically synthesized
tgcacgtagtatgaaatatt

SEQ ID NO: 169775 - DNA, 20 bp, Artificial Sequence
  chemically synthesized
cacgtagtatgaaatatttg

SEQ ID NO: 169776 - DNA, 20 bp, Artificial Sequence
  chemically synthesized
cgtagtatgaaatatttgga

SEQ ID NO: 169777 - DNA, 20 bp, Artificial Sequence
  chemically synthesized
ttgttgttaagaaatgtgtg

SEQ ID NO: 169778 - DNA, 20 bp, Artificial Sequence
  chemically synthesized
attgttgttaagaaatgtgt

SEQ ID NO: 169779 - DNA, 20 bp, Artificial Sequence
  chemically synthesized
gacattaatttattgttgtt

SEQ ID NO: 169780 - DNA, 20 bp, Artificial Sequence
  chemically synthesized
caacaataaattaatgtcac

SEQ ID NO: 169781 - DNA, 20 bp, Artificial Sequence
  chemically synthesized
acaataaattaatgtcactg

SEQ ID NO: 169782 - DNA, 20 bp, Artificial Sequence
  chemically synthesized
aattaatgtcactggagaac

SEQ ID NO: 169783 - DNA, 20 bp, Artificial Sequence
  chemically synthesized
ctttgctaagtctagttctc

SEQ ID NO: 169784 - DNA, 20 bp, Artificial Sequence
  chemically synthesized
tgtcactggagaactagact

SEQ ID NO: 169785 - DNA, 20 bp, Artificial Sequence
  chemically synthesized
gaagatatctttgctaagtc

SEQ ID NO: 169786 - DNA, 20 bp, Artificial Sequence
  chemically synthesized
ctggagaactagacttagca

SEQ ID NO: 169787 - DNA, 20 bp, Artificial Sequence
  chemically synthesized
cctgggaagatatctttgct

SEQ ID NO: 169788 - DNA, 20 bp, Artificial Sequence
  chemically synthesized
acttagcaaagatatcttcc

SEQ ID NO: 169789 - DNA, 20 bp, Artificial Sequence
  chemically synthesized
cttagcaaagatatcttccc

SEQ ID NO: 169790 - DNA, 20 bp, Artificial Sequence
  chemically synthesized
aatcgagttttgtgcctggg

SEQ ID NO: 169791 - DNA, 20 bp, Artificial Sequence
  chemically synthesized
aataatcgagttttgtgcct

SEQ ID NO: 169792 - DNA, 20 bp, Artificial Sequence
  chemically synthesized
aaataatcgagttttgtgcc

SEQ ID NO: 169793 - DNA, 20 bp, Artificial Sequence
  chemically synthesized
gaccagttgtaaaaataatc

SEQ ID NO: 169794 - DNA, 20 bp, Artificial Sequence
  chemically synthesized
aactcgattatttttacaac

SEQ ID NO: 169795 - DNA, 20 bp, Artificial Sequence
  chemically synthesized
tatttttacaactggtctcg

SEQ ID NO: 169796 - DNA, 20 bp, Artificial Sequence
  chemically synthesized
gggatattttaccacgagac

SEQ ID NO: 169797 - DNA, 20 bp, Artificial Sequence
  chemically synthesized
agtgagggatattttaccac

SEQ ID NO: 169798 - DNA, 20 bp, Artificial Sequence
  chemically synthesized
cgtggtaaaatatccctcac

SEQ ID NO: 169799 - DNA, 20 bp, Artificial Sequence
  chemically synthesized
gtggtaaaatatccctcact

SEQ ID NO: 169800 - DNA, 20 bp, Artificial Sequence
  chemically synthesized
ggtaaaatatccctcactag

SEQ ID NO: 169801 - DNA, 20 bp, Artificial Sequence
  chemically synthesized
aataaatgacctcctagtga

SEQ ID NO: 169802 - DNA, 20 bp, Artificial Sequence
  chemically synthesized
gtaaaatatccctcactagg

SEQ ID NO: 169803 - DNA, 20 bp, Artificial Sequence
  chemically synthesized
aaataaatgacctcctagtg

SEQ ID NO: 169804 - DNA, 20 bp, Artificial Sequence
  chemically synthesized
aaaataaatgacctcctagt

SEQ ID NO: 169805 - DNA, 20 bp, Artificial Sequence
  chemically synthesized
aaagaaaataaatgacctcc

SEQ ID NO: 169806 - DNA, 20 bp, Artificial Sequence
  chemically synthesized
tcatttattttctttccctc

SEQ ID NO: 169807 - DNA, 20 bp, Artificial Sequence
  chemically synthesized
ttattaaatttccagaggga

SEQ ID NO: 169808 - DNA, 20 bp, Artificial Sequence
  chemically synthesized
tattttattaaatttccaga

SEQ ID NO: 169809 - DNA, 20 bp, Artificial Sequence
  chemically synthesized
ttattttattaaatttccag

SEQ ID NO: 169810 - DNA, 20 bp, Artificial Sequence
  chemically synthesized
attattttattaaatttcca

SEQ ID NO: 169811 - DNA, 20 bp, Artificial Sequence
  chemically synthesized
tcattattttattaaatttc

SEQ ID NO: 169812 - DNA, 20 bp, Artificial Sequence
  chemically synthesized
tataaccacaatgtattttt

SEQ ID NO: 169813 - DNA, 20 bp, Artificial Sequence
  chemically synthesized
tatgactgaaaaatacattg

SEQ ID NO: 169814 - DNA, 20 bp, Artificial Sequence
  chemically synthesized
acattgtggttatatgccac

SEQ ID NO: 169815 - DNA, 20 bp, Artificial Sequence
  chemically synthesized
tatagttttaaaatatctgg

SEQ ID NO: 169816 - DNA, 20 bp, Artificial Sequence
  chemically synthesized
atttatagttttaaaatatc

SEQ ID NO: 169817 - DNA, 20 bp, Artificial Sequence
  chemically synthesized
ttacattgtatatggattta

SEQ ID NO: 169818 - DNA, 20 bp, Artificial Sequence
  chemically synthesized
agtcacttttacattgtata

SEQ ID NO: 169819 - DNA, 20 bp, Artificial Sequence
  chemically synthesized
taaatccatatacaatgtaa

SEQ ID NO: 169820 - DNA, 20 bp, Artificial Sequence
  chemically synthesized
tcataaaaatgatttgtaat

SEQ ID NO: 169821 - DNA, 20 bp, Artificial Sequence
  chemically synthesized
caaatcatttttatgacatt

SEQ ID NO: 169822 - DNA, 20 bp, Artificial Sequence
  chemically synthesized
tttttatgacattcagcccc

SEQ ID NO: 169823 - DNA, 20 bp, Artificial Sequence
  chemically synthesized
ttatgacattcagcccccag

SEQ ID NO: 169824 - DNA, 20 bp, Artificial Sequence
  chemically synthesized
tccgagagctatgccactgg

SEQ ID NO: 169825 - DNA, 20 bp, Artificial Sequence
  chemically synthesized
ttccgagagctatgccactg

SEQ ID NO: 169826 - DNA, 20 bp, Artificial Sequence
  chemically synthesized
acattcagcccccagtggca

SEQ ID NO: 169827 - DNA, 20 bp, Artificial Sequence
  chemically synthesized
attccgagagctatgccact

SEQ ID NO: 169828 - DNA, 20 bp, Artificial Sequence
  chemically synthesized
tattccgagagctatgccac

SEQ ID NO: 169829 - DNA, 20 bp, Artificial Sequence
  chemically synthesized
gcccccagtggcatagctct

SEQ ID NO: 169830 - DNA, 20 bp, Artificial Sequence
  chemically synthesized
cttttaaagtaatattccga

SEQ ID NO: 169831 - DNA, 20 bp, Artificial Sequence
  chemically synthesized
tacttttaaagtaatattcc

SEQ ID NO: 169832 - DNA, 20 bp, Artificial Sequence
  chemically synthesized
ctctcggaatattactttaa

SEQ ID NO: 169833 - DNA, 20 bp, Artificial Sequence
  chemically synthesized
cggaatattactttaaaagt

SEQ ID NO: 169834 - DNA, 20 bp, Artificial Sequence
  chemically synthesized
aggaaatccacttactttta

SEQ ID NO: 169835 - DNA, 20 bp, Artificial Sequence
  chemically synthesized
aatattactttaaaagtaag

SEQ ID NO: 169836 - DNA, 20 bp, Artificial Sequence
  chemically synthesized
gtaagtggatttccttttta

SEQ ID NO: 169837 - DNA, 20 bp, Artificial Sequence
  chemically synthesized
aaaatccacatgctttaaaa

SEQ ID NO: 169838 - DNA, 20 bp, Artificial Sequence
  chemically synthesized
taaaatccacatgctttaaa

SEQ ID NO: 169839 - DNA, 20 bp, Artificial Sequence
  chemically synthesized
gatttcctttttaaagcatg

SEQ ID NO: 169840 - DNA, 20 bp, Artificial Sequence
  chemically synthesized
tatagatgtataagcatcgt

SEQ ID NO: 169841 - DNA, 20 bp, Artificial Sequence
  chemically synthesized
tgtaggaaatatagatgtat

SEQ ID NO: 169842 - DNA, 20 bp, Artificial Sequence
  chemically synthesized
tggaaacaatgtaggaaata

SEQ ID NO: 169843 - DNA, 20 bp, Artificial Sequence
  chemically synthesized
cttaaaactggaaacaatgt

SEQ ID NO: 169844 - DNA, 20 bp, Artificial Sequence
  chemically synthesized
acttaaaactggaaacaatg

SEQ ID NO: 169845 - DNA, 20 bp, Artificial Sequence
  chemically synthesized
tatatttcctacattgtttc

SEQ ID NO: 169846 - DNA, 20 bp, Artificial Sequence
  chemically synthesized
cctacattgtttccagtttt

SEQ ID NO: 169847 - DNA, 20 bp, Artificial Sequence
  chemically synthesized
tgttatcagatacttaaaac

SEQ ID NO: 169848 - DNA, 20 bp, Artificial Sequence
  chemically synthesized
cagttttaagtatctgataa

SEQ ID NO: 169849 - DNA, 20 bp, Artificial Sequence
  chemically synthesized
acaggggacttcactgttat

SEQ ID NO: 169850 - DNA, 20 bp, Artificial Sequence
  chemically synthesized
ttaagtatctgataacagtg

SEQ ID NO: 169851 - DNA, 20 bp, Artificial Sequence
  chemically synthesized
tacactgtgatttgacacag

SEQ ID NO: 169852 - DNA, 20 bp, Artificial Sequence
  chemically synthesized
atacactgtgatttgacaca

SEQ ID NO: 169853 - DNA, 20 bp, Artificial Sequence
  chemically synthesized
catacactgtgatttgacac

SEQ ID NO: 169854 - DNA, 20 bp, Artificial Sequence
  chemically synthesized
acatacactgtgatttgaca

SEQ ID NO: 169855 - DNA, 20 bp, Artificial Sequence
  chemically synthesized
aagtcccctgtgtcaaatca

SEQ ID NO: 169856 - DNA, 20 bp, Artificial Sequence
  chemically synthesized
tgtcaaatcacagtgtatgt

SEQ ID NO: 169857 - DNA, 20 bp, Artificial Sequence
  chemically synthesized
atccatgtgtggtaatgaag

SEQ ID NO: 169858 - DNA, 20 bp, Artificial Sequence
  chemically synthesized
aaaatccatgtgtggtaatg

SEQ ID NO: 169859 - DNA, 20 bp, Artificial Sequence
  chemically synthesized
aaccacttcattaccacaca

SEQ ID NO: 169860 - DNA, 20 bp, Artificial Sequence
  chemically synthesized
aaaataacaaaatccatgtg

SEQ ID NO: 169861 - DNA, 20 bp, Artificial Sequence
  chemically synthesized
tggattttgttatttttctc

SEQ ID NO: 169862 - DNA, 20 bp, Artificial Sequence
  chemically synthesized
tattatatgtttgaggtctt

SEQ ID NO: 169863 - DNA, 20 bp, Artificial Sequence
  chemically synthesized
cgtaatgtattatatgtttg

SEQ ID NO: 169864 - DNA, 20 bp, Artificial Sequence
  chemically synthesized
tcgtaatgtattatatgttt

SEQ ID NO: 169865 - DNA, 20 bp, Artificial Sequence
  chemically synthesized
tcaaacatataatacattac

SEQ ID NO: 169866 - DNA, 20 bp, Artificial Sequence
  chemically synthesized
caaacatataatacattacg

SEQ ID NO: 169867 - DNA, 20 bp, Artificial Sequence
  chemically synthesized
acgaggtaaatgaacatttc

SEQ ID NO: 169868 - DNA, 20 bp, Artificial Sequence
  chemically synthesized
ggtaaatgaacatttctagc

SEQ ID NO: 169869 - DNA, 20 bp, Artificial Sequence
  chemically synthesized
tactgactttgaaatcttgc

SEQ ID NO: 169870 - DNA, 20 bp, Artificial Sequence
  chemically synthesized
acatttctagcaagatttca

SEQ ID NO: 169871 - DNA, 20 bp, Artificial Sequence
  chemically synthesized
ttctagcaagatttcaaagt

SEQ ID NO: 169872 - DNA, 20 bp, Artificial Sequence
  chemically synthesized
aaaatttgatgtacaataaa

SEQ ID NO: 169873 - DNA, 20 bp, Artificial Sequence
  chemically synthesized
aaatttgatgtacaataaat

SEQ ID NO: 169874 - DNA, 20 bp, Artificial Sequence
  chemically synthesized
ttgatgtacaataaataggt

SEQ ID NO: 169875 - DNA, 20 bp, Artificial Sequence
  chemically synthesized
atgtacaataaataggttgg

SEQ ID NO: 169876 - DNA, 20 bp, Artificial Sequence
  chemically synthesized
ataaataggttggcagtcct

SEQ ID NO: 169877 - DNA, 20 bp, Artificial Sequence
  chemically synthesized
aaataggttggcagtccttg

SEQ ID NO: 169878 - DNA, 20 bp, Artificial Sequence
  chemically synthesized
aataagggcagagttctcca

SEQ ID NO: 169879 - DNA, 20 bp, Artificial Sequence
  chemically synthesized
taataagggcagagttctcc

SEQ ID NO: 169880 - DNA, 20 bp, Artificial Sequence
  chemically synthesized
ttagtgtggtaataagggca

SEQ ID NO: 169881 - DNA, 20 bp, Artificial Sequence
  chemically synthesized
ttttagtgtggtaataaggg

SEQ ID NO: 169882 - DNA, 20 bp, Artificial Sequence
  chemically synthesized
tggttttagtgtggtaataa

SEQ ID NO: 169883 - DNA, 20 bp, Artificial Sequence
  chemically synthesized
atggttttagtgtggtaata

SEQ ID NO: 169884 - DNA, 20 bp, Artificial Sequence
  chemically synthesized
tatggttttagtgtggtaat

SEQ ID NO: 169885 - DNA, 20 bp, Artificial Sequence
  chemically synthesized
aagtcaatatggttttagtg

SEQ ID NO: 169886 - DNA, 20 bp, Artificial Sequence
  chemically synthesized
ctgaaaagtcaatatggttt

SEQ ID NO: 169887 - DNA, 20 bp, Artificial Sequence
  chemically synthesized
agtttactgaaaagtcaata

SEQ ID NO: 169888 - DNA, 20 bp, Artificial Sequence
  chemically synthesized
ctaaaaccatattgactttt

SEQ ID NO: 169889 - DNA, 20 bp, Artificial Sequence
  chemically synthesized
gaacaccaaagtttactgaa

SEQ ID NO: 169890 - DNA, 20 bp, Artificial Sequence
  chemically synthesized
attgacttttcagtaaactt

SEQ ID NO: 169891 - DNA, 20 bp, Artificial Sequence
  chemically synthesized
agtgctgctcatgaacacca

SEQ ID NO: 169892 - DNA, 20 bp, Artificial Sequence
  chemically synthesized
cagtaaactttggtgttcat

SEQ ID NO: 169893 - DNA, 20 bp, Artificial Sequence
  chemically synthesized
taaactttggtgttcatgag

SEQ ID NO: 169894 - DNA, 20 bp, Artificial Sequence
  chemically synthesized
acaaataaattaatgaataa

SEQ ID NO: 169895 - DNA, 20 bp, Artificial Sequence
  chemically synthesized
ttcattaatttatttgtttg

SEQ ID NO: 169896 - DNA, 20 bp, Artificial Sequence
  chemically synthesized
aatttatttgtttgcagtat

SEQ ID NO: 169897 - DNA, 20 bp, Artificial Sequence
  chemically synthesized
agtataagcatctaactcca

SEQ ID NO: 169898 - DNA, 20 bp, Artificial Sequence
  chemically synthesized
gtattctttgaccatggagt

SEQ ID NO: 169899 - DNA, 20 bp, Artificial Sequence
  chemically synthesized
ttaagtattctttgaccatg

SEQ ID NO: 169900 - DNA, 20 bp, Artificial Sequence
  chemically synthesized
agcatctaactccatggtca

SEQ ID NO: 169901 - DNA, 20 bp, Artificial Sequence
  chemically synthesized
tattaagtattctttgacca

SEQ ID NO: 169902 - DNA, 20 bp, Artificial Sequence
  chemically synthesized
atgtactcacgtatattatt

SEQ ID NO: 169903 - DNA, 20 bp, Artificial Sequence
  chemically synthesized
gaatacttaataatatacgt

SEQ ID NO: 169904 - DNA, 20 bp, Artificial Sequence
  chemically synthesized
taataatatacgtgagtaca

SEQ ID NO: 169905 - DNA, 20 bp, Artificial Sequence
  chemically synthesized
tttagatcaaggtgaacagt

SEQ ID NO: 169906 - DNA, 20 bp, Artificial Sequence
  chemically synthesized
taggtttagatcaaggtgaa

SEQ ID NO: 169907 - DNA, 20 bp, Artificial Sequence
  chemically synthesized
tttagggtaggtttagatca

SEQ ID NO: 169908 - DNA, 20 bp, Artificial Sequence
  chemically synthesized
ctttagggtaggtttagatc

SEQ ID NO: 169909 - DNA, 20 bp, Artificial Sequence
  chemically synthesized
acctaactttagggtaggtt

SEQ ID NO: 169910 - DNA, 20 bp, Artificial Sequence
  chemically synthesized
cttgatctaaacctacccta

SEQ ID NO: 169911 - DNA, 20 bp, Artificial Sequence
  chemically synthesized
ttgttacctaactttagggt

SEQ ID NO: 169912 - DNA, 20 bp, Artificial Sequence
  chemically synthesized
cttgttacctaactttaggg

SEQ ID NO: 169913 - DNA, 20 bp, Artificial Sequence
  chemically synthesized
atctaaacctaccctaaagt

SEQ ID NO: 169914 - DNA, 20 bp, Artificial Sequence
  chemically synthesized
tctaaacctaccctaaagtt

SEQ ID NO: 169915 - DNA, 20 bp, Artificial Sequence
  chemically synthesized
gggcttgttacctaacttta

SEQ ID NO: 169916 - DNA, 20 bp, Artificial Sequence
  chemically synthesized
agggcttgttacctaacttt

SEQ ID NO: 169917 - DNA, 20 bp, Artificial Sequence
  chemically synthesized
aagggcttgttacctaactt

SEQ ID NO: 169918 - DNA, 20 bp, Artificial Sequence
  chemically synthesized
ctaccctaaagttaggtaac

SEQ ID NO: 169919 - DNA, 20 bp, Artificial Sequence
  chemically synthesized
ttaggtaacaagccctttaa

SEQ ID NO: 169920 - DNA, 20 bp, Artificial Sequence
  chemically synthesized
tgcctccaggagccattaaa

SEQ ID NO: 169921 - DNA, 20 bp, Artificial Sequence
  chemically synthesized
atgcctccaggagccattaa

SEQ ID NO: 169922 - DNA, 20 bp, Artificial Sequence
  chemically synthesized
aatgcctccaggagccatta

SEQ ID NO: 169923 - DNA, 20 bp, Artificial Sequence
  chemically synthesized
acaagccctttaatggctcc

SEQ ID NO: 169924 - DNA, 20 bp, Artificial Sequence
  chemically synthesized
aagccctttaatggctcctg

SEQ ID NO: 169925 - DNA, 20 bp, Artificial Sequence
  chemically synthesized
agccctttaatggctcctgg

SEQ ID NO: 169926 - DNA, 20 bp, Artificial Sequence
  chemically synthesized
catttgtctaatgcctccag

SEQ ID NO: 169927 - DNA, 20 bp, Artificial Sequence
  chemically synthesized
ttcatttgtctaatgcctcc

SEQ ID NO: 169928 - DNA, 20 bp, Artificial Sequence
  chemically synthesized
ttaatggctcctggaggcat

SEQ ID NO: 169929 - DNA, 20 bp, Artificial Sequence
  chemically synthesized
cttcatttgtctaatgcctc

SEQ ID NO: 169930 - DNA, 20 bp, Artificial Sequence
  chemically synthesized
ctggaggcattagacaaatg

SEQ ID NO: 169931 - DNA, 20 bp, Artificial Sequence
  chemically synthesized
cattagacaaatgaagtgaa

SEQ ID NO: 169932 - DNA, 20 bp, Artificial Sequence
  chemically synthesized
attagacaaatgaagtgaat

SEQ ID NO: 169933 - DNA, 20 bp, Artificial Sequence
  chemically synthesized
ttttagaactattgaggttt

SEQ ID NO: 169934 - DNA, 20 bp, Artificial Sequence
  chemically synthesized
ttgatttgctcaaacctcaa

SEQ ID NO: 169935 - DNA, 20 bp, Artificial Sequence
  chemically synthesized
aatccattttagaactattg

SEQ ID NO: 169936 - DNA, 20 bp, Artificial Sequence
  chemically synthesized
aaatccattttagaactatt

SEQ ID NO: 169937 - DNA, 20 bp, Artificial Sequence
  chemically synthesized
aaacctcaatagttctaaaa

SEQ ID NO: 169938 - DNA, 20 bp, Artificial Sequence
  chemically synthesized
aatccctataaaatccattt

SEQ ID NO: 169939 - DNA, 20 bp, Artificial Sequence
  chemically synthesized
tagttctaaaatggatttta

SEQ ID NO: 169940 - DNA, 20 bp, Artificial Sequence
  chemically synthesized
agttctaaaatggattttat

SEQ ID NO: 169941 - DNA, 20 bp, Artificial Sequence
  chemically synthesized
gttctaaaatggattttata

SEQ ID NO: 169942 - DNA, 20 bp, Artificial Sequence
  chemically synthesized
gggtaggtggatagttagat

SEQ ID NO: 169943 - DNA, 20 bp, Artificial Sequence
  chemically synthesized
tgggtaggtggatagttaga

SEQ ID NO: 169944 - DNA, 20 bp, Artificial Sequence
  chemically synthesized
tttgtgggtaggtggatagt

SEQ ID NO: 169945 - DNA, 20 bp, Artificial Sequence
  chemically synthesized
agagtttgtgggtaggtgga

SEQ ID NO: 169946 - DNA, 20 bp, Artificial Sequence
  chemically synthesized
gtgaagagtttgtgggtagg

SEQ ID NO: 169947 - DNA, 20 bp, Artificial Sequence
  chemically synthesized
ttagtgaagagtttgtgggt

SEQ ID NO: 169948 - DNA, 20 bp, Artificial Sequence
  chemically synthesized
tttagtgaagagtttgtggg

SEQ ID NO: 169949 - DNA, 20 bp, Artificial Sequence
  chemically synthesized
ttatttagtgaagagtttgt

SEQ ID NO: 169950 - DNA, 20 bp, Artificial Sequence
  chemically synthesized
attatttagtgaagagtttg

SEQ ID NO: 169951 - DNA, 20 bp, Artificial Sequence
  chemically synthesized
aaatcacattatttagtgaa

SEQ ID NO: 169952 - DNA, 20 bp, Artificial Sequence
  chemically synthesized
caaaatcacattatttagtg

SEQ ID NO: 169953 - DNA, 20 bp, Artificial Sequence
  chemically synthesized
gtgaccaaaatcacattatt

SEQ ID NO: 169954 - DNA, 20 bp, Artificial Sequence
  chemically synthesized
ttcactaaataatgtgattt

SEQ ID NO: 169955 - DNA, 20 bp, Artificial Sequence
  chemically synthesized
tattgtcctcagggtttaaa

SEQ ID NO: 169956 - DNA, 20 bp, Artificial Sequence
  chemically synthesized
tcacatactgtttaaaccct

SEQ ID NO: 169957 - DNA, 20 bp, Artificial Sequence
  chemically synthesized
cacatactgtttaaaccctg

SEQ ID NO: 169958 - DNA, 20 bp, Artificial Sequence
  chemically synthesized
tttaaattttattgtcctca

SEQ ID NO: 169959 - DNA, 20 bp, Artificial Sequence
  chemically synthesized
ctttaaattttattgtcctc

SEQ ID NO: 169960 - DNA, 20 bp, Artificial Sequence
  chemically synthesized
tctttaaattttattgtcct

SEQ ID NO: 169961 - DNA, 20 bp, Artificial Sequence
  chemically synthesized
cctgaggacaataaaattta

SEQ ID NO: 169962 - DNA, 20 bp, Artificial Sequence
  chemically synthesized
gaggacaataaaatttaaag

SEQ ID NO: 169963 - DNA, 20 bp, Artificial Sequence
  chemically synthesized
gagagagagagacagagaga

SEQ ID NO: 169964 - DNA, 20 bp, Artificial Sequence
  chemically synthesized
gagagagagagagacagaga

SEQ ID NO: 169965 - DNA, 20 bp, Artificial Sequence
  chemically synthesized
gagagagagagagagacaga

SEQ ID NO: 169966 - DNA, 20 bp, Artificial Sequence
  chemically synthesized
gagagagagagagagagaca

SEQ ID NO: 169967 - DNA, 20 bp, Artificial Sequence
  chemically synthesized
gagagagagagagagagaga

SEQ ID NO: 169968 - DNA, 20 bp, Artificial Sequence
  chemically synthesized
gagagagagagagagagaga

SEQ ID NO: 169969 - DNA, 20 bp, Artificial Sequence
  chemically synthesized
gagagagagagagagagaga

SEQ ID NO: 169970 - DNA, 20 bp, Artificial Sequence
  chemically synthesized
gagagagagagagagagaga

SEQ ID NO: 169971 - DNA, 20 bp, Artificial Sequence
  chemically synthesized
gtgagagagagagagagaga

SEQ ID NO: 169972 - DNA, 20 bp, Artificial Sequence
  chemically synthesized
gtgtgagagagagagagaga

SEQ ID NO: 169973 - DNA, 20 bp, Artificial Sequence
  chemically synthesized
gtgtgtgagagagagagaga

SEQ ID NO: 169974 - DNA, 20 bp, Artificial Sequence
  chemically synthesized
gtgtgtgtgagagagagaga

SEQ ID NO: 169975 - DNA, 20 bp, Artificial Sequence
  chemically synthesized
gtgtgtgtgtgagagagaga

SEQ ID NO: 169976 - DNA, 20 bp, Artificial Sequence
  chemically synthesized
gtgtgtgtgtgtgagagaga

SEQ ID NO: 169977 - DNA, 20 bp, Artificial Sequence
  chemically synthesized
gtgtgtgtgtgtgtgagaga

SEQ ID NO: 169978 - DNA, 20 bp, Artificial Sequence
  chemically synthesized
gtgtgtgtgtgtgtgtgaga

SEQ ID NO: 169979 - DNA, 20 bp, Artificial Sequence
  chemically synthesized
gtgtgtgtgtgtgtgtgtga

SEQ ID NO: 169980 - DNA, 20 bp, Artificial Sequence
  chemically synthesized
gtgtgtgtgtgtgtgtgtgt

SEQ ID NO: 169981 - DNA, 20 bp, Artificial Sequence
  chemically synthesized
acacacacacacgcacacca

SEQ ID NO: 169982 - DNA, 20 bp, Artificial Sequence
  chemically synthesized
atttgtaacaacacattctg

SEQ ID NO: 169983 - DNA, 20 bp, Artificial Sequence
  chemically synthesized
gagagagggagaaaaatacg

SEQ ID NO: 169984 - DNA, 20 bp, Artificial Sequence
  chemically synthesized
ggagagagggagaaaaatac

SEQ ID NO: 169985 - DNA, 20 bp, Artificial Sequence
  chemically synthesized
gggagagagggagaaaaata

SEQ ID NO: 169986 - DNA, 20 bp, Artificial Sequence
  chemically synthesized
ctgggagggagggagagagg

SEQ ID NO: 169987 - DNA, 20 bp, Artificial Sequence
  chemically synthesized
ggctgggagggagggagaga

SEQ ID NO: 169988 - DNA, 20 bp, Artificial Sequence
  chemically synthesized
cggctgggagggagggagag

SEQ ID NO: 169989 - DNA, 20 bp, Artificial Sequence
  chemically synthesized
acggctgggagggagggaga

SEQ ID NO: 169990 - DNA, 20 bp, Artificial Sequence
  chemically synthesized
gtacggctgggagggaggga

SEQ ID NO: 169991 - DNA, 20 bp, Artificial Sequence
  chemically synthesized
gagtacggctgggagggagg

SEQ ID NO: 169992 - DNA, 20 bp, Artificial Sequence
  chemically synthesized
ctccctctctccctccctcc

SEQ ID NO: 169993 - DNA, 20 bp, Artificial Sequence
  chemically synthesized
tagagtacggctgggaggga

SEQ ID NO: 169994 - DNA, 20 bp, Artificial Sequence
  chemically synthesized
ttagagtacggctgggaggg

SEQ ID NO: 169995 - DNA, 20 bp, Artificial Sequence
  chemically synthesized
tttagagtacggctgggagg

SEQ ID NO: 169996 - DNA, 20 bp, Artificial Sequence
  chemically synthesized
tgtttagagtacggctggga

SEQ ID NO: 169997 - DNA, 20 bp, Artificial Sequence
  chemically synthesized
ttgtttagagtacggctggg

SEQ ID NO: 169998 - DNA, 20 bp, Artificial Sequence
  chemically synthesized
tttgtttagagtacggctgg

SEQ ID NO: 169999 - DNA, 20 bp, Artificial Sequence
  chemically synthesized
cctttgtttagagtacggct

SEQ ID NO: 170000 - DNA, 20 bp, Artificial Sequence
  chemically synthesized
gcctttgtttagagtacggc

SEQ ID NO: 170001 - DNA, 20 bp, Artificial Sequence
  chemically synthesized
tagagcctttgtttagagta

SEQ ID NO: 170002 - DNA, 20 bp, Artificial Sequence
  chemically synthesized
tcccagccgtactctaaaca

SEQ ID NO: 170003 - DNA, 20 bp, Artificial Sequence
  chemically synthesized
cccagccgtactctaaacaa

SEQ ID NO: 170004 - DNA, 20 bp, Artificial Sequence
  chemically synthesized
ctttgtagagcctttgttta

SEQ ID NO: 170005 - DNA, 20 bp, Artificial Sequence
  chemically synthesized
tactttgtagagcctttgtt

SEQ ID NO: 170006 - DNA, 20 bp, Artificial Sequence
  chemically synthesized
ctctaaacaaaggctctaca

SEQ ID NO: 170007 - DNA, 20 bp, Artificial Sequence
  chemically synthesized
taaacaaaggctctacaaag

SEQ ID NO: 170008 - DNA, 20 bp, Artificial Sequence
  chemically synthesized
ttgtttagtgctactttgta

SEQ ID NO: 170009 - DNA, 20 bp, Artificial Sequence
  chemically synthesized
ccttgtttagtgctactttg

SEQ ID NO: 170010 - DNA, 20 bp, Artificial Sequence
  chemically synthesized
tctacaaagtagcactaaac

SEQ ID NO: 170011 - DNA, 20 bp, Artificial Sequence
  chemically synthesized
ctacaaagtagcactaaaca

SEQ ID NO: 170012 - DNA, 20 bp, Artificial Sequence
  chemically synthesized
tacaaagtagcactaaacaa

SEQ ID NO: 170013 - DNA, 20 bp, Artificial Sequence
  chemically synthesized
ggaataaagtagcccttgtt

SEQ ID NO: 170014 - DNA, 20 bp, Artificial Sequence
  chemically synthesized
tggagagtgtgggaataaag

SEQ ID NO: 170015 - DNA, 20 bp, Artificial Sequence
  chemically synthesized
gattggagagtgtgggaata

SEQ ID NO: 170016 - DNA, 20 bp, Artificial Sequence
  chemically synthesized
gatttctgattggagagtgt

SEQ ID NO: 170017 - DNA, 20 bp, Artificial Sequence
  chemically synthesized
agatttctgattggagagtg

SEQ ID NO: 170018 - DNA, 20 bp, Artificial Sequence
  chemically synthesized
ttattcccacactctccaat

SEQ ID NO: 170019 - DNA, 20 bp, Artificial Sequence
  chemically synthesized
atcaaagatttctgattgga

SEQ ID NO: 170020 - DNA, 20 bp, Artificial Sequence
  chemically synthesized
agatcaaagatttctgattg

SEQ ID NO: 170021 - DNA, 20 bp, Artificial Sequence
  chemically synthesized
taagatcaaagatttctgat

SEQ ID NO: 170022 - DNA, 20 bp, Artificial Sequence
  chemically synthesized
ccttcaagcaaataagatca

SEQ ID NO: 170023 - DNA, 20 bp, Artificial Sequence
  chemically synthesized
ctaaggtccttcaagcaaat

SEQ ID NO: 170024 - DNA, 20 bp, Artificial Sequence
  chemically synthesized
tctttgatcttatttgcttg

SEQ ID NO: 170025 - DNA, 20 bp, Artificial Sequence
  chemically synthesized
ctttgatcttatttgcttga

SEQ ID NO: 170026 - DNA, 20 bp, Artificial Sequence
  chemically synthesized
ggctgatgctaaggtccttc

SEQ ID NO: 170027 - DNA, 20 bp, Artificial Sequence
  chemically synthesized
cttatttgcttgaaggacct

SEQ ID NO: 170028 - DNA, 20 bp, Artificial Sequence
  chemically synthesized
tgcttgaaggaccttagcat

SEQ ID NO: 170029 - DNA, 20 bp, Artificial Sequence
  chemically synthesized
tatcagccaggctgatgcta

SEQ ID NO: 170030 - DNA, 20 bp, Artificial Sequence
  chemically synthesized
gtatcagccaggctgatgct

SEQ ID NO: 170031 - DNA, 20 bp, Artificial Sequence
  chemically synthesized
gaaggaccttagcatcagcc

SEQ ID NO: 170032 - DNA, 20 bp, Artificial Sequence
  chemically synthesized
gacatttttctgtatcagcc

SEQ ID NO: 170033 - DNA, 20 bp, Artificial Sequence
  chemically synthesized
tagcatcagcctggctgata

SEQ ID NO: 170034 - DNA, 20 bp, Artificial Sequence
  chemically synthesized
ggacatttttctgtatcagc

SEQ ID NO: 170035 - DNA, 20 bp, Artificial Sequence
  chemically synthesized
caagggacatttttctgtat

SEQ ID NO: 170036 - DNA, 20 bp, Artificial Sequence
  chemically synthesized
tgatacagaaaaatgtccct

SEQ ID NO: 170037 - DNA, 20 bp, Artificial Sequence
  chemically synthesized
gatatttcctacgaatccaa

SEQ ID NO: 170038 - DNA, 20 bp, Artificial Sequence
  chemically synthesized
tgatatttcctacgaatcca

SEQ ID NO: 170039 - DNA, 20 bp, Artificial Sequence
  chemically synthesized
aaaaatgtcccttggattcg

SEQ ID NO: 170040 - DNA, 20 bp, Artificial Sequence
  chemically synthesized
atgatatttcctacgaatcc

SEQ ID NO: 170041 - DNA, 20 bp, Artificial Sequence
  chemically synthesized
aaaatgtcccttggattcgt

SEQ ID NO: 170042 - DNA, 20 bp, Artificial Sequence
  chemically synthesized
atcaaacaaatgaacaaaat

SEQ ID NO: 170043 - DNA, 20 bp, Artificial Sequence
  chemically synthesized
catttgtttgataaaaattc

SEQ ID NO: 170044 - DNA, 20 bp, Artificial Sequence
  chemically synthesized
atttgtttgataaaaattca

SEQ ID NO: 170045 - DNA, 20 bp, Artificial Sequence
  chemically synthesized
ataaaaattcaaggaaaact

SEQ ID NO: 170046 - DNA, 20 bp, Artificial Sequence
  chemically synthesized
aaactgtacagatcatgact

SEQ ID NO: 170047 - DNA, 20 bp, Artificial Sequence
  chemically synthesized
aaactaagtcatgatctgta

SEQ ID NO: 170048 - DNA, 20 bp, Artificial Sequence
  chemically synthesized
gttgcttgggtaaaactgta

SEQ ID NO: 170049 - DNA, 20 bp, Artificial Sequence
  chemically synthesized
tgatctgtacagttttaccc

SEQ ID NO: 170050 - DNA, 20 bp, Artificial Sequence
  chemically synthesized
tacagttttacccaagcaac

SEQ ID NO: 170051 - DNA, 20 bp, Artificial Sequence
  chemically synthesized
tgttatggttcttgttgctt

SEQ ID NO: 170052 - DNA, 20 bp, Artificial Sequence
  chemically synthesized
ttgttatggttcttgttgct

SEQ ID NO: 170053 - DNA, 20 bp, Artificial Sequence
  chemically synthesized
caagttattgttatttgtta

SEQ ID NO: 170054 - DNA, 20 bp, Artificial Sequence
  chemically synthesized
tcagggcctaaataaatatc

SEQ ID NO: 170055 - DNA, 20 bp, Artificial Sequence
  chemically synthesized
acaataacttgatatttatt

SEQ ID NO: 170056 - DNA, 20 bp, Artificial Sequence
  chemically synthesized
caataacttgatatttattt

SEQ ID NO: 170057 - DNA, 20 bp, Artificial Sequence
  chemically synthesized
ttgatatttatttaggccct

SEQ ID NO: 170058 - DNA, 20 bp, Artificial Sequence
  chemically synthesized
tgatatttatttaggccctg

SEQ ID NO: 170059 - DNA, 20 bp, Artificial Sequence
  chemically synthesized
aaattttaacagacacctca

SEQ ID NO: 170060 - DNA, 20 bp, Artificial Sequence
  chemically synthesized
caaattttaacagacacctc

SEQ ID NO: 170061 - DNA, 20 bp, Artificial Sequence
  chemically synthesized
ccaaattttaacagacacct

SEQ ID NO: 170062 - DNA, 20 bp, Artificial Sequence
  chemically synthesized
attaagaaaccaaattttaa

SEQ ID NO: 170063 - DNA, 20 bp, Artificial Sequence
  chemically synthesized
ctgaggtgtctgttaaaatt

SEQ ID NO: 170064 - DNA, 20 bp, Artificial Sequence
  chemically synthesized
gttaaaatttggtttcttaa

SEQ ID NO: 170065 - DNA, 20 bp, Artificial Sequence
  chemically synthesized
ttttttttttaaattctatt

SEQ ID NO: 170066 - DNA, 20 bp, Artificial Sequence
  chemically synthesized
tagaatttaaaaaaaaaaaa

SEQ ID NO: 170067 - DNA, 20 bp, Artificial Sequence
  chemically synthesized
tatataaaagtaaaaagaag

SEQ ID NO: 170068 - DNA, 20 bp, Artificial Sequence
  chemically synthesized
tttatataaaagtaaaaaga

SEQ ID NO: 170069 - DNA, 20 bp, Artificial Sequence
  chemically synthesized
atttatataaaagtaaaaag

SEQ ID NO: 170070 - DNA, 20 bp, Artificial Sequence
  chemically synthesized
gtgatttatataaaagtaaa

SEQ ID NO: 170071 - DNA, 20 bp, Artificial Sequence
  chemically synthesized
aagtacagtgatttatataa

SEQ ID NO: 170072 - DNA, 20 bp, Artificial Sequence
  chemically synthesized
ttatataaatcactgtactt

SEQ ID NO: 170073 - DNA, 20 bp, Artificial Sequence
  chemically synthesized
gaaatccatattctgaagta

SEQ ID NO: 170074 - DNA, 20 bp, Artificial Sequence
  chemically synthesized
aatcactgtacttcagaata

SEQ ID NO: 170075 - DNA, 20 bp, Artificial Sequence
  chemically synthesized
cccctgaaatccatattctg

SEQ ID NO: 170076 - DNA, 20 bp, Artificial Sequence
  chemically synthesized
gtacttcagaatatggattt

SEQ ID NO: 170077 - DNA, 20 bp, Artificial Sequence
  chemically synthesized
tacttcagaatatggatttc

SEQ ID NO: 170078 - DNA, 20 bp, Artificial Sequence
  chemically synthesized
acttcagaatatggatttca

SEQ ID NO: 170079 - DNA, 20 bp, Artificial Sequence
  chemically synthesized
cttcagaatatggatttcag

SEQ ID NO: 170080 - DNA, 20 bp, Artificial Sequence
  chemically synthesized
ttcagaatatggatttcagg

SEQ ID NO: 170081 - DNA, 20 bp, Artificial Sequence
  chemically synthesized
tcagaatatggatttcaggg

SEQ ID NO: 170082 - DNA, 20 bp, Artificial Sequence
  chemically synthesized
cagaatatggatttcagggg

SEQ ID NO: 170083 - DNA, 20 bp, Artificial Sequence
  chemically synthesized
atatggatttcaggggggga

SEQ ID NO: 170084 - DNA, 20 bp, Artificial Sequence
  chemically synthesized
ggatttcagggggggaaaga

SEQ ID NO: 170085 - DNA, 20 bp, Artificial Sequence
  chemically synthesized
gatttcagggggggaaagaa

SEQ ID NO: 170086 - DNA, 20 bp, Artificial Sequence
  chemically synthesized
atttcagggggggaaagaaa

SEQ ID NO: 170087 - DNA, 20 bp, Artificial Sequence
  chemically synthesized
ggatacgtgattatgtggtg

SEQ ID NO: 170088 - DNA, 20 bp, Artificial Sequence
  chemically synthesized
tttgaggatacgtgattatg

SEQ ID NO: 170089 - DNA, 20 bp, Artificial Sequence
  chemically synthesized
taatcacgtatcctcaaatt

SEQ ID NO: 170090 - DNA, 20 bp, Artificial Sequence
  chemically synthesized
aaatgaaacttctgaatttg

SEQ ID NO: 170091 - DNA, 20 bp, Artificial Sequence
  chemically synthesized
taaatgaaacttctgaattt

SEQ ID NO: 170092 - DNA, 20 bp, Artificial Sequence
  chemically synthesized
tcacgtatcctcaaattcag

SEQ ID NO: 170093 - DNA, 20 bp, Artificial Sequence
  chemically synthesized
caaattcagaagtttcattt

SEQ ID NO: 170094 - DNA, 20 bp, Artificial Sequence
  chemically synthesized
gtttcatttaagaaacaatt

SEQ ID NO: 170095 - DNA, 20 bp, Artificial Sequence
  chemically synthesized
catttaagaaacaatttagc

SEQ ID NO: 170096 - DNA, 20 bp, Artificial Sequence
  chemically synthesized
atttaagaaacaatttagct

SEQ ID NO: 170097 - DNA, 20 bp, Artificial Sequence
  chemically synthesized
tttaagaaacaatttagctg

SEQ ID NO: 170098 - DNA, 20 bp, Artificial Sequence
  chemically synthesized
agaaacaatttagctgggga

SEQ ID NO: 170099 - DNA, 20 bp, Artificial Sequence
  chemically synthesized
aacaatttagctggggatgg

SEQ ID NO: 170100 - DNA, 20 bp, Artificial Sequence
  chemically synthesized
taggcaggcaccaccatccc

SEQ ID NO: 170101 - DNA, 20 bp, Artificial Sequence
  chemically synthesized
aaagtgctaggattataggc

SEQ ID NO: 170102 - DNA, 20 bp, Artificial Sequence
  chemically synthesized
caaagtgctaggattatagg

SEQ ID NO: 170103 - DNA, 20 bp, Artificial Sequence
  chemically synthesized
gtggtgcctgcctataatcc

SEQ ID NO: 170104 - DNA, 20 bp, Artificial Sequence
  chemically synthesized
tcccaaagtgctaggattat

SEQ ID NO: 170105 - DNA, 20 bp, Artificial Sequence
  chemically synthesized
ctcccaaagtgctaggatta

SEQ ID NO: 170106 - DNA, 20 bp, Artificial Sequence
  chemically synthesized
tgcctataatcctagcactt

SEQ ID NO: 170107 - DNA, 20 bp, Artificial Sequence
  chemically synthesized
cctcggcctcccaaagtgct

SEQ ID NO: 170108 - DNA, 20 bp, Artificial Sequence
  chemically synthesized
gcctataatcctagcacttt

SEQ ID NO: 170109 - DNA, 20 bp, Artificial Sequence
  chemically synthesized
tcctcggcctcccaaagtgc

SEQ ID NO: 170110 - DNA, 20 bp, Artificial Sequence
  chemically synthesized
ctataatcctagcactttgg

SEQ ID NO: 170111 - DNA, 20 bp, Artificial Sequence
  chemically synthesized
tataatcctagcactttggg

SEQ ID NO: 170112 - DNA, 20 bp, Artificial Sequence
  chemically synthesized
cctccttcctcggcctccca

SEQ ID NO: 170113 - DNA, 20 bp, Artificial Sequence
  chemically synthesized
tcctagcactttgggaggcc

SEQ ID NO: 170114 - DNA, 20 bp, Artificial Sequence
  chemically synthesized
cctagcactttgggaggccg

SEQ ID NO: 170115 - DNA, 20 bp, Artificial Sequence
  chemically synthesized
agcactttgggaggccgagg

SEQ ID NO: 170116 - DNA, 20 bp, Artificial Sequence
  chemically synthesized
gcactttgggaggccgagga

SEQ ID NO: 170117 - DNA, 20 bp, Artificial Sequence
  chemically synthesized
actttgggaggccgaggaag

SEQ ID NO: 170118 - DNA, 20 bp, Artificial Sequence
  chemically synthesized
ctttgggaggccgaggaagg

SEQ ID NO: 170119 - DNA, 20 bp, Artificial Sequence
  chemically synthesized
ctcaagcagtcctccttcct

SEQ ID NO: 170120 - DNA, 20 bp, Artificial Sequence
  chemically synthesized
ccgaggaaggaggactgctt

SEQ ID NO: 170121 - DNA, 20 bp, Artificial Sequence
  chemically synthesized
atccaactcctgggctcaag

SEQ ID NO: 170122 - DNA, 20 bp, Artificial Sequence
  chemically synthesized
gaaggaggactgcttgagcc

SEQ ID NO: 170123 - DNA, 20 bp, Artificial Sequence
  chemically synthesized
aaggaggactgcttgagccc

SEQ ID NO: 170124 - DNA, 20 bp, Artificial Sequence
  chemically synthesized
ggtatccaactcctgggctc

SEQ ID NO: 170125 - DNA, 20 bp, Artificial Sequence
  chemically synthesized
ggaggactgcttgagcccag

SEQ ID NO: 170126 - DNA, 20 bp, Artificial Sequence
  chemically synthesized
gactgcttgagcccaggagt

SEQ ID NO: 170127 - DNA, 20 bp, Artificial Sequence
  chemically synthesized
caggctggtatccaactcct

SEQ ID NO: 170128 - DNA, 20 bp, Artificial Sequence
  chemically synthesized
ccaggctggtatccaactcc

SEQ ID NO: 170129 - DNA, 20 bp, Artificial Sequence
  chemically synthesized
tgagcccaggagttggatac

SEQ ID NO: 170130 - DNA, 20 bp, Artificial Sequence
  chemically synthesized
ccaggagttggataccagcc

SEQ ID NO: 170131 - DNA, 20 bp, Artificial Sequence
  chemically synthesized
caggagttggataccagcct

SEQ ID NO: 170132 - DNA, 20 bp, Artificial Sequence
  chemically synthesized
ggagttggataccagcctgg

SEQ ID NO: 170133 - DNA, 20 bp, Artificial Sequence
  chemically synthesized
gagttggataccagcctggg

SEQ ID NO: 170134 - DNA, 20 bp, Artificial Sequence
  chemically synthesized
cactatgttgcctcccaggc

SEQ ID NO: 170135 - DNA, 20 bp, Artificial Sequence
  chemically synthesized
atctcactatgttgcctccc

SEQ ID NO: 170136 - DNA, 20 bp, Artificial Sequence
  chemically synthesized
aatctcactatgttgcctcc

SEQ ID NO: 170137 - DNA, 20 bp, Artificial Sequence
  chemically synthesized
taccagcctgggaggcaaca

SEQ ID NO: 170138 - DNA, 20 bp, Artificial Sequence
  chemically synthesized
agcctgggaggcaacatagt

SEQ ID NO: 170139 - DNA, 20 bp, Artificial Sequence
  chemically synthesized
aaaaacaaaacaaaaaaaaa

SEQ ID NO: 170140 - DNA, 20 bp, Artificial Sequence
  chemically synthesized
aacaaaacaaaaaaaaaaag

SEQ ID NO: 170141 - DNA, 20 bp, Artificial Sequence
  chemically synthesized
aaaacaaaaaaaaaaagaag

SEQ ID NO: 170142 - DNA, 20 bp, Artificial Sequence
  chemically synthesized
caaaaaaaaaaagaagaaga

SEQ ID NO: 170143 - DNA, 20 bp, Artificial Sequence
  chemically synthesized
aaaaaaaagaagaagaaaga

SEQ ID NO: 170144 - DNA, 20 bp, Artificial Sequence
  chemically synthesized
aaaagaagaagaaagaaaga

SEQ ID NO: 170145 - DNA, 20 bp, Artificial Sequence
  chemically synthesized
gaagaaagaaagaaagaaaa

SEQ ID NO: 170146 - DNA, 20 bp, Artificial Sequence
  chemically synthesized
agaaagaaaaaagaaaaaca

SEQ ID NO: 170147 - DNA, 20 bp, Artificial Sequence
  chemically synthesized
gtttaatacatttaaattta

SEQ ID NO: 170148 - DNA, 20 bp, Artificial Sequence
  chemically synthesized
ctgatatttaaattgtattt

SEQ ID NO: 170149 - DNA, 20 bp, Artificial Sequence
  chemically synthesized
cttaaatacaatttaaatat

SEQ ID NO: 170150 - DNA, 20 bp, Artificial Sequence
  chemically synthesized
caatttaaatatcagttcct

SEQ ID NO: 170151 - DNA, 20 bp, Artificial Sequence
  chemically synthesized
aaatgtggtaagtgcaacta

SEQ ID NO: 170152 - DNA, 20 bp, Artificial Sequence
  chemically synthesized
gaaatgtggtaagtgcaact

SEQ ID NO: 170153 - DNA, 20 bp, Artificial Sequence
  chemically synthesized
ttgagcattggaaatgtggt

SEQ ID NO: 170154 - DNA, 20 bp, Artificial Sequence
  chemically synthesized
ggttttgagcattggaaatg

SEQ ID NO: 170155 - DNA, 20 bp, Artificial Sequence
  chemically synthesized
acaatgtgggttttgagcat

SEQ ID NO: 170156 - DNA, 20 bp, Artificial Sequence
  chemically synthesized
tctaatacaatgtgggtttt

SEQ ID NO: 170157 - DNA, 20 bp, Artificial Sequence
  chemically synthesized
tgccctgtctaatacaatgt

SEQ ID NO: 170158 - DNA, 20 bp, Artificial Sequence
  chemically synthesized
ctgccctgtctaatacaatg

SEQ ID NO: 170159 - DNA, 20 bp, Artificial Sequence
  chemically synthesized
gctcaaaacccacattgtat

SEQ ID NO: 170160 - DNA, 20 bp, Artificial Sequence
  chemically synthesized
aaaacccacattgtattaga

SEQ ID NO: 170161 - DNA, 20 bp, Artificial Sequence
  chemically synthesized
aaacccacattgtattagac

SEQ ID NO: 170162 - DNA, 20 bp, Artificial Sequence
  chemically synthesized
aacccacattgtattagaca

SEQ ID NO: 170163 - DNA, 20 bp, Artificial Sequence
  chemically synthesized
ccacattgtattagacaggg

SEQ ID NO: 170164 - DNA, 20 bp, Artificial Sequence
  chemically synthesized
acattgtattagacagggca

SEQ ID NO: 170165 - DNA, 20 bp, Artificial Sequence
  chemically synthesized
tgtattagacagggcagaga

SEQ ID NO: 170166 - DNA, 20 bp, Artificial Sequence
  chemically synthesized
taacttttttataatgagta

SEQ ID NO: 170167 - DNA, 20 bp, Artificial Sequence
  chemically synthesized
caagataacttttttataat

SEQ ID NO: 170168 - DNA, 20 bp, Artificial Sequence
  chemically synthesized
agaccatactcattataaaa

SEQ ID NO: 170169 - DNA, 20 bp, Artificial Sequence
  chemically synthesized
tataaaaaagttatcttgaa

SEQ ID NO: 170170 - DNA, 20 bp, Artificial Sequence
  chemically synthesized
tacggcttgtaacactgttc

SEQ ID NO: 170171 - DNA, 20 bp, Artificial Sequence
  chemically synthesized
gttatcttgaacagtgttac

SEQ ID NO: 170172 - DNA, 20 bp, Artificial Sequence
  chemically synthesized
cataagcaaatagtgtagta

SEQ ID NO: 170173 - DNA, 20 bp, Artificial Sequence
  chemically synthesized
agatgcataagcaaatagtg

SEQ ID NO: 170174 - DNA, 20 bp, Artificial Sequence
  chemically synthesized
tttttagatgcataagcaaa

SEQ ID NO: 170175 - DNA, 20 bp, Artificial Sequence
  chemically synthesized
ggcaagttttttagatgcat

SEQ ID NO: 170176 - DNA, 20 bp, Artificial Sequence
  chemically synthesized
atgaagattggcaagttttt

SEQ ID NO: 170177 - DNA, 20 bp, Artificial Sequence
  chemically synthesized
aaaaaatcatgaagattggc

SEQ ID NO: 170178 - DNA, 20 bp, Artificial Sequence
  chemically synthesized
tttcaaaaaatcatgaagat

SEQ ID NO: 170179 - DNA, 20 bp, Artificial Sequence
  chemically synthesized
tacgctttcaaaaaatcatg

SEQ ID NO: 170180 - DNA, 20 bp, Artificial Sequence
  chemically synthesized
caatcttcatgattttttga

SEQ ID NO: 170181 - DNA, 20 bp, Artificial Sequence
  chemically synthesized
tttttgaaagcgtaacattt

SEQ ID NO: 170182 - DNA, 20 bp, Artificial Sequence
  chemically synthesized
gtaacattttagaaaataat

SEQ ID NO: 170183 - DNA, 20 bp, Artificial Sequence
  chemically synthesized
acattttagaaaataatcag

SEQ ID NO: 170184 - DNA, 20 bp, Artificial Sequence
  chemically synthesized
aaatatatataccaatttga

SEQ ID NO: 170185 - DNA, 20 bp, Artificial Sequence
  chemically synthesized
tattattgaaactatcaaat

SEQ ID NO: 170186 - DNA, 20 bp, Artificial Sequence
  chemically synthesized
aaattaaaaccagcaattca

SEQ ID NO: 170187 - DNA, 20 bp, Artificial Sequence
  chemically synthesized
ataatatgaccatgaattgc

SEQ ID NO: 170188 - DNA, 20 bp, Artificial Sequence
  chemically synthesized
gaaaatattgaaattaaaac

SEQ ID NO: 170189 - DNA, 20 bp, Artificial Sequence
  chemically synthesized
taatttcaatattttctgtc

SEQ ID NO: 170190 - DNA, 20 bp, Artificial Sequence
  chemically synthesized
ttcaatattttctgtctaga

SEQ ID NO: 170191 - DNA, 20 bp, Artificial Sequence
  chemically synthesized
agaaaaacaagctttctaga

SEQ ID NO: 170192 - DNA, 20 bp, Artificial Sequence
  chemically synthesized
ttggagaaaaacaagctttc

SEQ ID NO: 170193 - DNA, 20 bp, Artificial Sequence
  chemically synthesized
aatgagttttggagaaaaac

SEQ ID NO: 170194 - DNA, 20 bp, Artificial Sequence
  chemically synthesized
tttttagagaatgagttttg

SEQ ID NO: 170195 - DNA, 20 bp, Artificial Sequence
  chemically synthesized
gttttttagagaatgagttt

SEQ ID NO: 170196 - DNA, 20 bp, Artificial Sequence
  chemically synthesized
tgttttgttttttagagaat

SEQ ID NO: 170197 - DNA, 20 bp, Artificial Sequence
  chemically synthesized
ttgttttgttttgtttttta

SEQ ID NO: 170198 - DNA, 20 bp, Artificial Sequence
  chemically synthesized
ttttgttttgttttgttttt

SEQ ID NO: 170199 - DNA, 20 bp, Artificial Sequence
  chemically synthesized
aaaacaaaacaaaacaaaaa

SEQ ID NO: 170200 - DNA, 20 bp, Artificial Sequence
  chemically synthesized
aggatttcttttcagtgtgg

SEQ ID NO: 170201 - DNA, 20 bp, Artificial Sequence
  chemically synthesized
tagaaaaccaccacactgaa

SEQ ID NO: 170202 - DNA, 20 bp, Artificial Sequence
  chemically synthesized
aataggatttcttttcagtg

SEQ ID NO: 170203 - DNA, 20 bp, Artificial Sequence
  chemically synthesized
aaaggaataggatttctttt

SEQ ID NO: 170204 - DNA, 20 bp, Artificial Sequence
  chemically synthesized
tcagatgaaggcaaaggaat

SEQ ID NO: 170205 - DNA, 20 bp, Artificial Sequence
  chemically synthesized
ttcagatgaaggcaaaggaa

SEQ ID NO: 170206 - DNA, 20 bp, Artificial Sequence
  chemically synthesized
ttccattcagatgaaggcaa

SEQ ID NO: 170207 - DNA, 20 bp, Artificial Sequence
  chemically synthesized
attccattcagatgaaggca

SEQ ID NO: 170208 - DNA, 20 bp, Artificial Sequence
  chemically synthesized
aaatgattccattcagatga

SEQ ID NO: 170209 - DNA, 20 bp, Artificial Sequence
  chemically synthesized
aaaatgattccattcagatg

SEQ ID NO: 170210 - DNA, 20 bp, Artificial Sequence
  chemically synthesized
ttcctttgccttcatctgaa

SEQ ID NO: 170211 - DNA, 20 bp, Artificial Sequence
  chemically synthesized
gacaataaaatgattccatt

SEQ ID NO: 170212 - DNA, 20 bp, Artificial Sequence
  chemically synthesized
aaaaaaaattttctatcaaa

SEQ ID NO: 170213 - DNA, 20 bp, Artificial Sequence
  chemically synthesized
atgtaggtcatgccatttga

SEQ ID NO: 170214 - DNA, 20 bp, Artificial Sequence
  chemically synthesized
aagataaatgtgagttatgt

SEQ ID NO: 170215 - DNA, 20 bp, Artificial Sequence
  chemically synthesized
aaagataaatgtgagttatg

SEQ ID NO: 170216 - DNA, 20 bp, Artificial Sequence
  chemically synthesized
cacatagaaaagataaatgt

SEQ ID NO: 170217 - DNA, 20 bp, Artificial Sequence
  chemically synthesized
tatgaatattacacatagaa

SEQ ID NO: 170218 - DNA, 20 bp, Artificial Sequence
  chemically synthesized
aacaatatgaatattacaca

SEQ ID NO: 170219 - DNA, 20 bp, Artificial Sequence
  chemically synthesized
ttattgttatttatactatg

SEQ ID NO: 170220 - DNA, 20 bp, Artificial Sequence
  chemically synthesized
agcaatatgcatttgcttca

SEQ ID NO: 170221 - DNA, 20 bp, Artificial Sequence
  chemically synthesized
ccatgtttcattgagtggat

SEQ ID NO: 170222 - DNA, 20 bp, Artificial Sequence
  chemically synthesized
gttagccatgtttcattgag

SEQ ID NO: 170223 - DNA, 20 bp, Artificial Sequence
  chemically synthesized
tttgttagccatgtttcatt

SEQ ID NO: 170224 - DNA, 20 bp, Artificial Sequence
  chemically synthesized
cttatccactcaatgaaaca

SEQ ID NO: 170225 - DNA, 20 bp, Artificial Sequence
  chemically synthesized
tcaatgaaacatggctaaca

SEQ ID NO: 170226 - DNA, 20 bp, Artificial Sequence
  chemically synthesized
atgaaacatggctaacaaag

SEQ ID NO: 170227 - DNA, 20 bp, Artificial Sequence
  chemically synthesized
atactgattttcttctttgt

SEQ ID NO: 170228 - DNA, 20 bp, Artificial Sequence
  chemically synthesized
tggctaacaaagaagaaaat

SEQ ID NO: 170229 - DNA, 20 bp, Artificial Sequence
  chemically synthesized
aagaagaaaatcagtatccc

SEQ ID NO: 170230 - DNA, 20 bp, Artificial Sequence
  chemically synthesized
tggtaaggttaaaagttcca

SEQ ID NO: 170231 - DNA, 20 bp, Artificial Sequence
  chemically synthesized
ttggtaaggttaaaagttcc

SEQ ID NO: 170232 - DNA, 20 bp, Artificial Sequence
  chemically synthesized
gttggtaaggttaaaagttc

SEQ ID NO: 170233 - DNA, 20 bp, Artificial Sequence
  chemically synthesized
ttacttgttggtaaggttaa

SEQ ID NO: 170234 - DNA, 20 bp, Artificial Sequence
  chemically synthesized
gaacttttaaccttaccaac

SEQ ID NO: 170235 - DNA, 20 bp, Artificial Sequence
  chemically synthesized
tattattttacttgttggta

SEQ ID NO: 170236 - DNA, 20 bp, Artificial Sequence
  chemically synthesized
ttattattttacttgttggt

SEQ ID NO: 170237 - DNA, 20 bp, Artificial Sequence
  chemically synthesized
gatattattattttacttgt

SEQ ID NO: 170238 - DNA, 20 bp, Artificial Sequence
  chemically synthesized
agtaaaataataatatcata

SEQ ID NO: 170239 - DNA, 20 bp, Artificial Sequence
  chemically synthesized
tcatatagaattgctactcc

SEQ ID NO: 170240 - DNA, 20 bp, Artificial Sequence
  chemically synthesized
catatagaattgctactcct

SEQ ID NO: 170241 - DNA, 20 bp, Artificial Sequence
  chemically synthesized
agcatcaccattcccaggag

SEQ ID NO: 170242 - DNA, 20 bp, Artificial Sequence
  chemically synthesized
agaattgctactcctgggaa

SEQ ID NO: 170243 - DNA, 20 bp, Artificial Sequence
  chemically synthesized
ctaagcatcaccattcccag

SEQ ID NO: 170244 - DNA, 20 bp, Artificial Sequence
  chemically synthesized
ttctaagcatcaccattccc

SEQ ID NO: 170245 - DNA, 20 bp, Artificial Sequence
  chemically synthesized
tttctaagcatcaccattcc

SEQ ID NO: 170246 - DNA, 20 bp, Artificial Sequence
  chemically synthesized
ctcctgggaatggtgatgct

SEQ ID NO: 170247 - DNA, 20 bp, Artificial Sequence
  chemically synthesized
tgggaatggtgatgcttaga

SEQ ID NO: 170248 - DNA, 20 bp, Artificial Sequence
  chemically synthesized
gggaatggtgatgcttagaa

SEQ ID NO: 170249 - DNA, 20 bp, Artificial Sequence
  chemically synthesized
gttgtgttcaaaacctttct

SEQ ID NO: 170250 - DNA, 20 bp, Artificial Sequence
  chemically synthesized
aaaggttttgaacacaacat

SEQ ID NO: 170251 - DNA, 20 bp, Artificial Sequence
  chemically synthesized
aaggttttgaacacaacatc

SEQ ID NO: 170252 - DNA, 20 bp, Artificial Sequence
  chemically synthesized
gttttgaacacaacatcggg

SEQ ID NO: 170253 - DNA, 20 bp, Artificial Sequence
  chemically synthesized
tttgaacacaacatcgggaa

SEQ ID NO: 170254 - DNA, 20 bp, Artificial Sequence
  chemically synthesized
aacacaacatcgggaagagt

SEQ ID NO: 170255 - DNA, 20 bp, Artificial Sequence
  chemically synthesized
acatcgggaagagttggcat

SEQ ID NO: 170256 - DNA, 20 bp, Artificial Sequence
  chemically synthesized
agttggcattggcatatgtg

SEQ ID NO: 170257 - DNA, 20 bp, Artificial Sequence
  chemically synthesized
cattggcatatgtgaagttg

SEQ ID NO: 170258 - DNA, 20 bp, Artificial Sequence
  chemically synthesized
atgtgaagttgtagctttac

SEQ ID NO: 170259 - DNA, 20 bp, Artificial Sequence
  chemically synthesized
ataccgtcacacagctagta

SEQ ID NO: 170260 - DNA, 20 bp, Artificial Sequence
  chemically synthesized
tcctcataccgtcacacagc

SEQ ID NO: 170261 - DNA, 20 bp, Artificial Sequence
  chemically synthesized
tagctttactagctgtgtga

SEQ ID NO: 170262 - DNA, 20 bp, Artificial Sequence
  chemically synthesized
actttcctcataccgtcaca

SEQ ID NO: 170263 - DNA, 20 bp, Artificial Sequence
  chemically synthesized
tactagctgtgtgacggtat

SEQ ID NO: 170264 - DNA, 20 bp, Artificial Sequence
  chemically synthesized
actagctgtgtgacggtatg

SEQ ID NO: 170265 - DNA, 20 bp, Artificial Sequence
  chemically synthesized
gctgtgtgacggtatgagga

SEQ ID NO: 170266 - DNA, 20 bp, Artificial Sequence
  chemically synthesized
aggaaagtgaatacaattca

SEQ ID NO: 170267 - DNA, 20 bp, Artificial Sequence
  chemically synthesized
aagtgaatacaattcaaaga

SEQ ID NO: 170268 - DNA, 20 bp, Artificial Sequence
  chemically synthesized
agtgaatacaattcaaagat

SEQ ID NO: 170269 - DNA, 20 bp, Artificial Sequence
  chemically synthesized
aatacaattcaaagatgggt

SEQ ID NO: 170270 - DNA, 20 bp, Artificial Sequence
  chemically synthesized
atgggttggtctcttcctgc

SEQ ID NO: 170271 - DNA, 20 bp, Artificial Sequence
  chemically synthesized
tctcttctggccagcaggaa

SEQ ID NO: 170272 - DNA, 20 bp, Artificial Sequence
  chemically synthesized
cttctcttctggccagcagg

SEQ ID NO: 170273 - DNA, 20 bp, Artificial Sequence
  chemically synthesized
gttggtctcttcctgctggc

SEQ ID NO: 170274 - DNA, 20 bp, Artificial Sequence
  chemically synthesized
tctcttctcttctggccagc

SEQ ID NO: 170275 - DNA, 20 bp, Artificial Sequence
  chemically synthesized
ctctcttctcttctggccag

SEQ ID NO: 170276 - DNA, 20 bp, Artificial Sequence
  chemically synthesized
ggtctcttcctgctggccag

SEQ ID NO: 170277 - DNA, 20 bp, Artificial Sequence
  chemically synthesized
tctcttcctgctggccagaa

SEQ ID NO: 170278 - DNA, 20 bp, Artificial Sequence
  chemically synthesized
ttgctctcttctcttctggc

SEQ ID NO: 170279 - DNA, 20 bp, Artificial Sequence
  chemically synthesized
cttcctgctggccagaagag

SEQ ID NO: 170280 - DNA, 20 bp, Artificial Sequence
  chemically synthesized
ttctttgctctcttctcttc

SEQ ID NO: 170281 - DNA, 20 bp, Artificial Sequence
  chemically synthesized
tcctgctggccagaagagaa

SEQ ID NO: 170282 - DNA, 20 bp, Artificial Sequence
  chemically synthesized
ctgctggccagaagagaaga

SEQ ID NO: 170283 - DNA, 20 bp, Artificial Sequence
  chemically synthesized
ggccagaagagaagagagca

SEQ ID NO: 170284 - DNA, 20 bp, Artificial Sequence
  chemically synthesized
gagaagagagcaaagaaaaa

SEQ ID NO: 170285 - DNA, 20 bp, Artificial Sequence
  chemically synthesized
gaagagagcaaagaaaaaaa

SEQ ID NO: 170286 - DNA, 20 bp, Artificial Sequence
  chemically synthesized
gcaaagaaaaaaagagaata

SEQ ID NO: 170287 - DNA, 20 bp, Artificial Sequence
  chemically synthesized
atatggatataaatttgaaa

SEQ ID NO: 170288 - DNA, 20 bp, Artificial Sequence
  chemically synthesized
ttattgtttccagagaaatc

SEQ ID NO: 170289 - DNA, 20 bp, Artificial Sequence
  chemically synthesized
agaaaaatacttgatttctc

SEQ ID NO: 170290 - DNA, 20 bp, Artificial Sequence
  chemically synthesized
tgatttttttattgtttcca

SEQ ID NO: 170291 - DNA, 20 bp, Artificial Sequence
  chemically synthesized
cctgatttttttattgtttc

SEQ ID NO: 170292 - DNA, 20 bp, Artificial Sequence
  chemically synthesized
tctggaaacaataaaaaaat

SEQ ID NO: 170293 - DNA, 20 bp, Artificial Sequence
  chemically synthesized
ctggaaacaataaaaaaatc

SEQ ID NO: 170294 - DNA, 20 bp, Artificial Sequence
  chemically synthesized
tggaaacaataaaaaaatca

SEQ ID NO: 170295 - DNA, 20 bp, Artificial Sequence
  chemically synthesized
caataaaaaaatcagggcaa

SEQ ID NO: 170296 - DNA, 20 bp, Artificial Sequence
  chemically synthesized
aaaaaaatcagggcaaaagt

SEQ ID NO: 170297 - DNA, 20 bp, Artificial Sequence
  chemically synthesized
aaaaaatcagggcaaaagtc

SEQ ID NO: 170298 - DNA, 20 bp, Artificial Sequence
  chemically synthesized
gcaaaagtcaggtgccaaaa

SEQ ID NO: 170299 - DNA, 20 bp, Artificial Sequence
  chemically synthesized
cgcagaatataaaactattt

SEQ ID NO: 170300 - DNA, 20 bp, Artificial Sequence
  chemically synthesized
aaaatagttttatattctgc

SEQ ID NO: 170301 - DNA, 20 bp, Artificial Sequence
  chemically synthesized
aaatagttttatattctgcg

SEQ ID NO: 170302 - DNA, 20 bp, Artificial Sequence
  chemically synthesized
ggttatggcaacaatcctcg

SEQ ID NO: 170303 - DNA, 20 bp, Artificial Sequence
  chemically synthesized
ctcctgttgaaatggggtta

SEQ ID NO: 170304 - DNA, 20 bp, Artificial Sequence
  chemically synthesized
ccaagtctcctgttgaaatg

SEQ ID NO: 170305 - DNA, 20 bp, Artificial Sequence
  chemically synthesized
ttgccataaccccatttcaa

SEQ ID NO: 170306 - DNA, 20 bp, Artificial Sequence
  chemically synthesized
cccaagtctcctgttgaaat

SEQ ID NO: 170307 - DNA, 20 bp, Artificial Sequence
  chemically synthesized
tgccataaccccatttcaac

SEQ ID NO: 170308 - DNA, 20 bp, Artificial Sequence
  chemically synthesized
gcccaagtctcctgttgaaa

SEQ ID NO: 170309 - DNA, 20 bp, Artificial Sequence
  chemically synthesized
ccataaccccatttcaacag

SEQ ID NO: 170310 - DNA, 20 bp, Artificial Sequence
  chemically synthesized
ccccatttcaacaggagact

SEQ ID NO: 170311 - DNA, 20 bp, Artificial Sequence
  chemically synthesized
cccatttcaacaggagactt

SEQ ID NO: 170312 - DNA, 20 bp, Artificial Sequence
  chemically synthesized
atttcaacaggagacttggg

SEQ ID NO: 170313 - DNA, 20 bp, Artificial Sequence
  chemically synthesized
ttcaacaggagacttgggca

SEQ ID NO: 170314 - DNA, 20 bp, Artificial Sequence
  chemically synthesized
tcaacaggagacttgggcag

SEQ ID NO: 170315 - DNA, 20 bp, Artificial Sequence
  chemically synthesized
caacaggagacttgggcaga

SEQ ID NO: 170316 - DNA, 20 bp, Artificial Sequence
  chemically synthesized
tagtttgctgccctctgccc

SEQ ID NO: 170317 - DNA, 20 bp, Artificial Sequence
  chemically synthesized
caggagacttgggcagaggg

SEQ ID NO: 170318 - DNA, 20 bp, Artificial Sequence
  chemically synthesized
gggcagagggcagcaaacta

SEQ ID NO: 170319 - DNA, 20 bp, Artificial Sequence
  chemically synthesized
gggcagcaaactatggctta

SEQ ID NO: 170320 - DNA, 20 bp, Artificial Sequence
  chemically synthesized
tgaatgtgacccataagcca

SEQ ID NO: 170321 - DNA, 20 bp, Artificial Sequence
  chemically synthesized
ggcagcaaactatggcttat

SEQ ID NO: 170322 - DNA, 20 bp, Artificial Sequence
  chemically synthesized
ggtggctgaatgtgacccat

SEQ ID NO: 170323 - DNA, 20 bp, Artificial Sequence
  chemically synthesized
tatggcttatgggtcacatt

SEQ ID NO: 170324 - DNA, 20 bp, Artificial Sequence
  chemically synthesized
aactgtacaaagacatatgg

SEQ ID NO: 170325 - DNA, 20 bp, Artificial Sequence
  chemically synthesized
tcaaactgtacaaagacata

SEQ ID NO: 170326 - DNA, 20 bp, Artificial Sequence
  chemically synthesized
agccaccatatgtctttgta

SEQ ID NO: 170327 - DNA, 20 bp, Artificial Sequence
  chemically synthesized
gttagttctcaaactgtaca

SEQ ID NO: 170328 - DNA, 20 bp, Artificial Sequence
  chemically synthesized
catatgtctttgtacagttt

SEQ ID NO: 170329 - DNA, 20 bp, Artificial Sequence
  chemically synthesized
tcaaatgttaaaacaattgt

SEQ ID NO: 170330 - DNA, 20 bp, Artificial Sequence
  chemically synthesized
aacaattgttttaacatttg

SEQ ID NO: 170331 - DNA, 20 bp, Artificial Sequence
  chemically synthesized
acccatttattaattatttt

SEQ ID NO: 170332 - DNA, 20 bp, Artificial Sequence
  chemically synthesized
aactgaaaataattaataaa

SEQ ID NO: 170333 - DNA, 20 bp, Artificial Sequence
  chemically synthesized
actgaaaataattaataaat

SEQ ID NO: 170334 - DNA, 20 bp, Artificial Sequence
  chemically synthesized
aaaataattaataaatgggt

SEQ ID NO: 170335 - DNA, 20 bp, Artificial Sequence
  chemically synthesized
aaattcaaatttgtgtcccc

SEQ ID NO: 170336 - DNA, 20 bp, Artificial Sequence
  chemically synthesized
gtcccgtgacaatttacttg

SEQ ID NO: 170337 - DNA, 20 bp, Artificial Sequence
  chemically synthesized
tgtcccgtgacaatttactt

SEQ ID NO: 170338 - DNA, 20 bp, Artificial Sequence
  chemically synthesized
gtgtcccgtgacaatttact

SEQ ID NO: 170339 - DNA, 20 bp, Artificial Sequence
  chemically synthesized
tgtccccaagtaaattgtca

SEQ ID NO: 170340 - DNA, 20 bp, Artificial Sequence
  chemically synthesized
gtccccaagtaaattgtcac

SEQ ID NO: 170341 - DNA, 20 bp, Artificial Sequence
  chemically synthesized
aagtaaattgtcacgggaca

SEQ ID NO: 170342 - DNA, 20 bp, Artificial Sequence
  chemically synthesized
tacacataaacgaatgggca

SEQ ID NO: 170343 - DNA, 20 bp, Artificial Sequence
  chemically synthesized
gtaactacacataaacgaat

SEQ ID NO: 170344 - DNA, 20 bp, Artificial Sequence
  chemically synthesized
cgtaactacacataaacgaa

SEQ ID NO: 170345 - DNA, 20 bp, Artificial Sequence
  chemically synthesized
catgcccattcgtttatgtg

SEQ ID NO: 170346 - DNA, 20 bp, Artificial Sequence
  chemically synthesized
gtttatgtgtagttacgtat

SEQ ID NO: 170347 - DNA, 20 bp, Artificial Sequence
  chemically synthesized
tttatgtgtagttacgtatt

SEQ ID NO: 170348 - DNA, 20 bp, Artificial Sequence
  chemically synthesized
ttatgtgtagttacgtatta

SEQ ID NO: 170349 - DNA, 20 bp, Artificial Sequence
  chemically synthesized
ccgctattgtggatcaaaag

SEQ ID NO: 170350 - DNA, 20 bp, Artificial Sequence
  chemically synthesized
acaccgctattgtggatcaa

SEQ ID NO: 170351 - DNA, 20 bp, Artificial Sequence
  chemically synthesized
gggctgcttttgatccacaa

SEQ ID NO: 170352 - DNA, 20 bp, Artificial Sequence
  chemically synthesized
ctgcttttgatccacaatag

SEQ ID NO: 170353 - DNA, 20 bp, Artificial Sequence
  chemically synthesized
actacttaacaccgctattg

SEQ ID NO: 170354 - DNA, 20 bp, Artificial Sequence
  chemically synthesized
tgatccacaatagcggtgtt

SEQ ID NO: 170355 - DNA, 20 bp, Artificial Sequence
  chemically synthesized
tccacaatagcggtgttaag

SEQ ID NO: 170356 - DNA, 20 bp, Artificial Sequence
  chemically synthesized
atagcggtgttaagtagtcg

SEQ ID NO: 170357 - DNA, 20 bp, Artificial Sequence
  chemically synthesized
gcggtgttaagtagtcgtgg

SEQ ID NO: 170358 - DNA, 20 bp, Artificial Sequence
  chemically synthesized
ggtgttaagtagtcgtggca

SEQ ID NO: 170359 - DNA, 20 bp, Artificial Sequence
  chemically synthesized
tagtcgtggcagagacctat

SEQ ID NO: 170360 - DNA, 20 bp, Artificial Sequence
  chemically synthesized
tttaggctttgcaggccaat

SEQ ID NO: 170361 - DNA, 20 bp, Artificial Sequence
  chemically synthesized
ttttaggctttgcaggccaa

SEQ ID NO: 170362 - DNA, 20 bp, Artificial Sequence
  chemically synthesized
cagagacctattggcctgca

SEQ ID NO: 170363 - DNA, 20 bp, Artificial Sequence
  chemically synthesized
gtaaatgttttaggctttgc

SEQ ID NO: 170364 - DNA, 20 bp, Artificial Sequence
  chemically synthesized
ggtaaatgttttaggctttg

SEQ ID NO: 170365 - DNA, 20 bp, Artificial Sequence
  chemically synthesized
gtccagatggtaaatgtttt

SEQ ID NO: 170366 - DNA, 20 bp, Artificial Sequence
  chemically synthesized
ggtccagatggtaaatgttt

SEQ ID NO: 170367 - DNA, 20 bp, Artificial Sequence
  chemically synthesized
agcctaaaacatttaccatc

SEQ ID NO: 170368 - DNA, 20 bp, Artificial Sequence
  chemically synthesized
actttctataacggtccaga

SEQ ID NO: 170369 - DNA, 20 bp, Artificial Sequence
  chemically synthesized
gcaaactttctataacggtc

SEQ ID NO: 170370 - DNA, 20 bp, Artificial Sequence
  chemically synthesized
atttaccatctggaccgtta

SEQ ID NO: 170371 - DNA, 20 bp, Artificial Sequence
  chemically synthesized
accatctggaccgttataga

SEQ ID NO: 170372 - DNA, 20 bp, Artificial Sequence
  chemically synthesized
ggtcagcaaactttctataa

SEQ ID NO: 170373 - DNA, 20 bp, Artificial Sequence
  chemically synthesized
tgaacacctagagcagaggt

SEQ ID NO: 170374 - DNA, 20 bp, Artificial Sequence
  chemically synthesized
aagtttgctgacctctgctc

SEQ ID NO: 170375 - DNA, 20 bp, Artificial Sequence
  chemically synthesized
agtttgctgacctctgctct

SEQ ID NO: 170376 - DNA, 20 bp, Artificial Sequence
  chemically synthesized
tccttgaacacctagagcag

SEQ ID NO: 170377 - DNA, 20 bp, Artificial Sequence
  chemically synthesized
ctccttgaacacctagagca

SEQ ID NO: 170378 - DNA, 20 bp, Artificial Sequence
  chemically synthesized
aactccttgaacacctagag

SEQ ID NO: 170379 - DNA, 20 bp, Artificial Sequence
  chemically synthesized
cacaactccttgaacaccta

SEQ ID NO: 170380 - DNA, 20 bp, Artificial Sequence
  chemically synthesized
gacctctgctctaggtgttc

SEQ ID NO: 170381 - DNA, 20 bp, Artificial Sequence
  chemically synthesized
gccacaactccttgaacacc

SEQ ID NO: 170382 - DNA, 20 bp, Artificial Sequence
  chemically synthesized
acctctgctctaggtgttca

SEQ ID NO: 170383 - DNA, 20 bp, Artificial Sequence
  chemically synthesized
ctctgctctaggtgttcaag

SEQ ID NO: 170384 - DNA, 20 bp, Artificial Sequence
  chemically synthesized
tctaggtgttcaaggagttg

SEQ ID NO: 170385 - DNA, 20 bp, Artificial Sequence
  chemically synthesized
aggagttgtggcccaacctc

SEQ ID NO: 170386 - DNA, 20 bp, Artificial Sequence
  chemically synthesized
acttagatggactggaggtt

SEQ ID NO: 170387 - DNA, 20 bp, Artificial Sequence
  chemically synthesized
gacttagatggactggaggt

SEQ ID NO: 170388 - DNA, 20 bp, Artificial Sequence
  chemically synthesized
ccaagacttagatggactgg

SEQ ID NO: 170389 - DNA, 20 bp, Artificial Sequence
  chemically synthesized
accaagacttagatggactg

SEQ ID NO: 170390 - DNA, 20 bp, Artificial Sequence
  chemically synthesized
ggaccaagacttagatggac

SEQ ID NO: 170391 - DNA, 20 bp, Artificial Sequence
  chemically synthesized
gcccaacctccagtccatct

SEQ ID NO: 170392 - DNA, 20 bp, Artificial Sequence
  chemically synthesized
aggcaggaccaagacttaga

SEQ ID NO: 170393 - DNA, 20 bp, Artificial Sequence
  chemically synthesized
cctccagtccatctaagtct

SEQ ID NO: 170394 - DNA, 20 bp, Artificial Sequence
  chemically synthesized
atacaggcaggaccaagact

SEQ ID NO: 170395 - DNA, 20 bp, Artificial Sequence
  chemically synthesized
tctgaaatacaggcaggacc

SEQ ID NO: 170396 - DNA, 20 bp, Artificial Sequence
  chemically synthesized
agcggctctgaaatacaggc

SEQ ID NO: 170397 - DNA, 20 bp, Artificial Sequence
  chemically synthesized
aagcggctctgaaatacagg

SEQ ID NO: 170398 - DNA, 20 bp, Artificial Sequence
  chemically synthesized
tcttggtcctgcctgtattt

SEQ ID NO: 170399 - DNA, 20 bp, Artificial Sequence
  chemically synthesized
ttaaagcggctctgaaatac

SEQ ID NO: 170400 - DNA, 20 bp, Artificial Sequence
  chemically synthesized
ttggtcctgcctgtatttca

SEQ ID NO: 170401 - DNA, 20 bp, Artificial Sequence
  chemically synthesized
gttaaagcggctctgaaata

SEQ ID NO: 170402 - DNA, 20 bp, Artificial Sequence
  chemically synthesized
gtatttcagagccgctttaa

SEQ ID NO: 170403 - DNA, 20 bp, Artificial Sequence
  chemically synthesized
tatttcagagccgctttaac

SEQ ID NO: 170404 - DNA, 20 bp, Artificial Sequence
  chemically synthesized
caccaactcacccgttaaag

SEQ ID NO: 170405 - DNA, 20 bp, Artificial Sequence
  chemically synthesized
actcaccaactcacccgtta

SEQ ID NO: 170406 - DNA, 20 bp, Artificial Sequence
  chemically synthesized
tcagagccgctttaacgggt

SEQ ID NO: 170407 - DNA, 20 bp, Artificial Sequence
  chemically synthesized
agccgctttaacgggtgagt

SEQ ID NO: 170408 - DNA, 20 bp, Artificial Sequence
  chemically synthesized
gctttaacgggtgagttggt

SEQ ID NO: 170409 - DNA, 20 bp, Artificial Sequence
  chemically synthesized
aacgggtgagttggtgagtg

SEQ ID NO: 170410 - DNA, 20 bp, Artificial Sequence
  chemically synthesized
gtgagttggtgagtgcagta

SEQ ID NO: 170411 - DNA, 20 bp, Artificial Sequence
  chemically synthesized
tgagttggtgagtgcagtac

SEQ ID NO: 170412 - DNA, 20 bp, Artificial Sequence
  chemically synthesized
gagttggtgagtgcagtaca

SEQ ID NO: 170413 - DNA, 20 bp, Artificial Sequence
  chemically synthesized
tttttatttctcgtacattg

SEQ ID NO: 170414 - DNA, 20 bp, Artificial Sequence
  chemically synthesized
agtacagggcttcaatgtac

SEQ ID NO: 170415 - DNA, 20 bp, Artificial Sequence
  chemically synthesized
aataaaaaaacttttaaatg

SEQ ID NO: 170416 - DNA, 20 bp, Artificial Sequence
  chemically synthesized
ttaatggatactgcatttaa

SEQ ID NO: 170417 - DNA, 20 bp, Artificial Sequence
  chemically synthesized
ttccaatttgggtaaattaa

SEQ ID NO: 170418 - DNA, 20 bp, Artificial Sequence
  chemically synthesized
atccattaatttacccaaat

SEQ ID NO: 170419 - DNA, 20 bp, Artificial Sequence
  chemically synthesized
tcttgtccattttccaattt

SEQ ID NO: 170420 - DNA, 20 bp, Artificial Sequence
  chemically synthesized
gtcttgtccattttccaatt

SEQ ID NO: 170421 - DNA, 20 bp, Artificial Sequence
  chemically synthesized
aatttacccaaattggaaaa

SEQ ID NO: 170422 - DNA, 20 bp, Artificial Sequence
  chemically synthesized
acccaaattggaaaatggac

SEQ ID NO: 170423 - DNA, 20 bp, Artificial Sequence
  chemically synthesized
aaattggaaaatggacaaga

SEQ ID NO: 170424 - DNA, 20 bp, Artificial Sequence
  chemically synthesized
atggacaagacagcatcctt

SEQ ID NO: 170425 - DNA, 20 bp, Artificial Sequence
  chemically synthesized
gacaagacagcatcctttgg

SEQ ID NO: 170426 - DNA, 20 bp, Artificial Sequence
  chemically synthesized
tttaaaaaaatttccaccaa

SEQ ID NO: 170427 - DNA, 20 bp, Artificial Sequence
  chemically synthesized
atttaaaaaaatttccacca

SEQ ID NO: 170428 - DNA, 20 bp, Artificial Sequence
  chemically synthesized
aaaacagaccaggagggtcg

SEQ ID NO: 170429 - DNA, 20 bp, Artificial Sequence
  chemically synthesized
ttttaaatccacgaccctcc

SEQ ID NO: 170430 - DNA, 20 bp, Artificial Sequence
  chemically synthesized
gtcccaaaaacagaccagga

SEQ ID NO: 170431 - DNA, 20 bp, Artificial Sequence
  chemically synthesized
tgtcccaaaaacagaccagg

SEQ ID NO: 170432 - DNA, 20 bp, Artificial Sequence
  chemically synthesized
gtgtcccaaaaacagaccag

SEQ ID NO: 170433 - DNA, 20 bp, Artificial Sequence
  chemically synthesized
aagtgtcccaaaaacagacc

SEQ ID NO: 170434 - DNA, 20 bp, Artificial Sequence
  chemically synthesized
aaagtgtcccaaaaacagac

SEQ ID NO: 170435 - DNA, 20 bp, Artificial Sequence
  chemically synthesized
cgaccctcctggtctgtttt

SEQ ID NO: 170436 - DNA, 20 bp, Artificial Sequence
  chemically synthesized
gaccctcctggtctgttttt

SEQ ID NO: 170437 - DNA, 20 bp, Artificial Sequence
  chemically synthesized
gctacaaagtgtcccaaaaa

SEQ ID NO: 170438 - DNA, 20 bp, Artificial Sequence
  chemically synthesized
tctgtttttgggacactttg

SEQ ID NO: 170439 - DNA, 20 bp, Artificial Sequence
  chemically synthesized
tttttgggacactttgtagc

SEQ ID NO: 170440 - DNA, 20 bp, Artificial Sequence
  chemically synthesized
atttgtacatactggctaca

SEQ ID NO: 170441 - DNA, 20 bp, Artificial Sequence
  chemically synthesized
aatcagacatttgtacatac

SEQ ID NO: 170442 - DNA, 20 bp, Artificial Sequence
  chemically synthesized
gtatgtacaaatgtctgatt

SEQ ID NO: 170443 - DNA, 20 bp, Artificial Sequence
  chemically synthesized
gtacaaatgtctgatttagc

SEQ ID NO: 170444 - DNA, 20 bp, Artificial Sequence
  chemically synthesized
gatggatggcccagctaaat

SEQ ID NO: 170445 - DNA, 20 bp, Artificial Sequence
  chemically synthesized
tacaaatgtctgatttagct

SEQ ID NO: 170446 - DNA, 20 bp, Artificial Sequence
  chemically synthesized
ctggtcccagatggatggcc

SEQ ID NO: 170447 - DNA, 20 bp, Artificial Sequence
  chemically synthesized
atttagctgggccatccatc

SEQ ID NO: 170448 - DNA, 20 bp, Artificial Sequence
  chemically synthesized
tttagctgggccatccatct

SEQ ID NO: 170449 - DNA, 20 bp, Artificial Sequence
  chemically synthesized
gctagctggtcccagatgga

SEQ ID NO: 170450 - DNA, 20 bp, Artificial Sequence
  chemically synthesized
ttcagctagctggtcccaga

SEQ ID NO: 170451 - DNA, 20 bp, Artificial Sequence
  chemically synthesized
ctgggccatccatctgggac

SEQ ID NO: 170452 - DNA, 20 bp, Artificial Sequence
  chemically synthesized
aagcttcagctagctggtcc

SEQ ID NO: 170453 - DNA, 20 bp, Artificial Sequence
  chemically synthesized
gccatccatctgggaccagc

SEQ ID NO: 170454 - DNA, 20 bp, Artificial Sequence
  chemically synthesized
gattgcaagcttcagctagc

SEQ ID NO: 170455 - DNA, 20 bp, Artificial Sequence
  chemically synthesized
catctgggaccagctagctg

SEQ ID NO: 170456 - DNA, 20 bp, Artificial Sequence
  chemically synthesized
ctgcgattgcaagcttcagc

SEQ ID NO: 170457 - DNA, 20 bp, Artificial Sequence
  chemically synthesized
ctaactgcgattgcaagctt

SEQ ID NO: 170458 - DNA, 20 bp, Artificial Sequence
  chemically synthesized
ctagctgaagcttgcaatcg

SEQ ID NO: 170459 - DNA, 20 bp, Artificial Sequence
  chemically synthesized
tttcagctaactgcgattgc

SEQ ID NO: 170460 - DNA, 20 bp, Artificial Sequence
  chemically synthesized
ctgaagcttgcaatcgcagt

SEQ ID NO: 170461 - DNA, 20 bp, Artificial Sequence
  chemically synthesized
aatattcaagtttcaaattt

SEQ ID NO: 170462 - DNA, 20 bp, Artificial Sequence
  chemically synthesized
gtctaccacttgaaatattc

SEQ ID NO: 170463 - DNA, 20 bp, Artificial Sequence
  chemically synthesized
atttgaaacttgaatatttc

SEQ ID NO: 170464 - DNA, 20 bp, Artificial Sequence
  chemically synthesized
tgaaacttgaatatttcaag

SEQ ID NO: 170465 - DNA, 20 bp, Artificial Sequence
  chemically synthesized
aacttgaatatttcaagtgg

SEQ ID NO: 170466 - DNA, 20 bp, Artificial Sequence
  chemically synthesized
tatttcaagtggtagacatt

SEQ ID NO: 170467 - DNA, 20 bp, Artificial Sequence
  chemically synthesized
aaagatatcaaataatgatg

SEQ ID NO: 170468 - DNA, 20 bp, Artificial Sequence
  chemically synthesized
cttcttggaatgcaaattaa

SEQ ID NO: 170469 - DNA, 20 bp, Artificial Sequence
  chemically synthesized
tatcttttaatttgcattcc

SEQ ID NO: 170470 - DNA, 20 bp, Artificial Sequence
  chemically synthesized
cttttaatttgcattccaag

SEQ ID NO: 170471 - DNA, 20 bp, Artificial Sequence
  chemically synthesized
tttggaaacgcacaacttct

SEQ ID NO: 170472 - DNA, 20 bp, Artificial Sequence
  chemically synthesized
caagaagttgtgcgtttcca

SEQ ID NO: 170473 - DNA, 20 bp, Artificial Sequence
  chemically synthesized
gaagttgtgcgtttccaaag

SEQ ID NO: 170474 - DNA, 20 bp, Artificial Sequence
  chemically synthesized
tttattttctttcactgctt

SEQ ID NO: 170475 - DNA, 20 bp, Artificial Sequence
  chemically synthesized
gtgcgtttccaaagcagtga

SEQ ID NO: 170476 - DNA, 20 bp, Artificial Sequence
  chemically synthesized
taaaacaaaaatttaaaaaa

SEQ ID NO: 170477 - DNA, 20 bp, Artificial Sequence
  chemically synthesized
gaaacgatatgtcaacataa

SEQ ID NO: 170478 - DNA, 20 bp, Artificial Sequence
  chemically synthesized
cgatatgtcaacataaaagc

SEQ ID NO: 170479 - DNA, 20 bp, Artificial Sequence
  chemically synthesized
tttaaaaattaatttttttc

SEQ ID NO: 170480 - DNA, 20 bp, Artificial Sequence
  chemically synthesized
acgtaatttacagggtataa

SEQ ID NO: 170481 - DNA, 20 bp, Artificial Sequence
  chemically synthesized
aaggctacacgtaatttaca

SEQ ID NO: 170482 - DNA, 20 bp, Artificial Sequence
  chemically synthesized
caaggctacacgtaatttac

SEQ ID NO: 170483 - DNA, 20 bp, Artificial Sequence
  chemically synthesized
tcaaggctacacgtaattta

SEQ ID NO: 170484 - DNA, 20 bp, Artificial Sequence
  chemically synthesized
tataccctgtaaattacgtg

SEQ ID NO: 170485 - DNA, 20 bp, Artificial Sequence
  chemically synthesized
taaattacgtgtagccttga

SEQ ID NO: 170486 - DNA, 20 bp, Artificial Sequence
  chemically synthesized
aaattacgtgtagccttgat

SEQ ID NO: 170487 - DNA, 20 bp, Artificial Sequence
  chemically synthesized
gtgaagttctatgcccatca

SEQ ID NO: 170488 - DNA, 20 bp, Artificial Sequence
  chemically synthesized
ggtgaagttctatgcccatc

SEQ ID NO: 170489 - DNA, 20 bp, Artificial Sequence
  chemically synthesized
acgtgtagccttgatgggca

SEQ ID NO: 170490 - DNA, 20 bp, Artificial Sequence
  chemically synthesized
tgatgggcatagaacttcac

SEQ ID NO: 170491 - DNA, 20 bp, Artificial Sequence
  chemically synthesized
ggctaccatattaaccggtg

SEQ ID NO: 170492 - DNA, 20 bp, Artificial Sequence
  chemically synthesized
tagaacttcaccggttaata

SEQ ID NO: 170493 - DNA, 20 bp, Artificial Sequence
  chemically synthesized
ttagtggctaccatattaac

SEQ ID NO: 170494 - DNA, 20 bp, Artificial Sequence
  chemically synthesized
aacttcaccggttaatatgg

SEQ ID NO: 170495 - DNA, 20 bp, Artificial Sequence
  chemically synthesized
caatagctacatgtggttag

SEQ ID NO: 170496 - DNA, 20 bp, Artificial Sequence
  chemically synthesized
gctcaatagctacatgtggt

SEQ ID NO: 170497 - DNA, 20 bp, Artificial Sequence
  chemically synthesized
tggtagccactaaccacatg

SEQ ID NO: 170498 - DNA, 20 bp, Artificial Sequence
  chemically synthesized
gggtgctcaatagctacatg

SEQ ID NO: 170499 - DNA, 20 bp, Artificial Sequence
  chemically synthesized
actaaccacatgtagctatt

SEQ ID NO: 170500 - DNA, 20 bp, Artificial Sequence
  chemically synthesized
attctgggctgggtgctcaa

SEQ ID NO: 170501 - DNA, 20 bp, Artificial Sequence
  chemically synthesized
acatgtagctattgagcacc

SEQ ID NO: 170502 - DNA, 20 bp, Artificial Sequence
  chemically synthesized
tagctattgagcacccagcc

SEQ ID NO: 170503 - DNA, 20 bp, Artificial Sequence
  chemically synthesized
aaataggcatattctgggct

SEQ ID NO: 170504 - DNA, 20 bp, Artificial Sequence
  chemically synthesized
caaataggcatattctgggc

SEQ ID NO: 170505 - DNA, 20 bp, Artificial Sequence
  chemically synthesized
attccaaataggcatattct

SEQ ID NO: 170506 - DNA, 20 bp, Artificial Sequence
  chemically synthesized
tattccaaataggcatattc

SEQ ID NO: 170507 - DNA, 20 bp, Artificial Sequence
  chemically synthesized
cagcccagaatatgcctatt

SEQ ID NO: 170508 - DNA, 20 bp, Artificial Sequence
  chemically synthesized
agcatatgtctattccaaat

SEQ ID NO: 170509 - DNA, 20 bp, Artificial Sequence
  chemically synthesized
cagaatatgcctatttggaa

SEQ ID NO: 170510 - DNA, 20 bp, Artificial Sequence
  chemically synthesized
cagcatatgtctattccaaa

SEQ ID NO: 170511 - DNA, 20 bp, Artificial Sequence
  chemically synthesized
ggaatccaatatgtatttta

SEQ ID NO: 170512 - DNA, 20 bp, Artificial Sequence
  chemically synthesized
atatgctgtaaaatacatat

SEQ ID NO: 170513 - DNA, 20 bp, Artificial Sequence
  chemically synthesized
aaaatacatattggattccg

SEQ ID NO: 170514 - DNA, 20 bp, Artificial Sequence
  chemically synthesized
aaatacatattggattccga

SEQ ID NO: 170515 - DNA, 20 bp, Artificial Sequence
  chemically synthesized
catattggattccgaaggca

SEQ ID NO: 170516 - DNA, 20 bp, Artificial Sequence
  chemically synthesized
ttttttcagtactatgcctt

SEQ ID NO: 170517 - DNA, 20 bp, Artificial Sequence
  chemically synthesized
tttggattcttttttttttt

SEQ ID NO: 170518 - DNA, 20 bp, Artificial Sequence
  chemically synthesized
gcatagtactgaaaaaaaaa

SEQ ID NO: 170519 - DNA, 20 bp, Artificial Sequence
  chemically synthesized
atggatgaattaaaatattt

SEQ ID NO: 170520 - DNA, 20 bp, Artificial Sequence
  chemically synthesized
tcctgtcattaagtgatgca

SEQ ID NO: 170521 - DNA, 20 bp, Artificial Sequence
  chemically synthesized
atccatgcatcacttaatga

SEQ ID NO: 170522 - DNA, 20 bp, Artificial Sequence
  chemically synthesized
tccatgcatcacttaatgac

SEQ ID NO: 170523 - DNA, 20 bp, Artificial Sequence
  chemically synthesized
cagaatgtattcctgtcatt

SEQ ID NO: 170524 - DNA, 20 bp, Artificial Sequence
  chemically synthesized
taatgacaggaatacattct

SEQ ID NO: 170525 - DNA, 20 bp, Artificial Sequence
  chemically synthesized
atgacaggaatacattctga

SEQ ID NO: 170526 - DNA, 20 bp, Artificial Sequence
  chemically synthesized
tcacctaatgacacatctct

SEQ ID NO: 170527 - DNA, 20 bp, Artificial Sequence
  chemically synthesized
cattctgagagatgtgtcat

SEQ ID NO: 170528 - DNA, 20 bp, Artificial Sequence
  chemically synthesized
attctgagagatgtgtcatt

SEQ ID NO: 170529 - DNA, 20 bp, Artificial Sequence
  chemically synthesized
cacactatgatgtttgcata

SEQ ID NO: 170530 - DNA, 20 bp, Artificial Sequence
  chemically synthesized
acacactatgatgtttgcat

SEQ ID NO: 170531 - DNA, 20 bp, Artificial Sequence
  chemically synthesized
ttatccttatgcaaacatca

SEQ ID NO: 170532 - DNA, 20 bp, Artificial Sequence
  chemically synthesized
tgtaccacctaggtttgtgt

SEQ ID NO: 170533 - DNA, 20 bp, Artificial Sequence
  chemically synthesized
atgtaccacctaggtttgtg

SEQ ID NO: 170534 - DNA, 20 bp, Artificial Sequence
  chemically synthesized
agtgtgtacctacacaaacc

SEQ ID NO: 170535 - DNA, 20 bp, Artificial Sequence
  chemically synthesized
gtgtgtacctacacaaacct

SEQ ID NO: 170536 - DNA, 20 bp, Artificial Sequence
  chemically synthesized
tgtacctacacaaacctagg

SEQ ID NO: 170537 - DNA, 20 bp, Artificial Sequence
  chemically synthesized
gtaggctatatgtaccacct

SEQ ID NO: 170538 - DNA, 20 bp, Artificial Sequence
  chemically synthesized
agtaggctatatgtaccacc

SEQ ID NO: 170539 - DNA, 20 bp, Artificial Sequence
  chemically synthesized
acaaacctaggtggtacata

SEQ ID NO: 170540 - DNA, 20 bp, Artificial Sequence
  chemically synthesized
atgtagcctaggtgtgtagt

SEQ ID NO: 170541 - DNA, 20 bp, Artificial Sequence
  chemically synthesized
catgtagcctaggtgtgtag

SEQ ID NO: 170542 - DNA, 20 bp, Artificial Sequence
  chemically synthesized
catatagcctactacacacc

SEQ ID NO: 170543 - DNA, 20 bp, Artificial Sequence
  chemically synthesized
atatagcctactacacacct

SEQ ID NO: 170544 - DNA, 20 bp, Artificial Sequence
  chemically synthesized
tatcatgtagcctaggtgtg

SEQ ID NO: 170545 - DNA, 20 bp, Artificial Sequence
  chemically synthesized
taggctatatcatgtagcct

SEQ ID NO: 170546 - DNA, 20 bp, Artificial Sequence
  chemically synthesized
ttaggctatatcatgtagcc

SEQ ID NO: 170547 - DNA, 20 bp, Artificial Sequence
  chemically synthesized
cacacctaggctacatgata

SEQ ID NO: 170548 - DNA, 20 bp, Artificial Sequence
  chemically synthesized
gagcattaggctatatcatg

SEQ ID NO: 170549 - DNA, 20 bp, Artificial Sequence
  chemically synthesized
atttgcagcccaggagcatt

SEQ ID NO: 170550 - DNA, 20 bp, Artificial Sequence
  chemically synthesized
atgatatagcctaatgctcc

SEQ ID NO: 170551 - DNA, 20 bp, Artificial Sequence
  chemically synthesized
aatttgcagcccaggagcat

SEQ ID NO: 170552 - DNA, 20 bp, Artificial Sequence
  chemically synthesized
tgatatagcctaatgctcct

SEQ ID NO: 170553 - DNA, 20 bp, Artificial Sequence
  chemically synthesized
tgcacaaatttgcagcccag

SEQ ID NO: 170554 - DNA, 20 bp, Artificial Sequence
  chemically synthesized
gctgcacaaatttgcagccc

SEQ ID NO: 170555 - DNA, 20 bp, Artificial Sequence
  chemically synthesized
tgctgcacaaatttgcagcc

SEQ ID NO: 170556 - DNA, 20 bp, Artificial Sequence
  chemically synthesized
tcacgtgctgcacaaatttg

SEQ ID NO: 170557 - DNA, 20 bp, Artificial Sequence
  chemically synthesized
tcctgggctgcaaatttgtg

SEQ ID NO: 170558 - DNA, 20 bp, Artificial Sequence
  chemically synthesized
atttcctgtagtattcagta

SEQ ID NO: 170559 - DNA, 20 bp, Artificial Sequence
  chemically synthesized
cgtgactgtactgaatacta

SEQ ID NO: 170560 - DNA, 20 bp, Artificial Sequence
  chemically synthesized
ttagaatttcctgtagtatt

SEQ ID NO: 170561 - DNA, 20 bp, Artificial Sequence
  chemically synthesized
gtgactgtactgaatactac

SEQ ID NO: 170562 - DNA, 20 bp, Artificial Sequence
  chemically synthesized
cactatgttagaatttcctg

SEQ ID NO: 170563 - DNA, 20 bp, Artificial Sequence
  chemically synthesized
tactacaggaaattctaaca

SEQ ID NO: 170564 - DNA, 20 bp, Artificial Sequence
  chemically synthesized
tacaggaaattctaacatag

SEQ ID NO: 170565 - DNA, 20 bp, Artificial Sequence
  chemically synthesized
acgagtacttgccactatgt

SEQ ID NO: 170566 - DNA, 20 bp, Artificial Sequence
  chemically synthesized
ggaaattctaacatagtggc

SEQ ID NO: 170567 - DNA, 20 bp, Artificial Sequence
  chemically synthesized
ttaggtatgtttagatgcac

SEQ ID NO: 170568 - DNA, 20 bp, Artificial Sequence
  chemically synthesized
tttctatgtttaggtatgtt

SEQ ID NO: 170569 - DNA, 20 bp, Artificial Sequence
  chemically synthesized
catctaaacatacctaaaca

SEQ ID NO: 170570 - DNA, 20 bp, Artificial Sequence
  chemically synthesized
ccatacctttttctatgttt

SEQ ID NO: 170571 - DNA, 20 bp, Artificial Sequence
  chemically synthesized
accatacctttttctatgtt

SEQ ID NO: 170572 - DNA, 20 bp, Artificial Sequence
  chemically synthesized
aacatacctaaacatagaaa

SEQ ID NO: 170573 - DNA, 20 bp, Artificial Sequence
  chemically synthesized
acatacctaaacatagaaaa

SEQ ID NO: 170574 - DNA, 20 bp, Artificial Sequence
  chemically synthesized
cctaaacatagaaaaaggta

SEQ ID NO: 170575 - DNA, 20 bp, Artificial Sequence
  chemically synthesized
taataggattataatacagt

SEQ ID NO: 170576 - DNA, 20 bp, Artificial Sequence
  chemically synthesized
ctaataggattataatacag

SEQ ID NO: 170577 - DNA, 20 bp, Artificial Sequence
  chemically synthesized
gatctaataggattataata

SEQ ID NO: 170578 - DNA, 20 bp, Artificial Sequence
  chemically synthesized
ctactgtattataatcctat

SEQ ID NO: 170579 - DNA, 20 bp, Artificial Sequence
  chemically synthesized
atatacactggtgatctaat

SEQ ID NO: 170580 - DNA, 20 bp, Artificial Sequence
  chemically synthesized
tatatacactggtgatctaa

SEQ ID NO: 170581 - DNA, 20 bp, Artificial Sequence
  chemically synthesized
ttataatcctattagatcac

SEQ ID NO: 170582 - DNA, 20 bp, Artificial Sequence
  chemically synthesized
atgataaactatatatacac

SEQ ID NO: 170583 - DNA, 20 bp, Artificial Sequence
  chemically synthesized
ttagatcaccagtgtatata

SEQ ID NO: 170584 - DNA, 20 bp, Artificial Sequence
  chemically synthesized
agtgtatatatagtttatca

SEQ ID NO: 170585 - DNA, 20 bp, Artificial Sequence
  chemically synthesized
tgctatgtgtaatgaggttt

SEQ ID NO: 170586 - DNA, 20 bp, Artificial Sequence
  chemically synthesized
cagtcatgctatgtgtaatg

SEQ ID NO: 170587 - DNA, 20 bp, Artificial Sequence
  chemically synthesized
acagtcatgctatgtgtaat

SEQ ID NO: 170588 - DNA, 20 bp, Artificial Sequence
  chemically synthesized
gaccaaaacctcattacaca

SEQ ID NO: 170589 - DNA, 20 bp, Artificial Sequence
  chemically synthesized
ttgcaatcagtgcaaaaata

SEQ ID NO: 170590 - DNA, 20 bp, Artificial Sequence
  chemically synthesized
tatcattttgacgttgcaat

SEQ ID NO: 170591 - DNA, 20 bp, Artificial Sequence
  chemically synthesized
acgtcaaaatgatacaattt

SEQ ID NO: 170592 - DNA, 20 bp, Artificial Sequence
  chemically synthesized
tgatacaattttagatacac

SEQ ID NO: 170593 - DNA, 20 bp, Artificial Sequence
  chemically synthesized
gatacaattttagatacact

SEQ ID NO: 170594 - DNA, 20 bp, Artificial Sequence
  chemically synthesized
attatatgttttatttaacc

SEQ ID NO: 170595 - DNA, 20 bp, Artificial Sequence
  chemically synthesized
ataaacaggtgaaatttatt

SEQ ID NO: 170596 - DNA, 20 bp, Artificial Sequence
  chemically synthesized
ttaaaatagtaaaaataaac

SEQ ID NO: 170597 - DNA, 20 bp, Artificial Sequence
  chemically synthesized
attaaaatagtaaaaataaa

SEQ ID NO: 170598 - DNA, 20 bp, Artificial Sequence
  chemically synthesized
tcttaatggccacattaaaa

SEQ ID NO: 170599 - DNA, 20 bp, Artificial Sequence
  chemically synthesized
ttatttttactattttaatg

SEQ ID NO: 170600 - DNA, 20 bp, Artificial Sequence
  chemically synthesized
actattttaatgtggccatt

SEQ ID NO: 170601 - DNA, 20 bp, Artificial Sequence
  chemically synthesized
atatgttattttaatcttaa

SEQ ID NO: 170602 - DNA, 20 bp, Artificial Sequence
  chemically synthesized
taagattaaaataacatatg

SEQ ID NO: 170603 - DNA, 20 bp, Artificial Sequence
  chemically synthesized
attattacagagcgtaatgt

SEQ ID NO: 170604 - DNA, 20 bp, Artificial Sequence
  chemically synthesized
gctgctattgcattattaca

SEQ ID NO: 170605 - DNA, 20 bp, Artificial Sequence
  chemically synthesized
aagctgctattgcattatta

SEQ ID NO: 170606 - DNA, 20 bp, Artificial Sequence
  chemically synthesized
tacgctctgtaataatgcaa

SEQ ID NO: 170607 - DNA, 20 bp, Artificial Sequence
  chemically synthesized
gctctgtaataatgcaatag

SEQ ID NO: 170608 - DNA, 20 bp, Artificial Sequence
  chemically synthesized
ctattcctactatagaataa

SEQ ID NO: 170609 - DNA, 20 bp, Artificial Sequence
  chemically synthesized
caatagcagcttttattcta

SEQ ID NO: 170610 - DNA, 20 bp, Artificial Sequence
  chemically synthesized
tagcagcttttattctatag

SEQ ID NO: 170611 - DNA, 20 bp, Artificial Sequence
  chemically synthesized
agcagcttttattctatagt

SEQ ID NO: 170612 - DNA, 20 bp, Artificial Sequence
  chemically synthesized
tttttctgctattcctacta

SEQ ID NO: 170613 - DNA, 20 bp, Artificial Sequence
  chemically synthesized
cttttattctatagtaggaa

SEQ ID NO: 170614 - DNA, 20 bp, Artificial Sequence
  chemically synthesized
ttattctatagtaggaatag

SEQ ID NO: 170615 - DNA, 20 bp, Artificial Sequence
  chemically synthesized
agcagaaaaatattaaatga

SEQ ID NO: 170616 - DNA, 20 bp, Artificial Sequence
  chemically synthesized
attaaatgaaagatcatcca

SEQ ID NO: 170617 - DNA, 20 bp, Artificial Sequence
  chemically synthesized
cacatgacttttgacatcta

SEQ ID NO: 170618 - DNA, 20 bp, Artificial Sequence
  chemically synthesized
agatcatccatagatgtcaa

SEQ ID NO: 170619 - DNA, 20 bp, Artificial Sequence
  chemically synthesized
atagatgtcaaaagtcatgt

SEQ ID NO: 170620 - DNA, 20 bp, Artificial Sequence
  chemically synthesized
gtcaaaagtcatgtgagttt

SEQ ID NO: 170621 - DNA, 20 bp, Artificial Sequence
  chemically synthesized
tgagttttagtatatcttct

SEQ ID NO: 170622 - DNA, 20 bp, Artificial Sequence
  chemically synthesized
tattaaaataatcaacttag

SEQ ID NO: 170623 - DNA, 20 bp, Artificial Sequence
  chemically synthesized
ttttattaaaataatcaact

SEQ ID NO: 170624 - DNA, 20 bp, Artificial Sequence
  chemically synthesized
taagttgattattttaataa

SEQ ID NO: 170625 - DNA, 20 bp, Artificial Sequence
  chemically synthesized
aagttgattattttaataaa

SEQ ID NO: 170626 - DNA, 20 bp, Artificial Sequence
  chemically synthesized
tgattattttaataaaaggt

SEQ ID NO: 170627 - DNA, 20 bp, Artificial Sequence
  chemically synthesized
attattttaataaaaggtaa

SEQ ID NO: 170628 - DNA, 20 bp, Artificial Sequence
  chemically synthesized
ttattttaataaaaggtaag

SEQ ID NO: 170629 - DNA, 20 bp, Artificial Sequence
  chemically synthesized
ttaataaaaggtaagaggta

SEQ ID NO: 170630 - DNA, 20 bp, Artificial Sequence
  chemically synthesized
aataaaaggtaagaggtaaa

SEQ ID NO: 170631 - DNA, 20 bp, Artificial Sequence
  chemically synthesized
ataaaaggtaagaggtaaag

SEQ ID NO: 170632 - DNA, 20 bp, Artificial Sequence
  chemically synthesized
aaaattgatgttatgttaat

SEQ ID NO: 170633 - DNA, 20 bp, Artificial Sequence
  chemically synthesized
agcatttatttagtgggggc

SEQ ID NO: 170634 - DNA, 20 bp, Artificial Sequence
  chemically synthesized
gttcagcatttatttagtgg

SEQ ID NO: 170635 - DNA, 20 bp, Artificial Sequence
  chemically synthesized
tgttcagcatttatttagtg

SEQ ID NO: 170636 - DNA, 20 bp, Artificial Sequence
  chemically synthesized
ttgttcagcatttatttagt

SEQ ID NO: 170637 - DNA, 20 bp, Artificial Sequence
  chemically synthesized
tttgttcagcatttatttag

SEQ ID NO: 170638 - DNA, 20 bp, Artificial Sequence
  chemically synthesized
atatttgttcagcatttatt

SEQ ID NO: 170639 - DNA, 20 bp, Artificial Sequence
  chemically synthesized
gcttgcttaaaatatttgtt

SEQ ID NO: 170640 - DNA, 20 bp, Artificial Sequence
  chemically synthesized
aaatgctgaacaaatatttt

SEQ ID NO: 170641 - DNA, 20 bp, Artificial Sequence
  chemically synthesized
gctgaacaaatattttaagc

SEQ ID NO: 170642 - DNA, 20 bp, Artificial Sequence
  chemically synthesized
atattttaagcaagcgtatg

SEQ ID NO: 170643 - DNA, 20 bp, Artificial Sequence
  chemically synthesized
tattttaagcaagcgtatga

SEQ ID NO: 170644 - DNA, 20 bp, Artificial Sequence
  chemically synthesized
ttttaagcaagcgtatgaag

SEQ ID NO: 170645 - DNA, 20 bp, Artificial Sequence
  chemically synthesized
gcgtatgaaggagcatcaaa

SEQ ID NO: 170646 - DNA, 20 bp, Artificial Sequence
  chemically synthesized
tatgaaggagcatcaaatag

SEQ ID NO: 170647 - DNA, 20 bp, Artificial Sequence
  chemically synthesized
ggggacaccttgttcaagac

SEQ ID NO: 170648 - DNA, 20 bp, Artificial Sequence
  chemically synthesized
aatagtagcttgtcttgaac

SEQ ID NO: 170649 - DNA, 20 bp, Artificial Sequence
  chemically synthesized
atagtagcttgtcttgaaca

SEQ ID NO: 170650 - DNA, 20 bp, Artificial Sequence
  chemically synthesized
acactggggacaccttgttc

SEQ ID NO: 170651 - DNA, 20 bp, Artificial Sequence
  chemically synthesized
tgtcttgaacaaggtgtccc

SEQ ID NO: 170652 - DNA, 20 bp, Artificial Sequence
  chemically synthesized
tgagtctaggaaacacactg

SEQ ID NO: 170653 - DNA, 20 bp, Artificial Sequence
  chemically synthesized
atgagtctaggaaacacact

SEQ ID NO: 170654 - DNA, 20 bp, Artificial Sequence
  chemically synthesized
aatgagtctaggaaacacac

SEQ ID NO: 170655 - DNA, 20 bp, Artificial Sequence
  chemically synthesized
ggtgtccccagtgtgtttcc

SEQ ID NO: 170656 - DNA, 20 bp, Artificial Sequence
  chemically synthesized
tgcttcttttcaatgagtct

SEQ ID NO: 170657 - DNA, 20 bp, Artificial Sequence
  chemically synthesized
ttgcttcttttcaatgagtc

SEQ ID NO: 170658 - DNA, 20 bp, Artificial Sequence
  chemically synthesized
tgtttcctagactcattgaa

SEQ ID NO: 170659 - DNA, 20 bp, Artificial Sequence
  chemically synthesized
taaggttgcttcttttcaat

SEQ ID NO: 170660 - DNA, 20 bp, Artificial Sequence
  chemically synthesized
ttcctagactcattgaaaag

SEQ ID NO: 170661 - DNA, 20 bp, Artificial Sequence
  chemically synthesized
acatgggattaacatacgta

SEQ ID NO: 170662 - DNA, 20 bp, Artificial Sequence
  chemically synthesized
cacatgggattaacatacgt

SEQ ID NO: 170663 - DNA, 20 bp, Artificial Sequence
  chemically synthesized
ttacgtatgttaatcccatg

SEQ ID NO: 170664 - DNA, 20 bp, Artificial Sequence
  chemically synthesized
aggccagaaattaaccacat

SEQ ID NO: 170665 - DNA, 20 bp, Artificial Sequence
  chemically synthesized
gaggccagaaattaaccaca

SEQ ID NO: 170666 - DNA, 20 bp, Artificial Sequence
  chemically synthesized
aatcccatgtggttaatttc

SEQ ID NO: 170667 - DNA, 20 bp, Artificial Sequence
  chemically synthesized
gatcaattaaacatggaggc

SEQ ID NO: 170668 - DNA, 20 bp, Artificial Sequence
  chemically synthesized
gagagatcaattaaacatgg

SEQ ID NO: 170669 - DNA, 20 bp, Artificial Sequence
  chemically synthesized
tgagagatcaattaaacatg

SEQ ID NO: 170670 - DNA, 20 bp, Artificial Sequence
  chemically synthesized
tatgagagatcaattaaaca

SEQ ID NO: 170671 - DNA, 20 bp, Artificial Sequence
  chemically synthesized
gtttaattgatctctcatac

SEQ ID NO: 170672 - DNA, 20 bp, Artificial Sequence
  chemically synthesized
tttaattgatctctcatact

SEQ ID NO: 170673 - DNA, 20 bp, Artificial Sequence
  chemically synthesized
ggctagaggccctagtatga

SEQ ID NO: 170674 - DNA, 20 bp, Artificial Sequence
  chemically synthesized
ttaattgatctctcatacta

SEQ ID NO: 170675 - DNA, 20 bp, Artificial Sequence
  chemically synthesized
gtggctagaggccctagtat

SEQ ID NO: 170676 - DNA, 20 bp, Artificial Sequence
  chemically synthesized
atctctcatactagggcctc

SEQ ID NO: 170677 - DNA, 20 bp, Artificial Sequence
  chemically synthesized
aggacggtggctagaggccc

SEQ ID NO: 170678 - DNA, 20 bp, Artificial Sequence
  chemically synthesized
ccttggaggacggtggctag

SEQ ID NO: 170679 - DNA, 20 bp, Artificial Sequence
  chemically synthesized
accttggaggacggtggcta

SEQ ID NO: 170680 - DNA, 20 bp, Artificial Sequence
  chemically synthesized
caaccttggaggacggtggc

SEQ ID NO: 170681 - DNA, 20 bp, Artificial Sequence
  chemically synthesized
tgcacaaccttggaggacgg

SEQ ID NO: 170682 - DNA, 20 bp, Artificial Sequence
  chemically synthesized
gcctctagccaccgtcctcc

SEQ ID NO: 170683 - DNA, 20 bp, Artificial Sequence
  chemically synthesized
cctctagccaccgtcctcca

SEQ ID NO: 170684 - DNA, 20 bp, Artificial Sequence
  chemically synthesized
tcatgcacaaccttggagga

SEQ ID NO: 170685 - DNA, 20 bp, Artificial Sequence
  chemically synthesized
ggtttcatgcacaaccttgg

SEQ ID NO: 170686 - DNA, 20 bp, Artificial Sequence
  chemically synthesized
tggtttcatgcacaaccttg

SEQ ID NO: 170687 - DNA, 20 bp, Artificial Sequence
  chemically synthesized
tctggtttcatgcacaacct

SEQ ID NO: 170688 - DNA, 20 bp, Artificial Sequence
  chemically synthesized
tccaaggttgtgcatgaaac

SEQ ID NO: 170689 - DNA, 20 bp, Artificial Sequence
  chemically synthesized
cagacaaaactgtagggttc

SEQ ID NO: 170690 - DNA, 20 bp, Artificial Sequence
  chemically synthesized
tgcatgaaaccagaacccta

SEQ ID NO: 170691 - DNA, 20 bp, Artificial Sequence
  chemically synthesized
gtgcttcagacaaaactgta

SEQ ID NO: 170692 - DNA, 20 bp, Artificial Sequence
  chemically synthesized
tgtgcttcagacaaaactgt

SEQ ID NO: 170693 - DNA, 20 bp, Artificial Sequence
  chemically synthesized
gtgtgcttcagacaaaactg

SEQ ID NO: 170694 - DNA, 20 bp, Artificial Sequence
  chemically synthesized
gaaccctacagttttgtctg

SEQ ID NO: 170695 - DNA, 20 bp, Artificial Sequence
  chemically synthesized
gtaggacaagcagtgtgctt

SEQ ID NO: 170696 - DNA, 20 bp, Artificial Sequence
  chemically synthesized
ggccaaaaatgtaggacaag

SEQ ID NO: 170697 - DNA, 20 bp, Artificial Sequence
  chemically synthesized
gggggccaaaaatgtaggac

SEQ ID NO: 170698 - DNA, 20 bp, Artificial Sequence
  chemically synthesized
cactgcttgtcctacatttt

SEQ ID NO: 170699 - DNA, 20 bp, Artificial Sequence
  chemically synthesized
agcctgggggccaaaaatgt

SEQ ID NO: 170700 - DNA, 20 bp, Artificial Sequence
  chemically synthesized
cagcctgggggccaaaaatg

SEQ ID NO: 170701 - DNA, 20 bp, Artificial Sequence
  chemically synthesized
tgtcctacatttttggcccc

SEQ ID NO: 170702 - DNA, 20 bp, Artificial Sequence
  chemically synthesized
gtcctacatttttggccccc

SEQ ID NO: 170703 - DNA, 20 bp, Artificial Sequence
  chemically synthesized
ttgcgtgatatgcagcctgg

SEQ ID NO: 170704 - DNA, 20 bp, Artificial Sequence
  chemically synthesized
gttgcgtgatatgcagcctg

SEQ ID NO: 170705 - DNA, 20 bp, Artificial Sequence
  chemically synthesized
ggttgcgtgatatgcagcct

SEQ ID NO: 170706 - DNA, 20 bp, Artificial Sequence
  chemically synthesized
gggttgcgtgatatgcagcc

SEQ ID NO: 170707 - DNA, 20 bp, Artificial Sequence
  chemically synthesized
aaatagggttgcgtgatatg

SEQ ID NO: 170708 - DNA, 20 bp, Artificial Sequence
  chemically synthesized
ccagaagttaatgaaaaata

SEQ ID NO: 170709 - DNA, 20 bp, Artificial Sequence
  chemically synthesized
accagaagttaatgaaaaat

SEQ ID NO: 170710 - DNA, 20 bp, Artificial Sequence
  chemically synthesized
gaccagaagttaatgaaaaa

SEQ ID NO: 170711 - DNA, 20 bp, Artificial Sequence
  chemically synthesized
ccctatttttcattaacttc

SEQ ID NO: 170712 - DNA, 20 bp, Artificial Sequence
  chemically synthesized
ttttcattaacttctggtct

SEQ ID NO: 170713 - DNA, 20 bp, Artificial Sequence
  chemically synthesized
taccttccccctcagaccag

SEQ ID NO: 170714 - DNA, 20 bp, Artificial Sequence
  chemically synthesized
tttcattaacttctggtctg

SEQ ID NO: 170715 - DNA, 20 bp, Artificial Sequence
  chemically synthesized
ttcattaacttctggtctga

SEQ ID NO: 170716 - DNA, 20 bp, Artificial Sequence
  chemically synthesized
tcattaacttctggtctgag

SEQ ID NO: 170717 - DNA, 20 bp, Artificial Sequence
  chemically synthesized
cagtaccttccccctcagac

SEQ ID NO: 170718 - DNA, 20 bp, Artificial Sequence
  chemically synthesized
cattaacttctggtctgagg

SEQ ID NO: 170719 - DNA, 20 bp, Artificial Sequence
  chemically synthesized
taacttctggtctgaggggg

SEQ ID NO: 170720 - DNA, 20 bp, Artificial Sequence
  chemically synthesized
aacttctggtctgaggggga

SEQ ID NO: 170721 - DNA, 20 bp, Artificial Sequence
  chemically synthesized
tttttcagtaccttccccct

SEQ ID NO: 170722 - DNA, 20 bp, Artificial Sequence
  chemically synthesized
gagggggaaggtactgaaaa

SEQ ID NO: 170723 - DNA, 20 bp, Artificial Sequence
  chemically synthesized
agggggaaggtactgaaaaa

SEQ ID NO: 170724 - DNA, 20 bp, Artificial Sequence
  chemically synthesized
agtacagctcttcctttttt

SEQ ID NO: 170725 - DNA, 20 bp, Artificial Sequence
  chemically synthesized
gggaaggtactgaaaaaagg

SEQ ID NO: 170726 - DNA, 20 bp, Artificial Sequence
  chemically synthesized
gaaggtactgaaaaaaggaa

SEQ ID NO: 170727 - DNA, 20 bp, Artificial Sequence
  chemically synthesized
acagtaacattattcaagta

SEQ ID NO: 170728 - DNA, 20 bp, Artificial Sequence
  chemically synthesized
gtgtgacagtaacattattc

SEQ ID NO: 170729 - DNA, 20 bp, Artificial Sequence
  chemically synthesized
tttcccctttttttgtgtga

SEQ ID NO: 170730 - DNA, 20 bp, Artificial Sequence
  chemically synthesized
atgttactgtcacacaaaaa

SEQ ID NO: 170731 - DNA, 20 bp, Artificial Sequence
  chemically synthesized
tgttactgtcacacaaaaaa

SEQ ID NO: 170732 - DNA, 20 bp, Artificial Sequence
  chemically synthesized
gttactgtcacacaaaaaaa

SEQ ID NO: 170733 - DNA, 20 bp, Artificial Sequence
  chemically synthesized
ttactgtcacacaaaaaaag

SEQ ID NO: 170734 - DNA, 20 bp, Artificial Sequence
  chemically synthesized
tgtcacacaaaaaaagggga

SEQ ID NO: 170735 - DNA, 20 bp, Artificial Sequence
  chemically synthesized
gtcacacaaaaaaaggggaa

SEQ ID NO: 170736 - DNA, 20 bp, Artificial Sequence
  chemically synthesized
tcacacaaaaaaaggggaaa

SEQ ID NO: 170737 - DNA, 20 bp, Artificial Sequence
  chemically synthesized
acacaaaaaaaggggaaagg

SEQ ID NO: 170738 - DNA, 20 bp, Artificial Sequence
  chemically synthesized
cacaaaaaaaggggaaaggg

SEQ ID NO: 170739 - DNA, 20 bp, Artificial Sequence
  chemically synthesized
acaaaaaaaggggaaaggga

SEQ ID NO: 170740 - DNA, 20 bp, Artificial Sequence
  chemically synthesized
aaaaaaaggggaaagggagg

SEQ ID NO: 170741 - DNA, 20 bp, Artificial Sequence
  chemically synthesized
aaaaaaggggaaagggaggg

SEQ ID NO: 170742 - DNA, 20 bp, Artificial Sequence
  chemically synthesized
aaaaaggggaaagggaggga

SEQ ID NO: 170743 - DNA, 20 bp, Artificial Sequence
  chemically synthesized
aaaggggaaagggagggagg

SEQ ID NO: 170744 - DNA, 20 bp, Artificial Sequence
  chemically synthesized
aaggggaaagggagggaggg

SEQ ID NO: 170745 - DNA, 20 bp, Artificial Sequence
  chemically synthesized
aggggaaagggagggaggga

SEQ ID NO: 170746 - DNA, 20 bp, Artificial Sequence
  chemically synthesized
aaagggagggagggagggaa

SEQ ID NO: 170747 - DNA, 20 bp, Artificial Sequence
  chemically synthesized
agggagggagggaaaagacc

SEQ ID NO: 170748 - DNA, 20 bp, Artificial Sequence
  chemically synthesized
gagacccgggaatggaggcc

SEQ ID NO: 170749 - DNA, 20 bp, Artificial Sequence
  chemically synthesized
tgagacccgggaatggaggc

SEQ ID NO: 170750 - DNA, 20 bp, Artificial Sequence
  chemically synthesized
aaagacctggcctccattcc

SEQ ID NO: 170751 - DNA, 20 bp, Artificial Sequence
  chemically synthesized
catctgagacccgggaatgg

SEQ ID NO: 170752 - DNA, 20 bp, Artificial Sequence
  chemically synthesized
aagacctggcctccattccc

SEQ ID NO: 170753 - DNA, 20 bp, Artificial Sequence
  chemically synthesized
tcatctgagacccgggaatg

SEQ ID NO: 170754 - DNA, 20 bp, Artificial Sequence
  chemically synthesized
cctcatctgagacccgggaa

SEQ ID NO: 170755 - DNA, 20 bp, Artificial Sequence
  chemically synthesized
tggcctccattcccgggtct

SEQ ID NO: 170756 - DNA, 20 bp, Artificial Sequence
  chemically synthesized
ggcatcctcatctgagaccc

SEQ ID NO: 170757 - DNA, 20 bp, Artificial Sequence
  chemically synthesized
aggcatcctcatctgagacc

SEQ ID NO: 170758 - DNA, 20 bp, Artificial Sequence
  chemically synthesized
tccattcccgggtctcagat

SEQ ID NO: 170759 - DNA, 20 bp, Artificial Sequence
  chemically synthesized
ccattcccgggtctcagatg

SEQ ID NO: 170760 - DNA, 20 bp, Artificial Sequence
  chemically synthesized
accaccaggcatcctcatct

SEQ ID NO: 170761 - DNA, 20 bp, Artificial Sequence
  chemically synthesized
gggtctcagatgaggatgcc

SEQ ID NO: 170762 - DNA, 20 bp, Artificial Sequence
  chemically synthesized
tctcagatgaggatgcctgg

SEQ ID NO: 170763 - DNA, 20 bp, Artificial Sequence
  chemically synthesized
cagatgaggatgcctggtgg

SEQ ID NO: 170764 - DNA, 20 bp, Artificial Sequence
  chemically synthesized
ctacaagggaaactaccacc

SEQ ID NO: 170765 - DNA, 20 bp, Artificial Sequence
  chemically synthesized
cctacaagggaaactaccac

SEQ ID NO: 170766 - DNA, 20 bp, Artificial Sequence
  chemically synthesized
cctggtggtagtttcccttg

SEQ ID NO: 170767 - DNA, 20 bp, Artificial Sequence
  chemically synthesized
ctggtggtagtttcccttgt

SEQ ID NO: 170768 - DNA, 20 bp, Artificial Sequence
  chemically synthesized
ggtggtagtttcccttgtag

SEQ ID NO: 170769 - DNA, 20 bp, Artificial Sequence
  chemically synthesized
gtggtagtttcccttgtagg

SEQ ID NO: 170770 - DNA, 20 bp, Artificial Sequence
  chemically synthesized
cctgcctatccctcctacaa

SEQ ID NO: 170771 - DNA, 20 bp, Artificial Sequence
  chemically synthesized
tggtagtttcccttgtagga

SEQ ID NO: 170772 - DNA, 20 bp, Artificial Sequence
  chemically synthesized
ccctgcctatccctcctaca

SEQ ID NO: 170773 - DNA, 20 bp, Artificial Sequence
  chemically synthesized
accctgcctatccctcctac

SEQ ID NO: 170774 - DNA, 20 bp, Artificial Sequence
  chemically synthesized
agtttcccttgtaggaggga

SEQ ID NO: 170775 - DNA, 20 bp, Artificial Sequence
  chemically synthesized
gtttcccttgtaggagggat

SEQ ID NO: 170776 - DNA, 20 bp, Artificial Sequence
  chemically synthesized
tcccttgtaggagggatagg

SEQ ID NO: 170777 - DNA, 20 bp, Artificial Sequence
  chemically synthesized
cccttgtaggagggataggc

SEQ ID NO: 170778 - DNA, 20 bp, Artificial Sequence
  chemically synthesized
ccttgtaggagggataggca

SEQ ID NO: 170779 - DNA, 20 bp, Artificial Sequence
  chemically synthesized
gagggataggcagggtaatc

SEQ ID NO: 170780 - DNA, 20 bp, Artificial Sequence
  chemically synthesized
agggataggcagggtaatca

SEQ ID NO: 170781 - DNA, 20 bp, Artificial Sequence
  chemically synthesized
gggataggcagggtaatcaa

SEQ ID NO: 170782 - DNA, 20 bp, Artificial Sequence
  chemically synthesized
ataggcagggtaatcaaggg

SEQ ID NO: 170783 - DNA, 20 bp, Artificial Sequence
  chemically synthesized
taggcagggtaatcaaggga

SEQ ID NO: 170784 - DNA, 20 bp, Artificial Sequence
  chemically synthesized
cagggtaatcaagggaagga

SEQ ID NO: 170785 - DNA, 20 bp, Artificial Sequence
  chemically synthesized
gggtaatcaagggaaggaaa

SEQ ID NO: 170786 - DNA, 20 bp, Artificial Sequence
  chemically synthesized
gtaatcaagggaaggaaaga

SEQ ID NO: 170787 - DNA, 20 bp, Artificial Sequence
  chemically synthesized
aatcaagggaaggaaagaga

SEQ ID NO: 170788 - DNA, 20 bp, Artificial Sequence
  chemically synthesized
tcaagggaaggaaagagaga

SEQ ID NO: 170789 - DNA, 20 bp, Artificial Sequence
  chemically synthesized
caagggaaggaaagagagag

SEQ ID NO: 170790 - DNA, 20 bp, Artificial Sequence
  chemically synthesized
aggaaagagagagaggcatg

SEQ ID NO: 170791 - DNA, 20 bp, Artificial Sequence
  chemically synthesized
gagagaggcatgtggcgaaa

SEQ ID NO: 170792 - DNA, 20 bp, Artificial Sequence
  chemically synthesized
agagaggcatgtggcgaaaa

SEQ ID NO: 170793 - DNA, 20 bp, Artificial Sequence
  chemically synthesized
gagaggcatgtggcgaaaaa

SEQ ID NO: 170794 - DNA, 20 bp, Artificial Sequence
  chemically synthesized
aggcatgtggcgaaaaaggg

SEQ ID NO: 170795 - DNA, 20 bp, Artificial Sequence
  chemically synthesized
atgtggcgaaaaagggaagt

SEQ ID NO: 170796 - DNA, 20 bp, Artificial Sequence
  chemically synthesized
gtggcgaaaaagggaagtga

SEQ ID NO: 170797 - DNA, 20 bp, Artificial Sequence
  chemically synthesized
gaaaaagggaagtgagagtt

SEQ ID NO: 170798 - DNA, 20 bp, Artificial Sequence
  chemically synthesized
aaaaagggaagtgagagttg

SEQ ID NO: 170799 - DNA, 20 bp, Artificial Sequence
  chemically synthesized
aaaagggaagtgagagttga

SEQ ID NO: 170800 - DNA, 20 bp, Artificial Sequence
  chemically synthesized
tgagagttgagggattacac

SEQ ID NO: 170801 - DNA, 20 bp, Artificial Sequence
  chemically synthesized
ccttcccctgcatgcagcac

SEQ ID NO: 170802 - DNA, 20 bp, Artificial Sequence
  chemically synthesized
gattacactagtgctgcatg

SEQ ID NO: 170803 - DNA, 20 bp, Artificial Sequence
  chemically synthesized
attacactagtgctgcatgc

SEQ ID NO: 170804 - DNA, 20 bp, Artificial Sequence
  chemically synthesized
ttacactagtgctgcatgca

SEQ ID NO: 170805 - DNA, 20 bp, Artificial Sequence
  chemically synthesized
tacactagtgctgcatgcag

SEQ ID NO: 170806 - DNA, 20 bp, Artificial Sequence
  chemically synthesized
actgtcccttcccctgcatg

SEQ ID NO: 170807 - DNA, 20 bp, Artificial Sequence
  chemically synthesized
actagtgctgcatgcagggg

SEQ ID NO: 170808 - DNA, 20 bp, Artificial Sequence
  chemically synthesized
ctagtgctgcatgcagggga

SEQ ID NO: 170809 - DNA, 20 bp, Artificial Sequence
  chemically synthesized
tagtgctgcatgcaggggaa

SEQ ID NO: 170810 - DNA, 20 bp, Artificial Sequence
  chemically synthesized
gctgcatgcaggggaaggga

SEQ ID NO: 170811 - DNA, 20 bp, Artificial Sequence
  chemically synthesized
ggggaagggacagtaactaa

SEQ ID NO: 170812 - DNA, 20 bp, Artificial Sequence
  chemically synthesized
ggaagggacagtaactaaca

SEQ ID NO: 170813 - DNA, 20 bp, Artificial Sequence
  chemically synthesized
gaagggacagtaactaacag

SEQ ID NO: 170814 - DNA, 20 bp, Artificial Sequence
  chemically synthesized
cctgacttccaaacctctgt

SEQ ID NO: 170815 - DNA, 20 bp, Artificial Sequence
  chemically synthesized
gacagtaactaacagaggtt

SEQ ID NO: 170816 - DNA, 20 bp, Artificial Sequence
  chemically synthesized
agtaactaacagaggtttgg

SEQ ID NO: 170817 - DNA, 20 bp, Artificial Sequence
  chemically synthesized
actaacagaggtttggaagt

SEQ ID NO: 170818 - DNA, 20 bp, Artificial Sequence
  chemically synthesized
ctaacagaggtttggaagtc

SEQ ID NO: 170819 - DNA, 20 bp, Artificial Sequence
  chemically synthesized
tagaggtggtattagaagtc

SEQ ID NO: 170820 - DNA, 20 bp, Artificial Sequence
  chemically synthesized
gtagaggtggtattagaagt

SEQ ID NO: 170821 - DNA, 20 bp, Artificial Sequence
  chemically synthesized
agcggtagaggtggtattag

SEQ ID NO: 170822 - DNA, 20 bp, Artificial Sequence
  chemically synthesized
agtagcggtagaggtggtat

SEQ ID NO: 170823 - DNA, 20 bp, Artificial Sequence
  chemically synthesized
tctataagtagcggtagagg

SEQ ID NO: 170824 - DNA, 20 bp, Artificial Sequence
  chemically synthesized
gattctataagtagcggtag

SEQ ID NO: 170825 - DNA, 20 bp, Artificial Sequence
  chemically synthesized
ggattctataagtagcggta

SEQ ID NO: 170826 - DNA, 20 bp, Artificial Sequence
  chemically synthesized
tcggattctataagtagcgg

SEQ ID NO: 170827 - DNA, 20 bp, Artificial Sequence
  chemically synthesized
accacctctaccgctactta

SEQ ID NO: 170828 - DNA, 20 bp, Artificial Sequence
  chemically synthesized
ccctcggattctataagtag

SEQ ID NO: 170829 - DNA, 20 bp, Artificial Sequence
  chemically synthesized
aggccctcggattctataag

SEQ ID NO: 170830 - DNA, 20 bp, Artificial Sequence
  chemically synthesized
ggaaggccctcggattctat

SEQ ID NO: 170831 - DNA, 20 bp, Artificial Sequence
  chemically synthesized
taccgctacttatagaatcc

SEQ ID NO: 170832 - DNA, 20 bp, Artificial Sequence
  chemically synthesized
accgctacttatagaatccg

SEQ ID NO: 170833 - DNA, 20 bp, Artificial Sequence
  chemically synthesized
ccgctacttatagaatccga

SEQ ID NO: 170834 - DNA, 20 bp, Artificial Sequence
  chemically synthesized
ggatactcagggaaggccct

SEQ ID NO: 170835 - DNA, 20 bp, Artificial Sequence
  chemically synthesized
agaatccgagggccttccct

SEQ ID NO: 170836 - DNA, 20 bp, Artificial Sequence
  chemically synthesized
gttccaaggatactcaggga

SEQ ID NO: 170837 - DNA, 20 bp, Artificial Sequence
  chemically synthesized
agttccaaggatactcaggg

SEQ ID NO: 170838 - DNA, 20 bp, Artificial Sequence
  chemically synthesized
ttcagttccaaggatactca

SEQ ID NO: 170839 - DNA, 20 bp, Artificial Sequence
  chemically synthesized
tttcagttccaaggatactc

SEQ ID NO: 170840 - DNA, 20 bp, Artificial Sequence
  chemically synthesized
ttttcagttccaaggatact

SEQ ID NO: 170841 - DNA, 20 bp, Artificial Sequence
  chemically synthesized
gggccttccctgagtatcct

SEQ ID NO: 170842 - DNA, 20 bp, Artificial Sequence
  chemically synthesized
gtctgcatttttcagttcca

SEQ ID NO: 170843 - DNA, 20 bp, Artificial Sequence
  chemically synthesized
tgtctgcatttttcagttcc

SEQ ID NO: 170844 - DNA, 20 bp, Artificial Sequence
  chemically synthesized
atccttggaactgaaaaatg

SEQ ID NO: 170845 - DNA, 20 bp, Artificial Sequence
  chemically synthesized
gatcaaatgtctgcattttt

SEQ ID NO: 170846 - DNA, 20 bp, Artificial Sequence
  chemically synthesized
gaaaaatgcagacatttgat

SEQ ID NO: 170847 - DNA, 20 bp, Artificial Sequence
  chemically synthesized
catttgatcagattaattct

SEQ ID NO: 170848 - DNA, 20 bp, Artificial Sequence
  chemically synthesized
atttgatcagattaattctg

SEQ ID NO: 170849 - DNA, 20 bp, Artificial Sequence
  chemically synthesized
agtcaagctagaagggacct

SEQ ID NO: 170850 - DNA, 20 bp, Artificial Sequence
  chemically synthesized
attaattctgaggtcccttc

SEQ ID NO: 170851 - DNA, 20 bp, Artificial Sequence
  chemically synthesized
gtggaacagtcaagctagaa

SEQ ID NO: 170852 - DNA, 20 bp, Artificial Sequence
  chemically synthesized
tgtggaacagtcaagctaga

SEQ ID NO: 170853 - DNA, 20 bp, Artificial Sequence
  chemically synthesized
ttgtggaacagtcaagctag

SEQ ID NO: 170854 - DNA, 20 bp, Artificial Sequence
  chemically synthesized
tgtttgtggaacagtcaagc

SEQ ID NO: 170855 - DNA, 20 bp, Artificial Sequence
  chemically synthesized
aaaatgtttgtggaacagtc

SEQ ID NO: 170856 - DNA, 20 bp, Artificial Sequence
  chemically synthesized
gagacaaaatgtttgtggaa

SEQ ID NO: 170857 - DNA, 20 bp, Artificial Sequence
  chemically synthesized
tgccagagacaaaatgtttg

SEQ ID NO: 170858 - DNA, 20 bp, Artificial Sequence
  chemically synthesized
ttccacaaacattttgtctc

SEQ ID NO: 170859 - DNA, 20 bp, Artificial Sequence
  chemically synthesized
cacaaacattttgtctctgg

SEQ ID NO: 170860 - DNA, 20 bp, Artificial Sequence
  chemically synthesized
acaaacattttgtctctggc

SEQ ID NO: 170861 - DNA, 20 bp, Artificial Sequence
  chemically synthesized
caaacattttgtctctggca

SEQ ID NO: 170862 - DNA, 20 bp, Artificial Sequence
  chemically synthesized
tactcctccattccctgcca

SEQ ID NO: 170863 - DNA, 20 bp, Artificial Sequence
  chemically synthesized
tatactcctccattccctgc

SEQ ID NO: 170864 - DNA, 20 bp, Artificial Sequence
  chemically synthesized
attttgtctctggcagggaa

SEQ ID NO: 170865 - DNA, 20 bp, Artificial Sequence
  chemically synthesized
tttgtctctggcagggaatg

SEQ ID NO: 170866 - DNA, 20 bp, Artificial Sequence
  chemically synthesized
ttgtctctggcagggaatgg

SEQ ID NO: 170867 - DNA, 20 bp, Artificial Sequence
  chemically synthesized
gtctctggcagggaatggag

SEQ ID NO: 170868 - DNA, 20 bp, Artificial Sequence
  chemically synthesized
agggaatggaggagtataca

SEQ ID NO: 170869 - DNA, 20 bp, Artificial Sequence
  chemically synthesized
gaagctcagtgacacgttca

SEQ ID NO: 170870 - DNA, 20 bp, Artificial Sequence
  chemically synthesized
tgaagctcagtgacacgttc

SEQ ID NO: 170871 - DNA, 20 bp, Artificial Sequence
  chemically synthesized
ttgaagctcagtgacacgtt

SEQ ID NO: 170872 - DNA, 20 bp, Artificial Sequence
  chemically synthesized
acagccctgaacgtgtcact

SEQ ID NO: 170873 - DNA, 20 bp, Artificial Sequence
  chemically synthesized
tgaacgtgtcactgagcttc

SEQ ID NO: 170874 - DNA, 20 bp, Artificial Sequence
  chemically synthesized
gtctttgtcttcttgaagct

SEQ ID NO: 170875 - DNA, 20 bp, Artificial Sequence
  chemically synthesized
acgtgtcactgagcttcaag

SEQ ID NO: 170876 - DNA, 20 bp, Artificial Sequence
  chemically synthesized
acacagtctttgtcttcttg

SEQ ID NO: 170877 - DNA, 20 bp, Artificial Sequence
  chemically synthesized
cactgagcttcaagaagaca

SEQ ID NO: 170878 - DNA, 20 bp, Artificial Sequence
  chemically synthesized
atccaggtgtcaggcagaca

SEQ ID NO: 170879 - DNA, 20 bp, Artificial Sequence
  chemically synthesized
acaggcatccaggtgtcagg

SEQ ID NO: 170880 - DNA, 20 bp, Artificial Sequence
  chemically synthesized
gactgtgtctgcctgacacc

SEQ ID NO: 170881 - DNA, 20 bp, Artificial Sequence
  chemically synthesized
ttcacaggcatccaggtgtc

SEQ ID NO: 170882 - DNA, 20 bp, Artificial Sequence
  chemically synthesized
gttcacaggcatccaggtgt

SEQ ID NO: 170883 - DNA, 20 bp, Artificial Sequence
  chemically synthesized
ttttgtgttcacaggcatcc

SEQ ID NO: 170884 - DNA, 20 bp, Artificial Sequence
  chemically synthesized
cttttgtgttcacaggcatc

SEQ ID NO: 170885 - DNA, 20 bp, Artificial Sequence
  chemically synthesized
agaagatcttttgtgttcac

SEQ ID NO: 170886 - DNA, 20 bp, Artificial Sequence
  chemically synthesized
gagaagatcttttgtgttca

SEQ ID NO: 170887 - DNA, 20 bp, Artificial Sequence
  chemically synthesized
ctggatgcctgtgaacacaa

SEQ ID NO: 170888 - DNA, 20 bp, Artificial Sequence
  chemically synthesized
gaacacaaaagatcttctct

SEQ ID NO: 170889 - DNA, 20 bp, Artificial Sequence
  chemically synthesized
aacacaaaagatcttctctg

SEQ ID NO: 170890 - DNA, 20 bp, Artificial Sequence
  chemically synthesized
acacaaaagatcttctctga

SEQ ID NO: 170891 - DNA, 20 bp, Artificial Sequence
  chemically synthesized
ctcccaataaaccctcagag

SEQ ID NO: 170892 - DNA, 20 bp, Artificial Sequence
  chemically synthesized
aagctcccaataaaccctca

SEQ ID NO: 170893 - DNA, 20 bp, Artificial Sequence
  chemically synthesized
acaagctcccaataaaccct

SEQ ID NO: 170894 - DNA, 20 bp, Artificial Sequence
  chemically synthesized
gatcttctctgagggtttat

SEQ ID NO: 170895 - DNA, 20 bp, Artificial Sequence
  chemically synthesized
atcttctctgagggtttatt

SEQ ID NO: 170896 - DNA, 20 bp, Artificial Sequence
  chemically synthesized
cttctctgagggtttattgg

SEQ ID NO: 170897 - DNA, 20 bp, Artificial Sequence
  chemically synthesized
tttattgggagcttgtgaca

SEQ ID NO: 170898 - DNA, 20 bp, Artificial Sequence
  chemically synthesized
ttattgggagcttgtgacat

SEQ ID NO: 170899 - DNA, 20 bp, Artificial Sequence
  chemically synthesized
acattttaggcctatgtcac

SEQ ID NO: 170900 - DNA, 20 bp, Artificial Sequence
  chemically synthesized
tgtgacataggcctaaaatg

SEQ ID NO: 170901 - DNA, 20 bp, Artificial Sequence
  chemically synthesized
cacaggattttccacatttt

SEQ ID NO: 170902 - DNA, 20 bp, Artificial Sequence
  chemically synthesized
tcacaggattttccacattt

SEQ ID NO: 170903 - DNA, 20 bp, Artificial Sequence
  chemically synthesized
tgtggaaaatcctgtgacaa

SEQ ID NO: 170904 - DNA, 20 bp, Artificial Sequence
  chemically synthesized
acagggtatcctgttgtcac

SEQ ID NO: 170905 - DNA, 20 bp, Artificial Sequence
  chemically synthesized
gtggaaaatcctgtgacaac

SEQ ID NO: 170906 - DNA, 20 bp, Artificial Sequence
  chemically synthesized
gacagggtatcctgttgtca

SEQ ID NO: 170907 - DNA, 20 bp, Artificial Sequence
  chemically synthesized
tacatctgcttagggtgaca

SEQ ID NO: 170908 - DNA, 20 bp, Artificial Sequence
  chemically synthesized
ttacatctgcttagggtgac

SEQ ID NO: 170909 - DNA, 20 bp, Artificial Sequence
  chemically synthesized
acaggataccctgtcaccct

SEQ ID NO: 170910 - DNA, 20 bp, Artificial Sequence
  chemically synthesized
cttacatctgcttagggtga

SEQ ID NO: 170911 - DNA, 20 bp, Artificial Sequence
  chemically synthesized
ggataccctgtcaccctaag

SEQ ID NO: 170912 - DNA, 20 bp, Artificial Sequence
  chemically synthesized
attaagcttacatctgctta

SEQ ID NO: 170913 - DNA, 20 bp, Artificial Sequence
  chemically synthesized
aattaagcttacatctgctt

SEQ ID NO: 170914 - DNA, 20 bp, Artificial Sequence
  chemically synthesized
aaattaagcttacatctgct

SEQ ID NO: 170915 - DNA, 20 bp, Artificial Sequence
  chemically synthesized
ctgtcaccctaagcagatgt

SEQ ID NO: 170916 - DNA, 20 bp, Artificial Sequence
  chemically synthesized
atcttgctgtgaagaaaatt

SEQ ID NO: 170917 - DNA, 20 bp, Artificial Sequence
  chemically synthesized
tgtaagcttaattttcttca

SEQ ID NO: 170918 - DNA, 20 bp, Artificial Sequence
  chemically synthesized
agcttaattttcttcacagc

SEQ ID NO: 170919 - DNA, 20 bp, Artificial Sequence
  chemically synthesized
ttgctcattatcttgctgtg

SEQ ID NO: 170920 - DNA, 20 bp, Artificial Sequence
  chemically synthesized
tttcttcacagcaagataat

SEQ ID NO: 170921 - DNA, 20 bp, Artificial Sequence
  chemically synthesized
cacagcaagataatgagcaa

SEQ ID NO: 170922 - DNA, 20 bp, Artificial Sequence
  chemically synthesized
caagataatgagcaatagaa

SEQ ID NO: 170923 - DNA, 20 bp, Artificial Sequence
  chemically synthesized
caatagaatagaacctaaca

SEQ ID NO: 170924 - DNA, 20 bp, Artificial Sequence
  chemically synthesized
tcatccaaaattgctttgtt

SEQ ID NO: 170925 - DNA, 20 bp, Artificial Sequence
  chemically synthesized
ctcatccaaaattgctttgt

SEQ ID NO: 170926 - DNA, 20 bp, Artificial Sequence
  chemically synthesized
agaacctaacaaagcaattt

SEQ ID NO: 170927 - DNA, 20 bp, Artificial Sequence
  chemically synthesized
ctaacaaagcaattttggat

SEQ ID NO: 170928 - DNA, 20 bp, Artificial Sequence
  chemically synthesized
taacaaagcaattttggatg

SEQ ID NO: 170929 - DNA, 20 bp, Artificial Sequence
  chemically synthesized
aacaaagcaattttggatga

SEQ ID NO: 170930 - DNA, 20 bp, Artificial Sequence
  chemically synthesized
ccatggcagttgattgtgtt

SEQ ID NO: 170931 - DNA, 20 bp, Artificial Sequence
  chemically synthesized
cttaacacaatcaactgcca

SEQ ID NO: 170932 - DNA, 20 bp, Artificial Sequence
  chemically synthesized
aaatggctggaacaccatgg

SEQ ID NO: 170933 - DNA, 20 bp, Artificial Sequence
  chemically synthesized
aataaatggctggaacacca

SEQ ID NO: 170934 - DNA, 20 bp, Artificial Sequence
  chemically synthesized
aatcaactgccatggtgttc

SEQ ID NO: 170935 - DNA, 20 bp, Artificial Sequence
  chemically synthesized
aaatcctgtaaataaatggc

SEQ ID NO: 170936 - DNA, 20 bp, Artificial Sequence
  chemically synthesized
gtttaaatcctgtaaataaa

SEQ ID NO: 170937 - DNA, 20 bp, Artificial Sequence
  chemically synthesized
gtgttccagccatttattta

SEQ ID NO: 170938 - DNA, 20 bp, Artificial Sequence
  chemically synthesized
tgttccagccatttatttac

SEQ ID NO: 170939 - DNA, 20 bp, Artificial Sequence
  chemically synthesized
atttaaacgtctttcctcca

SEQ ID NO: 170940 - DNA, 20 bp, Artificial Sequence
  chemically synthesized
ggagtcccggctttggagga

SEQ ID NO: 170941 - DNA, 20 bp, Artificial Sequence
  chemically synthesized
aaacgtctttcctccaaagc

SEQ ID NO: 170942 - DNA, 20 bp, Artificial Sequence
  chemically synthesized
ggcaggagtcccggctttgg

SEQ ID NO: 170943 - DNA, 20 bp, Artificial Sequence
  chemically synthesized
aacgtctttcctccaaagcc

SEQ ID NO: 170944 - DNA, 20 bp, Artificial Sequence
  chemically synthesized
tggcaggagtcccggctttg

SEQ ID NO: 170945 - DNA, 20 bp, Artificial Sequence
  chemically synthesized
tctggcaggagtcccggctt

SEQ ID NO: 170946 - DNA, 20 bp, Artificial Sequence
  chemically synthesized
aggttatctggcaggagtcc

SEQ ID NO: 170947 - DNA, 20 bp, Artificial Sequence
  chemically synthesized
tccaaagccgggactcctgc

SEQ ID NO: 170948 - DNA, 20 bp, Artificial Sequence
  chemically synthesized
ttacacaggttatctggcag

SEQ ID NO: 170949 - DNA, 20 bp, Artificial Sequence
  chemically synthesized
cattacacaggttatctggc

SEQ ID NO: 170950 - DNA, 20 bp, Artificial Sequence
  chemically synthesized
ccattacacaggttatctgg

SEQ ID NO: 170951 - DNA, 20 bp, Artificial Sequence
  chemically synthesized
ggtccattacacaggttatc

SEQ ID NO: 170952 - DNA, 20 bp, Artificial Sequence
  chemically synthesized
ctgccagataacctgtgtaa

SEQ ID NO: 170953 - DNA, 20 bp, Artificial Sequence
  chemically synthesized
ttgcactaggtccattacac

SEQ ID NO: 170954 - DNA, 20 bp, Artificial Sequence
  chemically synthesized
attgcactaggtccattaca

SEQ ID NO: 170955 - DNA, 20 bp, Artificial Sequence
  chemically synthesized
gataacctgtgtaatggacc

SEQ ID NO: 170956 - DNA, 20 bp, Artificial Sequence
  chemically synthesized
ttggtgtaggtcattgcact

SEQ ID NO: 170957 - DNA, 20 bp, Artificial Sequence
  chemically synthesized
tttggtgtaggtcattgcac

SEQ ID NO: 170958 - DNA, 20 bp, Artificial Sequence
  chemically synthesized
aattgttagccatttggtgt

SEQ ID NO: 170959 - DNA, 20 bp, Artificial Sequence
  chemically synthesized
gtgcaatgacctacaccaaa

SEQ ID NO: 170960 - DNA, 20 bp, Artificial Sequence
  chemically synthesized
aaattgttagccatttggtg

SEQ ID NO: 170961 - DNA, 20 bp, Artificial Sequence
  chemically synthesized
ggacaaaattgttagccatt

SEQ ID NO: 170962 - DNA, 20 bp, Artificial Sequence
  chemically synthesized
catgggctggacaaaattgt

SEQ ID NO: 170963 - DNA, 20 bp, Artificial Sequence
  chemically synthesized
aaatggctaacaattttgtc

SEQ ID NO: 170964 - DNA, 20 bp, Artificial Sequence
  chemically synthesized
taacaattttgtccagccca

SEQ ID NO: 170965 - DNA, 20 bp, Artificial Sequence
  chemically synthesized
aacaattttgtccagcccat

SEQ ID NO: 170966 - DNA, 20 bp, Artificial Sequence
  chemically synthesized
cactcgcaaagcccatgggc

SEQ ID NO: 170967 - DNA, 20 bp, Artificial Sequence
  chemically synthesized
gccccactcgcaaagcccat

SEQ ID NO: 170968 - DNA, 20 bp, Artificial Sequence
  chemically synthesized
agccccactcgcaaagccca

SEQ ID NO: 170969 - DNA, 20 bp, Artificial Sequence
  chemically synthesized
gtccagcccatgggctttgc

SEQ ID NO: 170970 - DNA, 20 bp, Artificial Sequence
  chemically synthesized
cagcccatgggctttgcgag

SEQ ID NO: 170971 - DNA, 20 bp, Artificial Sequence
  chemically synthesized
agcccatgggctttgcgagt

SEQ ID NO: 170972 - DNA, 20 bp, Artificial Sequence
  chemically synthesized
agagatgagccccactcgca

SEQ ID NO: 170973 - DNA, 20 bp, Artificial Sequence
  chemically synthesized
gcccatgggctttgcgagtg

SEQ ID NO: 170974 - DNA, 20 bp, Artificial Sequence
  chemically synthesized
tgcgagtggggctcatctct

SEQ ID NO: 170975 - DNA, 20 bp, Artificial Sequence
  chemically synthesized
cttagccagagccaagagat

SEQ ID NO: 170976 - DNA, 20 bp, Artificial Sequence
  chemically synthesized
tggggctcatctcttggctc

SEQ ID NO: 170977 - DNA, 20 bp, Artificial Sequence
  chemically synthesized
gcatacttagccagagccaa

SEQ ID NO: 170978 - DNA, 20 bp, Artificial Sequence
  chemically synthesized
ctgcatacttagccagagcc

SEQ ID NO: 170979 - DNA, 20 bp, Artificial Sequence
  chemically synthesized
ctcatctcttggctctggct

SEQ ID NO: 170980 - DNA, 20 bp, Artificial Sequence
  chemically synthesized
tgtagctgcatacttagcca

SEQ ID NO: 170981 - DNA, 20 bp, Artificial Sequence
  chemically synthesized
aatgtagctgcatacttagc

SEQ ID NO: 170982 - DNA, 20 bp, Artificial Sequence
  chemically synthesized
cttggctctggctaagtatg

SEQ ID NO: 170983 - DNA, 20 bp, Artificial Sequence
  chemically synthesized
cgggaatgtagctgcatact

SEQ ID NO: 170984 - DNA, 20 bp, Artificial Sequence
  chemically synthesized
ttgccacatcatcgggaatg

SEQ ID NO: 170985 - DNA, 20 bp, Artificial Sequence
  chemically synthesized
cagctacattcccgatgatg

SEQ ID NO: 170986 - DNA, 20 bp, Artificial Sequence
  chemically synthesized
taaaatgttgccacatcatc

SEQ ID NO: 170987 - DNA, 20 bp, Artificial Sequence
  chemically synthesized
ctaaaatgttgccacatcat

SEQ ID NO: 170988 - DNA, 20 bp, Artificial Sequence
  chemically synthesized
ccgatgatgtggcaacattt

SEQ ID NO: 170989 - DNA, 20 bp, Artificial Sequence
  chemically synthesized
cgatgatgtggcaacatttt

SEQ ID NO: 170990 - DNA, 20 bp, Artificial Sequence
  chemically synthesized
tgtggcaacattttaggctc

SEQ ID NO: 170991 - DNA, 20 bp, Artificial Sequence
  chemically synthesized
acattttaggctctggtttc

SEQ ID NO: 170992 - DNA, 20 bp, Artificial Sequence
  chemically synthesized
cagctctctcctggaaacca

SEQ ID NO: 170993 - DNA, 20 bp, Artificial Sequence
  chemically synthesized
cattttaggctctggtttcc

SEQ ID NO: 170994 - DNA, 20 bp, Artificial Sequence
  chemically synthesized
ctcagctctctcctggaaac

SEQ ID NO: 170995 - DNA, 20 bp, Artificial Sequence
  chemically synthesized
ttttaggctctggtttccag

SEQ ID NO: 170996 - DNA, 20 bp, Artificial Sequence
  chemically synthesized
ttaggctctggtttccagga

SEQ ID NO: 170997 - DNA, 20 bp, Artificial Sequence
  chemically synthesized
aggctctggtttccaggaga

SEQ ID NO: 170998 - DNA, 20 bp, Artificial Sequence
  chemically synthesized
gctgtgtctcagctctctcc

SEQ ID NO: 170999 - DNA, 20 bp, Artificial Sequence
  chemically synthesized
ctggtttccaggagagagct

SEQ ID NO: 171000 - DNA, 20 bp, Artificial Sequence
  chemically synthesized
tccaggagagagctgagaca

SEQ ID NO: 171001 - DNA, 20 bp, Artificial Sequence
  chemically synthesized
gcctgagaatagctgtgtct

SEQ ID NO: 171002 - DNA, 20 bp, Artificial Sequence
  chemically synthesized
agctgagacacagctattct

SEQ ID NO: 171003 - DNA, 20 bp, Artificial Sequence
  chemically synthesized
gctgagacacagctattctc

SEQ ID NO: 171004 - DNA, 20 bp, Artificial Sequence
  chemically synthesized
tggttcccaaggcctgagaa

SEQ ID NO: 171005 - DNA, 20 bp, Artificial Sequence
  chemically synthesized
acacagctattctcaggcct

SEQ ID NO: 171006 - DNA, 20 bp, Artificial Sequence
  chemically synthesized
cacagctattctcaggcctt

SEQ ID NO: 171007 - DNA, 20 bp, Artificial Sequence
  chemically synthesized
agcggtggttcccaaggcct

SEQ ID NO: 171008 - DNA, 20 bp, Artificial Sequence
  chemically synthesized
tctcaaagcggtggttccca

SEQ ID NO: 171009 - DNA, 20 bp, Artificial Sequence
  chemically synthesized
ttctcaaagcggtggttccc

SEQ ID NO: 171010 - DNA, 20 bp, Artificial Sequence
  chemically synthesized
gccttgggaaccaccgcttt

SEQ ID NO: 171011 - DNA, 20 bp, Artificial Sequence
  chemically synthesized
taacttgtttctcaaagcgg

SEQ ID NO: 171012 - DNA, 20 bp, Artificial Sequence
  chemically synthesized
tcctaacttgtttctcaaag

SEQ ID NO: 171013 - DNA, 20 bp, Artificial Sequence
  chemically synthesized
ttttcctaacttgtttctca

SEQ ID NO: 171014 - DNA, 20 bp, Artificial Sequence
  chemically synthesized
gaaccaccgctttgagaaac

SEQ ID NO: 171015 - DNA, 20 bp, Artificial Sequence
  chemically synthesized
caccgctttgagaaacaagt

SEQ ID NO: 171016 - DNA, 20 bp, Artificial Sequence
  chemically synthesized
accgctttgagaaacaagtt

SEQ ID NO: 171017 - DNA, 20 bp, Artificial Sequence
  chemically synthesized
agaaacaagttaggaaaatg

SEQ ID NO: 171018 - DNA, 20 bp, Artificial Sequence
  chemically synthesized
aaacaagttaggaaaatgca

SEQ ID NO: 171019 - DNA, 20 bp, Artificial Sequence
  chemically synthesized
aacaagttaggaaaatgcag

SEQ ID NO: 171020 - DNA, 20 bp, Artificial Sequence
  chemically synthesized
atgcagaggaccttacgtcc

SEQ ID NO: 171021 - DNA, 20 bp, Artificial Sequence
  chemically synthesized
tgagtttcccccgggacgta

SEQ ID NO: 171022 - DNA, 20 bp, Artificial Sequence
  chemically synthesized
tgcagaggaccttacgtccc

SEQ ID NO: 171023 - DNA, 20 bp, Artificial Sequence
  chemically synthesized
gtgagtttcccccgggacgt

SEQ ID NO: 171024 - DNA, 20 bp, Artificial Sequence
  chemically synthesized
gcagaggaccttacgtcccg

SEQ ID NO: 171025 - DNA, 20 bp, Artificial Sequence
  chemically synthesized
cagaggaccttacgtcccgg

SEQ ID NO: 171026 - DNA, 20 bp, Artificial Sequence
  chemically synthesized
aacttctgtgagtttccccc

SEQ ID NO: 171027 - DNA, 20 bp, Artificial Sequence
  chemically synthesized
aaacttctgtgagtttcccc

SEQ ID NO: 171028 - DNA, 20 bp, Artificial Sequence
  chemically synthesized
tacgtcccgggggaaactca

SEQ ID NO: 171029 - DNA, 20 bp, Artificial Sequence
  chemically synthesized
gtcccgggggaaactcacag

SEQ ID NO: 171030 - DNA, 20 bp, Artificial Sequence
  chemically synthesized
agatgccccaaaacttctgt

SEQ ID NO: 171031 - DNA, 20 bp, Artificial Sequence
  chemically synthesized
ggggaaactcacagaagttt

SEQ ID NO: 171032 - DNA, 20 bp, Artificial Sequence
  chemically synthesized
gggaaactcacagaagtttt

SEQ ID NO: 171033 - DNA, 20 bp, Artificial Sequence
  chemically synthesized
ggaaactcacagaagttttg

SEQ ID NO: 171034 - DNA, 20 bp, Artificial Sequence
  chemically synthesized
tttcattgacaaatattata

SEQ ID NO: 171035 - DNA, 20 bp, Artificial Sequence
  chemically synthesized
tttataatatttgtcaatga

SEQ ID NO: 171036 - DNA, 20 bp, Artificial Sequence
  chemically synthesized
ttataatatttgtcaatgaa

SEQ ID NO: 171037 - DNA, 20 bp, Artificial Sequence
  chemically synthesized
tataatatttgtcaatgaaa

SEQ ID NO: 171038 - DNA, 20 bp, Artificial Sequence
  chemically synthesized
atatttgtcaatgaaaggga

SEQ ID NO: 171039 - DNA, 20 bp, Artificial Sequence
  chemically synthesized
tatttgtcaatgaaagggaa

SEQ ID NO: 171040 - DNA, 20 bp, Artificial Sequence
  chemically synthesized
ggaaaggaacattcctttga

SEQ ID NO: 171041 - DNA, 20 bp, Artificial Sequence
  chemically synthesized
gaaaggaacattcctttgaa

SEQ ID NO: 171042 - DNA, 20 bp, Artificial Sequence
  chemically synthesized
gttctgtgtttgcctttcaa

SEQ ID NO: 171043 - DNA, 20 bp, Artificial Sequence
  chemically synthesized
agttctgtgtttgcctttca

SEQ ID NO: 171044 - DNA, 20 bp, Artificial Sequence
  chemically synthesized
attcctttgaaaggcaaaca

SEQ ID NO: 171045 - DNA, 20 bp, Artificial Sequence
  chemically synthesized
gcataagttgggaacagagc

SEQ ID NO: 171046 - DNA, 20 bp, Artificial Sequence
  chemically synthesized
ggaggcataagttgggaaca

SEQ ID NO: 171047 - DNA, 20 bp, Artificial Sequence
  chemically synthesized
ttggaggcataagttgggaa

SEQ ID NO: 171048 - DNA, 20 bp, Artificial Sequence
  chemically synthesized
cagccttggaggcataagtt

SEQ ID NO: 171049 - DNA, 20 bp, Artificial Sequence
  chemically synthesized
acagccttggaggcataagt

SEQ ID NO: 171050 - DNA, 20 bp, Artificial Sequence
  chemically synthesized
tcacacagccttggaggcat

SEQ ID NO: 171051 - DNA, 20 bp, Artificial Sequence
  chemically synthesized
tgttcccaacttatgcctcc

SEQ ID NO: 171052 - DNA, 20 bp, Artificial Sequence
  chemically synthesized
gttcccaacttatgcctcca

SEQ ID NO: 171053 - DNA, 20 bp, Artificial Sequence
  chemically synthesized
atctcctcacacagccttgg

SEQ ID NO: 171054 - DNA, 20 bp, Artificial Sequence
  chemically synthesized
aatctcctcacacagccttg

SEQ ID NO: 171055 - DNA, 20 bp, Artificial Sequence
  chemically synthesized
agaatctcctcacacagcct

SEQ ID NO: 171056 - DNA, 20 bp, Artificial Sequence
  chemically synthesized
ttatgcctccaaggctgtgt

SEQ ID NO: 171057 - DNA, 20 bp, Artificial Sequence
  chemically synthesized
tatgcctccaaggctgtgtg

SEQ ID NO: 171058 - DNA, 20 bp, Artificial Sequence
  chemically synthesized
tgcctccaaggctgtgtgag

SEQ ID NO: 171059 - DNA, 20 bp, Artificial Sequence
  chemically synthesized
ttcagaagaatctcctcaca

SEQ ID NO: 171060 - DNA, 20 bp, Artificial Sequence
  chemically synthesized
tgtgtgaggagattcttctg

SEQ ID NO: 171061 - DNA, 20 bp, Artificial Sequence
  chemically synthesized
cagcgatgtgtagacttcag

SEQ ID NO: 171062 - DNA, 20 bp, Artificial Sequence
  chemically synthesized
ggacagcgatgtgtagactt

SEQ ID NO: 171063 - DNA, 20 bp, Artificial Sequence
  chemically synthesized
ctctaatggacagcgatgtg

SEQ ID NO: 171064 - DNA, 20 bp, Artificial Sequence
  chemically synthesized
gtctacacatcgctgtccat

SEQ ID NO: 171065 - DNA, 20 bp, Artificial Sequence
  chemically synthesized
ctacacatcgctgtccatta

SEQ ID NO: 171066 - DNA, 20 bp, Artificial Sequence
  chemically synthesized
aatagagatgctctaatgga

SEQ ID NO: 171067 - DNA, 20 bp, Artificial Sequence
  chemically synthesized
gtctaatagagatgctctaa

SEQ ID NO: 171068 - DNA, 20 bp, Artificial Sequence
  chemically synthesized
gtccattagagcatctctat

SEQ ID NO: 171069 - DNA, 20 bp, Artificial Sequence
  chemically synthesized
attagagcatctctattaga

SEQ ID NO: 171070 - DNA, 20 bp, Artificial Sequence
  chemically synthesized
attaaaatgtctgtctaata

SEQ ID NO: 171071 - DNA, 20 bp, Artificial Sequence
  chemically synthesized
aaattaaaatgtctgtctaa

SEQ ID NO: 171072 - DNA, 20 bp, Artificial Sequence
  chemically synthesized
agacattttaatttcttcat

SEQ ID NO: 171073 - DNA, 20 bp, Artificial Sequence
  chemically synthesized
gacattttaatttcttcatt

SEQ ID NO: 171074 - DNA, 20 bp, Artificial Sequence
  chemically synthesized
taaaaagtttcatcccaatg

SEQ ID NO: 171075 - DNA, 20 bp, Artificial Sequence
  chemically synthesized
ttgggatgaaactttttaca

SEQ ID NO: 171076 - DNA, 20 bp, Artificial Sequence
  chemically synthesized
cgcagtatctactgtgtaaa

SEQ ID NO: 171077 - DNA, 20 bp, Artificial Sequence
  chemically synthesized
ggatgaaactttttacacag

SEQ ID NO: 171078 - DNA, 20 bp, Artificial Sequence
  chemically synthesized
atacaaacattacaaagtcg

SEQ ID NO: 171079 - DNA, 20 bp, Artificial Sequence
  chemically synthesized
cagttcatacaaacattaca

SEQ ID NO: 171080 - DNA, 20 bp, Artificial Sequence
  chemically synthesized
tgtaatgtttgtatgaactg

SEQ ID NO: 171081 - DNA, 20 bp, Artificial Sequence
  chemically synthesized
atgtttgtatgaactgaagc

SEQ ID NO: 171082 - DNA, 20 bp, Artificial Sequence
  chemically synthesized
tgttgttttaattccagctt

SEQ ID NO: 171083 - DNA, 20 bp, Artificial Sequence
  chemically synthesized
cagatttgttgttttaattc

SEQ ID NO: 171084 - DNA, 20 bp, Artificial Sequence
  chemically synthesized
gaattaaaacaacaaatctg

SEQ ID NO: 171085 - DNA, 20 bp, Artificial Sequence
  chemically synthesized
aaacaacaaatctgaagcca

SEQ ID NO: 171086 - DNA, 20 bp, Artificial Sequence
  chemically synthesized
gatgaaaaagaccatggctt

SEQ ID NO: 171087 - DNA, 20 bp, Artificial Sequence
  chemically synthesized
aaaagtgatgaaaaagacca

SEQ ID NO: 171088 - DNA, 20 bp, Artificial Sequence
  chemically synthesized
tttatataaaagtgatgaaa

SEQ ID NO: 171089 - DNA, 20 bp, Artificial Sequence
  chemically synthesized
actctgagtaatttatataa

SEQ ID NO: 171090 - DNA, 20 bp, Artificial Sequence
  chemically synthesized
tcacttttatataaattact

SEQ ID NO: 171091 - DNA, 20 bp, Artificial Sequence
  chemically synthesized
acttttatataaattactca

SEQ ID NO: 171092 - DNA, 20 bp, Artificial Sequence
  chemically synthesized
atataaattactcagagttc

SEQ ID NO: 171093 - DNA, 20 bp, Artificial Sequence
  chemically synthesized
gaattgcaatctggaactct

SEQ ID NO: 171094 - DNA, 20 bp, Artificial Sequence
  chemically synthesized
tatatagatgaattgcaatc

SEQ ID NO: 171095 - DNA, 20 bp, Artificial Sequence
  chemically synthesized
gcttcacctgtaaaaatata

SEQ ID NO: 171096 - DNA, 20 bp, Artificial Sequence
  chemically synthesized
aattcatctatatattttta

SEQ ID NO: 171097 - DNA, 20 bp, Artificial Sequence
  chemically synthesized
attcatctatatatttttac

SEQ ID NO: 171098 - DNA, 20 bp, Artificial Sequence
  chemically synthesized
tctatatatttttacaggtg

SEQ ID NO: 171099 - DNA, 20 bp, Artificial Sequence
  chemically synthesized
aatttaaaaaaaaatttaaa

SEQ ID NO: 171100 - DNA, 20 bp, Artificial Sequence
  chemically synthesized
ttaaaaaaaaatttaaaaag

SEQ ID NO: 171101 - DNA, 20 bp, Artificial Sequence
  chemically synthesized
aattcaacagttttttaaat

SEQ ID NO: 171102 - DNA, 20 bp, Artificial Sequence
  chemically synthesized
catttaaaaaactgttgaat

SEQ ID NO: 171103 - DNA, 20 bp, Artificial Sequence
  chemically synthesized
taaccaactaaccaattcaa

SEQ ID NO: 171104 - DNA, 20 bp, Artificial Sequence
  chemically synthesized
taaaaaactgttgaattggt

SEQ ID NO: 171105 - DNA, 20 bp, Artificial Sequence
  chemically synthesized
aaactgttgaattggttagt

SEQ ID NO: 171106 - DNA, 20 bp, Artificial Sequence
  chemically synthesized
tgaattggttagttggttac

SEQ ID NO: 171107 - DNA, 20 bp, Artificial Sequence
  chemically synthesized
gttagttggttactggttaa

SEQ ID NO: 171108 - DNA, 20 bp, Artificial Sequence
  chemically synthesized
taaataatttttcttttaac

SEQ ID NO: 171109 - DNA, 20 bp, Artificial Sequence
  chemically synthesized
tggttaaaagaaaaattatt

SEQ ID NO: 171110 - DNA, 20 bp, Artificial Sequence
  chemically synthesized
ggttaaaagaaaaattattt

SEQ ID NO: 171111 - DNA, 20 bp, Artificial Sequence
  chemically synthesized
gttaaaagaaaaattattta

SEQ ID NO: 171112 - DNA, 20 bp, Artificial Sequence
  chemically synthesized
catactgcctggcatataaa

SEQ ID NO: 171113 - DNA, 20 bp, Artificial Sequence
  chemically synthesized
gcatactgcctggcatataa

SEQ ID NO: 171114 - DNA, 20 bp, Artificial Sequence
  chemically synthesized
atttagggccttttatatgc

SEQ ID NO: 171115 - DNA, 20 bp, Artificial Sequence
  chemically synthesized
tttagggccttttatatgcc

SEQ ID NO: 171116 - DNA, 20 bp, Artificial Sequence
  chemically synthesized
agggccttttatatgccagg

SEQ ID NO: 171117 - DNA, 20 bp, Artificial Sequence
  chemically synthesized
gatttacctagcatactgcc

SEQ ID NO: 171118 - DNA, 20 bp, Artificial Sequence
  chemically synthesized
ttatatgccaggcagtatgc

SEQ ID NO: 171119 - DNA, 20 bp, Artificial Sequence
  chemically synthesized
tatatgccaggcagtatgct

SEQ ID NO: 171120 - DNA, 20 bp, Artificial Sequence
  chemically synthesized
gaagggagggatgatttacc

SEQ ID NO: 171121 - DNA, 20 bp, Artificial Sequence
  chemically synthesized
ataagtgttcatagaaggga

SEQ ID NO: 171122 - DNA, 20 bp, Artificial Sequence
  chemically synthesized
aataagtgttcatagaaggg

SEQ ID NO: 171123 - DNA, 20 bp, Artificial Sequence
  chemically synthesized
gaataagtgttcatagaagg

SEQ ID NO: 171124 - DNA, 20 bp, Artificial Sequence
  chemically synthesized
cagaataagtgttcatagaa

SEQ ID NO: 171125 - DNA, 20 bp, Artificial Sequence
  chemically synthesized
ccagaataagtgttcataga

SEQ ID NO: 171126 - DNA, 20 bp, Artificial Sequence
  chemically synthesized
tccagaataagtgttcatag

SEQ ID NO: 171127 - DNA, 20 bp, Artificial Sequence
  chemically synthesized
tcttccagaataagtgttca

SEQ ID NO: 171128 - DNA, 20 bp, Artificial Sequence
  chemically synthesized
ccttctatgaacacttattc

SEQ ID NO: 171129 - DNA, 20 bp, Artificial Sequence
  chemically synthesized
tctatgaacacttattctgg

SEQ ID NO: 171130 - DNA, 20 bp, Artificial Sequence
  chemically synthesized
cattttttttcttccagaat

SEQ ID NO: 171131 - DNA, 20 bp, Artificial Sequence
  chemically synthesized
taaatacattttttttcttc

SEQ ID NO: 171132 - DNA, 20 bp, Artificial Sequence
  chemically synthesized
aaaaaaaatgtatttaaaca

SEQ ID NO: 171133 - DNA, 20 bp, Artificial Sequence
  chemically synthesized
aaacacagaattcaattacc

SEQ ID NO: 171134 - DNA, 20 bp, Artificial Sequence
  chemically synthesized
ttattagagtattcatcact

SEQ ID NO: 171135 - DNA, 20 bp, Artificial Sequence
  chemically synthesized
aagtgatgaatactctaata

SEQ ID NO: 171136 - DNA, 20 bp, Artificial Sequence
  chemically synthesized
tattgtgtctgtctttatta

SEQ ID NO: 171137 - DNA, 20 bp, Artificial Sequence
  chemically synthesized
gatgaatactctaataaaga

SEQ ID NO: 171138 - DNA, 20 bp, Artificial Sequence
  chemically synthesized
tgtattgtgtctgtctttat

SEQ ID NO: 171139 - DNA, 20 bp, Artificial Sequence
  chemically synthesized
gacagacacaatacactaca

SEQ ID NO: 171140 - DNA, 20 bp, Artificial Sequence
  chemically synthesized
ctccagactccatgactttg

SEQ ID NO: 171141 - DNA, 20 bp, Artificial Sequence
  chemically synthesized
cacaatacactacaaagtca

SEQ ID NO: 171142 - DNA, 20 bp, Artificial Sequence
  chemically synthesized
caatacactacaaagtcatg

SEQ ID NO: 171143 - DNA, 20 bp, Artificial Sequence
  chemically synthesized
cactacaaagtcatggagtc

SEQ ID NO: 171144 - DNA, 20 bp, Artificial Sequence
  chemically synthesized
ctacaaagtcatggagtctg

SEQ ID NO: 171145 - DNA, 20 bp, Artificial Sequence
  chemically synthesized
tacaaagtcatggagtctgg

SEQ ID NO: 171146 - DNA, 20 bp, Artificial Sequence
  chemically synthesized
acaaagtcatggagtctgga

SEQ ID NO: 171147 - DNA, 20 bp, Artificial Sequence
  chemically synthesized
tccaggagacagaggccctc

SEQ ID NO: 171148 - DNA, 20 bp, Artificial Sequence
  chemically synthesized
attctttctccaggagacag

SEQ ID NO: 171149 - DNA, 20 bp, Artificial Sequence
  chemically synthesized
tctggagggcctctgtctcc

SEQ ID NO: 171150 - DNA, 20 bp, Artificial Sequence
  chemically synthesized
cattctttctccaggagaca

SEQ ID NO: 171151 - DNA, 20 bp, Artificial Sequence
  chemically synthesized
tggagggcctctgtctcctg

SEQ ID NO: 171152 - DNA, 20 bp, Artificial Sequence
  chemically synthesized
tccattctttctccaggaga

SEQ ID NO: 171153 - DNA, 20 bp, Artificial Sequence
  chemically synthesized
gggcctctgtctcctggaga

SEQ ID NO: 171154 - DNA, 20 bp, Artificial Sequence
  chemically synthesized
tctctccattctttctccag

SEQ ID NO: 171155 - DNA, 20 bp, Artificial Sequence
  chemically synthesized
tgtctctccattctttctcc

SEQ ID NO: 171156 - DNA, 20 bp, Artificial Sequence
  chemically synthesized
ctgtctctccattctttctc

SEQ ID NO: 171157 - DNA, 20 bp, Artificial Sequence
  chemically synthesized
tctgtctcctggagaaagaa

SEQ ID NO: 171158 - DNA, 20 bp, Artificial Sequence
  chemically synthesized
tgtctcctggagaaagaatg

SEQ ID NO: 171159 - DNA, 20 bp, Artificial Sequence
  chemically synthesized
tctcctggagaaagaatgga

SEQ ID NO: 171160 - DNA, 20 bp, Artificial Sequence
  chemically synthesized
ctggagaaagaatggagaga

SEQ ID NO: 171161 - DNA, 20 bp, Artificial Sequence
  chemically synthesized
tggagaaagaatggagagac

SEQ ID NO: 171162 - DNA, 20 bp, Artificial Sequence
  chemically synthesized
gagaaagaatggagagacag

SEQ ID NO: 171163 - DNA, 20 bp, Artificial Sequence
  chemically synthesized
agaaagaatggagagacagg

SEQ ID NO: 171164 - DNA, 20 bp, Artificial Sequence
  chemically synthesized
aagaatggagagacaggagg

SEQ ID NO: 171165 - DNA, 20 bp, Artificial Sequence
  chemically synthesized
agaatggagagacaggaggc

SEQ ID NO: 171166 - DNA, 20 bp, Artificial Sequence
  chemically synthesized
aatggagagacaggaggcag

SEQ ID NO: 171167 - DNA, 20 bp, Artificial Sequence
  chemically synthesized
tggagagacaggaggcagga

SEQ ID NO: 171168 - DNA, 20 bp, Artificial Sequence
  chemically synthesized
agagacaggaggcaggagag

SEQ ID NO: 171169 - DNA, 20 bp, Artificial Sequence
  chemically synthesized
gagacaggaggcaggagaga

SEQ ID NO: 171170 - DNA, 20 bp, Artificial Sequence
  chemically synthesized
aggagagaaggatgatttca

SEQ ID NO: 171171 - DNA, 20 bp, Artificial Sequence
  chemically synthesized
gagagaaggatgatttcaca

SEQ ID NO: 171172 - DNA, 20 bp, Artificial Sequence
  chemically synthesized
agagaaggatgatttcacag

SEQ ID NO: 171173 - DNA, 20 bp, Artificial Sequence
  chemically synthesized
aattaacagaaaattcaaat

SEQ ID NO: 171174 - DNA, 20 bp, Artificial Sequence
  chemically synthesized
atagtttacccattaattaa

SEQ ID NO: 171175 - DNA, 20 bp, Artificial Sequence
  chemically synthesized
ttgaattttctgttaattaa

SEQ ID NO: 171176 - DNA, 20 bp, Artificial Sequence
  chemically synthesized
tgaattttctgttaattaat

SEQ ID NO: 171177 - DNA, 20 bp, Artificial Sequence
  chemically synthesized
attaatgggtaaactatcga

SEQ ID NO: 171178 - DNA, 20 bp, Artificial Sequence
  chemically synthesized
ctgcgcagaatagctttcga

SEQ ID NO: 171179 - DNA, 20 bp, Artificial Sequence
  chemically synthesized
ctatcgaaagctattctgcg

SEQ ID NO: 171180 - DNA, 20 bp, Artificial Sequence
  chemically synthesized
ttttaatgggctgcgcagaa

SEQ ID NO: 171181 - DNA, 20 bp, Artificial Sequence
  chemically synthesized
gtaccttttaatgggctgcg

SEQ ID NO: 171182 - DNA, 20 bp, Artificial Sequence
  chemically synthesized
tattctgcgcagcccattaa

SEQ ID NO: 171183 - DNA, 20 bp, Artificial Sequence
  chemically synthesized
attctgcgcagcccattaaa

SEQ ID NO: 171184 - DNA, 20 bp, Artificial Sequence
  chemically synthesized
ccaacagagtaccttttaat

SEQ ID NO: 171185 - DNA, 20 bp, Artificial Sequence
  chemically synthesized
gccaacagagtaccttttaa

SEQ ID NO: 171186 - DNA, 20 bp, Artificial Sequence
  chemically synthesized
cccattaaaaggtactctgt

SEQ ID NO: 171187 - DNA, 20 bp, Artificial Sequence
  chemically synthesized
ctgtcaagcttgagccaaca

SEQ ID NO: 171188 - DNA, 20 bp, Artificial Sequence
  chemically synthesized
aaaaggtactctgttggctc

SEQ ID NO: 171189 - DNA, 20 bp, Artificial Sequence
  chemically synthesized
cactgtcaagcttgagccaa

SEQ ID NO: 171190 - DNA, 20 bp, Artificial Sequence
  chemically synthesized
cctcacacactgtcaagctt

SEQ ID NO: 171191 - DNA, 20 bp, Artificial Sequence
  chemically synthesized
ctctgttggctcaagcttga

SEQ ID NO: 171192 - DNA, 20 bp, Artificial Sequence
  chemically synthesized
cttcttcctcacacactgtc

SEQ ID NO: 171193 - DNA, 20 bp, Artificial Sequence
  chemically synthesized
gctcaagcttgacagtgtgt

SEQ ID NO: 171194 - DNA, 20 bp, Artificial Sequence
  chemically synthesized
ctcaagcttgacagtgtgtg

SEQ ID NO: 171195 - DNA, 20 bp, Artificial Sequence
  chemically synthesized
aagcttgacagtgtgtgagg

SEQ ID NO: 171196 - DNA, 20 bp, Artificial Sequence
  chemically synthesized
cttgacagtgtgtgaggaag

SEQ ID NO: 171197 - DNA, 20 bp, Artificial Sequence
  chemically synthesized
acagtgtgtgaggaagaaga

SEQ ID NO: 171198 - DNA, 20 bp, Artificial Sequence
  chemically synthesized
agtgtgtgaggaagaagaaa

SEQ ID NO: 171199 - DNA, 20 bp, Artificial Sequence
  chemically synthesized
gaagaaagagatcttatgac

SEQ ID NO: 171200 - DNA, 20 bp, Artificial Sequence
  chemically synthesized
aagaaagagatcttatgact

SEQ ID NO: 171201 - DNA, 20 bp, Artificial Sequence
  chemically synthesized
agaaagagatcttatgacta

SEQ ID NO: 171202 - DNA, 20 bp, Artificial Sequence
  chemically synthesized
tataaggcaaccctagtcat

SEQ ID NO: 171203 - DNA, 20 bp, Artificial Sequence
  chemically synthesized
tgtattttataaggcaaccc

SEQ ID NO: 171204 - DNA, 20 bp, Artificial Sequence
  chemically synthesized
atggtatcctgtattttata

SEQ ID NO: 171205 - DNA, 20 bp, Artificial Sequence
  chemically synthesized
aatggtatcctgtattttat

SEQ ID NO: 171206 - DNA, 20 bp, Artificial Sequence
  chemically synthesized
tagggttgccttataaaata

SEQ ID NO: 171207 - DNA, 20 bp, Artificial Sequence
  chemically synthesized
agggttgccttataaaatac

SEQ ID NO: 171208 - DNA, 20 bp, Artificial Sequence
  chemically synthesized
ttgcttatacaaaatgtaaa

SEQ ID NO: 171209 - DNA, 20 bp, Artificial Sequence
  chemically synthesized
ataccatttacattttgtat

SEQ ID NO: 171210 - DNA, 20 bp, Artificial Sequence
  chemically synthesized
tataagcaatcgatactttt

SEQ ID NO: 171211 - DNA, 20 bp, Artificial Sequence
  chemically synthesized
ctacaacaaaaaatactgaa

SEQ ID NO: 171212 - DNA, 20 bp, Artificial Sequence
  chemically synthesized
cttttcagtattttttgttg

SEQ ID NO: 171213 - DNA, 20 bp, Artificial Sequence
  chemically synthesized
gtattttttgttgtagtatt

SEQ ID NO: 171214 - DNA, 20 bp, Artificial Sequence
  chemically synthesized
tattttttgttgtagtattt

SEQ ID NO: 171215 - DNA, 20 bp, Artificial Sequence
  chemically synthesized
ttgttgtagtatttgggaca

SEQ ID NO: 171216 - DNA, 20 bp, Artificial Sequence
  chemically synthesized
atttgggacatagttatgct

SEQ ID NO: 171217 - DNA, 20 bp, Artificial Sequence
  chemically synthesized
catagttatgcttagaattc

SEQ ID NO: 171218 - DNA, 20 bp, Artificial Sequence
  chemically synthesized
tatgaaacatccagaattct

SEQ ID NO: 171219 - DNA, 20 bp, Artificial Sequence
  chemically synthesized
aaataaaaatatgaaacatc

SEQ ID NO: 171220 - DNA, 20 bp, Artificial Sequence
  chemically synthesized
tatttttatttgctaattct

SEQ ID NO: 171221 - DNA, 20 bp, Artificial Sequence
  chemically synthesized
atttttatttgctaattctt

SEQ ID NO: 171222 - DNA, 20 bp, Artificial Sequence
  chemically synthesized
ataactaggatcccaagaat

SEQ ID NO: 171223 - DNA, 20 bp, Artificial Sequence
  chemically synthesized
tttgctaattcttgggatcc

SEQ ID NO: 171224 - DNA, 20 bp, Artificial Sequence
  chemically synthesized
ccagtcataactaggatccc

SEQ ID NO: 171225 - DNA, 20 bp, Artificial Sequence
  chemically synthesized
tccacattccagtcataact

SEQ ID NO: 171226 - DNA, 20 bp, Artificial Sequence
  chemically synthesized
ttccacattccagtcataac

SEQ ID NO: 171227 - DNA, 20 bp, Artificial Sequence
  chemically synthesized
cttgggatcctagttatgac

SEQ ID NO: 171228 - DNA, 20 bp, Artificial Sequence
  chemically synthesized
tcctagttatgactggaatg

SEQ ID NO: 171229 - DNA, 20 bp, Artificial Sequence
  chemically synthesized
tattgttttcttccacattc

SEQ ID NO: 171230 - DNA, 20 bp, Artificial Sequence
  chemically synthesized
tagttatgactggaatgtgg

SEQ ID NO: 171231 - DNA, 20 bp, Artificial Sequence
  chemically synthesized
aatgtggaagaaaacaatac

SEQ ID NO: 171232 - DNA, 20 bp, Artificial Sequence
  chemically synthesized
ctcttcaaatcatattcagc

SEQ ID NO: 171233 - DNA, 20 bp, Artificial Sequence
  chemically synthesized
aaaactcttcaaatcatatt

SEQ ID NO: 171234 - DNA, 20 bp, Artificial Sequence
  chemically synthesized
taccagctgaatatgatttg

SEQ ID NO: 171235 - DNA, 20 bp, Artificial Sequence
  chemically synthesized
ccagctgaatatgatttgaa

SEQ ID NO: 171236 - DNA, 20 bp, Artificial Sequence
  chemically synthesized
gagttttgtgtgccatgaca

SEQ ID NO: 171237 - DNA, 20 bp, Artificial Sequence
  chemically synthesized
gttttgtgtgccatgacatg

SEQ ID NO: 171238 - DNA, 20 bp, Artificial Sequence
  chemically synthesized
aagttcaaaactccatgtca

SEQ ID NO: 171239 - DNA, 20 bp, Artificial Sequence
  chemically synthesized
ggagttttgaacttattcta

SEQ ID NO: 171240 - DNA, 20 bp, Artificial Sequence
  chemically synthesized
gagttttgaacttattctac

SEQ ID NO: 171241 - DNA, 20 bp, Artificial Sequence
  chemically synthesized
agtgtttatccctgtagaat

SEQ ID NO: 171242 - DNA, 20 bp, Artificial Sequence
  chemically synthesized
agttttgaacttattctaca

SEQ ID NO: 171243 - DNA, 20 bp, Artificial Sequence
  chemically synthesized
ttcaaaagtgtttatccctg

SEQ ID NO: 171244 - DNA, 20 bp, Artificial Sequence
  chemically synthesized
cagggataaacacttttgaa

SEQ ID NO: 171245 - DNA, 20 bp, Artificial Sequence
  chemically synthesized
gggataaacacttttgaaaa

SEQ ID NO: 171246 - DNA, 20 bp, Artificial Sequence
  chemically synthesized
tttgtataaactcttttcaa

SEQ ID NO: 171247 - DNA, 20 bp, Artificial Sequence
  chemically synthesized
ttttgaaaagagtttataca

SEQ ID NO: 171248 - DNA, 20 bp, Artificial Sequence
  chemically synthesized
agtttatacaaagttgactt

SEQ ID NO: 171249 - DNA, 20 bp, Artificial Sequence
  chemically synthesized
ttatacaaagttgactttag

SEQ ID NO: 171250 - DNA, 20 bp, Artificial Sequence
  chemically synthesized
tatacaaagttgactttaga

SEQ ID NO: 171251 - DNA, 20 bp, Artificial Sequence
  chemically synthesized
ctttgactctaatccttcta

SEQ ID NO: 171252 - DNA, 20 bp, Artificial Sequence
  chemically synthesized
aaagttgactttagaaggat

SEQ ID NO: 171253 - DNA, 20 bp, Artificial Sequence
  chemically synthesized
agttgactttagaaggatta

SEQ ID NO: 171254 - DNA, 20 bp, Artificial Sequence
  chemically synthesized
ctttagaaggattagagtca

SEQ ID NO: 171255 - DNA, 20 bp, Artificial Sequence
  chemically synthesized
tttagaaggattagagtcaa

SEQ ID NO: 171256 - DNA, 20 bp, Artificial Sequence
  chemically synthesized
ttagaaggattagagtcaaa

SEQ ID NO: 171257 - DNA, 20 bp, Artificial Sequence
  chemically synthesized
tagaaggattagagtcaaag

SEQ ID NO: 171258 - DNA, 20 bp, Artificial Sequence
  chemically synthesized
agaaggattagagtcaaagg

SEQ ID NO: 171259 - DNA, 20 bp, Artificial Sequence
  chemically synthesized
cttgacttcttaatggtttc

SEQ ID NO: 171260 - DNA, 20 bp, Artificial Sequence
  chemically synthesized
aagggggacttgaaaccatt

SEQ ID NO: 171261 - DNA, 20 bp, Artificial Sequence
  chemically synthesized
ggggacttgaaaccattaag

SEQ ID NO: 171262 - DNA, 20 bp, Artificial Sequence
  chemically synthesized
actggggcttgacttcttaa

SEQ ID NO: 171263 - DNA, 20 bp, Artificial Sequence
  chemically synthesized
cttgaaaccattaagaagtc

SEQ ID NO: 171264 - DNA, 20 bp, Artificial Sequence
  chemically synthesized
accattaagaagtcaagccc

SEQ ID NO: 171265 - DNA, 20 bp, Artificial Sequence
  chemically synthesized
aagaagtcaagccccagtaa

SEQ ID NO: 171266 - DNA, 20 bp, Artificial Sequence
  chemically synthesized
ctctgttcatgccattactg

SEQ ID NO: 171267 - DNA, 20 bp, Artificial Sequence
  chemically synthesized
gctctgttcatgccattact

SEQ ID NO: 171268 - DNA, 20 bp, Artificial Sequence
  chemically synthesized
agctctgttcatgccattac

SEQ ID NO: 171269 - DNA, 20 bp, Artificial Sequence
  chemically synthesized
agccccagtaatggcatgaa

SEQ ID NO: 171270 - DNA, 20 bp, Artificial Sequence
  chemically synthesized
ccccagtaatggcatgaaca

SEQ ID NO: 171271 - DNA, 20 bp, Artificial Sequence
  chemically synthesized
agatatttggaaagcagaat

SEQ ID NO: 171272 - DNA, 20 bp, Artificial Sequence
  chemically synthesized
cagattagatatttggaaag

SEQ ID NO: 171273 - DNA, 20 bp, Artificial Sequence
  chemically synthesized
ctgcagattagatatttgga

SEQ ID NO: 171274 - DNA, 20 bp, Artificial Sequence
  chemically synthesized
tctactgcagattagatatt

SEQ ID NO: 171275 - DNA, 20 bp, Artificial Sequence
  chemically synthesized
ctttccaaatatctaatctg

SEQ ID NO: 171276 - DNA, 20 bp, Artificial Sequence
  chemically synthesized
actaagtatctactgcagat

SEQ ID NO: 171277 - DNA, 20 bp, Artificial Sequence
  chemically synthesized
tccaaatatctaatctgcag

SEQ ID NO: 171278 - DNA, 20 bp, Artificial Sequence
  chemically synthesized
cagccactaagtatctactg

SEQ ID NO: 171279 - DNA, 20 bp, Artificial Sequence
  chemically synthesized
tctaatctgcagtagatact

SEQ ID NO: 171280 - DNA, 20 bp, Artificial Sequence
  chemically synthesized
aatctgcagtagatacttag

SEQ ID NO: 171281 - DNA, 20 bp, Artificial Sequence
  chemically synthesized
tgcagtagatacttagtggc

SEQ ID NO: 171282 - DNA, 20 bp, Artificial Sequence
  chemically synthesized
cagaggtgattccagccact

SEQ ID NO: 171283 - DNA, 20 bp, Artificial Sequence
  chemically synthesized
agccatgtcagaggtgattc

SEQ ID NO: 171284 - DNA, 20 bp, Artificial Sequence
  chemically synthesized
ggctggaatcacctctgaca

SEQ ID NO: 171285 - DNA, 20 bp, Artificial Sequence
  chemically synthesized
tcacaggtcagccatgtcag

SEQ ID NO: 171286 - DNA, 20 bp, Artificial Sequence
  chemically synthesized
gtcacaggtcagccatgtca

SEQ ID NO: 171287 - DNA, 20 bp, Artificial Sequence
  chemically synthesized
ctgtcacaggtcagccatgt

SEQ ID NO: 171288 - DNA, 20 bp, Artificial Sequence
  chemically synthesized
atgaaatagctgtcacaggt

SEQ ID NO: 171289 - DNA, 20 bp, Artificial Sequence
  chemically synthesized
ctgacatggctgacctgtga

SEQ ID NO: 171290 - DNA, 20 bp, Artificial Sequence
  chemically synthesized
gcagatgaaatagctgtcac

SEQ ID NO: 171291 - DNA, 20 bp, Artificial Sequence
  chemically synthesized
tgcagatgaaatagctgtca

SEQ ID NO: 171292 - DNA, 20 bp, Artificial Sequence
  chemically synthesized
ttggcaatgtgcagatgaaa

SEQ ID NO: 171293 - DNA, 20 bp, Artificial Sequence
  chemically synthesized
acagagatattggcaatgtg

SEQ ID NO: 171294 - DNA, 20 bp, Artificial Sequence
  chemically synthesized
tctcctaagcacagagatat

SEQ ID NO: 171295 - DNA, 20 bp, Artificial Sequence
  chemically synthesized
attgccaatatctctgtgct

SEQ ID NO: 171296 - DNA, 20 bp, Artificial Sequence
  chemically synthesized
ttgccaatatctctgtgctt

SEQ ID NO: 171297 - DNA, 20 bp, Artificial Sequence
  chemically synthesized
tagagaatctcctaagcaca

SEQ ID NO: 171298 - DNA, 20 bp, Artificial Sequence
  chemically synthesized
gccaatatctctgtgcttag

SEQ ID NO: 171299 - DNA, 20 bp, Artificial Sequence
  chemically synthesized
tttagagaatctcctaagca

SEQ ID NO: 171300 - DNA, 20 bp, Artificial Sequence
  chemically synthesized
cgcgctttagagaatctcct

SEQ ID NO: 171301 - DNA, 20 bp, Artificial Sequence
  chemically synthesized
tgtgcttaggagattctcta

SEQ ID NO: 171302 - DNA, 20 bp, Artificial Sequence
  chemically synthesized
ttaggagattctctaaagcg

SEQ ID NO: 171303 - DNA, 20 bp, Artificial Sequence
  chemically synthesized
aaaaattatgccgcgcttta

SEQ ID NO: 171304 - DNA, 20 bp, Artificial Sequence
  chemically synthesized
agaaaaattatgccgcgctt

SEQ ID NO: 171305 - DNA, 20 bp, Artificial Sequence
  chemically synthesized
aagcgcggcataatttttct

SEQ ID NO: 171306 - DNA, 20 bp, Artificial Sequence
  chemically synthesized
aaacaggaaaggggaaatcc

SEQ ID NO: 171307 - DNA, 20 bp, Artificial Sequence
  chemically synthesized
gggttaatgaaacaggaaag

SEQ ID NO: 171308 - DNA, 20 bp, Artificial Sequence
  chemically synthesized
agggttaatgaaacaggaaa

SEQ ID NO: 171309 - DNA, 20 bp, Artificial Sequence
  chemically synthesized
tagggttaatgaaacaggaa

SEQ ID NO: 171310 - DNA, 20 bp, Artificial Sequence
  chemically synthesized
atagggttaatgaaacagga

SEQ ID NO: 171311 - DNA, 20 bp, Artificial Sequence
  chemically synthesized
aagaatagggttaatgaaac

SEQ ID NO: 171312 - DNA, 20 bp, Artificial Sequence
  chemically synthesized
aaagaatagggttaatgaaa

SEQ ID NO: 171313 - DNA, 20 bp, Artificial Sequence
  chemically synthesized
aatgtaagagtgaaagaata

SEQ ID NO: 171314 - DNA, 20 bp, Artificial Sequence
  chemically synthesized
aaatgtaagagtgaaagaat

SEQ ID NO: 171315 - DNA, 20 bp, Artificial Sequence
  chemically synthesized
caaatgtaagagtgaaagaa

SEQ ID NO: 171316 - DNA, 20 bp, Artificial Sequence
  chemically synthesized
atcctcaaatgtaagagtga

SEQ ID NO: 171317 - DNA, 20 bp, Artificial Sequence
  chemically synthesized
aagttcatcctcaaatgtaa

SEQ ID NO: 171318 - DNA, 20 bp, Artificial Sequence
  chemically synthesized
attctttcactcttacattt

SEQ ID NO: 171319 - DNA, 20 bp, Artificial Sequence
  chemically synthesized
ttctttcactcttacatttg

SEQ ID NO: 171320 - DNA, 20 bp, Artificial Sequence
  chemically synthesized
agaagttcatcctcaaatgt

SEQ ID NO: 171321 - DNA, 20 bp, Artificial Sequence
  chemically synthesized
acaagaaattggaagcagag

SEQ ID NO: 171322 - DNA, 20 bp, Artificial Sequence
  chemically synthesized
aagacaagaaattggaagca

SEQ ID NO: 171323 - DNA, 20 bp, Artificial Sequence
  chemically synthesized
gtaagacaagaaattggaag

SEQ ID NO: 171324 - DNA, 20 bp, Artificial Sequence
  chemically synthesized
aatgtaagacaagaaattgg

SEQ ID NO: 171325 - DNA, 20 bp, Artificial Sequence
  chemically synthesized
cagaatgtaagacaagaaat

SEQ ID NO: 171326 - DNA, 20 bp, Artificial Sequence
  chemically synthesized
tcaagaacagaatgtaagac

SEQ ID NO: 171327 - DNA, 20 bp, Artificial Sequence
  chemically synthesized
tacactcaagaacagaatgt

SEQ ID NO: 171328 - DNA, 20 bp, Artificial Sequence
  chemically synthesized
ttgtcttacattctgttctt

SEQ ID NO: 171329 - DNA, 20 bp, Artificial Sequence
  chemically synthesized
agtttaaatacactcaagaa

SEQ ID NO: 171330 - DNA, 20 bp, Artificial Sequence
  chemically synthesized
gtgttagtttaaatacactc

SEQ ID NO: 171331 - DNA, 20 bp, Artificial Sequence
  chemically synthesized
aatggaaaaggataaagtgt

SEQ ID NO: 171332 - DNA, 20 bp, Artificial Sequence
  chemically synthesized
ggaagaaatggaaaaggata

SEQ ID NO: 171333 - DNA, 20 bp, Artificial Sequence
  chemically synthesized
ctttttggaagaaatggaaa

SEQ ID NO: 171334 - DNA, 20 bp, Artificial Sequence
  chemically synthesized
actttttggaagaaatggaa

SEQ ID NO: 171335 - DNA, 20 bp, Artificial Sequence
  chemically synthesized
tccttactttttggaagaaa

SEQ ID NO: 171336 - DNA, 20 bp, Artificial Sequence
  chemically synthesized
ccttttccatttcttccaaa

SEQ ID NO: 171337 - DNA, 20 bp, Artificial Sequence
  chemically synthesized
catttatccttactttttgg

SEQ ID NO: 171338 - DNA, 20 bp, Artificial Sequence
  chemically synthesized
ttccatttcttccaaaaagt

SEQ ID NO: 171339 - DNA, 20 bp, Artificial Sequence
  chemically synthesized
tccatttcttccaaaaagta

SEQ ID NO: 171340 - DNA, 20 bp, Artificial Sequence
  chemically synthesized
gaccatttatccttactttt

SEQ ID NO: 171341 - DNA, 20 bp, Artificial Sequence
  chemically synthesized
ttccaaaaagtaaggataaa

SEQ ID NO: 171342 - DNA, 20 bp, Artificial Sequence
  chemically synthesized
agtagcttgcaaataaatca

SEQ ID NO: 171343 - DNA, 20 bp, Artificial Sequence
  chemically synthesized
aagtagcttgcaaataaatc

SEQ ID NO: 171344 - DNA, 20 bp, Artificial Sequence
  chemically synthesized
atggtccttgatttatttgc

SEQ ID NO: 171345 - DNA, 20 bp, Artificial Sequence
  chemically synthesized
aactttttcagggaaagaag

SEQ ID NO: 171346 - DNA, 20 bp, Artificial Sequence
  chemically synthesized
ccaaactttttcagggaaag

SEQ ID NO: 171347 - DNA, 20 bp, Artificial Sequence
  chemically synthesized
cacccaaactttttcaggga

SEQ ID NO: 171348 - DNA, 20 bp, Artificial Sequence
  chemically synthesized
agctacttctttccctgaaa

SEQ ID NO: 171349 - DNA, 20 bp, Artificial Sequence
  chemically synthesized
ggatcacccaaactttttca

SEQ ID NO: 171350 - DNA, 20 bp, Artificial Sequence
  chemically synthesized
aggatcacccaaactttttc

SEQ ID NO: 171351 - DNA, 20 bp, Artificial Sequence
  chemically synthesized
aaggatcacccaaacttttt

SEQ ID NO: 171352 - DNA, 20 bp, Artificial Sequence
  chemically synthesized
cttctttccctgaaaaagtt

SEQ ID NO: 171353 - DNA, 20 bp, Artificial Sequence
  chemically synthesized
ttctttccctgaaaaagttt

SEQ ID NO: 171354 - DNA, 20 bp, Artificial Sequence
  chemically synthesized
gaaaaagtttgggtgatcct

SEQ ID NO: 171355 - DNA, 20 bp, Artificial Sequence
  chemically synthesized
gtttgggtgatccttagcat

SEQ ID NO: 171356 - DNA, 20 bp, Artificial Sequence
  chemically synthesized
tttgggtgatccttagcatc

SEQ ID NO: 171357 - DNA, 20 bp, Artificial Sequence
  chemically synthesized
catactaaaccctgatgcta

SEQ ID NO: 171358 - DNA, 20 bp, Artificial Sequence
  chemically synthesized
ttgggtgatccttagcatca

SEQ ID NO: 171359 - DNA, 20 bp, Artificial Sequence
  chemically synthesized
tcatactaaaccctgatgct

SEQ ID NO: 171360 - DNA, 20 bp, Artificial Sequence
  chemically synthesized
tgatccttagcatcagggtt

SEQ ID NO: 171361 - DNA, 20 bp, Artificial Sequence
  chemically synthesized
tcagggtttagtatgactaa

SEQ ID NO: 171362 - DNA, 20 bp, Artificial Sequence
  chemically synthesized
actaatacatatttttcttt

SEQ ID NO: 171363 - DNA, 20 bp, Artificial Sequence
  chemically synthesized
actaaaagaaaaatatgtat

SEQ ID NO: 171364 - DNA, 20 bp, Artificial Sequence
  chemically synthesized
atatgtattagttattgtac

SEQ ID NO: 171365 - DNA, 20 bp, Artificial Sequence
  chemically synthesized
taaaatttaaaagatcattc

SEQ ID NO: 171366 - DNA, 20 bp, Artificial Sequence
  chemically synthesized
atatgaactgtaaaatttaa

SEQ ID NO: 171367 - DNA, 20 bp, Artificial Sequence
  chemically synthesized
gaatgatcttttaaatttta

SEQ ID NO: 171368 - DNA, 20 bp, Artificial Sequence
  chemically synthesized
attttacagttcatatgtga

SEQ ID NO: 171369 - DNA, 20 bp, Artificial Sequence
  chemically synthesized
gttcatatgtgaaagaaact

SEQ ID NO: 171370 - DNA, 20 bp, Artificial Sequence
  chemically synthesized
catatgtgaaagaaacttgg

SEQ ID NO: 171371 - DNA, 20 bp, Artificial Sequence
  chemically synthesized
atatgtgaaagaaacttggc

SEQ ID NO: 171372 - DNA, 20 bp, Artificial Sequence
  chemically synthesized
tatgtgaaagaaacttggca

SEQ ID NO: 171373 - DNA, 20 bp, Artificial Sequence
  chemically synthesized
caatttaggaagaccctgcc

SEQ ID NO: 171374 - DNA, 20 bp, Artificial Sequence
  chemically synthesized
ttggcagggtcttcctaaat

SEQ ID NO: 171375 - DNA, 20 bp, Artificial Sequence
  chemically synthesized
aatttattgtccaatttagg

SEQ ID NO: 171376 - DNA, 20 bp, Artificial Sequence
  chemically synthesized
tacaatttattgtccaattt

SEQ ID NO: 171377 - DNA, 20 bp, Artificial Sequence
  chemically synthesized
ttacaatttattgtccaatt

SEQ ID NO: 171378 - DNA, 20 bp, Artificial Sequence
  chemically synthesized
tatgtgacatcaccaataat

SEQ ID NO: 171379 - DNA, 20 bp, Artificial Sequence
  chemically synthesized
ttacattttcaacttattat

SEQ ID NO: 171380 - DNA, 20 bp, Artificial Sequence
  chemically synthesized
ctatcattgatagtttagaa

SEQ ID NO: 171381 - DNA, 20 bp, Artificial Sequence
  chemically synthesized
gacttctatcattgatagtt

SEQ ID NO: 171382 - DNA, 20 bp, Artificial Sequence
  chemically synthesized
cttttctaaactatcaatga

SEQ ID NO: 171383 - DNA, 20 bp, Artificial Sequence
  chemically synthesized
aatttgacttctatcattga

SEQ ID NO: 171384 - DNA, 20 bp, Artificial Sequence
  chemically synthesized
ttctaaactatcaatgatag

SEQ ID NO: 171385 - DNA, 20 bp, Artificial Sequence
  chemically synthesized
caaattttaatcaacaatgc

SEQ ID NO: 171386 - DNA, 20 bp, Artificial Sequence
  chemically synthesized
aaattttaatcaacaatgct

SEQ ID NO: 171387 - DNA, 20 bp, Artificial Sequence
  chemically synthesized
aattttaatcaacaatgctg

SEQ ID NO: 171388 - DNA, 20 bp, Artificial Sequence
  chemically synthesized
attttaatcaacaatgctgg

SEQ ID NO: 171389 - DNA, 20 bp, Artificial Sequence
  chemically synthesized
taatcaacaatgctggggga

SEQ ID NO: 171390 - DNA, 20 bp, Artificial Sequence
  chemically synthesized
atcaacaatgctgggggaaa

SEQ ID NO: 171391 - DNA, 20 bp, Artificial Sequence
  chemically synthesized
aaataatttactctttcccc

SEQ ID NO: 171392 - DNA, 20 bp, Artificial Sequence
  chemically synthesized
acctcttcatgtgagagcat

SEQ ID NO: 171393 - DNA, 20 bp, Artificial Sequence
  chemically synthesized
ttttctgatgctctcacatg

SEQ ID NO: 171394 - DNA, 20 bp, Artificial Sequence
  chemically synthesized
ttcagcacctcttcatgtga

SEQ ID NO: 171395 - DNA, 20 bp, Artificial Sequence
  chemically synthesized
ttctgatgctctcacatgaa

SEQ ID NO: 171396 - DNA, 20 bp, Artificial Sequence
  chemically synthesized
ctttcagcacctcttcatgt

SEQ ID NO: 171397 - DNA, 20 bp, Artificial Sequence
  chemically synthesized
tctgatgctctcacatgaag

SEQ ID NO: 171398 - DNA, 20 bp, Artificial Sequence
  chemically synthesized
ctcacatgaagaggtgctga

SEQ ID NO: 171399 - DNA, 20 bp, Artificial Sequence
  chemically synthesized
cacatgaagaggtgctgaaa

SEQ ID NO: 171400 - DNA, 20 bp, Artificial Sequence
  chemically synthesized
acatgaagaggtgctgaaag

SEQ ID NO: 171401 - DNA, 20 bp, Artificial Sequence
  chemically synthesized
tttctggatgcatcctcttt

SEQ ID NO: 171402 - DNA, 20 bp, Artificial Sequence
  chemically synthesized
gtgctgaaagaggatgcatc

SEQ ID NO: 171403 - DNA, 20 bp, Artificial Sequence
  chemically synthesized
tgaaagaggatgcatccaga

SEQ ID NO: 171404 - DNA, 20 bp, Artificial Sequence
  chemically synthesized
agaggatgcatccagaaaga

SEQ ID NO: 171405 - DNA, 20 bp, Artificial Sequence
  chemically synthesized
aataattttttctatctttc

SEQ ID NO: 171406 - DNA, 20 bp, Artificial Sequence
  chemically synthesized
aaagatagaaaaaattattt

SEQ ID NO: 171407 - DNA, 20 bp, Artificial Sequence
  chemically synthesized
atttcagacactgtatattc

SEQ ID NO: 171408 - DNA, 20 bp, Artificial Sequence
  chemically synthesized
ctctgcaatactagaatata

SEQ ID NO: 171409 - DNA, 20 bp, Artificial Sequence
  chemically synthesized
cactgtatattctagtattg

SEQ ID NO: 171410 - DNA, 20 bp, Artificial Sequence
  chemically synthesized
atgaaccatctctgcaatac

SEQ ID NO: 171411 - DNA, 20 bp, Artificial Sequence
  chemically synthesized
ctgtatattctagtattgca

SEQ ID NO: 171412 - DNA, 20 bp, Artificial Sequence
  chemically synthesized
atattctagtattgcagaga

SEQ ID NO: 171413 - DNA, 20 bp, Artificial Sequence
  chemically synthesized
tgcagagatggttcattatt

SEQ ID NO: 171414 - DNA, 20 bp, Artificial Sequence
  chemically synthesized
caaaaattgaaaaaaataag

SEQ ID NO: 171415 - DNA, 20 bp, Artificial Sequence
  chemically synthesized
tcacaaaaattgaaaaaaat

SEQ ID NO: 171416 - DNA, 20 bp, Artificial Sequence
  chemically synthesized
ttcaatttttgtgatgtatg

SEQ ID NO: 171417 - DNA, 20 bp, Artificial Sequence
  chemically synthesized
atacgtttttaaaaagatga

SEQ ID NO: 171418 - DNA, 20 bp, Artificial Sequence
  chemically synthesized
acaaattatacgtttttaaa

SEQ ID NO: 171419 - DNA, 20 bp, Artificial Sequence
  chemically synthesized
gaacatgattatagaaagaa

SEQ ID NO: 171420 - DNA, 20 bp, Artificial Sequence
  chemically synthesized
tgaacatgattatagaaaga

SEQ ID NO: 171421 - DNA, 20 bp, Artificial Sequence
  chemically synthesized
ggtatgaacatgattataga

SEQ ID NO: 171422 - DNA, 20 bp, Artificial Sequence
  chemically synthesized
attaggtatgaacatgatta

SEQ ID NO: 171423 - DNA, 20 bp, Artificial Sequence
  chemically synthesized
aacaggacaaatataaaatt

SEQ ID NO: 171424 - DNA, 20 bp, Artificial Sequence
  chemically synthesized
taacaggacaaatataaaat

SEQ ID NO: 171425 - DNA, 20 bp, Artificial Sequence
  chemically synthesized
tttaagtcaaagaatataac

SEQ ID NO: 171426 - DNA, 20 bp, Artificial Sequence
  chemically synthesized
ctttaagtcaaagaatataa

SEQ ID NO: 171427 - DNA, 20 bp, Artificial Sequence
  chemically synthesized
ctgttatattctttgactta

SEQ ID NO: 171428 - DNA, 20 bp, Artificial Sequence
  chemically synthesized
tggcagttttctttaagtca

SEQ ID NO: 171429 - DNA, 20 bp, Artificial Sequence
  chemically synthesized
ctaatttggcagttttcttt

SEQ ID NO: 171430 - DNA, 20 bp, Artificial Sequence
  chemically synthesized
cttaaagaaaactgccaaat

SEQ ID NO: 171431 - DNA, 20 bp, Artificial Sequence
  chemically synthesized
tgaagcacattctaatttgg

SEQ ID NO: 171432 - DNA, 20 bp, Artificial Sequence
  chemically synthesized
acttgaagcacattctaatt

SEQ ID NO: 171433 - DNA, 20 bp, Artificial Sequence
  chemically synthesized
gccaaattagaatgtgcttc

SEQ ID NO: 171434 - DNA, 20 bp, Artificial Sequence
  chemically synthesized
ttagaatgtgcttcaagttt

SEQ ID NO: 171435 - DNA, 20 bp, Artificial Sequence
  chemically synthesized
atctggttttctgaaacttg

SEQ ID NO: 171436 - DNA, 20 bp, Artificial Sequence
  chemically synthesized
tgcttcaagtttcagaaaac

SEQ ID NO: 171437 - DNA, 20 bp, Artificial Sequence
  chemically synthesized
agaataagcagaggtagatc

SEQ ID NO: 171438 - DNA, 20 bp, Artificial Sequence
  chemically synthesized
ggtaaaagaataagcagagg

SEQ ID NO: 171439 - DNA, 20 bp, Artificial Sequence
  chemically synthesized
aaaggtaaaagaataagcag

SEQ ID NO: 171440 - DNA, 20 bp, Artificial Sequence
  chemically synthesized
taaaggtaaaagaataagca

SEQ ID NO: 171441 - DNA, 20 bp, Artificial Sequence
  chemically synthesized
aataaaggtaaaagaataag

SEQ ID NO: 171442 - DNA, 20 bp, Artificial Sequence
  chemically synthesized
ctcaataaaggtaaaagaat

SEQ ID NO: 171443 - DNA, 20 bp, Artificial Sequence
  chemically synthesized
tctatactcaataaaggtaa

SEQ ID NO: 171444 - DNA, 20 bp, Artificial Sequence
  chemically synthesized
cttattcttttacctttatt

SEQ ID NO: 171445 - DNA, 20 bp, Artificial Sequence
  chemically synthesized
tggttttctatactcaataa

SEQ ID NO: 171446 - DNA, 20 bp, Artificial Sequence
  chemically synthesized
atggttttctatactcaata

SEQ ID NO: 171447 - DNA, 20 bp, Artificial Sequence
  chemically synthesized
tcttttacctttattgagta

SEQ ID NO: 171448 - DNA, 20 bp, Artificial Sequence
  chemically synthesized
gtatagaaaaccatttcatt

SEQ ID NO: 171449 - DNA, 20 bp, Artificial Sequence
  chemically synthesized
ttttaggatactgaatgaaa

SEQ ID NO: 171450 - DNA, 20 bp, Artificial Sequence
  chemically synthesized
tataccaaattagttatttt

SEQ ID NO: 171451 - DNA, 20 bp, Artificial Sequence
  chemically synthesized
ctataccaaattagttattt

SEQ ID NO: 171452 - DNA, 20 bp, Artificial Sequence
  chemically synthesized
gtatcctaaaataactaatt

SEQ ID NO: 171453 - DNA, 20 bp, Artificial Sequence
  chemically synthesized
ttgcaatgcctataccaaat

SEQ ID NO: 171454 - DNA, 20 bp, Artificial Sequence
  chemically synthesized
ctaaaataactaatttggta

SEQ ID NO: 171455 - DNA, 20 bp, Artificial Sequence
  chemically synthesized
taaaataactaatttggtat

SEQ ID NO: 171456 - DNA, 20 bp, Artificial Sequence
  chemically synthesized
gggtcttcaaagtaaaagaa

SEQ ID NO: 171457 - DNA, 20 bp, Artificial Sequence
  chemically synthesized
tggggtcttcaaagtaaaag

SEQ ID NO: 171458 - DNA, 20 bp, Artificial Sequence
  chemically synthesized
cgatggggtcttcaaagtaa

SEQ ID NO: 171459 - DNA, 20 bp, Artificial Sequence
  chemically synthesized
aaatctcttcttttactttg

SEQ ID NO: 171460 - DNA, 20 bp, Artificial Sequence
  chemically synthesized
tagaaacgatggggtcttca

SEQ ID NO: 171461 - DNA, 20 bp, Artificial Sequence
  chemically synthesized
tacatctgttagaaacgatg

SEQ ID NO: 171462 - DNA, 20 bp, Artificial Sequence
  chemically synthesized
ttacatctgttagaaacgat

SEQ ID NO: 171463 - DNA, 20 bp, Artificial Sequence
  chemically synthesized
tttacatctgttagaaacga

SEQ ID NO: 171464 - DNA, 20 bp, Artificial Sequence
  chemically synthesized
gaagaccccatcgtttctaa

SEQ ID NO: 171465 - DNA, 20 bp, Artificial Sequence
  chemically synthesized
ctttttgtttttacatctgt

SEQ ID NO: 171466 - DNA, 20 bp, Artificial Sequence
  chemically synthesized
ctaacagatgtaaaaacaaa

SEQ ID NO: 171467 - DNA, 20 bp, Artificial Sequence
  chemically synthesized
aatgattttatctgacttat

SEQ ID NO: 171468 - DNA, 20 bp, Artificial Sequence
  chemically synthesized
ttaatgtactacttataagt

SEQ ID NO: 171469 - DNA, 20 bp, Artificial Sequence
  chemically synthesized
gattttatctgacttataag

SEQ ID NO: 171470 - DNA, 20 bp, Artificial Sequence
  chemically synthesized
agttttaatgtactacttat

SEQ ID NO: 171471 - DNA, 20 bp, Artificial Sequence
  chemically synthesized
tataagtagtacattaaaac

SEQ ID NO: 171472 - DNA, 20 bp, Artificial Sequence
  chemically synthesized
gtagtacattaaaactagtt

SEQ ID NO: 171473 - DNA, 20 bp, Artificial Sequence
  chemically synthesized
ttttagatcaaaaactcaac

SEQ ID NO: 171474 - DNA, 20 bp, Artificial Sequence
  chemically synthesized
ggctaattatttttaaattt

SEQ ID NO: 171475 - DNA, 20 bp, Artificial Sequence
  chemically synthesized
atctaaaatttaaaaataat

SEQ ID NO: 171476 - DNA, 20 bp, Artificial Sequence
  chemically synthesized
aaatttaaaaataattagcc

SEQ ID NO: 171477 - DNA, 20 bp, Artificial Sequence
  chemically synthesized
atgttgttctatcagaaact

SEQ ID NO: 171478 - DNA, 20 bp, Artificial Sequence
  chemically synthesized
ataattagccgagtttctga

SEQ ID NO: 171479 - DNA, 20 bp, Artificial Sequence
  chemically synthesized
attgtaaaatgttgttctat

SEQ ID NO: 171480 - DNA, 20 bp, Artificial Sequence
  chemically synthesized
aaaaaaaaaagaaaaaagca

SEQ ID NO: 171481 - DNA, 20 bp, Artificial Sequence
  chemically synthesized
aaaagaaaaaaaaaagaaaa

SEQ ID NO: 171482 - DNA, 20 bp, Artificial Sequence
  chemically synthesized
caataataaaagaaaaaaaa

SEQ ID NO: 171483 - DNA, 20 bp, Artificial Sequence
  chemically synthesized
aacttaaagtacaataataa

SEQ ID NO: 171484 - DNA, 20 bp, Artificial Sequence
  chemically synthesized
ttcttttattattgtacttt

SEQ ID NO: 171485 - DNA, 20 bp, Artificial Sequence
  chemically synthesized
tattattgtactttaagttt

SEQ ID NO: 171486 - DNA, 20 bp, Artificial Sequence
  chemically synthesized
cacatgtaccctaaaactta

SEQ ID NO: 171487 - DNA, 20 bp, Artificial Sequence
  chemically synthesized
attattgtactttaagtttt

SEQ ID NO: 171488 - DNA, 20 bp, Artificial Sequence
  chemically synthesized
ttattgtactttaagtttta

SEQ ID NO: 171489 - DNA, 20 bp, Artificial Sequence
  chemically synthesized
gggtacatgtgcacattgtg

SEQ ID NO: 171490 - DNA, 20 bp, Artificial Sequence
  chemically synthesized
ggtacatgtgcacattgtgc

SEQ ID NO: 171491 - DNA, 20 bp, Artificial Sequence
  chemically synthesized
catgtgcacattgtgcaggt

SEQ ID NO: 171492 - DNA, 20 bp, Artificial Sequence
  chemically synthesized
tatgtatacatgtgccatgc

SEQ ID NO: 171493 - DNA, 20 bp, Artificial Sequence
  chemically synthesized
gtgggtgcagcgcgccagca

SEQ ID NO: 171494 - DNA, 20 bp, Artificial Sequence
  chemically synthesized
agttagtgggtgcagcgcgc

SEQ ID NO: 171495 - DNA, 20 bp, Artificial Sequence
  chemically synthesized
agatgacaagttagtgggtg

SEQ ID NO: 171496 - DNA, 20 bp, Artificial Sequence
  chemically synthesized
atgctagatgacaagttagt

SEQ ID NO: 171497 - DNA, 20 bp, Artificial Sequence
  chemically synthesized
aatgctagatgacaagttag

SEQ ID NO: 171498 - DNA, 20 bp, Artificial Sequence
  chemically synthesized
cccaatgctagatgacaagt

SEQ ID NO: 171499 - DNA, 20 bp, Artificial Sequence
  chemically synthesized
gcacccactaacttgtcatc

SEQ ID NO: 171500 - DNA, 20 bp, Artificial Sequence
  chemically synthesized
tatacccaatgctagatgac

SEQ ID NO: 171501 - DNA, 20 bp, Artificial Sequence
  chemically synthesized
actaacttgtcatctagcat

SEQ ID NO: 171502 - DNA, 20 bp, Artificial Sequence
  chemically synthesized
ctaacttgtcatctagcatt

SEQ ID NO: 171503 - DNA, 20 bp, Artificial Sequence
  chemically synthesized
ttgggagatatacccaatgc

SEQ ID NO: 171504 - DNA, 20 bp, Artificial Sequence
  chemically synthesized
ggggggagggatagcattgg

SEQ ID NO: 171505 - DNA, 20 bp, Artificial Sequence
  chemically synthesized
aaggggggagggatagcatt

SEQ ID NO: 171506 - DNA, 20 bp, Artificial Sequence
  chemically synthesized
gaaggggggagggatagcat

SEQ ID NO: 171507 - DNA, 20 bp, Artificial Sequence
  chemically synthesized
gtgggggaaggggggaggga

SEQ ID NO: 171508 - DNA, 20 bp, Artificial Sequence
  chemically synthesized
tggggtgggggaagggggga

SEQ ID NO: 171509 - DNA, 20 bp, Artificial Sequence
  chemically synthesized
gtggggtgggggaagggggg

SEQ ID NO: 171510 - DNA, 20 bp, Artificial Sequence
  chemically synthesized
tgtggggtgggggaaggggg

SEQ ID NO: 171511 - DNA, 20 bp, Artificial Sequence
  chemically synthesized
gttgtggggtgggggaaggg

SEQ ID NO: 171512 - DNA, 20 bp, Artificial Sequence
  chemically synthesized
tgttgtggggtgggggaagg

SEQ ID NO: 171513 - DNA, 20 bp, Artificial Sequence
  chemically synthesized
ctgttgtggggtgggggaag

SEQ ID NO: 171514 - DNA, 20 bp, Artificial Sequence
  chemically synthesized
actgttgtggggtgggggaa

SEQ ID NO: 171515 - DNA, 20 bp, Artificial Sequence
  chemically synthesized
gactgttgtggggtggggga

SEQ ID NO: 171516 - DNA, 20 bp, Artificial Sequence
  chemically synthesized
ggactgttgtggggtggggg

SEQ ID NO: 171517 - DNA, 20 bp, Artificial Sequence
  chemically synthesized
tggggactgttgtggggtgg

SEQ ID NO: 171518 - DNA, 20 bp, Artificial Sequence
  chemically synthesized
ctggggactgttgtggggtg

SEQ ID NO: 171519 - DNA, 20 bp, Artificial Sequence
  chemically synthesized
tctggggactgttgtggggt

SEQ ID NO: 171520 - DNA, 20 bp, Artificial Sequence
  chemically synthesized
ctctggggactgttgtgggg

SEQ ID NO: 171521 - DNA, 20 bp, Artificial Sequence
  chemically synthesized
ccccttcccccaccccacaa

SEQ ID NO: 171522 - DNA, 20 bp, Artificial Sequence
  chemically synthesized
acactctggggactgttgtg

SEQ ID NO: 171523 - DNA, 20 bp, Artificial Sequence
  chemically synthesized
cacactctggggactgttgt

SEQ ID NO: 171524 - DNA, 20 bp, Artificial Sequence
  chemically synthesized
tcacactctggggactgttg

SEQ ID NO: 171525 - DNA, 20 bp, Artificial Sequence
  chemically synthesized
ccccaccccacaacagtccc

SEQ ID NO: 171526 - DNA, 20 bp, Artificial Sequence
  chemically synthesized
ccaccccacaacagtcccca

SEQ ID NO: 171527 - DNA, 20 bp, Artificial Sequence
  chemically synthesized
aaggggaacatcacactctg

SEQ ID NO: 171528 - DNA, 20 bp, Artificial Sequence
  chemically synthesized
gaaggggaacatcacactct

SEQ ID NO: 171529 - DNA, 20 bp, Artificial Sequence
  chemically synthesized
ggaaggggaacatcacactc

SEQ ID NO: 171530 - DNA, 20 bp, Artificial Sequence
  chemically synthesized
gaacacatggacacaggaag

SEQ ID NO: 171531 - DNA, 20 bp, Artificial Sequence
  chemically synthesized
agaacacatggacacaggaa

SEQ ID NO: 171532 - DNA, 20 bp, Artificial Sequence
  chemically synthesized
gagaacacatggacacagga

SEQ ID NO: 171533 - DNA, 20 bp, Artificial Sequence
  chemically synthesized
tgagaacacatggacacagg

SEQ ID NO: 171534 - DNA, 20 bp, Artificial Sequence
  chemically synthesized
caatgagaacacatggacac

SEQ ID NO: 171535 - DNA, 20 bp, Artificial Sequence
  chemically synthesized
acaatgagaacacatggaca

SEQ ID NO: 171536 - DNA, 20 bp, Artificial Sequence
  chemically synthesized
aattgaacaatgagaacaca

SEQ ID NO: 171537 - DNA, 20 bp, Artificial Sequence
  chemically synthesized
ataggtgggaattgaacaat

SEQ ID NO: 171538 - DNA, 20 bp, Artificial Sequence
  chemically synthesized
attgttcaattcccacctat

SEQ ID NO: 171539 - DNA, 20 bp, Artificial Sequence
  chemically synthesized
gcatgttctcactcataggt

SEQ ID NO: 171540 - DNA, 20 bp, Artificial Sequence
  chemically synthesized
cgcatgttctcactcatagg

SEQ ID NO: 171541 - DNA, 20 bp, Artificial Sequence
  chemically synthesized
ttcaattcccacctatgagt

SEQ ID NO: 171542 - DNA, 20 bp, Artificial Sequence
  chemically synthesized
caccgcatgttctcactcat

SEQ ID NO: 171543 - DNA, 20 bp, Artificial Sequence
  chemically synthesized
acaccgcatgttctcactca

SEQ ID NO: 171544 - DNA, 20 bp, Artificial Sequence
  chemically synthesized
cacctatgagtgagaacatg

SEQ ID NO: 171545 - DNA, 20 bp, Artificial Sequence
  chemically synthesized
gagtgagaacatgcggtgtt

SEQ ID NO: 171546 - DNA, 20 bp, Artificial Sequence
  chemically synthesized
ttggttttttgttcttgcga

SEQ ID NO: 171547 - DNA, 20 bp, Artificial Sequence
  chemically synthesized
cgttctcagtaaactgtcgc

SEQ ID NO: 171548 - DNA, 20 bp, Artificial Sequence
  chemically synthesized
tgttcttgcgacagtttact

SEQ ID NO: 171549 - DNA, 20 bp, Artificial Sequence
  chemically synthesized
aaattggaaatcatcgttct

SEQ ID NO: 171550 - DNA, 20 bp, Artificial Sequence
  chemically synthesized
tgtaggcacatgggtgaaat

SEQ ID NO: 171551 - DNA, 20 bp, Artificial Sequence
  chemically synthesized
catgtcctttgtaggcacat

SEQ ID NO: 171552 - DNA, 20 bp, Artificial Sequence
  chemically synthesized
tcatgtcctttgtaggcaca

SEQ ID NO: 171553 - DNA, 20 bp, Artificial Sequence
  chemically synthesized
atttcacccatgtgcctaca

SEQ ID NO: 171554 - DNA, 20 bp, Artificial Sequence
  chemically synthesized
tttcacccatgtgcctacaa

SEQ ID NO: 171555 - DNA, 20 bp, Artificial Sequence
  chemically synthesized
gatgagttcatgtcctttgt

SEQ ID NO: 171556 - DNA, 20 bp, Artificial Sequence
  chemically synthesized
ggatgagttcatgtcctttg

SEQ ID NO: 171557 - DNA, 20 bp, Artificial Sequence
  chemically synthesized
atgcagccataaaaaaggat

SEQ ID NO: 171558 - DNA, 20 bp, Artificial Sequence
  chemically synthesized
catgaactcatcctttttta

SEQ ID NO: 171559 - DNA, 20 bp, Artificial Sequence
  chemically synthesized
atactatgcagccataaaaa

SEQ ID NO: 171560 - DNA, 20 bp, Artificial Sequence
  chemically synthesized
aatactatgcagccataaaa

SEQ ID NO: 171561 - DNA, 20 bp, Artificial Sequence
  chemically synthesized
catccttttttatggctgca

SEQ ID NO: 171562 - DNA, 20 bp, Artificial Sequence
  chemically synthesized
atacaccatgcaatactatg

SEQ ID NO: 171563 - DNA, 20 bp, Artificial Sequence
  chemically synthesized
tatggctgcatagtattgca

SEQ ID NO: 171564 - DNA, 20 bp, Artificial Sequence
  chemically synthesized
tagactggattaagaaaatg

SEQ ID NO: 171565 - DNA, 20 bp, Artificial Sequence
  chemically synthesized
tgtgccacattttcttaatc

SEQ ID NO: 171566 - DNA, 20 bp, Artificial Sequence
  chemically synthesized
caacaatgatagactggatt

SEQ ID NO: 171567 - DNA, 20 bp, Artificial Sequence
  chemically synthesized
aatgtccaacaatgatagac

SEQ ID NO: 171568 - DNA, 20 bp, Artificial Sequence
  chemically synthesized
ttaatccagtctatcattgt

SEQ ID NO: 171569 - DNA, 20 bp, Artificial Sequence
  chemically synthesized
acccaaatgtccaacaatga

SEQ ID NO: 171570 - DNA, 20 bp, Artificial Sequence
  chemically synthesized
gtctatcattgttggacatt

SEQ ID NO: 171571 - DNA, 20 bp, Artificial Sequence
  chemically synthesized
tctatcattgttggacattt

SEQ ID NO: 171572 - DNA, 20 bp, Artificial Sequence
  chemically synthesized
tcattgttggacatttgggt

SEQ ID NO: 171573 - DNA, 20 bp, Artificial Sequence
  chemically synthesized
tggacatttgggttggttcc

SEQ ID NO: 171574 - DNA, 20 bp, Artificial Sequence
  chemically synthesized
tattcacaatagcaaagact

SEQ ID NO: 171575 - DNA, 20 bp, Artificial Sequence
  chemically synthesized
cggcgctattcacaatagca

SEQ ID NO: 171576 - DNA, 20 bp, Artificial Sequence
  chemically synthesized
caagtctttgctattgtgaa

SEQ ID NO: 171577 - DNA, 20 bp, Artificial Sequence
  chemically synthesized
tattgcggcgctattcacaa

SEQ ID NO: 171578 - DNA, 20 bp, Artificial Sequence
  chemically synthesized
atgcacacgtatgtttattg

SEQ ID NO: 171579 - DNA, 20 bp, Artificial Sequence
  chemically synthesized
tacgtgtgcatgtgtcttta

SEQ ID NO: 171580 - DNA, 20 bp, Artificial Sequence
  chemically synthesized
gtgtgcatgtgtctttatag

SEQ ID NO: 171581 - DNA, 20 bp, Artificial Sequence
  chemically synthesized
ctataaatcatgctgctata

SEQ ID NO: 171582 - DNA, 20 bp, Artificial Sequence
  chemically synthesized
ctttatagcagcatgattta

SEQ ID NO: 171583 - DNA, 20 bp, Artificial Sequence
  chemically synthesized
cagcatgatttatagtcctt

SEQ ID NO: 171584 - DNA, 20 bp, Artificial Sequence
  chemically synthesized
agcatgatttatagtccttt

SEQ ID NO: 171585 - DNA, 20 bp, Artificial Sequence
  chemically synthesized
attactgggtatatacccaa

SEQ ID NO: 171586 - DNA, 20 bp, Artificial Sequence
  chemically synthesized
cattactgggtatataccca

SEQ ID NO: 171587 - DNA, 20 bp, Artificial Sequence
  chemically synthesized
tagtcctttgggtatatacc

SEQ ID NO: 171588 - DNA, 20 bp, Artificial Sequence
  chemically synthesized
tttgggtatatacccagtaa

SEQ ID NO: 171589 - DNA, 20 bp, Artificial Sequence
  chemically synthesized
ttgggtatatacccagtaat

SEQ ID NO: 171590 - DNA, 20 bp, Artificial Sequence
  chemically synthesized
gacccagccatcccattact

SEQ ID NO: 171591 - DNA, 20 bp, Artificial Sequence
  chemically synthesized
tgacccagccatcccattac

SEQ ID NO: 171592 - DNA, 20 bp, Artificial Sequence
  chemically synthesized
gtatatacccagtaatggga

SEQ ID NO: 171593 - DNA, 20 bp, Artificial Sequence
  chemically synthesized
atacccagtaatgggatggc

SEQ ID NO: 171594 - DNA, 20 bp, Artificial Sequence
  chemically synthesized
tacccagtaatgggatggct

SEQ ID NO: 171595 - DNA, 20 bp, Artificial Sequence
  chemically synthesized
aatgggatggctgggtcaaa

SEQ ID NO: 171596 - DNA, 20 bp, Artificial Sequence
  chemically synthesized
actagaaataccatttgacc

SEQ ID NO: 171597 - DNA, 20 bp, Artificial Sequence
  chemically synthesized
gctgggtcaaatggtatttc

SEQ ID NO: 171598 - DNA, 20 bp, Artificial Sequence
  chemically synthesized
tcaaatggtatttctagttc

SEQ ID NO: 171599 - DNA, 20 bp, Artificial Sequence
  chemically synthesized
attcctcagggatctagaac

SEQ ID NO: 171600 - DNA, 20 bp, Artificial Sequence
  chemically synthesized
atttctagttctagatccct

SEQ ID NO: 171601 - DNA, 20 bp, Artificial Sequence
  chemically synthesized
gtggcgattcctcagggatc

SEQ ID NO: 171602 - DNA, 20 bp, Artificial Sequence
  chemically synthesized
tttctagttctagatccctg

SEQ ID NO: 171603 - DNA, 20 bp, Artificial Sequence
  chemically synthesized
gtcggtgtggcgattcctca

SEQ ID NO: 171604 - DNA, 20 bp, Artificial Sequence
  chemically synthesized
agtcggtgtggcgattcctc

SEQ ID NO: 171605 - DNA, 20 bp, Artificial Sequence
  chemically synthesized
aagtcggtgtggcgattcct

SEQ ID NO: 171606 - DNA, 20 bp, Artificial Sequence
  chemically synthesized
aaccattgtggaagtcggtg

SEQ ID NO: 171607 - DNA, 20 bp, Artificial Sequence
  chemically synthesized
agttcaaccattgtggaagt

SEQ ID NO: 171608 - DNA, 20 bp, Artificial Sequence
  chemically synthesized
cgccacaccgacttccacaa

SEQ ID NO: 171609 - DNA, 20 bp, Artificial Sequence
  chemically synthesized
aactagttcaaccattgtgg

SEQ ID NO: 171610 - DNA, 20 bp, Artificial Sequence
  chemically synthesized
gtaaactagttcaaccattg

SEQ ID NO: 171611 - DNA, 20 bp, Artificial Sequence
  chemically synthesized
gacttccacaatggttgaac

SEQ ID NO: 171612 - DNA, 20 bp, Artificial Sequence
  chemically synthesized
acaatggttgaactagttta

SEQ ID NO: 171613 - DNA, 20 bp, Artificial Sequence
  chemically synthesized
ctgttggtgggactgtaaac

SEQ ID NO: 171614 - DNA, 20 bp, Artificial Sequence
  chemically synthesized
ctagtttacagtcccaccaa

SEQ ID NO: 171615 - DNA, 20 bp, Artificial Sequence
  chemically synthesized
aacacttttacactgttggt

SEQ ID NO: 171616 - DNA, 20 bp, Artificial Sequence
  chemically synthesized
gaacacttttacactgttgg

SEQ ID NO: 171617 - DNA, 20 bp, Artificial Sequence
  chemically synthesized
taggaacacttttacactgt

SEQ ID NO: 171618 - DNA, 20 bp, Artificial Sequence
  chemically synthesized
cagtcccaccaacagtgtaa

SEQ ID NO: 171619 - DNA, 20 bp, Artificial Sequence
  chemically synthesized
tggagaggatgtggagaaat

SEQ ID NO: 171620 - DNA, 20 bp, Artificial Sequence
  chemically synthesized
ctggagaggatgtggagaaa

SEQ ID NO: 171621 - DNA, 20 bp, Artificial Sequence
  chemically synthesized
caggtgctggagaggatgtg

SEQ ID NO: 171622 - DNA, 20 bp, Artificial Sequence
  chemically synthesized
aacaggtgctggagaggatg

SEQ ID NO: 171623 - DNA, 20 bp, Artificial Sequence
  chemically synthesized
ctatttctccacatcctctc

SEQ ID NO: 171624 - DNA, 20 bp, Artificial Sequence
  chemically synthesized
ggaaacaacaggtgctggag

SEQ ID NO: 171625 - DNA, 20 bp, Artificial Sequence
  chemically synthesized
aggaaacaacaggtgctgga

SEQ ID NO: 171626 - DNA, 20 bp, Artificial Sequence
  chemically synthesized
tcaggaaacaacaggtgctg

SEQ ID NO: 171627 - DNA, 20 bp, Artificial Sequence
  chemically synthesized
agtcaggaaacaacaggtgc

SEQ ID NO: 171628 - DNA, 20 bp, Artificial Sequence
  chemically synthesized
ttaaaaagtcaggaaacaac

SEQ ID NO: 171629 - DNA, 20 bp, Artificial Sequence
  chemically synthesized
attaaaaagtcaggaaacaa

SEQ ID NO: 171630 - DNA, 20 bp, Artificial Sequence
  chemically synthesized
atggcaatcattaaaaagtc

SEQ ID NO: 171631 - DNA, 20 bp, Artificial Sequence
  chemically synthesized
aatggcaatcattaaaaagt

SEQ ID NO: 171632 - DNA, 20 bp, Artificial Sequence
  chemically synthesized
ttagaatggcaatcattaaa

SEQ ID NO: 171633 - DNA, 20 bp, Artificial Sequence
  chemically synthesized
ttaatgattgccattctaac

SEQ ID NO: 171634 - DNA, 20 bp, Artificial Sequence
  chemically synthesized
ccatctcacaccagttagaa

SEQ ID NO: 171635 - DNA, 20 bp, Artificial Sequence
  chemically synthesized
agataccatctcacaccagt

SEQ ID NO: 171636 - DNA, 20 bp, Artificial Sequence
  chemically synthesized
attgccattctaactggtgt

SEQ ID NO: 171637 - DNA, 20 bp, Artificial Sequence
  chemically synthesized
aatgagataccatctcacac

SEQ ID NO: 171638 - DNA, 20 bp, Artificial Sequence
  chemically synthesized
ccattctaactggtgtgaga

SEQ ID NO: 171639 - DNA, 20 bp, Artificial Sequence
  chemically synthesized
tgtgagatggtatctcattg

SEQ ID NO: 171640 - DNA, 20 bp, Artificial Sequence
  chemically synthesized
atgcaaatcaaaaccacaat

SEQ ID NO: 171641 - DNA, 20 bp, Artificial Sequence
  chemically synthesized
tttgatttgcatttctctga

SEQ ID NO: 171642 - DNA, 20 bp, Artificial Sequence
  chemically synthesized
atttgcatttctctgatggc

SEQ ID NO: 171643 - DNA, 20 bp, Artificial Sequence
  chemically synthesized
ctcaccatcactggccatca

SEQ ID NO: 171644 - DNA, 20 bp, Artificial Sequence
  chemically synthesized
tgctcaccatcactggccat

SEQ ID NO: 171645 - DNA, 20 bp, Artificial Sequence
  chemically synthesized
atttctctgatggccagtga

SEQ ID NO: 171646 - DNA, 20 bp, Artificial Sequence
  chemically synthesized
gaaaaaatgctcaccatcac

SEQ ID NO: 171647 - DNA, 20 bp, Artificial Sequence
  chemically synthesized
ctctgatggccagtgatggt

SEQ ID NO: 171648 - DNA, 20 bp, Artificial Sequence
  chemically synthesized
gcattttttcatgtgttttt

SEQ ID NO: 171649 - DNA, 20 bp, Artificial Sequence
  chemically synthesized
ctcaaaagaagacatttatg

SEQ ID NO: 171650 - DNA, 20 bp, Artificial Sequence
  chemically synthesized
ctgcataaatgtcttctttt

SEQ ID NO: 171651 - DNA, 20 bp, Artificial Sequence
  chemically synthesized
gaacagacacttctcaaaag

SEQ ID NO: 171652 - DNA, 20 bp, Artificial Sequence
  chemically synthesized
cataaatgtcttcttttgag

SEQ ID NO: 171653 - DNA, 20 bp, Artificial Sequence
  chemically synthesized
catgaacagacacttctcaa

SEQ ID NO: 171654 - DNA, 20 bp, Artificial Sequence
  chemically synthesized
aagtgggcgaaggacatgaa

SEQ ID NO: 171655 - DNA, 20 bp, Artificial Sequence
  chemically synthesized
ccccatcaaaaagtgggcga

SEQ ID NO: 171656 - DNA, 20 bp, Artificial Sequence
  chemically synthesized
accccatcaaaaagtgggcg

SEQ ID NO: 171657 - DNA, 20 bp, Artificial Sequence
  chemically synthesized
aaacaaccccatcaaaaagt

SEQ ID NO: 171658 - DNA, 20 bp, Artificial Sequence
  chemically synthesized
caaacaaccccatcaaaaag

SEQ ID NO: 171659 - DNA, 20 bp, Artificial Sequence
  chemically synthesized
gtccttcgcccactttttga

SEQ ID NO: 171660 - DNA, 20 bp, Artificial Sequence
  chemically synthesized
tccttcgcccactttttgat

SEQ ID NO: 171661 - DNA, 20 bp, Artificial Sequence
  chemically synthesized
ccttcgcccactttttgatg

SEQ ID NO: 171662 - DNA, 20 bp, Artificial Sequence
  chemically synthesized
aaacaaacaaccccatcaaa

SEQ ID NO: 171663 - DNA, 20 bp, Artificial Sequence
  chemically synthesized
atgaactccaacaaatttac

SEQ ID NO: 171664 - DNA, 20 bp, Artificial Sequence
  chemically synthesized
tttttttcttgtaaatttgt

SEQ ID NO: 171665 - DNA, 20 bp, Artificial Sequence
  chemically synthesized
tttttcttgtaaatttgttg

SEQ ID NO: 171666 - DNA, 20 bp, Artificial Sequence
  chemically synthesized
aaatttgttggagttcattg

SEQ ID NO: 171667 - DNA, 20 bp, Artificial Sequence
  chemically synthesized
ttggagttcattgtagattc

SEQ ID NO: 171668 - DNA, 20 bp, Artificial Sequence
  chemically synthesized
tcattgtagattctggatat

SEQ ID NO: 171669 - DNA, 20 bp, Artificial Sequence
  chemically synthesized
tctgataaagggctaatatc

SEQ ID NO: 171670 - DNA, 20 bp, Artificial Sequence
  chemically synthesized
tctggatattagccctttat

SEQ ID NO: 171671 - DNA, 20 bp, Artificial Sequence
  chemically synthesized
caacctactcatctgataaa

SEQ ID NO: 171672 - DNA, 20 bp, Artificial Sequence
  chemically synthesized
gcaacctactcatctgataa

SEQ ID NO: 171673 - DNA, 20 bp, Artificial Sequence
  chemically synthesized
cgcaacctactcatctgata

SEQ ID NO: 171674 - DNA, 20 bp, Artificial Sequence
  chemically synthesized
atattagccctttatcagat

SEQ ID NO: 171675 - DNA, 20 bp, Artificial Sequence
  chemically synthesized
ttagccctttatcagatgag

SEQ ID NO: 171676 - DNA, 20 bp, Artificial Sequence
  chemically synthesized
tagccctttatcagatgagt

SEQ ID NO: 171677 - DNA, 20 bp, Artificial Sequence
  chemically synthesized
acaggcaacctacaaaatgg

SEQ ID NO: 171678 - DNA, 20 bp, Artificial Sequence
  chemically synthesized
gaaaattttctcccattttg

SEQ ID NO: 171679 - DNA, 20 bp, Artificial Sequence
  chemically synthesized
aaaattttctcccattttgt

SEQ ID NO: 171680 - DNA, 20 bp, Artificial Sequence
  chemically synthesized
gaacaggcaacctacaaaat

SEQ ID NO: 171681 - DNA, 20 bp, Artificial Sequence
  chemically synthesized
tgaacaggcaacctacaaaa

SEQ ID NO: 171682 - DNA, 20 bp, Artificial Sequence
  chemically synthesized
aaactaccatcagagtgaac

SEQ ID NO: 171683 - DNA, 20 bp, Artificial Sequence
  chemically synthesized
gaaactaccatcagagtgaa

SEQ ID NO: 171684 - DNA, 20 bp, Artificial Sequence
  chemically synthesized
aggttgcctgttcactctga

SEQ ID NO: 171685 - DNA, 20 bp, Artificial Sequence
  chemically synthesized
ttgcctgttcactctgatgg

SEQ ID NO: 171686 - DNA, 20 bp, Artificial Sequence
  chemically synthesized
agcaaaagaaactaccatca

SEQ ID NO: 171687 - DNA, 20 bp, Artificial Sequence
  chemically synthesized
acagcaaaagaaactaccat

SEQ ID NO: 171688 - DNA, 20 bp, Artificial Sequence
  chemically synthesized
aaggagcttctgcacagcaa

SEQ ID NO: 171689 - DNA, 20 bp, Artificial Sequence
  chemically synthesized
tggtagtttcttttgctgtg

SEQ ID NO: 171690 - DNA, 20 bp, Artificial Sequence
  chemically synthesized
tagtttcttttgctgtgcag

SEQ ID NO: 171691 - DNA, 20 bp, Artificial Sequence
  chemically synthesized
taaactaaggagcttctgca

SEQ ID NO: 171692 - DNA, 20 bp, Artificial Sequence
  chemically synthesized
tttgctgtgcagaagctcct

SEQ ID NO: 171693 - DNA, 20 bp, Artificial Sequence
  chemically synthesized
tgggatctaattaaactaag

SEQ ID NO: 171694 - DNA, 20 bp, Artificial Sequence
  chemically synthesized
aatgggatctaattaaacta

SEQ ID NO: 171695 - DNA, 20 bp, Artificial Sequence
  chemically synthesized
aaatgggatctaattaaact

SEQ ID NO: 171696 - DNA, 20 bp, Artificial Sequence
  chemically synthesized
cagaagctccttagtttaat

SEQ ID NO: 171697 - DNA, 20 bp, Artificial Sequence
  chemically synthesized
aaaagccaaaattgacaaat

SEQ ID NO: 171698 - DNA, 20 bp, Artificial Sequence
  chemically synthesized
caaaagccaaaattgacaaa

SEQ ID NO: 171699 - DNA, 20 bp, Artificial Sequence
  chemically synthesized
tagatcccatttgtcaattt

SEQ ID NO: 171700 - DNA, 20 bp, Artificial Sequence
  chemically synthesized
accaaaaccaatggcaacaa

SEQ ID NO: 171701 - DNA, 20 bp, Artificial Sequence
  chemically synthesized
attttggcttttgttgccat

SEQ ID NO: 171702 - DNA, 20 bp, Artificial Sequence
  chemically synthesized
gcttttgttgccattggttt

SEQ ID NO: 171703 - DNA, 20 bp, Artificial Sequence
  chemically synthesized
gtctaaaacaccaaaaccaa

SEQ ID NO: 171704 - DNA, 20 bp, Artificial Sequence
  chemically synthesized
tgccattggttttggtgttt

SEQ ID NO: 171705 - DNA, 20 bp, Artificial Sequence
  chemically synthesized
gttttggtgttttagacatg

SEQ ID NO: 171706 - DNA, 20 bp, Artificial Sequence
  chemically synthesized
tcaggacataggcatgggca

SEQ ID NO: 171707 - DNA, 20 bp, Artificial Sequence
  chemically synthesized
ttcaggacataggcatgggc

SEQ ID NO: 171708 - DNA, 20 bp, Artificial Sequence
  chemically synthesized
accattcaggacataggcat

SEQ ID NO: 171709 - DNA, 20 bp, Artificial Sequence
  chemically synthesized
taccattcaggacataggca

SEQ ID NO: 171710 - DNA, 20 bp, Artificial Sequence
  chemically synthesized
ggcattaccattcaggacat

SEQ ID NO: 171711 - DNA, 20 bp, Artificial Sequence
  chemically synthesized
aggcattaccattcaggaca

SEQ ID NO: 171712 - DNA, 20 bp, Artificial Sequence
  chemically synthesized
gcccatgcctatgtcctgaa

SEQ ID NO: 171713 - DNA, 20 bp, Artificial Sequence
  chemically synthesized
ctcttgaggcattaccattc

SEQ ID NO: 171714 - DNA, 20 bp, Artificial Sequence
  chemically synthesized
tctcttgaggcattaccatt

SEQ ID NO: 171715 - DNA, 20 bp, Artificial Sequence
  chemically synthesized
gtcctgaatggtaatgcctc

SEQ ID NO: 171716 - DNA, 20 bp, Artificial Sequence
  chemically synthesized
cctgaatggtaatgcctcaa

SEQ ID NO: 171717 - DNA, 20 bp, Artificial Sequence
  chemically synthesized
ctaggcattttattctcttg

SEQ ID NO: 171718 - DNA, 20 bp, Artificial Sequence
  chemically synthesized
cctaggcattttattctctt

SEQ ID NO: 171719 - DNA, 20 bp, Artificial Sequence
  chemically synthesized
cctcaagagaataaaatgcc

SEQ ID NO: 171720 - DNA, 20 bp, Artificial Sequence
  chemically synthesized
ctcaagagaataaaatgcct

SEQ ID NO: 171721 - DNA, 20 bp, Artificial Sequence
  chemically synthesized
cccttgtaagttggattcct

SEQ ID NO: 171722 - DNA, 20 bp, Artificial Sequence
  chemically synthesized
tcccttgtaagttggattcc

SEQ ID NO: 171723 - DNA, 20 bp, Artificial Sequence
  chemically synthesized
tgcctaggaatccaacttac

SEQ ID NO: 171724 - DNA, 20 bp, Artificial Sequence
  chemically synthesized
gcctaggaatccaacttaca

SEQ ID NO: 171725 - DNA, 20 bp, Artificial Sequence
  chemically synthesized
ccttcacatcccttgtaagt

SEQ ID NO: 171726 - DNA, 20 bp, Artificial Sequence
  chemically synthesized
cctaggaatccaacttacaa

SEQ ID NO: 171727 - DNA, 20 bp, Artificial Sequence
  chemically synthesized
aggtccttcacatcccttgt

SEQ ID NO: 171728 - DNA, 20 bp, Artificial Sequence
  chemically synthesized
tccaacttacaagggatgtg

SEQ ID NO: 171729 - DNA, 20 bp, Artificial Sequence
  chemically synthesized
ccaacttacaagggatgtga

SEQ ID NO: 171730 - DNA, 20 bp, Artificial Sequence
  chemically synthesized
gggatgtgaaggacctcttc

SEQ ID NO: 171731 - DNA, 20 bp, Artificial Sequence
  chemically synthesized
ggatgtgaaggacctcttca

SEQ ID NO: 171732 - DNA, 20 bp, Artificial Sequence
  chemically synthesized
atgtgaaggacctcttcaag

SEQ ID NO: 171733 - DNA, 20 bp, Artificial Sequence
  chemically synthesized
gtttgtagttctccttgaag

SEQ ID NO: 171734 - DNA, 20 bp, Artificial Sequence
  chemically synthesized
ggtttgtagttctccttgaa

SEQ ID NO: 171735 - DNA, 20 bp, Artificial Sequence
  chemically synthesized
gtggtttgtagttctccttg

SEQ ID NO: 171736 - DNA, 20 bp, Artificial Sequence
  chemically synthesized
tttccttgagcagtggtttg

SEQ ID NO: 171737 - DNA, 20 bp, Artificial Sequence
  chemically synthesized
agaactacaaaccactgctc

SEQ ID NO: 171738 - DNA, 20 bp, Artificial Sequence
  chemically synthesized
gaactacaaaccactgctca

SEQ ID NO: 171739 - DNA, 20 bp, Artificial Sequence
  chemically synthesized
tcttttatttccttgagcag

SEQ ID NO: 171740 - DNA, 20 bp, Artificial Sequence
  chemically synthesized
tcctcttttatttccttgag

SEQ ID NO: 171741 - DNA, 20 bp, Artificial Sequence
  chemically synthesized
gtatcctcttttatttcctt

SEQ ID NO: 171742 - DNA, 20 bp, Artificial Sequence
  chemically synthesized
accactgctcaaggaaataa

SEQ ID NO: 171743 - DNA, 20 bp, Artificial Sequence
  chemically synthesized
cactgctcaaggaaataaaa

SEQ ID NO: 171744 - DNA, 20 bp, Artificial Sequence
  chemically synthesized
actgctcaaggaaataaaag

SEQ ID NO: 171745 - DNA, 20 bp, Artificial Sequence
  chemically synthesized
taaaagaggatacaaacaaa

SEQ ID NO: 171746 - DNA, 20 bp, Artificial Sequence
  chemically synthesized
aagaggatacaaacaaatgg

SEQ ID NO: 171747 - DNA, 20 bp, Artificial Sequence
  chemically synthesized
ggaagaacattccatgctca

SEQ ID NO: 171748 - DNA, 20 bp, Artificial Sequence
  chemically synthesized
gaagaacattccatgctcat

SEQ ID NO: 171749 - DNA, 20 bp, Artificial Sequence
  chemically synthesized
attcttcctacccatgagca

SEQ ID NO: 171750 - DNA, 20 bp, Artificial Sequence
  chemically synthesized
gaacattccatgctcatggg

SEQ ID NO: 171751 - DNA, 20 bp, Artificial Sequence
  chemically synthesized
aacattccatgctcatgggt

SEQ ID NO: 171752 - DNA, 20 bp, Artificial Sequence
  chemically synthesized
tattgattcttcctacccat

SEQ ID NO: 171753 - DNA, 20 bp, Artificial Sequence
  chemically synthesized
attccatgctcatgggtagg

SEQ ID NO: 171754 - DNA, 20 bp, Artificial Sequence
  chemically synthesized
aagaatcaatatcgtgaaaa

SEQ ID NO: 171755 - DNA, 20 bp, Artificial Sequence
  chemically synthesized
tgaaaatggtcatactgccc

SEQ ID NO: 171756 - DNA, 20 bp, Artificial Sequence
  chemically synthesized
gaaaatggtcatactgccca

SEQ ID NO: 171757 - DNA, 20 bp, Artificial Sequence
  chemically synthesized
aatctgtaaattaccttggg

SEQ ID NO: 171758 - DNA, 20 bp, Artificial Sequence
  chemically synthesized
ttgaatctgtaaattacctt

SEQ ID NO: 171759 - DNA, 20 bp, Artificial Sequence
  chemically synthesized
attgaatctgtaaattacct

SEQ ID NO: 171760 - DNA, 20 bp, Artificial Sequence
  chemically synthesized
atactgcccaaggtaattta

SEQ ID NO: 171761 - DNA, 20 bp, Artificial Sequence
  chemically synthesized
cattggtagcttgatgggga

SEQ ID NO: 171762 - DNA, 20 bp, Artificial Sequence
  chemically synthesized
gattcaatgccatccccatc

SEQ ID NO: 171763 - DNA, 20 bp, Artificial Sequence
  chemically synthesized
aaggcattggtagcttgatg

SEQ ID NO: 171764 - DNA, 20 bp, Artificial Sequence
  chemically synthesized
aaaggcattggtagcttgat

SEQ ID NO: 171765 - DNA, 20 bp, Artificial Sequence
  chemically synthesized
gaaaggcattggtagcttga

SEQ ID NO: 171766 - DNA, 20 bp, Artificial Sequence
  chemically synthesized
tctgtgaagaaaggcattgg

SEQ ID NO: 171767 - DNA, 20 bp, Artificial Sequence
  chemically synthesized
aattctgtgaagaaaggcat

SEQ ID NO: 171768 - DNA, 20 bp, Artificial Sequence
  chemically synthesized
gctaccaatgcctttcttca

SEQ ID NO: 171769 - DNA, 20 bp, Artificial Sequence
  chemically synthesized
ttttccaattctgtgaagaa

SEQ ID NO: 171770 - DNA, 20 bp, Artificial Sequence
  chemically synthesized
tttttccaattctgtgaaga

SEQ ID NO: 171771 - DNA, 20 bp, Artificial Sequence
  chemically synthesized
tagttttttccaattctgtg

SEQ ID NO: 171772 - DNA, 20 bp, Artificial Sequence
  chemically synthesized
aatgcctttcttcacagaat

SEQ ID NO: 171773 - DNA, 20 bp, Artificial Sequence
  chemically synthesized
aattggaaaaaactacttta

SEQ ID NO: 171774 - DNA, 20 bp, Artificial Sequence
  chemically synthesized
gttccatatgaactttaaag

SEQ ID NO: 171775 - DNA, 20 bp, Artificial Sequence
  chemically synthesized
ttggttccatatgaacttta

SEQ ID NO: 171776 - DNA, 20 bp, Artificial Sequence
  chemically synthesized
aaactactttaaagttcata

SEQ ID NO: 171777 - DNA, 20 bp, Artificial Sequence
  chemically synthesized
aagttcatatggaaccaaaa

SEQ ID NO: 171778 - DNA, 20 bp, Artificial Sequence
  chemically synthesized
gttcatatggaaccaaaaaa

SEQ ID NO: 171779 - DNA, 20 bp, Artificial Sequence
  chemically synthesized
tggcgatgcgggctcttttt

SEQ ID NO: 171780 - DNA, 20 bp, Artificial Sequence
  chemically synthesized
caggattgacttggcgatgc

SEQ ID NO: 171781 - DNA, 20 bp, Artificial Sequence
  chemically synthesized
aaaaaagagcccgcatcgcc

SEQ ID NO: 171782 - DNA, 20 bp, Artificial Sequence
  chemically synthesized
tcaggattgacttggcgatg

SEQ ID NO: 171783 - DNA, 20 bp, Artificial Sequence
  chemically synthesized
cttttggctcaggattgact

SEQ ID NO: 171784 - DNA, 20 bp, Artificial Sequence
  chemically synthesized
cgcatcgccaagtcaatcct

SEQ ID NO: 171785 - DNA, 20 bp, Artificial Sequence
  chemically synthesized
ccaagtcaatcctgagccaa

SEQ ID NO: 171786 - DNA, 20 bp, Artificial Sequence
  chemically synthesized
cagctttgttcttttggctc

SEQ ID NO: 171787 - DNA, 20 bp, Artificial Sequence
  chemically synthesized
ccagctttgttcttttggct

SEQ ID NO: 171788 - DNA, 20 bp, Artificial Sequence
  chemically synthesized
tgcctccagctttgttcttt

SEQ ID NO: 171789 - DNA, 20 bp, Artificial Sequence
  chemically synthesized
aatcctgagccaaaagaaca

SEQ ID NO: 171790 - DNA, 20 bp, Artificial Sequence
  chemically synthesized
ctgagccaaaagaacaaagc

SEQ ID NO: 171791 - DNA, 20 bp, Artificial Sequence
  chemically synthesized
gagccaaaagaacaaagctg

SEQ ID NO: 171792 - DNA, 20 bp, Artificial Sequence
  chemically synthesized
agccaaaagaacaaagctgg

SEQ ID NO: 171793 - DNA, 20 bp, Artificial Sequence
  chemically synthesized
gtcaggtagtgtgatgcctc

SEQ ID NO: 171794 - DNA, 20 bp, Artificial Sequence
  chemically synthesized
tagtatagtttgaagtcagg

SEQ ID NO: 171795 - DNA, 20 bp, Artificial Sequence
  chemically synthesized
ttgtagtatagtttgaagtc

SEQ ID NO: 171796 - DNA, 20 bp, Artificial Sequence
  chemically synthesized
cttgtagtatagtttgaagt

SEQ ID NO: 171797 - DNA, 20 bp, Artificial Sequence
  chemically synthesized
tagccttgtagtatagtttg

SEQ ID NO: 171798 - DNA, 20 bp, Artificial Sequence
  chemically synthesized
ctgacttcaaactatactac

SEQ ID NO: 171799 - DNA, 20 bp, Artificial Sequence
  chemically synthesized
tgacttcaaactatactaca

SEQ ID NO: 171800 - DNA, 20 bp, Artificial Sequence
  chemically synthesized
gttactgtagccttgtagta

SEQ ID NO: 171801 - DNA, 20 bp, Artificial Sequence
  chemically synthesized
ttttggttactgtagccttg

SEQ ID NO: 171802 - DNA, 20 bp, Artificial Sequence
  chemically synthesized
caaactatactacaaggcta

SEQ ID NO: 171803 - DNA, 20 bp, Artificial Sequence
  chemically synthesized
ccatgctgttttggttactg

SEQ ID NO: 171804 - DNA, 20 bp, Artificial Sequence
  chemically synthesized
caaggctacagtaaccaaaa

SEQ ID NO: 171805 - DNA, 20 bp, Artificial Sequence
  chemically synthesized
gtaccagtaccatgctgttt

SEQ ID NO: 171806 - DNA, 20 bp, Artificial Sequence
  chemically synthesized
ctacagtaaccaaaacagca

SEQ ID NO: 171807 - DNA, 20 bp, Artificial Sequence
  chemically synthesized
taaccaaaacagcatggtac

SEQ ID NO: 171808 - DNA, 20 bp, Artificial Sequence
  chemically synthesized
ctatatctctgttttggtac

SEQ ID NO: 171809 - DNA, 20 bp, Artificial Sequence
  chemically synthesized
gcatggtactggtaccaaaa

SEQ ID NO: 171810 - DNA, 20 bp, Artificial Sequence
  chemically synthesized
atggtactggtaccaaaaca

SEQ ID NO: 171811 - DNA, 20 bp, Artificial Sequence
  chemically synthesized
attgatctatatctctgttt

SEQ ID NO: 171812 - DNA, 20 bp, Artificial Sequence
  chemically synthesized
ctggtaccaaaacagagata

SEQ ID NO: 171813 - DNA, 20 bp, Artificial Sequence
  chemically synthesized
aaaacagagatatagatcaa

SEQ ID NO: 171814 - DNA, 20 bp, Artificial Sequence
  chemically synthesized
agagatatagatcaatggaa

SEQ ID NO: 171815 - DNA, 20 bp, Artificial Sequence
  chemically synthesized
tatagatcaatggaacagaa

SEQ ID NO: 171816 - DNA, 20 bp, Artificial Sequence
  chemically synthesized
tagatcaatggaacagaaca

SEQ ID NO: 171817 - DNA, 20 bp, Artificial Sequence
  chemically synthesized
atggaacagaacagagccct

SEQ ID NO: 171818 - DNA, 20 bp, Artificial Sequence
  chemically synthesized
gaacagaacagagccctcag

SEQ ID NO: 171819 - DNA, 20 bp, Artificial Sequence
  chemically synthesized
atatgcggcgttacttctga

SEQ ID NO: 171820 - DNA, 20 bp, Artificial Sequence
  chemically synthesized
gatatgcggcgttacttctg

SEQ ID NO: 171821 - DNA, 20 bp, Artificial Sequence
  chemically synthesized
agatatgcggcgttacttct

SEQ ID NO: 171822 - DNA, 20 bp, Artificial Sequence
  chemically synthesized
atcagatagttgtagatatg

SEQ ID NO: 171823 - DNA, 20 bp, Artificial Sequence
  chemically synthesized
tgtcaaagatcagatagttg

SEQ ID NO: 171824 - DNA, 20 bp, Artificial Sequence
  chemically synthesized
caggtttgtcaaagatcaga

SEQ ID NO: 171825 - DNA, 20 bp, Artificial Sequence
  chemically synthesized
ttctcaggtttgtcaaagat

SEQ ID NO: 171826 - DNA, 20 bp, Artificial Sequence
  chemically synthesized
tgtttttctcaggtttgtca

SEQ ID NO: 171827 - DNA, 20 bp, Artificial Sequence
  chemically synthesized
atctgatctttgacaaacct

SEQ ID NO: 171828 - DNA, 20 bp, Artificial Sequence
  chemically synthesized
ccccattgcttgtttttctc

SEQ ID NO: 171829 - DNA, 20 bp, Artificial Sequence
  chemically synthesized
tccccattgcttgtttttct

SEQ ID NO: 171830 - DNA, 20 bp, Artificial Sequence
  chemically synthesized
ttgacaaacctgagaaaaac

SEQ ID NO: 171831 - DNA, 20 bp, Artificial Sequence
  chemically synthesized
aacctgagaaaaacaagcaa

SEQ ID NO: 171832 - DNA, 20 bp, Artificial Sequence
  chemically synthesized
acctgagaaaaacaagcaat

SEQ ID NO: 171833 - DNA, 20 bp, Artificial Sequence
  chemically synthesized
cctgagaaaaacaagcaatg

SEQ ID NO: 171834 - DNA, 20 bp, Artificial Sequence
  chemically synthesized
agaaaaacaagcaatgggga

SEQ ID NO: 171835 - DNA, 20 bp, Artificial Sequence
  chemically synthesized
gaaaaacaagcaatggggaa

SEQ ID NO: 171836 - DNA, 20 bp, Artificial Sequence
  chemically synthesized
ccagcaccgtttattaaata

SEQ ID NO: 171837 - DNA, 20 bp, Artificial Sequence
  chemically synthesized
cccagcaccgtttattaaat

SEQ ID NO: 171838 - DNA, 20 bp, Artificial Sequence
  chemically synthesized
tcccagcaccgtttattaaa

SEQ ID NO: 171839 - DNA, 20 bp, Artificial Sequence
  chemically synthesized
aggattccctatttaataaa

SEQ ID NO: 171840 - DNA, 20 bp, Artificial Sequence
  chemically synthesized
ccctatttaataaacggtgc

SEQ ID NO: 171841 - DNA, 20 bp, Artificial Sequence
  chemically synthesized
cctatttaataaacggtgct

SEQ ID NO: 171842 - DNA, 20 bp, Artificial Sequence
  chemically synthesized
ataaacggtgctgggaaaat

SEQ ID NO: 171843 - DNA, 20 bp, Artificial Sequence
  chemically synthesized
gtatggctagccaattttcc

SEQ ID NO: 171844 - DNA, 20 bp, Artificial Sequence
  chemically synthesized
acggtgctgggaaaattggc

SEQ ID NO: 171845 - DNA, 20 bp, Artificial Sequence
  chemically synthesized
ttcagctttctacgtatggc

SEQ ID NO: 171846 - DNA, 20 bp, Artificial Sequence
  chemically synthesized
gaaaattggctagccatacg

SEQ ID NO: 171847 - DNA, 20 bp, Artificial Sequence
  chemically synthesized
cagtttcagctttctacgta

SEQ ID NO: 171848 - DNA, 20 bp, Artificial Sequence
  chemically synthesized
attggctagccatacgtaga

SEQ ID NO: 171849 - DNA, 20 bp, Artificial Sequence
  chemically synthesized
catacgtagaaagctgaaac

SEQ ID NO: 171850 - DNA, 20 bp, Artificial Sequence
  chemically synthesized
gtaaggaagggatccagttt

SEQ ID NO: 171851 - DNA, 20 bp, Artificial Sequence
  chemically synthesized
taaggtgtaaggaagggatc

SEQ ID NO: 171852 - DNA, 20 bp, Artificial Sequence
  chemically synthesized
tttgtataaggtgtaaggaa

SEQ ID NO: 171853 - DNA, 20 bp, Artificial Sequence
  chemically synthesized
ttttgtataaggtgtaagga

SEQ ID NO: 171854 - DNA, 20 bp, Artificial Sequence
  chemically synthesized
tttttgtataaggtgtaagg

SEQ ID NO: 171855 - DNA, 20 bp, Artificial Sequence
  chemically synthesized
tgatttttgtataaggtgta

SEQ ID NO: 171856 - DNA, 20 bp, Artificial Sequence
  chemically synthesized
ttgatttttgtataaggtgt

SEQ ID NO: 171857 - DNA, 20 bp, Artificial Sequence
  chemically synthesized
cttgaattgatttttgtata

SEQ ID NO: 171858 - DNA, 20 bp, Artificial Sequence
  chemically synthesized
tcttgaattgatttttgtat

SEQ ID NO: 171859 - DNA, 20 bp, Artificial Sequence
  chemically synthesized
ccttatacaaaaatcaattc

SEQ ID NO: 171860 - DNA, 20 bp, Artificial Sequence
  chemically synthesized
atacaaaaatcaattcaaga

SEQ ID NO: 171861 - DNA, 20 bp, Artificial Sequence
  chemically synthesized
aatcaattcaagatggatta

SEQ ID NO: 171862 - DNA, 20 bp, Artificial Sequence
  chemically synthesized
tggattaaagacttaaacgt

SEQ ID NO: 171863 - DNA, 20 bp, Artificial Sequence
  chemically synthesized
tggttttaggtctaacgttt

SEQ ID NO: 171864 - DNA, 20 bp, Artificial Sequence
  chemically synthesized
tctagggtttttatggtttt

SEQ ID NO: 171865 - DNA, 20 bp, Artificial Sequence
  chemically synthesized
ttctagggtttttatggttt

SEQ ID NO: 171866 - DNA, 20 bp, Artificial Sequence
  chemically synthesized
gttatcttctagggttttta

SEQ ID NO: 171867 - DNA, 20 bp, Artificial Sequence
  chemically synthesized
acctaaaaccataaaaaccc

SEQ ID NO: 171868 - DNA, 20 bp, Artificial Sequence
  chemically synthesized
taaaaccataaaaaccctag

SEQ ID NO: 171869 - DNA, 20 bp, Artificial Sequence
  chemically synthesized
aatgcctaggttatcttcta

SEQ ID NO: 171870 - DNA, 20 bp, Artificial Sequence
  chemically synthesized
taatgcctaggttatcttct

SEQ ID NO: 171871 - DNA, 20 bp, Artificial Sequence
  chemically synthesized
gtaatgcctaggttatcttc

SEQ ID NO: 171872 - DNA, 20 bp, Artificial Sequence
  chemically synthesized
aaaaaccctagaagataacc

SEQ ID NO: 171873 - DNA, 20 bp, Artificial Sequence
  chemically synthesized
aaaaccctagaagataacct

SEQ ID NO: 171874 - DNA, 20 bp, Artificial Sequence
  chemically synthesized
gaaaagaaattgtaatgcct

SEQ ID NO: 171875 - DNA, 20 bp, Artificial Sequence
  chemically synthesized
agaaaagaaattgtaatgcc

SEQ ID NO: 171876 - DNA, 20 bp, Artificial Sequence
  chemically synthesized
gcattacaatttcttttctt

SEQ ID NO: 171877 - DNA, 20 bp, Artificial Sequence
  chemically synthesized
cattacaatttcttttctta

SEQ ID NO: 171878 - DNA, 20 bp, Artificial Sequence
  chemically synthesized
aaaccatcattccttaagaa

SEQ ID NO: 171879 - DNA, 20 bp, Artificial Sequence
  chemically synthesized
tactcaaaccatcattcctt

SEQ ID NO: 171880 - DNA, 20 bp, Artificial Sequence
  chemically synthesized
tttcttttcttaaggaatga

SEQ ID NO: 171881 - DNA, 20 bp, Artificial Sequence
  chemically synthesized
ttcttaaggaatgatggttt

SEQ ID NO: 171882 - DNA, 20 bp, Artificial Sequence
  chemically synthesized
tgatggtttgagtaatcctt

SEQ ID NO: 171883 - DNA, 20 bp, Artificial Sequence
  chemically synthesized
gatggtttgagtaatccttt

SEQ ID NO: 171884 - DNA, 20 bp, Artificial Sequence
  chemically synthesized
atggtttgagtaatccttta

SEQ ID NO: 171885 - DNA, 20 bp, Artificial Sequence
  chemically synthesized
tgtaaagggtaaaaccctaa

SEQ ID NO: 171886 - DNA, 20 bp, Artificial Sequence
  chemically synthesized
atgtaaagggtaaaacccta

SEQ ID NO: 171887 - DNA, 20 bp, Artificial Sequence
  chemically synthesized
acaatttaatggcatgtaaa

SEQ ID NO: 171888 - DNA, 20 bp, Artificial Sequence
  chemically synthesized
gacaatttaatggcatgtaa

SEQ ID NO: 171889 - DNA, 20 bp, Artificial Sequence
  chemically synthesized
tgacaatttaatggcatgta

SEQ ID NO: 171890 - DNA, 20 bp, Artificial Sequence
  chemically synthesized
gattaattatgacaatttaa

SEQ ID NO: 171891 - DNA, 20 bp, Artificial Sequence
  chemically synthesized
cataattaatcatcatgcaa

SEQ ID NO: 171892 - DNA, 20 bp, Artificial Sequence
  chemically synthesized
ataattaatcatcatgcaac

SEQ ID NO: 171893 - DNA, 20 bp, Artificial Sequence
  chemically synthesized
gcaacaggttgtaacatgta

SEQ ID NO: 171894 - DNA, 20 bp, Artificial Sequence
  chemically synthesized
taacatgtaaagtgacaatt

SEQ ID NO: 171895 - DNA, 20 bp, Artificial Sequence
  chemically synthesized
acatgtaaagtgacaattta

SEQ ID NO: 171896 - DNA, 20 bp, Artificial Sequence
  chemically synthesized
catgtaaagtgacaatttag

SEQ ID NO: 171897 - DNA, 20 bp, Artificial Sequence
  chemically synthesized
tgacaatttagaggctgata

SEQ ID NO: 171898 - DNA, 20 bp, Artificial Sequence
  chemically synthesized
caatttagaggctgatacag

SEQ ID NO: 171899 - DNA, 20 bp, Artificial Sequence
  chemically synthesized
tattcgctattcttctgtat

SEQ ID NO: 171900 - DNA, 20 bp, Artificial Sequence
  chemically synthesized
tagaggctgatacagaagaa

SEQ ID NO: 171901 - DNA, 20 bp, Artificial Sequence
  chemically synthesized
tacagaagaatagcgaataa

SEQ ID NO: 171902 - DNA, 20 bp, Artificial Sequence
  chemically synthesized
acagaagaatagcgaataac

SEQ ID NO: 171903 - DNA, 20 bp, Artificial Sequence
  chemically synthesized
cagaagaatagcgaataaca

SEQ ID NO: 171904 - DNA, 20 bp, Artificial Sequence
  chemically synthesized
agaagaatagcgaataacag

SEQ ID NO: 171905 - DNA, 20 bp, Artificial Sequence
  chemically synthesized
aatagcgaataacaggggtt

SEQ ID NO: 171906 - DNA, 20 bp, Artificial Sequence
  chemically synthesized
gtttttatgcatcatttctt

SEQ ID NO: 171907 - DNA, 20 bp, Artificial Sequence
  chemically synthesized
tttttatgcatcatttcttc

SEQ ID NO: 171908 - DNA, 20 bp, Artificial Sequence
  chemically synthesized
cctcatgatgtgttttcctg

SEQ ID NO: 171909 - DNA, 20 bp, Artificial Sequence
  chemically synthesized
tcttcaggaaaacacatcat

SEQ ID NO: 171910 - DNA, 20 bp, Artificial Sequence
  chemically synthesized
cttcaggaaaacacatcatg

SEQ ID NO: 171911 - DNA, 20 bp, Artificial Sequence
  chemically synthesized
ttcaggaaaacacatcatga

SEQ ID NO: 171912 - DNA, 20 bp, Artificial Sequence
  chemically synthesized
tcaggaaaacacatcatgag

SEQ ID NO: 171913 - DNA, 20 bp, Artificial Sequence
  chemically synthesized
aaacacatcatgaggggaaa

SEQ ID NO: 171914 - DNA, 20 bp, Artificial Sequence
  chemically synthesized
gaggggaaatagctttgaat

SEQ ID NO: 171915 - DNA, 20 bp, Artificial Sequence
  chemically synthesized
accttcactgaacttattca

SEQ ID NO: 171916 - DNA, 20 bp, Artificial Sequence
  chemically synthesized
gaaatagctttgaataagtt

SEQ ID NO: 171917 - DNA, 20 bp, Artificial Sequence
  chemically synthesized
agctttgaataagttcagtg

SEQ ID NO: 171918 - DNA, 20 bp, Artificial Sequence
  chemically synthesized
gctttgaataagttcagtga

SEQ ID NO: 171919 - DNA, 20 bp, Artificial Sequence
  chemically synthesized
gttcagtgaaggttgccatt

SEQ ID NO: 171920 - DNA, 20 bp, Artificial Sequence
  chemically synthesized
ggttaagttaattaactaaa

SEQ ID NO: 171921 - DNA, 20 bp, Artificial Sequence
  chemically synthesized
gtctgctaatgaaaatggtt

SEQ ID NO: 171922 - DNA, 20 bp, Artificial Sequence
  chemically synthesized
attaacttaaccattttcat

SEQ ID NO: 171923 - DNA, 20 bp, Artificial Sequence
  chemically synthesized
actgagtctgctaatgaaaa

SEQ ID NO: 171924 - DNA, 20 bp, Artificial Sequence
  chemically synthesized
aacttaaccattttcattag

SEQ ID NO: 171925 - DNA, 20 bp, Artificial Sequence
  chemically synthesized
accattttcattagcagact

SEQ ID NO: 171926 - DNA, 20 bp, Artificial Sequence
  chemically synthesized
agtattctaaagtcaatact

SEQ ID NO: 171927 - DNA, 20 bp, Artificial Sequence
  chemically synthesized
agcagactcagtattgactt

SEQ ID NO: 171928 - DNA, 20 bp, Artificial Sequence
  chemically synthesized
attaagcagacagtattcta

SEQ ID NO: 171929 - DNA, 20 bp, Artificial Sequence
  chemically synthesized
tttggaagaaattaagcaga

SEQ ID NO: 171930 - DNA, 20 bp, Artificial Sequence
  chemically synthesized
attgtttggaagaaattaag

SEQ ID NO: 171931 - DNA, 20 bp, Artificial Sequence
  chemically synthesized
ttcattgtttggaagaaatt

SEQ ID NO: 171932 - DNA, 20 bp, Artificial Sequence
  chemically synthesized
catacatattcattgtttgg

SEQ ID NO: 171933 - DNA, 20 bp, Artificial Sequence
  chemically synthesized
tttcatacatattcattgtt

SEQ ID NO: 171934 - DNA, 20 bp, Artificial Sequence
  chemically synthesized
atatgtatgaaacaccacca

SEQ ID NO: 171935 - DNA, 20 bp, Artificial Sequence
  chemically synthesized
tatgtatgaaacaccaccaa

SEQ ID NO: 171936 - DNA, 20 bp, Artificial Sequence
  chemically synthesized
cattttcactttacctttgg

SEQ ID NO: 171937 - DNA, 20 bp, Artificial Sequence
  chemically synthesized
atgaaacaccaccaaaggta

SEQ ID NO: 171938 - DNA, 20 bp, Artificial Sequence
  chemically synthesized
cttcattttcactttacctt

SEQ ID NO: 171939 - DNA, 20 bp, Artificial Sequence
  chemically synthesized
ccaaaggtaaagtgaaaatg

SEQ ID NO: 171940 - DNA, 20 bp, Artificial Sequence
  chemically synthesized
aagtgaaaatgaagacaata

SEQ ID NO: 171941 - DNA, 20 bp, Artificial Sequence
  chemically synthesized
agtgaaaatgaagacaatat

SEQ ID NO: 171942 - DNA, 20 bp, Artificial Sequence
  chemically synthesized
attaaattattaaaatatat

SEQ ID NO: 171943 - DNA, 20 bp, Artificial Sequence
  chemically synthesized
attattaaaatatatcagaa

SEQ ID NO: 171944 - DNA, 20 bp, Artificial Sequence
  chemically synthesized
aaatatatcagaaaagtatg

SEQ ID NO: 171945 - DNA, 20 bp, Artificial Sequence
  chemically synthesized
agcacactgcaattgaatat

SEQ ID NO: 171946 - DNA, 20 bp, Artificial Sequence
  chemically synthesized
tataaacttatattcaattg

SEQ ID NO: 171947 - DNA, 20 bp, Artificial Sequence
  chemically synthesized
catatcttaaaagtttggag

SEQ ID NO: 171948 - DNA, 20 bp, Artificial Sequence
  chemically synthesized
gtcatatcttaaaagtttgg

SEQ ID NO: 171949 - DNA, 20 bp, Artificial Sequence
  chemically synthesized
ggtcatatcttaaaagtttg

SEQ ID NO: 171950 - DNA, 20 bp, Artificial Sequence
  chemically synthesized
gtgtgctcctccaaactttt

SEQ ID NO: 171951 - DNA, 20 bp, Artificial Sequence
  chemically synthesized
aaggtcatatcttaaaagtt

SEQ ID NO: 171952 - DNA, 20 bp, Artificial Sequence
  chemically synthesized
atgccaaggtcatatcttaa

SEQ ID NO: 171953 - DNA, 20 bp, Artificial Sequence
  chemically synthesized
aaacttttaagatatgacct

SEQ ID NO: 171954 - DNA, 20 bp, Artificial Sequence
  chemically synthesized
tttaagatatgaccttggca

SEQ ID NO: 171955 - DNA, 20 bp, Artificial Sequence
  chemically synthesized
ttaagatatgaccttggcat

SEQ ID NO: 171956 - DNA, 20 bp, Artificial Sequence
  chemically synthesized
gaaataatgtgcctatgcca

SEQ ID NO: 171957 - DNA, 20 bp, Artificial Sequence
  chemically synthesized
tgaaataatgtgcctatgcc

SEQ ID NO: 171958 - DNA, 20 bp, Artificial Sequence
  chemically synthesized
ttggcataggcacattattt

SEQ ID NO: 171959 - DNA, 20 bp, Artificial Sequence
  chemically synthesized
ggcacattatttcagctgct

SEQ ID NO: 171960 - DNA, 20 bp, Artificial Sequence
  chemically synthesized
attatttcagctgcttagca

SEQ ID NO: 171961 - DNA, 20 bp, Artificial Sequence
  chemically synthesized
attacaaatcctgtgctaag

SEQ ID NO: 171962 - DNA, 20 bp, Artificial Sequence
  chemically synthesized
ttatttcagctgcttagcac

SEQ ID NO: 171963 - DNA, 20 bp, Artificial Sequence
  chemically synthesized
attattacaaatcctgtgct

SEQ ID NO: 171964 - DNA, 20 bp, Artificial Sequence
  chemically synthesized
atgcattttcttataaaatt

SEQ ID NO: 171965 - DNA, 20 bp, Artificial Sequence
  chemically synthesized
tgtaataatctcaattttat

SEQ ID NO: 171966 - DNA, 20 bp, Artificial Sequence
  chemically synthesized
aagaaaatgcatttctaaat

SEQ ID NO: 171967 - DNA, 20 bp, Artificial Sequence
  chemically synthesized
aaatgcatttctaaattggt

SEQ ID NO: 171968 - DNA, 20 bp, Artificial Sequence
  chemically synthesized
ttagccttctccaaccaatt

SEQ ID NO: 171969 - DNA, 20 bp, Artificial Sequence
  chemically synthesized
atgcatttctaaattggttg

SEQ ID NO: 171970 - DNA, 20 bp, Artificial Sequence
  chemically synthesized
catttctaaattggttggag

SEQ ID NO: 171971 - DNA, 20 bp, Artificial Sequence
  chemically synthesized
atttctaaattggttggaga

SEQ ID NO: 171972 - DNA, 20 bp, Artificial Sequence
  chemically synthesized
actggatttatgcattgttt

SEQ ID NO: 171973 - DNA, 20 bp, Artificial Sequence
  chemically synthesized
gctaaaacaatgcataaatc

SEQ ID NO: 171974 - DNA, 20 bp, Artificial Sequence
  chemically synthesized
gaaaattatattcagtgcac

SEQ ID NO: 171975 - DNA, 20 bp, Artificial Sequence
  chemically synthesized
ttgaagcagaaaattatatt

SEQ ID NO: 171976 - DNA, 20 bp, Artificial Sequence
  chemically synthesized
gactagatcgtcagttgaag

SEQ ID NO: 171977 - DNA, 20 bp, Artificial Sequence
  chemically synthesized
aaagactagatcgtcagttg

SEQ ID NO: 171978 - DNA, 20 bp, Artificial Sequence
  chemically synthesized
ttctgcttcaactgacgatc

SEQ ID NO: 171979 - DNA, 20 bp, Artificial Sequence
  chemically synthesized
tcttcaaaagactagatcgt

SEQ ID NO: 171980 - DNA, 20 bp, Artificial Sequence
  chemically synthesized
aagcctgttcttcaaaagac

SEQ ID NO: 171981 - DNA, 20 bp, Artificial Sequence
  chemically synthesized
actgacgatctagtcttttg

SEQ ID NO: 171982 - DNA, 20 bp, Artificial Sequence
  chemically synthesized
aaaaaaagcctgttcttcaa

SEQ ID NO: 171983 - DNA, 20 bp, Artificial Sequence
  chemically synthesized
cgatctagtcttttgaagaa

SEQ ID NO: 171984 - DNA, 20 bp, Artificial Sequence
  chemically synthesized
gatctagtcttttgaagaac

SEQ ID NO: 171985 - DNA, 20 bp, Artificial Sequence
  chemically synthesized
aaaaatggttaaaaaaaaaa

SEQ ID NO: 171986 - DNA, 20 bp, Artificial Sequence
  chemically synthesized
tttttttttttaaccatttt

SEQ ID NO: 171987 - DNA, 20 bp, Artificial Sequence
  chemically synthesized
aaaatgaatatggccaaaaa

SEQ ID NO: 171988 - DNA, 20 bp, Artificial Sequence
  chemically synthesized
gaagttgcagaaaatgaata

SEQ ID NO: 171989 - DNA, 20 bp, Artificial Sequence
  chemically synthesized
tttattccaacatgaagttg

SEQ ID NO: 171990 - DNA, 20 bp, Artificial Sequence
  chemically synthesized
cattttctgcaacttcatgt

SEQ ID NO: 171991 - DNA, 20 bp, Artificial Sequence
  chemically synthesized
attttatttattccaacatg

SEQ ID NO: 171992 - DNA, 20 bp, Artificial Sequence
  chemically synthesized
catgttggaataaataaaat

SEQ ID NO: 171993 - DNA, 20 bp, Artificial Sequence
  chemically synthesized
gttggaataaataaaatcag

SEQ ID NO: 171994 - DNA, 20 bp, Artificial Sequence
  chemically synthesized
ttggaataaataaaatcagc

SEQ ID NO: 171995 - DNA, 20 bp, Artificial Sequence
  chemically synthesized
ttctccctccaaaaatcaat

SEQ ID NO: 171996 - DNA, 20 bp, Artificial Sequence
  chemically synthesized
tttctccctccaaaaatcaa

SEQ ID NO: 171997 - DNA, 20 bp, Artificial Sequence
  chemically synthesized
agcaggtgcctattgatttt

SEQ ID NO: 171998 - DNA, 20 bp, Artificial Sequence
  chemically synthesized
caggtgcctattgatttttg

SEQ ID NO: 171999 - DNA, 20 bp, Artificial Sequence
  chemically synthesized
aggtgcctattgatttttgg

SEQ ID NO: 172000 - DNA, 20 bp, Artificial Sequence
  chemically synthesized
ggtgcctattgatttttgga

SEQ ID NO: 172001 - DNA, 20 bp, Artificial Sequence
  chemically synthesized
tgcctattgatttttggagg

SEQ ID NO: 172002 - DNA, 20 bp, Artificial Sequence
  chemically synthesized
gagggagaaatctcattcgt

SEQ ID NO: 172003 - DNA, 20 bp, Artificial Sequence
  chemically synthesized
tttttttcagtcttacgaat

SEQ ID NO: 172004 - DNA, 20 bp, Artificial Sequence
  chemically synthesized
tcattcgtaagactgaaaaa

SEQ ID NO: 172005 - DNA, 20 bp, Artificial Sequence
  chemically synthesized
tgatggacttcacttttttt

SEQ ID NO: 172006 - DNA, 20 bp, Artificial Sequence
  chemically synthesized
cgtaagactgaaaaaaagtg

SEQ ID NO: 172007 - DNA, 20 bp, Artificial Sequence
  chemically synthesized
tgttcatcagttggttatga

SEQ ID NO: 172008 - DNA, 20 bp, Artificial Sequence
  chemically synthesized
acacgtatttgttcatcagt

SEQ ID NO: 172009 - DNA, 20 bp, Artificial Sequence
  chemically synthesized
tttcacacgtatttgttcat

SEQ ID NO: 172010 - DNA, 20 bp, Artificial Sequence
  chemically synthesized
acaaatacgtgtgaaaattg

SEQ ID NO: 172011 - DNA, 20 bp, Artificial Sequence
  chemically synthesized
aattgaagaaaataataacg

SEQ ID NO: 172012 - DNA, 20 bp, Artificial Sequence
  chemically synthesized
aaaataataacgtagaaaca

SEQ ID NO: 172013 - DNA, 20 bp, Artificial Sequence
  chemically synthesized
aaataataacgtagaaacaa

SEQ ID NO: 172014 - DNA, 20 bp, Artificial Sequence
  chemically synthesized
aataataacgtagaaacaaa

SEQ ID NO: 172015 - DNA, 20 bp, Artificial Sequence
  chemically synthesized
tgaaaatcagtcatattaaa

SEQ ID NO: 172016 - DNA, 20 bp, Artificial Sequence
  chemically synthesized
acaaatccagatttgaaaat

SEQ ID NO: 172017 - DNA, 20 bp, Artificial Sequence
  chemically synthesized
atatgactgattttcaaatc

SEQ ID NO: 172018 - DNA, 20 bp, Artificial Sequence
  chemically synthesized
actcctagagacaacaaatc

SEQ ID NO: 172019 - DNA, 20 bp, Artificial Sequence
  chemically synthesized
aaatctggatttgttgtctc

SEQ ID NO: 172020 - DNA, 20 bp, Artificial Sequence
  chemically synthesized
aatctggatttgttgtctct

SEQ ID NO: 172021 - DNA, 20 bp, Artificial Sequence
  chemically synthesized
tctggatttgttgtctctag

SEQ ID NO: 172022 - DNA, 20 bp, Artificial Sequence
  chemically synthesized
gatttgttgtctctaggagt

SEQ ID NO: 172023 - DNA, 20 bp, Artificial Sequence
  chemically synthesized
ttcccaccttccaactccta

SEQ ID NO: 172024 - DNA, 20 bp, Artificial Sequence
  chemically synthesized
ccttcccaccttccaactcc

SEQ ID NO: 172025 - DNA, 20 bp, Artificial Sequence
  chemically synthesized
ttgttgtctctaggagttgg

SEQ ID NO: 172026 - DNA, 20 bp, Artificial Sequence
  chemically synthesized
tgttgtctctaggagttgga

SEQ ID NO: 172027 - DNA, 20 bp, Artificial Sequence
  chemically synthesized
tgtctctaggagttggaagg

SEQ ID NO: 172028 - DNA, 20 bp, Artificial Sequence
  chemically synthesized
gtctctaggagttggaaggt

SEQ ID NO: 172029 - DNA, 20 bp, Artificial Sequence
  chemically synthesized
tctaggagttggaaggtggg

SEQ ID NO: 172030 - DNA, 20 bp, Artificial Sequence
  chemically synthesized
ctaggagttggaaggtggga

SEQ ID NO: 172031 - DNA, 20 bp, Artificial Sequence
  chemically synthesized
attaataaaaaaaattttgc

SEQ ID NO: 172032 - DNA, 20 bp, Artificial Sequence
  chemically synthesized
aattaataaaaaaaattttg

SEQ ID NO: 172033 - DNA, 20 bp, Artificial Sequence
  chemically synthesized
ttttttttattaatttaaaa

SEQ ID NO: 172034 - DNA, 20 bp, Artificial Sequence
  chemically synthesized
tttttttattaatttaaaat

SEQ ID NO: 172035 - DNA, 20 bp, Artificial Sequence
  chemically synthesized
aggacgatatacattccata

SEQ ID NO: 172036 - DNA, 20 bp, Artificial Sequence
  chemically synthesized
gaaaataaataatcgctgta

SEQ ID NO: 172037 - DNA, 20 bp, Artificial Sequence
  chemically synthesized
tagttaagactgttatggtt

SEQ ID NO: 172038 - DNA, 20 bp, Artificial Sequence
  chemically synthesized
atttattttcttaaccataa

SEQ ID NO: 172039 - DNA, 20 bp, Artificial Sequence
  chemically synthesized
tgctctagttaagactgtta

SEQ ID NO: 172040 - DNA, 20 bp, Artificial Sequence
  chemically synthesized
ttaaccataacagtcttaac

SEQ ID NO: 172041 - DNA, 20 bp, Artificial Sequence
  chemically synthesized
aaccataacagtcttaacta

SEQ ID NO: 172042 - DNA, 20 bp, Artificial Sequence
  chemically synthesized
ttctgctgtgtgctctagtt

SEQ ID NO: 172043 - DNA, 20 bp, Artificial Sequence
  chemically synthesized
acagtcttaactagagcaca

SEQ ID NO: 172044 - DNA, 20 bp, Artificial Sequence
  chemically synthesized
attgattctgctgtgtgctc

SEQ ID NO: 172045 - DNA, 20 bp, Artificial Sequence
  chemically synthesized
gtcttaactagagcacacag

SEQ ID NO: 172046 - DNA, 20 bp, Artificial Sequence
  chemically synthesized
gagcacacagcagaatcaat

SEQ ID NO: 172047 - DNA, 20 bp, Artificial Sequence
  chemically synthesized
agcacacagcagaatcaatt

SEQ ID NO: 172048 - DNA, 20 bp, Artificial Sequence
  chemically synthesized
acacagcagaatcaattggg

SEQ ID NO: 172049 - DNA, 20 bp, Artificial Sequence
  chemically synthesized
cacagcagaatcaattgggt

SEQ ID NO: 172050 - DNA, 20 bp, Artificial Sequence
  chemically synthesized
cagcagaatcaattgggtag

SEQ ID NO: 172051 - DNA, 20 bp, Artificial Sequence
  chemically synthesized
ttgttttaatatgtatatcc

SEQ ID NO: 172052 - DNA, 20 bp, Artificial Sequence
  chemically synthesized
agattctctggtatggagct

SEQ ID NO: 172053 - DNA, 20 bp, Artificial Sequence
  chemically synthesized
tgtatatccaagctccatac

SEQ ID NO: 172054 - DNA, 20 bp, Artificial Sequence
  chemically synthesized
tatatccaagctccatacca

SEQ ID NO: 172055 - DNA, 20 bp, Artificial Sequence
  chemically synthesized
gaattagattctctggtatg

SEQ ID NO: 172056 - DNA, 20 bp, Artificial Sequence
  chemically synthesized
tggaattagattctctggta

SEQ ID NO: 172057 - DNA, 20 bp, Artificial Sequence
  chemically synthesized
acttatggaattagattctc

SEQ ID NO: 172058 - DNA, 20 bp, Artificial Sequence
  chemically synthesized
accagagaatctaattccat

SEQ ID NO: 172059 - DNA, 20 bp, Artificial Sequence
  chemically synthesized
ccattacaaacttatggaat

SEQ ID NO: 172060 - DNA, 20 bp, Artificial Sequence
  chemically synthesized
gcgactccattacaaactta

SEQ ID NO: 172061 - DNA, 20 bp, Artificial Sequence
  chemically synthesized
ctaattccataagtttgtaa

SEQ ID NO: 172062 - DNA, 20 bp, Artificial Sequence
  chemically synthesized
aattccataagtttgtaatg

SEQ ID NO: 172063 - DNA, 20 bp, Artificial Sequence
  chemically synthesized
agtttgtaatggagtcgcga

SEQ ID NO: 172064 - DNA, 20 bp, Artificial Sequence
  chemically synthesized
ataaatagaaaaattaggtt

SEQ ID NO: 172065 - DNA, 20 bp, Artificial Sequence
  chemically synthesized
atattataaatagaaaaatt

SEQ ID NO: 172066 - DNA, 20 bp, Artificial Sequence
  chemically synthesized
tatattataaatagaaaaat

SEQ ID NO: 172067 - DNA, 20 bp, Artificial Sequence
  chemically synthesized
atctatttctatattataaa

SEQ ID NO: 172068 - DNA, 20 bp, Artificial Sequence
  chemically synthesized
taatttttctatttataata

SEQ ID NO: 172069 - DNA, 20 bp, Artificial Sequence
  chemically synthesized
ttctatttataatatagaaa

SEQ ID NO: 172070 - DNA, 20 bp, Artificial Sequence
  chemically synthesized
ataatatagaaatagatgct

SEQ ID NO: 172071 - DNA, 20 bp, Artificial Sequence
  chemically synthesized
agaaatagatgcttagatcc

SEQ ID NO: 172072 - DNA, 20 bp, Artificial Sequence
  chemically synthesized
tgtttgtaccactgggatct

SEQ ID NO: 172073 - DNA, 20 bp, Artificial Sequence
  chemically synthesized
aatagatgcttagatcccag

SEQ ID NO: 172074 - DNA, 20 bp, Artificial Sequence
  chemically synthesized
gcagggatgtttgtaccact

SEQ ID NO: 172075 - DNA, 20 bp, Artificial Sequence
  chemically synthesized
agcagggatgtttgtaccac

SEQ ID NO: 172076 - DNA, 20 bp, Artificial Sequence
  chemically synthesized
agtggtacaaacatccctgc

SEQ ID NO: 172077 - DNA, 20 bp, Artificial Sequence
  chemically synthesized
tggtacaaacatccctgcta

SEQ ID NO: 172078 - DNA, 20 bp, Artificial Sequence
  chemically synthesized
agtttgtgtgggctctagca

SEQ ID NO: 172079 - DNA, 20 bp, Artificial Sequence
  chemically synthesized
cagtttgtgtgggctctagc

SEQ ID NO: 172080 - DNA, 20 bp, Artificial Sequence
  chemically synthesized
gcagtttgtgtgggctctag

SEQ ID NO: 172081 - DNA, 20 bp, Artificial Sequence
  chemically synthesized
attgcagtttgtgtgggctc

SEQ ID NO: 172082 - DNA, 20 bp, Artificial Sequence
  chemically synthesized
ataggcattgcagtttgtgt

SEQ ID NO: 172083 - DNA, 20 bp, Artificial Sequence
  chemically synthesized
aataggcattgcagtttgtg

SEQ ID NO: 172084 - DNA, 20 bp, Artificial Sequence
  chemically synthesized
cttactactaataggcattg

SEQ ID NO: 172085 - DNA, 20 bp, Artificial Sequence
  chemically synthesized
acacaaactgcaatgcctat

SEQ ID NO: 172086 - DNA, 20 bp, Artificial Sequence
  chemically synthesized
caaactgcaatgcctattag

SEQ ID NO: 172087 - DNA, 20 bp, Artificial Sequence
  chemically synthesized
ctcattttcttactactaat

SEQ ID NO: 172088 - DNA, 20 bp, Artificial Sequence
  chemically synthesized
tctcattttcttactactaa

SEQ ID NO: 172089 - DNA, 20 bp, Artificial Sequence
  chemically synthesized
ctgcaatgcctattagtagt

SEQ ID NO: 172090 - DNA, 20 bp, Artificial Sequence
  chemically synthesized
cctattagtagtaagaaaat

SEQ ID NO: 172091 - DNA, 20 bp, Artificial Sequence
  chemically synthesized
caaaatgttaaaaagagaag

SEQ ID NO: 172092 - DNA, 20 bp, Artificial Sequence
  chemically synthesized
gaacaaaatgttaaaaagag

SEQ ID NO: 172093 - DNA, 20 bp, Artificial Sequence
  chemically synthesized
tgagaacaaaatgttaaaaa

SEQ ID NO: 172094 - DNA, 20 bp, Artificial Sequence
  chemically synthesized
aatgagaacaaaatgttaaa

SEQ ID NO: 172095 - DNA, 20 bp, Artificial Sequence
  chemically synthesized
ggtaaatgcagattgagaat

SEQ ID NO: 172096 - DNA, 20 bp, Artificial Sequence
  chemically synthesized
atctgaggtaaatgcagatt

SEQ ID NO: 172097 - DNA, 20 bp, Artificial Sequence
  chemically synthesized
tagtaaatctgaggtaaatg

SEQ ID NO: 172098 - DNA, 20 bp, Artificial Sequence
  chemically synthesized
ttctcaatctgcatttacct

SEQ ID NO: 172099 - DNA, 20 bp, Artificial Sequence
  chemically synthesized
ttttagacttagtaaatctg

SEQ ID NO: 172100 - DNA, 20 bp, Artificial Sequence
  chemically synthesized
gttttagacttagtaaatct

SEQ ID NO: 172101 - DNA, 20 bp, Artificial Sequence
  chemically synthesized
gcatttacctcagatttact

SEQ ID NO: 172102 - DNA, 20 bp, Artificial Sequence
  chemically synthesized
cttgacttgagttttagact

SEQ ID NO: 172103 - DNA, 20 bp, Artificial Sequence
  chemically synthesized
atttactaagtctaaaactc

SEQ ID NO: 172104 - DNA, 20 bp, Artificial Sequence
  chemically synthesized
actacacttgacttgagttt

SEQ ID NO: 172105 - DNA, 20 bp, Artificial Sequence
  chemically synthesized
ctaagtctaaaactcaagtc

SEQ ID NO: 172106 - DNA, 20 bp, Artificial Sequence
  chemically synthesized
tactgcactacacttgactt

SEQ ID NO: 172107 - DNA, 20 bp, Artificial Sequence
  chemically synthesized
tctaaaactcaagtcaagtg

SEQ ID NO: 172108 - DNA, 20 bp, Artificial Sequence
  chemically synthesized
aactcaagtcaagtgtagtg

SEQ ID NO: 172109 - DNA, 20 bp, Artificial Sequence
  chemically synthesized
caagtgtagtgcagtaaaac

SEQ ID NO: 172110 - DNA, 20 bp, Artificial Sequence
  chemically synthesized
tgtagtgcagtaaaacaagt

SEQ ID NO: 172111 - DNA, 20 bp, Artificial Sequence
  chemically synthesized
tgcagtaaaacaagtaagtt

SEQ ID NO: 172112 - DNA, 20 bp, Artificial Sequence
  chemically synthesized
cagtaaaacaagtaagttaa

SEQ ID NO: 172113 - DNA, 20 bp, Artificial Sequence
  chemically synthesized
aaaacaagtaagttaagagc

SEQ ID NO: 172114 - DNA, 20 bp, Artificial Sequence
  chemically synthesized
acaagtaagttaagagctgg

SEQ ID NO: 172115 - DNA, 20 bp, Artificial Sequence
  chemically synthesized
caagtaagttaagagctgga

SEQ ID NO: 172116 - DNA, 20 bp, Artificial Sequence
  chemically synthesized
actgttacaccgagtccttc

SEQ ID NO: 172117 - DNA, 20 bp, Artificial Sequence
  chemically synthesized
agttaagagctggaaggact

SEQ ID NO: 172118 - DNA, 20 bp, Artificial Sequence
  chemically synthesized
gctggaaggactcggtgtaa

SEQ ID NO: 172119 - DNA, 20 bp, Artificial Sequence
  chemically synthesized
ataatgcacactgttacacc

SEQ ID NO: 172120 - DNA, 20 bp, Artificial Sequence
  chemically synthesized
actaaaatccaaaggcacat

SEQ ID NO: 172121 - DNA, 20 bp, Artificial Sequence
  chemically synthesized
cattatgacttatgtgcctt

SEQ ID NO: 172122 - DNA, 20 bp, Artificial Sequence
  chemically synthesized
cccccaaaactaaaatccaa

SEQ ID NO: 172123 - DNA, 20 bp, Artificial Sequence
  chemically synthesized
acttatgtgcctttggattt

SEQ ID NO: 172124 - DNA, 20 bp, Artificial Sequence
  chemically synthesized
ccccccaaaactaaaatcca

SEQ ID NO: 172125 - DNA, 20 bp, Artificial Sequence
  chemically synthesized
gtgcctttggattttagttt

SEQ ID NO: 172126 - DNA, 20 bp, Artificial Sequence
  chemically synthesized
tgcctttggattttagtttt

SEQ ID NO: 172127 - DNA, 20 bp, Artificial Sequence
  chemically synthesized
gcctttggattttagttttg

SEQ ID NO: 172128 - DNA, 20 bp, Artificial Sequence
  chemically synthesized
cctttggattttagttttgg

SEQ ID NO: 172129 - DNA, 20 bp, Artificial Sequence
  chemically synthesized
ctttggattttagttttggg

SEQ ID NO: 172130 - DNA, 20 bp, Artificial Sequence
  chemically synthesized
gttttggggggaaccacttt

SEQ ID NO: 172131 - DNA, 20 bp, Artificial Sequence
  chemically synthesized
aagaagaaatgggcttaaag

SEQ ID NO: 172132 - DNA, 20 bp, Artificial Sequence
  chemically synthesized
caaaagaagaaatgggctta

SEQ ID NO: 172133 - DNA, 20 bp, Artificial Sequence
  chemically synthesized
tgttctacaaaagaagaaat

SEQ ID NO: 172134 - DNA, 20 bp, Artificial Sequence
  chemically synthesized
ctgttctacaaaagaagaaa

SEQ ID NO: 172135 - DNA, 20 bp, Artificial Sequence
  chemically synthesized
taagcccatttcttcttttg

SEQ ID NO: 172136 - DNA, 20 bp, Artificial Sequence
  chemically synthesized
aactctctgttctacaaaag

SEQ ID NO: 172137 - DNA, 20 bp, Artificial Sequence
  chemically synthesized
attaactctctgttctacaa

SEQ ID NO: 172138 - DNA, 20 bp, Artificial Sequence
  chemically synthesized
ccatttcttcttttgtagaa

SEQ ID NO: 172139 - DNA, 20 bp, Artificial Sequence
  chemically synthesized
atttcttcttttgtagaaca

SEQ ID NO: 172140 - DNA, 20 bp, Artificial Sequence
  chemically synthesized
ttcttcttttgtagaacaga

SEQ ID NO: 172141 - DNA, 20 bp, Artificial Sequence
  chemically synthesized
gaacagagagttaattctca

SEQ ID NO: 172142 - DNA, 20 bp, Artificial Sequence
  chemically synthesized
ctaggaagtatagatactgt

SEQ ID NO: 172143 - DNA, 20 bp, Artificial Sequence
  chemically synthesized
ctcacagtatctatacttcc

SEQ ID NO: 172144 - DNA, 20 bp, Artificial Sequence
  chemically synthesized
ggaagaggaactaggaagta

SEQ ID NO: 172145 - DNA, 20 bp, Artificial Sequence
  chemically synthesized
gaaaaggaagaggaactagg

SEQ ID NO: 172146 - DNA, 20 bp, Artificial Sequence
  chemically synthesized
ggagaaaaggaagaggaact

SEQ ID NO: 172147 - DNA, 20 bp, Artificial Sequence
  chemically synthesized
tggagaaaaggaagaggaac

SEQ ID NO: 172148 - DNA, 20 bp, Artificial Sequence
  chemically synthesized
tacacatggagaaaaggaag

SEQ ID NO: 172149 - DNA, 20 bp, Artificial Sequence
  chemically synthesized
ttacacatggagaaaaggaa

SEQ ID NO: 172150 - DNA, 20 bp, Artificial Sequence
  chemically synthesized
aattacacatggagaaaagg

SEQ ID NO: 172151 - DNA, 20 bp, Artificial Sequence
  chemically synthesized
gtaaattacacatggagaaa

SEQ ID NO: 172152 - DNA, 20 bp, Artificial Sequence
  chemically synthesized
agtaaattacacatggagaa

SEQ ID NO: 172153 - DNA, 20 bp, Artificial Sequence
  chemically synthesized
tgtggagtaaattacacatg

SEQ ID NO: 172154 - DNA, 20 bp, Artificial Sequence
  chemically synthesized
actgtggagtaaattacaca

SEQ ID NO: 172155 - DNA, 20 bp, Artificial Sequence
  chemically synthesized
tccatgtgtaatttactcca

SEQ ID NO: 172156 - DNA, 20 bp, Artificial Sequence
  chemically synthesized
caaaataaaagaagactgtg

SEQ ID NO: 172157 - DNA, 20 bp, Artificial Sequence
  chemically synthesized
tgcaaaataaaagaagactg

SEQ ID NO: 172158 - DNA, 20 bp, Artificial Sequence
  chemically synthesized
tcagtgatgcaaaataaaag

SEQ ID NO: 172159 - DNA, 20 bp, Artificial Sequence
  chemically synthesized
gtatcagtgatgcaaaataa

SEQ ID NO: 172160 - DNA, 20 bp, Artificial Sequence
  chemically synthesized
tttattttgcatcactgata

SEQ ID NO: 172161 - DNA, 20 bp, Artificial Sequence
  chemically synthesized
gagacacagccaaaccgtat

SEQ ID NO: 172162 - DNA, 20 bp, Artificial Sequence
  chemically synthesized
tttgcatcactgatacggtt

SEQ ID NO: 172163 - DNA, 20 bp, Artificial Sequence
  chemically synthesized
atgagatttgggtggagaca

SEQ ID NO: 172164 - DNA, 20 bp, Artificial Sequence
  chemically synthesized
ttcaacatgagatttgggtg

SEQ ID NO: 172165 - DNA, 20 bp, Artificial Sequence
  chemically synthesized
aattcaacatgagatttggg

SEQ ID NO: 172166 - DNA, 20 bp, Artificial Sequence
  chemically synthesized
gggaattcaacatgagattt

SEQ ID NO: 172167 - DNA, 20 bp, Artificial Sequence
  chemically synthesized
tgggaattcaacatgagatt

SEQ ID NO: 172168 - DNA, 20 bp, Artificial Sequence
  chemically synthesized
aacacatgggaattcaacat

SEQ ID NO: 172169 - DNA, 20 bp, Artificial Sequence
  chemically synthesized
gggtccctcccataacacat

SEQ ID NO: 172170 - DNA, 20 bp, Artificial Sequence
  chemically synthesized
tgttgaattcccatgtgtta

SEQ ID NO: 172171 - DNA, 20 bp, Artificial Sequence
  chemically synthesized
tgggtccctcccataacaca

SEQ ID NO: 172172 - DNA, 20 bp, Artificial Sequence
  chemically synthesized
gttgaattcccatgtgttat

SEQ ID NO: 172173 - DNA, 20 bp, Artificial Sequence
  chemically synthesized
tgaattcccatgtgttatgg

SEQ ID NO: 172174 - DNA, 20 bp, Artificial Sequence
  chemically synthesized
gaattcccatgtgttatggg

SEQ ID NO: 172175 - DNA, 20 bp, Artificial Sequence
  chemically synthesized
aattcccatgtgttatggga

SEQ ID NO: 172176 - DNA, 20 bp, Artificial Sequence
  chemically synthesized
catgtgttatgggagggacc

SEQ ID NO: 172177 - DNA, 20 bp, Artificial Sequence
  chemically synthesized
gtgttatgggagggacccag

SEQ ID NO: 172178 - DNA, 20 bp, Artificial Sequence
  chemically synthesized
tgttatgggagggacccagt

SEQ ID NO: 172179 - DNA, 20 bp, Artificial Sequence
  chemically synthesized
ttatgggagggacccagtgg

SEQ ID NO: 172180 - DNA, 20 bp, Artificial Sequence
  chemically synthesized
tatgggagggacccagtggg

SEQ ID NO: 172181 - DNA, 20 bp, Artificial Sequence
  chemically synthesized
tgattaaattacctcccact

SEQ ID NO: 172182 - DNA, 20 bp, Artificial Sequence
  chemically synthesized
atgattaaattacctcccac

SEQ ID NO: 172183 - DNA, 20 bp, Artificial Sequence
  chemically synthesized
agtgggaggtaatttaatca

SEQ ID NO: 172184 - DNA, 20 bp, Artificial Sequence
  chemically synthesized
gtgggaggtaatttaatcat

SEQ ID NO: 172185 - DNA, 20 bp, Artificial Sequence
  chemically synthesized
tgggaggtaatttaatcatg

SEQ ID NO: 172186 - DNA, 20 bp, Artificial Sequence
  chemically synthesized
gggaggtaatttaatcatgg

SEQ ID NO: 172187 - DNA, 20 bp, Artificial Sequence
  chemically synthesized
aggtaatttaatcatggggg

SEQ ID NO: 172188 - DNA, 20 bp, Artificial Sequence
  chemically synthesized
ggtaatttaatcatgggggc

SEQ ID NO: 172189 - DNA, 20 bp, Artificial Sequence
  chemically synthesized
atcactagaacagcacagga

SEQ ID NO: 172190 - DNA, 20 bp, Artificial Sequence
  chemically synthesized
cacaatcactagaacagcac

SEQ ID NO: 172191 - DNA, 20 bp, Artificial Sequence
  chemically synthesized
tcacaatcactagaacagca

SEQ ID NO: 172192 - DNA, 20 bp, Artificial Sequence
  chemically synthesized
aggtctttcctgtgctgttc

SEQ ID NO: 172193 - DNA, 20 bp, Artificial Sequence
  chemically synthesized
cttattcacaatcactagaa

SEQ ID NO: 172194 - DNA, 20 bp, Artificial Sequence
  chemically synthesized
tgagacttattcacaatcac

SEQ ID NO: 172195 - DNA, 20 bp, Artificial Sequence
  chemically synthesized
ctgttctagtgattgtgaat

SEQ ID NO: 172196 - DNA, 20 bp, Artificial Sequence
  chemically synthesized
tgattgtgaataagtctcat

SEQ ID NO: 172197 - DNA, 20 bp, Artificial Sequence
  chemically synthesized
tcaaaaccatcagatctcat

SEQ ID NO: 172198 - DNA, 20 bp, Artificial Sequence
  chemically synthesized
ataagtctcatgagatctga

SEQ ID NO: 172199 - DNA, 20 bp, Artificial Sequence
  chemically synthesized
actccgcttttcaaaaccat

SEQ ID NO: 172200 - DNA, 20 bp, Artificial Sequence
  chemically synthesized
tgagatctgatggttttgaa

SEQ ID NO: 172201 - DNA, 20 bp, Artificial Sequence
  chemically synthesized
gatctgatggttttgaaaag

SEQ ID NO: 172202 - DNA, 20 bp, Artificial Sequence
  chemically synthesized
tctgatggttttgaaaagcg

SEQ ID NO: 172203 - DNA, 20 bp, Artificial Sequence
  chemically synthesized
aaagcggagtttccctccaa

SEQ ID NO: 172204 - DNA, 20 bp, Artificial Sequence
  chemically synthesized
tcaaagagagagcttttgga

SEQ ID NO: 172205 - DNA, 20 bp, Artificial Sequence
  chemically synthesized
gtcaaagagagagcttttgg

SEQ ID NO: 172206 - DNA, 20 bp, Artificial Sequence
  chemically synthesized
agtcaaagagagagcttttg

SEQ ID NO: 172207 - DNA, 20 bp, Artificial Sequence
  chemically synthesized
gcagtcaaagagagagcttt

SEQ ID NO: 172208 - DNA, 20 bp, Artificial Sequence
  chemically synthesized
atgggcagcagtcaaagaga

SEQ ID NO: 172209 - DNA, 20 bp, Artificial Sequence
  chemically synthesized
ggatgggcagcagtcaaaga

SEQ ID NO: 172210 - DNA, 20 bp, Artificial Sequence
  chemically synthesized
gtggatgggcagcagtcaaa

SEQ ID NO: 172211 - DNA, 20 bp, Artificial Sequence
  chemically synthesized
acgtggatgggcagcagtca

SEQ ID NO: 172212 - DNA, 20 bp, Artificial Sequence
  chemically synthesized
catcttacgtggatgggcag

SEQ ID NO: 172213 - DNA, 20 bp, Artificial Sequence
  chemically synthesized
tcacatcttacgtggatggg

SEQ ID NO: 172214 - DNA, 20 bp, Artificial Sequence
  chemically synthesized
gagtcacatcttacgtggat

SEQ ID NO: 172215 - DNA, 20 bp, Artificial Sequence
  chemically synthesized
tgactgctgcccatccacgt

SEQ ID NO: 172216 - DNA, 20 bp, Artificial Sequence
  chemically synthesized
cgagtcacatcttacgtgga

SEQ ID NO: 172217 - DNA, 20 bp, Artificial Sequence
  chemically synthesized
ggaacgagtcacatcttacg

SEQ ID NO: 172218 - DNA, 20 bp, Artificial Sequence
  chemically synthesized
ggcaccaggcaaggaggaac

SEQ ID NO: 172219 - DNA, 20 bp, Artificial Sequence
  chemically synthesized
gtgactcgttcctccttgcc

SEQ ID NO: 172220 - DNA, 20 bp, Artificial Sequence
  chemically synthesized
aactatggcaccaggcaagg

SEQ ID NO: 172221 - DNA, 20 bp, Artificial Sequence
  chemically synthesized
caactatggcaccaggcaag

SEQ ID NO: 172222 - DNA, 20 bp, Artificial Sequence
  chemically synthesized
cacaactatggcaccaggca

SEQ ID NO: 172223 - DNA, 20 bp, Artificial Sequence
  chemically synthesized
tcacaactatggcaccaggc

SEQ ID NO: 172224 - DNA, 20 bp, Artificial Sequence
  chemically synthesized
ttcctccttgcctggtgcca

SEQ ID NO: 172225 - DNA, 20 bp, Artificial Sequence
  chemically synthesized
gacctcacaactatggcacc

SEQ ID NO: 172226 - DNA, 20 bp, Artificial Sequence
  chemically synthesized
agacctcacaactatggcac

SEQ ID NO: 172227 - DNA, 20 bp, Artificial Sequence
  chemically synthesized
ttgcctggtgccatagttgt

SEQ ID NO: 172228 - DNA, 20 bp, Artificial Sequence
  chemically synthesized
ctggggagacctcacaacta

SEQ ID NO: 172229 - DNA, 20 bp, Artificial Sequence
  chemically synthesized
tgcctggtgccatagttgtg

SEQ ID NO: 172230 - DNA, 20 bp, Artificial Sequence
  chemically synthesized
ccatagttgtgaggtctccc

SEQ ID NO: 172231 - DNA, 20 bp, Artificial Sequence
  chemically synthesized
gttgtgaggtctccccagcc

SEQ ID NO: 172232 - DNA, 20 bp, Artificial Sequence
  chemically synthesized
tacggttccacttggctggg

SEQ ID NO: 172233 - DNA, 20 bp, Artificial Sequence
  chemically synthesized
cttacggttccacttggctg

SEQ ID NO: 172234 - DNA, 20 bp, Artificial Sequence
  chemically synthesized
gtgaggtctccccagccaag

SEQ ID NO: 172235 - DNA, 20 bp, Artificial Sequence
  chemically synthesized
acttacggttccacttggct

SEQ ID NO: 172236 - DNA, 20 bp, Artificial Sequence
  chemically synthesized
gacttacggttccacttggc

SEQ ID NO: 172237 - DNA, 20 bp, Artificial Sequence
  chemically synthesized
aatggacttacggttccact

SEQ ID NO: 172238 - DNA, 20 bp, Artificial Sequence
  chemically synthesized
ccccagccaagtggaaccgt

SEQ ID NO: 172239 - DNA, 20 bp, Artificial Sequence
  chemically synthesized
aaagaggtttaatggactta

SEQ ID NO: 172240 - DNA, 20 bp, Artificial Sequence
  chemically synthesized
tacaaaagaaagaggtttaa

SEQ ID NO: 172241 - DNA, 20 bp, Artificial Sequence
  chemically synthesized
gggcaatttacaaaagaaag

SEQ ID NO: 172242 - DNA, 20 bp, Artificial Sequence
  chemically synthesized
tgggcaatttacaaaagaaa

SEQ ID NO: 172243 - DNA, 20 bp, Artificial Sequence
  chemically synthesized
actgggcaatttacaaaaga

SEQ ID NO: 172244 - DNA, 20 bp, Artificial Sequence
  chemically synthesized
cgagactgggcaatttacaa

SEQ ID NO: 172245 - DNA, 20 bp, Artificial Sequence
  chemically synthesized
tctttcttttgtaaattgcc

SEQ ID NO: 172246 - DNA, 20 bp, Artificial Sequence
  chemically synthesized
ttttgtaaattgcccagtct

SEQ ID NO: 172247 - DNA, 20 bp, Artificial Sequence
  chemically synthesized
tttgtaaattgcccagtctc

SEQ ID NO: 172248 - DNA, 20 bp, Artificial Sequence
  chemically synthesized
ataaagacatacccgagact

SEQ ID NO: 172249 - DNA, 20 bp, Artificial Sequence
  chemically synthesized
gataaagacatacccgagac

SEQ ID NO: 172250 - DNA, 20 bp, Artificial Sequence
  chemically synthesized
ctgcggataaagacataccc

SEQ ID NO: 172251 - DNA, 20 bp, Artificial Sequence
  chemically synthesized
ctcgggtatgtctttatccg

SEQ ID NO: 172252 - DNA, 20 bp, Artificial Sequence
  chemically synthesized
ccattttcacactgcggata

SEQ ID NO: 172253 - DNA, 20 bp, Artificial Sequence
  chemically synthesized
attagtccattttcacactg

SEQ ID NO: 172254 - DNA, 20 bp, Artificial Sequence
  chemically synthesized
ctttatccgcagtgtgaaaa

SEQ ID NO: 172255 - DNA, 20 bp, Artificial Sequence
  chemically synthesized
agtgtgaaaatggactaata

SEQ ID NO: 172256 - DNA, 20 bp, Artificial Sequence
  chemically synthesized
ctggtaccaaattactgtat

SEQ ID NO: 172257 - DNA, 20 bp, Artificial Sequence
  chemically synthesized
aatggactaatacagtaatt

SEQ ID NO: 172258 - DNA, 20 bp, Artificial Sequence
  chemically synthesized
ctaatacagtaatttggtac

SEQ ID NO: 172259 - DNA, 20 bp, Artificial Sequence
  chemically synthesized
atacagtaatttggtaccag

SEQ ID NO: 172260 - DNA, 20 bp, Artificial Sequence
  chemically synthesized
acagtaatttggtaccagta

SEQ ID NO: 172261 - DNA, 20 bp, Artificial Sequence
  chemically synthesized
gtaatttggtaccagtagag

SEQ ID NO: 172262 - DNA, 20 bp, Artificial Sequence
  chemically synthesized
taatttggtaccagtagagt

SEQ ID NO: 172263 - DNA, 20 bp, Artificial Sequence
  chemically synthesized
tcagcagtgccccactctac

SEQ ID NO: 172264 - DNA, 20 bp, Artificial Sequence
  chemically synthesized
aatttggtaccagtagagtg

SEQ ID NO: 172265 - DNA, 20 bp, Artificial Sequence
  chemically synthesized
tagagtggggcactgctgaa

SEQ ID NO: 172266 - DNA, 20 bp, Artificial Sequence
  chemically synthesized
attttcgggtgtcttttcag

SEQ ID NO: 172267 - DNA, 20 bp, Artificial Sequence
  chemically synthesized
cacattttcgggtgtctttt

SEQ ID NO: 172268 - DNA, 20 bp, Artificial Sequence
  chemically synthesized
tgaaaagacacccgaaaatg

SEQ ID NO: 172269 - DNA, 20 bp, Artificial Sequence
  chemically synthesized
aaagtcgcttccacattttc

SEQ ID NO: 172270 - DNA, 20 bp, Artificial Sequence
  chemically synthesized
caaagtcgcttccacatttt

SEQ ID NO: 172271 - DNA, 20 bp, Artificial Sequence
  chemically synthesized
aaagacacccgaaaatgtgg

SEQ ID NO: 172272 - DNA, 20 bp, Artificial Sequence
  chemically synthesized
cgaaaatgtggaagcgactt

SEQ ID NO: 172273 - DNA, 20 bp, Artificial Sequence
  chemically synthesized
aaatgtggaagcgactttgg

SEQ ID NO: 172274 - DNA, 20 bp, Artificial Sequence
  chemically synthesized
ctgcatgttacgcacttcca

SEQ ID NO: 172275 - DNA, 20 bp, Artificial Sequence
  chemically synthesized
ctttggaagtgcgtaacatg

SEQ ID NO: 172276 - DNA, 20 bp, Artificial Sequence
  chemically synthesized
ttggaagtgcgtaacatgca

SEQ ID NO: 172277 - DNA, 20 bp, Artificial Sequence
  chemically synthesized
agtgcgtaacatgcagagtc

SEQ ID NO: 172278 - DNA, 20 bp, Artificial Sequence
  chemically synthesized
gtaacatgcagagtctggta

SEQ ID NO: 172279 - DNA, 20 bp, Artificial Sequence
  chemically synthesized
ctgagccctccaaactgtac

SEQ ID NO: 172280 - DNA, 20 bp, Artificial Sequence
  chemically synthesized
atgcagagtctggtacagtt

SEQ ID NO: 172281 - DNA, 20 bp, Artificial Sequence
  chemically synthesized
gcagagtctggtacagtttg

SEQ ID NO: 172282 - DNA, 20 bp, Artificial Sequence
  chemically synthesized
cagagtctggtacagtttgg

SEQ ID NO: 172283 - DNA, 20 bp, Artificial Sequence
  chemically synthesized
agagtctggtacagtttgga

SEQ ID NO: 172284 - DNA, 20 bp, Artificial Sequence
  chemically synthesized
ctggtacagtttggagggct

SEQ ID NO: 172285 - DNA, 20 bp, Artificial Sequence
  chemically synthesized
gtacagtttggagggctcag

SEQ ID NO: 172286 - DNA, 20 bp, Artificial Sequence
  chemically synthesized
agtttggagggctcagaaga

SEQ ID NO: 172287 - DNA, 20 bp, Artificial Sequence
  chemically synthesized
gtttggagggctcagaagaa

SEQ ID NO: 172288 - DNA, 20 bp, Artificial Sequence
  chemically synthesized
cccacattttcctttcttct

SEQ ID NO: 172289 - DNA, 20 bp, Artificial Sequence
  chemically synthesized
gctcagaagaaaggaaaatg

SEQ ID NO: 172290 - DNA, 20 bp, Artificial Sequence
  chemically synthesized
ctcagaagaaaggaaaatgt

SEQ ID NO: 172291 - DNA, 20 bp, Artificial Sequence
  chemically synthesized
gaagaaaggaaaatgtggga

SEQ ID NO: 172292 - DNA, 20 bp, Artificial Sequence
  chemically synthesized
aaggaaaatgtgggacagtt

SEQ ID NO: 172293 - DNA, 20 bp, Artificial Sequence
  chemically synthesized
gctggatgtaagaggttagg

SEQ ID NO: 172294 - DNA, 20 bp, Artificial Sequence
  chemically synthesized
caggctggatgtaagaggtt

SEQ ID NO: 172295 - DNA, 20 bp, Artificial Sequence
  chemically synthesized
ccaggctggatgtaagaggt

SEQ ID NO: 172296 - DNA, 20 bp, Artificial Sequence
  chemically synthesized
aaggccaggctggatgtaag

SEQ ID NO: 172297 - DNA, 20 bp, Artificial Sequence
  chemically synthesized
acttcctaacctcttacatc

SEQ ID NO: 172298 - DNA, 20 bp, Artificial Sequence
  chemically synthesized
aaaggccaggctggatgtaa

SEQ ID NO: 172299 - DNA, 20 bp, Artificial Sequence
  chemically synthesized
taaaaggccaggctggatgt

SEQ ID NO: 172300 - DNA, 20 bp, Artificial Sequence
  chemically synthesized
ctaacctcttacatccagcc

SEQ ID NO: 172301 - DNA, 20 bp, Artificial Sequence
  chemically synthesized
gggaatgtaaaaggccaggc

SEQ ID NO: 172302 - DNA, 20 bp, Artificial Sequence
  chemically synthesized
ctctgggaatgtaaaaggcc

SEQ ID NO: 172303 - DNA, 20 bp, Artificial Sequence
  chemically synthesized
gctctgggaatgtaaaaggc

SEQ ID NO: 172304 - DNA, 20 bp, Artificial Sequence
  chemically synthesized
tcttgctctgggaatgtaaa

SEQ ID NO: 172305 - DNA, 20 bp, Artificial Sequence
  chemically synthesized
ttcttgctctgggaatgtaa

SEQ ID NO: 172306 - DNA, 20 bp, Artificial Sequence
  chemically synthesized
agcctggccttttacattcc

SEQ ID NO: 172307 - DNA, 20 bp, Artificial Sequence
  chemically synthesized
cctggccttttacattccca

SEQ ID NO: 172308 - DNA, 20 bp, Artificial Sequence
  chemically synthesized
gccttttacattcccagagc

SEQ ID NO: 172309 - DNA, 20 bp, Artificial Sequence
  chemically synthesized
ttgaacagacttcttgctct

SEQ ID NO: 172310 - DNA, 20 bp, Artificial Sequence
  chemically synthesized
ttttacattcccagagcaag

SEQ ID NO: 172311 - DNA, 20 bp, Artificial Sequence
  chemically synthesized
cttgaacagacttcttgctc

SEQ ID NO: 172312 - DNA, 20 bp, Artificial Sequence
  chemically synthesized
ccagagcaagaagtctgttc

SEQ ID NO: 172313 - DNA, 20 bp, Artificial Sequence
  chemically synthesized
ccagataataaggacttgaa

SEQ ID NO: 172314 - DNA, 20 bp, Artificial Sequence
  chemically synthesized
ctgttcaagtccttattatc

SEQ ID NO: 172315 - DNA, 20 bp, Artificial Sequence
  chemically synthesized
ttccggtggcccagataata

SEQ ID NO: 172316 - DNA, 20 bp, Artificial Sequence
  chemically synthesized
tgttcaagtccttattatct

SEQ ID NO: 172317 - DNA, 20 bp, Artificial Sequence
  chemically synthesized
tttccggtggcccagataat

SEQ ID NO: 172318 - DNA, 20 bp, Artificial Sequence
  chemically synthesized
gtccttattatctgggccac

SEQ ID NO: 172319 - DNA, 20 bp, Artificial Sequence
  chemically synthesized
atatattttttccggtggcc

SEQ ID NO: 172320 - DNA, 20 bp, Artificial Sequence
  chemically synthesized
gagatatatattttttccgg

SEQ ID NO: 172321 - DNA, 20 bp, Artificial Sequence
  chemically synthesized
tttgagatatatattttttc

SEQ ID NO: 172322 - DNA, 20 bp, Artificial Sequence
  chemically synthesized
aaaaaatatatatctcaaac

SEQ ID NO: 172323 - DNA, 20 bp, Artificial Sequence
  chemically synthesized
ggaggtctacaaactggttt

SEQ ID NO: 172324 - DNA, 20 bp, Artificial Sequence
  chemically synthesized
atatatctcaaaccagtttg

SEQ ID NO: 172325 - DNA, 20 bp, Artificial Sequence
  chemically synthesized
gagactggaggtctacaaac

SEQ ID NO: 172326 - DNA, 20 bp, Artificial Sequence
  chemically synthesized
caaaccagtttgtagacctc

SEQ ID NO: 172327 - DNA, 20 bp, Artificial Sequence
  chemically synthesized
ttacagcaggtagagactgg

SEQ ID NO: 172328 - DNA, 20 bp, Artificial Sequence
  chemically synthesized
attacagcaggtagagactg

SEQ ID NO: 172329 - DNA, 20 bp, Artificial Sequence
  chemically synthesized
gaattacagcaggtagagac

SEQ ID NO: 172330 - DNA, 20 bp, Artificial Sequence
  chemically synthesized
gggttgaattacagcaggta

SEQ ID NO: 172331 - DNA, 20 bp, Artificial Sequence
  chemically synthesized
aggggttgaattacagcagg

SEQ ID NO: 172332 - DNA, 20 bp, Artificial Sequence
  chemically synthesized
tgcaggggttgaattacagc

SEQ ID NO: 172333 - DNA, 20 bp, Artificial Sequence
  chemically synthesized
atgcaggggttgaattacag

SEQ ID NO: 172334 - DNA, 20 bp, Artificial Sequence
  chemically synthesized
gcaatgcaggggttgaatta

SEQ ID NO: 172335 - DNA, 20 bp, Artificial Sequence
  chemically synthesized
tcagtctgatggcaatgcag

SEQ ID NO: 172336 - DNA, 20 bp, Artificial Sequence
  chemically synthesized
ctcagtctgatggcaatgca

SEQ ID NO: 172337 - DNA, 20 bp, Artificial Sequence
  chemically synthesized
actcagtctgatggcaatgc

SEQ ID NO: 172338 - DNA, 20 bp, Artificial Sequence
  chemically synthesized
gactcagtctgatggcaatg

SEQ ID NO: 172339 - DNA, 20 bp, Artificial Sequence
  chemically synthesized
ttcaacccctgcattgccat

SEQ ID NO: 172340 - DNA, 20 bp, Artificial Sequence
  chemically synthesized
ccctgcattgccatcagact

SEQ ID NO: 172341 - DNA, 20 bp, Artificial Sequence
  chemically synthesized
ttttagaagactcagtctga

SEQ ID NO: 172342 - DNA, 20 bp, Artificial Sequence
  chemically synthesized
aagttttattttagaagact

SEQ ID NO: 172343 - DNA, 20 bp, Artificial Sequence
  chemically synthesized
agaattaagttttattttag

SEQ ID NO: 172344 - DNA, 20 bp, Artificial Sequence
  chemically synthesized
ttaagaattaagttttattt

SEQ ID NO: 172345 - DNA, 20 bp, Artificial Sequence
  chemically synthesized
gggactcatttttaagaatt

SEQ ID NO: 172346 - DNA, 20 bp, Artificial Sequence
  chemically synthesized
aaaacttaattcttaaaaat

SEQ ID NO: 172347 - DNA, 20 bp, Artificial Sequence
  chemically synthesized
caggggagggactcattttt

SEQ ID NO: 172348 - DNA, 20 bp, Artificial Sequence
  chemically synthesized
gataatccactcacagggga

SEQ ID NO: 172349 - DNA, 20 bp, Artificial Sequence
  chemically synthesized
aaaatgagtccctcccctgt

SEQ ID NO: 172350 - DNA, 20 bp, Artificial Sequence
  chemically synthesized
tgataatccactcacagggg

SEQ ID NO: 172351 - DNA, 20 bp, Artificial Sequence
  chemically synthesized
ctgataatccactcacaggg

SEQ ID NO: 172352 - DNA, 20 bp, Artificial Sequence
  chemically synthesized
atgagtccctcccctgtgag

SEQ ID NO: 172353 - DNA, 20 bp, Artificial Sequence
  chemically synthesized
tactgataatccactcacag

SEQ ID NO: 172354 - DNA, 20 bp, Artificial Sequence
  chemically synthesized
atactgataatccactcaca

SEQ ID NO: 172355 - DNA, 20 bp, Artificial Sequence
  chemically synthesized
aatactgataatccactcac

SEQ ID NO: 172356 - DNA, 20 bp, Artificial Sequence
  chemically synthesized
aaatactgataatccactca

SEQ ID NO: 172357 - DNA, 20 bp, Artificial Sequence
  chemically synthesized
ctcccctgtgagtggattat

SEQ ID NO: 172358 - DNA, 20 bp, Artificial Sequence
  chemically synthesized
gtatttgttgtatgtgcata

SEQ ID NO: 172359 - DNA, 20 bp, Artificial Sequence
  chemically synthesized
tatttgttgtatgtgcatat

SEQ ID NO: 172360 - DNA, 20 bp, Artificial Sequence
  chemically synthesized
atttgttgtatgtgcatatg

SEQ ID NO: 172361 - DNA, 20 bp, Artificial Sequence
  chemically synthesized
gttgtatgtgcatatgggga

SEQ ID NO: 172362 - DNA, 20 bp, Artificial Sequence
  chemically synthesized
ttgtatgtgcatatggggaa

SEQ ID NO: 172363 - DNA, 20 bp, Artificial Sequence
  chemically synthesized
aatgtctagaggagcatggg

SEQ ID NO: 172364 - DNA, 20 bp, Artificial Sequence
  chemically synthesized
cagaatgtctagaggagcat

SEQ ID NO: 172365 - DNA, 20 bp, Artificial Sequence
  chemically synthesized
ccagaatgtctagaggagca

SEQ ID NO: 172366 - DNA, 20 bp, Artificial Sequence
  chemically synthesized
ttacgctacccatgctcctc

SEQ ID NO: 172367 - DNA, 20 bp, Artificial Sequence
  chemically synthesized
atataccagaatgtctagag

SEQ ID NO: 172368 - DNA, 20 bp, Artificial Sequence
  chemically synthesized
gaatataccagaatgtctag

SEQ ID NO: 172369 - DNA, 20 bp, Artificial Sequence
  chemically synthesized
agaatataccagaatgtcta

SEQ ID NO: 172370 - DNA, 20 bp, Artificial Sequence
  chemically synthesized
ccatgctcctctagacattc

SEQ ID NO: 172371 - DNA, 20 bp, Artificial Sequence
  chemically synthesized
ggagaatataccagaatgtc

SEQ ID NO: 172372 - DNA, 20 bp, Artificial Sequence
  chemically synthesized
gtctacatgggagaatatac

SEQ ID NO: 172373 - DNA, 20 bp, Artificial Sequence
  chemically synthesized
ttctggtatattctcccatg

SEQ ID NO: 172374 - DNA, 20 bp, Artificial Sequence
  chemically synthesized
tgccttgtatgtctacatgg

SEQ ID NO: 172375 - DNA, 20 bp, Artificial Sequence
  chemically synthesized
tctgccttgtatgtctacat

SEQ ID NO: 172376 - DNA, 20 bp, Artificial Sequence
  chemically synthesized
ctctgccttgtatgtctaca

SEQ ID NO: 172377 - DNA, 20 bp, Artificial Sequence
  chemically synthesized
attctcccatgtagacatac

SEQ ID NO: 172378 - DNA, 20 bp, Artificial Sequence
  chemically synthesized
ttctcccatgtagacataca

SEQ ID NO: 172379 - DNA, 20 bp, Artificial Sequence
  chemically synthesized
tcccatgtagacatacaagg

SEQ ID NO: 172380 - DNA, 20 bp, Artificial Sequence
  chemically synthesized
ccatgtagacatacaaggca

SEQ ID NO: 172381 - DNA, 20 bp, Artificial Sequence
  chemically synthesized
tagacatacaaggcagagcc

SEQ ID NO: 172382 - DNA, 20 bp, Artificial Sequence
  chemically synthesized
agacatacaaggcagagcca

SEQ ID NO: 172383 - DNA, 20 bp, Artificial Sequence
  chemically synthesized
tggttcataaaggaaggcct

SEQ ID NO: 172384 - DNA, 20 bp, Artificial Sequence
  chemically synthesized
agtaaatggttcataaagga

SEQ ID NO: 172385 - DNA, 20 bp, Artificial Sequence
  chemically synthesized
cagtaaatggttcataaagg

SEQ ID NO: 172386 - DNA, 20 bp, Artificial Sequence
  chemically synthesized
ccccagtaaatggttcataa

SEQ ID NO: 172387 - DNA, 20 bp, Artificial Sequence
  chemically synthesized
cccccagtaaatggttcata

SEQ ID NO: 172388 - DNA, 20 bp, Artificial Sequence
  chemically synthesized
ttcctttatgaaccatttac

SEQ ID NO: 172389 - DNA, 20 bp, Artificial Sequence
  chemically synthesized
tcctttatgaaccatttact

SEQ ID NO: 172390 - DNA, 20 bp, Artificial Sequence
  chemically synthesized
cctttatgaaccatttactg

SEQ ID NO: 172391 - DNA, 20 bp, Artificial Sequence
  chemically synthesized
cattattttcccccagtaaa

SEQ ID NO: 172392 - DNA, 20 bp, Artificial Sequence
  chemically synthesized
ctttatgaaccatttactgg

SEQ ID NO: 172393 - DNA, 20 bp, Artificial Sequence
  chemically synthesized
tccgatacattattttcccc

SEQ ID NO: 172394 - DNA, 20 bp, Artificial Sequence
  chemically synthesized
actgggggaaaataatgtat

SEQ ID NO: 172395 - DNA, 20 bp, Artificial Sequence
  chemically synthesized
ttagtccatatcagggagta

SEQ ID NO: 172396 - DNA, 20 bp, Artificial Sequence
  chemically synthesized
gatcactttactccctgata

SEQ ID NO: 172397 - DNA, 20 bp, Artificial Sequence
  chemically synthesized
tagcattagtccatatcagg

SEQ ID NO: 172398 - DNA, 20 bp, Artificial Sequence
  chemically synthesized
tctagcattagtccatatca

SEQ ID NO: 172399 - DNA, 20 bp, Artificial Sequence
  chemically synthesized
ttctagcattagtccatatc

SEQ ID NO: 172400 - DNA, 20 bp, Artificial Sequence
  chemically synthesized
cttctagcattagtccatat

SEQ ID NO: 172401 - DNA, 20 bp, Artificial Sequence
  chemically synthesized
tccctgatatggactaatgc

SEQ ID NO: 172402 - DNA, 20 bp, Artificial Sequence
  chemically synthesized
ctgatatggactaatgctag

SEQ ID NO: 172403 - DNA, 20 bp, Artificial Sequence
  chemically synthesized
gattcaactgcttctagcat

SEQ ID NO: 172404 - DNA, 20 bp, Artificial Sequence
  chemically synthesized
atatggactaatgctagaag

SEQ ID NO: 172405 - DNA, 20 bp, Artificial Sequence
  chemically synthesized
acagtagattcaactgcttc

SEQ ID NO: 172406 - DNA, 20 bp, Artificial Sequence
  chemically synthesized
ctctgtcccattaaagacag

SEQ ID NO: 172407 - DNA, 20 bp, Artificial Sequence
  chemically synthesized
gttgaatctactgtctttaa

SEQ ID NO: 172408 - DNA, 20 bp, Artificial Sequence
  chemically synthesized
caactctgtcccattaaaga

SEQ ID NO: 172409 - DNA, 20 bp, Artificial Sequence
  chemically synthesized
ttgaatctactgtctttaat

SEQ ID NO: 172410 - DNA, 20 bp, Artificial Sequence
  chemically synthesized
agcacaactctgtcccatta

SEQ ID NO: 172411 - DNA, 20 bp, Artificial Sequence
  chemically synthesized
atctactgtctttaatggga

SEQ ID NO: 172412 - DNA, 20 bp, Artificial Sequence
  chemically synthesized
ctactgtctttaatgggaca

SEQ ID NO: 172413 - DNA, 20 bp, Artificial Sequence
  chemically synthesized
aatgggacagagttgtgctc

SEQ ID NO: 172414 - DNA, 20 bp, Artificial Sequence
  chemically synthesized
atgggacagagttgtgctca

SEQ ID NO: 172415 - DNA, 20 bp, Artificial Sequence
  chemically synthesized
ggttgtggttaatgatcctt

SEQ ID NO: 172416 - DNA, 20 bp, Artificial Sequence
  chemically synthesized
ctgagtaagggcggtggttg

SEQ ID NO: 172417 - DNA, 20 bp, Artificial Sequence
  chemically synthesized
ttatctctgagtaagggcgg

SEQ ID NO: 172418 - DNA, 20 bp, Artificial Sequence
  chemically synthesized
tctttatctctgagtaaggg

SEQ ID NO: 172419 - DNA, 20 bp, Artificial Sequence
  chemically synthesized
ccacaaccaccgcccttact

SEQ ID NO: 172420 - DNA, 20 bp, Artificial Sequence
  chemically synthesized
acaaccaccgcccttactca

SEQ ID NO: 172421 - DNA, 20 bp, Artificial Sequence
  chemically synthesized
aaatctttatctctgagtaa

SEQ ID NO: 172422 - DNA, 20 bp, Artificial Sequence
  chemically synthesized
taaatctttatctctgagta

SEQ ID NO: 172423 - DNA, 20 bp, Artificial Sequence
  chemically synthesized
ttaaatctttatctctgagt

SEQ ID NO: 172424 - DNA, 20 bp, Artificial Sequence
  chemically synthesized
accgcccttactcagagata

SEQ ID NO: 172425 - DNA, 20 bp, Artificial Sequence
  chemically synthesized
gatcttaaatctttatctct

SEQ ID NO: 172426 - DNA, 20 bp, Artificial Sequence
  chemically synthesized
ttactcagagataaagattt

SEQ ID NO: 172427 - DNA, 20 bp, Artificial Sequence
  chemically synthesized
gataaagatttaagatctct

SEQ ID NO: 172428 - DNA, 20 bp, Artificial Sequence
  chemically synthesized
agatttaagatctcttagca

SEQ ID NO: 172429 - DNA, 20 bp, Artificial Sequence
  chemically synthesized
acctttagccaccatgctaa

SEQ ID NO: 172430 - DNA, 20 bp, Artificial Sequence
  chemically synthesized
tttaagatctcttagcatgg

SEQ ID NO: 172431 - DNA, 20 bp, Artificial Sequence
  chemically synthesized
aaacctttagccaccatgct

SEQ ID NO: 172432 - DNA, 20 bp, Artificial Sequence
  chemically synthesized
atctcttagcatggtggcta

SEQ ID NO: 172433 - DNA, 20 bp, Artificial Sequence
  chemically synthesized
tctcttagcatggtggctaa

SEQ ID NO: 172434 - DNA, 20 bp, Artificial Sequence
  chemically synthesized
ggcaagagtttgaaaacctt

SEQ ID NO: 172435 - DNA, 20 bp, Artificial Sequence
  chemically synthesized
gaaaaggtatgtttgggcaa

SEQ ID NO: 172436 - DNA, 20 bp, Artificial Sequence
  chemically synthesized
ttgaaaaggtatgtttgggc

SEQ ID NO: 172437 - DNA, 20 bp, Artificial Sequence
  chemically synthesized
gacattgaaaaggtatgttt

SEQ ID NO: 172438 - DNA, 20 bp, Artificial Sequence
  chemically synthesized
tgacattgaaaaggtatgtt

SEQ ID NO: 172439 - DNA, 20 bp, Artificial Sequence
  chemically synthesized
gattgtgtttgacattgaaa

SEQ ID NO: 172440 - DNA, 20 bp, Artificial Sequence
  chemically synthesized
tgattgtgtttgacattgaa

SEQ ID NO: 172441 - DNA, 20 bp, Artificial Sequence
  chemically synthesized
gattcctcctgaatagagca

SEQ ID NO: 172442 - DNA, 20 bp, Artificial Sequence
  chemically synthesized
ggattcctcctgaatagagc

SEQ ID NO: 172443 - DNA, 20 bp, Artificial Sequence
  chemically synthesized
cacaatcaccttgctctatt

SEQ ID NO: 172444 - DNA, 20 bp, Artificial Sequence
  chemically synthesized
acaatcaccttgctctattc

SEQ ID NO: 172445 - DNA, 20 bp, Artificial Sequence
  chemically synthesized
aatcaccttgctctattcag

SEQ ID NO: 172446 - DNA, 20 bp, Artificial Sequence
  chemically synthesized
ggtaggattcctcctgaata

SEQ ID NO: 172447 - DNA, 20 bp, Artificial Sequence
  chemically synthesized
atcaccttgctctattcagg

SEQ ID NO: 172448 - DNA, 20 bp, Artificial Sequence
  chemically synthesized
atggtaggattcctcctgaa

SEQ ID NO: 172449 - DNA, 20 bp, Artificial Sequence
  chemically synthesized
tgtaaacaaaatattatggt

SEQ ID NO: 172450 - DNA, 20 bp, Artificial Sequence
  chemically synthesized
ctgtaaacaaaatattatgg

SEQ ID NO: 172451 - DNA, 20 bp, Artificial Sequence
  chemically synthesized
agactgtaaacaaaatatta

SEQ ID NO: 172452 - DNA, 20 bp, Artificial Sequence
  chemically synthesized
ctaccataatattttgttta

SEQ ID NO: 172453 - DNA, 20 bp, Artificial Sequence
  chemically synthesized
gaaagattattataggtgga

SEQ ID NO: 172454 - DNA, 20 bp, Artificial Sequence
  chemically synthesized
aggaaagattattataggtg

SEQ ID NO: 172455 - DNA, 20 bp, Artificial Sequence
  chemically synthesized
agaggaaagattattatagg

SEQ ID NO: 172456 - DNA, 20 bp, Artificial Sequence
  chemically synthesized
agaagaggaaagattattat

SEQ ID NO: 172457 - DNA, 20 bp, Artificial Sequence
  chemically synthesized
gagaagaggaaagattatta

SEQ ID NO: 172458 - DNA, 20 bp, Artificial Sequence
  chemically synthesized
cagtactcaagagaagagga

SEQ ID NO: 172459 - DNA, 20 bp, Artificial Sequence
  chemically synthesized
tttgcagtactcaagagaag

SEQ ID NO: 172460 - DNA, 20 bp, Artificial Sequence
  chemically synthesized
ataatctttcctcttctctt

SEQ ID NO: 172461 - DNA, 20 bp, Artificial Sequence
  chemically synthesized
atttgcagtactcaagagaa

SEQ ID NO: 172462 - DNA, 20 bp, Artificial Sequence
  chemically synthesized
gaatttgcagtactcaagag

SEQ ID NO: 172463 - DNA, 20 bp, Artificial Sequence
  chemically synthesized
gtagaatttgcagtactcaa

SEQ ID NO: 172464 - DNA, 20 bp, Artificial Sequence
  chemically synthesized
aagtagaatttgcagtactc

SEQ ID NO: 172465 - DNA, 20 bp, Artificial Sequence
  chemically synthesized
ctattctgaagtagaatttg

SEQ ID NO: 172466 - DNA, 20 bp, Artificial Sequence
  chemically synthesized
gagtactgcaaattctactt

SEQ ID NO: 172467 - DNA, 20 bp, Artificial Sequence
  chemically synthesized
gacattgttctattctgaag

SEQ ID NO: 172468 - DNA, 20 bp, Artificial Sequence
  chemically synthesized
ctgcaaattctacttcagaa

SEQ ID NO: 172469 - DNA, 20 bp, Artificial Sequence
  chemically synthesized
gtagacattgttctattctg

SEQ ID NO: 172470 - DNA, 20 bp, Artificial Sequence
  chemically synthesized
gaatagaacaatgtctacat

SEQ ID NO: 172471 - DNA, 20 bp, Artificial Sequence
  chemically synthesized
aatagaacaatgtctacatg

SEQ ID NO: 172472 - DNA, 20 bp, Artificial Sequence
  chemically synthesized
atagaacaatgtctacatga

SEQ ID NO: 172473 - DNA, 20 bp, Artificial Sequence
  chemically synthesized
cacaaaagaaggccctcatg

SEQ ID NO: 172474 - DNA, 20 bp, Artificial Sequence
  chemically synthesized
tacatgagggccttcttttg

SEQ ID NO: 172475 - DNA, 20 bp, Artificial Sequence
  chemically synthesized
tggccttggaccacaaaaga

SEQ ID NO: 172476 - DNA, 20 bp, Artificial Sequence
  chemically synthesized
atggccttggaccacaaaag

SEQ ID NO: 172477 - DNA, 20 bp, Artificial Sequence
  chemically synthesized
aaaatggccttggaccacaa

SEQ ID NO: 172478 - DNA, 20 bp, Artificial Sequence
  chemically synthesized
agggccttcttttgtggtcc

SEQ ID NO: 172479 - DNA, 20 bp, Artificial Sequence
  chemically synthesized
gggccttcttttgtggtcca

SEQ ID NO: 172480 - DNA, 20 bp, Artificial Sequence
  chemically synthesized
tagcagaagcaaaatggcct

SEQ ID NO: 172481 - DNA, 20 bp, Artificial Sequence
  chemically synthesized
aaactatagcagaagcaaaa

SEQ ID NO: 172482 - DNA, 20 bp, Artificial Sequence
  chemically synthesized
aggccattttgcttctgcta

SEQ ID NO: 172483 - DNA, 20 bp, Artificial Sequence
  chemically synthesized
tctcaaataaactatagcag

SEQ ID NO: 172484 - DNA, 20 bp, Artificial Sequence
  chemically synthesized
ttttctcaaataaactatag

SEQ ID NO: 172485 - DNA, 20 bp, Artificial Sequence
  chemically synthesized
ttattttctcaaataaacta

SEQ ID NO: 172486 - DNA, 20 bp, Artificial Sequence
  chemically synthesized
gcttctgctatagtttattt

SEQ ID NO: 172487 - DNA, 20 bp, Artificial Sequence
  chemically synthesized
agaaaataattgtctgtcct

SEQ ID NO: 172488 - DNA, 20 bp, Artificial Sequence
  chemically synthesized
gaaaataattgtctgtcctt

SEQ ID NO: 172489 - DNA, 20 bp, Artificial Sequence
  chemically synthesized
gtacaggagttgcccaagga

SEQ ID NO: 172490 - DNA, 20 bp, Artificial Sequence
  chemically synthesized
ggtagtacaggagttgccca

SEQ ID NO: 172491 - DNA, 20 bp, Artificial Sequence
  chemically synthesized
cggtagtacaggagttgccc

SEQ ID NO: 172492 - DNA, 20 bp, Artificial Sequence
  chemically synthesized
aacaaaggacggtagtacag

SEQ ID NO: 172493 - DNA, 20 bp, Artificial Sequence
  chemically synthesized
gcaacaaaggacggtagtac

SEQ ID NO: 172494 - DNA, 20 bp, Artificial Sequence
  chemically synthesized
tgcaacaaaggacggtagta

SEQ ID NO: 172495 - DNA, 20 bp, Artificial Sequence
  chemically synthesized
gagattgcaacaaaggacgg

SEQ ID NO: 172496 - DNA, 20 bp, Artificial Sequence
  chemically synthesized
gttgagattgcaacaaagga

SEQ ID NO: 172497 - DNA, 20 bp, Artificial Sequence
  chemically synthesized
gaaagttgagattgcaacaa

SEQ ID NO: 172498 - DNA, 20 bp, Artificial Sequence
  chemically synthesized
ggaaagttgagattgcaaca

SEQ ID NO: 172499 - DNA, 20 bp, Artificial Sequence
  chemically synthesized
aagtaattatgtggaaagtt

SEQ ID NO: 172500 - DNA, 20 bp, Artificial Sequence
  chemically synthesized
ttggaaagtaattatgtgga

SEQ ID NO: 172501 - DNA, 20 bp, Artificial Sequence
  chemically synthesized
tagcttggaaagtaattatg

SEQ ID NO: 172502 - DNA, 20 bp, Artificial Sequence
  chemically synthesized
tttccacataattactttcc

SEQ ID NO: 172503 - DNA, 20 bp, Artificial Sequence
  chemically synthesized
gcctcgtagtatagcttgga

SEQ ID NO: 172504 - DNA, 20 bp, Artificial Sequence
  chemically synthesized
ctttgcctcgtagtatagct

SEQ ID NO: 172505 - DNA, 20 bp, Artificial Sequence
  chemically synthesized
tactttccaagctatactac

SEQ ID NO: 172506 - DNA, 20 bp, Artificial Sequence
  chemically synthesized
actttccaagctatactacg

SEQ ID NO: 172507 - DNA, 20 bp, Artificial Sequence
  chemically synthesized
cctccctttgcctcgtagta

SEQ ID NO: 172508 - DNA, 20 bp, Artificial Sequence
  chemically synthesized
ccaagctatactacgaggca

SEQ ID NO: 172509 - DNA, 20 bp, Artificial Sequence
  chemically synthesized
ataatcctccctttgcctcg

SEQ ID NO: 172510 - DNA, 20 bp, Artificial Sequence
  chemically synthesized
caagctatactacgaggcaa

SEQ ID NO: 172511 - DNA, 20 bp, Artificial Sequence
  chemically synthesized
aagctatactacgaggcaaa

SEQ ID NO: 172512 - DNA, 20 bp, Artificial Sequence
  chemically synthesized
gctatactacgaggcaaagg

SEQ ID NO: 172513 - DNA, 20 bp, Artificial Sequence
  chemically synthesized
ctatactacgaggcaaaggg

SEQ ID NO: 172514 - DNA, 20 bp, Artificial Sequence
  chemically synthesized
gaggcaaagggaggattatg

SEQ ID NO: 172515 - DNA, 20 bp, Artificial Sequence
  chemically synthesized
aggcaaagggaggattatga

SEQ ID NO: 172516 - DNA, 20 bp, Artificial Sequence
  chemically synthesized
ggcaaagggaggattatgaa

SEQ ID NO: 172517 - DNA, 20 bp, Artificial Sequence
  chemically synthesized
agggaggattatgaagggtt

SEQ ID NO: 172518 - DNA, 20 bp, Artificial Sequence
  chemically synthesized
gggaggattatgaagggttt

SEQ ID NO: 172519 - DNA, 20 bp, Artificial Sequence
  chemically synthesized
ggaggattatgaagggttta

SEQ ID NO: 172520 - DNA, 20 bp, Artificial Sequence
  chemically synthesized
ttacagtgaagcggaagaga

SEQ ID NO: 172521 - DNA, 20 bp, Artificial Sequence
  chemically synthesized
aattacagtgaagcggaaga

SEQ ID NO: 172522 - DNA, 20 bp, Artificial Sequence
  chemically synthesized
gaaattacagtgaagcggaa

SEQ ID NO: 172523 - DNA, 20 bp, Artificial Sequence
  chemically synthesized
tagaaattacagtgaagcgg

SEQ ID NO: 172524 - DNA, 20 bp, Artificial Sequence
  chemically synthesized
gaatagaaattacagtgaag

SEQ ID NO: 172525 - DNA, 20 bp, Artificial Sequence
  chemically synthesized
aaagaatagaaattacagtg

SEQ ID NO: 172526 - DNA, 20 bp, Artificial Sequence
  chemically synthesized
taaataaagaatagaaatta

SEQ ID NO: 172527 - DNA, 20 bp, Artificial Sequence
  chemically synthesized
gaatgtttctaaataaagaa

SEQ ID NO: 172528 - DNA, 20 bp, Artificial Sequence
  chemically synthesized
tgtaatttctattctttatt

SEQ ID NO: 172529 - DNA, 20 bp, Artificial Sequence
  chemically synthesized
agacagaatgtttctaaata

SEQ ID NO: 172530 - DNA, 20 bp, Artificial Sequence
  chemically synthesized
caaaataataaaggaataga

SEQ ID NO: 172531 - DNA, 20 bp, Artificial Sequence
  chemically synthesized
actacaaaataataaaggaa

SEQ ID NO: 172532 - DNA, 20 bp, Artificial Sequence
  chemically synthesized
tatagactacaaaataataa

SEQ ID NO: 172533 - DNA, 20 bp, Artificial Sequence
  chemically synthesized
ttatagactacaaaataata

SEQ ID NO: 172534 - DNA, 20 bp, Artificial Sequence
  chemically synthesized
tctattcctttattattttg

SEQ ID NO: 172535 - DNA, 20 bp, Artificial Sequence
  chemically synthesized
aagatgttgtatgattatta

SEQ ID NO: 172536 - DNA, 20 bp, Artificial Sequence
  chemically synthesized
aaatatagtgtcatattaat

SEQ ID NO: 172537 - DNA, 20 bp, Artificial Sequence
  chemically synthesized
attaatatgacactatattt

SEQ ID NO: 172538 - DNA, 20 bp, Artificial Sequence
  chemically synthesized
tagagggcatatccaaaata

SEQ ID NO: 172539 - DNA, 20 bp, Artificial Sequence
  chemically synthesized
aatattagtaatataataga

SEQ ID NO: 172540 - DNA, 20 bp, Artificial Sequence
  chemically synthesized
aaatattagtaatataatag

SEQ ID NO: 172541 - DNA, 20 bp, Artificial Sequence
  chemically synthesized
taaatattagtaatataata

SEQ ID NO: 172542 - DNA, 20 bp, Artificial Sequence
  chemically synthesized
tgtaaatattagtaatataa

SEQ ID NO: 172543 - DNA, 20 bp, Artificial Sequence
  chemically synthesized
gtttacatttatgtaaatat

SEQ ID NO: 172544 - DNA, 20 bp, Artificial Sequence
  chemically synthesized
catttttatttccatgatcc

SEQ ID NO: 172545 - DNA, 20 bp, Artificial Sequence
  chemically synthesized
ggtaaaagtcactaggatca

SEQ ID NO: 172546 - DNA, 20 bp, Artificial Sequence
  chemically synthesized
tagaaacggtaaaagtcact

SEQ ID NO: 172547 - DNA, 20 bp, Artificial Sequence
  chemically synthesized
ttagaaacggtaaaagtcac

SEQ ID NO: 172548 - DNA, 20 bp, Artificial Sequence
  chemically synthesized
aaatacattagaaacggtaa

SEQ ID NO: 172549 - DNA, 20 bp, Artificial Sequence
  chemically synthesized
aaaaataaatacattagaaa

SEQ ID NO: 172550 - DNA, 20 bp, Artificial Sequence
  chemically synthesized
taatttaaaaataaatacat

SEQ ID NO: 172551 - DNA, 20 bp, Artificial Sequence
  chemically synthesized
tttgaaatatgcatacactg

SEQ ID NO: 172552 - DNA, 20 bp, Artificial Sequence
  chemically synthesized
aatatgcatacactgtggaa

SEQ ID NO: 172553 - DNA, 20 bp, Artificial Sequence
  chemically synthesized
atctcaatttagccattcca

SEQ ID NO: 172554 - DNA, 20 bp, Artificial Sequence
  chemically synthesized
cactgtggaatggctaaatt

SEQ ID NO: 172555 - DNA, 20 bp, Artificial Sequence
  chemically synthesized
atatgttaattatctcaatt

SEQ ID NO: 172556 - DNA, 20 bp, Artificial Sequence
  chemically synthesized
aaaaaaatgataagaatgtg

SEQ ID NO: 172557 - DNA, 20 bp, Artificial Sequence
  chemically synthesized
taaaaaaatgataagaatgt

SEQ ID NO: 172558 - DNA, 20 bp, Artificial Sequence
  chemically synthesized
ataaaaaaatgataagaatg

SEQ ID NO: 172559 - DNA, 20 bp, Artificial Sequence
  chemically synthesized
tctcaccataaaaaaatgat

SEQ ID NO: 172560 - DNA, 20 bp, Artificial Sequence
  chemically synthesized
acattcttatcattttttta

SEQ ID NO: 172561 - DNA, 20 bp, Artificial Sequence
  chemically synthesized
tcttatcatttttttatggt

SEQ ID NO: 172562 - DNA, 20 bp, Artificial Sequence
  chemically synthesized
atgtttaaaatgtaatctct

SEQ ID NO: 172563 - DNA, 20 bp, Artificial Sequence
  chemically synthesized
gtattcttgaaaattgccaa

SEQ ID NO: 172564 - DNA, 20 bp, Artificial Sequence
  chemically synthesized
ttgtattcttgaaaattgcc

SEQ ID NO: 172565 - DNA, 20 bp, Artificial Sequence
  chemically synthesized
gtaatctcttggcaattttc

SEQ ID NO: 172566 - DNA, 20 bp, Artificial Sequence
  chemically synthesized
caatgcattgttattaacta

SEQ ID NO: 172567 - DNA, 20 bp, Artificial Sequence
  chemically synthesized
aaaaggaatggagattacta

SEQ ID NO: 172568 - DNA, 20 bp, Artificial Sequence
  chemically synthesized
gcagatacctaaaaggaatg

SEQ ID NO: 172569 - DNA, 20 bp, Artificial Sequence
  chemically synthesized
atagtaatctccattccttt

SEQ ID NO: 172570 - DNA, 20 bp, Artificial Sequence
  chemically synthesized
aagcagatacctaaaaggaa

SEQ ID NO: 172571 - DNA, 20 bp, Artificial Sequence
  chemically synthesized
tagtaatctccattcctttt

SEQ ID NO: 172572 - DNA, 20 bp, Artificial Sequence
  chemically synthesized
agcctaagcagatacctaaa

SEQ ID NO: 172573 - DNA, 20 bp, Artificial Sequence
  chemically synthesized
cagcctaagcagatacctaa

SEQ ID NO: 172574 - DNA, 20 bp, Artificial Sequence
  chemically synthesized
attccttttaggtatctgct

SEQ ID NO: 172575 - DNA, 20 bp, Artificial Sequence
  chemically synthesized
ttccttttaggtatctgctt

SEQ ID NO: 172576 - DNA, 20 bp, Artificial Sequence
  chemically synthesized
ttttaggtatctgcttaggc

SEQ ID NO: 172577 - DNA, 20 bp, Artificial Sequence
  chemically synthesized
gtgtatgataccagcctaag

SEQ ID NO: 172578 - DNA, 20 bp, Artificial Sequence
  chemically synthesized
tatgtgtatgataccagcct

SEQ ID NO: 172579 - DNA, 20 bp, Artificial Sequence
  chemically synthesized
atttattatgtgtatgatac

SEQ ID NO: 172580 - DNA, 20 bp, Artificial Sequence
  chemically synthesized
aataaatgttcaattattta

SEQ ID NO: 172581 - DNA, 20 bp, Artificial Sequence
  chemically synthesized
cattaaagaaataaaacatt

SEQ ID NO: 172582 - DNA, 20 bp, Artificial Sequence
  chemically synthesized
tcattaaagaaataaaacat

SEQ ID NO: 172583 - DNA, 20 bp, Artificial Sequence
  chemically synthesized
cagaatgaactaattcatta

SEQ ID NO: 172584 - DNA, 20 bp, Artificial Sequence
  chemically synthesized
gttttatttctttaatgaat

SEQ ID NO: 172585 - DNA, 20 bp, Artificial Sequence
  chemically synthesized
ttgacagaagtattagtttt

SEQ ID NO: 172586 - DNA, 20 bp, Artificial Sequence
  chemically synthesized
ttgttgattgacagaagtat

SEQ ID NO: 172587 - DNA, 20 bp, Artificial Sequence
  chemically synthesized
tgattgttgttgattgacag

SEQ ID NO: 172588 - DNA, 20 bp, Artificial Sequence
  chemically synthesized
gattgattgttgttgattga

SEQ ID NO: 172589 - DNA, 20 bp, Artificial Sequence
  chemically synthesized
caatcaatcaaccaacttca

SEQ ID NO: 172590 - DNA, 20 bp, Artificial Sequence
  chemically synthesized
aagagaagttactttgaagt

SEQ ID NO: 172591 - DNA, 20 bp, Artificial Sequence
  chemically synthesized
aacgaagagaagttactttg

SEQ ID NO: 172592 - DNA, 20 bp, Artificial Sequence
  chemically synthesized
tagtcatctctaacgaagag

SEQ ID NO: 172593 - DNA, 20 bp, Artificial Sequence
  chemically synthesized
tcaaagtaacttctcttcgt

SEQ ID NO: 172594 - DNA, 20 bp, Artificial Sequence
  chemically synthesized
aaagtaacttctcttcgtta

SEQ ID NO: 172595 - DNA, 20 bp, Artificial Sequence
  chemically synthesized
tgctagtcatctctaacgaa

SEQ ID NO: 172596 - DNA, 20 bp, Artificial Sequence
  chemically synthesized
gctgctagtcatctctaacg

SEQ ID NO: 172597 - DNA, 20 bp, Artificial Sequence
  chemically synthesized
ttctcttcgttagagatgac

SEQ ID NO: 172598 - DNA, 20 bp, Artificial Sequence
  chemically synthesized
tcttcgttagagatgactag

SEQ ID NO: 172599 - DNA, 20 bp, Artificial Sequence
  chemically synthesized
ttagagatgactagcagcct

SEQ ID NO: 172600 - DNA, 20 bp, Artificial Sequence
  chemically synthesized
caatttgatactaaggctgc

SEQ ID NO: 172601 - DNA, 20 bp, Artificial Sequence
  chemically synthesized
taatcaccaatttgatacta

SEQ ID NO: 172602 - DNA, 20 bp, Artificial Sequence
  chemically synthesized
ataatcaccaatttgatact

SEQ ID NO: 172603 - DNA, 20 bp, Artificial Sequence
  chemically synthesized
tagcagccttagtatcaaat

SEQ ID NO: 172604 - DNA, 20 bp, Artificial Sequence
  chemically synthesized
gtatcaaattggtgattatt

SEQ ID NO: 172605 - DNA, 20 bp, Artificial Sequence
  chemically synthesized
caaattggtgattattaaga

SEQ ID NO: 172606 - DNA, 20 bp, Artificial Sequence
  chemically synthesized
tttggagagcgggagttatg

SEQ ID NO: 172607 - DNA, 20 bp, Artificial Sequence
  chemically synthesized
ctttggagagcgggagttat

SEQ ID NO: 172608 - DNA, 20 bp, Artificial Sequence
  chemically synthesized
actttggagagcgggagtta

SEQ ID NO: 172609 - DNA, 20 bp, Artificial Sequence
  chemically synthesized
gaattcactttggagagcgg

SEQ ID NO: 172610 - DNA, 20 bp, Artificial Sequence
  chemically synthesized
aagaattcactttggagagc

SEQ ID NO: 172611 - DNA, 20 bp, Artificial Sequence
  chemically synthesized
cccataactcccgctctcca

SEQ ID NO: 172612 - DNA, 20 bp, Artificial Sequence
  chemically synthesized
aaagaattcactttggagag

SEQ ID NO: 172613 - DNA, 20 bp, Artificial Sequence
  chemically synthesized
tttaaagaattcactttgga

SEQ ID NO: 172614 - DNA, 20 bp, Artificial Sequence
  chemically synthesized
gatttaaagaattcactttg

SEQ ID NO: 172615 - DNA, 20 bp, Artificial Sequence
  chemically synthesized
gagatttaaagaattcactt

SEQ ID NO: 172616 - DNA, 20 bp, Artificial Sequence
  chemically synthesized
tgcatatcaaaagagattta

SEQ ID NO: 172617 - DNA, 20 bp, Artificial Sequence
  chemically synthesized
ctgaactttgcatatcaaaa

SEQ ID NO: 172618 - DNA, 20 bp, Artificial Sequence
  chemically synthesized
cactgaactttgcatatcaa

SEQ ID NO: 172619 - DNA, 20 bp, Artificial Sequence
  chemically synthesized
taaatctcttttgatatgca

SEQ ID NO: 172620 - DNA, 20 bp, Artificial Sequence
  chemically synthesized
ctcttttgatatgcaaagtt

SEQ ID NO: 172621 - DNA, 20 bp, Artificial Sequence
  chemically synthesized
tttgatatgcaaagttcagt

SEQ ID NO: 172622 - DNA, 20 bp, Artificial Sequence
  chemically synthesized
gatatgcaaagttcagtgag

SEQ ID NO: 172623 - DNA, 20 bp, Artificial Sequence
  chemically synthesized
gcacgttgctaggtgacaga

SEQ ID NO: 172624 - DNA, 20 bp, Artificial Sequence
  chemically synthesized
agcacgttgctaggtgacag

SEQ ID NO: 172625 - DNA, 20 bp, Artificial Sequence
  chemically synthesized
agtgaacaccttctgtcacc

SEQ ID NO: 172626 - DNA, 20 bp, Artificial Sequence
  chemically synthesized
atcagcacgttgctaggtga

SEQ ID NO: 172627 - DNA, 20 bp, Artificial Sequence
  chemically synthesized
tttaagatcagcacgttgct

SEQ ID NO: 172628 - DNA, 20 bp, Artificial Sequence
  chemically synthesized
gtttaagatcagcacgttgc

SEQ ID NO: 172629 - DNA, 20 bp, Artificial Sequence
  chemically synthesized
taactggccttgtttaagat

SEQ ID NO: 172630 - DNA, 20 bp, Artificial Sequence
  chemically synthesized
gcaacgtgctgatcttaaac

SEQ ID NO: 172631 - DNA, 20 bp, Artificial Sequence
  chemically synthesized
caacgtgctgatcttaaaca

SEQ ID NO: 172632 - DNA, 20 bp, Artificial Sequence
  chemically synthesized
gaggttaactggccttgttt

SEQ ID NO: 172633 - DNA, 20 bp, Artificial Sequence
  chemically synthesized
gtgctgatcttaaacaaggc

SEQ ID NO: 172634 - DNA, 20 bp, Artificial Sequence
  chemically synthesized
ccaggttcagcgaggttaac

SEQ ID NO: 172635 - DNA, 20 bp, Artificial Sequence
  chemically synthesized
agagaaatccaggttcagcg

SEQ ID NO: 172636 - DNA, 20 bp, Artificial Sequence
  chemically synthesized
aagagaaatccaggttcagc

SEQ ID NO: 172637 - DNA, 20 bp, Artificial Sequence
  chemically synthesized
ccagttaacctcgctgaacc

SEQ ID NO: 172638 - DNA, 20 bp, Artificial Sequence
  chemically synthesized
cagaaagagaaatccaggtt

SEQ ID NO: 172639 - DNA, 20 bp, Artificial Sequence
  chemically synthesized
ttgttcagaaagagaaatcc

SEQ ID NO: 172640 - DNA, 20 bp, Artificial Sequence
  chemically synthesized
tttgttcagaaagagaaatc

SEQ ID NO: 172641 - DNA, 20 bp, Artificial Sequence
  chemically synthesized
tgtctttctttgttcagaaa

SEQ ID NO: 172642 - DNA, 20 bp, Artificial Sequence
  chemically synthesized
cttgtctttctttgttcaga

SEQ ID NO: 172643 - DNA, 20 bp, Artificial Sequence
  chemically synthesized
tggatttctctttctgaaca

SEQ ID NO: 172644 - DNA, 20 bp, Artificial Sequence
  chemically synthesized
ggatcttgtctttctttgtt

SEQ ID NO: 172645 - DNA, 20 bp, Artificial Sequence
  chemically synthesized
tttctctttctgaacaaaga

SEQ ID NO: 172646 - DNA, 20 bp, Artificial Sequence
  chemically synthesized
ctttctgaacaaagaaagac

SEQ ID NO: 172647 - DNA, 20 bp, Artificial Sequence
  chemically synthesized
gtcacagaagttataggagg

SEQ ID NO: 172648 - DNA, 20 bp, Artificial Sequence
  chemically synthesized
tgagtcacagaagttatagg

SEQ ID NO: 172649 - DNA, 20 bp, Artificial Sequence
  chemically synthesized
ttgagtcacagaagttatag

SEQ ID NO: 172650 - DNA, 20 bp, Artificial Sequence
  chemically synthesized
atttgagtcacagaagttat

SEQ ID NO: 172651 - DNA, 20 bp, Artificial Sequence
  chemically synthesized
catttgagtcacagaagtta

SEQ ID NO: 172652 - DNA, 20 bp, Artificial Sequence
  chemically synthesized
ttagctcatttgagtcacag

SEQ ID NO: 172653 - DNA, 20 bp, Artificial Sequence
  chemically synthesized
acattagctcatttgagtca

SEQ ID NO: 172654 - DNA, 20 bp, Artificial Sequence
  chemically synthesized
ataacttctgtgactcaaat

SEQ ID NO: 172655 - DNA, 20 bp, Artificial Sequence
  chemically synthesized
tcctatacattagctcattt

SEQ ID NO: 172656 - DNA, 20 bp, Artificial Sequence
  chemically synthesized
gactcaaatgagctaatgta

SEQ ID NO: 172657 - DNA, 20 bp, Artificial Sequence
  chemically synthesized
actcaaatgagctaatgtat

SEQ ID NO: 172658 - DNA, 20 bp, Artificial Sequence
  chemically synthesized
gcacagtatttcctatacat

SEQ ID NO: 172659 - DNA, 20 bp, Artificial Sequence
  chemically synthesized
ataaaccactatatgttgca

SEQ ID NO: 172660 - DNA, 20 bp, Artificial Sequence
  chemically synthesized
aggaaatactgtgcaacata

SEQ ID NO: 172661 - DNA, 20 bp, Artificial Sequence
  chemically synthesized
aaatactgtgcaacatatag

SEQ ID NO: 172662 - DNA, 20 bp, Artificial Sequence
  chemically synthesized
ctaattttttcagaatttta

SEQ ID NO: 172663 - DNA, 20 bp, Artificial Sequence
  chemically synthesized
ccataaaattctgaaaaaat

SEQ ID NO: 172664 - DNA, 20 bp, Artificial Sequence
  chemically synthesized
gttcaatcagctaatttttt

SEQ ID NO: 172665 - DNA, 20 bp, Artificial Sequence
  chemically synthesized
aaaaaattagctgattgaac

SEQ ID NO: 172666 - DNA, 20 bp, Artificial Sequence
  chemically synthesized
gctctactcactggttcaat

SEQ ID NO: 172667 - DNA, 20 bp, Artificial Sequence
  chemically synthesized
aattagctgattgaaccagt

SEQ ID NO: 172668 - DNA, 20 bp, Artificial Sequence
  chemically synthesized
tagctgattgaaccagtgag

SEQ ID NO: 172669 - DNA, 20 bp, Artificial Sequence
  chemically synthesized
gctgattgaaccagtgagta

SEQ ID NO: 172670 - DNA, 20 bp, Artificial Sequence
  chemically synthesized
tttgcctacgctctactcac

SEQ ID NO: 172671 - DNA, 20 bp, Artificial Sequence
  chemically synthesized
ttgaaccagtgagtagagcg

SEQ ID NO: 172672 - DNA, 20 bp, Artificial Sequence
  chemically synthesized
tgaaccagtgagtagagcgt

SEQ ID NO: 172673 - DNA, 20 bp, Artificial Sequence
  chemically synthesized
cagtgagtagagcgtaggca

SEQ ID NO: 172674 - DNA, 20 bp, Artificial Sequence
  chemically synthesized
gagcgtaggcaaagcgatat

SEQ ID NO: 172675 - DNA, 20 bp, Artificial Sequence
  chemically synthesized
gcgtaggcaaagcgatataa

SEQ ID NO: 172676 - DNA, 20 bp, Artificial Sequence
  chemically synthesized
taggcaaagcgatataagag

SEQ ID NO: 172677 - DNA, 20 bp, Artificial Sequence
  chemically synthesized
tcatcacctaatcagcaaat

SEQ ID NO: 172678 - DNA, 20 bp, Artificial Sequence
  chemically synthesized
agcagtactaatttgctgat

SEQ ID NO: 172679 - DNA, 20 bp, Artificial Sequence
  chemically synthesized
gcagtactaatttgctgatt

SEQ ID NO: 172680 - DNA, 20 bp, Artificial Sequence
  chemically synthesized
actaattttcatcacctaat

SEQ ID NO: 172681 - DNA, 20 bp, Artificial Sequence
  chemically synthesized
gctgattaggtgatgaaaat

SEQ ID NO: 172682 - DNA, 20 bp, Artificial Sequence
  chemically synthesized
gatgaaaattagtaaacact

SEQ ID NO: 172683 - DNA, 20 bp, Artificial Sequence
  chemically synthesized
atttattagtagcaaaatct

SEQ ID NO: 172684 - DNA, 20 bp, Artificial Sequence
  chemically synthesized
tgcagcaatacatttattag

SEQ ID NO: 172685 - DNA, 20 bp, Artificial Sequence
  chemically synthesized
ttttgcagcaatacatttat

SEQ ID NO: 172686 - DNA, 20 bp, Artificial Sequence
  chemically synthesized
taaccgtcagttacattttg

SEQ ID NO: 172687 - DNA, 20 bp, Artificial Sequence
  chemically synthesized
ttgctgcaaaatgtaactga

SEQ ID NO: 172688 - DNA, 20 bp, Artificial Sequence
  chemically synthesized
aatgattgtagtttaaccgt

SEQ ID NO: 172689 - DNA, 20 bp, Artificial Sequence
  chemically synthesized
aaattattattgaatgattg

SEQ ID NO: 172690 - DNA, 20 bp, Artificial Sequence
  chemically synthesized
ataatttgttgaacatctcc

SEQ ID NO: 172691 - DNA, 20 bp, Artificial Sequence
  chemically synthesized
taatttgttgaacatctcct

SEQ ID NO: 172692 - DNA, 20 bp, Artificial Sequence
  chemically synthesized
ttataatgctttatacctag

SEQ ID NO: 172693 - DNA, 20 bp, Artificial Sequence
  chemically synthesized
ttgaacatctcctaggtata

SEQ ID NO: 172694 - DNA, 20 bp, Artificial Sequence
  chemically synthesized
tcttataatgctttatacct

SEQ ID NO: 172695 - DNA, 20 bp, Artificial Sequence
  chemically synthesized
gtcttataatgctttatacc

SEQ ID NO: 172696 - DNA, 20 bp, Artificial Sequence
  chemically synthesized
tcctaggtataaagcattat

SEQ ID NO: 172697 - DNA, 20 bp, Artificial Sequence
  chemically synthesized
ataaagcattataagaccaa

SEQ ID NO: 172698 - DNA, 20 bp, Artificial Sequence
  chemically synthesized
tgtaattcttggatttcttt

SEQ ID NO: 172699 - DNA, 20 bp, Artificial Sequence
  chemically synthesized
tataagaccaaaagaaatcc

SEQ ID NO: 172700 - DNA, 20 bp, Artificial Sequence
  chemically synthesized
attatacgggatgtaattct

SEQ ID NO: 172701 - DNA, 20 bp, Artificial Sequence
  chemically synthesized
atccacaactaggattatac

SEQ ID NO: 172702 - DNA, 20 bp, Artificial Sequence
  chemically synthesized
aatccacaactaggattata

SEQ ID NO: 172703 - DNA, 20 bp, Artificial Sequence
  chemically synthesized
aattacatcccgtataatcc

SEQ ID NO: 172704 - DNA, 20 bp, Artificial Sequence
  chemically synthesized
atcccgtataatcctagttg

SEQ ID NO: 172705 - DNA, 20 bp, Artificial Sequence
  chemically synthesized
aaaaatataaatccacaact

SEQ ID NO: 172706 - DNA, 20 bp, Artificial Sequence
  chemically synthesized
gaaaaatataaatccacaac

SEQ ID NO: 172707 - DNA, 20 bp, Artificial Sequence
  chemically synthesized
tttacacacccagtatcaaa

SEQ ID NO: 172708 - DNA, 20 bp, Artificial Sequence
  chemically synthesized
tatatttttctttttgatac

SEQ ID NO: 172709 - DNA, 20 bp, Artificial Sequence
  chemically synthesized
atatttttctttttgatact

SEQ ID NO: 172710 - DNA, 20 bp, Artificial Sequence
  chemically synthesized
ttgagtctattttacacacc

SEQ ID NO: 172711 - DNA, 20 bp, Artificial Sequence
  chemically synthesized
ttgatactgggtgtgtaaaa

SEQ ID NO: 172712 - DNA, 20 bp, Artificial Sequence
  chemically synthesized
aggggaaaaaatcatttttt

SEQ ID NO: 172713 - DNA, 20 bp, Artificial Sequence
  chemically synthesized
aaaatgattttttccccttt

SEQ ID NO: 172714 - DNA, 20 bp, Artificial Sequence
  chemically synthesized
agcaaacaaaaatcttaaag

SEQ ID NO: 172715 - DNA, 20 bp, Artificial Sequence
  chemically synthesized
gagcaaacaaaaatcttaaa

SEQ ID NO: 172716 - DNA, 20 bp, Artificial Sequence
  chemically synthesized
tgagcaaacaaaaatcttaa

SEQ ID NO: 172717 - DNA, 20 bp, Artificial Sequence
  chemically synthesized
atgagcaaacaaaaatctta

SEQ ID NO: 172718 - DNA, 20 bp, Artificial Sequence
  chemically synthesized
gtagccaaccacgattcaat

SEQ ID NO: 172719 - DNA, 20 bp, Artificial Sequence
  chemically synthesized
tttgtttgctcattgaatcg

SEQ ID NO: 172720 - DNA, 20 bp, Artificial Sequence
  chemically synthesized
tttgctcattgaatcgtggt

SEQ ID NO: 172721 - DNA, 20 bp, Artificial Sequence
  chemically synthesized
tgaatcgtggttggctacat

SEQ ID NO: 172722 - DNA, 20 bp, Artificial Sequence
  chemically synthesized
gaatcgtggttggctacatc

SEQ ID NO: 172723 - DNA, 20 bp, Artificial Sequence
  chemically synthesized
tcgtggttggctacatcagg

SEQ ID NO: 172724 - DNA, 20 bp, Artificial Sequence
  chemically synthesized
cttaaaatctctgcctgatg

SEQ ID NO: 172725 - DNA, 20 bp, Artificial Sequence
  chemically synthesized
gtggttggctacatcaggca

SEQ ID NO: 172726 - DNA, 20 bp, Artificial Sequence
  chemically synthesized
ctacatcaggcagagatttt

SEQ ID NO: 172727 - DNA, 20 bp, Artificial Sequence
  chemically synthesized
tacatcaggcagagatttta

SEQ ID NO: 172728 - DNA, 20 bp, Artificial Sequence
  chemically synthesized
acatcaggcagagattttaa

SEQ ID NO: 172729 - DNA, 20 bp, Artificial Sequence
  chemically synthesized
tactctgtcttgttgaaaat

SEQ ID NO: 172730 - DNA, 20 bp, Artificial Sequence
  chemically synthesized
ttactctgtcttgttgaaaa

SEQ ID NO: 172731 - DNA, 20 bp, Artificial Sequence
  chemically synthesized
agggaaaacctattttcaac

SEQ ID NO: 172732 - DNA, 20 bp, Artificial Sequence
  chemically synthesized
aaaacctattttcaacaaga

SEQ ID NO: 172733 - DNA, 20 bp, Artificial Sequence
  chemically synthesized
aacctattttcaacaagaca

SEQ ID NO: 172734 - DNA, 20 bp, Artificial Sequence
  chemically synthesized
tattttcaacaagacagagt

SEQ ID NO: 172735 - DNA, 20 bp, Artificial Sequence
  chemically synthesized
agacagagtaagtcaattct

SEQ ID NO: 172736 - DNA, 20 bp, Artificial Sequence
  chemically synthesized
gtattagccgcagagttgct

SEQ ID NO: 172737 - DNA, 20 bp, Artificial Sequence
  chemically synthesized
gtcaattctaagcaactctg

SEQ ID NO: 172738 - DNA, 20 bp, Artificial Sequence
  chemically synthesized
tacaacatgtattagccgca

SEQ ID NO: 172739 - DNA, 20 bp, Artificial Sequence
  chemically synthesized
cctacaacatgtattagccg

SEQ ID NO: 172740 - DNA, 20 bp, Artificial Sequence
  chemically synthesized
atgaaccctacaacatgtat

SEQ ID NO: 172741 - DNA, 20 bp, Artificial Sequence
  chemically synthesized
tctgcggctaatacatgttg

SEQ ID NO: 172742 - DNA, 20 bp, Artificial Sequence
  chemically synthesized
ctgcggctaatacatgttgt

SEQ ID NO: 172743 - DNA, 20 bp, Artificial Sequence
  chemically synthesized
tgcggctaatacatgttgta

SEQ ID NO: 172744 - DNA, 20 bp, Artificial Sequence
  chemically synthesized
ttcatataatttcttcttca

SEQ ID NO: 172745 - DNA, 20 bp, Artificial Sequence
  chemically synthesized
catataatttcttcttcaca

SEQ ID NO: 172746 - DNA, 20 bp, Artificial Sequence
  chemically synthesized
ggacaattgtctctgtgaag

SEQ ID NO: 172747 - DNA, 20 bp, Artificial Sequence
  chemically synthesized
tagggacaattgtctctgtg

SEQ ID NO: 172748 - DNA, 20 bp, Artificial Sequence
  chemically synthesized
tgttgagaggtgtcataata

SEQ ID NO: 172749 - DNA, 20 bp, Artificial Sequence
  chemically synthesized
atgttgagaggtgtcataat

SEQ ID NO: 172750 - DNA, 20 bp, Artificial Sequence
  chemically synthesized
aatgttgagaggtgtcataa

SEQ ID NO: 172751 - DNA, 20 bp, Artificial Sequence
  chemically synthesized
taaacaatggcaatgttgag

SEQ ID NO: 172752 - DNA, 20 bp, Artificial Sequence
  chemically synthesized
ataaacaatggcaatgttga

SEQ ID NO: 172753 - DNA, 20 bp, Artificial Sequence
  chemically synthesized
agataaacaatggcaatgtt

SEQ ID NO: 172754 - DNA, 20 bp, Artificial Sequence
  chemically synthesized
tcattgttctagataaacaa

SEQ ID NO: 172755 - DNA, 20 bp, Artificial Sequence
  chemically synthesized
caacattgccattgtttatc

SEQ ID NO: 172756 - DNA, 20 bp, Artificial Sequence
  chemically synthesized
tttattggatgtcattgttc

SEQ ID NO: 172757 - DNA, 20 bp, Artificial Sequence
  chemically synthesized
cgctctcattataattttat

SEQ ID NO: 172758 - DNA, 20 bp, Artificial Sequence
  chemically synthesized
acatccaataaaattataat

SEQ ID NO: 172759 - DNA, 20 bp, Artificial Sequence
  chemically synthesized
atccaataaaattataatga

SEQ ID NO: 172760 - DNA, 20 bp, Artificial Sequence
  chemically synthesized
ttttttacttttgtaatgtg

SEQ ID NO: 172761 - DNA, 20 bp, Artificial Sequence
  chemically synthesized
aaattttctacacattacaa

SEQ ID NO: 172762 - DNA, 20 bp, Artificial Sequence
  chemically synthesized
cacattacaaaagtaaaaaa

SEQ ID NO: 172763 - DNA, 20 bp, Artificial Sequence
  chemically synthesized
acattacaaaagtaaaaaac

SEQ ID NO: 172764 - DNA, 20 bp, Artificial Sequence
  chemically synthesized
caatttggctatttaagtta

SEQ ID NO: 172765 - DNA, 20 bp, Artificial Sequence
  chemically synthesized
tatattttctttaacttaaa

SEQ ID NO: 172766 - DNA, 20 bp, Artificial Sequence
  chemically synthesized
tgacaacaatttggctattt

SEQ ID NO: 172767 - DNA, 20 bp, Artificial Sequence
  chemically synthesized
aggttgaagtgacaacaatt

SEQ ID NO: 172768 - DNA, 20 bp, Artificial Sequence
  chemically synthesized
tttatattgagtacaggttg

SEQ ID NO: 172769 - DNA, 20 bp, Artificial Sequence
  chemically synthesized
gtactttttatattgagtac

SEQ ID NO: 172770 - DNA, 20 bp, Artificial Sequence
  chemically synthesized
ggtactttttatattgagta

SEQ ID NO: 172771 - DNA, 20 bp, Artificial Sequence
  chemically synthesized
tcattggtactttttatatt

SEQ ID NO: 172772 - DNA, 20 bp, Artificial Sequence
  chemically synthesized
caacctgtactcaatataaa

SEQ ID NO: 172773 - DNA, 20 bp, Artificial Sequence
  chemically synthesized
tcaatataaaaagtaccaat

SEQ ID NO: 172774 - DNA, 20 bp, Artificial Sequence
  chemically synthesized
aaaaaaataaaatatctcat

SEQ ID NO: 172775 - DNA, 20 bp, Artificial Sequence
  chemically synthesized
tattttatttttttcatact

SEQ ID NO: 172776 - DNA, 20 bp, Artificial Sequence
  chemically synthesized
attttatttttttcatactt

SEQ ID NO: 172777 - DNA, 20 bp, Artificial Sequence
  chemically synthesized
ctcaccaaattacaaaacct

SEQ ID NO: 172778 - DNA, 20 bp, Artificial Sequence
  chemically synthesized
catacttaggttttgtaatt

SEQ ID NO: 172779 - DNA, 20 bp, Artificial Sequence
  chemically synthesized
cttaggttttgtaatttggt

SEQ ID NO: 172780 - DNA, 20 bp, Artificial Sequence
  chemically synthesized
tggtgagtgttttatactta

SEQ ID NO: 172781 - DNA, 20 bp, Artificial Sequence
  chemically synthesized
tccccactgaaatgtgctgt

SEQ ID NO: 172782 - DNA, 20 bp, Artificial Sequence
  chemically synthesized
tttatacttacagcacattt

SEQ ID NO: 172783 - DNA, 20 bp, Artificial Sequence
  chemically synthesized
atacttacagcacatttcag

SEQ ID NO: 172784 - DNA, 20 bp, Artificial Sequence
  chemically synthesized
tacttacagcacatttcagt

SEQ ID NO: 172785 - DNA, 20 bp, Artificial Sequence
  chemically synthesized
acttacagcacatttcagtg

SEQ ID NO: 172786 - DNA, 20 bp, Artificial Sequence
  chemically synthesized
cagcacatttcagtggggac

SEQ ID NO: 172787 - DNA, 20 bp, Artificial Sequence
  chemically synthesized
atgagcatttgaaatatggc

SEQ ID NO: 172788 - DNA, 20 bp, Artificial Sequence
  chemically synthesized
ccatatgagcatttgaaata

SEQ ID NO: 172789 - DNA, 20 bp, Artificial Sequence
  chemically synthesized
ccatatttcaaatgctcata

SEQ ID NO: 172790 - DNA, 20 bp, Artificial Sequence
  chemically synthesized
tatttcaaatgctcatatgg

SEQ ID NO: 172791 - DNA, 20 bp, Artificial Sequence
  chemically synthesized
atttcaaatgctcatatggt

SEQ ID NO: 172792 - DNA, 20 bp, Artificial Sequence
  chemically synthesized
gtaacaacagcctaccatat

SEQ ID NO: 172793 - DNA, 20 bp, Artificial Sequence
  chemically synthesized
gctctccaatgtggtaacaa

SEQ ID NO: 172794 - DNA, 20 bp, Artificial Sequence
  chemically synthesized
gtaggctgttgttaccacat

SEQ ID NO: 172795 - DNA, 20 bp, Artificial Sequence
  chemically synthesized
aggctgttgttaccacattg

SEQ ID NO: 172796 - DNA, 20 bp, Artificial Sequence
  chemically synthesized
gctgttgttaccacattgga

SEQ ID NO: 172797 - DNA, 20 bp, Artificial Sequence
  chemically synthesized
gagatcagtgctctccaatg

SEQ ID NO: 172798 - DNA, 20 bp, Artificial Sequence
  chemically synthesized
attggagagcactgatctca

SEQ ID NO: 172799 - DNA, 20 bp, Artificial Sequence
  chemically synthesized
ttggagagcactgatctcaa

SEQ ID NO: 172800 - DNA, 20 bp, Artificial Sequence
  chemically synthesized
gtccaactttcctttgagat

SEQ ID NO: 172801 - DNA, 20 bp, Artificial Sequence
  chemically synthesized
agagcactgatctcaaagga

SEQ ID NO: 172802 - DNA, 20 bp, Artificial Sequence
  chemically synthesized
gaaatgtccaactttccttt

SEQ ID NO: 172803 - DNA, 20 bp, Artificial Sequence
  chemically synthesized
cactgatctcaaaggaaagt

SEQ ID NO: 172804 - DNA, 20 bp, Artificial Sequence
  chemically synthesized
gaaagttggacatttcgtcc

SEQ ID NO: 172805 - DNA, 20 bp, Artificial Sequence
  chemically synthesized
tttttatttgaacaaaaact

SEQ ID NO: 172806 - DNA, 20 bp, Artificial Sequence
  chemically synthesized
atatttgctcaaagtttaat

SEQ ID NO: 172807 - DNA, 20 bp, Artificial Sequence
  chemically synthesized
taaaaaactgattaaacttt

SEQ ID NO: 172808 - DNA, 20 bp, Artificial Sequence
  chemically synthesized
gaataattcatatttgctca

SEQ ID NO: 172809 - DNA, 20 bp, Artificial Sequence
  chemically synthesized
caaatatgaattattcttat

SEQ ID NO: 172810 - DNA, 20 bp, Artificial Sequence
  chemically synthesized
agaaacaataagagactgat

SEQ ID NO: 172811 - DNA, 20 bp, Artificial Sequence
  chemically synthesized
ttgagaggaagaaacaataa

SEQ ID NO: 172812 - DNA, 20 bp, Artificial Sequence
  chemically synthesized
ttttgagaggaagaaacaat

SEQ ID NO: 172813 - DNA, 20 bp, Artificial Sequence
  chemically synthesized
ttgcgaatatttttgagagg

SEQ ID NO: 172814 - DNA, 20 bp, Artificial Sequence
  chemically synthesized
atattgcgaatatttttgag

SEQ ID NO: 172815 - DNA, 20 bp, Artificial Sequence
  chemically synthesized
aatattgcgaatatttttga

SEQ ID NO: 172816 - DNA, 20 bp, Artificial Sequence
  chemically synthesized
ataatattgcgaatattttt

SEQ ID NO: 172817 - DNA, 20 bp, Artificial Sequence
  chemically synthesized
tattcgcaatattataaaac

SEQ ID NO: 172818 - DNA, 20 bp, Artificial Sequence
  chemically synthesized
ttcagtatgtttaacattgc

SEQ ID NO: 172819 - DNA, 20 bp, Artificial Sequence
  chemically synthesized
tctttttcaaatggtgagtt

SEQ ID NO: 172820 - DNA, 20 bp, Artificial Sequence
  chemically synthesized
ttccatctttttcaaatggt

SEQ ID NO: 172821 - DNA, 20 bp, Artificial Sequence
  chemically synthesized
actgaactcaccatttgaaa

SEQ ID NO: 172822 - DNA, 20 bp, Artificial Sequence
  chemically synthesized
tatcttccatctttttcaaa

SEQ ID NO: 172823 - DNA, 20 bp, Artificial Sequence
  chemically synthesized
aactcaccatttgaaaaaga

SEQ ID NO: 172824 - DNA, 20 bp, Artificial Sequence
  chemically synthesized
tcaccatttgaaaaagatgg

SEQ ID NO: 172825 - DNA, 20 bp, Artificial Sequence
  chemically synthesized
atttgaaaaagatggaagat

SEQ ID NO: 172826 - DNA, 20 bp, Artificial Sequence
  chemically synthesized
ggtgtggggatagtatggta

SEQ ID NO: 172827 - DNA, 20 bp, Artificial Sequence
  chemically synthesized
gctttggtgtggggatagta

SEQ ID NO: 172828 - DNA, 20 bp, Artificial Sequence
  chemically synthesized
tggctgctttggtgtgggga

SEQ ID NO: 172829 - DNA, 20 bp, Artificial Sequence
  chemically synthesized
accatactatccccacacca

SEQ ID NO: 172830 - DNA, 20 bp, Artificial Sequence
  chemically synthesized
aaaatggctgctttggtgtg

SEQ ID NO: 172831 - DNA, 20 bp, Artificial Sequence
  chemically synthesized
caaaatggctgctttggtgt

SEQ ID NO: 172832 - DNA, 20 bp, Artificial Sequence
  chemically synthesized
acaaaatggctgctttggtg

SEQ ID NO: 172833 - DNA, 20 bp, Artificial Sequence
  chemically synthesized
atactatccccacaccaaag

SEQ ID NO: 172834 - DNA, 20 bp, Artificial Sequence
  chemically synthesized
aaataacaaaatggctgctt

SEQ ID NO: 172835 - DNA, 20 bp, Artificial Sequence
  chemically synthesized
tatttcttaaaataacaaaa

SEQ ID NO: 172836 - DNA, 20 bp, Artificial Sequence
  chemically synthesized
agcagccattttgttatttt

SEQ ID NO: 172837 - DNA, 20 bp, Artificial Sequence
  chemically synthesized
tttgctttcagtattcacag

SEQ ID NO: 172838 - DNA, 20 bp, Artificial Sequence
  chemically synthesized
acatttgctttcagtattca

SEQ ID NO: 172839 - DNA, 20 bp, Artificial Sequence
  chemically synthesized
aattcttctgtgaatactga

SEQ ID NO: 172840 - DNA, 20 bp, Artificial Sequence
  chemically synthesized
tttatacccacatttgcttt

SEQ ID NO: 172841 - DNA, 20 bp, Artificial Sequence
  chemically synthesized
gtgaatactgaaagcaaatg

SEQ ID NO: 172842 - DNA, 20 bp, Artificial Sequence
  chemically synthesized
tgaatactgaaagcaaatgt

SEQ ID NO: 172843 - DNA, 20 bp, Artificial Sequence
  chemically synthesized
tacattttattgcataagca

SEQ ID NO: 172844 - DNA, 20 bp, Artificial Sequence
  chemically synthesized
tatacattttattgcataag

SEQ ID NO: 172845 - DNA, 20 bp, Artificial Sequence
  chemically synthesized
aagtatacattttattgcat

SEQ ID NO: 172846 - DNA, 20 bp, Artificial Sequence
  chemically synthesized
ttcatctgtaatgtaatttt

SEQ ID NO: 172847 - DNA, 20 bp, Artificial Sequence
  chemically synthesized
gtatacttaaaattacatta

SEQ ID NO: 172848 - DNA, 20 bp, Artificial Sequence
  chemically synthesized
ttaaaattacattacagatg

SEQ ID NO: 172849 - DNA, 20 bp, Artificial Sequence
  chemically synthesized
tacagatgaagaatcataca

SEQ ID NO: 172850 - DNA, 20 bp, Artificial Sequence
  chemically synthesized
gtcaaaatacagcaaaggta

SEQ ID NO: 172851 - DNA, 20 bp, Artificial Sequence
  chemically synthesized
atgtcaaaatacagcaaagg

SEQ ID NO: 172852 - DNA, 20 bp, Artificial Sequence
  chemically synthesized
gaaatgtcaaaatacagcaa

SEQ ID NO: 172853 - DNA, 20 bp, Artificial Sequence
  chemically synthesized
agaaatgtcaaaatacagca

SEQ ID NO: 172854 - DNA, 20 bp, Artificial Sequence
  chemically synthesized
caaacagaaatgtcaaaata

SEQ ID NO: 172855 - DNA, 20 bp, Artificial Sequence
  chemically synthesized
taaaaagcttttattgcaaa

SEQ ID NO: 172856 - DNA, 20 bp, Artificial Sequence
  chemically synthesized
gacatttctgtttgcaataa

SEQ ID NO: 172857 - DNA, 20 bp, Artificial Sequence
  chemically synthesized
ttgcaataaaagctttttaa

SEQ ID NO: 172858 - DNA, 20 bp, Artificial Sequence
  chemically synthesized
gcaataaaagctttttaata

SEQ ID NO: 172859 - DNA, 20 bp, Artificial Sequence
  chemically synthesized
agagctgtgcctctattaaa

SEQ ID NO: 172860 - DNA, 20 bp, Artificial Sequence
  chemically synthesized
caataaaagctttttaatag

SEQ ID NO: 172861 - DNA, 20 bp, Artificial Sequence
  chemically synthesized
aaagctttttaatagaggca

SEQ ID NO: 172862 - DNA, 20 bp, Artificial Sequence
  chemically synthesized
atccttactatattcatgaa

SEQ ID NO: 172863 - DNA, 20 bp, Artificial Sequence
  chemically synthesized
aaatccttactatattcatg

SEQ ID NO: 172864 - DNA, 20 bp, Artificial Sequence
  chemically synthesized
ggcacagctcttcatgaata

SEQ ID NO: 172865 - DNA, 20 bp, Artificial Sequence
  chemically synthesized
cagctcttcatgaatatagt

SEQ ID NO: 172866 - DNA, 20 bp, Artificial Sequence
  chemically synthesized
agctcttcatgaatatagta

SEQ ID NO: 172867 - DNA, 20 bp, Artificial Sequence
  chemically synthesized
catgaatatagtaaggattt

SEQ ID NO: 172868 - DNA, 20 bp, Artificial Sequence
  chemically synthesized
atagtaaggattttagttac

SEQ ID NO: 172869 - DNA, 20 bp, Artificial Sequence
  chemically synthesized
tagtaaggattttagttact

SEQ ID NO: 172870 - DNA, 20 bp, Artificial Sequence
  chemically synthesized
gattttagttactaggaaat

SEQ ID NO: 172871 - DNA, 20 bp, Artificial Sequence
  chemically synthesized
taatgttctttcttatttcc

SEQ ID NO: 172872 - DNA, 20 bp, Artificial Sequence
  chemically synthesized
ttagttactaggaaataaga

SEQ ID NO: 172873 - DNA, 20 bp, Artificial Sequence
  chemically synthesized
aagaacattacttcaatatt

SEQ ID NO: 172874 - DNA, 20 bp, Artificial Sequence
  chemically synthesized
atgttaagaactcaatattg

SEQ ID NO: 172875 - DNA, 20 bp, Artificial Sequence
  chemically synthesized
tttatgctctcatttatgtt

SEQ ID NO: 172876 - DNA, 20 bp, Artificial Sequence
  chemically synthesized
attgagttcttaacataaat

SEQ ID NO: 172877 - DNA, 20 bp, Artificial Sequence
  chemically synthesized
tgagttcttaacataaatga

SEQ ID NO: 172878 - DNA, 20 bp, Artificial Sequence
  chemically synthesized
agagcataaaaattacgtca

SEQ ID NO: 172879 - DNA, 20 bp, Artificial Sequence
  chemically synthesized
aattacgtcaaagatatctt

SEQ ID NO: 172880 - DNA, 20 bp, Artificial Sequence
  chemically synthesized
atatttcctagtaaaatcta

SEQ ID NO: 172881 - DNA, 20 bp, Artificial Sequence
  chemically synthesized
aagatatctttagattttac

SEQ ID NO: 172882 - DNA, 20 bp, Artificial Sequence
  chemically synthesized
agatatctttagattttact

SEQ ID NO: 172883 - DNA, 20 bp, Artificial Sequence
  chemically synthesized
gtattgtggcaaatatttcc

SEQ ID NO: 172884 - DNA, 20 bp, Artificial Sequence
  chemically synthesized
ttattttttcaaaagtattg

SEQ ID NO: 172885 - DNA, 20 bp, Artificial Sequence
  chemically synthesized
aattcctattattttttcaa

SEQ ID NO: 172886 - DNA, 20 bp, Artificial Sequence
  chemically synthesized
caatacttttgaaaaaataa

SEQ ID NO: 172887 - DNA, 20 bp, Artificial Sequence
  chemically synthesized
aatacttttgaaaaaataat

SEQ ID NO: 172888 - DNA, 20 bp, Artificial Sequence
  chemically synthesized
aaaaaataataggaatttta

SEQ ID NO: 172889 - DNA, 20 bp, Artificial Sequence
  chemically synthesized
aactctcatattttcatata

SEQ ID NO: 172890 - DNA, 20 bp, Artificial Sequence
  chemically synthesized
aacaccatatatgaaaatat

SEQ ID NO: 172891 - DNA, 20 bp, Artificial Sequence
  chemically synthesized
caccatatatgaaaatatga

SEQ ID NO: 172892 - DNA, 20 bp, Artificial Sequence
  chemically synthesized
gaaaatatgagagtttaaat

SEQ ID NO: 172893 - DNA, 20 bp, Artificial Sequence
  chemically synthesized
atgagagtttaaatcagcat

SEQ ID NO: 172894 - DNA, 20 bp, Artificial Sequence
  chemically synthesized
agagtttaaatcagcatgag

SEQ ID NO: 172895 - DNA, 20 bp, Artificial Sequence
  chemically synthesized
atgtatttagttttaatgca

SEQ ID NO: 172896 - DNA, 20 bp, Artificial Sequence
  chemically synthesized
acagatgattcatatgtatt

SEQ ID NO: 172897 - DNA, 20 bp, Artificial Sequence
  chemically synthesized
acatatgaatcatctgtatt

SEQ ID NO: 172898 - DNA, 20 bp, Artificial Sequence
  chemically synthesized
catatgaatcatctgtattt

SEQ ID NO: 172899 - DNA, 20 bp, Artificial Sequence
  chemically synthesized
tatgaatcatctgtatttgg

SEQ ID NO: 172900 - DNA, 20 bp, Artificial Sequence
  chemically synthesized
accactgaggctcccaaata

SEQ ID NO: 172901 - DNA, 20 bp, Artificial Sequence
  chemically synthesized
tcatctgtatttgggagcct

SEQ ID NO: 172902 - DNA, 20 bp, Artificial Sequence
  chemically synthesized
tctgtatttgggagcctcag

SEQ ID NO: 172903 - DNA, 20 bp, Artificial Sequence
  chemically synthesized
gtataaggctgcaaccactg

SEQ ID NO: 172904 - DNA, 20 bp, Artificial Sequence
  chemically synthesized
agtataaggctgcaaccact

SEQ ID NO: 172905 - DNA, 20 bp, Artificial Sequence
  chemically synthesized
tttgggagcctcagtggttg

SEQ ID NO: 172906 - DNA, 20 bp, Artificial Sequence
  chemically synthesized
tttctctaagagatagtata

SEQ ID NO: 172907 - DNA, 20 bp, Artificial Sequence
  chemically synthesized
ttttctctaagagatagtat

SEQ ID NO: 172908 - DNA, 20 bp, Artificial Sequence
  chemically synthesized
tgcagccttatactatctct

SEQ ID NO: 172909 - DNA, 20 bp, Artificial Sequence
  chemically synthesized
cagccttatactatctctta

SEQ ID NO: 172910 - DNA, 20 bp, Artificial Sequence
  chemically synthesized
aaatatttttctctaagaga

SEQ ID NO: 172911 - DNA, 20 bp, Artificial Sequence
  chemically synthesized
tatgaaatatttttctctaa

SEQ ID NO: 172912 - DNA, 20 bp, Artificial Sequence
  chemically synthesized
attatgaaatatttttctct

SEQ ID NO: 172913 - DNA, 20 bp, Artificial Sequence
  chemically synthesized
taatacatacatgattggaa

SEQ ID NO: 172914 - DNA, 20 bp, Artificial Sequence
  chemically synthesized
aactttaatacatacatgat

SEQ ID NO: 172915 - DNA, 20 bp, Artificial Sequence
  chemically synthesized
ttccaatcatgtatgtatta

SEQ ID NO: 172916 - DNA, 20 bp, Artificial Sequence
  chemically synthesized
tattaaagtttatgacaaca

SEQ ID NO: 172917 - DNA, 20 bp, Artificial Sequence
  chemically synthesized
aagtacatggggttggggga

SEQ ID NO: 172918 - DNA, 20 bp, Artificial Sequence
  chemically synthesized
caaaaagtacatggggttgg

SEQ ID NO: 172919 - DNA, 20 bp, Artificial Sequence
  chemically synthesized
tcaaaaagtacatggggttg

SEQ ID NO: 172920 - DNA, 20 bp, Artificial Sequence
  chemically synthesized
ttcaaaaagtacatggggtt

SEQ ID NO: 172921 - DNA, 20 bp, Artificial Sequence
  chemically synthesized
tttcaaaaagtacatggggt

SEQ ID NO: 172922 - DNA, 20 bp, Artificial Sequence
  chemically synthesized
catatttcaaaaagtacatg

SEQ ID NO: 172923 - DNA, 20 bp, Artificial Sequence
  chemically synthesized
tcatatttcaaaaagtacat

SEQ ID NO: 172924 - DNA, 20 bp, Artificial Sequence
  chemically synthesized
ttcatatttcaaaaagtaca

SEQ ID NO: 172925 - DNA, 20 bp, Artificial Sequence
  chemically synthesized
ttattccttcatatttcaaa

SEQ ID NO: 172926 - DNA, 20 bp, Artificial Sequence
  chemically synthesized
catgtactttttgaaatatg

SEQ ID NO: 172927 - DNA, 20 bp, Artificial Sequence
  chemically synthesized
atgtactttttgaaatatga

SEQ ID NO: 172928 - DNA, 20 bp, Artificial Sequence
  chemically synthesized
gttaagtgtagtaatatatt

SEQ ID NO: 172929 - DNA, 20 bp, Artificial Sequence
  chemically synthesized
taatatattactacacttaa

SEQ ID NO: 172930 - DNA, 20 bp, Artificial Sequence
  chemically synthesized
ttgtcataatctgttaagtg

SEQ ID NO: 172931 - DNA, 20 bp, Artificial Sequence
  chemically synthesized
agtatttgtcataatctgtt

SEQ ID NO: 172932 - DNA, 20 bp, Artificial Sequence
  chemically synthesized
atttttttgtataattagag

SEQ ID NO: 172933 - DNA, 20 bp, Artificial Sequence
  chemically synthesized
ctaatttttttgtataatta

SEQ ID NO: 172934 - DNA, 20 bp, Artificial Sequence
  chemically synthesized
acctaatttttttgtataat

SEQ ID NO: 172935 - DNA, 20 bp, Artificial Sequence
  chemically synthesized
ctctaattatacaaaaaaat

SEQ ID NO: 172936 - DNA, 20 bp, Artificial Sequence
  chemically synthesized
tctaattatacaaaaaaatt

SEQ ID NO: 172937 - DNA, 20 bp, Artificial Sequence
  chemically synthesized
ttatacaaaaaaattaggtt

SEQ ID NO: 172938 - DNA, 20 bp, Artificial Sequence
  chemically synthesized
atacaaaaaaattaggtttg

SEQ ID NO: 172939 - DNA, 20 bp, Artificial Sequence
  chemically synthesized
aaattaggtttggagaatcc

SEQ ID NO: 172940 - DNA, 20 bp, Artificial Sequence
  chemically synthesized
attaggtttggagaatccca

SEQ ID NO: 172941 - DNA, 20 bp, Artificial Sequence
  chemically synthesized
tttggagaatcccagagtat

SEQ ID NO: 172942 - DNA, 20 bp, Artificial Sequence
  chemically synthesized
gaaaatgcagctaatactct

SEQ ID NO: 172943 - DNA, 20 bp, Artificial Sequence
  chemically synthesized
tgaaaatgcagctaatactc

SEQ ID NO: 172944 - DNA, 20 bp, Artificial Sequence
  chemically synthesized
cctgctggcatttgaaaatg

SEQ ID NO: 172945 - DNA, 20 bp, Artificial Sequence
  chemically synthesized
ttagctgcattttcaaatgc

SEQ ID NO: 172946 - DNA, 20 bp, Artificial Sequence
  chemically synthesized
gctgcattttcaaatgccag

SEQ ID NO: 172947 - DNA, 20 bp, Artificial Sequence
  chemically synthesized
ctgcattttcaaatgccagc

SEQ ID NO: 172948 - DNA, 20 bp, Artificial Sequence
  chemically synthesized
ttttcaaatgccagcaggtg

SEQ ID NO: 172949 - DNA, 20 bp, Artificial Sequence
  chemically synthesized
gattatttcccttcacctgc

SEQ ID NO: 172950 - DNA, 20 bp, Artificial Sequence
  chemically synthesized
tttcaaatgccagcaggtga

SEQ ID NO: 172951 - DNA, 20 bp, Artificial Sequence
  chemically synthesized
ttcaaatgccagcaggtgaa

SEQ ID NO: 172952 - DNA, 20 bp, Artificial Sequence
  chemically synthesized
aggtgaagggaaataatccg

SEQ ID NO: 172953 - DNA, 20 bp, Artificial Sequence
  chemically synthesized
tgaagggaaataatccgtgg

SEQ ID NO: 172954 - DNA, 20 bp, Artificial Sequence
  chemically synthesized
gaagggaaataatccgtggt

SEQ ID NO: 172955 - DNA, 20 bp, Artificial Sequence
  chemically synthesized
gggaaataatccgtggtggg

SEQ ID NO: 172956 - DNA, 20 bp, Artificial Sequence
  chemically synthesized
attttagagtcttcccacca

SEQ ID NO: 172957 - DNA, 20 bp, Artificial Sequence
  chemically synthesized
gtggtgggaagactctaaaa

SEQ ID NO: 172958 - DNA, 20 bp, Artificial Sequence
  chemically synthesized
gatcactgagtgccatttta

SEQ ID NO: 172959 - DNA, 20 bp, Artificial Sequence
  chemically synthesized
gagatcactgagtgccattt

SEQ ID NO: 172960 - DNA, 20 bp, Artificial Sequence
  chemically synthesized
gaagactctaaaatggcact

SEQ ID NO: 172961 - DNA, 20 bp, Artificial Sequence
  chemically synthesized
actaggagacagagatcact

SEQ ID NO: 172962 - DNA, 20 bp, Artificial Sequence
  chemically synthesized
actcagtgatctctgtctcc

SEQ ID NO: 172963 - DNA, 20 bp, Artificial Sequence
  chemically synthesized
gactcaaatactaggagaca

SEQ ID NO: 172964 - DNA, 20 bp, Artificial Sequence
  chemically synthesized
aggactcaaatactaggaga

SEQ ID NO: 172965 - DNA, 20 bp, Artificial Sequence
  chemically synthesized
ttaaaggactcaaatactag

SEQ ID NO: 172966 - DNA, 20 bp, Artificial Sequence
  chemically synthesized
atctctgtctcctagtattt

SEQ ID NO: 172967 - DNA, 20 bp, Artificial Sequence
  chemically synthesized
tattaaaggactcaaatact

SEQ ID NO: 172968 - DNA, 20 bp, Artificial Sequence
  chemically synthesized
ttattaaaggactcaaatac

SEQ ID NO: 172969 - DNA, 20 bp, Artificial Sequence
  chemically synthesized
caaggggaggaaattattaa

SEQ ID NO: 172970 - DNA, 20 bp, Artificial Sequence
  chemically synthesized
tcaaggggaggaaattatta

SEQ ID NO: 172971 - DNA, 20 bp, Artificial Sequence
  chemically synthesized
tttaataatttcctcccctt

SEQ ID NO: 172972 - DNA, 20 bp, Artificial Sequence
  chemically synthesized
tcttgaccactctcaagggg

SEQ ID NO: 172973 - DNA, 20 bp, Artificial Sequence
  chemically synthesized
taataatttcctccccttga

SEQ ID NO: 172974 - DNA, 20 bp, Artificial Sequence
  chemically synthesized
gtcttgaccactctcaaggg

SEQ ID NO: 172975 - DNA, 20 bp, Artificial Sequence
  chemically synthesized
aagtcttgaccactctcaag

SEQ ID NO: 172976 - DNA, 20 bp, Artificial Sequence
  chemically synthesized
taatttcctccccttgagag

SEQ ID NO: 172977 - DNA, 20 bp, Artificial Sequence
  chemically synthesized
aaagtcttgaccactctcaa

SEQ ID NO: 172978 - DNA, 20 bp, Artificial Sequence
  chemically synthesized
aaaagtcttgaccactctca

SEQ ID NO: 172979 - DNA, 20 bp, Artificial Sequence
  chemically synthesized
caaaagtcttgaccactctc

SEQ ID NO: 172980 - DNA, 20 bp, Artificial Sequence
  chemically synthesized
tcctccccttgagagtggtc

SEQ ID NO: 172981 - DNA, 20 bp, Artificial Sequence
  chemically synthesized
gcttgtcagaagcaagtcaa

SEQ ID NO: 172982 - DNA, 20 bp, Artificial Sequence
  chemically synthesized
atattctgcttgtcagaagc

SEQ ID NO: 172983 - DNA, 20 bp, Artificial Sequence
  chemically synthesized
acttttgacttgcttctgac

SEQ ID NO: 172984 - DNA, 20 bp, Artificial Sequence
  chemically synthesized
tgacatattctgcttgtcag

SEQ ID NO: 172985 - DNA, 20 bp, Artificial Sequence
  chemically synthesized
tttgacttgcttctgacaag

SEQ ID NO: 172986 - DNA, 20 bp, Artificial Sequence
  chemically synthesized
ctttgacatattctgcttgt

SEQ ID NO: 172987 - DNA, 20 bp, Artificial Sequence
  chemically synthesized
ctgacaagcagaatatgtca

SEQ ID NO: 172988 - DNA, 20 bp, Artificial Sequence
  chemically synthesized
gcagaatatgtcaaagacaa

SEQ ID NO: 172989 - DNA, 20 bp, Artificial Sequence
  chemically synthesized
cagaatatgtcaaagacaaa

SEQ ID NO: 172990 - DNA, 20 bp, Artificial Sequence
  chemically synthesized
aaggatatcacttctccaat

SEQ ID NO: 172991 - DNA, 20 bp, Artificial Sequence
  chemically synthesized
cttatgtagcctaattggag

SEQ ID NO: 172992 - DNA, 20 bp, Artificial Sequence
  chemically synthesized
aggatatcacttctccaatt

SEQ ID NO: 172993 - DNA, 20 bp, Artificial Sequence
  chemically synthesized
aatcttatgtagcctaattg

SEQ ID NO: 172994 - DNA, 20 bp, Artificial Sequence
  chemically synthesized
ccaatcttatgtagcctaat

SEQ ID NO: 172995 - DNA, 20 bp, Artificial Sequence
  chemically synthesized
cttctccaattaggctacat

SEQ ID NO: 172996 - DNA, 20 bp, Artificial Sequence
  chemically synthesized
acaaaagtcccaatcttatg

SEQ ID NO: 172997 - DNA, 20 bp, Artificial Sequence
  chemically synthesized
ccaattaggctacataagat

SEQ ID NO: 172998 - DNA, 20 bp, Artificial Sequence
  chemically synthesized
caattaggctacataagatt

SEQ ID NO: 172999 - DNA, 20 bp, Artificial Sequence
  chemically synthesized
tgaaattgctagcaagacaa

SEQ ID NO: 173000 - DNA, 20 bp, Artificial Sequence
  chemically synthesized
gattgggacttttgtcttgc

SEQ ID NO: 173001 - DNA, 20 bp, Artificial Sequence
  chemically synthesized
gaaagagtgaaattgctagc

SEQ ID NO: 173002 - DNA, 20 bp, Artificial Sequence
  chemically synthesized
cagagaaagagtgaaattgc

SEQ ID NO: 173003 - DNA, 20 bp, Artificial Sequence
  chemically synthesized
gggggaaagagacagagaaa

SEQ ID NO: 173004 - DNA, 20 bp, Artificial Sequence
  chemically synthesized
aggggggaaagagacagaga

SEQ ID NO: 173005 - DNA, 20 bp, Artificial Sequence
  chemically synthesized
ggggaggggggaaagagaca

SEQ ID NO: 173006 - DNA, 20 bp, Artificial Sequence
  chemically synthesized
tgggggaggggggaaagaga

SEQ ID NO: 173007 - DNA, 20 bp, Artificial Sequence
  chemically synthesized
aaagtgggggaggggggaaa

SEQ ID NO: 173008 - DNA, 20 bp, Artificial Sequence
  chemically synthesized
agaaagtgggggagggggga

SEQ ID NO: 173009 - DNA, 20 bp, Artificial Sequence
  chemically synthesized
tgagagaaagtgggggaggg

SEQ ID NO: 173010 - DNA, 20 bp, Artificial Sequence
  chemically synthesized
gtgagagaaagtgggggagg

SEQ ID NO: 173011 - DNA, 20 bp, Artificial Sequence
  chemically synthesized
agtgagagaaagtgggggag

SEQ ID NO: 173012 - DNA, 20 bp, Artificial Sequence
  chemically synthesized
cagtgagagaaagtggggga

SEQ ID NO: 173013 - DNA, 20 bp, Artificial Sequence
  chemically synthesized
tcagtgagagaaagtggggg

SEQ ID NO: 173014 - DNA, 20 bp, Artificial Sequence
  chemically synthesized
atcagtgagagaaagtgggg

SEQ ID NO: 173015 - DNA, 20 bp, Artificial Sequence
  chemically synthesized
aaatcagtgagagaaagtgg

SEQ ID NO: 173016 - DNA, 20 bp, Artificial Sequence
  chemically synthesized
aaaatcagtgagagaaagtg

SEQ ID NO: 173017 - DNA, 20 bp, Artificial Sequence
  chemically synthesized
caaaatcagtgagagaaagt

SEQ ID NO: 173018 - DNA, 20 bp, Artificial Sequence
  chemically synthesized
tcaaaatcagtgagagaaag

SEQ ID NO: 173019 - DNA, 20 bp, Artificial Sequence
  chemically synthesized
tcatcaaaatcagtgagaga

SEQ ID NO: 173020 - DNA, 20 bp, Artificial Sequence
  chemically synthesized
tgcctcatcaaaatcagtga

SEQ ID NO: 173021 - DNA, 20 bp, Artificial Sequence
  chemically synthesized
tttgcctcatcaaaatcagt

SEQ ID NO: 173022 - DNA, 20 bp, Artificial Sequence
  chemically synthesized
gcaatttgcctcatcaaaat

SEQ ID NO: 173023 - DNA, 20 bp, Artificial Sequence
  chemically synthesized
tttctctcactgattttgat

SEQ ID NO: 173024 - DNA, 20 bp, Artificial Sequence
  chemically synthesized
ttctctcactgattttgatg

SEQ ID NO: 173025 - DNA, 20 bp, Artificial Sequence
  chemically synthesized
gatgaggcaaattgccatgt

SEQ ID NO: 173026 - DNA, 20 bp, Artificial Sequence
  chemically synthesized
tgaggcaaattgccatgtta

SEQ ID NO: 173027 - DNA, 20 bp, Artificial Sequence
  chemically synthesized
agttccttcggtctctaaca

SEQ ID NO: 173028 - DNA, 20 bp, Artificial Sequence
  chemically synthesized
aattgccatgttagagaccg

SEQ ID NO: 173029 - DNA, 20 bp, Artificial Sequence
  chemically synthesized
attgccatgttagagaccga

SEQ ID NO: 173030 - DNA, 20 bp, Artificial Sequence
  chemically synthesized
atggccacgtttagttcctt

SEQ ID NO: 173031 - DNA, 20 bp, Artificial Sequence
  chemically synthesized
gagaccgaaggaactaaacg

SEQ ID NO: 173032 - DNA, 20 bp, Artificial Sequence
  chemically synthesized
tgttggctgatggccacgtt

SEQ ID NO: 173033 - DNA, 20 bp, Artificial Sequence
  chemically synthesized
aaggaactaaacgtggccat

SEQ ID NO: 173034 - DNA, 20 bp, Artificial Sequence
  chemically synthesized
ttccttttcttgttggctga

SEQ ID NO: 173035 - DNA, 20 bp, Artificial Sequence
  chemically synthesized
aaacgtggccatcagccaac

SEQ ID NO: 173036 - DNA, 20 bp, Artificial Sequence
  chemically synthesized
tggccatcagccaacaagaa

SEQ ID NO: 173037 - DNA, 20 bp, Artificial Sequence
  chemically synthesized
tgtagtcttccttttcttgt

SEQ ID NO: 173038 - DNA, 20 bp, Artificial Sequence
  chemically synthesized
ggccatcagccaacaagaaa

SEQ ID NO: 173039 - DNA, 20 bp, Artificial Sequence
  chemically synthesized
catcagccaacaagaaaagg

SEQ ID NO: 173040 - DNA, 20 bp, Artificial Sequence
  chemically synthesized
caacaagaaaaggaagacta

SEQ ID NO: 173041 - DNA, 20 bp, Artificial Sequence
  chemically synthesized
ccatgtgggttattggactg

SEQ ID NO: 173042 - DNA, 20 bp, Artificial Sequence
  chemically synthesized
ttcagttccatgtgggttat

SEQ ID NO: 173043 - DNA, 20 bp, Artificial Sequence
  chemically synthesized
ctacagtccaataacccaca

SEQ ID NO: 173044 - DNA, 20 bp, Artificial Sequence
  chemically synthesized
ggtaagtttcagttccatgt

SEQ ID NO: 173045 - DNA, 20 bp, Artificial Sequence
  chemically synthesized
tggtaagtttcagttccatg

SEQ ID NO: 173046 - DNA, 20 bp, Artificial Sequence
  chemically synthesized
cacctgttgttggtaagttt

SEQ ID NO: 173047 - DNA, 20 bp, Artificial Sequence
  chemically synthesized
caaactcacctgttgttggt

SEQ ID NO: 173048 - DNA, 20 bp, Artificial Sequence
  chemically synthesized
gaactgaaacttaccaacaa

SEQ ID NO: 173049 - DNA, 20 bp, Artificial Sequence
  chemically synthesized
aactgaaacttaccaacaac

SEQ ID NO: 173050 - DNA, 20 bp, Artificial Sequence
  chemically synthesized
cttccaaactcacctgttgt

SEQ ID NO: 173051 - DNA, 20 bp, Artificial Sequence
  chemically synthesized
gaaacttaccaacaacaggt

SEQ ID NO: 173052 - DNA, 20 bp, Artificial Sequence
  chemically synthesized
ttaccaacaacaggtgagtt

SEQ ID NO: 173053 - DNA, 20 bp, Artificial Sequence
  chemically synthesized
ccaacaacaggtgagtttgg

SEQ ID NO: 173054 - DNA, 20 bp, Artificial Sequence
  chemically synthesized
acaacaggtgagtttggaag

SEQ ID NO: 173055 - DNA, 20 bp, Artificial Sequence
  chemically synthesized
caacaggtgagtttggaagc

SEQ ID NO: 173056 - DNA, 20 bp, Artificial Sequence
  chemically synthesized
gtttggaagcaggtccttcc

SEQ ID NO: 173057 - DNA, 20 bp, Artificial Sequence
  chemically synthesized
tttggaagcaggtccttcca

SEQ ID NO: 173058 - DNA, 20 bp, Artificial Sequence
  chemically synthesized
atttgaaagcttgccttgga

SEQ ID NO: 173059 - DNA, 20 bp, Artificial Sequence
  chemically synthesized
gaagcaggtccttccaaggc

SEQ ID NO: 173060 - DNA, 20 bp, Artificial Sequence
  chemically synthesized
catttgaaagcttgccttgg

SEQ ID NO: 173061 - DNA, 20 bp, Artificial Sequence
  chemically synthesized
tctcatttgaaagcttgcct

SEQ ID NO: 173062 - DNA, 20 bp, Artificial Sequence
  chemically synthesized
tccaaggcaagctttcaaat

SEQ ID NO: 173063 - DNA, 20 bp, Artificial Sequence
  chemically synthesized
agggctagggtctcatttga

SEQ ID NO: 173064 - DNA, 20 bp, Artificial Sequence
  chemically synthesized
caagctttcaaatgagaccc

SEQ ID NO: 173065 - DNA, 20 bp, Artificial Sequence
  chemically synthesized
ttcaaatgagaccctagccc

SEQ ID NO: 173066 - DNA, 20 bp, Artificial Sequence
  chemically synthesized
ctaggtgttggccagggcta

SEQ ID NO: 173067 - DNA, 20 bp, Artificial Sequence
  chemically synthesized
actaggtgttggccagggct

SEQ ID NO: 173068 - DNA, 20 bp, Artificial Sequence
  chemically synthesized
cactaggtgttggccagggc

SEQ ID NO: 173069 - DNA, 20 bp, Artificial Sequence
  chemically synthesized
tgcacactaggtgttggcca

SEQ ID NO: 173070 - DNA, 20 bp, Artificial Sequence
  chemically synthesized
ctgcacactaggtgttggcc

SEQ ID NO: 173071 - DNA, 20 bp, Artificial Sequence
  chemically synthesized
gctgcacactaggtgttggc

SEQ ID NO: 173072 - DNA, 20 bp, Artificial Sequence
  chemically synthesized
ccctagccctggccaacacc

SEQ ID NO: 173073 - DNA, 20 bp, Artificial Sequence
  chemically synthesized
aaaggctgcacactaggtgt

SEQ ID NO: 173074 - DNA, 20 bp, Artificial Sequence
  chemically synthesized
cctggccaacacctagtgtg

SEQ ID NO: 173075 - DNA, 20 bp, Artificial Sequence
  chemically synthesized
tctcacaaaggctgcacact

SEQ ID NO: 173076 - DNA, 20 bp, Artificial Sequence
  chemically synthesized
ctctcacaaaggctgcacac

SEQ ID NO: 173077 - DNA, 20 bp, Artificial Sequence
  chemically synthesized
acctagtgtgcagcctttgt

SEQ ID NO: 173078 - DNA, 20 bp, Artificial Sequence
  chemically synthesized
ctagtgtgcagcctttgtga

SEQ ID NO: 173079 - DNA, 20 bp, Artificial Sequence
  chemically synthesized
tgcttcggggtctctcacaa

SEQ ID NO: 173080 - DNA, 20 bp, Artificial Sequence
  chemically synthesized
ttgcttcggggtctctcaca

SEQ ID NO: 173081 - DNA, 20 bp, Artificial Sequence
  chemically synthesized
agcctttgtgagagaccccg

SEQ ID NO: 173082 - DNA, 20 bp, Artificial Sequence
  chemically synthesized
ttgtgagagaccccgaagca

SEQ ID NO: 173083 - DNA, 20 bp, Artificial Sequence
  chemically synthesized
tatccatattctttgcttcg

SEQ ID NO: 173084 - DNA, 20 bp, Artificial Sequence
  chemically synthesized
ttatccatattctttgcttc

SEQ ID NO: 173085 - DNA, 20 bp, Artificial Sequence
  chemically synthesized
attatccatattctttgctt

SEQ ID NO: 173086 - DNA, 20 bp, Artificial Sequence
  chemically synthesized
agaccccgaagcaaagaata

SEQ ID NO: 173087 - DNA, 20 bp, Artificial Sequence
  chemically synthesized
gaatatggataatctatgcc

SEQ ID NO: 173088 - DNA, 20 bp, Artificial Sequence
  chemically synthesized
atgggtcagaagtctaggca

SEQ ID NO: 173089 - DNA, 20 bp, Artificial Sequence
  chemically synthesized
tacatatgggtcagaagtct

SEQ ID NO: 173090 - DNA, 20 bp, Artificial Sequence
  chemically synthesized
atacatatgggtcagaagtc

SEQ ID NO: 173091 - DNA, 20 bp, Artificial Sequence
  chemically synthesized
tcaggatacatatgggtcag

SEQ ID NO: 173092 - DNA, 20 bp, Artificial Sequence
  chemically synthesized
gtatcaggatacatatgggt

SEQ ID NO: 173093 - DNA, 20 bp, Artificial Sequence
  chemically synthesized
tagagtatcaggatacatat

SEQ ID NO: 173094 - DNA, 20 bp, Artificial Sequence
  chemically synthesized
ttagagtatcaggatacata

SEQ ID NO: 173095 - DNA, 20 bp, Artificial Sequence
  chemically synthesized
aactgtatctttagagtatc

SEQ ID NO: 173096 - DNA, 20 bp, Artificial Sequence
  chemically synthesized
aaactgtatctttagagtat

SEQ ID NO: 173097 - DNA, 20 bp, Artificial Sequence
  chemically synthesized
atatgtatcctgatactcta

SEQ ID NO: 173098 - DNA, 20 bp, Artificial Sequence
  chemically synthesized
ggcttaaaactgtatcttta

SEQ ID NO: 173099 - DNA, 20 bp, Artificial Sequence
  chemically synthesized
atcctgatactctaaagata

SEQ ID NO: 173100 - DNA, 20 bp, Artificial Sequence
  chemically synthesized
ggggcttaaaactgtatctt

SEQ ID NO: 173101 - DNA, 20 bp, Artificial Sequence
  chemically synthesized
tactctaaagatacagtttt

SEQ ID NO: 173102 - DNA, 20 bp, Artificial Sequence
  chemically synthesized
aacaattactacaaagatag

SEQ ID NO: 173103 - DNA, 20 bp, Artificial Sequence
  chemically synthesized
taacaattactacaaagata

SEQ ID NO: 173104 - DNA, 20 bp, Artificial Sequence
  chemically synthesized
gttttaagcccctatctttg

SEQ ID NO: 173105 - DNA, 20 bp, Artificial Sequence
  chemically synthesized
ataacaattactacaaagat

SEQ ID NO: 173106 - DNA, 20 bp, Artificial Sequence
  chemically synthesized
cataacaattactacaaaga

SEQ ID NO: 173107 - DNA, 20 bp, Artificial Sequence
  chemically synthesized
gctgcataacaattactaca

SEQ ID NO: 173108 - DNA, 20 bp, Artificial Sequence
  chemically synthesized
tctttgtagtaattgttatg

SEQ ID NO: 173109 - DNA, 20 bp, Artificial Sequence
  chemically synthesized
tagtaattgttatgcagcaa

SEQ ID NO: 173110 - DNA, 20 bp, Artificial Sequence
  chemically synthesized
aagattataatattatgtat

SEQ ID NO: 173111 - DNA, 20 bp, Artificial Sequence
  chemically synthesized
cataatattataatcttttt

SEQ ID NO: 173112 - DNA, 20 bp, Artificial Sequence
  chemically synthesized
tactatatttgtttcttaaa

SEQ ID NO: 173113 - DNA, 20 bp, Artificial Sequence
  chemically synthesized
atctttttaagaaacaaata

SEQ ID NO: 173114 - DNA, 20 bp, Artificial Sequence
  chemically synthesized
gtaacataaaaattaaataa

SEQ ID NO: 173115 - DNA, 20 bp, Artificial Sequence
  chemically synthesized
ataaaaattaaataatggtg

SEQ ID NO: 173116 - DNA, 20 bp, Artificial Sequence
  chemically synthesized
attaaataatggtgaagttg

SEQ ID NO: 173117 - DNA, 20 bp, Artificial Sequence
  chemically synthesized
ttaaataatggtgaagttgt

SEQ ID NO: 173118 - DNA, 20 bp, Artificial Sequence
  chemically synthesized
taaataatggtgaagttgta

SEQ ID NO: 173119 - DNA, 20 bp, Artificial Sequence
  chemically synthesized
tggtgaagttgtagggtttt

SEQ ID NO: 173120 - DNA, 20 bp, Artificial Sequence
  chemically synthesized
aagttgtagggttttcagta

SEQ ID NO: 173121 - DNA, 20 bp, Artificial Sequence
  chemically synthesized
agttgtagggttttcagtat

SEQ ID NO: 173122 - DNA, 20 bp, Artificial Sequence
  chemically synthesized
ttgtagggttttcagtatag

SEQ ID NO: 173123 - DNA, 20 bp, Artificial Sequence
  chemically synthesized
tataggagtattgcaaatat

SEQ ID NO: 173124 - DNA, 20 bp, Artificial Sequence
  chemically synthesized
gagtattgcaaatataagaa

SEQ ID NO: 173125 - DNA, 20 bp, Artificial Sequence
  chemically synthesized
ttcagtaactcgttaaaata

SEQ ID NO: 173126 - DNA, 20 bp, Artificial Sequence
  chemically synthesized
agaacggaccatattttaac

SEQ ID NO: 173127 - DNA, 20 bp, Artificial Sequence
  chemically synthesized
tttaacgagttactgaaaaa

SEQ ID NO: 173128 - DNA, 20 bp, Artificial Sequence
  chemically synthesized
taaaattcgccactattttt

SEQ ID NO: 173129 - DNA, 20 bp, Artificial Sequence
  chemically synthesized
aacgagttactgaaaaatag

SEQ ID NO: 173130 - DNA, 20 bp, Artificial Sequence
  chemically synthesized
aaaaatagtggcgaatttta

SEQ ID NO: 173131 - DNA, 20 bp, Artificial Sequence
  chemically synthesized
gaattttaaagtttcaatgt

SEQ ID NO: 173132 - DNA, 20 bp, Artificial Sequence
  chemically synthesized
tttaaagtttcaatgtcaga

SEQ ID NO: 173133 - DNA, 20 bp, Artificial Sequence
  chemically synthesized
aaagtttcaatgtcagaaag

SEQ ID NO: 173134 - DNA, 20 bp, Artificial Sequence
  chemically synthesized
gaagaaatcaaatatatact

SEQ ID NO: 173135 - DNA, 20 bp, Artificial Sequence
  chemically synthesized
atggttttatcatttcatct

SEQ ID NO: 173136 - DNA, 20 bp, Artificial Sequence
  chemically synthesized
gatgaaatgataaaaccatt

SEQ ID NO: 173137 - DNA, 20 bp, Artificial Sequence
  chemically synthesized
atgaaatgataaaaccatta

SEQ ID NO: 173138 - DNA, 20 bp, Artificial Sequence
  chemically synthesized
gagggtgcatgaaaccttaa

SEQ ID NO: 173139 - DNA, 20 bp, Artificial Sequence
  chemically synthesized
ttaatgttagaaatgtgaga

SEQ ID NO: 173140 - DNA, 20 bp, Artificial Sequence
  chemically synthesized
attaatgttagaaatgtgag

SEQ ID NO: 173141 - DNA, 20 bp, Artificial Sequence
  chemically synthesized
aattaatgttagaaatgtga

SEQ ID NO: 173142 - DNA, 20 bp, Artificial Sequence
  chemically synthesized
aaaattaatgttagaaatgt

SEQ ID NO: 173143 - DNA, 20 bp, Artificial Sequence
  chemically synthesized
taaaatttgaaaattaatgt

SEQ ID NO: 173144 - DNA, 20 bp, Artificial Sequence
  chemically synthesized
aacattaattttcaaatttt

SEQ ID NO: 173145 - DNA, 20 bp, Artificial Sequence
  chemically synthesized
attaattttcaaattttaag

SEQ ID NO: 173146 - DNA, 20 bp, Artificial Sequence
  chemically synthesized
ttttcaaattttaagtagaa

SEQ ID NO: 173147 - DNA, 20 bp, Artificial Sequence
  chemically synthesized
ttttaagtagaacagtgata

SEQ ID NO: 173148 - DNA, 20 bp, Artificial Sequence
  chemically synthesized
gaataatattgtcaatcttc

SEQ ID NO: 173149 - DNA, 20 bp, Artificial Sequence
  chemically synthesized
aggtgctaaaataaaactag

SEQ ID NO: 173150 - DNA, 20 bp, Artificial Sequence
  chemically synthesized
gcaaggtgctaaaataaaac

SEQ ID NO: 173151 - DNA, 20 bp, Artificial Sequence
  chemically synthesized
tcaatcttctagttttattt

SEQ ID NO: 173152 - DNA, 20 bp, Artificial Sequence
  chemically synthesized
aattgtctgttttaaatgca

SEQ ID NO: 173153 - DNA, 20 bp, Artificial Sequence
  chemically synthesized
aaattgtctgttttaaatgc

SEQ ID NO: 173154 - DNA, 20 bp, Artificial Sequence
  chemically synthesized
ttagcaccttgcatttaaaa

SEQ ID NO: 173155 - DNA, 20 bp, Artificial Sequence
  chemically synthesized
aaaacagacaatttatcttt

SEQ ID NO: 173156 - DNA, 20 bp, Artificial Sequence
  chemically synthesized
tttgaagtaccaacaactca

SEQ ID NO: 173157 - DNA, 20 bp, Artificial Sequence
  chemically synthesized
acaatttatctttgagttgt

SEQ ID NO: 173158 - DNA, 20 bp, Artificial Sequence
  chemically synthesized
tgagttgttggtacttcaaa

SEQ ID NO: 173159 - DNA, 20 bp, Artificial Sequence
  chemically synthesized
aactttaaaaaaactatttg

SEQ ID NO: 173160 - DNA, 20 bp, Artificial Sequence
  chemically synthesized
tacttcaaatagttttttta

SEQ ID NO: 173161 - DNA, 20 bp, Artificial Sequence
  chemically synthesized
ttcgtctctgtgtgaaattg

SEQ ID NO: 173162 - DNA, 20 bp, Artificial Sequence
  chemically synthesized
aaagtttccacaatttcaca

SEQ ID NO: 173163 - DNA, 20 bp, Artificial Sequence
  chemically synthesized
agtttccacaatttcacaca

SEQ ID NO: 173164 - DNA, 20 bp, Artificial Sequence
  chemically synthesized
ttcacacagagacgaatgct

SEQ ID NO: 173165 - DNA, 20 bp, Artificial Sequence
  chemically synthesized
aagcaagcttaacagattct

SEQ ID NO: 173166 - DNA, 20 bp, Artificial Sequence
  chemically synthesized
acgaatgctaagaatctgtt

SEQ ID NO: 173167 - DNA, 20 bp, Artificial Sequence
  chemically synthesized
ttccctaaaagcaagcttaa

SEQ ID NO: 173168 - DNA, 20 bp, Artificial Sequence
  chemically synthesized
gaatctgttaagcttgcttt

SEQ ID NO: 173169 - DNA, 20 bp, Artificial Sequence
  chemically synthesized
aatctgttaagcttgctttt

SEQ ID NO: 173170 - DNA, 20 bp, Artificial Sequence
  chemically synthesized
atctgttaagcttgctttta

SEQ ID NO: 173171 - DNA, 20 bp, Artificial Sequence
  chemically synthesized
gcatccttttccctaaaagc

SEQ ID NO: 173172 - DNA, 20 bp, Artificial Sequence
  chemically synthesized
tgaggcatccttttccctaa

SEQ ID NO: 173173 - DNA, 20 bp, Artificial Sequence
  chemically synthesized
ttaagcttgcttttagggaa

SEQ ID NO: 173174 - DNA, 20 bp, Artificial Sequence
  chemically synthesized
taagcttgcttttagggaaa

SEQ ID NO: 173175 - DNA, 20 bp, Artificial Sequence
  chemically synthesized
ttagggaaaaggatgcctca

SEQ ID NO: 173176 - DNA, 20 bp, Artificial Sequence
  chemically synthesized
taaaaagttttgtgactttg

SEQ ID NO: 173177 - DNA, 20 bp, Artificial Sequence
  chemically synthesized
ttaaaaagttttgtgacttt

SEQ ID NO: 173178 - DNA, 20 bp, Artificial Sequence
  chemically synthesized
cccaaagaaccaagtttaaa

SEQ ID NO: 173179 - DNA, 20 bp, Artificial Sequence
  chemically synthesized
gtcacaaaactttttaaact

SEQ ID NO: 173180 - DNA, 20 bp, Artificial Sequence
  chemically synthesized
actttttaaacttggttctt

SEQ ID NO: 173181 - DNA, 20 bp, Artificial Sequence
  chemically synthesized
tttttcacccccaaagaacc

SEQ ID NO: 173182 - DNA, 20 bp, Artificial Sequence
  chemically synthesized
ctttttaaacttggttcttt

SEQ ID NO: 173183 - DNA, 20 bp, Artificial Sequence
  chemically synthesized
tttttaaacttggttctttg

SEQ ID NO: 173184 - DNA, 20 bp, Artificial Sequence
  chemically synthesized
ttttaaacttggttctttgg

SEQ ID NO: 173185 - DNA, 20 bp, Artificial Sequence
  chemically synthesized
tgcctgctttttcaccccca

SEQ ID NO: 173186 - DNA, 20 bp, Artificial Sequence
  chemically synthesized
ttggttctttgggggtgaaa

SEQ ID NO: 173187 - DNA, 20 bp, Artificial Sequence
  chemically synthesized
gttctttgggggtgaaaaag

SEQ ID NO: 173188 - DNA, 20 bp, Artificial Sequence
  chemically synthesized
ttctttgggggtgaaaaagc

SEQ ID NO: 173189 - DNA, 20 bp, Artificial Sequence
  chemically synthesized
acatgtaaaatttagaaaat

SEQ ID NO: 173190 - DNA, 20 bp, Artificial Sequence
  chemically synthesized
ccaatttaacatgtaaaatt

SEQ ID NO: 173191 - DNA, 20 bp, Artificial Sequence
  chemically synthesized
ctaaattttacatgttaaat

SEQ ID NO: 173192 - DNA, 20 bp, Artificial Sequence
  chemically synthesized
aattttacatgttaaattgg

SEQ ID NO: 173193 - DNA, 20 bp, Artificial Sequence
  chemically synthesized
ttacatgttaaattggaagt

SEQ ID NO: 173194 - DNA, 20 bp, Artificial Sequence
  chemically synthesized
ctttaatatgttttaataaa

SEQ ID NO: 173195 - DNA, 20 bp, Artificial Sequence
  chemically synthesized
ctgtttattaaaacatatta

SEQ ID NO: 173196 - DNA, 20 bp, Artificial Sequence
  chemically synthesized
atattaaagataaaccatgt

SEQ ID NO: 173197 - DNA, 20 bp, Artificial Sequence
  chemically synthesized
attaaagataaaccatgtga

SEQ ID NO: 173198 - DNA, 20 bp, Artificial Sequence
  chemically synthesized
tttgattccattctctcaca

SEQ ID NO: 173199 - DNA, 20 bp, Artificial Sequence
  chemically synthesized
agataaaccatgtgagagaa

SEQ ID NO: 173200 - DNA, 20 bp, Artificial Sequence
  chemically synthesized
gtgagagaatggaatcaaaa

SEQ ID NO: 173201 - DNA, 20 bp, Artificial Sequence
  chemically synthesized
gagagaatggaatcaaaatg

SEQ ID NO: 173202 - DNA, 20 bp, Artificial Sequence
  chemically synthesized
ttggttgaagtgagcaaggt

SEQ ID NO: 173203 - DNA, 20 bp, Artificial Sequence
  chemically synthesized
attggttgaagtgagcaagg

SEQ ID NO: 173204 - DNA, 20 bp, Artificial Sequence
  chemically synthesized
ttaattggttgaagtgagca

SEQ ID NO: 173205 - DNA, 20 bp, Artificial Sequence
  chemically synthesized
cttaattggttgaagtgagc

SEQ ID NO: 173206 - DNA, 20 bp, Artificial Sequence
  chemically synthesized
tgttcttaattggttgaagt

SEQ ID NO: 173207 - DNA, 20 bp, Artificial Sequence
  chemically synthesized
attatgttcttaattggttg

SEQ ID NO: 173208 - DNA, 20 bp, Artificial Sequence
  chemically synthesized
cttgctcacttcaaccaatt

SEQ ID NO: 173209 - DNA, 20 bp, Artificial Sequence
  chemically synthesized
ctaccaattatgttcttaat

SEQ ID NO: 173210 - DNA, 20 bp, Artificial Sequence
  chemically synthesized
caaccaattaagaacataat

SEQ ID NO: 173211 - DNA, 20 bp, Artificial Sequence
  chemically synthesized
ccaattaagaacataattgg

SEQ ID NO: 173212 - DNA, 20 bp, Artificial Sequence
  chemically synthesized
aagaacataattggtagcaa

SEQ ID NO: 173213 - DNA, 20 bp, Artificial Sequence
  chemically synthesized
ataattggtagcaaaagatg

SEQ ID NO: 173214 - DNA, 20 bp, Artificial Sequence
  chemically synthesized
aattggtagcaaaagatgaa

SEQ ID NO: 173215 - DNA, 20 bp, Artificial Sequence
  chemically synthesized
attggtagcaaaagatgaag

SEQ ID NO: 173216 - DNA, 20 bp, Artificial Sequence
  chemically synthesized
ttggtagcaaaagatgaaga

SEQ ID NO: 173217 - DNA, 20 bp, Artificial Sequence
  chemically synthesized
ggtagcaaaagatgaagagg

SEQ ID NO: 173218 - DNA, 20 bp, Artificial Sequence
  chemically synthesized
aaagatgaagagggagattt

SEQ ID NO: 173219 - DNA, 20 bp, Artificial Sequence
  chemically synthesized
aagatgaagagggagatttc

SEQ ID NO: 173220 - DNA, 20 bp, Artificial Sequence
  chemically synthesized
aagagggagatttcaggtaa

SEQ ID NO: 173221 - DNA, 20 bp, Artificial Sequence
  chemically synthesized
gagggagatttcaggtaaaa

SEQ ID NO: 173222 - DNA, 20 bp, Artificial Sequence
  chemically synthesized
agatttcaggtaaaagagaa

SEQ ID NO: 173223 - DNA, 20 bp, Artificial Sequence
  chemically synthesized
gagaacagaaattaaaaaaa

SEQ ID NO: 173224 - DNA, 20 bp, Artificial Sequence
  chemically synthesized
agaacagaaattaaaaaaaa

SEQ ID NO: 173225 - DNA, 20 bp, Artificial Sequence
  chemically synthesized
acagaaattaaaaaaaaagg

SEQ ID NO: 173226 - DNA, 20 bp, Artificial Sequence
  chemically synthesized
cagaaattaaaaaaaaagga

SEQ ID NO: 173227 - DNA, 20 bp, Artificial Sequence
  chemically synthesized
agaaattaaaaaaaaaggaa

SEQ ID NO: 173228 - DNA, 20 bp, Artificial Sequence
  chemically synthesized
gaaattaaaaaaaaaggaag

SEQ ID NO: 173229 - DNA, 20 bp, Artificial Sequence
  chemically synthesized
aaattaaaaaaaaaggaagg

SEQ ID NO: 173230 - DNA, 20 bp, Artificial Sequence
  chemically synthesized
aattaaaaaaaaaggaaggg

SEQ ID NO: 173231 - DNA, 20 bp, Artificial Sequence
  chemically synthesized
ttaaaaaaaaaggaaggggg

SEQ ID NO: 173232 - DNA, 20 bp, Artificial Sequence
  chemically synthesized
aaaaaaaggaaggggggaga

SEQ ID NO: 173233 - DNA, 20 bp, Artificial Sequence
  chemically synthesized
aaaaaaggaaggggggagaa

SEQ ID NO: 173234 - DNA, 20 bp, Artificial Sequence
  chemically synthesized
ggaaggggggagaaaggcaa

SEQ ID NO: 173235 - DNA, 20 bp, Artificial Sequence
  chemically synthesized
aaggggggagaaaggcaaca

SEQ ID NO: 173236 - DNA, 20 bp, Artificial Sequence
  chemically synthesized
gggagaaaggcaacagagac

SEQ ID NO: 173237 - DNA, 20 bp, Artificial Sequence
  chemically synthesized
gaaaggcaacagagacgaga

SEQ ID NO: 173238 - DNA, 20 bp, Artificial Sequence
  chemically synthesized
aaaggcaacagagacgagat

SEQ ID NO: 173239 - DNA, 20 bp, Artificial Sequence
  chemically synthesized
aaggcaacagagacgagatg

SEQ ID NO: 173240 - DNA, 20 bp, Artificial Sequence
  chemically synthesized
aacagagacgagatggggaa

SEQ ID NO: 173241 - DNA, 20 bp, Artificial Sequence
  chemically synthesized
cagagacgagatggggaaaa

SEQ ID NO: 173242 - DNA, 20 bp, Artificial Sequence
  chemically synthesized
acgagatggggaaaagagca

SEQ ID NO: 173243 - DNA, 20 bp, Artificial Sequence
  chemically synthesized
cgagatggggaaaagagcaa

SEQ ID NO: 173244 - DNA, 20 bp, Artificial Sequence
  chemically synthesized
gagatggggaaaagagcaaa

SEQ ID NO: 173245 - DNA, 20 bp, Artificial Sequence
  chemically synthesized
agatggggaaaagagcaaag

SEQ ID NO: 173246 - DNA, 20 bp, Artificial Sequence
  chemically synthesized
aaaggggattaacacatctt

SEQ ID NO: 173247 - DNA, 20 bp, Artificial Sequence
  chemically synthesized
aggggattaacacatcttga

SEQ ID NO: 173248 - DNA, 20 bp, Artificial Sequence
  chemically synthesized
ggggattaacacatcttgag

SEQ ID NO: 173249 - DNA, 20 bp, Artificial Sequence
  chemically synthesized
gggattaacacatcttgaga

SEQ ID NO: 173250 - DNA, 20 bp, Artificial Sequence
  chemically synthesized
cactttcatctcaccctctc

SEQ ID NO: 173251 - DNA, 20 bp, Artificial Sequence
  chemically synthesized
ttaacacatcttgagagggt

SEQ ID NO: 173252 - DNA, 20 bp, Artificial Sequence
  chemically synthesized
atcttgagagggtgagatga

SEQ ID NO: 173253 - DNA, 20 bp, Artificial Sequence
  chemically synthesized
agagggtgagatgaaagtgt

SEQ ID NO: 173254 - DNA, 20 bp, Artificial Sequence
  chemically synthesized
gagggtgagatgaaagtgtg

SEQ ID NO: 173255 - DNA, 20 bp, Artificial Sequence
  chemically synthesized
gagatgaaagtgtgaggaaa

SEQ ID NO: 173256 - DNA, 20 bp, Artificial Sequence
  chemically synthesized
gaggaaaaagtaaaaaatta

SEQ ID NO: 173257 - DNA, 20 bp, Artificial Sequence
  chemically synthesized
aaaaaattatagcatgaaaa

SEQ ID NO: 173258 - DNA, 20 bp, Artificial Sequence
  chemically synthesized
aaaattatagcatgaaaata

SEQ ID NO: 173259 - DNA, 20 bp, Artificial Sequence
  chemically synthesized
atagcatgaaaatagagatg

SEQ ID NO: 173260 - DNA, 20 bp, Artificial Sequence
  chemically synthesized
atcaactctatattacatgt

SEQ ID NO: 173261 - DNA, 20 bp, Artificial Sequence
  chemically synthesized
tagtgtactaacatgtaata

SEQ ID NO: 173262 - DNA, 20 bp, Artificial Sequence
  chemically synthesized
gtgtactaacatgtaatata

SEQ ID NO: 173263 - DNA, 20 bp, Artificial Sequence
  chemically synthesized
catgtaatatagagttgatg

SEQ ID NO: 173264 - DNA, 20 bp, Artificial Sequence
  chemically synthesized
tagagttgatgaagacatgt

SEQ ID NO: 173265 - DNA, 20 bp, Artificial Sequence
  chemically synthesized
cattcatcaacaattttcag

SEQ ID NO: 173266 - DNA, 20 bp, Artificial Sequence
  chemically synthesized
gtgcattcatcaacaatttt

SEQ ID NO: 173267 - DNA, 20 bp, Artificial Sequence
  chemically synthesized
gaaaattgttgatgaatgca

SEQ ID NO: 173268 - DNA, 20 bp, Artificial Sequence
  chemically synthesized
ttgttgatgaatgcacagtt

SEQ ID NO: 173269 - DNA, 20 bp, Artificial Sequence
  chemically synthesized
agtttagaaatgacgaataa

SEQ ID NO: 173270 - DNA, 20 bp, Artificial Sequence
  chemically synthesized
tcctttaaatggaaatggaa

SEQ ID NO: 173271 - DNA, 20 bp, Artificial Sequence
  chemically synthesized
ctttatcctttaaatggaaa

SEQ ID NO: 173272 - DNA, 20 bp, Artificial Sequence
  chemically synthesized
ttctattccatttccattta

SEQ ID NO: 173273 - DNA, 20 bp, Artificial Sequence
  chemically synthesized
tctattccatttccatttaa

SEQ ID NO: 173274 - DNA, 20 bp, Artificial Sequence
  chemically synthesized
tgaagcctttatcctttaaa

SEQ ID NO: 173275 - DNA, 20 bp, Artificial Sequence
  chemically synthesized
ccatttccatttaaaggata

SEQ ID NO: 173276 - DNA, 20 bp, Artificial Sequence
  chemically synthesized
catttccatttaaaggataa

SEQ ID NO: 173277 - DNA, 20 bp, Artificial Sequence
  chemically synthesized
ataatttttcatgcattttg

SEQ ID NO: 173278 - DNA, 20 bp, Artificial Sequence
  chemically synthesized
aaaatgcatgaaaaattata

SEQ ID NO: 173279 - DNA, 20 bp, Artificial Sequence
  chemically synthesized
ttataaagtgaatttttaaa

SEQ ID NO: 173280 - DNA, 20 bp, Artificial Sequence
  chemically synthesized
ttaaatggttcatgaaatct

SEQ ID NO: 173281 - DNA, 20 bp, Artificial Sequence
  chemically synthesized
taatttagtttcagaaagct

SEQ ID NO: 173282 - DNA, 20 bp, Artificial Sequence
  chemically synthesized
gaagctaatttagtttcaga

SEQ ID NO: 173283 - DNA, 20 bp, Artificial Sequence
  chemically synthesized
aaaagaagctaatttagttt

SEQ ID NO: 173284 - DNA, 20 bp, Artificial Sequence
  chemically synthesized
tcagctttctgaaactaaat

SEQ ID NO: 173285 - DNA, 20 bp, Artificial Sequence
  chemically synthesized
aaaaacaaaagaagctaatt

SEQ ID NO: 173286 - DNA, 20 bp, Artificial Sequence
  chemically synthesized
tcgaatctgaaaaacaaaag

SEQ ID NO: 173287 - DNA, 20 bp, Artificial Sequence
  chemically synthesized
gtttcgaatctgaaaaacaa

SEQ ID NO: 173288 - DNA, 20 bp, Artificial Sequence
  chemically synthesized
aattagcttcttttgttttt

SEQ ID NO: 173289 - DNA, 20 bp, Artificial Sequence
  chemically synthesized
agattcgaaactctatgata

SEQ ID NO: 173290 - DNA, 20 bp, Artificial Sequence
  chemically synthesized
cacagccaaaccatatcata

SEQ ID NO: 173291 - DNA, 20 bp, Artificial Sequence
  chemically synthesized
gacacagccaaaccatatca

SEQ ID NO: 173292 - DNA, 20 bp, Artificial Sequence
  chemically synthesized
cgaaactctatgatatggtt

SEQ ID NO: 173293 - DNA, 20 bp, Artificial Sequence
  chemically synthesized
atgagcttttggtacagaca

SEQ ID NO: 173294 - DNA, 20 bp, Artificial Sequence
  chemically synthesized
tttggctgtgtctgtaccaa

SEQ ID NO: 173295 - DNA, 20 bp, Artificial Sequence
  chemically synthesized
cttaagatgagcttttggta

SEQ ID NO: 173296 - DNA, 20 bp, Artificial Sequence
  chemically synthesized
aacagcttaagatgagcttt

SEQ ID NO: 173297 - DNA, 20 bp, Artificial Sequence
  chemically synthesized
ctgtaccaaaagctcatctt

SEQ ID NO: 173298 - DNA, 20 bp, Artificial Sequence
  chemically synthesized
tgggaacaacagcttaagat

SEQ ID NO: 173299 - DNA, 20 bp, Artificial Sequence
  chemically synthesized
ggttatgggaacaacagctt

SEQ ID NO: 173300 - DNA, 20 bp, Artificial Sequence
  chemically synthesized
tgtgggggttatgggaacaa

SEQ ID NO: 173301 - DNA, 20 bp, Artificial Sequence
  chemically synthesized
ccaggacgtgtgggggttat

SEQ ID NO: 173302 - DNA, 20 bp, Artificial Sequence
  chemically synthesized
cccaggacgtgtgggggtta

SEQ ID NO: 173303 - DNA, 20 bp, Artificial Sequence
  chemically synthesized
atccctcccaggacgtgtgg

SEQ ID NO: 173304 - DNA, 20 bp, Artificial Sequence
  chemically synthesized
gatccctcccaggacgtgtg

SEQ ID NO: 173305 - DNA, 20 bp, Artificial Sequence
  chemically synthesized
tgatccctcccaggacgtgt

SEQ ID NO: 173306 - DNA, 20 bp, Artificial Sequence
  chemically synthesized
cccataacccccacacgtcc

SEQ ID NO: 173307 - DNA, 20 bp, Artificial Sequence
  chemically synthesized
ctgatccctcccaggacgtg

SEQ ID NO: 173308 - DNA, 20 bp, Artificial Sequence
  chemically synthesized
ccataacccccacacgtcct

SEQ ID NO: 173309 - DNA, 20 bp, Artificial Sequence
  chemically synthesized
ataacccccacacgtcctgg

SEQ ID NO: 173310 - DNA, 20 bp, Artificial Sequence
  chemically synthesized
taacccccacacgtcctggg

SEQ ID NO: 173311 - DNA, 20 bp, Artificial Sequence
  chemically synthesized
aacccccacacgtcctggga

SEQ ID NO: 173312 - DNA, 20 bp, Artificial Sequence
  chemically synthesized
atctccacctgatccctccc

SEQ ID NO: 173313 - DNA, 20 bp, Artificial Sequence
  chemically synthesized
tatctccacctgatccctcc

SEQ ID NO: 173314 - DNA, 20 bp, Artificial Sequence
  chemically synthesized
ccacacgtcctgggagggat

SEQ ID NO: 173315 - DNA, 20 bp, Artificial Sequence
  chemically synthesized
cacacgtcctgggagggatc

SEQ ID NO: 173316 - DNA, 20 bp, Artificial Sequence
  chemically synthesized
acgtcctgggagggatcagg

SEQ ID NO: 173317 - DNA, 20 bp, Artificial Sequence
  chemically synthesized
gtcctgggagggatcaggtg

SEQ ID NO: 173318 - DNA, 20 bp, Artificial Sequence
  chemically synthesized
aggtggagataattgaatca

SEQ ID NO: 173319 - DNA, 20 bp, Artificial Sequence
  chemically synthesized
tggagataattgaatcacgg

SEQ ID NO: 173320 - DNA, 20 bp, Artificial Sequence
  chemically synthesized
ggagataattgaatcacggc

SEQ ID NO: 173321 - DNA, 20 bp, Artificial Sequence
  chemically synthesized
gataattgaatcacggcggg

SEQ ID NO: 173322 - DNA, 20 bp, Artificial Sequence
  chemically synthesized
ctgtcacaagaacagcatga

SEQ ID NO: 173323 - DNA, 20 bp, Artificial Sequence
  chemically synthesized
actgtcacaagaacagcatg

SEQ ID NO: 173324 - DNA, 20 bp, Artificial Sequence
  chemically synthesized
cactgtcacaagaacagcat

SEQ ID NO: 173325 - DNA, 20 bp, Artificial Sequence
  chemically synthesized
agaactcactgtcacaagaa

SEQ ID NO: 173326 - DNA, 20 bp, Artificial Sequence
  chemically synthesized
ccctcatgctgttcttgtga

SEQ ID NO: 173327 - DNA, 20 bp, Artificial Sequence
  chemically synthesized
tcgtgagaactcactgtcac

SEQ ID NO: 173328 - DNA, 20 bp, Artificial Sequence
  chemically synthesized
catgctgttcttgtgacagt

SEQ ID NO: 173329 - DNA, 20 bp, Artificial Sequence
  chemically synthesized
ttgtgacagtgagttctcac

SEQ ID NO: 173330 - DNA, 20 bp, Artificial Sequence
  chemically synthesized
tgtgacagtgagttctcacg

SEQ ID NO: 173331 - DNA, 20 bp, Artificial Sequence
  chemically synthesized
ataaaaccatcagacctcgt

SEQ ID NO: 173332 - DNA, 20 bp, Artificial Sequence
  chemically synthesized
tgagttctcacgaggtctga

SEQ ID NO: 173333 - DNA, 20 bp, Artificial Sequence
  chemically synthesized
aaagccccttataaaaccat

SEQ ID NO: 173334 - DNA, 20 bp, Artificial Sequence
  chemically synthesized
acgaggtctgatggttttat

SEQ ID NO: 173335 - DNA, 20 bp, Artificial Sequence
  chemically synthesized
cgaggtctgatggttttata

SEQ ID NO: 173336 - DNA, 20 bp, Artificial Sequence
  chemically synthesized
gaggtctgatggttttataa

SEQ ID NO: 173337 - DNA, 20 bp, Artificial Sequence
  chemically synthesized
aggtctgatggttttataag

SEQ ID NO: 173338 - DNA, 20 bp, Artificial Sequence
  chemically synthesized
agaatgagcaaaagagggaa

SEQ ID NO: 173339 - DNA, 20 bp, Artificial Sequence
  chemically synthesized
ggaggagaatgagcaaaaga

SEQ ID NO: 173340 - DNA, 20 bp, Artificial Sequence
  chemically synthesized
aggaggagaatgagcaaaag

SEQ ID NO: 173341 - DNA, 20 bp, Artificial Sequence
  chemically synthesized
aaggaggagaatgagcaaaa

SEQ ID NO: 173342 - DNA, 20 bp, Artificial Sequence
  chemically synthesized
ggaaggaggagaatgagcaa

SEQ ID NO: 173343 - DNA, 20 bp, Artificial Sequence
  chemically synthesized
gcagcaggaaggaggagaat

SEQ ID NO: 173344 - DNA, 20 bp, Artificial Sequence
  chemically synthesized
cacatggcagcaggaaggag

SEQ ID NO: 173345 - DNA, 20 bp, Artificial Sequence
  chemically synthesized
ttcacatggcagcaggaagg

SEQ ID NO: 173346 - DNA, 20 bp, Artificial Sequence
  chemically synthesized
cttcacatggcagcaggaag

SEQ ID NO: 173347 - DNA, 20 bp, Artificial Sequence
  chemically synthesized
ttcttcacatggcagcagga

SEQ ID NO: 173348 - DNA, 20 bp, Artificial Sequence
  chemically synthesized
cttcttcacatggcagcagg

SEQ ID NO: 173349 - DNA, 20 bp, Artificial Sequence
  chemically synthesized
cttcttcttcacatggcagc

SEQ ID NO: 173350 - DNA, 20 bp, Artificial Sequence
  chemically synthesized
ccttcttcttcacatggcag

SEQ ID NO: 173351 - DNA, 20 bp, Artificial Sequence
  chemically synthesized
ctccttcctgctgccatgtg

SEQ ID NO: 173352 - DNA, 20 bp, Artificial Sequence
  chemically synthesized
acaccttcttcttcacatgg

SEQ ID NO: 173353 - DNA, 20 bp, Artificial Sequence
  chemically synthesized
cttcctgctgccatgtgaag

SEQ ID NO: 173354 - DNA, 20 bp, Artificial Sequence
  chemically synthesized
caaacaccttcttcttcaca

SEQ ID NO: 173355 - DNA, 20 bp, Artificial Sequence
  chemically synthesized
cctgctgccatgtgaagaag

SEQ ID NO: 173356 - DNA, 20 bp, Artificial Sequence
  chemically synthesized
ctgctgccatgtgaagaaga

SEQ ID NO: 173357 - DNA, 20 bp, Artificial Sequence
  chemically synthesized
tacaatcatggcagatgggg

SEQ ID NO: 173358 - DNA, 20 bp, Artificial Sequence
  chemically synthesized
acttacaatcatggcagatg

SEQ ID NO: 173359 - DNA, 20 bp, Artificial Sequence
  chemically synthesized
aacttacaatcatggcagat

SEQ ID NO: 173360 - DNA, 20 bp, Artificial Sequence
  chemically synthesized
aaacttacaatcatggcaga

SEQ ID NO: 173361 - DNA, 20 bp, Artificial Sequence
  chemically synthesized
caggaaacttacaatcatgg

SEQ ID NO: 173362 - DNA, 20 bp, Artificial Sequence
  chemically synthesized
tccccatctgccatgattgt

SEQ ID NO: 173363 - DNA, 20 bp, Artificial Sequence
  chemically synthesized
cctcaggaaacttacaatca

SEQ ID NO: 173364 - DNA, 20 bp, Artificial Sequence
  chemically synthesized
gccatgattgtaagtttcct

SEQ ID NO: 173365 - DNA, 20 bp, Artificial Sequence
  chemically synthesized
ccatgattgtaagtttcctg

SEQ ID NO: 173366 - DNA, 20 bp, Artificial Sequence
  chemically synthesized
agcatggctggggaggcctc

SEQ ID NO: 173367 - DNA, 20 bp, Artificial Sequence
  chemically synthesized
cagcatggctggggaggcct

SEQ ID NO: 173368 - DNA, 20 bp, Artificial Sequence
  chemically synthesized
taagtttcctgaggcctccc

SEQ ID NO: 173369 - DNA, 20 bp, Artificial Sequence
  chemically synthesized
acagttcagcatggctgggg

SEQ ID NO: 173370 - DNA, 20 bp, Artificial Sequence
  chemically synthesized
cacagttcagcatggctggg

SEQ ID NO: 173371 - DNA, 20 bp, Artificial Sequence
  chemically synthesized
ctcacagttcagcatggctg

SEQ ID NO: 173372 - DNA, 20 bp, Artificial Sequence
  chemically synthesized
actcacagttcagcatggct

SEQ ID NO: 173373 - DNA, 20 bp, Artificial Sequence
  chemically synthesized
gactcacagttcagcatggc

SEQ ID NO: 173374 - DNA, 20 bp, Artificial Sequence
  chemically synthesized
aattgactcacagttcagca

SEQ ID NO: 173375 - DNA, 20 bp, Artificial Sequence
  chemically synthesized
ccccagccatgctgaactgt

SEQ ID NO: 173376 - DNA, 20 bp, Artificial Sequence
  chemically synthesized
gatttaattgactcacagtt

SEQ ID NO: 173377 - DNA, 20 bp, Artificial Sequence
  chemically synthesized
aaagtgatttaattgactca

SEQ ID NO: 173378 - DNA, 20 bp, Artificial Sequence
  chemically synthesized
actgggtaatttataaagga

SEQ ID NO: 173379 - DNA, 20 bp, Artificial Sequence
  chemically synthesized
tgagactgggtaatttataa

SEQ ID NO: 173380 - DNA, 20 bp, Artificial Sequence
  chemically synthesized
ctgagactgggtaatttata

SEQ ID NO: 173381 - DNA, 20 bp, Artificial Sequence
  chemically synthesized
actttcctttataaattacc

SEQ ID NO: 173382 - DNA, 20 bp, Artificial Sequence
  chemically synthesized
ctttataaattacccagtct

SEQ ID NO: 173383 - DNA, 20 bp, Artificial Sequence
  chemically synthesized
tttataaattacccagtctc

SEQ ID NO: 173384 - DNA, 20 bp, Artificial Sequence
  chemically synthesized
ataaagacatacctgagact

SEQ ID NO: 173385 - DNA, 20 bp, Artificial Sequence
  chemically synthesized
aataaagacatacctgagac

SEQ ID NO: 173386 - DNA, 20 bp, Artificial Sequence
  chemically synthesized
ctgctaataaagacatacct

SEQ ID NO: 173387 - DNA, 20 bp, Artificial Sequence
  chemically synthesized
agtctcaggtatgtctttat

SEQ ID NO: 173388 - DNA, 20 bp, Artificial Sequence
  chemically synthesized
ctcaggtatgtctttattag

SEQ ID NO: 173389 - DNA, 20 bp, Artificial Sequence
  chemically synthesized
ctgttctcacactgctaata

SEQ ID NO: 173390 - DNA, 20 bp, Artificial Sequence
  chemically synthesized
tatgtctttattagcagtgt

SEQ ID NO: 173391 - DNA, 20 bp, Artificial Sequence
  chemically synthesized
ctttattagcagtgtgagaa

SEQ ID NO: 173392 - DNA, 20 bp, Artificial Sequence
  chemically synthesized
ttgtatggaatgaaatatat

SEQ ID NO: 173393 - DNA, 20 bp, Artificial Sequence
  chemically synthesized
gagacctggttggtgttgta

SEQ ID NO: 173394 - DNA, 20 bp, Artificial Sequence
  chemically synthesized
tcattccatacaacaccaac

SEQ ID NO: 173395 - DNA, 20 bp, Artificial Sequence
  chemically synthesized
cattccatacaacaccaacc

SEQ ID NO: 173396 - DNA, 20 bp, Artificial Sequence
  chemically synthesized
gacctggtatgagacctggt

SEQ ID NO: 173397 - DNA, 20 bp, Artificial Sequence
  chemically synthesized
acaagacctggtatgagacc

SEQ ID NO: 173398 - DNA, 20 bp, Artificial Sequence
  chemically synthesized
acaccaaccaggtctcatac

SEQ ID NO: 173399 - DNA, 20 bp, Artificial Sequence
  chemically synthesized
caccaaccaggtctcatacc

SEQ ID NO: 173400 - DNA, 20 bp, Artificial Sequence
  chemically synthesized
tcatctacaagacctggtat

SEQ ID NO: 173401 - DNA, 20 bp, Artificial Sequence
  chemically synthesized
aggtctcataccaggtcttg

SEQ ID NO: 173402 - DNA, 20 bp, Artificial Sequence
  chemically synthesized
ttggtatcatctacaagacc

SEQ ID NO: 173403 - DNA, 20 bp, Artificial Sequence
  chemically synthesized
gtttatttggtatcatctac

SEQ ID NO: 173404 - DNA, 20 bp, Artificial Sequence
  chemically synthesized
tatgtttcagagagtttatt

SEQ ID NO: 173405 - DNA, 20 bp, Artificial Sequence
  chemically synthesized
taggaaaaatatgtttcaga

SEQ ID NO: 173406 - DNA, 20 bp, Artificial Sequence
  chemically synthesized
attaggaaaaatatgtttca

SEQ ID NO: 173407 - DNA, 20 bp, Artificial Sequence
  chemically synthesized
gaattaggaaaaatatgttt

SEQ ID NO: 173408 - DNA, 20 bp, Artificial Sequence
  chemically synthesized
tcaatgggacaaaaagaatt

SEQ ID NO: 173409 - DNA, 20 bp, Artificial Sequence
  chemically synthesized
ttcaatgggacaaaaagaat

SEQ ID NO: 173410 - DNA, 20 bp, Artificial Sequence
  chemically synthesized
tcacaattcaatgggacaaa

SEQ ID NO: 173411 - DNA, 20 bp, Artificial Sequence
  chemically synthesized
gtacaatttcacaattcaat

SEQ ID NO: 173412 - DNA, 20 bp, Artificial Sequence
  chemically synthesized
tgtacaatttcacaattcaa

SEQ ID NO: 173413 - DNA, 20 bp, Artificial Sequence
  chemically synthesized
aaattgtacactttcatcta

SEQ ID NO: 173414 - DNA, 20 bp, Artificial Sequence
  chemically synthesized
ccaatatttgctgtagatga

SEQ ID NO: 173415 - DNA, 20 bp, Artificial Sequence
  chemically synthesized
aaactttccaatatttgctg

SEQ ID NO: 173416 - DNA, 20 bp, Artificial Sequence
  chemically synthesized
ctttcatctacagcaaatat

SEQ ID NO: 173417 - DNA, 20 bp, Artificial Sequence
  chemically synthesized
catctacagcaaatattgga

SEQ ID NO: 173418 - DNA, 20 bp, Artificial Sequence
  chemically synthesized
tattggaaagtttctgcatc

SEQ ID NO: 173419 - DNA, 20 bp, Artificial Sequence
  chemically synthesized
tggaaagtttctgcatctgg

SEQ ID NO: 173420 - DNA, 20 bp, Artificial Sequence
  chemically synthesized
ctttcaaaatcttccagatg

SEQ ID NO: 173421 - DNA, 20 bp, Artificial Sequence
  chemically synthesized
ttttcactttcaaaatcttc

SEQ ID NO: 173422 - DNA, 20 bp, Artificial Sequence
  chemically synthesized
ctgcatctggaagattttga

SEQ ID NO: 173423 - DNA, 20 bp, Artificial Sequence
  chemically synthesized
tggaagattttgaaagtgaa

SEQ ID NO: 173424 - DNA, 20 bp, Artificial Sequence
  chemically synthesized
tgtgtcattcatggcaatat

SEQ ID NO: 173425 - DNA, 20 bp, Artificial Sequence
  chemically synthesized
atcaagggctgtgtcattca

SEQ ID NO: 173426 - DNA, 20 bp, Artificial Sequence
  chemically synthesized
ttatattgccatgaatgaca

SEQ ID NO: 173427 - DNA, 20 bp, Artificial Sequence
  chemically synthesized
tattcctactcatttatcaa

SEQ ID NO: 173428 - DNA, 20 bp, Artificial Sequence
  chemically synthesized
atattcctactcatttatca

SEQ ID NO: 173429 - DNA, 20 bp, Artificial Sequence
  chemically synthesized
tgacacagcccttgataaat

SEQ ID NO: 173430 - DNA, 20 bp, Artificial Sequence
  chemically synthesized
catattcctactcatttatc

SEQ ID NO: 173431 - DNA, 20 bp, Artificial Sequence
  chemically synthesized
cacagcccttgataaatgag

SEQ ID NO: 173432 - DNA, 20 bp, Artificial Sequence
  chemically synthesized
acagcccttgataaatgagt

SEQ ID NO: 173433 - DNA, 20 bp, Artificial Sequence
  chemically synthesized
ataaatgagtaggaatatgt

SEQ ID NO: 173434 - DNA, 20 bp, Artificial Sequence
  chemically synthesized
tgcctttaaagacaatttta

SEQ ID NO: 173435 - DNA, 20 bp, Artificial Sequence
  chemically synthesized
ttactttaaaattgtcttta

SEQ ID NO: 173436 - DNA, 20 bp, Artificial Sequence
  chemically synthesized
tactttaaaattgtctttaa

SEQ ID NO: 173437 - DNA, 20 bp, Artificial Sequence
  chemically synthesized
tagaatggatattgccttta

SEQ ID NO: 173438 - DNA, 20 bp, Artificial Sequence
  chemically synthesized
ttatgatgtcaataatagaa

SEQ ID NO: 173439 - DNA, 20 bp, Artificial Sequence
  chemically synthesized
caatgttatgatgtcaataa

SEQ ID NO: 173440 - DNA, 20 bp, Artificial Sequence
  chemically synthesized
attattgacatcataacatt

SEQ ID NO: 173441 - DNA, 20 bp, Artificial Sequence
  chemically synthesized
acattgagtgaacatattat

SEQ ID NO: 173442 - DNA, 20 bp, Artificial Sequence
  chemically synthesized
tgagtgaacatattatcagc

SEQ ID NO: 173443 - DNA, 20 bp, Artificial Sequence
  chemically synthesized
aacatattatcagccagatt

SEQ ID NO: 173444 - DNA, 20 bp, Artificial Sequence
  chemically synthesized
ctgtacagttttactaaatc

SEQ ID NO: 173445 - DNA, 20 bp, Artificial Sequence
  chemically synthesized
ccagatttagtaaaactgta

SEQ ID NO: 173446 - DNA, 20 bp, Artificial Sequence
  chemically synthesized
tctctggaaaattcactgta

SEQ ID NO: 173447 - DNA, 20 bp, Artificial Sequence
  chemically synthesized
aaactgtacagtgaattttc

SEQ ID NO: 173448 - DNA, 20 bp, Artificial Sequence
  chemically synthesized
actgtacagtgaattttcca

SEQ ID NO: 173449 - DNA, 20 bp, Artificial Sequence
  chemically synthesized
atgttatacaaggatatctc

SEQ ID NO: 173450 - DNA, 20 bp, Artificial Sequence
  chemically synthesized
tagatgacttatgttataca

SEQ ID NO: 173451 - DNA, 20 bp, Artificial Sequence
  chemically synthesized
ctagatgacttatgttatac

SEQ ID NO: 173452 - DNA, 20 bp, Artificial Sequence
  chemically synthesized
gagatatccttgtataacat

SEQ ID NO: 173453 - DNA, 20 bp, Artificial Sequence
  chemically synthesized
cttgtataacataagtcatc

SEQ ID NO: 173454 - DNA, 20 bp, Artificial Sequence
  chemically synthesized
cataagtcatctagtctcca

SEQ ID NO: 173455 - DNA, 20 bp, Artificial Sequence
  chemically synthesized
tcaatcatttctgtggagac

SEQ ID NO: 173456 - DNA, 20 bp, Artificial Sequence
  chemically synthesized
gaatttcaatcatttctgtg

SEQ ID NO: 173457 - DNA, 20 bp, Artificial Sequence
  chemically synthesized
aggaatttcaatcatttctg

SEQ ID NO: 173458 - DNA, 20 bp, Artificial Sequence
  chemically synthesized
aatgattgaaattccttgac

SEQ ID NO: 173459 - DNA, 20 bp, Artificial Sequence
  chemically synthesized
ggagctgcttagtctagtca

SEQ ID NO: 173460 - DNA, 20 bp, Artificial Sequence
  chemically synthesized
tggagctgcttagtctagtc

SEQ ID NO: 173461 - DNA, 20 bp, Artificial Sequence
  chemically synthesized
tgaaattccttgactagact

SEQ ID NO: 173462 - DNA, 20 bp, Artificial Sequence
  chemically synthesized
aattccttgactagactaag

SEQ ID NO: 173463 - DNA, 20 bp, Artificial Sequence
  chemically synthesized
accaatggagctgcttagtc

SEQ ID NO: 173464 - DNA, 20 bp, Artificial Sequence
  chemically synthesized
ctgtaaccaatggagctgct

SEQ ID NO: 173465 - DNA, 20 bp, Artificial Sequence
  chemically synthesized
actagactaagcagctccat

SEQ ID NO: 173466 - DNA, 20 bp, Artificial Sequence
  chemically synthesized
tggatttactgtaaccaatg

SEQ ID NO: 173467 - DNA, 20 bp, Artificial Sequence
  chemically synthesized
ctaagcagctccattggtta

SEQ ID NO: 173468 - DNA, 20 bp, Artificial Sequence
  chemically synthesized
tttggatttactgtaaccaa

SEQ ID NO: 173469 - DNA, 20 bp, Artificial Sequence
  chemically synthesized
ggttggagggggaaattgtt

SEQ ID NO: 173470 - DNA, 20 bp, Artificial Sequence
  chemically synthesized
gtagaaggtgaggttggagg

SEQ ID NO: 173471 - DNA, 20 bp, Artificial Sequence
  chemically synthesized
agtagaaggtgaggttggag

SEQ ID NO: 173472 - DNA, 20 bp, Artificial Sequence
  chemically synthesized
aagtagaaggtgaggttgga

SEQ ID NO: 173473 - DNA, 20 bp, Artificial Sequence
  chemically synthesized
aaagtagaaggtgaggttgg

SEQ ID NO: 173474 - DNA, 20 bp, Artificial Sequence
  chemically synthesized
taaagtagaaggtgaggttg

SEQ ID NO: 173475 - DNA, 20 bp, Artificial Sequence
  chemically synthesized
cataaagtagaaggtgaggt

SEQ ID NO: 173476 - DNA, 20 bp, Artificial Sequence
  chemically synthesized
tgagcataaagtagaaggtg

SEQ ID NO: 173477 - DNA, 20 bp, Artificial Sequence
  chemically synthesized
gtgagcataaagtagaaggt

SEQ ID NO: 173478 - DNA, 20 bp, Artificial Sequence
  chemically synthesized
agatgtgagcataaagtaga

SEQ ID NO: 173479 - DNA, 20 bp, Artificial Sequence
  chemically synthesized
tagatgtgagcataaagtag

SEQ ID NO: 173480 - DNA, 20 bp, Artificial Sequence
  chemically synthesized
aagtagatgtgagcataaag

SEQ ID NO: 173481 - DNA, 20 bp, Artificial Sequence
  chemically synthesized
caaaagtagatgtgagcata

SEQ ID NO: 173482 - DNA, 20 bp, Artificial Sequence
  chemically synthesized
tcataaacaaaagtagatgt

SEQ ID NO: 173483 - DNA, 20 bp, Artificial Sequence
  chemically synthesized
attgagatcataaacaaaag

SEQ ID NO: 173484 - DNA, 20 bp, Artificial Sequence
  chemically synthesized
gaaattgagatcataaacaa

SEQ ID NO: 173485 - DNA, 20 bp, Artificial Sequence
  chemically synthesized
tttgtttatgatctcaattt

SEQ ID NO: 173486 - DNA, 20 bp, Artificial Sequence
  chemically synthesized
ttgtttatgatctcaatttc

SEQ ID NO: 173487 - DNA, 20 bp, Artificial Sequence
  chemically synthesized
taagacatggacctgaaatt

SEQ ID NO: 173488 - DNA, 20 bp, Artificial Sequence
  chemically synthesized
gtaggtctacatttaagaca

SEQ ID NO: 173489 - DNA, 20 bp, Artificial Sequence
  chemically synthesized
tcaggtccatgtcttaaatg

SEQ ID NO: 173490 - DNA, 20 bp, Artificial Sequence
  chemically synthesized
attttagtaggtctacattt

SEQ ID NO: 173491 - DNA, 20 bp, Artificial Sequence
  chemically synthesized
taaatgtagacctactaaaa

SEQ ID NO: 173492 - DNA, 20 bp, Artificial Sequence
  chemically synthesized
agtaaatgtcctattttagt

SEQ ID NO: 173493 - DNA, 20 bp, Artificial Sequence
  chemically synthesized
aaatgtagacctactaaaat

SEQ ID NO: 173494 - DNA, 20 bp, Artificial Sequence
  chemically synthesized
gagtaaatgtcctattttag

SEQ ID NO: 173495 - DNA, 20 bp, Artificial Sequence
  chemically synthesized
ttggagtaaatgtcctattt

SEQ ID NO: 173496 - DNA, 20 bp, Artificial Sequence
  chemically synthesized
agggaaggaattgaaatttg

SEQ ID NO: 173497 - DNA, 20 bp, Artificial Sequence
  chemically synthesized
ccagggaaggaattgaaatt

SEQ ID NO: 173498 - DNA, 20 bp, Artificial Sequence
  chemically synthesized
ccaaatttcaattccttccc

SEQ ID NO: 173499 - DNA, 20 bp, Artificial Sequence
  chemically synthesized
aacatggctgcaaccaggga

SEQ ID NO: 173500 - DNA, 20 bp, Artificial Sequence
  chemically synthesized
aaacatggctgcaaccaggg

SEQ ID NO: 173501 - DNA, 20 bp, Artificial Sequence
  chemically synthesized
ttcaattccttccctggttg

SEQ ID NO: 173502 - DNA, 20 bp, Artificial Sequence
  chemically synthesized
tcaaaacatggctgcaacca

SEQ ID NO: 173503 - DNA, 20 bp, Artificial Sequence
  chemically synthesized
ctcaaaacatggctgcaacc

SEQ ID NO: 173504 - DNA, 20 bp, Artificial Sequence
  chemically synthesized
tctcaaaacatggctgcaac

SEQ ID NO: 173505 - DNA, 20 bp, Artificial Sequence
  chemically synthesized
cctggttgcagccatgtttt

SEQ ID NO: 173506 - DNA, 20 bp, Artificial Sequence
  chemically synthesized
cattctggtgtctcaaaaca

SEQ ID NO: 173507 - DNA, 20 bp, Artificial Sequence
  chemically synthesized
gcagccatgttttgagacac

SEQ ID NO: 173508 - DNA, 20 bp, Artificial Sequence
  chemically synthesized
gttttgagacaccagaatgt

SEQ ID NO: 173509 - DNA, 20 bp, Artificial Sequence
  chemically synthesized
tttctgtgtgtcttacattc

SEQ ID NO: 173510 - DNA, 20 bp, Artificial Sequence
  chemically synthesized
acaccagaatgtaagacaca

SEQ ID NO: 173511 - DNA, 20 bp, Artificial Sequence
  chemically synthesized
gaatgtaagacacacagaaa

SEQ ID NO: 173512 - DNA, 20 bp, Artificial Sequence
  chemically synthesized
cacagaaacagaaaatactg

SEQ ID NO: 173513 - DNA, 20 bp, Artificial Sequence
  chemically synthesized
agaaacagaaaatactgtgg

SEQ ID NO: 173514 - DNA, 20 bp, Artificial Sequence
  chemically synthesized
gaaacagaaaatactgtgga

SEQ ID NO: 173515 - DNA, 20 bp, Artificial Sequence
  chemically synthesized
acagaaaatactgtggaagg

SEQ ID NO: 173516 - DNA, 20 bp, Artificial Sequence
  chemically synthesized
gatgttgattcttccttcca

SEQ ID NO: 173517 - DNA, 20 bp, Artificial Sequence
  chemically synthesized
ttatatcacaataagttgaa

SEQ ID NO: 173518 - DNA, 20 bp, Artificial Sequence
  chemically synthesized
tttcaaatttatatcacaat

SEQ ID NO: 173519 - DNA, 20 bp, Artificial Sequence
  chemically synthesized
tattgtgatataaatttgaa

SEQ ID NO: 173520 - DNA, 20 bp, Artificial Sequence
  chemically synthesized
aaatttgaaaagctatgaca

SEQ ID NO: 173521 - DNA, 20 bp, Artificial Sequence
  chemically synthesized
tgaatcagaattccatgtca

SEQ ID NO: 173522 - DNA, 20 bp, Artificial Sequence
  chemically synthesized
atcatggatatcaattgaat

SEQ ID NO: 173523 - DNA, 20 bp, Artificial Sequence
  chemically synthesized
aggtacttacaaggagatca

SEQ ID NO: 173524 - DNA, 20 bp, Artificial Sequence
  chemically synthesized
gatatccatgatctccttgt

SEQ ID NO: 173525 - DNA, 20 bp, Artificial Sequence
  chemically synthesized
agtactcaggtacttacaag

SEQ ID NO: 173526 - DNA, 20 bp, Artificial Sequence
  chemically synthesized
tcagtactcaggtacttaca

SEQ ID NO: 173527 - DNA, 20 bp, Artificial Sequence
  chemically synthesized
ttcagtactcaggtacttac

SEQ ID NO: 173528 - DNA, 20 bp, Artificial Sequence
  chemically synthesized
tgatctccttgtaagtacct

SEQ ID NO: 173529 - DNA, 20 bp, Artificial Sequence
  chemically synthesized
gacagttggcttcagtactc

SEQ ID NO: 173530 - DNA, 20 bp, Artificial Sequence
  chemically synthesized
ttgtaagtacctgagtactg

SEQ ID NO: 173531 - DNA, 20 bp, Artificial Sequence
  chemically synthesized
agacagttggcttcagtact

SEQ ID NO: 173532 - DNA, 20 bp, Artificial Sequence
  chemically synthesized
caaatcaagacagttggctt

SEQ ID NO: 173533 - DNA, 20 bp, Artificial Sequence
  chemically synthesized
gagacccaaatcaagacagt

SEQ ID NO: 173534 - DNA, 20 bp, Artificial Sequence
  chemically synthesized
ctgggagacccaaatcaaga

SEQ ID NO: 173535 - DNA, 20 bp, Artificial Sequence
  chemically synthesized
tgaagccaactgtcttgatt

SEQ ID NO: 173536 - DNA, 20 bp, Artificial Sequence
  chemically synthesized
gaagccaactgtcttgattt

SEQ ID NO: 173537 - DNA, 20 bp, Artificial Sequence
  chemically synthesized
gctactgggagacccaaatc

SEQ ID NO: 173538 - DNA, 20 bp, Artificial Sequence
  chemically synthesized
ctgtcttgatttgggtctcc

SEQ ID NO: 173539 - DNA, 20 bp, Artificial Sequence
  chemically synthesized
tcttgatttgggtctcccag

SEQ ID NO: 173540 - DNA, 20 bp, Artificial Sequence
  chemically synthesized
atttctgggtttgctactgg

SEQ ID NO: 173541 - DNA, 20 bp, Artificial Sequence
  chemically synthesized
ttatttctgggtttgctact

SEQ ID NO: 173542 - DNA, 20 bp, Artificial Sequence
  chemically synthesized
tttatttctgggtttgctac

SEQ ID NO: 173543 - DNA, 20 bp, Artificial Sequence
  chemically synthesized
gggtctcccagtagcaaacc

SEQ ID NO: 173544 - DNA, 20 bp, Artificial Sequence
  chemically synthesized
gagctcaaatttttatttct

SEQ ID NO: 173545 - DNA, 20 bp, Artificial Sequence
  chemically synthesized
tgagctcaaatttttatttc

SEQ ID NO: 173546 - DNA, 20 bp, Artificial Sequence
  chemically synthesized
aaacccagaaataaaaattt

SEQ ID NO: 173547 - DNA, 20 bp, Artificial Sequence
  chemically synthesized
agaaataaaaatttgagctc

SEQ ID NO: 173548 - DNA, 20 bp, Artificial Sequence
  chemically synthesized
aataaaaatttgagctcaag

SEQ ID NO: 173549 - DNA, 20 bp, Artificial Sequence
  chemically synthesized
atcacatcccaaaactactt

SEQ ID NO: 173550 - DNA, 20 bp, Artificial Sequence
  chemically synthesized
aatttgagctcaagtagttt

SEQ ID NO: 173551 - DNA, 20 bp, Artificial Sequence
  chemically synthesized
atttgagctcaagtagtttt

SEQ ID NO: 173552 - DNA, 20 bp, Artificial Sequence
  chemically synthesized
gtagttttgggatgtgattc

SEQ ID NO: 173553 - DNA, 20 bp, Artificial Sequence
  chemically synthesized
tagttttgggatgtgattcc

SEQ ID NO: 173554 - DNA, 20 bp, Artificial Sequence
  chemically synthesized
ctcaccctgttgatgtgtcc

SEQ ID NO: 173555 - DNA, 20 bp, Artificial Sequence
  chemically synthesized
gtgattccaggacacatcaa

SEQ ID NO: 173556 - DNA, 20 bp, Artificial Sequence
  chemically synthesized
tgattccaggacacatcaac

SEQ ID NO: 173557 - DNA, 20 bp, Artificial Sequence
  chemically synthesized
gattccaggacacatcaaca

SEQ ID NO: 173558 - DNA, 20 bp, Artificial Sequence
  chemically synthesized
ccaggacacatcaacagggt

SEQ ID NO: 173559 - DNA, 20 bp, Artificial Sequence
  chemically synthesized
ggacacatcaacagggtgag

SEQ ID NO: 173560 - DNA, 20 bp, Artificial Sequence
  chemically synthesized
cacatcaacagggtgagaag

SEQ ID NO: 173561 - DNA, 20 bp, Artificial Sequence
  chemically synthesized
cagggtgagaagaagtgaaa

SEQ ID NO: 173562 - DNA, 20 bp, Artificial Sequence
  chemically synthesized
agggtgagaagaagtgaaat

SEQ ID NO: 173563 - DNA, 20 bp, Artificial Sequence
  chemically synthesized
gggtgagaagaagtgaaata

SEQ ID NO: 173564 - DNA, 20 bp, Artificial Sequence
  chemically synthesized
tgagaagaagtgaaataggg

SEQ ID NO: 173565 - DNA, 20 bp, Artificial Sequence
  chemically synthesized
aagaagtgaaatagggaaga

SEQ ID NO: 173566 - DNA, 20 bp, Artificial Sequence
  chemically synthesized
aatagggaagatagccaata

SEQ ID NO: 173567 - DNA, 20 bp, Artificial Sequence
  chemically synthesized
atagggaagatagccaataa

SEQ ID NO: 173568 - DNA, 20 bp, Artificial Sequence
  chemically synthesized
tagggaagatagccaataaa

SEQ ID NO: 173569 - DNA, 20 bp, Artificial Sequence
  chemically synthesized
catgataatataccctttat

SEQ ID NO: 173570 - DNA, 20 bp, Artificial Sequence
  chemically synthesized
taaagggtatattatcatgc

SEQ ID NO: 173571 - DNA, 20 bp, Artificial Sequence
  chemically synthesized
taacagggagtattaagatt

SEQ ID NO: 173572 - DNA, 20 bp, Artificial Sequence
  chemically synthesized
tagggataacagggagtatt

SEQ ID NO: 173573 - DNA, 20 bp, Artificial Sequence
  chemically synthesized
cttcttttagggataacagg

SEQ ID NO: 173574 - DNA, 20 bp, Artificial Sequence
  chemically synthesized
atcttcttttagggataaca

SEQ ID NO: 173575 - DNA, 20 bp, Artificial Sequence
  chemically synthesized
catcttcttttagggataac

SEQ ID NO: 173576 - DNA, 20 bp, Artificial Sequence
  chemically synthesized
acatcttcttttagggataa

SEQ ID NO: 173577 - DNA, 20 bp, Artificial Sequence
  chemically synthesized
atactccctgttatccctaa

SEQ ID NO: 173578 - DNA, 20 bp, Artificial Sequence
  chemically synthesized
ctccctgttatccctaaaag

SEQ ID NO: 173579 - DNA, 20 bp, Artificial Sequence
  chemically synthesized
gtttcctacatcttctttta

SEQ ID NO: 173580 - DNA, 20 bp, Artificial Sequence
  chemically synthesized
agtttcctacatcttctttt

SEQ ID NO: 173581 - DNA, 20 bp, Artificial Sequence
  chemically synthesized
tagtttcctacatcttcttt

SEQ ID NO: 173582 - DNA, 20 bp, Artificial Sequence
  chemically synthesized
gttatccctaaaagaagatg

SEQ ID NO: 173583 - DNA, 20 bp, Artificial Sequence
  chemically synthesized
ttatccctaaaagaagatgt

SEQ ID NO: 173584 - DNA, 20 bp, Artificial Sequence
  chemically synthesized
aaaagaagatgtaggaaact

SEQ ID NO: 173585 - DNA, 20 bp, Artificial Sequence
  chemically synthesized
aaagaagatgtaggaaacta

SEQ ID NO: 173586 - DNA, 20 bp, Artificial Sequence
  chemically synthesized
tgttttggttacagtagcct

SEQ ID NO: 173587 - DNA, 20 bp, Artificial Sequence
  chemically synthesized
ccatgctgttttggttacag

SEQ ID NO: 173588 - DNA, 20 bp, Artificial Sequence
  chemically synthesized
gtaccatgctgttttggtta

SEQ ID NO: 173589 - DNA, 20 bp, Artificial Sequence
  chemically synthesized
taaggctactgtaaccaaaa

SEQ ID NO: 173590 - DNA, 20 bp, Artificial Sequence
  chemically synthesized
gtaccagtaccatgctgttt

SEQ ID NO: 173591 - DNA, 20 bp, Artificial Sequence
  chemically synthesized
ctactgtaaccaaaacagca

SEQ ID NO: 173592 - DNA, 20 bp, Artificial Sequence
  chemically synthesized
taaccaaaacagcatggtac

SEQ ID NO: 173593 - DNA, 20 bp, Artificial Sequence
  chemically synthesized
ctatatctctgttttggtac

SEQ ID NO: 173594 - DNA, 20 bp, Artificial Sequence
  chemically synthesized
gcatggtactggtaccaaaa

SEQ ID NO: 173595 - DNA, 20 bp, Artificial Sequence
  chemically synthesized
atggtactggtaccaaaaca

SEQ ID NO: 173596 - DNA, 20 bp, Artificial Sequence
  chemically synthesized
attggtctatatctctgttt

SEQ ID NO: 173597 - DNA, 20 bp, Artificial Sequence
  chemically synthesized
ctggtaccaaaacagagata

SEQ ID NO: 173598 - DNA, 20 bp, Artificial Sequence
  chemically synthesized
aaaacagagatatagaccaa

SEQ ID NO: 173599 - DNA, 20 bp, Artificial Sequence
  chemically synthesized
agagatatagaccaatggaa

SEQ ID NO: 173600 - DNA, 20 bp, Artificial Sequence
  chemically synthesized
aggcttccgttctgttccat

SEQ ID NO: 173601 - DNA, 20 bp, Artificial Sequence
  chemically synthesized
tatagaccaatggaacagaa

SEQ ID NO: 173602 - DNA, 20 bp, Artificial Sequence
  chemically synthesized
agaccaatggaacagaacgg

SEQ ID NO: 173603 - DNA, 20 bp, Artificial Sequence
  chemically synthesized
atggaacagaacggaagcct

SEQ ID NO: 173604 - DNA, 20 bp, Artificial Sequence
  chemically synthesized
gatgtgtggtattatttctg

SEQ ID NO: 173605 - DNA, 20 bp, Artificial Sequence
  chemically synthesized
agatgtgtggtattatttct

SEQ ID NO: 173606 - DNA, 20 bp, Artificial Sequence
  chemically synthesized
atcagatagttgtagatgtg

SEQ ID NO: 173607 - DNA, 20 bp, Artificial Sequence
  chemically synthesized
tgtcaaagatcagatagttg

SEQ ID NO: 173608 - DNA, 20 bp, Artificial Sequence
  chemically synthesized
caggtttgtcaaagatcaga

SEQ ID NO: 173609 - DNA, 20 bp, Artificial Sequence
  chemically synthesized
ttgtcaggtttgtcaaagat

SEQ ID NO: 173610 - DNA, 20 bp, Artificial Sequence
  chemically synthesized
gttttttgtcaggtttgtca

SEQ ID NO: 173611 - DNA, 20 bp, Artificial Sequence
  chemically synthesized
cccatttcttgttttttgtc

SEQ ID NO: 173612 - DNA, 20 bp, Artificial Sequence
  chemically synthesized
ccccatttcttgttttttgt

SEQ ID NO: 173613 - DNA, 20 bp, Artificial Sequence
  chemically synthesized
tgacaaacctgacaaaaaac

SEQ ID NO: 173614 - DNA, 20 bp, Artificial Sequence
  chemically synthesized
acctgacaaaaaacaagaaa

SEQ ID NO: 173615 - DNA, 20 bp, Artificial Sequence
  chemically synthesized
cctgacaaaaaacaagaaat

SEQ ID NO: 173616 - DNA, 20 bp, Artificial Sequence
  chemically synthesized
ctgacaaaaaacaagaaatg

SEQ ID NO: 173617 - DNA, 20 bp, Artificial Sequence
  chemically synthesized
caaaaaacaagaaatgggga

SEQ ID NO: 173618 - DNA, 20 bp, Artificial Sequence
  chemically synthesized
aaaaaacaagaaatggggaa

SEQ ID NO: 173619 - DNA, 20 bp, Artificial Sequence
  chemically synthesized
ccagcaccatttattaaata

SEQ ID NO: 173620 - DNA, 20 bp, Artificial Sequence
  chemically synthesized
cccagcaccatttattaaat

SEQ ID NO: 173621 - DNA, 20 bp, Artificial Sequence
  chemically synthesized
tcccagcaccatttattaaa

SEQ ID NO: 173622 - DNA, 20 bp, Artificial Sequence
  chemically synthesized
aggattccctatttaataaa

SEQ ID NO: 173623 - DNA, 20 bp, Artificial Sequence
  chemically synthesized
ccctatttaataaatggtgc

SEQ ID NO: 173624 - DNA, 20 bp, Artificial Sequence
  chemically synthesized
cctatttaataaatggtgct

SEQ ID NO: 173625 - DNA, 20 bp, Artificial Sequence
  chemically synthesized
ataaatggtgctgggaaaac

SEQ ID NO: 173626 - DNA, 20 bp, Artificial Sequence
  chemically synthesized
atatggctagccagttttcc

SEQ ID NO: 173627 - DNA, 20 bp, Artificial Sequence
  chemically synthesized
atggtgctgggaaaactggc

SEQ ID NO: 173628 - DNA, 20 bp, Artificial Sequence
  chemically synthesized
gctttctacatatggctagc

SEQ ID NO: 173629 - DNA, 20 bp, Artificial Sequence
  chemically synthesized
ttcagctttctacatatggc

SEQ ID NO: 173630 - DNA, 20 bp, Artificial Sequence
  chemically synthesized
gaaaactggctagccatatg

SEQ ID NO: 173631 - DNA, 20 bp, Artificial Sequence
  chemically synthesized
cagtttcagctttctacata

SEQ ID NO: 173632 - DNA, 20 bp, Artificial Sequence
  chemically synthesized
actggctagccatatgtaga

SEQ ID NO: 173633 - DNA, 20 bp, Artificial Sequence
  chemically synthesized
catatgtagaaagctgaaac

SEQ ID NO: 173634 - DNA, 20 bp, Artificial Sequence
  chemically synthesized
gtaaggaagggatccagttt

SEQ ID NO: 173635 - DNA, 20 bp, Artificial Sequence
  chemically synthesized
taaggtgtaaggaagggatc

SEQ ID NO: 173636 - DNA, 20 bp, Artificial Sequence
  chemically synthesized
tttgtataaggtgtaaggaa

SEQ ID NO: 173637 - DNA, 20 bp, Artificial Sequence
  chemically synthesized
ttttgtataaggtgtaagga

SEQ ID NO: 173638 - DNA, 20 bp, Artificial Sequence
  chemically synthesized
tttttgtataaggtgtaagg

SEQ ID NO: 173639 - DNA, 20 bp, Artificial Sequence
  chemically synthesized
taatttttgtataaggtgta

SEQ ID NO: 173640 - DNA, 20 bp, Artificial Sequence
  chemically synthesized
ttaatttttgtataaggtgt

SEQ ID NO: 173641 - DNA, 20 bp, Artificial Sequence
  chemically synthesized
aattaattaatttttgtata

SEQ ID NO: 173642 - DNA, 20 bp, Artificial Sequence
  chemically synthesized
gaattaattaatttttgtat

SEQ ID NO: 173643 - DNA, 20 bp, Artificial Sequence
  chemically synthesized
atacaaaaattaattaattc

SEQ ID NO: 173644 - DNA, 20 bp, Artificial Sequence
  chemically synthesized
aaaaattaattaattcaaga

SEQ ID NO: 173645 - DNA, 20 bp, Artificial Sequence
  chemically synthesized
aattaattcaagatggatta

SEQ ID NO: 173646 - DNA, 20 bp, Artificial Sequence
  chemically synthesized
tggattaaagacttacatgt

SEQ ID NO: 173647 - DNA, 20 bp, Artificial Sequence
  chemically synthesized
tggttttaggtctaacatgt

SEQ ID NO: 173648 - DNA, 20 bp, Artificial Sequence
  chemically synthesized
ttctagggttttatggtttt

SEQ ID NO: 173649 - DNA, 20 bp, Artificial Sequence
  chemically synthesized
cttctagggttttatggttt

SEQ ID NO: 173650 - DNA, 20 bp, Artificial Sequence
  chemically synthesized
ggttttcttctagggtttta

SEQ ID NO: 173651 - DNA, 20 bp, Artificial Sequence
  chemically synthesized
gacctaaaaccataaaaccc

SEQ ID NO: 173652 - DNA, 20 bp, Artificial Sequence
  chemically synthesized
ctaaaaccataaaaccctag

SEQ ID NO: 173653 - DNA, 20 bp, Artificial Sequence
  chemically synthesized
attgcctaggttttcttcta

SEQ ID NO: 173654 - DNA, 20 bp, Artificial Sequence
  chemically synthesized
tattgcctaggttttcttct

SEQ ID NO: 173655 - DNA, 20 bp, Artificial Sequence
  chemically synthesized
gtattgcctaggttttcttc

SEQ ID NO: 173656 - DNA, 20 bp, Artificial Sequence
  chemically synthesized
taaaaccctagaagaaaacc

SEQ ID NO: 173657 - DNA, 20 bp, Artificial Sequence
  chemically synthesized
aaaaccctagaagaaaacct

SEQ ID NO: 173658 - DNA, 20 bp, Artificial Sequence
  chemically synthesized
tgtcctgaatggtattgcct

SEQ ID NO: 173659 - DNA, 20 bp, Artificial Sequence
  chemically synthesized
ttgtcctgaatggtattgcc

SEQ ID NO: 173660 - DNA, 20 bp, Artificial Sequence
  chemically synthesized
aaaacctaggcaataccatt

SEQ ID NO: 173661 - DNA, 20 bp, Artificial Sequence
  chemically synthesized
aaacctaggcaataccattc

SEQ ID NO: 173662 - DNA, 20 bp, Artificial Sequence
  chemically synthesized
gcccatgcctttgtcctgaa

SEQ ID NO: 173663 - DNA, 20 bp, Artificial Sequence
  chemically synthesized
aggcaataccattcaggaca

SEQ ID NO: 173664 - DNA, 20 bp, Artificial Sequence
  chemically synthesized
ggcaataccattcaggacaa

SEQ ID NO: 173665 - DNA, 20 bp, Artificial Sequence
  chemically synthesized
taccattcaggacaaaggca

SEQ ID NO: 173666 - DNA, 20 bp, Artificial Sequence
  chemically synthesized
accattcaggacaaaggcat

SEQ ID NO: 173667 - DNA, 20 bp, Artificial Sequence
  chemically synthesized
ttcaggacaaaggcatgggc

SEQ ID NO: 173668 - DNA, 20 bp, Artificial Sequence
  chemically synthesized
tcaggacaaaggcatgggca

SEQ ID NO: 173669 - DNA, 20 bp, Artificial Sequence
  chemically synthesized
cttttggtgttttcatcatg

SEQ ID NO: 173670 - DNA, 20 bp, Artificial Sequence
  chemically synthesized
cttcatgatgaaaacaccaa

SEQ ID NO: 173671 - DNA, 20 bp, Artificial Sequence
  chemically synthesized
gatgaaaacaccaaaagcaa

SEQ ID NO: 173672 - DNA, 20 bp, Artificial Sequence
  chemically synthesized
gcttctgttgccattgcttt

SEQ ID NO: 173673 - DNA, 20 bp, Artificial Sequence
  chemically synthesized
aacaccaaaagcaatggcaa

SEQ ID NO: 173674 - DNA, 20 bp, Artificial Sequence
  chemically synthesized
accaaaagcaatggcaacag

SEQ ID NO: 173675 - DNA, 20 bp, Artificial Sequence
  chemically synthesized
tagatcccatttgtcaattt

SEQ ID NO: 173676 - DNA, 20 bp, Artificial Sequence
  chemically synthesized
cagaagccaaaattgacaaa

SEQ ID NO: 173677 - DNA, 20 bp, Artificial Sequence
  chemically synthesized
agaagccaaaattgacaaat

SEQ ID NO: 173678 - DNA, 20 bp, Artificial Sequence
  chemically synthesized
cagaagctctttcgtttaat

SEQ ID NO: 173679 - DNA, 20 bp, Artificial Sequence
  chemically synthesized
aatgggatctaattaaacga

SEQ ID NO: 173680 - DNA, 20 bp, Artificial Sequence
  chemically synthesized
tgggatctaattaaacgaaa

SEQ ID NO: 173681 - DNA, 20 bp, Artificial Sequence
  chemically synthesized
taaacgaaagagcttctgca

SEQ ID NO: 173682 - DNA, 20 bp, Artificial Sequence
  chemically synthesized
tactttcttttgctgtgcag

SEQ ID NO: 173683 - DNA, 20 bp, Artificial Sequence
  chemically synthesized
tggtactttcttttgctgtg

SEQ ID NO: 173684 - DNA, 20 bp, Artificial Sequence
  chemically synthesized
aaagagcttctgcacagcaa

SEQ ID NO: 173685 - DNA, 20 bp, Artificial Sequence
  chemically synthesized
agcttctgcacagcaaaaga

SEQ ID NO: 173686 - DNA, 20 bp, Artificial Sequence
  chemically synthesized
acagcaaaagaaagtaccat

SEQ ID NO: 173687 - DNA, 20 bp, Artificial Sequence
  chemically synthesized
agcaaaagaaagtaccatca

SEQ ID NO: 173688 - DNA, 20 bp, Artificial Sequence
  chemically synthesized
aggttgcttgttcactctga

SEQ ID NO: 173689 - DNA, 20 bp, Artificial Sequence
  chemically synthesized
aaagtaccatcagagtgaac

SEQ ID NO: 173690 - DNA, 20 bp, Artificial Sequence
  chemically synthesized
tgaacaagcaacctacataa

SEQ ID NO: 173691 - DNA, 20 bp, Artificial Sequence
  chemically synthesized
gaacaagcaacctacataat

SEQ ID NO: 173692 - DNA, 20 bp, Artificial Sequence
  chemically synthesized
aaaattttctcccattatgt

SEQ ID NO: 173693 - DNA, 20 bp, Artificial Sequence
  chemically synthesized
aaaaattttctcccattatg

SEQ ID NO: 173694 - DNA, 20 bp, Artificial Sequence
  chemically synthesized
acaagcaacctacataatgg

SEQ ID NO: 173695 - DNA, 20 bp, Artificial Sequence
  chemically synthesized
ttagccctttgtcagatggg

SEQ ID NO: 173696 - DNA, 20 bp, Artificial Sequence
  chemically synthesized
atattagccctttgtcagat

SEQ ID NO: 173697 - DNA, 20 bp, Artificial Sequence
  chemically synthesized
tgcaatctacccatctgaca

SEQ ID NO: 173698 - DNA, 20 bp, Artificial Sequence
  chemically synthesized
gatattagccctttgtcaga

SEQ ID NO: 173699 - DNA, 20 bp, Artificial Sequence
  chemically synthesized
gcaatctacccatctgacaa

SEQ ID NO: 173700 - DNA, 20 bp, Artificial Sequence
  chemically synthesized
caatctacccatctgacaaa

SEQ ID NO: 173701 - DNA, 20 bp, Artificial Sequence
  chemically synthesized
tctcgatattagccctttgt

SEQ ID NO: 173702 - DNA, 20 bp, Artificial Sequence
  chemically synthesized
tctgacaaagggctaatatc

SEQ ID NO: 173703 - DNA, 20 bp, Artificial Sequence
  chemically synthesized
tctttgtagattctcgatat

SEQ ID NO: 173704 - DNA, 20 bp, Artificial Sequence
  chemically synthesized
gctaatatcgagaatctaca

SEQ ID NO: 173705 - DNA, 20 bp, Artificial Sequence
  chemically synthesized
aaatttgtttaagttctttg

SEQ ID NO: 173706 - DNA, 20 bp, Artificial Sequence
  chemically synthesized
tttttcttgtaaatttgttt

SEQ ID NO: 173707 - DNA, 20 bp, Artificial Sequence
  chemically synthesized
aagaacttaaacaaatttac

SEQ ID NO: 173708 - DNA, 20 bp, Artificial Sequence
  chemically synthesized
ggccgacttttcgatgaggt

SEQ ID NO: 173709 - DNA, 20 bp, Artificial Sequence
  chemically synthesized
aaaaaaccaacctcatcgaa

SEQ ID NO: 173710 - DNA, 20 bp, Artificial Sequence
  chemically synthesized
ccttggccgacttttcgatg

SEQ ID NO: 173711 - DNA, 20 bp, Artificial Sequence
  chemically synthesized
tccttggccgacttttcgat

SEQ ID NO: 173712 - DNA, 20 bp, Artificial Sequence
  chemically synthesized
aaccaacctcatcgaaaagt

SEQ ID NO: 173713 - DNA, 20 bp, Artificial Sequence
  chemically synthesized
acctcatcgaaaagtcggcc

SEQ ID NO: 173714 - DNA, 20 bp, Artificial Sequence
  chemically synthesized
cctcatcgaaaagtcggcca

SEQ ID NO: 173715 - DNA, 20 bp, Artificial Sequence
  chemically synthesized
atcgaaaagtcggccaagga

SEQ ID NO: 173716 - DNA, 20 bp, Artificial Sequence
  chemically synthesized
tcgaaaagtcggccaaggat

SEQ ID NO: 173717 - DNA, 20 bp, Artificial Sequence
  chemically synthesized
gaagtgtctgttcctatcct

SEQ ID NO: 173718 - DNA, 20 bp, Artificial Sequence
  chemically synthesized
aagtcggccaaggataggaa

SEQ ID NO: 173719 - DNA, 20 bp, Artificial Sequence
  chemically synthesized
taggaacagacacttctcaa

SEQ ID NO: 173720 - DNA, 20 bp, Artificial Sequence
  chemically synthesized
cataaatgtcttcttttgag

SEQ ID NO: 173721 - DNA, 20 bp, Artificial Sequence
  chemically synthesized
gaacagacacttctcaaaag

SEQ ID NO: 173722 - DNA, 20 bp, Artificial Sequence
  chemically synthesized
ctgcataaatgtcttctttt

SEQ ID NO: 173723 - DNA, 20 bp, Artificial Sequence
  chemically synthesized
ctcaaaagaagacatttatg

SEQ ID NO: 173724 - DNA, 20 bp, Artificial Sequence
  chemically synthesized
gaagacatttatgcagctaa

SEQ ID NO: 173725 - DNA, 20 bp, Artificial Sequence
  chemically synthesized
gcattttttcatgtgtctgt

SEQ ID NO: 173726 - DNA, 20 bp, Artificial Sequence
  chemically synthesized
ctctgatgaccagtgatgat

SEQ ID NO: 173727 - DNA, 20 bp, Artificial Sequence
  chemically synthesized
gaaaaaatgctcatcatcac

SEQ ID NO: 173728 - DNA, 20 bp, Artificial Sequence
  chemically synthesized
tgctcatcatcactggtcat

SEQ ID NO: 173729 - DNA, 20 bp, Artificial Sequence
  chemically synthesized
ctcatcatcactggtcatca

SEQ ID NO: 173730 - DNA, 20 bp, Artificial Sequence
  chemically synthesized
atttgcatttctctgatgac

SEQ ID NO: 173731 - DNA, 20 bp, Artificial Sequence
  chemically synthesized
atgcaaatcaaaaccacaat

SEQ ID NO: 173732 - DNA, 20 bp, Artificial Sequence
  chemically synthesized
agtgagatggtatctcattg

SEQ ID NO: 173733 - DNA, 20 bp, Artificial Sequence
  chemically synthesized
ccattctaactggagtgaga

SEQ ID NO: 173734 - DNA, 20 bp, Artificial Sequence
  chemically synthesized
aatgagataccatctcactc

SEQ ID NO: 173735 - DNA, 20 bp, Artificial Sequence
  chemically synthesized
atcaccattctaactggagt

SEQ ID NO: 173736 - DNA, 20 bp, Artificial Sequence
  chemically synthesized
agataccatctcactccagt

SEQ ID NO: 173737 - DNA, 20 bp, Artificial Sequence
  chemically synthesized
aatgatcaccattctaactg

SEQ ID NO: 173738 - DNA, 20 bp, Artificial Sequence
  chemically synthesized
ccatctcactccagttagaa

SEQ ID NO: 173739 - DNA, 20 bp, Artificial Sequence
  chemically synthesized
ttaatgatcaccattctaac

SEQ ID NO: 173740 - DNA, 20 bp, Artificial Sequence
  chemically synthesized
ttagaatggtgatcattaaa

SEQ ID NO: 173741 - DNA, 20 bp, Artificial Sequence
  chemically synthesized
aatggtgatcattaaaaagt

SEQ ID NO: 173742 - DNA, 20 bp, Artificial Sequence
  chemically synthesized
atggtgatcattaaaaagtc

SEQ ID NO: 173743 - DNA, 20 bp, Artificial Sequence
  chemically synthesized
attaaaaagtcaggaaacaa

SEQ ID NO: 173744 - DNA, 20 bp, Artificial Sequence
  chemically synthesized
agtcaggaaacaacagatgc

SEQ ID NO: 173745 - DNA, 20 bp, Artificial Sequence
  chemically synthesized
tcaggaaacaacagatgctg

SEQ ID NO: 173746 - DNA, 20 bp, Artificial Sequence
  chemically synthesized
aggaaacaacagatgctgga

SEQ ID NO: 173747 - DNA, 20 bp, Artificial Sequence
  chemically synthesized
ggaaacaacagatgctggag

SEQ ID NO: 173748 - DNA, 20 bp, Artificial Sequence
  chemically synthesized
ctgtttctccacatcctctc

SEQ ID NO: 173749 - DNA, 20 bp, Artificial Sequence
  chemically synthesized
aacagatgctggagaggatg

SEQ ID NO: 173750 - DNA, 20 bp, Artificial Sequence
  chemically synthesized
cagatgctggagaggatgtg

SEQ ID NO: 173751 - DNA, 20 bp, Artificial Sequence
  chemically synthesized
ctggagaggatgtggagaaa

SEQ ID NO: 173752 - DNA, 20 bp, Artificial Sequence
  chemically synthesized
tggagaggatgtggagaaac

SEQ ID NO: 173753 - DNA, 20 bp, Artificial Sequence
  chemically synthesized
cagtcccaccaacggtgtga

SEQ ID NO: 173754 - DNA, 20 bp, Artificial Sequence
  chemically synthesized
caggaacactttcacaccgt

SEQ ID NO: 173755 - DNA, 20 bp, Artificial Sequence
  chemically synthesized
gaacactttcacaccgttgg

SEQ ID NO: 173756 - DNA, 20 bp, Artificial Sequence
  chemically synthesized
aacactttcacaccgttggt

SEQ ID NO: 173757 - DNA, 20 bp, Artificial Sequence
  chemically synthesized
ctagtttacagtcccaccaa

SEQ ID NO: 173758 - DNA, 20 bp, Artificial Sequence
  chemically synthesized
ccgttggtgggactgtaaac

SEQ ID NO: 173759 - DNA, 20 bp, Artificial Sequence
  chemically synthesized
acaatggttgaactagttta

SEQ ID NO: 173760 - DNA, 20 bp, Artificial Sequence
  chemically synthesized
gtcttccacaatggttgaac

SEQ ID NO: 173761 - DNA, 20 bp, Artificial Sequence
  chemically synthesized
gtaaactagttcaaccattg

SEQ ID NO: 173762 - DNA, 20 bp, Artificial Sequence
  chemically synthesized
aactagttcaaccattgtgg

SEQ ID NO: 173763 - DNA, 20 bp, Artificial Sequence
  chemically synthesized
cgccacactgtcttccacaa

SEQ ID NO: 173764 - DNA, 20 bp, Artificial Sequence
  chemically synthesized
agttcaaccattgtggaaga

SEQ ID NO: 173765 - DNA, 20 bp, Artificial Sequence
  chemically synthesized
aaccattgtggaagacagtg

SEQ ID NO: 173766 - DNA, 20 bp, Artificial Sequence
  chemically synthesized
agacagtgtggcgattcctc

SEQ ID NO: 173767 - DNA, 20 bp, Artificial Sequence
  chemically synthesized
gacagtgtggcgattcctca

SEQ ID NO: 173768 - DNA, 20 bp, Artificial Sequence
  chemically synthesized
tttctagttctagatccttg

SEQ ID NO: 173769 - DNA, 20 bp, Artificial Sequence
  chemically synthesized
gtggcgattcctcaaggatc

SEQ ID NO: 173770 - DNA, 20 bp, Artificial Sequence
  chemically synthesized
atttctagttctagatcctt

SEQ ID NO: 173771 - DNA, 20 bp, Artificial Sequence
  chemically synthesized
attcctcaaggatctagaac

SEQ ID NO: 173772 - DNA, 20 bp, Artificial Sequence
  chemically synthesized
tcaaatggtatttctagttc

SEQ ID NO: 173773 - DNA, 20 bp, Artificial Sequence
  chemically synthesized
gccgggtcaaatggtatttc

SEQ ID NO: 173774 - DNA, 20 bp, Artificial Sequence
  chemically synthesized
actagaaataccatttgacc

SEQ ID NO: 173775 - DNA, 20 bp, Artificial Sequence
  chemically synthesized
aatgggatggccgggtcaaa

SEQ ID NO: 173776 - DNA, 20 bp, Artificial Sequence
  chemically synthesized
tacccagtaatgggatggcc

SEQ ID NO: 173777 - DNA, 20 bp, Artificial Sequence
  chemically synthesized
atacccagtaatgggatggc

SEQ ID NO: 173778 - DNA, 20 bp, Artificial Sequence
  chemically synthesized
gtatatacccagtaatggga

SEQ ID NO: 173779 - DNA, 20 bp, Artificial Sequence
  chemically synthesized
tgacccggccatcccattac

SEQ ID NO: 173780 - DNA, 20 bp, Artificial Sequence
  chemically synthesized
gacccggccatcccattact

SEQ ID NO: 173781 - DNA, 20 bp, Artificial Sequence
  chemically synthesized
ttgggtatatacccagtaat

SEQ ID NO: 173782 - DNA, 20 bp, Artificial Sequence
  chemically synthesized
tttgggtatatacccagtaa

SEQ ID NO: 173783 - DNA, 20 bp, Artificial Sequence
  chemically synthesized
taatcctttgggtatatacc

SEQ ID NO: 173784 - DNA, 20 bp, Artificial Sequence
  chemically synthesized
cattactgggtatataccca

SEQ ID NO: 173785 - DNA, 20 bp, Artificial Sequence
  chemically synthesized
attactgggtatatacccaa

SEQ ID NO: 173786 - DNA, 20 bp, Artificial Sequence
  chemically synthesized
agcatgatttataatccttt

SEQ ID NO: 173787 - DNA, 20 bp, Artificial Sequence
  chemically synthesized
cagcatgatttataatcctt

SEQ ID NO: 173788 - DNA, 20 bp, Artificial Sequence
  chemically synthesized
ttataaatcatgctgctata

SEQ ID NO: 173789 - DNA, 20 bp, Artificial Sequence
  chemically synthesized
gtgtgcatgtgtctttatag

SEQ ID NO: 173790 - DNA, 20 bp, Artificial Sequence
  chemically synthesized
tacgtgtgcatgtgtcttta

SEQ ID NO: 173791 - DNA, 20 bp, Artificial Sequence
  chemically synthesized
atgcacacgtatgtttattg

SEQ ID NO: 173792 - DNA, 20 bp, Artificial Sequence
  chemically synthesized
tattgcggcactattcacaa

SEQ ID NO: 173793 - DNA, 20 bp, Artificial Sequence
  chemically synthesized
caagtctttgctattgtgaa

SEQ ID NO: 173794 - DNA, 20 bp, Artificial Sequence
  chemically synthesized
cggcactattcacaatagca

SEQ ID NO: 173795 - DNA, 20 bp, Artificial Sequence
  chemically synthesized
tattcacaatagcaaagact

SEQ ID NO: 173796 - DNA, 20 bp, Artificial Sequence
  chemically synthesized
tggacatttgggttggttcc

SEQ ID NO: 173797 - DNA, 20 bp, Artificial Sequence
  chemically synthesized
tcactgatggacatttgggt

SEQ ID NO: 173798 - DNA, 20 bp, Artificial Sequence
  chemically synthesized
tctatcactgatggacattt

SEQ ID NO: 173799 - DNA, 20 bp, Artificial Sequence
  chemically synthesized
gtctatcactgatggacatt

SEQ ID NO: 173800 - DNA, 20 bp, Artificial Sequence
  chemically synthesized
gaaccaacccaaatgtccat

SEQ ID NO: 173801 - DNA, 20 bp, Artificial Sequence
  chemically synthesized
acccaaatgtccatcagtga

SEQ ID NO: 173802 - DNA, 20 bp, Artificial Sequence
  chemically synthesized
ttaatccagtctatcactga

SEQ ID NO: 173803 - DNA, 20 bp, Artificial Sequence
  chemically synthesized
aatgtccatcagtgatagac

SEQ ID NO: 173804 - DNA, 20 bp, Artificial Sequence
  chemically synthesized
catcagtgatagactggatt

SEQ ID NO: 173805 - DNA, 20 bp, Artificial Sequence
  chemically synthesized
tgtgccacattttcttaatc

SEQ ID NO: 173806 - DNA, 20 bp, Artificial Sequence
  chemically synthesized
tagactggattaagaaaatg

SEQ ID NO: 173807 - DNA, 20 bp, Artificial Sequence
  chemically synthesized
aatgtggcacatacacacca

SEQ ID NO: 173808 - DNA, 20 bp, Artificial Sequence
  chemically synthesized
tatggttgcgtagtattcca

SEQ ID NO: 173809 - DNA, 20 bp, Artificial Sequence
  chemically synthesized
catccttttttatggttgcg

SEQ ID NO: 173810 - DNA, 20 bp, Artificial Sequence
  chemically synthesized
aatactacgcaaccataaaa

SEQ ID NO: 173811 - DNA, 20 bp, Artificial Sequence
  chemically synthesized
atactacgcaaccataaaaa

SEQ ID NO: 173812 - DNA, 20 bp, Artificial Sequence
  chemically synthesized
aaacaactcatcctttttta

SEQ ID NO: 173813 - DNA, 20 bp, Artificial Sequence
  chemically synthesized
acgcaaccataaaaaaggat

SEQ ID NO: 173814 - DNA, 20 bp, Artificial Sequence
  chemically synthesized
tgagttgtttatgtcctttg

SEQ ID NO: 173815 - DNA, 20 bp, Artificial Sequence
  chemically synthesized
gagttgtttatgtcctttga

SEQ ID NO: 173816 - DNA, 20 bp, Artificial Sequence
  chemically synthesized
agttgtttatgtcctttgaa

SEQ ID NO: 173817 - DNA, 20 bp, Artificial Sequence
  chemically synthesized
cttcatccatgtcccttcaa

SEQ ID NO: 173818 - DNA, 20 bp, Artificial Sequence
  chemically synthesized
gcttcatccatgtcccttca

SEQ ID NO: 173819 - DNA, 20 bp, Artificial Sequence
  chemically synthesized
ttatgtcctttgaagggaca

SEQ ID NO: 173820 - DNA, 20 bp, Artificial Sequence
  chemically synthesized
cctttgaagggacatggatg

SEQ ID NO: 173821 - DNA, 20 bp, Artificial Sequence
  chemically synthesized
tgaagggacatggatgaagc

SEQ ID NO: 173822 - DNA, 20 bp, Artificial Sequence
  chemically synthesized
ttgctcagaatgttggtttc

SEQ ID NO: 173823 - DNA, 20 bp, Artificial Sequence
  chemically synthesized
aagctggaaaccaacattct

SEQ ID NO: 173824 - DNA, 20 bp, Artificial Sequence
  chemically synthesized
tgatagtttgctcagaatgt

SEQ ID NO: 173825 - DNA, 20 bp, Artificial Sequence
  chemically synthesized
tgtccttgtgatagtttgct

SEQ ID NO: 173826 - DNA, 20 bp, Artificial Sequence
  chemically synthesized
cattctgagcaaactatcac

SEQ ID NO: 173827 - DNA, 20 bp, Artificial Sequence
  chemically synthesized
attctgagcaaactatcaca

SEQ ID NO: 173828 - DNA, 20 bp, Artificial Sequence
  chemically synthesized
ttggttttctgtccttgtga

SEQ ID NO: 173829 - DNA, 20 bp, Artificial Sequence
  chemically synthesized
tgagcaaactatcacaagga

SEQ ID NO: 173830 - DNA, 20 bp, Artificial Sequence
  chemically synthesized
gagtgaggacatgcggtgtt

SEQ ID NO: 173831 - DNA, 20 bp, Artificial Sequence
  chemically synthesized
cacctatgagtgaggacatg

SEQ ID NO: 173832 - DNA, 20 bp, Artificial Sequence
  chemically synthesized
acaccgcatgtcctcactca

SEQ ID NO: 173833 - DNA, 20 bp, Artificial Sequence
  chemically synthesized
caccgcatgtcctcactcat

SEQ ID NO: 173834 - DNA, 20 bp, Artificial Sequence
  chemically synthesized
tcaattcccacctatgagtg

SEQ ID NO: 173835 - DNA, 20 bp, Artificial Sequence
  chemically synthesized
ttcaattcccacctatgagt

SEQ ID NO: 173836 - DNA, 20 bp, Artificial Sequence
  chemically synthesized
cgcatgtcctcactcatagg

SEQ ID NO: 173837 - DNA, 20 bp, Artificial Sequence
  chemically synthesized
gcatgtcctcactcataggt

SEQ ID NO: 173838 - DNA, 20 bp, Artificial Sequence
  chemically synthesized
attgttcaattcccacctat

SEQ ID NO: 173839 - DNA, 20 bp, Artificial Sequence
  chemically synthesized
aattgaacaatgaaaacact

SEQ ID NO: 173840 - DNA, 20 bp, Artificial Sequence
  chemically synthesized
acaatgaaaacacttggaca

SEQ ID NO: 173841 - DNA, 20 bp, Artificial Sequence
  chemically synthesized
atgttgcctgcgctgtgtcc

SEQ ID NO: 173842 - DNA, 20 bp, Artificial Sequence
  chemically synthesized
gaaaacacttggacacagcg

SEQ ID NO: 173843 - DNA, 20 bp, Artificial Sequence
  chemically synthesized
aaaacacttggacacagcgc

SEQ ID NO: 173844 - DNA, 20 bp, Artificial Sequence
  chemically synthesized
gcgcaggcaacatcacacac

SEQ ID NO: 173845 - DNA, 20 bp, Artificial Sequence
  chemically synthesized
cgcaggcaacatcacacact

SEQ ID NO: 173846 - DNA, 20 bp, Artificial Sequence
  chemically synthesized
gcaggcaacatcacacactg

SEQ ID NO: 173847 - DNA, 20 bp, Artificial Sequence
  chemically synthesized
ccccaccccacgacaggccc

SEQ ID NO: 173848 - DNA, 20 bp, Artificial Sequence
  chemically synthesized
tcacacactggggcctgtcg

SEQ ID NO: 173849 - DNA, 20 bp, Artificial Sequence
  chemically synthesized
cacacactggggcctgtcgt

SEQ ID NO: 173850 - DNA, 20 bp, Artificial Sequence
  chemically synthesized
acacactggggcctgtcgtg

SEQ ID NO: 173851 - DNA, 20 bp, Artificial Sequence
  chemically synthesized
ccagccccccaccccacgac

SEQ ID NO: 173852 - DNA, 20 bp, Artificial Sequence
  chemically synthesized
cccagccccccaccccacga

SEQ ID NO: 173853 - DNA, 20 bp, Artificial Sequence
  chemically synthesized
cactggggcctgtcgtgggg

SEQ ID NO: 173854 - DNA, 20 bp, Artificial Sequence
  chemically synthesized
actggggcctgtcgtggggt

SEQ ID NO: 173855 - DNA, 20 bp, Artificial Sequence
  chemically synthesized
ctggggcctgtcgtggggtg

SEQ ID NO: 173856 - DNA, 20 bp, Artificial Sequence
  chemically synthesized
tggggcctgtcgtggggtgg

SEQ ID NO: 173857 - DNA, 20 bp, Artificial Sequence
  chemically synthesized
ggggcctgtcgtggggtggg

SEQ ID NO: 173858 - DNA, 20 bp, Artificial Sequence
  chemically synthesized
cctgtcgtggggtggggggc

SEQ ID NO: 173859 - DNA, 20 bp, Artificial Sequence
  chemically synthesized
ctgtcgtggggtggggggct

SEQ ID NO: 173860 - DNA, 20 bp, Artificial Sequence
  chemically synthesized
tgtcgtggggtggggggctg

SEQ ID NO: 173861 - DNA, 20 bp, Artificial Sequence
  chemically synthesized
tcgtggggtggggggctggg

SEQ ID NO: 173862 - DNA, 20 bp, Artificial Sequence
  chemically synthesized
cgtggggtggggggctgggg

SEQ ID NO: 173863 - DNA, 20 bp, Artificial Sequence
  chemically synthesized
gtggggtggggggctgggga

SEQ ID NO: 173864 - DNA, 20 bp, Artificial Sequence
  chemically synthesized
ctcctaatgctatccctccc

SEQ ID NO: 173865 - DNA, 20 bp, Artificial Sequence
  chemically synthesized
ggtggggggctggggaggga

SEQ ID NO: 173866 - DNA, 20 bp, Artificial Sequence
  chemically synthesized
gggctggggagggatagcat

SEQ ID NO: 173867 - DNA, 20 bp, Artificial Sequence
  chemically synthesized
ggctggggagggatagcatt

SEQ ID NO: 173868 - DNA, 20 bp, Artificial Sequence
  chemically synthesized
ctggggagggatagcattag

SEQ ID NO: 173869 - DNA, 20 bp, Artificial Sequence
  chemically synthesized
agggatagcattaggagaaa

SEQ ID NO: 173870 - DNA, 20 bp, Artificial Sequence
  chemically synthesized
cattaactcgtcatttacat

SEQ ID NO: 173871 - DNA, 20 bp, Artificial Sequence
  chemically synthesized
aaatagctaatgtaaatgac

SEQ ID NO: 173872 - DNA, 20 bp, Artificial Sequence
  chemically synthesized
taatgtaaatgacgagttaa

SEQ ID NO: 173873 - DNA, 20 bp, Artificial Sequence
  chemically synthesized
aatgtaaatgacgagttaat

SEQ ID NO: 173874 - DNA, 20 bp, Artificial Sequence
  chemically synthesized
aaatgacgagttaatgggtg

SEQ ID NO: 173875 - DNA, 20 bp, Artificial Sequence
  chemically synthesized
agttaatgggtgcagcacac

SEQ ID NO: 173876 - DNA, 20 bp, Artificial Sequence
  chemically synthesized
atgggtgcagcacaccagca

SEQ ID NO: 173877 - DNA, 20 bp, Artificial Sequence
  chemically synthesized
taggtatgcgtgggccatgc

SEQ ID NO: 173878 - DNA, 20 bp, Artificial Sequence
  chemically synthesized
tttgttacataggtatgcgt

SEQ ID NO: 173879 - DNA, 20 bp, Artificial Sequence
  chemically synthesized
gtttgttacataggtatgcg

SEQ ID NO: 173880 - DNA, 20 bp, Artificial Sequence
  chemically synthesized
aacgtgcaggtttgttacat

SEQ ID NO: 173881 - DNA, 20 bp, Artificial Sequence
  chemically synthesized
caacgtgcaggtttgttaca

SEQ ID NO: 173882 - DNA, 20 bp, Artificial Sequence
  chemically synthesized
ggtacatgtgcacaacgtgc

SEQ ID NO: 173883 - DNA, 20 bp, Artificial Sequence
  chemically synthesized
gggtacatgtgcacaacgtg

SEQ ID NO: 173884 - DNA, 20 bp, Artificial Sequence
  chemically synthesized
cacgttgtgcacatgtaccc

SEQ ID NO: 173885 - DNA, 20 bp, Artificial Sequence
  chemically synthesized
tatatatacttgaagttcta

SEQ ID NO: 173886 - DNA, 20 bp, Artificial Sequence
  chemically synthesized
atatatatacttgaagttct

SEQ ID NO: 173887 - DNA, 20 bp, Artificial Sequence
  chemically synthesized
cacatgtaccctagaacttc

SEQ ID NO: 173888 - DNA, 20 bp, Artificial Sequence
  chemically synthesized
tatatatatacttgaagttc

SEQ ID NO: 173889 - DNA, 20 bp, Artificial Sequence
  chemically synthesized
taagtatatatatatacttg

SEQ ID NO: 173890 - DNA, 20 bp, Artificial Sequence
  chemically synthesized
tttcatataagtatatatat

SEQ ID NO: 173891 - DNA, 20 bp, Artificial Sequence
  chemically synthesized
ttatatatatacttatatga

SEQ ID NO: 173892 - DNA, 20 bp, Artificial Sequence
  chemically synthesized
attccctacatctttcatat

SEQ ID NO: 173893 - DNA, 20 bp, Artificial Sequence
  chemically synthesized
atatacttatatgaaagatg

SEQ ID NO: 173894 - DNA, 20 bp, Artificial Sequence
  chemically synthesized
tatacttatatgaaagatgt

SEQ ID NO: 173895 - DNA, 20 bp, Artificial Sequence
  chemically synthesized
atacttatatgaaagatgta

SEQ ID NO: 173896 - DNA, 20 bp, Artificial Sequence
  chemically synthesized
tatgaaagatgtagggaatt

SEQ ID NO: 173897 - DNA, 20 bp, Artificial Sequence
  chemically synthesized
aagatgtagggaattaagct

SEQ ID NO: 173898 - DNA, 20 bp, Artificial Sequence
  chemically synthesized
gatgtagggaattaagcttg

SEQ ID NO: 173899 - DNA, 20 bp, Artificial Sequence
  chemically synthesized
ccttcagatctaataactcc

SEQ ID NO: 173900 - DNA, 20 bp, Artificial Sequence
  chemically synthesized
ggaattaagcttggagttat

SEQ ID NO: 173901 - DNA, 20 bp, Artificial Sequence
  chemically synthesized
gcttggagttattagatctg

SEQ ID NO: 173902 - DNA, 20 bp, Artificial Sequence
  chemically synthesized
cttggagttattagatctga

SEQ ID NO: 173903 - DNA, 20 bp, Artificial Sequence
  chemically synthesized
ttggagttattagatctgaa

SEQ ID NO: 173904 - DNA, 20 bp, Artificial Sequence
  chemically synthesized
agttattagatctgaagggc

SEQ ID NO: 173905 - DNA, 20 bp, Artificial Sequence
  chemically synthesized
gttattagatctgaagggca

SEQ ID NO: 173906 - DNA, 20 bp, Artificial Sequence
  chemically synthesized
accctgtcccccttgccctt

SEQ ID NO: 173907 - DNA, 20 bp, Artificial Sequence
  chemically synthesized
ttattagatctgaagggcaa

SEQ ID NO: 173908 - DNA, 20 bp, Artificial Sequence
  chemically synthesized
tattagatctgaagggcaag

SEQ ID NO: 173909 - DNA, 20 bp, Artificial Sequence
  chemically synthesized
attagatctgaagggcaagg

SEQ ID NO: 173910 - DNA, 20 bp, Artificial Sequence
  chemically synthesized
gatctgaagggcaaggggga

SEQ ID NO: 173911 - DNA, 20 bp, Artificial Sequence
  chemically synthesized
atctgaagggcaagggggac

SEQ ID NO: 173912 - DNA, 20 bp, Artificial Sequence
  chemically synthesized
tctgaagggcaagggggaca

SEQ ID NO: 173913 - DNA, 20 bp, Artificial Sequence
  chemically synthesized
ccctgtagagcagcagttga

SEQ ID NO: 173914 - DNA, 20 bp, Artificial Sequence
  chemically synthesized
gttatgcccctgtagagcag

SEQ ID NO: 173915 - DNA, 20 bp, Artificial Sequence
  chemically synthesized
atctatcaactgctgctcta

SEQ ID NO: 173916 - DNA, 20 bp, Artificial Sequence
  chemically synthesized
tctatcaactgctgctctac

SEQ ID NO: 173917 - DNA, 20 bp, Artificial Sequence
  chemically synthesized
ctatcaactgctgctctaca

SEQ ID NO: 173918 - DNA, 20 bp, Artificial Sequence
  chemically synthesized
gcagttatgcccctgtagag

SEQ ID NO: 173919 - DNA, 20 bp, Artificial Sequence
  chemically synthesized
tatcaactgctgctctacag

SEQ ID NO: 173920 - DNA, 20 bp, Artificial Sequence
  chemically synthesized
gtagcagttatgcccctgta

SEQ ID NO: 173921 - DNA, 20 bp, Artificial Sequence
  chemically synthesized
atgtagcagttatgcccctg

SEQ ID NO: 173922 - DNA, 20 bp, Artificial Sequence
  chemically synthesized
gggagagagcagaaatgtag

SEQ ID NO: 173923 - DNA, 20 bp, Artificial Sequence
  chemically synthesized
cttgggagagagcagaaatg

SEQ ID NO: 173924 - DNA, 20 bp, Artificial Sequence
  chemically synthesized
tgctcattcttgggagagag

SEQ ID NO: 173925 - DNA, 20 bp, Artificial Sequence
  chemically synthesized
ctacatttctgctctctccc

SEQ ID NO: 173926 - DNA, 20 bp, Artificial Sequence
  chemically synthesized
ctctgctcattcttgggaga

SEQ ID NO: 173927 - DNA, 20 bp, Artificial Sequence
  chemically synthesized
atctctgctcattcttggga

SEQ ID NO: 173928 - DNA, 20 bp, Artificial Sequence
  chemically synthesized
ctatctctgctcattcttgg

SEQ ID NO: 173929 - DNA, 20 bp, Artificial Sequence
  chemically synthesized
ttctgctctctcccaagaat

SEQ ID NO: 173930 - DNA, 20 bp, Artificial Sequence
  chemically synthesized
ggctatctctgctcattctt

SEQ ID NO: 173931 - DNA, 20 bp, Artificial Sequence
  chemically synthesized
gggctatctctgctcattct

SEQ ID NO: 173932 - DNA, 20 bp, Artificial Sequence
  chemically synthesized
tgctctctcccaagaatgag

SEQ ID NO: 173933 - DNA, 20 bp, Artificial Sequence
  chemically synthesized
ctctctcccaagaatgagca

SEQ ID NO: 173934 - DNA, 20 bp, Artificial Sequence
  chemically synthesized
ctcccaagaatgagcagaga

SEQ ID NO: 173935 - DNA, 20 bp, Artificial Sequence
  chemically synthesized
gaatgagcagagatagcccc

SEQ ID NO: 173936 - DNA, 20 bp, Artificial Sequence
  chemically synthesized
agcagagatagccccaagca

SEQ ID NO: 173937 - DNA, 20 bp, Artificial Sequence
  chemically synthesized
tacttgcatctctttgcttg

SEQ ID NO: 173938 - DNA, 20 bp, Artificial Sequence
  chemically synthesized
cagagatagccccaagcaaa

SEQ ID NO: 173939 - DNA, 20 bp, Artificial Sequence
  chemically synthesized
gtacttgcatctctttgctt

SEQ ID NO: 173940 - DNA, 20 bp, Artificial Sequence
  chemically synthesized
tgtacttgcatctctttgct

SEQ ID NO: 173941 - DNA, 20 bp, Artificial Sequence
  chemically synthesized
agccccaagcaaagagatgc

SEQ ID NO: 173942 - DNA, 20 bp, Artificial Sequence
  chemically synthesized
caagcaaagagatgcaagta

SEQ ID NO: 173943 - DNA, 20 bp, Artificial Sequence
  chemically synthesized
aagcaaagagatgcaagtac

SEQ ID NO: 173944 - DNA, 20 bp, Artificial Sequence
  chemically synthesized
caaagagatgcaagtacagg

SEQ ID NO: 173945 - DNA, 20 bp, Artificial Sequence
  chemically synthesized
gagatgcaagtacaggaagt

SEQ ID NO: 173946 - DNA, 20 bp, Artificial Sequence
  chemically synthesized
agtacaggaagttggaaatt

SEQ ID NO: 173947 - DNA, 20 bp, Artificial Sequence
  chemically synthesized
acaggaagttggaaattaag

SEQ ID NO: 173948 - DNA, 20 bp, Artificial Sequence
  chemically synthesized
ttaagaagcacgtataaaaa

SEQ ID NO: 173949 - DNA, 20 bp, Artificial Sequence
  chemically synthesized
gaagcacgtataaaaatggt

SEQ ID NO: 173950 - DNA, 20 bp, Artificial Sequence
  chemically synthesized
tataaaaatggtaagtgcta

SEQ ID NO: 173951 - DNA, 20 bp, Artificial Sequence
  chemically synthesized
ataaaaatggtaagtgctaa

SEQ ID NO: 173952 - DNA, 20 bp, Artificial Sequence
  chemically synthesized
taaaaatggtaagtgctaaa

SEQ ID NO: 173953 - DNA, 20 bp, Artificial Sequence
  chemically synthesized
gtgccccaccgatatccctt

SEQ ID NO: 173954 - DNA, 20 bp, Artificial Sequence
  chemically synthesized
ggtaagtgctaaagggatat

SEQ ID NO: 173955 - DNA, 20 bp, Artificial Sequence
  chemically synthesized
aagtgctaaagggatatcgg

SEQ ID NO: 173956 - DNA, 20 bp, Artificial Sequence
  chemically synthesized
agtgctaaagggatatcggt

SEQ ID NO: 173957 - DNA, 20 bp, Artificial Sequence
  chemically synthesized
gtgctaaagggatatcggtg

SEQ ID NO: 173958 - DNA, 20 bp, Artificial Sequence
  chemically synthesized
ggatatcggtggggcaccga

SEQ ID NO: 173959 - DNA, 20 bp, Artificial Sequence
  chemically synthesized
ggtgttgtagcagatactgt

SEQ ID NO: 173960 - DNA, 20 bp, Artificial Sequence
  chemically synthesized
aaatgtatgaggtgttgtag

SEQ ID NO: 173961 - DNA, 20 bp, Artificial Sequence
  chemically synthesized
aaaaaatgtatgaggtgttg

SEQ ID NO: 173962 - DNA, 20 bp, Artificial Sequence
  chemically synthesized
atttaaggaaaaaatgtatg

SEQ ID NO: 173963 - DNA, 20 bp, Artificial Sequence
  chemically synthesized
catttaaggaaaaaatgtat

SEQ ID NO: 173964 - DNA, 20 bp, Artificial Sequence
  chemically synthesized
caggttgtggagatcattta

SEQ ID NO: 173965 - DNA, 20 bp, Artificial Sequence
  chemically synthesized
gcaggttgtggagatcattt

SEQ ID NO: 173966 - DNA, 20 bp, Artificial Sequence
  chemically synthesized
ccaaatgtaggcaggttgtg

SEQ ID NO: 173967 - DNA, 20 bp, Artificial Sequence
  chemically synthesized
ttccaaatgtaggcaggttg

SEQ ID NO: 173968 - DNA, 20 bp, Artificial Sequence
  chemically synthesized
aatactttccaaatgtaggc

SEQ ID NO: 173969 - DNA, 20 bp, Artificial Sequence
  chemically synthesized
caatactttccaaatgtagg

SEQ ID NO: 173970 - DNA, 20 bp, Artificial Sequence
  chemically synthesized
ctccacaacctgcctacatt

SEQ ID NO: 173971 - DNA, 20 bp, Artificial Sequence
  chemically synthesized
caacaatactttccaaatgt

SEQ ID NO: 173972 - DNA, 20 bp, Artificial Sequence
  chemically synthesized
acaacaatactttccaaatg

SEQ ID NO: 173973 - DNA, 20 bp, Artificial Sequence
  chemically synthesized
acaacctgcctacatttgga

SEQ ID NO: 173974 - DNA, 20 bp, Artificial Sequence
  chemically synthesized
gtaatgtcaaaattaccatt

SEQ ID NO: 173975 - DNA, 20 bp, Artificial Sequence
  chemically synthesized
agtcaattaatgaaactgaa

SEQ ID NO: 173976 - DNA, 20 bp, Artificial Sequence
  chemically synthesized
cattaattgactaaaaaatc

SEQ ID NO: 173977 - DNA, 20 bp, Artificial Sequence
  chemically synthesized
attgctttgacttgattttt

SEQ ID NO: 173978 - DNA, 20 bp, Artificial Sequence
  chemically synthesized
ttgactaaaaaatcaagtca

SEQ ID NO: 173979 - DNA, 20 bp, Artificial Sequence
  chemically synthesized
atcaagtcaaagcaatgtga

SEQ ID NO: 173980 - DNA, 20 bp, Artificial Sequence
  chemically synthesized
caaagcaatgtgacagatat

SEQ ID NO: 173981 - DNA, 20 bp, Artificial Sequence
  chemically synthesized
gcaatgtgacagatattggt

SEQ ID NO: 173982 - DNA, 20 bp, Artificial Sequence
  chemically synthesized
atagatagatgaattaggaa

SEQ ID NO: 173983 - DNA, 20 bp, Artificial Sequence
  chemically synthesized
acagaatagatagatgaatt

SEQ ID NO: 173984 - DNA, 20 bp, Artificial Sequence
  chemically synthesized
gacagaatagatagatgaat

SEQ ID NO: 173985 - DNA, 20 bp, Artificial Sequence
  chemically synthesized
agacaggtagacagaataga

SEQ ID NO: 173986 - DNA, 20 bp, Artificial Sequence
  chemically synthesized
aaacagacaggtagacagaa

SEQ ID NO: 173987 - DNA, 20 bp, Artificial Sequence
  chemically synthesized
ctgataaacagacaggtaga

SEQ ID NO: 173988 - DNA, 20 bp, Artificial Sequence
  chemically synthesized
ttgactgataaacagacagg

SEQ ID NO: 173989 - DNA, 20 bp, Artificial Sequence
  chemically synthesized
tgattgactgataaacagac

SEQ ID NO: 173990 - DNA, 20 bp, Artificial Sequence
  chemically synthesized
atgattgactgataaacaga

SEQ ID NO: 173991 - DNA, 20 bp, Artificial Sequence
  chemically synthesized
ctgtctacctgtctgtttat

SEQ ID NO: 173992 - DNA, 20 bp, Artificial Sequence
  chemically synthesized
aaagatgattgactgataaa

SEQ ID NO: 173993 - DNA, 20 bp, Artificial Sequence
  chemically synthesized
tcaaaggaacgtaagggtga

SEQ ID NO: 173994 - DNA, 20 bp, Artificial Sequence
  chemically synthesized
agttcctcaaaggaacgtaa

SEQ ID NO: 173995 - DNA, 20 bp, Artificial Sequence
  chemically synthesized
aagttcctcaaaggaacgta

SEQ ID NO: 173996 - DNA, 20 bp, Artificial Sequence
  chemically synthesized
aaagttcctcaaaggaacgt

SEQ ID NO: 173997 - DNA, 20 bp, Artificial Sequence
  chemically synthesized
tttcacccttacgttccttt

SEQ ID NO: 173998 - DNA, 20 bp, Artificial Sequence
  chemically synthesized
ttcacccttacgttcctttg

SEQ ID NO: 173999 - DNA, 20 bp, Artificial Sequence
  chemically synthesized
gtaggtgcaaagttcctcaa

SEQ ID NO: 174000 - DNA, 20 bp, Artificial Sequence
  chemically synthesized
agtaggtgcaaagttcctca

SEQ ID NO: 174001 - DNA, 20 bp, Artificial Sequence
  chemically synthesized
aaggtagagaagtaggtgca

SEQ ID NO: 174002 - DNA, 20 bp, Artificial Sequence
  chemically synthesized
cacaacaaaggtagagaagt

SEQ ID NO: 174003 - DNA, 20 bp, Artificial Sequence
  chemically synthesized
ccacaacaaaggtagagaag

SEQ ID NO: 174004 - DNA, 20 bp, Artificial Sequence
  chemically synthesized
gcaccacaacaaaggtagag

SEQ ID NO: 174005 - DNA, 20 bp, Artificial Sequence
  chemically synthesized
gctgcaccacaacaaaggta

SEQ ID NO: 174006 - DNA, 20 bp, Artificial Sequence
  chemically synthesized
cagctgcaccacaacaaagg

SEQ ID NO: 174007 - DNA, 20 bp, Artificial Sequence
  chemically synthesized
ctacttctctacctttgttg

SEQ ID NO: 174008 - DNA, 20 bp, Artificial Sequence
  chemically synthesized
ctacagctgcaccacaacaa

SEQ ID NO: 174009 - DNA, 20 bp, Artificial Sequence
  chemically synthesized
tctacagctgcaccacaaca

SEQ ID NO: 174010 - DNA, 20 bp, Artificial Sequence
  chemically synthesized
tctctacctttgttgtggtg

SEQ ID NO: 174011 - DNA, 20 bp, Artificial Sequence
  chemically synthesized
cctttgttgtggtgcagctg

SEQ ID NO: 174012 - DNA, 20 bp, Artificial Sequence
  chemically synthesized
tttgttgtggtgcagctgta

SEQ ID NO: 174013 - DNA, 20 bp, Artificial Sequence
  chemically synthesized
tgtggtgcagctgtagagtt

SEQ ID NO: 174014 - DNA, 20 bp, Artificial Sequence
  chemically synthesized
taaatctcaaccaaactcta

SEQ ID NO: 174015 - DNA, 20 bp, Artificial Sequence
  chemically synthesized
tgcagctgtagagtttggtt

SEQ ID NO: 174016 - DNA, 20 bp, Artificial Sequence
  chemically synthesized
ggttgagatttaatgacttt

SEQ ID NO: 174017 - DNA, 20 bp, Artificial Sequence
  chemically synthesized
gatttaatgacttttagctg

SEQ ID NO: 174018 - DNA, 20 bp, Artificial Sequence
  chemically synthesized
cacctcacttctacagctaa

SEQ ID NO: 174019 - DNA, 20 bp, Artificial Sequence
  chemically synthesized
ttaatgacttttagctgtag

SEQ ID NO: 174020 - DNA, 20 bp, Artificial Sequence
  chemically synthesized
tgacttttagctgtagaagt

SEQ ID NO: 174021 - DNA, 20 bp, Artificial Sequence
  chemically synthesized
taaatcacacctcacttcta

SEQ ID NO: 174022 - DNA, 20 bp, Artificial Sequence
  chemically synthesized
gacttttagctgtagaagtg

SEQ ID NO: 174023 - DNA, 20 bp, Artificial Sequence
  chemically synthesized
tgtagaagtgaggtgtgatt

SEQ ID NO: 174024 - DNA, 20 bp, Artificial Sequence
  chemically synthesized
aagtgaggtgtgatttagta

SEQ ID NO: 174025 - DNA, 20 bp, Artificial Sequence
  chemically synthesized
agtgaggtgtgatttagtac

SEQ ID NO: 174026 - DNA, 20 bp, Artificial Sequence
  chemically synthesized
gtgtgatttagtacaggaat

SEQ ID NO: 174027 - DNA, 20 bp, Artificial Sequence
  chemically synthesized
aatgagcatgtgacctaatt

SEQ ID NO: 174028 - DNA, 20 bp, Artificial Sequence
  chemically synthesized
atgagcatgtgacctaattc

SEQ ID NO: 174029 - DNA, 20 bp, Artificial Sequence
  chemically synthesized
gaaactgactggcctgaatt

SEQ ID NO: 174030 - DNA, 20 bp, Artificial Sequence
  chemically synthesized
tgaaactgactggcctgaat

SEQ ID NO: 174031 - DNA, 20 bp, Artificial Sequence
  chemically synthesized
gcatgtgacctaattcaggc

SEQ ID NO: 174032 - DNA, 20 bp, Artificial Sequence
  chemically synthesized
gtgacctaattcaggccagt

SEQ ID NO: 174033 - DNA, 20 bp, Artificial Sequence
  chemically synthesized
aagactgctctgaaactgac

SEQ ID NO: 174034 - DNA, 20 bp, Artificial Sequence
  chemically synthesized
taattcaggccagtcagttt

SEQ ID NO: 174035 - DNA, 20 bp, Artificial Sequence
  chemically synthesized
attcaggccagtcagtttca

SEQ ID NO: 174036 - DNA, 20 bp, Artificial Sequence
  chemically synthesized
caggccagtcagtttcagag

SEQ ID NO: 174037 - DNA, 20 bp, Artificial Sequence
  chemically synthesized
agtttcagagcagtctttcc

SEQ ID NO: 174038 - DNA, 20 bp, Artificial Sequence
  chemically synthesized
ctttcccaaagcatccagga

SEQ ID NO: 174039 - DNA, 20 bp, Artificial Sequence
  chemically synthesized
ccttctttcccaaagcatcc

SEQ ID NO: 174040 - DNA, 20 bp, Artificial Sequence
  chemically synthesized
gcagtctttcctggatgctt

SEQ ID NO: 174041 - DNA, 20 bp, Artificial Sequence
  chemically synthesized
accttctttcccaaagcatc

SEQ ID NO: 174042 - DNA, 20 bp, Artificial Sequence
  chemically synthesized
cagtctttcctggatgcttt

SEQ ID NO: 174043 - DNA, 20 bp, Artificial Sequence
  chemically synthesized
ctttcctggatgctttggga

SEQ ID NO: 174044 - DNA, 20 bp, Artificial Sequence
  chemically synthesized
tttagggaccttctttccca

SEQ ID NO: 174045 - DNA, 20 bp, Artificial Sequence
  chemically synthesized
tcctggatgctttgggaaag

SEQ ID NO: 174046 - DNA, 20 bp, Artificial Sequence
  chemically synthesized
cctggatgctttgggaaaga

SEQ ID NO: 174047 - DNA, 20 bp, Artificial Sequence
  chemically synthesized
tttgggaaagaaggtcccta

SEQ ID NO: 174048 - DNA, 20 bp, Artificial Sequence
  chemically synthesized
tgggaaagaaggtccctaaa

SEQ ID NO: 174049 - DNA, 20 bp, Artificial Sequence
  chemically synthesized
tgatgaaaatcatctcttta

SEQ ID NO: 174050 - DNA, 20 bp, Artificial Sequence
  chemically synthesized
ttgatgaaaatcatctcttt

SEQ ID NO: 174051 - DNA, 20 bp, Artificial Sequence
  chemically synthesized
tttgatgaaaatcatctctt

SEQ ID NO: 174052 - DNA, 20 bp, Artificial Sequence
  chemically synthesized
aaagagatgattttcatcaa

SEQ ID NO: 174053 - DNA, 20 bp, Artificial Sequence
  chemically synthesized
agatgattttcatcaaaagt

SEQ ID NO: 174054 - DNA, 20 bp, Artificial Sequence
  chemically synthesized
tttcatcaaaagtaagtttg

SEQ ID NO: 174055 - DNA, 20 bp, Artificial Sequence
  chemically synthesized
caaaagtaagtttgcagatg

SEQ ID NO: 174056 - DNA, 20 bp, Artificial Sequence
  chemically synthesized
aaaagtaagtttgcagatgt

SEQ ID NO: 174057 - DNA, 20 bp, Artificial Sequence
  chemically synthesized
tgcagatgtgggttctgaaa

SEQ ID NO: 174058 - DNA, 20 bp, Artificial Sequence
  chemically synthesized
aaaatggcctgaagccgttt

SEQ ID NO: 174059 - DNA, 20 bp, Artificial Sequence
  chemically synthesized
tgtgggttctgaaacggctt

SEQ ID NO: 174060 - DNA, 20 bp, Artificial Sequence
  chemically synthesized
gtgggttctgaaacggcttc

SEQ ID NO: 174061 - DNA, 20 bp, Artificial Sequence
  chemically synthesized
ttggtgacaaaaatggcctg

SEQ ID NO: 174062 - DNA, 20 bp, Artificial Sequence
  chemically synthesized
ttccctcttggtgacaaaaa

SEQ ID NO: 174063 - DNA, 20 bp, Artificial Sequence
  chemically synthesized
ttcaggccatttttgtcacc

SEQ ID NO: 174064 - DNA, 20 bp, Artificial Sequence
  chemically synthesized
caggccatttttgtcaccaa

SEQ ID NO: 174065 - DNA, 20 bp, Artificial Sequence
  chemically synthesized
aggccatttttgtcaccaag

SEQ ID NO: 174066 - DNA, 20 bp, Artificial Sequence
  chemically synthesized
ggccatttttgtcaccaaga

SEQ ID NO: 174067 - DNA, 20 bp, Artificial Sequence
  chemically synthesized
catttttgtcaccaagaggg

SEQ ID NO: 174068 - DNA, 20 bp, Artificial Sequence
  chemically synthesized
gcttcacctgacttccctct

SEQ ID NO: 174069 - DNA, 20 bp, Artificial Sequence
  chemically synthesized
tttgtcaccaagagggaagt

SEQ ID NO: 174070 - DNA, 20 bp, Artificial Sequence
  chemically synthesized
ttgtcaccaagagggaagtc

SEQ ID NO: 174071 - DNA, 20 bp, Artificial Sequence
  chemically synthesized
accaagagggaagtcaggtg

SEQ ID NO: 174072 - DNA, 20 bp, Artificial Sequence
  chemically synthesized
gggaagtcaggtgaagctgc

SEQ ID NO: 174073 - DNA, 20 bp, Artificial Sequence
  chemically synthesized
ggaagtcaggtgaagctgct

SEQ ID NO: 174074 - DNA, 20 bp, Artificial Sequence
  chemically synthesized
atttttctgtgttgacctag

SEQ ID NO: 174075 - DNA, 20 bp, Artificial Sequence
  chemically synthesized
tctatttttctgtgttgacc

SEQ ID NO: 174076 - DNA, 20 bp, Artificial Sequence
  chemically synthesized
gtgaagctgctaggtcaaca

SEQ ID NO: 174077 - DNA, 20 bp, Artificial Sequence
  chemically synthesized
gctaggtcaacacagaaaaa

SEQ ID NO: 174078 - DNA, 20 bp, Artificial Sequence
  chemically synthesized
caacacagaaaaatagaacc

SEQ ID NO: 174079 - DNA, 20 bp, Artificial Sequence
  chemically synthesized
acacagaaaaatagaaccca

SEQ ID NO: 174080 - DNA, 20 bp, Artificial Sequence
  chemically synthesized
tttttttttcacatttctct

SEQ ID NO: 174081 - DNA, 20 bp, Artificial Sequence
  chemically synthesized
ttttttttttcacatttctc

SEQ ID NO: 174082 - DNA, 20 bp, Artificial Sequence
  chemically synthesized
gaaaaaaaaaaaaaaaaaac

SEQ ID NO: 174083 - DNA, 20 bp, Artificial Sequence
  chemically synthesized
aaaaacaagaaacaaaaaac

SEQ ID NO: 174084 - DNA, 20 bp, Artificial Sequence
  chemically synthesized
aataaatatgatcaaggttc

SEQ ID NO: 174085 - DNA, 20 bp, Artificial Sequence
  chemically synthesized
ttaaacaataaatatgatca

SEQ ID NO: 174086 - DNA, 20 bp, Artificial Sequence
  chemically synthesized
tttaaacaataaatatgatc

SEQ ID NO: 174087 - DNA, 20 bp, Artificial Sequence
  chemically synthesized
atcatatttattgtttaaat

SEQ ID NO: 174088 - DNA, 20 bp, Artificial Sequence
  chemically synthesized
tttattgtttaaatcagttt

SEQ ID NO: 174089 - DNA, 20 bp, Artificial Sequence
  chemically synthesized
tgtttaaatcagtttgagac

SEQ ID NO: 174090 - DNA, 20 bp, Artificial Sequence
  chemically synthesized
tgctgtaagtgacagaaaac

SEQ ID NO: 174091 - DNA, 20 bp, Artificial Sequence
  chemically synthesized
gaccagttttctgtcactta

SEQ ID NO: 174092 - DNA, 20 bp, Artificial Sequence
  chemically synthesized
tctcttaatgctgtaagtga

SEQ ID NO: 174093 - DNA, 20 bp, Artificial Sequence
  chemically synthesized
attggttctcttaatgctgt

SEQ ID NO: 174094 - DNA, 20 bp, Artificial Sequence
  chemically synthesized
tttctgtcacttacagcatt

SEQ ID NO: 174095 - DNA, 20 bp, Artificial Sequence
  chemically synthesized
tctgtcacttacagcattaa

SEQ ID NO: 174096 - DNA, 20 bp, Artificial Sequence
  chemically synthesized
tacagcattaagagaaccaa

SEQ ID NO: 174097 - DNA, 20 bp, Artificial Sequence
  chemically synthesized
aactgacttaatgcgtctat

SEQ ID NO: 174098 - DNA, 20 bp, Artificial Sequence
  chemically synthesized
agagaaccaatagacgcatt

SEQ ID NO: 174099 - DNA, 20 bp, Artificial Sequence
  chemically synthesized
aaccaatagacgcattaagt

SEQ ID NO: 174100 - DNA, 20 bp, Artificial Sequence
  chemically synthesized
cgcattaagtcagttactta

SEQ ID NO: 174101 - DNA, 20 bp, Artificial Sequence
  chemically synthesized
gcattaagtcagttacttac

SEQ ID NO: 174102 - DNA, 20 bp, Artificial Sequence
  chemically synthesized
gttctaactaatatgcctgt

SEQ ID NO: 174103 - DNA, 20 bp, Artificial Sequence
  chemically synthesized
tcagttacttacaggcatat

SEQ ID NO: 174104 - DNA, 20 bp, Artificial Sequence
  chemically synthesized
ttacttacaggcatattagt

SEQ ID NO: 174105 - DNA, 20 bp, Artificial Sequence
  chemically synthesized
tgtgaagtgtcatggaggat

SEQ ID NO: 174106 - DNA, 20 bp, Artificial Sequence
  chemically synthesized
ccttctgtgaagtgtcatgg

SEQ ID NO: 174107 - DNA, 20 bp, Artificial Sequence
  chemically synthesized
accttctgtgaagtgtcatg

SEQ ID NO: 174108 - DNA, 20 bp, Artificial Sequence
  chemically synthesized
tcaccttctgtgaagtgtca

SEQ ID NO: 174109 - DNA, 20 bp, Artificial Sequence
  chemically synthesized
taatcctccatgacacttca

SEQ ID NO: 174110 - DNA, 20 bp, Artificial Sequence
  chemically synthesized
tcctccatgacacttcacag

SEQ ID NO: 174111 - DNA, 20 bp, Artificial Sequence
  chemically synthesized
cctccatgacacttcacaga

SEQ ID NO: 174112 - DNA, 20 bp, Artificial Sequence
  chemically synthesized
atgaatcttcaccttctgtg

SEQ ID NO: 174113 - DNA, 20 bp, Artificial Sequence
  chemically synthesized
atgacacttcacagaaggtg

SEQ ID NO: 174114 - DNA, 20 bp, Artificial Sequence
  chemically synthesized
atgatattcaagtaaaatga

SEQ ID NO: 174115 - DNA, 20 bp, Artificial Sequence
  chemically synthesized
gagagatttttatgatattc

SEQ ID NO: 174116 - DNA, 20 bp, Artificial Sequence
  chemically synthesized
tgaatatcataaaaatctct

SEQ ID NO: 174117 - DNA, 20 bp, Artificial Sequence
  chemically synthesized
tatcataaaaatctctcggt

SEQ ID NO: 174118 - DNA, 20 bp, Artificial Sequence
  chemically synthesized
tatttgttaacactaaccga

SEQ ID NO: 174119 - DNA, 20 bp, Artificial Sequence
  chemically synthesized
attatttgttaacactaacc

SEQ ID NO: 174120 - DNA, 20 bp, Artificial Sequence
  chemically synthesized
cggttagtgttaacaaataa

SEQ ID NO: 174121 - DNA, 20 bp, Artificial Sequence
  chemically synthesized
tttaggtgttagaaaaacga

SEQ ID NO: 174122 - DNA, 20 bp, Artificial Sequence
  chemically synthesized
tgaaatatggttttaggtgt

SEQ ID NO: 174123 - DNA, 20 bp, Artificial Sequence
  chemically synthesized
ggattatgaaatatggtttt

SEQ ID NO: 174124 - DNA, 20 bp, Artificial Sequence
  chemically synthesized
gggattatgaaatatggttt

SEQ ID NO: 174125 - DNA, 20 bp, Artificial Sequence
  chemically synthesized
cattatgggattatgaaata

SEQ ID NO: 174126 - DNA, 20 bp, Artificial Sequence
  chemically synthesized
ttcacactatttcacattat

SEQ ID NO: 174127 - DNA, 20 bp, Artificial Sequence
  chemically synthesized
attcacactatttcacatta

SEQ ID NO: 174128 - DNA, 20 bp, Artificial Sequence
  chemically synthesized
cataatcccataatgtgaaa

SEQ ID NO: 174129 - DNA, 20 bp, Artificial Sequence
  chemically synthesized
atagtgtgaataatatgtaa

SEQ ID NO: 174130 - DNA, 20 bp, Artificial Sequence
  chemically synthesized
acagttcaaacattatgttc

SEQ ID NO: 174131 - DNA, 20 bp, Artificial Sequence
  chemically synthesized
gttcaaacattatgttccag

SEQ ID NO: 174132 - DNA, 20 bp, Artificial Sequence
  chemically synthesized
tcaaacattatgttccagaa

SEQ ID NO: 174133 - DNA, 20 bp, Artificial Sequence
  chemically synthesized
aaacattatgttccagaaga

SEQ ID NO: 174134 - DNA, 20 bp, Artificial Sequence
  chemically synthesized
acattatgttccagaagaga

SEQ ID NO: 174135 - DNA, 20 bp, Artificial Sequence
  chemically synthesized
aaataaaaatctctctcttc

SEQ ID NO: 174136 - DNA, 20 bp, Artificial Sequence
  chemically synthesized
tctggagttcaaaaaataga

SEQ ID NO: 174137 - DNA, 20 bp, Artificial Sequence
  chemically synthesized
tctctctggagttcaaaaaa

SEQ ID NO: 174138 - DNA, 20 bp, Artificial Sequence
  chemically synthesized
tctttctattttttgaactc

SEQ ID NO: 174139 - DNA, 20 bp, Artificial Sequence
  chemically synthesized
tttctattttttgaactcca

SEQ ID NO: 174140 - DNA, 20 bp, Artificial Sequence
  chemically synthesized
tctattttttgaactccaga

SEQ ID NO: 174141 - DNA, 20 bp, Artificial Sequence
  chemically synthesized
tattttttgaactccagaga

SEQ ID NO: 174142 - DNA, 20 bp, Artificial Sequence
  chemically synthesized
aatttaaaaatctctctctg

SEQ ID NO: 174143 - DNA, 20 bp, Artificial Sequence
  chemically synthesized
caaatttaaaaatctctctc

SEQ ID NO: 174144 - DNA, 20 bp, Artificial Sequence
  chemically synthesized
gagagagatttttaaatttg

SEQ ID NO: 174145 - DNA, 20 bp, Artificial Sequence
  chemically synthesized
gatttttaaatttgcagttt

SEQ ID NO: 174146 - DNA, 20 bp, Artificial Sequence
  chemically synthesized
ttaaatttgcagtttgagat

SEQ ID NO: 174147 - DNA, 20 bp, Artificial Sequence
  chemically synthesized
aaatttgcagtttgagatta

SEQ ID NO: 174148 - DNA, 20 bp, Artificial Sequence
  chemically synthesized
ttgagattagagctttccaa

SEQ ID NO: 174149 - DNA, 20 bp, Artificial Sequence
  chemically synthesized
taaacacttcagctgttgga

SEQ ID NO: 174150 - DNA, 20 bp, Artificial Sequence
  chemically synthesized
ttagagctttccaacagctg

SEQ ID NO: 174151 - DNA, 20 bp, Artificial Sequence
  chemically synthesized
atagtaaacacttcagctgt

SEQ ID NO: 174152 - DNA, 20 bp, Artificial Sequence
  chemically synthesized
tctcaaaatagtaaacactt

SEQ ID NO: 174153 - DNA, 20 bp, Artificial Sequence
  chemically synthesized
gctgaagtgtttactatttt

SEQ ID NO: 174154 - DNA, 20 bp, Artificial Sequence
  chemically synthesized
tgaagtgtttactattttga

SEQ ID NO: 174155 - DNA, 20 bp, Artificial Sequence
  chemically synthesized
tcgcaagtcttctctcaaaa

SEQ ID NO: 174156 - DNA, 20 bp, Artificial Sequence
  chemically synthesized
agtgtttactattttgagag

SEQ ID NO: 174157 - DNA, 20 bp, Artificial Sequence
  chemically synthesized
ttttgagagaagacttgcga

SEQ ID NO: 174158 - DNA, 20 bp, Artificial Sequence
  chemically synthesized
aggttaacctttgctttcgc

SEQ ID NO: 174159 - DNA, 20 bp, Artificial Sequence
  chemically synthesized
agagaagacttgcgaaagca

SEQ ID NO: 174160 - DNA, 20 bp, Artificial Sequence
  chemically synthesized
gagaagacttgcgaaagcaa

SEQ ID NO: 174161 - DNA, 20 bp, Artificial Sequence
  chemically synthesized
tgcgaaagcaaaggttaacc

SEQ ID NO: 174162 - DNA, 20 bp, Artificial Sequence
  chemically synthesized
gaaagcaaaggttaacctag

SEQ ID NO: 174163 - DNA, 20 bp, Artificial Sequence
  chemically synthesized
aaggcacagcaggtactact

SEQ ID NO: 174164 - DNA, 20 bp, Artificial Sequence
  chemically synthesized
gaaggcacagcaggtactac

SEQ ID NO: 174165 - DNA, 20 bp, Artificial Sequence
  chemically synthesized
tttgccaacgaaggcacagc

SEQ ID NO: 174166 - DNA, 20 bp, Artificial Sequence
  chemically synthesized
atttgccaacgaaggcacag

SEQ ID NO: 174167 - DNA, 20 bp, Artificial Sequence
  chemically synthesized
ttcatttgccaacgaaggca

SEQ ID NO: 174168 - DNA, 20 bp, Artificial Sequence
  chemically synthesized
agtacctgctgtgccttcgt

SEQ ID NO: 174169 - DNA, 20 bp, Artificial Sequence
  chemically synthesized
tttccttcatttgccaacga

SEQ ID NO: 174170 - DNA, 20 bp, Artificial Sequence
  chemically synthesized
ttttccttcatttgccaacg

SEQ ID NO: 174171 - DNA, 20 bp, Artificial Sequence
  chemically synthesized
tgtgccttcgttggcaaatg

SEQ ID NO: 174172 - DNA, 20 bp, Artificial Sequence
  chemically synthesized
gtgccttcgttggcaaatga

SEQ ID NO: 174173 - DNA, 20 bp, Artificial Sequence
  chemically synthesized
gcaaatgaaggaaaatcaca

SEQ ID NO: 174174 - DNA, 20 bp, Artificial Sequence
  chemically synthesized
atgaaggaaaatcacacaga

SEQ ID NO: 174175 - DNA, 20 bp, Artificial Sequence
  chemically synthesized
aaggaaaatcacacagatgg

SEQ ID NO: 174176 - DNA, 20 bp, Artificial Sequence
  chemically synthesized
cacagatggtggcatttgcc

SEQ ID NO: 174177 - DNA, 20 bp, Artificial Sequence
  chemically synthesized
acagatggtggcatttgcct

SEQ ID NO: 174178 - DNA, 20 bp, Artificial Sequence
  chemically synthesized
agatggtggcatttgcctgg

SEQ ID NO: 174179 - DNA, 20 bp, Artificial Sequence
  chemically synthesized
ggtggcatttgcctgggagt

SEQ ID NO: 174180 - DNA, 20 bp, Artificial Sequence
  chemically synthesized
gtggcatttgcctgggagtt

SEQ ID NO: 174181 - DNA, 20 bp, Artificial Sequence
  chemically synthesized
acccctggcacccaactccc

SEQ ID NO: 174182 - DNA, 20 bp, Artificial Sequence
  chemically synthesized
cacccctggcacccaactcc

SEQ ID NO: 174183 - DNA, 20 bp, Artificial Sequence
  chemically synthesized
tttgcctgggagttgggtgc

SEQ ID NO: 174184 - DNA, 20 bp, Artificial Sequence
  chemically synthesized
ttgcctgggagttgggtgcc

SEQ ID NO: 174185 - DNA, 20 bp, Artificial Sequence
  chemically synthesized
tgcctgggagttgggtgcca

SEQ ID NO: 174186 - DNA, 20 bp, Artificial Sequence
  chemically synthesized
gcctgggagttgggtgccag

SEQ ID NO: 174187 - DNA, 20 bp, Artificial Sequence
  chemically synthesized
tgcctttgagaggacacccc

SEQ ID NO: 174188 - DNA, 20 bp, Artificial Sequence
  chemically synthesized
gtgccaggggtgtcctctca

SEQ ID NO: 174189 - DNA, 20 bp, Artificial Sequence
  chemically synthesized
tgccaggggtgtcctctcaa

SEQ ID NO: 174190 - DNA, 20 bp, Artificial Sequence
  chemically synthesized
tctttttgtgtgcctttgag

SEQ ID NO: 174191 - DNA, 20 bp, Artificial Sequence
  chemically synthesized
atctttttgtgtgcctttga

SEQ ID NO: 174192 - DNA, 20 bp, Artificial Sequence
  chemically synthesized
ctatctttttgtgtgccttt

SEQ ID NO: 174193 - DNA, 20 bp, Artificial Sequence
  chemically synthesized
tcctctcaaaggcacacaaa

SEQ ID NO: 174194 - DNA, 20 bp, Artificial Sequence
  chemically synthesized
ctcaaaggcacacaaaaaga

SEQ ID NO: 174195 - DNA, 20 bp, Artificial Sequence
  chemically synthesized
tccacatatttaagaaaaga

SEQ ID NO: 174196 - DNA, 20 bp, Artificial Sequence
  chemically synthesized
catccacatatttaagaaaa

SEQ ID NO: 174197 - DNA, 20 bp, Artificial Sequence
  chemically synthesized
cacatccacatatttaagaa

SEQ ID NO: 174198 - DNA, 20 bp, Artificial Sequence
  chemically synthesized
tctctcttttcttaaatatg

SEQ ID NO: 174199 - DNA, 20 bp, Artificial Sequence
  chemically synthesized
aaatccacatccacatattt

SEQ ID NO: 174200 - DNA, 20 bp, Artificial Sequence
  chemically synthesized
ttttcttaaatatgtggatg

SEQ ID NO: 174201 - DNA, 20 bp, Artificial Sequence
  chemically synthesized
atatgtggatgtggatttgt

SEQ ID NO: 174202 - DNA, 20 bp, Artificial Sequence
  chemically synthesized
tgacttttcaagtgtgggta

SEQ ID NO: 174203 - DNA, 20 bp, Artificial Sequence
  chemically synthesized
ggtgatgacttttcaagtgt

SEQ ID NO: 174204 - DNA, 20 bp, Artificial Sequence
  chemically synthesized
tggtgatgacttttcaagtg

SEQ ID NO: 174205 - DNA, 20 bp, Artificial Sequence
  chemically synthesized
ttactttacccacacttgaa

SEQ ID NO: 174206 - DNA, 20 bp, Artificial Sequence
  chemically synthesized
gacagtggtgatgacttttc

SEQ ID NO: 174207 - DNA, 20 bp, Artificial Sequence
  chemically synthesized
gattgtggtggtggtgacag

SEQ ID NO: 174208 - DNA, 20 bp, Artificial Sequence
  chemically synthesized
attgattgtggtggtggtga

SEQ ID NO: 174209 - DNA, 20 bp, Artificial Sequence
  chemically synthesized
aaattgattgattgtggtgg

SEQ ID NO: 174210 - DNA, 20 bp, Artificial Sequence
  chemically synthesized
attaaattgattgattgtgg

SEQ ID NO: 174211 - DNA, 20 bp, Artificial Sequence
  chemically synthesized
actattaaattgattgattg

SEQ ID NO: 174212 - DNA, 20 bp, Artificial Sequence
  chemically synthesized
accacaatcaatcaatttaa

SEQ ID NO: 174213 - DNA, 20 bp, Artificial Sequence
  chemically synthesized
gtgaacatgtattaatcctt

SEQ ID NO: 174214 - DNA, 20 bp, Artificial Sequence
  chemically synthesized
gagaatgtggtacatactaa

SEQ ID NO: 174215 - DNA, 20 bp, Artificial Sequence
  chemically synthesized
ggagaatgtggtacatacta

SEQ ID NO: 174216 - DNA, 20 bp, Artificial Sequence
  chemically synthesized
ttgcctggcaagggagaatg

SEQ ID NO: 174217 - DNA, 20 bp, Artificial Sequence
  chemically synthesized
tgtaccacattctcccttgc

SEQ ID NO: 174218 - DNA, 20 bp, Artificial Sequence
  chemically synthesized
gtaccacattctcccttgcc

SEQ ID NO: 174219 - DNA, 20 bp, Artificial Sequence
  chemically synthesized
tccttgcttgcctggcaagg

SEQ ID NO: 174220 - DNA, 20 bp, Artificial Sequence
  chemically synthesized
attccttgcttgcctggcaa

SEQ ID NO: 174221 - DNA, 20 bp, Artificial Sequence
  chemically synthesized
aattccttgcttgcctggca

SEQ ID NO: 174222 - DNA, 20 bp, Artificial Sequence
  chemically synthesized
cacattctcccttgccaggc

SEQ ID NO: 174223 - DNA, 20 bp, Artificial Sequence
  chemically synthesized
gaattccttgcttgcctggc

SEQ ID NO: 174224 - DNA, 20 bp, Artificial Sequence
  chemically synthesized
ttctcccttgccaggcaagc

SEQ ID NO: 174225 - DNA, 20 bp, Artificial Sequence
  chemically synthesized
agctgaattccttgcttgcc

SEQ ID NO: 174226 - DNA, 20 bp, Artificial Sequence
  chemically synthesized
tctcccttgccaggcaagca

SEQ ID NO: 174227 - DNA, 20 bp, Artificial Sequence
  chemically synthesized
tgccaggcaagcaaggaatt

SEQ ID NO: 174228 - DNA, 20 bp, Artificial Sequence
  chemically synthesized
caaggaattcagctttgttc

SEQ ID NO: 174229 - DNA, 20 bp, Artificial Sequence
  chemically synthesized
ccaaacagcagtctagaaca

SEQ ID NO: 174230 - DNA, 20 bp, Artificial Sequence
  chemically synthesized
gactgtgccaaacagcagtc

SEQ ID NO: 174231 - DNA, 20 bp, Artificial Sequence
  chemically synthesized
ctttgttctagactgctgtt

SEQ ID NO: 174232 - DNA, 20 bp, Artificial Sequence
  chemically synthesized
cctaagactgtgccaaacag

SEQ ID NO: 174233 - DNA, 20 bp, Artificial Sequence
  chemically synthesized
ttctagactgctgtttggca

SEQ ID NO: 174234 - DNA, 20 bp, Artificial Sequence
  chemically synthesized
taacctaagactgtgccaaa

SEQ ID NO: 174235 - DNA, 20 bp, Artificial Sequence
  chemically synthesized
actgctgtttggcacagtct

SEQ ID NO: 174236 - DNA, 20 bp, Artificial Sequence
  chemically synthesized
ctgctgtttggcacagtctt

SEQ ID NO: 174237 - DNA, 20 bp, Artificial Sequence
  chemically synthesized
tgttagaaggagaataacct

SEQ ID NO: 174238 - DNA, 20 bp, Artificial Sequence
  chemically synthesized
ttaggttattctccttctaa

SEQ ID NO: 174239 - DNA, 20 bp, Artificial Sequence
  chemically synthesized
gtgctttgcactgttagaag

SEQ ID NO: 174240 - DNA, 20 bp, Artificial Sequence
  chemically synthesized
aagtgctttgcactgttaga

SEQ ID NO: 174241 - DNA, 20 bp, Artificial Sequence
  chemically synthesized
taagtgctttgcactgttag

SEQ ID NO: 174242 - DNA, 20 bp, Artificial Sequence
  chemically synthesized
ttctaagtgctttgcactgt

SEQ ID NO: 174243 - DNA, 20 bp, Artificial Sequence
  chemically synthesized
attctccttctaacagtgca

SEQ ID NO: 174244 - DNA, 20 bp, Artificial Sequence
  chemically synthesized
ttctaacagtgcaaagcact

SEQ ID NO: 174245 - DNA, 20 bp, Artificial Sequence
  chemically synthesized
agtgcaaagcacttagaata

SEQ ID NO: 174246 - DNA, 20 bp, Artificial Sequence
  chemically synthesized
ctgtgtatcgactgtattct

SEQ ID NO: 174247 - DNA, 20 bp, Artificial Sequence
  chemically synthesized
cttagaatacagtcgataca

SEQ ID NO: 174248 - DNA, 20 bp, Artificial Sequence
  chemically synthesized
gaatacagtcgatacacagt

SEQ ID NO: 174249 - DNA, 20 bp, Artificial Sequence
  chemically synthesized
ctcagtgtgttaggtaatga

SEQ ID NO: 174250 - DNA, 20 bp, Artificial Sequence
  chemically synthesized
taaagattcctcagtgtgtt

SEQ ID NO: 174251 - DNA, 20 bp, Artificial Sequence
  chemically synthesized
ctatcattacctaacacact

SEQ ID NO: 174252 - DNA, 20 bp, Artificial Sequence
  chemically synthesized
ttaaagattcctcagtgtgt

SEQ ID NO: 174253 - DNA, 20 bp, Artificial Sequence
  chemically synthesized
tatcattacctaacacactg

SEQ ID NO: 174254 - DNA, 20 bp, Artificial Sequence
  chemically synthesized
tgggagagttaaagattcct

SEQ ID NO: 174255 - DNA, 20 bp, Artificial Sequence
  chemically synthesized
cccactccttgggagagtta

SEQ ID NO: 174256 - DNA, 20 bp, Artificial Sequence
  chemically synthesized
gaggaatctttaactctccc

SEQ ID NO: 174257 - DNA, 20 bp, Artificial Sequence
  chemically synthesized
aggaatctttaactctccca

SEQ ID NO: 174258 - DNA, 20 bp, Artificial Sequence
  chemically synthesized
gaatctttaactctcccaag

SEQ ID NO: 174259 - DNA, 20 bp, Artificial Sequence
  chemically synthesized
gtcctccccactccttggga

SEQ ID NO: 174260 - DNA, 20 bp, Artificial Sequence
  chemically synthesized
aagtcctccccactccttgg

SEQ ID NO: 174261 - DNA, 20 bp, Artificial Sequence
  chemically synthesized
tctttaactctcccaaggag

SEQ ID NO: 174262 - DNA, 20 bp, Artificial Sequence
  chemically synthesized
ctttaactctcccaaggagt

SEQ ID NO: 174263 - DNA, 20 bp, Artificial Sequence
  chemically synthesized
tgaagtcctccccactcctt

SEQ ID NO: 174264 - DNA, 20 bp, Artificial Sequence
  chemically synthesized
tttaactctcccaaggagtg

SEQ ID NO: 174265 - DNA, 20 bp, Artificial Sequence
  chemically synthesized
ttgaagtcctccccactcct

SEQ ID NO: 174266 - DNA, 20 bp, Artificial Sequence
  chemically synthesized
taactctcccaaggagtggg

SEQ ID NO: 174267 - DNA, 20 bp, Artificial Sequence
  chemically synthesized
aactctcccaaggagtgggg

SEQ ID NO: 174268 - DNA, 20 bp, Artificial Sequence
  chemically synthesized
gagtggggaggacttcaaaa

SEQ ID NO: 174269 - DNA, 20 bp, Artificial Sequence
  chemically synthesized
agtggggaggacttcaaaac

SEQ ID NO: 174270 - DNA, 20 bp, Artificial Sequence
  chemically synthesized
tttaactgattcctgttttg

SEQ ID NO: 174271 - DNA, 20 bp, Artificial Sequence
  chemically synthesized
gaggacttcaaaacaggaat

SEQ ID NO: 174272 - DNA, 20 bp, Artificial Sequence
  chemically synthesized
gaatcagttaaatttctcct

SEQ ID NO: 174273 - DNA, 20 bp, Artificial Sequence
  chemically synthesized
cctgcactagacggtccaag

SEQ ID NO: 174274 - DNA, 20 bp, Artificial Sequence
  chemically synthesized
agcctgcactagacggtcca

SEQ ID NO: 174275 - DNA, 20 bp, Artificial Sequence
  chemically synthesized
aagcctgcactagacggtcc

SEQ ID NO: 174276 - DNA, 20 bp, Artificial Sequence
  chemically synthesized
aaatttctccttggaccgtc

SEQ ID NO: 174277 - DNA, 20 bp, Artificial Sequence
  chemically synthesized
tctccttggaccgtctagtg

SEQ ID NO: 174278 - DNA, 20 bp, Artificial Sequence
  chemically synthesized
tacaccaagcctgcactaga

SEQ ID NO: 174279 - DNA, 20 bp, Artificial Sequence
  chemically synthesized
ctccttggaccgtctagtgc

SEQ ID NO: 174280 - DNA, 20 bp, Artificial Sequence
  chemically synthesized
tatctacaccaagcctgcac

SEQ ID NO: 174281 - DNA, 20 bp, Artificial Sequence
  chemically synthesized
tggaccgtctagtgcaggct

SEQ ID NO: 174282 - DNA, 20 bp, Artificial Sequence
  chemically synthesized
cgtctagtgcaggcttggtg

SEQ ID NO: 174283 - DNA, 20 bp, Artificial Sequence
  chemically synthesized
tttctttttatatctacacc

SEQ ID NO: 174284 - DNA, 20 bp, Artificial Sequence
  chemically synthesized
aggcttggtgtagatataaa

SEQ ID NO: 174285 - DNA, 20 bp, Artificial Sequence
  chemically synthesized
tataaaaagaaataaaatat

SEQ ID NO: 174286 - DNA, 20 bp, Artificial Sequence
  chemically synthesized
cctcagatgtgtcaggcatt

SEQ ID NO: 174287 - DNA, 20 bp, Artificial Sequence
  chemically synthesized
gtttctacctcagatgtgtc

SEQ ID NO: 174288 - DNA, 20 bp, Artificial Sequence
  chemically synthesized
agtttctacctcagatgtgt

SEQ ID NO: 174289 - DNA, 20 bp, Artificial Sequence
  chemically synthesized
actaaatgcctgacacatct

SEQ ID NO: 174290 - DNA, 20 bp, Artificial Sequence
  chemically synthesized
ctaaatgcctgacacatctg

SEQ ID NO: 174291 - DNA, 20 bp, Artificial Sequence
  chemically synthesized
aatgcctgacacatctgagg

SEQ ID NO: 174292 - DNA, 20 bp, Artificial Sequence
  chemically synthesized
acgttcgttagtttctacct

SEQ ID NO: 174293 - DNA, 20 bp, Artificial Sequence
  chemically synthesized
atttcacttacaacgttcgt

SEQ ID NO: 174294 - DNA, 20 bp, Artificial Sequence
  chemically synthesized
tagaaactaacgaacgttgt

SEQ ID NO: 174295 - DNA, 20 bp, Artificial Sequence
  chemically synthesized
ttgtaagtgaaatactgctg

SEQ ID NO: 174296 - DNA, 20 bp, Artificial Sequence
  chemically synthesized
tgtaagtgaaatactgctgt

SEQ ID NO: 174297 - DNA, 20 bp, Artificial Sequence
  chemically synthesized
ctgttatcctcagcccacag

SEQ ID NO: 174298 - DNA, 20 bp, Artificial Sequence
  chemically synthesized
gtgaaatactgctgtgggct

SEQ ID NO: 174299 - DNA, 20 bp, Artificial Sequence
  chemically synthesized
tgaaatactgctgtgggctg

SEQ ID NO: 174300 - DNA, 20 bp, Artificial Sequence
  chemically synthesized
ctcctgttatcctcagccca

SEQ ID NO: 174301 - DNA, 20 bp, Artificial Sequence
  chemically synthesized
ctgctgtgggctgaggataa

SEQ ID NO: 174302 - DNA, 20 bp, Artificial Sequence
  chemically synthesized
tcttggcctcctgttatcct

SEQ ID NO: 174303 - DNA, 20 bp, Artificial Sequence
  chemically synthesized
tgctgtgggctgaggataac

SEQ ID NO: 174304 - DNA, 20 bp, Artificial Sequence
  chemically synthesized
ctgtgggctgaggataacag

SEQ ID NO: 174305 - DNA, 20 bp, Artificial Sequence
  chemically synthesized
tgtgggctgaggataacagg

SEQ ID NO: 174306 - DNA, 20 bp, Artificial Sequence
  chemically synthesized
gctgaggataacaggaggcc

SEQ ID NO: 174307 - DNA, 20 bp, Artificial Sequence
  chemically synthesized
aggataacaggaggccaaga

SEQ ID NO: 174308 - DNA, 20 bp, Artificial Sequence
  chemically synthesized
tctccaaacaagatccatct

SEQ ID NO: 174309 - DNA, 20 bp, Artificial Sequence
  chemically synthesized
aggccaagatggatcttgtt

SEQ ID NO: 174310 - DNA, 20 bp, Artificial Sequence
  chemically synthesized
gccaagatggatcttgtttg

SEQ ID NO: 174311 - DNA, 20 bp, Artificial Sequence
  chemically synthesized
ctgccttgtcatctccaaac

SEQ ID NO: 174312 - DNA, 20 bp, Artificial Sequence
  chemically synthesized
ggatcttgtttggagatgac

SEQ ID NO: 174313 - DNA, 20 bp, Artificial Sequence
  chemically synthesized
gatcttgtttggagatgaca

SEQ ID NO: 174314 - DNA, 20 bp, Artificial Sequence
  chemically synthesized
cttgtttggagatgacaagg

SEQ ID NO: 174315 - DNA, 20 bp, Artificial Sequence
  chemically synthesized
ttgtttggagatgacaaggc

SEQ ID NO: 174316 - DNA, 20 bp, Artificial Sequence
  chemically synthesized
agatgacaaggcaggctcta

SEQ ID NO: 174317 - DNA, 20 bp, Artificial Sequence
  chemically synthesized
gatgacaaggcaggctctat

SEQ ID NO: 174318 - DNA, 20 bp, Artificial Sequence
  chemically synthesized
ttctcctttctaatcccata

SEQ ID NO: 174319 - DNA, 20 bp, Artificial Sequence
  chemically synthesized
caaggcaggctctatgggat

SEQ ID NO: 174320 - DNA, 20 bp, Artificial Sequence
  chemically synthesized
acttctcctttctaatccca

SEQ ID NO: 174321 - DNA, 20 bp, Artificial Sequence
  chemically synthesized
gcaggctctatgggattaga

SEQ ID NO: 174322 - DNA, 20 bp, Artificial Sequence
  chemically synthesized
caggctctatgggattagaa

SEQ ID NO: 174323 - DNA, 20 bp, Artificial Sequence
  chemically synthesized
ggctctatgggattagaaag

SEQ ID NO: 174324 - DNA, 20 bp, Artificial Sequence
  chemically synthesized
tctatgggattagaaaggag

SEQ ID NO: 174325 - DNA, 20 bp, Artificial Sequence
  chemically synthesized
tgggattagaaaggagaagt

SEQ ID NO: 174326 - DNA, 20 bp, Artificial Sequence
  chemically synthesized
tagaaaggagaagtcagatt

SEQ ID NO: 174327 - DNA, 20 bp, Artificial Sequence
  chemically synthesized
gaaaggagaagtcagattta

SEQ ID NO: 174328 - DNA, 20 bp, Artificial Sequence
  chemically synthesized
gagaagtcagatttagagat

SEQ ID NO: 174329 - DNA, 20 bp, Artificial Sequence
  chemically synthesized
aagtcagatttagagattgg

SEQ ID NO: 174330 - DNA, 20 bp, Artificial Sequence
  chemically synthesized
atttagagattggtggtatt

SEQ ID NO: 174331 - DNA, 20 bp, Artificial Sequence
  chemically synthesized
ttagagattggtggtattaa

SEQ ID NO: 174332 - DNA, 20 bp, Artificial Sequence
  chemically synthesized
agagattggtggtattaaga

SEQ ID NO: 174333 - DNA, 20 bp, Artificial Sequence
  chemically synthesized
gattggtggtattaagagag

SEQ ID NO: 174334 - DNA, 20 bp, Artificial Sequence
  chemically synthesized
attggtggtattaagagaga

SEQ ID NO: 174335 - DNA, 20 bp, Artificial Sequence
  chemically synthesized
gtattaagagagaaggaaaa

SEQ ID NO: 174336 - DNA, 20 bp, Artificial Sequence
  chemically synthesized
tattaagagagaaggaaaaa

SEQ ID NO: 174337 - DNA, 20 bp, Artificial Sequence
  chemically synthesized
taagagagaaggaaaaaagg

SEQ ID NO: 174338 - DNA, 20 bp, Artificial Sequence
  chemically synthesized
ggaaaaaaggtagactttct

SEQ ID NO: 174339 - DNA, 20 bp, Artificial Sequence
  chemically synthesized
aaaaaggtagactttctaag

SEQ ID NO: 174340 - DNA, 20 bp, Artificial Sequence
  chemically synthesized
ccctgcctggtccacttaga

SEQ ID NO: 174341 - DNA, 20 bp, Artificial Sequence
  chemically synthesized
ggtagactttctaagtggac

SEQ ID NO: 174342 - DNA, 20 bp, Artificial Sequence
  chemically synthesized
gattccctgcctggtccact

SEQ ID NO: 174343 - DNA, 20 bp, Artificial Sequence
  chemically synthesized
gtagactttctaagtggacc

SEQ ID NO: 174344 - DNA, 20 bp, Artificial Sequence
  chemically synthesized
gactttctaagtggaccagg

SEQ ID NO: 174345 - DNA, 20 bp, Artificial Sequence
  chemically synthesized
actttctaagtggaccaggc

SEQ ID NO: 174346 - DNA, 20 bp, Artificial Sequence
  chemically synthesized
ctttctaagtggaccaggca

SEQ ID NO: 174347 - DNA, 20 bp, Artificial Sequence
  chemically synthesized
ctcgcctctgattccctgcc

SEQ ID NO: 174348 - DNA, 20 bp, Artificial Sequence
  chemically synthesized
aagtggaccaggcagggaat

SEQ ID NO: 174349 - DNA, 20 bp, Artificial Sequence
  chemically synthesized
gtggaccaggcagggaatca

SEQ ID NO: 174350 - DNA, 20 bp, Artificial Sequence
  chemically synthesized
tggaccaggcagggaatcag

SEQ ID NO: 174351 - DNA, 20 bp, Artificial Sequence
  chemically synthesized
ccaggcagggaatcagaggc

SEQ ID NO: 174352 - DNA, 20 bp, Artificial Sequence
  chemically synthesized
caggcagggaatcagaggcg

SEQ ID NO: 174353 - DNA, 20 bp, Artificial Sequence
  chemically synthesized
gcagggaatcagaggcgagg

SEQ ID NO: 174354 - DNA, 20 bp, Artificial Sequence
  chemically synthesized
atcagaggcgaggaagaaaa

SEQ ID NO: 174355 - DNA, 20 bp, Artificial Sequence
  chemically synthesized
gaggaagaaaacagaacaaa

SEQ ID NO: 174356 - DNA, 20 bp, Artificial Sequence
  chemically synthesized
aagaaaacagaacaaatgga

SEQ ID NO: 174357 - DNA, 20 bp, Artificial Sequence
  chemically synthesized
agaacaaatggaaagaacat

SEQ ID NO: 174358 - DNA, 20 bp, Artificial Sequence
  chemically synthesized
gaacaaatggaaagaacatt

SEQ ID NO: 174359 - DNA, 20 bp, Artificial Sequence
  chemically synthesized
caaatggaaagaacattggg

SEQ ID NO: 174360 - DNA, 20 bp, Artificial Sequence
  chemically synthesized
attgggtagtctcattttga

SEQ ID NO: 174361 - DNA, 20 bp, Artificial Sequence
  chemically synthesized
actcaggctgccatcaaaat

SEQ ID NO: 174362 - DNA, 20 bp, Artificial Sequence
  chemically synthesized
gggtagtctcattttgatgg

SEQ ID NO: 174363 - DNA, 20 bp, Artificial Sequence
  chemically synthesized
tctcattttgatggcagcct

SEQ ID NO: 174364 - DNA, 20 bp, Artificial Sequence
  chemically synthesized
cccactggtcattttcactc

SEQ ID NO: 174365 - DNA, 20 bp, Artificial Sequence
  chemically synthesized
tcccactggtcattttcact

SEQ ID NO: 174366 - DNA, 20 bp, Artificial Sequence
  chemically synthesized
gcagcctgagtgaaaatgac

SEQ ID NO: 174367 - DNA, 20 bp, Artificial Sequence
  chemically synthesized
gcctgagtgaaaatgaccag

SEQ ID NO: 174368 - DNA, 20 bp, Artificial Sequence
  chemically synthesized
cctgagtgaaaatgaccagt

SEQ ID NO: 174369 - DNA, 20 bp, Artificial Sequence
  chemically synthesized
tgagtgaaaatgaccagtgg

SEQ ID NO: 174370 - DNA, 20 bp, Artificial Sequence
  chemically synthesized
cttctgatattttctcccac

SEQ ID NO: 174371 - DNA, 20 bp, Artificial Sequence
  chemically synthesized
tgaccagtgggagaaaatat

SEQ ID NO: 174372 - DNA, 20 bp, Artificial Sequence
  chemically synthesized
ccagtgggagaaaatatcag

SEQ ID NO: 174373 - DNA, 20 bp, Artificial Sequence
  chemically synthesized
aaaatatcagaagatttcta

SEQ ID NO: 174374 - DNA, 20 bp, Artificial Sequence
  chemically synthesized
acccctgtgtcattcagcta

SEQ ID NO: 174375 - DNA, 20 bp, Artificial Sequence
  chemically synthesized
atttctatagctgaatgaca

SEQ ID NO: 174376 - DNA, 20 bp, Artificial Sequence
  chemically synthesized
tttccaacccctgtgtcatt

SEQ ID NO: 174377 - DNA, 20 bp, Artificial Sequence
  chemically synthesized
tttctatagctgaatgacac

SEQ ID NO: 174378 - DNA, 20 bp, Artificial Sequence
  chemically synthesized
ttctatagctgaatgacaca

SEQ ID NO: 174379 - DNA, 20 bp, Artificial Sequence
  chemically synthesized
tctatagctgaatgacacag

SEQ ID NO: 174380 - DNA, 20 bp, Artificial Sequence
  chemically synthesized
tagctgaatgacacaggggt

SEQ ID NO: 174381 - DNA, 20 bp, Artificial Sequence
  chemically synthesized
tgacacaggggttggaaacc

SEQ ID NO: 174382 - DNA, 20 bp, Artificial Sequence
  chemically synthesized
gacacaggggttggaaaccc

SEQ ID NO: 174383 - DNA, 20 bp, Artificial Sequence
  chemically synthesized
acacaggggttggaaaccca

SEQ ID NO: 174384 - DNA, 20 bp, Artificial Sequence
  chemically synthesized
gggttggaaacccagggcta

SEQ ID NO: 174385 - DNA, 20 bp, Artificial Sequence
  chemically synthesized
taaatttctcctttagccct

SEQ ID NO: 174386 - DNA, 20 bp, Artificial Sequence
  chemically synthesized
ggttggaaacccagggctaa

SEQ ID NO: 174387 - DNA, 20 bp, Artificial Sequence
  chemically synthesized
ataaatttctcctttagccc

SEQ ID NO: 174388 - DNA, 20 bp, Artificial Sequence
  chemically synthesized
ttggaaacccagggctaaag

SEQ ID NO: 174389 - DNA, 20 bp, Artificial Sequence
  chemically synthesized
tccttgataaatttctcctt

SEQ ID NO: 174390 - DNA, 20 bp, Artificial Sequence
  chemically synthesized
ggctaaaggagaaatttatc

SEQ ID NO: 174391 - DNA, 20 bp, Artificial Sequence
  chemically synthesized
gctaaaggagaaatttatca

SEQ ID NO: 174392 - DNA, 20 bp, Artificial Sequence
  chemically synthesized
tgtggatttagtaagggaaa

SEQ ID NO: 174393 - DNA, 20 bp, Artificial Sequence
  chemically synthesized
cgatgctgtggatttagtaa

SEQ ID NO: 174394 - DNA, 20 bp, Artificial Sequence
  chemically synthesized
gcgatgctgtggatttagta

SEQ ID NO: 174395 - DNA, 20 bp, Artificial Sequence
  chemically synthesized
ggcgatgctgtggatttagt

SEQ ID NO: 174396 - DNA, 20 bp, Artificial Sequence
  chemically synthesized
tgtttcccttactaaatcca

SEQ ID NO: 174397 - DNA, 20 bp, Artificial Sequence
  chemically synthesized
tgtgggcgatgctgtggatt

SEQ ID NO: 174398 - DNA, 20 bp, Artificial Sequence
  chemically synthesized
tacctatgtgggcgatgctg

SEQ ID NO: 174399 - DNA, 20 bp, Artificial Sequence
  chemically synthesized
aatccacagcatcgcccaca

SEQ ID NO: 174400 - DNA, 20 bp, Artificial Sequence
  chemically synthesized
atccacagcatcgcccacat

SEQ ID NO: 174401 - DNA, 20 bp, Artificial Sequence
  chemically synthesized
aaacaagtctgtacctatgt

SEQ ID NO: 174402 - DNA, 20 bp, Artificial Sequence
  chemically synthesized
caaacaagtctgtacctatg

SEQ ID NO: 174403 - DNA, 20 bp, Artificial Sequence
  chemically synthesized
cagcatcgcccacataggta

SEQ ID NO: 174404 - DNA, 20 bp, Artificial Sequence
  chemically synthesized
taggtacagacttgtttgtc

SEQ ID NO: 174405 - DNA, 20 bp, Artificial Sequence
  chemically synthesized
tcacaaaatcctagacaaac

SEQ ID NO: 174406 - DNA, 20 bp, Artificial Sequence
  chemically synthesized
aggtacagacttgtttgtct

SEQ ID NO: 174407 - DNA, 20 bp, Artificial Sequence
  chemically synthesized
gccatgtagtcacaaaatcc

SEQ ID NO: 174408 - DNA, 20 bp, Artificial Sequence
  chemically synthesized
tctaggattttgtgactaca

SEQ ID NO: 174409 - DNA, 20 bp, Artificial Sequence
  chemically synthesized
aggattttgtgactacatgg

SEQ ID NO: 174410 - DNA, 20 bp, Artificial Sequence
  chemically synthesized
tgataaggcaaactgccatg

SEQ ID NO: 174411 - DNA, 20 bp, Artificial Sequence
  chemically synthesized
catggcagtttgccttatca

SEQ ID NO: 174412 - DNA, 20 bp, Artificial Sequence
  chemically synthesized
tcctttcactcactttgata

SEQ ID NO: 174413 - DNA, 20 bp, Artificial Sequence
  chemically synthesized
atcctttcactcactttgat

SEQ ID NO: 174414 - DNA, 20 bp, Artificial Sequence
  chemically synthesized
gcagtttgccttatcaaagt

SEQ ID NO: 174415 - DNA, 20 bp, Artificial Sequence
  chemically synthesized
tgccttatcaaagtgagtga

SEQ ID NO: 174416 - DNA, 20 bp, Artificial Sequence
  chemically synthesized
gccttatcaaagtgagtgaa

SEQ ID NO: 174417 - DNA, 20 bp, Artificial Sequence
  chemically synthesized
tatcaaagtgagtgaaagga

SEQ ID NO: 174418 - DNA, 20 bp, Artificial Sequence
  chemically synthesized
atcaaagtgagtgaaaggat

SEQ ID NO: 174419 - DNA, 20 bp, Artificial Sequence
  chemically synthesized
tcaaagtgagtgaaaggatg

SEQ ID NO: 174420 - DNA, 20 bp, Artificial Sequence
  chemically synthesized
gtgagtgaaaggatggggaa

SEQ ID NO: 174421 - DNA, 20 bp, Artificial Sequence
  chemically synthesized
tgagtgaaaggatggggaaa

SEQ ID NO: 174422 - DNA, 20 bp, Artificial Sequence
  chemically synthesized
gagtgaaaggatggggaaaa

SEQ ID NO: 174423 - DNA, 20 bp, Artificial Sequence
  chemically synthesized
gaaaggatggggaaaaggga

SEQ ID NO: 174424 - DNA, 20 bp, Artificial Sequence
  chemically synthesized
ggatggggaaaagggaaagc

SEQ ID NO: 174425 - DNA, 20 bp, Artificial Sequence
  chemically synthesized
ggggaaaagggaaagcaaga

SEQ ID NO: 174426 - DNA, 20 bp, Artificial Sequence
  chemically synthesized
gggaaaagggaaagcaagac

SEQ ID NO: 174427 - DNA, 20 bp, Artificial Sequence
  chemically synthesized
aaaagggaaagcaagacagg

SEQ ID NO: 174428 - DNA, 20 bp, Artificial Sequence
  chemically synthesized
aagggaaagcaagacaggaa

SEQ ID NO: 174429 - DNA, 20 bp, Artificial Sequence
  chemically synthesized
aagcaagacaggaagagaaa

SEQ ID NO: 174430 - DNA, 20 bp, Artificial Sequence
  chemically synthesized
gacaggaagagaaaaagaaa

SEQ ID NO: 174431 - DNA, 20 bp, Artificial Sequence
  chemically synthesized
acaggaagagaaaaagaaat

SEQ ID NO: 174432 - DNA, 20 bp, Artificial Sequence
  chemically synthesized
caggaagagaaaaagaaata

SEQ ID NO: 174433 - DNA, 20 bp, Artificial Sequence
  chemically synthesized
ggaagagaaaaagaaatagg

SEQ ID NO: 174434 - DNA, 20 bp, Artificial Sequence
  chemically synthesized
aagagaaaaagaaataggga

SEQ ID NO: 174435 - DNA, 20 bp, Artificial Sequence
  chemically synthesized
gaaaaagaaatagggagagt

SEQ ID NO: 174436 - DNA, 20 bp, Artificial Sequence
  chemically synthesized
aaaaagaaatagggagagtg

SEQ ID NO: 174437 - DNA, 20 bp, Artificial Sequence
  chemically synthesized
ttacaagttgattgtgacaa

SEQ ID NO: 174438 - DNA, 20 bp, Artificial Sequence
  chemically synthesized
aattacaagttgattgtgac

SEQ ID NO: 174439 - DNA, 20 bp, Artificial Sequence
  chemically synthesized
acacactgttcagcaattac

SEQ ID NO: 174440 - DNA, 20 bp, Artificial Sequence
  chemically synthesized
atcaacttgtaattgctgaa

SEQ ID NO: 174441 - DNA, 20 bp, Artificial Sequence
  chemically synthesized
gaaagcaccaacacactgtt

SEQ ID NO: 174442 - DNA, 20 bp, Artificial Sequence
  chemically synthesized
gtaattgctgaacagtgtgt

SEQ ID NO: 174443 - DNA, 20 bp, Artificial Sequence
  chemically synthesized
gtgtgttggtgctttcatgt

SEQ ID NO: 174444 - DNA, 20 bp, Artificial Sequence
  chemically synthesized
aaatgttacctctgacatga

SEQ ID NO: 174445 - DNA, 20 bp, Artificial Sequence
  chemically synthesized
gtgttggtgctttcatgtca

SEQ ID NO: 174446 - DNA, 20 bp, Artificial Sequence
  chemically synthesized
tgttggtgctttcatgtcag

SEQ ID NO: 174447 - DNA, 20 bp, Artificial Sequence
  chemically synthesized
catgtcagaggtaacattta

SEQ ID NO: 174448 - DNA, 20 bp, Artificial Sequence
  chemically synthesized
ttacagaaatgacacatttt

SEQ ID NO: 174449 - DNA, 20 bp, Artificial Sequence
  chemically synthesized
tacagaaatgacacatttta

SEQ ID NO: 174450 - DNA, 20 bp, Artificial Sequence
  chemically synthesized
atgacacattttaaggccct

SEQ ID NO: 174451 - DNA, 20 bp, Artificial Sequence
  chemically synthesized
tgacacattttaaggccctg

SEQ ID NO: 174452 - DNA, 20 bp, Artificial Sequence
  chemically synthesized
gacacattttaaggccctga

SEQ ID NO: 174453 - DNA, 20 bp, Artificial Sequence
  chemically synthesized
acacattttaaggccctgag

SEQ ID NO: 174454 - DNA, 20 bp, Artificial Sequence
  chemically synthesized
cattttaaggccctgagggg

SEQ ID NO: 174455 - DNA, 20 bp, Artificial Sequence
  chemically synthesized
cctaatctgccttcccctca

SEQ ID NO: 174456 - DNA, 20 bp, Artificial Sequence
  chemically synthesized
attttaaggccctgagggga

SEQ ID NO: 174457 - DNA, 20 bp, Artificial Sequence
  chemically synthesized
tcctaatctgccttcccctc

SEQ ID NO: 174458 - DNA, 20 bp, Artificial Sequence
  chemically synthesized
atcctaatctgccttcccct

SEQ ID NO: 174459 - DNA, 20 bp, Artificial Sequence
  chemically synthesized
ttaaggccctgaggggaagg

SEQ ID NO: 174460 - DNA, 20 bp, Artificial Sequence
  chemically synthesized
gccctgaggggaaggcagat

SEQ ID NO: 174461 - DNA, 20 bp, Artificial Sequence
  chemically synthesized
ccctgaggggaaggcagatt

SEQ ID NO: 174462 - DNA, 20 bp, Artificial Sequence
  chemically synthesized
gaggggaaggcagattagga

SEQ ID NO: 174463 - DNA, 20 bp, Artificial Sequence
  chemically synthesized
gggaaggcagattaggatag

SEQ ID NO: 174464 - DNA, 20 bp, Artificial Sequence
  chemically synthesized
ataaagcagcaatacattat

SEQ ID NO: 174465 - DNA, 20 bp, Artificial Sequence
  chemically synthesized
tataatgtattgctgcttta

SEQ ID NO: 174466 - DNA, 20 bp, Artificial Sequence
  chemically synthesized
acagtgataaaactataaag

SEQ ID NO: 174467 - DNA, 20 bp, Artificial Sequence
  chemically synthesized
caaacagtgataaaactata

SEQ ID NO: 174468 - DNA, 20 bp, Artificial Sequence
  chemically synthesized
tttatagttttatcactgtt

SEQ ID NO: 174469 - DNA, 20 bp, Artificial Sequence
  chemically synthesized
tagttttatcactgtttgga

SEQ ID NO: 174470 - DNA, 20 bp, Artificial Sequence
  chemically synthesized
aaaatgaaatactttccaaa

SEQ ID NO: 174471 - DNA, 20 bp, Artificial Sequence
  chemically synthesized
aaagtatttcattttattta

SEQ ID NO: 174472 - DNA, 20 bp, Artificial Sequence
  chemically synthesized
tcattttatttatagctctg

SEQ ID NO: 174473 - DNA, 20 bp, Artificial Sequence
  chemically synthesized
cattttatttatagctctgt

SEQ ID NO: 174474 - DNA, 20 bp, Artificial Sequence
  chemically synthesized
tttttagtaattttcctaca

SEQ ID NO: 174475 - DNA, 20 bp, Artificial Sequence
  chemically synthesized
tttttttagtaattttccta

SEQ ID NO: 174476 - DNA, 20 bp, Artificial Sequence
  chemically synthesized
attagttatcataatttttt

SEQ ID NO: 174477 - DNA, 20 bp, Artificial Sequence
  chemically synthesized
ggtaagacatcagtaagtat

SEQ ID NO: 174478 - DNA, 20 bp, Artificial Sequence
  chemically synthesized
gcacatggtaagacatcagt

SEQ ID NO: 174479 - DNA, 20 bp, Artificial Sequence
  chemically synthesized
ctcagcacatggtaagacat

SEQ ID NO: 174480 - DNA, 20 bp, Artificial Sequence
  chemically synthesized
acctgagctcagcacatggt

SEQ ID NO: 174481 - DNA, 20 bp, Artificial Sequence
  chemically synthesized
ctgatgtcttaccatgtgct

SEQ ID NO: 174482 - DNA, 20 bp, Artificial Sequence
  chemically synthesized
tgaaacctgagctcagcaca

SEQ ID NO: 174483 - DNA, 20 bp, Artificial Sequence
  chemically synthesized
gtcttaccatgtgctgagct

SEQ ID NO: 174484 - DNA, 20 bp, Artificial Sequence
  chemically synthesized
tcttaccatgtgctgagctc

SEQ ID NO: 174485 - DNA, 20 bp, Artificial Sequence
  chemically synthesized
aagaagctgaaacctgagct

SEQ ID NO: 174486 - DNA, 20 bp, Artificial Sequence
  chemically synthesized
catgtgctgagctcaggttt

SEQ ID NO: 174487 - DNA, 20 bp, Artificial Sequence
  chemically synthesized
catttaagaagctgaaacct

SEQ ID NO: 174488 - DNA, 20 bp, Artificial Sequence
  chemically synthesized
cacctaatgacacatttaag

SEQ ID NO: 174489 - DNA, 20 bp, Artificial Sequence
  chemically synthesized
agtcacctaatgacacattt

SEQ ID NO: 174490 - DNA, 20 bp, Artificial Sequence
  chemically synthesized
cagcttcttaaatgtgtcat

SEQ ID NO: 174491 - DNA, 20 bp, Artificial Sequence
  chemically synthesized
agcttcttaaatgtgtcatt

SEQ ID NO: 174492 - DNA, 20 bp, Artificial Sequence
  chemically synthesized
gtgtcattaggtgactacaa

SEQ ID NO: 174493 - DNA, 20 bp, Artificial Sequence
  chemically synthesized
cattaggtgactacaaaagt

SEQ ID NO: 174494 - DNA, 20 bp, Artificial Sequence
  chemically synthesized
gaaaacaacacttacttttg

SEQ ID NO: 174495 - DNA, 20 bp, Artificial Sequence
  chemically synthesized
aagtgttgttttcacattca

SEQ ID NO: 174496 - DNA, 20 bp, Artificial Sequence
  chemically synthesized
gtatttcaatatcaaatggc

SEQ ID NO: 174497 - DNA, 20 bp, Artificial Sequence
  chemically synthesized
gaatgtatttcaatatcaaa

SEQ ID NO: 174498 - DNA, 20 bp, Artificial Sequence
  chemically synthesized
taacataatcacatttattt

SEQ ID NO: 174499 - DNA, 20 bp, Artificial Sequence
  chemically synthesized
atgttatacatcattttaat

SEQ ID NO: 174500 - DNA, 20 bp, Artificial Sequence
  chemically synthesized
ttagcaaaaaaaaaaaaagt

SEQ ID NO: 174501 - DNA, 20 bp, Artificial Sequence
  chemically synthesized
gtcattagcaaaaaaaaaaa

SEQ ID NO: 174502 - DNA, 20 bp, Artificial Sequence
  chemically synthesized
aacagcaagtaataagtcat

SEQ ID NO: 174503 - DNA, 20 bp, Artificial Sequence
  chemically synthesized
taaaataaacagcaagtaat

SEQ ID NO: 174504 - DNA, 20 bp, Artificial Sequence
  chemically synthesized
ataaacataaaataaacagc

SEQ ID NO: 174505 - DNA, 20 bp, Artificial Sequence
  chemically synthesized
taaaataaacataaaataaa

SEQ ID NO: 174506 - DNA, 20 bp, Artificial Sequence
  chemically synthesized
tgtttattttatgtttattt

SEQ ID NO: 174507 - DNA, 20 bp, Artificial Sequence
  chemically synthesized
tttatgtttattttagacta

SEQ ID NO: 174508 - DNA, 20 bp, Artificial Sequence
  chemically synthesized
tttgtctaacatcatttcca

SEQ ID NO: 174509 - DNA, 20 bp, Artificial Sequence
  chemically synthesized
ttagactatggaaatgatgt

SEQ ID NO: 174510 - DNA, 20 bp, Artificial Sequence
  chemically synthesized
tggaaatgatgttagacaaa

SEQ ID NO: 174511 - DNA, 20 bp, Artificial Sequence
  chemically synthesized
gttagacaaaaagcaaattc

SEQ ID NO: 174512 - DNA, 20 bp, Artificial Sequence
  chemically synthesized
ttcgagcgtttttcttattc

SEQ ID NO: 174513 - DNA, 20 bp, Artificial Sequence
  chemically synthesized
aatccattttgaactcgaat

SEQ ID NO: 174514 - DNA, 20 bp, Artificial Sequence
  chemically synthesized
tttcttattcgagttcaaaa

SEQ ID NO: 174515 - DNA, 20 bp, Artificial Sequence
  chemically synthesized
cgagttcaaaatggattgta

SEQ ID NO: 174516 - DNA, 20 bp, Artificial Sequence
  chemically synthesized
gttcaaaatggattgtaaag

SEQ ID NO: 174517 - DNA, 20 bp, Artificial Sequence
  chemically synthesized
caaaatggattgtaaagaag

SEQ ID NO: 174518 - DNA, 20 bp, Artificial Sequence
  chemically synthesized
aaatggattgtaaagaagca

SEQ ID NO: 174519 - DNA, 20 bp, Artificial Sequence
  chemically synthesized
aatggattgtaaagaagcag

SEQ ID NO: 174520 - DNA, 20 bp, Artificial Sequence
  chemically synthesized
aaatgtgtttttgacattgc

SEQ ID NO: 174521 - DNA, 20 bp, Artificial Sequence
  chemically synthesized
cgcaatgtcaaaaacacatt

SEQ ID NO: 174522 - DNA, 20 bp, Artificial Sequence
  chemically synthesized
tgtcaaaaacacatttggcc

SEQ ID NO: 174523 - DNA, 20 bp, Artificial Sequence
  chemically synthesized
tgcgtttgttagcagtaact

SEQ ID NO: 174524 - DNA, 20 bp, Artificial Sequence
  chemically synthesized
ctgcactgtgcgtttgttag

SEQ ID NO: 174525 - DNA, 20 bp, Artificial Sequence
  chemically synthesized
ccactgcactgtgcgtttgt

SEQ ID NO: 174526 - DNA, 20 bp, Artificial Sequence
  chemically synthesized
agttactgctaacaaacgca

SEQ ID NO: 174527 - DNA, 20 bp, Artificial Sequence
  chemically synthesized
ctgctaacaaacgcacagtg

SEQ ID NO: 174528 - DNA, 20 bp, Artificial Sequence
  chemically synthesized
ctaacaaacgcacagtgcag

SEQ ID NO: 174529 - DNA, 20 bp, Artificial Sequence
  chemically synthesized
acaaacgcacagtgcagtgg

SEQ ID NO: 174530 - DNA, 20 bp, Artificial Sequence
  chemically synthesized
gcacagtgcagtggtggttc

SEQ ID NO: 174531 - DNA, 20 bp, Artificial Sequence
  chemically synthesized
cagtgcagtggtggttcaag

SEQ ID NO: 174532 - DNA, 20 bp, Artificial Sequence
  chemically synthesized
gtggttcaagaagtttttca

SEQ ID NO: 174533 - DNA, 20 bp, Artificial Sequence
  chemically synthesized
tggttcaagaagtttttcaa

SEQ ID NO: 174534 - DNA, 20 bp, Artificial Sequence
  chemically synthesized
gttcaagaagtttttcaaag

SEQ ID NO: 174535 - DNA, 20 bp, Artificial Sequence
  chemically synthesized
agaagtttttcaaaggagat

SEQ ID NO: 174536 - DNA, 20 bp, Artificial Sequence
  chemically synthesized
aagtttttcaaaggagataa

SEQ ID NO: 174537 - DNA, 20 bp, Artificial Sequence
  chemically synthesized
caaaggagataagagtcttg

SEQ ID NO: 174538 - DNA, 20 bp, Artificial Sequence
  chemically synthesized
gagataagagtcttgaagat

SEQ ID NO: 174539 - DNA, 20 bp, Artificial Sequence
  chemically synthesized
agataagagtcttgaagatg

SEQ ID NO: 174540 - DNA, 20 bp, Artificial Sequence
  chemically synthesized
ccactacgcccctcatcttc

SEQ ID NO: 174541 - DNA, 20 bp, Artificial Sequence
  chemically synthesized
gataagagtcttgaagatga

SEQ ID NO: 174542 - DNA, 20 bp, Artificial Sequence
  chemically synthesized
ataagagtcttgaagatgag

SEQ ID NO: 174543 - DNA, 20 bp, Artificial Sequence
  chemically synthesized
agtcttgaagatgaggggcg

SEQ ID NO: 174544 - DNA, 20 bp, Artificial Sequence
  chemically synthesized
cttgaagatgaggggcgtag

SEQ ID NO: 174545 - DNA, 20 bp, Artificial Sequence
  chemically synthesized
aagatgaggggcgtagtggc

SEQ ID NO: 174546 - DNA, 20 bp, Artificial Sequence
  chemically synthesized
ggggcgtagtggctggccat

SEQ ID NO: 174547 - DNA, 20 bp, Artificial Sequence
  chemically synthesized
cattgtcaacttctgatggc

SEQ ID NO: 174548 - DNA, 20 bp, Artificial Sequence
  chemically synthesized
gcgtagtggctggccatcag

SEQ ID NO: 174549 - DNA, 20 bp, Artificial Sequence
  chemically synthesized
cggtcattgtcaacttctga

SEQ ID NO: 174550 - DNA, 20 bp, Artificial Sequence
  chemically synthesized
gaagttgacaatgaccgatt

SEQ ID NO: 174551 - DNA, 20 bp, Artificial Sequence
  chemically synthesized
cttcgatgattggtctcaat

SEQ ID NO: 174552 - DNA, 20 bp, Artificial Sequence
  chemically synthesized
ccgattgagaccaatcatcg

SEQ ID NO: 174553 - DNA, 20 bp, Artificial Sequence
  chemically synthesized
agaggatcagcttcgatgat

SEQ ID NO: 174554 - DNA, 20 bp, Artificial Sequence
  chemically synthesized
tcgtgtagttgtaagaggat

SEQ ID NO: 174555 - DNA, 20 bp, Artificial Sequence
  chemically synthesized
acttctcgtgtagttgtaag

SEQ ID NO: 174556 - DNA, 20 bp, Artificial Sequence
  chemically synthesized
aacttctcgtgtagttgtaa

SEQ ID NO: 174557 - DNA, 20 bp, Artificial Sequence
  chemically synthesized
gcaacttctcgtgtagttgt

SEQ ID NO: 174558 - DNA, 20 bp, Artificial Sequence
  chemically synthesized
tgatcctcttacaactacac

SEQ ID NO: 174559 - DNA, 20 bp, Artificial Sequence
  chemically synthesized
tcctcttacaactacacgag

SEQ ID NO: 174560 - DNA, 20 bp, Artificial Sequence
  chemically synthesized
ttcctcggcaacttctcgtg

SEQ ID NO: 174561 - DNA, 20 bp, Artificial Sequence
  chemically synthesized
caactacacgagaagttgcc

SEQ ID NO: 174562 - DNA, 20 bp, Artificial Sequence
  chemically synthesized
aactacacgagaagttgccg

SEQ ID NO: 174563 - DNA, 20 bp, Artificial Sequence
  chemically synthesized
atggttgacattgagttcct

SEQ ID NO: 174564 - DNA, 20 bp, Artificial Sequence
  chemically synthesized
actgtgaaatggttgacatt

SEQ ID NO: 174565 - DNA, 20 bp, Artificial Sequence
  chemically synthesized
actcaatgtcaaccatttca

SEQ ID NO: 174566 - DNA, 20 bp, Artificial Sequence
  chemically synthesized
aatgctgaacaactgtgaaa

SEQ ID NO: 174567 - DNA, 20 bp, Artificial Sequence
  chemically synthesized
tcaaccatttcacagttgtt

SEQ ID NO: 174568 - DNA, 20 bp, Artificial Sequence
  chemically synthesized
tcacagttgttcagcatttg

SEQ ID NO: 174569 - DNA, 20 bp, Artificial Sequence
  chemically synthesized
gttcagcatttgaagcaaat

SEQ ID NO: 174570 - DNA, 20 bp, Artificial Sequence
  chemically synthesized
agcatttgaagcaaattgga

SEQ ID NO: 174571 - DNA, 20 bp, Artificial Sequence
  chemically synthesized
gcatttgaagcaaattggaa

SEQ ID NO: 174572 - DNA, 20 bp, Artificial Sequence
  chemically synthesized
gaaaggcgaaaaaactcgat

SEQ ID NO: 174573 - DNA, 20 bp, Artificial Sequence
  chemically synthesized
aggcgaaaaaactcgataag

SEQ ID NO: 174574 - DNA, 20 bp, Artificial Sequence
  chemically synthesized
ggcgaaaaaactcgataagt

SEQ ID NO: 174575 - DNA, 20 bp, Artificial Sequence
  chemically synthesized
ttatgaggcacccacttatc

SEQ ID NO: 174576 - DNA, 20 bp, Artificial Sequence
  chemically synthesized
tcgataagtgggtgcctcat

SEQ ID NO: 174577 - DNA, 20 bp, Artificial Sequence
  chemically synthesized
ataagtgggtgcctcataag

SEQ ID NO: 174578 - DNA, 20 bp, Artificial Sequence
  chemically synthesized
ttattttcgctctgcttatg

SEQ ID NO: 174579 - DNA, 20 bp, Artificial Sequence
  chemically synthesized
aagtgggtgcctcataagca

SEQ ID NO: 174580 - DNA, 20 bp, Artificial Sequence
  chemically synthesized
tttattttcgctctgcttat

SEQ ID NO: 174581 - DNA, 20 bp, Artificial Sequence
  chemically synthesized
cataagcagagcgaaaataa

SEQ ID NO: 174582 - DNA, 20 bp, Artificial Sequence
  chemically synthesized
ataaaagtatcgtcattttg

SEQ ID NO: 174583 - DNA, 20 bp, Artificial Sequence
  chemically synthesized
tggcgtagaataagagaaga

SEQ ID NO: 174584 - DNA, 20 bp, Artificial Sequence
  chemically synthesized
ttgttggcgtagaataagag

SEQ ID NO: 174585 - DNA, 20 bp, Artificial Sequence
  chemically synthesized
ttgttgttggcgtagaataa

SEQ ID NO: 174586 - DNA, 20 bp, Artificial Sequence
  chemically synthesized
tgttgttgttggcgtagaat

SEQ ID NO: 174587 - DNA, 20 bp, Artificial Sequence
  chemically synthesized
atggtttgttgttgttggcg

SEQ ID NO: 174588 - DNA, 20 bp, Artificial Sequence
  chemically synthesized
aagaaatggtttgttgttgt

SEQ ID NO: 174589 - DNA, 20 bp, Artificial Sequence
  chemically synthesized
gttacaatccgatcaagaaa

SEQ ID NO: 174590 - DNA, 20 bp, Artificial Sequence
  chemically synthesized
acaacaaaccatttcttgat

SEQ ID NO: 174591 - DNA, 20 bp, Artificial Sequence
  chemically synthesized
ttgcacgttacaatccgatc

SEQ ID NO: 174592 - DNA, 20 bp, Artificial Sequence
  chemically synthesized
ggattgtaacgtgcaacaaa

SEQ ID NO: 174593 - DNA, 20 bp, Artificial Sequence
  chemically synthesized
ttgtaacgtgcaacaaaaag

SEQ ID NO: 174594 - DNA, 20 bp, Artificial Sequence
  chemically synthesized
agtggattttaaacgacaac

SEQ ID NO: 174595 - DNA, 20 bp, Artificial Sequence
  chemically synthesized
gccactgaactgggcatcgc

SEQ ID NO: 174596 - DNA, 20 bp, Artificial Sequence
  chemically synthesized
aaacgacaactggcgatgcc

SEQ ID NO: 174597 - DNA, 20 bp, Artificial Sequence
  chemically synthesized
acaactggcgatgcccagtt

SEQ ID NO: 174598 - DNA, 20 bp, Artificial Sequence
  chemically synthesized
actggcgatgcccagttcag

SEQ ID NO: 174599 - DNA, 20 bp, Artificial Sequence
  chemically synthesized
ctcagtccagccactgaact

SEQ ID NO: 174600 - DNA, 20 bp, Artificial Sequence
  chemically synthesized
tctcagtccagccactgaac

SEQ ID NO: 174601 - DNA, 20 bp, Artificial Sequence
  chemically synthesized
gcgatgcccagttcagtggc

SEQ ID NO: 174602 - DNA, 20 bp, Artificial Sequence
  chemically synthesized
cccagttcagtggctggact

SEQ ID NO: 174603 - DNA, 20 bp, Artificial Sequence
  chemically synthesized
agttcagtggctggactgag

SEQ ID NO: 174604 - DNA, 20 bp, Artificial Sequence
  chemically synthesized
tttggagcttcttctcagtc

SEQ ID NO: 174605 - DNA, 20 bp, Artificial Sequence
  chemically synthesized
tcagtggctggactgagaag

SEQ ID NO: 174606 - DNA, 20 bp, Artificial Sequence
  chemically synthesized
agtgctttggagcttcttct

SEQ ID NO: 174607 - DNA, 20 bp, Artificial Sequence
  chemically synthesized
tggactgagaagaagctcca

SEQ ID NO: 174608 - DNA, 20 bp, Artificial Sequence
  chemically synthesized
tggctttggaaagtgctttg

SEQ ID NO: 174609 - DNA, 20 bp, Artificial Sequence
  chemically synthesized
tttggctttggaaagtgctt

SEQ ID NO: 174610 - DNA, 20 bp, Artificial Sequence
  chemically synthesized
aagctccaaagcactttcca

SEQ ID NO: 174611 - DNA, 20 bp, Artificial Sequence
  chemically synthesized
ggtacaagtttggctttgga

SEQ ID NO: 174612 - DNA, 20 bp, Artificial Sequence
  chemically synthesized
ttttggtacaagtttggctt

SEQ ID NO: 174613 - DNA, 20 bp, Artificial Sequence
  chemically synthesized
catgacttttggtacaagtt

SEQ ID NO: 174614 - DNA, 20 bp, Artificial Sequence
  chemically synthesized
caaagccaaacttgtaccaa

SEQ ID NO: 174615 - DNA, 20 bp, Artificial Sequence
  chemically synthesized
gtgaccatgacttttggtac

SEQ ID NO: 174616 - DNA, 20 bp, Artificial Sequence
  chemically synthesized
caaacttgtaccaaaagtca

SEQ ID NO: 174617 - DNA, 20 bp, Artificial Sequence
  chemically synthesized
tgaacagtgaccatgacttt

SEQ ID NO: 174618 - DNA, 20 bp, Artificial Sequence
  chemically synthesized
aagtcatggtcactgttcac

SEQ ID NO: 174619 - DNA, 20 bp, Artificial Sequence
  chemically synthesized
gccagcaggagaccagtgaa

SEQ ID NO: 174620 - DNA, 20 bp, Artificial Sequence
  chemically synthesized
gggtcaggccagcaggagac

SEQ ID NO: 174621 - DNA, 20 bp, Artificial Sequence
  chemically synthesized
actgttcactggtctcctgc

SEQ ID NO: 174622 - DNA, 20 bp, Artificial Sequence
  chemically synthesized
gtagtgggtcaggccagcag

SEQ ID NO: 174623 - DNA, 20 bp, Artificial Sequence
  chemically synthesized
cggtagtgggtcaggccagc

SEQ ID NO: 174624 - DNA, 20 bp, Artificial Sequence
  chemically synthesized
gcggtagtgggtcaggccag

SEQ ID NO: 174625 - DNA, 20 bp, Artificial Sequence
  chemically synthesized
aaagcggtagtgggtcaggc

SEQ ID NO: 174626 - DNA, 20 bp, Artificial Sequence
  chemically synthesized
tcagaaagcggtagtgggtc

SEQ ID NO: 174627 - DNA, 20 bp, Artificial Sequence
  chemically synthesized
ttcagaaagcggtagtgggt

SEQ ID NO: 174628 - DNA, 20 bp, Artificial Sequence
  chemically synthesized
gggattcagaaagcggtagt

SEQ ID NO: 174629 - DNA, 20 bp, Artificial Sequence
  chemically synthesized
cgggattcagaaagcggtag

SEQ ID NO: 174630 - DNA, 20 bp, Artificial Sequence
  chemically synthesized
cgccgggattcagaaagcgg

SEQ ID NO: 174631 - DNA, 20 bp, Artificial Sequence
  chemically synthesized
tttcgccgggattcagaaag

SEQ ID NO: 174632 - DNA, 20 bp, Artificial Sequence
  chemically synthesized
tggtttcgccgggattcaga

SEQ ID NO: 174633 - DNA, 20 bp, Artificial Sequence
  chemically synthesized
cactaccgctttctgaatcc

SEQ ID NO: 174634 - DNA, 20 bp, Artificial Sequence
  chemically synthesized
gtagtggtttcgccgggatt

SEQ ID NO: 174635 - DNA, 20 bp, Artificial Sequence
  chemically synthesized
tcaaatgtagtggtttcgcc

SEQ ID NO: 174636 - DNA, 20 bp, Artificial Sequence
  chemically synthesized
ctcaaatgtagtggtttcgc

SEQ ID NO: 174637 - DNA, 20 bp, Artificial Sequence
  chemically synthesized
agcatacttctcaaatgtag

SEQ ID NO: 174638 - DNA, 20 bp, Artificial Sequence
  chemically synthesized
ccggcgaaaccactacattt

SEQ ID NO: 174639 - DNA, 20 bp, Artificial Sequence
  chemically synthesized
ctgagcatacttctcaaatg

SEQ ID NO: 174640 - DNA, 20 bp, Artificial Sequence
  chemically synthesized
gcgaaaccactacatttgag

SEQ ID NO: 174641 - DNA, 20 bp, Artificial Sequence
  chemically synthesized
ctacatttgagaagtatgct

SEQ ID NO: 174642 - DNA, 20 bp, Artificial Sequence
  chemically synthesized
atgtatctcatcaatttact

SEQ ID NO: 174643 - DNA, 20 bp, Artificial Sequence
  chemically synthesized
agtatgctcagtaaattgat

SEQ ID NO: 174644 - DNA, 20 bp, Artificial Sequence
  chemically synthesized
actgctggctgcaggcatgg

SEQ ID NO: 174645 - DNA, 20 bp, Artificial Sequence
  chemically synthesized
atcaaaaactgccatgcctg

SEQ ID NO: 174646 - DNA, 20 bp, Artificial Sequence
  chemically synthesized
accactgctggctgcaggca

SEQ ID NO: 174647 - DNA, 20 bp, Artificial Sequence
  chemically synthesized
aaaactgccatgcctgcagc

SEQ ID NO: 174648 - DNA, 20 bp, Artificial Sequence
  chemically synthesized
tgttgaccactgctggctgc

SEQ ID NO: 174649 - DNA, 20 bp, Artificial Sequence
  chemically synthesized
actgccatgcctgcagccag

SEQ ID NO: 174650 - DNA, 20 bp, Artificial Sequence
  chemically synthesized
ctgttgaccactgctggctg

SEQ ID NO: 174651 - DNA, 20 bp, Artificial Sequence
  chemically synthesized
gccatgcctgcagccagcag

SEQ ID NO: 174652 - DNA, 20 bp, Artificial Sequence
  chemically synthesized
ccctttctgttgaccactgc

SEQ ID NO: 174653 - DNA, 20 bp, Artificial Sequence
  chemically synthesized
ctgcagccagcagtggtcaa

SEQ ID NO: 174654 - DNA, 20 bp, Artificial Sequence
  chemically synthesized
agccagcagtggtcaacaga

SEQ ID NO: 174655 - DNA, 20 bp, Artificial Sequence
  chemically synthesized
gccagcagtggtcaacagaa

SEQ ID NO: 174656 - DNA, 20 bp, Artificial Sequence
  chemically synthesized
ccagcagtggtcaacagaaa

SEQ ID NO: 174657 - DNA, 20 bp, Artificial Sequence
  chemically synthesized
cgttgtcacagagaagaatt

SEQ ID NO: 174658 - DNA, 20 bp, Artificial Sequence
  chemically synthesized
gcgttgtcacagagaagaat

SEQ ID NO: 174659 - DNA, 20 bp, Artificial Sequence
  chemically synthesized
ggtcgggcgttgtcacagag

SEQ ID NO: 174660 - DNA, 20 bp, Artificial Sequence
  chemically synthesized
tgcggtcgggcgttgtcaca

SEQ ID NO: 174661 - DNA, 20 bp, Artificial Sequence
  chemically synthesized
cgtgcggtcgggcgttgtca

SEQ ID NO: 174662 - DNA, 20 bp, Artificial Sequence
  chemically synthesized
tggttgtgcgacgtgcggtc

SEQ ID NO: 174663 - DNA, 20 bp, Artificial Sequence
  chemically synthesized
ttggttgtgcgacgtgcggt

SEQ ID NO: 174664 - DNA, 20 bp, Artificial Sequence
  chemically synthesized
agcgttggttgtgcgacgtg

SEQ ID NO: 174665 - DNA, 20 bp, Artificial Sequence
  chemically synthesized
tcattcaacttgtgaagcgt

SEQ ID NO: 174666 - DNA, 20 bp, Artificial Sequence
  chemically synthesized
tcgcacaaccaacgcttcac

SEQ ID NO: 174667 - DNA, 20 bp, Artificial Sequence
  chemically synthesized
cccgattcattcaacttgtg

SEQ ID NO: 174668 - DNA, 20 bp, Artificial Sequence
  chemically synthesized
gcttcacaagttgaatgaat

SEQ ID NO: 174669 - DNA, 20 bp, Artificial Sequence
  chemically synthesized
cttcacaagttgaatgaatc

SEQ ID NO: 174670 - DNA, 20 bp, Artificial Sequence
  chemically synthesized
acaagttgaatgaatcgggc

SEQ ID NO: 174671 - DNA, 20 bp, Artificial Sequence
  chemically synthesized
caagttgaatgaatcgggct

SEQ ID NO: 174672 - DNA, 20 bp, Artificial Sequence
  chemically synthesized
gttgaatgaatcgggctagg

SEQ ID NO: 174673 - DNA, 20 bp, Artificial Sequence
  chemically synthesized
gcagatgaggcaaaacttcc

SEQ ID NO: 174674 - DNA, 20 bp, Artificial Sequence
  chemically synthesized
tcaggtaaatatggcagatg

SEQ ID NO: 174675 - DNA, 20 bp, Artificial Sequence
  chemically synthesized
gtcaggtaaatatggcagat

SEQ ID NO: 174676 - DNA, 20 bp, Artificial Sequence
  chemically synthesized
gagaggtcaggtaaatatgg

SEQ ID NO: 174677 - DNA, 20 bp, Artificial Sequence
  chemically synthesized
gttgagaggtcaggtaaata

SEQ ID NO: 174678 - DNA, 20 bp, Artificial Sequence
  chemically synthesized
agtcagttggttgagaggtc

SEQ ID NO: 174679 - DNA, 20 bp, Artificial Sequence
  chemically synthesized
tagtcagttggttgagaggt

SEQ ID NO: 174680 - DNA, 20 bp, Artificial Sequence
  chemically synthesized
gtggtagtcagttggttgag

SEQ ID NO: 174681 - DNA, 20 bp, Artificial Sequence
  chemically synthesized
agtggtagtcagttggttga

SEQ ID NO: 174682 - DNA, 20 bp, Artificial Sequence
  chemically synthesized
gaagtggtagtcagttggtt

SEQ ID NO: 174683 - DNA, 20 bp, Artificial Sequence
  chemically synthesized
ttgaagaagtggtagtcagt

SEQ ID NO: 174684 - DNA, 20 bp, Artificial Sequence
  chemically synthesized
atgcttgaagaagtggtagt

SEQ ID NO: 174685 - DNA, 20 bp, Artificial Sequence
  chemically synthesized
cgagatgcttgaagaagtgg

SEQ ID NO: 174686 - DNA, 20 bp, Artificial Sequence
  chemically synthesized
caactgactaccacttcttc

SEQ ID NO: 174687 - DNA, 20 bp, Artificial Sequence
  chemically synthesized
tgtcgagatgcttgaagaag

SEQ ID NO: 174688 - DNA, 20 bp, Artificial Sequence
  chemically synthesized
agttgtcgagatgcttgaag

SEQ ID NO: 174689 - DNA, 20 bp, Artificial Sequence
  chemically synthesized
aaaagttgtcgagatgcttg

SEQ ID NO: 174690 - DNA, 20 bp, Artificial Sequence
  chemically synthesized
tttccctgtaaaaagttgtc

SEQ ID NO: 174691 - DNA, 20 bp, Artificial Sequence
  chemically synthesized
agcatctcgacaacttttta

SEQ ID NO: 174692 - DNA, 20 bp, Artificial Sequence
  chemically synthesized
gcatctcgacaactttttac

SEQ ID NO: 174693 - DNA, 20 bp, Artificial Sequence
  chemically synthesized
catctcgacaactttttaca

SEQ ID NO: 174694 - DNA, 20 bp, Artificial Sequence
  chemically synthesized
ggaagcattttccctgtaaa

SEQ ID NO: 174695 - DNA, 20 bp, Artificial Sequence
  chemically synthesized
agggaaaatgcttccacaac

SEQ ID NO: 174696 - DNA, 20 bp, Artificial Sequence
  chemically synthesized
cttcatcctgctagttgtgg

SEQ ID NO: 174697 - DNA, 20 bp, Artificial Sequence
  chemically synthesized
gaaaatgcttccacaactag

SEQ ID NO: 174698 - DNA, 20 bp, Artificial Sequence
  chemically synthesized
tttcttcatcctgctagttg

SEQ ID NO: 174699 - DNA, 20 bp, Artificial Sequence
  chemically synthesized
aaaatgcttccacaactagc

SEQ ID NO: 174700 - DNA, 20 bp, Artificial Sequence
  chemically synthesized
aagcattttcttcatcctgc

SEQ ID NO: 174701 - DNA, 20 bp, Artificial Sequence
  chemically synthesized
cttccacaactagcaggatg

SEQ ID NO: 174702 - DNA, 20 bp, Artificial Sequence
  chemically synthesized
ggatgaagaaaatgctttcc

SEQ ID NO: 174703 - DNA, 20 bp, Artificial Sequence
  chemically synthesized
atgaagaaaatgctttccaa

SEQ ID NO: 174704 - DNA, 20 bp, Artificial Sequence
  chemically synthesized
ggattcaatgaactcttgga

SEQ ID NO: 174705 - DNA, 20 bp, Artificial Sequence
  chemically synthesized
tttgggattcaatgaactct

SEQ ID NO: 174706 - DNA, 20 bp, Artificial Sequence
  chemically synthesized
caagagttcattgaatccca

SEQ ID NO: 174707 - DNA, 20 bp, Artificial Sequence
  chemically synthesized
agcataaaaattcatgcttt

SEQ ID NO: 174708 - DNA, 20 bp, Artificial Sequence
  chemically synthesized
tagcataaaaattcatgctt

SEQ ID NO: 174709 - DNA, 20 bp, Artificial Sequence
  chemically synthesized
aagcatgaatttttatgcta

SEQ ID NO: 174710 - DNA, 20 bp, Artificial Sequence
  chemically synthesized
agcatgaatttttatgctac

SEQ ID NO: 174711 - DNA, 20 bp, Artificial Sequence
  chemically synthesized
aataagtgtgtttattcctg

SEQ ID NO: 174712 - DNA, 20 bp, Artificial Sequence
  chemically synthesized
catttttgccaagaagaaat

SEQ ID NO: 174713 - DNA, 20 bp, Artificial Sequence
  chemically synthesized
taaacacacttatttcttct

SEQ ID NO: 174714 - DNA, 20 bp, Artificial Sequence
  chemically synthesized
gtcaacacatttttgccaag

SEQ ID NO: 174715 - DNA, 20 bp, Artificial Sequence
  chemically synthesized
acagtcaacacatttttgcc

SEQ ID NO: 174716 - DNA, 20 bp, Artificial Sequence
  chemically synthesized
caaaaatgtgttgactgtaa

SEQ ID NO: 174717 - DNA, 20 bp, Artificial Sequence
  chemically synthesized
aatcaaagtaggaaccgtta

SEQ ID NO: 174718 - DNA, 20 bp, Artificial Sequence
  chemically synthesized
acatctttattaatcaaagt

SEQ ID NO: 174719 - DNA, 20 bp, Artificial Sequence
  chemically synthesized
cacatctttattaatcaaag

SEQ ID NO: 174720 - DNA, 20 bp, Artificial Sequence
  chemically synthesized
aagcacatctttattaatca

SEQ ID NO: 174721 - DNA, 20 bp, Artificial Sequence
  chemically synthesized
ggttcctactttgattaata

SEQ ID NO: 174722 - DNA, 20 bp, Artificial Sequence
  chemically synthesized
tgattaataaagatgtgctt

SEQ ID NO: 174723 - DNA, 20 bp, Artificial Sequence
  chemically synthesized
aataaagatgtgcttgagcc

SEQ ID NO: 174724 - DNA, 20 bp, Artificial Sequence
  chemically synthesized
aaatcattataactaggctc

SEQ ID NO: 174725 - DNA, 20 bp, Artificial Sequence
  chemically synthesized
aattttaaatcattataact

SEQ ID NO: 174726 - DNA, 20 bp, Artificial Sequence
  chemically synthesized
gaattttaaatcattataac

SEQ ID NO: 174727 - DNA, 20 bp, Artificial Sequence
  chemically synthesized
ttataatgatttaaaattca

SEQ ID NO: 174728 - DNA, 20 bp, Artificial Sequence
  chemically synthesized
tgcaaaagaaattgcagttt

SEQ ID NO: 174729 - DNA, 20 bp, Artificial Sequence
  chemically synthesized
gtgcaaaagaaattgcagtt

SEQ ID NO: 174730 - DNA, 20 bp, Artificial Sequence
  chemically synthesized
ggttggtgcaaaagaaattg

SEQ ID NO: 174731 - DNA, 20 bp, Artificial Sequence
  chemically synthesized
gatatattaggttggtgcaa

SEQ ID NO: 174732 - DNA, 20 bp, Artificial Sequence
  chemically synthesized
tggactgagatatattaggt

SEQ ID NO: 174733 - DNA, 20 bp, Artificial Sequence
  chemically synthesized
aaaatggactgagatatatt

SEQ ID NO: 174734 - DNA, 20 bp, Artificial Sequence
  chemically synthesized
aaaaatggactgagatatat

SEQ ID NO: 174735 - DNA, 20 bp, Artificial Sequence
  chemically synthesized
tgcaccaacctaatatatct

SEQ ID NO: 174736 - DNA, 20 bp, Artificial Sequence
  chemically synthesized
tggccctacaaaaatggact

SEQ ID NO: 174737 - DNA, 20 bp, Artificial Sequence
  chemically synthesized
tatatctcagtccatttttg

SEQ ID NO: 174738 - DNA, 20 bp, Artificial Sequence
  chemically synthesized
atatctcagtccatttttgt

SEQ ID NO: 174739 - DNA, 20 bp, Artificial Sequence
  chemically synthesized
caaaaatggccctacaaaaa

SEQ ID NO: 174740 - DNA, 20 bp, Artificial Sequence
  chemically synthesized
tatctcagtccatttttgta

SEQ ID NO: 174741 - DNA, 20 bp, Artificial Sequence
  chemically synthesized
cctggaaacaggaacaaaaa

SEQ ID NO: 174742 - DNA, 20 bp, Artificial Sequence
  chemically synthesized
gccatttttgttcctgtttc

SEQ ID NO: 174743 - DNA, 20 bp, Artificial Sequence
  chemically synthesized
ccatttttgttcctgtttcc

SEQ ID NO: 174744 - DNA, 20 bp, Artificial Sequence
  chemically synthesized
cagttttctcacctggaaac

SEQ ID NO: 174745 - DNA, 20 bp, Artificial Sequence
  chemically synthesized
tcagttttctcacctggaaa

SEQ ID NO: 174746 - DNA, 20 bp, Artificial Sequence
  chemically synthesized
ttttgttcctgtttccaggt

SEQ ID NO: 174747 - DNA, 20 bp, Artificial Sequence
  chemically synthesized
gtggtctcagttttctcacc

SEQ ID NO: 174748 - DNA, 20 bp, Artificial Sequence
  chemically synthesized
tgtttccaggtgagaaaact

SEQ ID NO: 174749 - DNA, 20 bp, Artificial Sequence
  chemically synthesized
aggtgagaaaactgagacca

SEQ ID NO: 174750 - DNA, 20 bp, Artificial Sequence
  chemically synthesized
gtgtcatctctctgtggtct

SEQ ID NO: 174751 - DNA, 20 bp, Artificial Sequence
  chemically synthesized
gtgagaaaactgagaccaca

SEQ ID NO: 174752 - DNA, 20 bp, Artificial Sequence
  chemically synthesized
gagaaaactgagaccacaga

SEQ ID NO: 174753 - DNA, 20 bp, Artificial Sequence
  chemically synthesized
ctagctgtgtcatctctctg

SEQ ID NO: 174754 - DNA, 20 bp, Artificial Sequence
  chemically synthesized
gagaccacagagagatgaca

SEQ ID NO: 174755 - DNA, 20 bp, Artificial Sequence
  chemically synthesized
ccacagagagatgacacagc

SEQ ID NO: 174756 - DNA, 20 bp, Artificial Sequence
  chemically synthesized
agagagatgacacagctagt

SEQ ID NO: 174757 - DNA, 20 bp, Artificial Sequence
  chemically synthesized
gagagatgacacagctagta

SEQ ID NO: 174758 - DNA, 20 bp, Artificial Sequence
  chemically synthesized
gccttccacaaattccttac

SEQ ID NO: 174759 - DNA, 20 bp, Artificial Sequence
  chemically synthesized
cacagctagtaaggaatttg

SEQ ID NO: 174760 - DNA, 20 bp, Artificial Sequence
  chemically synthesized
agctagtaaggaatttgtgg

SEQ ID NO: 174761 - DNA, 20 bp, Artificial Sequence
  chemically synthesized
gctagtaaggaatttgtgga

SEQ ID NO: 174762 - DNA, 20 bp, Artificial Sequence
  chemically synthesized
atttgtggaaggcgattatt

SEQ ID NO: 174763 - DNA, 20 bp, Artificial Sequence
  chemically synthesized
tgtggaaggcgattatttgg

SEQ ID NO: 174764 - DNA, 20 bp, Artificial Sequence
  chemically synthesized
aagaggcgtgattaattgtg

SEQ ID NO: 174765 - DNA, 20 bp, Artificial Sequence
  chemically synthesized
caagaggcgtgattaattgt

SEQ ID NO: 174766 - DNA, 20 bp, Artificial Sequence
  chemically synthesized
ccaagaggcgtgattaattg

SEQ ID NO: 174767 - DNA, 20 bp, Artificial Sequence
  chemically synthesized
ccacaattaatcacgcctct

SEQ ID NO: 174768 - DNA, 20 bp, Artificial Sequence
  chemically synthesized
cacaaaggcatgaatccaag

SEQ ID NO: 174769 - DNA, 20 bp, Artificial Sequence
  chemically synthesized
acacaaaggcatgaatccaa

SEQ ID NO: 174770 - DNA, 20 bp, Artificial Sequence
  chemically synthesized
ctacacaaaggcatgaatcc

SEQ ID NO: 174771 - DNA, 20 bp, Artificial Sequence
  chemically synthesized
cttggattcatgcctttgtg

SEQ ID NO: 174772 - DNA, 20 bp, Artificial Sequence
  chemically synthesized
aatgagaagggactacacaa

SEQ ID NO: 174773 - DNA, 20 bp, Artificial Sequence
  chemically synthesized
aaatgagaagggactacaca

SEQ ID NO: 174774 - DNA, 20 bp, Artificial Sequence
  chemically synthesized
gttcagaatcaaaatgagaa

SEQ ID NO: 174775 - DNA, 20 bp, Artificial Sequence
  chemically synthesized
agttcagaatcaaaatgaga

SEQ ID NO: 174776 - DNA, 20 bp, Artificial Sequence
  chemically synthesized
aagttcagaatcaaaatgag

SEQ ID NO: 174777 - DNA, 20 bp, Artificial Sequence
  chemically synthesized
gccaagttcagaatcaaaat

SEQ ID NO: 174778 - DNA, 20 bp, Artificial Sequence
  chemically synthesized
tctcattttgattctgaact

SEQ ID NO: 174779 - DNA, 20 bp, Artificial Sequence
  chemically synthesized
gccaggcatatggccaagtt

SEQ ID NO: 174780 - DNA, 20 bp, Artificial Sequence
  chemically synthesized
ccaaagccaggcatatggcc

SEQ ID NO: 174781 - DNA, 20 bp, Artificial Sequence
  chemically synthesized
tctgaacttggccatatgcc

SEQ ID NO: 174782 - DNA, 20 bp, Artificial Sequence
  chemically synthesized
attggccaaagccaggcata

SEQ ID NO: 174783 - DNA, 20 bp, Artificial Sequence
  chemically synthesized
cttggccatatgcctggctt

SEQ ID NO: 174784 - DNA, 20 bp, Artificial Sequence
  chemically synthesized
ctatcccattggccaaagcc

SEQ ID NO: 174785 - DNA, 20 bp, Artificial Sequence
  chemically synthesized
actatcccattggccaaagc

SEQ ID NO: 174786 - DNA, 20 bp, Artificial Sequence
  chemically synthesized
atatgcctggctttggccaa

SEQ ID NO: 174787 - DNA, 20 bp, Artificial Sequence
  chemically synthesized
tgctactatcccattggcca

SEQ ID NO: 174788 - DNA, 20 bp, Artificial Sequence
  chemically synthesized
tatgcctggctttggccaat

SEQ ID NO: 174789 - DNA, 20 bp, Artificial Sequence
  chemically synthesized
cctggctttggccaatggga

SEQ ID NO: 174790 - DNA, 20 bp, Artificial Sequence
  chemically synthesized
cacacttgctactatcccat

SEQ ID NO: 174791 - DNA, 20 bp, Artificial Sequence
  chemically synthesized
ggctttggccaatgggatag

SEQ ID NO: 174792 - DNA, 20 bp, Artificial Sequence
  chemically synthesized
ttggccaatgggatagtagc

SEQ ID NO: 174793 - DNA, 20 bp, Artificial Sequence
  chemically synthesized
agtagcaagtgtgatacaaa

SEQ ID NO: 174794 - DNA, 20 bp, Artificial Sequence
  chemically synthesized
agcaagtgtgatacaaacag

SEQ ID NO: 174795 - DNA, 20 bp, Artificial Sequence
  chemically synthesized
gatacaaacagaagcttgat

SEQ ID NO: 174796 - DNA, 20 bp, Artificial Sequence
  chemically synthesized
ccaatcttcaaagacttatc

SEQ ID NO: 174797 - DNA, 20 bp, Artificial Sequence
  chemically synthesized
agaagcttgataagtctttg

SEQ ID NO: 174798 - DNA, 20 bp, Artificial Sequence
  chemically synthesized
cttgataagtctttgaagat

SEQ ID NO: 174799 - DNA, 20 bp, Artificial Sequence
  chemically synthesized
agaacaagcaccaatcttca

SEQ ID NO: 174800 - DNA, 20 bp, Artificial Sequence
  chemically synthesized
aagattggtgcttgttcttt

SEQ ID NO: 174801 - DNA, 20 bp, Artificial Sequence
  chemically synthesized
aagaagccttccaaaagaac

SEQ ID NO: 174802 - DNA, 20 bp, Artificial Sequence
  chemically synthesized
attggtgcttgttcttttgg

SEQ ID NO: 174803 - DNA, 20 bp, Artificial Sequence
  chemically synthesized
ttggtgcttgttcttttgga

SEQ ID NO: 174804 - DNA, 20 bp, Artificial Sequence
  chemically synthesized
tctgtgaagaagccttccaa

SEQ ID NO: 174805 - DNA, 20 bp, Artificial Sequence
  chemically synthesized
tcttttggaaggcttcttca

SEQ ID NO: 174806 - DNA, 20 bp, Artificial Sequence
  chemically synthesized
ggtggttgagttctgtgaag

SEQ ID NO: 174807 - DNA, 20 bp, Artificial Sequence
  chemically synthesized
cttggtggttgagttctgtg

SEQ ID NO: 174808 - DNA, 20 bp, Artificial Sequence
  chemically synthesized
cttcacagaactcaaccacc

SEQ ID NO: 174809 - DNA, 20 bp, Artificial Sequence
  chemically synthesized
ttccccacagcttggtggtt

SEQ ID NO: 174810 - DNA, 20 bp, Artificial Sequence
  chemically synthesized
ttggcttccccacagcttgg

SEQ ID NO: 174811 - DNA, 20 bp, Artificial Sequence
  chemically synthesized
agaactcaaccaccaagctg

SEQ ID NO: 174812 - DNA, 20 bp, Artificial Sequence
  chemically synthesized
gaactcaaccaccaagctgt

SEQ ID NO: 174813 - DNA, 20 bp, Artificial Sequence
  chemically synthesized
aactcaaccaccaagctgtg

SEQ ID NO: 174814 - DNA, 20 bp, Artificial Sequence
  chemically synthesized
cctttggcttccccacagct

SEQ ID NO: 174815 - DNA, 20 bp, Artificial Sequence
  chemically synthesized
tcaaccaccaagctgtgggg

SEQ ID NO: 174816 - DNA, 20 bp, Artificial Sequence
  chemically synthesized
tgtctcctttggcttcccca

SEQ ID NO: 174817 - DNA, 20 bp, Artificial Sequence
  chemically synthesized
accaagctgtggggaagcca

SEQ ID NO: 174818 - DNA, 20 bp, Artificial Sequence
  chemically synthesized
ccaagctgtggggaagccaa

SEQ ID NO: 174819 - DNA, 20 bp, Artificial Sequence
  chemically synthesized
aagctgtggggaagccaaag

SEQ ID NO: 174820 - DNA, 20 bp, Artificial Sequence
  chemically synthesized
tcttctccatgtgtctcctt

SEQ ID NO: 174821 - DNA, 20 bp, Artificial Sequence
  chemically synthesized
gggaagccaaaggagacaca

SEQ ID NO: 174822 - DNA, 20 bp, Artificial Sequence
  chemically synthesized
gaagccaaaggagacacatg

SEQ ID NO: 174823 - DNA, 20 bp, Artificial Sequence
  chemically synthesized
gccaaaggagacacatggag

SEQ ID NO: 174824 - DNA, 20 bp, Artificial Sequence
  chemically synthesized
gagacacatggagaagacaa

SEQ ID NO: 174825 - DNA, 20 bp, Artificial Sequence
  chemically synthesized
gaagacaatggaaacaaact

SEQ ID NO: 174826 - DNA, 20 bp, Artificial Sequence
  chemically synthesized
aagacaatggaaacaaactg

SEQ ID NO: 174827 - DNA, 20 bp, Artificial Sequence
  chemically synthesized
tggaaacaaactgaggctca

SEQ ID NO: 174828 - DNA, 20 bp, Artificial Sequence
  chemically synthesized
aagctattggccatgagcct

SEQ ID NO: 174829 - DNA, 20 bp, Artificial Sequence
  chemically synthesized
cagctaaagctattggccat

SEQ ID NO: 174830 - DNA, 20 bp, Artificial Sequence
  chemically synthesized
aaactgaggctcatggccaa

SEQ ID NO: 174831 - DNA, 20 bp, Artificial Sequence
  chemically synthesized
aggctcatggccaatagctt

SEQ ID NO: 174832 - DNA, 20 bp, Artificial Sequence
  chemically synthesized
gagaactcagctaaagctat

SEQ ID NO: 174833 - DNA, 20 bp, Artificial Sequence
  chemically synthesized
catggccaatagctttagct

SEQ ID NO: 174834 - DNA, 20 bp, Artificial Sequence
  chemically synthesized
accagctgagaactcagcta

SEQ ID NO: 174835 - DNA, 20 bp, Artificial Sequence
  chemically synthesized
aatagctttagctgagttct

SEQ ID NO: 174836 - DNA, 20 bp, Artificial Sequence
  chemically synthesized
ctgcctaccagctgagaact

SEQ ID NO: 174837 - DNA, 20 bp, Artificial Sequence
  chemically synthesized
gctttagctgagttctcagc

SEQ ID NO: 174838 - DNA, 20 bp, Artificial Sequence
  chemically synthesized
ttagctgagttctcagctgg

SEQ ID NO: 174839 - DNA, 20 bp, Artificial Sequence
  chemically synthesized
tagctgagttctcagctggt

SEQ ID NO: 174840 - DNA, 20 bp, Artificial Sequence
  chemically synthesized
gttggtgctgcctaccagct

SEQ ID NO: 174841 - DNA, 20 bp, Artificial Sequence
  chemically synthesized
ctgagttctcagctggtagg

SEQ ID NO: 174842 - DNA, 20 bp, Artificial Sequence
  chemically synthesized
tggcagttggtgctgcctac

SEQ ID NO: 174843 - DNA, 20 bp, Artificial Sequence
  chemically synthesized
tggtaggcagcaccaactgc

SEQ ID NO: 174844 - DNA, 20 bp, Artificial Sequence
  chemically synthesized
tcactcacatgactggcagt

SEQ ID NO: 174845 - DNA, 20 bp, Artificial Sequence
  chemically synthesized
ggcctcactcacatgactgg

SEQ ID NO: 174846 - DNA, 20 bp, Artificial Sequence
  chemically synthesized
gcaccaactgccagtcatgt

SEQ ID NO: 174847 - DNA, 20 bp, Artificial Sequence
  chemically synthesized
aatggcctcactcacatgac

SEQ ID NO: 174848 - DNA, 20 bp, Artificial Sequence
  chemically synthesized
caactgccagtcatgtgagt

SEQ ID NO: 174849 - DNA, 20 bp, Artificial Sequence
  chemically synthesized
aactgccagtcatgtgagtg

SEQ ID NO: 174850 - DNA, 20 bp, Artificial Sequence
  chemically synthesized
tcatgtgagtgaggccattt

SEQ ID NO: 174851 - DNA, 20 bp, Artificial Sequence
  chemically synthesized
gaaagctggaaagtccaaaa

SEQ ID NO: 174852 - DNA, 20 bp, Artificial Sequence
  chemically synthesized
tgaggccattttggactttc

SEQ ID NO: 174853 - DNA, 20 bp, Artificial Sequence
  chemically synthesized
aagacactgggaaagctgga

SEQ ID NO: 174854 - DNA, 20 bp, Artificial Sequence
  chemically synthesized
tttggactttccagctttcc

SEQ ID NO: 174855 - DNA, 20 bp, Artificial Sequence
  chemically synthesized
aaccaagacactgggaaagc

SEQ ID NO: 174856 - DNA, 20 bp, Artificial Sequence
  chemically synthesized
tatcaaccaagacactggga

SEQ ID NO: 174857 - DNA, 20 bp, Artificial Sequence
  chemically synthesized
ttccagctttcccagtgtct

SEQ ID NO: 174858 - DNA, 20 bp, Artificial Sequence
  chemically synthesized
ctgatatcaaccaagacact

SEQ ID NO: 174859 - DNA, 20 bp, Artificial Sequence
  chemically synthesized
cctgatatcaaccaagacac

SEQ ID NO: 174860 - DNA, 20 bp, Artificial Sequence
  chemically synthesized
tgcttcacctgatatcaacc

SEQ ID NO: 174861 - DNA, 20 bp, Artificial Sequence
  chemically synthesized
cccagtgtcttggttgatat

SEQ ID NO: 174862 - DNA, 20 bp, Artificial Sequence
  chemically synthesized
ccagtgtcttggttgatatc

SEQ ID NO: 174863 - DNA, 20 bp, Artificial Sequence
  chemically synthesized
gtcttggttgatatcaggtg

SEQ ID NO: 174864 - DNA, 20 bp, Artificial Sequence
  chemically synthesized
ttggttgatatcaggtgaag

SEQ ID NO: 174865 - DNA, 20 bp, Artificial Sequence
  chemically synthesized
ggtgaagcagatgaatatca

SEQ ID NO: 174866 - DNA, 20 bp, Artificial Sequence
  chemically synthesized
tgaatatcatagtcaactct

SEQ ID NO: 174867 - DNA, 20 bp, Artificial Sequence
  chemically synthesized
acgatttctcataattctga

SEQ ID NO: 174868 - DNA, 20 bp, Artificial Sequence
  chemically synthesized
ttacgatttctcataattct

SEQ ID NO: 174869 - DNA, 20 bp, Artificial Sequence
  chemically synthesized
tagtcaactctcagaattat

SEQ ID NO: 174870 - DNA, 20 bp, Artificial Sequence
  chemically synthesized
gttactggcttaaaataaga

SEQ ID NO: 174871 - DNA, 20 bp, Artificial Sequence
  chemically synthesized
tcgtaaaactatcttatttt

SEQ ID NO: 174872 - DNA, 20 bp, Artificial Sequence
  chemically synthesized
aaaagttactggcttaaaat

SEQ ID NO: 174873 - DNA, 20 bp, Artificial Sequence
  chemically synthesized
aaaactatcttattttaagc

SEQ ID NO: 174874 - DNA, 20 bp, Artificial Sequence
  chemically synthesized
caaaccactctaaaagttac

SEQ ID NO: 174875 - DNA, 20 bp, Artificial Sequence
  chemically synthesized
tattttaagccagtaacttt

SEQ ID NO: 174876 - DNA, 20 bp, Artificial Sequence
  chemically synthesized
ttttaagccagtaactttta

SEQ ID NO: 174877 - DNA, 20 bp, Artificial Sequence
  chemically synthesized
taagccagtaacttttagag

SEQ ID NO: 174878 - DNA, 20 bp, Artificial Sequence
  chemically synthesized
tatgcaacaaaccactctaa

SEQ ID NO: 174879 - DNA, 20 bp, Artificial Sequence
  chemically synthesized
ttttagagtggtttgttgca

SEQ ID NO: 174880 - DNA, 20 bp, Artificial Sequence
  chemically synthesized
tgttgcatagcatatataac

SEQ ID NO: 174881 - DNA, 20 bp, Artificial Sequence
  chemically synthesized
catagcatatataactggaa

SEQ ID NO: 174882 - DNA, 20 bp, Artificial Sequence
  chemically synthesized
tagcatatataactggaaca

SEQ ID NO: 174883 - DNA, 20 bp, Artificial Sequence
  chemically synthesized
attttgatttcactctgttc

SEQ ID NO: 174884 - DNA, 20 bp, Artificial Sequence
  chemically synthesized
agtgaaatcaaaatttgaac

SEQ ID NO: 174885 - DNA, 20 bp, Artificial Sequence
  chemically synthesized
gtgaaatcaaaatttgaacc

SEQ ID NO: 174886 - DNA, 20 bp, Artificial Sequence
  chemically synthesized
aaatcaaaatttgaaccagg

SEQ ID NO: 174887 - DNA, 20 bp, Artificial Sequence
  chemically synthesized
atcaaaatttgaaccaggca

SEQ ID NO: 174888 - DNA, 20 bp, Artificial Sequence
  chemically synthesized
aaaatttgaaccaggcagag

SEQ ID NO: 174889 - DNA, 20 bp, Artificial Sequence
  chemically synthesized
cgacatgttactactctgcc

SEQ ID NO: 174890 - DNA, 20 bp, Artificial Sequence
  chemically synthesized
aacatgtcgaactaactata

SEQ ID NO: 174891 - DNA, 20 bp, Artificial Sequence
  chemically synthesized
acatgtcgaactaactatac

SEQ ID NO: 174892 - DNA, 20 bp, Artificial Sequence
  chemically synthesized
tttttttaatcctgtatagt

SEQ ID NO: 174893 - DNA, 20 bp, Artificial Sequence
  chemically synthesized
ctgttttttttaatcctgta

SEQ ID NO: 174894 - DNA, 20 bp, Artificial Sequence
  chemically synthesized
ctatacaggattaaaaaaaa

SEQ ID NO: 174895 - DNA, 20 bp, Artificial Sequence
  chemically synthesized
ttaaaaaaaacagcttctca

SEQ ID NO: 174896 - DNA, 20 bp, Artificial Sequence
  chemically synthesized
aagttctgcttcactttgag

SEQ ID NO: 174897 - DNA, 20 bp, Artificial Sequence
  chemically synthesized
aaaaacagcttctcaaagtg

SEQ ID NO: 174898 - DNA, 20 bp, Artificial Sequence
  chemically synthesized
ataaagttctgcttcacttt

SEQ ID NO: 174899 - DNA, 20 bp, Artificial Sequence
  chemically synthesized
aacagcttctcaaagtgaag

SEQ ID NO: 174900 - DNA, 20 bp, Artificial Sequence
  chemically synthesized
tcaaaaaacaaataaagata

SEQ ID NO: 174901 - DNA, 20 bp, Artificial Sequence
  chemically synthesized
tttatttcaaaaaacaaata

SEQ ID NO: 174902 - DNA, 20 bp, Artificial Sequence
  chemically synthesized
ttgaaataaatattctacat

SEQ ID NO: 174903 - DNA, 20 bp, Artificial Sequence
  chemically synthesized
gtagtctggtatagccaatg

SEQ ID NO: 174904 - DNA, 20 bp, Artificial Sequence
  chemically synthesized
atattctacattggctatac

SEQ ID NO: 174905 - DNA, 20 bp, Artificial Sequence
  chemically synthesized
gtatatcacgtagtctggta

SEQ ID NO: 174906 - DNA, 20 bp, Artificial Sequence
  chemically synthesized
tactagtatatcacgtagtc

SEQ ID NO: 174907 - DNA, 20 bp, Artificial Sequence
  chemically synthesized
tagcatactagtatatcacg

SEQ ID NO: 174908 - DNA, 20 bp, Artificial Sequence
  chemically synthesized
taccagactacgtgatatac

SEQ ID NO: 174909 - DNA, 20 bp, Artificial Sequence
  chemically synthesized
agtaaggtaaaatagcatac

SEQ ID NO: 174910 - DNA, 20 bp, Artificial Sequence
  chemically synthesized
agagacacagtaaggtaaaa

SEQ ID NO: 174911 - DNA, 20 bp, Artificial Sequence
  chemically synthesized
acaggaagagagacacagta

SEQ ID NO: 174912 - DNA, 20 bp, Artificial Sequence
  chemically synthesized
aacaggaagagagacacagt

SEQ ID NO: 174913 - DNA, 20 bp, Artificial Sequence
  chemically synthesized
aggaaacaggaagagagaca

SEQ ID NO: 174914 - DNA, 20 bp, Artificial Sequence
  chemically synthesized
aagagcaggaaacaggaaga

SEQ ID NO: 174915 - DNA, 20 bp, Artificial Sequence
  chemically synthesized
ataagagcaggaaacaggaa

SEQ ID NO: 174916 - DNA, 20 bp, Artificial Sequence
  chemically synthesized
acataagagcaggaaacagg

SEQ ID NO: 174917 - DNA, 20 bp, Artificial Sequence
  chemically synthesized
ttcacataagagcaggaaac

SEQ ID NO: 174918 - DNA, 20 bp, Artificial Sequence
  chemically synthesized
attcacataagagcaggaaa

SEQ ID NO: 174919 - DNA, 20 bp, Artificial Sequence
  chemically synthesized
ctgtatattcacataagagc

SEQ ID NO: 174920 - DNA, 20 bp, Artificial Sequence
  chemically synthesized
tctgtatattcacataagag

SEQ ID NO: 174921 - DNA, 20 bp, Artificial Sequence
  chemically synthesized
ttgtctgtatattcacataa

SEQ ID NO: 174922 - DNA, 20 bp, Artificial Sequence
  chemically synthesized
gattgtctgtatattcacat

SEQ ID NO: 174923 - DNA, 20 bp, Artificial Sequence
  chemically synthesized
cctgctcttatgtgaatata

SEQ ID NO: 174924 - DNA, 20 bp, Artificial Sequence
  chemically synthesized
aatatacagacaatcctttc

SEQ ID NO: 174925 - DNA, 20 bp, Artificial Sequence
  chemically synthesized
caaagataatgtcaccagaa

SEQ ID NO: 174926 - DNA, 20 bp, Artificial Sequence
  chemically synthesized
gcaaagataatgtcaccaga

SEQ ID NO: 174927 - DNA, 20 bp, Artificial Sequence
  chemically synthesized
gagagcaaagataatgtcac

SEQ ID NO: 174928 - DNA, 20 bp, Artificial Sequence
  chemically synthesized
ggtgacattatctttgctct

SEQ ID NO: 174929 - DNA, 20 bp, Artificial Sequence
  chemically synthesized
gtgacattatctttgctctc

SEQ ID NO: 174930 - DNA, 20 bp, Artificial Sequence
  chemically synthesized
attctttgttcctgagagca

SEQ ID NO: 174931 - DNA, 20 bp, Artificial Sequence
  chemically synthesized
aggtcattctttgttcctga

SEQ ID NO: 174932 - DNA, 20 bp, Artificial Sequence
  chemically synthesized
tatctttgctctcaggaaca

SEQ ID NO: 174933 - DNA, 20 bp, Artificial Sequence
  chemically synthesized
taaggtcattctttgttcct

SEQ ID NO: 174934 - DNA, 20 bp, Artificial Sequence
  chemically synthesized
tgatataggtaaatgtaata

SEQ ID NO: 174935 - DNA, 20 bp, Artificial Sequence
  chemically synthesized
atgatataggtaaatgtaat

SEQ ID NO: 174936 - DNA, 20 bp, Artificial Sequence
  chemically synthesized
gaaaggggtagtgatgatat

SEQ ID NO: 174937 - DNA, 20 bp, Artificial Sequence
  chemically synthesized
tgaaaggggtagtgatgata

SEQ ID NO: 174938 - DNA, 20 bp, Artificial Sequence
  chemically synthesized
taattaaaatgtgaaagggg

SEQ ID NO: 174939 - DNA, 20 bp, Artificial Sequence
  chemically synthesized
tgctaattaaaatgtgaaag

SEQ ID NO: 174940 - DNA, 20 bp, Artificial Sequence
  chemically synthesized
gtgctaattaaaatgtgaaa

SEQ ID NO: 174941 - DNA, 20 bp, Artificial Sequence
  chemically synthesized
ggtgctaattaaaatgtgaa

SEQ ID NO: 174942 - DNA, 20 bp, Artificial Sequence
  chemically synthesized
tggtgctaattaaaatgtga

SEQ ID NO: 174943 - DNA, 20 bp, Artificial Sequence
  chemically synthesized
tacccctttcacattttaat

SEQ ID NO: 174944 - DNA, 20 bp, Artificial Sequence
  chemically synthesized
ttttaattagcaccaaattg

SEQ ID NO: 174945 - DNA, 20 bp, Artificial Sequence
  chemically synthesized
ataattgtttttctacaatt

SEQ ID NO: 174946 - DNA, 20 bp, Artificial Sequence
  chemically synthesized
aaaacaattatgtaaattat

SEQ ID NO: 174947 - DNA, 20 bp, Artificial Sequence
  chemically synthesized
acaattatgtaaattattag

SEQ ID NO: 174948 - DNA, 20 bp, Artificial Sequence
  chemically synthesized
aattatgtaaattattagca

SEQ ID NO: 174949 - DNA, 20 bp, Artificial Sequence
  chemically synthesized
atgtaaattattagcagaga

SEQ ID NO: 174950 - DNA, 20 bp, Artificial Sequence
  chemically synthesized
taaattattagcagagatag

SEQ ID NO: 174951 - DNA, 20 bp, Artificial Sequence
  chemically synthesized
taatcttgaaagagacagag

SEQ ID NO: 174952 - DNA, 20 bp, Artificial Sequence
  chemically synthesized
ttaatcttgaaagagacaga

SEQ ID NO: 174953 - DNA, 20 bp, Artificial Sequence
  chemically synthesized
tattaatcttgaaagagaca

SEQ ID NO: 174954 - DNA, 20 bp, Artificial Sequence
  chemically synthesized
catattaatcttgaaagaga

SEQ ID NO: 174955 - DNA, 20 bp, Artificial Sequence
  chemically synthesized
gtggcctctctgtctctttc

SEQ ID NO: 174956 - DNA, 20 bp, Artificial Sequence
  chemically synthesized
cagtcatattaatcttgaaa

SEQ ID NO: 174957 - DNA, 20 bp, Artificial Sequence
  chemically synthesized
ctcagtcatattaatcttga

SEQ ID NO: 174958 - DNA, 20 bp, Artificial Sequence
  chemically synthesized
ctttcaagattaatatgact

SEQ ID NO: 174959 - DNA, 20 bp, Artificial Sequence
  chemically synthesized
agattaatatgactgagttg

SEQ ID NO: 174960 - DNA, 20 bp, Artificial Sequence
  chemically synthesized
acttattcttcaccacaact

SEQ ID NO: 174961 - DNA, 20 bp, Artificial Sequence
  chemically synthesized
aatatgactgagttgtggtg

SEQ ID NO: 174962 - DNA, 20 bp, Artificial Sequence
  chemically synthesized
actgagttgtggtgaagaat

SEQ ID NO: 174963 - DNA, 20 bp, Artificial Sequence
  chemically synthesized
gtgaagaataagtcaatgac

SEQ ID NO: 174964 - DNA, 20 bp, Artificial Sequence
  chemically synthesized
tgaagaataagtcaatgaca

SEQ ID NO: 174965 - DNA, 20 bp, Artificial Sequence
  chemically synthesized
gaataagtcaatgacaaggt

SEQ ID NO: 174966 - DNA, 20 bp, Artificial Sequence
  chemically synthesized
gacaaggtcagcatccattc

SEQ ID NO: 174967 - DNA, 20 bp, Artificial Sequence
  chemically synthesized
caaggtcagcatccattcca

SEQ ID NO: 174968 - DNA, 20 bp, Artificial Sequence
  chemically synthesized
aaggtcagcatccattccag

SEQ ID NO: 174969 - DNA, 20 bp, Artificial Sequence
  chemically synthesized
ttcaaaatcttcctctggaa

SEQ ID NO: 174970 - DNA, 20 bp, Artificial Sequence
  chemically synthesized
gtcagcatccattccagagg

SEQ ID NO: 174971 - DNA, 20 bp, Artificial Sequence
  chemically synthesized
tttttttcaaaatcttcctc

SEQ ID NO: 174972 - DNA, 20 bp, Artificial Sequence
  chemically synthesized
aaaaacaaaacaaaaacact

SEQ ID NO: 174973 - DNA, 20 bp, Artificial Sequence
  chemically synthesized
aaaacaaaacaaaaacactt

SEQ ID NO: 174974 - DNA, 20 bp, Artificial Sequence
  chemically synthesized
aacaaaaacacttaggcatt

SEQ ID NO: 174975 - DNA, 20 bp, Artificial Sequence
  chemically synthesized
cagcctttccccaaatgcct

SEQ ID NO: 174976 - DNA, 20 bp, Artificial Sequence
  chemically synthesized
acaaaaacacttaggcattt

SEQ ID NO: 174977 - DNA, 20 bp, Artificial Sequence
  chemically synthesized
caaaaacacttaggcatttg

SEQ ID NO: 174978 - DNA, 20 bp, Artificial Sequence
  chemically synthesized
aacacttaggcatttgggga

SEQ ID NO: 174979 - DNA, 20 bp, Artificial Sequence
  chemically synthesized
acacttaggcatttggggaa

SEQ ID NO: 174980 - DNA, 20 bp, Artificial Sequence
  chemically synthesized
aaatgtctcagtgataagag

SEQ ID NO: 174981 - DNA, 20 bp, Artificial Sequence
  chemically synthesized
aataaatgtctcagtgataa

SEQ ID NO: 174982 - DNA, 20 bp, Artificial Sequence
  chemically synthesized
gaaaggctgctcttatcact

SEQ ID NO: 174983 - DNA, 20 bp, Artificial Sequence
  chemically synthesized
caaataaatgtctcagtgat

SEQ ID NO: 174984 - DNA, 20 bp, Artificial Sequence
  chemically synthesized
tcttacccaaataaatgtct

SEQ ID NO: 174985 - DNA, 20 bp, Artificial Sequence
  chemically synthesized
ttatcactgagacatttatt

SEQ ID NO: 174986 - DNA, 20 bp, Artificial Sequence
  chemically synthesized
tatcactgagacatttattt

SEQ ID NO: 174987 - DNA, 20 bp, Artificial Sequence
  chemically synthesized
actgagacatttatttgggt

SEQ ID NO: 174988 - DNA, 20 bp, Artificial Sequence
  chemically synthesized
tttgggtaagaatttttcga

SEQ ID NO: 174989 - DNA, 20 bp, Artificial Sequence
  chemically synthesized
ttgggtaagaatttttcgat

SEQ ID NO: 174990 - DNA, 20 bp, Artificial Sequence
  chemically synthesized
aatttttcgataggtgtatc

SEQ ID NO: 174991 - DNA, 20 bp, Artificial Sequence
  chemically synthesized
tcgataggtgtatctagaac

SEQ ID NO: 174992 - DNA, 20 bp, Artificial Sequence
  chemically synthesized
gataggtgtatctagaacta

SEQ ID NO: 174993 - DNA, 20 bp, Artificial Sequence
  chemically synthesized
tcactgaagttctctagttc

SEQ ID NO: 174994 - DNA, 20 bp, Artificial Sequence
  chemically synthesized
caaagctcactgaagttctc

SEQ ID NO: 174995 - DNA, 20 bp, Artificial Sequence
  chemically synthesized
tatctagaactagagaactt

SEQ ID NO: 174996 - DNA, 20 bp, Artificial Sequence
  chemically synthesized
tagaactagagaacttcagt

SEQ ID NO: 174997 - DNA, 20 bp, Artificial Sequence
  chemically synthesized
tttgaaggcaaagctcactg

SEQ ID NO: 174998 - DNA, 20 bp, Artificial Sequence
  chemically synthesized
tgtgatttggtttgaaggca

SEQ ID NO: 174999 - DNA, 20 bp, Artificial Sequence
  chemically synthesized
gatactgtgatttggtttga

SEQ ID NO: 175000 - DNA, 20 bp, Artificial Sequence
  chemically synthesized
agatactgtgatttggtttg

SEQ ID NO: 175001 - DNA, 20 bp, Artificial Sequence
  chemically synthesized
tttgccttcaaaccaaatca

SEQ ID NO: 175002 - DNA, 20 bp, Artificial Sequence
  chemically synthesized
ttagagaagatactgtgatt

SEQ ID NO: 175003 - DNA, 20 bp, Artificial Sequence
  chemically synthesized
tttttagataattattagag

SEQ ID NO: 175004 - DNA, 20 bp, Artificial Sequence
  chemically synthesized
ttgtttttagataattatta

SEQ ID NO: 175005 - DNA, 20 bp, Artificial Sequence
  chemically synthesized
ggttgtttttagataattat

SEQ ID NO: 175006 - DNA, 20 bp, Artificial Sequence
  chemically synthesized
gtggaggcaatggttgtttt

SEQ ID NO: 175007 - DNA, 20 bp, Artificial Sequence
  chemically synthesized
cagtccagaagtggaggcaa

SEQ ID NO: 175008 - DNA, 20 bp, Artificial Sequence
  chemically synthesized
acaaccattgcctccacttc

SEQ ID NO: 175009 - DNA, 20 bp, Artificial Sequence
  chemically synthesized
ctgacgcagtccagaagtgg

SEQ ID NO: 175010 - DNA, 20 bp, Artificial Sequence
  chemically synthesized
tctgacgcagtccagaagtg

SEQ ID NO: 175011 - DNA, 20 bp, Artificial Sequence
  chemically synthesized
gatctgacgcagtccagaag

SEQ ID NO: 175012 - DNA, 20 bp, Artificial Sequence
  chemically synthesized
gtggatctgacgcagtccag

SEQ ID NO: 175013 - DNA, 20 bp, Artificial Sequence
  chemically synthesized
cgggtggatctgacgcagtc

SEQ ID NO: 175014 - DNA, 20 bp, Artificial Sequence
  chemically synthesized
cctccacttctggactgcgt

SEQ ID NO: 175015 - DNA, 20 bp, Artificial Sequence
  chemically synthesized
taaaacgggtggatctgacg

SEQ ID NO: 175016 - DNA, 20 bp, Artificial Sequence
  chemically synthesized
gcaagagagcataaaacggg

SEQ ID NO: 175017 - DNA, 20 bp, Artificial Sequence
  chemically synthesized
aaagcaagagagcataaaac

SEQ ID NO: 175018 - DNA, 20 bp, Artificial Sequence
  chemically synthesized
gaaagcaagagagcataaaa

SEQ ID NO: 175019 - DNA, 20 bp, Artificial Sequence
  chemically synthesized
tgcaaacaaggaaagcaaga

SEQ ID NO: 175020 - DNA, 20 bp, Artificial Sequence
  chemically synthesized
gatgcaaacaaggaaagcaa

SEQ ID NO: 175021 - DNA, 20 bp, Artificial Sequence
  chemically synthesized
gtgatgcaaacaaggaaagc

SEQ ID NO: 175022 - DNA, 20 bp, Artificial Sequence
  chemically synthesized
tgtggtgatgcaaacaagga

SEQ ID NO: 175023 - DNA, 20 bp, Artificial Sequence
  chemically synthesized
aaattgtggtgatgcaaaca

SEQ ID NO: 175024 - DNA, 20 bp, Artificial Sequence
  chemically synthesized
caaattgtggtgatgcaaac

SEQ ID NO: 175025 - DNA, 20 bp, Artificial Sequence
  chemically synthesized
taattgcttagttcaaattg

SEQ ID NO: 175026 - DNA, 20 bp, Artificial Sequence
  chemically synthesized
gcatcaccacaatttgaact

SEQ ID NO: 175027 - DNA, 20 bp, Artificial Sequence
  chemically synthesized
ccatcaaagtaataattgct

SEQ ID NO: 175028 - DNA, 20 bp, Artificial Sequence
  chemically synthesized
ctaagcaattattactttga

SEQ ID NO: 175029 - DNA, 20 bp, Artificial Sequence
  chemically synthesized
agcaattattactttgatgg

SEQ ID NO: 175030 - DNA, 20 bp, Artificial Sequence
  chemically synthesized
gcaattattactttgatggt

SEQ ID NO: 175031 - DNA, 20 bp, Artificial Sequence
  chemically synthesized
tttatgtaatcccaccatca

SEQ ID NO: 175032 - DNA, 20 bp, Artificial Sequence
  chemically synthesized
tgatggtgggattacataaa

SEQ ID NO: 175033 - DNA, 20 bp, Artificial Sequence
  chemically synthesized
agctttttgaagtcaaggat

SEQ ID NO: 175034 - DNA, 20 bp, Artificial Sequence
  chemically synthesized
aataaagctttttgaagtca

SEQ ID NO: 175035 - DNA, 20 bp, Artificial Sequence
  chemically synthesized
caataaagctttttgaagtc

SEQ ID NO: 175036 - DNA, 20 bp, Artificial Sequence
  chemically synthesized
ttctcatccttgacttcaaa

SEQ ID NO: 175037 - DNA, 20 bp, Artificial Sequence
  chemically synthesized
tgattcaataaagctttttg

SEQ ID NO: 175038 - DNA, 20 bp, Artificial Sequence
  chemically synthesized
ctaagctaaatgattcaata

SEQ ID NO: 175039 - DNA, 20 bp, Artificial Sequence
  chemically synthesized
aaaagctttattgaatcatt

SEQ ID NO: 175040 - DNA, 20 bp, Artificial Sequence
  chemically synthesized
ctttattgaatcatttagct

SEQ ID NO: 175041 - DNA, 20 bp, Artificial Sequence
  chemically synthesized
tgagttttcaaatgtaagct

SEQ ID NO: 175042 - DNA, 20 bp, Artificial Sequence
  chemically synthesized
cattctgagttttcaaatgt

SEQ ID NO: 175043 - DNA, 20 bp, Artificial Sequence
  chemically synthesized
ttagcttacatttgaaaact

SEQ ID NO: 175044 - DNA, 20 bp, Artificial Sequence
  chemically synthesized
ttacatttgaaaactcagaa

SEQ ID NO: 175045 - DNA, 20 bp, Artificial Sequence
  chemically synthesized
acatttgaaaactcagaatg

SEQ ID NO: 175046 - DNA, 20 bp, Artificial Sequence
  chemically synthesized
catacccaccactccattct

SEQ ID NO: 175047 - DNA, 20 bp, Artificial Sequence
  chemically synthesized
tttgaaaactcagaatggag

SEQ ID NO: 175048 - DNA, 20 bp, Artificial Sequence
  chemically synthesized
gaaaactcagaatggagtgg

SEQ ID NO: 175049 - DNA, 20 bp, Artificial Sequence
  chemically synthesized
aaaactcagaatggagtggt

SEQ ID NO: 175050 - DNA, 20 bp, Artificial Sequence
  chemically synthesized
tcagaatggagtggtgggta

SEQ ID NO: 175051 - DNA, 20 bp, Artificial Sequence
  chemically synthesized
cagaatggagtggtgggtat

SEQ ID NO: 175052 - DNA, 20 bp, Artificial Sequence
  chemically synthesized
agaatggagtggtgggtatg

SEQ ID NO: 175053 - DNA, 20 bp, Artificial Sequence
  chemically synthesized
gaatggagtggtgggtatgg

SEQ ID NO: 175054 - DNA, 20 bp, Artificial Sequence
  chemically synthesized
gagtggtgggtatgggggtg

SEQ ID NO: 175055 - DNA, 20 bp, Artificial Sequence
  chemically synthesized
gtggtgggtatgggggtgtg

SEQ ID NO: 175056 - DNA, 20 bp, Artificial Sequence
  chemically synthesized
ggtgggtatgggggtgtgga

SEQ ID NO: 175057 - DNA, 20 bp, Artificial Sequence
  chemically synthesized
gtgggtatgggggtgtggag

SEQ ID NO: 175058 - DNA, 20 bp, Artificial Sequence
  chemically synthesized
tgggtatgggggtgtggaga

SEQ ID NO: 175059 - DNA, 20 bp, Artificial Sequence
  chemically synthesized
ggtatgggggtgtggagagg

SEQ ID NO: 175060 - DNA, 20 bp, Artificial Sequence
  chemically synthesized
tatgggggtgtggagaggga

SEQ ID NO: 175061 - DNA, 20 bp, Artificial Sequence
  chemically synthesized
gggggtgtggagagggagag

SEQ ID NO: 175062 - DNA, 20 bp, Artificial Sequence
  chemically synthesized
gtggagagggagagaagtac

SEQ ID NO: 175063 - DNA, 20 bp, Artificial Sequence
  chemically synthesized
ggagagaagtactggattta

SEQ ID NO: 175064 - DNA, 20 bp, Artificial Sequence
  chemically synthesized
caagacctagactataaatc

SEQ ID NO: 175065 - DNA, 20 bp, Artificial Sequence
  chemically synthesized
gaagtactggatttatagtc

SEQ ID NO: 175066 - DNA, 20 bp, Artificial Sequence
  chemically synthesized
aagtactggatttatagtct

SEQ ID NO: 175067 - DNA, 20 bp, Artificial Sequence
  chemically synthesized
acgaccacctatgcaagacc

SEQ ID NO: 175068 - DNA, 20 bp, Artificial Sequence
  chemically synthesized
tttatagtctaggtcttgca

SEQ ID NO: 175069 - DNA, 20 bp, Artificial Sequence
  chemically synthesized
ttatagtctaggtcttgcat

SEQ ID NO: 175070 - DNA, 20 bp, Artificial Sequence
  chemically synthesized
tagtctaggtcttgcatagg

SEQ ID NO: 175071 - DNA, 20 bp, Artificial Sequence
  chemically synthesized
tgctggacgaccacctatgc

SEQ ID NO: 175072 - DNA, 20 bp, Artificial Sequence
  chemically synthesized
gtcttgcataggtggtcgtc

SEQ ID NO: 175073 - DNA, 20 bp, Artificial Sequence
  chemically synthesized
acaaagacagcagtaagtgc

SEQ ID NO: 175074 - DNA, 20 bp, Artificial Sequence
  chemically synthesized
ccaggcacaaagacagcagt

SEQ ID NO: 175075 - DNA, 20 bp, Artificial Sequence
  chemically synthesized
cagcccaggcacaaagacag

SEQ ID NO: 175076 - DNA, 20 bp, Artificial Sequence
  chemically synthesized
ctccagcccaggcacaaaga

SEQ ID NO: 175077 - DNA, 20 bp, Artificial Sequence
  chemically synthesized
cttactgctgtctttgtgcc

SEQ ID NO: 175078 - DNA, 20 bp, Artificial Sequence
  chemically synthesized
ttactgctgtctttgtgcct

SEQ ID NO: 175079 - DNA, 20 bp, Artificial Sequence
  chemically synthesized
ttctctccagcccaggcaca

SEQ ID NO: 175080 - DNA, 20 bp, Artificial Sequence
  chemically synthesized
tgctgtctttgtgcctgggc

SEQ ID NO: 175081 - DNA, 20 bp, Artificial Sequence
  chemically synthesized
ctgtctttgtgcctgggctg

SEQ ID NO: 175082 - DNA, 20 bp, Artificial Sequence
  chemically synthesized
ctccacattctctccagccc

SEQ ID NO: 175083 - DNA, 20 bp, Artificial Sequence
  chemically synthesized
gtctttgtgcctgggctgga

SEQ ID NO: 175084 - DNA, 20 bp, Artificial Sequence
  chemically synthesized
tctccacattctctccagcc

SEQ ID NO: 175085 - DNA, 20 bp, Artificial Sequence
  chemically synthesized
ccttttctccacattctctc

SEQ ID NO: 175086 - DNA, 20 bp, Artificial Sequence
  chemically synthesized
tgcctgggctggagagaatg

SEQ ID NO: 175087 - DNA, 20 bp, Artificial Sequence
  chemically synthesized
cctgggctggagagaatgtg

SEQ ID NO: 175088 - DNA, 20 bp, Artificial Sequence
  chemically synthesized
gctggagagaatgtggagaa

SEQ ID NO: 175089 - DNA, 20 bp, Artificial Sequence
  chemically synthesized
ctggagagaatgtggagaaa

SEQ ID NO: 175090 - DNA, 20 bp, Artificial Sequence
  chemically synthesized
attcctaccaacagtgtgca

SEQ ID NO: 175091 - DNA, 20 bp, Artificial Sequence
  chemically synthesized
tattcctaccaacagtgtgc

SEQ ID NO: 175092 - DNA, 20 bp, Artificial Sequence
  chemically synthesized
aggaaaaccttgcacactgt

SEQ ID NO: 175093 - DNA, 20 bp, Artificial Sequence
  chemically synthesized
aaaaccttgcacactgttgg

SEQ ID NO: 175094 - DNA, 20 bp, Artificial Sequence
  chemically synthesized
aaaccttgcacactgttggt

SEQ ID NO: 175095 - DNA, 20 bp, Artificial Sequence
  chemically synthesized
ctaatttatattcctaccaa

SEQ ID NO: 175096 - DNA, 20 bp, Artificial Sequence
  chemically synthesized
ctgttggtaggaatataaat

SEQ ID NO: 175097 - DNA, 20 bp, Artificial Sequence
  chemically synthesized
ataaattagtacaaccacta

SEQ ID NO: 175098 - DNA, 20 bp, Artificial Sequence
  chemically synthesized
aaattagtacaaccactata

SEQ ID NO: 175099 - DNA, 20 bp, Artificial Sequence
  chemically synthesized
ctccaaactgttctctatag

SEQ ID NO: 175100 - DNA, 20 bp, Artificial Sequence
  chemically synthesized
agtacaaccactatagagaa

SEQ ID NO: 175101 - DNA, 20 bp, Artificial Sequence
  chemically synthesized
aacctccaaactgttctcta

SEQ ID NO: 175102 - DNA, 20 bp, Artificial Sequence
  chemically synthesized
aaccactatagagaacagtt

SEQ ID NO: 175103 - DNA, 20 bp, Artificial Sequence
  chemically synthesized
ccactatagagaacagtttg

SEQ ID NO: 175104 - DNA, 20 bp, Artificial Sequence
  chemically synthesized
cactatagagaacagtttgg

SEQ ID NO: 175105 - DNA, 20 bp, Artificial Sequence
  chemically synthesized
agtttggaggttcctcaaaa

SEQ ID NO: 175106 - DNA, 20 bp, Artificial Sequence
  chemically synthesized
gctctatttttacttttttg

SEQ ID NO: 175107 - DNA, 20 bp, Artificial Sequence
  chemically synthesized
agctctatttttactttttt

SEQ ID NO: 175108 - DNA, 20 bp, Artificial Sequence
  chemically synthesized
gttcctcaaaaaagtaaaaa

SEQ ID NO: 175109 - DNA, 20 bp, Artificial Sequence
  chemically synthesized
tcctcaaaaaagtaaaaata

SEQ ID NO: 175110 - DNA, 20 bp, Artificial Sequence
  chemically synthesized
gggattgctggatcataggg

SEQ ID NO: 175111 - DNA, 20 bp, Artificial Sequence
  chemically synthesized
aatagagcttccctatgatc

SEQ ID NO: 175112 - DNA, 20 bp, Artificial Sequence
  chemically synthesized
agtgggattgctggatcata

SEQ ID NO: 175113 - DNA, 20 bp, Artificial Sequence
  chemically synthesized
cagtgggattgctggatcat

SEQ ID NO: 175114 - DNA, 20 bp, Artificial Sequence
  chemically synthesized
gcagtgggattgctggatca

SEQ ID NO: 175115 - DNA, 20 bp, Artificial Sequence
  chemically synthesized
atacccagcagtgggattgc

SEQ ID NO: 175116 - DNA, 20 bp, Artificial Sequence
  chemically synthesized
tgatccagcaatcccactgc

SEQ ID NO: 175117 - DNA, 20 bp, Artificial Sequence
  chemically synthesized
gatccagcaatcccactgct

SEQ ID NO: 175118 - DNA, 20 bp, Artificial Sequence
  chemically synthesized
ttgggtatatacccagcagt

SEQ ID NO: 175119 - DNA, 20 bp, Artificial Sequence
  chemically synthesized
tttgggtatatacccagcag

SEQ ID NO: 175120 - DNA, 20 bp, Artificial Sequence
  chemically synthesized
ttctttgggtatatacccag

SEQ ID NO: 175121 - DNA, 20 bp, Artificial Sequence
  chemically synthesized
cctttctttgggtatatacc

SEQ ID NO: 175122 - DNA, 20 bp, Artificial Sequence
  chemically synthesized
cactgctgggtatataccca

SEQ ID NO: 175123 - DNA, 20 bp, Artificial Sequence
  chemically synthesized
gctgggtatatacccaaaga

SEQ ID NO: 175124 - DNA, 20 bp, Artificial Sequence
  chemically synthesized
ctgggtatatacccaaagaa

SEQ ID NO: 175125 - DNA, 20 bp, Artificial Sequence
  chemically synthesized
tatactgatttcctttcttt

SEQ ID NO: 175126 - DNA, 20 bp, Artificial Sequence
  chemically synthesized
atatactgatttcctttctt

SEQ ID NO: 175127 - DNA, 20 bp, Artificial Sequence
  chemically synthesized
tatacccaaagaaaggaaat

SEQ ID NO: 175128 - DNA, 20 bp, Artificial Sequence
  chemically synthesized
ctgcaataaacatgggaatg

SEQ ID NO: 175129 - DNA, 20 bp, Artificial Sequence
  chemically synthesized
aatagagctgcaataaacat

SEQ ID NO: 175130 - DNA, 20 bp, Artificial Sequence
  chemically synthesized
gaatagagctgcaataaaca

SEQ ID NO: 175131 - DNA, 20 bp, Artificial Sequence
  chemically synthesized
ctgcattcccatgtttattg

SEQ ID NO: 175132 - DNA, 20 bp, Artificial Sequence
  chemically synthesized
aaccttggctattgtgaata

SEQ ID NO: 175133 - DNA, 20 bp, Artificial Sequence
  chemically synthesized
tattgcagctctattcacaa

SEQ ID NO: 175134 - DNA, 20 bp, Artificial Sequence
  chemically synthesized
caaaccttggctattgtgaa

SEQ ID NO: 175135 - DNA, 20 bp, Artificial Sequence
  chemically synthesized
cagctctattcacaatagcc

SEQ ID NO: 175136 - DNA, 20 bp, Artificial Sequence
  chemically synthesized
agctctattcacaatagcca

SEQ ID NO: 175137 - DNA, 20 bp, Artificial Sequence
  chemically synthesized
tattcacaatagccaaggtt

SEQ ID NO: 175138 - DNA, 20 bp, Artificial Sequence
  chemically synthesized
cttaaattttttccaaacct

SEQ ID NO: 175139 - DNA, 20 bp, Artificial Sequence
  chemically synthesized
ccaaggtttggaaaaaattt

SEQ ID NO: 175140 - DNA, 20 bp, Artificial Sequence
  chemically synthesized
tttatccattcatttgttga

SEQ ID NO: 175141 - DNA, 20 bp, Artificial Sequence
  chemically synthesized
agtgtccatcaacaaatgaa

SEQ ID NO: 175142 - DNA, 20 bp, Artificial Sequence
  chemically synthesized
catcaacaaatgaatggata

SEQ ID NO: 175143 - DNA, 20 bp, Artificial Sequence
  chemically synthesized
atgaatggataaagaaaacg

SEQ ID NO: 175144 - DNA, 20 bp, Artificial Sequence
  chemically synthesized
acgtggtacatatacacaaa

SEQ ID NO: 175145 - DNA, 20 bp, Artificial Sequence
  chemically synthesized
gtggtacatatacacaaatg

SEQ ID NO: 175146 - DNA, 20 bp, Artificial Sequence
  chemically synthesized
caatcttttctatggcagaa

SEQ ID NO: 175147 - DNA, 20 bp, Artificial Sequence
  chemically synthesized
aatggagtactattctgcca

SEQ ID NO: 175148 - DNA, 20 bp, Artificial Sequence
  chemically synthesized
gatctcaatcttttctatgg

SEQ ID NO: 175149 - DNA, 20 bp, Artificial Sequence
  chemically synthesized
agtactattctgccatagaa

SEQ ID NO: 175150 - DNA, 20 bp, Artificial Sequence
  chemically synthesized
caggatctcaatcttttcta

SEQ ID NO: 175151 - DNA, 20 bp, Artificial Sequence
  chemically synthesized
attctgccatagaaaagatt

SEQ ID NO: 175152 - DNA, 20 bp, Artificial Sequence
  chemically synthesized
tccatgttgttgcaaatgac

SEQ ID NO: 175153 - DNA, 20 bp, Artificial Sequence
  chemically synthesized
atccatgttgttgcaaatga

SEQ ID NO: 175154 - DNA, 20 bp, Artificial Sequence
  chemically synthesized
tcctgtcatttgcaacaaca

SEQ ID NO: 175155 - DNA, 20 bp, Artificial Sequence
  chemically synthesized
gtcatttgcaacaacatgga

SEQ ID NO: 175156 - DNA, 20 bp, Artificial Sequence
  chemically synthesized
tgcaacaacatggatggaaa

SEQ ID NO: 175157 - DNA, 20 bp, Artificial Sequence
  chemically synthesized
caacaacatggatggaaatg

SEQ ID NO: 175158 - DNA, 20 bp, Artificial Sequence
  chemically synthesized
aacaacatggatggaaatgg

SEQ ID NO: 175159 - DNA, 20 bp, Artificial Sequence
  chemically synthesized
gaaatggaggtcattatctt

SEQ ID NO: 175160 - DNA, 20 bp, Artificial Sequence
  chemically synthesized
gtgcttggcttattttgctt

SEQ ID NO: 175161 - DNA, 20 bp, Artificial Sequence
  chemically synthesized
gtcattatcttaagcaaaat

SEQ ID NO: 175162 - DNA, 20 bp, Artificial Sequence
  chemically synthesized
tatcttaagcaaaataagcc

SEQ ID NO: 175163 - DNA, 20 bp, Artificial Sequence
  chemically synthesized
taagcaaaataagccaagca

SEQ ID NO: 175164 - DNA, 20 bp, Artificial Sequence
  chemically synthesized
atgagatgtttttctgtgct

SEQ ID NO: 175165 - DNA, 20 bp, Artificial Sequence
  chemically synthesized
ctgcaaataagtgagaacat

SEQ ID NO: 175166 - DNA, 20 bp, Artificial Sequence
  chemically synthesized
tttagattctgcaaataagt

SEQ ID NO: 175167 - DNA, 20 bp, Artificial Sequence
  chemically synthesized
ctcatgttctcacttatttg

SEQ ID NO: 175168 - DNA, 20 bp, Artificial Sequence
  chemically synthesized
gatttttagattctgcaaat

SEQ ID NO: 175169 - DNA, 20 bp, Artificial Sequence
  chemically synthesized
agttccattgttttgatttt

SEQ ID NO: 175170 - DNA, 20 bp, Artificial Sequence
  chemically synthesized
gaatctaaaaatcaaaacaa

SEQ ID NO: 175171 - DNA, 20 bp, Artificial Sequence
  chemically synthesized
aatcaaaacaatggaactca

SEQ ID NO: 175172 - DNA, 20 bp, Artificial Sequence
  chemically synthesized
aacaatggaactcatggaca

SEQ ID NO: 175173 - DNA, 20 bp, Artificial Sequence
  chemically synthesized
tttctactctctatgtccat

SEQ ID NO: 175174 - DNA, 20 bp, Artificial Sequence
  chemically synthesized
caatggaactcatggacata

SEQ ID NO: 175175 - DNA, 20 bp, Artificial Sequence
  chemically synthesized
atggaactcatggacataga

SEQ ID NO: 175176 - DNA, 20 bp, Artificial Sequence
  chemically synthesized
gaactcatggacatagagag

SEQ ID NO: 175177 - DNA, 20 bp, Artificial Sequence
  chemically synthesized
tcatggacatagagagtaga

SEQ ID NO: 175178 - DNA, 20 bp, Artificial Sequence
  chemically synthesized
catggacatagagagtagaa

SEQ ID NO: 175179 - DNA, 20 bp, Artificial Sequence
  chemically synthesized
ggacatagagagtagaaagg

SEQ ID NO: 175180 - DNA, 20 bp, Artificial Sequence
  chemically synthesized
gagagtagaaaggtagttgc

SEQ ID NO: 175181 - DNA, 20 bp, Artificial Sequence
  chemically synthesized
gagtagaaaggtagttgcca

SEQ ID NO: 175182 - DNA, 20 bp, Artificial Sequence
  chemically synthesized
agtagaaaggtagttgccag

SEQ ID NO: 175183 - DNA, 20 bp, Artificial Sequence
  chemically synthesized
gaaaggtagttgccagaggc

SEQ ID NO: 175184 - DNA, 20 bp, Artificial Sequence
  chemically synthesized
aaaggtagttgccagaggct

SEQ ID NO: 175185 - DNA, 20 bp, Artificial Sequence
  chemically synthesized
ccactatccttcccagcctc

SEQ ID NO: 175186 - DNA, 20 bp, Artificial Sequence
  chemically synthesized
ggtagttgccagaggctggg

SEQ ID NO: 175187 - DNA, 20 bp, Artificial Sequence
  chemically synthesized
gtagttgccagaggctggga

SEQ ID NO: 175188 - DNA, 20 bp, Artificial Sequence
  chemically synthesized
ttgccagaggctgggaagga

SEQ ID NO: 175189 - DNA, 20 bp, Artificial Sequence
  chemically synthesized
gactcctccactatccttcc

SEQ ID NO: 175190 - DNA, 20 bp, Artificial Sequence
  chemically synthesized
ccagaggctgggaaggatag

SEQ ID NO: 175191 - DNA, 20 bp, Artificial Sequence
  chemically synthesized
agaggctgggaaggatagtg

SEQ ID NO: 175192 - DNA, 20 bp, Artificial Sequence
  chemically synthesized
gaggctgggaaggatagtgg

SEQ ID NO: 175193 - DNA, 20 bp, Artificial Sequence
  chemically synthesized
ggctgggaaggatagtggag

SEQ ID NO: 175194 - DNA, 20 bp, Artificial Sequence
  chemically synthesized
gggaaggatagtggaggagt

SEQ ID NO: 175195 - DNA, 20 bp, Artificial Sequence
  chemically synthesized
ggaaggatagtggaggagtc

SEQ ID NO: 175196 - DNA, 20 bp, Artificial Sequence
  chemically synthesized
gaaggatagtggaggagtcg

SEQ ID NO: 175197 - DNA, 20 bp, Artificial Sequence
  chemically synthesized
aggatagtggaggagtcggg

SEQ ID NO: 175198 - DNA, 20 bp, Artificial Sequence
  chemically synthesized
ggatagtggaggagtcgggg

SEQ ID NO: 175199 - DNA, 20 bp, Artificial Sequence
  chemically synthesized
gatagtggaggagtcgggga

SEQ ID NO: 175200 - DNA, 20 bp, Artificial Sequence
  chemically synthesized
atagtggaggagtcggggag

SEQ ID NO: 175201 - DNA, 20 bp, Artificial Sequence
  chemically synthesized
tagtggaggagtcggggagg

SEQ ID NO: 175202 - DNA, 20 bp, Artificial Sequence
  chemically synthesized
tggaggagtcggggaggggg

SEQ ID NO: 175203 - DNA, 20 bp, Artificial Sequence
  chemically synthesized
aggagtcggggagggggcag

SEQ ID NO: 175204 - DNA, 20 bp, Artificial Sequence
  chemically synthesized
ggagtcggggagggggcagc

SEQ ID NO: 175205 - DNA, 20 bp, Artificial Sequence
  chemically synthesized
tcggggagggggcagcggga

SEQ ID NO: 175206 - DNA, 20 bp, Artificial Sequence
  chemically synthesized
gggggcagcgggatggttaa

SEQ ID NO: 175207 - DNA, 20 bp, Artificial Sequence
  chemically synthesized
ggggcagcgggatggttaat

SEQ ID NO: 175208 - DNA, 20 bp, Artificial Sequence
  chemically synthesized
taatgggtacaaaaaatact

SEQ ID NO: 175209 - DNA, 20 bp, Artificial Sequence
  chemically synthesized
aatgggtacaaaaaatactt

SEQ ID NO: 175210 - DNA, 20 bp, Artificial Sequence
  chemically synthesized
gggtattattcatttttcct

SEQ ID NO: 175211 - DNA, 20 bp, Artificial Sequence
  chemically synthesized
taggaaaaatgaataatacc

SEQ ID NO: 175212 - DNA, 20 bp, Artificial Sequence
  chemically synthesized
ctgttgtgctatcgaatact

SEQ ID NO: 175213 - DNA, 20 bp, Artificial Sequence
  chemically synthesized
cctgttgtgctatcgaatac

SEQ ID NO: 175214 - DNA, 20 bp, Artificial Sequence
  chemically synthesized
gaataatacccagtattcga

SEQ ID NO: 175215 - DNA, 20 bp, Artificial Sequence
  chemically synthesized
cccagtattcgatagcacaa

SEQ ID NO: 175216 - DNA, 20 bp, Artificial Sequence
  chemically synthesized
ccagtattcgatagcacaac

SEQ ID NO: 175217 - DNA, 20 bp, Artificial Sequence
  chemically synthesized
cagtattcgatagcacaaca

SEQ ID NO: 175218 - DNA, 20 bp, Artificial Sequence
  chemically synthesized
cagttacattattttgacga

SEQ ID NO: 175219 - DNA, 20 bp, Artificial Sequence
  chemically synthesized
cttatttatttttaaatgtg

SEQ ID NO: 175220 - DNA, 20 bp, Artificial Sequence
  chemically synthesized
ctgcacatttaaaaataaat

SEQ ID NO: 175221 - DNA, 20 bp, Artificial Sequence
  chemically synthesized
gcacatttaaaaataaataa

SEQ ID NO: 175222 - DNA, 20 bp, Artificial Sequence
  chemically synthesized
aaaataaataagagtataat

SEQ ID NO: 175223 - DNA, 20 bp, Artificial Sequence
  chemically synthesized
ttggattgtttgtaacacaa

SEQ ID NO: 175224 - DNA, 20 bp, Artificial Sequence
  chemically synthesized
gtaacacaaaagattaatgc

SEQ ID NO: 175225 - DNA, 20 bp, Artificial Sequence
  chemically synthesized
aacacaaaagattaatgctg

SEQ ID NO: 175226 - DNA, 20 bp, Artificial Sequence
  chemically synthesized
acacaaaagattaatgctgg

SEQ ID NO: 175227 - DNA, 20 bp, Artificial Sequence
  chemically synthesized
cacaaaagattaatgctgga

SEQ ID NO: 175228 - DNA, 20 bp, Artificial Sequence
  chemically synthesized
acaaaagattaatgctggag

SEQ ID NO: 175229 - DNA, 20 bp, Artificial Sequence
  chemically synthesized
caaaagattaatgctggagg

SEQ ID NO: 175230 - DNA, 20 bp, Artificial Sequence
  chemically synthesized
aagattaatgctggaggggg

SEQ ID NO: 175231 - DNA, 20 bp, Artificial Sequence
  chemically synthesized
aacgggggatccaccccctc

SEQ ID NO: 175232 - DNA, 20 bp, Artificial Sequence
  chemically synthesized
aatcacatcatggagaacgg

SEQ ID NO: 175233 - DNA, 20 bp, Artificial Sequence
  chemically synthesized
taatcacatcatggagaacg

SEQ ID NO: 175234 - DNA, 20 bp, Artificial Sequence
  chemically synthesized
ataatcacatcatggagaac

SEQ ID NO: 175235 - DNA, 20 bp, Artificial Sequence
  chemically synthesized
aataatcacatcatggagaa

SEQ ID NO: 175236 - DNA, 20 bp, Artificial Sequence
  chemically synthesized
tgcataataatcacatcatg

SEQ ID NO: 175237 - DNA, 20 bp, Artificial Sequence
  chemically synthesized
aatgcataataatcacatca

SEQ ID NO: 175238 - DNA, 20 bp, Artificial Sequence
  chemically synthesized
tacttgagatgttttgacac

SEQ ID NO: 175239 - DNA, 20 bp, Artificial Sequence
  chemically synthesized
tgcttgtgtcaaaacatctc

SEQ ID NO: 175240 - DNA, 20 bp, Artificial Sequence
  chemically synthesized
tatgtatttatggggtactt

SEQ ID NO: 175241 - DNA, 20 bp, Artificial Sequence
  chemically synthesized
agtaggtgtatgtatttatg

SEQ ID NO: 175242 - DNA, 20 bp, Artificial Sequence
  chemically synthesized
tagtaggtgtatgtatttat

SEQ ID NO: 175243 - DNA, 20 bp, Artificial Sequence
  chemically synthesized
atagtaggtgtatgtattta

SEQ ID NO: 175244 - DNA, 20 bp, Artificial Sequence
  chemically synthesized
aatttttgtgggtacatagt

SEQ ID NO: 175245 - DNA, 20 bp, Artificial Sequence
  chemically synthesized
aaatttttgtgggtacatag

SEQ ID NO: 175246 - DNA, 20 bp, Artificial Sequence
  chemically synthesized
tttaaatttttgtgggtaca

SEQ ID NO: 175247 - DNA, 20 bp, Artificial Sequence
  chemically synthesized
aaatttttttaaatttttgt

SEQ ID NO: 175248 - DNA, 20 bp, Artificial Sequence
  chemically synthesized
aaaatttttttaaatttttg

SEQ ID NO: 175249 - DNA, 20 bp, Artificial Sequence
  chemically synthesized
aaatttaaaaaaattttaaa

SEQ ID NO: 175250 - DNA, 20 bp, Artificial Sequence
  chemically synthesized
atttaaaaaaattttaaaaa

SEQ ID NO: 175251 - DNA, 20 bp, Artificial Sequence
  chemically synthesized
ttaaaaaaattttaaaaaga

SEQ ID NO: 175252 - DNA, 20 bp, Artificial Sequence
  chemically synthesized
aaattttaaaaagagagaat

SEQ ID NO: 175253 - DNA, 20 bp, Artificial Sequence
  chemically synthesized
taaaaagagagaattggttg

SEQ ID NO: 175254 - DNA, 20 bp, Artificial Sequence
  chemically synthesized
aaagagagaattggttgtgg

SEQ ID NO: 175255 - DNA, 20 bp, Artificial Sequence
  chemically synthesized
aagagagaattggttgtggt

SEQ ID NO: 175256 - DNA, 20 bp, Artificial Sequence
  chemically synthesized
gagagaattggttgtggtag

SEQ ID NO: 175257 - DNA, 20 bp, Artificial Sequence
  chemically synthesized
agaattggttgtggtaggag

SEQ ID NO: 175258 - DNA, 20 bp, Artificial Sequence
  chemically synthesized
ttggttgtggtaggagcaga

SEQ ID NO: 175259 - DNA, 20 bp, Artificial Sequence
  chemically synthesized
tccagtgacctataaagtga

SEQ ID NO: 175260 - DNA, 20 bp, Artificial Sequence
  chemically synthesized
atagcataactttcacttta

SEQ ID NO: 175261 - DNA, 20 bp, Artificial Sequence
  chemically synthesized
tagcataactttcactttat

SEQ ID NO: 175262 - DNA, 20 bp, Artificial Sequence
  chemically synthesized
tcatggtccagtgacctata

SEQ ID NO: 175263 - DNA, 20 bp, Artificial Sequence
  chemically synthesized
actttcactttataggtcac

SEQ ID NO: 175264 - DNA, 20 bp, Artificial Sequence
  chemically synthesized
tttataggtcactggaccat

SEQ ID NO: 175265 - DNA, 20 bp, Artificial Sequence
  chemically synthesized
ttataggtcactggaccatg

SEQ ID NO: 175266 - DNA, 20 bp, Artificial Sequence
  chemically synthesized
agatatggttcctcatggtc

SEQ ID NO: 175267 - DNA, 20 bp, Artificial Sequence
  chemically synthesized
gatcaagatatggttcctca

SEQ ID NO: 175268 - DNA, 20 bp, Artificial Sequence
  chemically synthesized
ttctccatcagatcaagata

SEQ ID NO: 175269 - DNA, 20 bp, Artificial Sequence
  chemically synthesized
ggaaccatatcttgatctga

SEQ ID NO: 175270 - DNA, 20 bp, Artificial Sequence
  chemically synthesized
actgtcttctccatcagatc

SEQ ID NO: 175271 - DNA, 20 bp, Artificial Sequence
  chemically synthesized
aaccatatcttgatctgatg

SEQ ID NO: 175272 - DNA, 20 bp, Artificial Sequence
  chemically synthesized
catatcttgatctgatggag

SEQ ID NO: 175273 - DNA, 20 bp, Artificial Sequence
  chemically synthesized
tgatgcactgtcttctccat

SEQ ID NO: 175274 - DNA, 20 bp, Artificial Sequence
  chemically synthesized
tcttgatctgatggagaaga

SEQ ID NO: 175275 - DNA, 20 bp, Artificial Sequence
  chemically synthesized
agaagacagtgcatcatcca

SEQ ID NO: 175276 - DNA, 20 bp, Artificial Sequence
  chemically synthesized
agtgcatcatccacagacaa

SEQ ID NO: 175277 - DNA, 20 bp, Artificial Sequence
  chemically synthesized
agctaaaagtccattgtctg

SEQ ID NO: 175278 - DNA, 20 bp, Artificial Sequence
  chemically synthesized
atccacagacaatggacttt

SEQ ID NO: 175279 - DNA, 20 bp, Artificial Sequence
  chemically synthesized
acagacaatggacttttagc

SEQ ID NO: 175280 - DNA, 20 bp, Artificial Sequence
  chemically synthesized
cacttactgcatccagctaa

SEQ ID NO: 175281 - DNA, 20 bp, Artificial Sequence
  chemically synthesized
aatggacttttagctggatg

SEQ ID NO: 175282 - DNA, 20 bp, Artificial Sequence
  chemically synthesized
tctcattcacttactgcatc

SEQ ID NO: 175283 - DNA, 20 bp, Artificial Sequence
  chemically synthesized
gacttttagctggatgcagt

SEQ ID NO: 175284 - DNA, 20 bp, Artificial Sequence
  chemically synthesized
gctggatgcagtaagtgaat

SEQ ID NO: 175285 - DNA, 20 bp, Artificial Sequence
  chemically synthesized
taagtgaatgagactttgac

SEQ ID NO: 175286 - DNA, 20 bp, Artificial Sequence
  chemically synthesized
ttcccaagagagaccagtca

SEQ ID NO: 175287 - DNA, 20 bp, Artificial Sequence
  chemically synthesized
agtgccttcccaagagagac

SEQ ID NO: 175288 - DNA, 20 bp, Artificial Sequence
  chemically synthesized
agactttgactggtctctct

SEQ ID NO: 175289 - DNA, 20 bp, Artificial Sequence
  chemically synthesized
gactttgactggtctctctt

SEQ ID NO: 175290 - DNA, 20 bp, Artificial Sequence
  chemically synthesized
tttgactggtctctcttggg

SEQ ID NO: 175291 - DNA, 20 bp, Artificial Sequence
  chemically synthesized
cacacagtgccttcccaaga

SEQ ID NO: 175292 - DNA, 20 bp, Artificial Sequence
  chemically synthesized
ttgactggtctctcttggga

SEQ ID NO: 175293 - DNA, 20 bp, Artificial Sequence
  chemically synthesized
aacacacagtgccttcccaa

SEQ ID NO: 175294 - DNA, 20 bp, Artificial Sequence
  chemically synthesized
agaacacacagtgccttccc

SEQ ID NO: 175295 - DNA, 20 bp, Artificial Sequence
  chemically synthesized
cttatcatcaagagaacaca

SEQ ID NO: 175296 - DNA, 20 bp, Artificial Sequence
  chemically synthesized
actctctttcttatcatcaa

SEQ ID NO: 175297 - DNA, 20 bp, Artificial Sequence
  chemically synthesized
ctgtgtgttctcttgatgat

SEQ ID NO: 175298 - DNA, 20 bp, Artificial Sequence
  chemically synthesized
gcactctctttcttatcatc

SEQ ID NO: 175299 - DNA, 20 bp, Artificial Sequence
  chemically synthesized
gtgttctcttgatgataaga

SEQ ID NO: 175300 - DNA, 20 bp, Artificial Sequence
  chemically synthesized
gttctcttgatgataagaaa

SEQ ID NO: 175301 - DNA, 20 bp, Artificial Sequence
  chemically synthesized
tctcttgatgataagaaaga

SEQ ID NO: 175302 - DNA, 20 bp, Artificial Sequence
  chemically synthesized
atgataagaaagagagtgca

SEQ ID NO: 175303 - DNA, 20 bp, Artificial Sequence
  chemically synthesized
agagagtgcatggatatttg

SEQ ID NO: 175304 - DNA, 20 bp, Artificial Sequence
  chemically synthesized
gagagtgcatggatatttgt

SEQ ID NO: 175305 - DNA, 20 bp, Artificial Sequence
  chemically synthesized
tgcatggatatttgtgggac

SEQ ID NO: 175306 - DNA, 20 bp, Artificial Sequence
  chemically synthesized
ggatatttgtgggaccagca

SEQ ID NO: 175307 - DNA, 20 bp, Artificial Sequence
  chemically synthesized
atatttgtgggaccagcatg

SEQ ID NO: 175308 - DNA, 20 bp, Artificial Sequence
  chemically synthesized
gcatttcaaaatctccatgc

SEQ ID NO: 175309 - DNA, 20 bp, Artificial Sequence
  chemically synthesized
agcatggagattttgaaatg

SEQ ID NO: 175310 - DNA, 20 bp, Artificial Sequence
  chemically synthesized
ttgaaatgcagtattatatt

SEQ ID NO: 175311 - DNA, 20 bp, Artificial Sequence
  chemically synthesized
atgcagtattatattgagaa

SEQ ID NO: 175312 - DNA, 20 bp, Artificial Sequence
  chemically synthesized
gtattatattgagaatagta

SEQ ID NO: 175313 - DNA, 20 bp, Artificial Sequence
  chemically synthesized
gaatagtatagctgccttgc

SEQ ID NO: 175314 - DNA, 20 bp, Artificial Sequence
  chemically synthesized
aggaacacaggctagcaagg

SEQ ID NO: 175315 - DNA, 20 bp, Artificial Sequence
  chemically synthesized
aaaaggaacacaggctagca

SEQ ID NO: 175316 - DNA, 20 bp, Artificial Sequence
  chemically synthesized
aaaaaggaacacaggctagc

SEQ ID NO: 175317 - DNA, 20 bp, Artificial Sequence
  chemically synthesized
ctctaaaaaggaacacaggc

SEQ ID NO: 175318 - DNA, 20 bp, Artificial Sequence
  chemically synthesized
tctgctctaaaaaggaacac

SEQ ID NO: 175319 - DNA, 20 bp, Artificial Sequence
  chemically synthesized
ctctgctctaaaaaggaaca

SEQ ID NO: 175320 - DNA, 20 bp, Artificial Sequence
  chemically synthesized
tgctagcctgtgttcctttt

SEQ ID NO: 175321 - DNA, 20 bp, Artificial Sequence
  chemically synthesized
ctagcctgtgttccttttta

SEQ ID NO: 175322 - DNA, 20 bp, Artificial Sequence
  chemically synthesized
acgtagtctctgctctaaaa

SEQ ID NO: 175323 - DNA, 20 bp, Artificial Sequence
  chemically synthesized
gcctgtgttcctttttagag

SEQ ID NO: 175324 - DNA, 20 bp, Artificial Sequence
  chemically synthesized
tacgtagtctctgctctaaa

SEQ ID NO: 175325 - DNA, 20 bp, Artificial Sequence
  chemically synthesized
ctgtgttcctttttagagca

SEQ ID NO: 175326 - DNA, 20 bp, Artificial Sequence
  chemically synthesized
tagagcagagactacgtacc

SEQ ID NO: 175327 - DNA, 20 bp, Artificial Sequence
  chemically synthesized
agagcagagactacgtacct

SEQ ID NO: 175328 - DNA, 20 bp, Artificial Sequence
  chemically synthesized
taaagtccagcctaggtacg

SEQ ID NO: 175329 - DNA, 20 bp, Artificial Sequence
  chemically synthesized
cagagactacgtacctaggc

SEQ ID NO: 175330 - DNA, 20 bp, Artificial Sequence
  chemically synthesized
tcccacataaagtccagcct

SEQ ID NO: 175331 - DNA, 20 bp, Artificial Sequence
  chemically synthesized
ttcccacataaagtccagcc

SEQ ID NO: 175332 - DNA, 20 bp, Artificial Sequence
  chemically synthesized
tatctttcccacataaagtc

SEQ ID NO: 175333 - DNA, 20 bp, Artificial Sequence
  chemically synthesized
tacctaggctggactttatg

SEQ ID NO: 175334 - DNA, 20 bp, Artificial Sequence
  chemically synthesized
acctaggctggactttatgt

SEQ ID NO: 175335 - DNA, 20 bp, Artificial Sequence
  chemically synthesized
atgtgtatctttcccacata

SEQ ID NO: 175336 - DNA, 20 bp, Artificial Sequence
  chemically synthesized
aggctggactttatgtggga

SEQ ID NO: 175337 - DNA, 20 bp, Artificial Sequence
  chemically synthesized
tttccatgtttcaaacaata

SEQ ID NO: 175338 - DNA, 20 bp, Artificial Sequence
  chemically synthesized
tatctatattgtttgaaaca

SEQ ID NO: 175339 - DNA, 20 bp, Artificial Sequence
  chemically synthesized
ttgtttgaaacatggaaact

SEQ ID NO: 175340 - DNA, 20 bp, Artificial Sequence
  chemically synthesized
tgtttgaaacatggaaactt

SEQ ID NO: 175341 - DNA, 20 bp, Artificial Sequence
  chemically synthesized
gtttgaaacatggaaacttg

SEQ ID NO: 175342 - DNA, 20 bp, Artificial Sequence
  chemically synthesized
tactataataaaaatacccc

SEQ ID NO: 175343 - DNA, 20 bp, Artificial Sequence
  chemically synthesized
aacttggggtatttttatta

SEQ ID NO: 175344 - DNA, 20 bp, Artificial Sequence
  chemically synthesized
ttggggtatttttattatag

SEQ ID NO: 175345 - DNA, 20 bp, Artificial Sequence
  chemically synthesized
gtatttttattatagtagct

SEQ ID NO: 175346 - DNA, 20 bp, Artificial Sequence
  chemically synthesized
gatttctcagggtgtagact

SEQ ID NO: 175347 - DNA, 20 bp, Artificial Sequence
  chemically synthesized
agtagctcagtctacaccct

SEQ ID NO: 175348 - DNA, 20 bp, Artificial Sequence
  chemically synthesized
ttttcagatttctcagggtg

SEQ ID NO: 175349 - DNA, 20 bp, Artificial Sequence
  chemically synthesized
ttgtcttttcagatttctca

SEQ ID NO: 175350 - DNA, 20 bp, Artificial Sequence
  chemically synthesized
attgtcttttcagatttctc

SEQ ID NO: 175351 - DNA, 20 bp, Artificial Sequence
  chemically synthesized
cattgtcttttcagatttct

SEQ ID NO: 175352 - DNA, 20 bp, Artificial Sequence
  chemically synthesized
tacaccctgagaaatctgaa

SEQ ID NO: 175353 - DNA, 20 bp, Artificial Sequence
  chemically synthesized
agccgttctcattgtctttt

SEQ ID NO: 175354 - DNA, 20 bp, Artificial Sequence
  chemically synthesized
gagaaatctgaaaagacaat

SEQ ID NO: 175355 - DNA, 20 bp, Artificial Sequence
  chemically synthesized
atctgaaaagacaatgagaa

SEQ ID NO: 175356 - DNA, 20 bp, Artificial Sequence
  chemically synthesized
ggattatataattacaaatg

SEQ ID NO: 175357 - DNA, 20 bp, Artificial Sequence
  chemically synthesized
gagggggacaaacattaaaa

SEQ ID NO: 175358 - DNA, 20 bp, Artificial Sequence
  chemically synthesized
atggatcttacatttggagg

SEQ ID NO: 175359 - DNA, 20 bp, Artificial Sequence
  chemically synthesized
tatggatcttacatttggag

SEQ ID NO: 175360 - DNA, 20 bp, Artificial Sequence
  chemically synthesized
ttatggatcttacatttgga

SEQ ID NO: 175361 - DNA, 20 bp, Artificial Sequence
  chemically synthesized
tttatggatcttacatttgg

SEQ ID NO: 175362 - DNA, 20 bp, Artificial Sequence
  chemically synthesized
gtttgtccccctccaaatgt

SEQ ID NO: 175363 - DNA, 20 bp, Artificial Sequence
  chemically synthesized
ctttatggatcttacatttg

SEQ ID NO: 175364 - DNA, 20 bp, Artificial Sequence
  chemically synthesized
gtctttatggatcttacatt

SEQ ID NO: 175365 - DNA, 20 bp, Artificial Sequence
  chemically synthesized
ctccaaatgtaagatccata

SEQ ID NO: 175366 - DNA, 20 bp, Artificial Sequence
  chemically synthesized
aatgtaagatccataaagac

SEQ ID NO: 175367 - DNA, 20 bp, Artificial Sequence
  chemically synthesized
cagacagacacttgtcttta

SEQ ID NO: 175368 - DNA, 20 bp, Artificial Sequence
  chemically synthesized
aggatagagttatgaacaga

SEQ ID NO: 175369 - DNA, 20 bp, Artificial Sequence
  chemically synthesized
aatgaggatagagttatgaa

SEQ ID NO: 175370 - DNA, 20 bp, Artificial Sequence
  chemically synthesized
aatgttaaggaatgaggata

SEQ ID NO: 175371 - DNA, 20 bp, Artificial Sequence
  chemically synthesized
ataatgttaaggaatgagga

SEQ ID NO: 175372 - DNA, 20 bp, Artificial Sequence
  chemically synthesized
tggtataatgttaaggaatg

SEQ ID NO: 175373 - DNA, 20 bp, Artificial Sequence
  chemically synthesized
atggtataatgttaaggaat

SEQ ID NO: 175374 - DNA, 20 bp, Artificial Sequence
  chemically synthesized
tccaatatggtataatgtta

SEQ ID NO: 175375 - DNA, 20 bp, Artificial Sequence
  chemically synthesized
ttccaatatggtataatgtt

SEQ ID NO: 175376 - DNA, 20 bp, Artificial Sequence
  chemically synthesized
tccttaacattataccatat

SEQ ID NO: 175377 - DNA, 20 bp, Artificial Sequence
  chemically synthesized
tttattaagtgtttccaata

SEQ ID NO: 175378 - DNA, 20 bp, Artificial Sequence
  chemically synthesized
gtatacattcagtatttatt

SEQ ID NO: 175379 - DNA, 20 bp, Artificial Sequence
  chemically synthesized
ccttggtttatgtatacatt

SEQ ID NO: 175380 - DNA, 20 bp, Artificial Sequence
  chemically synthesized
actgaatgtatacataaacc

SEQ ID NO: 175381 - DNA, 20 bp, Artificial Sequence
  chemically synthesized
ctgaatgtatacataaacca

SEQ ID NO: 175382 - DNA, 20 bp, Artificial Sequence
  chemically synthesized
ggagtatagaaacagtacct

SEQ ID NO: 175383 - DNA, 20 bp, Artificial Sequence
  chemically synthesized
aaatcctaggagtatagaaa

SEQ ID NO: 175384 - DNA, 20 bp, Artificial Sequence
  chemically synthesized
aggtactgtttctatactcc

SEQ ID NO: 175385 - DNA, 20 bp, Artificial Sequence
  chemically synthesized
ggtactgtttctatactcct

SEQ ID NO: 175386 - DNA, 20 bp, Artificial Sequence
  chemically synthesized
tatgcaaaatcctaggagta

SEQ ID NO: 175387 - DNA, 20 bp, Artificial Sequence
  chemically synthesized
tactttatgcaaaatcctag

SEQ ID NO: 175388 - DNA, 20 bp, Artificial Sequence
  chemically synthesized
gatactttatgcaaaatcct

SEQ ID NO: 175389 - DNA, 20 bp, Artificial Sequence
  chemically synthesized
agatactttatgcaaaatcc

SEQ ID NO: 175390 - DNA, 20 bp, Artificial Sequence
  chemically synthesized
tactcctaggattttgcata

SEQ ID NO: 175391 - DNA, 20 bp, Artificial Sequence
  chemically synthesized
attttgcataaagtatcttt

SEQ ID NO: 175392 - DNA, 20 bp, Artificial Sequence
  chemically synthesized
ttttgcataaagtatctttg

SEQ ID NO: 175393 - DNA, 20 bp, Artificial Sequence
  chemically synthesized
gagggtcacaaagatcctca

SEQ ID NO: 175394 - DNA, 20 bp, Artificial Sequence
  chemically synthesized
caatagtctagagggtcaca

SEQ ID NO: 175395 - DNA, 20 bp, Artificial Sequence
  chemically synthesized
tgaggatctttgtgaccctc

SEQ ID NO: 175396 - DNA, 20 bp, Artificial Sequence
  chemically synthesized
tcaaaagccaatagtctaga

SEQ ID NO: 175397 - DNA, 20 bp, Artificial Sequence
  chemically synthesized
ctcaaaagccaatagtctag

SEQ ID NO: 175398 - DNA, 20 bp, Artificial Sequence
  chemically synthesized
tctcaaaagccaatagtcta

SEQ ID NO: 175399 - DNA, 20 bp, Artificial Sequence
  chemically synthesized
tttgtgaccctctagactat

SEQ ID NO: 175400 - DNA, 20 bp, Artificial Sequence
  chemically synthesized
attctcaaaagccaatagtc

SEQ ID NO: 175401 - DNA, 20 bp, Artificial Sequence
  chemically synthesized
tcaatattctcaaaagccaa

SEQ ID NO: 175402 - DNA, 20 bp, Artificial Sequence
  chemically synthesized
cctctagactattggctttt

SEQ ID NO: 175403 - DNA, 20 bp, Artificial Sequence
  chemically synthesized
cacagtatcaatattctcaa

SEQ ID NO: 175404 - DNA, 20 bp, Artificial Sequence
  chemically synthesized
attctcacgtaatattgaca

SEQ ID NO: 175405 - DNA, 20 bp, Artificial Sequence
  chemically synthesized
atactgtgtcaatattacgt

SEQ ID NO: 175406 - DNA, 20 bp, Artificial Sequence
  chemically synthesized
tgtcaatattacgtgagaat

SEQ ID NO: 175407 - DNA, 20 bp, Artificial Sequence
  chemically synthesized
gtcaatattacgtgagaatc

SEQ ID NO: 175408 - DNA, 20 bp, Artificial Sequence
  chemically synthesized
tattacgtgagaatcaggat

SEQ ID NO: 175409 - DNA, 20 bp, Artificial Sequence
  chemically synthesized
gagaatcaggattagttgat

SEQ ID NO: 175410 - DNA, 20 bp, Artificial Sequence
  chemically synthesized
tgattagaaatctgaataca

SEQ ID NO: 175411 - DNA, 20 bp, Artificial Sequence
  chemically synthesized
gattagaaatctgaatacat

SEQ ID NO: 175412 - DNA, 20 bp, Artificial Sequence
  chemically synthesized
aagatgcattcctatgtatt

SEQ ID NO: 175413 - DNA, 20 bp, Artificial Sequence
  chemically synthesized
cacaagtaaggtattcagtt

SEQ ID NO: 175414 - DNA, 20 bp, Artificial Sequence
  chemically synthesized
cccctcacaagtaaggtatt

SEQ ID NO: 175415 - DNA, 20 bp, Artificial Sequence
  chemically synthesized
taactgaataccttacttgt

SEQ ID NO: 175416 - DNA, 20 bp, Artificial Sequence
  chemically synthesized
ttctcaccccctcacaagta

SEQ ID NO: 175417 - DNA, 20 bp, Artificial Sequence
  chemically synthesized
aactgaataccttacttgtg

SEQ ID NO: 175418 - DNA, 20 bp, Artificial Sequence
  chemically synthesized
tttctcaccccctcacaagt

SEQ ID NO: 175419 - DNA, 20 bp, Artificial Sequence
  chemically synthesized
actgaataccttacttgtga

SEQ ID NO: 175420 - DNA, 20 bp, Artificial Sequence
  chemically synthesized
ctgaataccttacttgtgag

SEQ ID NO: 175421 - DNA, 20 bp, Artificial Sequence
  chemically synthesized
tgaataccttacttgtgagg

SEQ ID NO: 175422 - DNA, 20 bp, Artificial Sequence
  chemically synthesized
taagtttctcaccccctcac

SEQ ID NO: 175423 - DNA, 20 bp, Artificial Sequence
  chemically synthesized
taccttacttgtgagggggt

SEQ ID NO: 175424 - DNA, 20 bp, Artificial Sequence
  chemically synthesized
tgagggggtgagaaacttaa

SEQ ID NO: 175425 - DNA, 20 bp, Artificial Sequence
  chemically synthesized
accacaccttgcaatctatt

SEQ ID NO: 175426 - DNA, 20 bp, Artificial Sequence
  chemically synthesized
tgagaaacttaatagattgc

SEQ ID NO: 175427 - DNA, 20 bp, Artificial Sequence
  chemically synthesized
gagaaacttaatagattgca

SEQ ID NO: 175428 - DNA, 20 bp, Artificial Sequence
  chemically synthesized
acttaatagattgcaaggtg

SEQ ID NO: 175429 - DNA, 20 bp, Artificial Sequence
  chemically synthesized
taatagattgcaaggtgtgg

SEQ ID NO: 175430 - DNA, 20 bp, Artificial Sequence
  chemically synthesized
caaggtgtggtagattgcac

SEQ ID NO: 175431 - DNA, 20 bp, Artificial Sequence
  chemically synthesized
tgtgcatacagagaggtcac

SEQ ID NO: 175432 - DNA, 20 bp, Artificial Sequence
  chemically synthesized
aaaaagatgtgcatacagag

SEQ ID NO: 175433 - DNA, 20 bp, Artificial Sequence
  chemically synthesized
caaaaagatgtgcatacaga

SEQ ID NO: 175434 - DNA, 20 bp, Artificial Sequence
  chemically synthesized
tgcaaaaagatgtgcataca

SEQ ID NO: 175435 - DNA, 20 bp, Artificial Sequence
  chemically synthesized
attgcaaaaagatgtgcata

SEQ ID NO: 175436 - DNA, 20 bp, Artificial Sequence
  chemically synthesized
tttaaaagtcacattgcaaa

SEQ ID NO: 175437 - DNA, 20 bp, Artificial Sequence
  chemically synthesized
tttttgcaatgtgactttta

SEQ ID NO: 175438 - DNA, 20 bp, Artificial Sequence
  chemically synthesized
cctgatggtagcaactttaa

SEQ ID NO: 175439 - DNA, 20 bp, Artificial Sequence
  chemically synthesized
acttttaaagttgctaccat

SEQ ID NO: 175440 - DNA, 20 bp, Artificial Sequence
  chemically synthesized
cttttaaagttgctaccatc

SEQ ID NO: 175441 - DNA, 20 bp, Artificial Sequence
  chemically synthesized
tttaaagttgctaccatcag

SEQ ID NO: 175442 - DNA, 20 bp, Artificial Sequence
  chemically synthesized
taggttacaactcctgatgg

SEQ ID NO: 175443 - DNA, 20 bp, Artificial Sequence
  chemically synthesized
aaataggttacaactcctga

SEQ ID NO: 175444 - DNA, 20 bp, Artificial Sequence
  chemically synthesized
tattcagggattagggaaat

SEQ ID NO: 175445 - DNA, 20 bp, Artificial Sequence
  chemically synthesized
atattcagggattagggaaa

SEQ ID NO: 175446 - DNA, 20 bp, Artificial Sequence
  chemically synthesized
aggcccatattcagggatta

SEQ ID NO: 175447 - DNA, 20 bp, Artificial Sequence
  chemically synthesized
caggcccatattcagggatt

SEQ ID NO: 175448 - DNA, 20 bp, Artificial Sequence
  chemically synthesized
gcaggcccatattcagggat

SEQ ID NO: 175449 - DNA, 20 bp, Artificial Sequence
  chemically synthesized
atttccctaatccctgaata

SEQ ID NO: 175450 - DNA, 20 bp, Artificial Sequence
  chemically synthesized
tttccctaatccctgaatat

SEQ ID NO: 175451 - DNA, 20 bp, Artificial Sequence
  chemically synthesized
acaaggcaggcccatattca

SEQ ID NO: 175452 - DNA, 20 bp, Artificial Sequence
  chemically synthesized
cacaaggcaggcccatattc

SEQ ID NO: 175453 - DNA, 20 bp, Artificial Sequence
  chemically synthesized
tcacaaggcaggcccatatt

SEQ ID NO: 175454 - DNA, 20 bp, Artificial Sequence
  chemically synthesized
accaaagcaaatcacaaggc

SEQ ID NO: 175455 - DNA, 20 bp, Artificial Sequence
  chemically synthesized
aaccaaagcaaatcacaagg

SEQ ID NO: 175456 - DNA, 20 bp, Artificial Sequence
  chemically synthesized
tttaaccaaagcaaatcaca

SEQ ID NO: 175457 - DNA, 20 bp, Artificial Sequence
  chemically synthesized
ttttaaccaaagcaaatcac

SEQ ID NO: 175458 - DNA, 20 bp, Artificial Sequence
  chemically synthesized
gcctgccttgtgatttgctt

SEQ ID NO: 175459 - DNA, 20 bp, Artificial Sequence
  chemically synthesized
ctaacacatttttttaacca

SEQ ID NO: 175460 - DNA, 20 bp, Artificial Sequence
  chemically synthesized
ctttggttaaaaaaatgtgt

SEQ ID NO: 175461 - DNA, 20 bp, Artificial Sequence
  chemically synthesized
taaaaaaatgtgttagaaat

SEQ ID NO: 175462 - DNA, 20 bp, Artificial Sequence
  chemically synthesized
aaaatgtgttagaaatgagt

SEQ ID NO: 175463 - DNA, 20 bp, Artificial Sequence
  chemically synthesized
tgtgttagaaatgagtgagc

SEQ ID NO: 175464 - DNA, 20 bp, Artificial Sequence
  chemically synthesized
gaaatgagtgagccagctcc

SEQ ID NO: 175465 - DNA, 20 bp, Artificial Sequence
  chemically synthesized
ttgaagcttaagcttggagc

SEQ ID NO: 175466 - DNA, 20 bp, Artificial Sequence
  chemically synthesized
agtgagccagctccaagctt

SEQ ID NO: 175467 - DNA, 20 bp, Artificial Sequence
  chemically synthesized
cttcttgaagcttaagcttg

SEQ ID NO: 175468 - DNA, 20 bp, Artificial Sequence
  chemically synthesized
gacttcttgaagcttaagct

SEQ ID NO: 175469 - DNA, 20 bp, Artificial Sequence
  chemically synthesized
cagctccaagcttaagcttc

SEQ ID NO: 175470 - DNA, 20 bp, Artificial Sequence
  chemically synthesized
aacaagacttcttgaagctt

SEQ ID NO: 175471 - DNA, 20 bp, Artificial Sequence
  chemically synthesized
ctccaagcttaagcttcaag

SEQ ID NO: 175472 - DNA, 20 bp, Artificial Sequence
  chemically synthesized
gaaggaaacaagacttcttg

SEQ ID NO: 175473 - DNA, 20 bp, Artificial Sequence
  chemically synthesized
attctaatagagaaggaaac

SEQ ID NO: 175474 - DNA, 20 bp, Artificial Sequence
  chemically synthesized
agtcttgtttccttctctat

SEQ ID NO: 175475 - DNA, 20 bp, Artificial Sequence
  chemically synthesized
aaacaggattctaatagaga

SEQ ID NO: 175476 - DNA, 20 bp, Artificial Sequence
  chemically synthesized
gaaacaggattctaatagag

SEQ ID NO: 175477 - DNA, 20 bp, Artificial Sequence
  chemically synthesized
caagaaacaggattctaata

SEQ ID NO: 175478 - DNA, 20 bp, Artificial Sequence
  chemically synthesized
tgcaagaaacaggattctaa

SEQ ID NO: 175479 - DNA, 20 bp, Artificial Sequence
  chemically synthesized
cttattctcatgcaagaaac

SEQ ID NO: 175480 - DNA, 20 bp, Artificial Sequence
  chemically synthesized
gcttattctcatgcaagaaa

SEQ ID NO: 175481 - DNA, 20 bp, Artificial Sequence
  chemically synthesized
tagaatcctgtttcttgcat

SEQ ID NO: 175482 - DNA, 20 bp, Artificial Sequence
  chemically synthesized
tcctgggcttattctcatgc

SEQ ID NO: 175483 - DNA, 20 bp, Artificial Sequence
  chemically synthesized
cctgtttcttgcatgagaat

SEQ ID NO: 175484 - DNA, 20 bp, Artificial Sequence
  chemically synthesized
ttcttgcatgagaataagcc

SEQ ID NO: 175485 - DNA, 20 bp, Artificial Sequence
  chemically synthesized
tcttgcatgagaataagccc

SEQ ID NO: 175486 - DNA, 20 bp, Artificial Sequence
  chemically synthesized
ttgcatgagaataagcccag

SEQ ID NO: 175487 - DNA, 20 bp, Artificial Sequence
  chemically synthesized
atccttcggcaagcgctcct

SEQ ID NO: 175488 - DNA, 20 bp, Artificial Sequence
  chemically synthesized
catccttcggcaagcgctcc

SEQ ID NO: 175489 - DNA, 20 bp, Artificial Sequence
  chemically synthesized
aagcccaggagcgcttgccg

SEQ ID NO: 175490 - DNA, 20 bp, Artificial Sequence
  chemically synthesized
agcccaggagcgcttgccga

SEQ ID NO: 175491 - DNA, 20 bp, Artificial Sequence
  chemically synthesized
atggtctctcatccttcggc

SEQ ID NO: 175492 - DNA, 20 bp, Artificial Sequence
  chemically synthesized
aggagcgcttgccgaaggat

SEQ ID NO: 175493 - DNA, 20 bp, Artificial Sequence
  chemically synthesized
ccatatggtctctcatcctt

SEQ ID NO: 175494 - DNA, 20 bp, Artificial Sequence
  chemically synthesized
gagcgcttgccgaaggatga

SEQ ID NO: 175495 - DNA, 20 bp, Artificial Sequence
  chemically synthesized
ccgaaggatgagagaccata

SEQ ID NO: 175496 - DNA, 20 bp, Artificial Sequence
  chemically synthesized
gaaggatgagagaccatatg

SEQ ID NO: 175497 - DNA, 20 bp, Artificial Sequence
  chemically synthesized
ggatgagagaccatatggag

SEQ ID NO: 175498 - DNA, 20 bp, Artificial Sequence
  chemically synthesized
tgattcacctctgctccata

SEQ ID NO: 175499 - DNA, 20 bp, Artificial Sequence
  chemically synthesized
atgagagaccatatggagca

SEQ ID NO: 175500 - DNA, 20 bp, Artificial Sequence
  chemically synthesized
tgagagaccatatggagcag

SEQ ID NO: 175501 - DNA, 20 bp, Artificial Sequence
  chemically synthesized
ggagcagaggtgaatcatcc

SEQ ID NO: 175502 - DNA, 20 bp, Artificial Sequence
  chemically synthesized
tatctagcataagcgcagct

SEQ ID NO: 175503 - DNA, 20 bp, Artificial Sequence
  chemically synthesized
ttatctagcataagcgcagc

SEQ ID NO: 175504 - DNA, 20 bp, Artificial Sequence
  chemically synthesized
tggcttatctagcataagcg

SEQ ID NO: 175505 - DNA, 20 bp, Artificial Sequence
  chemically synthesized
catcctagctgcgcttatgc

SEQ ID NO: 175506 - DNA, 20 bp, Artificial Sequence
  chemically synthesized
ggggctggcttatctagcat

SEQ ID NO: 175507 - DNA, 20 bp, Artificial Sequence
  chemically synthesized
tagctgcgcttatgctagat

SEQ ID NO: 175508 - DNA, 20 bp, Artificial Sequence
  chemically synthesized
tgcgcttatgctagataagc

SEQ ID NO: 175509 - DNA, 20 bp, Artificial Sequence
  chemically synthesized
gggctaggggctggcttatc

SEQ ID NO: 175510 - DNA, 20 bp, Artificial Sequence
  chemically synthesized
atgctagataagccagcccc

SEQ ID NO: 175511 - DNA, 20 bp, Artificial Sequence
  chemically synthesized
ctaatgggtgggctaggggc

SEQ ID NO: 175512 - DNA, 20 bp, Artificial Sequence
  chemically synthesized
tcagctaatgggtgggctag

SEQ ID NO: 175513 - DNA, 20 bp, Artificial Sequence
  chemically synthesized
gtcagctaatgggtgggcta

SEQ ID NO: 175514 - DNA, 20 bp, Artificial Sequence
  chemically synthesized
agtcagctaatgggtgggct

SEQ ID NO: 175515 - DNA, 20 bp, Artificial Sequence
  chemically synthesized
cagtcagctaatgggtgggc

SEQ ID NO: 175516 - DNA, 20 bp, Artificial Sequence
  chemically synthesized
ccagcccctagcccacccat

SEQ ID NO: 175517 - DNA, 20 bp, Artificial Sequence
  chemically synthesized
ttttcagtcagctaatgggt

SEQ ID NO: 175518 - DNA, 20 bp, Artificial Sequence
  chemically synthesized
attttcagtcagctaatggg

SEQ ID NO: 175519 - DNA, 20 bp, Artificial Sequence
  chemically synthesized
tacattttcagtcagctaat

SEQ ID NO: 175520 - DNA, 20 bp, Artificial Sequence
  chemically synthesized
atacattttcagtcagctaa

SEQ ID NO: 175521 - DNA, 20 bp, Artificial Sequence
  chemically synthesized
ctcactcatacattttcagt

SEQ ID NO: 175522 - DNA, 20 bp, Artificial Sequence
  chemically synthesized
ctggctcactcatacatttt

SEQ ID NO: 175523 - DNA, 20 bp, Artificial Sequence
  chemically synthesized
ttagctgactgaaaatgtat

SEQ ID NO: 175524 - DNA, 20 bp, Artificial Sequence
  chemically synthesized
ctgactgaaaatgtatgagt

SEQ ID NO: 175525 - DNA, 20 bp, Artificial Sequence
  chemically synthesized
ctgaaaatgtatgagtgagc

SEQ ID NO: 175526 - DNA, 20 bp, Artificial Sequence
  chemically synthesized
cgtgagctgttgtgttgttc

SEQ ID NO: 175527 - DNA, 20 bp, Artificial Sequence
  chemically synthesized
agtgagccagaacaacacaa

SEQ ID NO: 175528 - DNA, 20 bp, Artificial Sequence
  chemically synthesized
cagaacaacacaacagctca

SEQ ID NO: 175529 - DNA, 20 bp, Artificial Sequence
  chemically synthesized
agaacaacacaacagctcac

SEQ ID NO: 175530 - DNA, 20 bp, Artificial Sequence
  chemically synthesized
cacagtctgtggggtcccgt

SEQ ID NO: 175531 - DNA, 20 bp, Artificial Sequence
  chemically synthesized
caacagctcacgggacccca

SEQ ID NO: 175532 - DNA, 20 bp, Artificial Sequence
  chemically synthesized
ataattgcacacagtctgtg

SEQ ID NO: 175533 - DNA, 20 bp, Artificial Sequence
  chemically synthesized
tataattgcacacagtctgt

SEQ ID NO: 175534 - DNA, 20 bp, Artificial Sequence
  chemically synthesized
ttataattgcacacagtctg

SEQ ID NO: 175535 - DNA, 20 bp, Artificial Sequence
  chemically synthesized
tcaccatttataattgcaca

SEQ ID NO: 175536 - DNA, 20 bp, Artificial Sequence
  chemically synthesized
agactgtgtgcaattataaa

SEQ ID NO: 175537 - DNA, 20 bp, Artificial Sequence
  chemically synthesized
ttataaatggtgataatttt

SEQ ID NO: 175538 - DNA, 20 bp, Artificial Sequence
  chemically synthesized
ggtgataattttaagtcaat

SEQ ID NO: 175539 - DNA, 20 bp, Artificial Sequence
  chemically synthesized
aattttaagtcaataagttt

SEQ ID NO: 175540 - DNA, 20 bp, Artificial Sequence
  chemically synthesized
attttaagtcaataagtttt

SEQ ID NO: 175541 - DNA, 20 bp, Artificial Sequence
  chemically synthesized
ttttaagtcaataagtttta

SEQ ID NO: 175542 - DNA, 20 bp, Artificial Sequence
  chemically synthesized
caatagtgtaaaatttgcaa

SEQ ID NO: 175543 - DNA, 20 bp, Artificial Sequence
  chemically synthesized
tattgcaaattttacactat

SEQ ID NO: 175544 - DNA, 20 bp, Artificial Sequence
  chemically synthesized
ttgcaaattttacactattg

SEQ ID NO: 175545 - DNA, 20 bp, Artificial Sequence
  chemically synthesized
cagttaagtaataactccaa

SEQ ID NO: 175546 - DNA, 20 bp, Artificial Sequence
  chemically synthesized
ctttcccctatatatcagtt

SEQ ID NO: 175547 - DNA, 20 bp, Artificial Sequence
  chemically synthesized
gttattacttaactgatata

SEQ ID NO: 175548 - DNA, 20 bp, Artificial Sequence
  chemically synthesized
ttattacttaactgatatat

SEQ ID NO: 175549 - DNA, 20 bp, Artificial Sequence
  chemically synthesized
tattacttaactgatatata

SEQ ID NO: 175550 - DNA, 20 bp, Artificial Sequence
  chemically synthesized
tctggctttcccctatatat

SEQ ID NO: 175551 - DNA, 20 bp, Artificial Sequence
  chemically synthesized
attacttaactgatatatag

SEQ ID NO: 175552 - DNA, 20 bp, Artificial Sequence
  chemically synthesized
cttaactgatatatagggga

SEQ ID NO: 175553 - DNA, 20 bp, Artificial Sequence
  chemically synthesized
actgatatataggggaaagc

SEQ ID NO: 175554 - DNA, 20 bp, Artificial Sequence
  chemically synthesized
atataggggaaagccagaaa

SEQ ID NO: 175555 - DNA, 20 bp, Artificial Sequence
  chemically synthesized
tataggggaaagccagaaat

SEQ ID NO: 175556 - DNA, 20 bp, Artificial Sequence
  chemically synthesized
taggggaaagccagaaatgg

SEQ ID NO: 175557 - DNA, 20 bp, Artificial Sequence
  chemically synthesized
ccaagcctcactcccatttc

SEQ ID NO: 175558 - DNA, 20 bp, Artificial Sequence
  chemically synthesized
ggaaagccagaaatgggagt

SEQ ID NO: 175559 - DNA, 20 bp, Artificial Sequence
  chemically synthesized
gaaagccagaaatgggagtg

SEQ ID NO: 175560 - DNA, 20 bp, Artificial Sequence
  chemically synthesized
ccagaaatgggagtgaggct

SEQ ID NO: 175561 - DNA, 20 bp, Artificial Sequence
  chemically synthesized
aatgggagtgaggcttggta

SEQ ID NO: 175562 - DNA, 20 bp, Artificial Sequence
  chemically synthesized
taagaactcttaactgtacc

SEQ ID NO: 175563 - DNA, 20 bp, Artificial Sequence
  chemically synthesized
gagtgaggcttggtacagtt

SEQ ID NO: 175564 - DNA, 20 bp, Artificial Sequence
  chemically synthesized
gtgaggcttggtacagttaa

SEQ ID NO: 175565 - DNA, 20 bp, Artificial Sequence
  chemically synthesized
tgaggactctggtattattt

SEQ ID NO: 175566 - DNA, 20 bp, Artificial Sequence
  chemically synthesized
taagagttcttaaataatac

SEQ ID NO: 175567 - DNA, 20 bp, Artificial Sequence
  chemically synthesized
agagttcttaaataatacca

SEQ ID NO: 175568 - DNA, 20 bp, Artificial Sequence
  chemically synthesized
aattttaggattgaggactc

SEQ ID NO: 175569 - DNA, 20 bp, Artificial Sequence
  chemically synthesized
aatcagtaattttaggattg

SEQ ID NO: 175570 - DNA, 20 bp, Artificial Sequence
  chemically synthesized
aaatcagtaattttaggatt

SEQ ID NO: 175571 - DNA, 20 bp, Artificial Sequence
  chemically synthesized
aaatcaaaatcagtaatttt

SEQ ID NO: 175572 - DNA, 20 bp, Artificial Sequence
  chemically synthesized
aaaatcaaaatcagtaattt

SEQ ID NO: 175573 - DNA, 20 bp, Artificial Sequence
  chemically synthesized
tactcattcaaaatcaaaat

SEQ ID NO: 175574 - DNA, 20 bp, Artificial Sequence
  chemically synthesized
tactgattttgattttgaat

SEQ ID NO: 175575 - DNA, 20 bp, Artificial Sequence
  chemically synthesized
tgattttgaatgagtatcta

SEQ ID NO: 175576 - DNA, 20 bp, Artificial Sequence
  chemically synthesized
tttgaatgagtatctaaagt

SEQ ID NO: 175577 - DNA, 20 bp, Artificial Sequence
  chemically synthesized
ttgaatgagtatctaaagtc

SEQ ID NO: 175578 - DNA, 20 bp, Artificial Sequence
  chemically synthesized
caaagaattgagcctgactt

SEQ ID NO: 175579 - DNA, 20 bp, Artificial Sequence
  chemically synthesized
agacatctttgcaaagaatt

SEQ ID NO: 175580 - DNA, 20 bp, Artificial Sequence
  chemically synthesized
gtcaggctcaattctttgca

SEQ ID NO: 175581 - DNA, 20 bp, Artificial Sequence
  chemically synthesized
tctcttcagacatctttgca

SEQ ID NO: 175582 - DNA, 20 bp, Artificial Sequence
  chemically synthesized
attctttgcaaagatgtctg

SEQ ID NO: 175583 - DNA, 20 bp, Artificial Sequence
  chemically synthesized
tctttgcaaagatgtctgaa

SEQ ID NO: 175584 - DNA, 20 bp, Artificial Sequence
  chemically synthesized
atttgccatgaatgtctctt

SEQ ID NO: 175585 - DNA, 20 bp, Artificial Sequence
  chemically synthesized
gatgtctgaagagacattca

SEQ ID NO: 175586 - DNA, 20 bp, Artificial Sequence
  chemically synthesized
agacattcatggcaaatcaa

SEQ ID NO: 175587 - DNA, 20 bp, Artificial Sequence
  chemically synthesized
gacattcatggcaaatcaat

SEQ ID NO: 175588 - DNA, 20 bp, Artificial Sequence
  chemically synthesized
acattcatggcaaatcaatg

SEQ ID NO: 175589 - DNA, 20 bp, Artificial Sequence
  chemically synthesized
cattcatggcaaatcaatgg

SEQ ID NO: 175590 - DNA, 20 bp, Artificial Sequence
  chemically synthesized
aatgggggtaaccactgaaa

SEQ ID NO: 175591 - DNA, 20 bp, Artificial Sequence
  chemically synthesized
ttctaaaatcactttttcag

SEQ ID NO: 175592 - DNA, 20 bp, Artificial Sequence
  chemically synthesized
atcttctaaaatcacttttt

SEQ ID NO: 175593 - DNA, 20 bp, Artificial Sequence
  chemically synthesized
aaccactgaaaaagtgattt

SEQ ID NO: 175594 - DNA, 20 bp, Artificial Sequence
  chemically synthesized
cactgaaaaagtgattttag

SEQ ID NO: 175595 - DNA, 20 bp, Artificial Sequence
  chemically synthesized
tgattttagaagatcattat

SEQ ID NO: 175596 - DNA, 20 bp, Artificial Sequence
  chemically synthesized
ttttagaagatcattattag

SEQ ID NO: 175597 - DNA, 20 bp, Artificial Sequence
  chemically synthesized
attattagaagacctaataa

SEQ ID NO: 175598 - DNA, 20 bp, Artificial Sequence
  chemically synthesized
aaaaaatactagctattatt

SEQ ID NO: 175599 - DNA, 20 bp, Artificial Sequence
  chemically synthesized
caaaaaatactagctattat

SEQ ID NO: 175600 - DNA, 20 bp, Artificial Sequence
  chemically synthesized
ttagaagacctaataatagc

SEQ ID NO: 175601 - DNA, 20 bp, Artificial Sequence
  chemically synthesized
agtaagtggccaaaaaatac

SEQ ID NO: 175602 - DNA, 20 bp, Artificial Sequence
  chemically synthesized
taataatagctagtattttt

SEQ ID NO: 175603 - DNA, 20 bp, Artificial Sequence
  chemically synthesized
aacagctgatacagagtaag

SEQ ID NO: 175604 - DNA, 20 bp, Artificial Sequence
  chemically synthesized
ggcaacagctgatacagagt

SEQ ID NO: 175605 - DNA, 20 bp, Artificial Sequence
  chemically synthesized
tttggccacttactctgtat

SEQ ID NO: 175606 - DNA, 20 bp, Artificial Sequence
  chemically synthesized
tttgggcaacagctgataca

SEQ ID NO: 175607 - DNA, 20 bp, Artificial Sequence
  chemically synthesized
gctttgggcaacagctgata

SEQ ID NO: 175608 - DNA, 20 bp, Artificial Sequence
  chemically synthesized
tctgtatcagctgttgccca

SEQ ID NO: 175609 - DNA, 20 bp, Artificial Sequence
  chemically synthesized
tctttcactgctttgggcaa

SEQ ID NO: 175610 - DNA, 20 bp, Artificial Sequence
  chemically synthesized
gtatcagctgttgcccaaag

SEQ ID NO: 175611 - DNA, 20 bp, Artificial Sequence
  chemically synthesized
tttccctctttcactgcttt

SEQ ID NO: 175612 - DNA, 20 bp, Artificial Sequence
  chemically synthesized
ctttccctctttcactgctt

SEQ ID NO: 175613 - DNA, 20 bp, Artificial Sequence
  chemically synthesized
gctgttgcccaaagcagtga

SEQ ID NO: 175614 - DNA, 20 bp, Artificial Sequence
  chemically synthesized
tgttgcccaaagcagtgaaa

SEQ ID NO: 175615 - DNA, 20 bp, Artificial Sequence
  chemically synthesized
gttgcccaaagcagtgaaag

SEQ ID NO: 175616 - DNA, 20 bp, Artificial Sequence
  chemically synthesized
ttgcccaaagcagtgaaaga

SEQ ID NO: 175617 - DNA, 20 bp, Artificial Sequence
  chemically synthesized
ccaaagcagtgaaagaggga

SEQ ID NO: 175618 - DNA, 20 bp, Artificial Sequence
  chemically synthesized
caggagaaggggagatttca

SEQ ID NO: 175619 - DNA, 20 bp, Artificial Sequence
  chemically synthesized
gcaggagaaggggagatttc

SEQ ID NO: 175620 - DNA, 20 bp, Artificial Sequence
  chemically synthesized
agcaggagaaggggagattt

SEQ ID NO: 175621 - DNA, 20 bp, Artificial Sequence
  chemically synthesized
attggagagcaggagaaggg

SEQ ID NO: 175622 - DNA, 20 bp, Artificial Sequence
  chemically synthesized
agattggagagcaggagaag

SEQ ID NO: 175623 - DNA, 20 bp, Artificial Sequence
  chemically synthesized
gagattggagagcaggagaa

SEQ ID NO: 175624 - DNA, 20 bp, Artificial Sequence
  chemically synthesized
ggagattggagagcaggaga

SEQ ID NO: 175625 - DNA, 20 bp, Artificial Sequence
  chemically synthesized
aggagattggagagcaggag

SEQ ID NO: 175626 - DNA, 20 bp, Artificial Sequence
  chemically synthesized
ggcaggagattggagagcag

SEQ ID NO: 175627 - DNA, 20 bp, Artificial Sequence
  chemically synthesized
ttggcaggagattggagagc

SEQ ID NO: 175628 - DNA, 20 bp, Artificial Sequence
  chemically synthesized
gttggcaggagattggagag

SEQ ID NO: 175629 - DNA, 20 bp, Artificial Sequence
  chemically synthesized
ggcgttggcaggagattgga

SEQ ID NO: 175630 - DNA, 20 bp, Artificial Sequence
  chemically synthesized
gaggcgttggcaggagattg

SEQ ID NO: 175631 - DNA, 20 bp, Artificial Sequence
  chemically synthesized
gggaggcgttggcaggagat

SEQ ID NO: 175632 - DNA, 20 bp, Artificial Sequence
  chemically synthesized
ccagtgggaggcgttggcag

SEQ ID NO: 175633 - DNA, 20 bp, Artificial Sequence
  chemically synthesized
aaccagtgggaggcgttggc

SEQ ID NO: 175634 - DNA, 20 bp, Artificial Sequence
  chemically synthesized
taaccagtgggaggcgttgg

SEQ ID NO: 175635 - DNA, 20 bp, Artificial Sequence
  chemically synthesized
atttaaccagtgggaggcgt

SEQ ID NO: 175636 - DNA, 20 bp, Artificial Sequence
  chemically synthesized
ctcctgccaacgcctcccac

SEQ ID NO: 175637 - DNA, 20 bp, Artificial Sequence
  chemically synthesized
gtatagatttaaccagtggg

SEQ ID NO: 175638 - DNA, 20 bp, Artificial Sequence
  chemically synthesized
tgtatagatttaaccagtgg

SEQ ID NO: 175639 - DNA, 20 bp, Artificial Sequence
  chemically synthesized
tctgtatagatttaaccagt

SEQ ID NO: 175640 - DNA, 20 bp, Artificial Sequence
  chemically synthesized
ttctgtatagatttaaccag

SEQ ID NO: 175641 - DNA, 20 bp, Artificial Sequence
  chemically synthesized
atcttctgtatagatttaac

SEQ ID NO: 175642 - DNA, 20 bp, Artificial Sequence
  chemically synthesized
tcccactggttaaatctata

SEQ ID NO: 175643 - DNA, 20 bp, Artificial Sequence
  chemically synthesized
cactggttaaatctatacag

SEQ ID NO: 175644 - DNA, 20 bp, Artificial Sequence
  chemically synthesized
cttctcaactatcttctgta

SEQ ID NO: 175645 - DNA, 20 bp, Artificial Sequence
  chemically synthesized
ggttaaatctatacagaaga

SEQ ID NO: 175646 - DNA, 20 bp, Artificial Sequence
  chemically synthesized
aatctatacagaagatagtt

SEQ ID NO: 175647 - DNA, 20 bp, Artificial Sequence
  chemically synthesized
ctatacagaagatagttgag

SEQ ID NO: 175648 - DNA, 20 bp, Artificial Sequence
  chemically synthesized
acagaagatagttgagaaga

SEQ ID NO: 175649 - DNA, 20 bp, Artificial Sequence
  chemically synthesized
gatagttgagaagaaagcct

SEQ ID NO: 175650 - DNA, 20 bp, Artificial Sequence
  chemically synthesized
atagttgagaagaaagcctg

SEQ ID NO: 175651 - DNA, 20 bp, Artificial Sequence
  chemically synthesized
gagaagaaagcctgaggaat

SEQ ID NO: 175652 - DNA, 20 bp, Artificial Sequence
  chemically synthesized
ctccactcaccttattcctc

SEQ ID NO: 175653 - DNA, 20 bp, Artificial Sequence
  chemically synthesized
agaagaaagcctgaggaata

SEQ ID NO: 175654 - DNA, 20 bp, Artificial Sequence
  chemically synthesized
cctccactcaccttattcct

SEQ ID NO: 175655 - DNA, 20 bp, Artificial Sequence
  chemically synthesized
gaaagcctgaggaataaggt

SEQ ID NO: 175656 - DNA, 20 bp, Artificial Sequence
  chemically synthesized
agcctgaggaataaggtgag

SEQ ID NO: 175657 - DNA, 20 bp, Artificial Sequence
  chemically synthesized
cctgaggaataaggtgagtg

SEQ ID NO: 175658 - DNA, 20 bp, Artificial Sequence
  chemically synthesized
ctgaggaataaggtgagtgg

SEQ ID NO: 175659 - DNA, 20 bp, Artificial Sequence
  chemically synthesized
ggaataaggtgagtggaggt

SEQ ID NO: 175660 - DNA, 20 bp, Artificial Sequence
  chemically synthesized
aatatattgtatattgcaag

SEQ ID NO: 175661 - DNA, 20 bp, Artificial Sequence
  chemically synthesized
tgcaatatattgtatattgc

SEQ ID NO: 175662 - DNA, 20 bp, Artificial Sequence
  chemically synthesized
gcaatatacaatatattgca

SEQ ID NO: 175663 - DNA, 20 bp, Artificial Sequence
  chemically synthesized
tatacaatatattgcacaga

SEQ ID NO: 175664 - DNA, 20 bp, Artificial Sequence
  chemically synthesized
tacaatatattgcacagaaa

SEQ ID NO: 175665 - DNA, 20 bp, Artificial Sequence
  chemically synthesized
acaatatattgcacagaaag

SEQ ID NO: 175666 - DNA, 20 bp, Artificial Sequence
  chemically synthesized
atatattgcacagaaagagg

SEQ ID NO: 175667 - DNA, 20 bp, Artificial Sequence
  chemically synthesized
tatattgcacagaaagagga

SEQ ID NO: 175668 - DNA, 20 bp, Artificial Sequence
  chemically synthesized
acagaaagaggaaggaaatt

SEQ ID NO: 175669 - DNA, 20 bp, Artificial Sequence
  chemically synthesized
aaggaaattgagtgaatctg

SEQ ID NO: 175670 - DNA, 20 bp, Artificial Sequence
  chemically synthesized
aggaaattgagtgaatctgt

SEQ ID NO: 175671 - DNA, 20 bp, Artificial Sequence
  chemically synthesized
aattgagtgaatctgtggga

SEQ ID NO: 175672 - DNA, 20 bp, Artificial Sequence
  chemically synthesized
acccaagtataactttccca

SEQ ID NO: 175673 - DNA, 20 bp, Artificial Sequence
  chemically synthesized
atctgtgggaaagttatact

SEQ ID NO: 175674 - DNA, 20 bp, Artificial Sequence
  chemically synthesized
tctgtgggaaagttatactt

SEQ ID NO: 175675 - DNA, 20 bp, Artificial Sequence
  chemically synthesized
cgttgtggggttcataaccc

SEQ ID NO: 175676 - DNA, 20 bp, Artificial Sequence
  chemically synthesized
ttgaaacatagatcgttgtg

SEQ ID NO: 175677 - DNA, 20 bp, Artificial Sequence
  chemically synthesized
tttgaaacatagatcgttgt

SEQ ID NO: 175678 - DNA, 20 bp, Artificial Sequence
  chemically synthesized
ctttgaaacatagatcgttg

SEQ ID NO: 175679 - DNA, 20 bp, Artificial Sequence
  chemically synthesized
ccacaacgatctatgtttca

SEQ ID NO: 175680 - DNA, 20 bp, Artificial Sequence
  chemically synthesized
tgatttatacctttgaaaca

SEQ ID NO: 175681 - DNA, 20 bp, Artificial Sequence
  chemically synthesized
cacaacgatctatgtttcaa

SEQ ID NO: 175682 - DNA, 20 bp, Artificial Sequence
  chemically synthesized
tgtgttcatattttctgtca

SEQ ID NO: 175683 - DNA, 20 bp, Artificial Sequence
  chemically synthesized
aagatacatatcaactttga

SEQ ID NO: 175684 - DNA, 20 bp, Artificial Sequence
  chemically synthesized
aagttgatatgtatcttctg

SEQ ID NO: 175685 - DNA, 20 bp, Artificial Sequence
  chemically synthesized
tgatatgtatcttctgtggt

SEQ ID NO: 175686 - DNA, 20 bp, Artificial Sequence
  chemically synthesized
gcacattcatccgaccacag

SEQ ID NO: 175687 - DNA, 20 bp, Artificial Sequence
  chemically synthesized
gaagcacattcatccgacca

SEQ ID NO: 175688 - DNA, 20 bp, Artificial Sequence
  chemically synthesized
tttgtctcttgatatttatg

SEQ ID NO: 175689 - DNA, 20 bp, Artificial Sequence
  chemically synthesized
gaatgtgcttcataaatatc

SEQ ID NO: 175690 - DNA, 20 bp, Artificial Sequence
  chemically synthesized
atgtgcttcataaatatcaa

SEQ ID NO: 175691 - DNA, 20 bp, Artificial Sequence
  chemically synthesized
agagacaaaatctttttgca

SEQ ID NO: 175692 - DNA, 20 bp, Artificial Sequence
  chemically synthesized
gagacaaaatctttttgcaa

SEQ ID NO: 175693 - DNA, 20 bp, Artificial Sequence
  chemically synthesized
actggaaaggcctttgcaaa

SEQ ID NO: 175694 - DNA, 20 bp, Artificial Sequence
  chemically synthesized
tctttttgcaaaggcctttc

SEQ ID NO: 175695 - DNA, 20 bp, Artificial Sequence
  chemically synthesized
tgtgttctgagatactggaa

SEQ ID NO: 175696 - DNA, 20 bp, Artificial Sequence
  chemically synthesized
gtgtgttctgagatactgga

SEQ ID NO: 175697 - DNA, 20 bp, Artificial Sequence
  chemically synthesized
caaaggcctttccagtatct

SEQ ID NO: 175698 - DNA, 20 bp, Artificial Sequence
  chemically synthesized
tacagtgtgttctgagatac

SEQ ID NO: 175699 - DNA, 20 bp, Artificial Sequence
  chemically synthesized
gaatgcatacagtgtgttct

SEQ ID NO: 175700 - DNA, 20 bp, Artificial Sequence
  chemically synthesized
cccattcaatggaatgcata

SEQ ID NO: 175701 - DNA, 20 bp, Artificial Sequence
  chemically synthesized
actgtatgcattccattgaa

SEQ ID NO: 175702 - DNA, 20 bp, Artificial Sequence
  chemically synthesized
ctgtatgcattccattgaat

SEQ ID NO: 175703 - DNA, 20 bp, Artificial Sequence
  chemically synthesized
tgaccaccaatcccattcaa

SEQ ID NO: 175704 - DNA, 20 bp, Artificial Sequence
  chemically synthesized
tgcattccattgaatgggat

SEQ ID NO: 175705 - DNA, 20 bp, Artificial Sequence
  chemically synthesized
attccattgaatgggattgg

SEQ ID NO: 175706 - DNA, 20 bp, Artificial Sequence
  chemically synthesized
attggtggtcaactcctaca

SEQ ID NO: 175707 - DNA, 20 bp, Artificial Sequence
  chemically synthesized
gctatcaagagtctgtgtag

SEQ ID NO: 175708 - DNA, 20 bp, Artificial Sequence
  chemically synthesized
tggctatcaagagtctgtgt

SEQ ID NO: 175709 - DNA, 20 bp, Artificial Sequence
  chemically synthesized
gtggctatcaagagtctgtg

SEQ ID NO: 175710 - DNA, 20 bp, Artificial Sequence
  chemically synthesized
actcctacacagactcttga

SEQ ID NO: 175711 - DNA, 20 bp, Artificial Sequence
  chemically synthesized
aggtagagagtggctatcaa

SEQ ID NO: 175712 - DNA, 20 bp, Artificial Sequence
  chemically synthesized
ggaggtagagagtggctatc

SEQ ID NO: 175713 - DNA, 20 bp, Artificial Sequence
  chemically synthesized
aatggtagggaggtagagag

SEQ ID NO: 175714 - DNA, 20 bp, Artificial Sequence
  chemically synthesized
ttaaatggtagggaggtaga

SEQ ID NO: 175715 - DNA, 20 bp, Artificial Sequence
  chemically synthesized
tcttaaatggtagggaggta

SEQ ID NO: 175716 - DNA, 20 bp, Artificial Sequence
  chemically synthesized
cttcttaaatggtagggagg

SEQ ID NO: 175717 - DNA, 20 bp, Artificial Sequence
  chemically synthesized
ctacttcttaaatggtaggg

SEQ ID NO: 175718 - DNA, 20 bp, Artificial Sequence
  chemically synthesized
tctacttcttaaatggtagg

SEQ ID NO: 175719 - DNA, 20 bp, Artificial Sequence
  chemically synthesized
gctctacttcttaaatggta

SEQ ID NO: 175720 - DNA, 20 bp, Artificial Sequence
  chemically synthesized
tctctacctccctaccattt

SEQ ID NO: 175721 - DNA, 20 bp, Artificial Sequence
  chemically synthesized
tgctctacttcttaaatggt

SEQ ID NO: 175722 - DNA, 20 bp, Artificial Sequence
  chemically synthesized
ttgctctacttcttaaatgg

SEQ ID NO: 175723 - DNA, 20 bp, Artificial Sequence
  chemically synthesized
ctacctccctaccatttaag

SEQ ID NO: 175724 - DNA, 20 bp, Artificial Sequence
  chemically synthesized
cccttgctctacttcttaaa

SEQ ID NO: 175725 - DNA, 20 bp, Artificial Sequence
  chemically synthesized
cctccctaccatttaagaag

SEQ ID NO: 175726 - DNA, 20 bp, Artificial Sequence
  chemically synthesized
tccctaccatttaagaagta

SEQ ID NO: 175727 - DNA, 20 bp, Artificial Sequence
  chemically synthesized
taccatttaagaagtagagc

SEQ ID NO: 175728 - DNA, 20 bp, Artificial Sequence
  chemically synthesized
accatttaagaagtagagca

SEQ ID NO: 175729 - DNA, 20 bp, Artificial Sequence
  chemically synthesized
ccatttaagaagtagagcaa

SEQ ID NO: 175730 - DNA, 20 bp, Artificial Sequence
  chemically synthesized
catttaagaagtagagcaag

SEQ ID NO: 175731 - DNA, 20 bp, Artificial Sequence
  chemically synthesized
aagaagtagagcaaggggac

SEQ ID NO: 175732 - DNA, 20 bp, Artificial Sequence
  chemically synthesized
agaagtagagcaaggggacc

SEQ ID NO: 175733 - DNA, 20 bp, Artificial Sequence
  chemically synthesized
gaagtagagcaaggggacca

SEQ ID NO: 175734 - DNA, 20 bp, Artificial Sequence
  chemically synthesized
gagcaaggggaccagggaac

SEQ ID NO: 175735 - DNA, 20 bp, Artificial Sequence
  chemically synthesized
atttcaagatgctggttccc

SEQ ID NO: 175736 - DNA, 20 bp, Artificial Sequence
  chemically synthesized
cccccctaatttcaagatgc

SEQ ID NO: 175737 - DNA, 20 bp, Artificial Sequence
  chemically synthesized
gggaaccagcatcttgaaat

SEQ ID NO: 175738 - DNA, 20 bp, Artificial Sequence
  chemically synthesized
ggaaccagcatcttgaaatt

SEQ ID NO: 175739 - DNA, 20 bp, Artificial Sequence
  chemically synthesized
gaaccagcatcttgaaatta

SEQ ID NO: 175740 - DNA, 20 bp, Artificial Sequence
  chemically synthesized
gcatttccccccctaatttc

SEQ ID NO: 175741 - DNA, 20 bp, Artificial Sequence
  chemically synthesized
aaccagcatcttgaaattag

SEQ ID NO: 175742 - DNA, 20 bp, Artificial Sequence
  chemically synthesized
accagcatcttgaaattagg

SEQ ID NO: 175743 - DNA, 20 bp, Artificial Sequence
  chemically synthesized
ccagcatcttgaaattaggg

SEQ ID NO: 175744 - DNA, 20 bp, Artificial Sequence
  chemically synthesized
cagcatcttgaaattagggg

SEQ ID NO: 175745 - DNA, 20 bp, Artificial Sequence
  chemically synthesized
tgaaattagggggggaaatg

SEQ ID NO: 175746 - DNA, 20 bp, Artificial Sequence
  chemically synthesized
gggggggaaatgcagaacct

SEQ ID NO: 175747 - DNA, 20 bp, Artificial Sequence
  chemically synthesized
ggggggaaatgcagaacctc

SEQ ID NO: 175748 - DNA, 20 bp, Artificial Sequence
  chemically synthesized
tggctcttgcataggacctg

SEQ ID NO: 175749 - DNA, 20 bp, Artificial Sequence
  chemically synthesized
atggctcttgcataggacct

SEQ ID NO: 175750 - DNA, 20 bp, Artificial Sequence
  chemically synthesized
cagaacctcaggtcctatgc

SEQ ID NO: 175751 - DNA, 20 bp, Artificial Sequence
  chemically synthesized
gaacctcaggtcctatgcaa

SEQ ID NO: 175752 - DNA, 20 bp, Artificial Sequence
  chemically synthesized
tgattcaatggctcttgcat

SEQ ID NO: 175753 - DNA, 20 bp, Artificial Sequence
  chemically synthesized
ctgattcaatggctcttgca

SEQ ID NO: 175754 - DNA, 20 bp, Artificial Sequence
  chemically synthesized
ctatgcaagagccattgaat

SEQ ID NO: 175755 - DNA, 20 bp, Artificial Sequence
  chemically synthesized
aaatcaggttactgattcaa

SEQ ID NO: 175756 - DNA, 20 bp, Artificial Sequence
  chemically synthesized
cttgagatcttgttaaaatc

SEQ ID NO: 175757 - DNA, 20 bp, Artificial Sequence
  chemically synthesized
ccttgagatcttgttaaaat

SEQ ID NO: 175758 - DNA, 20 bp, Artificial Sequence
  chemically synthesized
atcagtaacctgattttaac

SEQ ID NO: 175759 - DNA, 20 bp, Artificial Sequence
  chemically synthesized
cctgattttaacaagatctc

SEQ ID NO: 175760 - DNA, 20 bp, Artificial Sequence
  chemically synthesized
ctgattttaacaagatctca

SEQ ID NO: 175761 - DNA, 20 bp, Artificial Sequence
  chemically synthesized
actgaaacaggaatcacctt

SEQ ID NO: 175762 - DNA, 20 bp, Artificial Sequence
  chemically synthesized
tctcaaggtgattcctgttt

SEQ ID NO: 175763 - DNA, 20 bp, Artificial Sequence
  chemically synthesized
aattgatgacttactgaaac

SEQ ID NO: 175764 - DNA, 20 bp, Artificial Sequence
  chemically synthesized
aaggtgattcctgtttcagt

SEQ ID NO: 175765 - DNA, 20 bp, Artificial Sequence
  chemically synthesized
taattgatgacttactgaaa

SEQ ID NO: 175766 - DNA, 20 bp, Artificial Sequence
  chemically synthesized
tcatcaattaatgttgttga

SEQ ID NO: 175767 - DNA, 20 bp, Artificial Sequence
  chemically synthesized
ttaatgttgttgatagattc

SEQ ID NO: 175768 - DNA, 20 bp, Artificial Sequence
  chemically synthesized
taatgttgttgatagattct

SEQ ID NO: 175769 - DNA, 20 bp, Artificial Sequence
  chemically synthesized
ttgcctaagtcacagtttcc

SEQ ID NO: 175770 - DNA, 20 bp, Artificial Sequence
  chemically synthesized
gattctgggaaactgtgact

SEQ ID NO: 175771 - DNA, 20 bp, Artificial Sequence
  chemically synthesized
attctgggaaactgtgactt

SEQ ID NO: 175772 - DNA, 20 bp, Artificial Sequence
  chemically synthesized
atgtcattttgcctaagtca

SEQ ID NO: 175773 - DNA, 20 bp, Artificial Sequence
  chemically synthesized
cattatatgtcattttgcct

SEQ ID NO: 175774 - DNA, 20 bp, Artificial Sequence
  chemically synthesized
caattagcctatggtaagat

SEQ ID NO: 175775 - DNA, 20 bp, Artificial Sequence
  chemically synthesized
taatgaaaccaatcttacca

SEQ ID NO: 175776 - DNA, 20 bp, Artificial Sequence
  chemically synthesized
aatgaaaccaatcttaccat

SEQ ID NO: 175777 - DNA, 20 bp, Artificial Sequence
  chemically synthesized
tttatcaattagcctatggt

SEQ ID NO: 175778 - DNA, 20 bp, Artificial Sequence
  chemically synthesized
cttgtttatcaattagccta

SEQ ID NO: 175779 - DNA, 20 bp, Artificial Sequence
  chemically synthesized
cttaattcttgtttatcaat

SEQ ID NO: 175780 - DNA, 20 bp, Artificial Sequence
  chemically synthesized
ccataggctaattgataaac

SEQ ID NO: 175781 - DNA, 20 bp, Artificial Sequence
  chemically synthesized
ctaattgataaacaagaatt

SEQ ID NO: 175782 - DNA, 20 bp, Artificial Sequence
  chemically synthesized
tgtgaacacaggtatgcagt

SEQ ID NO: 175783 - DNA, 20 bp, Artificial Sequence
  chemically synthesized
ttgtgaacacaggtatgcag

SEQ ID NO: 175784 - DNA, 20 bp, Artificial Sequence
  chemically synthesized
gttttgtgaacacaggtatg

SEQ ID NO: 175785 - DNA, 20 bp, Artificial Sequence
  chemically synthesized
ggatcatgttttgtgaacac

SEQ ID NO: 175786 - DNA, 20 bp, Artificial Sequence
  chemically synthesized
tggatcatgttttgtgaaca

SEQ ID NO: 175787 - DNA, 20 bp, Artificial Sequence
  chemically synthesized
tggggtctttatttagatgt

SEQ ID NO: 175788 - DNA, 20 bp, Artificial Sequence
  chemically synthesized
catgatccaacatctaaata

SEQ ID NO: 175789 - DNA, 20 bp, Artificial Sequence
  chemically synthesized
aagtgcttggggtctttatt

SEQ ID NO: 175790 - DNA, 20 bp, Artificial Sequence
  chemically synthesized
aacatctaaataaagacccc

SEQ ID NO: 175791 - DNA, 20 bp, Artificial Sequence
  chemically synthesized
tttaatattagaagtgcttg

SEQ ID NO: 175792 - DNA, 20 bp, Artificial Sequence
  chemically synthesized
gtttaatattagaagtgctt

SEQ ID NO: 175793 - DNA, 20 bp, Artificial Sequence
  chemically synthesized
agtttaatattagaagtgct

SEQ ID NO: 175794 - DNA, 20 bp, Artificial Sequence
  chemically synthesized
atttctgagtttaatattag

SEQ ID NO: 175795 - DNA, 20 bp, Artificial Sequence
  chemically synthesized
tttatttctgagtttaatat

SEQ ID NO: 175796 - DNA, 20 bp, Artificial Sequence
  chemically synthesized
agcacttctaatattaaact

SEQ ID NO: 175797 - DNA, 20 bp, Artificial Sequence
  chemically synthesized
tatatctcacatttatttct

SEQ ID NO: 175798 - DNA, 20 bp, Artificial Sequence
  chemically synthesized
ttaaactcagaaataaatgt

SEQ ID NO: 175799 - DNA, 20 bp, Artificial Sequence
  chemically synthesized
tgtgagatatacatccactt

SEQ ID NO: 175800 - DNA, 20 bp, Artificial Sequence
  chemically synthesized
agatatacatccactttaga

SEQ ID NO: 175801 - DNA, 20 bp, Artificial Sequence
  chemically synthesized
ttttattaatctttctaaag

SEQ ID NO: 175802 - DNA, 20 bp, Artificial Sequence
  chemically synthesized
ggtttttattaatctttcta

SEQ ID NO: 175803 - DNA, 20 bp, Artificial Sequence
  chemically synthesized
ttagaaagattaataaaaac

SEQ ID NO: 175804 - DNA, 20 bp, Artificial Sequence
  chemically synthesized
tagaaagattaataaaaacc

SEQ ID NO: 175805 - DNA, 20 bp, Artificial Sequence
  chemically synthesized
gaaagattaataaaaaccag

SEQ ID NO: 175806 - DNA, 20 bp, Artificial Sequence
  chemically synthesized
aaagattaataaaaaccagg

SEQ ID NO: 175807 - DNA, 20 bp, Artificial Sequence
  chemically synthesized
tgggtaaataattttcctcc

SEQ ID NO: 175808 - DNA, 20 bp, Artificial Sequence
  chemically synthesized
caggaggaaaattatttacc

SEQ ID NO: 175809 - DNA, 20 bp, Artificial Sequence
  chemically synthesized
aaaattatttacccagtttt

SEQ ID NO: 175810 - DNA, 20 bp, Artificial Sequence
  chemically synthesized
tcactgattcaccaaaaact

SEQ ID NO: 175811 - DNA, 20 bp, Artificial Sequence
  chemically synthesized
ctcactgattcaccaaaaac

SEQ ID NO: 175812 - DNA, 20 bp, Artificial Sequence
  chemically synthesized
ttacccagtttttggtgaat

SEQ ID NO: 175813 - DNA, 20 bp, Artificial Sequence
  chemically synthesized
ccagtttttggtgaatcagt

SEQ ID NO: 175814 - DNA, 20 bp, Artificial Sequence
  chemically synthesized
tttggtgaatcagtgagtga

SEQ ID NO: 175815 - DNA, 20 bp, Artificial Sequence
  chemically synthesized
tcagtgagtgacagtgtttg

SEQ ID NO: 175816 - DNA, 20 bp, Artificial Sequence
  chemically synthesized
gtgagtgacagtgtttgcag

SEQ ID NO: 175817 - DNA, 20 bp, Artificial Sequence
  chemically synthesized
agtgacagtgtttgcagtgg

SEQ ID NO: 175818 - DNA, 20 bp, Artificial Sequence
  chemically synthesized
gacagtgtttgcagtggcgg

SEQ ID NO: 175819 - DNA, 20 bp, Artificial Sequence
  chemically synthesized
gcagtggcggtggttcattc

SEQ ID NO: 175820 - DNA, 20 bp, Artificial Sequence
  chemically synthesized
cagtggcggtggttcattca

SEQ ID NO: 175821 - DNA, 20 bp, Artificial Sequence
  chemically synthesized
tcaaggaataaatgtttgca

SEQ ID NO: 175822 - DNA, 20 bp, Artificial Sequence
  chemically synthesized
gtttgcaaagcataaactgc

SEQ ID NO: 175823 - DNA, 20 bp, Artificial Sequence
  chemically synthesized
tttgcaaagcataaactgcc

SEQ ID NO: 175824 - DNA, 20 bp, Artificial Sequence
  chemically synthesized
gtgagagaaggcaatcctgg

SEQ ID NO: 175825 - DNA, 20 bp, Artificial Sequence
  chemically synthesized
gtggtgagagaaggcaatcc

SEQ ID NO: 175826 - DNA, 20 bp, Artificial Sequence
  chemically synthesized
ttgaactttgtggtgagaga

SEQ ID NO: 175827 - DNA, 20 bp, Artificial Sequence
  chemically synthesized
tttgaactttgtggtgagag

SEQ ID NO: 175828 - DNA, 20 bp, Artificial Sequence
  chemically synthesized
gtttttgaactttgtggtga

SEQ ID NO: 175829 - DNA, 20 bp, Artificial Sequence
  chemically synthesized
gattgccttctctcaccaca

SEQ ID NO: 175830 - DNA, 20 bp, Artificial Sequence
  chemically synthesized
ttgtttttgaactttgtggt

SEQ ID NO: 175831 - DNA, 20 bp, Artificial Sequence
  chemically synthesized
ttgtttgtttttgaactttg

SEQ ID NO: 175832 - DNA, 20 bp, Artificial Sequence
  chemically synthesized
aaaacaaacaataatcaata

SEQ ID NO: 175833 - DNA, 20 bp, Artificial Sequence
  chemically synthesized
acaaacaataatcaatatgg

SEQ ID NO: 175834 - DNA, 20 bp, Artificial Sequence
  chemically synthesized
aatcaatatggcagctcact

SEQ ID NO: 175835 - DNA, 20 bp, Artificial Sequence
  chemically synthesized
gctctacagaagtgctcagt

SEQ ID NO: 175836 - DNA, 20 bp, Artificial Sequence
  chemically synthesized
tgatgctctacagaagtgct

SEQ ID NO: 175837 - DNA, 20 bp, Artificial Sequence
  chemically synthesized
cagctcactgagcacttctg

SEQ ID NO: 175838 - DNA, 20 bp, Artificial Sequence
  chemically synthesized
gctcactgagcacttctgta

SEQ ID NO: 175839 - DNA, 20 bp, Artificial Sequence
  chemically synthesized
caataattgatgctctacag

SEQ ID NO: 175840 - DNA, 20 bp, Artificial Sequence
  chemically synthesized
tgacaataattgatgctcta

SEQ ID NO: 175841 - DNA, 20 bp, Artificial Sequence
  chemically synthesized
tatagtattcaataatcata

SEQ ID NO: 175842 - DNA, 20 bp, Artificial Sequence
  chemically synthesized
ctgtgaaataaaaattcata

SEQ ID NO: 175843 - DNA, 20 bp, Artificial Sequence
  chemically synthesized
ctatatgaatttttatttca

SEQ ID NO: 175844 - DNA, 20 bp, Artificial Sequence
  chemically synthesized
cacagtaatttatattaatt

SEQ ID NO: 175845 - DNA, 20 bp, Artificial Sequence
  chemically synthesized
aattcagtcattcattttcc

SEQ ID NO: 175846 - DNA, 20 bp, Artificial Sequence
  chemically synthesized
ctgaactggaatacgtggct

SEQ ID NO: 175847 - DNA, 20 bp, Artificial Sequence
  chemically synthesized
attttccaagccacgtattc

SEQ ID NO: 175848 - DNA, 20 bp, Artificial Sequence
  chemically synthesized
agtccctgaactggaatacg

SEQ ID NO: 175849 - DNA, 20 bp, Artificial Sequence
  chemically synthesized
ccaagccacgtattccagtt

SEQ ID NO: 175850 - DNA, 20 bp, Artificial Sequence
  chemically synthesized
caagccacgtattccagttc

SEQ ID NO: 175851 - DNA, 20 bp, Artificial Sequence
  chemically synthesized
aagccacgtattccagttca

SEQ ID NO: 175852 - DNA, 20 bp, Artificial Sequence
  chemically synthesized
ggcctcccaagtccctgaac

SEQ ID NO: 175853 - DNA, 20 bp, Artificial Sequence
  chemically synthesized
cgtattccagttcagggact

SEQ ID NO: 175854 - DNA, 20 bp, Artificial Sequence
  chemically synthesized
gtattccagttcagggactt

SEQ ID NO: 175855 - DNA, 20 bp, Artificial Sequence
  chemically synthesized
attccagttcagggacttgg

SEQ ID NO: 175856 - DNA, 20 bp, Artificial Sequence
  chemically synthesized
ttccagttcagggacttggg

SEQ ID NO: 175857 - DNA, 20 bp, Artificial Sequence
  chemically synthesized
agttcagggacttgggaggc

SEQ ID NO: 175858 - DNA, 20 bp, Artificial Sequence
  chemically synthesized
aggatgggctctggcctccc

SEQ ID NO: 175859 - DNA, 20 bp, Artificial Sequence
  chemically synthesized
ttcagggacttgggaggcca

SEQ ID NO: 175860 - DNA, 20 bp, Artificial Sequence
  chemically synthesized
tgagttgccaggatgggctc

SEQ ID NO: 175861 - DNA, 20 bp, Artificial Sequence
  chemically synthesized
tgggaggccagagcccatcc

SEQ ID NO: 175862 - DNA, 20 bp, Artificial Sequence
  chemically synthesized
gtgctctgagttgccaggat

SEQ ID NO: 175863 - DNA, 20 bp, Artificial Sequence
  chemically synthesized
ggtgctctgagttgccagga

SEQ ID NO: 175864 - DNA, 20 bp, Artificial Sequence
  chemically synthesized
cagagcccatcctggcaact

SEQ ID NO: 175865 - DNA, 20 bp, Artificial Sequence
  chemically synthesized
gtctggtgctctgagttgcc

SEQ ID NO: 175866 - DNA, 20 bp, Artificial Sequence
  chemically synthesized
tgtctggtgctctgagttgc

SEQ ID NO: 175867 - DNA, 20 bp, Artificial Sequence
  chemically synthesized
gagcccatcctggcaactca

SEQ ID NO: 175868 - DNA, 20 bp, Artificial Sequence
  chemically synthesized
atcctggcaactcagagcac

SEQ ID NO: 175869 - DNA, 20 bp, Artificial Sequence
  chemically synthesized
tggctcctgtctggtgctct

SEQ ID NO: 175870 - DNA, 20 bp, Artificial Sequence
  chemically synthesized
tggcaactcagagcaccaga

SEQ ID NO: 175871 - DNA, 20 bp, Artificial Sequence
  chemically synthesized
ggcaactcagagcaccagac

SEQ ID NO: 175872 - DNA, 20 bp, Artificial Sequence
  chemically synthesized
caactcagagcaccagacag

SEQ ID NO: 175873 - DNA, 20 bp, Artificial Sequence
  chemically synthesized
tgccagtgttggctcctgtc

SEQ ID NO: 175874 - DNA, 20 bp, Artificial Sequence
  chemically synthesized
caccagacaggagccaacac

SEQ ID NO: 175875 - DNA, 20 bp, Artificial Sequence
  chemically synthesized
cagacaggagccaacactgg

SEQ ID NO: 175876 - DNA, 20 bp, Artificial Sequence
  chemically synthesized
aatggcatccctgccagtgt

SEQ ID NO: 175877 - DNA, 20 bp, Artificial Sequence
  chemically synthesized
agacaggagccaacactggc

SEQ ID NO: 175878 - DNA, 20 bp, Artificial Sequence
  chemically synthesized
gacaggagccaacactggca

SEQ ID NO: 175879 - DNA, 20 bp, Artificial Sequence
  chemically synthesized
cgatagaatggcatccctgc

SEQ ID NO: 175880 - DNA, 20 bp, Artificial Sequence
  chemically synthesized
gactgtgccctgcgatagaa

SEQ ID NO: 175881 - DNA, 20 bp, Artificial Sequence
  chemically synthesized
gcagggatgccattctatcg

SEQ ID NO: 175882 - DNA, 20 bp, Artificial Sequence
  chemically synthesized
cagggatgccattctatcgc

SEQ ID NO: 175883 - DNA, 20 bp, Artificial Sequence
  chemically synthesized
agggatgccattctatcgca

SEQ ID NO: 175884 - DNA, 20 bp, Artificial Sequence
  chemically synthesized
tctacgactgtgccctgcga

SEQ ID NO: 175885 - DNA, 20 bp, Artificial Sequence
  chemically synthesized
tgccattctatcgcagggca

SEQ ID NO: 175886 - DNA, 20 bp, Artificial Sequence
  chemically synthesized
tctatcgcagggcacagtcg

SEQ ID NO: 175887 - DNA, 20 bp, Artificial Sequence
  chemically synthesized
tagacacataaacactcaca

SEQ ID NO: 175888 - DNA, 20 bp, Artificial Sequence
  chemically synthesized
agacacataaacactcacat

SEQ ID NO: 175889 - DNA, 20 bp, Artificial Sequence
  chemically synthesized
gacacataaacactcacatg

SEQ ID NO: 175890 - DNA, 20 bp, Artificial Sequence
  chemically synthesized
tgtctacattgtccccatgt

SEQ ID NO: 175891 - DNA, 20 bp, Artificial Sequence
  chemically synthesized
acactcacatggggacaatg

SEQ ID NO: 175892 - DNA, 20 bp, Artificial Sequence
  chemically synthesized
actgtgcacgttaggggaat

SEQ ID NO: 175893 - DNA, 20 bp, Artificial Sequence
  chemically synthesized
tcccaaactgtgcacgttag

SEQ ID NO: 175894 - DNA, 20 bp, Artificial Sequence
  chemically synthesized
gtcccaaactgtgcacgtta

SEQ ID NO: 175895 - DNA, 20 bp, Artificial Sequence
  chemically synthesized
tgtcccaaactgtgcacgtt

SEQ ID NO: 175896 - DNA, 20 bp, Artificial Sequence
  chemically synthesized
accaattcccctaacgtgca

SEQ ID NO: 175897 - DNA, 20 bp, Artificial Sequence
  chemically synthesized
atgtcccaaactgtgcacgt

SEQ ID NO: 175898 - DNA, 20 bp, Artificial Sequence
  chemically synthesized
ttcccctaacgtgcacagtt

SEQ ID NO: 175899 - DNA, 20 bp, Artificial Sequence
  chemically synthesized
tcccctaacgtgcacagttt

SEQ ID NO: 175900 - DNA, 20 bp, Artificial Sequence
  chemically synthesized
gtgcacagtttgggacatgt

SEQ ID NO: 175901 - DNA, 20 bp, Artificial Sequence
  chemically synthesized
tgcacagtttgggacatgtg

SEQ ID NO: 175902 - DNA, 20 bp, Artificial Sequence
  chemically synthesized
tttgggacatgtgaggaaac

SEQ ID NO: 175903 - DNA, 20 bp, Artificial Sequence
  chemically synthesized
tgggacatgtgaggaaacca

SEQ ID NO: 175904 - DNA, 20 bp, Artificial Sequence
  chemically synthesized
atgtgaggaaaccagagtac

SEQ ID NO: 175905 - DNA, 20 bp, Artificial Sequence
  chemically synthesized
tgggttttcttctagtactc

SEQ ID NO: 175906 - DNA, 20 bp, Artificial Sequence
  chemically synthesized
tgaggaaaccagagtactag

SEQ ID NO: 175907 - DNA, 20 bp, Artificial Sequence
  chemically synthesized
tgtctctgtgggttttcttc

SEQ ID NO: 175908 - DNA, 20 bp, Artificial Sequence
  chemically synthesized
gagtactagaagaaaaccca

SEQ ID NO: 175909 - DNA, 20 bp, Artificial Sequence
  chemically synthesized
gtactagaagaaaacccaca

SEQ ID NO: 175910 - DNA, 20 bp, Artificial Sequence
  chemically synthesized
gggttttcttttgtctctgt

SEQ ID NO: 175911 - DNA, 20 bp, Artificial Sequence
  chemically synthesized
ggggttttcttttgtctctg

SEQ ID NO: 175912 - DNA, 20 bp, Artificial Sequence
  chemically synthesized
aagaaaacccacagagacaa

SEQ ID NO: 175913 - DNA, 20 bp, Artificial Sequence
  chemically synthesized
agacaaaagaaaaccccaca

SEQ ID NO: 175914 - DNA, 20 bp, Artificial Sequence
  chemically synthesized
aggggggcactgtctatgtg

SEQ ID NO: 175915 - DNA, 20 bp, Artificial Sequence
  chemically synthesized
aaaagaaaaccccacataga

SEQ ID NO: 175916 - DNA, 20 bp, Artificial Sequence
  chemically synthesized
taggggggcactgtctatgt

SEQ ID NO: 175917 - DNA, 20 bp, Artificial Sequence
  chemically synthesized
ctaggggggcactgtctatg

SEQ ID NO: 175918 - DNA, 20 bp, Artificial Sequence
  chemically synthesized
ccacatagacagtgcccccc

SEQ ID NO: 175919 - DNA, 20 bp, Artificial Sequence
  chemically synthesized
aaactgtatctcagctaggg

SEQ ID NO: 175920 - DNA, 20 bp, Artificial Sequence
  chemically synthesized
tagacagtgcccccctagct

SEQ ID NO: 175921 - DNA, 20 bp, Artificial Sequence
  chemically synthesized
aaaactgtatctcagctagg

SEQ ID NO: 175922 - DNA, 20 bp, Artificial Sequence
  chemically synthesized
aaaaactgtatctcagctag

SEQ ID NO: 175923 - DNA, 20 bp, Artificial Sequence
  chemically synthesized
aaaaaactgtatctcagcta

SEQ ID NO: 175924 - DNA, 20 bp, Artificial Sequence
  chemically synthesized
gaaaaaactgtatctcagct

SEQ ID NO: 175925 - DNA, 20 bp, Artificial Sequence
  chemically synthesized
ggaaaaaactgtatctcagc

SEQ ID NO: 175926 - DNA, 20 bp, Artificial Sequence
  chemically synthesized
gtgcccccctagctgagata

SEQ ID NO: 175927 - DNA, 20 bp, Artificial Sequence
  chemically synthesized
caagggaaaaaactgtatct

SEQ ID NO: 175928 - DNA, 20 bp, Artificial Sequence
  chemically synthesized
ctgtgttataatattggcaa

SEQ ID NO: 175929 - DNA, 20 bp, Artificial Sequence
  chemically synthesized
actgtgttataatattggca

SEQ ID NO: 175930 - DNA, 20 bp, Artificial Sequence
  chemically synthesized
cactgtgttataatattggc

SEQ ID NO: 175931 - DNA, 20 bp, Artificial Sequence
  chemically synthesized
gcatcactgtgttataatat

SEQ ID NO: 175932 - DNA, 20 bp, Artificial Sequence
  chemically synthesized
cccttgccaatattataaca

SEQ ID NO: 175933 - DNA, 20 bp, Artificial Sequence
  chemically synthesized
ttgaataatgttgtttcatt

SEQ ID NO: 175934 - DNA, 20 bp, Artificial Sequence
  chemically synthesized
tcaatgaaacaacattattc

SEQ ID NO: 175935 - DNA, 20 bp, Artificial Sequence
  chemically synthesized
caatgaaacaacattattca

SEQ ID NO: 175936 - DNA, 20 bp, Artificial Sequence
  chemically synthesized
ctcaaactttaatgtacggc

SEQ ID NO: 175937 - DNA, 20 bp, Artificial Sequence
  chemically synthesized
tctcaaactttaatgtacgg

SEQ ID NO: 175938 - DNA, 20 bp, Artificial Sequence
  chemically synthesized
caaggacctgccgtacatta

SEQ ID NO: 175939 - DNA, 20 bp, Artificial Sequence
  chemically synthesized
acttctcaaactttaatgta

SEQ ID NO: 175940 - DNA, 20 bp, Artificial Sequence
  chemically synthesized
cctgccgtacattaaagttt

SEQ ID NO: 175941 - DNA, 20 bp, Artificial Sequence
  chemically synthesized
gccgtacattaaagtttgag

SEQ ID NO: 175942 - DNA, 20 bp, Artificial Sequence
  chemically synthesized
ccacgtgccatcacgtagag

SEQ ID NO: 175943 - DNA, 20 bp, Artificial Sequence
  chemically synthesized
agaagttctgctctacgtga

SEQ ID NO: 175944 - DNA, 20 bp, Artificial Sequence
  chemically synthesized
gatccacgtgccatcacgta

SEQ ID NO: 175945 - DNA, 20 bp, Artificial Sequence
  chemically synthesized
aagatccacgtgccatcacg

SEQ ID NO: 175946 - DNA, 20 bp, Artificial Sequence
  chemically synthesized
ctgctctacgtgatggcacg

SEQ ID NO: 175947 - DNA, 20 bp, Artificial Sequence
  chemically synthesized
aatagcagtggtaaggggta

SEQ ID NO: 175948 - DNA, 20 bp, Artificial Sequence
  chemically synthesized
attctaatagcagtggtaag

SEQ ID NO: 175949 - DNA, 20 bp, Artificial Sequence
  chemically synthesized
aattctaatagcagtggtaa

SEQ ID NO: 175950 - DNA, 20 bp, Artificial Sequence
  chemically synthesized
aaattctaatagcagtggta

SEQ ID NO: 175951 - DNA, 20 bp, Artificial Sequence
  chemically synthesized
aaaattctaatagcagtggt

SEQ ID NO: 175952 - DNA, 20 bp, Artificial Sequence
  chemically synthesized
ttaccccttaccactgctat

SEQ ID NO: 175953 - DNA, 20 bp, Artificial Sequence
  chemically synthesized
ccataaaattctaatagcag

SEQ ID NO: 175954 - DNA, 20 bp, Artificial Sequence
  chemically synthesized
ttaccataaaattctaatag

SEQ ID NO: 175955 - DNA, 20 bp, Artificial Sequence
  chemically synthesized
aggttaccataaaattctaa

SEQ ID NO: 175956 - DNA, 20 bp, Artificial Sequence
  chemically synthesized
ccactgctattagaatttta

SEQ ID NO: 175957 - DNA, 20 bp, Artificial Sequence
  chemically synthesized
tgtggttactattacaaagt

SEQ ID NO: 175958 - DNA, 20 bp, Artificial Sequence
  chemically synthesized
ttgtggttactattacaaag

SEQ ID NO: 175959 - DNA, 20 bp, Artificial Sequence
  chemically synthesized
tatggtaacctactttgtaa

SEQ ID NO: 175960 - DNA, 20 bp, Artificial Sequence
  chemically synthesized
aaattgtggttactattaca

SEQ ID NO: 175961 - DNA, 20 bp, Artificial Sequence
  chemically synthesized
tattacgaggagttaaattg

SEQ ID NO: 175962 - DNA, 20 bp, Artificial Sequence
  chemically synthesized
ctatcatactttattacgag

SEQ ID NO: 175963 - DNA, 20 bp, Artificial Sequence
  chemically synthesized
caatttaactcctcgtaata

SEQ ID NO: 175964 - DNA, 20 bp, Artificial Sequence
  chemically synthesized
tactatcatactttattacg

SEQ ID NO: 175965 - DNA, 20 bp, Artificial Sequence
  chemically synthesized
atactatcatactttattac

SEQ ID NO: 175966 - DNA, 20 bp, Artificial Sequence
  chemically synthesized
ctcctcgtaataaagtatga

SEQ ID NO: 175967 - DNA, 20 bp, Artificial Sequence
  chemically synthesized
gatagtatatattgtgtttt

SEQ ID NO: 175968 - DNA, 20 bp, Artificial Sequence
  chemically synthesized
ttgtgtttttagttcctcac

SEQ ID NO: 175969 - DNA, 20 bp, Artificial Sequence
  chemically synthesized
ccatctcccagcgtctagtg

SEQ ID NO: 175970 - DNA, 20 bp, Artificial Sequence
  chemically synthesized
cccatctcccagcgtctagt

SEQ ID NO: 175971 - DNA, 20 bp, Artificial Sequence
  chemically synthesized
tttagttcctcactagacgc

SEQ ID NO: 175972 - DNA, 20 bp, Artificial Sequence
  chemically synthesized
ttagttcctcactagacgct

SEQ ID NO: 175973 - DNA, 20 bp, Artificial Sequence
  chemically synthesized
tttgcccatctcccagcgtc

SEQ ID NO: 175974 - DNA, 20 bp, Artificial Sequence
  chemically synthesized
agttcctcactagacgctgg

SEQ ID NO: 175975 - DNA, 20 bp, Artificial Sequence
  chemically synthesized
cctcactagacgctgggaga

SEQ ID NO: 175976 - DNA, 20 bp, Artificial Sequence
  chemically synthesized
ctcactagacgctgggagat

SEQ ID NO: 175977 - DNA, 20 bp, Artificial Sequence
  chemically synthesized
aagcatgtttgcccatctcc

SEQ ID NO: 175978 - DNA, 20 bp, Artificial Sequence
  chemically synthesized
tccaacagtgatgcattatg

SEQ ID NO: 175979 - DNA, 20 bp, Artificial Sequence
  chemically synthesized
gcttcataatgcatcactgt

SEQ ID NO: 175980 - DNA, 20 bp, Artificial Sequence
  chemically synthesized
ctagttcctcatttgtccaa

SEQ ID NO: 175981 - DNA, 20 bp, Artificial Sequence
  chemically synthesized
tgcatcactgttggacaaat

SEQ ID NO: 175982 - DNA, 20 bp, Artificial Sequence
  chemically synthesized
gcatcactgttggacaaatg

SEQ ID NO: 175983 - DNA, 20 bp, Artificial Sequence
  chemically synthesized
ctgttggacaaatgaggaac

SEQ ID NO: 175984 - DNA, 20 bp, Artificial Sequence
  chemically synthesized
gttggacaaatgaggaacta

SEQ ID NO: 175985 - DNA, 20 bp, Artificial Sequence
  chemically synthesized
ttggacaaatgaggaactag

SEQ ID NO: 175986 - DNA, 20 bp, Artificial Sequence
  chemically synthesized
tttaaatctcttagtgcctc

SEQ ID NO: 175987 - DNA, 20 bp, Artificial Sequence
  chemically synthesized
aatgaggaactagaggcact

SEQ ID NO: 175988 - DNA, 20 bp, Artificial Sequence
  chemically synthesized
tgaggaactagaggcactaa

SEQ ID NO: 175989 - DNA, 20 bp, Artificial Sequence
  chemically synthesized
ggccacttatttaaatctct

SEQ ID NO: 175990 - DNA, 20 bp, Artificial Sequence
  chemically synthesized
aggcactaagagatttaaat

SEQ ID NO: 175991 - DNA, 20 bp, Artificial Sequence
  chemically synthesized
cactaagagatttaaataag

SEQ ID NO: 175992 - DNA, 20 bp, Artificial Sequence
  chemically synthesized
agatttaaataagtggccca

SEQ ID NO: 175993 - DNA, 20 bp, Artificial Sequence
  chemically synthesized
actcactaactcataactgt

SEQ ID NO: 175994 - DNA, 20 bp, Artificial Sequence
  chemically synthesized
aataagtggcccacagttat

SEQ ID NO: 175995 - DNA, 20 bp, Artificial Sequence
  chemically synthesized
cactcactaactcataactg

SEQ ID NO: 175996 - DNA, 20 bp, Artificial Sequence
  chemically synthesized
agtggcccacagttatgagt

SEQ ID NO: 175997 - DNA, 20 bp, Artificial Sequence
  chemically synthesized
gcccacagttatgagttagt

SEQ ID NO: 175998 - DNA, 20 bp, Artificial Sequence
  chemically synthesized
gagttagtgagtgttgaacc

SEQ ID NO: 175999 - DNA, 20 bp, Artificial Sequence
  chemically synthesized
agttagtgagtgttgaacct

SEQ ID NO: 176000 - DNA, 20 bp, Artificial Sequence
  chemically synthesized
gtgagtgttgaacctgggtc

SEQ ID NO: 176001 - DNA, 20 bp, Artificial Sequence
  chemically synthesized
tcataactcagtctagaccc

SEQ ID NO: 176002 - DNA, 20 bp, Artificial Sequence
  chemically synthesized
ttcataactcagtctagacc

SEQ ID NO: 176003 - DNA, 20 bp, Artificial Sequence
  chemically synthesized
gttgaacctgggtctagact

SEQ ID NO: 176004 - DNA, 20 bp, Artificial Sequence
  chemically synthesized
ttgcagttcataactcagtc

SEQ ID NO: 176005 - DNA, 20 bp, Artificial Sequence
  chemically synthesized
taaacttgcagttcataact

SEQ ID NO: 176006 - DNA, 20 bp, Artificial Sequence
  chemically synthesized
tagactgagttatgaactgc

SEQ ID NO: 176007 - DNA, 20 bp, Artificial Sequence
  chemically synthesized
tgagttatgaactgcaagtt

SEQ ID NO: 176008 - DNA, 20 bp, Artificial Sequence
  chemically synthesized
tggaaagatcactaaacttg

SEQ ID NO: 176009 - DNA, 20 bp, Artificial Sequence
  chemically synthesized
tgcaagtttagtgatctttc

SEQ ID NO: 176010 - DNA, 20 bp, Artificial Sequence
  chemically synthesized
gcaagtttagtgatctttcc

SEQ ID NO: 176011 - DNA, 20 bp, Artificial Sequence
  chemically synthesized
tgcctcatctcagtcctgga

SEQ ID NO: 176012 - DNA, 20 bp, Artificial Sequence
  chemically synthesized
ttagtgatctttccaggact

SEQ ID NO: 176013 - DNA, 20 bp, Artificial Sequence
  chemically synthesized
tccatgcctcatctcagtcc

SEQ ID NO: 176014 - DNA, 20 bp, Artificial Sequence
  chemically synthesized
gatctttccaggactgagat

SEQ ID NO: 176015 - DNA, 20 bp, Artificial Sequence
  chemically synthesized
atctttccaggactgagatg

SEQ ID NO: 176016 - DNA, 20 bp, Artificial Sequence
  chemically synthesized
ttattctccatgcctcatct

SEQ ID NO: 176017 - DNA, 20 bp, Artificial Sequence
  chemically synthesized
tccaggactgagatgaggca

SEQ ID NO: 176018 - DNA, 20 bp, Artificial Sequence
  chemically synthesized
caggactgagatgaggcatg

SEQ ID NO: 176019 - DNA, 20 bp, Artificial Sequence
  chemically synthesized
tgagatgaggcatggagaat

SEQ ID NO: 176020 - DNA, 20 bp, Artificial Sequence
  chemically synthesized
gatgaggcatggagaataag

SEQ ID NO: 176021 - DNA, 20 bp, Artificial Sequence
  chemically synthesized
atgaggcatggagaataaga

SEQ ID NO: 176022 - DNA, 20 bp, Artificial Sequence
  chemically synthesized
aggcatggagaataagaagg

SEQ ID NO: 176023 - DNA, 20 bp, Artificial Sequence
  chemically synthesized
tggagaataagaaggtggaa

SEQ ID NO: 176024 - DNA, 20 bp, Artificial Sequence
  chemically synthesized
agaataagaaggtggaacgg

SEQ ID NO: 176025 - DNA, 20 bp, Artificial Sequence
  chemically synthesized
attctaatggtttgtgtaat

SEQ ID NO: 176026 - DNA, 20 bp, Artificial Sequence
  chemically synthesized
gcactcattacacaaaccat

SEQ ID NO: 176027 - DNA, 20 bp, Artificial Sequence
  chemically synthesized
cgtggcctcaaatattctaa

SEQ ID NO: 176028 - DNA, 20 bp, Artificial Sequence
  chemically synthesized
cacaaaccattagaatattt

SEQ ID NO: 176029 - DNA, 20 bp, Artificial Sequence
  chemically synthesized
acaaaccattagaatatttg

SEQ ID NO: 176030 - DNA, 20 bp, Artificial Sequence
  chemically synthesized
tagaatatttgaggccacgt

SEQ ID NO: 176031 - DNA, 20 bp, Artificial Sequence
  chemically synthesized
agaatatttgaggccacgtt

SEQ ID NO: 176032 - DNA, 20 bp, Artificial Sequence
  chemically synthesized
cgtgtggttaattcccaacg

SEQ ID NO: 176033 - DNA, 20 bp, Artificial Sequence
  chemically synthesized
ccagcttctcagttcgcgtg

SEQ ID NO: 176034 - DNA, 20 bp, Artificial Sequence
  chemically synthesized
gaattaaccacacgcgaact

SEQ ID NO: 176035 - DNA, 20 bp, Artificial Sequence
  chemically synthesized
ttaaccacacgcgaactgag

SEQ ID NO: 176036 - DNA, 20 bp, Artificial Sequence
  chemically synthesized
ccacacgcgaactgagaagc

SEQ ID NO: 176037 - DNA, 20 bp, Artificial Sequence
  chemically synthesized
gatacccctttccagcttct

SEQ ID NO: 176038 - DNA, 20 bp, Artificial Sequence
  chemically synthesized
acgcgaactgagaagctgga

SEQ ID NO: 176039 - DNA, 20 bp, Artificial Sequence
  chemically synthesized
cgcgaactgagaagctggaa

SEQ ID NO: 176040 - DNA, 20 bp, Artificial Sequence
  chemically synthesized
gcgaactgagaagctggaaa

SEQ ID NO: 176041 - DNA, 20 bp, Artificial Sequence
  chemically synthesized
cgaactgagaagctggaaag

SEQ ID NO: 176042 - DNA, 20 bp, Artificial Sequence
  chemically synthesized
ttcttaaagatacccctttc

SEQ ID NO: 176043 - DNA, 20 bp, Artificial Sequence
  chemically synthesized
agctggaaaggggtatcttt

SEQ ID NO: 176044 - DNA, 20 bp, Artificial Sequence
  chemically synthesized
gtgaaggattagttttctta

SEQ ID NO: 176045 - DNA, 20 bp, Artificial Sequence
  chemically synthesized
ttctacttcgggtgaaggat

SEQ ID NO: 176046 - DNA, 20 bp, Artificial Sequence
  chemically synthesized
gaaaactaatccttcacccg

SEQ ID NO: 176047 - DNA, 20 bp, Artificial Sequence
  chemically synthesized
atcatttctacttcgggtga

SEQ ID NO: 176048 - DNA, 20 bp, Artificial Sequence
  chemically synthesized
aatcatttctacttcgggtg

SEQ ID NO: 176049 - DNA, 20 bp, Artificial Sequence
  chemically synthesized
aactaatccttcacccgaag

SEQ ID NO: 176050 - DNA, 20 bp, Artificial Sequence
  chemically synthesized
taaataatcatttctacttc

SEQ ID NO: 176051 - DNA, 20 bp, Artificial Sequence
  chemically synthesized
ttaaataatcatttctactt

SEQ ID NO: 176052 - DNA, 20 bp, Artificial Sequence
  chemically synthesized
tatttaatcatactgcattc

SEQ ID NO: 176053 - DNA, 20 bp, Artificial Sequence
  chemically synthesized
tttatgctgaaactagaatg

SEQ ID NO: 176054 - DNA, 20 bp, Artificial Sequence
  chemically synthesized
atcatactgcattctagttt

SEQ ID NO: 176055 - DNA, 20 bp, Artificial Sequence
  chemically synthesized
tcaagtctttatgctgaaac

SEQ ID NO: 176056 - DNA, 20 bp, Artificial Sequence
  chemically synthesized
tgcattctagtttcagcata

SEQ ID NO: 176057 - DNA, 20 bp, Artificial Sequence
  chemically synthesized
atgttgacattaacatgttc

SEQ ID NO: 176058 - DNA, 20 bp, Artificial Sequence
  chemically synthesized
aaaaaaaaagattaaaaaaa

SEQ ID NO: 176059 - DNA, 20 bp, Artificial Sequence
  chemically synthesized
ctcaaacaaacaaaaaaaaa

SEQ ID NO: 176060 - DNA, 20 bp, Artificial Sequence
  chemically synthesized
ctttttttttttgtttgttt

SEQ ID NO: 176061 - DNA, 20 bp, Artificial Sequence
  chemically synthesized
ttttttttgtttgtttgaga

SEQ ID NO: 176062 - DNA, 20 bp, Artificial Sequence
  chemically synthesized
ttttttgtttgtttgagaca

SEQ ID NO: 176063 - DNA, 20 bp, Artificial Sequence
  chemically synthesized
gtttgagacagagtctcact

SEQ ID NO: 176064 - DNA, 20 bp, Artificial Sequence
  chemically synthesized
tccagcctgggcaaccgagt

SEQ ID NO: 176065 - DNA, 20 bp, Artificial Sequence
  chemically synthesized
cagagtctcactcggttgcc

SEQ ID NO: 176066 - DNA, 20 bp, Artificial Sequence
  chemically synthesized
gcattccagcctgggcaacc

SEQ ID NO: 176067 - DNA, 20 bp, Artificial Sequence
  chemically synthesized
agagtctcactcggttgccc

SEQ ID NO: 176068 - DNA, 20 bp, Artificial Sequence
  chemically synthesized
tctcactcggttgcccaggc

SEQ ID NO: 176069 - DNA, 20 bp, Artificial Sequence
  chemically synthesized
acgccactgcattccagcct

SEQ ID NO: 176070 - DNA, 20 bp, Artificial Sequence
  chemically synthesized
cacgccactgcattccagcc

SEQ ID NO: 176071 - DNA, 20 bp, Artificial Sequence
  chemically synthesized
cggttgcccaggctggaatg

SEQ ID NO: 176072 - DNA, 20 bp, Artificial Sequence
  chemically synthesized
gagatcacgccactgcattc

SEQ ID NO: 176073 - DNA, 20 bp, Artificial Sequence
  chemically synthesized
ttgcccaggctggaatgcag

SEQ ID NO: 176074 - DNA, 20 bp, Artificial Sequence
  chemically synthesized
ggcggaggttgcagtgaaag

SEQ ID NO: 176075 - DNA, 20 bp, Artificial Sequence
  chemically synthesized
gaggcggaggttgcagtgaa

SEQ ID NO: 176076 - DNA, 20 bp, Artificial Sequence
  chemically synthesized
ggaggcggaggttgcagtga

SEQ ID NO: 176077 - DNA, 20 bp, Artificial Sequence
  chemically synthesized
aacccaggaggcggaggttg

SEQ ID NO: 176078 - DNA, 20 bp, Artificial Sequence
  chemically synthesized
catttgaacccaggaggcgg

SEQ ID NO: 176079 - DNA, 20 bp, Artificial Sequence
  chemically synthesized
tcactgcaacctccgcctcc

SEQ ID NO: 176080 - DNA, 20 bp, Artificial Sequence
  chemically synthesized
tcatttgaacccaggaggcg

SEQ ID NO: 176081 - DNA, 20 bp, Artificial Sequence
  chemically synthesized
cactgcaacctccgcctcct

SEQ ID NO: 176082 - DNA, 20 bp, Artificial Sequence
  chemically synthesized
aatcatttgaacccaggagg

SEQ ID NO: 176083 - DNA, 20 bp, Artificial Sequence
  chemically synthesized
gagaatcatttgaacccagg

SEQ ID NO: 176084 - DNA, 20 bp, Artificial Sequence
  chemically synthesized
ggagaatcatttgaacccag

SEQ ID NO: 176085 - DNA, 20 bp, Artificial Sequence
  chemically synthesized
caggagaatcatttgaaccc

SEQ ID NO: 176086 - DNA, 20 bp, Artificial Sequence
  chemically synthesized
gcaggagaatcatttgaacc

SEQ ID NO: 176087 - DNA, 20 bp, Artificial Sequence
  chemically synthesized
ttcaaatgattctcctgcct

SEQ ID NO: 176088 - DNA, 20 bp, Artificial Sequence
  chemically synthesized
tacttgggaggctgaggcag

SEQ ID NO: 176089 - DNA, 20 bp, Artificial Sequence
  chemically synthesized
gctacttgggaggctgaggc

SEQ ID NO: 176090 - DNA, 20 bp, Artificial Sequence
  chemically synthesized
agctacttgggaggctgagg

SEQ ID NO: 176091 - DNA, 20 bp, Artificial Sequence
  chemically synthesized
cacagctacttgggaggctg

SEQ ID NO: 176092 - DNA, 20 bp, Artificial Sequence
  chemically synthesized
tcacagctacttgggaggct

SEQ ID NO: 176093 - DNA, 20 bp, Artificial Sequence
  chemically synthesized
ttctcctgcctcagcctccc

SEQ ID NO: 176094 - DNA, 20 bp, Artificial Sequence
  chemically synthesized
tcctgcctcagcctcccaag

SEQ ID NO: 176095 - DNA, 20 bp, Artificial Sequence
  chemically synthesized
ttgaatcacagctacttggg

SEQ ID NO: 176096 - DNA, 20 bp, Artificial Sequence
  chemically synthesized
cttgaatcacagctacttgg

SEQ ID NO: 176097 - DNA, 20 bp, Artificial Sequence
  chemically synthesized
gacttgaatcacagctactt

SEQ ID NO: 176098 - DNA, 20 bp, Artificial Sequence
  chemically synthesized
tgacttgaatcacagctact

SEQ ID NO: 176099 - DNA, 20 bp, Artificial Sequence
  chemically synthesized
ctcccaagtagctgtgattc

SEQ ID NO: 176100 - DNA, 20 bp, Artificial Sequence
  chemically synthesized
gtggcacatgacttgaatca

SEQ ID NO: 176101 - DNA, 20 bp, Artificial Sequence
  chemically synthesized
aagtcatgtgccaccacgcc

SEQ ID NO: 176102 - DNA, 20 bp, Artificial Sequence
  chemically synthesized
caaaaattagctgggcgtgg

SEQ ID NO: 176103 - DNA, 20 bp, Artificial Sequence
  chemically synthesized
atacaaaaattagctgggcg

SEQ ID NO: 176104 - DNA, 20 bp, Artificial Sequence
  chemically synthesized
taaaaatacaaaaattagct

SEQ ID NO: 176105 - DNA, 20 bp, Artificial Sequence
  chemically synthesized
ctaaaaatacaaaaattagc

SEQ ID NO: 176106 - DNA, 20 bp, Artificial Sequence
  chemically synthesized
tctactaaaaatacaaaaat

SEQ ID NO: 176107 - DNA, 20 bp, Artificial Sequence
  chemically synthesized
ccagctaatttttgtatttt

SEQ ID NO: 176108 - DNA, 20 bp, Artificial Sequence
  chemically synthesized
gctaatttttgtatttttag

SEQ ID NO: 176109 - DNA, 20 bp, Artificial Sequence
  chemically synthesized
taatttttgtatttttagta

SEQ ID NO: 176110 - DNA, 20 bp, Artificial Sequence
  chemically synthesized
ttttgtatttttagtagaga

SEQ ID NO: 176111 - DNA, 20 bp, Artificial Sequence
  chemically synthesized
tttgtatttttagtagagac

SEQ ID NO: 176112 - DNA, 20 bp, Artificial Sequence
  chemically synthesized
ttgtatttttagtagagaca

SEQ ID NO: 176113 - DNA, 20 bp, Artificial Sequence
  chemically synthesized
gagacagggtttgacaatgt

SEQ ID NO: 176114 - DNA, 20 bp, Artificial Sequence
  chemically synthesized
cagggtttgacaatgttggc

SEQ ID NO: 176115 - DNA, 20 bp, Artificial Sequence
  chemically synthesized
agggtttgacaatgttggcc

SEQ ID NO: 176116 - DNA, 20 bp, Artificial Sequence
  chemically synthesized
tttgacaatgttggccaggc

SEQ ID NO: 176117 - DNA, 20 bp, Artificial Sequence
  chemically synthesized
gtcagagttcaagaccagcc

SEQ ID NO: 176118 - DNA, 20 bp, Artificial Sequence
  chemically synthesized
ttgaggtcagagttcaagac

SEQ ID NO: 176119 - DNA, 20 bp, Artificial Sequence
  chemically synthesized
gccacttgaggtcagagttc

SEQ ID NO: 176120 - DNA, 20 bp, Artificial Sequence
  chemically synthesized
tggtcttgaactctgacctc

SEQ ID NO: 176121 - DNA, 20 bp, Artificial Sequence
  chemically synthesized
gggcaggccacttgaggtca

SEQ ID NO: 176122 - DNA, 20 bp, Artificial Sequence
  chemically synthesized
gagggcaggccacttgaggt

SEQ ID NO: 176123 - DNA, 20 bp, Artificial Sequence
  chemically synthesized
tcttgaactctgacctcaag

SEQ ID NO: 176124 - DNA, 20 bp, Artificial Sequence
  chemically synthesized
caaggagggcaggccacttg

SEQ ID NO: 176125 - DNA, 20 bp, Artificial Sequence
  chemically synthesized
ccaaggagggcaggccactt

SEQ ID NO: 176126 - DNA, 20 bp, Artificial Sequence
  chemically synthesized
tttgggaggccaaggagggc

SEQ ID NO: 176127 - DNA, 20 bp, Artificial Sequence
  chemically synthesized
ctcaagtggcctgccctcct

SEQ ID NO: 176128 - DNA, 20 bp, Artificial Sequence
  chemically synthesized
ctttgggaggccaaggaggg

SEQ ID NO: 176129 - DNA, 20 bp, Artificial Sequence
  chemically synthesized
gcactttgggaggccaagga

SEQ ID NO: 176130 - DNA, 20 bp, Artificial Sequence
  chemically synthesized
agcactttgggaggccaagg

SEQ ID NO: 176131 - DNA, 20 bp, Artificial Sequence
  chemically synthesized
cagcactttgggaggccaag

SEQ ID NO: 176132 - DNA, 20 bp, Artificial Sequence
  chemically synthesized
cccagcactttgggaggcca

SEQ ID NO: 176133 - DNA, 20 bp, Artificial Sequence
  chemically synthesized
tcccagcactttgggaggcc

SEQ ID NO: 176134 - DNA, 20 bp, Artificial Sequence
  chemically synthesized
ctgccctccttggcctccca

SEQ ID NO: 176135 - DNA, 20 bp, Artificial Sequence
  chemically synthesized
tgtaatcccagcactttggg

SEQ ID NO: 176136 - DNA, 20 bp, Artificial Sequence
  chemically synthesized
ctgtaatcccagcactttgg

SEQ ID NO: 176137 - DNA, 20 bp, Artificial Sequence
  chemically synthesized
tccttggcctcccaaagtgc

SEQ ID NO: 176138 - DNA, 20 bp, Artificial Sequence
  chemically synthesized
gcctgtaatcccagcacttt

SEQ ID NO: 176139 - DNA, 20 bp, Artificial Sequence
  chemically synthesized
ccttggcctcccaaagtgct

SEQ ID NO: 176140 - DNA, 20 bp, Artificial Sequence
  chemically synthesized
cgcctgtaatcccagcactt

SEQ ID NO: 176141 - DNA, 20 bp, Artificial Sequence
  chemically synthesized
ctcccaaagtgctgggatta

SEQ ID NO: 176142 - DNA, 20 bp, Artificial Sequence
  chemically synthesized
tcccaaagtgctgggattac

SEQ ID NO: 176143 - DNA, 20 bp, Artificial Sequence
  chemically synthesized
gtggctcacgcctgtaatcc

SEQ ID NO: 176144 - DNA, 20 bp, Artificial Sequence
  chemically synthesized
agtgctgggattacaggcgt

SEQ ID NO: 176145 - DNA, 20 bp, Artificial Sequence
  chemically synthesized
caggcgtgagccaccgtgcc

SEQ ID NO: 176146 - DNA, 20 bp, Artificial Sequence
  chemically synthesized
gatgttgaggctgggcacgg

SEQ ID NO: 176147 - DNA, 20 bp, Artificial Sequence
  chemically synthesized
aaagatgttgaggctgggca

SEQ ID NO: 176148 - DNA, 20 bp, Artificial Sequence
  chemically synthesized
ttaagaaagatgttgaggct

SEQ ID NO: 176149 - DNA, 20 bp, Artificial Sequence
  chemically synthesized
attaagaaagatgttgaggc

SEQ ID NO: 176150 - DNA, 20 bp, Artificial Sequence
  chemically synthesized
aataattaagaaagatgttg

SEQ ID NO: 176151 - DNA, 20 bp, Artificial Sequence
  chemically synthesized
aaataattaagaaagatgtt

SEQ ID NO: 176152 - DNA, 20 bp, Artificial Sequence
  chemically synthesized
aattactaaaataattaaga

SEQ ID NO: 176153 - DNA, 20 bp, Artificial Sequence
  chemically synthesized
ttttaattactaaaataatt

SEQ ID NO: 176154 - DNA, 20 bp, Artificial Sequence
  chemically synthesized
aacatctttcttaattattt

SEQ ID NO: 176155 - DNA, 20 bp, Artificial Sequence
  chemically synthesized
aattattttagtaattaaaa

SEQ ID NO: 176156 - DNA, 20 bp, Artificial Sequence
  chemically synthesized
gatttcatatagtttgggag

SEQ ID NO: 176157 - DNA, 20 bp, Artificial Sequence
  chemically synthesized
taagatttcatatagtttgg

SEQ ID NO: 176158 - DNA, 20 bp, Artificial Sequence
  chemically synthesized
ggtaagatttcatatagttt

SEQ ID NO: 176159 - DNA, 20 bp, Artificial Sequence
  chemically synthesized
gggtaagatttcatatagtt

SEQ ID NO: 176160 - DNA, 20 bp, Artificial Sequence
  chemically synthesized
tctatgggtaagatttcata

SEQ ID NO: 176161 - DNA, 20 bp, Artificial Sequence
  chemically synthesized
actatatgaaatcttaccca

SEQ ID NO: 176162 - DNA, 20 bp, Artificial Sequence
  chemically synthesized
tatatgaaatcttacccata

SEQ ID NO: 176163 - DNA, 20 bp, Artificial Sequence
  chemically synthesized
agaaaagacactctatgggt

SEQ ID NO: 176164 - DNA, 20 bp, Artificial Sequence
  chemically synthesized
taatagaaaagacactctat

SEQ ID NO: 176165 - DNA, 20 bp, Artificial Sequence
  chemically synthesized
ttaatagaaaagacactcta

SEQ ID NO: 176166 - DNA, 20 bp, Artificial Sequence
  chemically synthesized
aaacaggaaaattaatagaa

SEQ ID NO: 176167 - DNA, 20 bp, Artificial Sequence
  chemically synthesized
acacaaaacaggaaaattaa

SEQ ID NO: 176168 - DNA, 20 bp, Artificial Sequence
  chemically synthesized
taaaggccaacacacaaaac

SEQ ID NO: 176169 - DNA, 20 bp, Artificial Sequence
  chemically synthesized
ataaaggccaacacacaaaa

SEQ ID NO: 176170 - DNA, 20 bp, Artificial Sequence
  chemically synthesized
aattttcctgttttgtgtgt

SEQ ID NO: 176171 - DNA, 20 bp, Artificial Sequence
  chemically synthesized
tattcattgagaacaaataa

SEQ ID NO: 176172 - DNA, 20 bp, Artificial Sequence
  chemically synthesized
ttattcattgagaacaaata

SEQ ID NO: 176173 - DNA, 20 bp, Artificial Sequence
  chemically synthesized
tttatttgttctcaatgaat

SEQ ID NO: 176174 - DNA, 20 bp, Artificial Sequence
  chemically synthesized
tatataggcccttattcatt

SEQ ID NO: 176175 - DNA, 20 bp, Artificial Sequence
  chemically synthesized
ttatttgttctcaatgaata

SEQ ID NO: 176176 - DNA, 20 bp, Artificial Sequence
  chemically synthesized
tatttgttctcaatgaataa

SEQ ID NO: 176177 - DNA, 20 bp, Artificial Sequence
  chemically synthesized
tcaatgaataagggcctata

SEQ ID NO: 176178 - DNA, 20 bp, Artificial Sequence
  chemically synthesized
ttaatattcaggtgctatat

SEQ ID NO: 176179 - DNA, 20 bp, Artificial Sequence
  chemically synthesized
attaatattcaggtgctata

SEQ ID NO: 176180 - DNA, 20 bp, Artificial Sequence
  chemically synthesized
agagaaaaaaattaatattc

SEQ ID NO: 176181 - DNA, 20 bp, Artificial Sequence
  chemically synthesized
aagagaaaaaaattaatatt

SEQ ID NO: 176182 - DNA, 20 bp, Artificial Sequence
  chemically synthesized
ctgagctgctggttaaggaa

SEQ ID NO: 176183 - DNA, 20 bp, Artificial Sequence
  chemically synthesized
atttttttctcttccttaac

SEQ ID NO: 176184 - DNA, 20 bp, Artificial Sequence
  chemically synthesized
cactgagctgctggttaagg

SEQ ID NO: 176185 - DNA, 20 bp, Artificial Sequence
  chemically synthesized
tttttctcttccttaaccag

SEQ ID NO: 176186 - DNA, 20 bp, Artificial Sequence
  chemically synthesized
aatcactgagctgctggtta

SEQ ID NO: 176187 - DNA, 20 bp, Artificial Sequence
  chemically synthesized
gaatcactgagctgctggtt

SEQ ID NO: 176188 - DNA, 20 bp, Artificial Sequence
  chemically synthesized
ctcttccttaaccagcagct

SEQ ID NO: 176189 - DNA, 20 bp, Artificial Sequence
  chemically synthesized
tgttagaatcactgagctgc

SEQ ID NO: 176190 - DNA, 20 bp, Artificial Sequence
  chemically synthesized
tcagtgatgttagaatcact

SEQ ID NO: 176191 - DNA, 20 bp, Artificial Sequence
  chemically synthesized
gtgtattttatcagtgatgt

SEQ ID NO: 176192 - DNA, 20 bp, Artificial Sequence
  chemically synthesized
atcagtgatgtgtattttat

SEQ ID NO: 176193 - DNA, 20 bp, Artificial Sequence
  chemically synthesized
ctttattgttttattttcat

SEQ ID NO: 176194 - DNA, 20 bp, Artificial Sequence
  chemically synthesized
ctgatgaaaataaaacaata

SEQ ID NO: 176195 - DNA, 20 bp, Artificial Sequence
  chemically synthesized
taaaacaataaagcaacctc

SEQ ID NO: 176196 - DNA, 20 bp, Artificial Sequence
  chemically synthesized
aaaacaataaagcaacctct

SEQ ID NO: 176197 - DNA, 20 bp, Artificial Sequence
  chemically synthesized
aacaataaagcaacctctag

SEQ ID NO: 176198 - DNA, 20 bp, Artificial Sequence
  chemically synthesized
ccattgcagttatctcctag

SEQ ID NO: 176199 - DNA, 20 bp, Artificial Sequence
  chemically synthesized
accattgcagttatctccta

SEQ ID NO: 176200 - DNA, 20 bp, Artificial Sequence
  chemically synthesized
agaccattgcagttatctcc

SEQ ID NO: 176201 - DNA, 20 bp, Artificial Sequence
  chemically synthesized
cctctaggagataactgcaa

SEQ ID NO: 176202 - DNA, 20 bp, Artificial Sequence
  chemically synthesized
tgacaaattttagaccattg

SEQ ID NO: 176203 - DNA, 20 bp, Artificial Sequence
  chemically synthesized
atgacttttgtgacaaattt

SEQ ID NO: 176204 - DNA, 20 bp, Artificial Sequence
  chemically synthesized
tggtctaaaatttgtcacaa

SEQ ID NO: 176205 - DNA, 20 bp, Artificial Sequence
  chemically synthesized
aaaatttgtcacaaaagtca

SEQ ID NO: 176206 - DNA, 20 bp, Artificial Sequence
  chemically synthesized
cacaaaagtcatagcaccaa

SEQ ID NO: 176207 - DNA, 20 bp, Artificial Sequence
  chemically synthesized
aaaagtcatagcaccaacag

SEQ ID NO: 176208 - DNA, 20 bp, Artificial Sequence
  chemically synthesized
atcatgaagattgcttctgt

SEQ ID NO: 176209 - DNA, 20 bp, Artificial Sequence
  chemically synthesized
aacagaagcaatcttcatga

SEQ ID NO: 176210 - DNA, 20 bp, Artificial Sequence
  chemically synthesized
caatgtaaatgactatcatg

SEQ ID NO: 176211 - DNA, 20 bp, Artificial Sequence
  chemically synthesized
tagtcatttacattgcaatt

SEQ ID NO: 176212 - DNA, 20 bp, Artificial Sequence
  chemically synthesized
atttacattgcaattgagtt

SEQ ID NO: 176213 - DNA, 20 bp, Artificial Sequence
  chemically synthesized
gaatgttcattcttttataa

SEQ ID NO: 176214 - DNA, 20 bp, Artificial Sequence
  chemically synthesized
acttattgaaacttttataa

SEQ ID NO: 176215 - DNA, 20 bp, Artificial Sequence
  chemically synthesized
tcttttataaaagtttcaat

SEQ ID NO: 176216 - DNA, 20 bp, Artificial Sequence
  chemically synthesized
ataaaagtttcaataagtcc

SEQ ID NO: 176217 - DNA, 20 bp, Artificial Sequence
  chemically synthesized
aaagtttcaataagtccaag

SEQ ID NO: 176218 - DNA, 20 bp, Artificial Sequence
  chemically synthesized
ttgaataggacagtacttct

SEQ ID NO: 176219 - DNA, 20 bp, Artificial Sequence
  chemically synthesized
atcaacagttttgaatagga

SEQ ID NO: 176220 - DNA, 20 bp, Artificial Sequence
  chemically synthesized
tgacatcaacagttttgaat

SEQ ID NO: 176221 - DNA, 20 bp, Artificial Sequence
  chemically synthesized
gtgacatcaacagttttgaa

SEQ ID NO: 176222 - DNA, 20 bp, Artificial Sequence
  chemically synthesized
tgtgatgtgggtgacatcaa

SEQ ID NO: 176223 - DNA, 20 bp, Artificial Sequence
  chemically synthesized
tgttgatgtcacccacatca

SEQ ID NO: 176224 - DNA, 20 bp, Artificial Sequence
  chemically synthesized
acacattctgactgtgatgt

SEQ ID NO: 176225 - DNA, 20 bp, Artificial Sequence
  chemically synthesized
gacacattctgactgtgatg

SEQ ID NO: 176226 - DNA, 20 bp, Artificial Sequence
  chemically synthesized
gatgtcacccacatcacagt

SEQ ID NO: 176227 - DNA, 20 bp, Artificial Sequence
  chemically synthesized
ctaaaaatatttttttgtga

SEQ ID NO: 176228 - DNA, 20 bp, Artificial Sequence
  chemically synthesized
ctttcacaaaaaaatatttt

SEQ ID NO: 176229 - DNA, 20 bp, Artificial Sequence
  chemically synthesized
aatatttttagactgcattt

SEQ ID NO: 176230 - DNA, 20 bp, Artificial Sequence
  chemically synthesized
atatttttagactgcatttg

SEQ ID NO: 176231 - DNA, 20 bp, Artificial Sequence
  chemically synthesized
tgatgcttatacctcaaatg

SEQ ID NO: 176232 - DNA, 20 bp, Artificial Sequence
  chemically synthesized
ttagactgcatttgaggtat

SEQ ID NO: 176233 - DNA, 20 bp, Artificial Sequence
  chemically synthesized
tgcatttgaggtataagcat

SEQ ID NO: 176234 - DNA, 20 bp, Artificial Sequence
  chemically synthesized
gaggtataagcatcagtcat

SEQ ID NO: 176235 - DNA, 20 bp, Artificial Sequence
  chemically synthesized
taagcatcagtcatcagtca

SEQ ID NO: 176236 - DNA, 20 bp, Artificial Sequence
  chemically synthesized
aagcatcagtcatcagtcac

SEQ ID NO: 176237 - DNA, 20 bp, Artificial Sequence
  chemically synthesized
catcagtcacaggttgcctg

SEQ ID NO: 176238 - DNA, 20 bp, Artificial Sequence
  chemically synthesized
ttctgatggttacattctgc

SEQ ID NO: 176239 - DNA, 20 bp, Artificial Sequence
  chemically synthesized
gttctgatggttacattctg

SEQ ID NO: 176240 - DNA, 20 bp, Artificial Sequence
  chemically synthesized
tgcctgcagaatgtaaccat

SEQ ID NO: 176241 - DNA, 20 bp, Artificial Sequence
  chemically synthesized
gaaaactctatttgttctga

SEQ ID NO: 176242 - DNA, 20 bp, Artificial Sequence
  chemically synthesized
aatgtaaccatcagaacaaa

SEQ ID NO: 176243 - DNA, 20 bp, Artificial Sequence
  chemically synthesized
tgtaaccatcagaacaaata

SEQ ID NO: 176244 - DNA, 20 bp, Artificial Sequence
  chemically synthesized
agtcatcaaaagggtatttc

SEQ ID NO: 176245 - DNA, 20 bp, Artificial Sequence
  chemically synthesized
ggaaaccaaagtcatcaaaa

SEQ ID NO: 176246 - DNA, 20 bp, Artificial Sequence
  chemically synthesized
cggaaaccaaagtcatcaaa

SEQ ID NO: 176247 - DNA, 20 bp, Artificial Sequence
  chemically synthesized
ccggaaaccaaagtcatcaa

SEQ ID NO: 176248 - DNA, 20 bp, Artificial Sequence
  chemically synthesized
aaatacccttttgatgactt

SEQ ID NO: 176249 - DNA, 20 bp, Artificial Sequence
  chemically synthesized
cttttgatgactttggtttc

SEQ ID NO: 176250 - DNA, 20 bp, Artificial Sequence
  chemically synthesized
agcaaatgggccggaaacca

SEQ ID NO: 176251 - DNA, 20 bp, Artificial Sequence
  chemically synthesized
agatggaccagcaaatgggc

SEQ ID NO: 176252 - DNA, 20 bp, Artificial Sequence
  chemically synthesized
ttggtttccggcccatttgc

SEQ ID NO: 176253 - DNA, 20 bp, Artificial Sequence
  chemically synthesized
aaagagatggaccagcaaat

SEQ ID NO: 176254 - DNA, 20 bp, Artificial Sequence
  chemically synthesized
aaaagagatggaccagcaaa

SEQ ID NO: 176255 - DNA, 20 bp, Artificial Sequence
  chemically synthesized
tggtgggaaaagagatggac

SEQ ID NO: 176256 - DNA, 20 bp, Artificial Sequence
  chemically synthesized
aagtgtggtgggaaaagaga

SEQ ID NO: 176257 - DNA, 20 bp, Artificial Sequence
  chemically synthesized
ggccaagtgtggtgggaaaa

SEQ ID NO: 176258 - DNA, 20 bp, Artificial Sequence
  chemically synthesized
ttggccaagtgtggtgggaa

SEQ ID NO: 176259 - DNA, 20 bp, Artificial Sequence
  chemically synthesized
catggttggccaagtgtggt

SEQ ID NO: 176260 - DNA, 20 bp, Artificial Sequence
  chemically synthesized
atctcttttcccaccacact

SEQ ID NO: 176261 - DNA, 20 bp, Artificial Sequence
  chemically synthesized
gcatggttggccaagtgtgg

SEQ ID NO: 176262 - DNA, 20 bp, Artificial Sequence
  chemically synthesized
ttggcatggttggccaagtg

SEQ ID NO: 176263 - DNA, 20 bp, Artificial Sequence
  chemically synthesized
catctttggcatggttggcc

SEQ ID NO: 176264 - DNA, 20 bp, Artificial Sequence
  chemically synthesized
tagtccatctttggcatggt

SEQ ID NO: 176265 - DNA, 20 bp, Artificial Sequence
  chemically synthesized
acacttggccaaccatgcca

SEQ ID NO: 176266 - DNA, 20 bp, Artificial Sequence
  chemically synthesized
agtatagtccatctttggca

SEQ ID NO: 176267 - DNA, 20 bp, Artificial Sequence
  chemically synthesized
ttggccaaccatgccaaaga

SEQ ID NO: 176268 - DNA, 20 bp, Artificial Sequence
  chemically synthesized
ggacaagtatagtccatctt

SEQ ID NO: 176269 - DNA, 20 bp, Artificial Sequence
  chemically synthesized
agttatcaccgggacaagta

SEQ ID NO: 176270 - DNA, 20 bp, Artificial Sequence
  chemically synthesized
aagatggactatacttgtcc

SEQ ID NO: 176271 - DNA, 20 bp, Artificial Sequence
  chemically synthesized
ttttcagttatcaccgggac

SEQ ID NO: 176272 - DNA, 20 bp, Artificial Sequence
  chemically synthesized
gaacattttcagttatcacc

SEQ ID NO: 176273 - DNA, 20 bp, Artificial Sequence
  chemically synthesized
tgaacattttcagttatcac

SEQ ID NO: 176274 - DNA, 20 bp, Artificial Sequence
  chemically synthesized
ttataatttgtgaacatttt

SEQ ID NO: 176275 - DNA, 20 bp, Artificial Sequence
  chemically synthesized
tgaaaatgttcacaaattat

SEQ ID NO: 176276 - DNA, 20 bp, Artificial Sequence
  chemically synthesized
caaattataagtgcaacatt

SEQ ID NO: 176277 - DNA, 20 bp, Artificial Sequence
  chemically synthesized
ttgtggaaatgaaagcattt

SEQ ID NO: 176278 - DNA, 20 bp, Artificial Sequence
  chemically synthesized
caattttgttgtggaaatga

SEQ ID NO: 176279 - DNA, 20 bp, Artificial Sequence
  chemically synthesized
aaaatccatcaattttgttg

SEQ ID NO: 176280 - DNA, 20 bp, Artificial Sequence
  chemically synthesized
catttccacaacaaaattga

SEQ ID NO: 176281 - DNA, 20 bp, Artificial Sequence
  chemically synthesized
caaaattgatggattttctc

SEQ ID NO: 176282 - DNA, 20 bp, Artificial Sequence
  chemically synthesized
catttcattgtttgttgcta

SEQ ID NO: 176283 - DNA, 20 bp, Artificial Sequence
  chemically synthesized
agcatttcattgtttgttgc

SEQ ID NO: 176284 - DNA, 20 bp, Artificial Sequence
  chemically synthesized
caattacaagacattgacga

SEQ ID NO: 176285 - DNA, 20 bp, Artificial Sequence
  chemically synthesized
accaattacaagacattgac

SEQ ID NO: 176286 - DNA, 20 bp, Artificial Sequence
  chemically synthesized
tctcgtcaatgtcttgtaat

SEQ ID NO: 176287 - DNA, 20 bp, Artificial Sequence
  chemically synthesized
ctgatattagaaccaattac

SEQ ID NO: 176288 - DNA, 20 bp, Artificial Sequence
  chemically synthesized
cttgtaattggttctaatat

SEQ ID NO: 176289 - DNA, 20 bp, Artificial Sequence
  chemically synthesized
tttgattggcttgctgatat

SEQ ID NO: 176290 - DNA, 20 bp, Artificial Sequence
  chemically synthesized
taattggttctaatatcagc

SEQ ID NO: 176291 - DNA, 20 bp, Artificial Sequence
  chemically synthesized
aatatcagcaagccaatcaa

SEQ ID NO: 176292 - DNA, 20 bp, Artificial Sequence
  chemically synthesized
atatcagcaagccaatcaaa

SEQ ID NO: 176293 - DNA, 20 bp, Artificial Sequence
  chemically synthesized
tatcagcaagccaatcaaaa

SEQ ID NO: 176294 - DNA, 20 bp, Artificial Sequence
  chemically synthesized
tggtttttctcccttttgat

SEQ ID NO: 176295 - DNA, 20 bp, Artificial Sequence
  chemically synthesized
tcagcaagccaatcaaaagg

SEQ ID NO: 176296 - DNA, 20 bp, Artificial Sequence
  chemically synthesized
aagggcctgatggagaaatt

SEQ ID NO: 176297 - DNA, 20 bp, Artificial Sequence
  chemically synthesized
gaaaaaccaaatttctccat

SEQ ID NO: 176298 - DNA, 20 bp, Artificial Sequence
  chemically synthesized
aaaaaccaaatttctccatc

SEQ ID NO: 176299 - DNA, 20 bp, Artificial Sequence
  chemically synthesized
gggctgataagggcctgatg

SEQ ID NO: 176300 - DNA, 20 bp, Artificial Sequence
  chemically synthesized
aagggctgataagggcctga

SEQ ID NO: 176301 - DNA, 20 bp, Artificial Sequence
  chemically synthesized
tttctccatcaggcccttat

SEQ ID NO: 176302 - DNA, 20 bp, Artificial Sequence
  chemically synthesized
ggtaacaaaagggctgataa

SEQ ID NO: 176303 - DNA, 20 bp, Artificial Sequence
  chemically synthesized
gggtaacaaaagggctgata

SEQ ID NO: 176304 - DNA, 20 bp, Artificial Sequence
  chemically synthesized
tgggtaacaaaagggctgat

SEQ ID NO: 176305 - DNA, 20 bp, Artificial Sequence
  chemically synthesized
ccactgtatgggtaacaaaa

SEQ ID NO: 176306 - DNA, 20 bp, Artificial Sequence
  chemically synthesized
accactgtatgggtaacaaa

SEQ ID NO: 176307 - DNA, 20 bp, Artificial Sequence
  chemically synthesized
gaccactgtatgggtaacaa

SEQ ID NO: 176308 - DNA, 20 bp, Artificial Sequence
  chemically synthesized
cagcccttttgttacccata

SEQ ID NO: 176309 - DNA, 20 bp, Artificial Sequence
  chemically synthesized
cccttttgttacccatacag

SEQ ID NO: 176310 - DNA, 20 bp, Artificial Sequence
  chemically synthesized
tcggggcaagaccactgtat

SEQ ID NO: 176311 - DNA, 20 bp, Artificial Sequence
  chemically synthesized
ttcggggcaagaccactgta

SEQ ID NO: 176312 - DNA, 20 bp, Artificial Sequence
  chemically synthesized
tccaccttatggttcggggc

SEQ ID NO: 176313 - DNA, 20 bp, Artificial Sequence
  chemically synthesized
tttatccaccttatggttcg

SEQ ID NO: 176314 - DNA, 20 bp, Artificial Sequence
  chemically synthesized
gtggtcttgccccgaaccat

SEQ ID NO: 176315 - DNA, 20 bp, Artificial Sequence
  chemically synthesized
atttatccaccttatggttc

SEQ ID NO: 176316 - DNA, 20 bp, Artificial Sequence
  chemically synthesized
tggtcttgccccgaaccata

SEQ ID NO: 176317 - DNA, 20 bp, Artificial Sequence
  chemically synthesized
catttatccaccttatggtt

SEQ ID NO: 176318 - DNA, 20 bp, Artificial Sequence
  chemically synthesized
tcttgccccgaaccataagg

SEQ ID NO: 176319 - DNA, 20 bp, Artificial Sequence
  chemically synthesized
cccctcatttatccacctta

SEQ ID NO: 176320 - DNA, 20 bp, Artificial Sequence
  chemically synthesized
gaaccataaggtggataaat

SEQ ID NO: 176321 - DNA, 20 bp, Artificial Sequence
  chemically synthesized
aaccataaggtggataaatg

SEQ ID NO: 176322 - DNA, 20 bp, Artificial Sequence
  chemically synthesized
accataaggtggataaatga

SEQ ID NO: 176323 - DNA, 20 bp, Artificial Sequence
  chemically synthesized
ccataaggtggataaatgag

SEQ ID NO: 176324 - DNA, 20 bp, Artificial Sequence
  chemically synthesized
aatgaggggaatgctgattt

SEQ ID NO: 176325 - DNA, 20 bp, Artificial Sequence
  chemically synthesized
agtaagctggatgccaaaat

SEQ ID NO: 176326 - DNA, 20 bp, Artificial Sequence
  chemically synthesized
ggaatgctgattttggcatc

SEQ ID NO: 176327 - DNA, 20 bp, Artificial Sequence
  chemically synthesized
tagattatctgaaagtaagc

SEQ ID NO: 176328 - DNA, 20 bp, Artificial Sequence
  chemically synthesized
tttggcatccagcttacttt

SEQ ID NO: 176329 - DNA, 20 bp, Artificial Sequence
  chemically synthesized
gagctagattatctgaaagt

SEQ ID NO: 176330 - DNA, 20 bp, Artificial Sequence
  chemically synthesized
ggatgagctagattatctga

SEQ ID NO: 176331 - DNA, 20 bp, Artificial Sequence
  chemically synthesized
cagcttactttcagataatc

SEQ ID NO: 176332 - DNA, 20 bp, Artificial Sequence
  chemically synthesized
gtcagctgagaaggatgagc

SEQ ID NO: 176333 - DNA, 20 bp, Artificial Sequence
  chemically synthesized
tcgtgtcagctgagaaggat

SEQ ID NO: 176334 - DNA, 20 bp, Artificial Sequence
  chemically synthesized
ataatctagctcatccttct

SEQ ID NO: 176335 - DNA, 20 bp, Artificial Sequence
  chemically synthesized
ctgtctcgtgtcagctgaga

SEQ ID NO: 176336 - DNA, 20 bp, Artificial Sequence
  chemically synthesized
tctgtctcgtgtcagctgag

SEQ ID NO: 176337 - DNA, 20 bp, Artificial Sequence
  chemically synthesized
atttctgtctcgtgtcagct

SEQ ID NO: 176338 - DNA, 20 bp, Artificial Sequence
  chemically synthesized
tcatccttctcagctgacac

SEQ ID NO: 176339 - DNA, 20 bp, Artificial Sequence
  chemically synthesized
atgttatttctgtctcgtgt

SEQ ID NO: 176340 - DNA, 20 bp, Artificial Sequence
  chemically synthesized
ccttctcagctgacacgaga

SEQ ID NO: 176341 - DNA, 20 bp, Artificial Sequence
  chemically synthesized
acgagacagaaataacatca

SEQ ID NO: 176342 - DNA, 20 bp, Artificial Sequence
  chemically synthesized
cgagacagaaataacatcaa

SEQ ID NO: 176343 - DNA, 20 bp, Artificial Sequence
  chemically synthesized
gagacagaaataacatcaaa

SEQ ID NO: 176344 - DNA, 20 bp, Artificial Sequence
  chemically synthesized
aaccccaggtttgcaagaaa

SEQ ID NO: 176345 - DNA, 20 bp, Artificial Sequence
  chemically synthesized
ggaaccccaggtttgcaaga

SEQ ID NO: 176346 - DNA, 20 bp, Artificial Sequence
  chemically synthesized
taaactctttcttgcaaacc

SEQ ID NO: 176347 - DNA, 20 bp, Artificial Sequence
  chemically synthesized
ccatggaaccccaggtttgc

SEQ ID NO: 176348 - DNA, 20 bp, Artificial Sequence
  chemically synthesized
aaactctttcttgcaaacct

SEQ ID NO: 176349 - DNA, 20 bp, Artificial Sequence
  chemically synthesized
aactctttcttgcaaacctg

SEQ ID NO: 176350 - DNA, 20 bp, Artificial Sequence
  chemically synthesized
ccagtgaaccatggaacccc

SEQ ID NO: 176351 - DNA, 20 bp, Artificial Sequence
  chemically synthesized
gccagtgaaccatggaaccc

SEQ ID NO: 176352 - DNA, 20 bp, Artificial Sequence
  chemically synthesized
cttgcaaacctggggttcca

SEQ ID NO: 176353 - DNA, 20 bp, Artificial Sequence
  chemically synthesized
ggcctggggccagtgaacca

SEQ ID NO: 176354 - DNA, 20 bp, Artificial Sequence
  chemically synthesized
cctggggttccatggttcac

SEQ ID NO: 176355 - DNA, 20 bp, Artificial Sequence
  chemically synthesized
gttccatggttcactggccc

SEQ ID NO: 176356 - DNA, 20 bp, Artificial Sequence
  chemically synthesized
ttccatggttcactggcccc

SEQ ID NO: 176357 - DNA, 20 bp, Artificial Sequence
  chemically synthesized
tgttggattaggcctggggc

SEQ ID NO: 176358 - DNA, 20 bp, Artificial Sequence
  chemically synthesized
ggattgttggattaggcctg

SEQ ID NO: 176359 - DNA, 20 bp, Artificial Sequence
  chemically synthesized
tggattgttggattaggcct

SEQ ID NO: 176360 - DNA, 20 bp, Artificial Sequence
  chemically synthesized
atggattgttggattaggcc

SEQ ID NO: 176361 - DNA, 20 bp, Artificial Sequence
  chemically synthesized
agaaaatggattgttggatt

SEQ ID NO: 176362 - DNA, 20 bp, Artificial Sequence
  chemically synthesized
tagaaaatggattgttggat

SEQ ID NO: 176363 - DNA, 20 bp, Artificial Sequence
  chemically synthesized
ttgtgtagaaaatggattgt

SEQ ID NO: 176364 - DNA, 20 bp, Artificial Sequence
  chemically synthesized
accttttattgtgtagaaaa

SEQ ID NO: 176365 - DNA, 20 bp, Artificial Sequence
  chemically synthesized
gtttcttaccttttattgtg

SEQ ID NO: 176366 - DNA, 20 bp, Artificial Sequence
  chemically synthesized
atccattttctacacaataa

SEQ ID NO: 176367 - DNA, 20 bp, Artificial Sequence
  chemically synthesized
tccattttctacacaataaa

SEQ ID NO: 176368 - DNA, 20 bp, Artificial Sequence
  chemically synthesized
ttttctacacaataaaaggt

SEQ ID NO: 176369 - DNA, 20 bp, Artificial Sequence
  chemically synthesized
aaaaggtaagaaacccatta

SEQ ID NO: 176370 - DNA, 20 bp, Artificial Sequence
  chemically synthesized
gcttataacagatctgtaat

SEQ ID NO: 176371 - DNA, 20 bp, Artificial Sequence
  chemically synthesized
ggcttataacagatctgtaa

SEQ ID NO: 176372 - DNA, 20 bp, Artificial Sequence
  chemically synthesized
acccattacagatctgttat

SEQ ID NO: 176373 - DNA, 20 bp, Artificial Sequence
  chemically synthesized
ccacctgccaaggcttataa

SEQ ID NO: 176374 - DNA, 20 bp, Artificial Sequence
  chemically synthesized
tacagatctgttataagcct

SEQ ID NO: 176375 - DNA, 20 bp, Artificial Sequence
  chemically synthesized
agatctgttataagccttgg

SEQ ID NO: 176376 - DNA, 20 bp, Artificial Sequence
  chemically synthesized
gatctgttataagccttggc

SEQ ID NO: 176377 - DNA, 20 bp, Artificial Sequence
  chemically synthesized
ctgttataagccttggcagg

SEQ ID NO: 176378 - DNA, 20 bp, Artificial Sequence
  chemically synthesized
ttgccgtataccacctgcca

SEQ ID NO: 176379 - DNA, 20 bp, Artificial Sequence
  chemically synthesized
tttgccgtataccacctgcc

SEQ ID NO: 176380 - DNA, 20 bp, Artificial Sequence
  chemically synthesized
aagccttggcaggtggtata

SEQ ID NO: 176381 - DNA, 20 bp, Artificial Sequence
  chemically synthesized
caggtggtatacggcaaaaa

SEQ ID NO: 176382 - DNA, 20 bp, Artificial Sequence
  chemically synthesized
aatggaatacacaaccaacc

SEQ ID NO: 176383 - DNA, 20 bp, Artificial Sequence
  chemically synthesized
agggataccaaatgctgggt

SEQ ID NO: 176384 - DNA, 20 bp, Artificial Sequence
  chemically synthesized
tacacaaccaacccagcatt

SEQ ID NO: 176385 - DNA, 20 bp, Artificial Sequence
  chemically synthesized
gaaaagggataccaaatgct

SEQ ID NO: 176386 - DNA, 20 bp, Artificial Sequence
  chemically synthesized
agaaaagggataccaaatgc

SEQ ID NO: 176387 - DNA, 20 bp, Artificial Sequence
  chemically synthesized
catttggtatcccttttcta

SEQ ID NO: 176388 - DNA, 20 bp, Artificial Sequence
  chemically synthesized
gtgcttcaaaccatagaaaa

SEQ ID NO: 176389 - DNA, 20 bp, Artificial Sequence
  chemically synthesized
agtgcttcaaaccatagaaa

SEQ ID NO: 176390 - DNA, 20 bp, Artificial Sequence
  chemically synthesized
tagtgcttcaaaccatagaa

SEQ ID NO: 176391 - DNA, 20 bp, Artificial Sequence
  chemically synthesized
tatcccttttctatggtttg

SEQ ID NO: 176392 - DNA, 20 bp, Artificial Sequence
  chemically synthesized
acccctagtgcttcaaacca

SEQ ID NO: 176393 - DNA, 20 bp, Artificial Sequence
  chemically synthesized
ttttctatggtttgaagcac

SEQ ID NO: 176394 - DNA, 20 bp, Artificial Sequence
  chemically synthesized
tttctatggtttgaagcact

SEQ ID NO: 176395 - DNA, 20 bp, Artificial Sequence
  chemically synthesized
ttctatggtttgaagcacta

SEQ ID NO: 176396 - DNA, 20 bp, Artificial Sequence
  chemically synthesized
tctatggtttgaagcactag

SEQ ID NO: 176397 - DNA, 20 bp, Artificial Sequence
  chemically synthesized
tggtttgaagcactaggggt

SEQ ID NO: 176398 - DNA, 20 bp, Artificial Sequence
  chemically synthesized
tattcatgtcagctgacccc

SEQ ID NO: 176399 - DNA, 20 bp, Artificial Sequence
  chemically synthesized
gctgactactatattcatgt

SEQ ID NO: 176400 - DNA, 20 bp, Artificial Sequence
  chemically synthesized
ggggtcagctgacatgaata

SEQ ID NO: 176401 - DNA, 20 bp, Artificial Sequence
  chemically synthesized
gtcagctgacatgaatatag

SEQ ID NO: 176402 - DNA, 20 bp, Artificial Sequence
  chemically synthesized
gctgacatgaatatagtagt

SEQ ID NO: 176403 - DNA, 20 bp, Artificial Sequence
  chemically synthesized
tgaatatagtagtcagcatt

SEQ ID NO: 176404 - DNA, 20 bp, Artificial Sequence
  chemically synthesized
agtagtcagcatttagtatt

SEQ ID NO: 176405 - DNA, 20 bp, Artificial Sequence
  chemically synthesized
catttagtattaagttattt

SEQ ID NO: 176406 - DNA, 20 bp, Artificial Sequence
  chemically synthesized
aagatgtgagtttatttatg

SEQ ID NO: 176407 - DNA, 20 bp, Artificial Sequence
  chemically synthesized
atactcatacatcaagatgt

SEQ ID NO: 176408 - DNA, 20 bp, Artificial Sequence
  chemically synthesized
aaactcacatcttgatgtat

SEQ ID NO: 176409 - DNA, 20 bp, Artificial Sequence
  chemically synthesized
aatctttatactcatacatc

SEQ ID NO: 176410 - DNA, 20 bp, Artificial Sequence
  chemically synthesized
catcttgatgtatgagtata

SEQ ID NO: 176411 - DNA, 20 bp, Artificial Sequence
  chemically synthesized
gtatgagtataaagatttga

SEQ ID NO: 176412 - DNA, 20 bp, Artificial Sequence
  chemically synthesized
agtataaagatttgacagaa

SEQ ID NO: 176413 - DNA, 20 bp, Artificial Sequence
  chemically synthesized
ttgacagaaaagttcatttt

SEQ ID NO: 176414 - DNA, 20 bp, Artificial Sequence
  chemically synthesized
gggtgatttttattaaagat

SEQ ID NO: 176415 - DNA, 20 bp, Artificial Sequence
  chemically synthesized
taacagggtgatttttatta

SEQ ID NO: 176416 - DNA, 20 bp, Artificial Sequence
  chemically synthesized
catacaaaagtaaaataaca

SEQ ID NO: 176417 - DNA, 20 bp, Artificial Sequence
  chemically synthesized
ccatacaaaagtaaaataac

SEQ ID NO: 176418 - DNA, 20 bp, Artificial Sequence
  chemically synthesized
gccatacaaaagtaaaataa

SEQ ID NO: 176419 - DNA, 20 bp, Artificial Sequence
  chemically synthesized
cctgttattttacttttgta

SEQ ID NO: 176420 - DNA, 20 bp, Artificial Sequence
  chemically synthesized
aaagccaatatgccatacaa

SEQ ID NO: 176421 - DNA, 20 bp, Artificial Sequence
  chemically synthesized
tttacttttgtatggcatat

SEQ ID NO: 176422 - DNA, 20 bp, Artificial Sequence
  chemically synthesized
tgtatggcatattggctttg

SEQ ID NO: 176423 - DNA, 20 bp, Artificial Sequence
  chemically synthesized
gtatggcatattggctttgc

SEQ ID NO: 176424 - DNA, 20 bp, Artificial Sequence
  chemically synthesized
catttattatatcacctgca

SEQ ID NO: 176425 - DNA, 20 bp, Artificial Sequence
  chemically synthesized
ggtgatataataaatgaaac

SEQ ID NO: 176426 - DNA, 20 bp, Artificial Sequence
  chemically synthesized
gtgatataataaatgaaact

SEQ ID NO: 176427 - DNA, 20 bp, Artificial Sequence
  chemically synthesized
tataataaatgaaactgggt

SEQ ID NO: 176428 - DNA, 20 bp, Artificial Sequence
  chemically synthesized
acatattgtaaattctaacc

SEQ ID NO: 176429 - DNA, 20 bp, Artificial Sequence
  chemically synthesized
gggttagaatttacaatatg

SEQ ID NO: 176430 - DNA, 20 bp, Artificial Sequence
  chemically synthesized
acaatatgtggtcttaaata

SEQ ID NO: 176431 - DNA, 20 bp, Artificial Sequence
  chemically synthesized
aaagattaaaggccatattt

SEQ ID NO: 176432 - DNA, 20 bp, Artificial Sequence
  chemically synthesized
aaataaggaacaaagattaa

SEQ ID NO: 176433 - DNA, 20 bp, Artificial Sequence
  chemically synthesized
taaataaggaacaaagatta

SEQ ID NO: 176434 - DNA, 20 bp, Artificial Sequence
  chemically synthesized
ctgaggttaaataaggaaca

SEQ ID NO: 176435 - DNA, 20 bp, Artificial Sequence
  chemically synthesized
ccttaaactgaggttaaata

SEQ ID NO: 176436 - DNA, 20 bp, Artificial Sequence
  chemically synthesized
tccttaaactgaggttaaat

SEQ ID NO: 176437 - DNA, 20 bp, Artificial Sequence
  chemically synthesized
ctttgttccttatttaacct

SEQ ID NO: 176438 - DNA, 20 bp, Artificial Sequence
  chemically synthesized
tccttatttaacctcagttt

SEQ ID NO: 176439 - DNA, 20 bp, Artificial Sequence
  chemically synthesized
ccttatttaacctcagttta

SEQ ID NO: 176440 - DNA, 20 bp, Artificial Sequence
  chemically synthesized
tatgccaactccttaaactg

SEQ ID NO: 176441 - DNA, 20 bp, Artificial Sequence
  chemically synthesized
atatgccaactccttaaact

SEQ ID NO: 176442 - DNA, 20 bp, Artificial Sequence
  chemically synthesized
ttatttaacctcagtttaag

SEQ ID NO: 176443 - DNA, 20 bp, Artificial Sequence
  chemically synthesized
ttaacctcagtttaaggagt

SEQ ID NO: 176444 - DNA, 20 bp, Artificial Sequence
  chemically synthesized
cgtgaaatgatattaaatgg

SEQ ID NO: 176445 - DNA, 20 bp, Artificial Sequence
  chemically synthesized
aatcgtgaaatgatattaaa

SEQ ID NO: 176446 - DNA, 20 bp, Artificial Sequence
  chemically synthesized
tttcacgattattaaattat

SEQ ID NO: 176447 - DNA, 20 bp, Artificial Sequence
  chemically synthesized
acgattattaaattattaga

SEQ ID NO: 176448 - DNA, 20 bp, Artificial Sequence
  chemically synthesized
cgattattaaattattagaa

SEQ ID NO: 176449 - DNA, 20 bp, Artificial Sequence
  chemically synthesized
ttattaaattattagaaagg

SEQ ID NO: 176450 - DNA, 20 bp, Artificial Sequence
  chemically synthesized
tattaaattattagaaagga

SEQ ID NO: 176451 - DNA, 20 bp, Artificial Sequence
  chemically synthesized
gaaaggaaggaaactccctc

SEQ ID NO: 176452 - DNA, 20 bp, Artificial Sequence
  chemically synthesized
accaaccctgagactagagg

SEQ ID NO: 176453 - DNA, 20 bp, Artificial Sequence
  chemically synthesized
gcaccaaccctgagactaga

SEQ ID NO: 176454 - DNA, 20 bp, Artificial Sequence
  chemically synthesized
aaggaaactccctctagtct

SEQ ID NO: 176455 - DNA, 20 bp, Artificial Sequence
  chemically synthesized
agcaccaaccctgagactag

SEQ ID NO: 176456 - DNA, 20 bp, Artificial Sequence
  chemically synthesized
aggaaactccctctagtctc

SEQ ID NO: 176457 - DNA, 20 bp, Artificial Sequence
  chemically synthesized
tagcaccaaccctgagacta

SEQ ID NO: 176458 - DNA, 20 bp, Artificial Sequence
  chemically synthesized
ggaaactccctctagtctca

SEQ ID NO: 176459 - DNA, 20 bp, Artificial Sequence
  chemically synthesized
catagcaccaaccctgagac

SEQ ID NO: 176460 - DNA, 20 bp, Artificial Sequence
  chemically synthesized
actccctctagtctcagggt

SEQ ID NO: 176461 - DNA, 20 bp, Artificial Sequence
  chemically synthesized
acttacatagcaccaaccct

SEQ ID NO: 176462 - DNA, 20 bp, Artificial Sequence
  chemically synthesized
tctcagggttggtgctatgt

SEQ ID NO: 176463 - DNA, 20 bp, Artificial Sequence
  chemically synthesized
ctgcaatgcttttacttaca

SEQ ID NO: 176464 - DNA, 20 bp, Artificial Sequence
  chemically synthesized
ggttggtgctatgtaagtaa

SEQ ID NO: 176465 - DNA, 20 bp, Artificial Sequence
  chemically synthesized
ctatgtaagtaaaagcattg

SEQ ID NO: 176466 - DNA, 20 bp, Artificial Sequence
  chemically synthesized
taaaagcattgcagaaacaa

SEQ ID NO: 176467 - DNA, 20 bp, Artificial Sequence
  chemically synthesized
aaaagcattgcagaaacaaa

SEQ ID NO: 176468 - DNA, 20 bp, Artificial Sequence
  chemically synthesized
gcattgcagaaacaaaagga

SEQ ID NO: 176469 - DNA, 20 bp, Artificial Sequence
  chemically synthesized
aaagaaaaaacattttatat

SEQ ID NO: 176470 - DNA, 20 bp, Artificial Sequence
  chemically synthesized
aagaaatgacataataaaag

SEQ ID NO: 176471 - DNA, 20 bp, Artificial Sequence
  chemically synthesized
gaagaaatgacataataaaa

SEQ ID NO: 176472 - DNA, 20 bp, Artificial Sequence
  chemically synthesized
agaagaaatgacataataaa

SEQ ID NO: 176473 - DNA, 20 bp, Artificial Sequence
  chemically synthesized
gagaagaaatgacataataa

SEQ ID NO: 176474 - DNA, 20 bp, Artificial Sequence
  chemically synthesized
caatgacttctagaaaggag

SEQ ID NO: 176475 - DNA, 20 bp, Artificial Sequence
  chemically synthesized
atgtcatttcttctcctttc

SEQ ID NO: 176476 - DNA, 20 bp, Artificial Sequence
  chemically synthesized
aagcaatgacttctagaaag

SEQ ID NO: 176477 - DNA, 20 bp, Artificial Sequence
  chemically synthesized
tcatttcttctcctttctag

SEQ ID NO: 176478 - DNA, 20 bp, Artificial Sequence
  chemically synthesized
tgaagcaatgacttctagaa

SEQ ID NO: 176479 - DNA, 20 bp, Artificial Sequence
  chemically synthesized
ctgaagcaatgacttctaga

SEQ ID NO: 176480 - DNA, 20 bp, Artificial Sequence
  chemically synthesized
ttgcctgaagcaatgacttc

SEQ ID NO: 176481 - DNA, 20 bp, Artificial Sequence
  chemically synthesized
ctttctagaagtcattgctt

SEQ ID NO: 176482 - DNA, 20 bp, Artificial Sequence
  chemically synthesized
tttctagaagtcattgcttc

SEQ ID NO: 176483 - DNA, 20 bp, Artificial Sequence
  chemically synthesized
agcacaaaggtgtttgcctg

SEQ ID NO: 176484 - DNA, 20 bp, Artificial Sequence
  chemically synthesized
taactcctttattagcacaa

SEQ ID NO: 176485 - DNA, 20 bp, Artificial Sequence
  chemically synthesized
gtaactcctttattagcaca

SEQ ID NO: 176486 - DNA, 20 bp, Artificial Sequence
  chemically synthesized
caaacacctttgtgctaata

SEQ ID NO: 176487 - DNA, 20 bp, Artificial Sequence
  chemically synthesized
aaacacctttgtgctaataa

SEQ ID NO: 176488 - DNA, 20 bp, Artificial Sequence
  chemically synthesized
acacctttgtgctaataaag

SEQ ID NO: 176489 - DNA, 20 bp, Artificial Sequence
  chemically synthesized
tttttaagtaactcctttat

SEQ ID NO: 176490 - DNA, 20 bp, Artificial Sequence
  chemically synthesized
atcttcagtgtagcattttt

SEQ ID NO: 176491 - DNA, 20 bp, Artificial Sequence
  chemically synthesized
tacttaaaaatgctacactg

SEQ ID NO: 176492 - DNA, 20 bp, Artificial Sequence
  chemically synthesized
ataactctgcatcttcagtg

SEQ ID NO: 176493 - DNA, 20 bp, Artificial Sequence
  chemically synthesized
aaaatgctacactgaagatg

SEQ ID NO: 176494 - DNA, 20 bp, Artificial Sequence
  chemically synthesized
atttcataactctgcatctt

SEQ ID NO: 176495 - DNA, 20 bp, Artificial Sequence
  chemically synthesized
aatgctacactgaagatgca

SEQ ID NO: 176496 - DNA, 20 bp, Artificial Sequence
  chemically synthesized
atgatgaaaagagaaaggag

SEQ ID NO: 176497 - DNA, 20 bp, Artificial Sequence
  chemically synthesized
tgatgatgaaaagagaaagg

SEQ ID NO: 176498 - DNA, 20 bp, Artificial Sequence
  chemically synthesized
atgatgatgaaaagagaaag

SEQ ID NO: 176499 - DNA, 20 bp, Artificial Sequence
  chemically synthesized
aaatgatgatgaaaagagaa

SEQ ID NO: 176500 - DNA, 20 bp, Artificial Sequence
  chemically synthesized
taaatgatgatgaaaagaga

SEQ ID NO: 176501 - DNA, 20 bp, Artificial Sequence
  chemically synthesized
agtataaatgatgatgaaaa

SEQ ID NO: 176502 - DNA, 20 bp, Artificial Sequence
  chemically synthesized
agagtataaatgatgatgaa

SEQ ID NO: 176503 - DNA, 20 bp, Artificial Sequence
  chemically synthesized
gatggatttaaaatgatgaa

SEQ ID NO: 176504 - DNA, 20 bp, Artificial Sequence
  chemically synthesized
atgatggatttaaaatgatg

SEQ ID NO: 176505 - DNA, 20 bp, Artificial Sequence
  chemically synthesized
cattttaaatccatcatgaa

SEQ ID NO: 176506 - DNA, 20 bp, Artificial Sequence
  chemically synthesized
tctctcctccccgttcatga

SEQ ID NO: 176507 - DNA, 20 bp, Artificial Sequence
  chemically synthesized
attttaaatccatcatgaac

SEQ ID NO: 176508 - DNA, 20 bp, Artificial Sequence
  chemically synthesized
ttttaaatccatcatgaacg

SEQ ID NO: 176509 - DNA, 20 bp, Artificial Sequence
  chemically synthesized
ttaaatccatcatgaacggg

SEQ ID NO: 176510 - DNA, 20 bp, Artificial Sequence
  chemically synthesized
taaatccatcatgaacgggg

SEQ ID NO: 176511 - DNA, 20 bp, Artificial Sequence
  chemically synthesized
aatccatcatgaacggggag

SEQ ID NO: 176512 - DNA, 20 bp, Artificial Sequence
  chemically synthesized
tccatcatgaacggggagga

SEQ ID NO: 176513 - DNA, 20 bp, Artificial Sequence
  chemically synthesized
aacggggaggagagattgct

SEQ ID NO: 176514 - DNA, 20 bp, Artificial Sequence
  chemically synthesized
ggaggagagattgctaagaa

SEQ ID NO: 176515 - DNA, 20 bp, Artificial Sequence
  chemically synthesized
aaaacaaattcgactattct

SEQ ID NO: 176516 - DNA, 20 bp, Artificial Sequence
  chemically synthesized
agaatagtcgaatttgtttt

SEQ ID NO: 176517 - DNA, 20 bp, Artificial Sequence
  chemically synthesized
atttgtttttagttgaaaat

SEQ ID NO: 176518 - DNA, 20 bp, Artificial Sequence
  chemically synthesized
ctagattttatttaaaagtt

SEQ ID NO: 176519 - DNA, 20 bp, Artificial Sequence
  chemically synthesized
gtgccctagattttatttaa

SEQ ID NO: 176520 - DNA, 20 bp, Artificial Sequence
  chemically synthesized
cttaacttttaaataaaatc

SEQ ID NO: 176521 - DNA, 20 bp, Artificial Sequence
  chemically synthesized
ttaacttttaaataaaatct

SEQ ID NO: 176522 - DNA, 20 bp, Artificial Sequence
  chemically synthesized
taacttttaaataaaatcta

SEQ ID NO: 176523 - DNA, 20 bp, Artificial Sequence
  chemically synthesized
tttaaataaaatctagggca

SEQ ID NO: 176524 - DNA, 20 bp, Artificial Sequence
  chemically synthesized
cacttaagtatgctgtgccc

SEQ ID NO: 176525 - DNA, 20 bp, Artificial Sequence
  chemically synthesized
atctagggcacagcatactt

SEQ ID NO: 176526 - DNA, 20 bp, Artificial Sequence
  chemically synthesized
agcatgtaaatgtgtcactt

SEQ ID NO: 176527 - DNA, 20 bp, Artificial Sequence
  chemically synthesized
acatactgaaaatgtatatc

SEQ ID NO: 176528 - DNA, 20 bp, Artificial Sequence
  chemically synthesized
acatgcttgatatacatttt

SEQ ID NO: 176529 - DNA, 20 bp, Artificial Sequence
  chemically synthesized
tgatatacattttcagtatg

SEQ ID NO: 176530 - DNA, 20 bp, Artificial Sequence
  chemically synthesized
atacattttcagtatgtaga

SEQ ID NO: 176531 - DNA, 20 bp, Artificial Sequence
  chemically synthesized
cattttcagtatgtagatag

SEQ ID NO: 176532 - DNA, 20 bp, Artificial Sequence
  chemically synthesized
tgtagatagtggcaacaatg

SEQ ID NO: 176533 - DNA, 20 bp, Artificial Sequence
  chemically synthesized
gcaacaatgaagtttcacta

SEQ ID NO: 176534 - DNA, 20 bp, Artificial Sequence
  chemically synthesized
tgaagtttcactatggaaat

SEQ ID NO: 176535 - DNA, 20 bp, Artificial Sequence
  chemically synthesized
tgtgtaacaactaatttcca

SEQ ID NO: 176536 - DNA, 20 bp, Artificial Sequence
  chemically synthesized
atggaaattagttgttacac

SEQ ID NO: 176537 - DNA, 20 bp, Artificial Sequence
  chemically synthesized
attagttgttacacaagtat

SEQ ID NO: 176538 - DNA, 20 bp, Artificial Sequence
  chemically synthesized
aaaatccagcataaattgtg

SEQ ID NO: 176539 - DNA, 20 bp, Artificial Sequence
  chemically synthesized
cagtgcttcacaatttatgc

SEQ ID NO: 176540 - DNA, 20 bp, Artificial Sequence
  chemically synthesized
taaaaaatataacaaaaatc

SEQ ID NO: 176541 - DNA, 20 bp, Artificial Sequence
  chemically synthesized
tttttaaaacattattatat

SEQ ID NO: 176542 - DNA, 20 bp, Artificial Sequence
  chemically synthesized
tgaacaaattatcttgtatt

SEQ ID NO: 176543 - DNA, 20 bp, Artificial Sequence
  chemically synthesized
taggaaacctcaccaaatac

SEQ ID NO: 176544 - DNA, 20 bp, Artificial Sequence
  chemically synthesized
caaattatcttgtatttggt

SEQ ID NO: 176545 - DNA, 20 bp, Artificial Sequence
  chemically synthesized
aaattatcttgtatttggtg

SEQ ID NO: 176546 - DNA, 20 bp, Artificial Sequence
  chemically synthesized
tatttggtgaggtttcctaa

SEQ ID NO: 176547 - DNA, 20 bp, Artificial Sequence
  chemically synthesized
aagctagataattttctatt

SEQ ID NO: 176548 - DNA, 20 bp, Artificial Sequence
  chemically synthesized
gaagctagataattttctat

SEQ ID NO: 176549 - DNA, 20 bp, Artificial Sequence
  chemically synthesized
tttcctaatagaaaattatc

SEQ ID NO: 176550 - DNA, 20 bp, Artificial Sequence
  chemically synthesized
aatagaaaattatctagctt

SEQ ID NO: 176551 - DNA, 20 bp, Artificial Sequence
  chemically synthesized
gtagaaggttacactgaagc

SEQ ID NO: 176552 - DNA, 20 bp, Artificial Sequence
  chemically synthesized
atttgtagaaggttacactg

SEQ ID NO: 176553 - DNA, 20 bp, Artificial Sequence
  chemically synthesized
aaaggaaaagcatttgtaga

SEQ ID NO: 176554 - DNA, 20 bp, Artificial Sequence
  chemically synthesized
taaaggaaaagcatttgtag

SEQ ID NO: 176555 - DNA, 20 bp, Artificial Sequence
  chemically synthesized
aagtaaaggaaaagcatttg

SEQ ID NO: 176556 - DNA, 20 bp, Artificial Sequence
  chemically synthesized
attttggcaaagtaaaggaa

SEQ ID NO: 176557 - DNA, 20 bp, Artificial Sequence
  chemically synthesized
ccctcattttggcaaagtaa

SEQ ID NO: 176558 - DNA, 20 bp, Artificial Sequence
  chemically synthesized
tccctcattttggcaaagta

SEQ ID NO: 176559 - DNA, 20 bp, Artificial Sequence
  chemically synthesized
cagtttccctcattttggca

SEQ ID NO: 176560 - DNA, 20 bp, Artificial Sequence
  chemically synthesized
ttcctttactttgccaaaat

SEQ ID NO: 176561 - DNA, 20 bp, Artificial Sequence
  chemically synthesized
tcctttactttgccaaaatg

SEQ ID NO: 176562 - DNA, 20 bp, Artificial Sequence
  chemically synthesized
cctttactttgccaaaatga

SEQ ID NO: 176563 - DNA, 20 bp, Artificial Sequence
  chemically synthesized
gacatcagtttccctcattt

SEQ ID NO: 176564 - DNA, 20 bp, Artificial Sequence
  chemically synthesized
cctacctttatttttgacat

SEQ ID NO: 176565 - DNA, 20 bp, Artificial Sequence
  chemically synthesized
ggaaactgatgtcaaaaata

SEQ ID NO: 176566 - DNA, 20 bp, Artificial Sequence
  chemically synthesized
gaaactgatgtcaaaaataa

SEQ ID NO: 176567 - DNA, 20 bp, Artificial Sequence
  chemically synthesized
actgatgtcaaaaataaagg

SEQ ID NO: 176568 - DNA, 20 bp, Artificial Sequence
  chemically synthesized
ctgatgtcaaaaataaaggt

SEQ ID NO: 176569 - DNA, 20 bp, Artificial Sequence
  chemically synthesized
tgatgtcaaaaataaaggta

SEQ ID NO: 176570 - DNA, 20 bp, Artificial Sequence
  chemically synthesized
gatgtcaaaaataaaggtag

SEQ ID NO: 176571 - DNA, 20 bp, Artificial Sequence
  chemically synthesized
atgtcaaaaataaaggtagg

SEQ ID NO: 176572 - DNA, 20 bp, Artificial Sequence
  chemically synthesized
tcaaaaataaaggtaggggg

SEQ ID NO: 176573 - DNA, 20 bp, Artificial Sequence
  chemically synthesized
caaaaataaaggtaggggga

SEQ ID NO: 176574 - DNA, 20 bp, Artificial Sequence
  chemically synthesized
aaaaataaaggtagggggaa

SEQ ID NO: 176575 - DNA, 20 bp, Artificial Sequence
  chemically synthesized
ataaaggtagggggaaggga

SEQ ID NO: 176576 - DNA, 20 bp, Artificial Sequence
  chemically synthesized
taaaggtagggggaagggat

SEQ ID NO: 176577 - DNA, 20 bp, Artificial Sequence
  chemically synthesized
aaaggtagggggaagggatg

SEQ ID NO: 176578 - DNA, 20 bp, Artificial Sequence
  chemically synthesized
ggtagggggaagggatgggg

SEQ ID NO: 176579 - DNA, 20 bp, Artificial Sequence
  chemically synthesized
agggggaagggatggggaag

SEQ ID NO: 176580 - DNA, 20 bp, Artificial Sequence
  chemically synthesized
gggatggggaagcagtgtga

SEQ ID NO: 176581 - DNA, 20 bp, Artificial Sequence
  chemically synthesized
cagaaatccaagcagaaagc

SEQ ID NO: 176582 - DNA, 20 bp, Artificial Sequence
  chemically synthesized
aagtttacttgctttctgct

SEQ ID NO: 176583 - DNA, 20 bp, Artificial Sequence
  chemically synthesized
aacccagaaatccaagcaga

SEQ ID NO: 176584 - DNA, 20 bp, Artificial Sequence
  chemically synthesized
ttgtaacccagaaatccaag

SEQ ID NO: 176585 - DNA, 20 bp, Artificial Sequence
  chemically synthesized
ttgctttctgcttggatttc

SEQ ID NO: 176586 - DNA, 20 bp, Artificial Sequence
  chemically synthesized
tgattgtaacccagaaatcc

SEQ ID NO: 176587 - DNA, 20 bp, Artificial Sequence
  chemically synthesized
tgctttctgcttggatttct

SEQ ID NO: 176588 - DNA, 20 bp, Artificial Sequence
  chemically synthesized
ctattggcctgattgtaacc

SEQ ID NO: 176589 - DNA, 20 bp, Artificial Sequence
  chemically synthesized
ttggatttctgggttacaat

SEQ ID NO: 176590 - DNA, 20 bp, Artificial Sequence
  chemically synthesized
tggatttctgggttacaatc

SEQ ID NO: 176591 - DNA, 20 bp, Artificial Sequence
  chemically synthesized
ctgggttacaatcaggccaa

SEQ ID NO: 176592 - DNA, 20 bp, Artificial Sequence
  chemically synthesized
catcgtttttatcaatctat

SEQ ID NO: 176593 - DNA, 20 bp, Artificial Sequence
  chemically synthesized
agattgataaaaacgatgtt

SEQ ID NO: 176594 - DNA, 20 bp, Artificial Sequence
  chemically synthesized
aaaacgatgttcagaattaa

SEQ ID NO: 176595 - DNA, 20 bp, Artificial Sequence
  chemically synthesized
aaagtatgaacataattcag

SEQ ID NO: 176596 - DNA, 20 bp, Artificial Sequence
  chemically synthesized
taaagtatgaacataattca

SEQ ID NO: 176597 - DNA, 20 bp, Artificial Sequence
  chemically synthesized
tttaaagtatgaacataatt

SEQ ID NO: 176598 - DNA, 20 bp, Artificial Sequence
  chemically synthesized
gaattatgttcatactttaa

SEQ ID NO: 176599 - DNA, 20 bp, Artificial Sequence
  chemically synthesized
tatgttcatactttaaaagt

SEQ ID NO: 176600 - DNA, 20 bp, Artificial Sequence
  chemically synthesized
caccagcattctcactttta

SEQ ID NO: 176601 - DNA, 20 bp, Artificial Sequence
  chemically synthesized
tactttaaaagtgagaatgc

SEQ ID NO: 176602 - DNA, 20 bp, Artificial Sequence
  chemically synthesized
ccagcattgttttcaaacac

SEQ ID NO: 176603 - DNA, 20 bp, Artificial Sequence
  chemically synthesized
ctggtgtttgaaaacaatgc

SEQ ID NO: 176604 - DNA, 20 bp, Artificial Sequence
  chemically synthesized
gaaaacaatgctggctttgt

SEQ ID NO: 176605 - DNA, 20 bp, Artificial Sequence
  chemically synthesized
cctaagaagcccaacaaagc

SEQ ID NO: 176606 - DNA, 20 bp, Artificial Sequence
  chemically synthesized
aaaacaatgctggctttgtt

SEQ ID NO: 176607 - DNA, 20 bp, Artificial Sequence
  chemically synthesized
attgcctaagaagcccaaca

SEQ ID NO: 176608 - DNA, 20 bp, Artificial Sequence
  chemically synthesized
gctggctttgttgggcttct

SEQ ID NO: 176609 - DNA, 20 bp, Artificial Sequence
  chemically synthesized
ctggctttgttgggcttctt

SEQ ID NO: 176610 - DNA, 20 bp, Artificial Sequence
  chemically synthesized
ttctcctcctattgcctaag

SEQ ID NO: 176611 - DNA, 20 bp, Artificial Sequence
  chemically synthesized
ttgttgggcttcttaggcaa

SEQ ID NO: 176612 - DNA, 20 bp, Artificial Sequence
  chemically synthesized
tgttgggcttcttaggcaat

SEQ ID NO: 176613 - DNA, 20 bp, Artificial Sequence
  chemically synthesized
tttttctcctcctattgcct

SEQ ID NO: 176614 - DNA, 20 bp, Artificial Sequence
  chemically synthesized
ttgggcttcttaggcaatag

SEQ ID NO: 176615 - DNA, 20 bp, Artificial Sequence
  chemically synthesized
tgggcttcttaggcaatagg

SEQ ID NO: 176616 - DNA, 20 bp, Artificial Sequence
  chemically synthesized
ggcttcttaggcaataggag

SEQ ID NO: 176617 - DNA, 20 bp, Artificial Sequence
  chemically synthesized
taaaatgtgttggaaaatga

SEQ ID NO: 176618 - DNA, 20 bp, Artificial Sequence
  chemically synthesized
gcatttcagctaaaatgtgt

SEQ ID NO: 176619 - DNA, 20 bp, Artificial Sequence
  chemically synthesized
tatcattttccaacacattt

SEQ ID NO: 176620 - DNA, 20 bp, Artificial Sequence
  chemically synthesized
acacattttagctgaaatgc

SEQ ID NO: 176621 - DNA, 20 bp, Artificial Sequence
  chemically synthesized
tctatgaccaactagcattt

SEQ ID NO: 176622 - DNA, 20 bp, Artificial Sequence
  chemically synthesized
attttagctgaaatgctagt

SEQ ID NO: 176623 - DNA, 20 bp, Artificial Sequence
  chemically synthesized
tttcattttctatgaccaac

SEQ ID NO: 176624 - DNA, 20 bp, Artificial Sequence
  chemically synthesized
gctgaaatgctagttggtca

SEQ ID NO: 176625 - DNA, 20 bp, Artificial Sequence
  chemically synthesized
tagttggtcatagaaaatga

SEQ ID NO: 176626 - DNA, 20 bp, Artificial Sequence
  chemically synthesized
atagaaaatgaaagtaatat

SEQ ID NO: 176627 - DNA, 20 bp, Artificial Sequence
  chemically synthesized
gaaaatgaaagtaatatcag

SEQ ID NO: 176628 - DNA, 20 bp, Artificial Sequence
  chemically synthesized
tgaaagtaatatcagcggaa

SEQ ID NO: 176629 - DNA, 20 bp, Artificial Sequence
  chemically synthesized
gaaagtaatatcagcggaat

SEQ ID NO: 176630 - DNA, 20 bp, Artificial Sequence
  chemically synthesized
aagtaatatcagcggaatag

SEQ ID NO: 176631 - DNA, 20 bp, Artificial Sequence
  chemically synthesized
gtaatatcagcggaatagga

SEQ ID NO: 176632 - DNA, 20 bp, Artificial Sequence
  chemically synthesized
atatcagcggaataggagag

SEQ ID NO: 176633 - DNA, 20 bp, Artificial Sequence
  chemically synthesized
tcagcggaataggagagcag

SEQ ID NO: 176634 - DNA, 20 bp, Artificial Sequence
  chemically synthesized
tggaaggcacagaggatttt

SEQ ID NO: 176635 - DNA, 20 bp, Artificial Sequence
  chemically synthesized
ggctctcgtggaaggcacag

SEQ ID NO: 176636 - DNA, 20 bp, Artificial Sequence
  chemically synthesized
tggctctcgtggaaggcaca

SEQ ID NO: 176637 - DNA, 20 bp, Artificial Sequence
  chemically synthesized
aatggctctcgtggaaggca

SEQ ID NO: 176638 - DNA, 20 bp, Artificial Sequence
  chemically synthesized
aaatcctctgtgccttccac

SEQ ID NO: 176639 - DNA, 20 bp, Artificial Sequence
  chemically synthesized
atcctctgtgccttccacga

SEQ ID NO: 176640 - DNA, 20 bp, Artificial Sequence
  chemically synthesized
aaccaaatggctctcgtgga

SEQ ID NO: 176641 - DNA, 20 bp, Artificial Sequence
  chemically synthesized
caaccaaatggctctcgtgg

SEQ ID NO: 176642 - DNA, 20 bp, Artificial Sequence
  chemically synthesized
agacaaccaaatggctctcg

SEQ ID NO: 176643 - DNA, 20 bp, Artificial Sequence
  chemically synthesized
tgccttccacgagagccatt

SEQ ID NO: 176644 - DNA, 20 bp, Artificial Sequence
  chemically synthesized
gaggcagcaagacaaccaaa

SEQ ID NO: 176645 - DNA, 20 bp, Artificial Sequence
  chemically synthesized
agaggagagttagaggcagc

SEQ ID NO: 176646 - DNA, 20 bp, Artificial Sequence
  chemically synthesized
aaggagaggagagttagagg

SEQ ID NO: 176647 - DNA, 20 bp, Artificial Sequence
  chemically synthesized
gtgaaggagaggagagttag

SEQ ID NO: 176648 - DNA, 20 bp, Artificial Sequence
  chemically synthesized
ggtgaaggagaggagagtta

SEQ ID NO: 176649 - DNA, 20 bp, Artificial Sequence
  chemically synthesized
caggtgaaggagaggagagt

SEQ ID NO: 176650 - DNA, 20 bp, Artificial Sequence
  chemically synthesized
gcaacaggtgaaggagagga

SEQ ID NO: 176651 - DNA, 20 bp, Artificial Sequence
  chemically synthesized
atgcaacaggtgaaggagag

SEQ ID NO: 176652 - DNA, 20 bp, Artificial Sequence
  chemically synthesized
gaatgcaacaggtgaaggag

SEQ ID NO: 176653 - DNA, 20 bp, Artificial Sequence
  chemically synthesized
tgaatgcaacaggtgaagga

SEQ ID NO: 176654 - DNA, 20 bp, Artificial Sequence
  chemically synthesized
tatgaatgcaacaggtgaag

SEQ ID NO: 176655 - DNA, 20 bp, Artificial Sequence
  chemically synthesized
attatgaatgcaacaggtga

SEQ ID NO: 176656 - DNA, 20 bp, Artificial Sequence
  chemically synthesized
tattatgaatgcaacaggtg

SEQ ID NO: 176657 - DNA, 20 bp, Artificial Sequence
  chemically synthesized
gctactattatgaatgcaac

SEQ ID NO: 176658 - DNA, 20 bp, Artificial Sequence
  chemically synthesized
tgctactattatgaatgcaa

SEQ ID NO: 176659 - DNA, 20 bp, Artificial Sequence
  chemically synthesized
ttcacctgttgcattcataa

SEQ ID NO: 176660 - DNA, 20 bp, Artificial Sequence
  chemically synthesized
acctgttgcattcataatag

SEQ ID NO: 176661 - DNA, 20 bp, Artificial Sequence
  chemically synthesized
gcattcataatagtagcaca

SEQ ID NO: 176662 - DNA, 20 bp, Artificial Sequence
  chemically synthesized
cataatagtagcacatagtt

SEQ ID NO: 176663 - DNA, 20 bp, Artificial Sequence
  chemically synthesized
catagttcagctttctcccc

SEQ ID NO: 176664 - DNA, 20 bp, Artificial Sequence
  chemically synthesized
aaatatggctcttggggaga

SEQ ID NO: 176665 - DNA, 20 bp, Artificial Sequence
  chemically synthesized
tagttcagctttctccccaa

SEQ ID NO: 176666 - DNA, 20 bp, Artificial Sequence
  chemically synthesized
ttgtaaatatggctcttggg

SEQ ID NO: 176667 - DNA, 20 bp, Artificial Sequence
  chemically synthesized
agttgtaaatatggctcttg

SEQ ID NO: 176668 - DNA, 20 bp, Artificial Sequence
  chemically synthesized
aagttgtaaatatggctctt

SEQ ID NO: 176669 - DNA, 20 bp, Artificial Sequence
  chemically synthesized
aaagttgtaaatatggctct

SEQ ID NO: 176670 - DNA, 20 bp, Artificial Sequence
  chemically synthesized
cttaatcaaagttgtaaata

SEQ ID NO: 176671 - DNA, 20 bp, Artificial Sequence
  chemically synthesized
ccatatttacaactttgatt

SEQ ID NO: 176672 - DNA, 20 bp, Artificial Sequence
  chemically synthesized
aagtctcaccttcttaatca

SEQ ID NO: 176673 - DNA, 20 bp, Artificial Sequence
  chemically synthesized
tatttacaactttgattaag

SEQ ID NO: 176674 - DNA, 20 bp, Artificial Sequence
  chemically synthesized
atttacaactttgattaaga

SEQ ID NO: 176675 - DNA, 20 bp, Artificial Sequence
  chemically synthesized
acaactttgattaagaaggt

SEQ ID NO: 176676 - DNA, 20 bp, Artificial Sequence
  chemically synthesized
gattaagaaggtgagacttt

SEQ ID NO: 176677 - DNA, 20 bp, Artificial Sequence
  chemically synthesized
ttaagaaggtgagacttttg

SEQ ID NO: 176678 - DNA, 20 bp, Artificial Sequence
  chemically synthesized
ctcacctccaaattctccaa

SEQ ID NO: 176679 - DNA, 20 bp, Artificial Sequence
  chemically synthesized
ggtgagacttttggagaatt

SEQ ID NO: 176680 - DNA, 20 bp, Artificial Sequence
  chemically synthesized
tgagacttttggagaatttg

SEQ ID NO: 176681 - DNA, 20 bp, Artificial Sequence
  chemically synthesized
gagacttttggagaatttgg

SEQ ID NO: 176682 - DNA, 20 bp, Artificial Sequence
  chemically synthesized
cttttggagaatttggaggt

SEQ ID NO: 176683 - DNA, 20 bp, Artificial Sequence
  chemically synthesized
gagaatttggaggtgagaat

SEQ ID NO: 176684 - DNA, 20 bp, Artificial Sequence
  chemically synthesized
gaatttggaggtgagaatca

SEQ ID NO: 176685 - DNA, 20 bp, Artificial Sequence
  chemically synthesized
aatagaaaaatgcaaagagc

SEQ ID NO: 176686 - DNA, 20 bp, Artificial Sequence
  chemically synthesized
ctaaaatagaaaaatgcaaa

SEQ ID NO: 176687 - DNA, 20 bp, Artificial Sequence
  chemically synthesized
tactaaaatagaaaaatgca

SEQ ID NO: 176688 - DNA, 20 bp, Artificial Sequence
  chemically synthesized
ctctttgcatttttctattt

SEQ ID NO: 176689 - DNA, 20 bp, Artificial Sequence
  chemically synthesized
cagtaggagtaatactaaaa

SEQ ID NO: 176690 - DNA, 20 bp, Artificial Sequence
  chemically synthesized
tgttagattaaaaacagtag

SEQ ID NO: 176691 - DNA, 20 bp, Artificial Sequence
  chemically synthesized
aatgttagattaaaaacagt

SEQ ID NO: 176692 - DNA, 20 bp, Artificial Sequence
  chemically synthesized
aaatgttagattaaaaacag

SEQ ID NO: 176693 - DNA, 20 bp, Artificial Sequence
  chemically synthesized
aaaaaatgttagattaaaaa

SEQ ID NO: 176694 - DNA, 20 bp, Artificial Sequence
  chemically synthesized
tgtaattgctcaaaaaatgt

SEQ ID NO: 176695 - DNA, 20 bp, Artificial Sequence
  chemically synthesized
tttttaatctaacatttttt

SEQ ID NO: 176696 - DNA, 20 bp, Artificial Sequence
  chemically synthesized
tttgagcaattacaatatgc

SEQ ID NO: 176697 - DNA, 20 bp, Artificial Sequence
  chemically synthesized
gaaatgtgtaacacagtatc

SEQ ID NO: 176698 - DNA, 20 bp, Artificial Sequence
  chemically synthesized
taaatgggaaatgtgtaaca

SEQ ID NO: 176699 - DNA, 20 bp, Artificial Sequence
  chemically synthesized
aattcaatgaggtagtaaat

SEQ ID NO: 176700 - DNA, 20 bp, Artificial Sequence
  chemically synthesized
aaattcaatgaggtagtaaa

SEQ ID NO: 176701 - DNA, 20 bp, Artificial Sequence
  chemically synthesized
gtggtgaaaattcaatgagg

SEQ ID NO: 176702 - DNA, 20 bp, Artificial Sequence
  chemically synthesized
gttgtggtgaaaattcaatg

SEQ ID NO: 176703 - DNA, 20 bp, Artificial Sequence
  chemically synthesized
ggttgtggtgaaaattcaat

SEQ ID NO: 176704 - DNA, 20 bp, Artificial Sequence
  chemically synthesized
attgaattttcaccacaacc

SEQ ID NO: 176705 - DNA, 20 bp, Artificial Sequence
  chemically synthesized
ttgaattttcaccacaacct

SEQ ID NO: 176706 - DNA, 20 bp, Artificial Sequence
  chemically synthesized
tgaattttcaccacaacctg

SEQ ID NO: 176707 - DNA, 20 bp, Artificial Sequence
  chemically synthesized
gaagacacttccccaggttg

SEQ ID NO: 176708 - DNA, 20 bp, Artificial Sequence
  chemically synthesized
attttcaccacaacctgggg

SEQ ID NO: 176709 - DNA, 20 bp, Artificial Sequence
  chemically synthesized
ctaaaagaagacacttcccc

SEQ ID NO: 176710 - DNA, 20 bp, Artificial Sequence
  chemically synthesized
actaaaagaagacacttccc

SEQ ID NO: 176711 - DNA, 20 bp, Artificial Sequence
  chemically synthesized
cctggggaagtgtcttcttt

SEQ ID NO: 176712 - DNA, 20 bp, Artificial Sequence
  chemically synthesized
taaaattcaaatactaaaag

SEQ ID NO: 176713 - DNA, 20 bp, Artificial Sequence
  chemically synthesized
ccataaaattcaaatactaa

SEQ ID NO: 176714 - DNA, 20 bp, Artificial Sequence
  chemically synthesized
cttttagtatttgaatttta

SEQ ID NO: 176715 - DNA, 20 bp, Artificial Sequence
  chemically synthesized
attttatggatgttataact

SEQ ID NO: 176716 - DNA, 20 bp, Artificial Sequence
  chemically synthesized
ttttatggatgttataactt

SEQ ID NO: 176717 - DNA, 20 bp, Artificial Sequence
  chemically synthesized
tggatgttataacttaggta

SEQ ID NO: 176718 - DNA, 20 bp, Artificial Sequence
  chemically synthesized
tacctactctgtccatacct

SEQ ID NO: 176719 - DNA, 20 bp, Artificial Sequence
  chemically synthesized
tgttataacttaggtatgga

SEQ ID NO: 176720 - DNA, 20 bp, Artificial Sequence
  chemically synthesized
ttataacttaggtatggaca

SEQ ID NO: 176721 - DNA, 20 bp, Artificial Sequence
  chemically synthesized
taacttaggtatggacagag

SEQ ID NO: 176722 - DNA, 20 bp, Artificial Sequence
  chemically synthesized
aacttaggtatggacagagt

SEQ ID NO: 176723 - DNA, 20 bp, Artificial Sequence
  chemically synthesized
ggtatggacagagtaggtat

SEQ ID NO: 176724 - DNA, 20 bp, Artificial Sequence
  chemically synthesized
agagtaggtataagatcaca

SEQ ID NO: 176725 - DNA, 20 bp, Artificial Sequence
  chemically synthesized
taggtataagatcacatagc

SEQ ID NO: 176726 - DNA, 20 bp, Artificial Sequence
  chemically synthesized
gtataagatcacatagctgg

SEQ ID NO: 176727 - DNA, 20 bp, Artificial Sequence
  chemically synthesized
aagatcacatagctggtagc

SEQ ID NO: 176728 - DNA, 20 bp, Artificial Sequence
  chemically synthesized
ttatggattccacttgctac

SEQ ID NO: 176729 - DNA, 20 bp, Artificial Sequence
  chemically synthesized
atcacatagctggtagcaag

SEQ ID NO: 176730 - DNA, 20 bp, Artificial Sequence
  chemically synthesized
aatgatgagattatgaatta

SEQ ID NO: 176731 - DNA, 20 bp, Artificial Sequence
  chemically synthesized
ttactgcaggcattaatgat

SEQ ID NO: 176732 - DNA, 20 bp, Artificial Sequence
  chemically synthesized
aatctcatcattaatgcctg

SEQ ID NO: 176733 - DNA, 20 bp, Artificial Sequence
  chemically synthesized
atgaggaggtaatttactgc

SEQ ID NO: 176734 - DNA, 20 bp, Artificial Sequence
  chemically synthesized
gatgaggaggtaatttactg

SEQ ID NO: 176735 - DNA, 20 bp, Artificial Sequence
  chemically synthesized
agtaaacaggagtgatgagg

SEQ ID NO: 176736 - DNA, 20 bp, Artificial Sequence
  chemically synthesized
aagtaaacaggagtgatgag

SEQ ID NO: 176737 - DNA, 20 bp, Artificial Sequence
  chemically synthesized
aaaagtaaacaggagtgatg

SEQ ID NO: 176738 - DNA, 20 bp, Artificial Sequence
  chemically synthesized
aaaaagtaaacaggagtgat

SEQ ID NO: 176739 - DNA, 20 bp, Artificial Sequence
  chemically synthesized
aacaaggaaaaagtaaacag

SEQ ID NO: 176740 - DNA, 20 bp, Artificial Sequence
  chemically synthesized
caaacaaggaaaaagtaaac

SEQ ID NO: 176741 - DNA, 20 bp, Artificial Sequence
  chemically synthesized
acaaacaaggaaaaagtaaa

SEQ ID NO: 176742 - DNA, 20 bp, Artificial Sequence
  chemically synthesized
acactttacaaacaaggaaa

SEQ ID NO: 176743 - DNA, 20 bp, Artificial Sequence
  chemically synthesized
gatcagacactttacaaaca

SEQ ID NO: 176744 - DNA, 20 bp, Artificial Sequence
  chemically synthesized
ttactttttccttgtttgta

SEQ ID NO: 176745 - DNA, 20 bp, Artificial Sequence
  chemically synthesized
ggatcagacactttacaaac

SEQ ID NO: 176746 - DNA, 20 bp, Artificial Sequence
  chemically synthesized
gcaatgccaagaatatggat

SEQ ID NO: 176747 - DNA, 20 bp, Artificial Sequence
  chemically synthesized
aagtgtctgatccatattct

SEQ ID NO: 176748 - DNA, 20 bp, Artificial Sequence
  chemically synthesized
tataggcaatgccaagaata

SEQ ID NO: 176749 - DNA, 20 bp, Artificial Sequence
  chemically synthesized
aataccatataggcaatgcc

SEQ ID NO: 176750 - DNA, 20 bp, Artificial Sequence
  chemically synthesized
tattcttggcattgcctata

SEQ ID NO: 176751 - DNA, 20 bp, Artificial Sequence
  chemically synthesized
tatgtactataataccatat

SEQ ID NO: 176752 - DNA, 20 bp, Artificial Sequence
  chemically synthesized
gtatgtactataataccata

SEQ ID NO: 176753 - DNA, 20 bp, Artificial Sequence
  chemically synthesized
gcattgcctatatggtatta

SEQ ID NO: 176754 - DNA, 20 bp, Artificial Sequence
  chemically synthesized
tatggtattatagtacatac

SEQ ID NO: 176755 - DNA, 20 bp, Artificial Sequence
  chemically synthesized
ccaggaacctggatagaaac

SEQ ID NO: 176756 - DNA, 20 bp, Artificial Sequence
  chemically synthesized
agtacatactggtttctatc

SEQ ID NO: 176757 - DNA, 20 bp, Artificial Sequence
  chemically synthesized
gtacatactggtttctatcc

SEQ ID NO: 176758 - DNA, 20 bp, Artificial Sequence
  chemically synthesized
ttatgagccaggaacctgga

SEQ ID NO: 176759 - DNA, 20 bp, Artificial Sequence
  chemically synthesized
ctggtttctatccaggttcc

SEQ ID NO: 176760 - DNA, 20 bp, Artificial Sequence
  chemically synthesized
ggtgttatgagccaggaacc

SEQ ID NO: 176761 - DNA, 20 bp, Artificial Sequence
  chemically synthesized
ggctatgggtgttatgagcc

SEQ ID NO: 176762 - DNA, 20 bp, Artificial Sequence
  chemically synthesized
gggctatgggtgttatgagc

SEQ ID NO: 176763 - DNA, 20 bp, Artificial Sequence
  chemically synthesized
acaagggctatgggtgttat

SEQ ID NO: 176764 - DNA, 20 bp, Artificial Sequence
  chemically synthesized
ttcctggctcataacaccca

SEQ ID NO: 176765 - DNA, 20 bp, Artificial Sequence
  chemically synthesized
aaaactgtaacaagggctat

SEQ ID NO: 176766 - DNA, 20 bp, Artificial Sequence
  chemically synthesized
aaaaactgtaacaagggcta

SEQ ID NO: 176767 - DNA, 20 bp, Artificial Sequence
  chemically synthesized
aacacccatagcccttgtta

SEQ ID NO: 176768 - DNA, 20 bp, Artificial Sequence
  chemically synthesized
ataacaaaaaactgtaacaa

SEQ ID NO: 176769 - DNA, 20 bp, Artificial Sequence
  chemically synthesized
tataacaaaaaactgtaaca

SEQ ID NO: 176770 - DNA, 20 bp, Artificial Sequence
  chemically synthesized
ttataacaaaaaactgtaac

SEQ ID NO: 176771 - DNA, 20 bp, Artificial Sequence
  chemically synthesized
acagttttttgttataatgt

SEQ ID NO: 176772 - DNA, 20 bp, Artificial Sequence
  chemically synthesized
tgttataatgttggttgcgt

SEQ ID NO: 176773 - DNA, 20 bp, Artificial Sequence
  chemically synthesized
gttataatgttggttgcgtt

SEQ ID NO: 176774 - DNA, 20 bp, Artificial Sequence
  chemically synthesized
atgttggttgcgttgggtct

SEQ ID NO: 176775 - DNA, 20 bp, Artificial Sequence
  chemically synthesized
tgttggttgcgttgggtctc

SEQ ID NO: 176776 - DNA, 20 bp, Artificial Sequence
  chemically synthesized
gttggttgcgttgggtctca

SEQ ID NO: 176777 - DNA, 20 bp, Artificial Sequence
  chemically synthesized
ttggttgcgttgggtctcag

SEQ ID NO: 176778 - DNA, 20 bp, Artificial Sequence
  chemically synthesized
gttgcgttgggtctcagggg

SEQ ID NO: 176779 - DNA, 20 bp, Artificial Sequence
  chemically synthesized
ttgcgttgggtctcaggggc

SEQ ID NO: 176780 - DNA, 20 bp, Artificial Sequence
  chemically synthesized
aaggtcagaggcctgcccct

SEQ ID NO: 176781 - DNA, 20 bp, Artificial Sequence
  chemically synthesized
ggagagcaggagaaggtcag

SEQ ID NO: 176782 - DNA, 20 bp, Artificial Sequence
  chemically synthesized
aggagagcaggagaaggtca

SEQ ID NO: 176783 - DNA, 20 bp, Artificial Sequence
  chemically synthesized
aaaggagagcaggagaaggt

SEQ ID NO: 176784 - DNA, 20 bp, Artificial Sequence
  chemically synthesized
agtgaaaggagagcaggaga

SEQ ID NO: 176785 - DNA, 20 bp, Artificial Sequence
  chemically synthesized
aagtgaaaggagagcaggag

SEQ ID NO: 176786 - DNA, 20 bp, Artificial Sequence
  chemically synthesized
ttaaagtgaaaggagagcag

SEQ ID NO: 176787 - DNA, 20 bp, Artificial Sequence
  chemically synthesized
cattaaagtgaaaggagagc

SEQ ID NO: 176788 - DNA, 20 bp, Artificial Sequence
  chemically synthesized
acattaaagtgaaaggagag

SEQ ID NO: 176789 - DNA, 20 bp, Artificial Sequence
  chemically synthesized
ggaacattaaagtgaaagga

SEQ ID NO: 176790 - DNA, 20 bp, Artificial Sequence
  chemically synthesized
agggaacattaaagtgaaag

SEQ ID NO: 176791 - DNA, 20 bp, Artificial Sequence
  chemically synthesized
cgagggaacattaaagtgaa

SEQ ID NO: 176792 - DNA, 20 bp, Artificial Sequence
  chemically synthesized
gcgagggaacattaaagtga

SEQ ID NO: 176793 - DNA, 20 bp, Artificial Sequence
  chemically synthesized
tgaaaggcgagggaacatta

SEQ ID NO: 176794 - DNA, 20 bp, Artificial Sequence
  chemically synthesized
acctataatctgaaaggcga

SEQ ID NO: 176795 - DNA, 20 bp, Artificial Sequence
  chemically synthesized
tttaatgttccctcgccttt

SEQ ID NO: 176796 - DNA, 20 bp, Artificial Sequence
  chemically synthesized
gacctataatctgaaaggcg

SEQ ID NO: 176797 - DNA, 20 bp, Artificial Sequence
  chemically synthesized
agacctataatctgaaaggc

SEQ ID NO: 176798 - DNA, 20 bp, Artificial Sequence
  chemically synthesized
tttaagacctataatctgaa

SEQ ID NO: 176799 - DNA, 20 bp, Artificial Sequence
  chemically synthesized
ttttaagacctataatctga

SEQ ID NO: 176800 - DNA, 20 bp, Artificial Sequence
  chemically synthesized
ttccctcgcctttcagatta

SEQ ID NO: 176801 - DNA, 20 bp, Artificial Sequence
  chemically synthesized
tccctcgcctttcagattat

SEQ ID NO: 176802 - DNA, 20 bp, Artificial Sequence
  chemically synthesized
ccctctaacaggaggttttt

SEQ ID NO: 176803 - DNA, 20 bp, Artificial Sequence
  chemically synthesized
aggtcttaaaaacctcctgt

SEQ ID NO: 176804 - DNA, 20 bp, Artificial Sequence
  chemically synthesized
gtcttaaaaacctcctgtta

SEQ ID NO: 176805 - DNA, 20 bp, Artificial Sequence
  chemically synthesized
tggtgggaccctctaacagg

SEQ ID NO: 176806 - DNA, 20 bp, Artificial Sequence
  chemically synthesized
tcttaaaaacctcctgttag

SEQ ID NO: 176807 - DNA, 20 bp, Artificial Sequence
  chemically synthesized
atggtgggaccctctaacag

SEQ ID NO: 176808 - DNA, 20 bp, Artificial Sequence
  chemically synthesized
cttaaaaacctcctgttaga

SEQ ID NO: 176809 - DNA, 20 bp, Artificial Sequence
  chemically synthesized
atatggtgggaccctctaac

SEQ ID NO: 176810 - DNA, 20 bp, Artificial Sequence
  chemically synthesized
tatatggtgggaccctctaa

SEQ ID NO: 176811 - DNA, 20 bp, Artificial Sequence
  chemically synthesized
cttccccaagggtatatggt

SEQ ID NO: 176812 - DNA, 20 bp, Artificial Sequence
  chemically synthesized
ccttccccaagggtatatgg

SEQ ID NO: 176813 - DNA, 20 bp, Artificial Sequence
  chemically synthesized
attccttccccaagggtata

SEQ ID NO: 176814 - DNA, 20 bp, Artificial Sequence
  chemically synthesized
agggtcccaccatataccct

SEQ ID NO: 176815 - DNA, 20 bp, Artificial Sequence
  chemically synthesized
gggtcccaccatataccctt

SEQ ID NO: 176816 - DNA, 20 bp, Artificial Sequence
  chemically synthesized
ggtcccaccatatacccttg

SEQ ID NO: 176817 - DNA, 20 bp, Artificial Sequence
  chemically synthesized
cccaccatatacccttgggg

SEQ ID NO: 176818 - DNA, 20 bp, Artificial Sequence
  chemically synthesized
ccaccatatacccttgggga

SEQ ID NO: 176819 - DNA, 20 bp, Artificial Sequence
  chemically synthesized
catcagcattccttccccaa

SEQ ID NO: 176820 - DNA, 20 bp, Artificial Sequence
  chemically synthesized
acatcagcattccttcccca

SEQ ID NO: 176821 - DNA, 20 bp, Artificial Sequence
  chemically synthesized
gacatcagcattccttcccc

SEQ ID NO: 176822 - DNA, 20 bp, Artificial Sequence
  chemically synthesized
ttatggaagcttcatgacat

SEQ ID NO: 176823 - DNA, 20 bp, Artificial Sequence
  chemically synthesized
gaaggaatgctgatgtcatg

SEQ ID NO: 176824 - DNA, 20 bp, Artificial Sequence
  chemically synthesized
gtcctctttgttttttatgg

SEQ ID NO: 176825 - DNA, 20 bp, Artificial Sequence
  chemically synthesized
tctgtcctctttgtttttta

SEQ ID NO: 176826 - DNA, 20 bp, Artificial Sequence
  chemically synthesized
tgaagcttccataaaaaaca

SEQ ID NO: 176827 - DNA, 20 bp, Artificial Sequence
  chemically synthesized
aagcttccataaaaaacaaa

SEQ ID NO: 176828 - DNA, 20 bp, Artificial Sequence
  chemically synthesized
agcttccataaaaaacaaag

SEQ ID NO: 176829 - DNA, 20 bp, Artificial Sequence
  chemically synthesized
tccataaaaaacaaagagga

SEQ ID NO: 176830 - DNA, 20 bp, Artificial Sequence
  chemically synthesized
cataaaaaacaaagaggaca

SEQ ID NO: 176831 - DNA, 20 bp, Artificial Sequence
  chemically synthesized
aaaacaaagaggacagagtc

SEQ ID NO: 176832 - DNA, 20 bp, Artificial Sequence
  chemically synthesized
caaagaggacagagtccagt

SEQ ID NO: 176833 - DNA, 20 bp, Artificial Sequence
  chemically synthesized
tcagctacccggaagctcac

SEQ ID NO: 176834 - DNA, 20 bp, Artificial Sequence
  chemically synthesized
gacagagtccagtgagcttc

SEQ ID NO: 176835 - DNA, 20 bp, Artificial Sequence
  chemically synthesized
acagagtccagtgagcttcc

SEQ ID NO: 176836 - DNA, 20 bp, Artificial Sequence
  chemically synthesized
gagtccagtgagcttccggg

SEQ ID NO: 176837 - DNA, 20 bp, Artificial Sequence
  chemically synthesized
ccacctgttcagctacccgg

SEQ ID NO: 176838 - DNA, 20 bp, Artificial Sequence
  chemically synthesized
tccccacctgttcagctacc

SEQ ID NO: 176839 - DNA, 20 bp, Artificial Sequence
  chemically synthesized
tgagcttccgggtagctgaa

SEQ ID NO: 176840 - DNA, 20 bp, Artificial Sequence
  chemically synthesized
gagcttccgggtagctgaac

SEQ ID NO: 176841 - DNA, 20 bp, Artificial Sequence
  chemically synthesized
cttccgggtagctgaacagg

SEQ ID NO: 176842 - DNA, 20 bp, Artificial Sequence
  chemically synthesized
ttccgggtagctgaacaggt

SEQ ID NO: 176843 - DNA, 20 bp, Artificial Sequence
  chemically synthesized
tctaggaatccccacctgtt

SEQ ID NO: 176844 - DNA, 20 bp, Artificial Sequence
  chemically synthesized
tccgggtagctgaacaggtg

SEQ ID NO: 176845 - DNA, 20 bp, Artificial Sequence
  chemically synthesized
gctgaacaggtggggattcc

SEQ ID NO: 176846 - DNA, 20 bp, Artificial Sequence
  chemically synthesized
tgaacaggtggggattccta

SEQ ID NO: 176847 - DNA, 20 bp, Artificial Sequence
  chemically synthesized
gaacaggtggggattcctag

SEQ ID NO: 176848 - DNA, 20 bp, Artificial Sequence
  chemically synthesized
aacaggtggggattcctaga

SEQ ID NO: 176849 - DNA, 20 bp, Artificial Sequence
  chemically synthesized
aggtggggattcctagaggg

SEQ ID NO: 176850 - DNA, 20 bp, Artificial Sequence
  chemically synthesized
ccctgagtgcaccaccctct

SEQ ID NO: 176851 - DNA, 20 bp, Artificial Sequence
  chemically synthesized
tccctgagtgcaccaccctc

SEQ ID NO: 176852 - DNA, 20 bp, Artificial Sequence
  chemically synthesized
ttcctagagggtggtgcact

SEQ ID NO: 176853 - DNA, 20 bp, Artificial Sequence
  chemically synthesized
tcctagagggtggtgcactc

SEQ ID NO: 176854 - DNA, 20 bp, Artificial Sequence
  chemically synthesized
cctagagggtggtgcactca

SEQ ID NO: 176855 - DNA, 20 bp, Artificial Sequence
  chemically synthesized
tagagggtggtgcactcagg

SEQ ID NO: 176856 - DNA, 20 bp, Artificial Sequence
  chemically synthesized
agagggtggtgcactcaggg

SEQ ID NO: 176857 - DNA, 20 bp, Artificial Sequence
  chemically synthesized
gagggtggtgcactcaggga

SEQ ID NO: 176858 - DNA, 20 bp, Artificial Sequence
  chemically synthesized
ggagcttccatgccctccct

SEQ ID NO: 176859 - DNA, 20 bp, Artificial Sequence
  chemically synthesized
tggtgcactcagggagggca

SEQ ID NO: 176860 - DNA, 20 bp, Artificial Sequence
  chemically synthesized
tgcactcagggagggcatgg

SEQ ID NO: 176861 - DNA, 20 bp, Artificial Sequence
  chemically synthesized
gagggacggaaaggggcatg

SEQ ID NO: 176862 - DNA, 20 bp, Artificial Sequence
  chemically synthesized
tggagggacggaaaggggca

SEQ ID NO: 176863 - DNA, 20 bp, Artificial Sequence
  chemically synthesized
tggggtggagggacggaaag

SEQ ID NO: 176864 - DNA, 20 bp, Artificial Sequence
  chemically synthesized
ttggggtggagggacggaaa

SEQ ID NO: 176865 - DNA, 20 bp, Artificial Sequence
  chemically synthesized
gttggggtggagggacggaa

SEQ ID NO: 176866 - DNA, 20 bp, Artificial Sequence
  chemically synthesized
ggttggggtggagggacgga

SEQ ID NO: 176867 - DNA, 20 bp, Artificial Sequence
  chemically synthesized
gtatggttggggtggaggga

SEQ ID NO: 176868 - DNA, 20 bp, Artificial Sequence
  chemically synthesized
tgaggtatggttggggtgga

SEQ ID NO: 176869 - DNA, 20 bp, Artificial Sequence
  chemically synthesized
gtgaggtatggttggggtgg

SEQ ID NO: 176870 - DNA, 20 bp, Artificial Sequence
  chemically synthesized
ggtgaggtatggttggggtg

SEQ ID NO: 176871 - DNA, 20 bp, Artificial Sequence
  chemically synthesized
agggtgaggtatggttgggg

SEQ ID NO: 176872 - DNA, 20 bp, Artificial Sequence
  chemically synthesized
catagggtgaggtatggttg

SEQ ID NO: 176873 - DNA, 20 bp, Artificial Sequence
  chemically synthesized
gcatagggtgaggtatggtt

SEQ ID NO: 176874 - DNA, 20 bp, Artificial Sequence
  chemically synthesized
tgcatagggtgaggtatggt

SEQ ID NO: 176875 - DNA, 20 bp, Artificial Sequence
  chemically synthesized
gagatgcatagggtgaggta

SEQ ID NO: 176876 - DNA, 20 bp, Artificial Sequence
  chemically synthesized
atgaagagatgcatagggtg

SEQ ID NO: 176877 - DNA, 20 bp, Artificial Sequence
  chemically synthesized
gatgaagagatgcatagggt

SEQ ID NO: 176878 - DNA, 20 bp, Artificial Sequence
  chemically synthesized
cacagatgaagagatgcata

SEQ ID NO: 176879 - DNA, 20 bp, Artificial Sequence
  chemically synthesized
acacagatgaagagatgcat

SEQ ID NO: 176880 - DNA, 20 bp, Artificial Sequence
  chemically synthesized
gacacagatgaagagatgca

SEQ ID NO: 176881 - DNA, 20 bp, Artificial Sequence
  chemically synthesized
ttgcaaaggacacagatgaa

SEQ ID NO: 176882 - DNA, 20 bp, Artificial Sequence
  chemically synthesized
tattgcaaaggacacagatg

SEQ ID NO: 176883 - DNA, 20 bp, Artificial Sequence
  chemically synthesized
aaaggatattgcaaaggaca

SEQ ID NO: 176884 - DNA, 20 bp, Artificial Sequence
  chemically synthesized
tatgataaaggatattgcaa

SEQ ID NO: 176885 - DNA, 20 bp, Artificial Sequence
  chemically synthesized
ttatgataaaggatattgca

SEQ ID NO: 176886 - DNA, 20 bp, Artificial Sequence
  chemically synthesized
ctttcacctgtttatgataa

SEQ ID NO: 176887 - DNA, 20 bp, Artificial Sequence
  chemically synthesized
gctttcacctgtttatgata

SEQ ID NO: 176888 - DNA, 20 bp, Artificial Sequence
  chemically synthesized
gcaatatcctttatcataaa

SEQ ID NO: 176889 - DNA, 20 bp, Artificial Sequence
  chemically synthesized
caatatcctttatcataaac

SEQ ID NO: 176890 - DNA, 20 bp, Artificial Sequence
  chemically synthesized
cctttatcataaacaggtga

SEQ ID NO: 176891 - DNA, 20 bp, Artificial Sequence
  chemically synthesized
tatcataaacaggtgaaagc

SEQ ID NO: 176892 - DNA, 20 bp, Artificial Sequence
  chemically synthesized
gtgaaagcgagtgttttcct

SEQ ID NO: 176893 - DNA, 20 bp, Artificial Sequence
  chemically synthesized
tggagcagctcacagaactc

SEQ ID NO: 176894 - DNA, 20 bp, Artificial Sequence
  chemically synthesized
ctggagcagctcacagaact

SEQ ID NO: 176895 - DNA, 20 bp, Artificial Sequence
  chemically synthesized
agtgttttcctgagttctgt

SEQ ID NO: 176896 - DNA, 20 bp, Artificial Sequence
  chemically synthesized
taacttgctggagcagctca

SEQ ID NO: 176897 - DNA, 20 bp, Artificial Sequence
  chemically synthesized
ctgagttctgtgagctgctc

SEQ ID NO: 176898 - DNA, 20 bp, Artificial Sequence
  chemically synthesized
gttctgtgagctgctccagc

SEQ ID NO: 176899 - DNA, 20 bp, Artificial Sequence
  chemically synthesized
gttcaactaacttgctggag

SEQ ID NO: 176900 - DNA, 20 bp, Artificial Sequence
  chemically synthesized
tgggttcaactaacttgctg

SEQ ID NO: 176901 - DNA, 20 bp, Artificial Sequence
  chemically synthesized
tgtgagctgctccagcaagt

SEQ ID NO: 176902 - DNA, 20 bp, Artificial Sequence
  chemically synthesized
tttgggttcaactaacttgc

SEQ ID NO: 176903 - DNA, 20 bp, Artificial Sequence
  chemically synthesized
cagcaagttagttgaaccca

SEQ ID NO: 176904 - DNA, 20 bp, Artificial Sequence
  chemically synthesized
gcaagttagttgaacccaaa

SEQ ID NO: 176905 - DNA, 20 bp, Artificial Sequence
  chemically synthesized
aagttagttgaacccaaaga

SEQ ID NO: 176906 - DNA, 20 bp, Artificial Sequence
  chemically synthesized
agttagttgaacccaaagag

SEQ ID NO: 176907 - DNA, 20 bp, Artificial Sequence
  chemically synthesized
gttagttgaacccaaagaga

SEQ ID NO: 176908 - DNA, 20 bp, Artificial Sequence
  chemically synthesized
gttcccatgaccctctcttt

SEQ ID NO: 176909 - DNA, 20 bp, Artificial Sequence
  chemically synthesized
ggttcccatgaccctctctt

SEQ ID NO: 176910 - DNA, 20 bp, Artificial Sequence
  chemically synthesized
tgaacccaaagagagggtca

SEQ ID NO: 176911 - DNA, 20 bp, Artificial Sequence
  chemically synthesized
gaacccaaagagagggtcat

SEQ ID NO: 176912 - DNA, 20 bp, Artificial Sequence
  chemically synthesized
gtcatgggaaccccaacttg

SEQ ID NO: 176913 - DNA, 20 bp, Artificial Sequence
  chemically synthesized
gacccatgggcttcaagttg

SEQ ID NO: 176914 - DNA, 20 bp, Artificial Sequence
  chemically synthesized
tgacccatgggcttcaagtt

SEQ ID NO: 176915 - DNA, 20 bp, Artificial Sequence
  chemically synthesized
ctgacccatgggcttcaagt

SEQ ID NO: 176916 - DNA, 20 bp, Artificial Sequence
  chemically synthesized
acttctgacccatgggcttc

SEQ ID NO: 176917 - DNA, 20 bp, Artificial Sequence
  chemically synthesized
gaaccccaacttgaagccca

SEQ ID NO: 176918 - DNA, 20 bp, Artificial Sequence
  chemically synthesized
aaccccaacttgaagcccat

SEQ ID NO: 176919 - DNA, 20 bp, Artificial Sequence
  chemically synthesized
ccaacttgaagcccatgggt

SEQ ID NO: 176920 - DNA, 20 bp, Artificial Sequence
  chemically synthesized
ctctggaacttctgacccat

SEQ ID NO: 176921 - DNA, 20 bp, Artificial Sequence
  chemically synthesized
cctctggaacttctgaccca

SEQ ID NO: 176922 - DNA, 20 bp, Artificial Sequence
  chemically synthesized
acttgaagcccatgggtcag

SEQ ID NO: 176923 - DNA, 20 bp, Artificial Sequence
  chemically synthesized
agcccatgggtcagaagttc

SEQ ID NO: 176924 - DNA, 20 bp, Artificial Sequence
  chemically synthesized
cccatgggtcagaagttcca

SEQ ID NO: 176925 - DNA, 20 bp, Artificial Sequence
  chemically synthesized
ccatgggtcagaagttccag

SEQ ID NO: 176926 - DNA, 20 bp, Artificial Sequence
  chemically synthesized
ggtcagaagttccagaggcc

SEQ ID NO: 176927 - DNA, 20 bp, Artificial Sequence
  chemically synthesized
cagtctcaagtccaggcctc

SEQ ID NO: 176928 - DNA, 20 bp, Artificial Sequence
  chemically synthesized
agttccagaggcctggactt

SEQ ID NO: 176929 - DNA, 20 bp, Artificial Sequence
  chemically synthesized
cacacaccagtctcaagtcc

SEQ ID NO: 176930 - DNA, 20 bp, Artificial Sequence
  chemically synthesized
acacacaccagtctcaagtc

SEQ ID NO: 176931 - DNA, 20 bp, Artificial Sequence
  chemically synthesized
cagaggcctggacttgagac

SEQ ID NO: 176932 - DNA, 20 bp, Artificial Sequence
  chemically synthesized
cacacacacacaccagtctc

SEQ ID NO: 176933 - DNA, 20 bp, Artificial Sequence
  chemically synthesized
acacacacacacacacacac

SEQ ID NO: 176934 - DNA, 20 bp, Artificial Sequence
  chemically synthesized
gtgtgtgcgcgcgcgtgcgc

SEQ ID NO: 176935 - DNA, 20 bp, Artificial Sequence
  chemically synthesized
tgtgtgcgcgcgcgtgcgct

SEQ ID NO: 176936 - DNA, 20 bp, Artificial Sequence
  chemically synthesized
gtgtgcgcgcgcgtgcgcta

SEQ ID NO: 176937 - DNA, 20 bp, Artificial Sequence
  chemically synthesized
tgtgcgcgcgcgtgcgctag

SEQ ID NO: 176938 - DNA, 20 bp, Artificial Sequence
  chemically synthesized
gtgcgcgcgcgtgcgctagg

SEQ ID NO: 176939 - DNA, 20 bp, Artificial Sequence
  chemically synthesized
tgcgcgcgcgtgcgctaggg

SEQ ID NO: 176940 - DNA, 20 bp, Artificial Sequence
  chemically synthesized
ctgcctcctctgcacccccc

SEQ ID NO: 176941 - DNA, 20 bp, Artificial Sequence
  chemically synthesized
gcgcgtgcgctaggggggtg

SEQ ID NO: 176942 - DNA, 20 bp, Artificial Sequence
  chemically synthesized
gcgtgcgctaggggggtgca

SEQ ID NO: 176943 - DNA, 20 bp, Artificial Sequence
  chemically synthesized
cgtgcgctaggggggtgcag

SEQ ID NO: 176944 - DNA, 20 bp, Artificial Sequence
  chemically synthesized
tgcgctaggggggtgcagag

SEQ ID NO: 176945 - DNA, 20 bp, Artificial Sequence
  chemically synthesized
gcgctaggggggtgcagagg

SEQ ID NO: 176946 - DNA, 20 bp, Artificial Sequence
  chemically synthesized
ctaggggggtgcagaggagg

SEQ ID NO: 176947 - DNA, 20 bp, Artificial Sequence
  chemically synthesized
ggtgcagaggaggcagacct

SEQ ID NO: 176948 - DNA, 20 bp, Artificial Sequence
  chemically synthesized
aggaggcagacctcggtact

SEQ ID NO: 176949 - DNA, 20 bp, Artificial Sequence
  chemically synthesized
agattgagggctcagtaccg

SEQ ID NO: 176950 - DNA, 20 bp, Artificial Sequence
  chemically synthesized
tagattgagggctcagtacc

SEQ ID NO: 176951 - DNA, 20 bp, Artificial Sequence
  chemically synthesized
gatcccatagattgagggct

SEQ ID NO: 176952 - DNA, 20 bp, Artificial Sequence
  chemically synthesized
tgtcagatcccatagattga

SEQ ID NO: 176953 - DNA, 20 bp, Artificial Sequence
  chemically synthesized
ggtactgagccctcaatcta

SEQ ID NO: 176954 - DNA, 20 bp, Artificial Sequence
  chemically synthesized
gtgtcagatcccatagattg

SEQ ID NO: 176955 - DNA, 20 bp, Artificial Sequence
  chemically synthesized
gtactgagccctcaatctat

SEQ ID NO: 176956 - DNA, 20 bp, Artificial Sequence
  chemically synthesized
agtgtcagatcccatagatt

SEQ ID NO: 176957 - DNA, 20 bp, Artificial Sequence
  chemically synthesized
agagatagtgtcagatccca

SEQ ID NO: 176958 - DNA, 20 bp, Artificial Sequence
  chemically synthesized
tatccacccagagatagtgt

SEQ ID NO: 176959 - DNA, 20 bp, Artificial Sequence
  chemically synthesized
atgggatctgacactatctc

SEQ ID NO: 176960 - DNA, 20 bp, Artificial Sequence
  chemically synthesized
tgggatctgacactatctct

SEQ ID NO: 176961 - DNA, 20 bp, Artificial Sequence
  chemically synthesized
tgacactatccacccagaga

SEQ ID NO: 176962 - DNA, 20 bp, Artificial Sequence
  chemically synthesized
gatctgacactatctctggg

SEQ ID NO: 176963 - DNA, 20 bp, Artificial Sequence
  chemically synthesized
gtcctgacactatccaccca

SEQ ID NO: 176964 - DNA, 20 bp, Artificial Sequence
  chemically synthesized
tgacactatctctgggtgga

SEQ ID NO: 176965 - DNA, 20 bp, Artificial Sequence
  chemically synthesized
cagtcctgacactatccacc

SEQ ID NO: 176966 - DNA, 20 bp, Artificial Sequence
  chemically synthesized
tatctctgggtggatagtgt

SEQ ID NO: 176967 - DNA, 20 bp, Artificial Sequence
  chemically synthesized
atctctgggtggatagtgtc

SEQ ID NO: 176968 - DNA, 20 bp, Artificial Sequence
  chemically synthesized
ggatagtgtcaggactgaat

SEQ ID NO: 176969 - DNA, 20 bp, Artificial Sequence
  chemically synthesized
atagtgtcaggactgaatta

SEQ ID NO: 176970 - DNA, 20 bp, Artificial Sequence
  chemically synthesized
ccagctgggtgtctctaatt

SEQ ID NO: 176971 - DNA, 20 bp, Artificial Sequence
  chemically synthesized
aggactgaattagagacacc

SEQ ID NO: 176972 - DNA, 20 bp, Artificial Sequence
  chemically synthesized
ctgaattagagacacccagc

SEQ ID NO: 176973 - DNA, 20 bp, Artificial Sequence
  chemically synthesized
ccaaacagcaggcaccagct

SEQ ID NO: 176974 - DNA, 20 bp, Artificial Sequence
  chemically synthesized
accaaacagcaggcaccagc

SEQ ID NO: 176975 - DNA, 20 bp, Artificial Sequence
  chemically synthesized
atacaccaaacagcaggcac

SEQ ID NO: 176976 - DNA, 20 bp, Artificial Sequence
  chemically synthesized
cccagctggtgcctgctgtt

SEQ ID NO: 176977 - DNA, 20 bp, Artificial Sequence
  chemically synthesized
ttccccatacaccaaacagc

SEQ ID NO: 176978 - DNA, 20 bp, Artificial Sequence
  chemically synthesized
tttccccatacaccaaacag

SEQ ID NO: 176979 - DNA, 20 bp, Artificial Sequence
  chemically synthesized
ttttttccccatacaccaaa

SEQ ID NO: 176980 - DNA, 20 bp, Artificial Sequence
  chemically synthesized
ggtgcctgctgtttggtgta

SEQ ID NO: 176981 - DNA, 20 bp, Artificial Sequence
  chemically synthesized
gtgcctgctgtttggtgtat

SEQ ID NO: 176982 - DNA, 20 bp, Artificial Sequence
  chemically synthesized
tgcctgctgtttggtgtatg

SEQ ID NO: 176983 - DNA, 20 bp, Artificial Sequence
  chemically synthesized
ggaaaaaaattccacaaatt

SEQ ID NO: 176984 - DNA, 20 bp, Artificial Sequence
  chemically synthesized
gacttttatgaccaaatttg

SEQ ID NO: 176985 - DNA, 20 bp, Artificial Sequence
  chemically synthesized
ttccacaaatttggtcataa

SEQ ID NO: 176986 - DNA, 20 bp, Artificial Sequence
  chemically synthesized
aacaatcgtcaacacagaag

SEQ ID NO: 176987 - DNA, 20 bp, Artificial Sequence
  chemically synthesized
cgtaacaatcgtcaacacag

SEQ ID NO: 176988 - DNA, 20 bp, Artificial Sequence
  chemically synthesized
aatcgtaacaatcgtcaaca

SEQ ID NO: 176989 - DNA, 20 bp, Artificial Sequence
  chemically synthesized
gttgacgattgttacgattt

SEQ ID NO: 176990 - DNA, 20 bp, Artificial Sequence
  chemically synthesized
tgacgattgttacgatttga

SEQ ID NO: 176991 - DNA, 20 bp, Artificial Sequence
  chemically synthesized
cgattgttacgatttgagag

SEQ ID NO: 176992 - DNA, 20 bp, Artificial Sequence
  chemically synthesized
attgttacgatttgagagta

SEQ ID NO: 176993 - DNA, 20 bp, Artificial Sequence
  chemically synthesized
ttgagagtagagaaaaaaca

SEQ ID NO: 176994 - DNA, 20 bp, Artificial Sequence
  chemically synthesized
gagtagagaaaaaacacggt

SEQ ID NO: 176995 - DNA, 20 bp, Artificial Sequence
  chemically synthesized
agagaaaaaacacggttaga

SEQ ID NO: 176996 - DNA, 20 bp, Artificial Sequence
  chemically synthesized
tagaaagaattttccataca

SEQ ID NO: 176997 - DNA, 20 bp, Artificial Sequence
  chemically synthesized
ttgaaatgttacgctgtgta

SEQ ID NO: 176998 - DNA, 20 bp, Artificial Sequence
  chemically synthesized
agcgtaacatttcaataatt

SEQ ID NO: 176999 - DNA, 20 bp, Artificial Sequence
  chemically synthesized
taacatttcaataatttgga

SEQ ID NO: 177000 - DNA, 20 bp, Artificial Sequence
  chemically synthesized
ctttaatgacaatagtatat

SEQ ID NO: 177001 - DNA, 20 bp, Artificial Sequence
  chemically synthesized
taatcactctttaatgacaa

SEQ ID NO: 177002 - DNA, 20 bp, Artificial Sequence
  chemically synthesized
cttatatactattgtcatta

SEQ ID NO: 177003 - DNA, 20 bp, Artificial Sequence
  chemically synthesized
tatatactattgtcattaaa

SEQ ID NO: 177004 - DNA, 20 bp, Artificial Sequence
  chemically synthesized
tcattaaagagtgattaatt

SEQ ID NO: 177005 - DNA, 20 bp, Artificial Sequence
  chemically synthesized
agtgattaattcggtaataa

SEQ ID NO: 177006 - DNA, 20 bp, Artificial Sequence
  chemically synthesized
aattcggtaataatggcaat

SEQ ID NO: 177007 - DNA, 20 bp, Artificial Sequence
  chemically synthesized
ataatggcaatcagatttct

SEQ ID NO: 177008 - DNA, 20 bp, Artificial Sequence
  chemically synthesized
tggcaatcagatttcttgga

SEQ ID NO: 177009 - DNA, 20 bp, Artificial Sequence
  chemically synthesized
ggcaatcagatttcttggat

SEQ ID NO: 177010 - DNA, 20 bp, Artificial Sequence
  chemically synthesized
ctgagaatttcggcctatcc

SEQ ID NO: 177011 - DNA, 20 bp, Artificial Sequence
  chemically synthesized
cttggataggccgaaattct

SEQ ID NO: 177012 - DNA, 20 bp, Artificial Sequence
  chemically synthesized
tttagttcagctgagaattt

SEQ ID NO: 177013 - DNA, 20 bp, Artificial Sequence
  chemically synthesized
cctaatactttagttcagct

SEQ ID NO: 177014 - DNA, 20 bp, Artificial Sequence
  chemically synthesized
cgaaattctcagctgaacta

SEQ ID NO: 177015 - DNA, 20 bp, Artificial Sequence
  chemically synthesized
accttcctaatactttagtt

SEQ ID NO: 177016 - DNA, 20 bp, Artificial Sequence
  chemically synthesized
tctcagctgaactaaagtat

SEQ ID NO: 177017 - DNA, 20 bp, Artificial Sequence
  chemically synthesized
ctcagctgaactaaagtatt

SEQ ID NO: 177018 - DNA, 20 bp, Artificial Sequence
  chemically synthesized
catctaccttcctaatactt

SEQ ID NO: 177019 - DNA, 20 bp, Artificial Sequence
  chemically synthesized
agctgaactaaagtattagg

SEQ ID NO: 177020 - DNA, 20 bp, Artificial Sequence
  chemically synthesized
gctgaactaaagtattagga

SEQ ID NO: 177021 - DNA, 20 bp, Artificial Sequence
  chemically synthesized
gaactaaagtattaggaagg

SEQ ID NO: 177022 - DNA, 20 bp, Artificial Sequence
  chemically synthesized
ggaaggtagatgatgatgac

SEQ ID NO: 177023 - DNA, 20 bp, Artificial Sequence
  chemically synthesized
gaaggtagatgatgatgaca

SEQ ID NO: 177024 - DNA, 20 bp, Artificial Sequence
  chemically synthesized
acaaggacgatgatgctact

SEQ ID NO: 177025 - DNA, 20 bp, Artificial Sequence
  chemically synthesized
atgattgcttttgttcttag

SEQ ID NO: 177026 - DNA, 20 bp, Artificial Sequence
  chemically synthesized
gatgatgctactaagaacaa

SEQ ID NO: 177027 - DNA, 20 bp, Artificial Sequence
  chemically synthesized
atcatgattgcttttgttct

SEQ ID NO: 177028 - DNA, 20 bp, Artificial Sequence
  chemically synthesized
aaaagcaatcatgataataa

SEQ ID NO: 177029 - DNA, 20 bp, Artificial Sequence
  chemically synthesized
tcatgataataatagttatt

SEQ ID NO: 177030 - DNA, 20 bp, Artificial Sequence
  chemically synthesized
taataatagttattgagcac

SEQ ID NO: 177031 - DNA, 20 bp, Artificial Sequence
  chemically synthesized
tagttattgagcactggacc

SEQ ID NO: 177032 - DNA, 20 bp, Artificial Sequence
  chemically synthesized
ttttagagctaggcttggtc

SEQ ID NO: 177033 - DNA, 20 bp, Artificial Sequence
  chemically synthesized
attgagcactggaccaagcc

SEQ ID NO: 177034 - DNA, 20 bp, Artificial Sequence
  chemically synthesized
caggcttttagagctaggct

SEQ ID NO: 177035 - DNA, 20 bp, Artificial Sequence
  chemically synthesized
aacatcaggcttttagagct

SEQ ID NO: 177036 - DNA, 20 bp, Artificial Sequence
  chemically synthesized
tggaccaagcctagctctaa

SEQ ID NO: 177037 - DNA, 20 bp, Artificial Sequence
  chemically synthesized
aaacatcaggcttttagagc

SEQ ID NO: 177038 - DNA, 20 bp, Artificial Sequence
  chemically synthesized
gaacaaacatcaggctttta

SEQ ID NO: 177039 - DNA, 20 bp, Artificial Sequence
  chemically synthesized
gagaacaaacatcaggcttt

SEQ ID NO: 177040 - DNA, 20 bp, Artificial Sequence
  chemically synthesized
tagttatgagaacaaacatc

SEQ ID NO: 177041 - DNA, 20 bp, Artificial Sequence
  chemically synthesized
ctagttatgagaacaaacat

SEQ ID NO: 177042 - DNA, 20 bp, Artificial Sequence
  chemically synthesized
ctgatgtttgttctcataac

SEQ ID NO: 177043 - DNA, 20 bp, Artificial Sequence
  chemically synthesized
gatgtttgttctcataacta

SEQ ID NO: 177044 - DNA, 20 bp, Artificial Sequence
  chemically synthesized
gagagggtcactctagttat

SEQ ID NO: 177045 - DNA, 20 bp, Artificial Sequence
  chemically synthesized
atatatagagagggtcactc

SEQ ID NO: 177046 - DNA, 20 bp, Artificial Sequence
  chemically synthesized
gaagataaaatatatagaga

SEQ ID NO: 177047 - DNA, 20 bp, Artificial Sequence
  chemically synthesized
agaagataaaatatatagag

SEQ ID NO: 177048 - DNA, 20 bp, Artificial Sequence
  chemically synthesized
tagaagataaaatatataga

SEQ ID NO: 177049 - DNA, 20 bp, Artificial Sequence
  chemically synthesized
tttagaagataaaatatata

SEQ ID NO: 177050 - DNA, 20 bp, Artificial Sequence
  chemically synthesized
actttagaagataaaatata

SEQ ID NO: 177051 - DNA, 20 bp, Artificial Sequence
  chemically synthesized
tctatatattttatcttcta

SEQ ID NO: 177052 - DNA, 20 bp, Artificial Sequence
  chemically synthesized
atatattttatcttctaaag

SEQ ID NO: 177053 - DNA, 20 bp, Artificial Sequence
  chemically synthesized
tcataagtattccactttag

SEQ ID NO: 177054 - DNA, 20 bp, Artificial Sequence
  chemically synthesized
ttgtcataagtattccactt

SEQ ID NO: 177055 - DNA, 20 bp, Artificial Sequence
  chemically synthesized
gctccctctttcattgtcat

SEQ ID NO: 177056 - DNA, 20 bp, Artificial Sequence
  chemically synthesized
tggaatacttatgacaatga

SEQ ID NO: 177057 - DNA, 20 bp, Artificial Sequence
  chemically synthesized
gaatacttatgacaatgaaa

SEQ ID NO: 177058 - DNA, 20 bp, Artificial Sequence
  chemically synthesized
aatacttatgacaatgaaag

SEQ ID NO: 177059 - DNA, 20 bp, Artificial Sequence
  chemically synthesized
atacttatgacaatgaaaga

SEQ ID NO: 177060 - DNA, 20 bp, Artificial Sequence
  chemically synthesized
acttatgacaatgaaagagg

SEQ ID NO: 177061 - DNA, 20 bp, Artificial Sequence
  chemically synthesized
tatcctatcataatttttaa

SEQ ID NO: 177062 - DNA, 20 bp, Artificial Sequence
  chemically synthesized
ggagctattaaaaattatga

SEQ ID NO: 177063 - DNA, 20 bp, Artificial Sequence
  chemically synthesized
gagctattaaaaattatgat

SEQ ID NO: 177064 - DNA, 20 bp, Artificial Sequence
  chemically synthesized
taaaaattatgataggataa

SEQ ID NO: 177065 - DNA, 20 bp, Artificial Sequence
  chemically synthesized
aaaaattatgataggataac

SEQ ID NO: 177066 - DNA, 20 bp, Artificial Sequence
  chemically synthesized
ataggataacaggcaaaaac

SEQ ID NO: 177067 - DNA, 20 bp, Artificial Sequence
  chemically synthesized
ataacaggcaaaaaccagaa

SEQ ID NO: 177068 - DNA, 20 bp, Artificial Sequence
  chemically synthesized
caggcaaaaaccagaacagt

SEQ ID NO: 177069 - DNA, 20 bp, Artificial Sequence
  chemically synthesized
tcaatttgctctgactgttc

SEQ ID NO: 177070 - DNA, 20 bp, Artificial Sequence
  chemically synthesized
ggcaaaaaccagaacagtca

SEQ ID NO: 177071 - DNA, 20 bp, Artificial Sequence
  chemically synthesized
cagaacagtcagagcaaatt

SEQ ID NO: 177072 - DNA, 20 bp, Artificial Sequence
  chemically synthesized
attactaggttgtgtgtcat

SEQ ID NO: 177073 - DNA, 20 bp, Artificial Sequence
  chemically synthesized
tgtactcatgacacacaacc

SEQ ID NO: 177074 - DNA, 20 bp, Artificial Sequence
  chemically synthesized
ctgacatgaggtttattact

SEQ ID NO: 177075 - DNA, 20 bp, Artificial Sequence
  chemically synthesized
actgacatgaggtttattac

SEQ ID NO: 177076 - DNA, 20 bp, Artificial Sequence
  chemically synthesized
cctagtaataaacctcatgt

SEQ ID NO: 177077 - DNA, 20 bp, Artificial Sequence
  chemically synthesized
tataatttcacactgacatg

SEQ ID NO: 177078 - DNA, 20 bp, Artificial Sequence
  chemically synthesized
ctataatttcacactgacat

SEQ ID NO: 177079 - DNA, 20 bp, Artificial Sequence
  chemically synthesized
ctcatgtcagtgtgaaatta

SEQ ID NO: 177080 - DNA, 20 bp, Artificial Sequence
  chemically synthesized
tcatgtcagtgtgaaattat

SEQ ID NO: 177081 - DNA, 20 bp, Artificial Sequence
  chemically synthesized
atgtcagtgtgaaattatag

SEQ ID NO: 177082 - DNA, 20 bp, Artificial Sequence
  chemically synthesized
tgtcagtgtgaaattatagg

SEQ ID NO: 177083 - DNA, 20 bp, Artificial Sequence
  chemically synthesized
gtgtgaaattataggaggca

SEQ ID NO: 177084 - DNA, 20 bp, Artificial Sequence
  chemically synthesized
aaattataggaggcaaagtc

SEQ ID NO: 177085 - DNA, 20 bp, Artificial Sequence
  chemically synthesized
aattataggaggcaaagtca

SEQ ID NO: 177086 - DNA, 20 bp, Artificial Sequence
  chemically synthesized
taatttaaagtttataacat

SEQ ID NO: 177087 - DNA, 20 bp, Artificial Sequence
  chemically synthesized
gggaagggagtagtaattta

SEQ ID NO: 177088 - DNA, 20 bp, Artificial Sequence
  chemically synthesized
tgagggttgggggaagggag

SEQ ID NO: 177089 - DNA, 20 bp, Artificial Sequence
  chemically synthesized
agctgagggttgggggaagg

SEQ ID NO: 177090 - DNA, 20 bp, Artificial Sequence
  chemically synthesized
gaagctgagggttgggggaa

SEQ ID NO: 177091 - DNA, 20 bp, Artificial Sequence
  chemically synthesized
tgaagctgagggttggggga

SEQ ID NO: 177092 - DNA, 20 bp, Artificial Sequence
  chemically synthesized
ttgaagctgagggttggggg

SEQ ID NO: 177093 - DNA, 20 bp, Artificial Sequence
  chemically synthesized
agtttgaagctgagggttgg

SEQ ID NO: 177094 - DNA, 20 bp, Artificial Sequence
  chemically synthesized
tactcccttcccccaaccct

SEQ ID NO: 177095 - DNA, 20 bp, Artificial Sequence
  chemically synthesized
cagtttgaagctgagggttg

SEQ ID NO: 177096 - DNA, 20 bp, Artificial Sequence
  chemically synthesized
acagtttgaagctgagggtt

SEQ ID NO: 177097 - DNA, 20 bp, Artificial Sequence
  chemically synthesized
aacagtttgaagctgagggt

SEQ ID NO: 177098 - DNA, 20 bp, Artificial Sequence
  chemically synthesized
gctaaacagtttgaagctga

SEQ ID NO: 177099 - DNA, 20 bp, Artificial Sequence
  chemically synthesized
tgctaaacagtttgaagctg

SEQ ID NO: 177100 - DNA, 20 bp, Artificial Sequence
  chemically synthesized
ttgctaaacagtttgaagct

SEQ ID NO: 177101 - DNA, 20 bp, Artificial Sequence
  chemically synthesized
tatagttgctaaacagtttg

SEQ ID NO: 177102 - DNA, 20 bp, Artificial Sequence
  chemically synthesized
accctcagcttcaaactgtt

SEQ ID NO: 177103 - DNA, 20 bp, Artificial Sequence
  chemically synthesized
tctaatttatagttgctaaa

SEQ ID NO: 177104 - DNA, 20 bp, Artificial Sequence
  chemically synthesized
actgtttagcaactataaat

SEQ ID NO: 177105 - DNA, 20 bp, Artificial Sequence
  chemically synthesized
tgtttagcaactataaatta

SEQ ID NO: 177106 - DNA, 20 bp, Artificial Sequence
  chemically synthesized
atattcatatctctaattta

SEQ ID NO: 177107 - DNA, 20 bp, Artificial Sequence
  chemically synthesized
atatgaatatttataatgcc

SEQ ID NO: 177108 - DNA, 20 bp, Artificial Sequence
  chemically synthesized
atgcataattttatagggct

SEQ ID NO: 177109 - DNA, 20 bp, Artificial Sequence
  chemically synthesized
aggacatgcataattttata

SEQ ID NO: 177110 - DNA, 20 bp, Artificial Sequence
  chemically synthesized
aaggacatgcataattttat

SEQ ID NO: 177111 - DNA, 20 bp, Artificial Sequence
  chemically synthesized
aaaggacatgcataatttta

SEQ ID NO: 177112 - DNA, 20 bp, Artificial Sequence
  chemically synthesized
attatgcatgtcctttaaat

SEQ ID NO: 177113 - DNA, 20 bp, Artificial Sequence
  chemically synthesized
ttatgcatgtcctttaaata

SEQ ID NO: 177114 - DNA, 20 bp, Artificial Sequence
  chemically synthesized
cccacccttcccttatttaa

SEQ ID NO: 177115 - DNA, 20 bp, Artificial Sequence
  chemically synthesized
tatgcatgtcctttaaataa

SEQ ID NO: 177116 - DNA, 20 bp, Artificial Sequence
  chemically synthesized
tcccacccttcccttattta

SEQ ID NO: 177117 - DNA, 20 bp, Artificial Sequence
  chemically synthesized
gcatgtcctttaaataaggg

SEQ ID NO: 177118 - DNA, 20 bp, Artificial Sequence
  chemically synthesized
catgtcctttaaataaggga

SEQ ID NO: 177119 - DNA, 20 bp, Artificial Sequence
  chemically synthesized
atgtcctttaaataagggaa

SEQ ID NO: 177120 - DNA, 20 bp, Artificial Sequence
  chemically synthesized
tcctttaaataagggaaggg

SEQ ID NO: 177121 - DNA, 20 bp, Artificial Sequence
  chemically synthesized
cctttaaataagggaagggt

SEQ ID NO: 177122 - DNA, 20 bp, Artificial Sequence
  chemically synthesized
ttaaataagggaagggtggg

SEQ ID NO: 177123 - DNA, 20 bp, Artificial Sequence
  chemically synthesized
ggaagtgattatgatatgct

SEQ ID NO: 177124 - DNA, 20 bp, Artificial Sequence
  chemically synthesized
tgattatgatatgcttagaa

SEQ ID NO: 177125 - DNA, 20 bp, Artificial Sequence
  chemically synthesized
tatgtgccacattctgttct

SEQ ID NO: 177126 - DNA, 20 bp, Artificial Sequence
  chemically synthesized
gatatgcttagaacagaatg

SEQ ID NO: 177127 - DNA, 20 bp, Artificial Sequence
  chemically synthesized
ttagaacagaatgtggcaca

SEQ ID NO: 177128 - DNA, 20 bp, Artificial Sequence
  chemically synthesized
gaacagaatgtggcacatag

SEQ ID NO: 177129 - DNA, 20 bp, Artificial Sequence
  chemically synthesized
ggcacatagtagtcctttaa

SEQ ID NO: 177130 - DNA, 20 bp, Artificial Sequence
  chemically synthesized
attcaagagctatctattaa

SEQ ID NO: 177131 - DNA, 20 bp, Artificial Sequence
  chemically synthesized
catagtagtcctttaataga

SEQ ID NO: 177132 - DNA, 20 bp, Artificial Sequence
  chemically synthesized
tattcaagagctatctatta

SEQ ID NO: 177133 - DNA, 20 bp, Artificial Sequence
  chemically synthesized
taattaaattatttattcaa

SEQ ID NO: 177134 - DNA, 20 bp, Artificial Sequence
  chemically synthesized
tgtaattaaattatttattc

SEQ ID NO: 177135 - DNA, 20 bp, Artificial Sequence
  chemically synthesized
ttgaataaataatttaatta

SEQ ID NO: 177136 - DNA, 20 bp, Artificial Sequence
  chemically synthesized
tgtagttaataattacagca

SEQ ID NO: 177137 - DNA, 20 bp, Artificial Sequence
  chemically synthesized
ctttatgtagttaataatta

SEQ ID NO: 177138 - DNA, 20 bp, Artificial Sequence
  chemically synthesized
ctgtaattattaactacata

SEQ ID NO: 177139 - DNA, 20 bp, Artificial Sequence
  chemically synthesized
atttggatgttttctttatg

SEQ ID NO: 177140 - DNA, 20 bp, Artificial Sequence
  chemically synthesized
taaagaaaacatccaaataa

SEQ ID NO: 177141 - DNA, 20 bp, Artificial Sequence
  chemically synthesized
gttcctggaaatccattatt

SEQ ID NO: 177142 - DNA, 20 bp, Artificial Sequence
  chemically synthesized
acatccaaataatggatttc

SEQ ID NO: 177143 - DNA, 20 bp, Artificial Sequence
  chemically synthesized
catccaaataatggatttcc

SEQ ID NO: 177144 - DNA, 20 bp, Artificial Sequence
  chemically synthesized
gttttctttatgtaagttcc

SEQ ID NO: 177145 - DNA, 20 bp, Artificial Sequence
  chemically synthesized
gatttccaggaacttacata

SEQ ID NO: 177146 - DNA, 20 bp, Artificial Sequence
  chemically synthesized
cttgaatgttttctttatgt

SEQ ID NO: 177147 - DNA, 20 bp, Artificial Sequence
  chemically synthesized
cttacataaagaaaacattc

SEQ ID NO: 177148 - DNA, 20 bp, Artificial Sequence
  chemically synthesized
aaagaaaacattcaagataa

SEQ ID NO: 177149 - DNA, 20 bp, Artificial Sequence
  chemically synthesized
aagaaaacattcaagataat

SEQ ID NO: 177150 - DNA, 20 bp, Artificial Sequence
  chemically synthesized
cattcaagataatgggtttc

SEQ ID NO: 177151 - DNA, 20 bp, Artificial Sequence
  chemically synthesized
attcaagataatgggtttct

SEQ ID NO: 177152 - DNA, 20 bp, Artificial Sequence
  chemically synthesized
gcatatagtctgatagttcc

SEQ ID NO: 177153 - DNA, 20 bp, Artificial Sequence
  chemically synthesized
aatgggtttctgggaactat

SEQ ID NO: 177154 - DNA, 20 bp, Artificial Sequence
  chemically synthesized
ttattgggcatatagtctga

SEQ ID NO: 177155 - DNA, 20 bp, Artificial Sequence
  chemically synthesized
tcacctatttattgggcata

SEQ ID NO: 177156 - DNA, 20 bp, Artificial Sequence
  chemically synthesized
cagactatatgcccaataaa

SEQ ID NO: 177157 - DNA, 20 bp, Artificial Sequence
  chemically synthesized
agactatatgcccaataaat

SEQ ID NO: 177158 - DNA, 20 bp, Artificial Sequence
  chemically synthesized
agggtgttcacctatttatt

SEQ ID NO: 177159 - DNA, 20 bp, Artificial Sequence
  chemically synthesized
aagggtgttcacctatttat

SEQ ID NO: 177160 - DNA, 20 bp, Artificial Sequence
  chemically synthesized
aaaaaaaaaaaaaaaaaaaa

SEQ ID NO: 177161 - DNA, 20 bp, Artificial Sequence
  chemically synthesized
aaaaaaaaaaaaaaaaaaaa

SEQ ID NO: 177162 - DNA, 20 bp, Artificial Sequence
  chemically synthesized
aaaaaaaaaaaaaaaaaaaa

SEQ ID NO: 177163 - DNA, 20 bp, Artificial Sequence
  chemically synthesized
tttttttttttttttttttt

SEQ ID NO: 177164 - DNA, 20 bp, Artificial Sequence
  chemically synthesized
ttttttttttttttttgaga

SEQ ID NO: 177165 - DNA, 20 bp, Artificial Sequence
  chemically synthesized
ttttttttttttttgagata

SEQ ID NO: 177166 - DNA, 20 bp, Artificial Sequence
  chemically synthesized
ctccagcctggcgacagagc

SEQ ID NO: 177167 - DNA, 20 bp, Artificial Sequence
  chemically synthesized
atagagtcttgctctgtcgc

SEQ ID NO: 177168 - DNA, 20 bp, Artificial Sequence
  chemically synthesized
tagagtcttgctctgtcgcc

SEQ ID NO: 177169 - DNA, 20 bp, Artificial Sequence
  chemically synthesized
tatactccagcctggcgaca

SEQ ID NO: 177170 - DNA, 20 bp, Artificial Sequence
  chemically synthesized
gctatactccagcctggcga

SEQ ID NO: 177171 - DNA, 20 bp, Artificial Sequence
  chemically synthesized
gtcttgctctgtcgccaggc

SEQ ID NO: 177172 - DNA, 20 bp, Artificial Sequence
  chemically synthesized
cttgctctgtcgccaggctg

SEQ ID NO: 177173 - DNA, 20 bp, Artificial Sequence
  chemically synthesized
catgccgctatactccagcc

SEQ ID NO: 177174 - DNA, 20 bp, Artificial Sequence
  chemically synthesized
tctgtcgccaggctggagta

SEQ ID NO: 177175 - DNA, 20 bp, Artificial Sequence
  chemically synthesized
aagatcatgccgctatactc

SEQ ID NO: 177176 - DNA, 20 bp, Artificial Sequence
  chemically synthesized
gtcgccaggctggagtatag

SEQ ID NO: 177177 - DNA, 20 bp, Artificial Sequence
  chemically synthesized
ggagtatagcggcatgatct

SEQ ID NO: 177178 - DNA, 20 bp, Artificial Sequence
  chemically synthesized
gtaggaggttgcagtgagcc

SEQ ID NO: 177179 - DNA, 20 bp, Artificial Sequence
  chemically synthesized
agggagtaggaggttgcagt

SEQ ID NO: 177180 - DNA, 20 bp, Artificial Sequence
  chemically synthesized
aaccagggagtaggaggttg

SEQ ID NO: 177181 - DNA, 20 bp, Artificial Sequence
  chemically synthesized
cacttgaaccagggagtagg

SEQ ID NO: 177182 - DNA, 20 bp, Artificial Sequence
  chemically synthesized
tcacttgaaccagggagtag

SEQ ID NO: 177183 - DNA, 20 bp, Artificial Sequence
  chemically synthesized
cactgcaacctcctactccc

SEQ ID NO: 177184 - DNA, 20 bp, Artificial Sequence
  chemically synthesized
aatcacttgaaccagggagt

SEQ ID NO: 177185 - DNA, 20 bp, Artificial Sequence
  chemically synthesized
gaatcacttgaaccagggag

SEQ ID NO: 177186 - DNA, 20 bp, Artificial Sequence
  chemically synthesized
ggagaatcacttgaaccagg

SEQ ID NO: 177187 - DNA, 20 bp, Artificial Sequence
  chemically synthesized
aacctcctactccctggttc

SEQ ID NO: 177188 - DNA, 20 bp, Artificial Sequence
  chemically synthesized
caggagaatcacttgaacca

SEQ ID NO: 177189 - DNA, 20 bp, Artificial Sequence
  chemically synthesized
gcaggagaatcacttgaacc

SEQ ID NO: 177190 - DNA, 20 bp, Artificial Sequence
  chemically synthesized
ggcaggagaatcacttgaac

SEQ ID NO: 177191 - DNA, 20 bp, Artificial Sequence
  chemically synthesized
ttcaagtgattctcctgcct

SEQ ID NO: 177192 - DNA, 20 bp, Artificial Sequence
  chemically synthesized
tatttgggaggctgaggcag

SEQ ID NO: 177193 - DNA, 20 bp, Artificial Sequence
  chemically synthesized
gctatttgggaggctgaggc

SEQ ID NO: 177194 - DNA, 20 bp, Artificial Sequence
  chemically synthesized
agctatttgggaggctgagg

SEQ ID NO: 177195 - DNA, 20 bp, Artificial Sequence
  chemically synthesized
cccagctatttgggaggctg

SEQ ID NO: 177196 - DNA, 20 bp, Artificial Sequence
  chemically synthesized
tcccagctatttgggaggct

SEQ ID NO: 177197 - DNA, 20 bp, Artificial Sequence
  chemically synthesized
tcctgcctcagcctcccaaa

SEQ ID NO: 177198 - DNA, 20 bp, Artificial Sequence
  chemically synthesized
tgtaatcccagctatttggg

SEQ ID NO: 177199 - DNA, 20 bp, Artificial Sequence
  chemically synthesized
ctgtaatcccagctatttgg

SEQ ID NO: 177200 - DNA, 20 bp, Artificial Sequence
  chemically synthesized
gcctcagcctcccaaatagc

SEQ ID NO: 177201 - DNA, 20 bp, Artificial Sequence
  chemically synthesized
gtctgtaatcccagctattt

SEQ ID NO: 177202 - DNA, 20 bp, Artificial Sequence
  chemically synthesized
cctcagcctcccaaatagct

SEQ ID NO: 177203 - DNA, 20 bp, Artificial Sequence
  chemically synthesized
tgtctgtaatcccagctatt

SEQ ID NO: 177204 - DNA, 20 bp, Artificial Sequence
  chemically synthesized
ctcccaaatagctgggatta

SEQ ID NO: 177205 - DNA, 20 bp, Artificial Sequence
  chemically synthesized
gtggcatgtgtctgtaatcc

SEQ ID NO: 177206 - DNA, 20 bp, Artificial Sequence
  chemically synthesized
cagacacatgccaccacgct

SEQ ID NO: 177207 - DNA, 20 bp, Artificial Sequence
  chemically synthesized
caaaaattagctgagcgtgg

SEQ ID NO: 177208 - DNA, 20 bp, Artificial Sequence
  chemically synthesized
atacaaaaattagctgagcg

SEQ ID NO: 177209 - DNA, 20 bp, Artificial Sequence
  chemically synthesized
taaaaatacaaaaattagct

SEQ ID NO: 177210 - DNA, 20 bp, Artificial Sequence
  chemically synthesized
tctattaaaaatacaaaaat

SEQ ID NO: 177211 - DNA, 20 bp, Artificial Sequence
  chemically synthesized
gctaatttttgtatttttaa

SEQ ID NO: 177212 - DNA, 20 bp, Artificial Sequence
  chemically synthesized
taatttttgtatttttaata

SEQ ID NO: 177213 - DNA, 20 bp, Artificial Sequence
  chemically synthesized
ttttgtatttttaatagaga

SEQ ID NO: 177214 - DNA, 20 bp, Artificial Sequence
  chemically synthesized
ttgtatttttaatagagacg

SEQ ID NO: 177215 - DNA, 20 bp, Artificial Sequence
  chemically synthesized
gagacggagttttgccatgt

SEQ ID NO: 177216 - DNA, 20 bp, Artificial Sequence
  chemically synthesized
cggagttttgccatgttggc

SEQ ID NO: 177217 - DNA, 20 bp, Artificial Sequence
  chemically synthesized
cgagaccatcccagccaaca

SEQ ID NO: 177218 - DNA, 20 bp, Artificial Sequence
  chemically synthesized
ggagttttgccatgttggct

SEQ ID NO: 177219 - DNA, 20 bp, Artificial Sequence
  chemically synthesized
ttttgccatgttggctggga

SEQ ID NO: 177220 - DNA, 20 bp, Artificial Sequence
  chemically synthesized
tcaggagatcgagaccatcc

SEQ ID NO: 177221 - DNA, 20 bp, Artificial Sequence
  chemically synthesized
gatcacaaggtcaggagatc

SEQ ID NO: 177222 - DNA, 20 bp, Artificial Sequence
  chemically synthesized
cgggcagatcacaaggtcag

SEQ ID NO: 177223 - DNA, 20 bp, Artificial Sequence
  chemically synthesized
ggcgggcagatcacaaggtc

SEQ ID NO: 177224 - DNA, 20 bp, Artificial Sequence
  chemically synthesized
aggcgggcagatcacaaggt

SEQ ID NO: 177225 - DNA, 20 bp, Artificial Sequence
  chemically synthesized
gcccaggcgggcagatcaca

SEQ ID NO: 177226 - DNA, 20 bp, Artificial Sequence
  chemically synthesized
ggcccaggcgggcagatcac

SEQ ID NO: 177227 - DNA, 20 bp, Artificial Sequence
  chemically synthesized
gaccttgtgatctgcccgcc

SEQ ID NO: 177228 - DNA, 20 bp, Artificial Sequence
  chemically synthesized
accttgtgatctgcccgcct

SEQ ID NO: 177229 - DNA, 20 bp, Artificial Sequence
  chemically synthesized
ctttgggaggcccaggcggg

SEQ ID NO: 177230 - DNA, 20 bp, Artificial Sequence
  chemically synthesized
gcactttgggaggcccaggc

SEQ ID NO: 177231 - DNA, 20 bp, Artificial Sequence
  chemically synthesized
agcactttgggaggcccagg

SEQ ID NO: 177232 - DNA, 20 bp, Artificial Sequence
  chemically synthesized
cccagcactttgggaggccc

SEQ ID NO: 177233 - DNA, 20 bp, Artificial Sequence
  chemically synthesized
tcccagcactttgggaggcc

SEQ ID NO: 177234 - DNA, 20 bp, Artificial Sequence
  chemically synthesized
ctgcccgcctgggcctccca

SEQ ID NO: 177235 - DNA, 20 bp, Artificial Sequence
  chemically synthesized
tgtaatcccagcactttggg

SEQ ID NO: 177236 - DNA, 20 bp, Artificial Sequence
  chemically synthesized
ctgtaatcccagcactttgg

SEQ ID NO: 177237 - DNA, 20 bp, Artificial Sequence
  chemically synthesized
gcctgggcctcccaaagtgc

SEQ ID NO: 177238 - DNA, 20 bp, Artificial Sequence
  chemically synthesized
gcctgtaatcccagcacttt

SEQ ID NO: 177239 - DNA, 20 bp, Artificial Sequence
  chemically synthesized
cctgggcctcccaaagtgct

SEQ ID NO: 177240 - DNA, 20 bp, Artificial Sequence
  chemically synthesized
cgcctgtaatcccagcactt

SEQ ID NO: 177241 - DNA, 20 bp, Artificial Sequence
  chemically synthesized
ctcccaaagtgctgggatta

SEQ ID NO: 177242 - DNA, 20 bp, Artificial Sequence
  chemically synthesized
tcccaaagtgctgggattac

SEQ ID NO: 177243 - DNA, 20 bp, Artificial Sequence
  chemically synthesized
gtggctcacgcctgtaatcc

SEQ ID NO: 177244 - DNA, 20 bp, Artificial Sequence
  chemically synthesized
agtgctgggattacaggcgt

SEQ ID NO: 177245 - DNA, 20 bp, Artificial Sequence
  chemically synthesized
caggcgtgagccaccacacc

SEQ ID NO: 177246 - DNA, 20 bp, Artificial Sequence
  chemically synthesized
agaaaacgggccgggtgtgg

SEQ ID NO: 177247 - DNA, 20 bp, Artificial Sequence
  chemically synthesized
ataagaaaacgggccgggtg

SEQ ID NO: 177248 - DNA, 20 bp, Artificial Sequence
  chemically synthesized
attatataagaaaacgggcc

SEQ ID NO: 177249 - DNA, 20 bp, Artificial Sequence
  chemically synthesized
tattatataagaaaacgggc

SEQ ID NO: 177250 - DNA, 20 bp, Artificial Sequence
  chemically synthesized
acgctattatataagaaaac

SEQ ID NO: 177251 - DNA, 20 bp, Artificial Sequence
  chemically synthesized
aacgctattatataagaaaa

SEQ ID NO: 177252 - DNA, 20 bp, Artificial Sequence
  chemically synthesized
cggcccgttttcttatataa

SEQ ID NO: 177253 - DNA, 20 bp, Artificial Sequence
  chemically synthesized
gtgctaaaacgctattatat

SEQ ID NO: 177254 - DNA, 20 bp, Artificial Sequence
  chemically synthesized
tttcttatataatagcgttt

SEQ ID NO: 177255 - DNA, 20 bp, Artificial Sequence
  chemically synthesized
tataatagcgttttagcaca

SEQ ID NO: 177256 - DNA, 20 bp, Artificial Sequence
  chemically synthesized
tatttgtaacacagttcaca

SEQ ID NO: 177257 - DNA, 20 bp, Artificial Sequence
  chemically synthesized
cttgaagtgtatttgtaaca

SEQ ID NO: 177258 - DNA, 20 bp, Artificial Sequence
  chemically synthesized
ctgtgttacaaatacacttc

SEQ ID NO: 177259 - DNA, 20 bp, Artificial Sequence
  chemically synthesized
tgtgttacaaatacacttca

SEQ ID NO: 177260 - DNA, 20 bp, Artificial Sequence
  chemically synthesized
gtgttacaaatacacttcaa

SEQ ID NO: 177261 - DNA, 20 bp, Artificial Sequence
  chemically synthesized
gttacaaatacacttcaagg

SEQ ID NO: 177262 - DNA, 20 bp, Artificial Sequence
  chemically synthesized
gctcatgattttctcccttg

SEQ ID NO: 177263 - DNA, 20 bp, Artificial Sequence
  chemically synthesized
acttcaagggagaaaatcat

SEQ ID NO: 177264 - DNA, 20 bp, Artificial Sequence
  chemically synthesized
agaaaatcatgagcacataa

SEQ ID NO: 177265 - DNA, 20 bp, Artificial Sequence
  chemically synthesized
tcatgagcacataaaagctc

SEQ ID NO: 177266 - DNA, 20 bp, Artificial Sequence
  chemically synthesized
tgagcacataaaagctccag

SEQ ID NO: 177267 - DNA, 20 bp, Artificial Sequence
  chemically synthesized
gggaccagatagttccactg

SEQ ID NO: 177268 - DNA, 20 bp, Artificial Sequence
  chemically synthesized
cagggaccagatagttccac

SEQ ID NO: 177269 - DNA, 20 bp, Artificial Sequence
  chemically synthesized
aaagctccagtggaactatc

SEQ ID NO: 177270 - DNA, 20 bp, Artificial Sequence
  chemically synthesized
aagtcttagcagggaccaga

SEQ ID NO: 177271 - DNA, 20 bp, Artificial Sequence
  chemically synthesized
ctggaagtcttagcagggac

SEQ ID NO: 177272 - DNA, 20 bp, Artificial Sequence
  chemically synthesized
ggaactatctggtccctgct

SEQ ID NO: 177273 - DNA, 20 bp, Artificial Sequence
  chemically synthesized
tctagctggaagtcttagca

SEQ ID NO: 177274 - DNA, 20 bp, Artificial Sequence
  chemically synthesized
ctctagctggaagtcttagc

SEQ ID NO: 177275 - DNA, 20 bp, Artificial Sequence
  chemically synthesized
tctctagctggaagtcttag

SEQ ID NO: 177276 - DNA, 20 bp, Artificial Sequence
  chemically synthesized
ctggtccctgctaagacttc

SEQ ID NO: 177277 - DNA, 20 bp, Artificial Sequence
  chemically synthesized
atttctctagctggaagtct

SEQ ID NO: 177278 - DNA, 20 bp, Artificial Sequence
  chemically synthesized
tccctgctaagacttccagc

SEQ ID NO: 177279 - DNA, 20 bp, Artificial Sequence
  chemically synthesized
cctgctaagacttccagcta

SEQ ID NO: 177280 - DNA, 20 bp, Artificial Sequence
  chemically synthesized
gaaatcatttctctagctgg

SEQ ID NO: 177281 - DNA, 20 bp, Artificial Sequence
  chemically synthesized
taggaaatcatttctctagc

SEQ ID NO: 177282 - DNA, 20 bp, Artificial Sequence
  chemically synthesized
attataggaaatcatttctc

SEQ ID NO: 177283 - DNA, 20 bp, Artificial Sequence
  chemically synthesized
ggaagtataataatcattat

SEQ ID NO: 177284 - DNA, 20 bp, Artificial Sequence
  chemically synthesized
aggaagtataataatcatta

SEQ ID NO: 177285 - DNA, 20 bp, Artificial Sequence
  chemically synthesized
gctgtaaaatatatagtagg

SEQ ID NO: 177286 - DNA, 20 bp, Artificial Sequence
  chemically synthesized
aatgctgtaaaatatatagt

SEQ ID NO: 177287 - DNA, 20 bp, Artificial Sequence
  chemically synthesized
aaatgctgtaaaatatatag

SEQ ID NO: 177288 - DNA, 20 bp, Artificial Sequence
  chemically synthesized
aaaaaatgctgtaaaatata

SEQ ID NO: 177289 - DNA, 20 bp, Artificial Sequence
  chemically synthesized
acttcctactatatatttta

SEQ ID NO: 177290 - DNA, 20 bp, Artificial Sequence
  chemically synthesized
ttttacagcatttttttttc

SEQ ID NO: 177291 - DNA, 20 bp, Artificial Sequence
  chemically synthesized
tttacagcatttttttttcc

SEQ ID NO: 177292 - DNA, 20 bp, Artificial Sequence
  chemically synthesized
ttacagcatttttttttccg

SEQ ID NO: 177293 - DNA, 20 bp, Artificial Sequence
  chemically synthesized
gactggtatttatggaaccc

SEQ ID NO: 177294 - DNA, 20 bp, Artificial Sequence
  chemically synthesized
ttccggggttccataaatac

SEQ ID NO: 177295 - DNA, 20 bp, Artificial Sequence
  chemically synthesized
accatattgactggtattta

SEQ ID NO: 177296 - DNA, 20 bp, Artificial Sequence
  chemically synthesized
tccataaataccagtcaata

SEQ ID NO: 177297 - DNA, 20 bp, Artificial Sequence
  chemically synthesized
ggcattgttaccatattgac

SEQ ID NO: 177298 - DNA, 20 bp, Artificial Sequence
  chemically synthesized
agtcaatatggtaacaatgc

SEQ ID NO: 177299 - DNA, 20 bp, Artificial Sequence
  chemically synthesized
atatggtaacaatgccagtg

SEQ ID NO: 177300 - DNA, 20 bp, Artificial Sequence
  chemically synthesized
ccaaataatagaatcttcac

SEQ ID NO: 177301 - DNA, 20 bp, Artificial Sequence
  chemically synthesized
ccagtgaagattctattatt

SEQ ID NO: 177302 - DNA, 20 bp, Artificial Sequence
  chemically synthesized
atgttttttcaaccaaataa

SEQ ID NO: 177303 - DNA, 20 bp, Artificial Sequence
  chemically synthesized
ggttgaaaaaacatcacgtt

SEQ ID NO: 177304 - DNA, 20 bp, Artificial Sequence
  chemically synthesized
gttgaaaaaacatcacgtta

SEQ ID NO: 177305 - DNA, 20 bp, Artificial Sequence
  chemically synthesized
ttgaaaaaacatcacgttaa

SEQ ID NO: 177306 - DNA, 20 bp, Artificial Sequence
  chemically synthesized
aaaaaacatcacgttaaggg

SEQ ID NO: 177307 - DNA, 20 bp, Artificial Sequence
  chemically synthesized
aaaaacatcacgttaagggc

SEQ ID NO: 177308 - DNA, 20 bp, Artificial Sequence
  chemically synthesized
acgttaagggcaggactgaa

SEQ ID NO: 177309 - DNA, 20 bp, Artificial Sequence
  chemically synthesized
ttgttctaatagttaccatt

SEQ ID NO: 177310 - DNA, 20 bp, Artificial Sequence
  chemically synthesized
caggactgaatggtaactat

SEQ ID NO: 177311 - DNA, 20 bp, Artificial Sequence
  chemically synthesized
cgattaatagattgttctaa

SEQ ID NO: 177312 - DNA, 20 bp, Artificial Sequence
  chemically synthesized
tatcacaagatgacgattaa

SEQ ID NO: 177313 - DNA, 20 bp, Artificial Sequence
  chemically synthesized
tattaatcgtcatcttgtga

SEQ ID NO: 177314 - DNA, 20 bp, Artificial Sequence
  chemically synthesized
attaatcgtcatcttgtgat

SEQ ID NO: 177315 - DNA, 20 bp, Artificial Sequence
  chemically synthesized
tccaatcaatttcctatcac

SEQ ID NO: 177316 - DNA, 20 bp, Artificial Sequence
  chemically synthesized
tcttgtgataggaaattgat

SEQ ID NO: 177317 - DNA, 20 bp, Artificial Sequence
  chemically synthesized
gataggaaattgattggaca

SEQ ID NO: 177318 - DNA, 20 bp, Artificial Sequence
  chemically synthesized
tggacaaagtgtccattttt

SEQ ID NO: 177319 - DNA, 20 bp, Artificial Sequence
  chemically synthesized
tccgactccttgctcaaaaa

SEQ ID NO: 177320 - DNA, 20 bp, Artificial Sequence
  chemically synthesized
caaagtgtccatttttgagc

SEQ ID NO: 177321 - DNA, 20 bp, Artificial Sequence
  chemically synthesized
aaagtgtccatttttgagca

SEQ ID NO: 177322 - DNA, 20 bp, Artificial Sequence
  chemically synthesized
agtgtccatttttgagcaag

SEQ ID NO: 177323 - DNA, 20 bp, Artificial Sequence
  chemically synthesized
tccatttttgagcaaggagt

SEQ ID NO: 177324 - DNA, 20 bp, Artificial Sequence
  chemically synthesized
tttttgagcaaggagtcgga

SEQ ID NO: 177325 - DNA, 20 bp, Artificial Sequence
  chemically synthesized
gagcaaggagtcggaaagcc

SEQ ID NO: 177326 - DNA, 20 bp, Artificial Sequence
  chemically synthesized
ggagtcggaaagccaagctc

SEQ ID NO: 177327 - DNA, 20 bp, Artificial Sequence
  chemically synthesized
aattaaataaagctagagct

SEQ ID NO: 177328 - DNA, 20 bp, Artificial Sequence
  chemically synthesized
gagaaaattaaataaagcta

SEQ ID NO: 177329 - DNA, 20 bp, Artificial Sequence
  chemically synthesized
aggagaaaattaaataaagc

SEQ ID NO: 177330 - DNA, 20 bp, Artificial Sequence
  chemically synthesized
aaaaaggagaaaattaaata

SEQ ID NO: 177331 - DNA, 20 bp, Artificial Sequence
  chemically synthesized
taaatgtgaatagcaaaaag

SEQ ID NO: 177332 - DNA, 20 bp, Artificial Sequence
  chemically synthesized
tataaatgtgaatagcaaaa

SEQ ID NO: 177333 - DNA, 20 bp, Artificial Sequence
  chemically synthesized
gtataaatgtgaatagcaaa

SEQ ID NO: 177334 - DNA, 20 bp, Artificial Sequence
  chemically synthesized
gtcgtcagtataaatgtgaa

SEQ ID NO: 177335 - DNA, 20 bp, Artificial Sequence
  chemically synthesized
tgacagtcattattagtcgt

SEQ ID NO: 177336 - DNA, 20 bp, Artificial Sequence
  chemically synthesized
tatgtaatgacagtcattat

SEQ ID NO: 177337 - DNA, 20 bp, Artificial Sequence
  chemically synthesized
acgtatttgctatgtaatga

SEQ ID NO: 177338 - DNA, 20 bp, Artificial Sequence
  chemically synthesized
taataatgactgtcattaca

SEQ ID NO: 177339 - DNA, 20 bp, Artificial Sequence
  chemically synthesized
cattacatagcaaatacgtc

SEQ ID NO: 177340 - DNA, 20 bp, Artificial Sequence
  chemically synthesized
atagcaaatacgtctggaaa

SEQ ID NO: 177341 - DNA, 20 bp, Artificial Sequence
  chemically synthesized
atgaatgtttagtctttttc

SEQ ID NO: 177342 - DNA, 20 bp, Artificial Sequence
  chemically synthesized
gtataaggtaaatgaatgtt

SEQ ID NO: 177343 - DNA, 20 bp, Artificial Sequence
  chemically synthesized
gatttattttcatttgtata

SEQ ID NO: 177344 - DNA, 20 bp, Artificial Sequence
  chemically synthesized
agatttattttcatttgtat

SEQ ID NO: 177345 - DNA, 20 bp, Artificial Sequence
  chemically synthesized
tatctgaggagtaaacattt

SEQ ID NO: 177346 - DNA, 20 bp, Artificial Sequence
  chemically synthesized
aatctgaaatgtttactcct

SEQ ID NO: 177347 - DNA, 20 bp, Artificial Sequence
  chemically synthesized
cttctaaatatgtatctgag

SEQ ID NO: 177348 - DNA, 20 bp, Artificial Sequence
  chemically synthesized
tgcttctaaatatgtatctg

SEQ ID NO: 177349 - DNA, 20 bp, Artificial Sequence
  chemically synthesized
ttgcttctaaatatgtatct

SEQ ID NO: 177350 - DNA, 20 bp, Artificial Sequence
  chemically synthesized
ttactcctcagatacatatt

SEQ ID NO: 177351 - DNA, 20 bp, Artificial Sequence
  chemically synthesized
ctcctcagatacatatttag

SEQ ID NO: 177352 - DNA, 20 bp, Artificial Sequence
  chemically synthesized
atatttagaagcaacatgat

SEQ ID NO: 177353 - DNA, 20 bp, Artificial Sequence
  chemically synthesized
atttagaagcaacatgatta

SEQ ID NO: 177354 - DNA, 20 bp, Artificial Sequence
  chemically synthesized
gagattaatacaaaatgaac

SEQ ID NO: 177355 - DNA, 20 bp, Artificial Sequence
  chemically synthesized
tacaaaatgaaccagatttc

SEQ ID NO: 177356 - DNA, 20 bp, Artificial Sequence
  chemically synthesized
tatctaaatttccagaaatc

SEQ ID NO: 177357 - DNA, 20 bp, Artificial Sequence
  chemically synthesized
gaaccagatttctggaaatt

SEQ ID NO: 177358 - DNA, 20 bp, Artificial Sequence
  chemically synthesized
gttggctgtatctaaatttc

SEQ ID NO: 177359 - DNA, 20 bp, Artificial Sequence
  chemically synthesized
gatttctggaaatttagata

SEQ ID NO: 177360 - DNA, 20 bp, Artificial Sequence
  chemically synthesized
tatcttccacaatatacagt

SEQ ID NO: 177361 - DNA, 20 bp, Artificial Sequence
  chemically synthesized
atacagccaactgtatattg

SEQ ID NO: 177362 - DNA, 20 bp, Artificial Sequence
  chemically synthesized
aaactatcttccacaatata

SEQ ID NO: 177363 - DNA, 20 bp, Artificial Sequence
  chemically synthesized
cagccaactgtatattgtgg

SEQ ID NO: 177364 - DNA, 20 bp, Artificial Sequence
  chemically synthesized
caactgtatattgtggaaga

SEQ ID NO: 177365 - DNA, 20 bp, Artificial Sequence
  chemically synthesized
ttgtggaagatagtttgtgc

SEQ ID NO: 177366 - DNA, 20 bp, Artificial Sequence
  chemically synthesized
tgtggaagatagtttgtgct

SEQ ID NO: 177367 - DNA, 20 bp, Artificial Sequence
  chemically synthesized
tggaagatagtttgtgctag

SEQ ID NO: 177368 - DNA, 20 bp, Artificial Sequence
  chemically synthesized
taaaaatacagtgcaactcc

SEQ ID NO: 177369 - DNA, 20 bp, Artificial Sequence
  chemically synthesized
aaattatgaaagtaaaaata

SEQ ID NO: 177370 - DNA, 20 bp, Artificial Sequence
  chemically synthesized
tcaccaaataaaaattatga

SEQ ID NO: 177371 - DNA, 20 bp, Artificial Sequence
  chemically synthesized
ttactttcataatttttatt

SEQ ID NO: 177372 - DNA, 20 bp, Artificial Sequence
  chemically synthesized
tgtaatattgataataatac

SEQ ID NO: 177373 - DNA, 20 bp, Artificial Sequence
  chemically synthesized
ttgtaatattgataataata

SEQ ID NO: 177374 - DNA, 20 bp, Artificial Sequence
  chemically synthesized
caaaaattattcccatatta

SEQ ID NO: 177375 - DNA, 20 bp, Artificial Sequence
  chemically synthesized
aaaaattattcccatattaa

SEQ ID NO: 177376 - DNA, 20 bp, Artificial Sequence
  chemically synthesized
atataacaaacctttaatat

SEQ ID NO: 177377 - DNA, 20 bp, Artificial Sequence
  chemically synthesized
tatataacaaacctttaata

SEQ ID NO: 177378 - DNA, 20 bp, Artificial Sequence
  chemically synthesized
actttaccgaggaaaaaggt

SEQ ID NO: 177379 - DNA, 20 bp, Artificial Sequence
  chemically synthesized
cactttaccgaggaaaaagg

SEQ ID NO: 177380 - DNA, 20 bp, Artificial Sequence
  chemically synthesized
tgtaaacctacctttttcct

SEQ ID NO: 177381 - DNA, 20 bp, Artificial Sequence
  chemically synthesized
attcactttaccgaggaaaa

SEQ ID NO: 177382 - DNA, 20 bp, Artificial Sequence
  chemically synthesized
tattcactttaccgaggaaa

SEQ ID NO: 177383 - DNA, 20 bp, Artificial Sequence
  chemically synthesized
acctacctttttcctcggta

SEQ ID NO: 177384 - DNA, 20 bp, Artificial Sequence
  chemically synthesized
gcatcttattcactttaccg

SEQ ID NO: 177385 - DNA, 20 bp, Artificial Sequence
  chemically synthesized
tgcatcttattcactttacc

SEQ ID NO: 177386 - DNA, 20 bp, Artificial Sequence
  chemically synthesized
ttttcctcggtaaagtgaat

SEQ ID NO: 177387 - DNA, 20 bp, Artificial Sequence
  chemically synthesized
ctggaaagtgaattttagtt

SEQ ID NO: 177388 - DNA, 20 bp, Artificial Sequence
  chemically synthesized
tttggctggaaagtgaattt

SEQ ID NO: 177389 - DNA, 20 bp, Artificial Sequence
  chemically synthesized
cttaactaaaattcactttc

SEQ ID NO: 177390 - DNA, 20 bp, Artificial Sequence
  chemically synthesized
aattaagaaatttggctgga

SEQ ID NO: 177391 - DNA, 20 bp, Artificial Sequence
  chemically synthesized
aaacaattaagaaatttggc

SEQ ID NO: 177392 - DNA, 20 bp, Artificial Sequence
  chemically synthesized
tggaaaacaattaagaaatt

SEQ ID NO: 177393 - DNA, 20 bp, Artificial Sequence
  chemically synthesized
aagcattttggaaaacaatt

SEQ ID NO: 177394 - DNA, 20 bp, Artificial Sequence
  chemically synthesized
acataaagaaaaaagcattt

SEQ ID NO: 177395 - DNA, 20 bp, Artificial Sequence
  chemically synthesized
aatggtgcacataaagaaaa

SEQ ID NO: 177396 - DNA, 20 bp, Artificial Sequence
  chemically synthesized
agtataaaatggtgcacata

SEQ ID NO: 177397 - DNA, 20 bp, Artificial Sequence
  chemically synthesized
actgcccagacagtataaaa

SEQ ID NO: 177398 - DNA, 20 bp, Artificial Sequence
  chemically synthesized
gtgcaccattttatactgtc

SEQ ID NO: 177399 - DNA, 20 bp, Artificial Sequence
  chemically synthesized
tgcaccattttatactgtct

SEQ ID NO: 177400 - DNA, 20 bp, Artificial Sequence
  chemically synthesized
accattttatactgtctggg

SEQ ID NO: 177401 - DNA, 20 bp, Artificial Sequence
  chemically synthesized
tgaatttgttactgcccaga

SEQ ID NO: 177402 - DNA, 20 bp, Artificial Sequence
  chemically synthesized
tatttgaatttgttactgcc

SEQ ID NO: 177403 - DNA, 20 bp, Artificial Sequence
  chemically synthesized
tgggcagtaacaaattcaaa

SEQ ID NO: 177404 - DNA, 20 bp, Artificial Sequence
  chemically synthesized
atatactgtttatatgtaaa

SEQ ID NO: 177405 - DNA, 20 bp, Artificial Sequence
  chemically synthesized
atttaccatttacatataaa

SEQ ID NO: 177406 - DNA, 20 bp, Artificial Sequence
  chemically synthesized
ataaaataccatttacaaat

SEQ ID NO: 177407 - DNA, 20 bp, Artificial Sequence
  chemically synthesized
cagtatatcttatttgtaaa

SEQ ID NO: 177408 - DNA, 20 bp, Artificial Sequence
  chemically synthesized
tgtaaatggtattttatgtg

SEQ ID NO: 177409 - DNA, 20 bp, Artificial Sequence
  chemically synthesized
aatggtattttatgtgtaga

SEQ ID NO: 177410 - DNA, 20 bp, Artificial Sequence
  chemically synthesized
catcgcattttacatgtaaa

SEQ ID NO: 177411 - DNA, 20 bp, Artificial Sequence
  chemically synthesized
atgttgtcattttgttaaat

SEQ ID NO: 177412 - DNA, 20 bp, Artificial Sequence
  chemically synthesized
aacatatttattaaaactaa

SEQ ID NO: 177413 - DNA, 20 bp, Artificial Sequence
  chemically synthesized
acatatttattaaaactaat

SEQ ID NO: 177414 - DNA, 20 bp, Artificial Sequence
  chemically synthesized
tgtacgttatgcattcctat

SEQ ID NO: 177415 - DNA, 20 bp, Artificial Sequence
  chemically synthesized
atgtcaagtaattttacagg

SEQ ID NO: 177416 - DNA, 20 bp, Artificial Sequence
  chemically synthesized
ttaatgtcaagtaattttac

SEQ ID NO: 177417 - DNA, 20 bp, Artificial Sequence
  chemically synthesized
tttaatgtcaagtaatttta

SEQ ID NO: 177418 - DNA, 20 bp, Artificial Sequence
  chemically synthesized
atcctactatttttaatgtc

SEQ ID NO: 177419 - DNA, 20 bp, Artificial Sequence
  chemically synthesized
aaattacttgacattaaaaa

SEQ ID NO: 177420 - DNA, 20 bp, Artificial Sequence
  chemically synthesized
ttacttgacattaaaaatag

SEQ ID NO: 177421 - DNA, 20 bp, Artificial Sequence
  chemically synthesized
tacttgacattaaaaatagt

SEQ ID NO: 177422 - DNA, 20 bp, Artificial Sequence
  chemically synthesized
tgtttatgttgtttcagaat

SEQ ID NO: 177423 - DNA, 20 bp, Artificial Sequence
  chemically synthesized
aaaacatgtttatgttgttt

SEQ ID NO: 177424 - DNA, 20 bp, Artificial Sequence
  chemically synthesized
acatttacagttgtgtaata

SEQ ID NO: 177425 - DNA, 20 bp, Artificial Sequence
  chemically synthesized
tctctgctgtggaacattta

SEQ ID NO: 177426 - DNA, 20 bp, Artificial Sequence
  chemically synthesized
acacaactgtaaatgttcca

SEQ ID NO: 177427 - DNA, 20 bp, Artificial Sequence
  chemically synthesized
caactgtaaatgttccacag

SEQ ID NO: 177428 - DNA, 20 bp, Artificial Sequence
  chemically synthesized
actgtaaatgttccacagca

SEQ ID NO: 177429 - DNA, 20 bp, Artificial Sequence
  chemically synthesized
ttctagaaccttctctgctg

SEQ ID NO: 177430 - DNA, 20 bp, Artificial Sequence
  chemically synthesized
gtaaatgttccacagcagag

SEQ ID NO: 177431 - DNA, 20 bp, Artificial Sequence
  chemically synthesized
taaatgttccacagcagaga

SEQ ID NO: 177432 - DNA, 20 bp, Artificial Sequence
  chemically synthesized
ttccacagcagagaaggttc

SEQ ID NO: 177433 - DNA, 20 bp, Artificial Sequence
  chemically synthesized
acagcagagaaggttctaga

SEQ ID NO: 177434 - DNA, 20 bp, Artificial Sequence
  chemically synthesized
tgtgttttaaaattactttc

SEQ ID NO: 177435 - DNA, 20 bp, Artificial Sequence
  chemically synthesized
tagaaagtaattttaaaaca

SEQ ID NO: 177436 - DNA, 20 bp, Artificial Sequence
  chemically synthesized
taattttaaaacacagcatc

SEQ ID NO: 177437 - DNA, 20 bp, Artificial Sequence
  chemically synthesized
tttttgccctttttgagaac

SEQ ID NO: 177438 - DNA, 20 bp, Artificial Sequence
  chemically synthesized
cacagcatctagttctcaaa

SEQ ID NO: 177439 - DNA, 20 bp, Artificial Sequence
  chemically synthesized
acagcatctagttctcaaaa

SEQ ID NO: 177440 - DNA, 20 bp, Artificial Sequence
  chemically synthesized
cagcatctagttctcaaaaa

SEQ ID NO: 177441 - DNA, 20 bp, Artificial Sequence
  chemically synthesized
ctttggtttttgcccttttt

SEQ ID NO: 177442 - DNA, 20 bp, Artificial Sequence
  chemically synthesized
ctcaaaaagggcaaaaacca

SEQ ID NO: 177443 - DNA, 20 bp, Artificial Sequence
  chemically synthesized
aactatatgagtttttgctt

SEQ ID NO: 177444 - DNA, 20 bp, Artificial Sequence
  chemically synthesized
aaccaaagcaaaaactcata

SEQ ID NO: 177445 - DNA, 20 bp, Artificial Sequence
  chemically synthesized
ttcttttaaaaaaactatat

SEQ ID NO: 177446 - DNA, 20 bp, Artificial Sequence
  chemically synthesized
aactcatatagtttttttaa

SEQ ID NO: 177447 - DNA, 20 bp, Artificial Sequence
  chemically synthesized
aatatcctaatattaaaatg

SEQ ID NO: 177448 - DNA, 20 bp, Artificial Sequence
  chemically synthesized
taatatcctaatattaaaat

SEQ ID NO: 177449 - DNA, 20 bp, Artificial Sequence
  chemically synthesized
ataatatcctaatattaaaa

SEQ ID NO: 177450 - DNA, 20 bp, Artificial Sequence
  chemically synthesized
ataaatccccattttaatat

SEQ ID NO: 177451 - DNA, 20 bp, Artificial Sequence
  chemically synthesized
taaatccccattttaatatt

SEQ ID NO: 177452 - DNA, 20 bp, Artificial Sequence
  chemically synthesized
aagctcaagtgatttttatg

SEQ ID NO: 177453 - DNA, 20 bp, Artificial Sequence
  chemically synthesized
tatccacataaaaatcactt

SEQ ID NO: 177454 - DNA, 20 bp, Artificial Sequence
  chemically synthesized
ttaaccttttggtgaagctc

SEQ ID NO: 177455 - DNA, 20 bp, Artificial Sequence
  chemically synthesized
aatcacttgagcttcaccaa

SEQ ID NO: 177456 - DNA, 20 bp, Artificial Sequence
  chemically synthesized
atcacttgagcttcaccaaa

SEQ ID NO: 177457 - DNA, 20 bp, Artificial Sequence
  chemically synthesized
ggggttttaaccttttggtg

SEQ ID NO: 177458 - DNA, 20 bp, Artificial Sequence
  chemically synthesized
cagtaggggttttaaccttt

SEQ ID NO: 177459 - DNA, 20 bp, Artificial Sequence
  chemically synthesized
gattccaaaataaacagtag

SEQ ID NO: 177460 - DNA, 20 bp, Artificial Sequence
  chemically synthesized
tgattccaaaataaacagta

SEQ ID NO: 177461 - DNA, 20 bp, Artificial Sequence
  chemically synthesized
gtgattccaaaataaacagt

SEQ ID NO: 177462 - DNA, 20 bp, Artificial Sequence
  chemically synthesized
agtgattccaaaataaacag

SEQ ID NO: 177463 - DNA, 20 bp, Artificial Sequence
  chemically synthesized
aaaacccctactgtttattt

SEQ ID NO: 177464 - DNA, 20 bp, Artificial Sequence
  chemically synthesized
aaaagtgattccaaaataaa

SEQ ID NO: 177465 - DNA, 20 bp, Artificial Sequence
  chemically synthesized
agctttctatttaaatataa

SEQ ID NO: 177466 - DNA, 20 bp, Artificial Sequence
  chemically synthesized
gaatcacttttatatttaaa

SEQ ID NO: 177467 - DNA, 20 bp, Artificial Sequence
  chemically synthesized
cacttttatatttaaataga

SEQ ID NO: 177468 - DNA, 20 bp, Artificial Sequence
  chemically synthesized
tatttaaatagaaagctaca

SEQ ID NO: 177469 - DNA, 20 bp, Artificial Sequence
  chemically synthesized
gtgacttatttgagaccatg

SEQ ID NO: 177470 - DNA, 20 bp, Artificial Sequence
  chemically synthesized
aaagctacatggtctcaaat

SEQ ID NO: 177471 - DNA, 20 bp, Artificial Sequence
  chemically synthesized
aaaggttatgtgacttattt

SEQ ID NO: 177472 - DNA, 20 bp, Artificial Sequence
  chemically synthesized
aataagtcacataacctttc

SEQ ID NO: 177473 - DNA, 20 bp, Artificial Sequence
  chemically synthesized
ataagtcacataacctttct

SEQ ID NO: 177474 - DNA, 20 bp, Artificial Sequence
  chemically synthesized
ttgaacaccgagtcctagaa

SEQ ID NO: 177475 - DNA, 20 bp, Artificial Sequence
  chemically synthesized
tttgaacaccgagtcctaga

SEQ ID NO: 177476 - DNA, 20 bp, Artificial Sequence
  chemically synthesized
cacataacctttctaggact

SEQ ID NO: 177477 - DNA, 20 bp, Artificial Sequence
  chemically synthesized
tatttttgaacaccgagtcc

SEQ ID NO: 177478 - DNA, 20 bp, Artificial Sequence
  chemically synthesized
attctttatttttgaacacc

SEQ ID NO: 177479 - DNA, 20 bp, Artificial Sequence
  chemically synthesized
ggactcggtgttcaaaaata

SEQ ID NO: 177480 - DNA, 20 bp, Artificial Sequence
  chemically synthesized
ttcaaaaataaagaatgata

SEQ ID NO: 177481 - DNA, 20 bp, Artificial Sequence
  chemically synthesized
aagaatgataaagcatattt

SEQ ID NO: 177482 - DNA, 20 bp, Artificial Sequence
  chemically synthesized
atattttggttttaaataaa

SEQ ID NO: 177483 - DNA, 20 bp, Artificial Sequence
  chemically synthesized
tattttggttttaaataaat

SEQ ID NO: 177484 - DNA, 20 bp, Artificial Sequence
  chemically synthesized
tttggttttaaataaatggg

SEQ ID NO: 177485 - DNA, 20 bp, Artificial Sequence
  chemically synthesized
tctttgtatatgttatatgt

SEQ ID NO: 177486 - DNA, 20 bp, Artificial Sequence
  chemically synthesized
ctctttgtatatgttatatg

SEQ ID NO: 177487 - DNA, 20 bp, Artificial Sequence
  chemically synthesized
acccacatataacatataca

SEQ ID NO: 177488 - DNA, 20 bp, Artificial Sequence
  chemically synthesized
ccacatataacatatacaaa

SEQ ID NO: 177489 - DNA, 20 bp, Artificial Sequence
  chemically synthesized
aacatatacaaagagcaatg

SEQ ID NO: 177490 - DNA, 20 bp, Artificial Sequence
  chemically synthesized
tacaaagagcaatgaagaat

SEQ ID NO: 177491 - DNA, 20 bp, Artificial Sequence
  chemically synthesized
acaaagagcaatgaagaatg

SEQ ID NO: 177492 - DNA, 20 bp, Artificial Sequence
  chemically synthesized
agagcaatgaagaatgagga

SEQ ID NO: 177493 - DNA, 20 bp, Artificial Sequence
  chemically synthesized
gagcaatgaagaatgaggaa

SEQ ID NO: 177494 - DNA, 20 bp, Artificial Sequence
  chemically synthesized
agcaatgaagaatgaggaaa

SEQ ID NO: 177495 - DNA, 20 bp, Artificial Sequence
  chemically synthesized
gcaatgaagaatgaggaaag

SEQ ID NO: 177496 - DNA, 20 bp, Artificial Sequence
  chemically synthesized
gaaaggggacacaaaataaa

SEQ ID NO: 177497 - DNA, 20 bp, Artificial Sequence
  chemically synthesized
cacaaaataaaaagacatga

SEQ ID NO: 177498 - DNA, 20 bp, Artificial Sequence
  chemically synthesized
caaaataaaaagacatgaaa

SEQ ID NO: 177499 - DNA, 20 bp, Artificial Sequence
  chemically synthesized
agacatgaaagagatgaaac

SEQ ID NO: 177500 - DNA, 20 bp, Artificial Sequence
  chemically synthesized
gacatgaaagagatgaaact

SEQ ID NO: 177501 - DNA, 20 bp, Artificial Sequence
  chemically synthesized
agagatgaaactgggattaa

SEQ ID NO: 177502 - DNA, 20 bp, Artificial Sequence
  chemically synthesized
ttccctgaccccgttaatcc

SEQ ID NO: 177503 - DNA, 20 bp, Artificial Sequence
  chemically synthesized
gagatgaaactgggattaac

SEQ ID NO: 177504 - DNA, 20 bp, Artificial Sequence
  chemically synthesized
agatgaaactgggattaacg

SEQ ID NO: 177505 - DNA, 20 bp, Artificial Sequence
  chemically synthesized
gaaactgggattaacggggt

SEQ ID NO: 177506 - DNA, 20 bp, Artificial Sequence
  chemically synthesized
aaactgggattaacggggtc

SEQ ID NO: 177507 - DNA, 20 bp, Artificial Sequence
  chemically synthesized
aactgggattaacggggtca

SEQ ID NO: 177508 - DNA, 20 bp, Artificial Sequence
  chemically synthesized
tgggattaacggggtcaggg

SEQ ID NO: 177509 - DNA, 20 bp, Artificial Sequence
  chemically synthesized
gggattaacggggtcaggga

SEQ ID NO: 177510 - DNA, 20 bp, Artificial Sequence
  chemically synthesized
gattaacggggtcagggaag

SEQ ID NO: 177511 - DNA, 20 bp, Artificial Sequence
  chemically synthesized
ttaacggggtcagggaagga

SEQ ID NO: 177512 - DNA, 20 bp, Artificial Sequence
  chemically synthesized
acggggtcagggaaggagag

SEQ ID NO: 177513 - DNA, 20 bp, Artificial Sequence
  chemically synthesized
gggtcagggaaggagagcag

SEQ ID NO: 177514 - DNA, 20 bp, Artificial Sequence
  chemically synthesized
gtcagggaaggagagcagaa

SEQ ID NO: 177515 - DNA, 20 bp, Artificial Sequence
  chemically synthesized
gaatgtgttacataaacaac

SEQ ID NO: 177516 - DNA, 20 bp, Artificial Sequence
  chemically synthesized
aatgtgttacataaacaact

SEQ ID NO: 177517 - DNA, 20 bp, Artificial Sequence
  chemically synthesized
atgtgttacataaacaactg

SEQ ID NO: 177518 - DNA, 20 bp, Artificial Sequence
  chemically synthesized
tgttacataaacaactgggg

SEQ ID NO: 177519 - DNA, 20 bp, Artificial Sequence
  chemically synthesized
ttgccactctttttctgccc

SEQ ID NO: 177520 - DNA, 20 bp, Artificial Sequence
  chemically synthesized
ataaacaactggggcagaaa

SEQ ID NO: 177521 - DNA, 20 bp, Artificial Sequence
  chemically synthesized
aaacaactggggcagaaaaa

SEQ ID NO: 177522 - DNA, 20 bp, Artificial Sequence
  chemically synthesized
caactggggcagaaaaagag

SEQ ID NO: 177523 - DNA, 20 bp, Artificial Sequence
  chemically synthesized
aagagtggcaaatatgcaaa

SEQ ID NO: 177524 - DNA, 20 bp, Artificial Sequence
  chemically synthesized
tggcaaatatgcaaatagaa

SEQ ID NO: 177525 - DNA, 20 bp, Artificial Sequence
  chemically synthesized
caaatatgcaaatagaaaag

SEQ ID NO: 177526 - DNA, 20 bp, Artificial Sequence
  chemically synthesized
caaatagaaaagtagattca

SEQ ID NO: 177527 - DNA, 20 bp, Artificial Sequence
  chemically synthesized
tagaaaagtagattcatggc

SEQ ID NO: 177528 - DNA, 20 bp, Artificial Sequence
  chemically synthesized
agaaaagtagattcatggcc

SEQ ID NO: 177529 - DNA, 20 bp, Artificial Sequence
  chemically synthesized
agtagattcatggccaggtg

SEQ ID NO: 177530 - DNA, 20 bp, Artificial Sequence
  chemically synthesized
agattcatggccaggtgcgg

SEQ ID NO: 177531 - DNA, 20 bp, Artificial Sequence
  chemically synthesized
caggcgtgagccaccgcacc

SEQ ID NO: 177532 - DNA, 20 bp, Artificial Sequence
  chemically synthesized
attgctgatattacaggcgt

SEQ ID NO: 177533 - DNA, 20 bp, Artificial Sequence
  chemically synthesized
gtggctcacgcctgtaatat

SEQ ID NO: 177534 - DNA, 20 bp, Artificial Sequence
  chemically synthesized
tcccaaattgctgatattac

SEQ ID NO: 177535 - DNA, 20 bp, Artificial Sequence
  chemically synthesized
ctcccaaattgctgatatta

SEQ ID NO: 177536 - DNA, 20 bp, Artificial Sequence
  chemically synthesized
cgcctgtaatatcagcaatt

SEQ ID NO: 177537 - DNA, 20 bp, Artificial Sequence
  chemically synthesized
gcctgtaatatcagcaattt

SEQ ID NO: 177538 - DNA, 20 bp, Artificial Sequence
  chemically synthesized
ctgtaatatcagcaatttgg

SEQ ID NO: 177539 - DNA, 20 bp, Artificial Sequence
  chemically synthesized
tgtaatatcagcaatttggg

SEQ ID NO: 177540 - DNA, 20 bp, Artificial Sequence
  chemically synthesized
tatcagcaatttgggaggcc

SEQ ID NO: 177541 - DNA, 20 bp, Artificial Sequence
  chemically synthesized
atcagcaatttgggaggccg

SEQ ID NO: 177542 - DNA, 20 bp, Artificial Sequence
  chemically synthesized
agcaatttgggaggccgagg

SEQ ID NO: 177543 - DNA, 20 bp, Artificial Sequence
  chemically synthesized
gcaatttgggaggccgaggt

SEQ ID NO: 177544 - DNA, 20 bp, Artificial Sequence
  chemically synthesized
atttgggaggccgaggtggg

SEQ ID NO: 177545 - DNA, 20 bp, Artificial Sequence
  chemically synthesized
ctcaggtgatctgcccacct

SEQ ID NO: 177546 - DNA, 20 bp, Artificial Sequence
  chemically synthesized
ccgaggtgggcagatcacct

SEQ ID NO: 177547 - DNA, 20 bp, Artificial Sequence
  chemically synthesized
cgaggtgggcagatcacctg

SEQ ID NO: 177548 - DNA, 20 bp, Artificial Sequence
  chemically synthesized
gtgggcagatcacctgaggt

SEQ ID NO: 177549 - DNA, 20 bp, Artificial Sequence
  chemically synthesized
tgggcagatcacctgaggtc

SEQ ID NO: 177550 - DNA, 20 bp, Artificial Sequence
  chemically synthesized
ggtcttaaactcccgacctc

SEQ ID NO: 177551 - DNA, 20 bp, Artificial Sequence
  chemically synthesized
ggcagatcacctgaggtcgg

SEQ ID NO: 177552 - DNA, 20 bp, Artificial Sequence
  chemically synthesized
tggtcttaaactcccgacct

SEQ ID NO: 177553 - DNA, 20 bp, Artificial Sequence
  chemically synthesized
tcacctgaggtcgggagttt

SEQ ID NO: 177554 - DNA, 20 bp, Artificial Sequence
  chemically synthesized
tgaggtcgggagtttaagac

SEQ ID NO: 177555 - DNA, 20 bp, Artificial Sequence
  chemically synthesized
tttcaccacgttgatcaggc

SEQ ID NO: 177556 - DNA, 20 bp, Artificial Sequence
  chemically synthesized
ggggtttcaccacgttgatc

SEQ ID NO: 177557 - DNA, 20 bp, Artificial Sequence
  chemically synthesized
taagaccagcctgatcaacg

SEQ ID NO: 177558 - DNA, 20 bp, Artificial Sequence
  chemically synthesized
cggggtttcaccacgttgat

SEQ ID NO: 177559 - DNA, 20 bp, Artificial Sequence
  chemically synthesized
ttgtattttaagtagagacg

SEQ ID NO: 177560 - DNA, 20 bp, Artificial Sequence
  chemically synthesized
tttgtattttaagtagagac

SEQ ID NO: 177561 - DNA, 20 bp, Artificial Sequence
  chemically synthesized
ttttgtattttaagtagaga

SEQ ID NO: 177562 - DNA, 20 bp, Artificial Sequence
  chemically synthesized
taatttttgtattttaagta

SEQ ID NO: 177563 - DNA, 20 bp, Artificial Sequence
  chemically synthesized
gctaatttttgtattttaag

SEQ ID NO: 177564 - DNA, 20 bp, Artificial Sequence
  chemically synthesized
ctggctaatttttgtatttt

SEQ ID NO: 177565 - DNA, 20 bp, Artificial Sequence
  chemically synthesized
tctacttaaaatacaaaaat

SEQ ID NO: 177566 - DNA, 20 bp, Artificial Sequence
  chemically synthesized
cttaaaatacaaaaattagc

SEQ ID NO: 177567 - DNA, 20 bp, Artificial Sequence
  chemically synthesized
ttaaaatacaaaaattagcc

SEQ ID NO: 177568 - DNA, 20 bp, Artificial Sequence
  chemically synthesized
atacaaaaattagccaggcg

SEQ ID NO: 177569 - DNA, 20 bp, Artificial Sequence
  chemically synthesized
caaaaattagccaggcgtgg

SEQ ID NO: 177570 - DNA, 20 bp, Artificial Sequence
  chemically synthesized
caggcatgcaccaccacgcc

SEQ ID NO: 177571 - DNA, 20 bp, Artificial Sequence
  chemically synthesized
gtggtgcatgcctgtaatcc

SEQ ID NO: 177572 - DNA, 20 bp, Artificial Sequence
  chemically synthesized
tcccgagtagctgggattac

SEQ ID NO: 177573 - DNA, 20 bp, Artificial Sequence
  chemically synthesized
ttcccgagtagctgggatta

SEQ ID NO: 177574 - DNA, 20 bp, Artificial Sequence
  chemically synthesized
tgcctgtaatcccagctact

SEQ ID NO: 177575 - DNA, 20 bp, Artificial Sequence
  chemically synthesized
cctcagcttcccgagtagct

SEQ ID NO: 177576 - DNA, 20 bp, Artificial Sequence
  chemically synthesized
gcctgtaatcccagctactc

SEQ ID NO: 177577 - DNA, 20 bp, Artificial Sequence
  chemically synthesized
gcctcagcttcccgagtagc

SEQ ID NO: 177578 - DNA, 20 bp, Artificial Sequence
  chemically synthesized
tgtaatcccagctactcggg

SEQ ID NO: 177579 - DNA, 20 bp, Artificial Sequence
  chemically synthesized
tcctgcctcagcttcccgag

SEQ ID NO: 177580 - DNA, 20 bp, Artificial Sequence
  chemically synthesized
ttctcctgcctcagcttccc

SEQ ID NO: 177581 - DNA, 20 bp, Artificial Sequence
  chemically synthesized
tcccagctactcgggaagct

SEQ ID NO: 177582 - DNA, 20 bp, Artificial Sequence
  chemically synthesized
cccagctactcgggaagctg

SEQ ID NO: 177583 - DNA, 20 bp, Artificial Sequence
  chemically synthesized
agctactcgggaagctgagg

SEQ ID NO: 177584 - DNA, 20 bp, Artificial Sequence
  chemically synthesized
gctactcgggaagctgaggc

SEQ ID NO: 177585 - DNA, 20 bp, Artificial Sequence
  chemically synthesized
tactcgggaagctgaggcag

SEQ ID NO: 177586 - DNA, 20 bp, Artificial Sequence
  chemically synthesized
ttcaagcgattctcctgcct

SEQ ID NO: 177587 - DNA, 20 bp, Artificial Sequence
  chemically synthesized
gcaggagaatcgcttgaacc

SEQ ID NO: 177588 - DNA, 20 bp, Artificial Sequence
  chemically synthesized
caggagaatcgcttgaaccc

SEQ ID NO: 177589 - DNA, 20 bp, Artificial Sequence
  chemically synthesized
aacctctgtctcctgggttc

SEQ ID NO: 177590 - DNA, 20 bp, Artificial Sequence
  chemically synthesized
ggagaatcgcttgaacccag

SEQ ID NO: 177591 - DNA, 20 bp, Artificial Sequence
  chemically synthesized
aatcgcttgaacccaggaga

SEQ ID NO: 177592 - DNA, 20 bp, Artificial Sequence
  chemically synthesized
cactgcaacctctgtctcct

SEQ ID NO: 177593 - DNA, 20 bp, Artificial Sequence
  chemically synthesized
tcgcttgaacccaggagaca

SEQ ID NO: 177594 - DNA, 20 bp, Artificial Sequence
  chemically synthesized
tcactgcaacctctgtctcc

SEQ ID NO: 177595 - DNA, 20 bp, Artificial Sequence
  chemically synthesized
cgcttgaacccaggagacag

SEQ ID NO: 177596 - DNA, 20 bp, Artificial Sequence
  chemically synthesized
aacccaggagacagaggttg

SEQ ID NO: 177597 - DNA, 20 bp, Artificial Sequence
  chemically synthesized
caggagacagaggttgcagt

SEQ ID NO: 177598 - DNA, 20 bp, Artificial Sequence
  chemically synthesized
gagacagaggttgcagtgag

SEQ ID NO: 177599 - DNA, 20 bp, Artificial Sequence
  chemically synthesized
gacagaggttgcagtgagtg

SEQ ID NO: 177600 - DNA, 20 bp, Artificial Sequence
  chemically synthesized
tcgcccaggctggagtgcaa

SEQ ID NO: 177601 - DNA, 20 bp, Artificial Sequence
  chemically synthesized
gagatcgtgccattgcactc

SEQ ID NO: 177602 - DNA, 20 bp, Artificial Sequence
  chemically synthesized
cgtgccattgcactccagcc

SEQ ID NO: 177603 - DNA, 20 bp, Artificial Sequence
  chemically synthesized
gtgccattgcactccagcct

SEQ ID NO: 177604 - DNA, 20 bp, Artificial Sequence
  chemically synthesized
ttgctctgtcgcccaggctg

SEQ ID NO: 177605 - DNA, 20 bp, Artificial Sequence
  chemically synthesized
ttttgctctgtcgcccaggc

SEQ ID NO: 177606 - DNA, 20 bp, Artificial Sequence
  chemically synthesized
ttgcactccagcctgggcga

SEQ ID NO: 177607 - DNA, 20 bp, Artificial Sequence
  chemically synthesized
agagttttgctctgtcgccc

SEQ ID NO: 177608 - DNA, 20 bp, Artificial Sequence
  chemically synthesized
gcactccagcctgggcgaca

SEQ ID NO: 177609 - DNA, 20 bp, Artificial Sequence
  chemically synthesized
cagagttttgctctgtcgcc

SEQ ID NO: 177610 - DNA, 20 bp, Artificial Sequence
  chemically synthesized
ttttttttttttttgagaca

SEQ ID NO: 177611 - DNA, 20 bp, Artificial Sequence
  chemically synthesized
ttttttttttttttttgaga

SEQ ID NO: 177612 - DNA, 20 bp, Artificial Sequence
  chemically synthesized
tttgtttttttttttttttt

SEQ ID NO: 177613 - DNA, 20 bp, Artificial Sequence
  chemically synthesized
aaaaaaaaaaaaaaaacaaa

SEQ ID NO: 177614 - DNA, 20 bp, Artificial Sequence
  chemically synthesized
aaaaaaaaaaaaacaaaaag

SEQ ID NO: 177615 - DNA, 20 bp, Artificial Sequence
  chemically synthesized
tttatttttatatatttatt

SEQ ID NO: 177616 - DNA, 20 bp, Artificial Sequence
  chemically synthesized
atttatttttatatatttat

SEQ ID NO: 177617 - DNA, 20 bp, Artificial Sequence
  chemically synthesized
tgaattgacacgtatattat

SEQ ID NO: 177618 - DNA, 20 bp, Artificial Sequence
  chemically synthesized
atgaattgacacgtatatta

SEQ ID NO: 177619 - DNA, 20 bp, Artificial Sequence
  chemically synthesized
ataatatacgtgtcaattca

SEQ ID NO: 177620 - DNA, 20 bp, Artificial Sequence
  chemically synthesized
gtcaattcatagatgaaaat

SEQ ID NO: 177621 - DNA, 20 bp, Artificial Sequence
  chemically synthesized
atagatgaaaattagcctaa

SEQ ID NO: 177622 - DNA, 20 bp, Artificial Sequence
  chemically synthesized
atgaaaattagcctaaaagt

SEQ ID NO: 177623 - DNA, 20 bp, Artificial Sequence
  chemically synthesized
cctctgtgtttctcactttt

SEQ ID NO: 177624 - DNA, 20 bp, Artificial Sequence
  chemically synthesized
tcctctgtgtttctcacttt

SEQ ID NO: 177625 - DNA, 20 bp, Artificial Sequence
  chemically synthesized
tagcctaaaagtgagaaaca

SEQ ID NO: 177626 - DNA, 20 bp, Artificial Sequence
  chemically synthesized
gcctaaaagtgagaaacaca

SEQ ID NO: 177627 - DNA, 20 bp, Artificial Sequence
  chemically synthesized
cctaaaagtgagaaacacag

SEQ ID NO: 177628 - DNA, 20 bp, Artificial Sequence
  chemically synthesized
aaaagtgagaaacacagagg

SEQ ID NO: 177629 - DNA, 20 bp, Artificial Sequence
  chemically synthesized
aagtgagaaacacagaggaa

SEQ ID NO: 177630 - DNA, 20 bp, Artificial Sequence
  chemically synthesized
gtgagaaacacagaggaaga

SEQ ID NO: 177631 - DNA, 20 bp, Artificial Sequence
  chemically synthesized
gaggaagagagtgatgatga

SEQ ID NO: 177632 - DNA, 20 bp, Artificial Sequence
  chemically synthesized
aagagagtgatgatgatggc

SEQ ID NO: 177633 - DNA, 20 bp, Artificial Sequence
  chemically synthesized
gagagtgatgatgatggcga

SEQ ID NO: 177634 - DNA, 20 bp, Artificial Sequence
  chemically synthesized
gagtgatgatgatggcgaga

SEQ ID NO: 177635 - DNA, 20 bp, Artificial Sequence
  chemically synthesized
aacatgcatgtgggtgtagg

SEQ ID NO: 177636 - DNA, 20 bp, Artificial Sequence
  chemically synthesized
gaacatgcatgtgggtgtag

SEQ ID NO: 177637 - DNA, 20 bp, Artificial Sequence
  chemically synthesized
ctgaacatgcatgtgggtgt

SEQ ID NO: 177638 - DNA, 20 bp, Artificial Sequence
  chemically synthesized
tctgaacatgcatgtgggtg

SEQ ID NO: 177639 - DNA, 20 bp, Artificial Sequence
  chemically synthesized
ttttctctgaacatgcatgt

SEQ ID NO: 177640 - DNA, 20 bp, Artificial Sequence
  chemically synthesized
attttctctgaacatgcatg

SEQ ID NO: 177641 - DNA, 20 bp, Artificial Sequence
  chemically synthesized
cctacacccacatgcatgtt

SEQ ID NO: 177642 - DNA, 20 bp, Artificial Sequence
  chemically synthesized
tacacccacatgcatgttca

SEQ ID NO: 177643 - DNA, 20 bp, Artificial Sequence
  chemically synthesized
gcatgttcagagaaaataca

SEQ ID NO: 177644 - DNA, 20 bp, Artificial Sequence
  chemically synthesized
agaaaatacaaagaaatatg

SEQ ID NO: 177645 - DNA, 20 bp, Artificial Sequence
  chemically synthesized
aaaatacaaagaaatatgaa

SEQ ID NO: 177646 - DNA, 20 bp, Artificial Sequence
  chemically synthesized
aaatacaaagaaatatgaag

SEQ ID NO: 177647 - DNA, 20 bp, Artificial Sequence
  chemically synthesized
aatacaaagaaatatgaaga

SEQ ID NO: 177648 - DNA, 20 bp, Artificial Sequence
  chemically synthesized
gataaatattaaaaacacct

SEQ ID NO: 177649 - DNA, 20 bp, Artificial Sequence
  chemically synthesized
aatattaaaaacacctgagt

SEQ ID NO: 177650 - DNA, 20 bp, Artificial Sequence
  chemically synthesized
attaaaaacacctgagtcag

SEQ ID NO: 177651 - DNA, 20 bp, Artificial Sequence
  chemically synthesized
ttcacccacacttctgactc

SEQ ID NO: 177652 - DNA, 20 bp, Artificial Sequence
  chemically synthesized
cttcacccacacttctgact

SEQ ID NO: 177653 - DNA, 20 bp, Artificial Sequence
  chemically synthesized
aaacacctgagtcagaagtg

SEQ ID NO: 177654 - DNA, 20 bp, Artificial Sequence
  chemically synthesized
aacacctgagtcagaagtgt

SEQ ID NO: 177655 - DNA, 20 bp, Artificial Sequence
  chemically synthesized
ctgagtcagaagtgtgggtg

SEQ ID NO: 177656 - DNA, 20 bp, Artificial Sequence
  chemically synthesized
agaagtgtgggtgaagatca

SEQ ID NO: 177657 - DNA, 20 bp, Artificial Sequence
  chemically synthesized
gtgggtgaagatcatagaat

SEQ ID NO: 177658 - DNA, 20 bp, Artificial Sequence
  chemically synthesized
agatcatagaatgagatgat

SEQ ID NO: 177659 - DNA, 20 bp, Artificial Sequence
  chemically synthesized
atcatagaatgagatgatca

SEQ ID NO: 177660 - DNA, 20 bp, Artificial Sequence
  chemically synthesized
catagaatgagatgatcaga

SEQ ID NO: 177661 - DNA, 20 bp, Artificial Sequence
  chemically synthesized
tagaatgagatgatcagaga

SEQ ID NO: 177662 - DNA, 20 bp, Artificial Sequence
  chemically synthesized
agaatgagatgatcagagag

SEQ ID NO: 177663 - DNA, 20 bp, Artificial Sequence
  chemically synthesized
gatgatcagagagaggaaca

SEQ ID NO: 177664 - DNA, 20 bp, Artificial Sequence
  chemically synthesized
tgatcagagagaggaacaca

SEQ ID NO: 177665 - DNA, 20 bp, Artificial Sequence
  chemically synthesized
gatcagagagaggaacacag

SEQ ID NO: 177666 - DNA, 20 bp, Artificial Sequence
  chemically synthesized
agagagaggaacacagaggc

SEQ ID NO: 177667 - DNA, 20 bp, Artificial Sequence
  chemically synthesized
agtggggatgttattaaagc

SEQ ID NO: 177668 - DNA, 20 bp, Artificial Sequence
  chemically synthesized
acaaagtggggatgttatta

SEQ ID NO: 177669 - DNA, 20 bp, Artificial Sequence
  chemically synthesized
ttaataacatccccactttg

SEQ ID NO: 177670 - DNA, 20 bp, Artificial Sequence
  chemically synthesized
cccgtaagagccacaaagtg

SEQ ID NO: 177671 - DNA, 20 bp, Artificial Sequence
  chemically synthesized
acccgtaagagccacaaagt

SEQ ID NO: 177672 - DNA, 20 bp, Artificial Sequence
  chemically synthesized
tacccgtaagagccacaaag

SEQ ID NO: 177673 - DNA, 20 bp, Artificial Sequence
  chemically synthesized
tgatacccgtaagagccaca

SEQ ID NO: 177674 - DNA, 20 bp, Artificial Sequence
  chemically synthesized
tccccactttgtggctctta

SEQ ID NO: 177675 - DNA, 20 bp, Artificial Sequence
  chemically synthesized
ccccactttgtggctcttac

SEQ ID NO: 177676 - DNA, 20 bp, Artificial Sequence
  chemically synthesized
tttaacaatgatacccgtaa

SEQ ID NO: 177677 - DNA, 20 bp, Artificial Sequence
  chemically synthesized
cctttaacaatgatacccgt

SEQ ID NO: 177678 - DNA, 20 bp, Artificial Sequence
  chemically synthesized
tcttacgggtatcattgtta

SEQ ID NO: 177679 - DNA, 20 bp, Artificial Sequence
  chemically synthesized
cttacgggtatcattgttaa

SEQ ID NO: 177680 - DNA, 20 bp, Artificial Sequence
  chemically synthesized
atcattgttaaaggctgtaa

SEQ ID NO: 177681 - DNA, 20 bp, Artificial Sequence
  chemically synthesized
tcattgttaaaggctgtaaa

SEQ ID NO: 177682 - DNA, 20 bp, Artificial Sequence
  chemically synthesized
atacataacttgacctttta

SEQ ID NO: 177683 - DNA, 20 bp, Artificial Sequence
  chemically synthesized
gttaaaggctgtaaaaggtc

SEQ ID NO: 177684 - DNA, 20 bp, Artificial Sequence
  chemically synthesized
taaaaggtcaagttatgtat

SEQ ID NO: 177685 - DNA, 20 bp, Artificial Sequence
  chemically synthesized
ggtcaagttatgtattagac

SEQ ID NO: 177686 - DNA, 20 bp, Artificial Sequence
  chemically synthesized
gttatgtattagacaagaat

SEQ ID NO: 177687 - DNA, 20 bp, Artificial Sequence
  chemically synthesized
ttatgtattagacaagaatg

SEQ ID NO: 177688 - DNA, 20 bp, Artificial Sequence
  chemically synthesized
gaatgaggatatcatttcat

SEQ ID NO: 177689 - DNA, 20 bp, Artificial Sequence
  chemically synthesized
tgggtagcttcatgcaatga

SEQ ID NO: 177690 - DNA, 20 bp, Artificial Sequence
  chemically synthesized
atgggtagcttcatgcaatg

SEQ ID NO: 177691 - DNA, 20 bp, Artificial Sequence
  chemically synthesized
tcatgagccttcattgcatg

SEQ ID NO: 177692 - DNA, 20 bp, Artificial Sequence
  chemically synthesized
cattagcgtaaatttatggg

SEQ ID NO: 177693 - DNA, 20 bp, Artificial Sequence
  chemically synthesized
agccattagcgtaaatttat

SEQ ID NO: 177694 - DNA, 20 bp, Artificial Sequence
  chemically synthesized
tagccattagcgtaaattta

SEQ ID NO: 177695 - DNA, 20 bp, Artificial Sequence
  chemically synthesized
tacccataaatttacgctaa

SEQ ID NO: 177696 - DNA, 20 bp, Artificial Sequence
  chemically synthesized
tttaaactgaatatagccat

SEQ ID NO: 177697 - DNA, 20 bp, Artificial Sequence
  chemically synthesized
tttacgctaatggctatatt

SEQ ID NO: 177698 - DNA, 20 bp, Artificial Sequence
  chemically synthesized
gggttgctttaaactgaata

SEQ ID NO: 177699 - DNA, 20 bp, Artificial Sequence
  chemically synthesized
taatggctatattcagttta

SEQ ID NO: 177700 - DNA, 20 bp, Artificial Sequence
  chemically synthesized
ctttaagggagtggtggaca

SEQ ID NO: 177701 - DNA, 20 bp, Artificial Sequence
  chemically synthesized
tctttaagggagtggtggac

SEQ ID NO: 177702 - DNA, 20 bp, Artificial Sequence
  chemically synthesized
ttctttaagggagtggtgga

SEQ ID NO: 177703 - DNA, 20 bp, Artificial Sequence
  chemically synthesized
ctatttctttaagggagtgg

SEQ ID NO: 177704 - DNA, 20 bp, Artificial Sequence
  chemically synthesized
tagctatttctttaagggag

SEQ ID NO: 177705 - DNA, 20 bp, Artificial Sequence
  chemically synthesized
ccctgtccaccactccctta

SEQ ID NO: 177706 - DNA, 20 bp, Artificial Sequence
  chemically synthesized
atatagctatttctttaagg

SEQ ID NO: 177707 - DNA, 20 bp, Artificial Sequence
  chemically synthesized
taatatagctatttctttaa

SEQ ID NO: 177708 - DNA, 20 bp, Artificial Sequence
  chemically synthesized
ataatatagctatttcttta

SEQ ID NO: 177709 - DNA, 20 bp, Artificial Sequence
  chemically synthesized
ccaccactcccttaaagaaa

SEQ ID NO: 177710 - DNA, 20 bp, Artificial Sequence
  chemically synthesized
gataatatagctatttcttt

SEQ ID NO: 177711 - DNA, 20 bp, Artificial Sequence
  chemically synthesized
aacagcaggtgaagataata

SEQ ID NO: 177712 - DNA, 20 bp, Artificial Sequence
  chemically synthesized
aagagagaaaacagcaggtg

SEQ ID NO: 177713 - DNA, 20 bp, Artificial Sequence
  chemically synthesized
tactgaagagagaaaacagc

SEQ ID NO: 177714 - DNA, 20 bp, Artificial Sequence
  chemically synthesized
ttactgaagagagaaaacag

SEQ ID NO: 177715 - DNA, 20 bp, Artificial Sequence
  chemically synthesized
tcattactgaagagagaaaa

SEQ ID NO: 177716 - DNA, 20 bp, Artificial Sequence
  chemically synthesized
cacctgctgttttctctctt

SEQ ID NO: 177717 - DNA, 20 bp, Artificial Sequence
  chemically synthesized
ttatatttcattactgaaga

SEQ ID NO: 177718 - DNA, 20 bp, Artificial Sequence
  chemically synthesized
atttatatttcattactgaa

SEQ ID NO: 177719 - DNA, 20 bp, Artificial Sequence
  chemically synthesized
acatttatatttcattactg

SEQ ID NO: 177720 - DNA, 20 bp, Artificial Sequence
  chemically synthesized
agtaatgaaatataaatgta

SEQ ID NO: 177721 - DNA, 20 bp, Artificial Sequence
  chemically synthesized
gtaatgaaatataaatgtac

SEQ ID NO: 177722 - DNA, 20 bp, Artificial Sequence
  chemically synthesized
tgaaatataaatgtacaggc

SEQ ID NO: 177723 - DNA, 20 bp, Artificial Sequence
  chemically synthesized
gaaatataaatgtacaggcc

SEQ ID NO: 177724 - DNA, 20 bp, Artificial Sequence
  chemically synthesized
ataaatgtacaggccgggcg

SEQ ID NO: 177725 - DNA, 20 bp, Artificial Sequence
  chemically synthesized
aatgtacaggccgggcgcgg

SEQ ID NO: 177726 - DNA, 20 bp, Artificial Sequence
  chemically synthesized
caggtgtgagccaccgcgcc

SEQ ID NO: 177727 - DNA, 20 bp, Artificial Sequence
  chemically synthesized
agtgcggggattacaggtgt

SEQ ID NO: 177728 - DNA, 20 bp, Artificial Sequence
  chemically synthesized
tccgaaagtgcggggattac

SEQ ID NO: 177729 - DNA, 20 bp, Artificial Sequence
  chemically synthesized
ctccgaaagtgcggggatta

SEQ ID NO: 177730 - DNA, 20 bp, Artificial Sequence
  chemically synthesized
cctcagcctccgaaagtgcg

SEQ ID NO: 177731 - DNA, 20 bp, Artificial Sequence
  chemically synthesized
acctgtaatccccgcacttt

SEQ ID NO: 177732 - DNA, 20 bp, Artificial Sequence
  chemically synthesized
acctcagcctccgaaagtgc

SEQ ID NO: 177733 - DNA, 20 bp, Artificial Sequence
  chemically synthesized
cacctcagcctccgaaagtg

SEQ ID NO: 177734 - DNA, 20 bp, Artificial Sequence
  chemically synthesized
ctgtaatccccgcactttcg

SEQ ID NO: 177735 - DNA, 20 bp, Artificial Sequence
  chemically synthesized
tgtaatccccgcactttcgg

SEQ ID NO: 177736 - DNA, 20 bp, Artificial Sequence
  chemically synthesized
ctgctcacctcagcctccga

SEQ ID NO: 177737 - DNA, 20 bp, Artificial Sequence
  chemically synthesized
tccccgcactttcggaggct

SEQ ID NO: 177738 - DNA, 20 bp, Artificial Sequence
  chemically synthesized
ccccgcactttcggaggctg

SEQ ID NO: 177739 - DNA, 20 bp, Artificial Sequence
  chemically synthesized
gcactttcggaggctgaggt

SEQ ID NO: 177740 - DNA, 20 bp, Artificial Sequence
  chemically synthesized
ctttcggaggctgaggtgag

SEQ ID NO: 177741 - DNA, 20 bp, Artificial Sequence
  chemically synthesized
acctcatgatctgctcacct

SEQ ID NO: 177742 - DNA, 20 bp, Artificial Sequence
  chemically synthesized
ggctgaggtgagcagatcat

SEQ ID NO: 177743 - DNA, 20 bp, Artificial Sequence
  chemically synthesized
gctgaggtgagcagatcatg

SEQ ID NO: 177744 - DNA, 20 bp, Artificial Sequence
  chemically synthesized
aggtgagcagatcatgaggt

SEQ ID NO: 177745 - DNA, 20 bp, Artificial Sequence
  chemically synthesized
ggtgagcagatcatgaggtc

SEQ ID NO: 177746 - DNA, 20 bp, Artificial Sequence
  chemically synthesized
tgagcagatcatgaggtcag

SEQ ID NO: 177747 - DNA, 20 bp, Artificial Sequence
  chemically synthesized
gatcatgaggtcaggagttc

SEQ ID NO: 177748 - DNA, 20 bp, Artificial Sequence
  chemically synthesized
tgaggtcaggagttcgagac

SEQ ID NO: 177749 - DNA, 20 bp, Artificial Sequence
  chemically synthesized
tcaggagttcgagaccagcc

SEQ ID NO: 177750 - DNA, 20 bp, Artificial Sequence
  chemically synthesized
gttcgccatgtcggccaggc

SEQ ID NO: 177751 - DNA, 20 bp, Artificial Sequence
  chemically synthesized
gagggttcgccatgtcggcc

SEQ ID NO: 177752 - DNA, 20 bp, Artificial Sequence
  chemically synthesized
cgagaccagcctggccgaca

SEQ ID NO: 177753 - DNA, 20 bp, Artificial Sequence
  chemically synthesized
ggagggttcgccatgtcggc

SEQ ID NO: 177754 - DNA, 20 bp, Artificial Sequence
  chemically synthesized
agatggagggttcgccatgt

SEQ ID NO: 177755 - DNA, 20 bp, Artificial Sequence
  chemically synthesized
gtatttttagtagagatgga

SEQ ID NO: 177756 - DNA, 20 bp, Artificial Sequence
  chemically synthesized
tgtatttttagtagagatgg

SEQ ID NO: 177757 - DNA, 20 bp, Artificial Sequence
  chemically synthesized
ttgtatttttagtagagatg

SEQ ID NO: 177758 - DNA, 20 bp, Artificial Sequence
  chemically synthesized
ttttgtatttttagtagaga

SEQ ID NO: 177759 - DNA, 20 bp, Artificial Sequence
  chemically synthesized
taatttttgtatttttagta

SEQ ID NO: 177760 - DNA, 20 bp, Artificial Sequence
  chemically synthesized
actaatttttgtatttttag

SEQ ID NO: 177761 - DNA, 20 bp, Artificial Sequence
  chemically synthesized
ccaactaatttttgtatttt

SEQ ID NO: 177762 - DNA, 20 bp, Artificial Sequence
  chemically synthesized
tctactaaaaatacaaaaat

SEQ ID NO: 177763 - DNA, 20 bp, Artificial Sequence
  chemically synthesized
ctaaaaatacaaaaattagt

SEQ ID NO: 177764 - DNA, 20 bp, Artificial Sequence
  chemically synthesized
taaaaatacaaaaattagtt

SEQ ID NO: 177765 - DNA, 20 bp, Artificial Sequence
  chemically synthesized
atacaaaaattagttgggtg

SEQ ID NO: 177766 - DNA, 20 bp, Artificial Sequence
  chemically synthesized
caaaaattagttgggtgtgg

SEQ ID NO: 177767 - DNA, 20 bp, Artificial Sequence
  chemically synthesized
ggtgtggtggtgcgcgcctg

SEQ ID NO: 177768 - DNA, 20 bp, Artificial Sequence
  chemically synthesized
gtggtgcgcgcctgtagtcc

SEQ ID NO: 177769 - DNA, 20 bp, Artificial Sequence
  chemically synthesized
tctcgagtagctgggactac

SEQ ID NO: 177770 - DNA, 20 bp, Artificial Sequence
  chemically synthesized
ctctcgagtagctgggacta

SEQ ID NO: 177771 - DNA, 20 bp, Artificial Sequence
  chemically synthesized
cctcagcctctcgagtagct

SEQ ID NO: 177772 - DNA, 20 bp, Artificial Sequence
  chemically synthesized
gcctgtagtcccagctactc

SEQ ID NO: 177773 - DNA, 20 bp, Artificial Sequence
  chemically synthesized
gcctcagcctctcgagtagc

SEQ ID NO: 177774 - DNA, 20 bp, Artificial Sequence
  chemically synthesized
ctgtagtcccagctactcga

SEQ ID NO: 177775 - DNA, 20 bp, Artificial Sequence
  chemically synthesized
tgtagtcccagctactcgag

SEQ ID NO: 177776 - DNA, 20 bp, Artificial Sequence
  chemically synthesized
ttctgcctcagcctctcgag

SEQ ID NO: 177777 - DNA, 20 bp, Artificial Sequence
  chemically synthesized
ttcttctgcctcagcctctc

SEQ ID NO: 177778 - DNA, 20 bp, Artificial Sequence
  chemically synthesized
tcccagctactcgagaggct

SEQ ID NO: 177779 - DNA, 20 bp, Artificial Sequence
  chemically synthesized
cccagctactcgagaggctg

SEQ ID NO: 177780 - DNA, 20 bp, Artificial Sequence
  chemically synthesized
agctactcgagaggctgagg

SEQ ID NO: 177781 - DNA, 20 bp, Artificial Sequence
  chemically synthesized
tactcgagaggctgaggcag

SEQ ID NO: 177782 - DNA, 20 bp, Artificial Sequence
  chemically synthesized
ttcaagtgattcttctgcct

SEQ ID NO: 177783 - DNA, 20 bp, Artificial Sequence
  chemically synthesized
gcagaagaatcacttgaacc

SEQ ID NO: 177784 - DNA, 20 bp, Artificial Sequence
  chemically synthesized
cagaagaatcacttgaaccc

SEQ ID NO: 177785 - DNA, 20 bp, Artificial Sequence
  chemically synthesized
aacctccacctcccgggttc

SEQ ID NO: 177786 - DNA, 20 bp, Artificial Sequence
  chemically synthesized
gaagaatcacttgaacccgg

SEQ ID NO: 177787 - DNA, 20 bp, Artificial Sequence
  chemically synthesized
aagaatcacttgaacccggg

SEQ ID NO: 177788 - DNA, 20 bp, Artificial Sequence
  chemically synthesized
aatcacttgaacccgggagg

SEQ ID NO: 177789 - DNA, 20 bp, Artificial Sequence
  chemically synthesized
cactgcaacctccacctccc

SEQ ID NO: 177790 - DNA, 20 bp, Artificial Sequence
  chemically synthesized
tcacttgaacccgggaggtg

SEQ ID NO: 177791 - DNA, 20 bp, Artificial Sequence
  chemically synthesized
tcactgcaacctccacctcc

SEQ ID NO: 177792 - DNA, 20 bp, Artificial Sequence
  chemically synthesized
cacttgaacccgggaggtgg

SEQ ID NO: 177793 - DNA, 20 bp, Artificial Sequence
  chemically synthesized
aacccgggaggtggaggttg

SEQ ID NO: 177794 - DNA, 20 bp, Artificial Sequence
  chemically synthesized
cgggaggtggaggttgcagt

SEQ ID NO: 177795 - DNA, 20 bp, Artificial Sequence
  chemically synthesized
ggtggaggttgcagtgagct

SEQ ID NO: 177796 - DNA, 20 bp, Artificial Sequence
  chemically synthesized
gcagtgcagtggcacgatct

SEQ ID NO: 177797 - DNA, 20 bp, Artificial Sequence
  chemically synthesized
tcatccaggctgcagtgcag

SEQ ID NO: 177798 - DNA, 20 bp, Artificial Sequence
  chemically synthesized
gagatcgtgccactgcactg

SEQ ID NO: 177799 - DNA, 20 bp, Artificial Sequence
  chemically synthesized
ttgtcatccaggctgcagtg

SEQ ID NO: 177800 - DNA, 20 bp, Artificial Sequence
  chemically synthesized
cgtgccactgcactgcagcc

SEQ ID NO: 177801 - DNA, 20 bp, Artificial Sequence
  chemically synthesized
tcgctttgtcatccaggctg

SEQ ID NO: 177802 - DNA, 20 bp, Artificial Sequence
  chemically synthesized
agagtctcgctttgtcatcc

SEQ ID NO: 177803 - DNA, 20 bp, Artificial Sequence
  chemically synthesized
gcactgcagcctggatgaca

SEQ ID NO: 177804 - DNA, 20 bp, Artificial Sequence
  chemically synthesized
cagagtctcgctttgtcatc

SEQ ID NO: 177805 - DNA, 20 bp, Artificial Sequence
  chemically synthesized
tgcagcctggatgacaaagc

SEQ ID NO: 177806 - DNA, 20 bp, Artificial Sequence
  chemically synthesized
tttatttattttttgagaca

SEQ ID NO: 177807 - DNA, 20 bp, Artificial Sequence
  chemically synthesized
tttttatttattttttgaga

SEQ ID NO: 177808 - DNA, 20 bp, Artificial Sequence
  chemically synthesized
tttttttttatttatttttt

SEQ ID NO: 177809 - DNA, 20 bp, Artificial Sequence
  chemically synthesized
ataaaaaaaaaaataaaata

SEQ ID NO: 177810 - DNA, 20 bp, Artificial Sequence
  chemically synthesized
taaaaaaaaaaataaaataa

SEQ ID NO: 177811 - DNA, 20 bp, Artificial Sequence
  chemically synthesized
aaaaaataaaataaaggtac

SEQ ID NO: 177812 - DNA, 20 bp, Artificial Sequence
  chemically synthesized
aaaataaaataaaggtacaa

SEQ ID NO: 177813 - DNA, 20 bp, Artificial Sequence
  chemically synthesized
taaaataaaggtacaagagt

SEQ ID NO: 177814 - DNA, 20 bp, Artificial Sequence
  chemically synthesized
aaaataaaggtacaagagta

SEQ ID NO: 177815 - DNA, 20 bp, Artificial Sequence
  chemically synthesized
aaataaaggtacaagagtaa

SEQ ID NO: 177816 - DNA, 20 bp, Artificial Sequence
  chemically synthesized
aataaaggtacaagagtaag

SEQ ID NO: 177817 - DNA, 20 bp, Artificial Sequence
  chemically synthesized
aaggtacaagagtaaggggt

SEQ ID NO: 177818 - DNA, 20 bp, Artificial Sequence
  chemically synthesized
tacaagagtaaggggtcagt

SEQ ID NO: 177819 - DNA, 20 bp, Artificial Sequence
  chemically synthesized
gggtcagttggctcaatacg

SEQ ID NO: 177820 - DNA, 20 bp, Artificial Sequence
  chemically synthesized
tatgctgcattctgcgtatt

SEQ ID NO: 177821 - DNA, 20 bp, Artificial Sequence
  chemically synthesized
ttggctcaatacgcagaatg

SEQ ID NO: 177822 - DNA, 20 bp, Artificial Sequence
  chemically synthesized
atacgcagaatgcagcatat

SEQ ID NO: 177823 - DNA, 20 bp, Artificial Sequence
  chemically synthesized
acgcagaatgcagcatatta

SEQ ID NO: 177824 - DNA, 20 bp, Artificial Sequence
  chemically synthesized
agaatgcagcatattagagt

SEQ ID NO: 177825 - DNA, 20 bp, Artificial Sequence
  chemically synthesized
cagcatattagagttagctg

SEQ ID NO: 177826 - DNA, 20 bp, Artificial Sequence
  chemically synthesized
gcatattagagttagctgtg

SEQ ID NO: 177827 - DNA, 20 bp, Artificial Sequence
  chemically synthesized
attagagttagctgtggaga

SEQ ID NO: 177828 - DNA, 20 bp, Artificial Sequence
  chemically synthesized
ttggcaggtgactttctcca

SEQ ID NO: 177829 - DNA, 20 bp, Artificial Sequence
  chemically synthesized
taatatcataatcagttggc

SEQ ID NO: 177830 - DNA, 20 bp, Artificial Sequence
  chemically synthesized
ctaatatcataatcagttgg

SEQ ID NO: 177831 - DNA, 20 bp, Artificial Sequence
  chemically synthesized
atcctaatatcataatcagt

SEQ ID NO: 177832 - DNA, 20 bp, Artificial Sequence
  chemically synthesized
acatatcctaatatcataat

SEQ ID NO: 177833 - DNA, 20 bp, Artificial Sequence
  chemically synthesized
ctgccaactgattatgatat

SEQ ID NO: 177834 - DNA, 20 bp, Artificial Sequence
  chemically synthesized
tgccaactgattatgatatt

SEQ ID NO: 177835 - DNA, 20 bp, Artificial Sequence
  chemically synthesized
ttatgatattaggatatgtt

SEQ ID NO: 177836 - DNA, 20 bp, Artificial Sequence
  chemically synthesized
atgatattaggatatgtttg

SEQ ID NO: 177837 - DNA, 20 bp, Artificial Sequence
  chemically synthesized
gtttggagatactatgtact

SEQ ID NO: 177838 - DNA, 20 bp, Artificial Sequence
  chemically synthesized
tttggagatactatgtacta

SEQ ID NO: 177839 - DNA, 20 bp, Artificial Sequence
  chemically synthesized
tatgtcaattccttagtaca

SEQ ID NO: 177840 - DNA, 20 bp, Artificial Sequence
  chemically synthesized
acatgaatatgtcaattcct

SEQ ID NO: 177841 - DNA, 20 bp, Artificial Sequence
  chemically synthesized
gaattgacatattcatgtca

SEQ ID NO: 177842 - DNA, 20 bp, Artificial Sequence
  chemically synthesized
taattggaactagtgggtca

SEQ ID NO: 177843 - DNA, 20 bp, Artificial Sequence
  chemically synthesized
tcacagtaactatgacccac

SEQ ID NO: 177844 - DNA, 20 bp, Artificial Sequence
  chemically synthesized
gtgatataattggaactagt

SEQ ID NO: 177845 - DNA, 20 bp, Artificial Sequence
  chemically synthesized
ggtgatataattggaactag

SEQ ID NO: 177846 - DNA, 20 bp, Artificial Sequence
  chemically synthesized
gtgggtgatataattggaac

SEQ ID NO: 177847 - DNA, 20 bp, Artificial Sequence
  chemically synthesized
gttagagtgggtgatataat

SEQ ID NO: 177848 - DNA, 20 bp, Artificial Sequence
  chemically synthesized
cttcatccaaaggttagagt

SEQ ID NO: 177849 - DNA, 20 bp, Artificial Sequence
  chemically synthesized
ccttcatccaaaggttagag

SEQ ID NO: 177850 - DNA, 20 bp, Artificial Sequence
  chemically synthesized
atatcacccactctaacctt

SEQ ID NO: 177851 - DNA, 20 bp, Artificial Sequence
  chemically synthesized
tacccttcatccaaaggtta

SEQ ID NO: 177852 - DNA, 20 bp, Artificial Sequence
  chemically synthesized
cctacccttcatccaaaggt

SEQ ID NO: 177853 - DNA, 20 bp, Artificial Sequence
  chemically synthesized
cccactctaacctttggatg

SEQ ID NO: 177854 - DNA, 20 bp, Artificial Sequence
  chemically synthesized
cagccctacccttcatccaa

SEQ ID NO: 177855 - DNA, 20 bp, Artificial Sequence
  chemically synthesized
ccactctaacctttggatga

SEQ ID NO: 177856 - DNA, 20 bp, Artificial Sequence
  chemically synthesized
ccagccctacccttcatcca

SEQ ID NO: 177857 - DNA, 20 bp, Artificial Sequence
  chemically synthesized
cactctaacctttggatgaa

SEQ ID NO: 177858 - DNA, 20 bp, Artificial Sequence
  chemically synthesized
tctaacctttggatgaaggg

SEQ ID NO: 177859 - DNA, 20 bp, Artificial Sequence
  chemically synthesized
ctaacctttggatgaagggt

SEQ ID NO: 177860 - DNA, 20 bp, Artificial Sequence
  chemically synthesized
taacctttggatgaagggta

SEQ ID NO: 177861 - DNA, 20 bp, Artificial Sequence
  chemically synthesized
ctttggatgaagggtagggc

SEQ ID NO: 177862 - DNA, 20 bp, Artificial Sequence
  chemically synthesized
ttggatgaagggtagggctg

SEQ ID NO: 177863 - DNA, 20 bp, Artificial Sequence
  chemically synthesized
tggatgaagggtagggctgg

SEQ ID NO: 177864 - DNA, 20 bp, Artificial Sequence
  chemically synthesized
aagggtagggctggaggaca

SEQ ID NO: 177865 - DNA, 20 bp, Artificial Sequence
  chemically synthesized
gaccccctccctgtgtcctc

SEQ ID NO: 177866 - DNA, 20 bp, Artificial Sequence
  chemically synthesized
agggtagggctggaggacac

SEQ ID NO: 177867 - DNA, 20 bp, Artificial Sequence
  chemically synthesized
gggtagggctggaggacaca

SEQ ID NO: 177868 - DNA, 20 bp, Artificial Sequence
  chemically synthesized
gtagggctggaggacacagg

SEQ ID NO: 177869 - DNA, 20 bp, Artificial Sequence
  chemically synthesized
tagggctggaggacacaggg

SEQ ID NO: 177870 - DNA, 20 bp, Artificial Sequence
  chemically synthesized
agggctggaggacacaggga

SEQ ID NO: 177871 - DNA, 20 bp, Artificial Sequence
  chemically synthesized
gggctggaggacacagggag

SEQ ID NO: 177872 - DNA, 20 bp, Artificial Sequence
  chemically synthesized
ggctggaggacacagggagg

SEQ ID NO: 177873 - DNA, 20 bp, Artificial Sequence
  chemically synthesized
acaggagggtagaaataaag

SEQ ID NO: 177874 - DNA, 20 bp, Artificial Sequence
  chemically synthesized
attacaggagggtagaaata

SEQ ID NO: 177875 - DNA, 20 bp, Artificial Sequence
  chemically synthesized
tcttacttattacaggaggg

SEQ ID NO: 177876 - DNA, 20 bp, Artificial Sequence
  chemically synthesized
agctcttacttattacagga

SEQ ID NO: 177877 - DNA, 20 bp, Artificial Sequence
  chemically synthesized
aagctcttacttattacagg

SEQ ID NO: 177878 - DNA, 20 bp, Artificial Sequence
  chemically synthesized
tatttctaccctcctgtaat

SEQ ID NO: 177879 - DNA, 20 bp, Artificial Sequence
  chemically synthesized
caagctcttacttattacag

SEQ ID NO: 177880 - DNA, 20 bp, Artificial Sequence
  chemically synthesized
ctcaagctcttacttattac

SEQ ID NO: 177881 - DNA, 20 bp, Artificial Sequence
  chemically synthesized
tctcaagctcttacttatta

SEQ ID NO: 177882 - DNA, 20 bp, Artificial Sequence
  chemically synthesized
tctaccctcctgtaataagt

SEQ ID NO: 177883 - DNA, 20 bp, Artificial Sequence
  chemically synthesized
taccctcctgtaataagtaa

SEQ ID NO: 177884 - DNA, 20 bp, Artificial Sequence
  chemically synthesized
cctgtaataagtaagagctt

SEQ ID NO: 177885 - DNA, 20 bp, Artificial Sequence
  chemically synthesized
cttgatcttcattaaatctc

SEQ ID NO: 177886 - DNA, 20 bp, Artificial Sequence
  chemically synthesized
taagagcttgagatttaatg

SEQ ID NO: 177887 - DNA, 20 bp, Artificial Sequence
  chemically synthesized
cttgagatttaatgaagatc

SEQ ID NO: 177888 - DNA, 20 bp, Artificial Sequence
  chemically synthesized
tgaagatcaagactgtctgc

SEQ ID NO: 177889 - DNA, 20 bp, Artificial Sequence
  chemically synthesized
tggcttataacactggcaga

SEQ ID NO: 177890 - DNA, 20 bp, Artificial Sequence
  chemically synthesized
aaaatggcttataacactgg

SEQ ID NO: 177891 - DNA, 20 bp, Artificial Sequence
  chemically synthesized
agactgtctgccagtgttat

SEQ ID NO: 177892 - DNA, 20 bp, Artificial Sequence
  chemically synthesized
aagaaaatggcttataacac

SEQ ID NO: 177893 - DNA, 20 bp, Artificial Sequence
  chemically synthesized
tttttaaaagtaaaagaaaa

SEQ ID NO: 177894 - DNA, 20 bp, Artificial Sequence
  chemically synthesized
acaagtttttttaaaagtaa

SEQ ID NO: 177895 - DNA, 20 bp, Artificial Sequence
  chemically synthesized
aataacacaagtttttttaa

SEQ ID NO: 177896 - DNA, 20 bp, Artificial Sequence
  chemically synthesized
cagatttaggtaaataacac

SEQ ID NO: 177897 - DNA, 20 bp, Artificial Sequence
  chemically synthesized
ttgtgttatttacctaaatc

SEQ ID NO: 177898 - DNA, 20 bp, Artificial Sequence
  chemically synthesized
aaatgatcagtaccagattt

SEQ ID NO: 177899 - DNA, 20 bp, Artificial Sequence
  chemically synthesized
caaatgatcagtaccagatt

SEQ ID NO: 177900 - DNA, 20 bp, Artificial Sequence
  chemically synthesized
agaaagcaaatgatcagtac

SEQ ID NO: 177901 - DNA, 20 bp, Artificial Sequence
  chemically synthesized
agggatagaaagcaaatgat

SEQ ID NO: 177902 - DNA, 20 bp, Artificial Sequence
  chemically synthesized
agtttagatttagggataga

SEQ ID NO: 177903 - DNA, 20 bp, Artificial Sequence
  chemically synthesized
tgttagtttagatttaggga

SEQ ID NO: 177904 - DNA, 20 bp, Artificial Sequence
  chemically synthesized
tccctgttagtttagattta

SEQ ID NO: 177905 - DNA, 20 bp, Artificial Sequence
  chemically synthesized
atccctgttagtttagattt

SEQ ID NO: 177906 - DNA, 20 bp, Artificial Sequence
  chemically synthesized
tatccctgttagtttagatt

SEQ ID NO: 177907 - DNA, 20 bp, Artificial Sequence
  chemically synthesized
tatccctaaatctaaactaa

SEQ ID NO: 177908 - DNA, 20 bp, Artificial Sequence
  chemically synthesized
atccctaaatctaaactaac

SEQ ID NO: 177909 - DNA, 20 bp, Artificial Sequence
  chemically synthesized
cctctgtatccctgttagtt

SEQ ID NO: 177910 - DNA, 20 bp, Artificial Sequence
  chemically synthesized
tccctaaatctaaactaaca

SEQ ID NO: 177911 - DNA, 20 bp, Artificial Sequence
  chemically synthesized
atatgcctctgtatccctgt

SEQ ID NO: 177912 - DNA, 20 bp, Artificial Sequence
  chemically synthesized
aatctaaactaacagggata

SEQ ID NO: 177913 - DNA, 20 bp, Artificial Sequence
  chemically synthesized
tctaaactaacagggataca

SEQ ID NO: 177914 - DNA, 20 bp, Artificial Sequence
  chemically synthesized
ctaaactaacagggatacag

SEQ ID NO: 177915 - DNA, 20 bp, Artificial Sequence
  chemically synthesized
aacagggatacagaggcata

SEQ ID NO: 177916 - DNA, 20 bp, Artificial Sequence
  chemically synthesized
gggatacagaggcatatgga

SEQ ID NO: 177917 - DNA, 20 bp, Artificial Sequence
  chemically synthesized
gatacagaggcatatggatg

SEQ ID NO: 177918 - DNA, 20 bp, Artificial Sequence
  chemically synthesized
agaggcatatggatggagaa

SEQ ID NO: 177919 - DNA, 20 bp, Artificial Sequence
  chemically synthesized
ggatttggaattttattcat

SEQ ID NO: 177920 - DNA, 20 bp, Artificial Sequence
  chemically synthesized
gaataaaattccaaatcctg

SEQ ID NO: 177921 - DNA, 20 bp, Artificial Sequence
  chemically synthesized
ccattaaatgccacaggatt

SEQ ID NO: 177922 - DNA, 20 bp, Artificial Sequence
  chemically synthesized
tctttgccattaaatgccac

SEQ ID NO: 177923 - DNA, 20 bp, Artificial Sequence
  chemically synthesized
gtctttgccattaaatgcca

SEQ ID NO: 177924 - DNA, 20 bp, Artificial Sequence
  chemically synthesized
ccaaatcctgtggcatttaa

SEQ ID NO: 177925 - DNA, 20 bp, Artificial Sequence
  chemically synthesized
tcctgtggcatttaatggca

SEQ ID NO: 177926 - DNA, 20 bp, Artificial Sequence
  chemically synthesized
ttgcattaaaattataattt

SEQ ID NO: 177927 - DNA, 20 bp, Artificial Sequence
  chemically synthesized
ttaaaattataattttggca

SEQ ID NO: 177928 - DNA, 20 bp, Artificial Sequence
  chemically synthesized
taaaattataattttggcat

SEQ ID NO: 177929 - DNA, 20 bp, Artificial Sequence
  chemically synthesized
tataattttggcataggaaa

SEQ ID NO: 177930 - DNA, 20 bp, Artificial Sequence
  chemically synthesized
ggcataggaaacagatatta

SEQ ID NO: 177931 - DNA, 20 bp, Artificial Sequence
  chemically synthesized
aacagatattatggatgctg

SEQ ID NO: 177932 - DNA, 20 bp, Artificial Sequence
  chemically synthesized
tgtatagacttatattacta

SEQ ID NO: 177933 - DNA, 20 bp, Artificial Sequence
  chemically synthesized
tatggatgctgtagtaatat

SEQ ID NO: 177934 - DNA, 20 bp, Artificial Sequence
  chemically synthesized
taatataagtctatacatga

SEQ ID NO: 177935 - DNA, 20 bp, Artificial Sequence
  chemically synthesized
gttacgaacaccatcatgta

SEQ ID NO: 177936 - DNA, 20 bp, Artificial Sequence
  chemically synthesized
catgatggtgttcgtaacct

SEQ ID NO: 177937 - DNA, 20 bp, Artificial Sequence
  chemically synthesized
atgatagaaaattaaaactg

SEQ ID NO: 177938 - DNA, 20 bp, Artificial Sequence
  chemically synthesized
tatgatagaaaattaaaact

SEQ ID NO: 177939 - DNA, 20 bp, Artificial Sequence
  chemically synthesized
aaaaagtcaaatttttatga

SEQ ID NO: 177940 - DNA, 20 bp, Artificial Sequence
  chemically synthesized
gtgtcctgcaacagaataaa

SEQ ID NO: 177941 - DNA, 20 bp, Artificial Sequence
  chemically synthesized
tttgactttttattctgttg

SEQ ID NO: 177942 - DNA, 20 bp, Artificial Sequence
  chemically synthesized
ttgactttttattctgttgc

SEQ ID NO: 177943 - DNA, 20 bp, Artificial Sequence
  chemically synthesized
aggttttatgtgtcctgcaa

SEQ ID NO: 177944 - DNA, 20 bp, Artificial Sequence
  chemically synthesized
tgtgggttgtgaaagagtca

SEQ ID NO: 177945 - DNA, 20 bp, Artificial Sequence
  chemically synthesized
ttgtgggttgtgaaagagtc

SEQ ID NO: 177946 - DNA, 20 bp, Artificial Sequence
  chemically synthesized
cagctttgtgggttgtgaaa

SEQ ID NO: 177947 - DNA, 20 bp, Artificial Sequence
  chemically synthesized
agcagctttgtgggttgtga

SEQ ID NO: 177948 - DNA, 20 bp, Artificial Sequence
  chemically synthesized
tgactctttcacaacccaca

SEQ ID NO: 177949 - DNA, 20 bp, Artificial Sequence
  chemically synthesized
atatacaatagcagctttgt

SEQ ID NO: 177950 - DNA, 20 bp, Artificial Sequence
  chemically synthesized
aatatacaatagcagctttg

SEQ ID NO: 177951 - DNA, 20 bp, Artificial Sequence
  chemically synthesized
ctatctaaaatatacaatag

SEQ ID NO: 177952 - DNA, 20 bp, Artificial Sequence
  chemically synthesized
gaactatctaaaatatacaa

SEQ ID NO: 177953 - DNA, 20 bp, Artificial Sequence
  chemically synthesized
aaagctgctattgtatattt

SEQ ID NO: 177954 - DNA, 20 bp, Artificial Sequence
  chemically synthesized
ctgctattgtatattttaga

SEQ ID NO: 177955 - DNA, 20 bp, Artificial Sequence
  chemically synthesized
tataattgtaggaaatgtga

SEQ ID NO: 177956 - DNA, 20 bp, Artificial Sequence
  chemically synthesized
attataattgtaggaaatgt

SEQ ID NO: 177957 - DNA, 20 bp, Artificial Sequence
  chemically synthesized
agaacaaaaattataattgt

SEQ ID NO: 177958 - DNA, 20 bp, Artificial Sequence
  chemically synthesized
aagaacaaaaattataattg

SEQ ID NO: 177959 - DNA, 20 bp, Artificial Sequence
  chemically synthesized
gtacatcttatgacaaaaag

SEQ ID NO: 177960 - DNA, 20 bp, Artificial Sequence
  chemically synthesized
tcagtacatcttatgacaaa

SEQ ID NO: 177961 - DNA, 20 bp, Artificial Sequence
  chemically synthesized
tttgttcttctttttgtcat

SEQ ID NO: 177962 - DNA, 20 bp, Artificial Sequence
  chemically synthesized
tttttgtcataagatgtact

SEQ ID NO: 177963 - DNA, 20 bp, Artificial Sequence
  chemically synthesized
caaaatgttctacaatatct

SEQ ID NO: 177964 - DNA, 20 bp, Artificial Sequence
  chemically synthesized
taagatgtactgagatattg

SEQ ID NO: 177965 - DNA, 20 bp, Artificial Sequence
  chemically synthesized
tgagatattgtagaacattt

SEQ ID NO: 177966 - DNA, 20 bp, Artificial Sequence
  chemically synthesized
gagatattgtagaacatttt

SEQ ID NO: 177967 - DNA, 20 bp, Artificial Sequence
  chemically synthesized
taaaaagagaacaaggagga

SEQ ID NO: 177968 - DNA, 20 bp, Artificial Sequence
  chemically synthesized
ataaaaagagaacaaggagg

SEQ ID NO: 177969 - DNA, 20 bp, Artificial Sequence
  chemically synthesized
ctcataaaaagagaacaagg

SEQ ID NO: 177970 - DNA, 20 bp, Artificial Sequence
  chemically synthesized
cctcataaaaagagaacaag

SEQ ID NO: 177971 - DNA, 20 bp, Artificial Sequence
  chemically synthesized
tccctcataaaaagagaaca

SEQ ID NO: 177972 - DNA, 20 bp, Artificial Sequence
  chemically synthesized
atccctcataaaaagagaac

SEQ ID NO: 177973 - DNA, 20 bp, Artificial Sequence
  chemically synthesized
cctccttgttctctttttat

SEQ ID NO: 177974 - DNA, 20 bp, Artificial Sequence
  chemically synthesized
gaaatcatccctcataaaaa

SEQ ID NO: 177975 - DNA, 20 bp, Artificial Sequence
  chemically synthesized
ctccttgttctctttttatg

SEQ ID NO: 177976 - DNA, 20 bp, Artificial Sequence
  chemically synthesized
tccttgttctctttttatga

SEQ ID NO: 177977 - DNA, 20 bp, Artificial Sequence
  chemically synthesized
atgaaatcatccctcataaa

SEQ ID NO: 177978 - DNA, 20 bp, Artificial Sequence
  chemically synthesized
atttcatttgtattgttatg

SEQ ID NO: 177979 - DNA, 20 bp, Artificial Sequence
  chemically synthesized
gtcccagcaattaaatttta

SEQ ID NO: 177980 - DNA, 20 bp, Artificial Sequence
  chemically synthesized
tagctataaaatttaattgc

SEQ ID NO: 177981 - DNA, 20 bp, Artificial Sequence
  chemically synthesized
agctataaaatttaattgct

SEQ ID NO: 177982 - DNA, 20 bp, Artificial Sequence
  chemically synthesized
atggagggaaggtggtgtcc

SEQ ID NO: 177983 - DNA, 20 bp, Artificial Sequence
  chemically synthesized
ttttatgtatggagggaagg

SEQ ID NO: 177984 - DNA, 20 bp, Artificial Sequence
  chemically synthesized
gacttttatgtatggaggga

SEQ ID NO: 177985 - DNA, 20 bp, Artificial Sequence
  chemically synthesized
agacttttatgtatggaggg

SEQ ID NO: 177986 - DNA, 20 bp, Artificial Sequence
  chemically synthesized
tacagacttttatgtatgga

SEQ ID NO: 177987 - DNA, 20 bp, Artificial Sequence
  chemically synthesized
atacagacttttatgtatgg

SEQ ID NO: 177988 - DNA, 20 bp, Artificial Sequence
  chemically synthesized
gatacagacttttatgtatg

SEQ ID NO: 177989 - DNA, 20 bp, Artificial Sequence
  chemically synthesized
caccttccctccatacataa

SEQ ID NO: 177990 - DNA, 20 bp, Artificial Sequence
  chemically synthesized
aagatacagacttttatgta

SEQ ID NO: 177991 - DNA, 20 bp, Artificial Sequence
  chemically synthesized
aaaacatctgtgtaaagata

SEQ ID NO: 177992 - DNA, 20 bp, Artificial Sequence
  chemically synthesized
taaaagtctgtatctttaca

SEQ ID NO: 177993 - DNA, 20 bp, Artificial Sequence
  chemically synthesized
gattgcaaaacatctgtgta

SEQ ID NO: 177994 - DNA, 20 bp, Artificial Sequence
  chemically synthesized
cagatgttttgcaatcatta

SEQ ID NO: 177995 - DNA, 20 bp, Artificial Sequence
  chemically synthesized
agatgttttgcaatcattaa

SEQ ID NO: 177996 - DNA, 20 bp, Artificial Sequence
  chemically synthesized
tgttttgcaatcattaaagg

SEQ ID NO: 177997 - DNA, 20 bp, Artificial Sequence
  chemically synthesized
aatcattaaaggtagaaacc

SEQ ID NO: 177998 - DNA, 20 bp, Artificial Sequence
  chemically synthesized
cattaaaggtagaaaccaag

SEQ ID NO: 177999 - DNA, 20 bp, Artificial Sequence
  chemically synthesized
attaaaggtagaaaccaaga

SEQ ID NO: 178000 - DNA, 20 bp, Artificial Sequence
  chemically synthesized
ttaaaggtagaaaccaagaa

SEQ ID NO: 178001 - DNA, 20 bp, Artificial Sequence
  chemically synthesized
gaaaaaaaaaaatcccttct

SEQ ID NO: 178002 - DNA, 20 bp, Artificial Sequence
  chemically synthesized
gtgtctctatttcaagcagg

SEQ ID NO: 178003 - DNA, 20 bp, Artificial Sequence
  chemically synthesized
taagtgtctctatttcaagc

SEQ ID NO: 178004 - DNA, 20 bp, Artificial Sequence
  chemically synthesized
aaataactacctgcttgaaa

SEQ ID NO: 178005 - DNA, 20 bp, Artificial Sequence
  chemically synthesized
ttaagtgtctctatttcaag

SEQ ID NO: 178006 - DNA, 20 bp, Artificial Sequence
  chemically synthesized
ataactacctgcttgaaata

SEQ ID NO: 178007 - DNA, 20 bp, Artificial Sequence
  chemically synthesized
cgcttaagtgtctctatttc

SEQ ID NO: 178008 - DNA, 20 bp, Artificial Sequence
  chemically synthesized
tgcttgaaatagagacactt

SEQ ID NO: 178009 - DNA, 20 bp, Artificial Sequence
  chemically synthesized
taaaaccataatgtgcgctt

SEQ ID NO: 178010 - DNA, 20 bp, Artificial Sequence
  chemically synthesized
agacacttaagcgcacatta

SEQ ID NO: 178011 - DNA, 20 bp, Artificial Sequence
  chemically synthesized
tggttttaatgtcataaaat

SEQ ID NO: 178012 - DNA, 20 bp, Artificial Sequence
  chemically synthesized
cataaaattggtacttattt

SEQ ID NO: 178013 - DNA, 20 bp, Artificial Sequence
  chemically synthesized
aaatatttaggaactaaaat

SEQ ID NO: 178014 - DNA, 20 bp, Artificial Sequence
  chemically synthesized
acacgactgataaaatattt

SEQ ID NO: 178015 - DNA, 20 bp, Artificial Sequence
  chemically synthesized
tacacgactgataaaatatt

SEQ ID NO: 178016 - DNA, 20 bp, Artificial Sequence
  chemically synthesized
ttagttcctaaatattttat

SEQ ID NO: 178017 - DNA, 20 bp, Artificial Sequence
  chemically synthesized
tcgtgtaaatgatctgttat

SEQ ID NO: 178018 - DNA, 20 bp, Artificial Sequence
  chemically synthesized
tgatgctgacattctaataa

SEQ ID NO: 178019 - DNA, 20 bp, Artificial Sequence
  chemically synthesized
atgatctgttattagaatgt

SEQ ID NO: 178020 - DNA, 20 bp, Artificial Sequence
  chemically synthesized
atttattgtattttttaaat

SEQ ID NO: 178021 - DNA, 20 bp, Artificial Sequence
  chemically synthesized
tgaacattttgaattgtgtc

SEQ ID NO: 178022 - DNA, 20 bp, Artificial Sequence
  chemically synthesized
gtgaacattttgaattgtgt

SEQ ID NO: 178023 - DNA, 20 bp, Artificial Sequence
  chemically synthesized
aattcaaaatgttcacaaat

SEQ ID NO: 178024 - DNA, 20 bp, Artificial Sequence
  chemically synthesized
tgttcacaaattagatgact

SEQ ID NO: 178025 - DNA, 20 bp, Artificial Sequence
  chemically synthesized
gtcaacatctttacgatact

SEQ ID NO: 178026 - DNA, 20 bp, Artificial Sequence
  chemically synthesized
ttagatgactcagtatcgta

SEQ ID NO: 178027 - DNA, 20 bp, Artificial Sequence
  chemically synthesized
gtatcgtaaagatgttgact

SEQ ID NO: 178028 - DNA, 20 bp, Artificial Sequence
  chemically synthesized
taaagatgttgactgagctc

SEQ ID NO: 178029 - DNA, 20 bp, Artificial Sequence
  chemically synthesized
aattttgtgaatctggagct

SEQ ID NO: 178030 - DNA, 20 bp, Artificial Sequence
  chemically synthesized
attgaaattttgtgaatctg

SEQ ID NO: 178031 - DNA, 20 bp, Artificial Sequence
  chemically synthesized
tgattgaaattttgtgaatc

SEQ ID NO: 178032 - DNA, 20 bp, Artificial Sequence
  chemically synthesized
caaaatttcaatcaatatcc

SEQ ID NO: 178033 - DNA, 20 bp, Artificial Sequence
  chemically synthesized
aatttcaatcaatatcctgg

SEQ ID NO: 178034 - DNA, 20 bp, Artificial Sequence
  chemically synthesized
atttcaatcaatatcctgga

SEQ ID NO: 178035 - DNA, 20 bp, Artificial Sequence
  chemically synthesized
atttttacataaagccttcc

SEQ ID NO: 178036 - DNA, 20 bp, Artificial Sequence
  chemically synthesized
tatttttacataaagccttc

SEQ ID NO: 178037 - DNA, 20 bp, Artificial Sequence
  chemically synthesized
atattgtctatttttacata

SEQ ID NO: 178038 - DNA, 20 bp, Artificial Sequence
  chemically synthesized
tggaaggctttatgtaaaaa

SEQ ID NO: 178039 - DNA, 20 bp, Artificial Sequence
  chemically synthesized
ttatgtaaaaatagacaata

SEQ ID NO: 178040 - DNA, 20 bp, Artificial Sequence
  chemically synthesized
ttggttctttgaataaattt

SEQ ID NO: 178041 - DNA, 20 bp, Artificial Sequence
  chemically synthesized
atagttctaaaatttattca

SEQ ID NO: 178042 - DNA, 20 bp, Artificial Sequence
  chemically synthesized
aaatttattcaaagaaccaa

SEQ ID NO: 178043 - DNA, 20 bp, Artificial Sequence
  chemically synthesized
tttattcaaagaaccaaaag

SEQ ID NO: 178044 - DNA, 20 bp, Artificial Sequence
  chemically synthesized
aagattgccttggctacttt

SEQ ID NO: 178045 - DNA, 20 bp, Artificial Sequence
  chemically synthesized
tcaaagaaccaaaagtagcc

SEQ ID NO: 178046 - DNA, 20 bp, Artificial Sequence
  chemically synthesized
caaagaaccaaaagtagcca

SEQ ID NO: 178047 - DNA, 20 bp, Artificial Sequence
  chemically synthesized
cttcctattcaagattgcct

SEQ ID NO: 178048 - DNA, 20 bp, Artificial Sequence
  chemically synthesized
gtagccaaggcaatcttgaa

SEQ ID NO: 178049 - DNA, 20 bp, Artificial Sequence
  chemically synthesized
tagccaaggcaatcttgaat

SEQ ID NO: 178050 - DNA, 20 bp, Artificial Sequence
  chemically synthesized
ccaaggcaatcttgaatagg

SEQ ID NO: 178051 - DNA, 20 bp, Artificial Sequence
  chemically synthesized
ccactttgttcttcctattc

SEQ ID NO: 178052 - DNA, 20 bp, Artificial Sequence
  chemically synthesized
aatcttgaataggaagaaca

SEQ ID NO: 178053 - DNA, 20 bp, Artificial Sequence
  chemically synthesized
cttgaataggaagaacaaag

SEQ ID NO: 178054 - DNA, 20 bp, Artificial Sequence
  chemically synthesized
gaataggaagaacaaagtgg

SEQ ID NO: 178055 - DNA, 20 bp, Artificial Sequence
  chemically synthesized
aataggaagaacaaagtgga

SEQ ID NO: 178056 - DNA, 20 bp, Artificial Sequence
  chemically synthesized
aagtggaaggtttacacaac

SEQ ID NO: 178057 - DNA, 20 bp, Artificial Sequence
  chemically synthesized
ttatttaaacattttggatc

SEQ ID NO: 178058 - DNA, 20 bp, Artificial Sequence
  chemically synthesized
atcattttatttaaacattt

SEQ ID NO: 178059 - DNA, 20 bp, Artificial Sequence
  chemically synthesized
gattgcgtatatacatacaa

SEQ ID NO: 178060 - DNA, 20 bp, Artificial Sequence
  chemically synthesized
acatacaatggaatattatt

SEQ ID NO: 178061 - DNA, 20 bp, Artificial Sequence
  chemically synthesized
gaatattattcagtcataaa

SEQ ID NO: 178062 - DNA, 20 bp, Artificial Sequence
  chemically synthesized
aatattattcagtcataaaa

SEQ ID NO: 178063 - DNA, 20 bp, Artificial Sequence
  chemically synthesized
ttcagtcataaaaaggaatg

SEQ ID NO: 178064 - DNA, 20 bp, Artificial Sequence
  chemically synthesized
atctatgttgtagcatgtgt

SEQ ID NO: 178065 - DNA, 20 bp, Artificial Sequence
  chemically synthesized
ttctgacacatgctacaaca

SEQ ID NO: 178066 - DNA, 20 bp, Artificial Sequence
  chemically synthesized
ttcaaggttcatctatgttg

SEQ ID NO: 178067 - DNA, 20 bp, Artificial Sequence
  chemically synthesized
ccctcagcataatattttca

SEQ ID NO: 178068 - DNA, 20 bp, Artificial Sequence
  chemically synthesized
tccctcagcataatattttc

SEQ ID NO: 178069 - DNA, 20 bp, Artificial Sequence
  chemically synthesized
aaccttgaaaatattatgct

SEQ ID NO: 178070 - DNA, 20 bp, Artificial Sequence
  chemically synthesized
accttgaaaatattatgctg

SEQ ID NO: 178071 - DNA, 20 bp, Artificial Sequence
  chemically synthesized
ccttgaaaatattatgctga

SEQ ID NO: 178072 - DNA, 20 bp, Artificial Sequence
  chemically synthesized
tgaaaatattatgctgaggg

SEQ ID NO: 178073 - DNA, 20 bp, Artificial Sequence
  chemically synthesized
tgtgtctgccttacttccct

SEQ ID NO: 178074 - DNA, 20 bp, Artificial Sequence
  chemically synthesized
aatattatgctgagggaagt

SEQ ID NO: 178075 - DNA, 20 bp, Artificial Sequence
  chemically synthesized
atattatgctgagggaagta

SEQ ID NO: 178076 - DNA, 20 bp, Artificial Sequence
  chemically synthesized
ttatgctgagggaagtaagg

SEQ ID NO: 178077 - DNA, 20 bp, Artificial Sequence
  chemically synthesized
agggaagtaaggcagacaca

SEQ ID NO: 178078 - DNA, 20 bp, Artificial Sequence
  chemically synthesized
gaagtaaggcagacacaaag

SEQ ID NO: 178079 - DNA, 20 bp, Artificial Sequence
  chemically synthesized
ttctagatcttttatataat

SEQ ID NO: 178080 - DNA, 20 bp, Artificial Sequence
  chemically synthesized
atataattccaattatataa

SEQ ID NO: 178081 - DNA, 20 bp, Artificial Sequence
  chemically synthesized
ttccaattatataaaagatc

SEQ ID NO: 178082 - DNA, 20 bp, Artificial Sequence
  chemically synthesized
attatataaaagatctagaa

SEQ ID NO: 178083 - DNA, 20 bp, Artificial Sequence
  chemically synthesized
ttctatgaatttggctattc

SEQ ID NO: 178084 - DNA, 20 bp, Artificial Sequence
  chemically synthesized
atctagaatagccaaattca

SEQ ID NO: 178085 - DNA, 20 bp, Artificial Sequence
  chemically synthesized
actttctgtttctatgaatt

SEQ ID NO: 178086 - DNA, 20 bp, Artificial Sequence
  chemically synthesized
aatagccaaattcatagaaa

SEQ ID NO: 178087 - DNA, 20 bp, Artificial Sequence
  chemically synthesized
gccaaattcatagaaacaga

SEQ ID NO: 178088 - DNA, 20 bp, Artificial Sequence
  chemically synthesized
aaattcatagaaacagaaag

SEQ ID NO: 178089 - DNA, 20 bp, Artificial Sequence
  chemically synthesized
catagaaacagaaagtagtc

SEQ ID NO: 178090 - DNA, 20 bp, Artificial Sequence
  chemically synthesized
tagaaacagaaagtagtcca

SEQ ID NO: 178091 - DNA, 20 bp, Artificial Sequence
  chemically synthesized
agaaacagaaagtagtccag

SEQ ID NO: 178092 - DNA, 20 bp, Artificial Sequence
  chemically synthesized
tcccatccgctagtagcctc

SEQ ID NO: 178093 - DNA, 20 bp, Artificial Sequence
  chemically synthesized
gaaagtagtccagaggctac

SEQ ID NO: 178094 - DNA, 20 bp, Artificial Sequence
  chemically synthesized
agtagtccagaggctactag

SEQ ID NO: 178095 - DNA, 20 bp, Artificial Sequence
  chemically synthesized
tctctcttcccatccgctag

SEQ ID NO: 178096 - DNA, 20 bp, Artificial Sequence
  chemically synthesized
gtccagaggctactagcgga

SEQ ID NO: 178097 - DNA, 20 bp, Artificial Sequence
  chemically synthesized
tccagaggctactagcggat

SEQ ID NO: 178098 - DNA, 20 bp, Artificial Sequence
  chemically synthesized
ttctctctcttcccatccgc

SEQ ID NO: 178099 - DNA, 20 bp, Artificial Sequence
  chemically synthesized
agaggctactagcggatggg

SEQ ID NO: 178100 - DNA, 20 bp, Artificial Sequence
  chemically synthesized
aggctactagcggatgggaa

SEQ ID NO: 178101 - DNA, 20 bp, Artificial Sequence
  chemically synthesized
gctactagcggatgggaaga

SEQ ID NO: 178102 - DNA, 20 bp, Artificial Sequence
  chemically synthesized
tactagcggatgggaagaga

SEQ ID NO: 178103 - DNA, 20 bp, Artificial Sequence
  chemically synthesized
agcggatgggaagagagaga

SEQ ID NO: 178104 - DNA, 20 bp, Artificial Sequence
  chemically synthesized
gcggatgggaagagagagaa

SEQ ID NO: 178105 - DNA, 20 bp, Artificial Sequence
  chemically synthesized
cggatgggaagagagagaaa

SEQ ID NO: 178106 - DNA, 20 bp, Artificial Sequence
  chemically synthesized
ggatgggaagagagagaaag

SEQ ID NO: 178107 - DNA, 20 bp, Artificial Sequence
  chemically synthesized
agtctgtaaccattaagcaa

SEQ ID NO: 178108 - DNA, 20 bp, Artificial Sequence
  chemically synthesized
aaaggggaactattgcttaa

SEQ ID NO: 178109 - DNA, 20 bp, Artificial Sequence
  chemically synthesized
ccagacagtctgtaaccatt

SEQ ID NO: 178110 - DNA, 20 bp, Artificial Sequence
  chemically synthesized
gaactattgcttaatggtta

SEQ ID NO: 178111 - DNA, 20 bp, Artificial Sequence
  chemically synthesized
cttaatggttacagactgtc

SEQ ID NO: 178112 - DNA, 20 bp, Artificial Sequence
  chemically synthesized
atggttacagactgtctggt

SEQ ID NO: 178113 - DNA, 20 bp, Artificial Sequence
  chemically synthesized
tttttattactccaaccaga

SEQ ID NO: 178114 - DNA, 20 bp, Artificial Sequence
  chemically synthesized
ggttacagactgtctggttg

SEQ ID NO: 178115 - DNA, 20 bp, Artificial Sequence
  chemically synthesized
aaattttttattactccaac

SEQ ID NO: 178116 - DNA, 20 bp, Artificial Sequence
  chemically synthesized
gttggagtaataaaaaattt

SEQ ID NO: 178117 - DNA, 20 bp, Artificial Sequence
  chemically synthesized
tggagtaataaaaaattttg

SEQ ID NO: 178118 - DNA, 20 bp, Artificial Sequence
  chemically synthesized
ggagtaataaaaaattttgg

SEQ ID NO: 178119 - DNA, 20 bp, Artificial Sequence
  chemically synthesized
taataaaaaattttggaggc

SEQ ID NO: 178120 - DNA, 20 bp, Artificial Sequence
  chemically synthesized
aataaaaaattttggaggct

SEQ ID NO: 178121 - DNA, 20 bp, Artificial Sequence
  chemically synthesized
aaaattttggaggctgggcg

SEQ ID NO: 178122 - DNA, 20 bp, Artificial Sequence
  chemically synthesized
attttggaggctgggcgcgg

SEQ ID NO: 178123 - DNA, 20 bp, Artificial Sequence
  chemically synthesized
acagcgtgagccaccgcgcc

SEQ ID NO: 178124 - DNA, 20 bp, Artificial Sequence
  chemically synthesized
aagtcctgggattacagcgt

SEQ ID NO: 178125 - DNA, 20 bp, Artificial Sequence
  chemically synthesized
ggtggctcacgctgtaatcc

SEQ ID NO: 178126 - DNA, 20 bp, Artificial Sequence
  chemically synthesized
gtggctcacgctgtaatccc

SEQ ID NO: 178127 - DNA, 20 bp, Artificial Sequence
  chemically synthesized
ctcccaaagtcctgggatta

SEQ ID NO: 178128 - DNA, 20 bp, Artificial Sequence
  chemically synthesized
acgctgtaatcccaggactt

SEQ ID NO: 178129 - DNA, 20 bp, Artificial Sequence
  chemically synthesized
ccttggactcccaaagtcct

SEQ ID NO: 178130 - DNA, 20 bp, Artificial Sequence
  chemically synthesized
cgctgtaatcccaggacttt

SEQ ID NO: 178131 - DNA, 20 bp, Artificial Sequence
  chemically synthesized
accttggactcccaaagtcc

SEQ ID NO: 178132 - DNA, 20 bp, Artificial Sequence
  chemically synthesized
ctgtaatcccaggactttgg

SEQ ID NO: 178133 - DNA, 20 bp, Artificial Sequence
  chemically synthesized
ccgcccaccttggactccca

SEQ ID NO: 178134 - DNA, 20 bp, Artificial Sequence
  chemically synthesized
tcccaggactttgggagtcc

SEQ ID NO: 178135 - DNA, 20 bp, Artificial Sequence
  chemically synthesized
cccaggactttgggagtcca

SEQ ID NO: 178136 - DNA, 20 bp, Artificial Sequence
  chemically synthesized
aggactttgggagtccaagg

SEQ ID NO: 178137 - DNA, 20 bp, Artificial Sequence
  chemically synthesized
ggactttgggagtccaaggt

SEQ ID NO: 178138 - DNA, 20 bp, Artificial Sequence
  chemically synthesized
ctttgggagtccaaggtggg

SEQ ID NO: 178139 - DNA, 20 bp, Artificial Sequence
  chemically synthesized
ctcaggtgatccgcccacct

SEQ ID NO: 178140 - DNA, 20 bp, Artificial Sequence
  chemically synthesized
ccaaggtgggcggatcacct

SEQ ID NO: 178141 - DNA, 20 bp, Artificial Sequence
  chemically synthesized
caaggtgggcggatcacctg

SEQ ID NO: 178142 - DNA, 20 bp, Artificial Sequence
  chemically synthesized
gtgggcggatcacctgaggt

SEQ ID NO: 178143 - DNA, 20 bp, Artificial Sequence
  chemically synthesized
tgggcggatcacctgaggtc

SEQ ID NO: 178144 - DNA, 20 bp, Artificial Sequence
  chemically synthesized
ggtctcaaactcctgacctc

SEQ ID NO: 178145 - DNA, 20 bp, Artificial Sequence
  chemically synthesized
ggcggatcacctgaggtcag

SEQ ID NO: 178146 - DNA, 20 bp, Artificial Sequence
  chemically synthesized
tggtctcaaactcctgacct

SEQ ID NO: 178147 - DNA, 20 bp, Artificial Sequence
  chemically synthesized
tcacctgaggtcaggagttt

SEQ ID NO: 178148 - DNA, 20 bp, Artificial Sequence
  chemically synthesized
tgaggtcaggagtttgagac

SEQ ID NO: 178149 - DNA, 20 bp, Artificial Sequence
  chemically synthesized
tcaggagtttgagaccagcc

SEQ ID NO: 178150 - DNA, 20 bp, Artificial Sequence
  chemically synthesized
ttttgccatgttggccaggc

SEQ ID NO: 178151 - DNA, 20 bp, Artificial Sequence
  chemically synthesized
ggggttttgccatgttggcc

SEQ ID NO: 178152 - DNA, 20 bp, Artificial Sequence
  chemically synthesized
tgagaccagcctggccaaca

SEQ ID NO: 178153 - DNA, 20 bp, Artificial Sequence
  chemically synthesized
tggggttttgccatgttggc

SEQ ID NO: 178154 - DNA, 20 bp, Artificial Sequence
  chemically synthesized
gagatggggttttgccatgt

SEQ ID NO: 178155 - DNA, 20 bp, Artificial Sequence
  chemically synthesized
ttgtatttttagtagagatg

SEQ ID NO: 178156 - DNA, 20 bp, Artificial Sequence
  chemically synthesized
tttgtatttttagtagagat

SEQ ID NO: 178157 - DNA, 20 bp, Artificial Sequence
  chemically synthesized
ttttgtatttttagtagaga

SEQ ID NO: 178158 - DNA, 20 bp, Artificial Sequence
  chemically synthesized
aagtttttgtatttttagta

SEQ ID NO: 178159 - DNA, 20 bp, Artificial Sequence
  chemically synthesized
ctaagtttttgtatttttag

SEQ ID NO: 178160 - DNA, 20 bp, Artificial Sequence
  chemically synthesized
cagctaagtttttgtatttt

SEQ ID NO: 178161 - DNA, 20 bp, Artificial Sequence
  chemically synthesized
ctactaaaaatacaaaaact

SEQ ID NO: 178162 - DNA, 20 bp, Artificial Sequence
  chemically synthesized
taaaaatacaaaaacttagc

SEQ ID NO: 178163 - DNA, 20 bp, Artificial Sequence
  chemically synthesized
aaaaatacaaaaacttagct

SEQ ID NO: 178164 - DNA, 20 bp, Artificial Sequence
  chemically synthesized
acctgccagcatgcccagct

SEQ ID NO: 178165 - DNA, 20 bp, Artificial Sequence
  chemically synthesized
aaaaacttagctgggcatgc

SEQ ID NO: 178166 - DNA, 20 bp, Artificial Sequence
  chemically synthesized
caggcacctgccagcatgcc

SEQ ID NO: 178167 - DNA, 20 bp, Artificial Sequence
  chemically synthesized
aacttagctgggcatgctgg

SEQ ID NO: 178168 - DNA, 20 bp, Artificial Sequence
  chemically synthesized
acttagctgggcatgctggc

SEQ ID NO: 178169 - DNA, 20 bp, Artificial Sequence
  chemically synthesized
ctgggattacaggcacctgc

SEQ ID NO: 178170 - DNA, 20 bp, Artificial Sequence
  chemically synthesized
ctggcaggtgcctgtaatcc

SEQ ID NO: 178171 - DNA, 20 bp, Artificial Sequence
  chemically synthesized
tccctagtagctgggattac

SEQ ID NO: 178172 - DNA, 20 bp, Artificial Sequence
  chemically synthesized
ctccctagtagctgggatta

SEQ ID NO: 178173 - DNA, 20 bp, Artificial Sequence
  chemically synthesized
gtgcctgtaatcccagctac

SEQ ID NO: 178174 - DNA, 20 bp, Artificial Sequence
  chemically synthesized
tgcctgtaatcccagctact

SEQ ID NO: 178175 - DNA, 20 bp, Artificial Sequence
  chemically synthesized
cctcagcctccctagtagct

SEQ ID NO: 178176 - DNA, 20 bp, Artificial Sequence
  chemically synthesized
gcctgtaatcccagctacta

SEQ ID NO: 178177 - DNA, 20 bp, Artificial Sequence
  chemically synthesized
gcctcagcctccctagtagc

SEQ ID NO: 178178 - DNA, 20 bp, Artificial Sequence
  chemically synthesized
ctgtaatcccagctactagg

SEQ ID NO: 178179 - DNA, 20 bp, Artificial Sequence
  chemically synthesized
tgtaatcccagctactaggg

SEQ ID NO: 178180 - DNA, 20 bp, Artificial Sequence
  chemically synthesized
tcctgcctcagcctccctag

SEQ ID NO: 178181 - DNA, 20 bp, Artificial Sequence
  chemically synthesized
ttctcctgcctcagcctccc

SEQ ID NO: 178182 - DNA, 20 bp, Artificial Sequence
  chemically synthesized
tcccagctactagggaggct

SEQ ID NO: 178183 - DNA, 20 bp, Artificial Sequence
  chemically synthesized
cccagctactagggaggctg

SEQ ID NO: 178184 - DNA, 20 bp, Artificial Sequence
  chemically synthesized
agctactagggaggctgagg

SEQ ID NO: 178185 - DNA, 20 bp, Artificial Sequence
  chemically synthesized
gctactagggaggctgaggc

SEQ ID NO: 178186 - DNA, 20 bp, Artificial Sequence
  chemically synthesized
tactagggaggctgaggcag

SEQ ID NO: 178187 - DNA, 20 bp, Artificial Sequence
  chemically synthesized
ttcaagtggttctcctgcct

SEQ ID NO: 178188 - DNA, 20 bp, Artificial Sequence
  chemically synthesized
ttccgcctcccaggttcaag

SEQ ID NO: 178189 - DNA, 20 bp, Artificial Sequence
  chemically synthesized
gcaggagaaccacttgaacc

SEQ ID NO: 178190 - DNA, 20 bp, Artificial Sequence
  chemically synthesized
caggagaaccacttgaacct

SEQ ID NO: 178191 - DNA, 20 bp, Artificial Sequence
  chemically synthesized
aacttccgcctcccaggttc

SEQ ID NO: 178192 - DNA, 20 bp, Artificial Sequence
  chemically synthesized
ggagaaccacttgaacctgg

SEQ ID NO: 178193 - DNA, 20 bp, Artificial Sequence
  chemically synthesized
gagaaccacttgaacctggg

SEQ ID NO: 178194 - DNA, 20 bp, Artificial Sequence
  chemically synthesized
aaccacttgaacctgggagg

SEQ ID NO: 178195 - DNA, 20 bp, Artificial Sequence
  chemically synthesized
cactgcaacttccgcctccc

SEQ ID NO: 178196 - DNA, 20 bp, Artificial Sequence
  chemically synthesized
tcactgcaacttccgcctcc

SEQ ID NO: 178197 - DNA, 20 bp, Artificial Sequence
  chemically synthesized
cacttgaacctgggaggcgg

SEQ ID NO: 178198 - DNA, 20 bp, Artificial Sequence
  chemically synthesized
aacctgggaggcggaagttg

SEQ ID NO: 178199 - DNA, 20 bp, Artificial Sequence
  chemically synthesized
tgggaggcggaagttgcagt

SEQ ID NO: 178200 - DNA, 20 bp, Artificial Sequence
  chemically synthesized
ggcggaagttgcagtgagcc

SEQ ID NO: 178201 - DNA, 20 bp, Artificial Sequence
  chemically synthesized
ggagtgcagtggcgcgatct

SEQ ID NO: 178202 - DNA, 20 bp, Artificial Sequence
  chemically synthesized
tcgctcaggctggagtgcag

SEQ ID NO: 178203 - DNA, 20 bp, Artificial Sequence
  chemically synthesized
gagatcgcgccactgcactc

SEQ ID NO: 178204 - DNA, 20 bp, Artificial Sequence
  chemically synthesized
gtgtcgctcaggctggagtg

SEQ ID NO: 178205 - DNA, 20 bp, Artificial Sequence
  chemically synthesized
gcgccactgcactccagcct

SEQ ID NO: 178206 - DNA, 20 bp, Artificial Sequence
  chemically synthesized
tcgctgtgtcgctcaggctg

SEQ ID NO: 178207 - DNA, 20 bp, Artificial Sequence
  chemically synthesized
tctcgctgtgtcgctcaggc

SEQ ID NO: 178208 - DNA, 20 bp, Artificial Sequence
  chemically synthesized
agagtctcgctgtgtcgctc

SEQ ID NO: 178209 - DNA, 20 bp, Artificial Sequence
  chemically synthesized
gcactccagcctgagcgaca

SEQ ID NO: 178210 - DNA, 20 bp, Artificial Sequence
  chemically synthesized
cagagtctcgctgtgtcgct

SEQ ID NO: 178211 - DNA, 20 bp, Artificial Sequence
  chemically synthesized
tccagcctgagcgacacagc

SEQ ID NO: 178212 - DNA, 20 bp, Artificial Sequence
  chemically synthesized
ttttttcttttttggagaca

SEQ ID NO: 178213 - DNA, 20 bp, Artificial Sequence
  chemically synthesized
ttttttttcttttttggaga

SEQ ID NO: 178214 - DNA, 20 bp, Artificial Sequence
  chemically synthesized
gcgagactctgtctccaaaa

SEQ ID NO: 178215 - DNA, 20 bp, Artificial Sequence
  chemically synthesized
atttttttttttcttttttg

SEQ ID NO: 178216 - DNA, 20 bp, Artificial Sequence
  chemically synthesized
caatttttttttttcttttt

SEQ ID NO: 178217 - DNA, 20 bp, Artificial Sequence
  chemically synthesized
caaaaaagaaaaaaaaaaat

SEQ ID NO: 178218 - DNA, 20 bp, Artificial Sequence
  chemically synthesized
aaaaaagaaaaaaaaaaatt

SEQ ID NO: 178219 - DNA, 20 bp, Artificial Sequence
  chemically synthesized
aaaaagaaaaaaaaaaattg

SEQ ID NO: 178220 - DNA, 20 bp, Artificial Sequence
  chemically synthesized
aaaagaaaaaaaaaaattgg

SEQ ID NO: 178221 - DNA, 20 bp, Artificial Sequence
  chemically synthesized
agaaaaaaaaaaattggggg

SEQ ID NO: 178222 - DNA, 20 bp, Artificial Sequence
  chemically synthesized
gaaaaaaaaaaattgggggt

SEQ ID NO: 178223 - DNA, 20 bp, Artificial Sequence
  chemically synthesized
aaaaaaaaaaattgggggtg

SEQ ID NO: 178224 - DNA, 20 bp, Artificial Sequence
  chemically synthesized
tgggggtggggcataaactg

SEQ ID NO: 178225 - DNA, 20 bp, Artificial Sequence
  chemically synthesized
tggggcataaactgtggtga

SEQ ID NO: 178226 - DNA, 20 bp, Artificial Sequence
  chemically synthesized
atttattacaaccatcacca

SEQ ID NO: 178227 - DNA, 20 bp, Artificial Sequence
  chemically synthesized
tggttgtaataaatgccact

SEQ ID NO: 178228 - DNA, 20 bp, Artificial Sequence
  chemically synthesized
tgtaataaatgccactgagc

SEQ ID NO: 178229 - DNA, 20 bp, Artificial Sequence
  chemically synthesized
atttcgtgtgtccagctcag

SEQ ID NO: 178230 - DNA, 20 bp, Artificial Sequence
  chemically synthesized
gtcatttcgtgtgtccagct

SEQ ID NO: 178231 - DNA, 20 bp, Artificial Sequence
  chemically synthesized
ttttagtcatttcgtgtgtc

SEQ ID NO: 178232 - DNA, 20 bp, Artificial Sequence
  chemically synthesized
aacataaaaaattgtcattt

SEQ ID NO: 178233 - DNA, 20 bp, Artificial Sequence
  chemically synthesized
tattttatcacaccttaaaa

SEQ ID NO: 178234 - DNA, 20 bp, Artificial Sequence
  chemically synthesized
atttcggtgttactttttta

SEQ ID NO: 178235 - DNA, 20 bp, Artificial Sequence
  chemically synthesized
tatttcggtgttactttttt

SEQ ID NO: 178236 - DNA, 20 bp, Artificial Sequence
  chemically synthesized
tgaacaattcaatcgtattt

SEQ ID NO: 178237 - DNA, 20 bp, Artificial Sequence
  chemically synthesized
ttgaattgttcactttaaat

SEQ ID NO: 178238 - DNA, 20 bp, Artificial Sequence
  chemically synthesized
cataccattaaactcattta

SEQ ID NO: 178239 - DNA, 20 bp, Artificial Sequence
  chemically synthesized
ttcactttaaatgagtttaa

SEQ ID NO: 178240 - DNA, 20 bp, Artificial Sequence
  chemically synthesized
gtttaatggtatgtgaatta

SEQ ID NO: 178241 - DNA, 20 bp, Artificial Sequence
  chemically synthesized
atggtatgtgaattatagct

SEQ ID NO: 178242 - DNA, 20 bp, Artificial Sequence
  chemically synthesized
gtatgtgaattatagctcgg

SEQ ID NO: 178243 - DNA, 20 bp, Artificial Sequence
  chemically synthesized
tatgtgaattatagctcggt

SEQ ID NO: 178244 - DNA, 20 bp, Artificial Sequence
  chemically synthesized
ttttttaaaacaatcctacc

SEQ ID NO: 178245 - DNA, 20 bp, Artificial Sequence
  chemically synthesized
ggtaggattgttttaaaaaa

SEQ ID NO: 178246 - DNA, 20 bp, Artificial Sequence
  chemically synthesized
ttaaaaaaaagattgtaatt

SEQ ID NO: 178247 - DNA, 20 bp, Artificial Sequence
  chemically synthesized
aaaaaagattgtaattaagc

SEQ ID NO: 178248 - DNA, 20 bp, Artificial Sequence
  chemically synthesized
agattgtaattaagccagtg

SEQ ID NO: 178249 - DNA, 20 bp, Artificial Sequence
  chemically synthesized
ctttaacaacagtacttcac

SEQ ID NO: 178250 - DNA, 20 bp, Artificial Sequence
  chemically synthesized
ccagtgaagtactgttgtta

SEQ ID NO: 178251 - DNA, 20 bp, Artificial Sequence
  chemically synthesized
ttaaatctgtactttaacaa

SEQ ID NO: 178252 - DNA, 20 bp, Artificial Sequence
  chemically synthesized
gaagtactgttgttaaagta

SEQ ID NO: 178253 - DNA, 20 bp, Artificial Sequence
  chemically synthesized
aaagtacagatttaatcaaa

SEQ ID NO: 178254 - DNA, 20 bp, Artificial Sequence
  chemically synthesized
gtacagatttaatcaaatgg

SEQ ID NO: 178255 - DNA, 20 bp, Artificial Sequence
  chemically synthesized
acagatttaatcaaatggaa

SEQ ID NO: 178256 - DNA, 20 bp, Artificial Sequence
  chemically synthesized
cagatttaatcaaatggaag

SEQ ID NO: 178257 - DNA, 20 bp, Artificial Sequence
  chemically synthesized
taatcaaatggaagaggata

SEQ ID NO: 178258 - DNA, 20 bp, Artificial Sequence
  chemically synthesized
atggaagaggatacagaatc

SEQ ID NO: 178259 - DNA, 20 bp, Artificial Sequence
  chemically synthesized
gaagaggatacagaatccag

SEQ ID NO: 178260 - DNA, 20 bp, Artificial Sequence
  chemically synthesized
gaggatacagaatccagaag

SEQ ID NO: 178261 - DNA, 20 bp, Artificial Sequence
  chemically synthesized
tgtatgtatgaatctgcttc

SEQ ID NO: 178262 - DNA, 20 bp, Artificial Sequence
  chemically synthesized
agaagcagattcatacatac

SEQ ID NO: 178263 - DNA, 20 bp, Artificial Sequence
  chemically synthesized
gcatctttgtcataaatcaa

SEQ ID NO: 178264 - DNA, 20 bp, Artificial Sequence
  chemically synthesized
tggcatctttgtcataaatc

SEQ ID NO: 178265 - DNA, 20 bp, Artificial Sequence
  chemically synthesized
agttctcttgatttatgaca

SEQ ID NO: 178266 - DNA, 20 bp, Artificial Sequence
  chemically synthesized
atttccccactgtattttca

SEQ ID NO: 178267 - DNA, 20 bp, Artificial Sequence
  chemically synthesized
acaaagatgccatgaaaata

SEQ ID NO: 178268 - DNA, 20 bp, Artificial Sequence
  chemically synthesized
aagatgccatgaaaatacag

SEQ ID NO: 178269 - DNA, 20 bp, Artificial Sequence
  chemically synthesized
agatgccatgaaaatacagt

SEQ ID NO: 178270 - DNA, 20 bp, Artificial Sequence
  chemically synthesized
gatgccatgaaaatacagtg

SEQ ID NO: 178271 - DNA, 20 bp, Artificial Sequence
  chemically synthesized
gatccagcactattcattca

SEQ ID NO: 178272 - DNA, 20 bp, Artificial Sequence
  chemically synthesized
aatgattgtctttgaatgaa

SEQ ID NO: 178273 - DNA, 20 bp, Artificial Sequence
  chemically synthesized
tgtctttgaatgaatagtgc

SEQ ID NO: 178274 - DNA, 20 bp, Artificial Sequence
  chemically synthesized
aaaagcaacatcaattgatc

SEQ ID NO: 178275 - DNA, 20 bp, Artificial Sequence
  chemically synthesized
acatatgaatttatagtaaa

SEQ ID NO: 178276 - DNA, 20 bp, Artificial Sequence
  chemically synthesized
aagtggtacatatgaattta

SEQ ID NO: 178277 - DNA, 20 bp, Artificial Sequence
  chemically synthesized
tttattttatataaagcaag

SEQ ID NO: 178278 - DNA, 20 bp, Artificial Sequence
  chemically synthesized
atatttattttatataaagc

SEQ ID NO: 178279 - DNA, 20 bp, Artificial Sequence
  chemically synthesized
atacatatttattttatata

SEQ ID NO: 178280 - DNA, 20 bp, Artificial Sequence
  chemically synthesized
atatgtattaatttaataaa

SEQ ID NO: 178281 - DNA, 20 bp, Artificial Sequence
  chemically synthesized
ttaataaatagtattactgt

SEQ ID NO: 178282 - DNA, 20 bp, Artificial Sequence
  chemically synthesized
tgcatactatataaatctaa

SEQ ID NO: 178283 - DNA, 20 bp, Artificial Sequence
  chemically synthesized
gtattactgttagatttata

SEQ ID NO: 178284 - DNA, 20 bp, Artificial Sequence
  chemically synthesized
gttagatttatatagtatgc

SEQ ID NO: 178285 - DNA, 20 bp, Artificial Sequence
  chemically synthesized
ttagatttatatagtatgca

SEQ ID NO: 178286 - DNA, 20 bp, Artificial Sequence
  chemically synthesized
gatttatatagtatgcaagg

SEQ ID NO: 178287 - DNA, 20 bp, Artificial Sequence
  chemically synthesized
tatatagtatgcaaggtgga

SEQ ID NO: 178288 - DNA, 20 bp, Artificial Sequence
  chemically synthesized
gtggaaagatgaaaactcac

SEQ ID NO: 178289 - DNA, 20 bp, Artificial Sequence
  chemically synthesized
ctactgatttattaacttgt

SEQ ID NO: 178290 - DNA, 20 bp, Artificial Sequence
  chemically synthesized
aaactcacaagttaataaat

SEQ ID NO: 178291 - DNA, 20 bp, Artificial Sequence
  chemically synthesized
ctcacaagttaataaatcag

SEQ ID NO: 178292 - DNA, 20 bp, Artificial Sequence
  chemically synthesized
tcacaagttaataaatcagt

SEQ ID NO: 178293 - DNA, 20 bp, Artificial Sequence
  chemically synthesized
aagttaataaatcagtaggt

SEQ ID NO: 178294 - DNA, 20 bp, Artificial Sequence
  chemically synthesized
taagtaaataaataaacttg

SEQ ID NO: 178295 - DNA, 20 bp, Artificial Sequence
  chemically synthesized
tgtacactaacgttcgccac

SEQ ID NO: 178296 - DNA, 20 bp, Artificial Sequence
  chemically synthesized
aataaacttgtggcgaacgt

SEQ ID NO: 178297 - DNA, 20 bp, Artificial Sequence
  chemically synthesized
gttagtgtacattaattatt

SEQ ID NO: 178298 - DNA, 20 bp, Artificial Sequence
  chemically synthesized
taattattaagtccatacca

SEQ ID NO: 178299 - DNA, 20 bp, Artificial Sequence
  chemically synthesized
aattattaagtccataccac

SEQ ID NO: 178300 - DNA, 20 bp, Artificial Sequence
  chemically synthesized
aattattcacacctgtggta

SEQ ID NO: 178301 - DNA, 20 bp, Artificial Sequence
  chemically synthesized
aaattaattattcacacctg

SEQ ID NO: 178302 - DNA, 20 bp, Artificial Sequence
  chemically synthesized
atttatgacacttgtttaac

SEQ ID NO: 178303 - DNA, 20 bp, Artificial Sequence
  chemically synthesized
tggtctggttctagttaaac

SEQ ID NO: 178304 - DNA, 20 bp, Artificial Sequence
  chemically synthesized
gacacttgtttaactagaac

SEQ ID NO: 178305 - DNA, 20 bp, Artificial Sequence
  chemically synthesized
gaaaggacgtggtctggttc

SEQ ID NO: 178306 - DNA, 20 bp, Artificial Sequence
  chemically synthesized
taagctgaaaggacgtggtc

SEQ ID NO: 178307 - DNA, 20 bp, Artificial Sequence
  chemically synthesized
gtatttaagctgaaaggacg

SEQ ID NO: 178308 - DNA, 20 bp, Artificial Sequence
  chemically synthesized
agaaccagaccacgtccttt

SEQ ID NO: 178309 - DNA, 20 bp, Artificial Sequence
  chemically synthesized
ctgacagtatttaagctgaa

SEQ ID NO: 178310 - DNA, 20 bp, Artificial Sequence
  chemically synthesized
actgacagtatttaagctga

SEQ ID NO: 178311 - DNA, 20 bp, Artificial Sequence
  chemically synthesized
ggcatgtactgacagtattt

SEQ ID NO: 178312 - DNA, 20 bp, Artificial Sequence
  chemically synthesized
cctttcagcttaaatactgt

SEQ ID NO: 178313 - DNA, 20 bp, Artificial Sequence
  chemically synthesized
agtggccaggcatgtactga

SEQ ID NO: 178314 - DNA, 20 bp, Artificial Sequence
  chemically synthesized
aaatactgtcagtacatgcc

SEQ ID NO: 178315 - DNA, 20 bp, Artificial Sequence
  chemically synthesized
aagtatttaattcagtggcc

SEQ ID NO: 178316 - DNA, 20 bp, Artificial Sequence
  chemically synthesized
gaagtatttaattcagtggc

SEQ ID NO: 178317 - DNA, 20 bp, Artificial Sequence
  chemically synthesized
tggcgaagtatttaattcag

SEQ ID NO: 178318 - DNA, 20 bp, Artificial Sequence
  chemically synthesized
aaatggcgaagtatttaatt

SEQ ID NO: 178319 - DNA, 20 bp, Artificial Sequence
  chemically synthesized
atcagactgaagaaatggcg

SEQ ID NO: 178320 - DNA, 20 bp, Artificial Sequence
  chemically synthesized
taaatacttcgccatttctt

SEQ ID NO: 178321 - DNA, 20 bp, Artificial Sequence
  chemically synthesized
gaagaatcagactgaagaaa

SEQ ID NO: 178322 - DNA, 20 bp, Artificial Sequence
  chemically synthesized
tattctgaagaatcagactg

SEQ ID NO: 178323 - DNA, 20 bp, Artificial Sequence
  chemically synthesized
atttcttcagtctgattctt

SEQ ID NO: 178324 - DNA, 20 bp, Artificial Sequence
  chemically synthesized
cataaattattctgaagaat

SEQ ID NO: 178325 - DNA, 20 bp, Artificial Sequence
  chemically synthesized
tttttgcataaattattctg

SEQ ID NO: 178326 - DNA, 20 bp, Artificial Sequence
  chemically synthesized
ataatttatgcaaaaaattg

SEQ ID NO: 178327 - DNA, 20 bp, Artificial Sequence
  chemically synthesized
aaaaattgtggtataaattt

SEQ ID NO: 178328 - DNA, 20 bp, Artificial Sequence
  chemically synthesized
gtggtataaattttggcatt

SEQ ID NO: 178329 - DNA, 20 bp, Artificial Sequence
  chemically synthesized
ggcatttggtcattaatgta

SEQ ID NO: 178330 - DNA, 20 bp, Artificial Sequence
  chemically synthesized
gaaaaaatgatgatggtgaa

SEQ ID NO: 178331 - DNA, 20 bp, Artificial Sequence
  chemically synthesized
gtggctagaaaaaatgatga

SEQ ID NO: 178332 - DNA, 20 bp, Artificial Sequence
  chemically synthesized
ttcaccatcatcattttttc

SEQ ID NO: 178333 - DNA, 20 bp, Artificial Sequence
  chemically synthesized
gctatatgttttgttgtggc

SEQ ID NO: 178334 - DNA, 20 bp, Artificial Sequence
  chemically synthesized
tttggctatatgttttgttg

SEQ ID NO: 178335 - DNA, 20 bp, Artificial Sequence
  chemically synthesized
tctagccacaacaaaacata

SEQ ID NO: 178336 - DNA, 20 bp, Artificial Sequence
  chemically synthesized
cacaacaaaacatatagcca

SEQ ID NO: 178337 - DNA, 20 bp, Artificial Sequence
  chemically synthesized
aaacatatagccaaagcaaa

SEQ ID NO: 178338 - DNA, 20 bp, Artificial Sequence
  chemically synthesized
tttaacctgaccgtttgctt

SEQ ID NO: 178339 - DNA, 20 bp, Artificial Sequence
  chemically synthesized
atatagccaaagcaaacggt

SEQ ID NO: 178340 - DNA, 20 bp, Artificial Sequence
  chemically synthesized
tatagccaaagcaaacggtc

SEQ ID NO: 178341 - DNA, 20 bp, Artificial Sequence
  chemically synthesized
caaaacaacaatccacatac

SEQ ID NO: 178342 - DNA, 20 bp, Artificial Sequence
  chemically synthesized
tcggggaggaggctggtatg

SEQ ID NO: 178343 - DNA, 20 bp, Artificial Sequence
  chemically synthesized
tcattggtcggggaggaggc

SEQ ID NO: 178344 - DNA, 20 bp, Artificial Sequence
  chemically synthesized
tgcttcattggtcggggagg

SEQ ID NO: 178345 - DNA, 20 bp, Artificial Sequence
  chemically synthesized
gtgcttcattggtcggggag

SEQ ID NO: 178346 - DNA, 20 bp, Artificial Sequence
  chemically synthesized
gggtgcttcattggtcgggg

SEQ ID NO: 178347 - DNA, 20 bp, Artificial Sequence
  chemically synthesized
tgggtgcttcattggtcggg

SEQ ID NO: 178348 - DNA, 20 bp, Artificial Sequence
  chemically synthesized
cctgggtgcttcattggtcg

SEQ ID NO: 178349 - DNA, 20 bp, Artificial Sequence
  chemically synthesized
tcctgggtgcttcattggtc

SEQ ID NO: 178350 - DNA, 20 bp, Artificial Sequence
  chemically synthesized
agcctcctccccgaccaatg

SEQ ID NO: 178351 - DNA, 20 bp, Artificial Sequence
  chemically synthesized
ttcctgggtgcttcattggt

SEQ ID NO: 178352 - DNA, 20 bp, Artificial Sequence
  chemically synthesized
ttgtttcctgggtgcttcat

SEQ ID NO: 178353 - DNA, 20 bp, Artificial Sequence
  chemically synthesized
tccccgaccaatgaagcacc

SEQ ID NO: 178354 - DNA, 20 bp, Artificial Sequence
  chemically synthesized
ccccgaccaatgaagcaccc

SEQ ID NO: 178355 - DNA, 20 bp, Artificial Sequence
  chemically synthesized
ttgtatgtattttgtttcct

SEQ ID NO: 178356 - DNA, 20 bp, Artificial Sequence
  chemically synthesized
tttgtatgtattttgtttcc

SEQ ID NO: 178357 - DNA, 20 bp, Artificial Sequence
  chemically synthesized
tcacatgtgttaaatgttgc

SEQ ID NO: 178358 - DNA, 20 bp, Artificial Sequence
  chemically synthesized
gcaacatttaacacatgtga

SEQ ID NO: 178359 - DNA, 20 bp, Artificial Sequence
  chemically synthesized
acatttaacacatgtgacgg

SEQ ID NO: 178360 - DNA, 20 bp, Artificial Sequence
  chemically synthesized
atttaacacatgtgacggaa

SEQ ID NO: 178361 - DNA, 20 bp, Artificial Sequence
  chemically synthesized
aacacatgtgacggaagaga

SEQ ID NO: 178362 - DNA, 20 bp, Artificial Sequence
  chemically synthesized
aatctccagtggataaaggt

SEQ ID NO: 178363 - DNA, 20 bp, Artificial Sequence
  chemically synthesized
gacaaatctccagtggataa

SEQ ID NO: 178364 - DNA, 20 bp, Artificial Sequence
  chemically synthesized
aatgtctaacctttatccac

SEQ ID NO: 178365 - DNA, 20 bp, Artificial Sequence
  chemically synthesized
agacaaatctccagtggata

SEQ ID NO: 178366 - DNA, 20 bp, Artificial Sequence
  chemically synthesized
tgtctaacctttatccactg

SEQ ID NO: 178367 - DNA, 20 bp, Artificial Sequence
  chemically synthesized
tcaagcagacaaatctccag

SEQ ID NO: 178368 - DNA, 20 bp, Artificial Sequence
  chemically synthesized
agctcaagcagacaaatctc

SEQ ID NO: 178369 - DNA, 20 bp, Artificial Sequence
  chemically synthesized
cactggagatttgtctgctt

SEQ ID NO: 178370 - DNA, 20 bp, Artificial Sequence
  chemically synthesized
aacttgaaaataagctcaag

SEQ ID NO: 178371 - DNA, 20 bp, Artificial Sequence
  chemically synthesized
ataaacttgaaaataagctc

SEQ ID NO: 178372 - DNA, 20 bp, Artificial Sequence
  chemically synthesized
gtctgcttgagcttattttc

SEQ ID NO: 178373 - DNA, 20 bp, Artificial Sequence
  chemically synthesized
agcaagataaacttgaaaat

SEQ ID NO: 178374 - DNA, 20 bp, Artificial Sequence
  chemically synthesized
tcaagtttatcttgctcttc

SEQ ID NO: 178375 - DNA, 20 bp, Artificial Sequence
  chemically synthesized
tcccataagcccagaagagc

SEQ ID NO: 178376 - DNA, 20 bp, Artificial Sequence
  chemically synthesized
caagtttatcttgctcttct

SEQ ID NO: 178377 - DNA, 20 bp, Artificial Sequence
  chemically synthesized
gtgctcccataagcccagaa

SEQ ID NO: 178378 - DNA, 20 bp, Artificial Sequence
  chemically synthesized
aagtgctcccataagcccag

SEQ ID NO: 178379 - DNA, 20 bp, Artificial Sequence
  chemically synthesized
atcttgctcttctgggctta

SEQ ID NO: 178380 - DNA, 20 bp, Artificial Sequence
  chemically synthesized
tcttgctcttctgggcttat

SEQ ID NO: 178381 - DNA, 20 bp, Artificial Sequence
  chemically synthesized
tgtaagtgctcccataagcc

SEQ ID NO: 178382 - DNA, 20 bp, Artificial Sequence
  chemically synthesized
ttgctcttctgggcttatgg

SEQ ID NO: 178383 - DNA, 20 bp, Artificial Sequence
  chemically synthesized
gtgcttgtaagtgctcccat

SEQ ID NO: 178384 - DNA, 20 bp, Artificial Sequence
  chemically synthesized
gggcttatgggagcacttac

SEQ ID NO: 178385 - DNA, 20 bp, Artificial Sequence
  chemically synthesized
tatgggagcacttacaagca

SEQ ID NO: 178386 - DNA, 20 bp, Artificial Sequence
  chemically synthesized
actggaggacccgtgcttgt

SEQ ID NO: 178387 - DNA, 20 bp, Artificial Sequence
  chemically synthesized
atgggagcacttacaagcac

SEQ ID NO: 178388 - DNA, 20 bp, Artificial Sequence
  chemically synthesized
acttacaagcacgggtcctc

SEQ ID NO: 178389 - DNA, 20 bp, Artificial Sequence
  chemically synthesized
aaacaattaaatgaaactgg

SEQ ID NO: 178390 - DNA, 20 bp, Artificial Sequence
  chemically synthesized
caaacaattaaatgaaactg

SEQ ID NO: 178391 - DNA, 20 bp, Artificial Sequence
  chemically synthesized
ctcaaacaattaaatgaaac

SEQ ID NO: 178392 - DNA, 20 bp, Artificial Sequence
  chemically synthesized
ccagtttcatttaattgttt

SEQ ID NO: 178393 - DNA, 20 bp, Artificial Sequence
  chemically synthesized
ttaattgtttgagaattccc

SEQ ID NO: 178394 - DNA, 20 bp, Artificial Sequence
  chemically synthesized
tgtttgagaattccctggcg

SEQ ID NO: 178395 - DNA, 20 bp, Artificial Sequence
  chemically synthesized
gtttgagaattccctggcgc

SEQ ID NO: 178396 - DNA, 20 bp, Artificial Sequence
  chemically synthesized
tttgagaattccctggcgca

SEQ ID NO: 178397 - DNA, 20 bp, Artificial Sequence
  chemically synthesized
gaagagttgcccctgcgcca

SEQ ID NO: 178398 - DNA, 20 bp, Artificial Sequence
  chemically synthesized
ttgagaattccctggcgcag

SEQ ID NO: 178399 - DNA, 20 bp, Artificial Sequence
  chemically synthesized
ggaagagttgcccctgcgcc

SEQ ID NO: 178400 - DNA, 20 bp, Artificial Sequence
  chemically synthesized
tggaagagttgcccctgcgc

SEQ ID NO: 178401 - DNA, 20 bp, Artificial Sequence
  chemically synthesized
cgcaggggcaactcttccac

SEQ ID NO: 178402 - DNA, 20 bp, Artificial Sequence
  chemically synthesized
tgtttcagttactggtggaa

SEQ ID NO: 178403 - DNA, 20 bp, Artificial Sequence
  chemically synthesized
tctgtttcagttactggtgg

SEQ ID NO: 178404 - DNA, 20 bp, Artificial Sequence
  chemically synthesized
ttgtctgtttcagttactgg

SEQ ID NO: 178405 - DNA, 20 bp, Artificial Sequence
  chemically synthesized
catttgtctgtttcagttac

SEQ ID NO: 178406 - DNA, 20 bp, Artificial Sequence
  chemically synthesized
tcttccaccagtaactgaaa

SEQ ID NO: 178407 - DNA, 20 bp, Artificial Sequence
  chemically synthesized
gttgttgcatttgtctgttt

SEQ ID NO: 178408 - DNA, 20 bp, Artificial Sequence
  chemically synthesized
acaacgtttaaaatgaatta

SEQ ID NO: 178409 - DNA, 20 bp, Artificial Sequence
  chemically synthesized
agaagcaaagacaaggtagt

SEQ ID NO: 178410 - DNA, 20 bp, Artificial Sequence
  chemically synthesized
caatagaagcaaagacaagg

SEQ ID NO: 178411 - DNA, 20 bp, Artificial Sequence
  chemically synthesized
aatcaatagaagcaaagaca

SEQ ID NO: 178412 - DNA, 20 bp, Artificial Sequence
  chemically synthesized
taatcaatagaagcaaagac

SEQ ID NO: 178413 - DNA, 20 bp, Artificial Sequence
  chemically synthesized
tagactaatcaatagaagca

SEQ ID NO: 178414 - DNA, 20 bp, Artificial Sequence
  chemically synthesized
tttgatagactaatcaatag

SEQ ID NO: 178415 - DNA, 20 bp, Artificial Sequence
  chemically synthesized
ttgtctttgcttctattgat

SEQ ID NO: 178416 - DNA, 20 bp, Artificial Sequence
  chemically synthesized
cattttgatagactaatcaa

SEQ ID NO: 178417 - DNA, 20 bp, Artificial Sequence
  chemically synthesized
gtcaagtcgcttcattttga

SEQ ID NO: 178418 - DNA, 20 bp, Artificial Sequence
  chemically synthesized
ttgattagtctatcaaaatg

SEQ ID NO: 178419 - DNA, 20 bp, Artificial Sequence
  chemically synthesized
caaaatgaagcgacttgacc

SEQ ID NO: 178420 - DNA, 20 bp, Artificial Sequence
  chemically synthesized
aaaatgaagcgacttgaccg

SEQ ID NO: 178421 - DNA, 20 bp, Artificial Sequence
  chemically synthesized
aaatgaagcgacttgaccga

SEQ ID NO: 178422 - DNA, 20 bp, Artificial Sequence
  chemically synthesized
gtaccactgggccctcggtc

SEQ ID NO: 178423 - DNA, 20 bp, Artificial Sequence
  chemically synthesized
aagcgacttgaccgagggcc

SEQ ID NO: 178424 - DNA, 20 bp, Artificial Sequence
  chemically synthesized
ttgaggtaccactgggccct

SEQ ID NO: 178425 - DNA, 20 bp, Artificial Sequence
  chemically synthesized
cgacttgaccgagggcccag

SEQ ID NO: 178426 - DNA, 20 bp, Artificial Sequence
  chemically synthesized
ttggtatttgaggtaccact

SEQ ID NO: 178427 - DNA, 20 bp, Artificial Sequence
  chemically synthesized
gttggtatttgaggtaccac

SEQ ID NO: 178428 - DNA, 20 bp, Artificial Sequence
  chemically synthesized
tagaaaactgttggtatttg

SEQ ID NO: 178429 - DNA, 20 bp, Artificial Sequence
  chemically synthesized
atagaaaactgttggtattt

SEQ ID NO: 178430 - DNA, 20 bp, Artificial Sequence
  chemically synthesized
agtggtacctcaaataccaa

SEQ ID NO: 178431 - DNA, 20 bp, Artificial Sequence
  chemically synthesized
gtgctcagatagaaaactgt

SEQ ID NO: 178432 - DNA, 20 bp, Artificial Sequence
  chemically synthesized
ataccaacagttttctatct

SEQ ID NO: 178433 - DNA, 20 bp, Artificial Sequence
  chemically synthesized
caatcagctctgtgctcaga

SEQ ID NO: 178434 - DNA, 20 bp, Artificial Sequence
  chemically synthesized
aacagttttctatctgagca

SEQ ID NO: 178435 - DNA, 20 bp, Artificial Sequence
  chemically synthesized
cagttttctatctgagcaca

SEQ ID NO: 178436 - DNA, 20 bp, Artificial Sequence
  chemically synthesized
cagtcaatcagctctgtgct

SEQ ID NO: 178437 - DNA, 20 bp, Artificial Sequence
  chemically synthesized
gggtgagtgtttcagtcaat

SEQ ID NO: 178438 - DNA, 20 bp, Artificial Sequence
  chemically synthesized
tactgagggggtgagtgttt

SEQ ID NO: 178439 - DNA, 20 bp, Artificial Sequence
  chemically synthesized
gactgaaacactcaccccct

SEQ ID NO: 178440 - DNA, 20 bp, Artificial Sequence
  chemically synthesized
gatttatctactgagggggt

SEQ ID NO: 178441 - DNA, 20 bp, Artificial Sequence
  chemically synthesized
tgaaacactcaccccctcag

SEQ ID NO: 178442 - DNA, 20 bp, Artificial Sequence
  chemically synthesized
cagagatttatctactgagg

SEQ ID NO: 178443 - DNA, 20 bp, Artificial Sequence
  chemically synthesized
acagagatttatctactgag

SEQ ID NO: 178444 - DNA, 20 bp, Artificial Sequence
  chemically synthesized
tacagagatttatctactga

SEQ ID NO: 178445 - DNA, 20 bp, Artificial Sequence
  chemically synthesized
ctacagagatttatctactg

SEQ ID NO: 178446 - DNA, 20 bp, Artificial Sequence
  chemically synthesized
tctacagagatttatctact

SEQ ID NO: 178447 - DNA, 20 bp, Artificial Sequence
  chemically synthesized
cctcagtagataaatctctg

SEQ ID NO: 178448 - DNA, 20 bp, Artificial Sequence
  chemically synthesized
ataatcgtttattttctaca

SEQ ID NO: 178449 - DNA, 20 bp, Artificial Sequence
  chemically synthesized
atataatcgtttattttcta

SEQ ID NO: 178450 - DNA, 20 bp, Artificial Sequence
  chemically synthesized
ttctcttaaaaaatttatga

SEQ ID NO: 178451 - DNA, 20 bp, Artificial Sequence
  chemically synthesized
tttctcttaaaaaatttatg

SEQ ID NO: 178452 - DNA, 20 bp, Artificial Sequence
  chemically synthesized
ttttctcttaaaaaatttat

SEQ ID NO: 178453 - DNA, 20 bp, Artificial Sequence
  chemically synthesized
ttatccctcataaatttttt

SEQ ID NO: 178454 - DNA, 20 bp, Artificial Sequence
  chemically synthesized
atccctcataaattttttaa

SEQ ID NO: 178455 - DNA, 20 bp, Artificial Sequence
  chemically synthesized
attttttaagagaaaaatgt

SEQ ID NO: 178456 - DNA, 20 bp, Artificial Sequence
  chemically synthesized
tttaagagaaaaatgtgaga

SEQ ID NO: 178457 - DNA, 20 bp, Artificial Sequence
  chemically synthesized
gagaaaaatgtgagatggta

SEQ ID NO: 178458 - DNA, 20 bp, Artificial Sequence
  chemically synthesized
gtaaagcaacactccaaata

SEQ ID NO: 178459 - DNA, 20 bp, Artificial Sequence
  chemically synthesized
tcagacactaactttatttg

SEQ ID NO: 178460 - DNA, 20 bp, Artificial Sequence
  chemically synthesized
tttcagacactaactttatt

SEQ ID NO: 178461 - DNA, 20 bp, Artificial Sequence
  chemically synthesized
agcaacactccaaataaagt

SEQ ID NO: 178462 - DNA, 20 bp, Artificial Sequence
  chemically synthesized
ctgatagagagataggtttt

SEQ ID NO: 178463 - DNA, 20 bp, Artificial Sequence
  chemically synthesized
tctatttctgatagagagat

SEQ ID NO: 178464 - DNA, 20 bp, Artificial Sequence
  chemically synthesized
ttctatttctgatagagaga

SEQ ID NO: 178465 - DNA, 20 bp, Artificial Sequence
  chemically synthesized
ctgaaaacctatctctctat

SEQ ID NO: 178466 - DNA, 20 bp, Artificial Sequence
  chemically synthesized
attgttctatttctgataga

SEQ ID NO: 178467 - DNA, 20 bp, Artificial Sequence
  chemically synthesized
acattgttctatttctgata

SEQ ID NO: 178468 - DNA, 20 bp, Artificial Sequence
  chemically synthesized
acctatctctctatcagaaa

SEQ ID NO: 178469 - DNA, 20 bp, Artificial Sequence
  chemically synthesized
tcacattgttctatttctga

SEQ ID NO: 178470 - DNA, 20 bp, Artificial Sequence
  chemically synthesized
aacaatgtgaacaaattcat

SEQ ID NO: 178471 - DNA, 20 bp, Artificial Sequence
  chemically synthesized
gaacaaattcatcagcctct

SEQ ID NO: 178472 - DNA, 20 bp, Artificial Sequence
  chemically synthesized
aacaaattcatcagcctctt

SEQ ID NO: 178473 - DNA, 20 bp, Artificial Sequence
  chemically synthesized
ggcatgctatgatacccaag

SEQ ID NO: 178474 - DNA, 20 bp, Artificial Sequence
  chemically synthesized
tggcatgctatgatacccaa

SEQ ID NO: 178475 - DNA, 20 bp, Artificial Sequence
  chemically synthesized
tatggcatgctatgataccc

SEQ ID NO: 178476 - DNA, 20 bp, Artificial Sequence
  chemically synthesized
catcagcctcttgggtatca

SEQ ID NO: 178477 - DNA, 20 bp, Artificial Sequence
  chemically synthesized
ttgggtatcatagcatgcca

SEQ ID NO: 178478 - DNA, 20 bp, Artificial Sequence
  chemically synthesized
cagcaagctacggtatgcta

SEQ ID NO: 178479 - DNA, 20 bp, Artificial Sequence
  chemically synthesized
tagcatgccatagcataccg

SEQ ID NO: 178480 - DNA, 20 bp, Artificial Sequence
  chemically synthesized
aatttctcagcagcaagcta

SEQ ID NO: 178481 - DNA, 20 bp, Artificial Sequence
  chemically synthesized
gcataccgtagcttgctgct

SEQ ID NO: 178482 - DNA, 20 bp, Artificial Sequence
  chemically synthesized
taatgcaatttctcagcagc

SEQ ID NO: 178483 - DNA, 20 bp, Artificial Sequence
  chemically synthesized
atgataatgcaatttctcag

SEQ ID NO: 178484 - DNA, 20 bp, Artificial Sequence
  chemically synthesized
aagatgataatgcaatttct

SEQ ID NO: 178485 - DNA, 20 bp, Artificial Sequence
  chemically synthesized
agaaattgcattatcatctt

SEQ ID NO: 178486 - DNA, 20 bp, Artificial Sequence
  chemically synthesized
aaattgcattatcatcttaa

SEQ ID NO: 178487 - DNA, 20 bp, Artificial Sequence
  chemically synthesized
aattgcattatcatcttaag

SEQ ID NO: 178488 - DNA, 20 bp, Artificial Sequence
  chemically synthesized
ctcaatgtcagttacctctt

SEQ ID NO: 178489 - DNA, 20 bp, Artificial Sequence
  chemically synthesized
cttaagaggtaactgacatt

SEQ ID NO: 178490 - DNA, 20 bp, Artificial Sequence
  chemically synthesized
taagaggtaactgacattga

SEQ ID NO: 178491 - DNA, 20 bp, Artificial Sequence
  chemically synthesized
agagtcaatactctcaatgt

SEQ ID NO: 178492 - DNA, 20 bp, Artificial Sequence
  chemically synthesized
cctggcactgtgtatattga

SEQ ID NO: 178493 - DNA, 20 bp, Artificial Sequence
  chemically synthesized
tgcctggcactgtgtatatt

SEQ ID NO: 178494 - DNA, 20 bp, Artificial Sequence
  chemically synthesized
gtattgactctcaatataca

SEQ ID NO: 178495 - DNA, 20 bp, Artificial Sequence
  chemically synthesized
actctcaatatacacagtgc

SEQ ID NO: 178496 - DNA, 20 bp, Artificial Sequence
  chemically synthesized
ctctcaatatacacagtgcc

SEQ ID NO: 178497 - DNA, 20 bp, Artificial Sequence
  chemically synthesized
gaaaaggttagcacagtgcc

SEQ ID NO: 178498 - DNA, 20 bp, Artificial Sequence
  chemically synthesized
taaatgtgaaaaggttagca

SEQ ID NO: 178499 - DNA, 20 bp, Artificial Sequence
  chemically synthesized
gataataaatgtgaaaaggt

SEQ ID NO: 178500 - DNA, 20 bp, Artificial Sequence
  chemically synthesized
ctaagataataaatgtgaaa

SEQ ID NO: 178501 - DNA, 20 bp, Artificial Sequence
  chemically synthesized
actaagataataaatgtgaa

SEQ ID NO: 178502 - DNA, 20 bp, Artificial Sequence
  chemically synthesized
ccttttcacatttattatct

SEQ ID NO: 178503 - DNA, 20 bp, Artificial Sequence
  chemically synthesized
ttataatatgaagataaact

SEQ ID NO: 178504 - DNA, 20 bp, Artificial Sequence
  chemically synthesized
gatataattattataatatg

SEQ ID NO: 178505 - DNA, 20 bp, Artificial Sequence
  chemically synthesized
tcatattataataattatat

SEQ ID NO: 178506 - DNA, 20 bp, Artificial Sequence
  chemically synthesized
catattataataattatatc

SEQ ID NO: 178507 - DNA, 20 bp, Artificial Sequence
  chemically synthesized
attataataattatatcagg

SEQ ID NO: 178508 - DNA, 20 bp, Artificial Sequence
  chemically synthesized
ccatataaaatgaagataat

SEQ ID NO: 178509 - DNA, 20 bp, Artificial Sequence
  chemically synthesized
gtttccttccatataaaatg

SEQ ID NO: 178510 - DNA, 20 bp, Artificial Sequence
  chemically synthesized
ccaattatcttcattttata

SEQ ID NO: 178511 - DNA, 20 bp, Artificial Sequence
  chemically synthesized
attatcttcattttatatgg

SEQ ID NO: 178512 - DNA, 20 bp, Artificial Sequence
  chemically synthesized
ttatcttcattttatatgga

SEQ ID NO: 178513 - DNA, 20 bp, Artificial Sequence
  chemically synthesized
attttatatggaaggaaact

SEQ ID NO: 178514 - DNA, 20 bp, Artificial Sequence
  chemically synthesized
tatggaaggaaactgagaca

SEQ ID NO: 178515 - DNA, 20 bp, Artificial Sequence
  chemically synthesized
atggaaggaaactgagacaa

SEQ ID NO: 178516 - DNA, 20 bp, Artificial Sequence
  chemically synthesized
tggaaggaaactgagacaaa

SEQ ID NO: 178517 - DNA, 20 bp, Artificial Sequence
  chemically synthesized
ggtatttaacccctttgtct

SEQ ID NO: 178518 - DNA, 20 bp, Artificial Sequence
  chemically synthesized
ggaaggaaactgagacaaag

SEQ ID NO: 178519 - DNA, 20 bp, Artificial Sequence
  chemically synthesized
gagacaaaggggttaaatac

SEQ ID NO: 178520 - DNA, 20 bp, Artificial Sequence
  chemically synthesized
aggggttaaataccagctcc

SEQ ID NO: 178521 - DNA, 20 bp, Artificial Sequence
  chemically synthesized
ggggttaaataccagctccc

SEQ ID NO: 178522 - DNA, 20 bp, Artificial Sequence
  chemically synthesized
tagatttgtgtcctgggagc

SEQ ID NO: 178523 - DNA, 20 bp, Artificial Sequence
  chemically synthesized
ttgctagatttgtgtcctgg

SEQ ID NO: 178524 - DNA, 20 bp, Artificial Sequence
  chemically synthesized
gcttgctagatttgtgtcct

SEQ ID NO: 178525 - DNA, 20 bp, Artificial Sequence
  chemically synthesized
tgcttgctagatttgtgtcc

SEQ ID NO: 178526 - DNA, 20 bp, Artificial Sequence
  chemically synthesized
cagctcccaggacacaaatc

SEQ ID NO: 178527 - DNA, 20 bp, Artificial Sequence
  chemically synthesized
tcccaggacacaaatctagc

SEQ ID NO: 178528 - DNA, 20 bp, Artificial Sequence
  chemically synthesized
accacacctttgttgcttgc

SEQ ID NO: 178529 - DNA, 20 bp, Artificial Sequence
  chemically synthesized
cacaaatctagcaagcaaca

SEQ ID NO: 178530 - DNA, 20 bp, Artificial Sequence
  chemically synthesized
acaaatctagcaagcaacaa

SEQ ID NO: 178531 - DNA, 20 bp, Artificial Sequence
  chemically synthesized
tctagcaagcaacaaaggtg

SEQ ID NO: 178532 - DNA, 20 bp, Artificial Sequence
  chemically synthesized
acaaaggtgtggttcaaatt

SEQ ID NO: 178533 - DNA, 20 bp, Artificial Sequence
  chemically synthesized
caaaggtgtggttcaaattt

SEQ ID NO: 178534 - DNA, 20 bp, Artificial Sequence
  chemically synthesized
aggtgtggttcaaatttggg

SEQ ID NO: 178535 - DNA, 20 bp, Artificial Sequence
  chemically synthesized
aaatttgggtagtttcattc

SEQ ID NO: 178536 - DNA, 20 bp, Artificial Sequence
  chemically synthesized
atttgggtagtttcattctg

SEQ ID NO: 178537 - DNA, 20 bp, Artificial Sequence
  chemically synthesized
gaagtaaaaaatgaggactc

SEQ ID NO: 178538 - DNA, 20 bp, Artificial Sequence
  chemically synthesized
gggatatgaagtaaaaaatg

SEQ ID NO: 178539 - DNA, 20 bp, Artificial Sequence
  chemically synthesized
agggatatgaagtaaaaaat

SEQ ID NO: 178540 - DNA, 20 bp, Artificial Sequence
  chemically synthesized
tcgagaaatttagggatatg

SEQ ID NO: 178541 - DNA, 20 bp, Artificial Sequence
  chemically synthesized
gaatgagttcgagaaattta

SEQ ID NO: 178542 - DNA, 20 bp, Artificial Sequence
  chemically synthesized
tgaatgagttcgagaaattt

SEQ ID NO: 178543 - DNA, 20 bp, Artificial Sequence
  chemically synthesized
gtgaatgagttcgagaaatt

SEQ ID NO: 178544 - DNA, 20 bp, Artificial Sequence
  chemically synthesized
atgtggtggtgaatgagttc

SEQ ID NO: 178545 - DNA, 20 bp, Artificial Sequence
  chemically synthesized
tacactatgtggtggtgaat

SEQ ID NO: 178546 - DNA, 20 bp, Artificial Sequence
  chemically synthesized
cgaactcattcaccaccaca

SEQ ID NO: 178547 - DNA, 20 bp, Artificial Sequence
  chemically synthesized
aaagggcatacactatgtgg

SEQ ID NO: 178548 - DNA, 20 bp, Artificial Sequence
  chemically synthesized
gggaaagggcatacactatg

SEQ ID NO: 178549 - DNA, 20 bp, Artificial Sequence
  chemically synthesized
catagtgtatgccctttccc

SEQ ID NO: 178550 - DNA, 20 bp, Artificial Sequence
  chemically synthesized
attttggaggtcttgggaaa

SEQ ID NO: 178551 - DNA, 20 bp, Artificial Sequence
  chemically synthesized
gattttggaggtcttgggaa

SEQ ID NO: 178552 - DNA, 20 bp, Artificial Sequence
  chemically synthesized
tgattttggaggtcttggga

SEQ ID NO: 178553 - DNA, 20 bp, Artificial Sequence
  chemically synthesized
atggtgattttggaggtctt

SEQ ID NO: 178554 - DNA, 20 bp, Artificial Sequence
  chemically synthesized
catggtgattttggaggtct

SEQ ID NO: 178555 - DNA, 20 bp, Artificial Sequence
  chemically synthesized
taacaccatggtgattttgg

SEQ ID NO: 178556 - DNA, 20 bp, Artificial Sequence
  chemically synthesized
ttaacaccatggtgattttg

SEQ ID NO: 178557 - DNA, 20 bp, Artificial Sequence
  chemically synthesized
tgttaacaccatggtgattt

SEQ ID NO: 178558 - DNA, 20 bp, Artificial Sequence
  chemically synthesized
caagacctccaaaatcacca

SEQ ID NO: 178559 - DNA, 20 bp, Artificial Sequence
  chemically synthesized
aaaatgaagtgttaacacca

SEQ ID NO: 178560 - DNA, 20 bp, Artificial Sequence
  chemically synthesized
aactttagttgacaaaaatg

SEQ ID NO: 178561 - DNA, 20 bp, Artificial Sequence
  chemically synthesized
cacttcatttttgtcaacta

SEQ ID NO: 178562 - DNA, 20 bp, Artificial Sequence
  chemically synthesized
tgtagcagacacagtaactt

SEQ ID NO: 178563 - DNA, 20 bp, Artificial Sequence
  chemically synthesized
aatgggtactgtagcagaca

SEQ ID NO: 178564 - DNA, 20 bp, Artificial Sequence
  chemically synthesized
taaagttactgtgtctgcta

SEQ ID NO: 178565 - DNA, 20 bp, Artificial Sequence
  chemically synthesized
atggctaatgggtactgtag

SEQ ID NO: 178566 - DNA, 20 bp, Artificial Sequence
  chemically synthesized
tgtatggctaatgggtactg

SEQ ID NO: 178567 - DNA, 20 bp, Artificial Sequence
  chemically synthesized
gtgtctgctacagtacccat

SEQ ID NO: 178568 - DNA, 20 bp, Artificial Sequence
  chemically synthesized
aatagcgttgtatggctaat

SEQ ID NO: 178569 - DNA, 20 bp, Artificial Sequence
  chemically synthesized
taatagcgttgtatggctaa

SEQ ID NO: 178570 - DNA, 20 bp, Artificial Sequence
  chemically synthesized
tgaatgttaatagcgttgta

SEQ ID NO: 178571 - DNA, 20 bp, Artificial Sequence
  chemically synthesized
ttgattaacttgaatgttaa

SEQ ID NO: 178572 - DNA, 20 bp, Artificial Sequence
  chemically synthesized
atacaacgctattaacattc

SEQ ID NO: 178573 - DNA, 20 bp, Artificial Sequence
  chemically synthesized
aggaacttgagattttattt

SEQ ID NO: 178574 - DNA, 20 bp, Artificial Sequence
  chemically synthesized
attcactaaaataaaatctc

SEQ ID NO: 178575 - DNA, 20 bp, Artificial Sequence
  chemically synthesized
gtcgtgtgactgaggaactt

SEQ ID NO: 178576 - DNA, 20 bp, Artificial Sequence
  chemically synthesized
aaataaaatctcaagttcct

SEQ ID NO: 178577 - DNA, 20 bp, Artificial Sequence
  chemically synthesized
gagagttggtcgtgtgactg

SEQ ID NO: 178578 - DNA, 20 bp, Artificial Sequence
  chemically synthesized
ggagagttggtcgtgtgact

SEQ ID NO: 178579 - DNA, 20 bp, Artificial Sequence
  chemically synthesized
cagtcacacgaccaactctc

SEQ ID NO: 178580 - DNA, 20 bp, Artificial Sequence
  chemically synthesized
agtcacacgaccaactctcc

SEQ ID NO: 178581 - DNA, 20 bp, Artificial Sequence
  chemically synthesized
cttttgaatacctggagagt

SEQ ID NO: 178582 - DNA, 20 bp, Artificial Sequence
  chemically synthesized
gtgccttttgaatacctgga

SEQ ID NO: 178583 - DNA, 20 bp, Artificial Sequence
  chemically synthesized
ttgtgccttttgaatacctg

SEQ ID NO: 178584 - DNA, 20 bp, Artificial Sequence
  chemically synthesized
atttgtgccttttgaatacc

SEQ ID NO: 178585 - DNA, 20 bp, Artificial Sequence
  chemically synthesized
ccaactctccaggtattcaa

SEQ ID NO: 178586 - DNA, 20 bp, Artificial Sequence
  chemically synthesized
caactctccaggtattcaaa

SEQ ID NO: 178587 - DNA, 20 bp, Artificial Sequence
  chemically synthesized
aggtattcaaaaggcacaaa

SEQ ID NO: 178588 - DNA, 20 bp, Artificial Sequence
  chemically synthesized
attcaaaaggcacaaatagc

SEQ ID NO: 178589 - DNA, 20 bp, Artificial Sequence
  chemically synthesized
tcatccatttttgtaacgac

SEQ ID NO: 178590 - DNA, 20 bp, Artificial Sequence
  chemically synthesized
atagctagtcgttacaaaaa

SEQ ID NO: 178591 - DNA, 20 bp, Artificial Sequence
  chemically synthesized
cgttacaaaaatggatgatg

SEQ ID NO: 178592 - DNA, 20 bp, Artificial Sequence
  chemically synthesized
gcagaatattttcatcatca

SEQ ID NO: 178593 - DNA, 20 bp, Artificial Sequence
  chemically synthesized
cagaatattttcatcatcac

SEQ ID NO: 178594 - DNA, 20 bp, Artificial Sequence
  chemically synthesized
gaatattttcatcatcacgg

SEQ ID NO: 178595 - DNA, 20 bp, Artificial Sequence
  chemically synthesized
atcacgggagttctatttga

SEQ ID NO: 178596 - DNA, 20 bp, Artificial Sequence
  chemically synthesized
tctagatcagtgctttcaaa

SEQ ID NO: 178597 - DNA, 20 bp, Artificial Sequence
  chemically synthesized
tctatttgaaagcactgatc

SEQ ID NO: 178598 - DNA, 20 bp, Artificial Sequence
  chemically synthesized
tctcctgaaagaatctagat

SEQ ID NO: 178599 - DNA, 20 bp, Artificial Sequence
  chemically synthesized
tattttctcctgaaagaatc

SEQ ID NO: 178600 - DNA, 20 bp, Artificial Sequence
  chemically synthesized
agcactgatctagattcttt

SEQ ID NO: 178601 - DNA, 20 bp, Artificial Sequence
  chemically synthesized
gcactgatctagattctttc

SEQ ID NO: 178602 - DNA, 20 bp, Artificial Sequence
  chemically synthesized
actgatctagattctttcag

SEQ ID NO: 178603 - DNA, 20 bp, Artificial Sequence
  chemically synthesized
atgagtctattttctcctga

SEQ ID NO: 178604 - DNA, 20 bp, Artificial Sequence
  chemically synthesized
tagattctttcaggagaaaa

SEQ ID NO: 178605 - DNA, 20 bp, Artificial Sequence
  chemically synthesized
tcttattaattaatatgcat

SEQ ID NO: 178606 - DNA, 20 bp, Artificial Sequence
  chemically synthesized
actcatgcatattaattaat

SEQ ID NO: 178607 - DNA, 20 bp, Artificial Sequence
  chemically synthesized
ttcattcgaaacatatttag

SEQ ID NO: 178608 - DNA, 20 bp, Artificial Sequence
  chemically synthesized
taattcattcgaaacatatt

SEQ ID NO: 178609 - DNA, 20 bp, Artificial Sequence
  chemically synthesized
aatgtattgagtgtcatata

SEQ ID NO: 178610 - DNA, 20 bp, Artificial Sequence
  chemically synthesized
ttatctttcccaaatgtatt

SEQ ID NO: 178611 - DNA, 20 bp, Artificial Sequence
  chemically synthesized
tatatgacactcaatacatt

SEQ ID NO: 178612 - DNA, 20 bp, Artificial Sequence
  chemically synthesized
atatgacactcaatacattt

SEQ ID NO: 178613 - DNA, 20 bp, Artificial Sequence
  chemically synthesized
gacactcaatacatttggga

SEQ ID NO: 178614 - DNA, 20 bp, Artificial Sequence
  chemically synthesized
tttgggaaagataaatttcc

SEQ ID NO: 178615 - DNA, 20 bp, Artificial Sequence
  chemically synthesized
gaaagataaatttccaagaa

SEQ ID NO: 178616 - DNA, 20 bp, Artificial Sequence
  chemically synthesized
caatgaactcagtcttttct

SEQ ID NO: 178617 - DNA, 20 bp, Artificial Sequence
  chemically synthesized
taaatttccaagaaaagact

SEQ ID NO: 178618 - DNA, 20 bp, Artificial Sequence
  chemically synthesized
ataccctagaacaatgaact

SEQ ID NO: 178619 - DNA, 20 bp, Artificial Sequence
  chemically synthesized
aaagactgagttcattgttc

SEQ ID NO: 178620 - DNA, 20 bp, Artificial Sequence
  chemically synthesized
aagactgagttcattgttct

SEQ ID NO: 178621 - DNA, 20 bp, Artificial Sequence
  chemically synthesized
agactgagttcattgttcta

SEQ ID NO: 178622 - DNA, 20 bp, Artificial Sequence
  chemically synthesized
atttgaagatggttataccc

SEQ ID NO: 178623 - DNA, 20 bp, Artificial Sequence
  chemically synthesized
gagtgggaatcatttgaaga

SEQ ID NO: 178624 - DNA, 20 bp, Artificial Sequence
  chemically synthesized
aaaagagtgggaatcatttg

SEQ ID NO: 178625 - DNA, 20 bp, Artificial Sequence
  chemically synthesized
attcaaaaatagaaaagagt

SEQ ID NO: 178626 - DNA, 20 bp, Artificial Sequence
  chemically synthesized
gattcaaaaatagaaaagag

SEQ ID NO: 178627 - DNA, 20 bp, Artificial Sequence
  chemically synthesized
tgggattcaaaaatagaaaa

SEQ ID NO: 178628 - DNA, 20 bp, Artificial Sequence
  chemically synthesized
tttgggattcaaaaatagaa

SEQ ID NO: 178629 - DNA, 20 bp, Artificial Sequence
  chemically synthesized
aggtatttgggattcaaaaa

SEQ ID NO: 178630 - DNA, 20 bp, Artificial Sequence
  chemically synthesized
atttttgaatcccaaatacc

SEQ ID NO: 178631 - DNA, 20 bp, Artificial Sequence
  chemically synthesized
cgatgttttactaggtattt

SEQ ID NO: 178632 - DNA, 20 bp, Artificial Sequence
  chemically synthesized
ccgatgttttactaggtatt

SEQ ID NO: 178633 - DNA, 20 bp, Artificial Sequence
  chemically synthesized
tatacatccgatgttttact

SEQ ID NO: 178634 - DNA, 20 bp, Artificial Sequence
  chemically synthesized
ctatacatccgatgttttac

SEQ ID NO: 178635 - DNA, 20 bp, Artificial Sequence
  chemically synthesized
ccaaatacctagtaaaacat

SEQ ID NO: 178636 - DNA, 20 bp, Artificial Sequence
  chemically synthesized
ctagtaaaacatcggatgta

SEQ ID NO: 178637 - DNA, 20 bp, Artificial Sequence
  chemically synthesized
taaaacatcggatgtatagt

SEQ ID NO: 178638 - DNA, 20 bp, Artificial Sequence
  chemically synthesized
taattcaataaacaaatatg

SEQ ID NO: 178639 - DNA, 20 bp, Artificial Sequence
  chemically synthesized
cgtaattcaataaacaaata

SEQ ID NO: 178640 - DNA, 20 bp, Artificial Sequence
  chemically synthesized
taaagtataaaaataaaata

SEQ ID NO: 178641 - DNA, 20 bp, Artificial Sequence
  chemically synthesized
ttacacctgaacaagaaata

SEQ ID NO: 178642 - DNA, 20 bp, Artificial Sequence
  chemically synthesized
tttatactttatttcttgtt

SEQ ID NO: 178643 - DNA, 20 bp, Artificial Sequence
  chemically synthesized
ttatactttatttcttgttc

SEQ ID NO: 178644 - DNA, 20 bp, Artificial Sequence
  chemically synthesized
caagaggtttacacctgaac

SEQ ID NO: 178645 - DNA, 20 bp, Artificial Sequence
  chemically synthesized
gtttatttctgtgaaacaag

SEQ ID NO: 178646 - DNA, 20 bp, Artificial Sequence
  chemically synthesized
cgtttatttctgtgaaacaa

SEQ ID NO: 178647 - DNA, 20 bp, Artificial Sequence
  chemically synthesized
ggtgtaaacctcttgtttca

SEQ ID NO: 178648 - DNA, 20 bp, Artificial Sequence
  chemically synthesized
aacgtttatttctgtgaaac

SEQ ID NO: 178649 - DNA, 20 bp, Artificial Sequence
  chemically synthesized
cagaaataaacgtttgacat

SEQ ID NO: 178650 - DNA, 20 bp, Artificial Sequence
  chemically synthesized
tgctttacacatgtaaatta

SEQ ID NO: 178651 - DNA, 20 bp, Artificial Sequence
  chemically synthesized
ggtgctttacacatgtaaat

SEQ ID NO: 178652 - DNA, 20 bp, Artificial Sequence
  chemically synthesized
gactctaatttacatgtgta

SEQ ID NO: 178653 - DNA, 20 bp, Artificial Sequence
  chemically synthesized
tggtcctttatcaatgattc

SEQ ID NO: 178654 - DNA, 20 bp, Artificial Sequence
  chemically synthesized
ttggtcctttatcaatgatt

SEQ ID NO: 178655 - DNA, 20 bp, Artificial Sequence
  chemically synthesized
aagcacctgaatcattgata

SEQ ID NO: 178656 - DNA, 20 bp, Artificial Sequence
  chemically synthesized
agcacctgaatcattgataa

SEQ ID NO: 178657 - DNA, 20 bp, Artificial Sequence
  chemically synthesized
taatcaaagggaaatgaaat

SEQ ID NO: 178658 - DNA, 20 bp, Artificial Sequence
  chemically synthesized
tacacggtcacataatcaaa

SEQ ID NO: 178659 - DNA, 20 bp, Artificial Sequence
  chemically synthesized
ttacacggtcacataatcaa

SEQ ID NO: 178660 - DNA, 20 bp, Artificial Sequence
  chemically synthesized
tttacacggtcacataatca

SEQ ID NO: 178661 - DNA, 20 bp, Artificial Sequence
  chemically synthesized
gctattatcctcattttaca

SEQ ID NO: 178662 - DNA, 20 bp, Artificial Sequence
  chemically synthesized
attatgtgaccgtgtaaaat

SEQ ID NO: 178663 - DNA, 20 bp, Artificial Sequence
  chemically synthesized
ttatgtgaccgtgtaaaatg

SEQ ID NO: 178664 - DNA, 20 bp, Artificial Sequence
  chemically synthesized
accgtgtaaaatgaggataa

SEQ ID NO: 178665 - DNA, 20 bp, Artificial Sequence
  chemically synthesized
ttcatatcagattttgacaa

SEQ ID NO: 178666 - DNA, 20 bp, Artificial Sequence
  chemically synthesized
cattgtcaaaatctgatatg

SEQ ID NO: 178667 - DNA, 20 bp, Artificial Sequence
  chemically synthesized
attttatttaatcttcatat

SEQ ID NO: 178668 - DNA, 20 bp, Artificial Sequence
  chemically synthesized
gatatgaagattaaataaaa

SEQ ID NO: 178669 - DNA, 20 bp, Artificial Sequence
  chemically synthesized
atgaagattaaataaaatag

SEQ ID NO: 178670 - DNA, 20 bp, Artificial Sequence
  chemically synthesized
ccaagtattagatacattta

SEQ ID NO: 178671 - DNA, 20 bp, Artificial Sequence
  chemically synthesized
ctgtaaatgtatctaatact

SEQ ID NO: 178672 - DNA, 20 bp, Artificial Sequence
  chemically synthesized
ccctgttatgtgccaagtat

SEQ ID NO: 178673 - DNA, 20 bp, Artificial Sequence
  chemically synthesized
atcattccctgttatgtgcc

SEQ ID NO: 178674 - DNA, 20 bp, Artificial Sequence
  chemically synthesized
atctaatacttggcacataa

SEQ ID NO: 178675 - DNA, 20 bp, Artificial Sequence
  chemically synthesized
tctaatacttggcacataac

SEQ ID NO: 178676 - DNA, 20 bp, Artificial Sequence
  chemically synthesized
ctaatacttggcacataaca

SEQ ID NO: 178677 - DNA, 20 bp, Artificial Sequence
  chemically synthesized
agcagaaggtgaaaggggaa

SEQ ID NO: 178678 - DNA, 20 bp, Artificial Sequence
  chemically synthesized
caagcagaaggtgaaagggg

SEQ ID NO: 178679 - DNA, 20 bp, Artificial Sequence
  chemically synthesized
tgtcaagcagaaggtgaaag

SEQ ID NO: 178680 - DNA, 20 bp, Artificial Sequence
  chemically synthesized
ttgtcaagcagaaggtgaaa

SEQ ID NO: 178681 - DNA, 20 bp, Artificial Sequence
  chemically synthesized
gttgtcaagcagaaggtgaa

SEQ ID NO: 178682 - DNA, 20 bp, Artificial Sequence
  chemically synthesized
agttgtcaagcagaaggtga

SEQ ID NO: 178683 - DNA, 20 bp, Artificial Sequence
  chemically synthesized
cattttagttgtcaagcaga

SEQ ID NO: 178684 - DNA, 20 bp, Artificial Sequence
  chemically synthesized
tcattttagttgtcaagcag

SEQ ID NO: 178685 - DNA, 20 bp, Artificial Sequence
  chemically synthesized
atttcattttagttgtcaag

SEQ ID NO: 178686 - DNA, 20 bp, Artificial Sequence
  chemically synthesized
tctatttcattttagttgtc

SEQ ID NO: 178687 - DNA, 20 bp, Artificial Sequence
  chemically synthesized
cttttggatctatttcattt

SEQ ID NO: 178688 - DNA, 20 bp, Artificial Sequence
  chemically synthesized
gcttgacaactaaaatgaaa

SEQ ID NO: 178689 - DNA, 20 bp, Artificial Sequence
  chemically synthesized
ctaaaatgaaatagatccaa

SEQ ID NO: 178690 - DNA, 20 bp, Artificial Sequence
  chemically synthesized
aaaatgaaatagatccaaaa

SEQ ID NO: 178691 - DNA, 20 bp, Artificial Sequence
  chemically synthesized
ttttaggaaagcagctcttt

SEQ ID NO: 178692 - DNA, 20 bp, Artificial Sequence
  chemically synthesized
tggttttagttttaggaaag

SEQ ID NO: 178693 - DNA, 20 bp, Artificial Sequence
  chemically synthesized
tcatggttttagttttagga

SEQ ID NO: 178694 - DNA, 20 bp, Artificial Sequence
  chemically synthesized
actttcatggttttagtttt

SEQ ID NO: 178695 - DNA, 20 bp, Artificial Sequence
  chemically synthesized
aactttcatggttttagttt

SEQ ID NO: 178696 - DNA, 20 bp, Artificial Sequence
  chemically synthesized
tggattaactttcatggttt

SEQ ID NO: 178697 - DNA, 20 bp, Artificial Sequence
  chemically synthesized
tcctaaaactaaaaccatga

SEQ ID NO: 178698 - DNA, 20 bp, Artificial Sequence
  chemically synthesized
tgcaattggattaactttca

SEQ ID NO: 178699 - DNA, 20 bp, Artificial Sequence
  chemically synthesized
acatgctctgattgtgcaat

SEQ ID NO: 178700 - DNA, 20 bp, Artificial Sequence
  chemically synthesized
agttaatccaattgcacaat

SEQ ID NO: 178701 - DNA, 20 bp, Artificial Sequence
  chemically synthesized
ttaatccaattgcacaatca

SEQ ID NO: 178702 - DNA, 20 bp, Artificial Sequence
  chemically synthesized
attgcacaatcagagcatgt

SEQ ID NO: 178703 - DNA, 20 bp, Artificial Sequence
  chemically synthesized
cacaatcagagcatgtcagt

SEQ ID NO: 178704 - DNA, 20 bp, Artificial Sequence
  chemically synthesized
tcagagcatgtcagtcagcc

SEQ ID NO: 178705 - DNA, 20 bp, Artificial Sequence
  chemically synthesized
cagagcatgtcagtcagcca

SEQ ID NO: 178706 - DNA, 20 bp, Artificial Sequence
  chemically synthesized
agagcatgtcagtcagccaa

SEQ ID NO: 178707 - DNA, 20 bp, Artificial Sequence
  chemically synthesized
gcatgtcagtcagccaaggg

SEQ ID NO: 178708 - DNA, 20 bp, Artificial Sequence
  chemically synthesized
ttattactgattacttccct

SEQ ID NO: 178709 - DNA, 20 bp, Artificial Sequence
  chemically synthesized
agtcagccaagggaagtaat

SEQ ID NO: 178710 - DNA, 20 bp, Artificial Sequence
  chemically synthesized
caagggaagtaatcagtaat

SEQ ID NO: 178711 - DNA, 20 bp, Artificial Sequence
  chemically synthesized
gggaagtaatcagtaataag

SEQ ID NO: 178712 - DNA, 20 bp, Artificial Sequence
  chemically synthesized
tcagtaataagcagacatca

SEQ ID NO: 178713 - DNA, 20 bp, Artificial Sequence
  chemically synthesized
gtaataagcagacatcacag

SEQ ID NO: 178714 - DNA, 20 bp, Artificial Sequence
  chemically synthesized
taataagcagacatcacagt

SEQ ID NO: 178715 - DNA, 20 bp, Artificial Sequence
  chemically synthesized
aagcagacatcacagtagga

SEQ ID NO: 178716 - DNA, 20 bp, Artificial Sequence
  chemically synthesized
tcacagtaggacggtatgaa

SEQ ID NO: 178717 - DNA, 20 bp, Artificial Sequence
  chemically synthesized
aggacggtatgaaaagccac

SEQ ID NO: 178718 - DNA, 20 bp, Artificial Sequence
  chemically synthesized
gtatgaaaagccactggaat

SEQ ID NO: 178719 - DNA, 20 bp, Artificial Sequence
  chemically synthesized
agacatccagcttattccag

SEQ ID NO: 178720 - DNA, 20 bp, Artificial Sequence
  chemically synthesized
aatagacatccagcttattc

SEQ ID NO: 178721 - DNA, 20 bp, Artificial Sequence
  chemically synthesized
gaaaagccactggaataagc

SEQ ID NO: 178722 - DNA, 20 bp, Artificial Sequence
  chemically synthesized
catttggttgaatagacatc

SEQ ID NO: 178723 - DNA, 20 bp, Artificial Sequence
  chemically synthesized
tcacattccatttggttgaa

SEQ ID NO: 178724 - DNA, 20 bp, Artificial Sequence
  chemically synthesized
tggatgtctattcaaccaaa

SEQ ID NO: 178725 - DNA, 20 bp, Artificial Sequence
  chemically synthesized
gtgttggttcacattccatt

SEQ ID NO: 178726 - DNA, 20 bp, Artificial Sequence
  chemically synthesized
gggggtgtgggacgtggtgt

SEQ ID NO: 178727 - DNA, 20 bp, Artificial Sequence
  chemically synthesized
ttgtctgggggtgtgggacg

SEQ ID NO: 178728 - DNA, 20 bp, Artificial Sequence
  chemically synthesized
aacaccacgtcccacacccc

SEQ ID NO: 178729 - DNA, 20 bp, Artificial Sequence
  chemically synthesized
gctgatttgtctgggggtgt

SEQ ID NO: 178730 - DNA, 20 bp, Artificial Sequence
  chemically synthesized
agctgatttgtctgggggtg

SEQ ID NO: 178731 - DNA, 20 bp, Artificial Sequence
  chemically synthesized
gttttagctgatttgtctgg

SEQ ID NO: 178732 - DNA, 20 bp, Artificial Sequence
  chemically synthesized
tgttttagctgatttgtctg

SEQ ID NO: 178733 - DNA, 20 bp, Artificial Sequence
  chemically synthesized
ttgttttagctgatttgtct

SEQ ID NO: 178734 - DNA, 20 bp, Artificial Sequence
  chemically synthesized
tcccacacccccagacaaat

SEQ ID NO: 178735 - DNA, 20 bp, Artificial Sequence
  chemically synthesized
tttgttttagctgatttgtc

SEQ ID NO: 178736 - DNA, 20 bp, Artificial Sequence
  chemically synthesized
cccgaagcaatgttttgttt

SEQ ID NO: 178737 - DNA, 20 bp, Artificial Sequence
  chemically synthesized
gctaaaacaaaacattgctt

SEQ ID NO: 178738 - DNA, 20 bp, Artificial Sequence
  chemically synthesized
ctaaaacaaaacattgcttc

SEQ ID NO: 178739 - DNA, 20 bp, Artificial Sequence
  chemically synthesized
taaaacaaaacattgcttcg

SEQ ID NO: 178740 - DNA, 20 bp, Artificial Sequence
  chemically synthesized
aaaacaaaacattgcttcgg

SEQ ID NO: 178741 - DNA, 20 bp, Artificial Sequence
  chemically synthesized
aaaggcattatattcccccg

SEQ ID NO: 178742 - DNA, 20 bp, Artificial Sequence
  chemically synthesized
cgggggaatataatgccttt

SEQ ID NO: 178743 - DNA, 20 bp, Artificial Sequence
  chemically synthesized
gggaatataatgcctttaag

SEQ ID NO: 178744 - DNA, 20 bp, Artificial Sequence
  chemically synthesized
gaatataatgcctttaagta

SEQ ID NO: 178745 - DNA, 20 bp, Artificial Sequence
  chemically synthesized
ccacttcagcctctacttaa

SEQ ID NO: 178746 - DNA, 20 bp, Artificial Sequence
  chemically synthesized
aatataatgcctttaagtag

SEQ ID NO: 178747 - DNA, 20 bp, Artificial Sequence
  chemically synthesized
accacttcagcctctactta

SEQ ID NO: 178748 - DNA, 20 bp, Artificial Sequence
  chemically synthesized
atgcctttaagtagaggctg

SEQ ID NO: 178749 - DNA, 20 bp, Artificial Sequence
  chemically synthesized
cctttaagtagaggctgaag

SEQ ID NO: 178750 - DNA, 20 bp, Artificial Sequence
  chemically synthesized
taagtagaggctgaagtggt

SEQ ID NO: 178751 - DNA, 20 bp, Artificial Sequence
  chemically synthesized
ccagatcagtctcaccactt

SEQ ID NO: 178752 - DNA, 20 bp, Artificial Sequence
  chemically synthesized
ctgaagtggtgagactgatc

SEQ ID NO: 178753 - DNA, 20 bp, Artificial Sequence
  chemically synthesized
gaagatctggattgccagat

SEQ ID NO: 178754 - DNA, 20 bp, Artificial Sequence
  chemically synthesized
gtgagactgatctggcaatc

SEQ ID NO: 178755 - DNA, 20 bp, Artificial Sequence
  chemically synthesized
ttagggaagatctggattgc

SEQ ID NO: 178756 - DNA, 20 bp, Artificial Sequence
  chemically synthesized
ccattttcttagggaagatc

SEQ ID NO: 178757 - DNA, 20 bp, Artificial Sequence
  chemically synthesized
tggcaatccagatcttccct

SEQ ID NO: 178758 - DNA, 20 bp, Artificial Sequence
  chemically synthesized
aagaatccattttcttaggg

SEQ ID NO: 178759 - DNA, 20 bp, Artificial Sequence
  chemically synthesized
aagaagaatccattttctta

SEQ ID NO: 178760 - DNA, 20 bp, Artificial Sequence
  chemically synthesized
ccagatcttccctaagaaaa

SEQ ID NO: 178761 - DNA, 20 bp, Artificial Sequence
  chemically synthesized
aaagaagaatccattttctt

SEQ ID NO: 178762 - DNA, 20 bp, Artificial Sequence
  chemically synthesized
aaaagaagaatccattttct

SEQ ID NO: 178763 - DNA, 20 bp, Artificial Sequence
  chemically synthesized
aaaatggattcttcttttta

SEQ ID NO: 178764 - DNA, 20 bp, Artificial Sequence
  chemically synthesized
tgagaagagtctttaaaaag

SEQ ID NO: 178765 - DNA, 20 bp, Artificial Sequence
  chemically synthesized
atttgagaagagtctttaaa

SEQ ID NO: 178766 - DNA, 20 bp, Artificial Sequence
  chemically synthesized
cctacctggagatttgagaa

SEQ ID NO: 178767 - DNA, 20 bp, Artificial Sequence
  chemically synthesized
tacctacctggagatttgag

SEQ ID NO: 178768 - DNA, 20 bp, Artificial Sequence
  chemically synthesized
aaagactcttctcaaatctc

SEQ ID NO: 178769 - DNA, 20 bp, Artificial Sequence
  chemically synthesized
ggttacctacctggagattt

SEQ ID NO: 178770 - DNA, 20 bp, Artificial Sequence
  chemically synthesized
aagactcttctcaaatctcc

SEQ ID NO: 178771 - DNA, 20 bp, Artificial Sequence
  chemically synthesized
actcttctcaaatctccagg

SEQ ID NO: 178772 - DNA, 20 bp, Artificial Sequence
  chemically synthesized
ctcttctcaaatctccaggt

SEQ ID NO: 178773 - DNA, 20 bp, Artificial Sequence
  chemically synthesized
ctgtcctggttacctacctg

SEQ ID NO: 178774 - DNA, 20 bp, Artificial Sequence
  chemically synthesized
atctgtcctggttacctacc

SEQ ID NO: 178775 - DNA, 20 bp, Artificial Sequence
  chemically synthesized
caaatctccaggtaggtaac

SEQ ID NO: 178776 - DNA, 20 bp, Artificial Sequence
  chemically synthesized
aaatctccaggtaggtaacc

SEQ ID NO: 178777 - DNA, 20 bp, Artificial Sequence
  chemically synthesized
ctccaggtaggtaaccagga

SEQ ID NO: 178778 - DNA, 20 bp, Artificial Sequence
  chemically synthesized
atcacttttttaatctgtcc

SEQ ID NO: 178779 - DNA, 20 bp, Artificial Sequence
  chemically synthesized
gtaaccaggacagattaaaa

SEQ ID NO: 178780 - DNA, 20 bp, Artificial Sequence
  chemically synthesized
ttaaaaaagtgattcccatt

SEQ ID NO: 178781 - DNA, 20 bp, Artificial Sequence
  chemically synthesized
cataaaatctaaatctaaat

SEQ ID NO: 178782 - DNA, 20 bp, Artificial Sequence
  chemically synthesized
tcataaaatctaaatctaaa

SEQ ID NO: 178783 - DNA, 20 bp, Artificial Sequence
  chemically synthesized
aagtgattcccatttagatt

SEQ ID NO: 178784 - DNA, 20 bp, Artificial Sequence
  chemically synthesized
gattttatgattccacaatc

SEQ ID NO: 178785 - DNA, 20 bp, Artificial Sequence
  chemically synthesized
aaaaactgaagaccagattg

SEQ ID NO: 178786 - DNA, 20 bp, Artificial Sequence
  chemically synthesized
tgattccacaatctggtctt

SEQ ID NO: 178787 - DNA, 20 bp, Artificial Sequence
  chemically synthesized
taattttaaaaactgaagac

SEQ ID NO: 178788 - DNA, 20 bp, Artificial Sequence
  chemically synthesized
tcatataattttaaaaactg

SEQ ID NO: 178789 - DNA, 20 bp, Artificial Sequence
  chemically synthesized
tcagtttttaaaattatatg

SEQ ID NO: 178790 - DNA, 20 bp, Artificial Sequence
  chemically synthesized
taaaattatatgaagttgtg

SEQ ID NO: 178791 - DNA, 20 bp, Artificial Sequence
  chemically synthesized
tatgaagttgtgaagttctc

SEQ ID NO: 178792 - DNA, 20 bp, Artificial Sequence
  chemically synthesized
attaattttagattttactt

SEQ ID NO: 178793 - DNA, 20 bp, Artificial Sequence
  chemically synthesized
ctttgatttgaaattaattt

SEQ ID NO: 178794 - DNA, 20 bp, Artificial Sequence
  chemically synthesized
ctaaaattaatttcaaatca

SEQ ID NO: 178795 - DNA, 20 bp, Artificial Sequence
  chemically synthesized
gtctaaatgtatataattca

SEQ ID NO: 178796 - DNA, 20 bp, Artificial Sequence
  chemically synthesized
aactgtgaattatatacatt

SEQ ID NO: 178797 - DNA, 20 bp, Artificial Sequence
  chemically synthesized
catctacacatatagatgta

SEQ ID NO: 178798 - DNA, 20 bp, Artificial Sequence
  chemically synthesized
aatctatacatctatatgtg

SEQ ID NO: 178799 - DNA, 20 bp, Artificial Sequence
  chemically synthesized
catctatacatctacacata

SEQ ID NO: 178800 - DNA, 20 bp, Artificial Sequence
  chemically synthesized
catctatatgtgtagatgta

SEQ ID NO: 178801 - DNA, 20 bp, Artificial Sequence
  chemically synthesized
agttctgaaccagtgcacat

SEQ ID NO: 178802 - DNA, 20 bp, Artificial Sequence
  chemically synthesized
acatatgttcttatgtgcac

SEQ ID NO: 178803 - DNA, 20 bp, Artificial Sequence
  chemically synthesized
tgttcttatgtgcactggtt

SEQ ID NO: 178804 - DNA, 20 bp, Artificial Sequence
  chemically synthesized
ttaaccctgcagttctgaac

SEQ ID NO: 178805 - DNA, 20 bp, Artificial Sequence
  chemically synthesized
tgtgcactggttcagaactg

SEQ ID NO: 178806 - DNA, 20 bp, Artificial Sequence
  chemically synthesized
gtgcactggttcagaactgc

SEQ ID NO: 178807 - DNA, 20 bp, Artificial Sequence
  chemically synthesized
tgcactggttcagaactgca

SEQ ID NO: 178808 - DNA, 20 bp, Artificial Sequence
  chemically synthesized
tggttcagaactgcagggtt

SEQ ID NO: 178809 - DNA, 20 bp, Artificial Sequence
  chemically synthesized
tttatttcttcttaaccctg

SEQ ID NO: 178810 - DNA, 20 bp, Artificial Sequence
  chemically synthesized
ttcagaactgcagggttaag

SEQ ID NO: 178811 - DNA, 20 bp, Artificial Sequence
  chemically synthesized
tgcagggttaagaagaaata

SEQ ID NO: 178812 - DNA, 20 bp, Artificial Sequence
  chemically synthesized
ttaagaagaaataaagttgt

SEQ ID NO: 178813 - DNA, 20 bp, Artificial Sequence
  chemically synthesized
aagttgtgagaaaaacactt

SEQ ID NO: 178814 - DNA, 20 bp, Artificial Sequence
  chemically synthesized
tgtgagaaaaacactttagc

SEQ ID NO: 178815 - DNA, 20 bp, Artificial Sequence
  chemically synthesized
gtgagaaaaacactttagca

SEQ ID NO: 178816 - DNA, 20 bp, Artificial Sequence
  chemically synthesized
ttattcatagttccttgcta

SEQ ID NO: 178817 - DNA, 20 bp, Artificial Sequence
  chemically synthesized
tctgcccattaggttattca

SEQ ID NO: 178818 - DNA, 20 bp, Artificial Sequence
  chemically synthesized
aggaactatgaataacctaa

SEQ ID NO: 178819 - DNA, 20 bp, Artificial Sequence
  chemically synthesized
ggaactatgaataacctaat

SEQ ID NO: 178820 - DNA, 20 bp, Artificial Sequence
  chemically synthesized
actatgaataacctaatggg

SEQ ID NO: 178821 - DNA, 20 bp, Artificial Sequence
  chemically synthesized
tcattggttttctgcccatt

SEQ ID NO: 178822 - DNA, 20 bp, Artificial Sequence
  chemically synthesized
atcattggttttctgcccat

SEQ ID NO: 178823 - DNA, 20 bp, Artificial Sequence
  chemically synthesized
ctattttttaattcaatcat

SEQ ID NO: 178824 - DNA, 20 bp, Artificial Sequence
  chemically synthesized
ccaatgattgaattaaaaaa

SEQ ID NO: 178825 - DNA, 20 bp, Artificial Sequence
  chemically synthesized
cagggcctgcttgcataaag

SEQ ID NO: 178826 - DNA, 20 bp, Artificial Sequence
  chemically synthesized
attcatatacttctttatgc

SEQ ID NO: 178827 - DNA, 20 bp, Artificial Sequence
  chemically synthesized
ccccagggcctgcttgcata

SEQ ID NO: 178828 - DNA, 20 bp, Artificial Sequence
  chemically synthesized
catatacttctttatgcaag

SEQ ID NO: 178829 - DNA, 20 bp, Artificial Sequence
  chemically synthesized
atatacttctttatgcaagc

SEQ ID NO: 178830 - DNA, 20 bp, Artificial Sequence
  chemically synthesized
ttctttatgcaagcaggccc

SEQ ID NO: 178831 - DNA, 20 bp, Artificial Sequence
  chemically synthesized
tctttatgcaagcaggccct

SEQ ID NO: 178832 - DNA, 20 bp, Artificial Sequence
  chemically synthesized
ctttatgcaagcaggccctg

SEQ ID NO: 178833 - DNA, 20 bp, Artificial Sequence
  chemically synthesized
tttatgcaagcaggccctgg

SEQ ID NO: 178834 - DNA, 20 bp, Artificial Sequence
  chemically synthesized
ttattttctcaaatccccca

SEQ ID NO: 178835 - DNA, 20 bp, Artificial Sequence
  chemically synthesized
tttattttctcaaatccccc

SEQ ID NO: 178836 - DNA, 20 bp, Artificial Sequence
  chemically synthesized
ttttattttctcaaatcccc

SEQ ID NO: 178837 - DNA, 20 bp, Artificial Sequence
  chemically synthesized
aagcaggccctgggggattt

SEQ ID NO: 178838 - DNA, 20 bp, Artificial Sequence
  chemically synthesized
agaaaagcttgagcaagtca

SEQ ID NO: 178839 - DNA, 20 bp, Artificial Sequence
  chemically synthesized
aagaaaagcttgagcaagtc

SEQ ID NO: 178840 - DNA, 20 bp, Artificial Sequence
  chemically synthesized
aaaattaccttgacttgctc

SEQ ID NO: 178841 - DNA, 20 bp, Artificial Sequence
  chemically synthesized
actaaaagaaaagcttgagc

SEQ ID NO: 178842 - DNA, 20 bp, Artificial Sequence
  chemically synthesized
agcaactaaaagaaaagctt

SEQ ID NO: 178843 - DNA, 20 bp, Artificial Sequence
  chemically synthesized
acttgctcaagcttttcttt

SEQ ID NO: 178844 - DNA, 20 bp, Artificial Sequence
  chemically synthesized
aagagcagcaactaaaagaa

SEQ ID NO: 178845 - DNA, 20 bp, Artificial Sequence
  chemically synthesized
tggaaaagagcagcaactaa

SEQ ID NO: 178846 - DNA, 20 bp, Artificial Sequence
  chemically synthesized
cacttgaacctggaaaagag

SEQ ID NO: 178847 - DNA, 20 bp, Artificial Sequence
  chemically synthesized
ttttagttgctgctcttttc

SEQ ID NO: 178848 - DNA, 20 bp, Artificial Sequence
  chemically synthesized
tttagttgctgctcttttcc

SEQ ID NO: 178849 - DNA, 20 bp, Artificial Sequence
  chemically synthesized
tcccacttgaacctggaaaa

SEQ ID NO: 178850 - DNA, 20 bp, Artificial Sequence
  chemically synthesized
tatcccacttgaacctggaa

SEQ ID NO: 178851 - DNA, 20 bp, Artificial Sequence
  chemically synthesized
tgctgctcttttccaggttc

SEQ ID NO: 178852 - DNA, 20 bp, Artificial Sequence
  chemically synthesized
gctagtatcccacttgaacc

SEQ ID NO: 178853 - DNA, 20 bp, Artificial Sequence
  chemically synthesized
tgctcttttccaggttcaag

SEQ ID NO: 178854 - DNA, 20 bp, Artificial Sequence
  chemically synthesized
gctcttttccaggttcaagt

SEQ ID NO: 178855 - DNA, 20 bp, Artificial Sequence
  chemically synthesized
tccaggttcaagtgggatac

SEQ ID NO: 178856 - DNA, 20 bp, Artificial Sequence
  chemically synthesized
gaggaagcagataacattgc

SEQ ID NO: 178857 - DNA, 20 bp, Artificial Sequence
  chemically synthesized
tgttttatggttggaggaag

SEQ ID NO: 178858 - DNA, 20 bp, Artificial Sequence
  chemically synthesized
atttgttttatggttggagg

SEQ ID NO: 178859 - DNA, 20 bp, Artificial Sequence
  chemically synthesized
tgaatttgttttatggttgg

SEQ ID NO: 178860 - DNA, 20 bp, Artificial Sequence
  chemically synthesized
atgaatttgttttatggttg

SEQ ID NO: 178861 - DNA, 20 bp, Artificial Sequence
  chemically synthesized
aaatgaatttgttttatggt

SEQ ID NO: 178862 - DNA, 20 bp, Artificial Sequence
  chemically synthesized
atttaaatgaatttgtttta

SEQ ID NO: 178863 - DNA, 20 bp, Artificial Sequence
  chemically synthesized
tatcttgtcagaatttcaaa

SEQ ID NO: 178864 - DNA, 20 bp, Artificial Sequence
  chemically synthesized
aatatcttgtcagaatttca

SEQ ID NO: 178865 - DNA, 20 bp, Artificial Sequence
  chemically synthesized
aatctctttgaaattctgac

SEQ ID NO: 178866 - DNA, 20 bp, Artificial Sequence
  chemically synthesized
agaacaaaagaatatcttgt

SEQ ID NO: 178867 - DNA, 20 bp, Artificial Sequence
  chemically synthesized
tctccaggctagaagaacaa

SEQ ID NO: 178868 - DNA, 20 bp, Artificial Sequence
  chemically synthesized
aagatattcttttgttcttc

SEQ ID NO: 178869 - DNA, 20 bp, Artificial Sequence
  chemically synthesized
attcttttgttcttctagcc

SEQ ID NO: 178870 - DNA, 20 bp, Artificial Sequence
  chemically synthesized
ttcttctttctccaggctag

SEQ ID NO: 178871 - DNA, 20 bp, Artificial Sequence
  chemically synthesized
tcttttgttcttctagcctg

SEQ ID NO: 178872 - DNA, 20 bp, Artificial Sequence
  chemically synthesized
ttattcttctttctccaggc

SEQ ID NO: 178873 - DNA, 20 bp, Artificial Sequence
  chemically synthesized
ttgttcttctagcctggaga

SEQ ID NO: 178874 - DNA, 20 bp, Artificial Sequence
  chemically synthesized
aattttattcttctttctcc

SEQ ID NO: 178875 - DNA, 20 bp, Artificial Sequence
  chemically synthesized
ttcttctagcctggagaaag

SEQ ID NO: 178876 - DNA, 20 bp, Artificial Sequence
  chemically synthesized
caattttattcttctttctc

SEQ ID NO: 178877 - DNA, 20 bp, Artificial Sequence
  chemically synthesized
tgttatttttttttccaaca

SEQ ID NO: 178878 - DNA, 20 bp, Artificial Sequence
  chemically synthesized
aaatagtttgagaactatgt

SEQ ID NO: 178879 - DNA, 20 bp, Artificial Sequence
  chemically synthesized
tttgcattaacaaatagttt

SEQ ID NO: 178880 - DNA, 20 bp, Artificial Sequence
  chemically synthesized
tcccagtttgcattaacaaa

SEQ ID NO: 178881 - DNA, 20 bp, Artificial Sequence
  chemically synthesized
aactatttgttaatgcaaac

SEQ ID NO: 178882 - DNA, 20 bp, Artificial Sequence
  chemically synthesized
actatttgttaatgcaaact

SEQ ID NO: 178883 - DNA, 20 bp, Artificial Sequence
  chemically synthesized
aaattgccatgtttgtgtcc

SEQ ID NO: 178884 - DNA, 20 bp, Artificial Sequence
  chemically synthesized
tgcaaactgggacacaaaca

SEQ ID NO: 178885 - DNA, 20 bp, Artificial Sequence
  chemically synthesized
aaacatggcaatttaaaaat

SEQ ID NO: 178886 - DNA, 20 bp, Artificial Sequence
  chemically synthesized
tttaaaaataagcaatttaa

SEQ ID NO: 178887 - DNA, 20 bp, Artificial Sequence
  chemically synthesized
gaattttcttaaattatgta

SEQ ID NO: 178888 - DNA, 20 bp, Artificial Sequence
  chemically synthesized
atgttaaccatacataattt

SEQ ID NO: 178889 - DNA, 20 bp, Artificial Sequence
  chemically synthesized
aaattcattcactttgaaca

SEQ ID NO: 178890 - DNA, 20 bp, Artificial Sequence
  chemically synthesized
tattgaaattactttgttca

SEQ ID NO: 178891 - DNA, 20 bp, Artificial Sequence
  chemically synthesized
caaagtaatttcaatatttc

SEQ ID NO: 178892 - DNA, 20 bp, Artificial Sequence
  chemically synthesized
ttttaatctcttatcattta

SEQ ID NO: 178893 - DNA, 20 bp, Artificial Sequence
  chemically synthesized
ttcaagaatctctaaatgat

SEQ ID NO: 178894 - DNA, 20 bp, Artificial Sequence
  chemically synthesized
gattttaatctcttatcatt

SEQ ID NO: 178895 - DNA, 20 bp, Artificial Sequence
  chemically synthesized
caagaatctctaaatgataa

SEQ ID NO: 178896 - DNA, 20 bp, Artificial Sequence
  chemically synthesized
ataagagattaaaatcgaac

SEQ ID NO: 178897 - DNA, 20 bp, Artificial Sequence
  chemically synthesized
ctggccaggaatttttgaat

SEQ ID NO: 178898 - DNA, 20 bp, Artificial Sequence
  chemically synthesized
aattctgattcaaaaattcc

SEQ ID NO: 178899 - DNA, 20 bp, Artificial Sequence
  chemically synthesized
ctgattcaaaaattcctggc

SEQ ID NO: 178900 - DNA, 20 bp, Artificial Sequence
  chemically synthesized
tgattcaaaaattcctggcc

SEQ ID NO: 178901 - DNA, 20 bp, Artificial Sequence
  chemically synthesized
atgagccactgcgcctggcc

SEQ ID NO: 178902 - DNA, 20 bp, Artificial Sequence
  chemically synthesized
catgagccactgcgcctggc

SEQ ID NO: 178903 - DNA, 20 bp, Artificial Sequence
  chemically synthesized
caaaaattcctggccaggcg

SEQ ID NO: 178904 - DNA, 20 bp, Artificial Sequence
  chemically synthesized
aaattcctggccaggcgcag

SEQ ID NO: 178905 - DNA, 20 bp, Artificial Sequence
  chemically synthesized
caggcatgagccactgcgcc

SEQ ID NO: 178906 - DNA, 20 bp, Artificial Sequence
  chemically synthesized
agcgctagggttacaggcat

SEQ ID NO: 178907 - DNA, 20 bp, Artificial Sequence
  chemically synthesized
gtggctcatgcctgtaaccc

SEQ ID NO: 178908 - DNA, 20 bp, Artificial Sequence
  chemically synthesized
tccctaagcgctagggttac

SEQ ID NO: 178909 - DNA, 20 bp, Artificial Sequence
  chemically synthesized
ctccctaagcgctagggtta

SEQ ID NO: 178910 - DNA, 20 bp, Artificial Sequence
  chemically synthesized
atgcctgtaaccctagcgct

SEQ ID NO: 178911 - DNA, 20 bp, Artificial Sequence
  chemically synthesized
atcggcctccctaagcgcta

SEQ ID NO: 178912 - DNA, 20 bp, Artificial Sequence
  chemically synthesized
tgcctgtaaccctagcgctt

SEQ ID NO: 178913 - DNA, 20 bp, Artificial Sequence
  chemically synthesized
catcggcctccctaagcgct

SEQ ID NO: 178914 - DNA, 20 bp, Artificial Sequence
  chemically synthesized
gcctgtaaccctagcgctta

SEQ ID NO: 178915 - DNA, 20 bp, Artificial Sequence
  chemically synthesized
acatcggcctccctaagcgc

SEQ ID NO: 178916 - DNA, 20 bp, Artificial Sequence
  chemically synthesized
ctgtaaccctagcgcttagg

SEQ ID NO: 178917 - DNA, 20 bp, Artificial Sequence
  chemically synthesized
tgtaaccctagcgcttaggg

SEQ ID NO: 178918 - DNA, 20 bp, Artificial Sequence
  chemically synthesized
ccgcccacatcggcctccct

SEQ ID NO: 178919 - DNA, 20 bp, Artificial Sequence
  chemically synthesized
agcgcttagggaggccgatg

SEQ ID NO: 178920 - DNA, 20 bp, Artificial Sequence
  chemically synthesized
gcgcttagggaggccgatgt

SEQ ID NO: 178921 - DNA, 20 bp, Artificial Sequence
  chemically synthesized
cttagggaggccgatgtggg

SEQ ID NO: 178922 - DNA, 20 bp, Artificial Sequence
  chemically synthesized
ctcaagtgatccgcccacat

SEQ ID NO: 178923 - DNA, 20 bp, Artificial Sequence
  chemically synthesized
ccgatgtgggcggatcactt

SEQ ID NO: 178924 - DNA, 20 bp, Artificial Sequence
  chemically synthesized
cgatgtgggcggatcacttg

SEQ ID NO: 178925 - DNA, 20 bp, Artificial Sequence
  chemically synthesized
gtgggcggatcacttgaggt

SEQ ID NO: 178926 - DNA, 20 bp, Artificial Sequence
  chemically synthesized
tgggcggatcacttgaggtc

SEQ ID NO: 178927 - DNA, 20 bp, Artificial Sequence
  chemically synthesized
ggtcgcaaactcctgacctc

SEQ ID NO: 178928 - DNA, 20 bp, Artificial Sequence
  chemically synthesized
ggcggatcacttgaggtcag

SEQ ID NO: 178929 - DNA, 20 bp, Artificial Sequence
  chemically synthesized
tgaggtcaggagtttgcgac

SEQ ID NO: 178930 - DNA, 20 bp, Artificial Sequence
  chemically synthesized
tcaggagtttgcgaccagcc

SEQ ID NO: 178931 - DNA, 20 bp, Artificial Sequence
  chemically synthesized
tttcaccatatttgccaggc

SEQ ID NO: 178932 - DNA, 20 bp, Artificial Sequence
  chemically synthesized
ggggtttcaccatatttgcc

SEQ ID NO: 178933 - DNA, 20 bp, Artificial Sequence
  chemically synthesized
tgcgaccagcctggcaaata

SEQ ID NO: 178934 - DNA, 20 bp, Artificial Sequence
  chemically synthesized
cggggtttcaccatatttgc

SEQ ID NO: 178935 - DNA, 20 bp, Artificial Sequence
  chemically synthesized
ttgtatttttagtgtagacg

SEQ ID NO: 178936 - DNA, 20 bp, Artificial Sequence
  chemically synthesized
tttgtatttttagtgtagac

SEQ ID NO: 178937 - DNA, 20 bp, Artificial Sequence
  chemically synthesized
ttttgtatttttagtgtaga

SEQ ID NO: 178938 - DNA, 20 bp, Artificial Sequence
  chemically synthesized
aaatttttgtatttttagtg

SEQ ID NO: 178939 - DNA, 20 bp, Artificial Sequence
  chemically synthesized
ctggcaaatttttgtatttt

SEQ ID NO: 178940 - DNA, 20 bp, Artificial Sequence
  chemically synthesized
ctaaaaatacaaaaatttgc

SEQ ID NO: 178941 - DNA, 20 bp, Artificial Sequence
  chemically synthesized
taaaaatacaaaaatttgcc

SEQ ID NO: 178942 - DNA, 20 bp, Artificial Sequence
  chemically synthesized
atacaaaaatttgccaggtt

SEQ ID NO: 178943 - DNA, 20 bp, Artificial Sequence
  chemically synthesized
caaaaatttgccaggtttgg

SEQ ID NO: 178944 - DNA, 20 bp, Artificial Sequence
  chemically synthesized
caggcgcctgccaccaaacc

SEQ ID NO: 178945 - DNA, 20 bp, Artificial Sequence
  chemically synthesized
aaatttgccaggtttggtgg

SEQ ID NO: 178946 - DNA, 20 bp, Artificial Sequence
  chemically synthesized
aatttgccaggtttggtggc

SEQ ID NO: 178947 - DNA, 20 bp, Artificial Sequence
  chemically synthesized
gtggcaggcgcctgtaatcc

SEQ ID NO: 178948 - DNA, 20 bp, Artificial Sequence
  chemically synthesized
tccctagtagctgggattac

SEQ ID NO: 178949 - DNA, 20 bp, Artificial Sequence
  chemically synthesized
ctccctagtagctgggatta

SEQ ID NO: 178950 - DNA, 20 bp, Artificial Sequence
  chemically synthesized
gcgcctgtaatcccagctac

SEQ ID NO: 178951 - DNA, 20 bp, Artificial Sequence
  chemically synthesized
cgcctgtaatcccagctact

SEQ ID NO: 178952 - DNA, 20 bp, Artificial Sequence
  chemically synthesized
cctcagcctccctagtagct

SEQ ID NO: 178953 - DNA, 20 bp, Artificial Sequence
  chemically synthesized
gcctgtaatcccagctacta

SEQ ID NO: 178954 - DNA, 20 bp, Artificial Sequence
  chemically synthesized
gcctcagcctccctagtagc

SEQ ID NO: 178955 - DNA, 20 bp, Artificial Sequence
  chemically synthesized
ctgtaatcccagctactagg

SEQ ID NO: 178956 - DNA, 20 bp, Artificial Sequence
  chemically synthesized
tgtaatcccagctactaggg

SEQ ID NO: 178957 - DNA, 20 bp, Artificial Sequence
  chemically synthesized
tcctgcctcagcctccctag

SEQ ID NO: 178958 - DNA, 20 bp, Artificial Sequence
  chemically synthesized
ttctcctgcctcagcctccc

SEQ ID NO: 178959 - DNA, 20 bp, Artificial Sequence
  chemically synthesized
tcccagctactagggaggct

SEQ ID NO: 178960 - DNA, 20 bp, Artificial Sequence
  chemically synthesized
cccagctactagggaggctg

SEQ ID NO: 178961 - DNA, 20 bp, Artificial Sequence
  chemically synthesized
agctactagggaggctgagg

SEQ ID NO: 178962 - DNA, 20 bp, Artificial Sequence
  chemically synthesized
gctactagggaggctgaggc

SEQ ID NO: 178963 - DNA, 20 bp, Artificial Sequence
  chemically synthesized
tactagggaggctgaggcag

SEQ ID NO: 178964 - DNA, 20 bp, Artificial Sequence
  chemically synthesized
ttcaagtgattctcctgcct

SEQ ID NO: 178965 - DNA, 20 bp, Artificial Sequence
  chemically synthesized
gcaggagaatcacttgaacg

SEQ ID NO: 178966 - DNA, 20 bp, Artificial Sequence
  chemically synthesized
agcctctgccttccacgttc

SEQ ID NO: 178967 - DNA, 20 bp, Artificial Sequence
  chemically synthesized
ggagaatcacttgaacgtgg

SEQ ID NO: 178968 - DNA, 20 bp, Artificial Sequence
  chemically synthesized
gagaatcacttgaacgtgga

SEQ ID NO: 178969 - DNA, 20 bp, Artificial Sequence
  chemically synthesized
aatcacttgaacgtggaagg

SEQ ID NO: 178970 - DNA, 20 bp, Artificial Sequence
  chemically synthesized
tcacttgaacgtggaaggca

SEQ ID NO: 178971 - DNA, 20 bp, Artificial Sequence
  chemically synthesized
cacttgaacgtggaaggcag

SEQ ID NO: 178972 - DNA, 20 bp, Artificial Sequence
  chemically synthesized
aacgtggaaggcagaggctg

SEQ ID NO: 178973 - DNA, 20 bp, Artificial Sequence
  chemically synthesized
tggaaggcagaggctgcagt

SEQ ID NO: 178974 - DNA, 20 bp, Artificial Sequence
  chemically synthesized
ggcacgatctcggcttactg

SEQ ID NO: 178975 - DNA, 20 bp, Artificial Sequence
  chemically synthesized
ggcagaggctgcagtaagcc

SEQ ID NO: 178976 - DNA, 20 bp, Artificial Sequence
  chemically synthesized
ggagtgcagtggcacgatct

SEQ ID NO: 178977 - DNA, 20 bp, Artificial Sequence
  chemically synthesized
ttgcccggggtggagtgcag

SEQ ID NO: 178978 - DNA, 20 bp, Artificial Sequence
  chemically synthesized
ctgttgcccggggtggagtg

SEQ ID NO: 178979 - DNA, 20 bp, Artificial Sequence
  chemically synthesized
cgtgccactgcactccaccc

SEQ ID NO: 178980 - DNA, 20 bp, Artificial Sequence
  chemically synthesized
gtgccactgcactccacccc

SEQ ID NO: 178981 - DNA, 20 bp, Artificial Sequence
  chemically synthesized
tttctctgttgcccggggtg

SEQ ID NO: 178982 - DNA, 20 bp, Artificial Sequence
  chemically synthesized
tctttctctgttgcccgggg

SEQ ID NO: 178983 - DNA, 20 bp, Artificial Sequence
  chemically synthesized
ctgcactccaccccgggcaa

SEQ ID NO: 178984 - DNA, 20 bp, Artificial Sequence
  chemically synthesized
gagtctttctctgttgcccg

SEQ ID NO: 178985 - DNA, 20 bp, Artificial Sequence
  chemically synthesized
ggagtctttctctgttgccc

SEQ ID NO: 178986 - DNA, 20 bp, Artificial Sequence
  chemically synthesized
gcactccaccccgggcaaca

SEQ ID NO: 178987 - DNA, 20 bp, Artificial Sequence
  chemically synthesized
tggagtctttctctgttgcc

SEQ ID NO: 178988 - DNA, 20 bp, Artificial Sequence
  chemically synthesized
tccaccccgggcaacagaga

SEQ ID NO: 178989 - DNA, 20 bp, Artificial Sequence
  chemically synthesized
gtatgtatgtatttgagatg

SEQ ID NO: 178990 - DNA, 20 bp, Artificial Sequence
  chemically synthesized
atgtatgtatgtatttgaga

SEQ ID NO: 178991 - DNA, 20 bp, Artificial Sequence
  chemically synthesized
acgtatgtatgtatgtattt

SEQ ID NO: 178992 - DNA, 20 bp, Artificial Sequence
  chemically synthesized
atataatgacataatgttgt

SEQ ID NO: 178993 - DNA, 20 bp, Artificial Sequence
  chemically synthesized
aacattatgtcattatatct

SEQ ID NO: 178994 - DNA, 20 bp, Artificial Sequence
  chemically synthesized
ttatgtcattatatctgagc

SEQ ID NO: 178995 - DNA, 20 bp, Artificial Sequence
  chemically synthesized
tatgtcattatatctgagca

SEQ ID NO: 178996 - DNA, 20 bp, Artificial Sequence
  chemically synthesized
taaagttgagaaaccttgct

SEQ ID NO: 178997 - DNA, 20 bp, Artificial Sequence
  chemically synthesized
tgagcaaggtttctcaactt

SEQ ID NO: 178998 - DNA, 20 bp, Artificial Sequence
  chemically synthesized
atgttagtaatgctaaagtt

SEQ ID NO: 178999 - DNA, 20 bp, Artificial Sequence
  chemically synthesized
cctaaatgttagtaatgcta

SEQ ID NO: 179000 - DNA, 20 bp, Artificial Sequence
  chemically synthesized
actttagcattactaacatt

SEQ ID NO: 179001 - DNA, 20 bp, Artificial Sequence
  chemically synthesized
ctttagcattactaacattt

SEQ ID NO: 179002 - DNA, 20 bp, Artificial Sequence
  chemically synthesized
aattttccaaacctaaatgt

SEQ ID NO: 179003 - DNA, 20 bp, Artificial Sequence
  chemically synthesized
gcattactaacatttaggtt

SEQ ID NO: 179004 - DNA, 20 bp, Artificial Sequence
  chemically synthesized
tttggaaaattctttgctgt

SEQ ID NO: 179005 - DNA, 20 bp, Artificial Sequence
  chemically synthesized
gaggatagctgctcacagca

SEQ ID NO: 179006 - DNA, 20 bp, Artificial Sequence
  chemically synthesized
ggaaaattctttgctgtgag

SEQ ID NO: 179007 - DNA, 20 bp, Artificial Sequence
  chemically synthesized
atgcagaggatagctgctca

SEQ ID NO: 179008 - DNA, 20 bp, Artificial Sequence
  chemically synthesized
ataccctacaatgcagagga

SEQ ID NO: 179009 - DNA, 20 bp, Artificial Sequence
  chemically synthesized
ctaaataccctacaatgcag

SEQ ID NO: 179010 - DNA, 20 bp, Artificial Sequence
  chemically synthesized
agcagctatcctctgcattg

SEQ ID NO: 179011 - DNA, 20 bp, Artificial Sequence
  chemically synthesized
gctaaataccctacaatgca

SEQ ID NO: 179012 - DNA, 20 bp, Artificial Sequence
  chemically synthesized
gcagctatcctctgcattgt

SEQ ID NO: 179013 - DNA, 20 bp, Artificial Sequence
  chemically synthesized
cagctatcctctgcattgta

SEQ ID NO: 179014 - DNA, 20 bp, Artificial Sequence
  chemically synthesized
ctgctaaataccctacaatg

SEQ ID NO: 179015 - DNA, 20 bp, Artificial Sequence
  chemically synthesized
cctctgcattgtagggtatt

SEQ ID NO: 179016 - DNA, 20 bp, Artificial Sequence
  chemically synthesized
ctgcattgtagggtatttag

SEQ ID NO: 179017 - DNA, 20 bp, Artificial Sequence
  chemically synthesized
agggtatttagcagtatccc

SEQ ID NO: 179018 - DNA, 20 bp, Artificial Sequence
  chemically synthesized
ccagtgtgttcaacaggcca

SEQ ID NO: 179019 - DNA, 20 bp, Artificial Sequence
  chemically synthesized
tccagtgtgttcaacaggcc

SEQ ID NO: 179020 - DNA, 20 bp, Artificial Sequence
  chemically synthesized
atccagtgtgttcaacaggc

SEQ ID NO: 179021 - DNA, 20 bp, Artificial Sequence
  chemically synthesized
tggtatccagtgtgttcaac

SEQ ID NO: 179022 - DNA, 20 bp, Artificial Sequence
  chemically synthesized
ctggtatccagtgtgttcaa

SEQ ID NO: 179023 - DNA, 20 bp, Artificial Sequence
  chemically synthesized
ccctggcctgttgaacacac

SEQ ID NO: 179024 - DNA, 20 bp, Artificial Sequence
  chemically synthesized
ctgttgaacacactggatac

SEQ ID NO: 179025 - DNA, 20 bp, Artificial Sequence
  chemically synthesized
gaggtgttactactggtatc

SEQ ID NO: 179026 - DNA, 20 bp, Artificial Sequence
  chemically synthesized
ttgaacacactggataccag

SEQ ID NO: 179027 - DNA, 20 bp, Artificial Sequence
  chemically synthesized
caggggcgaggtgttactac

SEQ ID NO: 179028 - DNA, 20 bp, Artificial Sequence
  chemically synthesized
agtagtaacacctcgcccct

SEQ ID NO: 179029 - DNA, 20 bp, Artificial Sequence
  chemically synthesized
gttgtcacagctcaggggcg

SEQ ID NO: 179030 - DNA, 20 bp, Artificial Sequence
  chemically synthesized
ggttgtcacagctcaggggc

SEQ ID NO: 179031 - DNA, 20 bp, Artificial Sequence
  chemically synthesized
atttggttgtcacagctcag

SEQ ID NO: 179032 - DNA, 20 bp, Artificial Sequence
  chemically synthesized
tatttggttgtcacagctca

SEQ ID NO: 179033 - DNA, 20 bp, Artificial Sequence
  chemically synthesized
atatttggttgtcacagctc

SEQ ID NO: 179034 - DNA, 20 bp, Artificial Sequence
  chemically synthesized
catatttggttgtcacagct

SEQ ID NO: 179035 - DNA, 20 bp, Artificial Sequence
  chemically synthesized
tgaaacatatttggttgtca

SEQ ID NO: 179036 - DNA, 20 bp, Artificial Sequence
  chemically synthesized
gcagtgccttgaaacatatt

SEQ ID NO: 179037 - DNA, 20 bp, Artificial Sequence
  chemically synthesized
gtgacaaccaaatatgtttc

SEQ ID NO: 179038 - DNA, 20 bp, Artificial Sequence
  chemically synthesized
tgacaaccaaatatgtttca

SEQ ID NO: 179039 - DNA, 20 bp, Artificial Sequence
  chemically synthesized
caaccccccagcatatttgg

SEQ ID NO: 179040 - DNA, 20 bp, Artificial Sequence
  chemically synthesized
caaggcactgccaaatatgc

SEQ ID NO: 179041 - DNA, 20 bp, Artificial Sequence
  chemically synthesized
ccccaaccccccagcatatt

SEQ ID NO: 179042 - DNA, 20 bp, Artificial Sequence
  chemically synthesized
aaggcactgccaaatatgct

SEQ ID NO: 179043 - DNA, 20 bp, Artificial Sequence
  chemically synthesized
aggcactgccaaatatgctg

SEQ ID NO: 179044 - DNA, 20 bp, Artificial Sequence
  chemically synthesized
ggcactgccaaatatgctgg

SEQ ID NO: 179045 - DNA, 20 bp, Artificial Sequence
  chemically synthesized
gcactgccaaatatgctggg

SEQ ID NO: 179046 - DNA, 20 bp, Artificial Sequence
  chemically synthesized
tgccaaatatgctggggggt

SEQ ID NO: 179047 - DNA, 20 bp, Artificial Sequence
  chemically synthesized
gccaaatatgctggggggtt

SEQ ID NO: 179048 - DNA, 20 bp, Artificial Sequence
  chemically synthesized
tgtccccacccccaaccccc

SEQ ID NO: 179049 - DNA, 20 bp, Artificial Sequence
  chemically synthesized
ccaaatatgctggggggttg

SEQ ID NO: 179050 - DNA, 20 bp, Artificial Sequence
  chemically synthesized
caaatatgctggggggttgg

SEQ ID NO: 179051 - DNA, 20 bp, Artificial Sequence
  chemically synthesized
atatgctggggggttggggg

SEQ ID NO: 179052 - DNA, 20 bp, Artificial Sequence
  chemically synthesized
tatgctggggggttgggggt

SEQ ID NO: 179053 - DNA, 20 bp, Artificial Sequence
  chemically synthesized
atgctggggggttgggggtg

SEQ ID NO: 179054 - DNA, 20 bp, Artificial Sequence
  chemically synthesized
ggtggggacaaaattgtccc

SEQ ID NO: 179055 - DNA, 20 bp, Artificial Sequence
  chemically synthesized
ggacaaaattgtccctggtt

SEQ ID NO: 179056 - DNA, 20 bp, Artificial Sequence
  chemically synthesized
ctttagttggttctcaacca

SEQ ID NO: 179057 - DNA, 20 bp, Artificial Sequence
  chemically synthesized
actttagttggttctcaacc

SEQ ID NO: 179058 - DNA, 20 bp, Artificial Sequence
  chemically synthesized
tactttagttggttctcaac

SEQ ID NO: 179059 - DNA, 20 bp, Artificial Sequence
  chemically synthesized
ccctggttgagaaccaacta

SEQ ID NO: 179060 - DNA, 20 bp, Artificial Sequence
  chemically synthesized
ggttatatacttactttagt

SEQ ID NO: 179061 - DNA, 20 bp, Artificial Sequence
  chemically synthesized
ggttgagaaccaactaaagt

SEQ ID NO: 179062 - DNA, 20 bp, Artificial Sequence
  chemically synthesized
tttaggttatatacttactt

SEQ ID NO: 179063 - DNA, 20 bp, Artificial Sequence
  chemically synthesized
taaagtaagtatataaccta

SEQ ID NO: 179064 - DNA, 20 bp, Artificial Sequence
  chemically synthesized
attttaaaacttgtaacttt

SEQ ID NO: 179065 - DNA, 20 bp, Artificial Sequence
  chemically synthesized
agtatataacctaaagttac

SEQ ID NO: 179066 - DNA, 20 bp, Artificial Sequence
  chemically synthesized
cattttaaaacttgtaactt

SEQ ID NO: 179067 - DNA, 20 bp, Artificial Sequence
  chemically synthesized
agttttaaaatgtttaatta

SEQ ID NO: 179068 - DNA, 20 bp, Artificial Sequence
  chemically synthesized
gtttaattaaagtatactta

SEQ ID NO: 179069 - DNA, 20 bp, Artificial Sequence
  chemically synthesized
tttgtcctctcattttccat

SEQ ID NO: 179070 - DNA, 20 bp, Artificial Sequence
  chemically synthesized
aaagtatacttatggaaaat

SEQ ID NO: 179071 - DNA, 20 bp, Artificial Sequence
  chemically synthesized
agtatacttatggaaaatga

SEQ ID NO: 179072 - DNA, 20 bp, Artificial Sequence
  chemically synthesized
gtatacttatggaaaatgag

SEQ ID NO: 179073 - DNA, 20 bp, Artificial Sequence
  chemically synthesized
gagaggacaaaaatataaac

SEQ ID NO: 179074 - DNA, 20 bp, Artificial Sequence
  chemically synthesized
agaggacaaaaatataaaca

SEQ ID NO: 179075 - DNA, 20 bp, Artificial Sequence
  chemically synthesized
acaaggtttttgttttgttt

SEQ ID NO: 179076 - DNA, 20 bp, Artificial Sequence
  chemically synthesized
aggtttttgttttgtttaag

SEQ ID NO: 179077 - DNA, 20 bp, Artificial Sequence
  chemically synthesized
tttttgttttgtttaagtag

SEQ ID NO: 179078 - DNA, 20 bp, Artificial Sequence
  chemically synthesized
agaataagaagcagataaaa

SEQ ID NO: 179079 - DNA, 20 bp, Artificial Sequence
  chemically synthesized
ttgacccacagaataagaag

SEQ ID NO: 179080 - DNA, 20 bp, Artificial Sequence
  chemically synthesized
tccttgacccacagaataag

SEQ ID NO: 179081 - DNA, 20 bp, Artificial Sequence
  chemically synthesized
tttatctgcttcttattctg

SEQ ID NO: 179082 - DNA, 20 bp, Artificial Sequence
  chemically synthesized
ttatctgcttcttattctgt

SEQ ID NO: 179083 - DNA, 20 bp, Artificial Sequence
  chemically synthesized
aaatccttgacccacagaat

SEQ ID NO: 179084 - DNA, 20 bp, Artificial Sequence
  chemically synthesized
tgcttcttattctgtgggtc

SEQ ID NO: 179085 - DNA, 20 bp, Artificial Sequence
  chemically synthesized
gcttcttattctgtgggtca

SEQ ID NO: 179086 - DNA, 20 bp, Artificial Sequence
  chemically synthesized
ctatccaaatccttgaccca

SEQ ID NO: 179087 - DNA, 20 bp, Artificial Sequence
  chemically synthesized
tattctgtgggtcaaggatt

SEQ ID NO: 179088 - DNA, 20 bp, Artificial Sequence
  chemically synthesized
ctgtgggtcaaggatttgga

SEQ ID NO: 179089 - DNA, 20 bp, Artificial Sequence
  chemically synthesized
tgtgggtcaaggatttggat

SEQ ID NO: 179090 - DNA, 20 bp, Artificial Sequence
  chemically synthesized
gtgggtcaaggatttggata

SEQ ID NO: 179091 - DNA, 20 bp, Artificial Sequence
  chemically synthesized
tcaaggatttggatagggct

SEQ ID NO: 179092 - DNA, 20 bp, Artificial Sequence
  chemically synthesized
gatttggatagggctcagtt

SEQ ID NO: 179093 - DNA, 20 bp, Artificial Sequence
  chemically synthesized
ttggatagggctcagttgag

SEQ ID NO: 179094 - DNA, 20 bp, Artificial Sequence
  chemically synthesized
taaagcagaactgctcaact

SEQ ID NO: 179095 - DNA, 20 bp, Artificial Sequence
  chemically synthesized
ttgagcagttctgctttatg

SEQ ID NO: 179096 - DNA, 20 bp, Artificial Sequence
  chemically synthesized
caagctgaagccacataaag

SEQ ID NO: 179097 - DNA, 20 bp, Artificial Sequence
  chemically synthesized
aaccaagctgaagccacata

SEQ ID NO: 179098 - DNA, 20 bp, Artificial Sequence
  chemically synthesized
agttctgctttatgtggctt

SEQ ID NO: 179099 - DNA, 20 bp, Artificial Sequence
  chemically synthesized
tgctttatgtggcttcagct

SEQ ID NO: 179100 - DNA, 20 bp, Artificial Sequence
  chemically synthesized
ttttattttaaaccaagctg

SEQ ID NO: 179101 - DNA, 20 bp, Artificial Sequence
  chemically synthesized
ttagtgttttattttaaacc

SEQ ID NO: 179102 - DNA, 20 bp, Artificial Sequence
  chemically synthesized
cagtttagcatgtaataatt

SEQ ID NO: 179103 - DNA, 20 bp, Artificial Sequence
  chemically synthesized
tcataattcggaaaacagtt

SEQ ID NO: 179104 - DNA, 20 bp, Artificial Sequence
  chemically synthesized
gtgagtcataattcggaaaa

SEQ ID NO: 179105 - DNA, 20 bp, Artificial Sequence
  chemically synthesized
taaggttgtgagtcataatt

SEQ ID NO: 179106 - DNA, 20 bp, Artificial Sequence
  chemically synthesized
ctttcctcaaataaggttgt

SEQ ID NO: 179107 - DNA, 20 bp, Artificial Sequence
  chemically synthesized
tatgactcacaaccttattt

SEQ ID NO: 179108 - DNA, 20 bp, Artificial Sequence
  chemically synthesized
atgactcacaaccttatttg

SEQ ID NO: 179109 - DNA, 20 bp, Artificial Sequence
  chemically synthesized
tttttctctttcctcaaata

SEQ ID NO: 179110 - DNA, 20 bp, Artificial Sequence
  chemically synthesized
gtttttctctttcctcaaat

SEQ ID NO: 179111 - DNA, 20 bp, Artificial Sequence
  chemically synthesized
ctcacaaccttatttgagga

SEQ ID NO: 179112 - DNA, 20 bp, Artificial Sequence
  chemically synthesized
cacaaccttatttgaggaaa

SEQ ID NO: 179113 - DNA, 20 bp, Artificial Sequence
  chemically synthesized
atatgttaagtattttaaat

SEQ ID NO: 179114 - DNA, 20 bp, Artificial Sequence
  chemically synthesized
ccacgagtacaacatatgtt

SEQ ID NO: 179115 - DNA, 20 bp, Artificial Sequence
  chemically synthesized
cttaacatatgttgtactcg

SEQ ID NO: 179116 - DNA, 20 bp, Artificial Sequence
  chemically synthesized
aacatatgttgtactcgtgg

SEQ ID NO: 179117 - DNA, 20 bp, Artificial Sequence
  chemically synthesized
ttcataattaaaacttccac

SEQ ID NO: 179118 - DNA, 20 bp, Artificial Sequence
  chemically synthesized
atttatggctaattagcata

SEQ ID NO: 179119 - DNA, 20 bp, Artificial Sequence
  chemically synthesized
gcatataactctatgctaat

SEQ ID NO: 179120 - DNA, 20 bp, Artificial Sequence
  chemically synthesized
aaatttatggctaattagca

SEQ ID NO: 179121 - DNA, 20 bp, Artificial Sequence
  chemically synthesized
agaataaatttatggctaat

SEQ ID NO: 179122 - DNA, 20 bp, Artificial Sequence
  chemically synthesized
aatatgtaagaataaattta

SEQ ID NO: 179123 - DNA, 20 bp, Artificial Sequence
  chemically synthesized
tgtcttacaatcgaatatgt

SEQ ID NO: 179124 - DNA, 20 bp, Artificial Sequence
  chemically synthesized
attcttacatattcgattgt

SEQ ID NO: 179125 - DNA, 20 bp, Artificial Sequence
  chemically synthesized
ttacatattcgattgtaaga

SEQ ID NO: 179126 - DNA, 20 bp, Artificial Sequence
  chemically synthesized
taagcacaaacaattttgtt

SEQ ID NO: 179127 - DNA, 20 bp, Artificial Sequence
  chemically synthesized
aaaaaattttcaattatttt

SEQ ID NO: 179128 - DNA, 20 bp, Artificial Sequence
  chemically synthesized
ttttttgttttgttgtcttt

SEQ ID NO: 179129 - DNA, 20 bp, Artificial Sequence
  chemically synthesized
tttttgttttgttgtctttt

SEQ ID NO: 179130 - DNA, 20 bp, Artificial Sequence
  chemically synthesized
aagctacacatagttcccaa

SEQ ID NO: 179131 - DNA, 20 bp, Artificial Sequence
  chemically synthesized
tgtcttttgggaactatgtg

SEQ ID NO: 179132 - DNA, 20 bp, Artificial Sequence
  chemically synthesized
gcttccatggaagctacaca

SEQ ID NO: 179133 - DNA, 20 bp, Artificial Sequence
  chemically synthesized
ggaactatgtgtagcttcca

SEQ ID NO: 179134 - DNA, 20 bp, Artificial Sequence
  chemically synthesized
actatgtgtagcttccatgg

SEQ ID NO: 179135 - DNA, 20 bp, Artificial Sequence
  chemically synthesized
tcagttaaaagcttccatgg

SEQ ID NO: 179136 - DNA, 20 bp, Artificial Sequence
  chemically synthesized
acttcagttaaaagcttcca

SEQ ID NO: 179137 - DNA, 20 bp, Artificial Sequence
  chemically synthesized
tccatggaagcttttaactg

SEQ ID NO: 179138 - DNA, 20 bp, Artificial Sequence
  chemically synthesized
gtatattacacttcagttaa

SEQ ID NO: 179139 - DNA, 20 bp, Artificial Sequence
  chemically synthesized
cctgtacgtatattacactt

SEQ ID NO: 179140 - DNA, 20 bp, Artificial Sequence
  chemically synthesized
actgaagtgtaatatacgta

SEQ ID NO: 179141 - DNA, 20 bp, Artificial Sequence
  chemically synthesized
ctgaagtgtaatatacgtac

SEQ ID NO: 179142 - DNA, 20 bp, Artificial Sequence
  chemically synthesized
ggctatacagttaaattgtg

SEQ ID NO: 179143 - DNA, 20 bp, Artificial Sequence
  chemically synthesized
cactgcacaatttaactgta

SEQ ID NO: 179144 - DNA, 20 bp, Artificial Sequence
  chemically synthesized
taaaacactattgggctata

SEQ ID NO: 179145 - DNA, 20 bp, Artificial Sequence
  chemically synthesized
aatttaactgtatagcccaa

SEQ ID NO: 179146 - DNA, 20 bp, Artificial Sequence
  chemically synthesized
tcaatttttaaaacactatt

SEQ ID NO: 179147 - DNA, 20 bp, Artificial Sequence
  chemically synthesized
ttcaatttttaaaacactat

SEQ ID NO: 179148 - DNA, 20 bp, Artificial Sequence
  chemically synthesized
aattgaacacactgtacaac

SEQ ID NO: 179149 - DNA, 20 bp, Artificial Sequence
  chemically synthesized
tatttccttctctggttgta

SEQ ID NO: 179150 - DNA, 20 bp, Artificial Sequence
  chemically synthesized
ttgaacacactgtacaacca

SEQ ID NO: 179151 - DNA, 20 bp, Artificial Sequence
  chemically synthesized
aacacactgtacaaccagag

SEQ ID NO: 179152 - DNA, 20 bp, Artificial Sequence
  chemically synthesized
acacactgtacaaccagaga

SEQ ID NO: 179153 - DNA, 20 bp, Artificial Sequence
  chemically synthesized
taatattctatttccttctc

SEQ ID NO: 179154 - DNA, 20 bp, Artificial Sequence
  chemically synthesized
tgtacaaccagagaaggaaa

SEQ ID NO: 179155 - DNA, 20 bp, Artificial Sequence
  chemically synthesized
agaaggaaatagaatattat

SEQ ID NO: 179156 - DNA, 20 bp, Artificial Sequence
  chemically synthesized
atagaatattatcagaatct

SEQ ID NO: 179157 - DNA, 20 bp, Artificial Sequence
  chemically synthesized
agggataagaggagatttct

SEQ ID NO: 179158 - DNA, 20 bp, Artificial Sequence
  chemically synthesized
tgactgcaaagggataagag

SEQ ID NO: 179159 - DNA, 20 bp, Artificial Sequence
  chemically synthesized
agtgactgcaaagggataag

SEQ ID NO: 179160 - DNA, 20 bp, Artificial Sequence
  chemically synthesized
cagtgactgcaaagggataa

SEQ ID NO: 179161 - DNA, 20 bp, Artificial Sequence
  chemically synthesized
ggcagtgactgcaaagggat

SEQ ID NO: 179162 - DNA, 20 bp, Artificial Sequence
  chemically synthesized
aatctcctcttatccctttg

SEQ ID NO: 179163 - DNA, 20 bp, Artificial Sequence
  chemically synthesized
ttggaggcagtgactgcaaa

SEQ ID NO: 179164 - DNA, 20 bp, Artificial Sequence
  chemically synthesized
cttggaggcagtgactgcaa

SEQ ID NO: 179165 - DNA, 20 bp, Artificial Sequence
  chemically synthesized
acttggaggcagtgactgca

SEQ ID NO: 179166 - DNA, 20 bp, Artificial Sequence
  chemically synthesized
cctttgcagtcactgcctcc

SEQ ID NO: 179167 - DNA, 20 bp, Artificial Sequence
  chemically synthesized
gtactggttatacttggagg

SEQ ID NO: 179168 - DNA, 20 bp, Artificial Sequence
  chemically synthesized
agggtactggttatacttgg

SEQ ID NO: 179169 - DNA, 20 bp, Artificial Sequence
  chemically synthesized
cagggtactggttatacttg

SEQ ID NO: 179170 - DNA, 20 bp, Artificial Sequence
  chemically synthesized
gacagggtactggttatact

SEQ ID NO: 179171 - DNA, 20 bp, Artificial Sequence
  chemically synthesized
tcactgcctccaagtataac

SEQ ID NO: 179172 - DNA, 20 bp, Artificial Sequence
  chemically synthesized
aatcaaagttgacagggtac

SEQ ID NO: 179173 - DNA, 20 bp, Artificial Sequence
  chemically synthesized
caaaataatcaaagttgaca

SEQ ID NO: 179174 - DNA, 20 bp, Artificial Sequence
  chemically synthesized
gcaaaataatcaaagttgac

SEQ ID NO: 179175 - DNA, 20 bp, Artificial Sequence
  chemically synthesized
ggcaaaataatcaaagttga

SEQ ID NO: 179176 - DNA, 20 bp, Artificial Sequence
  chemically synthesized
cagtaccggcaaaataatca

SEQ ID NO: 179177 - DNA, 20 bp, Artificial Sequence
  chemically synthesized
gtcaactttgattattttgc

SEQ ID NO: 179178 - DNA, 20 bp, Artificial Sequence
  chemically synthesized
attttcataatattcagtac

SEQ ID NO: 179179 - DNA, 20 bp, Artificial Sequence
  chemically synthesized
aattccattttcataatatt

SEQ ID NO: 179180 - DNA, 20 bp, Artificial Sequence
  chemically synthesized
ggtactgaatattatgaaaa

SEQ ID NO: 179181 - DNA, 20 bp, Artificial Sequence
  chemically synthesized
attatgaaaatggaattgta

SEQ ID NO: 179182 - DNA, 20 bp, Artificial Sequence
  chemically synthesized
gcgagacacaaaggagtata

SEQ ID NO: 179183 - DNA, 20 bp, Artificial Sequence
  chemically synthesized
gaaaaaggcgagacacaaag

SEQ ID NO: 179184 - DNA, 20 bp, Artificial Sequence
  chemically synthesized
atgaaaaaggcgagacacaa

SEQ ID NO: 179185 - DNA, 20 bp, Artificial Sequence
  chemically synthesized
aatgaaaaaggcgagacaca

SEQ ID NO: 179186 - DNA, 20 bp, Artificial Sequence
  chemically synthesized
taattttgaatgaaaaaggc

SEQ ID NO: 179187 - DNA, 20 bp, Artificial Sequence
  chemically synthesized
aacataattttgaatgaaaa

SEQ ID NO: 179188 - DNA, 20 bp, Artificial Sequence
  chemically synthesized
aaacataattttgaatgaaa

SEQ ID NO: 179189 - DNA, 20 bp, Artificial Sequence
  chemically synthesized
gactaaaattatatgcaaca

SEQ ID NO: 179190 - DNA, 20 bp, Artificial Sequence
  chemically synthesized
atccatgttgcatataattt

SEQ ID NO: 179191 - DNA, 20 bp, Artificial Sequence
  chemically synthesized
tatacagccaggttaatgaa

SEQ ID NO: 179192 - DNA, 20 bp, Artificial Sequence
  chemically synthesized
ttttagtctgttcattaacc

SEQ ID NO: 179193 - DNA, 20 bp, Artificial Sequence
  chemically synthesized
tgttcattaacctggctgta

SEQ ID NO: 179194 - DNA, 20 bp, Artificial Sequence
  chemically synthesized
caattaaatgctatacagcc

SEQ ID NO: 179195 - DNA, 20 bp, Artificial Sequence
  chemically synthesized
acaattaaatgctatacagc

SEQ ID NO: 179196 - DNA, 20 bp, Artificial Sequence
  chemically synthesized
ttacacaattaaatgctata

SEQ ID NO: 179197 - DNA, 20 bp, Artificial Sequence
  chemically synthesized
agcatttaattgtgtaaata

SEQ ID NO: 179198 - DNA, 20 bp, Artificial Sequence
  chemically synthesized
attgtgtaaatatagtactt

SEQ ID NO: 179199 - DNA, 20 bp, Artificial Sequence
  chemically synthesized
tgtaaatatagtactttaga

SEQ ID NO: 179200 - DNA, 20 bp, Artificial Sequence
  chemically synthesized
ttatcacaaatgtccatcta

SEQ ID NO: 179201 - DNA, 20 bp, Artificial Sequence
  chemically synthesized
gatggacatttgtgataatt

SEQ ID NO: 179202 - DNA, 20 bp, Artificial Sequence
  chemically synthesized
aattcagttttttgaatgat

SEQ ID NO: 179203 - DNA, 20 bp, Artificial Sequence
  chemically synthesized
ttgaagcaaaaaaaaaaaaa

SEQ ID NO: 179204 - DNA, 20 bp, Artificial Sequence
  chemically synthesized
aatacacatttgttaatttg

SEQ ID NO: 179205 - DNA, 20 bp, Artificial Sequence
  chemically synthesized
tcaaattaacaaatgtgtat

SEQ ID NO: 179206 - DNA, 20 bp, Artificial Sequence
  chemically synthesized
caaattaacaaatgtgtatt

SEQ ID NO: 179207 - DNA, 20 bp, Artificial Sequence
  chemically synthesized
aattaacaaatgtgtattgg

SEQ ID NO: 179208 - DNA, 20 bp, Artificial Sequence
  chemically synthesized
ttgagctcttagaaggtagt

SEQ ID NO: 179209 - DNA, 20 bp, Artificial Sequence
  chemically synthesized
ttgggagcttactaccttct

SEQ ID NO: 179210 - DNA, 20 bp, Artificial Sequence
  chemically synthesized
ccaattgagctcttagaagg

SEQ ID NO: 179211 - DNA, 20 bp, Artificial Sequence
  chemically synthesized
gggagcttactaccttctaa

SEQ ID NO: 179212 - DNA, 20 bp, Artificial Sequence
  chemically synthesized
tgcccaattgagctcttaga

SEQ ID NO: 179213 - DNA, 20 bp, Artificial Sequence
  chemically synthesized
atgcccaattgagctcttag

SEQ ID NO: 179214 - DNA, 20 bp, Artificial Sequence
  chemically synthesized
ctaatgcccaattgagctct

SEQ ID NO: 179215 - DNA, 20 bp, Artificial Sequence
  chemically synthesized
ctaccttctaagagctcaat

SEQ ID NO: 179216 - DNA, 20 bp, Artificial Sequence
  chemically synthesized
taccttctaagagctcaatt

SEQ ID NO: 179217 - DNA, 20 bp, Artificial Sequence
  chemically synthesized
tttaatcctaatgcccaatt

SEQ ID NO: 179218 - DNA, 20 bp, Artificial Sequence
  chemically synthesized
ctaagagctcaattgggcat

SEQ ID NO: 179219 - DNA, 20 bp, Artificial Sequence
  chemically synthesized
taagagctcaattgggcatt

SEQ ID NO: 179220 - DNA, 20 bp, Artificial Sequence
  chemically synthesized
tcaattgggcattaggatta

SEQ ID NO: 179221 - DNA, 20 bp, Artificial Sequence
  chemically synthesized
tacgttatataccttgtctt

SEQ ID NO: 179222 - DNA, 20 bp, Artificial Sequence
  chemically synthesized
acgttatataccttgtcttg

SEQ ID NO: 179223 - DNA, 20 bp, Artificial Sequence
  chemically synthesized
actatgaaatcctcaagaca

SEQ ID NO: 179224 - DNA, 20 bp, Artificial Sequence
  chemically synthesized
gactatgaaatcctcaagac

SEQ ID NO: 179225 - DNA, 20 bp, Artificial Sequence
  chemically synthesized
tcattgactatgaaatcctc

SEQ ID NO: 179226 - DNA, 20 bp, Artificial Sequence
  chemically synthesized
accttgtcttgaggatttca

SEQ ID NO: 179227 - DNA, 20 bp, Artificial Sequence
  chemically synthesized
ttgaggatttcatagtcaat

SEQ ID NO: 179228 - DNA, 20 bp, Artificial Sequence
  chemically synthesized
aggatttcatagtcaatgag

SEQ ID NO: 179229 - DNA, 20 bp, Artificial Sequence
  chemically synthesized
catagtcaatgagaagaaac

SEQ ID NO: 179230 - DNA, 20 bp, Artificial Sequence
  chemically synthesized
atgagaagaaacaagcatgt

SEQ ID NO: 179231 - DNA, 20 bp, Artificial Sequence
  chemically synthesized
aagaaacaagcatgtaagcc

SEQ ID NO: 179232 - DNA, 20 bp, Artificial Sequence
  chemically synthesized
agaaacaagcatgtaagcca

SEQ ID NO: 179233 - DNA, 20 bp, Artificial Sequence
  chemically synthesized
taatacttaatcataatcct

SEQ ID NO: 179234 - DNA, 20 bp, Artificial Sequence
  chemically synthesized
gtaagccaaggattatgatt

SEQ ID NO: 179235 - DNA, 20 bp, Artificial Sequence
  chemically synthesized
aggattatgattaagtatta

SEQ ID NO: 179236 - DNA, 20 bp, Artificial Sequence
  chemically synthesized
ggattatgattaagtattat

SEQ ID NO: 179237 - DNA, 20 bp, Artificial Sequence
  chemically synthesized
attatgattaagtattatag

SEQ ID NO: 179238 - DNA, 20 bp, Artificial Sequence
  chemically synthesized
ttatgattaagtattatagg

SEQ ID NO: 179239 - DNA, 20 bp, Artificial Sequence
  chemically synthesized
atgattaagtattataggag

SEQ ID NO: 179240 - DNA, 20 bp, Artificial Sequence
  chemically synthesized
attaagtattataggaggag

SEQ ID NO: 179241 - DNA, 20 bp, Artificial Sequence
  chemically synthesized
ataggaggagaagttatttc

SEQ ID NO: 179242 - DNA, 20 bp, Artificial Sequence
  chemically synthesized
taggaggagaagttatttct

SEQ ID NO: 179243 - DNA, 20 bp, Artificial Sequence
  chemically synthesized
aggaggagaagttatttctg

SEQ ID NO: 179244 - DNA, 20 bp, Artificial Sequence
  chemically synthesized
aggagaagttatttctgggg

SEQ ID NO: 179245 - DNA, 20 bp, Artificial Sequence
  chemically synthesized
atgtctcccaagcactgccc

SEQ ID NO: 179246 - DNA, 20 bp, Artificial Sequence
  chemically synthesized
gttatttctggggcagtgct

SEQ ID NO: 179247 - DNA, 20 bp, Artificial Sequence
  chemically synthesized
ttatttctggggcagtgctt

SEQ ID NO: 179248 - DNA, 20 bp, Artificial Sequence
  chemically synthesized
atttctggggcagtgcttgg

SEQ ID NO: 179249 - DNA, 20 bp, Artificial Sequence
  chemically synthesized
tcttctctgggatgtctccc

SEQ ID NO: 179250 - DNA, 20 bp, Artificial Sequence
  chemically synthesized
gcagtgcttgggagacatcc

SEQ ID NO: 179251 - DNA, 20 bp, Artificial Sequence
  chemically synthesized
agtgcttgggagacatccca

SEQ ID NO: 179252 - DNA, 20 bp, Artificial Sequence
  chemically synthesized
gcttgggagacatcccagag

SEQ ID NO: 179253 - DNA, 20 bp, Artificial Sequence
  chemically synthesized
ctcagatcattatcttctct

SEQ ID NO: 179254 - DNA, 20 bp, Artificial Sequence
  chemically synthesized
actcagatcattatcttctc

SEQ ID NO: 179255 - DNA, 20 bp, Artificial Sequence
  chemically synthesized
cccagagaagataatgatct

SEQ ID NO: 179256 - DNA, 20 bp, Artificial Sequence
  chemically synthesized
agataatgatctgagtcttg

SEQ ID NO: 179257 - DNA, 20 bp, Artificial Sequence
  chemically synthesized
tatcttcatgcttcaagact

SEQ ID NO: 179258 - DNA, 20 bp, Artificial Sequence
  chemically synthesized
ctgatctatcttcatgcttc

SEQ ID NO: 179259 - DNA, 20 bp, Artificial Sequence
  chemically synthesized
gatctgagtcttgaagcatg

SEQ ID NO: 179260 - DNA, 20 bp, Artificial Sequence
  chemically synthesized
tgagtcttgaagcatgaaga

SEQ ID NO: 179261 - DNA, 20 bp, Artificial Sequence
  chemically synthesized
cttgaagcatgaagatagat

SEQ ID NO: 179262 - DNA, 20 bp, Artificial Sequence
  chemically synthesized
gaagatagatcagcatgttg

SEQ ID NO: 179263 - DNA, 20 bp, Artificial Sequence
  chemically synthesized
aagatagatcagcatgttgc

SEQ ID NO: 179264 - DNA, 20 bp, Artificial Sequence
  chemically synthesized
gatcagcatgttgcaggaat

SEQ ID NO: 179265 - DNA, 20 bp, Artificial Sequence
  chemically synthesized
catgttgcaggaataagaca

SEQ ID NO: 179266 - DNA, 20 bp, Artificial Sequence
  chemically synthesized
aataagacacagcctgttca

SEQ ID NO: 179267 - DNA, 20 bp, Artificial Sequence
  chemically synthesized
tcaaggccctgtctttgaac

SEQ ID NO: 179268 - DNA, 20 bp, Artificial Sequence
  chemically synthesized
ctcaaggccctgtctttgaa

SEQ ID NO: 179269 - DNA, 20 bp, Artificial Sequence
  chemically synthesized
agacacagcctgttcaaaga

SEQ ID NO: 179270 - DNA, 20 bp, Artificial Sequence
  chemically synthesized
gacacagcctgttcaaagac

SEQ ID NO: 179271 - DNA, 20 bp, Artificial Sequence
  chemically synthesized
acacagcctgttcaaagaca

SEQ ID NO: 179272 - DNA, 20 bp, Artificial Sequence
  chemically synthesized
ctgttcaaagacagggcctt

SEQ ID NO: 179273 - DNA, 20 bp, Artificial Sequence
  chemically synthesized
gttcaaagacagggccttga

SEQ ID NO: 179274 - DNA, 20 bp, Artificial Sequence
  chemically synthesized
tcgcaactgtagttctctca

SEQ ID NO: 179275 - DNA, 20 bp, Artificial Sequence
  chemically synthesized
atcgcaactgtagttctctc

SEQ ID NO: 179276 - DNA, 20 bp, Artificial Sequence
  chemically synthesized
acagggccttgagagaacta

SEQ ID NO: 179277 - DNA, 20 bp, Artificial Sequence
  chemically synthesized
ttacagaatgatcgcaactg

SEQ ID NO: 179278 - DNA, 20 bp, Artificial Sequence
  chemically synthesized
gttgcgatcattctgtaaat

SEQ ID NO: 179279 - DNA, 20 bp, Artificial Sequence
  chemically synthesized
aataaccagattctgattta

SEQ ID NO: 179280 - DNA, 20 bp, Artificial Sequence
  chemically synthesized
tcattctgtaaatcagaatc

SEQ ID NO: 179281 - DNA, 20 bp, Artificial Sequence
  chemically synthesized
gtaaatcagaatctggttat

SEQ ID NO: 179282 - DNA, 20 bp, Artificial Sequence
  chemically synthesized
gcaagcataagtccaataac

SEQ ID NO: 179283 - DNA, 20 bp, Artificial Sequence
  chemically synthesized
gaatgaatatatgcaagcat

SEQ ID NO: 179284 - DNA, 20 bp, Artificial Sequence
  chemically synthesized
aaaactgaatgaatatatgc

SEQ ID NO: 179285 - DNA, 20 bp, Artificial Sequence
  chemically synthesized
tatgcttgcatatattcatt

SEQ ID NO: 179286 - DNA, 20 bp, Artificial Sequence
  chemically synthesized
attcagttttcctatatgat

SEQ ID NO: 179287 - DNA, 20 bp, Artificial Sequence
  chemically synthesized
tgaacaggctcttatcatat

SEQ ID NO: 179288 - DNA, 20 bp, Artificial Sequence
  chemically synthesized
ttgaacaggctcttatcata

SEQ ID NO: 179289 - DNA, 20 bp, Artificial Sequence
  chemically synthesized
tcagttttcctatatgataa

SEQ ID NO: 179290 - DNA, 20 bp, Artificial Sequence
  chemically synthesized
atatgataagagcctgttca

SEQ ID NO: 179291 - DNA, 20 bp, Artificial Sequence
  chemically synthesized
tcccagaacagactttgaac

SEQ ID NO: 179292 - DNA, 20 bp, Artificial Sequence
  chemically synthesized
gtcccagaacagactttgaa

SEQ ID NO: 179293 - DNA, 20 bp, Artificial Sequence
  chemically synthesized
agcctgttcaaagtctgttc

SEQ ID NO: 179294 - DNA, 20 bp, Artificial Sequence
  chemically synthesized
gcctgttcaaagtctgttct

SEQ ID NO: 179295 - DNA, 20 bp, Artificial Sequence
  chemically synthesized
taactttacgtgtcccagaa

SEQ ID NO: 179296 - DNA, 20 bp, Artificial Sequence
  chemically synthesized
gaatgtaactttacgtgtcc

SEQ ID NO: 179297 - DNA, 20 bp, Artificial Sequence
  chemically synthesized
agtctgttctgggacacgta

SEQ ID NO: 179298 - DNA, 20 bp, Artificial Sequence
  chemically synthesized
aaaagagaatagacagaggg

SEQ ID NO: 179299 - DNA, 20 bp, Artificial Sequence
  chemically synthesized
ttaaaagagaatagacagag

SEQ ID NO: 179300 - DNA, 20 bp, Artificial Sequence
  chemically synthesized
tttaaaagagaatagacaga

SEQ ID NO: 179301 - DNA, 20 bp, Artificial Sequence
  chemically synthesized
atttaaaagagaatagacag

SEQ ID NO: 179302 - DNA, 20 bp, Artificial Sequence
  chemically synthesized
aatttaaaagagaatagaca

SEQ ID NO: 179303 - DNA, 20 bp, Artificial Sequence
  chemically synthesized
tgaatttaaaagagaataga

SEQ ID NO: 179304 - DNA, 20 bp, Artificial Sequence
  chemically synthesized
taaatgaatttaaaagagaa

SEQ ID NO: 179305 - DNA, 20 bp, Artificial Sequence
  chemically synthesized
atgtataaatgaatttaaaa

SEQ ID NO: 179306 - DNA, 20 bp, Artificial Sequence
  chemically synthesized
aaatgtataaatgaatttaa

SEQ ID NO: 179307 - DNA, 20 bp, Artificial Sequence
  chemically synthesized
tcataaacatttgtaaaaat

SEQ ID NO: 179308 - DNA, 20 bp, Artificial Sequence
  chemically synthesized
tttattgtttttaatttttg

SEQ ID NO: 179309 - DNA, 20 bp, Artificial Sequence
  chemically synthesized
ttattgtttttaatttttgt

SEQ ID NO: 179310 - DNA, 20 bp, Artificial Sequence
  chemically synthesized
tattgtttttaatttttgta

SEQ ID NO: 179311 - DNA, 20 bp, Artificial Sequence
  chemically synthesized
ttttaatttttgtagggaca

SEQ ID NO: 179312 - DNA, 20 bp, Artificial Sequence
  chemically synthesized
aatttttgtagggacatagt

SEQ ID NO: 179313 - DNA, 20 bp, Artificial Sequence
  chemically synthesized
atagtaagtgtatgtacttg

SEQ ID NO: 179314 - DNA, 20 bp, Artificial Sequence
  chemically synthesized
tagtaagtgtatgtacttgt

SEQ ID NO: 179315 - DNA, 20 bp, Artificial Sequence
  chemically synthesized
agtaagtgtatgtacttgta

SEQ ID NO: 179316 - DNA, 20 bp, Artificial Sequence
  chemically synthesized
aaatatctcacgtaccctac

SEQ ID NO: 179317 - DNA, 20 bp, Artificial Sequence
  chemically synthesized
tatgtacttgtagggtacgt

SEQ ID NO: 179318 - DNA, 20 bp, Artificial Sequence
  chemically synthesized
ttttgatacacgcatgcaat

SEQ ID NO: 179319 - DNA, 20 bp, Artificial Sequence
  chemically synthesized
acacgcatgcaatgagaaat

SEQ ID NO: 179320 - DNA, 20 bp, Artificial Sequence
  chemically synthesized
agtgtcccaggaatgaacag

SEQ ID NO: 179321 - DNA, 20 bp, Artificial Sequence
  chemically synthesized
cccagtgtcccaggaatgaa

SEQ ID NO: 179322 - DNA, 20 bp, Artificial Sequence
  chemically synthesized
gcacatccactgttcattcc

SEQ ID NO: 179323 - DNA, 20 bp, Artificial Sequence
  chemically synthesized
cacatccactgttcattcct

SEQ ID NO: 179324 - DNA, 20 bp, Artificial Sequence
  chemically synthesized
actgttcattcctgggacac

SEQ ID NO: 179325 - DNA, 20 bp, Artificial Sequence
  chemically synthesized
gaccctgctcccagtgtccc

SEQ ID NO: 179326 - DNA, 20 bp, Artificial Sequence
  chemically synthesized
ctgttcattcctgggacact

SEQ ID NO: 179327 - DNA, 20 bp, Artificial Sequence
  chemically synthesized
agaccctgctcccagtgtcc

SEQ ID NO: 179328 - DNA, 20 bp, Artificial Sequence
  chemically synthesized
gttcattcctgggacactgg

SEQ ID NO: 179329 - DNA, 20 bp, Artificial Sequence
  chemically synthesized
cattcctgggacactgggag

SEQ ID NO: 179330 - DNA, 20 bp, Artificial Sequence
  chemically synthesized
attcctgggacactgggagc

SEQ ID NO: 179331 - DNA, 20 bp, Artificial Sequence
  chemically synthesized
ttcctgggacactgggagca

SEQ ID NO: 179332 - DNA, 20 bp, Artificial Sequence
  chemically synthesized
ttaaaaacagaccctgctcc

SEQ ID NO: 179333 - DNA, 20 bp, Artificial Sequence
  chemically synthesized
tattcgggataggttaaaaa

SEQ ID NO: 179334 - DNA, 20 bp, Artificial Sequence
  chemically synthesized
tcagatgttatattcgggat

SEQ ID NO: 179335 - DNA, 20 bp, Artificial Sequence
  chemically synthesized
atcagatgttatattcggga

SEQ ID NO: 179336 - DNA, 20 bp, Artificial Sequence
  chemically synthesized
ctagatcagatgttatattc

SEQ ID NO: 179337 - DNA, 20 bp, Artificial Sequence
  chemically synthesized
tctagatcagatgttatatt

SEQ ID NO: 179338 - DNA, 20 bp, Artificial Sequence
  chemically synthesized
cccgaatataacatctgatc

SEQ ID NO: 179339 - DNA, 20 bp, Artificial Sequence
  chemically synthesized
gaatataacatctgatctag

SEQ ID NO: 179340 - DNA, 20 bp, Artificial Sequence
  chemically synthesized
aggcagaagtacttctagat

SEQ ID NO: 179341 - DNA, 20 bp, Artificial Sequence
  chemically synthesized
agataaggcagaagtacttc

SEQ ID NO: 179342 - DNA, 20 bp, Artificial Sequence
  chemically synthesized
ttcccagtcagataaggcag

SEQ ID NO: 179343 - DNA, 20 bp, Artificial Sequence
  chemically synthesized
atcttcccagtcagataagg

SEQ ID NO: 179344 - DNA, 20 bp, Artificial Sequence
  chemically synthesized
ttcatcttcccagtcagata

SEQ ID NO: 179345 - DNA, 20 bp, Artificial Sequence
  chemically synthesized
gtacttctgccttatctgac

SEQ ID NO: 179346 - DNA, 20 bp, Artificial Sequence
  chemically synthesized
attcatcttcccagtcagat

SEQ ID NO: 179347 - DNA, 20 bp, Artificial Sequence
  chemically synthesized
tacttctgccttatctgact

SEQ ID NO: 179348 - DNA, 20 bp, Artificial Sequence
  chemically synthesized
ttctgccttatctgactggg

SEQ ID NO: 179349 - DNA, 20 bp, Artificial Sequence
  chemically synthesized
atagcattcatcttcccagt

SEQ ID NO: 179350 - DNA, 20 bp, Artificial Sequence
  chemically synthesized
gtaaatagcattcatcttcc

SEQ ID NO: 179351 - DNA, 20 bp, Artificial Sequence
  chemically synthesized
aagatgaatgctatttactt

SEQ ID NO: 179352 - DNA, 20 bp, Artificial Sequence
  chemically synthesized
atactctcagctgaagtaaa

SEQ ID NO: 179353 - DNA, 20 bp, Artificial Sequence
  chemically synthesized
gaatgctatttacttcagct

SEQ ID NO: 179354 - DNA, 20 bp, Artificial Sequence
  chemically synthesized
atgctatttacttcagctga

SEQ ID NO: 179355 - DNA, 20 bp, Artificial Sequence
  chemically synthesized
acaaaatatactctcagctg

SEQ ID NO: 179356 - DNA, 20 bp, Artificial Sequence
  chemically synthesized
gagacaacaaaatatactct

SEQ ID NO: 179357 - DNA, 20 bp, Artificial Sequence
  chemically synthesized
gtagtttccccaaaatatat

SEQ ID NO: 179358 - DNA, 20 bp, Artificial Sequence
  chemically synthesized
ttttgttgtctcatatattt

SEQ ID NO: 179359 - DNA, 20 bp, Artificial Sequence
  chemically synthesized
tttgttgtctcatatatttt

SEQ ID NO: 179360 - DNA, 20 bp, Artificial Sequence
  chemically synthesized
ttgttgtctcatatattttg

SEQ ID NO: 179361 - DNA, 20 bp, Artificial Sequence
  chemically synthesized
atatattttggggaaactac

SEQ ID NO: 179362 - DNA, 20 bp, Artificial Sequence
  chemically synthesized
ctcttgatttattaaactag

SEQ ID NO: 179363 - DNA, 20 bp, Artificial Sequence
  chemically synthesized
gatctcttgatttattaaac

SEQ ID NO: 179364 - DNA, 20 bp, Artificial Sequence
  chemically synthesized
aactactagtttaataaatc

SEQ ID NO: 179365 - DNA, 20 bp, Artificial Sequence
  chemically synthesized
ctactagtttaataaatcaa

SEQ ID NO: 179366 - DNA, 20 bp, Artificial Sequence
  chemically synthesized
gtttaataaatcaagagatc

SEQ ID NO: 179367 - DNA, 20 bp, Artificial Sequence
  chemically synthesized
ttaataaatcaagagatctg

SEQ ID NO: 179368 - DNA, 20 bp, Artificial Sequence
  chemically synthesized
aaatcaagagatctggagct

SEQ ID NO: 179369 - DNA, 20 bp, Artificial Sequence
  chemically synthesized
aatcaagagatctggagctc

SEQ ID NO: 179370 - DNA, 20 bp, Artificial Sequence
  chemically synthesized
atcaagagatctggagctcg

SEQ ID NO: 179371 - DNA, 20 bp, Artificial Sequence
  chemically synthesized
tttcctctctccccgagctc

SEQ ID NO: 179372 - DNA, 20 bp, Artificial Sequence
  chemically synthesized
caagagatctggagctcggg

SEQ ID NO: 179373 - DNA, 20 bp, Artificial Sequence
  chemically synthesized
agagatctggagctcgggga

SEQ ID NO: 179374 - DNA, 20 bp, Artificial Sequence
  chemically synthesized
agatctggagctcggggaga

SEQ ID NO: 179375 - DNA, 20 bp, Artificial Sequence
  chemically synthesized
tccagctttcctctctcccc

SEQ ID NO: 179376 - DNA, 20 bp, Artificial Sequence
  chemically synthesized
gatctggagctcggggagag

SEQ ID NO: 179377 - DNA, 20 bp, Artificial Sequence
  chemically synthesized
tggagctcggggagagagga

SEQ ID NO: 179378 - DNA, 20 bp, Artificial Sequence
  chemically synthesized
gctcggggagagaggaaagc

SEQ ID NO: 179379 - DNA, 20 bp, Artificial Sequence
  chemically synthesized
gagagaggaaagctggaaat

SEQ ID NO: 179380 - DNA, 20 bp, Artificial Sequence
  chemically synthesized
agagaggaaagctggaaata

SEQ ID NO: 179381 - DNA, 20 bp, Artificial Sequence
  chemically synthesized
atgactaaagtccttatttc

SEQ ID NO: 179382 - DNA, 20 bp, Artificial Sequence
  chemically synthesized
aaagctggaaataaggactt

SEQ ID NO: 179383 - DNA, 20 bp, Artificial Sequence
  chemically synthesized
gaaataaggactttagtcat

SEQ ID NO: 179384 - DNA, 20 bp, Artificial Sequence
  chemically synthesized
caactgattgctaatgacta

SEQ ID NO: 179385 - DNA, 20 bp, Artificial Sequence
  chemically synthesized
ggactttagtcattagcaat

SEQ ID NO: 179386 - DNA, 20 bp, Artificial Sequence
  chemically synthesized
tttagtcattagcaatcagt

SEQ ID NO: 179387 - DNA, 20 bp, Artificial Sequence
  chemically synthesized
agtcattagcaatcagttgg

SEQ ID NO: 179388 - DNA, 20 bp, Artificial Sequence
  chemically synthesized
tcattagcaatcagttggca

SEQ ID NO: 179389 - DNA, 20 bp, Artificial Sequence
  chemically synthesized
atcagttggcagagaaaaca

SEQ ID NO: 179390 - DNA, 20 bp, Artificial Sequence
  chemically synthesized
ttaattattagttcaaaagt

SEQ ID NO: 179391 - DNA, 20 bp, Artificial Sequence
  chemically synthesized
aatgttaattattagttcaa

SEQ ID NO: 179392 - DNA, 20 bp, Artificial Sequence
  chemically synthesized
aaacatgaaatgttaattat

SEQ ID NO: 179393 - DNA, 20 bp, Artificial Sequence
  chemically synthesized
tttcatgtttgctattttct

SEQ ID NO: 179394 - DNA, 20 bp, Artificial Sequence
  chemically synthesized
gaaagaatggactcagaaaa

SEQ ID NO: 179395 - DNA, 20 bp, Artificial Sequence
  chemically synthesized
aaacgaagaaagaatggact

SEQ ID NO: 179396 - DNA, 20 bp, Artificial Sequence
  chemically synthesized
ttcataaaacgaagaaagaa

SEQ ID NO: 179397 - DNA, 20 bp, Artificial Sequence
  chemically synthesized
taaaattcataaaacgaaga

SEQ ID NO: 179398 - DNA, 20 bp, Artificial Sequence
  chemically synthesized
tgattaaaattcataaaacg

SEQ ID NO: 179399 - DNA, 20 bp, Artificial Sequence
  chemically synthesized
atttttcaatttaaataaga

SEQ ID NO: 179400 - DNA, 20 bp, Artificial Sequence
  chemically synthesized
ctatttttcaatttaaataa

SEQ ID NO: 179401 - DNA, 20 bp, Artificial Sequence
  chemically synthesized
tcctatttttcaatttaaat

SEQ ID NO: 179402 - DNA, 20 bp, Artificial Sequence
  chemically synthesized
ctcttatttaaattgaaaaa

SEQ ID NO: 179403 - DNA, 20 bp, Artificial Sequence
  chemically synthesized
tcttatttaaattgaaaaat

SEQ ID NO: 179404 - DNA, 20 bp, Artificial Sequence
  chemically synthesized
tttaaattgaaaaataggaa

SEQ ID NO: 179405 - DNA, 20 bp, Artificial Sequence
  chemically synthesized
aataggaaaagtcaatttca

SEQ ID NO: 179406 - DNA, 20 bp, Artificial Sequence
  chemically synthesized
atacataagaaatcaacaaa

SEQ ID NO: 179407 - DNA, 20 bp, Artificial Sequence
  chemically synthesized
catacataagaaatcaacaa

SEQ ID NO: 179408 - DNA, 20 bp, Artificial Sequence
  chemically synthesized
ttttgttgatttcttatgta

SEQ ID NO: 179409 - DNA, 20 bp, Artificial Sequence
  chemically synthesized
ccgtaaggttaaccatacat

SEQ ID NO: 179410 - DNA, 20 bp, Artificial Sequence
  chemically synthesized
cttatgtatggttaacctta

SEQ ID NO: 179411 - DNA, 20 bp, Artificial Sequence
  chemically synthesized
gaagaagaggaggaaccgta

SEQ ID NO: 179412 - DNA, 20 bp, Artificial Sequence
  chemically synthesized
agaagaagaggaggaaccgt

SEQ ID NO: 179413 - DNA, 20 bp, Artificial Sequence
  chemically synthesized
acatagagtagaagaagagg

SEQ ID NO: 179414 - DNA, 20 bp, Artificial Sequence
  chemically synthesized
cacatagagtagaagaagag

SEQ ID NO: 179415 - DNA, 20 bp, Artificial Sequence
  chemically synthesized
agcacatagagtagaagaag

SEQ ID NO: 179416 - DNA, 20 bp, Artificial Sequence
  chemically synthesized
aagcacatagagtagaagaa

SEQ ID NO: 179417 - DNA, 20 bp, Artificial Sequence
  chemically synthesized
ccaagcacatagagtagaag

SEQ ID NO: 179418 - DNA, 20 bp, Artificial Sequence
  chemically synthesized
tggccaagcacatagagtag

SEQ ID NO: 179419 - DNA, 20 bp, Artificial Sequence
  chemically synthesized
ccatggccaagcacatagag

SEQ ID NO: 179420 - DNA, 20 bp, Artificial Sequence
  chemically synthesized
tttccatggccaagcacata

SEQ ID NO: 179421 - DNA, 20 bp, Artificial Sequence
  chemically synthesized
cttcttctactctatgtgct

SEQ ID NO: 179422 - DNA, 20 bp, Artificial Sequence
  chemically synthesized
gctttccatggccaagcaca

SEQ ID NO: 179423 - DNA, 20 bp, Artificial Sequence
  chemically synthesized
ctactctatgtgcttggcca

SEQ ID NO: 179424 - DNA, 20 bp, Artificial Sequence
  chemically synthesized
tcctttggctttccatggcc

SEQ ID NO: 179425 - DNA, 20 bp, Artificial Sequence
  chemically synthesized
tctatgtgcttggccatgga

SEQ ID NO: 179426 - DNA, 20 bp, Artificial Sequence
  chemically synthesized
ggcattcctttggctttcca

SEQ ID NO: 179427 - DNA, 20 bp, Artificial Sequence
  chemically synthesized
tgcttggccatggaaagcca

SEQ ID NO: 179428 - DNA, 20 bp, Artificial Sequence
  chemically synthesized
gcttggccatggaaagccaa

SEQ ID NO: 179429 - DNA, 20 bp, Artificial Sequence
  chemically synthesized
gagcaccgtaggcattcctt

SEQ ID NO: 179430 - DNA, 20 bp, Artificial Sequence
  chemically synthesized
gaaagccaaaggaatgccta

SEQ ID NO: 179431 - DNA, 20 bp, Artificial Sequence
  chemically synthesized
agaggccagaagagcaccgt

SEQ ID NO: 179432 - DNA, 20 bp, Artificial Sequence
  chemically synthesized
gagaggccagaagagcaccg

SEQ ID NO: 179433 - DNA, 20 bp, Artificial Sequence
  chemically synthesized
gaatgcctacggtgctcttc

SEQ ID NO: 179434 - DNA, 20 bp, Artificial Sequence
  chemically synthesized
agcttttggagaggccagaa

SEQ ID NO: 179435 - DNA, 20 bp, Artificial Sequence
  chemically synthesized
gtagcttttggagaggccag

SEQ ID NO: 179436 - DNA, 20 bp, Artificial Sequence
  chemically synthesized
tgtgtagcttttggagaggc

SEQ ID NO: 179437 - DNA, 20 bp, Artificial Sequence
  chemically synthesized
tgctcttctggcctctccaa

SEQ ID NO: 179438 - DNA, 20 bp, Artificial Sequence
  chemically synthesized
ggtctgtgtagcttttggag

SEQ ID NO: 179439 - DNA, 20 bp, Artificial Sequence
  chemically synthesized
aggtctgtgtagcttttgga

SEQ ID NO: 179440 - DNA, 20 bp, Artificial Sequence
  chemically synthesized
ccaggtctgtgtagcttttg

SEQ ID NO: 179441 - DNA, 20 bp, Artificial Sequence
  chemically synthesized
tcccaggtctgtgtagcttt

SEQ ID NO: 179442 - DNA, 20 bp, Artificial Sequence
  chemically synthesized
tggcctctccaaaagctaca

SEQ ID NO: 179443 - DNA, 20 bp, Artificial Sequence
  chemically synthesized
acctccttcccaggtctgtg

SEQ ID NO: 179444 - DNA, 20 bp, Artificial Sequence
  chemically synthesized
ctccaaaagctacacagacc

SEQ ID NO: 179445 - DNA, 20 bp, Artificial Sequence
  chemically synthesized
tccaaaagctacacagacct

SEQ ID NO: 179446 - DNA, 20 bp, Artificial Sequence
  chemically synthesized
aaaagctacacagacctggg

SEQ ID NO: 179447 - DNA, 20 bp, Artificial Sequence
  chemically synthesized
aaagctacacagacctggga

SEQ ID NO: 179448 - DNA, 20 bp, Artificial Sequence
  chemically synthesized
agctacacagacctgggaag

SEQ ID NO: 179449 - DNA, 20 bp, Artificial Sequence
  chemically synthesized
gctacacagacctgggaagg

SEQ ID NO: 179450 - DNA, 20 bp, Artificial Sequence
  chemically synthesized
aatctgcagacctccttccc

SEQ ID NO: 179451 - DNA, 20 bp, Artificial Sequence
  chemically synthesized
gaatctgcagacctccttcc

SEQ ID NO: 179452 - DNA, 20 bp, Artificial Sequence
  chemically synthesized
agacctgggaaggaggtctg

SEQ ID NO: 179453 - DNA, 20 bp, Artificial Sequence
  chemically synthesized
caatgaatgtttggaatctg

SEQ ID NO: 179454 - DNA, 20 bp, Artificial Sequence
  chemically synthesized
ctctcacttcaatgaatgtt

SEQ ID NO: 179455 - DNA, 20 bp, Artificial Sequence
  chemically synthesized
cagattccaaacattcattg

SEQ ID NO: 179456 - DNA, 20 bp, Artificial Sequence
  chemically synthesized
ttccaaacattcattgaagt

SEQ ID NO: 179457 - DNA, 20 bp, Artificial Sequence
  chemically synthesized
ccaaacattcattgaagtga

SEQ ID NO: 179458 - DNA, 20 bp, Artificial Sequence
  chemically synthesized
caaacattcattgaagtgag

SEQ ID NO: 179459 - DNA, 20 bp, Artificial Sequence
  chemically synthesized
tgtagactccaagaaggaaa

SEQ ID NO: 179460 - DNA, 20 bp, Artificial Sequence
  chemically synthesized
agaggatgctttttccttct

SEQ ID NO: 179461 - DNA, 20 bp, Artificial Sequence
  chemically synthesized
aggatgctttttccttcttg

SEQ ID NO: 179462 - DNA, 20 bp, Artificial Sequence
  chemically synthesized
taagtatgtagactccaaga

SEQ ID NO: 179463 - DNA, 20 bp, Artificial Sequence
  chemically synthesized
gtaagtatgtagactccaag

SEQ ID NO: 179464 - DNA, 20 bp, Artificial Sequence
  chemically synthesized
agagtaagtatgtagactcc

SEQ ID NO: 179465 - DNA, 20 bp, Artificial Sequence
  chemically synthesized
aatcactgagagtaagtatg

SEQ ID NO: 179466 - DNA, 20 bp, Artificial Sequence
  chemically synthesized
ggagtctacatacttactct

SEQ ID NO: 179467 - DNA, 20 bp, Artificial Sequence
  chemically synthesized
tcgagagaatcactgagagt

SEQ ID NO: 179468 - DNA, 20 bp, Artificial Sequence
  chemically synthesized
gacttcgagagaatcactga

SEQ ID NO: 179469 - DNA, 20 bp, Artificial Sequence
  chemically synthesized
gagacttcgagagaatcact

SEQ ID NO: 179470 - DNA, 20 bp, Artificial Sequence
  chemically synthesized
tactctcagtgattctctcg

SEQ ID NO: 179471 - DNA, 20 bp, Artificial Sequence
  chemically synthesized
gtcagaagtagagacttcga

SEQ ID NO: 179472 - DNA, 20 bp, Artificial Sequence
  chemically synthesized
gagtcagaagtagagacttc

SEQ ID NO: 179473 - DNA, 20 bp, Artificial Sequence
  chemically synthesized
atctctctgagtcagaagta

SEQ ID NO: 179474 - DNA, 20 bp, Artificial Sequence
  chemically synthesized
tcatctctctgagtcagaag

SEQ ID NO: 179475 - DNA, 20 bp, Artificial Sequence
  chemically synthesized
cgaagtctctacttctgact

SEQ ID NO: 179476 - DNA, 20 bp, Artificial Sequence
  chemically synthesized
ctttcatctctctgagtcag

SEQ ID NO: 179477 - DNA, 20 bp, Artificial Sequence
  chemically synthesized
aagtctctacttctgactca

SEQ ID NO: 179478 - DNA, 20 bp, Artificial Sequence
  chemically synthesized
gtctctacttctgactcaga

SEQ ID NO: 179479 - DNA, 20 bp, Artificial Sequence
  chemically synthesized
tctctttcatctctctgagt

SEQ ID NO: 179480 - DNA, 20 bp, Artificial Sequence
  chemically synthesized
tccttctctttcatctctct

SEQ ID NO: 179481 - DNA, 20 bp, Artificial Sequence
  chemically synthesized
cttctgactcagagagatga

SEQ ID NO: 179482 - DNA, 20 bp, Artificial Sequence
  chemically synthesized
tctgactcagagagatgaaa

SEQ ID NO: 179483 - DNA, 20 bp, Artificial Sequence
  chemically synthesized
gactcagagagatgaaagag

SEQ ID NO: 179484 - DNA, 20 bp, Artificial Sequence
  chemically synthesized
actcagagagatgaaagaga

SEQ ID NO: 179485 - DNA, 20 bp, Artificial Sequence
  chemically synthesized
gtgcagtttgtggtaaggga

SEQ ID NO: 179486 - DNA, 20 bp, Artificial Sequence
  chemically synthesized
gggagtgcagtttgtggtaa

SEQ ID NO: 179487 - DNA, 20 bp, Artificial Sequence
  chemically synthesized
ggggagtgcagtttgtggta

SEQ ID NO: 179488 - DNA, 20 bp, Artificial Sequence
  chemically synthesized
tggggagtgcagtttgtggt

SEQ ID NO: 179489 - DNA, 20 bp, Artificial Sequence
  chemically synthesized
tttgtggggagtgcagtttg

SEQ ID NO: 179490 - DNA, 20 bp, Artificial Sequence
  chemically synthesized
agtaagctttgtggggagtg

SEQ ID NO: 179491 - DNA, 20 bp, Artificial Sequence
  chemically synthesized
cacaaactgcactccccaca

SEQ ID NO: 179492 - DNA, 20 bp, Artificial Sequence
  chemically synthesized
ggggtagtaagctttgtggg

SEQ ID NO: 179493 - DNA, 20 bp, Artificial Sequence
  chemically synthesized
aaggggtagtaagctttgtg

SEQ ID NO: 179494 - DNA, 20 bp, Artificial Sequence
  chemically synthesized
gaaggggtagtaagctttgt

SEQ ID NO: 179495 - DNA, 20 bp, Artificial Sequence
  chemically synthesized
ggaaggggtagtaagctttg

SEQ ID NO: 179496 - DNA, 20 bp, Artificial Sequence
  chemically synthesized
ctcaggtaggaaggggtagt

SEQ ID NO: 179497 - DNA, 20 bp, Artificial Sequence
  chemically synthesized
aagactcaggtaggaagggg

SEQ ID NO: 179498 - DNA, 20 bp, Artificial Sequence
  chemically synthesized
aaaaagactcaggtaggaag

SEQ ID NO: 179499 - DNA, 20 bp, Artificial Sequence
  chemically synthesized
taaaaagactcaggtaggaa

SEQ ID NO: 179500 - DNA, 20 bp, Artificial Sequence
  chemically synthesized
ttaaaaagactcaggtagga

SEQ ID NO: 179501 - DNA, 20 bp, Artificial Sequence
  chemically synthesized
cttactaccccttcctacct

SEQ ID NO: 179502 - DNA, 20 bp, Artificial Sequence
  chemically synthesized
attaaaaagactcaggtagg

SEQ ID NO: 179503 - DNA, 20 bp, Artificial Sequence
  chemically synthesized
aagattaaaaagactcaggt

SEQ ID NO: 179504 - DNA, 20 bp, Artificial Sequence
  chemically synthesized
caagattaaaaagactcagg

SEQ ID NO: 179505 - DNA, 20 bp, Artificial Sequence
  chemically synthesized
aggcaagattaaaaagactc

SEQ ID NO: 179506 - DNA, 20 bp, Artificial Sequence
  chemically synthesized
caggcaagattaaaaagact

SEQ ID NO: 179507 - DNA, 20 bp, Artificial Sequence
  chemically synthesized
gtgtcccaggcaagattaaa

SEQ ID NO: 179508 - DNA, 20 bp, Artificial Sequence
  chemically synthesized
tgagtctttttaatcttgcc

SEQ ID NO: 179509 - DNA, 20 bp, Artificial Sequence
  chemically synthesized
gagtctttttaatcttgcct

SEQ ID NO: 179510 - DNA, 20 bp, Artificial Sequence
  chemically synthesized
ctgtactccgtgtcccaggc

SEQ ID NO: 179511 - DNA, 20 bp, Artificial Sequence
  chemically synthesized
ttttaatcttgcctgggaca

SEQ ID NO: 179512 - DNA, 20 bp, Artificial Sequence
  chemically synthesized
tcctctgtactccgtgtccc

SEQ ID NO: 179513 - DNA, 20 bp, Artificial Sequence
  chemically synthesized
ttaatcttgcctgggacacg

SEQ ID NO: 179514 - DNA, 20 bp, Artificial Sequence
  chemically synthesized
ctcctctgtactccgtgtcc

SEQ ID NO: 179515 - DNA, 20 bp, Artificial Sequence
  chemically synthesized
cttgcctgggacacggagta

SEQ ID NO: 179516 - DNA, 20 bp, Artificial Sequence
  chemically synthesized
tgcctgggacacggagtaca

SEQ ID NO: 179517 - DNA, 20 bp, Artificial Sequence
  chemically synthesized
gcctgggacacggagtacag

SEQ ID NO: 179518 - DNA, 20 bp, Artificial Sequence
  chemically synthesized
ctgggacacggagtacagag

SEQ ID NO: 179519 - DNA, 20 bp, Artificial Sequence
  chemically synthesized
acacggagtacagaggagat

SEQ ID NO: 179520 - DNA, 20 bp, Artificial Sequence
  chemically synthesized
agaggagattggaaattgct

SEQ ID NO: 179521 - DNA, 20 bp, Artificial Sequence
  chemically synthesized
agattggaaattgcttggaa

SEQ ID NO: 179522 - DNA, 20 bp, Artificial Sequence
  chemically synthesized
attggaaattgcttggaata

SEQ ID NO: 179523 - DNA, 20 bp, Artificial Sequence
  chemically synthesized
gggattattatctctattcc

SEQ ID NO: 179524 - DNA, 20 bp, Artificial Sequence
  chemically synthesized
gggtttactctaaagcaaca

SEQ ID NO: 179525 - DNA, 20 bp, Artificial Sequence
  chemically synthesized
gataataatccctgttgctt

SEQ ID NO: 179526 - DNA, 20 bp, Artificial Sequence
  chemically synthesized
agggtttactctaaagcaac

SEQ ID NO: 179527 - DNA, 20 bp, Artificial Sequence
  chemically synthesized
tagggtttactctaaagcaa

SEQ ID NO: 179528 - DNA, 20 bp, Artificial Sequence
  chemically synthesized
taataatccctgttgcttta

SEQ ID NO: 179529 - DNA, 20 bp, Artificial Sequence
  chemically synthesized
tccccatagggtttactcta

SEQ ID NO: 179530 - DNA, 20 bp, Artificial Sequence
  chemically synthesized
ttgctttagagtaaacccta

SEQ ID NO: 179531 - DNA, 20 bp, Artificial Sequence
  chemically synthesized
tgctttagagtaaaccctat

SEQ ID NO: 179532 - DNA, 20 bp, Artificial Sequence
  chemically synthesized
gctttagagtaaaccctatg

SEQ ID NO: 179533 - DNA, 20 bp, Artificial Sequence
  chemically synthesized
ttagagtaaaccctatgggg

SEQ ID NO: 179534 - DNA, 20 bp, Artificial Sequence
  chemically synthesized
agaccagccacttccccata

SEQ ID NO: 179535 - DNA, 20 bp, Artificial Sequence
  chemically synthesized
gagaccagccacttccccat

SEQ ID NO: 179536 - DNA, 20 bp, Artificial Sequence
  chemically synthesized
cgagaccagccacttcccca

SEQ ID NO: 179537 - DNA, 20 bp, Artificial Sequence
  chemically synthesized
gagtaaaccctatggggaag

SEQ ID NO: 179538 - DNA, 20 bp, Artificial Sequence
  chemically synthesized
aaaccctatggggaagtggc

SEQ ID NO: 179539 - DNA, 20 bp, Artificial Sequence
  chemically synthesized
aaactgccagcaatcgagac

SEQ ID NO: 179540 - DNA, 20 bp, Artificial Sequence
  chemically synthesized
aagtggctggtctcgattgc

SEQ ID NO: 179541 - DNA, 20 bp, Artificial Sequence
  chemically synthesized
aaaacaaactgccagcaatc

SEQ ID NO: 179542 - DNA, 20 bp, Artificial Sequence
  chemically synthesized
tggctggtctcgattgctgg

SEQ ID NO: 179543 - DNA, 20 bp, Artificial Sequence
  chemically synthesized
cacattctaaaacaaactgc

SEQ ID NO: 179544 - DNA, 20 bp, Artificial Sequence
  chemically synthesized
cgattgctggcagtttgttt

SEQ ID NO: 179545 - DNA, 20 bp, Artificial Sequence
  chemically synthesized
tggcagtttgttttagaatg

SEQ ID NO: 179546 - DNA, 20 bp, Artificial Sequence
  chemically synthesized
gtttgttttagaatgtggaa

SEQ ID NO: 179547 - DNA, 20 bp, Artificial Sequence
  chemically synthesized
ggtcagaatctgaggggaaa

SEQ ID NO: 179548 - DNA, 20 bp, Artificial Sequence
  chemically synthesized
ggaacagcaccatttcccct

SEQ ID NO: 179549 - DNA, 20 bp, Artificial Sequence
  chemically synthesized
ttctaaggtcagaatctgag

SEQ ID NO: 179550 - DNA, 20 bp, Artificial Sequence
  chemically synthesized
attctaaggtcagaatctga

SEQ ID NO: 179551 - DNA, 20 bp, Artificial Sequence
  chemically synthesized
gattctaaggtcagaatctg

SEQ ID NO: 179552 - DNA, 20 bp, Artificial Sequence
  chemically synthesized
tgattctaaggtcagaatct

SEQ ID NO: 179553 - DNA, 20 bp, Artificial Sequence
  chemically synthesized
ttcccctcagattctgacct

SEQ ID NO: 179554 - DNA, 20 bp, Artificial Sequence
  chemically synthesized
tccacaattgattctaaggt

SEQ ID NO: 179555 - DNA, 20 bp, Artificial Sequence
  chemically synthesized
ttcttccacaattgattcta

SEQ ID NO: 179556 - DNA, 20 bp, Artificial Sequence
  chemically synthesized
cttcttccacaattgattct

SEQ ID NO: 179557 - DNA, 20 bp, Artificial Sequence
  chemically synthesized
tctgaccttagaatcaattg

SEQ ID NO: 179558 - DNA, 20 bp, Artificial Sequence
  chemically synthesized
gaccttagaatcaattgtgg

SEQ ID NO: 179559 - DNA, 20 bp, Artificial Sequence
  chemically synthesized
cttagaatcaattgtggaag

SEQ ID NO: 179560 - DNA, 20 bp, Artificial Sequence
  chemically synthesized
ttgtggaagaagaaaacgtc

SEQ ID NO: 179561 - DNA, 20 bp, Artificial Sequence
  chemically synthesized
gaagaagaaaacgtctagta

SEQ ID NO: 179562 - DNA, 20 bp, Artificial Sequence
  chemically synthesized
aaaggatgcctgtactatac

SEQ ID NO: 179563 - DNA, 20 bp, Artificial Sequence
  chemically synthesized
agaaaacgtctagtatagta

SEQ ID NO: 179564 - DNA, 20 bp, Artificial Sequence
  chemically synthesized
gaaaacgtctagtatagtac

SEQ ID NO: 179565 - DNA, 20 bp, Artificial Sequence
  chemically synthesized
tggaacatttaaacaaataa

SEQ ID NO: 179566 - DNA, 20 bp, Artificial Sequence
  chemically synthesized
ttggaacatttaaacaaata

SEQ ID NO: 179567 - DNA, 20 bp, Artificial Sequence
  chemically synthesized
tttatttgtttaaatgttcc

SEQ ID NO: 179568 - DNA, 20 bp, Artificial Sequence
  chemically synthesized
atttgtttaaatgttccaag

SEQ ID NO: 179569 - DNA, 20 bp, Artificial Sequence
  chemically synthesized
cccaaggaattaaatctgct

SEQ ID NO: 179570 - DNA, 20 bp, Artificial Sequence
  chemically synthesized
tccaagcagatttaattcct

SEQ ID NO: 179571 - DNA, 20 bp, Artificial Sequence
  chemically synthesized
ccaagcagatttaattcctt

SEQ ID NO: 179572 - DNA, 20 bp, Artificial Sequence
  chemically synthesized
cagatttaattccttgggtc

SEQ ID NO: 179573 - DNA, 20 bp, Artificial Sequence
  chemically synthesized
accctcaaaatctagaccca

SEQ ID NO: 179574 - DNA, 20 bp, Artificial Sequence
  chemically synthesized
gaccctcaaaatctagaccc

SEQ ID NO: 179575 - DNA, 20 bp, Artificial Sequence
  chemically synthesized
attccttgggtctagatttt

SEQ ID NO: 179576 - DNA, 20 bp, Artificial Sequence
  chemically synthesized
ttccttgggtctagattttg

SEQ ID NO: 179577 - DNA, 20 bp, Artificial Sequence
  chemically synthesized
tgagatagaccctcaaaatc

SEQ ID NO: 179578 - DNA, 20 bp, Artificial Sequence
  chemically synthesized
tccttgggtctagattttga

SEQ ID NO: 179579 - DNA, 20 bp, Artificial Sequence
  chemically synthesized
agagagagaaaaagatgaga

SEQ ID NO: 179580 - DNA, 20 bp, Artificial Sequence
  chemically synthesized
acagagagagagaaaaagat

SEQ ID NO: 179581 - DNA, 20 bp, Artificial Sequence
  chemically synthesized
tagaaacagagagagagaaa

SEQ ID NO: 179582 - DNA, 20 bp, Artificial Sequence
  chemically synthesized
gcagagtagaaacagagaga

SEQ ID NO: 179583 - DNA, 20 bp, Artificial Sequence
  chemically synthesized
ttgcagagtagaaacagaga

SEQ ID NO: 179584 - DNA, 20 bp, Artificial Sequence
  chemically synthesized
atttgcagagtagaaacaga

SEQ ID NO: 179585 - DNA, 20 bp, Artificial Sequence
  chemically synthesized
tgatttgcagagtagaaaca

SEQ ID NO: 179586 - DNA, 20 bp, Artificial Sequence
  chemically synthesized
aatgatttgcagagtagaaa

SEQ ID NO: 179587 - DNA, 20 bp, Artificial Sequence
  chemically synthesized
ggaggcaatgatttgcagag

SEQ ID NO: 179588 - DNA, 20 bp, Artificial Sequence
  chemically synthesized
aatggaggcaatgatttgca

SEQ ID NO: 179589 - DNA, 20 bp, Artificial Sequence
  chemically synthesized
gtaatggaggcaatgatttg

SEQ ID NO: 179590 - DNA, 20 bp, Artificial Sequence
  chemically synthesized
ctggagtcaaatagtaatgg

SEQ ID NO: 179591 - DNA, 20 bp, Artificial Sequence
  chemically synthesized
tctggagtcaaatagtaatg

SEQ ID NO: 179592 - DNA, 20 bp, Artificial Sequence
  chemically synthesized
catctggagtcaaatagtaa

SEQ ID NO: 179593 - DNA, 20 bp, Artificial Sequence
  chemically synthesized
caaaatcatctggagtcaaa

SEQ ID NO: 179594 - DNA, 20 bp, Artificial Sequence
  chemically synthesized
cctccattactatttgactc

SEQ ID NO: 179595 - DNA, 20 bp, Artificial Sequence
  chemically synthesized
acactgtgcaaaatcatctg

SEQ ID NO: 179596 - DNA, 20 bp, Artificial Sequence
  chemically synthesized
gaacactgtgcaaaatcatc

SEQ ID NO: 179597 - DNA, 20 bp, Artificial Sequence
  chemically synthesized
tgactccagatgattttgca

SEQ ID NO: 179598 - DNA, 20 bp, Artificial Sequence
  chemically synthesized
tttacttaactaaaagtatt

SEQ ID NO: 179599 - DNA, 20 bp, Artificial Sequence
  chemically synthesized
cacagtgttctgaatacttt

SEQ ID NO: 179600 - DNA, 20 bp, Artificial Sequence
  chemically synthesized
tgttctgaatacttttagtt

SEQ ID NO: 179601 - DNA, 20 bp, Artificial Sequence
  chemically synthesized
gcaagattttacttaactaa

SEQ ID NO: 179602 - DNA, 20 bp, Artificial Sequence
  chemically synthesized
aaatgtaatcagattttagc

SEQ ID NO: 179603 - DNA, 20 bp, Artificial Sequence
  chemically synthesized
tttcaaatgtaatcagattt

SEQ ID NO: 179604 - DNA, 20 bp, Artificial Sequence
  chemically synthesized
ctaggtttttcaaatgtaat

SEQ ID NO: 179605 - DNA, 20 bp, Artificial Sequence
  chemically synthesized
ctgattacatttgaaaaacc

SEQ ID NO: 179606 - DNA, 20 bp, Artificial Sequence
  chemically synthesized
aaagccttgccaatgtgtct

SEQ ID NO: 179607 - DNA, 20 bp, Artificial Sequence
  chemically synthesized
tttgaaaaacctagacacat

SEQ ID NO: 179608 - DNA, 20 bp, Artificial Sequence
  chemically synthesized
aaaagccttgccaatgtgtc

SEQ ID NO: 179609 - DNA, 20 bp, Artificial Sequence
  chemically synthesized
aaaaacctagacacattggc

SEQ ID NO: 179610 - DNA, 20 bp, Artificial Sequence
  chemically synthesized
aaaacctagacacattggca

SEQ ID NO: 179611 - DNA, 20 bp, Artificial Sequence
  chemically synthesized
tgaaagttgaaaatgtttaa

SEQ ID NO: 179612 - DNA, 20 bp, Artificial Sequence
  chemically synthesized
aaacattttcaactttcatc

SEQ ID NO: 179613 - DNA, 20 bp, Artificial Sequence
  chemically synthesized
acgtgtctgcttctagatga

SEQ ID NO: 179614 - DNA, 20 bp, Artificial Sequence
  chemically synthesized
cattttcaactttcatctag

SEQ ID NO: 179615 - DNA, 20 bp, Artificial Sequence
  chemically synthesized
tttcaactttcatctagaag

SEQ ID NO: 179616 - DNA, 20 bp, Artificial Sequence
  chemically synthesized
tccttaaacgtgtctgcttc

SEQ ID NO: 179617 - DNA, 20 bp, Artificial Sequence
  chemically synthesized
atctagaagcagacacgttt

SEQ ID NO: 179618 - DNA, 20 bp, Artificial Sequence
  chemically synthesized
tctagaagcagacacgttta

SEQ ID NO: 179619 - DNA, 20 bp, Artificial Sequence
  chemically synthesized
aagcagacacgtttaaggaa

SEQ ID NO: 179620 - DNA, 20 bp, Artificial Sequence
  chemically synthesized
ttgtttgtttggggggtttg

SEQ ID NO: 179621 - DNA, 20 bp, Artificial Sequence
  chemically synthesized
tttgtttgtttggggggttt

SEQ ID NO: 179622 - DNA, 20 bp, Artificial Sequence
  chemically synthesized
ttttgtttgtttggggggtt

SEQ ID NO: 179623 - DNA, 20 bp, Artificial Sequence
  chemically synthesized
taaatttttgtttgtttggg

SEQ ID NO: 179624 - DNA, 20 bp, Artificial Sequence
  chemically synthesized
ttaaatttttgtttgtttgg

SEQ ID NO: 179625 - DNA, 20 bp, Artificial Sequence
  chemically synthesized
cttaaatttttgtttgtttg

SEQ ID NO: 179626 - DNA, 20 bp, Artificial Sequence
  chemically synthesized
ccttaaatttttgtttgttt

SEQ ID NO: 179627 - DNA, 20 bp, Artificial Sequence
  chemically synthesized
tccttaaatttttgtttgtt

SEQ ID NO: 179628 - DNA, 20 bp, Artificial Sequence
  chemically synthesized
ccccaaacaaacaaaaattt

SEQ ID NO: 179629 - DNA, 20 bp, Artificial Sequence
  chemically synthesized
cccaaacaaacaaaaattta

SEQ ID NO: 179630 - DNA, 20 bp, Artificial Sequence
  chemically synthesized
caaacaaacaaaaatttaag

SEQ ID NO: 179631 - DNA, 20 bp, Artificial Sequence
  chemically synthesized
acaaacaaaaatttaaggag

SEQ ID NO: 179632 - DNA, 20 bp, Artificial Sequence
  chemically synthesized
caaacaaaaatttaaggagc

SEQ ID NO: 179633 - DNA, 20 bp, Artificial Sequence
  chemically synthesized
aaaatttaaggagcaggaaa

SEQ ID NO: 179634 - DNA, 20 bp, Artificial Sequence
  chemically synthesized
gagggttattattatttttt

SEQ ID NO: 179635 - DNA, 20 bp, Artificial Sequence
  chemically synthesized
aaaaaataataataaccctc

SEQ ID NO: 179636 - DNA, 20 bp, Artificial Sequence
  chemically synthesized
ataataataaccctcaagtt

SEQ ID NO: 179637 - DNA, 20 bp, Artificial Sequence
  chemically synthesized
ttagaattttctaaacttga

SEQ ID NO: 179638 - DNA, 20 bp, Artificial Sequence
  chemically synthesized
tttagaattttctaaacttg

SEQ ID NO: 179639 - DNA, 20 bp, Artificial Sequence
  chemically synthesized
atttagaattttctaaactt

SEQ ID NO: 179640 - DNA, 20 bp, Artificial Sequence
  chemically synthesized
aaagaggggagtgtttgatt

SEQ ID NO: 179641 - DNA, 20 bp, Artificial Sequence
  chemically synthesized
agacatatttgaaaagaggg

SEQ ID NO: 179642 - DNA, 20 bp, Artificial Sequence
  chemically synthesized
tgagacatatttgaaaagag

SEQ ID NO: 179643 - DNA, 20 bp, Artificial Sequence
  chemically synthesized
ttgagacatatttgaaaaga

SEQ ID NO: 179644 - DNA, 20 bp, Artificial Sequence
  chemically synthesized
tttgagacatatttgaaaag

SEQ ID NO: 179645 - DNA, 20 bp, Artificial Sequence
  chemically synthesized
atttgagacatatttgaaaa

SEQ ID NO: 179646 - DNA, 20 bp, Artificial Sequence
  chemically synthesized
taatttgagacatatttgaa

SEQ ID NO: 179647 - DNA, 20 bp, Artificial Sequence
  chemically synthesized
aatatgctagtaaataattt

SEQ ID NO: 179648 - DNA, 20 bp, Artificial Sequence
  chemically synthesized
atatgtctcaaattatttac

SEQ ID NO: 179649 - DNA, 20 bp, Artificial Sequence
  chemically synthesized
cttgatagaaaaaaatatgc

SEQ ID NO: 179650 - DNA, 20 bp, Artificial Sequence
  chemically synthesized
ctagcatatttttttctatc

SEQ ID NO: 179651 - DNA, 20 bp, Artificial Sequence
  chemically synthesized
tctgtactggatattcttga

SEQ ID NO: 179652 - DNA, 20 bp, Artificial Sequence
  chemically synthesized
ttttttctatcaagaatatc

SEQ ID NO: 179653 - DNA, 20 bp, Artificial Sequence
  chemically synthesized
tctatcaagaatatccagta

SEQ ID NO: 179654 - DNA, 20 bp, Artificial Sequence
  chemically synthesized
tatcaagaatatccagtaca

SEQ ID NO: 179655 - DNA, 20 bp, Artificial Sequence
  chemically synthesized
atcaagaatatccagtacag

SEQ ID NO: 179656 - DNA, 20 bp, Artificial Sequence
  chemically synthesized
acaacatctctcctctgtac

SEQ ID NO: 179657 - DNA, 20 bp, Artificial Sequence
  chemically synthesized
caagaatatccagtacagag

SEQ ID NO: 179658 - DNA, 20 bp, Artificial Sequence
  chemically synthesized
agaatatccagtacagagga

SEQ ID NO: 179659 - DNA, 20 bp, Artificial Sequence
  chemically synthesized
aaatctcaactatgatgaat

SEQ ID NO: 179660 - DNA, 20 bp, Artificial Sequence
  chemically synthesized
gatgttgtgcttattcatca

SEQ ID NO: 179661 - DNA, 20 bp, Artificial Sequence
  chemically synthesized
tgtgcttattcatcatagtt

SEQ ID NO: 179662 - DNA, 20 bp, Artificial Sequence
  chemically synthesized
ttgagatttatatgtattac

SEQ ID NO: 179663 - DNA, 20 bp, Artificial Sequence
  chemically synthesized
tgagatttatatgtattact

SEQ ID NO: 179664 - DNA, 20 bp, Artificial Sequence
  chemically synthesized
tacaatatagggtttgaacc

SEQ ID NO: 179665 - DNA, 20 bp, Artificial Sequence
  chemically synthesized
gaaaataagcatacaatata

SEQ ID NO: 179666 - DNA, 20 bp, Artificial Sequence
  chemically synthesized
agaaaataagcatacaatat

SEQ ID NO: 179667 - DNA, 20 bp, Artificial Sequence
  chemically synthesized
aagaaaataagcatacaata

SEQ ID NO: 179668 - DNA, 20 bp, Artificial Sequence
  chemically synthesized
gaataataaatgaagaaaat

SEQ ID NO: 179669 - DNA, 20 bp, Artificial Sequence
  chemically synthesized
acatagtagaataataaatg

SEQ ID NO: 179670 - DNA, 20 bp, Artificial Sequence
  chemically synthesized
tgacctacagagacacatag

SEQ ID NO: 179671 - DNA, 20 bp, Artificial Sequence
  chemically synthesized
taatgacctacagagacaca

SEQ ID NO: 179672 - DNA, 20 bp, Artificial Sequence
  chemically synthesized
tattctactatgtgtctctg

SEQ ID NO: 179673 - DNA, 20 bp, Artificial Sequence
  chemically synthesized
attctactatgtgtctctgt

SEQ ID NO: 179674 - DNA, 20 bp, Artificial Sequence
  chemically synthesized
agcgtaattaatgacctaca

SEQ ID NO: 179675 - DNA, 20 bp, Artificial Sequence
  chemically synthesized
aaagcgtaattaatgaccta

SEQ ID NO: 179676 - DNA, 20 bp, Artificial Sequence
  chemically synthesized
cttaaaaaatcaagttttta

SEQ ID NO: 179677 - DNA, 20 bp, Artificial Sequence
  chemically synthesized
tactaggatcttaaaaaatc

SEQ ID NO: 179678 - DNA, 20 bp, Artificial Sequence
  chemically synthesized
ctttaaaaacttgatttttt

SEQ ID NO: 179679 - DNA, 20 bp, Artificial Sequence
  chemically synthesized
aacttgattttttaagatcc

SEQ ID NO: 179680 - DNA, 20 bp, Artificial Sequence
  chemically synthesized
ttttttaagatcctagtaat

SEQ ID NO: 179681 - DNA, 20 bp, Artificial Sequence
  chemically synthesized
cccctatatatcttattact

SEQ ID NO: 179682 - DNA, 20 bp, Artificial Sequence
  chemically synthesized
acccctatatatcttattac

SEQ ID NO: 179683 - DNA, 20 bp, Artificial Sequence
  chemically synthesized
gatcctagtaataagatata

SEQ ID NO: 179684 - DNA, 20 bp, Artificial Sequence
  chemically synthesized
atcctagtaataagatatat

SEQ ID NO: 179685 - DNA, 20 bp, Artificial Sequence
  chemically synthesized
tcctagtaataagatatata

SEQ ID NO: 179686 - DNA, 20 bp, Artificial Sequence
  chemically synthesized
cctagtaataagatatatag

SEQ ID NO: 179687 - DNA, 20 bp, Artificial Sequence
  chemically synthesized
cacaataatggtgaaatata

SEQ ID NO: 179688 - DNA, 20 bp, Artificial Sequence
  chemically synthesized
acacaataatggtgaaatat

SEQ ID NO: 179689 - DNA, 20 bp, Artificial Sequence
  chemically synthesized
aacacaataatggtgaaata

SEQ ID NO: 179690 - DNA, 20 bp, Artificial Sequence
  chemically synthesized
aattcctaataacacaataa

SEQ ID NO: 179691 - DNA, 20 bp, Artificial Sequence
  chemically synthesized
tttcaccattattgtgttat

SEQ ID NO: 179692 - DNA, 20 bp, Artificial Sequence
  chemically synthesized
ttcaccattattgtgttatt

SEQ ID NO: 179693 - DNA, 20 bp, Artificial Sequence
  chemically synthesized
ttcattataataaaaaatga

SEQ ID NO: 179694 - DNA, 20 bp, Artificial Sequence
  chemically synthesized
aaataaatgtgtttattgta

SEQ ID NO: 179695 - DNA, 20 bp, Artificial Sequence
  chemically synthesized
taaataaatgtgtttattgt

SEQ ID NO: 179696 - DNA, 20 bp, Artificial Sequence
  chemically synthesized
ataaataaatgtgtttattg

SEQ ID NO: 179697 - DNA, 20 bp, Artificial Sequence
  chemically synthesized
attttgaatcatgtatctgc

SEQ ID NO: 179698 - DNA, 20 bp, Artificial Sequence
  chemically synthesized
aatcatgtatctgctggaat

SEQ ID NO: 179699 - DNA, 20 bp, Artificial Sequence
  chemically synthesized
acttttcattctcattccag

SEQ ID NO: 179700 - DNA, 20 bp, Artificial Sequence
  chemically synthesized
ttaacttttcattctcattc

SEQ ID NO: 179701 - DNA, 20 bp, Artificial Sequence
  chemically synthesized
tctgctggaatgagaatgaa

SEQ ID NO: 179702 - DNA, 20 bp, Artificial Sequence
  chemically synthesized
tgagaatgaaaagttaacaa

SEQ ID NO: 179703 - DNA, 20 bp, Artificial Sequence
  chemically synthesized
gagaatgaaaagttaacaat

SEQ ID NO: 179704 - DNA, 20 bp, Artificial Sequence
  chemically synthesized
aagttaacaatgggaatcct

SEQ ID NO: 179705 - DNA, 20 bp, Artificial Sequence
  chemically synthesized
agttaacaatgggaatccta

SEQ ID NO: 179706 - DNA, 20 bp, Artificial Sequence
  chemically synthesized
caatgggaatcctaaggatt

SEQ ID NO: 179707 - DNA, 20 bp, Artificial Sequence
  chemically synthesized
caatgtgtatctaaatcctt

SEQ ID NO: 179708 - DNA, 20 bp, Artificial Sequence
  chemically synthesized
acaatgtgtatctaaatcct

SEQ ID NO: 179709 - DNA, 20 bp, Artificial Sequence
  chemically synthesized
cacattgttgaatttctgtc

SEQ ID NO: 179710 - DNA, 20 bp, Artificial Sequence
  chemically synthesized
acattgttgaatttctgtca

SEQ ID NO: 179711 - DNA, 20 bp, Artificial Sequence
  chemically synthesized
tgttgaatttctgtcaaggt

SEQ ID NO: 179712 - DNA, 20 bp, Artificial Sequence
  chemically synthesized
gttctgagtaccaaccttga

SEQ ID NO: 179713 - DNA, 20 bp, Artificial Sequence
  chemically synthesized
tttctgtcaaggttggtact

SEQ ID NO: 179714 - DNA, 20 bp, Artificial Sequence
  chemically synthesized
tgggagtttacgagtgttct

SEQ ID NO: 179715 - DNA, 20 bp, Artificial Sequence
  chemically synthesized
aactgttggtgggagtttac

SEQ ID NO: 179716 - DNA, 20 bp, Artificial Sequence
  chemically synthesized
cactcgtaaactcccaccaa

SEQ ID NO: 179717 - DNA, 20 bp, Artificial Sequence
  chemically synthesized
tattttgtaactgttggtgg

SEQ ID NO: 179718 - DNA, 20 bp, Artificial Sequence
  chemically synthesized
agtattttgtaactgttggt

SEQ ID NO: 179719 - DNA, 20 bp, Artificial Sequence
  chemically synthesized
aagtattttgtaactgttgg

SEQ ID NO: 179720 - DNA, 20 bp, Artificial Sequence
  chemically synthesized
gacaagtattttgtaactgt

SEQ ID NO: 179721 - DNA, 20 bp, Artificial Sequence
  chemically synthesized
tggcaaaagtgtagtgagac

SEQ ID NO: 179722 - DNA, 20 bp, Artificial Sequence
  chemically synthesized
aatagtggcaaaagtgtagt

SEQ ID NO: 179723 - DNA, 20 bp, Artificial Sequence
  chemically synthesized
gctcaatagtggcaaaagtg

SEQ ID NO: 179724 - DNA, 20 bp, Artificial Sequence
  chemically synthesized
ataatgctcaatagtggcaa

SEQ ID NO: 179725 - DNA, 20 bp, Artificial Sequence
  chemically synthesized
actacacttttgccactatt

SEQ ID NO: 179726 - DNA, 20 bp, Artificial Sequence
  chemically synthesized
tcaattataatgctcaatag

SEQ ID NO: 179727 - DNA, 20 bp, Artificial Sequence
  chemically synthesized
atatcaattataatgctcaa

SEQ ID NO: 179728 - DNA, 20 bp, Artificial Sequence
  chemically synthesized
aagctttttatttgttttat

SEQ ID NO: 179729 - DNA, 20 bp, Artificial Sequence
  chemically synthesized
ataccaataaaacaaataaa

SEQ ID NO: 179730 - DNA, 20 bp, Artificial Sequence
  chemically synthesized
aacaaataaaaagcttgcca

SEQ ID NO: 179731 - DNA, 20 bp, Artificial Sequence
  chemically synthesized
atacttaaaatatctatggc

SEQ ID NO: 179732 - DNA, 20 bp, Artificial Sequence
  chemically synthesized
tagaatacttaaaatatcta

SEQ ID NO: 179733 - DNA, 20 bp, Artificial Sequence
  chemically synthesized
aagcttgccatagatatttt

SEQ ID NO: 179734 - DNA, 20 bp, Artificial Sequence
  chemically synthesized
tattttaagtattctactaa

SEQ ID NO: 179735 - DNA, 20 bp, Artificial Sequence
  chemically synthesized
attttaagtattctactaat

SEQ ID NO: 179736 - DNA, 20 bp, Artificial Sequence
  chemically synthesized
attttcaactttcctattag

SEQ ID NO: 179737 - DNA, 20 bp, Artificial Sequence
  chemically synthesized
taagtattctactaatagga

SEQ ID NO: 179738 - DNA, 20 bp, Artificial Sequence
  chemically synthesized
aacattttcaactttcctat

SEQ ID NO: 179739 - DNA, 20 bp, Artificial Sequence
  chemically synthesized
gtacatgtttgtcatttatt

SEQ ID NO: 179740 - DNA, 20 bp, Artificial Sequence
  chemically synthesized
acattgccgataattgacag

SEQ ID NO: 179741 - DNA, 20 bp, Artificial Sequence
  chemically synthesized
cagacattgccgataattga

SEQ ID NO: 179742 - DNA, 20 bp, Artificial Sequence
  chemically synthesized
tagtttccactgtcaattat

SEQ ID NO: 179743 - DNA, 20 bp, Artificial Sequence
  chemically synthesized
aacacaggaaaaatgggcaa

SEQ ID NO: 179744 - DNA, 20 bp, Artificial Sequence
  chemically synthesized
taggaaaacacaggaaaaat

SEQ ID NO: 179745 - DNA, 20 bp, Artificial Sequence
  chemically synthesized
ataggaaaacacaggaaaaa

SEQ ID NO: 179746 - DNA, 20 bp, Artificial Sequence
  chemically synthesized
tcttaaaaataggaaaacac

SEQ ID NO: 179747 - DNA, 20 bp, Artificial Sequence
  chemically synthesized
ctcttaaaaataggaaaaca

SEQ ID NO: 179748 - DNA, 20 bp, Artificial Sequence
  chemically synthesized
tcctgtgttttcctattttt

SEQ ID NO: 179749 - DNA, 20 bp, Artificial Sequence
  chemically synthesized
tgaaaagagctcttaaaaat

SEQ ID NO: 179750 - DNA, 20 bp, Artificial Sequence
  chemically synthesized
ctgtgttttcctatttttaa

SEQ ID NO: 179751 - DNA, 20 bp, Artificial Sequence
  chemically synthesized
gtgaaaagagctcttaaaaa

SEQ ID NO: 179752 - DNA, 20 bp, Artificial Sequence
  chemically synthesized
tgtttcagataatgtgaaaa

SEQ ID NO: 179753 - DNA, 20 bp, Artificial Sequence
  chemically synthesized
tatgtttcagataatgtgaa

SEQ ID NO: 179754 - DNA, 20 bp, Artificial Sequence
  chemically synthesized
ttttcacattatctgaaaca

SEQ ID NO: 179755 - DNA, 20 bp, Artificial Sequence
  chemically synthesized
gtctcaattaatctatgttt

SEQ ID NO: 179756 - DNA, 20 bp, Artificial Sequence
  chemically synthesized
atctgaaacatagattaatt

SEQ ID NO: 179757 - DNA, 20 bp, Artificial Sequence
  chemically synthesized
attaattgagactacgtttc

SEQ ID NO: 179758 - DNA, 20 bp, Artificial Sequence
  chemically synthesized
caaaaaggaagctggaaacg

SEQ ID NO: 179759 - DNA, 20 bp, Artificial Sequence
  chemically synthesized
ctaaaaggcaaaaaggaagc

SEQ ID NO: 179760 - DNA, 20 bp, Artificial Sequence
  chemically synthesized
actactaaaaggcaaaaagg

SEQ ID NO: 179761 - DNA, 20 bp, Artificial Sequence
  chemically synthesized
aaaactactaaaaggcaaaa

SEQ ID NO: 179762 - DNA, 20 bp, Artificial Sequence
  chemically synthesized
aaaaactactaaaaggcaaa

SEQ ID NO: 179763 - DNA, 20 bp, Artificial Sequence
  chemically synthesized
ccagcttcctttttgccttt

SEQ ID NO: 179764 - DNA, 20 bp, Artificial Sequence
  chemically synthesized
gcttcctttttgccttttag

SEQ ID NO: 179765 - DNA, 20 bp, Artificial Sequence
  chemically synthesized
atttagaaaaaactactaaa

SEQ ID NO: 179766 - DNA, 20 bp, Artificial Sequence
  chemically synthesized
tatttagaaaaaactactaa

SEQ ID NO: 179767 - DNA, 20 bp, Artificial Sequence
  chemically synthesized
ataaactgttaaattttatt

SEQ ID NO: 179768 - DNA, 20 bp, Artificial Sequence
  chemically synthesized
tttttctaaataaaatttaa

SEQ ID NO: 179769 - DNA, 20 bp, Artificial Sequence
  chemically synthesized
tatcaatgaacataatatca

SEQ ID NO: 179770 - DNA, 20 bp, Artificial Sequence
  chemically synthesized
tttgatattatgttcattga

SEQ ID NO: 179771 - DNA, 20 bp, Artificial Sequence
  chemically synthesized
gtaaaatggccacaatttta

SEQ ID NO: 179772 - DNA, 20 bp, Artificial Sequence
  chemically synthesized
tgatagtatccttaaaattg

SEQ ID NO: 179773 - DNA, 20 bp, Artificial Sequence
  chemically synthesized
ggtaaaatggccacaatttt

SEQ ID NO: 179774 - DNA, 20 bp, Artificial Sequence
  chemically synthesized
atatctgaacaatggtaaaa

SEQ ID NO: 179775 - DNA, 20 bp, Artificial Sequence
  chemically synthesized
gtggccattttaccattgtt

SEQ ID NO: 179776 - DNA, 20 bp, Artificial Sequence
  chemically synthesized
aaatgagaatatctgaacaa

SEQ ID NO: 179777 - DNA, 20 bp, Artificial Sequence
  chemically synthesized
gtaaaggatcaagaataaat

SEQ ID NO: 179778 - DNA, 20 bp, Artificial Sequence
  chemically synthesized
aaatgaaagagtaaaggatc

SEQ ID NO: 179779 - DNA, 20 bp, Artificial Sequence
  chemically synthesized
tttaacaaatgaaagagtaa

SEQ ID NO: 179780 - DNA, 20 bp, Artificial Sequence
  chemically synthesized
ttttaacaaatgaaagagta

SEQ ID NO: 179781 - DNA, 20 bp, Artificial Sequence
  chemically synthesized
ttcttttttaacaaatgaaa

SEQ ID NO: 179782 - DNA, 20 bp, Artificial Sequence
  chemically synthesized
tgttcttttttaacaaatga

SEQ ID NO: 179783 - DNA, 20 bp, Artificial Sequence
  chemically synthesized
tactctttcatttgttaaaa

SEQ ID NO: 179784 - DNA, 20 bp, Artificial Sequence
  chemically synthesized
tttaagatggattaaatatt

SEQ ID NO: 179785 - DNA, 20 bp, Artificial Sequence
  chemically synthesized
aacactatataaatttaaga

SEQ ID NO: 179786 - DNA, 20 bp, Artificial Sequence
  chemically synthesized
aaacaacactatataaattt

SEQ ID NO: 179787 - DNA, 20 bp, Artificial Sequence
  chemically synthesized
taatccatcttaaatttata

SEQ ID NO: 179788 - DNA, 20 bp, Artificial Sequence
  chemically synthesized
tagtgttgtttctaaccttg

SEQ ID NO: 179789 - DNA, 20 bp, Artificial Sequence
  chemically synthesized
tctgaaaaactcttcaaggt

SEQ ID NO: 179790 - DNA, 20 bp, Artificial Sequence
  chemically synthesized
gtgttgtttctaaccttgaa

SEQ ID NO: 179791 - DNA, 20 bp, Artificial Sequence
  chemically synthesized
agtttctgaaaaactcttca

SEQ ID NO: 179792 - DNA, 20 bp, Artificial Sequence
  chemically synthesized
cagtttctgaaaaactcttc

SEQ ID NO: 179793 - DNA, 20 bp, Artificial Sequence
  chemically synthesized
tctaaccttgaagagttttt

SEQ ID NO: 179794 - DNA, 20 bp, Artificial Sequence
  chemically synthesized
ggtgctgggggaaaaaatat

SEQ ID NO: 179795 - DNA, 20 bp, Artificial Sequence
  chemically synthesized
gaaactgatattttttcccc

SEQ ID NO: 179796 - DNA, 20 bp, Artificial Sequence
  chemically synthesized
ttcagaagagatggtgctgg

SEQ ID NO: 179797 - DNA, 20 bp, Artificial Sequence
  chemically synthesized
attcagaagagatggtgctg

SEQ ID NO: 179798 - DNA, 20 bp, Artificial Sequence
  chemically synthesized
aattcagaagagatggtgct

SEQ ID NO: 179799 - DNA, 20 bp, Artificial Sequence
  chemically synthesized
caattcagaagagatggtgc

SEQ ID NO: 179800 - DNA, 20 bp, Artificial Sequence
  chemically synthesized
ataaatcaattcagaagaga

SEQ ID NO: 179801 - DNA, 20 bp, Artificial Sequence
  chemically synthesized
caccataaatcaattcagaa

SEQ ID NO: 179802 - DNA, 20 bp, Artificial Sequence
  chemically synthesized
agcaccataaatcaattcag

SEQ ID NO: 179803 - DNA, 20 bp, Artificial Sequence
  chemically synthesized
gaaagcaccataaatcaatt

SEQ ID NO: 179804 - DNA, 20 bp, Artificial Sequence
  chemically synthesized
atctcttctgaattgattta

SEQ ID NO: 179805 - DNA, 20 bp, Artificial Sequence
  chemically synthesized
aacttaaaatatcatgaaga

SEQ ID NO: 179806 - DNA, 20 bp, Artificial Sequence
  chemically synthesized
cagaaacttaaaatatcatg

SEQ ID NO: 179807 - DNA, 20 bp, Artificial Sequence
  chemically synthesized
tgctttcttcatgatatttt

SEQ ID NO: 179808 - DNA, 20 bp, Artificial Sequence
  chemically synthesized
atctacagtagatcaacaag

SEQ ID NO: 179809 - DNA, 20 bp, Artificial Sequence
  chemically synthesized
aaaatctacagtagatcaac

SEQ ID NO: 179810 - DNA, 20 bp, Artificial Sequence
  chemically synthesized
ttctgcttgttgatctactg

SEQ ID NO: 179811 - DNA, 20 bp, Artificial Sequence
  chemically synthesized
actgtcacaaaaatctacag

SEQ ID NO: 179812 - DNA, 20 bp, Artificial Sequence
  chemically synthesized
attactgtcacaaaaatcta

SEQ ID NO: 179813 - DNA, 20 bp, Artificial Sequence
  chemically synthesized
tctactgtagatttttgtga

SEQ ID NO: 179814 - DNA, 20 bp, Artificial Sequence
  chemically synthesized
taaagctgcaataattgaca

SEQ ID NO: 179815 - DNA, 20 bp, Artificial Sequence
  chemically synthesized
atgcactatgtcaattattg

SEQ ID NO: 179816 - DNA, 20 bp, Artificial Sequence
  chemically synthesized
cagaaattaaacatatttta

SEQ ID NO: 179817 - DNA, 20 bp, Artificial Sequence
  chemically synthesized
tttaaaatatgtttaatttc

SEQ ID NO: 179818 - DNA, 20 bp, Artificial Sequence
  chemically synthesized
aaaatatgtttaatttctgg

SEQ ID NO: 179819 - DNA, 20 bp, Artificial Sequence
  chemically synthesized
aaatatgtttaatttctggt

SEQ ID NO: 179820 - DNA, 20 bp, Artificial Sequence
  chemically synthesized
gggagagcgggttaacctac

SEQ ID NO: 179821 - DNA, 20 bp, Artificial Sequence
  chemically synthesized
aataactaaagtgggagagc

SEQ ID NO: 179822 - DNA, 20 bp, Artificial Sequence
  chemically synthesized
gaataactaaagtgggagag

SEQ ID NO: 179823 - DNA, 20 bp, Artificial Sequence
  chemically synthesized
ttagaataactaaagtggga

SEQ ID NO: 179824 - DNA, 20 bp, Artificial Sequence
  chemically synthesized
gttaacccgctctcccactt

SEQ ID NO: 179825 - DNA, 20 bp, Artificial Sequence
  chemically synthesized
agttagaataactaaagtgg

SEQ ID NO: 179826 - DNA, 20 bp, Artificial Sequence
  chemically synthesized
taagttagaataactaaagt

SEQ ID NO: 179827 - DNA, 20 bp, Artificial Sequence
  chemically synthesized
ataagttagaataactaaag

SEQ ID NO: 179828 - DNA, 20 bp, Artificial Sequence
  chemically synthesized
tacataagttagaataacta

SEQ ID NO: 179829 - DNA, 20 bp, Artificial Sequence
  chemically synthesized
gaatgatacattacataagt

SEQ ID NO: 179830 - DNA, 20 bp, Artificial Sequence
  chemically synthesized
gactgaatgatacattacat

SEQ ID NO: 179831 - DNA, 20 bp, Artificial Sequence
  chemically synthesized
aacttatgtaatgtatcatt

SEQ ID NO: 179832 - DNA, 20 bp, Artificial Sequence
  chemically synthesized
cccatttaaaaattttcagc

SEQ ID NO: 179833 - DNA, 20 bp, Artificial Sequence
  chemically synthesized
caatcccatttaaaaatttt

SEQ ID NO: 179834 - DNA, 20 bp, Artificial Sequence
  chemically synthesized
tctcgctgaaaatttttaaa

SEQ ID NO: 179835 - DNA, 20 bp, Artificial Sequence
  chemically synthesized
ctcgctgaaaatttttaaat

SEQ ID NO: 179836 - DNA, 20 bp, Artificial Sequence
  chemically synthesized
tgggattgcattatatcaat

SEQ ID NO: 179837 - DNA, 20 bp, Artificial Sequence
  chemically synthesized
tatcaataagttaatttgtg

SEQ ID NO: 179838 - DNA, 20 bp, Artificial Sequence
  chemically synthesized
gcagaattatattggaaagg

SEQ ID NO: 179839 - DNA, 20 bp, Artificial Sequence
  chemically synthesized
ttagcagaattatattggaa

SEQ ID NO: 179840 - DNA, 20 bp, Artificial Sequence
  chemically synthesized
tttagcagaattatattgga

SEQ ID NO: 179841 - DNA, 20 bp, Artificial Sequence
  chemically synthesized
aaagtttagcagaattatat

SEQ ID NO: 179842 - DNA, 20 bp, Artificial Sequence
  chemically synthesized
tgtaaatacagaaagtttag

SEQ ID NO: 179843 - DNA, 20 bp, Artificial Sequence
  chemically synthesized
cactgtaaatacagaaagtt

SEQ ID NO: 179844 - DNA, 20 bp, Artificial Sequence
  chemically synthesized
aagaacactgtaaatacaga

SEQ ID NO: 179845 - DNA, 20 bp, Artificial Sequence
  chemically synthesized
tgctaaactttctgtattta

SEQ ID NO: 179846 - DNA, 20 bp, Artificial Sequence
  chemically synthesized
gtccaagaacactgtaaata

SEQ ID NO: 179847 - DNA, 20 bp, Artificial Sequence
  chemically synthesized
ttctgtatttacagtgttct

SEQ ID NO: 179848 - DNA, 20 bp, Artificial Sequence
  chemically synthesized
atttacagtgttcttggaca

SEQ ID NO: 179849 - DNA, 20 bp, Artificial Sequence
  chemically synthesized
ttacagtgttcttggacaca

SEQ ID NO: 179850 - DNA, 20 bp, Artificial Sequence
  chemically synthesized
gtcccagatactctgtgtcc

SEQ ID NO: 179851 - DNA, 20 bp, Artificial Sequence
  chemically synthesized
gttcttggacacagagtatc

SEQ ID NO: 179852 - DNA, 20 bp, Artificial Sequence
  chemically synthesized
ttcttggacacagagtatct

SEQ ID NO: 179853 - DNA, 20 bp, Artificial Sequence
  chemically synthesized
tatagtgtcccattgagtcc

SEQ ID NO: 179854 - DNA, 20 bp, Artificial Sequence
  chemically synthesized
acagagtatctgggactcaa

SEQ ID NO: 179855 - DNA, 20 bp, Artificial Sequence
  chemically synthesized
cagagtatctgggactcaat

SEQ ID NO: 179856 - DNA, 20 bp, Artificial Sequence
  chemically synthesized
attatttatagtgtcccatt

SEQ ID NO: 179857 - DNA, 20 bp, Artificial Sequence
  chemically synthesized
aaaatgtacttaattattta

SEQ ID NO: 179858 - DNA, 20 bp, Artificial Sequence
  chemically synthesized
atgggacactataaataatt

SEQ ID NO: 179859 - DNA, 20 bp, Artificial Sequence
  chemically synthesized
tacattttataattaacctt

SEQ ID NO: 179860 - DNA, 20 bp, Artificial Sequence
  chemically synthesized
gtctttcaaattgatgctga

SEQ ID NO: 179861 - DNA, 20 bp, Artificial Sequence
  chemically synthesized
tgtctttcaaattgatgctg

SEQ ID NO: 179862 - DNA, 20 bp, Artificial Sequence
  chemically synthesized
aaccttcagcatcaatttga

SEQ ID NO: 179863 - DNA, 20 bp, Artificial Sequence
  chemically synthesized
ttcagcatcaatttgaaaga

SEQ ID NO: 179864 - DNA, 20 bp, Artificial Sequence
  chemically synthesized
atatccataaaatcatatgc

SEQ ID NO: 179865 - DNA, 20 bp, Artificial Sequence
  chemically synthesized
gcatcttgcatatgatttta

SEQ ID NO: 179866 - DNA, 20 bp, Artificial Sequence
  chemically synthesized
gagttttctaaattagtata

SEQ ID NO: 179867 - DNA, 20 bp, Artificial Sequence
  chemically synthesized
atattaaccatatactaatt

SEQ ID NO: 179868 - DNA, 20 bp, Artificial Sequence
  chemically synthesized
ttcttaagagttttctaaat

SEQ ID NO: 179869 - DNA, 20 bp, Artificial Sequence
  chemically synthesized
tactaatttagaaaactctt

SEQ ID NO: 179870 - DNA, 20 bp, Artificial Sequence
  chemically synthesized
tttattctgagagttcttaa

SEQ ID NO: 179871 - DNA, 20 bp, Artificial Sequence
  chemically synthesized
gatttattctgagagttctt

SEQ ID NO: 179872 - DNA, 20 bp, Artificial Sequence
  chemically synthesized
agaaaactcttaagaactct

SEQ ID NO: 179873 - DNA, 20 bp, Artificial Sequence
  chemically synthesized
taagtgatgatttattctga

SEQ ID NO: 179874 - DNA, 20 bp, Artificial Sequence
  chemically synthesized
tttaagtgatgatttattct

SEQ ID NO: 179875 - DNA, 20 bp, Artificial Sequence
  chemically synthesized
agaataaatcatcacttaaa

SEQ ID NO: 179876 - DNA, 20 bp, Artificial Sequence
  chemically synthesized
agccaaagcttttactgttt

SEQ ID NO: 179877 - DNA, 20 bp, Artificial Sequence
  chemically synthesized
aatcatcacttaaacagtaa

SEQ ID NO: 179878 - DNA, 20 bp, Artificial Sequence
  chemically synthesized
cacttaaacagtaaaagctt

SEQ ID NO: 179879 - DNA, 20 bp, Artificial Sequence
  chemically synthesized
aaacagtaaaagctttggct

SEQ ID NO: 179880 - DNA, 20 bp, Artificial Sequence
  chemically synthesized
gacagcaaaaagcttagcca

SEQ ID NO: 179881 - DNA, 20 bp, Artificial Sequence
  chemically synthesized
aagaaagacagcaaaaagct

SEQ ID NO: 179882 - DNA, 20 bp, Artificial Sequence
  chemically synthesized
gtaaaaagaaagacagcaaa

SEQ ID NO: 179883 - DNA, 20 bp, Artificial Sequence
  chemically synthesized
atatcgtgtaaaaagaaaga

SEQ ID NO: 179884 - DNA, 20 bp, Artificial Sequence
  chemically synthesized
acaaatatcgtgtaaaaaga

SEQ ID NO: 179885 - DNA, 20 bp, Artificial Sequence
  chemically synthesized
ttccacaaatatcgtgtaaa

SEQ ID NO: 179886 - DNA, 20 bp, Artificial Sequence
  chemically synthesized
ttctttttacacgatatttg

SEQ ID NO: 179887 - DNA, 20 bp, Artificial Sequence
  chemically synthesized
tttgtggaaaactttttttc

SEQ ID NO: 179888 - DNA, 20 bp, Artificial Sequence
  chemically synthesized
aaattaaatcactggaaaaa

SEQ ID NO: 179889 - DNA, 20 bp, Artificial Sequence
  chemically synthesized
tttttaaaaaattaaatcac

SEQ ID NO: 179890 - DNA, 20 bp, Artificial Sequence
  chemically synthesized
gatttaattttttaaaaaaa

SEQ ID NO: 179891 - DNA, 20 bp, Artificial Sequence
  chemically synthesized
ccaaatgttttcatatttaa

SEQ ID NO: 179892 - DNA, 20 bp, Artificial Sequence
  chemically synthesized
cttttaaatatgaaaacatt

SEQ ID NO: 179893 - DNA, 20 bp, Artificial Sequence
  chemically synthesized
ttaaatatgaaaacatttgg

SEQ ID NO: 179894 - DNA, 20 bp, Artificial Sequence
  chemically synthesized
tttggtagtcatttcttatc

SEQ ID NO: 179895 - DNA, 20 bp, Artificial Sequence
  chemically synthesized
agtataaaaaaaatctagat

SEQ ID NO: 179896 - DNA, 20 bp, Artificial Sequence
  chemically synthesized
ttcaaagtataaaaaaaatc

SEQ ID NO: 179897 - DNA, 20 bp, Artificial Sequence
  chemically synthesized
accatcttttttatatttca

SEQ ID NO: 179898 - DNA, 20 bp, Artificial Sequence
  chemically synthesized
ttatactttgaaatataaaa

SEQ ID NO: 179899 - DNA, 20 bp, Artificial Sequence
  chemically synthesized
actttgaaatataaaaaaga

SEQ ID NO: 179900 - DNA, 20 bp, Artificial Sequence
  chemically synthesized
agatggtgacaaaatcccgt

SEQ ID NO: 179901 - DNA, 20 bp, Artificial Sequence
  chemically synthesized
gatggtgacaaaatcccgtt

SEQ ID NO: 179902 - DNA, 20 bp, Artificial Sequence
  chemically synthesized
gattataacaaggtcccaac

SEQ ID NO: 179903 - DNA, 20 bp, Artificial Sequence
  chemically synthesized
agattataacaaggtcccaa

SEQ ID NO: 179904 - DNA, 20 bp, Artificial Sequence
  chemically synthesized
tggaaaagcagattataaca

SEQ ID NO: 179905 - DNA, 20 bp, Artificial Sequence
  chemically synthesized
ttggaaaagcagattataac

SEQ ID NO: 179906 - DNA, 20 bp, Artificial Sequence
  chemically synthesized
ttgttataatctgcttttcc

SEQ ID NO: 179907 - DNA, 20 bp, Artificial Sequence
  chemically synthesized
aacacatgcgcttggaaaag

SEQ ID NO: 179908 - DNA, 20 bp, Artificial Sequence
  chemically synthesized
gaaaacacatgcgcttggaa

SEQ ID NO: 179909 - DNA, 20 bp, Artificial Sequence
  chemically synthesized
tttcagaaaacacatgcgct

SEQ ID NO: 179910 - DNA, 20 bp, Artificial Sequence
  chemically synthesized
aatcgaggcttttgaaattt

SEQ ID NO: 179911 - DNA, 20 bp, Artificial Sequence
  chemically synthesized
tgtgttttctgaaatttcaa

SEQ ID NO: 179912 - DNA, 20 bp, Artificial Sequence
  chemically synthesized
atttcaaaagcctcgatttg

SEQ ID NO: 179913 - DNA, 20 bp, Artificial Sequence
  chemically synthesized
gcttttaaaacttcaaatcg

SEQ ID NO: 179914 - DNA, 20 bp, Artificial Sequence
  chemically synthesized
agcttttaaaacttcaaatc

SEQ ID NO: 179915 - DNA, 20 bp, Artificial Sequence
  chemically synthesized
gcctcgatttgaagttttaa

SEQ ID NO: 179916 - DNA, 20 bp, Artificial Sequence
  chemically synthesized
gaatacataaattcaaattg

SEQ ID NO: 179917 - DNA, 20 bp, Artificial Sequence
  chemically synthesized
gcaatttgaatttatgtatt

SEQ ID NO: 179918 - DNA, 20 bp, Artificial Sequence
  chemically synthesized
tttatgtattcagatgattg

SEQ ID NO: 179919 - DNA, 20 bp, Artificial Sequence
  chemically synthesized
gtattcagatgattgcagaa

SEQ ID NO: 179920 - DNA, 20 bp, Artificial Sequence
  chemically synthesized
cagatgattgcagaaaagca

SEQ ID NO: 179921 - DNA, 20 bp, Artificial Sequence
  chemically synthesized
tgcagaaaagcaaagaaaca

SEQ ID NO: 179922 - DNA, 20 bp, Artificial Sequence
  chemically synthesized
gaaaagcaaagaaacacagt

SEQ ID NO: 179923 - DNA, 20 bp, Artificial Sequence
  chemically synthesized
agaaacacagttagcatttc

SEQ ID NO: 179924 - DNA, 20 bp, Artificial Sequence
  chemically synthesized
gaaacacagttagcatttcc

SEQ ID NO: 179925 - DNA, 20 bp, Artificial Sequence
  chemically synthesized
gttctgtcaagagacaagcc

SEQ ID NO: 179926 - DNA, 20 bp, Artificial Sequence
  chemically synthesized
aaactgttctgtcaagagac

SEQ ID NO: 179927 - DNA, 20 bp, Artificial Sequence
  chemically synthesized
tttccaggcttgtctcttga

SEQ ID NO: 179928 - DNA, 20 bp, Artificial Sequence
  chemically synthesized
cgtttaaactgttctgtcaa

SEQ ID NO: 179929 - DNA, 20 bp, Artificial Sequence
  chemically synthesized
aggcttgtctcttgacagaa

SEQ ID NO: 179930 - DNA, 20 bp, Artificial Sequence
  chemically synthesized
cacgtttaaactgttctgtc

SEQ ID NO: 179931 - DNA, 20 bp, Artificial Sequence
  chemically synthesized
agtttaaacgtgcttcatat

SEQ ID NO: 179932 - DNA, 20 bp, Artificial Sequence
  chemically synthesized
atgtgatgaatgccaatatg

SEQ ID NO: 179933 - DNA, 20 bp, Artificial Sequence
  chemically synthesized
atattggcattcatcacatg

SEQ ID NO: 179934 - DNA, 20 bp, Artificial Sequence
  chemically synthesized
attaagcaagtaggtaaaca

SEQ ID NO: 179935 - DNA, 20 bp, Artificial Sequence
  chemically synthesized
cccataagcattaagcaagt

SEQ ID NO: 179936 - DNA, 20 bp, Artificial Sequence
  chemically synthesized
tcccataagcattaagcaag

SEQ ID NO: 179937 - DNA, 20 bp, Artificial Sequence
  chemically synthesized
tcctcccataagcattaagc

SEQ ID NO: 179938 - DNA, 20 bp, Artificial Sequence
  chemically synthesized
taaatcctcccataagcatt

SEQ ID NO: 179939 - DNA, 20 bp, Artificial Sequence
  chemically synthesized
acctacttgcttaatgctta

SEQ ID NO: 179940 - DNA, 20 bp, Artificial Sequence
  chemically synthesized
cctacttgcttaatgcttat

SEQ ID NO: 179941 - DNA, 20 bp, Artificial Sequence
  chemically synthesized
tacttgcttaatgcttatgg

SEQ ID NO: 179942 - DNA, 20 bp, Artificial Sequence
  chemically synthesized
acttgcttaatgcttatggg

SEQ ID NO: 179943 - DNA, 20 bp, Artificial Sequence
  chemically synthesized
gtctgaataaatcctcccat

SEQ ID NO: 179944 - DNA, 20 bp, Artificial Sequence
  chemically synthesized
tgcttatgggaggatttatt

SEQ ID NO: 179945 - DNA, 20 bp, Artificial Sequence
  chemically synthesized
atgggaggatttattcagac

SEQ ID NO: 179946 - DNA, 20 bp, Artificial Sequence
  chemically synthesized
ggaggatttattcagacaag

SEQ ID NO: 179947 - DNA, 20 bp, Artificial Sequence
  chemically synthesized
ggatttattcagacaagtgg

SEQ ID NO: 179948 - DNA, 20 bp, Artificial Sequence
  chemically synthesized
caagtggtagtaataataat

SEQ ID NO: 179949 - DNA, 20 bp, Artificial Sequence
  chemically synthesized
tggtagtaataataatgagt

SEQ ID NO: 179950 - DNA, 20 bp, Artificial Sequence
  chemically synthesized
tttagcacttatttgcagat

SEQ ID NO: 179951 - DNA, 20 bp, Artificial Sequence
  chemically synthesized
atttagcacttatttgcaga

SEQ ID NO: 179952 - DNA, 20 bp, Artificial Sequence
  chemically synthesized
aacattacccatctgcaaat

SEQ ID NO: 179953 - DNA, 20 bp, Artificial Sequence
  chemically synthesized
aaatatttagcacttatttg

SEQ ID NO: 179954 - DNA, 20 bp, Artificial Sequence
  chemically synthesized
gcttctaaaagtaaaatatt

SEQ ID NO: 179955 - DNA, 20 bp, Artificial Sequence
  chemically synthesized
agtgctaaatattttacttt

SEQ ID NO: 179956 - DNA, 20 bp, Artificial Sequence
  chemically synthesized
gctaaatattttacttttag

SEQ ID NO: 179957 - DNA, 20 bp, Artificial Sequence
  chemically synthesized
atgtattgaaatgcttctaa

SEQ ID NO: 179958 - DNA, 20 bp, Artificial Sequence
  chemically synthesized
tagaagcatttcaatacatt

SEQ ID NO: 179959 - DNA, 20 bp, Artificial Sequence
  chemically synthesized
tttcaatacatttagacatt

SEQ ID NO: 179960 - DNA, 20 bp, Artificial Sequence
  chemically synthesized
tttagacatttagctttttt

SEQ ID NO: 179961 - DNA, 20 bp, Artificial Sequence
  chemically synthesized
gaagccattctttctaaaaa

SEQ ID NO: 179962 - DNA, 20 bp, Artificial Sequence
  chemically synthesized
gacatttagctttttttaga

SEQ ID NO: 179963 - DNA, 20 bp, Artificial Sequence
  chemically synthesized
ttagctttttttagaaagaa

SEQ ID NO: 179964 - DNA, 20 bp, Artificial Sequence
  chemically synthesized
agagccaatatttcaaacag

SEQ ID NO: 179965 - DNA, 20 bp, Artificial Sequence
  chemically synthesized
aacagagccaatatttcaaa

SEQ ID NO: 179966 - DNA, 20 bp, Artificial Sequence
  chemically synthesized
atggcttctgtttgaaatat

SEQ ID NO: 179967 - DNA, 20 bp, Artificial Sequence
  chemically synthesized
ttgtaatgtaaatggtaaca

SEQ ID NO: 179968 - DNA, 20 bp, Artificial Sequence
  chemically synthesized
atttgtaatgtaaatggtaa

SEQ ID NO: 179969 - DNA, 20 bp, Artificial Sequence
  chemically synthesized
gggaacatttgtaatgtaaa

SEQ ID NO: 179970 - DNA, 20 bp, Artificial Sequence
  chemically synthesized
gtgcttcctttaatttcatt

SEQ ID NO: 179971 - DNA, 20 bp, Artificial Sequence
  chemically synthesized
cgtgcttcctttaatttcat

SEQ ID NO: 179972 - DNA, 20 bp, Artificial Sequence
  chemically synthesized
aaatgttcccaatgaaatta

SEQ ID NO: 179973 - DNA, 20 bp, Artificial Sequence
  chemically synthesized
aatgttcccaatgaaattaa

SEQ ID NO: 179974 - DNA, 20 bp, Artificial Sequence
  chemically synthesized
gttcccaatgaaattaaagg

SEQ ID NO: 179975 - DNA, 20 bp, Artificial Sequence
  chemically synthesized
aaaggaagcacgtattacga

SEQ ID NO: 179976 - DNA, 20 bp, Artificial Sequence
  chemically synthesized
gaagcacgtattacgatggt

SEQ ID NO: 179977 - DNA, 20 bp, Artificial Sequence
  chemically synthesized
agcacgtattacgatggtga

SEQ ID NO: 179978 - DNA, 20 bp, Artificial Sequence
  chemically synthesized
tggtgagagatttgcataat

SEQ ID NO: 179979 - DNA, 20 bp, Artificial Sequence
  chemically synthesized
gagagatttgcataatcaga

SEQ ID NO: 179980 - DNA, 20 bp, Artificial Sequence
  chemically synthesized
agagatttgcataatcagaa

SEQ ID NO: 179981 - DNA, 20 bp, Artificial Sequence
  chemically synthesized
gatttgcataatcagaaagg

SEQ ID NO: 179982 - DNA, 20 bp, Artificial Sequence
  chemically synthesized
tgaatttagcaacacatgag

SEQ ID NO: 179983 - DNA, 20 bp, Artificial Sequence
  chemically synthesized
cattgaatttagcaacacat

SEQ ID NO: 179984 - DNA, 20 bp, Artificial Sequence
  chemically synthesized
aatgttaaattcattgaatt

SEQ ID NO: 179985 - DNA, 20 bp, Artificial Sequence
  chemically synthesized
cgacagaaaatgttcattaa

SEQ ID NO: 179986 - DNA, 20 bp, Artificial Sequence
  chemically synthesized
cccgacagaaaatgttcatt

SEQ ID NO: 179987 - DNA, 20 bp, Artificial Sequence
  chemically synthesized
tcttaatgaacattttctgt

SEQ ID NO: 179988 - DNA, 20 bp, Artificial Sequence
  chemically synthesized
cttaatgaacattttctgtc

SEQ ID NO: 179989 - DNA, 20 bp, Artificial Sequence
  chemically synthesized
ttagcgtaagagtagcccga

SEQ ID NO: 179990 - DNA, 20 bp, Artificial Sequence
  chemically synthesized
tattcctcttagcgtaagag

SEQ ID NO: 179991 - DNA, 20 bp, Artificial Sequence
  chemically synthesized
tgtcgggctactcttacgct

SEQ ID NO: 179992 - DNA, 20 bp, Artificial Sequence
  chemically synthesized
gtctattcctcttagcgtaa

SEQ ID NO: 179993 - DNA, 20 bp, Artificial Sequence
  chemically synthesized
tcgggctactcttacgctaa

SEQ ID NO: 179994 - DNA, 20 bp, Artificial Sequence
  chemically synthesized
cagtctattcctcttagcgt

SEQ ID NO: 179995 - DNA, 20 bp, Artificial Sequence
  chemically synthesized
cgggctactcttacgctaag

SEQ ID NO: 179996 - DNA, 20 bp, Artificial Sequence
  chemically synthesized
tactcttacgctaagaggaa

SEQ ID NO: 179997 - DNA, 20 bp, Artificial Sequence
  chemically synthesized
atttggcagtctattcctct

SEQ ID NO: 179998 - DNA, 20 bp, Artificial Sequence
  chemically synthesized
aatcatgccatgtgatttgg

SEQ ID NO: 179999 - DNA, 20 bp, Artificial Sequence
  chemically synthesized
gaatagactgccaaatcaca

SEQ ID NO: 180000 - DNA, 20 bp, Artificial Sequence
  chemically synthesized
caaaatcatgccatgtgatt

SEQ ID NO: 180001 - DNA, 20 bp, Artificial Sequence
  chemically synthesized
caaatcacatggcatgattt

SEQ ID NO: 180002 - DNA, 20 bp, Artificial Sequence
  chemically synthesized
tcacatggcatgattttggt

SEQ ID NO: 180003 - DNA, 20 bp, Artificial Sequence
  chemically synthesized
cacatggcatgattttggtg

SEQ ID NO: 180004 - DNA, 20 bp, Artificial Sequence
  chemically synthesized
acatggcatgattttggtga

SEQ ID NO: 180005 - DNA, 20 bp, Artificial Sequence
  chemically synthesized
catggcatgattttggtgag

SEQ ID NO: 180006 - DNA, 20 bp, Artificial Sequence
  chemically synthesized
ttttggtgaggggatctaac

SEQ ID NO: 180007 - DNA, 20 bp, Artificial Sequence
  chemically synthesized
actttacctgaaacacttgt

SEQ ID NO: 180008 - DNA, 20 bp, Artificial Sequence
  chemically synthesized
aggggatctaacaagtgttt

SEQ ID NO: 180009 - DNA, 20 bp, Artificial Sequence
  chemically synthesized
ggggatctaacaagtgtttc

SEQ ID NO: 180010 - DNA, 20 bp, Artificial Sequence
  chemically synthesized
tctaacaagtgtttcaggta

SEQ ID NO: 180011 - DNA, 20 bp, Artificial Sequence
  chemically synthesized
aagtgtttcaggtaaagtgc

SEQ ID NO: 180012 - DNA, 20 bp, Artificial Sequence
  chemically synthesized
gtttcaggtaaagtgctaga

SEQ ID NO: 180013 - DNA, 20 bp, Artificial Sequence
  chemically synthesized
gattccactgtgaaactatc

SEQ ID NO: 180014 - DNA, 20 bp, Artificial Sequence
  chemically synthesized
taaagtgctagatagtttca

SEQ ID NO: 180015 - DNA, 20 bp, Artificial Sequence
  chemically synthesized
agtgctagatagtttcacag

SEQ ID NO: 180016 - DNA, 20 bp, Artificial Sequence
  chemically synthesized
aaggatgtatggaatattaa

SEQ ID NO: 180017 - DNA, 20 bp, Artificial Sequence
  chemically synthesized
aaggcaatccaaaggatgta

SEQ ID NO: 180018 - DNA, 20 bp, Artificial Sequence
  chemically synthesized
ttaatattccatacatcctt

SEQ ID NO: 180019 - DNA, 20 bp, Artificial Sequence
  chemically synthesized
gcatataaaaggcaatccaa

SEQ ID NO: 180020 - DNA, 20 bp, Artificial Sequence
  chemically synthesized
agcatataaaaggcaatcca

SEQ ID NO: 180021 - DNA, 20 bp, Artificial Sequence
  chemically synthesized
cttcattgaaagcatataaa

SEQ ID NO: 180022 - DNA, 20 bp, Artificial Sequence
  chemically synthesized
tcttcattgaaagcatataa

SEQ ID NO: 180023 - DNA, 20 bp, Artificial Sequence
  chemically synthesized
ccttttatatgctttcaatg

SEQ ID NO: 180024 - DNA, 20 bp, Artificial Sequence
  chemically synthesized
aacttcagtttcttcattga

SEQ ID NO: 180025 - DNA, 20 bp, Artificial Sequence
  chemically synthesized
tgctttcaatgaagaaactg

SEQ ID NO: 180026 - DNA, 20 bp, Artificial Sequence
  chemically synthesized
caatgaagaaactgaagttc

SEQ ID NO: 180027 - DNA, 20 bp, Artificial Sequence
  chemically synthesized
tgtatcaatctctagaactt

SEQ ID NO: 180028 - DNA, 20 bp, Artificial Sequence
  chemically synthesized
atgaagaaactgaagttcta

SEQ ID NO: 180029 - DNA, 20 bp, Artificial Sequence
  chemically synthesized
gtatgtgatgtatcaatctc

SEQ ID NO: 180030 - DNA, 20 bp, Artificial Sequence
  chemically synthesized
attgatacatcacataccca

SEQ ID NO: 180031 - DNA, 20 bp, Artificial Sequence
  chemically synthesized
ttgatacatcacatacccaa

SEQ ID NO: 180032 - DNA, 20 bp, Artificial Sequence
  chemically synthesized
aaaatgggatagtcaccttt

SEQ ID NO: 180033 - DNA, 20 bp, Artificial Sequence
  chemically synthesized
gaaaatgggatagtcacctt

SEQ ID NO: 180034 - DNA, 20 bp, Artificial Sequence
  chemically synthesized
ttctcatttggaaaatggga

SEQ ID NO: 180035 - DNA, 20 bp, Artificial Sequence
  chemically synthesized
ggacttctcatttggaaaat

SEQ ID NO: 180036 - DNA, 20 bp, Artificial Sequence
  chemically synthesized
gggacttctcatttggaaaa

SEQ ID NO: 180037 - DNA, 20 bp, Artificial Sequence
  chemically synthesized
gactatcccattttccaaat

SEQ ID NO: 180038 - DNA, 20 bp, Artificial Sequence
  chemically synthesized
tatcccattttccaaatgag

SEQ ID NO: 180039 - DNA, 20 bp, Artificial Sequence
  chemically synthesized
ggagagagggacttctcatt

SEQ ID NO: 180040 - DNA, 20 bp, Artificial Sequence
  chemically synthesized
aatgagaagtccctctctcc

SEQ ID NO: 180041 - DNA, 20 bp, Artificial Sequence
  chemically synthesized
gatcaaaaaacttggagaga

SEQ ID NO: 180042 - DNA, 20 bp, Artificial Sequence
  chemically synthesized
tgatcaaaaaacttggagag

SEQ ID NO: 180043 - DNA, 20 bp, Artificial Sequence
  chemically synthesized
gtgatcaaaaaacttggaga

SEQ ID NO: 180044 - DNA, 20 bp, Artificial Sequence
  chemically synthesized
aggtgatcaaaaaacttgga

SEQ ID NO: 180045 - DNA, 20 bp, Artificial Sequence
  chemically synthesized
aaaggtgatcaaaaaacttg

SEQ ID NO: 180046 - DNA, 20 bp, Artificial Sequence
  chemically synthesized
ttaaaggtgatcaaaaaact

SEQ ID NO: 180047 - DNA, 20 bp, Artificial Sequence
  chemically synthesized
ttttttgatcacctttaaca

SEQ ID NO: 180048 - DNA, 20 bp, Artificial Sequence
  chemically synthesized
ttctaaagtttctatgttaa

SEQ ID NO: 180049 - DNA, 20 bp, Artificial Sequence
  chemically synthesized
tttctaaagtttctatgtta

SEQ ID NO: 180050 - DNA, 20 bp, Artificial Sequence
  chemically synthesized
cacctttaacatagaaactt

SEQ ID NO: 180051 - DNA, 20 bp, Artificial Sequence
  chemically synthesized
aacatagaaactttagaaaa

SEQ ID NO: 180052 - DNA, 20 bp, Artificial Sequence
  chemically synthesized
cattgtatctccattttcta

SEQ ID NO: 180053 - DNA, 20 bp, Artificial Sequence
  chemically synthesized
catagaaactttagaaaatg

SEQ ID NO: 180054 - DNA, 20 bp, Artificial Sequence
  chemically synthesized
attaaacattatatgtaaac

SEQ ID NO: 180055 - DNA, 20 bp, Artificial Sequence
  chemically synthesized
aattaaacattatatgtaaa

SEQ ID NO: 180056 - DNA, 20 bp, Artificial Sequence
  chemically synthesized
tgtactatataattttaaag

SEQ ID NO: 180057 - DNA, 20 bp, Artificial Sequence
  chemically synthesized
ttttgtactatataatttta

SEQ ID NO: 180058 - DNA, 20 bp, Artificial Sequence
  chemically synthesized
tgtactactttaaaattata

SEQ ID NO: 180059 - DNA, 20 bp, Artificial Sequence
  chemically synthesized
agtacaaaatattatgtcat

SEQ ID NO: 180060 - DNA, 20 bp, Artificial Sequence
  chemically synthesized
tgcatgaaatatgaatgaag

SEQ ID NO: 180061 - DNA, 20 bp, Artificial Sequence
  chemically synthesized
tgttgcatgaaatatgaatg

SEQ ID NO: 180062 - DNA, 20 bp, Artificial Sequence
  chemically synthesized
aattttgttcaaattcttca

SEQ ID NO: 180063 - DNA, 20 bp, Artificial Sequence
  chemically synthesized
attttgttcaaattcttcac

SEQ ID NO: 180064 - DNA, 20 bp, Artificial Sequence
  chemically synthesized
caatgttgaaggtgcctgtg

SEQ ID NO: 180065 - DNA, 20 bp, Artificial Sequence
  chemically synthesized
gatgcaaatttcaatgttga

SEQ ID NO: 180066 - DNA, 20 bp, Artificial Sequence
  chemically synthesized
ggatgcaaatttcaatgttg

SEQ ID NO: 180067 - DNA, 20 bp, Artificial Sequence
  chemically synthesized
cattgaaatttgcatcctca

SEQ ID NO: 180068 - DNA, 20 bp, Artificial Sequence
  chemically synthesized
caacaacaagtgcatccatg

SEQ ID NO: 180069 - DNA, 20 bp, Artificial Sequence
  chemically synthesized
gcaacaacaagtgcatccat

SEQ ID NO: 180070 - DNA, 20 bp, Artificial Sequence
  chemically synthesized
aaactgagttaggcaacaac

SEQ ID NO: 180071 - DNA, 20 bp, Artificial Sequence
  chemically synthesized
gcacttgttgttgcctaact

SEQ ID NO: 180072 - DNA, 20 bp, Artificial Sequence
  chemically synthesized
gccctctggaaaactgagtt

SEQ ID NO: 180073 - DNA, 20 bp, Artificial Sequence
  chemically synthesized
tgccctctggaaaactgagt

SEQ ID NO: 180074 - DNA, 20 bp, Artificial Sequence
  chemically synthesized
tgttgcctaactcagttttc

SEQ ID NO: 180075 - DNA, 20 bp, Artificial Sequence
  chemically synthesized
atgatgccctctggaaaact

SEQ ID NO: 180076 - DNA, 20 bp, Artificial Sequence
  chemically synthesized
ttgcctaactcagttttcca

SEQ ID NO: 180077 - DNA, 20 bp, Artificial Sequence
  chemically synthesized
tgcctaactcagttttccag

SEQ ID NO: 180078 - DNA, 20 bp, Artificial Sequence
  chemically synthesized
gcctaactcagttttccaga

SEQ ID NO: 180079 - DNA, 20 bp, Artificial Sequence
  chemically synthesized
taagtaaagatgatgccctc

SEQ ID NO: 180080 - DNA, 20 bp, Artificial Sequence
  chemically synthesized
aggccacatggatgtaagta

SEQ ID NO: 180081 - DNA, 20 bp, Artificial Sequence
  chemically synthesized
acctcaggccacatggatgt

SEQ ID NO: 180082 - DNA, 20 bp, Artificial Sequence
  chemically synthesized
catctttacttacatccatg

SEQ ID NO: 180083 - DNA, 20 bp, Artificial Sequence
  chemically synthesized
gtactatacctcaggccaca

SEQ ID NO: 180084 - DNA, 20 bp, Artificial Sequence
  chemically synthesized
tacttacatccatgtggcct

SEQ ID NO: 180085 - DNA, 20 bp, Artificial Sequence
  chemically synthesized
acttacatccatgtggcctg

SEQ ID NO: 180086 - DNA, 20 bp, Artificial Sequence
  chemically synthesized
catccatgtggcctgaggta

SEQ ID NO: 180087 - DNA, 20 bp, Artificial Sequence
  chemically synthesized
attcagcagtactatacctc

SEQ ID NO: 180088 - DNA, 20 bp, Artificial Sequence
  chemically synthesized
gattcagcagtactatacct

SEQ ID NO: 180089 - DNA, 20 bp, Artificial Sequence
  chemically synthesized
aggtatagtactgctgaatc

SEQ ID NO: 180090 - DNA, 20 bp, Artificial Sequence
  chemically synthesized
aacattacctctagattcag

SEQ ID NO: 180091 - DNA, 20 bp, Artificial Sequence
  chemically synthesized
gtatagtactgctgaatcta

SEQ ID NO: 180092 - DNA, 20 bp, Artificial Sequence
  chemically synthesized
tatagtactgctgaatctag

SEQ ID NO: 180093 - DNA, 20 bp, Artificial Sequence
  chemically synthesized
tgaaacattacctctagatt

SEQ ID NO: 180094 - DNA, 20 bp, Artificial Sequence
  chemically synthesized
tcctagtgaaacattacctc

SEQ ID NO: 180095 - DNA, 20 bp, Artificial Sequence
  chemically synthesized
atctagaggtaatgtttcac

SEQ ID NO: 180096 - DNA, 20 bp, Artificial Sequence
  chemically synthesized
tctagaggtaatgtttcact

SEQ ID NO: 180097 - DNA, 20 bp, Artificial Sequence
  chemically synthesized
gtggcttgcagtaaaattcc

SEQ ID NO: 180098 - DNA, 20 bp, Artificial Sequence
  chemically synthesized
ttcactaggaattttactgc

SEQ ID NO: 180099 - DNA, 20 bp, Artificial Sequence
  chemically synthesized
aaatgtgtgcttgtggcttg

SEQ ID NO: 180100 - DNA, 20 bp, Artificial Sequence
  chemically synthesized
ggaattttactgcaagccac

SEQ ID NO: 180101 - DNA, 20 bp, Artificial Sequence
  chemically synthesized
gttatgtaaatgtgtgcttg

SEQ ID NO: 180102 - DNA, 20 bp, Artificial Sequence
  chemically synthesized
acaagcacacatttacataa

SEQ ID NO: 180103 - DNA, 20 bp, Artificial Sequence
  chemically synthesized
cacatttacataacagaata

SEQ ID NO: 180104 - DNA, 20 bp, Artificial Sequence
  chemically synthesized
atacagttttatgttatgta

SEQ ID NO: 180105 - DNA, 20 bp, Artificial Sequence
  chemically synthesized
agttttatgttatgtaaaga

SEQ ID NO: 180106 - DNA, 20 bp, Artificial Sequence
  chemically synthesized
tatggcacagaaaaaagata

SEQ ID NO: 180107 - DNA, 20 bp, Artificial Sequence
  chemically synthesized
tggacatatggcacagaaaa

SEQ ID NO: 180108 - DNA, 20 bp, Artificial Sequence
  chemically synthesized
tagctcatggacatatggca

SEQ ID NO: 180109 - DNA, 20 bp, Artificial Sequence
  chemically synthesized
tggtgtagctcatggacata

SEQ ID NO: 180110 - DNA, 20 bp, Artificial Sequence
  chemically synthesized
tttctgtgccatatgtccat

SEQ ID NO: 180111 - DNA, 20 bp, Artificial Sequence
  chemically synthesized
tggttacatggtgtagctca

SEQ ID NO: 180112 - DNA, 20 bp, Artificial Sequence
  chemically synthesized
cattaagtggttacatggtg

SEQ ID NO: 180113 - DNA, 20 bp, Artificial Sequence
  chemically synthesized
taactcattaagtggttaca

SEQ ID NO: 180114 - DNA, 20 bp, Artificial Sequence
  chemically synthesized
acaccatgtaaccacttaat

SEQ ID NO: 180115 - DNA, 20 bp, Artificial Sequence
  chemically synthesized
gttaaaagtaactcattaag

SEQ ID NO: 180116 - DNA, 20 bp, Artificial Sequence
  chemically synthesized
actgttaaaagtaactcatt

SEQ ID NO: 180117 - DNA, 20 bp, Artificial Sequence
  chemically synthesized
acttaatgagttacttttaa

SEQ ID NO: 180118 - DNA, 20 bp, Artificial Sequence
  chemically synthesized
tatggaaagaatactgttaa

SEQ ID NO: 180119 - DNA, 20 bp, Artificial Sequence
  chemically synthesized
ttttaacagtattctttcca

SEQ ID NO: 180120 - DNA, 20 bp, Artificial Sequence
  chemically synthesized
cattgtaaacaagctatgga

SEQ ID NO: 180121 - DNA, 20 bp, Artificial Sequence
  chemically synthesized
atgccattgtaaacaagcta

SEQ ID NO: 180122 - DNA, 20 bp, Artificial Sequence
  chemically synthesized
agttggatgccattgtaaac

SEQ ID NO: 180123 - DNA, 20 bp, Artificial Sequence
  chemically synthesized
tttccatagcttgtttacaa

SEQ ID NO: 180124 - DNA, 20 bp, Artificial Sequence
  chemically synthesized
gacatcacaattgcaagagt

SEQ ID NO: 180125 - DNA, 20 bp, Artificial Sequence
  chemically synthesized
gtatgacatcacaattgcaa

SEQ ID NO: 180126 - DNA, 20 bp, Artificial Sequence
  chemically synthesized
ttgtatgacatcacaattgc

SEQ ID NO: 180127 - DNA, 20 bp, Artificial Sequence
  chemically synthesized
attgtgatgtcatacaacca

SEQ ID NO: 180128 - DNA, 20 bp, Artificial Sequence
  chemically synthesized
cacagtttagggattgactt

SEQ ID NO: 180129 - DNA, 20 bp, Artificial Sequence
  chemically synthesized
aataaatttaacacagttta

SEQ ID NO: 180130 - DNA, 20 bp, Artificial Sequence
  chemically synthesized
aaataaatttaacacagttt

SEQ ID NO: 180131 - DNA, 20 bp, Artificial Sequence
  chemically synthesized
aaaataaatttaacacagtt

SEQ ID NO: 180132 - DNA, 20 bp, Artificial Sequence
  chemically synthesized
gggagaaaataaatttaaca

SEQ ID NO: 180133 - DNA, 20 bp, Artificial Sequence
  chemically synthesized
gtgttaaatttattttctcc

SEQ ID NO: 180134 - DNA, 20 bp, Artificial Sequence
  chemically synthesized
cacagacacacacacactgg

SEQ ID NO: 180135 - DNA, 20 bp, Artificial Sequence
  chemically synthesized
cacacagacacacacacact

SEQ ID NO: 180136 - DNA, 20 bp, Artificial Sequence
  chemically synthesized
acacacagacacacacacac

SEQ ID NO: 180137 - DNA, 20 bp, Artificial Sequence
  chemically synthesized
agggcaaaaacacacacaca

SEQ ID NO: 180138 - DNA, 20 bp, Artificial Sequence
  chemically synthesized
gaagtaaacctgatagagga

SEQ ID NO: 180139 - DNA, 20 bp, Artificial Sequence
  chemically synthesized
gtgtttttgccctcctctat

SEQ ID NO: 180140 - DNA, 20 bp, Artificial Sequence
  chemically synthesized
agaagtaaacctgatagagg

SEQ ID NO: 180141 - DNA, 20 bp, Artificial Sequence
  chemically synthesized
tgtttttgccctcctctatc

SEQ ID NO: 180142 - DNA, 20 bp, Artificial Sequence
  chemically synthesized
tagaagtaaacctgatagag

SEQ ID NO: 180143 - DNA, 20 bp, Artificial Sequence
  chemically synthesized
tgtagaagtaaacctgatag

SEQ ID NO: 180144 - DNA, 20 bp, Artificial Sequence
  chemically synthesized
ttgtagaagtaaacctgata

SEQ ID NO: 180145 - DNA, 20 bp, Artificial Sequence
  chemically synthesized
gcttgtagaagtaaacctga

SEQ ID NO: 180146 - DNA, 20 bp, Artificial Sequence
  chemically synthesized
tctatcaggtttacttctac

SEQ ID NO: 180147 - DNA, 20 bp, Artificial Sequence
  chemically synthesized
cttattttggaggcttgtag

SEQ ID NO: 180148 - DNA, 20 bp, Artificial Sequence
  chemically synthesized
atgcttattttggaggcttg

SEQ ID NO: 180149 - DNA, 20 bp, Artificial Sequence
  chemically synthesized
cttctacaagcctccaaaat

SEQ ID NO: 180150 - DNA, 20 bp, Artificial Sequence
  chemically synthesized
tcaatttatgcttattttgg

SEQ ID NO: 180151 - DNA, 20 bp, Artificial Sequence
  chemically synthesized
ctcaatttatgcttattttg

SEQ ID NO: 180152 - DNA, 20 bp, Artificial Sequence
  chemically synthesized
ttctcaatttatgcttattt

SEQ ID NO: 180153 - DNA, 20 bp, Artificial Sequence
  chemically synthesized
ctccaaaataagcataaatt

SEQ ID NO: 180154 - DNA, 20 bp, Artificial Sequence
  chemically synthesized
aataagcataaattgagaat

SEQ ID NO: 180155 - DNA, 20 bp, Artificial Sequence
  chemically synthesized
gcataaattgagaataagtc

SEQ ID NO: 180156 - DNA, 20 bp, Artificial Sequence
  chemically synthesized
cataaattgagaataagtca

SEQ ID NO: 180157 - DNA, 20 bp, Artificial Sequence
  chemically synthesized
tcaaggcaatacatctttcc

SEQ ID NO: 180158 - DNA, 20 bp, Artificial Sequence
  chemically synthesized
ggcaatacatctttcccgga

SEQ ID NO: 180159 - DNA, 20 bp, Artificial Sequence
  chemically synthesized
caacaaagtactgtccggga

SEQ ID NO: 180160 - DNA, 20 bp, Artificial Sequence
  chemically synthesized
aaaacaacaaagtactgtcc

SEQ ID NO: 180161 - DNA, 20 bp, Artificial Sequence
  chemically synthesized
caaaacaacaaagtactgtc

SEQ ID NO: 180162 - DNA, 20 bp, Artificial Sequence
  chemically synthesized
ttacttcaatcaaaacaaca

SEQ ID NO: 180163 - DNA, 20 bp, Artificial Sequence
  chemically synthesized
gtactttgttgttttgattg

SEQ ID NO: 180164 - DNA, 20 bp, Artificial Sequence
  chemically synthesized
aagtttctcaaattacaaga

SEQ ID NO: 180165 - DNA, 20 bp, Artificial Sequence
  chemically synthesized
aaatgaccatcttgtaattt

SEQ ID NO: 180166 - DNA, 20 bp, Artificial Sequence
  chemically synthesized
tctgaagtttctcaaattac

SEQ ID NO: 180167 - DNA, 20 bp, Artificial Sequence
  chemically synthesized
tcttgtaatttgagaaactt

SEQ ID NO: 180168 - DNA, 20 bp, Artificial Sequence
  chemically synthesized
tgtaatttgagaaacttcag

SEQ ID NO: 180169 - DNA, 20 bp, Artificial Sequence
  chemically synthesized
gtaatttgagaaacttcaga

SEQ ID NO: 180170 - DNA, 20 bp, Artificial Sequence
  chemically synthesized
cttatacttgaatccttctg

SEQ ID NO: 180171 - DNA, 20 bp, Artificial Sequence
  chemically synthesized
gagaaacttcagaaggattc

SEQ ID NO: 180172 - DNA, 20 bp, Artificial Sequence
  chemically synthesized
cttcagaaggattcaagtat

SEQ ID NO: 180173 - DNA, 20 bp, Artificial Sequence
  chemically synthesized
agtataagttgacccttccc

SEQ ID NO: 180174 - DNA, 20 bp, Artificial Sequence
  chemically synthesized
gtataagttgacccttcccg

SEQ ID NO: 180175 - DNA, 20 bp, Artificial Sequence
  chemically synthesized
tataagttgacccttcccga

SEQ ID NO: 180176 - DNA, 20 bp, Artificial Sequence
  chemically synthesized
ttttggttttccctcgggaa

SEQ ID NO: 180177 - DNA, 20 bp, Artificial Sequence
  chemically synthesized
gttttggttttccctcggga

SEQ ID NO: 180178 - DNA, 20 bp, Artificial Sequence
  chemically synthesized
tgttttggttttccctcggg

SEQ ID NO: 180179 - DNA, 20 bp, Artificial Sequence
  chemically synthesized
ttttgttttggttttccctc

SEQ ID NO: 180180 - DNA, 20 bp, Artificial Sequence
  chemically synthesized
gttttgttttggttttccct

SEQ ID NO: 180181 - DNA, 20 bp, Artificial Sequence
  chemically synthesized
tagaaatcaatgttttgttt

SEQ ID NO: 180182 - DNA, 20 bp, Artificial Sequence
  chemically synthesized
aggaggttactaggtgtgtg

SEQ ID NO: 180183 - DNA, 20 bp, Artificial Sequence
  chemically synthesized
cattgatttctacacacacc

SEQ ID NO: 180184 - DNA, 20 bp, Artificial Sequence
  chemically synthesized
tatggcctgaggaggttact

SEQ ID NO: 180185 - DNA, 20 bp, Artificial Sequence
  chemically synthesized
gtatggcctgaggaggttac

SEQ ID NO: 180186 - DNA, 20 bp, Artificial Sequence
  chemically synthesized
cacacacctagtaacctcct

SEQ ID NO: 180187 - DNA, 20 bp, Artificial Sequence
  chemically synthesized
acacacctagtaacctcctc

SEQ ID NO: 180188 - DNA, 20 bp, Artificial Sequence
  chemically synthesized
acggagggtatggcctgagg

SEQ ID NO: 180189 - DNA, 20 bp, Artificial Sequence
  chemically synthesized
tacggagggtatggcctgag

SEQ ID NO: 180190 - DNA, 20 bp, Artificial Sequence
  chemically synthesized
cctacggagggtatggcctg

SEQ ID NO: 180191 - DNA, 20 bp, Artificial Sequence
  chemically synthesized
acctacggagggtatggcct

SEQ ID NO: 180192 - DNA, 20 bp, Artificial Sequence
  chemically synthesized
ataatgacctacggagggta

SEQ ID NO: 180193 - DNA, 20 bp, Artificial Sequence
  chemically synthesized
tcctcaggccataccctccg

SEQ ID NO: 180194 - DNA, 20 bp, Artificial Sequence
  chemically synthesized
cctcaggccataccctccgt

SEQ ID NO: 180195 - DNA, 20 bp, Artificial Sequence
  chemically synthesized
ttctgataatgacctacgga

SEQ ID NO: 180196 - DNA, 20 bp, Artificial Sequence
  chemically synthesized
attctgataatgacctacgg

SEQ ID NO: 180197 - DNA, 20 bp, Artificial Sequence
  chemically synthesized
gattctgataatgacctacg

SEQ ID NO: 180198 - DNA, 20 bp, Artificial Sequence
  chemically synthesized
ctgattctgataatgaccta

SEQ ID NO: 180199 - DNA, 20 bp, Artificial Sequence
  chemically synthesized
taccctccgtaggtcattat

SEQ ID NO: 180200 - DNA, 20 bp, Artificial Sequence
  chemically synthesized
ccgtaggtcattatcagaat

SEQ ID NO: 180201 - DNA, 20 bp, Artificial Sequence
  chemically synthesized
cattatcagaatcagaaccc

SEQ ID NO: 180202 - DNA, 20 bp, Artificial Sequence
  chemically synthesized
taaaaataaagttgatgctt

SEQ ID NO: 180203 - DNA, 20 bp, Artificial Sequence
  chemically synthesized
ttaaaaataaagttgatgct

SEQ ID NO: 180204 - DNA, 20 bp, Artificial Sequence
  chemically synthesized
caagcatcaactttattttt

SEQ ID NO: 180205 - DNA, 20 bp, Artificial Sequence
  chemically synthesized
gacatgttggcttaaaaata

SEQ ID NO: 180206 - DNA, 20 bp, Artificial Sequence
  chemically synthesized
accaggtatggtagacatgt

SEQ ID NO: 180207 - DNA, 20 bp, Artificial Sequence
  chemically synthesized
gccaacatgtctaccatacc

SEQ ID NO: 180208 - DNA, 20 bp, Artificial Sequence
  chemically synthesized
caagcaccaaccaggtatgg

SEQ ID NO: 180209 - DNA, 20 bp, Artificial Sequence
  chemically synthesized
actcaagcaccaaccaggta

SEQ ID NO: 180210 - DNA, 20 bp, Artificial Sequence
  chemically synthesized
acatgtctaccatacctggt

SEQ ID NO: 180211 - DNA, 20 bp, Artificial Sequence
  chemically synthesized
gtacaactcaagcaccaacc

SEQ ID NO: 180212 - DNA, 20 bp, Artificial Sequence
  chemically synthesized
tgtacaactcaagcaccaac

SEQ ID NO: 180213 - DNA, 20 bp, Artificial Sequence
  chemically synthesized
accatacctggttggtgctt

SEQ ID NO: 180214 - DNA, 20 bp, Artificial Sequence
  chemically synthesized
aatgtctacttgtacaactc

SEQ ID NO: 180215 - DNA, 20 bp, Artificial Sequence
  chemically synthesized
ggttggtgcttgagttgtac

SEQ ID NO: 180216 - DNA, 20 bp, Artificial Sequence
  chemically synthesized
tggtgcttgagttgtacaag

SEQ ID NO: 180217 - DNA, 20 bp, Artificial Sequence
  chemically synthesized
acatttgttcattttcccta

SEQ ID NO: 180218 - DNA, 20 bp, Artificial Sequence
  chemically synthesized
ccgacaagacacaaacttta

SEQ ID NO: 180219 - DNA, 20 bp, Artificial Sequence
  chemically synthesized
tccgacaagacacaaacttt

SEQ ID NO: 180220 - DNA, 20 bp, Artificial Sequence
  chemically synthesized
ttccgacaagacacaaactt

SEQ ID NO: 180221 - DNA, 20 bp, Artificial Sequence
  chemically synthesized
ccctaaagtttgtgtcttgt

SEQ ID NO: 180222 - DNA, 20 bp, Artificial Sequence
  chemically synthesized
caggagcacttcattccgac

SEQ ID NO: 180223 - DNA, 20 bp, Artificial Sequence
  chemically synthesized
gtttgtgtcttgtcggaatg

SEQ ID NO: 180224 - DNA, 20 bp, Artificial Sequence
  chemically synthesized
tgtcggaatgaagtgctcct

SEQ ID NO: 180225 - DNA, 20 bp, Artificial Sequence
  chemically synthesized
gtcggaatgaagtgctcctg

SEQ ID NO: 180226 - DNA, 20 bp, Artificial Sequence
  chemically synthesized
tcggaatgaagtgctcctga

SEQ ID NO: 180227 - DNA, 20 bp, Artificial Sequence
  chemically synthesized
cggaatgaagtgctcctgag

SEQ ID NO: 180228 - DNA, 20 bp, Artificial Sequence
  chemically synthesized
ggaatgaagtgctcctgagg

SEQ ID NO: 180229 - DNA, 20 bp, Artificial Sequence
  chemically synthesized
tgatatattatccccctcag

SEQ ID NO: 180230 - DNA, 20 bp, Artificial Sequence
  chemically synthesized
cttgatatattatccccctc

SEQ ID NO: 180231 - DNA, 20 bp, Artificial Sequence
  chemically synthesized
tcttgatatattatccccct

SEQ ID NO: 180232 - DNA, 20 bp, Artificial Sequence
  chemically synthesized
cctgagggggataatatatc

SEQ ID NO: 180233 - DNA, 20 bp, Artificial Sequence
  chemically synthesized
gataatatatcaagatttct

SEQ ID NO: 180234 - DNA, 20 bp, Artificial Sequence
  chemically synthesized
atagtgaggcataaatgact

SEQ ID NO: 180235 - DNA, 20 bp, Artificial Sequence
  chemically synthesized
gtcatttatgcctcactatt

SEQ ID NO: 180236 - DNA, 20 bp, Artificial Sequence
  chemically synthesized
taatcatttccttaatagtg

SEQ ID NO: 180237 - DNA, 20 bp, Artificial Sequence
  chemically synthesized
tcatttatgcctcactatta

SEQ ID NO: 180238 - DNA, 20 bp, Artificial Sequence
  chemically synthesized
ctaatcatttccttaatagt

SEQ ID NO: 180239 - DNA, 20 bp, Artificial Sequence
  chemically synthesized
gttgctaatcatttccttaa

SEQ ID NO: 180240 - DNA, 20 bp, Artificial Sequence
  chemically synthesized
ctcactattaaggaaatgat

SEQ ID NO: 180241 - DNA, 20 bp, Artificial Sequence
  chemically synthesized
ggaaatgattagcaactttt

SEQ ID NO: 180242 - DNA, 20 bp, Artificial Sequence
  chemically synthesized
aatgattagcaacttttgag

SEQ ID NO: 180243 - DNA, 20 bp, Artificial Sequence
  chemically synthesized
cgttttccacatctactcaa

SEQ ID NO: 180244 - DNA, 20 bp, Artificial Sequence
  chemically synthesized
tagcaacttttgagtagatg

SEQ ID NO: 180245 - DNA, 20 bp, Artificial Sequence
  chemically synthesized
gagtagatgtggaaaacgat

SEQ ID NO: 180246 - DNA, 20 bp, Artificial Sequence
  chemically synthesized
agtagatgtggaaaacgatg

SEQ ID NO: 180247 - DNA, 20 bp, Artificial Sequence
  chemically synthesized
gtagatgtggaaaacgatga

SEQ ID NO: 180248 - DNA, 20 bp, Artificial Sequence
  chemically synthesized
aacgatgagggaaaaacctg

SEQ ID NO: 180249 - DNA, 20 bp, Artificial Sequence
  chemically synthesized
acgatgagggaaaaacctga

SEQ ID NO: 180250 - DNA, 20 bp, Artificial Sequence
  chemically synthesized
tgagggaaaaacctgaaggt

SEQ ID NO: 180251 - DNA, 20 bp, Artificial Sequence
  chemically synthesized
tattcgcattgctaaccttc

SEQ ID NO: 180252 - DNA, 20 bp, Artificial Sequence
  chemically synthesized
atattcgcattgctaacctt

SEQ ID NO: 180253 - DNA, 20 bp, Artificial Sequence
  chemically synthesized
tagcaatgcgaatatctgta

SEQ ID NO: 180254 - DNA, 20 bp, Artificial Sequence
  chemically synthesized
aatgcgaatatctgtatgga

SEQ ID NO: 180255 - DNA, 20 bp, Artificial Sequence
  chemically synthesized
atttggacttactttccata

SEQ ID NO: 180256 - DNA, 20 bp, Artificial Sequence
  chemically synthesized
cgaatatctgtatggaaagt

SEQ ID NO: 180257 - DNA, 20 bp, Artificial Sequence
  chemically synthesized
taactggcagcatttagatt

SEQ ID NO: 180258 - DNA, 20 bp, Artificial Sequence
  chemically synthesized
agctgataactggcagcatt

SEQ ID NO: 180259 - DNA, 20 bp, Artificial Sequence
  chemically synthesized
agtccaaatctaaatgctgc

SEQ ID NO: 180260 - DNA, 20 bp, Artificial Sequence
  chemically synthesized
cgtactcagctgataactgg

SEQ ID NO: 180261 - DNA, 20 bp, Artificial Sequence
  chemically synthesized
atctaaatgctgccagttat

SEQ ID NO: 180262 - DNA, 20 bp, Artificial Sequence
  chemically synthesized
tcacgtactcagctgataac

SEQ ID NO: 180263 - DNA, 20 bp, Artificial Sequence
  chemically synthesized
aatgctgccagttatcagct

SEQ ID NO: 180264 - DNA, 20 bp, Artificial Sequence
  chemically synthesized
ctcgcccgtgttcacgtact

SEQ ID NO: 180265 - DNA, 20 bp, Artificial Sequence
  chemically synthesized
atcagctgagtacgtgaaca

SEQ ID NO: 180266 - DNA, 20 bp, Artificial Sequence
  chemically synthesized
tcagctgagtacgtgaacac

SEQ ID NO: 180267 - DNA, 20 bp, Artificial Sequence
  chemically synthesized
ctgagtacgtgaacacgggc

SEQ ID NO: 180268 - DNA, 20 bp, Artificial Sequence
  chemically synthesized
actgagggctaaagagatta

SEQ ID NO: 180269 - DNA, 20 bp, Artificial Sequence
  chemically synthesized
aactgagggctaaagagatt

SEQ ID NO: 180270 - DNA, 20 bp, Artificial Sequence
  chemically synthesized
ggcgagttccttaatctctt

SEQ ID NO: 180271 - DNA, 20 bp, Artificial Sequence
  chemically synthesized
cgaggaaactgagggctaaa

SEQ ID NO: 180272 - DNA, 20 bp, Artificial Sequence
  chemically synthesized
tccttaatctctttagccct

SEQ ID NO: 180273 - DNA, 20 bp, Artificial Sequence
  chemically synthesized
gacgaggaaactgagggcta

SEQ ID NO: 180274 - DNA, 20 bp, Artificial Sequence
  chemically synthesized
ttttaagacgaggaaactga

SEQ ID NO: 180275 - DNA, 20 bp, Artificial Sequence
  chemically synthesized
attttaagacgaggaaactg

SEQ ID NO: 180276 - DNA, 20 bp, Artificial Sequence
  chemically synthesized
aattttaagacgaggaaact

SEQ ID NO: 180277 - DNA, 20 bp, Artificial Sequence
  chemically synthesized
attgttctaattttaagacg

SEQ ID NO: 180278 - DNA, 20 bp, Artificial Sequence
  chemically synthesized
tattgttctaattttaagac

SEQ ID NO: 180279 - DNA, 20 bp, Artificial Sequence
  chemically synthesized
cagtttcctcgtcttaaaat

SEQ ID NO: 180280 - DNA, 20 bp, Artificial Sequence
  chemically synthesized
atgtttattgttctaatttt

SEQ ID NO: 180281 - DNA, 20 bp, Artificial Sequence
  chemically synthesized
aattagaacaataaacattt

SEQ ID NO: 180282 - DNA, 20 bp, Artificial Sequence
  chemically synthesized
ttagaacaataaacatttta

SEQ ID NO: 180283 - DNA, 20 bp, Artificial Sequence
  chemically synthesized
taaacattttagagtgttgt

SEQ ID NO: 180284 - DNA, 20 bp, Artificial Sequence
  chemically synthesized
aaacattttagagtgttgtg

SEQ ID NO: 180285 - DNA, 20 bp, Artificial Sequence
  chemically synthesized
ttagagtgttgtgaggatta

SEQ ID NO: 180286 - DNA, 20 bp, Artificial Sequence
  chemically synthesized
gaggattaaagttttttttg

SEQ ID NO: 180287 - DNA, 20 bp, Artificial Sequence
  chemically synthesized
agttttttttgcagaaaccc

SEQ ID NO: 180288 - DNA, 20 bp, Artificial Sequence
  chemically synthesized
ttttgcagaaacccaagatt

SEQ ID NO: 180289 - DNA, 20 bp, Artificial Sequence
  chemically synthesized
gaagcactaggctaaatctt

SEQ ID NO: 180290 - DNA, 20 bp, Artificial Sequence
  chemically synthesized
tgaagcactaggctaaatct

SEQ ID NO: 180291 - DNA, 20 bp, Artificial Sequence
  chemically synthesized
cagaaacccaagatttagcc

SEQ ID NO: 180292 - DNA, 20 bp, Artificial Sequence
  chemically synthesized
agtgctgttagtgaagcact

SEQ ID NO: 180293 - DNA, 20 bp, Artificial Sequence
  chemically synthesized
gagtgctgttagtgaagcac

SEQ ID NO: 180294 - DNA, 20 bp, Artificial Sequence
  chemically synthesized
ttagcctagtgcttcactaa

SEQ ID NO: 180295 - DNA, 20 bp, Artificial Sequence
  chemically synthesized
ttttttgagtgctgttagtg

SEQ ID NO: 180296 - DNA, 20 bp, Artificial Sequence
  chemically synthesized
ccattttttttgagtgctgt

SEQ ID NO: 180297 - DNA, 20 bp, Artificial Sequence
  chemically synthesized
tgttctctaccatttttttt

SEQ ID NO: 180298 - DNA, 20 bp, Artificial Sequence
  chemically synthesized
ctaacagcactcaaaaaaaa

SEQ ID NO: 180299 - DNA, 20 bp, Artificial Sequence
  chemically synthesized
acagcactcaaaaaaaatgg

SEQ ID NO: 180300 - DNA, 20 bp, Artificial Sequence
  chemically synthesized
agcactcaaaaaaaatggta

SEQ ID NO: 180301 - DNA, 20 bp, Artificial Sequence
  chemically synthesized
aaaaatggtagagaacataa

SEQ ID NO: 180302 - DNA, 20 bp, Artificial Sequence
  chemically synthesized
aaaatggtagagaacataaa

SEQ ID NO: 180303 - DNA, 20 bp, Artificial Sequence
  chemically synthesized
aatggtagagaacataaaag

SEQ ID NO: 180304 - DNA, 20 bp, Artificial Sequence
  chemically synthesized
atggtagagaacataaaagg

SEQ ID NO: 180305 - DNA, 20 bp, Artificial Sequence
  chemically synthesized
acataaaaggaggtacaaaa

SEQ ID NO: 180306 - DNA, 20 bp, Artificial Sequence
  chemically synthesized
cataaaaggaggtacaaaaa

SEQ ID NO: 180307 - DNA, 20 bp, Artificial Sequence
  chemically synthesized
ataaaaggaggtacaaaaaa

SEQ ID NO: 180308 - DNA, 20 bp, Artificial Sequence
  chemically synthesized
ggtacaaaaaagggaaaata

SEQ ID NO: 180309 - DNA, 20 bp, Artificial Sequence
  chemically synthesized
aaaaagggaaaatatggata

SEQ ID NO: 180310 - DNA, 20 bp, Artificial Sequence
  chemically synthesized
aaagggaaaatatggataca

SEQ ID NO: 180311 - DNA, 20 bp, Artificial Sequence
  chemically synthesized
aattctaggattaaaacaga

SEQ ID NO: 180312 - DNA, 20 bp, Artificial Sequence
  chemically synthesized
acacaattctaggattaaaa

SEQ ID NO: 180313 - DNA, 20 bp, Artificial Sequence
  chemically synthesized
agagctttctgttttaatcc

SEQ ID NO: 180314 - DNA, 20 bp, Artificial Sequence
  chemically synthesized
gtgggcttagacacaattct

SEQ ID NO: 180315 - DNA, 20 bp, Artificial Sequence
  chemically synthesized
cgtgggcttagacacaattc

SEQ ID NO: 180316 - DNA, 20 bp, Artificial Sequence
  chemically synthesized
ttaatcctagaattgtgtct

SEQ ID NO: 180317 - DNA, 20 bp, Artificial Sequence
  chemically synthesized
tctatgtaagcacgtgggct

SEQ ID NO: 180318 - DNA, 20 bp, Artificial Sequence
  chemically synthesized
ttttatctatgtaagcacgt

SEQ ID NO: 180319 - DNA, 20 bp, Artificial Sequence
  chemically synthesized
cttttatctatgtaagcacg

SEQ ID NO: 180320 - DNA, 20 bp, Artificial Sequence
  chemically synthesized
tctaagcccacgtgcttaca

SEQ ID NO: 180321 - DNA, 20 bp, Artificial Sequence
  chemically synthesized
ataaatacttttatctatgt

SEQ ID NO: 180322 - DNA, 20 bp, Artificial Sequence
  chemically synthesized
ccacgtgcttacatagataa

SEQ ID NO: 180323 - DNA, 20 bp, Artificial Sequence
  chemically synthesized
aagtatttataaaacattat

SEQ ID NO: 180324 - DNA, 20 bp, Artificial Sequence
  chemically synthesized
tataaaacattatgagtaca

SEQ ID NO: 180325 - DNA, 20 bp, Artificial Sequence
  chemically synthesized
ataaaacattatgagtacac

SEQ ID NO: 180326 - DNA, 20 bp, Artificial Sequence
  chemically synthesized
aaaacattatgagtacacag

SEQ ID NO: 180327 - DNA, 20 bp, Artificial Sequence
  chemically synthesized
aaacattatgagtacacagg

SEQ ID NO: 180328 - DNA, 20 bp, Artificial Sequence
  chemically synthesized
acattatgagtacacaggag

SEQ ID NO: 180329 - DNA, 20 bp, Artificial Sequence
  chemically synthesized
ctcatcaaaagttcaatttt

SEQ ID NO: 180330 - DNA, 20 bp, Artificial Sequence
  chemically synthesized
ctcaaaattgaacttttgat

SEQ ID NO: 180331 - DNA, 20 bp, Artificial Sequence
  chemically synthesized
gttgtcaggtggctcatcaa

SEQ ID NO: 180332 - DNA, 20 bp, Artificial Sequence
  chemically synthesized
ggagaaataaagttgtcagg

SEQ ID NO: 180333 - DNA, 20 bp, Artificial Sequence
  chemically synthesized
tagggagaaataaagttgtc

SEQ ID NO: 180334 - DNA, 20 bp, Artificial Sequence
  chemically synthesized
gtagggagaaataaagttgt

SEQ ID NO: 180335 - DNA, 20 bp, Artificial Sequence
  chemically synthesized
tttgtcagtagggagaaata

SEQ ID NO: 180336 - DNA, 20 bp, Artificial Sequence
  chemically synthesized
caaggtagtttgtcagtagg

SEQ ID NO: 180337 - DNA, 20 bp, Artificial Sequence
  chemically synthesized
gtcaaggtagtttgtcagta

SEQ ID NO: 180338 - DNA, 20 bp, Artificial Sequence
  chemically synthesized
tgtcaaggtagtttgtcagt

SEQ ID NO: 180339 - DNA, 20 bp, Artificial Sequence
  chemically synthesized
ttgtcaaggtagtttgtcag

SEQ ID NO: 180340 - DNA, 20 bp, Artificial Sequence
  chemically synthesized
aatttgtcaaggtagtttgt

SEQ ID NO: 180341 - DNA, 20 bp, Artificial Sequence
  chemically synthesized
cccagcaaaatttgtcaagg

SEQ ID NO: 180342 - DNA, 20 bp, Artificial Sequence
  chemically synthesized
ttccccagcaaaatttgtca

SEQ ID NO: 180343 - DNA, 20 bp, Artificial Sequence
  chemically synthesized
tttccccagcaaaatttgtc

SEQ ID NO: 180344 - DNA, 20 bp, Artificial Sequence
  chemically synthesized
actaccttgacaaattttgc

SEQ ID NO: 180345 - DNA, 20 bp, Artificial Sequence
  chemically synthesized
ctaccttgacaaattttgct

SEQ ID NO: 180346 - DNA, 20 bp, Artificial Sequence
  chemically synthesized
taccttgacaaattttgctg

SEQ ID NO: 180347 - DNA, 20 bp, Artificial Sequence
  chemically synthesized
attctctattgttttttccc

SEQ ID NO: 180348 - DNA, 20 bp, Artificial Sequence
  chemically synthesized
ttttgctggggaaaaaacaa

SEQ ID NO: 180349 - DNA, 20 bp, Artificial Sequence
  chemically synthesized
ttgctggggaaaaaacaata

SEQ ID NO: 180350 - DNA, 20 bp, Artificial Sequence
  chemically synthesized
gagaattaatgtcaatctat

SEQ ID NO: 180351 - DNA, 20 bp, Artificial Sequence
  chemically synthesized
tctggtggcacatttactca

SEQ ID NO: 180352 - DNA, 20 bp, Artificial Sequence
  chemically synthesized
tctatgagtaaatgtgccac

SEQ ID NO: 180353 - DNA, 20 bp, Artificial Sequence
  chemically synthesized
gagtaaatgtgccaccagat

SEQ ID NO: 180354 - DNA, 20 bp, Artificial Sequence
  chemically synthesized
ctagaagtagtctcatctgg

SEQ ID NO: 180355 - DNA, 20 bp, Artificial Sequence
  chemically synthesized
cacctagaagtagtctcatc

SEQ ID NO: 180356 - DNA, 20 bp, Artificial Sequence
  chemically synthesized
ccaccagatgagactacttc

SEQ ID NO: 180357 - DNA, 20 bp, Artificial Sequence
  chemically synthesized
caccagatgagactacttct

SEQ ID NO: 180358 - DNA, 20 bp, Artificial Sequence
  chemically synthesized
atatatgcttcacctagaag

SEQ ID NO: 180359 - DNA, 20 bp, Artificial Sequence
  chemically synthesized
gatgagactacttctaggtg

SEQ ID NO: 180360 - DNA, 20 bp, Artificial Sequence
  chemically synthesized
tacatatatgcttcacctag

SEQ ID NO: 180361 - DNA, 20 bp, Artificial Sequence
  chemically synthesized
gattacatatatgcttcacc

SEQ ID NO: 180362 - DNA, 20 bp, Artificial Sequence
  chemically synthesized
tatatgtaatcacaatgcaa

SEQ ID NO: 180363 - DNA, 20 bp, Artificial Sequence
  chemically synthesized
caatgcaacagccatttatt

SEQ ID NO: 180364 - DNA, 20 bp, Artificial Sequence
  chemically synthesized
aatgcaacagccatttattg

SEQ ID NO: 180365 - DNA, 20 bp, Artificial Sequence
  chemically synthesized
actagtagaccctcaataaa

SEQ ID NO: 180366 - DNA, 20 bp, Artificial Sequence
  chemically synthesized
atgcaacagccatttattga

SEQ ID NO: 180367 - DNA, 20 bp, Artificial Sequence
  chemically synthesized
gccatttattgagggtctac

SEQ ID NO: 180368 - DNA, 20 bp, Artificial Sequence
  chemically synthesized
gccatatcaatggacactag

SEQ ID NO: 180369 - DNA, 20 bp, Artificial Sequence
  chemically synthesized
acggccatatcaatggacac

SEQ ID NO: 180370 - DNA, 20 bp, Artificial Sequence
  chemically synthesized
tctactagtgtccattgata

SEQ ID NO: 180371 - DNA, 20 bp, Artificial Sequence
  chemically synthesized
gatattcacggccatatcaa

SEQ ID NO: 180372 - DNA, 20 bp, Artificial Sequence
  chemically synthesized
attgatatggccgtgaatat

SEQ ID NO: 180373 - DNA, 20 bp, Artificial Sequence
  chemically synthesized
gggattgctgccgatattca

SEQ ID NO: 180374 - DNA, 20 bp, Artificial Sequence
  chemically synthesized
gatatggccgtgaatatcgg

SEQ ID NO: 180375 - DNA, 20 bp, Artificial Sequence
  chemically synthesized
cggcagcaatccctgcctca

SEQ ID NO: 180376 - DNA, 20 bp, Artificial Sequence
  chemically synthesized
gatgtaaggtccatgaggca

SEQ ID NO: 180377 - DNA, 20 bp, Artificial Sequence
  chemically synthesized
ggatgtaaggtccatgaggc

SEQ ID NO: 180378 - DNA, 20 bp, Artificial Sequence
  chemically synthesized
cggatgtaaggtccatgagg

SEQ ID NO: 180379 - DNA, 20 bp, Artificial Sequence
  chemically synthesized
aatcggatgtaaggtccatg

SEQ ID NO: 180380 - DNA, 20 bp, Artificial Sequence
  chemically synthesized
caatcggatgtaaggtccat

SEQ ID NO: 180381 - DNA, 20 bp, Artificial Sequence
  chemically synthesized
cttcctcccaatcggatgta

SEQ ID NO: 180382 - DNA, 20 bp, Artificial Sequence
  chemically synthesized
ccttcctcccaatcggatgt

SEQ ID NO: 180383 - DNA, 20 bp, Artificial Sequence
  chemically synthesized
tcatggaccttacatccgat

SEQ ID NO: 180384 - DNA, 20 bp, Artificial Sequence
  chemically synthesized
catggaccttacatccgatt

SEQ ID NO: 180385 - DNA, 20 bp, Artificial Sequence
  chemically synthesized
tggaccttacatccgattgg

SEQ ID NO: 180386 - DNA, 20 bp, Artificial Sequence
  chemically synthesized
ggaccttacatccgattggg

SEQ ID NO: 180387 - DNA, 20 bp, Artificial Sequence
  chemically synthesized
tgcctccccttcctcccaat

SEQ ID NO: 180388 - DNA, 20 bp, Artificial Sequence
  chemically synthesized
ccttacatccgattgggagg

SEQ ID NO: 180389 - DNA, 20 bp, Artificial Sequence
  chemically synthesized
cttacatccgattgggagga

SEQ ID NO: 180390 - DNA, 20 bp, Artificial Sequence
  chemically synthesized
ttacatccgattgggaggaa

SEQ ID NO: 180391 - DNA, 20 bp, Artificial Sequence
  chemically synthesized
tacatccgattgggaggaag

SEQ ID NO: 180392 - DNA, 20 bp, Artificial Sequence
  chemically synthesized
catccgattgggaggaaggg

SEQ ID NO: 180393 - DNA, 20 bp, Artificial Sequence
  chemically synthesized
atccgattgggaggaagggg

SEQ ID NO: 180394 - DNA, 20 bp, Artificial Sequence
  chemically synthesized
cgattgggaggaaggggagg

SEQ ID NO: 180395 - DNA, 20 bp, Artificial Sequence
  chemically synthesized
tgggaggaaggggaggcaga

SEQ ID NO: 180396 - DNA, 20 bp, Artificial Sequence
  chemically synthesized
aggggaggcagacagtaaac

SEQ ID NO: 180397 - DNA, 20 bp, Artificial Sequence
  chemically synthesized
ggcagacagtaaacaagata

SEQ ID NO: 180398 - DNA, 20 bp, Artificial Sequence
  chemically synthesized
agataaagaaataaaatcta

SEQ ID NO: 180399 - DNA, 20 bp, Artificial Sequence
  chemically synthesized
acttactgtatcacaatcta

SEQ ID NO: 180400 - DNA, 20 bp, Artificial Sequence
  chemically synthesized
aaaatctatagattgtgata

SEQ ID NO: 180401 - DNA, 20 bp, Artificial Sequence
  chemically synthesized
tctatagattgtgatacagt

SEQ ID NO: 180402 - DNA, 20 bp, Artificial Sequence
  chemically synthesized
ttgtgatacagtaagtgtta

SEQ ID NO: 180403 - DNA, 20 bp, Artificial Sequence
  chemically synthesized
gtgatacagtaagtgttaca

SEQ ID NO: 180404 - DNA, 20 bp, Artificial Sequence
  chemically synthesized
tgatacagtaagtgttacag

SEQ ID NO: 180405 - DNA, 20 bp, Artificial Sequence
  chemically synthesized
tgttacagaggaaaaaaatg

SEQ ID NO: 180406 - DNA, 20 bp, Artificial Sequence
  chemically synthesized
cagaggaaaaaaatgaagca

SEQ ID NO: 180407 - DNA, 20 bp, Artificial Sequence
  chemically synthesized
gaaaaaaatgaagcatggaa

SEQ ID NO: 180408 - DNA, 20 bp, Artificial Sequence
  chemically synthesized
aaaaaaatgaagcatggaaa

SEQ ID NO: 180409 - DNA, 20 bp, Artificial Sequence
  chemically synthesized
aaaaaatgaagcatggaaaa

SEQ ID NO: 180410 - DNA, 20 bp, Artificial Sequence
  chemically synthesized
aatgaagcatggaaaaggga

SEQ ID NO: 180411 - DNA, 20 bp, Artificial Sequence
  chemically synthesized
ggaaaagggatggaaatatt

SEQ ID NO: 180412 - DNA, 20 bp, Artificial Sequence
  chemically synthesized
gaaaagggatggaaatattg

SEQ ID NO: 180413 - DNA, 20 bp, Artificial Sequence
  chemically synthesized
aaaagggatggaaatattga

SEQ ID NO: 180414 - DNA, 20 bp, Artificial Sequence
  chemically synthesized
aaagggatggaaatattgag

SEQ ID NO: 180415 - DNA, 20 bp, Artificial Sequence
  chemically synthesized
gggatggaaatattgagggg

SEQ ID NO: 180416 - DNA, 20 bp, Artificial Sequence
  chemically synthesized
tggaaatattgaggggaaga

SEQ ID NO: 180417 - DNA, 20 bp, Artificial Sequence
  chemically synthesized
ggaaatattgaggggaagat

SEQ ID NO: 180418 - DNA, 20 bp, Artificial Sequence
  chemically synthesized
gaaatattgaggggaagatg

SEQ ID NO: 180419 - DNA, 20 bp, Artificial Sequence
  chemically synthesized
aatattgaggggaagatggg

SEQ ID NO: 180420 - DNA, 20 bp, Artificial Sequence
  chemically synthesized
attgaggggaagatggggag

SEQ ID NO: 180421 - DNA, 20 bp, Artificial Sequence
  chemically synthesized
ggagcagttgtgattttata

SEQ ID NO: 180422 - DNA, 20 bp, Artificial Sequence
  chemically synthesized
gagcagttgtgattttataa

SEQ ID NO: 180423 - DNA, 20 bp, Artificial Sequence
  chemically synthesized
agcagttgtgattttataaa

SEQ ID NO: 180424 - DNA, 20 bp, Artificial Sequence
  chemically synthesized
gattttataaagggtgatca

SEQ ID NO: 180425 - DNA, 20 bp, Artificial Sequence
  chemically synthesized
tttataaagggtgatcatag

SEQ ID NO: 180426 - DNA, 20 bp, Artificial Sequence
  chemically synthesized
ttataaagggtgatcataga

SEQ ID NO: 180427 - DNA, 20 bp, Artificial Sequence
  chemically synthesized
ggtgatcatagaaggttcca

SEQ ID NO: 180428 - DNA, 20 bp, Artificial Sequence
  chemically synthesized
tgatcatagaaggttccatg

SEQ ID NO: 180429 - DNA, 20 bp, Artificial Sequence
  chemically synthesized
tcatagaaggttccatggag

SEQ ID NO: 180430 - DNA, 20 bp, Artificial Sequence
  chemically synthesized
catagaaggttccatggaga

SEQ ID NO: 180431 - DNA, 20 bp, Artificial Sequence
  chemically synthesized
ctcaaatgtctccttctcca

SEQ ID NO: 180432 - DNA, 20 bp, Artificial Sequence
  chemically synthesized
tagaaggttccatggagaag

SEQ ID NO: 180433 - DNA, 20 bp, Artificial Sequence
  chemically synthesized
ccatggagaaggagacattt

SEQ ID NO: 180434 - DNA, 20 bp, Artificial Sequence
  chemically synthesized
gagaaggagacatttgagca

SEQ ID NO: 180435 - DNA, 20 bp, Artificial Sequence
  chemically synthesized
acatttgagcaaagtcctcg

SEQ ID NO: 180436 - DNA, 20 bp, Artificial Sequence
  chemically synthesized
tttgagcaaagtcctcgtgg

SEQ ID NO: 180437 - DNA, 20 bp, Artificial Sequence
  chemically synthesized
ttgagcaaagtcctcgtggt

SEQ ID NO: 180438 - DNA, 20 bp, Artificial Sequence
  chemically synthesized
tgagcaaagtcctcgtggta

SEQ ID NO: 180439 - DNA, 20 bp, Artificial Sequence
  chemically synthesized
gctagccagtccctaccacg

SEQ ID NO: 180440 - DNA, 20 bp, Artificial Sequence
  chemically synthesized
agctagccagtccctaccac

SEQ ID NO: 180441 - DNA, 20 bp, Artificial Sequence
  chemically synthesized
aaagtcctcgtggtagggac

SEQ ID NO: 180442 - DNA, 20 bp, Artificial Sequence
  chemically synthesized
tcctcgtggtagggactggc

SEQ ID NO: 180443 - DNA, 20 bp, Artificial Sequence
  chemically synthesized
ttgtctaatgagcagctagc

SEQ ID NO: 180444 - DNA, 20 bp, Artificial Sequence
  chemically synthesized
agacttgtctaatgagcagc

SEQ ID NO: 180445 - DNA, 20 bp, Artificial Sequence
  chemically synthesized
gggactggctagctgctcat

SEQ ID NO: 180446 - DNA, 20 bp, Artificial Sequence
  chemically synthesized
gagtagacttgtctaatgag

SEQ ID NO: 180447 - DNA, 20 bp, Artificial Sequence
  chemically synthesized
tggctagctgctcattagac

SEQ ID NO: 180448 - DNA, 20 bp, Artificial Sequence
  chemically synthesized
aatgagtagacttgtctaat

SEQ ID NO: 180449 - DNA, 20 bp, Artificial Sequence
  chemically synthesized
gcacaattaagagaaatgag

SEQ ID NO: 180450 - DNA, 20 bp, Artificial Sequence
  chemically synthesized
gctgcacaattaagagaaat

SEQ ID NO: 180451 - DNA, 20 bp, Artificial Sequence
  chemically synthesized
acagctagctgcacaattaa

SEQ ID NO: 180452 - DNA, 20 bp, Artificial Sequence
  chemically synthesized
actcatttctcttaattgtg

SEQ ID NO: 180453 - DNA, 20 bp, Artificial Sequence
  chemically synthesized
tgacagctagctgcacaatt

SEQ ID NO: 180454 - DNA, 20 bp, Artificial Sequence
  chemically synthesized
atttctcttaattgtgcagc

SEQ ID NO: 180455 - DNA, 20 bp, Artificial Sequence
  chemically synthesized
ggagactgggaaatgacagc

SEQ ID NO: 180456 - DNA, 20 bp, Artificial Sequence
  chemically synthesized
caagggagactgggaaatga

SEQ ID NO: 180457 - DNA, 20 bp, Artificial Sequence
  chemically synthesized
tgcagctagctgtcatttcc

SEQ ID NO: 180458 - DNA, 20 bp, Artificial Sequence
  chemically synthesized
aactaatggcaagggagact

SEQ ID NO: 180459 - DNA, 20 bp, Artificial Sequence
  chemically synthesized
aaactaatggcaagggagac

SEQ ID NO: 180460 - DNA, 20 bp, Artificial Sequence
  chemically synthesized
tagccaaactaatggcaagg

SEQ ID NO: 180461 - DNA, 20 bp, Artificial Sequence
  chemically synthesized
ttcccagtctcccttgccat

SEQ ID NO: 180462 - DNA, 20 bp, Artificial Sequence
  chemically synthesized
tgtagccaaactaatggcaa

SEQ ID NO: 180463 - DNA, 20 bp, Artificial Sequence
  chemically synthesized
atgtagccaaactaatggca

SEQ ID NO: 180464 - DNA, 20 bp, Artificial Sequence
  chemically synthesized
catgtagccaaactaatggc

SEQ ID NO: 180465 - DNA, 20 bp, Artificial Sequence
  chemically synthesized
agtctcccttgccattagtt

SEQ ID NO: 180466 - DNA, 20 bp, Artificial Sequence
  chemically synthesized
cagtcatgtagccaaactaa

SEQ ID NO: 180467 - DNA, 20 bp, Artificial Sequence
  chemically synthesized
attagtttggctacatgact

SEQ ID NO: 180468 - DNA, 20 bp, Artificial Sequence
  chemically synthesized
ttggctcgaactcagtcatg

SEQ ID NO: 180469 - DNA, 20 bp, Artificial Sequence
  chemically synthesized
ttggctacatgactgagttc

SEQ ID NO: 180470 - DNA, 20 bp, Artificial Sequence
  chemically synthesized
acactccattggctcgaact

SEQ ID NO: 180471 - DNA, 20 bp, Artificial Sequence
  chemically synthesized
catgactgagttcgagccaa

SEQ ID NO: 180472 - DNA, 20 bp, Artificial Sequence
  chemically synthesized
tgactgagttcgagccaatg

SEQ ID NO: 180473 - DNA, 20 bp, Artificial Sequence
  chemically synthesized
cacttttgctcacactccat

SEQ ID NO: 180474 - DNA, 20 bp, Artificial Sequence
  chemically synthesized
agttcgagccaatggagtgt

SEQ ID NO: 180475 - DNA, 20 bp, Artificial Sequence
  chemically synthesized
agccaatggagtgtgagcaa

SEQ ID NO: 180476 - DNA, 20 bp, Artificial Sequence
  chemically synthesized
gagccaggcttcatattcat

SEQ ID NO: 180477 - DNA, 20 bp, Artificial Sequence
  chemically synthesized
aagtgatgctcatgaatatg

SEQ ID NO: 180478 - DNA, 20 bp, Artificial Sequence
  chemically synthesized
atgctcatgaatatgaagcc

SEQ ID NO: 180479 - DNA, 20 bp, Artificial Sequence
  chemically synthesized
tggaggtggggttatgagcc

SEQ ID NO: 180480 - DNA, 20 bp, Artificial Sequence
  chemically synthesized
ttggaggtggggttatgagc

SEQ ID NO: 180481 - DNA, 20 bp, Artificial Sequence
  chemically synthesized
gttattggaggtggggttat

SEQ ID NO: 180482 - DNA, 20 bp, Artificial Sequence
  chemically synthesized
ggtggtggttattggaggtg

SEQ ID NO: 180483 - DNA, 20 bp, Artificial Sequence
  chemically synthesized
tggtggtggttattggaggt

SEQ ID NO: 180484 - DNA, 20 bp, Artificial Sequence
  chemically synthesized
gtggtggtggttattggagg

SEQ ID NO: 180485 - DNA, 20 bp, Artificial Sequence
  chemically synthesized
tatgtggtggtggttattgg

SEQ ID NO: 180486 - DNA, 20 bp, Artificial Sequence
  chemically synthesized
atatgtggtggtggttattg

SEQ ID NO: 180487 - DNA, 20 bp, Artificial Sequence
  chemically synthesized
acatatgtggtggtggttat

SEQ ID NO: 180488 - DNA, 20 bp, Artificial Sequence
  chemically synthesized
gaatattacatatgtggtgg

SEQ ID NO: 180489 - DNA, 20 bp, Artificial Sequence
  chemically synthesized
aaggaatattacatatgtgg

SEQ ID NO: 180490 - DNA, 20 bp, Artificial Sequence
  chemically synthesized
aacaaggaatattacatatg

SEQ ID NO: 180491 - DNA, 20 bp, Artificial Sequence
  chemically synthesized
cataagaatgaaaaagaaca

SEQ ID NO: 180492 - DNA, 20 bp, Artificial Sequence
  chemically synthesized
acataagaatgaaaaagaac

SEQ ID NO: 180493 - DNA, 20 bp, Artificial Sequence
  chemically synthesized
tcttgtacataagaatgaaa

SEQ ID NO: 180494 - DNA, 20 bp, Artificial Sequence
  chemically synthesized
tctttttcattcttatgtac

SEQ ID NO: 180495 - DNA, 20 bp, Artificial Sequence
  chemically synthesized
atcactgtgctcttgtacat

SEQ ID NO: 180496 - DNA, 20 bp, Artificial Sequence
  chemically synthesized
tttttcattcttatgtacaa

SEQ ID NO: 180497 - DNA, 20 bp, Artificial Sequence
  chemically synthesized
cattcttatgtacaagagca

SEQ ID NO: 180498 - DNA, 20 bp, Artificial Sequence
  chemically synthesized
attttgaaatccgtatgtta

SEQ ID NO: 180499 - DNA, 20 bp, Artificial Sequence
  chemically synthesized
gctctgatgtctttaacata

SEQ ID NO: 180500 - DNA, 20 bp, Artificial Sequence
  chemically synthesized
aatccgtatgttaaagacat

SEQ ID NO: 180501 - DNA, 20 bp, Artificial Sequence
  chemically synthesized
tccgtatgttaaagacatca

SEQ ID NO: 180502 - DNA, 20 bp, Artificial Sequence
  chemically synthesized
taaagacatcagagccacaa

SEQ ID NO: 180503 - DNA, 20 bp, Artificial Sequence
  chemically synthesized
cccagggcacttcgcttttg

SEQ ID NO: 180504 - DNA, 20 bp, Artificial Sequence
  chemically synthesized
acatcagagccacaaaagcg

SEQ ID NO: 180505 - DNA, 20 bp, Artificial Sequence
  chemically synthesized
gccacaaaagcgaagtgccc

SEQ ID NO: 180506 - DNA, 20 bp, Artificial Sequence
  chemically synthesized
ccacaaaagcgaagtgccct

SEQ ID NO: 180507 - DNA, 20 bp, Artificial Sequence
  chemically synthesized
tggtggatcaggggggccca

SEQ ID NO: 180508 - DNA, 20 bp, Artificial Sequence
  chemically synthesized
atggtggatcaggggggccc

SEQ ID NO: 180509 - DNA, 20 bp, Artificial Sequence
  chemically synthesized
aatggtggatcaggggggcc

SEQ ID NO: 180510 - DNA, 20 bp, Artificial Sequence
  chemically synthesized
ctccaaatggtggatcaggg

SEQ ID NO: 180511 - DNA, 20 bp, Artificial Sequence
  chemically synthesized
cctccaaatggtggatcagg

SEQ ID NO: 180512 - DNA, 20 bp, Artificial Sequence
  chemically synthesized
tcctccaaatggtggatcag

SEQ ID NO: 180513 - DNA, 20 bp, Artificial Sequence
  chemically synthesized
ttcctccaaatggtggatca

SEQ ID NO: 180514 - DNA, 20 bp, Artificial Sequence
  chemically synthesized
tttcctccaaatggtggatc

SEQ ID NO: 180515 - DNA, 20 bp, Artificial Sequence
  chemically synthesized
atttcctccaaatggtggat

SEQ ID NO: 180516 - DNA, 20 bp, Artificial Sequence
  chemically synthesized
ggcccccctgatccaccatt

SEQ ID NO: 180517 - DNA, 20 bp, Artificial Sequence
  chemically synthesized
cccccctgatccaccatttg

SEQ ID NO: 180518 - DNA, 20 bp, Artificial Sequence
  chemically synthesized
agtagatttcctccaaatgg

SEQ ID NO: 180519 - DNA, 20 bp, Artificial Sequence
  chemically synthesized
ccccctgatccaccatttgg

SEQ ID NO: 180520 - DNA, 20 bp, Artificial Sequence
  chemically synthesized
acaagtagatttcctccaaa

SEQ ID NO: 180521 - DNA, 20 bp, Artificial Sequence
  chemically synthesized
aaaattttctggtcaacaag

SEQ ID NO: 180522 - DNA, 20 bp, Artificial Sequence
  chemically synthesized
gaggaaatctacttgttgac

SEQ ID NO: 180523 - DNA, 20 bp, Artificial Sequence
  chemically synthesized
acaaaaattttctggtcaac

SEQ ID NO: 180524 - DNA, 20 bp, Artificial Sequence
  chemically synthesized
caaactttacaaaaattttc

SEQ ID NO: 180525 - DNA, 20 bp, Artificial Sequence
  chemically synthesized
ttgaccagaaaatttttgta

SEQ ID NO: 180526 - DNA, 20 bp, Artificial Sequence
  chemically synthesized
ttttgtaaagtttgcatgaa

SEQ ID NO: 180527 - DNA, 20 bp, Artificial Sequence
  chemically synthesized
gtaaagtttgcatgaacgga

SEQ ID NO: 180528 - DNA, 20 bp, Artificial Sequence
  chemically synthesized
cggaaagtttctattatgtt

SEQ ID NO: 180529 - DNA, 20 bp, Artificial Sequence
  chemically synthesized
acctcagtggcttaacataa

SEQ ID NO: 180530 - DNA, 20 bp, Artificial Sequence
  chemically synthesized
ttctattatgttaagccact

SEQ ID NO: 180531 - DNA, 20 bp, Artificial Sequence
  chemically synthesized
tctattatgttaagccactg

SEQ ID NO: 180532 - DNA, 20 bp, Artificial Sequence
  chemically synthesized
aaaaaaagcccacacctcag

SEQ ID NO: 180533 - DNA, 20 bp, Artificial Sequence
  chemically synthesized
tatgttaagccactgaggtg

SEQ ID NO: 180534 - DNA, 20 bp, Artificial Sequence
  chemically synthesized
atgttaagccactgaggtgt

SEQ ID NO: 180535 - DNA, 20 bp, Artificial Sequence
  chemically synthesized
aaaaaaaaaagcccacacct

SEQ ID NO: 180536 - DNA, 20 bp, Artificial Sequence
  chemically synthesized
aagctgctataaaaaaaaaa

SEQ ID NO: 180537 - DNA, 20 bp, Artificial Sequence
  chemically synthesized
tgtgggctttttttttttta

SEQ ID NO: 180538 - DNA, 20 bp, Artificial Sequence
  chemically synthesized
gggcttttttttttttatag

SEQ ID NO: 180539 - DNA, 20 bp, Artificial Sequence
  chemically synthesized
tttttatagcagctttaata

SEQ ID NO: 180540 - DNA, 20 bp, Artificial Sequence
  chemically synthesized
tatattacctatctttatta

SEQ ID NO: 180541 - DNA, 20 bp, Artificial Sequence
  chemically synthesized
tatagcagctttaataaaga

SEQ ID NO: 180542 - DNA, 20 bp, Artificial Sequence
  chemically synthesized
atagcagctttaataaagat

SEQ ID NO: 180543 - DNA, 20 bp, Artificial Sequence
  chemically synthesized
tttaataaagataggtaata

SEQ ID NO: 180544 - DNA, 20 bp, Artificial Sequence
  chemically synthesized
agataggtaatatagaaata

SEQ ID NO: 180545 - DNA, 20 bp, Artificial Sequence
  chemically synthesized
taggtaatatagaaataaag

SEQ ID NO: 180546 - DNA, 20 bp, Artificial Sequence
  chemically synthesized
taatatagaaataaagaagc

SEQ ID NO: 180547 - DNA, 20 bp, Artificial Sequence
  chemically synthesized
aatatagaaataaagaagcg

SEQ ID NO: 180548 - DNA, 20 bp, Artificial Sequence
  chemically synthesized
atatagaaataaagaagcga

SEQ ID NO: 180549 - DNA, 20 bp, Artificial Sequence
  chemically synthesized
atagaaataaagaagcgagg

SEQ ID NO: 180550 - DNA, 20 bp, Artificial Sequence
  chemically synthesized
tagaaataaagaagcgaggg

SEQ ID NO: 180551 - DNA, 20 bp, Artificial Sequence
  chemically synthesized
gaaataaagaagcgagggag

SEQ ID NO: 180552 - DNA, 20 bp, Artificial Sequence
  chemically synthesized
aaataaagaagcgagggagg

SEQ ID NO: 180553 - DNA, 20 bp, Artificial Sequence
  chemically synthesized
tctttcccgcaatatttgca

SEQ ID NO: 180554 - DNA, 20 bp, Artificial Sequence
  chemically synthesized
aggaggccatgcaaatattg

SEQ ID NO: 180555 - DNA, 20 bp, Artificial Sequence
  chemically synthesized
ggaggccatgcaaatattgc

SEQ ID NO: 180556 - DNA, 20 bp, Artificial Sequence
  chemically synthesized
gccatgcaaatattgcggga

SEQ ID NO: 180557 - DNA, 20 bp, Artificial Sequence
  chemically synthesized
attgcgggaaagaacgccct

SEQ ID NO: 180558 - DNA, 20 bp, Artificial Sequence
  chemically synthesized
gcgggaaagaacgccctaag

SEQ ID NO: 180559 - DNA, 20 bp, Artificial Sequence
  chemically synthesized
gggaaagaacgccctaagca

SEQ ID NO: 180560 - DNA, 20 bp, Artificial Sequence
  chemically synthesized
gtacttgttttctctgctta

SEQ ID NO: 180561 - DNA, 20 bp, Artificial Sequence
  chemically synthesized
tgtacttgttttctctgctt

SEQ ID NO: 180562 - DNA, 20 bp, Artificial Sequence
  chemically synthesized
ttgtacttgttttctctgct

SEQ ID NO: 180563 - DNA, 20 bp, Artificial Sequence
  chemically synthesized
acgccctaagcagagaaaac

SEQ ID NO: 180564 - DNA, 20 bp, Artificial Sequence
  chemically synthesized
aagcagagaaaacaagtaca

SEQ ID NO: 180565 - DNA, 20 bp, Artificial Sequence
  chemically synthesized
agcagagaaaacaagtacaa

SEQ ID NO: 180566 - DNA, 20 bp, Artificial Sequence
  chemically synthesized
aaaacaagtacaaaggcctt

SEQ ID NO: 180567 - DNA, 20 bp, Artificial Sequence
  chemically synthesized
aaacaagtacaaaggccttg

SEQ ID NO: 180568 - DNA, 20 bp, Artificial Sequence
  chemically synthesized
caagtacaaaggccttgagg

SEQ ID NO: 180569 - DNA, 20 bp, Artificial Sequence
  chemically synthesized
aagtacaaaggccttgaggc

SEQ ID NO: 180570 - DNA, 20 bp, Artificial Sequence
  chemically synthesized
cttactacactcctgcctca

SEQ ID NO: 180571 - DNA, 20 bp, Artificial Sequence
  chemically synthesized
gtacaaaggccttgaggcag

SEQ ID NO: 180572 - DNA, 20 bp, Artificial Sequence
  chemically synthesized
tcttactacactcctgcctc

SEQ ID NO: 180573 - DNA, 20 bp, Artificial Sequence
  chemically synthesized
aaggccttgaggcaggagtg

SEQ ID NO: 180574 - DNA, 20 bp, Artificial Sequence
  chemically synthesized
ccttgaggcaggagtgtagt

SEQ ID NO: 180575 - DNA, 20 bp, Artificial Sequence
  chemically synthesized
tagtaagaacgtcctaaaaa

SEQ ID NO: 180576 - DNA, 20 bp, Artificial Sequence
  chemically synthesized
ttcacttcttcgctgttttt

SEQ ID NO: 180577 - DNA, 20 bp, Artificial Sequence
  chemically synthesized
gttcacttcttcgctgtttt

SEQ ID NO: 180578 - DNA, 20 bp, Artificial Sequence
  chemically synthesized
agaacgtcctaaaaacagcg

SEQ ID NO: 180579 - DNA, 20 bp, Artificial Sequence
  chemically synthesized
acgtcctaaaaacagcgaag

SEQ ID NO: 180580 - DNA, 20 bp, Artificial Sequence
  chemically synthesized
aaaacagcgaagaagtgaac

SEQ ID NO: 180581 - DNA, 20 bp, Artificial Sequence
  chemically synthesized
acagcgaagaagtgaacaag

SEQ ID NO: 180582 - DNA, 20 bp, Artificial Sequence
  chemically synthesized
gaagaagtgaacaagaagtt

SEQ ID NO: 180583 - DNA, 20 bp, Artificial Sequence
  chemically synthesized
gtgaacaagaagttcagaaa

SEQ ID NO: 180584 - DNA, 20 bp, Artificial Sequence
  chemically synthesized
gaacaagaagttcagaaatg

SEQ ID NO: 180585 - DNA, 20 bp, Artificial Sequence
  chemically synthesized
aagaagttcagaaatggagt

SEQ ID NO: 180586 - DNA, 20 bp, Artificial Sequence
  chemically synthesized
agaagttcagaaatggagtg

SEQ ID NO: 180587 - DNA, 20 bp, Artificial Sequence
  chemically synthesized
gttcagaaatggagtgagga

SEQ ID NO: 180588 - DNA, 20 bp, Artificial Sequence
  chemically synthesized
ttcagaaatggagtgaggaa

SEQ ID NO: 180589 - DNA, 20 bp, Artificial Sequence
  chemically synthesized
cagaaatggagtgaggaaag

SEQ ID NO: 180590 - DNA, 20 bp, Artificial Sequence
  chemically synthesized
gagtgaggaaaggagattac

SEQ ID NO: 180591 - DNA, 20 bp, Artificial Sequence
  chemically synthesized
ggaaaggagattactagatg

SEQ ID NO: 180592 - DNA, 20 bp, Artificial Sequence
  chemically synthesized
gaaggcttttgggccacatc

SEQ ID NO: 180593 - DNA, 20 bp, Artificial Sequence
  chemically synthesized
gattactagatgtggcccaa

SEQ ID NO: 180594 - DNA, 20 bp, Artificial Sequence
  chemically synthesized
tctctgaatagaaggctttt

SEQ ID NO: 180595 - DNA, 20 bp, Artificial Sequence
  chemically synthesized
atctctgaatagaaggcttt

SEQ ID NO: 180596 - DNA, 20 bp, Artificial Sequence
  chemically synthesized
tggcccaaaagccttctatt

SEQ ID NO: 180597 - DNA, 20 bp, Artificial Sequence
  chemically synthesized
agatagaatctctgaataga

SEQ ID NO: 180598 - DNA, 20 bp, Artificial Sequence
  chemically synthesized
gcccaaaagccttctattca

SEQ ID NO: 180599 - DNA, 20 bp, Artificial Sequence
  chemically synthesized
cagatagaatctctgaatag

SEQ ID NO: 180600 - DNA, 20 bp, Artificial Sequence
  chemically synthesized
ttccagatagaatctctgaa

SEQ ID NO: 180601 - DNA, 20 bp, Artificial Sequence
  chemically synthesized
ttctattcagagattctatc

SEQ ID NO: 180602 - DNA, 20 bp, Artificial Sequence
  chemically synthesized
aaaagccttcagattccaga

SEQ ID NO: 180603 - DNA, 20 bp, Artificial Sequence
  chemically synthesized
gagattctatctggaatctg

SEQ ID NO: 180604 - DNA, 20 bp, Artificial Sequence
  chemically synthesized
ttataaaagccttcagattc

SEQ ID NO: 180605 - DNA, 20 bp, Artificial Sequence
  chemically synthesized
agattctatctggaatctga

SEQ ID NO: 180606 - DNA, 20 bp, Artificial Sequence
  chemically synthesized
atagggattataaaagcctt

SEQ ID NO: 180607 - DNA, 20 bp, Artificial Sequence
  chemically synthesized
atgtgggatagggattataa

SEQ ID NO: 180608 - DNA, 20 bp, Artificial Sequence
  chemically synthesized
actgaattcgatgtgggata

SEQ ID NO: 180609 - DNA, 20 bp, Artificial Sequence
  chemically synthesized
aactgaattcgatgtgggat

SEQ ID NO: 180610 - DNA, 20 bp, Artificial Sequence
  chemically synthesized
aaactgaattcgatgtggga

SEQ ID NO: 180611 - DNA, 20 bp, Artificial Sequence
  chemically synthesized
ccagaaactgaattcgatgt

SEQ ID NO: 180612 - DNA, 20 bp, Artificial Sequence
  chemically synthesized
cccagaaactgaattcgatg

SEQ ID NO: 180613 - DNA, 20 bp, Artificial Sequence
  chemically synthesized
tccctatcccacatcgaatt

SEQ ID NO: 180614 - DNA, 20 bp, Artificial Sequence
  chemically synthesized
cccacatcgaattcagtttc

SEQ ID NO: 180615 - DNA, 20 bp, Artificial Sequence
  chemically synthesized
ccacatcgaattcagtttct

SEQ ID NO: 180616 - DNA, 20 bp, Artificial Sequence
  chemically synthesized
ctctataatttatttttacc

SEQ ID NO: 180617 - DNA, 20 bp, Artificial Sequence
  chemically synthesized
ttctgggtaaaaataaatta

SEQ ID NO: 180618 - DNA, 20 bp, Artificial Sequence
  chemically synthesized
ctgggtaaaaataaattata

SEQ ID NO: 180619 - DNA, 20 bp, Artificial Sequence
  chemically synthesized
aaattatagagcaatatgtt

SEQ ID NO: 180620 - DNA, 20 bp, Artificial Sequence
  chemically synthesized
aattatagagcaatatgttt

SEQ ID NO: 180621 - DNA, 20 bp, Artificial Sequence
  chemically synthesized
gcaatatgtttgggaaatct

SEQ ID NO: 180622 - DNA, 20 bp, Artificial Sequence
  chemically synthesized
tggagaacacagttcagtct

SEQ ID NO: 180623 - DNA, 20 bp, Artificial Sequence
  chemically synthesized
tagcattggagaacacagtt

SEQ ID NO: 180624 - DNA, 20 bp, Artificial Sequence
  chemically synthesized
taaagtagcattggagaaca

SEQ ID NO: 180625 - DNA, 20 bp, Artificial Sequence
  chemically synthesized
gatctattaaagtagcattg

SEQ ID NO: 180626 - DNA, 20 bp, Artificial Sequence
  chemically synthesized
tggatctattaaagtagcat

SEQ ID NO: 180627 - DNA, 20 bp, Artificial Sequence
  chemically synthesized
gttctccaatgctactttaa

SEQ ID NO: 180628 - DNA, 20 bp, Artificial Sequence
  chemically synthesized
gttgattggatctattaaag

SEQ ID NO: 180629 - DNA, 20 bp, Artificial Sequence
  chemically synthesized
ttagttgattggatctatta

SEQ ID NO: 180630 - DNA, 20 bp, Artificial Sequence
  chemically synthesized
ctagggctcagttagttgat

SEQ ID NO: 180631 - DNA, 20 bp, Artificial Sequence
  chemically synthesized
atagatccaatcaactaact

SEQ ID NO: 180632 - DNA, 20 bp, Artificial Sequence
  chemically synthesized
gggaagtcctagggctcagt

SEQ ID NO: 180633 - DNA, 20 bp, Artificial Sequence
  chemically synthesized
ccaatcaactaactgagccc

SEQ ID NO: 180634 - DNA, 20 bp, Artificial Sequence
  chemically synthesized
caatcaactaactgagccct

SEQ ID NO: 180635 - DNA, 20 bp, Artificial Sequence
  chemically synthesized
tggggggaagtcctagggct

SEQ ID NO: 180636 - DNA, 20 bp, Artificial Sequence
  chemically synthesized
aaatctggggggaagtccta

SEQ ID NO: 180637 - DNA, 20 bp, Artificial Sequence
  chemically synthesized
aaaatctggggggaagtcct

SEQ ID NO: 180638 - DNA, 20 bp, Artificial Sequence
  chemically synthesized
aaaaatctggggggaagtcc

SEQ ID NO: 180639 - DNA, 20 bp, Artificial Sequence
  chemically synthesized
tgagccctaggacttccccc

SEQ ID NO: 180640 - DNA, 20 bp, Artificial Sequence
  chemically synthesized
acacacaaaaatctgggggg

SEQ ID NO: 180641 - DNA, 20 bp, Artificial Sequence
  chemically synthesized
agcacacacaaaaatctggg

SEQ ID NO: 180642 - DNA, 20 bp, Artificial Sequence
  chemically synthesized
cagcacacacaaaaatctgg

SEQ ID NO: 180643 - DNA, 20 bp, Artificial Sequence
  chemically synthesized
acagcacacacaaaaatctg

SEQ ID NO: 180644 - DNA, 20 bp, Artificial Sequence
  chemically synthesized
gacagcacacacaaaaatct

SEQ ID NO: 180645 - DNA, 20 bp, Artificial Sequence
  chemically synthesized
agacagcacacacaaaaatc

SEQ ID NO: 180646 - DNA, 20 bp, Artificial Sequence
  chemically synthesized
ttttgtgtgtgctgtctaca

SEQ ID NO: 180647 - DNA, 20 bp, Artificial Sequence
  chemically synthesized
tgtttcagcaactgtgtaga

SEQ ID NO: 180648 - DNA, 20 bp, Artificial Sequence
  chemically synthesized
agcctgtttcagcaactgtg

SEQ ID NO: 180649 - DNA, 20 bp, Artificial Sequence
  chemically synthesized
tgtctacacagttgctgaaa

SEQ ID NO: 180650 - DNA, 20 bp, Artificial Sequence
  chemically synthesized
gtctacacagttgctgaaac

SEQ ID NO: 180651 - DNA, 20 bp, Artificial Sequence
  chemically synthesized
gattttcccgaagcctgttt

SEQ ID NO: 180652 - DNA, 20 bp, Artificial Sequence
  chemically synthesized
acagttgctgaaacaggctt

SEQ ID NO: 180653 - DNA, 20 bp, Artificial Sequence
  chemically synthesized
cagttgctgaaacaggcttc

SEQ ID NO: 180654 - DNA, 20 bp, Artificial Sequence
  chemically synthesized
agcatcctcagattttcccg

SEQ ID NO: 180655 - DNA, 20 bp, Artificial Sequence
  chemically synthesized
aacaggcttcgggaaaatct

SEQ ID NO: 180656 - DNA, 20 bp, Artificial Sequence
  chemically synthesized
acaggcttcgggaaaatctg

SEQ ID NO: 180657 - DNA, 20 bp, Artificial Sequence
  chemically synthesized
atgaagatccaaagcatcct

SEQ ID NO: 180658 - DNA, 20 bp, Artificial Sequence
  chemically synthesized
gggaaaatctgaggatgctt

SEQ ID NO: 180659 - DNA, 20 bp, Artificial Sequence
  chemically synthesized
ctctgacagatgaagatcca

SEQ ID NO: 180660 - DNA, 20 bp, Artificial Sequence
  chemically synthesized
tgctttggatcttcatctgt

SEQ ID NO: 180661 - DNA, 20 bp, Artificial Sequence
  chemically synthesized
aactctgcctctgacagatg

SEQ ID NO: 180662 - DNA, 20 bp, Artificial Sequence
  chemically synthesized
ctttggatcttcatctgtca

SEQ ID NO: 180663 - DNA, 20 bp, Artificial Sequence
  chemically synthesized
tttggatcttcatctgtcag

SEQ ID NO: 180664 - DNA, 20 bp, Artificial Sequence
  chemically synthesized
ggatcttcatctgtcagagg

SEQ ID NO: 180665 - DNA, 20 bp, Artificial Sequence
  chemically synthesized
tgatgtaactctgcctctga

SEQ ID NO: 180666 - DNA, 20 bp, Artificial Sequence
  chemically synthesized
atcttcatctgtcagaggca

SEQ ID NO: 180667 - DNA, 20 bp, Artificial Sequence
  chemically synthesized
ggcagagttacatcacctat

SEQ ID NO: 180668 - DNA, 20 bp, Artificial Sequence
  chemically synthesized
agttacatcacctatcagta

SEQ ID NO: 180669 - DNA, 20 bp, Artificial Sequence
  chemically synthesized
ttgtgacaggctttactgat

SEQ ID NO: 180670 - DNA, 20 bp, Artificial Sequence
  chemically synthesized
tttgtgacaggctttactga

SEQ ID NO: 180671 - DNA, 20 bp, Artificial Sequence
  chemically synthesized
tatcagtaaagcctgtcaca

SEQ ID NO: 180672 - DNA, 20 bp, Artificial Sequence
  chemically synthesized
gatggtaatggctttgtgac

SEQ ID NO: 180673 - DNA, 20 bp, Artificial Sequence
  chemically synthesized
ggatggtaatggctttgtga

SEQ ID NO: 180674 - DNA, 20 bp, Artificial Sequence
  chemically synthesized
cattttctatcggatggtaa

SEQ ID NO: 180675 - DNA, 20 bp, Artificial Sequence
  chemically synthesized
acaaagccattaccatccga

SEQ ID NO: 180676 - DNA, 20 bp, Artificial Sequence
  chemically synthesized
taattgcattttctatcgga

SEQ ID NO: 180677 - DNA, 20 bp, Artificial Sequence
  chemically synthesized
ctcttaattgcattttctat

SEQ ID NO: 180678 - DNA, 20 bp, Artificial Sequence
  chemically synthesized
atccgatagaaaatgcaatt

SEQ ID NO: 180679 - DNA, 20 bp, Artificial Sequence
  chemically synthesized
ccgatagaaaatgcaattaa

SEQ ID NO: 180680 - DNA, 20 bp, Artificial Sequence
  chemically synthesized
cgatagaaaatgcaattaag

SEQ ID NO: 180681 - DNA, 20 bp, Artificial Sequence
  chemically synthesized
gatagaaaatgcaattaaga

SEQ ID NO: 180682 - DNA, 20 bp, Artificial Sequence
  chemically synthesized
aaatcagaaaaaacggtttg

SEQ ID NO: 180683 - DNA, 20 bp, Artificial Sequence
  chemically synthesized
gggattcaaatcagaaaaaa

SEQ ID NO: 180684 - DNA, 20 bp, Artificial Sequence
  chemically synthesized
aactgaactgggattcaaat

SEQ ID NO: 180685 - DNA, 20 bp, Artificial Sequence
  chemically synthesized
gttttttctgatttgaatcc

SEQ ID NO: 180686 - DNA, 20 bp, Artificial Sequence
  chemically synthesized
ttctgatttgaatcccagtt

SEQ ID NO: 180687 - DNA, 20 bp, Artificial Sequence
  chemically synthesized
gcgaagggaaaaactgaact

SEQ ID NO: 180688 - DNA, 20 bp, Artificial Sequence
  chemically synthesized
tgcgaagggaaaaactgaac

SEQ ID NO: 180689 - DNA, 20 bp, Artificial Sequence
  chemically synthesized
cagttcagtttttcccttcg

SEQ ID NO: 180690 - DNA, 20 bp, Artificial Sequence
  chemically synthesized
ggtgtttgaatgtctgcgaa

SEQ ID NO: 180691 - DNA, 20 bp, Artificial Sequence
  chemically synthesized
tggtgtttgaatgtctgcga

SEQ ID NO: 180692 - DNA, 20 bp, Artificial Sequence
  chemically synthesized
atggtgtttgaatgtctgcg

SEQ ID NO: 180693 - DNA, 20 bp, Artificial Sequence
  chemically synthesized
acgtttaggcaggaagatga

SEQ ID NO: 180694 - DNA, 20 bp, Artificial Sequence
  chemically synthesized
gaggagcacgtttaggcagg

SEQ ID NO: 180695 - DNA, 20 bp, Artificial Sequence
  chemically synthesized
acagaggagcacgtttaggc

SEQ ID NO: 180696 - DNA, 20 bp, Artificial Sequence
  chemically synthesized
gacagaggagcacgtttagg

SEQ ID NO: 180697 - DNA, 20 bp, Artificial Sequence
  chemically synthesized
cttgacagaggagcacgttt

SEQ ID NO: 180698 - DNA, 20 bp, Artificial Sequence
  chemically synthesized
acttgacagaggagcacgtt

SEQ ID NO: 180699 - DNA, 20 bp, Artificial Sequence
  chemically synthesized
cctaaacgtgctcctctgtc

SEQ ID NO: 180700 - DNA, 20 bp, Artificial Sequence
  chemically synthesized
atccattgaacttgacagag

SEQ ID NO: 180701 - DNA, 20 bp, Artificial Sequence
  chemically synthesized
tcatccattgaacttgacag

SEQ ID NO: 180702 - DNA, 20 bp, Artificial Sequence
  chemically synthesized
gtcatccattgaacttgaca

SEQ ID NO: 180703 - DNA, 20 bp, Artificial Sequence
  chemically synthesized
gagtcatccattgaacttga

SEQ ID NO: 180704 - DNA, 20 bp, Artificial Sequence
  chemically synthesized
tgctcctctgtcaagttcaa

SEQ ID NO: 180705 - DNA, 20 bp, Artificial Sequence
  chemically synthesized
agttcaatggatgactccac

SEQ ID NO: 180706 - DNA, 20 bp, Artificial Sequence
  chemically synthesized
taaaaaaccgggagctggtg

SEQ ID NO: 180707 - DNA, 20 bp, Artificial Sequence
  chemically synthesized
cttaaaaaaccgggagctgg

SEQ ID NO: 180708 - DNA, 20 bp, Artificial Sequence
  chemically synthesized
tggatgactccaccagctcc

SEQ ID NO: 180709 - DNA, 20 bp, Artificial Sequence
  chemically synthesized
cagcttaaaaaaccgggagc

SEQ ID NO: 180710 - DNA, 20 bp, Artificial Sequence
  chemically synthesized
ctttcagcttaaaaaaccgg

SEQ ID NO: 180711 - DNA, 20 bp, Artificial Sequence
  chemically synthesized
cactttcagcttaaaaaacc

SEQ ID NO: 180712 - DNA, 20 bp, Artificial Sequence
  chemically synthesized
ccaccagctcccggtttttt

SEQ ID NO: 180713 - DNA, 20 bp, Artificial Sequence
  chemically synthesized
acactttcagcttaaaaaac

SEQ ID NO: 180714 - DNA, 20 bp, Artificial Sequence
  chemically synthesized
ctcccggttttttaagctga

SEQ ID NO: 180715 - DNA, 20 bp, Artificial Sequence
  chemically synthesized
ggttttttaagctgaaagtg

SEQ ID NO: 180716 - DNA, 20 bp, Artificial Sequence
  chemically synthesized
aaggatgacttctacacttt

SEQ ID NO: 180717 - DNA, 20 bp, Artificial Sequence
  chemically synthesized
tttttaagctgaaagtgtag

SEQ ID NO: 180718 - DNA, 20 bp, Artificial Sequence
  chemically synthesized
tgagggagagagaagaatca

SEQ ID NO: 180719 - DNA, 20 bp, Artificial Sequence
  chemically synthesized
gtgagggagagagaagaatc

SEQ ID NO: 180720 - DNA, 20 bp, Artificial Sequence
  chemically synthesized
tctgggagtgagggagagag

SEQ ID NO: 180721 - DNA, 20 bp, Artificial Sequence
  chemically synthesized
cgctctgggagtgagggaga

SEQ ID NO: 180722 - DNA, 20 bp, Artificial Sequence
  chemically synthesized
tacgctctgggagtgaggga

SEQ ID NO: 180723 - DNA, 20 bp, Artificial Sequence
  chemically synthesized
gatacgctctgggagtgagg

SEQ ID NO: 180724 - DNA, 20 bp, Artificial Sequence
  chemically synthesized
tcttctctctccctcactcc

SEQ ID NO: 180725 - DNA, 20 bp, Artificial Sequence
  chemically synthesized
ttgatacgctctgggagtga

SEQ ID NO: 180726 - DNA, 20 bp, Artificial Sequence
  chemically synthesized
attgatacgctctgggagtg

SEQ ID NO: 180727 - DNA, 20 bp, Artificial Sequence
  chemically synthesized
ttctctctccctcactccca

SEQ ID NO: 180728 - DNA, 20 bp, Artificial Sequence
  chemically synthesized
tattgatacgctctgggagt

SEQ ID NO: 180729 - DNA, 20 bp, Artificial Sequence
  chemically synthesized
tgcttattgatacgctctgg

SEQ ID NO: 180730 - DNA, 20 bp, Artificial Sequence
  chemically synthesized
catgcttattgatacgctct

SEQ ID NO: 180731 - DNA, 20 bp, Artificial Sequence
  chemically synthesized
acatgcttattgatacgctc

SEQ ID NO: 180732 - DNA, 20 bp, Artificial Sequence
  chemically synthesized
cactcccagagcgtatcaat

SEQ ID NO: 180733 - DNA, 20 bp, Artificial Sequence
  chemically synthesized
atcaataagcatgtcctcat

SEQ ID NO: 180734 - DNA, 20 bp, Artificial Sequence
  chemically synthesized
atttctcaagtggacttatg

SEQ ID NO: 180735 - DNA, 20 bp, Artificial Sequence
  chemically synthesized
gatttctcaagtggacttat

SEQ ID NO: 180736 - DNA, 20 bp, Artificial Sequence
  chemically synthesized
atgtcctcataagtccactt

SEQ ID NO: 180737 - DNA, 20 bp, Artificial Sequence
  chemically synthesized
ttcaagagagatttctcaag

SEQ ID NO: 180738 - DNA, 20 bp, Artificial Sequence
  chemically synthesized
agattcaagagagatttctc

SEQ ID NO: 180739 - DNA, 20 bp, Artificial Sequence
  chemically synthesized
agaagtgggcagattcaaga

SEQ ID NO: 180740 - DNA, 20 bp, Artificial Sequence
  chemically synthesized
agagaagtgggcagattcaa

SEQ ID NO: 180741 - DNA, 20 bp, Artificial Sequence
  chemically synthesized
ggagagaagtgggcagattc

SEQ ID NO: 180742 - DNA, 20 bp, Artificial Sequence
  chemically synthesized
ggaggatggagagaagtggg

SEQ ID NO: 180743 - DNA, 20 bp, Artificial Sequence
  chemically synthesized
acaggaggatggagagaagt

SEQ ID NO: 180744 - DNA, 20 bp, Artificial Sequence
  chemically synthesized
gacaggaggatggagagaag

SEQ ID NO: 180745 - DNA, 20 bp, Artificial Sequence
  chemically synthesized
agcgacaggaggatggagag

SEQ ID NO: 180746 - DNA, 20 bp, Artificial Sequence
  chemically synthesized
gacagcgacaggaggatgga

SEQ ID NO: 180747 - DNA, 20 bp, Artificial Sequence
  chemically synthesized
gagacagcgacaggaggatg

SEQ ID NO: 180748 - DNA, 20 bp, Artificial Sequence
  chemically synthesized
aggagacagcgacaggagga

SEQ ID NO: 180749 - DNA, 20 bp, Artificial Sequence
  chemically synthesized
gcgaaggagacagcgacagg

SEQ ID NO: 180750 - DNA, 20 bp, Artificial Sequence
  chemically synthesized
agcgaaggagacagcgacag

SEQ ID NO: 180751 - DNA, 20 bp, Artificial Sequence
  chemically synthesized
ggagcgaaggagacagcgac

SEQ ID NO: 180752 - DNA, 20 bp, Artificial Sequence
  chemically synthesized
aggagcgaaggagacagcga

SEQ ID NO: 180753 - DNA, 20 bp, Artificial Sequence
  chemically synthesized
atgagaaggagcgaaggaga

SEQ ID NO: 180754 - DNA, 20 bp, Artificial Sequence
  chemically synthesized
cagaatgagaaggagcgaag

SEQ ID NO: 180755 - DNA, 20 bp, Artificial Sequence
  chemically synthesized
atcagaatgagaaggagcga

SEQ ID NO: 180756 - DNA, 20 bp, Artificial Sequence
  chemically synthesized
aatcagaatgagaaggagcg

SEQ ID NO: 180757 - DNA, 20 bp, Artificial Sequence
  chemically synthesized
gttgaaatcagaatgagaag

SEQ ID NO: 180758 - DNA, 20 bp, Artificial Sequence
  chemically synthesized
aagttgaaatcagaatgaga

SEQ ID NO: 180759 - DNA, 20 bp, Artificial Sequence
  chemically synthesized
aaagttgaaatcagaatgag

SEQ ID NO: 180760 - DNA, 20 bp, Artificial Sequence
  chemically synthesized
ataaaagttgaaatcagaat

SEQ ID NO: 180761 - DNA, 20 bp, Artificial Sequence
  chemically synthesized
tcaaaaataaaagttgaaat

SEQ ID NO: 180762 - DNA, 20 bp, Artificial Sequence
  chemically synthesized
actacctggatcaaaaataa

SEQ ID NO: 180763 - DNA, 20 bp, Artificial Sequence
  chemically synthesized
ttcaacttttatttttgatc

SEQ ID NO: 180764 - DNA, 20 bp, Artificial Sequence
  chemically synthesized
tcaacttttatttttgatcc

SEQ ID NO: 180765 - DNA, 20 bp, Artificial Sequence
  chemically synthesized
acttttatttttgatccagg

SEQ ID NO: 180766 - DNA, 20 bp, Artificial Sequence
  chemically synthesized
aaacctgtacgtatactacc

SEQ ID NO: 180767 - DNA, 20 bp, Artificial Sequence
  chemically synthesized
tgatccaggtagtatacgta

SEQ ID NO: 180768 - DNA, 20 bp, Artificial Sequence
  chemically synthesized
gatccaggtagtatacgtac

SEQ ID NO: 180769 - DNA, 20 bp, Artificial Sequence
  chemically synthesized
tacgtacaggtttgttacct

SEQ ID NO: 180770 - DNA, 20 bp, Artificial Sequence
  chemically synthesized
tggcatcacacaacatactc

SEQ ID NO: 180771 - DNA, 20 bp, Artificial Sequence
  chemically synthesized
ttggcatcacacaacatact

SEQ ID NO: 180772 - DNA, 20 bp, Artificial Sequence
  chemically synthesized
tgagtatgttgtgtgatgcc

SEQ ID NO: 180773 - DNA, 20 bp, Artificial Sequence
  chemically synthesized
gagtatgttgtgtgatgcca

SEQ ID NO: 180774 - DNA, 20 bp, Artificial Sequence
  chemically synthesized
tgttgtgtgatgccaaggtt

SEQ ID NO: 180775 - DNA, 20 bp, Artificial Sequence
  chemically synthesized
gttgtgtgatgccaaggttt

SEQ ID NO: 180776 - DNA, 20 bp, Artificial Sequence
  chemically synthesized
ttgtgtgatgccaaggttta

SEQ ID NO: 180777 - DNA, 20 bp, Artificial Sequence
  chemically synthesized
atcatttttaccctaaacct

SEQ ID NO: 180778 - DNA, 20 bp, Artificial Sequence
  chemically synthesized
gctcactacctgtgtgtggt

SEQ ID NO: 180779 - DNA, 20 bp, Artificial Sequence
  chemically synthesized
aaaaatgatcccaccacaca

SEQ ID NO: 180780 - DNA, 20 bp, Artificial Sequence
  chemically synthesized
tgctcactacctgtgtgtgg

SEQ ID NO: 180781 - DNA, 20 bp, Artificial Sequence
  chemically synthesized
aaaatgatcccaccacacac

SEQ ID NO: 180782 - DNA, 20 bp, Artificial Sequence
  chemically synthesized
ctatgctcactacctgtgtg

SEQ ID NO: 180783 - DNA, 20 bp, Artificial Sequence
  chemically synthesized
atgatcccaccacacacagg

SEQ ID NO: 180784 - DNA, 20 bp, Artificial Sequence
  chemically synthesized
tcccaccacacacaggtagt

SEQ ID NO: 180785 - DNA, 20 bp, Artificial Sequence
  chemically synthesized
ccacacacaggtagtgagca

SEQ ID NO: 180786 - DNA, 20 bp, Artificial Sequence
  chemically synthesized
gtagtgagcatagtacccga

SEQ ID NO: 180787 - DNA, 20 bp, Artificial Sequence
  chemically synthesized
tagtgagcatagtacccgat

SEQ ID NO: 180788 - DNA, 20 bp, Artificial Sequence
  chemically synthesized
tgagcatagtacccgatagg

SEQ ID NO: 180789 - DNA, 20 bp, Artificial Sequence
  chemically synthesized
gggttgaaaaactacctatc

SEQ ID NO: 180790 - DNA, 20 bp, Artificial Sequence
  chemically synthesized
agggttgaaaaactacctat

SEQ ID NO: 180791 - DNA, 20 bp, Artificial Sequence
  chemically synthesized
gggaggaaggagaggggcaa

SEQ ID NO: 180792 - DNA, 20 bp, Artificial Sequence
  chemically synthesized
ggggaggaaggagaggggca

SEQ ID NO: 180793 - DNA, 20 bp, Artificial Sequence
  chemically synthesized
gggggaggaaggagaggggc

SEQ ID NO: 180794 - DNA, 20 bp, Artificial Sequence
  chemically synthesized
agaagggggaggaaggagag

SEQ ID NO: 180795 - DNA, 20 bp, Artificial Sequence
  chemically synthesized
tagaagggggaggaaggaga

SEQ ID NO: 180796 - DNA, 20 bp, Artificial Sequence
  chemically synthesized
ctagaagggggaggaaggag

SEQ ID NO: 180797 - DNA, 20 bp, Artificial Sequence
  chemically synthesized
actagaagggggaggaagga

SEQ ID NO: 180798 - DNA, 20 bp, Artificial Sequence
  chemically synthesized
ctactagaagggggaggaag

SEQ ID NO: 180799 - DNA, 20 bp, Artificial Sequence
  chemically synthesized
gactactagaagggggagga

SEQ ID NO: 180800 - DNA, 20 bp, Artificial Sequence
  chemically synthesized
ggactactagaagggggagg

SEQ ID NO: 180801 - DNA, 20 bp, Artificial Sequence
  chemically synthesized
tggggactactagaaggggg

SEQ ID NO: 180802 - DNA, 20 bp, Artificial Sequence
  chemically synthesized
cctctccttcctcccccttc

SEQ ID NO: 180803 - DNA, 20 bp, Artificial Sequence
  chemically synthesized
ttggggactactagaagggg

SEQ ID NO: 180804 - DNA, 20 bp, Artificial Sequence
  chemically synthesized
cattggggactactagaagg

SEQ ID NO: 180805 - DNA, 20 bp, Artificial Sequence
  chemically synthesized
ctccttcctcccccttctag

SEQ ID NO: 180806 - DNA, 20 bp, Artificial Sequence
  chemically synthesized
acattggggactactagaag

SEQ ID NO: 180807 - DNA, 20 bp, Artificial Sequence
  chemically synthesized
gacattggggactactagaa

SEQ ID NO: 180808 - DNA, 20 bp, Artificial Sequence
  chemically synthesized
agacattggggactactaga

SEQ ID NO: 180809 - DNA, 20 bp, Artificial Sequence
  chemically synthesized
tagacattggggactactag

SEQ ID NO: 180810 - DNA, 20 bp, Artificial Sequence
  chemically synthesized
caatagacattggggactac

SEQ ID NO: 180811 - DNA, 20 bp, Artificial Sequence
  chemically synthesized
ggtgaaaacaatagacattg

SEQ ID NO: 180812 - DNA, 20 bp, Artificial Sequence
  chemically synthesized
aggtgaaaacaatagacatt

SEQ ID NO: 180813 - DNA, 20 bp, Artificial Sequence
  chemically synthesized
aaggtgaaaacaatagacat

SEQ ID NO: 180814 - DNA, 20 bp, Artificial Sequence
  chemically synthesized
cattataaaggtgaaaacaa

SEQ ID NO: 180815 - DNA, 20 bp, Artificial Sequence
  chemically synthesized
attgttttcacctttataat

SEQ ID NO: 180816 - DNA, 20 bp, Artificial Sequence
  chemically synthesized
acattgggtactcattataa

SEQ ID NO: 180817 - DNA, 20 bp, Artificial Sequence
  chemically synthesized
aacattgggtactcattata

SEQ ID NO: 180818 - DNA, 20 bp, Artificial Sequence
  chemically synthesized
tataatgagtacccaatgtt

SEQ ID NO: 180819 - DNA, 20 bp, Artificial Sequence
  chemically synthesized
atagttagaagctaaacatt

SEQ ID NO: 180820 - DNA, 20 bp, Artificial Sequence
  chemically synthesized
gatagttagaagctaaacat

SEQ ID NO: 180821 - DNA, 20 bp, Artificial Sequence
  chemically synthesized
agaaaaccgaagatagttag

SEQ ID NO: 180822 - DNA, 20 bp, Artificial Sequence
  chemically synthesized
aacagaaaaccgaagatagt

SEQ ID NO: 180823 - DNA, 20 bp, Artificial Sequence
  chemically synthesized
gtttagcttctaactatctt

SEQ ID NO: 180824 - DNA, 20 bp, Artificial Sequence
  chemically synthesized
caggaacagaaaaccgaaga

SEQ ID NO: 180825 - DNA, 20 bp, Artificial Sequence
  chemically synthesized
aatgcaggaacagaaaaccg

SEQ ID NO: 180826 - DNA, 20 bp, Artificial Sequence
  chemically synthesized
taagtgaattaatgcaggaa

SEQ ID NO: 180827 - DNA, 20 bp, Artificial Sequence
  chemically synthesized
tatcctaagtgaattaatgc

SEQ ID NO: 180828 - DNA, 20 bp, Artificial Sequence
  chemically synthesized
ttatcctaagtgaattaatg

SEQ ID NO: 180829 - DNA, 20 bp, Artificial Sequence
  chemically synthesized
tgttcctgcattaattcact

SEQ ID NO: 180830 - DNA, 20 bp, Artificial Sequence
  chemically synthesized
gttcctgcattaattcactt

SEQ ID NO: 180831 - DNA, 20 bp, Artificial Sequence
  chemically synthesized
cagctggaggtcattatcct

SEQ ID NO: 180832 - DNA, 20 bp, Artificial Sequence
  chemically synthesized
tcacttaggataatgacctc

SEQ ID NO: 180833 - DNA, 20 bp, Artificial Sequence
  chemically synthesized
aggaacatggatgcagctgg

SEQ ID NO: 180834 - DNA, 20 bp, Artificial Sequence
  chemically synthesized
taggaacatggatgcagctg

SEQ ID NO: 180835 - DNA, 20 bp, Artificial Sequence
  chemically synthesized
tgtaggaacatggatgcagc

SEQ ID NO: 180836 - DNA, 20 bp, Artificial Sequence
  chemically synthesized
cttttgtaggaacatggatg

SEQ ID NO: 180837 - DNA, 20 bp, Artificial Sequence
  chemically synthesized
tcacgccttttgtaggaaca

SEQ ID NO: 180838 - DNA, 20 bp, Artificial Sequence
  chemically synthesized
ctgcatccatgttcctacaa

SEQ ID NO: 180839 - DNA, 20 bp, Artificial Sequence
  chemically synthesized
tgcatccatgttcctacaaa

SEQ ID NO: 180840 - DNA, 20 bp, Artificial Sequence
  chemically synthesized
catacagtcacgccttttgt

SEQ ID NO: 180841 - DNA, 20 bp, Artificial Sequence
  chemically synthesized
gcatacagtcacgccttttg

SEQ ID NO: 180842 - DNA, 20 bp, Artificial Sequence
  chemically synthesized
acacagtcataaaaagcata

SEQ ID NO: 180843 - DNA, 20 bp, Artificial Sequence
  chemically synthesized
gaatactacacagtcataaa

SEQ ID NO: 180844 - DNA, 20 bp, Artificial Sequence
  chemically synthesized
gtatgctttttatgactgtg

SEQ ID NO: 180845 - DNA, 20 bp, Artificial Sequence
  chemically synthesized
atgcaccatggaatactaca

SEQ ID NO: 180846 - DNA, 20 bp, Artificial Sequence
  chemically synthesized
tatgactgtgtagtattcca

SEQ ID NO: 180847 - DNA, 20 bp, Artificial Sequence
  chemically synthesized
aacgtggtatacatgcacca

SEQ ID NO: 180848 - DNA, 20 bp, Artificial Sequence
  chemically synthesized
tggattgaatgaaataaacg

SEQ ID NO: 180849 - DNA, 20 bp, Artificial Sequence
  chemically synthesized
tatttcattcaatccaccac

SEQ ID NO: 180850 - DNA, 20 bp, Artificial Sequence
  chemically synthesized
ttcattcaatccaccactgg

SEQ ID NO: 180851 - DNA, 20 bp, Artificial Sequence
  chemically synthesized
acctaggtgcccaccagtgg

SEQ ID NO: 180852 - DNA, 20 bp, Artificial Sequence
  chemically synthesized
tcattcaatccaccactggt

SEQ ID NO: 180853 - DNA, 20 bp, Artificial Sequence
  chemically synthesized
tcaacctaggtgcccaccag

SEQ ID NO: 180854 - DNA, 20 bp, Artificial Sequence
  chemically synthesized
gaatcaacctaggtgcccac

SEQ ID NO: 180855 - DNA, 20 bp, Artificial Sequence
  chemically synthesized
atccaccactggtgggcacc

SEQ ID NO: 180856 - DNA, 20 bp, Artificial Sequence
  chemically synthesized
tccaccactggtgggcacct

SEQ ID NO: 180857 - DNA, 20 bp, Artificial Sequence
  chemically synthesized
caaagacatggaatcaacct

SEQ ID NO: 180858 - DNA, 20 bp, Artificial Sequence
  chemically synthesized
acaaagacatggaatcaacc

SEQ ID NO: 180859 - DNA, 20 bp, Artificial Sequence
  chemically synthesized
actatacagtaacaaagaca

SEQ ID NO: 180860 - DNA, 20 bp, Artificial Sequence
  chemically synthesized
cgcagcactatacagtaaca

SEQ ID NO: 180861 - DNA, 20 bp, Artificial Sequence
  chemically synthesized
tccatgtctttgttactgta

SEQ ID NO: 180862 - DNA, 20 bp, Artificial Sequence
  chemically synthesized
atgttcgtcgcagcactata

SEQ ID NO: 180863 - DNA, 20 bp, Artificial Sequence
  chemically synthesized
atgtactcacatgttcgtcg

SEQ ID NO: 180864 - DNA, 20 bp, Artificial Sequence
  chemically synthesized
tagtgctgcgacgaacatgt

SEQ ID NO: 180865 - DNA, 20 bp, Artificial Sequence
  chemically synthesized
tgtgagtacatgtgtctctt

SEQ ID NO: 180866 - DNA, 20 bp, Artificial Sequence
  chemically synthesized
gagtacatgtgtctctttgg

SEQ ID NO: 180867 - DNA, 20 bp, Artificial Sequence
  chemically synthesized
acacgaatctttctaccaaa

SEQ ID NO: 180868 - DNA, 20 bp, Artificial Sequence
  chemically synthesized
acatgtgtctctttggtaga

SEQ ID NO: 180869 - DNA, 20 bp, Artificial Sequence
  chemically synthesized
gaacacgaatctttctacca

SEQ ID NO: 180870 - DNA, 20 bp, Artificial Sequence
  chemically synthesized
attacttggtatatatttaa

SEQ ID NO: 180871 - DNA, 20 bp, Artificial Sequence
  chemically synthesized
tgttcttttaaatatatacc

SEQ ID NO: 180872 - DNA, 20 bp, Artificial Sequence
  chemically synthesized
ttaaatatataccaagtaat

SEQ ID NO: 180873 - DNA, 20 bp, Artificial Sequence
  chemically synthesized
aacccagcaatctcattact

SEQ ID NO: 180874 - DNA, 20 bp, Artificial Sequence
  chemically synthesized
ataccaagtaatgagattgc

SEQ ID NO: 180875 - DNA, 20 bp, Artificial Sequence
  chemically synthesized
taccaagtaatgagattgct

SEQ ID NO: 180876 - DNA, 20 bp, Artificial Sequence
  chemically synthesized
aatgagattgctgggttgaa

SEQ ID NO: 180877 - DNA, 20 bp, Artificial Sequence
  chemically synthesized
aagagagctgccattcaacc

SEQ ID NO: 180878 - DNA, 20 bp, Artificial Sequence
  chemically synthesized
gagattgctgggttgaatgg

SEQ ID NO: 180879 - DNA, 20 bp, Artificial Sequence
  chemically synthesized
ttgaatggcagctctctttt

SEQ ID NO: 180880 - DNA, 20 bp, Artificial Sequence
  chemically synthesized
ttctcaaagaacttaaaaga

SEQ ID NO: 180881 - DNA, 20 bp, Artificial Sequence
  chemically synthesized
atttctcaaagaacttaaaa

SEQ ID NO: 180882 - DNA, 20 bp, Artificial Sequence
  chemically synthesized
aaatttctcaaagaacttaa

SEQ ID NO: 180883 - DNA, 20 bp, Artificial Sequence
  chemically synthesized
agctctcttttaagttcttt

SEQ ID NO: 180884 - DNA, 20 bp, Artificial Sequence
  chemically synthesized
agcagtttgaaaatttctca

SEQ ID NO: 180885 - DNA, 20 bp, Artificial Sequence
  chemically synthesized
aattttcaaactgctctcca

SEQ ID NO: 180886 - DNA, 20 bp, Artificial Sequence
  chemically synthesized
agtttaggcactgtggagag

SEQ ID NO: 180887 - DNA, 20 bp, Artificial Sequence
  chemically synthesized
atgagtttaggcactgtgga

SEQ ID NO: 180888 - DNA, 20 bp, Artificial Sequence
  chemically synthesized
aaatgagtttaggcactgtg

SEQ ID NO: 180889 - DNA, 20 bp, Artificial Sequence
  chemically synthesized
gtaaatgagtttaggcactg

SEQ ID NO: 180890 - DNA, 20 bp, Artificial Sequence
  chemically synthesized
atgggaatgtaaatgagttt

SEQ ID NO: 180891 - DNA, 20 bp, Artificial Sequence
  chemically synthesized
tatgggaatgtaaatgagtt

SEQ ID NO: 180892 - DNA, 20 bp, Artificial Sequence
  chemically synthesized
ctgtttatgggaatgtaaat

SEQ ID NO: 180893 - DNA, 20 bp, Artificial Sequence
  chemically synthesized
ctcatttacattcccataaa

SEQ ID NO: 180894 - DNA, 20 bp, Artificial Sequence
  chemically synthesized
aatgcttatacactgtttat

SEQ ID NO: 180895 - DNA, 20 bp, Artificial Sequence
  chemically synthesized
gaatgcttatacactgttta

SEQ ID NO: 180896 - DNA, 20 bp, Artificial Sequence
  chemically synthesized
cattcccataaacagtgtat

SEQ ID NO: 180897 - DNA, 20 bp, Artificial Sequence
  chemically synthesized
tggtgaggcttcagagaaaa

SEQ ID NO: 180898 - DNA, 20 bp, Artificial Sequence
  chemically synthesized
atggtgaggcttcagagaaa

SEQ ID NO: 180899 - DNA, 20 bp, Artificial Sequence
  chemically synthesized
taagcattcccttttctctg

SEQ ID NO: 180900 - DNA, 20 bp, Artificial Sequence
  chemically synthesized
gatggtgaggcttcagagaa

SEQ ID NO: 180901 - DNA, 20 bp, Artificial Sequence
  chemically synthesized
cagatgatggtgaggcttca

SEQ ID NO: 180902 - DNA, 20 bp, Artificial Sequence
  chemically synthesized
aacagatgatggtgaggctt

SEQ ID NO: 180903 - DNA, 20 bp, Artificial Sequence
  chemically synthesized
aaaaacaacagatgatggtg

SEQ ID NO: 180904 - DNA, 20 bp, Artificial Sequence
  chemically synthesized
aaaaaacaacagatgatggt

SEQ ID NO: 180905 - DNA, 20 bp, Artificial Sequence
  chemically synthesized
agtcaaaaaacaacagatga

SEQ ID NO: 180906 - DNA, 20 bp, Artificial Sequence
  chemically synthesized
attaaaaagtcaaaaaacaa

SEQ ID NO: 180907 - DNA, 20 bp, Artificial Sequence
  chemically synthesized
acagaatggctattattaaa

SEQ ID NO: 180908 - DNA, 20 bp, Artificial Sequence
  chemically synthesized
gttttttgactttttaataa

SEQ ID NO: 180909 - DNA, 20 bp, Artificial Sequence
  chemically synthesized
tgttagaaatcagaacagaa

SEQ ID NO: 180910 - DNA, 20 bp, Artificial Sequence
  chemically synthesized
gaggctgttagaaatcagaa

SEQ ID NO: 180911 - DNA, 20 bp, Artificial Sequence
  chemically synthesized
tcagagaggctgttagaaat

SEQ ID NO: 180912 - DNA, 20 bp, Artificial Sequence
  chemically synthesized
cattctgttctgatttctaa

SEQ ID NO: 180913 - DNA, 20 bp, Artificial Sequence
  chemically synthesized
agcagtctcagagaggctgt

SEQ ID NO: 180914 - DNA, 20 bp, Artificial Sequence
  chemically synthesized
tgatttctaacagcctctct

SEQ ID NO: 180915 - DNA, 20 bp, Artificial Sequence
  chemically synthesized
attagaaagcagtctcagag

SEQ ID NO: 180916 - DNA, 20 bp, Artificial Sequence
  chemically synthesized
aattagaaagcagtctcaga

SEQ ID NO: 180917 - DNA, 20 bp, Artificial Sequence
  chemically synthesized
ctaattagaaagcagtctca

SEQ ID NO: 180918 - DNA, 20 bp, Artificial Sequence
  chemically synthesized
agctaattagaaagcagtct

SEQ ID NO: 180919 - DNA, 20 bp, Artificial Sequence
  chemically synthesized
ggcacgagctaattagaaag

SEQ ID NO: 180920 - DNA, 20 bp, Artificial Sequence
  chemically synthesized
ctctgagactgctttctaat

SEQ ID NO: 180921 - DNA, 20 bp, Artificial Sequence
  chemically synthesized
ggaggcacgagctaattaga

SEQ ID NO: 180922 - DNA, 20 bp, Artificial Sequence
  chemically synthesized
ggtaggaggcacgagctaat

SEQ ID NO: 180923 - DNA, 20 bp, Artificial Sequence
  chemically synthesized
ggagacaaggtaggaggcac

SEQ ID NO: 180924 - DNA, 20 bp, Artificial Sequence
  chemically synthesized
taagaaggagacaaggtagg

SEQ ID NO: 180925 - DNA, 20 bp, Artificial Sequence
  chemically synthesized
ataagaaggagacaaggtag

SEQ ID NO: 180926 - DNA, 20 bp, Artificial Sequence
  chemically synthesized
ggataagaaggagacaaggt

SEQ ID NO: 180927 - DNA, 20 bp, Artificial Sequence
  chemically synthesized
tggataagaaggagacaagg

SEQ ID NO: 180928 - DNA, 20 bp, Artificial Sequence
  chemically synthesized
gagtggataagaaggagaca

SEQ ID NO: 180929 - DNA, 20 bp, Artificial Sequence
  chemically synthesized
agagtggataagaaggagac

SEQ ID NO: 180930 - DNA, 20 bp, Artificial Sequence
  chemically synthesized
tgtaaagagtggataagaag

SEQ ID NO: 180931 - DNA, 20 bp, Artificial Sequence
  chemically synthesized
agtgtaaagagtggataaga

SEQ ID NO: 180932 - DNA, 20 bp, Artificial Sequence
  chemically synthesized
aagtgtaaagagtggataag

SEQ ID NO: 180933 - DNA, 20 bp, Artificial Sequence
  chemically synthesized
ctgaagtgtaaagagtggat

SEQ ID NO: 180934 - DNA, 20 bp, Artificial Sequence
  chemically synthesized
ttattctgaagtgtaaagag

SEQ ID NO: 180935 - DNA, 20 bp, Artificial Sequence
  chemically synthesized
ctcttattctgaagtgtaaa

SEQ ID NO: 180936 - DNA, 20 bp, Artificial Sequence
  chemically synthesized
cttatccactctttacactt

SEQ ID NO: 180937 - DNA, 20 bp, Artificial Sequence
  chemically synthesized
atctcttattctgaagtgta

SEQ ID NO: 180938 - DNA, 20 bp, Artificial Sequence
  chemically synthesized
cactctttacacttcagaat

SEQ ID NO: 180939 - DNA, 20 bp, Artificial Sequence
  chemically synthesized
tagaaagatctcttattctg

SEQ ID NO: 180940 - DNA, 20 bp, Artificial Sequence
  chemically synthesized
ctctttacacttcagaataa

SEQ ID NO: 180941 - DNA, 20 bp, Artificial Sequence
  chemically synthesized
gatcagcaacatattttaga

SEQ ID NO: 180942 - DNA, 20 bp, Artificial Sequence
  chemically synthesized
acatgatcagcaacatattt

SEQ ID NO: 180943 - DNA, 20 bp, Artificial Sequence
  chemically synthesized
tgagtatatgaggacatgat

SEQ ID NO: 180944 - DNA, 20 bp, Artificial Sequence
  chemically synthesized
aggatgttgttgagtatatg

SEQ ID NO: 180945 - DNA, 20 bp, Artificial Sequence
  chemically synthesized
taggatgttgttgagtatat

SEQ ID NO: 180946 - DNA, 20 bp, Artificial Sequence
  chemically synthesized
attggcactaggatgttgtt

SEQ ID NO: 180947 - DNA, 20 bp, Artificial Sequence
  chemically synthesized
tcatatactcaacaacatcc

SEQ ID NO: 180948 - DNA, 20 bp, Artificial Sequence
  chemically synthesized
tattttatcccattggcact

SEQ ID NO: 180949 - DNA, 20 bp, Artificial Sequence
  chemically synthesized
caacaacatcctagtgccaa

SEQ ID NO: 180950 - DNA, 20 bp, Artificial Sequence
  chemically synthesized
atattttatcccattggcac

SEQ ID NO: 180951 - DNA, 20 bp, Artificial Sequence
  chemically synthesized
aacaacatcctagtgccaat

SEQ ID NO: 180952 - DNA, 20 bp, Artificial Sequence
  chemically synthesized
gaagttatattttatcccat

SEQ ID NO: 180953 - DNA, 20 bp, Artificial Sequence
  chemically synthesized
gctttttgaccatgttagag

SEQ ID NO: 180954 - DNA, 20 bp, Artificial Sequence
  chemically synthesized
aaaatataacttctctaaca

SEQ ID NO: 180955 - DNA, 20 bp, Artificial Sequence
  chemically synthesized
agggctttttgaccatgtta

SEQ ID NO: 180956 - DNA, 20 bp, Artificial Sequence
  chemically synthesized
aaagggctttttgaccatgt

SEQ ID NO: 180957 - DNA, 20 bp, Artificial Sequence
  chemically synthesized
acttctctaacatggtcaaa

SEQ ID NO: 180958 - DNA, 20 bp, Artificial Sequence
  chemically synthesized
agtagagaccagatcacaaa

SEQ ID NO: 180959 - DNA, 20 bp, Artificial Sequence
  chemically synthesized
aagtagagaccagatcacaa

SEQ ID NO: 180960 - DNA, 20 bp, Artificial Sequence
  chemically synthesized
tcaaaaagccctttgtgatc

SEQ ID NO: 180961 - DNA, 20 bp, Artificial Sequence
  chemically synthesized
gaagtagagaccagatcaca

SEQ ID NO: 180962 - DNA, 20 bp, Artificial Sequence
  chemically synthesized
gaagaaatagaagtagagac

SEQ ID NO: 180963 - DNA, 20 bp, Artificial Sequence
  chemically synthesized
aagatgaagaaatagaagta

SEQ ID NO: 180964 - DNA, 20 bp, Artificial Sequence
  chemically synthesized
gaaagatgaagaaatagaag

SEQ ID NO: 180965 - DNA, 20 bp, Artificial Sequence
  chemically synthesized
aaagaaagatgaagaaatag

SEQ ID NO: 180966 - DNA, 20 bp, Artificial Sequence
  chemically synthesized
tgcaaagaaagatgaagaaa

SEQ ID NO: 180967 - DNA, 20 bp, Artificial Sequence
  chemically synthesized
atacagtgcaaagaaagatg

SEQ ID NO: 180968 - DNA, 20 bp, Artificial Sequence
  chemically synthesized
tgaactatacagtgcaaaga

SEQ ID NO: 180969 - DNA, 20 bp, Artificial Sequence
  chemically synthesized
tccatgaactatacagtgca

SEQ ID NO: 180970 - DNA, 20 bp, Artificial Sequence
  chemically synthesized
tcatctttctttgcactgta

SEQ ID NO: 180971 - DNA, 20 bp, Artificial Sequence
  chemically synthesized
aagttgttccatgaactata

SEQ ID NO: 180972 - DNA, 20 bp, Artificial Sequence
  chemically synthesized
tctttgcactgtatagttca

SEQ ID NO: 180973 - DNA, 20 bp, Artificial Sequence
  chemically synthesized
gctggattttaaggaagagt

SEQ ID NO: 180974 - DNA, 20 bp, Artificial Sequence
  chemically synthesized
tagtgctggattttaaggaa

SEQ ID NO: 180975 - DNA, 20 bp, Artificial Sequence
  chemically synthesized
tatagtgctggattttaagg

SEQ ID NO: 180976 - DNA, 20 bp, Artificial Sequence
  chemically synthesized
acttactcttccttaaaatc

SEQ ID NO: 180977 - DNA, 20 bp, Artificial Sequence
  chemically synthesized
ggatatagtgctggatttta

SEQ ID NO: 180978 - DNA, 20 bp, Artificial Sequence
  chemically synthesized
tggatatagtgctggatttt

SEQ ID NO: 180979 - DNA, 20 bp, Artificial Sequence
  chemically synthesized
tcctgatatggatatagtgc

SEQ ID NO: 180980 - DNA, 20 bp, Artificial Sequence
  chemically synthesized
gatgaatcctgatatggata

SEQ ID NO: 180981 - DNA, 20 bp, Artificial Sequence
  chemically synthesized
atccagcactatatccatat

SEQ ID NO: 180982 - DNA, 20 bp, Artificial Sequence
  chemically synthesized
tccagcactatatccatatc

SEQ ID NO: 180983 - DNA, 20 bp, Artificial Sequence
  chemically synthesized
ttgtatgatgaatcctgata

SEQ ID NO: 180984 - DNA, 20 bp, Artificial Sequence
  chemically synthesized
catacaatgttccctctgcc

SEQ ID NO: 180985 - DNA, 20 bp, Artificial Sequence
  chemically synthesized
atacaatgttccctctgcct

SEQ ID NO: 180986 - DNA, 20 bp, Artificial Sequence
  chemically synthesized
ggaaggacatcccaggcaga

SEQ ID NO: 180987 - DNA, 20 bp, Artificial Sequence
  chemically synthesized
tggaaggacatcccaggcag

SEQ ID NO: 180988 - DNA, 20 bp, Artificial Sequence
  chemically synthesized
atggaaggacatcccaggca

SEQ ID NO: 180989 - DNA, 20 bp, Artificial Sequence
  chemically synthesized
gtatggaaggacatcccagg

SEQ ID NO: 180990 - DNA, 20 bp, Artificial Sequence
  chemically synthesized
gatgtatggaaggacatccc

SEQ ID NO: 180991 - DNA, 20 bp, Artificial Sequence
  chemically synthesized
agatgtatggaaggacatcc

SEQ ID NO: 180992 - DNA, 20 bp, Artificial Sequence
  chemically synthesized
cctagatgaagatgtatgga

SEQ ID NO: 180993 - DNA, 20 bp, Artificial Sequence
  chemically synthesized
acctagatgaagatgtatgg

SEQ ID NO: 180994 - DNA, 20 bp, Artificial Sequence
  chemically synthesized
gctacctagatgaagatgta

SEQ ID NO: 180995 - DNA, 20 bp, Artificial Sequence
  chemically synthesized
tccttccatacatcttcatc

SEQ ID NO: 180996 - DNA, 20 bp, Artificial Sequence
  chemically synthesized
ccttccatacatcttcatct

SEQ ID NO: 180997 - DNA, 20 bp, Artificial Sequence
  chemically synthesized
aacctggagctacctagatg

SEQ ID NO: 180998 - DNA, 20 bp, Artificial Sequence
  chemically synthesized
tccatacatcttcatctagg

SEQ ID NO: 180999 - DNA, 20 bp, Artificial Sequence
  chemically synthesized
aaggtcaacctggagctacc

SEQ ID NO: 181000 - DNA, 20 bp, Artificial Sequence
  chemically synthesized
catcttcatctaggtagctc

SEQ ID NO: 181001 - DNA, 20 bp, Artificial Sequence
  chemically synthesized
atcttcatctaggtagctcc

SEQ ID NO: 181002 - DNA, 20 bp, Artificial Sequence
  chemically synthesized
agattggaaaggtcaacctg

SEQ ID NO: 181003 - DNA, 20 bp, Artificial Sequence
  chemically synthesized
tgagattggaaaggtcaacc

SEQ ID NO: 181004 - DNA, 20 bp, Artificial Sequence
  chemically synthesized
tgtctaacctgagattggaa

SEQ ID NO: 181005 - DNA, 20 bp, Artificial Sequence
  chemically synthesized
atgtctaacctgagattgga

SEQ ID NO: 181006 - DNA, 20 bp, Artificial Sequence
  chemically synthesized
caggttgacctttccaatct

SEQ ID NO: 181007 - DNA, 20 bp, Artificial Sequence
  chemically synthesized
aggttgacctttccaatctc

SEQ ID NO: 181008 - DNA, 20 bp, Artificial Sequence
  chemically synthesized
agtgatgtctaacctgagat

SEQ ID NO: 181009 - DNA, 20 bp, Artificial Sequence
  chemically synthesized
tgacctttccaatctcaggt

SEQ ID NO: 181010 - DNA, 20 bp, Artificial Sequence
  chemically synthesized
gaggaagtgatgtctaacct

SEQ ID NO: 181011 - DNA, 20 bp, Artificial Sequence
  chemically synthesized
caaggaaagctttgtagagg

SEQ ID NO: 181012 - DNA, 20 bp, Artificial Sequence
  chemically synthesized
tagacatcacttcctctaca

SEQ ID NO: 181013 - DNA, 20 bp, Artificial Sequence
  chemically synthesized
aatcaaggaaagctttgtag

SEQ ID NO: 181014 - DNA, 20 bp, Artificial Sequence
  chemically synthesized
taatcaaggaaagctttgta

SEQ ID NO: 181015 - DNA, 20 bp, Artificial Sequence
  chemically synthesized
attaatcaaggaaagctttg

SEQ ID NO: 181016 - DNA, 20 bp, Artificial Sequence
  chemically synthesized
gatgtctaattaatcaagga

SEQ ID NO: 181017 - DNA, 20 bp, Artificial Sequence
  chemically synthesized
tggggatgtctaattaatca

SEQ ID NO: 181018 - DNA, 20 bp, Artificial Sequence
  chemically synthesized
caaagctttccttgattaat

SEQ ID NO: 181019 - DNA, 20 bp, Artificial Sequence
  chemically synthesized
ttggggatgtctaattaatc

SEQ ID NO: 181020 - DNA, 20 bp, Artificial Sequence
  chemically synthesized
ttaattagacatccccaacc

SEQ ID NO: 181021 - DNA, 20 bp, Artificial Sequence
  chemically synthesized
taattagacatccccaaccc

SEQ ID NO: 181022 - DNA, 20 bp, Artificial Sequence
  chemically synthesized
tgtgacctatacctgggttg

SEQ ID NO: 181023 - DNA, 20 bp, Artificial Sequence
  chemically synthesized
ctgtgacctatacctgggtt

SEQ ID NO: 181024 - DNA, 20 bp, Artificial Sequence
  chemically synthesized
cctgtgacctatacctgggt

SEQ ID NO: 181025 - DNA, 20 bp, Artificial Sequence
  chemically synthesized
agacatccccaacccaggta

SEQ ID NO: 181026 - DNA, 20 bp, Artificial Sequence
  chemically synthesized
gacatccccaacccaggtat

SEQ ID NO: 181027 - DNA, 20 bp, Artificial Sequence
  chemically synthesized
aggacctgtgacctatacct

SEQ ID NO: 181028 - DNA, 20 bp, Artificial Sequence
  chemically synthesized
caggacctgtgacctatacc

SEQ ID NO: 181029 - DNA, 20 bp, Artificial Sequence
  chemically synthesized
cccaacccaggtataggtca

SEQ ID NO: 181030 - DNA, 20 bp, Artificial Sequence
  chemically synthesized
ccaacccaggtataggtcac

SEQ ID NO: 181031 - DNA, 20 bp, Artificial Sequence
  chemically synthesized
aggtcacaggtcctgttatg

SEQ ID NO: 181032 - DNA, 20 bp, Artificial Sequence
  chemically synthesized
gggctgtgggactacataac

SEQ ID NO: 181033 - DNA, 20 bp, Artificial Sequence
  chemically synthesized
ggggctgtgggactacataa

SEQ ID NO: 181034 - DNA, 20 bp, Artificial Sequence
  chemically synthesized
ggtcctgttatgtagtccca

SEQ ID NO: 181035 - DNA, 20 bp, Artificial Sequence
  chemically synthesized
gaaacattatgaggggctgt

SEQ ID NO: 181036 - DNA, 20 bp, Artificial Sequence
  chemically synthesized
ggaaacattatgaggggctg

SEQ ID NO: 181037 - DNA, 20 bp, Artificial Sequence
  chemically synthesized
tgtgatggaaacattatgag

SEQ ID NO: 181038 - DNA, 20 bp, Artificial Sequence
  chemically synthesized
ctgtgatggaaacattatga

SEQ ID NO: 181039 - DNA, 20 bp, Artificial Sequence
  chemically synthesized
cctgtgatggaaacattatg

SEQ ID NO: 181040 - DNA, 20 bp, Artificial Sequence
  chemically synthesized
tcctgtgatggaaacattat

SEQ ID NO: 181041 - DNA, 20 bp, Artificial Sequence
  chemically synthesized
ccctcataatgtttccatca

SEQ ID NO: 181042 - DNA, 20 bp, Artificial Sequence
  chemically synthesized
cctcataatgtttccatcac

SEQ ID NO: 181043 - DNA, 20 bp, Artificial Sequence
  chemically synthesized
aattacagtatttcctgtga

SEQ ID NO: 181044 - DNA, 20 bp, Artificial Sequence
  chemically synthesized
ttgatgaacatgggaaatta

SEQ ID NO: 181045 - DNA, 20 bp, Artificial Sequence
  chemically synthesized
tgcaatagtttgatgaacat

SEQ ID NO: 181046 - DNA, 20 bp, Artificial Sequence
  chemically synthesized
ctgcaatagtttgatgaaca

SEQ ID NO: 181047 - DNA, 20 bp, Artificial Sequence
  chemically synthesized
ccatgttcatcaaactattg

SEQ ID NO: 181048 - DNA, 20 bp, Artificial Sequence
  chemically synthesized
aatagatagaaaatctgcaa

SEQ ID NO: 181049 - DNA, 20 bp, Artificial Sequence
  chemically synthesized
tagggtgcgatcacaataga

SEQ ID NO: 181050 - DNA, 20 bp, Artificial Sequence
  chemically synthesized
aggatagggtgcgatcacaa

SEQ ID NO: 181051 - DNA, 20 bp, Artificial Sequence
  chemically synthesized
ttgtgatcgcaccctatcct

SEQ ID NO: 181052 - DNA, 20 bp, Artificial Sequence
  chemically synthesized
tatgctaagtactgaggata

SEQ ID NO: 181053 - DNA, 20 bp, Artificial Sequence
  chemically synthesized
atatgctaagtactgaggat

SEQ ID NO: 181054 - DNA, 20 bp, Artificial Sequence
  chemically synthesized
tatatgctaagtactgagga

SEQ ID NO: 181055 - DNA, 20 bp, Artificial Sequence
  chemically synthesized
cgcaccctatcctcagtact

SEQ ID NO: 181056 - DNA, 20 bp, Artificial Sequence
  chemically synthesized
atactatatgctaagtactg

SEQ ID NO: 181057 - DNA, 20 bp, Artificial Sequence
  chemically synthesized
aatactatatgctaagtact

SEQ ID NO: 181058 - DNA, 20 bp, Artificial Sequence
  chemically synthesized
tatcctcagtacttagcata

SEQ ID NO: 181059 - DNA, 20 bp, Artificial Sequence
  chemically synthesized
ctaagcaaatactatatgct

SEQ ID NO: 181060 - DNA, 20 bp, Artificial Sequence
  chemically synthesized
cttagcatatagtatttgct

SEQ ID NO: 181061 - DNA, 20 bp, Artificial Sequence
  chemically synthesized
agattattaatataggaact

SEQ ID NO: 181062 - DNA, 20 bp, Artificial Sequence
  chemically synthesized
cattaggagattattaatat

SEQ ID NO: 181063 - DNA, 20 bp, Artificial Sequence
  chemically synthesized
tcattaggagattattaata

SEQ ID NO: 181064 - DNA, 20 bp, Artificial Sequence
  chemically synthesized
aattaagatgatgtcattag

SEQ ID NO: 181065 - DNA, 20 bp, Artificial Sequence
  chemically synthesized
acaattaagatgatgtcatt

SEQ ID NO: 181066 - DNA, 20 bp, Artificial Sequence
  chemically synthesized
tacaattaagatgatgtcat

SEQ ID NO: 181067 - DNA, 20 bp, Artificial Sequence
  chemically synthesized
ttacttggagatatacaatt

SEQ ID NO: 181068 - DNA, 20 bp, Artificial Sequence
  chemically synthesized
catcttaattgtatatctcc

SEQ ID NO: 181069 - DNA, 20 bp, Artificial Sequence
  chemically synthesized
tgaaataatgttattacttg

SEQ ID NO: 181070 - DNA, 20 bp, Artificial Sequence
  chemically synthesized
tatgaaataatgttattact

SEQ ID NO: 181071 - DNA, 20 bp, Artificial Sequence
  chemically synthesized
caagtaataacattatttca

SEQ ID NO: 181072 - DNA, 20 bp, Artificial Sequence
  chemically synthesized
gtaataacattatttcatag

SEQ ID NO: 181073 - DNA, 20 bp, Artificial Sequence
  chemically synthesized
aacattatttcatagtagtc

SEQ ID NO: 181074 - DNA, 20 bp, Artificial Sequence
  chemically synthesized
acattatttcatagtagtct

SEQ ID NO: 181075 - DNA, 20 bp, Artificial Sequence
  chemically synthesized
cattatttcatagtagtctg

SEQ ID NO: 181076 - DNA, 20 bp, Artificial Sequence
  chemically synthesized
ttatttcatagtagtctggg

SEQ ID NO: 181077 - DNA, 20 bp, Artificial Sequence
  chemically synthesized
ttcttcatggaaaatctccc

SEQ ID NO: 181078 - DNA, 20 bp, Artificial Sequence
  chemically synthesized
gtctggggagattttccatg

SEQ ID NO: 181079 - DNA, 20 bp, Artificial Sequence
  chemically synthesized
cacacacactttgttcttca

SEQ ID NO: 181080 - DNA, 20 bp, Artificial Sequence
  chemically synthesized
gagattttccatgaagaaca

SEQ ID NO: 181081 - DNA, 20 bp, Artificial Sequence
  chemically synthesized
aagaacaaagtgtgtgtgta

SEQ ID NO: 181082 - DNA, 20 bp, Artificial Sequence
  chemically synthesized
agaacaaagtgtgtgtgtat

SEQ ID NO: 181083 - DNA, 20 bp, Artificial Sequence
  chemically synthesized
aacaaagtgtgtgtgtatgg

SEQ ID NO: 181084 - DNA, 20 bp, Artificial Sequence
  chemically synthesized
acaaagtgtgtgtgtatggg

SEQ ID NO: 181085 - DNA, 20 bp, Artificial Sequence
  chemically synthesized
aagtgtgtgtgtatgggagg

SEQ ID NO: 181086 - DNA, 20 bp, Artificial Sequence
  chemically synthesized
agtgtgtgtgtatgggaggc

SEQ ID NO: 181087 - DNA, 20 bp, Artificial Sequence
  chemically synthesized
tgaatttcgttaattttata

SEQ ID NO: 181088 - DNA, 20 bp, Artificial Sequence
  chemically synthesized
taaaattaacgaaattcaac

SEQ ID NO: 181089 - DNA, 20 bp, Artificial Sequence
  chemically synthesized
aaaattaacgaaattcaacc

SEQ ID NO: 181090 - DNA, 20 bp, Artificial Sequence
  chemically synthesized
aaattaacgaaattcaacca

SEQ ID NO: 181091 - DNA, 20 bp, Artificial Sequence
  chemically synthesized
taacgaaattcaaccaggga

SEQ ID NO: 181092 - DNA, 20 bp, Artificial Sequence
  chemically synthesized
acttgctgtatagctttccc

SEQ ID NO: 181093 - DNA, 20 bp, Artificial Sequence
  chemically synthesized
ttcaaccagggaaagctata

SEQ ID NO: 181094 - DNA, 20 bp, Artificial Sequence
  chemically synthesized
accagggaaagctatacagc

SEQ ID NO: 181095 - DNA, 20 bp, Artificial Sequence
  chemically synthesized
gtttacaaacacttgctgta

SEQ ID NO: 181096 - DNA, 20 bp, Artificial Sequence
  chemically synthesized
cagcaagtgtttgtaaacta

SEQ ID NO: 181097 - DNA, 20 bp, Artificial Sequence
  chemically synthesized
acaacttggttcatgagcca

SEQ ID NO: 181098 - DNA, 20 bp, Artificial Sequence
  chemically synthesized
taaactatggctcatgaacc

SEQ ID NO: 181099 - DNA, 20 bp, Artificial Sequence
  chemically synthesized
gtgagcacaacttggttcat

SEQ ID NO: 181100 - DNA, 20 bp, Artificial Sequence
  chemically synthesized
aacaggtggtgagcacaact

SEQ ID NO: 181101 - DNA, 20 bp, Artificial Sequence
  chemically synthesized
tatttacaaaaacaggtggt

SEQ ID NO: 181102 - DNA, 20 bp, Artificial Sequence
  chemically synthesized
actttatttacaaaaacagg

SEQ ID NO: 181103 - DNA, 20 bp, Artificial Sequence
  chemically synthesized
aaaactttatttacaaaaac

SEQ ID NO: 181104 - DNA, 20 bp, Artificial Sequence
  chemically synthesized
taaaactttatttacaaaaa

SEQ ID NO: 181105 - DNA, 20 bp, Artificial Sequence
  chemically synthesized
accacctgtttttgtaaata

SEQ ID NO: 181106 - DNA, 20 bp, Artificial Sequence
  chemically synthesized
ttttgtaaataaagttttac

SEQ ID NO: 181107 - DNA, 20 bp, Artificial Sequence
  chemically synthesized
taaataaagttttactggaa

SEQ ID NO: 181108 - DNA, 20 bp, Artificial Sequence
  chemically synthesized
aataaagttttactggaaca

SEQ ID NO: 181109 - DNA, 20 bp, Artificial Sequence
  chemically synthesized
gaatgagtgtagctctgttc

SEQ ID NO: 181110 - DNA, 20 bp, Artificial Sequence
  chemically synthesized
aatatgtaaatgaatgagtg

SEQ ID NO: 181111 - DNA, 20 bp, Artificial Sequence
  chemically synthesized
tagacaatatgtaaatgaat

SEQ ID NO: 181112 - DNA, 20 bp, Artificial Sequence
  chemically synthesized
attcatttacatattgtcta

SEQ ID NO: 181113 - DNA, 20 bp, Artificial Sequence
  chemically synthesized
ttgtagcatgaaagtaacca

SEQ ID NO: 181114 - DNA, 20 bp, Artificial Sequence
  chemically synthesized
actctgctattgtagcatga

SEQ ID NO: 181115 - DNA, 20 bp, Artificial Sequence
  chemically synthesized
tggttactttcatgctacaa

SEQ ID NO: 181116 - DNA, 20 bp, Artificial Sequence
  chemically synthesized
ttactttcatgctacaatag

SEQ ID NO: 181117 - DNA, 20 bp, Artificial Sequence
  chemically synthesized
actactcaactctgctattg

SEQ ID NO: 181118 - DNA, 20 bp, Artificial Sequence
  chemically synthesized
actttcatgctacaatagca

SEQ ID NO: 181119 - DNA, 20 bp, Artificial Sequence
  chemically synthesized
catgctacaatagcagagtt

SEQ ID NO: 181120 - DNA, 20 bp, Artificial Sequence
  chemically synthesized
gctacaatagcagagttgag

SEQ ID NO: 181121 - DNA, 20 bp, Artificial Sequence
  chemically synthesized
atagcagagttgagtagttg

SEQ ID NO: 181122 - DNA, 20 bp, Artificial Sequence
  chemically synthesized
agagttgagtagttgcagca

SEQ ID NO: 181123 - DNA, 20 bp, Artificial Sequence
  chemically synthesized
tagttgcagcaaagattgaa

SEQ ID NO: 181124 - DNA, 20 bp, Artificial Sequence
  chemically synthesized
caaagattgaatggcccaca

SEQ ID NO: 181125 - DNA, 20 bp, Artificial Sequence
  chemically synthesized
ctaaatgcctttggctttgt

SEQ ID NO: 181126 - DNA, 20 bp, Artificial Sequence
  chemically synthesized
actaaatgcctttggctttg

SEQ ID NO: 181127 - DNA, 20 bp, Artificial Sequence
  chemically synthesized
ttgaatggcccacaaagcca

SEQ ID NO: 181128 - DNA, 20 bp, Artificial Sequence
  chemically synthesized
tgaatggcccacaaagccaa

SEQ ID NO: 181129 - DNA, 20 bp, Artificial Sequence
  chemically synthesized
tgccagatactaaatgcctt

SEQ ID NO: 181130 - DNA, 20 bp, Artificial Sequence
  chemically synthesized
cccacaaagccaaaggcatt

SEQ ID NO: 181131 - DNA, 20 bp, Artificial Sequence
  chemically synthesized
agccaaaggcatttagtatc

SEQ ID NO: 181132 - DNA, 20 bp, Artificial Sequence
  chemically synthesized
ggtaaacttgagtaaagtgc

SEQ ID NO: 181133 - DNA, 20 bp, Artificial Sequence
  chemically synthesized
tagtatctggcactttactc

SEQ ID NO: 181134 - DNA, 20 bp, Artificial Sequence
  chemically synthesized
gatggtggtaaacttgagta

SEQ ID NO: 181135 - DNA, 20 bp, Artificial Sequence
  chemically synthesized
tagcagatggtggtaaactt

SEQ ID NO: 181136 - DNA, 20 bp, Artificial Sequence
  chemically synthesized
atttatcacatagcagatgg

SEQ ID NO: 181137 - DNA, 20 bp, Artificial Sequence
  chemically synthesized
gagatttatcacatagcaga

SEQ ID NO: 181138 - DNA, 20 bp, Artificial Sequence
  chemically synthesized
gaaggagatttatcacatag

SEQ ID NO: 181139 - DNA, 20 bp, Artificial Sequence
  chemically synthesized
taagaaggagatttatcaca

SEQ ID NO: 181140 - DNA, 20 bp, Artificial Sequence
  chemically synthesized
tatgtgataaatctccttct

SEQ ID NO: 181141 - DNA, 20 bp, Artificial Sequence
  chemically synthesized
cctagtagatgtctaagaag

SEQ ID NO: 181142 - DNA, 20 bp, Artificial Sequence
  chemically synthesized
tccctagtagatgtctaaga

SEQ ID NO: 181143 - DNA, 20 bp, Artificial Sequence
  chemically synthesized
ttccctagtagatgtctaag

SEQ ID NO: 181144 - DNA, 20 bp, Artificial Sequence
  chemically synthesized
taattccctagtagatgtct

SEQ ID NO: 181145 - DNA, 20 bp, Artificial Sequence
  chemically synthesized
tctccttcttagacatctac

SEQ ID NO: 181146 - DNA, 20 bp, Artificial Sequence
  chemically synthesized
ctccttcttagacatctact

SEQ ID NO: 181147 - DNA, 20 bp, Artificial Sequence
  chemically synthesized
tccttcttagacatctacta

SEQ ID NO: 181148 - DNA, 20 bp, Artificial Sequence
  chemically synthesized
tcgtatctttaattccctag

SEQ ID NO: 181149 - DNA, 20 bp, Artificial Sequence
  chemically synthesized
ctctcgtatctttaattccc

SEQ ID NO: 181150 - DNA, 20 bp, Artificial Sequence
  chemically synthesized
agacatctactagggaatta

SEQ ID NO: 181151 - DNA, 20 bp, Artificial Sequence
  chemically synthesized
tactagggaattaaagatac

SEQ ID NO: 181152 - DNA, 20 bp, Artificial Sequence
  chemically synthesized
ctagggaattaaagatacga

SEQ ID NO: 181153 - DNA, 20 bp, Artificial Sequence
  chemically synthesized
agatacgagagttctgatat

SEQ ID NO: 181154 - DNA, 20 bp, Artificial Sequence
  chemically synthesized
ttatacagattttcttatat

SEQ ID NO: 181155 - DNA, 20 bp, Artificial Sequence
  chemically synthesized
actggtttatagagattata

SEQ ID NO: 181156 - DNA, 20 bp, Artificial Sequence
  chemically synthesized
tctgtataatctctataaac

SEQ ID NO: 181157 - DNA, 20 bp, Artificial Sequence
  chemically synthesized
tcgcataccactggtttata

SEQ ID NO: 181158 - DNA, 20 bp, Artificial Sequence
  chemically synthesized
cttcgcataccactggttta

SEQ ID NO: 181159 - DNA, 20 bp, Artificial Sequence
  chemically synthesized
gtataatctctataaaccag

SEQ ID NO: 181160 - DNA, 20 bp, Artificial Sequence
  chemically synthesized
ttcatgacttcgcataccac

SEQ ID NO: 181161 - DNA, 20 bp, Artificial Sequence
  chemically synthesized
ctataaaccagtggtatgcg

SEQ ID NO: 181162 - DNA, 20 bp, Artificial Sequence
  chemically synthesized
atgaaaatatctatgataat

SEQ ID NO: 181163 - DNA, 20 bp, Artificial Sequence
  chemically synthesized
aggagtagttctaattatca

SEQ ID NO: 181164 - DNA, 20 bp, Artificial Sequence
  chemically synthesized
ttgtttcaaggggtgaggag

SEQ ID NO: 181165 - DNA, 20 bp, Artificial Sequence
  chemically synthesized
tgattgtttcaaggggtgag

SEQ ID NO: 181166 - DNA, 20 bp, Artificial Sequence
  chemically synthesized
catgattgtttcaaggggtg

SEQ ID NO: 181167 - DNA, 20 bp, Artificial Sequence
  chemically synthesized
tcatgattgtttcaaggggt

SEQ ID NO: 181168 - DNA, 20 bp, Artificial Sequence
  chemically synthesized
gtgctcatgattgtttcaag

SEQ ID NO: 181169 - DNA, 20 bp, Artificial Sequence
  chemically synthesized
agtgctcatgattgtttcaa

SEQ ID NO: 181170 - DNA, 20 bp, Artificial Sequence
  chemically synthesized
aagtgctcatgattgtttca

SEQ ID NO: 181171 - DNA, 20 bp, Artificial Sequence
  chemically synthesized
aaagtgctcatgattgtttc

SEQ ID NO: 181172 - DNA, 20 bp, Artificial Sequence
  chemically synthesized
tcaccccttgaaacaatcat

SEQ ID NO: 181173 - DNA, 20 bp, Artificial Sequence
  chemically synthesized
tgtgaaataataattgtgta

SEQ ID NO: 181174 - DNA, 20 bp, Artificial Sequence
  chemically synthesized
tttacacaattattatttca

SEQ ID NO: 181175 - DNA, 20 bp, Artificial Sequence
  chemically synthesized
ttacacaattattatttcac

SEQ ID NO: 181176 - DNA, 20 bp, Artificial Sequence
  chemically synthesized
ttattatttcacaggacaaa

SEQ ID NO: 181177 - DNA, 20 bp, Artificial Sequence
  chemically synthesized
cacaggacaaatagaaaaac

SEQ ID NO: 181178 - DNA, 20 bp, Artificial Sequence
  chemically synthesized
ttataatcagatgcaatgtc

SEQ ID NO: 181179 - DNA, 20 bp, Artificial Sequence
  chemically synthesized
acagaattaatgtttataat

SEQ ID NO: 181180 - DNA, 20 bp, Artificial Sequence
  chemically synthesized
gaaatgttcgtgaatttaaa

SEQ ID NO: 181181 - DNA, 20 bp, Artificial Sequence
  chemically synthesized
tcacgaacatttccaactat

SEQ ID NO: 181182 - DNA, 20 bp, Artificial Sequence
  chemically synthesized
tagatatagtttctcatagt

SEQ ID NO: 181183 - DNA, 20 bp, Artificial Sequence
  chemically synthesized
taagtagatatagtttctca

SEQ ID NO: 181184 - DNA, 20 bp, Artificial Sequence
  chemically synthesized
gattctaaggtaagtagata

SEQ ID NO: 181185 - DNA, 20 bp, Artificial Sequence
  chemically synthesized
gaaactatatctacttacct

SEQ ID NO: 181186 - DNA, 20 bp, Artificial Sequence
  chemically synthesized
atgtttgattctaaggtaag

SEQ ID NO: 181187 - DNA, 20 bp, Artificial Sequence
  chemically synthesized
tccatgtttgattctaaggt

SEQ ID NO: 181188 - DNA, 20 bp, Artificial Sequence
  chemically synthesized
attttccatgtttgattcta

SEQ ID NO: 181189 - DNA, 20 bp, Artificial Sequence
  chemically synthesized
tattttccatgtttgattct

SEQ ID NO: 181190 - DNA, 20 bp, Artificial Sequence
  chemically synthesized
acttaccttagaatcaaaca

SEQ ID NO: 181191 - DNA, 20 bp, Artificial Sequence
  chemically synthesized
ttagaatcaaacatggaaaa

SEQ ID NO: 181192 - DNA, 20 bp, Artificial Sequence
  chemically synthesized
caaacatggaaaatagtcaa

SEQ ID NO: 181193 - DNA, 20 bp, Artificial Sequence
  chemically synthesized
gaaaagtgaggcagaggcat

SEQ ID NO: 181194 - DNA, 20 bp, Artificial Sequence
  chemically synthesized
agaaaagtgaggcagaggca

SEQ ID NO: 181195 - DNA, 20 bp, Artificial Sequence
  chemically synthesized
agacaagaaaagtgaggcag

SEQ ID NO: 181196 - DNA, 20 bp, Artificial Sequence
  chemically synthesized
aagacaagaaaagtgaggca

SEQ ID NO: 181197 - DNA, 20 bp, Artificial Sequence
  chemically synthesized
ccaagacaagaaaagtgagg

SEQ ID NO: 181198 - DNA, 20 bp, Artificial Sequence
  chemically synthesized
aagccaagacaagaaaagtg

SEQ ID NO: 181199 - DNA, 20 bp, Artificial Sequence
  chemically synthesized
aaagccaagacaagaaaagt

SEQ ID NO: 181200 - DNA, 20 bp, Artificial Sequence
  chemically synthesized
tgtaaaagccaagacaagaa

SEQ ID NO: 181201 - DNA, 20 bp, Artificial Sequence
  chemically synthesized
ctgcctcacttttcttgtct

SEQ ID NO: 181202 - DNA, 20 bp, Artificial Sequence
  chemically synthesized
cataatgtaaaagccaagac

SEQ ID NO: 181203 - DNA, 20 bp, Artificial Sequence
  chemically synthesized
actggcataatgtaaaagcc

SEQ ID NO: 181204 - DNA, 20 bp, Artificial Sequence
  chemically synthesized
aagaaactggcataatgtaa

SEQ ID NO: 181205 - DNA, 20 bp, Artificial Sequence
  chemically synthesized
tcttggcttttacattatgc

SEQ ID NO: 181206 - DNA, 20 bp, Artificial Sequence
  chemically synthesized
aaagagaaatataaagaaac

SEQ ID NO: 181207 - DNA, 20 bp, Artificial Sequence
  chemically synthesized
taggaagaaagagaaatata

SEQ ID NO: 181208 - DNA, 20 bp, Artificial Sequence
  chemically synthesized
ggttgtgggttaggaagaaa

SEQ ID NO: 181209 - DNA, 20 bp, Artificial Sequence
  chemically synthesized
ttggttgtgggttaggaaga

SEQ ID NO: 181210 - DNA, 20 bp, Artificial Sequence
  chemically synthesized
aaagttggttgtgggttagg

SEQ ID NO: 181211 - DNA, 20 bp, Artificial Sequence
  chemically synthesized
gataaagttggttgtgggtt

SEQ ID NO: 181212 - DNA, 20 bp, Artificial Sequence
  chemically synthesized
tgataaagttggttgtgggt

SEQ ID NO: 181213 - DNA, 20 bp, Artificial Sequence
  chemically synthesized
taaatgataaagttggttgt

SEQ ID NO: 181214 - DNA, 20 bp, Artificial Sequence
  chemically synthesized
ataaatgataaagttggttg

SEQ ID NO: 181215 - DNA, 20 bp, Artificial Sequence
  chemically synthesized
tataaaataaatgataaagt

SEQ ID NO: 181216 - DNA, 20 bp, Artificial Sequence
  chemically synthesized
aaattataaaataaatgata

SEQ ID NO: 181217 - DNA, 20 bp, Artificial Sequence
  chemically synthesized
aaaactgagtaacaaaaaag

SEQ ID NO: 181218 - DNA, 20 bp, Artificial Sequence
  chemically synthesized
taaaactgagtaacaaaaaa

SEQ ID NO: 181219 - DNA, 20 bp, Artificial Sequence
  chemically synthesized
tataaaactgagtaacaaaa

SEQ ID NO: 181220 - DNA, 20 bp, Artificial Sequence
  chemically synthesized
ttcacctcttttttgttact

SEQ ID NO: 181221 - DNA, 20 bp, Artificial Sequence
  chemically synthesized
ggaggtgaaattataaaact

SEQ ID NO: 181222 - DNA, 20 bp, Artificial Sequence
  chemically synthesized
aaattgagtaacaaaatagg

SEQ ID NO: 181223 - DNA, 20 bp, Artificial Sequence
  chemically synthesized
aaaattgagtaacaaaatag

SEQ ID NO: 181224 - DNA, 20 bp, Artificial Sequence
  chemically synthesized
aaaaaattgagtaacaaaat

SEQ ID NO: 181225 - DNA, 20 bp, Artificial Sequence
  chemically synthesized
aaaaaaattgagtaacaaaa

SEQ ID NO: 181226 - DNA, 20 bp, Artificial Sequence
  chemically synthesized
gcccagaggggaaaaaaatt

SEQ ID NO: 181227 - DNA, 20 bp, Artificial Sequence
  chemically synthesized
tactcaatttttttcccctc

SEQ ID NO: 181228 - DNA, 20 bp, Artificial Sequence
  chemically synthesized
actcaatttttttcccctct

SEQ ID NO: 181229 - DNA, 20 bp, Artificial Sequence
  chemically synthesized
aatcaccataaagcccagag

SEQ ID NO: 181230 - DNA, 20 bp, Artificial Sequence
  chemically synthesized
aaatcaccataaagcccaga

SEQ ID NO: 181231 - DNA, 20 bp, Artificial Sequence
  chemically synthesized
aaaatcaccataaagcccag

SEQ ID NO: 181232 - DNA, 20 bp, Artificial Sequence
  chemically synthesized
aaaaatcaccataaagccca

SEQ ID NO: 181233 - DNA, 20 bp, Artificial Sequence
  chemically synthesized
tttttcccctctgggcttta

SEQ ID NO: 181234 - DNA, 20 bp, Artificial Sequence
  chemically synthesized
ataaaaatcaccataaagcc

SEQ ID NO: 181235 - DNA, 20 bp, Artificial Sequence
  chemically synthesized
cagtaataaaaatcaccata

SEQ ID NO: 181236 - DNA, 20 bp, Artificial Sequence
  chemically synthesized
aggaattcaaaatacagaca

SEQ ID NO: 181237 - DNA, 20 bp, Artificial Sequence
  chemically synthesized
accacgaggaattcaaaata

SEQ ID NO: 181238 - DNA, 20 bp, Artificial Sequence
  chemically synthesized
tctgtattttgaattcctcg

SEQ ID NO: 181239 - DNA, 20 bp, Artificial Sequence
  chemically synthesized
gtattttgaattcctcgtgg

SEQ ID NO: 181240 - DNA, 20 bp, Artificial Sequence
  chemically synthesized
tggaaagaattactaccacg

SEQ ID NO: 181241 - DNA, 20 bp, Artificial Sequence
  chemically synthesized
gtggaaagaattactaccac

SEQ ID NO: 181242 - DNA, 20 bp, Artificial Sequence
  chemically synthesized
acattttttctgggggtgga

SEQ ID NO: 181243 - DNA, 20 bp, Artificial Sequence
  chemically synthesized
gtagtaattctttccacccc

SEQ ID NO: 181244 - DNA, 20 bp, Artificial Sequence
  chemically synthesized
gatgacattttttctggggg

SEQ ID NO: 181245 - DNA, 20 bp, Artificial Sequence
  chemically synthesized
acagatgacattttttctgg

SEQ ID NO: 181246 - DNA, 20 bp, Artificial Sequence
  chemically synthesized
aacagatgacattttttctg

SEQ ID NO: 181247 - DNA, 20 bp, Artificial Sequence
  chemically synthesized
aaacagatgacattttttct

SEQ ID NO: 181248 - DNA, 20 bp, Artificial Sequence
  chemically synthesized
aaaacagatgacattttttc

SEQ ID NO: 181249 - DNA, 20 bp, Artificial Sequence
  chemically synthesized
acatacatagtttgagaaaa

SEQ ID NO: 181250 - DNA, 20 bp, Artificial Sequence
  chemically synthesized
actggaaacatacatagttt

SEQ ID NO: 181251 - DNA, 20 bp, Artificial Sequence
  chemically synthesized
tattccactggaaacataca

SEQ ID NO: 181252 - DNA, 20 bp, Artificial Sequence
  chemically synthesized
tctcaaactatgtatgtttc

SEQ ID NO: 181253 - DNA, 20 bp, Artificial Sequence
  chemically synthesized
caaactatgtatgtttccag

SEQ ID NO: 181254 - DNA, 20 bp, Artificial Sequence
  chemically synthesized
ataatgtattcatattccac

SEQ ID NO: 181255 - DNA, 20 bp, Artificial Sequence
  chemically synthesized
tggaatatgaatacattata

SEQ ID NO: 181256 - DNA, 20 bp, Artificial Sequence
  chemically synthesized
gaatatgaatacattatata

SEQ ID NO: 181257 - DNA, 20 bp, Artificial Sequence
  chemically synthesized
atgaatacattatatagaga

SEQ ID NO: 181258 - DNA, 20 bp, Artificial Sequence
  chemically synthesized
tatatagagacggaaacccg

SEQ ID NO: 181259 - DNA, 20 bp, Artificial Sequence
  chemically synthesized
ctcactctctggggaacttc

SEQ ID NO: 181260 - DNA, 20 bp, Artificial Sequence
  chemically synthesized
tctcactctctggggaactt

SEQ ID NO: 181261 - DNA, 20 bp, Artificial Sequence
  chemically synthesized
gacggaaacccgaagttccc

SEQ ID NO: 181262 - DNA, 20 bp, Artificial Sequence
  chemically synthesized
cggaaacccgaagttcccca

SEQ ID NO: 181263 - DNA, 20 bp, Artificial Sequence
  chemically synthesized
gaaacccgaagttccccaga

SEQ ID NO: 181264 - DNA, 20 bp, Artificial Sequence
  chemically synthesized
tctctctctctcactctctg

SEQ ID NO: 181265 - DNA, 20 bp, Artificial Sequence
  chemically synthesized
cccgaagttccccagagagt

SEQ ID NO: 181266 - DNA, 20 bp, Artificial Sequence
  chemically synthesized
ctctctctctctcactctct

SEQ ID NO: 181267 - DNA, 20 bp, Artificial Sequence
  chemically synthesized
tctctctctctctcactctc

SEQ ID NO: 181268 - DNA, 20 bp, Artificial Sequence
  chemically synthesized
cgaagttccccagagagtga

SEQ ID NO: 181269 - DNA, 20 bp, Artificial Sequence
  chemically synthesized
aagttccccagagagtgaga

SEQ ID NO: 181270 - DNA, 20 bp, Artificial Sequence
  chemically synthesized
gttccccagagagtgagaga

SEQ ID NO: 181271 - DNA, 20 bp, Artificial Sequence
  chemically synthesized
tccccagagagtgagagaga

SEQ ID NO: 181272 - DNA, 20 bp, Artificial Sequence
  chemically synthesized
cccagagagtgagagagaga

SEQ ID NO: 181273 - DNA, 20 bp, Artificial Sequence
  chemically synthesized
cagagagtgagagagagaga

SEQ ID NO: 181274 - DNA, 20 bp, Artificial Sequence
  chemically synthesized
gagagtgagagagagagaga

SEQ ID NO: 181275 - DNA, 20 bp, Artificial Sequence
  chemically synthesized
gagtgagagagagagagaga

SEQ ID NO: 181276 - DNA, 20 bp, Artificial Sequence
  chemically synthesized
gtgagagagagagagagaga

SEQ ID NO: 181277 - DNA, 20 bp, Artificial Sequence
  chemically synthesized
gagagagagagagagagaga

SEQ ID NO: 181278 - DNA, 20 bp, Artificial Sequence
  chemically synthesized
gagagagagagagagagaga

SEQ ID NO: 181279 - DNA, 20 bp, Artificial Sequence
  chemically synthesized
gagagagagagagagagaga

SEQ ID NO: 181280 - DNA, 20 bp, Artificial Sequence
  chemically synthesized
gagagagagagagagagaga

SEQ ID NO: 181281 - DNA, 20 bp, Artificial Sequence
  chemically synthesized
gagagagagagagagagaga

SEQ ID NO: 181282 - DNA, 20 bp, Artificial Sequence
  chemically synthesized
gagagagagagagagagaga

SEQ ID NO: 181283 - DNA, 20 bp, Artificial Sequence
  chemically synthesized
gagagagagagagagagaga

SEQ ID NO: 181284 - DNA, 20 bp, Artificial Sequence
  chemically synthesized
gagagagagagagagagaga

SEQ ID NO: 181285 - DNA, 20 bp, Artificial Sequence
  chemically synthesized
gagagagagagagagagaga

SEQ ID NO: 181286 - DNA, 20 bp, Artificial Sequence
  chemically synthesized
gagagagagagagagagaga

SEQ ID NO: 181287 - DNA, 20 bp, Artificial Sequence
  chemically synthesized
gagagagagagagagagaga

SEQ ID NO: 181288 - DNA, 20 bp, Artificial Sequence
  chemically synthesized
gagagagagagagagagaga

SEQ ID NO: 181289 - DNA, 20 bp, Artificial Sequence
  chemically synthesized
gagagagagagagagagaga

SEQ ID NO: 181290 - DNA, 20 bp, Artificial Sequence
  chemically synthesized
gagagagagagagagagaga

SEQ ID NO: 181291 - DNA, 20 bp, Artificial Sequence
  chemically synthesized
agagagagagagagagagaa

SEQ ID NO: 181292 - DNA, 20 bp, Artificial Sequence
  chemically synthesized
gagagagagagagagagaaa

SEQ ID NO: 181293 - DNA, 20 bp, Artificial Sequence
  chemically synthesized
agagagagagagagagaaaa

SEQ ID NO: 181294 - DNA, 20 bp, Artificial Sequence
  chemically synthesized
gcctttctgctcgagtatga

SEQ ID NO: 181295 - DNA, 20 bp, Artificial Sequence
  chemically synthesized
tgatcatcactttcatactc

SEQ ID NO: 181296 - DNA, 20 bp, Artificial Sequence
  chemically synthesized
tcatcactttcatactcgag

SEQ ID NO: 181297 - DNA, 20 bp, Artificial Sequence
  chemically synthesized
cactttcatactcgagcaga

SEQ ID NO: 181298 - DNA, 20 bp, Artificial Sequence
  chemically synthesized
taccctttgcctttctgctc

SEQ ID NO: 181299 - DNA, 20 bp, Artificial Sequence
  chemically synthesized
actttcatactcgagcagaa

SEQ ID NO: 181300 - DNA, 20 bp, Artificial Sequence
  chemically synthesized
catactcgagcagaaaggca

SEQ ID NO: 181301 - DNA, 20 bp, Artificial Sequence
  chemically synthesized
atactcgagcagaaaggcaa

SEQ ID NO: 181302 - DNA, 20 bp, Artificial Sequence
  chemically synthesized
tactcgagcagaaaggcaaa

SEQ ID NO: 181303 - DNA, 20 bp, Artificial Sequence
  chemically synthesized
cagagtttaaataagtgaaa

SEQ ID NO: 181304 - DNA, 20 bp, Artificial Sequence
  chemically synthesized
attatgtgcagagtttaaat

SEQ ID NO: 181305 - DNA, 20 bp, Artificial Sequence
  chemically synthesized
cttagctgcaattatgtgca

SEQ ID NO: 181306 - DNA, 20 bp, Artificial Sequence
  chemically synthesized
aacttagctgcaattatgtg

SEQ ID NO: 181307 - DNA, 20 bp, Artificial Sequence
  chemically synthesized
ttaaactctgcacataattg

SEQ ID NO: 181308 - DNA, 20 bp, Artificial Sequence
  chemically synthesized
ctctgcacataattgcagct

SEQ ID NO: 181309 - DNA, 20 bp, Artificial Sequence
  chemically synthesized
ataattgcagctaagttcct

SEQ ID NO: 181310 - DNA, 20 bp, Artificial Sequence
  chemically synthesized
acctctgtttctgaggaact

SEQ ID NO: 181311 - DNA, 20 bp, Artificial Sequence
  chemically synthesized
gcagctaagttcctcagaaa

SEQ ID NO: 181312 - DNA, 20 bp, Artificial Sequence
  chemically synthesized
aatagtaacctctgtttctg

SEQ ID NO: 181313 - DNA, 20 bp, Artificial Sequence
  chemically synthesized
agctaagttcctcagaaaca

SEQ ID NO: 181314 - DNA, 20 bp, Artificial Sequence
  chemically synthesized
gaatagtaacctctgtttct

SEQ ID NO: 181315 - DNA, 20 bp, Artificial Sequence
  chemically synthesized
gctaagttcctcagaaacag

SEQ ID NO: 181316 - DNA, 20 bp, Artificial Sequence
  chemically synthesized
ggctatattcttttaaagaa

SEQ ID NO: 181317 - DNA, 20 bp, Artificial Sequence
  chemically synthesized
cagaggttactattctttaa

SEQ ID NO: 181318 - DNA, 20 bp, Artificial Sequence
  chemically synthesized
cctgtggctatattctttta

SEQ ID NO: 181319 - DNA, 20 bp, Artificial Sequence
  chemically synthesized
tactattctttaaaagaata

SEQ ID NO: 181320 - DNA, 20 bp, Artificial Sequence
  chemically synthesized
tctttaaaagaatatagcca

SEQ ID NO: 181321 - DNA, 20 bp, Artificial Sequence
  chemically synthesized
ctttaaaagaatatagccac

SEQ ID NO: 181322 - DNA, 20 bp, Artificial Sequence
  chemically synthesized
ttaaaagaatatagccacag

SEQ ID NO: 181323 - DNA, 20 bp, Artificial Sequence
  chemically synthesized
taaaagaatatagccacagg

SEQ ID NO: 181324 - DNA, 20 bp, Artificial Sequence
  chemically synthesized
aactatttttgtacctcctg

SEQ ID NO: 181325 - DNA, 20 bp, Artificial Sequence
  chemically synthesized
agccacaggaggtacaaaaa

SEQ ID NO: 181326 - DNA, 20 bp, Artificial Sequence
  chemically synthesized
aatagttatattccctgaaa

SEQ ID NO: 181327 - DNA, 20 bp, Artificial Sequence
  chemically synthesized
tttaaggaaatactgtttca

SEQ ID NO: 181328 - DNA, 20 bp, Artificial Sequence
  chemically synthesized
atttaaggaaatactgtttc

SEQ ID NO: 181329 - DNA, 20 bp, Artificial Sequence
  chemically synthesized
catttaaggaaatactgttt

SEQ ID NO: 181330 - DNA, 20 bp, Artificial Sequence
  chemically synthesized
aaacagtatttccttaaatg

SEQ ID NO: 181331 - DNA, 20 bp, Artificial Sequence
  chemically synthesized
gggtccccagaccacattta

SEQ ID NO: 181332 - DNA, 20 bp, Artificial Sequence
  chemically synthesized
ggggtccccagaccacattt

SEQ ID NO: 181333 - DNA, 20 bp, Artificial Sequence
  chemically synthesized
gtatttccttaaatgtggtc

SEQ ID NO: 181334 - DNA, 20 bp, Artificial Sequence
  chemically synthesized
tatttccttaaatgtggtct

SEQ ID NO: 181335 - DNA, 20 bp, Artificial Sequence
  chemically synthesized
atttccttaaatgtggtctg

SEQ ID NO: 181336 - DNA, 20 bp, Artificial Sequence
  chemically synthesized
cagggactcccaggggtccc

SEQ ID NO: 181337 - DNA, 20 bp, Artificial Sequence
  chemically synthesized
aaatgtggtctggggacccc

SEQ ID NO: 181338 - DNA, 20 bp, Artificial Sequence
  chemically synthesized
aatgtggtctggggacccct

SEQ ID NO: 181339 - DNA, 20 bp, Artificial Sequence
  chemically synthesized
tgtggtctggggacccctgg

SEQ ID NO: 181340 - DNA, 20 bp, Artificial Sequence
  chemically synthesized
tgggtctcagggactcccag

SEQ ID NO: 181341 - DNA, 20 bp, Artificial Sequence
  chemically synthesized
atgggtctcagggactccca

SEQ ID NO: 181342 - DNA, 20 bp, Artificial Sequence
  chemically synthesized
catgggtctcagggactccc

SEQ ID NO: 181343 - DNA, 20 bp, Artificial Sequence
  chemically synthesized
gcatgggtctcagggactcc

SEQ ID NO: 181344 - DNA, 20 bp, Artificial Sequence
  chemically synthesized
ggggacccctgggagtccct

SEQ ID NO: 181345 - DNA, 20 bp, Artificial Sequence
  chemically synthesized
gaaccactgcatgggtctca

SEQ ID NO: 181346 - DNA, 20 bp, Artificial Sequence
  chemically synthesized
agaaccactgcatgggtctc

SEQ ID NO: 181347 - DNA, 20 bp, Artificial Sequence
  chemically synthesized
cagaaccactgcatgggtct

SEQ ID NO: 181348 - DNA, 20 bp, Artificial Sequence
  chemically synthesized
gggagtccctgagacccatg

SEQ ID NO: 181349 - DNA, 20 bp, Artificial Sequence
  chemically synthesized
agtccctgagacccatgcag

SEQ ID NO: 181350 - DNA, 20 bp, Artificial Sequence
  chemically synthesized
acctcacagaaccactgcat

SEQ ID NO: 181351 - DNA, 20 bp, Artificial Sequence
  chemically synthesized
gacctcacagaaccactgca

SEQ ID NO: 181352 - DNA, 20 bp, Artificial Sequence
  chemically synthesized
gacccatgcagtggttctgt

SEQ ID NO: 181353 - DNA, 20 bp, Artificial Sequence
  chemically synthesized
acccatgcagtggttctgtg

SEQ ID NO: 181354 - DNA, 20 bp, Artificial Sequence
  chemically synthesized
cgaaaataatttggacctca

SEQ ID NO: 181355 - DNA, 20 bp, Artificial Sequence
  chemically synthesized
gtattattacgaaaataatt

SEQ ID NO: 181356 - DNA, 20 bp, Artificial Sequence
  chemically synthesized
attattttcgtaataatact

SEQ ID NO: 181357 - DNA, 20 bp, Artificial Sequence
  chemically synthesized
gaaaaagtcaaataacatct

SEQ ID NO: 181358 - DNA, 20 bp, Artificial Sequence
  chemically synthesized
taatagaatgagagaggaaa

SEQ ID NO: 181359 - DNA, 20 bp, Artificial Sequence
  chemically synthesized
aactcataatagaatgagag

SEQ ID NO: 181360 - DNA, 20 bp, Artificial Sequence
  chemically synthesized
aaactcataatagaatgaga

SEQ ID NO: 181361 - DNA, 20 bp, Artificial Sequence
  chemically synthesized
aaaaactcataatagaatga

SEQ ID NO: 181362 - DNA, 20 bp, Artificial Sequence
  chemically synthesized
tgaaaaactcataatagaat

SEQ ID NO: 181363 - DNA, 20 bp, Artificial Sequence
  chemically synthesized
ttcctctctcattctattat

SEQ ID NO: 181364 - DNA, 20 bp, Artificial Sequence
  chemically synthesized
agcctctgaaaaactcataa

SEQ ID NO: 181365 - DNA, 20 bp, Artificial Sequence
  chemically synthesized
tcattctattatgagttttt

SEQ ID NO: 181366 - DNA, 20 bp, Artificial Sequence
  chemically synthesized
attctattatgagtttttca

SEQ ID NO: 181367 - DNA, 20 bp, Artificial Sequence
  chemically synthesized
ttctattatgagtttttcag

SEQ ID NO: 181368 - DNA, 20 bp, Artificial Sequence
  chemically synthesized
ctgtcatatctcgcatcatg

SEQ ID NO: 181369 - DNA, 20 bp, Artificial Sequence
  chemically synthesized
tttcagaggctacatgatgc

SEQ ID NO: 181370 - DNA, 20 bp, Artificial Sequence
  chemically synthesized
ctacatgatgcgagatatga

SEQ ID NO: 181371 - DNA, 20 bp, Artificial Sequence
  chemically synthesized
atatgacagcacattcaatg

SEQ ID NO: 181372 - DNA, 20 bp, Artificial Sequence
  chemically synthesized
cagcacattcaatgcagaaa

SEQ ID NO: 181373 - DNA, 20 bp, Artificial Sequence
  chemically synthesized
ttcaatgcagaaacagatat

SEQ ID NO: 181374 - DNA, 20 bp, Artificial Sequence
  chemically synthesized
gcagaaacagatataagaac

SEQ ID NO: 181375 - DNA, 20 bp, Artificial Sequence
  chemically synthesized
ttagcttaagagaaggcagc

SEQ ID NO: 181376 - DNA, 20 bp, Artificial Sequence
  chemically synthesized
aaagttagcttaagagaagg

SEQ ID NO: 181377 - DNA, 20 bp, Artificial Sequence
  chemically synthesized
agaaccagctgccttctctt

SEQ ID NO: 181378 - DNA, 20 bp, Artificial Sequence
  chemically synthesized
ttaaaagttagcttaagaga

SEQ ID NO: 181379 - DNA, 20 bp, Artificial Sequence
  chemically synthesized
tttaaaagttagcttaagag

SEQ ID NO: 181380 - DNA, 20 bp, Artificial Sequence
  chemically synthesized
ctctttaaaagttagcttaa

SEQ ID NO: 181381 - DNA, 20 bp, Artificial Sequence
  chemically synthesized
atctctttaaaagttagctt

SEQ ID NO: 181382 - DNA, 20 bp, Artificial Sequence
  chemically synthesized
ttctcttaagctaactttta

SEQ ID NO: 181383 - DNA, 20 bp, Artificial Sequence
  chemically synthesized
ttgcaaatctctttaaaagt

SEQ ID NO: 181384 - DNA, 20 bp, Artificial Sequence
  chemically synthesized
ctcttaagctaacttttaaa

SEQ ID NO: 181385 - DNA, 20 bp, Artificial Sequence
  chemically synthesized
atttttgcaaatctctttaa

SEQ ID NO: 181386 - DNA, 20 bp, Artificial Sequence
  chemically synthesized
gatttgcaaaaatgtaaaac

SEQ ID NO: 181387 - DNA, 20 bp, Artificial Sequence
  chemically synthesized
cagaaacaatatagtgagaa

SEQ ID NO: 181388 - DNA, 20 bp, Artificial Sequence
  chemically synthesized
aacagaaacaatatagtgag

SEQ ID NO: 181389 - DNA, 20 bp, Artificial Sequence
  chemically synthesized
tacaacagaaacaatatagt

SEQ ID NO: 181390 - DNA, 20 bp, Artificial Sequence
  chemically synthesized
cttctacaacagaaacaata

SEQ ID NO: 181391 - DNA, 20 bp, Artificial Sequence
  chemically synthesized
tcactatattgtttctgttg

SEQ ID NO: 181392 - DNA, 20 bp, Artificial Sequence
  chemically synthesized
ctatattgtttctgttgtag

SEQ ID NO: 181393 - DNA, 20 bp, Artificial Sequence
  chemically synthesized
ttaaactatctcttctacaa

SEQ ID NO: 181394 - DNA, 20 bp, Artificial Sequence
  chemically synthesized
atattgtttctgttgtagaa

SEQ ID NO: 181395 - DNA, 20 bp, Artificial Sequence
  chemically synthesized
tgtttctgttgtagaagaga

SEQ ID NO: 181396 - DNA, 20 bp, Artificial Sequence
  chemically synthesized
tgaaataaaaaataaatgtt

SEQ ID NO: 181397 - DNA, 20 bp, Artificial Sequence
  chemically synthesized
caattttaaaatgaattaat

SEQ ID NO: 181398 - DNA, 20 bp, Artificial Sequence
  chemically synthesized
ctcaaaaaaaaaaaaaaaag

SEQ ID NO: 181399 - DNA, 20 bp, Artificial Sequence
  chemically synthesized
cgtctcaaaaaaaaaaaaaa

SEQ ID NO: 181400 - DNA, 20 bp, Artificial Sequence
  chemically synthesized
ccactttttttttttttttt

SEQ ID NO: 181401 - DNA, 20 bp, Artificial Sequence
  chemically synthesized
ttttttttttttttttgaga

SEQ ID NO: 181402 - DNA, 20 bp, Artificial Sequence
  chemically synthesized
ttttttttttttttgagacg

SEQ ID NO: 181403 - DNA, 20 bp, Artificial Sequence
  chemically synthesized
ctccagccgggcgacagagt

SEQ ID NO: 181404 - DNA, 20 bp, Artificial Sequence
  chemically synthesized
cggagtctcactctgtcgcc

SEQ ID NO: 181405 - DNA, 20 bp, Artificial Sequence
  chemically synthesized
tgcactccagccgggcgaca

SEQ ID NO: 181406 - DNA, 20 bp, Artificial Sequence
  chemically synthesized
actgcactccagccgggcga

SEQ ID NO: 181407 - DNA, 20 bp, Artificial Sequence
  chemically synthesized
gtctcactctgtcgcccggc

SEQ ID NO: 181408 - DNA, 20 bp, Artificial Sequence
  chemically synthesized
ctcactctgtcgcccggctg

SEQ ID NO: 181409 - DNA, 20 bp, Artificial Sequence
  chemically synthesized
cgcaccactgcactccagcc

SEQ ID NO: 181410 - DNA, 20 bp, Artificial Sequence
  chemically synthesized
tcgcaccactgcactccagc

SEQ ID NO: 181411 - DNA, 20 bp, Artificial Sequence
  chemically synthesized
tctgtcgcccggctggagtg

SEQ ID NO: 181412 - DNA, 20 bp, Artificial Sequence
  chemically synthesized
gagatcgcaccactgcactc

SEQ ID NO: 181413 - DNA, 20 bp, Artificial Sequence
  chemically synthesized
gtcgcccggctggagtgcag

SEQ ID NO: 181414 - DNA, 20 bp, Artificial Sequence
  chemically synthesized
ggagtgcagtggtgcgatct

SEQ ID NO: 181415 - DNA, 20 bp, Artificial Sequence
  chemically synthesized
ggcagaggttgcagtgagcc

SEQ ID NO: 181416 - DNA, 20 bp, Artificial Sequence
  chemically synthesized
cgggaggcagaggttgcagt

SEQ ID NO: 181417 - DNA, 20 bp, Artificial Sequence
  chemically synthesized
aacccgggaggcagaggttg

SEQ ID NO: 181418 - DNA, 20 bp, Artificial Sequence
  chemically synthesized
tgctcgaacccgggaggcag

SEQ ID NO: 181419 - DNA, 20 bp, Artificial Sequence
  chemically synthesized
tcactgcaacctctgcctcc

SEQ ID NO: 181420 - DNA, 20 bp, Artificial Sequence
  chemically synthesized
ttgctcgaacccgggaggca

SEQ ID NO: 181421 - DNA, 20 bp, Artificial Sequence
  chemically synthesized
cactgcaacctctgcctccc

SEQ ID NO: 181422 - DNA, 20 bp, Artificial Sequence
  chemically synthesized
aattgctcgaacccgggagg

SEQ ID NO: 181423 - DNA, 20 bp, Artificial Sequence
  chemically synthesized
aagaattgctcgaacccggg

SEQ ID NO: 181424 - DNA, 20 bp, Artificial Sequence
  chemically synthesized
gaagaattgctcgaacccgg

SEQ ID NO: 181425 - DNA, 20 bp, Artificial Sequence
  chemically synthesized
aacctctgcctcccgggttc

SEQ ID NO: 181426 - DNA, 20 bp, Artificial Sequence
  chemically synthesized
cagaagaattgctcgaaccc

SEQ ID NO: 181427 - DNA, 20 bp, Artificial Sequence
  chemically synthesized
gcagaagaattgctcgaacc

SEQ ID NO: 181428 - DNA, 20 bp, Artificial Sequence
  chemically synthesized
ttcgagcaattcttctgctt

SEQ ID NO: 181429 - DNA, 20 bp, Artificial Sequence
  chemically synthesized
tactcgggaggctgaagcag

SEQ ID NO: 181430 - DNA, 20 bp, Artificial Sequence
  chemically synthesized
agctactcgggaggctgaag

SEQ ID NO: 181431 - DNA, 20 bp, Artificial Sequence
  chemically synthesized
cccagctactcgggaggctg

SEQ ID NO: 181432 - DNA, 20 bp, Artificial Sequence
  chemically synthesized
ttcttctgcttcagcctccc

SEQ ID NO: 181433 - DNA, 20 bp, Artificial Sequence
  chemically synthesized
ttctgcttcagcctcccgag

SEQ ID NO: 181434 - DNA, 20 bp, Artificial Sequence
  chemically synthesized
tgtagtcccagctactcggg

SEQ ID NO: 181435 - DNA, 20 bp, Artificial Sequence
  chemically synthesized
ctgtagtcccagctactcgg

SEQ ID NO: 181436 - DNA, 20 bp, Artificial Sequence
  chemically synthesized
gcttcagcctcccgagtagc

SEQ ID NO: 181437 - DNA, 20 bp, Artificial Sequence
  chemically synthesized
gcctgtagtcccagctactc

SEQ ID NO: 181438 - DNA, 20 bp, Artificial Sequence
  chemically synthesized
cttcagcctcccgagtagct

SEQ ID NO: 181439 - DNA, 20 bp, Artificial Sequence
  chemically synthesized
cgcctgtagtcccagctact

SEQ ID NO: 181440 - DNA, 20 bp, Artificial Sequence
  chemically synthesized
ctcccgagtagctgggacta

SEQ ID NO: 181441 - DNA, 20 bp, Artificial Sequence
  chemically synthesized
tcccgagtagctgggactac

SEQ ID NO: 181442 - DNA, 20 bp, Artificial Sequence
  chemically synthesized
gtggcgggcgcctgtagtcc

SEQ ID NO: 181443 - DNA, 20 bp, Artificial Sequence
  chemically synthesized
ggagtggtggcgggcgcctg

SEQ ID NO: 181444 - DNA, 20 bp, Artificial Sequence
  chemically synthesized
aaacaaacaggagtggtggc

SEQ ID NO: 181445 - DNA, 20 bp, Artificial Sequence
  chemically synthesized
caaacaaacaggagtggtgg

SEQ ID NO: 181446 - DNA, 20 bp, Artificial Sequence
  chemically synthesized
aaacaaacaaacaggagtgg

SEQ ID NO: 181447 - DNA, 20 bp, Artificial Sequence
  chemically synthesized
acaaaacaaacaaacaggag

SEQ ID NO: 181448 - DNA, 20 bp, Artificial Sequence
  chemically synthesized
aaaacaaaacaaacaaacag

SEQ ID NO: 181449 - DNA, 20 bp, Artificial Sequence
  chemically synthesized
acaaaacaaaacaaacaaac

SEQ ID NO: 181450 - DNA, 20 bp, Artificial Sequence
  chemically synthesized
aacaaaacaaaacaaacaaa

SEQ ID NO: 181451 - DNA, 20 bp, Artificial Sequence
  chemically synthesized
caaaaaaaaaaaaaaaaaag

SEQ ID NO: 181452 - DNA, 20 bp, Artificial Sequence
  chemically synthesized
atacaaaaaaaaaaaaaaaa

SEQ ID NO: 181453 - DNA, 20 bp, Artificial Sequence
  chemically synthesized
ttttttttttgtatttttaa

SEQ ID NO: 181454 - DNA, 20 bp, Artificial Sequence
  chemically synthesized
ttttttttgtatttttaaca

SEQ ID NO: 181455 - DNA, 20 bp, Artificial Sequence
  chemically synthesized
ttttgtatttttaacagaga

SEQ ID NO: 181456 - DNA, 20 bp, Artificial Sequence
  chemically synthesized
tttgtatttttaacagagac

SEQ ID NO: 181457 - DNA, 20 bp, Artificial Sequence
  chemically synthesized
ttgtatttttaacagagaca

SEQ ID NO: 181458 - DNA, 20 bp, Artificial Sequence
  chemically synthesized
cagggtttcaccatgttcac

SEQ ID NO: 181459 - DNA, 20 bp, Artificial Sequence
  chemically synthesized
cgagaccatcctggtgaaca

SEQ ID NO: 181460 - DNA, 20 bp, Artificial Sequence
  chemically synthesized
agggtttcaccatgttcacc

SEQ ID NO: 181461 - DNA, 20 bp, Artificial Sequence
  chemically synthesized
tttcaccatgttcaccagga

SEQ ID NO: 181462 - DNA, 20 bp, Artificial Sequence
  chemically synthesized
tcaagagatcgagaccatcc

SEQ ID NO: 181463 - DNA, 20 bp, Artificial Sequence
  chemically synthesized
gatcacgaggtcaagagatc

SEQ ID NO: 181464 - DNA, 20 bp, Artificial Sequence
  chemically synthesized
cgggcggatcacgaggtcaa

SEQ ID NO: 181465 - DNA, 20 bp, Artificial Sequence
  chemically synthesized
ggcgggcggatcacgaggtc

SEQ ID NO: 181466 - DNA, 20 bp, Artificial Sequence
  chemically synthesized
gccgaggcgggcggatcacg

SEQ ID NO: 181467 - DNA, 20 bp, Artificial Sequence
  chemically synthesized
ggccgaggcgggcggatcac

SEQ ID NO: 181468 - DNA, 20 bp, Artificial Sequence
  chemically synthesized
acctcgtgatccgcccgcct

SEQ ID NO: 181469 - DNA, 20 bp, Artificial Sequence
  chemically synthesized
ctctgggaggccgaggcggg

SEQ ID NO: 181470 - DNA, 20 bp, Artificial Sequence
  chemically synthesized
gcactctgggaggccgaggc

SEQ ID NO: 181471 - DNA, 20 bp, Artificial Sequence
  chemically synthesized
agcactctgggaggccgagg

SEQ ID NO: 181472 - DNA, 20 bp, Artificial Sequence
  chemically synthesized
cccagcactctgggaggccg

SEQ ID NO: 181473 - DNA, 20 bp, Artificial Sequence
  chemically synthesized
atccgcccgcctcggcctcc

SEQ ID NO: 181474 - DNA, 20 bp, Artificial Sequence
  chemically synthesized
tcccagcactctgggaggcc

SEQ ID NO: 181475 - DNA, 20 bp, Artificial Sequence
  chemically synthesized
ccgcccgcctcggcctccca

SEQ ID NO: 181476 - DNA, 20 bp, Artificial Sequence
  chemically synthesized
tgtaatcccagcactctggg

SEQ ID NO: 181477 - DNA, 20 bp, Artificial Sequence
  chemically synthesized
ctgtaatcccagcactctgg

SEQ ID NO: 181478 - DNA, 20 bp, Artificial Sequence
  chemically synthesized
gcctcggcctcccagagtgc

SEQ ID NO: 181479 - DNA, 20 bp, Artificial Sequence
  chemically synthesized
gcctgtaatcccagcactct

SEQ ID NO: 181480 - DNA, 20 bp, Artificial Sequence
  chemically synthesized
cctcggcctcccagagtgct

SEQ ID NO: 181481 - DNA, 20 bp, Artificial Sequence
  chemically synthesized
cgcctgtaatcccagcactc

SEQ ID NO: 181482 - DNA, 20 bp, Artificial Sequence
  chemically synthesized
ctcccagagtgctgggatta

SEQ ID NO: 181483 - DNA, 20 bp, Artificial Sequence
  chemically synthesized
tcccagagtgctgggattac

SEQ ID NO: 181484 - DNA, 20 bp, Artificial Sequence
  chemically synthesized
gtgcctcacgcctgtaatcc

SEQ ID NO: 181485 - DNA, 20 bp, Artificial Sequence
  chemically synthesized
agtgctgggattacaggcgt

SEQ ID NO: 181486 - DNA, 20 bp, Artificial Sequence
  chemically synthesized
gtgctgggattacaggcgtg

SEQ ID NO: 181487 - DNA, 20 bp, Artificial Sequence
  chemically synthesized
caggcgtgaggcaccgcgcc

SEQ ID NO: 181488 - DNA, 20 bp, Artificial Sequence
  chemically synthesized
aaaattatcttggccaggcg

SEQ ID NO: 181489 - DNA, 20 bp, Artificial Sequence
  chemically synthesized
gtgaggcaccgcgcctggcc

SEQ ID NO: 181490 - DNA, 20 bp, Artificial Sequence
  chemically synthesized
caaaaaaaattatcttggcc

SEQ ID NO: 181491 - DNA, 20 bp, Artificial Sequence
  chemically synthesized
acaaaaaaaattatcttggc

SEQ ID NO: 181492 - DNA, 20 bp, Artificial Sequence
  chemically synthesized
ttctacaaaaaaaattatct

SEQ ID NO: 181493 - DNA, 20 bp, Artificial Sequence
  chemically synthesized
ggccaagataattttttttg

SEQ ID NO: 181494 - DNA, 20 bp, Artificial Sequence
  chemically synthesized
aataatatgtccttgtcaac

SEQ ID NO: 181495 - DNA, 20 bp, Artificial Sequence
  chemically synthesized
attacttatgccagttgaca

SEQ ID NO: 181496 - DNA, 20 bp, Artificial Sequence
  chemically synthesized
cattacttatgccagttgac

SEQ ID NO: 181497 - DNA, 20 bp, Artificial Sequence
  chemically synthesized
atgtccttgtcaactggcat

SEQ ID NO: 181498 - DNA, 20 bp, Artificial Sequence
  chemically synthesized
taagctgtcattacttatgc

SEQ ID NO: 181499 - DNA, 20 bp, Artificial Sequence
  chemically synthesized
tcaactggcataagtaatga

SEQ ID NO: 181500 - DNA, 20 bp, Artificial Sequence
  chemically synthesized
acaaactcggcatgcatgat

SEQ ID NO: 181501 - DNA, 20 bp, Artificial Sequence
  chemically synthesized
gacagcttatcatgcatgcc

SEQ ID NO: 181502 - DNA, 20 bp, Artificial Sequence
  chemically synthesized
ggtctttataatgacaaact

SEQ ID NO: 181503 - DNA, 20 bp, Artificial Sequence
  chemically synthesized
atgccgagtttgtcattata

SEQ ID NO: 181504 - DNA, 20 bp, Artificial Sequence
  chemically synthesized
gtttgtcattataaagacct

SEQ ID NO: 181505 - DNA, 20 bp, Artificial Sequence
  chemically synthesized
tcattataaagacctcagac

SEQ ID NO: 181506 - DNA, 20 bp, Artificial Sequence
  chemically synthesized
ttgtattatttacttgtctg

SEQ ID NO: 181507 - DNA, 20 bp, Artificial Sequence
  chemically synthesized
attgtattatttacttgtct

SEQ ID NO: 181508 - DNA, 20 bp, Artificial Sequence
  chemically synthesized
tgaaaattgaaataatccat

SEQ ID NO: 181509 - DNA, 20 bp, Artificial Sequence
  chemically synthesized
gaaaattgaaataatccatt

SEQ ID NO: 181510 - DNA, 20 bp, Artificial Sequence
  chemically synthesized
gtggatttcttcatacctaa

SEQ ID NO: 181511 - DNA, 20 bp, Artificial Sequence
  chemically synthesized
gaaataatccattaggtatg

SEQ ID NO: 181512 - DNA, 20 bp, Artificial Sequence
  chemically synthesized
tccaactggaatgtttgtgg

SEQ ID NO: 181513 - DNA, 20 bp, Artificial Sequence
  chemically synthesized
aactccaactggaatgtttg

SEQ ID NO: 181514 - DNA, 20 bp, Artificial Sequence
  chemically synthesized
gaaatccaccacaaacattc

SEQ ID NO: 181515 - DNA, 20 bp, Artificial Sequence
  chemically synthesized
tccaccacaaacattccagt

SEQ ID NO: 181516 - DNA, 20 bp, Artificial Sequence
  chemically synthesized
caccacaaacattccagttg

SEQ ID NO: 181517 - DNA, 20 bp, Artificial Sequence
  chemically synthesized
gcaaatttctgaactccaac

SEQ ID NO: 181518 - DNA, 20 bp, Artificial Sequence
  chemically synthesized
caaacattccagttggagtt

SEQ ID NO: 181519 - DNA, 20 bp, Artificial Sequence
  chemically synthesized
tctgtctctaataaattcat

SEQ ID NO: 181520 - DNA, 20 bp, Artificial Sequence
  chemically synthesized
aaatttgccaatgaatttat

SEQ ID NO: 181521 - DNA, 20 bp, Artificial Sequence
  chemically synthesized
atttgccaatgaatttatta

SEQ ID NO: 181522 - DNA, 20 bp, Artificial Sequence
  chemically synthesized
gccaatgaatttattagaga

SEQ ID NO: 181523 - DNA, 20 bp, Artificial Sequence
  chemically synthesized
caatgaatttattagagaca

SEQ ID NO: 181524 - DNA, 20 bp, Artificial Sequence
  chemically synthesized
aatgaatttattagagacag

SEQ ID NO: 181525 - DNA, 20 bp, Artificial Sequence
  chemically synthesized
atgaatttattagagacaga

SEQ ID NO: 181526 - DNA, 20 bp, Artificial Sequence
  chemically synthesized
gaatttattagagacagagg

SEQ ID NO: 181527 - DNA, 20 bp, Artificial Sequence
  chemically synthesized
aatttattagagacagaggg

SEQ ID NO: 181528 - DNA, 20 bp, Artificial Sequence
  chemically synthesized
acagagggaggtgaataatg

SEQ ID NO: 181529 - DNA, 20 bp, Artificial Sequence
  chemically synthesized
cagagggaggtgaataatgt

SEQ ID NO: 181530 - DNA, 20 bp, Artificial Sequence
  chemically synthesized
aagttgaccctcatagtcat

SEQ ID NO: 181531 - DNA, 20 bp, Artificial Sequence
  chemically synthesized
taatgtaggccaatgactat

SEQ ID NO: 181532 - DNA, 20 bp, Artificial Sequence
  chemically synthesized
aatgtaggccaatgactatg

SEQ ID NO: 181533 - DNA, 20 bp, Artificial Sequence
  chemically synthesized
atgtaggccaatgactatga

SEQ ID NO: 181534 - DNA, 20 bp, Artificial Sequence
  chemically synthesized
actctaaaagttgaccctca

SEQ ID NO: 181535 - DNA, 20 bp, Artificial Sequence
  chemically synthesized
tgactatgagggtcaacttt

SEQ ID NO: 181536 - DNA, 20 bp, Artificial Sequence
  chemically synthesized
actatgagggtcaactttta

SEQ ID NO: 181537 - DNA, 20 bp, Artificial Sequence
  chemically synthesized
aggcagttcattaactctaa

SEQ ID NO: 181538 - DNA, 20 bp, Artificial Sequence
  chemically synthesized
attcccagtaaatatttagg

SEQ ID NO: 181539 - DNA, 20 bp, Artificial Sequence
  chemically synthesized
gagattcccagtaaatattt

SEQ ID NO: 181540 - DNA, 20 bp, Artificial Sequence
  chemically synthesized
agagattcccagtaaatatt

SEQ ID NO: 181541 - DNA, 20 bp, Artificial Sequence
  chemically synthesized
tgaactgcctaaatatttac

SEQ ID NO: 181542 - DNA, 20 bp, Artificial Sequence
  chemically synthesized
gaactgcctaaatatttact

SEQ ID NO: 181543 - DNA, 20 bp, Artificial Sequence
  chemically synthesized
tagcatatcacagagattcc

SEQ ID NO: 181544 - DNA, 20 bp, Artificial Sequence
  chemically synthesized
acttagcctagcatatcaca

SEQ ID NO: 181545 - DNA, 20 bp, Artificial Sequence
  chemically synthesized
ctacttagcctagcatatca

SEQ ID NO: 181546 - DNA, 20 bp, Artificial Sequence
  chemically synthesized
tgggaatctctgtgatatgc

SEQ ID NO: 181547 - DNA, 20 bp, Artificial Sequence
  chemically synthesized
gggaatctctgtgatatgct

SEQ ID NO: 181548 - DNA, 20 bp, Artificial Sequence
  chemically synthesized
tctctgtgatatgctaggct

SEQ ID NO: 181549 - DNA, 20 bp, Artificial Sequence
  chemically synthesized
ctgtgatatgctaggctaag

SEQ ID NO: 181550 - DNA, 20 bp, Artificial Sequence
  chemically synthesized
tgaaggtgccctacttagcc

SEQ ID NO: 181551 - DNA, 20 bp, Artificial Sequence
  chemically synthesized
tgtgatatgctaggctaagt

SEQ ID NO: 181552 - DNA, 20 bp, Artificial Sequence
  chemically synthesized
gtgatatgctaggctaagta

SEQ ID NO: 181553 - DNA, 20 bp, Artificial Sequence
  chemically synthesized
tcatttgaaggtgccctact

SEQ ID NO: 181554 - DNA, 20 bp, Artificial Sequence
  chemically synthesized
gcagtgtgtatatcatttga

SEQ ID NO: 181555 - DNA, 20 bp, Artificial Sequence
  chemically synthesized
agcagtgtgtatatcatttg

SEQ ID NO: 181556 - DNA, 20 bp, Artificial Sequence
  chemically synthesized
aaatataatctgtaagtgag

SEQ ID NO: 181557 - DNA, 20 bp, Artificial Sequence
  chemically synthesized
atatacacactgctcactta

SEQ ID NO: 181558 - DNA, 20 bp, Artificial Sequence
  chemically synthesized
gtgaaatataatctgtaagt

SEQ ID NO: 181559 - DNA, 20 bp, Artificial Sequence
  chemically synthesized
ctcagtgaaatataatctgt

SEQ ID NO: 181560 - DNA, 20 bp, Artificial Sequence
  chemically synthesized
cttacagattatatttcact

SEQ ID NO: 181561 - DNA, 20 bp, Artificial Sequence
  chemically synthesized
ttacagattatatttcactg

SEQ ID NO: 181562 - DNA, 20 bp, Artificial Sequence
  chemically synthesized
agattatatttcactgaggc

SEQ ID NO: 181563 - DNA, 20 bp, Artificial Sequence
  chemically synthesized
aatgacaggcgagcttgcct

SEQ ID NO: 181564 - DNA, 20 bp, Artificial Sequence
  chemically synthesized
acagtaagttaatgacaggc

SEQ ID NO: 181565 - DNA, 20 bp, Artificial Sequence
  chemically synthesized
aaatacagtaagttaatgac

SEQ ID NO: 181566 - DNA, 20 bp, Artificial Sequence
  chemically synthesized
aaaatacagtaagttaatga

SEQ ID NO: 181567 - DNA, 20 bp, Artificial Sequence
  chemically synthesized
atttgttgataaaatacagt

SEQ ID NO: 181568 - DNA, 20 bp, Artificial Sequence
  chemically synthesized
aaatatttgttgataaaata

SEQ ID NO: 181569 - DNA, 20 bp, Artificial Sequence
  chemically synthesized
tattttatcaacaaatattt

SEQ ID NO: 181570 - DNA, 20 bp, Artificial Sequence
  chemically synthesized
aatcagtacctggtatgtgg

SEQ ID NO: 181571 - DNA, 20 bp, Artificial Sequence
  chemically synthesized
tttgagcatctaccacatac

SEQ ID NO: 181572 - DNA, 20 bp, Artificial Sequence
  chemically synthesized
ttgagcatctaccacatacc

SEQ ID NO: 181573 - DNA, 20 bp, Artificial Sequence
  chemically synthesized
caaaatcagtacctggtatg

SEQ ID NO: 181574 - DNA, 20 bp, Artificial Sequence
  chemically synthesized
caagtagcaaaatcagtacc

SEQ ID NO: 181575 - DNA, 20 bp, Artificial Sequence
  chemically synthesized
acctcatcaagtagcaaaat

SEQ ID NO: 181576 - DNA, 20 bp, Artificial Sequence
  chemically synthesized
tactgattttgctacttgat

SEQ ID NO: 181577 - DNA, 20 bp, Artificial Sequence
  chemically synthesized
actgattttgctacttgatg

SEQ ID NO: 181578 - DNA, 20 bp, Artificial Sequence
  chemically synthesized
ttgttaactacctcatcaag

SEQ ID NO: 181579 - DNA, 20 bp, Artificial Sequence
  chemically synthesized
gattttgctacttgatgagg

SEQ ID NO: 181580 - DNA, 20 bp, Artificial Sequence
  chemically synthesized
attttgttaactacctcatc

SEQ ID NO: 181581 - DNA, 20 bp, Artificial Sequence
  chemically synthesized
ggtagttaacaaaatgttga

SEQ ID NO: 181582 - DNA, 20 bp, Artificial Sequence
  chemically synthesized
gtagttaacaaaatgttgac

SEQ ID NO: 181583 - DNA, 20 bp, Artificial Sequence
  chemically synthesized
ttaacaaaatgttgacaggc

SEQ ID NO: 181584 - DNA, 20 bp, Artificial Sequence
  chemically synthesized
caaaatgttgacaggctagt

SEQ ID NO: 181585 - DNA, 20 bp, Artificial Sequence
  chemically synthesized
catgtatctgtatcactgac

SEQ ID NO: 181586 - DNA, 20 bp, Artificial Sequence
  chemically synthesized
tgacaggctagtcagtgata

SEQ ID NO: 181587 - DNA, 20 bp, Artificial Sequence
  chemically synthesized
cagtgatacagatacatgaa

SEQ ID NO: 181588 - DNA, 20 bp, Artificial Sequence
  chemically synthesized
agtgatacagatacatgaat

SEQ ID NO: 181589 - DNA, 20 bp, Artificial Sequence
  chemically synthesized
ataaaaacaataaaaaaaag

SEQ ID NO: 181590 - DNA, 20 bp, Artificial Sequence
  chemically synthesized
aaataaaaacaataaaaaaa

SEQ ID NO: 181591 - DNA, 20 bp, Artificial Sequence
  chemically synthesized
aaaataaaaacaataaaaaa

SEQ ID NO: 181592 - DNA, 20 bp, Artificial Sequence
  chemically synthesized
ttttattgtttttatttttt

SEQ ID NO: 181593 - DNA, 20 bp, Artificial Sequence
  chemically synthesized
attgtttttattttttgaga

SEQ ID NO: 181594 - DNA, 20 bp, Artificial Sequence
  chemically synthesized
tgtttttattttttgagatg

SEQ ID NO: 181595 - DNA, 20 bp, Artificial Sequence
  chemically synthesized
cccagcctgggtgacagagc

SEQ ID NO: 181596 - DNA, 20 bp, Artificial Sequence
  chemically synthesized
tggagtctcgctctgtcacc

SEQ ID NO: 181597 - DNA, 20 bp, Artificial Sequence
  chemically synthesized
gcaccccagcctgggtgaca

SEQ ID NO: 181598 - DNA, 20 bp, Artificial Sequence
  chemically synthesized
ggagtctcgctctgtcaccc

SEQ ID NO: 181599 - DNA, 20 bp, Artificial Sequence
  chemically synthesized
ctgcaccccagcctgggtga

SEQ ID NO: 181600 - DNA, 20 bp, Artificial Sequence
  chemically synthesized
tctcgctctgtcacccaggc

SEQ ID NO: 181601 - DNA, 20 bp, Artificial Sequence
  chemically synthesized
ctcgctctgtcacccaggct

SEQ ID NO: 181602 - DNA, 20 bp, Artificial Sequence
  chemically synthesized
tcgctctgtcacccaggctg

SEQ ID NO: 181603 - DNA, 20 bp, Artificial Sequence
  chemically synthesized
gcgccactgcaccccagcct

SEQ ID NO: 181604 - DNA, 20 bp, Artificial Sequence
  chemically synthesized
cgcgccactgcaccccagcc

SEQ ID NO: 181605 - DNA, 20 bp, Artificial Sequence
  chemically synthesized
ctgtcacccaggctggggtg

SEQ ID NO: 181606 - DNA, 20 bp, Artificial Sequence
  chemically synthesized
aagatcgcgccactgcaccc

SEQ ID NO: 181607 - DNA, 20 bp, Artificial Sequence
  chemically synthesized
tcacccaggctggggtgcag

SEQ ID NO: 181608 - DNA, 20 bp, Artificial Sequence
  chemically synthesized
ggggtgcagtggcgcgatct

SEQ ID NO: 181609 - DNA, 20 bp, Artificial Sequence
  chemically synthesized
agtggcgcgatcttggctca

SEQ ID NO: 181610 - DNA, 20 bp, Artificial Sequence
  chemically synthesized
ggtggaggttgctgtgagcc

SEQ ID NO: 181611 - DNA, 20 bp, Artificial Sequence
  chemically synthesized
caggaggtggaggttgctgt

SEQ ID NO: 181612 - DNA, 20 bp, Artificial Sequence
  chemically synthesized
cgtttgaacccaggaggtgg

SEQ ID NO: 181613 - DNA, 20 bp, Artificial Sequence
  chemically synthesized
tcacagcaacctccacctcc

SEQ ID NO: 181614 - DNA, 20 bp, Artificial Sequence
  chemically synthesized
tcgtttgaacccaggaggtg

SEQ ID NO: 181615 - DNA, 20 bp, Artificial Sequence
  chemically synthesized
cacagcaacctccacctcct

SEQ ID NO: 181616 - DNA, 20 bp, Artificial Sequence
  chemically synthesized
aatcgtttgaacccaggagg

SEQ ID NO: 181617 - DNA, 20 bp, Artificial Sequence
  chemically synthesized
gagaatcgtttgaacccagg

SEQ ID NO: 181618 - DNA, 20 bp, Artificial Sequence
  chemically synthesized
ggagaatcgtttgaacccag

SEQ ID NO: 181619 - DNA, 20 bp, Artificial Sequence
  chemically synthesized
caggagaatcgtttgaaccc

SEQ ID NO: 181620 - DNA, 20 bp, Artificial Sequence
  chemically synthesized
gcaggagaatcgtttgaacc

SEQ ID NO: 181621 - DNA, 20 bp, Artificial Sequence
  chemically synthesized
ttcaaacgattctcctgcct

SEQ ID NO: 181622 - DNA, 20 bp, Artificial Sequence
  chemically synthesized
ctactcggaggctgaggcag

SEQ ID NO: 181623 - DNA, 20 bp, Artificial Sequence
  chemically synthesized
agctactcggaggctgaggc

SEQ ID NO: 181624 - DNA, 20 bp, Artificial Sequence
  chemically synthesized
cagctactcggaggctgagg

SEQ ID NO: 181625 - DNA, 20 bp, Artificial Sequence
  chemically synthesized
tcccagctactcggaggctg

SEQ ID NO: 181626 - DNA, 20 bp, Artificial Sequence
  chemically synthesized
attctcctgcctcagcctcc

SEQ ID NO: 181627 - DNA, 20 bp, Artificial Sequence
  chemically synthesized
atcccagctactcggaggct

SEQ ID NO: 181628 - DNA, 20 bp, Artificial Sequence
  chemically synthesized
ctcctgcctcagcctccgag

SEQ ID NO: 181629 - DNA, 20 bp, Artificial Sequence
  chemically synthesized
ttttaatcccagctactcgg

SEQ ID NO: 181630 - DNA, 20 bp, Artificial Sequence
  chemically synthesized
attttaatcccagctactcg

SEQ ID NO: 181631 - DNA, 20 bp, Artificial Sequence
  chemically synthesized
tgcctcagcctccgagtagc

SEQ ID NO: 181632 - DNA, 20 bp, Artificial Sequence
  chemically synthesized
gcctcagcctccgagtagct

SEQ ID NO: 181633 - DNA, 20 bp, Artificial Sequence
  chemically synthesized
gcattttaatcccagctact

SEQ ID NO: 181634 - DNA, 20 bp, Artificial Sequence
  chemically synthesized
tgcttatcgcattttaatcc

SEQ ID NO: 181635 - DNA, 20 bp, Artificial Sequence
  chemically synthesized
agctgggattaaaatgcgat

SEQ ID NO: 181636 - DNA, 20 bp, Artificial Sequence
  chemically synthesized
ttaaaatgcgataagcattg

SEQ ID NO: 181637 - DNA, 20 bp, Artificial Sequence
  chemically synthesized
atgcgataagcattgaagtg

SEQ ID NO: 181638 - DNA, 20 bp, Artificial Sequence
  chemically synthesized
ataaatgtttggtgaatgca

SEQ ID NO: 181639 - DNA, 20 bp, Artificial Sequence
  chemically synthesized
gtagatgtgtaataaatgtt

SEQ ID NO: 181640 - DNA, 20 bp, Artificial Sequence
  chemically synthesized
acatttattacacatctacc

SEQ ID NO: 181641 - DNA, 20 bp, Artificial Sequence
  chemically synthesized
catttattacacatctacca

SEQ ID NO: 181642 - DNA, 20 bp, Artificial Sequence
  chemically synthesized
atttattacacatctaccaa

SEQ ID NO: 181643 - DNA, 20 bp, Artificial Sequence
  chemically synthesized
gtatagtgcctggcccttgg

SEQ ID NO: 181644 - DNA, 20 bp, Artificial Sequence
  chemically synthesized
attacacatctaccaagggc

SEQ ID NO: 181645 - DNA, 20 bp, Artificial Sequence
  chemically synthesized
ttacacatctaccaagggcc

SEQ ID NO: 181646 - DNA, 20 bp, Artificial Sequence
  chemically synthesized
atagtatagtgcctggccct

SEQ ID NO: 181647 - DNA, 20 bp, Artificial Sequence
  chemically synthesized
agcaaaaatagtatagtgcc

SEQ ID NO: 181648 - DNA, 20 bp, Artificial Sequence
  chemically synthesized
aatatccagcaaaaatagta

SEQ ID NO: 181649 - DNA, 20 bp, Artificial Sequence
  chemically synthesized
aggcactatactatttttgc

SEQ ID NO: 181650 - DNA, 20 bp, Artificial Sequence
  chemically synthesized
tcctgaatatccagcaaaaa

SEQ ID NO: 181651 - DNA, 20 bp, Artificial Sequence
  chemically synthesized
tactatttttgctggatatt

SEQ ID NO: 181652 - DNA, 20 bp, Artificial Sequence
  chemically synthesized
actatttttgctggatattc

SEQ ID NO: 181653 - DNA, 20 bp, Artificial Sequence
  chemically synthesized
tttgttcactcctgaatatc

SEQ ID NO: 181654 - DNA, 20 bp, Artificial Sequence
  chemically synthesized
tatttttgctggatattcag

SEQ ID NO: 181655 - DNA, 20 bp, Artificial Sequence
  chemically synthesized
atattcaggagtgaacaaaa

SEQ ID NO: 181656 - DNA, 20 bp, Artificial Sequence
  chemically synthesized
attcaggagtgaacaaaaca

SEQ ID NO: 181657 - DNA, 20 bp, Artificial Sequence
  chemically synthesized
aggagtgaacaaaacagagc

SEQ ID NO: 181658 - DNA, 20 bp, Artificial Sequence
  chemically synthesized
cataagctacgtgtatggac

SEQ ID NO: 181659 - DNA, 20 bp, Artificial Sequence
  chemically synthesized
acagagccagtccatacacg

SEQ ID NO: 181660 - DNA, 20 bp, Artificial Sequence
  chemically synthesized
gacaccataagctacgtgta

SEQ ID NO: 181661 - DNA, 20 bp, Artificial Sequence
  chemically synthesized
cagtccatacacgtagctta

SEQ ID NO: 181662 - DNA, 20 bp, Artificial Sequence
  chemically synthesized
gatgtcacccatgacaccat

SEQ ID NO: 181663 - DNA, 20 bp, Artificial Sequence
  chemically synthesized
acacgtagcttatggtgtca

SEQ ID NO: 181664 - DNA, 20 bp, Artificial Sequence
  chemically synthesized
cacgtagcttatggtgtcat

SEQ ID NO: 181665 - DNA, 20 bp, Artificial Sequence
  chemically synthesized
aaactcttttgtatgattag

SEQ ID NO: 181666 - DNA, 20 bp, Artificial Sequence
  chemically synthesized
attaaactcttttgtatgat

SEQ ID NO: 181667 - DNA, 20 bp, Artificial Sequence
  chemically synthesized
ttaaaccactaatcatacaa

SEQ ID NO: 181668 - DNA, 20 bp, Artificial Sequence
  chemically synthesized
aaaccactaatcatacaaaa

SEQ ID NO: 181669 - DNA, 20 bp, Artificial Sequence
  chemically synthesized
tttttttctatatatatgta

SEQ ID NO: 181670 - DNA, 20 bp, Artificial Sequence
  chemically synthesized
atgcaaaccatacatatata

SEQ ID NO: 181671 - DNA, 20 bp, Artificial Sequence
  chemically synthesized
catatatatagaaaaaaatt

SEQ ID NO: 181672 - DNA, 20 bp, Artificial Sequence
  chemically synthesized
tagaaaaaaattaagattgt

SEQ ID NO: 181673 - DNA, 20 bp, Artificial Sequence
  chemically synthesized
agaaaaaaattaagattgtt

SEQ ID NO: 181674 - DNA, 20 bp, Artificial Sequence
  chemically synthesized
aaaaaaattaagattgttag

SEQ ID NO: 181675 - DNA, 20 bp, Artificial Sequence
  chemically synthesized
aaaaattaagattgttagga

SEQ ID NO: 181676 - DNA, 20 bp, Artificial Sequence
  chemically synthesized
agtgaaagtttgtaaaaaag

SEQ ID NO: 181677 - DNA, 20 bp, Artificial Sequence
  chemically synthesized
aaagtgaaagtttgtaaaaa

SEQ ID NO: 181678 - DNA, 20 bp, Artificial Sequence
  chemically synthesized
gaaagtgaaagtttgtaaaa

SEQ ID NO: 181679 - DNA, 20 bp, Artificial Sequence
  chemically synthesized
tttttacaaactttcacttt

SEQ ID NO: 181680 - DNA, 20 bp, Artificial Sequence
  chemically synthesized
tatgaaagttctgaaagtga

SEQ ID NO: 181681 - DNA, 20 bp, Artificial Sequence
  chemically synthesized
catacctatgaaagttctga

SEQ ID NO: 181682 - DNA, 20 bp, Artificial Sequence
  chemically synthesized
tttcactttcagaactttca

SEQ ID NO: 181683 - DNA, 20 bp, Artificial Sequence
  chemically synthesized
ttcactttcagaactttcat

SEQ ID NO: 181684 - DNA, 20 bp, Artificial Sequence
  chemically synthesized
taggagcaacatacctatga

SEQ ID NO: 181685 - DNA, 20 bp, Artificial Sequence
  chemically synthesized
tcataggtatgttgctccta

SEQ ID NO: 181686 - DNA, 20 bp, Artificial Sequence
  chemically synthesized
cataggtatgttgctcctaa

SEQ ID NO: 181687 - DNA, 20 bp, Artificial Sequence
  chemically synthesized
tgatgcatatttgcctttag

SEQ ID NO: 181688 - DNA, 20 bp, Artificial Sequence
  chemically synthesized
tttgatgcatatttgccttt

SEQ ID NO: 181689 - DNA, 20 bp, Artificial Sequence
  chemically synthesized
atttgatgcatatttgcctt

SEQ ID NO: 181690 - DNA, 20 bp, Artificial Sequence
  chemically synthesized
tgaccccatttattcatgga

SEQ ID NO: 181691 - DNA, 20 bp, Artificial Sequence
  chemically synthesized
ccagtgaccccatttattca

SEQ ID NO: 181692 - DNA, 20 bp, Artificial Sequence
  chemically synthesized
ttttactttccatgaataaa

SEQ ID NO: 181693 - DNA, 20 bp, Artificial Sequence
  chemically synthesized
tttactttccatgaataaat

SEQ ID NO: 181694 - DNA, 20 bp, Artificial Sequence
  chemically synthesized
ttactttccatgaataaatg

SEQ ID NO: 181695 - DNA, 20 bp, Artificial Sequence
  chemically synthesized
ccatgaataaatggggtcac

SEQ ID NO: 181696 - DNA, 20 bp, Artificial Sequence
  chemically synthesized
gaataaatggggtcactggt

SEQ ID NO: 181697 - DNA, 20 bp, Artificial Sequence
  chemically synthesized
ctataataactatagctgac

SEQ ID NO: 181698 - DNA, 20 bp, Artificial Sequence
  chemically synthesized
atggggtcactggtcagcta

SEQ ID NO: 181699 - DNA, 20 bp, Artificial Sequence
  chemically synthesized
accaaaaactataataacta

SEQ ID NO: 181700 - DNA, 20 bp, Artificial Sequence
  chemically synthesized
ctggtcagctatagttatta

SEQ ID NO: 181701 - DNA, 20 bp, Artificial Sequence
  chemically synthesized
gctatagttattatagtttt

SEQ ID NO: 181702 - DNA, 20 bp, Artificial Sequence
  chemically synthesized
tttggtatcatgtctaactt

SEQ ID NO: 181703 - DNA, 20 bp, Artificial Sequence
  chemically synthesized
gacacatcttagtctaaagt

SEQ ID NO: 181704 - DNA, 20 bp, Artificial Sequence
  chemically synthesized
atcatgtctaactttagact

SEQ ID NO: 181705 - DNA, 20 bp, Artificial Sequence
  chemically synthesized
aggagacacatcttagtcta

SEQ ID NO: 181706 - DNA, 20 bp, Artificial Sequence
  chemically synthesized
cacacagaggagacacatct

SEQ ID NO: 181707 - DNA, 20 bp, Artificial Sequence
  chemically synthesized
tttcaaaaatacacacagag

SEQ ID NO: 181708 - DNA, 20 bp, Artificial Sequence
  chemically synthesized
catttcaaaaatacacacag

SEQ ID NO: 181709 - DNA, 20 bp, Artificial Sequence
  chemically synthesized
acatttcaaaaatacacaca

SEQ ID NO: 181710 - DNA, 20 bp, Artificial Sequence
  chemically synthesized
aaacatttcaaaaatacaca

SEQ ID NO: 181711 - DNA, 20 bp, Artificial Sequence
  chemically synthesized
ataatgagattaataatgtt

SEQ ID NO: 181712 - DNA, 20 bp, Artificial Sequence
  chemically synthesized
ttgtactcatggcacataat

SEQ ID NO: 181713 - DNA, 20 bp, Artificial Sequence
  chemically synthesized
ttaatctcattatgtgccat

SEQ ID NO: 181714 - DNA, 20 bp, Artificial Sequence
  chemically synthesized
ttgctttgcttttgtactca

SEQ ID NO: 181715 - DNA, 20 bp, Artificial Sequence
  chemically synthesized
attatgtgccatgagtacaa

SEQ ID NO: 181716 - DNA, 20 bp, Artificial Sequence
  chemically synthesized
gtgccatgagtacaaaagca

SEQ ID NO: 181717 - DNA, 20 bp, Artificial Sequence
  chemically synthesized
aaaagcaaagcaaatttgtt

SEQ ID NO: 181718 - DNA, 20 bp, Artificial Sequence
  chemically synthesized
aagcaaagcaaatttgttga

SEQ ID NO: 181719 - DNA, 20 bp, Artificial Sequence
  chemically synthesized
agcaaatttgttgagagtcc

SEQ ID NO: 181720 - DNA, 20 bp, Artificial Sequence
  chemically synthesized
gcaaatttgttgagagtcct

SEQ ID NO: 181721 - DNA, 20 bp, Artificial Sequence
  chemically synthesized
cttcttttctatgttttccc

SEQ ID NO: 181722 - DNA, 20 bp, Artificial Sequence
  chemically synthesized
gcttcttttctatgttttcc

SEQ ID NO: 181723 - DNA, 20 bp, Artificial Sequence
  chemically synthesized
ttgagagtcctgggaaaaca

SEQ ID NO: 181724 - DNA, 20 bp, Artificial Sequence
  chemically synthesized
agtcctgggaaaacatagaa

SEQ ID NO: 181725 - DNA, 20 bp, Artificial Sequence
  chemically synthesized
cctgggaaaacatagaaaag

SEQ ID NO: 181726 - DNA, 20 bp, Artificial Sequence
  chemically synthesized
caataataacaataataatc

SEQ ID NO: 181727 - DNA, 20 bp, Artificial Sequence
  chemically synthesized
aataataacaataataatca

SEQ ID NO: 181728 - DNA, 20 bp, Artificial Sequence
  chemically synthesized
tgagaaaattataaatgttg

SEQ ID NO: 181729 - DNA, 20 bp, Artificial Sequence
  chemically synthesized
ttgagaaaattataaatgtt

SEQ ID NO: 181730 - DNA, 20 bp, Artificial Sequence
  chemically synthesized
caacatttataattttctca

SEQ ID NO: 181731 - DNA, 20 bp, Artificial Sequence
  chemically synthesized
aacatttataattttctcaa

SEQ ID NO: 181732 - DNA, 20 bp, Artificial Sequence
  chemically synthesized
acatttataattttctcaaa

SEQ ID NO: 181733 - DNA, 20 bp, Artificial Sequence
  chemically synthesized
gatattcagttaagcccttt

SEQ ID NO: 181734 - DNA, 20 bp, Artificial Sequence
  chemically synthesized
agaccgatagatattcagtt

SEQ ID NO: 181735 - DNA, 20 bp, Artificial Sequence
  chemically synthesized
tcaaaagaccgatagatatt

SEQ ID NO: 181736 - DNA, 20 bp, Artificial Sequence
  chemically synthesized
gggcttaactgaatatctat

SEQ ID NO: 181737 - DNA, 20 bp, Artificial Sequence
  chemically synthesized
gtctccattcaaaagaccga

SEQ ID NO: 181738 - DNA, 20 bp, Artificial Sequence
  chemically synthesized
atatctatcggtcttttgaa

SEQ ID NO: 181739 - DNA, 20 bp, Artificial Sequence
  chemically synthesized
atctatcggtcttttgaatg

SEQ ID NO: 181740 - DNA, 20 bp, Artificial Sequence
  chemically synthesized
gaacatatgtctccattcaa

SEQ ID NO: 181741 - DNA, 20 bp, Artificial Sequence
  chemically synthesized
tgaatggagacatatgttct

SEQ ID NO: 181742 - DNA, 20 bp, Artificial Sequence
  chemically synthesized
gacatatgttctaagaacaa

SEQ ID NO: 181743 - DNA, 20 bp, Artificial Sequence
  chemically synthesized
actgtaagtgcttttgttct

SEQ ID NO: 181744 - DNA, 20 bp, Artificial Sequence
  chemically synthesized
tctaagaacaaaagcactta

SEQ ID NO: 181745 - DNA, 20 bp, Artificial Sequence
  chemically synthesized
gttatattccaaatgactgt

SEQ ID NO: 181746 - DNA, 20 bp, Artificial Sequence
  chemically synthesized
caaaagcacttacagtcatt

SEQ ID NO: 181747 - DNA, 20 bp, Artificial Sequence
  chemically synthesized
ttggaatataacctgtttct

SEQ ID NO: 181748 - DNA, 20 bp, Artificial Sequence
  chemically synthesized
ccactgctcttcttagaaac

SEQ ID NO: 181749 - DNA, 20 bp, Artificial Sequence
  chemically synthesized
tccactgctcttcttagaaa

SEQ ID NO: 181750 - DNA, 20 bp, Artificial Sequence
  chemically synthesized
gaatataacctgtttctaag

SEQ ID NO: 181751 - DNA, 20 bp, Artificial Sequence
  chemically synthesized
atataacctgtttctaagaa

SEQ ID NO: 181752 - DNA, 20 bp, Artificial Sequence
  chemically synthesized
taacctgtttctaagaagag

SEQ ID NO: 181753 - DNA, 20 bp, Artificial Sequence
  chemically synthesized
gtaagatccactgctcttct

SEQ ID NO: 181754 - DNA, 20 bp, Artificial Sequence
  chemically synthesized
cctgtttctaagaagagcag

SEQ ID NO: 181755 - DNA, 20 bp, Artificial Sequence
  chemically synthesized
gaagagcagtggatcttact

SEQ ID NO: 181756 - DNA, 20 bp, Artificial Sequence
  chemically synthesized
acagccttttcaatctaagt

SEQ ID NO: 181757 - DNA, 20 bp, Artificial Sequence
  chemically synthesized
caccacagccttttcaatct

SEQ ID NO: 181758 - DNA, 20 bp, Artificial Sequence
  chemically synthesized
tggatcttacttagattgaa

SEQ ID NO: 181759 - DNA, 20 bp, Artificial Sequence
  chemically synthesized
ggatcttacttagattgaaa

SEQ ID NO: 181760 - DNA, 20 bp, Artificial Sequence
  chemically synthesized
tacttagattgaaaaggctg

SEQ ID NO: 181761 - DNA, 20 bp, Artificial Sequence
  chemically synthesized
ttagattgaaaaggctgtgg

SEQ ID NO: 181762 - DNA, 20 bp, Artificial Sequence
  chemically synthesized
actcactgttacaaccacca

SEQ ID NO: 181763 - DNA, 20 bp, Artificial Sequence
  chemically synthesized
aaaggctgtggtggttgtaa

SEQ ID NO: 181764 - DNA, 20 bp, Artificial Sequence
  chemically synthesized
gctgtggtggttgtaacagt

SEQ ID NO: 181765 - DNA, 20 bp, Artificial Sequence
  chemically synthesized
ttgtaacagtgagtccctct

SEQ ID NO: 181766 - DNA, 20 bp, Artificial Sequence
  chemically synthesized
aacagtgagtccctctgagt

SEQ ID NO: 181767 - DNA, 20 bp, Artificial Sequence
  chemically synthesized
ttcaatgttacttactcaga

SEQ ID NO: 181768 - DNA, 20 bp, Artificial Sequence
  chemically synthesized
tttcaatgttacttactcag

SEQ ID NO: 181769 - DNA, 20 bp, Artificial Sequence
  chemically synthesized
atttcaatgttacttactca

SEQ ID NO: 181770 - DNA, 20 bp, Artificial Sequence
  chemically synthesized
caatttcaatgttacttact

SEQ ID NO: 181771 - DNA, 20 bp, Artificial Sequence
  chemically synthesized
gagtaagtaacattgaaatt

SEQ ID NO: 181772 - DNA, 20 bp, Artificial Sequence
  chemically synthesized
tgatattgacatagttttca

SEQ ID NO: 181773 - DNA, 20 bp, Artificial Sequence
  chemically synthesized
ctgatattgacatagttttc

SEQ ID NO: 181774 - DNA, 20 bp, Artificial Sequence
  chemically synthesized
gctgatattgacatagtttt

SEQ ID NO: 181775 - DNA, 20 bp, Artificial Sequence
  chemically synthesized
tattccggctgatattgaca

SEQ ID NO: 181776 - DNA, 20 bp, Artificial Sequence
  chemically synthesized
cctgaaaactatgtcaatat

SEQ ID NO: 181777 - DNA, 20 bp, Artificial Sequence
  chemically synthesized
aaaactatgtcaatatcagc

SEQ ID NO: 181778 - DNA, 20 bp, Artificial Sequence
  chemically synthesized
tgtcaatatcagccggaata

SEQ ID NO: 181779 - DNA, 20 bp, Artificial Sequence
  chemically synthesized
gtcttgtaccatctgtattc

SEQ ID NO: 181780 - DNA, 20 bp, Artificial Sequence
  chemically synthesized
aatatcagccggaatacaga

SEQ ID NO: 181781 - DNA, 20 bp, Artificial Sequence
  chemically synthesized
agccggaatacagatggtac

SEQ ID NO: 181782 - DNA, 20 bp, Artificial Sequence
  chemically synthesized
aatacagatggtacaagaca

SEQ ID NO: 181783 - DNA, 20 bp, Artificial Sequence
  chemically synthesized
atacagatggtacaagacaa

SEQ ID NO: 181784 - DNA, 20 bp, Artificial Sequence
  chemically synthesized
atggtacaagacaaaggaat

SEQ ID NO: 181785 - DNA, 20 bp, Artificial Sequence
  chemically synthesized
caaaggaattagcttttatc

SEQ ID NO: 181786 - DNA, 20 bp, Artificial Sequence
  chemically synthesized
aaaggaattagcttttatca

SEQ ID NO: 181787 - DNA, 20 bp, Artificial Sequence
  chemically synthesized
tatttcttctaccttgataa

SEQ ID NO: 181788 - DNA, 20 bp, Artificial Sequence
  chemically synthesized
ggaattagcttttatcaagg

SEQ ID NO: 181789 - DNA, 20 bp, Artificial Sequence
  chemically synthesized
attagcttttatcaaggtag

SEQ ID NO: 181790 - DNA, 20 bp, Artificial Sequence
  chemically synthesized
atcaaggtagaagaaatact

SEQ ID NO: 181791 - DNA, 20 bp, Artificial Sequence
  chemically synthesized
aggtagaagaaatacttagc

SEQ ID NO: 181792 - DNA, 20 bp, Artificial Sequence
  chemically synthesized
agaagaaatacttagcgagt

SEQ ID NO: 181793 - DNA, 20 bp, Artificial Sequence
  chemically synthesized
ttcaattcctctgactcgct

SEQ ID NO: 181794 - DNA, 20 bp, Artificial Sequence
  chemically synthesized
aagaaatacttagcgagtca

SEQ ID NO: 181795 - DNA, 20 bp, Artificial Sequence
  chemically synthesized
agaaatacttagcgagtcag

SEQ ID NO: 181796 - DNA, 20 bp, Artificial Sequence
  chemically synthesized
cgagtcagaggaattgaaac

SEQ ID NO: 181797 - DNA, 20 bp, Artificial Sequence
  chemically synthesized
gagtcagaggaattgaaact

SEQ ID NO: 181798 - DNA, 20 bp, Artificial Sequence
  chemically synthesized
aggaattgaaactaggaatt

SEQ ID NO: 181799 - DNA, 20 bp, Artificial Sequence
  chemically synthesized
ctttagccacactgaattcc

SEQ ID NO: 181800 - DNA, 20 bp, Artificial Sequence
  chemically synthesized
ttgaaactaggaattcagtg

SEQ ID NO: 181801 - DNA, 20 bp, Artificial Sequence
  chemically synthesized
ctaggaattcagtgtggcta

SEQ ID NO: 181802 - DNA, 20 bp, Artificial Sequence
  chemically synthesized
aattcagtgtggctaaagtt

SEQ ID NO: 181803 - DNA, 20 bp, Artificial Sequence
  chemically synthesized
ttcagtgtggctaaagttta

SEQ ID NO: 181804 - DNA, 20 bp, Artificial Sequence
  chemically synthesized
ccatttttctctctaaactt

SEQ ID NO: 181805 - DNA, 20 bp, Artificial Sequence
  chemically synthesized
cagtgtggctaaagtttaga

SEQ ID NO: 181806 - DNA, 20 bp, Artificial Sequence
  chemically synthesized
ctaaagtttagagagaaaaa

SEQ ID NO: 181807 - DNA, 20 bp, Artificial Sequence
  chemically synthesized
aaagtttagagagaaaaatg

SEQ ID NO: 181808 - DNA, 20 bp, Artificial Sequence
  chemically synthesized
agtttagagagaaaaatgga

SEQ ID NO: 181809 - DNA, 20 bp, Artificial Sequence
  chemically synthesized
gagagaaaaatggagagttg

SEQ ID NO: 181810 - DNA, 20 bp, Artificial Sequence
  chemically synthesized
agagaaaaatggagagttgc

SEQ ID NO: 181811 - DNA, 20 bp, Artificial Sequence
  chemically synthesized
agaaaaatggagagttgcag

SEQ ID NO: 181812 - DNA, 20 bp, Artificial Sequence
  chemically synthesized
aatggagagttgcaggagct

SEQ ID NO: 181813 - DNA, 20 bp, Artificial Sequence
  chemically synthesized
agagttgcaggagctaagtc

SEQ ID NO: 181814 - DNA, 20 bp, Artificial Sequence
  chemically synthesized
agttgcaggagctaagtcca

SEQ ID NO: 181815 - DNA, 20 bp, Artificial Sequence
  chemically synthesized
cctgtccatttctctggact

SEQ ID NO: 181816 - DNA, 20 bp, Artificial Sequence
  chemically synthesized
aggagctaagtccagagaaa

SEQ ID NO: 181817 - DNA, 20 bp, Artificial Sequence
  chemically synthesized
atattacctgtccatttctc

SEQ ID NO: 181818 - DNA, 20 bp, Artificial Sequence
  chemically synthesized
gctaagtccagagaaatgga

SEQ ID NO: 181819 - DNA, 20 bp, Artificial Sequence
  chemically synthesized
ctaagtccagagaaatggac

SEQ ID NO: 181820 - DNA, 20 bp, Artificial Sequence
  chemically synthesized
aatgcccagaggtaatgtag

SEQ ID NO: 181821 - DNA, 20 bp, Artificial Sequence
  chemically synthesized
tttaatgcccagaggtaatg

SEQ ID NO: 181822 - DNA, 20 bp, Artificial Sequence
  chemically synthesized
aatatcttctacattacctc

SEQ ID NO: 181823 - DNA, 20 bp, Artificial Sequence
  chemically synthesized
atatcttctacattacctct

SEQ ID NO: 181824 - DNA, 20 bp, Artificial Sequence
  chemically synthesized
aatcaaattttaatgcccag

SEQ ID NO: 181825 - DNA, 20 bp, Artificial Sequence
  chemically synthesized
gaatcaaattttaatgccca

SEQ ID NO: 181826 - DNA, 20 bp, Artificial Sequence
  chemically synthesized
cagaatcaaattttaatgcc

SEQ ID NO: 181827 - DNA, 20 bp, Artificial Sequence
  chemically synthesized
atacactaataaagttcatg

SEQ ID NO: 181828 - DNA, 20 bp, Artificial Sequence
  chemically synthesized
tgattctgcatgaactttat

SEQ ID NO: 181829 - DNA, 20 bp, Artificial Sequence
  chemically synthesized
aaataaataatacactaata

SEQ ID NO: 181830 - DNA, 20 bp, Artificial Sequence
  chemically synthesized
aatgaatttagtaattgaca

SEQ ID NO: 181831 - DNA, 20 bp, Artificial Sequence
  chemically synthesized
taccaaatttttaatgaatt

SEQ ID NO: 181832 - DNA, 20 bp, Artificial Sequence
  chemically synthesized
tactaaattcattaaaaatt

SEQ ID NO: 181833 - DNA, 20 bp, Artificial Sequence
  chemically synthesized
attcattaaaaatttggtac

SEQ ID NO: 181834 - DNA, 20 bp, Artificial Sequence
  chemically synthesized
ttcattaaaaatttggtaca

SEQ ID NO: 181835 - DNA, 20 bp, Artificial Sequence
  chemically synthesized
taaaaatttggtacaaggta

SEQ ID NO: 181836 - DNA, 20 bp, Artificial Sequence
  chemically synthesized
gtacaaggtacagatgaact

SEQ ID NO: 181837 - DNA, 20 bp, Artificial Sequence
  chemically synthesized
tacaaggtacagatgaactt

SEQ ID NO: 181838 - DNA, 20 bp, Artificial Sequence
  chemically synthesized
acaaggtacagatgaactta

SEQ ID NO: 181839 - DNA, 20 bp, Artificial Sequence
  chemically synthesized
aaggtacagatgaacttagg

SEQ ID NO: 181840 - DNA, 20 bp, Artificial Sequence
  chemically synthesized
atctgttaggtagactccct

SEQ ID NO: 181841 - DNA, 20 bp, Artificial Sequence
  chemically synthesized
aacttagggagtctacctaa

SEQ ID NO: 181842 - DNA, 20 bp, Artificial Sequence
  chemically synthesized
atcttgagtaatctgttagg

SEQ ID NO: 181843 - DNA, 20 bp, Artificial Sequence
  chemically synthesized
ccaatcttgagtaatctgtt

SEQ ID NO: 181844 - DNA, 20 bp, Artificial Sequence
  chemically synthesized
accaatcttgagtaatctgt

SEQ ID NO: 181845 - DNA, 20 bp, Artificial Sequence
  chemically synthesized
gtctacctaacagattactc

SEQ ID NO: 181846 - DNA, 20 bp, Artificial Sequence
  chemically synthesized
cctaacagattactcaagat

SEQ ID NO: 181847 - DNA, 20 bp, Artificial Sequence
  chemically synthesized
caaggatcaaaaccaatctt

SEQ ID NO: 181848 - DNA, 20 bp, Artificial Sequence
  chemically synthesized
aagattggttttgatccttg

SEQ ID NO: 181849 - DNA, 20 bp, Artificial Sequence
  chemically synthesized
attggttttgatccttgaag

SEQ ID NO: 181850 - DNA, 20 bp, Artificial Sequence
  chemically synthesized
aagtgaagtggtctacttca

SEQ ID NO: 181851 - DNA, 20 bp, Artificial Sequence
  chemically synthesized
taagtgaagtggtctacttc

SEQ ID NO: 181852 - DNA, 20 bp, Artificial Sequence
  chemically synthesized
ttgaagtagaccacttcact

SEQ ID NO: 181853 - DNA, 20 bp, Artificial Sequence
  chemically synthesized
ggatgcttagctaagtgaag

SEQ ID NO: 181854 - DNA, 20 bp, Artificial Sequence
  chemically synthesized
aacggatgcttagctaagtg

SEQ ID NO: 181855 - DNA, 20 bp, Artificial Sequence
  chemically synthesized
gtagaccacttcacttagct

SEQ ID NO: 181856 - DNA, 20 bp, Artificial Sequence
  chemically synthesized
tttaaaacggatgcttagct

SEQ ID NO: 181857 - DNA, 20 bp, Artificial Sequence
  chemically synthesized
agtattttaaaacggatgct

SEQ ID NO: 181858 - DNA, 20 bp, Artificial Sequence
  chemically synthesized
tggattctagtattttaaaa

SEQ ID NO: 181859 - DNA, 20 bp, Artificial Sequence
  chemically synthesized
aagcatccgttttaaaatac

SEQ ID NO: 181860 - DNA, 20 bp, Artificial Sequence
  chemically synthesized
ttttaaaatactagaatcca

SEQ ID NO: 181861 - DNA, 20 bp, Artificial Sequence
  chemically synthesized
tgaagataccctttggattc

SEQ ID NO: 181862 - DNA, 20 bp, Artificial Sequence
  chemically synthesized
tttaaaatactagaatccaa

SEQ ID NO: 181863 - DNA, 20 bp, Artificial Sequence
  chemically synthesized
ttaaaatactagaatccaaa

SEQ ID NO: 181864 - DNA, 20 bp, Artificial Sequence
  chemically synthesized
aaatccttgaagataccctt

SEQ ID NO: 181865 - DNA, 20 bp, Artificial Sequence
  chemically synthesized
agaatccaaagggtatcttc

SEQ ID NO: 181866 - DNA, 20 bp, Artificial Sequence
  chemically synthesized
gaatccaaagggtatcttca

SEQ ID NO: 181867 - DNA, 20 bp, Artificial Sequence
  chemically synthesized
gtttaaaaaagaaatccttg

SEQ ID NO: 181868 - DNA, 20 bp, Artificial Sequence
  chemically synthesized
tcaaggatttcttttttaaa

SEQ ID NO: 181869 - DNA, 20 bp, Artificial Sequence
  chemically synthesized
atggctaggtctgtttaaaa

SEQ ID NO: 181870 - DNA, 20 bp, Artificial Sequence
  chemically synthesized
atttcttttttaaacagacc

SEQ ID NO: 181871 - DNA, 20 bp, Artificial Sequence
  chemically synthesized
tgactctattgtacatggct

SEQ ID NO: 181872 - DNA, 20 bp, Artificial Sequence
  chemically synthesized
ttgactctattgtacatggc

SEQ ID NO: 181873 - DNA, 20 bp, Artificial Sequence
  chemically synthesized
acagacctagccatgtacaa

SEQ ID NO: 181874 - DNA, 20 bp, Artificial Sequence
  chemically synthesized
tgccttgactctattgtaca

SEQ ID NO: 181875 - DNA, 20 bp, Artificial Sequence
  chemically synthesized
agacctagccatgtacaata

SEQ ID NO: 181876 - DNA, 20 bp, Artificial Sequence
  chemically synthesized
tagccatgtacaatagagtc

SEQ ID NO: 181877 - DNA, 20 bp, Artificial Sequence
  chemically synthesized
agccatgtacaatagagtca

SEQ ID NO: 181878 - DNA, 20 bp, Artificial Sequence
  chemically synthesized
catgtacaatagagtcaagg

SEQ ID NO: 181879 - DNA, 20 bp, Artificial Sequence
  chemically synthesized
gaaccagaaaacacatattt

SEQ ID NO: 181880 - DNA, 20 bp, Artificial Sequence
  chemically synthesized
aaactaaaatatgtgttttc

SEQ ID NO: 181881 - DNA, 20 bp, Artificial Sequence
  chemically synthesized
aatatgtgttttctggttct

SEQ ID NO: 181882 - DNA, 20 bp, Artificial Sequence
  chemically synthesized
tgtcctattgatctgagaac

SEQ ID NO: 181883 - DNA, 20 bp, Artificial Sequence
  chemically synthesized
ttttctggttctcagatcaa

SEQ ID NO: 181884 - DNA, 20 bp, Artificial Sequence
  chemically synthesized
gctgtatgtcctattgatct

SEQ ID NO: 181885 - DNA, 20 bp, Artificial Sequence
  chemically synthesized
tttctggttctcagatcaat

SEQ ID NO: 181886 - DNA, 20 bp, Artificial Sequence
  chemically synthesized
tctcagatcaataggacata

SEQ ID NO: 181887 - DNA, 20 bp, Artificial Sequence
  chemically synthesized
cagatcaataggacatacag

SEQ ID NO: 181888 - DNA, 20 bp, Artificial Sequence
  chemically synthesized
ggacatacagcagactgaca

SEQ ID NO: 181889 - DNA, 20 bp, Artificial Sequence
  chemically synthesized
ttttctcctaagtgctatgt

SEQ ID NO: 181890 - DNA, 20 bp, Artificial Sequence
  chemically synthesized
cagcagactgacatagcact

SEQ ID NO: 181891 - DNA, 20 bp, Artificial Sequence
  chemically synthesized
agcagactgacatagcactt

SEQ ID NO: 181892 - DNA, 20 bp, Artificial Sequence
  chemically synthesized
cagactgacatagcacttag

SEQ ID NO: 181893 - DNA, 20 bp, Artificial Sequence
  chemically synthesized
atacagagaaattttctcct

SEQ ID NO: 181894 - DNA, 20 bp, Artificial Sequence
  chemically synthesized
tcagttttcgtaaacataca

SEQ ID NO: 181895 - DNA, 20 bp, Artificial Sequence
  chemically synthesized
cttcagttttcgtaaacata

SEQ ID NO: 181896 - DNA, 20 bp, Artificial Sequence
  chemically synthesized
ctgtatgtttacgaaaactg

SEQ ID NO: 181897 - DNA, 20 bp, Artificial Sequence
  chemically synthesized
tgtatgtttacgaaaactga

SEQ ID NO: 181898 - DNA, 20 bp, Artificial Sequence
  chemically synthesized
gtatgtttacgaaaactgaa

SEQ ID NO: 181899 - DNA, 20 bp, Artificial Sequence
  chemically synthesized
atgtttacgaaaactgaagg

SEQ ID NO: 181900 - DNA, 20 bp, Artificial Sequence
  chemically synthesized
aaaaaaaaaaaaactccctt

SEQ ID NO: 181901 - DNA, 20 bp, Artificial Sequence
  chemically synthesized
gtttttttttttttctccac

SEQ ID NO: 181902 - DNA, 20 bp, Artificial Sequence
  chemically synthesized
tttttttttttttctccact

SEQ ID NO: 181903 - DNA, 20 bp, Artificial Sequence
  chemically synthesized
tttttttttttctccactgg

SEQ ID NO: 181904 - DNA, 20 bp, Artificial Sequence
  chemically synthesized
atgatggtcagctcccagtg

SEQ ID NO: 181905 - DNA, 20 bp, Artificial Sequence
  chemically synthesized
taatgatggtcagctcccag

SEQ ID NO: 181906 - DNA, 20 bp, Artificial Sequence
  chemically synthesized
aggtaatgatggtcagctcc

SEQ ID NO: 181907 - DNA, 20 bp, Artificial Sequence
  chemically synthesized
agctggaaggtaatgatggt

SEQ ID NO: 181908 - DNA, 20 bp, Artificial Sequence
  chemically synthesized
attcagctggaaggtaatga

SEQ ID NO: 181909 - DNA, 20 bp, Artificial Sequence
  chemically synthesized
agctgaccatcattaccttc

SEQ ID NO: 181910 - DNA, 20 bp, Artificial Sequence
  chemically synthesized
ctctcatagattcagctgga

SEQ ID NO: 181911 - DNA, 20 bp, Artificial Sequence
  chemically synthesized
tctctcatagattcagctgg

SEQ ID NO: 181912 - DNA, 20 bp, Artificial Sequence
  chemically synthesized
aattctctcatagattcagc

SEQ ID NO: 181913 - DNA, 20 bp, Artificial Sequence
  chemically synthesized
taccttccagctgaatctat

SEQ ID NO: 181914 - DNA, 20 bp, Artificial Sequence
  chemically synthesized
acagaattctctcatagatt

SEQ ID NO: 181915 - DNA, 20 bp, Artificial Sequence
  chemically synthesized
ccttccagctgaatctatga

SEQ ID NO: 181916 - DNA, 20 bp, Artificial Sequence
  chemically synthesized
atgggaacagaattctctca

SEQ ID NO: 181917 - DNA, 20 bp, Artificial Sequence
  chemically synthesized
ttaattcaggagaatgggaa

SEQ ID NO: 181918 - DNA, 20 bp, Artificial Sequence
  chemically synthesized
aactattaattcaggagaat

SEQ ID NO: 181919 - DNA, 20 bp, Artificial Sequence
  chemically synthesized
caactattaattcaggagaa

SEQ ID NO: 181920 - DNA, 20 bp, Artificial Sequence
  chemically synthesized
cttagcaactattaattcag

SEQ ID NO: 181921 - DNA, 20 bp, Artificial Sequence
  chemically synthesized
ttcccattctcctgaattaa

SEQ ID NO: 181922 - DNA, 20 bp, Artificial Sequence
  chemically synthesized
ttcttagcaactattaattc

SEQ ID NO: 181923 - DNA, 20 bp, Artificial Sequence
  chemically synthesized
tttcttagcaactattaatt

SEQ ID NO: 181924 - DNA, 20 bp, Artificial Sequence
  chemically synthesized
ctcctgaattaatagttgct

SEQ ID NO: 181925 - DNA, 20 bp, Artificial Sequence
  chemically synthesized
taaattatgtggcattttct

SEQ ID NO: 181926 - DNA, 20 bp, Artificial Sequence
  chemically synthesized
catatagcaaataaattatg

SEQ ID NO: 181927 - DNA, 20 bp, Artificial Sequence
  chemically synthesized
gctttgccttttaagtcata

SEQ ID NO: 181928 - DNA, 20 bp, Artificial Sequence
  chemically synthesized
ttatttgctatatgacttaa

SEQ ID NO: 181929 - DNA, 20 bp, Artificial Sequence
  chemically synthesized
tatttgctatatgacttaaa

SEQ ID NO: 181930 - DNA, 20 bp, Artificial Sequence
  chemically synthesized
ttcattatgctttgcctttt

SEQ ID NO: 181931 - DNA, 20 bp, Artificial Sequence
  chemically synthesized
gctatatgacttaaaaggca

SEQ ID NO: 181932 - DNA, 20 bp, Artificial Sequence
  chemically synthesized
aggcaaagcataatgaaaat

SEQ ID NO: 181933 - DNA, 20 bp, Artificial Sequence
  chemically synthesized
gcaaagcataatgaaaatga

SEQ ID NO: 181934 - DNA, 20 bp, Artificial Sequence
  chemically synthesized
tgaaaatgagagtaaaataa

SEQ ID NO: 181935 - DNA, 20 bp, Artificial Sequence
  chemically synthesized
gaaaatgagagtaaaataaa

SEQ ID NO: 181936 - DNA, 20 bp, Artificial Sequence
  chemically synthesized
taaaataaaaggccattaac

SEQ ID NO: 181937 - DNA, 20 bp, Artificial Sequence
  chemically synthesized
atgcaatattttctcgttaa

SEQ ID NO: 181938 - DNA, 20 bp, Artificial Sequence
  chemically synthesized
ataaatttgtgtcatatata

SEQ ID NO: 181939 - DNA, 20 bp, Artificial Sequence
  chemically synthesized
aatttgcatcataccaatat

SEQ ID NO: 181940 - DNA, 20 bp, Artificial Sequence
  chemically synthesized
atttgcatcataccaatatc

SEQ ID NO: 181941 - DNA, 20 bp, Artificial Sequence
  chemically synthesized
tttgcatcataccaatatca

SEQ ID NO: 181942 - DNA, 20 bp, Artificial Sequence
  chemically synthesized
cttacttttctccctgatat

SEQ ID NO: 181943 - DNA, 20 bp, Artificial Sequence
  chemically synthesized
tgcatcataccaatatcagg

SEQ ID NO: 181944 - DNA, 20 bp, Artificial Sequence
  chemically synthesized
cataccaatatcagggagaa

SEQ ID NO: 181945 - DNA, 20 bp, Artificial Sequence
  chemically synthesized
ccaatatcagggagaaaagt

SEQ ID NO: 181946 - DNA, 20 bp, Artificial Sequence
  chemically synthesized
aaaagtaagattaccttgtc

SEQ ID NO: 181947 - DNA, 20 bp, Artificial Sequence
  chemically synthesized
cttgtgcttgatgcttgaca

SEQ ID NO: 181948 - DNA, 20 bp, Artificial Sequence
  chemically synthesized
acttgtgcttgatgcttgac

SEQ ID NO: 181949 - DNA, 20 bp, Artificial Sequence
  chemically synthesized
agattaccttgtcaagcatc

SEQ ID NO: 181950 - DNA, 20 bp, Artificial Sequence
  chemically synthesized
ccttgtcaagcatcaagcac

SEQ ID NO: 181951 - DNA, 20 bp, Artificial Sequence
  chemically synthesized
tgtcaagcatcaagcacaag

SEQ ID NO: 181952 - DNA, 20 bp, Artificial Sequence
  chemically synthesized
tatccactgtatttaaggtt

SEQ ID NO: 181953 - DNA, 20 bp, Artificial Sequence
  chemically synthesized
aagtagctaaaccttaaata

SEQ ID NO: 181954 - DNA, 20 bp, Artificial Sequence
  chemically synthesized
ctcattatccactgtattta

SEQ ID NO: 181955 - DNA, 20 bp, Artificial Sequence
  chemically synthesized
cctcattatccactgtattt

SEQ ID NO: 181956 - DNA, 20 bp, Artificial Sequence
  chemically synthesized
tagctaaaccttaaatacag

SEQ ID NO: 181957 - DNA, 20 bp, Artificial Sequence
  chemically synthesized
ccttaaatacagtggataat

SEQ ID NO: 181958 - DNA, 20 bp, Artificial Sequence
  chemically synthesized
cttaaatacagtggataatg

SEQ ID NO: 181959 - DNA, 20 bp, Artificial Sequence
  chemically synthesized
agtggataatgaggaacact

SEQ ID NO: 181960 - DNA, 20 bp, Artificial Sequence
  chemically synthesized
tttaaaaaatattggtatct

SEQ ID NO: 181961 - DNA, 20 bp, Artificial Sequence
  chemically synthesized
atagaagctttaaaaaatat

SEQ ID NO: 181962 - DNA, 20 bp, Artificial Sequence
  chemically synthesized
tgagataccaatatttttta

SEQ ID NO: 181963 - DNA, 20 bp, Artificial Sequence
  chemically synthesized
gtctcaaaataaataaatag

SEQ ID NO: 181964 - DNA, 20 bp, Artificial Sequence
  chemically synthesized
cctgtctcaaaataaataaa

SEQ ID NO: 181965 - DNA, 20 bp, Artificial Sequence
  chemically synthesized
agcttctatttatttatttt

SEQ ID NO: 181966 - DNA, 20 bp, Artificial Sequence
  chemically synthesized
tctatttatttattttgaga

SEQ ID NO: 181967 - DNA, 20 bp, Artificial Sequence
  chemically synthesized
ctatttatttattttgagac

SEQ ID NO: 181968 - DNA, 20 bp, Artificial Sequence
  chemically synthesized
tatttatttattttgagaca

SEQ ID NO: 181969 - DNA, 20 bp, Artificial Sequence
  chemically synthesized
tattttgagacagggtctcc

SEQ ID NO: 181970 - DNA, 20 bp, Artificial Sequence
  chemically synthesized
attttgagacagggtctcct

SEQ ID NO: 181971 - DNA, 20 bp, Artificial Sequence
  chemically synthesized
ttttgagacagggtctcctg

SEQ ID NO: 181972 - DNA, 20 bp, Artificial Sequence
  chemically synthesized
atcatgctaccacaccccag

SEQ ID NO: 181973 - DNA, 20 bp, Artificial Sequence
  chemically synthesized
agacagggtctcctggggtg

SEQ ID NO: 181974 - DNA, 20 bp, Artificial Sequence
  chemically synthesized
taatcatgctaccacacccc

SEQ ID NO: 181975 - DNA, 20 bp, Artificial Sequence
  chemically synthesized
ataatcatgctaccacaccc

SEQ ID NO: 181976 - DNA, 20 bp, Artificial Sequence
  chemically synthesized
cagggtctcctggggtgtgg

SEQ ID NO: 181977 - DNA, 20 bp, Artificial Sequence
  chemically synthesized
ggggtgtggtagcatgatta

SEQ ID NO: 181978 - DNA, 20 bp, Artificial Sequence
  chemically synthesized
caggagttggaggttacagt

SEQ ID NO: 181979 - DNA, 20 bp, Artificial Sequence
  chemically synthesized
agcccaggagttggaggtta

SEQ ID NO: 181980 - DNA, 20 bp, Artificial Sequence
  chemically synthesized
ttcttgagcccaggagttgg

SEQ ID NO: 181981 - DNA, 20 bp, Artificial Sequence
  chemically synthesized
tcactgtaacctccaactcc

SEQ ID NO: 181982 - DNA, 20 bp, Artificial Sequence
  chemically synthesized
tttcttgagcccaggagttg

SEQ ID NO: 181983 - DNA, 20 bp, Artificial Sequence
  chemically synthesized
cactgtaacctccaactcct

SEQ ID NO: 181984 - DNA, 20 bp, Artificial Sequence
  chemically synthesized
aatttcttgagcccaggagt

SEQ ID NO: 181985 - DNA, 20 bp, Artificial Sequence
  chemically synthesized
ggagaatttcttgagcccag

SEQ ID NO: 181986 - DNA, 20 bp, Artificial Sequence
  chemically synthesized
aacctccaactcctgggctc

SEQ ID NO: 181987 - DNA, 20 bp, Artificial Sequence
  chemically synthesized
tgggagaatttcttgagccc

SEQ ID NO: 181988 - DNA, 20 bp, Artificial Sequence
  chemically synthesized
ttgggagaatttcttgagcc

SEQ ID NO: 181989 - DNA, 20 bp, Artificial Sequence
  chemically synthesized
ctgagttgggagaatttctt

SEQ ID NO: 181990 - DNA, 20 bp, Artificial Sequence
  chemically synthesized
ctcaagaaattctcccaact

SEQ ID NO: 181991 - DNA, 20 bp, Artificial Sequence
  chemically synthesized
tgctcgggaggctgagttgg

SEQ ID NO: 181992 - DNA, 20 bp, Artificial Sequence
  chemically synthesized
gatgctcgggaggctgagtt

SEQ ID NO: 181993 - DNA, 20 bp, Artificial Sequence
  chemically synthesized
agatgctcgggaggctgagt

SEQ ID NO: 181994 - DNA, 20 bp, Artificial Sequence
  chemically synthesized
tcctagatgctcgggaggct

SEQ ID NO: 181995 - DNA, 20 bp, Artificial Sequence
  chemically synthesized
ttctcccaactcagcctccc

SEQ ID NO: 181996 - DNA, 20 bp, Artificial Sequence
  chemically synthesized
tgtagtcctagatgctcggg

SEQ ID NO: 181997 - DNA, 20 bp, Artificial Sequence
  chemically synthesized
ctgtagtcctagatgctcgg

SEQ ID NO: 181998 - DNA, 20 bp, Artificial Sequence
  chemically synthesized
aactcagcctcccgagcatc

SEQ ID NO: 181999 - DNA, 20 bp, Artificial Sequence
  chemically synthesized
gcctgtagtcctagatgctc

SEQ ID NO: 182000 - DNA, 20 bp, Artificial Sequence
  chemically synthesized
actcagcctcccgagcatct

SEQ ID NO: 182001 - DNA, 20 bp, Artificial Sequence
  chemically synthesized
agcctgtagtcctagatgct

SEQ ID NO: 182002 - DNA, 20 bp, Artificial Sequence
  chemically synthesized
ctcccgagcatctaggacta

SEQ ID NO: 182003 - DNA, 20 bp, Artificial Sequence
  chemically synthesized
tcccgagcatctaggactac

SEQ ID NO: 182004 - DNA, 20 bp, Artificial Sequence
  chemically synthesized
gtgatgcaagcctgtagtcc

SEQ ID NO: 182005 - DNA, 20 bp, Artificial Sequence
  chemically synthesized
actgtggtgatgcaagcctg

SEQ ID NO: 182006 - DNA, 20 bp, Artificial Sequence
  chemically synthesized
gtagccgactgtggtgatgc

SEQ ID NO: 182007 - DNA, 20 bp, Artificial Sequence
  chemically synthesized
actacaggcttgcatcacca

SEQ ID NO: 182008 - DNA, 20 bp, Artificial Sequence
  chemically synthesized
caggcttgcatcaccacagt

SEQ ID NO: 182009 - DNA, 20 bp, Artificial Sequence
  chemically synthesized
attaaaaatgtagccgactg

SEQ ID NO: 182010 - DNA, 20 bp, Artificial Sequence
  chemically synthesized
tctacataaaattaaaaatg

SEQ ID NO: 182011 - DNA, 20 bp, Artificial Sequence
  chemically synthesized
gctacatttttaattttatg

SEQ ID NO: 182012 - DNA, 20 bp, Artificial Sequence
  chemically synthesized
tacatttttaattttatgta

SEQ ID NO: 182013 - DNA, 20 bp, Artificial Sequence
  chemically synthesized
tttttaattttatgtagaga

SEQ ID NO: 182014 - DNA, 20 bp, Artificial Sequence
  chemically synthesized
tggaatgttgctatgtgccc

SEQ ID NO: 182015 - DNA, 20 bp, Artificial Sequence
  chemically synthesized
tcaagaccagcttgggcaca

SEQ ID NO: 182016 - DNA, 20 bp, Artificial Sequence
  chemically synthesized
atgttgctatgtgcccaagc

SEQ ID NO: 182017 - DNA, 20 bp, Artificial Sequence
  chemically synthesized
caggagttcaagaccagctt

SEQ ID NO: 182018 - DNA, 20 bp, Artificial Sequence
  chemically synthesized
ccaggagttcaagaccagct

SEQ ID NO: 182019 - DNA, 20 bp, Artificial Sequence
  chemically synthesized
tgaggccaggagttcaagac

SEQ ID NO: 182020 - DNA, 20 bp, Artificial Sequence
  chemically synthesized
ccaagctggtcttgaactcc

SEQ ID NO: 182021 - DNA, 20 bp, Artificial Sequence
  chemically synthesized
ttgcttgaggccaggagttc

SEQ ID NO: 182022 - DNA, 20 bp, Artificial Sequence
  chemically synthesized
agaggattgcttgaggccag

SEQ ID NO: 182023 - DNA, 20 bp, Artificial Sequence
  chemically synthesized
ggtcttgaactcctggcctc

SEQ ID NO: 182024 - DNA, 20 bp, Artificial Sequence
  chemically synthesized
caagaggattgcttgaggcc

SEQ ID NO: 182025 - DNA, 20 bp, Artificial Sequence
  chemically synthesized
gcaagaggattgcttgaggc

SEQ ID NO: 182026 - DNA, 20 bp, Artificial Sequence
  chemically synthesized
caaggcaagaggattgcttg

SEQ ID NO: 182027 - DNA, 20 bp, Artificial Sequence
  chemically synthesized
ccaaggcaagaggattgctt

SEQ ID NO: 182028 - DNA, 20 bp, Artificial Sequence
  chemically synthesized
ctcaagcaatcctcttgcct

SEQ ID NO: 182029 - DNA, 20 bp, Artificial Sequence
  chemically synthesized
ctttgggaggccaaggcaag

SEQ ID NO: 182030 - DNA, 20 bp, Artificial Sequence
  chemically synthesized
gctttgggaggccaaggcaa

SEQ ID NO: 182031 - DNA, 20 bp, Artificial Sequence
  chemically synthesized
gtgctttgggaggccaaggc

SEQ ID NO: 182032 - DNA, 20 bp, Artificial Sequence
  chemically synthesized
ctcagtgctttgggaggcca

SEQ ID NO: 182033 - DNA, 20 bp, Artificial Sequence
  chemically synthesized
tctcagtgctttgggaggcc

SEQ ID NO: 182034 - DNA, 20 bp, Artificial Sequence
  chemically synthesized
cctcttgccttggcctccca

SEQ ID NO: 182035 - DNA, 20 bp, Artificial Sequence
  chemically synthesized
tgtcatctcagtgctttggg

SEQ ID NO: 182036 - DNA, 20 bp, Artificial Sequence
  chemically synthesized
ctgtcatctcagtgctttgg

SEQ ID NO: 182037 - DNA, 20 bp, Artificial Sequence
  chemically synthesized
gcctgtcatctcagtgcttt

SEQ ID NO: 182038 - DNA, 20 bp, Artificial Sequence
  chemically synthesized
ccttggcctcccaaagcact

SEQ ID NO: 182039 - DNA, 20 bp, Artificial Sequence
  chemically synthesized
tgcctgtcatctcagtgctt

SEQ ID NO: 182040 - DNA, 20 bp, Artificial Sequence
  chemically synthesized
ctcccaaagcactgagatga

SEQ ID NO: 182041 - DNA, 20 bp, Artificial Sequence
  chemically synthesized
tcccaaagcactgagatgac

SEQ ID NO: 182042 - DNA, 20 bp, Artificial Sequence
  chemically synthesized
atggctcatgcctgtcatct

SEQ ID NO: 182043 - DNA, 20 bp, Artificial Sequence
  chemically synthesized
agcactgagatgacaggcat

SEQ ID NO: 182044 - DNA, 20 bp, Artificial Sequence
  chemically synthesized
acaggcatgagccatgtgcc

SEQ ID NO: 182045 - DNA, 20 bp, Artificial Sequence
  chemically synthesized
ttaaaagttgactgggcaca

SEQ ID NO: 182046 - DNA, 20 bp, Artificial Sequence
  chemically synthesized
atgaaaattaaaagttgact

SEQ ID NO: 182047 - DNA, 20 bp, Artificial Sequence
  chemically synthesized
aatgaaaattaaaagttgac

SEQ ID NO: 182048 - DNA, 20 bp, Artificial Sequence
  chemically synthesized
agctgttaaatgaaaattaa

SEQ ID NO: 182049 - DNA, 20 bp, Artificial Sequence
  chemically synthesized
aacttttaattttcatttaa

SEQ ID NO: 182050 - DNA, 20 bp, Artificial Sequence
  chemically synthesized
tttcatttaacagctttatt

SEQ ID NO: 182051 - DNA, 20 bp, Artificial Sequence
  chemically synthesized
tacaccttaaatacttaata

SEQ ID NO: 182052 - DNA, 20 bp, Artificial Sequence
  chemically synthesized
aacagctttattaagtattt

SEQ ID NO: 182053 - DNA, 20 bp, Artificial Sequence
  chemically synthesized
acagctttattaagtattta

SEQ ID NO: 182054 - DNA, 20 bp, Artificial Sequence
  chemically synthesized
agtatttaaggtgtacacga

SEQ ID NO: 182055 - DNA, 20 bp, Artificial Sequence
  chemically synthesized
gtatttaaggtgtacacgat

SEQ ID NO: 182056 - DNA, 20 bp, Artificial Sequence
  chemically synthesized
gaagatctgtttgttaatta

SEQ ID NO: 182057 - DNA, 20 bp, Artificial Sequence
  chemically synthesized
atgggtccataattaacaaa

SEQ ID NO: 182058 - DNA, 20 bp, Artificial Sequence
  chemically synthesized
accatcgtagtcagtcgggg

SEQ ID NO: 182059 - DNA, 20 bp, Artificial Sequence
  chemically synthesized
caaaccatcgtagtcagtcg

SEQ ID NO: 182060 - DNA, 20 bp, Artificial Sequence
  chemically synthesized
tcaaaccatcgtagtcagtc

SEQ ID NO: 182061 - DNA, 20 bp, Artificial Sequence
  chemically synthesized
gtcaaaccatcgtagtcagt

SEQ ID NO: 182062 - DNA, 20 bp, Artificial Sequence
  chemically synthesized
tcttccccgactgactacga

SEQ ID NO: 182063 - DNA, 20 bp, Artificial Sequence
  chemically synthesized
gtaagtcaaaccatcgtagt

SEQ ID NO: 182064 - DNA, 20 bp, Artificial Sequence
  chemically synthesized
aattgtaagtcaaaccatcg

SEQ ID NO: 182065 - DNA, 20 bp, Artificial Sequence
  chemically synthesized
atggtgaacttcaaaattgt

SEQ ID NO: 182066 - DNA, 20 bp, Artificial Sequence
  chemically synthesized
tggtttgacttacaattttg

SEQ ID NO: 182067 - DNA, 20 bp, Artificial Sequence
  chemically synthesized
tacaattttgaagttcacca

SEQ ID NO: 182068 - DNA, 20 bp, Artificial Sequence
  chemically synthesized
tgtgtatcgcttttgcacca

SEQ ID NO: 182069 - DNA, 20 bp, Artificial Sequence
  chemically synthesized
tgaagttcaccatggtgcaa

SEQ ID NO: 182070 - DNA, 20 bp, Artificial Sequence
  chemically synthesized
gtgcaaaagcgatacacatt

SEQ ID NO: 182071 - DNA, 20 bp, Artificial Sequence
  chemically synthesized
atacacatttagtataatcc

SEQ ID NO: 182072 - DNA, 20 bp, Artificial Sequence
  chemically synthesized
atttagtataatcctggact

SEQ ID NO: 182073 - DNA, 20 bp, Artificial Sequence
  chemically synthesized
tttagtataatcctggactg

SEQ ID NO: 182074 - DNA, 20 bp, Artificial Sequence
  chemically synthesized
tataaccccatcctcagtcc

SEQ ID NO: 182075 - DNA, 20 bp, Artificial Sequence
  chemically synthesized
atataaccccatcctcagtc

SEQ ID NO: 182076 - DNA, 20 bp, Artificial Sequence
  chemically synthesized
gtataatcctggactgagga

SEQ ID NO: 182077 - DNA, 20 bp, Artificial Sequence
  chemically synthesized
tataatcctggactgaggat

SEQ ID NO: 182078 - DNA, 20 bp, Artificial Sequence
  chemically synthesized
ataatcctggactgaggatg

SEQ ID NO: 182079 - DNA, 20 bp, Artificial Sequence
  chemically synthesized
tccagatataaccccatcct

SEQ ID NO: 182080 - DNA, 20 bp, Artificial Sequence
  chemically synthesized
actgaggatggggttatatc

SEQ ID NO: 182081 - DNA, 20 bp, Artificial Sequence
  chemically synthesized
caacttacagtgagtatatc

SEQ ID NO: 182082 - DNA, 20 bp, Artificial Sequence
  chemically synthesized
tatctggatatactcactgt

SEQ ID NO: 182083 - DNA, 20 bp, Artificial Sequence
  chemically synthesized
tgatattttcaacttacagt

SEQ ID NO: 182084 - DNA, 20 bp, Artificial Sequence
  chemically synthesized
ttaatgatattttcaactta

SEQ ID NO: 182085 - DNA, 20 bp, Artificial Sequence
  chemically synthesized
ttgaaaatgttatgagtcaa

SEQ ID NO: 182086 - DNA, 20 bp, Artificial Sequence
  chemically synthesized
tcataaattgaaaatgttat

SEQ ID NO: 182087 - DNA, 20 bp, Artificial Sequence
  chemically synthesized
ataacattttcaatttatga

SEQ ID NO: 182088 - DNA, 20 bp, Artificial Sequence
  chemically synthesized
taacattttcaatttatgat

SEQ ID NO: 182089 - DNA, 20 bp, Artificial Sequence
  chemically synthesized
tcaatttatgatgggtttat

SEQ ID NO: 182090 - DNA, 20 bp, Artificial Sequence
  chemically synthesized
caatttatgatgggtttatc

SEQ ID NO: 182091 - DNA, 20 bp, Artificial Sequence
  chemically synthesized
tcaggacacaatcccatcct

SEQ ID NO: 182092 - DNA, 20 bp, Artificial Sequence
  chemically synthesized
caggacacaatcccatccta

SEQ ID NO: 182093 - DNA, 20 bp, Artificial Sequence
  chemically synthesized
gatgctcctcaccttaggat

SEQ ID NO: 182094 - DNA, 20 bp, Artificial Sequence
  chemically synthesized
agatgctcctcaccttagga

SEQ ID NO: 182095 - DNA, 20 bp, Artificial Sequence
  chemically synthesized
acacaatcccatcctaaggt

SEQ ID NO: 182096 - DNA, 20 bp, Artificial Sequence
  chemically synthesized
cacaatcccatcctaaggtg

SEQ ID NO: 182097 - DNA, 20 bp, Artificial Sequence
  chemically synthesized
atacagatgctcctcacctt

SEQ ID NO: 182098 - DNA, 20 bp, Artificial Sequence
  chemically synthesized
caatcccatcctaaggtgag

SEQ ID NO: 182099 - DNA, 20 bp, Artificial Sequence
  chemically synthesized
tatacagatgctcctcacct

SEQ ID NO: 182100 - DNA, 20 bp, Artificial Sequence
  chemically synthesized
ccaattcatcacattgtata

SEQ ID NO: 182101 - DNA, 20 bp, Artificial Sequence
  chemically synthesized
ctgtatacaatgtgatgaat

SEQ ID NO: 182102 - DNA, 20 bp, Artificial Sequence
  chemically synthesized
tgtatacaatgtgatgaatt

SEQ ID NO: 182103 - DNA, 20 bp, Artificial Sequence
  chemically synthesized
aatgtgatgaattgggatat

SEQ ID NO: 182104 - DNA, 20 bp, Artificial Sequence
  chemically synthesized
tgattatggggatggtttca

SEQ ID NO: 182105 - DNA, 20 bp, Artificial Sequence
  chemically synthesized
ggttaccttgattatgggga

SEQ ID NO: 182106 - DNA, 20 bp, Artificial Sequence
  chemically synthesized
atgaaaccatccccataatc

SEQ ID NO: 182107 - DNA, 20 bp, Artificial Sequence
  chemically synthesized
acttggttaccttgattatg

SEQ ID NO: 182108 - DNA, 20 bp, Artificial Sequence
  chemically synthesized
tgaaaccatccccataatca

SEQ ID NO: 182109 - DNA, 20 bp, Artificial Sequence
  chemically synthesized
tacttggttaccttgattat

SEQ ID NO: 182110 - DNA, 20 bp, Artificial Sequence
  chemically synthesized
atacttggttaccttgatta

SEQ ID NO: 182111 - DNA, 20 bp, Artificial Sequence
  chemically synthesized
tccccataatcaaggtaacc

SEQ ID NO: 182112 - DNA, 20 bp, Artificial Sequence
  chemically synthesized
ttggagttgatgcatatact

SEQ ID NO: 182113 - DNA, 20 bp, Artificial Sequence
  chemically synthesized
agtatatgcatcaactccaa

SEQ ID NO: 182114 - DNA, 20 bp, Artificial Sequence
  chemically synthesized
ggggcatgagcaaacttttg

SEQ ID NO: 182115 - DNA, 20 bp, Artificial Sequence
  chemically synthesized
agggggcatgagcaaacttt

SEQ ID NO: 182116 - DNA, 20 bp, Artificial Sequence
  chemically synthesized
agaaaaaatgaagggggcat

SEQ ID NO: 182117 - DNA, 20 bp, Artificial Sequence
  chemically synthesized
gaagaaagaaaaaatgaagg

SEQ ID NO: 182118 - DNA, 20 bp, Artificial Sequence
  chemically synthesized
agaagaaagaaaaaatgaag

SEQ ID NO: 182119 - DNA, 20 bp, Artificial Sequence
  chemically synthesized
aagaagaaagaaaaaatgaa

SEQ ID NO: 182120 - DNA, 20 bp, Artificial Sequence
  chemically synthesized
gaagaagaaagaaaaaatga

SEQ ID NO: 182121 - DNA, 20 bp, Artificial Sequence
  chemically synthesized
agaagaagaaagaaaaaatg

SEQ ID NO: 182122 - DNA, 20 bp, Artificial Sequence
  chemically synthesized
ggagaaagtgaagaagaaga

SEQ ID NO: 182123 - DNA, 20 bp, Artificial Sequence
  chemically synthesized
agaaggagaaagtgaagaag

SEQ ID NO: 182124 - DNA, 20 bp, Artificial Sequence
  chemically synthesized
aggagaaggagaaagtgaag

SEQ ID NO: 182125 - DNA, 20 bp, Artificial Sequence
  chemically synthesized
agaaggagaaggagaaagtg

SEQ ID NO: 182126 - DNA, 20 bp, Artificial Sequence
  chemically synthesized
gaagaagaaggagaaggaga

SEQ ID NO: 182127 - DNA, 20 bp, Artificial Sequence
  chemically synthesized
agaagaagaagaaggagaag

SEQ ID NO: 182128 - DNA, 20 bp, Artificial Sequence
  chemically synthesized
gaagaagaagaagaaggaga

SEQ ID NO: 182129 - DNA, 20 bp, Artificial Sequence
  chemically synthesized
agaagaagaagaagaaggag

SEQ ID NO: 182130 - DNA, 20 bp, Artificial Sequence
  chemically synthesized
ataagaagaagaagaagaag

SEQ ID NO: 182131 - DNA, 20 bp, Artificial Sequence
  chemically synthesized
ccataagaagaagaagaaga

SEQ ID NO: 182132 - DNA, 20 bp, Artificial Sequence
  chemically synthesized
accataagaagaagaagaag

SEQ ID NO: 182133 - DNA, 20 bp, Artificial Sequence
  chemically synthesized
cctaccataagaagaagaag

SEQ ID NO: 182134 - DNA, 20 bp, Artificial Sequence
  chemically synthesized
gttcctaccataagaagaag

SEQ ID NO: 182135 - DNA, 20 bp, Artificial Sequence
  chemically synthesized
ccttcttcttcttcttctta

SEQ ID NO: 182136 - DNA, 20 bp, Artificial Sequence
  chemically synthesized
agtgttcctaccataagaag

SEQ ID NO: 182137 - DNA, 20 bp, Artificial Sequence
  chemically synthesized
tcttcttcttcttcttatgg

SEQ ID NO: 182138 - DNA, 20 bp, Artificial Sequence
  chemically synthesized
ttaagtgttcctaccataag

SEQ ID NO: 182139 - DNA, 20 bp, Artificial Sequence
  chemically synthesized
cttcttcttcttcttatggt

SEQ ID NO: 182140 - DNA, 20 bp, Artificial Sequence
  chemically synthesized
gtcttaagtgttcctaccat

SEQ ID NO: 182141 - DNA, 20 bp, Artificial Sequence
  chemically synthesized
ttcttatggtaggaacactt

SEQ ID NO: 182142 - DNA, 20 bp, Artificial Sequence
  chemically synthesized
ttattaagaggatatgtctt

SEQ ID NO: 182143 - DNA, 20 bp, Artificial Sequence
  chemically synthesized
gcacttaaattattattaag

SEQ ID NO: 182144 - DNA, 20 bp, Artificial Sequence
  chemically synthesized
tgcacttaaattattattaa

SEQ ID NO: 182145 - DNA, 20 bp, Artificial Sequence
  chemically synthesized
tgtgcacttaaattattatt

SEQ ID NO: 182146 - DNA, 20 bp, Artificial Sequence
  chemically synthesized
tatcctcttaataataattt

SEQ ID NO: 182147 - DNA, 20 bp, Artificial Sequence
  chemically synthesized
ttaataataatttaagtgca

SEQ ID NO: 182148 - DNA, 20 bp, Artificial Sequence
  chemically synthesized
aataatttaagtgcacagta

SEQ ID NO: 182149 - DNA, 20 bp, Artificial Sequence
  chemically synthesized
ataatttaagtgcacagtac

SEQ ID NO: 182150 - DNA, 20 bp, Artificial Sequence
  chemically synthesized
agtacaggcactatgttgta

SEQ ID NO: 182151 - DNA, 20 bp, Artificial Sequence
  chemically synthesized
taaagatctgctgtacaaca

SEQ ID NO: 182152 - DNA, 20 bp, Artificial Sequence
  chemically synthesized
acaggcactatgttgtacag

SEQ ID NO: 182153 - DNA, 20 bp, Artificial Sequence
  chemically synthesized
tatgttgtacagcagatctt

SEQ ID NO: 182154 - DNA, 20 bp, Artificial Sequence
  chemically synthesized
tataatgtaaataagttcta

SEQ ID NO: 182155 - DNA, 20 bp, Artificial Sequence
  chemically synthesized
ttcagttatataatgtaaat

SEQ ID NO: 182156 - DNA, 20 bp, Artificial Sequence
  chemically synthesized
gttcaatgagtataaagttt

SEQ ID NO: 182157 - DNA, 20 bp, Artificial Sequence
  chemically synthesized
gttgctgttcaatgagtata

SEQ ID NO: 182158 - DNA, 20 bp, Artificial Sequence
  chemically synthesized
gaaactttatactcattgaa

SEQ ID NO: 182159 - DNA, 20 bp, Artificial Sequence
  chemically synthesized
actgggagttgctgttcaat

SEQ ID NO: 182160 - DNA, 20 bp, Artificial Sequence
  chemically synthesized
actcattgaacagcaactcc

SEQ ID NO: 182161 - DNA, 20 bp, Artificial Sequence
  chemically synthesized
ctgggcgaagggggaactgg

SEQ ID NO: 182162 - DNA, 20 bp, Artificial Sequence
  chemically synthesized
ggctgggcgaagggggaact

SEQ ID NO: 182163 - DNA, 20 bp, Artificial Sequence
  chemically synthesized
gggctgggcgaagggggaac

SEQ ID NO: 182164 - DNA, 20 bp, Artificial Sequence
  chemically synthesized
aaccaggggctgggcgaagg

SEQ ID NO: 182165 - DNA, 20 bp, Artificial Sequence
  chemically synthesized
ctcccagttcccccttcgcc

SEQ ID NO: 182166 - DNA, 20 bp, Artificial Sequence
  chemically synthesized
taaccaggggctgggcgaag

SEQ ID NO: 182167 - DNA, 20 bp, Artificial Sequence
  chemically synthesized
gtaaccaggggctgggcgaa

SEQ ID NO: 182168 - DNA, 20 bp, Artificial Sequence
  chemically synthesized
agtaaccaggggctgggcga

SEQ ID NO: 182169 - DNA, 20 bp, Artificial Sequence
  chemically synthesized
tagtaaccaggggctgggcg

SEQ ID NO: 182170 - DNA, 20 bp, Artificial Sequence
  chemically synthesized
ttcccccttcgcccagcccc

SEQ ID NO: 182171 - DNA, 20 bp, Artificial Sequence
  chemically synthesized
aatgatagtaaccaggggct

SEQ ID NO: 182172 - DNA, 20 bp, Artificial Sequence
  chemically synthesized
gaatgatagtaaccaggggc

SEQ ID NO: 182173 - DNA, 20 bp, Artificial Sequence
  chemically synthesized
agtagaatgatagtaaccag

SEQ ID NO: 182174 - DNA, 20 bp, Artificial Sequence
  chemically synthesized
gagtagaatgatagtaacca

SEQ ID NO: 182175 - DNA, 20 bp, Artificial Sequence
  chemically synthesized
agagtagaatgatagtaacc

SEQ ID NO: 182176 - DNA, 20 bp, Artificial Sequence
  chemically synthesized
gagagtagaatgatagtaac

SEQ ID NO: 182177 - DNA, 20 bp, Artificial Sequence
  chemically synthesized
agaaccagagagtagaatga

SEQ ID NO: 182178 - DNA, 20 bp, Artificial Sequence
  chemically synthesized
gttactatcattctactctc

SEQ ID NO: 182179 - DNA, 20 bp, Artificial Sequence
  chemically synthesized
aaactcgtagaaccagagag

SEQ ID NO: 182180 - DNA, 20 bp, Artificial Sequence
  chemically synthesized
gtcaaactcgtagaaccaga

SEQ ID NO: 182181 - DNA, 20 bp, Artificial Sequence
  chemically synthesized
cagtcaaactcgtagaacca

SEQ ID NO: 182182 - DNA, 20 bp, Artificial Sequence
  chemically synthesized
attctactctctggttctac

SEQ ID NO: 182183 - DNA, 20 bp, Artificial Sequence
  chemically synthesized
gacagtcaaactcgtagaac

SEQ ID NO: 182184 - DNA, 20 bp, Artificial Sequence
  chemically synthesized
gtctgagacagtcaaactcg

SEQ ID NO: 182185 - DNA, 20 bp, Artificial Sequence
  chemically synthesized
ttctacgagtttgactgtct

SEQ ID NO: 182186 - DNA, 20 bp, Artificial Sequence
  chemically synthesized
tttatatgaggtgtctgaga

SEQ ID NO: 182187 - DNA, 20 bp, Artificial Sequence
  chemically synthesized
tccatttatatgaggtgtct

SEQ ID NO: 182188 - DNA, 20 bp, Artificial Sequence
  chemically synthesized
tgaatgattccatttatatg

SEQ ID NO: 182189 - DNA, 20 bp, Artificial Sequence
  chemically synthesized
tctcagacacctcatataaa

SEQ ID NO: 182190 - DNA, 20 bp, Artificial Sequence
  chemically synthesized
ctgaatgattccatttatat

SEQ ID NO: 182191 - DNA, 20 bp, Artificial Sequence
  chemically synthesized
ctcatataaatggaatcatt

SEQ ID NO: 182192 - DNA, 20 bp, Artificial Sequence
  chemically synthesized
atcattcagtatttgccctt

SEQ ID NO: 182193 - DNA, 20 bp, Artificial Sequence
  chemically synthesized
gaaataagccagtcaccaaa

SEQ ID NO: 182194 - DNA, 20 bp, Artificial Sequence
  chemically synthesized
tgaaataagccagtcaccaa

SEQ ID NO: 182195 - DNA, 20 bp, Artificial Sequence
  chemically synthesized
agtatttgccctttggtgac

SEQ ID NO: 182196 - DNA, 20 bp, Artificial Sequence
  chemically synthesized
gtgaaataagccagtcacca

SEQ ID NO: 182197 - DNA, 20 bp, Artificial Sequence
  chemically synthesized
ttatgctaagtgaaataagc

SEQ ID NO: 182198 - DNA, 20 bp, Artificial Sequence
  chemically synthesized
ggcattatgctaagtgaaat

SEQ ID NO: 182199 - DNA, 20 bp, Artificial Sequence
  chemically synthesized
ggtgactggcttatttcact

SEQ ID NO: 182200 - DNA, 20 bp, Artificial Sequence
  chemically synthesized
aacctggaaggcattatgct

SEQ ID NO: 182201 - DNA, 20 bp, Artificial Sequence
  chemically synthesized
tcacttagcataatgccttc

SEQ ID NO: 182202 - DNA, 20 bp, Artificial Sequence
  chemically synthesized
cacttagcataatgccttcc

SEQ ID NO: 182203 - DNA, 20 bp, Artificial Sequence
  chemically synthesized
acaatatgtatgaacctgga

SEQ ID NO: 182204 - DNA, 20 bp, Artificial Sequence
  chemically synthesized
gacaatatgtatgaacctgg

SEQ ID NO: 182205 - DNA, 20 bp, Artificial Sequence
  chemically synthesized
tttgacaatatgtatgaacc

SEQ ID NO: 182206 - DNA, 20 bp, Artificial Sequence
  chemically synthesized
ttcatacatattgtcaaata

SEQ ID NO: 182207 - DNA, 20 bp, Artificial Sequence
  chemically synthesized
atacatattgtcaaatatgg

SEQ ID NO: 182208 - DNA, 20 bp, Artificial Sequence
  chemically synthesized
tacatattgtcaaatatggc

SEQ ID NO: 182209 - DNA, 20 bp, Artificial Sequence
  chemically synthesized
ttatttggccttaaaaggga

SEQ ID NO: 182210 - DNA, 20 bp, Artificial Sequence
  chemically synthesized
gcaggacgtccttccctttt

SEQ ID NO: 182211 - DNA, 20 bp, Artificial Sequence
  chemically synthesized
attatttggccttaaaaggg

SEQ ID NO: 182212 - DNA, 20 bp, Artificial Sequence
  chemically synthesized
caggacgtccttccctttta

SEQ ID NO: 182213 - DNA, 20 bp, Artificial Sequence
  chemically synthesized
aatattatttggccttaaaa

SEQ ID NO: 182214 - DNA, 20 bp, Artificial Sequence
  chemically synthesized
gaatattatttggccttaaa

SEQ ID NO: 182215 - DNA, 20 bp, Artificial Sequence
  chemically synthesized
ggaatattatttggccttaa

SEQ ID NO: 182216 - DNA, 20 bp, Artificial Sequence
  chemically synthesized
ttcatacagggaatattatt

SEQ ID NO: 182217 - DNA, 20 bp, Artificial Sequence
  chemically synthesized
aaatgtggtgtattcataca

SEQ ID NO: 182218 - DNA, 20 bp, Artificial Sequence
  chemically synthesized
aaaatgtggtgtattcatac

SEQ ID NO: 182219 - DNA, 20 bp, Artificial Sequence
  chemically synthesized
gaaaatgtggtgtattcata

SEQ ID NO: 182220 - DNA, 20 bp, Artificial Sequence
  chemically synthesized
atgcatggataaagaaaatg

SEQ ID NO: 182221 - DNA, 20 bp, Artificial Sequence
  chemically synthesized
catggaagaatgcatggata

SEQ ID NO: 182222 - DNA, 20 bp, Artificial Sequence
  chemically synthesized
gctgtgcatggaagaatgca

SEQ ID NO: 182223 - DNA, 20 bp, Artificial Sequence
  chemically synthesized
tccatgcattcttccatgca

SEQ ID NO: 182224 - DNA, 20 bp, Artificial Sequence
  chemically synthesized
tacagcatagctgtgcatgg

SEQ ID NO: 182225 - DNA, 20 bp, Artificial Sequence
  chemically synthesized
caatacagcatagctgtgca

SEQ ID NO: 182226 - DNA, 20 bp, Artificial Sequence
  chemically synthesized
gccaagatatcaatacagca

SEQ ID NO: 182227 - DNA, 20 bp, Artificial Sequence
  chemically synthesized
cagtagccaagatatcaata

SEQ ID NO: 182228 - DNA, 20 bp, Artificial Sequence
  chemically synthesized
gctatgctgtattgatatct

SEQ ID NO: 182229 - DNA, 20 bp, Artificial Sequence
  chemically synthesized
aagcattattcacagtagcc

SEQ ID NO: 182230 - DNA, 20 bp, Artificial Sequence
  chemically synthesized
ctctgaagcattattcacag

SEQ ID NO: 182231 - DNA, 20 bp, Artificial Sequence
  chemically synthesized
cttctctgaagcattattca

SEQ ID NO: 182232 - DNA, 20 bp, Artificial Sequence
  chemically synthesized
ggctactgtgaataatgctt

SEQ ID NO: 182233 - DNA, 20 bp, Artificial Sequence
  chemically synthesized
ctactgtgaataatgcttca

SEQ ID NO: 182234 - DNA, 20 bp, Artificial Sequence
  chemically synthesized
ctgtgaataatgcttcagag

SEQ ID NO: 182235 - DNA, 20 bp, Artificial Sequence
  chemically synthesized
ctgcactctcatcttctctg

SEQ ID NO: 182236 - DNA, 20 bp, Artificial Sequence
  chemically synthesized
aataatgcttcagagaagat

SEQ ID NO: 182237 - DNA, 20 bp, Artificial Sequence
  chemically synthesized
taatgcttcagagaagatga

SEQ ID NO: 182238 - DNA, 20 bp, Artificial Sequence
  chemically synthesized
cttcagagaagatgagagtg

SEQ ID NO: 182239 - DNA, 20 bp, Artificial Sequence
  chemically synthesized
gagagtgcagatatcttttt

SEQ ID NO: 182240 - DNA, 20 bp, Artificial Sequence
  chemically synthesized
attaaaaccagaatctcaaa

SEQ ID NO: 182241 - DNA, 20 bp, Artificial Sequence
  chemically synthesized
cagatatctttttgagattc

SEQ ID NO: 182242 - DNA, 20 bp, Artificial Sequence
  chemically synthesized
atatcccaaagaattaaaac

SEQ ID NO: 182243 - DNA, 20 bp, Artificial Sequence
  chemically synthesized
agattctggttttaattctt

SEQ ID NO: 182244 - DNA, 20 bp, Artificial Sequence
  chemically synthesized
gattctggttttaattcttt

SEQ ID NO: 182245 - DNA, 20 bp, Artificial Sequence
  chemically synthesized
actcctgggtatatatccca

SEQ ID NO: 182246 - DNA, 20 bp, Artificial Sequence
  chemically synthesized
aattctttgggatatatacc

SEQ ID NO: 182247 - DNA, 20 bp, Artificial Sequence
  chemically synthesized
attctttgggatatataccc

SEQ ID NO: 182248 - DNA, 20 bp, Artificial Sequence
  chemically synthesized
tctttgggatatatacccag

SEQ ID NO: 182249 - DNA, 20 bp, Artificial Sequence
  chemically synthesized
tgggatatatacccaggagt

SEQ ID NO: 182250 - DNA, 20 bp, Artificial Sequence
  chemically synthesized
gggatatatacccaggagtg

SEQ ID NO: 182251 - DNA, 20 bp, Artificial Sequence
  chemically synthesized
gatccagcaacctcactcct

SEQ ID NO: 182252 - DNA, 20 bp, Artificial Sequence
  chemically synthesized
tgatccagcaacctcactcc

SEQ ID NO: 182253 - DNA, 20 bp, Artificial Sequence
  chemically synthesized
atacccaggagtgaggttgc

SEQ ID NO: 182254 - DNA, 20 bp, Artificial Sequence
  chemically synthesized
agtgaggttgctggatcata

SEQ ID NO: 182255 - DNA, 20 bp, Artificial Sequence
  chemically synthesized
aatagaactaccatatgatc

SEQ ID NO: 182256 - DNA, 20 bp, Artificial Sequence
  chemically synthesized
gaggttgctggatcatatgg

SEQ ID NO: 182257 - DNA, 20 bp, Artificial Sequence
  chemically synthesized
gttcttgaaaaagttaaaaa

SEQ ID NO: 182258 - DNA, 20 bp, Artificial Sequence
  chemically synthesized
gttctatttttaactttttc

SEQ ID NO: 182259 - DNA, 20 bp, Artificial Sequence
  chemically synthesized
cagtagaaaggttcttgaaa

SEQ ID NO: 182260 - DNA, 20 bp, Artificial Sequence
  chemically synthesized
tgctatagaacacagtagaa

SEQ ID NO: 182261 - DNA, 20 bp, Artificial Sequence
  chemically synthesized
ctgctatagaacacagtaga

SEQ ID NO: 182262 - DNA, 20 bp, Artificial Sequence
  chemically synthesized
gcagctgctatagaacacag

SEQ ID NO: 182263 - DNA, 20 bp, Artificial Sequence
  chemically synthesized
aacctttctactgtgttcta

SEQ ID NO: 182264 - DNA, 20 bp, Artificial Sequence
  chemically synthesized
gatgcagctgctatagaaca

SEQ ID NO: 182265 - DNA, 20 bp, Artificial Sequence
  chemically synthesized
ctttctactgtgttctatag

SEQ ID NO: 182266 - DNA, 20 bp, Artificial Sequence
  chemically synthesized
gaaaaatgatgcagctgcta

SEQ ID NO: 182267 - DNA, 20 bp, Artificial Sequence
  chemically synthesized
gtggtaatggaaaaatgatg

SEQ ID NO: 182268 - DNA, 20 bp, Artificial Sequence
  chemically synthesized
tagtacaccataggtggtaa

SEQ ID NO: 182269 - DNA, 20 bp, Artificial Sequence
  chemically synthesized
catttttccattaccaccta

SEQ ID NO: 182270 - DNA, 20 bp, Artificial Sequence
  chemically synthesized
gaacgctagtacaccatagg

SEQ ID NO: 182271 - DNA, 20 bp, Artificial Sequence
  chemically synthesized
tcggaacgctagtacaccat

SEQ ID NO: 182272 - DNA, 20 bp, Artificial Sequence
  chemically synthesized
atcggaacgctagtacacca

SEQ ID NO: 182273 - DNA, 20 bp, Artificial Sequence
  chemically synthesized
cattaccacctatggtgtac

SEQ ID NO: 182274 - DNA, 20 bp, Artificial Sequence
  chemically synthesized
atgtgaggaaatcggaacgc

SEQ ID NO: 182275 - DNA, 20 bp, Artificial Sequence
  chemically synthesized
tgttgaggatgtgaggaaat

SEQ ID NO: 182276 - DNA, 20 bp, Artificial Sequence
  chemically synthesized
gaaatgttgttgaggatgtg

SEQ ID NO: 182277 - DNA, 20 bp, Artificial Sequence
  chemically synthesized
agaaatgttgttgaggatgt

SEQ ID NO: 182278 - DNA, 20 bp, Artificial Sequence
  chemically synthesized
agagataagaaatgttgttg

SEQ ID NO: 182279 - DNA, 20 bp, Artificial Sequence
  chemically synthesized
aagagataagaaatgttgtt

SEQ ID NO: 182280 - DNA, 20 bp, Artificial Sequence
  chemically synthesized
acaaaccaaaaacaagagat

SEQ ID NO: 182281 - DNA, 20 bp, Artificial Sequence
  chemically synthesized
catttcttatctcttgtttt

SEQ ID NO: 182282 - DNA, 20 bp, Artificial Sequence
  chemically synthesized
taaaaacaaaccaaaaacaa

SEQ ID NO: 182283 - DNA, 20 bp, Artificial Sequence
  chemically synthesized
tataaaaacaaaccaaaaac

SEQ ID NO: 182284 - DNA, 20 bp, Artificial Sequence
  chemically synthesized
ttgtttttggtttgttttta

SEQ ID NO: 182285 - DNA, 20 bp, Artificial Sequence
  chemically synthesized
tttttggtttgtttttatag

SEQ ID NO: 182286 - DNA, 20 bp, Artificial Sequence
  chemically synthesized
ttttatagtagccatcctaa

SEQ ID NO: 182287 - DNA, 20 bp, Artificial Sequence
  chemically synthesized
tttatagtagccatcctaac

SEQ ID NO: 182288 - DNA, 20 bp, Artificial Sequence
  chemically synthesized
tcatctcacccctgttagga

SEQ ID NO: 182289 - DNA, 20 bp, Artificial Sequence
  chemically synthesized
ttatagtagccatcctaaca

SEQ ID NO: 182290 - DNA, 20 bp, Artificial Sequence
  chemically synthesized
tatagtagccatcctaacag

SEQ ID NO: 182291 - DNA, 20 bp, Artificial Sequence
  chemically synthesized
actatcatctcacccctgtt

SEQ ID NO: 182292 - DNA, 20 bp, Artificial Sequence
  chemically synthesized
cactatcatctcacccctgt

SEQ ID NO: 182293 - DNA, 20 bp, Artificial Sequence
  chemically synthesized
gtagccatcctaacaggggt

SEQ ID NO: 182294 - DNA, 20 bp, Artificial Sequence
  chemically synthesized
tcctaacaggggtgagatga

SEQ ID NO: 182295 - DNA, 20 bp, Artificial Sequence
  chemically synthesized
agatgatagtgttcatctca

SEQ ID NO: 182296 - DNA, 20 bp, Artificial Sequence
  chemically synthesized
atgatagtgttcatctcaca

SEQ ID NO: 182297 - DNA, 20 bp, Artificial Sequence
  chemically synthesized
tgatagtgttcatctcacag

SEQ ID NO: 182298 - DNA, 20 bp, Artificial Sequence
  chemically synthesized
atgcaaatcaaaacctctgt

SEQ ID NO: 182299 - DNA, 20 bp, Artificial Sequence
  chemically synthesized
atttgcatttccctgatgac

SEQ ID NO: 182300 - DNA, 20 bp, Artificial Sequence
  chemically synthesized
ctcagcatcactagtcatca

SEQ ID NO: 182301 - DNA, 20 bp, Artificial Sequence
  chemically synthesized
gctcagcatcactagtcatc

SEQ ID NO: 182302 - DNA, 20 bp, Artificial Sequence
  chemically synthesized
tgctcagcatcactagtcat

SEQ ID NO: 182303 - DNA, 20 bp, Artificial Sequence
  chemically synthesized
gaaaaggtgctcagcatcac

SEQ ID NO: 182304 - DNA, 20 bp, Artificial Sequence
  chemically synthesized
ccctgatgactagtgatgct

SEQ ID NO: 182305 - DNA, 20 bp, Artificial Sequence
  chemically synthesized
caggtatgtgaaaaggtgct

SEQ ID NO: 182306 - DNA, 20 bp, Artificial Sequence
  chemically synthesized
tggccaacaggtatgtgaaa

SEQ ID NO: 182307 - DNA, 20 bp, Artificial Sequence
  chemically synthesized
atggccaacaggtatgtgaa

SEQ ID NO: 182308 - DNA, 20 bp, Artificial Sequence
  chemically synthesized
gcaccttttcacatacctgt

SEQ ID NO: 182309 - DNA, 20 bp, Artificial Sequence
  chemically synthesized
aagacatagaaatggccaac

SEQ ID NO: 182310 - DNA, 20 bp, Artificial Sequence
  chemically synthesized
gaagacatagaaatggccaa

SEQ ID NO: 182311 - DNA, 20 bp, Artificial Sequence
  chemically synthesized
ctccaaagaagacatagaaa

SEQ ID NO: 182312 - DNA, 20 bp, Artificial Sequence
  chemically synthesized
atatttctccaaagaagaca

SEQ ID NO: 182313 - DNA, 20 bp, Artificial Sequence
  chemically synthesized
ggccatttctatgtcttctt

SEQ ID NO: 182314 - DNA, 20 bp, Artificial Sequence
  chemically synthesized
ccatttctatgtcttctttg

SEQ ID NO: 182315 - DNA, 20 bp, Artificial Sequence
  chemically synthesized
aaatatatatttctccaaag

SEQ ID NO: 182316 - DNA, 20 bp, Artificial Sequence
  chemically synthesized
tttaaatatatatttctcca

SEQ ID NO: 182317 - DNA, 20 bp, Artificial Sequence
  chemically synthesized
atttaaatattttaaaaatc

SEQ ID NO: 182318 - DNA, 20 bp, Artificial Sequence
  chemically synthesized
aatacaactcaacaggaaaa

SEQ ID NO: 182319 - DNA, 20 bp, Artificial Sequence
  chemically synthesized
taatacaactcaacaggaaa

SEQ ID NO: 182320 - DNA, 20 bp, Artificial Sequence
  chemically synthesized
ttatttgcctttttcctgtt

SEQ ID NO: 182321 - DNA, 20 bp, Artificial Sequence
  chemically synthesized
gattgttaatacaactcaac

SEQ ID NO: 182322 - DNA, 20 bp, Artificial Sequence
  chemically synthesized
tgattgttaatacaactcaa

SEQ ID NO: 182323 - DNA, 20 bp, Artificial Sequence
  chemically synthesized
tgttgagttgtattaacaat

SEQ ID NO: 182324 - DNA, 20 bp, Artificial Sequence
  chemically synthesized
attgttagtgtacagaaaca

SEQ ID NO: 182325 - DNA, 20 bp, Artificial Sequence
  chemically synthesized
ttattgttagtgtacagaaa

SEQ ID NO: 182326 - DNA, 20 bp, Artificial Sequence
  chemically synthesized
ggtagcttattgttagtgta

SEQ ID NO: 182327 - DNA, 20 bp, Artificial Sequence
  chemically synthesized
tgtttctgtacactaacaat

SEQ ID NO: 182328 - DNA, 20 bp, Artificial Sequence
  chemically synthesized
attattgggtagcttattgt

SEQ ID NO: 182329 - DNA, 20 bp, Artificial Sequence
  chemically synthesized
aagaaaagcttattattggg

SEQ ID NO: 182330 - DNA, 20 bp, Artificial Sequence
  chemically synthesized
acaataagctacccaataat

SEQ ID NO: 182331 - DNA, 20 bp, Artificial Sequence
  chemically synthesized
tagaagaaaagcttattatt

SEQ ID NO: 182332 - DNA, 20 bp, Artificial Sequence
  chemically synthesized
atagaagaaaagcttattat

SEQ ID NO: 182333 - DNA, 20 bp, Artificial Sequence
  chemically synthesized
aagataatccaatagaagaa

SEQ ID NO: 182334 - DNA, 20 bp, Artificial Sequence
  chemically synthesized
ataataagcttttcttctat

SEQ ID NO: 182335 - DNA, 20 bp, Artificial Sequence
  chemically synthesized
gtgacaagataatccaatag

SEQ ID NO: 182336 - DNA, 20 bp, Artificial Sequence
  chemically synthesized
aaggtgacaagataatccaa

SEQ ID NO: 182337 - DNA, 20 bp, Artificial Sequence
  chemically synthesized
caatatatgacaaaggtgac

SEQ ID NO: 182338 - DNA, 20 bp, Artificial Sequence
  chemically synthesized
ggtcaatcaatatatgacaa

SEQ ID NO: 182339 - DNA, 20 bp, Artificial Sequence
  chemically synthesized
tggtcaatcaatatatgaca

SEQ ID NO: 182340 - DNA, 20 bp, Artificial Sequence
  chemically synthesized
tattgattgaccataaatat

SEQ ID NO: 182341 - DNA, 20 bp, Artificial Sequence
  chemically synthesized
gcaataaactcttatattta

SEQ ID NO: 182342 - DNA, 20 bp, Artificial Sequence
  chemically synthesized
ttgattgaccataaatataa

SEQ ID NO: 182343 - DNA, 20 bp, Artificial Sequence
  chemically synthesized
taaatataagagtttattgc

SEQ ID NO: 182344 - DNA, 20 bp, Artificial Sequence
  chemically synthesized
gagtttattgctggactatc

SEQ ID NO: 182345 - DNA, 20 bp, Artificial Sequence
  chemically synthesized
atggaagagactcgatagtc

SEQ ID NO: 182346 - DNA, 20 bp, Artificial Sequence
  chemically synthesized
tgacaatggaagagactcga

SEQ ID NO: 182347 - DNA, 20 bp, Artificial Sequence
  chemically synthesized
tcctaatgttgacaatggaa

SEQ ID NO: 182348 - DNA, 20 bp, Artificial Sequence
  chemically synthesized
actcctaatgttgacaatgg

SEQ ID NO: 182349 - DNA, 20 bp, Artificial Sequence
  chemically synthesized
tgcactcctaatgttgacaa

SEQ ID NO: 182350 - DNA, 20 bp, Artificial Sequence
  chemically synthesized
gtctcttccattgtcaacat

SEQ ID NO: 182351 - DNA, 20 bp, Artificial Sequence
  chemically synthesized
tctcttccattgtcaacatt

SEQ ID NO: 182352 - DNA, 20 bp, Artificial Sequence
  chemically synthesized
tcttccattgtcaacattag

SEQ ID NO: 182353 - DNA, 20 bp, Artificial Sequence
  chemically synthesized
cattgtcaacattaggagtg

SEQ ID NO: 182354 - DNA, 20 bp, Artificial Sequence
  chemically synthesized
gtcaacattaggagtgcagt

SEQ ID NO: 182355 - DNA, 20 bp, Artificial Sequence
  chemically synthesized
aacattaggagtgcagttag

SEQ ID NO: 182356 - DNA, 20 bp, Artificial Sequence
  chemically synthesized
ggagtgcagttagtagattt

SEQ ID NO: 182357 - DNA, 20 bp, Artificial Sequence
  chemically synthesized
atttaagaaaaaaatatgaa

SEQ ID NO: 182358 - DNA, 20 bp, Artificial Sequence
  chemically synthesized
tttaagaaaaaaatatgaat

SEQ ID NO: 182359 - DNA, 20 bp, Artificial Sequence
  chemically synthesized
aggtttgtttcctaaaccta

SEQ ID NO: 182360 - DNA, 20 bp, Artificial Sequence
  chemically synthesized
tatagatcacctgtaggttt

SEQ ID NO: 182361 - DNA, 20 bp, Artificial Sequence
  chemically synthesized
ggtttgtttcctaaacctac

SEQ ID NO: 182362 - DNA, 20 bp, Artificial Sequence
  chemically synthesized
ttatagatcacctgtaggtt

SEQ ID NO: 182363 - DNA, 20 bp, Artificial Sequence
  chemically synthesized
caggcttatagatcacctgt

SEQ ID NO: 182364 - DNA, 20 bp, Artificial Sequence
  chemically synthesized
acaggcttatagatcacctg

SEQ ID NO: 182365 - DNA, 20 bp, Artificial Sequence
  chemically synthesized
taaacctacaggtgatctat

SEQ ID NO: 182366 - DNA, 20 bp, Artificial Sequence
  chemically synthesized
ctgtcataaggacaggctta

SEQ ID NO: 182367 - DNA, 20 bp, Artificial Sequence
  chemically synthesized
tgtggtactgtcataaggac

SEQ ID NO: 182368 - DNA, 20 bp, Artificial Sequence
  chemically synthesized
gtgtggtactgtcataagga

SEQ ID NO: 182369 - DNA, 20 bp, Artificial Sequence
  chemically synthesized
ctataagcctgtccttatga

SEQ ID NO: 182370 - DNA, 20 bp, Artificial Sequence
  chemically synthesized
gacagtgtggtactgtcata

SEQ ID NO: 182371 - DNA, 20 bp, Artificial Sequence
  chemically synthesized
agacagtgtggtactgtcat

SEQ ID NO: 182372 - DNA, 20 bp, Artificial Sequence
  chemically synthesized
ctgcaatgatgaagacagtg

SEQ ID NO: 182373 - DNA, 20 bp, Artificial Sequence
  chemically synthesized
taaatctgcaatgatgaaga

SEQ ID NO: 182374 - DNA, 20 bp, Artificial Sequence
  chemically synthesized
gatgtaaatctgcaatgatg

SEQ ID NO: 182375 - DNA, 20 bp, Artificial Sequence
  chemically synthesized
ccacactgtcttcatcattg

SEQ ID NO: 182376 - DNA, 20 bp, Artificial Sequence
  chemically synthesized
catcattgcagatttacatc

SEQ ID NO: 182377 - DNA, 20 bp, Artificial Sequence
  chemically synthesized
tttacatcaagatttgaaat

SEQ ID NO: 182378 - DNA, 20 bp, Artificial Sequence
  chemically synthesized
ttacatcaagatttgaaatc

SEQ ID NO: 182379 - DNA, 20 bp, Artificial Sequence
  chemically synthesized
caggtaatgtcctgatttca

SEQ ID NO: 182380 - DNA, 20 bp, Artificial Sequence
  chemically synthesized
agttagaggactttgaaatc

SEQ ID NO: 182381 - DNA, 20 bp, Artificial Sequence
  chemically synthesized
aagttagaggactttgaaat

SEQ ID NO: 182382 - DNA, 20 bp, Artificial Sequence
  chemically synthesized
aaaaagaagaaaaaagttag

SEQ ID NO: 182383 - DNA, 20 bp, Artificial Sequence
  chemically synthesized
gaaaaagaagaaaaaagtta

SEQ ID NO: 182384 - DNA, 20 bp, Artificial Sequence
  chemically synthesized
gtgaaaaagaagaaaaaagt

SEQ ID NO: 182385 - DNA, 20 bp, Artificial Sequence
  chemically synthesized
aattgtgaaaaagaagaaaa

SEQ ID NO: 182386 - DNA, 20 bp, Artificial Sequence
  chemically synthesized
ccaaaacaattgtgaaaaag

SEQ ID NO: 182387 - DNA, 20 bp, Artificial Sequence
  chemically synthesized
tagccaaaacaattgtgaaa

SEQ ID NO: 182388 - DNA, 20 bp, Artificial Sequence
  chemically synthesized
cttctttttcacaattgttt

SEQ ID NO: 182389 - DNA, 20 bp, Artificial Sequence
  chemically synthesized
tcacaattgttttggctatt

SEQ ID NO: 182390 - DNA, 20 bp, Artificial Sequence
  chemically synthesized
agcaattcaaatgtaccaaa

SEQ ID NO: 182391 - DNA, 20 bp, Artificial Sequence
  chemically synthesized
ttgatcccacaatttatata

SEQ ID NO: 182392 - DNA, 20 bp, Artificial Sequence
  chemically synthesized
gaattgctatatataaattg

SEQ ID NO: 182393 - DNA, 20 bp, Artificial Sequence
  chemically synthesized
aattgctatatataaattgt

SEQ ID NO: 182394 - DNA, 20 bp, Artificial Sequence
  chemically synthesized
tcaatttttcaatttgtgcc

SEQ ID NO: 182395 - DNA, 20 bp, Artificial Sequence
  chemically synthesized
attgaaaaattgcacaatct

SEQ ID NO: 182396 - DNA, 20 bp, Artificial Sequence
  chemically synthesized
atcgacatcttagcagatgt

SEQ ID NO: 182397 - DNA, 20 bp, Artificial Sequence
  chemically synthesized
aatttgtgccaacatctgct

SEQ ID NO: 182398 - DNA, 20 bp, Artificial Sequence
  chemically synthesized
aatctccatcgacatcttag

SEQ ID NO: 182399 - DNA, 20 bp, Artificial Sequence
  chemically synthesized
tgcaatctccatcgacatct

SEQ ID NO: 182400 - DNA, 20 bp, Artificial Sequence
  chemically synthesized
aacatctgctaagatgtcga

SEQ ID NO: 182401 - DNA, 20 bp, Artificial Sequence
  chemically synthesized
catctgctaagatgtcgatg

SEQ ID NO: 182402 - DNA, 20 bp, Artificial Sequence
  chemically synthesized
tggagattgcattaaatcta

SEQ ID NO: 182403 - DNA, 20 bp, Artificial Sequence
  chemically synthesized
ttgcattaaatctatagaac

SEQ ID NO: 182404 - DNA, 20 bp, Artificial Sequence
  chemically synthesized
attctccccaacttgttcta

SEQ ID NO: 182405 - DNA, 20 bp, Artificial Sequence
  chemically synthesized
attaaatctatagaacaagt

SEQ ID NO: 182406 - DNA, 20 bp, Artificial Sequence
  chemically synthesized
ttaaatctatagaacaagtt

SEQ ID NO: 182407 - DNA, 20 bp, Artificial Sequence
  chemically synthesized
taaatctatagaacaagttg

SEQ ID NO: 182408 - DNA, 20 bp, Artificial Sequence
  chemically synthesized
aatctatagaacaagttggg

SEQ ID NO: 182409 - DNA, 20 bp, Artificial Sequence
  chemically synthesized
ggggagaatcactaccttat

SEQ ID NO: 182410 - DNA, 20 bp, Artificial Sequence
  chemically synthesized
aagactcaatactgataagg

SEQ ID NO: 182411 - DNA, 20 bp, Artificial Sequence
  chemically synthesized
tggaagactcaatactgata

SEQ ID NO: 182412 - DNA, 20 bp, Artificial Sequence
  chemically synthesized
ttggaagactcaatactgat

SEQ ID NO: 182413 - DNA, 20 bp, Artificial Sequence
  chemically synthesized
atcactaccttatcagtatt

SEQ ID NO: 182414 - DNA, 20 bp, Artificial Sequence
  chemically synthesized
attccatgttcatgaattgg

SEQ ID NO: 182415 - DNA, 20 bp, Artificial Sequence
  chemically synthesized
catattccatgttcatgaat

SEQ ID NO: 182416 - DNA, 20 bp, Artificial Sequence
  chemically synthesized
agtcttccaattcatgaaca

SEQ ID NO: 182417 - DNA, 20 bp, Artificial Sequence
  chemically synthesized
caattcatgaacatggaata

SEQ ID NO: 182418 - DNA, 20 bp, Artificial Sequence
  chemically synthesized
ggaatatggtcccatttatt

SEQ ID NO: 182419 - DNA, 20 bp, Artificial Sequence
  chemically synthesized
aattaaaaatctaaataaat

SEQ ID NO: 182420 - DNA, 20 bp, Artificial Sequence
  chemically synthesized
aaattaaaaatctaaataaa

SEQ ID NO: 182421 - DNA, 20 bp, Artificial Sequence
  chemically synthesized
tttagatttttaatttctct

SEQ ID NO: 182422 - DNA, 20 bp, Artificial Sequence
  chemically synthesized
aaactgtaatacattgctga

SEQ ID NO: 182423 - DNA, 20 bp, Artificial Sequence
  chemically synthesized
gaaaactgtaatacattgct

SEQ ID NO: 182424 - DNA, 20 bp, Artificial Sequence
  chemically synthesized
tttctctcagcaatgtatta

SEQ ID NO: 182425 - DNA, 20 bp, Artificial Sequence
  chemically synthesized
cagcaatgtattacagtttt

SEQ ID NO: 182426 - DNA, 20 bp, Artificial Sequence
  chemically synthesized
gcaatgtattacagttttca

SEQ ID NO: 182427 - DNA, 20 bp, Artificial Sequence
  chemically synthesized
gtattacagttttcagagta

SEQ ID NO: 182428 - DNA, 20 bp, Artificial Sequence
  chemically synthesized
tattacagttttcagagtac

SEQ ID NO: 182429 - DNA, 20 bp, Artificial Sequence
  chemically synthesized
cagttttcagagtacaggtt

SEQ ID NO: 182430 - DNA, 20 bp, Artificial Sequence
  chemically synthesized
ggtcataaatttgaaaatat

SEQ ID NO: 182431 - DNA, 20 bp, Artificial Sequence
  chemically synthesized
gtagcataaaatagattaaa

SEQ ID NO: 182432 - DNA, 20 bp, Artificial Sequence
  chemically synthesized
tcattctttgtagcataaaa

SEQ ID NO: 182433 - DNA, 20 bp, Artificial Sequence
  chemically synthesized
ttaatctattttatgctaca

SEQ ID NO: 182434 - DNA, 20 bp, Artificial Sequence
  chemically synthesized
gaaaataatttcattctttg

SEQ ID NO: 182435 - DNA, 20 bp, Artificial Sequence
  chemically synthesized
aaagaatgaaattattttct

SEQ ID NO: 182436 - DNA, 20 bp, Artificial Sequence
  chemically synthesized
aaaaaattgaaaatgatact

SEQ ID NO: 182437 - DNA, 20 bp, Artificial Sequence
  chemically synthesized
cattttcaattttttattgc

SEQ ID NO: 182438 - DNA, 20 bp, Artificial Sequence
  chemically synthesized
aattttttattgctagtaca

SEQ ID NO: 182439 - DNA, 20 bp, Artificial Sequence
  chemically synthesized
attttttattgctagtacac

SEQ ID NO: 182440 - DNA, 20 bp, Artificial Sequence
  chemically synthesized
taaattacattcctgtgtac

SEQ ID NO: 182441 - DNA, 20 bp, Artificial Sequence
  chemically synthesized
ttgcaagataatcaatatac

SEQ ID NO: 182442 - DNA, 20 bp, Artificial Sequence
  chemically synthesized
ttgtatattgattatcttgc

SEQ ID NO: 182443 - DNA, 20 bp, Artificial Sequence
  chemically synthesized
gataagttcatgaagcttgc

SEQ ID NO: 182444 - DNA, 20 bp, Artificial Sequence
  chemically synthesized
ctagatctgataagttcatg

SEQ ID NO: 182445 - DNA, 20 bp, Artificial Sequence
  chemically synthesized
tgcaagcttcatgaacttat

SEQ ID NO: 182446 - DNA, 20 bp, Artificial Sequence
  chemically synthesized
aaataactgctagatctgat

SEQ ID NO: 182447 - DNA, 20 bp, Artificial Sequence
  chemically synthesized
cttcatgaacttatcagatc

SEQ ID NO: 182448 - DNA, 20 bp, Artificial Sequence
  chemically synthesized
catgaacttatcagatctag

SEQ ID NO: 182449 - DNA, 20 bp, Artificial Sequence
  chemically synthesized
gatatccacaaaataactgc

SEQ ID NO: 182450 - DNA, 20 bp, Artificial Sequence
  chemically synthesized
cagatctagcagttattttg

SEQ ID NO: 182451 - DNA, 20 bp, Artificial Sequence
  chemically synthesized
agcagttattttgtggatat

SEQ ID NO: 182452 - DNA, 20 bp, Artificial Sequence
  chemically synthesized
atatcagatttttctacata

SEQ ID NO: 182453 - DNA, 20 bp, Artificial Sequence
  chemically synthesized
tatcagatttttctacatac

SEQ ID NO: 182454 - DNA, 20 bp, Artificial Sequence
  chemically synthesized
agacaatacaatcctgtatg

SEQ ID NO: 182455 - DNA, 20 bp, Artificial Sequence
  chemically synthesized
gattgtattgtctgtgaata

SEQ ID NO: 182456 - DNA, 20 bp, Artificial Sequence
  chemically synthesized
aatgaaactctctttattca

SEQ ID NO: 182457 - DNA, 20 bp, Artificial Sequence
  chemically synthesized
ttgtattgtctgtgaataaa

SEQ ID NO: 182458 - DNA, 20 bp, Artificial Sequence
  chemically synthesized
gtattgtctgtgaataaaga

SEQ ID NO: 182459 - DNA, 20 bp, Artificial Sequence
  chemically synthesized
aggcatccacagtatagaag

SEQ ID NO: 182460 - DNA, 20 bp, Artificial Sequence
  chemically synthesized
ccgaggcatccacagtatag

SEQ ID NO: 182461 - DNA, 20 bp, Artificial Sequence
  chemically synthesized
tcatttcttcttctatactg

SEQ ID NO: 182462 - DNA, 20 bp, Artificial Sequence
  chemically synthesized
aatccgaggcatccacagta

SEQ ID NO: 182463 - DNA, 20 bp, Artificial Sequence
  chemically synthesized
ataggaatccgaggcatcca

SEQ ID NO: 182464 - DNA, 20 bp, Artificial Sequence
  chemically synthesized
cttctatactgtggatgcct

SEQ ID NO: 182465 - DNA, 20 bp, Artificial Sequence
  chemically synthesized
aggagaaagataggaatccg

SEQ ID NO: 182466 - DNA, 20 bp, Artificial Sequence
  chemically synthesized
caggagaaagataggaatcc

SEQ ID NO: 182467 - DNA, 20 bp, Artificial Sequence
  chemically synthesized
cccaggtccaggagaaagat

SEQ ID NO: 182468 - DNA, 20 bp, Artificial Sequence
  chemically synthesized
acccaggtccaggagaaaga

SEQ ID NO: 182469 - DNA, 20 bp, Artificial Sequence
  chemically synthesized
tcggattcctatctttctcc

SEQ ID NO: 182470 - DNA, 20 bp, Artificial Sequence
  chemically synthesized
aaaaacccaggtccaggaga

SEQ ID NO: 182471 - DNA, 20 bp, Artificial Sequence
  chemically synthesized
tcctatctttctcctggacc

SEQ ID NO: 182472 - DNA, 20 bp, Artificial Sequence
  chemically synthesized
acaaaaaaacccaggtccag

SEQ ID NO: 182473 - DNA, 20 bp, Artificial Sequence
  chemically synthesized
cctatctttctcctggacct

SEQ ID NO: 182474 - DNA, 20 bp, Artificial Sequence
  chemically synthesized
caacaaaaaaacccaggtcc

SEQ ID NO: 182475 - DNA, 20 bp, Artificial Sequence
  chemically synthesized
ccaacaaaaaaacccaggtc

SEQ ID NO: 182476 - DNA, 20 bp, Artificial Sequence
  chemically synthesized
attttccaacaaaaaaaccc

SEQ ID NO: 182477 - DNA, 20 bp, Artificial Sequence
  chemically synthesized
aattttccaacaaaaaaacc

SEQ ID NO: 182478 - DNA, 20 bp, Artificial Sequence
  chemically synthesized
ctggacctgggtttttttgt

SEQ ID NO: 182479 - DNA, 20 bp, Artificial Sequence
  chemically synthesized
aaaattttaaattactaatt

SEQ ID NO: 182480 - DNA, 20 bp, Artificial Sequence
  chemically synthesized
cacaaacacagaaactgaat

SEQ ID NO: 182481 - DNA, 20 bp, Artificial Sequence
  chemically synthesized
gaatagacctaacacaaaca

SEQ ID NO: 182482 - DNA, 20 bp, Artificial Sequence
  chemically synthesized
ttcagtttctgtgtttgtgt

SEQ ID NO: 182483 - DNA, 20 bp, Artificial Sequence
  chemically synthesized
tcagtttctgtgtttgtgtt

SEQ ID NO: 182484 - DNA, 20 bp, Artificial Sequence
  chemically synthesized
gaaaaaaatagacatatgaa

SEQ ID NO: 182485 - DNA, 20 bp, Artificial Sequence
  chemically synthesized
aaactgattcaagaaaaaaa

SEQ ID NO: 182486 - DNA, 20 bp, Artificial Sequence
  chemically synthesized
tgtctatttttttcttgaat

SEQ ID NO: 182487 - DNA, 20 bp, Artificial Sequence
  chemically synthesized
taaattaacaaaactgattc

SEQ ID NO: 182488 - DNA, 20 bp, Artificial Sequence
  chemically synthesized
ttgttaatttatgtctttct

SEQ ID NO: 182489 - DNA, 20 bp, Artificial Sequence
  chemically synthesized
taaatgaaaaaattcttaga

SEQ ID NO: 182490 - DNA, 20 bp, Artificial Sequence
  chemically synthesized
atattaaatgaaaaaattct

SEQ ID NO: 182491 - DNA, 20 bp, Artificial Sequence
  chemically synthesized
ttttcatttaatatgttttg

SEQ ID NO: 182492 - DNA, 20 bp, Artificial Sequence
  chemically synthesized
ttgttcatgttattacattc

SEQ ID NO: 182493 - DNA, 20 bp, Artificial Sequence
  chemically synthesized
cctacagaaattagaaagac

SEQ ID NO: 182494 - DNA, 20 bp, Artificial Sequence
  chemically synthesized
ccaaccctacagaaattaga

SEQ ID NO: 182495 - DNA, 20 bp, Artificial Sequence
  chemically synthesized
tctagtctttctaatttctg

SEQ ID NO: 182496 - DNA, 20 bp, Artificial Sequence
  chemically synthesized
actaccaaccctacagaaat

SEQ ID NO: 182497 - DNA, 20 bp, Artificial Sequence
  chemically synthesized
ctagtctttctaatttctgt

SEQ ID NO: 182498 - DNA, 20 bp, Artificial Sequence
  chemically synthesized
tagtctttctaatttctgta

SEQ ID NO: 182499 - DNA, 20 bp, Artificial Sequence
  chemically synthesized
ctttctaatttctgtagggt

SEQ ID NO: 182500 - DNA, 20 bp, Artificial Sequence
  chemically synthesized
ggtaattactaccaacccta

SEQ ID NO: 182501 - DNA, 20 bp, Artificial Sequence
  chemically synthesized
tctaatttctgtagggttgg

SEQ ID NO: 182502 - DNA, 20 bp, Artificial Sequence
  chemically synthesized
caaaatcataaaggaaaaag

SEQ ID NO: 182503 - DNA, 20 bp, Artificial Sequence
  chemically synthesized
ccaaaatcataaaggaaaaa

SEQ ID NO: 182504 - DNA, 20 bp, Artificial Sequence
  chemically synthesized
accaaaatcataaaggaaaa

SEQ ID NO: 182505 - DNA, 20 bp, Artificial Sequence
  chemically synthesized
taccaaaatcataaaggaaa

SEQ ID NO: 182506 - DNA, 20 bp, Artificial Sequence
  chemically synthesized
aagaattaccaaaatcataa

SEQ ID NO: 182507 - DNA, 20 bp, Artificial Sequence
  chemically synthesized
aaagaattaccaaaatcata

SEQ ID NO: 182508 - DNA, 20 bp, Artificial Sequence
  chemically synthesized
ccctttttcctttatgattt

SEQ ID NO: 182509 - DNA, 20 bp, Artificial Sequence
  chemically synthesized
tttggtaattcttttttttt

SEQ ID NO: 182510 - DNA, 20 bp, Artificial Sequence
  chemically synthesized
gctagactgaccaaaaaaaa

SEQ ID NO: 182511 - DNA, 20 bp, Artificial Sequence
  chemically synthesized
gtaattcttttttttttggt

SEQ ID NO: 182512 - DNA, 20 bp, Artificial Sequence
  chemically synthesized
tcttttttttttggtcagtc

SEQ ID NO: 182513 - DNA, 20 bp, Artificial Sequence
  chemically synthesized
ttttttggtcagtctagcta

SEQ ID NO: 182514 - DNA, 20 bp, Artificial Sequence
  chemically synthesized
ttacatggagaagctttagc

SEQ ID NO: 182515 - DNA, 20 bp, Artificial Sequence
  chemically synthesized
ttttttacatggagaagctt

SEQ ID NO: 182516 - DNA, 20 bp, Artificial Sequence
  chemically synthesized
aaaatattttttacatggag

SEQ ID NO: 182517 - DNA, 20 bp, Artificial Sequence
  chemically synthesized
ttgaaaatattttttacatg

SEQ ID NO: 182518 - DNA, 20 bp, Artificial Sequence
  chemically synthesized
ctttgaaaatattttttaca

SEQ ID NO: 182519 - DNA, 20 bp, Artificial Sequence
  chemically synthesized
ccatgtaaaaaatattttca

SEQ ID NO: 182520 - DNA, 20 bp, Artificial Sequence
  chemically synthesized
tattttcaaagattaatgta

SEQ ID NO: 182521 - DNA, 20 bp, Artificial Sequence
  chemically synthesized
aataaaatagaagaagaaga

SEQ ID NO: 182522 - DNA, 20 bp, Artificial Sequence
  chemically synthesized
agtcaataaaatagaagaag

SEQ ID NO: 182523 - DNA, 20 bp, Artificial Sequence
  chemically synthesized
agaagtcaataaaatagaag

SEQ ID NO: 182524 - DNA, 20 bp, Artificial Sequence
  chemically synthesized
agcagaagtcaataaaatag

SEQ ID NO: 182525 - DNA, 20 bp, Artificial Sequence
  chemically synthesized
tagagcagaagtcaataaaa

SEQ ID NO: 182526 - DNA, 20 bp, Artificial Sequence
  chemically synthesized
aataacgggggttagagcag

SEQ ID NO: 182527 - DNA, 20 bp, Artificial Sequence
  chemically synthesized
ggaaataacgggggttagag

SEQ ID NO: 182528 - DNA, 20 bp, Artificial Sequence
  chemically synthesized
gaaggaaataacgggggtta

SEQ ID NO: 182529 - DNA, 20 bp, Artificial Sequence
  chemically synthesized
aggaaggaaataacgggggt

SEQ ID NO: 182530 - DNA, 20 bp, Artificial Sequence
  chemically synthesized
cataaggaaggaaataacgg

SEQ ID NO: 182531 - DNA, 20 bp, Artificial Sequence
  chemically synthesized
gcataaggaaggaaataacg

SEQ ID NO: 182532 - DNA, 20 bp, Artificial Sequence
  chemically synthesized
agcataaggaaggaaataac

SEQ ID NO: 182533 - DNA, 20 bp, Artificial Sequence
  chemically synthesized
aagcataaggaaggaaataa

SEQ ID NO: 182534 - DNA, 20 bp, Artificial Sequence
  chemically synthesized
gctcgaaggaagcataagga

SEQ ID NO: 182535 - DNA, 20 bp, Artificial Sequence
  chemically synthesized
agctcgaaggaagcataagg

SEQ ID NO: 182536 - DNA, 20 bp, Artificial Sequence
  chemically synthesized
gtaagctcgaaggaagcata

SEQ ID NO: 182537 - DNA, 20 bp, Artificial Sequence
  chemically synthesized
agtaagctcgaaggaagcat

SEQ ID NO: 182538 - DNA, 20 bp, Artificial Sequence
  chemically synthesized
tccttccttatgcttccttc

SEQ ID NO: 182539 - DNA, 20 bp, Artificial Sequence
  chemically synthesized
gaacacagtaagctcgaagg

SEQ ID NO: 182540 - DNA, 20 bp, Artificial Sequence
  chemically synthesized
gaagaacacagtaagctcga

SEQ ID NO: 182541 - DNA, 20 bp, Artificial Sequence
  chemically synthesized
agaagaacacagtaagctcg

SEQ ID NO: 182542 - DNA, 20 bp, Artificial Sequence
  chemically synthesized
tagaaaaagaagaacacagt

SEQ ID NO: 182543 - DNA, 20 bp, Artificial Sequence
  chemically synthesized
aaactagaaaaagaagaaca

SEQ ID NO: 182544 - DNA, 20 bp, Artificial Sequence
  chemically synthesized
ttactgtgttcttctttttc

SEQ ID NO: 182545 - DNA, 20 bp, Artificial Sequence
  chemically synthesized
ccataagaaactagaaaaag

SEQ ID NO: 182546 - DNA, 20 bp, Artificial Sequence
  chemically synthesized
tcgccataagaaactagaaa

SEQ ID NO: 182547 - DNA, 20 bp, Artificial Sequence
  chemically synthesized
aagctttcgccataagaaac

SEQ ID NO: 182548 - DNA, 20 bp, Artificial Sequence
  chemically synthesized
cttctttttctagtttctta

SEQ ID NO: 182549 - DNA, 20 bp, Artificial Sequence
  chemically synthesized
tttctagtttcttatggcga

SEQ ID NO: 182550 - DNA, 20 bp, Artificial Sequence
  chemically synthesized
ttaactcaagctttcgccat

SEQ ID NO: 182551 - DNA, 20 bp, Artificial Sequence
  chemically synthesized
gtttcttatggcgaaagctt

SEQ ID NO: 182552 - DNA, 20 bp, Artificial Sequence
  chemically synthesized
aattcttaaatcattaactc

SEQ ID NO: 182553 - DNA, 20 bp, Artificial Sequence
  chemically synthesized
aaagcttgagttaatgattt

SEQ ID NO: 182554 - DNA, 20 bp, Artificial Sequence
  chemically synthesized
tttaaatacctattttagaa

SEQ ID NO: 182555 - DNA, 20 bp, Artificial Sequence
  chemically synthesized
aattttattcttttctaaaa

SEQ ID NO: 182556 - DNA, 20 bp, Artificial Sequence
  chemically synthesized
attttattcttttctaaaat

SEQ ID NO: 182557 - DNA, 20 bp, Artificial Sequence
  chemically synthesized
ctagttttaaatacctattt

SEQ ID NO: 182558 - DNA, 20 bp, Artificial Sequence
  chemically synthesized
ctaaaataggtatttaaaac

SEQ ID NO: 182559 - DNA, 20 bp, Artificial Sequence
  chemically synthesized
aaataggtatttaaaactag

SEQ ID NO: 182560 - DNA, 20 bp, Artificial Sequence
  chemically synthesized
agtgcttacagggaaacttc

SEQ ID NO: 182561 - DNA, 20 bp, Artificial Sequence
  chemically synthesized
aaaactagaagtttccctgt

SEQ ID NO: 182562 - DNA, 20 bp, Artificial Sequence
  chemically synthesized
taactaaagcagtgcttaca

SEQ ID NO: 182563 - DNA, 20 bp, Artificial Sequence
  chemically synthesized
gtaactaaagcagtgcttac

SEQ ID NO: 182564 - DNA, 20 bp, Artificial Sequence
  chemically synthesized
tgtaactaaagcagtgctta

SEQ ID NO: 182565 - DNA, 20 bp, Artificial Sequence
  chemically synthesized
tttccctgtaagcactgctt

SEQ ID NO: 182566 - DNA, 20 bp, Artificial Sequence
  chemically synthesized
tttataggatgtaactaaag

SEQ ID NO: 182567 - DNA, 20 bp, Artificial Sequence
  chemically synthesized
agatttataggatgtaacta

SEQ ID NO: 182568 - DNA, 20 bp, Artificial Sequence
  chemically synthesized
cacaacatgtcaagatttat

SEQ ID NO: 182569 - DNA, 20 bp, Artificial Sequence
  chemically synthesized
gcacaacatgtcaagattta

SEQ ID NO: 182570 - DNA, 20 bp, Artificial Sequence
  chemically synthesized
aaataaaagcacaacatgtc

SEQ ID NO: 182571 - DNA, 20 bp, Artificial Sequence
  chemically synthesized
tttgaactgaataaaaataa

SEQ ID NO: 182572 - DNA, 20 bp, Artificial Sequence
  chemically synthesized
gttgtgcttttatttttatt

SEQ ID NO: 182573 - DNA, 20 bp, Artificial Sequence
  chemically synthesized
ggttaaaaactaaatcacat

SEQ ID NO: 182574 - DNA, 20 bp, Artificial Sequence
  chemically synthesized
ttataatttcctatgtgatt

SEQ ID NO: 182575 - DNA, 20 bp, Artificial Sequence
  chemically synthesized
tggttaaaaactaaatcaca

SEQ ID NO: 182576 - DNA, 20 bp, Artificial Sequence
  chemically synthesized
gtgatttagtttttaaccaa

SEQ ID NO: 182577 - DNA, 20 bp, Artificial Sequence
  chemically synthesized
tagtttttaaccaatggatt

SEQ ID NO: 182578 - DNA, 20 bp, Artificial Sequence
  chemically synthesized
tcaacaacttctaaatccat

SEQ ID NO: 182579 - DNA, 20 bp, Artificial Sequence
  chemically synthesized
tttttaaccaatggatttag

SEQ ID NO: 182580 - DNA, 20 bp, Artificial Sequence
  chemically synthesized
ttcaacagaaggaaatttgg

SEQ ID NO: 182581 - DNA, 20 bp, Artificial Sequence
  chemically synthesized
gaattcaacagaaggaaatt

SEQ ID NO: 182582 - DNA, 20 bp, Artificial Sequence
  chemically synthesized
ttaaattggaattcaacaga

SEQ ID NO: 182583 - DNA, 20 bp, Artificial Sequence
  chemically synthesized
attaaattggaattcaacag

SEQ ID NO: 182584 - DNA, 20 bp, Artificial Sequence
  chemically synthesized
agaattaaattggaattcaa

SEQ ID NO: 182585 - DNA, 20 bp, Artificial Sequence
  chemically synthesized
ttaatatgtcagaattaaat

SEQ ID NO: 182586 - DNA, 20 bp, Artificial Sequence
  chemically synthesized
caatttaattctgacatatt

SEQ ID NO: 182587 - DNA, 20 bp, Artificial Sequence
  chemically synthesized
attatgttctcttaatatgt

SEQ ID NO: 182588 - DNA, 20 bp, Artificial Sequence
  chemically synthesized
atttaattctgacatattaa

SEQ ID NO: 182589 - DNA, 20 bp, Artificial Sequence
  chemically synthesized
aacataatttttatgaattc

SEQ ID NO: 182590 - DNA, 20 bp, Artificial Sequence
  chemically synthesized
tttatgaattcaagcctgtt

SEQ ID NO: 182591 - DNA, 20 bp, Artificial Sequence
  chemically synthesized
caaatctcaatacactcaac

SEQ ID NO: 182592 - DNA, 20 bp, Artificial Sequence
  chemically synthesized
acaaatctcaatacactcaa

SEQ ID NO: 182593 - DNA, 20 bp, Artificial Sequence
  chemically synthesized
tcaagcctgttgagtgtatt

SEQ ID NO: 182594 - DNA, 20 bp, Artificial Sequence
  chemically synthesized
ttgagatttgttttttgacc

SEQ ID NO: 182595 - DNA, 20 bp, Artificial Sequence
  chemically synthesized
atttgttttttgacctagca

SEQ ID NO: 182596 - DNA, 20 bp, Artificial Sequence
  chemically synthesized
tctgggatagattctatgct

SEQ ID NO: 182597 - DNA, 20 bp, Artificial Sequence
  chemically synthesized
ctctgggatagattctatgc

SEQ ID NO: 182598 - DNA, 20 bp, Artificial Sequence
  chemically synthesized
acctagcatagaatctatcc

SEQ ID NO: 182599 - DNA, 20 bp, Artificial Sequence
  chemically synthesized
ctagcatagaatctatccca

SEQ ID NO: 182600 - DNA, 20 bp, Artificial Sequence
  chemically synthesized
acatgaaattttctctggga

SEQ ID NO: 182601 - DNA, 20 bp, Artificial Sequence
  chemically synthesized
gtgcacatgaaattttctct

SEQ ID NO: 182602 - DNA, 20 bp, Artificial Sequence
  chemically synthesized
agtgcacatgaaattttctc

SEQ ID NO: 182603 - DNA, 20 bp, Artificial Sequence
  chemically synthesized
gcagaatacatattatttta

SEQ ID NO: 182604 - DNA, 20 bp, Artificial Sequence
  chemically synthesized
gagacgccaccaaatgaaag

SEQ ID NO: 182605 - DNA, 20 bp, Artificial Sequence
  chemically synthesized
atatgtattctgctttcatt

SEQ ID NO: 182606 - DNA, 20 bp, Artificial Sequence
  chemically synthesized
taggagacgccaccaaatga

SEQ ID NO: 182607 - DNA, 20 bp, Artificial Sequence
  chemically synthesized
tgtattctgctttcatttgg

SEQ ID NO: 182608 - DNA, 20 bp, Artificial Sequence
  chemically synthesized
gacctaactaacatttatag

SEQ ID NO: 182609 - DNA, 20 bp, Artificial Sequence
  chemically synthesized
ttgacctaactaacatttat

SEQ ID NO: 182610 - DNA, 20 bp, Artificial Sequence
  chemically synthesized
gtggcgtctcctataaatgt

SEQ ID NO: 182611 - DNA, 20 bp, Artificial Sequence
  chemically synthesized
cttgacctaactaacattta

SEQ ID NO: 182612 - DNA, 20 bp, Artificial Sequence
  chemically synthesized
cgtctcctataaatgttagt

SEQ ID NO: 182613 - DNA, 20 bp, Artificial Sequence
  chemically synthesized
gtctcctataaatgttagtt

SEQ ID NO: 182614 - DNA, 20 bp, Artificial Sequence
  chemically synthesized
ctataaatgttagttaggtc

SEQ ID NO: 182615 - DNA, 20 bp, Artificial Sequence
  chemically synthesized
aaatgttagttaggtcaagc

SEQ ID NO: 182616 - DNA, 20 bp, Artificial Sequence
  chemically synthesized
agttaggtcaagctggttga

SEQ ID NO: 182617 - DNA, 20 bp, Artificial Sequence
  chemically synthesized
aattcaccaacactatcaac

SEQ ID NO: 182618 - DNA, 20 bp, Artificial Sequence
  chemically synthesized
gtcaagctggttgatagtgt

SEQ ID NO: 182619 - DNA, 20 bp, Artificial Sequence
  chemically synthesized
gaaaaatagcaacaatatag

SEQ ID NO: 182620 - DNA, 20 bp, Artificial Sequence
  chemically synthesized
acagaaaaatagcaacaata

SEQ ID NO: 182621 - DNA, 20 bp, Artificial Sequence
  chemically synthesized
aggccaattagacagaaaaa

SEQ ID NO: 182622 - DNA, 20 bp, Artificial Sequence
  chemically synthesized
ttgctatttttctgtctaat

SEQ ID NO: 182623 - DNA, 20 bp, Artificial Sequence
  chemically synthesized
tagctggcaggccaattaga

SEQ ID NO: 182624 - DNA, 20 bp, Artificial Sequence
  chemically synthesized
tcaatagctggcaggccaat

SEQ ID NO: 182625 - DNA, 20 bp, Artificial Sequence
  chemically synthesized
tttctgtctaattggcctgc

SEQ ID NO: 182626 - DNA, 20 bp, Artificial Sequence
  chemically synthesized
ccctactctcaatagctggc

SEQ ID NO: 182627 - DNA, 20 bp, Artificial Sequence
  chemically synthesized
accctactctcaatagctgg

SEQ ID NO: 182628 - DNA, 20 bp, Artificial Sequence
  chemically synthesized
taattggcctgccagctatt

SEQ ID NO: 182629 - DNA, 20 bp, Artificial Sequence
  chemically synthesized
caaaccctactctcaatagc

SEQ ID NO: 182630 - DNA, 20 bp, Artificial Sequence
  chemically synthesized
attggcctgccagctattga

SEQ ID NO: 182631 - DNA, 20 bp, Artificial Sequence
  chemically synthesized
ggcctgccagctattgagag

SEQ ID NO: 182632 - DNA, 20 bp, Artificial Sequence
  chemically synthesized
acttcaaaccctactctcaa

SEQ ID NO: 182633 - DNA, 20 bp, Artificial Sequence
  chemically synthesized
gcctgccagctattgagagt

SEQ ID NO: 182634 - DNA, 20 bp, Artificial Sequence
  chemically synthesized
cctgccagctattgagagta

SEQ ID NO: 182635 - DNA, 20 bp, Artificial Sequence
  chemically synthesized
gctattgagagtagggtttg

SEQ ID NO: 182636 - DNA, 20 bp, Artificial Sequence
  chemically synthesized
caattcaacaattattattg

SEQ ID NO: 182637 - DNA, 20 bp, Artificial Sequence
  chemically synthesized
gacaattcaacaattattat

SEQ ID NO: 182638 - DNA, 20 bp, Artificial Sequence
  chemically synthesized
ataataattgttgaattgtc

SEQ ID NO: 182639 - DNA, 20 bp, Artificial Sequence
  chemically synthesized
gacagaattcaaaggagaac

SEQ ID NO: 182640 - DNA, 20 bp, Artificial Sequence
  chemically synthesized
gaaattgacagaattcaaag

SEQ ID NO: 182641 - DNA, 20 bp, Artificial Sequence
  chemically synthesized
cagaaattgacagaattcaa

SEQ ID NO: 182642 - DNA, 20 bp, Artificial Sequence
  chemically synthesized
gcagaaattgacagaattca

SEQ ID NO: 182643 - DNA, 20 bp, Artificial Sequence
  chemically synthesized
ttctatgatgcagaaattga

SEQ ID NO: 182644 - DNA, 20 bp, Artificial Sequence
  chemically synthesized
ttctgtcaatttctgcatca

SEQ ID NO: 182645 - DNA, 20 bp, Artificial Sequence
  chemically synthesized
aagtcccaaattctatgatg

SEQ ID NO: 182646 - DNA, 20 bp, Artificial Sequence
  chemically synthesized
aatttctgcatcatagaatt

SEQ ID NO: 182647 - DNA, 20 bp, Artificial Sequence
  chemically synthesized
atttctgcatcatagaattt

SEQ ID NO: 182648 - DNA, 20 bp, Artificial Sequence
  chemically synthesized
aacgtatataattaatagga

SEQ ID NO: 182649 - DNA, 20 bp, Artificial Sequence
  chemically synthesized
tataaacgtatataattaat

SEQ ID NO: 182650 - DNA, 20 bp, Artificial Sequence
  chemically synthesized
ttataaacgtatataattaa

SEQ ID NO: 182651 - DNA, 20 bp, Artificial Sequence
  chemically synthesized
tatataaggggtcaattaag

SEQ ID NO: 182652 - DNA, 20 bp, Artificial Sequence
  chemically synthesized
aattatataaggggtcaatt

SEQ ID NO: 182653 - DNA, 20 bp, Artificial Sequence
  chemically synthesized
gacatttttaattatataag

SEQ ID NO: 182654 - DNA, 20 bp, Artificial Sequence
  chemically synthesized
agacatttttaattatataa

SEQ ID NO: 182655 - DNA, 20 bp, Artificial Sequence
  chemically synthesized
aagacatttttaattatata

SEQ ID NO: 182656 - DNA, 20 bp, Artificial Sequence
  chemically synthesized
aaagacatttttaattatat

SEQ ID NO: 182657 - DNA, 20 bp, Artificial Sequence
  chemically synthesized
aaaatatgtaacaagagaaa

SEQ ID NO: 182658 - DNA, 20 bp, Artificial Sequence
  chemically synthesized
tatgacaaaatatgtaacaa

SEQ ID NO: 182659 - DNA, 20 bp, Artificial Sequence
  chemically synthesized
tttatgacaaaatatgtaac

SEQ ID NO: 182660 - DNA, 20 bp, Artificial Sequence
  chemically synthesized
ttgttacatattttgtcata

SEQ ID NO: 182661 - DNA, 20 bp, Artificial Sequence
  chemically synthesized
aatactaatgtcagacaaaa

SEQ ID NO: 182662 - DNA, 20 bp, Artificial Sequence
  chemically synthesized
aagtctattttgtctgacat

SEQ ID NO: 182663 - DNA, 20 bp, Artificial Sequence
  chemically synthesized
tgaagtgacaatactaatgt

SEQ ID NO: 182664 - DNA, 20 bp, Artificial Sequence
  chemically synthesized
ttgtttacatataaaaaatg

SEQ ID NO: 182665 - DNA, 20 bp, Artificial Sequence
  chemically synthesized
ttatatgtaaacaatttgca

SEQ ID NO: 182666 - DNA, 20 bp, Artificial Sequence
  chemically synthesized
tataatttcaaagaaaaaag

SEQ ID NO: 182667 - DNA, 20 bp, Artificial Sequence
  chemically synthesized
atataatttcaaagaaaaaa

SEQ ID NO: 182668 - DNA, 20 bp, Artificial Sequence
  chemically synthesized
ccatataatttcaaagaaaa

SEQ ID NO: 182669 - DNA, 20 bp, Artificial Sequence
  chemically synthesized
gccaaaaccatataatttca

SEQ ID NO: 182670 - DNA, 20 bp, Artificial Sequence
  chemically synthesized
cttttttctttgaaattata

SEQ ID NO: 182671 - DNA, 20 bp, Artificial Sequence
  chemically synthesized
tctttgaaattatatggttt

SEQ ID NO: 182672 - DNA, 20 bp, Artificial Sequence
  chemically synthesized
tttaaaagagaaatgtatta

SEQ ID NO: 182673 - DNA, 20 bp, Artificial Sequence
  chemically synthesized
tgtttaaaagagaaatgtat

SEQ ID NO: 182674 - DNA, 20 bp, Artificial Sequence
  chemically synthesized
caaccatagtttgtttaaaa

SEQ ID NO: 182675 - DNA, 20 bp, Artificial Sequence
  chemically synthesized
tccaaccatagtttgtttaa

SEQ ID NO: 182676 - DNA, 20 bp, Artificial Sequence
  chemically synthesized
tttctcttttaaacaaacta

SEQ ID NO: 182677 - DNA, 20 bp, Artificial Sequence
  chemically synthesized
tcttttaaacaaactatggt

SEQ ID NO: 182678 - DNA, 20 bp, Artificial Sequence
  chemically synthesized
ttatttaaaatatccaacca

SEQ ID NO: 182679 - DNA, 20 bp, Artificial Sequence
  chemically synthesized
tataggcagagatttcagac

SEQ ID NO: 182680 - DNA, 20 bp, Artificial Sequence
  chemically synthesized
ttataggcagagatttcaga

SEQ ID NO: 182681 - DNA, 20 bp, Artificial Sequence
  chemically synthesized
ccaattataggcagagattt

SEQ ID NO: 182682 - DNA, 20 bp, Artificial Sequence
  chemically synthesized
aagcattccaattataggca

SEQ ID NO: 182683 - DNA, 20 bp, Artificial Sequence
  chemically synthesized
ctaagcattccaattatagg

SEQ ID NO: 182684 - DNA, 20 bp, Artificial Sequence
  chemically synthesized
ctgaaatctctgcctataat

SEQ ID NO: 182685 - DNA, 20 bp, Artificial Sequence
  chemically synthesized
gaactaagcattccaattat

SEQ ID NO: 182686 - DNA, 20 bp, Artificial Sequence
  chemically synthesized
tgaactaagcattccaatta

SEQ ID NO: 182687 - DNA, 20 bp, Artificial Sequence
  chemically synthesized
ctgcctataattggaatgct

SEQ ID NO: 182688 - DNA, 20 bp, Artificial Sequence
  chemically synthesized
atagtaaatgggagtgaact

SEQ ID NO: 182689 - DNA, 20 bp, Artificial Sequence
  chemically synthesized
tcaatagttatagtaaatgg

SEQ ID NO: 182690 - DNA, 20 bp, Artificial Sequence
  chemically synthesized
tatcaatagttatagtaaat

SEQ ID NO: 182691 - DNA, 20 bp, Artificial Sequence
  chemically synthesized
atatcaatagttatagtaaa

SEQ ID NO: 182692 - DNA, 20 bp, Artificial Sequence
  chemically synthesized
aacctacatatcaatagtta

SEQ ID NO: 182693 - DNA, 20 bp, Artificial Sequence
  chemically synthesized
atactcaacctacatatcaa

SEQ ID NO: 182694 - DNA, 20 bp, Artificial Sequence
  chemically synthesized
ttactataactattgatatg

SEQ ID NO: 182695 - DNA, 20 bp, Artificial Sequence
  chemically synthesized
tactataactattgatatgt

SEQ ID NO: 182696 - DNA, 20 bp, Artificial Sequence
  chemically synthesized
taactattgatatgtaggtt

SEQ ID NO: 182697 - DNA, 20 bp, Artificial Sequence
  chemically synthesized
atcccaagcattttggatat

SEQ ID NO: 182698 - DNA, 20 bp, Artificial Sequence
  chemically synthesized
aatcccaagcattttggata

SEQ ID NO: 182699 - DNA, 20 bp, Artificial Sequence
  chemically synthesized
tatcccatatccaaaatgct

SEQ ID NO: 182700 - DNA, 20 bp, Artificial Sequence
  chemically synthesized
acttccaatcccaagcattt

SEQ ID NO: 182701 - DNA, 20 bp, Artificial Sequence
  chemically synthesized
atcccatatccaaaatgctt

SEQ ID NO: 182702 - DNA, 20 bp, Artificial Sequence
  chemically synthesized
atatccaaaatgcttgggat

SEQ ID NO: 182703 - DNA, 20 bp, Artificial Sequence
  chemically synthesized
tccaaaacacttccaatccc

SEQ ID NO: 182704 - DNA, 20 bp, Artificial Sequence
  chemically synthesized
tccaaaatgcttgggattgg

SEQ ID NO: 182705 - DNA, 20 bp, Artificial Sequence
  chemically synthesized
gcttgggattggaagtgttt

SEQ ID NO: 182706 - DNA, 20 bp, Artificial Sequence
  chemically synthesized
attggaagtgttttggattt

SEQ ID NO: 182707 - DNA, 20 bp, Artificial Sequence
  chemically synthesized
ttttggattttggatttctt

SEQ ID NO: 182708 - DNA, 20 bp, Artificial Sequence
  chemically synthesized
tgcaaatattacaaaatcta

SEQ ID NO: 182709 - DNA, 20 bp, Artificial Sequence
  chemically synthesized
tttgcatatacctaatatct

SEQ ID NO: 182710 - DNA, 20 bp, Artificial Sequence
  chemically synthesized
ggtcctatctccaagatatt

SEQ ID NO: 182711 - DNA, 20 bp, Artificial Sequence
  chemically synthesized
aggtcctatctccaagatat

SEQ ID NO: 182712 - DNA, 20 bp, Artificial Sequence
  chemically synthesized
tgcatatacctaatatcttg

SEQ ID NO: 182713 - DNA, 20 bp, Artificial Sequence
  chemically synthesized
tatacctaatatcttggaga

SEQ ID NO: 182714 - DNA, 20 bp, Artificial Sequence
  chemically synthesized
atacctaatatcttggagat

SEQ ID NO: 182715 - DNA, 20 bp, Artificial Sequence
  chemically synthesized
taaacttaggtcctatctcc

SEQ ID NO: 182716 - DNA, 20 bp, Artificial Sequence
  chemically synthesized
atatcttggagataggacct

SEQ ID NO: 182717 - DNA, 20 bp, Artificial Sequence
  chemically synthesized
tagtatgtgtgtttaaactt

SEQ ID NO: 182718 - DNA, 20 bp, Artificial Sequence
  chemically synthesized
atagtatgtgtgtttaaact

SEQ ID NO: 182719 - DNA, 20 bp, Artificial Sequence
  chemically synthesized
tatatatatatgtatatata

SEQ ID NO: 182720 - DNA, 20 bp, Artificial Sequence
  chemically synthesized
tgtatatatatatatcttaa

SEQ ID NO: 182721 - DNA, 20 bp, Artificial Sequence
  chemically synthesized
atatgtataagatatctatt

SEQ ID NO: 182722 - DNA, 20 bp, Artificial Sequence
  chemically synthesized
tacctccaggttatatgtat

SEQ ID NO: 182723 - DNA, 20 bp, Artificial Sequence
  chemically synthesized
gatatcttatacatataacc

SEQ ID NO: 182724 - DNA, 20 bp, Artificial Sequence
  chemically synthesized
tatcttatacatataacctg

SEQ ID NO: 182725 - DNA, 20 bp, Artificial Sequence
  chemically synthesized
atcttatacatataacctgg

SEQ ID NO: 182726 - DNA, 20 bp, Artificial Sequence
  chemically synthesized
tactttataaaattacctcc

SEQ ID NO: 182727 - DNA, 20 bp, Artificial Sequence
  chemically synthesized
atactttataaaattacctc

SEQ ID NO: 182728 - DNA, 20 bp, Artificial Sequence
  chemically synthesized
aacctggaggtaattttata

SEQ ID NO: 182729 - DNA, 20 bp, Artificial Sequence
  chemically synthesized
tttcatgcaaaaaattattt

SEQ ID NO: 182730 - DNA, 20 bp, Artificial Sequence
  chemically synthesized
ataattttttgcatgaaaca

SEQ ID NO: 182731 - DNA, 20 bp, Artificial Sequence
  chemically synthesized
ttttgcatgaaacaaagttt

SEQ ID NO: 182732 - DNA, 20 bp, Artificial Sequence
  chemically synthesized
aatgagtcacagtcaaaaca

SEQ ID NO: 182733 - DNA, 20 bp, Artificial Sequence
  chemically synthesized
acctgacctgtaatgagtca

SEQ ID NO: 182734 - DNA, 20 bp, Artificial Sequence
  chemically synthesized
gttttgactgtgactcatta

SEQ ID NO: 182735 - DNA, 20 bp, Artificial Sequence
  chemically synthesized
ttttgactgtgactcattac

SEQ ID NO: 182736 - DNA, 20 bp, Artificial Sequence
  chemically synthesized
tttcacacctgacctgtaat

SEQ ID NO: 182737 - DNA, 20 bp, Artificial Sequence
  chemically synthesized
gactgtgactcattacaggt

SEQ ID NO: 182738 - DNA, 20 bp, Artificial Sequence
  chemically synthesized
actgtgactcattacaggtc

SEQ ID NO: 182739 - DNA, 20 bp, Artificial Sequence
  chemically synthesized
ggtgtgaaattttccacttg

SEQ ID NO: 182740 - DNA, 20 bp, Artificial Sequence
  chemically synthesized
ggttgatataataccacaag

SEQ ID NO: 182741 - DNA, 20 bp, Artificial Sequence
  chemically synthesized
gaaggttgatataataccac

SEQ ID NO: 182742 - DNA, 20 bp, Artificial Sequence
  chemically synthesized
tgtggtattatatcaacctt

SEQ ID NO: 182743 - DNA, 20 bp, Artificial Sequence
  chemically synthesized
gtattatatcaaccttcaga

SEQ ID NO: 182744 - DNA, 20 bp, Artificial Sequence
  chemically synthesized
taaaatgtgaaactttctga

SEQ ID NO: 182745 - DNA, 20 bp, Artificial Sequence
  chemically synthesized
ctaaaatgtgaaactttctg

SEQ ID NO: 182746 - DNA, 20 bp, Artificial Sequence
  chemically synthesized
cttcagaaagtttcacattt

SEQ ID NO: 182747 - DNA, 20 bp, Artificial Sequence
  chemically synthesized
tcagaaagtttcacatttta

SEQ ID NO: 182748 - DNA, 20 bp, Artificial Sequence
  chemically synthesized
ttttagagcatttcaaattt

SEQ ID NO: 182749 - DNA, 20 bp, Artificial Sequence
  chemically synthesized
caaatttcagatttttttaa

SEQ ID NO: 182750 - DNA, 20 bp, Artificial Sequence
  chemically synthesized
aaatttcagatttttttaat

SEQ ID NO: 182751 - DNA, 20 bp, Artificial Sequence
  chemically synthesized
taatgggaattctcaacttt

SEQ ID NO: 182752 - DNA, 20 bp, Artificial Sequence
  chemically synthesized
tgtaattgcaactaaaagtt

SEQ ID NO: 182753 - DNA, 20 bp, Artificial Sequence
  chemically synthesized
gcacatgtaattgcaactaa

SEQ ID NO: 182754 - DNA, 20 bp, Artificial Sequence
  chemically synthesized
agatgtgaaaaaatacaata

SEQ ID NO: 182755 - DNA, 20 bp, Artificial Sequence
  chemically synthesized
ggaacaaaaaagacatgaat

SEQ ID NO: 182756 - DNA, 20 bp, Artificial Sequence
  chemically synthesized
aaggagaaacaggaacaaaa

SEQ ID NO: 182757 - DNA, 20 bp, Artificial Sequence
  chemically synthesized
cagtgcagtaaaggagaaac

SEQ ID NO: 182758 - DNA, 20 bp, Artificial Sequence
  chemically synthesized
acagtgcagtaaaggagaaa

SEQ ID NO: 182759 - DNA, 20 bp, Artificial Sequence
  chemically synthesized
aacaagacagtgcagtaaag

SEQ ID NO: 182760 - DNA, 20 bp, Artificial Sequence
  chemically synthesized
ctaacaagacagtgcagtaa

SEQ ID NO: 182761 - DNA, 20 bp, Artificial Sequence
  chemically synthesized
actaacaagacagtgcagta

SEQ ID NO: 182762 - DNA, 20 bp, Artificial Sequence
  chemically synthesized
aaataactaacaagacagtg

SEQ ID NO: 182763 - DNA, 20 bp, Artificial Sequence
  chemically synthesized
cctttactgcactgtcttgt

SEQ ID NO: 182764 - DNA, 20 bp, Artificial Sequence
  chemically synthesized
actaaaaataactaacaaga

SEQ ID NO: 182765 - DNA, 20 bp, Artificial Sequence
  chemically synthesized
acacactaaaaataactaac

SEQ ID NO: 182766 - DNA, 20 bp, Artificial Sequence
  chemically synthesized
actgtcttgttagttatttt

SEQ ID NO: 182767 - DNA, 20 bp, Artificial Sequence
  chemically synthesized
gcaagcactaagaaaataaa

SEQ ID NO: 182768 - DNA, 20 bp, Artificial Sequence
  chemically synthesized
tttttaactatttattttct

SEQ ID NO: 182769 - DNA, 20 bp, Artificial Sequence
  chemically synthesized
taatctttagagcaagcact

SEQ ID NO: 182770 - DNA, 20 bp, Artificial Sequence
  chemically synthesized
ttttcttagtgcttgctcta

SEQ ID NO: 182771 - DNA, 20 bp, Artificial Sequence
  chemically synthesized
gcatatgtaatctttagagc

SEQ ID NO: 182772 - DNA, 20 bp, Artificial Sequence
  chemically synthesized
agatgcatatgtaatcttta

SEQ ID NO: 182773 - DNA, 20 bp, Artificial Sequence
  chemically synthesized
taagatgcatatgtaatctt

SEQ ID NO: 182774 - DNA, 20 bp, Artificial Sequence
  chemically synthesized
taagtaaattatgatcaatt

SEQ ID NO: 182775 - DNA, 20 bp, Artificial Sequence
  chemically synthesized
taattgatcataatttactt

SEQ ID NO: 182776 - DNA, 20 bp, Artificial Sequence
  chemically synthesized
tgttaaattagtttgaactt

SEQ ID NO: 182777 - DNA, 20 bp, Artificial Sequence
  chemically synthesized
taaattttactgtgttaaat

SEQ ID NO: 182778 - DNA, 20 bp, Artificial Sequence
  chemically synthesized
aagttcaaactaatttaaca

SEQ ID NO: 182779 - DNA, 20 bp, Artificial Sequence
  chemically synthesized
taatttaacacagtaaaatt

SEQ ID NO: 182780 - DNA, 20 bp, Artificial Sequence
  chemically synthesized
tttagatatttttctctgct

SEQ ID NO: 182781 - DNA, 20 bp, Artificial Sequence
  chemically synthesized
agcaaaaatggagcttagca

SEQ ID NO: 182782 - DNA, 20 bp, Artificial Sequence
  chemically synthesized
ggagcaaaaatggagcttag

SEQ ID NO: 182783 - DNA, 20 bp, Artificial Sequence
  chemically synthesized
ggaggagcaaaaatggagct

SEQ ID NO: 182784 - DNA, 20 bp, Artificial Sequence
  chemically synthesized
aagcaggaggagcaaaaatg

SEQ ID NO: 182785 - DNA, 20 bp, Artificial Sequence
  chemically synthesized
ataagcaggaggagcaaaaa

SEQ ID NO: 182786 - DNA, 20 bp, Artificial Sequence
  chemically synthesized
attgtgtttataagcaggag

SEQ ID NO: 182787 - DNA, 20 bp, Artificial Sequence
  chemically synthesized
ttattgtgtttataagcagg

SEQ ID NO: 182788 - DNA, 20 bp, Artificial Sequence
  chemically synthesized
gttattgtgtttataagcag

SEQ ID NO: 182789 - DNA, 20 bp, Artificial Sequence
  chemically synthesized
gtgttattgtgtttataagc

SEQ ID NO: 182790 - DNA, 20 bp, Artificial Sequence
  chemically synthesized
tgtgttattgtgtttataag

SEQ ID NO: 182791 - DNA, 20 bp, Artificial Sequence
  chemically synthesized
cattgtgttattgtgtttat

SEQ ID NO: 182792 - DNA, 20 bp, Artificial Sequence
  chemically synthesized
ttataatttttatgcaatct

SEQ ID NO: 182793 - DNA, 20 bp, Artificial Sequence
  chemically synthesized
tataatttttatgcaatctt

SEQ ID NO: 182794 - DNA, 20 bp, Artificial Sequence
  chemically synthesized
ttaacttctttaaaagacct

SEQ ID NO: 182795 - DNA, 20 bp, Artificial Sequence
  chemically synthesized
atgcaatcttaggtctttta

SEQ ID NO: 182796 - DNA, 20 bp, Artificial Sequence
  chemically synthesized
caatcttaggtcttttaaag

SEQ ID NO: 182797 - DNA, 20 bp, Artificial Sequence
  chemically synthesized
tcttcttttaacttctttaa

SEQ ID NO: 182798 - DNA, 20 bp, Artificial Sequence
  chemically synthesized
aggtcttttaaagaagttaa

SEQ ID NO: 182799 - DNA, 20 bp, Artificial Sequence
  chemically synthesized
tcttttaaagaagttaaaag

SEQ ID NO: 182800 - DNA, 20 bp, Artificial Sequence
  chemically synthesized
tataaaagactgtacaaata

SEQ ID NO: 182801 - DNA, 20 bp, Artificial Sequence
  chemically synthesized
aacatatatctatatttgta

SEQ ID NO: 182802 - DNA, 20 bp, Artificial Sequence
  chemically synthesized
aaatatgtagatacatataa

SEQ ID NO: 182803 - DNA, 20 bp, Artificial Sequence
  chemically synthesized
tcacagaactgataaatatg

SEQ ID NO: 182804 - DNA, 20 bp, Artificial Sequence
  chemically synthesized
atatgtatctacatatttat

SEQ ID NO: 182805 - DNA, 20 bp, Artificial Sequence
  chemically synthesized
aatgaagagataaagaatca

SEQ ID NO: 182806 - DNA, 20 bp, Artificial Sequence
  chemically synthesized
cgaacccaaatgaagagata

SEQ ID NO: 182807 - DNA, 20 bp, Artificial Sequence
  chemically synthesized
tgattctttatctcttcatt

SEQ ID NO: 182808 - DNA, 20 bp, Artificial Sequence
  chemically synthesized
gattctttatctcttcattt

SEQ ID NO: 182809 - DNA, 20 bp, Artificial Sequence
  chemically synthesized
gtaactcgaacccaaatgaa

SEQ ID NO: 182810 - DNA, 20 bp, Artificial Sequence
  chemically synthesized
cagtaactcgaacccaaatg

SEQ ID NO: 182811 - DNA, 20 bp, Artificial Sequence
  chemically synthesized
ttatctcttcatttgggttc

SEQ ID NO: 182812 - DNA, 20 bp, Artificial Sequence
  chemically synthesized
ggctgaaaagaagtgatatt

SEQ ID NO: 182813 - DNA, 20 bp, Artificial Sequence
  chemically synthesized
tactgaatatcacttctttt

SEQ ID NO: 182814 - DNA, 20 bp, Artificial Sequence
  chemically synthesized
aagtcattcaggctgaaaag

SEQ ID NO: 182815 - DNA, 20 bp, Artificial Sequence
  chemically synthesized
ataaagtcattcaggctgaa

SEQ ID NO: 182816 - DNA, 20 bp, Artificial Sequence
  chemically synthesized
aaaactaaataaagtcattc

SEQ ID NO: 182817 - DNA, 20 bp, Artificial Sequence
  chemically synthesized
aaaaactaaataaagtcatt

SEQ ID NO: 182818 - DNA, 20 bp, Artificial Sequence
  chemically synthesized
tcagcctgaatgactttatt

SEQ ID NO: 182819 - DNA, 20 bp, Artificial Sequence
  chemically synthesized
ttacaagaaaaaactaaata

SEQ ID NO: 182820 - DNA, 20 bp, Artificial Sequence
  chemically synthesized
tttatttagttttttcttgt

SEQ ID NO: 182821 - DNA, 20 bp, Artificial Sequence
  chemically synthesized
tttagttttttcttgtaagt

SEQ ID NO: 182822 - DNA, 20 bp, Artificial Sequence
  chemically synthesized
ttagttttttcttgtaagtc

SEQ ID NO: 182823 - DNA, 20 bp, Artificial Sequence
  chemically synthesized
tgctagctgacctgacttac

SEQ ID NO: 182824 - DNA, 20 bp, Artificial Sequence
  chemically synthesized
ttttttcttgtaagtcaggt

SEQ ID NO: 182825 - DNA, 20 bp, Artificial Sequence
  chemically synthesized
ttcttgtaagtcaggtcagc

SEQ ID NO: 182826 - DNA, 20 bp, Artificial Sequence
  chemically synthesized
tgtaagtcaggtcagctagc

SEQ ID NO: 182827 - DNA, 20 bp, Artificial Sequence
  chemically synthesized
agaatgagaatatttcttgc

SEQ ID NO: 182828 - DNA, 20 bp, Artificial Sequence
  chemically synthesized
tatattaccaagttgagaat

SEQ ID NO: 182829 - DNA, 20 bp, Artificial Sequence
  chemically synthesized
aaatattctcattctcaact

SEQ ID NO: 182830 - DNA, 20 bp, Artificial Sequence
  chemically synthesized
aataaatatattaccaagtt

SEQ ID NO: 182831 - DNA, 20 bp, Artificial Sequence
  chemically synthesized
ggtaaaataaatatattacc

SEQ ID NO: 182832 - DNA, 20 bp, Artificial Sequence
  chemically synthesized
aaactatccttcaaaaatat

SEQ ID NO: 182833 - DNA, 20 bp, Artificial Sequence
  chemically synthesized
aaaactatccttcaaaaata

SEQ ID NO: 182834 - DNA, 20 bp, Artificial Sequence
  chemically synthesized
ttattttacctatatttttg

SEQ ID NO: 182835 - DNA, 20 bp, Artificial Sequence
  chemically synthesized
tattttacctatatttttga

SEQ ID NO: 182836 - DNA, 20 bp, Artificial Sequence
  chemically synthesized
ttacctatatttttgaagga

SEQ ID NO: 182837 - DNA, 20 bp, Artificial Sequence
  chemically synthesized
aaggatagttttgttttatg

SEQ ID NO: 182838 - DNA, 20 bp, Artificial Sequence
  chemically synthesized
tttgttttatgcggaattct

SEQ ID NO: 182839 - DNA, 20 bp, Artificial Sequence
  chemically synthesized
ttttatgcggaattcttggt

SEQ ID NO: 182840 - DNA, 20 bp, Artificial Sequence
  chemically synthesized
agaacacaaaattgccaacc

SEQ ID NO: 182841 - DNA, 20 bp, Artificial Sequence
  chemically synthesized
ttggcaattttgtgttctct

SEQ ID NO: 182842 - DNA, 20 bp, Artificial Sequence
  chemically synthesized
tgacatattcagagttctca

SEQ ID NO: 182843 - DNA, 20 bp, Artificial Sequence
  chemically synthesized
aatgacatattcagagttct

SEQ ID NO: 182844 - DNA, 20 bp, Artificial Sequence
  chemically synthesized
gtattgaaatgacatattca

SEQ ID NO: 182845 - DNA, 20 bp, Artificial Sequence
  chemically synthesized
aggtattgaaatgacatatt

SEQ ID NO: 182846 - DNA, 20 bp, Artificial Sequence
  chemically synthesized
atatgtcatttcaatacctc

SEQ ID NO: 182847 - DNA, 20 bp, Artificial Sequence
  chemically synthesized
tcataaacaatagaggccag

SEQ ID NO: 182848 - DNA, 20 bp, Artificial Sequence
  chemically synthesized
atcataaacaatagaggcca

SEQ ID NO: 182849 - DNA, 20 bp, Artificial Sequence
  chemically synthesized
tcatcataaacaatagaggc

SEQ ID NO: 182850 - DNA, 20 bp, Artificial Sequence
  chemically synthesized
tttctcatcataaacaatag

SEQ ID NO: 182851 - DNA, 20 bp, Artificial Sequence
  chemically synthesized
atttctcatcataaacaata

SEQ ID NO: 182852 - DNA, 20 bp, Artificial Sequence
  chemically synthesized
taatttctcatcataaacaa

SEQ ID NO: 182853 - DNA, 20 bp, Artificial Sequence
  chemically synthesized
tggcctctattgtttatgat

SEQ ID NO: 182854 - DNA, 20 bp, Artificial Sequence
  chemically synthesized
tacagggatcacatgattga

SEQ ID NO: 182855 - DNA, 20 bp, Artificial Sequence
  chemically synthesized
atcatgtgatccctgtacat

SEQ ID NO: 182856 - DNA, 20 bp, Artificial Sequence
  chemically synthesized
aaaatgactcctcatgtaca

SEQ ID NO: 182857 - DNA, 20 bp, Artificial Sequence
  chemically synthesized
tcatgtgatccctgtacatg

SEQ ID NO: 182858 - DNA, 20 bp, Artificial Sequence
  chemically synthesized
aaaaatgactcctcatgtac

SEQ ID NO: 182859 - DNA, 20 bp, Artificial Sequence
  chemically synthesized
aaaaaatgactcctcatgta

SEQ ID NO: 182860 - DNA, 20 bp, Artificial Sequence
  chemically synthesized
atgtgatccctgtacatgag

SEQ ID NO: 182861 - DNA, 20 bp, Artificial Sequence
  chemically synthesized
catgaggagtcatttttttc

SEQ ID NO: 182862 - DNA, 20 bp, Artificial Sequence
  chemically synthesized
gggaaagtctttaaaacaac

SEQ ID NO: 182863 - DNA, 20 bp, Artificial Sequence
  chemically synthesized
atttttttctggttgtttta

SEQ ID NO: 182864 - DNA, 20 bp, Artificial Sequence
  chemically synthesized
ttattgaaagacaaatggga

SEQ ID NO: 182865 - DNA, 20 bp, Artificial Sequence
  chemically synthesized
gaaattattgaaagacaaat

SEQ ID NO: 182866 - DNA, 20 bp, Artificial Sequence
  chemically synthesized
tgaaattattgaaagacaaa

SEQ ID NO: 182867 - DNA, 20 bp, Artificial Sequence
  chemically synthesized
gtttcatttgaaattattga

SEQ ID NO: 182868 - DNA, 20 bp, Artificial Sequence
  chemically synthesized
ttcaaatgaaactatttcaa

SEQ ID NO: 182869 - DNA, 20 bp, Artificial Sequence
  chemically synthesized
taagagtcaaactattgaaa

SEQ ID NO: 182870 - DNA, 20 bp, Artificial Sequence
  chemically synthesized
atcaataccctaaaacataa

SEQ ID NO: 182871 - DNA, 20 bp, Artificial Sequence
  chemically synthesized
atagtttgactcttatgttt

SEQ ID NO: 182872 - DNA, 20 bp, Artificial Sequence
  chemically synthesized
tagtttgactcttatgtttt

SEQ ID NO: 182873 - DNA, 20 bp, Artificial Sequence
  chemically synthesized
agatcaataccctaaaacat

SEQ ID NO: 182874 - DNA, 20 bp, Artificial Sequence
  chemically synthesized
agtttgactcttatgtttta

SEQ ID NO: 182875 - DNA, 20 bp, Artificial Sequence
  chemically synthesized
ccaaatagaataaacacgaa

SEQ ID NO: 182876 - DNA, 20 bp, Artificial Sequence
  chemically synthesized
ccccaaatagaataaacacg

SEQ ID NO: 182877 - DNA, 20 bp, Artificial Sequence
  chemically synthesized
ctcttcgtgtttattctatt

SEQ ID NO: 182878 - DNA, 20 bp, Artificial Sequence
  chemically synthesized
tcttcgtgtttattctattt

SEQ ID NO: 182879 - DNA, 20 bp, Artificial Sequence
  chemically synthesized
cttcgtgtttattctatttg

SEQ ID NO: 182880 - DNA, 20 bp, Artificial Sequence
  chemically synthesized
taagctcaacaaaccccaaa

SEQ ID NO: 182881 - DNA, 20 bp, Artificial Sequence
  chemically synthesized
tattctatttggggtttgtt

SEQ ID NO: 182882 - DNA, 20 bp, Artificial Sequence
  chemically synthesized
aacacttcacaaatacggtt

SEQ ID NO: 182883 - DNA, 20 bp, Artificial Sequence
  chemically synthesized
ggccaaacacttcacaaata

SEQ ID NO: 182884 - DNA, 20 bp, Artificial Sequence
  chemically synthesized
tgagcttaaccgtatttgtg

SEQ ID NO: 182885 - DNA, 20 bp, Artificial Sequence
  chemically synthesized
aaccgtatttgtgaagtgtt

SEQ ID NO: 182886 - DNA, 20 bp, Artificial Sequence
  chemically synthesized
aaaattatttgaagaaataa

SEQ ID NO: 182887 - DNA, 20 bp, Artificial Sequence
  chemically synthesized
agaggcagaaaaattatttg

SEQ ID NO: 182888 - DNA, 20 bp, Artificial Sequence
  chemically synthesized
agagaatgttgttaaagagg

SEQ ID NO: 182889 - DNA, 20 bp, Artificial Sequence
  chemically synthesized
aaaagagaatgttgttaaag

SEQ ID NO: 182890 - DNA, 20 bp, Artificial Sequence
  chemically synthesized
aaaaagagaatgttgttaaa

SEQ ID NO: 182891 - DNA, 20 bp, Artificial Sequence
  chemically synthesized
aaaaaaagagaatgttgtta

SEQ ID NO: 182892 - DNA, 20 bp, Artificial Sequence
  chemically synthesized
acaagagttccagaaaaaaa

SEQ ID NO: 182893 - DNA, 20 bp, Artificial Sequence
  chemically synthesized
aacaacattctctttttttc

SEQ ID NO: 182894 - DNA, 20 bp, Artificial Sequence
  chemically synthesized
ttacaagagttccagaaaaa

SEQ ID NO: 182895 - DNA, 20 bp, Artificial Sequence
  chemically synthesized
tgtagatgttacaagagttc

SEQ ID NO: 182896 - DNA, 20 bp, Artificial Sequence
  chemically synthesized
tatcaatgtagatgttacaa

SEQ ID NO: 182897 - DNA, 20 bp, Artificial Sequence
  chemically synthesized
catatcaatgtagatgttac

SEQ ID NO: 182898 - DNA, 20 bp, Artificial Sequence
  chemically synthesized
aaacattgagcatatcaatg

SEQ ID NO: 182899 - DNA, 20 bp, Artificial Sequence
  chemically synthesized
tagctttgtgtcaaaacatt

SEQ ID NO: 182900 - DNA, 20 bp, Artificial Sequence
  chemically synthesized
atgctcaatgttttgacaca

SEQ ID NO: 182901 - DNA, 20 bp, Artificial Sequence
  chemically synthesized
taaaaaacgaacatgagtca

SEQ ID NO: 182902 - DNA, 20 bp, Artificial Sequence
  chemically synthesized
acagtataaaaaacgaacat

SEQ ID NO: 182903 - DNA, 20 bp, Artificial Sequence
  chemically synthesized
tctgaatgtcagaggtaaaa

SEQ ID NO: 182904 - DNA, 20 bp, Artificial Sequence
  chemically synthesized
ttatccaatctgaatgtcag

SEQ ID NO: 182905 - DNA, 20 bp, Artificial Sequence
  chemically synthesized
actgttttacctctgacatt

SEQ ID NO: 182906 - DNA, 20 bp, Artificial Sequence
  chemically synthesized
attatccaatctgaatgtca

SEQ ID NO: 182907 - DNA, 20 bp, Artificial Sequence
  chemically synthesized
aaattatccaatctgaatgt

SEQ ID NO: 182908 - DNA, 20 bp, Artificial Sequence
  chemically synthesized
tttacctctgacattcagat

SEQ ID NO: 182909 - DNA, 20 bp, Artificial Sequence
  chemically synthesized
aaaatcagtaaatttgaaaa

SEQ ID NO: 182910 - DNA, 20 bp, Artificial Sequence
  chemically synthesized
agacagaaaaaaaaaaaaat

SEQ ID NO: 182911 - DNA, 20 bp, Artificial Sequence
  chemically synthesized
ctcaagagcagatagtaaga

SEQ ID NO: 182912 - DNA, 20 bp, Artificial Sequence
  chemically synthesized
ggggctcaagagcagatagt

SEQ ID NO: 182913 - DNA, 20 bp, Artificial Sequence
  chemically synthesized
taatggggctcaagagcaga

SEQ ID NO: 182914 - DNA, 20 bp, Artificial Sequence
  chemically synthesized
ctgtcttactatctgctctt

SEQ ID NO: 182915 - DNA, 20 bp, Artificial Sequence
  chemically synthesized
tcactaatggggctcaagag

SEQ ID NO: 182916 - DNA, 20 bp, Artificial Sequence
  chemically synthesized
aaatcactaatggggctcaa

SEQ ID NO: 182917 - DNA, 20 bp, Artificial Sequence
  chemically synthesized
aaaaatcactaatggggctc

SEQ ID NO: 182918 - DNA, 20 bp, Artificial Sequence
  chemically synthesized
tatctgctcttgagccccat

SEQ ID NO: 182919 - DNA, 20 bp, Artificial Sequence
  chemically synthesized
atttaaaaaaatcactaatg

SEQ ID NO: 182920 - DNA, 20 bp, Artificial Sequence
  chemically synthesized
aatttaaaaaaatcactaat

SEQ ID NO: 182921 - DNA, 20 bp, Artificial Sequence
  chemically synthesized
aaatttaaaaaaatcactaa

SEQ ID NO: 182922 - DNA, 20 bp, Artificial Sequence
  chemically synthesized
ttagtgatttttttaaattt

SEQ ID NO: 182923 - DNA, 20 bp, Artificial Sequence
  chemically synthesized
aaaattctagaattggaaag

SEQ ID NO: 182924 - DNA, 20 bp, Artificial Sequence
  chemically synthesized
atgaaaattctagaattgga

SEQ ID NO: 182925 - DNA, 20 bp, Artificial Sequence
  chemically synthesized
gttattctactttccaattc

SEQ ID NO: 182926 - DNA, 20 bp, Artificial Sequence
  chemically synthesized
ccaaatgaaaattctagaat

SEQ ID NO: 182927 - DNA, 20 bp, Artificial Sequence
  chemically synthesized
aaagaaccaaatgaaaattc

SEQ ID NO: 182928 - DNA, 20 bp, Artificial Sequence
  chemically synthesized
ccaattctagaattttcatt

SEQ ID NO: 182929 - DNA, 20 bp, Artificial Sequence
  chemically synthesized
tttcatttggttcttttata

SEQ ID NO: 182930 - DNA, 20 bp, Artificial Sequence
  chemically synthesized
aaaagatacacactatataa

SEQ ID NO: 182931 - DNA, 20 bp, Artificial Sequence
  chemically synthesized
tttatatagtgtgtatcttt

SEQ ID NO: 182932 - DNA, 20 bp, Artificial Sequence
  chemically synthesized
atagtgtgtatcttttagtt

SEQ ID NO: 182933 - DNA, 20 bp, Artificial Sequence
  chemically synthesized
aaatagagaatctcaactaa

SEQ ID NO: 182934 - DNA, 20 bp, Artificial Sequence
  chemically synthesized
tagttgagattctctatttg

SEQ ID NO: 182935 - DNA, 20 bp, Artificial Sequence
  chemically synthesized
ggtaacaataactacaaata

SEQ ID NO: 182936 - DNA, 20 bp, Artificial Sequence
  chemically synthesized
atggtaacaataactacaaa

SEQ ID NO: 182937 - DNA, 20 bp, Artificial Sequence
  chemically synthesized
taaataattaaatgaaagta

SEQ ID NO: 182938 - DNA, 20 bp, Artificial Sequence
  chemically synthesized
atgtttaaataattaaatga

SEQ ID NO: 182939 - DNA, 20 bp, Artificial Sequence
  chemically synthesized
tatttaaacatgcttttctt

SEQ ID NO: 182940 - DNA, 20 bp, Artificial Sequence
  chemically synthesized
accttcaaacaactgaagaa

SEQ ID NO: 182941 - DNA, 20 bp, Artificial Sequence
  chemically synthesized
taaataccttcaaacaactg

SEQ ID NO: 182942 - DNA, 20 bp, Artificial Sequence
  chemically synthesized
tgcttttcttcagttgtttg

SEQ ID NO: 182943 - DNA, 20 bp, Artificial Sequence
  chemically synthesized
gcttttcttcagttgtttga

SEQ ID NO: 182944 - DNA, 20 bp, Artificial Sequence
  chemically synthesized
cagttgtttgaaggtattta

SEQ ID NO: 182945 - DNA, 20 bp, Artificial Sequence
  chemically synthesized
ttgtttgaaggtatttatag

SEQ ID NO: 182946 - DNA, 20 bp, Artificial Sequence
  chemically synthesized
tgtttgaaggtatttatagt

SEQ ID NO: 182947 - DNA, 20 bp, Artificial Sequence
  chemically synthesized
tttgaaggtatttatagtag

SEQ ID NO: 182948 - DNA, 20 bp, Artificial Sequence
  chemically synthesized
tatttatagtaggagccttt

SEQ ID NO: 182949 - DNA, 20 bp, Artificial Sequence
  chemically synthesized
attggcagatagagacttaa

SEQ ID NO: 182950 - DNA, 20 bp, Artificial Sequence
  chemically synthesized
tattggcagatagagactta

SEQ ID NO: 182951 - DNA, 20 bp, Artificial Sequence
  chemically synthesized
ggcccaggtattggcagata

SEQ ID NO: 182952 - DNA, 20 bp, Artificial Sequence
  chemically synthesized
ttggcccaggtattggcaga

SEQ ID NO: 182953 - DNA, 20 bp, Artificial Sequence
  chemically synthesized
tgaattggcccaggtattgg

SEQ ID NO: 182954 - DNA, 20 bp, Artificial Sequence
  chemically synthesized
agtctctatctgccaatacc

SEQ ID NO: 182955 - DNA, 20 bp, Artificial Sequence
  chemically synthesized
gtctctatctgccaatacct

SEQ ID NO: 182956 - DNA, 20 bp, Artificial Sequence
  chemically synthesized
ctctgaattggcccaggtat

SEQ ID NO: 182957 - DNA, 20 bp, Artificial Sequence
  chemically synthesized
agttgtctctgaattggccc

SEQ ID NO: 182958 - DNA, 20 bp, Artificial Sequence
  chemically synthesized
aagttgtctctgaattggcc

SEQ ID NO: 182959 - DNA, 20 bp, Artificial Sequence
  chemically synthesized
tgccaatacctgggccaatt

SEQ ID NO: 182960 - DNA, 20 bp, Artificial Sequence
  chemically synthesized
ccaatacctgggccaattca

SEQ ID NO: 182961 - DNA, 20 bp, Artificial Sequence
  chemically synthesized
aacaaaagttgtctctgaat

SEQ ID NO: 182962 - DNA, 20 bp, Artificial Sequence
  chemically synthesized
tggggaaaagcagtcaacaa

SEQ ID NO: 182963 - DNA, 20 bp, Artificial Sequence
  chemically synthesized
cccattctcatggggaaaag

SEQ ID NO: 182964 - DNA, 20 bp, Artificial Sequence
  chemically synthesized
tgacccattctcatggggaa

SEQ ID NO: 182965 - DNA, 20 bp, Artificial Sequence
  chemically synthesized
tgttgactgcttttccccat

SEQ ID NO: 182966 - DNA, 20 bp, Artificial Sequence
  chemically synthesized
aactgtgacccattctcatg

SEQ ID NO: 182967 - DNA, 20 bp, Artificial Sequence
  chemically synthesized
actgcttttccccatgagaa

SEQ ID NO: 182968 - DNA, 20 bp, Artificial Sequence
  chemically synthesized
caactgtgacccattctcat

SEQ ID NO: 182969 - DNA, 20 bp, Artificial Sequence
  chemically synthesized
ctgcttttccccatgagaat

SEQ ID NO: 182970 - DNA, 20 bp, Artificial Sequence
  chemically synthesized
tcaactgtgacccattctca

SEQ ID NO: 182971 - DNA, 20 bp, Artificial Sequence
  chemically synthesized
ttccccatgagaatgggtca

SEQ ID NO: 182972 - DNA, 20 bp, Artificial Sequence
  chemically synthesized
atttaaaatgtcaaattttc

SEQ ID NO: 182973 - DNA, 20 bp, Artificial Sequence
  chemically synthesized
acattttaaataacatatta

SEQ ID NO: 182974 - DNA, 20 bp, Artificial Sequence
  chemically synthesized
cattttaaataacatattaa

SEQ ID NO: 182975 - DNA, 20 bp, Artificial Sequence
  chemically synthesized
ttttaaataacatattaaag

SEQ ID NO: 182976 - DNA, 20 bp, Artificial Sequence
  chemically synthesized
agaaggaacatcagaatttg

SEQ ID NO: 182977 - DNA, 20 bp, Artificial Sequence
  chemically synthesized
aagaaggaacatcagaattt

SEQ ID NO: 182978 - DNA, 20 bp, Artificial Sequence
  chemically synthesized
taagaaggaacatcagaatt

SEQ ID NO: 182979 - DNA, 20 bp, Artificial Sequence
  chemically synthesized
ctgggcataagaaggaacat

SEQ ID NO: 182980 - DNA, 20 bp, Artificial Sequence
  chemically synthesized
aaaaaacgctgggcataaga

SEQ ID NO: 182981 - DNA, 20 bp, Artificial Sequence
  chemically synthesized
taaaaaacgctgggcataag

SEQ ID NO: 182982 - DNA, 20 bp, Artificial Sequence
  chemically synthesized
ctgatgttccttcttatgcc

SEQ ID NO: 182983 - DNA, 20 bp, Artificial Sequence
  chemically synthesized
atttaaaaaacgctgggcat

SEQ ID NO: 182984 - DNA, 20 bp, Artificial Sequence
  chemically synthesized
acttcaatttaaaaaacgct

SEQ ID NO: 182985 - DNA, 20 bp, Artificial Sequence
  chemically synthesized
aacttcaatttaaaaaacgc

SEQ ID NO: 182986 - DNA, 20 bp, Artificial Sequence
  chemically synthesized
gcccagcgttttttaaattg

SEQ ID NO: 182987 - DNA, 20 bp, Artificial Sequence
  chemically synthesized
tgaagttttaataacttgcc

SEQ ID NO: 182988 - DNA, 20 bp, Artificial Sequence
  chemically synthesized
tccacagatttcatctaggc

SEQ ID NO: 182989 - DNA, 20 bp, Artificial Sequence
  chemically synthesized
agattccacagatttcatct

SEQ ID NO: 182990 - DNA, 20 bp, Artificial Sequence
  chemically synthesized
cagattccacagatttcatc

SEQ ID NO: 182991 - DNA, 20 bp, Artificial Sequence
  chemically synthesized
acttgcctagatgaaatctg

SEQ ID NO: 182992 - DNA, 20 bp, Artificial Sequence
  chemically synthesized
ctgtggggaaacagattcca

SEQ ID NO: 182993 - DNA, 20 bp, Artificial Sequence
  chemically synthesized
agccacacactgtggggaaa

SEQ ID NO: 182994 - DNA, 20 bp, Artificial Sequence
  chemically synthesized
ctgtggaatctgtttcccca

SEQ ID NO: 182995 - DNA, 20 bp, Artificial Sequence
  chemically synthesized
atcaacagccacacactgtg

SEQ ID NO: 182996 - DNA, 20 bp, Artificial Sequence
  chemically synthesized
tatcaacagccacacactgt

SEQ ID NO: 182997 - DNA, 20 bp, Artificial Sequence
  chemically synthesized
atctgtttccccacagtgtg

SEQ ID NO: 182998 - DNA, 20 bp, Artificial Sequence
  chemically synthesized
atatcaacagccacacactg

SEQ ID NO: 182999 - DNA, 20 bp, Artificial Sequence
  chemically synthesized
tgacagagaaagaatatcaa

SEQ ID NO: 183000 - DNA, 20 bp, Artificial Sequence
  chemically synthesized
tttctgttgtttgacagaga

SEQ ID NO: 183001 - DNA, 20 bp, Artificial Sequence
  chemically synthesized
tttgtttctgttgtttgaca

SEQ ID NO: 183002 - DNA, 20 bp, Artificial Sequence
  chemically synthesized
agtttgtttctgttgtttga

SEQ ID NO: 183003 - DNA, 20 bp, Artificial Sequence
  chemically synthesized
attctttctctgtcaaacaa

SEQ ID NO: 183004 - DNA, 20 bp, Artificial Sequence
  chemically synthesized
acagaaacaaactgtatgcc

SEQ ID NO: 183005 - DNA, 20 bp, Artificial Sequence
  chemically synthesized
cctctaggaaactaggcata

SEQ ID NO: 183006 - DNA, 20 bp, Artificial Sequence
  chemically synthesized
aaactgtatgcctagtttcc

SEQ ID NO: 183007 - DNA, 20 bp, Artificial Sequence
  chemically synthesized
atgcttacctctaggaaact

SEQ ID NO: 183008 - DNA, 20 bp, Artificial Sequence
  chemically synthesized
tatgcttacctctaggaaac

SEQ ID NO: 183009 - DNA, 20 bp, Artificial Sequence
  chemically synthesized
actgtatgcctagtttccta

SEQ ID NO: 183010 - DNA, 20 bp, Artificial Sequence
  chemically synthesized
ctgtatgcctagtttcctag

SEQ ID NO: 183011 - DNA, 20 bp, Artificial Sequence
  chemically synthesized
atgcctagtttcctagaggt

SEQ ID NO: 183012 - DNA, 20 bp, Artificial Sequence
  chemically synthesized
attaagctatgcttacctct

SEQ ID NO: 183013 - DNA, 20 bp, Artificial Sequence
  chemically synthesized
aattaagctatgcttacctc

SEQ ID NO: 183014 - DNA, 20 bp, Artificial Sequence
  chemically synthesized
tagtttcctagaggtaagca

SEQ ID NO: 183015 - DNA, 20 bp, Artificial Sequence
  chemically synthesized
actattgactaatgcaaatt

SEQ ID NO: 183016 - DNA, 20 bp, Artificial Sequence
  chemically synthesized
aagcatagcttaatttgcat

SEQ ID NO: 183017 - DNA, 20 bp, Artificial Sequence
  chemically synthesized
gcttaatttgcattagtcaa

SEQ ID NO: 183018 - DNA, 20 bp, Artificial Sequence
  chemically synthesized
aatttgcattagtcaatagt

SEQ ID NO: 183019 - DNA, 20 bp, Artificial Sequence
  chemically synthesized
tgcattagtcaatagttggc

SEQ ID NO: 183020 - DNA, 20 bp, Artificial Sequence
  chemically synthesized
attagtcaatagttggccag

SEQ ID NO: 183021 - DNA, 20 bp, Artificial Sequence
  chemically synthesized
aggtatttaagatcaactgc

SEQ ID NO: 183022 - DNA, 20 bp, Artificial Sequence
  chemically synthesized
cttactggcttgaggtattt

SEQ ID NO: 183023 - DNA, 20 bp, Artificial Sequence
  chemically synthesized
cagttgatcttaaatacctc

SEQ ID NO: 183024 - DNA, 20 bp, Artificial Sequence
  chemically synthesized
tgatcttaaatacctcaagc

SEQ ID NO: 183025 - DNA, 20 bp, Artificial Sequence
  chemically synthesized
ttggaagtcttactggcttg

SEQ ID NO: 183026 - DNA, 20 bp, Artificial Sequence
  chemically synthesized
cttggaagtcttactggctt

SEQ ID NO: 183027 - DNA, 20 bp, Artificial Sequence
  chemically synthesized
cttaaatacctcaagccagt

SEQ ID NO: 183028 - DNA, 20 bp, Artificial Sequence
  chemically synthesized
gcaaaacttggaagtcttac

SEQ ID NO: 183029 - DNA, 20 bp, Artificial Sequence
  chemically synthesized
ctcaagccagtaagacttcc

SEQ ID NO: 183030 - DNA, 20 bp, Artificial Sequence
  chemically synthesized
gaacctttagcaaaacttgg

SEQ ID NO: 183031 - DNA, 20 bp, Artificial Sequence
  chemically synthesized
aaagaacctttagcaaaact

SEQ ID NO: 183032 - DNA, 20 bp, Artificial Sequence
  chemically synthesized
aagacttccaagttttgcta

SEQ ID NO: 183033 - DNA, 20 bp, Artificial Sequence
  chemically synthesized
agacttccaagttttgctaa

SEQ ID NO: 183034 - DNA, 20 bp, Artificial Sequence
  chemically synthesized
taacacatataaagaacctt

SEQ ID NO: 183035 - DNA, 20 bp, Artificial Sequence
  chemically synthesized
tataccctttaacacatata

SEQ ID NO: 183036 - DNA, 20 bp, Artificial Sequence
  chemically synthesized
aaggttctttatatgtgtta

SEQ ID NO: 183037 - DNA, 20 bp, Artificial Sequence
  chemically synthesized
aggttctttatatgtgttaa

SEQ ID NO: 183038 - DNA, 20 bp, Artificial Sequence
  chemically synthesized
ggttctttatatgtgttaaa

SEQ ID NO: 183039 - DNA, 20 bp, Artificial Sequence
  chemically synthesized
taaagggtatattcaacatg

SEQ ID NO: 183040 - DNA, 20 bp, Artificial Sequence
  chemically synthesized
aaagggtatattcaacatgc

SEQ ID NO: 183041 - DNA, 20 bp, Artificial Sequence
  chemically synthesized
tcaacatgcaggcacatttt

SEQ ID NO: 183042 - DNA, 20 bp, Artificial Sequence
  chemically synthesized
gcacattttaagttttcatg

SEQ ID NO: 183043 - DNA, 20 bp, Artificial Sequence
  chemically synthesized
cacattttaagttttcatga

SEQ ID NO: 183044 - DNA, 20 bp, Artificial Sequence
  chemically synthesized
cattttaagttttcatgaag

SEQ ID NO: 183045 - DNA, 20 bp, Artificial Sequence
  chemically synthesized
agttttcatgaaggagacac

SEQ ID NO: 183046 - DNA, 20 bp, Artificial Sequence
  chemically synthesized
gttttcatgaaggagacaca

SEQ ID NO: 183047 - DNA, 20 bp, Artificial Sequence
  chemically synthesized
tttcatgaaggagacacaag

SEQ ID NO: 183048 - DNA, 20 bp, Artificial Sequence
  chemically synthesized
agacacaaggagtccttact

SEQ ID NO: 183049 - DNA, 20 bp, Artificial Sequence
  chemically synthesized
gacacaaggagtccttactg

SEQ ID NO: 183050 - DNA, 20 bp, Artificial Sequence
  chemically synthesized
agccgtaataggcctcagta

SEQ ID NO: 183051 - DNA, 20 bp, Artificial Sequence
  chemically synthesized
cagccgtaataggcctcagt

SEQ ID NO: 183052 - DNA, 20 bp, Artificial Sequence
  chemically synthesized
gaggcagccgtaataggcct

SEQ ID NO: 183053 - DNA, 20 bp, Artificial Sequence
  chemically synthesized
gtccttactgaggcctatta

SEQ ID NO: 183054 - DNA, 20 bp, Artificial Sequence
  chemically synthesized
caaaatgaggcagccgtaat

SEQ ID NO: 183055 - DNA, 20 bp, Artificial Sequence
  chemically synthesized
gcaaaatgaggcagccgtaa

SEQ ID NO: 183056 - DNA, 20 bp, Artificial Sequence
  chemically synthesized
agcatatctgcaaaatgagg

SEQ ID NO: 183057 - DNA, 20 bp, Artificial Sequence
  chemically synthesized
attacggctgcctcattttg

SEQ ID NO: 183058 - DNA, 20 bp, Artificial Sequence
  chemically synthesized
accagcatatctgcaaaatg

SEQ ID NO: 183059 - DNA, 20 bp, Artificial Sequence
  chemically synthesized
aaccagcatatctgcaaaat

SEQ ID NO: 183060 - DNA, 20 bp, Artificial Sequence
  chemically synthesized
gcctcattttgcagatatgc

SEQ ID NO: 183061 - DNA, 20 bp, Artificial Sequence
  chemically synthesized
ggccagaaatttaatttaac

SEQ ID NO: 183062 - DNA, 20 bp, Artificial Sequence
  chemically synthesized
tgctggttaaattaaatttc

SEQ ID NO: 183063 - DNA, 20 bp, Artificial Sequence
  chemically synthesized
ggttaaattaaatttctggc

SEQ ID NO: 183064 - DNA, 20 bp, Artificial Sequence
  chemically synthesized
taactgactggcagactggc

SEQ ID NO: 183065 - DNA, 20 bp, Artificial Sequence
  chemically synthesized
taaatttctggccagtctgc

SEQ ID NO: 183066 - DNA, 20 bp, Artificial Sequence
  chemically synthesized
caagtaactgactggcagac

SEQ ID NO: 183067 - DNA, 20 bp, Artificial Sequence
  chemically synthesized
tttctggccagtctgccagt

SEQ ID NO: 183068 - DNA, 20 bp, Artificial Sequence
  chemically synthesized
tggaacaagtaactgactgg

SEQ ID NO: 183069 - DNA, 20 bp, Artificial Sequence
  chemically synthesized
gattggaacaagtaactgac

SEQ ID NO: 183070 - DNA, 20 bp, Artificial Sequence
  chemically synthesized
gttgcagtcttgattggaac

SEQ ID NO: 183071 - DNA, 20 bp, Artificial Sequence
  chemically synthesized
gtcagttacttgttccaatc

SEQ ID NO: 183072 - DNA, 20 bp, Artificial Sequence
  chemically synthesized
cctaaagttgcagtcttgat

SEQ ID NO: 183073 - DNA, 20 bp, Artificial Sequence
  chemically synthesized
tccaatcaagactgcaactt

SEQ ID NO: 183074 - DNA, 20 bp, Artificial Sequence
  chemically synthesized
ccaatcaagactgcaacttt

SEQ ID NO: 183075 - DNA, 20 bp, Artificial Sequence
  chemically synthesized
actcagctggcctaaagttg

SEQ ID NO: 183076 - DNA, 20 bp, Artificial Sequence
  chemically synthesized
tcaagactgcaactttaggc

SEQ ID NO: 183077 - DNA, 20 bp, Artificial Sequence
  chemically synthesized
atagcaactcagctggccta

SEQ ID NO: 183078 - DNA, 20 bp, Artificial Sequence
  chemically synthesized
actgcaactttaggccagct

SEQ ID NO: 183079 - DNA, 20 bp, Artificial Sequence
  chemically synthesized
aggcagaatagcaactcagc

SEQ ID NO: 183080 - DNA, 20 bp, Artificial Sequence
  chemically synthesized
aaaaaggcagaatagcaact

SEQ ID NO: 183081 - DNA, 20 bp, Artificial Sequence
  chemically synthesized
cggcaaacaaaaaggcagaa

SEQ ID NO: 183082 - DNA, 20 bp, Artificial Sequence
  chemically synthesized
ctaggcggcaaacaaaaagg

SEQ ID NO: 183083 - DNA, 20 bp, Artificial Sequence
  chemically synthesized
gacctaggcggcaaacaaaa

SEQ ID NO: 183084 - DNA, 20 bp, Artificial Sequence
  chemically synthesized
agacctaggcggcaaacaaa

SEQ ID NO: 183085 - DNA, 20 bp, Artificial Sequence
  chemically synthesized
ctgcctttttgtttgccgcc

SEQ ID NO: 183086 - DNA, 20 bp, Artificial Sequence
  chemically synthesized
tgcctttttgtttgccgcct

SEQ ID NO: 183087 - DNA, 20 bp, Artificial Sequence
  chemically synthesized
agtaacggtggagacctagg

SEQ ID NO: 183088 - DNA, 20 bp, Artificial Sequence
  chemically synthesized
gtcagtaacggtggagacct

SEQ ID NO: 183089 - DNA, 20 bp, Artificial Sequence
  chemically synthesized
tgtcagtaacggtggagacc

SEQ ID NO: 183090 - DNA, 20 bp, Artificial Sequence
  chemically synthesized
aagcattgtcagtaacggtg

SEQ ID NO: 183091 - DNA, 20 bp, Artificial Sequence
  chemically synthesized
agaagcattgtcagtaacgg

SEQ ID NO: 183092 - DNA, 20 bp, Artificial Sequence
  chemically synthesized
tccagaagcattgtcagtaa

SEQ ID NO: 183093 - DNA, 20 bp, Artificial Sequence
  chemically synthesized
tccatgtccagaagcattgt

SEQ ID NO: 183094 - DNA, 20 bp, Artificial Sequence
  chemically synthesized
accgttactgacaatgcttc

SEQ ID NO: 183095 - DNA, 20 bp, Artificial Sequence
  chemically synthesized
actgacaatgcttctggaca

SEQ ID NO: 183096 - DNA, 20 bp, Artificial Sequence
  chemically synthesized
gtttaaaactccatgtccag

SEQ ID NO: 183097 - DNA, 20 bp, Artificial Sequence
  chemically synthesized
tgacaatgcttctggacatg

SEQ ID NO: 183098 - DNA, 20 bp, Artificial Sequence
  chemically synthesized
gaagtttaaaactccatgtc

SEQ ID NO: 183099 - DNA, 20 bp, Artificial Sequence
  chemically synthesized
actgattttatttgaagcag

SEQ ID NO: 183100 - DNA, 20 bp, Artificial Sequence
  chemically synthesized
gggactgattttatttgaag

SEQ ID NO: 183101 - DNA, 20 bp, Artificial Sequence
  chemically synthesized
acagggactgattttatttg

SEQ ID NO: 183102 - DNA, 20 bp, Artificial Sequence
  chemically synthesized
acttctgcttcaaataaaat

SEQ ID NO: 183103 - DNA, 20 bp, Artificial Sequence
  chemically synthesized
tcaaataaaatcagtccctg

SEQ ID NO: 183104 - DNA, 20 bp, Artificial Sequence
  chemically synthesized
taagcagcttcatcaccaca

SEQ ID NO: 183105 - DNA, 20 bp, Artificial Sequence
  chemically synthesized
ataagcagcttcatcaccac

SEQ ID NO: 183106 - DNA, 20 bp, Artificial Sequence
  chemically synthesized
aataagcagcttcatcacca

SEQ ID NO: 183107 - DNA, 20 bp, Artificial Sequence
  chemically synthesized
aatcagtccctgtggtgatg

SEQ ID NO: 183108 - DNA, 20 bp, Artificial Sequence
  chemically synthesized
gaacaagccatggaaataag

SEQ ID NO: 183109 - DNA, 20 bp, Artificial Sequence
  chemically synthesized
gatgaagctgcttatttcca

SEQ ID NO: 183110 - DNA, 20 bp, Artificial Sequence
  chemically synthesized
gtagaacaagccatggaaat

SEQ ID NO: 183111 - DNA, 20 bp, Artificial Sequence
  chemically synthesized
tatcaaggtagaacaagcca

SEQ ID NO: 183112 - DNA, 20 bp, Artificial Sequence
  chemically synthesized
tagttctatcaaggtagaac

SEQ ID NO: 183113 - DNA, 20 bp, Artificial Sequence
  chemically synthesized
catggcttgttctaccttga

SEQ ID NO: 183114 - DNA, 20 bp, Artificial Sequence
  chemically synthesized
gcataatagttctatcaagg

SEQ ID NO: 183115 - DNA, 20 bp, Artificial Sequence
  chemically synthesized
caagcataatagttctatca

SEQ ID NO: 183116 - DNA, 20 bp, Artificial Sequence
  chemically synthesized
tcaagcataatagttctatc

SEQ ID NO: 183117 - DNA, 20 bp, Artificial Sequence
  chemically synthesized
cccagcttggtcaagcataa

SEQ ID NO: 183118 - DNA, 20 bp, Artificial Sequence
  chemically synthesized
tagaactattatgcttgacc

SEQ ID NO: 183119 - DNA, 20 bp, Artificial Sequence
  chemically synthesized
tccccactcccagcttggtc

SEQ ID NO: 183120 - DNA, 20 bp, Artificial Sequence
  chemically synthesized
actattatgcttgaccaagc

SEQ ID NO: 183121 - DNA, 20 bp, Artificial Sequence
  chemically synthesized
ctattatgcttgaccaagct

SEQ ID NO: 183122 - DNA, 20 bp, Artificial Sequence
  chemically synthesized
attatgcttgaccaagctgg

SEQ ID NO: 183123 - DNA, 20 bp, Artificial Sequence
  chemically synthesized
cccagtccccactcccagct

SEQ ID NO: 183124 - DNA, 20 bp, Artificial Sequence
  chemically synthesized
atgcttgaccaagctgggag

SEQ ID NO: 183125 - DNA, 20 bp, Artificial Sequence
  chemically synthesized
tgcttgaccaagctgggagt

SEQ ID NO: 183126 - DNA, 20 bp, Artificial Sequence
  chemically synthesized
gcttgaccaagctgggagtg

SEQ ID NO: 183127 - DNA, 20 bp, Artificial Sequence
  chemically synthesized
ttgcccccagtccccactcc

SEQ ID NO: 183128 - DNA, 20 bp, Artificial Sequence
  chemically synthesized
accaagctgggagtggggac

SEQ ID NO: 183129 - DNA, 20 bp, Artificial Sequence
  chemically synthesized
ccaagctgggagtggggact

SEQ ID NO: 183130 - DNA, 20 bp, Artificial Sequence
  chemically synthesized
caagctgggagtggggactg

SEQ ID NO: 183131 - DNA, 20 bp, Artificial Sequence
  chemically synthesized
aagctgggagtggggactgg

SEQ ID NO: 183132 - DNA, 20 bp, Artificial Sequence
  chemically synthesized
gtatttgcctgtattgcccc

SEQ ID NO: 183133 - DNA, 20 bp, Artificial Sequence
  chemically synthesized
agtggggactgggggcaata

SEQ ID NO: 183134 - DNA, 20 bp, Artificial Sequence
  chemically synthesized
gtggggactgggggcaatac

SEQ ID NO: 183135 - DNA, 20 bp, Artificial Sequence
  chemically synthesized
atatgaacaatatgaatttg

SEQ ID NO: 183136 - DNA, 20 bp, Artificial Sequence
  chemically synthesized
attcatattgttcatataca

SEQ ID NO: 183137 - DNA, 20 bp, Artificial Sequence
  chemically synthesized
tattgttcatatacaaagtt

SEQ ID NO: 183138 - DNA, 20 bp, Artificial Sequence
  chemically synthesized
aaaaagtgattatttataaa

SEQ ID NO: 183139 - DNA, 20 bp, Artificial Sequence
  chemically synthesized
taaataatcactttttaatt

SEQ ID NO: 183140 - DNA, 20 bp, Artificial Sequence
  chemically synthesized
acggcatatgctaaattaaa

SEQ ID NO: 183141 - DNA, 20 bp, Artificial Sequence
  chemically synthesized
tttaatttagcatatgccgt

SEQ ID NO: 183142 - DNA, 20 bp, Artificial Sequence
  chemically synthesized
tgaccctggatatcaaccaa

SEQ ID NO: 183143 - DNA, 20 bp, Artificial Sequence
  chemically synthesized
atatgccgttggttgatatc

SEQ ID NO: 183144 - DNA, 20 bp, Artificial Sequence
  chemically synthesized
tatgccgttggttgatatcc

SEQ ID NO: 183145 - DNA, 20 bp, Artificial Sequence
  chemically synthesized
atgccgttggttgatatcca

SEQ ID NO: 183146 - DNA, 20 bp, Artificial Sequence
  chemically synthesized
tggttgatatccagggtcat

SEQ ID NO: 183147 - DNA, 20 bp, Artificial Sequence
  chemically synthesized
gagaaaacatcttatgaccc

SEQ ID NO: 183148 - DNA, 20 bp, Artificial Sequence
  chemically synthesized
gggtcataagatgttttctc

SEQ ID NO: 183149 - DNA, 20 bp, Artificial Sequence
  chemically synthesized
cagtaaaatgggacacactg

SEQ ID NO: 183150 - DNA, 20 bp, Artificial Sequence
  chemically synthesized
atcagtaaaatgggacacac

SEQ ID NO: 183151 - DNA, 20 bp, Artificial Sequence
  chemically synthesized
tccccaagaatcagtaaaat

SEQ ID NO: 183152 - DNA, 20 bp, Artificial Sequence
  chemically synthesized
ctccccaagaatcagtaaaa

SEQ ID NO: 183153 - DNA, 20 bp, Artificial Sequence
  chemically synthesized
tgtcccattttactgattct

SEQ ID NO: 183154 - DNA, 20 bp, Artificial Sequence
  chemically synthesized
gtcccattttactgattctt

SEQ ID NO: 183155 - DNA, 20 bp, Artificial Sequence
  chemically synthesized
tcccattttactgattcttg

SEQ ID NO: 183156 - DNA, 20 bp, Artificial Sequence
  chemically synthesized
cgataaatctccccaagaat

SEQ ID NO: 183157 - DNA, 20 bp, Artificial Sequence
  chemically synthesized
ccattttactgattcttggg

SEQ ID NO: 183158 - DNA, 20 bp, Artificial Sequence
  chemically synthesized
gtagctcgataaatctcccc

SEQ ID NO: 183159 - DNA, 20 bp, Artificial Sequence
  chemically synthesized
gattcttggggagatttatc

SEQ ID NO: 183160 - DNA, 20 bp, Artificial Sequence
  chemically synthesized
tctggggatgataaagtgag

SEQ ID NO: 183161 - DNA, 20 bp, Artificial Sequence
  chemically synthesized
acttctggggatgataaagt

SEQ ID NO: 183162 - DNA, 20 bp, Artificial Sequence
  chemically synthesized
catgacttctggggatgata

SEQ ID NO: 183163 - DNA, 20 bp, Artificial Sequence
  chemically synthesized
gctactcactttatcatccc

SEQ ID NO: 183164 - DNA, 20 bp, Artificial Sequence
  chemically synthesized
actcactttatcatccccag

SEQ ID NO: 183165 - DNA, 20 bp, Artificial Sequence
  chemically synthesized
gtctgggtacatgacttctg

SEQ ID NO: 183166 - DNA, 20 bp, Artificial Sequence
  chemically synthesized
tgtctgggtacatgacttct

SEQ ID NO: 183167 - DNA, 20 bp, Artificial Sequence
  chemically synthesized
gtgtctgggtacatgacttc

SEQ ID NO: 183168 - DNA, 20 bp, Artificial Sequence
  chemically synthesized
atccccagaagtcatgtacc

SEQ ID NO: 183169 - DNA, 20 bp, Artificial Sequence
  chemically synthesized
gtgcttagaagttagtgtct

SEQ ID NO: 183170 - DNA, 20 bp, Artificial Sequence
  chemically synthesized
ggtgcttagaagttagtgtc

SEQ ID NO: 183171 - DNA, 20 bp, Artificial Sequence
  chemically synthesized
gtacccagacactaacttct

SEQ ID NO: 183172 - DNA, 20 bp, Artificial Sequence
  chemically synthesized
atgagtaggtgcttagaagt

SEQ ID NO: 183173 - DNA, 20 bp, Artificial Sequence
  chemically synthesized
gcacatgagtaggtgcttag

SEQ ID NO: 183174 - DNA, 20 bp, Artificial Sequence
  chemically synthesized
ccagcacatgagtaggtgct

SEQ ID NO: 183175 - DNA, 20 bp, Artificial Sequence
  chemically synthesized
tctatgcccagcacatgagt

SEQ ID NO: 183176 - DNA, 20 bp, Artificial Sequence
  chemically synthesized
ctctatgcccagcacatgag

SEQ ID NO: 183177 - DNA, 20 bp, Artificial Sequence
  chemically synthesized
ctaagcacctactcatgtgc

SEQ ID NO: 183178 - DNA, 20 bp, Artificial Sequence
  chemically synthesized
taagcacctactcatgtgct

SEQ ID NO: 183179 - DNA, 20 bp, Artificial Sequence
  chemically synthesized
tagctctatgcccagcacat

SEQ ID NO: 183180 - DNA, 20 bp, Artificial Sequence
  chemically synthesized
acctactcatgtgctgggca

SEQ ID NO: 183181 - DNA, 20 bp, Artificial Sequence
  chemically synthesized
ctactcatgtgctgggcata

SEQ ID NO: 183182 - DNA, 20 bp, Artificial Sequence
  chemically synthesized
aaattggctagctctatgcc

SEQ ID NO: 183183 - DNA, 20 bp, Artificial Sequence
  chemically synthesized
tcatgtgctgggcatagagc

SEQ ID NO: 183184 - DNA, 20 bp, Artificial Sequence
  chemically synthesized
ggtaatgtaaataaattggc

SEQ ID NO: 183185 - DNA, 20 bp, Artificial Sequence
  chemically synthesized
aagaggtaatgtaaataaat

SEQ ID NO: 183186 - DNA, 20 bp, Artificial Sequence
  chemically synthesized
agagatgttgtaagagtaag

SEQ ID NO: 183187 - DNA, 20 bp, Artificial Sequence
  chemically synthesized
tagagatgttgtaagagtaa

SEQ ID NO: 183188 - DNA, 20 bp, Artificial Sequence
  chemically synthesized
tatagagatgttgtaagagt

SEQ ID NO: 183189 - DNA, 20 bp, Artificial Sequence
  chemically synthesized
tatttatagagatgttgtaa

SEQ ID NO: 183190 - DNA, 20 bp, Artificial Sequence
  chemically synthesized
catatttatagagatgttgt

SEQ ID NO: 183191 - DNA, 20 bp, Artificial Sequence
  chemically synthesized
gataatagtacatatttata

SEQ ID NO: 183192 - DNA, 20 bp, Artificial Sequence
  chemically synthesized
aagataatagtacatattta

SEQ ID NO: 183193 - DNA, 20 bp, Artificial Sequence
  chemically synthesized
taatccaaaaataaagataa

SEQ ID NO: 183194 - DNA, 20 bp, Artificial Sequence
  chemically synthesized
tgtactattatctttatttt

SEQ ID NO: 183195 - DNA, 20 bp, Artificial Sequence
  chemically synthesized
cttttactaatccaaaaata

SEQ ID NO: 183196 - DNA, 20 bp, Artificial Sequence
  chemically synthesized
tattatctttatttttggat

SEQ ID NO: 183197 - DNA, 20 bp, Artificial Sequence
  chemically synthesized
ctttatttttggattagtaa

SEQ ID NO: 183198 - DNA, 20 bp, Artificial Sequence
  chemically synthesized
tttatttttggattagtaaa

SEQ ID NO: 183199 - DNA, 20 bp, Artificial Sequence
  chemically synthesized
atttttggattagtaaaagg

SEQ ID NO: 183200 - DNA, 20 bp, Artificial Sequence
  chemically synthesized
tggattagtaaaaggaagct

SEQ ID NO: 183201 - DNA, 20 bp, Artificial Sequence
  chemically synthesized
accagctacttaaattatct

SEQ ID NO: 183202 - DNA, 20 bp, Artificial Sequence
  chemically synthesized
aaaggaagctcagataattt

SEQ ID NO: 183203 - DNA, 20 bp, Artificial Sequence
  chemically synthesized
ggaagctcagataatttaag

SEQ ID NO: 183204 - DNA, 20 bp, Artificial Sequence
  chemically synthesized
gctcagataatttaagtagc

SEQ ID NO: 183205 - DNA, 20 bp, Artificial Sequence
  chemically synthesized
ataatttaagtagctggtgc

SEQ ID NO: 183206 - DNA, 20 bp, Artificial Sequence
  chemically synthesized
aatttaagtagctggtgcaa

SEQ ID NO: 183207 - DNA, 20 bp, Artificial Sequence
  chemically synthesized
tgttcttttttctcttgcac

SEQ ID NO: 183208 - DNA, 20 bp, Artificial Sequence
  chemically synthesized
gtagctggtgcaagagaaaa

SEQ ID NO: 183209 - DNA, 20 bp, Artificial Sequence
  chemically synthesized
aaattaaaaatataaacgca

SEQ ID NO: 183210 - DNA, 20 bp, Artificial Sequence
  chemically synthesized
acctttggaagtatgtaaca

SEQ ID NO: 183211 - DNA, 20 bp, Artificial Sequence
  chemically synthesized
taccatgttacatacttcca

SEQ ID NO: 183212 - DNA, 20 bp, Artificial Sequence
  chemically synthesized
accatgttacatacttccaa

SEQ ID NO: 183213 - DNA, 20 bp, Artificial Sequence
  chemically synthesized
cctgtgtttattacctttgg

SEQ ID NO: 183214 - DNA, 20 bp, Artificial Sequence
  chemically synthesized
ccacctgtgtttattacctt

SEQ ID NO: 183215 - DNA, 20 bp, Artificial Sequence
  chemically synthesized
acttccaaaggtaataaaca

SEQ ID NO: 183216 - DNA, 20 bp, Artificial Sequence
  chemically synthesized
cttccaaaggtaataaacac

SEQ ID NO: 183217 - DNA, 20 bp, Artificial Sequence
  chemically synthesized
ccaaaggtaataaacacagg

SEQ ID NO: 183218 - DNA, 20 bp, Artificial Sequence
  chemically synthesized
caaaggtaataaacacaggt

SEQ ID NO: 183219 - DNA, 20 bp, Artificial Sequence
  chemically synthesized
aggtaataaacacaggtggg

SEQ ID NO: 183220 - DNA, 20 bp, Artificial Sequence
  chemically synthesized
aataaacacaggtgggaaga

SEQ ID NO: 183221 - DNA, 20 bp, Artificial Sequence
  chemically synthesized
ataaacacaggtgggaagat

SEQ ID NO: 183222 - DNA, 20 bp, Artificial Sequence
  chemically synthesized
gaagataggtgattattacc

SEQ ID NO: 183223 - DNA, 20 bp, Artificial Sequence
  chemically synthesized
ggtgattattacccagcatt

SEQ ID NO: 183224 - DNA, 20 bp, Artificial Sequence
  chemically synthesized
aaacctggcaactaaatgct

SEQ ID NO: 183225 - DNA, 20 bp, Artificial Sequence
  chemically synthesized
taaacctggcaactaaatgc

SEQ ID NO: 183226 - DNA, 20 bp, Artificial Sequence
  chemically synthesized
attacccagcatttagttgc

SEQ ID NO: 183227 - DNA, 20 bp, Artificial Sequence
  chemically synthesized
ttacccagcatttagttgcc

SEQ ID NO: 183228 - DNA, 20 bp, Artificial Sequence
  chemically synthesized
ggttggccattacataaacc

SEQ ID NO: 183229 - DNA, 20 bp, Artificial Sequence
  chemically synthesized
tagttgccaggtttatgtaa

SEQ ID NO: 183230 - DNA, 20 bp, Artificial Sequence
  chemically synthesized
tttatgtaatggccaacctg

SEQ ID NO: 183231 - DNA, 20 bp, Artificial Sequence
  chemically synthesized
agagtacttggacttcaggt

SEQ ID NO: 183232 - DNA, 20 bp, Artificial Sequence
  chemically synthesized
taatggccaacctgaagtcc

SEQ ID NO: 183233 - DNA, 20 bp, Artificial Sequence
  chemically synthesized
aatcagagtacttggacttc

SEQ ID NO: 183234 - DNA, 20 bp, Artificial Sequence
  chemically synthesized
aaatcagagtacttggactt

SEQ ID NO: 183235 - DNA, 20 bp, Artificial Sequence
  chemically synthesized
cagtagtaaatcagagtact

SEQ ID NO: 183236 - DNA, 20 bp, Artificial Sequence
  chemically synthesized
tactaggcagtagtaaatca

SEQ ID NO: 183237 - DNA, 20 bp, Artificial Sequence
  chemically synthesized
tatactaggcagtagtaaat

SEQ ID NO: 183238 - DNA, 20 bp, Artificial Sequence
  chemically synthesized
tactctgatttactactgcc

SEQ ID NO: 183239 - DNA, 20 bp, Artificial Sequence
  chemically synthesized
ttagcctttatactaggcag

SEQ ID NO: 183240 - DNA, 20 bp, Artificial Sequence
  chemically synthesized
taattagcctttatactagg

SEQ ID NO: 183241 - DNA, 20 bp, Artificial Sequence
  chemically synthesized
atttactactgcctagtata

SEQ ID NO: 183242 - DNA, 20 bp, Artificial Sequence
  chemically synthesized
tttactactgcctagtataa

SEQ ID NO: 183243 - DNA, 20 bp, Artificial Sequence
  chemically synthesized
tgctaattagcctttatact

SEQ ID NO: 183244 - DNA, 20 bp, Artificial Sequence
  chemically synthesized
ttgctaattagcctttatac

SEQ ID NO: 183245 - DNA, 20 bp, Artificial Sequence
  chemically synthesized
tgcctagtataaaggctaat

SEQ ID NO: 183246 - DNA, 20 bp, Artificial Sequence
  chemically synthesized
tagtataaaggctaattagc

SEQ ID NO: 183247 - DNA, 20 bp, Artificial Sequence
  chemically synthesized
tttggtgttttcttgctaat

SEQ ID NO: 183248 - DNA, 20 bp, Artificial Sequence
  chemically synthesized
ttagcaagaaaacaccaaat

SEQ ID NO: 183249 - DNA, 20 bp, Artificial Sequence
  chemically synthesized
caagaaaacaccaaataagt

SEQ ID NO: 183250 - DNA, 20 bp, Artificial Sequence
  chemically synthesized
gtttctcctactgacttatt

SEQ ID NO: 183251 - DNA, 20 bp, Artificial Sequence
  chemically synthesized
gaaaacaccaaataagtcag

SEQ ID NO: 183252 - DNA, 20 bp, Artificial Sequence
  chemically synthesized
aaaacaccaaataagtcagt

SEQ ID NO: 183253 - DNA, 20 bp, Artificial Sequence
  chemically synthesized
aacaccaaataagtcagtag

SEQ ID NO: 183254 - DNA, 20 bp, Artificial Sequence
  chemically synthesized
aataagtcagtaggagaaac

SEQ ID NO: 183255 - DNA, 20 bp, Artificial Sequence
  chemically synthesized
gagtctatccatgacaaaaa

SEQ ID NO: 183256 - DNA, 20 bp, Artificial Sequence
  chemically synthesized
gaaacaagctgtttttgtca

SEQ ID NO: 183257 - DNA, 20 bp, Artificial Sequence
  chemically synthesized
caagctgtttttgtcatgga

SEQ ID NO: 183258 - DNA, 20 bp, Artificial Sequence
  chemically synthesized
gattgtttttttaatgatta

SEQ ID NO: 183259 - DNA, 20 bp, Artificial Sequence
  chemically synthesized
atgattgtttttttaatgat

SEQ ID NO: 183260 - DNA, 20 bp, Artificial Sequence
  chemically synthesized
taaaaaaacaatcattatat

SEQ ID NO: 183261 - DNA, 20 bp, Artificial Sequence
  chemically synthesized
aatcattatattggctcata

SEQ ID NO: 183262 - DNA, 20 bp, Artificial Sequence
  chemically synthesized
attatattggctcataaagt

SEQ ID NO: 183263 - DNA, 20 bp, Artificial Sequence
  chemically synthesized
gaatcaaattctaactttat

SEQ ID NO: 183264 - DNA, 20 bp, Artificial Sequence
  chemically synthesized
cgtgggaccctggattttat

SEQ ID NO: 183265 - DNA, 20 bp, Artificial Sequence
  chemically synthesized
catgtaattctaataaaatc

SEQ ID NO: 183266 - DNA, 20 bp, Artificial Sequence
  chemically synthesized
atgtaattctaataaaatcc

SEQ ID NO: 183267 - DNA, 20 bp, Artificial Sequence
  chemically synthesized
tgtaattctaataaaatcca

SEQ ID NO: 183268 - DNA, 20 bp, Artificial Sequence
  chemically synthesized
atatgggtcacgtgggaccc

SEQ ID NO: 183269 - DNA, 20 bp, Artificial Sequence
  chemically synthesized
ttaacgaatatgggtcacgt

SEQ ID NO: 183270 - DNA, 20 bp, Artificial Sequence
  chemically synthesized
tttaacgaatatgggtcacg

SEQ ID NO: 183271 - DNA, 20 bp, Artificial Sequence
  chemically synthesized
tgtaactctttaacgaatat

SEQ ID NO: 183272 - DNA, 20 bp, Artificial Sequence
  chemically synthesized
gtgtaactctttaacgaata

SEQ ID NO: 183273 - DNA, 20 bp, Artificial Sequence
  chemically synthesized
cacgtgacccatattcgtta

SEQ ID NO: 183274 - DNA, 20 bp, Artificial Sequence
  chemically synthesized
cgtgacccatattcgttaaa

SEQ ID NO: 183275 - DNA, 20 bp, Artificial Sequence
  chemically synthesized
tcgttaaagagttacaccaa

SEQ ID NO: 183276 - DNA, 20 bp, Artificial Sequence
  chemically synthesized
gttaaagagttacaccaaca

SEQ ID NO: 183277 - DNA, 20 bp, Artificial Sequence
  chemically synthesized
ttgctgggctgattctctgt

SEQ ID NO: 183278 - DNA, 20 bp, Artificial Sequence
  chemically synthesized
gagttacaccaacagagaat

SEQ ID NO: 183279 - DNA, 20 bp, Artificial Sequence
  chemically synthesized
acaccaacagagaatcagcc

SEQ ID NO: 183280 - DNA, 20 bp, Artificial Sequence
  chemically synthesized
tttgatgatctatttttgct

SEQ ID NO: 183281 - DNA, 20 bp, Artificial Sequence
  chemically synthesized
gagaatcagcccagcaaaaa

SEQ ID NO: 183282 - DNA, 20 bp, Artificial Sequence
  chemically synthesized
ttttgatgatctatttttgc

SEQ ID NO: 183283 - DNA, 20 bp, Artificial Sequence
  chemically synthesized
ttaattttaaaatgtaaatt

SEQ ID NO: 183284 - DNA, 20 bp, Artificial Sequence
  chemically synthesized
tttacattttaaaattaata

SEQ ID NO: 183285 - DNA, 20 bp, Artificial Sequence
  chemically synthesized
ttacattttaaaattaatat

SEQ ID NO: 183286 - DNA, 20 bp, Artificial Sequence
  chemically synthesized
tacattttaaaattaatata

SEQ ID NO: 183287 - DNA, 20 bp, Artificial Sequence
  chemically synthesized
atgttctgtaaattgtagat

SEQ ID NO: 183288 - DNA, 20 bp, Artificial Sequence
  chemically synthesized
gggaactcatctacaattta

SEQ ID NO: 183289 - DNA, 20 bp, Artificial Sequence
  chemically synthesized
ctggaatgttctgtaaattg

SEQ ID NO: 183290 - DNA, 20 bp, Artificial Sequence
  chemically synthesized
ctacaatttacagaacattc

SEQ ID NO: 183291 - DNA, 20 bp, Artificial Sequence
  chemically synthesized
aggagaagaaatgaaagttc

SEQ ID NO: 183292 - DNA, 20 bp, Artificial Sequence
  chemically synthesized
gtgaggaggagaagaaatga

SEQ ID NO: 183293 - DNA, 20 bp, Artificial Sequence
  chemically synthesized
taaaaaaaagtgaggaggag

SEQ ID NO: 183294 - DNA, 20 bp, Artificial Sequence
  chemically synthesized
gtataaaaaaaagtgaggag

SEQ ID NO: 183295 - DNA, 20 bp, Artificial Sequence
  chemically synthesized
gggtataaaaaaaagtgagg

SEQ ID NO: 183296 - DNA, 20 bp, Artificial Sequence
  chemically synthesized
tgggtataaaaaaaagtgag

SEQ ID NO: 183297 - DNA, 20 bp, Artificial Sequence
  chemically synthesized
gatgggtataaaaaaaagtg

SEQ ID NO: 183298 - DNA, 20 bp, Artificial Sequence
  chemically synthesized
ggatgggtataaaaaaaagt

SEQ ID NO: 183299 - DNA, 20 bp, Artificial Sequence
  chemically synthesized
aactggatgggtataaaaaa

SEQ ID NO: 183300 - DNA, 20 bp, Artificial Sequence
  chemically synthesized
cacttttttttatacccatc

SEQ ID NO: 183301 - DNA, 20 bp, Artificial Sequence
  chemically synthesized
aagattgtgaagaactggat

SEQ ID NO: 183302 - DNA, 20 bp, Artificial Sequence
  chemically synthesized
aaagattgtgaagaactgga

SEQ ID NO: 183303 - DNA, 20 bp, Artificial Sequence
  chemically synthesized
gttgaaagattgtgaagaac

SEQ ID NO: 183304 - DNA, 20 bp, Artificial Sequence
  chemically synthesized
tcagaggttgaaagattgtg

SEQ ID NO: 183305 - DNA, 20 bp, Artificial Sequence
  chemically synthesized
tggagtgtttcagaggttga

SEQ ID NO: 183306 - DNA, 20 bp, Artificial Sequence
  chemically synthesized
cggtttctggagtgtttcag

SEQ ID NO: 183307 - DNA, 20 bp, Artificial Sequence
  chemically synthesized
acggtttctggagtgtttca

SEQ ID NO: 183308 - DNA, 20 bp, Artificial Sequence
  chemically synthesized
atacggtttctggagtgttt

SEQ ID NO: 183309 - DNA, 20 bp, Artificial Sequence
  chemically synthesized
tttcaacctctgaaacactc

SEQ ID NO: 183310 - DNA, 20 bp, Artificial Sequence
  chemically synthesized
gaatgtggatacggtttctg

SEQ ID NO: 183311 - DNA, 20 bp, Artificial Sequence
  chemically synthesized
gtgaatgtggatacggtttc

SEQ ID NO: 183312 - DNA, 20 bp, Artificial Sequence
  chemically synthesized
agaatctgtgaatgtggata

SEQ ID NO: 183313 - DNA, 20 bp, Artificial Sequence
  chemically synthesized
agaaaccgtatccacattca

SEQ ID NO: 183314 - DNA, 20 bp, Artificial Sequence
  chemically synthesized
aacaagagaatctgtgaatg

SEQ ID NO: 183315 - DNA, 20 bp, Artificial Sequence
  chemically synthesized
ctaccccataaagataacaa

SEQ ID NO: 183316 - DNA, 20 bp, Artificial Sequence
  chemically synthesized
atctaccccataaagataac

SEQ ID NO: 183317 - DNA, 20 bp, Artificial Sequence
  chemically synthesized
agattctcttgttatcttta

SEQ ID NO: 183318 - DNA, 20 bp, Artificial Sequence
  chemically synthesized
gattctcttgttatctttat

SEQ ID NO: 183319 - DNA, 20 bp, Artificial Sequence
  chemically synthesized
attctcttgttatctttatg

SEQ ID NO: 183320 - DNA, 20 bp, Artificial Sequence
  chemically synthesized
ctcttgttatctttatgggg

SEQ ID NO: 183321 - DNA, 20 bp, Artificial Sequence
  chemically synthesized
caaggtttatctaccccata

SEQ ID NO: 183322 - DNA, 20 bp, Artificial Sequence
  chemically synthesized
ggaaagtatctacaaaagca

SEQ ID NO: 183323 - DNA, 20 bp, Artificial Sequence
  chemically synthesized
gtagataaaccttgcttttg

SEQ ID NO: 183324 - DNA, 20 bp, Artificial Sequence
  chemically synthesized
aggaaagtatctacaaaagc

SEQ ID NO: 183325 - DNA, 20 bp, Artificial Sequence
  chemically synthesized
taaaaggaaagtatctacaa

SEQ ID NO: 183326 - DNA, 20 bp, Artificial Sequence
  chemically synthesized
atgacgattgtgtaaaagga

SEQ ID NO: 183327 - DNA, 20 bp, Artificial Sequence
  chemically synthesized
aaaaatgacgattgtgtaaa

SEQ ID NO: 183328 - DNA, 20 bp, Artificial Sequence
  chemically synthesized
gaaaaatgacgattgtgtaa

SEQ ID NO: 183329 - DNA, 20 bp, Artificial Sequence
  chemically synthesized
cacaatcgtcatttttcctt

SEQ ID NO: 183330 - DNA, 20 bp, Artificial Sequence
  chemically synthesized
tggaatttggagaatactta

SEQ ID NO: 183331 - DNA, 20 bp, Artificial Sequence
  chemically synthesized
gtggaatttggagaatactt

SEQ ID NO: 183332 - DNA, 20 bp, Artificial Sequence
  chemically synthesized
tttaaatggtgtggaatttg

SEQ ID NO: 183333 - DNA, 20 bp, Artificial Sequence
  chemically synthesized
attttaaatggtgtggaatt

SEQ ID NO: 183334 - DNA, 20 bp, Artificial Sequence
  chemically synthesized
cctataaattttaaatggtg

SEQ ID NO: 183335 - DNA, 20 bp, Artificial Sequence
  chemically synthesized
ttcatcctataaattttaaa

SEQ ID NO: 183336 - DNA, 20 bp, Artificial Sequence
  chemically synthesized
tccacaccatttaaaattta

SEQ ID NO: 183337 - DNA, 20 bp, Artificial Sequence
  chemically synthesized
ccacaccatttaaaatttat

SEQ ID NO: 183338 - DNA, 20 bp, Artificial Sequence
  chemically synthesized
tttaaaatttataggatgaa

SEQ ID NO: 183339 - DNA, 20 bp, Artificial Sequence
  chemically synthesized
atttataggatgaatggata

SEQ ID NO: 183340 - DNA, 20 bp, Artificial Sequence
  chemically synthesized
tgatatatatatatgcacca

SEQ ID NO: 183341 - DNA, 20 bp, Artificial Sequence
  chemically synthesized
gatatatatatatgcaccat

SEQ ID NO: 183342 - DNA, 20 bp, Artificial Sequence
  chemically synthesized
tatggctgaataatatccca

SEQ ID NO: 183343 - DNA, 20 bp, Artificial Sequence
  chemically synthesized
atgcaccatgggatattatt

SEQ ID NO: 183344 - DNA, 20 bp, Artificial Sequence
  chemically synthesized
ggatattattcagccataca

SEQ ID NO: 183345 - DNA, 20 bp, Artificial Sequence
  chemically synthesized
gatattattcagccatacaa

SEQ ID NO: 183346 - DNA, 20 bp, Artificial Sequence
  chemically synthesized
atattattcagccatacaaa

SEQ ID NO: 183347 - DNA, 20 bp, Artificial Sequence
  chemically synthesized
acaggatttcaccctttgta

SEQ ID NO: 183348 - DNA, 20 bp, Artificial Sequence
  chemically synthesized
tccacgttgctgcaaatgac

SEQ ID NO: 183349 - DNA, 20 bp, Artificial Sequence
  chemically synthesized
gggtgaaatcctgtcatttg

SEQ ID NO: 183350 - DNA, 20 bp, Artificial Sequence
  chemically synthesized
atccacgttgctgcaaatga

SEQ ID NO: 183351 - DNA, 20 bp, Artificial Sequence
  chemically synthesized
tcctgtcatttgcagcaacg

SEQ ID NO: 183352 - DNA, 20 bp, Artificial Sequence
  chemically synthesized
gtcatttgcagcaacgtgga

SEQ ID NO: 183353 - DNA, 20 bp, Artificial Sequence
  chemically synthesized
tgcagcaacgtggatagaac

SEQ ID NO: 183354 - DNA, 20 bp, Artificial Sequence
  chemically synthesized
cagcaacgtggatagaactg

SEQ ID NO: 183355 - DNA, 20 bp, Artificial Sequence
  chemically synthesized
agcaacgtggatagaactgg

SEQ ID NO: 183356 - DNA, 20 bp, Artificial Sequence
  chemically synthesized
ttacttaaaataattacctc

SEQ ID NO: 183357 - DNA, 20 bp, Artificial Sequence
  chemically synthesized
gaactggaggtaattatttt

SEQ ID NO: 183358 - DNA, 20 bp, Artificial Sequence
  chemically synthesized
tggaggtaattattttaagt

SEQ ID NO: 183359 - DNA, 20 bp, Artificial Sequence
  chemically synthesized
ggaggtaattattttaagta

SEQ ID NO: 183360 - DNA, 20 bp, Artificial Sequence
  chemically synthesized
ttattttaagtaaggtaaac

SEQ ID NO: 183361 - DNA, 20 bp, Artificial Sequence
  chemically synthesized
tattttaagtaaggtaaacc

SEQ ID NO: 183362 - DNA, 20 bp, Artificial Sequence
  chemically synthesized
taagtaaggtaaaccaggca

SEQ ID NO: 183363 - DNA, 20 bp, Artificial Sequence
  chemically synthesized
aatatttgtctttctgtgcc

SEQ ID NO: 183364 - DNA, 20 bp, Artificial Sequence
  chemically synthesized
taaggtaaaccaggcacaga

SEQ ID NO: 183365 - DNA, 20 bp, Artificial Sequence
  chemically synthesized
tatgtgttgtcactcacatg

SEQ ID NO: 183366 - DNA, 20 bp, Artificial Sequence
  chemically synthesized
atgtgttgtcactcacatgt

SEQ ID NO: 183367 - DNA, 20 bp, Artificial Sequence
  chemically synthesized
tgtttttagctcccacatgt

SEQ ID NO: 183368 - DNA, 20 bp, Artificial Sequence
  chemically synthesized
gtgttgtcactcacatgtgg

SEQ ID NO: 183369 - DNA, 20 bp, Artificial Sequence
  chemically synthesized
acatgtgggagctaaaaaca

SEQ ID NO: 183370 - DNA, 20 bp, Artificial Sequence
  chemically synthesized
tttcatgagatccatgtttt

SEQ ID NO: 183371 - DNA, 20 bp, Artificial Sequence
  chemically synthesized
taaaaacatggatctcatga

SEQ ID NO: 183372 - DNA, 20 bp, Artificial Sequence
  chemically synthesized
aaacatggatctcatgaaag

SEQ ID NO: 183373 - DNA, 20 bp, Artificial Sequence
  chemically synthesized
aaggtagtgtctactttcat

SEQ ID NO: 183374 - DNA, 20 bp, Artificial Sequence
  chemically synthesized
catgaaagtagacactacct

SEQ ID NO: 183375 - DNA, 20 bp, Artificial Sequence
  chemically synthesized
gaaagtagacactaccttgg

SEQ ID NO: 183376 - DNA, 20 bp, Artificial Sequence
  chemically synthesized
atctctggtaaccaccaagg

SEQ ID NO: 183377 - DNA, 20 bp, Artificial Sequence
  chemically synthesized
ctgatctctggtaaccacca

SEQ ID NO: 183378 - DNA, 20 bp, Artificial Sequence
  chemically synthesized
tctgatctctggtaaccacc

SEQ ID NO: 183379 - DNA, 20 bp, Artificial Sequence
  chemically synthesized
gacactaccttggtggttac

SEQ ID NO: 183380 - DNA, 20 bp, Artificial Sequence
  chemically synthesized
cactaccttggtggttacca

SEQ ID NO: 183381 - DNA, 20 bp, Artificial Sequence
  chemically synthesized
ccttggtggttaccagagat

SEQ ID NO: 183382 - DNA, 20 bp, Artificial Sequence
  chemically synthesized
ctactcctatttctgatctc

SEQ ID NO: 183383 - DNA, 20 bp, Artificial Sequence
  chemically synthesized
tggttaccagagatcagaaa

SEQ ID NO: 183384 - DNA, 20 bp, Artificial Sequence
  chemically synthesized
ggttaccagagatcagaaat

SEQ ID NO: 183385 - DNA, 20 bp, Artificial Sequence
  chemically synthesized
ttaccagagatcagaaatag

SEQ ID NO: 183386 - DNA, 20 bp, Artificial Sequence
  chemically synthesized
ccagagatcagaaataggag

SEQ ID NO: 183387 - DNA, 20 bp, Artificial Sequence
  chemically synthesized
cagagatcagaaataggagt

SEQ ID NO: 183388 - DNA, 20 bp, Artificial Sequence
  chemically synthesized
agagatcagaaataggagta

SEQ ID NO: 183389 - DNA, 20 bp, Artificial Sequence
  chemically synthesized
agatcagaaataggagtagg

SEQ ID NO: 183390 - DNA, 20 bp, Artificial Sequence
  chemically synthesized
atcagaaataggagtaggga

SEQ ID NO: 183391 - DNA, 20 bp, Artificial Sequence
  chemically synthesized
tcagaaataggagtagggag

SEQ ID NO: 183392 - DNA, 20 bp, Artificial Sequence
  chemically synthesized
cagaaataggagtagggaga

SEQ ID NO: 183393 - DNA, 20 bp, Artificial Sequence
  chemically synthesized
agaaataggagtagggagag

SEQ ID NO: 183394 - DNA, 20 bp, Artificial Sequence
  chemically synthesized
aggagtagggagaggggaca

SEQ ID NO: 183395 - DNA, 20 bp, Artificial Sequence
  chemically synthesized
ggagtagggagaggggacaa

SEQ ID NO: 183396 - DNA, 20 bp, Artificial Sequence
  chemically synthesized
gagtagggagaggggacaaa

SEQ ID NO: 183397 - DNA, 20 bp, Artificial Sequence
  chemically synthesized
agtagggagaggggacaaag

SEQ ID NO: 183398 - DNA, 20 bp, Artificial Sequence
  chemically synthesized
gtatacagttcagtggtaat

SEQ ID NO: 183399 - DNA, 20 bp, Artificial Sequence
  chemically synthesized
tttttaagtatacagttcag

SEQ ID NO: 183400 - DNA, 20 bp, Artificial Sequence
  chemically synthesized
ccatttttaagtatacagtt

SEQ ID NO: 183401 - DNA, 20 bp, Artificial Sequence
  chemically synthesized
ctttaccatttttaagtata

SEQ ID NO: 183402 - DNA, 20 bp, Artificial Sequence
  chemically synthesized
ctgaactgtatacttaaaaa

SEQ ID NO: 183403 - DNA, 20 bp, Artificial Sequence
  chemically synthesized
aatatacctttaccattttt

SEQ ID NO: 183404 - DNA, 20 bp, Artificial Sequence
  chemically synthesized
ctgtatacttaaaaatggta

SEQ ID NO: 183405 - DNA, 20 bp, Artificial Sequence
  chemically synthesized
tgtatacttaaaaatggtaa

SEQ ID NO: 183406 - DNA, 20 bp, Artificial Sequence
  chemically synthesized
atatacctctatataaataa

SEQ ID NO: 183407 - DNA, 20 bp, Artificial Sequence
  chemically synthesized
tatatttacttttatttata

SEQ ID NO: 183408 - DNA, 20 bp, Artificial Sequence
  chemically synthesized
tatttacttttatttatata

SEQ ID NO: 183409 - DNA, 20 bp, Artificial Sequence
  chemically synthesized
atttacttttatttatatag

SEQ ID NO: 183410 - DNA, 20 bp, Artificial Sequence
  chemically synthesized
ttttaaatttaattttattg

SEQ ID NO: 183411 - DNA, 20 bp, Artificial Sequence
  chemically synthesized
tttttaaatttaattttatt

SEQ ID NO: 183412 - DNA, 20 bp, Artificial Sequence
  chemically synthesized
aaaattaaatttaaaaaatt

SEQ ID NO: 183413 - DNA, 20 bp, Artificial Sequence
  chemically synthesized
aaattaaatttaaaaaattc

SEQ ID NO: 183414 - DNA, 20 bp, Artificial Sequence
  chemically synthesized
aaaattcaggccaatcacat

SEQ ID NO: 183415 - DNA, 20 bp, Artificial Sequence
  chemically synthesized
caggcatgagccaatgtgat

SEQ ID NO: 183416 - DNA, 20 bp, Artificial Sequence
  chemically synthesized
agtgcggggattacaggcat

SEQ ID NO: 183417 - DNA, 20 bp, Artificial Sequence
  chemically synthesized
tcccaaagtgcggggattac

SEQ ID NO: 183418 - DNA, 20 bp, Artificial Sequence
  chemically synthesized
ctcccaaagtgcggggatta

SEQ ID NO: 183419 - DNA, 20 bp, Artificial Sequence
  chemically synthesized
tgcctgtaatccccgcactt

SEQ ID NO: 183420 - DNA, 20 bp, Artificial Sequence
  chemically synthesized
cctcagcctcccaaagtgcg

SEQ ID NO: 183421 - DNA, 20 bp, Artificial Sequence
  chemically synthesized
gcctgtaatccccgcacttt

SEQ ID NO: 183422 - DNA, 20 bp, Artificial Sequence
  chemically synthesized
acctcagcctcccaaagtgc

SEQ ID NO: 183423 - DNA, 20 bp, Artificial Sequence
  chemically synthesized
cacctcagcctcccaaagtg

SEQ ID NO: 183424 - DNA, 20 bp, Artificial Sequence
  chemically synthesized
ctgtaatccccgcactttgg

SEQ ID NO: 183425 - DNA, 20 bp, Artificial Sequence
  chemically synthesized
tgtaatccccgcactttggg

SEQ ID NO: 183426 - DNA, 20 bp, Artificial Sequence
  chemically synthesized
ccacccacctcagcctccca

SEQ ID NO: 183427 - DNA, 20 bp, Artificial Sequence
  chemically synthesized
tccccgcactttgggaggct

SEQ ID NO: 183428 - DNA, 20 bp, Artificial Sequence
  chemically synthesized
ccccgcactttgggaggctg

SEQ ID NO: 183429 - DNA, 20 bp, Artificial Sequence
  chemically synthesized
cgcactttgggaggctgagg

SEQ ID NO: 183430 - DNA, 20 bp, Artificial Sequence
  chemically synthesized
gcactttgggaggctgaggt

SEQ ID NO: 183431 - DNA, 20 bp, Artificial Sequence
  chemically synthesized
ctttgggaggctgaggtggg

SEQ ID NO: 183432 - DNA, 20 bp, Artificial Sequence
  chemically synthesized
gtcaagtgatccacccacct

SEQ ID NO: 183433 - DNA, 20 bp, Artificial Sequence
  chemically synthesized
gtgggtggatcacttgacct

SEQ ID NO: 183434 - DNA, 20 bp, Artificial Sequence
  chemically synthesized
tgggtggatcacttgacctc

SEQ ID NO: 183435 - DNA, 20 bp, Artificial Sequence
  chemically synthesized
ggtctcaaactcctgaggtc

SEQ ID NO: 183436 - DNA, 20 bp, Artificial Sequence
  chemically synthesized
ggtggatcacttgacctcag

SEQ ID NO: 183437 - DNA, 20 bp, Artificial Sequence
  chemically synthesized
cacctggtctcaaactcctg

SEQ ID NO: 183438 - DNA, 20 bp, Artificial Sequence
  chemically synthesized
ccacctggtctcaaactcct

SEQ ID NO: 183439 - DNA, 20 bp, Artificial Sequence
  chemically synthesized
tcacttgacctcaggagttt

SEQ ID NO: 183440 - DNA, 20 bp, Artificial Sequence
  chemically synthesized
tgacctcaggagtttgagac

SEQ ID NO: 183441 - DNA, 20 bp, Artificial Sequence
  chemically synthesized
gacctcaggagtttgagacc

SEQ ID NO: 183442 - DNA, 20 bp, Artificial Sequence
  chemically synthesized
ctcaggagtttgagaccagg

SEQ ID NO: 183443 - DNA, 20 bp, Artificial Sequence
  chemically synthesized
tcaggagtttgagaccaggt

SEQ ID NO: 183444 - DNA, 20 bp, Artificial Sequence
  chemically synthesized
atttcactgtgttgcccacc

SEQ ID NO: 183445 - DNA, 20 bp, Artificial Sequence
  chemically synthesized
ttgagaccaggtgggcaaca

SEQ ID NO: 183446 - DNA, 20 bp, Artificial Sequence
  chemically synthesized
tttttttttttggtagaggc

SEQ ID NO: 183447 - DNA, 20 bp, Artificial Sequence
  chemically synthesized
ttttttttttttggtagagg

SEQ ID NO: 183448 - DNA, 20 bp, Artificial Sequence
  chemically synthesized
tttttttttttttttggtag

SEQ ID NO: 183449 - DNA, 20 bp, Artificial Sequence
  chemically synthesized
ttttttttttttttttggta

SEQ ID NO: 183450 - DNA, 20 bp, Artificial Sequence
  chemically synthesized
ttttttttttttttttttgg

SEQ ID NO: 183451 - DNA, 20 bp, Artificial Sequence
  chemically synthesized
cttttttttttttttttttt

SEQ ID NO: 183452 - DNA, 20 bp, Artificial Sequence
  chemically synthesized
ccaaaaaaaaaaaaaaaaaa

SEQ ID NO: 183453 - DNA, 20 bp, Artificial Sequence
  chemically synthesized
aaaaaaaaaaaaaaaagaaa

SEQ ID NO: 183454 - DNA, 20 bp, Artificial Sequence
  chemically synthesized
aaaaaaaaaaaagaaatagc

SEQ ID NO: 183455 - DNA, 20 bp, Artificial Sequence
  chemically synthesized
aaaaaaaaaaagaaatagct

SEQ ID NO: 183456 - DNA, 20 bp, Artificial Sequence
  chemically synthesized
aaaaaagaaatagctgggtg

SEQ ID NO: 183457 - DNA, 20 bp, Artificial Sequence
  chemically synthesized
aaagaaatagctgggtgtag

SEQ ID NO: 183458 - DNA, 20 bp, Artificial Sequence
  chemically synthesized
cagacacgggctactacacc

SEQ ID NO: 183459 - DNA, 20 bp, Artificial Sequence
  chemically synthesized
ggtgtagtagcccgtgtctg

SEQ ID NO: 183460 - DNA, 20 bp, Artificial Sequence
  chemically synthesized
gtagctgggaccacagacac

SEQ ID NO: 183461 - DNA, 20 bp, Artificial Sequence
  chemically synthesized
agtagctgggaccacagaca

SEQ ID NO: 183462 - DNA, 20 bp, Artificial Sequence
  chemically synthesized
gtagcccgtgtctgtggtcc

SEQ ID NO: 183463 - DNA, 20 bp, Artificial Sequence
  chemically synthesized
ctcctgagtagctgggacca

SEQ ID NO: 183464 - DNA, 20 bp, Artificial Sequence
  chemically synthesized
tgtctgtggtcccagctact

SEQ ID NO: 183465 - DNA, 20 bp, Artificial Sequence
  chemically synthesized
cctcagcctcctgagtagct

SEQ ID NO: 183466 - DNA, 20 bp, Artificial Sequence
  chemically synthesized
gtctgtggtcccagctactc

SEQ ID NO: 183467 - DNA, 20 bp, Artificial Sequence
  chemically synthesized
acctcagcctcctgagtagc

SEQ ID NO: 183468 - DNA, 20 bp, Artificial Sequence
  chemically synthesized
ctgtggtcccagctactcag

SEQ ID NO: 183469 - DNA, 20 bp, Artificial Sequence
  chemically synthesized
tgtggtcccagctactcagg

SEQ ID NO: 183470 - DNA, 20 bp, Artificial Sequence
  chemically synthesized
tccaacctcagcctcctgag

SEQ ID NO: 183471 - DNA, 20 bp, Artificial Sequence
  chemically synthesized
tcctccaacctcagcctcct

SEQ ID NO: 183472 - DNA, 20 bp, Artificial Sequence
  chemically synthesized
tcccagctactcaggaggct

SEQ ID NO: 183473 - DNA, 20 bp, Artificial Sequence
  chemically synthesized
cccagctactcaggaggctg

SEQ ID NO: 183474 - DNA, 20 bp, Artificial Sequence
  chemically synthesized
gctactcaggaggctgaggt

SEQ ID NO: 183475 - DNA, 20 bp, Artificial Sequence
  chemically synthesized
tactcaggaggctgaggttg

SEQ ID NO: 183476 - DNA, 20 bp, Artificial Sequence
  chemically synthesized
actcaggaggctgaggttgg

SEQ ID NO: 183477 - DNA, 20 bp, Artificial Sequence
  chemically synthesized
ttcaagcgatcctccaacct

SEQ ID NO: 183478 - DNA, 20 bp, Artificial Sequence
  chemically synthesized
gttggaggatcgcttgaacc

SEQ ID NO: 183479 - DNA, 20 bp, Artificial Sequence
  chemically synthesized
ttggaggatcgcttgaacct

SEQ ID NO: 183480 - DNA, 20 bp, Artificial Sequence
  chemically synthesized
agccttgatctcccaggttc

SEQ ID NO: 183481 - DNA, 20 bp, Artificial Sequence
  chemically synthesized
ggaggatcgcttgaacctgg

SEQ ID NO: 183482 - DNA, 20 bp, Artificial Sequence
  chemically synthesized
cactgcagccttgatctccc

SEQ ID NO: 183483 - DNA, 20 bp, Artificial Sequence
  chemically synthesized
tcgcttgaacctgggagatc

SEQ ID NO: 183484 - DNA, 20 bp, Artificial Sequence
  chemically synthesized
tcactgcagccttgatctcc

SEQ ID NO: 183485 - DNA, 20 bp, Artificial Sequence
  chemically synthesized
cgcttgaacctgggagatca

SEQ ID NO: 183486 - DNA, 20 bp, Artificial Sequence
  chemically synthesized
aacctgggagatcaaggctg

SEQ ID NO: 183487 - DNA, 20 bp, Artificial Sequence
  chemically synthesized
ggcatgatcacagttcactg

SEQ ID NO: 183488 - DNA, 20 bp, Artificial Sequence
  chemically synthesized
ggaatgcagtggcatgatca

SEQ ID NO: 183489 - DNA, 20 bp, Artificial Sequence
  chemically synthesized
tcactcaggctggaatgcag

SEQ ID NO: 183490 - DNA, 20 bp, Artificial Sequence
  chemically synthesized
gtgatcatgccactgcattc

SEQ ID NO: 183491 - DNA, 20 bp, Artificial Sequence
  chemically synthesized
ctgtcactcaggctggaatg

SEQ ID NO: 183492 - DNA, 20 bp, Artificial Sequence
  chemically synthesized
atgccactgcattccagcct

SEQ ID NO: 183493 - DNA, 20 bp, Artificial Sequence
  chemically synthesized
tctggctctgtcactcaggc

SEQ ID NO: 183494 - DNA, 20 bp, Artificial Sequence
  chemically synthesized
ctgcattccagcctgagtga

SEQ ID NO: 183495 - DNA, 20 bp, Artificial Sequence
  chemically synthesized
gggttctggctctgtcactc

SEQ ID NO: 183496 - DNA, 20 bp, Artificial Sequence
  chemically synthesized
gcattccagcctgagtgaca

SEQ ID NO: 183497 - DNA, 20 bp, Artificial Sequence
  chemically synthesized
ggggttctggctctgtcact

SEQ ID NO: 183498 - DNA, 20 bp, Artificial Sequence
  chemically synthesized
tccagcctgagtgacagagc

SEQ ID NO: 183499 - DNA, 20 bp, Artificial Sequence
  chemically synthesized
tcttttttgagatggggttc

SEQ ID NO: 183500 - DNA, 20 bp, Artificial Sequence
  chemically synthesized
gaactttcttttttgagatg

SEQ ID NO: 183501 - DNA, 20 bp, Artificial Sequence
  chemically synthesized
tgaactttcttttttgagat

SEQ ID NO: 183502 - DNA, 20 bp, Artificial Sequence
  chemically synthesized
atgaactttcttttttgaga

SEQ ID NO: 183503 - DNA, 20 bp, Artificial Sequence
  chemically synthesized
gccagaaccccatctcaaaa

SEQ ID NO: 183504 - DNA, 20 bp, Artificial Sequence
  chemically synthesized
ttttatgaactttctttttt

SEQ ID NO: 183505 - DNA, 20 bp, Artificial Sequence
  chemically synthesized
gaaccccatctcaaaaaaga

SEQ ID NO: 183506 - DNA, 20 bp, Artificial Sequence
  chemically synthesized
tcaaaaaagaaagttcataa

SEQ ID NO: 183507 - DNA, 20 bp, Artificial Sequence
  chemically synthesized
tcataaaagcatatcaaata

SEQ ID NO: 183508 - DNA, 20 bp, Artificial Sequence
  chemically synthesized
tcaaatatagtacttttcct

SEQ ID NO: 183509 - DNA, 20 bp, Artificial Sequence
  chemically synthesized
ttcctcttatgtctaaggaa

SEQ ID NO: 183510 - DNA, 20 bp, Artificial Sequence
  chemically synthesized
tagtacttttccttagacat

SEQ ID NO: 183511 - DNA, 20 bp, Artificial Sequence
  chemically synthesized
tgtgcttcctcttatgtcta

SEQ ID NO: 183512 - DNA, 20 bp, Artificial Sequence
  chemically synthesized
atgtgcttcctcttatgtct

SEQ ID NO: 183513 - DNA, 20 bp, Artificial Sequence
  chemically synthesized
gtacttttccttagacataa

SEQ ID NO: 183514 - DNA, 20 bp, Artificial Sequence
  chemically synthesized
tacttttccttagacataag

SEQ ID NO: 183515 - DNA, 20 bp, Artificial Sequence
  chemically synthesized
ttttccttagacataagagg

SEQ ID NO: 183516 - DNA, 20 bp, Artificial Sequence
  chemically synthesized
ataagaggaagcacatatct

SEQ ID NO: 183517 - DNA, 20 bp, Artificial Sequence
  chemically synthesized
agaggaagcacatatctgag

SEQ ID NO: 183518 - DNA, 20 bp, Artificial Sequence
  chemically synthesized
gcttcaagcctgtgtcttct

SEQ ID NO: 183519 - DNA, 20 bp, Artificial Sequence
  chemically synthesized
agcacatatctgagaagaca

SEQ ID NO: 183520 - DNA, 20 bp, Artificial Sequence
  chemically synthesized
gcacatatctgagaagacac

SEQ ID NO: 183521 - DNA, 20 bp, Artificial Sequence
  chemically synthesized
tctgagaagacacaggcttg

SEQ ID NO: 183522 - DNA, 20 bp, Artificial Sequence
  chemically synthesized
tttgccagtttaacagcttc

SEQ ID NO: 183523 - DNA, 20 bp, Artificial Sequence
  chemically synthesized
caggcttgaagctgttaaac

SEQ ID NO: 183524 - DNA, 20 bp, Artificial Sequence
  chemically synthesized
atgattatttgccagtttaa

SEQ ID NO: 183525 - DNA, 20 bp, Artificial Sequence
  chemically synthesized
ctacatttatgattatttgc

SEQ ID NO: 183526 - DNA, 20 bp, Artificial Sequence
  chemically synthesized
ctggcaaataatcataaatg

SEQ ID NO: 183527 - DNA, 20 bp, Artificial Sequence
  chemically synthesized
gcaaataatcataaatgtag

SEQ ID NO: 183528 - DNA, 20 bp, Artificial Sequence
  chemically synthesized
caaataatcataaatgtagt

SEQ ID NO: 183529 - DNA, 20 bp, Artificial Sequence
  chemically synthesized
aaataatcataaatgtagtg

SEQ ID NO: 183530 - DNA, 20 bp, Artificial Sequence
  chemically synthesized
acagggtagaacaaataaga

SEQ ID NO: 183531 - DNA, 20 bp, Artificial Sequence
  chemically synthesized
gacgacagggtagaacaaat

SEQ ID NO: 183532 - DNA, 20 bp, Artificial Sequence
  chemically synthesized
agctaatagtgacgacaggg

SEQ ID NO: 183533 - DNA, 20 bp, Artificial Sequence
  chemically synthesized
agcagctaatagtgacgaca

SEQ ID NO: 183534 - DNA, 20 bp, Artificial Sequence
  chemically synthesized
aagcagctaatagtgacgac

SEQ ID NO: 183535 - DNA, 20 bp, Artificial Sequence
  chemically synthesized
aaagcagctaatagtgacga

SEQ ID NO: 183536 - DNA, 20 bp, Artificial Sequence
  chemically synthesized
ttctaccctgtcgtcactat

SEQ ID NO: 183537 - DNA, 20 bp, Artificial Sequence
  chemically synthesized
tatgtgaacaaagcagctaa

SEQ ID NO: 183538 - DNA, 20 bp, Artificial Sequence
  chemically synthesized
atctagctatgtgaacaaag

SEQ ID NO: 183539 - DNA, 20 bp, Artificial Sequence
  chemically synthesized
catatctagctatgtgaaca

SEQ ID NO: 183540 - DNA, 20 bp, Artificial Sequence
  chemically synthesized
tattagctgctttgttcaca

SEQ ID NO: 183541 - DNA, 20 bp, Artificial Sequence
  chemically synthesized
agctgctttgttcacatagc

SEQ ID NO: 183542 - DNA, 20 bp, Artificial Sequence
  chemically synthesized
tttgttcacatagctagata

SEQ ID NO: 183543 - DNA, 20 bp, Artificial Sequence
  chemically synthesized
ttgttacatatgaccatatc

SEQ ID NO: 183544 - DNA, 20 bp, Artificial Sequence
  chemically synthesized
atatggtcatatgtaacaat

SEQ ID NO: 183545 - DNA, 20 bp, Artificial Sequence
  chemically synthesized
tatggtcatatgtaacaata

SEQ ID NO: 183546 - DNA, 20 bp, Artificial Sequence
  chemically synthesized
atggtcatatgtaacaataa

SEQ ID NO: 183547 - DNA, 20 bp, Artificial Sequence
  chemically synthesized
catatgtaacaataagggaa

SEQ ID NO: 183548 - DNA, 20 bp, Artificial Sequence
  chemically synthesized
atatgtaacaataagggaaa

SEQ ID NO: 183549 - DNA, 20 bp, Artificial Sequence
  chemically synthesized
taacaataagggaaaaggca

SEQ ID NO: 183550 - DNA, 20 bp, Artificial Sequence
  chemically synthesized
taagggaaaaggcacagatc

SEQ ID NO: 183551 - DNA, 20 bp, Artificial Sequence
  chemically synthesized
aagggaaaaggcacagatct

SEQ ID NO: 183552 - DNA, 20 bp, Artificial Sequence
  chemically synthesized
aaaagtcagtgatttagacc

SEQ ID NO: 183553 - DNA, 20 bp, Artificial Sequence
  chemically synthesized
agaactaaaagtcagtgatt

SEQ ID NO: 183554 - DNA, 20 bp, Artificial Sequence
  chemically synthesized
gggtctaaatcactgacttt

SEQ ID NO: 183555 - DNA, 20 bp, Artificial Sequence
  chemically synthesized
aaggatcgagaactaaaagt

SEQ ID NO: 183556 - DNA, 20 bp, Artificial Sequence
  chemically synthesized
atagaaggatcgagaactaa

SEQ ID NO: 183557 - DNA, 20 bp, Artificial Sequence
  chemically synthesized
accaaagttatagaaggatc

SEQ ID NO: 183558 - DNA, 20 bp, Artificial Sequence
  chemically synthesized
aggctaaccaaagttataga

SEQ ID NO: 183559 - DNA, 20 bp, Artificial Sequence
  chemically synthesized
aaggctaaccaaagttatag

SEQ ID NO: 183560 - DNA, 20 bp, Artificial Sequence
  chemically synthesized
tctcgatccttctataactt

SEQ ID NO: 183561 - DNA, 20 bp, Artificial Sequence
  chemically synthesized
tccaaggctaaccaaagtta

SEQ ID NO: 183562 - DNA, 20 bp, Artificial Sequence
  chemically synthesized
gatccttctataactttggt

SEQ ID NO: 183563 - DNA, 20 bp, Artificial Sequence
  chemically synthesized
tatatgtccaaggctaacca

SEQ ID NO: 183564 - DNA, 20 bp, Artificial Sequence
  chemically synthesized
tctataactttggttagcct

SEQ ID NO: 183565 - DNA, 20 bp, Artificial Sequence
  chemically synthesized
aaaaacaagatatatgtcca

SEQ ID NO: 183566 - DNA, 20 bp, Artificial Sequence
  chemically synthesized
aaaaaacaagatatatgtcc

SEQ ID NO: 183567 - DNA, 20 bp, Artificial Sequence
  chemically synthesized
cattaagcacaagaaaaaac

SEQ ID NO: 183568 - DNA, 20 bp, Artificial Sequence
  chemically synthesized
caaattaccacattaagcac

SEQ ID NO: 183569 - DNA, 20 bp, Artificial Sequence
  chemically synthesized
gttttttcttgtgcttaatg

SEQ ID NO: 183570 - DNA, 20 bp, Artificial Sequence
  chemically synthesized
attttacaaattaccacatt

SEQ ID NO: 183571 - DNA, 20 bp, Artificial Sequence
  chemically synthesized
taatgtggtaatttgtaaaa

SEQ ID NO: 183572 - DNA, 20 bp, Artificial Sequence
  chemically synthesized
gtaatttgtaaaatggacat

SEQ ID NO: 183573 - DNA, 20 bp, Artificial Sequence
  chemically synthesized
agatcataagcaaagcatgg

SEQ ID NO: 183574 - DNA, 20 bp, Artificial Sequence
  chemically synthesized
tcgagatcataagcaaagca

SEQ ID NO: 183575 - DNA, 20 bp, Artificial Sequence
  chemically synthesized
actcttcgagatcataagca

SEQ ID NO: 183576 - DNA, 20 bp, Artificial Sequence
  chemically synthesized
acctgactcttcgagatcat

SEQ ID NO: 183577 - DNA, 20 bp, Artificial Sequence
  chemically synthesized
atgctttgcttatgatctcg

SEQ ID NO: 183578 - DNA, 20 bp, Artificial Sequence
  chemically synthesized
gctttgcttatgatctcgaa

SEQ ID NO: 183579 - DNA, 20 bp, Artificial Sequence
  chemically synthesized
tgcttatgatctcgaagagt

SEQ ID NO: 183580 - DNA, 20 bp, Artificial Sequence
  chemically synthesized
atcatctcacctgactcttc

SEQ ID NO: 183581 - DNA, 20 bp, Artificial Sequence
  chemically synthesized
gcttatgatctcgaagagtc

SEQ ID NO: 183582 - DNA, 20 bp, Artificial Sequence
  chemically synthesized
atgatctcgaagagtcaggt

SEQ ID NO: 183583 - DNA, 20 bp, Artificial Sequence
  chemically synthesized
cgaagagtcaggtgagatga

SEQ ID NO: 183584 - DNA, 20 bp, Artificial Sequence
  chemically synthesized
cgtataaaatctctataact

SEQ ID NO: 183585 - DNA, 20 bp, Artificial Sequence
  chemically synthesized
gtcgcaatatctcagttata

SEQ ID NO: 183586 - DNA, 20 bp, Artificial Sequence
  chemically synthesized
ttgtcgcaatatctcagtta

SEQ ID NO: 183587 - DNA, 20 bp, Artificial Sequence
  chemically synthesized
acttaattgtcgcaatatct

SEQ ID NO: 183588 - DNA, 20 bp, Artificial Sequence
  chemically synthesized
actgagatattgcgacaatt

SEQ ID NO: 183589 - DNA, 20 bp, Artificial Sequence
  chemically synthesized
gagatattgcgacaattaag

SEQ ID NO: 183590 - DNA, 20 bp, Artificial Sequence
  chemically synthesized
agatattgcgacaattaagt

SEQ ID NO: 183591 - DNA, 20 bp, Artificial Sequence
  chemically synthesized
catttgtaaaactcttatca

SEQ ID NO: 183592 - DNA, 20 bp, Artificial Sequence
  chemically synthesized
tatgaacaggactttgataa

SEQ ID NO: 183593 - DNA, 20 bp, Artificial Sequence
  chemically synthesized
tctatgaacaggactttgat

SEQ ID NO: 183594 - DNA, 20 bp, Artificial Sequence
  chemically synthesized
tcttatcaaagtcctgttca

SEQ ID NO: 183595 - DNA, 20 bp, Artificial Sequence
  chemically synthesized
ttatcaaagtcctgttcata

SEQ ID NO: 183596 - DNA, 20 bp, Artificial Sequence
  chemically synthesized
tgtgcatttactctatgaac

SEQ ID NO: 183597 - DNA, 20 bp, Artificial Sequence
  chemically synthesized
ttgtgcatttactctatgaa

SEQ ID NO: 183598 - DNA, 20 bp, Artificial Sequence
  chemically synthesized
tagagtaaatgcacaaaact

SEQ ID NO: 183599 - DNA, 20 bp, Artificial Sequence
  chemically synthesized
gagctagtattaatgacact

SEQ ID NO: 183600 - DNA, 20 bp, Artificial Sequence
  chemically synthesized
aaacttagtgtcattaatac

SEQ ID NO: 183601 - DNA, 20 bp, Artificial Sequence
  chemically synthesized
aatttggaagttacaagagc

SEQ ID NO: 183602 - DNA, 20 bp, Artificial Sequence
  chemically synthesized
tataaatttggaagttacaa

SEQ ID NO: 183603 - DNA, 20 bp, Artificial Sequence
  chemically synthesized
actataaatttggaagttac

SEQ ID NO: 183604 - DNA, 20 bp, Artificial Sequence
  chemically synthesized
tacccaaactataaatttgg

SEQ ID NO: 183605 - DNA, 20 bp, Artificial Sequence
  chemically synthesized
tcttgtaacttccaaattta

SEQ ID NO: 183606 - DNA, 20 bp, Artificial Sequence
  chemically synthesized
atgtacccaaactataaatt

SEQ ID NO: 183607 - DNA, 20 bp, Artificial Sequence
  chemically synthesized
taacttccaaatttatagtt

SEQ ID NO: 183608 - DNA, 20 bp, Artificial Sequence
  chemically synthesized
aacttccaaatttatagttt

SEQ ID NO: 183609 - DNA, 20 bp, Artificial Sequence
  chemically synthesized
ttatagtttgggtacatgaa

SEQ ID NO: 183610 - DNA, 20 bp, Artificial Sequence
  chemically synthesized
agtttgggtacatgaataga

SEQ ID NO: 183611 - DNA, 20 bp, Artificial Sequence
  chemically synthesized
atagatagtgatatcaccca

SEQ ID NO: 183612 - DNA, 20 bp, Artificial Sequence
  chemically synthesized
gatagtgatatcacccacag

SEQ ID NO: 183613 - DNA, 20 bp, Artificial Sequence
  chemically synthesized
cctctcccaaaatctactgt

SEQ ID NO: 183614 - DNA, 20 bp, Artificial Sequence
  chemically synthesized
tcctctcccaaaatctactg

SEQ ID NO: 183615 - DNA, 20 bp, Artificial Sequence
  chemically synthesized
atatcacccacagtagattt

SEQ ID NO: 183616 - DNA, 20 bp, Artificial Sequence
  chemically synthesized
tatcacccacagtagatttt

SEQ ID NO: 183617 - DNA, 20 bp, Artificial Sequence
  chemically synthesized
tcacccacagtagattttgg

SEQ ID NO: 183618 - DNA, 20 bp, Artificial Sequence
  chemically synthesized
acccacagtagattttggga

SEQ ID NO: 183619 - DNA, 20 bp, Artificial Sequence
  chemically synthesized
cccacagtagattttgggag

SEQ ID NO: 183620 - DNA, 20 bp, Artificial Sequence
  chemically synthesized
ggagaggaatataacatgtt

SEQ ID NO: 183621 - DNA, 20 bp, Artificial Sequence
  chemically synthesized
gaatataacatgttgagttt

SEQ ID NO: 183622 - DNA, 20 bp, Artificial Sequence
  chemically synthesized
gttttggatatactgacttt

SEQ ID NO: 183623 - DNA, 20 bp, Artificial Sequence
  chemically synthesized
tctcaaagccatctcaaagt

SEQ ID NO: 183624 - DNA, 20 bp, Artificial Sequence
  chemically synthesized
tggatatactgactttgaga

SEQ ID NO: 183625 - DNA, 20 bp, Artificial Sequence
  chemically synthesized
tatgtctcaaagccatctca

SEQ ID NO: 183626 - DNA, 20 bp, Artificial Sequence
  chemically synthesized
actgactttgagatggcttt

SEQ ID NO: 183627 - DNA, 20 bp, Artificial Sequence
  chemically synthesized
tttgagatggctttgagaca

SEQ ID NO: 183628 - DNA, 20 bp, Artificial Sequence
  chemically synthesized
atttcctcttctatgtctca

SEQ ID NO: 183629 - DNA, 20 bp, Artificial Sequence
  chemically synthesized
gagatggctttgagacatag

SEQ ID NO: 183630 - DNA, 20 bp, Artificial Sequence
  chemically synthesized
gatggctttgagacatagaa

SEQ ID NO: 183631 - DNA, 20 bp, Artificial Sequence
  chemically synthesized
atggctttgagacatagaag

SEQ ID NO: 183632 - DNA, 20 bp, Artificial Sequence
  chemically synthesized
ttgagacatagaagaggaaa

SEQ ID NO: 183633 - DNA, 20 bp, Artificial Sequence
  chemically synthesized
aagaggaaatggtccatttg

SEQ ID NO: 183634 - DNA, 20 bp, Artificial Sequence
  chemically synthesized
cctacatatgtagcttcaaa

SEQ ID NO: 183635 - DNA, 20 bp, Artificial Sequence
  chemically synthesized
tccatttgaagctacatatg

SEQ ID NO: 183636 - DNA, 20 bp, Artificial Sequence
  chemically synthesized
ccatttgaagctacatatgt

SEQ ID NO: 183637 - DNA, 20 bp, Artificial Sequence
  chemically synthesized
tcagattagacctacatatg

SEQ ID NO: 183638 - DNA, 20 bp, Artificial Sequence
  chemically synthesized
cccaatatatagtttcagat

SEQ ID NO: 183639 - DNA, 20 bp, Artificial Sequence
  chemically synthesized
tttggcccaatatatagttt

SEQ ID NO: 183640 - DNA, 20 bp, Artificial Sequence
  chemically synthesized
tctaatctgaaactatatat

SEQ ID NO: 183641 - DNA, 20 bp, Artificial Sequence
  chemically synthesized
ctaatctgaaactatatatt

SEQ ID NO: 183642 - DNA, 20 bp, Artificial Sequence
  chemically synthesized
ctaatatttggcccaatata

SEQ ID NO: 183643 - DNA, 20 bp, Artificial Sequence
  chemically synthesized
ctatatattgggccaaatat

SEQ ID NO: 183644 - DNA, 20 bp, Artificial Sequence
  chemically synthesized
tatggcctaagtctaatatt

SEQ ID NO: 183645 - DNA, 20 bp, Artificial Sequence
  chemically synthesized
attgggccaaatattagact

SEQ ID NO: 183646 - DNA, 20 bp, Artificial Sequence
  chemically synthesized
ttgggccaaatattagactt

SEQ ID NO: 183647 - DNA, 20 bp, Artificial Sequence
  chemically synthesized
ccgatttcattttatggcct

SEQ ID NO: 183648 - DNA, 20 bp, Artificial Sequence
  chemically synthesized
aagtcaccgatttcatttta

SEQ ID NO: 183649 - DNA, 20 bp, Artificial Sequence
  chemically synthesized
cttaggccataaaatgaaat

SEQ ID NO: 183650 - DNA, 20 bp, Artificial Sequence
  chemically synthesized
taaaatgaaatcggtgactt

SEQ ID NO: 183651 - DNA, 20 bp, Artificial Sequence
  chemically synthesized
aatgaaatcggtgactttgg

SEQ ID NO: 183652 - DNA, 20 bp, Artificial Sequence
  chemically synthesized
tgaaatcggtgactttggta

SEQ ID NO: 183653 - DNA, 20 bp, Artificial Sequence
  chemically synthesized
cagctaagcagtctctacca

SEQ ID NO: 183654 - DNA, 20 bp, Artificial Sequence
  chemically synthesized
tgactttggtagagactgct

SEQ ID NO: 183655 - DNA, 20 bp, Artificial Sequence
  chemically synthesized
tcatgggctaagcagctaag

SEQ ID NO: 183656 - DNA, 20 bp, Artificial Sequence
  chemically synthesized
gtagagactgcttagctgct

SEQ ID NO: 183657 - DNA, 20 bp, Artificial Sequence
  chemically synthesized
ggatcatgggctaagcagct

SEQ ID NO: 183658 - DNA, 20 bp, Artificial Sequence
  chemically synthesized
ggaatggatcatgggctaag

SEQ ID NO: 183659 - DNA, 20 bp, Artificial Sequence
  chemically synthesized
agtggaatggatcatgggct

SEQ ID NO: 183660 - DNA, 20 bp, Artificial Sequence
  chemically synthesized
aatgtagtggaatggatcat

SEQ ID NO: 183661 - DNA, 20 bp, Artificial Sequence
  chemically synthesized
aaatgtagtggaatggatca

SEQ ID NO: 183662 - DNA, 20 bp, Artificial Sequence
  chemically synthesized
gcattcaaaatgtagtggaa

SEQ ID NO: 183663 - DNA, 20 bp, Artificial Sequence
  chemically synthesized
aatgggcattcaaaatgtag

SEQ ID NO: 183664 - DNA, 20 bp, Artificial Sequence
  chemically synthesized
tgcaatgggcattcaaaatg

SEQ ID NO: 183665 - DNA, 20 bp, Artificial Sequence
  chemically synthesized
tacattttgaatgcccattg

SEQ ID NO: 183666 - DNA, 20 bp, Artificial Sequence
  chemically synthesized
tgacaatgccaaactgcaat

SEQ ID NO: 183667 - DNA, 20 bp, Artificial Sequence
  chemically synthesized
atgacaatgccaaactgcaa

SEQ ID NO: 183668 - DNA, 20 bp, Artificial Sequence
  chemically synthesized
tttgaatgcccattgcagtt

SEQ ID NO: 183669 - DNA, 20 bp, Artificial Sequence
  chemically synthesized
ttgcagtttggcattgtcat

SEQ ID NO: 183670 - DNA, 20 bp, Artificial Sequence
  chemically synthesized
attgtcatgagaataaattc

SEQ ID NO: 183671 - DNA, 20 bp, Artificial Sequence
  chemically synthesized
ttagcttgtatgtcattggc

SEQ ID NO: 183672 - DNA, 20 bp, Artificial Sequence
  chemically synthesized
cactttagcttgtatgtcat

SEQ ID NO: 183673 - DNA, 20 bp, Artificial Sequence
  chemically synthesized
aattctggccaatgacatac

SEQ ID NO: 183674 - DNA, 20 bp, Artificial Sequence
  chemically synthesized
ggccaatgacatacaagcta

SEQ ID NO: 183675 - DNA, 20 bp, Artificial Sequence
  chemically synthesized
ggaagatctacacaacactt

SEQ ID NO: 183676 - DNA, 20 bp, Artificial Sequence
  chemically synthesized
atacaagctaaagtgttgtg

SEQ ID NO: 183677 - DNA, 20 bp, Artificial Sequence
  chemically synthesized
tgttgtgtagatcttccatg

SEQ ID NO: 183678 - DNA, 20 bp, Artificial Sequence
  chemically synthesized
cttttaaagggacttcatgg

SEQ ID NO: 183679 - DNA, 20 bp, Artificial Sequence
  chemically synthesized
acccttttaaagggacttca

SEQ ID NO: 183680 - DNA, 20 bp, Artificial Sequence
  chemically synthesized
cttccatgaagtccctttaa

SEQ ID NO: 183681 - DNA, 20 bp, Artificial Sequence
  chemically synthesized
ttccatgaagtccctttaaa

SEQ ID NO: 183682 - DNA, 20 bp, Artificial Sequence
  chemically synthesized
tccatgaagtccctttaaaa

SEQ ID NO: 183683 - DNA, 20 bp, Artificial Sequence
  chemically synthesized
gatacctctacccttttaaa

SEQ ID NO: 183684 - DNA, 20 bp, Artificial Sequence
  chemically synthesized
ggatacctctacccttttaa

SEQ ID NO: 183685 - DNA, 20 bp, Artificial Sequence
  chemically synthesized
gggatacctctaccctttta

SEQ ID NO: 183686 - DNA, 20 bp, Artificial Sequence
  chemically synthesized
atgaagtccctttaaaaggg

SEQ ID NO: 183687 - DNA, 20 bp, Artificial Sequence
  chemically synthesized
gaagtccctttaaaagggta

SEQ ID NO: 183688 - DNA, 20 bp, Artificial Sequence
  chemically synthesized
aagtccctttaaaagggtag

SEQ ID NO: 183689 - DNA, 20 bp, Artificial Sequence
  chemically synthesized
tgtaggaagtggacaaaaaa

SEQ ID NO: 183690 - DNA, 20 bp, Artificial Sequence
  chemically synthesized
gtgtaggaagtggacaaaaa

SEQ ID NO: 183691 - DNA, 20 bp, Artificial Sequence
  chemically synthesized
ggtgtaggaagtggacaaaa

SEQ ID NO: 183692 - DNA, 20 bp, Artificial Sequence
  chemically synthesized
aggctgcaaggtgtaggaag

SEQ ID NO: 183693 - DNA, 20 bp, Artificial Sequence
  chemically synthesized
caaaggctgcaaggtgtagg

SEQ ID NO: 183694 - DNA, 20 bp, Artificial Sequence
  chemically synthesized
tttcaaaggctgcaaggtgt

SEQ ID NO: 183695 - DNA, 20 bp, Artificial Sequence
  chemically synthesized
tgtccacttcctacaccttg

SEQ ID NO: 183696 - DNA, 20 bp, Artificial Sequence
  chemically synthesized
ttttcaaaggctgcaaggtg

SEQ ID NO: 183697 - DNA, 20 bp, Artificial Sequence
  chemically synthesized
actgcttttcaaaggctgca

SEQ ID NO: 183698 - DNA, 20 bp, Artificial Sequence
  chemically synthesized
aactgcttttcaaaggctgc

SEQ ID NO: 183699 - DNA, 20 bp, Artificial Sequence
  chemically synthesized
tacaccttgcagcctttgaa

SEQ ID NO: 183700 - DNA, 20 bp, Artificial Sequence
  chemically synthesized
ctatcacaactgcttttcaa

SEQ ID NO: 183701 - DNA, 20 bp, Artificial Sequence
  chemically synthesized
accttgcagcctttgaaaag

SEQ ID NO: 183702 - DNA, 20 bp, Artificial Sequence
  chemically synthesized
tctatcacaactgcttttca

SEQ ID NO: 183703 - DNA, 20 bp, Artificial Sequence
  chemically synthesized
cctttgaaaagcagttgtga

SEQ ID NO: 183704 - DNA, 20 bp, Artificial Sequence
  chemically synthesized
tgaaaagcagttgtgataga

SEQ ID NO: 183705 - DNA, 20 bp, Artificial Sequence
  chemically synthesized
aaaagcagttgtgatagata

SEQ ID NO: 183706 - DNA, 20 bp, Artificial Sequence
  chemically synthesized
aagcagttgtgatagataga

SEQ ID NO: 183707 - DNA, 20 bp, Artificial Sequence
  chemically synthesized
tgtgatagatagagagctga

SEQ ID NO: 183708 - DNA, 20 bp, Artificial Sequence
  chemically synthesized
tcatggatcaagatgactat

SEQ ID NO: 183709 - DNA, 20 bp, Artificial Sequence
  chemically synthesized
tgatagtcatcttgatccat

SEQ ID NO: 183710 - DNA, 20 bp, Artificial Sequence
  chemically synthesized
ggtccttacactcatggatc

SEQ ID NO: 183711 - DNA, 20 bp, Artificial Sequence
  chemically synthesized
tcatcttgatccatgagtgt

SEQ ID NO: 183712 - DNA, 20 bp, Artificial Sequence
  chemically synthesized
tggtgaggtccttacactca

SEQ ID NO: 183713 - DNA, 20 bp, Artificial Sequence
  chemically synthesized
catcttgatccatgagtgta

SEQ ID NO: 183714 - DNA, 20 bp, Artificial Sequence
  chemically synthesized
tgagtgtaaggacctcacca

SEQ ID NO: 183715 - DNA, 20 bp, Artificial Sequence
  chemically synthesized
gagtgtaaggacctcaccaa

SEQ ID NO: 183716 - DNA, 20 bp, Artificial Sequence
  chemically synthesized
agatctgccatcctttggtg

SEQ ID NO: 183717 - DNA, 20 bp, Artificial Sequence
  chemically synthesized
cagatctgccatcctttggt

SEQ ID NO: 183718 - DNA, 20 bp, Artificial Sequence
  chemically synthesized
gtaaggacctcaccaaagga

SEQ ID NO: 183719 - DNA, 20 bp, Artificial Sequence
  chemically synthesized
ctcacagatctgccatcctt

SEQ ID NO: 183720 - DNA, 20 bp, Artificial Sequence
  chemically synthesized
aggacctcaccaaaggatgg

SEQ ID NO: 183721 - DNA, 20 bp, Artificial Sequence
  chemically synthesized
ccaaaggatggcagatctgt

SEQ ID NO: 183722 - DNA, 20 bp, Artificial Sequence
  chemically synthesized
aggatggcagatctgtgaga

SEQ ID NO: 183723 - DNA, 20 bp, Artificial Sequence
  chemically synthesized
tccagatcccttctgtctca

SEQ ID NO: 183724 - DNA, 20 bp, Artificial Sequence
  chemically synthesized
atggcagatctgtgagacag

SEQ ID NO: 183725 - DNA, 20 bp, Artificial Sequence
  chemically synthesized
tggcagatctgtgagacaga

SEQ ID NO: 183726 - DNA, 20 bp, Artificial Sequence
  chemically synthesized
ggcagatctgtgagacagaa

SEQ ID NO: 183727 - DNA, 20 bp, Artificial Sequence
  chemically synthesized
tctgtgagacagaagggatc

SEQ ID NO: 183728 - DNA, 20 bp, Artificial Sequence
  chemically synthesized
gctctatgatgttgaagatc

SEQ ID NO: 183729 - DNA, 20 bp, Artificial Sequence
  chemically synthesized
atcattgctctatgatgttg

SEQ ID NO: 183730 - DNA, 20 bp, Artificial Sequence
  chemically synthesized
gatctggatcttcaacatca

SEQ ID NO: 183731 - DNA, 20 bp, Artificial Sequence
  chemically synthesized
tctggatcttcaacatcata

SEQ ID NO: 183732 - DNA, 20 bp, Artificial Sequence
  chemically synthesized
tagagcaatgataccaacct

SEQ ID NO: 183733 - DNA, 20 bp, Artificial Sequence
  chemically synthesized
gccagtaggtagtccgaggt

SEQ ID NO: 183734 - DNA, 20 bp, Artificial Sequence
  chemically synthesized
atctgccagtaggtagtccg

SEQ ID NO: 183735 - DNA, 20 bp, Artificial Sequence
  chemically synthesized
aatctgccagtaggtagtcc

SEQ ID NO: 183736 - DNA, 20 bp, Artificial Sequence
  chemically synthesized
accaacctcggactacctac

SEQ ID NO: 183737 - DNA, 20 bp, Artificial Sequence
  chemically synthesized
agaaggaatctgccagtagg

SEQ ID NO: 183738 - DNA, 20 bp, Artificial Sequence
  chemically synthesized
aacctcggactacctactgg

SEQ ID NO: 183739 - DNA, 20 bp, Artificial Sequence
  chemically synthesized
tgtagaaggaatctgccagt

SEQ ID NO: 183740 - DNA, 20 bp, Artificial Sequence
  chemically synthesized
ttgtagaaggaatctgccag

SEQ ID NO: 183741 - DNA, 20 bp, Artificial Sequence
  chemically synthesized
ttcttgtagaaggaatctgc

SEQ ID NO: 183742 - DNA, 20 bp, Artificial Sequence
  chemically synthesized
tactggcagattccttctac

SEQ ID NO: 183743 - DNA, 20 bp, Artificial Sequence
  chemically synthesized
tatattcatcttcttgtaga

SEQ ID NO: 183744 - DNA, 20 bp, Artificial Sequence
  chemically synthesized
tggcagattccttctacaag

SEQ ID NO: 183745 - DNA, 20 bp, Artificial Sequence
  chemically synthesized
atatattcatcttcttgtag

SEQ ID NO: 183746 - DNA, 20 bp, Artificial Sequence
  chemically synthesized
gaaatatattcatcttcttg

SEQ ID NO: 183747 - DNA, 20 bp, Artificial Sequence
  chemically synthesized
ttatagtaactgaaacaaag

SEQ ID NO: 183748 - DNA, 20 bp, Artificial Sequence
  chemically synthesized
aatatatttctactttgttt

SEQ ID NO: 183749 - DNA, 20 bp, Artificial Sequence
  chemically synthesized
gaattatagtaactgaaaca

SEQ ID NO: 183750 - DNA, 20 bp, Artificial Sequence
  chemically synthesized
gggagattaaaaaagaatta

SEQ ID NO: 183751 - DNA, 20 bp, Artificial Sequence
  chemically synthesized
aatatctagggagattaaaa

SEQ ID NO: 183752 - DNA, 20 bp, Artificial Sequence
  chemically synthesized
taattcttttttaatctccc

SEQ ID NO: 183753 - DNA, 20 bp, Artificial Sequence
  chemically synthesized
caattagaataatatctagg

SEQ ID NO: 183754 - DNA, 20 bp, Artificial Sequence
  chemically synthesized
atcaattagaataatatcta

SEQ ID NO: 183755 - DNA, 20 bp, Artificial Sequence
  chemically synthesized
tatcaattagaataatatct

SEQ ID NO: 183756 - DNA, 20 bp, Artificial Sequence
  chemically synthesized
gtatcaattagaataatatc

SEQ ID NO: 183757 - DNA, 20 bp, Artificial Sequence
  chemically synthesized
agatattattctaattgata

SEQ ID NO: 183758 - DNA, 20 bp, Artificial Sequence
  chemically synthesized
gtagctttcactgtatcaat

SEQ ID NO: 183759 - DNA, 20 bp, Artificial Sequence
  chemically synthesized
tattctaattgatacagtga

SEQ ID NO: 183760 - DNA, 20 bp, Artificial Sequence
  chemically synthesized
gttatccatagcaacaaatg

SEQ ID NO: 183761 - DNA, 20 bp, Artificial Sequence
  chemically synthesized
gaaagctacatttgttgcta

SEQ ID NO: 183762 - DNA, 20 bp, Artificial Sequence
  chemically synthesized
gtttccctgattgttatcca

SEQ ID NO: 183763 - DNA, 20 bp, Artificial Sequence
  chemically synthesized
ttgttgctatggataacaat

SEQ ID NO: 183764 - DNA, 20 bp, Artificial Sequence
  chemically synthesized
tgttgctatggataacaatc

SEQ ID NO: 183765 - DNA, 20 bp, Artificial Sequence
  chemically synthesized
gttgctatggataacaatca

SEQ ID NO: 183766 - DNA, 20 bp, Artificial Sequence
  chemically synthesized
taacaatcagggaaaccgta

SEQ ID NO: 183767 - DNA, 20 bp, Artificial Sequence
  chemically synthesized
tcccttcttctcattctata

SEQ ID NO: 183768 - DNA, 20 bp, Artificial Sequence
  chemically synthesized
tcagggaaaccgtatagaat

SEQ ID NO: 183769 - DNA, 20 bp, Artificial Sequence
  chemically synthesized
gggaaaccgtatagaatgag

SEQ ID NO: 183770 - DNA, 20 bp, Artificial Sequence
  chemically synthesized
aaaccgtatagaatgagaag

SEQ ID NO: 183771 - DNA, 20 bp, Artificial Sequence
  chemically synthesized
aaccgtatagaatgagaaga

SEQ ID NO: 183772 - DNA, 20 bp, Artificial Sequence
  chemically synthesized
accgtatagaatgagaagaa

SEQ ID NO: 183773 - DNA, 20 bp, Artificial Sequence
  chemically synthesized
cgtatagaatgagaagaagg

SEQ ID NO: 183774 - DNA, 20 bp, Artificial Sequence
  chemically synthesized
gtatagaatgagaagaaggg

SEQ ID NO: 183775 - DNA, 20 bp, Artificial Sequence
  chemically synthesized
tatagaatgagaagaaggga

SEQ ID NO: 183776 - DNA, 20 bp, Artificial Sequence
  chemically synthesized
aatgagaagaagggagggtt

SEQ ID NO: 183777 - DNA, 20 bp, Artificial Sequence
  chemically synthesized
ggagggttcagaacatgtcc

SEQ ID NO: 183778 - DNA, 20 bp, Artificial Sequence
  chemically synthesized
agggttcagaacatgtccta

SEQ ID NO: 183779 - DNA, 20 bp, Artificial Sequence
  chemically synthesized
ttacatcctgatgtttctct

SEQ ID NO: 183780 - DNA, 20 bp, Artificial Sequence
  chemically synthesized
cttacatcctgatgtttctc

SEQ ID NO: 183781 - DNA, 20 bp, Artificial Sequence
  chemically synthesized
aacatgtcctagagaaacat

SEQ ID NO: 183782 - DNA, 20 bp, Artificial Sequence
  chemically synthesized
acatgtcctagagaaacatc

SEQ ID NO: 183783 - DNA, 20 bp, Artificial Sequence
  chemically synthesized
ctagagaaacatcaggatgt

SEQ ID NO: 183784 - DNA, 20 bp, Artificial Sequence
  chemically synthesized
tagagaaacatcaggatgta

SEQ ID NO: 183785 - DNA, 20 bp, Artificial Sequence
  chemically synthesized
agagaaacatcaggatgtaa

SEQ ID NO: 183786 - DNA, 20 bp, Artificial Sequence
  chemically synthesized
gagaaacatcaggatgtaag

SEQ ID NO: 183787 - DNA, 20 bp, Artificial Sequence
  chemically synthesized
aaacatcaggatgtaagggg

SEQ ID NO: 183788 - DNA, 20 bp, Artificial Sequence
  chemically synthesized
aacatcaggatgtaaggggc

SEQ ID NO: 183789 - DNA, 20 bp, Artificial Sequence
  chemically synthesized
caggatgtaaggggcaggta

SEQ ID NO: 183790 - DNA, 20 bp, Artificial Sequence
  chemically synthesized
atgtaaggggcaggtaaagc

SEQ ID NO: 183791 - DNA, 20 bp, Artificial Sequence
  chemically synthesized
tgtaaggggcaggtaaagca

SEQ ID NO: 183792 - DNA, 20 bp, Artificial Sequence
  chemically synthesized
taaggggcaggtaaagcaag

SEQ ID NO: 183793 - DNA, 20 bp, Artificial Sequence
  chemically synthesized
agcaaggagtgtcatcaata

SEQ ID NO: 183794 - DNA, 20 bp, Artificial Sequence
  chemically synthesized
aggagtgtcatcaatatagt

SEQ ID NO: 183795 - DNA, 20 bp, Artificial Sequence
  chemically synthesized
ggagtgtcatcaatatagta

SEQ ID NO: 183796 - DNA, 20 bp, Artificial Sequence
  chemically synthesized
caatatagtaaggaattaca

SEQ ID NO: 183797 - DNA, 20 bp, Artificial Sequence
  chemically synthesized
atatagtaaggaattacata

SEQ ID NO: 183798 - DNA, 20 bp, Artificial Sequence
  chemically synthesized
atagtaaggaattacataga

SEQ ID NO: 183799 - DNA, 20 bp, Artificial Sequence
  chemically synthesized
tagtaaggaattacatagag

SEQ ID NO: 183800 - DNA, 20 bp, Artificial Sequence
  chemically synthesized
aaggaattacatagagaggt

SEQ ID NO: 183801 - DNA, 20 bp, Artificial Sequence
  chemically synthesized
tagagaggtaagaataaatt

SEQ ID NO: 183802 - DNA, 20 bp, Artificial Sequence
  chemically synthesized
aggtaagaataaattcagat

SEQ ID NO: 183803 - DNA, 20 bp, Artificial Sequence
  chemically synthesized
agaataaattcagataagat

SEQ ID NO: 183804 - DNA, 20 bp, Artificial Sequence
  chemically synthesized
ttcagataagattagtgact

SEQ ID NO: 183805 - DNA, 20 bp, Artificial Sequence
  chemically synthesized
agataagattagtgacttgg

SEQ ID NO: 183806 - DNA, 20 bp, Artificial Sequence
  chemically synthesized
agattagtgacttggaagat

SEQ ID NO: 183807 - DNA, 20 bp, Artificial Sequence
  chemically synthesized
ttggtcctatcttatcttcc

SEQ ID NO: 183808 - DNA, 20 bp, Artificial Sequence
  chemically synthesized
tagtgacttggaagataaga

SEQ ID NO: 183809 - DNA, 20 bp, Artificial Sequence
  chemically synthesized
agtgacttggaagataagat

SEQ ID NO: 183810 - DNA, 20 bp, Artificial Sequence
  chemically synthesized
ttggaagataagataggacc

SEQ ID NO: 183811 - DNA, 20 bp, Artificial Sequence
  chemically synthesized
acactttccgtattagcact

SEQ ID NO: 183812 - DNA, 20 bp, Artificial Sequence
  chemically synthesized
gataggaccaagtgctaata

SEQ ID NO: 183813 - DNA, 20 bp, Artificial Sequence
  chemically synthesized
ggaccaagtgctaatacgga

SEQ ID NO: 183814 - DNA, 20 bp, Artificial Sequence
  chemically synthesized
taactgaacactttccgtat

SEQ ID NO: 183815 - DNA, 20 bp, Artificial Sequence
  chemically synthesized
gtgctaatacggaaagtgtt

SEQ ID NO: 183816 - DNA, 20 bp, Artificial Sequence
  chemically synthesized
tacggaaagtgttcagttaa

SEQ ID NO: 183817 - DNA, 20 bp, Artificial Sequence
  chemically synthesized
agtgttcagttaatggcaca

SEQ ID NO: 183818 - DNA, 20 bp, Artificial Sequence
  chemically synthesized
agttaatggcacatggccta

SEQ ID NO: 183819 - DNA, 20 bp, Artificial Sequence
  chemically synthesized
atcttagtcctattatccgt

SEQ ID NO: 183820 - DNA, 20 bp, Artificial Sequence
  chemically synthesized
ggcacatggcctacggataa

SEQ ID NO: 183821 - DNA, 20 bp, Artificial Sequence
  chemically synthesized
tatcttagtcctattatccg

SEQ ID NO: 183822 - DNA, 20 bp, Artificial Sequence
  chemically synthesized
gcacatggcctacggataat

SEQ ID NO: 183823 - DNA, 20 bp, Artificial Sequence
  chemically synthesized
ggcctacggataataggact

SEQ ID NO: 183824 - DNA, 20 bp, Artificial Sequence
  chemically synthesized
taaatccactggacatatct

SEQ ID NO: 183825 - DNA, 20 bp, Artificial Sequence
  chemically synthesized
taataggactaagatatgtc

SEQ ID NO: 183826 - DNA, 20 bp, Artificial Sequence
  chemically synthesized
taggactaagatatgtccag

SEQ ID NO: 183827 - DNA, 20 bp, Artificial Sequence
  chemically synthesized
tttcttgtagttaaatccac

SEQ ID NO: 183828 - DNA, 20 bp, Artificial Sequence
  chemically synthesized
tgtccagtggatttaactac

SEQ ID NO: 183829 - DNA, 20 bp, Artificial Sequence
  chemically synthesized
ataacaacaatgatttcttg

SEQ ID NO: 183830 - DNA, 20 bp, Artificial Sequence
  chemically synthesized
caagaaatcattgttgttat

SEQ ID NO: 183831 - DNA, 20 bp, Artificial Sequence
  chemically synthesized
attgttgttattggcaataa

SEQ ID NO: 183832 - DNA, 20 bp, Artificial Sequence
  chemically synthesized
tattggcaataatggtttct

SEQ ID NO: 183833 - DNA, 20 bp, Artificial Sequence
  chemically synthesized
tggcaataatggtttctgag

SEQ ID NO: 183834 - DNA, 20 bp, Artificial Sequence
  chemically synthesized
caataatggtttctgagcag

SEQ ID NO: 183835 - DNA, 20 bp, Artificial Sequence
  chemically synthesized
ttttgatccaaaccactgct

SEQ ID NO: 183836 - DNA, 20 bp, Artificial Sequence
  chemically synthesized
atggtttctgagcagtggtt

SEQ ID NO: 183837 - DNA, 20 bp, Artificial Sequence
  chemically synthesized
tgagcagtggtttggatcaa

SEQ ID NO: 183838 - DNA, 20 bp, Artificial Sequence
  chemically synthesized
tggtttggatcaaaagcaaa

SEQ ID NO: 183839 - DNA, 20 bp, Artificial Sequence
  chemically synthesized
ggatcaaaagcaaacagcaa

SEQ ID NO: 183840 - DNA, 20 bp, Artificial Sequence
  chemically synthesized
atcaaaagcaaacagcaaaa

SEQ ID NO: 183841 - DNA, 20 bp, Artificial Sequence
  chemically synthesized
caaaagcaaacagcaaaaga

SEQ ID NO: 183842 - DNA, 20 bp, Artificial Sequence
  chemically synthesized
aaaagcaaacagcaaaagag

SEQ ID NO: 183843 - DNA, 20 bp, Artificial Sequence
  chemically synthesized
aagcaaacagcaaaagagag

SEQ ID NO: 183844 - DNA, 20 bp, Artificial Sequence
  chemically synthesized
gcaaacagcaaaagagagga

SEQ ID NO: 183845 - DNA, 20 bp, Artificial Sequence
  chemically synthesized
caaacagcaaaagagaggag

SEQ ID NO: 183846 - DNA, 20 bp, Artificial Sequence
  chemically synthesized
aaacagcaaaagagaggaga

SEQ ID NO: 183847 - DNA, 20 bp, Artificial Sequence
  chemically synthesized
aggagagggaaatgtgataa

SEQ ID NO: 183848 - DNA, 20 bp, Artificial Sequence
  chemically synthesized
gagagggaaatgtgataata

SEQ ID NO: 183849 - DNA, 20 bp, Artificial Sequence
  chemically synthesized
ataatagagaatgtgtgttt

SEQ ID NO: 183850 - DNA, 20 bp, Artificial Sequence
  chemically synthesized
gagaatgtgtgtttaagtaa

SEQ ID NO: 183851 - DNA, 20 bp, Artificial Sequence
  chemically synthesized
agtaacagtgactaactatg

SEQ ID NO: 183852 - DNA, 20 bp, Artificial Sequence
  chemically synthesized
atttgaatcttcttcatagt

SEQ ID NO: 183853 - DNA, 20 bp, Artificial Sequence
  chemically synthesized
aacagtgactaactatgaag

SEQ ID NO: 183854 - DNA, 20 bp, Artificial Sequence
  chemically synthesized
tcccatttgaatcttcttca

SEQ ID NO: 183855 - DNA, 20 bp, Artificial Sequence
  chemically synthesized
aactatgaagaagattcaaa

SEQ ID NO: 183856 - DNA, 20 bp, Artificial Sequence
  chemically synthesized
actatgaagaagattcaaat

SEQ ID NO: 183857 - DNA, 20 bp, Artificial Sequence
  chemically synthesized
attcaaatgggaataataac

SEQ ID NO: 183858 - DNA, 20 bp, Artificial Sequence
  chemically synthesized
aaatgggaataataacaaga

SEQ ID NO: 183859 - DNA, 20 bp, Artificial Sequence
  chemically synthesized
aatgggaataataacaagaa

SEQ ID NO: 183860 - DNA, 20 bp, Artificial Sequence
  chemically synthesized
atgggaataataacaagaaa

SEQ ID NO: 183861 - DNA, 20 bp, Artificial Sequence
  chemically synthesized
tgggaataataacaagaaag

SEQ ID NO: 183862 - DNA, 20 bp, Artificial Sequence
  chemically synthesized
gaataataacaagaaagggg

SEQ ID NO: 183863 - DNA, 20 bp, Artificial Sequence
  chemically synthesized
aataacaagaaaggggaagt

SEQ ID NO: 183864 - DNA, 20 bp, Artificial Sequence
  chemically synthesized
taacaagaaaggggaagtaa

SEQ ID NO: 183865 - DNA, 20 bp, Artificial Sequence
  chemically synthesized
taagagacatttgttaactt

SEQ ID NO: 183866 - DNA, 20 bp, Artificial Sequence
  chemically synthesized
attcagattctgggcaacca

SEQ ID NO: 183867 - DNA, 20 bp, Artificial Sequence
  chemically synthesized
atttgttaactttggttgcc

SEQ ID NO: 183868 - DNA, 20 bp, Artificial Sequence
  chemically synthesized
aatcagggcattcagattct

SEQ ID NO: 183869 - DNA, 20 bp, Artificial Sequence
  chemically synthesized
taatcagggcattcagattc

SEQ ID NO: 183870 - DNA, 20 bp, Artificial Sequence
  chemically synthesized
ttcgacataatcagggcatt

SEQ ID NO: 183871 - DNA, 20 bp, Artificial Sequence
  chemically synthesized
gattttgttcgacataatca

SEQ ID NO: 183872 - DNA, 20 bp, Artificial Sequence
  chemically synthesized
ggattttgttcgacataatc

SEQ ID NO: 183873 - DNA, 20 bp, Artificial Sequence
  chemically synthesized
gggattttgttcgacataat

SEQ ID NO: 183874 - DNA, 20 bp, Artificial Sequence
  chemically synthesized
tcagattccatttgtatttg

SEQ ID NO: 183875 - DNA, 20 bp, Artificial Sequence
  chemically synthesized
atcagattccatttgtattt

SEQ ID NO: 183876 - DNA, 20 bp, Artificial Sequence
  chemically synthesized
catcagattccatttgtatt

SEQ ID NO: 183877 - DNA, 20 bp, Artificial Sequence
  chemically synthesized
acaaaatccccaaatacaaa

SEQ ID NO: 183878 - DNA, 20 bp, Artificial Sequence
  chemically synthesized
caaatacaaatggaatctga

SEQ ID NO: 183879 - DNA, 20 bp, Artificial Sequence
  chemically synthesized
aaatacaaatggaatctgat

SEQ ID NO: 183880 - DNA, 20 bp, Artificial Sequence
  chemically synthesized
aatacaaatggaatctgatg

SEQ ID NO: 183881 - DNA, 20 bp, Artificial Sequence
  chemically synthesized
atacaaatggaatctgatgg

SEQ ID NO: 183882 - DNA, 20 bp, Artificial Sequence
  chemically synthesized
caaatggaatctgatggggg

SEQ ID NO: 183883 - DNA, 20 bp, Artificial Sequence
  chemically synthesized
aaaaactgaacttcccccat

SEQ ID NO: 183884 - DNA, 20 bp, Artificial Sequence
  chemically synthesized
ggaatctgatgggggaagtt

SEQ ID NO: 183885 - DNA, 20 bp, Artificial Sequence
  chemically synthesized
ggaagttcagtttttgaatc

SEQ ID NO: 183886 - DNA, 20 bp, Artificial Sequence
  chemically synthesized
tcagtttttgaatctggaat

SEQ ID NO: 183887 - DNA, 20 bp, Artificial Sequence
  chemically synthesized
tataattctgtcactcattc

SEQ ID NO: 183888 - DNA, 20 bp, Artificial Sequence
  chemically synthesized
tttgaatctggaatgagtga

SEQ ID NO: 183889 - DNA, 20 bp, Artificial Sequence
  chemically synthesized
ggaatgagtgacagaattat

SEQ ID NO: 183890 - DNA, 20 bp, Artificial Sequence
  chemically synthesized
gaatgagtgacagaattata

SEQ ID NO: 183891 - DNA, 20 bp, Artificial Sequence
  chemically synthesized
cagaattataaggcactatc

SEQ ID NO: 183892 - DNA, 20 bp, Artificial Sequence
  chemically synthesized
ctactggaaagaattctaga

SEQ ID NO: 183893 - DNA, 20 bp, Artificial Sequence
  chemically synthesized
attgctactggaaagaattc

SEQ ID NO: 183894 - DNA, 20 bp, Artificial Sequence
  chemically synthesized
gcactatctagaattctttc

SEQ ID NO: 183895 - DNA, 20 bp, Artificial Sequence
  chemically synthesized
ctatctagaattctttccag

SEQ ID NO: 183896 - DNA, 20 bp, Artificial Sequence
  chemically synthesized
agaatgtcattgctactgga

SEQ ID NO: 183897 - DNA, 20 bp, Artificial Sequence
  chemically synthesized
gtgaagaatgtcattgctac

SEQ ID NO: 183898 - DNA, 20 bp, Artificial Sequence
  chemically synthesized
tagcaatgacattcttcacc

SEQ ID NO: 183899 - DNA, 20 bp, Artificial Sequence
  chemically synthesized
accactgcagacactgggtg

SEQ ID NO: 183900 - DNA, 20 bp, Artificial Sequence
  chemically synthesized
actctaccactgcagacact

SEQ ID NO: 183901 - DNA, 20 bp, Artificial Sequence
  chemically synthesized
cattcttcacccagtgtctg

SEQ ID NO: 183902 - DNA, 20 bp, Artificial Sequence
  chemically synthesized
cactctaccactgcagacac

SEQ ID NO: 183903 - DNA, 20 bp, Artificial Sequence
  chemically synthesized
tcttcacccagtgtctgcag

SEQ ID NO: 183904 - DNA, 20 bp, Artificial Sequence
  chemically synthesized
tcacccagtgtctgcagtgg

SEQ ID NO: 183905 - DNA, 20 bp, Artificial Sequence
  chemically synthesized
catgcaccactctaccactg

SEQ ID NO: 183906 - DNA, 20 bp, Artificial Sequence
  chemically synthesized
acccagtgtctgcagtggta

SEQ ID NO: 183907 - DNA, 20 bp, Artificial Sequence
  chemically synthesized
cagtgtctgcagtggtagag

SEQ ID NO: 183908 - DNA, 20 bp, Artificial Sequence
  chemically synthesized
tgcagtggtagagtggtgca

SEQ ID NO: 183909 - DNA, 20 bp, Artificial Sequence
  chemically synthesized
tgcatggcaacgtttacatc

SEQ ID NO: 183910 - DNA, 20 bp, Artificial Sequence
  chemically synthesized
caacgtttacatctagtgta

SEQ ID NO: 183911 - DNA, 20 bp, Artificial Sequence
  chemically synthesized
aacgtttacatctagtgtat

SEQ ID NO: 183912 - DNA, 20 bp, Artificial Sequence
  chemically synthesized
acgtttacatctagtgtatg

SEQ ID NO: 183913 - DNA, 20 bp, Artificial Sequence
  chemically synthesized
gacgtctggcccccatacac

SEQ ID NO: 183914 - DNA, 20 bp, Artificial Sequence
  chemically synthesized
cgtttacatctagtgtatgg

SEQ ID NO: 183915 - DNA, 20 bp, Artificial Sequence
  chemically synthesized
tacatctagtgtatgggggc

SEQ ID NO: 183916 - DNA, 20 bp, Artificial Sequence
  chemically synthesized
tgtatgggggccagacgtcg

SEQ ID NO: 183917 - DNA, 20 bp, Artificial Sequence
  chemically synthesized
caggcatgtgccacgacgtc

SEQ ID NO: 183918 - DNA, 20 bp, Artificial Sequence
  chemically synthesized
gtggcacatgcctgtaatcc

SEQ ID NO: 183919 - DNA, 20 bp, Artificial Sequence
  chemically synthesized
tcccacagtgctgggattac

SEQ ID NO: 183920 - DNA, 20 bp, Artificial Sequence
  chemically synthesized
ctcccacagtgctgggatta

SEQ ID NO: 183921 - DNA, 20 bp, Artificial Sequence
  chemically synthesized
tgcctgtaatcccagcactg

SEQ ID NO: 183922 - DNA, 20 bp, Artificial Sequence
  chemically synthesized
tcttagcctcccacagtgct

SEQ ID NO: 183923 - DNA, 20 bp, Artificial Sequence
  chemically synthesized
gcctgtaatcccagcactgt

SEQ ID NO: 183924 - DNA, 20 bp, Artificial Sequence
  chemically synthesized
atcttagcctcccacagtgc

SEQ ID NO: 183925 - DNA, 20 bp, Artificial Sequence
  chemically synthesized
ctgtaatcccagcactgtgg

SEQ ID NO: 183926 - DNA, 20 bp, Artificial Sequence
  chemically synthesized
tgtaatcccagcactgtggg

SEQ ID NO: 183927 - DNA, 20 bp, Artificial Sequence
  chemically synthesized
ccactcatcttagcctccca

SEQ ID NO: 183928 - DNA, 20 bp, Artificial Sequence
  chemically synthesized
tcccagcactgtgggaggct

SEQ ID NO: 183929 - DNA, 20 bp, Artificial Sequence
  chemically synthesized
gcactgtgggaggctaagat

SEQ ID NO: 183930 - DNA, 20 bp, Artificial Sequence
  chemically synthesized
ctgtgggaggctaagatgag

SEQ ID NO: 183931 - DNA, 20 bp, Artificial Sequence
  chemically synthesized
ctcaagcgatccactcatct

SEQ ID NO: 183932 - DNA, 20 bp, Artificial Sequence
  chemically synthesized
ctaagatgagtggatcgctt

SEQ ID NO: 183933 - DNA, 20 bp, Artificial Sequence
  chemically synthesized
tgagtggatcgcttgagtcc

SEQ ID NO: 183934 - DNA, 20 bp, Artificial Sequence
  chemically synthesized
gatctcgaactcttggactc

SEQ ID NO: 183935 - DNA, 20 bp, Artificial Sequence
  chemically synthesized
agtggatcgcttgagtccaa

SEQ ID NO: 183936 - DNA, 20 bp, Artificial Sequence
  chemically synthesized
tcgcttgagtccaagagttc

SEQ ID NO: 183937 - DNA, 20 bp, Artificial Sequence
  chemically synthesized
tagattggatctcgaactct

SEQ ID NO: 183938 - DNA, 20 bp, Artificial Sequence
  chemically synthesized
caagagttcgagatccaatc

SEQ ID NO: 183939 - DNA, 20 bp, Artificial Sequence
  chemically synthesized
aagagttcgagatccaatct

SEQ ID NO: 183940 - DNA, 20 bp, Artificial Sequence
  chemically synthesized
agagttcgagatccaatcta

SEQ ID NO: 183941 - DNA, 20 bp, Artificial Sequence
  chemically synthesized
gtccaaatcataccctagat

SEQ ID NO: 183942 - DNA, 20 bp, Artificial Sequence
  chemically synthesized
ctatagtccaaatcataccc

SEQ ID NO: 183943 - DNA, 20 bp, Artificial Sequence
  chemically synthesized
atccaatctagggtatgatt

SEQ ID NO: 183944 - DNA, 20 bp, Artificial Sequence
  chemically synthesized
ctagggtatgatttggacta

SEQ ID NO: 183945 - DNA, 20 bp, Artificial Sequence
  chemically synthesized
atgatttggactatagttct

SEQ ID NO: 183946 - DNA, 20 bp, Artificial Sequence
  chemically synthesized
aggctcagctccaagaacta

SEQ ID NO: 183947 - DNA, 20 bp, Artificial Sequence
  chemically synthesized
gatttggactatagttcttg

SEQ ID NO: 183948 - DNA, 20 bp, Artificial Sequence
  chemically synthesized
ggactatagttcttggagct

SEQ ID NO: 183949 - DNA, 20 bp, Artificial Sequence
  chemically synthesized
caaaaaagaggctcagctcc

SEQ ID NO: 183950 - DNA, 20 bp, Artificial Sequence
  chemically synthesized
cagaactcaaaaaagaggct

SEQ ID NO: 183951 - DNA, 20 bp, Artificial Sequence
  chemically synthesized
tggagctgagcctctttttt

SEQ ID NO: 183952 - DNA, 20 bp, Artificial Sequence
  chemically synthesized
atgggcagaactcaaaaaag

SEQ ID NO: 183953 - DNA, 20 bp, Artificial Sequence
  chemically synthesized
aatgggcagaactcaaaaaa

SEQ ID NO: 183954 - DNA, 20 bp, Artificial Sequence
  chemically synthesized
aaaatgggcagaactcaaaa

SEQ ID NO: 183955 - DNA, 20 bp, Artificial Sequence
  chemically synthesized
gaaaaccagctcaaaatggg

SEQ ID NO: 183956 - DNA, 20 bp, Artificial Sequence
  chemically synthesized
ttttgagttctgcccatttt

SEQ ID NO: 183957 - DNA, 20 bp, Artificial Sequence
  chemically synthesized
atagaaaaccagctcaaaat

SEQ ID NO: 183958 - DNA, 20 bp, Artificial Sequence
  chemically synthesized
gatagaaaaccagctcaaaa

SEQ ID NO: 183959 - DNA, 20 bp, Artificial Sequence
  chemically synthesized
gagttctgcccattttgagc

SEQ ID NO: 183960 - DNA, 20 bp, Artificial Sequence
  chemically synthesized
taaacaaagggatagaaaac

SEQ ID NO: 183961 - DNA, 20 bp, Artificial Sequence
  chemically synthesized
cccattcctaaacaaaggga

SEQ ID NO: 183962 - DNA, 20 bp, Artificial Sequence
  chemically synthesized
tggttttctatccctttgtt

SEQ ID NO: 183963 - DNA, 20 bp, Artificial Sequence
  chemically synthesized
ggttttctatccctttgttt

SEQ ID NO: 183964 - DNA, 20 bp, Artificial Sequence
  chemically synthesized
tgttcccattcctaaacaaa

SEQ ID NO: 183965 - DNA, 20 bp, Artificial Sequence
  chemically synthesized
ctgttcccattcctaaacaa

SEQ ID NO: 183966 - DNA, 20 bp, Artificial Sequence
  chemically synthesized
cctgttcccattcctaaaca

SEQ ID NO: 183967 - DNA, 20 bp, Artificial Sequence
  chemically synthesized
tctatccctttgtttaggaa

SEQ ID NO: 183968 - DNA, 20 bp, Artificial Sequence
  chemically synthesized
ctatccctttgtttaggaat

SEQ ID NO: 183969 - DNA, 20 bp, Artificial Sequence
  chemically synthesized
cctttgtttaggaatgggaa

SEQ ID NO: 183970 - DNA, 20 bp, Artificial Sequence
  chemically synthesized
ctttgtttaggaatgggaac

SEQ ID NO: 183971 - DNA, 20 bp, Artificial Sequence
  chemically synthesized
cggactttaggagaaagata

SEQ ID NO: 183972 - DNA, 20 bp, Artificial Sequence
  chemically synthesized
aggtctgtatctttctccta

SEQ ID NO: 183973 - DNA, 20 bp, Artificial Sequence
  chemically synthesized
cggaaacggactttaggaga

SEQ ID NO: 183974 - DNA, 20 bp, Artificial Sequence
  chemically synthesized
gaagcggaaacggactttag

SEQ ID NO: 183975 - DNA, 20 bp, Artificial Sequence
  chemically synthesized
tagaagcggaaacggacttt

SEQ ID NO: 183976 - DNA, 20 bp, Artificial Sequence
  chemically synthesized
atagaagcggaaacggactt

SEQ ID NO: 183977 - DNA, 20 bp, Artificial Sequence
  chemically synthesized
tttgttgatagaagcggaaa

SEQ ID NO: 183978 - DNA, 20 bp, Artificial Sequence
  chemically synthesized
ccagtttttgttgatagaag

SEQ ID NO: 183979 - DNA, 20 bp, Artificial Sequence
  chemically synthesized
aacccagtttttgttgatag

SEQ ID NO: 183980 - DNA, 20 bp, Artificial Sequence
  chemically synthesized
cagaacccagtttttgttga

SEQ ID NO: 183981 - DNA, 20 bp, Artificial Sequence
  chemically synthesized
ccgcttctatcaacaaaaac

SEQ ID NO: 183982 - DNA, 20 bp, Artificial Sequence
  chemically synthesized
cgcttctatcaacaaaaact

SEQ ID NO: 183983 - DNA, 20 bp, Artificial Sequence
  chemically synthesized
tagctgtgaataacagaacc

SEQ ID NO: 183984 - DNA, 20 bp, Artificial Sequence
  chemically synthesized
aaactgggttctgttattca

SEQ ID NO: 183985 - DNA, 20 bp, Artificial Sequence
  chemically synthesized
gagttcatagctgtgaataa

SEQ ID NO: 183986 - DNA, 20 bp, Artificial Sequence
  chemically synthesized
actgtacttgtcagagttca

SEQ ID NO: 183987 - DNA, 20 bp, Artificial Sequence
  chemically synthesized
tcacagctatgaactctgac

SEQ ID NO: 183988 - DNA, 20 bp, Artificial Sequence
  chemically synthesized
tcattccactgtacttgtca

SEQ ID NO: 183989 - DNA, 20 bp, Artificial Sequence
  chemically synthesized
gctatgaactctgacaagta

SEQ ID NO: 183990 - DNA, 20 bp, Artificial Sequence
  chemically synthesized
attcattccactgtacttgt

SEQ ID NO: 183991 - DNA, 20 bp, Artificial Sequence
  chemically synthesized
atgaactctgacaagtacag

SEQ ID NO: 183992 - DNA, 20 bp, Artificial Sequence
  chemically synthesized
tacagtggaatgaatgcatt

SEQ ID NO: 183993 - DNA, 20 bp, Artificial Sequence
  chemically synthesized
gtggaatgaatgcatttgga

SEQ ID NO: 183994 - DNA, 20 bp, Artificial Sequence
  chemically synthesized
tggaatgaatgcatttggaa

SEQ ID NO: 183995 - DNA, 20 bp, Artificial Sequence
  chemically synthesized
gattacaatataaatatatt

SEQ ID NO: 183996 - DNA, 20 bp, Artificial Sequence
  chemically synthesized
aatatatttatattgtaatc

SEQ ID NO: 183997 - DNA, 20 bp, Artificial Sequence
  chemically synthesized
atatatttatattgtaatct

SEQ ID NO: 183998 - DNA, 20 bp, Artificial Sequence
  chemically synthesized
atatttatattgtaatctag

SEQ ID NO: 183999 - DNA, 20 bp, Artificial Sequence
  chemically synthesized
aggtgaatgtttttagctcc

SEQ ID NO: 184000 - DNA, 20 bp, Artificial Sequence
  chemically synthesized
cctgatcaggtgaatgtttt

SEQ ID NO: 184001 - DNA, 20 bp, Artificial Sequence
  chemically synthesized
gctaaaaacattcacctgat

SEQ ID NO: 184002 - DNA, 20 bp, Artificial Sequence
  chemically synthesized
ctaaaaacattcacctgatc

SEQ ID NO: 184003 - DNA, 20 bp, Artificial Sequence
  chemically synthesized
taaaaacattcacctgatca

SEQ ID NO: 184004 - DNA, 20 bp, Artificial Sequence
  chemically synthesized
ctgcctcactatccctgatc

SEQ ID NO: 184005 - DNA, 20 bp, Artificial Sequence
  chemically synthesized
gctgcctcactatccctgat

SEQ ID NO: 184006 - DNA, 20 bp, Artificial Sequence
  chemically synthesized
aacattcacctgatcaggga

SEQ ID NO: 184007 - DNA, 20 bp, Artificial Sequence
  chemically synthesized
ttcacctgatcagggatagt

SEQ ID NO: 184008 - DNA, 20 bp, Artificial Sequence
  chemically synthesized
tcacctgatcagggatagtg

SEQ ID NO: 184009 - DNA, 20 bp, Artificial Sequence
  chemically synthesized
cctgatcagggatagtgagg

SEQ ID NO: 184010 - DNA, 20 bp, Artificial Sequence
  chemically synthesized
gatcagggatagtgaggcag

SEQ ID NO: 184011 - DNA, 20 bp, Artificial Sequence
  chemically synthesized
ggatagtgaggcagcagaaa

SEQ ID NO: 184012 - DNA, 20 bp, Artificial Sequence
  chemically synthesized
gatagtgaggcagcagaaaa

SEQ ID NO: 184013 - DNA, 20 bp, Artificial Sequence
  chemically synthesized
atagtgaggcagcagaaaaa

SEQ ID NO: 184014 - DNA, 20 bp, Artificial Sequence
  chemically synthesized
gaggcagcagaaaaagggta

SEQ ID NO: 184015 - DNA, 20 bp, Artificial Sequence
  chemically synthesized
tcttgaatgcacacaaacac

SEQ ID NO: 184016 - DNA, 20 bp, Artificial Sequence
  chemically synthesized
gcttgtgtttgtgtgcattc

SEQ ID NO: 184017 - DNA, 20 bp, Artificial Sequence
  chemically synthesized
ttgtgtttgtgtgcattcaa

SEQ ID NO: 184018 - DNA, 20 bp, Artificial Sequence
  chemically synthesized
gtttgtgtgcattcaagaga

SEQ ID NO: 184019 - DNA, 20 bp, Artificial Sequence
  chemically synthesized
caagagacagaataattaac

SEQ ID NO: 184020 - DNA, 20 bp, Artificial Sequence
  chemically synthesized
aagagacagaataattaacc

SEQ ID NO: 184021 - DNA, 20 bp, Artificial Sequence
  chemically synthesized
agagacagaataattaaccg

SEQ ID NO: 184022 - DNA, 20 bp, Artificial Sequence
  chemically synthesized
acagaataattaaccggggc

SEQ ID NO: 184023 - DNA, 20 bp, Artificial Sequence
  chemically synthesized
atttcagaggaatcttgccc

SEQ ID NO: 184024 - DNA, 20 bp, Artificial Sequence
  chemically synthesized
gggcaagattcctctgaaat

SEQ ID NO: 184025 - DNA, 20 bp, Artificial Sequence
  chemically synthesized
agccttatctctcatttcag

SEQ ID NO: 184026 - DNA, 20 bp, Artificial Sequence
  chemically synthesized
aagccttatctctcatttca

SEQ ID NO: 184027 - DNA, 20 bp, Artificial Sequence
  chemically synthesized
gcaagattcctctgaaatga

SEQ ID NO: 184028 - DNA, 20 bp, Artificial Sequence
  chemically synthesized
gaaagccttatctctcattt

SEQ ID NO: 184029 - DNA, 20 bp, Artificial Sequence
  chemically synthesized
attcctctgaaatgagagat

SEQ ID NO: 184030 - DNA, 20 bp, Artificial Sequence
  chemically synthesized
ttcctctgaaatgagagata

SEQ ID NO: 184031 - DNA, 20 bp, Artificial Sequence
  chemically synthesized
caatccttatattcagcaga

SEQ ID NO: 184032 - DNA, 20 bp, Artificial Sequence
  chemically synthesized
ataacaatccttatattcag

SEQ ID NO: 184033 - DNA, 20 bp, Artificial Sequence
  chemically synthesized
taaggctttctgctgaatat

SEQ ID NO: 184034 - DNA, 20 bp, Artificial Sequence
  chemically synthesized
aaggctttctgctgaatata

SEQ ID NO: 184035 - DNA, 20 bp, Artificial Sequence
  chemically synthesized
tgtataacaatccttatatt

SEQ ID NO: 184036 - DNA, 20 bp, Artificial Sequence
  chemically synthesized
ttatacattcaccatcataa

SEQ ID NO: 184037 - DNA, 20 bp, Artificial Sequence
  chemically synthesized
tttatcatttaccattatga

SEQ ID NO: 184038 - DNA, 20 bp, Artificial Sequence
  chemically synthesized
aatggtaaatgataaattgt

SEQ ID NO: 184039 - DNA, 20 bp, Artificial Sequence
  chemically synthesized
taaatgataaattgttagat

SEQ ID NO: 184040 - DNA, 20 bp, Artificial Sequence
  chemically synthesized
atgataaattgttagattgg

SEQ ID NO: 184041 - DNA, 20 bp, Artificial Sequence
  chemically synthesized
tgaaagtactatatttgtgt

SEQ ID NO: 184042 - DNA, 20 bp, Artificial Sequence
  chemically synthesized
attggcagcttacacaaata

SEQ ID NO: 184043 - DNA, 20 bp, Artificial Sequence
  chemically synthesized
aaaaatcgtttgtaaaatga

SEQ ID NO: 184044 - DNA, 20 bp, Artificial Sequence
  chemically synthesized
atttttaaaaacatttatca

SEQ ID NO: 184045 - DNA, 20 bp, Artificial Sequence
  chemically synthesized
tttaaaaacatttatcatag

SEQ ID NO: 184046 - DNA, 20 bp, Artificial Sequence
  chemically synthesized
taaaaacatttatcatagta

SEQ ID NO: 184047 - DNA, 20 bp, Artificial Sequence
  chemically synthesized
aaaacatttatcatagtaga

SEQ ID NO: 184048 - DNA, 20 bp, Artificial Sequence
  chemically synthesized
aacatttatcatagtagaga

SEQ ID NO: 184049 - DNA, 20 bp, Artificial Sequence
  chemically synthesized
ttaattcaaattaacctttg

SEQ ID NO: 184050 - DNA, 20 bp, Artificial Sequence
  chemically synthesized
taatgtgattttttctacaa

SEQ ID NO: 184051 - DNA, 20 bp, Artificial Sequence
  chemically synthesized
ataatgtgattttttctaca

SEQ ID NO: 184052 - DNA, 20 bp, Artificial Sequence
  chemically synthesized
aaatcacattataataaatt

SEQ ID NO: 184053 - DNA, 20 bp, Artificial Sequence
  chemically synthesized
taaatttagacttatattaa

SEQ ID NO: 184054 - DNA, 20 bp, Artificial Sequence
  chemically synthesized
catagtttgaccattaatat

SEQ ID NO: 184055 - DNA, 20 bp, Artificial Sequence
  chemically synthesized
ttactaattatatgttgtca

SEQ ID NO: 184056 - DNA, 20 bp, Artificial Sequence
  chemically synthesized
aaactatgacaacatataat

SEQ ID NO: 184057 - DNA, 20 bp, Artificial Sequence
  chemically synthesized
acatataattagtaaaacaa

SEQ ID NO: 184058 - DNA, 20 bp, Artificial Sequence
  chemically synthesized
atataattagtaaaacaaaa

SEQ ID NO: 184059 - DNA, 20 bp, Artificial Sequence
  chemically synthesized
taaaacaaaagagaatttta

SEQ ID NO: 184060 - DNA, 20 bp, Artificial Sequence
  chemically synthesized
aaaacaaaagagaattttaa

SEQ ID NO: 184061 - DNA, 20 bp, Artificial Sequence
  chemically synthesized
aaacaaaagagaattttaaa

SEQ ID NO: 184062 - DNA, 20 bp, Artificial Sequence
  chemically synthesized
ttttaaagggaacatgataa

SEQ ID NO: 184063 - DNA, 20 bp, Artificial Sequence
  chemically synthesized
atgtcttagatatgtataat

SEQ ID NO: 184064 - DNA, 20 bp, Artificial Sequence
  chemically synthesized
tagacttattatacatatct

SEQ ID NO: 184065 - DNA, 20 bp, Artificial Sequence
  chemically synthesized
aatatagttaatggatgtct

SEQ ID NO: 184066 - DNA, 20 bp, Artificial Sequence
  chemically synthesized
ccttggtttaatatagttaa

SEQ ID NO: 184067 - DNA, 20 bp, Artificial Sequence
  chemically synthesized
ttccttaccttggtttaata

SEQ ID NO: 184068 - DNA, 20 bp, Artificial Sequence
  chemically synthesized
tccattaactatattaaacc

SEQ ID NO: 184069 - DNA, 20 bp, Artificial Sequence
  chemically synthesized
ccattaactatattaaacca

SEQ ID NO: 184070 - DNA, 20 bp, Artificial Sequence
  chemically synthesized
taactatattaaaccaaggt

SEQ ID NO: 184071 - DNA, 20 bp, Artificial Sequence
  chemically synthesized
aactatattaaaccaaggta

SEQ ID NO: 184072 - DNA, 20 bp, Artificial Sequence
  chemically synthesized
attttattgattccttacct

SEQ ID NO: 184073 - DNA, 20 bp, Artificial Sequence
  chemically synthesized
tgatcaacacatttttctct

SEQ ID NO: 184074 - DNA, 20 bp, Artificial Sequence
  chemically synthesized
gatcaacacatttttctctt

SEQ ID NO: 184075 - DNA, 20 bp, Artificial Sequence
  chemically synthesized
aagaaaacccaaagtcctaa

SEQ ID NO: 184076 - DNA, 20 bp, Artificial Sequence
  chemically synthesized
acatttttctcttaggactt

SEQ ID NO: 184077 - DNA, 20 bp, Artificial Sequence
  chemically synthesized
aaaagaaaacccaaagtcct

SEQ ID NO: 184078 - DNA, 20 bp, Artificial Sequence
  chemically synthesized
catttttctcttaggacttt

SEQ ID NO: 184079 - DNA, 20 bp, Artificial Sequence
  chemically synthesized
tgtttacaaaagaaaaccca

SEQ ID NO: 184080 - DNA, 20 bp, Artificial Sequence
  chemically synthesized
tgtcctacctttgtttacaa

SEQ ID NO: 184081 - DNA, 20 bp, Artificial Sequence
  chemically synthesized
tgggttttcttttgtaaaca

SEQ ID NO: 184082 - DNA, 20 bp, Artificial Sequence
  chemically synthesized
gggttttcttttgtaaacaa

SEQ ID NO: 184083 - DNA, 20 bp, Artificial Sequence
  chemically synthesized
ttttcttttgtaaacaaagg

SEQ ID NO: 184084 - DNA, 20 bp, Artificial Sequence
  chemically synthesized
tttcttttgtaaacaaaggt

SEQ ID NO: 184085 - DNA, 20 bp, Artificial Sequence
  chemically synthesized
caaaggtaggacactcacct

SEQ ID NO: 184086 - DNA, 20 bp, Artificial Sequence
  chemically synthesized
aaaggtaggacactcacctg

SEQ ID NO: 184087 - DNA, 20 bp, Artificial Sequence
  chemically synthesized
ggaatacactatcctcaggt

SEQ ID NO: 184088 - DNA, 20 bp, Artificial Sequence
  chemically synthesized
gtaggacactcacctgagga

SEQ ID NO: 184089 - DNA, 20 bp, Artificial Sequence
  chemically synthesized
aaaaggaatacactatcctc

SEQ ID NO: 184090 - DNA, 20 bp, Artificial Sequence
  chemically synthesized
aaaaaggaatacactatcct

SEQ ID NO: 184091 - DNA, 20 bp, Artificial Sequence
  chemically synthesized
aggatagtgtattccttttt

SEQ ID NO: 184092 - DNA, 20 bp, Artificial Sequence
  chemically synthesized
gatagtgtattccttttttg

SEQ ID NO: 184093 - DNA, 20 bp, Artificial Sequence
  chemically synthesized
aaatcataacactccaaaaa

SEQ ID NO: 184094 - DNA, 20 bp, Artificial Sequence
  chemically synthesized
caaatcataacactccaaaa

SEQ ID NO: 184095 - DNA, 20 bp, Artificial Sequence
  chemically synthesized
atttgtgattctaacataaa

SEQ ID NO: 184096 - DNA, 20 bp, Artificial Sequence
  chemically synthesized
ttacaaagttctttttatgt

SEQ ID NO: 184097 - DNA, 20 bp, Artificial Sequence
  chemically synthesized
ataaaaagaactttgtaaat

SEQ ID NO: 184098 - DNA, 20 bp, Artificial Sequence
  chemically synthesized
attagaaacacttatttaca

SEQ ID NO: 184099 - DNA, 20 bp, Artificial Sequence
  chemically synthesized
tttgagacacattttataat

SEQ ID NO: 184100 - DNA, 20 bp, Artificial Sequence
  chemically synthesized
taattataaaatgtgtctca

SEQ ID NO: 184101 - DNA, 20 bp, Artificial Sequence
  chemically synthesized
aattataaaatgtgtctcaa

SEQ ID NO: 184102 - DNA, 20 bp, Artificial Sequence
  chemically synthesized
ataaaatgtgtctcaaagga

SEQ ID NO: 184103 - DNA, 20 bp, Artificial Sequence
  chemically synthesized
taaaatgtgtctcaaaggac

SEQ ID NO: 184104 - DNA, 20 bp, Artificial Sequence
  chemically synthesized
accctcaaagcctgtccttt

SEQ ID NO: 184105 - DNA, 20 bp, Artificial Sequence
  chemically synthesized
tgtctcaaaggacaggcttt

SEQ ID NO: 184106 - DNA, 20 bp, Artificial Sequence
  chemically synthesized
gtctcaaaggacaggctttg

SEQ ID NO: 184107 - DNA, 20 bp, Artificial Sequence
  chemically synthesized
tctcaaaggacaggctttga

SEQ ID NO: 184108 - DNA, 20 bp, Artificial Sequence
  chemically synthesized
caaaggacaggctttgaggg

SEQ ID NO: 184109 - DNA, 20 bp, Artificial Sequence
  chemically synthesized
acttgaattgtctaccctca

SEQ ID NO: 184110 - DNA, 20 bp, Artificial Sequence
  chemically synthesized
gctttgagggtagacaattc

SEQ ID NO: 184111 - DNA, 20 bp, Artificial Sequence
  chemically synthesized
gtagacaattcaagtttctt

SEQ ID NO: 184112 - DNA, 20 bp, Artificial Sequence
  chemically synthesized
attcaagtttcttcagcaac

SEQ ID NO: 184113 - DNA, 20 bp, Artificial Sequence
  chemically synthesized
atttattttccttgttgctg

SEQ ID NO: 184114 - DNA, 20 bp, Artificial Sequence
  chemically synthesized
ttcaagtttcttcagcaaca

SEQ ID NO: 184115 - DNA, 20 bp, Artificial Sequence
  chemically synthesized
agcaacaaggaaaataaatg

SEQ ID NO: 184116 - DNA, 20 bp, Artificial Sequence
  chemically synthesized
aataaatgcagaatgccatt

SEQ ID NO: 184117 - DNA, 20 bp, Artificial Sequence
  chemically synthesized
aaaaaaaaaaacaggccaaa

SEQ ID NO: 184118 - DNA, 20 bp, Artificial Sequence
  chemically synthesized
aaaaaaaaaaaaaaaaaaac

SEQ ID NO: 184119 - DNA, 20 bp, Artificial Sequence
  chemically synthesized
aaaaaaaaaaaaaaaaaaaa

SEQ ID NO: 184120 - DNA, 20 bp, Artificial Sequence
  chemically synthesized
tttttttttttttttaaaaa

SEQ ID NO: 184121 - DNA, 20 bp, Artificial Sequence
  chemically synthesized
ttttttttttaaaaatggta

SEQ ID NO: 184122 - DNA, 20 bp, Artificial Sequence
  chemically synthesized
ttttaaaaatggtacagtct

SEQ ID NO: 184123 - DNA, 20 bp, Artificial Sequence
  chemically synthesized
aaaatggtacagtcttggtg

SEQ ID NO: 184124 - DNA, 20 bp, Artificial Sequence
  chemically synthesized
gacccaacagcagctgcacc

SEQ ID NO: 184125 - DNA, 20 bp, Artificial Sequence
  chemically synthesized
agtcttggtgcagctgctgt

SEQ ID NO: 184126 - DNA, 20 bp, Artificial Sequence
  chemically synthesized
gtcttggtgcagctgctgtt

SEQ ID NO: 184127 - DNA, 20 bp, Artificial Sequence
  chemically synthesized
ctgttgattggacccaacag

SEQ ID NO: 184128 - DNA, 20 bp, Artificial Sequence
  chemically synthesized
tatctgttgattggacccaa

SEQ ID NO: 184129 - DNA, 20 bp, Artificial Sequence
  chemically synthesized
ctgctgttgggtccaatcaa

SEQ ID NO: 184130 - DNA, 20 bp, Artificial Sequence
  chemically synthesized
tttaaagtctatctgttgat

SEQ ID NO: 184131 - DNA, 20 bp, Artificial Sequence
  chemically synthesized
tgttgggtccaatcaacaga

SEQ ID NO: 184132 - DNA, 20 bp, Artificial Sequence
  chemically synthesized
ctttaaggttattgcattta

SEQ ID NO: 184133 - DNA, 20 bp, Artificial Sequence
  chemically synthesized
ctttaaatgcaataacctta

SEQ ID NO: 184134 - DNA, 20 bp, Artificial Sequence
  chemically synthesized
tttaaatgcaataaccttaa

SEQ ID NO: 184135 - DNA, 20 bp, Artificial Sequence
  chemically synthesized
ttaaatgcaataaccttaaa

SEQ ID NO: 184136 - DNA, 20 bp, Artificial Sequence
  chemically synthesized
aaatgcaataaccttaaagg

SEQ ID NO: 184137 - DNA, 20 bp, Artificial Sequence
  chemically synthesized
gtaaattctctctcccttta

SEQ ID NO: 184138 - DNA, 20 bp, Artificial Sequence
  chemically synthesized
atgcaataaccttaaaggga

SEQ ID NO: 184139 - DNA, 20 bp, Artificial Sequence
  chemically synthesized
tgtaaattctctctcccttt

SEQ ID NO: 184140 - DNA, 20 bp, Artificial Sequence
  chemically synthesized
gcaataaccttaaagggaga

SEQ ID NO: 184141 - DNA, 20 bp, Artificial Sequence
  chemically synthesized
ttaaagggagagagaattta

SEQ ID NO: 184142 - DNA, 20 bp, Artificial Sequence
  chemically synthesized
gagagaatttacagcaaccc

SEQ ID NO: 184143 - DNA, 20 bp, Artificial Sequence
  chemically synthesized
gaatttacagcaacccaagt

SEQ ID NO: 184144 - DNA, 20 bp, Artificial Sequence
  chemically synthesized
aatttacagcaacccaagta

SEQ ID NO: 184145 - DNA, 20 bp, Artificial Sequence
  chemically synthesized
tttacagcaacccaagtaag

SEQ ID NO: 184146 - DNA, 20 bp, Artificial Sequence
  chemically synthesized
cccagtcagactccttactt

SEQ ID NO: 184147 - DNA, 20 bp, Artificial Sequence
  chemically synthesized
ccccagtcagactccttact

SEQ ID NO: 184148 - DNA, 20 bp, Artificial Sequence
  chemically synthesized
acccaagtaaggagtctgac

SEQ ID NO: 184149 - DNA, 20 bp, Artificial Sequence
  chemically synthesized
cccaagtaaggagtctgact

SEQ ID NO: 184150 - DNA, 20 bp, Artificial Sequence
  chemically synthesized
ccaagtaaggagtctgactg

SEQ ID NO: 184151 - DNA, 20 bp, Artificial Sequence
  chemically synthesized
aaagaaatacatgccccagt

SEQ ID NO: 184152 - DNA, 20 bp, Artificial Sequence
  chemically synthesized
acacaaagaaatacatgccc

SEQ ID NO: 184153 - DNA, 20 bp, Artificial Sequence
  chemically synthesized
taacatgaaaaggaaacaca

SEQ ID NO: 184154 - DNA, 20 bp, Artificial Sequence
  chemically synthesized
acagagcccataacatgaaa

SEQ ID NO: 184155 - DNA, 20 bp, Artificial Sequence
  chemically synthesized
tacagagcccataacatgaa

SEQ ID NO: 184156 - DNA, 20 bp, Artificial Sequence
  chemically synthesized
tgtgtttccttttcatgtta

SEQ ID NO: 184157 - DNA, 20 bp, Artificial Sequence
  chemically synthesized
gtgtttccttttcatgttat

SEQ ID NO: 184158 - DNA, 20 bp, Artificial Sequence
  chemically synthesized
ttttcatgttatgggctctg

SEQ ID NO: 184159 - DNA, 20 bp, Artificial Sequence
  chemically synthesized
tcaatacaagggtagctaca

SEQ ID NO: 184160 - DNA, 20 bp, Artificial Sequence
  chemically synthesized
ggtcaatacaagggtagcta

SEQ ID NO: 184161 - DNA, 20 bp, Artificial Sequence
  chemically synthesized
gcaaatggtcaatacaaggg

SEQ ID NO: 184162 - DNA, 20 bp, Artificial Sequence
  chemically synthesized
actgcaaatggtcaatacaa

SEQ ID NO: 184163 - DNA, 20 bp, Artificial Sequence
  chemically synthesized
tactgcaaatggtcaataca

SEQ ID NO: 184164 - DNA, 20 bp, Artificial Sequence
  chemically synthesized
atactgcaaatggtcaatac

SEQ ID NO: 184165 - DNA, 20 bp, Artificial Sequence
  chemically synthesized
acccttgtattgaccatttg

SEQ ID NO: 184166 - DNA, 20 bp, Artificial Sequence
  chemically synthesized
ttatttgaatatactgcaaa

SEQ ID NO: 184167 - DNA, 20 bp, Artificial Sequence
  chemically synthesized
gtatatttaaagtatgaata

SEQ ID NO: 184168 - DNA, 20 bp, Artificial Sequence
  chemically synthesized
gatgcccatatgtatattta

SEQ ID NO: 184169 - DNA, 20 bp, Artificial Sequence
  chemically synthesized
tcatactttaaatatacata

SEQ ID NO: 184170 - DNA, 20 bp, Artificial Sequence
  chemically synthesized
catactttaaatatacatat

SEQ ID NO: 184171 - DNA, 20 bp, Artificial Sequence
  chemically synthesized
ggggcaccctagggaaagag

SEQ ID NO: 184172 - DNA, 20 bp, Artificial Sequence
  chemically synthesized
atgggcatctactctttccc

SEQ ID NO: 184173 - DNA, 20 bp, Artificial Sequence
  chemically synthesized
tgggcatctactctttccct

SEQ ID NO: 184174 - DNA, 20 bp, Artificial Sequence
  chemically synthesized
tttggggcaccctagggaaa

SEQ ID NO: 184175 - DNA, 20 bp, Artificial Sequence
  chemically synthesized
gggcatctactctttcccta

SEQ ID NO: 184176 - DNA, 20 bp, Artificial Sequence
  chemically synthesized
tatttggggcaccctaggga

SEQ ID NO: 184177 - DNA, 20 bp, Artificial Sequence
  chemically synthesized
tttttatttggggcacccta

SEQ ID NO: 184178 - DNA, 20 bp, Artificial Sequence
  chemically synthesized
ctttttatttggggcaccct

SEQ ID NO: 184179 - DNA, 20 bp, Artificial Sequence
  chemically synthesized
cctttttatttggggcaccc

SEQ ID NO: 184180 - DNA, 20 bp, Artificial Sequence
  chemically synthesized
aaatgagccctttttatttg

SEQ ID NO: 184181 - DNA, 20 bp, Artificial Sequence
  chemically synthesized
cctagggtgccccaaataaa

SEQ ID NO: 184182 - DNA, 20 bp, Artificial Sequence
  chemically synthesized
gaaatgagccctttttattt

SEQ ID NO: 184183 - DNA, 20 bp, Artificial Sequence
  chemically synthesized
ctagggtgccccaaataaaa

SEQ ID NO: 184184 - DNA, 20 bp, Artificial Sequence
  chemically synthesized
agaaatgagccctttttatt

SEQ ID NO: 184185 - DNA, 20 bp, Artificial Sequence
  chemically synthesized
tagggtgccccaaataaaaa

SEQ ID NO: 184186 - DNA, 20 bp, Artificial Sequence
  chemically synthesized
acagattgcagataagaaat

SEQ ID NO: 184187 - DNA, 20 bp, Artificial Sequence
  chemically synthesized
tcatcctacagattgcagat

SEQ ID NO: 184188 - DNA, 20 bp, Artificial Sequence
  chemically synthesized
catttcttatctgcaatctg

SEQ ID NO: 184189 - DNA, 20 bp, Artificial Sequence
  chemically synthesized
agatttcatcctacagattg

SEQ ID NO: 184190 - DNA, 20 bp, Artificial Sequence
  chemically synthesized
atttcttatctgcaatctgt

SEQ ID NO: 184191 - DNA, 20 bp, Artificial Sequence
  chemically synthesized
agttcaaagatttcatccta

SEQ ID NO: 184192 - DNA, 20 bp, Artificial Sequence
  chemically synthesized
catacaggaaaataagttca

SEQ ID NO: 184193 - DNA, 20 bp, Artificial Sequence
  chemically synthesized
accacaacatacaggaaaat

SEQ ID NO: 184194 - DNA, 20 bp, Artificial Sequence
  chemically synthesized
gaaaacctaccacaacatac

SEQ ID NO: 184195 - DNA, 20 bp, Artificial Sequence
  chemically synthesized
acttattttcctgtatgttg

SEQ ID NO: 184196 - DNA, 20 bp, Artificial Sequence
  chemically synthesized
ggaaaacctaccacaacata

SEQ ID NO: 184197 - DNA, 20 bp, Artificial Sequence
  chemically synthesized
tattttcctgtatgttgtgg

SEQ ID NO: 184198 - DNA, 20 bp, Artificial Sequence
  chemically synthesized
attttcctgtatgttgtggt

SEQ ID NO: 184199 - DNA, 20 bp, Artificial Sequence
  chemically synthesized
aaaatattggggataaatca

SEQ ID NO: 184200 - DNA, 20 bp, Artificial Sequence
  chemically synthesized
caaaatattggggataaatc

SEQ ID NO: 184201 - DNA, 20 bp, Artificial Sequence
  chemically synthesized
acaaaatattggggataaat

SEQ ID NO: 184202 - DNA, 20 bp, Artificial Sequence
  chemically synthesized
ggttgacaaacaaaatattg

SEQ ID NO: 184203 - DNA, 20 bp, Artificial Sequence
  chemically synthesized
gggttgacaaacaaaatatt

SEQ ID NO: 184204 - DNA, 20 bp, Artificial Sequence
  chemically synthesized
agggttgacaaacaaaatat

SEQ ID NO: 184205 - DNA, 20 bp, Artificial Sequence
  chemically synthesized
taaactatcacaaatcagaa

SEQ ID NO: 184206 - DNA, 20 bp, Artificial Sequence
  chemically synthesized
gtaaactatcacaaatcaga

SEQ ID NO: 184207 - DNA, 20 bp, Artificial Sequence
  chemically synthesized
tgtaaactatcacaaatcag

SEQ ID NO: 184208 - DNA, 20 bp, Artificial Sequence
  chemically synthesized
cactgtaaactatcacaaat

SEQ ID NO: 184209 - DNA, 20 bp, Artificial Sequence
  chemically synthesized
tcaacccttctgatttgtga

SEQ ID NO: 184210 - DNA, 20 bp, Artificial Sequence
  chemically synthesized
ttctgatttgtgatagttta

SEQ ID NO: 184211 - DNA, 20 bp, Artificial Sequence
  chemically synthesized
tgatttgtgatagtttacag

SEQ ID NO: 184212 - DNA, 20 bp, Artificial Sequence
  chemically synthesized
tagtttacagtggtactctg

SEQ ID NO: 184213 - DNA, 20 bp, Artificial Sequence
  chemically synthesized
gtgatctttatggggccaca

SEQ ID NO: 184214 - DNA, 20 bp, Artificial Sequence
  chemically synthesized
gggtgatctttatggggcca

SEQ ID NO: 184215 - DNA, 20 bp, Artificial Sequence
  chemically synthesized
tggtactctgtggccccata

SEQ ID NO: 184216 - DNA, 20 bp, Artificial Sequence
  chemically synthesized
tgatatgggtgatctttatg

SEQ ID NO: 184217 - DNA, 20 bp, Artificial Sequence
  chemically synthesized
gtgatatgggtgatctttat

SEQ ID NO: 184218 - DNA, 20 bp, Artificial Sequence
  chemically synthesized
agtgatatgggtgatcttta

SEQ ID NO: 184219 - DNA, 20 bp, Artificial Sequence
  chemically synthesized
caaatgaaccaaagtgatat

SEQ ID NO: 184220 - DNA, 20 bp, Artificial Sequence
  chemically synthesized
acaaatgaaccaaagtgata

SEQ ID NO: 184221 - DNA, 20 bp, Artificial Sequence
  chemically synthesized
aaagatcacccatatcactt

SEQ ID NO: 184222 - DNA, 20 bp, Artificial Sequence
  chemically synthesized
tagtggtgacaaatgaacca

SEQ ID NO: 184223 - DNA, 20 bp, Artificial Sequence
  chemically synthesized
tttggttcatttgtcaccac

SEQ ID NO: 184224 - DNA, 20 bp, Artificial Sequence
  chemically synthesized
acgtggcagatgagcactag

SEQ ID NO: 184225 - DNA, 20 bp, Artificial Sequence
  chemically synthesized
ccaacgtggcagatgagcac

SEQ ID NO: 184226 - DNA, 20 bp, Artificial Sequence
  chemically synthesized
aggaagccaacgtggcagat

SEQ ID NO: 184227 - DNA, 20 bp, Artificial Sequence
  chemically synthesized
ctagtgctcatctgccacgt

SEQ ID NO: 184228 - DNA, 20 bp, Artificial Sequence
  chemically synthesized
gtgtcaggaagccaacgtgg

SEQ ID NO: 184229 - DNA, 20 bp, Artificial Sequence
  chemically synthesized
caggtgtcaggaagccaacg

SEQ ID NO: 184230 - DNA, 20 bp, Artificial Sequence
  chemically synthesized
aaaggagttcaggtgtcagg

SEQ ID NO: 184231 - DNA, 20 bp, Artificial Sequence
  chemically synthesized
ggaaaaggagttcaggtgtc

SEQ ID NO: 184232 - DNA, 20 bp, Artificial Sequence
  chemically synthesized
tggaaaaggagttcaggtgt

SEQ ID NO: 184233 - DNA, 20 bp, Artificial Sequence
  chemically synthesized
ctgctgtggaaaaggagttc

SEQ ID NO: 184234 - DNA, 20 bp, Artificial Sequence
  chemically synthesized
actgctgtggaaaaggagtt

SEQ ID NO: 184235 - DNA, 20 bp, Artificial Sequence
  chemically synthesized
taagcactgctgtggaaaag

SEQ ID NO: 184236 - DNA, 20 bp, Artificial Sequence
  chemically synthesized
acacctgaactccttttcca

SEQ ID NO: 184237 - DNA, 20 bp, Artificial Sequence
  chemically synthesized
attaagcactgctgtggaaa

SEQ ID NO: 184238 - DNA, 20 bp, Artificial Sequence
  chemically synthesized
cattaagcactgctgtggaa

SEQ ID NO: 184239 - DNA, 20 bp, Artificial Sequence
  chemically synthesized
cctgaactccttttccacag

SEQ ID NO: 184240 - DNA, 20 bp, Artificial Sequence
  chemically synthesized
ttaaccattaagcactgctg

SEQ ID NO: 184241 - DNA, 20 bp, Artificial Sequence
  chemically synthesized
ttttccacagcagtgcttaa

SEQ ID NO: 184242 - DNA, 20 bp, Artificial Sequence
  chemically synthesized
cagagtacacattaaccatt

SEQ ID NO: 184243 - DNA, 20 bp, Artificial Sequence
  chemically synthesized
ttaatggttaatgtgtactc

SEQ ID NO: 184244 - DNA, 20 bp, Artificial Sequence
  chemically synthesized
taatggttaatgtgtactct

SEQ ID NO: 184245 - DNA, 20 bp, Artificial Sequence
  chemically synthesized
taaacaaaccagaattccca

SEQ ID NO: 184246 - DNA, 20 bp, Artificial Sequence
  chemically synthesized
aatgtgtactctgggaattc

SEQ ID NO: 184247 - DNA, 20 bp, Artificial Sequence
  chemically synthesized
agtaaacaaaccagaattcc

SEQ ID NO: 184248 - DNA, 20 bp, Artificial Sequence
  chemically synthesized
ttgctaaccagtaaacaaac

SEQ ID NO: 184249 - DNA, 20 bp, Artificial Sequence
  chemically synthesized
gggaattctggtttgtttac

SEQ ID NO: 184250 - DNA, 20 bp, Artificial Sequence
  chemically synthesized
attctggtttgtttactggt

SEQ ID NO: 184251 - DNA, 20 bp, Artificial Sequence
  chemically synthesized
caagtcattaatttgctaac

SEQ ID NO: 184252 - DNA, 20 bp, Artificial Sequence
  chemically synthesized
ggttagcaaattaatgactt

SEQ ID NO: 184253 - DNA, 20 bp, Artificial Sequence
  chemically synthesized
agcaaattaatgacttgaga

SEQ ID NO: 184254 - DNA, 20 bp, Artificial Sequence
  chemically synthesized
gcaaattaatgacttgagaa

SEQ ID NO: 184255 - DNA, 20 bp, Artificial Sequence
  chemically synthesized
ctcaataaggtacctttctc

SEQ ID NO: 184256 - DNA, 20 bp, Artificial Sequence
  chemically synthesized
cttgagaaaggtaccttatt

SEQ ID NO: 184257 - DNA, 20 bp, Artificial Sequence
  chemically synthesized
gagaaaggtaccttattgag

SEQ ID NO: 184258 - DNA, 20 bp, Artificial Sequence
  chemically synthesized
gaactaactgcttctcaata

SEQ ID NO: 184259 - DNA, 20 bp, Artificial Sequence
  chemically synthesized
tgaactaactgcttctcaat

SEQ ID NO: 184260 - DNA, 20 bp, Artificial Sequence
  chemically synthesized
aaaggtaccttattgagaag

SEQ ID NO: 184261 - DNA, 20 bp, Artificial Sequence
  chemically synthesized
gtaccttattgagaagcagt

SEQ ID NO: 184262 - DNA, 20 bp, Artificial Sequence
  chemically synthesized
ttgagaagcagttagttcaa

SEQ ID NO: 184263 - DNA, 20 bp, Artificial Sequence
  chemically synthesized
gagaagcagttagttcaatg

SEQ ID NO: 184264 - DNA, 20 bp, Artificial Sequence
  chemically synthesized
tgctgtcaatgtagagatgg

SEQ ID NO: 184265 - DNA, 20 bp, Artificial Sequence
  chemically synthesized
ttttgctgtcaatgtagaga

SEQ ID NO: 184266 - DNA, 20 bp, Artificial Sequence
  chemically synthesized
gccattttgctgtcaatgta

SEQ ID NO: 184267 - DNA, 20 bp, Artificial Sequence
  chemically synthesized
tgccaccatctctacattga

SEQ ID NO: 184268 - DNA, 20 bp, Artificial Sequence
  chemically synthesized
gagccattttgctgtcaatg

SEQ ID NO: 184269 - DNA, 20 bp, Artificial Sequence
  chemically synthesized
tctctacattgacagcaaaa

SEQ ID NO: 184270 - DNA, 20 bp, Artificial Sequence
  chemically synthesized
acattgacagcaaaatggct

SEQ ID NO: 184271 - DNA, 20 bp, Artificial Sequence
  chemically synthesized
agacaagggctgaagacact

SEQ ID NO: 184272 - DNA, 20 bp, Artificial Sequence
  chemically synthesized
gcaaaatggctcagtgtctt

SEQ ID NO: 184273 - DNA, 20 bp, Artificial Sequence
  chemically synthesized
caggaggaagacaagggctg

SEQ ID NO: 184274 - DNA, 20 bp, Artificial Sequence
  chemically synthesized
gaacatcaggaggaagacaa

SEQ ID NO: 184275 - DNA, 20 bp, Artificial Sequence
  chemically synthesized
tgaacatcaggaggaagaca

SEQ ID NO: 184276 - DNA, 20 bp, Artificial Sequence
  chemically synthesized
ctgaacatcaggaggaagac

SEQ ID NO: 184277 - DNA, 20 bp, Artificial Sequence
  chemically synthesized
taagtctgaacatcaggagg

SEQ ID NO: 184278 - DNA, 20 bp, Artificial Sequence
  chemically synthesized
aggtaagtctgaacatcagg

SEQ ID NO: 184279 - DNA, 20 bp, Artificial Sequence
  chemically synthesized
taggtaagtctgaacatcag

SEQ ID NO: 184280 - DNA, 20 bp, Artificial Sequence
  chemically synthesized
cttgtcttcctcctgatgtt

SEQ ID NO: 184281 - DNA, 20 bp, Artificial Sequence
  chemically synthesized
aataggtaagtctgaacatc

SEQ ID NO: 184282 - DNA, 20 bp, Artificial Sequence
  chemically synthesized
gaataggtaagtctgaacat

SEQ ID NO: 184283 - DNA, 20 bp, Artificial Sequence
  chemically synthesized
aaacacgcatttgaataggt

SEQ ID NO: 184284 - DNA, 20 bp, Artificial Sequence
  chemically synthesized
cagaaaacacgcatttgaat

SEQ ID NO: 184285 - DNA, 20 bp, Artificial Sequence
  chemically synthesized
tcagaaaacacgcatttgaa

SEQ ID NO: 184286 - DNA, 20 bp, Artificial Sequence
  chemically synthesized
aacattgaaaataaggtgat

SEQ ID NO: 184287 - DNA, 20 bp, Artificial Sequence
  chemically synthesized
ctcttggaacattgaaaata

SEQ ID NO: 184288 - DNA, 20 bp, Artificial Sequence
  chemically synthesized
gctcttggaacattgaaaat

SEQ ID NO: 184289 - DNA, 20 bp, Artificial Sequence
  chemically synthesized
caccttattttcaatgttcc

SEQ ID NO: 184290 - DNA, 20 bp, Artificial Sequence
  chemically synthesized
ccttattttcaatgttccaa

SEQ ID NO: 184291 - DNA, 20 bp, Artificial Sequence
  chemically synthesized
taatagtcttaaggagctct

SEQ ID NO: 184292 - DNA, 20 bp, Artificial Sequence
  chemically synthesized
caatgttccaagagctcctt

SEQ ID NO: 184293 - DNA, 20 bp, Artificial Sequence
  chemically synthesized
tgggatataatagtcttaag

SEQ ID NO: 184294 - DNA, 20 bp, Artificial Sequence
  chemically synthesized
cttgggatataatagtctta

SEQ ID NO: 184295 - DNA, 20 bp, Artificial Sequence
  chemically synthesized
acttgggatataatagtctt

SEQ ID NO: 184296 - DNA, 20 bp, Artificial Sequence
  chemically synthesized
gagctcaacttgggatataa

SEQ ID NO: 184297 - DNA, 20 bp, Artificial Sequence
  chemically synthesized
ccttaagactattatatccc

SEQ ID NO: 184298 - DNA, 20 bp, Artificial Sequence
  chemically synthesized
agactattatatcccaagtt

SEQ ID NO: 184299 - DNA, 20 bp, Artificial Sequence
  chemically synthesized
agacatacagagctcaactt

SEQ ID NO: 184300 - DNA, 20 bp, Artificial Sequence
  chemically synthesized
cagacatacagagctcaact

SEQ ID NO: 184301 - DNA, 20 bp, Artificial Sequence
  chemically synthesized
gaaagcaaatcagacataca

SEQ ID NO: 184302 - DNA, 20 bp, Artificial Sequence
  chemically synthesized
aggaaagcaaatcagacata

SEQ ID NO: 184303 - DNA, 20 bp, Artificial Sequence
  chemically synthesized
atggaaagaggaaagcaaat

SEQ ID NO: 184304 - DNA, 20 bp, Artificial Sequence
  chemically synthesized
gtaactgaatggaaagagga

SEQ ID NO: 184305 - DNA, 20 bp, Artificial Sequence
  chemically synthesized
gagagtaactgaatggaaag

SEQ ID NO: 184306 - DNA, 20 bp, Artificial Sequence
  chemically synthesized
ggagagtaactgaatggaaa

SEQ ID NO: 184307 - DNA, 20 bp, Artificial Sequence
  chemically synthesized
tttgctttcctctttccatt

SEQ ID NO: 184308 - DNA, 20 bp, Artificial Sequence
  chemically synthesized
aaggagagtaactgaatgga

SEQ ID NO: 184309 - DNA, 20 bp, Artificial Sequence
  chemically synthesized
tacaaaggagagtaactgaa

SEQ ID NO: 184310 - DNA, 20 bp, Artificial Sequence
  chemically synthesized
aggataggaaatacaaagga

SEQ ID NO: 184311 - DNA, 20 bp, Artificial Sequence
  chemically synthesized
tcaggataggaaatacaaag

SEQ ID NO: 184312 - DNA, 20 bp, Artificial Sequence
  chemically synthesized
agtcaggataggaaatacaa

SEQ ID NO: 184313 - DNA, 20 bp, Artificial Sequence
  chemically synthesized
tagtcaggataggaaataca

SEQ ID NO: 184314 - DNA, 20 bp, Artificial Sequence
  chemically synthesized
ggaaggctgttagtcaggat

SEQ ID NO: 184315 - DNA, 20 bp, Artificial Sequence
  chemically synthesized
tggaaggctgttagtcagga

SEQ ID NO: 184316 - DNA, 20 bp, Artificial Sequence
  chemically synthesized
gtatttcctatcctgactaa

SEQ ID NO: 184317 - DNA, 20 bp, Artificial Sequence
  chemically synthesized
tgcatggaaggctgttagtc

SEQ ID NO: 184318 - DNA, 20 bp, Artificial Sequence
  chemically synthesized
ctgcatggaaggctgttagt

SEQ ID NO: 184319 - DNA, 20 bp, Artificial Sequence
  chemically synthesized
ctggctgcatggaaggctgt

SEQ ID NO: 184320 - DNA, 20 bp, Artificial Sequence
  chemically synthesized
ctgactaacagccttccatg

SEQ ID NO: 184321 - DNA, 20 bp, Artificial Sequence
  chemically synthesized
gggggaactggctgcatgga

SEQ ID NO: 184322 - DNA, 20 bp, Artificial Sequence
  chemically synthesized
tgggggaactggctgcatgg

SEQ ID NO: 184323 - DNA, 20 bp, Artificial Sequence
  chemically synthesized
ctaacagccttccatgcagc

SEQ ID NO: 184324 - DNA, 20 bp, Artificial Sequence
  chemically synthesized
gcttgggggaactggctgca

SEQ ID NO: 184325 - DNA, 20 bp, Artificial Sequence
  chemically synthesized
ggttttttgcttgggggaac

SEQ ID NO: 184326 - DNA, 20 bp, Artificial Sequence
  chemically synthesized
tccatgcagccagttccccc

SEQ ID NO: 184327 - DNA, 20 bp, Artificial Sequence
  chemically synthesized
tttccaggttttttgcttgg

SEQ ID NO: 184328 - DNA, 20 bp, Artificial Sequence
  chemically synthesized
ttttccaggttttttgcttg

SEQ ID NO: 184329 - DNA, 20 bp, Artificial Sequence
  chemically synthesized
cttttccaggttttttgctt

SEQ ID NO: 184330 - DNA, 20 bp, Artificial Sequence
  chemically synthesized
ccttttccaggttttttgct

SEQ ID NO: 184331 - DNA, 20 bp, Artificial Sequence
  chemically synthesized
gttcccccaagcaaaaaacc

SEQ ID NO: 184332 - DNA, 20 bp, Artificial Sequence
  chemically synthesized
cccaagcaaaaaacctggaa

SEQ ID NO: 184333 - DNA, 20 bp, Artificial Sequence
  chemically synthesized
ccaagcaaaaaacctggaaa

SEQ ID NO: 184334 - DNA, 20 bp, Artificial Sequence
  chemically synthesized
caagcaaaaaacctggaaaa

SEQ ID NO: 184335 - DNA, 20 bp, Artificial Sequence
  chemically synthesized
tctaggatgatcccttttcc

SEQ ID NO: 184336 - DNA, 20 bp, Artificial Sequence
  chemically synthesized
ttctaggatgatcccttttc

SEQ ID NO: 184337 - DNA, 20 bp, Artificial Sequence
  chemically synthesized
acctggaaaagggatcatcc

SEQ ID NO: 184338 - DNA, 20 bp, Artificial Sequence
  chemically synthesized
gggaatgaagggacaattct

SEQ ID NO: 184339 - DNA, 20 bp, Artificial Sequence
  chemically synthesized
ggggaatgaagggacaattc

SEQ ID NO: 184340 - DNA, 20 bp, Artificial Sequence
  chemically synthesized
gggatgatgaggggaatgaa

SEQ ID NO: 184341 - DNA, 20 bp, Artificial Sequence
  chemically synthesized
tgggatgatgaggggaatga

SEQ ID NO: 184342 - DNA, 20 bp, Artificial Sequence
  chemically synthesized
atgggatgatgaggggaatg

SEQ ID NO: 184343 - DNA, 20 bp, Artificial Sequence
  chemically synthesized
taagtagatgggatgatgag

SEQ ID NO: 184344 - DNA, 20 bp, Artificial Sequence
  chemically synthesized
ttaagtagatgggatgatga

SEQ ID NO: 184345 - DNA, 20 bp, Artificial Sequence
  chemically synthesized
gttaagtagatgggatgatg

SEQ ID NO: 184346 - DNA, 20 bp, Artificial Sequence
  chemically synthesized
cgttaagtagatgggatgat

SEQ ID NO: 184347 - DNA, 20 bp, Artificial Sequence
  chemically synthesized
aatttagtcgttaagtagat

SEQ ID NO: 184348 - DNA, 20 bp, Artificial Sequence
  chemically synthesized
caatttagtcgttaagtaga

SEQ ID NO: 184349 - DNA, 20 bp, Artificial Sequence
  chemically synthesized
ggaacaatttagtcgttaag

SEQ ID NO: 184350 - DNA, 20 bp, Artificial Sequence
  chemically synthesized
agtggaacaatttagtcgtt

SEQ ID NO: 184351 - DNA, 20 bp, Artificial Sequence
  chemically synthesized
ttgatgaaagtggaacaatt

SEQ ID NO: 184352 - DNA, 20 bp, Artificial Sequence
  chemically synthesized
caagaaatacttgatgaaag

SEQ ID NO: 184353 - DNA, 20 bp, Artificial Sequence
  chemically synthesized
taaattgttccactttcatc

SEQ ID NO: 184354 - DNA, 20 bp, Artificial Sequence
  chemically synthesized
attcaagaaatacttgatga

SEQ ID NO: 184355 - DNA, 20 bp, Artificial Sequence
  chemically synthesized
tttaaaaacctgacagattc

SEQ ID NO: 184356 - DNA, 20 bp, Artificial Sequence
  chemically synthesized
caagtatttcttgaatctgt

SEQ ID NO: 184357 - DNA, 20 bp, Artificial Sequence
  chemically synthesized
aagtatttcttgaatctgtc

SEQ ID NO: 184358 - DNA, 20 bp, Artificial Sequence
  chemically synthesized
atagaactttaaaaacctga

SEQ ID NO: 184359 - DNA, 20 bp, Artificial Sequence
  chemically synthesized
ttgaatctgtcaggttttta

SEQ ID NO: 184360 - DNA, 20 bp, Artificial Sequence
  chemically synthesized
gagacaatgagtaagcagaa

SEQ ID NO: 184361 - DNA, 20 bp, Artificial Sequence
  chemically synthesized
agttagagacaatgagtaag

SEQ ID NO: 184362 - DNA, 20 bp, Artificial Sequence
  chemically synthesized
tcaagttagagacaatgagt

SEQ ID NO: 184363 - DNA, 20 bp, Artificial Sequence
  chemically synthesized
tgactcaagttagagacaat

SEQ ID NO: 184364 - DNA, 20 bp, Artificial Sequence
  chemically synthesized
ttactcattgtctctaactt

SEQ ID NO: 184365 - DNA, 20 bp, Artificial Sequence
  chemically synthesized
tggcagggtgactcaagtta

SEQ ID NO: 184366 - DNA, 20 bp, Artificial Sequence
  chemically synthesized
agtggcagggtgactcaagt

SEQ ID NO: 184367 - DNA, 20 bp, Artificial Sequence
  chemically synthesized
aactagtggcagggtgactc

SEQ ID NO: 184368 - DNA, 20 bp, Artificial Sequence
  chemically synthesized
aacttgagtcaccctgccac

SEQ ID NO: 184369 - DNA, 20 bp, Artificial Sequence
  chemically synthesized
agagagtgaaactagtggca

SEQ ID NO: 184370 - DNA, 20 bp, Artificial Sequence
  chemically synthesized
aagagagtgaaactagtggc

SEQ ID NO: 184371 - DNA, 20 bp, Artificial Sequence
  chemically synthesized
aaagagagtgaaactagtgg

SEQ ID NO: 184372 - DNA, 20 bp, Artificial Sequence
  chemically synthesized
aaaaaagagagtgaaactag

SEQ ID NO: 184373 - DNA, 20 bp, Artificial Sequence
  chemically synthesized
tgaaaaaaagagagtgaaac

SEQ ID NO: 184374 - DNA, 20 bp, Artificial Sequence
  chemically synthesized
agctcagagtgaaaaaaaga

SEQ ID NO: 184375 - DNA, 20 bp, Artificial Sequence
  chemically synthesized
tgagctcagagtgaaaaaaa

SEQ ID NO: 184376 - DNA, 20 bp, Artificial Sequence
  chemically synthesized
gttgagctcagagtgaaaaa

SEQ ID NO: 184377 - DNA, 20 bp, Artificial Sequence
  chemically synthesized
cactctctttttttcactct

SEQ ID NO: 184378 - DNA, 20 bp, Artificial Sequence
  chemically synthesized
ccctttgacagttgagctca

SEQ ID NO: 184379 - DNA, 20 bp, Artificial Sequence
  chemically synthesized
gtccctttgacagttgagct

SEQ ID NO: 184380 - DNA, 20 bp, Artificial Sequence
  chemically synthesized
catatgtccctttgacagtt

SEQ ID NO: 184381 - DNA, 20 bp, Artificial Sequence
  chemically synthesized
cactctgagctcaactgtca

SEQ ID NO: 184382 - DNA, 20 bp, Artificial Sequence
  chemically synthesized
actctgagctcaactgtcaa

SEQ ID NO: 184383 - DNA, 20 bp, Artificial Sequence
  chemically synthesized
ctctgagctcaactgtcaaa

SEQ ID NO: 184384 - DNA, 20 bp, Artificial Sequence
  chemically synthesized
atcctcatatgtccctttga

SEQ ID NO: 184385 - DNA, 20 bp, Artificial Sequence
  chemically synthesized
caactgtcaaagggacatat

SEQ ID NO: 184386 - DNA, 20 bp, Artificial Sequence
  chemically synthesized
aactgtcaaagggacatatg

SEQ ID NO: 184387 - DNA, 20 bp, Artificial Sequence
  chemically synthesized
catatgaggatgcaaatcta

SEQ ID NO: 184388 - DNA, 20 bp, Artificial Sequence
  chemically synthesized
tgggacgtttttatatgctt

SEQ ID NO: 184389 - DNA, 20 bp, Artificial Sequence
  chemically synthesized
gggtagaatataaggatgtt

SEQ ID NO: 184390 - DNA, 20 bp, Artificial Sequence
  chemically synthesized
agggtagaatataaggatgt

SEQ ID NO: 184391 - DNA, 20 bp, Artificial Sequence
  chemically synthesized
tttttccagggtagaatata

SEQ ID NO: 184392 - DNA, 20 bp, Artificial Sequence
  chemically synthesized
ttttttccagggtagaatat

SEQ ID NO: 184393 - DNA, 20 bp, Artificial Sequence
  chemically synthesized
aacatccttatattctaccc

SEQ ID NO: 184394 - DNA, 20 bp, Artificial Sequence
  chemically synthesized
tcaaagaattttttccaggg

SEQ ID NO: 184395 - DNA, 20 bp, Artificial Sequence
  chemically synthesized
atctcaaagaattttttcca

SEQ ID NO: 184396 - DNA, 20 bp, Artificial Sequence
  chemically synthesized
aatctcaaagaattttttcc

SEQ ID NO: 184397 - DNA, 20 bp, Artificial Sequence
  chemically synthesized
aaatctcaaagaattttttc

SEQ ID NO: 184398 - DNA, 20 bp, Artificial Sequence
  chemically synthesized
taccctggaaaaaattcttt

SEQ ID NO: 184399 - DNA, 20 bp, Artificial Sequence
  chemically synthesized
atggaagatttgaaatctca

SEQ ID NO: 184400 - DNA, 20 bp, Artificial Sequence
  chemically synthesized
caagatggaccaggtcatgg

SEQ ID NO: 184401 - DNA, 20 bp, Artificial Sequence
  chemically synthesized
atttcaaatcttccatgacc

SEQ ID NO: 184402 - DNA, 20 bp, Artificial Sequence
  chemically synthesized
tgtcaagatggaccaggtca

SEQ ID NO: 184403 - DNA, 20 bp, Artificial Sequence
  chemically synthesized
tgaaattgtcaagatggacc

SEQ ID NO: 184404 - DNA, 20 bp, Artificial Sequence
  chemically synthesized
atgaaattgtcaagatggac

SEQ ID NO: 184405 - DNA, 20 bp, Artificial Sequence
  chemically synthesized
gacaaatgaaattgtcaaga

SEQ ID NO: 184406 - DNA, 20 bp, Artificial Sequence
  chemically synthesized
ccatgacaaatgaaattgtc

SEQ ID NO: 184407 - DNA, 20 bp, Artificial Sequence
  chemically synthesized
cttgacaatttcatttgtca

SEQ ID NO: 184408 - DNA, 20 bp, Artificial Sequence
  chemically synthesized
tttgtcatggcgtcattttt

SEQ ID NO: 184409 - DNA, 20 bp, Artificial Sequence
  chemically synthesized
acttccttttatatgtagga

SEQ ID NO: 184410 - DNA, 20 bp, Artificial Sequence
  chemically synthesized
gacttccttttatatgtagg

SEQ ID NO: 184411 - DNA, 20 bp, Artificial Sequence
  chemically synthesized
ggggacttccttttatatgt

SEQ ID NO: 184412 - DNA, 20 bp, Artificial Sequence
  chemically synthesized
ttcagccttcctacatataa

SEQ ID NO: 184413 - DNA, 20 bp, Artificial Sequence
  chemically synthesized
aggggacttccttttatatg

SEQ ID NO: 184414 - DNA, 20 bp, Artificial Sequence
  chemically synthesized
tcagccttcctacatataaa

SEQ ID NO: 184415 - DNA, 20 bp, Artificial Sequence
  chemically synthesized
gccttcctacatataaaagg

SEQ ID NO: 184416 - DNA, 20 bp, Artificial Sequence
  chemically synthesized
ccctaatcaagtttgataag

SEQ ID NO: 184417 - DNA, 20 bp, Artificial Sequence
  chemically synthesized
accctaatcaagtttgataa

SEQ ID NO: 184418 - DNA, 20 bp, Artificial Sequence
  chemically synthesized
taccctaatcaagtttgata

SEQ ID NO: 184419 - DNA, 20 bp, Artificial Sequence
  chemically synthesized
ttaccctaatcaagtttgat

SEQ ID NO: 184420 - DNA, 20 bp, Artificial Sequence
  chemically synthesized
gtccccttatcaaacttgat

SEQ ID NO: 184421 - DNA, 20 bp, Artificial Sequence
  chemically synthesized
tccccttatcaaacttgatt

SEQ ID NO: 184422 - DNA, 20 bp, Artificial Sequence
  chemically synthesized
ccccttatcaaacttgatta

SEQ ID NO: 184423 - DNA, 20 bp, Artificial Sequence
  chemically synthesized
cctatccacttaccctaatc

SEQ ID NO: 184424 - DNA, 20 bp, Artificial Sequence
  chemically synthesized
ttatcaaacttgattagggt

SEQ ID NO: 184425 - DNA, 20 bp, Artificial Sequence
  chemically synthesized
tcaaacttgattagggtaag

SEQ ID NO: 184426 - DNA, 20 bp, Artificial Sequence
  chemically synthesized
acttgattagggtaagtgga

SEQ ID NO: 184427 - DNA, 20 bp, Artificial Sequence
  chemically synthesized
cttgattagggtaagtggat

SEQ ID NO: 184428 - DNA, 20 bp, Artificial Sequence
  chemically synthesized
gattagggtaagtggatagg

SEQ ID NO: 184429 - DNA, 20 bp, Artificial Sequence
  chemically synthesized
gtaagtggataggcggtttt

SEQ ID NO: 184430 - DNA, 20 bp, Artificial Sequence
  chemically synthesized
ttggaaaaatattgtaaaat

SEQ ID NO: 184431 - DNA, 20 bp, Artificial Sequence
  chemically synthesized
ggaaaaatattgtaaaattg

SEQ ID NO: 184432 - DNA, 20 bp, Artificial Sequence
  chemically synthesized
gaaaaatattgtaaaattgg

SEQ ID NO: 184433 - DNA, 20 bp, Artificial Sequence
  chemically synthesized
aaaaatattgtaaaattgga

SEQ ID NO: 184434 - DNA, 20 bp, Artificial Sequence
  chemically synthesized
taagaaaaataaaatgtttg

SEQ ID NO: 184435 - DNA, 20 bp, Artificial Sequence
  chemically synthesized
ttcaaacattttatttttct

SEQ ID NO: 184436 - DNA, 20 bp, Artificial Sequence
  chemically synthesized
agtgaccacttgtatattct

SEQ ID NO: 184437 - DNA, 20 bp, Artificial Sequence
  chemically synthesized
ttatttttcttagaatatac

SEQ ID NO: 184438 - DNA, 20 bp, Artificial Sequence
  chemically synthesized
tttttcttagaatatacaag

SEQ ID NO: 184439 - DNA, 20 bp, Artificial Sequence
  chemically synthesized
ataccaaatgagaagtaaat

SEQ ID NO: 184440 - DNA, 20 bp, Artificial Sequence
  chemically synthesized
tcactcatttacttctcatt

SEQ ID NO: 184441 - DNA, 20 bp, Artificial Sequence
  chemically synthesized
cggaccccataccaaatgag

SEQ ID NO: 184442 - DNA, 20 bp, Artificial Sequence
  chemically synthesized
tctcggaccccataccaaat

SEQ ID NO: 184443 - DNA, 20 bp, Artificial Sequence
  chemically synthesized
catttacttctcatttggta

SEQ ID NO: 184444 - DNA, 20 bp, Artificial Sequence
  chemically synthesized
atttacttctcatttggtat

SEQ ID NO: 184445 - DNA, 20 bp, Artificial Sequence
  chemically synthesized
tttacttctcatttggtatg

SEQ ID NO: 184446 - DNA, 20 bp, Artificial Sequence
  chemically synthesized
tctcatttggtatggggtcc

SEQ ID NO: 184447 - DNA, 20 bp, Artificial Sequence
  chemically synthesized
ttttactccaggaaaagtct

SEQ ID NO: 184448 - DNA, 20 bp, Artificial Sequence
  chemically synthesized
atggggtccgagacttttcc

SEQ ID NO: 184449 - DNA, 20 bp, Artificial Sequence
  chemically synthesized
ggggtccgagacttttcctg

SEQ ID NO: 184450 - DNA, 20 bp, Artificial Sequence
  chemically synthesized
gtgggcttttactccaggaa

SEQ ID NO: 184451 - DNA, 20 bp, Artificial Sequence
  chemically synthesized
cgagacttttcctggagtaa

SEQ ID NO: 184452 - DNA, 20 bp, Artificial Sequence
  chemically synthesized
aacctgtgggcttttactcc

SEQ ID NO: 184453 - DNA, 20 bp, Artificial Sequence
  chemically synthesized
caacctgtgggcttttactc

SEQ ID NO: 184454 - DNA, 20 bp, Artificial Sequence
  chemically synthesized
tttcctggagtaaaagccca

SEQ ID NO: 184455 - DNA, 20 bp, Artificial Sequence
  chemically synthesized
ttcctggagtaaaagcccac

SEQ ID NO: 184456 - DNA, 20 bp, Artificial Sequence
  chemically synthesized
tatgcttaacttcaacctgt

SEQ ID NO: 184457 - DNA, 20 bp, Artificial Sequence
  chemically synthesized
gagtaaaagcccacaggttg

SEQ ID NO: 184458 - DNA, 20 bp, Artificial Sequence
  chemically synthesized
atatgcttaacttcaacctg

SEQ ID NO: 184459 - DNA, 20 bp, Artificial Sequence
  chemically synthesized
aaagcccacaggttgaagtt

SEQ ID NO: 184460 - DNA, 20 bp, Artificial Sequence
  chemically synthesized
gtagaagtgttttatgcaaa

SEQ ID NO: 184461 - DNA, 20 bp, Artificial Sequence
  chemically synthesized
tcacagattatgaaatgtag

SEQ ID NO: 184462 - DNA, 20 bp, Artificial Sequence
  chemically synthesized
aagtcacagattatgaaatg

SEQ ID NO: 184463 - DNA, 20 bp, Artificial Sequence
  chemically synthesized
atttcataatctgtgacttt

SEQ ID NO: 184464 - DNA, 20 bp, Artificial Sequence
  chemically synthesized
agaaaccaaactaaaagtca

SEQ ID NO: 184465 - DNA, 20 bp, Artificial Sequence
  chemically synthesized
ataatctgtgacttttagtt

SEQ ID NO: 184466 - DNA, 20 bp, Artificial Sequence
  chemically synthesized
attcaaagaaaccaaactaa

SEQ ID NO: 184467 - DNA, 20 bp, Artificial Sequence
  chemically synthesized
agtttggtttctttgaatta

SEQ ID NO: 184468 - DNA, 20 bp, Artificial Sequence
  chemically synthesized
ccaaatctgactgtaattca

SEQ ID NO: 184469 - DNA, 20 bp, Artificial Sequence
  chemically synthesized
tggtttctttgaattacagt

SEQ ID NO: 184470 - DNA, 20 bp, Artificial Sequence
  chemically synthesized
ctttgaattacagtcagatt

SEQ ID NO: 184471 - DNA, 20 bp, Artificial Sequence
  chemically synthesized
ttgaattacagtcagatttg

SEQ ID NO: 184472 - DNA, 20 bp, Artificial Sequence
  chemically synthesized
ttttgcattgagattatttt

SEQ ID NO: 184473 - DNA, 20 bp, Artificial Sequence
  chemically synthesized
aaatggaggtattttgcatt

SEQ ID NO: 184474 - DNA, 20 bp, Artificial Sequence
  chemically synthesized
atagaatccccaaaaaatgg

SEQ ID NO: 184475 - DNA, 20 bp, Artificial Sequence
  chemically synthesized
tgcaaaatacctccattttt

SEQ ID NO: 184476 - DNA, 20 bp, Artificial Sequence
  chemically synthesized
gatagaatccccaaaaaatg

SEQ ID NO: 184477 - DNA, 20 bp, Artificial Sequence
  chemically synthesized
gcaaaatacctccatttttt

SEQ ID NO: 184478 - DNA, 20 bp, Artificial Sequence
  chemically synthesized
caaaatacctccattttttg

SEQ ID NO: 184479 - DNA, 20 bp, Artificial Sequence
  chemically synthesized
gggatagaatccccaaaaaa

SEQ ID NO: 184480 - DNA, 20 bp, Artificial Sequence
  chemically synthesized
ttaagattgggtatgaggga

SEQ ID NO: 184481 - DNA, 20 bp, Artificial Sequence
  chemically synthesized
ctgtttaagattgggtatga

SEQ ID NO: 184482 - DNA, 20 bp, Artificial Sequence
  chemically synthesized
actgtttaagattgggtatg

SEQ ID NO: 184483 - DNA, 20 bp, Artificial Sequence
  chemically synthesized
aactgtttaagattgggtat

SEQ ID NO: 184484 - DNA, 20 bp, Artificial Sequence
  chemically synthesized
taagacaactgtttaagatt

SEQ ID NO: 184485 - DNA, 20 bp, Artificial Sequence
  chemically synthesized
gtaagacaactgtttaagat

SEQ ID NO: 184486 - DNA, 20 bp, Artificial Sequence
  chemically synthesized
ccctcatacccaatcttaaa

SEQ ID NO: 184487 - DNA, 20 bp, Artificial Sequence
  chemically synthesized
tgtaggtaagacaactgttt

SEQ ID NO: 184488 - DNA, 20 bp, Artificial Sequence
  chemically synthesized
ctgttgaattagatgtaggt

SEQ ID NO: 184489 - DNA, 20 bp, Artificial Sequence
  chemically synthesized
ggtgctgttgaattagatgt

SEQ ID NO: 184490 - DNA, 20 bp, Artificial Sequence
  chemically synthesized
cggtgctgttgaattagatg

SEQ ID NO: 184491 - DNA, 20 bp, Artificial Sequence
  chemically synthesized
cttacctacatctaattcaa

SEQ ID NO: 184492 - DNA, 20 bp, Artificial Sequence
  chemically synthesized
aaaccacggtgctgttgaat

SEQ ID NO: 184493 - DNA, 20 bp, Artificial Sequence
  chemically synthesized
catctaattcaacagcaccg

SEQ ID NO: 184494 - DNA, 20 bp, Artificial Sequence
  chemically synthesized
aaaaaaaaaaaaaaaaacca

SEQ ID NO: 184495 - DNA, 20 bp, Artificial Sequence
  chemically synthesized
ccagcctgggtgacagagtg

SEQ ID NO: 184496 - DNA, 20 bp, Artificial Sequence
  chemically synthesized
tccagcctgggtgacagagt

SEQ ID NO: 184497 - DNA, 20 bp, Artificial Sequence
  chemically synthesized
tttttcctcactctgtcacc

SEQ ID NO: 184498 - DNA, 20 bp, Artificial Sequence
  chemically synthesized
gcactccagcctgggtgaca

SEQ ID NO: 184499 - DNA, 20 bp, Artificial Sequence
  chemically synthesized
ttttcctcactctgtcaccc

SEQ ID NO: 184500 - DNA, 20 bp, Artificial Sequence
  chemically synthesized
ttgcactccagcctgggtga

SEQ ID NO: 184501 - DNA, 20 bp, Artificial Sequence
  chemically synthesized
cctcactctgtcacccaggc

SEQ ID NO: 184502 - DNA, 20 bp, Artificial Sequence
  chemically synthesized
tcactctgtcacccaggctg

SEQ ID NO: 184503 - DNA, 20 bp, Artificial Sequence
  chemically synthesized
atgccattgcactccagcct

SEQ ID NO: 184504 - DNA, 20 bp, Artificial Sequence
  chemically synthesized
catgccattgcactccagcc

SEQ ID NO: 184505 - DNA, 20 bp, Artificial Sequence
  chemically synthesized
aagatcatgccattgcactc

SEQ ID NO: 184506 - DNA, 20 bp, Artificial Sequence
  chemically synthesized
tcacccaggctggagtgcaa

SEQ ID NO: 184507 - DNA, 20 bp, Artificial Sequence
  chemically synthesized
ggcggaggttgcagtgagac

SEQ ID NO: 184508 - DNA, 20 bp, Artificial Sequence
  chemically synthesized
cgggaggcggaggttgcagt

SEQ ID NO: 184509 - DNA, 20 bp, Artificial Sequence
  chemically synthesized
aacccgggaggcggaggttg

SEQ ID NO: 184510 - DNA, 20 bp, Artificial Sequence
  chemically synthesized
tgctcgaacccgggaggcgg

SEQ ID NO: 184511 - DNA, 20 bp, Artificial Sequence
  chemically synthesized
tcactgcaacctccgcctcc

SEQ ID NO: 184512 - DNA, 20 bp, Artificial Sequence
  chemically synthesized
ttgctcgaacccgggaggcg

SEQ ID NO: 184513 - DNA, 20 bp, Artificial Sequence
  chemically synthesized
cactgcaacctccgcctccc

SEQ ID NO: 184514 - DNA, 20 bp, Artificial Sequence
  chemically synthesized
agttgctcgaacccgggagg

SEQ ID NO: 184515 - DNA, 20 bp, Artificial Sequence
  chemically synthesized
gagagttgctcgaacccggg

SEQ ID NO: 184516 - DNA, 20 bp, Artificial Sequence
  chemically synthesized
ggagagttgctcgaacccgg

SEQ ID NO: 184517 - DNA, 20 bp, Artificial Sequence
  chemically synthesized
aacctccgcctcccgggttc

SEQ ID NO: 184518 - DNA, 20 bp, Artificial Sequence
  chemically synthesized
tgggagagttgctcgaaccc

SEQ ID NO: 184519 - DNA, 20 bp, Artificial Sequence
  chemically synthesized
gtgggagagttgctcgaacc

SEQ ID NO: 184520 - DNA, 20 bp, Artificial Sequence
  chemically synthesized
catgggagtctgaggtggga

SEQ ID NO: 184521 - DNA, 20 bp, Artificial Sequence
  chemically synthesized
ttcgagcaactctcccacct

SEQ ID NO: 184522 - DNA, 20 bp, Artificial Sequence
  chemically synthesized
tacatgggagtctgaggtgg

SEQ ID NO: 184523 - DNA, 20 bp, Artificial Sequence
  chemically synthesized
gctacatgggagtctgaggt

SEQ ID NO: 184524 - DNA, 20 bp, Artificial Sequence
  chemically synthesized
agctacatgggagtctgagg

SEQ ID NO: 184525 - DNA, 20 bp, Artificial Sequence
  chemically synthesized
cccagctacatgggagtctg

SEQ ID NO: 184526 - DNA, 20 bp, Artificial Sequence
  chemically synthesized
tcccagctacatgggagtct

SEQ ID NO: 184527 - DNA, 20 bp, Artificial Sequence
  chemically synthesized
tcccacctcagactcccatg

SEQ ID NO: 184528 - DNA, 20 bp, Artificial Sequence
  chemically synthesized
ctgtagtcccagctacatgg

SEQ ID NO: 184529 - DNA, 20 bp, Artificial Sequence
  chemically synthesized
acctcagactcccatgtagc

SEQ ID NO: 184530 - DNA, 20 bp, Artificial Sequence
  chemically synthesized
gcctgtagtcccagctacat

SEQ ID NO: 184531 - DNA, 20 bp, Artificial Sequence
  chemically synthesized
cctcagactcccatgtagct

SEQ ID NO: 184532 - DNA, 20 bp, Artificial Sequence
  chemically synthesized
ggcctgtagtcccagctaca

SEQ ID NO: 184533 - DNA, 20 bp, Artificial Sequence
  chemically synthesized
ctcccatgtagctgggacta

SEQ ID NO: 184534 - DNA, 20 bp, Artificial Sequence
  chemically synthesized
tcccatgtagctgggactac

SEQ ID NO: 184535 - DNA, 20 bp, Artificial Sequence
  chemically synthesized
cagacgtgggcctgtagtcc

SEQ ID NO: 184536 - DNA, 20 bp, Artificial Sequence
  chemically synthesized
cttagccagacgtgggcctg

SEQ ID NO: 184537 - DNA, 20 bp, Artificial Sequence
  chemically synthesized
tgggactacaggcccacgtc

SEQ ID NO: 184538 - DNA, 20 bp, Artificial Sequence
  chemically synthesized
tacaaaacttagccagacgt

SEQ ID NO: 184539 - DNA, 20 bp, Artificial Sequence
  chemically synthesized
atacaaaacttagccagacg

SEQ ID NO: 184540 - DNA, 20 bp, Artificial Sequence
  chemically synthesized
ctacaggcccacgtctggct

SEQ ID NO: 184541 - DNA, 20 bp, Artificial Sequence
  chemically synthesized
aagaaaatacaaaacttagc

SEQ ID NO: 184542 - DNA, 20 bp, Artificial Sequence
  chemically synthesized
tactaagaaaatacaaaact

SEQ ID NO: 184543 - DNA, 20 bp, Artificial Sequence
  chemically synthesized
ggctaagttttgtattttct

SEQ ID NO: 184544 - DNA, 20 bp, Artificial Sequence
  chemically synthesized
taagttttgtattttcttag

SEQ ID NO: 184545 - DNA, 20 bp, Artificial Sequence
  chemically synthesized
ggcgaaaccacatcgctact

SEQ ID NO: 184546 - DNA, 20 bp, Artificial Sequence
  chemically synthesized
gtattttcttagtagcgatg

SEQ ID NO: 184547 - DNA, 20 bp, Artificial Sequence
  chemically synthesized
gcgatgtggtttcgccatgt

SEQ ID NO: 184548 - DNA, 20 bp, Artificial Sequence
  chemically synthesized
tgtggtttcgccatgttggc

SEQ ID NO: 184549 - DNA, 20 bp, Artificial Sequence
  chemically synthesized
cgagaccagcctggccaaca

SEQ ID NO: 184550 - DNA, 20 bp, Artificial Sequence
  chemically synthesized
gtggtttcgccatgttggcc

SEQ ID NO: 184551 - DNA, 20 bp, Artificial Sequence
  chemically synthesized
tttcgccatgttggccaggc

SEQ ID NO: 184552 - DNA, 20 bp, Artificial Sequence
  chemically synthesized
tcaggatttcgagaccagcc

SEQ ID NO: 184553 - DNA, 20 bp, Artificial Sequence
  chemically synthesized
tgaggtcaggatttcgagac

SEQ ID NO: 184554 - DNA, 20 bp, Artificial Sequence
  chemically synthesized
tcacctgaggtcaggatttc

SEQ ID NO: 184555 - DNA, 20 bp, Artificial Sequence
  chemically synthesized
tggtctcgaaatcctgacct

SEQ ID NO: 184556 - DNA, 20 bp, Artificial Sequence
  chemically synthesized
ggtctcgaaatcctgacctc

SEQ ID NO: 184557 - DNA, 20 bp, Artificial Sequence
  chemically synthesized
tgggtggatcacctgaggtc

SEQ ID NO: 184558 - DNA, 20 bp, Artificial Sequence
  chemically synthesized
atgggtggatcacctgaggt

SEQ ID NO: 184559 - DNA, 20 bp, Artificial Sequence
  chemically synthesized
cgagatgggtggatcacctg

SEQ ID NO: 184560 - DNA, 20 bp, Artificial Sequence
  chemically synthesized
ccgagatgggtggatcacct

SEQ ID NO: 184561 - DNA, 20 bp, Artificial Sequence
  chemically synthesized
ctcaggtgatccacccatct

SEQ ID NO: 184562 - DNA, 20 bp, Artificial Sequence
  chemically synthesized
ctttgggaggccgagatggg

SEQ ID NO: 184563 - DNA, 20 bp, Artificial Sequence
  chemically synthesized
gcactttgggaggccgagat

SEQ ID NO: 184564 - DNA, 20 bp, Artificial Sequence
  chemically synthesized
agcactttgggaggccgaga

SEQ ID NO: 184565 - DNA, 20 bp, Artificial Sequence
  chemically synthesized
tcccagcactttgggaggcc

SEQ ID NO: 184566 - DNA, 20 bp, Artificial Sequence
  chemically synthesized
ccacccatctcggcctccca

SEQ ID NO: 184567 - DNA, 20 bp, Artificial Sequence
  chemically synthesized
tataatcccagcactttggg

SEQ ID NO: 184568 - DNA, 20 bp, Artificial Sequence
  chemically synthesized
ctataatcccagcactttgg

SEQ ID NO: 184569 - DNA, 20 bp, Artificial Sequence
  chemically synthesized
atctcggcctcccaaagtgc

SEQ ID NO: 184570 - DNA, 20 bp, Artificial Sequence
  chemically synthesized
acctataatcccagcacttt

SEQ ID NO: 184571 - DNA, 20 bp, Artificial Sequence
  chemically synthesized
tctcggcctcccaaagtgct

SEQ ID NO: 184572 - DNA, 20 bp, Artificial Sequence
  chemically synthesized
cacctataatcccagcactt

SEQ ID NO: 184573 - DNA, 20 bp, Artificial Sequence
  chemically synthesized
ctcccaaagtgctgggatta

SEQ ID NO: 184574 - DNA, 20 bp, Artificial Sequence
  chemically synthesized
tcccaaagtgctgggattat

SEQ ID NO: 184575 - DNA, 20 bp, Artificial Sequence
  chemically synthesized
gtggctcacacctataatcc

SEQ ID NO: 184576 - DNA, 20 bp, Artificial Sequence
  chemically synthesized
agtgctgggattataggtgt

SEQ ID NO: 184577 - DNA, 20 bp, Artificial Sequence
  chemically synthesized
taggtgtgagccaccgcatc

SEQ ID NO: 184578 - DNA, 20 bp, Artificial Sequence
  chemically synthesized
aaaaaaaaggccagatgcgg

SEQ ID NO: 184579 - DNA, 20 bp, Artificial Sequence
  chemically synthesized
aaaaaaaaaaaggccagatg

SEQ ID NO: 184580 - DNA, 20 bp, Artificial Sequence
  chemically synthesized
attagaaaaaaaaaaaaggc

SEQ ID NO: 184581 - DNA, 20 bp, Artificial Sequence
  chemically synthesized
ggtgattagaaaaaaaaaaa

SEQ ID NO: 184582 - DNA, 20 bp, Artificial Sequence
  chemically synthesized
aggtgattagaaaaaaaaaa

SEQ ID NO: 184583 - DNA, 20 bp, Artificial Sequence
  chemically synthesized
gaagacttgataaaggtgat

SEQ ID NO: 184584 - DNA, 20 bp, Artificial Sequence
  chemically synthesized
tttttctaatcacctttatc

SEQ ID NO: 184585 - DNA, 20 bp, Artificial Sequence
  chemically synthesized
tgctttggaagacttgataa

SEQ ID NO: 184586 - DNA, 20 bp, Artificial Sequence
  chemically synthesized
atgctttggaagacttgata

SEQ ID NO: 184587 - DNA, 20 bp, Artificial Sequence
  chemically synthesized
cacctttatcaagtcttcca

SEQ ID NO: 184588 - DNA, 20 bp, Artificial Sequence
  chemically synthesized
tactaaattgaatgctttgg

SEQ ID NO: 184589 - DNA, 20 bp, Artificial Sequence
  chemically synthesized
gaatactaaattgaatgctt

SEQ ID NO: 184590 - DNA, 20 bp, Artificial Sequence
  chemically synthesized
gtcttccaaagcattcaatt

SEQ ID NO: 184591 - DNA, 20 bp, Artificial Sequence
  chemically synthesized
agcattcaatttagtattca

SEQ ID NO: 184592 - DNA, 20 bp, Artificial Sequence
  chemically synthesized
atgaaaagataagagaattg

SEQ ID NO: 184593 - DNA, 20 bp, Artificial Sequence
  chemically synthesized
aaatagaaatgaaaagataa

SEQ ID NO: 184594 - DNA, 20 bp, Artificial Sequence
  chemically synthesized
tgaaatagaaatgaaaagat

SEQ ID NO: 184595 - DNA, 20 bp, Artificial Sequence
  chemically synthesized
actaatgaaatagaaatgaa

SEQ ID NO: 184596 - DNA, 20 bp, Artificial Sequence
  chemically synthesized
tcttttcatttctatttcat

SEQ ID NO: 184597 - DNA, 20 bp, Artificial Sequence
  chemically synthesized
tatcatgaaaactaatgaaa

SEQ ID NO: 184598 - DNA, 20 bp, Artificial Sequence
  chemically synthesized
tttcatgatatttaattaaa

SEQ ID NO: 184599 - DNA, 20 bp, Artificial Sequence
  chemically synthesized
ttcatgatatttaattaaat

SEQ ID NO: 184600 - DNA, 20 bp, Artificial Sequence
  chemically synthesized
aataggacaattttaataat

SEQ ID NO: 184601 - DNA, 20 bp, Artificial Sequence
  chemically synthesized
aataataagaataacttgca

SEQ ID NO: 184602 - DNA, 20 bp, Artificial Sequence
  chemically synthesized
ataagaataacttgcatagc

SEQ ID NO: 184603 - DNA, 20 bp, Artificial Sequence
  chemically synthesized
ggttcctgacctggctatgc

SEQ ID NO: 184604 - DNA, 20 bp, Artificial Sequence
  chemically synthesized
taagaataacttgcatagcc

SEQ ID NO: 184605 - DNA, 20 bp, Artificial Sequence
  chemically synthesized
aataacttgcatagccaggt

SEQ ID NO: 184606 - DNA, 20 bp, Artificial Sequence
  chemically synthesized
ataacttgcatagccaggtc

SEQ ID NO: 184607 - DNA, 20 bp, Artificial Sequence
  chemically synthesized
acagtctgtggttcctgacc

SEQ ID NO: 184608 - DNA, 20 bp, Artificial Sequence
  chemically synthesized
catagccaggtcaggaacca

SEQ ID NO: 184609 - DNA, 20 bp, Artificial Sequence
  chemically synthesized
ctccaagaggcaacagtctg

SEQ ID NO: 184610 - DNA, 20 bp, Artificial Sequence
  chemically synthesized
gtatgttctccaagaggcaa

SEQ ID NO: 184611 - DNA, 20 bp, Artificial Sequence
  chemically synthesized
aaccacagactgttgcctct

SEQ ID NO: 184612 - DNA, 20 bp, Artificial Sequence
  chemically synthesized
ccacagactgttgcctcttg

SEQ ID NO: 184613 - DNA, 20 bp, Artificial Sequence
  chemically synthesized
ttgagagtatgttctccaag

SEQ ID NO: 184614 - DNA, 20 bp, Artificial Sequence
  chemically synthesized
tttgagagtatgttctccaa

SEQ ID NO: 184615 - DNA, 20 bp, Artificial Sequence
  chemically synthesized
catttgagagtatgttctcc

SEQ ID NO: 184616 - DNA, 20 bp, Artificial Sequence
  chemically synthesized
ttggagaacatactctcaaa

SEQ ID NO: 184617 - DNA, 20 bp, Artificial Sequence
  chemically synthesized
ccttggctcccaccatttga

SEQ ID NO: 184618 - DNA, 20 bp, Artificial Sequence
  chemically synthesized
gagaacatactctcaaatgg

SEQ ID NO: 184619 - DNA, 20 bp, Artificial Sequence
  chemically synthesized
agaacatactctcaaatggt

SEQ ID NO: 184620 - DNA, 20 bp, Artificial Sequence
  chemically synthesized
taccttggctcccaccattt

SEQ ID NO: 184621 - DNA, 20 bp, Artificial Sequence
  chemically synthesized
aacatactctcaaatggtgg

SEQ ID NO: 184622 - DNA, 20 bp, Artificial Sequence
  chemically synthesized
actctcaaatggtgggagcc

SEQ ID NO: 184623 - DNA, 20 bp, Artificial Sequence
  chemically synthesized
ctctcaaatggtgggagcca

SEQ ID NO: 184624 - DNA, 20 bp, Artificial Sequence
  chemically synthesized
atggtgggagccaaggtaca

SEQ ID NO: 184625 - DNA, 20 bp, Artificial Sequence
  chemically synthesized
ctttctggtaccatgtacct

SEQ ID NO: 184626 - DNA, 20 bp, Artificial Sequence
  chemically synthesized
ggagccaaggtacatggtac

SEQ ID NO: 184627 - DNA, 20 bp, Artificial Sequence
  chemically synthesized
ccaaggtacatggtaccaga

SEQ ID NO: 184628 - DNA, 20 bp, Artificial Sequence
  chemically synthesized
caaggtacatggtaccagaa

SEQ ID NO: 184629 - DNA, 20 bp, Artificial Sequence
  chemically synthesized
aggtgttcaagtatcctttc

SEQ ID NO: 184630 - DNA, 20 bp, Artificial Sequence
  chemically synthesized
gatgtttttgaaaggtgttc

SEQ ID NO: 184631 - DNA, 20 bp, Artificial Sequence
  chemically synthesized
aacctattgatgtttttgaa

SEQ ID NO: 184632 - DNA, 20 bp, Artificial Sequence
  chemically synthesized
taacctattgatgtttttga

SEQ ID NO: 184633 - DNA, 20 bp, Artificial Sequence
  chemically synthesized
acacctttcaaaaacatcaa

SEQ ID NO: 184634 - DNA, 20 bp, Artificial Sequence
  chemically synthesized
cacctttcaaaaacatcaat

SEQ ID NO: 184635 - DNA, 20 bp, Artificial Sequence
  chemically synthesized
ccaaacctattgatggatat

SEQ ID NO: 184636 - DNA, 20 bp, Artificial Sequence
  chemically synthesized
aggttactaatatccatcaa

SEQ ID NO: 184637 - DNA, 20 bp, Artificial Sequence
  chemically synthesized
ggttactaatatccatcaat

SEQ ID NO: 184638 - DNA, 20 bp, Artificial Sequence
  chemically synthesized
tcccactccaaacctattga

SEQ ID NO: 184639 - DNA, 20 bp, Artificial Sequence
  chemically synthesized
ctaatatccatcaataggtt

SEQ ID NO: 184640 - DNA, 20 bp, Artificial Sequence
  chemically synthesized
aatatccatcaataggtttg

SEQ ID NO: 184641 - DNA, 20 bp, Artificial Sequence
  chemically synthesized
atccatcaataggtttggag

SEQ ID NO: 184642 - DNA, 20 bp, Artificial Sequence
  chemically synthesized
tccatcaataggtttggagt

SEQ ID NO: 184643 - DNA, 20 bp, Artificial Sequence
  chemically synthesized
aataggtttggagtgggaat

SEQ ID NO: 184644 - DNA, 20 bp, Artificial Sequence
  chemically synthesized
ataggtttggagtgggaatt

SEQ ID NO: 184645 - DNA, 20 bp, Artificial Sequence
  chemically synthesized
ggtttggagtgggaattggg

SEQ ID NO: 184646 - DNA, 20 bp, Artificial Sequence
  chemically synthesized
ggaattgggcagtttatatg

SEQ ID NO: 184647 - DNA, 20 bp, Artificial Sequence
  chemically synthesized
cagtttatatgtagaaaatg

SEQ ID NO: 184648 - DNA, 20 bp, Artificial Sequence
  chemically synthesized
gtttatatgtagaaaatgaa

SEQ ID NO: 184649 - DNA, 20 bp, Artificial Sequence
  chemically synthesized
tatgtagaaaatgaagagtt

SEQ ID NO: 184650 - DNA, 20 bp, Artificial Sequence
  chemically synthesized
atgtagaaaatgaagagttt

SEQ ID NO: 184651 - DNA, 20 bp, Artificial Sequence
  chemically synthesized
tgtagaaaatgaagagttta

SEQ ID NO: 184652 - DNA, 20 bp, Artificial Sequence
  chemically synthesized
gaaaatgaagagtttagggt

SEQ ID NO: 184653 - DNA, 20 bp, Artificial Sequence
  chemically synthesized
aagagtttagggtaagtcaa

SEQ ID NO: 184654 - DNA, 20 bp, Artificial Sequence
  chemically synthesized
agtcaatggtgcttgcttaa

SEQ ID NO: 184655 - DNA, 20 bp, Artificial Sequence
  chemically synthesized
ataaaaaggctctgttaagc

SEQ ID NO: 184656 - DNA, 20 bp, Artificial Sequence
  chemically synthesized
tcaatggtgcttgcttaaca

SEQ ID NO: 184657 - DNA, 20 bp, Artificial Sequence
  chemically synthesized
cagtataaaaaggctctgtt

SEQ ID NO: 184658 - DNA, 20 bp, Artificial Sequence
  chemically synthesized
atacacagttcagtataaaa

SEQ ID NO: 184659 - DNA, 20 bp, Artificial Sequence
  chemically synthesized
tatacacagttcagtataaa

SEQ ID NO: 184660 - DNA, 20 bp, Artificial Sequence
  chemically synthesized
ttgaaggactatacacagtt

SEQ ID NO: 184661 - DNA, 20 bp, Artificial Sequence
  chemically synthesized
tttttatactgaactgtgta

SEQ ID NO: 184662 - DNA, 20 bp, Artificial Sequence
  chemically synthesized
ctacattgaaggactataca

SEQ ID NO: 184663 - DNA, 20 bp, Artificial Sequence
  chemically synthesized
ctgtgtatagtccttcaatg

SEQ ID NO: 184664 - DNA, 20 bp, Artificial Sequence
  chemically synthesized
tgtgtatagtccttcaatgt

SEQ ID NO: 184665 - DNA, 20 bp, Artificial Sequence
  chemically synthesized
gaaaaaatggcctacattga

SEQ ID NO: 184666 - DNA, 20 bp, Artificial Sequence
  chemically synthesized
agaaaaaatggcctacattg

SEQ ID NO: 184667 - DNA, 20 bp, Artificial Sequence
  chemically synthesized
atcactgaagcaagaaaaaa

SEQ ID NO: 184668 - DNA, 20 bp, Artificial Sequence
  chemically synthesized
taggccattttttcttgctt

SEQ ID NO: 184669 - DNA, 20 bp, Artificial Sequence
  chemically synthesized
aggagcaaaatcactgaagc

SEQ ID NO: 184670 - DNA, 20 bp, Artificial Sequence
  chemically synthesized
tgacaggagcaaaatcactg

SEQ ID NO: 184671 - DNA, 20 bp, Artificial Sequence
  chemically synthesized
ccagagagaaaaagtgacag

SEQ ID NO: 184672 - DNA, 20 bp, Artificial Sequence
  chemically synthesized
tgccagagagaaaaagtgac

SEQ ID NO: 184673 - DNA, 20 bp, Artificial Sequence
  chemically synthesized
atgccagagagaaaaagtga

SEQ ID NO: 184674 - DNA, 20 bp, Artificial Sequence
  chemically synthesized
atggacatgccagagagaaa

SEQ ID NO: 184675 - DNA, 20 bp, Artificial Sequence
  chemically synthesized
ctcctgtcactttttctctc

SEQ ID NO: 184676 - DNA, 20 bp, Artificial Sequence
  chemically synthesized
gagtaaatggacatgccaga

SEQ ID NO: 184677 - DNA, 20 bp, Artificial Sequence
  chemically synthesized
aagagtaaatggacatgcca

SEQ ID NO: 184678 - DNA, 20 bp, Artificial Sequence
  chemically synthesized
tgaagagtaaatggacatgc

SEQ ID NO: 184679 - DNA, 20 bp, Artificial Sequence
  chemically synthesized
agaggcaaatgaagagtaaa

SEQ ID NO: 184680 - DNA, 20 bp, Artificial Sequence
  chemically synthesized
gatgagaagaggcaaatgaa

SEQ ID NO: 184681 - DNA, 20 bp, Artificial Sequence
  chemically synthesized
aggatgagaagaggcaaatg

SEQ ID NO: 184682 - DNA, 20 bp, Artificial Sequence
  chemically synthesized
gggtcttaaaggatgagaag

SEQ ID NO: 184683 - DNA, 20 bp, Artificial Sequence
  chemically synthesized
tgggtcttaaaggatgagaa

SEQ ID NO: 184684 - DNA, 20 bp, Artificial Sequence
  chemically synthesized
gatgggtcttaaaggatgag

SEQ ID NO: 184685 - DNA, 20 bp, Artificial Sequence
  chemically synthesized
tttgcctcttctcatccttt

SEQ ID NO: 184686 - DNA, 20 bp, Artificial Sequence
  chemically synthesized
tgggatgggtcttaaaggat

SEQ ID NO: 184687 - DNA, 20 bp, Artificial Sequence
  chemically synthesized
atctctgggatgggtcttaa

SEQ ID NO: 184688 - DNA, 20 bp, Artificial Sequence
  chemically synthesized
gatctctgggatgggtctta

SEQ ID NO: 184689 - DNA, 20 bp, Artificial Sequence
  chemically synthesized
tcatcctttaagacccatcc

SEQ ID NO: 184690 - DNA, 20 bp, Artificial Sequence
  chemically synthesized
atcctttaagacccatccca

SEQ ID NO: 184691 - DNA, 20 bp, Artificial Sequence
  chemically synthesized
gggaacgtgatctctgggat

SEQ ID NO: 184692 - DNA, 20 bp, Artificial Sequence
  chemically synthesized
agggaacgtgatctctggga

SEQ ID NO: 184693 - DNA, 20 bp, Artificial Sequence
  chemically synthesized
tgttagggaacgtgatctct

SEQ ID NO: 184694 - DNA, 20 bp, Artificial Sequence
  chemically synthesized
ttgttagggaacgtgatctc

SEQ ID NO: 184695 - DNA, 20 bp, Artificial Sequence
  chemically synthesized
gagttagggagagtttgtta

SEQ ID NO: 184696 - DNA, 20 bp, Artificial Sequence
  chemically synthesized
ggagttagggagagtttgtt

SEQ ID NO: 184697 - DNA, 20 bp, Artificial Sequence
  chemically synthesized
aggagttagggagagtttgt

SEQ ID NO: 184698 - DNA, 20 bp, Artificial Sequence
  chemically synthesized
gggaaagtaggagttaggga

SEQ ID NO: 184699 - DNA, 20 bp, Artificial Sequence
  chemically synthesized
ctgggaaagtaggagttagg

SEQ ID NO: 184700 - DNA, 20 bp, Artificial Sequence
  chemically synthesized
gcctgggaaagtaggagtta

SEQ ID NO: 184701 - DNA, 20 bp, Artificial Sequence
  chemically synthesized
tgcctgggaaagtaggagtt

SEQ ID NO: 184702 - DNA, 20 bp, Artificial Sequence
  chemically synthesized
gtgcctgggaaagtaggagt

SEQ ID NO: 184703 - DNA, 20 bp, Artificial Sequence
  chemically synthesized
ttatgtgcctgggaaagtag

SEQ ID NO: 184704 - DNA, 20 bp, Artificial Sequence
  chemically synthesized
ctccctaactcctactttcc

SEQ ID NO: 184705 - DNA, 20 bp, Artificial Sequence
  chemically synthesized
ctttatgtgcctgggaaagt

SEQ ID NO: 184706 - DNA, 20 bp, Artificial Sequence
  chemically synthesized
tccctaactcctactttccc

SEQ ID NO: 184707 - DNA, 20 bp, Artificial Sequence
  chemically synthesized
actttatgtgcctgggaaag

SEQ ID NO: 184708 - DNA, 20 bp, Artificial Sequence
  chemically synthesized
tgaactttatgtgcctggga

SEQ ID NO: 184709 - DNA, 20 bp, Artificial Sequence
  chemically synthesized
tccatgaactttatgtgcct

SEQ ID NO: 184710 - DNA, 20 bp, Artificial Sequence
  chemically synthesized
ttccatgaactttatgtgcc

SEQ ID NO: 184711 - DNA, 20 bp, Artificial Sequence
  chemically synthesized
cctactttcccaggcacata

SEQ ID NO: 184712 - DNA, 20 bp, Artificial Sequence
  chemically synthesized
tcccaggcacataaagttca

SEQ ID NO: 184713 - DNA, 20 bp, Artificial Sequence
  chemically synthesized
caggcacataaagttcatgg

SEQ ID NO: 184714 - DNA, 20 bp, Artificial Sequence
  chemically synthesized
aggcacataaagttcatgga

SEQ ID NO: 184715 - DNA, 20 bp, Artificial Sequence
  chemically synthesized
ttcatggaaggccacaaata

SEQ ID NO: 184716 - DNA, 20 bp, Artificial Sequence
  chemically synthesized
aagtgaatgtactttatttg

SEQ ID NO: 184717 - DNA, 20 bp, Artificial Sequence
  chemically synthesized
accactgtgtggagatatac

SEQ ID NO: 184718 - DNA, 20 bp, Artificial Sequence
  chemically synthesized
ttcacttgtatatctccaca

SEQ ID NO: 184719 - DNA, 20 bp, Artificial Sequence
  chemically synthesized
acttgtatatctccacacag

SEQ ID NO: 184720 - DNA, 20 bp, Artificial Sequence
  chemically synthesized
aatgatgataccactgtgtg

SEQ ID NO: 184721 - DNA, 20 bp, Artificial Sequence
  chemically synthesized
gtaatgatgataccactgtg

SEQ ID NO: 184722 - DNA, 20 bp, Artificial Sequence
  chemically synthesized
cacagtggtatcatcattac

SEQ ID NO: 184723 - DNA, 20 bp, Artificial Sequence
  chemically synthesized
aaatatgttgttgcattggc

SEQ ID NO: 184724 - DNA, 20 bp, Artificial Sequence
  chemically synthesized
caccaaatatgttgttgcat

SEQ ID NO: 184725 - DNA, 20 bp, Artificial Sequence
  chemically synthesized
agccaatgcaacaacatatt

SEQ ID NO: 184726 - DNA, 20 bp, Artificial Sequence
  chemically synthesized
tgcaacaacatatttggtgc

SEQ ID NO: 184727 - DNA, 20 bp, Artificial Sequence
  chemically synthesized
acaacatatttggtgccagc

SEQ ID NO: 184728 - DNA, 20 bp, Artificial Sequence
  chemically synthesized
ttctagtgaaacagactagc

SEQ ID NO: 184729 - DNA, 20 bp, Artificial Sequence
  chemically synthesized
ctagttctagtgaaacagac

SEQ ID NO: 184730 - DNA, 20 bp, Artificial Sequence
  chemically synthesized
tgccagctagtctgtttcac

SEQ ID NO: 184731 - DNA, 20 bp, Artificial Sequence
  chemically synthesized
cttggctagttctagtgaaa

SEQ ID NO: 184732 - DNA, 20 bp, Artificial Sequence
  chemically synthesized
ctagtctgtttcactagaac

SEQ ID NO: 184733 - DNA, 20 bp, Artificial Sequence
  chemically synthesized
tttttcaacttggctagttc

SEQ ID NO: 184734 - DNA, 20 bp, Artificial Sequence
  chemically synthesized
ctgtttcactagaactagcc

SEQ ID NO: 184735 - DNA, 20 bp, Artificial Sequence
  chemically synthesized
ttttattttttcaacttggc

SEQ ID NO: 184736 - DNA, 20 bp, Artificial Sequence
  chemically synthesized
catattttattttttcaact

SEQ ID NO: 184737 - DNA, 20 bp, Artificial Sequence
  chemically synthesized
acataaaacaattaactatg

SEQ ID NO: 184738 - DNA, 20 bp, Artificial Sequence
  chemically synthesized
actatgaaaaatcagcttca

SEQ ID NO: 184739 - DNA, 20 bp, Artificial Sequence
  chemically synthesized
atcaaaagactatgaaaaat

SEQ ID NO: 184740 - DNA, 20 bp, Artificial Sequence
  chemically synthesized
actatgaagctgatttttca

SEQ ID NO: 184741 - DNA, 20 bp, Artificial Sequence
  chemically synthesized
tttttcatagtcttttgatg

SEQ ID NO: 184742 - DNA, 20 bp, Artificial Sequence
  chemically synthesized
cattcataattcttcatcaa

SEQ ID NO: 184743 - DNA, 20 bp, Artificial Sequence
  chemically synthesized
agaattatgaatgcccttga

SEQ ID NO: 184744 - DNA, 20 bp, Artificial Sequence
  chemically synthesized
gactcttgaaaagctttcaa

SEQ ID NO: 184745 - DNA, 20 bp, Artificial Sequence
  chemically synthesized
tgactcttgaaaagctttca

SEQ ID NO: 184746 - DNA, 20 bp, Artificial Sequence
  chemically synthesized
atgactcttgaaaagctttc

SEQ ID NO: 184747 - DNA, 20 bp, Artificial Sequence
  chemically synthesized
aatgcccttgaaagcttttc

SEQ ID NO: 184748 - DNA, 20 bp, Artificial Sequence
  chemically synthesized
tgcccttgaaagcttttcaa

SEQ ID NO: 184749 - DNA, 20 bp, Artificial Sequence
  chemically synthesized
gttctctgatgactcttgaa

SEQ ID NO: 184750 - DNA, 20 bp, Artificial Sequence
  chemically synthesized
gaaagcttttcaagagtcat

SEQ ID NO: 184751 - DNA, 20 bp, Artificial Sequence
  chemically synthesized
aagcttttcaagagtcatca

SEQ ID NO: 184752 - DNA, 20 bp, Artificial Sequence
  chemically synthesized
tttcaagagtcatcagagaa

SEQ ID NO: 184753 - DNA, 20 bp, Artificial Sequence
  chemically synthesized
aagagtcatcagagaacaga

SEQ ID NO: 184754 - DNA, 20 bp, Artificial Sequence
  chemically synthesized
agagtcatcagagaacagat

SEQ ID NO: 184755 - DNA, 20 bp, Artificial Sequence
  chemically synthesized
gtcatcagagaacagatggg

SEQ ID NO: 184756 - DNA, 20 bp, Artificial Sequence
  chemically synthesized
catcagagaacagatgggaa

SEQ ID NO: 184757 - DNA, 20 bp, Artificial Sequence
  chemically synthesized
gagaacagatgggaagagac

SEQ ID NO: 184758 - DNA, 20 bp, Artificial Sequence
  chemically synthesized
acaggtgtcaatggaaaagc

SEQ ID NO: 184759 - DNA, 20 bp, Artificial Sequence
  chemically synthesized
attcacaggtgtcaatggaa

SEQ ID NO: 184760 - DNA, 20 bp, Artificial Sequence
  chemically synthesized
ttattattcacaggtgtcaa

SEQ ID NO: 184761 - DNA, 20 bp, Artificial Sequence
  chemically synthesized
atacagatattattattcac

SEQ ID NO: 184762 - DNA, 20 bp, Artificial Sequence
  chemically synthesized
catacagatattattattca

SEQ ID NO: 184763 - DNA, 20 bp, Artificial Sequence
  chemically synthesized
attgatcagagagaatcata

SEQ ID NO: 184764 - DNA, 20 bp, Artificial Sequence
  chemically synthesized
ctatttttagattgatcaga

SEQ ID NO: 184765 - DNA, 20 bp, Artificial Sequence
  chemically synthesized
agctatttttagattgatca

SEQ ID NO: 184766 - DNA, 20 bp, Artificial Sequence
  chemically synthesized
agagctatttttagattgat

SEQ ID NO: 184767 - DNA, 20 bp, Artificial Sequence
  chemically synthesized
ctctctgatcaatctaaaaa

SEQ ID NO: 184768 - DNA, 20 bp, Artificial Sequence
  chemically synthesized
tatcaccaaagagctatttt

SEQ ID NO: 184769 - DNA, 20 bp, Artificial Sequence
  chemically synthesized
tcaatctaaaaatagctctt

SEQ ID NO: 184770 - DNA, 20 bp, Artificial Sequence
  chemically synthesized
atgcaatccatatcaccaaa

SEQ ID NO: 184771 - DNA, 20 bp, Artificial Sequence
  chemically synthesized
agatgcaatccatatcacca

SEQ ID NO: 184772 - DNA, 20 bp, Artificial Sequence
  chemically synthesized
aaaatagctctttggtgata

SEQ ID NO: 184773 - DNA, 20 bp, Artificial Sequence
  chemically synthesized
catatagccacaagatgttt

SEQ ID NO: 184774 - DNA, 20 bp, Artificial Sequence
  chemically synthesized
attgcatctaaaacatcttg

SEQ ID NO: 184775 - DNA, 20 bp, Artificial Sequence
  chemically synthesized
ctcatcctacatatagccac

SEQ ID NO: 184776 - DNA, 20 bp, Artificial Sequence
  chemically synthesized
aaacatcttgtggctatatg

SEQ ID NO: 184777 - DNA, 20 bp, Artificial Sequence
  chemically synthesized
aacatcttgtggctatatgt

SEQ ID NO: 184778 - DNA, 20 bp, Artificial Sequence
  chemically synthesized
ttttagcctcatcctacata

SEQ ID NO: 184779 - DNA, 20 bp, Artificial Sequence
  chemically synthesized
cttgtggctatatgtaggat

SEQ ID NO: 184780 - DNA, 20 bp, Artificial Sequence
  chemically synthesized
ttgtggctatatgtaggatg

SEQ ID NO: 184781 - DNA, 20 bp, Artificial Sequence
  chemically synthesized
taggatgaggctaaaacatt

SEQ ID NO: 184782 - DNA, 20 bp, Artificial Sequence
  chemically synthesized
agccctgaaactgaatgttt

SEQ ID NO: 184783 - DNA, 20 bp, Artificial Sequence
  chemically synthesized
gaggctaaaacattcagttt

SEQ ID NO: 184784 - DNA, 20 bp, Artificial Sequence
  chemically synthesized
aggctaaaacattcagtttc

SEQ ID NO: 184785 - DNA, 20 bp, Artificial Sequence
  chemically synthesized
ggctaaaacattcagtttca

SEQ ID NO: 184786 - DNA, 20 bp, Artificial Sequence
  chemically synthesized
taagtgaattaagcaggaat

SEQ ID NO: 184787 - DNA, 20 bp, Artificial Sequence
  chemically synthesized
accttttaagtgaattaagc

SEQ ID NO: 184788 - DNA, 20 bp, Artificial Sequence
  chemically synthesized
taccttttaagtgaattaag

SEQ ID NO: 184789 - DNA, 20 bp, Artificial Sequence
  chemically synthesized
taataccttttaagtgaatt

SEQ ID NO: 184790 - DNA, 20 bp, Artificial Sequence
  chemically synthesized
ttcctgcttaattcacttaa

SEQ ID NO: 184791 - DNA, 20 bp, Artificial Sequence
  chemically synthesized
tcctgcttaattcacttaaa

SEQ ID NO: 184792 - DNA, 20 bp, Artificial Sequence
  chemically synthesized
tatctcaactaatacctttt

SEQ ID NO: 184793 - DNA, 20 bp, Artificial Sequence
  chemically synthesized
ttaattcacttaaaaggtat

SEQ ID NO: 184794 - DNA, 20 bp, Artificial Sequence
  chemically synthesized
tcacttaaaaggtattagtt

SEQ ID NO: 184795 - DNA, 20 bp, Artificial Sequence
  chemically synthesized
aaaaggtattagttgagata

SEQ ID NO: 184796 - DNA, 20 bp, Artificial Sequence
  chemically synthesized
ggtattagttgagatacagt

SEQ ID NO: 184797 - DNA, 20 bp, Artificial Sequence
  chemically synthesized
tattagttgagatacagtga

SEQ ID NO: 184798 - DNA, 20 bp, Artificial Sequence
  chemically synthesized
tagttgagatacagtgagag

SEQ ID NO: 184799 - DNA, 20 bp, Artificial Sequence
  chemically synthesized
agttgagatacagtgagagt

SEQ ID NO: 184800 - DNA, 20 bp, Artificial Sequence
  chemically synthesized
tgtacaaaatgtttgaatca

SEQ ID NO: 184801 - DNA, 20 bp, Artificial Sequence
  chemically synthesized
tacaaaatgtttgaatcaaa

SEQ ID NO: 184802 - DNA, 20 bp, Artificial Sequence
  chemically synthesized
tagctagttatggcaaaaag

SEQ ID NO: 184803 - DNA, 20 bp, Artificial Sequence
  chemically synthesized
atttagctagttatggcaaa

SEQ ID NO: 184804 - DNA, 20 bp, Artificial Sequence
  chemically synthesized
gagctgctttttgccataac

SEQ ID NO: 184805 - DNA, 20 bp, Artificial Sequence
  chemically synthesized
tcaatttatttagctagtta

SEQ ID NO: 184806 - DNA, 20 bp, Artificial Sequence
  chemically synthesized
gtaacttcaatttatttagc

SEQ ID NO: 184807 - DNA, 20 bp, Artificial Sequence
  chemically synthesized
acaagtaacttcaatttatt

SEQ ID NO: 184808 - DNA, 20 bp, Artificial Sequence
  chemically synthesized
ataactagctaaataaattg

SEQ ID NO: 184809 - DNA, 20 bp, Artificial Sequence
  chemically synthesized
atttagtacatttaagagac

SEQ ID NO: 184810 - DNA, 20 bp, Artificial Sequence
  chemically synthesized
tcagaatttagtacatttaa

SEQ ID NO: 184811 - DNA, 20 bp, Artificial Sequence
  chemically synthesized
cttcagaatttagtacattt

SEQ ID NO: 184812 - DNA, 20 bp, Artificial Sequence
  chemically synthesized
cttaaatgtactaaattctg

SEQ ID NO: 184813 - DNA, 20 bp, Artificial Sequence
  chemically synthesized
tttaggtattcttcagaatt

SEQ ID NO: 184814 - DNA, 20 bp, Artificial Sequence
  chemically synthesized
ataatattttaggtattctt

SEQ ID NO: 184815 - DNA, 20 bp, Artificial Sequence
  chemically synthesized
agtttggttaataatatttt

SEQ ID NO: 184816 - DNA, 20 bp, Artificial Sequence
  chemically synthesized
gagtttggttaataatattt

SEQ ID NO: 184817 - DNA, 20 bp, Artificial Sequence
  chemically synthesized
ttaaaaaaatggaaggagtt

SEQ ID NO: 184818 - DNA, 20 bp, Artificial Sequence
  chemically synthesized
tagtcttaaaaaaatggaag

SEQ ID NO: 184819 - DNA, 20 bp, Artificial Sequence
  chemically synthesized
tctagtcttaaaaaaatgga

SEQ ID NO: 184820 - DNA, 20 bp, Artificial Sequence
  chemically synthesized
ttctagtcttaaaaaaatgg

SEQ ID NO: 184821 - DNA, 20 bp, Artificial Sequence
  chemically synthesized
caaactccttccattttttt

SEQ ID NO: 184822 - DNA, 20 bp, Artificial Sequence
  chemically synthesized
cccttctagtcttaaaaaaa

SEQ ID NO: 184823 - DNA, 20 bp, Artificial Sequence
  chemically synthesized
tccttccatttttttaagac

SEQ ID NO: 184824 - DNA, 20 bp, Artificial Sequence
  chemically synthesized
ttccatttttttaagactag

SEQ ID NO: 184825 - DNA, 20 bp, Artificial Sequence
  chemically synthesized
tccatttttttaagactaga

SEQ ID NO: 184826 - DNA, 20 bp, Artificial Sequence
  chemically synthesized
ccatttttttaagactagaa

SEQ ID NO: 184827 - DNA, 20 bp, Artificial Sequence
  chemically synthesized
aaattgaccttgatcccttc

SEQ ID NO: 184828 - DNA, 20 bp, Artificial Sequence
  chemically synthesized
ttttaagactagaagggatc

SEQ ID NO: 184829 - DNA, 20 bp, Artificial Sequence
  chemically synthesized
tttaagactagaagggatca

SEQ ID NO: 184830 - DNA, 20 bp, Artificial Sequence
  chemically synthesized
aagggatcaaggtcaatttc

SEQ ID NO: 184831 - DNA, 20 bp, Artificial Sequence
  chemically synthesized
catggatacgtttgcaattc

SEQ ID NO: 184832 - DNA, 20 bp, Artificial Sequence
  chemically synthesized
tagaattgcaaacgtatcca

SEQ ID NO: 184833 - DNA, 20 bp, Artificial Sequence
  chemically synthesized
atcatgttatcacatttcca

SEQ ID NO: 184834 - DNA, 20 bp, Artificial Sequence
  chemically synthesized
atgtgataacatgataaaaa

SEQ ID NO: 184835 - DNA, 20 bp, Artificial Sequence
  chemically synthesized
catgataaaaacagaaaaat

SEQ ID NO: 184836 - DNA, 20 bp, Artificial Sequence
  chemically synthesized
taaaaacagaaaaattggtc

SEQ ID NO: 184837 - DNA, 20 bp, Artificial Sequence
  chemically synthesized
gaaaaattggtctggctctt

SEQ ID NO: 184838 - DNA, 20 bp, Artificial Sequence
  chemically synthesized
taaaaatagatctaaagagc

SEQ ID NO: 184839 - DNA, 20 bp, Artificial Sequence
  chemically synthesized
agattaaaaatagatctaaa

SEQ ID NO: 184840 - DNA, 20 bp, Artificial Sequence
  chemically synthesized
atagattaaaaatagatcta

SEQ ID NO: 184841 - DNA, 20 bp, Artificial Sequence
  chemically synthesized
attattatatagattaaaaa

SEQ ID NO: 184842 - DNA, 20 bp, Artificial Sequence
  chemically synthesized
ttacacttgacattattata

SEQ ID NO: 184843 - DNA, 20 bp, Artificial Sequence
  chemically synthesized
ttaatctatataataatgtc

SEQ ID NO: 184844 - DNA, 20 bp, Artificial Sequence
  chemically synthesized
atataataatgtcaagtgta

SEQ ID NO: 184845 - DNA, 20 bp, Artificial Sequence
  chemically synthesized
agtgtaaagatttaaatctt

SEQ ID NO: 184846 - DNA, 20 bp, Artificial Sequence
  chemically synthesized
ttcacattcagattaaactg

SEQ ID NO: 184847 - DNA, 20 bp, Artificial Sequence
  chemically synthesized
gtaagaattttattcacatt

SEQ ID NO: 184848 - DNA, 20 bp, Artificial Sequence
  chemically synthesized
actttcttaatttaaatcgt

SEQ ID NO: 184849 - DNA, 20 bp, Artificial Sequence
  chemically synthesized
aaattcttacgatttaaatt

SEQ ID NO: 184850 - DNA, 20 bp, Artificial Sequence
  chemically synthesized
tcttacgatttaaattaaga

SEQ ID NO: 184851 - DNA, 20 bp, Artificial Sequence
  chemically synthesized
taaattaagaaagtacttac

SEQ ID NO: 184852 - DNA, 20 bp, Artificial Sequence
  chemically synthesized
atatattgtagatggccagt

SEQ ID NO: 184853 - DNA, 20 bp, Artificial Sequence
  chemically synthesized
cctgatatattgtagatggc

SEQ ID NO: 184854 - DNA, 20 bp, Artificial Sequence
  chemically synthesized
aaagcctgatatattgtaga

SEQ ID NO: 184855 - DNA, 20 bp, Artificial Sequence
  chemically synthesized
ccagaaagcctgatatattg

SEQ ID NO: 184856 - DNA, 20 bp, Artificial Sequence
  chemically synthesized
actggccatctacaatatat

SEQ ID NO: 184857 - DNA, 20 bp, Artificial Sequence
  chemically synthesized
ctggccatctacaatatatc

SEQ ID NO: 184858 - DNA, 20 bp, Artificial Sequence
  chemically synthesized
ctacaatatatcaggctttc

SEQ ID NO: 184859 - DNA, 20 bp, Artificial Sequence
  chemically synthesized
aatatatcaggctttctggt

SEQ ID NO: 184860 - DNA, 20 bp, Artificial Sequence
  chemically synthesized
aacccacagtacttaccaga

SEQ ID NO: 184861 - DNA, 20 bp, Artificial Sequence
  chemically synthesized
ctataacccacagtacttac

SEQ ID NO: 184862 - DNA, 20 bp, Artificial Sequence
  chemically synthesized
aggctttctggtaagtactg

SEQ ID NO: 184863 - DNA, 20 bp, Artificial Sequence
  chemically synthesized
ggctttctggtaagtactgt

SEQ ID NO: 184864 - DNA, 20 bp, Artificial Sequence
  chemically synthesized
ctggtaagtactgtgggtta

SEQ ID NO: 184865 - DNA, 20 bp, Artificial Sequence
  chemically synthesized
attgttatctctataaccca

SEQ ID NO: 184866 - DNA, 20 bp, Artificial Sequence
  chemically synthesized
ggtaagtactgtgggttata

SEQ ID NO: 184867 - DNA, 20 bp, Artificial Sequence
  chemically synthesized
tgggttatagagataacaat

SEQ ID NO: 184868 - DNA, 20 bp, Artificial Sequence
  chemically synthesized
ggttatagagataacaataa

SEQ ID NO: 184869 - DNA, 20 bp, Artificial Sequence
  chemically synthesized
ttatagagataacaataaga

SEQ ID NO: 184870 - DNA, 20 bp, Artificial Sequence
  chemically synthesized
taaaagcttcatgagggcag

SEQ ID NO: 184871 - DNA, 20 bp, Artificial Sequence
  chemically synthesized
ttaaaagcttcatgagggca

SEQ ID NO: 184872 - DNA, 20 bp, Artificial Sequence
  chemically synthesized
gattaaaagcttcatgaggg

SEQ ID NO: 184873 - DNA, 20 bp, Artificial Sequence
  chemically synthesized
gagagtcctctgccctcatg

SEQ ID NO: 184874 - DNA, 20 bp, Artificial Sequence
  chemically synthesized
caagattaaaagcttcatga

SEQ ID NO: 184875 - DNA, 20 bp, Artificial Sequence
  chemically synthesized
gcaagattaaaagcttcatg

SEQ ID NO: 184876 - DNA, 20 bp, Artificial Sequence
  chemically synthesized
agcaagattaaaagcttcat

SEQ ID NO: 184877 - DNA, 20 bp, Artificial Sequence
  chemically synthesized
ttttcccccagcaagattaa

SEQ ID NO: 184878 - DNA, 20 bp, Artificial Sequence
  chemically synthesized
catgaagcttttaatcttgc

SEQ ID NO: 184879 - DNA, 20 bp, Artificial Sequence
  chemically synthesized
atgaagcttttaatcttgct

SEQ ID NO: 184880 - DNA, 20 bp, Artificial Sequence
  chemically synthesized
tgaagcttttaatcttgctg

SEQ ID NO: 184881 - DNA, 20 bp, Artificial Sequence
  chemically synthesized
gaagcttttaatcttgctgg

SEQ ID NO: 184882 - DNA, 20 bp, Artificial Sequence
  chemically synthesized
acatatgcttttcccccagc

SEQ ID NO: 184883 - DNA, 20 bp, Artificial Sequence
  chemically synthesized
ttttaatcttgctgggggaa

SEQ ID NO: 184884 - DNA, 20 bp, Artificial Sequence
  chemically synthesized
atttacatatgcttttcccc

SEQ ID NO: 184885 - DNA, 20 bp, Artificial Sequence
  chemically synthesized
gggggaaaagcatatgtaaa

SEQ ID NO: 184886 - DNA, 20 bp, Artificial Sequence
  chemically synthesized
ggggaaaagcatatgtaaat

SEQ ID NO: 184887 - DNA, 20 bp, Artificial Sequence
  chemically synthesized
atatacatacaatattacat

SEQ ID NO: 184888 - DNA, 20 bp, Artificial Sequence
  chemically synthesized
tattacatgagtgttataaa

SEQ ID NO: 184889 - DNA, 20 bp, Artificial Sequence
  chemically synthesized
attacatgagtgttataaaa

SEQ ID NO: 184890 - DNA, 20 bp, Artificial Sequence
  chemically synthesized
ttacatgagtgttataaaaa

SEQ ID NO: 184891 - DNA, 20 bp, Artificial Sequence
  chemically synthesized
tacatgagtgttataaaaag

SEQ ID NO: 184892 - DNA, 20 bp, Artificial Sequence
  chemically synthesized
tgagtgttataaaaaggggc

SEQ ID NO: 184893 - DNA, 20 bp, Artificial Sequence
  chemically synthesized
aaaaggggcaagaaaacctt

SEQ ID NO: 184894 - DNA, 20 bp, Artificial Sequence
  chemically synthesized
aaggggcaagaaaaccttaa

SEQ ID NO: 184895 - DNA, 20 bp, Artificial Sequence
  chemically synthesized
ataagcagtttattctctta

SEQ ID NO: 184896 - DNA, 20 bp, Artificial Sequence
  chemically synthesized
cataagcagtttattctctt

SEQ ID NO: 184897 - DNA, 20 bp, Artificial Sequence
  chemically synthesized
ctgctcttctcaaacataag

SEQ ID NO: 184898 - DNA, 20 bp, Artificial Sequence
  chemically synthesized
agaataaactgcttatgttt

SEQ ID NO: 184899 - DNA, 20 bp, Artificial Sequence
  chemically synthesized
gacctgctcttctcaaacat

SEQ ID NO: 184900 - DNA, 20 bp, Artificial Sequence
  chemically synthesized
ataaactgcttatgtttgag

SEQ ID NO: 184901 - DNA, 20 bp, Artificial Sequence
  chemically synthesized
aaactgcttatgtttgagaa

SEQ ID NO: 184902 - DNA, 20 bp, Artificial Sequence
  chemically synthesized
ctgcttatgtttgagaagag

SEQ ID NO: 184903 - DNA, 20 bp, Artificial Sequence
  chemically synthesized
tgcttatgtttgagaagagc

SEQ ID NO: 184904 - DNA, 20 bp, Artificial Sequence
  chemically synthesized
agagcaggtcacaattcatt

SEQ ID NO: 184905 - DNA, 20 bp, Artificial Sequence
  chemically synthesized
gagcaggtcacaattcattg

SEQ ID NO: 184906 - DNA, 20 bp, Artificial Sequence
  chemically synthesized
gtcacaattcattgaggtaa

SEQ ID NO: 184907 - DNA, 20 bp, Artificial Sequence
  chemically synthesized
acaattcattgaggtaatag

SEQ ID NO: 184908 - DNA, 20 bp, Artificial Sequence
  chemically synthesized
tcattgaggtaatagcagtt

SEQ ID NO: 184909 - DNA, 20 bp, Artificial Sequence
  chemically synthesized
gaggtaatagcagttaagat

SEQ ID NO: 184910 - DNA, 20 bp, Artificial Sequence
  chemically synthesized
tagcagttaagatgagtctt

SEQ ID NO: 184911 - DNA, 20 bp, Artificial Sequence
  chemically synthesized
agcagttaagatgagtctta

SEQ ID NO: 184912 - DNA, 20 bp, Artificial Sequence
  chemically synthesized
gcagttaagatgagtcttaa

SEQ ID NO: 184913 - DNA, 20 bp, Artificial Sequence
  chemically synthesized
caaaatcttacacatccctt

SEQ ID NO: 184914 - DNA, 20 bp, Artificial Sequence
  chemically synthesized
atgagtcttaagggatgtgt

SEQ ID NO: 184915 - DNA, 20 bp, Artificial Sequence
  chemically synthesized
ttaagggatgtgtaagattt

SEQ ID NO: 184916 - DNA, 20 bp, Artificial Sequence
  chemically synthesized
taagggatgtgtaagatttt

SEQ ID NO: 184917 - DNA, 20 bp, Artificial Sequence
  chemically synthesized
aagattttgggaaaaaaaat

SEQ ID NO: 184918 - DNA, 20 bp, Artificial Sequence
  chemically synthesized
agattttgggaaaaaaaata

SEQ ID NO: 184919 - DNA, 20 bp, Artificial Sequence
  chemically synthesized
gattttgggaaaaaaaataa

SEQ ID NO: 184920 - DNA, 20 bp, Artificial Sequence
  chemically synthesized
attttgggaaaaaaaataag

SEQ ID NO: 184921 - DNA, 20 bp, Artificial Sequence
  chemically synthesized
tgggaaaaaaaataagggga

SEQ ID NO: 184922 - DNA, 20 bp, Artificial Sequence
  chemically synthesized
ggaaaaaaaataaggggaaa

SEQ ID NO: 184923 - DNA, 20 bp, Artificial Sequence
  chemically synthesized
ggggaaagagaattcaacca

SEQ ID NO: 184924 - DNA, 20 bp, Artificial Sequence
  chemically synthesized
gggaaagagaattcaaccaa

SEQ ID NO: 184925 - DNA, 20 bp, Artificial Sequence
  chemically synthesized
aaagagaattcaaccaaagg

SEQ ID NO: 184926 - DNA, 20 bp, Artificial Sequence
  chemically synthesized
gagaattcaaccaaaggaag

SEQ ID NO: 184927 - DNA, 20 bp, Artificial Sequence
  chemically synthesized
aaaaaaaaaaccgcttcctt

SEQ ID NO: 184928 - DNA, 20 bp, Artificial Sequence
  chemically synthesized
aaaaacaaagaacaaaaaac

SEQ ID NO: 184929 - DNA, 20 bp, Artificial Sequence
  chemically synthesized
tttgcaaaaaaaaaaaaaca

SEQ ID NO: 184930 - DNA, 20 bp, Artificial Sequence
  chemically synthesized
ttgtttttttttttttgcaa

SEQ ID NO: 184931 - DNA, 20 bp, Artificial Sequence
  chemically synthesized
ttttttttttgcaaaagctg

SEQ ID NO: 184932 - DNA, 20 bp, Artificial Sequence
  chemically synthesized
tttttgcaaaagctgaagaa

SEQ ID NO: 184933 - DNA, 20 bp, Artificial Sequence
  chemically synthesized
acctgaagttttctgttctt

SEQ ID NO: 184934 - DNA, 20 bp, Artificial Sequence
  chemically synthesized
agctgaagaacagaaaactt

SEQ ID NO: 184935 - DNA, 20 bp, Artificial Sequence
  chemically synthesized
gctgaagaacagaaaacttc

SEQ ID NO: 184936 - DNA, 20 bp, Artificial Sequence
  chemically synthesized
ctgaagctttgaatgacctg

SEQ ID NO: 184937 - DNA, 20 bp, Artificial Sequence
  chemically synthesized
agaaaacttcaggtcattca

SEQ ID NO: 184938 - DNA, 20 bp, Artificial Sequence
  chemically synthesized
cttcaggtcattcaaagctt

SEQ ID NO: 184939 - DNA, 20 bp, Artificial Sequence
  chemically synthesized
actatttctgtttatgtctg

SEQ ID NO: 184940 - DNA, 20 bp, Artificial Sequence
  chemically synthesized
ttcaaagcttcagacataaa

SEQ ID NO: 184941 - DNA, 20 bp, Artificial Sequence
  chemically synthesized
gcttcagacataaacagaaa

SEQ ID NO: 184942 - DNA, 20 bp, Artificial Sequence
  chemically synthesized
tcagacataaacagaaatag

SEQ ID NO: 184943 - DNA, 20 bp, Artificial Sequence
  chemically synthesized
atagtggaaattatgaaaaa

SEQ ID NO: 184944 - DNA, 20 bp, Artificial Sequence
  chemically synthesized
tagtggaaattatgaaaaac

SEQ ID NO: 184945 - DNA, 20 bp, Artificial Sequence
  chemically synthesized
agtggaaattatgaaaaaca

SEQ ID NO: 184946 - DNA, 20 bp, Artificial Sequence
  chemically synthesized
gaaattatgaaaaacagggt

SEQ ID NO: 184947 - DNA, 20 bp, Artificial Sequence
  chemically synthesized
ttatgaaaaacagggttgga

SEQ ID NO: 184948 - DNA, 20 bp, Artificial Sequence
  chemically synthesized
gaaaaacagggttggaaaga

SEQ ID NO: 184949 - DNA, 20 bp, Artificial Sequence
  chemically synthesized
aaaaacagggttggaaagat

SEQ ID NO: 184950 - DNA, 20 bp, Artificial Sequence
  chemically synthesized
acagggttggaaagataggt

SEQ ID NO: 184951 - DNA, 20 bp, Artificial Sequence
  chemically synthesized
gttggaaagataggtcagaa

SEQ ID NO: 184952 - DNA, 20 bp, Artificial Sequence
  chemically synthesized
agtagcaaaagaattgaaca

SEQ ID NO: 184953 - DNA, 20 bp, Artificial Sequence
  chemically synthesized
atggccacacgtagtagcaa

SEQ ID NO: 184954 - DNA, 20 bp, Artificial Sequence
  chemically synthesized
aattcttttgctactacgtg

SEQ ID NO: 184955 - DNA, 20 bp, Artificial Sequence
  chemically synthesized
cctttgatggccacacgtag

SEQ ID NO: 184956 - DNA, 20 bp, Artificial Sequence
  chemically synthesized
ttacctttgatggccacacg

SEQ ID NO: 184957 - DNA, 20 bp, Artificial Sequence
  chemically synthesized
gctactacgtgtggccatca

SEQ ID NO: 184958 - DNA, 20 bp, Artificial Sequence
  chemically synthesized
ctactacgtgtggccatcaa

SEQ ID NO: 184959 - DNA, 20 bp, Artificial Sequence
  chemically synthesized
aaccttctccttacctttga

SEQ ID NO: 184960 - DNA, 20 bp, Artificial Sequence
  chemically synthesized
tacgtgtggccatcaaaggt

SEQ ID NO: 184961 - DNA, 20 bp, Artificial Sequence
  chemically synthesized
acgtgtggccatcaaaggta

SEQ ID NO: 184962 - DNA, 20 bp, Artificial Sequence
  chemically synthesized
gtgtggccatcaaaggtaag

SEQ ID NO: 184963 - DNA, 20 bp, Artificial Sequence
  chemically synthesized
tggccatcaaaggtaaggag

SEQ ID NO: 184964 - DNA, 20 bp, Artificial Sequence
  chemically synthesized
ggccatcaaaggtaaggaga

SEQ ID NO: 184965 - DNA, 20 bp, Artificial Sequence
  chemically synthesized
atcaaaggtaaggagaaggt

SEQ ID NO: 184966 - DNA, 20 bp, Artificial Sequence
  chemically synthesized
aaaggtaaggagaaggttgg

SEQ ID NO: 184967 - DNA, 20 bp, Artificial Sequence
  chemically synthesized
aaggtaaggagaaggttggt

SEQ ID NO: 184968 - DNA, 20 bp, Artificial Sequence
  chemically synthesized
gtaaggagaaggttggtagg

SEQ ID NO: 184969 - DNA, 20 bp, Artificial Sequence
  chemically synthesized
ggttggtaggaagaaattgc

SEQ ID NO: 184970 - DNA, 20 bp, Artificial Sequence
  chemically synthesized
aagaaattgcaagtgtatac

SEQ ID NO: 184971 - DNA, 20 bp, Artificial Sequence
  chemically synthesized
gaaattgcaagtgtatacca

SEQ ID NO: 184972 - DNA, 20 bp, Artificial Sequence
  chemically synthesized
ttttgtccatcaggattctc

SEQ ID NO: 184973 - DNA, 20 bp, Artificial Sequence
  chemically synthesized
tgtataccagagaatcctga

SEQ ID NO: 184974 - DNA, 20 bp, Artificial Sequence
  chemically synthesized
ttatcccagttttgtccatc

SEQ ID NO: 184975 - DNA, 20 bp, Artificial Sequence
  chemically synthesized
tttatcccagttttgtccat

SEQ ID NO: 184976 - DNA, 20 bp, Artificial Sequence
  chemically synthesized
agaatcctgatggacaaaac

SEQ ID NO: 184977 - DNA, 20 bp, Artificial Sequence
  chemically synthesized
gaatcctgatggacaaaact

SEQ ID NO: 184978 - DNA, 20 bp, Artificial Sequence
  chemically synthesized
agattttgcattatttatcc

SEQ ID NO: 184979 - DNA, 20 bp, Artificial Sequence
  chemically synthesized
aaataatgcaaaatctgatc

SEQ ID NO: 184980 - DNA, 20 bp, Artificial Sequence
  chemically synthesized
ataatgcaaaatctgatcta

SEQ ID NO: 184981 - DNA, 20 bp, Artificial Sequence
  chemically synthesized
ccggagtccttactctagat

SEQ ID NO: 184982 - DNA, 20 bp, Artificial Sequence
  chemically synthesized
tgcaaaatctgatctagagt

SEQ ID NO: 184983 - DNA, 20 bp, Artificial Sequence
  chemically synthesized
gcaaaatctgatctagagta

SEQ ID NO: 184984 - DNA, 20 bp, Artificial Sequence
  chemically synthesized
tgcctccggagtccttactc

SEQ ID NO: 184985 - DNA, 20 bp, Artificial Sequence
  chemically synthesized
ctgatctagagtaaggactc

SEQ ID NO: 184986 - DNA, 20 bp, Artificial Sequence
  chemically synthesized
gatctagagtaaggactccg

SEQ ID NO: 184987 - DNA, 20 bp, Artificial Sequence
  chemically synthesized
atctagagtaaggactccgg

SEQ ID NO: 184988 - DNA, 20 bp, Artificial Sequence
  chemically synthesized
tagagtaaggactccggagg

SEQ ID NO: 184989 - DNA, 20 bp, Artificial Sequence
  chemically synthesized
agtcccgcagtctgcctccg

SEQ ID NO: 184990 - DNA, 20 bp, Artificial Sequence
  chemically synthesized
gcagtcccgcagtctgcctc

SEQ ID NO: 184991 - DNA, 20 bp, Artificial Sequence
  chemically synthesized
aggactccggaggcagactg

SEQ ID NO: 184992 - DNA, 20 bp, Artificial Sequence
  chemically synthesized
ggactccggaggcagactgc

SEQ ID NO: 184993 - DNA, 20 bp, Artificial Sequence
  chemically synthesized
tgaaccaggatgcagtcccg

SEQ ID NO: 184994 - DNA, 20 bp, Artificial Sequence
  chemically synthesized
cagactgcgggactgcatcc

SEQ ID NO: 184995 - DNA, 20 bp, Artificial Sequence
  chemically synthesized
caagtatttgaaccaggatg

SEQ ID NO: 184996 - DNA, 20 bp, Artificial Sequence
  chemically synthesized
agccagcaagtatttgaacc

SEQ ID NO: 184997 - DNA, 20 bp, Artificial Sequence
  chemically synthesized
cagccagcaagtatttgaac

SEQ ID NO: 184998 - DNA, 20 bp, Artificial Sequence
  chemically synthesized
atcctggttcaaatacttgc

SEQ ID NO: 184999 - DNA, 20 bp, Artificial Sequence
  chemically synthesized
cccaagattgcacagccagc

SEQ ID NO: 185000 - DNA, 20 bp, Artificial Sequence
  chemically synthesized
tttgcccaagattgcacagc

SEQ ID NO: 185001 - DNA, 20 bp, Artificial Sequence
  chemically synthesized
actctttgcccaagattgca

SEQ ID NO: 185002 - DNA, 20 bp, Artificial Sequence
  chemically synthesized
acttgctggctgtgcaatct

SEQ ID NO: 185003 - DNA, 20 bp, Artificial Sequence
  chemically synthesized
cttgctggctgtgcaatctt

SEQ ID NO: 185004 - DNA, 20 bp, Artificial Sequence
  chemically synthesized
tggctgtgcaatcttgggca

SEQ ID NO: 185005 - DNA, 20 bp, Artificial Sequence
  chemically synthesized
gctgtgcaatcttgggcaaa

SEQ ID NO: 185006 - DNA, 20 bp, Artificial Sequence
  chemically synthesized
actgataaaactctttgccc

SEQ ID NO: 185007 - DNA, 20 bp, Artificial Sequence
  chemically synthesized
tcttgggcaaagagttttat

SEQ ID NO: 185008 - DNA, 20 bp, Artificial Sequence
  chemically synthesized
acaggagggcaacgaaggca

SEQ ID NO: 185009 - DNA, 20 bp, Artificial Sequence
  chemically synthesized
attttacaggagggcaacga

SEQ ID NO: 185010 - DNA, 20 bp, Artificial Sequence
  chemically synthesized
aattttacaggagggcaacg

SEQ ID NO: 185011 - DNA, 20 bp, Artificial Sequence
  chemically synthesized
ctccttttaattttacagga

SEQ ID NO: 185012 - DNA, 20 bp, Artificial Sequence
  chemically synthesized
tctccttttaattttacagg

SEQ ID NO: 185013 - DNA, 20 bp, Artificial Sequence
  chemically synthesized
ttctccttttaattttacag

SEQ ID NO: 185014 - DNA, 20 bp, Artificial Sequence
  chemically synthesized
tattctccttttaattttac

SEQ ID NO: 185015 - DNA, 20 bp, Artificial Sequence
  chemically synthesized
ctattctccttttaatttta

SEQ ID NO: 185016 - DNA, 20 bp, Artificial Sequence
  chemically synthesized
ttgccctcctgtaaaattaa

SEQ ID NO: 185017 - DNA, 20 bp, Artificial Sequence
  chemically synthesized
tgccctcctgtaaaattaaa

SEQ ID NO: 185018 - DNA, 20 bp, Artificial Sequence
  chemically synthesized
ccctcctgtaaaattaaaag

SEQ ID NO: 185019 - DNA, 20 bp, Artificial Sequence
  chemically synthesized
ctgtaaaattaaaaggagaa

SEQ ID NO: 185020 - DNA, 20 bp, Artificial Sequence
  chemically synthesized
ggagaatagcaactatttca

SEQ ID NO: 185021 - DNA, 20 bp, Artificial Sequence
  chemically synthesized
agaatagcaactatttcata

SEQ ID NO: 185022 - DNA, 20 bp, Artificial Sequence
  chemically synthesized
cttataacaactctatgaaa

SEQ ID NO: 185023 - DNA, 20 bp, Artificial Sequence
  chemically synthesized
ctatttcatagagttgttat

SEQ ID NO: 185024 - DNA, 20 bp, Artificial Sequence
  chemically synthesized
atagagttgttataagtatt

SEQ ID NO: 185025 - DNA, 20 bp, Artificial Sequence
  chemically synthesized
actgttccaagtgttttacg

SEQ ID NO: 185026 - DNA, 20 bp, Artificial Sequence
  chemically synthesized
attgagctacgtaaaacact

SEQ ID NO: 185027 - DNA, 20 bp, Artificial Sequence
  chemically synthesized
gctacgtaaaacacttggaa

SEQ ID NO: 185028 - DNA, 20 bp, Artificial Sequence
  chemically synthesized
atattgccatgcactgttcc

SEQ ID NO: 185029 - DNA, 20 bp, Artificial Sequence
  chemically synthesized
aaaacacttggaacagtgca

SEQ ID NO: 185030 - DNA, 20 bp, Artificial Sequence
  chemically synthesized
gaacagtgcatggcaatatt

SEQ ID NO: 185031 - DNA, 20 bp, Artificial Sequence
  chemically synthesized
tagggtggtgatggaagtga

SEQ ID NO: 185032 - DNA, 20 bp, Artificial Sequence
  chemically synthesized
gacggttagggtggtgatgg

SEQ ID NO: 185033 - DNA, 20 bp, Artificial Sequence
  chemically synthesized
gatgacggttagggtggtga

SEQ ID NO: 185034 - DNA, 20 bp, Artificial Sequence
  chemically synthesized
tatgatgatgacggttaggg

SEQ ID NO: 185035 - DNA, 20 bp, Artificial Sequence
  chemically synthesized
ttgtatgatgatgacggtta

SEQ ID NO: 185036 - DNA, 20 bp, Artificial Sequence
  chemically synthesized
tttgtatgatgatgacggtt

SEQ ID NO: 185037 - DNA, 20 bp, Artificial Sequence
  chemically synthesized
ctttgtatgatgatgacggt

SEQ ID NO: 185038 - DNA, 20 bp, Artificial Sequence
  chemically synthesized
agacctttgtatgatgatga

SEQ ID NO: 185039 - DNA, 20 bp, Artificial Sequence
  chemically synthesized
ctaaccgtcatcatcataca

SEQ ID NO: 185040 - DNA, 20 bp, Artificial Sequence
  chemically synthesized
taaccgtcatcatcatacaa

SEQ ID NO: 185041 - DNA, 20 bp, Artificial Sequence
  chemically synthesized
catcatacaaaggtctgcat

SEQ ID NO: 185042 - DNA, 20 bp, Artificial Sequence
  chemically synthesized
atcatacaaaggtctgcatg

SEQ ID NO: 185043 - DNA, 20 bp, Artificial Sequence
  chemically synthesized
tgattttatagtacctcatg

SEQ ID NO: 185044 - DNA, 20 bp, Artificial Sequence
  chemically synthesized
tccatagatatttgatttta

SEQ ID NO: 185045 - DNA, 20 bp, Artificial Sequence
  chemically synthesized
actataaaatcaaatatcta

SEQ ID NO: 185046 - DNA, 20 bp, Artificial Sequence
  chemically synthesized
aaaatcaaatatctatggaa

SEQ ID NO: 185047 - DNA, 20 bp, Artificial Sequence
  chemically synthesized
ttatattaattgcttttcca

SEQ ID NO: 185048 - DNA, 20 bp, Artificial Sequence
  chemically synthesized
gaaaagcaattaatataaat

SEQ ID NO: 185049 - DNA, 20 bp, Artificial Sequence
  chemically synthesized
gcaattaatataaatgagca

SEQ ID NO: 185050 - DNA, 20 bp, Artificial Sequence
  chemically synthesized
attaatataaatgagcaaag

SEQ ID NO: 185051 - DNA, 20 bp, Artificial Sequence
  chemically synthesized
ttaatataaatgagcaaagt

SEQ ID NO: 185052 - DNA, 20 bp, Artificial Sequence
  chemically synthesized
tataaatgagcaaagtggga

SEQ ID NO: 185053 - DNA, 20 bp, Artificial Sequence
  chemically synthesized
ataaatgagcaaagtgggac

SEQ ID NO: 185054 - DNA, 20 bp, Artificial Sequence
  chemically synthesized
tgggacaggtgctgcaaact

SEQ ID NO: 185055 - DNA, 20 bp, Artificial Sequence
  chemically synthesized
gggacaggtgctgcaaactg

SEQ ID NO: 185056 - DNA, 20 bp, Artificial Sequence
  chemically synthesized
caagctttgtcctcagtttg

SEQ ID NO: 185057 - DNA, 20 bp, Artificial Sequence
  chemically synthesized
ggtgctgcaaactgaggaca

SEQ ID NO: 185058 - DNA, 20 bp, Artificial Sequence
  chemically synthesized
gggtaagcaagctttgtcct

SEQ ID NO: 185059 - DNA, 20 bp, Artificial Sequence
  chemically synthesized
aagcattgcctggggtaagc

SEQ ID NO: 185060 - DNA, 20 bp, Artificial Sequence
  chemically synthesized
aggacaaagcttgcttaccc

SEQ ID NO: 185061 - DNA, 20 bp, Artificial Sequence
  chemically synthesized
ggacaaagcttgcttacccc

SEQ ID NO: 185062 - DNA, 20 bp, Artificial Sequence
  chemically synthesized
tgagaagcattgcctggggt

SEQ ID NO: 185063 - DNA, 20 bp, Artificial Sequence
  chemically synthesized
agtttgagaagcattgcctg

SEQ ID NO: 185064 - DNA, 20 bp, Artificial Sequence
  chemically synthesized
aagtttgagaagcattgcct

SEQ ID NO: 185065 - DNA, 20 bp, Artificial Sequence
  chemically synthesized
aaagtttgagaagcattgcc

SEQ ID NO: 185066 - DNA, 20 bp, Artificial Sequence
  chemically synthesized
tgggcacattaaagtttgag

SEQ ID NO: 185067 - DNA, 20 bp, Artificial Sequence
  chemically synthesized
tcatgggcacattaaagttt

SEQ ID NO: 185068 - DNA, 20 bp, Artificial Sequence
  chemically synthesized
agtgattcatgggcacatta

SEQ ID NO: 185069 - DNA, 20 bp, Artificial Sequence
  chemically synthesized
caagtttccaagtgattcat

SEQ ID NO: 185070 - DNA, 20 bp, Artificial Sequence
  chemically synthesized
ccaagtttccaagtgattca

SEQ ID NO: 185071 - DNA, 20 bp, Artificial Sequence
  chemically synthesized
taatgtgcccatgaatcact

SEQ ID NO: 185072 - DNA, 20 bp, Artificial Sequence
  chemically synthesized
ccatgaatcacttggaaact

SEQ ID NO: 185073 - DNA, 20 bp, Artificial Sequence
  chemically synthesized
aataagatttccaagtttcc

SEQ ID NO: 185074 - DNA, 20 bp, Artificial Sequence
  chemically synthesized
gcatttttaataagatttcc

SEQ ID NO: 185075 - DNA, 20 bp, Artificial Sequence
  chemically synthesized
taacagtcagcatttttaat

SEQ ID NO: 185076 - DNA, 20 bp, Artificial Sequence
  chemically synthesized
agaatctaataaataacagt

SEQ ID NO: 185077 - DNA, 20 bp, Artificial Sequence
  chemically synthesized
atgcagaatctaataaataa

SEQ ID NO: 185078 - DNA, 20 bp, Artificial Sequence
  chemically synthesized
aaatgctgactgttatttat

SEQ ID NO: 185079 - DNA, 20 bp, Artificial Sequence
  chemically synthesized
ttattagattctgcatttct

SEQ ID NO: 185080 - DNA, 20 bp, Artificial Sequence
  chemically synthesized
ctgggagttgctaagaaatg

SEQ ID NO: 185081 - DNA, 20 bp, Artificial Sequence
  chemically synthesized
gacatcacctgggagttgct

SEQ ID NO: 185082 - DNA, 20 bp, Artificial Sequence
  chemically synthesized
ctgcatttcttagcaactcc

SEQ ID NO: 185083 - DNA, 20 bp, Artificial Sequence
  chemically synthesized
tgcatttcttagcaactccc

SEQ ID NO: 185084 - DNA, 20 bp, Artificial Sequence
  chemically synthesized
agagcacagacatcacctgg

SEQ ID NO: 185085 - DNA, 20 bp, Artificial Sequence
  chemically synthesized
ccagagcacagacatcacct

SEQ ID NO: 185086 - DNA, 20 bp, Artificial Sequence
  chemically synthesized
tccagagcacagacatcacc

SEQ ID NO: 185087 - DNA, 20 bp, Artificial Sequence
  chemically synthesized
cccaggtgatgtctgtgctc

SEQ ID NO: 185088 - DNA, 20 bp, Artificial Sequence
  chemically synthesized
gtggtctctggtccagagca

SEQ ID NO: 185089 - DNA, 20 bp, Artificial Sequence
  chemically synthesized
gtgatgtctgtgctctggac

SEQ ID NO: 185090 - DNA, 20 bp, Artificial Sequence
  chemically synthesized
gatgtctgtgctctggacca

SEQ ID NO: 185091 - DNA, 20 bp, Artificial Sequence
  chemically synthesized
aaagtgtggtctctggtcca

SEQ ID NO: 185092 - DNA, 20 bp, Artificial Sequence
  chemically synthesized
tcaaagtgtggtctctggtc

SEQ ID NO: 185093 - DNA, 20 bp, Artificial Sequence
  chemically synthesized
gctactcaaagtgtggtctc

SEQ ID NO: 185094 - DNA, 20 bp, Artificial Sequence
  chemically synthesized
tggaccagagaccacacttt

SEQ ID NO: 185095 - DNA, 20 bp, Artificial Sequence
  chemically synthesized
ttttcttgctactcaaagtg

SEQ ID NO: 185096 - DNA, 20 bp, Artificial Sequence
  chemically synthesized
accagagaccacactttgag

SEQ ID NO: 185097 - DNA, 20 bp, Artificial Sequence
  chemically synthesized
tttcattttcttgctactca

SEQ ID NO: 185098 - DNA, 20 bp, Artificial Sequence
  chemically synthesized
gagaccacactttgagtagc

SEQ ID NO: 185099 - DNA, 20 bp, Artificial Sequence
  chemically synthesized
aaaatgaaacatctgttact

SEQ ID NO: 185100 - DNA, 20 bp, Artificial Sequence
  chemically synthesized
catcacctacaactgagtaa

SEQ ID NO: 185101 - DNA, 20 bp, Artificial Sequence
  chemically synthesized
aaacatctgttactcagttg

SEQ ID NO: 185102 - DNA, 20 bp, Artificial Sequence
  chemically synthesized
aacatctgttactcagttgt

SEQ ID NO: 185103 - DNA, 20 bp, Artificial Sequence
  chemically synthesized
tggcaccatcacctacaact

SEQ ID NO: 185104 - DNA, 20 bp, Artificial Sequence
  chemically synthesized
tgttactcagttgtaggtga

SEQ ID NO: 185105 - DNA, 20 bp, Artificial Sequence
  chemically synthesized
cagttgtaggtgatggtgcc

SEQ ID NO: 185106 - DNA, 20 bp, Artificial Sequence
  chemically synthesized
gttgtaggtgatggtgccaa

SEQ ID NO: 185107 - DNA, 20 bp, Artificial Sequence
  chemically synthesized
ctcattactatattttctct

SEQ ID NO: 185108 - DNA, 20 bp, Artificial Sequence
  chemically synthesized
gatggtgccaagagaaaata

SEQ ID NO: 185109 - DNA, 20 bp, Artificial Sequence
  chemically synthesized
ccaagagaaaatatagtaat

SEQ ID NO: 185110 - DNA, 20 bp, Artificial Sequence
  chemically synthesized
aaaatatagtaatgagtgcc

SEQ ID NO: 185111 - DNA, 20 bp, Artificial Sequence
  chemically synthesized
atatagtaatgagtgcctag

SEQ ID NO: 185112 - DNA, 20 bp, Artificial Sequence
  chemically synthesized
agtaatgagtgcctagtagc

SEQ ID NO: 185113 - DNA, 20 bp, Artificial Sequence
  chemically synthesized
aaaatttagatctggctact

SEQ ID NO: 185114 - DNA, 20 bp, Artificial Sequence
  chemically synthesized
gaaaatttagatctggctac

SEQ ID NO: 185115 - DNA, 20 bp, Artificial Sequence
  chemically synthesized
ttcttttgaaaatttagatc

SEQ ID NO: 185116 - DNA, 20 bp, Artificial Sequence
  chemically synthesized
tctgtcttcttttgaaaatt

SEQ ID NO: 185117 - DNA, 20 bp, Artificial Sequence
  chemically synthesized
agccagatctaaattttcaa

SEQ ID NO: 185118 - DNA, 20 bp, Artificial Sequence
  chemically synthesized
cagatctaaattttcaaaag

SEQ ID NO: 185119 - DNA, 20 bp, Artificial Sequence
  chemically synthesized
tctaaattttcaaaagaaga

SEQ ID NO: 185120 - DNA, 20 bp, Artificial Sequence
  chemically synthesized
cctcattttttaaaaaaata

SEQ ID NO: 185121 - DNA, 20 bp, Artificial Sequence
  chemically synthesized
tccatatttttttaaaaaat

SEQ ID NO: 185122 - DNA, 20 bp, Artificial Sequence
  chemically synthesized
ccatatttttttaaaaaatg

SEQ ID NO: 185123 - DNA, 20 bp, Artificial Sequence
  chemically synthesized
tgacaacttttaaaaattga

SEQ ID NO: 185124 - DNA, 20 bp, Artificial Sequence
  chemically synthesized
attgacaacttttaaaaatt

SEQ ID NO: 185125 - DNA, 20 bp, Artificial Sequence
  chemically synthesized
tgaggtctctcaatttttaa

SEQ ID NO: 185126 - DNA, 20 bp, Artificial Sequence
  chemically synthesized
agttgtcaattatttaaaaa

SEQ ID NO: 185127 - DNA, 20 bp, Artificial Sequence
  chemically synthesized
tgtcaattatttaaaaacag

SEQ ID NO: 185128 - DNA, 20 bp, Artificial Sequence
  chemically synthesized
atgcatgcagtatttttgca

SEQ ID NO: 185129 - DNA, 20 bp, Artificial Sequence
  chemically synthesized
ggctgaatcctgaatgcatg

SEQ ID NO: 185130 - DNA, 20 bp, Artificial Sequence
  chemically synthesized
gcaaaaatactgcatgcatt

SEQ ID NO: 185131 - DNA, 20 bp, Artificial Sequence
  chemically synthesized
caaaaatactgcatgcattc

SEQ ID NO: 185132 - DNA, 20 bp, Artificial Sequence
  chemically synthesized
tactgcatgcattcaggatt

SEQ ID NO: 185133 - DNA, 20 bp, Artificial Sequence
  chemically synthesized
tgcattcaggattcagcctg

SEQ ID NO: 185134 - DNA, 20 bp, Artificial Sequence
  chemically synthesized
gcattcaggattcagcctgt

SEQ ID NO: 185135 - DNA, 20 bp, Artificial Sequence
  chemically synthesized
tttggaaactgagtacccac

SEQ ID NO: 185136 - DNA, 20 bp, Artificial Sequence
  chemically synthesized
gtttggaaactgagtaccca

SEQ ID NO: 185137 - DNA, 20 bp, Artificial Sequence
  chemically synthesized
ggattcagcctgtgggtact

SEQ ID NO: 185138 - DNA, 20 bp, Artificial Sequence
  chemically synthesized
cagcccagagtttggaaact

SEQ ID NO: 185139 - DNA, 20 bp, Artificial Sequence
  chemically synthesized
ggtactcagtttccaaactc

SEQ ID NO: 185140 - DNA, 20 bp, Artificial Sequence
  chemically synthesized
gtactcagtttccaaactct

SEQ ID NO: 185141 - DNA, 20 bp, Artificial Sequence
  chemically synthesized
tctccatccagcccagagtt

SEQ ID NO: 185142 - DNA, 20 bp, Artificial Sequence
  chemically synthesized
tcagtttccaaactctgggc

SEQ ID NO: 185143 - DNA, 20 bp, Artificial Sequence
  chemically synthesized
ttgactctccatccagccca

SEQ ID NO: 185144 - DNA, 20 bp, Artificial Sequence
  chemically synthesized
tttccaaactctgggctgga

SEQ ID NO: 185145 - DNA, 20 bp, Artificial Sequence
  chemically synthesized
ccttgactctccatccagcc

SEQ ID NO: 185146 - DNA, 20 bp, Artificial Sequence
  chemically synthesized
tccaaactctgggctggatg

SEQ ID NO: 185147 - DNA, 20 bp, Artificial Sequence
  chemically synthesized
caaactctgggctggatgga

SEQ ID NO: 185148 - DNA, 20 bp, Artificial Sequence
  chemically synthesized
ttagaccttgactctccatc

SEQ ID NO: 185149 - DNA, 20 bp, Artificial Sequence
  chemically synthesized
tctgggctggatggagagtc

SEQ ID NO: 185150 - DNA, 20 bp, Artificial Sequence
  chemically synthesized
ctgggctggatggagagtca

SEQ ID NO: 185151 - DNA, 20 bp, Artificial Sequence
  chemically synthesized
tggagagtcaaggtctaaac

SEQ ID NO: 185152 - DNA, 20 bp, Artificial Sequence
  chemically synthesized
tttttttctcattgccagtt

SEQ ID NO: 185153 - DNA, 20 bp, Artificial Sequence
  chemically synthesized
tcaaggtctaaactggcaat

SEQ ID NO: 185154 - DNA, 20 bp, Artificial Sequence
  chemically synthesized
cttcctttttttctcattgc

SEQ ID NO: 185155 - DNA, 20 bp, Artificial Sequence
  chemically synthesized
taaactggcaatgagaaaaa

SEQ ID NO: 185156 - DNA, 20 bp, Artificial Sequence
  chemically synthesized
aaactggcaatgagaaaaaa

SEQ ID NO: 185157 - DNA, 20 bp, Artificial Sequence
  chemically synthesized
ctggcaatgagaaaaaaagg

SEQ ID NO: 185158 - DNA, 20 bp, Artificial Sequence
  chemically synthesized
atgagaaaaaaaggaagttt

SEQ ID NO: 185159 - DNA, 20 bp, Artificial Sequence
  chemically synthesized
aaaaaaaggaagtttgagta

SEQ ID NO: 185160 - DNA, 20 bp, Artificial Sequence
  chemically synthesized
aaaaaggaagtttgagtaca

SEQ ID NO: 185161 - DNA, 20 bp, Artificial Sequence
  chemically synthesized
aggaagtttgagtacagagc

SEQ ID NO: 185162 - DNA, 20 bp, Artificial Sequence
  chemically synthesized
aagtttgagtacagagcaag

SEQ ID NO: 185163 - DNA, 20 bp, Artificial Sequence
  chemically synthesized
ttgagtacagagcaagcgga

SEQ ID NO: 185164 - DNA, 20 bp, Artificial Sequence
  chemically synthesized
tgagtacagagcaagcggac

SEQ ID NO: 185165 - DNA, 20 bp, Artificial Sequence
  chemically synthesized
tacagagcaagcggacggga

SEQ ID NO: 185166 - DNA, 20 bp, Artificial Sequence
  chemically synthesized
caagcggacgggacagatcc

SEQ ID NO: 185167 - DNA, 20 bp, Artificial Sequence
  chemically synthesized
aagcggacgggacagatcct

SEQ ID NO: 185168 - DNA, 20 bp, Artificial Sequence
  chemically synthesized
agcggacgggacagatcctg

SEQ ID NO: 185169 - DNA, 20 bp, Artificial Sequence
  chemically synthesized
gcggacgggacagatcctgg

SEQ ID NO: 185170 - DNA, 20 bp, Artificial Sequence
  chemically synthesized
cacattcacattttgccccc

SEQ ID NO: 185171 - DNA, 20 bp, Artificial Sequence
  chemically synthesized
acacattcacattttgcccc

SEQ ID NO: 185172 - DNA, 20 bp, Artificial Sequence
  chemically synthesized
ggggcaaaatgtgaatgtgt

SEQ ID NO: 185173 - DNA, 20 bp, Artificial Sequence
  chemically synthesized
gcaaaatgtgaatgtgtgag

SEQ ID NO: 185174 - DNA, 20 bp, Artificial Sequence
  chemically synthesized
caaaatgtgaatgtgtgagc

SEQ ID NO: 185175 - DNA, 20 bp, Artificial Sequence
  chemically synthesized
tgaatgtgtgagcaggcttg

SEQ ID NO: 185176 - DNA, 20 bp, Artificial Sequence
  chemically synthesized
tgtgagcaggcttgtagcac

SEQ ID NO: 185177 - DNA, 20 bp, Artificial Sequence
  chemically synthesized
tccgtgtgaaccagtgctac

SEQ ID NO: 185178 - DNA, 20 bp, Artificial Sequence
  chemically synthesized
gcttgtagcactggttcaca

SEQ ID NO: 185179 - DNA, 20 bp, Artificial Sequence
  chemically synthesized
cccagtatatccgtgtgaac

SEQ ID NO: 185180 - DNA, 20 bp, Artificial Sequence
  chemically synthesized
actggttcacacggatatac

SEQ ID NO: 185181 - DNA, 20 bp, Artificial Sequence
  chemically synthesized
ctggttcacacggatatact

SEQ ID NO: 185182 - DNA, 20 bp, Artificial Sequence
  chemically synthesized
tgcaatatgttaaatgtacc

SEQ ID NO: 185183 - DNA, 20 bp, Artificial Sequence
  chemically synthesized
aacatattgcacacactgta

SEQ ID NO: 185184 - DNA, 20 bp, Artificial Sequence
  chemically synthesized
catattgcacacactgtaaa

SEQ ID NO: 185185 - DNA, 20 bp, Artificial Sequence
  chemically synthesized
atgactcaaatggctcttta

SEQ ID NO: 185186 - DNA, 20 bp, Artificial Sequence
  chemically synthesized
cacactgtaaagagccattt

SEQ ID NO: 185187 - DNA, 20 bp, Artificial Sequence
  chemically synthesized
gaatattttaatgactcaaa

SEQ ID NO: 185188 - DNA, 20 bp, Artificial Sequence
  chemically synthesized
tcttatttcctacaaattaa

SEQ ID NO: 185189 - DNA, 20 bp, Artificial Sequence
  chemically synthesized
aaatattcgcttttaatttg

SEQ ID NO: 185190 - DNA, 20 bp, Artificial Sequence
  chemically synthesized
aatattcgcttttaatttgt

SEQ ID NO: 185191 - DNA, 20 bp, Artificial Sequence
  chemically synthesized
gcttttaatttgtaggaaat

SEQ ID NO: 185192 - DNA, 20 bp, Artificial Sequence
  chemically synthesized
gtaggaaataagatgctgaa

SEQ ID NO: 185193 - DNA, 20 bp, Artificial Sequence
  chemically synthesized
ctttcaaccaaatagctttt

SEQ ID NO: 185194 - DNA, 20 bp, Artificial Sequence
  chemically synthesized
taagatgctgaaaagctatt

SEQ ID NO: 185195 - DNA, 20 bp, Artificial Sequence
  chemically synthesized
ccaaatagctttcaaccaaa

SEQ ID NO: 185196 - DNA, 20 bp, Artificial Sequence
  chemically synthesized
ctgaaaagctatttggttga

SEQ ID NO: 185197 - DNA, 20 bp, Artificial Sequence
  chemically synthesized
ctatttggttgaaagctatt

SEQ ID NO: 185198 - DNA, 20 bp, Artificial Sequence
  chemically synthesized
ttggttgaaagctatttggt

SEQ ID NO: 185199 - DNA, 20 bp, Artificial Sequence
  chemically synthesized
tggttgaaagctatttggtt

SEQ ID NO: 185200 - DNA, 20 bp, Artificial Sequence
  chemically synthesized
agaccccacccccaaccaaa

SEQ ID NO: 185201 - DNA, 20 bp, Artificial Sequence
  chemically synthesized
ggttgaaagctatttggttg

SEQ ID NO: 185202 - DNA, 20 bp, Artificial Sequence
  chemically synthesized
gttgaaagctatttggttgg

SEQ ID NO: 185203 - DNA, 20 bp, Artificial Sequence
  chemically synthesized
gaaagctatttggttggggg

SEQ ID NO: 185204 - DNA, 20 bp, Artificial Sequence
  chemically synthesized
aaagctatttggttgggggt

SEQ ID NO: 185205 - DNA, 20 bp, Artificial Sequence
  chemically synthesized
aagctatttggttgggggtg

SEQ ID NO: 185206 - DNA, 20 bp, Artificial Sequence
  chemically synthesized
ggggtggggtctgaatttgt

SEQ ID NO: 185207 - DNA, 20 bp, Artificial Sequence
  chemically synthesized
actttggcttcttacaaatt

SEQ ID NO: 185208 - DNA, 20 bp, Artificial Sequence
  chemically synthesized
gtggggtctgaatttgtaag

SEQ ID NO: 185209 - DNA, 20 bp, Artificial Sequence
  chemically synthesized
tctgaatttgtaagaagcca

SEQ ID NO: 185210 - DNA, 20 bp, Artificial Sequence
  chemically synthesized
tttgtaagaagccaaagtta

SEQ ID NO: 185211 - DNA, 20 bp, Artificial Sequence
  chemically synthesized
tcttaagttttctttaactt

SEQ ID NO: 185212 - DNA, 20 bp, Artificial Sequence
  chemically synthesized
gccaaagttaaagaaaactt

SEQ ID NO: 185213 - DNA, 20 bp, Artificial Sequence
  chemically synthesized
caaagttaaagaaaacttaa

SEQ ID NO: 185214 - DNA, 20 bp, Artificial Sequence
  chemically synthesized
taagacaactgttgtctctt

SEQ ID NO: 185215 - DNA, 20 bp, Artificial Sequence
  chemically synthesized
aaagaaaacttaagagacaa

SEQ ID NO: 185216 - DNA, 20 bp, Artificial Sequence
  chemically synthesized
agagacaacagttgtcttac

SEQ ID NO: 185217 - DNA, 20 bp, Artificial Sequence
  chemically synthesized
gagacaacagttgtcttaca

SEQ ID NO: 185218 - DNA, 20 bp, Artificial Sequence
  chemically synthesized
acaacagttgtcttacaagg

SEQ ID NO: 185219 - DNA, 20 bp, Artificial Sequence
  chemically synthesized
tgctctatgcgcttccttgt

SEQ ID NO: 185220 - DNA, 20 bp, Artificial Sequence
  chemically synthesized
ttgtcttacaaggaagcgca

SEQ ID NO: 185221 - DNA, 20 bp, Artificial Sequence
  chemically synthesized
gtcttacaaggaagcgcata

SEQ ID NO: 185222 - DNA, 20 bp, Artificial Sequence
  chemically synthesized
agagcaatatgaattgctaa

SEQ ID NO: 185223 - DNA, 20 bp, Artificial Sequence
  chemically synthesized
agcaatatgaattgctaatg

SEQ ID NO: 185224 - DNA, 20 bp, Artificial Sequence
  chemically synthesized
ctcttcttgaaagtctccat

SEQ ID NO: 185225 - DNA, 20 bp, Artificial Sequence
  chemically synthesized
aattgctaatggagactttc

SEQ ID NO: 185226 - DNA, 20 bp, Artificial Sequence
  chemically synthesized
tgctaatggagactttcaag

SEQ ID NO: 185227 - DNA, 20 bp, Artificial Sequence
  chemically synthesized
ctaatggagactttcaagaa

SEQ ID NO: 185228 - DNA, 20 bp, Artificial Sequence
  chemically synthesized
ctggttggtcctcttcttga

SEQ ID NO: 185229 - DNA, 20 bp, Artificial Sequence
  chemically synthesized
taatggagactttcaagaag

SEQ ID NO: 185230 - DNA, 20 bp, Artificial Sequence
  chemically synthesized
ctttcaagaagaggaccaac

SEQ ID NO: 185231 - DNA, 20 bp, Artificial Sequence
  chemically synthesized
tttcaagaagaggaccaacc

SEQ ID NO: 185232 - DNA, 20 bp, Artificial Sequence
  chemically synthesized
ttcattaaagtaggcctggt

SEQ ID NO: 185233 - DNA, 20 bp, Artificial Sequence
  chemically synthesized
ctaattcattaaagtaggcc

SEQ ID NO: 185234 - DNA, 20 bp, Artificial Sequence
  chemically synthesized
cttatctaattcattaaagt

SEQ ID NO: 185235 - DNA, 20 bp, Artificial Sequence
  chemically synthesized
ccttatctaattcattaaag

SEQ ID NO: 185236 - DNA, 20 bp, Artificial Sequence
  chemically synthesized
gagccttatctaattcatta

SEQ ID NO: 185237 - DNA, 20 bp, Artificial Sequence
  chemically synthesized
ccaggcctactttaatgaat

SEQ ID NO: 185238 - DNA, 20 bp, Artificial Sequence
  chemically synthesized
cctactttaatgaattagat

SEQ ID NO: 185239 - DNA, 20 bp, Artificial Sequence
  chemically synthesized
ctactttaatgaattagata

SEQ ID NO: 185240 - DNA, 20 bp, Artificial Sequence
  chemically synthesized
acacgctgttgattagaaat

SEQ ID NO: 185241 - DNA, 20 bp, Artificial Sequence
  chemically synthesized
taaggctcatttctaatcaa

SEQ ID NO: 185242 - DNA, 20 bp, Artificial Sequence
  chemically synthesized
tgcaaatacacgctgttgat

SEQ ID NO: 185243 - DNA, 20 bp, Artificial Sequence
  chemically synthesized
tgtatttgcatgcaaacaat

SEQ ID NO: 185244 - DNA, 20 bp, Artificial Sequence
  chemically synthesized
ttgcatgcaaacaatgagct

SEQ ID NO: 185245 - DNA, 20 bp, Artificial Sequence
  chemically synthesized
tgcatgcaaacaatgagcta

SEQ ID NO: 185246 - DNA, 20 bp, Artificial Sequence
  chemically synthesized
aaattattgtttaaagacct

SEQ ID NO: 185247 - DNA, 20 bp, Artificial Sequence
  chemically synthesized
aaggaagaaattattgttta

SEQ ID NO: 185248 - DNA, 20 bp, Artificial Sequence
  chemically synthesized
aaacaataatttcttccttt

SEQ ID NO: 185249 - DNA, 20 bp, Artificial Sequence
  chemically synthesized
ttcgtaaatgtacttaaagg

SEQ ID NO: 185250 - DNA, 20 bp, Artificial Sequence
  chemically synthesized
gcattcgtaaatgtacttaa

SEQ ID NO: 185251 - DNA, 20 bp, Artificial Sequence
  chemically synthesized
ggcattcgtaaatgtactta

SEQ ID NO: 185252 - DNA, 20 bp, Artificial Sequence
  chemically synthesized
ggtgtaaataagataatggg

SEQ ID NO: 185253 - DNA, 20 bp, Artificial Sequence
  chemically synthesized
tggtgtaaataagataatgg

SEQ ID NO: 185254 - DNA, 20 bp, Artificial Sequence
  chemically synthesized
aatggtgtaaataagataat

SEQ ID NO: 185255 - DNA, 20 bp, Artificial Sequence
  chemically synthesized
taatggtgtaaataagataa

SEQ ID NO: 185256 - DNA, 20 bp, Artificial Sequence
  chemically synthesized
tgcaaattaatggtgtaaat

SEQ ID NO: 185257 - DNA, 20 bp, Artificial Sequence
  chemically synthesized
tggtttgccatgcaaattaa

SEQ ID NO: 185258 - DNA, 20 bp, Artificial Sequence
  chemically synthesized
atttacaccattaatttgca

SEQ ID NO: 185259 - DNA, 20 bp, Artificial Sequence
  chemically synthesized
cattaatttgcatggcaaac

SEQ ID NO: 185260 - DNA, 20 bp, Artificial Sequence
  chemically synthesized
atttgcatggcaaaccagca

SEQ ID NO: 185261 - DNA, 20 bp, Artificial Sequence
  chemically synthesized
tactagtatataatctatgc

SEQ ID NO: 185262 - DNA, 20 bp, Artificial Sequence
  chemically synthesized
aaccagcatagattatatac

SEQ ID NO: 185263 - DNA, 20 bp, Artificial Sequence
  chemically synthesized
attcttaaaccaaaatgtac

SEQ ID NO: 185264 - DNA, 20 bp, Artificial Sequence
  chemically synthesized
gattatatactagtacattt

SEQ ID NO: 185265 - DNA, 20 bp, Artificial Sequence
  chemically synthesized
atactagtacattttggttt

SEQ ID NO: 185266 - DNA, 20 bp, Artificial Sequence
  chemically synthesized
tacattttggtttaagaatt

SEQ ID NO: 185267 - DNA, 20 bp, Artificial Sequence
  chemically synthesized
attttggtttaagaattcag

SEQ ID NO: 185268 - DNA, 20 bp, Artificial Sequence
  chemically synthesized
ttggtttaagaattcagaag

SEQ ID NO: 185269 - DNA, 20 bp, Artificial Sequence
  chemically synthesized
ggtttaagaattcagaagta

SEQ ID NO: 185270 - DNA, 20 bp, Artificial Sequence
  chemically synthesized
tttaagaattcagaagtaga

SEQ ID NO: 185271 - DNA, 20 bp, Artificial Sequence
  chemically synthesized
ttaagaattcagaagtagag

SEQ ID NO: 185272 - DNA, 20 bp, Artificial Sequence
  chemically synthesized
ttcagaagtagagaggttta

SEQ ID NO: 185273 - DNA, 20 bp, Artificial Sequence
  chemically synthesized
tcagaagtagagaggtttaa

SEQ ID NO: 185274 - DNA, 20 bp, Artificial Sequence
  chemically synthesized
agaagtagagaggtttaaag

SEQ ID NO: 185275 - DNA, 20 bp, Artificial Sequence
  chemically synthesized
agtagagaggtttaaaggag

SEQ ID NO: 185276 - DNA, 20 bp, Artificial Sequence
  chemically synthesized
agacttcatgtacggtcatt

SEQ ID NO: 185277 - DNA, 20 bp, Artificial Sequence
  chemically synthesized
taacttaatgaccgtacatg

SEQ ID NO: 185278 - DNA, 20 bp, Artificial Sequence
  chemically synthesized
cttgtgtgagacttcatgta

SEQ ID NO: 185279 - DNA, 20 bp, Artificial Sequence
  chemically synthesized
ccgtacatgaagtctcacac

SEQ ID NO: 185280 - DNA, 20 bp, Artificial Sequence
  chemically synthesized
tacatgaagtctcacacaag

SEQ ID NO: 185281 - DNA, 20 bp, Artificial Sequence
  chemically synthesized
ttaaaaagcccttcttgtgt

SEQ ID NO: 185282 - DNA, 20 bp, Artificial Sequence
  chemically synthesized
acatgaagtctcacacaaga

SEQ ID NO: 185283 - DNA, 20 bp, Artificial Sequence
  chemically synthesized
catgaagtctcacacaagaa

SEQ ID NO: 185284 - DNA, 20 bp, Artificial Sequence
  chemically synthesized
gtaagtctagacatgttaaa

SEQ ID NO: 185285 - DNA, 20 bp, Artificial Sequence
  chemically synthesized
gaagggctttttaacatgtc

SEQ ID NO: 185286 - DNA, 20 bp, Artificial Sequence
  chemically synthesized
atggaagttaaaagtaagtc

SEQ ID NO: 185287 - DNA, 20 bp, Artificial Sequence
  chemically synthesized
aatacatggaagttaaaagt

SEQ ID NO: 185288 - DNA, 20 bp, Artificial Sequence
  chemically synthesized
tcagaatacatggaagttaa

SEQ ID NO: 185289 - DNA, 20 bp, Artificial Sequence
  chemically synthesized
atctctttcagaatacatgg

SEQ ID NO: 185290 - DNA, 20 bp, Artificial Sequence
  chemically synthesized
caaatctctttcagaataca

SEQ ID NO: 185291 - DNA, 20 bp, Artificial Sequence
  chemically synthesized
ttaacttccatgtattctga

SEQ ID NO: 185292 - DNA, 20 bp, Artificial Sequence
  chemically synthesized
aacttccatgtattctgaaa

SEQ ID NO: 185293 - DNA, 20 bp, Artificial Sequence
  chemically synthesized
gattcttgacaaatctcttt

SEQ ID NO: 185294 - DNA, 20 bp, Artificial Sequence
  chemically synthesized
tattctgaaagagatttgtc

SEQ ID NO: 185295 - DNA, 20 bp, Artificial Sequence
  chemically synthesized
atttgtcaagaatcatttcc

SEQ ID NO: 185296 - DNA, 20 bp, Artificial Sequence
  chemically synthesized
tttgtcaagaatcatttcca

SEQ ID NO: 185297 - DNA, 20 bp, Artificial Sequence
  chemically synthesized
ataatattttcagattacct

SEQ ID NO: 185298 - DNA, 20 bp, Artificial Sequence
  chemically synthesized
cccaaaggagataatatttt

SEQ ID NO: 185299 - DNA, 20 bp, Artificial Sequence
  chemically synthesized
tctgaaaatattatctcctt

SEQ ID NO: 185300 - DNA, 20 bp, Artificial Sequence
  chemically synthesized
ctgaaaatattatctccttt

SEQ ID NO: 185301 - DNA, 20 bp, Artificial Sequence
  chemically synthesized
tctggcaagcagtcccaaag

SEQ ID NO: 185302 - DNA, 20 bp, Artificial Sequence
  chemically synthesized
tttctggcaagcagtcccaa

SEQ ID NO: 185303 - DNA, 20 bp, Artificial Sequence
  chemically synthesized
ctttctggcaagcagtccca

SEQ ID NO: 185304 - DNA, 20 bp, Artificial Sequence
  chemically synthesized
tctcctttgggactgcttgc

SEQ ID NO: 185305 - DNA, 20 bp, Artificial Sequence
  chemically synthesized
gtgtgcacctttctggcaag

SEQ ID NO: 185306 - DNA, 20 bp, Artificial Sequence
  chemically synthesized
ctttgggactgcttgccaga

SEQ ID NO: 185307 - DNA, 20 bp, Artificial Sequence
  chemically synthesized
tttgggactgcttgccagaa

SEQ ID NO: 185308 - DNA, 20 bp, Artificial Sequence
  chemically synthesized
aatgtgtgcacctttctggc

SEQ ID NO: 185309 - DNA, 20 bp, Artificial Sequence
  chemically synthesized
atggaatgtgtgcacctttc

SEQ ID NO: 185310 - DNA, 20 bp, Artificial Sequence
  chemically synthesized
aaaggtgcacacattccatt

SEQ ID NO: 185311 - DNA, 20 bp, Artificial Sequence
  chemically synthesized
ggtgcacacattccattgag

SEQ ID NO: 185312 - DNA, 20 bp, Artificial Sequence
  chemically synthesized
gtgcacacattccattgaga

SEQ ID NO: 185313 - DNA, 20 bp, Artificial Sequence
  chemically synthesized
tgcacacattccattgagaa

SEQ ID NO: 185314 - DNA, 20 bp, Artificial Sequence
  chemically synthesized
gggtagtagccccttctcaa

SEQ ID NO: 185315 - DNA, 20 bp, Artificial Sequence
  chemically synthesized
gcacacattccattgagaag

SEQ ID NO: 185316 - DNA, 20 bp, Artificial Sequence
  chemically synthesized
attgagaaggggctactacc

SEQ ID NO: 185317 - DNA, 20 bp, Artificial Sequence
  chemically synthesized
agaaacgtacatctgggtag

SEQ ID NO: 185318 - DNA, 20 bp, Artificial Sequence
  chemically synthesized
cgtagaaacgtacatctggg

SEQ ID NO: 185319 - DNA, 20 bp, Artificial Sequence
  chemically synthesized
gtacgtagaaacgtacatct

SEQ ID NO: 185320 - DNA, 20 bp, Artificial Sequence
  chemically synthesized
agtacgtagaaacgtacatc

SEQ ID NO: 185321 - DNA, 20 bp, Artificial Sequence
  chemically synthesized
ttttagaggtgaatagtacg

SEQ ID NO: 185322 - DNA, 20 bp, Artificial Sequence
  chemically synthesized
tggttacttttagaggtgaa

SEQ ID NO: 185323 - DNA, 20 bp, Artificial Sequence
  chemically synthesized
tacgtactattcacctctaa

SEQ ID NO: 185324 - DNA, 20 bp, Artificial Sequence
  chemically synthesized
ggaactctggttacttttag

SEQ ID NO: 185325 - DNA, 20 bp, Artificial Sequence
  chemically synthesized
aggaactctggttactttta

SEQ ID NO: 185326 - DNA, 20 bp, Artificial Sequence
  chemically synthesized
caaggaactctggttacttt

SEQ ID NO: 185327 - DNA, 20 bp, Artificial Sequence
  chemically synthesized
tattcacctctaaaagtaac

SEQ ID NO: 185328 - DNA, 20 bp, Artificial Sequence
  chemically synthesized
ttcacctctaaaagtaacca

SEQ ID NO: 185329 - DNA, 20 bp, Artificial Sequence
  chemically synthesized
ccatttttttcaaggaactc

SEQ ID NO: 185330 - DNA, 20 bp, Artificial Sequence
  chemically synthesized
agaattacccatttttttca

SEQ ID NO: 185331 - DNA, 20 bp, Artificial Sequence
  chemically synthesized
tagaattacccatttttttc

SEQ ID NO: 185332 - DNA, 20 bp, Artificial Sequence
  chemically synthesized
ccagagttccttgaaaaaaa

SEQ ID NO: 185333 - DNA, 20 bp, Artificial Sequence
  chemically synthesized
cagagttccttgaaaaaaat

SEQ ID NO: 185334 - DNA, 20 bp, Artificial Sequence
  chemically synthesized
aaaatgggtaattctaaatc

SEQ ID NO: 185335 - DNA, 20 bp, Artificial Sequence
  chemically synthesized
aaatgggtaattctaaatct

SEQ ID NO: 185336 - DNA, 20 bp, Artificial Sequence
  chemically synthesized
gactttgcctatcccagatt

SEQ ID NO: 185337 - DNA, 20 bp, Artificial Sequence
  chemically synthesized
gggtaattctaaatctggga

SEQ ID NO: 185338 - DNA, 20 bp, Artificial Sequence
  chemically synthesized
ggtaattctaaatctgggat

SEQ ID NO: 185339 - DNA, 20 bp, Artificial Sequence
  chemically synthesized
accttggactttgcctatcc

SEQ ID NO: 185340 - DNA, 20 bp, Artificial Sequence
  chemically synthesized
ttctaaatctgggataggca

SEQ ID NO: 185341 - DNA, 20 bp, Artificial Sequence
  chemically synthesized
atctgggataggcaaagtcc

SEQ ID NO: 185342 - DNA, 20 bp, Artificial Sequence
  chemically synthesized
tctgggataggcaaagtcca

SEQ ID NO: 185343 - DNA, 20 bp, Artificial Sequence
  chemically synthesized
ggataggcaaagtccaaggt

SEQ ID NO: 185344 - DNA, 20 bp, Artificial Sequence
  chemically synthesized
caattgtcccaggctcacct

SEQ ID NO: 185345 - DNA, 20 bp, Artificial Sequence
  chemically synthesized
ggcaaagtccaaggtgagcc

SEQ ID NO: 185346 - DNA, 20 bp, Artificial Sequence
  chemically synthesized
gcaaagtccaaggtgagcct

SEQ ID NO: 185347 - DNA, 20 bp, Artificial Sequence
  chemically synthesized
gcttcctgctcaattgtccc

SEQ ID NO: 185348 - DNA, 20 bp, Artificial Sequence
  chemically synthesized
agcttcctgctcaattgtcc

SEQ ID NO: 185349 - DNA, 20 bp, Artificial Sequence
  chemically synthesized
aaggtgagcctgggacaatt

SEQ ID NO: 185350 - DNA, 20 bp, Artificial Sequence
  chemically synthesized
gtgagcctgggacaattgag

SEQ ID NO: 185351 - DNA, 20 bp, Artificial Sequence
  chemically synthesized
tgagcctgggacaattgagc

SEQ ID NO: 185352 - DNA, 20 bp, Artificial Sequence
  chemically synthesized
gcctgggacaattgagcagg

SEQ ID NO: 185353 - DNA, 20 bp, Artificial Sequence
  chemically synthesized
gacaattgagcaggaagctc

SEQ ID NO: 185354 - DNA, 20 bp, Artificial Sequence
  chemically synthesized
acaattgagcaggaagctct

SEQ ID NO: 185355 - DNA, 20 bp, Artificial Sequence
  chemically synthesized
ttgagcaggaagctctgggc

SEQ ID NO: 185356 - DNA, 20 bp, Artificial Sequence
  chemically synthesized
acagttattattcttgccca

SEQ ID NO: 185357 - DNA, 20 bp, Artificial Sequence
  chemically synthesized
ttacagttattattcttgcc

SEQ ID NO: 185358 - DNA, 20 bp, Artificial Sequence
  chemically synthesized
caatatattattatgaatta

SEQ ID NO: 185359 - DNA, 20 bp, Artificial Sequence
  chemically synthesized
ttgaataaataaaaatttat

SEQ ID NO: 185360 - DNA, 20 bp, Artificial Sequence
  chemically synthesized
cctctatatttatgtcaaaa

SEQ ID NO: 185361 - DNA, 20 bp, Artificial Sequence
  chemically synthesized
agtccattttgacataaata

SEQ ID NO: 185362 - DNA, 20 bp, Artificial Sequence
  chemically synthesized
tccattttgacataaatata

SEQ ID NO: 185363 - DNA, 20 bp, Artificial Sequence
  chemically synthesized
ccattttgacataaatatag

SEQ ID NO: 185364 - DNA, 20 bp, Artificial Sequence
  chemically synthesized
ttgaaaaaaaaaaaaaaaaa

SEQ ID NO: 185365 - DNA, 20 bp, Artificial Sequence
  chemically synthesized
tttgaaaaaaaaaaaaaaaa

SEQ ID NO: 185366 - DNA, 20 bp, Artificial Sequence
  chemically synthesized
ttttttttttttttttcaaa

SEQ ID NO: 185367 - DNA, 20 bp, Artificial Sequence
  chemically synthesized
tttttttttttttcaaacag

SEQ ID NO: 185368 - DNA, 20 bp, Artificial Sequence
  chemically synthesized
tttttttttcaaacagaaga

SEQ ID NO: 185369 - DNA, 20 bp, Artificial Sequence
  chemically synthesized
tttttcaaacagaagaaagc

SEQ ID NO: 185370 - DNA, 20 bp, Artificial Sequence
  chemically synthesized
tcaaacagaagaaagccagc

SEQ ID NO: 185371 - DNA, 20 bp, Artificial Sequence
  chemically synthesized
tgatcttaacatttaccagc

SEQ ID NO: 185372 - DNA, 20 bp, Artificial Sequence
  chemically synthesized
gacatgatcttaacatttac

SEQ ID NO: 185373 - DNA, 20 bp, Artificial Sequence
  chemically synthesized
aaagccagctggtaaatgtt

SEQ ID NO: 185374 - DNA, 20 bp, Artificial Sequence
  chemically synthesized
ggtaaatgttaagatcatgt

SEQ ID NO: 185375 - DNA, 20 bp, Artificial Sequence
  chemically synthesized
atgttaagatcatgtcagat

SEQ ID NO: 185376 - DNA, 20 bp, Artificial Sequence
  chemically synthesized
tgttaagatcatgtcagatt

SEQ ID NO: 185377 - DNA, 20 bp, Artificial Sequence
  chemically synthesized
cactggggcttgcaaaatgg

SEQ ID NO: 185378 - DNA, 20 bp, Artificial Sequence
  chemically synthesized
acactggggcttgcaaaatg

SEQ ID NO: 185379 - DNA, 20 bp, Artificial Sequence
  chemically synthesized
taggaaaacctccattttgc

SEQ ID NO: 185380 - DNA, 20 bp, Artificial Sequence
  chemically synthesized
ttacactggggcttgcaaaa

SEQ ID NO: 185381 - DNA, 20 bp, Artificial Sequence
  chemically synthesized
aacctccattttgcaagccc

SEQ ID NO: 185382 - DNA, 20 bp, Artificial Sequence
  chemically synthesized
ctaactcagttattacactg

SEQ ID NO: 185383 - DNA, 20 bp, Artificial Sequence
  chemically synthesized
cctaactcagttattacact

SEQ ID NO: 185384 - DNA, 20 bp, Artificial Sequence
  chemically synthesized
ccctaactcagttattacac

SEQ ID NO: 185385 - DNA, 20 bp, Artificial Sequence
  chemically synthesized
caagccccagtgtaataact

SEQ ID NO: 185386 - DNA, 20 bp, Artificial Sequence
  chemically synthesized
ccccagtgtaataactgagt

SEQ ID NO: 185387 - DNA, 20 bp, Artificial Sequence
  chemically synthesized
cccagtgtaataactgagtt

SEQ ID NO: 185388 - DNA, 20 bp, Artificial Sequence
  chemically synthesized
ccagtgtaataactgagtta

SEQ ID NO: 185389 - DNA, 20 bp, Artificial Sequence
  chemically synthesized
ttgatgatccttccctaact

SEQ ID NO: 185390 - DNA, 20 bp, Artificial Sequence
  chemically synthesized
gtgtaataactgagttaggg

SEQ ID NO: 185391 - DNA, 20 bp, Artificial Sequence
  chemically synthesized
tgtaataactgagttaggga

SEQ ID NO: 185392 - DNA, 20 bp, Artificial Sequence
  chemically synthesized
agttagggaaggatcatcaa

SEQ ID NO: 185393 - DNA, 20 bp, Artificial Sequence
  chemically synthesized
aggatcatcaatggatacta

SEQ ID NO: 185394 - DNA, 20 bp, Artificial Sequence
  chemically synthesized
tcaatggatactaaagccat

SEQ ID NO: 185395 - DNA, 20 bp, Artificial Sequence
  chemically synthesized
aataaatcatctaatggctt

SEQ ID NO: 185396 - DNA, 20 bp, Artificial Sequence
  chemically synthesized
gcaattaataaatcatctaa

SEQ ID NO: 185397 - DNA, 20 bp, Artificial Sequence
  chemically synthesized
tagatgatttattaattgcg

SEQ ID NO: 185398 - DNA, 20 bp, Artificial Sequence
  chemically synthesized
aaaatgtgacattataatgc

SEQ ID NO: 185399 - DNA, 20 bp, Artificial Sequence
  chemically synthesized
cattataatgcaagatctgt

SEQ ID NO: 185400 - DNA, 20 bp, Artificial Sequence
  chemically synthesized
ttgcttcaggtggtgactga

SEQ ID NO: 185401 - DNA, 20 bp, Artificial Sequence
  chemically synthesized
gatctgtcagtcaccacctg

SEQ ID NO: 185402 - DNA, 20 bp, Artificial Sequence
  chemically synthesized
gttttattacttgcttcagg

SEQ ID NO: 185403 - DNA, 20 bp, Artificial Sequence
  chemically synthesized
tgtcagtcaccacctgaagc

SEQ ID NO: 185404 - DNA, 20 bp, Artificial Sequence
  chemically synthesized
aaagttttattacttgcttc

SEQ ID NO: 185405 - DNA, 20 bp, Artificial Sequence
  chemically synthesized
caaagttttattacttgctt

SEQ ID NO: 185406 - DNA, 20 bp, Artificial Sequence
  chemically synthesized
aagcaagtaataaaactttg

SEQ ID NO: 185407 - DNA, 20 bp, Artificial Sequence
  chemically synthesized
tagtctcactaaatgctgca

SEQ ID NO: 185408 - DNA, 20 bp, Artificial Sequence
  chemically synthesized
taataaaactttgcagcatt

SEQ ID NO: 185409 - DNA, 20 bp, Artificial Sequence
  chemically synthesized
aaaactttgcagcatttagt

SEQ ID NO: 185410 - DNA, 20 bp, Artificial Sequence
  chemically synthesized
aggaggtgcatcatatgaag

SEQ ID NO: 185411 - DNA, 20 bp, Artificial Sequence
  chemically synthesized
atcaggaggtgcatcatatg

SEQ ID NO: 185412 - DNA, 20 bp, Artificial Sequence
  chemically synthesized
ttgtattacgtcacatcagg

SEQ ID NO: 185413 - DNA, 20 bp, Artificial Sequence
  chemically synthesized
tttgtattacgtcacatcag

SEQ ID NO: 185414 - DNA, 20 bp, Artificial Sequence
  chemically synthesized
attttgtattacgtcacatc

SEQ ID NO: 185415 - DNA, 20 bp, Artificial Sequence
  chemically synthesized
tattttgtattacgtcacat

SEQ ID NO: 185416 - DNA, 20 bp, Artificial Sequence
  chemically synthesized
gtgacgtaatacaaaataca

SEQ ID NO: 185417 - DNA, 20 bp, Artificial Sequence
  chemically synthesized
aatacacagcatctcatatg

SEQ ID NO: 185418 - DNA, 20 bp, Artificial Sequence
  chemically synthesized
ttggcgagaatacttcatat

SEQ ID NO: 185419 - DNA, 20 bp, Artificial Sequence
  chemically synthesized
gcatgtcaaacatgtttggc

SEQ ID NO: 185420 - DNA, 20 bp, Artificial Sequence
  chemically synthesized
agatgcatgtcaaacatgtt

SEQ ID NO: 185421 - DNA, 20 bp, Artificial Sequence
  chemically synthesized
tgtttgacatgcatctcttg

SEQ ID NO: 185422 - DNA, 20 bp, Artificial Sequence
  chemically synthesized
aggtctaaataagacttcaa

SEQ ID NO: 185423 - DNA, 20 bp, Artificial Sequence
  chemically synthesized
ttaggtctaaataagacttc

SEQ ID NO: 185424 - DNA, 20 bp, Artificial Sequence
  chemically synthesized
gcatctcttgaagtcttatt

SEQ ID NO: 185425 - DNA, 20 bp, Artificial Sequence
  chemically synthesized
actggaagttaggtctaaat

SEQ ID NO: 185426 - DNA, 20 bp, Artificial Sequence
  chemically synthesized
tcttatttagacctaacttc

SEQ ID NO: 185427 - DNA, 20 bp, Artificial Sequence
  chemically synthesized
tttctagtaaactggaagtt

SEQ ID NO: 185428 - DNA, 20 bp, Artificial Sequence
  chemically synthesized
atttctagtaaactggaagt

SEQ ID NO: 185429 - DNA, 20 bp, Artificial Sequence
  chemically synthesized
ctgaatttctagtaaactgg

SEQ ID NO: 185430 - DNA, 20 bp, Artificial Sequence
  chemically synthesized
agacctaacttccagtttac

SEQ ID NO: 185431 - DNA, 20 bp, Artificial Sequence
  chemically synthesized
tctctgaatttctagtaaac

SEQ ID NO: 185432 - DNA, 20 bp, Artificial Sequence
  chemically synthesized
cttccagtttactagaaatt

SEQ ID NO: 185433 - DNA, 20 bp, Artificial Sequence
  chemically synthesized
ttctgtagtctctgaatttc

SEQ ID NO: 185434 - DNA, 20 bp, Artificial Sequence
  chemically synthesized
tccagtttactagaaattca

SEQ ID NO: 185435 - DNA, 20 bp, Artificial Sequence
  chemically synthesized
tactagaaattcagagacta

SEQ ID NO: 185436 - DNA, 20 bp, Artificial Sequence
  chemically synthesized
aaattcagagactacagaac

SEQ ID NO: 185437 - DNA, 20 bp, Artificial Sequence
  chemically synthesized
ggatgatttaacttgttctg

SEQ ID NO: 185438 - DNA, 20 bp, Artificial Sequence
  chemically synthesized
aacaagttaaatcatcccat

SEQ ID NO: 185439 - DNA, 20 bp, Artificial Sequence
  chemically synthesized
acaagttaaatcatcccatc

SEQ ID NO: 185440 - DNA, 20 bp, Artificial Sequence
  chemically synthesized
caagttaaatcatcccatca

SEQ ID NO: 185441 - DNA, 20 bp, Artificial Sequence
  chemically synthesized
aagttaaatcatcccatcag

SEQ ID NO: 185442 - DNA, 20 bp, Artificial Sequence
  chemically synthesized
tttattttttttcccctgat

SEQ ID NO: 185443 - DNA, 20 bp, Artificial Sequence
  chemically synthesized
ttttattttttttcccctga

SEQ ID NO: 185444 - DNA, 20 bp, Artificial Sequence
  chemically synthesized
aaaaataaaacaaatcctga

SEQ ID NO: 185445 - DNA, 20 bp, Artificial Sequence
  chemically synthesized
taaaacaaatcctgaaagat

SEQ ID NO: 185446 - DNA, 20 bp, Artificial Sequence
  chemically synthesized
caaaaaatgtctcatctttc

SEQ ID NO: 185447 - DNA, 20 bp, Artificial Sequence
  chemically synthesized
tcaaaaaatgtctcatcttt

SEQ ID NO: 185448 - DNA, 20 bp, Artificial Sequence
  chemically synthesized
tgaaagatgagacatttttt

SEQ ID NO: 185449 - DNA, 20 bp, Artificial Sequence
  chemically synthesized
gaaagatgagacattttttg

SEQ ID NO: 185450 - DNA, 20 bp, Artificial Sequence
  chemically synthesized
gatgagacattttttgaggc

SEQ ID NO: 185451 - DNA, 20 bp, Artificial Sequence
  chemically synthesized
attttttgaggctagcgtcc

SEQ ID NO: 185452 - DNA, 20 bp, Artificial Sequence
  chemically synthesized
tttgaaaatgtccaggacgc

SEQ ID NO: 185453 - DNA, 20 bp, Artificial Sequence
  chemically synthesized
attgaaatttgaaaatgtcc

SEQ ID NO: 185454 - DNA, 20 bp, Artificial Sequence
  chemically synthesized
tattgaaatttgaaaatgtc

SEQ ID NO: 185455 - DNA, 20 bp, Artificial Sequence
  chemically synthesized
acattttcaaatttcaatat

SEQ ID NO: 185456 - DNA, 20 bp, Artificial Sequence
  chemically synthesized
caatatcggtgaaaaaaatg

SEQ ID NO: 185457 - DNA, 20 bp, Artificial Sequence
  chemically synthesized
tatcggtgaaaaaaatgtgg

SEQ ID NO: 185458 - DNA, 20 bp, Artificial Sequence
  chemically synthesized
atcggtgaaaaaaatgtgga

SEQ ID NO: 185459 - DNA, 20 bp, Artificial Sequence
  chemically synthesized
tcggtgaaaaaaatgtggaa

SEQ ID NO: 185460 - DNA, 20 bp, Artificial Sequence
  chemically synthesized
aaaatgtggaagggctattt

SEQ ID NO: 185461 - DNA, 20 bp, Artificial Sequence
  chemically synthesized
tcatccttcttagtctaaaa

SEQ ID NO: 185462 - DNA, 20 bp, Artificial Sequence
  chemically synthesized
tggaagggctattttagact

SEQ ID NO: 185463 - DNA, 20 bp, Artificial Sequence
  chemically synthesized
aagggctattttagactaag

SEQ ID NO: 185464 - DNA, 20 bp, Artificial Sequence
  chemically synthesized
agggctattttagactaaga

SEQ ID NO: 185465 - DNA, 20 bp, Artificial Sequence
  chemically synthesized
ttattatttttcatccttct

SEQ ID NO: 185466 - DNA, 20 bp, Artificial Sequence
  chemically synthesized
catggctcatgcattacatt

SEQ ID NO: 185467 - DNA, 20 bp, Artificial Sequence
  chemically synthesized
aataaccaaatgtaatgcat

SEQ ID NO: 185468 - DNA, 20 bp, Artificial Sequence
  chemically synthesized
tgtaatgcatgagccatgat

SEQ ID NO: 185469 - DNA, 20 bp, Artificial Sequence
  chemically synthesized
ttagtaccaatatcttatca

SEQ ID NO: 185470 - DNA, 20 bp, Artificial Sequence
  chemically synthesized
catgagccatgataagatat

SEQ ID NO: 185471 - DNA, 20 bp, Artificial Sequence
  chemically synthesized
tttatattttgcaggggagt

SEQ ID NO: 185472 - DNA, 20 bp, Artificial Sequence
  chemically synthesized
gtcttttatattttgcaggg

SEQ ID NO: 185473 - DNA, 20 bp, Artificial Sequence
  chemically synthesized
atgtcttttatattttgcag

SEQ ID NO: 185474 - DNA, 20 bp, Artificial Sequence
  chemically synthesized
aatgtcttttatattttgca

SEQ ID NO: 185475 - DNA, 20 bp, Artificial Sequence
  chemically synthesized
aaatgtcttttatattttgc

SEQ ID NO: 185476 - DNA, 20 bp, Artificial Sequence
  chemically synthesized
aaaatgtcttttatattttg

SEQ ID NO: 185477 - DNA, 20 bp, Artificial Sequence
  chemically synthesized
aactcccctgcaaaatataa

SEQ ID NO: 185478 - DNA, 20 bp, Artificial Sequence
  chemically synthesized
aaagacatttttgaactatt

SEQ ID NO: 185479 - DNA, 20 bp, Artificial Sequence
  chemically synthesized
aagacatttttgaactatta

SEQ ID NO: 185480 - DNA, 20 bp, Artificial Sequence
  chemically synthesized
ccatattcatatttccttaa

SEQ ID NO: 185481 - DNA, 20 bp, Artificial Sequence
  chemically synthesized
ctattaaggaaatatgaata

SEQ ID NO: 185482 - DNA, 20 bp, Artificial Sequence
  chemically synthesized
aaggaaatatgaatatggaa

SEQ ID NO: 185483 - DNA, 20 bp, Artificial Sequence
  chemically synthesized
aatggatattaacaataatg

SEQ ID NO: 185484 - DNA, 20 bp, Artificial Sequence
  chemically synthesized
atgcagtattatatttaatt

SEQ ID NO: 185485 - DNA, 20 bp, Artificial Sequence
  chemically synthesized
gcagtattatatttaatttg

SEQ ID NO: 185486 - DNA, 20 bp, Artificial Sequence
  chemically synthesized
cagtattatatttaatttgg

SEQ ID NO: 185487 - DNA, 20 bp, Artificial Sequence
  chemically synthesized
gtattatatttaatttggag

SEQ ID NO: 185488 - DNA, 20 bp, Artificial Sequence
  chemically synthesized
attatatttaatttggagga

SEQ ID NO: 185489 - DNA, 20 bp, Artificial Sequence
  chemically synthesized
ttggaggagagcataataaa

SEQ ID NO: 185490 - DNA, 20 bp, Artificial Sequence
  chemically synthesized
tggaggagagcataataaac

SEQ ID NO: 185491 - DNA, 20 bp, Artificial Sequence
  chemically synthesized
gagagcataataaacaggca

SEQ ID NO: 185492 - DNA, 20 bp, Artificial Sequence
  chemically synthesized
taaacaggcatggttatata

SEQ ID NO: 185493 - DNA, 20 bp, Artificial Sequence
  chemically synthesized
tatggcatgtctgtatttca

SEQ ID NO: 185494 - DNA, 20 bp, Artificial Sequence
  chemically synthesized
gcatgtgtcgctttgaaata

SEQ ID NO: 185495 - DNA, 20 bp, Artificial Sequence
  chemically synthesized
gcgacacatgctgaattatt

SEQ ID NO: 185496 - DNA, 20 bp, Artificial Sequence
  chemically synthesized
tattttacccctaaataatt

SEQ ID NO: 185497 - DNA, 20 bp, Artificial Sequence
  chemically synthesized
cgacacatgctgaattattt

SEQ ID NO: 185498 - DNA, 20 bp, Artificial Sequence
  chemically synthesized
gacacatgctgaattattta

SEQ ID NO: 185499 - DNA, 20 bp, Artificial Sequence
  chemically synthesized
acacatgctgaattatttag

SEQ ID NO: 185500 - DNA, 20 bp, Artificial Sequence
  chemically synthesized
tatttaggggtaaaatataa

SEQ ID NO: 185501 - DNA, 20 bp, Artificial Sequence
  chemically synthesized
tttttaacatttttgcaaat

SEQ ID NO: 185502 - DNA, 20 bp, Artificial Sequence
  chemically synthesized
ttatttgcaaaaatgttaaa

SEQ ID NO: 185503 - DNA, 20 bp, Artificial Sequence
  chemically synthesized
gtgtgtgatgccctatatat

SEQ ID NO: 185504 - DNA, 20 bp, Artificial Sequence
  chemically synthesized
ttctgtatctctcatatata

SEQ ID NO: 185505 - DNA, 20 bp, Artificial Sequence
  chemically synthesized
tttctgtatctctcatatat

SEQ ID NO: 185506 - DNA, 20 bp, Artificial Sequence
  chemically synthesized
gtgtgatgccctatatatga

SEQ ID NO: 185507 - DNA, 20 bp, Artificial Sequence
  chemically synthesized
ctttctgtatctctcatata

SEQ ID NO: 185508 - DNA, 20 bp, Artificial Sequence
  chemically synthesized
tgccctatatatgagagata

SEQ ID NO: 185509 - DNA, 20 bp, Artificial Sequence
  chemically synthesized
ctatatatgagagatacaga

SEQ ID NO: 185510 - DNA, 20 bp, Artificial Sequence
  chemically synthesized
atatatgagagatacagaaa

SEQ ID NO: 185511 - DNA, 20 bp, Artificial Sequence
  chemically synthesized
tatatgagagatacagaaag

SEQ ID NO: 185512 - DNA, 20 bp, Artificial Sequence
  chemically synthesized
atatgagagatacagaaaga

SEQ ID NO: 185513 - DNA, 20 bp, Artificial Sequence
  chemically synthesized
tgagagatacagaaagaggg

SEQ ID NO: 185514 - DNA, 20 bp, Artificial Sequence
  chemically synthesized
agagatacagaaagagggta

SEQ ID NO: 185515 - DNA, 20 bp, Artificial Sequence
  chemically synthesized
atacagaaagagggtagaga

SEQ ID NO: 185516 - DNA, 20 bp, Artificial Sequence
  chemically synthesized
agaaagagggtagagaaagc

SEQ ID NO: 185517 - DNA, 20 bp, Artificial Sequence
  chemically synthesized
aaagagggtagagaaagcga

SEQ ID NO: 185518 - DNA, 20 bp, Artificial Sequence
  chemically synthesized
tagagaaagcgagagaaaaa

SEQ ID NO: 185519 - DNA, 20 bp, Artificial Sequence
  chemically synthesized
cgagagaaaaaaagcatata

SEQ ID NO: 185520 - DNA, 20 bp, Artificial Sequence
  chemically synthesized
tgttaacaattgttgactct

SEQ ID NO: 185521 - DNA, 20 bp, Artificial Sequence
  chemically synthesized
ttcctccccctaaattctta

SEQ ID NO: 185522 - DNA, 20 bp, Artificial Sequence
  chemically synthesized
aattgttgactctaagaatt

SEQ ID NO: 185523 - DNA, 20 bp, Artificial Sequence
  chemically synthesized
attgttgactctaagaattt

SEQ ID NO: 185524 - DNA, 20 bp, Artificial Sequence
  chemically synthesized
ttttcctccccctaaattct

SEQ ID NO: 185525 - DNA, 20 bp, Artificial Sequence
  chemically synthesized
ttgttgactctaagaattta

SEQ ID NO: 185526 - DNA, 20 bp, Artificial Sequence
  chemically synthesized
tgttgactctaagaatttag

SEQ ID NO: 185527 - DNA, 20 bp, Artificial Sequence
  chemically synthesized
gttgactctaagaatttagg

SEQ ID NO: 185528 - DNA, 20 bp, Artificial Sequence
  chemically synthesized
tgactctaagaatttagggg

SEQ ID NO: 185529 - DNA, 20 bp, Artificial Sequence
  chemically synthesized
gactctaagaatttaggggg

SEQ ID NO: 185530 - DNA, 20 bp, Artificial Sequence
  chemically synthesized
agaatttagggggaggaaaa

SEQ ID NO: 185531 - DNA, 20 bp, Artificial Sequence
  chemically synthesized
ggggaggaaaacagtgtaaa

SEQ ID NO: 185532 - DNA, 20 bp, Artificial Sequence
  chemically synthesized
gggaggaaaacagtgtaaat

SEQ ID NO: 185533 - DNA, 20 bp, Artificial Sequence
  chemically synthesized
tgtgaaaaatttcaaacata

SEQ ID NO: 185534 - DNA, 20 bp, Artificial Sequence
  chemically synthesized
tgtttgaaatttttcacaaa

SEQ ID NO: 185535 - DNA, 20 bp, Artificial Sequence
  chemically synthesized
aaatttttcacaaaaagact

SEQ ID NO: 185536 - DNA, 20 bp, Artificial Sequence
  chemically synthesized
aatttttcacaaaaagactt

SEQ ID NO: 185537 - DNA, 20 bp, Artificial Sequence
  chemically synthesized
atttttcacaaaaagacttg

SEQ ID NO: 185538 - DNA, 20 bp, Artificial Sequence
  chemically synthesized
tttcacaaaaagacttgggg

SEQ ID NO: 185539 - DNA, 20 bp, Artificial Sequence
  chemically synthesized
ttcacaaaaagacttgggga

SEQ ID NO: 185540 - DNA, 20 bp, Artificial Sequence
  chemically synthesized
tttgaattttttccttcccc

SEQ ID NO: 185541 - DNA, 20 bp, Artificial Sequence
  chemically synthesized
aattcaaaattattttcatt

SEQ ID NO: 185542 - DNA, 20 bp, Artificial Sequence
  chemically synthesized
attcaaaattattttcatta

SEQ ID NO: 185543 - DNA, 20 bp, Artificial Sequence
  chemically synthesized
aggaatagtggttttaattt

SEQ ID NO: 185544 - DNA, 20 bp, Artificial Sequence
  chemically synthesized
taatatgcattaaggaatag

SEQ ID NO: 185545 - DNA, 20 bp, Artificial Sequence
  chemically synthesized
tactaatatgcattaaggaa

SEQ ID NO: 185546 - DNA, 20 bp, Artificial Sequence
  chemically synthesized
tattctactaatatgcatta

SEQ ID NO: 185547 - DNA, 20 bp, Artificial Sequence
  chemically synthesized
ttattctactaatatgcatt

SEQ ID NO: 185548 - DNA, 20 bp, Artificial Sequence
  chemically synthesized
cactattccttaatgcatat

SEQ ID NO: 185549 - DNA, 20 bp, Artificial Sequence
  chemically synthesized
tattccttaatgcatattag

SEQ ID NO: 185550 - DNA, 20 bp, Artificial Sequence
  chemically synthesized
cttatcccatatcacagata

SEQ ID NO: 185551 - DNA, 20 bp, Artificial Sequence
  chemically synthesized
gcttatcccatatcacagat

SEQ ID NO: 185552 - DNA, 20 bp, Artificial Sequence
  chemically synthesized
taattgccttatctgtgata

SEQ ID NO: 185553 - DNA, 20 bp, Artificial Sequence
  chemically synthesized
aattgccttatctgtgatat

SEQ ID NO: 185554 - DNA, 20 bp, Artificial Sequence
  chemically synthesized
atattgcttatcccatatca

SEQ ID NO: 185555 - DNA, 20 bp, Artificial Sequence
  chemically synthesized
ccttatctgtgatatgggat

SEQ ID NO: 185556 - DNA, 20 bp, Artificial Sequence
  chemically synthesized
tgatatgggataagcaatat

SEQ ID NO: 185557 - DNA, 20 bp, Artificial Sequence
  chemically synthesized
gcaatatcagacttgtctaa

SEQ ID NO: 185558 - DNA, 20 bp, Artificial Sequence
  chemically synthesized
aattctttcttcttttagac

SEQ ID NO: 185559 - DNA, 20 bp, Artificial Sequence
  chemically synthesized
atatcagacttgtctaaaag

SEQ ID NO: 185560 - DNA, 20 bp, Artificial Sequence
  chemically synthesized
attataattctttcttcttt

SEQ ID NO: 185561 - DNA, 20 bp, Artificial Sequence
  chemically synthesized
cagacttgtctaaaagaaga

SEQ ID NO: 185562 - DNA, 20 bp, Artificial Sequence
  chemically synthesized
aatccttagcaataataatt

SEQ ID NO: 185563 - DNA, 20 bp, Artificial Sequence
  chemically synthesized
aaatcttaattattattgct

SEQ ID NO: 185564 - DNA, 20 bp, Artificial Sequence
  chemically synthesized
aatcttaattattattgcta

SEQ ID NO: 185565 - DNA, 20 bp, Artificial Sequence
  chemically synthesized
aacctctgaatcataatcct

SEQ ID NO: 185566 - DNA, 20 bp, Artificial Sequence
  chemically synthesized
tattgctaaggattatgatt

SEQ ID NO: 185567 - DNA, 20 bp, Artificial Sequence
  chemically synthesized
ttgctaaggattatgattca

SEQ ID NO: 185568 - DNA, 20 bp, Artificial Sequence
  chemically synthesized
tgctaaggattatgattcag

SEQ ID NO: 185569 - DNA, 20 bp, Artificial Sequence
  chemically synthesized
gattcagaggttcctcaatt

SEQ ID NO: 185570 - DNA, 20 bp, Artificial Sequence
  chemically synthesized
attcagaggttcctcaattt

SEQ ID NO: 185571 - DNA, 20 bp, Artificial Sequence
  chemically synthesized
gaagtggaattcctaaattg

SEQ ID NO: 185572 - DNA, 20 bp, Artificial Sequence
  chemically synthesized
ggaagtggaattcctaaatt

SEQ ID NO: 185573 - DNA, 20 bp, Artificial Sequence
  chemically synthesized
ggaagcaaggcagtgggaag

SEQ ID NO: 185574 - DNA, 20 bp, Artificial Sequence
  chemically synthesized
gacggaagcaaggcagtggg

SEQ ID NO: 185575 - DNA, 20 bp, Artificial Sequence
  chemically synthesized
ggagacggaagcaaggcagt

SEQ ID NO: 185576 - DNA, 20 bp, Artificial Sequence
  chemically synthesized
gggagacggaagcaaggcag

SEQ ID NO: 185577 - DNA, 20 bp, Artificial Sequence
  chemically synthesized
aatgggagacggaagcaagg

SEQ ID NO: 185578 - DNA, 20 bp, Artificial Sequence
  chemically synthesized
ttgaatgggagacggaagca

SEQ ID NO: 185579 - DNA, 20 bp, Artificial Sequence
  chemically synthesized
tttgaatgggagacggaagc

SEQ ID NO: 185580 - DNA, 20 bp, Artificial Sequence
  chemically synthesized
aaagtttgaatgggagacgg

SEQ ID NO: 185581 - DNA, 20 bp, Artificial Sequence
  chemically synthesized
ataaaagtttgaatgggaga

SEQ ID NO: 185582 - DNA, 20 bp, Artificial Sequence
  chemically synthesized
gttgataaaagtttgaatgg

SEQ ID NO: 185583 - DNA, 20 bp, Artificial Sequence
  chemically synthesized
cagttgataaaagtttgaat

SEQ ID NO: 185584 - DNA, 20 bp, Artificial Sequence
  chemically synthesized
tcagttgataaaagtttgaa

SEQ ID NO: 185585 - DNA, 20 bp, Artificial Sequence
  chemically synthesized
agaataatgtcagttgataa

SEQ ID NO: 185586 - DNA, 20 bp, Artificial Sequence
  chemically synthesized
gattttacttagaataatgt

SEQ ID NO: 185587 - DNA, 20 bp, Artificial Sequence
  chemically synthesized
ttatcaactgacattattct

SEQ ID NO: 185588 - DNA, 20 bp, Artificial Sequence
  chemically synthesized
ataatgaagaggattttact

SEQ ID NO: 185589 - DNA, 20 bp, Artificial Sequence
  chemically synthesized
ttgctgacaacataatgaag

SEQ ID NO: 185590 - DNA, 20 bp, Artificial Sequence
  chemically synthesized
attgctgacaacataatgaa

SEQ ID NO: 185591 - DNA, 20 bp, Artificial Sequence
  chemically synthesized
ggattgctgacaacataatg

SEQ ID NO: 185592 - DNA, 20 bp, Artificial Sequence
  chemically synthesized
aatcctcttcattatgttgt

SEQ ID NO: 185593 - DNA, 20 bp, Artificial Sequence
  chemically synthesized
tgtcagcaatccattgcttg

SEQ ID NO: 185594 - DNA, 20 bp, Artificial Sequence
  chemically synthesized
ggagccaggccttcaagcaa

SEQ ID NO: 185595 - DNA, 20 bp, Artificial Sequence
  chemically synthesized
gtcagcaatccattgcttga

SEQ ID NO: 185596 - DNA, 20 bp, Artificial Sequence
  chemically synthesized
caatccattgcttgaaggcc

SEQ ID NO: 185597 - DNA, 20 bp, Artificial Sequence
  chemically synthesized
ttctggggagccaggccttc

SEQ ID NO: 185598 - DNA, 20 bp, Artificial Sequence
  chemically synthesized
tgcttgaaggcctggctccc

SEQ ID NO: 185599 - DNA, 20 bp, Artificial Sequence
  chemically synthesized
tcgaggggttctggggagcc

SEQ ID NO: 185600 - DNA, 20 bp, Artificial Sequence
  chemically synthesized
gtcgaggggttctggggagc

SEQ ID NO: 185601 - DNA, 20 bp, Artificial Sequence
  chemically synthesized
accagtcgaggggttctggg

SEQ ID NO: 185602 - DNA, 20 bp, Artificial Sequence
  chemically synthesized
ataccagtcgaggggttctg

SEQ ID NO: 185603 - DNA, 20 bp, Artificial Sequence
  chemically synthesized
cataccagtcgaggggttct

SEQ ID NO: 185604 - DNA, 20 bp, Artificial Sequence
  chemically synthesized
acataccagtcgaggggttc

SEQ ID NO: 185605 - DNA, 20 bp, Artificial Sequence
  chemically synthesized
gctccccagaacccctcgac

SEQ ID NO: 185606 - DNA, 20 bp, Artificial Sequence
  chemically synthesized
gagaagacataccagtcgag

SEQ ID NO: 185607 - DNA, 20 bp, Artificial Sequence
  chemically synthesized
ggagaagacataccagtcga

SEQ ID NO: 185608 - DNA, 20 bp, Artificial Sequence
  chemically synthesized
aggagaagacataccagtcg

SEQ ID NO: 185609 - DNA, 20 bp, Artificial Sequence
  chemically synthesized
taggagaagacataccagtc

SEQ ID NO: 185610 - DNA, 20 bp, Artificial Sequence
  chemically synthesized
tattctaggagaagacatac

SEQ ID NO: 185611 - DNA, 20 bp, Artificial Sequence
  chemically synthesized
tcgactggtatgtcttctcc

SEQ ID NO: 185612 - DNA, 20 bp, Artificial Sequence
  chemically synthesized
cttctggagtattctaggag

SEQ ID NO: 185613 - DNA, 20 bp, Artificial Sequence
  chemically synthesized
tttcttctggagtattctag

SEQ ID NO: 185614 - DNA, 20 bp, Artificial Sequence
  chemically synthesized
cttttcttctggagtattct

SEQ ID NO: 185615 - DNA, 20 bp, Artificial Sequence
  chemically synthesized
ccttttcttctggagtattc

SEQ ID NO: 185616 - DNA, 20 bp, Artificial Sequence
  chemically synthesized
tgtcttctcctagaatactc

SEQ ID NO: 185617 - DNA, 20 bp, Artificial Sequence
  chemically synthesized
cttctcctagaatactccag

SEQ ID NO: 185618 - DNA, 20 bp, Artificial Sequence
  chemically synthesized
catacactccttttcttctg

SEQ ID NO: 185619 - DNA, 20 bp, Artificial Sequence
  chemically synthesized
cctagaatactccagaagaa

SEQ ID NO: 185620 - DNA, 20 bp, Artificial Sequence
  chemically synthesized
ctagaatactccagaagaaa

SEQ ID NO: 185621 - DNA, 20 bp, Artificial Sequence
  chemically synthesized
ttcatacactccttttcttc

SEQ ID NO: 185622 - DNA, 20 bp, Artificial Sequence
  chemically synthesized
agaatactccagaagaaaag

SEQ ID NO: 185623 - DNA, 20 bp, Artificial Sequence
  chemically synthesized
cagaagaaaaggagtgtatg

SEQ ID NO: 185624 - DNA, 20 bp, Artificial Sequence
  chemically synthesized
agaaaaggagtgtatgaaga

SEQ ID NO: 185625 - DNA, 20 bp, Artificial Sequence
  chemically synthesized
gtttcagtcattttaatgtg

SEQ ID NO: 185626 - DNA, 20 bp, Artificial Sequence
  chemically synthesized
cattaaaatgactgaaacca

SEQ ID NO: 185627 - DNA, 20 bp, Artificial Sequence
  chemically synthesized
atcctaatttactatggttt

SEQ ID NO: 185628 - DNA, 20 bp, Artificial Sequence
  chemically synthesized
aatctcatcctaatttacta

SEQ ID NO: 185629 - DNA, 20 bp, Artificial Sequence
  chemically synthesized
tgactgaaaccatagtaaat

SEQ ID NO: 185630 - DNA, 20 bp, Artificial Sequence
  chemically synthesized
gactgaaaccatagtaaatt

SEQ ID NO: 185631 - DNA, 20 bp, Artificial Sequence
  chemically synthesized
aaaccatagtaaattaggat

SEQ ID NO: 185632 - DNA, 20 bp, Artificial Sequence
  chemically synthesized
agtaaattaggatgagattc

SEQ ID NO: 185633 - DNA, 20 bp, Artificial Sequence
  chemically synthesized
gtaaattaggatgagattct

SEQ ID NO: 185634 - DNA, 20 bp, Artificial Sequence
  chemically synthesized
aattaggatgagattctggg

SEQ ID NO: 185635 - DNA, 20 bp, Artificial Sequence
  chemically synthesized
cagctgtctgtttatctgcc

SEQ ID NO: 185636 - DNA, 20 bp, Artificial Sequence
  chemically synthesized
tgagattctgggcagataaa

SEQ ID NO: 185637 - DNA, 20 bp, Artificial Sequence
  chemically synthesized
attctgggcagataaacaga

SEQ ID NO: 185638 - DNA, 20 bp, Artificial Sequence
  chemically synthesized
tgggcagataaacagacagc

SEQ ID NO: 185639 - DNA, 20 bp, Artificial Sequence
  chemically synthesized
cagataaacagacagctggc

SEQ ID NO: 185640 - DNA, 20 bp, Artificial Sequence
  chemically synthesized
agataaacagacagctggct

SEQ ID NO: 185641 - DNA, 20 bp, Artificial Sequence
  chemically synthesized
cataaaaaaatgatcctagc

SEQ ID NO: 185642 - DNA, 20 bp, Artificial Sequence
  chemically synthesized
aaggcataaaaaaatgatcc

SEQ ID NO: 185643 - DNA, 20 bp, Artificial Sequence
  chemically synthesized
aggatcatttttttatgcct

SEQ ID NO: 185644 - DNA, 20 bp, Artificial Sequence
  chemically synthesized
cagattgccaaagaagtcca

SEQ ID NO: 185645 - DNA, 20 bp, Artificial Sequence
  chemically synthesized
acagattgccaaagaagtcc

SEQ ID NO: 185646 - DNA, 20 bp, Artificial Sequence
  chemically synthesized
ttttatgccttggacttctt

SEQ ID NO: 185647 - DNA, 20 bp, Artificial Sequence
  chemically synthesized
gcttcaacagattgccaaag

SEQ ID NO: 185648 - DNA, 20 bp, Artificial Sequence
  chemically synthesized
caggcttcaacagattgcca

SEQ ID NO: 185649 - DNA, 20 bp, Artificial Sequence
  chemically synthesized
acttctttggcaatctgttg

SEQ ID NO: 185650 - DNA, 20 bp, Artificial Sequence
  chemically synthesized
tgaggaatgtcaggcttcaa

SEQ ID NO: 185651 - DNA, 20 bp, Artificial Sequence
  chemically synthesized
acattattctgaggaatgtc

SEQ ID NO: 185652 - DNA, 20 bp, Artificial Sequence
  chemically synthesized
aacattattctgaggaatgt

SEQ ID NO: 185653 - DNA, 20 bp, Artificial Sequence
  chemically synthesized
tgttgaagcctgacattcct

SEQ ID NO: 185654 - DNA, 20 bp, Artificial Sequence
  chemically synthesized
ggctttaaaacattattctg

SEQ ID NO: 185655 - DNA, 20 bp, Artificial Sequence
  chemically synthesized
gggctttaaaacattattct

SEQ ID NO: 185656 - DNA, 20 bp, Artificial Sequence
  chemically synthesized
ttcctcagaataatgtttta

SEQ ID NO: 185657 - DNA, 20 bp, Artificial Sequence
  chemically synthesized
atgttttaaagcccaacaat

SEQ ID NO: 185658 - DNA, 20 bp, Artificial Sequence
  chemically synthesized
tgctacagggtcttattgtt

SEQ ID NO: 185659 - DNA, 20 bp, Artificial Sequence
  chemically synthesized
gtgctacagggtcttattgt

SEQ ID NO: 185660 - DNA, 20 bp, Artificial Sequence
  chemically synthesized
agcccaacaataagaccctg

SEQ ID NO: 185661 - DNA, 20 bp, Artificial Sequence
  chemically synthesized
tacttattatatgtgctaca

SEQ ID NO: 185662 - DNA, 20 bp, Artificial Sequence
  chemically synthesized
gtacttattatatgtgctac

SEQ ID NO: 185663 - DNA, 20 bp, Artificial Sequence
  chemically synthesized
agtacttattatatgtgcta

SEQ ID NO: 185664 - DNA, 20 bp, Artificial Sequence
  chemically synthesized
gaccctgtagcacatataat

SEQ ID NO: 185665 - DNA, 20 bp, Artificial Sequence
  chemically synthesized
agcacatataataagtactg

SEQ ID NO: 185666 - DNA, 20 bp, Artificial Sequence
  chemically synthesized
ttatcactacttcaaaactg

SEQ ID NO: 185667 - DNA, 20 bp, Artificial Sequence
  chemically synthesized
taataagtactgcagttttg

SEQ ID NO: 185668 - DNA, 20 bp, Artificial Sequence
  chemically synthesized
taagtactgcagttttgaag

SEQ ID NO: 185669 - DNA, 20 bp, Artificial Sequence
  chemically synthesized
tgcagttttgaagtagtgat

SEQ ID NO: 185670 - DNA, 20 bp, Artificial Sequence
  chemically synthesized
atatttattataactgtaat

SEQ ID NO: 185671 - DNA, 20 bp, Artificial Sequence
  chemically synthesized
gatatgtacacatctcatta

SEQ ID NO: 185672 - DNA, 20 bp, Artificial Sequence
  chemically synthesized
aatcagtacctatgaagtca

SEQ ID NO: 185673 - DNA, 20 bp, Artificial Sequence
  chemically synthesized
tgtacatatctgtgacttca

SEQ ID NO: 185674 - DNA, 20 bp, Artificial Sequence
  chemically synthesized
gtacatatctgtgacttcat

SEQ ID NO: 185675 - DNA, 20 bp, Artificial Sequence
  chemically synthesized
tagtacaatcagtacctatg

SEQ ID NO: 185676 - DNA, 20 bp, Artificial Sequence
  chemically synthesized
aaaaatcacagtagtacaat

SEQ ID NO: 185677 - DNA, 20 bp, Artificial Sequence
  chemically synthesized
agtaggcaaaaaaatcacag

SEQ ID NO: 185678 - DNA, 20 bp, Artificial Sequence
  chemically synthesized
gaaagtaggcaaaaaaatca

SEQ ID NO: 185679 - DNA, 20 bp, Artificial Sequence
  chemically synthesized
ttccttttcattttgaaagt

SEQ ID NO: 185680 - DNA, 20 bp, Artificial Sequence
  chemically synthesized
attccttttcattttgaaag

SEQ ID NO: 185681 - DNA, 20 bp, Artificial Sequence
  chemically synthesized
agcattccttttcattttga

SEQ ID NO: 185682 - DNA, 20 bp, Artificial Sequence
  chemically synthesized
ttgcctactttcaaaatgaa

SEQ ID NO: 185683 - DNA, 20 bp, Artificial Sequence
  chemically synthesized
tgcctactttcaaaatgaaa

SEQ ID NO: 185684 - DNA, 20 bp, Artificial Sequence
  chemically synthesized
tgaaaaggaatgcttaattt

SEQ ID NO: 185685 - DNA, 20 bp, Artificial Sequence
  chemically synthesized
actaacctctaactgaaatt

SEQ ID NO: 185686 - DNA, 20 bp, Artificial Sequence
  chemically synthesized
aaggaatgcttaatttcagt

SEQ ID NO: 185687 - DNA, 20 bp, Artificial Sequence
  chemically synthesized
ggaatgcttaatttcagtta

SEQ ID NO: 185688 - DNA, 20 bp, Artificial Sequence
  chemically synthesized
gaatgcttaatttcagttag

SEQ ID NO: 185689 - DNA, 20 bp, Artificial Sequence
  chemically synthesized
gcttaatttcagttagaggt

SEQ ID NO: 185690 - DNA, 20 bp, Artificial Sequence
  chemically synthesized
atttcagttagaggttagta

SEQ ID NO: 185691 - DNA, 20 bp, Artificial Sequence
  chemically synthesized
tagaggttagtaaagacaaa

SEQ ID NO: 185692 - DNA, 20 bp, Artificial Sequence
  chemically synthesized
agaggttagtaaagacaaat

SEQ ID NO: 185693 - DNA, 20 bp, Artificial Sequence
  chemically synthesized
aaataggtaattttcttctc

SEQ ID NO: 185694 - DNA, 20 bp, Artificial Sequence
  chemically synthesized
cgccatgctcttcactggag

SEQ ID NO: 185695 - DNA, 20 bp, Artificial Sequence
  chemically synthesized
ggtaattttcttctccagtg

SEQ ID NO: 185696 - DNA, 20 bp, Artificial Sequence
  chemically synthesized
taattttcttctccagtgaa

SEQ ID NO: 185697 - DNA, 20 bp, Artificial Sequence
  chemically synthesized
gggcgccatgctcttcactg

SEQ ID NO: 185698 - DNA, 20 bp, Artificial Sequence
  chemically synthesized
aggggcgccatgctcttcac

SEQ ID NO: 185699 - DNA, 20 bp, Artificial Sequence
  chemically synthesized
ttcttctccagtgaagagca

SEQ ID NO: 185700 - DNA, 20 bp, Artificial Sequence
  chemically synthesized
aagcgtccatgaatagcaag

SEQ ID NO: 185701 - DNA, 20 bp, Artificial Sequence
  chemically synthesized
caagcgtccatgaatagcaa

SEQ ID NO: 185702 - DNA, 20 bp, Artificial Sequence
  chemically synthesized
gcaagcgtccatgaatagca

SEQ ID NO: 185703 - DNA, 20 bp, Artificial Sequence
  chemically synthesized
agcaagcgtccatgaatagc

SEQ ID NO: 185704 - DNA, 20 bp, Artificial Sequence
  chemically synthesized
atggcgccccttgctattca

SEQ ID NO: 185705 - DNA, 20 bp, Artificial Sequence
  chemically synthesized
tttaagcaagcgtccatgaa

SEQ ID NO: 185706 - DNA, 20 bp, Artificial Sequence
  chemically synthesized
tattcatggacgcttgctta

SEQ ID NO: 185707 - DNA, 20 bp, Artificial Sequence
  chemically synthesized
ctgtgtacaagtctttaagc

SEQ ID NO: 185708 - DNA, 20 bp, Artificial Sequence
  chemically synthesized
aagcctgtgtacaagtcttt

SEQ ID NO: 185709 - DNA, 20 bp, Artificial Sequence
  chemically synthesized
cttgcttaaagacttgtaca

SEQ ID NO: 185710 - DNA, 20 bp, Artificial Sequence
  chemically synthesized
ttgcttaaagacttgtacac

SEQ ID NO: 185711 - DNA, 20 bp, Artificial Sequence
  chemically synthesized
tacaaagcaagcctgtgtac

SEQ ID NO: 185712 - DNA, 20 bp, Artificial Sequence
  chemically synthesized
gtcataggttgatacaaagc

SEQ ID NO: 185713 - DNA, 20 bp, Artificial Sequence
  chemically synthesized
ggaagtcataggttgataca

SEQ ID NO: 185714 - DNA, 20 bp, Artificial Sequence
  chemically synthesized
cggctgtaaggggaagtcat

SEQ ID NO: 185715 - DNA, 20 bp, Artificial Sequence
  chemically synthesized
tcggctgtaaggggaagtca

SEQ ID NO: 185716 - DNA, 20 bp, Artificial Sequence
  chemically synthesized
caacctatgacttcccctta

SEQ ID NO: 185717 - DNA, 20 bp, Artificial Sequence
  chemically synthesized
ctatcatcggctgtaagggg

SEQ ID NO: 185718 - DNA, 20 bp, Artificial Sequence
  chemically synthesized
aacctatcatcggctgtaag

SEQ ID NO: 185719 - DNA, 20 bp, Artificial Sequence
  chemically synthesized
aaacctatcatcggctgtaa

SEQ ID NO: 185720 - DNA, 20 bp, Artificial Sequence
  chemically synthesized
aaaacctatcatcggctgta

SEQ ID NO: 185721 - DNA, 20 bp, Artificial Sequence
  chemically synthesized
aaaaacctatcatcggctgt

SEQ ID NO: 185722 - DNA, 20 bp, Artificial Sequence
  chemically synthesized
cttccccttacagccgatga

SEQ ID NO: 185723 - DNA, 20 bp, Artificial Sequence
  chemically synthesized
ttccccttacagccgatgat

SEQ ID NO: 185724 - DNA, 20 bp, Artificial Sequence
  chemically synthesized
tgcaaataaaaacctatcat

SEQ ID NO: 185725 - DNA, 20 bp, Artificial Sequence
  chemically synthesized
actgtctttgtacacgaagg

SEQ ID NO: 185726 - DNA, 20 bp, Artificial Sequence
  chemically synthesized
aactgtctttgtacacgaag

SEQ ID NO: 185727 - DNA, 20 bp, Artificial Sequence
  chemically synthesized
aaaactgtctttgtacacga

SEQ ID NO: 185728 - DNA, 20 bp, Artificial Sequence
  chemically synthesized
caaaactgtctttgtacacg

SEQ ID NO: 185729 - DNA, 20 bp, Artificial Sequence
  chemically synthesized
ttgcacctccttcgtgtaca

SEQ ID NO: 185730 - DNA, 20 bp, Artificial Sequence
  chemically synthesized
acctccttcgtgtacaaaga

SEQ ID NO: 185731 - DNA, 20 bp, Artificial Sequence
  chemically synthesized
ttcgtgtacaaagacagttt

SEQ ID NO: 185732 - DNA, 20 bp, Artificial Sequence
  chemically synthesized
gtgtacaaagacagttttgg

SEQ ID NO: 185733 - DNA, 20 bp, Artificial Sequence
  chemically synthesized
taatgagtttaatgatggcg

SEQ ID NO: 185734 - DNA, 20 bp, Artificial Sequence
  chemically synthesized
gataataatgagtttaatga

SEQ ID NO: 185735 - DNA, 20 bp, Artificial Sequence
  chemically synthesized
ggcttaagcatgataataat

SEQ ID NO: 185736 - DNA, 20 bp, Artificial Sequence
  chemically synthesized
aactcattattatcatgctt

SEQ ID NO: 185737 - DNA, 20 bp, Artificial Sequence
  chemically synthesized
tattatcatgcttaagccta

SEQ ID NO: 185738 - DNA, 20 bp, Artificial Sequence
  chemically synthesized
ctggatacatctataggctt

SEQ ID NO: 185739 - DNA, 20 bp, Artificial Sequence
  chemically synthesized
gaagaactggatacatctat

SEQ ID NO: 185740 - DNA, 20 bp, Artificial Sequence
  chemically synthesized
agaagaactggatacatcta

SEQ ID NO: 185741 - DNA, 20 bp, Artificial Sequence
  chemically synthesized
cttaagcctatagatgtatc

SEQ ID NO: 185742 - DNA, 20 bp, Artificial Sequence
  chemically synthesized
caattatgtaacagaagaac

SEQ ID NO: 185743 - DNA, 20 bp, Artificial Sequence
  chemically synthesized
cagcttcaattatgtaacag

SEQ ID NO: 185744 - DNA, 20 bp, Artificial Sequence
  chemically synthesized
ctacagcttcaattatgtaa

SEQ ID NO: 185745 - DNA, 20 bp, Artificial Sequence
  chemically synthesized
gttcttctgttacataattg

SEQ ID NO: 185746 - DNA, 20 bp, Artificial Sequence
  chemically synthesized
ctgttacataattgaagctg

SEQ ID NO: 185747 - DNA, 20 bp, Artificial Sequence
  chemically synthesized
ttaagatagacaattcacta

SEQ ID NO: 185748 - DNA, 20 bp, Artificial Sequence
  chemically synthesized
gttagcgatgcagtttaaga

SEQ ID NO: 185749 - DNA, 20 bp, Artificial Sequence
  chemically synthesized
gtcagttagcgatgcagttt

SEQ ID NO: 185750 - DNA, 20 bp, Artificial Sequence
  chemically synthesized
aatgtagtcagttagcgatg

SEQ ID NO: 185751 - DNA, 20 bp, Artificial Sequence
  chemically synthesized
aagtgtgaaatgtagtcagt

SEQ ID NO: 185752 - DNA, 20 bp, Artificial Sequence
  chemically synthesized
aatgaagtgtgaaatgtagt

SEQ ID NO: 185753 - DNA, 20 bp, Artificial Sequence
  chemically synthesized
agcaaatgaagtgtgaaatg

SEQ ID NO: 185754 - DNA, 20 bp, Artificial Sequence
  chemically synthesized
gtctatgttggaagcaaatg

SEQ ID NO: 185755 - DNA, 20 bp, Artificial Sequence
  chemically synthesized
cacttcatttgcttccaaca

SEQ ID NO: 185756 - DNA, 20 bp, Artificial Sequence
  chemically synthesized
agaaggttagtctatgttgg

SEQ ID NO: 185757 - DNA, 20 bp, Artificial Sequence
  chemically synthesized
ccaagaaggttagtctatgt

SEQ ID NO: 185758 - DNA, 20 bp, Artificial Sequence
  chemically synthesized
ccaacatagactaaccttct

SEQ ID NO: 185759 - DNA, 20 bp, Artificial Sequence
  chemically synthesized
tagtggacatccaagaaggt

SEQ ID NO: 185760 - DNA, 20 bp, Artificial Sequence
  chemically synthesized
ataatagtggacatccaaga

SEQ ID NO: 185761 - DNA, 20 bp, Artificial Sequence
  chemically synthesized
aataatagtggacatccaag

SEQ ID NO: 185762 - DNA, 20 bp, Artificial Sequence
  chemically synthesized
tcaaataatagtggacatcc

SEQ ID NO: 185763 - DNA, 20 bp, Artificial Sequence
  chemically synthesized
ctcaaaagttcaaataatag

SEQ ID NO: 185764 - DNA, 20 bp, Artificial Sequence
  chemically synthesized
aatctcaaaagttcaaataa

SEQ ID NO: 185765 - DNA, 20 bp, Artificial Sequence
  chemically synthesized
ccactattatttgaactttt

SEQ ID NO: 185766 - DNA, 20 bp, Artificial Sequence
  chemically synthesized
aataggaaaaaaaatctcaa

SEQ ID NO: 185767 - DNA, 20 bp, Artificial Sequence
  chemically synthesized
aattttaagatattagaaat

SEQ ID NO: 185768 - DNA, 20 bp, Artificial Sequence
  chemically synthesized
aaattttaagatattagaaa

SEQ ID NO: 185769 - DNA, 20 bp, Artificial Sequence
  chemically synthesized
cttctgaaattttaagatat

SEQ ID NO: 185770 - DNA, 20 bp, Artificial Sequence
  chemically synthesized
tttctaatatcttaaaattt

SEQ ID NO: 185771 - DNA, 20 bp, Artificial Sequence
  chemically synthesized
tttaagtcttctgaaatttt

SEQ ID NO: 185772 - DNA, 20 bp, Artificial Sequence
  chemically synthesized
ctaatatcttaaaatttcag

SEQ ID NO: 185773 - DNA, 20 bp, Artificial Sequence
  chemically synthesized
ttaaaatttcagaagactta

SEQ ID NO: 185774 - DNA, 20 bp, Artificial Sequence
  chemically synthesized
ccctgtagttgcaaaacttt

SEQ ID NO: 185775 - DNA, 20 bp, Artificial Sequence
  chemically synthesized
gacttaaagttttgcaacta

SEQ ID NO: 185776 - DNA, 20 bp, Artificial Sequence
  chemically synthesized
acttaaagttttgcaactac

SEQ ID NO: 185777 - DNA, 20 bp, Artificial Sequence
  chemically synthesized
cttaaagttttgcaactaca

SEQ ID NO: 185778 - DNA, 20 bp, Artificial Sequence
  chemically synthesized
gatgtctatatggagccctg

SEQ ID NO: 185779 - DNA, 20 bp, Artificial Sequence
  chemically synthesized
tgcaactacagggctccata

SEQ ID NO: 185780 - DNA, 20 bp, Artificial Sequence
  chemically synthesized
tcaagctagatgtctatatg

SEQ ID NO: 185781 - DNA, 20 bp, Artificial Sequence
  chemically synthesized
attcaagctagatgtctata

SEQ ID NO: 185782 - DNA, 20 bp, Artificial Sequence
  chemically synthesized
cagggctccatatagacatc

SEQ ID NO: 185783 - DNA, 20 bp, Artificial Sequence
  chemically synthesized
gaaagtgtataaattcaagc

SEQ ID NO: 185784 - DNA, 20 bp, Artificial Sequence
  chemically synthesized
gaaagaaagtgtataaattc

SEQ ID NO: 185785 - DNA, 20 bp, Artificial Sequence
  chemically synthesized
ccagggacatcaatgaaaga

SEQ ID NO: 185786 - DNA, 20 bp, Artificial Sequence
  chemically synthesized
tagtccagggacatcaatga

SEQ ID NO: 185787 - DNA, 20 bp, Artificial Sequence
  chemically synthesized
ctttctttcattgatgtccc

SEQ ID NO: 185788 - DNA, 20 bp, Artificial Sequence
  chemically synthesized
atttaacattttttagtcca

SEQ ID NO: 185789 - DNA, 20 bp, Artificial Sequence
  chemically synthesized
tatttaacattttttagtcc

SEQ ID NO: 185790 - DNA, 20 bp, Artificial Sequence
  chemically synthesized
atatttaacattttttagtc

SEQ ID NO: 185791 - DNA, 20 bp, Artificial Sequence
  chemically synthesized
tagaaatatttaacattttt

SEQ ID NO: 185792 - DNA, 20 bp, Artificial Sequence
  chemically synthesized
tggactttaagtacagcggt

SEQ ID NO: 185793 - DNA, 20 bp, Artificial Sequence
  chemically synthesized
gtaatggactttaagtacag

SEQ ID NO: 185794 - DNA, 20 bp, Artificial Sequence
  chemically synthesized
atttctaaccgctgtactta

SEQ ID NO: 185795 - DNA, 20 bp, Artificial Sequence
  chemically synthesized
tttgtaatggactttaagta

SEQ ID NO: 185796 - DNA, 20 bp, Artificial Sequence
  chemically synthesized
cttcgtttgtaatggacttt

SEQ ID NO: 185797 - DNA, 20 bp, Artificial Sequence
  chemically synthesized
acagtagtcttcgtttgtaa

SEQ ID NO: 185798 - DNA, 20 bp, Artificial Sequence
  chemically synthesized
cttaaagtccattacaaacg

SEQ ID NO: 185799 - DNA, 20 bp, Artificial Sequence
  chemically synthesized
cctattcaacttaacaacag

SEQ ID NO: 185800 - DNA, 20 bp, Artificial Sequence
  chemically synthesized
aaacgaagactactgttgtt

SEQ ID NO: 185801 - DNA, 20 bp, Artificial Sequence
  chemically synthesized
atgcctattcaacttaacaa

SEQ ID NO: 185802 - DNA, 20 bp, Artificial Sequence
  chemically synthesized
actactgttgttaagttgaa

SEQ ID NO: 185803 - DNA, 20 bp, Artificial Sequence
  chemically synthesized
ctactgttgttaagttgaat

SEQ ID NO: 185804 - DNA, 20 bp, Artificial Sequence
  chemically synthesized
tgcaccggtgaaaaatatat

SEQ ID NO: 185805 - DNA, 20 bp, Artificial Sequence
  chemically synthesized
gcatcttatatatttttcac

SEQ ID NO: 185806 - DNA, 20 bp, Artificial Sequence
  chemically synthesized
atagaagttatttattgcac

SEQ ID NO: 185807 - DNA, 20 bp, Artificial Sequence
  chemically synthesized
cagatgttagaagggaatag

SEQ ID NO: 185808 - DNA, 20 bp, Artificial Sequence
  chemically synthesized
aagcagatgttagaagggaa

SEQ ID NO: 185809 - DNA, 20 bp, Artificial Sequence
  chemically synthesized
aacgcaagcagatgttagaa

SEQ ID NO: 185810 - DNA, 20 bp, Artificial Sequence
  chemically synthesized
caacgcaagcagatgttaga

SEQ ID NO: 185811 - DNA, 20 bp, Artificial Sequence
  chemically synthesized
gcaacgcaagcagatgttag

SEQ ID NO: 185812 - DNA, 20 bp, Artificial Sequence
  chemically synthesized
agtgcaacgcaagcagatgt

SEQ ID NO: 185813 - DNA, 20 bp, Artificial Sequence
  chemically synthesized
tactctcagtgcaacgcaag

SEQ ID NO: 185814 - DNA, 20 bp, Artificial Sequence
  chemically synthesized
gtgtactctcagtgcaacgc

SEQ ID NO: 185815 - DNA, 20 bp, Artificial Sequence
  chemically synthesized
acatctgcttgcgttgcact

SEQ ID NO: 185816 - DNA, 20 bp, Artificial Sequence
  chemically synthesized
atctgcttgcgttgcactga

SEQ ID NO: 185817 - DNA, 20 bp, Artificial Sequence
  chemically synthesized
gctaatcaatagtgtactct

SEQ ID NO: 185818 - DNA, 20 bp, Artificial Sequence
  chemically synthesized
actgagagtacactattgat

SEQ ID NO: 185819 - DNA, 20 bp, Artificial Sequence
  chemically synthesized
acgaacctattgctaatcaa

SEQ ID NO: 185820 - DNA, 20 bp, Artificial Sequence
  chemically synthesized
agtacactattgattagcaa

SEQ ID NO: 185821 - DNA, 20 bp, Artificial Sequence
  chemically synthesized
gtacactattgattagcaat

SEQ ID NO: 185822 - DNA, 20 bp, Artificial Sequence
  chemically synthesized
tagcaataggttcgtgatta

SEQ ID NO: 185823 - DNA, 20 bp, Artificial Sequence
  chemically synthesized
cctaacaattaattatagaa

SEQ ID NO: 185824 - DNA, 20 bp, Artificial Sequence
  chemically synthesized
acctaacaattaattataga

SEQ ID NO: 185825 - DNA, 20 bp, Artificial Sequence
  chemically synthesized
aacctaacaattaattatag

SEQ ID NO: 185826 - DNA, 20 bp, Artificial Sequence
  chemically synthesized
gttaacctaacaattaatta

SEQ ID NO: 185827 - DNA, 20 bp, Artificial Sequence
  chemically synthesized
gcccttctataattaattgt

SEQ ID NO: 185828 - DNA, 20 bp, Artificial Sequence
  chemically synthesized
cccttctataattaattgtt

SEQ ID NO: 185829 - DNA, 20 bp, Artificial Sequence
  chemically synthesized
taagcatccagtagcaaatc

SEQ ID NO: 185830 - DNA, 20 bp, Artificial Sequence
  chemically synthesized
atttttacttgatttgctac

SEQ ID NO: 185831 - DNA, 20 bp, Artificial Sequence
  chemically synthesized
agctatttctaagcatccag

SEQ ID NO: 185832 - DNA, 20 bp, Artificial Sequence
  chemically synthesized
ttgatttgctactggatgct

SEQ ID NO: 185833 - DNA, 20 bp, Artificial Sequence
  chemically synthesized
catagctatttctaagcatc

SEQ ID NO: 185834 - DNA, 20 bp, Artificial Sequence
  chemically synthesized
tgctactggatgcttagaaa

SEQ ID NO: 185835 - DNA, 20 bp, Artificial Sequence
  chemically synthesized
atatactcatagctatttct

SEQ ID NO: 185836 - DNA, 20 bp, Artificial Sequence
  chemically synthesized
ggatgcttagaaatagctat

SEQ ID NO: 185837 - DNA, 20 bp, Artificial Sequence
  chemically synthesized
tggttctaccaatatactca

SEQ ID NO: 185838 - DNA, 20 bp, Artificial Sequence
  chemically synthesized
agaaatagctatgagtatat

SEQ ID NO: 185839 - DNA, 20 bp, Artificial Sequence
  chemically synthesized
aatagctatgagtatattgg

SEQ ID NO: 185840 - DNA, 20 bp, Artificial Sequence
  chemically synthesized
tatgagtatattggtagaac

SEQ ID NO: 185841 - DNA, 20 bp, Artificial Sequence
  chemically synthesized
atgtaataaaatataagtac

SEQ ID NO: 185842 - DNA, 20 bp, Artificial Sequence
  chemically synthesized
gtaaaaatgtaataaaatat

SEQ ID NO: 185843 - DNA, 20 bp, Artificial Sequence
  chemically synthesized
ttttacatttcataaaattt

SEQ ID NO: 185844 - DNA, 20 bp, Artificial Sequence
  chemically synthesized
ttaagtgatataaaaatcct

SEQ ID NO: 185845 - DNA, 20 bp, Artificial Sequence
  chemically synthesized
taagtgatataaaaatcctg

SEQ ID NO: 185846 - DNA, 20 bp, Artificial Sequence
  chemically synthesized
gtgatataaaaatcctgagg

SEQ ID NO: 185847 - DNA, 20 bp, Artificial Sequence
  chemically synthesized
cttttgtggcatacttcctc

SEQ ID NO: 185848 - DNA, 20 bp, Artificial Sequence
  chemically synthesized
acttttgtggcatacttcct

SEQ ID NO: 185849 - DNA, 20 bp, Artificial Sequence
  chemically synthesized
cctgaggaagtatgccacaa

SEQ ID NO: 185850 - DNA, 20 bp, Artificial Sequence
  chemically synthesized
gaggaagtatgccacaaaag

SEQ ID NO: 185851 - DNA, 20 bp, Artificial Sequence
  chemically synthesized
ttccactgagaccacttttg

SEQ ID NO: 185852 - DNA, 20 bp, Artificial Sequence
  chemically synthesized
gtatgccacaaaagtggtct

SEQ ID NO: 185853 - DNA, 20 bp, Artificial Sequence
  chemically synthesized
tgccacaaaagtggtctcag

SEQ ID NO: 185854 - DNA, 20 bp, Artificial Sequence
  chemically synthesized
aacatatttaaatttccact

SEQ ID NO: 185855 - DNA, 20 bp, Artificial Sequence
  chemically synthesized
taacatttatttttaaaatg

SEQ ID NO: 185856 - DNA, 20 bp, Artificial Sequence
  chemically synthesized
ttttaaaatgtagcgtgaaa

SEQ ID NO: 185857 - DNA, 20 bp, Artificial Sequence
  chemically synthesized
cgtgaaatagacaactttaa

SEQ ID NO: 185858 - DNA, 20 bp, Artificial Sequence
  chemically synthesized
ttttttaagctgagctttta

SEQ ID NO: 185859 - DNA, 20 bp, Artificial Sequence
  chemically synthesized
aatagacaactttaaaagct

SEQ ID NO: 185860 - DNA, 20 bp, Artificial Sequence
  chemically synthesized
ttgagttttttttttaagct

SEQ ID NO: 185861 - DNA, 20 bp, Artificial Sequence
  chemically synthesized
cttccttgagtttttttttt

SEQ ID NO: 185862 - DNA, 20 bp, Artificial Sequence
  chemically synthesized
tcagcttaaaaaaaaaactc

SEQ ID NO: 185863 - DNA, 20 bp, Artificial Sequence
  chemically synthesized
cagcttaaaaaaaaaactca

SEQ ID NO: 185864 - DNA, 20 bp, Artificial Sequence
  chemically synthesized
cttaaaaaaaaaactcaagg

SEQ ID NO: 185865 - DNA, 20 bp, Artificial Sequence
  chemically synthesized
aagtcaagttcagcttcctt

SEQ ID NO: 185866 - DNA, 20 bp, Artificial Sequence
  chemically synthesized
gtgctttaaaaagtcaagtt

SEQ ID NO: 185867 - DNA, 20 bp, Artificial Sequence
  chemically synthesized
cttcagtgctttaaaaagtc

SEQ ID NO: 185868 - DNA, 20 bp, Artificial Sequence
  chemically synthesized
aagctgaacttgacttttta

SEQ ID NO: 185869 - DNA, 20 bp, Artificial Sequence
  chemically synthesized
ttgcacttcagtgctttaaa

SEQ ID NO: 185870 - DNA, 20 bp, Artificial Sequence
  chemically synthesized
cttgactttttaaagcactg

SEQ ID NO: 185871 - DNA, 20 bp, Artificial Sequence
  chemically synthesized
ctacattaaatattgcactt

SEQ ID NO: 185872 - DNA, 20 bp, Artificial Sequence
  chemically synthesized
ctgaagtgcaatatttaatg

SEQ ID NO: 185873 - DNA, 20 bp, Artificial Sequence
  chemically synthesized
tgaagtgcaatatttaatgt

SEQ ID NO: 185874 - DNA, 20 bp, Artificial Sequence
  chemically synthesized
tgtaggtcaacatgtttaaa

SEQ ID NO: 185875 - DNA, 20 bp, Artificial Sequence
  chemically synthesized
gtaggtcaacatgtttaaat

SEQ ID NO: 185876 - DNA, 20 bp, Artificial Sequence
  chemically synthesized
gaaaatttttttcctaatta

SEQ ID NO: 185877 - DNA, 20 bp, Artificial Sequence
  chemically synthesized
ctagggatttggctgtaatt

SEQ ID NO: 185878 - DNA, 20 bp, Artificial Sequence
  chemically synthesized
gctagggatttggctgtaat

SEQ ID NO: 185879 - DNA, 20 bp, Artificial Sequence
  chemically synthesized
cctaattacagccaaatccc

SEQ ID NO: 185880 - DNA, 20 bp, Artificial Sequence
  chemically synthesized
gttaattacagctagggatt

SEQ ID NO: 185881 - DNA, 20 bp, Artificial Sequence
  chemically synthesized
ttttaagttaattacagcta

SEQ ID NO: 185882 - DNA, 20 bp, Artificial Sequence
  chemically synthesized
attttaagttaattacagct

SEQ ID NO: 185883 - DNA, 20 bp, Artificial Sequence
  chemically synthesized
aattttaagttaattacagc

SEQ ID NO: 185884 - DNA, 20 bp, Artificial Sequence
  chemically synthesized
tacaaattttaagttaatta

SEQ ID NO: 185885 - DNA, 20 bp, Artificial Sequence
  chemically synthesized
tgaaatagtatacaaatttt

SEQ ID NO: 185886 - DNA, 20 bp, Artificial Sequence
  chemically synthesized
atgctgactctgttgtgaaa

SEQ ID NO: 185887 - DNA, 20 bp, Artificial Sequence
  chemically synthesized
atttgtatactatttcacaa

SEQ ID NO: 185888 - DNA, 20 bp, Artificial Sequence
  chemically synthesized
ttgtatactatttcacaaca

SEQ ID NO: 185889 - DNA, 20 bp, Artificial Sequence
  chemically synthesized
atactatttcacaacagagt

SEQ ID NO: 185890 - DNA, 20 bp, Artificial Sequence
  chemically synthesized
tttctaattttataagaaag

SEQ ID NO: 185891 - DNA, 20 bp, Artificial Sequence
  chemically synthesized
atctttctaattttataaga

SEQ ID NO: 185892 - DNA, 20 bp, Artificial Sequence
  chemically synthesized
ataccactttcttataaaat

SEQ ID NO: 185893 - DNA, 20 bp, Artificial Sequence
  chemically synthesized
ttagatctttctaattttat

SEQ ID NO: 185894 - DNA, 20 bp, Artificial Sequence
  chemically synthesized
cactttcttataaaattaga

SEQ ID NO: 185895 - DNA, 20 bp, Artificial Sequence
  chemically synthesized
attagaaagatctaaaattt

SEQ ID NO: 185896 - DNA, 20 bp, Artificial Sequence
  chemically synthesized
ccaaataagctctaaaattt

SEQ ID NO: 185897 - DNA, 20 bp, Artificial Sequence
  chemically synthesized
tagaaagatctaaaatttta

SEQ ID NO: 185898 - DNA, 20 bp, Artificial Sequence
  chemically synthesized
ctaaaattttagagcttatt

SEQ ID NO: 185899 - DNA, 20 bp, Artificial Sequence
  chemically synthesized
atatgcctgtttcaccaaat

SEQ ID NO: 185900 - DNA, 20 bp, Artificial Sequence
  chemically synthesized
ttagagcttatttggtgaaa

SEQ ID NO: 185901 - DNA, 20 bp, Artificial Sequence
  chemically synthesized
tagagcttatttggtgaaac

SEQ ID NO: 185902 - DNA, 20 bp, Artificial Sequence
  chemically synthesized
ataatttataaacaaagatg

SEQ ID NO: 185903 - DNA, 20 bp, Artificial Sequence
  chemically synthesized
cacattataatttataaaca

SEQ ID NO: 185904 - DNA, 20 bp, Artificial Sequence
  chemically synthesized
tataaattataatgtgcctt

SEQ ID NO: 185905 - DNA, 20 bp, Artificial Sequence
  chemically synthesized
taaattataatgtgccttta

SEQ ID NO: 185906 - DNA, 20 bp, Artificial Sequence
  chemically synthesized
tatctgttattgggctctaa

SEQ ID NO: 185907 - DNA, 20 bp, Artificial Sequence
  chemically synthesized
ttatctgttattgggctcta

SEQ ID NO: 185908 - DNA, 20 bp, Artificial Sequence
  chemically synthesized
gtgcctttagagcccaataa

SEQ ID NO: 185909 - DNA, 20 bp, Artificial Sequence
  chemically synthesized
aaatcttgttatctgttatt

SEQ ID NO: 185910 - DNA, 20 bp, Artificial Sequence
  chemically synthesized
aaaatcttgttatctgttat

SEQ ID NO: 185911 - DNA, 20 bp, Artificial Sequence
  chemically synthesized
agagcccaataacagataac

SEQ ID NO: 185912 - DNA, 20 bp, Artificial Sequence
  chemically synthesized
ataacaagattttgaaaatt

SEQ ID NO: 185913 - DNA, 20 bp, Artificial Sequence
  chemically synthesized
taacaagattttgaaaattc

SEQ ID NO: 185914 - DNA, 20 bp, Artificial Sequence
  chemically synthesized
ttttgaaaattcaggtgaat

SEQ ID NO: 185915 - DNA, 20 bp, Artificial Sequence
  chemically synthesized
ttgaaaattcaggtgaatta

SEQ ID NO: 185916 - DNA, 20 bp, Artificial Sequence
  chemically synthesized
ttcaggtgaattagagttat

SEQ ID NO: 185917 - DNA, 20 bp, Artificial Sequence
  chemically synthesized
caggtgaattagagttatca

SEQ ID NO: 185918 - DNA, 20 bp, Artificial Sequence
  chemically synthesized
aggtgaattagagttatcag

SEQ ID NO: 185919 - DNA, 20 bp, Artificial Sequence
  chemically synthesized
ggtgaattagagttatcaga

SEQ ID NO: 185920 - DNA, 20 bp, Artificial Sequence
  chemically synthesized
actcatatagtatttgaata

SEQ ID NO: 185921 - DNA, 20 bp, Artificial Sequence
  chemically synthesized
ttactcatatagtatttgaa

SEQ ID NO: 185922 - DNA, 20 bp, Artificial Sequence
  chemically synthesized
actctattcaaatactatat

SEQ ID NO: 185923 - DNA, 20 bp, Artificial Sequence
  chemically synthesized
tattcaaatactatatgagt

SEQ ID NO: 185924 - DNA, 20 bp, Artificial Sequence
  chemically synthesized
ttttaaatgtcttactcata

SEQ ID NO: 185925 - DNA, 20 bp, Artificial Sequence
  chemically synthesized
tatgagtaagacatttaaaa

SEQ ID NO: 185926 - DNA, 20 bp, Artificial Sequence
  chemically synthesized
atgagtaagacatttaaaat

SEQ ID NO: 185927 - DNA, 20 bp, Artificial Sequence
  chemically synthesized
ttatttttctataatatata

SEQ ID NO: 185928 - DNA, 20 bp, Artificial Sequence
  chemically synthesized
aaacaatactttatatatta

SEQ ID NO: 185929 - DNA, 20 bp, Artificial Sequence
  chemically synthesized
attatagaaaaataatcttc

SEQ ID NO: 185930 - DNA, 20 bp, Artificial Sequence
  chemically synthesized
aagtggattaaatcgactgg

SEQ ID NO: 185931 - DNA, 20 bp, Artificial Sequence
  chemically synthesized
ataaagtggattaaatcgac

SEQ ID NO: 185932 - DNA, 20 bp, Artificial Sequence
  chemically synthesized
tacggagagaattcataaag

SEQ ID NO: 185933 - DNA, 20 bp, Artificial Sequence
  chemically synthesized
atatacggagagaattcata

SEQ ID NO: 185934 - DNA, 20 bp, Artificial Sequence
  chemically synthesized
tataaatatatatatacgga

SEQ ID NO: 185935 - DNA, 20 bp, Artificial Sequence
  chemically synthesized
actataaatatatatatacg

SEQ ID NO: 185936 - DNA, 20 bp, Artificial Sequence
  chemically synthesized
atactataaatatatatata

SEQ ID NO: 185937 - DNA, 20 bp, Artificial Sequence
  chemically synthesized
tctccgtatatatatattta

SEQ ID NO: 185938 - DNA, 20 bp, Artificial Sequence
  chemically synthesized
gtatatatatatttatagta

SEQ ID NO: 185939 - DNA, 20 bp, Artificial Sequence
  chemically synthesized
aaattaagatggtaagaaat

SEQ ID NO: 185940 - DNA, 20 bp, Artificial Sequence
  chemically synthesized
ctaatccaaattaagatggt

SEQ ID NO: 185941 - DNA, 20 bp, Artificial Sequence
  chemically synthesized
caatctaatccaaattaaga

SEQ ID NO: 185942 - DNA, 20 bp, Artificial Sequence
  chemically synthesized
catttcttaccatcttaatt

SEQ ID NO: 185943 - DNA, 20 bp, Artificial Sequence
  chemically synthesized
ggctcaatctaatccaaatt

SEQ ID NO: 185944 - DNA, 20 bp, Artificial Sequence
  chemically synthesized
cttaccatcttaatttggat

SEQ ID NO: 185945 - DNA, 20 bp, Artificial Sequence
  chemically synthesized
atcttaatttggattagatt

SEQ ID NO: 185946 - DNA, 20 bp, Artificial Sequence
  chemically synthesized
aatttggattagattgagcc

SEQ ID NO: 185947 - DNA, 20 bp, Artificial Sequence
  chemically synthesized
ggattagattgagcctagtt

SEQ ID NO: 185948 - DNA, 20 bp, Artificial Sequence
  chemically synthesized
tataatgtcatttctgaact

SEQ ID NO: 185949 - DNA, 20 bp, Artificial Sequence
  chemically synthesized
gtataatgtcatttctgaac

SEQ ID NO: 185950 - DNA, 20 bp, Artificial Sequence
  chemically synthesized
agttcagaaatgacattata

SEQ ID NO: 185951 - DNA, 20 bp, Artificial Sequence
  chemically synthesized
gttcagaaatgacattatac

SEQ ID NO: 185952 - DNA, 20 bp, Artificial Sequence
  chemically synthesized
tacaggtttatacctgttca

SEQ ID NO: 185953 - DNA, 20 bp, Artificial Sequence
  chemically synthesized
gatgtgcttatactatgaac

SEQ ID NO: 185954 - DNA, 20 bp, Artificial Sequence
  chemically synthesized
tgatgtgcttatactatgaa

SEQ ID NO: 185955 - DNA, 20 bp, Artificial Sequence
  chemically synthesized
tttatacctgttcatagtat

SEQ ID NO: 185956 - DNA, 20 bp, Artificial Sequence
  chemically synthesized
tgttcatagtataagcacat

SEQ ID NO: 185957 - DNA, 20 bp, Artificial Sequence
  chemically synthesized
catacaagtattttattatt

SEQ ID NO: 185958 - DNA, 20 bp, Artificial Sequence
  chemically synthesized
aattcttctcttaatcatac

SEQ ID NO: 185959 - DNA, 20 bp, Artificial Sequence
  chemically synthesized
aataaaatacttgtatgatt

SEQ ID NO: 185960 - DNA, 20 bp, Artificial Sequence
  chemically synthesized
taaaatacttgtatgattaa

SEQ ID NO: 185961 - DNA, 20 bp, Artificial Sequence
  chemically synthesized
aatacttgtatgattaagag

SEQ ID NO: 185962 - DNA, 20 bp, Artificial Sequence
  chemically synthesized
ttaagagaagaatttcaatc

SEQ ID NO: 185963 - DNA, 20 bp, Artificial Sequence
  chemically synthesized
taagagaagaatttcaatct

SEQ ID NO: 185964 - DNA, 20 bp, Artificial Sequence
  chemically synthesized
agaatttcaatctgggaaaa

SEQ ID NO: 185965 - DNA, 20 bp, Artificial Sequence
  chemically synthesized
taagtcatatacttttttcc

SEQ ID NO: 185966 - DNA, 20 bp, Artificial Sequence
  chemically synthesized
aaaaagtatatgacttacct

SEQ ID NO: 185967 - DNA, 20 bp, Artificial Sequence
  chemically synthesized
aaaagtatatgacttaccta

SEQ ID NO: 185968 - DNA, 20 bp, Artificial Sequence
  chemically synthesized
gttaaactacttccttaggt

SEQ ID NO: 185969 - DNA, 20 bp, Artificial Sequence
  chemically synthesized
agtatatgacttacctaagg

SEQ ID NO: 185970 - DNA, 20 bp, Artificial Sequence
  chemically synthesized
atatgacttacctaaggaag

SEQ ID NO: 185971 - DNA, 20 bp, Artificial Sequence
  chemically synthesized
tgtagttaaactacttcctt

SEQ ID NO: 185972 - DNA, 20 bp, Artificial Sequence
  chemically synthesized
ttgtagttaaactacttcct

SEQ ID NO: 185973 - DNA, 20 bp, Artificial Sequence
  chemically synthesized
aaggaagtagtttaactaca

SEQ ID NO: 185974 - DNA, 20 bp, Artificial Sequence
  chemically synthesized
agtagtttaactacaaagtt

SEQ ID NO: 185975 - DNA, 20 bp, Artificial Sequence
  chemically synthesized
aaataaagaactaaactttg

SEQ ID NO: 185976 - DNA, 20 bp, Artificial Sequence
  chemically synthesized
gattatagatagataaaata

SEQ ID NO: 185977 - DNA, 20 bp, Artificial Sequence
  chemically synthesized
aaaatcttcttgattataga

SEQ ID NO: 185978 - DNA, 20 bp, Artificial Sequence
  chemically synthesized
tattttatctatctataatc

SEQ ID NO: 185979 - DNA, 20 bp, Artificial Sequence
  chemically synthesized
tttgaaaatcttcttgatta

SEQ ID NO: 185980 - DNA, 20 bp, Artificial Sequence
  chemically synthesized
tttatctatctataatcaag

SEQ ID NO: 185981 - DNA, 20 bp, Artificial Sequence
  chemically synthesized
tcaagaagattttcaaaacc

SEQ ID NO: 185982 - DNA, 20 bp, Artificial Sequence
  chemically synthesized
tattttgaataattaagtct

SEQ ID NO: 185983 - DNA, 20 bp, Artificial Sequence
  chemically synthesized
aaaagatattttgaataatt

SEQ ID NO: 185984 - DNA, 20 bp, Artificial Sequence
  chemically synthesized
tattcaaaatatcttttgat

SEQ ID NO: 185985 - DNA, 20 bp, Artificial Sequence
  chemically synthesized
attcaaaatatcttttgatg

SEQ ID NO: 185986 - DNA, 20 bp, Artificial Sequence
  chemically synthesized
aagaattatagcctcatcaa

SEQ ID NO: 185987 - DNA, 20 bp, Artificial Sequence
  chemically synthesized
ttgccaaagttaaagaatta

SEQ ID NO: 185988 - DNA, 20 bp, Artificial Sequence
  chemically synthesized
aggctataattctttaactt

SEQ ID NO: 185989 - DNA, 20 bp, Artificial Sequence
  chemically synthesized
cacaccccttgccaaagtta

SEQ ID NO: 185990 - DNA, 20 bp, Artificial Sequence
  chemically synthesized
tataattctttaactttggc

SEQ ID NO: 185991 - DNA, 20 bp, Artificial Sequence
  chemically synthesized
ataattctttaactttggca

SEQ ID NO: 185992 - DNA, 20 bp, Artificial Sequence
  chemically synthesized
taattctttaactttggcaa

SEQ ID NO: 185993 - DNA, 20 bp, Artificial Sequence
  chemically synthesized
aattctttaactttggcaag

SEQ ID NO: 185994 - DNA, 20 bp, Artificial Sequence
  chemically synthesized
cacacacacaccccttgcca

SEQ ID NO: 185995 - DNA, 20 bp, Artificial Sequence
  chemically synthesized
tgtgtgtgtgtgtgtgtgtt

SEQ ID NO: 185996 - DNA, 20 bp, Artificial Sequence
  chemically synthesized
gtgtgtgtgtgtgtgtgttt

SEQ ID NO: 185997 - DNA, 20 bp, Artificial Sequence
  chemically synthesized
tttgtacaaaataaacacat

SEQ ID NO: 185998 - DNA, 20 bp, Artificial Sequence
  chemically synthesized
atgttacattattcagaaag

SEQ ID NO: 185999 - DNA, 20 bp, Artificial Sequence
  chemically synthesized
ttcatgttacattattcaga

SEQ ID NO: 186000 - DNA, 20 bp, Artificial Sequence
  chemically synthesized
tttattcatgttacattatt

SEQ ID NO: 186001 - DNA, 20 bp, Artificial Sequence
  chemically synthesized
tgaataatgtaacatgaata

SEQ ID NO: 186002 - DNA, 20 bp, Artificial Sequence
  chemically synthesized
aataatgtaacatgaataaa

SEQ ID NO: 186003 - DNA, 20 bp, Artificial Sequence
  chemically synthesized
ataatgtaacatgaataaag

SEQ ID NO: 186004 - DNA, 20 bp, Artificial Sequence
  chemically synthesized
taatgtaacatgaataaaga

SEQ ID NO: 186005 - DNA, 20 bp, Artificial Sequence
  chemically synthesized
gtaacatgaataaagaggga

SEQ ID NO: 186006 - DNA, 20 bp, Artificial Sequence
  chemically synthesized
aacatgaataaagagggaaa

SEQ ID NO: 186007 - DNA, 20 bp, Artificial Sequence
  chemically synthesized
acatgaataaagagggaaag

SEQ ID NO: 186008 - DNA, 20 bp, Artificial Sequence
  chemically synthesized
atgaataaagagggaaagag

SEQ ID NO: 186009 - DNA, 20 bp, Artificial Sequence
  chemically synthesized
tgaataaagagggaaagagg

SEQ ID NO: 186010 - DNA, 20 bp, Artificial Sequence
  chemically synthesized
ataaagagggaaagaggagg

SEQ ID NO: 186011 - DNA, 20 bp, Artificial Sequence
  chemically synthesized
taaagagggaaagaggaggt

SEQ ID NO: 186012 - DNA, 20 bp, Artificial Sequence
  chemically synthesized
agggaaagaggaggtgggca

SEQ ID NO: 186013 - DNA, 20 bp, Artificial Sequence
  chemically synthesized
agaagattttggaattatgt

SEQ ID NO: 186014 - DNA, 20 bp, Artificial Sequence
  chemically synthesized
atgtattaaaaagaagattt

SEQ ID NO: 186015 - DNA, 20 bp, Artificial Sequence
  chemically synthesized
cgttaagatgtattaaaaag

SEQ ID NO: 186016 - DNA, 20 bp, Artificial Sequence
  chemically synthesized
tttcgttaagatgtattaaa

SEQ ID NO: 186017 - DNA, 20 bp, Artificial Sequence
  chemically synthesized
tttttaatacatcttaacga

SEQ ID NO: 186018 - DNA, 20 bp, Artificial Sequence
  chemically synthesized
attgatgaatatctttcgtt

SEQ ID NO: 186019 - DNA, 20 bp, Artificial Sequence
  chemically synthesized
aacgaaagatattcatcaat

SEQ ID NO: 186020 - DNA, 20 bp, Artificial Sequence
  chemically synthesized
tattcatcaatgagttgttc

SEQ ID NO: 186021 - DNA, 20 bp, Artificial Sequence
  chemically synthesized
gattttaatattcaggaagc

SEQ ID NO: 186022 - DNA, 20 bp, Artificial Sequence
  chemically synthesized
ggtggattttaatattcagg

SEQ ID NO: 186023 - DNA, 20 bp, Artificial Sequence
  chemically synthesized
ataggtggattttaatattc

SEQ ID NO: 186024 - DNA, 20 bp, Artificial Sequence
  chemically synthesized
aataggtggattttaatatt

SEQ ID NO: 186025 - DNA, 20 bp, Artificial Sequence
  chemically synthesized
cccatcatccacataatagg

SEQ ID NO: 186026 - DNA, 20 bp, Artificial Sequence
  chemically synthesized
attaaaatccacctattatg

SEQ ID NO: 186027 - DNA, 20 bp, Artificial Sequence
  chemically synthesized
ccacccatcatccacataat

SEQ ID NO: 186028 - DNA, 20 bp, Artificial Sequence
  chemically synthesized
cccacccatcatccacataa

SEQ ID NO: 186029 - DNA, 20 bp, Artificial Sequence
  chemically synthesized
tccacctattatgtggatga

SEQ ID NO: 186030 - DNA, 20 bp, Artificial Sequence
  chemically synthesized
ccacctattatgtggatgat

SEQ ID NO: 186031 - DNA, 20 bp, Artificial Sequence
  chemically synthesized
cctattatgtggatgatggg

SEQ ID NO: 186032 - DNA, 20 bp, Artificial Sequence
  chemically synthesized
ctattatgtggatgatgggt

SEQ ID NO: 186033 - DNA, 20 bp, Artificial Sequence
  chemically synthesized
gtggatgatgggtgggatgc

SEQ ID NO: 186034 - DNA, 20 bp, Artificial Sequence
  chemically synthesized
ggatgatgggtgggatgcaa

SEQ ID NO: 186035 - DNA, 20 bp, Artificial Sequence
  chemically synthesized
atgggtgggatgcaagagct

SEQ ID NO: 186036 - DNA, 20 bp, Artificial Sequence
  chemically synthesized
gggatgcaagagcttggcaa

SEQ ID NO: 186037 - DNA, 20 bp, Artificial Sequence
  chemically synthesized
gaaaacttcgttcttttgcc

SEQ ID NO: 186038 - DNA, 20 bp, Artificial Sequence
  chemically synthesized
aagagcttggcaaaagaacg

SEQ ID NO: 186039 - DNA, 20 bp, Artificial Sequence
  chemically synthesized
gttttcattgttcataacaa

SEQ ID NO: 186040 - DNA, 20 bp, Artificial Sequence
  chemically synthesized
ttcataacaatagtctcatt

SEQ ID NO: 186041 - DNA, 20 bp, Artificial Sequence
  chemically synthesized
ttggcctttatttaccaaat

SEQ ID NO: 186042 - DNA, 20 bp, Artificial Sequence
  chemically synthesized
atagtctcatttggtaaata

SEQ ID NO: 186043 - DNA, 20 bp, Artificial Sequence
  chemically synthesized
tagtctcatttggtaaataa

SEQ ID NO: 186044 - DNA, 20 bp, Artificial Sequence
  chemically synthesized
tcatttggtaaataaaggcc

SEQ ID NO: 186045 - DNA, 20 bp, Artificial Sequence
  chemically synthesized
ttgtttcgtaaaggaagact

SEQ ID NO: 186046 - DNA, 20 bp, Artificial Sequence
  chemically synthesized
tgtgtcttgtttcgtaaagg

SEQ ID NO: 186047 - DNA, 20 bp, Artificial Sequence
  chemically synthesized
taatgtgtcttgtttcgtaa

SEQ ID NO: 186048 - DNA, 20 bp, Artificial Sequence
  chemically synthesized
ttaatgtgtcttgtttcgta

SEQ ID NO: 186049 - DNA, 20 bp, Artificial Sequence
  chemically synthesized
caagtcttcctttacgaaac

SEQ ID NO: 186050 - DNA, 20 bp, Artificial Sequence
  chemically synthesized
gacacattaacatcaacaac

SEQ ID NO: 186051 - DNA, 20 bp, Artificial Sequence
  chemically synthesized
acattaacatcaacaactgg

SEQ ID NO: 186052 - DNA, 20 bp, Artificial Sequence
  chemically synthesized
gggattttgtattatgcttc

SEQ ID NO: 186053 - DNA, 20 bp, Artificial Sequence
  chemically synthesized
agcctagagagtttataaat

SEQ ID NO: 186054 - DNA, 20 bp, Artificial Sequence
  chemically synthesized
aagcctagagagtttataaa

SEQ ID NO: 186055 - DNA, 20 bp, Artificial Sequence
  chemically synthesized
aatcccatttataaactctc

SEQ ID NO: 186056 - DNA, 20 bp, Artificial Sequence
  chemically synthesized
atcccatttataaactctct

SEQ ID NO: 186057 - DNA, 20 bp, Artificial Sequence
  chemically synthesized
ctgcagttggaaagcctaga

SEQ ID NO: 186058 - DNA, 20 bp, Artificial Sequence
  chemically synthesized
tgctgcagttggaaagccta

SEQ ID NO: 186059 - DNA, 20 bp, Artificial Sequence
  chemically synthesized
gctgctgcagttggaaagcc

SEQ ID NO: 186060 - DNA, 20 bp, Artificial Sequence
  chemically synthesized
tgcgtgctgctgcagttgga

SEQ ID NO: 186061 - DNA, 20 bp, Artificial Sequence
  chemically synthesized
ctctctaggctttccaactg

SEQ ID NO: 186062 - DNA, 20 bp, Artificial Sequence
  chemically synthesized
tctaggctttccaactgcag

SEQ ID NO: 186063 - DNA, 20 bp, Artificial Sequence
  chemically synthesized
caaatgcgtgctgctgcagt

SEQ ID NO: 186064 - DNA, 20 bp, Artificial Sequence
  chemically synthesized
aagccaaatgcgtgctgctg

SEQ ID NO: 186065 - DNA, 20 bp, Artificial Sequence
  chemically synthesized
caactgcagcagcacgcatt

SEQ ID NO: 186066 - DNA, 20 bp, Artificial Sequence
  chemically synthesized
gaatgtattgaaggcacaga

SEQ ID NO: 186067 - DNA, 20 bp, Artificial Sequence
  chemically synthesized
cttggaatgtattgaaggca

SEQ ID NO: 186068 - DNA, 20 bp, Artificial Sequence
  chemically synthesized
tttcccttggaatgtattga

SEQ ID NO: 186069 - DNA, 20 bp, Artificial Sequence
  chemically synthesized
atttcccttggaatgtattg

SEQ ID NO: 186070 - DNA, 20 bp, Artificial Sequence
  chemically synthesized
ctgtgccttcaatacattcc

SEQ ID NO: 186071 - DNA, 20 bp, Artificial Sequence
  chemically synthesized
tgtgccttcaatacattcca

SEQ ID NO: 186072 - DNA, 20 bp, Artificial Sequence
  chemically synthesized
gtgccttcaatacattccaa

SEQ ID NO: 186073 - DNA, 20 bp, Artificial Sequence
  chemically synthesized
atcatcatttaaatttccct

SEQ ID NO: 186074 - DNA, 20 bp, Artificial Sequence
  chemically synthesized
taaatgatgattgaatttga

SEQ ID NO: 186075 - DNA, 20 bp, Artificial Sequence
  chemically synthesized
aatttgacagtaaccttttt

SEQ ID NO: 186076 - DNA, 20 bp, Artificial Sequence
  chemically synthesized
atttgacagtaacctttttg

SEQ ID NO: 186077 - DNA, 20 bp, Artificial Sequence
  chemically synthesized
gggaaaacaaaacctcaaaa

SEQ ID NO: 186078 - DNA, 20 bp, Artificial Sequence
  chemically synthesized
ggggaaaacaaaacctcaaa

SEQ ID NO: 186079 - DNA, 20 bp, Artificial Sequence
  chemically synthesized
aaagaggtacaagtttaatg

SEQ ID NO: 186080 - DNA, 20 bp, Artificial Sequence
  chemically synthesized
caaagaggtacaagtttaat

SEQ ID NO: 186081 - DNA, 20 bp, Artificial Sequence
  chemically synthesized
ccaaagaggtacaagtttaa

SEQ ID NO: 186082 - DNA, 20 bp, Artificial Sequence
  chemically synthesized
aacttgagccaaagaggtac

SEQ ID NO: 186083 - DNA, 20 bp, Artificial Sequence
  chemically synthesized
ccattaaacttgtacctctt

SEQ ID NO: 186084 - DNA, 20 bp, Artificial Sequence
  chemically synthesized
aaggggaacttgagccaaag

SEQ ID NO: 186085 - DNA, 20 bp, Artificial Sequence
  chemically synthesized
gaaggggaacttgagccaaa

SEQ ID NO: 186086 - DNA, 20 bp, Artificial Sequence
  chemically synthesized
aacttgtacctctttggctc

SEQ ID NO: 186087 - DNA, 20 bp, Artificial Sequence
  chemically synthesized
ttgaaggggaacttgagcca

SEQ ID NO: 186088 - DNA, 20 bp, Artificial Sequence
  chemically synthesized
acattcttgaaggggaactt

SEQ ID NO: 186089 - DNA, 20 bp, Artificial Sequence
  chemically synthesized
tttggctcaagttccccttc

SEQ ID NO: 186090 - DNA, 20 bp, Artificial Sequence
  chemically synthesized
ttgtgaatacattcttgaag

SEQ ID NO: 186091 - DNA, 20 bp, Artificial Sequence
  chemically synthesized
tttgtgaatacattcttgaa

SEQ ID NO: 186092 - DNA, 20 bp, Artificial Sequence
  chemically synthesized
atttgtgaatacattcttga

SEQ ID NO: 186093 - DNA, 20 bp, Artificial Sequence
  chemically synthesized
catttgtgaatacattcttg

SEQ ID NO: 186094 - DNA, 20 bp, Artificial Sequence
  chemically synthesized
caagaatgtattcacaaatg

SEQ ID NO: 186095 - DNA, 20 bp, Artificial Sequence
  chemically synthesized
attcacaaatgtggtgaaac

SEQ ID NO: 186096 - DNA, 20 bp, Artificial Sequence
  chemically synthesized
tcacaaatgtggtgaaacta

SEQ ID NO: 186097 - DNA, 20 bp, Artificial Sequence
  chemically synthesized
cacaaatgtggtgaaactag

SEQ ID NO: 186098 - DNA, 20 bp, Artificial Sequence
  chemically synthesized
aatgtggtgaaactagaggt

SEQ ID NO: 186099 - DNA, 20 bp, Artificial Sequence
  chemically synthesized
gtgatagtgtcacttacctc

SEQ ID NO: 186100 - DNA, 20 bp, Artificial Sequence
  chemically synthesized
tatgaagctaaaaaaagtga

SEQ ID NO: 186101 - DNA, 20 bp, Artificial Sequence
  chemically synthesized
agtgacactatcactttttt

SEQ ID NO: 186102 - DNA, 20 bp, Artificial Sequence
  chemically synthesized
tatgactatgaagctaaaaa

SEQ ID NO: 186103 - DNA, 20 bp, Artificial Sequence
  chemically synthesized
tatcactttttttagcttca

SEQ ID NO: 186104 - DNA, 20 bp, Artificial Sequence
  chemically synthesized
tagctatgaatatgactatg

SEQ ID NO: 186105 - DNA, 20 bp, Artificial Sequence
  chemically synthesized
tagcttcatagtcatattca

SEQ ID NO: 186106 - DNA, 20 bp, Artificial Sequence
  chemically synthesized
tctttgcttagttttaaaaa

SEQ ID NO: 186107 - DNA, 20 bp, Artificial Sequence
  chemically synthesized
tcatagctatttttaaaact

SEQ ID NO: 186108 - DNA, 20 bp, Artificial Sequence
  chemically synthesized
gctatttttaaaactaagca

SEQ ID NO: 186109 - DNA, 20 bp, Artificial Sequence
  chemically synthesized
aggaaagacagatctttgct

SEQ ID NO: 186110 - DNA, 20 bp, Artificial Sequence
  chemically synthesized
tgattgttttgtaggaaaga

SEQ ID NO: 186111 - DNA, 20 bp, Artificial Sequence
  chemically synthesized
taaatgattgttttgtagga

SEQ ID NO: 186112 - DNA, 20 bp, Artificial Sequence
  chemically synthesized
attataaatgattgttttgt

SEQ ID NO: 186113 - DNA, 20 bp, Artificial Sequence
  chemically synthesized
aattataaatgattgttttg

SEQ ID NO: 186114 - DNA, 20 bp, Artificial Sequence
  chemically synthesized
tttttcaagaagattttaga

SEQ ID NO: 186115 - DNA, 20 bp, Artificial Sequence
  chemically synthesized
gttgtttttcaagaagattt

SEQ ID NO: 186116 - DNA, 20 bp, Artificial Sequence
  chemically synthesized
aatctcagttgtttttcaag

SEQ ID NO: 186117 - DNA, 20 bp, Artificial Sequence
  chemically synthesized
ctgaatctcagttgtttttc

SEQ ID NO: 186118 - DNA, 20 bp, Artificial Sequence
  chemically synthesized
aatcttcttgaaaaacaact

SEQ ID NO: 186119 - DNA, 20 bp, Artificial Sequence
  chemically synthesized
cttgaaaaacaactgagatt

SEQ ID NO: 186120 - DNA, 20 bp, Artificial Sequence
  chemically synthesized
aacttcaacaagctgaatct

SEQ ID NO: 186121 - DNA, 20 bp, Artificial Sequence
  chemically synthesized
aactgagattcagcttgttg

SEQ ID NO: 186122 - DNA, 20 bp, Artificial Sequence
  chemically synthesized
caatatattttaacttcaac

SEQ ID NO: 186123 - DNA, 20 bp, Artificial Sequence
  chemically synthesized
gttgaagttaaaatatattg

SEQ ID NO: 186124 - DNA, 20 bp, Artificial Sequence
  chemically synthesized
tattgaagatattcaccttt

SEQ ID NO: 186125 - DNA, 20 bp, Artificial Sequence
  chemically synthesized
aatcacccatgattgcttaa

SEQ ID NO: 186126 - DNA, 20 bp, Artificial Sequence
  chemically synthesized
aaatcacccatgattgctta

SEQ ID NO: 186127 - DNA, 20 bp, Artificial Sequence
  chemically synthesized
tattcacctttaagcaatca

SEQ ID NO: 186128 - DNA, 20 bp, Artificial Sequence
  chemically synthesized
attcacctttaagcaatcat

SEQ ID NO: 186129 - DNA, 20 bp, Artificial Sequence
  chemically synthesized
gcaatcatgggtgattttta

SEQ ID NO: 186130 - DNA, 20 bp, Artificial Sequence
  chemically synthesized
tgatttttaaagcaaacttc

SEQ ID NO: 186131 - DNA, 20 bp, Artificial Sequence
  chemically synthesized
tttctgctattttaaacttg

SEQ ID NO: 186132 - DNA, 20 bp, Artificial Sequence
  chemically synthesized
agcaaacttcaagtttaaaa

SEQ ID NO: 186133 - DNA, 20 bp, Artificial Sequence
  chemically synthesized
aaacttcaagtttaaaatag

SEQ ID NO: 186134 - DNA, 20 bp, Artificial Sequence
  chemically synthesized
aatagcagaaaaccactaac

SEQ ID NO: 186135 - DNA, 20 bp, Artificial Sequence
  chemically synthesized
atatacttgtggctagttag

SEQ ID NO: 186136 - DNA, 20 bp, Artificial Sequence
  chemically synthesized
aatatatacttgtggctagt

SEQ ID NO: 186137 - DNA, 20 bp, Artificial Sequence
  chemically synthesized
gaaaaccactaactagccac

SEQ ID NO: 186138 - DNA, 20 bp, Artificial Sequence
  chemically synthesized
ctaaaatatatacttgtggc

SEQ ID NO: 186139 - DNA, 20 bp, Artificial Sequence
  chemically synthesized
tatactaaaatatatacttg

SEQ ID NO: 186140 - DNA, 20 bp, Artificial Sequence
  chemically synthesized
ctagccacaagtatatattt

SEQ ID NO: 186141 - DNA, 20 bp, Artificial Sequence
  chemically synthesized
atattttagtatatgaaaaa

SEQ ID NO: 186142 - DNA, 20 bp, Artificial Sequence
  chemically synthesized
accattaatcaacagcagta

SEQ ID NO: 186143 - DNA, 20 bp, Artificial Sequence
  chemically synthesized
tatcaaccattaatcaacag

SEQ ID NO: 186144 - DNA, 20 bp, Artificial Sequence
  chemically synthesized
acctatcaaccattaatcaa

SEQ ID NO: 186145 - DNA, 20 bp, Artificial Sequence
  chemically synthesized
tctttactgctgttgattaa

SEQ ID NO: 186146 - DNA, 20 bp, Artificial Sequence
  chemically synthesized
tgctgttgattaatggttga

SEQ ID NO: 186147 - DNA, 20 bp, Artificial Sequence
  chemically synthesized
gctgttgattaatggttgat

SEQ ID NO: 186148 - DNA, 20 bp, Artificial Sequence
  chemically synthesized
gttgataggttctttaatgt

SEQ ID NO: 186149 - DNA, 20 bp, Artificial Sequence
  chemically synthesized
ggtgaaaggcactaacatta

SEQ ID NO: 186150 - DNA, 20 bp, Artificial Sequence
  chemically synthesized
gagattataagcagggtgaa

SEQ ID NO: 186151 - DNA, 20 bp, Artificial Sequence
  chemically synthesized
agagattataagcagggtga

SEQ ID NO: 186152 - DNA, 20 bp, Artificial Sequence
  chemically synthesized
ttcatgagagattataagca

SEQ ID NO: 186153 - DNA, 20 bp, Artificial Sequence
  chemically synthesized
tttcatgagagattataagc

SEQ ID NO: 186154 - DNA, 20 bp, Artificial Sequence
  chemically synthesized
atttcatgagagattataag

SEQ ID NO: 186155 - DNA, 20 bp, Artificial Sequence
  chemically synthesized
aatatttcatgagagattat

SEQ ID NO: 186156 - DNA, 20 bp, Artificial Sequence
  chemically synthesized
tttagaagaatatttcatga

SEQ ID NO: 186157 - DNA, 20 bp, Artificial Sequence
  chemically synthesized
tctttagaagaatatttcat

SEQ ID NO: 186158 - DNA, 20 bp, Artificial Sequence
  chemically synthesized
tctcatgaaatattcttcta

SEQ ID NO: 186159 - DNA, 20 bp, Artificial Sequence
  chemically synthesized
atgaaatattcttctaaaga

SEQ ID NO: 186160 - DNA, 20 bp, Artificial Sequence
  chemically synthesized
actttttaagctttctttag

SEQ ID NO: 186161 - DNA, 20 bp, Artificial Sequence
  chemically synthesized
cagactttttaagctttctt

SEQ ID NO: 186162 - DNA, 20 bp, Artificial Sequence
  chemically synthesized
tcttctaaagaaagcttaaa

SEQ ID NO: 186163 - DNA, 20 bp, Artificial Sequence
  chemically synthesized
aacattttagcagacttttt

SEQ ID NO: 186164 - DNA, 20 bp, Artificial Sequence
  chemically synthesized
taggaatgaaaacattttag

SEQ ID NO: 186165 - DNA, 20 bp, Artificial Sequence
  chemically synthesized
taataggaatgaaaacattt

SEQ ID NO: 186166 - DNA, 20 bp, Artificial Sequence
  chemically synthesized
taaaatgttttcattcctat

SEQ ID NO: 186167 - DNA, 20 bp, Artificial Sequence
  chemically synthesized
ggtagggcgacagatctaat

SEQ ID NO: 186168 - DNA, 20 bp, Artificial Sequence
  chemically synthesized
aggtagggcgacagatctaa

SEQ ID NO: 186169 - DNA, 20 bp, Artificial Sequence
  chemically synthesized
agaaaaaagaggtagggcga

SEQ ID NO: 186170 - DNA, 20 bp, Artificial Sequence
  chemically synthesized
tcagacagaaaaaagaggta

SEQ ID NO: 186171 - DNA, 20 bp, Artificial Sequence
  chemically synthesized
gtcagacagaaaaaagaggt

SEQ ID NO: 186172 - DNA, 20 bp, Artificial Sequence
  chemically synthesized
tgtcagacagaaaaaagagg

SEQ ID NO: 186173 - DNA, 20 bp, Artificial Sequence
  chemically synthesized
agctgtcagacagaaaaaag

SEQ ID NO: 186174 - DNA, 20 bp, Artificial Sequence
  chemically synthesized
cagctgtcagacagaaaaaa

SEQ ID NO: 186175 - DNA, 20 bp, Artificial Sequence
  chemically synthesized
aacagctgtcagacagaaaa

SEQ ID NO: 186176 - DNA, 20 bp, Artificial Sequence
  chemically synthesized
tacctcttttttctgtctga

SEQ ID NO: 186177 - DNA, 20 bp, Artificial Sequence
  chemically synthesized
gtctgcaaacagctgtcaga

SEQ ID NO: 186178 - DNA, 20 bp, Artificial Sequence
  chemically synthesized
ggaggtctgcaaacagctgt

SEQ ID NO: 186179 - DNA, 20 bp, Artificial Sequence
  chemically synthesized
ttctgtctgacagctgtttg

SEQ ID NO: 186180 - DNA, 20 bp, Artificial Sequence
  chemically synthesized
ggtggcaggaggtctgcaaa

SEQ ID NO: 186181 - DNA, 20 bp, Artificial Sequence
  chemically synthesized
cctgaatctgcggtggcagg

SEQ ID NO: 186182 - DNA, 20 bp, Artificial Sequence
  chemically synthesized
gcctgaatctgcggtggcag

SEQ ID NO: 186183 - DNA, 20 bp, Artificial Sequence
  chemically synthesized
ttgcagacctcctgccaccg

SEQ ID NO: 186184 - DNA, 20 bp, Artificial Sequence
  chemically synthesized
aagcctgaatctgcggtggc

SEQ ID NO: 186185 - DNA, 20 bp, Artificial Sequence
  chemically synthesized
gaagcctgaatctgcggtgg

SEQ ID NO: 186186 - DNA, 20 bp, Artificial Sequence
  chemically synthesized
tgggaagcctgaatctgcgg

SEQ ID NO: 186187 - DNA, 20 bp, Artificial Sequence
  chemically synthesized
acctcctgccaccgcagatt

SEQ ID NO: 186188 - DNA, 20 bp, Artificial Sequence
  chemically synthesized
cctcctgccaccgcagattc

SEQ ID NO: 186189 - DNA, 20 bp, Artificial Sequence
  chemically synthesized
aattgggaagcctgaatctg

SEQ ID NO: 186190 - DNA, 20 bp, Artificial Sequence
  chemically synthesized
attctacaggaaaaattggg

SEQ ID NO: 186191 - DNA, 20 bp, Artificial Sequence
  chemically synthesized
agtattctacaggaaaaatt

SEQ ID NO: 186192 - DNA, 20 bp, Artificial Sequence
  chemically synthesized
cagtattctacaggaaaaat

SEQ ID NO: 186193 - DNA, 20 bp, Artificial Sequence
  chemically synthesized
aggcttcccaatttttcctg

SEQ ID NO: 186194 - DNA, 20 bp, Artificial Sequence
  chemically synthesized
aacagatgccagtattctac

SEQ ID NO: 186195 - DNA, 20 bp, Artificial Sequence
  chemically synthesized
aaacagatgccagtattcta

SEQ ID NO: 186196 - DNA, 20 bp, Artificial Sequence
  chemically synthesized
caatttttcctgtagaatac

SEQ ID NO: 186197 - DNA, 20 bp, Artificial Sequence
  chemically synthesized
caatcctcaaaaacagatgc

SEQ ID NO: 186198 - DNA, 20 bp, Artificial Sequence
  chemically synthesized
gaatactggcatctgttttt

SEQ ID NO: 186199 - DNA, 20 bp, Artificial Sequence
  chemically synthesized
aatactggcatctgtttttg

SEQ ID NO: 186200 - DNA, 20 bp, Artificial Sequence
  chemically synthesized
aattcagcaatcctcaaaaa

SEQ ID NO: 186201 - DNA, 20 bp, Artificial Sequence
  chemically synthesized
caactggggaagaaataatt

SEQ ID NO: 186202 - DNA, 20 bp, Artificial Sequence
  chemically synthesized
ttgctgaattatttcttccc

SEQ ID NO: 186203 - DNA, 20 bp, Artificial Sequence
  chemically synthesized
aacattgaatgcaactgggg

SEQ ID NO: 186204 - DNA, 20 bp, Artificial Sequence
  chemically synthesized
cagaacattgaatgcaactg

SEQ ID NO: 186205 - DNA, 20 bp, Artificial Sequence
  chemically synthesized
tcagaacattgaatgcaact

SEQ ID NO: 186206 - DNA, 20 bp, Artificial Sequence
  chemically synthesized
gtcagaacattgaatgcaac

SEQ ID NO: 186207 - DNA, 20 bp, Artificial Sequence
  chemically synthesized
tgcattcaatgttctgacaa

SEQ ID NO: 186208 - DNA, 20 bp, Artificial Sequence
  chemically synthesized
gggcagcggcaaactgttgt

SEQ ID NO: 186209 - DNA, 20 bp, Artificial Sequence
  chemically synthesized
tccaggatggcattgggcag

SEQ ID NO: 186210 - DNA, 20 bp, Artificial Sequence
  chemically synthesized
aactccaggatggcattggg

SEQ ID NO: 186211 - DNA, 20 bp, Artificial Sequence
  chemically synthesized
aggaactccaggatggcatt

SEQ ID NO: 186212 - DNA, 20 bp, Artificial Sequence
  chemically synthesized
caggaactccaggatggcat

SEQ ID NO: 186213 - DNA, 20 bp, Artificial Sequence
  chemically synthesized
gccgctgcccaatgccatcc

SEQ ID NO: 186214 - DNA, 20 bp, Artificial Sequence
  chemically synthesized
cgctgcccaatgccatcctg

SEQ ID NO: 186215 - DNA, 20 bp, Artificial Sequence
  chemically synthesized
atcttacaggaactccagga

SEQ ID NO: 186216 - DNA, 20 bp, Artificial Sequence
  chemically synthesized
tggtatcttacaggaactcc

SEQ ID NO: 186217 - DNA, 20 bp, Artificial Sequence
  chemically synthesized
ttggtatcttacaggaactc

SEQ ID NO: 186218 - DNA, 20 bp, Artificial Sequence
  chemically synthesized
tgccatcctggagttcctgt

SEQ ID NO: 186219 - DNA, 20 bp, Artificial Sequence
  chemically synthesized
ttgcctttttggtatcttac

SEQ ID NO: 186220 - DNA, 20 bp, Artificial Sequence
  chemically synthesized
tttgcctttttggtatctta

SEQ ID NO: 186221 - DNA, 20 bp, Artificial Sequence
  chemically synthesized
agttcctgtaagataccaaa

SEQ ID NO: 186222 - DNA, 20 bp, Artificial Sequence
  chemically synthesized
gttcctgtaagataccaaaa

SEQ ID NO: 186223 - DNA, 20 bp, Artificial Sequence
  chemically synthesized
tcatttttgttttgcctttt

SEQ ID NO: 186224 - DNA, 20 bp, Artificial Sequence
  chemically synthesized
aaaaaggcaaaacaaaaatg

SEQ ID NO: 186225 - DNA, 20 bp, Artificial Sequence
  chemically synthesized
ttctcaaataaaaagacatg

SEQ ID NO: 186226 - DNA, 20 bp, Artificial Sequence
  chemically synthesized
tttctcaaataaaaagacat

SEQ ID NO: 186227 - DNA, 20 bp, Artificial Sequence
  chemically synthesized
ttttctcaaataaaaagaca

SEQ ID NO: 186228 - DNA, 20 bp, Artificial Sequence
  chemically synthesized
agccccatgtctttttattt

SEQ ID NO: 186229 - DNA, 20 bp, Artificial Sequence
  chemically synthesized
ttaatcttttctcaaataaa

SEQ ID NO: 186230 - DNA, 20 bp, Artificial Sequence
  chemically synthesized
catgtctttttatttgagaa

SEQ ID NO: 186231 - DNA, 20 bp, Artificial Sequence
  chemically synthesized
ttatttgagaaaagattaaa

SEQ ID NO: 186232 - DNA, 20 bp, Artificial Sequence
  chemically synthesized
aaacagtgtgctaccacatg

SEQ ID NO: 186233 - DNA, 20 bp, Artificial Sequence
  chemically synthesized
gccagtacaactgcatgtgg

SEQ ID NO: 186234 - DNA, 20 bp, Artificial Sequence
  chemically synthesized
tttgccagtacaactgcatg

SEQ ID NO: 186235 - DNA, 20 bp, Artificial Sequence
  chemically synthesized
gctaccacatgcagttgtac

SEQ ID NO: 186236 - DNA, 20 bp, Artificial Sequence
  chemically synthesized
cacatgcagttgtactggca

SEQ ID NO: 186237 - DNA, 20 bp, Artificial Sequence
  chemically synthesized
tgcagttgtactggcaaaga

SEQ ID NO: 186238 - DNA, 20 bp, Artificial Sequence
  chemically synthesized
ttttgtatttctttctttgc

SEQ ID NO: 186239 - DNA, 20 bp, Artificial Sequence
  chemically synthesized
tggcaaagaaagaaatacaa

SEQ ID NO: 186240 - DNA, 20 bp, Artificial Sequence
  chemically synthesized
catagggaaattttcacatg

SEQ ID NO: 186241 - DNA, 20 bp, Artificial Sequence
  chemically synthesized
ttcatagggaaattttcaca

SEQ ID NO: 186242 - DNA, 20 bp, Artificial Sequence
  chemically synthesized
atgggcatgtcagtttcata

SEQ ID NO: 186243 - DNA, 20 bp, Artificial Sequence
  chemically synthesized
tatgggcatgtcagtttcat

SEQ ID NO: 186244 - DNA, 20 bp, Artificial Sequence
  chemically synthesized
atatgggcatgtcagtttca

SEQ ID NO: 186245 - DNA, 20 bp, Artificial Sequence
  chemically synthesized
tcctttggatatgggcatgt

SEQ ID NO: 186246 - DNA, 20 bp, Artificial Sequence
  chemically synthesized
aactgacatgcccatatcca

SEQ ID NO: 186247 - DNA, 20 bp, Artificial Sequence
  chemically synthesized
gtcttgtatcctttggatat

SEQ ID NO: 186248 - DNA, 20 bp, Artificial Sequence
  chemically synthesized
actgacatgcccatatccaa

SEQ ID NO: 186249 - DNA, 20 bp, Artificial Sequence
  chemically synthesized
tgtcttgtatcctttggata

SEQ ID NO: 186250 - DNA, 20 bp, Artificial Sequence
  chemically synthesized
tctttctgtcttgtatcctt

SEQ ID NO: 186251 - DNA, 20 bp, Artificial Sequence
  chemically synthesized
tgcccatatccaaaggatac

SEQ ID NO: 186252 - DNA, 20 bp, Artificial Sequence
  chemically synthesized
catatccaaaggatacaaga

SEQ ID NO: 186253 - DNA, 20 bp, Artificial Sequence
  chemically synthesized
tccaaaggatacaagacaga

SEQ ID NO: 186254 - DNA, 20 bp, Artificial Sequence
  chemically synthesized
ttttttccctgacacataaa

SEQ ID NO: 186255 - DNA, 20 bp, Artificial Sequence
  chemically synthesized
cttttttccctgacacataa

SEQ ID NO: 186256 - DNA, 20 bp, Artificial Sequence
  chemically synthesized
gaaagacaccttttatgtgt

SEQ ID NO: 186257 - DNA, 20 bp, Artificial Sequence
  chemically synthesized
aaagacaccttttatgtgtc

SEQ ID NO: 186258 - DNA, 20 bp, Artificial Sequence
  chemically synthesized
aagacaccttttatgtgtca

SEQ ID NO: 186259 - DNA, 20 bp, Artificial Sequence
  chemically synthesized
cttttatgtgtcagggaaaa

SEQ ID NO: 186260 - DNA, 20 bp, Artificial Sequence
  chemically synthesized
cagggaaaaaagcaccctct

SEQ ID NO: 186261 - DNA, 20 bp, Artificial Sequence
  chemically synthesized
gaaaaaagcaccctctcggt

SEQ ID NO: 186262 - DNA, 20 bp, Artificial Sequence
  chemically synthesized
aaaactggagctaaccgaga

SEQ ID NO: 186263 - DNA, 20 bp, Artificial Sequence
  chemically synthesized
aaaaactggagctaaccgag

SEQ ID NO: 186264 - DNA, 20 bp, Artificial Sequence
  chemically synthesized
taaaaactggagctaaccga

SEQ ID NO: 186265 - DNA, 20 bp, Artificial Sequence
  chemically synthesized
aataaaaactggagctaacc

SEQ ID NO: 186266 - DNA, 20 bp, Artificial Sequence
  chemically synthesized
agcaccctctcggttagctc

SEQ ID NO: 186267 - DNA, 20 bp, Artificial Sequence
  chemically synthesized
gcttacaaaaataaaaactg

SEQ ID NO: 186268 - DNA, 20 bp, Artificial Sequence
  chemically synthesized
aagcttacaaaaataaaaac

SEQ ID NO: 186269 - DNA, 20 bp, Artificial Sequence
  chemically synthesized
gctccagtttttatttttgt

SEQ ID NO: 186270 - DNA, 20 bp, Artificial Sequence
  chemically synthesized
ttttatttttgtaagcttgt

SEQ ID NO: 186271 - DNA, 20 bp, Artificial Sequence
  chemically synthesized
atttttgtaagcttgtcagc

SEQ ID NO: 186272 - DNA, 20 bp, Artificial Sequence
  chemically synthesized
tataacatcctctagctgac

SEQ ID NO: 186273 - DNA, 20 bp, Artificial Sequence
  chemically synthesized
ttttgtaagcttgtcagcta

SEQ ID NO: 186274 - DNA, 20 bp, Artificial Sequence
  chemically synthesized
tttgtaagcttgtcagctag

SEQ ID NO: 186275 - DNA, 20 bp, Artificial Sequence
  chemically synthesized
taggacattataacatcctc

SEQ ID NO: 186276 - DNA, 20 bp, Artificial Sequence
  chemically synthesized
tttccaactaattgatttgt

SEQ ID NO: 186277 - DNA, 20 bp, Artificial Sequence
  chemically synthesized
gtttccaactaattgatttg

SEQ ID NO: 186278 - DNA, 20 bp, Artificial Sequence
  chemically synthesized
ataatgtcctacaaatcaat

SEQ ID NO: 186279 - DNA, 20 bp, Artificial Sequence
  chemically synthesized
tgtcctacaaatcaattagt

SEQ ID NO: 186280 - DNA, 20 bp, Artificial Sequence
  chemically synthesized
aattagttggaaaccttttc

SEQ ID NO: 186281 - DNA, 20 bp, Artificial Sequence
  chemically synthesized
ttagttggaaaccttttcaa

SEQ ID NO: 186282 - DNA, 20 bp, Artificial Sequence
  chemically synthesized
aatcgaatttgctcttgaaa

SEQ ID NO: 186283 - DNA, 20 bp, Artificial Sequence
  chemically synthesized
aaatcgaatttgctcttgaa

SEQ ID NO: 186284 - DNA, 20 bp, Artificial Sequence
  chemically synthesized
tggaacatccttgtggggac

SEQ ID NO: 186285 - DNA, 20 bp, Artificial Sequence
  chemically synthesized
attcgatttcttgtccccac

SEQ ID NO: 186286 - DNA, 20 bp, Artificial Sequence
  chemically synthesized
ttcgatttcttgtccccaca

SEQ ID NO: 186287 - DNA, 20 bp, Artificial Sequence
  chemically synthesized
aaacatggaacatccttgtg

SEQ ID NO: 186288 - DNA, 20 bp, Artificial Sequence
  chemically synthesized
taaacatggaacatccttgt

SEQ ID NO: 186289 - DNA, 20 bp, Artificial Sequence
  chemically synthesized
ttaaacatggaacatccttg

SEQ ID NO: 186290 - DNA, 20 bp, Artificial Sequence
  chemically synthesized
caaggatgttccatgtttaa

SEQ ID NO: 186291 - DNA, 20 bp, Artificial Sequence
  chemically synthesized
atttcatagactattaaaca

SEQ ID NO: 186292 - DNA, 20 bp, Artificial Sequence
  chemically synthesized
ttaaattttacaacatttca

SEQ ID NO: 186293 - DNA, 20 bp, Artificial Sequence
  chemically synthesized
gtaaaatttaaacatgaaca

SEQ ID NO: 186294 - DNA, 20 bp, Artificial Sequence
  chemically synthesized
ttaaacatgaacaaagtatt

SEQ ID NO: 186295 - DNA, 20 bp, Artificial Sequence
  chemically synthesized
taaacatgaacaaagtattt

SEQ ID NO: 186296 - DNA, 20 bp, Artificial Sequence
  chemically synthesized
aacaaagtatttgggtttct

SEQ ID NO: 186297 - DNA, 20 bp, Artificial Sequence
  chemically synthesized
ctctcgtatccacgatcact

SEQ ID NO: 186298 - DNA, 20 bp, Artificial Sequence
  chemically synthesized
tttgggtttcttagtgatcg

SEQ ID NO: 186299 - DNA, 20 bp, Artificial Sequence
  chemically synthesized
ttcttagtgatcgtggatac

SEQ ID NO: 186300 - DNA, 20 bp, Artificial Sequence
  chemically synthesized
cttagtgatcgtggatacga

SEQ ID NO: 186301 - DNA, 20 bp, Artificial Sequence
  chemically synthesized
ttagtgatcgtggatacgag

SEQ ID NO: 186302 - DNA, 20 bp, Artificial Sequence
  chemically synthesized
cgtggatacgagaggtgaaa

SEQ ID NO: 186303 - DNA, 20 bp, Artificial Sequence
  chemically synthesized
gaggtgaaaaagaacaaaca

SEQ ID NO: 186304 - DNA, 20 bp, Artificial Sequence
  chemically synthesized
aggtgaaaaagaacaaacat

SEQ ID NO: 186305 - DNA, 20 bp, Artificial Sequence
  chemically synthesized
gaaaaagaacaaacataggt

SEQ ID NO: 186306 - DNA, 20 bp, Artificial Sequence
  chemically synthesized
gaacaaacataggttagtca

SEQ ID NO: 186307 - DNA, 20 bp, Artificial Sequence
  chemically synthesized
acagtattaaaaaaaaactc

SEQ ID NO: 186308 - DNA, 20 bp, Artificial Sequence
  chemically synthesized
agtattaaaaaaaaactcta

SEQ ID NO: 186309 - DNA, 20 bp, Artificial Sequence
  chemically synthesized
attttatttaaatatctcta

SEQ ID NO: 186310 - DNA, 20 bp, Artificial Sequence
  chemically synthesized
taattttatttaaatatctc

SEQ ID NO: 186311 - DNA, 20 bp, Artificial Sequence
  chemically synthesized
aataaaattaattgctatat

SEQ ID NO: 186312 - DNA, 20 bp, Artificial Sequence
  chemically synthesized
aaaattaattgctatattag

SEQ ID NO: 186313 - DNA, 20 bp, Artificial Sequence
  chemically synthesized
aaatgaattttcttctaata

SEQ ID NO: 186314 - DNA, 20 bp, Artificial Sequence
  chemically synthesized
gcaaaatacattgacgcaga

SEQ ID NO: 186315 - DNA, 20 bp, Artificial Sequence
  chemically synthesized
taatgcaaaatacattgacg

SEQ ID NO: 186316 - DNA, 20 bp, Artificial Sequence
  chemically synthesized
tgcgtcaatgtattttgcat

SEQ ID NO: 186317 - DNA, 20 bp, Artificial Sequence
  chemically synthesized
gtcaatgtattttgcattag

SEQ ID NO: 186318 - DNA, 20 bp, Artificial Sequence
  chemically synthesized
aattaattctcagttttttg

SEQ ID NO: 186319 - DNA, 20 bp, Artificial Sequence
  chemically synthesized
attagaagccacaaaaaact

SEQ ID NO: 186320 - DNA, 20 bp, Artificial Sequence
  chemically synthesized
tcctgaaagcaattaattct

SEQ ID NO: 186321 - DNA, 20 bp, Artificial Sequence
  chemically synthesized
aactgagaattaattgcttt

SEQ ID NO: 186322 - DNA, 20 bp, Artificial Sequence
  chemically synthesized
actgagaattaattgctttc

SEQ ID NO: 186323 - DNA, 20 bp, Artificial Sequence
  chemically synthesized
tgagaattaattgctttcag

SEQ ID NO: 186324 - DNA, 20 bp, Artificial Sequence
  chemically synthesized
tcttgatgggatgctcctga

SEQ ID NO: 186325 - DNA, 20 bp, Artificial Sequence
  chemically synthesized
gctttcaggagcatcccatc

SEQ ID NO: 186326 - DNA, 20 bp, Artificial Sequence
  chemically synthesized
tagcttagggatatcttgat

SEQ ID NO: 186327 - DNA, 20 bp, Artificial Sequence
  chemically synthesized
gtagcttagggatatcttga

SEQ ID NO: 186328 - DNA, 20 bp, Artificial Sequence
  chemically synthesized
catcccatcaagatatccct

SEQ ID NO: 186329 - DNA, 20 bp, Artificial Sequence
  chemically synthesized
atcaagatatccctaagcta

SEQ ID NO: 186330 - DNA, 20 bp, Artificial Sequence
  chemically synthesized
aaatttattactgtagctta

SEQ ID NO: 186331 - DNA, 20 bp, Artificial Sequence
  chemically synthesized
aaaatttattactgtagctt

SEQ ID NO: 186332 - DNA, 20 bp, Artificial Sequence
  chemically synthesized
taaaatttattactgtagct

SEQ ID NO: 186333 - DNA, 20 bp, Artificial Sequence
  chemically synthesized
tattttaaaatttattactg

SEQ ID NO: 186334 - DNA, 20 bp, Artificial Sequence
  chemically synthesized
ataaattttaaaataatcta

SEQ ID NO: 186335 - DNA, 20 bp, Artificial Sequence
  chemically synthesized
ttaaaataatctatagtcac

SEQ ID NO: 186336 - DNA, 20 bp, Artificial Sequence
  chemically synthesized
taaaaatgctctggtgacta

SEQ ID NO: 186337 - DNA, 20 bp, Artificial Sequence
  chemically synthesized
aaaataatctatagtcacca

SEQ ID NO: 186338 - DNA, 20 bp, Artificial Sequence
  chemically synthesized
tgacaatcataaaaatgctc

SEQ ID NO: 186339 - DNA, 20 bp, Artificial Sequence
  chemically synthesized
agagcatttttatgattgtc

SEQ ID NO: 186340 - DNA, 20 bp, Artificial Sequence
  chemically synthesized
gaaaaaagtaaacaatattt

SEQ ID NO: 186341 - DNA, 20 bp, Artificial Sequence
  chemically synthesized
taaaatttcattcaggaaaa

SEQ ID NO: 186342 - DNA, 20 bp, Artificial Sequence
  chemically synthesized
ttactcttaaaatttcattc

SEQ ID NO: 186343 - DNA, 20 bp, Artificial Sequence
  chemically synthesized
tttactcttaaaatttcatt

SEQ ID NO: 186344 - DNA, 20 bp, Artificial Sequence
  chemically synthesized
tttttcctgaatgaaatttt

SEQ ID NO: 186345 - DNA, 20 bp, Artificial Sequence
  chemically synthesized
tttcctgaatgaaattttaa

SEQ ID NO: 186346 - DNA, 20 bp, Artificial Sequence
  chemically synthesized
tgaatgaaattttaagagta

SEQ ID NO: 186347 - DNA, 20 bp, Artificial Sequence
  chemically synthesized
aaattttaagagtaaagtat

SEQ ID NO: 186348 - DNA, 20 bp, Artificial Sequence
  chemically synthesized
agagtaaagtatcagaaaaa

SEQ ID NO: 186349 - DNA, 20 bp, Artificial Sequence
  chemically synthesized
agaaaaatagctcaattgaa

SEQ ID NO: 186350 - DNA, 20 bp, Artificial Sequence
  chemically synthesized
taatattctccttttcaatt

SEQ ID NO: 186351 - DNA, 20 bp, Artificial Sequence
  chemically synthesized
gaaaaatagctcaattgaaa

SEQ ID NO: 186352 - DNA, 20 bp, Artificial Sequence
  chemically synthesized
aaaatagctcaattgaaaag

SEQ ID NO: 186353 - DNA, 20 bp, Artificial Sequence
  chemically synthesized
aaaaggagaatattacaacc

SEQ ID NO: 186354 - DNA, 20 bp, Artificial Sequence
  chemically synthesized
tttttgtttttgtgtgtact

SEQ ID NO: 186355 - DNA, 20 bp, Artificial Sequence
  chemically synthesized
catttttatttaatggtaaa

SEQ ID NO: 186356 - DNA, 20 bp, Artificial Sequence
  chemically synthesized
taattgccatttttatttaa

SEQ ID NO: 186357 - DNA, 20 bp, Artificial Sequence
  chemically synthesized
tttttaccattaaataaaaa

SEQ ID NO: 186358 - DNA, 20 bp, Artificial Sequence
  chemically synthesized
atcttttttaaaaagttaaa

SEQ ID NO: 186359 - DNA, 20 bp, Artificial Sequence
  chemically synthesized
ttctatttaactttttaaaa

SEQ ID NO: 186360 - DNA, 20 bp, Artificial Sequence
  chemically synthesized
tctagattatcttttttaaa

SEQ ID NO: 186361 - DNA, 20 bp, Artificial Sequence
  chemically synthesized
actttttaaaaaagataatc

SEQ ID NO: 186362 - DNA, 20 bp, Artificial Sequence
  chemically synthesized
tttaatggccttacaaattc

SEQ ID NO: 186363 - DNA, 20 bp, Artificial Sequence
  chemically synthesized
aaagataatctagaatttgt

SEQ ID NO: 186364 - DNA, 20 bp, Artificial Sequence
  chemically synthesized
aagataatctagaatttgta

SEQ ID NO: 186365 - DNA, 20 bp, Artificial Sequence
  chemically synthesized
tagttaatatgttattttaa

SEQ ID NO: 186366 - DNA, 20 bp, Artificial Sequence
  chemically synthesized
cattttctaaggttcgtatt

SEQ ID NO: 186367 - DNA, 20 bp, Artificial Sequence
  chemically synthesized
tattaactaaatacgaacct

SEQ ID NO: 186368 - DNA, 20 bp, Artificial Sequence
  chemically synthesized
agatattatttcattttcta

SEQ ID NO: 186369 - DNA, 20 bp, Artificial Sequence
  chemically synthesized
cagatattatttcattttct

SEQ ID NO: 186370 - DNA, 20 bp, Artificial Sequence
  chemically synthesized
tagaaaatgaaataatatct

SEQ ID NO: 186371 - DNA, 20 bp, Artificial Sequence
  chemically synthesized
gaaataatatctgagaactt

SEQ ID NO: 186372 - DNA, 20 bp, Artificial Sequence
  chemically synthesized
cggtaggtacctcaagttct

SEQ ID NO: 186373 - DNA, 20 bp, Artificial Sequence
  chemically synthesized
aaataatatctgagaacttg

SEQ ID NO: 186374 - DNA, 20 bp, Artificial Sequence
  chemically synthesized
ttaaatacggtaggtacctc

SEQ ID NO: 186375 - DNA, 20 bp, Artificial Sequence
  chemically synthesized
cattcagatttaaatacggt

SEQ ID NO: 186376 - DNA, 20 bp, Artificial Sequence
  chemically synthesized
tcattcagatttaaatacgg

SEQ ID NO: 186377 - DNA, 20 bp, Artificial Sequence
  chemically synthesized
gagtcattcagatttaaata

SEQ ID NO: 186378 - DNA, 20 bp, Artificial Sequence
  chemically synthesized
acataaggatttgagtcatt

SEQ ID NO: 186379 - DNA, 20 bp, Artificial Sequence
  chemically synthesized
tgtcagtgacataaggattt

SEQ ID NO: 186380 - DNA, 20 bp, Artificial Sequence
  chemically synthesized
attattctgtcagtgacata

SEQ ID NO: 186381 - DNA, 20 bp, Artificial Sequence
  chemically synthesized
cattattctgtcagtgacat

SEQ ID NO: 186382 - DNA, 20 bp, Artificial Sequence
  chemically synthesized
tcaaatccttatgtcactga

SEQ ID NO: 186383 - DNA, 20 bp, Artificial Sequence
  chemically synthesized
acatacgcacattattctgt

SEQ ID NO: 186384 - DNA, 20 bp, Artificial Sequence
  chemically synthesized
gacagaataatgtgcgtatg

SEQ ID NO: 186385 - DNA, 20 bp, Artificial Sequence
  chemically synthesized
tatgtagaaaactctcctaa

SEQ ID NO: 186386 - DNA, 20 bp, Artificial Sequence
  chemically synthesized
atgaatcacatctattagga

SEQ ID NO: 186387 - DNA, 20 bp, Artificial Sequence
  chemically synthesized
atatgaatcacatctattag

SEQ ID NO: 186388 - DNA, 20 bp, Artificial Sequence
  chemically synthesized
gaatatgaatcacatctatt

SEQ ID NO: 186389 - DNA, 20 bp, Artificial Sequence
  chemically synthesized
agaatatgaatcacatctat

SEQ ID NO: 186390 - DNA, 20 bp, Artificial Sequence
  chemically synthesized
aggagaatacaaaaatatta

SEQ ID NO: 186391 - DNA, 20 bp, Artificial Sequence
  chemically synthesized
gtaggagaatacaaaaatat

SEQ ID NO: 186392 - DNA, 20 bp, Artificial Sequence
  chemically synthesized
gctattgtgtcaaggagtag

SEQ ID NO: 186393 - DNA, 20 bp, Artificial Sequence
  chemically synthesized
ttgctattgtgtcaaggagt

SEQ ID NO: 186394 - DNA, 20 bp, Artificial Sequence
  chemically synthesized
cttgctattgtgtcaaggag

SEQ ID NO: 186395 - DNA, 20 bp, Artificial Sequence
  chemically synthesized
cagcttgctattgtgtcaag

SEQ ID NO: 186396 - DNA, 20 bp, Artificial Sequence
  chemically synthesized
gtcagcttgctattgtgtca

SEQ ID NO: 186397 - DNA, 20 bp, Artificial Sequence
  chemically synthesized
tctcctactccttgacacaa

SEQ ID NO: 186398 - DNA, 20 bp, Artificial Sequence
  chemically synthesized
tgtcagcttgctattgtgtc

SEQ ID NO: 186399 - DNA, 20 bp, Artificial Sequence
  chemically synthesized
ctactccttgacacaatagc

SEQ ID NO: 186400 - DNA, 20 bp, Artificial Sequence
  chemically synthesized
ttgacacaatagcaagctga

SEQ ID NO: 186401 - DNA, 20 bp, Artificial Sequence
  chemically synthesized
acacaatagcaagctgacag

SEQ ID NO: 186402 - DNA, 20 bp, Artificial Sequence
  chemically synthesized
catgtactggggtctactgt

SEQ ID NO: 186403 - DNA, 20 bp, Artificial Sequence
  chemically synthesized
agcaagctgacagtagaccc

SEQ ID NO: 186404 - DNA, 20 bp, Artificial Sequence
  chemically synthesized
catttaggaagcatgtactg

SEQ ID NO: 186405 - DNA, 20 bp, Artificial Sequence
  chemically synthesized
tcatttaggaagcatgtact

SEQ ID NO: 186406 - DNA, 20 bp, Artificial Sequence
  chemically synthesized
ttcatttaggaagcatgtac

SEQ ID NO: 186407 - DNA, 20 bp, Artificial Sequence
  chemically synthesized
cattccttccttcatttagg

SEQ ID NO: 186408 - DNA, 20 bp, Artificial Sequence
  chemically synthesized
cagtacatgcttcctaaatg

SEQ ID NO: 186409 - DNA, 20 bp, Artificial Sequence
  chemically synthesized
agtacatgcttcctaaatga

SEQ ID NO: 186410 - DNA, 20 bp, Artificial Sequence
  chemically synthesized
atgcattccttccttcattt

SEQ ID NO: 186411 - DNA, 20 bp, Artificial Sequence
  chemically synthesized
catgcattccttccttcatt

SEQ ID NO: 186412 - DNA, 20 bp, Artificial Sequence
  chemically synthesized
acatgcttcctaaatgaagg

SEQ ID NO: 186413 - DNA, 20 bp, Artificial Sequence
  chemically synthesized
catgcttcctaaatgaagga

SEQ ID NO: 186414 - DNA, 20 bp, Artificial Sequence
  chemically synthesized
ggaaggaatgcatgttttct

SEQ ID NO: 186415 - DNA, 20 bp, Artificial Sequence
  chemically synthesized
aatgcatgttttctgagact

SEQ ID NO: 186416 - DNA, 20 bp, Artificial Sequence
  chemically synthesized
atgcatgttttctgagactg

SEQ ID NO: 186417 - DNA, 20 bp, Artificial Sequence
  chemically synthesized
agggagctttacctcagtct

SEQ ID NO: 186418 - DNA, 20 bp, Artificial Sequence
  chemically synthesized
tgttttctgagactgaggta

SEQ ID NO: 186419 - DNA, 20 bp, Artificial Sequence
  chemically synthesized
agtctaagggagctttacct

SEQ ID NO: 186420 - DNA, 20 bp, Artificial Sequence
  chemically synthesized
agactgaggtaaagctccct

SEQ ID NO: 186421 - DNA, 20 bp, Artificial Sequence
  chemically synthesized
tgtgaaacgagagtctaagg

SEQ ID NO: 186422 - DNA, 20 bp, Artificial Sequence
  chemically synthesized
tatgtgaaacgagagtctaa

SEQ ID NO: 186423 - DNA, 20 bp, Artificial Sequence
  chemically synthesized
gtatgtgaaacgagagtcta

SEQ ID NO: 186424 - DNA, 20 bp, Artificial Sequence
  chemically synthesized
tgtatgtgaaacgagagtct

SEQ ID NO: 186425 - DNA, 20 bp, Artificial Sequence
  chemically synthesized
aagaaatgtatgtgaaacga

SEQ ID NO: 186426 - DNA, 20 bp, Artificial Sequence
  chemically synthesized
ccaagaaatgtatgtgaaac

SEQ ID NO: 186427 - DNA, 20 bp, Artificial Sequence
  chemically synthesized
ctcgtttcacatacatttct

SEQ ID NO: 186428 - DNA, 20 bp, Artificial Sequence
  chemically synthesized
tgtagaaaaagaaaaaagcc

SEQ ID NO: 186429 - DNA, 20 bp, Artificial Sequence
  chemically synthesized
ttgaatgtagaaaaagaaaa

SEQ ID NO: 186430 - DNA, 20 bp, Artificial Sequence
  chemically synthesized
attttgcttgaatgtagaaa

SEQ ID NO: 186431 - DNA, 20 bp, Artificial Sequence
  chemically synthesized
ttttttctttttctacattc

SEQ ID NO: 186432 - DNA, 20 bp, Artificial Sequence
  chemically synthesized
aaaataattttgcttgaatg

SEQ ID NO: 186433 - DNA, 20 bp, Artificial Sequence
  chemically synthesized
gcaaaattattttcgaatac

SEQ ID NO: 186434 - DNA, 20 bp, Artificial Sequence
  chemically synthesized
ttttcgaatactggaaattt

SEQ ID NO: 186435 - DNA, 20 bp, Artificial Sequence
  chemically synthesized
ctgtatgctaccaaaatttc

SEQ ID NO: 186436 - DNA, 20 bp, Artificial Sequence
  chemically synthesized
tcgaatactggaaattttgg

SEQ ID NO: 186437 - DNA, 20 bp, Artificial Sequence
  chemically synthesized
ctggaaattttggtagcata

SEQ ID NO: 186438 - DNA, 20 bp, Artificial Sequence
  chemically synthesized
aaattttggtagcatacagt

SEQ ID NO: 186439 - DNA, 20 bp, Artificial Sequence
  chemically synthesized
aattaaaatactctgtaaat

SEQ ID NO: 186440 - DNA, 20 bp, Artificial Sequence
  chemically synthesized
caccggtttgctgatttaca

SEQ ID NO: 186441 - DNA, 20 bp, Artificial Sequence
  chemically synthesized
gtcaccggtttgctgattta

SEQ ID NO: 186442 - DNA, 20 bp, Artificial Sequence
  chemically synthesized
tactctgtaaatcagcaaac

SEQ ID NO: 186443 - DNA, 20 bp, Artificial Sequence
  chemically synthesized
aaatcagcaaaccggtgaca

SEQ ID NO: 186444 - DNA, 20 bp, Artificial Sequence
  chemically synthesized
attgtgaggcaccgtgtcac

SEQ ID NO: 186445 - DNA, 20 bp, Artificial Sequence
  chemically synthesized
atagttttatattcattgtg

SEQ ID NO: 186446 - DNA, 20 bp, Artificial Sequence
  chemically synthesized
catagttttatattcattgt

SEQ ID NO: 186447 - DNA, 20 bp, Artificial Sequence
  chemically synthesized
aatgaatataaaactatgca

SEQ ID NO: 186448 - DNA, 20 bp, Artificial Sequence
  chemically synthesized
aatagttcagtaactgtgca

SEQ ID NO: 186449 - DNA, 20 bp, Artificial Sequence
  chemically synthesized
aggacagcttgtgaatagtt

SEQ ID NO: 186450 - DNA, 20 bp, Artificial Sequence
  chemically synthesized
acagttactgaactattcac

SEQ ID NO: 186451 - DNA, 20 bp, Artificial Sequence
  chemically synthesized
tggccaggacagcttgtgaa

SEQ ID NO: 186452 - DNA, 20 bp, Artificial Sequence
  chemically synthesized
gaactattcacaagctgtcc

SEQ ID NO: 186453 - DNA, 20 bp, Artificial Sequence
  chemically synthesized
tcaagagagtatggccagga

SEQ ID NO: 186454 - DNA, 20 bp, Artificial Sequence
  chemically synthesized
gcattcaagagagtatggcc

SEQ ID NO: 186455 - DNA, 20 bp, Artificial Sequence
  chemically synthesized
ggcattcaagagagtatggc

SEQ ID NO: 186456 - DNA, 20 bp, Artificial Sequence
  chemically synthesized
catgggcattcaagagagta

SEQ ID NO: 186457 - DNA, 20 bp, Artificial Sequence
  chemically synthesized
catctcatgggcattcaaga

SEQ ID NO: 186458 - DNA, 20 bp, Artificial Sequence
  chemically synthesized
cacatctcatgggcattcaa

SEQ ID NO: 186459 - DNA, 20 bp, Artificial Sequence
  chemically synthesized
agcacatctcatgggcattc

SEQ ID NO: 186460 - DNA, 20 bp, Artificial Sequence
  chemically synthesized
atactctcttgaatgcccat

SEQ ID NO: 186461 - DNA, 20 bp, Artificial Sequence
  chemically synthesized
tttactagagcacatctcat

SEQ ID NO: 186462 - DNA, 20 bp, Artificial Sequence
  chemically synthesized
gtttactagagcacatctca

SEQ ID NO: 186463 - DNA, 20 bp, Artificial Sequence
  chemically synthesized
aatgcccatgagatgtgctc

SEQ ID NO: 186464 - DNA, 20 bp, Artificial Sequence
  chemically synthesized
gaaatatcacatgtttacta

SEQ ID NO: 186465 - DNA, 20 bp, Artificial Sequence
  chemically synthesized
aggaaatatcacatgtttac

SEQ ID NO: 186466 - DNA, 20 bp, Artificial Sequence
  chemically synthesized
atgtgatatttccttgtaac

SEQ ID NO: 186467 - DNA, 20 bp, Artificial Sequence
  chemically synthesized
agcaaagccaactagttaca

SEQ ID NO: 186468 - DNA, 20 bp, Artificial Sequence
  chemically synthesized
gagcaaagccaactagttac

SEQ ID NO: 186469 - DNA, 20 bp, Artificial Sequence
  chemically synthesized
gatatttccttgtaactagt

SEQ ID NO: 186470 - DNA, 20 bp, Artificial Sequence
  chemically synthesized
agcaatggagcaaagccaac

SEQ ID NO: 186471 - DNA, 20 bp, Artificial Sequence
  chemically synthesized
gagatgtaagcaatggagca

SEQ ID NO: 186472 - DNA, 20 bp, Artificial Sequence
  chemically synthesized
agagtgagatgtaagcaatg

SEQ ID NO: 186473 - DNA, 20 bp, Artificial Sequence
  chemically synthesized
aaagagtgagatgtaagcaa

SEQ ID NO: 186474 - DNA, 20 bp, Artificial Sequence
  chemically synthesized
ggtggtaaagagtgagatgt

SEQ ID NO: 186475 - DNA, 20 bp, Artificial Sequence
  chemically synthesized
ctgaacaggtggtaaagagt

SEQ ID NO: 186476 - DNA, 20 bp, Artificial Sequence
  chemically synthesized
tgatctgaacaggtggtaaa

SEQ ID NO: 186477 - DNA, 20 bp, Artificial Sequence
  chemically synthesized
gctgatctgaacaggtggta

SEQ ID NO: 186478 - DNA, 20 bp, Artificial Sequence
  chemically synthesized
ctcactctttaccacctgtt

SEQ ID NO: 186479 - DNA, 20 bp, Artificial Sequence
  chemically synthesized
gcaacgctgatctgaacagg

SEQ ID NO: 186480 - DNA, 20 bp, Artificial Sequence
  chemically synthesized
catgcaacgctgatctgaac

SEQ ID NO: 186481 - DNA, 20 bp, Artificial Sequence
  chemically synthesized
tctttaccacctgttcagat

SEQ ID NO: 186482 - DNA, 20 bp, Artificial Sequence
  chemically synthesized
acatgcaacgctgatctgaa

SEQ ID NO: 186483 - DNA, 20 bp, Artificial Sequence
  chemically synthesized
cagatcagcgttgcatgtga

SEQ ID NO: 186484 - DNA, 20 bp, Artificial Sequence
  chemically synthesized
tgcatgtgacagtcattgct

SEQ ID NO: 186485 - DNA, 20 bp, Artificial Sequence
  chemically synthesized
tgacagtcattgcttagtaa

SEQ ID NO: 186486 - DNA, 20 bp, Artificial Sequence
  chemically synthesized
acagtcattgcttagtaata

SEQ ID NO: 186487 - DNA, 20 bp, Artificial Sequence
  chemically synthesized
tgactggtgtctctattact

SEQ ID NO: 186488 - DNA, 20 bp, Artificial Sequence
  chemically synthesized
ttgcttagtaatagagacac

SEQ ID NO: 186489 - DNA, 20 bp, Artificial Sequence
  chemically synthesized
tagacacagtttgttatgac

SEQ ID NO: 186490 - DNA, 20 bp, Artificial Sequence
  chemically synthesized
accaacctaatatatagaca

SEQ ID NO: 186491 - DNA, 20 bp, Artificial Sequence
  chemically synthesized
aacaaactgtgtctatatat

SEQ ID NO: 186492 - DNA, 20 bp, Artificial Sequence
  chemically synthesized
acaaactgtgtctatatatt

SEQ ID NO: 186493 - DNA, 20 bp, Artificial Sequence
  chemically synthesized
ttttgcaccaacctaatata

SEQ ID NO: 186494 - DNA, 20 bp, Artificial Sequence
  chemically synthesized
actgtgtctatatattaggt

SEQ ID NO: 186495 - DNA, 20 bp, Artificial Sequence
  chemically synthesized
tatatattaggttggtgcaa

SEQ ID NO: 186496 - DNA, 20 bp, Artificial Sequence
  chemically synthesized
ggttggtgcaaaagtaatca

SEQ ID NO: 186497 - DNA, 20 bp, Artificial Sequence
  chemically synthesized
aatttatgatataaaagtaa

SEQ ID NO: 186498 - DNA, 20 bp, Artificial Sequence
  chemically synthesized
tcaaagaatttatgatataa

SEQ ID NO: 186499 - DNA, 20 bp, Artificial Sequence
  chemically synthesized
ttttatatcataaattcttt

SEQ ID NO: 186500 - DNA, 20 bp, Artificial Sequence
  chemically synthesized
tttatatcataaattctttg

SEQ ID NO: 186501 - DNA, 20 bp, Artificial Sequence
  chemically synthesized
tatcataaattctttgaggt

SEQ ID NO: 186502 - DNA, 20 bp, Artificial Sequence
  chemically synthesized
agacacaatatctgacctca

SEQ ID NO: 186503 - DNA, 20 bp, Artificial Sequence
  chemically synthesized
aataggaaactatcatgaat

SEQ ID NO: 186504 - DNA, 20 bp, Artificial Sequence
  chemically synthesized
atattgtgtcttattcatga

SEQ ID NO: 186505 - DNA, 20 bp, Artificial Sequence
  chemically synthesized
catgatagtttcctattgtt

SEQ ID NO: 186506 - DNA, 20 bp, Artificial Sequence
  chemically synthesized
cagacattgtactaaacaat

SEQ ID NO: 186507 - DNA, 20 bp, Artificial Sequence
  chemically synthesized
tcagacattgtactaaacaa

SEQ ID NO: 186508 - DNA, 20 bp, Artificial Sequence
  chemically synthesized
ttagtacaatgtctgatgca

SEQ ID NO: 186509 - DNA, 20 bp, Artificial Sequence
  chemically synthesized
tactgaaaccttccatgcat

SEQ ID NO: 186510 - DNA, 20 bp, Artificial Sequence
  chemically synthesized
gtacaatgtctgatgcatgg

SEQ ID NO: 186511 - DNA, 20 bp, Artificial Sequence
  chemically synthesized
tacaatgtctgatgcatgga

SEQ ID NO: 186512 - DNA, 20 bp, Artificial Sequence
  chemically synthesized
gtctgatgcatggaaggttt

SEQ ID NO: 186513 - DNA, 20 bp, Artificial Sequence
  chemically synthesized
gatgcatggaaggtttcagt

SEQ ID NO: 186514 - DNA, 20 bp, Artificial Sequence
  chemically synthesized
ggtttcagtaagcatttgct

SEQ ID NO: 186515 - DNA, 20 bp, Artificial Sequence
  chemically synthesized
catagattcatgcgttcact

SEQ ID NO: 186516 - DNA, 20 bp, Artificial Sequence
  chemically synthesized
gaacgcatgaatctatgaat

SEQ ID NO: 186517 - DNA, 20 bp, Artificial Sequence
  chemically synthesized
aacgcatgaatctatgaata

SEQ ID NO: 186518 - DNA, 20 bp, Artificial Sequence
  chemically synthesized
acgcatgaatctatgaataa

SEQ ID NO: 186519 - DNA, 20 bp, Artificial Sequence
  chemically synthesized
ttccccacttcccttattca

SEQ ID NO: 186520 - DNA, 20 bp, Artificial Sequence
  chemically synthesized
catgaatctatgaataaggg

SEQ ID NO: 186521 - DNA, 20 bp, Artificial Sequence
  chemically synthesized
gaatctatgaataagggaag

SEQ ID NO: 186522 - DNA, 20 bp, Artificial Sequence
  chemically synthesized
aatctatgaataagggaagt

SEQ ID NO: 186523 - DNA, 20 bp, Artificial Sequence
  chemically synthesized
atctatgaataagggaagtg

SEQ ID NO: 186524 - DNA, 20 bp, Artificial Sequence
  chemically synthesized
tatgaataagggaagtgggg

SEQ ID NO: 186525 - DNA, 20 bp, Artificial Sequence
  chemically synthesized
gaataagggaagtggggaag

SEQ ID NO: 186526 - DNA, 20 bp, Artificial Sequence
  chemically synthesized
taagggaagtggggaagaag

SEQ ID NO: 186527 - DNA, 20 bp, Artificial Sequence
  chemically synthesized
agggaagtggggaagaagcg

SEQ ID NO: 186528 - DNA, 20 bp, Artificial Sequence
  chemically synthesized
gggaagtggggaagaagcgg

SEQ ID NO: 186529 - DNA, 20 bp, Artificial Sequence
  chemically synthesized
ggaagtggggaagaagcgga

SEQ ID NO: 186530 - DNA, 20 bp, Artificial Sequence
  chemically synthesized
aagtggggaagaagcggagg

SEQ ID NO: 186531 - DNA, 20 bp, Artificial Sequence
  chemically synthesized
agtggggaagaagcggaggg

SEQ ID NO: 186532 - DNA, 20 bp, Artificial Sequence
  chemically synthesized
ggggaagaagcggagggagg

SEQ ID NO: 186533 - DNA, 20 bp, Artificial Sequence
  chemically synthesized
ggaagaagcggagggaggaa

SEQ ID NO: 186534 - DNA, 20 bp, Artificial Sequence
  chemically synthesized
aagaagcggagggaggaaga

SEQ ID NO: 186535 - DNA, 20 bp, Artificial Sequence
  chemically synthesized
agaagcggagggaggaagag

SEQ ID NO: 186536 - DNA, 20 bp, Artificial Sequence
  chemically synthesized
agcggagggaggaagagagg

SEQ ID NO: 186537 - DNA, 20 bp, Artificial Sequence
  chemically synthesized
gcggagggaggaagagagga

SEQ ID NO: 186538 - DNA, 20 bp, Artificial Sequence
  chemically synthesized
gggaggaagagaggaaggaa

SEQ ID NO: 186539 - DNA, 20 bp, Artificial Sequence
  chemically synthesized
gaggaagagaggaaggaatg

SEQ ID NO: 186540 - DNA, 20 bp, Artificial Sequence
  chemically synthesized
aggaagagaggaaggaatgg

SEQ ID NO: 186541 - DNA, 20 bp, Artificial Sequence
  chemically synthesized
aagagaggaaggaatggagg

SEQ ID NO: 186542 - DNA, 20 bp, Artificial Sequence
  chemically synthesized
aggaaggaatggaggaagaa

SEQ ID NO: 186543 - DNA, 20 bp, Artificial Sequence
  chemically synthesized
aaggaatggaggaagaaaag

SEQ ID NO: 186544 - DNA, 20 bp, Artificial Sequence
  chemically synthesized
aggaatggaggaagaaaaga

SEQ ID NO: 186545 - DNA, 20 bp, Artificial Sequence
  chemically synthesized
ggaatggaggaagaaaagaa

SEQ ID NO: 186546 - DNA, 20 bp, Artificial Sequence
  chemically synthesized
aatggaggaagaaaagaagg

SEQ ID NO: 186547 - DNA, 20 bp, Artificial Sequence
  chemically synthesized
atggaggaagaaaagaaggg

SEQ ID NO: 186548 - DNA, 20 bp, Artificial Sequence
  chemically synthesized
aggaagaaaagaagggagga

SEQ ID NO: 186549 - DNA, 20 bp, Artificial Sequence
  chemically synthesized
ggaagaaaagaagggaggaa

SEQ ID NO: 186550 - DNA, 20 bp, Artificial Sequence
  chemically synthesized
aagaaaagaagggaggaaag

SEQ ID NO: 186551 - DNA, 20 bp, Artificial Sequence
  chemically synthesized
gaaaagaagggaggaaagga

SEQ ID NO: 186552 - DNA, 20 bp, Artificial Sequence
  chemically synthesized
aaagaagggaggaaaggaga

SEQ ID NO: 186553 - DNA, 20 bp, Artificial Sequence
  chemically synthesized
aagaagggaggaaaggagag

SEQ ID NO: 186554 - DNA, 20 bp, Artificial Sequence
  chemically synthesized
aagggaggaaaggagagagg

SEQ ID NO: 186555 - DNA, 20 bp, Artificial Sequence
  chemically synthesized
gaggaaaggagagaggtaga

SEQ ID NO: 186556 - DNA, 20 bp, Artificial Sequence
  chemically synthesized
aaaggagagaggtagaaaga

SEQ ID NO: 186557 - DNA, 20 bp, Artificial Sequence
  chemically synthesized
aaggagagaggtagaaagaa

SEQ ID NO: 186558 - DNA, 20 bp, Artificial Sequence
  chemically synthesized
gagagaggtagaaagaaagg

SEQ ID NO: 186559 - DNA, 20 bp, Artificial Sequence
  chemically synthesized
agagaggtagaaagaaagga

SEQ ID NO: 186560 - DNA, 20 bp, Artificial Sequence
  chemically synthesized
gagaggtagaaagaaaggaa

SEQ ID NO: 186561 - DNA, 20 bp, Artificial Sequence
  chemically synthesized
gaggtagaaagaaaggaagg

SEQ ID NO: 186562 - DNA, 20 bp, Artificial Sequence
  chemically synthesized
aggtagaaagaaaggaaggg

SEQ ID NO: 186563 - DNA, 20 bp, Artificial Sequence
  chemically synthesized
tagaaagaaaggaagggagg

SEQ ID NO: 186564 - DNA, 20 bp, Artificial Sequence
  chemically synthesized
agaaaggaagggaggaagtt

SEQ ID NO: 186565 - DNA, 20 bp, Artificial Sequence
  chemically synthesized
gaaaggaagggaggaagttc

SEQ ID NO: 186566 - DNA, 20 bp, Artificial Sequence
  chemically synthesized
aatgactccatggtgatgat

SEQ ID NO: 186567 - DNA, 20 bp, Artificial Sequence
  chemically synthesized
gttcaggctcatcatcacca

SEQ ID NO: 186568 - DNA, 20 bp, Artificial Sequence
  chemically synthesized
tcaggctcatcatcaccatg

SEQ ID NO: 186569 - DNA, 20 bp, Artificial Sequence
  chemically synthesized
tattaatactaatgactcca

SEQ ID NO: 186570 - DNA, 20 bp, Artificial Sequence
  chemically synthesized
catcatcaccatggagtcat

SEQ ID NO: 186571 - DNA, 20 bp, Artificial Sequence
  chemically synthesized
tctctaggaggatcagtaat

SEQ ID NO: 186572 - DNA, 20 bp, Artificial Sequence
  chemically synthesized
atctctaggaggatcagtaa

SEQ ID NO: 186573 - DNA, 20 bp, Artificial Sequence
  chemically synthesized
atacccattactgatcctcc

SEQ ID NO: 186574 - DNA, 20 bp, Artificial Sequence
  chemically synthesized
atttgaatctctaggaggat

SEQ ID NO: 186575 - DNA, 20 bp, Artificial Sequence
  chemically synthesized
acccattactgatcctccta

SEQ ID NO: 186576 - DNA, 20 bp, Artificial Sequence
  chemically synthesized
tatttatttgaatctctagg

SEQ ID NO: 186577 - DNA, 20 bp, Artificial Sequence
  chemically synthesized
ttatttatttgaatctctag

SEQ ID NO: 186578 - DNA, 20 bp, Artificial Sequence
  chemically synthesized
gcttatttatttgaatctct

SEQ ID NO: 186579 - DNA, 20 bp, Artificial Sequence
  chemically synthesized
tgcttatttatttgaatctc

SEQ ID NO: 186580 - DNA, 20 bp, Artificial Sequence
  chemically synthesized
tcctagagattcaaataaat

SEQ ID NO: 186581 - DNA, 20 bp, Artificial Sequence
  chemically synthesized
aataaataagcacaattttc

SEQ ID NO: 186582 - DNA, 20 bp, Artificial Sequence
  chemically synthesized
ataaataagcacaattttct

SEQ ID NO: 186583 - DNA, 20 bp, Artificial Sequence
  chemically synthesized
aagcacaattttctaggtct

SEQ ID NO: 186584 - DNA, 20 bp, Artificial Sequence
  chemically synthesized
agcacaattttctaggtctt

SEQ ID NO: 186585 - DNA, 20 bp, Artificial Sequence
  chemically synthesized
attatgtactgcctaagacc

SEQ ID NO: 186586 - DNA, 20 bp, Artificial Sequence
  chemically synthesized
acaattttctaggtcttagg

SEQ ID NO: 186587 - DNA, 20 bp, Artificial Sequence
  chemically synthesized
aactagattatgtactgcct

SEQ ID NO: 186588 - DNA, 20 bp, Artificial Sequence
  chemically synthesized
gtcttaggcagtacataatc

SEQ ID NO: 186589 - DNA, 20 bp, Artificial Sequence
  chemically synthesized
ctgtgtcttattttttcaac

SEQ ID NO: 186590 - DNA, 20 bp, Artificial Sequence
  chemically synthesized
cataatctagttgaaaaaat

SEQ ID NO: 186591 - DNA, 20 bp, Artificial Sequence
  chemically synthesized
ctagttgaaaaaataagaca

SEQ ID NO: 186592 - DNA, 20 bp, Artificial Sequence
  chemically synthesized
aaaaaataagacacagttgc

SEQ ID NO: 186593 - DNA, 20 bp, Artificial Sequence
  chemically synthesized
ataatttgttatactacata

SEQ ID NO: 186594 - DNA, 20 bp, Artificial Sequence
  chemically synthesized
atttgttatactacatacag

SEQ ID NO: 186595 - DNA, 20 bp, Artificial Sequence
  chemically synthesized
tttttttatcctactgtatg

SEQ ID NO: 186596 - DNA, 20 bp, Artificial Sequence
  chemically synthesized
tttgttatactacatacagt

SEQ ID NO: 186597 - DNA, 20 bp, Artificial Sequence
  chemically synthesized
catacagtaggataaaaaaa

SEQ ID NO: 186598 - DNA, 20 bp, Artificial Sequence
  chemically synthesized
cagtaggataaaaaaaaagc

SEQ ID NO: 186599 - DNA, 20 bp, Artificial Sequence
  chemically synthesized
agtaggataaaaaaaaagca

SEQ ID NO: 186600 - DNA, 20 bp, Artificial Sequence
  chemically synthesized
aaagcaaggtgatcaacaaa

SEQ ID NO: 186601 - DNA, 20 bp, Artificial Sequence
  chemically synthesized
gcaaggtgatcaacaaatgg

SEQ ID NO: 186602 - DNA, 20 bp, Artificial Sequence
  chemically synthesized
caaggtgatcaacaaatggt

SEQ ID NO: 186603 - DNA, 20 bp, Artificial Sequence
  chemically synthesized
gtgatcaacaaatggtaggc

SEQ ID NO: 186604 - DNA, 20 bp, Artificial Sequence
  chemically synthesized
atcaacaaatggtaggccag

SEQ ID NO: 186605 - DNA, 20 bp, Artificial Sequence
  chemically synthesized
caacaaatggtaggccagaa

SEQ ID NO: 186606 - DNA, 20 bp, Artificial Sequence
  chemically synthesized
aacaaatggtaggccagaag

SEQ ID NO: 186607 - DNA, 20 bp, Artificial Sequence
  chemically synthesized
acaaatggtaggccagaaga

SEQ ID NO: 186608 - DNA, 20 bp, Artificial Sequence
  chemically synthesized
cactgagatcatccctcttc

SEQ ID NO: 186609 - DNA, 20 bp, Artificial Sequence
  chemically synthesized
ggccagaagagggatgatct

SEQ ID NO: 186610 - DNA, 20 bp, Artificial Sequence
  chemically synthesized
agagggatgatctcagtgaa

SEQ ID NO: 186611 - DNA, 20 bp, Artificial Sequence
  chemically synthesized
gagggatgatctcagtgaaa

SEQ ID NO: 186612 - DNA, 20 bp, Artificial Sequence
  chemically synthesized
ctccgctcatccttttcact

SEQ ID NO: 186613 - DNA, 20 bp, Artificial Sequence
  chemically synthesized
atgatctcagtgaaaaggat

SEQ ID NO: 186614 - DNA, 20 bp, Artificial Sequence
  chemically synthesized
atctcagtgaaaaggatgag

SEQ ID NO: 186615 - DNA, 20 bp, Artificial Sequence
  chemically synthesized
ctcagtgaaaaggatgagcg

SEQ ID NO: 186616 - DNA, 20 bp, Artificial Sequence
  chemically synthesized
tcagtgaaaaggatgagcgg

SEQ ID NO: 186617 - DNA, 20 bp, Artificial Sequence
  chemically synthesized
agtgaaaaggatgagcggag

SEQ ID NO: 186618 - DNA, 20 bp, Artificial Sequence
  chemically synthesized
ggatgagcggaggagacttc

SEQ ID NO: 186619 - DNA, 20 bp, Artificial Sequence
  chemically synthesized
gatgagcggaggagacttct

SEQ ID NO: 186620 - DNA, 20 bp, Artificial Sequence
  chemically synthesized
taaattccaaattgacccag

SEQ ID NO: 186621 - DNA, 20 bp, Artificial Sequence
  chemically synthesized
ctttaaattccaaattgacc

SEQ ID NO: 186622 - DNA, 20 bp, Artificial Sequence
  chemically synthesized
aggagacttctgggtcaatt

SEQ ID NO: 186623 - DNA, 20 bp, Artificial Sequence
  chemically synthesized
ctgggtcaatttggaattta

SEQ ID NO: 186624 - DNA, 20 bp, Artificial Sequence
  chemically synthesized
atttggaatttaaagaatcg

SEQ ID NO: 186625 - DNA, 20 bp, Artificial Sequence
  chemically synthesized
atttaaagaatcgtagaact

SEQ ID NO: 186626 - DNA, 20 bp, Artificial Sequence
  chemically synthesized
tttaaagaatcgtagaactt

SEQ ID NO: 186627 - DNA, 20 bp, Artificial Sequence
  chemically synthesized
aatcgtagaacttaggcata

SEQ ID NO: 186628 - DNA, 20 bp, Artificial Sequence
  chemically synthesized
ctctaaccctccatatgcct

SEQ ID NO: 186629 - DNA, 20 bp, Artificial Sequence
  chemically synthesized
tcgtagaacttaggcatatg

SEQ ID NO: 186630 - DNA, 20 bp, Artificial Sequence
  chemically synthesized
cgtagaacttaggcatatgg

SEQ ID NO: 186631 - DNA, 20 bp, Artificial Sequence
  chemically synthesized
gtagaacttaggcatatgga

SEQ ID NO: 186632 - DNA, 20 bp, Artificial Sequence
  chemically synthesized
aacttaggcatatggagggt

SEQ ID NO: 186633 - DNA, 20 bp, Artificial Sequence
  chemically synthesized
cttaggcatatggagggtta

SEQ ID NO: 186634 - DNA, 20 bp, Artificial Sequence
  chemically synthesized
ttaggcatatggagggttag

SEQ ID NO: 186635 - DNA, 20 bp, Artificial Sequence
  chemically synthesized
ggcatatggagggttagagg

SEQ ID NO: 186636 - DNA, 20 bp, Artificial Sequence
  chemically synthesized
tatggagggttagaggcagt

SEQ ID NO: 186637 - DNA, 20 bp, Artificial Sequence
  chemically synthesized
tggagggttagaggcagtga

SEQ ID NO: 186638 - DNA, 20 bp, Artificial Sequence
  chemically synthesized
ggttagaggcagtgagagta

SEQ ID NO: 186639 - DNA, 20 bp, Artificial Sequence
  chemically synthesized
tagaggcagtgagagtacgg

SEQ ID NO: 186640 - DNA, 20 bp, Artificial Sequence
  chemically synthesized
aggcagtgagagtacggcag

SEQ ID NO: 186641 - DNA, 20 bp, Artificial Sequence
  chemically synthesized
tgagagtacggcagaagtta

SEQ ID NO: 186642 - DNA, 20 bp, Artificial Sequence
  chemically synthesized
acggcagaagttaaagcctg

SEQ ID NO: 186643 - DNA, 20 bp, Artificial Sequence
  chemically synthesized
tcatggagattgcacaccac

SEQ ID NO: 186644 - DNA, 20 bp, Artificial Sequence
  chemically synthesized
atcatggagattgcacacca

SEQ ID NO: 186645 - DNA, 20 bp, Artificial Sequence
  chemically synthesized
atgctcttggtcacatcatg

SEQ ID NO: 186646 - DNA, 20 bp, Artificial Sequence
  chemically synthesized
ttatgctcttggtcacatca

SEQ ID NO: 186647 - DNA, 20 bp, Artificial Sequence
  chemically synthesized
gcaatctccatgatgtgacc

SEQ ID NO: 186648 - DNA, 20 bp, Artificial Sequence
  chemically synthesized
aatctccatgatgtgaccaa

SEQ ID NO: 186649 - DNA, 20 bp, Artificial Sequence
  chemically synthesized
agagcccagttttatgctct

SEQ ID NO: 186650 - DNA, 20 bp, Artificial Sequence
  chemically synthesized
tgtgaccaagagcataaaac

SEQ ID NO: 186651 - DNA, 20 bp, Artificial Sequence
  chemically synthesized
gtgaccaagagcataaaact

SEQ ID NO: 186652 - DNA, 20 bp, Artificial Sequence
  chemically synthesized
tcatacagtggcatagagcc

SEQ ID NO: 186653 - DNA, 20 bp, Artificial Sequence
  chemically synthesized
tgctctcatacagtggcata

SEQ ID NO: 186654 - DNA, 20 bp, Artificial Sequence
  chemically synthesized
cctgctctcatacagtggca

SEQ ID NO: 186655 - DNA, 20 bp, Artificial Sequence
  chemically synthesized
tgggctctatgccactgtat

SEQ ID NO: 186656 - DNA, 20 bp, Artificial Sequence
  chemically synthesized
taacgcctgctctcatacag

SEQ ID NO: 186657 - DNA, 20 bp, Artificial Sequence
  chemically synthesized
ggctctatgccactgtatga

SEQ ID NO: 186658 - DNA, 20 bp, Artificial Sequence
  chemically synthesized
ccctaacgcctgctctcata

SEQ ID NO: 186659 - DNA, 20 bp, Artificial Sequence
  chemically synthesized
tctatgccactgtatgagag

SEQ ID NO: 186660 - DNA, 20 bp, Artificial Sequence
  chemically synthesized
ctatgccactgtatgagagc

SEQ ID NO: 186661 - DNA, 20 bp, Artificial Sequence
  chemically synthesized
cactgtatgagagcaggcgt

SEQ ID NO: 186662 - DNA, 20 bp, Artificial Sequence
  chemically synthesized
actgtatgagagcaggcgtt

SEQ ID NO: 186663 - DNA, 20 bp, Artificial Sequence
  chemically synthesized
ctgtatgagagcaggcgtta

SEQ ID NO: 186664 - DNA, 20 bp, Artificial Sequence
  chemically synthesized
tgtatgagagcaggcgttag

SEQ ID NO: 186665 - DNA, 20 bp, Artificial Sequence
  chemically synthesized
tatgagagcaggcgttaggg

SEQ ID NO: 186666 - DNA, 20 bp, Artificial Sequence
  chemically synthesized
atgagagcaggcgttagggg

SEQ ID NO: 186667 - DNA, 20 bp, Artificial Sequence
  chemically synthesized
gagagcaggcgttaggggag

SEQ ID NO: 186668 - DNA, 20 bp, Artificial Sequence
  chemically synthesized
caggcgttaggggaggagta

SEQ ID NO: 186669 - DNA, 20 bp, Artificial Sequence
  chemically synthesized
taggggaggagtacagccct

SEQ ID NO: 186670 - DNA, 20 bp, Artificial Sequence
  chemically synthesized
caggccccaatatacaccga

SEQ ID NO: 186671 - DNA, 20 bp, Artificial Sequence
  chemically synthesized
ccaggccccaatatacaccg

SEQ ID NO: 186672 - DNA, 20 bp, Artificial Sequence
  chemically synthesized
cccaggccccaatatacacc

SEQ ID NO: 186673 - DNA, 20 bp, Artificial Sequence
  chemically synthesized
gtacagccctcggtgtatat

SEQ ID NO: 186674 - DNA, 20 bp, Artificial Sequence
  chemically synthesized
tacagccctcggtgtatatt

SEQ ID NO: 186675 - DNA, 20 bp, Artificial Sequence
  chemically synthesized
acagccctcggtgtatattg

SEQ ID NO: 186676 - DNA, 20 bp, Artificial Sequence
  chemically synthesized
cctcggtgtatattggggcc

SEQ ID NO: 186677 - DNA, 20 bp, Artificial Sequence
  chemically synthesized
ctcggtgtatattggggcct

SEQ ID NO: 186678 - DNA, 20 bp, Artificial Sequence
  chemically synthesized
ggtgtatattggggcctggg

SEQ ID NO: 186679 - DNA, 20 bp, Artificial Sequence
  chemically synthesized
tgtatattggggcctgggca

SEQ ID NO: 186680 - DNA, 20 bp, Artificial Sequence
  chemically synthesized
ttgcctcaagttctctgccc

SEQ ID NO: 186681 - DNA, 20 bp, Artificial Sequence
  chemically synthesized
gttgcctcaagttctctgcc

SEQ ID NO: 186682 - DNA, 20 bp, Artificial Sequence
  chemically synthesized
ggggcctgggcagagaactt

SEQ ID NO: 186683 - DNA, 20 bp, Artificial Sequence
  chemically synthesized
gggcctgggcagagaacttg

SEQ ID NO: 186684 - DNA, 20 bp, Artificial Sequence
  chemically synthesized
ttaataatttacgttgcctc

SEQ ID NO: 186685 - DNA, 20 bp, Artificial Sequence
  chemically synthesized
ttgaggcaacgtaaattatt

SEQ ID NO: 186686 - DNA, 20 bp, Artificial Sequence
  chemically synthesized
tgaggcaacgtaaattatta

SEQ ID NO: 186687 - DNA, 20 bp, Artificial Sequence
  chemically synthesized
ggcaacatgaactattacat

SEQ ID NO: 186688 - DNA, 20 bp, Artificial Sequence
  chemically synthesized
caatggtgattctcatgtaa

SEQ ID NO: 186689 - DNA, 20 bp, Artificial Sequence
  chemically synthesized
catgagaatcaccattgttt

SEQ ID NO: 186690 - DNA, 20 bp, Artificial Sequence
  chemically synthesized
tgcagtttattccaaaacaa

SEQ ID NO: 186691 - DNA, 20 bp, Artificial Sequence
  chemically synthesized
tcactgatgcttgcacgatg

SEQ ID NO: 186692 - DNA, 20 bp, Artificial Sequence
  chemically synthesized
tggaataaactgcatcgtgc

SEQ ID NO: 186693 - DNA, 20 bp, Artificial Sequence
  chemically synthesized
aaactgcatcgtgcaagcat

SEQ ID NO: 186694 - DNA, 20 bp, Artificial Sequence
  chemically synthesized
agcatcagtgactactgaaa

SEQ ID NO: 186695 - DNA, 20 bp, Artificial Sequence
  chemically synthesized
gcatcagtgactactgaaat

SEQ ID NO: 186696 - DNA, 20 bp, Artificial Sequence
  chemically synthesized
aaatttttttcccatttcag

SEQ ID NO: 186697 - DNA, 20 bp, Artificial Sequence
  chemically synthesized
gcaaaatttttttcccattt

SEQ ID NO: 186698 - DNA, 20 bp, Artificial Sequence
  chemically synthesized
aaaaaattttgcctaaaaca

SEQ ID NO: 186699 - DNA, 20 bp, Artificial Sequence
  chemically synthesized
ctccctgacatctatgtttt

SEQ ID NO: 186700 - DNA, 20 bp, Artificial Sequence
  chemically synthesized
cctccctgacatctatgttt

SEQ ID NO: 186701 - DNA, 20 bp, Artificial Sequence
  chemically synthesized
tttgcctaaaacatagatgt

SEQ ID NO: 186702 - DNA, 20 bp, Artificial Sequence
  chemically synthesized
ttgcctaaaacatagatgtc

SEQ ID NO: 186703 - DNA, 20 bp, Artificial Sequence
  chemically synthesized
tgcctaaaacatagatgtca

SEQ ID NO: 186704 - DNA, 20 bp, Artificial Sequence
  chemically synthesized
cctaaaacatagatgtcagg

SEQ ID NO: 186705 - DNA, 20 bp, Artificial Sequence
  chemically synthesized
ctaaaacatagatgtcaggg

SEQ ID NO: 186706 - DNA, 20 bp, Artificial Sequence
  chemically synthesized
atagatgtcagggaggtatt

SEQ ID NO: 186707 - DNA, 20 bp, Artificial Sequence
  chemically synthesized
agatgtcagggaggtattta

SEQ ID NO: 186708 - DNA, 20 bp, Artificial Sequence
  chemically synthesized
atgtcagggaggtatttaga

SEQ ID NO: 186709 - DNA, 20 bp, Artificial Sequence
  chemically synthesized
agggaggtatttagagagta

SEQ ID NO: 186710 - DNA, 20 bp, Artificial Sequence
  chemically synthesized
tatttagagagtaaagacca

SEQ ID NO: 186711 - DNA, 20 bp, Artificial Sequence
  chemically synthesized
gaaggaacaaataagagcca

SEQ ID NO: 186712 - DNA, 20 bp, Artificial Sequence
  chemically synthesized
actcttgaaggaacaaataa

SEQ ID NO: 186713 - DNA, 20 bp, Artificial Sequence
  chemically synthesized
acactcttgaaggaacaaat

SEQ ID NO: 186714 - DNA, 20 bp, Artificial Sequence
  chemically synthesized
tggctcttatttgttccttc

SEQ ID NO: 186715 - DNA, 20 bp, Artificial Sequence
  chemically synthesized
gctcttatttgttccttcaa

SEQ ID NO: 186716 - DNA, 20 bp, Artificial Sequence
  chemically synthesized
taagtattggacactcttga

SEQ ID NO: 186717 - DNA, 20 bp, Artificial Sequence
  chemically synthesized
gtaagtattggacactcttg

SEQ ID NO: 186718 - DNA, 20 bp, Artificial Sequence
  chemically synthesized
gaagtaatagttgtaagtat

SEQ ID NO: 186719 - DNA, 20 bp, Artificial Sequence
  chemically synthesized
aagtatgaagtaatagttgt

SEQ ID NO: 186720 - DNA, 20 bp, Artificial Sequence
  chemically synthesized
tttttaaaagtatgaagtaa

SEQ ID NO: 186721 - DNA, 20 bp, Artificial Sequence
  chemically synthesized
atgcattttttaaaagtatg

SEQ ID NO: 186722 - DNA, 20 bp, Artificial Sequence
  chemically synthesized
tgtgcccatgcattttttaa

SEQ ID NO: 186723 - DNA, 20 bp, Artificial Sequence
  chemically synthesized
tcatacttttaaaaaatgca

SEQ ID NO: 186724 - DNA, 20 bp, Artificial Sequence
  chemically synthesized
catacttttaaaaaatgcat

SEQ ID NO: 186725 - DNA, 20 bp, Artificial Sequence
  chemically synthesized
aaaaatgcatgggcacacat

SEQ ID NO: 186726 - DNA, 20 bp, Artificial Sequence
  chemically synthesized
cacacatcagatgtatacca

SEQ ID NO: 186727 - DNA, 20 bp, Artificial Sequence
  chemically synthesized
acatcagatgtataccatag

SEQ ID NO: 186728 - DNA, 20 bp, Artificial Sequence
  chemically synthesized
aagtctaggaagcaccgcta

SEQ ID NO: 186729 - DNA, 20 bp, Artificial Sequence
  chemically synthesized
tataccatagcggtgcttcc

SEQ ID NO: 186730 - DNA, 20 bp, Artificial Sequence
  chemically synthesized
tatgcgcattaaagtctagg

SEQ ID NO: 186731 - DNA, 20 bp, Artificial Sequence
  chemically synthesized
ttgtatgcgcattaaagtct

SEQ ID NO: 186732 - DNA, 20 bp, Artificial Sequence
  chemically synthesized
tttgtatgcgcattaaagtc

SEQ ID NO: 186733 - DNA, 20 bp, Artificial Sequence
  chemically synthesized
ggagatttgtatgcgcatta

SEQ ID NO: 186734 - DNA, 20 bp, Artificial Sequence
  chemically synthesized
taatgcgcatacaaatctcc

SEQ ID NO: 186735 - DNA, 20 bp, Artificial Sequence
  chemically synthesized
atgcgcatacaaatctcctg

SEQ ID NO: 186736 - DNA, 20 bp, Artificial Sequence
  chemically synthesized
cagtttagtaagatctccag

SEQ ID NO: 186737 - DNA, 20 bp, Artificial Sequence
  chemically synthesized
tgcagtttagtaagatctcc

SEQ ID NO: 186738 - DNA, 20 bp, Artificial Sequence
  chemically synthesized
ttgcagtttagtaagatctc

SEQ ID NO: 186739 - DNA, 20 bp, Artificial Sequence
  chemically synthesized
agcagaacttgcagtttagt

SEQ ID NO: 186740 - DNA, 20 bp, Artificial Sequence
  chemically synthesized
tggagatcttactaaactgc

SEQ ID NO: 186741 - DNA, 20 bp, Artificial Sequence
  chemically synthesized
atgcagcagaacttgcagtt

SEQ ID NO: 186742 - DNA, 20 bp, Artificial Sequence
  chemically synthesized
acctaatgcagcagaacttg

SEQ ID NO: 186743 - DNA, 20 bp, Artificial Sequence
  chemically synthesized
aactgcaagttctgctgcat

SEQ ID NO: 186744 - DNA, 20 bp, Artificial Sequence
  chemically synthesized
actgcaagttctgctgcatt

SEQ ID NO: 186745 - DNA, 20 bp, Artificial Sequence
  chemically synthesized
cctccacggacctaatgcag

SEQ ID NO: 186746 - DNA, 20 bp, Artificial Sequence
  chemically synthesized
gtgcctccacggacctaatg

SEQ ID NO: 186747 - DNA, 20 bp, Artificial Sequence
  chemically synthesized
gttctgctgcattaggtccg

SEQ ID NO: 186748 - DNA, 20 bp, Artificial Sequence
  chemically synthesized
tctgctgcattaggtccgtg

SEQ ID NO: 186749 - DNA, 20 bp, Artificial Sequence
  chemically synthesized
ctgctgcattaggtccgtgg

SEQ ID NO: 186750 - DNA, 20 bp, Artificial Sequence
  chemically synthesized
gcagaattttggtgcctcca

SEQ ID NO: 186751 - DNA, 20 bp, Artificial Sequence
  chemically synthesized
ttgtaggaaatgcagaattt

SEQ ID NO: 186752 - DNA, 20 bp, Artificial Sequence
  chemically synthesized
tttgaagtttgtaggaaatg

SEQ ID NO: 186753 - DNA, 20 bp, Artificial Sequence
  chemically synthesized
ggcatttttttgaagtttgt

SEQ ID NO: 186754 - DNA, 20 bp, Artificial Sequence
  chemically synthesized
tggcatttttttgaagtttg

SEQ ID NO: 186755 - DNA, 20 bp, Artificial Sequence
  chemically synthesized
gcagtattggcatttttttg

SEQ ID NO: 186756 - DNA, 20 bp, Artificial Sequence
  chemically synthesized
caaaaaaatgccaatactgc

SEQ ID NO: 186757 - DNA, 20 bp, Artificial Sequence
  chemically synthesized
tattcctggaccagcagtat

SEQ ID NO: 186758 - DNA, 20 bp, Artificial Sequence
  chemically synthesized
aaatgccaatactgctggtc

SEQ ID NO: 186759 - DNA, 20 bp, Artificial Sequence
  chemically synthesized
aatgccaatactgctggtcc

SEQ ID NO: 186760 - DNA, 20 bp, Artificial Sequence
  chemically synthesized
aagaggtattcctggaccag

SEQ ID NO: 186761 - DNA, 20 bp, Artificial Sequence
  chemically synthesized
tcaaagaggtattcctggac

SEQ ID NO: 186762 - DNA, 20 bp, Artificial Sequence
  chemically synthesized
acaactcaaagaggtattcc

SEQ ID NO: 186763 - DNA, 20 bp, Artificial Sequence
  chemically synthesized
tggtccaggaatacctcttt

SEQ ID NO: 186764 - DNA, 20 bp, Artificial Sequence
  chemically synthesized
cattaccttacaactcaaag

SEQ ID NO: 186765 - DNA, 20 bp, Artificial Sequence
  chemically synthesized
ccattaccttacaactcaaa

SEQ ID NO: 186766 - DNA, 20 bp, Artificial Sequence
  chemically synthesized
ctccattaccttacaactca

SEQ ID NO: 186767 - DNA, 20 bp, Artificial Sequence
  chemically synthesized
ggaatacctctttgagttgt

SEQ ID NO: 186768 - DNA, 20 bp, Artificial Sequence
  chemically synthesized
gaatacctctttgagttgta

SEQ ID NO: 186769 - DNA, 20 bp, Artificial Sequence
  chemically synthesized
ctctttgagttgtaaggtaa

SEQ ID NO: 186770 - DNA, 20 bp, Artificial Sequence
  chemically synthesized
ctttgagttgtaaggtaatg

SEQ ID NO: 186771 - DNA, 20 bp, Artificial Sequence
  chemically synthesized
taatggagtaaatgcctttt

SEQ ID NO: 186772 - DNA, 20 bp, Artificial Sequence
  chemically synthesized
ttgcttaacaaagactcaaa

SEQ ID NO: 186773 - DNA, 20 bp, Artificial Sequence
  chemically synthesized
attgcttaacaaagactcaa

SEQ ID NO: 186774 - DNA, 20 bp, Artificial Sequence
  chemically synthesized
atgccttttgagtctttgtt

SEQ ID NO: 186775 - DNA, 20 bp, Artificial Sequence
  chemically synthesized
aattccttgattgcttaaca

SEQ ID NO: 186776 - DNA, 20 bp, Artificial Sequence
  chemically synthesized
tgagtctttgttaagcaatc

SEQ ID NO: 186777 - DNA, 20 bp, Artificial Sequence
  chemically synthesized
gagtctttgttaagcaatca

SEQ ID NO: 186778 - DNA, 20 bp, Artificial Sequence
  chemically synthesized
atagcattataagcagcaat

SEQ ID NO: 186779 - DNA, 20 bp, Artificial Sequence
  chemically synthesized
ttagtttatagcattataag

SEQ ID NO: 186780 - DNA, 20 bp, Artificial Sequence
  chemically synthesized
gcattagtttatagcattat

SEQ ID NO: 186781 - DNA, 20 bp, Artificial Sequence
  chemically synthesized
aatgctgcagcattagttta

SEQ ID NO: 186782 - DNA, 20 bp, Artificial Sequence
  chemically synthesized
aatgctataaactaatgctg

SEQ ID NO: 186783 - DNA, 20 bp, Artificial Sequence
  chemically synthesized
agataaaaatgctgcagcat

SEQ ID NO: 186784 - DNA, 20 bp, Artificial Sequence
  chemically synthesized
aggctgagataaaaatgctg

SEQ ID NO: 186785 - DNA, 20 bp, Artificial Sequence
  chemically synthesized
atgctgcagcatttttatct

SEQ ID NO: 186786 - DNA, 20 bp, Artificial Sequence
  chemically synthesized
aactacaaagcaaagaggct

SEQ ID NO: 186787 - DNA, 20 bp, Artificial Sequence
  chemically synthesized
atcaaaactacaaagcaaag

SEQ ID NO: 186788 - DNA, 20 bp, Artificial Sequence
  chemically synthesized
gatcaaaactacaaagcaaa

SEQ ID NO: 186789 - DNA, 20 bp, Artificial Sequence
  chemically synthesized
atctcagcctctttgctttg

SEQ ID NO: 186790 - DNA, 20 bp, Artificial Sequence
  chemically synthesized
aagatcaaaactacaaagca

SEQ ID NO: 186791 - DNA, 20 bp, Artificial Sequence
  chemically synthesized
gtgccaagatcaaaactaca

SEQ ID NO: 186792 - DNA, 20 bp, Artificial Sequence
  chemically synthesized
ttgctttgtagttttgatct

SEQ ID NO: 186793 - DNA, 20 bp, Artificial Sequence
  chemically synthesized
agccatgaagcaaaagtgcc

SEQ ID NO: 186794 - DNA, 20 bp, Artificial Sequence
  chemically synthesized
agccatcagccatgaagcaa

SEQ ID NO: 186795 - DNA, 20 bp, Artificial Sequence
  chemically synthesized
atcttggcacttttgcttca

SEQ ID NO: 186796 - DNA, 20 bp, Artificial Sequence
  chemically synthesized
caccgtagccatcagccatg

SEQ ID NO: 186797 - DNA, 20 bp, Artificial Sequence
  chemically synthesized
cacttttgcttcatggctga

SEQ ID NO: 186798 - DNA, 20 bp, Artificial Sequence
  chemically synthesized
tgcttcatggctgatggcta

SEQ ID NO: 186799 - DNA, 20 bp, Artificial Sequence
  chemically synthesized
gtaaaagtcaccgtagccat

SEQ ID NO: 186800 - DNA, 20 bp, Artificial Sequence
  chemically synthesized
ttaggttgtaaaagtcaccg

SEQ ID NO: 186801 - DNA, 20 bp, Artificial Sequence
  chemically synthesized
attccacaattaggttgtaa

SEQ ID NO: 186802 - DNA, 20 bp, Artificial Sequence
  chemically synthesized
tgacttttacaacctaattg

SEQ ID NO: 186803 - DNA, 20 bp, Artificial Sequence
  chemically synthesized
ccattgctgattccacaatt

SEQ ID NO: 186804 - DNA, 20 bp, Artificial Sequence
  chemically synthesized
accattgctgattccacaat

SEQ ID NO: 186805 - DNA, 20 bp, Artificial Sequence
  chemically synthesized
ttacaacctaattgtggaat

SEQ ID NO: 186806 - DNA, 20 bp, Artificial Sequence
  chemically synthesized
cctaattgtggaatcagcaa

SEQ ID NO: 186807 - DNA, 20 bp, Artificial Sequence
  chemically synthesized
cagcaatggttttattattt

SEQ ID NO: 186808 - DNA, 20 bp, Artificial Sequence
  chemically synthesized
attatttcggtttcccaaat

SEQ ID NO: 186809 - DNA, 20 bp, Artificial Sequence
  chemically synthesized
tatttcggtttcccaaataa

SEQ ID NO: 186810 - DNA, 20 bp, Artificial Sequence
  chemically synthesized
ttcaattctatctcttattt

SEQ ID NO: 186811 - DNA, 20 bp, Artificial Sequence
  chemically synthesized
gttcaattctatctcttatt

SEQ ID NO: 186812 - DNA, 20 bp, Artificial Sequence
  chemically synthesized
tcggtttcccaaataagaga

SEQ ID NO: 186813 - DNA, 20 bp, Artificial Sequence
  chemically synthesized
aaataagagatagaattgaa

SEQ ID NO: 186814 - DNA, 20 bp, Artificial Sequence
  chemically synthesized
agagatagaattgaacagct

SEQ ID NO: 186815 - DNA, 20 bp, Artificial Sequence
  chemically synthesized
agatagaattgaacagctaa

SEQ ID NO: 186816 - DNA, 20 bp, Artificial Sequence
  chemically synthesized
gaattgaacagctaagagtg

SEQ ID NO: 186817 - DNA, 20 bp, Artificial Sequence
  chemically synthesized
ttaaattattgcttcactct

SEQ ID NO: 186818 - DNA, 20 bp, Artificial Sequence
  chemically synthesized
aagcaataatttaaaattgt

SEQ ID NO: 186819 - DNA, 20 bp, Artificial Sequence
  chemically synthesized
gattctatacaaatgagatt

SEQ ID NO: 186820 - DNA, 20 bp, Artificial Sequence
  chemically synthesized
agatctaaatctcatttgta

SEQ ID NO: 186821 - DNA, 20 bp, Artificial Sequence
  chemically synthesized
atttgcgattctatacaaat

SEQ ID NO: 186822 - DNA, 20 bp, Artificial Sequence
  chemically synthesized
atttgtatagaatcgcaaat

SEQ ID NO: 186823 - DNA, 20 bp, Artificial Sequence
  chemically synthesized
tttgtatagaatcgcaaatc

SEQ ID NO: 186824 - DNA, 20 bp, Artificial Sequence
  chemically synthesized
ttgtatagaatcgcaaatca

SEQ ID NO: 186825 - DNA, 20 bp, Artificial Sequence
  chemically synthesized
gaatcgcaaatcagggcttt

SEQ ID NO: 186826 - DNA, 20 bp, Artificial Sequence
  chemically synthesized
aatcgcaaatcagggctttc

SEQ ID NO: 186827 - DNA, 20 bp, Artificial Sequence
  chemically synthesized
acaaaattaaaaaaacctga

SEQ ID NO: 186828 - DNA, 20 bp, Artificial Sequence
  chemically synthesized
aggtttttttaattttgtga

SEQ ID NO: 186829 - DNA, 20 bp, Artificial Sequence
  chemically synthesized
tttttttaattttgtgaaag

SEQ ID NO: 186830 - DNA, 20 bp, Artificial Sequence
  chemically synthesized
tttttaattttgtgaaagaa

SEQ ID NO: 186831 - DNA, 20 bp, Artificial Sequence
  chemically synthesized
tgaaagaagagctcattaca

SEQ ID NO: 186832 - DNA, 20 bp, Artificial Sequence
  chemically synthesized
aatgcagtagactgtgtaat

SEQ ID NO: 186833 - DNA, 20 bp, Artificial Sequence
  chemically synthesized
accttctcatacaaatgcag

SEQ ID NO: 186834 - DNA, 20 bp, Artificial Sequence
  chemically synthesized
aaaaccttctcatacaaatg

SEQ ID NO: 186835 - DNA, 20 bp, Artificial Sequence
  chemically synthesized
acagtctactgcatttgtat

SEQ ID NO: 186836 - DNA, 20 bp, Artificial Sequence
  chemically synthesized
gtctactgcatttgtatgag

SEQ ID NO: 186837 - DNA, 20 bp, Artificial Sequence
  chemically synthesized
tctactgcatttgtatgaga

SEQ ID NO: 186838 - DNA, 20 bp, Artificial Sequence
  chemically synthesized
gtatgagaaggttttgcaac

SEQ ID NO: 186839 - DNA, 20 bp, Artificial Sequence
  chemically synthesized
tatgagaaggttttgcaacc

SEQ ID NO: 186840 - DNA, 20 bp, Artificial Sequence
  chemically synthesized
tgagaaggttttgcaaccag

SEQ ID NO: 186841 - DNA, 20 bp, Artificial Sequence
  chemically synthesized
tgcactgtaaatatttctcc

SEQ ID NO: 186842 - DNA, 20 bp, Artificial Sequence
  chemically synthesized
gcaaccaggagaaatattta

SEQ ID NO: 186843 - DNA, 20 bp, Artificial Sequence
  chemically synthesized
ggagaaatatttacagtgca

SEQ ID NO: 186844 - DNA, 20 bp, Artificial Sequence
  chemically synthesized
ttacagtgcatggcctgctc

SEQ ID NO: 186845 - DNA, 20 bp, Artificial Sequence
  chemically synthesized
tacagtgcatggcctgctca

SEQ ID NO: 186846 - DNA, 20 bp, Artificial Sequence
  chemically synthesized
cagtgcatggcctgctcaag

SEQ ID NO: 186847 - DNA, 20 bp, Artificial Sequence
  chemically synthesized
actgaaaactctccttgagc

SEQ ID NO: 186848 - DNA, 20 bp, Artificial Sequence
  chemically synthesized
cactgaaaactctccttgag

SEQ ID NO: 186849 - DNA, 20 bp, Artificial Sequence
  chemically synthesized
gtgcatggcctgctcaagga

SEQ ID NO: 186850 - DNA, 20 bp, Artificial Sequence
  chemically synthesized
tatcactgaaaactctcctt

SEQ ID NO: 186851 - DNA, 20 bp, Artificial Sequence
  chemically synthesized
gcctgctcaaggagagtttt

SEQ ID NO: 186852 - DNA, 20 bp, Artificial Sequence
  chemically synthesized
aaggagagttttcagtgata

SEQ ID NO: 186853 - DNA, 20 bp, Artificial Sequence
  chemically synthesized
agttttcagtgataaagcat

SEQ ID NO: 186854 - DNA, 20 bp, Artificial Sequence
  chemically synthesized
ttcagtgataaagcataaga

SEQ ID NO: 186855 - DNA, 20 bp, Artificial Sequence
  chemically synthesized
aaagcataagaaagaaaaat

SEQ ID NO: 186856 - DNA, 20 bp, Artificial Sequence
  chemically synthesized
aagcataagaaagaaaaata

SEQ ID NO: 186857 - DNA, 20 bp, Artificial Sequence
  chemically synthesized
agcataagaaagaaaaataa

SEQ ID NO: 186858 - DNA, 20 bp, Artificial Sequence
  chemically synthesized
agaaaaataagggatcaaaa

SEQ ID NO: 186859 - DNA, 20 bp, Artificial Sequence
  chemically synthesized
aaataagggatcaaaacaga

SEQ ID NO: 186860 - DNA, 20 bp, Artificial Sequence
  chemically synthesized
taagggatcaaaacagaaag

SEQ ID NO: 186861 - DNA, 20 bp, Artificial Sequence
  chemically synthesized
gggatcaaaacagaaagtag

SEQ ID NO: 186862 - DNA, 20 bp, Artificial Sequence
  chemically synthesized
agaaagtagtagcttgtatg

SEQ ID NO: 186863 - DNA, 20 bp, Artificial Sequence
  chemically synthesized
gctcagaaaacaccacatac

SEQ ID NO: 186864 - DNA, 20 bp, Artificial Sequence
  chemically synthesized
gcttgtatgtggtgttttct

SEQ ID NO: 186865 - DNA, 20 bp, Artificial Sequence
  chemically synthesized
gtatgtggtgttttctgagc

SEQ ID NO: 186866 - DNA, 20 bp, Artificial Sequence
  chemically synthesized
cagtgttatcttttccagct

SEQ ID NO: 186867 - DNA, 20 bp, Artificial Sequence
  chemically synthesized
tggtgttttctgagctggaa

SEQ ID NO: 186868 - DNA, 20 bp, Artificial Sequence
  chemically synthesized
aaacccagtgttatcttttc

SEQ ID NO: 186869 - DNA, 20 bp, Artificial Sequence
  chemically synthesized
tgagctggaaaagataacac

SEQ ID NO: 186870 - DNA, 20 bp, Artificial Sequence
  chemically synthesized
gagctggaaaagataacact

SEQ ID NO: 186871 - DNA, 20 bp, Artificial Sequence
  chemically synthesized
tacatttaattttgtaaacc

SEQ ID NO: 186872 - DNA, 20 bp, Artificial Sequence
  chemically synthesized
ctgtgtgaataaagttgatt

SEQ ID NO: 186873 - DNA, 20 bp, Artificial Sequence
  chemically synthesized
tgttgttcactgtgtgaata

SEQ ID NO: 186874 - DNA, 20 bp, Artificial Sequence
  chemically synthesized
ctcaatcaactttattcaca

SEQ ID NO: 186875 - DNA, 20 bp, Artificial Sequence
  chemically synthesized
attaattaattttaattcta

SEQ ID NO: 186876 - DNA, 20 bp, Artificial Sequence
  chemically synthesized
cttaaaatatttagaagcta

SEQ ID NO: 186877 - DNA, 20 bp, Artificial Sequence
  chemically synthesized
tcagtacttaaaatatttag

SEQ ID NO: 186878 - DNA, 20 bp, Artificial Sequence
  chemically synthesized
aattcagtacttaaaatatt

SEQ ID NO: 186879 - DNA, 20 bp, Artificial Sequence
  chemically synthesized
ctatagcttctaaatatttt

SEQ ID NO: 186880 - DNA, 20 bp, Artificial Sequence
  chemically synthesized
tttattggtaatgaataatt

SEQ ID NO: 186881 - DNA, 20 bp, Artificial Sequence
  chemically synthesized
tcaaagcttggaaattttat

SEQ ID NO: 186882 - DNA, 20 bp, Artificial Sequence
  chemically synthesized
tcattaccaataaaatttcc

SEQ ID NO: 186883 - DNA, 20 bp, Artificial Sequence
  chemically synthesized
attaatatgatatcaaagct

SEQ ID NO: 186884 - DNA, 20 bp, Artificial Sequence
  chemically synthesized
agtacattaatatgatatca

SEQ ID NO: 186885 - DNA, 20 bp, Artificial Sequence
  chemically synthesized
atattaatgtactgctgtca

SEQ ID NO: 186886 - DNA, 20 bp, Artificial Sequence
  chemically synthesized
tattaatgtactgctgtcat

SEQ ID NO: 186887 - DNA, 20 bp, Artificial Sequence
  chemically synthesized
gataagaatgcctatgacag

SEQ ID NO: 186888 - DNA, 20 bp, Artificial Sequence
  chemically synthesized
atagataagaatgcctatga

SEQ ID NO: 186889 - DNA, 20 bp, Artificial Sequence
  chemically synthesized
taattgccagagaaatagat

SEQ ID NO: 186890 - DNA, 20 bp, Artificial Sequence
  chemically synthesized
ggcattcttatctatttctc

SEQ ID NO: 186891 - DNA, 20 bp, Artificial Sequence
  chemically synthesized
gatgttaattgccagagaaa

SEQ ID NO: 186892 - DNA, 20 bp, Artificial Sequence
  chemically synthesized
agactagatgttaattgcca

SEQ ID NO: 186893 - DNA, 20 bp, Artificial Sequence
  chemically synthesized
caagactagatgttaattgc

SEQ ID NO: 186894 - DNA, 20 bp, Artificial Sequence
  chemically synthesized
tttctctggcaattaacatc

SEQ ID NO: 186895 - DNA, 20 bp, Artificial Sequence
  chemically synthesized
tggcaattaacatctagtct

SEQ ID NO: 186896 - DNA, 20 bp, Artificial Sequence
  chemically synthesized
tttttgtccagaaccaagac

SEQ ID NO: 186897 - DNA, 20 bp, Artificial Sequence
  chemically synthesized
ttaacatctagtcttggttc

SEQ ID NO: 186898 - DNA, 20 bp, Artificial Sequence
  chemically synthesized
ttttctttttgtccagaacc

SEQ ID NO: 186899 - DNA, 20 bp, Artificial Sequence
  chemically synthesized
tagtcttggttctggacaaa

SEQ ID NO: 186900 - DNA, 20 bp, Artificial Sequence
  chemically synthesized
attatgattttctttttgtc

SEQ ID NO: 186901 - DNA, 20 bp, Artificial Sequence
  chemically synthesized
aaaatcataattaaatctgt

SEQ ID NO: 186902 - DNA, 20 bp, Artificial Sequence
  chemically synthesized
aactatgatgaataatccaa

SEQ ID NO: 186903 - DNA, 20 bp, Artificial Sequence
  chemically synthesized
atctgttggattattcatca

SEQ ID NO: 186904 - DNA, 20 bp, Artificial Sequence
  chemically synthesized
gttggattattcatcatagt

SEQ ID NO: 186905 - DNA, 20 bp, Artificial Sequence
  chemically synthesized
gattattcatcatagttaga

SEQ ID NO: 186906 - DNA, 20 bp, Artificial Sequence
  chemically synthesized
tattggaatcaaaacacaat

SEQ ID NO: 186907 - DNA, 20 bp, Artificial Sequence
  chemically synthesized
tgtgttttgattccaatatt

SEQ ID NO: 186908 - DNA, 20 bp, Artificial Sequence
  chemically synthesized
taagaatgaatgcttaatat

SEQ ID NO: 186909 - DNA, 20 bp, Artificial Sequence
  chemically synthesized
attaagcattcattcttaat

SEQ ID NO: 186910 - DNA, 20 bp, Artificial Sequence
  chemically synthesized
aagcattcattcttaataag

SEQ ID NO: 186911 - DNA, 20 bp, Artificial Sequence
  chemically synthesized
ttagatatgcacttcttatt

SEQ ID NO: 186912 - DNA, 20 bp, Artificial Sequence
  chemically synthesized
aagtgcatatctaactcccg

SEQ ID NO: 186913 - DNA, 20 bp, Artificial Sequence
  chemically synthesized
gaaaagctccccacgggagt

SEQ ID NO: 186914 - DNA, 20 bp, Artificial Sequence
  chemically synthesized
agtgcatatctaactcccgt

SEQ ID NO: 186915 - DNA, 20 bp, Artificial Sequence
  chemically synthesized
gtgcatatctaactcccgtg

SEQ ID NO: 186916 - DNA, 20 bp, Artificial Sequence
  chemically synthesized
gcatatctaactcccgtggg

SEQ ID NO: 186917 - DNA, 20 bp, Artificial Sequence
  chemically synthesized
ttttgaaaagctccccacgg

SEQ ID NO: 186918 - DNA, 20 bp, Artificial Sequence
  chemically synthesized
tattttgaaaagctccccac

SEQ ID NO: 186919 - DNA, 20 bp, Artificial Sequence
  chemically synthesized
atattttgaaaagctcccca

SEQ ID NO: 186920 - DNA, 20 bp, Artificial Sequence
  chemically synthesized
ctgggcttttatattttgaa

SEQ ID NO: 186921 - DNA, 20 bp, Artificial Sequence
  chemically synthesized
gggagcttttcaaaatataa

SEQ ID NO: 186922 - DNA, 20 bp, Artificial Sequence
  chemically synthesized
cttttcaaaatataaaagcc

SEQ ID NO: 186923 - DNA, 20 bp, Artificial Sequence
  chemically synthesized
tagacttagaatggaattct

SEQ ID NO: 186924 - DNA, 20 bp, Artificial Sequence
  chemically synthesized
gtagacttagaatggaattc

SEQ ID NO: 186925 - DNA, 20 bp, Artificial Sequence
  chemically synthesized
aaagcccagaattccattct

SEQ ID NO: 186926 - DNA, 20 bp, Artificial Sequence
  chemically synthesized
ctgattcagtagacttagaa

SEQ ID NO: 186927 - DNA, 20 bp, Artificial Sequence
  chemically synthesized
aaattctgattcagtagact

SEQ ID NO: 186928 - DNA, 20 bp, Artificial Sequence
  chemically synthesized
ccattctaagtctactgaat

SEQ ID NO: 186929 - DNA, 20 bp, Artificial Sequence
  chemically synthesized
ccccagaaattctgattcag

SEQ ID NO: 186930 - DNA, 20 bp, Artificial Sequence
  chemically synthesized
tgtccccagaaattctgatt

SEQ ID NO: 186931 - DNA, 20 bp, Artificial Sequence
  chemically synthesized
gtctactgaatcagaatttc

SEQ ID NO: 186932 - DNA, 20 bp, Artificial Sequence
  chemically synthesized
tctactgaatcagaatttct

SEQ ID NO: 186933 - DNA, 20 bp, Artificial Sequence
  chemically synthesized
ctactgaatcagaatttctg

SEQ ID NO: 186934 - DNA, 20 bp, Artificial Sequence
  chemically synthesized
aatcagaatttctggggaca

SEQ ID NO: 186935 - DNA, 20 bp, Artificial Sequence
  chemically synthesized
atcagaatttctggggacaa

SEQ ID NO: 186936 - DNA, 20 bp, Artificial Sequence
  chemically synthesized
ctttcatatacctttgtccc

SEQ ID NO: 186937 - DNA, 20 bp, Artificial Sequence
  chemically synthesized
ctggggacaaaggtatatga

SEQ ID NO: 186938 - DNA, 20 bp, Artificial Sequence
  chemically synthesized
ggggacaaaggtatatgaaa

SEQ ID NO: 186939 - DNA, 20 bp, Artificial Sequence
  chemically synthesized
atgaaagagatacactaaaa

SEQ ID NO: 186940 - DNA, 20 bp, Artificial Sequence
  chemically synthesized
aagagatacactaaaaaaga

SEQ ID NO: 186941 - DNA, 20 bp, Artificial Sequence
  chemically synthesized
gtaacctcccctttcttttt

SEQ ID NO: 186942 - DNA, 20 bp, Artificial Sequence
  chemically synthesized
agagatacactaaaaaagaa

SEQ ID NO: 186943 - DNA, 20 bp, Artificial Sequence
  chemically synthesized
gagatacactaaaaaagaaa

SEQ ID NO: 186944 - DNA, 20 bp, Artificial Sequence
  chemically synthesized
agatacactaaaaaagaaag

SEQ ID NO: 186945 - DNA, 20 bp, Artificial Sequence
  chemically synthesized
atacactaaaaaagaaaggg

SEQ ID NO: 186946 - DNA, 20 bp, Artificial Sequence
  chemically synthesized
tacactaaaaaagaaagggg

SEQ ID NO: 186947 - DNA, 20 bp, Artificial Sequence
  chemically synthesized
ggggaggttacaaacatgtg

SEQ ID NO: 186948 - DNA, 20 bp, Artificial Sequence
  chemically synthesized
ggaggttacaaacatgtgca

SEQ ID NO: 186949 - DNA, 20 bp, Artificial Sequence
  chemically synthesized
aggttacaaacatgtgcaga

SEQ ID NO: 186950 - DNA, 20 bp, Artificial Sequence
  chemically synthesized
tacaaacatgtgcagagagt

SEQ ID NO: 186951 - DNA, 20 bp, Artificial Sequence
  chemically synthesized
acaaacatgtgcagagagtt

SEQ ID NO: 186952 - DNA, 20 bp, Artificial Sequence
  chemically synthesized
aacatgtgcagagagttggg

SEQ ID NO: 186953 - DNA, 20 bp, Artificial Sequence
  chemically synthesized
atgtgcagagagttgggaag

SEQ ID NO: 186954 - DNA, 20 bp, Artificial Sequence
  chemically synthesized
tgtgcagagagttgggaagc

SEQ ID NO: 186955 - DNA, 20 bp, Artificial Sequence
  chemically synthesized
gcagagagttgggaagcagg

SEQ ID NO: 186956 - DNA, 20 bp, Artificial Sequence
  chemically synthesized
cagagagttgggaagcagga

SEQ ID NO: 186957 - DNA, 20 bp, Artificial Sequence
  chemically synthesized
tgggaagcaggaaggacatg

SEQ ID NO: 186958 - DNA, 20 bp, Artificial Sequence
  chemically synthesized
aagagaagttgaaaataata

SEQ ID NO: 186959 - DNA, 20 bp, Artificial Sequence
  chemically synthesized
tgacttaaaaagcagaagag

SEQ ID NO: 186960 - DNA, 20 bp, Artificial Sequence
  chemically synthesized
ttttgacttaaaaagcagaa

SEQ ID NO: 186961 - DNA, 20 bp, Artificial Sequence
  chemically synthesized
gcttttgacttaaaaagcag

SEQ ID NO: 186962 - DNA, 20 bp, Artificial Sequence
  chemically synthesized
caacttctcttctgcttttt

SEQ ID NO: 186963 - DNA, 20 bp, Artificial Sequence
  chemically synthesized
acagcttttgacttaaaaag

SEQ ID NO: 186964 - DNA, 20 bp, Artificial Sequence
  chemically synthesized
ggaacagcttttgacttaaa

SEQ ID NO: 186965 - DNA, 20 bp, Artificial Sequence
  chemically synthesized
tcttctgctttttaagtcaa

SEQ ID NO: 186966 - DNA, 20 bp, Artificial Sequence
  chemically synthesized
tattttctataatttaggaa

SEQ ID NO: 186967 - DNA, 20 bp, Artificial Sequence
  chemically synthesized
caaaagctgttcctaaatta

SEQ ID NO: 186968 - DNA, 20 bp, Artificial Sequence
  chemically synthesized
agtgttattttctataattt

SEQ ID NO: 186969 - DNA, 20 bp, Artificial Sequence
  chemically synthesized
cagtgttattttctataatt

SEQ ID NO: 186970 - DNA, 20 bp, Artificial Sequence
  chemically synthesized
tgaaggacttagatatgtaa

SEQ ID NO: 186971 - DNA, 20 bp, Artificial Sequence
  chemically synthesized
aataacactgttacatatct

SEQ ID NO: 186972 - DNA, 20 bp, Artificial Sequence
  chemically synthesized
ttgaccagacttgaaggact

SEQ ID NO: 186973 - DNA, 20 bp, Artificial Sequence
  chemically synthesized
gttacatatctaagtccttc

SEQ ID NO: 186974 - DNA, 20 bp, Artificial Sequence
  chemically synthesized
atatctaagtccttcaagtc

SEQ ID NO: 186975 - DNA, 20 bp, Artificial Sequence
  chemically synthesized
cccaatttgaccagacttga

SEQ ID NO: 186976 - DNA, 20 bp, Artificial Sequence
  chemically synthesized
ccccaatttgaccagacttg

SEQ ID NO: 186977 - DNA, 20 bp, Artificial Sequence
  chemically synthesized
tccttcaagtctggtcaaat

SEQ ID NO: 186978 - DNA, 20 bp, Artificial Sequence
  chemically synthesized
tttccttcccccaatttgac

SEQ ID NO: 186979 - DNA, 20 bp, Artificial Sequence
  chemically synthesized
ccttcaagtctggtcaaatt

SEQ ID NO: 186980 - DNA, 20 bp, Artificial Sequence
  chemically synthesized
cttcaagtctggtcaaattg

SEQ ID NO: 186981 - DNA, 20 bp, Artificial Sequence
  chemically synthesized
ttcaagtctggtcaaattgg

SEQ ID NO: 186982 - DNA, 20 bp, Artificial Sequence
  chemically synthesized
aagtctggtcaaattggggg

SEQ ID NO: 186983 - DNA, 20 bp, Artificial Sequence
  chemically synthesized
agtctggtcaaattggggga

SEQ ID NO: 186984 - DNA, 20 bp, Artificial Sequence
  chemically synthesized
tggtcaaattgggggaagga

SEQ ID NO: 186985 - DNA, 20 bp, Artificial Sequence
  chemically synthesized
gtcaaattgggggaaggaaa

SEQ ID NO: 186986 - DNA, 20 bp, Artificial Sequence
  chemically synthesized
tcaaattgggggaaggaaag

SEQ ID NO: 186987 - DNA, 20 bp, Artificial Sequence
  chemically synthesized
ggggaaggaaagaggaaaca

SEQ ID NO: 186988 - DNA, 20 bp, Artificial Sequence
  chemically synthesized
gggaaggaaagaggaaacat

SEQ ID NO: 186989 - DNA, 20 bp, Artificial Sequence
  chemically synthesized
ggaaagaggaaacataggca

SEQ ID NO: 186990 - DNA, 20 bp, Artificial Sequence
  chemically synthesized
agaggaaacataggcaaaga

SEQ ID NO: 186991 - DNA, 20 bp, Artificial Sequence
  chemically synthesized
gtataaaaataaaaatgtag

SEQ ID NO: 186992 - DNA, 20 bp, Artificial Sequence
  chemically synthesized
cctgtataaaaataaaaatg

SEQ ID NO: 186993 - DNA, 20 bp, Artificial Sequence
  chemically synthesized
gctacatttttatttttata

SEQ ID NO: 186994 - DNA, 20 bp, Artificial Sequence
  chemically synthesized
ctacatttttatttttatac

SEQ ID NO: 186995 - DNA, 20 bp, Artificial Sequence
  chemically synthesized
tacatttttatttttataca

SEQ ID NO: 186996 - DNA, 20 bp, Artificial Sequence
  chemically synthesized
atttttatttttatacaggg

SEQ ID NO: 186997 - DNA, 20 bp, Artificial Sequence
  chemically synthesized
tttttatttttatacaggga

SEQ ID NO: 186998 - DNA, 20 bp, Artificial Sequence
  chemically synthesized
ttttatacagggaaggatat

SEQ ID NO: 186999 - DNA, 20 bp, Artificial Sequence
  chemically synthesized
acagggaaggatataagaaa

SEQ ID NO: 187000 - DNA, 20 bp, Artificial Sequence
  chemically synthesized
tgttttcatagaaaaggtag

SEQ ID NO: 187001 - DNA, 20 bp, Artificial Sequence
  chemically synthesized
taatgttttcatagaaaagg

SEQ ID NO: 187002 - DNA, 20 bp, Artificial Sequence
  chemically synthesized
acgtaatgttttcatagaaa

SEQ ID NO: 187003 - DNA, 20 bp, Artificial Sequence
  chemically synthesized
tacgtaatgttttcatagaa

SEQ ID NO: 187004 - DNA, 20 bp, Artificial Sequence
  chemically synthesized
aaatgtacgtaatgttttca

SEQ ID NO: 187005 - DNA, 20 bp, Artificial Sequence
  chemically synthesized
cattacgtacatttttttaa

SEQ ID NO: 187006 - DNA, 20 bp, Artificial Sequence
  chemically synthesized
gttttggaaagttttacaaa

SEQ ID NO: 187007 - DNA, 20 bp, Artificial Sequence
  chemically synthesized
tgttttcatgcagttttgga

SEQ ID NO: 187008 - DNA, 20 bp, Artificial Sequence
  chemically synthesized
attgtgttttcatgcagttt

SEQ ID NO: 187009 - DNA, 20 bp, Artificial Sequence
  chemically synthesized
tcatctattgtgttttcatg

SEQ ID NO: 187010 - DNA, 20 bp, Artificial Sequence
  chemically synthesized
aaaactgcatgaaaacacaa

SEQ ID NO: 187011 - DNA, 20 bp, Artificial Sequence
  chemically synthesized
aaaacacaatagatgaaaaa

SEQ ID NO: 187012 - DNA, 20 bp, Artificial Sequence
  chemically synthesized
aaaatagaatgtgacaaatg

SEQ ID NO: 187013 - DNA, 20 bp, Artificial Sequence
  chemically synthesized
agaatgtgacaaatgaagaa

SEQ ID NO: 187014 - DNA, 20 bp, Artificial Sequence
  chemically synthesized
gaatgtgacaaatgaagaaa

SEQ ID NO: 187015 - DNA, 20 bp, Artificial Sequence
  chemically synthesized
gacaaatgaagaaaaggaat

SEQ ID NO: 187016 - DNA, 20 bp, Artificial Sequence
  chemically synthesized
atgaagaaaaggaataagct

SEQ ID NO: 187017 - DNA, 20 bp, Artificial Sequence
  chemically synthesized
aagaaaaggaataagctaag

SEQ ID NO: 187018 - DNA, 20 bp, Artificial Sequence
  chemically synthesized
aaaaggaataagctaagaag

SEQ ID NO: 187019 - DNA, 20 bp, Artificial Sequence
  chemically synthesized
aatttcttataactgcttct

SEQ ID NO: 187020 - DNA, 20 bp, Artificial Sequence
  chemically synthesized
ataagctaagaagcagttat

SEQ ID NO: 187021 - DNA, 20 bp, Artificial Sequence
  chemically synthesized
tataagaaattgtacaatga

SEQ ID NO: 187022 - DNA, 20 bp, Artificial Sequence
  chemically synthesized
gaaattgtacaatgacagat

SEQ ID NO: 187023 - DNA, 20 bp, Artificial Sequence
  chemically synthesized
gacagattggatgaattatg

SEQ ID NO: 187024 - DNA, 20 bp, Artificial Sequence
  chemically synthesized
acagattggatgaattatgt

SEQ ID NO: 187025 - DNA, 20 bp, Artificial Sequence
  chemically synthesized
ttatgtaggaaataaaaaat

SEQ ID NO: 187026 - DNA, 20 bp, Artificial Sequence
  chemically synthesized
attggcaaaaaatcacaaac

SEQ ID NO: 187027 - DNA, 20 bp, Artificial Sequence
  chemically synthesized
ttggcaaaaaatcacaaact

SEQ ID NO: 187028 - DNA, 20 bp, Artificial Sequence
  chemically synthesized
tggcaaaaaatcacaaacta

SEQ ID NO: 187029 - DNA, 20 bp, Artificial Sequence
  chemically synthesized
gcaaaaaatcacaaactagg

SEQ ID NO: 187030 - DNA, 20 bp, Artificial Sequence
  chemically synthesized
aaaatcacaaactagggagc

SEQ ID NO: 187031 - DNA, 20 bp, Artificial Sequence
  chemically synthesized
tgtttttttatcttgctccc

SEQ ID NO: 187032 - DNA, 20 bp, Artificial Sequence
  chemically synthesized
tagggagcaagataaaaaaa

SEQ ID NO: 187033 - DNA, 20 bp, Artificial Sequence
  chemically synthesized
ggagcaagataaaaaaacag

SEQ ID NO: 187034 - DNA, 20 bp, Artificial Sequence
  chemically synthesized
agcaagataaaaaaacagaa

SEQ ID NO: 187035 - DNA, 20 bp, Artificial Sequence
  chemically synthesized
cagaagagataaaatgcaac

SEQ ID NO: 187036 - DNA, 20 bp, Artificial Sequence
  chemically synthesized
aagagataaaatgcaactgg

SEQ ID NO: 187037 - DNA, 20 bp, Artificial Sequence
  chemically synthesized
ataaaatgcaactggaagaa

SEQ ID NO: 187038 - DNA, 20 bp, Artificial Sequence
  chemically synthesized
cctgtatttatcttttcttc

SEQ ID NO: 187039 - DNA, 20 bp, Artificial Sequence
  chemically synthesized
actggaagaaaagataaata

SEQ ID NO: 187040 - DNA, 20 bp, Artificial Sequence
  chemically synthesized
ctggaagaaaagataaatac

SEQ ID NO: 187041 - DNA, 20 bp, Artificial Sequence
  chemically synthesized
tggaagaaaagataaataca

SEQ ID NO: 187042 - DNA, 20 bp, Artificial Sequence
  chemically synthesized
aaaagataaatacagggaaa

SEQ ID NO: 187043 - DNA, 20 bp, Artificial Sequence
  chemically synthesized
aagataaatacagggaaata

SEQ ID NO: 187044 - DNA, 20 bp, Artificial Sequence
  chemically synthesized
agataaatacagggaaatag

SEQ ID NO: 187045 - DNA, 20 bp, Artificial Sequence
  chemically synthesized
gataaatacagggaaataga

SEQ ID NO: 187046 - DNA, 20 bp, Artificial Sequence
  chemically synthesized
aaatacagggaaatagaggg

SEQ ID NO: 187047 - DNA, 20 bp, Artificial Sequence
  chemically synthesized
agggaaatagagggaagaaa

SEQ ID NO: 187048 - DNA, 20 bp, Artificial Sequence
  chemically synthesized
gggaaatagagggaagaaaa

SEQ ID NO: 187049 - DNA, 20 bp, Artificial Sequence
  chemically synthesized
aaacatctccttgttcaatg

SEQ ID NO: 187050 - DNA, 20 bp, Artificial Sequence
  chemically synthesized
aaaaggaaacttcattgaac

SEQ ID NO: 187051 - DNA, 20 bp, Artificial Sequence
  chemically synthesized
aaaggaaacttcattgaaca

SEQ ID NO: 187052 - DNA, 20 bp, Artificial Sequence
  chemically synthesized
aggaaacttcattgaacaag

SEQ ID NO: 187053 - DNA, 20 bp, Artificial Sequence
  chemically synthesized
attgaacaaggagatgtttc

SEQ ID NO: 187054 - DNA, 20 bp, Artificial Sequence
  chemically synthesized
tgtttcaagaatccaatact

SEQ ID NO: 187055 - DNA, 20 bp, Artificial Sequence
  chemically synthesized
ttacaagtaaatctcagtat

SEQ ID NO: 187056 - DNA, 20 bp, Artificial Sequence
  chemically synthesized
acaaaattacaagtaaatct

SEQ ID NO: 187057 - DNA, 20 bp, Artificial Sequence
  chemically synthesized
taattcatgaacaaaattac

SEQ ID NO: 187058 - DNA, 20 bp, Artificial Sequence
  chemically synthesized
ttttgttcatgaattatttt

SEQ ID NO: 187059 - DNA, 20 bp, Artificial Sequence
  chemically synthesized
gttcatgaattattttgaga

SEQ ID NO: 187060 - DNA, 20 bp, Artificial Sequence
  chemically synthesized
ttcatgaattattttgagac

SEQ ID NO: 187061 - DNA, 20 bp, Artificial Sequence
  chemically synthesized
agacaggtaaatcattaacc

SEQ ID NO: 187062 - DNA, 20 bp, Artificial Sequence
  chemically synthesized
tcttgaccaatcagtaaact

SEQ ID NO: 187063 - DNA, 20 bp, Artificial Sequence
  chemically synthesized
cattaaccgagtttactgat

SEQ ID NO: 187064 - DNA, 20 bp, Artificial Sequence
  chemically synthesized
accgagtttactgattggtc

SEQ ID NO: 187065 - DNA, 20 bp, Artificial Sequence
  chemically synthesized
catcttttctcttgaccaat

SEQ ID NO: 187066 - DNA, 20 bp, Artificial Sequence
  chemically synthesized
cgagtttactgattggtcaa

SEQ ID NO: 187067 - DNA, 20 bp, Artificial Sequence
  chemically synthesized
ttactgattggtcaagagaa

SEQ ID NO: 187068 - DNA, 20 bp, Artificial Sequence
  chemically synthesized
agatgtaataaaatgaaatt

SEQ ID NO: 187069 - DNA, 20 bp, Artificial Sequence
  chemically synthesized
gatgtaataaaatgaaattt

SEQ ID NO: 187070 - DNA, 20 bp, Artificial Sequence
  chemically synthesized
tgtaataaaatgaaatttgg

SEQ ID NO: 187071 - DNA, 20 bp, Artificial Sequence
  chemically synthesized
taataaaatgaaatttggga

SEQ ID NO: 187072 - DNA, 20 bp, Artificial Sequence
  chemically synthesized
aatttgggagagttgtgaaa

SEQ ID NO: 187073 - DNA, 20 bp, Artificial Sequence
  chemically synthesized
agttgtgaaacagactttta

SEQ ID NO: 187074 - DNA, 20 bp, Artificial Sequence
  chemically synthesized
tgtaggaaattgcaccataa

SEQ ID NO: 187075 - DNA, 20 bp, Artificial Sequence
  chemically synthesized
ggtgcaatttcctacaaata

SEQ ID NO: 187076 - DNA, 20 bp, Artificial Sequence
  chemically synthesized
agataaagcaccatatttgt

SEQ ID NO: 187077 - DNA, 20 bp, Artificial Sequence
  chemically synthesized
aagataaagcaccatatttg

SEQ ID NO: 187078 - DNA, 20 bp, Artificial Sequence
  chemically synthesized
taggataaaaaaacaagata

SEQ ID NO: 187079 - DNA, 20 bp, Artificial Sequence
  chemically synthesized
tgaccttaggataaaaaaac

SEQ ID NO: 187080 - DNA, 20 bp, Artificial Sequence
  chemically synthesized
ttatcttgtttttttatcct

SEQ ID NO: 187081 - DNA, 20 bp, Artificial Sequence
  chemically synthesized
tatcttgtttttttatccta

SEQ ID NO: 187082 - DNA, 20 bp, Artificial Sequence
  chemically synthesized
gacacaatgagaatgacctt

SEQ ID NO: 187083 - DNA, 20 bp, Artificial Sequence
  chemically synthesized
agacacaatgagaatgacct

SEQ ID NO: 187084 - DNA, 20 bp, Artificial Sequence
  chemically synthesized
cactgacgaagagacacaat

SEQ ID NO: 187085 - DNA, 20 bp, Artificial Sequence
  chemically synthesized
ttctcattgtgtctcttcgt

SEQ ID NO: 187086 - DNA, 20 bp, Artificial Sequence
  chemically synthesized
gaattcttggcactgacgaa

SEQ ID NO: 187087 - DNA, 20 bp, Artificial Sequence
  chemically synthesized
ctgaattcttggcactgacg

SEQ ID NO: 187088 - DNA, 20 bp, Artificial Sequence
  chemically synthesized
tgtgtctcttcgtcagtgcc

SEQ ID NO: 187089 - DNA, 20 bp, Artificial Sequence
  chemically synthesized
cttcgtcagtgccaagaatt

SEQ ID NO: 187090 - DNA, 20 bp, Artificial Sequence
  chemically synthesized
ttcgtcagtgccaagaattc

SEQ ID NO: 187091 - DNA, 20 bp, Artificial Sequence
  chemically synthesized
atatcaaactcctgaattct

SEQ ID NO: 187092 - DNA, 20 bp, Artificial Sequence
  chemically synthesized
cgtcagtgccaagaattcag

SEQ ID NO: 187093 - DNA, 20 bp, Artificial Sequence
  chemically synthesized
gaattcaggagtttgatata

SEQ ID NO: 187094 - DNA, 20 bp, Artificial Sequence
  chemically synthesized
tttatcattgaaaaaagtat

SEQ ID NO: 187095 - DNA, 20 bp, Artificial Sequence
  chemically synthesized
gctttatttatcattgaaaa

SEQ ID NO: 187096 - DNA, 20 bp, Artificial Sequence
  chemically synthesized
acttttttcaatgataaata

SEQ ID NO: 187097 - DNA, 20 bp, Artificial Sequence
  chemically synthesized
ttttcaatgataaataaagc

SEQ ID NO: 187098 - DNA, 20 bp, Artificial Sequence
  chemically synthesized
gataaataaagcaagttaac

SEQ ID NO: 187099 - DNA, 20 bp, Artificial Sequence
  chemically synthesized
tttctaataattagcatgac

SEQ ID NO: 187100 - DNA, 20 bp, Artificial Sequence
  chemically synthesized
taaccagtcatgctaattat

SEQ ID NO: 187101 - DNA, 20 bp, Artificial Sequence
  chemically synthesized
tggctatattttctaataat

SEQ ID NO: 187102 - DNA, 20 bp, Artificial Sequence
  chemically synthesized
atgctaattattagaaaata

SEQ ID NO: 187103 - DNA, 20 bp, Artificial Sequence
  chemically synthesized
aaaatctctgaaaacagtat

SEQ ID NO: 187104 - DNA, 20 bp, Artificial Sequence
  chemically synthesized
aatatagccaatactgtttt

SEQ ID NO: 187105 - DNA, 20 bp, Artificial Sequence
  chemically synthesized
tatagccaatactgttttca

SEQ ID NO: 187106 - DNA, 20 bp, Artificial Sequence
  chemically synthesized
cacattaaaatctctgaaaa

SEQ ID NO: 187107 - DNA, 20 bp, Artificial Sequence
  chemically synthesized
tcagagattttaatgtgctt

SEQ ID NO: 187108 - DNA, 20 bp, Artificial Sequence
  chemically synthesized
agattttaatgtgcttcagc

SEQ ID NO: 187109 - DNA, 20 bp, Artificial Sequence
  chemically synthesized
aagttgaaagaaacttgctg

SEQ ID NO: 187110 - DNA, 20 bp, Artificial Sequence
  chemically synthesized
catcatccgatagaagttga

SEQ ID NO: 187111 - DNA, 20 bp, Artificial Sequence
  chemically synthesized
aagtttctttcaacttctat

SEQ ID NO: 187112 - DNA, 20 bp, Artificial Sequence
  chemically synthesized
aaaaatccatcatccgatag

SEQ ID NO: 187113 - DNA, 20 bp, Artificial Sequence
  chemically synthesized
tacaaaaatccatcatccga

SEQ ID NO: 187114 - DNA, 20 bp, Artificial Sequence
  chemically synthesized
tttcaacttctatcggatga

SEQ ID NO: 187115 - DNA, 20 bp, Artificial Sequence
  chemically synthesized
tcggatgatggatttttgta

SEQ ID NO: 187116 - DNA, 20 bp, Artificial Sequence
  chemically synthesized
gatgatggatttttgtaaag

SEQ ID NO: 187117 - DNA, 20 bp, Artificial Sequence
  chemically synthesized
aaataaatgcacaaatactc

SEQ ID NO: 187118 - DNA, 20 bp, Artificial Sequence
  chemically synthesized
aataaatgcacaaatactca

SEQ ID NO: 187119 - DNA, 20 bp, Artificial Sequence
  chemically synthesized
ctgtgcttagcatatgcctt

SEQ ID NO: 187120 - DNA, 20 bp, Artificial Sequence
  chemically synthesized
aaatactcaaggcatatgct

SEQ ID NO: 187121 - DNA, 20 bp, Artificial Sequence
  chemically synthesized
ctcaaggcatatgctaagca

SEQ ID NO: 187122 - DNA, 20 bp, Artificial Sequence
  chemically synthesized
atgggtcctggtgctgtgct

SEQ ID NO: 187123 - DNA, 20 bp, Artificial Sequence
  chemically synthesized
gcatatgctaagcacagcac

SEQ ID NO: 187124 - DNA, 20 bp, Artificial Sequence
  chemically synthesized
catatgctaagcacagcacc

SEQ ID NO: 187125 - DNA, 20 bp, Artificial Sequence
  chemically synthesized
aggctaagttgaatgggtcc

SEQ ID NO: 187126 - DNA, 20 bp, Artificial Sequence
  chemically synthesized
atggacaggctaagttgaat

SEQ ID NO: 187127 - DNA, 20 bp, Artificial Sequence
  chemically synthesized
gcaccaggacccattcaact

SEQ ID NO: 187128 - DNA, 20 bp, Artificial Sequence
  chemically synthesized
tatggacaggctaagttgaa

SEQ ID NO: 187129 - DNA, 20 bp, Artificial Sequence
  chemically synthesized
cctcagtctatggacaggct

SEQ ID NO: 187130 - DNA, 20 bp, Artificial Sequence
  chemically synthesized
cattcaacttagcctgtcca

SEQ ID NO: 187131 - DNA, 20 bp, Artificial Sequence
  chemically synthesized
gaatccctcagtctatggac

SEQ ID NO: 187132 - DNA, 20 bp, Artificial Sequence
  chemically synthesized
ggaatccctcagtctatgga

SEQ ID NO: 187133 - DNA, 20 bp, Artificial Sequence
  chemically synthesized
acttagcctgtccatagact

SEQ ID NO: 187134 - DNA, 20 bp, Artificial Sequence
  chemically synthesized
cttagcctgtccatagactg

SEQ ID NO: 187135 - DNA, 20 bp, Artificial Sequence
  chemically synthesized
agacggaatccctcagtcta

SEQ ID NO: 187136 - DNA, 20 bp, Artificial Sequence
  chemically synthesized
ttagcctgtccatagactga

SEQ ID NO: 187137 - DNA, 20 bp, Artificial Sequence
  chemically synthesized
tccaccaagacggaatccct

SEQ ID NO: 187138 - DNA, 20 bp, Artificial Sequence
  chemically synthesized
tagactgagggattccgtct

SEQ ID NO: 187139 - DNA, 20 bp, Artificial Sequence
  chemically synthesized
actgagggattccgtcttgg

SEQ ID NO: 187140 - DNA, 20 bp, Artificial Sequence
  chemically synthesized
tatcagaccttccaccaaga

SEQ ID NO: 187141 - DNA, 20 bp, Artificial Sequence
  chemically synthesized
gagggattccgtcttggtgg

SEQ ID NO: 187142 - DNA, 20 bp, Artificial Sequence
  chemically synthesized
agggattccgtcttggtgga

SEQ ID NO: 187143 - DNA, 20 bp, Artificial Sequence
  chemically synthesized
aggttatcagaccttccacc

SEQ ID NO: 187144 - DNA, 20 bp, Artificial Sequence
  chemically synthesized
aggtgctcccacaaggttat

SEQ ID NO: 187145 - DNA, 20 bp, Artificial Sequence
  chemically synthesized
tggaaggtctgataaccttg

SEQ ID NO: 187146 - DNA, 20 bp, Artificial Sequence
  chemically synthesized
ggaaggtctgataaccttgt

SEQ ID NO: 187147 - DNA, 20 bp, Artificial Sequence
  chemically synthesized
aaggtctgataaccttgtgg

SEQ ID NO: 187148 - DNA, 20 bp, Artificial Sequence
  chemically synthesized
tatcctcaggtgctcccaca

SEQ ID NO: 187149 - DNA, 20 bp, Artificial Sequence
  chemically synthesized
ctatcctcaggtgctcccac

SEQ ID NO: 187150 - DNA, 20 bp, Artificial Sequence
  chemically synthesized
ataaccttgtgggagcacct

SEQ ID NO: 187151 - DNA, 20 bp, Artificial Sequence
  chemically synthesized
taaccttgtgggagcacctg

SEQ ID NO: 187152 - DNA, 20 bp, Artificial Sequence
  chemically synthesized
cttgtgggagcacctgagga

SEQ ID NO: 187153 - DNA, 20 bp, Artificial Sequence
  chemically synthesized
caattgttctgactatcctc

SEQ ID NO: 187154 - DNA, 20 bp, Artificial Sequence
  chemically synthesized
tcaattgttctgactatcct

SEQ ID NO: 187155 - DNA, 20 bp, Artificial Sequence
  chemically synthesized
tgggagcacctgaggatagt

SEQ ID NO: 187156 - DNA, 20 bp, Artificial Sequence
  chemically synthesized
aggatagtcagaacaattga

SEQ ID NO: 187157 - DNA, 20 bp, Artificial Sequence
  chemically synthesized
tagtcagaacaattgaaaga

SEQ ID NO: 187158 - DNA, 20 bp, Artificial Sequence
  chemically synthesized
aattgaaagatggctaaaat

SEQ ID NO: 187159 - DNA, 20 bp, Artificial Sequence
  chemically synthesized
attgaaagatggctaaaatt

SEQ ID NO: 187160 - DNA, 20 bp, Artificial Sequence
  chemically synthesized
ttgaaagatggctaaaattg

SEQ ID NO: 187161 - DNA, 20 bp, Artificial Sequence
  chemically synthesized
ctgctagatttccccaattt

SEQ ID NO: 187162 - DNA, 20 bp, Artificial Sequence
  chemically synthesized
tggctaaaattggggaaatc

SEQ ID NO: 187163 - DNA, 20 bp, Artificial Sequence
  chemically synthesized
ctaaaattggggaaatctag

SEQ ID NO: 187164 - DNA, 20 bp, Artificial Sequence
  chemically synthesized
aattggggaaatctagcagt

SEQ ID NO: 187165 - DNA, 20 bp, Artificial Sequence
  chemically synthesized
attggggaaatctagcagtt

SEQ ID NO: 187166 - DNA, 20 bp, Artificial Sequence
  chemically synthesized
ctctccattttcctaactgc

SEQ ID NO: 187167 - DNA, 20 bp, Artificial Sequence
  chemically synthesized
aaatctagcagttaggaaaa

SEQ ID NO: 187168 - DNA, 20 bp, Artificial Sequence
  chemically synthesized
atctagcagttaggaaaatg

SEQ ID NO: 187169 - DNA, 20 bp, Artificial Sequence
  chemically synthesized
ctagcagttaggaaaatgga

SEQ ID NO: 187170 - DNA, 20 bp, Artificial Sequence
  chemically synthesized
gcagttaggaaaatggagag

SEQ ID NO: 187171 - DNA, 20 bp, Artificial Sequence
  chemically synthesized
cagttaggaaaatggagaga

SEQ ID NO: 187172 - DNA, 20 bp, Artificial Sequence
  chemically synthesized
agttaggaaaatggagagaa

SEQ ID NO: 187173 - DNA, 20 bp, Artificial Sequence
  chemically synthesized
aaatggagagaagggcaaaa

SEQ ID NO: 187174 - DNA, 20 bp, Artificial Sequence
  chemically synthesized
gagagaagggcaaaatagta

SEQ ID NO: 187175 - DNA, 20 bp, Artificial Sequence
  chemically synthesized
aaaatagtatagaaaaaaaa

SEQ ID NO: 187176 - DNA, 20 bp, Artificial Sequence
  chemically synthesized
aatagtatagaaaaaaaaaa

SEQ ID NO: 187177 - DNA, 20 bp, Artificial Sequence
  chemically synthesized
agtatagaaaaaaaaaagag

SEQ ID NO: 187178 - DNA, 20 bp, Artificial Sequence
  chemically synthesized
aaaaaaaaagagtggaaaaa

SEQ ID NO: 187179 - DNA, 20 bp, Artificial Sequence
  chemically synthesized
aaaagagtggaaaaatagta

SEQ ID NO: 187180 - DNA, 20 bp, Artificial Sequence
  chemically synthesized
agtggaaaaatagtatagaa

SEQ ID NO: 187181 - DNA, 20 bp, Artificial Sequence
  chemically synthesized
aaatagtatagaaaagcaac

SEQ ID NO: 187182 - DNA, 20 bp, Artificial Sequence
  chemically synthesized
aatagtatagaaaagcaact

SEQ ID NO: 187183 - DNA, 20 bp, Artificial Sequence
  chemically synthesized
agtatagaaaagcaactagg

SEQ ID NO: 187184 - DNA, 20 bp, Artificial Sequence
  chemically synthesized
gtatagaaaagcaactagga

SEQ ID NO: 187185 - DNA, 20 bp, Artificial Sequence
  chemically synthesized
cactgttttcttatccttcc

SEQ ID NO: 187186 - DNA, 20 bp, Artificial Sequence
  chemically synthesized
gaaaagcaactaggaaggat

SEQ ID NO: 187187 - DNA, 20 bp, Artificial Sequence
  chemically synthesized
aactaggaaggataagaaaa

SEQ ID NO: 187188 - DNA, 20 bp, Artificial Sequence
  chemically synthesized
gataagaaaacagtgaaaaa

SEQ ID NO: 187189 - DNA, 20 bp, Artificial Sequence
  chemically synthesized
tgaaaaatggctgaaataaa

SEQ ID NO: 187190 - DNA, 20 bp, Artificial Sequence
  chemically synthesized
caaaaaaaggccatttattt

SEQ ID NO: 187191 - DNA, 20 bp, Artificial Sequence
  chemically synthesized
gaaataaatggccttttttt

SEQ ID NO: 187192 - DNA, 20 bp, Artificial Sequence
  chemically synthesized
ttctttctttactcaaaaaa

SEQ ID NO: 187193 - DNA, 20 bp, Artificial Sequence
  chemically synthesized
attctttctttactcaaaaa

SEQ ID NO: 187194 - DNA, 20 bp, Artificial Sequence
  chemically synthesized
aaatggcctttttttgagta

SEQ ID NO: 187195 - DNA, 20 bp, Artificial Sequence
  chemically synthesized
ggcctttttttgagtaaaga

SEQ ID NO: 187196 - DNA, 20 bp, Artificial Sequence
  chemically synthesized
tttgagtaaagaaagaatga

SEQ ID NO: 187197 - DNA, 20 bp, Artificial Sequence
  chemically synthesized
taaagaaagaatgaaagtta

SEQ ID NO: 187198 - DNA, 20 bp, Artificial Sequence
  chemically synthesized
aaagaaagaatgaaagttat

SEQ ID NO: 187199 - DNA, 20 bp, Artificial Sequence
  chemically synthesized
agaaagaatgaaagttatag

SEQ ID NO: 187200 - DNA, 20 bp, Artificial Sequence
  chemically synthesized
gaaagaatgaaagttatagg

SEQ ID NO: 187201 - DNA, 20 bp, Artificial Sequence
  chemically synthesized
gaatgaaagttataggaggt

SEQ ID NO: 187202 - DNA, 20 bp, Artificial Sequence
  chemically synthesized
agttataggaggtaagaatc

SEQ ID NO: 187203 - DNA, 20 bp, Artificial Sequence
  chemically synthesized
gttataggaggtaagaatca

SEQ ID NO: 187204 - DNA, 20 bp, Artificial Sequence
  chemically synthesized
aggaggtaagaatcaaggtc

SEQ ID NO: 187205 - DNA, 20 bp, Artificial Sequence
  chemically synthesized
ggaggtaagaatcaaggtca

SEQ ID NO: 187206 - DNA, 20 bp, Artificial Sequence
  chemically synthesized
aggtaagaatcaaggtcaag

SEQ ID NO: 187207 - DNA, 20 bp, Artificial Sequence
  chemically synthesized
gtaagaatcaaggtcaagga

SEQ ID NO: 187208 - DNA, 20 bp, Artificial Sequence
  chemically synthesized
aatcaaggtcaaggagagct

SEQ ID NO: 187209 - DNA, 20 bp, Artificial Sequence
  chemically synthesized
ggtcaaggagagctcagaat

SEQ ID NO: 187210 - DNA, 20 bp, Artificial Sequence
  chemically synthesized
attcttgtccttctcattct

SEQ ID NO: 187211 - DNA, 20 bp, Artificial Sequence
  chemically synthesized
caaggagagctcagaatgag

SEQ ID NO: 187212 - DNA, 20 bp, Artificial Sequence
  chemically synthesized
aaggagagctcagaatgaga

SEQ ID NO: 187213 - DNA, 20 bp, Artificial Sequence
  chemically synthesized
gagctcagaatgagaaggac

SEQ ID NO: 187214 - DNA, 20 bp, Artificial Sequence
  chemically synthesized
gaatgagaaggacaagaatc

SEQ ID NO: 187215 - DNA, 20 bp, Artificial Sequence
  chemically synthesized
cttatacttcatatatggac

SEQ ID NO: 187216 - DNA, 20 bp, Artificial Sequence
  chemically synthesized
aagaatccagtccatatatg

SEQ ID NO: 187217 - DNA, 20 bp, Artificial Sequence
  chemically synthesized
attatcttatacttcatata

SEQ ID NO: 187218 - DNA, 20 bp, Artificial Sequence
  chemically synthesized
ccagtccatatatgaagtat

SEQ ID NO: 187219 - DNA, 20 bp, Artificial Sequence
  chemically synthesized
aagataatatccaaacatgt

SEQ ID NO: 187220 - DNA, 20 bp, Artificial Sequence
  chemically synthesized
ccctgttgtactaacatgtt

SEQ ID NO: 187221 - DNA, 20 bp, Artificial Sequence
  chemically synthesized
atccaaacatgttagtacaa

SEQ ID NO: 187222 - DNA, 20 bp, Artificial Sequence
  chemically synthesized
tccaaacatgttagtacaac

SEQ ID NO: 187223 - DNA, 20 bp, Artificial Sequence
  chemically synthesized
ccaaacatgttagtacaaca

SEQ ID NO: 187224 - DNA, 20 bp, Artificial Sequence
  chemically synthesized
aaacatgttagtacaacagg

SEQ ID NO: 187225 - DNA, 20 bp, Artificial Sequence
  chemically synthesized
tgttagtacaacagggagca

SEQ ID NO: 187226 - DNA, 20 bp, Artificial Sequence
  chemically synthesized
agtacaacagggagcatgga

SEQ ID NO: 187227 - DNA, 20 bp, Artificial Sequence
  chemically synthesized
gtacaacagggagcatggaa

SEQ ID NO: 187228 - DNA, 20 bp, Artificial Sequence
  chemically synthesized
cagtggggagaagaggagga

SEQ ID NO: 187229 - DNA, 20 bp, Artificial Sequence
  chemically synthesized
aaggcagtggggagaagagg

SEQ ID NO: 187230 - DNA, 20 bp, Artificial Sequence
  chemically synthesized
gaaggcagtggggagaagag

SEQ ID NO: 187231 - DNA, 20 bp, Artificial Sequence
  chemically synthesized
gagaaggcagtggggagaag

SEQ ID NO: 187232 - DNA, 20 bp, Artificial Sequence
  chemically synthesized
cgagaaggcagtggggagaa

SEQ ID NO: 187233 - DNA, 20 bp, Artificial Sequence
  chemically synthesized
gccgagaaggcagtggggag

SEQ ID NO: 187234 - DNA, 20 bp, Artificial Sequence
  chemically synthesized
ggagccgagaaggcagtggg

SEQ ID NO: 187235 - DNA, 20 bp, Artificial Sequence
  chemically synthesized
acggagccgagaaggcagtg

SEQ ID NO: 187236 - DNA, 20 bp, Artificial Sequence
  chemically synthesized
gacggagccgagaaggcagt

SEQ ID NO: 187237 - DNA, 20 bp, Artificial Sequence
  chemically synthesized
agacggagccgagaaggcag

SEQ ID NO: 187238 - DNA, 20 bp, Artificial Sequence
  chemically synthesized
tcttctccccactgccttct

SEQ ID NO: 187239 - DNA, 20 bp, Artificial Sequence
  chemically synthesized
aggagacggagccgagaagg

SEQ ID NO: 187240 - DNA, 20 bp, Artificial Sequence
  chemically synthesized
ggcaggagacggagccgaga

SEQ ID NO: 187241 - DNA, 20 bp, Artificial Sequence
  chemically synthesized
cggcaggagacggagccgag

SEQ ID NO: 187242 - DNA, 20 bp, Artificial Sequence
  chemically synthesized
aagcggcaggagacggagcc

SEQ ID NO: 187243 - DNA, 20 bp, Artificial Sequence
  chemically synthesized
aggagaagcggcaggagacg

SEQ ID NO: 187244 - DNA, 20 bp, Artificial Sequence
  chemically synthesized
ggaggagaagcggcaggaga

SEQ ID NO: 187245 - DNA, 20 bp, Artificial Sequence
  chemically synthesized
gtgaggaggagaagcggcag

SEQ ID NO: 187246 - DNA, 20 bp, Artificial Sequence
  chemically synthesized
aagtgaggaggagaagcggc

SEQ ID NO: 187247 - DNA, 20 bp, Artificial Sequence
  chemically synthesized
aaagtgaggaggagaagcgg

SEQ ID NO: 187248 - DNA, 20 bp, Artificial Sequence
  chemically synthesized
ttgaaagtgaggaggagaag

SEQ ID NO: 187249 - DNA, 20 bp, Artificial Sequence
  chemically synthesized
agcttgaaagtgaggaggag

SEQ ID NO: 187250 - DNA, 20 bp, Artificial Sequence
  chemically synthesized
ctaagcttgaaagtgaggag

SEQ ID NO: 187251 - DNA, 20 bp, Artificial Sequence
  chemically synthesized
agctaagcttgaaagtgagg

SEQ ID NO: 187252 - DNA, 20 bp, Artificial Sequence
  chemically synthesized
gagctaagcttgaaagtgag

SEQ ID NO: 187253 - DNA, 20 bp, Artificial Sequence
  chemically synthesized
cgcttctcctcctcactttc

SEQ ID NO: 187254 - DNA, 20 bp, Artificial Sequence
  chemically synthesized
tggagctaagcttgaaagtg

SEQ ID NO: 187255 - DNA, 20 bp, Artificial Sequence
  chemically synthesized
ttggagctaagcttgaaagt

SEQ ID NO: 187256 - DNA, 20 bp, Artificial Sequence
  chemically synthesized
ctcctcctcactttcaagct

SEQ ID NO: 187257 - DNA, 20 bp, Artificial Sequence
  chemically synthesized
ggcattggagctaagcttga

SEQ ID NO: 187258 - DNA, 20 bp, Artificial Sequence
  chemically synthesized
ttttactgggcattggagct

SEQ ID NO: 187259 - DNA, 20 bp, Artificial Sequence
  chemically synthesized
tcaagcttagctccaatgcc

SEQ ID NO: 187260 - DNA, 20 bp, Artificial Sequence
  chemically synthesized
ctcagttttactgggcattg

SEQ ID NO: 187261 - DNA, 20 bp, Artificial Sequence
  chemically synthesized
tactcagttttactgggcat

SEQ ID NO: 187262 - DNA, 20 bp, Artificial Sequence
  chemically synthesized
gaaagttactcagttttact

SEQ ID NO: 187263 - DNA, 20 bp, Artificial Sequence
  chemically synthesized
agaaagttactcagttttac

SEQ ID NO: 187264 - DNA, 20 bp, Artificial Sequence
  chemically synthesized
ctccaatgcccagtaaaact

SEQ ID NO: 187265 - DNA, 20 bp, Artificial Sequence
  chemically synthesized
caaggaagtagaaagttact

SEQ ID NO: 187266 - DNA, 20 bp, Artificial Sequence
  chemically synthesized
agtatcgtcaaggaagtaga

SEQ ID NO: 187267 - DNA, 20 bp, Artificial Sequence
  chemically synthesized
taacagtatcgtcaaggaag

SEQ ID NO: 187268 - DNA, 20 bp, Artificial Sequence
  chemically synthesized
acttaacagtatcgtcaagg

SEQ ID NO: 187269 - DNA, 20 bp, Artificial Sequence
  chemically synthesized
acaacttaacagtatcgtca

SEQ ID NO: 187270 - DNA, 20 bp, Artificial Sequence
  chemically synthesized
tacaacttaacagtatcgtc

SEQ ID NO: 187271 - DNA, 20 bp, Artificial Sequence
  chemically synthesized
acttccttgacgatactgtt

SEQ ID NO: 187272 - DNA, 20 bp, Artificial Sequence
  chemically synthesized
atttgtcctatacaacttaa

SEQ ID NO: 187273 - DNA, 20 bp, Artificial Sequence
  chemically synthesized
gacgatactgttaagttgta

SEQ ID NO: 187274 - DNA, 20 bp, Artificial Sequence
  chemically synthesized
acgatactgttaagttgtat

SEQ ID NO: 187275 - DNA, 20 bp, Artificial Sequence
  chemically synthesized
ttatgctaactattaaagat

SEQ ID NO: 187276 - DNA, 20 bp, Artificial Sequence
  chemically synthesized
aattcgttactcatctttaa

SEQ ID NO: 187277 - DNA, 20 bp, Artificial Sequence
  chemically synthesized
cgttactcatctttaatagt

SEQ ID NO: 187278 - DNA, 20 bp, Artificial Sequence
  chemically synthesized
tacttttatgctaactatta

SEQ ID NO: 187279 - DNA, 20 bp, Artificial Sequence
  chemically synthesized
atctttaatagttagcataa

SEQ ID NO: 187280 - DNA, 20 bp, Artificial Sequence
  chemically synthesized
gcataaaagtaccctctttc

SEQ ID NO: 187281 - DNA, 20 bp, Artificial Sequence
  chemically synthesized
ttaaaagtcctctagaaaga

SEQ ID NO: 187282 - DNA, 20 bp, Artificial Sequence
  chemically synthesized
ataaaagtaccctctttcta

SEQ ID NO: 187283 - DNA, 20 bp, Artificial Sequence
  chemically synthesized
cttaaaagtcctctagaaag

SEQ ID NO: 187284 - DNA, 20 bp, Artificial Sequence
  chemically synthesized
taaaagtaccctctttctag

SEQ ID NO: 187285 - DNA, 20 bp, Artificial Sequence
  chemically synthesized
tcttaaaagtcctctagaaa

SEQ ID NO: 187286 - DNA, 20 bp, Artificial Sequence
  chemically synthesized
cctcttaaaagtcctctaga

SEQ ID NO: 187287 - DNA, 20 bp, Artificial Sequence
  chemically synthesized
taggcctcttaaaagtcctc

SEQ ID NO: 187288 - DNA, 20 bp, Artificial Sequence
  chemically synthesized
cctctttctagaggactttt

SEQ ID NO: 187289 - DNA, 20 bp, Artificial Sequence
  chemically synthesized
tctttctagaggacttttaa

SEQ ID NO: 187290 - DNA, 20 bp, Artificial Sequence
  chemically synthesized
ctttctagaggacttttaag

SEQ ID NO: 187291 - DNA, 20 bp, Artificial Sequence
  chemically synthesized
agttcccctaggcctcttaa

SEQ ID NO: 187292 - DNA, 20 bp, Artificial Sequence
  chemically synthesized
tagaggacttttaagaggcc

SEQ ID NO: 187293 - DNA, 20 bp, Artificial Sequence
  chemically synthesized
agaggacttttaagaggcct

SEQ ID NO: 187294 - DNA, 20 bp, Artificial Sequence
  chemically synthesized
gaggacttttaagaggccta

SEQ ID NO: 187295 - DNA, 20 bp, Artificial Sequence
  chemically synthesized
aggacttttaagaggcctag

SEQ ID NO: 187296 - DNA, 20 bp, Artificial Sequence
  chemically synthesized
gaggggcacttagttcccct

SEQ ID NO: 187297 - DNA, 20 bp, Artificial Sequence
  chemically synthesized
ggaggggcacttagttcccc

SEQ ID NO: 187298 - DNA, 20 bp, Artificial Sequence
  chemically synthesized
ttaagaggcctaggggaact

SEQ ID NO: 187299 - DNA, 20 bp, Artificial Sequence
  chemically synthesized
ctatacaaaggaggggcact

SEQ ID NO: 187300 - DNA, 20 bp, Artificial Sequence
  chemically synthesized
taaatacctatacaaaggag

SEQ ID NO: 187301 - DNA, 20 bp, Artificial Sequence
  chemically synthesized
ataaatacctatacaaagga

SEQ ID NO: 187302 - DNA, 20 bp, Artificial Sequence
  chemically synthesized
tataaatacctatacaaagg

SEQ ID NO: 187303 - DNA, 20 bp, Artificial Sequence
  chemically synthesized
ctaagtgcccctcctttgta

SEQ ID NO: 187304 - DNA, 20 bp, Artificial Sequence
  chemically synthesized
ttataaatacctatacaaag

SEQ ID NO: 187305 - DNA, 20 bp, Artificial Sequence
  chemically synthesized
taagtgcccctcctttgtat

SEQ ID NO: 187306 - DNA, 20 bp, Artificial Sequence
  chemically synthesized
ttttataaatacctatacaa

SEQ ID NO: 187307 - DNA, 20 bp, Artificial Sequence
  chemically synthesized
attttataaatacctataca

SEQ ID NO: 187308 - DNA, 20 bp, Artificial Sequence
  chemically synthesized
acatatgagaatgacacaaa

SEQ ID NO: 187309 - DNA, 20 bp, Artificial Sequence
  chemically synthesized
ctgtaaagtccaaaacatat

SEQ ID NO: 187310 - DNA, 20 bp, Artificial Sequence
  chemically synthesized
tgtgtcattctcatatgttt

SEQ ID NO: 187311 - DNA, 20 bp, Artificial Sequence
  chemically synthesized
ctcatatgttttggacttta

SEQ ID NO: 187312 - DNA, 20 bp, Artificial Sequence
  chemically synthesized
atgcttaatattcagctgta

SEQ ID NO: 187313 - DNA, 20 bp, Artificial Sequence
  chemically synthesized
ggactttacagctgaatatt

SEQ ID NO: 187314 - DNA, 20 bp, Artificial Sequence
  chemically synthesized
attcggtcatgcttaatatt

SEQ ID NO: 187315 - DNA, 20 bp, Artificial Sequence
  chemically synthesized
aatattaagcatgaccgaat

SEQ ID NO: 187316 - DNA, 20 bp, Artificial Sequence
  chemically synthesized
atattaagcatgaccgaatg

SEQ ID NO: 187317 - DNA, 20 bp, Artificial Sequence
  chemically synthesized
tattaagcatgaccgaatga

SEQ ID NO: 187318 - DNA, 20 bp, Artificial Sequence
  chemically synthesized
aagagaagaaagccctcatt

SEQ ID NO: 187319 - DNA, 20 bp, Artificial Sequence
  chemically synthesized
attttctgttcaagagaaga

SEQ ID NO: 187320 - DNA, 20 bp, Artificial Sequence
  chemically synthesized
atgtattttctgttcaagag

SEQ ID NO: 187321 - DNA, 20 bp, Artificial Sequence
  chemically synthesized
gagggctttcttctcttgaa

SEQ ID NO: 187322 - DNA, 20 bp, Artificial Sequence
  chemically synthesized
gagatgtattttctgttcaa

SEQ ID NO: 187323 - DNA, 20 bp, Artificial Sequence
  chemically synthesized
tagagatgtattttctgttc

SEQ ID NO: 187324 - DNA, 20 bp, Artificial Sequence
  chemically synthesized
tgtagtgccgttcaaattta

SEQ ID NO: 187325 - DNA, 20 bp, Artificial Sequence
  chemically synthesized
tctgtagtgccgttcaaatt

SEQ ID NO: 187326 - DNA, 20 bp, Artificial Sequence
  chemically synthesized
aatacatctctaaatttgaa

SEQ ID NO: 187327 - DNA, 20 bp, Artificial Sequence
  chemically synthesized
tctaaatttgaacggcacta

SEQ ID NO: 187328 - DNA, 20 bp, Artificial Sequence
  chemically synthesized
ttagttaaaagttgaatctg

SEQ ID NO: 187329 - DNA, 20 bp, Artificial Sequence
  chemically synthesized
tacagattcaacttttaact

SEQ ID NO: 187330 - DNA, 20 bp, Artificial Sequence
  chemically synthesized
acagattcaacttttaacta

SEQ ID NO: 187331 - DNA, 20 bp, Artificial Sequence
  chemically synthesized
atctggaggtccttagttaa

SEQ ID NO: 187332 - DNA, 20 bp, Artificial Sequence
  chemically synthesized
ataaaagatctggaggtcct

SEQ ID NO: 187333 - DNA, 20 bp, Artificial Sequence
  chemically synthesized
aacttttaactaaggacctc

SEQ ID NO: 187334 - DNA, 20 bp, Artificial Sequence
  chemically synthesized
attactaataaaagatctgg

SEQ ID NO: 187335 - DNA, 20 bp, Artificial Sequence
  chemically synthesized
aattactaataaaagatctg

SEQ ID NO: 187336 - DNA, 20 bp, Artificial Sequence
  chemically synthesized
caaattactaataaaagatc

SEQ ID NO: 187337 - DNA, 20 bp, Artificial Sequence
  chemically synthesized
aggacctccagatcttttat

SEQ ID NO: 187338 - DNA, 20 bp, Artificial Sequence
  chemically synthesized
tccttgcaaattactaataa

SEQ ID NO: 187339 - DNA, 20 bp, Artificial Sequence
  chemically synthesized
atcttttattagtaatttgc

SEQ ID NO: 187340 - DNA, 20 bp, Artificial Sequence
  chemically synthesized
tcttttattagtaatttgca

SEQ ID NO: 187341 - DNA, 20 bp, Artificial Sequence
  chemically synthesized
ttagtaatttgcaaggaact

SEQ ID NO: 187342 - DNA, 20 bp, Artificial Sequence
  chemically synthesized
caggacctttttatttgact

SEQ ID NO: 187343 - DNA, 20 bp, Artificial Sequence
  chemically synthesized
aaggaactcagtcaaataaa

SEQ ID NO: 187344 - DNA, 20 bp, Artificial Sequence
  chemically synthesized
aggaactcagtcaaataaaa

SEQ ID NO: 187345 - DNA, 20 bp, Artificial Sequence
  chemically synthesized
tattgtgaatagcacaagac

SEQ ID NO: 187346 - DNA, 20 bp, Artificial Sequence
  chemically synthesized
ctattgtgaatagcacaaga

SEQ ID NO: 187347 - DNA, 20 bp, Artificial Sequence
  chemically synthesized
tttgctattgtgaatagcac

SEQ ID NO: 187348 - DNA, 20 bp, Artificial Sequence
  chemically synthesized
ctgtcttgtgctattcacaa

SEQ ID NO: 187349 - DNA, 20 bp, Artificial Sequence
  chemically synthesized
catgtctttgctattgtgaa

SEQ ID NO: 187350 - DNA, 20 bp, Artificial Sequence
  chemically synthesized
ttgtgctattcacaatagca

SEQ ID NO: 187351 - DNA, 20 bp, Artificial Sequence
  chemically synthesized
tattcacaatagcaaagaca

SEQ ID NO: 187352 - DNA, 20 bp, Artificial Sequence
  chemically synthesized
gcaaagacatggaatccatc

SEQ ID NO: 187353 - DNA, 20 bp, Artificial Sequence
  chemically synthesized
accattgtttcacaactaga

SEQ ID NO: 187354 - DNA, 20 bp, Artificial Sequence
  chemically synthesized
atctaccattgtttcacaac

SEQ ID NO: 187355 - DNA, 20 bp, Artificial Sequence
  chemically synthesized
tccatctagttgtgaaacaa

SEQ ID NO: 187356 - DNA, 20 bp, Artificial Sequence
  chemically synthesized
atctagttgtgaaacaatgg

SEQ ID NO: 187357 - DNA, 20 bp, Artificial Sequence
  chemically synthesized
gttgtgaaacaatggtagat

SEQ ID NO: 187358 - DNA, 20 bp, Artificial Sequence
  chemically synthesized
aaacaatggtagattggata

SEQ ID NO: 187359 - DNA, 20 bp, Artificial Sequence
  chemically synthesized
tagattggataaagaaaatg

SEQ ID NO: 187360 - DNA, 20 bp, Artificial Sequence
  chemically synthesized
tatgactatgtagtatttca

SEQ ID NO: 187361 - DNA, 20 bp, Artificial Sequence
  chemically synthesized
atacaccatgaaatactaca

SEQ ID NO: 187362 - DNA, 20 bp, Artificial Sequence
  chemically synthesized
tcattctttttatgactatg

SEQ ID NO: 187363 - DNA, 20 bp, Artificial Sequence
  chemically synthesized
aaatactacatagtcataaa

SEQ ID NO: 187364 - DNA, 20 bp, Artificial Sequence
  chemically synthesized
gaatgaaatcatgtcctttg

SEQ ID NO: 187365 - DNA, 20 bp, Artificial Sequence
  chemically synthesized
tgaaatcatgtcctttgcgg

SEQ ID NO: 187366 - DNA, 20 bp, Artificial Sequence
  chemically synthesized
ctgcatccgtgcttccgcaa

SEQ ID NO: 187367 - DNA, 20 bp, Artificial Sequence
  chemically synthesized
actgcatccgtgcttccgca

SEQ ID NO: 187368 - DNA, 20 bp, Artificial Sequence
  chemically synthesized
tcatgtcctttgcggaagca

SEQ ID NO: 187369 - DNA, 20 bp, Artificial Sequence
  chemically synthesized
cctttgcggaagcacggatg

SEQ ID NO: 187370 - DNA, 20 bp, Artificial Sequence
  chemically synthesized
tgcggaagcacggatgcagt

SEQ ID NO: 187371 - DNA, 20 bp, Artificial Sequence
  chemically synthesized
cggaagcacggatgcagttg

SEQ ID NO: 187372 - DNA, 20 bp, Artificial Sequence
  chemically synthesized
ggaagcacggatgcagttgg

SEQ ID NO: 187373 - DNA, 20 bp, Artificial Sequence
  chemically synthesized
cagttggaggccataatcat

SEQ ID NO: 187374 - DNA, 20 bp, Artificial Sequence
  chemically synthesized
cgttaatttgcttatgatta

SEQ ID NO: 187375 - DNA, 20 bp, Artificial Sequence
  chemically synthesized
taatcataagcaaattaacg

SEQ ID NO: 187376 - DNA, 20 bp, Artificial Sequence
  chemically synthesized
aatcataagcaaattaacgc

SEQ ID NO: 187377 - DNA, 20 bp, Artificial Sequence
  chemically synthesized
taagcaaattaacgcaggaa

SEQ ID NO: 187378 - DNA, 20 bp, Artificial Sequence
  chemically synthesized
aagcaaattaacgcaggaac

SEQ ID NO: 187379 - DNA, 20 bp, Artificial Sequence
  chemically synthesized
cacttataagtgagaacata

SEQ ID NO: 187380 - DNA, 20 bp, Artificial Sequence
  chemically synthesized
cactatatgttctcacttat

SEQ ID NO: 187381 - DNA, 20 bp, Artificial Sequence
  chemically synthesized
tttagctcccacttataagt

SEQ ID NO: 187382 - DNA, 20 bp, Artificial Sequence
  chemically synthesized
tatatgttctcacttataag

SEQ ID NO: 187383 - DNA, 20 bp, Artificial Sequence
  chemically synthesized
atatgttctcacttataagt

SEQ ID NO: 187384 - DNA, 20 bp, Artificial Sequence
  chemically synthesized
tatgtttagctcccacttat

SEQ ID NO: 187385 - DNA, 20 bp, Artificial Sequence
  chemically synthesized
atgttctcacttataagtgg

SEQ ID NO: 187386 - DNA, 20 bp, Artificial Sequence
  chemically synthesized
ttataagtgggagctaaaca

SEQ ID NO: 187387 - DNA, 20 bp, Artificial Sequence
  chemically synthesized
ataagtgggagctaaacata

SEQ ID NO: 187388 - DNA, 20 bp, Artificial Sequence
  chemically synthesized
gtccatatatgctctatgtt

SEQ ID NO: 187389 - DNA, 20 bp, Artificial Sequence
  chemically synthesized
agctaaacatagagcatata

SEQ ID NO: 187390 - DNA, 20 bp, Artificial Sequence
  chemically synthesized
ggacgtaaatatgcgaacaa

SEQ ID NO: 187391 - DNA, 20 bp, Artificial Sequence
  chemically synthesized
tatgcgaacaacagataccg

SEQ ID NO: 187392 - DNA, 20 bp, Artificial Sequence
  chemically synthesized
gaacaacagataccgcggac

SEQ ID NO: 187393 - DNA, 20 bp, Artificial Sequence
  chemically synthesized
ttcccacatctactagtccg

SEQ ID NO: 187394 - DNA, 20 bp, Artificial Sequence
  chemically synthesized
caacagataccgcggactag

SEQ ID NO: 187395 - DNA, 20 bp, Artificial Sequence
  chemically synthesized
ataccgcggactagtagatg

SEQ ID NO: 187396 - DNA, 20 bp, Artificial Sequence
  chemically synthesized
tccctccttcccacatctac

SEQ ID NO: 187397 - DNA, 20 bp, Artificial Sequence
  chemically synthesized
taccgcggactagtagatgt

SEQ ID NO: 187398 - DNA, 20 bp, Artificial Sequence
  chemically synthesized
cgcggactagtagatgtggg

SEQ ID NO: 187399 - DNA, 20 bp, Artificial Sequence
  chemically synthesized
gcggactagtagatgtggga

SEQ ID NO: 187400 - DNA, 20 bp, Artificial Sequence
  chemically synthesized
ggactagtagatgtgggaag

SEQ ID NO: 187401 - DNA, 20 bp, Artificial Sequence
  chemically synthesized
gactagtagatgtgggaagg

SEQ ID NO: 187402 - DNA, 20 bp, Artificial Sequence
  chemically synthesized
actagtagatgtgggaagga

SEQ ID NO: 187403 - DNA, 20 bp, Artificial Sequence
  chemically synthesized
tagtagatgtgggaaggagg

SEQ ID NO: 187404 - DNA, 20 bp, Artificial Sequence
  chemically synthesized
agtagatgtgggaaggaggg

SEQ ID NO: 187405 - DNA, 20 bp, Artificial Sequence
  chemically synthesized
gtagatgtgggaaggaggga

SEQ ID NO: 187406 - DNA, 20 bp, Artificial Sequence
  chemically synthesized
gaaggagggagggtgcgcat

SEQ ID NO: 187407 - DNA, 20 bp, Artificial Sequence
  chemically synthesized
ttggttgaaaaactactcat

SEQ ID NO: 187408 - DNA, 20 bp, Artificial Sequence
  chemically synthesized
tggttgaaaaactactcatc

SEQ ID NO: 187409 - DNA, 20 bp, Artificial Sequence
  chemically synthesized
catagtacctacctgatgag

SEQ ID NO: 187410 - DNA, 20 bp, Artificial Sequence
  chemically synthesized
ttgaaaaactactcatcagg

SEQ ID NO: 187411 - DNA, 20 bp, Artificial Sequence
  chemically synthesized
tgaaaaactactcatcaggt

SEQ ID NO: 187412 - DNA, 20 bp, Artificial Sequence
  chemically synthesized
gagcatagtacctacctgat

SEQ ID NO: 187413 - DNA, 20 bp, Artificial Sequence
  chemically synthesized
catcacccaaacagtgagca

SEQ ID NO: 187414 - DNA, 20 bp, Artificial Sequence
  chemically synthesized
taggtactatgctcactgtt

SEQ ID NO: 187415 - DNA, 20 bp, Artificial Sequence
  chemically synthesized
aggtactatgctcactgttt

SEQ ID NO: 187416 - DNA, 20 bp, Artificial Sequence
  chemically synthesized
gatctcatcacccaaacagt

SEQ ID NO: 187417 - DNA, 20 bp, Artificial Sequence
  chemically synthesized
tacagatctcatcacccaaa

SEQ ID NO: 187418 - DNA, 20 bp, Artificial Sequence
  chemically synthesized
atgctcactgtttgggtgat

SEQ ID NO: 187419 - DNA, 20 bp, Artificial Sequence
  chemically synthesized
tgatgctgaggtttggggta

SEQ ID NO: 187420 - DNA, 20 bp, Artificial Sequence
  chemically synthesized
gagatctgtaccccaaacct

SEQ ID NO: 187421 - DNA, 20 bp, Artificial Sequence
  chemically synthesized
gcgcatgatgctgaggtttg

SEQ ID NO: 187422 - DNA, 20 bp, Artificial Sequence
  chemically synthesized
agcgcatgatgctgaggttt

SEQ ID NO: 187423 - DNA, 20 bp, Artificial Sequence
  chemically synthesized
tagcgcatgatgctgaggtt

SEQ ID NO: 187424 - DNA, 20 bp, Artificial Sequence
  chemically synthesized
gggaatagcgcatgatgctg

SEQ ID NO: 187425 - DNA, 20 bp, Artificial Sequence
  chemically synthesized
ggggaatagcgcatgatgct

SEQ ID NO: 187426 - DNA, 20 bp, Artificial Sequence
  chemically synthesized
acaggcttgtcacaggggaa

SEQ ID NO: 187427 - DNA, 20 bp, Artificial Sequence
  chemically synthesized
atgcgctattcccctgtgac

SEQ ID NO: 187428 - DNA, 20 bp, Artificial Sequence
  chemically synthesized
catgtacaggcttgtcacag

SEQ ID NO: 187429 - DNA, 20 bp, Artificial Sequence
  chemically synthesized
acatgtacaggcttgtcaca

SEQ ID NO: 187430 - DNA, 20 bp, Artificial Sequence
  chemically synthesized
tacatgtacaggcttgtcac

SEQ ID NO: 187431 - DNA, 20 bp, Artificial Sequence
  chemically synthesized
gtacatgtacaggcttgtca

SEQ ID NO: 187432 - DNA, 20 bp, Artificial Sequence
  chemically synthesized
tatacagagggtacatgtac

SEQ ID NO: 187433 - DNA, 20 bp, Artificial Sequence
  chemically synthesized
atatacagagggtacatgta

SEQ ID NO: 187434 - DNA, 20 bp, Artificial Sequence
  chemically synthesized
aattttattttatatacaga

SEQ ID NO: 187435 - DNA, 20 bp, Artificial Sequence
  chemically synthesized
aaattttattttatatacag

SEQ ID NO: 187436 - DNA, 20 bp, Artificial Sequence
  chemically synthesized
caaattttattttatataca

SEQ ID NO: 187437 - DNA, 20 bp, Artificial Sequence
  chemically synthesized
atcaaattttattttatata

SEQ ID NO: 187438 - DNA, 20 bp, Artificial Sequence
  chemically synthesized
taaaatttgattattttaaa

SEQ ID NO: 187439 - DNA, 20 bp, Artificial Sequence
  chemically synthesized
aaaatttgattattttaaaa

SEQ ID NO: 187440 - DNA, 20 bp, Artificial Sequence
  chemically synthesized
aatttgattattttaaaaag

SEQ ID NO: 187441 - DNA, 20 bp, Artificial Sequence
  chemically synthesized
ttgattattttaaaaaggag

SEQ ID NO: 187442 - DNA, 20 bp, Artificial Sequence
  chemically synthesized
atttctgatcgttcattgta

SEQ ID NO: 187443 - DNA, 20 bp, Artificial Sequence
  chemically synthesized
cagtctttacaatgaacgat

SEQ ID NO: 187444 - DNA, 20 bp, Artificial Sequence
  chemically synthesized
agaaataaaatgcacctttt

SEQ ID NO: 187445 - DNA, 20 bp, Artificial Sequence
  chemically synthesized
ggagaaagaagaggctaaaa

SEQ ID NO: 187446 - DNA, 20 bp, Artificial Sequence
  chemically synthesized
aggagaaagaagaggctaaa

SEQ ID NO: 187447 - DNA, 20 bp, Artificial Sequence
  chemically synthesized
aagataacaggagaaagaag

SEQ ID NO: 187448 - DNA, 20 bp, Artificial Sequence
  chemically synthesized
aaagataacaggagaaagaa

SEQ ID NO: 187449 - DNA, 20 bp, Artificial Sequence
  chemically synthesized
aaaaagataacaggagaaag

SEQ ID NO: 187450 - DNA, 20 bp, Artificial Sequence
  chemically synthesized
aaaaaaaagataacaggaga

SEQ ID NO: 187451 - DNA, 20 bp, Artificial Sequence
  chemically synthesized
gaaaaaaaaaaagataacag

SEQ ID NO: 187452 - DNA, 20 bp, Artificial Sequence
  chemically synthesized
ttgaaaaaaaaaaagataac

SEQ ID NO: 187453 - DNA, 20 bp, Artificial Sequence
  chemically synthesized
attgaaaaaaaaaaagataa

SEQ ID NO: 187454 - DNA, 20 bp, Artificial Sequence
  chemically synthesized
tactgaaattgaaaaaaaaa

SEQ ID NO: 187455 - DNA, 20 bp, Artificial Sequence
  chemically synthesized
atctttttttttttcaattt

SEQ ID NO: 187456 - DNA, 20 bp, Artificial Sequence
  chemically synthesized
tttcagcatttgtattagta

SEQ ID NO: 187457 - DNA, 20 bp, Artificial Sequence
  chemically synthesized
gtttcagcatttgtattagt

SEQ ID NO: 187458 - DNA, 20 bp, Artificial Sequence
  chemically synthesized
tatggtttcagcatttgtat

SEQ ID NO: 187459 - DNA, 20 bp, Artificial Sequence
  chemically synthesized
cacacacatttgtatggttt

SEQ ID NO: 187460 - DNA, 20 bp, Artificial Sequence
  chemically synthesized
aatgaacacacacatttgta

SEQ ID NO: 187461 - DNA, 20 bp, Artificial Sequence
  chemically synthesized
atgtgtgtgttcatttgtta

SEQ ID NO: 187462 - DNA, 20 bp, Artificial Sequence
  chemically synthesized
tgtgtgtgttcatttgttac

SEQ ID NO: 187463 - DNA, 20 bp, Artificial Sequence
  chemically synthesized
tgttcatttgttacaggaac

SEQ ID NO: 187464 - DNA, 20 bp, Artificial Sequence
  chemically synthesized
ttcatttgttacaggaacta

SEQ ID NO: 187465 - DNA, 20 bp, Artificial Sequence
  chemically synthesized
tttgttacaggaactagagt

SEQ ID NO: 187466 - DNA, 20 bp, Artificial Sequence
  chemically synthesized
ttgttacaggaactagagtc

SEQ ID NO: 187467 - DNA, 20 bp, Artificial Sequence
  chemically synthesized
gttacaggaactagagtcag

SEQ ID NO: 187468 - DNA, 20 bp, Artificial Sequence
  chemically synthesized
acaaggcctgctcctgactc

SEQ ID NO: 187469 - DNA, 20 bp, Artificial Sequence
  chemically synthesized
acaggaactagagtcaggag

SEQ ID NO: 187470 - DNA, 20 bp, Artificial Sequence
  chemically synthesized
caggaactagagtcaggagc

SEQ ID NO: 187471 - DNA, 20 bp, Artificial Sequence
  chemically synthesized
gagtcaggagcaggccttgt

SEQ ID NO: 187472 - DNA, 20 bp, Artificial Sequence
  chemically synthesized
gtattaaatgaaatctaaca

SEQ ID NO: 187473 - DNA, 20 bp, Artificial Sequence
  chemically synthesized
agtattaaatgaaatctaac

SEQ ID NO: 187474 - DNA, 20 bp, Artificial Sequence
  chemically synthesized
tatacctcacaggaaaaaga

SEQ ID NO: 187475 - DNA, 20 bp, Artificial Sequence
  chemically synthesized
attatacctcacaggaaaaa

SEQ ID NO: 187476 - DNA, 20 bp, Artificial Sequence
  chemically synthesized
ctattatacctcacaggaaa

SEQ ID NO: 187477 - DNA, 20 bp, Artificial Sequence
  chemically synthesized
taatactctctttttcctgt

SEQ ID NO: 187478 - DNA, 20 bp, Artificial Sequence
  chemically synthesized
aatactctctttttcctgtg

SEQ ID NO: 187479 - DNA, 20 bp, Artificial Sequence
  chemically synthesized
tatctactattatacctcac

SEQ ID NO: 187480 - DNA, 20 bp, Artificial Sequence
  chemically synthesized
atatctactattatacctca

SEQ ID NO: 187481 - DNA, 20 bp, Artificial Sequence
  chemically synthesized
ctttttcctgtgaggtataa

SEQ ID NO: 187482 - DNA, 20 bp, Artificial Sequence
  chemically synthesized
tttcctgtgaggtataatag

SEQ ID NO: 187483 - DNA, 20 bp, Artificial Sequence
  chemically synthesized
tataatagtagatatgctct

SEQ ID NO: 187484 - DNA, 20 bp, Artificial Sequence
  chemically synthesized
cagatgggaaattgtaccaa

SEQ ID NO: 187485 - DNA, 20 bp, Artificial Sequence
  chemically synthesized
agcagatgggaaattgtacc

SEQ ID NO: 187486 - DNA, 20 bp, Artificial Sequence
  chemically synthesized
aaccattatcaggagcagat

SEQ ID NO: 187487 - DNA, 20 bp, Artificial Sequence
  chemically synthesized
caaccattatcaggagcaga

SEQ ID NO: 187488 - DNA, 20 bp, Artificial Sequence
  chemically synthesized
atagcaaccattatcaggag

SEQ ID NO: 187489 - DNA, 20 bp, Artificial Sequence
  chemically synthesized
ttcccatctgctcctgataa

SEQ ID NO: 187490 - DNA, 20 bp, Artificial Sequence
  chemically synthesized
tttatagcaaccattatcag

SEQ ID NO: 187491 - DNA, 20 bp, Artificial Sequence
  chemically synthesized
cttttatagcaaccattatc

SEQ ID NO: 187492 - DNA, 20 bp, Artificial Sequence
  chemically synthesized
tcttttatagcaaccattat

SEQ ID NO: 187493 - DNA, 20 bp, Artificial Sequence
  chemically synthesized
cctgataatggttgctataa

SEQ ID NO: 187494 - DNA, 20 bp, Artificial Sequence
  chemically synthesized
gaattctcattattctttta

SEQ ID NO: 187495 - DNA, 20 bp, Artificial Sequence
  chemically synthesized
ggttgctataaaagaataat

SEQ ID NO: 187496 - DNA, 20 bp, Artificial Sequence
  chemically synthesized
agtctatttctagttttaga

SEQ ID NO: 187497 - DNA, 20 bp, Artificial Sequence
  chemically synthesized
atgagaattccttctaaaac

SEQ ID NO: 187498 - DNA, 20 bp, Artificial Sequence
  chemically synthesized
cagtctatttctagttttag

SEQ ID NO: 187499 - DNA, 20 bp, Artificial Sequence
  chemically synthesized
aaacagtctatttctagttt

SEQ ID NO: 187500 - DNA, 20 bp, Artificial Sequence
  chemically synthesized
attccttctaaaactagaaa

SEQ ID NO: 187501 - DNA, 20 bp, Artificial Sequence
  chemically synthesized
gaaaataaacagtctatttc

SEQ ID NO: 187502 - DNA, 20 bp, Artificial Sequence
  chemically synthesized
tgtttgctttggaaaataaa

SEQ ID NO: 187503 - DNA, 20 bp, Artificial Sequence
  chemically synthesized
aatagactgtttattttcca

SEQ ID NO: 187504 - DNA, 20 bp, Artificial Sequence
  chemically synthesized
cattggcaggatgtttgctt

SEQ ID NO: 187505 - DNA, 20 bp, Artificial Sequence
  chemically synthesized
ttttccttcagttcattggc

SEQ ID NO: 187506 - DNA, 20 bp, Artificial Sequence
  chemically synthesized
attttccttcagttcattgg

SEQ ID NO: 187507 - DNA, 20 bp, Artificial Sequence
  chemically synthesized
ataattttccttcagttcat

SEQ ID NO: 187508 - DNA, 20 bp, Artificial Sequence
  chemically synthesized
aacatcctgccaatgaactg

SEQ ID NO: 187509 - DNA, 20 bp, Artificial Sequence
  chemically synthesized
acatcctgccaatgaactga

SEQ ID NO: 187510 - DNA, 20 bp, Artificial Sequence
  chemically synthesized
tactgtacataattttcctt

SEQ ID NO: 187511 - DNA, 20 bp, Artificial Sequence
  chemically synthesized
aactgaaggaaaattatgta

SEQ ID NO: 187512 - DNA, 20 bp, Artificial Sequence
  chemically synthesized
tgaaggaaaattatgtacag

SEQ ID NO: 187513 - DNA, 20 bp, Artificial Sequence
  chemically synthesized
acagtagcaatttattttaa

SEQ ID NO: 187514 - DNA, 20 bp, Artificial Sequence
  chemically synthesized
cagtagcaatttattttaat

SEQ ID NO: 187515 - DNA, 20 bp, Artificial Sequence
  chemically synthesized
tttcattacaatttgatatt

SEQ ID NO: 187516 - DNA, 20 bp, Artificial Sequence
  chemically synthesized
atttcattacaatttgatat

SEQ ID NO: 187517 - DNA, 20 bp, Artificial Sequence
  chemically synthesized
aataagataaatacatcaaa

SEQ ID NO: 187518 - DNA, 20 bp, Artificial Sequence
  chemically synthesized
gaataagataaatacatcaa

SEQ ID NO: 187519 - DNA, 20 bp, Artificial Sequence
  chemically synthesized
tatatataattgatatgaat

SEQ ID NO: 187520 - DNA, 20 bp, Artificial Sequence
  chemically synthesized
atcaattatatatatatata

SEQ ID NO: 187521 - DNA, 20 bp, Artificial Sequence
  chemically synthesized
tttggtatacacattaatag

SEQ ID NO: 187522 - DNA, 20 bp, Artificial Sequence
  chemically synthesized
aattttggtatacacattaa

SEQ ID NO: 187523 - DNA, 20 bp, Artificial Sequence
  chemically synthesized
tctttatgatgaattaattt

SEQ ID NO: 187524 - DNA, 20 bp, Artificial Sequence
  chemically synthesized
accaaaattaattcatcata

SEQ ID NO: 187525 - DNA, 20 bp, Artificial Sequence
  chemically synthesized
caaaattaattcatcataaa

SEQ ID NO: 187526 - DNA, 20 bp, Artificial Sequence
  chemically synthesized
aattcatcataaagagcttt

SEQ ID NO: 187527 - DNA, 20 bp, Artificial Sequence
  chemically synthesized
tacaaaacatgtagtactta

SEQ ID NO: 187528 - DNA, 20 bp, Artificial Sequence
  chemically synthesized
agatacccttacaaaacatg

SEQ ID NO: 187529 - DNA, 20 bp, Artificial Sequence
  chemically synthesized
ttaagtactacatgttttgt

SEQ ID NO: 187530 - DNA, 20 bp, Artificial Sequence
  chemically synthesized
taagtactacatgttttgta

SEQ ID NO: 187531 - DNA, 20 bp, Artificial Sequence
  chemically synthesized
aagtactacatgttttgtaa

SEQ ID NO: 187532 - DNA, 20 bp, Artificial Sequence
  chemically synthesized
catgttttgtaagggtatct

SEQ ID NO: 187533 - DNA, 20 bp, Artificial Sequence
  chemically synthesized
atgttttgtaagggtatctt

SEQ ID NO: 187534 - DNA, 20 bp, Artificial Sequence
  chemically synthesized
aagagaaagaaaaacaaccc

SEQ ID NO: 187535 - DNA, 20 bp, Artificial Sequence
  chemically synthesized
gcagcatttcttggaagaga

SEQ ID NO: 187536 - DNA, 20 bp, Artificial Sequence
  chemically synthesized
gttgtttttctttctcttcc

SEQ ID NO: 187537 - DNA, 20 bp, Artificial Sequence
  chemically synthesized
cagggcagcatttcttggaa

SEQ ID NO: 187538 - DNA, 20 bp, Artificial Sequence
  chemically synthesized
cccagggcagcatttcttgg

SEQ ID NO: 187539 - DNA, 20 bp, Artificial Sequence
  chemically synthesized
tggcccagggcagcatttct

SEQ ID NO: 187540 - DNA, 20 bp, Artificial Sequence
  chemically synthesized
tcttccaagaaatgctgccc

SEQ ID NO: 187541 - DNA, 20 bp, Artificial Sequence
  chemically synthesized
cttccaagaaatgctgccct

SEQ ID NO: 187542 - DNA, 20 bp, Artificial Sequence
  chemically synthesized
tttttctttttggcccaggg

SEQ ID NO: 187543 - DNA, 20 bp, Artificial Sequence
  chemically synthesized
gattttttctttttggccca

SEQ ID NO: 187544 - DNA, 20 bp, Artificial Sequence
  chemically synthesized
tgattttttctttttggccc

SEQ ID NO: 187545 - DNA, 20 bp, Artificial Sequence
  chemically synthesized
aaatgctgccctgggccaaa

SEQ ID NO: 187546 - DNA, 20 bp, Artificial Sequence
  chemically synthesized
gtgattttttctttttggcc

SEQ ID NO: 187547 - DNA, 20 bp, Artificial Sequence
  chemically synthesized
agcacgtgattttttctttt

SEQ ID NO: 187548 - DNA, 20 bp, Artificial Sequence
  chemically synthesized
aatctctgcttgaaattgag

SEQ ID NO: 187549 - DNA, 20 bp, Artificial Sequence
  chemically synthesized
atcacgtgctcctcaatttc

SEQ ID NO: 187550 - DNA, 20 bp, Artificial Sequence
  chemically synthesized
tgaatctctgcttgaaattg

SEQ ID NO: 187551 - DNA, 20 bp, Artificial Sequence
  chemically synthesized
ttgaatctctgcttgaaatt

SEQ ID NO: 187552 - DNA, 20 bp, Artificial Sequence
  chemically synthesized
acgtgctcctcaatttcaag

SEQ ID NO: 187553 - DNA, 20 bp, Artificial Sequence
  chemically synthesized
gtgctcctcaatttcaagca

SEQ ID NO: 187554 - DNA, 20 bp, Artificial Sequence
  chemically synthesized
tttcaagcagagattcaata

SEQ ID NO: 187555 - DNA, 20 bp, Artificial Sequence
  chemically synthesized
attcaatacagtgttaccta

SEQ ID NO: 187556 - DNA, 20 bp, Artificial Sequence
  chemically synthesized
aatacagtgttacctaaagt

SEQ ID NO: 187557 - DNA, 20 bp, Artificial Sequence
  chemically synthesized
atacagtgttacctaaagtg

SEQ ID NO: 187558 - DNA, 20 bp, Artificial Sequence
  chemically synthesized
atttatattttcctcacttt

SEQ ID NO: 187559 - DNA, 20 bp, Artificial Sequence
  chemically synthesized
tatttatattttcctcactt

SEQ ID NO: 187560 - DNA, 20 bp, Artificial Sequence
  chemically synthesized
gaggaaaatataaatatgtt

SEQ ID NO: 187561 - DNA, 20 bp, Artificial Sequence
  chemically synthesized
atgtagccctcagtttcaga

SEQ ID NO: 187562 - DNA, 20 bp, Artificial Sequence
  chemically synthesized
aatgtagccctcagtttcag

SEQ ID NO: 187563 - DNA, 20 bp, Artificial Sequence
  chemically synthesized
agtttttgccctctgaaact

SEQ ID NO: 187564 - DNA, 20 bp, Artificial Sequence
  chemically synthesized
aaatgtagccctcagtttca

SEQ ID NO: 187565 - DNA, 20 bp, Artificial Sequence
  chemically synthesized
gtttttgccctctgaaactg

SEQ ID NO: 187566 - DNA, 20 bp, Artificial Sequence
  chemically synthesized
tttttgccctctgaaactga

SEQ ID NO: 187567 - DNA, 20 bp, Artificial Sequence
  chemically synthesized
taaaatgtagccctcagttt

SEQ ID NO: 187568 - DNA, 20 bp, Artificial Sequence
  chemically synthesized
cagatttaaaatgtagccct

SEQ ID NO: 187569 - DNA, 20 bp, Artificial Sequence
  chemically synthesized
ctgggaccagatttaaaatg

SEQ ID NO: 187570 - DNA, 20 bp, Artificial Sequence
  chemically synthesized
tgagggctacattttaaatc

SEQ ID NO: 187571 - DNA, 20 bp, Artificial Sequence
  chemically synthesized
ctacattttaaatctggtcc

SEQ ID NO: 187572 - DNA, 20 bp, Artificial Sequence
  chemically synthesized
cgccaaaacatgtctgggac

SEQ ID NO: 187573 - DNA, 20 bp, Artificial Sequence
  chemically synthesized
tctaacgccaaaacatgtct

SEQ ID NO: 187574 - DNA, 20 bp, Artificial Sequence
  chemically synthesized
ttctaacgccaaaacatgtc

SEQ ID NO: 187575 - DNA, 20 bp, Artificial Sequence
  chemically synthesized
atctggtcccagacatgttt

SEQ ID NO: 187576 - DNA, 20 bp, Artificial Sequence
  chemically synthesized
tcccagacatgttttggcgt

SEQ ID NO: 187577 - DNA, 20 bp, Artificial Sequence
  chemically synthesized
ttcaaatcattaatcaaaca

SEQ ID NO: 187578 - DNA, 20 bp, Artificial Sequence
  chemically synthesized
attaatgatttgaatgcctt

SEQ ID NO: 187579 - DNA, 20 bp, Artificial Sequence
  chemically synthesized
ttaatgatttgaatgccttt

SEQ ID NO: 187580 - DNA, 20 bp, Artificial Sequence
  chemically synthesized
atgatttgaatgcctttagg

SEQ ID NO: 187581 - DNA, 20 bp, Artificial Sequence
  chemically synthesized
tgatttgaatgcctttaggt

SEQ ID NO: 187582 - DNA, 20 bp, Artificial Sequence
  chemically synthesized
gatttgaatgcctttaggtg

SEQ ID NO: 187583 - DNA, 20 bp, Artificial Sequence
  chemically synthesized
tgctttcatgccccacctaa

SEQ ID NO: 187584 - DNA, 20 bp, Artificial Sequence
  chemically synthesized
atgctttcatgccccaccta

SEQ ID NO: 187585 - DNA, 20 bp, Artificial Sequence
  chemically synthesized
tgcctttaggtggggcatga

SEQ ID NO: 187586 - DNA, 20 bp, Artificial Sequence
  chemically synthesized
aagcattcaatcattctgta

SEQ ID NO: 187587 - DNA, 20 bp, Artificial Sequence
  chemically synthesized
agcattcaatcattctgtaa

SEQ ID NO: 187588 - DNA, 20 bp, Artificial Sequence
  chemically synthesized
caccaattcaaatgccttta

SEQ ID NO: 187589 - DNA, 20 bp, Artificial Sequence
  chemically synthesized
ttctgtaaaggcatttgaat

SEQ ID NO: 187590 - DNA, 20 bp, Artificial Sequence
  chemically synthesized
tgtaaaggcatttgaattgg

SEQ ID NO: 187591 - DNA, 20 bp, Artificial Sequence
  chemically synthesized
aacagttttctttaaaacaa

SEQ ID NO: 187592 - DNA, 20 bp, Artificial Sequence
  chemically synthesized
aattggtggctcttgtttta

SEQ ID NO: 187593 - DNA, 20 bp, Artificial Sequence
  chemically synthesized
acaacagttttctttaaaac

SEQ ID NO: 187594 - DNA, 20 bp, Artificial Sequence
  chemically synthesized
tgttctgtactttgtaacaa

SEQ ID NO: 187595 - DNA, 20 bp, Artificial Sequence
  chemically synthesized
taaagaaaactgttgttaca

SEQ ID NO: 187596 - DNA, 20 bp, Artificial Sequence
  chemically synthesized
aaaactgttgttacaaagta

SEQ ID NO: 187597 - DNA, 20 bp, Artificial Sequence
  chemically synthesized
tgttgttacaaagtacagaa

SEQ ID NO: 187598 - DNA, 20 bp, Artificial Sequence
  chemically synthesized
gtacagaacagaactttgca

SEQ ID NO: 187599 - DNA, 20 bp, Artificial Sequence
  chemically synthesized
taaaacctattcgctttgca

SEQ ID NO: 187600 - DNA, 20 bp, Artificial Sequence
  chemically synthesized
acagaactttgcaaagcgaa

SEQ ID NO: 187601 - DNA, 20 bp, Artificial Sequence
  chemically synthesized
cagaactttgcaaagcgaat

SEQ ID NO: 187602 - DNA, 20 bp, Artificial Sequence
  chemically synthesized
tttgcaaagcgaataggttt

SEQ ID NO: 187603 - DNA, 20 bp, Artificial Sequence
  chemically synthesized
gagagagctaacatttattt

SEQ ID NO: 187604 - DNA, 20 bp, Artificial Sequence
  chemically synthesized
tagtttgctaaaataaatgt

SEQ ID NO: 187605 - DNA, 20 bp, Artificial Sequence
  chemically synthesized
taaatccttgaacgtagaga

SEQ ID NO: 187606 - DNA, 20 bp, Artificial Sequence
  chemically synthesized
aataaatccttgaacgtaga

SEQ ID NO: 187607 - DNA, 20 bp, Artificial Sequence
  chemically synthesized
tgttagctctctctacgttc

SEQ ID NO: 187608 - DNA, 20 bp, Artificial Sequence
  chemically synthesized
taaataaatccttgaacgta

SEQ ID NO: 187609 - DNA, 20 bp, Artificial Sequence
  chemically synthesized
gttagctctctctacgttca

SEQ ID NO: 187610 - DNA, 20 bp, Artificial Sequence
  chemically synthesized
attaaataaatccttgaacg

SEQ ID NO: 187611 - DNA, 20 bp, Artificial Sequence
  chemically synthesized
gaatgagttagaaggcgaga

SEQ ID NO: 187612 - DNA, 20 bp, Artificial Sequence
  chemically synthesized
tgaatgagttagaaggcgag

SEQ ID NO: 187613 - DNA, 20 bp, Artificial Sequence
  chemically synthesized
tcatgaatgagttagaaggc

SEQ ID NO: 187614 - DNA, 20 bp, Artificial Sequence
  chemically synthesized
gttctcatgaatgagttaga

SEQ ID NO: 187615 - DNA, 20 bp, Artificial Sequence
  chemically synthesized
agttctcatgaatgagttag

SEQ ID NO: 187616 - DNA, 20 bp, Artificial Sequence
  chemically synthesized
tgaagttctcatgaatgagt

SEQ ID NO: 187617 - DNA, 20 bp, Artificial Sequence
  chemically synthesized
tcgccttctaactcattcat

SEQ ID NO: 187618 - DNA, 20 bp, Artificial Sequence
  chemically synthesized
gtcctgaagttctcatgaat

SEQ ID NO: 187619 - DNA, 20 bp, Artificial Sequence
  chemically synthesized
taactcattcatgagaactt

SEQ ID NO: 187620 - DNA, 20 bp, Artificial Sequence
  chemically synthesized
aactcattcatgagaacttc

SEQ ID NO: 187621 - DNA, 20 bp, Artificial Sequence
  chemically synthesized
aatgttttctatttgtcctg

SEQ ID NO: 187622 - DNA, 20 bp, Artificial Sequence
  chemically synthesized
catgagaacttcaggacaaa

SEQ ID NO: 187623 - DNA, 20 bp, Artificial Sequence
  chemically synthesized
aggacaaatagaaaacattt

SEQ ID NO: 187624 - DNA, 20 bp, Artificial Sequence
  chemically synthesized
ggacaaatagaaaacattta

SEQ ID NO: 187625 - DNA, 20 bp, Artificial Sequence
  chemically synthesized
gacaaatagaaaacatttaa

SEQ ID NO: 187626 - DNA, 20 bp, Artificial Sequence
  chemically synthesized
agtaaatggagagaaaaaca

SEQ ID NO: 187627 - DNA, 20 bp, Artificial Sequence
  chemically synthesized
tgcaaatctaagtaaatgga

SEQ ID NO: 187628 - DNA, 20 bp, Artificial Sequence
  chemically synthesized
tttgcaaatctaagtaaatg

SEQ ID NO: 187629 - DNA, 20 bp, Artificial Sequence
  chemically synthesized
tgtttttctctccatttact

SEQ ID NO: 187630 - DNA, 20 bp, Artificial Sequence
  chemically synthesized
tctttgcaaatctaagtaaa

SEQ ID NO: 187631 - DNA, 20 bp, Artificial Sequence
  chemically synthesized
tttgttttctttgcaaatct

SEQ ID NO: 187632 - DNA, 20 bp, Artificial Sequence
  chemically synthesized
tccatttacttagatttgca

SEQ ID NO: 187633 - DNA, 20 bp, Artificial Sequence
  chemically synthesized
gatttgcaaagaaaacaaat

SEQ ID NO: 187634 - DNA, 20 bp, Artificial Sequence
  chemically synthesized
gatgcctttttatcagggaa

SEQ ID NO: 187635 - DNA, 20 bp, Artificial Sequence
  chemically synthesized
agatgcctttttatcaggga

SEQ ID NO: 187636 - DNA, 20 bp, Artificial Sequence
  chemically synthesized
attggcctttccctgataaa

SEQ ID NO: 187637 - DNA, 20 bp, Artificial Sequence
  chemically synthesized
gacaagatgcctttttatca

SEQ ID NO: 187638 - DNA, 20 bp, Artificial Sequence
  chemically synthesized
ttggcctttccctgataaaa

SEQ ID NO: 187639 - DNA, 20 bp, Artificial Sequence
  chemically synthesized
ggacaagatgcctttttatc

SEQ ID NO: 187640 - DNA, 20 bp, Artificial Sequence
  chemically synthesized
tggacaagatgcctttttat

SEQ ID NO: 187641 - DNA, 20 bp, Artificial Sequence
  chemically synthesized
ataaaaaggcatcttgtcca

SEQ ID NO: 187642 - DNA, 20 bp, Artificial Sequence
  chemically synthesized
aaacaagtacagctgtggac

SEQ ID NO: 187643 - DNA, 20 bp, Artificial Sequence
  chemically synthesized
taagaaaacaagtacagctg

SEQ ID NO: 187644 - DNA, 20 bp, Artificial Sequence
  chemically synthesized
acttaataagaaaacaagta

SEQ ID NO: 187645 - DNA, 20 bp, Artificial Sequence
  chemically synthesized
ggatcacttaataagaaaac

SEQ ID NO: 187646 - DNA, 20 bp, Artificial Sequence
  chemically synthesized
gctgtacttgttttcttatt

SEQ ID NO: 187647 - DNA, 20 bp, Artificial Sequence
  chemically synthesized
tataaccaggatcacttaat

SEQ ID NO: 187648 - DNA, 20 bp, Artificial Sequence
  chemically synthesized
gttttcttattaagtgatcc

SEQ ID NO: 187649 - DNA, 20 bp, Artificial Sequence
  chemically synthesized
ttattaagtgatcctggtta

SEQ ID NO: 187650 - DNA, 20 bp, Artificial Sequence
  chemically synthesized
aagtcacatgttctataacc

SEQ ID NO: 187651 - DNA, 20 bp, Artificial Sequence
  chemically synthesized
gaagtcacatgttctataac

SEQ ID NO: 187652 - DNA, 20 bp, Artificial Sequence
  chemically synthesized
ggttatagaacatgtgactt

SEQ ID NO: 187653 - DNA, 20 bp, Artificial Sequence
  chemically synthesized
gttatagaacatgtgacttc

SEQ ID NO: 187654 - DNA, 20 bp, Artificial Sequence
  chemically synthesized
tagaaagaattttatgcctg

SEQ ID NO: 187655 - DNA, 20 bp, Artificial Sequence
  chemically synthesized
catgctagtaatcatgtaga

SEQ ID NO: 187656 - DNA, 20 bp, Artificial Sequence
  chemically synthesized
gaggcatgctagtaatcatg

SEQ ID NO: 187657 - DNA, 20 bp, Artificial Sequence
  chemically synthesized
aattctttctacatgattac

SEQ ID NO: 187658 - DNA, 20 bp, Artificial Sequence
  chemically synthesized
taatgtgttcagaggcatgc

SEQ ID NO: 187659 - DNA, 20 bp, Artificial Sequence
  chemically synthesized
gaaacatttaatgtgttcag

SEQ ID NO: 187660 - DNA, 20 bp, Artificial Sequence
  chemically synthesized
tgaaacatttaatgtgttca

SEQ ID NO: 187661 - DNA, 20 bp, Artificial Sequence
  chemically synthesized
gatgaaacatttaatgtgtt

SEQ ID NO: 187662 - DNA, 20 bp, Artificial Sequence
  chemically synthesized
acacattaaatgtttcatcg

SEQ ID NO: 187663 - DNA, 20 bp, Artificial Sequence
  chemically synthesized
gtcctgagacagtgtttttt

SEQ ID NO: 187664 - DNA, 20 bp, Artificial Sequence
  chemically synthesized
taactcaaaaaacactgtct

SEQ ID NO: 187665 - DNA, 20 bp, Artificial Sequence
  chemically synthesized
aactcaaaaaacactgtctc

SEQ ID NO: 187666 - DNA, 20 bp, Artificial Sequence
  chemically synthesized
tcgaatatcacgtcctgaga

SEQ ID NO: 187667 - DNA, 20 bp, Artificial Sequence
  chemically synthesized
cctttcgaatatcacgtcct

SEQ ID NO: 187668 - DNA, 20 bp, Artificial Sequence
  chemically synthesized
tctcaggacgtgatattcga

SEQ ID NO: 187669 - DNA, 20 bp, Artificial Sequence
  chemically synthesized
ctcaggacgtgatattcgaa

SEQ ID NO: 187670 - DNA, 20 bp, Artificial Sequence
  chemically synthesized
aggacgtgatattcgaaagg

SEQ ID NO: 187671 - DNA, 20 bp, Artificial Sequence
  chemically synthesized
gtgatattcgaaaggaagca

SEQ ID NO: 187672 - DNA, 20 bp, Artificial Sequence
  chemically synthesized
tgatattcgaaaggaagcat

SEQ ID NO: 187673 - DNA, 20 bp, Artificial Sequence
  chemically synthesized
cctctagagagaagagaaat

SEQ ID NO: 187674 - DNA, 20 bp, Artificial Sequence
  chemically synthesized
tttctaatttctcttctctc

SEQ ID NO: 187675 - DNA, 20 bp, Artificial Sequence
  chemically synthesized
gataatacctctagagagaa

SEQ ID NO: 187676 - DNA, 20 bp, Artificial Sequence
  chemically synthesized
tctaatttctcttctctcta

SEQ ID NO: 187677 - DNA, 20 bp, Artificial Sequence
  chemically synthesized
ttgataatacctctagagag

SEQ ID NO: 187678 - DNA, 20 bp, Artificial Sequence
  chemically synthesized
ctaatttctcttctctctag

SEQ ID NO: 187679 - DNA, 20 bp, Artificial Sequence
  chemically synthesized
aaattgataatacctctaga

SEQ ID NO: 187680 - DNA, 20 bp, Artificial Sequence
  chemically synthesized
ccaaattgataatacctcta

SEQ ID NO: 187681 - DNA, 20 bp, Artificial Sequence
  chemically synthesized
ctccaaattgataatacctc

SEQ ID NO: 187682 - DNA, 20 bp, Artificial Sequence
  chemically synthesized
ctctagaggtattatcaatt

SEQ ID NO: 187683 - DNA, 20 bp, Artificial Sequence
  chemically synthesized
ctagaggtattatcaatttg

SEQ ID NO: 187684 - DNA, 20 bp, Artificial Sequence
  chemically synthesized
cttttgaagaagtatttatg

SEQ ID NO: 187685 - DNA, 20 bp, Artificial Sequence
  chemically synthesized
ccacataaatacttcttcaa

SEQ ID NO: 187686 - DNA, 20 bp, Artificial Sequence
  chemically synthesized
ccgccaaatggcttttgaag

SEQ ID NO: 187687 - DNA, 20 bp, Artificial Sequence
  chemically synthesized
tacccgccaaatggcttttg

SEQ ID NO: 187688 - DNA, 20 bp, Artificial Sequence
  chemically synthesized
atacttcttcaaaagccatt

SEQ ID NO: 187689 - DNA, 20 bp, Artificial Sequence
  chemically synthesized
cttcttcaaaagccatttgg

SEQ ID NO: 187690 - DNA, 20 bp, Artificial Sequence
  chemically synthesized
ttcttcaaaagccatttggc

SEQ ID NO: 187691 - DNA, 20 bp, Artificial Sequence
  chemically synthesized
atcaccctctacccgccaaa

SEQ ID NO: 187692 - DNA, 20 bp, Artificial Sequence
  chemically synthesized
ttcaaaagccatttggcggg

SEQ ID NO: 187693 - DNA, 20 bp, Artificial Sequence
  chemically synthesized
caaaagccatttggcgggta

SEQ ID NO: 187694 - DNA, 20 bp, Artificial Sequence
  chemically synthesized
aaaagccatttggcgggtag

SEQ ID NO: 187695 - DNA, 20 bp, Artificial Sequence
  chemically synthesized
aaagccatttggcgggtaga

SEQ ID NO: 187696 - DNA, 20 bp, Artificial Sequence
  chemically synthesized
acaatatgtatgtgtgcata

SEQ ID NO: 187697 - DNA, 20 bp, Artificial Sequence
  chemically synthesized
tgtatgtgtgcatatagaaa

SEQ ID NO: 187698 - DNA, 20 bp, Artificial Sequence
  chemically synthesized
tttttgaaaaacaattttgt

SEQ ID NO: 187699 - DNA, 20 bp, Artificial Sequence
  chemically synthesized
caaaattgtttttcaaaaat

SEQ ID NO: 187700 - DNA, 20 bp, Artificial Sequence
  chemically synthesized
tcaaaaataagacaatgtgc

SEQ ID NO: 187701 - DNA, 20 bp, Artificial Sequence
  chemically synthesized
aatatttacagtgtataatc

SEQ ID NO: 187702 - DNA, 20 bp, Artificial Sequence
  chemically synthesized
atacttccatcaaatattta

SEQ ID NO: 187703 - DNA, 20 bp, Artificial Sequence
  chemically synthesized
tatacactgtaaatatttga

SEQ ID NO: 187704 - DNA, 20 bp, Artificial Sequence
  chemically synthesized
acactgtaaatatttgatgg

SEQ ID NO: 187705 - DNA, 20 bp, Artificial Sequence
  chemically synthesized
atggaagtatctaatgtcat

SEQ ID NO: 187706 - DNA, 20 bp, Artificial Sequence
  chemically synthesized
ggttttagaaccaatgacat

SEQ ID NO: 187707 - DNA, 20 bp, Artificial Sequence
  chemically synthesized
agtagagaactacagggttt

SEQ ID NO: 187708 - DNA, 20 bp, Artificial Sequence
  chemically synthesized
tcattggttctaaaaccctg

SEQ ID NO: 187709 - DNA, 20 bp, Artificial Sequence
  chemically synthesized
aataccagtagagaactaca

SEQ ID NO: 187710 - DNA, 20 bp, Artificial Sequence
  chemically synthesized
aaataccagtagagaactac

SEQ ID NO: 187711 - DNA, 20 bp, Artificial Sequence
  chemically synthesized
caaataccagtagagaacta

SEQ ID NO: 187712 - DNA, 20 bp, Artificial Sequence
  chemically synthesized
aaaaccctgtagttctctac

SEQ ID NO: 187713 - DNA, 20 bp, Artificial Sequence
  chemically synthesized
aggcatggcaaataccagta

SEQ ID NO: 187714 - DNA, 20 bp, Artificial Sequence
  chemically synthesized
ataggcatggcaaataccag

SEQ ID NO: 187715 - DNA, 20 bp, Artificial Sequence
  chemically synthesized
aatataggcatggcaaatac

SEQ ID NO: 187716 - DNA, 20 bp, Artificial Sequence
  chemically synthesized
acagagtgaaaatataggca

SEQ ID NO: 187717 - DNA, 20 bp, Artificial Sequence
  chemically synthesized
gacttacagagtgaaaatat

SEQ ID NO: 187718 - DNA, 20 bp, Artificial Sequence
  chemically synthesized
tgacttacagagtgaaaata

SEQ ID NO: 187719 - DNA, 20 bp, Artificial Sequence
  chemically synthesized
tgcctatattttcactctgt

SEQ ID NO: 187720 - DNA, 20 bp, Artificial Sequence
  chemically synthesized
caatcaataattgacttaca

SEQ ID NO: 187721 - DNA, 20 bp, Artificial Sequence
  chemically synthesized
tccaatcaataattgactta

SEQ ID NO: 187722 - DNA, 20 bp, Artificial Sequence
  chemically synthesized
tctgtaagtcaattattgat

SEQ ID NO: 187723 - DNA, 20 bp, Artificial Sequence
  chemically synthesized
attgattggatacctcctat

SEQ ID NO: 187724 - DNA, 20 bp, Artificial Sequence
  chemically synthesized
cacagtgtctggctaatagg

SEQ ID NO: 187725 - DNA, 20 bp, Artificial Sequence
  chemically synthesized
ccacagtgtctggctaatag

SEQ ID NO: 187726 - DNA, 20 bp, Artificial Sequence
  chemically synthesized
attggatacctcctattagc

SEQ ID NO: 187727 - DNA, 20 bp, Artificial Sequence
  chemically synthesized
ttccacagtgtctggctaat

SEQ ID NO: 187728 - DNA, 20 bp, Artificial Sequence
  chemically synthesized
cttccacagtgtctggctaa

SEQ ID NO: 187729 - DNA, 20 bp, Artificial Sequence
  chemically synthesized
ctcctattagccagacactg

SEQ ID NO: 187730 - DNA, 20 bp, Artificial Sequence
  chemically synthesized
ctagcaccttccacagtgtc

SEQ ID NO: 187731 - DNA, 20 bp, Artificial Sequence
  chemically synthesized
ctattagccagacactgtgg

SEQ ID NO: 187732 - DNA, 20 bp, Artificial Sequence
  chemically synthesized
tattagccagacactgtgga

SEQ ID NO: 187733 - DNA, 20 bp, Artificial Sequence
  chemically synthesized
atgatgactagcaccttcca

SEQ ID NO: 187734 - DNA, 20 bp, Artificial Sequence
  chemically synthesized
ccagacactgtggaaggtgc

SEQ ID NO: 187735 - DNA, 20 bp, Artificial Sequence
  chemically synthesized
ctccagcagagaatgatgac

SEQ ID NO: 187736 - DNA, 20 bp, Artificial Sequence
  chemically synthesized
tgctagtcatcattctctgc

SEQ ID NO: 187737 - DNA, 20 bp, Artificial Sequence
  chemically synthesized
ctagtcatcattctctgctg

SEQ ID NO: 187738 - DNA, 20 bp, Artificial Sequence
  chemically synthesized
tagtcatcattctctgctgg

SEQ ID NO: 187739 - DNA, 20 bp, Artificial Sequence
  chemically synthesized
aatccattcatcctccagca

SEQ ID NO: 187740 - DNA, 20 bp, Artificial Sequence
  chemically synthesized
ccaatccattcatcctccag

SEQ ID NO: 187741 - DNA, 20 bp, Artificial Sequence
  chemically synthesized
cctccaatccattcatcctc

SEQ ID NO: 187742 - DNA, 20 bp, Artificial Sequence
  chemically synthesized
attctctgctggaggatgaa

SEQ ID NO: 187743 - DNA, 20 bp, Artificial Sequence
  chemically synthesized
ctgctggaggatgaatggat

SEQ ID NO: 187744 - DNA, 20 bp, Artificial Sequence
  chemically synthesized
gctggaggatgaatggattg

SEQ ID NO: 187745 - DNA, 20 bp, Artificial Sequence
  chemically synthesized
ctggaggatgaatggattgg

SEQ ID NO: 187746 - DNA, 20 bp, Artificial Sequence
  chemically synthesized
ggaggatgaatggattggag

SEQ ID NO: 187747 - DNA, 20 bp, Artificial Sequence
  chemically synthesized
atgaatggattggaggagcc

SEQ ID NO: 187748 - DNA, 20 bp, Artificial Sequence
  chemically synthesized
tgaatggattggaggagccc

SEQ ID NO: 187749 - DNA, 20 bp, Artificial Sequence
  chemically synthesized
ggattggaggagcccgggaa

SEQ ID NO: 187750 - DNA, 20 bp, Artificial Sequence
  chemically synthesized
gtctccttacttctattccc

SEQ ID NO: 187751 - DNA, 20 bp, Artificial Sequence
  chemically synthesized
ttggaggagcccgggaatag

SEQ ID NO: 187752 - DNA, 20 bp, Artificial Sequence
  chemically synthesized
ggtctccttacttctattcc

SEQ ID NO: 187753 - DNA, 20 bp, Artificial Sequence
  chemically synthesized
aggagcccgggaatagaagt

SEQ ID NO: 187754 - DNA, 20 bp, Artificial Sequence
  chemically synthesized
ggagcccgggaatagaagta

SEQ ID NO: 187755 - DNA, 20 bp, Artificial Sequence
  chemically synthesized
agcccgggaatagaagtaag

SEQ ID NO: 187756 - DNA, 20 bp, Artificial Sequence
  chemically synthesized
ggaatagaagtaaggagacc

SEQ ID NO: 187757 - DNA, 20 bp, Artificial Sequence
  chemically synthesized
atagaagtaaggagaccaag

SEQ ID NO: 187758 - DNA, 20 bp, Artificial Sequence
  chemically synthesized
tagaagtaaggagaccaagc

SEQ ID NO: 187759 - DNA, 20 bp, Artificial Sequence
  chemically synthesized
gaagtaaggagaccaagcag

SEQ ID NO: 187760 - DNA, 20 bp, Artificial Sequence
  chemically synthesized
ctaccatgatatctcctgct

SEQ ID NO: 187761 - DNA, 20 bp, Artificial Sequence
  chemically synthesized
agaccaagcaggagatatca

SEQ ID NO: 187762 - DNA, 20 bp, Artificial Sequence
  chemically synthesized
ccaagcaggagatatcatgg

SEQ ID NO: 187763 - DNA, 20 bp, Artificial Sequence
  chemically synthesized
aggagatatcatggtagtta

SEQ ID NO: 187764 - DNA, 20 bp, Artificial Sequence
  chemically synthesized
gatatcatggtagttaaagt

SEQ ID NO: 187765 - DNA, 20 bp, Artificial Sequence
  chemically synthesized
atatcatggtagttaaagtg

SEQ ID NO: 187766 - DNA, 20 bp, Artificial Sequence
  chemically synthesized
catggtagttaaagtgagga

SEQ ID NO: 187767 - DNA, 20 bp, Artificial Sequence
  chemically synthesized
gtagttaaagtgaggaaaga

SEQ ID NO: 187768 - DNA, 20 bp, Artificial Sequence
  chemically synthesized
agtgaggaaagatggtcgct

SEQ ID NO: 187769 - DNA, 20 bp, Artificial Sequence
  chemically synthesized
gaaagatggtcgcttggatt

SEQ ID NO: 187770 - DNA, 20 bp, Artificial Sequence
  chemically synthesized
aaagatggtcgcttggattg

SEQ ID NO: 187771 - DNA, 20 bp, Artificial Sequence
  chemically synthesized
cactgactcctcctcaatcc

SEQ ID NO: 187772 - DNA, 20 bp, Artificial Sequence
  chemically synthesized
agatggtcgcttggattgag

SEQ ID NO: 187773 - DNA, 20 bp, Artificial Sequence
  chemically synthesized
gatggtcgcttggattgagg

SEQ ID NO: 187774 - DNA, 20 bp, Artificial Sequence
  chemically synthesized
tggtcgcttggattgaggag

SEQ ID NO: 187775 - DNA, 20 bp, Artificial Sequence
  chemically synthesized
cgcttggattgaggaggagt

SEQ ID NO: 187776 - DNA, 20 bp, Artificial Sequence
  chemically synthesized
ttggattgaggaggagtcag

SEQ ID NO: 187777 - DNA, 20 bp, Artificial Sequence
  chemically synthesized
gattgaggaggagtcagtgg

SEQ ID NO: 187778 - DNA, 20 bp, Artificial Sequence
  chemically synthesized
ggaggagtcagtggcagaaa

SEQ ID NO: 187779 - DNA, 20 bp, Artificial Sequence
  chemically synthesized
aggagtcagtggcagaaatg

SEQ ID NO: 187780 - DNA, 20 bp, Artificial Sequence
  chemically synthesized
gagtcagtggcagaaatgga

SEQ ID NO: 187781 - DNA, 20 bp, Artificial Sequence
  chemically synthesized
tcagtggcagaaatggagag

SEQ ID NO: 187782 - DNA, 20 bp, Artificial Sequence
  chemically synthesized
cagaaatggagagaagtgca

SEQ ID NO: 187783 - DNA, 20 bp, Artificial Sequence
  chemically synthesized
ggagagaagtgcatggaacc

SEQ ID NO: 187784 - DNA, 20 bp, Artificial Sequence
  chemically synthesized
gagaagtgcatggaaccaag

SEQ ID NO: 187785 - DNA, 20 bp, Artificial Sequence
  chemically synthesized
tttactttccaaatgccact

SEQ ID NO: 187786 - DNA, 20 bp, Artificial Sequence
  chemically synthesized
gcatggaaccaagtggcatt

SEQ ID NO: 187787 - DNA, 20 bp, Artificial Sequence
  chemically synthesized
ggaaccaagtggcatttgga

SEQ ID NO: 187788 - DNA, 20 bp, Artificial Sequence
  chemically synthesized
gcatttggaaagtaaataca

SEQ ID NO: 187789 - DNA, 20 bp, Artificial Sequence
  chemically synthesized
catttggaaagtaaatacac

SEQ ID NO: 187790 - DNA, 20 bp, Artificial Sequence
  chemically synthesized
atacacaggacttaatgcat

SEQ ID NO: 187791 - DNA, 20 bp, Artificial Sequence
  chemically synthesized
atttctgtctccaatgcatt

SEQ ID NO: 187792 - DNA, 20 bp, Artificial Sequence
  chemically synthesized
acacaggacttaatgcattg

SEQ ID NO: 187793 - DNA, 20 bp, Artificial Sequence
  chemically synthesized
aggacttaatgcattggaga

SEQ ID NO: 187794 - DNA, 20 bp, Artificial Sequence
  chemically synthesized
atgcattggagacagaaatg

SEQ ID NO: 187795 - DNA, 20 bp, Artificial Sequence
  chemically synthesized
tgcattggagacagaaatga

SEQ ID NO: 187796 - DNA, 20 bp, Artificial Sequence
  chemically synthesized
cattggagacagaaatgaag

SEQ ID NO: 187797 - DNA, 20 bp, Artificial Sequence
  chemically synthesized
ttggagacagaaatgaagga

SEQ ID NO: 187798 - DNA, 20 bp, Artificial Sequence
  chemically synthesized
ggagacagaaatgaaggaga

SEQ ID NO: 187799 - DNA, 20 bp, Artificial Sequence
  chemically synthesized
atgaaggagagagtatcaat

SEQ ID NO: 187800 - DNA, 20 bp, Artificial Sequence
  chemically synthesized
aggagagagtatcaatcaga

SEQ ID NO: 187801 - DNA, 20 bp, Artificial Sequence
  chemically synthesized
gagtatcaatcagacagttg

SEQ ID NO: 187802 - DNA, 20 bp, Artificial Sequence
  chemically synthesized
aatcagacagttgaagatac

SEQ ID NO: 187803 - DNA, 20 bp, Artificial Sequence
  chemically synthesized
gacagttgaagatactggtc

SEQ ID NO: 187804 - DNA, 20 bp, Artificial Sequence
  chemically synthesized
atttcctctgagttccagac

SEQ ID NO: 187805 - DNA, 20 bp, Artificial Sequence
  chemically synthesized
gaagatactggtctggaact

SEQ ID NO: 187806 - DNA, 20 bp, Artificial Sequence
  chemically synthesized
agatactggtctggaactca

SEQ ID NO: 187807 - DNA, 20 bp, Artificial Sequence
  chemically synthesized
ctaatatttcctctgagttc

SEQ ID NO: 187808 - DNA, 20 bp, Artificial Sequence
  chemically synthesized
gatactggtctggaactcag

SEQ ID NO: 187809 - DNA, 20 bp, Artificial Sequence
  chemically synthesized
tcagtcctaatatttcctct

SEQ ID NO: 187810 - DNA, 20 bp, Artificial Sequence
  chemically synthesized
ctggaactcagaggaaatat

SEQ ID NO: 187811 - DNA, 20 bp, Artificial Sequence
  chemically synthesized
tggaactcagaggaaatatt

SEQ ID NO: 187812 - DNA, 20 bp, Artificial Sequence
  chemically synthesized
aatgctctcagttatatttt

SEQ ID NO: 187813 - DNA, 20 bp, Artificial Sequence
  chemically synthesized
ttaggactgaaaatataact

SEQ ID NO: 187814 - DNA, 20 bp, Artificial Sequence
  chemically synthesized
aggactgaaaatataactga

SEQ ID NO: 187815 - DNA, 20 bp, Artificial Sequence
  chemically synthesized
agctctgccaataatgctct

SEQ ID NO: 187816 - DNA, 20 bp, Artificial Sequence
  chemically synthesized
aatataactgagagcattat

SEQ ID NO: 187817 - DNA, 20 bp, Artificial Sequence
  chemically synthesized
ataactgagagcattattgg

SEQ ID NO: 187818 - DNA, 20 bp, Artificial Sequence
  chemically synthesized
aactgagagcattattggca

SEQ ID NO: 187819 - DNA, 20 bp, Artificial Sequence
  chemically synthesized
cacatcataaattttagaca

SEQ ID NO: 187820 - DNA, 20 bp, Artificial Sequence
  chemically synthesized
aaaactcacatcataaattt

SEQ ID NO: 187821 - DNA, 20 bp, Artificial Sequence
  chemically synthesized
atgtctaaaatttatgatgt

SEQ ID NO: 187822 - DNA, 20 bp, Artificial Sequence
  chemically synthesized
aagggactcaaacacatttg

SEQ ID NO: 187823 - DNA, 20 bp, Artificial Sequence
  chemically synthesized
ataagggactcaaacacatt

SEQ ID NO: 187824 - DNA, 20 bp, Artificial Sequence
  chemically synthesized
gttttgctccaaatgtgttt

SEQ ID NO: 187825 - DNA, 20 bp, Artificial Sequence
  chemically synthesized
aatcgtttcaataaaaataa

SEQ ID NO: 187826 - DNA, 20 bp, Artificial Sequence
  chemically synthesized
gaatcgtttcaataaaaata

SEQ ID NO: 187827 - DNA, 20 bp, Artificial Sequence
  chemically synthesized
agaatcgtttcaataaaaat

SEQ ID NO: 187828 - DNA, 20 bp, Artificial Sequence
  chemically synthesized
tatttttattgaaacgattc

SEQ ID NO: 187829 - DNA, 20 bp, Artificial Sequence
  chemically synthesized
atttttattgaaacgattct

SEQ ID NO: 187830 - DNA, 20 bp, Artificial Sequence
  chemically synthesized
ttgctagctttgagtttgcc

SEQ ID NO: 187831 - DNA, 20 bp, Artificial Sequence
  chemically synthesized
aacgattctgggcaaactca

SEQ ID NO: 187832 - DNA, 20 bp, Artificial Sequence
  chemically synthesized
attctgggcaaactcaaagc

SEQ ID NO: 187833 - DNA, 20 bp, Artificial Sequence
  chemically synthesized
ggattatgattgctagcttt

SEQ ID NO: 187834 - DNA, 20 bp, Artificial Sequence
  chemically synthesized
tatgtttggattatgattgc

SEQ ID NO: 187835 - DNA, 20 bp, Artificial Sequence
  chemically synthesized
agggattcccaaaatatgtt

SEQ ID NO: 187836 - DNA, 20 bp, Artificial Sequence
  chemically synthesized
atcataatccaaacatattt

SEQ ID NO: 187837 - DNA, 20 bp, Artificial Sequence
  chemically synthesized
tcataatccaaacatatttt

SEQ ID NO: 187838 - DNA, 20 bp, Artificial Sequence
  chemically synthesized
aacatattttgggaatccct

SEQ ID NO: 187839 - DNA, 20 bp, Artificial Sequence
  chemically synthesized
agtcatcatgcagatactca

SEQ ID NO: 187840 - DNA, 20 bp, Artificial Sequence
  chemically synthesized
tagtcatcatgcagatactc

SEQ ID NO: 187841 - DNA, 20 bp, Artificial Sequence
  chemically synthesized
ttagtcatcatgcagatact

SEQ ID NO: 187842 - DNA, 20 bp, Artificial Sequence
  chemically synthesized
tgacaaaattagtcatcatg

SEQ ID NO: 187843 - DNA, 20 bp, Artificial Sequence
  chemically synthesized
aatgtcaataatgacaaaat

SEQ ID NO: 187844 - DNA, 20 bp, Artificial Sequence
  chemically synthesized
aaaataatacatattagatg

SEQ ID NO: 187845 - DNA, 20 bp, Artificial Sequence
  chemically synthesized
caaatgaaaataatacatat

SEQ ID NO: 187846 - DNA, 20 bp, Artificial Sequence
  chemically synthesized
tatgtattattttcatttgc

SEQ ID NO: 187847 - DNA, 20 bp, Artificial Sequence
  chemically synthesized
gtattattttcatttgctgg

SEQ ID NO: 187848 - DNA, 20 bp, Artificial Sequence
  chemically synthesized
attattttcatttgctggca

SEQ ID NO: 187849 - DNA, 20 bp, Artificial Sequence
  chemically synthesized
tattttcatttgctggcaga

SEQ ID NO: 187850 - DNA, 20 bp, Artificial Sequence
  chemically synthesized
tatgatattaatctctctgc

SEQ ID NO: 187851 - DNA, 20 bp, Artificial Sequence
  chemically synthesized
agagagattaatatcataat

SEQ ID NO: 187852 - DNA, 20 bp, Artificial Sequence
  chemically synthesized
atatcataattagcataatg

SEQ ID NO: 187853 - DNA, 20 bp, Artificial Sequence
  chemically synthesized
ttagcataatgtagaaaatt

SEQ ID NO: 187854 - DNA, 20 bp, Artificial Sequence
  chemically synthesized
agcataatgtagaaaattga

SEQ ID NO: 187855 - DNA, 20 bp, Artificial Sequence
  chemically synthesized
gcataatgtagaaaattgag

SEQ ID NO: 187856 - DNA, 20 bp, Artificial Sequence
  chemically synthesized
caaatttgtggggaatcata

SEQ ID NO: 187857 - DNA, 20 bp, Artificial Sequence
  chemically synthesized
ctattttcttcaaatttgtg

SEQ ID NO: 187858 - DNA, 20 bp, Artificial Sequence
  chemically synthesized
tctattttcttcaaatttgt

SEQ ID NO: 187859 - DNA, 20 bp, Artificial Sequence
  chemically synthesized
ttctattttcttcaaatttg

SEQ ID NO: 187860 - DNA, 20 bp, Artificial Sequence
  chemically synthesized
tatgattccccacaaatttg

SEQ ID NO: 187861 - DNA, 20 bp, Artificial Sequence
  chemically synthesized
ccccacaaatttgaagaaaa

SEQ ID NO: 187862 - DNA, 20 bp, Artificial Sequence
  chemically synthesized
aatagaatatcgttttgatg

SEQ ID NO: 187863 - DNA, 20 bp, Artificial Sequence
  chemically synthesized
ttagggtaggaaaacacaag

SEQ ID NO: 187864 - DNA, 20 bp, Artificial Sequence
  chemically synthesized
gagttagggtaggaaaacac

SEQ ID NO: 187865 - DNA, 20 bp, Artificial Sequence
  chemically synthesized
aggtgggtgggagttagggt

SEQ ID NO: 187866 - DNA, 20 bp, Artificial Sequence
  chemically synthesized
taggtgggtgggagttaggg

SEQ ID NO: 187867 - DNA, 20 bp, Artificial Sequence
  chemically synthesized
taataggtgggtgggagtta

SEQ ID NO: 187868 - DNA, 20 bp, Artificial Sequence
  chemically synthesized
ctaataggtgggtgggagtt

SEQ ID NO: 187869 - DNA, 20 bp, Artificial Sequence
  chemically synthesized
actaataggtgggtgggagt

SEQ ID NO: 187870 - DNA, 20 bp, Artificial Sequence
  chemically synthesized
tttaactaataggtgggtgg

SEQ ID NO: 187871 - DNA, 20 bp, Artificial Sequence
  chemically synthesized
tttttaactaataggtgggt

SEQ ID NO: 187872 - DNA, 20 bp, Artificial Sequence
  chemically synthesized
ttttttaactaataggtggg

SEQ ID NO: 187873 - DNA, 20 bp, Artificial Sequence
  chemically synthesized
cctaactcccacccacctat

SEQ ID NO: 187874 - DNA, 20 bp, Artificial Sequence
  chemically synthesized
attttttttaactaataggt

SEQ ID NO: 187875 - DNA, 20 bp, Artificial Sequence
  chemically synthesized
cattttttttaactaatagg

SEQ ID NO: 187876 - DNA, 20 bp, Artificial Sequence
  chemically synthesized
gaccattttttttaactaat

SEQ ID NO: 187877 - DNA, 20 bp, Artificial Sequence
  chemically synthesized
tgaccattttttttaactaa

SEQ ID NO: 187878 - DNA, 20 bp, Artificial Sequence
  chemically synthesized
cacctattagttaaaaaaaa

SEQ ID NO: 187879 - DNA, 20 bp, Artificial Sequence
  chemically synthesized
ttagttaaaaaaaatggtca

SEQ ID NO: 187880 - DNA, 20 bp, Artificial Sequence
  chemically synthesized
tagttaaaaaaaatggtcaa

SEQ ID NO: 187881 - DNA, 20 bp, Artificial Sequence
  chemically synthesized
gtgatttcaaaatatgtttt

SEQ ID NO: 187882 - DNA, 20 bp, Artificial Sequence
  chemically synthesized
tttcaaaatatgttttgaga

SEQ ID NO: 187883 - DNA, 20 bp, Artificial Sequence
  chemically synthesized
ttgagaaagtgttgtgcttt

SEQ ID NO: 187884 - DNA, 20 bp, Artificial Sequence
  chemically synthesized
gagaaagtgttgtgctttaa

SEQ ID NO: 187885 - DNA, 20 bp, Artificial Sequence
  chemically synthesized
agcttaattctgttctctta

SEQ ID NO: 187886 - DNA, 20 bp, Artificial Sequence
  chemically synthesized
agtgttgtgctttaagagaa

SEQ ID NO: 187887 - DNA, 20 bp, Artificial Sequence
  chemically synthesized
tgctttaagagaacagaatt

SEQ ID NO: 187888 - DNA, 20 bp, Artificial Sequence
  chemically synthesized
atagaagtgtattaaggaac

SEQ ID NO: 187889 - DNA, 20 bp, Artificial Sequence
  chemically synthesized
cacagaatagaagtgtatta

SEQ ID NO: 187890 - DNA, 20 bp, Artificial Sequence
  chemically synthesized
acacagaatagaagtgtatt

SEQ ID NO: 187891 - DNA, 20 bp, Artificial Sequence
  chemically synthesized
ttcttgtgaacacagaatag

SEQ ID NO: 187892 - DNA, 20 bp, Artificial Sequence
  chemically synthesized
gaattcttgtgaacacagaa

SEQ ID NO: 187893 - DNA, 20 bp, Artificial Sequence
  chemically synthesized
cacttctattctgtgttcac

SEQ ID NO: 187894 - DNA, 20 bp, Artificial Sequence
  chemically synthesized
ccatggaattcttgtgaaca

SEQ ID NO: 187895 - DNA, 20 bp, Artificial Sequence
  chemically synthesized
ctgtgttcacaagaattcca

SEQ ID NO: 187896 - DNA, 20 bp, Artificial Sequence
  chemically synthesized
tgtgttcacaagaattccat

SEQ ID NO: 187897 - DNA, 20 bp, Artificial Sequence
  chemically synthesized
tatgccacagcaaaggccca

SEQ ID NO: 187898 - DNA, 20 bp, Artificial Sequence
  chemically synthesized
aattccatgggcctttgctg

SEQ ID NO: 187899 - DNA, 20 bp, Artificial Sequence
  chemically synthesized
taaagactatgccacagcaa

SEQ ID NO: 187900 - DNA, 20 bp, Artificial Sequence
  chemically synthesized
ttaaagactatgccacagca

SEQ ID NO: 187901 - DNA, 20 bp, Artificial Sequence
  chemically synthesized
catgggcctttgctgtggca

SEQ ID NO: 187902 - DNA, 20 bp, Artificial Sequence
  chemically synthesized
agcatttaaagactatgcca

SEQ ID NO: 187903 - DNA, 20 bp, Artificial Sequence
  chemically synthesized
cctacattagacagcattta

SEQ ID NO: 187904 - DNA, 20 bp, Artificial Sequence
  chemically synthesized
tctttaaatgctgtctaatg

SEQ ID NO: 187905 - DNA, 20 bp, Artificial Sequence
  chemically synthesized
aacaatttacctacattaga

SEQ ID NO: 187906 - DNA, 20 bp, Artificial Sequence
  chemically synthesized
ctttaaatgctgtctaatgt

SEQ ID NO: 187907 - DNA, 20 bp, Artificial Sequence
  chemically synthesized
attgaacaatttacctacat

SEQ ID NO: 187908 - DNA, 20 bp, Artificial Sequence
  chemically synthesized
tgtaggtaaattgttcaatg

SEQ ID NO: 187909 - DNA, 20 bp, Artificial Sequence
  chemically synthesized
ggtaaattgttcaatgcagt

SEQ ID NO: 187910 - DNA, 20 bp, Artificial Sequence
  chemically synthesized
aatgcagtaagtgttctctt

SEQ ID NO: 187911 - DNA, 20 bp, Artificial Sequence
  chemically synthesized
ttggagtcagtcacactaaa

SEQ ID NO: 187912 - DNA, 20 bp, Artificial Sequence
  chemically synthesized
tgttggagtcagtcacacta

SEQ ID NO: 187913 - DNA, 20 bp, Artificial Sequence
  chemically synthesized
aattaaatatttgttggagt

SEQ ID NO: 187914 - DNA, 20 bp, Artificial Sequence
  chemically synthesized
cctaaattaaatatttgttg

SEQ ID NO: 187915 - DNA, 20 bp, Artificial Sequence
  chemically synthesized
accctaaattaaatatttgt

SEQ ID NO: 187916 - DNA, 20 bp, Artificial Sequence
  chemically synthesized
actccaacaaatatttaatt

SEQ ID NO: 187917 - DNA, 20 bp, Artificial Sequence
  chemically synthesized
ctccaacaaatatttaattt

SEQ ID NO: 187918 - DNA, 20 bp, Artificial Sequence
  chemically synthesized
tccaacaaatatttaattta

SEQ ID NO: 187919 - DNA, 20 bp, Artificial Sequence
  chemically synthesized
atttaatttagggtaactac

SEQ ID NO: 187920 - DNA, 20 bp, Artificial Sequence
  chemically synthesized
tttaatttagggtaactact

SEQ ID NO: 187921 - DNA, 20 bp, Artificial Sequence
  chemically synthesized
gtaaaacttgagacacctag

SEQ ID NO: 187922 - DNA, 20 bp, Artificial Sequence
  chemically synthesized
attgtaaaacttgagacacc

SEQ ID NO: 187923 - DNA, 20 bp, Artificial Sequence
  chemically synthesized
gggtaactactaggtgtctc

SEQ ID NO: 187924 - DNA, 20 bp, Artificial Sequence
  chemically synthesized
tatttatcattgtaaaactt

SEQ ID NO: 187925 - DNA, 20 bp, Artificial Sequence
  chemically synthesized
caagttttacaatgataaat

SEQ ID NO: 187926 - DNA, 20 bp, Artificial Sequence
  chemically synthesized
gagtgttgacaagaaaatac

SEQ ID NO: 187927 - DNA, 20 bp, Artificial Sequence
  chemically synthesized
attaagttgagagtgttgac

SEQ ID NO: 187928 - DNA, 20 bp, Artificial Sequence
  chemically synthesized
gggtgtccccattaagttga

SEQ ID NO: 187929 - DNA, 20 bp, Artificial Sequence
  chemically synthesized
tgtcaacactctcaacttaa

SEQ ID NO: 187930 - DNA, 20 bp, Artificial Sequence
  chemically synthesized
tagggtgtccccattaagtt

SEQ ID NO: 187931 - DNA, 20 bp, Artificial Sequence
  chemically synthesized
gtcaacactctcaacttaat

SEQ ID NO: 187932 - DNA, 20 bp, Artificial Sequence
  chemically synthesized
tcaacactctcaacttaatg

SEQ ID NO: 187933 - DNA, 20 bp, Artificial Sequence
  chemically synthesized
ttttctagggtgtccccatt

SEQ ID NO: 187934 - DNA, 20 bp, Artificial Sequence
  chemically synthesized
tcaacttaatggggacaccc

SEQ ID NO: 187935 - DNA, 20 bp, Artificial Sequence
  chemically synthesized
ttgtaacacagcattttcta

SEQ ID NO: 187936 - DNA, 20 bp, Artificial Sequence
  chemically synthesized
attgtaacacagcattttct

SEQ ID NO: 187937 - DNA, 20 bp, Artificial Sequence
  chemically synthesized
tattgtaacacagcattttc

SEQ ID NO: 187938 - DNA, 20 bp, Artificial Sequence
  chemically synthesized
gccatagttatattgtaaca

SEQ ID NO: 187939 - DNA, 20 bp, Artificial Sequence
  chemically synthesized
gctgtgttacaatataacta

SEQ ID NO: 187940 - DNA, 20 bp, Artificial Sequence
  chemically synthesized
tgttctcaaagcaatcgcca

SEQ ID NO: 187941 - DNA, 20 bp, Artificial Sequence
  chemically synthesized
ataactatggcgattgcttt

SEQ ID NO: 187942 - DNA, 20 bp, Artificial Sequence
  chemically synthesized
atggcgattgctttgagaac

SEQ ID NO: 187943 - DNA, 20 bp, Artificial Sequence
  chemically synthesized
attgatctatcttgttctca

SEQ ID NO: 187944 - DNA, 20 bp, Artificial Sequence
  chemically synthesized
cgattgctttgagaacaaga

SEQ ID NO: 187945 - DNA, 20 bp, Artificial Sequence
  chemically synthesized
acaagatagatcaatgaatt

SEQ ID NO: 187946 - DNA, 20 bp, Artificial Sequence
  chemically synthesized
gatcaatgaatttggcgaaa

SEQ ID NO: 187947 - DNA, 20 bp, Artificial Sequence
  chemically synthesized
aatgaatttggcgaaatggt

SEQ ID NO: 187948 - DNA, 20 bp, Artificial Sequence
  chemically synthesized
atgaatttggcgaaatggta

SEQ ID NO: 187949 - DNA, 20 bp, Artificial Sequence
  chemically synthesized
tttggcgaaatggtaaggaa

SEQ ID NO: 187950 - DNA, 20 bp, Artificial Sequence
  chemically synthesized
gaaatggtaaggaaaagaaa

SEQ ID NO: 187951 - DNA, 20 bp, Artificial Sequence
  chemically synthesized
ggtaaggaaaagaaacagac

SEQ ID NO: 187952 - DNA, 20 bp, Artificial Sequence
  chemically synthesized
ggaaaagaaacagacaagtt

SEQ ID NO: 187953 - DNA, 20 bp, Artificial Sequence
  chemically synthesized
gaaaagaaacagacaagttg

SEQ ID NO: 187954 - DNA, 20 bp, Artificial Sequence
  chemically synthesized
ttgaggtaattactattata

SEQ ID NO: 187955 - DNA, 20 bp, Artificial Sequence
  chemically synthesized
tgaggtaattactattataa

SEQ ID NO: 187956 - DNA, 20 bp, Artificial Sequence
  chemically synthesized
tgtctttaaggcctttataa

SEQ ID NO: 187957 - DNA, 20 bp, Artificial Sequence
  chemically synthesized
ttactattataaaggcctta

SEQ ID NO: 187958 - DNA, 20 bp, Artificial Sequence
  chemically synthesized
tattataaaggccttaaaga

SEQ ID NO: 187959 - DNA, 20 bp, Artificial Sequence
  chemically synthesized
tggggaaaagactgtcttta

SEQ ID NO: 187960 - DNA, 20 bp, Artificial Sequence
  chemically synthesized
atggggaaaagactgtcttt

SEQ ID NO: 187961 - DNA, 20 bp, Artificial Sequence
  chemically synthesized
gtgatataggaaatggggaa

SEQ ID NO: 187962 - DNA, 20 bp, Artificial Sequence
  chemically synthesized
acttggtgatataggaaatg

SEQ ID NO: 187963 - DNA, 20 bp, Artificial Sequence
  chemically synthesized
tacttggtgatataggaaat

SEQ ID NO: 187964 - DNA, 20 bp, Artificial Sequence
  chemically synthesized
gtacttggtgatataggaaa

SEQ ID NO: 187965 - DNA, 20 bp, Artificial Sequence
  chemically synthesized
agcgctgtacttggtgatat

SEQ ID NO: 187966 - DNA, 20 bp, Artificial Sequence
  chemically synthesized
tccccatttcctatatcacc

SEQ ID NO: 187967 - DNA, 20 bp, Artificial Sequence
  chemically synthesized
cagcgctgtacttggtgata

SEQ ID NO: 187968 - DNA, 20 bp, Artificial Sequence
  chemically synthesized
atttcctatatcaccaagta

SEQ ID NO: 187969 - DNA, 20 bp, Artificial Sequence
  chemically synthesized
gcagtgctcagcgctgtact

SEQ ID NO: 187970 - DNA, 20 bp, Artificial Sequence
  chemically synthesized
atatcaccaagtacagcgct

SEQ ID NO: 187971 - DNA, 20 bp, Artificial Sequence
  chemically synthesized
ttattaagctgagcagtgct

SEQ ID NO: 187972 - DNA, 20 bp, Artificial Sequence
  chemically synthesized
gtacagcgctgagcactgct

SEQ ID NO: 187973 - DNA, 20 bp, Artificial Sequence
  chemically synthesized
taagcaattattaagctgag

SEQ ID NO: 187974 - DNA, 20 bp, Artificial Sequence
  chemically synthesized
tcttaagcaattattaagct

SEQ ID NO: 187975 - DNA, 20 bp, Artificial Sequence
  chemically synthesized
atatttcttaagcaattatt

SEQ ID NO: 187976 - DNA, 20 bp, Artificial Sequence
  chemically synthesized
gctcagcttaataattgctt

SEQ ID NO: 187977 - DNA, 20 bp, Artificial Sequence
  chemically synthesized
tttatcaacaaatatttctt

SEQ ID NO: 187978 - DNA, 20 bp, Artificial Sequence
  chemically synthesized
gaaatatttgttgataaatt

SEQ ID NO: 187979 - DNA, 20 bp, Artificial Sequence
  chemically synthesized
atatttgttgataaattgag

SEQ ID NO: 187980 - DNA, 20 bp, Artificial Sequence
  chemically synthesized
gataaattgagcagaaaact

SEQ ID NO: 187981 - DNA, 20 bp, Artificial Sequence
  chemically synthesized
aattgagcagaaaactaagc

SEQ ID NO: 187982 - DNA, 20 bp, Artificial Sequence
  chemically synthesized
gaagattataatatcttgct

SEQ ID NO: 187983 - DNA, 20 bp, Artificial Sequence
  chemically synthesized
agaatgagaaagcaatcaag

SEQ ID NO: 187984 - DNA, 20 bp, Artificial Sequence
  chemically synthesized
tccagaatgagaaagcaatc

SEQ ID NO: 187985 - DNA, 20 bp, Artificial Sequence
  chemically synthesized
tgaccctttccagaatgaga

SEQ ID NO: 187986 - DNA, 20 bp, Artificial Sequence
  chemically synthesized
tcttgattgctttctcattc

SEQ ID NO: 187987 - DNA, 20 bp, Artificial Sequence
  chemically synthesized
cttttgaccctttccagaat

SEQ ID NO: 187988 - DNA, 20 bp, Artificial Sequence
  chemically synthesized
gattgctttctcattctgga

SEQ ID NO: 187989 - DNA, 20 bp, Artificial Sequence
  chemically synthesized
attgctttctcattctggaa

SEQ ID NO: 187990 - DNA, 20 bp, Artificial Sequence
  chemically synthesized
ttgctttctcattctggaaa

SEQ ID NO: 187991 - DNA, 20 bp, Artificial Sequence
  chemically synthesized
aagttacttttgaccctttc

SEQ ID NO: 187992 - DNA, 20 bp, Artificial Sequence
  chemically synthesized
ctcattctggaaagggtcaa

SEQ ID NO: 187993 - DNA, 20 bp, Artificial Sequence
  chemically synthesized
gctgttgtatgtatttcaaa

SEQ ID NO: 187994 - DNA, 20 bp, Artificial Sequence
  chemically synthesized
actttttgaaatacatacaa

SEQ ID NO: 187995 - DNA, 20 bp, Artificial Sequence
  chemically synthesized
ttgaaatacatacaacagcc

SEQ ID NO: 187996 - DNA, 20 bp, Artificial Sequence
  chemically synthesized
gaaatacatacaacagccta

SEQ ID NO: 187997 - DNA, 20 bp, Artificial Sequence
  chemically synthesized
aaatgtctctttttcactct

SEQ ID NO: 187998 - DNA, 20 bp, Artificial Sequence
  chemically synthesized
taaatgtctctttttcactc

SEQ ID NO: 187999 - DNA, 20 bp, Artificial Sequence
  chemically synthesized
tacaacagcctagagtgaaa

SEQ ID NO: 188000 - DNA, 20 bp, Artificial Sequence
  chemically synthesized
caacagcctagagtgaaaaa

SEQ ID NO: 188001 - DNA, 20 bp, Artificial Sequence
  chemically synthesized
aaataattgtgtttttatca

SEQ ID NO: 188002 - DNA, 20 bp, Artificial Sequence
  chemically synthesized
taacttgttatttgtggtag

SEQ ID NO: 188003 - DNA, 20 bp, Artificial Sequence
  chemically synthesized
aataacttgttatttgtggt

SEQ ID NO: 188004 - DNA, 20 bp, Artificial Sequence
  chemically synthesized
taataacttgttatttgtgg

SEQ ID NO: 188005 - DNA, 20 bp, Artificial Sequence
  chemically synthesized
ccttaataacttgttatttg

SEQ ID NO: 188006 - DNA, 20 bp, Artificial Sequence
  chemically synthesized
catctcctaccacaaataac

SEQ ID NO: 188007 - DNA, 20 bp, Artificial Sequence
  chemically synthesized
accacaaataacaagttatt

SEQ ID NO: 188008 - DNA, 20 bp, Artificial Sequence
  chemically synthesized
ccacaaataacaagttatta

SEQ ID NO: 188009 - DNA, 20 bp, Artificial Sequence
  chemically synthesized
aaataacaagttattaagga

SEQ ID NO: 188010 - DNA, 20 bp, Artificial Sequence
  chemically synthesized
ctcaagagcctgagaaacga

SEQ ID NO: 188011 - DNA, 20 bp, Artificial Sequence
  chemically synthesized
taaggaaagctgtcgtttct

SEQ ID NO: 188012 - DNA, 20 bp, Artificial Sequence
  chemically synthesized
aaggaaagctgtcgtttctc

SEQ ID NO: 188013 - DNA, 20 bp, Artificial Sequence
  chemically synthesized
cttcccattctcaagagcct

SEQ ID NO: 188014 - DNA, 20 bp, Artificial Sequence
  chemically synthesized
ctgtcgtttctcaggctctt

SEQ ID NO: 188015 - DNA, 20 bp, Artificial Sequence
  chemically synthesized
gtttctcaggctcttgagaa

SEQ ID NO: 188016 - DNA, 20 bp, Artificial Sequence
  chemically synthesized
ctaggccttcccattctcaa

SEQ ID NO: 188017 - DNA, 20 bp, Artificial Sequence
  chemically synthesized
tttctcaggctcttgagaat

SEQ ID NO: 188018 - DNA, 20 bp, Artificial Sequence
  chemically synthesized
ttctaggccttcccattctc

SEQ ID NO: 188019 - DNA, 20 bp, Artificial Sequence
  chemically synthesized
ctcaggctcttgagaatggg

SEQ ID NO: 188020 - DNA, 20 bp, Artificial Sequence
  chemically synthesized
tcaggctcttgagaatggga

SEQ ID NO: 188021 - DNA, 20 bp, Artificial Sequence
  chemically synthesized
ctcttgagaatgggaaggcc

SEQ ID NO: 188022 - DNA, 20 bp, Artificial Sequence
  chemically synthesized
tccctctttatcgtatttct

SEQ ID NO: 188023 - DNA, 20 bp, Artificial Sequence
  chemically synthesized
atccctctttatcgtatttc

SEQ ID NO: 188024 - DNA, 20 bp, Artificial Sequence
  chemically synthesized
gaaggcctagaaatacgata

SEQ ID NO: 188025 - DNA, 20 bp, Artificial Sequence
  chemically synthesized
aggcctagaaatacgataaa

SEQ ID NO: 188026 - DNA, 20 bp, Artificial Sequence
  chemically synthesized
ggcctagaaatacgataaag

SEQ ID NO: 188027 - DNA, 20 bp, Artificial Sequence
  chemically synthesized
gcctagaaatacgataaaga

SEQ ID NO: 188028 - DNA, 20 bp, Artificial Sequence
  chemically synthesized
aatacgataaagagggatca

SEQ ID NO: 188029 - DNA, 20 bp, Artificial Sequence
  chemically synthesized
acgataaagagggatcaaag

SEQ ID NO: 188030 - DNA, 20 bp, Artificial Sequence
  chemically synthesized
attaattgatgttagacaca

SEQ ID NO: 188031 - DNA, 20 bp, Artificial Sequence
  chemically synthesized
caattaattgatgttagaca

SEQ ID NO: 188032 - DNA, 20 bp, Artificial Sequence
  chemically synthesized
caaaatcaattaattgatgt

SEQ ID NO: 188033 - DNA, 20 bp, Artificial Sequence
  chemically synthesized
aacatcaattaattgatttt

SEQ ID NO: 188034 - DNA, 20 bp, Artificial Sequence
  chemically synthesized
attaattgattttgagcatt

SEQ ID NO: 188035 - DNA, 20 bp, Artificial Sequence
  chemically synthesized
ttgattttgagcatttagct

SEQ ID NO: 188036 - DNA, 20 bp, Artificial Sequence
  chemically synthesized
tgagcatttagcttagatta

SEQ ID NO: 188037 - DNA, 20 bp, Artificial Sequence
  chemically synthesized
tcttgggggttctgtaatct

SEQ ID NO: 188038 - DNA, 20 bp, Artificial Sequence
  chemically synthesized
gcttagattacagaaccccc

SEQ ID NO: 188039 - DNA, 20 bp, Artificial Sequence
  chemically synthesized
attgttagttgatgtcttgg

SEQ ID NO: 188040 - DNA, 20 bp, Artificial Sequence
  chemically synthesized
gattgttagttgatgtcttg

SEQ ID NO: 188041 - DNA, 20 bp, Artificial Sequence
  chemically synthesized
ggattgttagttgatgtctt

SEQ ID NO: 188042 - DNA, 20 bp, Artificial Sequence
  chemically synthesized
tggattgttagttgatgtct

SEQ ID NO: 188043 - DNA, 20 bp, Artificial Sequence
  chemically synthesized
tgtgcttagatgtggattgt

SEQ ID NO: 188044 - DNA, 20 bp, Artificial Sequence
  chemically synthesized
tcaactaacaatccacatct

SEQ ID NO: 188045 - DNA, 20 bp, Artificial Sequence
  chemically synthesized
gcccaacatgtgcttagatg

SEQ ID NO: 188046 - DNA, 20 bp, Artificial Sequence
  chemically synthesized
agtgatgcccaacatgtgct

SEQ ID NO: 188047 - DNA, 20 bp, Artificial Sequence
  chemically synthesized
atccacatctaagcacatgt

SEQ ID NO: 188048 - DNA, 20 bp, Artificial Sequence
  chemically synthesized
tccacatctaagcacatgtt

SEQ ID NO: 188049 - DNA, 20 bp, Artificial Sequence
  chemically synthesized
agcacatgttgggcatcact

SEQ ID NO: 188050 - DNA, 20 bp, Artificial Sequence
  chemically synthesized
caagagggacatataaggct

SEQ ID NO: 188051 - DNA, 20 bp, Artificial Sequence
  chemically synthesized
cttggcaagagggacatata

SEQ ID NO: 188052 - DNA, 20 bp, Artificial Sequence
  chemically synthesized
acttggcaagagggacatat

SEQ ID NO: 188053 - DNA, 20 bp, Artificial Sequence
  chemically synthesized
ccttatatgtccctcttgcc

SEQ ID NO: 188054 - DNA, 20 bp, Artificial Sequence
  chemically synthesized
gcctgtataacttggcaaga

SEQ ID NO: 188055 - DNA, 20 bp, Artificial Sequence
  chemically synthesized
tgcctgtataacttggcaag

SEQ ID NO: 188056 - DNA, 20 bp, Artificial Sequence
  chemically synthesized
atgcctgtataacttggcaa

SEQ ID NO: 188057 - DNA, 20 bp, Artificial Sequence
  chemically synthesized
taatgcctgtataacttggc

SEQ ID NO: 188058 - DNA, 20 bp, Artificial Sequence
  chemically synthesized
gtccctcttgccaagttata

SEQ ID NO: 188059 - DNA, 20 bp, Artificial Sequence
  chemically synthesized
tgtttaatgcctgtataact

SEQ ID NO: 188060 - DNA, 20 bp, Artificial Sequence
  chemically synthesized
tccctcttgccaagttatac

SEQ ID NO: 188061 - DNA, 20 bp, Artificial Sequence
  chemically synthesized
aggcttggggaaaaataaaa

SEQ ID NO: 188062 - DNA, 20 bp, Artificial Sequence
  chemically synthesized
taaggcttggggaaaaataa

SEQ ID NO: 188063 - DNA, 20 bp, Artificial Sequence
  chemically synthesized
ttactcttttatttttcccc

SEQ ID NO: 188064 - DNA, 20 bp, Artificial Sequence
  chemically synthesized
acctcagaacttaaggcttg

SEQ ID NO: 188065 - DNA, 20 bp, Artificial Sequence
  chemically synthesized
tttatttttccccaagcctt

SEQ ID NO: 188066 - DNA, 20 bp, Artificial Sequence
  chemically synthesized
aacctcagaacttaaggctt

SEQ ID NO: 188067 - DNA, 20 bp, Artificial Sequence
  chemically synthesized
taacctcagaacttaaggct

SEQ ID NO: 188068 - DNA, 20 bp, Artificial Sequence
  chemically synthesized
aaacctaacctcagaactta

SEQ ID NO: 188069 - DNA, 20 bp, Artificial Sequence
  chemically synthesized
ttccccaagccttaagttct

SEQ ID NO: 188070 - DNA, 20 bp, Artificial Sequence
  chemically synthesized
gaaacctaacctcagaactt

SEQ ID NO: 188071 - DNA, 20 bp, Artificial Sequence
  chemically synthesized
tccccaagccttaagttctg

SEQ ID NO: 188072 - DNA, 20 bp, Artificial Sequence
  chemically synthesized
caagccttaagttctgaggt

SEQ ID NO: 188073 - DNA, 20 bp, Artificial Sequence
  chemically synthesized
aagccttaagttctgaggtt

SEQ ID NO: 188074 - DNA, 20 bp, Artificial Sequence
  chemically synthesized
gaaaacaagaaacctaacct

SEQ ID NO: 188075 - DNA, 20 bp, Artificial Sequence
  chemically synthesized
cagataatgagttggaaaac

SEQ ID NO: 188076 - DNA, 20 bp, Artificial Sequence
  chemically synthesized
ccatacaacagataatgagt

SEQ ID NO: 188077 - DNA, 20 bp, Artificial Sequence
  chemically synthesized
attaccatacaacagataat

SEQ ID NO: 188078 - DNA, 20 bp, Artificial Sequence
  chemically synthesized
ccaactcattatctgttgta

SEQ ID NO: 188079 - DNA, 20 bp, Artificial Sequence
  chemically synthesized
agagtagtattaccatacaa

SEQ ID NO: 188080 - DNA, 20 bp, Artificial Sequence
  chemically synthesized
tctaattccatgaaggagag

SEQ ID NO: 188081 - DNA, 20 bp, Artificial Sequence
  chemically synthesized
ggtaatactactctccttca

SEQ ID NO: 188082 - DNA, 20 bp, Artificial Sequence
  chemically synthesized
tcatctaattccatgaagga

SEQ ID NO: 188083 - DNA, 20 bp, Artificial Sequence
  chemically synthesized
tctcatctaattccatgaag

SEQ ID NO: 188084 - DNA, 20 bp, Artificial Sequence
  chemically synthesized
cttctcatctaattccatga

SEQ ID NO: 188085 - DNA, 20 bp, Artificial Sequence
  chemically synthesized
tcttctcatctaattccatg

SEQ ID NO: 188086 - DNA, 20 bp, Artificial Sequence
  chemically synthesized
actactctccttcatggaat

SEQ ID NO: 188087 - DNA, 20 bp, Artificial Sequence
  chemically synthesized
tctccttcatggaattagat

SEQ ID NO: 188088 - DNA, 20 bp, Artificial Sequence
  chemically synthesized
ccttcatggaattagatgag

SEQ ID NO: 188089 - DNA, 20 bp, Artificial Sequence
  chemically synthesized
ttcatggaattagatgagaa

SEQ ID NO: 188090 - DNA, 20 bp, Artificial Sequence
  chemically synthesized
tcatggaattagatgagaag

SEQ ID NO: 188091 - DNA, 20 bp, Artificial Sequence
  chemically synthesized
gcgtgcccagtcaacaagag

SEQ ID NO: 188092 - DNA, 20 bp, Artificial Sequence
  chemically synthesized
ggcgtgcccagtcaacaaga

SEQ ID NO: 188093 - DNA, 20 bp, Artificial Sequence
  chemically synthesized
agggcgtgcccagtcaacaa

SEQ ID NO: 188094 - DNA, 20 bp, Artificial Sequence
  chemically synthesized
attgtgcctctcttgttgac

SEQ ID NO: 188095 - DNA, 20 bp, Artificial Sequence
  chemically synthesized
ttgtgcctctcttgttgact

SEQ ID NO: 188096 - DNA, 20 bp, Artificial Sequence
  chemically synthesized
agagggcgtgcccagtcaac

SEQ ID NO: 188097 - DNA, 20 bp, Artificial Sequence
  chemically synthesized
tgatttgcagagggcgtgcc

SEQ ID NO: 188098 - DNA, 20 bp, Artificial Sequence
  chemically synthesized
ttttttttttgatttgcaga

SEQ ID NO: 188099 - DNA, 20 bp, Artificial Sequence
  chemically synthesized
tttttttttttgatttgcag

SEQ ID NO: 188100 - DNA, 20 bp, Artificial Sequence
  chemically synthesized
ttttttttttttgatttgca

SEQ ID NO: 188101 - DNA, 20 bp, Artificial Sequence
  chemically synthesized
ttttttttttttttgatttg

SEQ ID NO: 188102 - DNA, 20 bp, Artificial Sequence
  chemically synthesized
aatcaaaaaaaaaaaaaaaa

SEQ ID NO: 188103 - DNA, 20 bp, Artificial Sequence
  chemically synthesized
aaaaaaaaaaaagaatgcac

SEQ ID NO: 188104 - DNA, 20 bp, Artificial Sequence
  chemically synthesized
aaaaaaagaatgcacaagca

SEQ ID NO: 188105 - DNA, 20 bp, Artificial Sequence
  chemically synthesized
tacaatgtactgataatggg

SEQ ID NO: 188106 - DNA, 20 bp, Artificial Sequence
  chemically synthesized
atggattcactccccattat

SEQ ID NO: 188107 - DNA, 20 bp, Artificial Sequence
  chemically synthesized
tgtacaatgtactgataatg

SEQ ID NO: 188108 - DNA, 20 bp, Artificial Sequence
  chemically synthesized
ttgtacaatgtactgataat

SEQ ID NO: 188109 - DNA, 20 bp, Artificial Sequence
  chemically synthesized
attgtacaatgtactgataa

SEQ ID NO: 188110 - DNA, 20 bp, Artificial Sequence
  chemically synthesized
atatattgttcaataaaata

SEQ ID NO: 188111 - DNA, 20 bp, Artificial Sequence
  chemically synthesized
tattttattgaacaatatat

SEQ ID NO: 188112 - DNA, 20 bp, Artificial Sequence
  chemically synthesized
ttattgaacaatatataagc

SEQ ID NO: 188113 - DNA, 20 bp, Artificial Sequence
  chemically synthesized
attgaacaatatataagcca

SEQ ID NO: 188114 - DNA, 20 bp, Artificial Sequence
  chemically synthesized
ttgaacaatatataagccag

SEQ ID NO: 188115 - DNA, 20 bp, Artificial Sequence
  chemically synthesized
gctttatccttaggttcctc

SEQ ID NO: 188116 - DNA, 20 bp, Artificial Sequence
  chemically synthesized
tatataagccagaggaacct

SEQ ID NO: 188117 - DNA, 20 bp, Artificial Sequence
  chemically synthesized
atataagccagaggaaccta

SEQ ID NO: 188118 - DNA, 20 bp, Artificial Sequence
  chemically synthesized
gccagaggaacctaaggata

SEQ ID NO: 188119 - DNA, 20 bp, Artificial Sequence
  chemically synthesized
catttgtctgctttatcctt

SEQ ID NO: 188120 - DNA, 20 bp, Artificial Sequence
  chemically synthesized
tcatttgtctgctttatcct

SEQ ID NO: 188121 - DNA, 20 bp, Artificial Sequence
  chemically synthesized
agaggaacctaaggataaag

SEQ ID NO: 188122 - DNA, 20 bp, Artificial Sequence
  chemically synthesized
ataaagcagacaaatgacat

SEQ ID NO: 188123 - DNA, 20 bp, Artificial Sequence
  chemically synthesized
agcagacaaatgacataagc

SEQ ID NO: 188124 - DNA, 20 bp, Artificial Sequence
  chemically synthesized
gacataagcaagtcatctgt

SEQ ID NO: 188125 - DNA, 20 bp, Artificial Sequence
  chemically synthesized
aataattgagaaaaatctaa

SEQ ID NO: 188126 - DNA, 20 bp, Artificial Sequence
  chemically synthesized
agatattcacatgaataatt

SEQ ID NO: 188127 - DNA, 20 bp, Artificial Sequence
  chemically synthesized
ttattcatgtgaatatctaa

SEQ ID NO: 188128 - DNA, 20 bp, Artificial Sequence
  chemically synthesized
tattcatgtgaatatctaaa

SEQ ID NO: 188129 - DNA, 20 bp, Artificial Sequence
  chemically synthesized
catgtgaatatctaaaaggt

SEQ ID NO: 188130 - DNA, 20 bp, Artificial Sequence
  chemically synthesized
atgtgaatatctaaaaggtt

SEQ ID NO: 188131 - DNA, 20 bp, Artificial Sequence
  chemically synthesized
tacaaatatccctaaccttt

SEQ ID NO: 188132 - DNA, 20 bp, Artificial Sequence
  chemically synthesized
tgtgaatatctaaaaggtta

SEQ ID NO: 188133 - DNA, 20 bp, Artificial Sequence
  chemically synthesized
aaggttagggatatttgtaa

SEQ ID NO: 188134 - DNA, 20 bp, Artificial Sequence
  chemically synthesized
ggttagggatatttgtaaaa

SEQ ID NO: 188135 - DNA, 20 bp, Artificial Sequence
  chemically synthesized
tagggatatttgtaaaagag

SEQ ID NO: 188136 - DNA, 20 bp, Artificial Sequence
  chemically synthesized
taaaagagtggtgaaaacta

SEQ ID NO: 188137 - DNA, 20 bp, Artificial Sequence
  chemically synthesized
aaaagagtggtgaaaactat

SEQ ID NO: 188138 - DNA, 20 bp, Artificial Sequence
  chemically synthesized
tgataagaaagtaaaaccta

SEQ ID NO: 188139 - DNA, 20 bp, Artificial Sequence
  chemically synthesized
tacaagctaaattgataaga

SEQ ID NO: 188140 - DNA, 20 bp, Artificial Sequence
  chemically synthesized
gttttactttcttatcaatt

SEQ ID NO: 188141 - DNA, 20 bp, Artificial Sequence
  chemically synthesized
ttcatacaagctaaattgat

SEQ ID NO: 188142 - DNA, 20 bp, Artificial Sequence
  chemically synthesized
ttatcaatttagcttgtatg

SEQ ID NO: 188143 - DNA, 20 bp, Artificial Sequence
  chemically synthesized
tatcaatttagcttgtatga

SEQ ID NO: 188144 - DNA, 20 bp, Artificial Sequence
  chemically synthesized
tttaatcttttccttcatac

SEQ ID NO: 188145 - DNA, 20 bp, Artificial Sequence
  chemically synthesized
atttagcttgtatgaaggaa

SEQ ID NO: 188146 - DNA, 20 bp, Artificial Sequence
  chemically synthesized
tagagagaaaaaaattagaa

SEQ ID NO: 188147 - DNA, 20 bp, Artificial Sequence
  chemically synthesized
gttcctagagagaaaaaaat

SEQ ID NO: 188148 - DNA, 20 bp, Artificial Sequence
  chemically synthesized
ttttctaatttttttctctc

SEQ ID NO: 188149 - DNA, 20 bp, Artificial Sequence
  chemically synthesized
tttctaatttttttctctct

SEQ ID NO: 188150 - DNA, 20 bp, Artificial Sequence
  chemically synthesized
aagaaggaagcgttcctaga

SEQ ID NO: 188151 - DNA, 20 bp, Artificial Sequence
  chemically synthesized
ctaagaaggaagcgttccta

SEQ ID NO: 188152 - DNA, 20 bp, Artificial Sequence
  chemically synthesized
gcctaagaaggaagcgttcc

SEQ ID NO: 188153 - DNA, 20 bp, Artificial Sequence
  chemically synthesized
ctctaggaacgcttccttct

SEQ ID NO: 188154 - DNA, 20 bp, Artificial Sequence
  chemically synthesized
tctaggaacgcttccttctt

SEQ ID NO: 188155 - DNA, 20 bp, Artificial Sequence
  chemically synthesized
tacgtggtagcctaagaagg

SEQ ID NO: 188156 - DNA, 20 bp, Artificial Sequence
  chemically synthesized
tgctacgtggtagcctaaga

SEQ ID NO: 188157 - DNA, 20 bp, Artificial Sequence
  chemically synthesized
atgctacgtggtagcctaag

SEQ ID NO: 188158 - DNA, 20 bp, Artificial Sequence
  chemically synthesized
gaaatgctacgtggtagcct

SEQ ID NO: 188159 - DNA, 20 bp, Artificial Sequence
  chemically synthesized
ttccttcttaggctaccacg

SEQ ID NO: 188160 - DNA, 20 bp, Artificial Sequence
  chemically synthesized
ggtcctgaaatgctacgtgg

SEQ ID NO: 188161 - DNA, 20 bp, Artificial Sequence
  chemically synthesized
aaaggtcctgaaatgctacg

SEQ ID NO: 188162 - DNA, 20 bp, Artificial Sequence
  chemically synthesized
taggctaccacgtagcattt

SEQ ID NO: 188163 - DNA, 20 bp, Artificial Sequence
  chemically synthesized
aggctaccacgtagcatttc

SEQ ID NO: 188164 - DNA, 20 bp, Artificial Sequence
  chemically synthesized
gaggtttcagtcaaatgaaa

SEQ ID NO: 188165 - DNA, 20 bp, Artificial Sequence
  chemically synthesized
tgaggtttcagtcaaatgaa

SEQ ID NO: 188166 - DNA, 20 bp, Artificial Sequence
  chemically synthesized
aaatatttcctttgaggttt

SEQ ID NO: 188167 - DNA, 20 bp, Artificial Sequence
  chemically synthesized
ttcatttgactgaaacctca

SEQ ID NO: 188168 - DNA, 20 bp, Artificial Sequence
  chemically synthesized
tcatttgactgaaacctcaa

SEQ ID NO: 188169 - DNA, 20 bp, Artificial Sequence
  chemically synthesized
gcttgaaaatatttcctttg

SEQ ID NO: 188170 - DNA, 20 bp, Artificial Sequence
  chemically synthesized
ggcttgaaaatatttccttt

SEQ ID NO: 188171 - DNA, 20 bp, Artificial Sequence
  chemically synthesized
acctcaaaggaaatattttc

SEQ ID NO: 188172 - DNA, 20 bp, Artificial Sequence
  chemically synthesized
tttaggagtgaagtggatgt

SEQ ID NO: 188173 - DNA, 20 bp, Artificial Sequence
  chemically synthesized
aaccagttttaggagtgaag

SEQ ID NO: 188174 - DNA, 20 bp, Artificial Sequence
  chemically synthesized
agaaaccagttttaggagtg

SEQ ID NO: 188175 - DNA, 20 bp, Artificial Sequence
  chemically synthesized
atccacttcactcctaaaac

SEQ ID NO: 188176 - DNA, 20 bp, Artificial Sequence
  chemically synthesized
atataagaaaccagttttag

SEQ ID NO: 188177 - DNA, 20 bp, Artificial Sequence
  chemically synthesized
gaatataagaaaccagtttt

SEQ ID NO: 188178 - DNA, 20 bp, Artificial Sequence
  chemically synthesized
tgaatataagaaaccagttt

SEQ ID NO: 188179 - DNA, 20 bp, Artificial Sequence
  chemically synthesized
atgtaatgaatataagaaac

SEQ ID NO: 188180 - DNA, 20 bp, Artificial Sequence
  chemically synthesized
ataaataatgtaatgaatat

SEQ ID NO: 188181 - DNA, 20 bp, Artificial Sequence
  chemically synthesized
tgaatgacatctgtattttc

SEQ ID NO: 188182 - DNA, 20 bp, Artificial Sequence
  chemically synthesized
ggtatccatactggaaaata

SEQ ID NO: 188183 - DNA, 20 bp, Artificial Sequence
  chemically synthesized
gacatctgtattttccagta

SEQ ID NO: 188184 - DNA, 20 bp, Artificial Sequence
  chemically synthesized
tgaactgctggtatccatac

SEQ ID NO: 188185 - DNA, 20 bp, Artificial Sequence
  chemically synthesized
gtattttccagtatggatac

SEQ ID NO: 188186 - DNA, 20 bp, Artificial Sequence
  chemically synthesized
ttttccagtatggataccag

SEQ ID NO: 188187 - DNA, 20 bp, Artificial Sequence
  chemically synthesized
acaaaacaaagttgaactgc

SEQ ID NO: 188188 - DNA, 20 bp, Artificial Sequence
  chemically synthesized
aaaaaaaaagggacaaaaca

SEQ ID NO: 188189 - DNA, 20 bp, Artificial Sequence
  chemically synthesized
ttggaggaatgaaaaaaaaa

SEQ ID NO: 188190 - DNA, 20 bp, Artificial Sequence
  chemically synthesized
attggaggaatgaaaaaaaa

SEQ ID NO: 188191 - DNA, 20 bp, Artificial Sequence
  chemically synthesized
gattggaggaatgaaaaaaa

SEQ ID NO: 188192 - DNA, 20 bp, Artificial Sequence
  chemically synthesized
taaaatagaatttggattgg

SEQ ID NO: 188193 - DNA, 20 bp, Artificial Sequence
  chemically synthesized
gtaaaatagaatttggattg

SEQ ID NO: 188194 - DNA, 20 bp, Artificial Sequence
  chemically synthesized
cagtaaaatagaatttggat

SEQ ID NO: 188195 - DNA, 20 bp, Artificial Sequence
  chemically synthesized
aggatcagtaaaatagaatt

SEQ ID NO: 188196 - DNA, 20 bp, Artificial Sequence
  chemically synthesized
aacaattaggatcagtaaaa

SEQ ID NO: 188197 - DNA, 20 bp, Artificial Sequence
  chemically synthesized
agaagtataacaattaggat

SEQ ID NO: 188198 - DNA, 20 bp, Artificial Sequence
  chemically synthesized
gggcaagaagtataacaatt

SEQ ID NO: 188199 - DNA, 20 bp, Artificial Sequence
  chemically synthesized
cgggcaagaagtataacaat

SEQ ID NO: 188200 - DNA, 20 bp, Artificial Sequence
  chemically synthesized
taattgttatacttcttgcc

SEQ ID NO: 188201 - DNA, 20 bp, Artificial Sequence
  chemically synthesized
gatggaatcaaccgggcaag

SEQ ID NO: 188202 - DNA, 20 bp, Artificial Sequence
  chemically synthesized
aacgatggaatcaaccgggc

SEQ ID NO: 188203 - DNA, 20 bp, Artificial Sequence
  chemically synthesized
caataacgatggaatcaacc

SEQ ID NO: 188204 - DNA, 20 bp, Artificial Sequence
  chemically synthesized
gcaataacgatggaatcaac

SEQ ID NO: 188205 - DNA, 20 bp, Artificial Sequence
  chemically synthesized
tggaggaaaagcaataacga

SEQ ID NO: 188206 - DNA, 20 bp, Artificial Sequence
  chemically synthesized
catcgttattgcttttcctc

SEQ ID NO: 188207 - DNA, 20 bp, Artificial Sequence
  chemically synthesized
gaataaccaggctggaggaa

SEQ ID NO: 188208 - DNA, 20 bp, Artificial Sequence
  chemically synthesized
ttattgcttttcctccagcc

SEQ ID NO: 188209 - DNA, 20 bp, Artificial Sequence
  chemically synthesized
gtaatgaataaccaggctgg

SEQ ID NO: 188210 - DNA, 20 bp, Artificial Sequence
  chemically synthesized
tgtaatgaataaccaggctg

SEQ ID NO: 188211 - DNA, 20 bp, Artificial Sequence
  chemically synthesized
agtgtaatgaataaccaggc

SEQ ID NO: 188212 - DNA, 20 bp, Artificial Sequence
  chemically synthesized
gtgaagtgtaatgaataacc

SEQ ID NO: 188213 - DNA, 20 bp, Artificial Sequence
  chemically synthesized
ggtgaagtgtaatgaataac

SEQ ID NO: 188214 - DNA, 20 bp, Artificial Sequence
  chemically synthesized
gtgtattaataacataggtg

SEQ ID NO: 188215 - DNA, 20 bp, Artificial Sequence
  chemically synthesized
ggagggtgtattaataacat

SEQ ID NO: 188216 - DNA, 20 bp, Artificial Sequence
  chemically synthesized
aggagggtgtattaataaca

SEQ ID NO: 188217 - DNA, 20 bp, Artificial Sequence
  chemically synthesized
ctgagatgaaacagttagga

SEQ ID NO: 188218 - DNA, 20 bp, Artificial Sequence
  chemically synthesized
tctgagatgaaacagttagg

SEQ ID NO: 188219 - DNA, 20 bp, Artificial Sequence
  chemically synthesized
gtctgagatgaaacagttag

SEQ ID NO: 188220 - DNA, 20 bp, Artificial Sequence
  chemically synthesized
gagtctgagatgaaacagtt

SEQ ID NO: 188221 - DNA, 20 bp, Artificial Sequence
  chemically synthesized
agagtctgagatgaaacagt

SEQ ID NO: 188222 - DNA, 20 bp, Artificial Sequence
  chemically synthesized
tgaaagagtctgagatgaaa

SEQ ID NO: 188223 - DNA, 20 bp, Artificial Sequence
  chemically synthesized
ccctcctaactgtttcatct

SEQ ID NO: 188224 - DNA, 20 bp, Artificial Sequence
  chemically synthesized
gttatgcagtgaaagagtct

SEQ ID NO: 188225 - DNA, 20 bp, Artificial Sequence
  chemically synthesized
tagaatgttatgcagtgaaa

SEQ ID NO: 188226 - DNA, 20 bp, Artificial Sequence
  chemically synthesized
tgtagaatgttatgcagtga

SEQ ID NO: 188227 - DNA, 20 bp, Artificial Sequence
  chemically synthesized
agattgtgtagaatgttatg

SEQ ID NO: 188228 - DNA, 20 bp, Artificial Sequence
  chemically synthesized
attaatctggaaagattgtg

SEQ ID NO: 188229 - DNA, 20 bp, Artificial Sequence
  chemically synthesized
aacattctacacaatctttc

SEQ ID NO: 188230 - DNA, 20 bp, Artificial Sequence
  chemically synthesized
atctggaggattaatctgga

SEQ ID NO: 188231 - DNA, 20 bp, Artificial Sequence
  chemically synthesized
atgcatctggaggattaatc

SEQ ID NO: 188232 - DNA, 20 bp, Artificial Sequence
  chemically synthesized
atctttccagattaatcctc

SEQ ID NO: 188233 - DNA, 20 bp, Artificial Sequence
  chemically synthesized
cagaagaactatgcatctgg

SEQ ID NO: 188234 - DNA, 20 bp, Artificial Sequence
  chemically synthesized
ccagaagaactatgcatctg

SEQ ID NO: 188235 - DNA, 20 bp, Artificial Sequence
  chemically synthesized
agattaatcctccagatgca

SEQ ID NO: 188236 - DNA, 20 bp, Artificial Sequence
  chemically synthesized
caccagaagaactatgcatc

SEQ ID NO: 188237 - DNA, 20 bp, Artificial Sequence
  chemically synthesized
ctccagatgcatagttcttc

SEQ ID NO: 188238 - DNA, 20 bp, Artificial Sequence
  chemically synthesized
cagatgcatagttcttctgg

SEQ ID NO: 188239 - DNA, 20 bp, Artificial Sequence
  chemically synthesized
ttgagcagggaatccaccag

SEQ ID NO: 188240 - DNA, 20 bp, Artificial Sequence
  chemically synthesized
tttttgagcagggaatccac

SEQ ID NO: 188241 - DNA, 20 bp, Artificial Sequence
  chemically synthesized
tcagtataaatttttgagca

SEQ ID NO: 188242 - DNA, 20 bp, Artificial Sequence
  chemically synthesized
ttcagtataaatttttgagc

SEQ ID NO: 188243 - DNA, 20 bp, Artificial Sequence
  chemically synthesized
attcagtataaatttttgag

SEQ ID NO: 188244 - DNA, 20 bp, Artificial Sequence
  chemically synthesized
agtattcagtataaattttt

SEQ ID NO: 188245 - DNA, 20 bp, Artificial Sequence
  chemically synthesized
aaaaatttatactgaatact

SEQ ID NO: 188246 - DNA, 20 bp, Artificial Sequence
  chemically synthesized
acaggcaggcactgagtatt

SEQ ID NO: 188247 - DNA, 20 bp, Artificial Sequence
  chemically synthesized
ggcttcaacaggcaggcact

SEQ ID NO: 188248 - DNA, 20 bp, Artificial Sequence
  chemically synthesized
ctatttgggcttcaacaggc

SEQ ID NO: 188249 - DNA, 20 bp, Artificial Sequence
  chemically synthesized
tactcagtgcctgcctgttg

SEQ ID NO: 188250 - DNA, 20 bp, Artificial Sequence
  chemically synthesized
gctatttgggcttcaacagg

SEQ ID NO: 188251 - DNA, 20 bp, Artificial Sequence
  chemically synthesized
tacgctatttgggcttcaac

SEQ ID NO: 188252 - DNA, 20 bp, Artificial Sequence
  chemically synthesized
gtacgctatttgggcttcaa

SEQ ID NO: 188253 - DNA, 20 bp, Artificial Sequence
  chemically synthesized
cctgcctgttgaagcccaaa

SEQ ID NO: 188254 - DNA, 20 bp, Artificial Sequence
  chemically synthesized
gaatgttatgtacgctattt

SEQ ID NO: 188255 - DNA, 20 bp, Artificial Sequence
  chemically synthesized
tgaatgttatgtacgctatt

SEQ ID NO: 188256 - DNA, 20 bp, Artificial Sequence
  chemically synthesized
caaatagcgtacataacatt

SEQ ID NO: 188257 - DNA, 20 bp, Artificial Sequence
  chemically synthesized
acataacattcagaacctca

SEQ ID NO: 188258 - DNA, 20 bp, Artificial Sequence
  chemically synthesized
tatctctcagggatgctatg

SEQ ID NO: 188259 - DNA, 20 bp, Artificial Sequence
  chemically synthesized
gtatctctcagggatgctat

SEQ ID NO: 188260 - DNA, 20 bp, Artificial Sequence
  chemically synthesized
cagaacctcatagcatccct

SEQ ID NO: 188261 - DNA, 20 bp, Artificial Sequence
  chemically synthesized
gaacctcatagcatccctga

SEQ ID NO: 188262 - DNA, 20 bp, Artificial Sequence
  chemically synthesized
gcctaaaaaggtatctctca

SEQ ID NO: 188263 - DNA, 20 bp, Artificial Sequence
  chemically synthesized
agcctaaaaaggtatctctc

SEQ ID NO: 188264 - DNA, 20 bp, Artificial Sequence
  chemically synthesized
aagcctaaaaaggtatctct

SEQ ID NO: 188265 - DNA, 20 bp, Artificial Sequence
  chemically synthesized
atccctgagagatacctttt

SEQ ID NO: 188266 - DNA, 20 bp, Artificial Sequence
  chemically synthesized
tccctgagagataccttttt

SEQ ID NO: 188267 - DNA, 20 bp, Artificial Sequence
  chemically synthesized
tcattgtaagaagcctaaaa

SEQ ID NO: 188268 - DNA, 20 bp, Artificial Sequence
  chemically synthesized
gtcattgtaagaagcctaaa

SEQ ID NO: 188269 - DNA, 20 bp, Artificial Sequence
  chemically synthesized
aattggaaagtcattgtaag

SEQ ID NO: 188270 - DNA, 20 bp, Artificial Sequence
  chemically synthesized
aagaattggaaagtcattgt

SEQ ID NO: 188271 - DNA, 20 bp, Artificial Sequence
  chemically synthesized
agcatggatgaagaattgga

SEQ ID NO: 188272 - DNA, 20 bp, Artificial Sequence
  chemically synthesized
ctgaagcatggatgaagaat

SEQ ID NO: 188273 - DNA, 20 bp, Artificial Sequence
  chemically synthesized
attgcactgaagcatggatg

SEQ ID NO: 188274 - DNA, 20 bp, Artificial Sequence
  chemically synthesized
ccaattcttcatccatgctt

SEQ ID NO: 188275 - DNA, 20 bp, Artificial Sequence
  chemically synthesized
tgtctaattgcactgaagca

SEQ ID NO: 188276 - DNA, 20 bp, Artificial Sequence
  chemically synthesized
tgagttgtctaattgcactg

SEQ ID NO: 188277 - DNA, 20 bp, Artificial Sequence
  chemically synthesized
catccatgcttcagtgcaat

SEQ ID NO: 188278 - DNA, 20 bp, Artificial Sequence
  chemically synthesized
cagtgcaattagacaactca

SEQ ID NO: 188279 - DNA, 20 bp, Artificial Sequence
  chemically synthesized
aatgaccaggacgtcactgt

SEQ ID NO: 188280 - DNA, 20 bp, Artificial Sequence
  chemically synthesized
gacaactcacagtgacgtcc

SEQ ID NO: 188281 - DNA, 20 bp, Artificial Sequence
  chemically synthesized
caaaggtctggagaatgacc

SEQ ID NO: 188282 - DNA, 20 bp, Artificial Sequence
  chemically synthesized
tcaaaggtctggagaatgac

SEQ ID NO: 188283 - DNA, 20 bp, Artificial Sequence
  chemically synthesized
gtgacgtcctggtcattctc

SEQ ID NO: 188284 - DNA, 20 bp, Artificial Sequence
  chemically synthesized
ggagaatagtcaaaggtctg

SEQ ID NO: 188285 - DNA, 20 bp, Artificial Sequence
  chemically synthesized
atggagaatagtcaaaggtc

SEQ ID NO: 188286 - DNA, 20 bp, Artificial Sequence
  chemically synthesized
ggaggatggagaatagtcaa

SEQ ID NO: 188287 - DNA, 20 bp, Artificial Sequence
  chemically synthesized
tggaggatggagaatagtca

SEQ ID NO: 188288 - DNA, 20 bp, Artificial Sequence
  chemically synthesized
acatgatggaggatggagaa

SEQ ID NO: 188289 - DNA, 20 bp, Artificial Sequence
  chemically synthesized
gacacacatgatggaggatg

SEQ ID NO: 188290 - DNA, 20 bp, Artificial Sequence
  chemically synthesized
aagacacacatgatggagga

SEQ ID NO: 188291 - DNA, 20 bp, Artificial Sequence
  chemically synthesized
ggtaaagacacacatgatgg

SEQ ID NO: 188292 - DNA, 20 bp, Artificial Sequence
  chemically synthesized
aggtaaagacacacatgatg

SEQ ID NO: 188293 - DNA, 20 bp, Artificial Sequence
  chemically synthesized
agaggtaaagacacacatga

SEQ ID NO: 188294 - DNA, 20 bp, Artificial Sequence
  chemically synthesized
ggattacataagtagaggta

SEQ ID NO: 188295 - DNA, 20 bp, Artificial Sequence
  chemically synthesized
tgaaaggattacataagtag

SEQ ID NO: 188296 - DNA, 20 bp, Artificial Sequence
  chemically synthesized
atgaaaggattacataagta

SEQ ID NO: 188297 - DNA, 20 bp, Artificial Sequence
  chemically synthesized
gaatgaaaggattacataag

SEQ ID NO: 188298 - DNA, 20 bp, Artificial Sequence
  chemically synthesized
ctggaatgaaaggattacat

SEQ ID NO: 188299 - DNA, 20 bp, Artificial Sequence
  chemically synthesized
cttatgtaatcctttcattc

SEQ ID NO: 188300 - DNA, 20 bp, Artificial Sequence
  chemically synthesized
gtctagtcaactggaatgaa

SEQ ID NO: 188301 - DNA, 20 bp, Artificial Sequence
  chemically synthesized
ggtctagtcaactggaatga

SEQ ID NO: 188302 - DNA, 20 bp, Artificial Sequence
  chemically synthesized
atcctttcattccagttgac

SEQ ID NO: 188303 - DNA, 20 bp, Artificial Sequence
  chemically synthesized
gatctcatggtctagtcaac

SEQ ID NO: 188304 - DNA, 20 bp, Artificial Sequence
  chemically synthesized
attccagttgactagaccat

SEQ ID NO: 188305 - DNA, 20 bp, Artificial Sequence
  chemically synthesized
ctctcatggatctcatggtc

SEQ ID NO: 188306 - DNA, 20 bp, Artificial Sequence
  chemically synthesized
tcctgctctcatggatctca

SEQ ID NO: 188307 - DNA, 20 bp, Artificial Sequence
  chemically synthesized
gactagaccatgagatccat

SEQ ID NO: 188308 - DNA, 20 bp, Artificial Sequence
  chemically synthesized
ctagaccatgagatccatga

SEQ ID NO: 188309 - DNA, 20 bp, Artificial Sequence
  chemically synthesized
gaccatgagatccatgagag

SEQ ID NO: 188310 - DNA, 20 bp, Artificial Sequence
  chemically synthesized
accatgagatccatgagagc

SEQ ID NO: 188311 - DNA, 20 bp, Artificial Sequence
  chemically synthesized
gattacagttcctgctctca

SEQ ID NO: 188312 - DNA, 20 bp, Artificial Sequence
  chemically synthesized
actagagtgagaaaagatta

SEQ ID NO: 188313 - DNA, 20 bp, Artificial Sequence
  chemically synthesized
actaggcactagagtgagaa

SEQ ID NO: 188314 - DNA, 20 bp, Artificial Sequence
  chemically synthesized
actgtaatcttttctcactc

SEQ ID NO: 188315 - DNA, 20 bp, Artificial Sequence
  chemically synthesized
acgttactaggcactagagt

SEQ ID NO: 188316 - DNA, 20 bp, Artificial Sequence
  chemically synthesized
tcttttctcactctagtgcc

SEQ ID NO: 188317 - DNA, 20 bp, Artificial Sequence
  chemically synthesized
caacacgttactaggcacta

SEQ ID NO: 188318 - DNA, 20 bp, Artificial Sequence
  chemically synthesized
agcaacacgttactaggcac

SEQ ID NO: 188319 - DNA, 20 bp, Artificial Sequence
  chemically synthesized
ccaggtagcaacacgttact

SEQ ID NO: 188320 - DNA, 20 bp, Artificial Sequence
  chemically synthesized
gccaggtagcaacacgttac

SEQ ID NO: 188321 - DNA, 20 bp, Artificial Sequence
  chemically synthesized
cctagtaacgtgttgctacc

SEQ ID NO: 188322 - DNA, 20 bp, Artificial Sequence
  chemically synthesized
agtaacgtgttgctacctgg

SEQ ID NO: 188323 - DNA, 20 bp, Artificial Sequence
  chemically synthesized
atgttttgagcactgccagg

SEQ ID NO: 188324 - DNA, 20 bp, Artificial Sequence
  chemically synthesized
aacatgttttgagcactgcc

SEQ ID NO: 188325 - DNA, 20 bp, Artificial Sequence
  chemically synthesized
aaacatgttttgagcactgc

SEQ ID NO: 188326 - DNA, 20 bp, Artificial Sequence
  chemically synthesized
ccatttaacaaacatgtttt

SEQ ID NO: 188327 - DNA, 20 bp, Artificial Sequence
  chemically synthesized
ctcaaaacatgtttgttaaa

SEQ ID NO: 188328 - DNA, 20 bp, Artificial Sequence
  chemically synthesized
acatgtttgttaaatggata

SEQ ID NO: 188329 - DNA, 20 bp, Artificial Sequence
  chemically synthesized
catgtttgttaaatggataa

SEQ ID NO: 188330 - DNA, 20 bp, Artificial Sequence
  chemically synthesized
cacaatagagttagtatttg

SEQ ID NO: 188331 - DNA, 20 bp, Artificial Sequence
  chemically synthesized
tcacaatagagttagtattt

SEQ ID NO: 188332 - DNA, 20 bp, Artificial Sequence
  chemically synthesized
ttcacaatagagttagtatt

SEQ ID NO: 188333 - DNA, 20 bp, Artificial Sequence
  chemically synthesized
aaatgtattcacaatagagt

SEQ ID NO: 188334 - DNA, 20 bp, Artificial Sequence
  chemically synthesized
ttgaaaatgtattcacaata

SEQ ID NO: 188335 - DNA, 20 bp, Artificial Sequence
  chemically synthesized
gcttgaaaatgtattcacaa

SEQ ID NO: 188336 - DNA, 20 bp, Artificial Sequence
  chemically synthesized
tctattgtgaatacattttc

SEQ ID NO: 188337 - DNA, 20 bp, Artificial Sequence
  chemically synthesized
gtgaatacattttcaagcaa

SEQ ID NO: 188338 - DNA, 20 bp, Artificial Sequence
  chemically synthesized
tgtattcccaatttatagga

SEQ ID NO: 188339 - DNA, 20 bp, Artificial Sequence
  chemically synthesized
aagttatctatcctataaat

SEQ ID NO: 188340 - DNA, 20 bp, Artificial Sequence
  chemically synthesized
agttatctatcctataaatt

SEQ ID NO: 188341 - DNA, 20 bp, Artificial Sequence
  chemically synthesized
aaaatgtattcccaatttat

SEQ ID NO: 188342 - DNA, 20 bp, Artificial Sequence
  chemically synthesized
gaaaatgtattcccaattta

SEQ ID NO: 188343 - DNA, 20 bp, Artificial Sequence
  chemically synthesized
taaattgggaatacattttc

SEQ ID NO: 188344 - DNA, 20 bp, Artificial Sequence
  chemically synthesized
gggaatacattttcaagcaa

SEQ ID NO: 188345 - DNA, 20 bp, Artificial Sequence
  chemically synthesized
tacagtatgattttatagga

SEQ ID NO: 188346 - DNA, 20 bp, Artificial Sequence
  chemically synthesized
caagtacagtatgattttat

SEQ ID NO: 188347 - DNA, 20 bp, Artificial Sequence
  chemically synthesized
tcaagtacagtatgatttta

SEQ ID NO: 188348 - DNA, 20 bp, Artificial Sequence
  chemically synthesized
atgtagatacagttcaagta

SEQ ID NO: 188349 - DNA, 20 bp, Artificial Sequence
  chemically synthesized
ccattatgtagatacagttc

SEQ ID NO: 188350 - DNA, 20 bp, Artificial Sequence
  chemically synthesized
gaaaaaccattatgtagata

SEQ ID NO: 188351 - DNA, 20 bp, Artificial Sequence
  chemically synthesized
cttgaactgtatctacataa

SEQ ID NO: 188352 - DNA, 20 bp, Artificial Sequence
  chemically synthesized
gactgtgaaaaaccattatg

SEQ ID NO: 188353 - DNA, 20 bp, Artificial Sequence
  chemically synthesized
atctacataatggtttttca

SEQ ID NO: 188354 - DNA, 20 bp, Artificial Sequence
  chemically synthesized
ataacaaaatttaattttta

SEQ ID NO: 188355 - DNA, 20 bp, Artificial Sequence
  chemically synthesized
aaattaaattttgttattat

SEQ ID NO: 188356 - DNA, 20 bp, Artificial Sequence
  chemically synthesized
attaaattttgttattatta

SEQ ID NO: 188357 - DNA, 20 bp, Artificial Sequence
  chemically synthesized
attttgttattattagagac

SEQ ID NO: 188358 - DNA, 20 bp, Artificial Sequence
  chemically synthesized
ttttgttattattagagaca

SEQ ID NO: 188359 - DNA, 20 bp, Artificial Sequence
  chemically synthesized
tcaaacttgcatgacagaat

SEQ ID NO: 188360 - DNA, 20 bp, Artificial Sequence
  chemically synthesized
aaggactcattctgtcatgc

SEQ ID NO: 188361 - DNA, 20 bp, Artificial Sequence
  chemically synthesized
ctgcactcaaacttgcatga

SEQ ID NO: 188362 - DNA, 20 bp, Artificial Sequence
  chemically synthesized
tcattctgtcatgcaagttt

SEQ ID NO: 188363 - DNA, 20 bp, Artificial Sequence
  chemically synthesized
ctgtcatgcaagtttgagtg

SEQ ID NO: 188364 - DNA, 20 bp, Artificial Sequence
  chemically synthesized
tcatgcaagtttgagtgcag

SEQ ID NO: 188365 - DNA, 20 bp, Artificial Sequence
  chemically synthesized
tgagtgcagtggtacaatca

SEQ ID NO: 188366 - DNA, 20 bp, Artificial Sequence
  chemically synthesized
ggtacaatcatagctcactg

SEQ ID NO: 188367 - DNA, 20 bp, Artificial Sequence
  chemically synthesized
caggggttggagactacagt

SEQ ID NO: 188368 - DNA, 20 bp, Artificial Sequence
  chemically synthesized
agctcaggggttggagacta

SEQ ID NO: 188369 - DNA, 20 bp, Artificial Sequence
  chemically synthesized
tcaccagagctcaggggttg

SEQ ID NO: 188370 - DNA, 20 bp, Artificial Sequence
  chemically synthesized
cactgtagtctccaacccct

SEQ ID NO: 188371 - DNA, 20 bp, Artificial Sequence
  chemically synthesized
gatcaccagagctcaggggt

SEQ ID NO: 188372 - DNA, 20 bp, Artificial Sequence
  chemically synthesized
ggaggatcaccagagctcag

SEQ ID NO: 188373 - DNA, 20 bp, Artificial Sequence
  chemically synthesized
agtctccaacccctgagctc

SEQ ID NO: 188374 - DNA, 20 bp, Artificial Sequence
  chemically synthesized
tggaggatcaccagagctca

SEQ ID NO: 188375 - DNA, 20 bp, Artificial Sequence
  chemically synthesized
gtggaggatcaccagagctc

SEQ ID NO: 188376 - DNA, 20 bp, Artificial Sequence
  chemically synthesized
ggtggaggatcaccagagct

SEQ ID NO: 188377 - DNA, 20 bp, Artificial Sequence
  chemically synthesized
gctgaggtggaggatcacca

SEQ ID NO: 188378 - DNA, 20 bp, Artificial Sequence
  chemically synthesized
aggctgaggtggaggatcac

SEQ ID NO: 188379 - DNA, 20 bp, Artificial Sequence
  chemically synthesized
gctctggtgatcctccacct

SEQ ID NO: 188380 - DNA, 20 bp, Artificial Sequence
  chemically synthesized
tactcaagaggctgaggtgg

SEQ ID NO: 188381 - DNA, 20 bp, Artificial Sequence
  chemically synthesized
ctactcaagaggctgaggtg

SEQ ID NO: 188382 - DNA, 20 bp, Artificial Sequence
  chemically synthesized
agctactcaagaggctgagg

SEQ ID NO: 188383 - DNA, 20 bp, Artificial Sequence
  chemically synthesized
ctcagctactcaagaggctg

SEQ ID NO: 188384 - DNA, 20 bp, Artificial Sequence
  chemically synthesized
tctcagctactcaagaggct

SEQ ID NO: 188385 - DNA, 20 bp, Artificial Sequence
  chemically synthesized
atcctccacctcagcctctt

SEQ ID NO: 188386 - DNA, 20 bp, Artificial Sequence
  chemically synthesized
ctccacctcagcctcttgag

SEQ ID NO: 188387 - DNA, 20 bp, Artificial Sequence
  chemically synthesized
ggtggtctcagctactcaag

SEQ ID NO: 188388 - DNA, 20 bp, Artificial Sequence
  chemically synthesized
cggtggtctcagctactcaa

SEQ ID NO: 188389 - DNA, 20 bp, Artificial Sequence
  chemically synthesized
accggtggtctcagctactc

SEQ ID NO: 188390 - DNA, 20 bp, Artificial Sequence
  chemically synthesized
cctcagcctcttgagtagct

SEQ ID NO: 188391 - DNA, 20 bp, Artificial Sequence
  chemically synthesized
tcttgagtagctgagaccac

SEQ ID NO: 188392 - DNA, 20 bp, Artificial Sequence
  chemically synthesized
gtggtatgcaccggtggtct

SEQ ID NO: 188393 - DNA, 20 bp, Artificial Sequence
  chemically synthesized
ggtgtggtggtatgcaccgg

SEQ ID NO: 188394 - DNA, 20 bp, Artificial Sequence
  chemically synthesized
ctgggtgtggtggtatgcac

SEQ ID NO: 188395 - DNA, 20 bp, Artificial Sequence
  chemically synthesized
ccggtgcataccaccacacc

SEQ ID NO: 188396 - DNA, 20 bp, Artificial Sequence
  chemically synthesized
taaaaattatctgggtgtgg

SEQ ID NO: 188397 - DNA, 20 bp, Artificial Sequence
  chemically synthesized
ttttaaaaattatctgggtg

SEQ ID NO: 188398 - DNA, 20 bp, Artificial Sequence
  chemically synthesized
aaaaattttaaaaattatct

SEQ ID NO: 188399 - DNA, 20 bp, Artificial Sequence
  chemically synthesized
aaaaaattttaaaaattatc

SEQ ID NO: 188400 - DNA, 20 bp, Artificial Sequence
  chemically synthesized
taatttttaaaatttttttg

SEQ ID NO: 188401 - DNA, 20 bp, Artificial Sequence
  chemically synthesized
atttttaaaatttttttgtg

SEQ ID NO: 188402 - DNA, 20 bp, Artificial Sequence
  chemically synthesized
ttaaaatttttttgtggaga

SEQ ID NO: 188403 - DNA, 20 bp, Artificial Sequence
  chemically synthesized
taaaatttttttgtggagac

SEQ ID NO: 188404 - DNA, 20 bp, Artificial Sequence
  chemically synthesized
aaaatttttttgtggagaca

SEQ ID NO: 188405 - DNA, 20 bp, Artificial Sequence
  chemically synthesized
accagcctcagcaaaaaagt

SEQ ID NO: 188406 - DNA, 20 bp, Artificial Sequence
  chemically synthesized
cagggtctcacttttttgct

SEQ ID NO: 188407 - DNA, 20 bp, Artificial Sequence
  chemically synthesized
caagaccagcctcagcaaaa

SEQ ID NO: 188408 - DNA, 20 bp, Artificial Sequence
  chemically synthesized
agggtctcacttttttgctg

SEQ ID NO: 188409 - DNA, 20 bp, Artificial Sequence
  chemically synthesized
tctcacttttttgctgaggc

SEQ ID NO: 188410 - DNA, 20 bp, Artificial Sequence
  chemically synthesized
caggagttcaagaccagcct

SEQ ID NO: 188411 - DNA, 20 bp, Artificial Sequence
  chemically synthesized
tgaggccaggagttcaagac

SEQ ID NO: 188412 - DNA, 20 bp, Artificial Sequence
  chemically synthesized
tgaggctggtcttgaactcc

SEQ ID NO: 188413 - DNA, 20 bp, Artificial Sequence
  chemically synthesized
ttgtttgaggccaggagttc

SEQ ID NO: 188414 - DNA, 20 bp, Artificial Sequence
  chemically synthesized
ggaggattgtttgaggccag

SEQ ID NO: 188415 - DNA, 20 bp, Artificial Sequence
  chemically synthesized
tgggaggattgtttgaggcc

SEQ ID NO: 188416 - DNA, 20 bp, Artificial Sequence
  chemically synthesized
gtgggaggattgtttgaggc

SEQ ID NO: 188417 - DNA, 20 bp, Artificial Sequence
  chemically synthesized
taaggtgggaggattgtttg

SEQ ID NO: 188418 - DNA, 20 bp, Artificial Sequence
  chemically synthesized
ctaaggtgggaggattgttt

SEQ ID NO: 188419 - DNA, 20 bp, Artificial Sequence
  chemically synthesized
ctcaaacaatcctcccacct

SEQ ID NO: 188420 - DNA, 20 bp, Artificial Sequence
  chemically synthesized
ctttggaaggctaaggtggg

SEQ ID NO: 188421 - DNA, 20 bp, Artificial Sequence
  chemically synthesized
actttggaaggctaaggtgg

SEQ ID NO: 188422 - DNA, 20 bp, Artificial Sequence
  chemically synthesized
gcactttggaaggctaaggt

SEQ ID NO: 188423 - DNA, 20 bp, Artificial Sequence
  chemically synthesized
agcactttggaaggctaagg

SEQ ID NO: 188424 - DNA, 20 bp, Artificial Sequence
  chemically synthesized
cctagcactttggaaggcta

SEQ ID NO: 188425 - DNA, 20 bp, Artificial Sequence
  chemically synthesized
tcctagcactttggaaggct

SEQ ID NO: 188426 - DNA, 20 bp, Artificial Sequence
  chemically synthesized
cctcccaccttagccttcca

SEQ ID NO: 188427 - DNA, 20 bp, Artificial Sequence
  chemically synthesized
tatgatcctagcactttgga

SEQ ID NO: 188428 - DNA, 20 bp, Artificial Sequence
  chemically synthesized
ctatgatcctagcactttgg

SEQ ID NO: 188429 - DNA, 20 bp, Artificial Sequence
  chemically synthesized
accttagccttccaaagtgc

SEQ ID NO: 188430 - DNA, 20 bp, Artificial Sequence
  chemically synthesized
ccttagccttccaaagtgct

SEQ ID NO: 188431 - DNA, 20 bp, Artificial Sequence
  chemically synthesized
tgcctatgatcctagcactt

SEQ ID NO: 188432 - DNA, 20 bp, Artificial Sequence
  chemically synthesized
cttccaaagtgctaggatca

SEQ ID NO: 188433 - DNA, 20 bp, Artificial Sequence
  chemically synthesized
ttccaaagtgctaggatcat

SEQ ID NO: 188434 - DNA, 20 bp, Artificial Sequence
  chemically synthesized
gtggctcatgcctatgatcc

SEQ ID NO: 188435 - DNA, 20 bp, Artificial Sequence
  chemically synthesized
agtgctaggatcataggcat

SEQ ID NO: 188436 - DNA, 20 bp, Artificial Sequence
  chemically synthesized
taggcatgagccaccatgcc

SEQ ID NO: 188437 - DNA, 20 bp, Artificial Sequence
  chemically synthesized
gaaatttaggctgggcatgg

SEQ ID NO: 188438 - DNA, 20 bp, Artificial Sequence
  chemically synthesized
aatgaaatttaggctgggca

SEQ ID NO: 188439 - DNA, 20 bp, Artificial Sequence
  chemically synthesized
aaaataatgaaatttaggct

SEQ ID NO: 188440 - DNA, 20 bp, Artificial Sequence
  chemically synthesized
caaaataatgaaatttaggc

SEQ ID NO: 188441 - DNA, 20 bp, Artificial Sequence
  chemically synthesized
caatcaaaataatgaaattt

SEQ ID NO: 188442 - DNA, 20 bp, Artificial Sequence
  chemically synthesized
tcaatcaaaataatgaaatt

SEQ ID NO: 188443 - DNA, 20 bp, Artificial Sequence
  chemically synthesized
atttatgattgtctttattt

SEQ ID NO: 188444 - DNA, 20 bp, Artificial Sequence
  chemically synthesized
tttatgattgtctttatttc

SEQ ID NO: 188445 - DNA, 20 bp, Artificial Sequence
  chemically synthesized
ttatgattgtctttatttca

SEQ ID NO: 188446 - DNA, 20 bp, Artificial Sequence
  chemically synthesized
aagacaatgtccctgaaata

SEQ ID NO: 188447 - DNA, 20 bp, Artificial Sequence
  chemically synthesized
tggagacctcaaaggtaaag

SEQ ID NO: 188448 - DNA, 20 bp, Artificial Sequence
  chemically synthesized
acattgtcttctttaccttt

SEQ ID NO: 188449 - DNA, 20 bp, Artificial Sequence
  chemically synthesized
tagtggagacctcaaaggta

SEQ ID NO: 188450 - DNA, 20 bp, Artificial Sequence
  chemically synthesized
cattgtcttctttacctttg

SEQ ID NO: 188451 - DNA, 20 bp, Artificial Sequence
  chemically synthesized
gagcatagtggagacctcaa

SEQ ID NO: 188452 - DNA, 20 bp, Artificial Sequence
  chemically synthesized
tgagcatagtggagacctca

SEQ ID NO: 188453 - DNA, 20 bp, Artificial Sequence
  chemically synthesized
attaactgatgagcatagtg

SEQ ID NO: 188454 - DNA, 20 bp, Artificial Sequence
  chemically synthesized
aaattaactgatgagcatag

SEQ ID NO: 188455 - DNA, 20 bp, Artificial Sequence
  chemically synthesized
gaggtctccactatgctcat

SEQ ID NO: 188456 - DNA, 20 bp, Artificial Sequence
  chemically synthesized
aacaaattaactgatgagca

SEQ ID NO: 188457 - DNA, 20 bp, Artificial Sequence
  chemically synthesized
aaaagaacaaattaactgat

SEQ ID NO: 188458 - DNA, 20 bp, Artificial Sequence
  chemically synthesized
tcatttagccatttagtaaa

SEQ ID NO: 188459 - DNA, 20 bp, Artificial Sequence
  chemically synthesized
aatttgttctttttactaaa

SEQ ID NO: 188460 - DNA, 20 bp, Artificial Sequence
  chemically synthesized
cagtcactcatttagccatt

SEQ ID NO: 188461 - DNA, 20 bp, Artificial Sequence
  chemically synthesized
tttttactaaatggctaaat

SEQ ID NO: 188462 - DNA, 20 bp, Artificial Sequence
  chemically synthesized
aagaaactcagtcactcatt

SEQ ID NO: 188463 - DNA, 20 bp, Artificial Sequence
  chemically synthesized
aaatggctaaatgagtgact

SEQ ID NO: 188464 - DNA, 20 bp, Artificial Sequence
  chemically synthesized
acataccagtaaaagaaact

SEQ ID NO: 188465 - DNA, 20 bp, Artificial Sequence
  chemically synthesized
agtgactgagtttcttttac

SEQ ID NO: 188466 - DNA, 20 bp, Artificial Sequence
  chemically synthesized
gtttcaccacataccagtaa

SEQ ID NO: 188467 - DNA, 20 bp, Artificial Sequence
  chemically synthesized
gagtttcttttactggtatg

SEQ ID NO: 188468 - DNA, 20 bp, Artificial Sequence
  chemically synthesized
tctgcagtttcaccacatac

SEQ ID NO: 188469 - DNA, 20 bp, Artificial Sequence
  chemically synthesized
actggtatgtggtgaaactg

SEQ ID NO: 188470 - DNA, 20 bp, Artificial Sequence
  chemically synthesized
caacgtgcataaaaattctg

SEQ ID NO: 188471 - DNA, 20 bp, Artificial Sequence
  chemically synthesized
agaatttttatgcacgttga

SEQ ID NO: 188472 - DNA, 20 bp, Artificial Sequence
  chemically synthesized
tgcacgttgaaagaatctct

SEQ ID NO: 188473 - DNA, 20 bp, Artificial Sequence
  chemically synthesized
cacgttgaaagaatctctaa

SEQ ID NO: 188474 - DNA, 20 bp, Artificial Sequence
  chemically synthesized
ccaaatgtgctatgctctta

SEQ ID NO: 188475 - DNA, 20 bp, Artificial Sequence
  chemically synthesized
tgaaagaatctctaagagca

SEQ ID NO: 188476 - DNA, 20 bp, Artificial Sequence
  chemically synthesized
taccaaatgtgctatgctct

SEQ ID NO: 188477 - DNA, 20 bp, Artificial Sequence
  chemically synthesized
ctctaagagcatagcacatt

SEQ ID NO: 188478 - DNA, 20 bp, Artificial Sequence
  chemically synthesized
agcatagcacatttggtaaa

SEQ ID NO: 188479 - DNA, 20 bp, Artificial Sequence
  chemically synthesized
ggtatttaaaagtacagaaa

SEQ ID NO: 188480 - DNA, 20 bp, Artificial Sequence
  chemically synthesized
ctagtaggtatttaaaagta

SEQ ID NO: 188481 - DNA, 20 bp, Artificial Sequence
  chemically synthesized
gacccctagtaggtatttaa

SEQ ID NO: 188482 - DNA, 20 bp, Artificial Sequence
  chemically synthesized
ctgtacttttaaatacctac

SEQ ID NO: 188483 - DNA, 20 bp, Artificial Sequence
  chemically synthesized
tgtacttttaaatacctact

SEQ ID NO: 188484 - DNA, 20 bp, Artificial Sequence
  chemically synthesized
gtacttttaaatacctacta

SEQ ID NO: 188485 - DNA, 20 bp, Artificial Sequence
  chemically synthesized
tacttttaaatacctactag

SEQ ID NO: 188486 - DNA, 20 bp, Artificial Sequence
  chemically synthesized
ttttttgctagacccctagt

SEQ ID NO: 188487 - DNA, 20 bp, Artificial Sequence
  chemically synthesized
tttttttgctagacccctag

SEQ ID NO: 188488 - DNA, 20 bp, Artificial Sequence
  chemically synthesized
ttaaatacctactaggggtc

SEQ ID NO: 188489 - DNA, 20 bp, Artificial Sequence
  chemically synthesized
ttttttttttgctagacccc

SEQ ID NO: 188490 - DNA, 20 bp, Artificial Sequence
  chemically synthesized
gcactattttttttttttgc

SEQ ID NO: 188491 - DNA, 20 bp, Artificial Sequence
  chemically synthesized
ggtctagcaaaaaaaaaaaa

SEQ ID NO: 188492 - DNA, 20 bp, Artificial Sequence
  chemically synthesized
aaaaaatagtgctgatgctg

SEQ ID NO: 188493 - DNA, 20 bp, Artificial Sequence
  chemically synthesized
tctttgaccagcttcagcat

SEQ ID NO: 188494 - DNA, 20 bp, Artificial Sequence
  chemically synthesized
aatagtgctgatgctgaagc

SEQ ID NO: 188495 - DNA, 20 bp, Artificial Sequence
  chemically synthesized
gaattgtctttgaccagctt

SEQ ID NO: 188496 - DNA, 20 bp, Artificial Sequence
  chemically synthesized
gctgatgctgaagctggtca

SEQ ID NO: 188497 - DNA, 20 bp, Artificial Sequence
  chemically synthesized
acatttgaattgtctttgac

SEQ ID NO: 188498 - DNA, 20 bp, Artificial Sequence
  chemically synthesized
cccaccactaatatgaagtg

SEQ ID NO: 188499 - DNA, 20 bp, Artificial Sequence
  chemically synthesized
aaatgttctgcacttcatat

SEQ ID NO: 188500 - DNA, 20 bp, Artificial Sequence
  chemically synthesized
gcaaccccaccactaatatg

SEQ ID NO: 188501 - DNA, 20 bp, Artificial Sequence
  chemically synthesized
tgttctgcacttcatattag

SEQ ID NO: 188502 - DNA, 20 bp, Artificial Sequence
  chemically synthesized
tctgcacttcatattagtgg

SEQ ID NO: 188503 - DNA, 20 bp, Artificial Sequence
  chemically synthesized
ctgcacttcatattagtggt

SEQ ID NO: 188504 - DNA, 20 bp, Artificial Sequence
  chemically synthesized
tgcacttcatattagtggtg

SEQ ID NO: 188505 - DNA, 20 bp, Artificial Sequence
  chemically synthesized
atattagtggtggggttgcc

SEQ ID NO: 188506 - DNA, 20 bp, Artificial Sequence
  chemically synthesized
tattagtggtggggttgcca

SEQ ID NO: 188507 - DNA, 20 bp, Artificial Sequence
  chemically synthesized
gtggtggggttgccaaggaa

SEQ ID NO: 188508 - DNA, 20 bp, Artificial Sequence
  chemically synthesized
ggtggggttgccaaggaaca

SEQ ID NO: 188509 - DNA, 20 bp, Artificial Sequence
  chemically synthesized
tttgtaaaagctctgttcct

SEQ ID NO: 188510 - DNA, 20 bp, Artificial Sequence
  chemically synthesized
caaggaacagagcttttaca

SEQ ID NO: 188511 - DNA, 20 bp, Artificial Sequence
  chemically synthesized
gcagggcattagctttgtaa

SEQ ID NO: 188512 - DNA, 20 bp, Artificial Sequence
  chemically synthesized
ctgcctgagcagcagggcat

SEQ ID NO: 188513 - DNA, 20 bp, Artificial Sequence
  chemically synthesized
aaagctaatgccctgctgct

SEQ ID NO: 188514 - DNA, 20 bp, Artificial Sequence
  chemically synthesized
gtgttgctgcctgagcagca

SEQ ID NO: 188515 - DNA, 20 bp, Artificial Sequence
  chemically synthesized
aagctaatgccctgctgctc

SEQ ID NO: 188516 - DNA, 20 bp, Artificial Sequence
  chemically synthesized
agtgttgctgcctgagcagc

SEQ ID NO: 188517 - DNA, 20 bp, Artificial Sequence
  chemically synthesized
cagtgttgctgcctgagcag

SEQ ID NO: 188518 - DNA, 20 bp, Artificial Sequence
  chemically synthesized
ctaatgccctgctgctcagg

SEQ ID NO: 188519 - DNA, 20 bp, Artificial Sequence
  chemically synthesized
atgcagtgttgctgcctgag

SEQ ID NO: 188520 - DNA, 20 bp, Artificial Sequence
  chemically synthesized
agaatgcagtgttgctgcct

SEQ ID NO: 188521 - DNA, 20 bp, Artificial Sequence
  chemically synthesized
caggcagcaacactgcattc

SEQ ID NO: 188522 - DNA, 20 bp, Artificial Sequence
  chemically synthesized
ctgaagagtctactagaatg

SEQ ID NO: 188523 - DNA, 20 bp, Artificial Sequence
  chemically synthesized
gcagcaacactgcattctag

SEQ ID NO: 188524 - DNA, 20 bp, Artificial Sequence
  chemically synthesized
actttatctgaagagtctac

SEQ ID NO: 188525 - DNA, 20 bp, Artificial Sequence
  chemically synthesized
ctgcattctagtagactctt

SEQ ID NO: 188526 - DNA, 20 bp, Artificial Sequence
  chemically synthesized
ttctttttactttatctgaa

SEQ ID NO: 188527 - DNA, 20 bp, Artificial Sequence
  chemically synthesized
tctagtagactcttcagata

SEQ ID NO: 188528 - DNA, 20 bp, Artificial Sequence
  chemically synthesized
ttttctttttactttatctg

SEQ ID NO: 188529 - DNA, 20 bp, Artificial Sequence
  chemically synthesized
gactcttcagataaagtaaa

SEQ ID NO: 188530 - DNA, 20 bp, Artificial Sequence
  chemically synthesized
ttcagataaagtaaaaagaa

SEQ ID NO: 188531 - DNA, 20 bp, Artificial Sequence
  chemically synthesized
taaaaagaaaagaaacaaaa

SEQ ID NO: 188532 - DNA, 20 bp, Artificial Sequence
  chemically synthesized
aaaaagaaaagaaacaaaac

SEQ ID NO: 188533 - DNA, 20 bp, Artificial Sequence
  chemically synthesized
aggaaaatgtctgtcattcc

SEQ ID NO: 188534 - DNA, 20 bp, Artificial Sequence
  chemically synthesized
aacttgaagactgggaatga

SEQ ID NO: 188535 - DNA, 20 bp, Artificial Sequence
  chemically synthesized
gtctgtcattcccagtcttc

SEQ ID NO: 188536 - DNA, 20 bp, Artificial Sequence
  chemically synthesized
attcatataacttgaagact

SEQ ID NO: 188537 - DNA, 20 bp, Artificial Sequence
  chemically synthesized
cattcatataacttgaagac

SEQ ID NO: 188538 - DNA, 20 bp, Artificial Sequence
  chemically synthesized
gaggtcattcatataacttg

SEQ ID NO: 188539 - DNA, 20 bp, Artificial Sequence
  chemically synthesized
gtgaaaatagtatcattttg

SEQ ID NO: 188540 - DNA, 20 bp, Artificial Sequence
  chemically synthesized
ggtgaaaatagtatcatttt

SEQ ID NO: 188541 - DNA, 20 bp, Artificial Sequence
  chemically synthesized
ttatgattattgggtgaaaa

SEQ ID NO: 188542 - DNA, 20 bp, Artificial Sequence
  chemically synthesized
ttattacctttatgattatt

SEQ ID NO: 188543 - DNA, 20 bp, Artificial Sequence
  chemically synthesized
attattacctttatgattat

SEQ ID NO: 188544 - DNA, 20 bp, Artificial Sequence
  chemically synthesized
attttcacccaataatcata

SEQ ID NO: 188545 - DNA, 20 bp, Artificial Sequence
  chemically synthesized
ttttcacccaataatcataa

SEQ ID NO: 188546 - DNA, 20 bp, Artificial Sequence
  chemically synthesized
catatagattatgtgtgttg

SEQ ID NO: 188547 - DNA, 20 bp, Artificial Sequence
  chemically synthesized
ggatttattggacattcata

SEQ ID NO: 188548 - DNA, 20 bp, Artificial Sequence
  chemically synthesized
gcatcttttcatggatttat

SEQ ID NO: 188549 - DNA, 20 bp, Artificial Sequence
  chemically synthesized
atgtccaataaatccatgaa

SEQ ID NO: 188550 - DNA, 20 bp, Artificial Sequence
  chemically synthesized
cactattaagcatcttttca

SEQ ID NO: 188551 - DNA, 20 bp, Artificial Sequence
  chemically synthesized
atccatgaaaagatgcttaa

SEQ ID NO: 188552 - DNA, 20 bp, Artificial Sequence
  chemically synthesized
ctctgattactagcactatt

SEQ ID NO: 188553 - DNA, 20 bp, Artificial Sequence
  chemically synthesized
gaaaagatgcttaatagtgc

SEQ ID NO: 188554 - DNA, 20 bp, Artificial Sequence
  chemically synthesized
tgcttaatagtgctagtaat

SEQ ID NO: 188555 - DNA, 20 bp, Artificial Sequence
  chemically synthesized
cttaatagtgctagtaatca

SEQ ID NO: 188556 - DNA, 20 bp, Artificial Sequence
  chemically synthesized
acttatattcctctgattac

SEQ ID NO: 188557 - DNA, 20 bp, Artificial Sequence
  chemically synthesized
ttaatagtgctagtaatcag

SEQ ID NO: 188558 - DNA, 20 bp, Artificial Sequence
  chemically synthesized
gctagtaatcagaggaatat

SEQ ID NO: 188559 - DNA, 20 bp, Artificial Sequence
  chemically synthesized
aatatgtaggtatattgttg

SEQ ID NO: 188560 - DNA, 20 bp, Artificial Sequence
  chemically synthesized
tgctatcttacagaatatgt

SEQ ID NO: 188561 - DNA, 20 bp, Artificial Sequence
  chemically synthesized
ttgctatcttacagaatatg

SEQ ID NO: 188562 - DNA, 20 bp, Artificial Sequence
  chemically synthesized
aatatacctacatattctgt

SEQ ID NO: 188563 - DNA, 20 bp, Artificial Sequence
  chemically synthesized
tacctacatattctgtaaga

SEQ ID NO: 188564 - DNA, 20 bp, Artificial Sequence
  chemically synthesized
ttttaatttttgctatctta

SEQ ID NO: 188565 - DNA, 20 bp, Artificial Sequence
  chemically synthesized
caaaaattaaaatgactgac

SEQ ID NO: 188566 - DNA, 20 bp, Artificial Sequence
  chemically synthesized
ttgtcaatatttggtcttgt

SEQ ID NO: 188567 - DNA, 20 bp, Artificial Sequence
  chemically synthesized
tctacatctttgtcaatatt

SEQ ID NO: 188568 - DNA, 20 bp, Artificial Sequence
  chemically synthesized
gacaagaccaaatattgaca

SEQ ID NO: 188569 - DNA, 20 bp, Artificial Sequence
  chemically synthesized
accaaatattgacaaagatg

SEQ ID NO: 188570 - DNA, 20 bp, Artificial Sequence
  chemically synthesized
caaatattgacaaagatgta

SEQ ID NO: 188571 - DNA, 20 bp, Artificial Sequence
  chemically synthesized
tgacaaagatgtagagtaac

SEQ ID NO: 188572 - DNA, 20 bp, Artificial Sequence
  chemically synthesized
ccagtgatgatggagagttc

SEQ ID NO: 188573 - DNA, 20 bp, Artificial Sequence
  chemically synthesized
atgccaccagtgatgatgga

SEQ ID NO: 188574 - DNA, 20 bp, Artificial Sequence
  chemically synthesized
caatgccaccagtgatgatg

SEQ ID NO: 188575 - DNA, 20 bp, Artificial Sequence
  chemically synthesized
ctggaactctccatcatcac

SEQ ID NO: 188576 - DNA, 20 bp, Artificial Sequence
  chemically synthesized
tgcaatgccaccagtgatga

SEQ ID NO: 188577 - DNA, 20 bp, Artificial Sequence
  chemically synthesized
gaactctccatcatcactgg

SEQ ID NO: 188578 - DNA, 20 bp, Artificial Sequence
  chemically synthesized
gtgccattttgcaatgccac

SEQ ID NO: 188579 - DNA, 20 bp, Artificial Sequence
  chemically synthesized
tcactggtggcattgcaaaa

SEQ ID NO: 188580 - DNA, 20 bp, Artificial Sequence
  chemically synthesized
gcaaaatggcacaaccactt

SEQ ID NO: 188581 - DNA, 20 bp, Artificial Sequence
  chemically synthesized
acctaaacagttttctaaag

SEQ ID NO: 188582 - DNA, 20 bp, Artificial Sequence
  chemically synthesized
agcacctaaacagttttcta

SEQ ID NO: 188583 - DNA, 20 bp, Artificial Sequence
  chemically synthesized
aaccactttagaaaactgtt

SEQ ID NO: 188584 - DNA, 20 bp, Artificial Sequence
  chemically synthesized
accactttagaaaactgttt

SEQ ID NO: 188585 - DNA, 20 bp, Artificial Sequence
  chemically synthesized
attgtcaaacagcacctaaa

SEQ ID NO: 188586 - DNA, 20 bp, Artificial Sequence
  chemically synthesized
atttatgagatattgtcaaa

SEQ ID NO: 188587 - DNA, 20 bp, Artificial Sequence
  chemically synthesized
ggtgaaatgtttaaatttat

SEQ ID NO: 188588 - DNA, 20 bp, Artificial Sequence
  chemically synthesized
ataaatttaaacatttcacc

SEQ ID NO: 188589 - DNA, 20 bp, Artificial Sequence
  chemically synthesized
tctgtagaagtggaatggct

SEQ ID NO: 188590 - DNA, 20 bp, Artificial Sequence
  chemically synthesized
ctctgtagaagtggaatggc

SEQ ID NO: 188591 - DNA, 20 bp, Artificial Sequence
  chemically synthesized
gtaactctgtagaagtggaa

SEQ ID NO: 188592 - DNA, 20 bp, Artificial Sequence
  chemically synthesized
acccagccattccacttcta

SEQ ID NO: 188593 - DNA, 20 bp, Artificial Sequence
  chemically synthesized
tttgagtaactctgtagaag

SEQ ID NO: 188594 - DNA, 20 bp, Artificial Sequence
  chemically synthesized
ccagccattccacttctaca

SEQ ID NO: 188595 - DNA, 20 bp, Artificial Sequence
  chemically synthesized
tagtttgagtaactctgtag

SEQ ID NO: 188596 - DNA, 20 bp, Artificial Sequence
  chemically synthesized
atttagtttgagtaactctg

SEQ ID NO: 188597 - DNA, 20 bp, Artificial Sequence
  chemically synthesized
catatgttttcatttagttt

SEQ ID NO: 188598 - DNA, 20 bp, Artificial Sequence
  chemically synthesized
tgtgagcatatgttttcatt

SEQ ID NO: 188599 - DNA, 20 bp, Artificial Sequence
  chemically synthesized
tgaaaacatatgctcacaaa

SEQ ID NO: 188600 - DNA, 20 bp, Artificial Sequence
  chemically synthesized
tttgtgtacaagccatttgt

SEQ ID NO: 188601 - DNA, 20 bp, Artificial Sequence
  chemically synthesized
tgctgtggacatttgtgtac

SEQ ID NO: 188602 - DNA, 20 bp, Artificial Sequence
  chemically synthesized
ggcttgtacacaaatgtcca

SEQ ID NO: 188603 - DNA, 20 bp, Artificial Sequence
  chemically synthesized
ctgttatgaataagatgctg

SEQ ID NO: 188604 - DNA, 20 bp, Artificial Sequence
  chemically synthesized
agtttttggctgttatgaat

SEQ ID NO: 188605 - DNA, 20 bp, Artificial Sequence
  chemically synthesized
ccacagcatcttattcataa

SEQ ID NO: 188606 - DNA, 20 bp, Artificial Sequence
  chemically synthesized
ttcaggtggttttcagtttt

SEQ ID NO: 188607 - DNA, 20 bp, Artificial Sequence
  chemically synthesized
atggacattcaggtggtttt

SEQ ID NO: 188608 - DNA, 20 bp, Artificial Sequence
  chemically synthesized
ccttttgatggacattcagg

SEQ ID NO: 188609 - DNA, 20 bp, Artificial Sequence
  chemically synthesized
tctccttttgatggacattc

SEQ ID NO: 188610 - DNA, 20 bp, Artificial Sequence
  chemically synthesized
ttctccttttgatggacatt

SEQ ID NO: 188611 - DNA, 20 bp, Artificial Sequence
  chemically synthesized
accacctgaatgtccatcaa

SEQ ID NO: 188612 - DNA, 20 bp, Artificial Sequence
  chemically synthesized
ccacctgaatgtccatcaaa

SEQ ID NO: 188613 - DNA, 20 bp, Artificial Sequence
  chemically synthesized
acctgaatgtccatcaaaag

SEQ ID NO: 188614 - DNA, 20 bp, Artificial Sequence
  chemically synthesized
tttatctattctccttttga

SEQ ID NO: 188615 - DNA, 20 bp, Artificial Sequence
  chemically synthesized
aatgtccatcaaaaggagaa

SEQ ID NO: 188616 - DNA, 20 bp, Artificial Sequence
  chemically synthesized
gagaatagataaataaattg

SEQ ID NO: 188617 - DNA, 20 bp, Artificial Sequence
  chemically synthesized
attgtggtatatctatacaa

SEQ ID NO: 188618 - DNA, 20 bp, Artificial Sequence
  chemically synthesized
atgattaatattctattgta

SEQ ID NO: 188619 - DNA, 20 bp, Artificial Sequence
  chemically synthesized
tagaatattaatcatcaata

SEQ ID NO: 188620 - DNA, 20 bp, Artificial Sequence
  chemically synthesized
agaatattaatcatcaataa

SEQ ID NO: 188621 - DNA, 20 bp, Artificial Sequence
  chemically synthesized
atcatcaataaaggaatgaa

SEQ ID NO: 188622 - DNA, 20 bp, Artificial Sequence
  chemically synthesized
attcatccatgtaagtgtat

SEQ ID NO: 188623 - DNA, 20 bp, Artificial Sequence
  chemically synthesized
gaacagctgatacacttaca

SEQ ID NO: 188624 - DNA, 20 bp, Artificial Sequence
  chemically synthesized
cttttgagattcatccatgt

SEQ ID NO: 188625 - DNA, 20 bp, Artificial Sequence
  chemically synthesized
cttacatggatgaatctcaa

SEQ ID NO: 188626 - DNA, 20 bp, Artificial Sequence
  chemically synthesized
acatggatgaatctcaaaag

SEQ ID NO: 188627 - DNA, 20 bp, Artificial Sequence
  chemically synthesized
ttgatcagcatactactttt

SEQ ID NO: 188628 - DNA, 20 bp, Artificial Sequence
  chemically synthesized
aagtagtatgctgatcaaaa

SEQ ID NO: 188629 - DNA, 20 bp, Artificial Sequence
  chemically synthesized
acaaaatgtactattttgat

SEQ ID NO: 188630 - DNA, 20 bp, Artificial Sequence
  chemically synthesized
catttatacaaatttttaaa

SEQ ID NO: 188631 - DNA, 20 bp, Artificial Sequence
  chemically synthesized
aaaaagacaaaactaatcta

SEQ ID NO: 188632 - DNA, 20 bp, Artificial Sequence
  chemically synthesized
tgatttatatcaccatagat

SEQ ID NO: 188633 - DNA, 20 bp, Artificial Sequence
  chemically synthesized
tcttctgatttatatcacca

SEQ ID NO: 188634 - DNA, 20 bp, Artificial Sequence
  chemically synthesized
taatctatggtgatataaat

SEQ ID NO: 188635 - DNA, 20 bp, Artificial Sequence
  chemically synthesized
tctatggtgatataaatcag

SEQ ID NO: 188636 - DNA, 20 bp, Artificial Sequence
  chemically synthesized
ggtgatataaatcagaagaa

SEQ ID NO: 188637 - DNA, 20 bp, Artificial Sequence
  chemically synthesized
gtgatataaatcagaagaat

SEQ ID NO: 188638 - DNA, 20 bp, Artificial Sequence
  chemically synthesized
tcagaagaataggtgcctat

SEQ ID NO: 188639 - DNA, 20 bp, Artificial Sequence
  chemically synthesized
cagaagaataggtgcctatt

SEQ ID NO: 188640 - DNA, 20 bp, Artificial Sequence
  chemically synthesized
agaagaataggtgcctattg

SEQ ID NO: 188641 - DNA, 20 bp, Artificial Sequence
  chemically synthesized
agtcaattcccagccccaat

SEQ ID NO: 188642 - DNA, 20 bp, Artificial Sequence
  chemically synthesized
gaataggtgcctattggggc

SEQ ID NO: 188643 - DNA, 20 bp, Artificial Sequence
  chemically synthesized
cagtcaattcccagccccaa

SEQ ID NO: 188644 - DNA, 20 bp, Artificial Sequence
  chemically synthesized
aataggtgcctattggggct

SEQ ID NO: 188645 - DNA, 20 bp, Artificial Sequence
  chemically synthesized
gctaccttccagtcaattcc

SEQ ID NO: 188646 - DNA, 20 bp, Artificial Sequence
  chemically synthesized
tattggggctgggaattgac

SEQ ID NO: 188647 - DNA, 20 bp, Artificial Sequence
  chemically synthesized
tggggctgggaattgactgg

SEQ ID NO: 188648 - DNA, 20 bp, Artificial Sequence
  chemically synthesized
ggggctgggaattgactgga

SEQ ID NO: 188649 - DNA, 20 bp, Artificial Sequence
  chemically synthesized
gctgggaattgactggaagg

SEQ ID NO: 188650 - DNA, 20 bp, Artificial Sequence
  chemically synthesized
agctttttcatgctaccttc

SEQ ID NO: 188651 - DNA, 20 bp, Artificial Sequence
  chemically synthesized
gactggaaggtagcatgaaa

SEQ ID NO: 188652 - DNA, 20 bp, Artificial Sequence
  chemically synthesized
gtagcatgaaaaagctttct

SEQ ID NO: 188653 - DNA, 20 bp, Artificial Sequence
  chemically synthesized
tagcatgaaaaagctttctg

SEQ ID NO: 188654 - DNA, 20 bp, Artificial Sequence
  chemically synthesized
aaaatttccattacctcaga

SEQ ID NO: 188655 - DNA, 20 bp, Artificial Sequence
  chemically synthesized
gaaaaagctttctgaggtaa

SEQ ID NO: 188656 - DNA, 20 bp, Artificial Sequence
  chemically synthesized
aataaaaatttccattacct

SEQ ID NO: 188657 - DNA, 20 bp, Artificial Sequence
  chemically synthesized
atggaaatttttattttatt

SEQ ID NO: 188658 - DNA, 20 bp, Artificial Sequence
  chemically synthesized
tggaaatttttattttattg

SEQ ID NO: 188659 - DNA, 20 bp, Artificial Sequence
  chemically synthesized
ttattgaggtgtcactttat

SEQ ID NO: 188660 - DNA, 20 bp, Artificial Sequence
  chemically synthesized
ttgaggtgtcactttatcag

SEQ ID NO: 188661 - DNA, 20 bp, Artificial Sequence
  chemically synthesized
tgaggtgtcactttatcagt

SEQ ID NO: 188662 - DNA, 20 bp, Artificial Sequence
  chemically synthesized
gtgaagtggtcccactgata

SEQ ID NO: 188663 - DNA, 20 bp, Artificial Sequence
  chemically synthesized
atctgttaacttttgtgaag

SEQ ID NO: 188664 - DNA, 20 bp, Artificial Sequence
  chemically synthesized
tcagtgggaccacttcacaa

SEQ ID NO: 188665 - DNA, 20 bp, Artificial Sequence
  chemically synthesized
tcaatctgttaacttttgtg

SEQ ID NO: 188666 - DNA, 20 bp, Artificial Sequence
  chemically synthesized
gaccacttcacaaaagttaa

SEQ ID NO: 188667 - DNA, 20 bp, Artificial Sequence
  chemically synthesized
ttcacaaaagttaacagatt

SEQ ID NO: 188668 - DNA, 20 bp, Artificial Sequence
  chemically synthesized
ggcaggtgtataagttagta

SEQ ID NO: 188669 - DNA, 20 bp, Artificial Sequence
  chemically synthesized
actgtggcaggtgtataagt

SEQ ID NO: 188670 - DNA, 20 bp, Artificial Sequence
  chemically synthesized
ttatactgtggcaggtgtat

SEQ ID NO: 188671 - DNA, 20 bp, Artificial Sequence
  chemically synthesized
actaacttatacacctgcca

SEQ ID NO: 188672 - DNA, 20 bp, Artificial Sequence
  chemically synthesized
acagtaacttatactgtggc

SEQ ID NO: 188673 - DNA, 20 bp, Artificial Sequence
  chemically synthesized
gacagtaacttatactgtgg

SEQ ID NO: 188674 - DNA, 20 bp, Artificial Sequence
  chemically synthesized
ttatacacctgccacagtat

SEQ ID NO: 188675 - DNA, 20 bp, Artificial Sequence
  chemically synthesized
tgtgacagtaacttatactg

SEQ ID NO: 188676 - DNA, 20 bp, Artificial Sequence
  chemically synthesized
gtataagttactgtcacacc

SEQ ID NO: 188677 - DNA, 20 bp, Artificial Sequence
  chemically synthesized
cgctttcttactgggtgtga

SEQ ID NO: 188678 - DNA, 20 bp, Artificial Sequence
  chemically synthesized
aagttactgtcacacccagt

SEQ ID NO: 188679 - DNA, 20 bp, Artificial Sequence
  chemically synthesized
tactgtcacacccagtaaga

SEQ ID NO: 188680 - DNA, 20 bp, Artificial Sequence
  chemically synthesized
attttccacgctttcttact

SEQ ID NO: 188681 - DNA, 20 bp, Artificial Sequence
  chemically synthesized
tattttccacgctttcttac

SEQ ID NO: 188682 - DNA, 20 bp, Artificial Sequence
  chemically synthesized
tcacacccagtaagaaagcg

SEQ ID NO: 188683 - DNA, 20 bp, Artificial Sequence
  chemically synthesized
agaaagcgtggaaaatatat

SEQ ID NO: 188684 - DNA, 20 bp, Artificial Sequence
  chemically synthesized
agcgtggaaaatatattaga

SEQ ID NO: 188685 - DNA, 20 bp, Artificial Sequence
  chemically synthesized
gtggaaaatatattagatgg

SEQ ID NO: 188686 - DNA, 20 bp, Artificial Sequence
  chemically synthesized
aagatactttgtataatatt

SEQ ID NO: 188687 - DNA, 20 bp, Artificial Sequence
  chemically synthesized
cagaatctgaatattataca

SEQ ID NO: 188688 - DNA, 20 bp, Artificial Sequence
  chemically synthesized
tattatacaaagtatcttga

SEQ ID NO: 188689 - DNA, 20 bp, Artificial Sequence
  chemically synthesized
gttgagaacttcaatctgtc

SEQ ID NO: 188690 - DNA, 20 bp, Artificial Sequence
  chemically synthesized
caaagtatcttgacagattg

SEQ ID NO: 188691 - DNA, 20 bp, Artificial Sequence
  chemically synthesized
tcaacctgtcatatttagtt

SEQ ID NO: 188692 - DNA, 20 bp, Artificial Sequence
  chemically synthesized
aagttctcaactaaatatga

SEQ ID NO: 188693 - DNA, 20 bp, Artificial Sequence
  chemically synthesized
acatttcaacctgtcatatt

SEQ ID NO: 188694 - DNA, 20 bp, Artificial Sequence
  chemically synthesized
agttctcaactaaatatgac

SEQ ID NO: 188695 - DNA, 20 bp, Artificial Sequence
  chemically synthesized
gacaggttgaaatgttatgt

SEQ ID NO: 188696 - DNA, 20 bp, Artificial Sequence
  chemically synthesized
cttatttgggagaggaggaa

SEQ ID NO: 188697 - DNA, 20 bp, Artificial Sequence
  chemically synthesized
gacttatttgggagaggagg

SEQ ID NO: 188698 - DNA, 20 bp, Artificial Sequence
  chemically synthesized
acagacttatttgggagagg

SEQ ID NO: 188699 - DNA, 20 bp, Artificial Sequence
  chemically synthesized
aacagacttatttgggagag

SEQ ID NO: 188700 - DNA, 20 bp, Artificial Sequence
  chemically synthesized
gaaacagacttatttgggag

SEQ ID NO: 188701 - DNA, 20 bp, Artificial Sequence
  chemically synthesized
tgaaacagacttatttggga

SEQ ID NO: 188702 - DNA, 20 bp, Artificial Sequence
  chemically synthesized
ctcttcctcctctcccaaat

SEQ ID NO: 188703 - DNA, 20 bp, Artificial Sequence
  chemically synthesized
gatgaaacagacttatttgg

SEQ ID NO: 188704 - DNA, 20 bp, Artificial Sequence
  chemically synthesized
aagatgaaacagacttattt

SEQ ID NO: 188705 - DNA, 20 bp, Artificial Sequence
  chemically synthesized
taagatgaaacagacttatt

SEQ ID NO: 188706 - DNA, 20 bp, Artificial Sequence
  chemically synthesized
aaattttatataagatgaaa

SEQ ID NO: 188707 - DNA, 20 bp, Artificial Sequence
  chemically synthesized
attgaggtaaaattttatat

SEQ ID NO: 188708 - DNA, 20 bp, Artificial Sequence
  chemically synthesized
tataaaattttacctcaatt

SEQ ID NO: 188709 - DNA, 20 bp, Artificial Sequence
  chemically synthesized
ttgtttttatttcttaattg

SEQ ID NO: 188710 - DNA, 20 bp, Artificial Sequence
  chemically synthesized
attgtttttatttcttaatt

SEQ ID NO: 188711 - DNA, 20 bp, Artificial Sequence
  chemically synthesized
tattgtgtaagtaaggagag

SEQ ID NO: 188712 - DNA, 20 bp, Artificial Sequence
  chemically synthesized
aggtattgtgtaagtaagga

SEQ ID NO: 188713 - DNA, 20 bp, Artificial Sequence
  chemically synthesized
taaggtattgtgtaagtaag

SEQ ID NO: 188714 - DNA, 20 bp, Artificial Sequence
  chemically synthesized
gctaaggtattgtgtaagta

SEQ ID NO: 188715 - DNA, 20 bp, Artificial Sequence
  chemically synthesized
ggctaaggtattgtgtaagt

SEQ ID NO: 188716 - DNA, 20 bp, Artificial Sequence
  chemically synthesized
gcatggctaaggtattgtgt

SEQ ID NO: 188717 - DNA, 20 bp, Artificial Sequence
  chemically synthesized
tccttacttacacaatacct

SEQ ID NO: 188718 - DNA, 20 bp, Artificial Sequence
  chemically synthesized
cctgattgttagcatggcta

SEQ ID NO: 188719 - DNA, 20 bp, Artificial Sequence
  chemically synthesized
ccctgattgttagcatggct

SEQ ID NO: 188720 - DNA, 20 bp, Artificial Sequence
  chemically synthesized
ggatgccctgattgttagca

SEQ ID NO: 188721 - DNA, 20 bp, Artificial Sequence
  chemically synthesized
accttagccatgctaacaat

SEQ ID NO: 188722 - DNA, 20 bp, Artificial Sequence
  chemically synthesized
ccttagccatgctaacaatc

SEQ ID NO: 188723 - DNA, 20 bp, Artificial Sequence
  chemically synthesized
cttagccatgctaacaatca

SEQ ID NO: 188724 - DNA, 20 bp, Artificial Sequence
  chemically synthesized
ttgctggatgccctgattgt

SEQ ID NO: 188725 - DNA, 20 bp, Artificial Sequence
  chemically synthesized
atgctaacaatcagggcatc

SEQ ID NO: 188726 - DNA, 20 bp, Artificial Sequence
  chemically synthesized
gagaaagtacttagatttgc

SEQ ID NO: 188727 - DNA, 20 bp, Artificial Sequence
  chemically synthesized
tcagggcatccagcaaatct

SEQ ID NO: 188728 - DNA, 20 bp, Artificial Sequence
  chemically synthesized
agtaagagagagaaagtact

SEQ ID NO: 188729 - DNA, 20 bp, Artificial Sequence
  chemically synthesized
tgtgtgaagtaagagagaga

SEQ ID NO: 188730 - DNA, 20 bp, Artificial Sequence
  chemically synthesized
gtactgtgtgaagtaagaga

SEQ ID NO: 188731 - DNA, 20 bp, Artificial Sequence
  chemically synthesized
atgtactgtgtgaagtaaga

SEQ ID NO: 188732 - DNA, 20 bp, Artificial Sequence
  chemically synthesized
atatgtactgtgtgaagtaa

SEQ ID NO: 188733 - DNA, 20 bp, Artificial Sequence
  chemically synthesized
ccatatgtactgtgtgaagt

SEQ ID NO: 188734 - DNA, 20 bp, Artificial Sequence
  chemically synthesized
tttctctctcttacttcaca

SEQ ID NO: 188735 - DNA, 20 bp, Artificial Sequence
  chemically synthesized
gggtccatatgtactgtgtg

SEQ ID NO: 188736 - DNA, 20 bp, Artificial Sequence
  chemically synthesized
cttacttcacacagtacata

SEQ ID NO: 188737 - DNA, 20 bp, Artificial Sequence
  chemically synthesized
gttgttttcttgcataagaa

SEQ ID NO: 188738 - DNA, 20 bp, Artificial Sequence
  chemically synthesized
agttgttttcttgcataaga

SEQ ID NO: 188739 - DNA, 20 bp, Artificial Sequence
  chemically synthesized
catatggacccttcttatgc

SEQ ID NO: 188740 - DNA, 20 bp, Artificial Sequence
  chemically synthesized
tagttgttttcttgcataag

SEQ ID NO: 188741 - DNA, 20 bp, Artificial Sequence
  chemically synthesized
agttagttgttttcttgcat

SEQ ID NO: 188742 - DNA, 20 bp, Artificial Sequence
  chemically synthesized
aagaaaacaactaactgaaa

SEQ ID NO: 188743 - DNA, 20 bp, Artificial Sequence
  chemically synthesized
ggcaatcagcctatttcagt

SEQ ID NO: 188744 - DNA, 20 bp, Artificial Sequence
  chemically synthesized
agaaaacaactaactgaaat

SEQ ID NO: 188745 - DNA, 20 bp, Artificial Sequence
  chemically synthesized
gtttggcaatcagcctattt

SEQ ID NO: 188746 - DNA, 20 bp, Artificial Sequence
  chemically synthesized
aatgactgaggtttggcaat

SEQ ID NO: 188747 - DNA, 20 bp, Artificial Sequence
  chemically synthesized
ataggctgattgccaaacct

SEQ ID NO: 188748 - DNA, 20 bp, Artificial Sequence
  chemically synthesized
gtctgcaaatgactgaggtt

SEQ ID NO: 188749 - DNA, 20 bp, Artificial Sequence
  chemically synthesized
attctgtctgcaaatgactg

SEQ ID NO: 188750 - DNA, 20 bp, Artificial Sequence
  chemically synthesized
aattctgtctgcaaatgact

SEQ ID NO: 188751 - DNA, 20 bp, Artificial Sequence
  chemically synthesized
tgccaaacctcagtcatttg

SEQ ID NO: 188752 - DNA, 20 bp, Artificial Sequence
  chemically synthesized
aaacctcagtcatttgcaga

SEQ ID NO: 188753 - DNA, 20 bp, Artificial Sequence
  chemically synthesized
catttgcagacagaatttaa

SEQ ID NO: 188754 - DNA, 20 bp, Artificial Sequence
  chemically synthesized
tttgcagacagaatttaaaa

SEQ ID NO: 188755 - DNA, 20 bp, Artificial Sequence
  chemically synthesized
agacagaatttaaaagagtt

SEQ ID NO: 188756 - DNA, 20 bp, Artificial Sequence
  chemically synthesized
cagaatttaaaagagttcag

SEQ ID NO: 188757 - DNA, 20 bp, Artificial Sequence
  chemically synthesized
aaagagttcagaagactaat

SEQ ID NO: 188758 - DNA, 20 bp, Artificial Sequence
  chemically synthesized
aagagttcagaagactaatc

SEQ ID NO: 188759 - DNA, 20 bp, Artificial Sequence
  chemically synthesized
ctgttcctgtataacctgat

SEQ ID NO: 188760 - DNA, 20 bp, Artificial Sequence
  chemically synthesized
agaagactaatcaggttata

SEQ ID NO: 188761 - DNA, 20 bp, Artificial Sequence
  chemically synthesized
gaagactaatcaggttatac

SEQ ID NO: 188762 - DNA, 20 bp, Artificial Sequence
  chemically synthesized
ctaatcaggttatacaggaa

SEQ ID NO: 188763 - DNA, 20 bp, Artificial Sequence
  chemically synthesized
aatatccctgatggttcacg

SEQ ID NO: 188764 - DNA, 20 bp, Artificial Sequence
  chemically synthesized
gaacagacttcgtgaaccat

SEQ ID NO: 188765 - DNA, 20 bp, Artificial Sequence
  chemically synthesized
aacagacttcgtgaaccatc

SEQ ID NO: 188766 - DNA, 20 bp, Artificial Sequence
  chemically synthesized
acagacttcgtgaaccatca

SEQ ID NO: 188767 - DNA, 20 bp, Artificial Sequence
  chemically synthesized
gaattgtataatatccctga

SEQ ID NO: 188768 - DNA, 20 bp, Artificial Sequence
  chemically synthesized
cattgtgtgtggggataaaa

SEQ ID NO: 188769 - DNA, 20 bp, Artificial Sequence
  chemically synthesized
tcattgtgtgtggggataaa

SEQ ID NO: 188770 - DNA, 20 bp, Artificial Sequence
  chemically synthesized
atcattgtgtgtggggataa

SEQ ID NO: 188771 - DNA, 20 bp, Artificial Sequence
  chemically synthesized
taaattgatcattgtgtgtg

SEQ ID NO: 188772 - DNA, 20 bp, Artificial Sequence
  chemically synthesized
ctaaattgatcattgtgtgt

SEQ ID NO: 188773 - DNA, 20 bp, Artificial Sequence
  chemically synthesized
tctaaattgatcattgtgtg

SEQ ID NO: 188774 - DNA, 20 bp, Artificial Sequence
  chemically synthesized
cccacacacaatgatcaatt

SEQ ID NO: 188775 - DNA, 20 bp, Artificial Sequence
  chemically synthesized
gatcaatttagacaatctat

SEQ ID NO: 188776 - DNA, 20 bp, Artificial Sequence
  chemically synthesized
atttagacaatctataagac

SEQ ID NO: 188777 - DNA, 20 bp, Artificial Sequence
  chemically synthesized
atgccacttgactcgtctta

SEQ ID NO: 188778 - DNA, 20 bp, Artificial Sequence
  chemically synthesized
gacaatctataagacgagtc

SEQ ID NO: 188779 - DNA, 20 bp, Artificial Sequence
  chemically synthesized
aatctataagacgagtcaag

SEQ ID NO: 188780 - DNA, 20 bp, Artificial Sequence
  chemically synthesized
gtcaagtggcatctgtcttt

SEQ ID NO: 188781 - DNA, 20 bp, Artificial Sequence
  chemically synthesized
tcaagtggcatctgtctttc

SEQ ID NO: 188782 - DNA, 20 bp, Artificial Sequence
  chemically synthesized
acacgtgtgttcctgaaaga

SEQ ID NO: 188783 - DNA, 20 bp, Artificial Sequence
  chemically synthesized
atacacacgtgtgttcctga

SEQ ID NO: 188784 - DNA, 20 bp, Artificial Sequence
  chemically synthesized
caggaacacacgtgtgtatg

SEQ ID NO: 188785 - DNA, 20 bp, Artificial Sequence
  chemically synthesized
aggaacacacgtgtgtatgt

SEQ ID NO: 188786 - DNA, 20 bp, Artificial Sequence
  chemically synthesized
ggaacacacgtgtgtatgtg

SEQ ID NO: 188787 - DNA, 20 bp, Artificial Sequence
  chemically synthesized
gaacacacgtgtgtatgtgg

SEQ ID NO: 188788 - DNA, 20 bp, Artificial Sequence
  chemically synthesized
atgtgggggtgtatgtttat

SEQ ID NO: 188789 - DNA, 20 bp, Artificial Sequence
  chemically synthesized
gggtgtatgtttattagatt

SEQ ID NO: 188790 - DNA, 20 bp, Artificial Sequence
  chemically synthesized
tgtatgtttattagattaag

SEQ ID NO: 188791 - DNA, 20 bp, Artificial Sequence
  chemically synthesized
gtatgtttattagattaaga

SEQ ID NO: 188792 - DNA, 20 bp, Artificial Sequence
  chemically synthesized
ttattagattaagaaggaaa

SEQ ID NO: 188793 - DNA, 20 bp, Artificial Sequence
  chemically synthesized
agattaagaaggaaaaagcg

SEQ ID NO: 188794 - DNA, 20 bp, Artificial Sequence
  chemically synthesized
attaagaaggaaaaagcgta

SEQ ID NO: 188795 - DNA, 20 bp, Artificial Sequence
  chemically synthesized
attcaacgatcttgaatttc

SEQ ID NO: 188796 - DNA, 20 bp, Artificial Sequence
  chemically synthesized
gccattttctcttgaaattc

SEQ ID NO: 188797 - DNA, 20 bp, Artificial Sequence
  chemically synthesized
tcaacgatcttgaatttcaa

SEQ ID NO: 188798 - DNA, 20 bp, Artificial Sequence
  chemically synthesized
tcttgaatttcaagagaaaa

SEQ ID NO: 188799 - DNA, 20 bp, Artificial Sequence
  chemically synthesized
atttcaagagaaaatggctc

SEQ ID NO: 188800 - DNA, 20 bp, Artificial Sequence
  chemically synthesized
caagagaaaatggctcaaga

SEQ ID NO: 188801 - DNA, 20 bp, Artificial Sequence
  chemically synthesized
gagcttttacaggctttctt

SEQ ID NO: 188802 - DNA, 20 bp, Artificial Sequence
  chemically synthesized
tggctcaagaaagcctgtaa

SEQ ID NO: 188803 - DNA, 20 bp, Artificial Sequence
  chemically synthesized
ttattctaaagagcttttac

SEQ ID NO: 188804 - DNA, 20 bp, Artificial Sequence
  chemically synthesized
tttattctaaagagctttta

SEQ ID NO: 188805 - DNA, 20 bp, Artificial Sequence
  chemically synthesized
gaaagcctgtaaaagctctt

SEQ ID NO: 188806 - DNA, 20 bp, Artificial Sequence
  chemically synthesized
tgtcaaaattttattctaaa

SEQ ID NO: 188807 - DNA, 20 bp, Artificial Sequence
  chemically synthesized
attgtcaaaattttattcta

SEQ ID NO: 188808 - DNA, 20 bp, Artificial Sequence
  chemically synthesized
ataaaattttgacaatataa

SEQ ID NO: 188809 - DNA, 20 bp, Artificial Sequence
  chemically synthesized
aatataatggcaaatcatcc

SEQ ID NO: 188810 - DNA, 20 bp, Artificial Sequence
  chemically synthesized
taatggcaaatcatcccagt

SEQ ID NO: 188811 - DNA, 20 bp, Artificial Sequence
  chemically synthesized
atctttgttttatactcact

SEQ ID NO: 188812 - DNA, 20 bp, Artificial Sequence
  chemically synthesized
catctttgttttatactcac

SEQ ID NO: 188813 - DNA, 20 bp, Artificial Sequence
  chemically synthesized
atcccagtgagtataaaaca

SEQ ID NO: 188814 - DNA, 20 bp, Artificial Sequence
  chemically synthesized
caaagatgtgtgccactgta

SEQ ID NO: 188815 - DNA, 20 bp, Artificial Sequence
  chemically synthesized
ctttgaggttgtccatacag

SEQ ID NO: 188816 - DNA, 20 bp, Artificial Sequence
  chemically synthesized
cacctttgaggttgtccata

SEQ ID NO: 188817 - DNA, 20 bp, Artificial Sequence
  chemically synthesized
ccactgtatggacaacctca

SEQ ID NO: 188818 - DNA, 20 bp, Artificial Sequence
  chemically synthesized
cactgtatggacaacctcaa

SEQ ID NO: 188819 - DNA, 20 bp, Artificial Sequence
  chemically synthesized
ttagaatctgagcacctttg

SEQ ID NO: 188820 - DNA, 20 bp, Artificial Sequence
  chemically synthesized
attagaatctgagcaccttt

SEQ ID NO: 188821 - DNA, 20 bp, Artificial Sequence
  chemically synthesized
tggacaacctcaaaggtgct

SEQ ID NO: 188822 - DNA, 20 bp, Artificial Sequence
  chemically synthesized
ttcatactctattagaatct

SEQ ID NO: 188823 - DNA, 20 bp, Artificial Sequence
  chemically synthesized
caaaggtgctcagattctaa

SEQ ID NO: 188824 - DNA, 20 bp, Artificial Sequence
  chemically synthesized
aaggtgctcagattctaata

SEQ ID NO: 188825 - DNA, 20 bp, Artificial Sequence
  chemically synthesized
ttcccatgttcatactctat

SEQ ID NO: 188826 - DNA, 20 bp, Artificial Sequence
  chemically synthesized
attctaatagagtatgaaca

SEQ ID NO: 188827 - DNA, 20 bp, Artificial Sequence
  chemically synthesized
ttctaatagagtatgaacat

SEQ ID NO: 188828 - DNA, 20 bp, Artificial Sequence
  chemically synthesized
taatagagtatgaacatggg

SEQ ID NO: 188829 - DNA, 20 bp, Artificial Sequence
  chemically synthesized
gtatgaacatgggaagaaac

SEQ ID NO: 188830 - DNA, 20 bp, Artificial Sequence
  chemically synthesized
tatgaacatgggaagaaacg

SEQ ID NO: 188831 - DNA, 20 bp, Artificial Sequence
  chemically synthesized
atgaacatgggaagaaacga

SEQ ID NO: 188832 - DNA, 20 bp, Artificial Sequence
  chemically synthesized
acatgggaagaaacgaggga

SEQ ID NO: 188833 - DNA, 20 bp, Artificial Sequence
  chemically synthesized
atgggaagaaacgagggaca

SEQ ID NO: 188834 - DNA, 20 bp, Artificial Sequence
  chemically synthesized
gaaacgagggacagagaact

SEQ ID NO: 188835 - DNA, 20 bp, Artificial Sequence
  chemically synthesized
aaacgagggacagagaactg

SEQ ID NO: 188836 - DNA, 20 bp, Artificial Sequence
  chemically synthesized
aacgagggacagagaactga

SEQ ID NO: 188837 - DNA, 20 bp, Artificial Sequence
  chemically synthesized
gttcttctaatatttgccct

SEQ ID NO: 188838 - DNA, 20 bp, Artificial Sequence
  chemically synthesized
agagaactgagggcaaatat

SEQ ID NO: 188839 - DNA, 20 bp, Artificial Sequence
  chemically synthesized
gaactgagggcaaatattag

SEQ ID NO: 188840 - DNA, 20 bp, Artificial Sequence
  chemically synthesized
caaatattagaagaacaata

SEQ ID NO: 188841 - DNA, 20 bp, Artificial Sequence
  chemically synthesized
acaatatagaactgtataaa

SEQ ID NO: 188842 - DNA, 20 bp, Artificial Sequence
  chemically synthesized
gcttttcctcactgtttata

SEQ ID NO: 188843 - DNA, 20 bp, Artificial Sequence
  chemically synthesized
tatagaactgtataaacagt

SEQ ID NO: 188844 - DNA, 20 bp, Artificial Sequence
  chemically synthesized
atagaactgtataaacagtg

SEQ ID NO: 188845 - DNA, 20 bp, Artificial Sequence
  chemically synthesized
actgtataaacagtgaggaa

SEQ ID NO: 188846 - DNA, 20 bp, Artificial Sequence
  chemically synthesized
ataaacagtgaggaaaagct

SEQ ID NO: 188847 - DNA, 20 bp, Artificial Sequence
  chemically synthesized
cagtgaggaaaagctgagct

SEQ ID NO: 188848 - DNA, 20 bp, Artificial Sequence
  chemically synthesized
gcctcaattcattccaagct

SEQ ID NO: 188849 - DNA, 20 bp, Artificial Sequence
  chemically synthesized
cacgagcctcaattcattcc

SEQ ID NO: 188850 - DNA, 20 bp, Artificial Sequence
  chemically synthesized
agctgagcttggaatgaatt

SEQ ID NO: 188851 - DNA, 20 bp, Artificial Sequence
  chemically synthesized
gctgagcttggaatgaattg

SEQ ID NO: 188852 - DNA, 20 bp, Artificial Sequence
  chemically synthesized
tgaattgaggctcgtgataa

SEQ ID NO: 188853 - DNA, 20 bp, Artificial Sequence
  chemically synthesized
gttgtctttaccattatcac

SEQ ID NO: 188854 - DNA, 20 bp, Artificial Sequence
  chemically synthesized
tgaggctcgtgataatggta

SEQ ID NO: 188855 - DNA, 20 bp, Artificial Sequence
  chemically synthesized
ataatggtaaagacaacatt

SEQ ID NO: 188856 - DNA, 20 bp, Artificial Sequence
  chemically synthesized
taatggtaaagacaacattc

SEQ ID NO: 188857 - DNA, 20 bp, Artificial Sequence
  chemically synthesized
aatggtaaagacaacattca

SEQ ID NO: 188858 - DNA, 20 bp, Artificial Sequence
  chemically synthesized
tcctccaaatggaagtaaaa

SEQ ID NO: 188859 - DNA, 20 bp, Artificial Sequence
  chemically synthesized
ttcctccaaatggaagtaaa

SEQ ID NO: 188860 - DNA, 20 bp, Artificial Sequence
  chemically synthesized
agggcctttttacttccatt

SEQ ID NO: 188861 - DNA, 20 bp, Artificial Sequence
  chemically synthesized
ggcctttttacttccatttg

SEQ ID NO: 188862 - DNA, 20 bp, Artificial Sequence
  chemically synthesized
gttcttcttcctccaaatgg

SEQ ID NO: 188863 - DNA, 20 bp, Artificial Sequence
  chemically synthesized
gcctttttacttccatttgg

SEQ ID NO: 188864 - DNA, 20 bp, Artificial Sequence
  chemically synthesized
ctggttcttcttcctccaaa

SEQ ID NO: 188865 - DNA, 20 bp, Artificial Sequence
  chemically synthesized
tttttacttccatttggagg

SEQ ID NO: 188866 - DNA, 20 bp, Artificial Sequence
  chemically synthesized
ttacttccatttggaggaag

SEQ ID NO: 188867 - DNA, 20 bp, Artificial Sequence
  chemically synthesized
ccatttggaggaagaagaac

SEQ ID NO: 188868 - DNA, 20 bp, Artificial Sequence
  chemically synthesized
ttggaggaagaagaaccaga

SEQ ID NO: 188869 - DNA, 20 bp, Artificial Sequence
  chemically synthesized
tcagtgaaccttcgtctttc

SEQ ID NO: 188870 - DNA, 20 bp, Artificial Sequence
  chemically synthesized
gaagaagaaccagaaagacg

SEQ ID NO: 188871 - DNA, 20 bp, Artificial Sequence
  chemically synthesized
aagaagaaccagaaagacga

SEQ ID NO: 188872 - DNA, 20 bp, Artificial Sequence
  chemically synthesized
aaagacgaaggttcactgat

SEQ ID NO: 188873 - DNA, 20 bp, Artificial Sequence
  chemically synthesized
aagacgaaggttcactgatt

SEQ ID NO: 188874 - DNA, 20 bp, Artificial Sequence
  chemically synthesized
agacgaaggttcactgattg

SEQ ID NO: 188875 - DNA, 20 bp, Artificial Sequence
  chemically synthesized
cgaaggttcactgattgggg

SEQ ID NO: 188876 - DNA, 20 bp, Artificial Sequence
  chemically synthesized
cttctcccttctgccccaat

SEQ ID NO: 188877 - DNA, 20 bp, Artificial Sequence
  chemically synthesized
aggttcactgattggggcag

SEQ ID NO: 188878 - DNA, 20 bp, Artificial Sequence
  chemically synthesized
ggttcactgattggggcaga

SEQ ID NO: 188879 - DNA, 20 bp, Artificial Sequence
  chemically synthesized
gttcactgattggggcagaa

SEQ ID NO: 188880 - DNA, 20 bp, Artificial Sequence
  chemically synthesized
tcactgattggggcagaagg

SEQ ID NO: 188881 - DNA, 20 bp, Artificial Sequence
  chemically synthesized
ctgattggggcagaagggag

SEQ ID NO: 188882 - DNA, 20 bp, Artificial Sequence
  chemically synthesized
tgattggggcagaagggaga

SEQ ID NO: 188883 - DNA, 20 bp, Artificial Sequence
  chemically synthesized
tggggcagaagggagaaggt

SEQ ID NO: 188884 - DNA, 20 bp, Artificial Sequence
  chemically synthesized
ggggcagaagggagaaggtt

SEQ ID NO: 188885 - DNA, 20 bp, Artificial Sequence
  chemically synthesized
gggcagaagggagaaggtta

SEQ ID NO: 188886 - DNA, 20 bp, Artificial Sequence
  chemically synthesized
agaagggagaaggttaggga

SEQ ID NO: 188887 - DNA, 20 bp, Artificial Sequence
  chemically synthesized
aagggagaaggttagggata

SEQ ID NO: 188888 - DNA, 20 bp, Artificial Sequence
  chemically synthesized
ggttagggatagagacgaca

SEQ ID NO: 188889 - DNA, 20 bp, Artificial Sequence
  chemically synthesized
agggatagagacgacacaga

SEQ ID NO: 188890 - DNA, 20 bp, Artificial Sequence
  chemically synthesized
gatagagacgacacagaaag

SEQ ID NO: 188891 - DNA, 20 bp, Artificial Sequence
  chemically synthesized
agagacgacacagaaagcag

SEQ ID NO: 188892 - DNA, 20 bp, Artificial Sequence
  chemically synthesized
acacagaaagcagcagtgtg

SEQ ID NO: 188893 - DNA, 20 bp, Artificial Sequence
  chemically synthesized
acagagcagacaagcaaaag

SEQ ID NO: 188894 - DNA, 20 bp, Artificial Sequence
  chemically synthesized
tgacagagcagacaagcaaa

SEQ ID NO: 188895 - DNA, 20 bp, Artificial Sequence
  chemically synthesized
ttgacagagcagacaagcaa

SEQ ID NO: 188896 - DNA, 20 bp, Artificial Sequence
  chemically synthesized
ttctccttgacagagcagac

SEQ ID NO: 188897 - DNA, 20 bp, Artificial Sequence
  chemically synthesized
ttttgcttgtctgctctgtc

SEQ ID NO: 188898 - DNA, 20 bp, Artificial Sequence
  chemically synthesized
gaacattctccttgacagag

SEQ ID NO: 188899 - DNA, 20 bp, Artificial Sequence
  chemically synthesized
tttgcttgtctgctctgtca

SEQ ID NO: 188900 - DNA, 20 bp, Artificial Sequence
  chemically synthesized
tgcttgtctgctctgtcaag

SEQ ID NO: 188901 - DNA, 20 bp, Artificial Sequence
  chemically synthesized
gatgaacattctccttgaca

SEQ ID NO: 188902 - DNA, 20 bp, Artificial Sequence
  chemically synthesized
ctgatgaacattctccttga

SEQ ID NO: 188903 - DNA, 20 bp, Artificial Sequence
  chemically synthesized
ctgtcaaggagaatgttcat

SEQ ID NO: 188904 - DNA, 20 bp, Artificial Sequence
  chemically synthesized
aaggagaatgttcatcagac

SEQ ID NO: 188905 - DNA, 20 bp, Artificial Sequence
  chemically synthesized
gaatgttcatcagactggaa

SEQ ID NO: 188906 - DNA, 20 bp, Artificial Sequence
  chemically synthesized
aatgttcatcagactggaaa

SEQ ID NO: 188907 - DNA, 20 bp, Artificial Sequence
  chemically synthesized
ttatacggttatgccttttc

SEQ ID NO: 188908 - DNA, 20 bp, Artificial Sequence
  chemically synthesized
tggaaaaggcataaccgtat

SEQ ID NO: 188909 - DNA, 20 bp, Artificial Sequence
  chemically synthesized
ggaaaaggcataaccgtata

SEQ ID NO: 188910 - DNA, 20 bp, Artificial Sequence
  chemically synthesized
gaaaaggcataaccgtataa

SEQ ID NO: 188911 - DNA, 20 bp, Artificial Sequence
  chemically synthesized
tgggcttcatttcccttata

SEQ ID NO: 188912 - DNA, 20 bp, Artificial Sequence
  chemically synthesized
ataaccgtataagggaaatg

SEQ ID NO: 188913 - DNA, 20 bp, Artificial Sequence
  chemically synthesized
aagggaaatgaagcccaaaa

SEQ ID NO: 188914 - DNA, 20 bp, Artificial Sequence
  chemically synthesized
agggaaatgaagcccaaaat

SEQ ID NO: 188915 - DNA, 20 bp, Artificial Sequence
  chemically synthesized
aaaattccctcacctatttt

SEQ ID NO: 188916 - DNA, 20 bp, Artificial Sequence
  chemically synthesized
taaaattccctcacctattt

SEQ ID NO: 188917 - DNA, 20 bp, Artificial Sequence
  chemically synthesized
aaatgaagcccaaaataggt

SEQ ID NO: 188918 - DNA, 20 bp, Artificial Sequence
  chemically synthesized
aatgaagcccaaaataggtg

SEQ ID NO: 188919 - DNA, 20 bp, Artificial Sequence
  chemically synthesized
atgaagcccaaaataggtga

SEQ ID NO: 188920 - DNA, 20 bp, Artificial Sequence
  chemically synthesized
aataggtgagggaattttaa

SEQ ID NO: 188921 - DNA, 20 bp, Artificial Sequence
  chemically synthesized
taggtgagggaattttaaaa

SEQ ID NO: 188922 - DNA, 20 bp, Artificial Sequence
  chemically synthesized
ttagctcatttagagcagca

SEQ ID NO: 188923 - DNA, 20 bp, Artificial Sequence
  chemically synthesized
tttagctcatttagagcagc

SEQ ID NO: 188924 - DNA, 20 bp, Artificial Sequence
  chemically synthesized
agattttagctcatttagag

SEQ ID NO: 188925 - DNA, 20 bp, Artificial Sequence
  chemically synthesized
agcaccttgctgctctaaat

SEQ ID NO: 188926 - DNA, 20 bp, Artificial Sequence
  chemically synthesized
cagagattttagctcattta

SEQ ID NO: 188927 - DNA, 20 bp, Artificial Sequence
  chemically synthesized
gccagagattttagctcatt

SEQ ID NO: 188928 - DNA, 20 bp, Artificial Sequence
  chemically synthesized
tctaaatgagctaaaatctc

SEQ ID NO: 188929 - DNA, 20 bp, Artificial Sequence
  chemically synthesized
tggtccagggccagagattt

SEQ ID NO: 188930 - DNA, 20 bp, Artificial Sequence
  chemically synthesized
tgagctaaaatctctggccc

SEQ ID NO: 188931 - DNA, 20 bp, Artificial Sequence
  chemically synthesized
atataattggtccagggcca

SEQ ID NO: 188932 - DNA, 20 bp, Artificial Sequence
  chemically synthesized
gaatataattggtccagggc

SEQ ID NO: 188933 - DNA, 20 bp, Artificial Sequence
  chemically synthesized
cctagaatataattggtcca

SEQ ID NO: 188934 - DNA, 20 bp, Artificial Sequence
  chemically synthesized
ccctagaatataattggtcc

SEQ ID NO: 188935 - DNA, 20 bp, Artificial Sequence
  chemically synthesized
tccctagaatataattggtc

SEQ ID NO: 188936 - DNA, 20 bp, Artificial Sequence
  chemically synthesized
tcatttccctagaatataat

SEQ ID NO: 188937 - DNA, 20 bp, Artificial Sequence
  chemically synthesized
gccctggaccaattatattc

SEQ ID NO: 188938 - DNA, 20 bp, Artificial Sequence
  chemically synthesized
ccctggaccaattatattct

SEQ ID NO: 188939 - DNA, 20 bp, Artificial Sequence
  chemically synthesized
cctggaccaattatattcta

SEQ ID NO: 188940 - DNA, 20 bp, Artificial Sequence
  chemically synthesized
caattatattctagggaaat

SEQ ID NO: 188941 - DNA, 20 bp, Artificial Sequence
  chemically synthesized
cgcaagttctctcatttccc

SEQ ID NO: 188942 - DNA, 20 bp, Artificial Sequence
  chemically synthesized
attatattctagggaaatga

SEQ ID NO: 188943 - DNA, 20 bp, Artificial Sequence
  chemically synthesized
ggggtaggactgtattgcgc

SEQ ID NO: 188944 - DNA, 20 bp, Artificial Sequence
  chemically synthesized
atgagagaacttgcgcaata

SEQ ID NO: 188945 - DNA, 20 bp, Artificial Sequence
  chemically synthesized
aagaccactgacagtggggt

SEQ ID NO: 188946 - DNA, 20 bp, Artificial Sequence
  chemically synthesized
aaagaccactgacagtgggg

SEQ ID NO: 188947 - DNA, 20 bp, Artificial Sequence
  chemically synthesized
atacagtcctaccccactgt

SEQ ID NO: 188948 - DNA, 20 bp, Artificial Sequence
  chemically synthesized
ctcaaagaccactgacagtg

SEQ ID NO: 188949 - DNA, 20 bp, Artificial Sequence
  chemically synthesized
cctcaaagaccactgacagt

SEQ ID NO: 188950 - DNA, 20 bp, Artificial Sequence
  chemically synthesized
cagtcctaccccactgtcag

SEQ ID NO: 188951 - DNA, 20 bp, Artificial Sequence
  chemically synthesized
tcctcaaagaccactgacag

SEQ ID NO: 188952 - DNA, 20 bp, Artificial Sequence
  chemically synthesized
agttcctcaaagaccactga

SEQ ID NO: 188953 - DNA, 20 bp, Artificial Sequence
  chemically synthesized
ccccactgtcagtggtcttt

SEQ ID NO: 188954 - DNA, 20 bp, Artificial Sequence
  chemically synthesized
cccactgtcagtggtctttg

SEQ ID NO: 188955 - DNA, 20 bp, Artificial Sequence
  chemically synthesized
agtgttaacatagttcctca

SEQ ID NO: 188956 - DNA, 20 bp, Artificial Sequence
  chemically synthesized
gcccatctgcagtgttaaca

SEQ ID NO: 188957 - DNA, 20 bp, Artificial Sequence
  chemically synthesized
gaggaactatgttaacactg

SEQ ID NO: 188958 - DNA, 20 bp, Artificial Sequence
  chemically synthesized
aactatgttaacactgcaga

SEQ ID NO: 188959 - DNA, 20 bp, Artificial Sequence
  chemically synthesized
actatgttaacactgcagat

SEQ ID NO: 188960 - DNA, 20 bp, Artificial Sequence
  chemically synthesized
agatgacatttgcccatctg

SEQ ID NO: 188961 - DNA, 20 bp, Artificial Sequence
  chemically synthesized
tcttcctgtctttaaaaatc

SEQ ID NO: 188962 - DNA, 20 bp, Artificial Sequence
  chemically synthesized
aaatgtcatctcgattttta

SEQ ID NO: 188963 - DNA, 20 bp, Artificial Sequence
  chemically synthesized
gtcatctcgatttttaaaga

SEQ ID NO: 188964 - DNA, 20 bp, Artificial Sequence
  chemically synthesized
tcatctcgatttttaaagac

SEQ ID NO: 188965 - DNA, 20 bp, Artificial Sequence
  chemically synthesized
tctcgatttttaaagacagg

SEQ ID NO: 188966 - DNA, 20 bp, Artificial Sequence
  chemically synthesized
tcgatttttaaagacaggaa

SEQ ID NO: 188967 - DNA, 20 bp, Artificial Sequence
  chemically synthesized
cgatttttaaagacaggaag

SEQ ID NO: 188968 - DNA, 20 bp, Artificial Sequence
  chemically synthesized
gaattgatggaacacagtcg

SEQ ID NO: 188969 - DNA, 20 bp, Artificial Sequence
  chemically synthesized
tagcaggaattgatggaaca

SEQ ID NO: 188970 - DNA, 20 bp, Artificial Sequence
  chemically synthesized
tgctctttagcaggaattga

SEQ ID NO: 188971 - DNA, 20 bp, Artificial Sequence
  chemically synthesized
tgttccatcaattcctgcta

SEQ ID NO: 188972 - DNA, 20 bp, Artificial Sequence
  chemically synthesized
ttccatcaattcctgctaaa

SEQ ID NO: 188973 - DNA, 20 bp, Artificial Sequence
  chemically synthesized
attcagaaatgctctttagc

SEQ ID NO: 188974 - DNA, 20 bp, Artificial Sequence
  chemically synthesized
cattcagaaatgctctttag

SEQ ID NO: 188975 - DNA, 20 bp, Artificial Sequence
  chemically synthesized
catcattcagaaatgctctt

SEQ ID NO: 188976 - DNA, 20 bp, Artificial Sequence
  chemically synthesized
taaagagcatttctgaatga

SEQ ID NO: 188977 - DNA, 20 bp, Artificial Sequence
  chemically synthesized
ttgctccttgttccatcatt

SEQ ID NO: 188978 - DNA, 20 bp, Artificial Sequence
  chemically synthesized
gcatttctgaatgatggaac

SEQ ID NO: 188979 - DNA, 20 bp, Artificial Sequence
  chemically synthesized
catttctgaatgatggaaca

SEQ ID NO: 188980 - DNA, 20 bp, Artificial Sequence
  chemically synthesized
tttctgaatgatggaacaag

SEQ ID NO: 188981 - DNA, 20 bp, Artificial Sequence
  chemically synthesized
caaacaaacacttgttaaca

SEQ ID NO: 188982 - DNA, 20 bp, Artificial Sequence
  chemically synthesized
tccacgttgtctttgttaac

SEQ ID NO: 188983 - DNA, 20 bp, Artificial Sequence
  chemically synthesized
acttgttaacaaagacaacg

SEQ ID NO: 188984 - DNA, 20 bp, Artificial Sequence
  chemically synthesized
ttgttaacaaagacaacgtg

SEQ ID NO: 188985 - DNA, 20 bp, Artificial Sequence
  chemically synthesized
tgttaacaaagacaacgtgg

SEQ ID NO: 188986 - DNA, 20 bp, Artificial Sequence
  chemically synthesized
taacaaagacaacgtggagg

SEQ ID NO: 188987 - DNA, 20 bp, Artificial Sequence
  chemically synthesized
caacgtggaggcagctaatt

SEQ ID NO: 188988 - DNA, 20 bp, Artificial Sequence
  chemically synthesized
aacgtggaggcagctaattt

SEQ ID NO: 188989 - DNA, 20 bp, Artificial Sequence
  chemically synthesized
gttgtcatacaaacccaaat

SEQ ID NO: 188990 - DNA, 20 bp, Artificial Sequence
  chemically synthesized
cacatgtctggtgtaagaac

SEQ ID NO: 188991 - DNA, 20 bp, Artificial Sequence
  chemically synthesized
atgacaactcgttcttacac

SEQ ID NO: 188992 - DNA, 20 bp, Artificial Sequence
  chemically synthesized
caggcacacatgtctggtgt

SEQ ID NO: 188993 - DNA, 20 bp, Artificial Sequence
  chemically synthesized
caaacacaggcacacatgtc

SEQ ID NO: 188994 - DNA, 20 bp, Artificial Sequence
  chemically synthesized
gacatgtgtgcctgtgtttg

SEQ ID NO: 188995 - DNA, 20 bp, Artificial Sequence
  chemically synthesized
agagattcaactgcaaacac

SEQ ID NO: 188996 - DNA, 20 bp, Artificial Sequence
  chemically synthesized
aagagattcaactgcaaaca

SEQ ID NO: 188997 - DNA, 20 bp, Artificial Sequence
  chemically synthesized
ttgcagttgaatctcttttg

SEQ ID NO: 188998 - DNA, 20 bp, Artificial Sequence
  chemically synthesized
tcaattttcatactgcaaaa

SEQ ID NO: 188999 - DNA, 20 bp, Artificial Sequence
  chemically synthesized
attcaattttcatactgcaa

SEQ ID NO: 189000 - DNA, 20 bp, Artificial Sequence
  chemically synthesized
gaagtggtttttaagttgtt

SEQ ID NO: 189001 - DNA, 20 bp, Artificial Sequence
  chemically synthesized
aaaaaaaagaagtggttttt

SEQ ID NO: 189002 - DNA, 20 bp, Artificial Sequence
  chemically synthesized
tagctggaaaaaaaaagaag

SEQ ID NO: 189003 - DNA, 20 bp, Artificial Sequence
  chemically synthesized
cattagctggaaaaaaaaag

SEQ ID NO: 189004 - DNA, 20 bp, Artificial Sequence
  chemically synthesized
tttcattagctggaaaaaaa

SEQ ID NO: 189005 - DNA, 20 bp, Artificial Sequence
  chemically synthesized
aaaccacttctttttttttc

SEQ ID NO: 189006 - DNA, 20 bp, Artificial Sequence
  chemically synthesized
aaaatttaactttcattagc

SEQ ID NO: 189007 - DNA, 20 bp, Artificial Sequence
  chemically synthesized
tttttttttccagctaatga

SEQ ID NO: 189008 - DNA, 20 bp, Artificial Sequence
  chemically synthesized
taagaaaatttaactttcat

SEQ ID NO: 189009 - DNA, 20 bp, Artificial Sequence
  chemically synthesized
ttatatggttatttcatttt

SEQ ID NO: 189010 - DNA, 20 bp, Artificial Sequence
  chemically synthesized
aacacaattcattatttata

SEQ ID NO: 189011 - DNA, 20 bp, Artificial Sequence
  chemically synthesized
tgaattgtgttctgttgtac

SEQ ID NO: 189012 - DNA, 20 bp, Artificial Sequence
  chemically synthesized
gaattgtgttctgttgtaca

SEQ ID NO: 189013 - DNA, 20 bp, Artificial Sequence
  chemically synthesized
tcatgctgctccttgtacaa

SEQ ID NO: 189014 - DNA, 20 bp, Artificial Sequence
  chemically synthesized
attgtgttctgttgtacaag

SEQ ID NO: 189015 - DNA, 20 bp, Artificial Sequence
  chemically synthesized
gtgttctgttgtacaaggag

SEQ ID NO: 189016 - DNA, 20 bp, Artificial Sequence
  chemically synthesized
acaaggagcagcatgacatc

SEQ ID NO: 189017 - DNA, 20 bp, Artificial Sequence
  chemically synthesized
tttttcaggtggtgggcaac

SEQ ID NO: 189018 - DNA, 20 bp, Artificial Sequence
  chemically synthesized
ctcaaactttttcaggtggt

SEQ ID NO: 189019 - DNA, 20 bp, Artificial Sequence
  chemically synthesized
cctcaaactttttcaggtgg

SEQ ID NO: 189020 - DNA, 20 bp, Artificial Sequence
  chemically synthesized
cagttgcccaccacctgaaa

SEQ ID NO: 189021 - DNA, 20 bp, Artificial Sequence
  chemically synthesized
ggacctcaaactttttcagg

SEQ ID NO: 189022 - DNA, 20 bp, Artificial Sequence
  chemically synthesized
agaggacctcaaactttttc

SEQ ID NO: 189023 - DNA, 20 bp, Artificial Sequence
  chemically synthesized
cagaggacctcaaacttttt

SEQ ID NO: 189024 - DNA, 20 bp, Artificial Sequence
  chemically synthesized
cccaccacctgaaaaagttt

SEQ ID NO: 189025 - DNA, 20 bp, Artificial Sequence
  chemically synthesized
ccaccacctgaaaaagtttg

SEQ ID NO: 189026 - DNA, 20 bp, Artificial Sequence
  chemically synthesized
tgaaaaagtttgaggtcctc

SEQ ID NO: 189027 - DNA, 20 bp, Artificial Sequence
  chemically synthesized
ctctgtccattatttgccag

SEQ ID NO: 189028 - DNA, 20 bp, Artificial Sequence
  chemically synthesized
tctctgtccattatttgcca

SEQ ID NO: 189029 - DNA, 20 bp, Artificial Sequence
  chemically synthesized
tgtctctgtccattatttgc

SEQ ID NO: 189030 - DNA, 20 bp, Artificial Sequence
  chemically synthesized
tgaggtcctctggcaaataa

SEQ ID NO: 189031 - DNA, 20 bp, Artificial Sequence
  chemically synthesized
gtcctctggcaaataatgga

SEQ ID NO: 189032 - DNA, 20 bp, Artificial Sequence
  chemically synthesized
cctctggcaaataatggaca

SEQ ID NO: 189033 - DNA, 20 bp, Artificial Sequence
  chemically synthesized
acacaaaatggtgcacgtat

SEQ ID NO: 189034 - DNA, 20 bp, Artificial Sequence
  chemically synthesized
ccatgtcaaataacacaaaa

SEQ ID NO: 189035 - DNA, 20 bp, Artificial Sequence
  chemically synthesized
ccattttgtgttatttgaca

SEQ ID NO: 189036 - DNA, 20 bp, Artificial Sequence
  chemically synthesized
gttatttgacatggtgacaa

SEQ ID NO: 189037 - DNA, 20 bp, Artificial Sequence
  chemically synthesized
ttatttgacatggtgacaat

SEQ ID NO: 189038 - DNA, 20 bp, Artificial Sequence
  chemically synthesized
tgttctgttcttgtagaaag

SEQ ID NO: 189039 - DNA, 20 bp, Artificial Sequence
  chemically synthesized
acaatgggtctcctttctac

SEQ ID NO: 189040 - DNA, 20 bp, Artificial Sequence
  chemically synthesized
cttgttctgttcttgtagaa

SEQ ID NO: 189041 - DNA, 20 bp, Artificial Sequence
  chemically synthesized
tcttgttctgttcttgtaga

SEQ ID NO: 189042 - DNA, 20 bp, Artificial Sequence
  chemically synthesized
gggtctcctttctacaagaa

SEQ ID NO: 189043 - DNA, 20 bp, Artificial Sequence
  chemically synthesized
ttcctcttgttctgttcttg

SEQ ID NO: 189044 - DNA, 20 bp, Artificial Sequence
  chemically synthesized
cctttctacaagaacagaac

SEQ ID NO: 189045 - DNA, 20 bp, Artificial Sequence
  chemically synthesized
tttctacaagaacagaacaa

SEQ ID NO: 189046 - DNA, 20 bp, Artificial Sequence
  chemically synthesized
ttctacaagaacagaacaag

SEQ ID NO: 189047 - DNA, 20 bp, Artificial Sequence
  chemically synthesized
agaacagaacaagaggaaat

SEQ ID NO: 189048 - DNA, 20 bp, Artificial Sequence
  chemically synthesized
aacaagaggaaataagattg

SEQ ID NO: 189049 - DNA, 20 bp, Artificial Sequence
  chemically synthesized
caagaggaaataagattgca

SEQ ID NO: 189050 - DNA, 20 bp, Artificial Sequence
  chemically synthesized
gaggaaataagattgcagag

SEQ ID NO: 189051 - DNA, 20 bp, Artificial Sequence
  chemically synthesized
aaataagattgcagagtagt

SEQ ID NO: 189052 - DNA, 20 bp, Artificial Sequence
  chemically synthesized
aataagattgcagagtagtt

SEQ ID NO: 189053 - DNA, 20 bp, Artificial Sequence
  chemically synthesized
ataagattgcagagtagttg

SEQ ID NO: 189054 - DNA, 20 bp, Artificial Sequence
  chemically synthesized
gagtagttggggaacctaca

SEQ ID NO: 189055 - DNA, 20 bp, Artificial Sequence
  chemically synthesized
agtagttggggaacctacac

SEQ ID NO: 189056 - DNA, 20 bp, Artificial Sequence
  chemically synthesized
tagttggggaacctacacag

SEQ ID NO: 189057 - DNA, 20 bp, Artificial Sequence
  chemically synthesized
agttggggaacctacacagg

SEQ ID NO: 189058 - DNA, 20 bp, Artificial Sequence
  chemically synthesized
cggaagactccctcctgtgt

SEQ ID NO: 189059 - DNA, 20 bp, Artificial Sequence
  chemically synthesized
gttggggaacctacacagga

SEQ ID NO: 189060 - DNA, 20 bp, Artificial Sequence
  chemically synthesized
tcggaagactccctcctgtg

SEQ ID NO: 189061 - DNA, 20 bp, Artificial Sequence
  chemically synthesized
tggggaacctacacaggagg

SEQ ID NO: 189062 - DNA, 20 bp, Artificial Sequence
  chemically synthesized
acaggagggagtcttccgaa

SEQ ID NO: 189063 - DNA, 20 bp, Artificial Sequence
  chemically synthesized
aggagggagtcttccgaaaa

SEQ ID NO: 189064 - DNA, 20 bp, Artificial Sequence
  chemically synthesized
cagtctaaatctcttttcgg

SEQ ID NO: 189065 - DNA, 20 bp, Artificial Sequence
  chemically synthesized
atacagtctaaatctctttt

SEQ ID NO: 189066 - DNA, 20 bp, Artificial Sequence
  chemically synthesized
gagtcttccgaaaagagatt

SEQ ID NO: 189067 - DNA, 20 bp, Artificial Sequence
  chemically synthesized
catttttctggatattgata

SEQ ID NO: 189068 - DNA, 20 bp, Artificial Sequence
  chemically synthesized
atttagactgtatcaatatc

SEQ ID NO: 189069 - DNA, 20 bp, Artificial Sequence
  chemically synthesized
aatcaccttcgacatttttc

SEQ ID NO: 189070 - DNA, 20 bp, Artificial Sequence
  chemically synthesized
caatatccagaaaaatgtcg

SEQ ID NO: 189071 - DNA, 20 bp, Artificial Sequence
  chemically synthesized
aatatccagaaaaatgtcga

SEQ ID NO: 189072 - DNA, 20 bp, Artificial Sequence
  chemically synthesized
aaaatgtcgaaggtgatttt

SEQ ID NO: 189073 - DNA, 20 bp, Artificial Sequence
  chemically synthesized
cgaaggtgatttttggaaaa

SEQ ID NO: 189074 - DNA, 20 bp, Artificial Sequence
  chemically synthesized
attgtttacatttattcttt

SEQ ID NO: 189075 - DNA, 20 bp, Artificial Sequence
  chemically synthesized
aagtgatagaagaaaaccaa

SEQ ID NO: 189076 - DNA, 20 bp, Artificial Sequence
  chemically synthesized
aaatccactaaaagtgatag

SEQ ID NO: 189077 - DNA, 20 bp, Artificial Sequence
  chemically synthesized
tggttttcttctatcacttt

SEQ ID NO: 189078 - DNA, 20 bp, Artificial Sequence
  chemically synthesized
taaaaatccactaaaagtga

SEQ ID NO: 189079 - DNA, 20 bp, Artificial Sequence
  chemically synthesized
ttttcttctatcacttttag

SEQ ID NO: 189080 - DNA, 20 bp, Artificial Sequence
  chemically synthesized
tcattataaaaatccactaa

SEQ ID NO: 189081 - DNA, 20 bp, Artificial Sequence
  chemically synthesized
tttagtggatttttataatg

SEQ ID NO: 189082 - DNA, 20 bp, Artificial Sequence
  chemically synthesized
tagtggatttttataatgaa

SEQ ID NO: 189083 - DNA, 20 bp, Artificial Sequence
  chemically synthesized
aagagacatacgtttatgat

SEQ ID NO: 189084 - DNA, 20 bp, Artificial Sequence
  chemically synthesized
ttatttcccaaatgggtaga

SEQ ID NO: 189085 - DNA, 20 bp, Artificial Sequence
  chemically synthesized
tttatttcccaaatgggtag

SEQ ID NO: 189086 - DNA, 20 bp, Artificial Sequence
  chemically synthesized
atttatttcccaaatgggta

SEQ ID NO: 189087 - DNA, 20 bp, Artificial Sequence
  chemically synthesized
aaaataaccctctacccatt

SEQ ID NO: 189088 - DNA, 20 bp, Artificial Sequence
  chemically synthesized
aaataaccctctacccattt

SEQ ID NO: 189089 - DNA, 20 bp, Artificial Sequence
  chemically synthesized
caatttatttcccaaatggg

SEQ ID NO: 189090 - DNA, 20 bp, Artificial Sequence
  chemically synthesized
tatcaatttatttcccaaat

SEQ ID NO: 189091 - DNA, 20 bp, Artificial Sequence
  chemically synthesized
atatcaatttatttcccaaa

SEQ ID NO: 189092 - DNA, 20 bp, Artificial Sequence
  chemically synthesized
aaaaaataccttgttttggt

SEQ ID NO: 189093 - DNA, 20 bp, Artificial Sequence
  chemically synthesized
tgatataatcttaccaaaac

SEQ ID NO: 189094 - DNA, 20 bp, Artificial Sequence
  chemically synthesized
gatataatcttaccaaaaca

SEQ ID NO: 189095 - DNA, 20 bp, Artificial Sequence
  chemically synthesized
cagaaaaaaataccttgttt

SEQ ID NO: 189096 - DNA, 20 bp, Artificial Sequence
  chemically synthesized
caaaacaaggtatttttttc

SEQ ID NO: 189097 - DNA, 20 bp, Artificial Sequence
  chemically synthesized
cactcttgaataaaaaaatc

SEQ ID NO: 189098 - DNA, 20 bp, Artificial Sequence
  chemically synthesized
ttttctggatttttttattc

SEQ ID NO: 189099 - DNA, 20 bp, Artificial Sequence
  chemically synthesized
ttctggatttttttattcaa

SEQ ID NO: 189100 - DNA, 20 bp, Artificial Sequence
  chemically synthesized
ggatttttttattcaagagt

SEQ ID NO: 189101 - DNA, 20 bp, Artificial Sequence
  chemically synthesized
atttttttattcaagagtga

SEQ ID NO: 189102 - DNA, 20 bp, Artificial Sequence
  chemically synthesized
tttattcaagagtgagagaa

SEQ ID NO: 189103 - DNA, 20 bp, Artificial Sequence
  chemically synthesized
gagtgagagaatagataaaa

SEQ ID NO: 189104 - DNA, 20 bp, Artificial Sequence
  chemically synthesized
atagataaaatagtctttcc

SEQ ID NO: 189105 - DNA, 20 bp, Artificial Sequence
  chemically synthesized
attaatatacagtactggga

SEQ ID NO: 189106 - DNA, 20 bp, Artificial Sequence
  chemically synthesized
aataattaatatacagtact

SEQ ID NO: 189107 - DNA, 20 bp, Artificial Sequence
  chemically synthesized
aaataattaatatacagtac

SEQ ID NO: 189108 - DNA, 20 bp, Artificial Sequence
  chemically synthesized
atatttaaataattaatata

SEQ ID NO: 189109 - DNA, 20 bp, Artificial Sequence
  chemically synthesized
aaatatgatattttaaaata

SEQ ID NO: 189110 - DNA, 20 bp, Artificial Sequence
  chemically synthesized
tgctgataccatagtagata

SEQ ID NO: 189111 - DNA, 20 bp, Artificial Sequence
  chemically synthesized
ttatcatactttatctacta

SEQ ID NO: 189112 - DNA, 20 bp, Artificial Sequence
  chemically synthesized
tacaggtgctgataccatag

SEQ ID NO: 189113 - DNA, 20 bp, Artificial Sequence
  chemically synthesized
tactttatctactatggtat

SEQ ID NO: 189114 - DNA, 20 bp, Artificial Sequence
  chemically synthesized
gtctacaggtgctgatacca

SEQ ID NO: 189115 - DNA, 20 bp, Artificial Sequence
  chemically synthesized
tactatggtatcagcacctg

SEQ ID NO: 189116 - DNA, 20 bp, Artificial Sequence
  chemically synthesized
tggtagtaaattatgtctac

SEQ ID NO: 189117 - DNA, 20 bp, Artificial Sequence
  chemically synthesized
atggtagtaaattatgtcta

SEQ ID NO: 189118 - DNA, 20 bp, Artificial Sequence
  chemically synthesized
atgtactaatgcaaatatgg

SEQ ID NO: 189119 - DNA, 20 bp, Artificial Sequence
  chemically synthesized
aatatgtactaatgcaaata

SEQ ID NO: 189120 - DNA, 20 bp, Artificial Sequence
  chemically synthesized
atttactaccatatttgcat

SEQ ID NO: 189121 - DNA, 20 bp, Artificial Sequence
  chemically synthesized
tgcattagtacatattacta

SEQ ID NO: 189122 - DNA, 20 bp, Artificial Sequence
  chemically synthesized
gccatatctctgaaaaactt

SEQ ID NO: 189123 - DNA, 20 bp, Artificial Sequence
  chemically synthesized
tacatattactaaagttttt

SEQ ID NO: 189124 - DNA, 20 bp, Artificial Sequence
  chemically synthesized
catattactaaagtttttca

SEQ ID NO: 189125 - DNA, 20 bp, Artificial Sequence
  chemically synthesized
actaaagtttttcagagata

SEQ ID NO: 189126 - DNA, 20 bp, Artificial Sequence
  chemically synthesized
ttcagagatatggccatata

SEQ ID NO: 189127 - DNA, 20 bp, Artificial Sequence
  chemically synthesized
agagatatggccatatatag

SEQ ID NO: 189128 - DNA, 20 bp, Artificial Sequence
  chemically synthesized
tatcttttacccactatata

SEQ ID NO: 189129 - DNA, 20 bp, Artificial Sequence
  chemically synthesized
gagatatggccatatatagt

SEQ ID NO: 189130 - DNA, 20 bp, Artificial Sequence
  chemically synthesized
tggccatatatagtgggtaa

SEQ ID NO: 189131 - DNA, 20 bp, Artificial Sequence
  chemically synthesized
aaaatgttatttatgatttt

SEQ ID NO: 189132 - DNA, 20 bp, Artificial Sequence
  chemically synthesized
ataacattttattctttctc

SEQ ID NO: 189133 - DNA, 20 bp, Artificial Sequence
  chemically synthesized
ctgaataatgttacttgaga

SEQ ID NO: 189134 - DNA, 20 bp, Artificial Sequence
  chemically synthesized
ggagctgaataatgttactt

SEQ ID NO: 189135 - DNA, 20 bp, Artificial Sequence
  chemically synthesized
ctttctcaagtaacattatt

SEQ ID NO: 189136 - DNA, 20 bp, Artificial Sequence
  chemically synthesized
gctctgaaattatattagag

SEQ ID NO: 189137 - DNA, 20 bp, Artificial Sequence
  chemically synthesized
aagctctgaaattatattag

SEQ ID NO: 189138 - DNA, 20 bp, Artificial Sequence
  chemically synthesized
aaagctctgaaattatatta

SEQ ID NO: 189139 - DNA, 20 bp, Artificial Sequence
  chemically synthesized
caaaagctctgaaattatat

SEQ ID NO: 189140 - DNA, 20 bp, Artificial Sequence
  chemically synthesized
cagctcctctaatataattt

SEQ ID NO: 189141 - DNA, 20 bp, Artificial Sequence
  chemically synthesized
gctcctctaatataatttca

SEQ ID NO: 189142 - DNA, 20 bp, Artificial Sequence
  chemically synthesized
aatttcagagcttttgttaa

SEQ ID NO: 189143 - DNA, 20 bp, Artificial Sequence
  chemically synthesized
tagaaaaataccattaacaa

SEQ ID NO: 189144 - DNA, 20 bp, Artificial Sequence
  chemically synthesized
aatggtatttttctacatac

SEQ ID NO: 189145 - DNA, 20 bp, Artificial Sequence
  chemically synthesized
atttattcaaaactagtatg

SEQ ID NO: 189146 - DNA, 20 bp, Artificial Sequence
  chemically synthesized
gacatgaatttattcaaaac

SEQ ID NO: 189147 - DNA, 20 bp, Artificial Sequence
  chemically synthesized
tctccctagatagttcatgg

SEQ ID NO: 189148 - DNA, 20 bp, Artificial Sequence
  chemically synthesized
atttctccctagatagttca

SEQ ID NO: 189149 - DNA, 20 bp, Artificial Sequence
  chemically synthesized
catgtctaccatgaactatc

SEQ ID NO: 189150 - DNA, 20 bp, Artificial Sequence
  chemically synthesized
atgtctaccatgaactatct

SEQ ID NO: 189151 - DNA, 20 bp, Artificial Sequence
  chemically synthesized
tgtctaccatgaactatcta

SEQ ID NO: 189152 - DNA, 20 bp, Artificial Sequence
  chemically synthesized
tctaccatgaactatctagg

SEQ ID NO: 189153 - DNA, 20 bp, Artificial Sequence
  chemically synthesized
taacaacatttctccctaga

SEQ ID NO: 189154 - DNA, 20 bp, Artificial Sequence
  chemically synthesized
tttttaacaacatttctccc

SEQ ID NO: 189155 - DNA, 20 bp, Artificial Sequence
  chemically synthesized
gttgttaaaaatgctgttac

SEQ ID NO: 189156 - DNA, 20 bp, Artificial Sequence
  chemically synthesized
taagtttatggaacttgtaa

SEQ ID NO: 189157 - DNA, 20 bp, Artificial Sequence
  chemically synthesized
tgttacaagttccataaact

SEQ ID NO: 189158 - DNA, 20 bp, Artificial Sequence
  chemically synthesized
tatcaagtaaactaagttta

SEQ ID NO: 189159 - DNA, 20 bp, Artificial Sequence
  chemically synthesized
tataagatatcaagtaaact

SEQ ID NO: 189160 - DNA, 20 bp, Artificial Sequence
  chemically synthesized
cagcatgtttataagatatc

SEQ ID NO: 189161 - DNA, 20 bp, Artificial Sequence
  chemically synthesized
gcaaaaggcagcatgtttat

SEQ ID NO: 189162 - DNA, 20 bp, Artificial Sequence
  chemically synthesized
aatctgtattttgcaaaagg

SEQ ID NO: 189163 - DNA, 20 bp, Artificial Sequence
  chemically synthesized
agtaatctgtattttgcaaa

SEQ ID NO: 189164 - DNA, 20 bp, Artificial Sequence
  chemically synthesized
tagtaatctgtattttgcaa

SEQ ID NO: 189165 - DNA, 20 bp, Artificial Sequence
  chemically synthesized
atgctgccttttgcaaaata

SEQ ID NO: 189166 - DNA, 20 bp, Artificial Sequence
  chemically synthesized
atacagattactactgaaat

SEQ ID NO: 189167 - DNA, 20 bp, Artificial Sequence
  chemically synthesized
ctaagctttcctgatttcag

SEQ ID NO: 189168 - DNA, 20 bp, Artificial Sequence
  chemically synthesized
tacagattactactgaaatc

SEQ ID NO: 189169 - DNA, 20 bp, Artificial Sequence
  chemically synthesized
attctaagctttcctgattt

SEQ ID NO: 189170 - DNA, 20 bp, Artificial Sequence
  chemically synthesized
gattactactgaaatcagga

SEQ ID NO: 189171 - DNA, 20 bp, Artificial Sequence
  chemically synthesized
ctactgaaatcaggaaagct

SEQ ID NO: 189172 - DNA, 20 bp, Artificial Sequence
  chemically synthesized
acgtctgtcttaataattct

SEQ ID NO: 189173 - DNA, 20 bp, Artificial Sequence
  chemically synthesized
caggaaagcttagaattatt

SEQ ID NO: 189174 - DNA, 20 bp, Artificial Sequence
  chemically synthesized
aaagcttagaattattaaga

SEQ ID NO: 189175 - DNA, 20 bp, Artificial Sequence
  chemically synthesized
ttattaagacagacgtattg

SEQ ID NO: 189176 - DNA, 20 bp, Artificial Sequence
  chemically synthesized
tattaagacagacgtattgt

SEQ ID NO: 189177 - DNA, 20 bp, Artificial Sequence
  chemically synthesized
attaagacagacgtattgta

SEQ ID NO: 189178 - DNA, 20 bp, Artificial Sequence
  chemically synthesized
cagacgtattgtagggaaat

SEQ ID NO: 189179 - DNA, 20 bp, Artificial Sequence
  chemically synthesized
agacgtattgtagggaaata

SEQ ID NO: 189180 - DNA, 20 bp, Artificial Sequence
  chemically synthesized
gacgtattgtagggaaataa

SEQ ID NO: 189181 - DNA, 20 bp, Artificial Sequence
  chemically synthesized
tgaatgtcagaacaaaatta

SEQ ID NO: 189182 - DNA, 20 bp, Artificial Sequence
  chemically synthesized
tctgaatgtcagaacaaaat

SEQ ID NO: 189183 - DNA, 20 bp, Artificial Sequence
  chemically synthesized
tctaattttgttctgacatt

SEQ ID NO: 189184 - DNA, 20 bp, Artificial Sequence
  chemically synthesized
tatctttatattctgaatgt

SEQ ID NO: 189185 - DNA, 20 bp, Artificial Sequence
  chemically synthesized
gttctgacattcagaatata

SEQ ID NO: 189186 - DNA, 20 bp, Artificial Sequence
  chemically synthesized
cattcagaatataaagataa

SEQ ID NO: 189187 - DNA, 20 bp, Artificial Sequence
  chemically synthesized
attcagaatataaagataat

SEQ ID NO: 189188 - DNA, 20 bp, Artificial Sequence
  chemically synthesized
attgaatgggagttttgatg

SEQ ID NO: 189189 - DNA, 20 bp, Artificial Sequence
  chemically synthesized
gtattgaatgggagttttga

SEQ ID NO: 189190 - DNA, 20 bp, Artificial Sequence
  chemically synthesized
aaaagaatggtattgaatgg

SEQ ID NO: 189191 - DNA, 20 bp, Artificial Sequence
  chemically synthesized
gaaaaagaatggtattgaat

SEQ ID NO: 189192 - DNA, 20 bp, Artificial Sequence
  chemically synthesized
ggaaaaagaatggtattgaa

SEQ ID NO: 189193 - DNA, 20 bp, Artificial Sequence
  chemically synthesized
aagtatatatggaaaaagaa

SEQ ID NO: 189194 - DNA, 20 bp, Artificial Sequence
  chemically synthesized
aaagtaagtatatatggaaa

SEQ ID NO: 189195 - DNA, 20 bp, Artificial Sequence
  chemically synthesized
aaaaaaaaagtaagtatata

SEQ ID NO: 189196 - DNA, 20 bp, Artificial Sequence
  chemically synthesized
aggatgaggaaaaaaaaagt

SEQ ID NO: 189197 - DNA, 20 bp, Artificial Sequence
  chemically synthesized
gccaaggatgaggaaaaaaa

SEQ ID NO: 189198 - DNA, 20 bp, Artificial Sequence
  chemically synthesized
actttttttttcctcatcct

SEQ ID NO: 189199 - DNA, 20 bp, Artificial Sequence
  chemically synthesized
ttgtattaaggccaaggatg

SEQ ID NO: 189200 - DNA, 20 bp, Artificial Sequence
  chemically synthesized
tttgtattaaggccaaggat

SEQ ID NO: 189201 - DNA, 20 bp, Artificial Sequence
  chemically synthesized
tgagttttgtattaaggcca

SEQ ID NO: 189202 - DNA, 20 bp, Artificial Sequence
  chemically synthesized
ttgagttttgtattaaggcc

SEQ ID NO: 189203 - DNA, 20 bp, Artificial Sequence
  chemically synthesized
aaatattgagttttgtatta

SEQ ID NO: 189204 - DNA, 20 bp, Artificial Sequence
  chemically synthesized
gaaatattgagttttgtatt

SEQ ID NO: 189205 - DNA, 20 bp, Artificial Sequence
  chemically synthesized
caaactataaatgaaatatt

SEQ ID NO: 189206 - DNA, 20 bp, Artificial Sequence
  chemically synthesized
aaaactcaatatttcattta

SEQ ID NO: 189207 - DNA, 20 bp, Artificial Sequence
  chemically synthesized
caatccacataggattaggg

SEQ ID NO: 189208 - DNA, 20 bp, Artificial Sequence
  chemically synthesized
cttcaatccacataggatta

SEQ ID NO: 189209 - DNA, 20 bp, Artificial Sequence
  chemically synthesized
tcttcaatccacataggatt

SEQ ID NO: 189210 - DNA, 20 bp, Artificial Sequence
  chemically synthesized
ttcttcaatccacataggat

SEQ ID NO: 189211 - DNA, 20 bp, Artificial Sequence
  chemically synthesized
catactaccctaatcctatg

SEQ ID NO: 189212 - DNA, 20 bp, Artificial Sequence
  chemically synthesized
tacccttcttcaatccacat

SEQ ID NO: 189213 - DNA, 20 bp, Artificial Sequence
  chemically synthesized
atacccttcttcaatccaca

SEQ ID NO: 189214 - DNA, 20 bp, Artificial Sequence
  chemically synthesized
ccctaatcctatgtggattg

SEQ ID NO: 189215 - DNA, 20 bp, Artificial Sequence
  chemically synthesized
taatcctatgtggattgaag

SEQ ID NO: 189216 - DNA, 20 bp, Artificial Sequence
  chemically synthesized
aatcctatgtggattgaaga

SEQ ID NO: 189217 - DNA, 20 bp, Artificial Sequence
  chemically synthesized
atcctatgtggattgaagaa

SEQ ID NO: 189218 - DNA, 20 bp, Artificial Sequence
  chemically synthesized
aaaggagaaaattcagtttt

SEQ ID NO: 189219 - DNA, 20 bp, Artificial Sequence
  chemically synthesized
actgcttaaaggagaaaatt

SEQ ID NO: 189220 - DNA, 20 bp, Artificial Sequence
  chemically synthesized
aaaactgaattttctccttt

SEQ ID NO: 189221 - DNA, 20 bp, Artificial Sequence
  chemically synthesized
actgaattttctcctttaag

SEQ ID NO: 189222 - DNA, 20 bp, Artificial Sequence
  chemically synthesized
aatatctaaactgcttaaag

SEQ ID NO: 189223 - DNA, 20 bp, Artificial Sequence
  chemically synthesized
aaaatatctaaactgcttaa

SEQ ID NO: 189224 - DNA, 20 bp, Artificial Sequence
  chemically synthesized
taaaatatctaaactgctta

SEQ ID NO: 189225 - DNA, 20 bp, Artificial Sequence
  chemically synthesized
attttctcctttaagcagtt

SEQ ID NO: 189226 - DNA, 20 bp, Artificial Sequence
  chemically synthesized
agcagtttagatattttaat

SEQ ID NO: 189227 - DNA, 20 bp, Artificial Sequence
  chemically synthesized
attagtaaacacaaacaaat

SEQ ID NO: 189228 - DNA, 20 bp, Artificial Sequence
  chemically synthesized
ttagtaaacacaaacaaata

SEQ ID NO: 189229 - DNA, 20 bp, Artificial Sequence
  chemically synthesized
taaacacaaacaaataaggt

SEQ ID NO: 189230 - DNA, 20 bp, Artificial Sequence
  chemically synthesized
ttctttaaatgtgcaataca

SEQ ID NO: 189231 - DNA, 20 bp, Artificial Sequence
  chemically synthesized
agctatgtattgcacattta

SEQ ID NO: 189232 - DNA, 20 bp, Artificial Sequence
  chemically synthesized
caaatttcttttcacattga

SEQ ID NO: 189233 - DNA, 20 bp, Artificial Sequence
  chemically synthesized
tatcacactgtcaatgtgaa

SEQ ID NO: 189234 - DNA, 20 bp, Artificial Sequence
  chemically synthesized
caatgtgaaaagaaatttgt

SEQ ID NO: 189235 - DNA, 20 bp, Artificial Sequence
  chemically synthesized
aatgtgaaaagaaatttgta

SEQ ID NO: 189236 - DNA, 20 bp, Artificial Sequence
  chemically synthesized
agaaatttgtaaggaaaaaa

SEQ ID NO: 189237 - DNA, 20 bp, Artificial Sequence
  chemically synthesized
tgtaaggaaaaaaaagaaca

SEQ ID NO: 189238 - DNA, 20 bp, Artificial Sequence
  chemically synthesized
ggaaaaaaaagaacaaagat

SEQ ID NO: 189239 - DNA, 20 bp, Artificial Sequence
  chemically synthesized
aaaaagaacaaagatcagtc

SEQ ID NO: 189240 - DNA, 20 bp, Artificial Sequence
  chemically synthesized
aaaagaacaaagatcagtct

SEQ ID NO: 189241 - DNA, 20 bp, Artificial Sequence
  chemically synthesized
ggaatgtattgcagatgtcc

SEQ ID NO: 189242 - DNA, 20 bp, Artificial Sequence
  chemically synthesized
cctgaatctggaatgtattg

SEQ ID NO: 189243 - DNA, 20 bp, Artificial Sequence
  chemically synthesized
gggacatctgcaatacattc

SEQ ID NO: 189244 - DNA, 20 bp, Artificial Sequence
  chemically synthesized
tctgcaatacattccagatt

SEQ ID NO: 189245 - DNA, 20 bp, Artificial Sequence
  chemically synthesized
ctgcaatacattccagattc

SEQ ID NO: 189246 - DNA, 20 bp, Artificial Sequence
  chemically synthesized
taacttgttgttcctgaatc

SEQ ID NO: 189247 - DNA, 20 bp, Artificial Sequence
  chemically synthesized
attccagattcaggaacaac

SEQ ID NO: 189248 - DNA, 20 bp, Artificial Sequence
  chemically synthesized
agattcaggaacaacaagtt

SEQ ID NO: 189249 - DNA, 20 bp, Artificial Sequence
  chemically synthesized
tgccagaaaagatgagtagg

SEQ ID NO: 189250 - DNA, 20 bp, Artificial Sequence
  chemically synthesized
tcatgccagaaaagatgagt

SEQ ID NO: 189251 - DNA, 20 bp, Artificial Sequence
  chemically synthesized
atcatgccagaaaagatgag

SEQ ID NO: 189252 - DNA, 20 bp, Artificial Sequence
  chemically synthesized
aagatcatgccagaaaagat

SEQ ID NO: 189253 - DNA, 20 bp, Artificial Sequence
  chemically synthesized
atctacctactcatcttttc

SEQ ID NO: 189254 - DNA, 20 bp, Artificial Sequence
  chemically synthesized
aacagaagatcatgccagaa

SEQ ID NO: 189255 - DNA, 20 bp, Artificial Sequence
  chemically synthesized
gttttaacagaagatcatgc

SEQ ID NO: 189256 - DNA, 20 bp, Artificial Sequence
  chemically synthesized
gcctttccttgttttaacag

SEQ ID NO: 189257 - DNA, 20 bp, Artificial Sequence
  chemically synthesized
gcatgatcttctgttaaaac

SEQ ID NO: 189258 - DNA, 20 bp, Artificial Sequence
  chemically synthesized
actgcctttccttgttttaa

SEQ ID NO: 189259 - DNA, 20 bp, Artificial Sequence
  chemically synthesized
catgatcttctgttaaaaca

SEQ ID NO: 189260 - DNA, 20 bp, Artificial Sequence
  chemically synthesized
atcttctgttaaaacaagga

SEQ ID NO: 189261 - DNA, 20 bp, Artificial Sequence
  chemically synthesized
tcttctgttaaaacaaggaa

SEQ ID NO: 189262 - DNA, 20 bp, Artificial Sequence
  chemically synthesized
tctgttaaaacaaggaaagg

SEQ ID NO: 189263 - DNA, 20 bp, Artificial Sequence
  chemically synthesized
aaggaaaggcagttaccata

SEQ ID NO: 189264 - DNA, 20 bp, Artificial Sequence
  chemically synthesized
acaaaatcaacatttctgta

SEQ ID NO: 189265 - DNA, 20 bp, Artificial Sequence
  chemically synthesized
tacagaaatgttgattttgt

SEQ ID NO: 189266 - DNA, 20 bp, Artificial Sequence
  chemically synthesized
gaaatgttgattttgtcaga

SEQ ID NO: 189267 - DNA, 20 bp, Artificial Sequence
  chemically synthesized
ttgattttgtcagacagata

SEQ ID NO: 189268 - DNA, 20 bp, Artificial Sequence
  chemically synthesized
attattctttggcatagtat

SEQ ID NO: 189269 - DNA, 20 bp, Artificial Sequence
  chemically synthesized
acatcactaatactatgcca

SEQ ID NO: 189270 - DNA, 20 bp, Artificial Sequence
  chemically synthesized
attgcaattattctttggca

SEQ ID NO: 189271 - DNA, 20 bp, Artificial Sequence
  chemically synthesized
agataattgcaattattctt

SEQ ID NO: 189272 - DNA, 20 bp, Artificial Sequence
  chemically synthesized
aagcaataaattatcacaat

SEQ ID NO: 189273 - DNA, 20 bp, Artificial Sequence
  chemically synthesized
gcactttatgaagtatatga

SEQ ID NO: 189274 - DNA, 20 bp, Artificial Sequence
  chemically synthesized
ttgctttcatatacttcata

SEQ ID NO: 189275 - DNA, 20 bp, Artificial Sequence
  chemically synthesized
tcatctgatagcactttatg

SEQ ID NO: 189276 - DNA, 20 bp, Artificial Sequence
  chemically synthesized
tatacttcataaagtgctat

SEQ ID NO: 189277 - DNA, 20 bp, Artificial Sequence
  chemically synthesized
caaatggaacaatcatctga

SEQ ID NO: 189278 - DNA, 20 bp, Artificial Sequence
  chemically synthesized
atcagatgattgttccattt

SEQ ID NO: 189279 - DNA, 20 bp, Artificial Sequence
  chemically synthesized
tacttcacgtggatctcaaa

SEQ ID NO: 189280 - DNA, 20 bp, Artificial Sequence
  chemically synthesized
ttccatttgagatccacgtg

SEQ ID NO: 189281 - DNA, 20 bp, Artificial Sequence
  chemically synthesized
ttctgacctcatacttcacg

SEQ ID NO: 189282 - DNA, 20 bp, Artificial Sequence
  chemically synthesized
ttgagatccacgtgaagtat

SEQ ID NO: 189283 - DNA, 20 bp, Artificial Sequence
  chemically synthesized
tgagatccacgtgaagtatg

SEQ ID NO: 189284 - DNA, 20 bp, Artificial Sequence
  chemically synthesized
atccacgtgaagtatgaggt

SEQ ID NO: 189285 - DNA, 20 bp, Artificial Sequence
  chemically synthesized
gaaaaatgtgttattattcc

SEQ ID NO: 189286 - DNA, 20 bp, Artificial Sequence
  chemically synthesized
aaaaatgtgttattattcct

SEQ ID NO: 189287 - DNA, 20 bp, Artificial Sequence
  chemically synthesized
aaaatgtgttattattccta

SEQ ID NO: 189288 - DNA, 20 bp, Artificial Sequence
  chemically synthesized
gtgttattattcctagggta

SEQ ID NO: 189289 - DNA, 20 bp, Artificial Sequence
  chemically synthesized
caattcctcgtctttaccct

SEQ ID NO: 189290 - DNA, 20 bp, Artificial Sequence
  chemically synthesized
ccaattcctcgtctttaccc

SEQ ID NO: 189291 - DNA, 20 bp, Artificial Sequence
  chemically synthesized
attattcctagggtaaagac

SEQ ID NO: 189292 - DNA, 20 bp, Artificial Sequence
  chemically synthesized
ttattcctagggtaaagacg

SEQ ID NO: 189293 - DNA, 20 bp, Artificial Sequence
  chemically synthesized
ctagggtaaagacgaggaat

SEQ ID NO: 189294 - DNA, 20 bp, Artificial Sequence
  chemically synthesized
tagggtaaagacgaggaatt

SEQ ID NO: 189295 - DNA, 20 bp, Artificial Sequence
  chemically synthesized
agggtaaagacgaggaattg

SEQ ID NO: 189296 - DNA, 20 bp, Artificial Sequence
  chemically synthesized
gggtaaagacgaggaattgg

SEQ ID NO: 189297 - DNA, 20 bp, Artificial Sequence
  chemically synthesized
ggacaacttggacaaatatt

SEQ ID NO: 189298 - DNA, 20 bp, Artificial Sequence
  chemically synthesized
gggggtctaaatatttgtcc

SEQ ID NO: 189299 - DNA, 20 bp, Artificial Sequence
  chemically synthesized
cctttatctgcaggacaact

SEQ ID NO: 189300 - DNA, 20 bp, Artificial Sequence
  chemically synthesized
tatttgtccaagttgtcctg

SEQ ID NO: 189301 - DNA, 20 bp, Artificial Sequence
  chemically synthesized
tccaagttgtcctgcagata

SEQ ID NO: 189302 - DNA, 20 bp, Artificial Sequence
  chemically synthesized
gtcctgggacctttatctgc

SEQ ID NO: 189303 - DNA, 20 bp, Artificial Sequence
  chemically synthesized
ccaagttgtcctgcagataa

SEQ ID NO: 189304 - DNA, 20 bp, Artificial Sequence
  chemically synthesized
ggtcctgggacctttatctg

SEQ ID NO: 189305 - DNA, 20 bp, Artificial Sequence
  chemically synthesized
tgtcctgcagataaaggtcc

SEQ ID NO: 189306 - DNA, 20 bp, Artificial Sequence
  chemically synthesized
gtcctgcagataaaggtccc

SEQ ID NO: 189307 - DNA, 20 bp, Artificial Sequence
  chemically synthesized
gcagataaaggtcccaggac

SEQ ID NO: 189308 - DNA, 20 bp, Artificial Sequence
  chemically synthesized
cagataaaggtcccaggacc

SEQ ID NO: 189309 - DNA, 20 bp, Artificial Sequence
  chemically synthesized
acaatctggggcctggtcct

SEQ ID NO: 189310 - DNA, 20 bp, Artificial Sequence
  chemically synthesized
aacaatctggggcctggtcc

SEQ ID NO: 189311 - DNA, 20 bp, Artificial Sequence
  chemically synthesized
aaggtcccaggaccaggccc

SEQ ID NO: 189312 - DNA, 20 bp, Artificial Sequence
  chemically synthesized
tgtgataacaatctggggcc

SEQ ID NO: 189313 - DNA, 20 bp, Artificial Sequence
  chemically synthesized
tgaaatgtgataacaatctg

SEQ ID NO: 189314 - DNA, 20 bp, Artificial Sequence
  chemically synthesized
ctgaaatgtgataacaatct

SEQ ID NO: 189315 - DNA, 20 bp, Artificial Sequence
  chemically synthesized
actgaaatgtgataacaatc

SEQ ID NO: 189316 - DNA, 20 bp, Artificial Sequence
  chemically synthesized
cccagattgttatcacattt

SEQ ID NO: 189317 - DNA, 20 bp, Artificial Sequence
  chemically synthesized
gattgttatcacatttcagt

SEQ ID NO: 189318 - DNA, 20 bp, Artificial Sequence
  chemically synthesized
tcagtgagattcccattatt

SEQ ID NO: 189319 - DNA, 20 bp, Artificial Sequence
  chemically synthesized
aagagccagtaccgaataat

SEQ ID NO: 189320 - DNA, 20 bp, Artificial Sequence
  chemically synthesized
aaagagccagtaccgaataa

SEQ ID NO: 189321 - DNA, 20 bp, Artificial Sequence
  chemically synthesized
agattcccattattcggtac

SEQ ID NO: 189322 - DNA, 20 bp, Artificial Sequence
  chemically synthesized
tatttgagtcagaaaagagc

SEQ ID NO: 189323 - DNA, 20 bp, Artificial Sequence
  chemically synthesized
taagtatttgagtcagaaaa

SEQ ID NO: 189324 - DNA, 20 bp, Artificial Sequence
  chemically synthesized
tctaagtatttgagtcagaa

SEQ ID NO: 189325 - DNA, 20 bp, Artificial Sequence
  chemically synthesized
taatatctaagtatttgagt

SEQ ID NO: 189326 - DNA, 20 bp, Artificial Sequence
  chemically synthesized
tcttttctgactcaaatact

SEQ ID NO: 189327 - DNA, 20 bp, Artificial Sequence
  chemically synthesized
tctttaatatctaagtattt

SEQ ID NO: 189328 - DNA, 20 bp, Artificial Sequence
  chemically synthesized
catatatctctttaatatct

SEQ ID NO: 189329 - DNA, 20 bp, Artificial Sequence
  chemically synthesized
actcaaatacttagatatta

SEQ ID NO: 189330 - DNA, 20 bp, Artificial Sequence
  chemically synthesized
tcaaatacttagatattaaa

SEQ ID NO: 189331 - DNA, 20 bp, Artificial Sequence
  chemically synthesized
gatattaaagagatatatgc

SEQ ID NO: 189332 - DNA, 20 bp, Artificial Sequence
  chemically synthesized
agatatatgcgagacatgaa

SEQ ID NO: 189333 - DNA, 20 bp, Artificial Sequence
  chemically synthesized
tatatgcgagacatgaaaag

SEQ ID NO: 189334 - DNA, 20 bp, Artificial Sequence
  chemically synthesized
tgcgagacatgaaaagtaga

SEQ ID NO: 189335 - DNA, 20 bp, Artificial Sequence
  chemically synthesized
agtagaaagtacaaaaaaat

SEQ ID NO: 189336 - DNA, 20 bp, Artificial Sequence
  chemically synthesized
gaaagtacaaaaaaatcggc

SEQ ID NO: 189337 - DNA, 20 bp, Artificial Sequence
  chemically synthesized
ttattttcacaataatttaa

SEQ ID NO: 189338 - DNA, 20 bp, Artificial Sequence
  chemically synthesized
atctataattatgaagtatt

SEQ ID NO: 189339 - DNA, 20 bp, Artificial Sequence
  chemically synthesized
caaaaacatctataattatg

SEQ ID NO: 189340 - DNA, 20 bp, Artificial Sequence
  chemically synthesized
aaccaaatacttcataatta

SEQ ID NO: 189341 - DNA, 20 bp, Artificial Sequence
  chemically synthesized
ttcataattatagatgtttt

SEQ ID NO: 189342 - DNA, 20 bp, Artificial Sequence
  chemically synthesized
ataattatagatgtttttgg

SEQ ID NO: 189343 - DNA, 20 bp, Artificial Sequence
  chemically synthesized
tagatgtttttggtagaaaa

SEQ ID NO: 189344 - DNA, 20 bp, Artificial Sequence
  chemically synthesized
tagatgtttaataggaaagt

SEQ ID NO: 189345 - DNA, 20 bp, Artificial Sequence
  chemically synthesized
aaaatagatgtttaatagga

SEQ ID NO: 189346 - DNA, 20 bp, Artificial Sequence
  chemically synthesized
agacaaaatagatgtttaat

SEQ ID NO: 189347 - DNA, 20 bp, Artificial Sequence
  chemically synthesized
aagacaaaatagatgtttaa

SEQ ID NO: 189348 - DNA, 20 bp, Artificial Sequence
  chemically synthesized
tatcaaagtgaaagacaaaa

SEQ ID NO: 189349 - DNA, 20 bp, Artificial Sequence
  chemically synthesized
taacagcattatcaaagtga

SEQ ID NO: 189350 - DNA, 20 bp, Artificial Sequence
  chemically synthesized
tgaagataacagcattatca

SEQ ID NO: 189351 - DNA, 20 bp, Artificial Sequence
  chemically synthesized
tttgataatgctgttatctt

SEQ ID NO: 189352 - DNA, 20 bp, Artificial Sequence
  chemically synthesized
ttatatttaactgaagataa

SEQ ID NO: 189353 - DNA, 20 bp, Artificial Sequence
  chemically synthesized
ataatgattatatttaactg

SEQ ID NO: 189354 - DNA, 20 bp, Artificial Sequence
  chemically synthesized
cattatgtgaataaacaatg

SEQ ID NO: 189355 - DNA, 20 bp, Artificial Sequence
  chemically synthesized
ataaacaatgtggatcaaaa

SEQ ID NO: 189356 - DNA, 20 bp, Artificial Sequence
  chemically synthesized
aatgtggatcaaaaaagaat

SEQ ID NO: 189357 - DNA, 20 bp, Artificial Sequence
  chemically synthesized
aagaatgagaaatatcaacc

SEQ ID NO: 189358 - DNA, 20 bp, Artificial Sequence
  chemically synthesized
atcagcttcaaacatattct

SEQ ID NO: 189359 - DNA, 20 bp, Artificial Sequence
  chemically synthesized
aatcagcttcaaacatattc

SEQ ID NO: 189360 - DNA, 20 bp, Artificial Sequence
  chemically synthesized
atcaacccagaatatgtttg

SEQ ID NO: 189361 - DNA, 20 bp, Artificial Sequence
  chemically synthesized
atatgtttgaagctgattta

SEQ ID NO: 189362 - DNA, 20 bp, Artificial Sequence
  chemically synthesized
atgtttgaagctgatttaaa

SEQ ID NO: 189363 - DNA, 20 bp, Artificial Sequence
  chemically synthesized
tgctgttgtcctctttaaat

SEQ ID NO: 189364 - DNA, 20 bp, Artificial Sequence
  chemically synthesized
tgtttgaagctgatttaaag

SEQ ID NO: 189365 - DNA, 20 bp, Artificial Sequence
  chemically synthesized
agctgatttaaagaggacaa

SEQ ID NO: 189366 - DNA, 20 bp, Artificial Sequence
  chemically synthesized
aaagaggacaacagcatccc

SEQ ID NO: 189367 - DNA, 20 bp, Artificial Sequence
  chemically synthesized
ggacaacagcatccctagat

SEQ ID NO: 189368 - DNA, 20 bp, Artificial Sequence
  chemically synthesized
aaaacatgtaatctaatcta

SEQ ID NO: 189369 - DNA, 20 bp, Artificial Sequence
  chemically synthesized
aaaaacatgtaatctaatct

SEQ ID NO: 189370 - DNA, 20 bp, Artificial Sequence
  chemically synthesized
caaaaacatgtaatctaatc

SEQ ID NO: 189371 - DNA, 20 bp, Artificial Sequence
  chemically synthesized
ttagattacatgtttttgta

SEQ ID NO: 189372 - DNA, 20 bp, Artificial Sequence
  chemically synthesized
tttttgtaaagctgctatat

SEQ ID NO: 189373 - DNA, 20 bp, Artificial Sequence
  chemically synthesized
agcatgacattctaatatag

SEQ ID NO: 189374 - DNA, 20 bp, Artificial Sequence
  chemically synthesized
gtcagcatgacattctaata

SEQ ID NO: 189375 - DNA, 20 bp, Artificial Sequence
  chemically synthesized
tacattatcaagaatcatgt

SEQ ID NO: 189376 - DNA, 20 bp, Artificial Sequence
  chemically synthesized
tacccattaaatacattatc

SEQ ID NO: 189377 - DNA, 20 bp, Artificial Sequence
  chemically synthesized
attcttgataatgtatttaa

SEQ ID NO: 189378 - DNA, 20 bp, Artificial Sequence
  chemically synthesized
ttcttgataatgtatttaat

SEQ ID NO: 189379 - DNA, 20 bp, Artificial Sequence
  chemically synthesized
gataatgtatttaatgggta

SEQ ID NO: 189380 - DNA, 20 bp, Artificial Sequence
  chemically synthesized
tttaatgggtaaagtatgca

SEQ ID NO: 189381 - DNA, 20 bp, Artificial Sequence
  chemically synthesized
atgcatagtgaacatttgtg

SEQ ID NO: 189382 - DNA, 20 bp, Artificial Sequence
  chemically synthesized
gcatagtgaacatttgtgta

SEQ ID NO: 189383 - DNA, 20 bp, Artificial Sequence
  chemically synthesized
atcaaaagaaaacagaaaat

SEQ ID NO: 189384 - DNA, 20 bp, Artificial Sequence
  chemically synthesized
cttcgtgtatcaaaagaaaa

SEQ ID NO: 189385 - DNA, 20 bp, Artificial Sequence
  chemically synthesized
cattcaccttcgtgtatcaa

SEQ ID NO: 189386 - DNA, 20 bp, Artificial Sequence
  chemically synthesized
ctgttttcttttgatacacg

SEQ ID NO: 189387 - DNA, 20 bp, Artificial Sequence
  chemically synthesized
tgttttcttttgatacacga

SEQ ID NO: 189388 - DNA, 20 bp, Artificial Sequence
  chemically synthesized
gaaggtgaatgatgcaattg

SEQ ID NO: 189389 - DNA, 20 bp, Artificial Sequence
  chemically synthesized
attttcattaagttcaacag

SEQ ID NO: 189390 - DNA, 20 bp, Artificial Sequence
  chemically synthesized
agaattttcattaagttcaa

SEQ ID NO: 189391 - DNA, 20 bp, Artificial Sequence
  chemically synthesized
tagtggacagaattttcatt

SEQ ID NO: 189392 - DNA, 20 bp, Artificial Sequence
  chemically synthesized
tctatttgattgatagtgga

SEQ ID NO: 189393 - DNA, 20 bp, Artificial Sequence
  chemically synthesized
aagatctatttgattgatag

SEQ ID NO: 189394 - DNA, 20 bp, Artificial Sequence
  chemically synthesized
gaaaagatctatttgattga

SEQ ID NO: 189395 - DNA, 20 bp, Artificial Sequence
  chemically synthesized
tctgtccactatcaatcaaa

SEQ ID NO: 189396 - DNA, 20 bp, Artificial Sequence
  chemically synthesized
ttggacaacaaacaagagaa

SEQ ID NO: 189397 - DNA, 20 bp, Artificial Sequence
  chemically synthesized
tttgtttggacaacaaacaa

SEQ ID NO: 189398 - DNA, 20 bp, Artificial Sequence
  chemically synthesized
tatttgtttggacaacaaac

SEQ ID NO: 189399 - DNA, 20 bp, Artificial Sequence
  chemically synthesized
tacttttgaacatatttgtt

SEQ ID NO: 189400 - DNA, 20 bp, Artificial Sequence
  chemically synthesized
gtccaaacaaatatgttcaa

SEQ ID NO: 189401 - DNA, 20 bp, Artificial Sequence
  chemically synthesized
agtaattcatttttattgaa

SEQ ID NO: 189402 - DNA, 20 bp, Artificial Sequence
  chemically synthesized
ttttttcatcatgtgagtac

SEQ ID NO: 189403 - DNA, 20 bp, Artificial Sequence
  chemically synthesized
ttgtgtttttttcatcatgt

SEQ ID NO: 189404 - DNA, 20 bp, Artificial Sequence
  chemically synthesized
atgatgaaaaaaacacaaac

SEQ ID NO: 189405 - DNA, 20 bp, Artificial Sequence
  chemically synthesized
tgatgaaaaaaacacaaaca

SEQ ID NO: 189406 - DNA, 20 bp, Artificial Sequence
  chemically synthesized
agtgcatgtgaaataaatta

SEQ ID NO: 189407 - DNA, 20 bp, Artificial Sequence
  chemically synthesized
tttcacatgcacttgcttgc

SEQ ID NO: 189408 - DNA, 20 bp, Artificial Sequence
  chemically synthesized
ccagtgtatagcttgcaagc

SEQ ID NO: 189409 - DNA, 20 bp, Artificial Sequence
  chemically synthesized
ttctccagtgtatagcttgc

SEQ ID NO: 189410 - DNA, 20 bp, Artificial Sequence
  chemically synthesized
cttgcttgcaagctatacac

SEQ ID NO: 189411 - DNA, 20 bp, Artificial Sequence
  chemically synthesized
tgcttgcaagctatacactg

SEQ ID NO: 189412 - DNA, 20 bp, Artificial Sequence
  chemically synthesized
ttcccctcttctccagtgta

SEQ ID NO: 189413 - DNA, 20 bp, Artificial Sequence
  chemically synthesized
ttgcaagctatacactggag

SEQ ID NO: 189414 - DNA, 20 bp, Artificial Sequence
  chemically synthesized
gcaagctatacactggagaa

SEQ ID NO: 189415 - DNA, 20 bp, Artificial Sequence
  chemically synthesized
caagctatacactggagaag

SEQ ID NO: 189416 - DNA, 20 bp, Artificial Sequence
  chemically synthesized
aagctatacactggagaaga

SEQ ID NO: 189417 - DNA, 20 bp, Artificial Sequence
  chemically synthesized
actaaacttcccctcttctc

SEQ ID NO: 189418 - DNA, 20 bp, Artificial Sequence
  chemically synthesized
agctatacactggagaagag

SEQ ID NO: 189419 - DNA, 20 bp, Artificial Sequence
  chemically synthesized
tatacactggagaagagggg

SEQ ID NO: 189420 - DNA, 20 bp, Artificial Sequence
  chemically synthesized
actggagaagaggggaagtt

SEQ ID NO: 189421 - DNA, 20 bp, Artificial Sequence
  chemically synthesized
gttttatatttatgtaattc

SEQ ID NO: 189422 - DNA, 20 bp, Artificial Sequence
  chemically synthesized
tttatgtaattcaagttatg

SEQ ID NO: 189423 - DNA, 20 bp, Artificial Sequence
  chemically synthesized
tgtaattcaagttatgtaga

SEQ ID NO: 189424 - DNA, 20 bp, Artificial Sequence
  chemically synthesized
ttcaagttatgtagatagac

SEQ ID NO: 189425 - DNA, 20 bp, Artificial Sequence
  chemically synthesized
tcaagttatgtagatagacc

SEQ ID NO: 189426 - DNA, 20 bp, Artificial Sequence
  chemically synthesized
ctgtccatttatataacacc

SEQ ID NO: 189427 - DNA, 20 bp, Artificial Sequence
  chemically synthesized
tagaccaggtgttatataaa

SEQ ID NO: 189428 - DNA, 20 bp, Artificial Sequence
  chemically synthesized
ccaggtgttatataaatgga

SEQ ID NO: 189429 - DNA, 20 bp, Artificial Sequence
  chemically synthesized
aaatggacagatttttaaac

SEQ ID NO: 189430 - DNA, 20 bp, Artificial Sequence
  chemically synthesized
tattatttattgaaacatac

SEQ ID NO: 189431 - DNA, 20 bp, Artificial Sequence
  chemically synthesized
tatgtttcaataaataatat

SEQ ID NO: 189432 - DNA, 20 bp, Artificial Sequence
  chemically synthesized
aaataatatgagccaatctt

SEQ ID NO: 189433 - DNA, 20 bp, Artificial Sequence
  chemically synthesized
ttatattcatttctgaagat

SEQ ID NO: 189434 - DNA, 20 bp, Artificial Sequence
  chemically synthesized
catgtttatattcatttctg

SEQ ID NO: 189435 - DNA, 20 bp, Artificial Sequence
  chemically synthesized
cagaaatgaatataaacatg

SEQ ID NO: 189436 - DNA, 20 bp, Artificial Sequence
  chemically synthesized
accttgtgtttttatagaga

SEQ ID NO: 189437 - DNA, 20 bp, Artificial Sequence
  chemically synthesized
aaccttgtgtttttatagag

SEQ ID NO: 189438 - DNA, 20 bp, Artificial Sequence
  chemically synthesized
ttcaaccttgtgtttttata

SEQ ID NO: 189439 - DNA, 20 bp, Artificial Sequence
  chemically synthesized
cattcaaccttgtgttttta

SEQ ID NO: 189440 - DNA, 20 bp, Artificial Sequence
  chemically synthesized
atccttctctataaaaacac

SEQ ID NO: 189441 - DNA, 20 bp, Artificial Sequence
  chemically synthesized
tccttctctataaaaacaca

SEQ ID NO: 189442 - DNA, 20 bp, Artificial Sequence
  chemically synthesized
tataaaaacacaaggttgaa

SEQ ID NO: 189443 - DNA, 20 bp, Artificial Sequence
  chemically synthesized
ataaaaacacaaggttgaat

SEQ ID NO: 189444 - DNA, 20 bp, Artificial Sequence
  chemically synthesized
taaaaacacaaggttgaatg

SEQ ID NO: 189445 - DNA, 20 bp, Artificial Sequence
  chemically synthesized
ggttgaatggggctcatctg

SEQ ID NO: 189446 - DNA, 20 bp, Artificial Sequence
  chemically synthesized
gttgcagcaacacttcagat

SEQ ID NO: 189447 - DNA, 20 bp, Artificial Sequence
  chemically synthesized
acactgttgcagcaacactt

SEQ ID NO: 189448 - DNA, 20 bp, Artificial Sequence
  chemically synthesized
catctgaagtgttgctgcaa

SEQ ID NO: 189449 - DNA, 20 bp, Artificial Sequence
  chemically synthesized
ggacagacatcacactgttg

SEQ ID NO: 189450 - DNA, 20 bp, Artificial Sequence
  chemically synthesized
caacagtgtgatgtctgtcc

SEQ ID NO: 189451 - DNA, 20 bp, Artificial Sequence
  chemically synthesized
ccacatactctcggccagga

SEQ ID NO: 189452 - DNA, 20 bp, Artificial Sequence
  chemically synthesized
gtgtgatgtctgtcctggcc

SEQ ID NO: 189453 - DNA, 20 bp, Artificial Sequence
  chemically synthesized
gtgatgtctgtcctggccga

SEQ ID NO: 189454 - DNA, 20 bp, Artificial Sequence
  chemically synthesized
catcccacatactctcggcc

SEQ ID NO: 189455 - DNA, 20 bp, Artificial Sequence
  chemically synthesized
tcatcccacatactctcggc

SEQ ID NO: 189456 - DNA, 20 bp, Artificial Sequence
  chemically synthesized
taaatcatcccacatactct

SEQ ID NO: 189457 - DNA, 20 bp, Artificial Sequence
  chemically synthesized
ctgtcctggccgagagtatg

SEQ ID NO: 189458 - DNA, 20 bp, Artificial Sequence
  chemically synthesized
tgtcctggccgagagtatgt

SEQ ID NO: 189459 - DNA, 20 bp, Artificial Sequence
  chemically synthesized
tgttactgcaaaaacatatt

SEQ ID NO: 189460 - DNA, 20 bp, Artificial Sequence
  chemically synthesized
tttatctcaatatgtttttg

SEQ ID NO: 189461 - DNA, 20 bp, Artificial Sequence
  chemically synthesized
tcaatatgtttttgcagtaa

SEQ ID NO: 189462 - DNA, 20 bp, Artificial Sequence
  chemically synthesized
caatatgtttttgcagtaac

SEQ ID NO: 189463 - DNA, 20 bp, Artificial Sequence
  chemically synthesized
ttgttgtcccatcattgttt

SEQ ID NO: 189464 - DNA, 20 bp, Artificial Sequence
  chemically synthesized
aggtcatactgaaacaatga

SEQ ID NO: 189465 - DNA, 20 bp, Artificial Sequence
  chemically synthesized
ggtcatactgaaacaatgat

SEQ ID NO: 189466 - DNA, 20 bp, Artificial Sequence
  chemically synthesized
atcacaatgtatgccataca

SEQ ID NO: 189467 - DNA, 20 bp, Artificial Sequence
  chemically synthesized
tcccatatcatttctttgta

SEQ ID NO: 189468 - DNA, 20 bp, Artificial Sequence
  chemically synthesized
tgccatacaaagaaatgata

SEQ ID NO: 189469 - DNA, 20 bp, Artificial Sequence
  chemically synthesized
gccatacaaagaaatgatat

SEQ ID NO: 189470 - DNA, 20 bp, Artificial Sequence
  chemically synthesized
atacaaagaaatgatatggg

SEQ ID NO: 189471 - DNA, 20 bp, Artificial Sequence
  chemically synthesized
ggaagaataatttcattccc

SEQ ID NO: 189472 - DNA, 20 bp, Artificial Sequence
  chemically synthesized
agtatcaattttaaatactt

SEQ ID NO: 189473 - DNA, 20 bp, Artificial Sequence
  chemically synthesized
gagtatcaattttaaatact

SEQ ID NO: 189474 - DNA, 20 bp, Artificial Sequence
  chemically synthesized
aaaattgatactctattttg

SEQ ID NO: 189475 - DNA, 20 bp, Artificial Sequence
  chemically synthesized
ctatggtgatcttcaaaata

SEQ ID NO: 189476 - DNA, 20 bp, Artificial Sequence
  chemically synthesized
ttctatggtgatcttcaaaa

SEQ ID NO: 189477 - DNA, 20 bp, Artificial Sequence
  chemically synthesized
ctctattttgaagatcacca

SEQ ID NO: 189478 - DNA, 20 bp, Artificial Sequence
  chemically synthesized
tttgaagatcaccatagaat

SEQ ID NO: 189479 - DNA, 20 bp, Artificial Sequence
  chemically synthesized
ttacattgtttctaattcta

SEQ ID NO: 189480 - DNA, 20 bp, Artificial Sequence
  chemically synthesized
tagaattagaaacaatgtaa

SEQ ID NO: 189481 - DNA, 20 bp, Artificial Sequence
  chemically synthesized
ttagaaacaatgtaaaagaa

SEQ ID NO: 189482 - DNA, 20 bp, Artificial Sequence
  chemically synthesized
acaatgtaaaagaatagacc

SEQ ID NO: 189483 - DNA, 20 bp, Artificial Sequence
  chemically synthesized
aaattatagttattattacc

SEQ ID NO: 189484 - DNA, 20 bp, Artificial Sequence
  chemically synthesized
gaaattatagttattattac

SEQ ID NO: 189485 - DNA, 20 bp, Artificial Sequence
  chemically synthesized
tctctttttgaaagaaatta

SEQ ID NO: 189486 - DNA, 20 bp, Artificial Sequence
  chemically synthesized
taactataatttctttcaaa

SEQ ID NO: 189487 - DNA, 20 bp, Artificial Sequence
  chemically synthesized
actataatttctttcaaaaa

SEQ ID NO: 189488 - DNA, 20 bp, Artificial Sequence
  chemically synthesized
tttatgaattctctttttga

SEQ ID NO: 189489 - DNA, 20 bp, Artificial Sequence
  chemically synthesized
aaaaagagaattcataaaca

SEQ ID NO: 189490 - DNA, 20 bp, Artificial Sequence
  chemically synthesized
aattcataaacatagaaacc

SEQ ID NO: 189491 - DNA, 20 bp, Artificial Sequence
  chemically synthesized
attcataaacatagaaacca

SEQ ID NO: 189492 - DNA, 20 bp, Artificial Sequence
  chemically synthesized
aaacatagaaaccaaggact

SEQ ID NO: 189493 - DNA, 20 bp, Artificial Sequence
  chemically synthesized
gtggttcttctctgagtcct

SEQ ID NO: 189494 - DNA, 20 bp, Artificial Sequence
  chemically synthesized
acatagaaaccaaggactca

SEQ ID NO: 189495 - DNA, 20 bp, Artificial Sequence
  chemically synthesized
tagaaaccaaggactcagag

SEQ ID NO: 189496 - DNA, 20 bp, Artificial Sequence
  chemically synthesized
tttataagtggttcttctct

SEQ ID NO: 189497 - DNA, 20 bp, Artificial Sequence
  chemically synthesized
aatattctaatgtttataag

SEQ ID NO: 189498 - DNA, 20 bp, Artificial Sequence
  chemically synthesized
ggtaatattctaatgtttat

SEQ ID NO: 189499 - DNA, 20 bp, Artificial Sequence
  chemically synthesized
gaagaaccacttataaacat

SEQ ID NO: 189500 - DNA, 20 bp, Artificial Sequence
  chemically synthesized
gctaaattaggaatggcaga

SEQ ID NO: 189501 - DNA, 20 bp, Artificial Sequence
  chemically synthesized
tgctaaattaggaatggcag

SEQ ID NO: 189502 - DNA, 20 bp, Artificial Sequence
  chemically synthesized
atatgctaaattaggaatgg

SEQ ID NO: 189503 - DNA, 20 bp, Artificial Sequence
  chemically synthesized
tttatatgctaaattaggaa

SEQ ID NO: 189504 - DNA, 20 bp, Artificial Sequence
  chemically synthesized
accttctgccattcctaatt

SEQ ID NO: 189505 - DNA, 20 bp, Artificial Sequence
  chemically synthesized
ttacctttatatgctaaatt

SEQ ID NO: 189506 - DNA, 20 bp, Artificial Sequence
  chemically synthesized
gttacctttatatgctaaat

SEQ ID NO: 189507 - DNA, 20 bp, Artificial Sequence
  chemically synthesized
cattcctaatttagcatata

SEQ ID NO: 189508 - DNA, 20 bp, Artificial Sequence
  chemically synthesized
attcctaatttagcatataa

SEQ ID NO: 189509 - DNA, 20 bp, Artificial Sequence
  chemically synthesized
tgaaaagcagagattttaaa

SEQ ID NO: 189510 - DNA, 20 bp, Artificial Sequence
  chemically synthesized
gctctcagttatgaaaagca

SEQ ID NO: 189511 - DNA, 20 bp, Artificial Sequence
  chemically synthesized
tggctctcagttatgaaaag

SEQ ID NO: 189512 - DNA, 20 bp, Artificial Sequence
  chemically synthesized
ttctggctctcagttatgaa

SEQ ID NO: 189513 - DNA, 20 bp, Artificial Sequence
  chemically synthesized
aatctctgcttttcataact

SEQ ID NO: 189514 - DNA, 20 bp, Artificial Sequence
  chemically synthesized
tctctgcttttcataactga

SEQ ID NO: 189515 - DNA, 20 bp, Artificial Sequence
  chemically synthesized
tgcttttcataactgagagc

SEQ ID NO: 189516 - DNA, 20 bp, Artificial Sequence
  chemically synthesized
gacgttttgtttctggctct

SEQ ID NO: 189517 - DNA, 20 bp, Artificial Sequence
  chemically synthesized
tcatgcagacgttttgtttc

SEQ ID NO: 189518 - DNA, 20 bp, Artificial Sequence
  chemically synthesized
aagaacacctaatcatcatg

SEQ ID NO: 189519 - DNA, 20 bp, Artificial Sequence
  chemically synthesized
caaaacgtctgcatgatgat

SEQ ID NO: 189520 - DNA, 20 bp, Artificial Sequence
  chemically synthesized
aaaacgtctgcatgatgatt

SEQ ID NO: 189521 - DNA, 20 bp, Artificial Sequence
  chemically synthesized
gattaggtgttctttgtata

SEQ ID NO: 189522 - DNA, 20 bp, Artificial Sequence
  chemically synthesized
ggatactgttgctatataca

SEQ ID NO: 189523 - DNA, 20 bp, Artificial Sequence
  chemically synthesized
gtgttctttgtatatagcaa

SEQ ID NO: 189524 - DNA, 20 bp, Artificial Sequence
  chemically synthesized
atattgttaaaattggcaag

SEQ ID NO: 189525 - DNA, 20 bp, Artificial Sequence
  chemically synthesized
aatattgttaaaattggcaa

SEQ ID NO: 189526 - DNA, 20 bp, Artificial Sequence
  chemically synthesized
taatattgttaaaattggca

SEQ ID NO: 189527 - DNA, 20 bp, Artificial Sequence
  chemically synthesized
ttaatattgttaaaattggc

SEQ ID NO: 189528 - DNA, 20 bp, Artificial Sequence
  chemically synthesized
tttcttaatattgttaaaat

SEQ ID NO: 189529 - DNA, 20 bp, Artificial Sequence
  chemically synthesized
ttgccaattttaacaatatt

SEQ ID NO: 189530 - DNA, 20 bp, Artificial Sequence
  chemically synthesized
gaaacatatgccccactctc

SEQ ID NO: 189531 - DNA, 20 bp, Artificial Sequence
  chemically synthesized
gctatttattctggagagtg

SEQ ID NO: 189532 - DNA, 20 bp, Artificial Sequence
  chemically synthesized
agctatttattctggagagt

SEQ ID NO: 189533 - DNA, 20 bp, Artificial Sequence
  chemically synthesized
cagctatttattctggagag

SEQ ID NO: 189534 - DNA, 20 bp, Artificial Sequence
  chemically synthesized
acacagctatttattctgga

SEQ ID NO: 189535 - DNA, 20 bp, Artificial Sequence
  chemically synthesized
ctacacagctatttattctg

SEQ ID NO: 189536 - DNA, 20 bp, Artificial Sequence
  chemically synthesized
gccccactctccagaataaa

SEQ ID NO: 189537 - DNA, 20 bp, Artificial Sequence
  chemically synthesized
ttctacacagctatttattc

SEQ ID NO: 189538 - DNA, 20 bp, Artificial Sequence
  chemically synthesized
ctccagaataaatagctgtg

SEQ ID NO: 189539 - DNA, 20 bp, Artificial Sequence
  chemically synthesized
cagaataaatagctgtgtag

SEQ ID NO: 189540 - DNA, 20 bp, Artificial Sequence
  chemically synthesized
tcaaagcattttcttctaca

SEQ ID NO: 189541 - DNA, 20 bp, Artificial Sequence
  chemically synthesized
agaagacaatgaatgtttca

SEQ ID NO: 189542 - DNA, 20 bp, Artificial Sequence
  chemically synthesized
gttgattttcatattttaag

SEQ ID NO: 189543 - DNA, 20 bp, Artificial Sequence
  chemically synthesized
aatgttgattttcatatttt

SEQ ID NO: 189544 - DNA, 20 bp, Artificial Sequence
  chemically synthesized
aaaatatgaaaatcaacatt

SEQ ID NO: 189545 - DNA, 20 bp, Artificial Sequence
  chemically synthesized
aaatatgaaaatcaacattt

SEQ ID NO: 189546 - DNA, 20 bp, Artificial Sequence
  chemically synthesized
acccaaaggctattatgtag

SEQ ID NO: 189547 - DNA, 20 bp, Artificial Sequence
  chemically synthesized
tttatgtcgcttctacataa

SEQ ID NO: 189548 - DNA, 20 bp, Artificial Sequence
  chemically synthesized
cttacccaaaggctattatg

SEQ ID NO: 189549 - DNA, 20 bp, Artificial Sequence
  chemically synthesized
cgcttctacataatagcctt

SEQ ID NO: 189550 - DNA, 20 bp, Artificial Sequence
  chemically synthesized
gcttctacataatagccttt

SEQ ID NO: 189551 - DNA, 20 bp, Artificial Sequence
  chemically synthesized
ctacataatagcctttgggt

SEQ ID NO: 189552 - DNA, 20 bp, Artificial Sequence
  chemically synthesized
gttaatctgtacttacccaa

SEQ ID NO: 189553 - DNA, 20 bp, Artificial Sequence
  chemically synthesized
agttaatctgtacttaccca

SEQ ID NO: 189554 - DNA, 20 bp, Artificial Sequence
  chemically synthesized
taatagcctttgggtaagta

SEQ ID NO: 189555 - DNA, 20 bp, Artificial Sequence
  chemically synthesized
gtaagtacagattaacttga

SEQ ID NO: 189556 - DNA, 20 bp, Artificial Sequence
  chemically synthesized
aagtacagattaacttgaca

SEQ ID NO: 189557 - DNA, 20 bp, Artificial Sequence
  chemically synthesized
agtacagattaacttgacag

SEQ ID NO: 189558 - DNA, 20 bp, Artificial Sequence
  chemically synthesized
aagcgtgaaagacctctgtc

SEQ ID NO: 189559 - DNA, 20 bp, Artificial Sequence
  chemically synthesized
atgtcgatgtttaagcgtga

SEQ ID NO: 189560 - DNA, 20 bp, Artificial Sequence
  chemically synthesized
aaatttaaatgtcgatgttt

SEQ ID NO: 189561 - DNA, 20 bp, Artificial Sequence
  chemically synthesized
aaattttgattgacaaccaa

SEQ ID NO: 189562 - DNA, 20 bp, Artificial Sequence
  chemically synthesized
aaagcgttactcgttactgt

SEQ ID NO: 189563 - DNA, 20 bp, Artificial Sequence
  chemically synthesized
gattgacaaccaacagtaac

SEQ ID NO: 189564 - DNA, 20 bp, Artificial Sequence
  chemically synthesized
aacgagtaacgctttcattt

SEQ ID NO: 189565 - DNA, 20 bp, Artificial Sequence
  chemically synthesized
tatttaaatatctaaaatga

SEQ ID NO: 189566 - DNA, 20 bp, Artificial Sequence
  chemically synthesized
attttagatatttaaatata

SEQ ID NO: 189567 - DNA, 20 bp, Artificial Sequence
  chemically synthesized
ttagatatttaaatatacag

SEQ ID NO: 189568 - DNA, 20 bp, Artificial Sequence
  chemically synthesized
tgctcagtcttgcaggcaaa

SEQ ID NO: 189569 - DNA, 20 bp, Artificial Sequence
  chemically synthesized
cagaagtaccatttgcctgc

SEQ ID NO: 189570 - DNA, 20 bp, Artificial Sequence
  chemically synthesized
attcatttgctcagtcttgc

SEQ ID NO: 189571 - DNA, 20 bp, Artificial Sequence
  chemically synthesized
taccatttgcctgcaagact

SEQ ID NO: 189572 - DNA, 20 bp, Artificial Sequence
  chemically synthesized
aattcatttgctcagtcttg

SEQ ID NO: 189573 - DNA, 20 bp, Artificial Sequence
  chemically synthesized
aacaaattaattcatttgct

SEQ ID NO: 189574 - DNA, 20 bp, Artificial Sequence
  chemically synthesized
agcaaatgaattaatttgtt

SEQ ID NO: 189575 - DNA, 20 bp, Artificial Sequence
  chemically synthesized
ttgttcagtaaatatttatt

SEQ ID NO: 189576 - DNA, 20 bp, Artificial Sequence
  chemically synthesized
gagcgcattgcatcctgcat

SEQ ID NO: 189577 - DNA, 20 bp, Artificial Sequence
  chemically synthesized
ggtcaggaactgtctgatgc

SEQ ID NO: 189578 - DNA, 20 bp, Artificial Sequence
  chemically synthesized
gcattgcatcctgcatcaga

SEQ ID NO: 189579 - DNA, 20 bp, Artificial Sequence
  chemically synthesized
aggtcaggaactgtctgatg

SEQ ID NO: 189580 - DNA, 20 bp, Artificial Sequence
  chemically synthesized
catcagacagttcctgacct

SEQ ID NO: 189581 - DNA, 20 bp, Artificial Sequence
  chemically synthesized
atcagacagttcctgacctt

SEQ ID NO: 189582 - DNA, 20 bp, Artificial Sequence
  chemically synthesized
gcaatgaaatgcctaaggtc

SEQ ID NO: 189583 - DNA, 20 bp, Artificial Sequence
  chemically synthesized
tgcaatgaaatgcctaaggt

SEQ ID NO: 189584 - DNA, 20 bp, Artificial Sequence
  chemically synthesized
tacctgcaatgaaatgccta

SEQ ID NO: 189585 - DNA, 20 bp, Artificial Sequence
  chemically synthesized
atacctgcaatgaaatgcct

SEQ ID NO: 189586 - DNA, 20 bp, Artificial Sequence
  chemically synthesized
tgaccttaggcatttcattg

SEQ ID NO: 189587 - DNA, 20 bp, Artificial Sequence
  chemically synthesized
gaccttaggcatttcattgc

SEQ ID NO: 189588 - DNA, 20 bp, Artificial Sequence
  chemically synthesized
taggcatttcattgcaggta

SEQ ID NO: 189589 - DNA, 20 bp, Artificial Sequence
  chemically synthesized
agacaaacaataaacaaaca

SEQ ID NO: 189590 - DNA, 20 bp, Artificial Sequence
  chemically synthesized
caaacaaagatgtacataca

SEQ ID NO: 189591 - DNA, 20 bp, Artificial Sequence
  chemically synthesized
cacggaataaacacatattg

SEQ ID NO: 189592 - DNA, 20 bp, Artificial Sequence
  chemically synthesized
ataaacacatattgtggtaa

SEQ ID NO: 189593 - DNA, 20 bp, Artificial Sequence
  chemically synthesized
taaacacatattgtggtaat

SEQ ID NO: 189594 - DNA, 20 bp, Artificial Sequence
  chemically synthesized
aaacacatattgtggtaata

SEQ ID NO: 189595 - DNA, 20 bp, Artificial Sequence
  chemically synthesized
tattgtggtaatagggacaa

SEQ ID NO: 189596 - DNA, 20 bp, Artificial Sequence
  chemically synthesized
atagggacaaaagaaaatca

SEQ ID NO: 189597 - DNA, 20 bp, Artificial Sequence
  chemically synthesized
tagggacaaaagaaaatcac

SEQ ID NO: 189598 - DNA, 20 bp, Artificial Sequence
  chemically synthesized
aaaatcacgggatgctttca

SEQ ID NO: 189599 - DNA, 20 bp, Artificial Sequence
  chemically synthesized
aatcacgggatgctttcaca

SEQ ID NO: 189600 - DNA, 20 bp, Artificial Sequence
  chemically synthesized
ttctccattattctctgtga

SEQ ID NO: 189601 - DNA, 20 bp, Artificial Sequence
  chemically synthesized
gatgctttcacagagaataa

SEQ ID NO: 189602 - DNA, 20 bp, Artificial Sequence
  chemically synthesized
tgctttcacagagaataatg

SEQ ID NO: 189603 - DNA, 20 bp, Artificial Sequence
  chemically synthesized
ataatggagaataatgataa

SEQ ID NO: 189604 - DNA, 20 bp, Artificial Sequence
  chemically synthesized
aatggagaataatgataacg

SEQ ID NO: 189605 - DNA, 20 bp, Artificial Sequence
  chemically synthesized
cctcaactattgagcattat

SEQ ID NO: 189606 - DNA, 20 bp, Artificial Sequence
  chemically synthesized
cggagactaataatgctcaa

SEQ ID NO: 189607 - DNA, 20 bp, Artificial Sequence
  chemically synthesized
actaataatgctcaatagtt

SEQ ID NO: 189608 - DNA, 20 bp, Artificial Sequence
  chemically synthesized
cttgcaaatcctcaactatt

SEQ ID NO: 189609 - DNA, 20 bp, Artificial Sequence
  chemically synthesized
ctaataatgctcaatagttg

SEQ ID NO: 189610 - DNA, 20 bp, Artificial Sequence
  chemically synthesized
ctcaatagttgaggatttgc

SEQ ID NO: 189611 - DNA, 20 bp, Artificial Sequence
  chemically synthesized
gttgaggatttgcaagatta

SEQ ID NO: 189612 - DNA, 20 bp, Artificial Sequence
  chemically synthesized
gcaagattatggtgtaactt

SEQ ID NO: 189613 - DNA, 20 bp, Artificial Sequence
  chemically synthesized
ttatggtgtaactttagata

SEQ ID NO: 189614 - DNA, 20 bp, Artificial Sequence
  chemically synthesized
tttccaggtcactttatcta

SEQ ID NO: 189615 - DNA, 20 bp, Artificial Sequence
  chemically synthesized
taactttagataaagtgacc

SEQ ID NO: 189616 - DNA, 20 bp, Artificial Sequence
  chemically synthesized
tttagataaagtgacctgga

SEQ ID NO: 189617 - DNA, 20 bp, Artificial Sequence
  chemically synthesized
ttagataaagtgacctggaa

SEQ ID NO: 189618 - DNA, 20 bp, Artificial Sequence
  chemically synthesized
ttcatctccaaagcctttcc

SEQ ID NO: 189619 - DNA, 20 bp, Artificial Sequence
  chemically synthesized
cttcatctccaaagcctttc

SEQ ID NO: 189620 - DNA, 20 bp, Artificial Sequence
  chemically synthesized
aaagtgacctggaaaggctt

SEQ ID NO: 189621 - DNA, 20 bp, Artificial Sequence
  chemically synthesized
agtgacctggaaaggctttg

SEQ ID NO: 189622 - DNA, 20 bp, Artificial Sequence
  chemically synthesized
tttcagtaacttcatctcca

SEQ ID NO: 189623 - DNA, 20 bp, Artificial Sequence
  chemically synthesized
ctggaaaggctttggagatg

SEQ ID NO: 189624 - DNA, 20 bp, Artificial Sequence
  chemically synthesized
tggagatgaagttactgaaa

SEQ ID NO: 189625 - DNA, 20 bp, Artificial Sequence
  chemically synthesized
ggagatgaagttactgaaac

SEQ ID NO: 189626 - DNA, 20 bp, Artificial Sequence
  chemically synthesized
agatgaagttactgaaacgg

SEQ ID NO: 189627 - DNA, 20 bp, Artificial Sequence
  chemically synthesized
tctttgtgcatctcccgttt

SEQ ID NO: 189628 - DNA, 20 bp, Artificial Sequence
  chemically synthesized
actgaaacgggagatgcaca

SEQ ID NO: 189629 - DNA, 20 bp, Artificial Sequence
  chemically synthesized
gaaacgggagatgcacaaag

SEQ ID NO: 189630 - DNA, 20 bp, Artificial Sequence
  chemically synthesized
gggagatgcacaaagaagaa

SEQ ID NO: 189631 - DNA, 20 bp, Artificial Sequence
  chemically synthesized
aacagaattaactacttatc

SEQ ID NO: 189632 - DNA, 20 bp, Artificial Sequence
  chemically synthesized
gttttctccatctggataag

SEQ ID NO: 189633 - DNA, 20 bp, Artificial Sequence
  chemically synthesized
gaattaactacttatccaga

SEQ ID NO: 189634 - DNA, 20 bp, Artificial Sequence
  chemically synthesized
gctgttttctccatctggat

SEQ ID NO: 189635 - DNA, 20 bp, Artificial Sequence
  chemically synthesized
attaactacttatccagatg

SEQ ID NO: 189636 - DNA, 20 bp, Artificial Sequence
  chemically synthesized
tacatgctgttttctccatc

SEQ ID NO: 189637 - DNA, 20 bp, Artificial Sequence
  chemically synthesized
acttatccagatggagaaaa

SEQ ID NO: 189638 - DNA, 20 bp, Artificial Sequence
  chemically synthesized
acagcatgtatgacgctccc

SEQ ID NO: 189639 - DNA, 20 bp, Artificial Sequence
  chemically synthesized
catgtatgacgctcccgagt

SEQ ID NO: 189640 - DNA, 20 bp, Artificial Sequence
  chemically synthesized
atgtatgacgctcccgagtc

SEQ ID NO: 189641 - DNA, 20 bp, Artificial Sequence
  chemically synthesized
aaagttccttcctgactcgg

SEQ ID NO: 189642 - DNA, 20 bp, Artificial Sequence
  chemically synthesized
ataaagttccttcctgactc

SEQ ID NO: 189643 - DNA, 20 bp, Artificial Sequence
  chemically synthesized
tatgacgctcccgagtcagg

SEQ ID NO: 189644 - DNA, 20 bp, Artificial Sequence
  chemically synthesized
tataaagttccttcctgact

SEQ ID NO: 189645 - DNA, 20 bp, Artificial Sequence
  chemically synthesized
atgacgctcccgagtcagga

SEQ ID NO: 189646 - DNA, 20 bp, Artificial Sequence
  chemically synthesized
tctttatatccaggcatata

SEQ ID NO: 189647 - DNA, 20 bp, Artificial Sequence
  chemically synthesized
aggaaggaactttatatgcc

SEQ ID NO: 189648 - DNA, 20 bp, Artificial Sequence
  chemically synthesized
actttatatgcctggatata

SEQ ID NO: 189649 - DNA, 20 bp, Artificial Sequence
  chemically synthesized
ctttcagcttctttatatcc

SEQ ID NO: 189650 - DNA, 20 bp, Artificial Sequence
  chemically synthesized
tctttcagcttctttatatc

SEQ ID NO: 189651 - DNA, 20 bp, Artificial Sequence
  chemically synthesized
ttatatgcctggatataaag

SEQ ID NO: 189652 - DNA, 20 bp, Artificial Sequence
  chemically synthesized
cctggatataaagaagctga

SEQ ID NO: 189653 - DNA, 20 bp, Artificial Sequence
  chemically synthesized
caaccattctcgttttcttt

SEQ ID NO: 189654 - DNA, 20 bp, Artificial Sequence
  chemically synthesized
taaagaagctgaaagaaaac

SEQ ID NO: 189655 - DNA, 20 bp, Artificial Sequence
  chemically synthesized
aagctgaaagaaaacgagaa

SEQ ID NO: 189656 - DNA, 20 bp, Artificial Sequence
  chemically synthesized
tgaaagaaaacgagaatggt

SEQ ID NO: 189657 - DNA, 20 bp, Artificial Sequence
  chemically synthesized
aaagaaaacgagaatggttg

SEQ ID NO: 189658 - DNA, 20 bp, Artificial Sequence
  chemically synthesized
cacactccccttcattcaag

SEQ ID NO: 189659 - DNA, 20 bp, Artificial Sequence
  chemically synthesized
tggttggagccccttgaatg

SEQ ID NO: 189660 - DNA, 20 bp, Artificial Sequence
  chemically synthesized
ccacactccccttcattcaa

SEQ ID NO: 189661 - DNA, 20 bp, Artificial Sequence
  chemically synthesized
ggttggagccccttgaatga

SEQ ID NO: 189662 - DNA, 20 bp, Artificial Sequence
  chemically synthesized
tccacactccccttcattca

SEQ ID NO: 189663 - DNA, 20 bp, Artificial Sequence
  chemically synthesized
gttggagccccttgaatgaa

SEQ ID NO: 189664 - DNA, 20 bp, Artificial Sequence
  chemically synthesized
ttccacactccccttcattc

SEQ ID NO: 189665 - DNA, 20 bp, Artificial Sequence
  chemically synthesized
ttggagccccttgaatgaag

SEQ ID NO: 189666 - DNA, 20 bp, Artificial Sequence
  chemically synthesized
ggagccccttgaatgaaggg

SEQ ID NO: 189667 - DNA, 20 bp, Artificial Sequence
  chemically synthesized
cccttgaatgaaggggagtg

SEQ ID NO: 189668 - DNA, 20 bp, Artificial Sequence
  chemically synthesized
atgaaatcaacttcaacata

SEQ ID NO: 189669 - DNA, 20 bp, Artificial Sequence
  chemically synthesized
gtacatgaatctgtatgttg

SEQ ID NO: 189670 - DNA, 20 bp, Artificial Sequence
  chemically synthesized
caacatacagattcatgtac

SEQ ID NO: 189671 - DNA, 20 bp, Artificial Sequence
  chemically synthesized
aacatacagattcatgtaca

SEQ ID NO: 189672 - DNA, 20 bp, Artificial Sequence
  chemically synthesized
atgtacaaggatgttcactg

SEQ ID NO: 189673 - DNA, 20 bp, Artificial Sequence
  chemically synthesized
cttccacattttggtcactg

SEQ ID NO: 189674 - DNA, 20 bp, Artificial Sequence
  chemically synthesized
tcactgcagtgaccaaaatg

SEQ ID NO: 189675 - DNA, 20 bp, Artificial Sequence
  chemically synthesized
ttgggactgcttccacattt

SEQ ID NO: 189676 - DNA, 20 bp, Artificial Sequence
  chemically synthesized
ctgcagtgaccaaaatgtgg

SEQ ID NO: 189677 - DNA, 20 bp, Artificial Sequence
  chemically synthesized
cagtgaccaaaatgtggaag

SEQ ID NO: 189678 - DNA, 20 bp, Artificial Sequence
  chemically synthesized
ttctcccattattgggcatt

SEQ ID NO: 189679 - DNA, 20 bp, Artificial Sequence
  chemically synthesized
attctcccattattgggcat

SEQ ID NO: 189680 - DNA, 20 bp, Artificial Sequence
  chemically synthesized
gcagtcccaatgcccaataa

SEQ ID NO: 189681 - DNA, 20 bp, Artificial Sequence
  chemically synthesized
cagtcccaatgcccaataat

SEQ ID NO: 189682 - DNA, 20 bp, Artificial Sequence
  chemically synthesized
ttaattattctcccattatt

SEQ ID NO: 189683 - DNA, 20 bp, Artificial Sequence
  chemically synthesized
gtcccaatgcccaataatgg

SEQ ID NO: 189684 - DNA, 20 bp, Artificial Sequence
  chemically synthesized
attaattattctcccattat

SEQ ID NO: 189685 - DNA, 20 bp, Artificial Sequence
  chemically synthesized
taattatttacaatcacatc

SEQ ID NO: 189686 - DNA, 20 bp, Artificial Sequence
  chemically synthesized
aattatttacaatcacatct

SEQ ID NO: 189687 - DNA, 20 bp, Artificial Sequence
  chemically synthesized
ttatttacaatcacatctgg

SEQ ID NO: 189688 - DNA, 20 bp, Artificial Sequence
  chemically synthesized
aatacaatatagtaaactcc

SEQ ID NO: 189689 - DNA, 20 bp, Artificial Sequence
  chemically synthesized
ttttaaaatgcaatacaata

SEQ ID NO: 189690 - DNA, 20 bp, Artificial Sequence
  chemically synthesized
ttttattgatgtttaataat

SEQ ID NO: 189691 - DNA, 20 bp, Artificial Sequence
  chemically synthesized
atcaataaaatattaaataa

SEQ ID NO: 189692 - DNA, 20 bp, Artificial Sequence
  chemically synthesized
agttctgtcccattagcaag

SEQ ID NO: 189693 - DNA, 20 bp, Artificial Sequence
  chemically synthesized
tgtacaatactacttgctaa

SEQ ID NO: 189694 - DNA, 20 bp, Artificial Sequence
  chemically synthesized
gtacaatactacttgctaat

SEQ ID NO: 189695 - DNA, 20 bp, Artificial Sequence
  chemically synthesized
ttgagttctgtcccattagc

SEQ ID NO: 189696 - DNA, 20 bp, Artificial Sequence
  chemically synthesized
aatactacttgctaatggga

SEQ ID NO: 189697 - DNA, 20 bp, Artificial Sequence
  chemically synthesized
tttcttgagttctgtcccat

SEQ ID NO: 189698 - DNA, 20 bp, Artificial Sequence
  chemically synthesized
ttgctaatgggacagaactc

SEQ ID NO: 189699 - DNA, 20 bp, Artificial Sequence
  chemically synthesized
acaccttttgatgttttctt

SEQ ID NO: 189700 - DNA, 20 bp, Artificial Sequence
  chemically synthesized
agaactcaagaaaacatcaa

SEQ ID NO: 189701 - DNA, 20 bp, Artificial Sequence
  chemically synthesized
gaactcaagaaaacatcaaa

SEQ ID NO: 189702 - DNA, 20 bp, Artificial Sequence
  chemically synthesized
caaaaggtgtaaaacccatt

SEQ ID NO: 189703 - DNA, 20 bp, Artificial Sequence
  chemically synthesized
aaggtgtaaaacccattaag

SEQ ID NO: 189704 - DNA, 20 bp, Artificial Sequence
  chemically synthesized
aggtgtaaaacccattaaga

SEQ ID NO: 189705 - DNA, 20 bp, Artificial Sequence
  chemically synthesized
ccataggttgccttcttaat

SEQ ID NO: 189706 - DNA, 20 bp, Artificial Sequence
  chemically synthesized
cccataggttgccttcttaa

SEQ ID NO: 189707 - DNA, 20 bp, Artificial Sequence
  chemically synthesized
cccattaagaaggcaaccta

SEQ ID NO: 189708 - DNA, 20 bp, Artificial Sequence
  chemically synthesized
ccattaagaaggcaacctat

SEQ ID NO: 189709 - DNA, 20 bp, Artificial Sequence
  chemically synthesized
attaagaaggcaacctatgg

SEQ ID NO: 189710 - DNA, 20 bp, Artificial Sequence
  chemically synthesized
acctatagtctttctcccat

SEQ ID NO: 189711 - DNA, 20 bp, Artificial Sequence
  chemically synthesized
agaaggcaacctatgggaga

SEQ ID NO: 189712 - DNA, 20 bp, Artificial Sequence
  chemically synthesized
cacctatagtctttctccca

SEQ ID NO: 189713 - DNA, 20 bp, Artificial Sequence
  chemically synthesized
aacctatgggagaaagacta

SEQ ID NO: 189714 - DNA, 20 bp, Artificial Sequence
  chemically synthesized
acctatgggagaaagactat

SEQ ID NO: 189715 - DNA, 20 bp, Artificial Sequence
  chemically synthesized
aacaaacaaaaaagcaccta

SEQ ID NO: 189716 - DNA, 20 bp, Artificial Sequence
  chemically synthesized
aacaaaacaaacaaacaaaa

SEQ ID NO: 189717 - DNA, 20 bp, Artificial Sequence
  chemically synthesized
gtttgttttgttttttttct

SEQ ID NO: 189718 - DNA, 20 bp, Artificial Sequence
  chemically synthesized
gttttgttttttttctgaga

SEQ ID NO: 189719 - DNA, 20 bp, Artificial Sequence
  chemically synthesized
tttgttttttttctgagaca

SEQ ID NO: 189720 - DNA, 20 bp, Artificial Sequence
  chemically synthesized
gacagagcgagactctgtct

SEQ ID NO: 189721 - DNA, 20 bp, Artificial Sequence
  chemically synthesized
ttccagcctggtgacagagc

SEQ ID NO: 189722 - DNA, 20 bp, Artificial Sequence
  chemically synthesized
acagagtctcgctctgtcac

SEQ ID NO: 189723 - DNA, 20 bp, Artificial Sequence
  chemically synthesized
cagagtctcgctctgtcacc

SEQ ID NO: 189724 - DNA, 20 bp, Artificial Sequence
  chemically synthesized
tgtattccagcctggtgaca

SEQ ID NO: 189725 - DNA, 20 bp, Artificial Sequence
  chemically synthesized
actgtattccagcctggtga

SEQ ID NO: 189726 - DNA, 20 bp, Artificial Sequence
  chemically synthesized
gtctcgctctgtcaccaggc

SEQ ID NO: 189727 - DNA, 20 bp, Artificial Sequence
  chemically synthesized
cacaccactgtattccagcc

SEQ ID NO: 189728 - DNA, 20 bp, Artificial Sequence
  chemically synthesized
tctgtcaccaggctggaata

SEQ ID NO: 189729 - DNA, 20 bp, Artificial Sequence
  chemically synthesized
gggatcacaccactgtattc

SEQ ID NO: 189730 - DNA, 20 bp, Artificial Sequence
  chemically synthesized
gtcaccaggctggaatacag

SEQ ID NO: 189731 - DNA, 20 bp, Artificial Sequence
  chemically synthesized
ggaatacagtggtgtgatcc

SEQ ID NO: 189732 - DNA, 20 bp, Artificial Sequence
  chemically synthesized
ggcagaggttgcagtgagcc

SEQ ID NO: 189733 - DNA, 20 bp, Artificial Sequence
  chemically synthesized
aggcagaggttgcagtgagc

SEQ ID NO: 189734 - DNA, 20 bp, Artificial Sequence
  chemically synthesized
cgggaggcagaggttgcagt

SEQ ID NO: 189735 - DNA, 20 bp, Artificial Sequence
  chemically synthesized
aacccgggaggcagaggttg

SEQ ID NO: 189736 - DNA, 20 bp, Artificial Sequence
  chemically synthesized
cgcttgaacccgggaggcag

SEQ ID NO: 189737 - DNA, 20 bp, Artificial Sequence
  chemically synthesized
tcactgcaacctctgcctcc

SEQ ID NO: 189738 - DNA, 20 bp, Artificial Sequence
  chemically synthesized
tcgcttgaacccgggaggca

SEQ ID NO: 189739 - DNA, 20 bp, Artificial Sequence
  chemically synthesized
cactgcaacctctgcctccc

SEQ ID NO: 189740 - DNA, 20 bp, Artificial Sequence
  chemically synthesized
aatcgcttgaacccgggagg

SEQ ID NO: 189741 - DNA, 20 bp, Artificial Sequence
  chemically synthesized
gagaatcgcttgaacccggg

SEQ ID NO: 189742 - DNA, 20 bp, Artificial Sequence
  chemically synthesized
ggagaatcgcttgaacccgg

SEQ ID NO: 189743 - DNA, 20 bp, Artificial Sequence
  chemically synthesized
aacctctgcctcccgggttc

SEQ ID NO: 189744 - DNA, 20 bp, Artificial Sequence
  chemically synthesized
caggagaatcgcttgaaccc

SEQ ID NO: 189745 - DNA, 20 bp, Artificial Sequence
  chemically synthesized
gcaggagaatcgcttgaacc

SEQ ID NO: 189746 - DNA, 20 bp, Artificial Sequence
  chemically synthesized
ttcaagcgattctcctgcct

SEQ ID NO: 189747 - DNA, 20 bp, Artificial Sequence
  chemically synthesized
tactcgggaggctgaggcag

SEQ ID NO: 189748 - DNA, 20 bp, Artificial Sequence
  chemically synthesized
gctactcgggaggctgaggc

SEQ ID NO: 189749 - DNA, 20 bp, Artificial Sequence
  chemically synthesized
agctactcgggaggctgagg

SEQ ID NO: 189750 - DNA, 20 bp, Artificial Sequence
  chemically synthesized
cccagctactcgggaggctg

SEQ ID NO: 189751 - DNA, 20 bp, Artificial Sequence
  chemically synthesized
tcccagctactcgggaggct

SEQ ID NO: 189752 - DNA, 20 bp, Artificial Sequence
  chemically synthesized
ttctcctgcctcagcctccc

SEQ ID NO: 189753 - DNA, 20 bp, Artificial Sequence
  chemically synthesized
tcctgcctcagcctcccgag

SEQ ID NO: 189754 - DNA, 20 bp, Artificial Sequence
  chemically synthesized
tgtagtcccagctactcggg

SEQ ID NO: 189755 - DNA, 20 bp, Artificial Sequence
  chemically synthesized
ctgtagtcccagctactcgg

SEQ ID NO: 189756 - DNA, 20 bp, Artificial Sequence
  chemically synthesized
gcctcagcctcccgagtagc

SEQ ID NO: 189757 - DNA, 20 bp, Artificial Sequence
  chemically synthesized
gcctgtagtcccagctactc

SEQ ID NO: 189758 - DNA, 20 bp, Artificial Sequence
  chemically synthesized
cctcagcctcccgagtagct

SEQ ID NO: 189759 - DNA, 20 bp, Artificial Sequence
  chemically synthesized
tgcctgtagtcccagctact

SEQ ID NO: 189760 - DNA, 20 bp, Artificial Sequence
  chemically synthesized
ctcccgagtagctgggacta

SEQ ID NO: 189761 - DNA, 20 bp, Artificial Sequence
  chemically synthesized
tcccgagtagctgggactac

SEQ ID NO: 189762 - DNA, 20 bp, Artificial Sequence
  chemically synthesized
gtggtgtgtgcctgtagtcc

SEQ ID NO: 189763 - DNA, 20 bp, Artificial Sequence
  chemically synthesized
agcatggtggtgtgtgcctg

SEQ ID NO: 189764 - DNA, 20 bp, Artificial Sequence
  chemically synthesized
caggcacacaccaccatgct

SEQ ID NO: 189765 - DNA, 20 bp, Artificial Sequence
  chemically synthesized
caaaaattagctgagcatgg

SEQ ID NO: 189766 - DNA, 20 bp, Artificial Sequence
  chemically synthesized
atacaaaaattagctgagca

SEQ ID NO: 189767 - DNA, 20 bp, Artificial Sequence
  chemically synthesized
taaaaatacaaaaattagct

SEQ ID NO: 189768 - DNA, 20 bp, Artificial Sequence
  chemically synthesized
tctactaaaaatacaaaaat

SEQ ID NO: 189769 - DNA, 20 bp, Artificial Sequence
  chemically synthesized
tcagctaatttttgtatttt

SEQ ID NO: 189770 - DNA, 20 bp, Artificial Sequence
  chemically synthesized
gctaatttttgtatttttag

SEQ ID NO: 189771 - DNA, 20 bp, Artificial Sequence
  chemically synthesized
taatttttgtatttttagta

SEQ ID NO: 189772 - DNA, 20 bp, Artificial Sequence
  chemically synthesized
ttttgtatttttagtagaga

SEQ ID NO: 189773 - DNA, 20 bp, Artificial Sequence
  chemically synthesized
tttgtatttttagtagagac

SEQ ID NO: 189774 - DNA, 20 bp, Artificial Sequence
  chemically synthesized
agagacgggattcaccatgt

SEQ ID NO: 189775 - DNA, 20 bp, Artificial Sequence
  chemically synthesized
acgggattcaccatgttggc

SEQ ID NO: 189776 - DNA, 20 bp, Artificial Sequence
  chemically synthesized
cgacaccatcctggccaaca

SEQ ID NO: 189777 - DNA, 20 bp, Artificial Sequence
  chemically synthesized
cgggattcaccatgttggcc

SEQ ID NO: 189778 - DNA, 20 bp, Artificial Sequence
  chemically synthesized
attcaccatgttggccagga

SEQ ID NO: 189779 - DNA, 20 bp, Artificial Sequence
  chemically synthesized
tcaagagatcgacaccatcc

SEQ ID NO: 189780 - DNA, 20 bp, Artificial Sequence
  chemically synthesized
tgggtggatcacgaggtcaa

SEQ ID NO: 189781 - DNA, 20 bp, Artificial Sequence
  chemically synthesized
ggtgggtggatcacgaggtc

SEQ ID NO: 189782 - DNA, 20 bp, Artificial Sequence
  chemically synthesized
gccaaggtgggtggatcacg

SEQ ID NO: 189783 - DNA, 20 bp, Artificial Sequence
  chemically synthesized
ggccaaggtgggtggatcac

SEQ ID NO: 189784 - DNA, 20 bp, Artificial Sequence
  chemically synthesized
acctcgtgatccacccacct

SEQ ID NO: 189785 - DNA, 20 bp, Artificial Sequence
  chemically synthesized
cttcgggaggccaaggtggg

SEQ ID NO: 189786 - DNA, 20 bp, Artificial Sequence
  chemically synthesized
gcacttcgggaggccaaggt

SEQ ID NO: 189787 - DNA, 20 bp, Artificial Sequence
  chemically synthesized
agcacttcgggaggccaagg

SEQ ID NO: 189788 - DNA, 20 bp, Artificial Sequence
  chemically synthesized
cccagcacttcgggaggcca

SEQ ID NO: 189789 - DNA, 20 bp, Artificial Sequence
  chemically synthesized
tcccagcacttcgggaggcc

SEQ ID NO: 189790 - DNA, 20 bp, Artificial Sequence
  chemically synthesized
ccacccaccttggcctcccg

SEQ ID NO: 189791 - DNA, 20 bp, Artificial Sequence
  chemically synthesized
tgtaatcccagcacttcggg

SEQ ID NO: 189792 - DNA, 20 bp, Artificial Sequence
  chemically synthesized
ctgtaatcccagcacttcgg

SEQ ID NO: 189793 - DNA, 20 bp, Artificial Sequence
  chemically synthesized
accttggcctcccgaagtgc

SEQ ID NO: 189794 - DNA, 20 bp, Artificial Sequence
  chemically synthesized
gcctgtaatcccagcacttc

SEQ ID NO: 189795 - DNA, 20 bp, Artificial Sequence
  chemically synthesized
ccttggcctcccgaagtgct

SEQ ID NO: 189796 - DNA, 20 bp, Artificial Sequence
  chemically synthesized
cgcctgtaatcccagcactt

SEQ ID NO: 189797 - DNA, 20 bp, Artificial Sequence
  chemically synthesized
ctcccgaagtgctgggatta

SEQ ID NO: 189798 - DNA, 20 bp, Artificial Sequence
  chemically synthesized
tcccgaagtgctgggattac

SEQ ID NO: 189799 - DNA, 20 bp, Artificial Sequence
  chemically synthesized
gtggctcacgcctgtaatcc

SEQ ID NO: 189800 - DNA, 20 bp, Artificial Sequence
  chemically synthesized
agtgctgggattacaggcgt

SEQ ID NO: 189801 - DNA, 20 bp, Artificial Sequence
  chemically synthesized
caggcgtgagccactgtgcc

SEQ ID NO: 189802 - DNA, 20 bp, Artificial Sequence
  chemically synthesized
attaagacagctgggcacag

SEQ ID NO: 189803 - DNA, 20 bp, Artificial Sequence
  chemically synthesized
taaattaagacagctgggca

SEQ ID NO: 189804 - DNA, 20 bp, Artificial Sequence
  chemically synthesized
agtattaaattaagacagct

SEQ ID NO: 189805 - DNA, 20 bp, Artificial Sequence
  chemically synthesized
aagtattaaattaagacagc

SEQ ID NO: 189806 - DNA, 20 bp, Artificial Sequence
  chemically synthesized
acaaaagtattaaattaaga

SEQ ID NO: 189807 - DNA, 20 bp, Artificial Sequence
  chemically synthesized
atacacaaaagtattaaatt

SEQ ID NO: 189808 - DNA, 20 bp, Artificial Sequence
  chemically synthesized
aaaagtttgaaaatacacaa

SEQ ID NO: 189809 - DNA, 20 bp, Artificial Sequence
  chemically synthesized
ttttaaagctcagtgtagaa

SEQ ID NO: 189810 - DNA, 20 bp, Artificial Sequence
  chemically synthesized
ttttcaaacttttctacact

SEQ ID NO: 189811 - DNA, 20 bp, Artificial Sequence
  chemically synthesized
atactttttaaagctcagtg

SEQ ID NO: 189812 - DNA, 20 bp, Artificial Sequence
  chemically synthesized
tgcttatactttttaaagct

SEQ ID NO: 189813 - DNA, 20 bp, Artificial Sequence
  chemically synthesized
tttctacactgagctttaaa

SEQ ID NO: 189814 - DNA, 20 bp, Artificial Sequence
  chemically synthesized
atttttgcttatacttttta

SEQ ID NO: 189815 - DNA, 20 bp, Artificial Sequence
  chemically synthesized
cactgagctttaaaaagtat

SEQ ID NO: 189816 - DNA, 20 bp, Artificial Sequence
  chemically synthesized
ataagcaaaaatgaaaaaca

SEQ ID NO: 189817 - DNA, 20 bp, Artificial Sequence
  chemically synthesized
tcaggacaaaggcaatatgg

SEQ ID NO: 189818 - DNA, 20 bp, Artificial Sequence
  chemically synthesized
atttcaggacaaaggcaata

SEQ ID NO: 189819 - DNA, 20 bp, Artificial Sequence
  chemically synthesized
tttttaatatttcaggacaa

SEQ ID NO: 189820 - DNA, 20 bp, Artificial Sequence
  chemically synthesized
ttttttaatatttcaggaca

SEQ ID NO: 189821 - DNA, 20 bp, Artificial Sequence
  chemically synthesized
agttcgttttttaatatttc

SEQ ID NO: 189822 - DNA, 20 bp, Artificial Sequence
  chemically synthesized
tagttcgttttttaatattt

SEQ ID NO: 189823 - DNA, 20 bp, Artificial Sequence
  chemically synthesized
tattaaaaaacgaactaaaa

SEQ ID NO: 189824 - DNA, 20 bp, Artificial Sequence
  chemically synthesized
attaaaaaacgaactaaaat

SEQ ID NO: 189825 - DNA, 20 bp, Artificial Sequence
  chemically synthesized
tttttgttctgtgcccattt

SEQ ID NO: 189826 - DNA, 20 bp, Artificial Sequence
  chemically synthesized
aaaacgaactaaaatgggca

SEQ ID NO: 189827 - DNA, 20 bp, Artificial Sequence
  chemically synthesized
acatgcatataggaatatta

SEQ ID NO: 189828 - DNA, 20 bp, Artificial Sequence
  chemically synthesized
ctcaatgtgaacatgcatat

SEQ ID NO: 189829 - DNA, 20 bp, Artificial Sequence
  chemically synthesized
tctcaatgtgaacatgcata

SEQ ID NO: 189830 - DNA, 20 bp, Artificial Sequence
  chemically synthesized
cctatatgcatgttcacatt

SEQ ID NO: 189831 - DNA, 20 bp, Artificial Sequence
  chemically synthesized
catgttcacattgagaaaaa

SEQ ID NO: 189832 - DNA, 20 bp, Artificial Sequence
  chemically synthesized
ttcacattgagaaaaatagt

SEQ ID NO: 189833 - DNA, 20 bp, Artificial Sequence
  chemically synthesized
gagacaaaatgtctgaatcc

SEQ ID NO: 189834 - DNA, 20 bp, Artificial Sequence
  chemically synthesized
ctatcatagttaccaggatt

SEQ ID NO: 189835 - DNA, 20 bp, Artificial Sequence
  chemically synthesized
ccatttctatcatagttacc

SEQ ID NO: 189836 - DNA, 20 bp, Artificial Sequence
  chemically synthesized
tccatttctatcatagttac

SEQ ID NO: 189837 - DNA, 20 bp, Artificial Sequence
  chemically synthesized
ctgaatcctggtaactatga

SEQ ID NO: 189838 - DNA, 20 bp, Artificial Sequence
  chemically synthesized
ggcacactccatttctatca

SEQ ID NO: 189839 - DNA, 20 bp, Artificial Sequence
  chemically synthesized
cctggtaactatgatagaaa

SEQ ID NO: 189840 - DNA, 20 bp, Artificial Sequence
  chemically synthesized
tggtaactatgatagaaatg

SEQ ID NO: 189841 - DNA, 20 bp, Artificial Sequence
  chemically synthesized
cccttcacacacgtgcatat

SEQ ID NO: 189842 - DNA, 20 bp, Artificial Sequence
  chemically synthesized
tcccttcacacacgtgcata

SEQ ID NO: 189843 - DNA, 20 bp, Artificial Sequence
  chemically synthesized
tgcctatatgcacgtgtgtg

SEQ ID NO: 189844 - DNA, 20 bp, Artificial Sequence
  chemically synthesized
gcctatatgcacgtgtgtga

SEQ ID NO: 189845 - DNA, 20 bp, Artificial Sequence
  chemically synthesized
cctatatgcacgtgtgtgaa

SEQ ID NO: 189846 - DNA, 20 bp, Artificial Sequence
  chemically synthesized
tatgcacgtgtgtgaaggga

SEQ ID NO: 189847 - DNA, 20 bp, Artificial Sequence
  chemically synthesized
atgcacgtgtgtgaagggaa

SEQ ID NO: 189848 - DNA, 20 bp, Artificial Sequence
  chemically synthesized
ataaatatagataatcgaga

SEQ ID NO: 189849 - DNA, 20 bp, Artificial Sequence
  chemically synthesized
agataaatatagataatcga

SEQ ID NO: 189850 - DNA, 20 bp, Artificial Sequence
  chemically synthesized
atagataaatatagataatc

SEQ ID NO: 189851 - DNA, 20 bp, Artificial Sequence
  chemically synthesized
aaatgataaatagataaata

SEQ ID NO: 189852 - DNA, 20 bp, Artificial Sequence
  chemically synthesized
gatgacagataaatgataaa

SEQ ID NO: 189853 - DNA, 20 bp, Artificial Sequence
  chemically synthesized
gatagataactaatagatga

SEQ ID NO: 189854 - DNA, 20 bp, Artificial Sequence
  chemically synthesized
atcatttatctgtcatctat

SEQ ID NO: 189855 - DNA, 20 bp, Artificial Sequence
  chemically synthesized
gataactgatagataactaa

SEQ ID NO: 189856 - DNA, 20 bp, Artificial Sequence
  chemically synthesized
gtcatctattagttatctat

SEQ ID NO: 189857 - DNA, 20 bp, Artificial Sequence
  chemically synthesized
gatgatagatagataactga

SEQ ID NO: 189858 - DNA, 20 bp, Artificial Sequence
  chemically synthesized
gtaaacagatagatgataga

SEQ ID NO: 189859 - DNA, 20 bp, Artificial Sequence
  chemically synthesized
gatggtaaacagatagatga

SEQ ID NO: 189860 - DNA, 20 bp, Artificial Sequence
  chemically synthesized
acagctagatggtaaacaga

SEQ ID NO: 189861 - DNA, 20 bp, Artificial Sequence
  chemically synthesized
acctacagctagatggtaaa

SEQ ID NO: 189862 - DNA, 20 bp, Artificial Sequence
  chemically synthesized
tcatctatctgtttaccatc

SEQ ID NO: 189863 - DNA, 20 bp, Artificial Sequence
  chemically synthesized
atttatgacctacagctaga

SEQ ID NO: 189864 - DNA, 20 bp, Artificial Sequence
  chemically synthesized
atctgtttaccatctagctg

SEQ ID NO: 189865 - DNA, 20 bp, Artificial Sequence
  chemically synthesized
tctgtttaccatctagctgt

SEQ ID NO: 189866 - DNA, 20 bp, Artificial Sequence
  chemically synthesized
ttctatttatgacctacagc

SEQ ID NO: 189867 - DNA, 20 bp, Artificial Sequence
  chemically synthesized
tgtcttctatttatgaccta

SEQ ID NO: 189868 - DNA, 20 bp, Artificial Sequence
  chemically synthesized
atctagctgtaggtcataaa

SEQ ID NO: 189869 - DNA, 20 bp, Artificial Sequence
  chemically synthesized
tagctgtaggtcataaatag

SEQ ID NO: 189870 - DNA, 20 bp, Artificial Sequence
  chemically synthesized
gatttttgagaataggtcaa

SEQ ID NO: 189871 - DNA, 20 bp, Artificial Sequence
  chemically synthesized
cagtagtgatttttgagaat

SEQ ID NO: 189872 - DNA, 20 bp, Artificial Sequence
  chemically synthesized
tcagtagtgatttttgagaa

SEQ ID NO: 189873 - DNA, 20 bp, Artificial Sequence
  chemically synthesized
acaattcagtagtgattttt

SEQ ID NO: 189874 - DNA, 20 bp, Artificial Sequence
  chemically synthesized
gagttttgtaaacaattcag

SEQ ID NO: 189875 - DNA, 20 bp, Artificial Sequence
  chemically synthesized
gctgagttttgtaaacaatt

SEQ ID NO: 189876 - DNA, 20 bp, Artificial Sequence
  chemically synthesized
actgaattgtttacaaaact

SEQ ID NO: 189877 - DNA, 20 bp, Artificial Sequence
  chemically synthesized
attatttggcaaagcatgct

SEQ ID NO: 189878 - DNA, 20 bp, Artificial Sequence
  chemically synthesized
aaggtcttaattatttggca

SEQ ID NO: 189879 - DNA, 20 bp, Artificial Sequence
  chemically synthesized
gcatgctttgccaaataatt

SEQ ID NO: 189880 - DNA, 20 bp, Artificial Sequence
  chemically synthesized
aaataaaggtcttaattatt

SEQ ID NO: 189881 - DNA, 20 bp, Artificial Sequence
  chemically synthesized
agactcatgaatacaaataa

SEQ ID NO: 189882 - DNA, 20 bp, Artificial Sequence
  chemically synthesized
aagactcatgaatacaaata

SEQ ID NO: 189883 - DNA, 20 bp, Artificial Sequence
  chemically synthesized
agacctttatttgtattcat

SEQ ID NO: 189884 - DNA, 20 bp, Artificial Sequence
  chemically synthesized
gtcttaattgtttggcaatt

SEQ ID NO: 189885 - DNA, 20 bp, Artificial Sequence
  chemically synthesized
gtcttaattgccaaacaatt

SEQ ID NO: 189886 - DNA, 20 bp, Artificial Sequence
  chemically synthesized
aagtaaaggtcttaattgtt

SEQ ID NO: 189887 - DNA, 20 bp, Artificial Sequence
  chemically synthesized
ttcttgatttgatcaagtaa

SEQ ID NO: 189888 - DNA, 20 bp, Artificial Sequence
  chemically synthesized
tttcttgatttgatcaagta

SEQ ID NO: 189889 - DNA, 20 bp, Artificial Sequence
  chemically synthesized
ctaattttcttgatttgatc

SEQ ID NO: 189890 - DNA, 20 bp, Artificial Sequence
  chemically synthesized
gacctttacttgatcaaatc

SEQ ID NO: 189891 - DNA, 20 bp, Artificial Sequence
  chemically synthesized
cttgatcaaatcaagaaaat

SEQ ID NO: 189892 - DNA, 20 bp, Artificial Sequence
  chemically synthesized
aaataaatggtaaatgtttg

SEQ ID NO: 189893 - DNA, 20 bp, Artificial Sequence
  chemically synthesized
caaataaatggtaaatgttt

SEQ ID NO: 189894 - DNA, 20 bp, Artificial Sequence
  chemically synthesized
tcaaacatttaccatttatt

SEQ ID NO: 189895 - DNA, 20 bp, Artificial Sequence
  chemically synthesized
caaacatttaccatttattt

SEQ ID NO: 189896 - DNA, 20 bp, Artificial Sequence
  chemically synthesized
aggtttctaccccaaataaa

SEQ ID NO: 189897 - DNA, 20 bp, Artificial Sequence
  chemically synthesized
aaacatttaccatttatttg

SEQ ID NO: 189898 - DNA, 20 bp, Artificial Sequence
  chemically synthesized
catttaccatttatttgggg

SEQ ID NO: 189899 - DNA, 20 bp, Artificial Sequence
  chemically synthesized
gctagaagagagggttttga

SEQ ID NO: 189900 - DNA, 20 bp, Artificial Sequence
  chemically synthesized
ggctagaagagagggttttg

SEQ ID NO: 189901 - DNA, 20 bp, Artificial Sequence
  chemically synthesized
accttcaaaaccctctcttc

SEQ ID NO: 189902 - DNA, 20 bp, Artificial Sequence
  chemically synthesized
ctcaaaacggctagaagaga

SEQ ID NO: 189903 - DNA, 20 bp, Artificial Sequence
  chemically synthesized
tctcaaaacggctagaagag

SEQ ID NO: 189904 - DNA, 20 bp, Artificial Sequence
  chemically synthesized
atctcaaaacggctagaaga

SEQ ID NO: 189905 - DNA, 20 bp, Artificial Sequence
  chemically synthesized
gtatctcaaaacggctagaa

SEQ ID NO: 189906 - DNA, 20 bp, Artificial Sequence
  chemically synthesized
gcgtatctcaaaacggctag

SEQ ID NO: 189907 - DNA, 20 bp, Artificial Sequence
  chemically synthesized
attgcgtatctcaaaacggc

SEQ ID NO: 189908 - DNA, 20 bp, Artificial Sequence
  chemically synthesized
ccctctcttctagccgtttt

SEQ ID NO: 189909 - DNA, 20 bp, Artificial Sequence
  chemically synthesized
aggtattgcgtatctcaaaa

SEQ ID NO: 189910 - DNA, 20 bp, Artificial Sequence
  chemically synthesized
ggagactattgtcaacagta

SEQ ID NO: 189911 - DNA, 20 bp, Artificial Sequence
  chemically synthesized
tggagactattgtcaacagt

SEQ ID NO: 189912 - DNA, 20 bp, Artificial Sequence
  chemically synthesized
caataccttactgttgacaa

SEQ ID NO: 189913 - DNA, 20 bp, Artificial Sequence
  chemically synthesized
agtatggagactattgtcaa

SEQ ID NO: 189914 - DNA, 20 bp, Artificial Sequence
  chemically synthesized
gtgtcctgttgcatagtatg

SEQ ID NO: 189915 - DNA, 20 bp, Artificial Sequence
  chemically synthesized
tggtgtcctgttgcatagta

SEQ ID NO: 189916 - DNA, 20 bp, Artificial Sequence
  chemically synthesized
atagtctccatactatgcaa

SEQ ID NO: 189917 - DNA, 20 bp, Artificial Sequence
  chemically synthesized
tagtctccatactatgcaac

SEQ ID NO: 189918 - DNA, 20 bp, Artificial Sequence
  chemically synthesized
agttctggtgtcctgttgca

SEQ ID NO: 189919 - DNA, 20 bp, Artificial Sequence
  chemically synthesized
catactatgcaacaggacac

SEQ ID NO: 189920 - DNA, 20 bp, Artificial Sequence
  chemically synthesized
tagaaaggaagaattagttc

SEQ ID NO: 189921 - DNA, 20 bp, Artificial Sequence
  chemically synthesized
cacgattagaaaggaagaat

SEQ ID NO: 189922 - DNA, 20 bp, Artificial Sequence
  chemically synthesized
caaagtcacgattagaaagg

SEQ ID NO: 189923 - DNA, 20 bp, Artificial Sequence
  chemically synthesized
gtacaaagtcacgattagaa

SEQ ID NO: 189924 - DNA, 20 bp, Artificial Sequence
  chemically synthesized
ggtacaaagtcacgattaga

SEQ ID NO: 189925 - DNA, 20 bp, Artificial Sequence
  chemically synthesized
aatgggtacaaagtcacgat

SEQ ID NO: 189926 - DNA, 20 bp, Artificial Sequence
  chemically synthesized
gaggattgtcaatgggtaca

SEQ ID NO: 189927 - DNA, 20 bp, Artificial Sequence
  chemically synthesized
atggggagaggattgtcaat

SEQ ID NO: 189928 - DNA, 20 bp, Artificial Sequence
  chemically synthesized
aatggggagaggattgtcaa

SEQ ID NO: 189929 - DNA, 20 bp, Artificial Sequence
  chemically synthesized
ggaaaagcgagaatggggag

SEQ ID NO: 189930 - DNA, 20 bp, Artificial Sequence
  chemically synthesized
gggaaaagcgagaatgggga

SEQ ID NO: 189931 - DNA, 20 bp, Artificial Sequence
  chemically synthesized
aggggaaaagcgagaatggg

SEQ ID NO: 189932 - DNA, 20 bp, Artificial Sequence
  chemically synthesized
gtaggggaaaagcgagaatg

SEQ ID NO: 189933 - DNA, 20 bp, Artificial Sequence
  chemically synthesized
agtaggggaaaagcgagaat

SEQ ID NO: 189934 - DNA, 20 bp, Artificial Sequence
  chemically synthesized
aagtaggggaaaagcgagaa

SEQ ID NO: 189935 - DNA, 20 bp, Artificial Sequence
  chemically synthesized
gggggaagtaggggaaaagc

SEQ ID NO: 189936 - DNA, 20 bp, Artificial Sequence
  chemically synthesized
gaatgggggaagtaggggaa

SEQ ID NO: 189937 - DNA, 20 bp, Artificial Sequence
  chemically synthesized
ccaaagaatgggggaagtag

SEQ ID NO: 189938 - DNA, 20 bp, Artificial Sequence
  chemically synthesized
accaaagaatgggggaagta

SEQ ID NO: 189939 - DNA, 20 bp, Artificial Sequence
  chemically synthesized
caccaaagaatgggggaagt

SEQ ID NO: 189940 - DNA, 20 bp, Artificial Sequence
  chemically synthesized
tcaccaaagaatgggggaag

SEQ ID NO: 189941 - DNA, 20 bp, Artificial Sequence
  chemically synthesized
tggtcaccaaagaatggggg

SEQ ID NO: 189942 - DNA, 20 bp, Artificial Sequence
  chemically synthesized
cggtggtcaccaaagaatgg

SEQ ID NO: 189943 - DNA, 20 bp, Artificial Sequence
  chemically synthesized
cccctacttcccccattctt

SEQ ID NO: 189944 - DNA, 20 bp, Artificial Sequence
  chemically synthesized
acggtggtcaccaaagaatg

SEQ ID NO: 189945 - DNA, 20 bp, Artificial Sequence
  chemically synthesized
gacggtggtcaccaaagaat

SEQ ID NO: 189946 - DNA, 20 bp, Artificial Sequence
  chemically synthesized
ggacggtggtcaccaaagaa

SEQ ID NO: 189947 - DNA, 20 bp, Artificial Sequence
  chemically synthesized
taaatggacggtggtcacca

SEQ ID NO: 189948 - DNA, 20 bp, Artificial Sequence
  chemically synthesized
tagaagcagtaaatggacgg

SEQ ID NO: 189949 - DNA, 20 bp, Artificial Sequence
  chemically synthesized
tcatagaagcagtaaatgga

SEQ ID NO: 189950 - DNA, 20 bp, Artificial Sequence
  chemically synthesized
gatctcatagaagcagtaaa

SEQ ID NO: 189951 - DNA, 20 bp, Artificial Sequence
  chemically synthesized
cgtccatttactgcttctat

SEQ ID NO: 189952 - DNA, 20 bp, Artificial Sequence
  chemically synthesized
aaacatcgatctcatagaag

SEQ ID NO: 189953 - DNA, 20 bp, Artificial Sequence
  chemically synthesized
taaaaacatcgatctcatag

SEQ ID NO: 189954 - DNA, 20 bp, Artificial Sequence
  chemically synthesized
atctaaaaacatcgatctca

SEQ ID NO: 189955 - DNA, 20 bp, Artificial Sequence
  chemically synthesized
ttctatgagatcgatgtttt

SEQ ID NO: 189956 - DNA, 20 bp, Artificial Sequence
  chemically synthesized
tttagattgtgcatatgaat

SEQ ID NO: 189957 - DNA, 20 bp, Artificial Sequence
  chemically synthesized
ttgtgcatatgaatgagaac

SEQ ID NO: 189958 - DNA, 20 bp, Artificial Sequence
  chemically synthesized
caaacacagaaagacaaatg

SEQ ID NO: 189959 - DNA, 20 bp, Artificial Sequence
  chemically synthesized
ttaactaagccaaacacaga

SEQ ID NO: 189960 - DNA, 20 bp, Artificial Sequence
  chemically synthesized
tgcatttgtctttctgtgtt

SEQ ID NO: 189961 - DNA, 20 bp, Artificial Sequence
  chemically synthesized
tgtattaactaagccaaaca

SEQ ID NO: 189962 - DNA, 20 bp, Artificial Sequence
  chemically synthesized
ttgtctttctgtgtttggct

SEQ ID NO: 189963 - DNA, 20 bp, Artificial Sequence
  chemically synthesized
tttcatatgttgtattaact

SEQ ID NO: 189964 - DNA, 20 bp, Artificial Sequence
  chemically synthesized
aaaatgttcaacatcactat

SEQ ID NO: 189965 - DNA, 20 bp, Artificial Sequence
  chemically synthesized
aaatgttcaacatcactatc

SEQ ID NO: 189966 - DNA, 20 bp, Artificial Sequence
  chemically synthesized
tttgatttgcattttcctga

SEQ ID NO: 189967 - DNA, 20 bp, Artificial Sequence
  chemically synthesized
atgcaaatcaaaaccacaat

SEQ ID NO: 189968 - DNA, 20 bp, Artificial Sequence
  chemically synthesized
aatgagatgatatctcattg

SEQ ID NO: 189969 - DNA, 20 bp, Artificial Sequence
  chemically synthesized
aatgagatatcatctcattc

SEQ ID NO: 189970 - DNA, 20 bp, Artificial Sequence
  chemically synthesized
atagccattctaactggaat

SEQ ID NO: 189971 - DNA, 20 bp, Artificial Sequence
  chemically synthesized
agatatcatctcattccagt

SEQ ID NO: 189972 - DNA, 20 bp, Artificial Sequence
  chemically synthesized
tcatctcattccagttagaa

SEQ ID NO: 189973 - DNA, 20 bp, Artificial Sequence
  chemically synthesized
ttgataatagccattctaac

SEQ ID NO: 189974 - DNA, 20 bp, Artificial Sequence
  chemically synthesized
tatcttttgtattttgataa

SEQ ID NO: 189975 - DNA, 20 bp, Artificial Sequence
  chemically synthesized
tggctattatcaaaatacaa

SEQ ID NO: 189976 - DNA, 20 bp, Artificial Sequence
  chemically synthesized
atcaaaatacaaaagataaa

SEQ ID NO: 189977 - DNA, 20 bp, Artificial Sequence
  chemically synthesized
atacaaaagataaaaagtgt

SEQ ID NO: 189978 - DNA, 20 bp, Artificial Sequence
  chemically synthesized
aaaagataaaaagtgttggc

SEQ ID NO: 189979 - DNA, 20 bp, Artificial Sequence
  chemically synthesized
aaaaagtgttggcaagaata

SEQ ID NO: 189980 - DNA, 20 bp, Artificial Sequence
  chemically synthesized
aaagtgttggcaagaatatg

SEQ ID NO: 189981 - DNA, 20 bp, Artificial Sequence
  chemically synthesized
gttggcaagaatatggagaa

SEQ ID NO: 189982 - DNA, 20 bp, Artificial Sequence
  chemically synthesized
ttggcaagaatatggagaaa

SEQ ID NO: 189983 - DNA, 20 bp, Artificial Sequence
  chemically synthesized
tggcaagaatatggagaaaa

SEQ ID NO: 189984 - DNA, 20 bp, Artificial Sequence
  chemically synthesized
ttcccaccaacagtgcataa

SEQ ID NO: 189985 - DNA, 20 bp, Artificial Sequence
  chemically synthesized
attcccaccaacagtgcata

SEQ ID NO: 189986 - DNA, 20 bp, Artificial Sequence
  chemically synthesized
cattcccaccaacagtgcat

SEQ ID NO: 189987 - DNA, 20 bp, Artificial Sequence
  chemically synthesized
agggaacccttatgcactgt

SEQ ID NO: 189988 - DNA, 20 bp, Artificial Sequence
  chemically synthesized
gaacccttatgcactgttgg

SEQ ID NO: 189989 - DNA, 20 bp, Artificial Sequence
  chemically synthesized
aacccttatgcactgttggt

SEQ ID NO: 189990 - DNA, 20 bp, Artificial Sequence
  chemically synthesized
ctcatttacattcccaccaa

SEQ ID NO: 189991 - DNA, 20 bp, Artificial Sequence
  chemically synthesized
ctgttggtgggaatgtaaat

SEQ ID NO: 189992 - DNA, 20 bp, Artificial Sequence
  chemically synthesized
gtaaatgagtacatccatta

SEQ ID NO: 189993 - DNA, 20 bp, Artificial Sequence
  chemically synthesized
aaatgagtacatccattatg

SEQ ID NO: 189994 - DNA, 20 bp, Artificial Sequence
  chemically synthesized
aatgagtacatccattatgg

SEQ ID NO: 189995 - DNA, 20 bp, Artificial Sequence
  chemically synthesized
ctccataccgtcctccataa

SEQ ID NO: 189996 - DNA, 20 bp, Artificial Sequence
  chemically synthesized
agtacatccattatggagga

SEQ ID NO: 189997 - DNA, 20 bp, Artificial Sequence
  chemically synthesized
atccattatggaggacggta

SEQ ID NO: 189998 - DNA, 20 bp, Artificial Sequence
  chemically synthesized
ccattatggaggacggtatg

SEQ ID NO: 189999 - DNA, 20 bp, Artificial Sequence
  chemically synthesized
cattatggaggacggtatgg

SEQ ID NO: 190000 - DNA, 20 bp, Artificial Sequence
  chemically synthesized
gttctatttttaagttttcg

SEQ ID NO: 190001 - DNA, 20 bp, Artificial Sequence
  chemically synthesized
agttctatttttaagttttc

SEQ ID NO: 190002 - DNA, 20 bp, Artificial Sequence
  chemically synthesized
gttcctcgaaaacttaaaaa

SEQ ID NO: 190003 - DNA, 20 bp, Artificial Sequence
  chemically synthesized
cgtatggtagttctattttt

SEQ ID NO: 190004 - DNA, 20 bp, Artificial Sequence
  chemically synthesized
ggaattgctgtatcgtatgg

SEQ ID NO: 190005 - DNA, 20 bp, Artificial Sequence
  chemically synthesized
aatagaactaccatacgata

SEQ ID NO: 190006 - DNA, 20 bp, Artificial Sequence
  chemically synthesized
agtggaattgctgtatcgta

SEQ ID NO: 190007 - DNA, 20 bp, Artificial Sequence
  chemically synthesized
cgatacagcaattccactac

SEQ ID NO: 190008 - DNA, 20 bp, Artificial Sequence
  chemically synthesized
gatacagcaattccactact

SEQ ID NO: 190009 - DNA, 20 bp, Artificial Sequence
  chemically synthesized
atacagcaattccactactg

SEQ ID NO: 190010 - DNA, 20 bp, Artificial Sequence
  chemically synthesized
tttgtctctgtccccagtag

SEQ ID NO: 190011 - DNA, 20 bp, Artificial Sequence
  chemically synthesized
agcaattccactactgggga

SEQ ID NO: 190012 - DNA, 20 bp, Artificial Sequence
  chemically synthesized
tgctttgtctctgtccccag

SEQ ID NO: 190013 - DNA, 20 bp, Artificial Sequence
  chemically synthesized
caattccactactggggaca

SEQ ID NO: 190014 - DNA, 20 bp, Artificial Sequence
  chemically synthesized
atttgctttgtctctgtccc

SEQ ID NO: 190015 - DNA, 20 bp, Artificial Sequence
  chemically synthesized
cactactggggacagagaca

SEQ ID NO: 190016 - DNA, 20 bp, Artificial Sequence
  chemically synthesized
agagacaaagcaaataaaat

SEQ ID NO: 190017 - DNA, 20 bp, Artificial Sequence
  chemically synthesized
caaataaaatcagtatgtca

SEQ ID NO: 190018 - DNA, 20 bp, Artificial Sequence
  chemically synthesized
aataaaatcagtatgtcata

SEQ ID NO: 190019 - DNA, 20 bp, Artificial Sequence
  chemically synthesized
ctgcaataaacatgggaatg

SEQ ID NO: 190020 - DNA, 20 bp, Artificial Sequence
  chemically synthesized
aataatgctgcaataaacat

SEQ ID NO: 190021 - DNA, 20 bp, Artificial Sequence
  chemically synthesized
gaataatgctgcaataaaca

SEQ ID NO: 190022 - DNA, 20 bp, Artificial Sequence
  chemically synthesized
ctgcattcccatgtttattg

SEQ ID NO: 190023 - DNA, 20 bp, Artificial Sequence
  chemically synthesized
tattgcagcattattcacaa

SEQ ID NO: 190024 - DNA, 20 bp, Artificial Sequence
  chemically synthesized
cagcattattcacaatagcc

SEQ ID NO: 190025 - DNA, 20 bp, Artificial Sequence
  chemically synthesized
tattcacaatagccaagata

SEQ ID NO: 190026 - DNA, 20 bp, Artificial Sequence
  chemically synthesized
cttaagttgattctatatct

SEQ ID NO: 190027 - DNA, 20 bp, Artificial Sequence
  chemically synthesized
ccaagatatagaatcaactt

SEQ ID NO: 190028 - DNA, 20 bp, Artificial Sequence
  chemically synthesized
tcatccattattaaacactt

SEQ ID NO: 190029 - DNA, 20 bp, Artificial Sequence
  chemically synthesized
tcaacttaagtgtttaataa

SEQ ID NO: 190030 - DNA, 20 bp, Artificial Sequence
  chemically synthesized
tgtttaataatggatgaata

SEQ ID NO: 190031 - DNA, 20 bp, Artificial Sequence
  chemically synthesized
aatattgcatatatatgcaa

SEQ ID NO: 190032 - DNA, 20 bp, Artificial Sequence
  chemically synthesized
atattgcatatatatgcaat

SEQ ID NO: 190033 - DNA, 20 bp, Artificial Sequence
  chemically synthesized
atatgcaatgggatattatt

SEQ ID NO: 190034 - DNA, 20 bp, Artificial Sequence
  chemically synthesized
gatattattgagtcatataa

SEQ ID NO: 190035 - DNA, 20 bp, Artificial Sequence
  chemically synthesized
tccatgttgtcataaatgac

SEQ ID NO: 190036 - DNA, 20 bp, Artificial Sequence
  chemically synthesized
atccatgttgtcataaatga

SEQ ID NO: 190037 - DNA, 20 bp, Artificial Sequence
  chemically synthesized
tcctgtcatttatgacaaca

SEQ ID NO: 190038 - DNA, 20 bp, Artificial Sequence
  chemically synthesized
atgacaacatggatgaacct

SEQ ID NO: 190039 - DNA, 20 bp, Artificial Sequence
  chemically synthesized
tgacaacatggatgaacctg

SEQ ID NO: 190040 - DNA, 20 bp, Artificial Sequence
  chemically synthesized
acacttaacatagtatcctc

SEQ ID NO: 190041 - DNA, 20 bp, Artificial Sequence
  chemically synthesized
gacacttaacatagtatcct

SEQ ID NO: 190042 - DNA, 20 bp, Artificial Sequence
  chemically synthesized
gaacctgaggatactatgtt

SEQ ID NO: 190043 - DNA, 20 bp, Artificial Sequence
  chemically synthesized
aaaacttcagacacttaaca

SEQ ID NO: 190044 - DNA, 20 bp, Artificial Sequence
  chemically synthesized
gatactatgttaagtgtctg

SEQ ID NO: 190045 - DNA, 20 bp, Artificial Sequence
  chemically synthesized
catttcaggagtcaaaactt

SEQ ID NO: 190046 - DNA, 20 bp, Artificial Sequence
  chemically synthesized
aggacattataacatttcag

SEQ ID NO: 190047 - DNA, 20 bp, Artificial Sequence
  chemically synthesized
cgaggacattataacatttc

SEQ ID NO: 190048 - DNA, 20 bp, Artificial Sequence
  chemically synthesized
ccgaggacattataacattt

SEQ ID NO: 190049 - DNA, 20 bp, Artificial Sequence
  chemically synthesized
ctgaaatgttataatgtcct

SEQ ID NO: 190050 - DNA, 20 bp, Artificial Sequence
  chemically synthesized
atgttataatgtcctcggtt

SEQ ID NO: 190051 - DNA, 20 bp, Artificial Sequence
  chemically synthesized
tgttataatgtcctcggttt

SEQ ID NO: 190052 - DNA, 20 bp, Artificial Sequence
  chemically synthesized
caagctaatatcctaaaccg

SEQ ID NO: 190053 - DNA, 20 bp, Artificial Sequence
  chemically synthesized
tcaagctaatatcctaaacc

SEQ ID NO: 190054 - DNA, 20 bp, Artificial Sequence
  chemically synthesized
atgtcctcggtttaggatat

SEQ ID NO: 190055 - DNA, 20 bp, Artificial Sequence
  chemically synthesized
tcggtttaggatattagctt

SEQ ID NO: 190056 - DNA, 20 bp, Artificial Sequence
  chemically synthesized
gtttaggatattagcttgag

SEQ ID NO: 190057 - DNA, 20 bp, Artificial Sequence
  chemically synthesized
accttgttgccattctactc

SEQ ID NO: 190058 - DNA, 20 bp, Artificial Sequence
  chemically synthesized
ggatattagcttgagtagaa

SEQ ID NO: 190059 - DNA, 20 bp, Artificial Sequence
  chemically synthesized
agcttgagtagaatggcaac

SEQ ID NO: 190060 - DNA, 20 bp, Artificial Sequence
  chemically synthesized
gcttgagtagaatggcaaca

SEQ ID NO: 190061 - DNA, 20 bp, Artificial Sequence
  chemically synthesized
ggtttgcacaaatatttaaa

SEQ ID NO: 190062 - DNA, 20 bp, Artificial Sequence
  chemically synthesized
atatttaaaaagtgactcac

SEQ ID NO: 190063 - DNA, 20 bp, Artificial Sequence
  chemically synthesized
taaatagcactttttcttgt

SEQ ID NO: 190064 - DNA, 20 bp, Artificial Sequence
  chemically synthesized
aaaaagtgactcacaagaaa

SEQ ID NO: 190065 - DNA, 20 bp, Artificial Sequence
  chemically synthesized
cacaagaaaaagtgctattt

SEQ ID NO: 190066 - DNA, 20 bp, Artificial Sequence
  chemically synthesized
agaaaaagtgctatttaagc

SEQ ID NO: 190067 - DNA, 20 bp, Artificial Sequence
  chemically synthesized
gccaccatgcccggcttaaa

SEQ ID NO: 190068 - DNA, 20 bp, Artificial Sequence
  chemically synthesized
gaaaaagtgctatttaagcc

SEQ ID NO: 190069 - DNA, 20 bp, Artificial Sequence
  chemically synthesized
agtgctatttaagccgggca

SEQ ID NO: 190070 - DNA, 20 bp, Artificial Sequence
  chemically synthesized
gctatttaagccgggcatgg

SEQ ID NO: 190071 - DNA, 20 bp, Artificial Sequence
  chemically synthesized
caggcatgagccaccatgcc

SEQ ID NO: 190072 - DNA, 20 bp, Artificial Sequence
  chemically synthesized
agtgctgggattacaggcat

SEQ ID NO: 190073 - DNA, 20 bp, Artificial Sequence
  chemically synthesized
gtggctcatgcctgtaatcc

SEQ ID NO: 190074 - DNA, 20 bp, Artificial Sequence
  chemically synthesized
tcccaaagtgctgggattac

SEQ ID NO: 190075 - DNA, 20 bp, Artificial Sequence
  chemically synthesized
ctcccaaagtgctgggatta

SEQ ID NO: 190076 - DNA, 20 bp, Artificial Sequence
  chemically synthesized
tgcctgtaatcccagcactt

SEQ ID NO: 190077 - DNA, 20 bp, Artificial Sequence
  chemically synthesized
ccttggcctcccaaagtgct

SEQ ID NO: 190078 - DNA, 20 bp, Artificial Sequence
  chemically synthesized
gcctgtaatcccagcacttt

SEQ ID NO: 190079 - DNA, 20 bp, Artificial Sequence
  chemically synthesized
accttggcctcccaaagtgc

SEQ ID NO: 190080 - DNA, 20 bp, Artificial Sequence
  chemically synthesized
ctgtaatcccagcactttgg

SEQ ID NO: 190081 - DNA, 20 bp, Artificial Sequence
  chemically synthesized
tgtaatcccagcactttggg

SEQ ID NO: 190082 - DNA, 20 bp, Artificial Sequence
  chemically synthesized
ccacccaccttggcctccca

SEQ ID NO: 190083 - DNA, 20 bp, Artificial Sequence
  chemically synthesized
tcccagcactttgggaggcc

SEQ ID NO: 190084 - DNA, 20 bp, Artificial Sequence
  chemically synthesized
cccagcactttgggaggcca

SEQ ID NO: 190085 - DNA, 20 bp, Artificial Sequence
  chemically synthesized
agcactttgggaggccaagg

SEQ ID NO: 190086 - DNA, 20 bp, Artificial Sequence
  chemically synthesized
gcactttgggaggccaaggt

SEQ ID NO: 190087 - DNA, 20 bp, Artificial Sequence
  chemically synthesized
ctttgggaggccaaggtggg

SEQ ID NO: 190088 - DNA, 20 bp, Artificial Sequence
  chemically synthesized
acctcatgatccacccacct

SEQ ID NO: 190089 - DNA, 20 bp, Artificial Sequence
  chemically synthesized
ggccaaggtgggtggatcat

SEQ ID NO: 190090 - DNA, 20 bp, Artificial Sequence
  chemically synthesized
gccaaggtgggtggatcatg

SEQ ID NO: 190091 - DNA, 20 bp, Artificial Sequence
  chemically synthesized
aggtgggtggatcatgaggt

SEQ ID NO: 190092 - DNA, 20 bp, Artificial Sequence
  chemically synthesized
ggtgggtggatcatgaggtc

SEQ ID NO: 190093 - DNA, 20 bp, Artificial Sequence
  chemically synthesized
tgggtggatcatgaggtcag

SEQ ID NO: 190094 - DNA, 20 bp, Artificial Sequence
  chemically synthesized
gatcatgaggtcaggagatc

SEQ ID NO: 190095 - DNA, 20 bp, Artificial Sequence
  chemically synthesized
tcaggagatcgagaacaacc

SEQ ID NO: 190096 - DNA, 20 bp, Artificial Sequence
  chemically synthesized
ggagtttcaccgtgttagcc

SEQ ID NO: 190097 - DNA, 20 bp, Artificial Sequence
  chemically synthesized
cgagaacaacctggctaaca

SEQ ID NO: 190098 - DNA, 20 bp, Artificial Sequence
  chemically synthesized
cggagtttcaccgtgttagc

SEQ ID NO: 190099 - DNA, 20 bp, Artificial Sequence
  chemically synthesized
gagacggagtttcaccgtgt

SEQ ID NO: 190100 - DNA, 20 bp, Artificial Sequence
  chemically synthesized
gtatttttttagtagagacg

SEQ ID NO: 190101 - DNA, 20 bp, Artificial Sequence
  chemically synthesized
ttgtatttttttagtagaga

SEQ ID NO: 190102 - DNA, 20 bp, Artificial Sequence
  chemically synthesized
ttttttgtatttttttagta

SEQ ID NO: 190103 - DNA, 20 bp, Artificial Sequence
  chemically synthesized
aattttttgtatttttttag

SEQ ID NO: 190104 - DNA, 20 bp, Artificial Sequence
  chemically synthesized
ggtaattttttgtatttttt

SEQ ID NO: 190105 - DNA, 20 bp, Artificial Sequence
  chemically synthesized
aaaaaatacaaaaaattacc

SEQ ID NO: 190106 - DNA, 20 bp, Artificial Sequence
  chemically synthesized
tacaaaaaattacccggacg

SEQ ID NO: 190107 - DNA, 20 bp, Artificial Sequence
  chemically synthesized
aggcggccgccaccacgtcc

SEQ ID NO: 190108 - DNA, 20 bp, Artificial Sequence
  chemically synthesized
aaaaaattacccggacgtgg

SEQ ID NO: 190109 - DNA, 20 bp, Artificial Sequence
  chemically synthesized
caggcggccgccaccacgtc

SEQ ID NO: 190110 - DNA, 20 bp, Artificial Sequence
  chemically synthesized
aaattacccggacgtggtgg

SEQ ID NO: 190111 - DNA, 20 bp, Artificial Sequence
  chemically synthesized
gacgtggtggcggccgcctg

SEQ ID NO: 190112 - DNA, 20 bp, Artificial Sequence
  chemically synthesized
caagtagctgggactacagg

SEQ ID NO: 190113 - DNA, 20 bp, Artificial Sequence
  chemically synthesized
gtggcggccgcctgtagtcc

SEQ ID NO: 190114 - DNA, 20 bp, Artificial Sequence
  chemically synthesized
tcccaagtagctgggactac

SEQ ID NO: 190115 - DNA, 20 bp, Artificial Sequence
  chemically synthesized
ctcccaagtagctgggacta

SEQ ID NO: 190116 - DNA, 20 bp, Artificial Sequence
  chemically synthesized
cgcctgtagtcccagctact

SEQ ID NO: 190117 - DNA, 20 bp, Artificial Sequence
  chemically synthesized
cctcagcctcccaagtagct

SEQ ID NO: 190118 - DNA, 20 bp, Artificial Sequence
  chemically synthesized
gcctgtagtcccagctactt

SEQ ID NO: 190119 - DNA, 20 bp, Artificial Sequence
  chemically synthesized
gcctcagcctcccaagtagc

SEQ ID NO: 190120 - DNA, 20 bp, Artificial Sequence
  chemically synthesized
ctgtagtcccagctacttgg

SEQ ID NO: 190121 - DNA, 20 bp, Artificial Sequence
  chemically synthesized
tgtagtcccagctacttggg

SEQ ID NO: 190122 - DNA, 20 bp, Artificial Sequence
  chemically synthesized
tcctgcctcagcctcccaag

SEQ ID NO: 190123 - DNA, 20 bp, Artificial Sequence
  chemically synthesized
ttctcctgcctcagcctccc

SEQ ID NO: 190124 - DNA, 20 bp, Artificial Sequence
  chemically synthesized
tcccagctacttgggaggct

SEQ ID NO: 190125 - DNA, 20 bp, Artificial Sequence
  chemically synthesized
cccagctacttgggaggctg

SEQ ID NO: 190126 - DNA, 20 bp, Artificial Sequence
  chemically synthesized
agctacttgggaggctgagg

SEQ ID NO: 190127 - DNA, 20 bp, Artificial Sequence
  chemically synthesized
gctacttgggaggctgaggc

SEQ ID NO: 190128 - DNA, 20 bp, Artificial Sequence
  chemically synthesized
tacttgggaggctgaggcag

SEQ ID NO: 190129 - DNA, 20 bp, Artificial Sequence
  chemically synthesized
ttcacgccattctcctgcct

SEQ ID NO: 190130 - DNA, 20 bp, Artificial Sequence
  chemically synthesized
gggaggctgaggcaggagaa

SEQ ID NO: 190131 - DNA, 20 bp, Artificial Sequence
  chemically synthesized
gcaggagaatggcgtgaacc

SEQ ID NO: 190132 - DNA, 20 bp, Artificial Sequence
  chemically synthesized
caggagaatggcgtgaaccc

SEQ ID NO: 190133 - DNA, 20 bp, Artificial Sequence
  chemically synthesized
gagaatggcgtgaacccggg

SEQ ID NO: 190134 - DNA, 20 bp, Artificial Sequence
  chemically synthesized
aatggcgtgaacccgggcag

SEQ ID NO: 190135 - DNA, 20 bp, Artificial Sequence
  chemically synthesized
cactgcaagctccactgccc

SEQ ID NO: 190136 - DNA, 20 bp, Artificial Sequence
  chemically synthesized
tggcgtgaacccgggcagtg

SEQ ID NO: 190137 - DNA, 20 bp, Artificial Sequence
  chemically synthesized
tcactgcaagctccactgcc

SEQ ID NO: 190138 - DNA, 20 bp, Artificial Sequence
  chemically synthesized
aacccgggcagtggagcttg

SEQ ID NO: 190139 - DNA, 20 bp, Artificial Sequence
  chemically synthesized
cgggcagtggagcttgcagt

SEQ ID NO: 190140 - DNA, 20 bp, Artificial Sequence
  chemically synthesized
gcatgatctcggctcactgc

SEQ ID NO: 190141 - DNA, 20 bp, Artificial Sequence
  chemically synthesized
agtggagcttgcagtgagcc

SEQ ID NO: 190142 - DNA, 20 bp, Artificial Sequence
  chemically synthesized
ggagtgcagtggcatgatct

SEQ ID NO: 190143 - DNA, 20 bp, Artificial Sequence
  chemically synthesized
ttgcccaggctggagtgcag

SEQ ID NO: 190144 - DNA, 20 bp, Artificial Sequence
  chemically synthesized
gagatcatgccactgcactc

SEQ ID NO: 190145 - DNA, 20 bp, Artificial Sequence
  chemically synthesized
ctgttgcccaggctggagtg

SEQ ID NO: 190146 - DNA, 20 bp, Artificial Sequence
  chemically synthesized
catgccactgcactccagcc

SEQ ID NO: 190147 - DNA, 20 bp, Artificial Sequence
  chemically synthesized
atgccactgcactccagcct

SEQ ID NO: 190148 - DNA, 20 bp, Artificial Sequence
  chemically synthesized
tcactctgttgcccaggctg

SEQ ID NO: 190149 - DNA, 20 bp, Artificial Sequence
  chemically synthesized
tctcactctgttgcccaggc

SEQ ID NO: 190150 - DNA, 20 bp, Artificial Sequence
  chemically synthesized
ctgcactccagcctgggcaa

SEQ ID NO: 190151 - DNA, 20 bp, Artificial Sequence
  chemically synthesized
ggagtctcactctgttgccc

SEQ ID NO: 190152 - DNA, 20 bp, Artificial Sequence
  chemically synthesized
gcactccagcctgggcaaca

SEQ ID NO: 190153 - DNA, 20 bp, Artificial Sequence
  chemically synthesized
tggagtctcactctgttgcc

SEQ ID NO: 190154 - DNA, 20 bp, Artificial Sequence
  chemically synthesized
tccagcctgggcaacagagt

SEQ ID NO: 190155 - DNA, 20 bp, Artificial Sequence
  chemically synthesized
ttttttttttttttgagatg

SEQ ID NO: 190156 - DNA, 20 bp, Artificial Sequence
  chemically synthesized
ttttttttttttttttgaga

SEQ ID NO: 190157 - DNA, 20 bp, Artificial Sequence
  chemically synthesized
tttttttttttttttttttt

SEQ ID NO: 190158 - DNA, 20 bp, Artificial Sequence
  chemically synthesized
aaaaaaaaaaaaaaaaaaaa

SEQ ID NO: 190159 - DNA, 20 bp, Artificial Sequence
  chemically synthesized
aaaaaaaaaaaaaaaaaaaa

SEQ ID NO: 190160 - DNA, 20 bp, Artificial Sequence
  chemically synthesized
aaaaaaaaaaaaaaaaggaa

SEQ ID NO: 190161 - DNA, 20 bp, Artificial Sequence
  chemically synthesized
aaaaaaaaaaggaaaagaaa

SEQ ID NO: 190162 - DNA, 20 bp, Artificial Sequence
  chemically synthesized
ttagtgttgctatttttaaa

SEQ ID NO: 190163 - DNA, 20 bp, Artificial Sequence
  chemically synthesized
gaaaaagtgctatttaaaaa

SEQ ID NO: 190164 - DNA, 20 bp, Artificial Sequence
  chemically synthesized
tatttaaaaatagcaacact

SEQ ID NO: 190165 - DNA, 20 bp, Artificial Sequence
  chemically synthesized
atttaatattgtattattct

SEQ ID NO: 190166 - DNA, 20 bp, Artificial Sequence
  chemically synthesized
aatacaatattaaattttca

SEQ ID NO: 190167 - DNA, 20 bp, Artificial Sequence
  chemically synthesized
taaattttcatagtatttta

SEQ ID NO: 190168 - DNA, 20 bp, Artificial Sequence
  chemically synthesized
atagtattttaaagcctcca

SEQ ID NO: 190169 - DNA, 20 bp, Artificial Sequence
  chemically synthesized
aataaattaatatgctatgg

SEQ ID NO: 190170 - DNA, 20 bp, Artificial Sequence
  chemically synthesized
gaataaattaatatgctatg

SEQ ID NO: 190171 - DNA, 20 bp, Artificial Sequence
  chemically synthesized
ttgaataaattaatatgcta

SEQ ID NO: 190172 - DNA, 20 bp, Artificial Sequence
  chemically synthesized
taatttattcaaataacttt

SEQ ID NO: 190173 - DNA, 20 bp, Artificial Sequence
  chemically synthesized
aatttattcaaataactttc

SEQ ID NO: 190174 - DNA, 20 bp, Artificial Sequence
  chemically synthesized
aattagttctggtgtcctga

SEQ ID NO: 190175 - DNA, 20 bp, Artificial Sequence
  chemically synthesized
tcaaataactttcaggacac

SEQ ID NO: 190176 - DNA, 20 bp, Artificial Sequence
  chemically synthesized
taaaaaggaagaattagttc

SEQ ID NO: 190177 - DNA, 20 bp, Artificial Sequence
  chemically synthesized
cacaattaaaaaggaagaat

SEQ ID NO: 190178 - DNA, 20 bp, Artificial Sequence
  chemically synthesized
gaaagtcacaattaaaaagg

SEQ ID NO: 190179 - DNA, 20 bp, Artificial Sequence
  chemically synthesized
tatgaaagtcacaattaaaa

SEQ ID NO: 190180 - DNA, 20 bp, Artificial Sequence
  chemically synthesized
gtatgaaagtcacaattaaa

SEQ ID NO: 190181 - DNA, 20 bp, Artificial Sequence
  chemically synthesized
ttcatggagttaatgtatga

SEQ ID NO: 190182 - DNA, 20 bp, Artificial Sequence
  chemically synthesized
ggtgacctcaatttttcatg

SEQ ID NO: 190183 - DNA, 20 bp, Artificial Sequence
  chemically synthesized
aaggtgacctcaatttttca

SEQ ID NO: 190184 - DNA, 20 bp, Artificial Sequence
  chemically synthesized
cattaactccatgaaaaatt

SEQ ID NO: 190185 - DNA, 20 bp, Artificial Sequence
  chemically synthesized
attaactccatgaaaaattg

SEQ ID NO: 190186 - DNA, 20 bp, Artificial Sequence
  chemically synthesized
agttataaaattggtataaa

SEQ ID NO: 190187 - DNA, 20 bp, Artificial Sequence
  chemically synthesized
aagttataaaattggtataa

SEQ ID NO: 190188 - DNA, 20 bp, Artificial Sequence
  chemically synthesized
actcttcaaagttataaaat

SEQ ID NO: 190189 - DNA, 20 bp, Artificial Sequence
  chemically synthesized
ataccaattttataactttg

SEQ ID NO: 190190 - DNA, 20 bp, Artificial Sequence
  chemically synthesized
accaattttataactttgaa

SEQ ID NO: 190191 - DNA, 20 bp, Artificial Sequence
  chemically synthesized
atatcactggttactcttca

SEQ ID NO: 190192 - DNA, 20 bp, Artificial Sequence
  chemically synthesized
ttataactttgaagagtaac

SEQ ID NO: 190193 - DNA, 20 bp, Artificial Sequence
  chemically synthesized
ataatttctctaaatatcac

SEQ ID NO: 190194 - DNA, 20 bp, Artificial Sequence
  chemically synthesized
gaagagtaaccagtgatatt

SEQ ID NO: 190195 - DNA, 20 bp, Artificial Sequence
  chemically synthesized
agagtaaccagtgatattta

SEQ ID NO: 190196 - DNA, 20 bp, Artificial Sequence
  chemically synthesized
gatatttagagaaattatat

SEQ ID NO: 190197 - DNA, 20 bp, Artificial Sequence
  chemically synthesized
atatttagagaaattatatt

SEQ ID NO: 190198 - DNA, 20 bp, Artificial Sequence
  chemically synthesized
tatttagagaaattatatta

SEQ ID NO: 190199 - DNA, 20 bp, Artificial Sequence
  chemically synthesized
gcacaagaacgtgagtgtga

SEQ ID NO: 190200 - DNA, 20 bp, Artificial Sequence
  chemically synthesized
gagcacaagaacgtgagtgt

SEQ ID NO: 190201 - DNA, 20 bp, Artificial Sequence
  chemically synthesized
aaatgagagcacaagaacgt

SEQ ID NO: 190202 - DNA, 20 bp, Artificial Sequence
  chemically synthesized
agagagagaaatgagagcac

SEQ ID NO: 190203 - DNA, 20 bp, Artificial Sequence
  chemically synthesized
agagacagagagagaaatga

SEQ ID NO: 190204 - DNA, 20 bp, Artificial Sequence
  chemically synthesized
agagagacagagagagaaat

SEQ ID NO: 190205 - DNA, 20 bp, Artificial Sequence
  chemically synthesized
gagagagagagagacagaga

SEQ ID NO: 190206 - DNA, 20 bp, Artificial Sequence
  chemically synthesized
gagagagagagagagacaga

SEQ ID NO: 190207 - DNA, 20 bp, Artificial Sequence
  chemically synthesized
gagagagagagagagagaca

SEQ ID NO: 190208 - DNA, 20 bp, Artificial Sequence
  chemically synthesized
gagagagagagagagagaga

SEQ ID NO: 190209 - DNA, 20 bp, Artificial Sequence
  chemically synthesized
tttcgagagagagagagaga

SEQ ID NO: 190210 - DNA, 20 bp, Artificial Sequence
  chemically synthesized
ggtttcgagagagagagaga

SEQ ID NO: 190211 - DNA, 20 bp, Artificial Sequence
  chemically synthesized
ctggtttcgagagagagaga

SEQ ID NO: 190212 - DNA, 20 bp, Artificial Sequence
  chemically synthesized
ctctggtttcgagagagaga

SEQ ID NO: 190213 - DNA, 20 bp, Artificial Sequence
  chemically synthesized
ctctctggtttcgagagaga

SEQ ID NO: 190214 - DNA, 20 bp, Artificial Sequence
  chemically synthesized
ccctctctggtttcgagaga

SEQ ID NO: 190215 - DNA, 20 bp, Artificial Sequence
  chemically synthesized
ctccctctctggtttcgaga

SEQ ID NO: 190216 - DNA, 20 bp, Artificial Sequence
  chemically synthesized
ctctctctctctctcgaaac

SEQ ID NO: 190217 - DNA, 20 bp, Artificial Sequence
  chemically synthesized
ctctccctctctggtttcga

SEQ ID NO: 190218 - DNA, 20 bp, Artificial Sequence
  chemically synthesized
ctctctctctctcgaaacca

SEQ ID NO: 190219 - DNA, 20 bp, Artificial Sequence
  chemically synthesized
gtctctccctctctggtttc

SEQ ID NO: 190220 - DNA, 20 bp, Artificial Sequence
  chemically synthesized
ctctctctctcgaaaccaga

SEQ ID NO: 190221 - DNA, 20 bp, Artificial Sequence
  chemically synthesized
tctctctctcgaaaccagag

SEQ ID NO: 190222 - DNA, 20 bp, Artificial Sequence
  chemically synthesized
ctctctctcgaaaccagaga

SEQ ID NO: 190223 - DNA, 20 bp, Artificial Sequence
  chemically synthesized
ctctctcgaaaccagagagg

SEQ ID NO: 190224 - DNA, 20 bp, Artificial Sequence
  chemically synthesized
acaataagtctctccctctc

SEQ ID NO: 190225 - DNA, 20 bp, Artificial Sequence
  chemically synthesized
ctctcgaaaccagagaggga

SEQ ID NO: 190226 - DNA, 20 bp, Artificial Sequence
  chemically synthesized
atgagccaatttattacaat

SEQ ID NO: 190227 - DNA, 20 bp, Artificial Sequence
  chemically synthesized
agagacttattgtaataaat

SEQ ID NO: 190228 - DNA, 20 bp, Artificial Sequence
  chemically synthesized
gacttctccagattcgtaat

SEQ ID NO: 190229 - DNA, 20 bp, Artificial Sequence
  chemically synthesized
aaattggctcattacgaatc

SEQ ID NO: 190230 - DNA, 20 bp, Artificial Sequence
  chemically synthesized
attggctcattacgaatctg

SEQ ID NO: 190231 - DNA, 20 bp, Artificial Sequence
  chemically synthesized
ggctcattacgaatctggag

SEQ ID NO: 190232 - DNA, 20 bp, Artificial Sequence
  chemically synthesized
tgtaaatcttgggacttctc

SEQ ID NO: 190233 - DNA, 20 bp, Artificial Sequence
  chemically synthesized
tacgaatctggagaagtccc

SEQ ID NO: 190234 - DNA, 20 bp, Artificial Sequence
  chemically synthesized
gcttgctgactgtaaatctt

SEQ ID NO: 190235 - DNA, 20 bp, Artificial Sequence
  chemically synthesized
tggagaagtcccaagattta

SEQ ID NO: 190236 - DNA, 20 bp, Artificial Sequence
  chemically synthesized
agcttgctgactgtaaatct

SEQ ID NO: 190237 - DNA, 20 bp, Artificial Sequence
  chemically synthesized
gaagtcccaagatttacagt

SEQ ID NO: 190238 - DNA, 20 bp, Artificial Sequence
  chemically synthesized
tcccaagatttacagtcagc

SEQ ID NO: 190239 - DNA, 20 bp, Artificial Sequence
  chemically synthesized
aagatttacagtcagcaagc

SEQ ID NO: 190240 - DNA, 20 bp, Artificial Sequence
  chemically synthesized
gatttacagtcagcaagctg

SEQ ID NO: 190241 - DNA, 20 bp, Artificial Sequence
  chemically synthesized
cagtcagcaagctggagacc

SEQ ID NO: 190242 - DNA, 20 bp, Artificial Sequence
  chemically synthesized
agtcagcaagctggagaccc

SEQ ID NO: 190243 - DNA, 20 bp, Artificial Sequence
  chemically synthesized
cattggctttcctgggtctc

SEQ ID NO: 190244 - DNA, 20 bp, Artificial Sequence
  chemically synthesized
agcaagctggagacccagga

SEQ ID NO: 190245 - DNA, 20 bp, Artificial Sequence
  chemically synthesized
actacatcattggctttcct

SEQ ID NO: 190246 - DNA, 20 bp, Artificial Sequence
  chemically synthesized
aactacatcattggctttcc

SEQ ID NO: 190247 - DNA, 20 bp, Artificial Sequence
  chemically synthesized
acccaggaaagccaatgatg

SEQ ID NO: 190248 - DNA, 20 bp, Artificial Sequence
  chemically synthesized
tcagacaggaactacatcat

SEQ ID NO: 190249 - DNA, 20 bp, Artificial Sequence
  chemically synthesized
caatgatgtagttcctgtct

SEQ ID NO: 190250 - DNA, 20 bp, Artificial Sequence
  chemically synthesized
tcatgcctttggactcagac

SEQ ID NO: 190251 - DNA, 20 bp, Artificial Sequence
  chemically synthesized
ctcatgcctttggactcaga

SEQ ID NO: 190252 - DNA, 20 bp, Artificial Sequence
  chemically synthesized
gtagttcctgtctgagtcca

SEQ ID NO: 190253 - DNA, 20 bp, Artificial Sequence
  chemically synthesized
tagttcctgtctgagtccaa

SEQ ID NO: 190254 - DNA, 20 bp, Artificial Sequence
  chemically synthesized
ggttctcatgcctttggact

SEQ ID NO: 190255 - DNA, 20 bp, Artificial Sequence
  chemically synthesized
ctgtctgagtccaaaggcat

SEQ ID NO: 190256 - DNA, 20 bp, Artificial Sequence
  chemically synthesized
tttcttggttctcatgcctt

SEQ ID NO: 190257 - DNA, 20 bp, Artificial Sequence
  chemically synthesized
agtccaaaggcatgagaacc

SEQ ID NO: 190258 - DNA, 20 bp, Artificial Sequence
  chemically synthesized
caaaggcatgagaaccaaga

SEQ ID NO: 190259 - DNA, 20 bp, Artificial Sequence
  chemically synthesized
cttaacgtcattggctttct

SEQ ID NO: 190260 - DNA, 20 bp, Artificial Sequence
  chemically synthesized
gggctggaacttaacgtcat

SEQ ID NO: 190261 - DNA, 20 bp, Artificial Sequence
  chemically synthesized
ccaagaaagccaatgacgtt

SEQ ID NO: 190262 - DNA, 20 bp, Artificial Sequence
  chemically synthesized
aagccaatgacgttaagttc

SEQ ID NO: 190263 - DNA, 20 bp, Artificial Sequence
  chemically synthesized
atgacgttaagttccagccc

SEQ ID NO: 190264 - DNA, 20 bp, Artificial Sequence
  chemically synthesized
taagcctccagttctggggc

SEQ ID NO: 190265 - DNA, 20 bp, Artificial Sequence
  chemically synthesized
ttaagttccagccccagaac

SEQ ID NO: 190266 - DNA, 20 bp, Artificial Sequence
  chemically synthesized
gtcttaagcctccagttctg

SEQ ID NO: 190267 - DNA, 20 bp, Artificial Sequence
  chemically synthesized
aagttccagccccagaactg

SEQ ID NO: 190268 - DNA, 20 bp, Artificial Sequence
  chemically synthesized
agtcttaagcctccagttct

SEQ ID NO: 190269 - DNA, 20 bp, Artificial Sequence
  chemically synthesized
agttccagccccagaactgg

SEQ ID NO: 190270 - DNA, 20 bp, Artificial Sequence
  chemically synthesized
gagtcttaagcctccagttc

SEQ ID NO: 190271 - DNA, 20 bp, Artificial Sequence
  chemically synthesized
agccccagaactggaggctt

SEQ ID NO: 190272 - DNA, 20 bp, Artificial Sequence
  chemically synthesized
cttcttgagtcttaagcctc

SEQ ID NO: 190273 - DNA, 20 bp, Artificial Sequence
  chemically synthesized
gaactggaggcttaagactc

SEQ ID NO: 190274 - DNA, 20 bp, Artificial Sequence
  chemically synthesized
cttgggtcttcttgagtctt

SEQ ID NO: 190275 - DNA, 20 bp, Artificial Sequence
  chemically synthesized
ctggaggcttaagactcaag

SEQ ID NO: 190276 - DNA, 20 bp, Artificial Sequence
  chemically synthesized
ttgaaaccttgggtcttctt

SEQ ID NO: 190277 - DNA, 20 bp, Artificial Sequence
  chemically synthesized
cttaagactcaagaagaccc

SEQ ID NO: 190278 - DNA, 20 bp, Artificial Sequence
  chemically synthesized
ttaagactcaagaagaccca

SEQ ID NO: 190279 - DNA, 20 bp, Artificial Sequence
  chemically synthesized
tgagcttgaattgaaacctt

SEQ ID NO: 190280 - DNA, 20 bp, Artificial Sequence
  chemically synthesized
ttgagcttgaattgaaacct

SEQ ID NO: 190281 - DNA, 20 bp, Artificial Sequence
  chemically synthesized
aagacccaaggtttcaattc

SEQ ID NO: 190282 - DNA, 20 bp, Artificial Sequence
  chemically synthesized
aaggtttcaattcaagctca

SEQ ID NO: 190283 - DNA, 20 bp, Artificial Sequence
  chemically synthesized
aggtttcaattcaagctcaa

SEQ ID NO: 190284 - DNA, 20 bp, Artificial Sequence
  chemically synthesized
tttcaattcaagctcaaagg

SEQ ID NO: 190285 - DNA, 20 bp, Artificial Sequence
  chemically synthesized
ttcaattcaagctcaaaggc

SEQ ID NO: 190286 - DNA, 20 bp, Artificial Sequence
  chemically synthesized
acccatcttttcctgccttt

SEQ ID NO: 190287 - DNA, 20 bp, Artificial Sequence
  chemically synthesized
ttcaagctcaaaggcaggaa

SEQ ID NO: 190288 - DNA, 20 bp, Artificial Sequence
  chemically synthesized
agctcaaaggcaggaaaaga

SEQ ID NO: 190289 - DNA, 20 bp, Artificial Sequence
  chemically synthesized
gctcaaaggcaggaaaagat

SEQ ID NO: 190290 - DNA, 20 bp, Artificial Sequence
  chemically synthesized
gcaggaaaagatgggtgttc

SEQ ID NO: 190291 - DNA, 20 bp, Artificial Sequence
  chemically synthesized
aaagatgggtgttccagctt

SEQ ID NO: 190292 - DNA, 20 bp, Artificial Sequence
  chemically synthesized
tcctgcctgatagctaaagc

SEQ ID NO: 190293 - DNA, 20 bp, Artificial Sequence
  chemically synthesized
ggtgttccagctttagctat

SEQ ID NO: 190294 - DNA, 20 bp, Artificial Sequence
  chemically synthesized
gaactcctgcctgatagcta

SEQ ID NO: 190295 - DNA, 20 bp, Artificial Sequence
  chemically synthesized
gtgttccagctttagctatc

SEQ ID NO: 190296 - DNA, 20 bp, Artificial Sequence
  chemically synthesized
ttccagctttagctatcagg

SEQ ID NO: 190297 - DNA, 20 bp, Artificial Sequence
  chemically synthesized
tccagctttagctatcaggc

SEQ ID NO: 190298 - DNA, 20 bp, Artificial Sequence
  chemically synthesized
taaaaggaactcctgcctga

SEQ ID NO: 190299 - DNA, 20 bp, Artificial Sequence
  chemically synthesized
cagctttagctatcaggcag

SEQ ID NO: 190300 - DNA, 20 bp, Artificial Sequence
  chemically synthesized
aggcaggagttccttttaat

SEQ ID NO: 190301 - DNA, 20 bp, Artificial Sequence
  chemically synthesized
ggcaggagttccttttaatc

SEQ ID NO: 190302 - DNA, 20 bp, Artificial Sequence
  chemically synthesized
aatcaaaaagcctgattaaa

SEQ ID NO: 190303 - DNA, 20 bp, Artificial Sequence
  chemically synthesized
taatcaaaaagcctgattaa

SEQ ID NO: 190304 - DNA, 20 bp, Artificial Sequence
  chemically synthesized
ttttaatcaggctttttgat

SEQ ID NO: 190305 - DNA, 20 bp, Artificial Sequence
  chemically synthesized
tttaatcaggctttttgatt

SEQ ID NO: 190306 - DNA, 20 bp, Artificial Sequence
  chemically synthesized
cgattgaagacctaatcaaa

SEQ ID NO: 190307 - DNA, 20 bp, Artificial Sequence
  chemically synthesized
gacctaagtccaatcgattg

SEQ ID NO: 190308 - DNA, 20 bp, Artificial Sequence
  chemically synthesized
tgattaggtcttcaatcgat

SEQ ID NO: 190309 - DNA, 20 bp, Artificial Sequence
  chemically synthesized
ggtcttcaatcgattggact

SEQ ID NO: 190310 - DNA, 20 bp, Artificial Sequence
  chemically synthesized
gtcttcaatcgattggactt

SEQ ID NO: 190311 - DNA, 20 bp, Artificial Sequence
  chemically synthesized
atccaatcaattgaggacct

SEQ ID NO: 190312 - DNA, 20 bp, Artificial Sequence
  chemically synthesized
gggtctgatccaatcaattg

SEQ ID NO: 190313 - DNA, 20 bp, Artificial Sequence
  chemically synthesized
gacttaggtcctcaattgat

SEQ ID NO: 190314 - DNA, 20 bp, Artificial Sequence
  chemically synthesized
tgggtctgatccaatcaatt

SEQ ID NO: 190315 - DNA, 20 bp, Artificial Sequence
  chemically synthesized
aggtcctcaattgattggat

SEQ ID NO: 190316 - DNA, 20 bp, Artificial Sequence
  chemically synthesized
ttgttctcccttgtgtgggt

SEQ ID NO: 190317 - DNA, 20 bp, Artificial Sequence
  chemically synthesized
tggatcagacccacccacac

SEQ ID NO: 190318 - DNA, 20 bp, Artificial Sequence
  chemically synthesized
attgttctcccttgtgtggg

SEQ ID NO: 190319 - DNA, 20 bp, Artificial Sequence
  chemically synthesized
ggatcagacccacccacaca

SEQ ID NO: 190320 - DNA, 20 bp, Artificial Sequence
  chemically synthesized
gatcagacccacccacacaa

SEQ ID NO: 190321 - DNA, 20 bp, Artificial Sequence
  chemically synthesized
ccgattgttctcccttgtgt

SEQ ID NO: 190322 - DNA, 20 bp, Artificial Sequence
  chemically synthesized
tcagacccacccacacaagg

SEQ ID NO: 190323 - DNA, 20 bp, Artificial Sequence
  chemically synthesized
gccgattgttctcccttgtg

SEQ ID NO: 190324 - DNA, 20 bp, Artificial Sequence
  chemically synthesized
cccacacaagggagaacaat

SEQ ID NO: 190325 - DNA, 20 bp, Artificial Sequence
  chemically synthesized
ttgaatcagtagagggagca

SEQ ID NO: 190326 - DNA, 20 bp, Artificial Sequence
  chemically synthesized
cacatttgaatcagtagagg

SEQ ID NO: 190327 - DNA, 20 bp, Artificial Sequence
  chemically synthesized
ttcacatttgaatcagtaga

SEQ ID NO: 190328 - DNA, 20 bp, Artificial Sequence
  chemically synthesized
attcacatttgaatcagtag

SEQ ID NO: 190329 - DNA, 20 bp, Artificial Sequence
  chemically synthesized
gattcacatttgaatcagta

SEQ ID NO: 190330 - DNA, 20 bp, Artificial Sequence
  chemically synthesized
gagattcacatttgaatcag

SEQ ID NO: 190331 - DNA, 20 bp, Artificial Sequence
  chemically synthesized
ggagagattcacatttgaat

SEQ ID NO: 190332 - DNA, 20 bp, Artificial Sequence
  chemically synthesized
gattcaaatgtgaatctctc

SEQ ID NO: 190333 - DNA, 20 bp, Artificial Sequence
  chemically synthesized
tttatgaggctgtttctgga

SEQ ID NO: 190334 - DNA, 20 bp, Artificial Sequence
  chemically synthesized
aatgtgaatctctccagaaa

SEQ ID NO: 190335 - DNA, 20 bp, Artificial Sequence
  chemically synthesized
tgtttatgaggctgtttctg

SEQ ID NO: 190336 - DNA, 20 bp, Artificial Sequence
  chemically synthesized
tgtgtttatgaggctgtttc

SEQ ID NO: 190337 - DNA, 20 bp, Artificial Sequence
  chemically synthesized
ttattctgggtgtgtttatg

SEQ ID NO: 190338 - DNA, 20 bp, Artificial Sequence
  chemically synthesized
attattctgggtgtgtttat

SEQ ID NO: 190339 - DNA, 20 bp, Artificial Sequence
  chemically synthesized
aacagcctcataaacacacc

SEQ ID NO: 190340 - DNA, 20 bp, Artificial Sequence
  chemically synthesized
atttggtcaaacattattct

SEQ ID NO: 190341 - DNA, 20 bp, Artificial Sequence
  chemically synthesized
catttggtcaaacattattc

SEQ ID NO: 190342 - DNA, 20 bp, Artificial Sequence
  chemically synthesized
taatgtttgaccaaatgtct

SEQ ID NO: 190343 - DNA, 20 bp, Artificial Sequence
  chemically synthesized
ccgcagggtaccgagacatt

SEQ ID NO: 190344 - DNA, 20 bp, Artificial Sequence
  chemically synthesized
tggctgggccgcagggtacc

SEQ ID NO: 190345 - DNA, 20 bp, Artificial Sequence
  chemically synthesized
ccaaatgtctcggtaccctg

SEQ ID NO: 190346 - DNA, 20 bp, Artificial Sequence
  chemically synthesized
tgtctcggtaccctgcggcc

SEQ ID NO: 190347 - DNA, 20 bp, Artificial Sequence
  chemically synthesized
gtcaacttggctgggccgca

SEQ ID NO: 190348 - DNA, 20 bp, Artificial Sequence
  chemically synthesized
tgtcaacttggctgggccgc

SEQ ID NO: 190349 - DNA, 20 bp, Artificial Sequence
  chemically synthesized
gtgtcaacttggctgggccg

SEQ ID NO: 190350 - DNA, 20 bp, Artificial Sequence
  chemically synthesized
cggtaccctgcggcccagcc

SEQ ID NO: 190351 - DNA, 20 bp, Artificial Sequence
  chemically synthesized
tttcatgtgtcaacttggct

SEQ ID NO: 190352 - DNA, 20 bp, Artificial Sequence
  chemically synthesized
atttcatgtgtcaacttggc

SEQ ID NO: 190353 - DNA, 20 bp, Artificial Sequence
  chemically synthesized
gttaatttcatgtgtcaact

SEQ ID NO: 190354 - DNA, 20 bp, Artificial Sequence
  chemically synthesized
acacatgaaattaaccatca

SEQ ID NO: 190355 - DNA, 20 bp, Artificial Sequence
  chemically synthesized
aaattacttaatttctgtga

SEQ ID NO: 190356 - DNA, 20 bp, Artificial Sequence
  chemically synthesized
aattaaccatcacagaaatt

SEQ ID NO: 190357 - DNA, 20 bp, Artificial Sequence
  chemically synthesized
agaaattaagtaatttgttg

SEQ ID NO: 190358 - DNA, 20 bp, Artificial Sequence
  chemically synthesized
atttgttgaagttaaattga

SEQ ID NO: 190359 - DNA, 20 bp, Artificial Sequence
  chemically synthesized
gaagttaaattgatagactt

SEQ ID NO: 190360 - DNA, 20 bp, Artificial Sequence
  chemically synthesized
cgattgttattaaaaatctc

SEQ ID NO: 190361 - DNA, 20 bp, Artificial Sequence
  chemically synthesized
ttgagatttttaataacaat

SEQ ID NO: 190362 - DNA, 20 bp, Artificial Sequence
  chemically synthesized
taacaatcggttccaaattc

SEQ ID NO: 190363 - DNA, 20 bp, Artificial Sequence
  chemically synthesized
aaacacatcaggctagaatt

SEQ ID NO: 190364 - DNA, 20 bp, Artificial Sequence
  chemically synthesized
aaggaaaaaacacatcaggc

SEQ ID NO: 190365 - DNA, 20 bp, Artificial Sequence
  chemically synthesized
ataaaaggaaaaaacacatc

SEQ ID NO: 190366 - DNA, 20 bp, Artificial Sequence
  chemically synthesized
aataaaaggaaaaaacacat

SEQ ID NO: 190367 - DNA, 20 bp, Artificial Sequence
  chemically synthesized
aataaatttaatataataaa

SEQ ID NO: 190368 - DNA, 20 bp, Artificial Sequence
  chemically synthesized
caataaatttaatataataa

SEQ ID NO: 190369 - DNA, 20 bp, Artificial Sequence
  chemically synthesized
tttattgcaaaatgttctta

SEQ ID NO: 190370 - DNA, 20 bp, Artificial Sequence
  chemically synthesized
gccttttccaaatttgcttt

SEQ ID NO: 190371 - DNA, 20 bp, Artificial Sequence
  chemically synthesized
aaatgttcttaaagcaaatt

SEQ ID NO: 190372 - DNA, 20 bp, Artificial Sequence
  chemically synthesized
ttcttaaagcaaatttggaa

SEQ ID NO: 190373 - DNA, 20 bp, Artificial Sequence
  chemically synthesized
tcttaaagcaaatttggaaa

SEQ ID NO: 190374 - DNA, 20 bp, Artificial Sequence
  chemically synthesized
aaagcaaatttggaaaaggc

SEQ ID NO: 190375 - DNA, 20 bp, Artificial Sequence
  chemically synthesized
atttctgacctgaagaaatc

SEQ ID NO: 190376 - DNA, 20 bp, Artificial Sequence
  chemically synthesized
tggaaaaggctagatttctt

SEQ ID NO: 190377 - DNA, 20 bp, Artificial Sequence
  chemically synthesized
ggaaaaggctagatttcttc

SEQ ID NO: 190378 - DNA, 20 bp, Artificial Sequence
  chemically synthesized
aaggctagatttcttcaggt

SEQ ID NO: 190379 - DNA, 20 bp, Artificial Sequence
  chemically synthesized
acggcagaatttctgacctg

SEQ ID NO: 190380 - DNA, 20 bp, Artificial Sequence
  chemically synthesized
tcttcatgcattgaatacgg

SEQ ID NO: 190381 - DNA, 20 bp, Artificial Sequence
  chemically synthesized
ctttcttcatgcattgaata

SEQ ID NO: 190382 - DNA, 20 bp, Artificial Sequence
  chemically synthesized
tctgccgtattcaatgcatg

SEQ ID NO: 190383 - DNA, 20 bp, Artificial Sequence
  chemically synthesized
ccgtattcaatgcatgaaga

SEQ ID NO: 190384 - DNA, 20 bp, Artificial Sequence
  chemically synthesized
tctgtcaaatagattcattt

SEQ ID NO: 190385 - DNA, 20 bp, Artificial Sequence
  chemically synthesized
gctcaaatgaatctatttga

SEQ ID NO: 190386 - DNA, 20 bp, Artificial Sequence
  chemically synthesized
actgctccaggtctgtcaaa

SEQ ID NO: 190387 - DNA, 20 bp, Artificial Sequence
  chemically synthesized
atgaatctatttgacagacc

SEQ ID NO: 190388 - DNA, 20 bp, Artificial Sequence
  chemically synthesized
gaatctatttgacagacctg

SEQ ID NO: 190389 - DNA, 20 bp, Artificial Sequence
  chemically synthesized
tctatttgacagacctggag

SEQ ID NO: 190390 - DNA, 20 bp, Artificial Sequence
  chemically synthesized
tcagacaaaataactgctcc

SEQ ID NO: 190391 - DNA, 20 bp, Artificial Sequence
  chemically synthesized
atcagacaaaataactgctc

SEQ ID NO: 190392 - DNA, 20 bp, Artificial Sequence
  chemically synthesized
cagttattttgtctgatgct

SEQ ID NO: 190393 - DNA, 20 bp, Artificial Sequence
  chemically synthesized
agttattttgtctgatgcta

SEQ ID NO: 190394 - DNA, 20 bp, Artificial Sequence
  chemically synthesized
gtaaatcaaaaccttagcat

SEQ ID NO: 190395 - DNA, 20 bp, Artificial Sequence
  chemically synthesized
gcgcttgtaaatcaaaacct

SEQ ID NO: 190396 - DNA, 20 bp, Artificial Sequence
  chemically synthesized
atgctaaggttttgatttac

SEQ ID NO: 190397 - DNA, 20 bp, Artificial Sequence
  chemically synthesized
aggttttgatttacaagcgc

SEQ ID NO: 190398 - DNA, 20 bp, Artificial Sequence
  chemically synthesized
tgccacaatcagaaagcaca

SEQ ID NO: 190399 - DNA, 20 bp, Artificial Sequence
  chemically synthesized
acttggctgccacaatcaga

SEQ ID NO: 190400 - DNA, 20 bp, Artificial Sequence
  chemically synthesized
gtctttgtgctttctgattg

SEQ ID NO: 190401 - DNA, 20 bp, Artificial Sequence
  chemically synthesized
tttgtgctttctgattgtgg

SEQ ID NO: 190402 - DNA, 20 bp, Artificial Sequence
  chemically synthesized
ctcaacttggctgccacaat

SEQ ID NO: 190403 - DNA, 20 bp, Artificial Sequence
  chemically synthesized
gctttctgattgtggcagcc

SEQ ID NO: 190404 - DNA, 20 bp, Artificial Sequence
  chemically synthesized
ctgattgtggcagccaagtt

SEQ ID NO: 190405 - DNA, 20 bp, Artificial Sequence
  chemically synthesized
attgtggcagccaagttgag

SEQ ID NO: 190406 - DNA, 20 bp, Artificial Sequence
  chemically synthesized
ctgtttttccccactcaact

SEQ ID NO: 190407 - DNA, 20 bp, Artificial Sequence
  chemically synthesized
ttgtggcagccaagttgagt

SEQ ID NO: 190408 - DNA, 20 bp, Artificial Sequence
  chemically synthesized
tgtggcagccaagttgagtg

SEQ ID NO: 190409 - DNA, 20 bp, Artificial Sequence
  chemically synthesized
ccaagttgagtggggaaaaa

SEQ ID NO: 190410 - DNA, 20 bp, Artificial Sequence
  chemically synthesized
caagttgagtggggaaaaac

SEQ ID NO: 190411 - DNA, 20 bp, Artificial Sequence
  chemically synthesized
agttgagtggggaaaaacag

SEQ ID NO: 190412 - DNA, 20 bp, Artificial Sequence
  chemically synthesized
aggagaaaaacatgctaata

SEQ ID NO: 190413 - DNA, 20 bp, Artificial Sequence
  chemically synthesized
ggagaaaaacatgctaatac

SEQ ID NO: 190414 - DNA, 20 bp, Artificial Sequence
  chemically synthesized
gagaaaaacatgctaatacg

SEQ ID NO: 190415 - DNA, 20 bp, Artificial Sequence
  chemically synthesized
ttatgtttttttccccgtat

SEQ ID NO: 190416 - DNA, 20 bp, Artificial Sequence
  chemically synthesized
aatacggggaaaaaaacata

SEQ ID NO: 190417 - DNA, 20 bp, Artificial Sequence
  chemically synthesized
tacggggaaaaaaacataaa

SEQ ID NO: 190418 - DNA, 20 bp, Artificial Sequence
  chemically synthesized
cggggaaaaaaacataaaga

SEQ ID NO: 190419 - DNA, 20 bp, Artificial Sequence
  chemically synthesized
ggggaaaaaaacataaagag

SEQ ID NO: 190420 - DNA, 20 bp, Artificial Sequence
  chemically synthesized
aagagaggatttttgcaact

SEQ ID NO: 190421 - DNA, 20 bp, Artificial Sequence
  chemically synthesized
ttgtatataagttcatttct

SEQ ID NO: 190422 - DNA, 20 bp, Artificial Sequence
  chemically synthesized
ataggctcttcattgtatat

SEQ ID NO: 190423 - DNA, 20 bp, Artificial Sequence
  chemically synthesized
aaatgaacttatatacaatg

SEQ ID NO: 190424 - DNA, 20 bp, Artificial Sequence
  chemically synthesized
atgaacttatatacaatgaa

SEQ ID NO: 190425 - DNA, 20 bp, Artificial Sequence
  chemically synthesized
tattattttaggaataaaat

SEQ ID NO: 190426 - DNA, 20 bp, Artificial Sequence
  chemically synthesized
ttattattttaggaataaaa

SEQ ID NO: 190427 - DNA, 20 bp, Artificial Sequence
  chemically synthesized
aaattttagattattatttt

SEQ ID NO: 190428 - DNA, 20 bp, Artificial Sequence
  chemically synthesized
aaaattttagattattattt

SEQ ID NO: 190429 - DNA, 20 bp, Artificial Sequence
  chemically synthesized
tcatttttaaaataaaattt

SEQ ID NO: 190430 - DNA, 20 bp, Artificial Sequence
  chemically synthesized
taaaattttattttaaaaat

SEQ ID NO: 190431 - DNA, 20 bp, Artificial Sequence
  chemically synthesized
attttattttaaaaatgaga

SEQ ID NO: 190432 - DNA, 20 bp, Artificial Sequence
  chemically synthesized
ttttaaaaatgagaaagctt

SEQ ID NO: 190433 - DNA, 20 bp, Artificial Sequence
  chemically synthesized
ttaaaaatgagaaagcttga

SEQ ID NO: 190434 - DNA, 20 bp, Artificial Sequence
  chemically synthesized
taaaaatgagaaagcttgag

SEQ ID NO: 190435 - DNA, 20 bp, Artificial Sequence
  chemically synthesized
taatctaataaatacctctc

SEQ ID NO: 190436 - DNA, 20 bp, Artificial Sequence
  chemically synthesized
aaagcttgagaggtatttat

SEQ ID NO: 190437 - DNA, 20 bp, Artificial Sequence
  chemically synthesized
agagattaaaaaaaggaaat

SEQ ID NO: 190438 - DNA, 20 bp, Artificial Sequence
  chemically synthesized
taaaaatagagattaaaaaa

SEQ ID NO: 190439 - DNA, 20 bp, Artificial Sequence
  chemically synthesized
ttaaaaatagagattaaaaa

SEQ ID NO: 190440 - DNA, 20 bp, Artificial Sequence
  chemically synthesized
ctgagtctacattaaaaata

SEQ ID NO: 190441 - DNA, 20 bp, Artificial Sequence
  chemically synthesized
ccctgagtctacattaaaaa

SEQ ID NO: 190442 - DNA, 20 bp, Artificial Sequence
  chemically synthesized
tttaatctctatttttaatg

SEQ ID NO: 190443 - DNA, 20 bp, Artificial Sequence
  chemically synthesized
ctctatttttaatgtagact

SEQ ID NO: 190444 - DNA, 20 bp, Artificial Sequence
  chemically synthesized
tctatttttaatgtagactc

SEQ ID NO: 190445 - DNA, 20 bp, Artificial Sequence
  chemically synthesized
ctatttttaatgtagactca

SEQ ID NO: 190446 - DNA, 20 bp, Artificial Sequence
  chemically synthesized
tatttttaatgtagactcag

SEQ ID NO: 190447 - DNA, 20 bp, Artificial Sequence
  chemically synthesized
aaaccaacacatgtacccct

SEQ ID NO: 190448 - DNA, 20 bp, Artificial Sequence
  chemically synthesized
agactcaggggtacatgtgt

SEQ ID NO: 190449 - DNA, 20 bp, Artificial Sequence
  chemically synthesized
tacatgtgttggtttgttac

SEQ ID NO: 190450 - DNA, 20 bp, Artificial Sequence
  chemically synthesized
acatgtgttggtttgttaca

SEQ ID NO: 190451 - DNA, 20 bp, Artificial Sequence
  chemically synthesized
catgtgttggtttgttacaa

SEQ ID NO: 190452 - DNA, 20 bp, Artificial Sequence
  chemically synthesized
gcccaaacctcagcatcacg

SEQ ID NO: 190453 - DNA, 20 bp, Artificial Sequence
  chemically synthesized
agggtatactgcgtgatgct

SEQ ID NO: 190454 - DNA, 20 bp, Artificial Sequence
  chemically synthesized
gggtatactgcgtgatgctg

SEQ ID NO: 190455 - DNA, 20 bp, Artificial Sequence
  chemically synthesized
tactgcgtgatgctgaggtt

SEQ ID NO: 190456 - DNA, 20 bp, Artificial Sequence
  chemically synthesized
actgcgtgatgctgaggttt

SEQ ID NO: 190457 - DNA, 20 bp, Artificial Sequence
  chemically synthesized
atcaacagaagcccaaacct

SEQ ID NO: 190458 - DNA, 20 bp, Artificial Sequence
  chemically synthesized
ctgggtgatggaatcaacag

SEQ ID NO: 190459 - DNA, 20 bp, Artificial Sequence
  chemically synthesized
tatctgggtgatggaatcaa

SEQ ID NO: 190460 - DNA, 20 bp, Artificial Sequence
  chemically synthesized
cttctgttgattccatcacc

SEQ ID NO: 190461 - DNA, 20 bp, Artificial Sequence
  chemically synthesized
tatgttcactatctgggtga

SEQ ID NO: 190462 - DNA, 20 bp, Artificial Sequence
  chemically synthesized
tgttgattccatcacccaga

SEQ ID NO: 190463 - DNA, 20 bp, Artificial Sequence
  chemically synthesized
gggtactatgttcactatct

SEQ ID NO: 190464 - DNA, 20 bp, Artificial Sequence
  chemically synthesized
tgggtactatgttcactatc

SEQ ID NO: 190465 - DNA, 20 bp, Artificial Sequence
  chemically synthesized
catcacccagatagtgaaca

SEQ ID NO: 190466 - DNA, 20 bp, Artificial Sequence
  chemically synthesized
atagtgaacatagtacccaa

SEQ ID NO: 190467 - DNA, 20 bp, Artificial Sequence
  chemically synthesized
tagtgaacatagtacccaac

SEQ ID NO: 190468 - DNA, 20 bp, Artificial Sequence
  chemically synthesized
tgaacatagtacccaacagg

SEQ ID NO: 190469 - DNA, 20 bp, Artificial Sequence
  chemically synthesized
gtgctgcaaaacttcctgtt

SEQ ID NO: 190470 - DNA, 20 bp, Artificial Sequence
  chemically synthesized
agtgctgcaaaacttcctgt

SEQ ID NO: 190471 - DNA, 20 bp, Artificial Sequence
  chemically synthesized
gtacccaacaggaagttttg

SEQ ID NO: 190472 - DNA, 20 bp, Artificial Sequence
  chemically synthesized
aggaggggagggaggggagc

SEQ ID NO: 190473 - DNA, 20 bp, Artificial Sequence
  chemically synthesized
aaggaggaggggagggaggg

SEQ ID NO: 190474 - DNA, 20 bp, Artificial Sequence
  chemically synthesized
gaaaggaggaggggagggag

SEQ ID NO: 190475 - DNA, 20 bp, Artificial Sequence
  chemically synthesized
cgaaaggaggaggggaggga

SEQ ID NO: 190476 - DNA, 20 bp, Artificial Sequence
  chemically synthesized
ccgaaaggaggaggggaggg

SEQ ID NO: 190477 - DNA, 20 bp, Artificial Sequence
  chemically synthesized
tccgaaaggaggaggggagg

SEQ ID NO: 190478 - DNA, 20 bp, Artificial Sequence
  chemically synthesized
actccgaaaggaggagggga

SEQ ID NO: 190479 - DNA, 20 bp, Artificial Sequence
  chemically synthesized
cactccgaaaggaggagggg

SEQ ID NO: 190480 - DNA, 20 bp, Artificial Sequence
  chemically synthesized
gcactccgaaaggaggaggg

SEQ ID NO: 190481 - DNA, 20 bp, Artificial Sequence
  chemically synthesized
aggcactccgaaaggaggag

SEQ ID NO: 190482 - DNA, 20 bp, Artificial Sequence
  chemically synthesized
taggcactccgaaaggagga

SEQ ID NO: 190483 - DNA, 20 bp, Artificial Sequence
  chemically synthesized
ttaggcactccgaaaggagg

SEQ ID NO: 190484 - DNA, 20 bp, Artificial Sequence
  chemically synthesized
cctccctcccctcctccttt

SEQ ID NO: 190485 - DNA, 20 bp, Artificial Sequence
  chemically synthesized
attaggcactccgaaaggag

SEQ ID NO: 190486 - DNA, 20 bp, Artificial Sequence
  chemically synthesized
tccctcccctcctcctttcg

SEQ ID NO: 190487 - DNA, 20 bp, Artificial Sequence
  chemically synthesized
gaattaggcactccgaaagg

SEQ ID NO: 190488 - DNA, 20 bp, Artificial Sequence
  chemically synthesized
cgaattaggcactccgaaag

SEQ ID NO: 190489 - DNA, 20 bp, Artificial Sequence
  chemically synthesized
cacgaattaggcactccgaa

SEQ ID NO: 190490 - DNA, 20 bp, Artificial Sequence
  chemically synthesized
acacgaattaggcactccga

SEQ ID NO: 190491 - DNA, 20 bp, Artificial Sequence
  chemically synthesized
gcaaatttccaacacgaatt

SEQ ID NO: 190492 - DNA, 20 bp, Artificial Sequence
  chemically synthesized
agcaaatttccaacacgaat

SEQ ID NO: 190493 - DNA, 20 bp, Artificial Sequence
  chemically synthesized
tcggagtgcctaattcgtgt

SEQ ID NO: 190494 - DNA, 20 bp, Artificial Sequence
  chemically synthesized
ttggaaatttgctttaatct

SEQ ID NO: 190495 - DNA, 20 bp, Artificial Sequence
  chemically synthesized
tggaaatttgctttaatctt

SEQ ID NO: 190496 - DNA, 20 bp, Artificial Sequence
  chemically synthesized
tgaatgttcccctaagatta

SEQ ID NO: 190497 - DNA, 20 bp, Artificial Sequence
  chemically synthesized
ggaaatttgctttaatctta

SEQ ID NO: 190498 - DNA, 20 bp, Artificial Sequence
  chemically synthesized
gaaatttgctttaatcttag

SEQ ID NO: 190499 - DNA, 20 bp, Artificial Sequence
  chemically synthesized
ttttctatgaatgttcccct

SEQ ID NO: 190500 - DNA, 20 bp, Artificial Sequence
  chemically synthesized
taatcttaggggaacattca

SEQ ID NO: 190501 - DNA, 20 bp, Artificial Sequence
  chemically synthesized
ttcatagaaaaaactgtaca

SEQ ID NO: 190502 - DNA, 20 bp, Artificial Sequence
  chemically synthesized
tcatagaaaaaactgtacaa

SEQ ID NO: 190503 - DNA, 20 bp, Artificial Sequence
  chemically synthesized
catagaaaaaactgtacaaa

SEQ ID NO: 190504 - DNA, 20 bp, Artificial Sequence
  chemically synthesized
gcgtaaagaaaccctttgta

SEQ ID NO: 190505 - DNA, 20 bp, Artificial Sequence
  chemically synthesized
ttcatcattgagaatgcgta

SEQ ID NO: 190506 - DNA, 20 bp, Artificial Sequence
  chemically synthesized
tcaacatgattttcatcatt

SEQ ID NO: 190507 - DNA, 20 bp, Artificial Sequence
  chemically synthesized
tgttgacattgttctgtcat

SEQ ID NO: 190508 - DNA, 20 bp, Artificial Sequence
  chemically synthesized
tgacattgttctgtcattag

SEQ ID NO: 190509 - DNA, 20 bp, Artificial Sequence
  chemically synthesized
ttgtacatgtcttctaatga

SEQ ID NO: 190510 - DNA, 20 bp, Artificial Sequence
  chemically synthesized
ttagaagacatgtacaaaaa

SEQ ID NO: 190511 - DNA, 20 bp, Artificial Sequence
  chemically synthesized
aaaaatagtttttgataaac

SEQ ID NO: 190512 - DNA, 20 bp, Artificial Sequence
  chemically synthesized
gttatgaagacattaagcgc

SEQ ID NO: 190513 - DNA, 20 bp, Artificial Sequence
  chemically synthesized
acttacgttatgaagacatt

SEQ ID NO: 190514 - DNA, 20 bp, Artificial Sequence
  chemically synthesized
tcgcttccacttacgttatg

SEQ ID NO: 190515 - DNA, 20 bp, Artificial Sequence
  chemically synthesized
gcttaatgtcttcataacgt

SEQ ID NO: 190516 - DNA, 20 bp, Artificial Sequence
  chemically synthesized
taatgtcttcataacgtaag

SEQ ID NO: 190517 - DNA, 20 bp, Artificial Sequence
  chemically synthesized
tgtcttcataacgtaagtgg

SEQ ID NO: 190518 - DNA, 20 bp, Artificial Sequence
  chemically synthesized
aagcgatgaaaatatactgc

SEQ ID NO: 190519 - DNA, 20 bp, Artificial Sequence
  chemically synthesized
ctttgaaaaatagtttcttg

SEQ ID NO: 190520 - DNA, 20 bp, Artificial Sequence
  chemically synthesized
ctgcaagaaactatttttca

SEQ ID NO: 190521 - DNA, 20 bp, Artificial Sequence
  chemically synthesized
atgtcgaagactttgaaaaa

SEQ ID NO: 190522 - DNA, 20 bp, Artificial Sequence
  chemically synthesized
gaaaaaaagtaaaaatgtcg

SEQ ID NO: 190523 - DNA, 20 bp, Artificial Sequence
  chemically synthesized
tgaagtgtttagttgaaaaa

SEQ ID NO: 190524 - DNA, 20 bp, Artificial Sequence
  chemically synthesized
tttttttcaactaaacactt

SEQ ID NO: 190525 - DNA, 20 bp, Artificial Sequence
  chemically synthesized
cccaaaaggactgaagtgtt

SEQ ID NO: 190526 - DNA, 20 bp, Artificial Sequence
  chemically synthesized
gagctcacccaaaaggactg

SEQ ID NO: 190527 - DNA, 20 bp, Artificial Sequence
  chemically synthesized
actaaacacttcagtccttt

SEQ ID NO: 190528 - DNA, 20 bp, Artificial Sequence
  chemically synthesized
ctaaacacttcagtcctttt

SEQ ID NO: 190529 - DNA, 20 bp, Artificial Sequence
  chemically synthesized
acacttcagtccttttgggt

SEQ ID NO: 190530 - DNA, 20 bp, Artificial Sequence
  chemically synthesized
atataaagagctcacccaaa

SEQ ID NO: 190531 - DNA, 20 bp, Artificial Sequence
  chemically synthesized
aatataaagagctcacccaa

SEQ ID NO: 190532 - DNA, 20 bp, Artificial Sequence
  chemically synthesized
aaccttttaaataatataaa

SEQ ID NO: 190533 - DNA, 20 bp, Artificial Sequence
  chemically synthesized
agaaccttttaaataatata

SEQ ID NO: 190534 - DNA, 20 bp, Artificial Sequence
  chemically synthesized
gagctctttatattatttaa

SEQ ID NO: 190535 - DNA, 20 bp, Artificial Sequence
  chemically synthesized
agctctttatattatttaaa

SEQ ID NO: 190536 - DNA, 20 bp, Artificial Sequence
  chemically synthesized
tatttaaaaggttcttttcc

SEQ ID NO: 190537 - DNA, 20 bp, Artificial Sequence
  chemically synthesized
ttacataaactatctaggaa

SEQ ID NO: 190538 - DNA, 20 bp, Artificial Sequence
  chemically synthesized
taaaaggttcttttcctaga

SEQ ID NO: 190539 - DNA, 20 bp, Artificial Sequence
  chemically synthesized
ggcatttacataaactatct

SEQ ID NO: 190540 - DNA, 20 bp, Artificial Sequence
  chemically synthesized
aggcatttacataaactatc

SEQ ID NO: 190541 - DNA, 20 bp, Artificial Sequence
  chemically synthesized
tttatgtaaatgccttttcc

SEQ ID NO: 190542 - DNA, 20 bp, Artificial Sequence
  chemically synthesized
tatgtaaatgccttttcctg

SEQ ID NO: 190543 - DNA, 20 bp, Artificial Sequence
  chemically synthesized
ttaaaggttactccaggaaa

SEQ ID NO: 190544 - DNA, 20 bp, Artificial Sequence
  chemically synthesized
cttaaaggttactccaggaa

SEQ ID NO: 190545 - DNA, 20 bp, Artificial Sequence
  chemically synthesized
aatgccttaaaggttactcc

SEQ ID NO: 190546 - DNA, 20 bp, Artificial Sequence
  chemically synthesized
taatgccttaaaggttactc

SEQ ID NO: 190547 - DNA, 20 bp, Artificial Sequence
  chemically synthesized
cttttcctggagtaaccttt

SEQ ID NO: 190548 - DNA, 20 bp, Artificial Sequence
  chemically synthesized
ttttcctggagtaaccttta

SEQ ID NO: 190549 - DNA, 20 bp, Artificial Sequence
  chemically synthesized
atttccaaataatgccttaa

SEQ ID NO: 190550 - DNA, 20 bp, Artificial Sequence
  chemically synthesized
tatttccaaataatgcctta

SEQ ID NO: 190551 - DNA, 20 bp, Artificial Sequence
  chemically synthesized
gtaacctttaaggcattatt

SEQ ID NO: 190552 - DNA, 20 bp, Artificial Sequence
  chemically synthesized
ggcattatttggaaataaca

SEQ ID NO: 190553 - DNA, 20 bp, Artificial Sequence
  chemically synthesized
aaataacatagtttctccta

SEQ ID NO: 190554 - DNA, 20 bp, Artificial Sequence
  chemically synthesized
taaaaacagacatactttag

SEQ ID NO: 190555 - DNA, 20 bp, Artificial Sequence
  chemically synthesized
gataaaaacagacatacttt

SEQ ID NO: 190556 - DNA, 20 bp, Artificial Sequence
  chemically synthesized
ggataaaaacagacatactt

SEQ ID NO: 190557 - DNA, 20 bp, Artificial Sequence
  chemically synthesized
tctactgttgtggataaaaa

SEQ ID NO: 190558 - DNA, 20 bp, Artificial Sequence
  chemically synthesized
atgtctgtttttatccacaa

SEQ ID NO: 190559 - DNA, 20 bp, Artificial Sequence
  chemically synthesized
tctgtttttatccacaacag

SEQ ID NO: 190560 - DNA, 20 bp, Artificial Sequence
  chemically synthesized
ttcctactactctactgttg

SEQ ID NO: 190561 - DNA, 20 bp, Artificial Sequence
  chemically synthesized
tgtttttatccacaacagta

SEQ ID NO: 190562 - DNA, 20 bp, Artificial Sequence
  chemically synthesized
ttttatccacaacagtagag

SEQ ID NO: 190563 - DNA, 20 bp, Artificial Sequence
  chemically synthesized
tatccacaacagtagagtag

SEQ ID NO: 190564 - DNA, 20 bp, Artificial Sequence
  chemically synthesized
atccacaacagtagagtagt

SEQ ID NO: 190565 - DNA, 20 bp, Artificial Sequence
  chemically synthesized
acaacagtagagtagtagga

SEQ ID NO: 190566 - DNA, 20 bp, Artificial Sequence
  chemically synthesized
gtagtaggaaagtgtgtgct

SEQ ID NO: 190567 - DNA, 20 bp, Artificial Sequence
  chemically synthesized
taggaaagtgtgtgctaaga

SEQ ID NO: 190568 - DNA, 20 bp, Artificial Sequence
  chemically synthesized
aagagaatattgtactttct

SEQ ID NO: 190569 - DNA, 20 bp, Artificial Sequence
  chemically synthesized
caataatgtacagtgacaaa

SEQ ID NO: 190570 - DNA, 20 bp, Artificial Sequence
  chemically synthesized
tacaataatgtacagtgaca

SEQ ID NO: 190571 - DNA, 20 bp, Artificial Sequence
  chemically synthesized
atggtaactacaataatgta

SEQ ID NO: 190572 - DNA, 20 bp, Artificial Sequence
  chemically synthesized
tttgtcactgtacattattg

SEQ ID NO: 190573 - DNA, 20 bp, Artificial Sequence
  chemically synthesized
cattattgtagttaccatat

SEQ ID NO: 190574 - DNA, 20 bp, Artificial Sequence
  chemically synthesized
gcatagtctcttagctcata

SEQ ID NO: 190575 - DNA, 20 bp, Artificial Sequence
  chemically synthesized
ttgtagttaccatatgagct

SEQ ID NO: 190576 - DNA, 20 bp, Artificial Sequence
  chemically synthesized
gtagttaccatatgagctaa

SEQ ID NO: 190577 - DNA, 20 bp, Artificial Sequence
  chemically synthesized
ttaacactagcatagtctct

SEQ ID NO: 190578 - DNA, 20 bp, Artificial Sequence
  chemically synthesized
tatgagctaagagactatgc

SEQ ID NO: 190579 - DNA, 20 bp, Artificial Sequence
  chemically synthesized
aggcaaccttaacactagca

SEQ ID NO: 190580 - DNA, 20 bp, Artificial Sequence
  chemically synthesized
taagagactatgctagtgtt

SEQ ID NO: 190581 - DNA, 20 bp, Artificial Sequence
  chemically synthesized
aagagactatgctagtgtta

SEQ ID NO: 190582 - DNA, 20 bp, Artificial Sequence
  chemically synthesized
tataaaggcaaccttaacac

SEQ ID NO: 190583 - DNA, 20 bp, Artificial Sequence
  chemically synthesized
tagtgttaaggttgccttta

SEQ ID NO: 190584 - DNA, 20 bp, Artificial Sequence
  chemically synthesized
caggtataatcatactataa

SEQ ID NO: 190585 - DNA, 20 bp, Artificial Sequence
  chemically synthesized
acaggtataatcatactata

SEQ ID NO: 190586 - DNA, 20 bp, Artificial Sequence
  chemically synthesized
cttagagcaaggaaaataac

SEQ ID NO: 190587 - DNA, 20 bp, Artificial Sequence
  chemically synthesized
acttagagcaaggaaaataa

SEQ ID NO: 190588 - DNA, 20 bp, Artificial Sequence
  chemically synthesized
cctgttattttccttgctct

SEQ ID NO: 190589 - DNA, 20 bp, Artificial Sequence
  chemically synthesized
atgccaacaaacttagagca

SEQ ID NO: 190590 - DNA, 20 bp, Artificial Sequence
  chemically synthesized
aatgccaacaaacttagagc

SEQ ID NO: 190591 - DNA, 20 bp, Artificial Sequence
  chemically synthesized
gtgaaatgccaacaaactta

SEQ ID NO: 190592 - DNA, 20 bp, Artificial Sequence
  chemically synthesized
tttccttgctctaagtttgt

SEQ ID NO: 190593 - DNA, 20 bp, Artificial Sequence
  chemically synthesized
ttgtgaaatgccaacaaact

SEQ ID NO: 190594 - DNA, 20 bp, Artificial Sequence
  chemically synthesized
taagtttgttggcatttcac

SEQ ID NO: 190595 - DNA, 20 bp, Artificial Sequence
  chemically synthesized
aaataatacgtacaaccaca

SEQ ID NO: 190596 - DNA, 20 bp, Artificial Sequence
  chemically synthesized
cacagctcaagttaactttg

SEQ ID NO: 190597 - DNA, 20 bp, Artificial Sequence
  chemically synthesized
tacaaccacaaagttaactt

SEQ ID NO: 190598 - DNA, 20 bp, Artificial Sequence
  chemically synthesized
ttttctcataatcacagctc

SEQ ID NO: 190599 - DNA, 20 bp, Artificial Sequence
  chemically synthesized
ttaacttgagctgtgattat

SEQ ID NO: 190600 - DNA, 20 bp, Artificial Sequence
  chemically synthesized
gtaccattttctcataatca

SEQ ID NO: 190601 - DNA, 20 bp, Artificial Sequence
  chemically synthesized
gagctgtgattatgagaaaa

SEQ ID NO: 190602 - DNA, 20 bp, Artificial Sequence
  chemically synthesized
ttatgagaaaatggtacaat

SEQ ID NO: 190603 - DNA, 20 bp, Artificial Sequence
  chemically synthesized
agaaaatggtacaataagtt

SEQ ID NO: 190604 - DNA, 20 bp, Artificial Sequence
  chemically synthesized
agcaacacatttaaaacaaa

SEQ ID NO: 190605 - DNA, 20 bp, Artificial Sequence
  chemically synthesized
aaactgtaccgcatgaaatt

SEQ ID NO: 190606 - DNA, 20 bp, Artificial Sequence
  chemically synthesized
ttcaattactcaatttcatg

SEQ ID NO: 190607 - DNA, 20 bp, Artificial Sequence
  chemically synthesized
ttactcaatttcatgcggta

SEQ ID NO: 190608 - DNA, 20 bp, Artificial Sequence
  chemically synthesized
cggtacagttttaacattgc

SEQ ID NO: 190609 - DNA, 20 bp, Artificial Sequence
  chemically synthesized
tatttaatctgaggatgtac

SEQ ID NO: 190610 - DNA, 20 bp, Artificial Sequence
  chemically synthesized
taacattgctagtacatcct

SEQ ID NO: 190611 - DNA, 20 bp, Artificial Sequence
  chemically synthesized
gttttcgtatatttaatctg

SEQ ID NO: 190612 - DNA, 20 bp, Artificial Sequence
  chemically synthesized
tgttttcgtatatttaatct

SEQ ID NO: 190613 - DNA, 20 bp, Artificial Sequence
  chemically synthesized
aaaacattaataactcacgt

SEQ ID NO: 190614 - DNA, 20 bp, Artificial Sequence
  chemically synthesized
gccttacaccttgcttacgt

SEQ ID NO: 190615 - DNA, 20 bp, Artificial Sequence
  chemically synthesized
cattaataactcacgtaagc

SEQ ID NO: 190616 - DNA, 20 bp, Artificial Sequence
  chemically synthesized
attaataactcacgtaagca

SEQ ID NO: 190617 - DNA, 20 bp, Artificial Sequence
  chemically synthesized
aactcacgtaagcaaggtgt

SEQ ID NO: 190618 - DNA, 20 bp, Artificial Sequence
  chemically synthesized
actcacgtaagcaaggtgta

SEQ ID NO: 190619 - DNA, 20 bp, Artificial Sequence
  chemically synthesized
cacgtaagcaaggtgtaagg

SEQ ID NO: 190620 - DNA, 20 bp, Artificial Sequence
  chemically synthesized
tagcatactttacacgtggt

SEQ ID NO: 190621 - DNA, 20 bp, Artificial Sequence
  chemically synthesized
gtagcatactttacacgtgg

SEQ ID NO: 190622 - DNA, 20 bp, Artificial Sequence
  chemically synthesized
tacacatcctaccacgtgta

SEQ ID NO: 190623 - DNA, 20 bp, Artificial Sequence
  chemically synthesized
ttagtagcatactttacacg

SEQ ID NO: 190624 - DNA, 20 bp, Artificial Sequence
  chemically synthesized
ttattttaattcagatttag

SEQ ID NO: 190625 - DNA, 20 bp, Artificial Sequence
  chemically synthesized
tatttattttaattcagatt

SEQ ID NO: 190626 - DNA, 20 bp, Artificial Sequence
  chemically synthesized
atcttatatttattttaatt

SEQ ID NO: 190627 - DNA, 20 bp, Artificial Sequence
  chemically synthesized
atctgaattaaaataaatat

SEQ ID NO: 190628 - DNA, 20 bp, Artificial Sequence
  chemically synthesized
gttaacctactagaaagtaa

SEQ ID NO: 190629 - DNA, 20 bp, Artificial Sequence
  chemically synthesized
aagattaaactattactttc

SEQ ID NO: 190630 - DNA, 20 bp, Artificial Sequence
  chemically synthesized
attaaactattactttctag

SEQ ID NO: 190631 - DNA, 20 bp, Artificial Sequence
  chemically synthesized
ttaaactattactttctagt

SEQ ID NO: 190632 - DNA, 20 bp, Artificial Sequence
  chemically synthesized
cggagtgttaacctactaga

SEQ ID NO: 190633 - DNA, 20 bp, Artificial Sequence
  chemically synthesized
ctcacggagtgttaacctac

SEQ ID NO: 190634 - DNA, 20 bp, Artificial Sequence
  chemically synthesized
ctagtaggttaacactccgt

SEQ ID NO: 190635 - DNA, 20 bp, Artificial Sequence
  chemically synthesized
tagtaggttaacactccgtg

SEQ ID NO: 190636 - DNA, 20 bp, Artificial Sequence
  chemically synthesized
ttacatcttgtttcctcacg

SEQ ID NO: 190637 - DNA, 20 bp, Artificial Sequence
  chemically synthesized
gcttacatcttgtttcctca

SEQ ID NO: 190638 - DNA, 20 bp, Artificial Sequence
  chemically synthesized
ttaacactccgtgaggaaac

SEQ ID NO: 190639 - DNA, 20 bp, Artificial Sequence
  chemically synthesized
tccgtgaggaaacaagatgt

SEQ ID NO: 190640 - DNA, 20 bp, Artificial Sequence
  chemically synthesized
acaagatgtaagcatataaa

SEQ ID NO: 190641 - DNA, 20 bp, Artificial Sequence
  chemically synthesized
agcatataaaaagtcaaata

SEQ ID NO: 190642 - DNA, 20 bp, Artificial Sequence
  chemically synthesized
taaagttttaattaatgttc

SEQ ID NO: 190643 - DNA, 20 bp, Artificial Sequence
  chemically synthesized
ttaattaatgttcaagacaa

SEQ ID NO: 190644 - DNA, 20 bp, Artificial Sequence
  chemically synthesized
attaatgttcaagacaatag

SEQ ID NO: 190645 - DNA, 20 bp, Artificial Sequence
  chemically synthesized
aatcaatttggaaattcatc

SEQ ID NO: 190646 - DNA, 20 bp, Artificial Sequence
  chemically synthesized
taatcaatttggaaattcat

SEQ ID NO: 190647 - DNA, 20 bp, Artificial Sequence
  chemically synthesized
ttttgtctgtataatcaatt

SEQ ID NO: 190648 - DNA, 20 bp, Artificial Sequence
  chemically synthesized
gaatttccaaattgattata

SEQ ID NO: 190649 - DNA, 20 bp, Artificial Sequence
  chemically synthesized
attatacagacaaaatattg

SEQ ID NO: 190650 - DNA, 20 bp, Artificial Sequence
  chemically synthesized
acagacaaaatattgtagtt

SEQ ID NO: 190651 - DNA, 20 bp, Artificial Sequence
  chemically synthesized
agacaaaatattgtagttca

SEQ ID NO: 190652 - DNA, 20 bp, Artificial Sequence
  chemically synthesized
acaaaatattgtagttcaga

SEQ ID NO: 190653 - DNA, 20 bp, Artificial Sequence
  chemically synthesized
aaaatattgtagttcagaga

SEQ ID NO: 190654 - DNA, 20 bp, Artificial Sequence
  chemically synthesized
agttcagagagagatcttca

SEQ ID NO: 190655 - DNA, 20 bp, Artificial Sequence
  chemically synthesized
ccttttgtttgtcatctttg

SEQ ID NO: 190656 - DNA, 20 bp, Artificial Sequence
  chemically synthesized
tcttcaaagatgacaaacaa

SEQ ID NO: 190657 - DNA, 20 bp, Artificial Sequence
  chemically synthesized
cttcaaagatgacaaacaaa

SEQ ID NO: 190658 - DNA, 20 bp, Artificial Sequence
  chemically synthesized
gacaaacaaaaggtctacaa

SEQ ID NO: 190659 - DNA, 20 bp, Artificial Sequence
  chemically synthesized
actcataaattattcttttg

SEQ ID NO: 190660 - DNA, 20 bp, Artificial Sequence
  chemically synthesized
tctacaaaagaataatttat

SEQ ID NO: 190661 - DNA, 20 bp, Artificial Sequence
  chemically synthesized
caaaacctgtattggttttc

SEQ ID NO: 190662 - DNA, 20 bp, Artificial Sequence
  chemically synthesized
tcaaaacctgtattggtttt

SEQ ID NO: 190663 - DNA, 20 bp, Artificial Sequence
  chemically synthesized
agttttcctgaaaaccaata

SEQ ID NO: 190664 - DNA, 20 bp, Artificial Sequence
  chemically synthesized
gttttcctgaaaaccaatac

SEQ ID NO: 190665 - DNA, 20 bp, Artificial Sequence
  chemically synthesized
tcaactctcaaaacctgtat

SEQ ID NO: 190666 - DNA, 20 bp, Artificial Sequence
  chemically synthesized
tgaaaaccaatacaggtttt

SEQ ID NO: 190667 - DNA, 20 bp, Artificial Sequence
  chemically synthesized
aaaaccaatacaggttttga

SEQ ID NO: 190668 - DNA, 20 bp, Artificial Sequence
  chemically synthesized
tacaggttttgagagttgat

SEQ ID NO: 190669 - DNA, 20 bp, Artificial Sequence
  chemically synthesized
ttttgagagttgataagaca

SEQ ID NO: 190670 - DNA, 20 bp, Artificial Sequence
  chemically synthesized
gttgataagacatggttgat

SEQ ID NO: 190671 - DNA, 20 bp, Artificial Sequence
  chemically synthesized
acatggttgatgagatgtat

SEQ ID NO: 190672 - DNA, 20 bp, Artificial Sequence
  chemically synthesized
tgagatgtataagaaataaa

SEQ ID NO: 190673 - DNA, 20 bp, Artificial Sequence
  chemically synthesized
gtataagaaataaaaagtgc

SEQ ID NO: 190674 - DNA, 20 bp, Artificial Sequence
  chemically synthesized
aaataaaaagtgcaagaaca

SEQ ID NO: 190675 - DNA, 20 bp, Artificial Sequence
  chemically synthesized
aataaaaagtgcaagaacac

SEQ ID NO: 190676 - DNA, 20 bp, Artificial Sequence
  chemically synthesized
ataaaaagtgcaagaacaca

SEQ ID NO: 190677 - DNA, 20 bp, Artificial Sequence
  chemically synthesized
taaaaagtgcaagaacacag

SEQ ID NO: 190678 - DNA, 20 bp, Artificial Sequence
  chemically synthesized
aaaaagtgcaagaacacagg

SEQ ID NO: 190679 - DNA, 20 bp, Artificial Sequence
  chemically synthesized
gatttatgacgcataatatt

SEQ ID NO: 190680 - DNA, 20 bp, Artificial Sequence
  chemically synthesized
atattgagattatattaaaa

SEQ ID NO: 190681 - DNA, 20 bp, Artificial Sequence
  chemically synthesized
tattgagattatattaaaac

SEQ ID NO: 190682 - DNA, 20 bp, Artificial Sequence
  chemically synthesized
ttaaaacaggcattgaatat

SEQ ID NO: 190683 - DNA, 20 bp, Artificial Sequence
  chemically synthesized
taaaacaggcattgaatatc

SEQ ID NO: 190684 - DNA, 20 bp, Artificial Sequence
  chemically synthesized
aacaggcattgaatatcagg

SEQ ID NO: 190685 - DNA, 20 bp, Artificial Sequence
  chemically synthesized
acaggcattgaatatcagga

SEQ ID NO: 190686 - DNA, 20 bp, Artificial Sequence
  chemically synthesized
caggcattgaatatcaggaa

SEQ ID NO: 190687 - DNA, 20 bp, Artificial Sequence
  chemically synthesized
caggaagggtgattttatac

SEQ ID NO: 190688 - DNA, 20 bp, Artificial Sequence
  chemically synthesized
tcccctctatttacaagatc

SEQ ID NO: 190689 - DNA, 20 bp, Artificial Sequence
  chemically synthesized
tttataccagatcttgtaaa

SEQ ID NO: 190690 - DNA, 20 bp, Artificial Sequence
  chemically synthesized
tataccagatcttgtaaata

SEQ ID NO: 190691 - DNA, 20 bp, Artificial Sequence
  chemically synthesized
agtagatcccctctatttac

SEQ ID NO: 190692 - DNA, 20 bp, Artificial Sequence
  chemically synthesized
ataccagatcttgtaaatag

SEQ ID NO: 190693 - DNA, 20 bp, Artificial Sequence
  chemically synthesized
taccagatcttgtaaataga

SEQ ID NO: 190694 - DNA, 20 bp, Artificial Sequence
  chemically synthesized
accagatcttgtaaatagag

SEQ ID NO: 190695 - DNA, 20 bp, Artificial Sequence
  chemically synthesized
taaatagaggggatctacta

SEQ ID NO: 190696 - DNA, 20 bp, Artificial Sequence
  chemically synthesized
aaatagaggggatctactac

SEQ ID NO: 190697 - DNA, 20 bp, Artificial Sequence
  chemically synthesized
tgtctccttaaaacctgtag

SEQ ID NO: 190698 - DNA, 20 bp, Artificial Sequence
  chemically synthesized
gtttgtctccttaaaacctg

SEQ ID NO: 190699 - DNA, 20 bp, Artificial Sequence
  chemically synthesized
ggggatctactacaggtttt

SEQ ID NO: 190700 - DNA, 20 bp, Artificial Sequence
  chemically synthesized
gggatctactacaggtttta

SEQ ID NO: 190701 - DNA, 20 bp, Artificial Sequence
  chemically synthesized
gatctactacaggttttaag

SEQ ID NO: 190702 - DNA, 20 bp, Artificial Sequence
  chemically synthesized
tatgataaatgttattttta

SEQ ID NO: 190703 - DNA, 20 bp, Artificial Sequence
  chemically synthesized
gttatttttatggctgatca

SEQ ID NO: 190704 - DNA, 20 bp, Artificial Sequence
  chemically synthesized
tccatttataatactgtgat

SEQ ID NO: 190705 - DNA, 20 bp, Artificial Sequence
  chemically synthesized
gctgatcacagtattataaa

SEQ ID NO: 190706 - DNA, 20 bp, Artificial Sequence
  chemically synthesized
tcacagtattataaatggat

SEQ ID NO: 190707 - DNA, 20 bp, Artificial Sequence
  chemically synthesized
gtattataaatggattggaa

SEQ ID NO: 190708 - DNA, 20 bp, Artificial Sequence
  chemically synthesized
atggataatgtgattacaaa

SEQ ID NO: 190709 - DNA, 20 bp, Artificial Sequence
  chemically synthesized
ataatgtgattacaaatgga

SEQ ID NO: 190710 - DNA, 20 bp, Artificial Sequence
  chemically synthesized
taatgtgattacaaatggaa

SEQ ID NO: 190711 - DNA, 20 bp, Artificial Sequence
  chemically synthesized
gtgattacaaatggaaagga

SEQ ID NO: 190712 - DNA, 20 bp, Artificial Sequence
  chemically synthesized
attacaaatggaaaggaaag

SEQ ID NO: 190713 - DNA, 20 bp, Artificial Sequence
  chemically synthesized
ttacaaatggaaaggaaagc

SEQ ID NO: 190714 - DNA, 20 bp, Artificial Sequence
  chemically synthesized
caaatggaaaggaaagcagg

SEQ ID NO: 190715 - DNA, 20 bp, Artificial Sequence
  chemically synthesized
tggaaaggaaagcaggcaga

SEQ ID NO: 190716 - DNA, 20 bp, Artificial Sequence
  chemically synthesized
aggaaagcaggcagaaagac

SEQ ID NO: 190717 - DNA, 20 bp, Artificial Sequence
  chemically synthesized
agcaggcagaaagaccagac

SEQ ID NO: 190718 - DNA, 20 bp, Artificial Sequence
  chemically synthesized
aggcagaaagaccagaccag

SEQ ID NO: 190719 - DNA, 20 bp, Artificial Sequence
  chemically synthesized
cgttgtaattgccactggtc

SEQ ID NO: 190720 - DNA, 20 bp, Artificial Sequence
  chemically synthesized
ccttacgttgtaattgccac

SEQ ID NO: 190721 - DNA, 20 bp, Artificial Sequence
  chemically synthesized
accagtggcaattacaacgt

SEQ ID NO: 190722 - DNA, 20 bp, Artificial Sequence
  chemically synthesized
ccagtggcaattacaacgta

SEQ ID NO: 190723 - DNA, 20 bp, Artificial Sequence
  chemically synthesized
aagttcttagataaaagtca

SEQ ID NO: 190724 - DNA, 20 bp, Artificial Sequence
  chemically synthesized
aggtactatgacttttatct

SEQ ID NO: 190725 - DNA, 20 bp, Artificial Sequence
  chemically synthesized
ttttccaagttcttagataa

SEQ ID NO: 190726 - DNA, 20 bp, Artificial Sequence
  chemically synthesized
atgacttttatctaagaact

SEQ ID NO: 190727 - DNA, 20 bp, Artificial Sequence
  chemically synthesized
ctcttttttttccaagttct

SEQ ID NO: 190728 - DNA, 20 bp, Artificial Sequence
  chemically synthesized
tcagtacctcttttttttcc

SEQ ID NO: 190729 - DNA, 20 bp, Artificial Sequence
  chemically synthesized
atctaagaacttggaaaaaa

SEQ ID NO: 190730 - DNA, 20 bp, Artificial Sequence
  chemically synthesized
ctaagaacttggaaaaaaaa

SEQ ID NO: 190731 - DNA, 20 bp, Artificial Sequence
  chemically synthesized
taagaacttggaaaaaaaag

SEQ ID NO: 190732 - DNA, 20 bp, Artificial Sequence
  chemically synthesized
ttggaaaaaaaagaggtact

SEQ ID NO: 190733 - DNA, 20 bp, Artificial Sequence
  chemically synthesized
gaaaaaaaagaggtactgag

SEQ ID NO: 190734 - DNA, 20 bp, Artificial Sequence
  chemically synthesized
aaaaaaaagaggtactgaga

SEQ ID NO: 190735 - DNA, 20 bp, Artificial Sequence
  chemically synthesized
caggctacacttttccttct

SEQ ID NO: 190736 - DNA, 20 bp, Artificial Sequence
  chemically synthesized
aaagaggtactgagaaggaa

SEQ ID NO: 190737 - DNA, 20 bp, Artificial Sequence
  chemically synthesized
ggtactgagaaggaaaagtg

SEQ ID NO: 190738 - DNA, 20 bp, Artificial Sequence
  chemically synthesized
aaggaaaagtgtagcctgca

SEQ ID NO: 190739 - DNA, 20 bp, Artificial Sequence
  chemically synthesized
aggaaaagtgtagcctgcaa

SEQ ID NO: 190740 - DNA, 20 bp, Artificial Sequence
  chemically synthesized
gaaaagtgtagcctgcaaag

SEQ ID NO: 190741 - DNA, 20 bp, Artificial Sequence
  chemically synthesized
aaaagtgtagcctgcaaagg

SEQ ID NO: 190742 - DNA, 20 bp, Artificial Sequence
  chemically synthesized
cacttttgctcctcctttgc

SEQ ID NO: 190743 - DNA, 20 bp, Artificial Sequence
  chemically synthesized
ccacttttgctcctcctttg

SEQ ID NO: 190744 - DNA, 20 bp, Artificial Sequence
  chemically synthesized
aagtgtagcctgcaaaggag

SEQ ID NO: 190745 - DNA, 20 bp, Artificial Sequence
  chemically synthesized
agcctgcaaaggaggagcaa

SEQ ID NO: 190746 - DNA, 20 bp, Artificial Sequence
  chemically synthesized
ctgcaaaggaggagcaaaag

SEQ ID NO: 190747 - DNA, 20 bp, Artificial Sequence
  chemically synthesized
tgcaaaggaggagcaaaagt

SEQ ID NO: 190748 - DNA, 20 bp, Artificial Sequence
  chemically synthesized
aaagtgggtttgaaccttaa

SEQ ID NO: 190749 - DNA, 20 bp, Artificial Sequence
  chemically synthesized
aagtgggtttgaaccttaat

SEQ ID NO: 190750 - DNA, 20 bp, Artificial Sequence
  chemically synthesized
ctgttccttccaacctatta

SEQ ID NO: 190751 - DNA, 20 bp, Artificial Sequence
  chemically synthesized
gggtttgaaccttaataggt

SEQ ID NO: 190752 - DNA, 20 bp, Artificial Sequence
  chemically synthesized
cctgttccttccaacctatt

SEQ ID NO: 190753 - DNA, 20 bp, Artificial Sequence
  chemically synthesized
tttgaaccttaataggttgg

SEQ ID NO: 190754 - DNA, 20 bp, Artificial Sequence
  chemically synthesized
ttgaaccttaataggttgga

SEQ ID NO: 190755 - DNA, 20 bp, Artificial Sequence
  chemically synthesized
ccttaataggttggaaggaa

SEQ ID NO: 190756 - DNA, 20 bp, Artificial Sequence
  chemically synthesized
cttaataggttggaaggaac

SEQ ID NO: 190757 - DNA, 20 bp, Artificial Sequence
  chemically synthesized
aataggttggaaggaacagg

SEQ ID NO: 190758 - DNA, 20 bp, Artificial Sequence
  chemically synthesized
aaggaacaggaagtcaattg

SEQ ID NO: 190759 - DNA, 20 bp, Artificial Sequence
  chemically synthesized
aggaacaggaagtcaattgt

SEQ ID NO: 190760 - DNA, 20 bp, Artificial Sequence
  chemically synthesized
ggaacaggaagtcaattgtg

SEQ ID NO: 190761 - DNA, 20 bp, Artificial Sequence
  chemically synthesized
gtcaattgtggggatgactt

SEQ ID NO: 190762 - DNA, 20 bp, Artificial Sequence
  chemically synthesized
caattgtggggatgactttg

SEQ ID NO: 190763 - DNA, 20 bp, Artificial Sequence
  chemically synthesized
aattgtggggatgactttgg

SEQ ID NO: 190764 - DNA, 20 bp, Artificial Sequence
  chemically synthesized
attgtggggatgactttgga

SEQ ID NO: 190765 - DNA, 20 bp, Artificial Sequence
  chemically synthesized
ttgtggggatgactttggag

SEQ ID NO: 190766 - DNA, 20 bp, Artificial Sequence
  chemically synthesized
gtggggatgactttggaggg

SEQ ID NO: 190767 - DNA, 20 bp, Artificial Sequence
  chemically synthesized
catccctgctctcccctcca

SEQ ID NO: 190768 - DNA, 20 bp, Artificial Sequence
  chemically synthesized
ggggatgactttggagggga

SEQ ID NO: 190769 - DNA, 20 bp, Artificial Sequence
  chemically synthesized
gatgactttggaggggagag

SEQ ID NO: 190770 - DNA, 20 bp, Artificial Sequence
  chemically synthesized
atgactttggaggggagagc

SEQ ID NO: 190771 - DNA, 20 bp, Artificial Sequence
  chemically synthesized
tgactttggaggggagagca

SEQ ID NO: 190772 - DNA, 20 bp, Artificial Sequence
  chemically synthesized
agagcagggatgaatttgca

SEQ ID NO: 190773 - DNA, 20 bp, Artificial Sequence
  chemically synthesized
gatgaatttgcaaagtcata

SEQ ID NO: 190774 - DNA, 20 bp, Artificial Sequence
  chemically synthesized
gcaaagtcatatggaaactg

SEQ ID NO: 190775 - DNA, 20 bp, Artificial Sequence
  chemically synthesized
tggatatctccgtatgaccg

SEQ ID NO: 190776 - DNA, 20 bp, Artificial Sequence
  chemically synthesized
atatggaaactgcggtcata

SEQ ID NO: 190777 - DNA, 20 bp, Artificial Sequence
  chemically synthesized
atggaaactgcggtcatacg

SEQ ID NO: 190778 - DNA, 20 bp, Artificial Sequence
  chemically synthesized
tactacctggacatgacatg

SEQ ID NO: 190779 - DNA, 20 bp, Artificial Sequence
  chemically synthesized
agatatccacatgtcatgtc

SEQ ID NO: 190780 - DNA, 20 bp, Artificial Sequence
  chemically synthesized
gatatccacatgtcatgtcc

SEQ ID NO: 190781 - DNA, 20 bp, Artificial Sequence
  chemically synthesized
atccacatgtcatgtccagg

SEQ ID NO: 190782 - DNA, 20 bp, Artificial Sequence
  chemically synthesized
cacatgtcatgtccaggtag

SEQ ID NO: 190783 - DNA, 20 bp, Artificial Sequence
  chemically synthesized
acatgtcatgtccaggtagt

SEQ ID NO: 190784 - DNA, 20 bp, Artificial Sequence
  chemically synthesized
catgtcatgtccaggtagta

SEQ ID NO: 190785 - DNA, 20 bp, Artificial Sequence
  chemically synthesized
gtatttctagccctactacc

SEQ ID NO: 190786 - DNA, 20 bp, Artificial Sequence
  chemically synthesized
tcatgtccaggtagtagggc

SEQ ID NO: 190787 - DNA, 20 bp, Artificial Sequence
  chemically synthesized
aggtagtagggctagaaata

SEQ ID NO: 190788 - DNA, 20 bp, Artificial Sequence
  chemically synthesized
ggtagtagggctagaaatac

SEQ ID NO: 190789 - DNA, 20 bp, Artificial Sequence
  chemically synthesized
tctgttccaacctgtatttc

SEQ ID NO: 190790 - DNA, 20 bp, Artificial Sequence
  chemically synthesized
gtagggctagaaatacaggt

SEQ ID NO: 190791 - DNA, 20 bp, Artificial Sequence
  chemically synthesized
gctagaaatacaggttggaa

SEQ ID NO: 190792 - DNA, 20 bp, Artificial Sequence
  chemically synthesized
tagaaatacaggttggaaca

SEQ ID NO: 190793 - DNA, 20 bp, Artificial Sequence
  chemically synthesized
gttggaacagagataaaaaa

SEQ ID NO: 190794 - DNA, 20 bp, Artificial Sequence
  chemically synthesized
ttggaacagagataaaaaac

SEQ ID NO: 190795 - DNA, 20 bp, Artificial Sequence
  chemically synthesized
aacagagataaaaaacagga

SEQ ID NO: 190796 - DNA, 20 bp, Artificial Sequence
  chemically synthesized
gataaaaaacaggatagcca

SEQ ID NO: 190797 - DNA, 20 bp, Artificial Sequence
  chemically synthesized
aaaaacaggatagccaaagc

SEQ ID NO: 190798 - DNA, 20 bp, Artificial Sequence
  chemically synthesized
aacaggatagccaaagccag

SEQ ID NO: 190799 - DNA, 20 bp, Artificial Sequence
  chemically synthesized
tacatctcatcttctggctt

SEQ ID NO: 190800 - DNA, 20 bp, Artificial Sequence
  chemically synthesized
gatagccaaagccagaagat

SEQ ID NO: 190801 - DNA, 20 bp, Artificial Sequence
  chemically synthesized
tttgtttacatctcatcttc

SEQ ID NO: 190802 - DNA, 20 bp, Artificial Sequence
  chemically synthesized
cagaagatgagatgtaaaca

SEQ ID NO: 190803 - DNA, 20 bp, Artificial Sequence
  chemically synthesized
agaagatgagatgtaaacaa

SEQ ID NO: 190804 - DNA, 20 bp, Artificial Sequence
  chemically synthesized
gatgagatgtaaacaaaggt

SEQ ID NO: 190805 - DNA, 20 bp, Artificial Sequence
  chemically synthesized
atgagatgtaaacaaaggtg

SEQ ID NO: 190806 - DNA, 20 bp, Artificial Sequence
  chemically synthesized
gatgtaaacaaaggtgaggt

SEQ ID NO: 190807 - DNA, 20 bp, Artificial Sequence
  chemically synthesized
tgtaaacaaaggtgaggtca

SEQ ID NO: 190808 - DNA, 20 bp, Artificial Sequence
  chemically synthesized
aacaaaggtgaggtcagagt

SEQ ID NO: 190809 - DNA, 20 bp, Artificial Sequence
  chemically synthesized
aaggtgaggtcagagtgaga

SEQ ID NO: 190810 - DNA, 20 bp, Artificial Sequence
  chemically synthesized
ggtgaggtcagagtgagaaa

SEQ ID NO: 190811 - DNA, 20 bp, Artificial Sequence
  chemically synthesized
agtgagaaagagaaaacaat

SEQ ID NO: 190812 - DNA, 20 bp, Artificial Sequence
  chemically synthesized
tgtgtcaaaatcatcagttg

SEQ ID NO: 190813 - DNA, 20 bp, Artificial Sequence
  chemically synthesized
atgtgtcaaaatcatcagtt

SEQ ID NO: 190814 - DNA, 20 bp, Artificial Sequence
  chemically synthesized
ctctcatgtgtcaaaatcat

SEQ ID NO: 190815 - DNA, 20 bp, Artificial Sequence
  chemically synthesized
aactgatgattttgacacat

SEQ ID NO: 190816 - DNA, 20 bp, Artificial Sequence
  chemically synthesized
ctgatgattttgacacatga

SEQ ID NO: 190817 - DNA, 20 bp, Artificial Sequence
  chemically synthesized
tgatgattttgacacatgag

SEQ ID NO: 190818 - DNA, 20 bp, Artificial Sequence
  chemically synthesized
acatgagaggaataaaaaac

SEQ ID NO: 190819 - DNA, 20 bp, Artificial Sequence
  chemically synthesized
catgagaggaataaaaaact

SEQ ID NO: 190820 - DNA, 20 bp, Artificial Sequence
  chemically synthesized
tttagcttctgtaatattcc

SEQ ID NO: 190821 - DNA, 20 bp, Artificial Sequence
  chemically synthesized
ataaaaaactaggaatatta

SEQ ID NO: 190822 - DNA, 20 bp, Artificial Sequence
  chemically synthesized
aaaaactaggaatattacag

SEQ ID NO: 190823 - DNA, 20 bp, Artificial Sequence
  chemically synthesized
taggaatattacagaagcta

SEQ ID NO: 190824 - DNA, 20 bp, Artificial Sequence
  chemically synthesized
aggaatattacagaagctaa

SEQ ID NO: 190825 - DNA, 20 bp, Artificial Sequence
  chemically synthesized
ggaatattacagaagctaaa

SEQ ID NO: 190826 - DNA, 20 bp, Artificial Sequence
  chemically synthesized
ttttaaagtctgtaaccctt

SEQ ID NO: 190827 - DNA, 20 bp, Artificial Sequence
  chemically synthesized
ttacagaagctaaagggtta

SEQ ID NO: 190828 - DNA, 20 bp, Artificial Sequence
  chemically synthesized
ttccttttttttttttttta

SEQ ID NO: 190829 - DNA, 20 bp, Artificial Sequence
  chemically synthesized
agactttaaaaaaaaaaaaa

SEQ ID NO: 190830 - DNA, 20 bp, Artificial Sequence
  chemically synthesized
gactttaaaaaaaaaaaaaa

SEQ ID NO: 190831 - DNA, 20 bp, Artificial Sequence
  chemically synthesized
tttaaaaaaaaaaaaaaagg

SEQ ID NO: 190832 - DNA, 20 bp, Artificial Sequence
  chemically synthesized
ttaaaaaaaaaaaaaaagga

SEQ ID NO: 190833 - DNA, 20 bp, Artificial Sequence
  chemically synthesized
taaaaaaaaaaaaaaaggaa

SEQ ID NO: 190834 - DNA, 20 bp, Artificial Sequence
  chemically synthesized
aaaaaaaaaaaaaaaggaag

SEQ ID NO: 190835 - DNA, 20 bp, Artificial Sequence
  chemically synthesized
aaaaaggaaggggaatatcg

SEQ ID NO: 190836 - DNA, 20 bp, Artificial Sequence
  chemically synthesized
aaggaaggggaatatcgcag

SEQ ID NO: 190837 - DNA, 20 bp, Artificial Sequence
  chemically synthesized
atatcgcagtggtattgaac

SEQ ID NO: 190838 - DNA, 20 bp, Artificial Sequence
  chemically synthesized
tggtattgaacaagataaaa

SEQ ID NO: 190839 - DNA, 20 bp, Artificial Sequence
  chemically synthesized
tattgaacaagataaaatgg

SEQ ID NO: 190840 - DNA, 20 bp, Artificial Sequence
  chemically synthesized
ttgaacaagataaaatggca

SEQ ID NO: 190841 - DNA, 20 bp, Artificial Sequence
  chemically synthesized
aacaagataaaatggcagag

SEQ ID NO: 190842 - DNA, 20 bp, Artificial Sequence
  chemically synthesized
taaaatggcagagaagccaa

SEQ ID NO: 190843 - DNA, 20 bp, Artificial Sequence
  chemically synthesized
ggcagagaagccaatggatt

SEQ ID NO: 190844 - DNA, 20 bp, Artificial Sequence
  chemically synthesized
aatgtatttgccaaatccat

SEQ ID NO: 190845 - DNA, 20 bp, Artificial Sequence
  chemically synthesized
tacattattgttgattttga

SEQ ID NO: 190846 - DNA, 20 bp, Artificial Sequence
  chemically synthesized
gattttgaaagtttattcta

SEQ ID NO: 190847 - DNA, 20 bp, Artificial Sequence
  chemically synthesized
gggcattccttaaatagctg

SEQ ID NO: 190848 - DNA, 20 bp, Artificial Sequence
  chemically synthesized
agtttattctacagctattt

SEQ ID NO: 190849 - DNA, 20 bp, Artificial Sequence
  chemically synthesized
gtttattctacagctattta

SEQ ID NO: 190850 - DNA, 20 bp, Artificial Sequence
  chemically synthesized
cataatgggcattccttaaa

SEQ ID NO: 190851 - DNA, 20 bp, Artificial Sequence
  chemically synthesized
aacagtgcttggaacataat

SEQ ID NO: 190852 - DNA, 20 bp, Artificial Sequence
  chemically synthesized
gaacagtgcttggaacataa

SEQ ID NO: 190853 - DNA, 20 bp, Artificial Sequence
  chemically synthesized
aggaatgcccattatgttcc

SEQ ID NO: 190854 - DNA, 20 bp, Artificial Sequence
  chemically synthesized
ttagaacatggaacagtgct

SEQ ID NO: 190855 - DNA, 20 bp, Artificial Sequence
  chemically synthesized
cgtatctttagaacatggaa

SEQ ID NO: 190856 - DNA, 20 bp, Artificial Sequence
  chemically synthesized
aagcactgttccatgttcta

SEQ ID NO: 190857 - DNA, 20 bp, Artificial Sequence
  chemically synthesized
actgccgtatctttagaaca

SEQ ID NO: 190858 - DNA, 20 bp, Artificial Sequence
  chemically synthesized
tgttccatgttctaaagata

SEQ ID NO: 190859 - DNA, 20 bp, Artificial Sequence
  chemically synthesized
agagctcactgccgtatctt

SEQ ID NO: 190860 - DNA, 20 bp, Artificial Sequence
  chemically synthesized
tccatgttctaaagatacgg

SEQ ID NO: 190861 - DNA, 20 bp, Artificial Sequence
  chemically synthesized
tgttctaaagatacggcagt

SEQ ID NO: 190862 - DNA, 20 bp, Artificial Sequence
  chemically synthesized
gatacggcagtgagctctca

SEQ ID NO: 190863 - DNA, 20 bp, Artificial Sequence
  chemically synthesized
tgccttcataaattccatga

SEQ ID NO: 190864 - DNA, 20 bp, Artificial Sequence
  chemically synthesized
gttgccttcataaattccat

SEQ ID NO: 190865 - DNA, 20 bp, Artificial Sequence
  chemically synthesized
gagctctcatggaatttatg

SEQ ID NO: 190866 - DNA, 20 bp, Artificial Sequence
  chemically synthesized
agctctcatggaatttatga

SEQ ID NO: 190867 - DNA, 20 bp, Artificial Sequence
  chemically synthesized
gcaacataaaataaacaact

SEQ ID NO: 190868 - DNA, 20 bp, Artificial Sequence
  chemically synthesized
gtatcatgcatcggttttct

SEQ ID NO: 190869 - DNA, 20 bp, Artificial Sequence
  chemically synthesized
tatcaccttgtatcatgcat

SEQ ID NO: 190870 - DNA, 20 bp, Artificial Sequence
  chemically synthesized
agaaaaccgatgcatgatac

SEQ ID NO: 190871 - DNA, 20 bp, Artificial Sequence
  chemically synthesized
gaaaaccgatgcatgataca

SEQ ID NO: 190872 - DNA, 20 bp, Artificial Sequence
  chemically synthesized
atgcatgatacaaggtgata

SEQ ID NO: 190873 - DNA, 20 bp, Artificial Sequence
  chemically synthesized
acaaggtgataaagaatatg

SEQ ID NO: 190874 - DNA, 20 bp, Artificial Sequence
  chemically synthesized
aaggtgataaagaatatgaa

SEQ ID NO: 190875 - DNA, 20 bp, Artificial Sequence
  chemically synthesized
atatgaagagacttaaaacg

SEQ ID NO: 190876 - DNA, 20 bp, Artificial Sequence
  chemically synthesized
acttccttacactgcgtttt

SEQ ID NO: 190877 - DNA, 20 bp, Artificial Sequence
  chemically synthesized
agagacttaaaacgcagtgt

SEQ ID NO: 190878 - DNA, 20 bp, Artificial Sequence
  chemically synthesized
gagacttaaaacgcagtgta

SEQ ID NO: 190879 - DNA, 20 bp, Artificial Sequence
  chemically synthesized
acttaaaacgcagtgtaagg

SEQ ID NO: 190880 - DNA, 20 bp, Artificial Sequence
  chemically synthesized
taaaacgcagtgtaaggaag

SEQ ID NO: 190881 - DNA, 20 bp, Artificial Sequence
  chemically synthesized
aaacgcagtgtaaggaagtg

SEQ ID NO: 190882 - DNA, 20 bp, Artificial Sequence
  chemically synthesized
acgcagtgtaaggaagtgga

SEQ ID NO: 190883 - DNA, 20 bp, Artificial Sequence
  chemically synthesized
agtgtaaggaagtggagagt

SEQ ID NO: 190884 - DNA, 20 bp, Artificial Sequence
  chemically synthesized
aaggaagtggagagtgagaa

SEQ ID NO: 190885 - DNA, 20 bp, Artificial Sequence
  chemically synthesized
gaagtggagagtgagaacag

SEQ ID NO: 190886 - DNA, 20 bp, Artificial Sequence
  chemically synthesized
aagtggagagtgagaacagc

SEQ ID NO: 190887 - DNA, 20 bp, Artificial Sequence
  chemically synthesized
agtggagagtgagaacagca

SEQ ID NO: 190888 - DNA, 20 bp, Artificial Sequence
  chemically synthesized
gtggagagtgagaacagcag

SEQ ID NO: 190889 - DNA, 20 bp, Artificial Sequence
  chemically synthesized
ttacagtgaccacagtaata

SEQ ID NO: 190890 - DNA, 20 bp, Artificial Sequence
  chemically synthesized
aggggattactatattactg

SEQ ID NO: 190891 - DNA, 20 bp, Artificial Sequence
  chemically synthesized
agctcccattacagtgacca

SEQ ID NO: 190892 - DNA, 20 bp, Artificial Sequence
  chemically synthesized
tattactgtggtcactgtaa

SEQ ID NO: 190893 - DNA, 20 bp, Artificial Sequence
  chemically synthesized
attactgtggtcactgtaat

SEQ ID NO: 190894 - DNA, 20 bp, Artificial Sequence
  chemically synthesized
tactgtggtcactgtaatgg

SEQ ID NO: 190895 - DNA, 20 bp, Artificial Sequence
  chemically synthesized
gtgtctattagctcccatta

SEQ ID NO: 190896 - DNA, 20 bp, Artificial Sequence
  chemically synthesized
gtcactgtaatgggagctaa

SEQ ID NO: 190897 - DNA, 20 bp, Artificial Sequence
  chemically synthesized
cttccctcaggagtgtctat

SEQ ID NO: 190898 - DNA, 20 bp, Artificial Sequence
  chemically synthesized
gggagctaatagacactcct

SEQ ID NO: 190899 - DNA, 20 bp, Artificial Sequence
  chemically synthesized
ggagctaatagacactcctg

SEQ ID NO: 190900 - DNA, 20 bp, Artificial Sequence
  chemically synthesized
gagctaatagacactcctga

SEQ ID NO: 190901 - DNA, 20 bp, Artificial Sequence
  chemically synthesized
ctaatagacactcctgaggg

SEQ ID NO: 190902 - DNA, 20 bp, Artificial Sequence
  chemically synthesized
taccctctaacttccctcag

SEQ ID NO: 190903 - DNA, 20 bp, Artificial Sequence
  chemically synthesized
cttaccctctaacttccctc

SEQ ID NO: 190904 - DNA, 20 bp, Artificial Sequence
  chemically synthesized
tcttaccctctaacttccct

SEQ ID NO: 190905 - DNA, 20 bp, Artificial Sequence
  chemically synthesized
tagacactcctgagggaagt

SEQ ID NO: 190906 - DNA, 20 bp, Artificial Sequence
  chemically synthesized
gacactcctgagggaagtta

SEQ ID NO: 190907 - DNA, 20 bp, Artificial Sequence
  chemically synthesized
acactcctgagggaagttag

SEQ ID NO: 190908 - DNA, 20 bp, Artificial Sequence
  chemically synthesized
cactcctgagggaagttaga

SEQ ID NO: 190909 - DNA, 20 bp, Artificial Sequence
  chemically synthesized
cctgagggaagttagagggt

SEQ ID NO: 190910 - DNA, 20 bp, Artificial Sequence
  chemically synthesized
aagttagagggtaagacgtg

SEQ ID NO: 190911 - DNA, 20 bp, Artificial Sequence
  chemically synthesized
tagagggtaagacgtgtgga

SEQ ID NO: 190912 - DNA, 20 bp, Artificial Sequence
  chemically synthesized
gtaagacgtgtggatagctg

SEQ ID NO: 190913 - DNA, 20 bp, Artificial Sequence
  chemically synthesized
gacgtgtggatagctgaaga

SEQ ID NO: 190914 - DNA, 20 bp, Artificial Sequence
  chemically synthesized
gtgtggatagctgaagaaag

SEQ ID NO: 190915 - DNA, 20 bp, Artificial Sequence
  chemically synthesized
gaaattcaaccttctttctt

SEQ ID NO: 190916 - DNA, 20 bp, Artificial Sequence
  chemically synthesized
tgtggatagctgaagaaaga

SEQ ID NO: 190917 - DNA, 20 bp, Artificial Sequence
  chemically synthesized
gaagaaagaaggttgaattt

SEQ ID NO: 190918 - DNA, 20 bp, Artificial Sequence
  chemically synthesized
gaaagaaggttgaatttcag

SEQ ID NO: 190919 - DNA, 20 bp, Artificial Sequence
  chemically synthesized
aaagaaggttgaatttcagc

SEQ ID NO: 190920 - DNA, 20 bp, Artificial Sequence
  chemically synthesized
agaaggttgaatttcagcag

SEQ ID NO: 190921 - DNA, 20 bp, Artificial Sequence
  chemically synthesized
gaaggttgaatttcagcagg

SEQ ID NO: 190922 - DNA, 20 bp, Artificial Sequence
  chemically synthesized
aggaatcaaaaccaaatcta

SEQ ID NO: 190923 - DNA, 20 bp, Artificial Sequence
  chemically synthesized
ctatcctctctctatagatt

SEQ ID NO: 190924 - DNA, 20 bp, Artificial Sequence
  chemically synthesized
gaatcaaaaccaaatctata

SEQ ID NO: 190925 - DNA, 20 bp, Artificial Sequence
  chemically synthesized
atcaaaaccaaatctataga

SEQ ID NO: 190926 - DNA, 20 bp, Artificial Sequence
  chemically synthesized
caaaaccaaatctatagaga

SEQ ID NO: 190927 - DNA, 20 bp, Artificial Sequence
  chemically synthesized
aaaaccaaatctatagagag

SEQ ID NO: 190928 - DNA, 20 bp, Artificial Sequence
  chemically synthesized
ccttcactatcctctctcta

SEQ ID NO: 190929 - DNA, 20 bp, Artificial Sequence
  chemically synthesized
ccaaatctatagagagagga

SEQ ID NO: 190930 - DNA, 20 bp, Artificial Sequence
  chemically synthesized
tctatagagagaggatagtg

SEQ ID NO: 190931 - DNA, 20 bp, Artificial Sequence
  chemically synthesized
ctatagagagaggatagtga

SEQ ID NO: 190932 - DNA, 20 bp, Artificial Sequence
  chemically synthesized
ggatagtgaaggatttatgt

SEQ ID NO: 190933 - DNA, 20 bp, Artificial Sequence
  chemically synthesized
atttatgttggaatgactta

SEQ ID NO: 190934 - DNA, 20 bp, Artificial Sequence
  chemically synthesized
aactagctacacaaaaccgt

SEQ ID NO: 190935 - DNA, 20 bp, Artificial Sequence
  chemically synthesized
gaatgacttacggttttgtg

SEQ ID NO: 190936 - DNA, 20 bp, Artificial Sequence
  chemically synthesized
gacttacggttttgtgtagc

SEQ ID NO: 190937 - DNA, 20 bp, Artificial Sequence
  chemically synthesized
gtttattctttaagaaaaac

SEQ ID NO: 190938 - DNA, 20 bp, Artificial Sequence
  chemically synthesized
tgtgtagctagtttttctta

SEQ ID NO: 190939 - DNA, 20 bp, Artificial Sequence
  chemically synthesized
gataagccagtttattcttt

SEQ ID NO: 190940 - DNA, 20 bp, Artificial Sequence
  chemically synthesized
gtttttcttaaagaataaac

SEQ ID NO: 190941 - DNA, 20 bp, Artificial Sequence
  chemically synthesized
tccttatcaagaggataagc

SEQ ID NO: 190942 - DNA, 20 bp, Artificial Sequence
  chemically synthesized
taattccttatcaagaggat

SEQ ID NO: 190943 - DNA, 20 bp, Artificial Sequence
  chemically synthesized
aactggcttatcctcttgat

SEQ ID NO: 190944 - DNA, 20 bp, Artificial Sequence
  chemically synthesized
actggcttatcctcttgata

SEQ ID NO: 190945 - DNA, 20 bp, Artificial Sequence
  chemically synthesized
accactaattccttatcaag

SEQ ID NO: 190946 - DNA, 20 bp, Artificial Sequence
  chemically synthesized
caccactaattccttatcaa

SEQ ID NO: 190947 - DNA, 20 bp, Artificial Sequence
  chemically synthesized
ttcaccactaattccttatc

SEQ ID NO: 190948 - DNA, 20 bp, Artificial Sequence
  chemically synthesized
ttatcctcttgataaggaat

SEQ ID NO: 190949 - DNA, 20 bp, Artificial Sequence
  chemically synthesized
tcctcttgataaggaattag

SEQ ID NO: 190950 - DNA, 20 bp, Artificial Sequence
  chemically synthesized
tgataaggaattagtggtga

SEQ ID NO: 190951 - DNA, 20 bp, Artificial Sequence
  chemically synthesized
taaggaattagtggtgaaag

SEQ ID NO: 190952 - DNA, 20 bp, Artificial Sequence
  chemically synthesized
tagtggtgaaagaagctttg

SEQ ID NO: 190953 - DNA, 20 bp, Artificial Sequence
  chemically synthesized
cctaacattaaatgtcttca

SEQ ID NO: 190954 - DNA, 20 bp, Artificial Sequence
  chemically synthesized
gctttgaagacatttaatgt

SEQ ID NO: 190955 - DNA, 20 bp, Artificial Sequence
  chemically synthesized
ctttgaagacatttaatgtt

SEQ ID NO: 190956 - DNA, 20 bp, Artificial Sequence
  chemically synthesized
tgaagacatttaatgttagg

SEQ ID NO: 190957 - DNA, 20 bp, Artificial Sequence
  chemically synthesized
gacatttaatgttaggaagc

SEQ ID NO: 190958 - DNA, 20 bp, Artificial Sequence
  chemically synthesized
aatgttaggaagcaagaaat

SEQ ID NO: 190959 - DNA, 20 bp, Artificial Sequence
  chemically synthesized
tgttaggaagcaagaaatca

SEQ ID NO: 190960 - DNA, 20 bp, Artificial Sequence
  chemically synthesized
agcaagaaatcagagttgtg

SEQ ID NO: 190961 - DNA, 20 bp, Artificial Sequence
  chemically synthesized
caagaaatcagagttgtgaa

SEQ ID NO: 190962 - DNA, 20 bp, Artificial Sequence
  chemically synthesized
gtgaagagatatgttaaaat

SEQ ID NO: 190963 - DNA, 20 bp, Artificial Sequence
  chemically synthesized
tgaagagatatgttaaaatt

SEQ ID NO: 190964 - DNA, 20 bp, Artificial Sequence
  chemically synthesized
gaagagatatgttaaaatta

SEQ ID NO: 190965 - DNA, 20 bp, Artificial Sequence
  chemically synthesized
aattagggcattgcctccat

SEQ ID NO: 190966 - DNA, 20 bp, Artificial Sequence
  chemically synthesized
tagggcattgcctccatgag

SEQ ID NO: 190967 - DNA, 20 bp, Artificial Sequence
  chemically synthesized
ttttaatggcctgctcatgg

SEQ ID NO: 190968 - DNA, 20 bp, Artificial Sequence
  chemically synthesized
agggcattgcctccatgagc

SEQ ID NO: 190969 - DNA, 20 bp, Artificial Sequence
  chemically synthesized
gttttaatggcctgctcatg

SEQ ID NO: 190970 - DNA, 20 bp, Artificial Sequence
  chemically synthesized
tagttttaatggcctgctca

SEQ ID NO: 190971 - DNA, 20 bp, Artificial Sequence
  chemically synthesized
acatttccagatagttttaa

SEQ ID NO: 190972 - DNA, 20 bp, Artificial Sequence
  chemically synthesized
agcaggccattaaaactatc

SEQ ID NO: 190973 - DNA, 20 bp, Artificial Sequence
  chemically synthesized
gtcctttcaacatttccaga

SEQ ID NO: 190974 - DNA, 20 bp, Artificial Sequence
  chemically synthesized
catagtcctttcaacatttc

SEQ ID NO: 190975 - DNA, 20 bp, Artificial Sequence
  chemically synthesized
aaactatctggaaatgttga

SEQ ID NO: 190976 - DNA, 20 bp, Artificial Sequence
  chemically synthesized
aactatctggaaatgttgaa

SEQ ID NO: 190977 - DNA, 20 bp, Artificial Sequence
  chemically synthesized
aaatgttgaaaggactatga

SEQ ID NO: 190978 - DNA, 20 bp, Artificial Sequence
  chemically synthesized
atcatcatctagtgctttca

SEQ ID NO: 190979 - DNA, 20 bp, Artificial Sequence
  chemically synthesized
tgaaaggactatgaaagcac

SEQ ID NO: 190980 - DNA, 20 bp, Artificial Sequence
  chemically synthesized
agaaacgtagcatcatcatc

SEQ ID NO: 190981 - DNA, 20 bp, Artificial Sequence
  chemically synthesized
gagggataacttcagaaacg

SEQ ID NO: 190982 - DNA, 20 bp, Artificial Sequence
  chemically synthesized
atgatgatgctacgtttctg

SEQ ID NO: 190983 - DNA, 20 bp, Artificial Sequence
  chemically synthesized
ccaatgatgagggataactt

SEQ ID NO: 190984 - DNA, 20 bp, Artificial Sequence
  chemically synthesized
ctgaagttatccctcatcat

SEQ ID NO: 190985 - DNA, 20 bp, Artificial Sequence
  chemically synthesized
atatttggagccaatgatga

SEQ ID NO: 190986 - DNA, 20 bp, Artificial Sequence
  chemically synthesized
catatttggagccaatgatg

SEQ ID NO: 190987 - DNA, 20 bp, Artificial Sequence
  chemically synthesized
gcatatttggagccaatgat

SEQ ID NO: 190988 - DNA, 20 bp, Artificial Sequence
  chemically synthesized
ttaagtgcaatgcatatttg

SEQ ID NO: 190989 - DNA, 20 bp, Artificial Sequence
  chemically synthesized
ttttaagtgcaatgcatatt

SEQ ID NO: 190990 - DNA, 20 bp, Artificial Sequence
  chemically synthesized
atattataaaataaaatttt

SEQ ID NO: 190991 - DNA, 20 bp, Artificial Sequence
  chemically synthesized
ttttattttataatatttta

SEQ ID NO: 190992 - DNA, 20 bp, Artificial Sequence
  chemically synthesized
tatacacaaacaatttaaaa

SEQ ID NO: 190993 - DNA, 20 bp, Artificial Sequence
  chemically synthesized
catacgtgatcatatttttg

SEQ ID NO: 190994 - DNA, 20 bp, Artificial Sequence
  chemically synthesized
tgcaaaaatatgatcacgta

SEQ ID NO: 190995 - DNA, 20 bp, Artificial Sequence
  chemically synthesized
gagtgagccaagaaaaacga

SEQ ID NO: 190996 - DNA, 20 bp, Artificial Sequence
  chemically synthesized
ggagtgagccaagaaaaacg

SEQ ID NO: 190997 - DNA, 20 bp, Artificial Sequence
  chemically synthesized
aggagtgagccaagaaaaac

SEQ ID NO: 190998 - DNA, 20 bp, Artificial Sequence
  chemically synthesized
gtatggtccctcgtttttct

SEQ ID NO: 190999 - DNA, 20 bp, Artificial Sequence
  chemically synthesized
gaggaggagaggagtgagcc

SEQ ID NO: 191000 - DNA, 20 bp, Artificial Sequence
  chemically synthesized
gggtggaggaggagaggagt

SEQ ID NO: 191001 - DNA, 20 bp, Artificial Sequence
  chemically synthesized
ttgtgggtggaggaggagag

SEQ ID NO: 191002 - DNA, 20 bp, Artificial Sequence
  chemically synthesized
tgttgtgggtggaggaggag

SEQ ID NO: 191003 - DNA, 20 bp, Artificial Sequence
  chemically synthesized
ttgttgtgggtggaggagga

SEQ ID NO: 191004 - DNA, 20 bp, Artificial Sequence
  chemically synthesized
gtttgttgtgggtggaggag

SEQ ID NO: 191005 - DNA, 20 bp, Artificial Sequence
  chemically synthesized
aggtttgttgtgggtggagg

SEQ ID NO: 191006 - DNA, 20 bp, Artificial Sequence
  chemically synthesized
aaggtttgttgtgggtggag

SEQ ID NO: 191007 - DNA, 20 bp, Artificial Sequence
  chemically synthesized
ggaaggtttgttgtgggtgg

SEQ ID NO: 191008 - DNA, 20 bp, Artificial Sequence
  chemically synthesized
aggaaggtttgttgtgggtg

SEQ ID NO: 191009 - DNA, 20 bp, Artificial Sequence
  chemically synthesized
ggaggaaggtttgttgtggg

SEQ ID NO: 191010 - DNA, 20 bp, Artificial Sequence
  chemically synthesized
agtggaggaaggtttgttgt

SEQ ID NO: 191011 - DNA, 20 bp, Artificial Sequence
  chemically synthesized
tagtggaggaaggtttgttg

SEQ ID NO: 191012 - DNA, 20 bp, Artificial Sequence
  chemically synthesized
taggttattttagtggagga

SEQ ID NO: 191013 - DNA, 20 bp, Artificial Sequence
  chemically synthesized
ttaggttattttagtggagg

SEQ ID NO: 191014 - DNA, 20 bp, Artificial Sequence
  chemically synthesized
taattaggttattttagtgg

SEQ ID NO: 191015 - DNA, 20 bp, Artificial Sequence
  chemically synthesized
ataattaggttattttagtg

SEQ ID NO: 191016 - DNA, 20 bp, Artificial Sequence
  chemically synthesized
aaataattaggttattttag

SEQ ID NO: 191017 - DNA, 20 bp, Artificial Sequence
  chemically synthesized
aataaataattaggttattt

SEQ ID NO: 191018 - DNA, 20 bp, Artificial Sequence
  chemically synthesized
aattacagaaataaataatt

SEQ ID NO: 191019 - DNA, 20 bp, Artificial Sequence
  chemically synthesized
aaattacagaaataaataat

SEQ ID NO: 191020 - DNA, 20 bp, Artificial Sequence
  chemically synthesized
aaatatcaagtgcaaaatta

SEQ ID NO: 191021 - DNA, 20 bp, Artificial Sequence
  chemically synthesized
tataaattgaaaaaaatatc

SEQ ID NO: 191022 - DNA, 20 bp, Artificial Sequence
  chemically synthesized
gatatttttttcaatttata

SEQ ID NO: 191023 - DNA, 20 bp, Artificial Sequence
  chemically synthesized
tatagtcatatatacttttg

SEQ ID NO: 191024 - DNA, 20 bp, Artificial Sequence
  chemically synthesized
tagtcatatatacttttgta

SEQ ID NO: 191025 - DNA, 20 bp, Artificial Sequence
  chemically synthesized
tctcaccctctgctctacaa

SEQ ID NO: 191026 - DNA, 20 bp, Artificial Sequence
  chemically synthesized
tcatatatacttttgtagag

SEQ ID NO: 191027 - DNA, 20 bp, Artificial Sequence
  chemically synthesized
atatatacttttgtagagca

SEQ ID NO: 191028 - DNA, 20 bp, Artificial Sequence
  chemically synthesized
tatatacttttgtagagcag

SEQ ID NO: 191029 - DNA, 20 bp, Artificial Sequence
  chemically synthesized
atatacttttgtagagcaga

SEQ ID NO: 191030 - DNA, 20 bp, Artificial Sequence
  chemically synthesized
acttttgtagagcagagggt

SEQ ID NO: 191031 - DNA, 20 bp, Artificial Sequence
  chemically synthesized
tttgtagagcagagggtgag

SEQ ID NO: 191032 - DNA, 20 bp, Artificial Sequence
  chemically synthesized
tgtagagcagagggtgagaa

SEQ ID NO: 191033 - DNA, 20 bp, Artificial Sequence
  chemically synthesized
gagcagagggtgagaagaga

SEQ ID NO: 191034 - DNA, 20 bp, Artificial Sequence
  chemically synthesized
gatataaatgaaaatgaaac

SEQ ID NO: 191035 - DNA, 20 bp, Artificial Sequence
  chemically synthesized
aaagaattttaatttatttc

SEQ ID NO: 191036 - DNA, 20 bp, Artificial Sequence
  chemically synthesized
ataaattaaaattctttacc

SEQ ID NO: 191037 - DNA, 20 bp, Artificial Sequence
  chemically synthesized
taaattaaaattctttacca

SEQ ID NO: 191038 - DNA, 20 bp, Artificial Sequence
  chemically synthesized
gatttatttttaccttggta

SEQ ID NO: 191039 - DNA, 20 bp, Artificial Sequence
  chemically synthesized
aataagatttatttttacct

SEQ ID NO: 191040 - DNA, 20 bp, Artificial Sequence
  chemically synthesized
aaggtaaaaataaatcttat

SEQ ID NO: 191041 - DNA, 20 bp, Artificial Sequence
  chemically synthesized
tgcattatcataagaccaat

SEQ ID NO: 191042 - DNA, 20 bp, Artificial Sequence
  chemically synthesized
agaggacaatgcattatcat

SEQ ID NO: 191043 - DNA, 20 bp, Artificial Sequence
  chemically synthesized
tagatttttggtgatcacag

SEQ ID NO: 191044 - DNA, 20 bp, Artificial Sequence
  chemically synthesized
gtagatttttggtgatcaca

SEQ ID NO: 191045 - DNA, 20 bp, Artificial Sequence
  chemically synthesized
ttgtagatttttggtgatca

SEQ ID NO: 191046 - DNA, 20 bp, Artificial Sequence
  chemically synthesized
ggctttgtattgtagatttt

SEQ ID NO: 191047 - DNA, 20 bp, Artificial Sequence
  chemically synthesized
caccaaaaatctacaataca

SEQ ID NO: 191048 - DNA, 20 bp, Artificial Sequence
  chemically synthesized
gattggctggctttgtattg

SEQ ID NO: 191049 - DNA, 20 bp, Artificial Sequence
  chemically synthesized
aaaaatctacaatacaaagc

SEQ ID NO: 191050 - DNA, 20 bp, Artificial Sequence
  chemically synthesized
cactctcccaagagattggc

SEQ ID NO: 191051 - DNA, 20 bp, Artificial Sequence
  chemically synthesized
tacaaagccagccaatctct

SEQ ID NO: 191052 - DNA, 20 bp, Artificial Sequence
  chemically synthesized
acaaagccagccaatctctt

SEQ ID NO: 191053 - DNA, 20 bp, Artificial Sequence
  chemically synthesized
tctacactctcccaagagat

SEQ ID NO: 191054 - DNA, 20 bp, Artificial Sequence
  chemically synthesized
aaagccagccaatctcttgg

SEQ ID NO: 191055 - DNA, 20 bp, Artificial Sequence
  chemically synthesized
agccagccaatctcttggga

SEQ ID NO: 191056 - DNA, 20 bp, Artificial Sequence
  chemically synthesized
aactttctacactctcccaa

SEQ ID NO: 191057 - DNA, 20 bp, Artificial Sequence
  chemically synthesized
taaactttctacactctccc

SEQ ID NO: 191058 - DNA, 20 bp, Artificial Sequence
  chemically synthesized
gccaatctcttgggagagtg

SEQ ID NO: 191059 - DNA, 20 bp, Artificial Sequence
  chemically synthesized
atctcttgggagagtgtaga

SEQ ID NO: 191060 - DNA, 20 bp, Artificial Sequence
  chemically synthesized
ttgggagagtgtagaaagtt

SEQ ID NO: 191061 - DNA, 20 bp, Artificial Sequence
  chemically synthesized
tgggagagtgtagaaagttt

SEQ ID NO: 191062 - DNA, 20 bp, Artificial Sequence
  chemically synthesized
gggagagtgtagaaagttta

SEQ ID NO: 191063 - DNA, 20 bp, Artificial Sequence
  chemically synthesized
atgtaattatattttatttg

SEQ ID NO: 191064 - DNA, 20 bp, Artificial Sequence
  chemically synthesized
taattatattttatttgcag

SEQ ID NO: 191065 - DNA, 20 bp, Artificial Sequence
  chemically synthesized
aattatattttatttgcaga

SEQ ID NO: 191066 - DNA, 20 bp, Artificial Sequence
  chemically synthesized
atttgcagaaggaatcaata

SEQ ID NO: 191067 - DNA, 20 bp, Artificial Sequence
  chemically synthesized
tgcagaaggaatcaatatgg

SEQ ID NO: 191068 - DNA, 20 bp, Artificial Sequence
  chemically synthesized
tcaatatggcggtacttttc

SEQ ID NO: 191069 - DNA, 20 bp, Artificial Sequence
  chemically synthesized
gtgattgaattgaacttgaa

SEQ ID NO: 191070 - DNA, 20 bp, Artificial Sequence
  chemically synthesized
tcaattcaatcacaaatgta

SEQ ID NO: 191071 - DNA, 20 bp, Artificial Sequence
  chemically synthesized
tcaatcacaaatgtaaagaa

SEQ ID NO: 191072 - DNA, 20 bp, Artificial Sequence
  chemically synthesized
acagatttgcatttacatct

SEQ ID NO: 191073 - DNA, 20 bp, Artificial Sequence
  chemically synthesized
gatttgcatttacatctaag

SEQ ID NO: 191074 - DNA, 20 bp, Artificial Sequence
  chemically synthesized
ttgcatttacatctaagcag

SEQ ID NO: 191075 - DNA, 20 bp, Artificial Sequence
  chemically synthesized
taatccaccacgcttctgct

SEQ ID NO: 191076 - DNA, 20 bp, Artificial Sequence
  chemically synthesized
tttacatctaagcagaagcg

SEQ ID NO: 191077 - DNA, 20 bp, Artificial Sequence
  chemically synthesized
acatctaagcagaagcgtgg

SEQ ID NO: 191078 - DNA, 20 bp, Artificial Sequence
  chemically synthesized
cagaagcgtggtggattaaa

SEQ ID NO: 191079 - DNA, 20 bp, Artificial Sequence
  chemically synthesized
aaaaagatttcaataacatt

SEQ ID NO: 191080 - DNA, 20 bp, Artificial Sequence
  chemically synthesized
gaatgccctattttgacaaa

SEQ ID NO: 191081 - DNA, 20 bp, Artificial Sequence
  chemically synthesized
atgaatgccctattttgaca

SEQ ID NO: 191082 - DNA, 20 bp, Artificial Sequence
  chemically synthesized
tagtcatctctttgtcaaaa

SEQ ID NO: 191083 - DNA, 20 bp, Artificial Sequence
  chemically synthesized
agtcatctctttgtcaaaat

SEQ ID NO: 191084 - DNA, 20 bp, Artificial Sequence
  chemically synthesized
gtcatctctttgtcaaaata

SEQ ID NO: 191085 - DNA, 20 bp, Artificial Sequence
  chemically synthesized
cattgaacataatgacactc

SEQ ID NO: 191086 - DNA, 20 bp, Artificial Sequence
  chemically synthesized
attgaacataatgacactca

SEQ ID NO: 191087 - DNA, 20 bp, Artificial Sequence
  chemically synthesized
tttattggaaggatggcctt

SEQ ID NO: 191088 - DNA, 20 bp, Artificial Sequence
  chemically synthesized
agggtaatttattggaagga

SEQ ID NO: 191089 - DNA, 20 bp, Artificial Sequence
  chemically synthesized
ttatagggtaatttattgga

SEQ ID NO: 191090 - DNA, 20 bp, Artificial Sequence
  chemically synthesized
tttatagggtaatttattgg

SEQ ID NO: 191091 - DNA, 20 bp, Artificial Sequence
  chemically synthesized
agttttatagggtaatttat

SEQ ID NO: 191092 - DNA, 20 bp, Artificial Sequence
  chemically synthesized
ttttgaatggaagttttata

SEQ ID NO: 191093 - DNA, 20 bp, Artificial Sequence
  chemically synthesized
attttgaatggaagttttat

SEQ ID NO: 191094 - DNA, 20 bp, Artificial Sequence
  chemically synthesized
aattttgaatggaagtttta

SEQ ID NO: 191095 - DNA, 20 bp, Artificial Sequence
  chemically synthesized
ccatattaaattttgaatgg

SEQ ID NO: 191096 - DNA, 20 bp, Artificial Sequence
  chemically synthesized
gtaccatattaaattttgaa

SEQ ID NO: 191097 - DNA, 20 bp, Artificial Sequence
  chemically synthesized
cttccattcaaaatttaata

SEQ ID NO: 191098 - DNA, 20 bp, Artificial Sequence
  chemically synthesized
attcaaaatttaatatggta

SEQ ID NO: 191099 - DNA, 20 bp, Artificial Sequence
  chemically synthesized
ttcaaaatttaatatggtac

SEQ ID NO: 191100 - DNA, 20 bp, Artificial Sequence
  chemically synthesized
aaatttaatatggtacaggt

SEQ ID NO: 191101 - DNA, 20 bp, Artificial Sequence
  chemically synthesized
aatttaatatggtacaggtt

SEQ ID NO: 191102 - DNA, 20 bp, Artificial Sequence
  chemically synthesized
atttaatatggtacaggttg

SEQ ID NO: 191103 - DNA, 20 bp, Artificial Sequence
  chemically synthesized
atggtacaggttggggaata

SEQ ID NO: 191104 - DNA, 20 bp, Artificial Sequence
  chemically synthesized
tggtacaggttggggaatat

SEQ ID NO: 191105 - DNA, 20 bp, Artificial Sequence
  chemically synthesized
ataggtaattaaatgtgtcg

SEQ ID NO: 191106 - DNA, 20 bp, Artificial Sequence
  chemically synthesized
aggtaattaaatgtgtcgta

SEQ ID NO: 191107 - DNA, 20 bp, Artificial Sequence
  chemically synthesized
ggtaattaaatgtgtcgtag

SEQ ID NO: 191108 - DNA, 20 bp, Artificial Sequence
  chemically synthesized
aattaaatgtgtcgtagagg

SEQ ID NO: 191109 - DNA, 20 bp, Artificial Sequence
  chemically synthesized
aaatgtgtcgtagaggtaga

SEQ ID NO: 191110 - DNA, 20 bp, Artificial Sequence
  chemically synthesized
tgtgtcgtagaggtagaaag

SEQ ID NO: 191111 - DNA, 20 bp, Artificial Sequence
  chemically synthesized
tagaggtagaaagaagaccc

SEQ ID NO: 191112 - DNA, 20 bp, Artificial Sequence
  chemically synthesized
agaggtagaaagaagaccct

SEQ ID NO: 191113 - DNA, 20 bp, Artificial Sequence
  chemically synthesized
tagaaagaagaccctgggta

SEQ ID NO: 191114 - DNA, 20 bp, Artificial Sequence
  chemically synthesized
agaaagaagaccctgggtaa

SEQ ID NO: 191115 - DNA, 20 bp, Artificial Sequence
  chemically synthesized
accatcttttcctttaccca

SEQ ID NO: 191116 - DNA, 20 bp, Artificial Sequence
  chemically synthesized
taccatcttttcctttaccc

SEQ ID NO: 191117 - DNA, 20 bp, Artificial Sequence
  chemically synthesized
ttaccatcttttcctttacc

SEQ ID NO: 191118 - DNA, 20 bp, Artificial Sequence
  chemically synthesized
gaagaccctgggtaaaggaa

SEQ ID NO: 191119 - DNA, 20 bp, Artificial Sequence
  chemically synthesized
accctgggtaaaggaaaaga

SEQ ID NO: 191120 - DNA, 20 bp, Artificial Sequence
  chemically synthesized
taaaggaaaagatggtaatt

SEQ ID NO: 191121 - DNA, 20 bp, Artificial Sequence
  chemically synthesized
agatggtaattaagatttga

SEQ ID NO: 191122 - DNA, 20 bp, Artificial Sequence
  chemically synthesized
aagaataatactgaaataaa

SEQ ID NO: 191123 - DNA, 20 bp, Artificial Sequence
  chemically synthesized
ctagaataacctatttattt

SEQ ID NO: 191124 - DNA, 20 bp, Artificial Sequence
  chemically synthesized
agaataatactgaaataaat

SEQ ID NO: 191125 - DNA, 20 bp, Artificial Sequence
  chemically synthesized
ctgaaataaataggttattc

SEQ ID NO: 191126 - DNA, 20 bp, Artificial Sequence
  chemically synthesized
tgaaataaataggttattct

SEQ ID NO: 191127 - DNA, 20 bp, Artificial Sequence
  chemically synthesized
gcatactgataagattttcc

SEQ ID NO: 191128 - DNA, 20 bp, Artificial Sequence
  chemically synthesized
ttattctaggaaaatcttat

SEQ ID NO: 191129 - DNA, 20 bp, Artificial Sequence
  chemically synthesized
aaagtgattagcatactgat

SEQ ID NO: 191130 - DNA, 20 bp, Artificial Sequence
  chemically synthesized
tatcagtatgctaatcactt

SEQ ID NO: 191131 - DNA, 20 bp, Artificial Sequence
  chemically synthesized
gataagggacctaaagtgat

SEQ ID NO: 191132 - DNA, 20 bp, Artificial Sequence
  chemically synthesized
atcagtatgctaatcacttt

SEQ ID NO: 191133 - DNA, 20 bp, Artificial Sequence
  chemically synthesized
ttcctatgataagggaccta

SEQ ID NO: 191134 - DNA, 20 bp, Artificial Sequence
  chemically synthesized
tcactttaggtcccttatca

SEQ ID NO: 191135 - DNA, 20 bp, Artificial Sequence
  chemically synthesized
cactttaggtcccttatcat

SEQ ID NO: 191136 - DNA, 20 bp, Artificial Sequence
  chemically synthesized
aagattctttcctatgataa

SEQ ID NO: 191137 - DNA, 20 bp, Artificial Sequence
  chemically synthesized
taagattctttcctatgata

SEQ ID NO: 191138 - DNA, 20 bp, Artificial Sequence
  chemically synthesized
ttaagattctttcctatgat

SEQ ID NO: 191139 - DNA, 20 bp, Artificial Sequence
  chemically synthesized
ttaggtcccttatcatagga

SEQ ID NO: 191140 - DNA, 20 bp, Artificial Sequence
  chemically synthesized
tcataggaaagaatcttaaa

SEQ ID NO: 191141 - DNA, 20 bp, Artificial Sequence
  chemically synthesized
cataggaaagaatcttaaac

SEQ ID NO: 191142 - DNA, 20 bp, Artificial Sequence
  chemically synthesized
attgtcccaagcacctgttt

SEQ ID NO: 191143 - DNA, 20 bp, Artificial Sequence
  chemically synthesized
aagaatcttaaacaggtgct

SEQ ID NO: 191144 - DNA, 20 bp, Artificial Sequence
  chemically synthesized
agaatcttaaacaggtgctt

SEQ ID NO: 191145 - DNA, 20 bp, Artificial Sequence
  chemically synthesized
taaacaggtgcttgggacaa

SEQ ID NO: 191146 - DNA, 20 bp, Artificial Sequence
  chemically synthesized
gggttgaccaccattgtccc

SEQ ID NO: 191147 - DNA, 20 bp, Artificial Sequence
  chemically synthesized
acaggtgcttgggacaatgg

SEQ ID NO: 191148 - DNA, 20 bp, Artificial Sequence
  chemically synthesized
gacaatggtggtcaacccct

SEQ ID NO: 191149 - DNA, 20 bp, Artificial Sequence
  chemically synthesized
aatggtggtcaaccccttag

SEQ ID NO: 191150 - DNA, 20 bp, Artificial Sequence
  chemically synthesized
tagcatttgaaaccgctaag

SEQ ID NO: 191151 - DNA, 20 bp, Artificial Sequence
  chemically synthesized
ctagcatttgaaaccgctaa

SEQ ID NO: 191152 - DNA, 20 bp, Artificial Sequence
  chemically synthesized
cctagcatttgaaaccgcta

SEQ ID NO: 191153 - DNA, 20 bp, Artificial Sequence
  chemically synthesized
tcctagcatttgaaaccgct

SEQ ID NO: 191154 - DNA, 20 bp, Artificial Sequence
  chemically synthesized
cccttagcggtttcaaatgc

SEQ ID NO: 191155 - DNA, 20 bp, Artificial Sequence
  chemically synthesized
ccttagcggtttcaaatgct

SEQ ID NO: 191156 - DNA, 20 bp, Artificial Sequence
  chemically synthesized
ttagcggtttcaaatgctag

SEQ ID NO: 191157 - DNA, 20 bp, Artificial Sequence
  chemically synthesized
cctgtgtgtcatgagactcc

SEQ ID NO: 191158 - DNA, 20 bp, Artificial Sequence
  chemically synthesized
gtttagagcctgtgtgtcat

SEQ ID NO: 191159 - DNA, 20 bp, Artificial Sequence
  chemically synthesized
gctaggagtctcatgacaca

SEQ ID NO: 191160 - DNA, 20 bp, Artificial Sequence
  chemically synthesized
ctaggagtctcatgacacac

SEQ ID NO: 191161 - DNA, 20 bp, Artificial Sequence
  chemically synthesized
agaaaggtaatcaaggttta

SEQ ID NO: 191162 - DNA, 20 bp, Artificial Sequence
  chemically synthesized
gtagaaaggtaatcaaggtt

SEQ ID NO: 191163 - DNA, 20 bp, Artificial Sequence
  chemically synthesized
ttcttgtagaaaggtaatca

SEQ ID NO: 191164 - DNA, 20 bp, Artificial Sequence
  chemically synthesized
gttcttgtagaaaggtaatc

SEQ ID NO: 191165 - DNA, 20 bp, Artificial Sequence
  chemically synthesized
aaccttgattacctttctac

SEQ ID NO: 191166 - DNA, 20 bp, Artificial Sequence
  chemically synthesized
gcaacaatgttcttgtagaa

SEQ ID NO: 191167 - DNA, 20 bp, Artificial Sequence
  chemically synthesized
agcaacaatgttcttgtaga

SEQ ID NO: 191168 - DNA, 20 bp, Artificial Sequence
  chemically synthesized
aacaagcaacaatgttcttg

SEQ ID NO: 191169 - DNA, 20 bp, Artificial Sequence
  chemically synthesized
taaaaagattggagatcaac

SEQ ID NO: 191170 - DNA, 20 bp, Artificial Sequence
  chemically synthesized
ttagcgtattaaaaagattg

SEQ ID NO: 191171 - DNA, 20 bp, Artificial Sequence
  chemically synthesized
cattagcgtattaaaaagat

SEQ ID NO: 191172 - DNA, 20 bp, Artificial Sequence
  chemically synthesized
tctgacattagcgtattaaa

SEQ ID NO: 191173 - DNA, 20 bp, Artificial Sequence
  chemically synthesized
tctttttaatacgctaatgt

SEQ ID NO: 191174 - DNA, 20 bp, Artificial Sequence
  chemically synthesized
aatttgtttccatctgacat

SEQ ID NO: 191175 - DNA, 20 bp, Artificial Sequence
  chemically synthesized
tttaatacgctaatgtcaga

SEQ ID NO: 191176 - DNA, 20 bp, Artificial Sequence
  chemically synthesized
atggaaacaaattcgactcc

SEQ ID NO: 191177 - DNA, 20 bp, Artificial Sequence
  chemically synthesized
aaacaaattcgactcctgga

SEQ ID NO: 191178 - DNA, 20 bp, Artificial Sequence
  chemically synthesized
gcagcttgcttgccatccag

SEQ ID NO: 191179 - DNA, 20 bp, Artificial Sequence
  chemically synthesized
aaattcgactcctggatggc

SEQ ID NO: 191180 - DNA, 20 bp, Artificial Sequence
  chemically synthesized
gtgcagcttgcttgccatcc

SEQ ID NO: 191181 - DNA, 20 bp, Artificial Sequence
  chemically synthesized
agtgcagcttgcttgccatc

SEQ ID NO: 191182 - DNA, 20 bp, Artificial Sequence
  chemically synthesized
tcgactcctggatggcaagc

SEQ ID NO: 191183 - DNA, 20 bp, Artificial Sequence
  chemically synthesized
ggatggcaagcaagctgcac

SEQ ID NO: 191184 - DNA, 20 bp, Artificial Sequence
  chemically synthesized
gatggcaagcaagctgcact

SEQ ID NO: 191185 - DNA, 20 bp, Artificial Sequence
  chemically synthesized
agccttacccaatcccagtg

SEQ ID NO: 191186 - DNA, 20 bp, Artificial Sequence
  chemically synthesized
caagcaagctgcactgggat

SEQ ID NO: 191187 - DNA, 20 bp, Artificial Sequence
  chemically synthesized
aagcaagctgcactgggatt

SEQ ID NO: 191188 - DNA, 20 bp, Artificial Sequence
  chemically synthesized
cttctagccttacccaatcc

SEQ ID NO: 191189 - DNA, 20 bp, Artificial Sequence
  chemically synthesized
aagctgcactgggattgggt

SEQ ID NO: 191190 - DNA, 20 bp, Artificial Sequence
  chemically synthesized
agctgcactgggattgggta

SEQ ID NO: 191191 - DNA, 20 bp, Artificial Sequence
  chemically synthesized
gcactgggattgggtaaggc

SEQ ID NO: 191192 - DNA, 20 bp, Artificial Sequence
  chemically synthesized
ctgggattgggtaaggctag

SEQ ID NO: 191193 - DNA, 20 bp, Artificial Sequence
  chemically synthesized
gtgttgcagatgatggcttc

SEQ ID NO: 191194 - DNA, 20 bp, Artificial Sequence
  chemically synthesized
tatctctgtgttgcagatga

SEQ ID NO: 191195 - DNA, 20 bp, Artificial Sequence
  chemically synthesized
agaagccatcatctgcaaca

SEQ ID NO: 191196 - DNA, 20 bp, Artificial Sequence
  chemically synthesized
aagccatcatctgcaacaca

SEQ ID NO: 191197 - DNA, 20 bp, Artificial Sequence
  chemically synthesized
cctcgcttatctctgtgttg

SEQ ID NO: 191198 - DNA, 20 bp, Artificial Sequence
  chemically synthesized
atcatctgcaacacagagat

SEQ ID NO: 191199 - DNA, 20 bp, Artificial Sequence
  chemically synthesized
tctgcaacacagagataagc

SEQ ID NO: 191200 - DNA, 20 bp, Artificial Sequence
  chemically synthesized
ctgcaacacagagataagcg

SEQ ID NO: 191201 - DNA, 20 bp, Artificial Sequence
  chemically synthesized
tcaaaaggccacagagaatt

SEQ ID NO: 191202 - DNA, 20 bp, Artificial Sequence
  chemically synthesized
aagcgaggctgaattctctg

SEQ ID NO: 191203 - DNA, 20 bp, Artificial Sequence
  chemically synthesized
tacagtctcaaaaggccaca

SEQ ID NO: 191204 - DNA, 20 bp, Artificial Sequence
  chemically synthesized
aatacagtctcaaaaggcca

SEQ ID NO: 191205 - DNA, 20 bp, Artificial Sequence
  chemically synthesized
tgaattctctgtggcctttt

SEQ ID NO: 191206 - DNA, 20 bp, Artificial Sequence
  chemically synthesized
tcacataatacagtctcaaa

SEQ ID NO: 191207 - DNA, 20 bp, Artificial Sequence
  chemically synthesized
ttcacataatacagtctcaa

SEQ ID NO: 191208 - DNA, 20 bp, Artificial Sequence
  chemically synthesized
attcttcatttcacataata

SEQ ID NO: 191209 - DNA, 20 bp, Artificial Sequence
  chemically synthesized
agactgtattatgtgaaatg

SEQ ID NO: 191210 - DNA, 20 bp, Artificial Sequence
  chemically synthesized
atgtgaaatgaagaatttac

SEQ ID NO: 191211 - DNA, 20 bp, Artificial Sequence
  chemically synthesized
tgaaatgaagaatttacaag

SEQ ID NO: 191212 - DNA, 20 bp, Artificial Sequence
  chemically synthesized
gaagaatttacaagcagaaa

SEQ ID NO: 191213 - DNA, 20 bp, Artificial Sequence
  chemically synthesized
gaatttacaagcagaaacag

SEQ ID NO: 191214 - DNA, 20 bp, Artificial Sequence
  chemically synthesized
gtcattaataatgagatttt

SEQ ID NO: 191215 - DNA, 20 bp, Artificial Sequence
  chemically synthesized
gctcaaaagtcattaataat

SEQ ID NO: 191216 - DNA, 20 bp, Artificial Sequence
  chemically synthesized
tctcattattaatgactttt

SEQ ID NO: 191217 - DNA, 20 bp, Artificial Sequence
  chemically synthesized
cattattaatgacttttgag

SEQ ID NO: 191218 - DNA, 20 bp, Artificial Sequence
  chemically synthesized
cagaaaccgtggctgctcaa

SEQ ID NO: 191219 - DNA, 20 bp, Artificial Sequence
  chemically synthesized
taatgacttttgagcagcca

SEQ ID NO: 191220 - DNA, 20 bp, Artificial Sequence
  chemically synthesized
ttttgagcagccacggtttc

SEQ ID NO: 191221 - DNA, 20 bp, Artificial Sequence
  chemically synthesized
acatgaaaaaccagaaaccg

SEQ ID NO: 191222 - DNA, 20 bp, Artificial Sequence
  chemically synthesized
tacagattcacatgaaaaac

SEQ ID NO: 191223 - DNA, 20 bp, Artificial Sequence
  chemically synthesized
ggtttttcatgtgaatctgt

SEQ ID NO: 191224 - DNA, 20 bp, Artificial Sequence
  chemically synthesized
tttttcatgtgaatctgtaa

SEQ ID NO: 191225 - DNA, 20 bp, Artificial Sequence
  chemically synthesized
tgtctttgttaagtctctta

SEQ ID NO: 191226 - DNA, 20 bp, Artificial Sequence
  chemically synthesized
aatctgtaagagacttaaca

SEQ ID NO: 191227 - DNA, 20 bp, Artificial Sequence
  chemically synthesized
cccacatttttgtctttgtt

SEQ ID NO: 191228 - DNA, 20 bp, Artificial Sequence
  chemically synthesized
acttaacaaagacaaaaatg

SEQ ID NO: 191229 - DNA, 20 bp, Artificial Sequence
  chemically synthesized
cttaacaaagacaaaaatgt

SEQ ID NO: 191230 - DNA, 20 bp, Artificial Sequence
  chemically synthesized
aaatgtgggcacaaaaaatg

SEQ ID NO: 191231 - DNA, 20 bp, Artificial Sequence
  chemically synthesized
caaaaaatgtagcaaataaa

SEQ ID NO: 191232 - DNA, 20 bp, Artificial Sequence
  chemically synthesized
tgtagcaaataaacagaatc

SEQ ID NO: 191233 - DNA, 20 bp, Artificial Sequence
  chemically synthesized
gtagcaaataaacagaatct

SEQ ID NO: 191234 - DNA, 20 bp, Artificial Sequence
  chemically synthesized
acatttttctattttagtcc

SEQ ID NO: 191235 - DNA, 20 bp, Artificial Sequence
  chemically synthesized
aacagaatctgggactaaaa

SEQ ID NO: 191236 - DNA, 20 bp, Artificial Sequence
  chemically synthesized
acagttacatttttctattt

SEQ ID NO: 191237 - DNA, 20 bp, Artificial Sequence
  chemically synthesized
atgtaaacacttttgagaca

SEQ ID NO: 191238 - DNA, 20 bp, Artificial Sequence
  chemically synthesized
aaaatgtaactgtgtctcaa

SEQ ID NO: 191239 - DNA, 20 bp, Artificial Sequence
  chemically synthesized
gccagtatgtaaacactttt

SEQ ID NO: 191240 - DNA, 20 bp, Artificial Sequence
  chemically synthesized
tctcaaaagtgtttacatac

SEQ ID NO: 191241 - DNA, 20 bp, Artificial Sequence
  chemically synthesized
agtgtttacatactggctga

SEQ ID NO: 191242 - DNA, 20 bp, Artificial Sequence
  chemically synthesized
tgtttacatactggctgaaa

SEQ ID NO: 191243 - DNA, 20 bp, Artificial Sequence
  chemically synthesized
gtacagttcactctttcagc

SEQ ID NO: 191244 - DNA, 20 bp, Artificial Sequence
  chemically synthesized
ccctgtacagttcactcttt

SEQ ID NO: 191245 - DNA, 20 bp, Artificial Sequence
  chemically synthesized
ggctgaaagagtgaactgta

SEQ ID NO: 191246 - DNA, 20 bp, Artificial Sequence
  chemically synthesized
gctgaaagagtgaactgtac

SEQ ID NO: 191247 - DNA, 20 bp, Artificial Sequence
  chemically synthesized
ctgaaagagtgaactgtaca

SEQ ID NO: 191248 - DNA, 20 bp, Artificial Sequence
  chemically synthesized
ttgtttaaacaaaccctgta

SEQ ID NO: 191249 - DNA, 20 bp, Artificial Sequence
  chemically synthesized
tacagggtttgtttaaacaa

SEQ ID NO: 191250 - DNA, 20 bp, Artificial Sequence
  chemically synthesized
aagttatgtaaatctttgct

SEQ ID NO: 191251 - DNA, 20 bp, Artificial Sequence
  chemically synthesized
cctgagcaaccagctgagca

SEQ ID NO: 191252 - DNA, 20 bp, Artificial Sequence
  chemically synthesized
tatgtaaatctttgctcagc

SEQ ID NO: 191253 - DNA, 20 bp, Artificial Sequence
  chemically synthesized
actttcctgagcaaccagct

SEQ ID NO: 191254 - DNA, 20 bp, Artificial Sequence
  chemically synthesized
tctttgctcagctggttgct

SEQ ID NO: 191255 - DNA, 20 bp, Artificial Sequence
  chemically synthesized
ctttgctcagctggttgctc

SEQ ID NO: 191256 - DNA, 20 bp, Artificial Sequence
  chemically synthesized
catttactttcctgagcaac

SEQ ID NO: 191257 - DNA, 20 bp, Artificial Sequence
  chemically synthesized
gctcagctggttgctcagga

SEQ ID NO: 191258 - DNA, 20 bp, Artificial Sequence
  chemically synthesized
ttgcttccatttactttcct

SEQ ID NO: 191259 - DNA, 20 bp, Artificial Sequence
  chemically synthesized
tggttgctcaggaaagtaaa

SEQ ID NO: 191260 - DNA, 20 bp, Artificial Sequence
  chemically synthesized
ttgctcaggaaagtaaatgg

SEQ ID NO: 191261 - DNA, 20 bp, Artificial Sequence
  chemically synthesized
ggaaagtaaatggaagcaaa

SEQ ID NO: 191262 - DNA, 20 bp, Artificial Sequence
  chemically synthesized
aaagtaaatggaagcaaaca

SEQ ID NO: 191263 - DNA, 20 bp, Artificial Sequence
  chemically synthesized
aagtaaatggaagcaaacag

SEQ ID NO: 191264 - DNA, 20 bp, Artificial Sequence
  chemically synthesized
tggaagcaaacagaggaaaa

SEQ ID NO: 191265 - DNA, 20 bp, Artificial Sequence
  chemically synthesized
aaacagaggaaaacagacca

SEQ ID NO: 191266 - DNA, 20 bp, Artificial Sequence
  chemically synthesized
aacagaggaaaacagaccac

SEQ ID NO: 191267 - DNA, 20 bp, Artificial Sequence
  chemically synthesized
gaggaaaacagaccacgggc

SEQ ID NO: 191268 - DNA, 20 bp, Artificial Sequence
  chemically synthesized
tgacaaactcttccagcccg

SEQ ID NO: 191269 - DNA, 20 bp, Artificial Sequence
  chemically synthesized
gaaaacagaccacgggctgg

SEQ ID NO: 191270 - DNA, 20 bp, Artificial Sequence
  chemically synthesized
aaacagaccacgggctggaa

SEQ ID NO: 191271 - DNA, 20 bp, Artificial Sequence
  chemically synthesized
tcattcttgacaaactcttc

SEQ ID NO: 191272 - DNA, 20 bp, Artificial Sequence
  chemically synthesized
acgggctggaagagtttgtc

SEQ ID NO: 191273 - DNA, 20 bp, Artificial Sequence
  chemically synthesized
gagtttgtcaagaatgataa

SEQ ID NO: 191274 - DNA, 20 bp, Artificial Sequence
  chemically synthesized
agtttgtcaagaatgataac

SEQ ID NO: 191275 - DNA, 20 bp, Artificial Sequence
  chemically synthesized
aagaatgataacgggcattg

SEQ ID NO: 191276 - DNA, 20 bp, Artificial Sequence
  chemically synthesized
gataacgggcattgaagcat

SEQ ID NO: 191277 - DNA, 20 bp, Artificial Sequence
  chemically synthesized
ataacgggcattgaagcatc

SEQ ID NO: 191278 - DNA, 20 bp, Artificial Sequence
  chemically synthesized
agcatcaggatttaaaatga

SEQ ID NO: 191279 - DNA, 20 bp, Artificial Sequence
  chemically synthesized
caggatttaaaatgatagcc

SEQ ID NO: 191280 - DNA, 20 bp, Artificial Sequence
  chemically synthesized
ttgcattatttacagaggct

SEQ ID NO: 191281 - DNA, 20 bp, Artificial Sequence
  chemically synthesized
cttgcattatttacagaggc

SEQ ID NO: 191282 - DNA, 20 bp, Artificial Sequence
  chemically synthesized
agagcttgcattatttacag

SEQ ID NO: 191283 - DNA, 20 bp, Artificial Sequence
  chemically synthesized
aagagcttgcattatttaca

SEQ ID NO: 191284 - DNA, 20 bp, Artificial Sequence
  chemically synthesized
tgaagagcttgcattattta

SEQ ID NO: 191285 - DNA, 20 bp, Artificial Sequence
  chemically synthesized
ccagcctctgtaaataatgc

SEQ ID NO: 191286 - DNA, 20 bp, Artificial Sequence
  chemically synthesized
tgtaaataatgcaagctctt

SEQ ID NO: 191287 - DNA, 20 bp, Artificial Sequence
  chemically synthesized
gtaaataatgcaagctcttc

SEQ ID NO: 191288 - DNA, 20 bp, Artificial Sequence
  chemically synthesized
ggtctctagtgcatcctgaa

SEQ ID NO: 191289 - DNA, 20 bp, Artificial Sequence
  chemically synthesized
tgggtctctagtgcatcctg

SEQ ID NO: 191290 - DNA, 20 bp, Artificial Sequence
  chemically synthesized
gcaagctcttcaggatgcac

SEQ ID NO: 191291 - DNA, 20 bp, Artificial Sequence
  chemically synthesized
aagctcttcaggatgcacta

SEQ ID NO: 191292 - DNA, 20 bp, Artificial Sequence
  chemically synthesized
atgctgtcgagttgggtctc

SEQ ID NO: 191293 - DNA, 20 bp, Artificial Sequence
  chemically synthesized
gcactagagacccaactcga

SEQ ID NO: 191294 - DNA, 20 bp, Artificial Sequence
  chemically synthesized
aattatcatgctgtcgagtt

SEQ ID NO: 191295 - DNA, 20 bp, Artificial Sequence
  chemically synthesized
aaattatcatgctgtcgagt

SEQ ID NO: 191296 - DNA, 20 bp, Artificial Sequence
  chemically synthesized
gctaaaattatcatgctgtc

SEQ ID NO: 191297 - DNA, 20 bp, Artificial Sequence
  chemically synthesized
actcgacagcatgataattt

SEQ ID NO: 191298 - DNA, 20 bp, Artificial Sequence
  chemically synthesized
tggagggaatagcaggtttt

SEQ ID NO: 191299 - DNA, 20 bp, Artificial Sequence
  chemically synthesized
agtcttgtggagggaatagc

SEQ ID NO: 191300 - DNA, 20 bp, Artificial Sequence
  chemically synthesized
gagtcttgtggagggaatag

SEQ ID NO: 191301 - DNA, 20 bp, Artificial Sequence
  chemically synthesized
atggagtcttgtggagggaa

SEQ ID NO: 191302 - DNA, 20 bp, Artificial Sequence
  chemically synthesized
aaacctgctattccctccac

SEQ ID NO: 191303 - DNA, 20 bp, Artificial Sequence
  chemically synthesized
agtttatggagtcttgtgga

SEQ ID NO: 191304 - DNA, 20 bp, Artificial Sequence
  chemically synthesized
tagtttatggagtcttgtgg

SEQ ID NO: 191305 - DNA, 20 bp, Artificial Sequence
  chemically synthesized
ttagtttatggagtcttgtg

SEQ ID NO: 191306 - DNA, 20 bp, Artificial Sequence
  chemically synthesized
ctttagtttatggagtcttg

SEQ ID NO: 191307 - DNA, 20 bp, Artificial Sequence
  chemically synthesized
gctttcttctttagtttatg

SEQ ID NO: 191308 - DNA, 20 bp, Artificial Sequence
  chemically synthesized
ccacaagactccataaacta

SEQ ID NO: 191309 - DNA, 20 bp, Artificial Sequence
  chemically synthesized
cagctttcttctttagttta

SEQ ID NO: 191310 - DNA, 20 bp, Artificial Sequence
  chemically synthesized
caagactccataaactaaag

SEQ ID NO: 191311 - DNA, 20 bp, Artificial Sequence
  chemically synthesized
actccataaactaaagaaga

SEQ ID NO: 191312 - DNA, 20 bp, Artificial Sequence
  chemically synthesized
aatccctcagctttcttctt

SEQ ID NO: 191313 - DNA, 20 bp, Artificial Sequence
  chemically synthesized
ataaactaaagaagaaagct

SEQ ID NO: 191314 - DNA, 20 bp, Artificial Sequence
  chemically synthesized
taaactaaagaagaaagctg

SEQ ID NO: 191315 - DNA, 20 bp, Artificial Sequence
  chemically synthesized
aaactaaagaagaaagctga

SEQ ID NO: 191316 - DNA, 20 bp, Artificial Sequence
  chemically synthesized
tttgggtgtatacaatccct

SEQ ID NO: 191317 - DNA, 20 bp, Artificial Sequence
  chemically synthesized
cttctaacagttggcgtttt

SEQ ID NO: 191318 - DNA, 20 bp, Artificial Sequence
  chemically synthesized
gcttctaacagttggcgttt

SEQ ID NO: 191319 - DNA, 20 bp, Artificial Sequence
  chemically synthesized
acacccaaaacgccaactgt

SEQ ID NO: 191320 - DNA, 20 bp, Artificial Sequence
  chemically synthesized
tttcccacgcttctaacagt

SEQ ID NO: 191321 - DNA, 20 bp, Artificial Sequence
  chemically synthesized
cccaaaacgccaactgttag

SEQ ID NO: 191322 - DNA, 20 bp, Artificial Sequence
  chemically synthesized
caggtttcccacgcttctaa

SEQ ID NO: 191323 - DNA, 20 bp, Artificial Sequence
  chemically synthesized
aacgccaactgttagaagcg

SEQ ID NO: 191324 - DNA, 20 bp, Artificial Sequence
  chemically synthesized
acgccaactgttagaagcgt

SEQ ID NO: 191325 - DNA, 20 bp, Artificial Sequence
  chemically synthesized
tgttagaagcgtgggaaacc

SEQ ID NO: 191326 - DNA, 20 bp, Artificial Sequence
  chemically synthesized
atcagagatttaaaggtgcc

SEQ ID NO: 191327 - DNA, 20 bp, Artificial Sequence
  chemically synthesized
aatcagagatttaaaggtgc

SEQ ID NO: 191328 - DNA, 20 bp, Artificial Sequence
  chemically synthesized
ggataaaatcagagatttaa

SEQ ID NO: 191329 - DNA, 20 bp, Artificial Sequence
  chemically synthesized
gggataaaatcagagattta

SEQ ID NO: 191330 - DNA, 20 bp, Artificial Sequence
  chemically synthesized
gcaactaagggataaaatca

SEQ ID NO: 191331 - DNA, 20 bp, Artificial Sequence
  chemically synthesized
gggcaactaagggataaaat

SEQ ID NO: 191332 - DNA, 20 bp, Artificial Sequence
  chemically synthesized
aaatctctgattttatccct

SEQ ID NO: 191333 - DNA, 20 bp, Artificial Sequence
  chemically synthesized
gcaatgtcatgggcaactaa

SEQ ID NO: 191334 - DNA, 20 bp, Artificial Sequence
  chemically synthesized
ggcaatgtcatgggcaacta

SEQ ID NO: 191335 - DNA, 20 bp, Artificial Sequence
  chemically synthesized
aggcaatgtcatgggcaact

SEQ ID NO: 191336 - DNA, 20 bp, Artificial Sequence
  chemically synthesized
aatctcccaggcaatgtcat

SEQ ID NO: 191337 - DNA, 20 bp, Artificial Sequence
  chemically synthesized
aaatctcccaggcaatgtca

SEQ ID NO: 191338 - DNA, 20 bp, Artificial Sequence
  chemically synthesized
tagttgcccatgacattgcc

SEQ ID NO: 191339 - DNA, 20 bp, Artificial Sequence
  chemically synthesized
agttgcccatgacattgcct

SEQ ID NO: 191340 - DNA, 20 bp, Artificial Sequence
  chemically synthesized
ttgcccatgacattgcctgg

SEQ ID NO: 191341 - DNA, 20 bp, Artificial Sequence
  chemically synthesized
taagtgctgcaaaatctccc

SEQ ID NO: 191342 - DNA, 20 bp, Artificial Sequence
  chemically synthesized
ttaagtgctgcaaaatctcc

SEQ ID NO: 191343 - DNA, 20 bp, Artificial Sequence
  chemically synthesized
acattgcctgggagattttg

SEQ ID NO: 191344 - DNA, 20 bp, Artificial Sequence
  chemically synthesized
agattttgcagcacttaaac

SEQ ID NO: 191345 - DNA, 20 bp, Artificial Sequence
  chemically synthesized
gattttgcagcacttaaact

SEQ ID NO: 191346 - DNA, 20 bp, Artificial Sequence
  chemically synthesized
tgtctaacttatcccagttt

SEQ ID NO: 191347 - DNA, 20 bp, Artificial Sequence
  chemically synthesized
tgcagcacttaaactgggat

SEQ ID NO: 191348 - DNA, 20 bp, Artificial Sequence
  chemically synthesized
tttaattgtctaacttatcc

SEQ ID NO: 191349 - DNA, 20 bp, Artificial Sequence
  chemically synthesized
gcacttaaactgggataagt

SEQ ID NO: 191350 - DNA, 20 bp, Artificial Sequence
  chemically synthesized
tgggataagttagacaatta

SEQ ID NO: 191351 - DNA, 20 bp, Artificial Sequence
  chemically synthesized
gttagacaattaaagcatct

SEQ ID NO: 191352 - DNA, 20 bp, Artificial Sequence
  chemically synthesized
agcatggttagacaaaaact

SEQ ID NO: 191353 - DNA, 20 bp, Artificial Sequence
  chemically synthesized
actcttatttttagcatggt

SEQ ID NO: 191354 - DNA, 20 bp, Artificial Sequence
  chemically synthesized
tgtcactcttatttttagca

SEQ ID NO: 191355 - DNA, 20 bp, Artificial Sequence
  chemically synthesized
tgtctaaccatgctaaaaat

SEQ ID NO: 191356 - DNA, 20 bp, Artificial Sequence
  chemically synthesized
tctaaccatgctaaaaataa

SEQ ID NO: 191357 - DNA, 20 bp, Artificial Sequence
  chemically synthesized
agacctgtcactcttatttt

SEQ ID NO: 191358 - DNA, 20 bp, Artificial Sequence
  chemically synthesized
catgctaaaaataagagtga

SEQ ID NO: 191359 - DNA, 20 bp, Artificial Sequence
  chemically synthesized
atgctaaaaataagagtgac

SEQ ID NO: 191360 - DNA, 20 bp, Artificial Sequence
  chemically synthesized
aaataagagtgacaggtctg

SEQ ID NO: 191361 - DNA, 20 bp, Artificial Sequence
  chemically synthesized
aaggcacaaaatgtttgctt

SEQ ID NO: 191362 - DNA, 20 bp, Artificial Sequence
  chemically synthesized
tgaattttgtttgcatacaa

SEQ ID NO: 191363 - DNA, 20 bp, Artificial Sequence
  chemically synthesized
ctgaattttgtttgcataca

SEQ ID NO: 191364 - DNA, 20 bp, Artificial Sequence
  chemically synthesized
ctttgtatgcaaacaaaatt

SEQ ID NO: 191365 - DNA, 20 bp, Artificial Sequence
  chemically synthesized
aattcagttgacaaaacaca

SEQ ID NO: 191366 - DNA, 20 bp, Artificial Sequence
  chemically synthesized
aaagtacaatgactacgaat

SEQ ID NO: 191367 - DNA, 20 bp, Artificial Sequence
  chemically synthesized
ttgtatctttagctcattcg

SEQ ID NO: 191368 - DNA, 20 bp, Artificial Sequence
  chemically synthesized
caatgactacgaatgagcta

SEQ ID NO: 191369 - DNA, 20 bp, Artificial Sequence
  chemically synthesized
ctaacttaattttgtatctt

SEQ ID NO: 191370 - DNA, 20 bp, Artificial Sequence
  chemically synthesized
tgagctaaagatacaaaatt

SEQ ID NO: 191371 - DNA, 20 bp, Artificial Sequence
  chemically synthesized
ctaaagatacaaaattaagt

SEQ ID NO: 191372 - DNA, 20 bp, Artificial Sequence
  chemically synthesized
taaagatacaaaattaagtt

SEQ ID NO: 191373 - DNA, 20 bp, Artificial Sequence
  chemically synthesized
ggggaagggacagcgttcat

SEQ ID NO: 191374 - DNA, 20 bp, Artificial Sequence
  chemically synthesized
cggggaagggacagcgttca

SEQ ID NO: 191375 - DNA, 20 bp, Artificial Sequence
  chemically synthesized
aatatttagcggggaaggga

SEQ ID NO: 191376 - DNA, 20 bp, Artificial Sequence
  chemically synthesized
gtaaaatatttagcggggaa

SEQ ID NO: 191377 - DNA, 20 bp, Artificial Sequence
  chemically synthesized
agtaaaatatttagcgggga

SEQ ID NO: 191378 - DNA, 20 bp, Artificial Sequence
  chemically synthesized
aagtaaaatatttagcgggg

SEQ ID NO: 191379 - DNA, 20 bp, Artificial Sequence
  chemically synthesized
cggaagtaaaatatttagcg

SEQ ID NO: 191380 - DNA, 20 bp, Artificial Sequence
  chemically synthesized
gcggaagtaaaatatttagc

SEQ ID NO: 191381 - DNA, 20 bp, Artificial Sequence
  chemically synthesized
ggcggaagtaaaatatttag

SEQ ID NO: 191382 - DNA, 20 bp, Artificial Sequence
  chemically synthesized
agtggcggaagtaaaatatt

SEQ ID NO: 191383 - DNA, 20 bp, Artificial Sequence
  chemically synthesized
ttagagggtttcagtggcgg

SEQ ID NO: 191384 - DNA, 20 bp, Artificial Sequence
  chemically synthesized
gtgttagagggtttcagtgg

SEQ ID NO: 191385 - DNA, 20 bp, Artificial Sequence
  chemically synthesized
ttggtgttagagggtttcag

SEQ ID NO: 191386 - DNA, 20 bp, Artificial Sequence
  chemically synthesized
tcattggtgttagagggttt

SEQ ID NO: 191387 - DNA, 20 bp, Artificial Sequence
  chemically synthesized
tttatttcattggtgttaga

SEQ ID NO: 191388 - DNA, 20 bp, Artificial Sequence
  chemically synthesized
gtttatttcattggtgttag

SEQ ID NO: 191389 - DNA, 20 bp, Artificial Sequence
  chemically synthesized
tgtttatttcattggtgtta

SEQ ID NO: 191390 - DNA, 20 bp, Artificial Sequence
  chemically synthesized
tatgtttatttcattggtgt

SEQ ID NO: 191391 - DNA, 20 bp, Artificial Sequence
  chemically synthesized
ccaacttatgtttatttcat

SEQ ID NO: 191392 - DNA, 20 bp, Artificial Sequence
  chemically synthesized
aacaccaatgaaataaacat

SEQ ID NO: 191393 - DNA, 20 bp, Artificial Sequence
  chemically synthesized
ccaatgaaataaacataagt

SEQ ID NO: 191394 - DNA, 20 bp, Artificial Sequence
  chemically synthesized
atgaaataaacataagttgg

SEQ ID NO: 191395 - DNA, 20 bp, Artificial Sequence
  chemically synthesized
tgaaataaacataagttggt

SEQ ID NO: 191396 - DNA, 20 bp, Artificial Sequence
  chemically synthesized
ataaacataagttggtagga

SEQ ID NO: 191397 - DNA, 20 bp, Artificial Sequence
  chemically synthesized
taaacataagttggtaggac

SEQ ID NO: 191398 - DNA, 20 bp, Artificial Sequence
  chemically synthesized
cataagttggtaggacaggt

SEQ ID NO: 191399 - DNA, 20 bp, Artificial Sequence
  chemically synthesized
caggtgagaaaaatcttctt

SEQ ID NO: 191400 - DNA, 20 bp, Artificial Sequence
  chemically synthesized
aggtgagaaaaatcttctta

SEQ ID NO: 191401 - DNA, 20 bp, Artificial Sequence
  chemically synthesized
gtgagaaaaatcttcttaag

SEQ ID NO: 191402 - DNA, 20 bp, Artificial Sequence
  chemically synthesized
attagtttgagctccttaag

SEQ ID NO: 191403 - DNA, 20 bp, Artificial Sequence
  chemically synthesized
gttattagtttgagctcctt

SEQ ID NO: 191404 - DNA, 20 bp, Artificial Sequence
  chemically synthesized
atacgtagggttattagttt

SEQ ID NO: 191405 - DNA, 20 bp, Artificial Sequence
  chemically synthesized
cagatgatacgtagggttat

SEQ ID NO: 191406 - DNA, 20 bp, Artificial Sequence
  chemically synthesized
tgttttccagatgatacgta

SEQ ID NO: 191407 - DNA, 20 bp, Artificial Sequence
  chemically synthesized
ctgttttccagatgatacgt

SEQ ID NO: 191408 - DNA, 20 bp, Artificial Sequence
  chemically synthesized
actgttttccagatgatacg

SEQ ID NO: 191409 - DNA, 20 bp, Artificial Sequence
  chemically synthesized
taataaccctacgtatcatc

SEQ ID NO: 191410 - DNA, 20 bp, Artificial Sequence
  chemically synthesized
cctacgtatcatctggaaaa

SEQ ID NO: 191411 - DNA, 20 bp, Artificial Sequence
  chemically synthesized
cctcttgccagactgttttc

SEQ ID NO: 191412 - DNA, 20 bp, Artificial Sequence
  chemically synthesized
gtatcatctggaaaacagtc

SEQ ID NO: 191413 - DNA, 20 bp, Artificial Sequence
  chemically synthesized
catctggaaaacagtctggc

SEQ ID NO: 191414 - DNA, 20 bp, Artificial Sequence
  chemically synthesized
tctggaaaacagtctggcaa

SEQ ID NO: 191415 - DNA, 20 bp, Artificial Sequence
  chemically synthesized
ctggaaaacagtctggcaag

SEQ ID NO: 191416 - DNA, 20 bp, Artificial Sequence
  chemically synthesized
gcgaaaagaaggcctcttgc

SEQ ID NO: 191417 - DNA, 20 bp, Artificial Sequence
  chemically synthesized
agaaggttaatgcgaaaaga

SEQ ID NO: 191418 - DNA, 20 bp, Artificial Sequence
  chemically synthesized
cagaaggttaatgcgaaaag

SEQ ID NO: 191419 - DNA, 20 bp, Artificial Sequence
  chemically synthesized
ccacagaaggttaatgcgaa

SEQ ID NO: 191420 - DNA, 20 bp, Artificial Sequence
  chemically synthesized
cttttcgcattaaccttctg

SEQ ID NO: 191421 - DNA, 20 bp, Artificial Sequence
  chemically synthesized
ttttcgcattaaccttctgt

SEQ ID NO: 191422 - DNA, 20 bp, Artificial Sequence
  chemically synthesized
tcaggtgcggagcccacaga

SEQ ID NO: 191423 - DNA, 20 bp, Artificial Sequence
  chemically synthesized
gtcaggtgcggagcccacag

SEQ ID NO: 191424 - DNA, 20 bp, Artificial Sequence
  chemically synthesized
tttgtcaggtgcggagccca

SEQ ID NO: 191425 - DNA, 20 bp, Artificial Sequence
  chemically synthesized
cccatgctttgtcaggtgcg

SEQ ID NO: 191426 - DNA, 20 bp, Artificial Sequence
  chemically synthesized
gccccatgctttgtcaggtg

SEQ ID NO: 191427 - DNA, 20 bp, Artificial Sequence
  chemically synthesized
tgtgggctccgcacctgaca

SEQ ID NO: 191428 - DNA, 20 bp, Artificial Sequence
  chemically synthesized
gagcagccccatgctttgtc

SEQ ID NO: 191429 - DNA, 20 bp, Artificial Sequence
  chemically synthesized
ggagcagccccatgctttgt

SEQ ID NO: 191430 - DNA, 20 bp, Artificial Sequence
  chemically synthesized
gctccgcacctgacaaagca

SEQ ID NO: 191431 - DNA, 20 bp, Artificial Sequence
  chemically synthesized
ctccgcacctgacaaagcat

SEQ ID NO: 191432 - DNA, 20 bp, Artificial Sequence
  chemically synthesized
tccgcacctgacaaagcatg

SEQ ID NO: 191433 - DNA, 20 bp, Artificial Sequence
  chemically synthesized
aaagcatggggctgctcccc

SEQ ID NO: 191434 - DNA, 20 bp, Artificial Sequence
  chemically synthesized
gagtcccatttctcggggag

SEQ ID NO: 191435 - DNA, 20 bp, Artificial Sequence
  chemically synthesized
tgggagtcccatttctcggg

SEQ ID NO: 191436 - DNA, 20 bp, Artificial Sequence
  chemically synthesized
tggggctgctccccgagaaa

SEQ ID NO: 191437 - DNA, 20 bp, Artificial Sequence
  chemically synthesized
actgggagtcccatttctcg

SEQ ID NO: 191438 - DNA, 20 bp, Artificial Sequence
  chemically synthesized
ggggctgctccccgagaaat

SEQ ID NO: 191439 - DNA, 20 bp, Artificial Sequence
  chemically synthesized
cactgggagtcccatttctc

SEQ ID NO: 191440 - DNA, 20 bp, Artificial Sequence
  chemically synthesized
tcactgggagtcccatttct

SEQ ID NO: 191441 - DNA, 20 bp, Artificial Sequence
  chemically synthesized
tccccgagaaatgggactcc

SEQ ID NO: 191442 - DNA, 20 bp, Artificial Sequence
  chemically synthesized
cagttagtctgtgtcactgg

SEQ ID NO: 191443 - DNA, 20 bp, Artificial Sequence
  chemically synthesized
aaatgggactcccagtgaca

SEQ ID NO: 191444 - DNA, 20 bp, Artificial Sequence
  chemically synthesized
tccagttagtctgtgtcact

SEQ ID NO: 191445 - DNA, 20 bp, Artificial Sequence
  chemically synthesized
ctccagttagtctgtgtcac

SEQ ID NO: 191446 - DNA, 20 bp, Artificial Sequence
  chemically synthesized
tcccagtgacacagactaac

SEQ ID NO: 191447 - DNA, 20 bp, Artificial Sequence
  chemically synthesized
ccagtgacacagactaactg

SEQ ID NO: 191448 - DNA, 20 bp, Artificial Sequence
  chemically synthesized
caggccaatttttctccagt

SEQ ID NO: 191449 - DNA, 20 bp, Artificial Sequence
  chemically synthesized
acttcaggccaatttttctc

SEQ ID NO: 191450 - DNA, 20 bp, Artificial Sequence
  chemically synthesized
cagactaactggagaaaaat

SEQ ID NO: 191451 - DNA, 20 bp, Artificial Sequence
  chemically synthesized
actggagaaaaattggcctg

SEQ ID NO: 191452 - DNA, 20 bp, Artificial Sequence
  chemically synthesized
aatgactgatgtataacttc

SEQ ID NO: 191453 - DNA, 20 bp, Artificial Sequence
  chemically synthesized
aaatgactgatgtataactt

SEQ ID NO: 191454 - DNA, 20 bp, Artificial Sequence
  chemically synthesized
attggcctgaagttatacat

SEQ ID NO: 191455 - DNA, 20 bp, Artificial Sequence
  chemically synthesized
agttatacatcagtcatttg

SEQ ID NO: 191456 - DNA, 20 bp, Artificial Sequence
  chemically synthesized
acatcagtcatttgcagaac

SEQ ID NO: 191457 - DNA, 20 bp, Artificial Sequence
  chemically synthesized
tcatttgcagaacaagactt

SEQ ID NO: 191458 - DNA, 20 bp, Artificial Sequence
  chemically synthesized
catttgcagaacaagacttg

SEQ ID NO: 191459 - DNA, 20 bp, Artificial Sequence
  chemically synthesized
tccaaaggctgatgatcctc

SEQ ID NO: 191460 - DNA, 20 bp, Artificial Sequence
  chemically synthesized
gaacaagacttgaggatcat

SEQ ID NO: 191461 - DNA, 20 bp, Artificial Sequence
  chemically synthesized
acttgaggatcatcagcctt

SEQ ID NO: 191462 - DNA, 20 bp, Artificial Sequence
  chemically synthesized
ggatcatcagcctttggaaa

SEQ ID NO: 191463 - DNA, 20 bp, Artificial Sequence
  chemically synthesized
tggaataaaaccatttccaa

SEQ ID NO: 191464 - DNA, 20 bp, Artificial Sequence
  chemically synthesized
ttggaataaaaccatttcca

SEQ ID NO: 191465 - DNA, 20 bp, Artificial Sequence
  chemically synthesized
tttggaaatggttttattcc

SEQ ID NO: 191466 - DNA, 20 bp, Artificial Sequence
  chemically synthesized
tggttttattccaagttata

SEQ ID NO: 191467 - DNA, 20 bp, Artificial Sequence
  chemically synthesized
gtgcctactcctgtataact

SEQ ID NO: 191468 - DNA, 20 bp, Artificial Sequence
  chemically synthesized
ggttttattccaagttatac

SEQ ID NO: 191469 - DNA, 20 bp, Artificial Sequence
  chemically synthesized
ttttattccaagttatacag

SEQ ID NO: 191470 - DNA, 20 bp, Artificial Sequence
  chemically synthesized
tattccaagttatacaggag

SEQ ID NO: 191471 - DNA, 20 bp, Artificial Sequence
  chemically synthesized
attccaagttatacaggagt

SEQ ID NO: 191472 - DNA, 20 bp, Artificial Sequence
  chemically synthesized
gctaagggcagatataaagc

SEQ ID NO: 191473 - DNA, 20 bp, Artificial Sequence
  chemically synthesized
tgctaagggcagatataaag

SEQ ID NO: 191474 - DNA, 20 bp, Artificial Sequence
  chemically synthesized
gagtgctaagggcagatata

SEQ ID NO: 191475 - DNA, 20 bp, Artificial Sequence
  chemically synthesized
acctgctttatatctgccct

SEQ ID NO: 191476 - DNA, 20 bp, Artificial Sequence
  chemically synthesized
ttaatccggagtgctaaggg

SEQ ID NO: 191477 - DNA, 20 bp, Artificial Sequence
  chemically synthesized
cgattaatccggagtgctaa

SEQ ID NO: 191478 - DNA, 20 bp, Artificial Sequence
  chemically synthesized
gcgattaatccggagtgcta

SEQ ID NO: 191479 - DNA, 20 bp, Artificial Sequence
  chemically synthesized
tatatctgcccttagcactc

SEQ ID NO: 191480 - DNA, 20 bp, Artificial Sequence
  chemically synthesized
tgcgattaatccggagtgct

SEQ ID NO: 191481 - DNA, 20 bp, Artificial Sequence
  chemically synthesized
atatatgtgcgattaatccg

SEQ ID NO: 191482 - DNA, 20 bp, Artificial Sequence
  chemically synthesized
ctatatatgtgcgattaatc

SEQ ID NO: 191483 - DNA, 20 bp, Artificial Sequence
  chemically synthesized
ccggattaatcgcacatata

SEQ ID NO: 191484 - DNA, 20 bp, Artificial Sequence
  chemically synthesized
cggattaatcgcacatatat

SEQ ID NO: 191485 - DNA, 20 bp, Artificial Sequence
  chemically synthesized
ggattaatcgcacatatata

SEQ ID NO: 191486 - DNA, 20 bp, Artificial Sequence
  chemically synthesized
gcaatgaagagatcaacagg

SEQ ID NO: 191487 - DNA, 20 bp, Artificial Sequence
  chemically synthesized
ttgcaatgaagagatcaaca

SEQ ID NO: 191488 - DNA, 20 bp, Artificial Sequence
  chemically synthesized
attgcaatgaagagatcaac

SEQ ID NO: 191489 - DNA, 20 bp, Artificial Sequence
  chemically synthesized
gattgcaatgaagagatcaa

SEQ ID NO: 191490 - DNA, 20 bp, Artificial Sequence
  chemically synthesized
gggcacaagattgcaatgaa

SEQ ID NO: 191491 - DNA, 20 bp, Artificial Sequence
  chemically synthesized
gtgggcacaagattgcaatg

SEQ ID NO: 191492 - DNA, 20 bp, Artificial Sequence
  chemically synthesized
cattgagattttgtgggcac

SEQ ID NO: 191493 - DNA, 20 bp, Artificial Sequence
  chemically synthesized
cagttccattgagattttgt

SEQ ID NO: 191494 - DNA, 20 bp, Artificial Sequence
  chemically synthesized
gcagttccattgagattttg

SEQ ID NO: 191495 - DNA, 20 bp, Artificial Sequence
  chemically synthesized
ttgtgcccacaaaatctcaa

SEQ ID NO: 191496 - DNA, 20 bp, Artificial Sequence
  chemically synthesized
cctgttagcgcagttccatt

SEQ ID NO: 191497 - DNA, 20 bp, Artificial Sequence
  chemically synthesized
tctcaatggaactgcgctaa

SEQ ID NO: 191498 - DNA, 20 bp, Artificial Sequence
  chemically synthesized
ctcaatggaactgcgctaac

SEQ ID NO: 191499 - DNA, 20 bp, Artificial Sequence
  chemically synthesized
gtcttttaaacctgttagcg

SEQ ID NO: 191500 - DNA, 20 bp, Artificial Sequence
  chemically synthesized
acttggtcttttaaacctgt

SEQ ID NO: 191501 - DNA, 20 bp, Artificial Sequence
  chemically synthesized
aactgcgctaacaggtttaa

SEQ ID NO: 191502 - DNA, 20 bp, Artificial Sequence
  chemically synthesized
gctaacaggtttaaaagacc

SEQ ID NO: 191503 - DNA, 20 bp, Artificial Sequence
  chemically synthesized
acaggtttaaaagaccaagt

SEQ ID NO: 191504 - DNA, 20 bp, Artificial Sequence
  chemically synthesized
caggtttaaaagaccaagtc

SEQ ID NO: 191505 - DNA, 20 bp, Artificial Sequence
  chemically synthesized
gacaagtgaatttcctgact

SEQ ID NO: 191506 - DNA, 20 bp, Artificial Sequence
  chemically synthesized
caggaaattcacttgtcact

SEQ ID NO: 191507 - DNA, 20 bp, Artificial Sequence
  chemically synthesized
cactttgagaaccaagtgac

SEQ ID NO: 191508 - DNA, 20 bp, Artificial Sequence
  chemically synthesized
tcgcgttcactttgagaacc

SEQ ID NO: 191509 - DNA, 20 bp, Artificial Sequence
  chemically synthesized
cacttgtcacttggttctca

SEQ ID NO: 191510 - DNA, 20 bp, Artificial Sequence
  chemically synthesized
gtttctttcgcgttcacttt

SEQ ID NO: 191511 - DNA, 20 bp, Artificial Sequence
  chemically synthesized
ggttctcaaagtgaacgcga

SEQ ID NO: 191512 - DNA, 20 bp, Artificial Sequence
  chemically synthesized
agtgaacgcgaaagaaactg

SEQ ID NO: 191513 - DNA, 20 bp, Artificial Sequence
  chemically synthesized
catgacccctttgaattctt

SEQ ID NO: 191514 - DNA, 20 bp, Artificial Sequence
  chemically synthesized
gaaagaaactgaagaattca

SEQ ID NO: 191515 - DNA, 20 bp, Artificial Sequence
  chemically synthesized
aaagaaactgaagaattcaa

SEQ ID NO: 191516 - DNA, 20 bp, Artificial Sequence
  chemically synthesized
aagaaactgaagaattcaaa

SEQ ID NO: 191517 - DNA, 20 bp, Artificial Sequence
  chemically synthesized
agaaactgaagaattcaaag

SEQ ID NO: 191518 - DNA, 20 bp, Artificial Sequence
  chemically synthesized
tgaagaattcaaaggggtca

SEQ ID NO: 191519 - DNA, 20 bp, Artificial Sequence
  chemically synthesized
gggtcatggatatttcttca

SEQ ID NO: 191520 - DNA, 20 bp, Artificial Sequence
  chemically synthesized
aacaactatttggagctttg

SEQ ID NO: 191521 - DNA, 20 bp, Artificial Sequence
  chemically synthesized
tatttcttcaaagctccaaa

SEQ ID NO: 191522 - DNA, 20 bp, Artificial Sequence
  chemically synthesized
ctctaccaaacaactatttg

SEQ ID NO: 191523 - DNA, 20 bp, Artificial Sequence
  chemically synthesized
atctctaccaaacaactatt

SEQ ID NO: 191524 - DNA, 20 bp, Artificial Sequence
  chemically synthesized
caaagctccaaatagttgtt

SEQ ID NO: 191525 - DNA, 20 bp, Artificial Sequence
  chemically synthesized
agctccaaatagttgtttgg

SEQ ID NO: 191526 - DNA, 20 bp, Artificial Sequence
  chemically synthesized
ctccaaatagttgtttggta

SEQ ID NO: 191527 - DNA, 20 bp, Artificial Sequence
  chemically synthesized
tggtagagatgacgaatttt

SEQ ID NO: 191528 - DNA, 20 bp, Artificial Sequence
  chemically synthesized
atgacgaattttgagccatc

SEQ ID NO: 191529 - DNA, 20 bp, Artificial Sequence
  chemically synthesized
tgacgaattttgagccatct

SEQ ID NO: 191530 - DNA, 20 bp, Artificial Sequence
  chemically synthesized
gccttctcgtattgcccaga

SEQ ID NO: 191531 - DNA, 20 bp, Artificial Sequence
  chemically synthesized
gggagccttctcgtattgcc

SEQ ID NO: 191532 - DNA, 20 bp, Artificial Sequence
  chemically synthesized
ttgagccatctgggcaatac

SEQ ID NO: 191533 - DNA, 20 bp, Artificial Sequence
  chemically synthesized
agccatctgggcaatacgag

SEQ ID NO: 191534 - DNA, 20 bp, Artificial Sequence
  chemically synthesized
gccatctgggcaatacgaga

SEQ ID NO: 191535 - DNA, 20 bp, Artificial Sequence
  chemically synthesized
gtaaggaaggataatcaggg

SEQ ID NO: 191536 - DNA, 20 bp, Artificial Sequence
  chemically synthesized
acgtaaggaaggataatcag

SEQ ID NO: 191537 - DNA, 20 bp, Artificial Sequence
  chemically synthesized
cacgtaaggaaggataatca

SEQ ID NO: 191538 - DNA, 20 bp, Artificial Sequence
  chemically synthesized
gcacgtaaggaaggataatc

SEQ ID NO: 191539 - DNA, 20 bp, Artificial Sequence
  chemically synthesized
agcacgtaaggaaggataat

SEQ ID NO: 191540 - DNA, 20 bp, Artificial Sequence
  chemically synthesized
agttgataagcacgtaagga

SEQ ID NO: 191541 - DNA, 20 bp, Artificial Sequence
  chemically synthesized
gagttgataagcacgtaagg

SEQ ID NO: 191542 - DNA, 20 bp, Artificial Sequence
  chemically synthesized
agtgagttgataagcacgta

SEQ ID NO: 191543 - DNA, 20 bp, Artificial Sequence
  chemically synthesized
aagtgagttgataagcacgt

SEQ ID NO: 191544 - DNA, 20 bp, Artificial Sequence
  chemically synthesized
agggccgcaagtgagttgat

SEQ ID NO: 191545 - DNA, 20 bp, Artificial Sequence
  chemically synthesized
cgtgcttatcaactcacttg

SEQ ID NO: 191546 - DNA, 20 bp, Artificial Sequence
  chemically synthesized
ctctccctagggccgcaagt

SEQ ID NO: 191547 - DNA, 20 bp, Artificial Sequence
  chemically synthesized
tatcaactcacttgcggccc

SEQ ID NO: 191548 - DNA, 20 bp, Artificial Sequence
  chemically synthesized
catcctctccctagggccgc

SEQ ID NO: 191549 - DNA, 20 bp, Artificial Sequence
  chemically synthesized
atcaactcacttgcggccct

SEQ ID NO: 191550 - DNA, 20 bp, Artificial Sequence
  chemically synthesized
tcaactcacttgcggcccta

SEQ ID NO: 191551 - DNA, 20 bp, Artificial Sequence
  chemically synthesized
aactcacttgcggccctagg

SEQ ID NO: 191552 - DNA, 20 bp, Artificial Sequence
  chemically synthesized
ctcacttgcggccctaggga

SEQ ID NO: 191553 - DNA, 20 bp, Artificial Sequence
  chemically synthesized
tcacttgcggccctagggag

SEQ ID NO: 191554 - DNA, 20 bp, Artificial Sequence
  chemically synthesized
gaaatgccatcctctcccta

SEQ ID NO: 191555 - DNA, 20 bp, Artificial Sequence
  chemically synthesized
ggaaatgccatcctctccct

SEQ ID NO: 191556 - DNA, 20 bp, Artificial Sequence
  chemically synthesized
cggaaatgccatcctctccc

SEQ ID NO: 191557 - DNA, 20 bp, Artificial Sequence
  chemically synthesized
ttgcggccctagggagagga

SEQ ID NO: 191558 - DNA, 20 bp, Artificial Sequence
  chemically synthesized
gggagaggatggcatttccg

SEQ ID NO: 191559 - DNA, 20 bp, Artificial Sequence
  chemically synthesized
acagagagaatttggaactt

SEQ ID NO: 191560 - DNA, 20 bp, Artificial Sequence
  chemically synthesized
agatacacacagagagaatt

SEQ ID NO: 191561 - DNA, 20 bp, Artificial Sequence
  chemically synthesized
agcacacagatacacacaga

SEQ ID NO: 191562 - DNA, 20 bp, Artificial Sequence
  chemically synthesized
caagcacacagatacacaca

SEQ ID NO: 191563 - DNA, 20 bp, Artificial Sequence
  chemically synthesized
ctcaagcacacagatacaca

SEQ ID NO: 191564 - DNA, 20 bp, Artificial Sequence
  chemically synthesized
ctgtgtgtatctgtgtgctt

SEQ ID NO: 191565 - DNA, 20 bp, Artificial Sequence
  chemically synthesized
aacttatgcgctcaagcaca

SEQ ID NO: 191566 - DNA, 20 bp, Artificial Sequence
  chemically synthesized
atgtaataacttatgcgctc

SEQ ID NO: 191567 - DNA, 20 bp, Artificial Sequence
  chemically synthesized
atctgtgtgcttgagcgcat

SEQ ID NO: 191568 - DNA, 20 bp, Artificial Sequence
  chemically synthesized
aaatgaataaatatttaagt

SEQ ID NO: 191569 - DNA, 20 bp, Artificial Sequence
  chemically synthesized
cagtaaatgaataaatattt

SEQ ID NO: 191570 - DNA, 20 bp, Artificial Sequence
  chemically synthesized
tatttattcatttactgaaa

SEQ ID NO: 191571 - DNA, 20 bp, Artificial Sequence
  chemically synthesized
atttattcatttactgaaaa

SEQ ID NO: 191572 - DNA, 20 bp, Artificial Sequence
  chemically synthesized
tttattcatttactgaaaaa

SEQ ID NO: 191573 - DNA, 20 bp, Artificial Sequence
  chemically synthesized
tactacctcttgcccttttt

SEQ ID NO: 191574 - DNA, 20 bp, Artificial Sequence
  chemically synthesized
ttcatttactgaaaaagggc

SEQ ID NO: 191575 - DNA, 20 bp, Artificial Sequence
  chemically synthesized
catttactgaaaaagggcaa

SEQ ID NO: 191576 - DNA, 20 bp, Artificial Sequence
  chemically synthesized
atttactgaaaaagggcaag

SEQ ID NO: 191577 - DNA, 20 bp, Artificial Sequence
  chemically synthesized
tactgaaaaagggcaagagg

SEQ ID NO: 191578 - DNA, 20 bp, Artificial Sequence
  chemically synthesized
aaaaagggcaagaggtagta

SEQ ID NO: 191579 - DNA, 20 bp, Artificial Sequence
  chemically synthesized
agggcaagaggtagtaaagt

SEQ ID NO: 191580 - DNA, 20 bp, Artificial Sequence
  chemically synthesized
gaggtagtaaagtaagtcca

SEQ ID NO: 191581 - DNA, 20 bp, Artificial Sequence
  chemically synthesized
ggtagtaaagtaagtccaca

SEQ ID NO: 191582 - DNA, 20 bp, Artificial Sequence
  chemically synthesized
cctactcatttttcactctg

SEQ ID NO: 191583 - DNA, 20 bp, Artificial Sequence
  chemically synthesized
aagtccacagagtgaaaaat

SEQ ID NO: 191584 - DNA, 20 bp, Artificial Sequence
  chemically synthesized
tccacagagtgaaaaatgag

SEQ ID NO: 191585 - DNA, 20 bp, Artificial Sequence
  chemically synthesized
ccacagagtgaaaaatgagt

SEQ ID NO: 191586 - DNA, 20 bp, Artificial Sequence
  chemically synthesized
aaatgagtaggcaaatttga

SEQ ID NO: 191587 - DNA, 20 bp, Artificial Sequence
  chemically synthesized
taggcaaatttgaaagtcac

SEQ ID NO: 191588 - DNA, 20 bp, Artificial Sequence
  chemically synthesized
tcaaccaatagagtaatcac

SEQ ID NO: 191589 - DNA, 20 bp, Artificial Sequence
  chemically synthesized
gtcaccagtgattactctat

SEQ ID NO: 191590 - DNA, 20 bp, Artificial Sequence
  chemically synthesized
atgcatcttttcaaccaata

SEQ ID NO: 191591 - DNA, 20 bp, Artificial Sequence
  chemically synthesized
taatgcatcttttcaaccaa

SEQ ID NO: 191592 - DNA, 20 bp, Artificial Sequence
  chemically synthesized
tgattactctattggttgaa

SEQ ID NO: 191593 - DNA, 20 bp, Artificial Sequence
  chemically synthesized
cattatcataatgaatgcat

SEQ ID NO: 191594 - DNA, 20 bp, Artificial Sequence
  chemically synthesized
ttatcataatgaatgcatta

SEQ ID NO: 191595 - DNA, 20 bp, Artificial Sequence
  chemically synthesized
gagataacaaacatatgtac

SEQ ID NO: 191596 - DNA, 20 bp, Artificial Sequence
  chemically synthesized
aacatatgtacaagtgtcaa

SEQ ID NO: 191597 - DNA, 20 bp, Artificial Sequence
  chemically synthesized
acatatgtacaagtgtcaat

SEQ ID NO: 191598 - DNA, 20 bp, Artificial Sequence
  chemically synthesized
tacaagtgtcaataggtttg

SEQ ID NO: 191599 - DNA, 20 bp, Artificial Sequence
  chemically synthesized
acaagtgtcaataggtttgt

SEQ ID NO: 191600 - DNA, 20 bp, Artificial Sequence
  chemically synthesized
tcaataggtttgtaggatta

SEQ ID NO: 191601 - DNA, 20 bp, Artificial Sequence
  chemically synthesized
gcacggaagacgaataaaat

SEQ ID NO: 191602 - DNA, 20 bp, Artificial Sequence
  chemically synthesized
aaatataggaagttgcacgg

SEQ ID NO: 191603 - DNA, 20 bp, Artificial Sequence
  chemically synthesized
gaaaaatataggaagttgca

SEQ ID NO: 191604 - DNA, 20 bp, Artificial Sequence
  chemically synthesized
tagaatttgaaaaatatagg

SEQ ID NO: 191605 - DNA, 20 bp, Artificial Sequence
  chemically synthesized
ttatagaatttgaaaaatat

SEQ ID NO: 191606 - DNA, 20 bp, Artificial Sequence
  chemically synthesized
attatagaatttgaaaaata

SEQ ID NO: 191607 - DNA, 20 bp, Artificial Sequence
  chemically synthesized
tatttttcaaattctataat

SEQ ID NO: 191608 - DNA, 20 bp, Artificial Sequence
  chemically synthesized
aaggtaataagtgctcatta

SEQ ID NO: 191609 - DNA, 20 bp, Artificial Sequence
  chemically synthesized
tttcttattataaaggtaat

SEQ ID NO: 191610 - DNA, 20 bp, Artificial Sequence
  chemically synthesized
gcacttattacctttataat

SEQ ID NO: 191611 - DNA, 20 bp, Artificial Sequence
  chemically synthesized
tttcttttttcttattataa

SEQ ID NO: 191612 - DNA, 20 bp, Artificial Sequence
  chemically synthesized
ttttcttttttcttattata

SEQ ID NO: 191613 - DNA, 20 bp, Artificial Sequence
  chemically synthesized
ttacctttataataagaaaa

SEQ ID NO: 191614 - DNA, 20 bp, Artificial Sequence
  chemically synthesized
aatgtaaaacttttcaattt

SEQ ID NO: 191615 - DNA, 20 bp, Artificial Sequence
  chemically synthesized
aaatgcaaaccaaaattgaa

SEQ ID NO: 191616 - DNA, 20 bp, Artificial Sequence
  chemically synthesized
ttgaaaagttttacattttg

SEQ ID NO: 191617 - DNA, 20 bp, Artificial Sequence
  chemically synthesized
tacattttgtggataattta

SEQ ID NO: 191618 - DNA, 20 bp, Artificial Sequence
  chemically synthesized
gataatttatggcacatctt

SEQ ID NO: 191619 - DNA, 20 bp, Artificial Sequence
  chemically synthesized
cctctaacataaaatttcca

SEQ ID NO: 191620 - DNA, 20 bp, Artificial Sequence
  chemically synthesized
catctttggaaattttatgt

SEQ ID NO: 191621 - DNA, 20 bp, Artificial Sequence
  chemically synthesized
tctttggaaattttatgtta

SEQ ID NO: 191622 - DNA, 20 bp, Artificial Sequence
  chemically synthesized
ctttggaaattttatgttag

SEQ ID NO: 191623 - DNA, 20 bp, Artificial Sequence
  chemically synthesized
tttatgttagaggctttcac

SEQ ID NO: 191624 - DNA, 20 bp, Artificial Sequence
  chemically synthesized
aatttctgattagccagtga

SEQ ID NO: 191625 - DNA, 20 bp, Artificial Sequence
  chemically synthesized
agaggctttcactggctaat

SEQ ID NO: 191626 - DNA, 20 bp, Artificial Sequence
  chemically synthesized
taaagcaatttctgattagc

SEQ ID NO: 191627 - DNA, 20 bp, Artificial Sequence
  chemically synthesized
tagataaagcaatttctgat

SEQ ID NO: 191628 - DNA, 20 bp, Artificial Sequence
  chemically synthesized
tcaacaaagaaaaatagata

SEQ ID NO: 191629 - DNA, 20 bp, Artificial Sequence
  chemically synthesized
ttccattcaacaaagaaaaa

SEQ ID NO: 191630 - DNA, 20 bp, Artificial Sequence
  chemically synthesized
atctatttttctttgttgaa

SEQ ID NO: 191631 - DNA, 20 bp, Artificial Sequence
  chemically synthesized
tcctccctttccattcaaca

SEQ ID NO: 191632 - DNA, 20 bp, Artificial Sequence
  chemically synthesized
atttttctttgttgaatgga

SEQ ID NO: 191633 - DNA, 20 bp, Artificial Sequence
  chemically synthesized
tttttctttgttgaatggaa

SEQ ID NO: 191634 - DNA, 20 bp, Artificial Sequence
  chemically synthesized
ttttctttgttgaatggaaa

SEQ ID NO: 191635 - DNA, 20 bp, Artificial Sequence
  chemically synthesized
ttctttgttgaatggaaagg

SEQ ID NO: 191636 - DNA, 20 bp, Artificial Sequence
  chemically synthesized
tctttgttgaatggaaaggg

SEQ ID NO: 191637 - DNA, 20 bp, Artificial Sequence
  chemically synthesized
tttgttgaatggaaagggag

SEQ ID NO: 191638 - DNA, 20 bp, Artificial Sequence
  chemically synthesized
ttgttgaatggaaagggagg

SEQ ID NO: 191639 - DNA, 20 bp, Artificial Sequence
  chemically synthesized
tgttgaatggaaagggagga

SEQ ID NO: 191640 - DNA, 20 bp, Artificial Sequence
  chemically synthesized
ttgaatggaaagggaggagg

SEQ ID NO: 191641 - DNA, 20 bp, Artificial Sequence
  chemically synthesized
tgaatggaaagggaggaggg

SEQ ID NO: 191642 - DNA, 20 bp, Artificial Sequence
  chemically synthesized
gaatggaaagggaggaggga

SEQ ID NO: 191643 - DNA, 20 bp, Artificial Sequence
  chemically synthesized
atggaaagggaggagggagg

SEQ ID NO: 191644 - DNA, 20 bp, Artificial Sequence
  chemically synthesized
ggaaagggaggagggaggga

SEQ ID NO: 191645 - DNA, 20 bp, Artificial Sequence
  chemically synthesized
gaaagggaggagggagggag

SEQ ID NO: 191646 - DNA, 20 bp, Artificial Sequence
  chemically synthesized
aaagggaggagggagggaga

SEQ ID NO: 191647 - DNA, 20 bp, Artificial Sequence
  chemically synthesized
aagggaggagggagggagag

SEQ ID NO: 191648 - DNA, 20 bp, Artificial Sequence
  chemically synthesized
ggagggagggagaggggaat

SEQ ID NO: 191649 - DNA, 20 bp, Artificial Sequence
  chemically synthesized
ggagggagaggggaataagc

SEQ ID NO: 191650 - DNA, 20 bp, Artificial Sequence
  chemically synthesized
gagggagaggggaataagca

SEQ ID NO: 191651 - DNA, 20 bp, Artificial Sequence
  chemically synthesized
agggagaggggaataagcaa

SEQ ID NO: 191652 - DNA, 20 bp, Artificial Sequence
  chemically synthesized
ggagaggggaataagcaagg

SEQ ID NO: 191653 - DNA, 20 bp, Artificial Sequence
  chemically synthesized
aataagcaagggagaaataa

SEQ ID NO: 191654 - DNA, 20 bp, Artificial Sequence
  chemically synthesized
ataagcaagggagaaataat

SEQ ID NO: 191655 - DNA, 20 bp, Artificial Sequence
  chemically synthesized
taagcaagggagaaataata

SEQ ID NO: 191656 - DNA, 20 bp, Artificial Sequence
  chemically synthesized
gaaataatagggcaaataac

SEQ ID NO: 191657 - DNA, 20 bp, Artificial Sequence
  chemically synthesized
aatttgctcttgagtggaac

SEQ ID NO: 191658 - DNA, 20 bp, Artificial Sequence
  chemically synthesized
gcaaataactggttccactc

SEQ ID NO: 191659 - DNA, 20 bp, Artificial Sequence
  chemically synthesized
aaataactggttccactcaa

SEQ ID NO: 191660 - DNA, 20 bp, Artificial Sequence
  chemically synthesized
aaagttaatttgctcttgag

SEQ ID NO: 191661 - DNA, 20 bp, Artificial Sequence
  chemically synthesized
gggaaagttaatttgctctt

SEQ ID NO: 191662 - DNA, 20 bp, Artificial Sequence
  chemically synthesized
agcaaattaactttccctca

SEQ ID NO: 191663 - DNA, 20 bp, Artificial Sequence
  chemically synthesized
tactgactacccatgaggga

SEQ ID NO: 191664 - DNA, 20 bp, Artificial Sequence
  chemically synthesized
gcaaattaactttccctcat

SEQ ID NO: 191665 - DNA, 20 bp, Artificial Sequence
  chemically synthesized
aattaactttccctcatggg

SEQ ID NO: 191666 - DNA, 20 bp, Artificial Sequence
  chemically synthesized
catgtactgactacccatga

SEQ ID NO: 191667 - DNA, 20 bp, Artificial Sequence
  chemically synthesized
acatgtactgactacccatg

SEQ ID NO: 191668 - DNA, 20 bp, Artificial Sequence
  chemically synthesized
aacatgtactgactacccat

SEQ ID NO: 191669 - DNA, 20 bp, Artificial Sequence
  chemically synthesized
aactttccctcatgggtagt

SEQ ID NO: 191670 - DNA, 20 bp, Artificial Sequence
  chemically synthesized
catgttaattgatgataatt

SEQ ID NO: 191671 - DNA, 20 bp, Artificial Sequence
  chemically synthesized
tgatgataattaagaaaaat

SEQ ID NO: 191672 - DNA, 20 bp, Artificial Sequence
  chemically synthesized
aaatgagttttcttttttgt

SEQ ID NO: 191673 - DNA, 20 bp, Artificial Sequence
  chemically synthesized
gtgtggtggtgctcacaaaa

SEQ ID NO: 191674 - DNA, 20 bp, Artificial Sequence
  chemically synthesized
gaaaatatggaattgtgtgg

SEQ ID NO: 191675 - DNA, 20 bp, Artificial Sequence
  chemically synthesized
tatgaaaatatggaattgtg

SEQ ID NO: 191676 - DNA, 20 bp, Artificial Sequence
  chemically synthesized
ctttagctaatatgaaaata

SEQ ID NO: 191677 - DNA, 20 bp, Artificial Sequence
  chemically synthesized
acaattccatattttcatat

SEQ ID NO: 191678 - DNA, 20 bp, Artificial Sequence
  chemically synthesized
ccatattttcatattagcta

SEQ ID NO: 191679 - DNA, 20 bp, Artificial Sequence
  chemically synthesized
catattttcatattagctaa

SEQ ID NO: 191680 - DNA, 20 bp, Artificial Sequence
  chemically synthesized
ttcatattagctaaaggtta

SEQ ID NO: 191681 - DNA, 20 bp, Artificial Sequence
  chemically synthesized
atcagtttgactttaacctt

SEQ ID NO: 191682 - DNA, 20 bp, Artificial Sequence
  chemically synthesized
aggttaaagtcaaactgatc

SEQ ID NO: 191683 - DNA, 20 bp, Artificial Sequence
  chemically synthesized
actgcaaagttgtactggat

SEQ ID NO: 191684 - DNA, 20 bp, Artificial Sequence
  chemically synthesized
atccaactgcaaagttgtac

SEQ ID NO: 191685 - DNA, 20 bp, Artificial Sequence
  chemically synthesized
actgatccagtacaactttg

SEQ ID NO: 191686 - DNA, 20 bp, Artificial Sequence
  chemically synthesized
atccagtacaactttgcagt

SEQ ID NO: 191687 - DNA, 20 bp, Artificial Sequence
  chemically synthesized
gtagttaacatccaactgca

SEQ ID NO: 191688 - DNA, 20 bp, Artificial Sequence
  chemically synthesized
tggatgttaactacttttca

SEQ ID NO: 191689 - DNA, 20 bp, Artificial Sequence
  chemically synthesized
gtggccccttctatgaaaag

SEQ ID NO: 191690 - DNA, 20 bp, Artificial Sequence
  chemically synthesized
atgttaactacttttcatag

SEQ ID NO: 191691 - DNA, 20 bp, Artificial Sequence
  chemically synthesized
aatgtggccccttctatgaa

SEQ ID NO: 191692 - DNA, 20 bp, Artificial Sequence
  chemically synthesized
tgttaactacttttcataga

SEQ ID NO: 191693 - DNA, 20 bp, Artificial Sequence
  chemically synthesized
gttaactacttttcatagaa

SEQ ID NO: 191694 - DNA, 20 bp, Artificial Sequence
  chemically synthesized
ttaactacttttcatagaag

SEQ ID NO: 191695 - DNA, 20 bp, Artificial Sequence
  chemically synthesized
catagaaggggccacattca

SEQ ID NO: 191696 - DNA, 20 bp, Artificial Sequence
  chemically synthesized
cttgagattcaccatgaatg

SEQ ID NO: 191697 - DNA, 20 bp, Artificial Sequence
  chemically synthesized
ccacattcatggtgaatctc

SEQ ID NO: 191698 - DNA, 20 bp, Artificial Sequence
  chemically synthesized
taacaaataaacgaggtctt

SEQ ID NO: 191699 - DNA, 20 bp, Artificial Sequence
  chemically synthesized
atgcatttaacaaataaacg

SEQ ID NO: 191700 - DNA, 20 bp, Artificial Sequence
  chemically synthesized
gatgcatttaacaaataaac

SEQ ID NO: 191701 - DNA, 20 bp, Artificial Sequence
  chemically synthesized
agaaatagaaaatagttgca

SEQ ID NO: 191702 - DNA, 20 bp, Artificial Sequence
  chemically synthesized
gtatagggagaaatagaaaa

SEQ ID NO: 191703 - DNA, 20 bp, Artificial Sequence
  chemically synthesized
attaatggtatagggagaaa

SEQ ID NO: 191704 - DNA, 20 bp, Artificial Sequence
  chemically synthesized
ggtgtcattaatggtatagg

SEQ ID NO: 191705 - DNA, 20 bp, Artificial Sequence
  chemically synthesized
tgggtgtcattaatggtata

SEQ ID NO: 191706 - DNA, 20 bp, Artificial Sequence
  chemically synthesized
gtgggtgtcattaatggtat

SEQ ID NO: 191707 - DNA, 20 bp, Artificial Sequence
  chemically synthesized
tgtgggtgtcattaatggta

SEQ ID NO: 191708 - DNA, 20 bp, Artificial Sequence
  chemically synthesized
actattgtgggtgtcattaa

SEQ ID NO: 191709 - DNA, 20 bp, Artificial Sequence
  chemically synthesized
accattaatgacacccacaa

SEQ ID NO: 191710 - DNA, 20 bp, Artificial Sequence
  chemically synthesized
aatgtcctgtgtactattgt

SEQ ID NO: 191711 - DNA, 20 bp, Artificial Sequence
  chemically synthesized
aaatgtcctgtgtactattg

SEQ ID NO: 191712 - DNA, 20 bp, Artificial Sequence
  chemically synthesized
atgacacccacaatagtaca

SEQ ID NO: 191713 - DNA, 20 bp, Artificial Sequence
  chemically synthesized
tgacacccacaatagtacac

SEQ ID NO: 191714 - DNA, 20 bp, Artificial Sequence
  chemically synthesized
aaatgcagacatgcaagaaa

SEQ ID NO: 191715 - DNA, 20 bp, Artificial Sequence
  chemically synthesized
caaaggaaatgcagacatgc

SEQ ID NO: 191716 - DNA, 20 bp, Artificial Sequence
  chemically synthesized
atttctcagcaaaggaaatg

SEQ ID NO: 191717 - DNA, 20 bp, Artificial Sequence
  chemically synthesized
atgtctgcatttcctttgct

SEQ ID NO: 191718 - DNA, 20 bp, Artificial Sequence
  chemically synthesized
atttctctatttctcagcaa

SEQ ID NO: 191719 - DNA, 20 bp, Artificial Sequence
  chemically synthesized
tatttctctatttctcagca

SEQ ID NO: 191720 - DNA, 20 bp, Artificial Sequence
  chemically synthesized
gcatttcctttgctgagaaa

SEQ ID NO: 191721 - DNA, 20 bp, Artificial Sequence
  chemically synthesized
atttcctttgctgagaaata

SEQ ID NO: 191722 - DNA, 20 bp, Artificial Sequence
  chemically synthesized
ttatgtatttctctatttct

SEQ ID NO: 191723 - DNA, 20 bp, Artificial Sequence
  chemically synthesized
gagaaatagagaaatacata

SEQ ID NO: 191724 - DNA, 20 bp, Artificial Sequence
  chemically synthesized
gaaatacataaagaacaaaa

SEQ ID NO: 191725 - DNA, 20 bp, Artificial Sequence
  chemically synthesized
aaatacataaagaacaaaaa

SEQ ID NO: 191726 - DNA, 20 bp, Artificial Sequence
  chemically synthesized
aatacataaagaacaaaaaa

SEQ ID NO: 191727 - DNA, 20 bp, Artificial Sequence
  chemically synthesized
aaagaacaaaaaagggctct

SEQ ID NO: 191728 - DNA, 20 bp, Artificial Sequence
  chemically synthesized
agatttttgaatgggactta

SEQ ID NO: 191729 - DNA, 20 bp, Artificial Sequence
  chemically synthesized
gtagatttttgaatgggact

SEQ ID NO: 191730 - DNA, 20 bp, Artificial Sequence
  chemically synthesized
acgtttgtagatttttgaat

SEQ ID NO: 191731 - DNA, 20 bp, Artificial Sequence
  chemically synthesized
cacgtttgtagatttttgaa

SEQ ID NO: 191732 - DNA, 20 bp, Artificial Sequence
  chemically synthesized
gcgttcagcagtcacgtttg

SEQ ID NO: 191733 - DNA, 20 bp, Artificial Sequence
  chemically synthesized
gcttttgttaaggcgttcag

SEQ ID NO: 191734 - DNA, 20 bp, Artificial Sequence
  chemically synthesized
ggtgcttttgttaaggcgtt

SEQ ID NO: 191735 - DNA, 20 bp, Artificial Sequence
  chemically synthesized
actgctgaacgccttaacaa

SEQ ID NO: 191736 - DNA, 20 bp, Artificial Sequence
  chemically synthesized
attcatgggtgcttttgtta

SEQ ID NO: 191737 - DNA, 20 bp, Artificial Sequence
  chemically synthesized
gattcatgggtgcttttgtt

SEQ ID NO: 191738 - DNA, 20 bp, Artificial Sequence
  chemically synthesized
taacaaaagcacccatgaat

SEQ ID NO: 191739 - DNA, 20 bp, Artificial Sequence
  chemically synthesized
taaagccatggccgattcat

SEQ ID NO: 191740 - DNA, 20 bp, Artificial Sequence
  chemically synthesized
ataaagccatggccgattca

SEQ ID NO: 191741 - DNA, 20 bp, Artificial Sequence
  chemically synthesized
aagcacccatgaatcggcca

SEQ ID NO: 191742 - DNA, 20 bp, Artificial Sequence
  chemically synthesized
ccttcgcagctataaagcca

SEQ ID NO: 191743 - DNA, 20 bp, Artificial Sequence
  chemically synthesized
atgaatcggccatggcttta

SEQ ID NO: 191744 - DNA, 20 bp, Artificial Sequence
  chemically synthesized
gttgtcccttcgcagctata

SEQ ID NO: 191745 - DNA, 20 bp, Artificial Sequence
  chemically synthesized
gccatggctttatagctgcg

SEQ ID NO: 191746 - DNA, 20 bp, Artificial Sequence
  chemically synthesized
ccatggctttatagctgcga

SEQ ID NO: 191747 - DNA, 20 bp, Artificial Sequence
  chemically synthesized
catggctttatagctgcgaa

SEQ ID NO: 191748 - DNA, 20 bp, Artificial Sequence
  chemically synthesized
gcctatgtgttgtcccttcg

SEQ ID NO: 191749 - DNA, 20 bp, Artificial Sequence
  chemically synthesized
agctgcgaagggacaacaca

SEQ ID NO: 191750 - DNA, 20 bp, Artificial Sequence
  chemically synthesized
gctgcgaagggacaacacat

SEQ ID NO: 191751 - DNA, 20 bp, Artificial Sequence
  chemically synthesized
gaagggacaacacataggca

SEQ ID NO: 191752 - DNA, 20 bp, Artificial Sequence
  chemically synthesized
agggacaacacataggcatg

SEQ ID NO: 191753 - DNA, 20 bp, Artificial Sequence
  chemically synthesized
ggacaacacataggcatgga

SEQ ID NO: 191754 - DNA, 20 bp, Artificial Sequence
  chemically synthesized
acataggcatggagagaaat

SEQ ID NO: 191755 - DNA, 20 bp, Artificial Sequence
  chemically synthesized
atggagagaaattggaaaaa

SEQ ID NO: 191756 - DNA, 20 bp, Artificial Sequence
  chemically synthesized
aaaaagaaaataacgtgaat

SEQ ID NO: 191757 - DNA, 20 bp, Artificial Sequence
  chemically synthesized
gtgaattagaattctgccaa

SEQ ID NO: 191758 - DNA, 20 bp, Artificial Sequence
  chemically synthesized
attagcactaatactattgg

SEQ ID NO: 191759 - DNA, 20 bp, Artificial Sequence
  chemically synthesized
tagaattctgccaatagtat

SEQ ID NO: 191760 - DNA, 20 bp, Artificial Sequence
  chemically synthesized
tacattagcactaatactat

SEQ ID NO: 191761 - DNA, 20 bp, Artificial Sequence
  chemically synthesized
ttatgtcatgttgattacat

SEQ ID NO: 191762 - DNA, 20 bp, Artificial Sequence
  chemically synthesized
taatgtaatcaacatgacat

SEQ ID NO: 191763 - DNA, 20 bp, Artificial Sequence
  chemically synthesized
ctcgaagttttggtatttca

SEQ ID NO: 191764 - DNA, 20 bp, Artificial Sequence
  chemically synthesized
ctttgaaataccaaaacttc

SEQ ID NO: 191765 - DNA, 20 bp, Artificial Sequence
  chemically synthesized
actttacctactcgaagttt

SEQ ID NO: 191766 - DNA, 20 bp, Artificial Sequence
  chemically synthesized
tgaaataccaaaacttcgag

SEQ ID NO: 191767 - DNA, 20 bp, Artificial Sequence
  chemically synthesized
gaaataccaaaacttcgagt

SEQ ID NO: 191768 - DNA, 20 bp, Artificial Sequence
  chemically synthesized
agaaccactttacctactcg

SEQ ID NO: 191769 - DNA, 20 bp, Artificial Sequence
  chemically synthesized
accaaaacttcgagtaggta

SEQ ID NO: 191770 - DNA, 20 bp, Artificial Sequence
  chemically synthesized
aaaacttcgagtaggtaaag

SEQ ID NO: 191771 - DNA, 20 bp, Artificial Sequence
  chemically synthesized
ctgagaagaaagatattgtt

SEQ ID NO: 191772 - DNA, 20 bp, Artificial Sequence
  chemically synthesized
ctcaacaatatctttcttct

SEQ ID NO: 191773 - DNA, 20 bp, Artificial Sequence
  chemically synthesized
tcaacaatatctttcttctc

SEQ ID NO: 191774 - DNA, 20 bp, Artificial Sequence
  chemically synthesized
ctatgattaccctgagaaga

SEQ ID NO: 191775 - DNA, 20 bp, Artificial Sequence
  chemically synthesized
caacaatatctttcttctca

SEQ ID NO: 191776 - DNA, 20 bp, Artificial Sequence
  chemically synthesized
ttcactatgattaccctgag

SEQ ID NO: 191777 - DNA, 20 bp, Artificial Sequence
  chemically synthesized
atattcactatgattaccct

SEQ ID NO: 191778 - DNA, 20 bp, Artificial Sequence
  chemically synthesized
ctttcttctcagggtaatca

SEQ ID NO: 191779 - DNA, 20 bp, Artificial Sequence
  chemically synthesized
agggtaatcatagtgaatat

SEQ ID NO: 191780 - DNA, 20 bp, Artificial Sequence
  chemically synthesized
gggtaatcatagtgaatatg

SEQ ID NO: 191781 - DNA, 20 bp, Artificial Sequence
  chemically synthesized
tgaatatgaggatacatcga

SEQ ID NO: 191782 - DNA, 20 bp, Artificial Sequence
  chemically synthesized
gaatatgaggatacatcgac

SEQ ID NO: 191783 - DNA, 20 bp, Artificial Sequence
  chemically synthesized
aatatgaggatacatcgaca

SEQ ID NO: 191784 - DNA, 20 bp, Artificial Sequence
  chemically synthesized
gaggatacatcgacagggaa

SEQ ID NO: 191785 - DNA, 20 bp, Artificial Sequence
  chemically synthesized
tacatcgacagggaaaagaa

SEQ ID NO: 191786 - DNA, 20 bp, Artificial Sequence
  chemically synthesized
atcgacagggaaaagaacag

SEQ ID NO: 191787 - DNA, 20 bp, Artificial Sequence
  chemically synthesized
tcgacagggaaaagaacagt

SEQ ID NO: 191788 - DNA, 20 bp, Artificial Sequence
  chemically synthesized
aaaagaacagtaggtaattt

SEQ ID NO: 191789 - DNA, 20 bp, Artificial Sequence
  chemically synthesized
aaagaacagtaggtaatttg

SEQ ID NO: 191790 - DNA, 20 bp, Artificial Sequence
  chemically synthesized
aagaacagtaggtaatttga

SEQ ID NO: 191791 - DNA, 20 bp, Artificial Sequence
  chemically synthesized
ggtaatttgagggaattttg

SEQ ID NO: 191792 - DNA, 20 bp, Artificial Sequence
  chemically synthesized
ggaattttgcagcactaatt

SEQ ID NO: 191793 - DNA, 20 bp, Artificial Sequence
  chemically synthesized
tcagtgtttggagactaaat

SEQ ID NO: 191794 - DNA, 20 bp, Artificial Sequence
  chemically synthesized
cactgaataatcagtgtttg

SEQ ID NO: 191795 - DNA, 20 bp, Artificial Sequence
  chemically synthesized
accactgaataatcagtgtt

SEQ ID NO: 191796 - DNA, 20 bp, Artificial Sequence
  chemically synthesized
gtctccaaacactgattatt

SEQ ID NO: 191797 - DNA, 20 bp, Artificial Sequence
  chemically synthesized
aataatgaccactgaataat

SEQ ID NO: 191798 - DNA, 20 bp, Artificial Sequence
  chemically synthesized
tccaaacactgattattcag

SEQ ID NO: 191799 - DNA, 20 bp, Artificial Sequence
  chemically synthesized
tggtcattattccaaactgc

SEQ ID NO: 191800 - DNA, 20 bp, Artificial Sequence
  chemically synthesized
ggtcattattccaaactgcg

SEQ ID NO: 191801 - DNA, 20 bp, Artificial Sequence
  chemically synthesized
cattactgtccctcgcagtt

SEQ ID NO: 191802 - DNA, 20 bp, Artificial Sequence
  chemically synthesized
gtcattattccaaactgcga

SEQ ID NO: 191803 - DNA, 20 bp, Artificial Sequence
  chemically synthesized
ttattccaaactgcgaggga

SEQ ID NO: 191804 - DNA, 20 bp, Artificial Sequence
  chemically synthesized
ggattcattactgtccctcg

SEQ ID NO: 191805 - DNA, 20 bp, Artificial Sequence
  chemically synthesized
tttgcctttcgaatagtgtt

SEQ ID NO: 191806 - DNA, 20 bp, Artificial Sequence
  chemically synthesized
tgaatccaaacactattcga

SEQ ID NO: 191807 - DNA, 20 bp, Artificial Sequence
  chemically synthesized
gaatccaaacactattcgaa

SEQ ID NO: 191808 - DNA, 20 bp, Artificial Sequence
  chemically synthesized
gtaatagtttgcctttcgaa

SEQ ID NO: 191809 - DNA, 20 bp, Artificial Sequence
  chemically synthesized
attcgaaaggcaaactatta

SEQ ID NO: 191810 - DNA, 20 bp, Artificial Sequence
  chemically synthesized
tcgaaaggcaaactattaca

SEQ ID NO: 191811 - DNA, 20 bp, Artificial Sequence
  chemically synthesized
gggtgtaacattctctgtaa

SEQ ID NO: 191812 - DNA, 20 bp, Artificial Sequence
  chemically synthesized
gagaatgttacacccttcct

SEQ ID NO: 191813 - DNA, 20 bp, Artificial Sequence
  chemically synthesized
tgccactcacaacttaggaa

SEQ ID NO: 191814 - DNA, 20 bp, Artificial Sequence
  chemically synthesized
gtgccactcacaacttagga

SEQ ID NO: 191815 - DNA, 20 bp, Artificial Sequence
  chemically synthesized
tgtgccactcacaacttagg

SEQ ID NO: 191816 - DNA, 20 bp, Artificial Sequence
  chemically synthesized
ttacacccttcctaagttgt

SEQ ID NO: 191817 - DNA, 20 bp, Artificial Sequence
  chemically synthesized
atctgtgccactcacaactt

SEQ ID NO: 191818 - DNA, 20 bp, Artificial Sequence
  chemically synthesized
aatctgtgccactcacaact

SEQ ID NO: 191819 - DNA, 20 bp, Artificial Sequence
  chemically synthesized
cacccttcctaagttgtgag

SEQ ID NO: 191820 - DNA, 20 bp, Artificial Sequence
  chemically synthesized
ttcctaagttgtgagtggca

SEQ ID NO: 191821 - DNA, 20 bp, Artificial Sequence
  chemically synthesized
agtggcacagatttatgtaa

SEQ ID NO: 191822 - DNA, 20 bp, Artificial Sequence
  chemically synthesized
cagatttatgtaatggcaac

SEQ ID NO: 191823 - DNA, 20 bp, Artificial Sequence
  chemically synthesized
agatttatgtaatggcaact

SEQ ID NO: 191824 - DNA, 20 bp, Artificial Sequence
  chemically synthesized
accttggctgtttttgttcc

SEQ ID NO: 191825 - DNA, 20 bp, Artificial Sequence
  chemically synthesized
atggcaactgggaacaaaaa

SEQ ID NO: 191826 - DNA, 20 bp, Artificial Sequence
  chemically synthesized
aactgggaacaaaaacagcc

SEQ ID NO: 191827 - DNA, 20 bp, Artificial Sequence
  chemically synthesized
actgggaacaaaaacagcca

SEQ ID NO: 191828 - DNA, 20 bp, Artificial Sequence
  chemically synthesized
ggaacaaaaacagccaaggt

SEQ ID NO: 191829 - DNA, 20 bp, Artificial Sequence
  chemically synthesized
acaaaaacagccaaggtcag

SEQ ID NO: 191830 - DNA, 20 bp, Artificial Sequence
  chemically synthesized
aattaggtttccactgacct

SEQ ID NO: 191831 - DNA, 20 bp, Artificial Sequence
  chemically synthesized
ggtcagtggaaacctaattg

SEQ ID NO: 191832 - DNA, 20 bp, Artificial Sequence
  chemically synthesized
ctagataaagtactacaatt

SEQ ID NO: 191833 - DNA, 20 bp, Artificial Sequence
  chemically synthesized
actagataaagtactacaat

SEQ ID NO: 191834 - DNA, 20 bp, Artificial Sequence
  chemically synthesized
cctaattgtagtactttatc

SEQ ID NO: 191835 - DNA, 20 bp, Artificial Sequence
  chemically synthesized
gatttttattcaactagata

SEQ ID NO: 191836 - DNA, 20 bp, Artificial Sequence
  chemically synthesized
aatgtggatttttattcaac

SEQ ID NO: 191837 - DNA, 20 bp, Artificial Sequence
  chemically synthesized
aattcagtgctaaaaaaatg

SEQ ID NO: 191838 - DNA, 20 bp, Artificial Sequence
  chemically synthesized
aataaaaatccacatttttt

SEQ ID NO: 191839 - DNA, 20 bp, Artificial Sequence
  chemically synthesized
tttttttagcactgaatttt

SEQ ID NO: 191840 - DNA, 20 bp, Artificial Sequence
  chemically synthesized
gttttcaattactgaaaatt

SEQ ID NO: 191841 - DNA, 20 bp, Artificial Sequence
  chemically synthesized
tcagtaattgaaaacaaaaa

SEQ ID NO: 191842 - DNA, 20 bp, Artificial Sequence
  chemically synthesized
gtaattgaaaacaaaaaaag

SEQ ID NO: 191843 - DNA, 20 bp, Artificial Sequence
  chemically synthesized
taattgaaaacaaaaaaagt

SEQ ID NO: 191844 - DNA, 20 bp, Artificial Sequence
  chemically synthesized
aattgaaaacaaaaaaagtg

SEQ ID NO: 191845 - DNA, 20 bp, Artificial Sequence
  chemically synthesized
tcatagctgatataaaattg

SEQ ID NO: 191846 - DNA, 20 bp, Artificial Sequence
  chemically synthesized
gtggggcttcaattttatat

SEQ ID NO: 191847 - DNA, 20 bp, Artificial Sequence
  chemically synthesized
ttttatatcagctatgataa

SEQ ID NO: 191848 - DNA, 20 bp, Artificial Sequence
  chemically synthesized
tgagttactgtcttttatca

SEQ ID NO: 191849 - DNA, 20 bp, Artificial Sequence
  chemically synthesized
atatcagctatgataaaaga

SEQ ID NO: 191850 - DNA, 20 bp, Artificial Sequence
  chemically synthesized
tgataaaagacagtaactca

SEQ ID NO: 191851 - DNA, 20 bp, Artificial Sequence
  chemically synthesized
gataaaagacagtaactcaa

SEQ ID NO: 191852 - DNA, 20 bp, Artificial Sequence
  chemically synthesized
gtttaaggtatcaagccttt

SEQ ID NO: 191853 - DNA, 20 bp, Artificial Sequence
  chemically synthesized
accctgaagtttaaggtatc

SEQ ID NO: 191854 - DNA, 20 bp, Artificial Sequence
  chemically synthesized
aggcttgataccttaaactt

SEQ ID NO: 191855 - DNA, 20 bp, Artificial Sequence
  chemically synthesized
ggaaacaaccctgaagttta

SEQ ID NO: 191856 - DNA, 20 bp, Artificial Sequence
  chemically synthesized
ggcttgataccttaaacttc

SEQ ID NO: 191857 - DNA, 20 bp, Artificial Sequence
  chemically synthesized
aggaaacaaccctgaagttt

SEQ ID NO: 191858 - DNA, 20 bp, Artificial Sequence
  chemically synthesized
gcttgataccttaaacttca

SEQ ID NO: 191859 - DNA, 20 bp, Artificial Sequence
  chemically synthesized
atgaacaggaaacaaccctg

SEQ ID NO: 191860 - DNA, 20 bp, Artificial Sequence
  chemically synthesized
ctgaggatattacaatgaac

SEQ ID NO: 191861 - DNA, 20 bp, Artificial Sequence
  chemically synthesized
gctgaggatattacaatgaa

SEQ ID NO: 191862 - DNA, 20 bp, Artificial Sequence
  chemically synthesized
cctgttcattgtaatatcct

SEQ ID NO: 191863 - DNA, 20 bp, Artificial Sequence
  chemically synthesized
tgcaacgctacgtaaggctg

SEQ ID NO: 191864 - DNA, 20 bp, Artificial Sequence
  chemically synthesized
ctgcaacgctacgtaaggct

SEQ ID NO: 191865 - DNA, 20 bp, Artificial Sequence
  chemically synthesized
gtaatatcctcagccttacg

SEQ ID NO: 191866 - DNA, 20 bp, Artificial Sequence
  chemically synthesized
tatgcctgcaacgctacgta

SEQ ID NO: 191867 - DNA, 20 bp, Artificial Sequence
  chemically synthesized
atatgcctgcaacgctacgt

SEQ ID NO: 191868 - DNA, 20 bp, Artificial Sequence
  chemically synthesized
ctcagccttacgtagcgttg

SEQ ID NO: 191869 - DNA, 20 bp, Artificial Sequence
  chemically synthesized
tcagccttacgtagcgttgc

SEQ ID NO: 191870 - DNA, 20 bp, Artificial Sequence
  chemically synthesized
tagcgttgcaggcatataac

SEQ ID NO: 191871 - DNA, 20 bp, Artificial Sequence
  chemically synthesized
tggtttttattgttttggac

SEQ ID NO: 191872 - DNA, 20 bp, Artificial Sequence
  chemically synthesized
caacatggtttttattgttt

SEQ ID NO: 191873 - DNA, 20 bp, Artificial Sequence
  chemically synthesized
actcactaattaattcaaca

SEQ ID NO: 191874 - DNA, 20 bp, Artificial Sequence
  chemically synthesized
aaaaaccatgttgaattaat

SEQ ID NO: 191875 - DNA, 20 bp, Artificial Sequence
  chemically synthesized
accatgttgaattaattagt

SEQ ID NO: 191876 - DNA, 20 bp, Artificial Sequence
  chemically synthesized
tgttgaattaattagtgagt

SEQ ID NO: 191877 - DNA, 20 bp, Artificial Sequence
  chemically synthesized
gagtgagtgaacaatgaatg

SEQ ID NO: 191878 - DNA, 20 bp, Artificial Sequence
  chemically synthesized
tgagtgaacaatgaatgtag

SEQ ID NO: 191879 - DNA, 20 bp, Artificial Sequence
  chemically synthesized
gtgaacaatgaatgtagaag

SEQ ID NO: 191880 - DNA, 20 bp, Artificial Sequence
  chemically synthesized
tgaatgtagaagtagataat

SEQ ID NO: 191881 - DNA, 20 bp, Artificial Sequence
  chemically synthesized
tgtagaagtagataataagc

SEQ ID NO: 191882 - DNA, 20 bp, Artificial Sequence
  chemically synthesized
gtagaagtagataataagcc

SEQ ID NO: 191883 - DNA, 20 bp, Artificial Sequence
  chemically synthesized
agataataagccaggataat

SEQ ID NO: 191884 - DNA, 20 bp, Artificial Sequence
  chemically synthesized
cagttcatcacttattatcc

SEQ ID NO: 191885 - DNA, 20 bp, Artificial Sequence
  chemically synthesized
taataagtgatgaactgtgt

SEQ ID NO: 191886 - DNA, 20 bp, Artificial Sequence
  chemically synthesized
tgttgatcttggttctgaca

SEQ ID NO: 191887 - DNA, 20 bp, Artificial Sequence
  chemically synthesized
tgatgaactgtgtcagaacc

SEQ ID NO: 191888 - DNA, 20 bp, Artificial Sequence
  chemically synthesized
tggtttcttgttgttgatct

SEQ ID NO: 191889 - DNA, 20 bp, Artificial Sequence
  chemically synthesized
tcagaaccaagatcaacaac

SEQ ID NO: 191890 - DNA, 20 bp, Artificial Sequence
  chemically synthesized
cattggtgtagttaggttgg

SEQ ID NO: 191891 - DNA, 20 bp, Artificial Sequence
  chemically synthesized
ttgcattggtgtagttaggt

SEQ ID NO: 191892 - DNA, 20 bp, Artificial Sequence
  chemically synthesized
atcattgcattggtgtagtt

SEQ ID NO: 191893 - DNA, 20 bp, Artificial Sequence
  chemically synthesized
catcattgcattggtgtagt

SEQ ID NO: 191894 - DNA, 20 bp, Artificial Sequence
  chemically synthesized
atgacatcattgcattggtg

SEQ ID NO: 191895 - DNA, 20 bp, Artificial Sequence
  chemically synthesized
catagatgacatcattgcat

SEQ ID NO: 191896 - DNA, 20 bp, Artificial Sequence
  chemically synthesized
caatgcaatgatgtcatcta

SEQ ID NO: 191897 - DNA, 20 bp, Artificial Sequence
  chemically synthesized
aatgcaatgatgtcatctat

SEQ ID NO: 191898 - DNA, 20 bp, Artificial Sequence
  chemically synthesized
gcaatgatgtcatctatggg

SEQ ID NO: 191899 - DNA, 20 bp, Artificial Sequence
  chemically synthesized
caatgatgtcatctatggga

SEQ ID NO: 191900 - DNA, 20 bp, Artificial Sequence
  chemically synthesized
aatgatgtcatctatgggaa

SEQ ID NO: 191901 - DNA, 20 bp, Artificial Sequence
  chemically synthesized
cctttcctcttcccttccca

SEQ ID NO: 191902 - DNA, 20 bp, Artificial Sequence
  chemically synthesized
gatgtcatctatgggaaggg

SEQ ID NO: 191903 - DNA, 20 bp, Artificial Sequence
  chemically synthesized
tgtcatctatgggaagggaa

SEQ ID NO: 191904 - DNA, 20 bp, Artificial Sequence
  chemically synthesized
gtcatctatgggaagggaag

SEQ ID NO: 191905 - DNA, 20 bp, Artificial Sequence
  chemically synthesized
tctatgggaagggaagagga

SEQ ID NO: 191906 - DNA, 20 bp, Artificial Sequence
  chemically synthesized
ctatgggaagggaagaggaa

SEQ ID NO: 191907 - DNA, 20 bp, Artificial Sequence
  chemically synthesized
tatgggaagggaagaggaaa

SEQ ID NO: 191908 - DNA, 20 bp, Artificial Sequence
  chemically synthesized
gggaagggaagaggaaaggg

SEQ ID NO: 191909 - DNA, 20 bp, Artificial Sequence
  chemically synthesized
taaatgattaatattcatga

SEQ ID NO: 191910 - DNA, 20 bp, Artificial Sequence
  chemically synthesized
attgtggaatggaagatata

SEQ ID NO: 191911 - DNA, 20 bp, Artificial Sequence
  chemically synthesized
gaacccacattgtggaatgg

SEQ ID NO: 191912 - DNA, 20 bp, Artificial Sequence
  chemically synthesized
gctgaacccacattgtggaa

SEQ ID NO: 191913 - DNA, 20 bp, Artificial Sequence
  chemically synthesized
atatcttccattccacaatg

SEQ ID NO: 191914 - DNA, 20 bp, Artificial Sequence
  chemically synthesized
tatcttccattccacaatgt

SEQ ID NO: 191915 - DNA, 20 bp, Artificial Sequence
  chemically synthesized
aaagagctgaacccacattg

SEQ ID NO: 191916 - DNA, 20 bp, Artificial Sequence
  chemically synthesized
tccattccacaatgtgggtt

SEQ ID NO: 191917 - DNA, 20 bp, Artificial Sequence
  chemically synthesized
agaaaaagcttaattgaaaa

SEQ ID NO: 191918 - DNA, 20 bp, Artificial Sequence
  chemically synthesized
gggttcagctcttttcaatt

SEQ ID NO: 191919 - DNA, 20 bp, Artificial Sequence
  chemically synthesized
aaagaaaaagcttaattgaa

SEQ ID NO: 191920 - DNA, 20 bp, Artificial Sequence
  chemically synthesized
attatatgggcaaaaagaaa

SEQ ID NO: 191921 - DNA, 20 bp, Artificial Sequence
  chemically synthesized
tggatcattatatgggcaaa

SEQ ID NO: 191922 - DNA, 20 bp, Artificial Sequence
  chemically synthesized
ttctgattggatcattatat

SEQ ID NO: 191923 - DNA, 20 bp, Artificial Sequence
  chemically synthesized
cttctgattggatcattata

SEQ ID NO: 191924 - DNA, 20 bp, Artificial Sequence
  chemically synthesized
tgcccatataatgatccaat

SEQ ID NO: 191925 - DNA, 20 bp, Artificial Sequence
  chemically synthesized
ccatataatgatccaatcag

SEQ ID NO: 191926 - DNA, 20 bp, Artificial Sequence
  chemically synthesized
ttgactaaggttcttctgat

SEQ ID NO: 191927 - DNA, 20 bp, Artificial Sequence
  chemically synthesized
tgatccaatcagaagaacct

SEQ ID NO: 191928 - DNA, 20 bp, Artificial Sequence
  chemically synthesized
caatcagaagaaccttagtc

SEQ ID NO: 191929 - DNA, 20 bp, Artificial Sequence
  chemically synthesized
tttgcagcagcacttgacta

SEQ ID NO: 191930 - DNA, 20 bp, Artificial Sequence
  chemically synthesized
ctttgcagcagcacttgact

SEQ ID NO: 191931 - DNA, 20 bp, Artificial Sequence
  chemically synthesized
cttagtcaagtgctgctgca

SEQ ID NO: 191932 - DNA, 20 bp, Artificial Sequence
  chemically synthesized
tagtcaagtgctgctgcaaa

SEQ ID NO: 191933 - DNA, 20 bp, Artificial Sequence
  chemically synthesized
gttcaggcacctctttgcag

SEQ ID NO: 191934 - DNA, 20 bp, Artificial Sequence
  chemically synthesized
agtcaagtgctgctgcaaag

SEQ ID NO: 191935 - DNA, 20 bp, Artificial Sequence
  chemically synthesized
ccagttcaggcacctctttg

SEQ ID NO: 191936 - DNA, 20 bp, Artificial Sequence
  chemically synthesized
ctgcaaagaggtgcctgaac

SEQ ID NO: 191937 - DNA, 20 bp, Artificial Sequence
  chemically synthesized
tgcaaagaggtgcctgaact

SEQ ID NO: 191938 - DNA, 20 bp, Artificial Sequence
  chemically synthesized
ctttagggttcacccagttc

SEQ ID NO: 191939 - DNA, 20 bp, Artificial Sequence
  chemically synthesized
tctttagggttcacccagtt

SEQ ID NO: 191940 - DNA, 20 bp, Artificial Sequence
  chemically synthesized
aattttctttagggttcacc

SEQ ID NO: 191941 - DNA, 20 bp, Artificial Sequence
  chemically synthesized
cctgaactgggtgaacccta

SEQ ID NO: 191942 - DNA, 20 bp, Artificial Sequence
  chemically synthesized
aggcagcagaattttcttta

SEQ ID NO: 191943 - DNA, 20 bp, Artificial Sequence
  chemically synthesized
caggcagcagaattttcttt

SEQ ID NO: 191944 - DNA, 20 bp, Artificial Sequence
  chemically synthesized
gcaggcagcagaattttctt

SEQ ID NO: 191945 - DNA, 20 bp, Artificial Sequence
  chemically synthesized
attcttgccaatgcaggcag

SEQ ID NO: 191946 - DNA, 20 bp, Artificial Sequence
  chemically synthesized
gaaaattctgctgcctgcat

SEQ ID NO: 191947 - DNA, 20 bp, Artificial Sequence
  chemically synthesized
tggattcttgccaatgcagg

SEQ ID NO: 191948 - DNA, 20 bp, Artificial Sequence
  chemically synthesized
ttgtggattcttgccaatgc

SEQ ID NO: 191949 - DNA, 20 bp, Artificial Sequence
  chemically synthesized
attctgctgcctgcattggc

SEQ ID NO: 191950 - DNA, 20 bp, Artificial Sequence
  chemically synthesized
cttgtggattcttgccaatg

SEQ ID NO: 191951 - DNA, 20 bp, Artificial Sequence
  chemically synthesized
ctgcattggcaagaatccac

SEQ ID NO: 191952 - DNA, 20 bp, Artificial Sequence
  chemically synthesized
gcagtatacagagtggcttg

SEQ ID NO: 191953 - DNA, 20 bp, Artificial Sequence
  chemically synthesized
ataagatgcagtatacagag

SEQ ID NO: 191954 - DNA, 20 bp, Artificial Sequence
  chemically synthesized
cacataagatgcagtataca

SEQ ID NO: 191955 - DNA, 20 bp, Artificial Sequence
  chemically synthesized
ttcacataagatgcagtata

SEQ ID NO: 191956 - DNA, 20 bp, Artificial Sequence
  chemically synthesized
tagaagattcacataagatg

SEQ ID NO: 191957 - DNA, 20 bp, Artificial Sequence
  chemically synthesized
aaatgatagaagattcacat

SEQ ID NO: 191958 - DNA, 20 bp, Artificial Sequence
  chemically synthesized
attgaatatacaaatgatag

SEQ ID NO: 191959 - DNA, 20 bp, Artificial Sequence
  chemically synthesized
aagattgaatatacaaatga

SEQ ID NO: 191960 - DNA, 20 bp, Artificial Sequence
  chemically synthesized
gagggcaaattgatttattc

SEQ ID NO: 191961 - DNA, 20 bp, Artificial Sequence
  chemically synthesized
aataaatcaatttgccctct

SEQ ID NO: 191962 - DNA, 20 bp, Artificial Sequence
  chemically synthesized
ataaatcaatttgccctctt

SEQ ID NO: 191963 - DNA, 20 bp, Artificial Sequence
  chemically synthesized
gaagatcataagacccaaga

SEQ ID NO: 191964 - DNA, 20 bp, Artificial Sequence
  chemically synthesized
cgaagatcataagacccaag

SEQ ID NO: 191965 - DNA, 20 bp, Artificial Sequence
  chemically synthesized
acgaagatcataagacccaa

SEQ ID NO: 191966 - DNA, 20 bp, Artificial Sequence
  chemically synthesized
agacgaagatcataagaccc

SEQ ID NO: 191967 - DNA, 20 bp, Artificial Sequence
  chemically synthesized
attttatagacgaagatcat

SEQ ID NO: 191968 - DNA, 20 bp, Artificial Sequence
  chemically synthesized
ctatcctgattttatagacg

SEQ ID NO: 191969 - DNA, 20 bp, Artificial Sequence
  chemically synthesized
atgatcttcgtctataaaat

SEQ ID NO: 191970 - DNA, 20 bp, Artificial Sequence
  chemically synthesized
tgatcttcgtctataaaatc

SEQ ID NO: 191971 - DNA, 20 bp, Artificial Sequence
  chemically synthesized
aatcacctatcctgatttta

SEQ ID NO: 191972 - DNA, 20 bp, Artificial Sequence
  chemically synthesized
cttcgtctataaaatcagga

SEQ ID NO: 191973 - DNA, 20 bp, Artificial Sequence
  chemically synthesized
ttcgtctataaaatcaggat

SEQ ID NO: 191974 - DNA, 20 bp, Artificial Sequence
  chemically synthesized
aaatcaggataggtgattgc

SEQ ID NO: 191975 - DNA, 20 bp, Artificial Sequence
  chemically synthesized
aatcaggataggtgattgct

SEQ ID NO: 191976 - DNA, 20 bp, Artificial Sequence
  chemically synthesized
acctcatattatgcagaacc

SEQ ID NO: 191977 - DNA, 20 bp, Artificial Sequence
  chemically synthesized
aaggtaaacctcatattatg

SEQ ID NO: 191978 - DNA, 20 bp, Artificial Sequence
  chemically synthesized
tgctaggttctgcataatat

SEQ ID NO: 191979 - DNA, 20 bp, Artificial Sequence
  chemically synthesized
gctaggttctgcataatatg

SEQ ID NO: 191980 - DNA, 20 bp, Artificial Sequence
  chemically synthesized
cataatatgaggtttacctt

SEQ ID NO: 191981 - DNA, 20 bp, Artificial Sequence
  chemically synthesized
ataatatgaggtttacctta

SEQ ID NO: 191982 - DNA, 20 bp, Artificial Sequence
  chemically synthesized
gtgccacctaggttgcctta

SEQ ID NO: 191983 - DNA, 20 bp, Artificial Sequence
  chemically synthesized
tgtgccacctaggttgcctt

SEQ ID NO: 191984 - DNA, 20 bp, Artificial Sequence
  chemically synthesized
aggtttaccttaaggcaacc

SEQ ID NO: 191985 - DNA, 20 bp, Artificial Sequence
  chemically synthesized
ggtttaccttaaggcaacct

SEQ ID NO: 191986 - DNA, 20 bp, Artificial Sequence
  chemically synthesized
ttaccttaaggcaacctagg

SEQ ID NO: 191987 - DNA, 20 bp, Artificial Sequence
  chemically synthesized
gtgattctagtgtgccacct

SEQ ID NO: 191988 - DNA, 20 bp, Artificial Sequence
  chemically synthesized
agtgattctagtgtgccacc

SEQ ID NO: 191989 - DNA, 20 bp, Artificial Sequence
  chemically synthesized
aggcaacctaggtggcacac

SEQ ID NO: 191990 - DNA, 20 bp, Artificial Sequence
  chemically synthesized
aggtggcacactagaatcac

SEQ ID NO: 191991 - DNA, 20 bp, Artificial Sequence
  chemically synthesized
taaagcttccctagtgattc

SEQ ID NO: 191992 - DNA, 20 bp, Artificial Sequence
  chemically synthesized
ggtggcacactagaatcact

SEQ ID NO: 191993 - DNA, 20 bp, Artificial Sequence
  chemically synthesized
gtggcacactagaatcacta

SEQ ID NO: 191994 - DNA, 20 bp, Artificial Sequence
  chemically synthesized
gcacactagaatcactaggg

SEQ ID NO: 191995 - DNA, 20 bp, Artificial Sequence
  chemically synthesized
gaatttttttaaagcttccc

SEQ ID NO: 191996 - DNA, 20 bp, Artificial Sequence
  chemically synthesized
tgagaataggaattttttta

SEQ ID NO: 191997 - DNA, 20 bp, Artificial Sequence
  chemically synthesized
tttaaaaaaattcctattct

SEQ ID NO: 191998 - DNA, 20 bp, Artificial Sequence
  chemically synthesized
ttaaaaaaattcctattctc

SEQ ID NO: 191999 - DNA, 20 bp, Artificial Sequence
  chemically synthesized
ctggtgcgagacctgagaat

SEQ ID NO: 192000 - DNA, 20 bp, Artificial Sequence
  chemically synthesized
tctggtgcgagacctgagaa

SEQ ID NO: 192001 - DNA, 20 bp, Artificial Sequence
  chemically synthesized
atttttctggtgcgagacct

SEQ ID NO: 192002 - DNA, 20 bp, Artificial Sequence
  chemically synthesized
cctattctcaggtctcgcac

SEQ ID NO: 192003 - DNA, 20 bp, Artificial Sequence
  chemically synthesized
tgatttgatttttctggtgc

SEQ ID NO: 192004 - DNA, 20 bp, Artificial Sequence
  chemically synthesized
aaattctgatttgatttttc

SEQ ID NO: 192005 - DNA, 20 bp, Artificial Sequence
  chemically synthesized
tcgcaccagaaaaatcaaat

SEQ ID NO: 192006 - DNA, 20 bp, Artificial Sequence
  chemically synthesized
aaatcaaatcagaatttctg

SEQ ID NO: 192007 - DNA, 20 bp, Artificial Sequence
  chemically synthesized
aatcaaatcagaatttctgc

SEQ ID NO: 192008 - DNA, 20 bp, Artificial Sequence
  chemically synthesized
caaatcagaatttctgcagg

SEQ ID NO: 192009 - DNA, 20 bp, Artificial Sequence
  chemically synthesized
aaatcagaatttctgcaggt

SEQ ID NO: 192010 - DNA, 20 bp, Artificial Sequence
  chemically synthesized
agatgcctagttcccacctg

SEQ ID NO: 192011 - DNA, 20 bp, Artificial Sequence
  chemically synthesized
gaatttctgcaggtgggaac

SEQ ID NO: 192012 - DNA, 20 bp, Artificial Sequence
  chemically synthesized
aatttctgcaggtgggaact

SEQ ID NO: 192013 - DNA, 20 bp, Artificial Sequence
  chemically synthesized
caaaaaaaaatagagatgcc

SEQ ID NO: 192014 - DNA, 20 bp, Artificial Sequence
  chemically synthesized
acaaaaaacaaaaaaaaata

SEQ ID NO: 192015 - DNA, 20 bp, Artificial Sequence
  chemically synthesized
aaacaaaaaacaaaaaaaaa

SEQ ID NO: 192016 - DNA, 20 bp, Artificial Sequence
  chemically synthesized
ttttttgttttttgtttttt

SEQ ID NO: 192017 - DNA, 20 bp, Artificial Sequence
  chemically synthesized
ttttgttttttgttttttta

SEQ ID NO: 192018 - DNA, 20 bp, Artificial Sequence
  chemically synthesized
ttttgtttttttagagcttc

SEQ ID NO: 192019 - DNA, 20 bp, Artificial Sequence
  chemically synthesized
ttgtttttttagagcttcca

SEQ ID NO: 192020 - DNA, 20 bp, Artificial Sequence
  chemically synthesized
acaagttggaattactctgg

SEQ ID NO: 192021 - DNA, 20 bp, Artificial Sequence
  chemically synthesized
gctacaagttggaattactc

SEQ ID NO: 192022 - DNA, 20 bp, Artificial Sequence
  chemically synthesized
tccagagtaattccaacttg

SEQ ID NO: 192023 - DNA, 20 bp, Artificial Sequence
  chemically synthesized
tttcaatcttagctacaagt

SEQ ID NO: 192024 - DNA, 20 bp, Artificial Sequence
  chemically synthesized
agtaattccaacttgtagct

SEQ ID NO: 192025 - DNA, 20 bp, Artificial Sequence
  chemically synthesized
tagttttcaatcttagctac

SEQ ID NO: 192026 - DNA, 20 bp, Artificial Sequence
  chemically synthesized
aaagagttagttttcaatct

SEQ ID NO: 192027 - DNA, 20 bp, Artificial Sequence
  chemically synthesized
acaattagtgtttaaagagt

SEQ ID NO: 192028 - DNA, 20 bp, Artificial Sequence
  chemically synthesized
gacaacaattagtgtttaaa

SEQ ID NO: 192029 - DNA, 20 bp, Artificial Sequence
  chemically synthesized
gtgacaacaattagtgttta

SEQ ID NO: 192030 - DNA, 20 bp, Artificial Sequence
  chemically synthesized
tttactcaggtgacaacaat

SEQ ID NO: 192031 - DNA, 20 bp, Artificial Sequence
  chemically synthesized
aacactaattgttgtcacct

SEQ ID NO: 192032 - DNA, 20 bp, Artificial Sequence
  chemically synthesized
aaagtatccttaatttactc

SEQ ID NO: 192033 - DNA, 20 bp, Artificial Sequence
  chemically synthesized
gaaagtatccttaatttact

SEQ ID NO: 192034 - DNA, 20 bp, Artificial Sequence
  chemically synthesized
tgttgtcacctgagtaaatt

SEQ ID NO: 192035 - DNA, 20 bp, Artificial Sequence
  chemically synthesized
gttgtcacctgagtaaatta

SEQ ID NO: 192036 - DNA, 20 bp, Artificial Sequence
  chemically synthesized
gagtaaattaaggatacttt

SEQ ID NO: 192037 - DNA, 20 bp, Artificial Sequence
  chemically synthesized
gtaaattaaggatactttca

SEQ ID NO: 192038 - DNA, 20 bp, Artificial Sequence
  chemically synthesized
aaattattttatggctctga

SEQ ID NO: 192039 - DNA, 20 bp, Artificial Sequence
  chemically synthesized
acaaaaagtaaattatttta

SEQ ID NO: 192040 - DNA, 20 bp, Artificial Sequence
  chemically synthesized
taggcctaaaaaagtacaaa

SEQ ID NO: 192041 - DNA, 20 bp, Artificial Sequence
  chemically synthesized
atttactttttgtacttttt

SEQ ID NO: 192042 - DNA, 20 bp, Artificial Sequence
  chemically synthesized
tttactttttgtactttttt

SEQ ID NO: 192043 - DNA, 20 bp, Artificial Sequence
  chemically synthesized
atataactttaggcctaaaa

SEQ ID NO: 192044 - DNA, 20 bp, Artificial Sequence
  chemically synthesized
tttgtacttttttaggccta

SEQ ID NO: 192045 - DNA, 20 bp, Artificial Sequence
  chemically synthesized
ttctagaaatatataacttt

SEQ ID NO: 192046 - DNA, 20 bp, Artificial Sequence
  chemically synthesized
attctagaaatatataactt

SEQ ID NO: 192047 - DNA, 20 bp, Artificial Sequence
  chemically synthesized
ggcctaaagttatatatttc

SEQ ID NO: 192048 - DNA, 20 bp, Artificial Sequence
  chemically synthesized
agttatatatttctagaata

SEQ ID NO: 192049 - DNA, 20 bp, Artificial Sequence
  chemically synthesized
acgtgcacaaatctttattc

SEQ ID NO: 192050 - DNA, 20 bp, Artificial Sequence
  chemically synthesized
gatttgtgcacgtattttta

SEQ ID NO: 192051 - DNA, 20 bp, Artificial Sequence
  chemically synthesized
atttgtgcacgtatttttaa

SEQ ID NO: 192052 - DNA, 20 bp, Artificial Sequence
  chemically synthesized
tttgtgcacgtatttttaaa

SEQ ID NO: 192053 - DNA, 20 bp, Artificial Sequence
  chemically synthesized
acgtatttttaaagggcatg

SEQ ID NO: 192054 - DNA, 20 bp, Artificial Sequence
  chemically synthesized
ttgcaaagaaaaaaaaatac

SEQ ID NO: 192055 - DNA, 20 bp, Artificial Sequence
  chemically synthesized
aatcatcacattaagttgca

SEQ ID NO: 192056 - DNA, 20 bp, Artificial Sequence
  chemically synthesized
ggaatattaatcatcacatt

SEQ ID NO: 192057 - DNA, 20 bp, Artificial Sequence
  chemically synthesized
atgaaaactggtagcaaatt

SEQ ID NO: 192058 - DNA, 20 bp, Artificial Sequence
  chemically synthesized
taatattccaaatttgctac

SEQ ID NO: 192059 - DNA, 20 bp, Artificial Sequence
  chemically synthesized
tgagtaataatgaaaactgg

SEQ ID NO: 192060 - DNA, 20 bp, Artificial Sequence
  chemically synthesized
tactgagtaataatgaaaac

SEQ ID NO: 192061 - DNA, 20 bp, Artificial Sequence
  chemically synthesized
taccagttttcattattact

SEQ ID NO: 192062 - DNA, 20 bp, Artificial Sequence
  chemically synthesized
catccatgcctgaaaatact

SEQ ID NO: 192063 - DNA, 20 bp, Artificial Sequence
  chemically synthesized
tcattattactcagtatttt

SEQ ID NO: 192064 - DNA, 20 bp, Artificial Sequence
  chemically synthesized
cattattactcagtattttc

SEQ ID NO: 192065 - DNA, 20 bp, Artificial Sequence
  chemically synthesized
ttactcagtattttcaggca

SEQ ID NO: 192066 - DNA, 20 bp, Artificial Sequence
  chemically synthesized
tcagtattttcaggcatgga

SEQ ID NO: 192067 - DNA, 20 bp, Artificial Sequence
  chemically synthesized
ttcaggcatggatggctcca

SEQ ID NO: 192068 - DNA, 20 bp, Artificial Sequence
  chemically synthesized
gcatggatggctccatagtt

SEQ ID NO: 192069 - DNA, 20 bp, Artificial Sequence
  chemically synthesized
ggcagaaatcctgaactatg

SEQ ID NO: 192070 - DNA, 20 bp, Artificial Sequence
  chemically synthesized
catggatggctccatagttc

SEQ ID NO: 192071 - DNA, 20 bp, Artificial Sequence
  chemically synthesized
taggcagaaatcctgaacta

SEQ ID NO: 192072 - DNA, 20 bp, Artificial Sequence
  chemically synthesized
ggcgactgcttttaaatagg

SEQ ID NO: 192073 - DNA, 20 bp, Artificial Sequence
  chemically synthesized
caggatttctgcctatttaa

SEQ ID NO: 192074 - DNA, 20 bp, Artificial Sequence
  chemically synthesized
taaggcgactgcttttaaat

SEQ ID NO: 192075 - DNA, 20 bp, Artificial Sequence
  chemically synthesized
ttaaggcgactgcttttaaa

SEQ ID NO: 192076 - DNA, 20 bp, Artificial Sequence
  chemically synthesized
gatttctgcctatttaaaag

SEQ ID NO: 192077 - DNA, 20 bp, Artificial Sequence
  chemically synthesized
tatttaaaagcagtcgcctt

SEQ ID NO: 192078 - DNA, 20 bp, Artificial Sequence
  chemically synthesized
gacagacgaaaatgtgctta

SEQ ID NO: 192079 - DNA, 20 bp, Artificial Sequence
  chemically synthesized
tgacagacgaaaatgtgctt

SEQ ID NO: 192080 - DNA, 20 bp, Artificial Sequence
  chemically synthesized
ttaagcacattttcgtctgt

SEQ ID NO: 192081 - DNA, 20 bp, Artificial Sequence
  chemically synthesized
agcacattttcgtctgtcag

SEQ ID NO: 192082 - DNA, 20 bp, Artificial Sequence
  chemically synthesized
gaagaatatacatctactga

SEQ ID NO: 192083 - DNA, 20 bp, Artificial Sequence
  chemically synthesized
ttttcattattaaaagcagg

SEQ ID NO: 192084 - DNA, 20 bp, Artificial Sequence
  chemically synthesized
aaattttcattattaaaagc

SEQ ID NO: 192085 - DNA, 20 bp, Artificial Sequence
  chemically synthesized
gaaattttcattattaaaag

SEQ ID NO: 192086 - DNA, 20 bp, Artificial Sequence
  chemically synthesized
aatgaaattttcattattaa

SEQ ID NO: 192087 - DNA, 20 bp, Artificial Sequence
  chemically synthesized
aataatgaaaatttcatttt

SEQ ID NO: 192088 - DNA, 20 bp, Artificial Sequence
  chemically synthesized
tttaagtgataatccctaaa

SEQ ID NO: 192089 - DNA, 20 bp, Artificial Sequence
  chemically synthesized
ttaagtgataatccctaaaa

SEQ ID NO: 192090 - DNA, 20 bp, Artificial Sequence
  chemically synthesized
ctgccaggaaatccttttta

SEQ ID NO: 192091 - DNA, 20 bp, Artificial Sequence
  chemically synthesized
tctgccaggaaatccttttt

SEQ ID NO: 192092 - DNA, 20 bp, Artificial Sequence
  chemically synthesized
ttctgccaggaaatcctttt

SEQ ID NO: 192093 - DNA, 20 bp, Artificial Sequence
  chemically synthesized
aatccctaaaaaggatttcc

SEQ ID NO: 192094 - DNA, 20 bp, Artificial Sequence
  chemically synthesized
ccctaaaaaggatttcctgg

SEQ ID NO: 192095 - DNA, 20 bp, Artificial Sequence
  chemically synthesized
aaaaggatttcctggcagaa

SEQ ID NO: 192096 - DNA, 20 bp, Artificial Sequence
  chemically synthesized
atgatataaaccattctgcc

SEQ ID NO: 192097 - DNA, 20 bp, Artificial Sequence
  chemically synthesized
tatgatataaaccattctgc

SEQ ID NO: 192098 - DNA, 20 bp, Artificial Sequence
  chemically synthesized
ggcagaatggtttatatcat

SEQ ID NO: 192099 - DNA, 20 bp, Artificial Sequence
  chemically synthesized
cagaatggtttatatcataa

SEQ ID NO: 192100 - DNA, 20 bp, Artificial Sequence
  chemically synthesized
gtttatatcataagagcgta

SEQ ID NO: 192101 - DNA, 20 bp, Artificial Sequence
  chemically synthesized
tttatatcataagagcgtat

SEQ ID NO: 192102 - DNA, 20 bp, Artificial Sequence
  chemically synthesized
tatatcataagagcgtatgg

SEQ ID NO: 192103 - DNA, 20 bp, Artificial Sequence
  chemically synthesized
cataagagcgtatgggagtt

SEQ ID NO: 192104 - DNA, 20 bp, Artificial Sequence
  chemically synthesized
gggagttaagaataattatg

SEQ ID NO: 192105 - DNA, 20 bp, Artificial Sequence
  chemically synthesized
gttaagaataattatgcagc

SEQ ID NO: 192106 - DNA, 20 bp, Artificial Sequence
  chemically synthesized
gcagcgagtatctttctcca

SEQ ID NO: 192107 - DNA, 20 bp, Artificial Sequence
  chemically synthesized
tgctttaagctctttggaga

SEQ ID NO: 192108 - DNA, 20 bp, Artificial Sequence
  chemically synthesized
agcgagtatctttctccaaa

SEQ ID NO: 192109 - DNA, 20 bp, Artificial Sequence
  chemically synthesized
aaagtgctttaagctctttg

SEQ ID NO: 192110 - DNA, 20 bp, Artificial Sequence
  chemically synthesized
ataaagtgctttaagctctt

SEQ ID NO: 192111 - DNA, 20 bp, Artificial Sequence
  chemically synthesized
atctttctccaaagagctta

SEQ ID NO: 192112 - DNA, 20 bp, Artificial Sequence
  chemically synthesized
tgaattccataaagtgcttt

SEQ ID NO: 192113 - DNA, 20 bp, Artificial Sequence
  chemically synthesized
aaagagcttaaagcacttta

SEQ ID NO: 192114 - DNA, 20 bp, Artificial Sequence
  chemically synthesized
ttaattagatgaattccata

SEQ ID NO: 192115 - DNA, 20 bp, Artificial Sequence
  chemically synthesized
gatatagtgtgaacattaat

SEQ ID NO: 192116 - DNA, 20 bp, Artificial Sequence
  chemically synthesized
aatgttcacactatatccat

SEQ ID NO: 192117 - DNA, 20 bp, Artificial Sequence
  chemically synthesized
ccactgccttctcatggata

SEQ ID NO: 192118 - DNA, 20 bp, Artificial Sequence
  chemically synthesized
gttcacactatatccatgag

SEQ ID NO: 192119 - DNA, 20 bp, Artificial Sequence
  chemically synthesized
ttcacactatatccatgaga

SEQ ID NO: 192120 - DNA, 20 bp, Artificial Sequence
  chemically synthesized
cactgtccactgccttctca

SEQ ID NO: 192121 - DNA, 20 bp, Artificial Sequence
  chemically synthesized
acactatatccatgagaagg

SEQ ID NO: 192122 - DNA, 20 bp, Artificial Sequence
  chemically synthesized
ctatatccatgagaaggcag

SEQ ID NO: 192123 - DNA, 20 bp, Artificial Sequence
  chemically synthesized
atccatgagaaggcagtgga

SEQ ID NO: 192124 - DNA, 20 bp, Artificial Sequence
  chemically synthesized
tgagaaggcagtggacagtg

SEQ ID NO: 192125 - DNA, 20 bp, Artificial Sequence
  chemically synthesized
aggcagtggacagtgaagca

SEQ ID NO: 192126 - DNA, 20 bp, Artificial Sequence
  chemically synthesized
agtggacagtgaagcatggc

SEQ ID NO: 192127 - DNA, 20 bp, Artificial Sequence
  chemically synthesized
gtggacagtgaagcatggct

SEQ ID NO: 192128 - DNA, 20 bp, Artificial Sequence
  chemically synthesized
gtgaagcatggctgggtctg

SEQ ID NO: 192129 - DNA, 20 bp, Artificial Sequence
  chemically synthesized
atgggagctcacttcagacc

SEQ ID NO: 192130 - DNA, 20 bp, Artificial Sequence
  chemically synthesized
agcatggctgggtctgaagt

SEQ ID NO: 192131 - DNA, 20 bp, Artificial Sequence
  chemically synthesized
catggaatgggagctcactt

SEQ ID NO: 192132 - DNA, 20 bp, Artificial Sequence
  chemically synthesized
cctctcaaggcatggaatgg

SEQ ID NO: 192133 - DNA, 20 bp, Artificial Sequence
  chemically synthesized
accctctcaaggcatggaat

SEQ ID NO: 192134 - DNA, 20 bp, Artificial Sequence
  chemically synthesized
taccctctcaaggcatggaa

SEQ ID NO: 192135 - DNA, 20 bp, Artificial Sequence
  chemically synthesized
gagctcccattccatgcctt

SEQ ID NO: 192136 - DNA, 20 bp, Artificial Sequence
  chemically synthesized
aatcttaccctctcaaggca

SEQ ID NO: 192137 - DNA, 20 bp, Artificial Sequence
  chemically synthesized
gctcccattccatgccttga

SEQ ID NO: 192138 - DNA, 20 bp, Artificial Sequence
  chemically synthesized
ctcccattccatgccttgag

SEQ ID NO: 192139 - DNA, 20 bp, Artificial Sequence
  chemically synthesized
tcccattccatgccttgaga

SEQ ID NO: 192140 - DNA, 20 bp, Artificial Sequence
  chemically synthesized
ggtttaatcttaccctctca

SEQ ID NO: 192141 - DNA, 20 bp, Artificial Sequence
  chemically synthesized
gggtttaatcttaccctctc

SEQ ID NO: 192142 - DNA, 20 bp, Artificial Sequence
  chemically synthesized
attccatgccttgagagggt

SEQ ID NO: 192143 - DNA, 20 bp, Artificial Sequence
  chemically synthesized
tgagagggtaagattaaacc

SEQ ID NO: 192144 - DNA, 20 bp, Artificial Sequence
  chemically synthesized
acactaactctgcgtttgct

SEQ ID NO: 192145 - DNA, 20 bp, Artificial Sequence
  chemically synthesized
aagattaaacccagcaaacg

SEQ ID NO: 192146 - DNA, 20 bp, Artificial Sequence
  chemically synthesized
tacactaactctgcgtttgc

SEQ ID NO: 192147 - DNA, 20 bp, Artificial Sequence
  chemically synthesized
gattaaacccagcaaacgca

SEQ ID NO: 192148 - DNA, 20 bp, Artificial Sequence
  chemically synthesized
aaacccagcaaacgcagagt

SEQ ID NO: 192149 - DNA, 20 bp, Artificial Sequence
  chemically synthesized
cagcaaacgcagagttagtg

SEQ ID NO: 192150 - DNA, 20 bp, Artificial Sequence
  chemically synthesized
catgggctgacaaacagtgg

SEQ ID NO: 192151 - DNA, 20 bp, Artificial Sequence
  chemically synthesized
tgtcatgggctgacaaacag

SEQ ID NO: 192152 - DNA, 20 bp, Artificial Sequence
  chemically synthesized
tgtagtctaccactgtttgt

SEQ ID NO: 192153 - DNA, 20 bp, Artificial Sequence
  chemically synthesized
ttttgtcatgggctgacaaa

SEQ ID NO: 192154 - DNA, 20 bp, Artificial Sequence
  chemically synthesized
taaaatgtagtttttgtcat

SEQ ID NO: 192155 - DNA, 20 bp, Artificial Sequence
  chemically synthesized
ataaaatgtagtttttgtca

SEQ ID NO: 192156 - DNA, 20 bp, Artificial Sequence
  chemically synthesized
tattttaatgtgataaaatg

SEQ ID NO: 192157 - DNA, 20 bp, Artificial Sequence
  chemically synthesized
cattttatcacattaaaata

SEQ ID NO: 192158 - DNA, 20 bp, Artificial Sequence
  chemically synthesized
ttttatcacattaaaataaa

SEQ ID NO: 192159 - DNA, 20 bp, Artificial Sequence
  chemically synthesized
tttatcacattaaaataaag

SEQ ID NO: 192160 - DNA, 20 bp, Artificial Sequence
  chemically synthesized
atcacattaaaataaagagg

SEQ ID NO: 192161 - DNA, 20 bp, Artificial Sequence
  chemically synthesized
agaggaagaaacgtataaat

SEQ ID NO: 192162 - DNA, 20 bp, Artificial Sequence
  chemically synthesized
aagaaacgtataaatcagct

SEQ ID NO: 192163 - DNA, 20 bp, Artificial Sequence
  chemically synthesized
atccaaagggtaaagaaact

SEQ ID NO: 192164 - DNA, 20 bp, Artificial Sequence
  chemically synthesized
agctgagtttctttaccctt

SEQ ID NO: 192165 - DNA, 20 bp, Artificial Sequence
  chemically synthesized
tacttgaaatccaaagggta

SEQ ID NO: 192166 - DNA, 20 bp, Artificial Sequence
  chemically synthesized
taggatacttgaaatccaaa

SEQ ID NO: 192167 - DNA, 20 bp, Artificial Sequence
  chemically synthesized
ttaggatacttgaaatccaa

SEQ ID NO: 192168 - DNA, 20 bp, Artificial Sequence
  chemically synthesized
gttaggatacttgaaatcca

SEQ ID NO: 192169 - DNA, 20 bp, Artificial Sequence
  chemically synthesized
ttctttaccctttggatttc

SEQ ID NO: 192170 - DNA, 20 bp, Artificial Sequence
  chemically synthesized
ttggatttcaagtatcctaa

SEQ ID NO: 192171 - DNA, 20 bp, Artificial Sequence
  chemically synthesized
tttttgtgtttttaactgtt

SEQ ID NO: 192172 - DNA, 20 bp, Artificial Sequence
  chemically synthesized
gtttttgtgtttttaactgt

SEQ ID NO: 192173 - DNA, 20 bp, Artificial Sequence
  chemically synthesized
gttaaaaacacaaaaactat

SEQ ID NO: 192174 - DNA, 20 bp, Artificial Sequence
  chemically synthesized
ggaattgttaaaggaactga

SEQ ID NO: 192175 - DNA, 20 bp, Artificial Sequence
  chemically synthesized
agagcatctggaattgttaa

SEQ ID NO: 192176 - DNA, 20 bp, Artificial Sequence
  chemically synthesized
cagagcatctggaattgtta

SEQ ID NO: 192177 - DNA, 20 bp, Artificial Sequence
  chemically synthesized
atcagttcctttaacaattc

SEQ ID NO: 192178 - DNA, 20 bp, Artificial Sequence
  chemically synthesized
tttaacaattccagatgctc

SEQ ID NO: 192179 - DNA, 20 bp, Artificial Sequence
  chemically synthesized
ttctaaaatgccagagcatc

SEQ ID NO: 192180 - DNA, 20 bp, Artificial Sequence
  chemically synthesized
accgtatttctaaaatgcca

SEQ ID NO: 192181 - DNA, 20 bp, Artificial Sequence
  chemically synthesized
ttccagatgctctggcattt

SEQ ID NO: 192182 - DNA, 20 bp, Artificial Sequence
  chemically synthesized
tgaccgtatttctaaaatgc

SEQ ID NO: 192183 - DNA, 20 bp, Artificial Sequence
  chemically synthesized
gctctggcattttagaaata

SEQ ID NO: 192184 - DNA, 20 bp, Artificial Sequence
  chemically synthesized
gcattttagaaatacggtca

SEQ ID NO: 192185 - DNA, 20 bp, Artificial Sequence
  chemically synthesized
gtcaaagtttgattaaaatg

SEQ ID NO: 192186 - DNA, 20 bp, Artificial Sequence
  chemically synthesized
caaagtttgattaaaatgtg

SEQ ID NO: 192187 - DNA, 20 bp, Artificial Sequence
  chemically synthesized
attaaaatgtggagcttccc

SEQ ID NO: 192188 - DNA, 20 bp, Artificial Sequence
  chemically synthesized
aaaatgtggagcttccctag

SEQ ID NO: 192189 - DNA, 20 bp, Artificial Sequence
  chemically synthesized
tattgtttgttctactaggg

SEQ ID NO: 192190 - DNA, 20 bp, Artificial Sequence
  chemically synthesized
aaatattgtttgttctacta

SEQ ID NO: 192191 - DNA, 20 bp, Artificial Sequence
  chemically synthesized
taaatattgtttgttctact

SEQ ID NO: 192192 - DNA, 20 bp, Artificial Sequence
  chemically synthesized
gtaaatattgtttgttctac

SEQ ID NO: 192193 - DNA, 20 bp, Artificial Sequence
  chemically synthesized
tttattgtgtgaatgaaaag

SEQ ID NO: 192194 - DNA, 20 bp, Artificial Sequence
  chemically synthesized
ccatttattgtgtgaatgaa

SEQ ID NO: 192195 - DNA, 20 bp, Artificial Sequence
  chemically synthesized
cttttcattcacacaataaa

SEQ ID NO: 192196 - DNA, 20 bp, Artificial Sequence
  chemically synthesized
tcattcacacaataaatggt

SEQ ID NO: 192197 - DNA, 20 bp, Artificial Sequence
  chemically synthesized
caataaatggtaagcattgt

SEQ ID NO: 192198 - DNA, 20 bp, Artificial Sequence
  chemically synthesized
gtaagcattgtcagtatgtg

SEQ ID NO: 192199 - DNA, 20 bp, Artificial Sequence
  chemically synthesized
taagcattgtcagtatgtgt

SEQ ID NO: 192200 - DNA, 20 bp, Artificial Sequence
  chemically synthesized
gtcagatctgggtaacattt

SEQ ID NO: 192201 - DNA, 20 bp, Artificial Sequence
  chemically synthesized
acatcaactcaaatgttacc

SEQ ID NO: 192202 - DNA, 20 bp, Artificial Sequence
  chemically synthesized
aaaagtacacagtcagatct

SEQ ID NO: 192203 - DNA, 20 bp, Artificial Sequence
  chemically synthesized
taaaagtacacagtcagatc

SEQ ID NO: 192204 - DNA, 20 bp, Artificial Sequence
  chemically synthesized
ctgggctaaaagtacacagt

SEQ ID NO: 192205 - DNA, 20 bp, Artificial Sequence
  chemically synthesized
ccgtctgggctaaaagtaca

SEQ ID NO: 192206 - DNA, 20 bp, Artificial Sequence
  chemically synthesized
cagatctgactgtgtacttt

SEQ ID NO: 192207 - DNA, 20 bp, Artificial Sequence
  chemically synthesized
ctgactgtgtacttttagcc

SEQ ID NO: 192208 - DNA, 20 bp, Artificial Sequence
  chemically synthesized
tgtcaggccgtctgggctaa

SEQ ID NO: 192209 - DNA, 20 bp, Artificial Sequence
  chemically synthesized
ctgtgtacttttagcccaga

SEQ ID NO: 192210 - DNA, 20 bp, Artificial Sequence
  chemically synthesized
cttcatctgtcaggccgtct

SEQ ID NO: 192211 - DNA, 20 bp, Artificial Sequence
  chemically synthesized
acttcatctgtcaggccgtc

SEQ ID NO: 192212 - DNA, 20 bp, Artificial Sequence
  chemically synthesized
ttttagcccagacggcctga

SEQ ID NO: 192213 - DNA, 20 bp, Artificial Sequence
  chemically synthesized
taaaattaacttcatctgtc

SEQ ID NO: 192214 - DNA, 20 bp, Artificial Sequence
  chemically synthesized
cccagacggcctgacagatg

SEQ ID NO: 192215 - DNA, 20 bp, Artificial Sequence
  chemically synthesized
ttaaaattaacttcatctgt

SEQ ID NO: 192216 - DNA, 20 bp, Artificial Sequence
  chemically synthesized
gttaattttaatattatctc

SEQ ID NO: 192217 - DNA, 20 bp, Artificial Sequence
  chemically synthesized
ttttaatattatctcaagaa

SEQ ID NO: 192218 - DNA, 20 bp, Artificial Sequence
  chemically synthesized
atataattaatgcttttctt

SEQ ID NO: 192219 - DNA, 20 bp, Artificial Sequence
  chemically synthesized
ctccaccagaacgtattaac

SEQ ID NO: 192220 - DNA, 20 bp, Artificial Sequence
  chemically synthesized
tctccaccagaacgtattaa

SEQ ID NO: 192221 - DNA, 20 bp, Artificial Sequence
  chemically synthesized
gcatgcctgttaatacgttc

SEQ ID NO: 192222 - DNA, 20 bp, Artificial Sequence
  chemically synthesized
tgcctgttaatacgttctgg

SEQ ID NO: 192223 - DNA, 20 bp, Artificial Sequence
  chemically synthesized
cctgttaatacgttctggtg

SEQ ID NO: 192224 - DNA, 20 bp, Artificial Sequence
  chemically synthesized
ccttctatctttttctccac

SEQ ID NO: 192225 - DNA, 20 bp, Artificial Sequence
  chemically synthesized
aatacgttctggtggagaaa

SEQ ID NO: 192226 - DNA, 20 bp, Artificial Sequence
  chemically synthesized
cgttctggtggagaaaaaga

SEQ ID NO: 192227 - DNA, 20 bp, Artificial Sequence
  chemically synthesized
tctggtggagaaaaagatag

SEQ ID NO: 192228 - DNA, 20 bp, Artificial Sequence
  chemically synthesized
ctggtggagaaaaagataga

SEQ ID NO: 192229 - DNA, 20 bp, Artificial Sequence
  chemically synthesized
tggagaaaaagatagaagga

SEQ ID NO: 192230 - DNA, 20 bp, Artificial Sequence
  chemically synthesized
ggagaaaaagatagaaggat

SEQ ID NO: 192231 - DNA, 20 bp, Artificial Sequence
  chemically synthesized
agaaaaagatagaaggatgg

SEQ ID NO: 192232 - DNA, 20 bp, Artificial Sequence
  chemically synthesized
agaaggatgggagtacataa

SEQ ID NO: 192233 - DNA, 20 bp, Artificial Sequence
  chemically synthesized
ggatgggagtacataatagt

SEQ ID NO: 192234 - DNA, 20 bp, Artificial Sequence
  chemically synthesized
gggagtacataatagttaga

SEQ ID NO: 192235 - DNA, 20 bp, Artificial Sequence
  chemically synthesized
ggagtacataatagttagaa

SEQ ID NO: 192236 - DNA, 20 bp, Artificial Sequence
  chemically synthesized
ttttatttttgtttacaaat

SEQ ID NO: 192237 - DNA, 20 bp, Artificial Sequence
  chemically synthesized
caaaaataaaaacaacactt

SEQ ID NO: 192238 - DNA, 20 bp, Artificial Sequence
  chemically synthesized
aaaatagggaagaggtactg

SEQ ID NO: 192239 - DNA, 20 bp, Artificial Sequence
  chemically synthesized
tgtgatttaaaatagggaag

SEQ ID NO: 192240 - DNA, 20 bp, Artificial Sequence
  chemically synthesized
ctgtgatttaaaatagggaa

SEQ ID NO: 192241 - DNA, 20 bp, Artificial Sequence
  chemically synthesized
gactgtgatttaaaataggg

SEQ ID NO: 192242 - DNA, 20 bp, Artificial Sequence
  chemically synthesized
gtggactgtgatttaaaata

SEQ ID NO: 192243 - DNA, 20 bp, Artificial Sequence
  chemically synthesized
tgtggactgtgatttaaaat

SEQ ID NO: 192244 - DNA, 20 bp, Artificial Sequence
  chemically synthesized
ctgtggactgtgatttaaaa

SEQ ID NO: 192245 - DNA, 20 bp, Artificial Sequence
  chemically synthesized
ctcttccctattttaaatca

SEQ ID NO: 192246 - DNA, 20 bp, Artificial Sequence
  chemically synthesized
ctattttaaatcacagtcca

SEQ ID NO: 192247 - DNA, 20 bp, Artificial Sequence
  chemically synthesized
ttaaatcacagtccacagtt

SEQ ID NO: 192248 - DNA, 20 bp, Artificial Sequence
  chemically synthesized
ccagtggaaaagctgaactg

SEQ ID NO: 192249 - DNA, 20 bp, Artificial Sequence
  chemically synthesized
ccacagttcagcttttccac

SEQ ID NO: 192250 - DNA, 20 bp, Artificial Sequence
  chemically synthesized
cacagttcagcttttccact

SEQ ID NO: 192251 - DNA, 20 bp, Artificial Sequence
  chemically synthesized
acgacgtgatcccagtggaa

SEQ ID NO: 192252 - DNA, 20 bp, Artificial Sequence
  chemically synthesized
aggttacgacgtgatcccag

SEQ ID NO: 192253 - DNA, 20 bp, Artificial Sequence
  chemically synthesized
gtcaggttacgacgtgatcc

SEQ ID NO: 192254 - DNA, 20 bp, Artificial Sequence
  chemically synthesized
caggttagggaaatcaggtc

SEQ ID NO: 192255 - DNA, 20 bp, Artificial Sequence
  chemically synthesized
ccaggttagggaaatcaggt

SEQ ID NO: 192256 - DNA, 20 bp, Artificial Sequence
  chemically synthesized
ctgaccaggttagggaaatc

SEQ ID NO: 192257 - DNA, 20 bp, Artificial Sequence
  chemically synthesized
tctgaccaggttagggaaat

SEQ ID NO: 192258 - DNA, 20 bp, Artificial Sequence
  chemically synthesized
ctgacctgatttccctaacc

SEQ ID NO: 192259 - DNA, 20 bp, Artificial Sequence
  chemically synthesized
aagaaaatctgaccaggtta

SEQ ID NO: 192260 - DNA, 20 bp, Artificial Sequence
  chemically synthesized
gaagaaaatctgaccaggtt

SEQ ID NO: 192261 - DNA, 20 bp, Artificial Sequence
  chemically synthesized
cctgatttccctaacctggt

SEQ ID NO: 192262 - DNA, 20 bp, Artificial Sequence
  chemically synthesized
tgaagaaaatctgaccaggt

SEQ ID NO: 192263 - DNA, 20 bp, Artificial Sequence
  chemically synthesized
attctgaagaaaatctgacc

SEQ ID NO: 192264 - DNA, 20 bp, Artificial Sequence
  chemically synthesized
tattctgaagaaaatctgac

SEQ ID NO: 192265 - DNA, 20 bp, Artificial Sequence
  chemically synthesized
taacctggtcagattttctt

SEQ ID NO: 192266 - DNA, 20 bp, Artificial Sequence
  chemically synthesized
cttttattaattttattctg

SEQ ID NO: 192267 - DNA, 20 bp, Artificial Sequence
  chemically synthesized
cttcagaataaaattaataa

SEQ ID NO: 192268 - DNA, 20 bp, Artificial Sequence
  chemically synthesized
aaaattaataaaagaattca

SEQ ID NO: 192269 - DNA, 20 bp, Artificial Sequence
  chemically synthesized
attaataaaagaattcacag

SEQ ID NO: 192270 - DNA, 20 bp, Artificial Sequence
  chemically synthesized
ttaataaaagaattcacaga

SEQ ID NO: 192271 - DNA, 20 bp, Artificial Sequence
  chemically synthesized
atctattttaatgaaattgt

SEQ ID NO: 192272 - DNA, 20 bp, Artificial Sequence
  chemically synthesized
ggcttacaatttcattaaaa

SEQ ID NO: 192273 - DNA, 20 bp, Artificial Sequence
  chemically synthesized
tttcattaaaatagataaaa

SEQ ID NO: 192274 - DNA, 20 bp, Artificial Sequence
  chemically synthesized
caatacaatttttatgaagt

SEQ ID NO: 192275 - DNA, 20 bp, Artificial Sequence
  chemically synthesized
gtgccaatacaatttttatg

SEQ ID NO: 192276 - DNA, 20 bp, Artificial Sequence
  chemically synthesized
caacttcataaaaattgtat

SEQ ID NO: 192277 - DNA, 20 bp, Artificial Sequence
  chemically synthesized
aaattgtattggcacattca

SEQ ID NO: 192278 - DNA, 20 bp, Artificial Sequence
  chemically synthesized
tggcacattcaaagacataa

SEQ ID NO: 192279 - DNA, 20 bp, Artificial Sequence
  chemically synthesized
ttatgcattgtagaatttat

SEQ ID NO: 192280 - DNA, 20 bp, Artificial Sequence
  chemically synthesized
atttcacagattatgcattg

SEQ ID NO: 192281 - DNA, 20 bp, Artificial Sequence
  chemically synthesized
tttcaaataaaaagatttca

SEQ ID NO: 192282 - DNA, 20 bp, Artificial Sequence
  chemically synthesized
tactttgtttttcaaataaa

SEQ ID NO: 192283 - DNA, 20 bp, Artificial Sequence
  chemically synthesized
atctttttatttgaaaaaca

SEQ ID NO: 192284 - DNA, 20 bp, Artificial Sequence
  chemically synthesized
tatttgaaaaacaaagtatt

SEQ ID NO: 192285 - DNA, 20 bp, Artificial Sequence
  chemically synthesized
aaaacaaagtatttagcaaa

SEQ ID NO: 192286 - DNA, 20 bp, Artificial Sequence
  chemically synthesized
ggtgtgactatgtggagaga

SEQ ID NO: 192287 - DNA, 20 bp, Artificial Sequence
  chemically synthesized
aatagcactgtctctccaca

SEQ ID NO: 192288 - DNA, 20 bp, Artificial Sequence
  chemically synthesized
gcatggtgtgactatgtgga

SEQ ID NO: 192289 - DNA, 20 bp, Artificial Sequence
  chemically synthesized
cagcatggtgtgactatgtg

SEQ ID NO: 192290 - DNA, 20 bp, Artificial Sequence
  chemically synthesized
gtcagcatggtgtgactatg

SEQ ID NO: 192291 - DNA, 20 bp, Artificial Sequence
  chemically synthesized
acatagtcacaccatgctga

SEQ ID NO: 192292 - DNA, 20 bp, Artificial Sequence
  chemically synthesized
atgtttatcttctgtcagca

SEQ ID NO: 192293 - DNA, 20 bp, Artificial Sequence
  chemically synthesized
tagtcacaccatgctgacag

SEQ ID NO: 192294 - DNA, 20 bp, Artificial Sequence
  chemically synthesized
accttatgtttatcttctgt

SEQ ID NO: 192295 - DNA, 20 bp, Artificial Sequence
  chemically synthesized
tgctgacagaagataaacat

SEQ ID NO: 192296 - DNA, 20 bp, Artificial Sequence
  chemically synthesized
gctgacagaagataaacata

SEQ ID NO: 192297 - DNA, 20 bp, Artificial Sequence
  chemically synthesized
acagaagataaacataaggt

SEQ ID NO: 192298 - DNA, 20 bp, Artificial Sequence
  chemically synthesized
gaagataaacataaggtcag

SEQ ID NO: 192299 - DNA, 20 bp, Artificial Sequence
  chemically synthesized
aagataaacataaggtcagt

SEQ ID NO: 192300 - DNA, 20 bp, Artificial Sequence
  chemically synthesized
aggtcagtaggtcttcctca

SEQ ID NO: 192301 - DNA, 20 bp, Artificial Sequence
  chemically synthesized
atggatggatgtctttgagg

SEQ ID NO: 192302 - DNA, 20 bp, Artificial Sequence
  chemically synthesized
tgtatggatggatgtctttg

SEQ ID NO: 192303 - DNA, 20 bp, Artificial Sequence
  chemically synthesized
gtgtatggatggatgtcttt

SEQ ID NO: 192304 - DNA, 20 bp, Artificial Sequence
  chemically synthesized
tcatgtctccagtgtatgga

SEQ ID NO: 192305 - DNA, 20 bp, Artificial Sequence
  chemically synthesized
aaagacatccatccatacac

SEQ ID NO: 192306 - DNA, 20 bp, Artificial Sequence
  chemically synthesized
agacatccatccatacactg

SEQ ID NO: 192307 - DNA, 20 bp, Artificial Sequence
  chemically synthesized
ttgatcatgtctccagtgta

SEQ ID NO: 192308 - DNA, 20 bp, Artificial Sequence
  chemically synthesized
agatgaattgatcatgtctc

SEQ ID NO: 192309 - DNA, 20 bp, Artificial Sequence
  chemically synthesized
tcccctactatgaaagtgat

SEQ ID NO: 192310 - DNA, 20 bp, Artificial Sequence
  chemically synthesized
aattcatctcatcactttca

SEQ ID NO: 192311 - DNA, 20 bp, Artificial Sequence
  chemically synthesized
tcatctcatcactttcatag

SEQ ID NO: 192312 - DNA, 20 bp, Artificial Sequence
  chemically synthesized
catctcatcactttcatagt

SEQ ID NO: 192313 - DNA, 20 bp, Artificial Sequence
  chemically synthesized
tagttattcccctactatga

SEQ ID NO: 192314 - DNA, 20 bp, Artificial Sequence
  chemically synthesized
atctcatcactttcatagta

SEQ ID NO: 192315 - DNA, 20 bp, Artificial Sequence
  chemically synthesized
tctcatcactttcatagtag

SEQ ID NO: 192316 - DNA, 20 bp, Artificial Sequence
  chemically synthesized
tttcatagtaggggaataac

SEQ ID NO: 192317 - DNA, 20 bp, Artificial Sequence
  chemically synthesized
catagtaggggaataactag

SEQ ID NO: 192318 - DNA, 20 bp, Artificial Sequence
  chemically synthesized
tttaggcaaaaagtatccgc

SEQ ID NO: 192319 - DNA, 20 bp, Artificial Sequence
  chemically synthesized
caaatctgcttttaggcaaa

SEQ ID NO: 192320 - DNA, 20 bp, Artificial Sequence
  chemically synthesized
agcggatactttttgcctaa

SEQ ID NO: 192321 - DNA, 20 bp, Artificial Sequence
  chemically synthesized
ggatactttttgcctaaaag

SEQ ID NO: 192322 - DNA, 20 bp, Artificial Sequence
  chemically synthesized
tcagagtcaaatctgctttt

SEQ ID NO: 192323 - DNA, 20 bp, Artificial Sequence
  chemically synthesized
atcagagtcaaatctgcttt

SEQ ID NO: 192324 - DNA, 20 bp, Artificial Sequence
  chemically synthesized
atttgtactgataatcatca

SEQ ID NO: 192325 - DNA, 20 bp, Artificial Sequence
  chemically synthesized
aaatttgtactgataatcat

SEQ ID NO: 192326 - DNA, 20 bp, Artificial Sequence
  chemically synthesized
gatttgactctgatgattat

SEQ ID NO: 192327 - DNA, 20 bp, Artificial Sequence
  chemically synthesized
cagtacaaatttaaaacgtc

SEQ ID NO: 192328 - DNA, 20 bp, Artificial Sequence
  chemically synthesized
tttaaaacgtcaagtcaatt

SEQ ID NO: 192329 - DNA, 20 bp, Artificial Sequence
  chemically synthesized
taaaacgtcaagtcaatttg

SEQ ID NO: 192330 - DNA, 20 bp, Artificial Sequence
  chemically synthesized
aacgtcaagtcaatttggag

SEQ ID NO: 192331 - DNA, 20 bp, Artificial Sequence
  chemically synthesized
aagtcaatttggagaagtgc

SEQ ID NO: 192332 - DNA, 20 bp, Artificial Sequence
  chemically synthesized
aatttggagaagtgcaagca

SEQ ID NO: 192333 - DNA, 20 bp, Artificial Sequence
  chemically synthesized
atttggagaagtgcaagcaa

SEQ ID NO: 192334 - DNA, 20 bp, Artificial Sequence
  chemically synthesized
gaatcttactattgatttgt

SEQ ID NO: 192335 - DNA, 20 bp, Artificial Sequence
  chemically synthesized
caaaggcaccaacaaatcaa

SEQ ID NO: 192336 - DNA, 20 bp, Artificial Sequence
  chemically synthesized
ggcaccaacaaatcaatagt

SEQ ID NO: 192337 - DNA, 20 bp, Artificial Sequence
  chemically synthesized
atcttaaaagatgaacatca

SEQ ID NO: 192338 - DNA, 20 bp, Artificial Sequence
  chemically synthesized
ttctttgatgttcatctttt

SEQ ID NO: 192339 - DNA, 20 bp, Artificial Sequence
  chemically synthesized
agtacaaaggagaatcttaa

SEQ ID NO: 192340 - DNA, 20 bp, Artificial Sequence
  chemically synthesized
agtcaagagttagtacaaag

SEQ ID NO: 192341 - DNA, 20 bp, Artificial Sequence
  chemically synthesized
tgagtcaagagttagtacaa

SEQ ID NO: 192342 - DNA, 20 bp, Artificial Sequence
  chemically synthesized
atgagtcaagagttagtaca

SEQ ID NO: 192343 - DNA, 20 bp, Artificial Sequence
  chemically synthesized
ggaaagtatgagtcaagagt

SEQ ID NO: 192344 - DNA, 20 bp, Artificial Sequence
  chemically synthesized
aatgggaaagtatgagtcaa

SEQ ID NO: 192345 - DNA, 20 bp, Artificial Sequence
  chemically synthesized
taaatgggaaagtatgagtc

SEQ ID NO: 192346 - DNA, 20 bp, Artificial Sequence
  chemically synthesized
tactttaaatgggaaagtat

SEQ ID NO: 192347 - DNA, 20 bp, Artificial Sequence
  chemically synthesized
aacagttactttaaatggga

SEQ ID NO: 192348 - DNA, 20 bp, Artificial Sequence
  chemically synthesized
gactcatactttcccattta

SEQ ID NO: 192349 - DNA, 20 bp, Artificial Sequence
  chemically synthesized
aataaacagttactttaaat

SEQ ID NO: 192350 - DNA, 20 bp, Artificial Sequence
  chemically synthesized
taataaacagttactttaaa

SEQ ID NO: 192351 - DNA, 20 bp, Artificial Sequence
  chemically synthesized
ttcaatgttcaattaataaa

SEQ ID NO: 192352 - DNA, 20 bp, Artificial Sequence
  chemically synthesized
tagctggtattataaatttc

SEQ ID NO: 192353 - DNA, 20 bp, Artificial Sequence
  chemically synthesized
ttacttgaaatttataatac

SEQ ID NO: 192354 - DNA, 20 bp, Artificial Sequence
  chemically synthesized
gagcttatccagttattagc

SEQ ID NO: 192355 - DNA, 20 bp, Artificial Sequence
  chemically synthesized
ttataataccagctaataac

SEQ ID NO: 192356 - DNA, 20 bp, Artificial Sequence
  chemically synthesized
ttaagagcttatccagttat

SEQ ID NO: 192357 - DNA, 20 bp, Artificial Sequence
  chemically synthesized
ataccagctaataactggat

SEQ ID NO: 192358 - DNA, 20 bp, Artificial Sequence
  chemically synthesized
aacacccttaagagcttatc

SEQ ID NO: 192359 - DNA, 20 bp, Artificial Sequence
  chemically synthesized
taataactggataagctctt

SEQ ID NO: 192360 - DNA, 20 bp, Artificial Sequence
  chemically synthesized
aataactggataagctctta

SEQ ID NO: 192361 - DNA, 20 bp, Artificial Sequence
  chemically synthesized
ataactggataagctcttaa

SEQ ID NO: 192362 - DNA, 20 bp, Artificial Sequence
  chemically synthesized
aggtaaggaaacacccttaa

SEQ ID NO: 192363 - DNA, 20 bp, Artificial Sequence
  chemically synthesized
acaggtaaggaaacaccctt

SEQ ID NO: 192364 - DNA, 20 bp, Artificial Sequence
  chemically synthesized
ctgtacgttgggtacaggta

SEQ ID NO: 192365 - DNA, 20 bp, Artificial Sequence
  chemically synthesized
actgtacgttgggtacaggt

SEQ ID NO: 192366 - DNA, 20 bp, Artificial Sequence
  chemically synthesized
ttcaactgtacgttgggtac

SEQ ID NO: 192367 - DNA, 20 bp, Artificial Sequence
  chemically synthesized
tttcaactgtacgttgggta

SEQ ID NO: 192368 - DNA, 20 bp, Artificial Sequence
  chemically synthesized
ccttacctgtacccaacgta

SEQ ID NO: 192369 - DNA, 20 bp, Artificial Sequence
  chemically synthesized
acaattttcaactgtacgtt

SEQ ID NO: 192370 - DNA, 20 bp, Artificial Sequence
  chemically synthesized
cacaattttcaactgtacgt

SEQ ID NO: 192371 - DNA, 20 bp, Artificial Sequence
  chemically synthesized
caacgtacagttgaaaattg

SEQ ID NO: 192372 - DNA, 20 bp, Artificial Sequence
  chemically synthesized
gaaaattgtggattatttca

SEQ ID NO: 192373 - DNA, 20 bp, Artificial Sequence
  chemically synthesized
aaaattgtggattatttcac

SEQ ID NO: 192374 - DNA, 20 bp, Artificial Sequence
  chemically synthesized
cattgctatcaatttcagtc

SEQ ID NO: 192375 - DNA, 20 bp, Artificial Sequence
  chemically synthesized
gcattgctatcaatttcagt

SEQ ID NO: 192376 - DNA, 20 bp, Artificial Sequence
  chemically synthesized
tttatcctgactgaaattga

SEQ ID NO: 192377 - DNA, 20 bp, Artificial Sequence
  chemically synthesized
tatggcattgctatcaattt

SEQ ID NO: 192378 - DNA, 20 bp, Artificial Sequence
  chemically synthesized
aatttcatgaaagtttcgta

SEQ ID NO: 192379 - DNA, 20 bp, Artificial Sequence
  chemically synthesized
tatgtatttaaatttcatga

SEQ ID NO: 192380 - DNA, 20 bp, Artificial Sequence
  chemically synthesized
tttcatgaaatttaaataca

SEQ ID NO: 192381 - DNA, 20 bp, Artificial Sequence
  chemically synthesized
catagcattgcataaaatta

SEQ ID NO: 192382 - DNA, 20 bp, Artificial Sequence
  chemically synthesized
aggctaaaactaaattcaaa

SEQ ID NO: 192383 - DNA, 20 bp, Artificial Sequence
  chemically synthesized
aaaataataccatttgaatt

SEQ ID NO: 192384 - DNA, 20 bp, Artificial Sequence
  chemically synthesized
ataccatttgaatttagttt

SEQ ID NO: 192385 - DNA, 20 bp, Artificial Sequence
  chemically synthesized
gaatttagttttagcctttt

SEQ ID NO: 192386 - DNA, 20 bp, Artificial Sequence
  chemically synthesized
taagattagccaaactcaaa

SEQ ID NO: 192387 - DNA, 20 bp, Artificial Sequence
  chemically synthesized
tagttttagccttttgagtt

SEQ ID NO: 192388 - DNA, 20 bp, Artificial Sequence
  chemically synthesized
ttaagattagccaaactcaa

SEQ ID NO: 192389 - DNA, 20 bp, Artificial Sequence
  chemically synthesized
ggtcatccagtgattaagat

SEQ ID NO: 192390 - DNA, 20 bp, Artificial Sequence
  chemically synthesized
gtttggctaatcttaatcac

SEQ ID NO: 192391 - DNA, 20 bp, Artificial Sequence
  chemically synthesized
ccagtggtcatccagtgatt

SEQ ID NO: 192392 - DNA, 20 bp, Artificial Sequence
  chemically synthesized
tgttgaagccagtggtcatc

SEQ ID NO: 192393 - DNA, 20 bp, Artificial Sequence
  chemically synthesized
cttaatcactggatgaccac

SEQ ID NO: 192394 - DNA, 20 bp, Artificial Sequence
  chemically synthesized
ttcttctatgttgaagccag

SEQ ID NO: 192395 - DNA, 20 bp, Artificial Sequence
  chemically synthesized
tggttcttctatgttgaagc

SEQ ID NO: 192396 - DNA, 20 bp, Artificial Sequence
  chemically synthesized
gatgaccactggcttcaaca

SEQ ID NO: 192397 - DNA, 20 bp, Artificial Sequence
  chemically synthesized
tatatggttcttctatgttg

SEQ ID NO: 192398 - DNA, 20 bp, Artificial Sequence
  chemically synthesized
gaccactggcttcaacatag

SEQ ID NO: 192399 - DNA, 20 bp, Artificial Sequence
  chemically synthesized
aacatagaagaaccatataa

SEQ ID NO: 192400 - DNA, 20 bp, Artificial Sequence
  chemically synthesized
acatagaagaaccatataaa

SEQ ID NO: 192401 - DNA, 20 bp, Artificial Sequence
  chemically synthesized
tgtacacttttccttttata

SEQ ID NO: 192402 - DNA, 20 bp, Artificial Sequence
  chemically synthesized
gaagaaccatataaaaggaa

SEQ ID NO: 192403 - DNA, 20 bp, Artificial Sequence
  chemically synthesized
aaagtgtacaaattatttta

SEQ ID NO: 192404 - DNA, 20 bp, Artificial Sequence
  chemically synthesized
taagatatgtaagaaattat

SEQ ID NO: 192405 - DNA, 20 bp, Artificial Sequence
  chemically synthesized
atagtccttataagatatgt

SEQ ID NO: 192406 - DNA, 20 bp, Artificial Sequence
  chemically synthesized
taatttcttacatatcttat

SEQ ID NO: 192407 - DNA, 20 bp, Artificial Sequence
  chemically synthesized
aatttcttacatatcttata

SEQ ID NO: 192408 - DNA, 20 bp, Artificial Sequence
  chemically synthesized
agtaaggtaatagtccttat

SEQ ID NO: 192409 - DNA, 20 bp, Artificial Sequence
  chemically synthesized
agtcaacaacagtaaggtaa

SEQ ID NO: 192410 - DNA, 20 bp, Artificial Sequence
  chemically synthesized
aggtagagtcaacaacagta

SEQ ID NO: 192411 - DNA, 20 bp, Artificial Sequence
  chemically synthesized
aaggtagagtcaacaacagt

SEQ ID NO: 192412 - DNA, 20 bp, Artificial Sequence
  chemically synthesized
tagaaaggtagagtcaacaa

SEQ ID NO: 192413 - DNA, 20 bp, Artificial Sequence
  chemically synthesized
taggcatgtctagaaaggta

SEQ ID NO: 192414 - DNA, 20 bp, Artificial Sequence
  chemically synthesized
tgttgttgactctacctttc

SEQ ID NO: 192415 - DNA, 20 bp, Artificial Sequence
  chemically synthesized
cctaggcatgtctagaaagg

SEQ ID NO: 192416 - DNA, 20 bp, Artificial Sequence
  chemically synthesized
gtccctaggcatgtctagaa

SEQ ID NO: 192417 - DNA, 20 bp, Artificial Sequence
  chemically synthesized
agtccctaggcatgtctaga

SEQ ID NO: 192418 - DNA, 20 bp, Artificial Sequence
  chemically synthesized
aattagtccctaggcatgtc

SEQ ID NO: 192419 - DNA, 20 bp, Artificial Sequence
  chemically synthesized
tctacctttctagacatgcc

SEQ ID NO: 192420 - DNA, 20 bp, Artificial Sequence
  chemically synthesized
ctacctttctagacatgcct

SEQ ID NO: 192421 - DNA, 20 bp, Artificial Sequence
  chemically synthesized
tacctttctagacatgccta

SEQ ID NO: 192422 - DNA, 20 bp, Artificial Sequence
  chemically synthesized
aagtaatccaattagtccct

SEQ ID NO: 192423 - DNA, 20 bp, Artificial Sequence
  chemically synthesized
aaagtaatccaattagtccc

SEQ ID NO: 192424 - DNA, 20 bp, Artificial Sequence
  chemically synthesized
agacatgcctagggactaat

SEQ ID NO: 192425 - DNA, 20 bp, Artificial Sequence
  chemically synthesized
ttgtttcaaagtaatccaat

SEQ ID NO: 192426 - DNA, 20 bp, Artificial Sequence
  chemically synthesized
cagtaaaagagattgtttca

SEQ ID NO: 192427 - DNA, 20 bp, Artificial Sequence
  chemically synthesized
tctttccttttgcagtaaaa

SEQ ID NO: 192428 - DNA, 20 bp, Artificial Sequence
  chemically synthesized
attctttccttttgcagtaa

SEQ ID NO: 192429 - DNA, 20 bp, Artificial Sequence
  chemically synthesized
aacaatctcttttactgcaa

SEQ ID NO: 192430 - DNA, 20 bp, Artificial Sequence
  chemically synthesized
acaatctcttttactgcaaa

SEQ ID NO: 192431 - DNA, 20 bp, Artificial Sequence
  chemically synthesized
ttgtaaattctttccttttg

SEQ ID NO: 192432 - DNA, 20 bp, Artificial Sequence
  chemically synthesized
tctcttttactgcaaaagga

SEQ ID NO: 192433 - DNA, 20 bp, Artificial Sequence
  chemically synthesized
gcaaaaggaaagaatttaca

SEQ ID NO: 192434 - DNA, 20 bp, Artificial Sequence
  chemically synthesized
caaaaggaaagaatttacaa

SEQ ID NO: 192435 - DNA, 20 bp, Artificial Sequence
  chemically synthesized
ggaaagaatttacaaaggca

SEQ ID NO: 192436 - DNA, 20 bp, Artificial Sequence
  chemically synthesized
tttacaaaggcaaagctcta

SEQ ID NO: 192437 - DNA, 20 bp, Artificial Sequence
  chemically synthesized
ttcttaactcattggctata

SEQ ID NO: 192438 - DNA, 20 bp, Artificial Sequence
  chemically synthesized
acttcttaactcattggcta

SEQ ID NO: 192439 - DNA, 20 bp, Artificial Sequence
  chemically synthesized
ggcaaagctctatagccaat

SEQ ID NO: 192440 - DNA, 20 bp, Artificial Sequence
  chemically synthesized
agctctatagccaatgagtt

SEQ ID NO: 192441 - DNA, 20 bp, Artificial Sequence
  chemically synthesized
taagtaacttcttaactcat

SEQ ID NO: 192442 - DNA, 20 bp, Artificial Sequence
  chemically synthesized
tctatagccaatgagttaag

SEQ ID NO: 192443 - DNA, 20 bp, Artificial Sequence
  chemically synthesized
aacaccctctggaattcagt

SEQ ID NO: 192444 - DNA, 20 bp, Artificial Sequence
  chemically synthesized
agaagttacttactgaattc

SEQ ID NO: 192445 - DNA, 20 bp, Artificial Sequence
  chemically synthesized
aagttacttactgaattcca

SEQ ID NO: 192446 - DNA, 20 bp, Artificial Sequence
  chemically synthesized
atggaacaccctctggaatt

SEQ ID NO: 192447 - DNA, 20 bp, Artificial Sequence
  chemically synthesized
agttacttactgaattccag

SEQ ID NO: 192448 - DNA, 20 bp, Artificial Sequence
  chemically synthesized
gttacttactgaattccaga

SEQ ID NO: 192449 - DNA, 20 bp, Artificial Sequence
  chemically synthesized
gtataatatggaacaccctc

SEQ ID NO: 192450 - DNA, 20 bp, Artificial Sequence
  chemically synthesized
ttcactaccacagtataata

SEQ ID NO: 192451 - DNA, 20 bp, Artificial Sequence
  chemically synthesized
gggtgttccatattatactg

SEQ ID NO: 192452 - DNA, 20 bp, Artificial Sequence
  chemically synthesized
tgttccatattatactgtgg

SEQ ID NO: 192453 - DNA, 20 bp, Artificial Sequence
  chemically synthesized
cactgccacgttcactacca

SEQ ID NO: 192454 - DNA, 20 bp, Artificial Sequence
  chemically synthesized
ttatactgtggtagtgaacg

SEQ ID NO: 192455 - DNA, 20 bp, Artificial Sequence
  chemically synthesized
tactgtggtagtgaacgtgg

SEQ ID NO: 192456 - DNA, 20 bp, Artificial Sequence
  chemically synthesized
tgtggtagtgaacgtggcag

SEQ ID NO: 192457 - DNA, 20 bp, Artificial Sequence
  chemically synthesized
agtgaacgtggcagtggttg

SEQ ID NO: 192458 - DNA, 20 bp, Artificial Sequence
  chemically synthesized
gaacgtggcagtggttgaag

SEQ ID NO: 192459 - DNA, 20 bp, Artificial Sequence
  chemically synthesized
aacgtggcagtggttgaagt

SEQ ID NO: 192460 - DNA, 20 bp, Artificial Sequence
  chemically synthesized
cagtggttgaagtgggttct

SEQ ID NO: 192461 - DNA, 20 bp, Artificial Sequence
  chemically synthesized
tggttgaagtgggttcttag

SEQ ID NO: 192462 - DNA, 20 bp, Artificial Sequence
  chemically synthesized
agaaccacttttcatccact

SEQ ID NO: 192463 - DNA, 20 bp, Artificial Sequence
  chemically synthesized
gtgggttcttagtggatgaa

SEQ ID NO: 192464 - DNA, 20 bp, Artificial Sequence
  chemically synthesized
ggttcttagtggatgaaaag

SEQ ID NO: 192465 - DNA, 20 bp, Artificial Sequence
  chemically synthesized
gtggatgaaaagtggttctg

SEQ ID NO: 192466 - DNA, 20 bp, Artificial Sequence
  chemically synthesized
atatgatccctaaacgactt

SEQ ID NO: 192467 - DNA, 20 bp, Artificial Sequence
  chemically synthesized
aaagtggttctgaagtcgtt

SEQ ID NO: 192468 - DNA, 20 bp, Artificial Sequence
  chemically synthesized
aagtggttctgaagtcgttt

SEQ ID NO: 192469 - DNA, 20 bp, Artificial Sequence
  chemically synthesized
agtggttctgaagtcgttta

SEQ ID NO: 192470 - DNA, 20 bp, Artificial Sequence
  chemically synthesized
gaagtcgtttagggatcata

SEQ ID NO: 192471 - DNA, 20 bp, Artificial Sequence
  chemically synthesized
aagtcgtttagggatcatat

SEQ ID NO: 192472 - DNA, 20 bp, Artificial Sequence
  chemically synthesized
tgaagctatcatggtaattt

SEQ ID NO: 192473 - DNA, 20 bp, Artificial Sequence
  chemically synthesized
atgggctaaaattaccatga

SEQ ID NO: 192474 - DNA, 20 bp, Artificial Sequence
  chemically synthesized
tgttgctaatgaagctatca

SEQ ID NO: 192475 - DNA, 20 bp, Artificial Sequence
  chemically synthesized
aattaccatgatagcttcat

SEQ ID NO: 192476 - DNA, 20 bp, Artificial Sequence
  chemically synthesized
ttcaggtggtgttgctaatg

SEQ ID NO: 192477 - DNA, 20 bp, Artificial Sequence
  chemically synthesized
ttcattagcaacaccacctg

SEQ ID NO: 192478 - DNA, 20 bp, Artificial Sequence
  chemically synthesized
attagcaacaccacctgaag

SEQ ID NO: 192479 - DNA, 20 bp, Artificial Sequence
  chemically synthesized
gagacagtttctacttcagg

SEQ ID NO: 192480 - DNA, 20 bp, Artificial Sequence
  chemically synthesized
acagagacagtttctacttc

SEQ ID NO: 192481 - DNA, 20 bp, Artificial Sequence
  chemically synthesized
tacagagacagtttctactt

SEQ ID NO: 192482 - DNA, 20 bp, Artificial Sequence
  chemically synthesized
tgagtgaaattatacagaga

SEQ ID NO: 192483 - DNA, 20 bp, Artificial Sequence
  chemically synthesized
gttctgagtgaaattataca

SEQ ID NO: 192484 - DNA, 20 bp, Artificial Sequence
  chemically synthesized
tggttctgagtgaaattata

SEQ ID NO: 192485 - DNA, 20 bp, Artificial Sequence
  chemically synthesized
tgtctctgtataatttcact

SEQ ID NO: 192486 - DNA, 20 bp, Artificial Sequence
  chemically synthesized
gtataatttcactcagaacc

SEQ ID NO: 192487 - DNA, 20 bp, Artificial Sequence
  chemically synthesized
ttgaaaagtaacttggttct

SEQ ID NO: 192488 - DNA, 20 bp, Artificial Sequence
  chemically synthesized
agaccagttgaaaagtaact

SEQ ID NO: 192489 - DNA, 20 bp, Artificial Sequence
  chemically synthesized
gaaccaagttacttttcaac

SEQ ID NO: 192490 - DNA, 20 bp, Artificial Sequence
  chemically synthesized
ctggggagagaccagttgaa

SEQ ID NO: 192491 - DNA, 20 bp, Artificial Sequence
  chemically synthesized
aacacatcctggggagagac

SEQ ID NO: 192492 - DNA, 20 bp, Artificial Sequence
  chemically synthesized
cttttcaactggtctctccc

SEQ ID NO: 192493 - DNA, 20 bp, Artificial Sequence
  chemically synthesized
ttttcaactggtctctcccc

SEQ ID NO: 192494 - DNA, 20 bp, Artificial Sequence
  chemically synthesized
ataggaacacatcctgggga

SEQ ID NO: 192495 - DNA, 20 bp, Artificial Sequence
  chemically synthesized
taataggaacacatcctggg

SEQ ID NO: 192496 - DNA, 20 bp, Artificial Sequence
  chemically synthesized
gctaataggaacacatcctg

SEQ ID NO: 192497 - DNA, 20 bp, Artificial Sequence
  chemically synthesized
agctaataggaacacatcct

SEQ ID NO: 192498 - DNA, 20 bp, Artificial Sequence
  chemically synthesized
cagctaataggaacacatcc

SEQ ID NO: 192499 - DNA, 20 bp, Artificial Sequence
  chemically synthesized
tccccaggatgtgttcctat

SEQ ID NO: 192500 - DNA, 20 bp, Artificial Sequence
  chemically synthesized
tgtaagaatttgcagctaat

SEQ ID NO: 192501 - DNA, 20 bp, Artificial Sequence
  chemically synthesized
ttgtaagaatttgcagctaa

SEQ ID NO: 192502 - DNA, 20 bp, Artificial Sequence
  chemically synthesized
aaggttgttgtaagaatttg

SEQ ID NO: 192503 - DNA, 20 bp, Artificial Sequence
  chemically synthesized
attagccataaggttgttgt

SEQ ID NO: 192504 - DNA, 20 bp, Artificial Sequence
  chemically synthesized
aaattcttacaacaacctta

SEQ ID NO: 192505 - DNA, 20 bp, Artificial Sequence
  chemically synthesized
ctgaatcctcattagccata

SEQ ID NO: 192506 - DNA, 20 bp, Artificial Sequence
  chemically synthesized
tctgaatcctcattagccat

SEQ ID NO: 192507 - DNA, 20 bp, Artificial Sequence
  chemically synthesized
acaacaaccttatggctaat

SEQ ID NO: 192508 - DNA, 20 bp, Artificial Sequence
  chemically synthesized
caacaaccttatggctaatg

SEQ ID NO: 192509 - DNA, 20 bp, Artificial Sequence
  chemically synthesized
tctggattctgaatcctcat

SEQ ID NO: 192510 - DNA, 20 bp, Artificial Sequence
  chemically synthesized
ccttatggctaatgaggatt

SEQ ID NO: 192511 - DNA, 20 bp, Artificial Sequence
  chemically synthesized
gctaatgaggattcagaatc

SEQ ID NO: 192512 - DNA, 20 bp, Artificial Sequence
  chemically synthesized
gaggattcagaatccagaaa

SEQ ID NO: 192513 - DNA, 20 bp, Artificial Sequence
  chemically synthesized
ggattcagaatccagaaatg

SEQ ID NO: 192514 - DNA, 20 bp, Artificial Sequence
  chemically synthesized
aggaacaaattctccatttc

SEQ ID NO: 192515 - DNA, 20 bp, Artificial Sequence
  chemically synthesized
atggagaatttgttcctctg

SEQ ID NO: 192516 - DNA, 20 bp, Artificial Sequence
  chemically synthesized
agaatttgttcctctgaaga

SEQ ID NO: 192517 - DNA, 20 bp, Artificial Sequence
  chemically synthesized
aaaattctaactttcttcag

SEQ ID NO: 192518 - DNA, 20 bp, Artificial Sequence
  chemically synthesized
taaaattctaactttcttca

SEQ ID NO: 192519 - DNA, 20 bp, Artificial Sequence
  chemically synthesized
tttaaaattctaactttctt

SEQ ID NO: 192520 - DNA, 20 bp, Artificial Sequence
  chemically synthesized
tttgttcctctgaagaaagt

SEQ ID NO: 192521 - DNA, 20 bp, Artificial Sequence
  chemically synthesized
taaataaatactgcaacttc

SEQ ID NO: 192522 - DNA, 20 bp, Artificial Sequence
  chemically synthesized
tgagaagtctccagaagttg

SEQ ID NO: 192523 - DNA, 20 bp, Artificial Sequence
  chemically synthesized
aataaatactgcaacttctg

SEQ ID NO: 192524 - DNA, 20 bp, Artificial Sequence
  chemically synthesized
ttaaattgagaagtctccag

SEQ ID NO: 192525 - DNA, 20 bp, Artificial Sequence
  chemically synthesized
acattaaattgagaagtctc

SEQ ID NO: 192526 - DNA, 20 bp, Artificial Sequence
  chemically synthesized
tggagtcacattaaattgag

SEQ ID NO: 192527 - DNA, 20 bp, Artificial Sequence
  chemically synthesized
ctatggagtcacattaaatt

SEQ ID NO: 192528 - DNA, 20 bp, Artificial Sequence
  chemically synthesized
ctcaatttaatgtgactcca

SEQ ID NO: 192529 - DNA, 20 bp, Artificial Sequence
  chemically synthesized
tggtcactatgatcactatg

SEQ ID NO: 192530 - DNA, 20 bp, Artificial Sequence
  chemically synthesized
tgtggtcactatgatcacta

SEQ ID NO: 192531 - DNA, 20 bp, Artificial Sequence
  chemically synthesized
atgtgactccatagtgatca

SEQ ID NO: 192532 - DNA, 20 bp, Artificial Sequence
  chemically synthesized
tagtgatcatagtgaccaca

SEQ ID NO: 192533 - DNA, 20 bp, Artificial Sequence
  chemically synthesized
agtgatcatagtgaccacat

SEQ ID NO: 192534 - DNA, 20 bp, Artificial Sequence
  chemically synthesized
ttgaagaggtttcacccatg

SEQ ID NO: 192535 - DNA, 20 bp, Artificial Sequence
  chemically synthesized
ttttatttatcaatttgaag

SEQ ID NO: 192536 - DNA, 20 bp, Artificial Sequence
  chemically synthesized
attttatttatcaatttgaa

SEQ ID NO: 192537 - DNA, 20 bp, Artificial Sequence
  chemically synthesized
ccattttatttatcaatttg

SEQ ID NO: 192538 - DNA, 20 bp, Artificial Sequence
  chemically synthesized
cttcaaattgataaataaaa

SEQ ID NO: 192539 - DNA, 20 bp, Artificial Sequence
  chemically synthesized
gattgtccaagatacacaat

SEQ ID NO: 192540 - DNA, 20 bp, Artificial Sequence
  chemically synthesized
gaatttccaattgtgtatct

SEQ ID NO: 192541 - DNA, 20 bp, Artificial Sequence
  chemically synthesized
taattgtgcatggattgtcc

SEQ ID NO: 192542 - DNA, 20 bp, Artificial Sequence
  chemically synthesized
catctgtttctaattgtgca

SEQ ID NO: 192543 - DNA, 20 bp, Artificial Sequence
  chemically synthesized
ttggacaatccatgcacaat

SEQ ID NO: 192544 - DNA, 20 bp, Artificial Sequence
  chemically synthesized
aatccatgcacaattagaaa

SEQ ID NO: 192545 - DNA, 20 bp, Artificial Sequence
  chemically synthesized
attagaaacagatgtaacaa

SEQ ID NO: 192546 - DNA, 20 bp, Artificial Sequence
  chemically synthesized
aacagatgtaacaatggctt

SEQ ID NO: 192547 - DNA, 20 bp, Artificial Sequence
  chemically synthesized
gtttatccgtcatgcatcta

SEQ ID NO: 192548 - DNA, 20 bp, Artificial Sequence
  chemically synthesized
caatggctttagatgcatga

SEQ ID NO: 192549 - DNA, 20 bp, Artificial Sequence
  chemically synthesized
atgcatgacggataaactat

SEQ ID NO: 192550 - DNA, 20 bp, Artificial Sequence
  chemically synthesized
tgcatgacggataaactata

SEQ ID NO: 192551 - DNA, 20 bp, Artificial Sequence
  chemically synthesized
gcatgacggataaactataa

SEQ ID NO: 192552 - DNA, 20 bp, Artificial Sequence
  chemically synthesized
ctatgcaactgtggccctta

SEQ ID NO: 192553 - DNA, 20 bp, Artificial Sequence
  chemically synthesized
cggataaactataagggcca

SEQ ID NO: 192554 - DNA, 20 bp, Artificial Sequence
  chemically synthesized
gtcagagtactatgcaactg

SEQ ID NO: 192555 - DNA, 20 bp, Artificial Sequence
  chemically synthesized
ctataagggccacagttgca

SEQ ID NO: 192556 - DNA, 20 bp, Artificial Sequence
  chemically synthesized
aatgtacacttatagagtca

SEQ ID NO: 192557 - DNA, 20 bp, Artificial Sequence
  chemically synthesized
gcatagtactctgactctat

SEQ ID NO: 192558 - DNA, 20 bp, Artificial Sequence
  chemically synthesized
aaaatgtacacttatagagt

SEQ ID NO: 192559 - DNA, 20 bp, Artificial Sequence
  chemically synthesized
gtttaaaatgtacacttata

SEQ ID NO: 192560 - DNA, 20 bp, Artificial Sequence
  chemically synthesized
gtgtttaaaatgtacactta

SEQ ID NO: 192561 - DNA, 20 bp, Artificial Sequence
  chemically synthesized
tatgttttagaaggcattga

SEQ ID NO: 192562 - DNA, 20 bp, Artificial Sequence
  chemically synthesized
ttatgttttagaaggcattg

SEQ ID NO: 192563 - DNA, 20 bp, Artificial Sequence
  chemically synthesized
ttttgttcttatgttttaga

SEQ ID NO: 192564 - DNA, 20 bp, Artificial Sequence
  chemically synthesized
tttttgttcttatgttttag

SEQ ID NO: 192565 - DNA, 20 bp, Artificial Sequence
  chemically synthesized
ttcaatgccttctaaaacat

SEQ ID NO: 192566 - DNA, 20 bp, Artificial Sequence
  chemically synthesized
caatttttgttcttatgttt

SEQ ID NO: 192567 - DNA, 20 bp, Artificial Sequence
  chemically synthesized
cataagaacaaaaattgttc

SEQ ID NO: 192568 - DNA, 20 bp, Artificial Sequence
  chemically synthesized
gtagaagtcatcaaagttac

SEQ ID NO: 192569 - DNA, 20 bp, Artificial Sequence
  chemically synthesized
cgattaagtagaagtcatca

SEQ ID NO: 192570 - DNA, 20 bp, Artificial Sequence
  chemically synthesized
gaaagacaacgattaagtag

SEQ ID NO: 192571 - DNA, 20 bp, Artificial Sequence
  chemically synthesized
tgagaaagacaacgattaag

SEQ ID NO: 192572 - DNA, 20 bp, Artificial Sequence
  chemically synthesized
ttctgagaaagacaacgatt

SEQ ID NO: 192573 - DNA, 20 bp, Artificial Sequence
  chemically synthesized
tacttaatcgttgtctttct

SEQ ID NO: 192574 - DNA, 20 bp, Artificial Sequence
  chemically synthesized
tcaacctatttgttctgaga

SEQ ID NO: 192575 - DNA, 20 bp, Artificial Sequence
  chemically synthesized
atgttcaacctatttgttct

SEQ ID NO: 192576 - DNA, 20 bp, Artificial Sequence
  chemically synthesized
gttgtctttctcagaacaaa

SEQ ID NO: 192577 - DNA, 20 bp, Artificial Sequence
  chemically synthesized
ttgtctttctcagaacaaat

SEQ ID NO: 192578 - DNA, 20 bp, Artificial Sequence
  chemically synthesized
attttaacaaaattatcaaa

SEQ ID NO: 192579 - DNA, 20 bp, Artificial Sequence
  chemically synthesized
taaaatgttcaaataaaaaa

SEQ ID NO: 192580 - DNA, 20 bp, Artificial Sequence
  chemically synthesized
aataaaaaacagtgatttat

SEQ ID NO: 192581 - DNA, 20 bp, Artificial Sequence
  chemically synthesized
ataaaaaacagtgatttatt

SEQ ID NO: 192582 - DNA, 20 bp, Artificial Sequence
  chemically synthesized
ataaataggcaattttcgat

SEQ ID NO: 192583 - DNA, 20 bp, Artificial Sequence
  chemically synthesized
cataaataggcaattttcga

SEQ ID NO: 192584 - DNA, 20 bp, Artificial Sequence
  chemically synthesized
tgcttattgtatacataaat

SEQ ID NO: 192585 - DNA, 20 bp, Artificial Sequence
  chemically synthesized
atgcttattgtatacataaa

SEQ ID NO: 192586 - DNA, 20 bp, Artificial Sequence
  chemically synthesized
tgcctatttatgtatacaat

SEQ ID NO: 192587 - DNA, 20 bp, Artificial Sequence
  chemically synthesized
tttatgtatacaataagcat

SEQ ID NO: 192588 - DNA, 20 bp, Artificial Sequence
  chemically synthesized
caataagcatgagaaatcca

SEQ ID NO: 192589 - DNA, 20 bp, Artificial Sequence
  chemically synthesized
aataagcatgagaaatccaa

SEQ ID NO: 192590 - DNA, 20 bp, Artificial Sequence
  chemically synthesized
agcatgagaaatccaaagga

SEQ ID NO: 192591 - DNA, 20 bp, Artificial Sequence
  chemically synthesized
aatttcatgaagctttcctt

SEQ ID NO: 192592 - DNA, 20 bp, Artificial Sequence
  chemically synthesized
gcatttaaggtaatttcatg

SEQ ID NO: 192593 - DNA, 20 bp, Artificial Sequence
  chemically synthesized
catgaaattaccttaaatgc

SEQ ID NO: 192594 - DNA, 20 bp, Artificial Sequence
  chemically synthesized
aggttaaaaactagcattta

SEQ ID NO: 192595 - DNA, 20 bp, Artificial Sequence
  chemically synthesized
gaggttaaaaactagcattt

SEQ ID NO: 192596 - DNA, 20 bp, Artificial Sequence
  chemically synthesized
attcaaaggaggttaaaaac

SEQ ID NO: 192597 - DNA, 20 bp, Artificial Sequence
  chemically synthesized
cacattggctcattcaaagg

SEQ ID NO: 192598 - DNA, 20 bp, Artificial Sequence
  chemically synthesized
acacattggctcattcaaag

SEQ ID NO: 192599 - DNA, 20 bp, Artificial Sequence
  chemically synthesized
gtttttaacctcctttgaat

SEQ ID NO: 192600 - DNA, 20 bp, Artificial Sequence
  chemically synthesized
acacacattggctcattcaa

SEQ ID NO: 192601 - DNA, 20 bp, Artificial Sequence
  chemically synthesized
aacacacattggctcattca

SEQ ID NO: 192602 - DNA, 20 bp, Artificial Sequence
  chemically synthesized
cttctcaagggaacacacat

SEQ ID NO: 192603 - DNA, 20 bp, Artificial Sequence
  chemically synthesized
gagccaatgtgtgttccctt

SEQ ID NO: 192604 - DNA, 20 bp, Artificial Sequence
  chemically synthesized
ccaatgtgtgttcccttgag

SEQ ID NO: 192605 - DNA, 20 bp, Artificial Sequence
  chemically synthesized
caatgtgtgttcccttgaga

SEQ ID NO: 192606 - DNA, 20 bp, Artificial Sequence
  chemically synthesized
tgagaaagtttccttctcaa

SEQ ID NO: 192607 - DNA, 20 bp, Artificial Sequence
  chemically synthesized
ctgagaaagtttccttctca

SEQ ID NO: 192608 - DNA, 20 bp, Artificial Sequence
  chemically synthesized
cctgagaaagtttccttctc

SEQ ID NO: 192609 - DNA, 20 bp, Artificial Sequence
  chemically synthesized
ccttgagaaggaaactttct

SEQ ID NO: 192610 - DNA, 20 bp, Artificial Sequence
  chemically synthesized
cttgagaaggaaactttctc

SEQ ID NO: 192611 - DNA, 20 bp, Artificial Sequence
  chemically synthesized
aaatagtcacagacctgaga

SEQ ID NO: 192612 - DNA, 20 bp, Artificial Sequence
  chemically synthesized
ctttaaatagtcacagacct

SEQ ID NO: 192613 - DNA, 20 bp, Artificial Sequence
  chemically synthesized
ataaatcctttaaatagtca

SEQ ID NO: 192614 - DNA, 20 bp, Artificial Sequence
  chemically synthesized
ctcaggtctgtgactattta

SEQ ID NO: 192615 - DNA, 20 bp, Artificial Sequence
  chemically synthesized
tcaggtctgtgactatttaa

SEQ ID NO: 192616 - DNA, 20 bp, Artificial Sequence
  chemically synthesized
agaaaaataaatcctttaaa

SEQ ID NO: 192617 - DNA, 20 bp, Artificial Sequence
  chemically synthesized
aggatttatttttctattgt

SEQ ID NO: 192618 - DNA, 20 bp, Artificial Sequence
  chemically synthesized
tgtgaaaagaaaacttacaa

SEQ ID NO: 192619 - DNA, 20 bp, Artificial Sequence
  chemically synthesized
ggtcactggtgttatgtgaa

SEQ ID NO: 192620 - DNA, 20 bp, Artificial Sequence
  chemically synthesized
gttttcttttcacataacac

SEQ ID NO: 192621 - DNA, 20 bp, Artificial Sequence
  chemically synthesized
tcacataacaccagtgaccc

SEQ ID NO: 192622 - DNA, 20 bp, Artificial Sequence
  chemically synthesized
tttactatcaccagggtcac

SEQ ID NO: 192623 - DNA, 20 bp, Artificial Sequence
  chemically synthesized
aacaccagtgaccctggtga

SEQ ID NO: 192624 - DNA, 20 bp, Artificial Sequence
  chemically synthesized
ctaaagctttactatcacca

SEQ ID NO: 192625 - DNA, 20 bp, Artificial Sequence
  chemically synthesized
gctaaagctttactatcacc

SEQ ID NO: 192626 - DNA, 20 bp, Artificial Sequence
  chemically synthesized
tgctaaagctttactatcac

SEQ ID NO: 192627 - DNA, 20 bp, Artificial Sequence
  chemically synthesized
cagtgaccctggtgatagta

SEQ ID NO: 192628 - DNA, 20 bp, Artificial Sequence
  chemically synthesized
ccctggtgatagtaaagctt

SEQ ID NO: 192629 - DNA, 20 bp, Artificial Sequence
  chemically synthesized
gatagtaaagctttagcact

SEQ ID NO: 192630 - DNA, 20 bp, Artificial Sequence
  chemically synthesized
aggagtttaaccaagtgcta

SEQ ID NO: 192631 - DNA, 20 bp, Artificial Sequence
  chemically synthesized
tataacgcaggagtttaacc

SEQ ID NO: 192632 - DNA, 20 bp, Artificial Sequence
  chemically synthesized
tatgatacattataacgcag

SEQ ID NO: 192633 - DNA, 20 bp, Artificial Sequence
  chemically synthesized
aatatgatacattataacgc

SEQ ID NO: 192634 - DNA, 20 bp, Artificial Sequence
  chemically synthesized
taatatgatacattataacg

SEQ ID NO: 192635 - DNA, 20 bp, Artificial Sequence
  chemically synthesized
tatcatattatcatattgta

SEQ ID NO: 192636 - DNA, 20 bp, Artificial Sequence
  chemically synthesized
catattatcatattgtatag

SEQ ID NO: 192637 - DNA, 20 bp, Artificial Sequence
  chemically synthesized
tgtatagaagctgtactttc

SEQ ID NO: 192638 - DNA, 20 bp, Artificial Sequence
  chemically synthesized
gactatcccactggaaagta

SEQ ID NO: 192639 - DNA, 20 bp, Artificial Sequence
  chemically synthesized
atagaagctgtactttccag

SEQ ID NO: 192640 - DNA, 20 bp, Artificial Sequence
  chemically synthesized
tagaagctgtactttccagt

SEQ ID NO: 192641 - DNA, 20 bp, Artificial Sequence
  chemically synthesized
ctaatgactatcccactgga

SEQ ID NO: 192642 - DNA, 20 bp, Artificial Sequence
  chemically synthesized
agctgtactttccagtggga

SEQ ID NO: 192643 - DNA, 20 bp, Artificial Sequence
  chemically synthesized
gtggctaatgactatcccac

SEQ ID NO: 192644 - DNA, 20 bp, Artificial Sequence
  chemically synthesized
ctttccagtgggatagtcat

SEQ ID NO: 192645 - DNA, 20 bp, Artificial Sequence
  chemically synthesized
ggatagtcattagccacatg

SEQ ID NO: 192646 - DNA, 20 bp, Artificial Sequence
  chemically synthesized
taaatttatatagccacatg

SEQ ID NO: 192647 - DNA, 20 bp, Artificial Sequence
  chemically synthesized
tcaattaatttaaatttata

SEQ ID NO: 192648 - DNA, 20 bp, Artificial Sequence
  chemically synthesized
aaattaattgaaattaaata

SEQ ID NO: 192649 - DNA, 20 bp, Artificial Sequence
  chemically synthesized
attaaataaagttaaaactt

SEQ ID NO: 192650 - DNA, 20 bp, Artificial Sequence
  chemically synthesized
ttagtgggaatgaagaactg

SEQ ID NO: 192651 - DNA, 20 bp, Artificial Sequence
  chemically synthesized
aaatgtgcttagtgggaatg

SEQ ID NO: 192652 - DNA, 20 bp, Artificial Sequence
  chemically synthesized
ttcagttcttcattcccact

SEQ ID NO: 192653 - DNA, 20 bp, Artificial Sequence
  chemically synthesized
gaacttgaaatgtgcttagt

SEQ ID NO: 192654 - DNA, 20 bp, Artificial Sequence
  chemically synthesized
agaacttgaaatgtgcttag

SEQ ID NO: 192655 - DNA, 20 bp, Artificial Sequence
  chemically synthesized
ttgagaacttgaaatgtgct

SEQ ID NO: 192656 - DNA, 20 bp, Artificial Sequence
  chemically synthesized
attcccactaagcacatttc

SEQ ID NO: 192657 - DNA, 20 bp, Artificial Sequence
  chemically synthesized
agcacatttcaagttctcaa

SEQ ID NO: 192658 - DNA, 20 bp, Artificial Sequence
  chemically synthesized
tgcagtataatgtggccatt

SEQ ID NO: 192659 - DNA, 20 bp, Artificial Sequence
  chemically synthesized
gttagaaatgcagtataatg

SEQ ID NO: 192660 - DNA, 20 bp, Artificial Sequence
  chemically synthesized
attcttcaatgttagaaatg

SEQ ID NO: 192661 - DNA, 20 bp, Artificial Sequence
  chemically synthesized
atactgcatttctaacattg

SEQ ID NO: 192662 - DNA, 20 bp, Artificial Sequence
  chemically synthesized
tatagaacattcttcaatgt

SEQ ID NO: 192663 - DNA, 20 bp, Artificial Sequence
  chemically synthesized
aacattgaagaatgttctat

SEQ ID NO: 192664 - DNA, 20 bp, Artificial Sequence
  chemically synthesized
ttgaagaatgttctataaga

SEQ ID NO: 192665 - DNA, 20 bp, Artificial Sequence
  chemically synthesized
tgaagaatgttctataagat

SEQ ID NO: 192666 - DNA, 20 bp, Artificial Sequence
  chemically synthesized
gaagaatgttctataagata

SEQ ID NO: 192667 - DNA, 20 bp, Artificial Sequence
  chemically synthesized
tctctatcacccctatctta

SEQ ID NO: 192668 - DNA, 20 bp, Artificial Sequence
  chemically synthesized
aagaatgttctataagatag

SEQ ID NO: 192669 - DNA, 20 bp, Artificial Sequence
  chemically synthesized
gttctataagataggggtga

SEQ ID NO: 192670 - DNA, 20 bp, Artificial Sequence
  chemically synthesized
tctataagataggggtgata

SEQ ID NO: 192671 - DNA, 20 bp, Artificial Sequence
  chemically synthesized
tataagataggggtgataga

SEQ ID NO: 192672 - DNA, 20 bp, Artificial Sequence
  chemically synthesized
agataggggtgatagagaga

SEQ ID NO: 192673 - DNA, 20 bp, Artificial Sequence
  chemically synthesized
agtggcagagatagacaaag

SEQ ID NO: 192674 - DNA, 20 bp, Artificial Sequence
  chemically synthesized
actagtggcagagatagaca

SEQ ID NO: 192675 - DNA, 20 bp, Artificial Sequence
  chemically synthesized
ggataaactagtggcagaga

SEQ ID NO: 192676 - DNA, 20 bp, Artificial Sequence
  chemically synthesized
tctttgtctatctctgccac

SEQ ID NO: 192677 - DNA, 20 bp, Artificial Sequence
  chemically synthesized
ccagggataaactagtggca

SEQ ID NO: 192678 - DNA, 20 bp, Artificial Sequence
  chemically synthesized
caccagggataaactagtgg

SEQ ID NO: 192679 - DNA, 20 bp, Artificial Sequence
  chemically synthesized
cctcaccagggataaactag

SEQ ID NO: 192680 - DNA, 20 bp, Artificial Sequence
  chemically synthesized
cctcctcaccagggataaac

SEQ ID NO: 192681 - DNA, 20 bp, Artificial Sequence
  chemically synthesized
ctctgccactagtttatccc

SEQ ID NO: 192682 - DNA, 20 bp, Artificial Sequence
  chemically synthesized
gccactagtttatccctggt

SEQ ID NO: 192683 - DNA, 20 bp, Artificial Sequence
  chemically synthesized
ccactagtttatccctggtg

SEQ ID NO: 192684 - DNA, 20 bp, Artificial Sequence
  chemically synthesized
actagtttatccctggtgag

SEQ ID NO: 192685 - DNA, 20 bp, Artificial Sequence
  chemically synthesized
aacccctgccctcctcacca

SEQ ID NO: 192686 - DNA, 20 bp, Artificial Sequence
  chemically synthesized
ctagtttatccctggtgagg

SEQ ID NO: 192687 - DNA, 20 bp, Artificial Sequence
  chemically synthesized
caacccctgccctcctcacc

SEQ ID NO: 192688 - DNA, 20 bp, Artificial Sequence
  chemically synthesized
tagtttatccctggtgagga

SEQ ID NO: 192689 - DNA, 20 bp, Artificial Sequence
  chemically synthesized
tcaacccctgccctcctcac

SEQ ID NO: 192690 - DNA, 20 bp, Artificial Sequence
  chemically synthesized
tttatccctggtgaggaggg

SEQ ID NO: 192691 - DNA, 20 bp, Artificial Sequence
  chemically synthesized
ttatccctggtgaggagggc

SEQ ID NO: 192692 - DNA, 20 bp, Artificial Sequence
  chemically synthesized
tatccctggtgaggagggca

SEQ ID NO: 192693 - DNA, 20 bp, Artificial Sequence
  chemically synthesized
atccctggtgaggagggcag

SEQ ID NO: 192694 - DNA, 20 bp, Artificial Sequence
  chemically synthesized
tggtgaggagggcaggggtt

SEQ ID NO: 192695 - DNA, 20 bp, Artificial Sequence
  chemically synthesized
agggcaggggttgagcataa

SEQ ID NO: 192696 - DNA, 20 bp, Artificial Sequence
  chemically synthesized
gggcaggggttgagcataat

SEQ ID NO: 192697 - DNA, 20 bp, Artificial Sequence
  chemically synthesized
gcataatgggttgcatacaa

SEQ ID NO: 192698 - DNA, 20 bp, Artificial Sequence
  chemically synthesized
cataatgggttgcatacaac

SEQ ID NO: 192699 - DNA, 20 bp, Artificial Sequence
  chemically synthesized
tgcatacaacgggcacatat

SEQ ID NO: 192700 - DNA, 20 bp, Artificial Sequence
  chemically synthesized
catataagtgctcaaaaata

SEQ ID NO: 192701 - DNA, 20 bp, Artificial Sequence
  chemically synthesized
cattggttcactgtattttt

SEQ ID NO: 192702 - DNA, 20 bp, Artificial Sequence
  chemically synthesized
taataacaagatttattcat

SEQ ID NO: 192703 - DNA, 20 bp, Artificial Sequence
  chemically synthesized
gtgtcagtggtaataataac

SEQ ID NO: 192704 - DNA, 20 bp, Artificial Sequence
  chemically synthesized
ttaatgtatggcagtgtcag

SEQ ID NO: 192705 - DNA, 20 bp, Artificial Sequence
  chemically synthesized
tatttaatgtatggcagtgt

SEQ ID NO: 192706 - DNA, 20 bp, Artificial Sequence
  chemically synthesized
gaaaggtatttaatgtatgg

SEQ ID NO: 192707 - DNA, 20 bp, Artificial Sequence
  chemically synthesized
tctgaaaggtatttaatgta

SEQ ID NO: 192708 - DNA, 20 bp, Artificial Sequence
  chemically synthesized
gccatacattaaataccttt

SEQ ID NO: 192709 - DNA, 20 bp, Artificial Sequence
  chemically synthesized
aaaagcacttttaatctgaa

SEQ ID NO: 192710 - DNA, 20 bp, Artificial Sequence
  chemically synthesized
taaaagcacttttaatctga

SEQ ID NO: 192711 - DNA, 20 bp, Artificial Sequence
  chemically synthesized
ttaaatacctttcagattaa

SEQ ID NO: 192712 - DNA, 20 bp, Artificial Sequence
  chemically synthesized
tggaaaccactgataggtaa

SEQ ID NO: 192713 - DNA, 20 bp, Artificial Sequence
  chemically synthesized
ttaaaagtgcttttacctat

SEQ ID NO: 192714 - DNA, 20 bp, Artificial Sequence
  chemically synthesized
aaagtgcttttacctatcag

SEQ ID NO: 192715 - DNA, 20 bp, Artificial Sequence
  chemically synthesized
agcccctggaaaccactgat

SEQ ID NO: 192716 - DNA, 20 bp, Artificial Sequence
  chemically synthesized
cagcccctggaaaccactga

SEQ ID NO: 192717 - DNA, 20 bp, Artificial Sequence
  chemically synthesized
ttttacctatcagtggtttc

SEQ ID NO: 192718 - DNA, 20 bp, Artificial Sequence
  chemically synthesized
tttacctatcagtggtttcc

SEQ ID NO: 192719 - DNA, 20 bp, Artificial Sequence
  chemically synthesized
ttacctatcagtggtttcca

SEQ ID NO: 192720 - DNA, 20 bp, Artificial Sequence
  chemically synthesized
tacctatcagtggtttccag

SEQ ID NO: 192721 - DNA, 20 bp, Artificial Sequence
  chemically synthesized
tatcagtggtttccaggggc

SEQ ID NO: 192722 - DNA, 20 bp, Artificial Sequence
  chemically synthesized
atcagtggtttccaggggct

SEQ ID NO: 192723 - DNA, 20 bp, Artificial Sequence
  chemically synthesized
tcagtggtttccaggggctg

SEQ ID NO: 192724 - DNA, 20 bp, Artificial Sequence
  chemically synthesized
tcctgccccaccccagcccc

SEQ ID NO: 192725 - DNA, 20 bp, Artificial Sequence
  chemically synthesized
gtggtttccaggggctgggg

SEQ ID NO: 192726 - DNA, 20 bp, Artificial Sequence
  chemically synthesized
tggtttccaggggctggggt

SEQ ID NO: 192727 - DNA, 20 bp, Artificial Sequence
  chemically synthesized
ggtttccaggggctggggtg

SEQ ID NO: 192728 - DNA, 20 bp, Artificial Sequence
  chemically synthesized
gtcagtctcctgccccaccc

SEQ ID NO: 192729 - DNA, 20 bp, Artificial Sequence
  chemically synthesized
ttccaggggctggggtgggg

SEQ ID NO: 192730 - DNA, 20 bp, Artificial Sequence
  chemically synthesized
tccaggggctggggtggggc

SEQ ID NO: 192731 - DNA, 20 bp, Artificial Sequence
  chemically synthesized
caggggctggggtggggcag

SEQ ID NO: 192732 - DNA, 20 bp, Artificial Sequence
  chemically synthesized
gggcaggagactgactgcaa

SEQ ID NO: 192733 - DNA, 20 bp, Artificial Sequence
  chemically synthesized
ccttgtactcccgttgcagt

SEQ ID NO: 192734 - DNA, 20 bp, Artificial Sequence
  chemically synthesized
ggcaggagactgactgcaac

SEQ ID NO: 192735 - DNA, 20 bp, Artificial Sequence
  chemically synthesized
caggagactgactgcaacgg

SEQ ID NO: 192736 - DNA, 20 bp, Artificial Sequence
  chemically synthesized
gtttccttgtactcccgttg

SEQ ID NO: 192737 - DNA, 20 bp, Artificial Sequence
  chemically synthesized
actgactgcaacgggagtac

SEQ ID NO: 192738 - DNA, 20 bp, Artificial Sequence
  chemically synthesized
ctgactgcaacgggagtaca

SEQ ID NO: 192739 - DNA, 20 bp, Artificial Sequence
  chemically synthesized
gagtacaaggaaactttttg

SEQ ID NO: 192740 - DNA, 20 bp, Artificial Sequence
  chemically synthesized
aatatttttatcacttcaaa

SEQ ID NO: 192741 - DNA, 20 bp, Artificial Sequence
  chemically synthesized
accacgtccgtgatcagaat

SEQ ID NO: 192742 - DNA, 20 bp, Artificial Sequence
  chemically synthesized
aaccacgtccgtgatcagaa

SEQ ID NO: 192743 - DNA, 20 bp, Artificial Sequence
  chemically synthesized
aatatttcctattctgatca

SEQ ID NO: 192744 - DNA, 20 bp, Artificial Sequence
  chemically synthesized
cctacaaccacgtccgtgat

SEQ ID NO: 192745 - DNA, 20 bp, Artificial Sequence
  chemically synthesized
tcctattctgatcacggacg

SEQ ID NO: 192746 - DNA, 20 bp, Artificial Sequence
  chemically synthesized
tctgatcacggacgtggttg

SEQ ID NO: 192747 - DNA, 20 bp, Artificial Sequence
  chemically synthesized
ctgatcacggacgtggttgt

SEQ ID NO: 192748 - DNA, 20 bp, Artificial Sequence
  chemically synthesized
tgagttttgacaaacatatg

SEQ ID NO: 192749 - DNA, 20 bp, Artificial Sequence
  chemically synthesized
tttaaagtgtacagtttgat

SEQ ID NO: 192750 - DNA, 20 bp, Artificial Sequence
  chemically synthesized
aatcgcctttttaaagtgta

SEQ ID NO: 192751 - DNA, 20 bp, Artificial Sequence
  chemically synthesized
atcaaactgtacactttaaa

SEQ ID NO: 192752 - DNA, 20 bp, Artificial Sequence
  chemically synthesized
tcaaactgtacactttaaaa

SEQ ID NO: 192753 - DNA, 20 bp, Artificial Sequence
  chemically synthesized
acaaaaaaatcgccttttta

SEQ ID NO: 192754 - DNA, 20 bp, Artificial Sequence
  chemically synthesized
aattcctttttgttttattg

SEQ ID NO: 192755 - DNA, 20 bp, Artificial Sequence
  chemically synthesized
caattcctttttgttttatt

SEQ ID NO: 192756 - DNA, 20 bp, Artificial Sequence
  chemically synthesized
ttatacctcaataaaacaaa

SEQ ID NO: 192757 - DNA, 20 bp, Artificial Sequence
  chemically synthesized
tatacctcaataaaacaaaa

SEQ ID NO: 192758 - DNA, 20 bp, Artificial Sequence
  chemically synthesized
tcaataaaacaaaaaggaat

SEQ ID NO: 192759 - DNA, 20 bp, Artificial Sequence
  chemically synthesized
taaaacaaaaaggaattgga

SEQ ID NO: 192760 - DNA, 20 bp, Artificial Sequence
  chemically synthesized
aaacaaaaaggaattggaaa

SEQ ID NO: 192761 - DNA, 20 bp, Artificial Sequence
  chemically synthesized
acaaaaaggaattggaaaga

SEQ ID NO: 192762 - DNA, 20 bp, Artificial Sequence
  chemically synthesized
aaaggaattggaaagagaga

SEQ ID NO: 192763 - DNA, 20 bp, Artificial Sequence
  chemically synthesized
ggaattggaaagagagaaag

SEQ ID NO: 192764 - DNA, 20 bp, Artificial Sequence
  chemically synthesized
gaattggaaagagagaaagt

SEQ ID NO: 192765 - DNA, 20 bp, Artificial Sequence
  chemically synthesized
aaattttaaaatgcaaataa

SEQ ID NO: 192766 - DNA, 20 bp, Artificial Sequence
  chemically synthesized
aaaatttcatccttgacttt

SEQ ID NO: 192767 - DNA, 20 bp, Artificial Sequence
  chemically synthesized
tttagtcactctaaaagtca

SEQ ID NO: 192768 - DNA, 20 bp, Artificial Sequence
  chemically synthesized
gtttagtcactctaaaagtc

SEQ ID NO: 192769 - DNA, 20 bp, Artificial Sequence
  chemically synthesized
aatttcatccttgactttta

SEQ ID NO: 192770 - DNA, 20 bp, Artificial Sequence
  chemically synthesized
atctggtttagtcactctaa

SEQ ID NO: 192771 - DNA, 20 bp, Artificial Sequence
  chemically synthesized
gacttttagagtgactaaac

SEQ ID NO: 192772 - DNA, 20 bp, Artificial Sequence
  chemically synthesized
tcggtagtaatcatctggtt

SEQ ID NO: 192773 - DNA, 20 bp, Artificial Sequence
  chemically synthesized
gtttctcggtagtaatcatc

SEQ ID NO: 192774 - DNA, 20 bp, Artificial Sequence
  chemically synthesized
taaaccagatgattactacc

SEQ ID NO: 192775 - DNA, 20 bp, Artificial Sequence
  chemically synthesized
tttttattgttgtttctcgg

SEQ ID NO: 192776 - DNA, 20 bp, Artificial Sequence
  chemically synthesized
atatttttattgttgtttct

SEQ ID NO: 192777 - DNA, 20 bp, Artificial Sequence
  chemically synthesized
gaaacaacaataaaaatatt

SEQ ID NO: 192778 - DNA, 20 bp, Artificial Sequence
  chemically synthesized
aataaaaatatttagaaatg

SEQ ID NO: 192779 - DNA, 20 bp, Artificial Sequence
  chemically synthesized
ataaaaatatttagaaatgt

SEQ ID NO: 192780 - DNA, 20 bp, Artificial Sequence
  chemically synthesized
ttagaaatgtaggatgcatc

SEQ ID NO: 192781 - DNA, 20 bp, Artificial Sequence
  chemically synthesized
aggatgcatcaagtgtgctt

SEQ ID NO: 192782 - DNA, 20 bp, Artificial Sequence
  chemically synthesized
cctaagttgcttgacatcca

SEQ ID NO: 192783 - DNA, 20 bp, Artificial Sequence
  chemically synthesized
tcaagtgtgctttggatgtc

SEQ ID NO: 192784 - DNA, 20 bp, Artificial Sequence
  chemically synthesized
gctttggatgtcaagcaact

SEQ ID NO: 192785 - DNA, 20 bp, Artificial Sequence
  chemically synthesized
ctttggatgtcaagcaactt

SEQ ID NO: 192786 - DNA, 20 bp, Artificial Sequence
  chemically synthesized
tttggatgtcaagcaactta

SEQ ID NO: 192787 - DNA, 20 bp, Artificial Sequence
  chemically synthesized
ttggatgtcaagcaacttag

SEQ ID NO: 192788 - DNA, 20 bp, Artificial Sequence
  chemically synthesized
tgtcaagcaacttaggggca

SEQ ID NO: 192789 - DNA, 20 bp, Artificial Sequence
  chemically synthesized
ttttagaaatctgtgcccct

SEQ ID NO: 192790 - DNA, 20 bp, Artificial Sequence
  chemically synthesized
atgttaacccaagacaattt

SEQ ID NO: 192791 - DNA, 20 bp, Artificial Sequence
  chemically synthesized
acagatttctaaaattgtct

SEQ ID NO: 192792 - DNA, 20 bp, Artificial Sequence
  chemically synthesized
cagatttctaaaattgtctt

SEQ ID NO: 192793 - DNA, 20 bp, Artificial Sequence
  chemically synthesized
cctgagcagtatgttaaccc

SEQ ID NO: 192794 - DNA, 20 bp, Artificial Sequence
  chemically synthesized
tcttgggttaacatactgct

SEQ ID NO: 192795 - DNA, 20 bp, Artificial Sequence
  chemically synthesized
cttgggttaacatactgctc

SEQ ID NO: 192796 - DNA, 20 bp, Artificial Sequence
  chemically synthesized
ttgggttaacatactgctca

SEQ ID NO: 192797 - DNA, 20 bp, Artificial Sequence
  chemically synthesized
ggttaacatactgctcaggg

SEQ ID NO: 192798 - DNA, 20 bp, Artificial Sequence
  chemically synthesized
ccgctagcgtcttccctgag

SEQ ID NO: 192799 - DNA, 20 bp, Artificial Sequence
  chemically synthesized
gacccgctagcgtcttccct

SEQ ID NO: 192800 - DNA, 20 bp, Artificial Sequence
  chemically synthesized
atactgctcagggaagacgc

SEQ ID NO: 192801 - DNA, 20 bp, Artificial Sequence
  chemically synthesized
ctgctcagggaagacgctag

SEQ ID NO: 192802 - DNA, 20 bp, Artificial Sequence
  chemically synthesized
tgctcagggaagacgctagc

SEQ ID NO: 192803 - DNA, 20 bp, Artificial Sequence
  chemically synthesized
gtcttcccagtgagacccgc

SEQ ID NO: 192804 - DNA, 20 bp, Artificial Sequence
  chemically synthesized
aagacgctagcgggtctcac

SEQ ID NO: 192805 - DNA, 20 bp, Artificial Sequence
  chemically synthesized
agacgctagcgggtctcact

SEQ ID NO: 192806 - DNA, 20 bp, Artificial Sequence
  chemically synthesized
cgctagcgggtctcactggg

SEQ ID NO: 192807 - DNA, 20 bp, Artificial Sequence
  chemically synthesized
aggggagaggtcttcccagt

SEQ ID NO: 192808 - DNA, 20 bp, Artificial Sequence
  chemically synthesized
ttggaggggagaggtcttcc

SEQ ID NO: 192809 - DNA, 20 bp, Artificial Sequence
  chemically synthesized
ggggtgagattggaggggag

SEQ ID NO: 192810 - DNA, 20 bp, Artificial Sequence
  chemically synthesized
gggggtgagattggagggga

SEQ ID NO: 192811 - DNA, 20 bp, Artificial Sequence
  chemically synthesized
gtgggggtgagattggaggg

SEQ ID NO: 192812 - DNA, 20 bp, Artificial Sequence
  chemically synthesized
gggtgggggtgagattggag

SEQ ID NO: 192813 - DNA, 20 bp, Artificial Sequence
  chemically synthesized
ggggtgggggtgagattgga

SEQ ID NO: 192814 - DNA, 20 bp, Artificial Sequence
  chemically synthesized
tggggtgggggtgagattgg

SEQ ID NO: 192815 - DNA, 20 bp, Artificial Sequence
  chemically synthesized
gtggggtgggggtgagattg

SEQ ID NO: 192816 - DNA, 20 bp, Artificial Sequence
  chemically synthesized
cagtggggtgggggtgagat

SEQ ID NO: 192817 - DNA, 20 bp, Artificial Sequence
  chemically synthesized
agaatcagtggggtgggggt

SEQ ID NO: 192818 - DNA, 20 bp, Artificial Sequence
  chemically synthesized
ttagagaatcagtggggtgg

SEQ ID NO: 192819 - DNA, 20 bp, Artificial Sequence
  chemically synthesized
attagagaatcagtggggtg

SEQ ID NO: 192820 - DNA, 20 bp, Artificial Sequence
  chemically synthesized
gattagagaatcagtggggt

SEQ ID NO: 192821 - DNA, 20 bp, Artificial Sequence
  chemically synthesized
tgattagagaatcagtgggg

SEQ ID NO: 192822 - DNA, 20 bp, Artificial Sequence
  chemically synthesized
aagtgattagagaatcagtg

SEQ ID NO: 192823 - DNA, 20 bp, Artificial Sequence
  chemically synthesized
aaagtgattagagaatcagt

SEQ ID NO: 192824 - DNA, 20 bp, Artificial Sequence
  chemically synthesized
aaaagtgattagagaatcag

SEQ ID NO: 192825 - DNA, 20 bp, Artificial Sequence
  chemically synthesized
atcaaaagtgattagagaat

SEQ ID NO: 192826 - DNA, 20 bp, Artificial Sequence
  chemically synthesized
ggtaaaatcaaaagtgatta

SEQ ID NO: 192827 - DNA, 20 bp, Artificial Sequence
  chemically synthesized
atggtaaaatcaaaagtgat

SEQ ID NO: 192828 - DNA, 20 bp, Artificial Sequence
  chemically synthesized
ggaacagatggtaaaatcaa

SEQ ID NO: 192829 - DNA, 20 bp, Artificial Sequence
  chemically synthesized
gttgtgccaggaggaacaga

SEQ ID NO: 192830 - DNA, 20 bp, Artificial Sequence
  chemically synthesized
attttaccatctgttcctcc

SEQ ID NO: 192831 - DNA, 20 bp, Artificial Sequence
  chemically synthesized
ctttgttgtgccaggaggaa

SEQ ID NO: 192832 - DNA, 20 bp, Artificial Sequence
  chemically synthesized
tgaacctttgttgtgccagg

SEQ ID NO: 192833 - DNA, 20 bp, Artificial Sequence
  chemically synthesized
ctgaacctttgttgtgccag

SEQ ID NO: 192834 - DNA, 20 bp, Artificial Sequence
  chemically synthesized
tgctgaacctttgttgtgcc

SEQ ID NO: 192835 - DNA, 20 bp, Artificial Sequence
  chemically synthesized
ttgctgaacctttgttgtgc

SEQ ID NO: 192836 - DNA, 20 bp, Artificial Sequence
  chemically synthesized
ctgttcctcctggcacaaca

SEQ ID NO: 192837 - DNA, 20 bp, Artificial Sequence
  chemically synthesized
tgttcctcctggcacaacaa

SEQ ID NO: 192838 - DNA, 20 bp, Artificial Sequence
  chemically synthesized
ctcctggcacaacaaaggtt

SEQ ID NO: 192839 - DNA, 20 bp, Artificial Sequence
  chemically synthesized
tggcacaacaaaggttcagc

SEQ ID NO: 192840 - DNA, 20 bp, Artificial Sequence
  chemically synthesized
caacaaaggttcagcaagaa

SEQ ID NO: 192841 - DNA, 20 bp, Artificial Sequence
  chemically synthesized
aggttcagcaagaaaagtga

SEQ ID NO: 192842 - DNA, 20 bp, Artificial Sequence
  chemically synthesized
cattgaagacaaggttgttg

SEQ ID NO: 192843 - DNA, 20 bp, Artificial Sequence
  chemically synthesized
caaaaatatcattgaagaca

SEQ ID NO: 192844 - DNA, 20 bp, Artificial Sequence
  chemically synthesized
tcaaaaatatcattgaagac

SEQ ID NO: 192845 - DNA, 20 bp, Artificial Sequence
  chemically synthesized
taatttcaaaaatatcattg

SEQ ID NO: 192846 - DNA, 20 bp, Artificial Sequence
  chemically synthesized
aatgatatttttgaaattat

SEQ ID NO: 192847 - DNA, 20 bp, Artificial Sequence
  chemically synthesized
tgatatttttgaaattattg

SEQ ID NO: 192848 - DNA, 20 bp, Artificial Sequence
  chemically synthesized
gatatttttgaaattattgg

SEQ ID NO: 192849 - DNA, 20 bp, Artificial Sequence
  chemically synthesized
attggaggtaaaaatcaaat

SEQ ID NO: 192850 - DNA, 20 bp, Artificial Sequence
  chemically synthesized
aataggcactcaataaatag

SEQ ID NO: 192851 - DNA, 20 bp, Artificial Sequence
  chemically synthesized
gatttaatccactatttatt

SEQ ID NO: 192852 - DNA, 20 bp, Artificial Sequence
  chemically synthesized
atgaataggcactcaataaa

SEQ ID NO: 192853 - DNA, 20 bp, Artificial Sequence
  chemically synthesized
ttattgagtgcctattcatg

SEQ ID NO: 192854 - DNA, 20 bp, Artificial Sequence
  chemically synthesized
tgaatttatacttcatgaat

SEQ ID NO: 192855 - DNA, 20 bp, Artificial Sequence
  chemically synthesized
atgaatttatacttcatgaa

SEQ ID NO: 192856 - DNA, 20 bp, Artificial Sequence
  chemically synthesized
attcatgaagtataaattca

SEQ ID NO: 192857 - DNA, 20 bp, Artificial Sequence
  chemically synthesized
gtataaattcatggctatac

SEQ ID NO: 192858 - DNA, 20 bp, Artificial Sequence
  chemically synthesized
gaaatcatgtcagactggta

SEQ ID NO: 192859 - DNA, 20 bp, Artificial Sequence
  chemically synthesized
ttagtgaaatcatgtcagac

SEQ ID NO: 192860 - DNA, 20 bp, Artificial Sequence
  chemically synthesized
taatattagtgaaatcatgt

SEQ ID NO: 192861 - DNA, 20 bp, Artificial Sequence
  chemically synthesized
gttttagattcatataatat

SEQ ID NO: 192862 - DNA, 20 bp, Artificial Sequence
  chemically synthesized
aatattatatgaatctaaaa

SEQ ID NO: 192863 - DNA, 20 bp, Artificial Sequence
  chemically synthesized
attatatgaatctaaaacag

SEQ ID NO: 192864 - DNA, 20 bp, Artificial Sequence
  chemically synthesized
cgtttttccggccactgttt

SEQ ID NO: 192865 - DNA, 20 bp, Artificial Sequence
  chemically synthesized
tatgaatctaaaacagtggc

SEQ ID NO: 192866 - DNA, 20 bp, Artificial Sequence
  chemically synthesized
gaattggtcacacgtttttc

SEQ ID NO: 192867 - DNA, 20 bp, Artificial Sequence
  chemically synthesized
tgcaatgtggaaatcagaat

SEQ ID NO: 192868 - DNA, 20 bp, Artificial Sequence
  chemically synthesized
cttttgtgcaatgtggaaat

SEQ ID NO: 192869 - DNA, 20 bp, Artificial Sequence
  chemically synthesized
ctgtcaacttttgtgcaatg

SEQ ID NO: 192870 - DNA, 20 bp, Artificial Sequence
  chemically synthesized
ctgatttccacattgcacaa

SEQ ID NO: 192871 - DNA, 20 bp, Artificial Sequence
  chemically synthesized
ccacattgcacaaaagttga

SEQ ID NO: 192872 - DNA, 20 bp, Artificial Sequence
  chemically synthesized
tcaaagtttctcagaacagt

SEQ ID NO: 192873 - DNA, 20 bp, Artificial Sequence
  chemically synthesized
agtgatgcactgactgttct

SEQ ID NO: 192874 - DNA, 20 bp, Artificial Sequence
  chemically synthesized
accctcaaagtttctcagaa

SEQ ID NO: 192875 - DNA, 20 bp, Artificial Sequence
  chemically synthesized
agttaaccctcaaagtttct

SEQ ID NO: 192876 - DNA, 20 bp, Artificial Sequence
  chemically synthesized
tgactgttctgagaaacttt

SEQ ID NO: 192877 - DNA, 20 bp, Artificial Sequence
  chemically synthesized
gactgttctgagaaactttg

SEQ ID NO: 192878 - DNA, 20 bp, Artificial Sequence
  chemically synthesized
actgttctgagaaactttga

SEQ ID NO: 192879 - DNA, 20 bp, Artificial Sequence
  chemically synthesized
taattcctagttaaccctca

SEQ ID NO: 192880 - DNA, 20 bp, Artificial Sequence
  chemically synthesized
gagaaactttgagggttaac

SEQ ID NO: 192881 - DNA, 20 bp, Artificial Sequence
  chemically synthesized
agaaactttgagggttaact

SEQ ID NO: 192882 - DNA, 20 bp, Artificial Sequence
  chemically synthesized
tttgagggttaactaggaat

SEQ ID NO: 192883 - DNA, 20 bp, Artificial Sequence
  chemically synthesized
ttgagggttaactaggaatt

SEQ ID NO: 192884 - DNA, 20 bp, Artificial Sequence
  chemically synthesized
gaaatcatgatcctaattcc

SEQ ID NO: 192885 - DNA, 20 bp, Artificial Sequence
  chemically synthesized
actttccagggaatgtgatc

SEQ ID NO: 192886 - DNA, 20 bp, Artificial Sequence
  chemically synthesized
gatttcttgatcacattccc

SEQ ID NO: 192887 - DNA, 20 bp, Artificial Sequence
  chemically synthesized
tcttgatcacattccctgga

SEQ ID NO: 192888 - DNA, 20 bp, Artificial Sequence
  chemically synthesized
atcacaaggtttactttcca

SEQ ID NO: 192889 - DNA, 20 bp, Artificial Sequence
  chemically synthesized
tatcacaaggtttactttcc

SEQ ID NO: 192890 - DNA, 20 bp, Artificial Sequence
  chemically synthesized
ctatcacaaggtttactttc

SEQ ID NO: 192891 - DNA, 20 bp, Artificial Sequence
  chemically synthesized
ctggaaagtaaaccttgtga

SEQ ID NO: 192892 - DNA, 20 bp, Artificial Sequence
  chemically synthesized
gcttggcatattctatcaca

SEQ ID NO: 192893 - DNA, 20 bp, Artificial Sequence
  chemically synthesized
tgcttggcatattctatcac

SEQ ID NO: 192894 - DNA, 20 bp, Artificial Sequence
  chemically synthesized
accttgtgatagaatatgcc

SEQ ID NO: 192895 - DNA, 20 bp, Artificial Sequence
  chemically synthesized
atagaatatgccaagcaatt

SEQ ID NO: 192896 - DNA, 20 bp, Artificial Sequence
  chemically synthesized
tttgcacataccaaattgct

SEQ ID NO: 192897 - DNA, 20 bp, Artificial Sequence
  chemically synthesized
caagcaatttggtatgtgca

SEQ ID NO: 192898 - DNA, 20 bp, Artificial Sequence
  chemically synthesized
tggtatgtgcaaagaaatgt

SEQ ID NO: 192899 - DNA, 20 bp, Artificial Sequence
  chemically synthesized
aagaaatgtaagatttctgt

SEQ ID NO: 192900 - DNA, 20 bp, Artificial Sequence
  chemically synthesized
acccagaaaggaacggctta

SEQ ID NO: 192901 - DNA, 20 bp, Artificial Sequence
  chemically synthesized
ctgctgcacccagaaaggaa

SEQ ID NO: 192902 - DNA, 20 bp, Artificial Sequence
  chemically synthesized
ttctgtaagccgttcctttc

SEQ ID NO: 192903 - DNA, 20 bp, Artificial Sequence
  chemically synthesized
tctgtaagccgttcctttct

SEQ ID NO: 192904 - DNA, 20 bp, Artificial Sequence
  chemically synthesized
agttcctgctgcacccagaa

SEQ ID NO: 192905 - DNA, 20 bp, Artificial Sequence
  chemically synthesized
aagttcctgctgcacccaga

SEQ ID NO: 192906 - DNA, 20 bp, Artificial Sequence
  chemically synthesized
aagccgttcctttctgggtg

SEQ ID NO: 192907 - DNA, 20 bp, Artificial Sequence
  chemically synthesized
ccgttcctttctgggtgcag

SEQ ID NO: 192908 - DNA, 20 bp, Artificial Sequence
  chemically synthesized
aatcaagttcctgctgcacc

SEQ ID NO: 192909 - DNA, 20 bp, Artificial Sequence
  chemically synthesized
cgttcctttctgggtgcagc

SEQ ID NO: 192910 - DNA, 20 bp, Artificial Sequence
  chemically synthesized
gggtgcagcaggaacttgat

SEQ ID NO: 192911 - DNA, 20 bp, Artificial Sequence
  chemically synthesized
ggtgcagcaggaacttgatt

SEQ ID NO: 192912 - DNA, 20 bp, Artificial Sequence
  chemically synthesized
gtgcagcaggaacttgattg

SEQ ID NO: 192913 - DNA, 20 bp, Artificial Sequence
  chemically synthesized
tctaatggaaatccccaatc

SEQ ID NO: 192914 - DNA, 20 bp, Artificial Sequence
  chemically synthesized
acttgattggggatttccat

SEQ ID NO: 192915 - DNA, 20 bp, Artificial Sequence
  chemically synthesized
tgagcaggagatttttctaa

SEQ ID NO: 192916 - DNA, 20 bp, Artificial Sequence
  chemically synthesized
ttgaccatcatgatgagcag

SEQ ID NO: 192917 - DNA, 20 bp, Artificial Sequence
  chemically synthesized
ctttgaccatcatgatgagc

SEQ ID NO: 192918 - DNA, 20 bp, Artificial Sequence
  chemically synthesized
gctttgaccatcatgatgag

SEQ ID NO: 192919 - DNA, 20 bp, Artificial Sequence
  chemically synthesized
aaatctcctgctcatcatga

SEQ ID NO: 192920 - DNA, 20 bp, Artificial Sequence
  chemically synthesized
caggctttgaccatcatgat

SEQ ID NO: 192921 - DNA, 20 bp, Artificial Sequence
  chemically synthesized
cctgctcatcatgatggtca

SEQ ID NO: 192922 - DNA, 20 bp, Artificial Sequence
  chemically synthesized
atgatggtcaaagcctgacc

SEQ ID NO: 192923 - DNA, 20 bp, Artificial Sequence
  chemically synthesized
gaagattaacaagctgggtc

SEQ ID NO: 192924 - DNA, 20 bp, Artificial Sequence
  chemically synthesized
tgaagattaacaagctgggt

SEQ ID NO: 192925 - DNA, 20 bp, Artificial Sequence
  chemically synthesized
gctctgaagattaacaagct

SEQ ID NO: 192926 - DNA, 20 bp, Artificial Sequence
  chemically synthesized
tgctctgaagattaacaagc

SEQ ID NO: 192927 - DNA, 20 bp, Artificial Sequence
  chemically synthesized
attctgctctgaagattaac

SEQ ID NO: 192928 - DNA, 20 bp, Artificial Sequence
  chemically synthesized
tgacccagcttgttaatctt

SEQ ID NO: 192929 - DNA, 20 bp, Artificial Sequence
  chemically synthesized
acccagcttgttaatcttca

SEQ ID NO: 192930 - DNA, 20 bp, Artificial Sequence
  chemically synthesized
cagcttgttaatcttcagag

SEQ ID NO: 192931 - DNA, 20 bp, Artificial Sequence
  chemically synthesized
gtgcgttgcattctgctctg

SEQ ID NO: 192932 - DNA, 20 bp, Artificial Sequence
  chemically synthesized
aagtaaaaggatagtgcaaa

SEQ ID NO: 192933 - DNA, 20 bp, Artificial Sequence
  chemically synthesized
aatttgtgaaagtaaaagga

SEQ ID NO: 192934 - DNA, 20 bp, Artificial Sequence
  chemically synthesized
ctggaatttgtgaaagtaaa

SEQ ID NO: 192935 - DNA, 20 bp, Artificial Sequence
  chemically synthesized
actggaatttgtgaaagtaa

SEQ ID NO: 192936 - DNA, 20 bp, Artificial Sequence
  chemically synthesized
acagcgactggaatttgtga

SEQ ID NO: 192937 - DNA, 20 bp, Artificial Sequence
  chemically synthesized
ccttttactttcacaaattc

SEQ ID NO: 192938 - DNA, 20 bp, Artificial Sequence
  chemically synthesized
accatagaggcaacagcgac

SEQ ID NO: 192939 - DNA, 20 bp, Artificial Sequence
  chemically synthesized
aaaagacaccatagaggcaa

SEQ ID NO: 192940 - DNA, 20 bp, Artificial Sequence
  chemically synthesized
tccagtcgctgttgcctcta

SEQ ID NO: 192941 - DNA, 20 bp, Artificial Sequence
  chemically synthesized
tgaattaaaagacaccatag

SEQ ID NO: 192942 - DNA, 20 bp, Artificial Sequence
  chemically synthesized
ttgaattaaaagacaccata

SEQ ID NO: 192943 - DNA, 20 bp, Artificial Sequence
  chemically synthesized
cattgaattaaaagacacca

SEQ ID NO: 192944 - DNA, 20 bp, Artificial Sequence
  chemically synthesized
aagtaatgacattgaattaa

SEQ ID NO: 192945 - DNA, 20 bp, Artificial Sequence
  chemically synthesized
caccatagagaacaaacacg

SEQ ID NO: 192946 - DNA, 20 bp, Artificial Sequence
  chemically synthesized
tacttcgtgtttgttctcta

SEQ ID NO: 192947 - DNA, 20 bp, Artificial Sequence
  chemically synthesized
ttgtaataaacatcaccata

SEQ ID NO: 192948 - DNA, 20 bp, Artificial Sequence
  chemically synthesized
ctttgtaataaacatcacca

SEQ ID NO: 192949 - DNA, 20 bp, Artificial Sequence
  chemically synthesized
ctatggtgatgtttattaca

SEQ ID NO: 192950 - DNA, 20 bp, Artificial Sequence
  chemically synthesized
atggtgatgtttattacaaa

SEQ ID NO: 192951 - DNA, 20 bp, Artificial Sequence
  chemically synthesized
tgtttattacaaagagcaca

SEQ ID NO: 192952 - DNA, 20 bp, Artificial Sequence
  chemically synthesized
gtttattacaaagagcacaa

SEQ ID NO: 192953 - DNA, 20 bp, Artificial Sequence
  chemically synthesized
tttattacaaagagcacaaa

SEQ ID NO: 192954 - DNA, 20 bp, Artificial Sequence
  chemically synthesized
agggaacaatttatgcacta

SEQ ID NO: 192955 - DNA, 20 bp, Artificial Sequence
  chemically synthesized
gggaacaatttatgcactaa

SEQ ID NO: 192956 - DNA, 20 bp, Artificial Sequence
  chemically synthesized
gataagcagagacatacctt

SEQ ID NO: 192957 - DNA, 20 bp, Artificial Sequence
  chemically synthesized
aaaggtatgtctctgcttat

SEQ ID NO: 192958 - DNA, 20 bp, Artificial Sequence
  chemically synthesized
gtaatttattctgataagca

SEQ ID NO: 192959 - DNA, 20 bp, Artificial Sequence
  chemically synthesized
gggtaatttattctgataag

SEQ ID NO: 192960 - DNA, 20 bp, Artificial Sequence
  chemically synthesized
tacgggtaatttattctgat

SEQ ID NO: 192961 - DNA, 20 bp, Artificial Sequence
  chemically synthesized
tcagaataaattacccgtat

SEQ ID NO: 192962 - DNA, 20 bp, Artificial Sequence
  chemically synthesized
atttttgcagacacttatac

SEQ ID NO: 192963 - DNA, 20 bp, Artificial Sequence
  chemically synthesized
tatttttgcagacacttata

SEQ ID NO: 192964 - DNA, 20 bp, Artificial Sequence
  chemically synthesized
agtagatgggattatttttg

SEQ ID NO: 192965 - DNA, 20 bp, Artificial Sequence
  chemically synthesized
attcaccaagaaaagtagat

SEQ ID NO: 192966 - DNA, 20 bp, Artificial Sequence
  chemically synthesized
tattcaccaagaaaagtaga

SEQ ID NO: 192967 - DNA, 20 bp, Artificial Sequence
  chemically synthesized
ataatcccatctacttttct

SEQ ID NO: 192968 - DNA, 20 bp, Artificial Sequence
  chemically synthesized
tcaatattcaccaagaaaag

SEQ ID NO: 192969 - DNA, 20 bp, Artificial Sequence
  chemically synthesized
tactcaatattcaccaagaa

SEQ ID NO: 192970 - DNA, 20 bp, Artificial Sequence
  chemically synthesized
cggtttactcaatattcacc

SEQ ID NO: 192971 - DNA, 20 bp, Artificial Sequence
  chemically synthesized
tacttttcttggtgaatatt

SEQ ID NO: 192972 - DNA, 20 bp, Artificial Sequence
  chemically synthesized
aatattgagtaaaccgttaa

SEQ ID NO: 192973 - DNA, 20 bp, Artificial Sequence
  chemically synthesized
atattgagtaaaccgttaac

SEQ ID NO: 192974 - DNA, 20 bp, Artificial Sequence
  chemically synthesized
tattgagtaaaccgttaaca

SEQ ID NO: 192975 - DNA, 20 bp, Artificial Sequence
  chemically synthesized
atgcttcactgccctgttaa

SEQ ID NO: 192976 - DNA, 20 bp, Artificial Sequence
  chemically synthesized
tgagtaaaccgttaacaggg

SEQ ID NO: 192977 - DNA, 20 bp, Artificial Sequence
  chemically synthesized
aaaccgttaacagggcagtg

SEQ ID NO: 192978 - DNA, 20 bp, Artificial Sequence
  chemically synthesized
aagcatttgattatcttctc

SEQ ID NO: 192979 - DNA, 20 bp, Artificial Sequence
  chemically synthesized
gcatttgattatcttctcaa

SEQ ID NO: 192980 - DNA, 20 bp, Artificial Sequence
  chemically synthesized
aaggtcttcattctcttgag

SEQ ID NO: 192981 - DNA, 20 bp, Artificial Sequence
  chemically synthesized
atgaaggtcttcattctctt

SEQ ID NO: 192982 - DNA, 20 bp, Artificial Sequence
  chemically synthesized
attatcttctcaagagaatg

SEQ ID NO: 192983 - DNA, 20 bp, Artificial Sequence
  chemically synthesized
caagagaatgaagaccttca

SEQ ID NO: 192984 - DNA, 20 bp, Artificial Sequence
  chemically synthesized
tagaaggaggatgaccatga

SEQ ID NO: 192985 - DNA, 20 bp, Artificial Sequence
  chemically synthesized
ctagaaggaggatgaccatg

SEQ ID NO: 192986 - DNA, 20 bp, Artificial Sequence
  chemically synthesized
cttcatggtcatcctccttc

SEQ ID NO: 192987 - DNA, 20 bp, Artificial Sequence
  chemically synthesized
ttcatggtcatcctccttct

SEQ ID NO: 192988 - DNA, 20 bp, Artificial Sequence
  chemically synthesized
tttctctcagtcctagaagg

SEQ ID NO: 192989 - DNA, 20 bp, Artificial Sequence
  chemically synthesized
atttctctcagtcctagaag

SEQ ID NO: 192990 - DNA, 20 bp, Artificial Sequence
  chemically synthesized
gcatttctctcagtcctaga

SEQ ID NO: 192991 - DNA, 20 bp, Artificial Sequence
  chemically synthesized
agcatttctctcagtcctag

SEQ ID NO: 192992 - DNA, 20 bp, Artificial Sequence
  chemically synthesized
gtcatcctccttctaggact

SEQ ID NO: 192993 - DNA, 20 bp, Artificial Sequence
  chemically synthesized
catcctccttctaggactga

SEQ ID NO: 192994 - DNA, 20 bp, Artificial Sequence
  chemically synthesized
attagcatttctctcagtcc

SEQ ID NO: 192995 - DNA, 20 bp, Artificial Sequence
  chemically synthesized
ggagaaattagcatttctct

SEQ ID NO: 192996 - DNA, 20 bp, Artificial Sequence
  chemically synthesized
taaccttggtgaggagaaat

SEQ ID NO: 192997 - DNA, 20 bp, Artificial Sequence
  chemically synthesized
aatgctaatttctcctcacc

SEQ ID NO: 192998 - DNA, 20 bp, Artificial Sequence
  chemically synthesized
atgctaatttctcctcacca

SEQ ID NO: 192999 - DNA, 20 bp, Artificial Sequence
  chemically synthesized
accttcataaccttggtgag

SEQ ID NO: 193000 - DNA, 20 bp, Artificial Sequence
  chemically synthesized
ctaccttcataaccttggtg

SEQ ID NO: 193001 - DNA, 20 bp, Artificial Sequence
  chemically synthesized
gctaccttcataaccttggt

SEQ ID NO: 193002 - DNA, 20 bp, Artificial Sequence
  chemically synthesized
atatgctaccttcataacct

SEQ ID NO: 193003 - DNA, 20 bp, Artificial Sequence
  chemically synthesized
ttctcctcaccaaggttatg

SEQ ID NO: 193004 - DNA, 20 bp, Artificial Sequence
  chemically synthesized
tctcctcaccaaggttatga

SEQ ID NO: 193005 - DNA, 20 bp, Artificial Sequence
  chemically synthesized
cctcaccaaggttatgaagg

SEQ ID NO: 193006 - DNA, 20 bp, Artificial Sequence
  chemically synthesized
tagcatatcatctttacacc

SEQ ID NO: 193007 - DNA, 20 bp, Artificial Sequence
  chemically synthesized
cttagctaatgctaggtgta

SEQ ID NO: 193008 - DNA, 20 bp, Artificial Sequence
  chemically synthesized
atcatctttacacctagcat

SEQ ID NO: 193009 - DNA, 20 bp, Artificial Sequence
  chemically synthesized
tgagaaacttagctaatgct

SEQ ID NO: 193010 - DNA, 20 bp, Artificial Sequence
  chemically synthesized
ttgagaaacttagctaatgc

SEQ ID NO: 193011 - DNA, 20 bp, Artificial Sequence
  chemically synthesized
ctttacacctagcattagct

SEQ ID NO: 193012 - DNA, 20 bp, Artificial Sequence
  chemically synthesized
aattttgagattgagaaact

SEQ ID NO: 193013 - DNA, 20 bp, Artificial Sequence
  chemically synthesized
acttcttcaattttgagatt

SEQ ID NO: 193014 - DNA, 20 bp, Artificial Sequence
  chemically synthesized
gtttctcaatctcaaaattg

SEQ ID NO: 193015 - DNA, 20 bp, Artificial Sequence
  chemically synthesized
tgaaacacttcttcaatttt

SEQ ID NO: 193016 - DNA, 20 bp, Artificial Sequence
  chemically synthesized
tctcaatctcaaaattgaag

SEQ ID NO: 193017 - DNA, 20 bp, Artificial Sequence
  chemically synthesized
tcaaaattgaagaagtgttt

SEQ ID NO: 193018 - DNA, 20 bp, Artificial Sequence
  chemically synthesized
aagaagtgtttcagtttgtt

SEQ ID NO: 193019 - DNA, 20 bp, Artificial Sequence
  chemically synthesized
gtttgttaagcccatgatga

SEQ ID NO: 193020 - DNA, 20 bp, Artificial Sequence
  chemically synthesized
aaaagacaagctttcatcat

SEQ ID NO: 193021 - DNA, 20 bp, Artificial Sequence
  chemically synthesized
aaaaagacaagctttcatca

SEQ ID NO: 193022 - DNA, 20 bp, Artificial Sequence
  chemically synthesized
agaatgtgagagaaaaagac

SEQ ID NO: 193023 - DNA, 20 bp, Artificial Sequence
  chemically synthesized
agactagaatgtgagagaaa

SEQ ID NO: 193024 - DNA, 20 bp, Artificial Sequence
  chemically synthesized
acttatagactagaatgtga

SEQ ID NO: 193025 - DNA, 20 bp, Artificial Sequence
  chemically synthesized
tgtctttttctctcacattc

SEQ ID NO: 193026 - DNA, 20 bp, Artificial Sequence
  chemically synthesized
ctacttatagactagaatgt

SEQ ID NO: 193027 - DNA, 20 bp, Artificial Sequence
  chemically synthesized
tctctcacattctagtctat

SEQ ID NO: 193028 - DNA, 20 bp, Artificial Sequence
  chemically synthesized
tagctgtgctacttatagac

SEQ ID NO: 193029 - DNA, 20 bp, Artificial Sequence
  chemically synthesized
ctcacattctagtctataag

SEQ ID NO: 193030 - DNA, 20 bp, Artificial Sequence
  chemically synthesized
agacatagctgtgctactta

SEQ ID NO: 193031 - DNA, 20 bp, Artificial Sequence
  chemically synthesized
attctagtctataagtagca

SEQ ID NO: 193032 - DNA, 20 bp, Artificial Sequence
  chemically synthesized
ataagtagcacagctatgtc

SEQ ID NO: 193033 - DNA, 20 bp, Artificial Sequence
  chemically synthesized
taagtagcacagctatgtct

SEQ ID NO: 193034 - DNA, 20 bp, Artificial Sequence
  chemically synthesized
aagtagcacagctatgtctg

SEQ ID NO: 193035 - DNA, 20 bp, Artificial Sequence
  chemically synthesized
aaaaactaagaccccagaca

SEQ ID NO: 193036 - DNA, 20 bp, Artificial Sequence
  chemically synthesized
cacagctatgtctggggtct

SEQ ID NO: 193037 - DNA, 20 bp, Artificial Sequence
  chemically synthesized
ctaaaaaaaaactaagaccc

SEQ ID NO: 193038 - DNA, 20 bp, Artificial Sequence
  chemically synthesized
ccttattctaaaaaaaaact

SEQ ID NO: 193039 - DNA, 20 bp, Artificial Sequence
  chemically synthesized
ctggggtcttagtttttttt

SEQ ID NO: 193040 - DNA, 20 bp, Artificial Sequence
  chemically synthesized
tcttagtttttttttagaat

SEQ ID NO: 193041 - DNA, 20 bp, Artificial Sequence
  chemically synthesized
cttagtttttttttagaata

SEQ ID NO: 193042 - DNA, 20 bp, Artificial Sequence
  chemically synthesized
tttttttagaataaggatga

SEQ ID NO: 193043 - DNA, 20 bp, Artificial Sequence
  chemically synthesized
gccctcatcgaagacagaca

SEQ ID NO: 193044 - DNA, 20 bp, Artificial Sequence
  chemically synthesized
aggccctcatcgaagacaga

SEQ ID NO: 193045 - DNA, 20 bp, Artificial Sequence
  chemically synthesized
gctcaggccctcatcgaaga

SEQ ID NO: 193046 - DNA, 20 bp, Artificial Sequence
  chemically synthesized
tagctctgtctgtcttcgat

SEQ ID NO: 193047 - DNA, 20 bp, Artificial Sequence
  chemically synthesized
agctctgtctgtcttcgatg

SEQ ID NO: 193048 - DNA, 20 bp, Artificial Sequence
  chemically synthesized
gctctgtctgtcttcgatga

SEQ ID NO: 193049 - DNA, 20 bp, Artificial Sequence
  chemically synthesized
tagagctcaggccctcatcg

SEQ ID NO: 193050 - DNA, 20 bp, Artificial Sequence
  chemically synthesized
tctgtcttcgatgagggcct

SEQ ID NO: 193051 - DNA, 20 bp, Artificial Sequence
  chemically synthesized
ttcgatgagggcctgagctc

SEQ ID NO: 193052 - DNA, 20 bp, Artificial Sequence
  chemically synthesized
tcgatgagggcctgagctct

SEQ ID NO: 193053 - DNA, 20 bp, Artificial Sequence
  chemically synthesized
tatccagaggcctagagctc

SEQ ID NO: 193054 - DNA, 20 bp, Artificial Sequence
  chemically synthesized
ctatccagaggcctagagct

SEQ ID NO: 193055 - DNA, 20 bp, Artificial Sequence
  chemically synthesized
tgtttctatccagaggccta

SEQ ID NO: 193056 - DNA, 20 bp, Artificial Sequence
  chemically synthesized
gggcctgagctctaggcctc

SEQ ID NO: 193057 - DNA, 20 bp, Artificial Sequence
  chemically synthesized
tctgtttctatccagaggcc

SEQ ID NO: 193058 - DNA, 20 bp, Artificial Sequence
  chemically synthesized
ctgagctctaggcctctgga

SEQ ID NO: 193059 - DNA, 20 bp, Artificial Sequence
  chemically synthesized
cctcttctgtttctatccag

SEQ ID NO: 193060 - DNA, 20 bp, Artificial Sequence
  chemically synthesized
acctcttctgtttctatcca

SEQ ID NO: 193061 - DNA, 20 bp, Artificial Sequence
  chemically synthesized
ttacctcttctgtttctatc

SEQ ID NO: 193062 - DNA, 20 bp, Artificial Sequence
  chemically synthesized
tctaggcctctggatagaaa

SEQ ID NO: 193063 - DNA, 20 bp, Artificial Sequence
  chemically synthesized
aggcctctggatagaaacag

SEQ ID NO: 193064 - DNA, 20 bp, Artificial Sequence
  chemically synthesized
gcctctggatagaaacagaa

SEQ ID NO: 193065 - DNA, 20 bp, Artificial Sequence
  chemically synthesized
cctctggatagaaacagaag

SEQ ID NO: 193066 - DNA, 20 bp, Artificial Sequence
  chemically synthesized
acattaattcacatgtagga

SEQ ID NO: 193067 - DNA, 20 bp, Artificial Sequence
  chemically synthesized
cctcacattaattcacatgt

SEQ ID NO: 193068 - DNA, 20 bp, Artificial Sequence
  chemically synthesized
tcctcacattaattcacatg

SEQ ID NO: 193069 - DNA, 20 bp, Artificial Sequence
  chemically synthesized
tcctacatgtgaattaatgt

SEQ ID NO: 193070 - DNA, 20 bp, Artificial Sequence
  chemically synthesized
cctacatgtgaattaatgtg

SEQ ID NO: 193071 - DNA, 20 bp, Artificial Sequence
  chemically synthesized
acatgtgaattaatgtgagg

SEQ ID NO: 193072 - DNA, 20 bp, Artificial Sequence
  chemically synthesized
catgtgaattaatgtgagga

SEQ ID NO: 193073 - DNA, 20 bp, Artificial Sequence
  chemically synthesized
aattaatgtgaggaaggaat

SEQ ID NO: 193074 - DNA, 20 bp, Artificial Sequence
  chemically synthesized
aatgtgaggaaggaatgaga

SEQ ID NO: 193075 - DNA, 20 bp, Artificial Sequence
  chemically synthesized
gtgaggaaggaatgagaaag

SEQ ID NO: 193076 - DNA, 20 bp, Artificial Sequence
  chemically synthesized
ggaatgagaaagcagatata

SEQ ID NO: 193077 - DNA, 20 bp, Artificial Sequence
  chemically synthesized
gaaagcagatataaagtacc

SEQ ID NO: 193078 - DNA, 20 bp, Artificial Sequence
  chemically synthesized
atattatgatcatagtgact

SEQ ID NO: 193079 - DNA, 20 bp, Artificial Sequence
  chemically synthesized
tatattatgatcatagtgac

SEQ ID NO: 193080 - DNA, 20 bp, Artificial Sequence
  chemically synthesized
taaattgtatattatgatca

SEQ ID NO: 193081 - DNA, 20 bp, Artificial Sequence
  chemically synthesized
gatcataatatacaatttat

SEQ ID NO: 193082 - DNA, 20 bp, Artificial Sequence
  chemically synthesized
ataatatacaatttataagt

SEQ ID NO: 193083 - DNA, 20 bp, Artificial Sequence
  chemically synthesized
aatatacaatttataagtga

SEQ ID NO: 193084 - DNA, 20 bp, Artificial Sequence
  chemically synthesized
ataagtgagagctccgatat

SEQ ID NO: 193085 - DNA, 20 bp, Artificial Sequence
  chemically synthesized
taacaatattactgatatcg

SEQ ID NO: 193086 - DNA, 20 bp, Artificial Sequence
  chemically synthesized
agtaacaatattactgatat

SEQ ID NO: 193087 - DNA, 20 bp, Artificial Sequence
  chemically synthesized
gatatcagtaatattgttac

SEQ ID NO: 193088 - DNA, 20 bp, Artificial Sequence
  chemically synthesized
tgaaagacagcgagttatac

SEQ ID NO: 193089 - DNA, 20 bp, Artificial Sequence
  chemically synthesized
taaaccagttgaaagacagc

SEQ ID NO: 193090 - DNA, 20 bp, Artificial Sequence
  chemically synthesized
tgaataaaccagttgaaaga

SEQ ID NO: 193091 - DNA, 20 bp, Artificial Sequence
  chemically synthesized
ataactcgctgtctttcaac

SEQ ID NO: 193092 - DNA, 20 bp, Artificial Sequence
  chemically synthesized
taaatgaataaaccagttga

SEQ ID NO: 193093 - DNA, 20 bp, Artificial Sequence
  chemically synthesized
agaaagctaaatgaataaac

SEQ ID NO: 193094 - DNA, 20 bp, Artificial Sequence
  chemically synthesized
tttcaactggtttattcatt

SEQ ID NO: 193095 - DNA, 20 bp, Artificial Sequence
  chemically synthesized
gcttaccatatatatggaga

SEQ ID NO: 193096 - DNA, 20 bp, Artificial Sequence
  chemically synthesized
tggggcttaccatatatatg

SEQ ID NO: 193097 - DNA, 20 bp, Artificial Sequence
  chemically synthesized
tttagctttctccatatata

SEQ ID NO: 193098 - DNA, 20 bp, Artificial Sequence
  chemically synthesized
tttggggcttaccatatata

SEQ ID NO: 193099 - DNA, 20 bp, Artificial Sequence
  chemically synthesized
gctttctccatatatatggt

SEQ ID NO: 193100 - DNA, 20 bp, Artificial Sequence
  chemically synthesized
catatatatggtaagcccca

SEQ ID NO: 193101 - DNA, 20 bp, Artificial Sequence
  chemically synthesized
gagaacaaaaaaatgctttg

SEQ ID NO: 193102 - DNA, 20 bp, Artificial Sequence
  chemically synthesized
ggagaacaaaaaaatgcttt

SEQ ID NO: 193103 - DNA, 20 bp, Artificial Sequence
  chemically synthesized
aggagaacaaaaaaatgctt

SEQ ID NO: 193104 - DNA, 20 bp, Artificial Sequence
  chemically synthesized
cagaaaggcttgagaaagag

SEQ ID NO: 193105 - DNA, 20 bp, Artificial Sequence
  chemically synthesized
tttttgttctcctctttctc

SEQ ID NO: 193106 - DNA, 20 bp, Artificial Sequence
  chemically synthesized
accagaaaggcttgagaaag

SEQ ID NO: 193107 - DNA, 20 bp, Artificial Sequence
  chemically synthesized
gaccagaaaggcttgagaaa

SEQ ID NO: 193108 - DNA, 20 bp, Artificial Sequence
  chemically synthesized
aggaccagaaaggcttgaga

SEQ ID NO: 193109 - DNA, 20 bp, Artificial Sequence
  chemically synthesized
ccataggaccagaaaggctt

SEQ ID NO: 193110 - DNA, 20 bp, Artificial Sequence
  chemically synthesized
tcctctttctcaagcctttc

SEQ ID NO: 193111 - DNA, 20 bp, Artificial Sequence
  chemically synthesized
cactttccataggaccagaa

SEQ ID NO: 193112 - DNA, 20 bp, Artificial Sequence
  chemically synthesized
acactttccataggaccaga

SEQ ID NO: 193113 - DNA, 20 bp, Artificial Sequence
  chemically synthesized
ctcaagcctttctggtccta

SEQ ID NO: 193114 - DNA, 20 bp, Artificial Sequence
  chemically synthesized
tccaacactttccataggac

SEQ ID NO: 193115 - DNA, 20 bp, Artificial Sequence
  chemically synthesized
agcctttctggtcctatgga

SEQ ID NO: 193116 - DNA, 20 bp, Artificial Sequence
  chemically synthesized
taaactccaacactttccat

SEQ ID NO: 193117 - DNA, 20 bp, Artificial Sequence
  chemically synthesized
ataaactccaacactttcca

SEQ ID NO: 193118 - DNA, 20 bp, Artificial Sequence
  chemically synthesized
tctggtcctatggaaagtgt

SEQ ID NO: 193119 - DNA, 20 bp, Artificial Sequence
  chemically synthesized
tggtcctatggaaagtgttg

SEQ ID NO: 193120 - DNA, 20 bp, Artificial Sequence
  chemically synthesized
agtgttggagtttattgcta

SEQ ID NO: 193121 - DNA, 20 bp, Artificial Sequence
  chemically synthesized
aactaaagaaataatttctg

SEQ ID NO: 193122 - DNA, 20 bp, Artificial Sequence
  chemically synthesized
tgctacagaaattatttctt

SEQ ID NO: 193123 - DNA, 20 bp, Artificial Sequence
  chemically synthesized
ctatggatcacaataaacta

SEQ ID NO: 193124 - DNA, 20 bp, Artificial Sequence
  chemically synthesized
ctttagtttattgtgatcca

SEQ ID NO: 193125 - DNA, 20 bp, Artificial Sequence
  chemically synthesized
gtttattgtgatccatagtt

SEQ ID NO: 193126 - DNA, 20 bp, Artificial Sequence
  chemically synthesized
tagacttaacttccaaacta

SEQ ID NO: 193127 - DNA, 20 bp, Artificial Sequence
  chemically synthesized
tattgtgatccatagtttgg

SEQ ID NO: 193128 - DNA, 20 bp, Artificial Sequence
  chemically synthesized
tgatccatagtttggaagtt

SEQ ID NO: 193129 - DNA, 20 bp, Artificial Sequence
  chemically synthesized
ggaagttaagtctattttta

SEQ ID NO: 193130 - DNA, 20 bp, Artificial Sequence
  chemically synthesized
gagaaaaacagctataaaaa

SEQ ID NO: 193131 - DNA, 20 bp, Artificial Sequence
  chemically synthesized
tatgctctgaaggagaaaaa

SEQ ID NO: 193132 - DNA, 20 bp, Artificial Sequence
  chemically synthesized
ttatagctgtttttctcctt

SEQ ID NO: 193133 - DNA, 20 bp, Artificial Sequence
  chemically synthesized
atagctgtttttctccttca

SEQ ID NO: 193134 - DNA, 20 bp, Artificial Sequence
  chemically synthesized
attgaaaatatgctctgaag

SEQ ID NO: 193135 - DNA, 20 bp, Artificial Sequence
  chemically synthesized
aaattgaaaatatgctctga

SEQ ID NO: 193136 - DNA, 20 bp, Artificial Sequence
  chemically synthesized
taaattgaaaatatgctctg

SEQ ID NO: 193137 - DNA, 20 bp, Artificial Sequence
  chemically synthesized
agcatattttcaatttaact

SEQ ID NO: 193138 - DNA, 20 bp, Artificial Sequence
  chemically synthesized
tttcaatttaacttagcaaa

SEQ ID NO: 193139 - DNA, 20 bp, Artificial Sequence
  chemically synthesized
ttcaatttaacttagcaaac

SEQ ID NO: 193140 - DNA, 20 bp, Artificial Sequence
  chemically synthesized
aaaaacagtgcctgtttgct

SEQ ID NO: 193141 - DNA, 20 bp, Artificial Sequence
  chemically synthesized
ctttgttttggaattaaaaa

SEQ ID NO: 193142 - DNA, 20 bp, Artificial Sequence
  chemically synthesized
ctgtttttaattccaaaaca

SEQ ID NO: 193143 - DNA, 20 bp, Artificial Sequence
  chemically synthesized
gtttatgcattactttgttt

SEQ ID NO: 193144 - DNA, 20 bp, Artificial Sequence
  chemically synthesized
taaacaaaaactctaacccc

SEQ ID NO: 193145 - DNA, 20 bp, Artificial Sequence
  chemically synthesized
tcaagaacctcttggggtta

SEQ ID NO: 193146 - DNA, 20 bp, Artificial Sequence
  chemically synthesized
aacaaaaactctaaccccaa

SEQ ID NO: 193147 - DNA, 20 bp, Artificial Sequence
  chemically synthesized
aatcaagaacctcttggggt

SEQ ID NO: 193148 - DNA, 20 bp, Artificial Sequence
  chemically synthesized
acaaaaactctaaccccaag

SEQ ID NO: 193149 - DNA, 20 bp, Artificial Sequence
  chemically synthesized
gctaaatcaagaacctcttg

SEQ ID NO: 193150 - DNA, 20 bp, Artificial Sequence
  chemically synthesized
agctaaatcaagaacctctt

SEQ ID NO: 193151 - DNA, 20 bp, Artificial Sequence
  chemically synthesized
gagctaaatcaagaacctct

SEQ ID NO: 193152 - DNA, 20 bp, Artificial Sequence
  chemically synthesized
accccaagaggttcttgatt

SEQ ID NO: 193153 - DNA, 20 bp, Artificial Sequence
  chemically synthesized
cacagtagcagagctaaatc

SEQ ID NO: 193154 - DNA, 20 bp, Artificial Sequence
  chemically synthesized
gttgaggatacacagtagca

SEQ ID NO: 193155 - DNA, 20 bp, Artificial Sequence
  chemically synthesized
tggttgaggatacacagtag

SEQ ID NO: 193156 - DNA, 20 bp, Artificial Sequence
  chemically synthesized
atctggttgaggatacacag

SEQ ID NO: 193157 - DNA, 20 bp, Artificial Sequence
  chemically synthesized
actatctggttgaggataca

SEQ ID NO: 193158 - DNA, 20 bp, Artificial Sequence
  chemically synthesized
tgctactgtgtatcctcaac

SEQ ID NO: 193159 - DNA, 20 bp, Artificial Sequence
  chemically synthesized
taaatttaactatctggttg

SEQ ID NO: 193160 - DNA, 20 bp, Artificial Sequence
  chemically synthesized
actgtgtatcctcaaccaga

SEQ ID NO: 193161 - DNA, 20 bp, Artificial Sequence
  chemically synthesized
ttaaatttaactatctggtt

SEQ ID NO: 193162 - DNA, 20 bp, Artificial Sequence
  chemically synthesized
atttcttaaatttaactatc

SEQ ID NO: 193163 - DNA, 20 bp, Artificial Sequence
  chemically synthesized
tcaaccagatagttaaattt

SEQ ID NO: 193164 - DNA, 20 bp, Artificial Sequence
  chemically synthesized
agatagttaaatttaagaaa

SEQ ID NO: 193165 - DNA, 20 bp, Artificial Sequence
  chemically synthesized
acctagcagacaaagacatt

SEQ ID NO: 193166 - DNA, 20 bp, Artificial Sequence
  chemically synthesized
aacttaatgtctttgtctgc

SEQ ID NO: 193167 - DNA, 20 bp, Artificial Sequence
  chemically synthesized
actgcttcacctagcagaca

SEQ ID NO: 193168 - DNA, 20 bp, Artificial Sequence
  chemically synthesized
acttaatgtctttgtctgct

SEQ ID NO: 193169 - DNA, 20 bp, Artificial Sequence
  chemically synthesized
atgtctttgtctgctaggtg

SEQ ID NO: 193170 - DNA, 20 bp, Artificial Sequence
  chemically synthesized
agttcaactgcttcacctag

SEQ ID NO: 193171 - DNA, 20 bp, Artificial Sequence
  chemically synthesized
tctttgtctgctaggtgaag

SEQ ID NO: 193172 - DNA, 20 bp, Artificial Sequence
  chemically synthesized
tgcagttcaactgcttcacc

SEQ ID NO: 193173 - DNA, 20 bp, Artificial Sequence
  chemically synthesized
cagagacattaggtgtcatg

SEQ ID NO: 193174 - DNA, 20 bp, Artificial Sequence
  chemically synthesized
ttagagatggcagagacatt

SEQ ID NO: 193175 - DNA, 20 bp, Artificial Sequence
  chemically synthesized
attagagatggcagagacat

SEQ ID NO: 193176 - DNA, 20 bp, Artificial Sequence
  chemically synthesized
cagtagcattagagatggca

SEQ ID NO: 193177 - DNA, 20 bp, Artificial Sequence
  chemically synthesized
aacagtagcattagagatgg

SEQ ID NO: 193178 - DNA, 20 bp, Artificial Sequence
  chemically synthesized
gtaaacagtagcattagaga

SEQ ID NO: 193179 - DNA, 20 bp, Artificial Sequence
  chemically synthesized
aatagtaaacagtagcatta

SEQ ID NO: 193180 - DNA, 20 bp, Artificial Sequence
  chemically synthesized
tgaatagtaaacagtagcat

SEQ ID NO: 193181 - DNA, 20 bp, Artificial Sequence
  chemically synthesized
aatcactgaatagtaaacag

SEQ ID NO: 193182 - DNA, 20 bp, Artificial Sequence
  chemically synthesized
taaaatcactgaatagtaaa

SEQ ID NO: 193183 - DNA, 20 bp, Artificial Sequence
  chemically synthesized
taatgctactgtttactatt

SEQ ID NO: 193184 - DNA, 20 bp, Artificial Sequence
  chemically synthesized
ggctaactaaaatcactgaa

SEQ ID NO: 193185 - DNA, 20 bp, Artificial Sequence
  chemically synthesized
tgtttactattcagtgattt

SEQ ID NO: 193186 - DNA, 20 bp, Artificial Sequence
  chemically synthesized
tactattcagtgattttagt

SEQ ID NO: 193187 - DNA, 20 bp, Artificial Sequence
  chemically synthesized
ttttagttagccaaataaca

SEQ ID NO: 193188 - DNA, 20 bp, Artificial Sequence
  chemically synthesized
tgcttaaaaactttgttatt

SEQ ID NO: 193189 - DNA, 20 bp, Artificial Sequence
  chemically synthesized
agccaaataacaaagttttt

SEQ ID NO: 193190 - DNA, 20 bp, Artificial Sequence
  chemically synthesized
acaaagtttttaagcaattt

SEQ ID NO: 193191 - DNA, 20 bp, Artificial Sequence
  chemically synthesized
tttaagcaattttagcaccc

SEQ ID NO: 193192 - DNA, 20 bp, Artificial Sequence
  chemically synthesized
ttaagcaattttagcaccct

SEQ ID NO: 193193 - DNA, 20 bp, Artificial Sequence
  chemically synthesized
tctgtgggtgtatttgccta

SEQ ID NO: 193194 - DNA, 20 bp, Artificial Sequence
  chemically synthesized
ctctgtgggtgtatttgcct

SEQ ID NO: 193195 - DNA, 20 bp, Artificial Sequence
  chemically synthesized
actctgtgggtgtatttgcc

SEQ ID NO: 193196 - DNA, 20 bp, Artificial Sequence
  chemically synthesized
accctaggcaaatacaccca

SEQ ID NO: 193197 - DNA, 20 bp, Artificial Sequence
  chemically synthesized
cctaggcaaatacacccaca

SEQ ID NO: 193198 - DNA, 20 bp, Artificial Sequence
  chemically synthesized
ggcaaatacacccacagagt

SEQ ID NO: 193199 - DNA, 20 bp, Artificial Sequence
  chemically synthesized
tgccaaaatcctcactctgt

SEQ ID NO: 193200 - DNA, 20 bp, Artificial Sequence
  chemically synthesized
gcaaatacacccacagagtg

SEQ ID NO: 193201 - DNA, 20 bp, Artificial Sequence
  chemically synthesized
ttgccaaaatcctcactctg

SEQ ID NO: 193202 - DNA, 20 bp, Artificial Sequence
  chemically synthesized
cacccacagagtgaggattt

SEQ ID NO: 193203 - DNA, 20 bp, Artificial Sequence
  chemically synthesized
tgtccattgtaacattaaaa

SEQ ID NO: 193204 - DNA, 20 bp, Artificial Sequence
  chemically synthesized
aaactattttaatgttacaa

SEQ ID NO: 193205 - DNA, 20 bp, Artificial Sequence
  chemically synthesized
tattttaatgttacaatgga

SEQ ID NO: 193206 - DNA, 20 bp, Artificial Sequence
  chemically synthesized
aatgttacaatggacagtgc

SEQ ID NO: 193207 - DNA, 20 bp, Artificial Sequence
  chemically synthesized
atggacagtgctggaaaata

SEQ ID NO: 193208 - DNA, 20 bp, Artificial Sequence
  chemically synthesized
tttgaggagcccgtattttc

SEQ ID NO: 193209 - DNA, 20 bp, Artificial Sequence
  chemically synthesized
tggacagtgctggaaaatac

SEQ ID NO: 193210 - DNA, 20 bp, Artificial Sequence
  chemically synthesized
aggtaagattttgttttgag

SEQ ID NO: 193211 - DNA, 20 bp, Artificial Sequence
  chemically synthesized
caaggtaagattttgttttg

SEQ ID NO: 193212 - DNA, 20 bp, Artificial Sequence
  chemically synthesized
gcaaggtaagattttgtttt

SEQ ID NO: 193213 - DNA, 20 bp, Artificial Sequence
  chemically synthesized
gggtctaaaataggcaaggt

SEQ ID NO: 193214 - DNA, 20 bp, Artificial Sequence
  chemically synthesized
agctgggtctaaaataggca

SEQ ID NO: 193215 - DNA, 20 bp, Artificial Sequence
  chemically synthesized
aagctgggtctaaaataggc

SEQ ID NO: 193216 - DNA, 20 bp, Artificial Sequence
  chemically synthesized
aaatcttaccttgcctattt

SEQ ID NO: 193217 - DNA, 20 bp, Artificial Sequence
  chemically synthesized
caaaaagctgggtctaaaat

SEQ ID NO: 193218 - DNA, 20 bp, Artificial Sequence
  chemically synthesized
tcaaaaagctgggtctaaaa

SEQ ID NO: 193219 - DNA, 20 bp, Artificial Sequence
  chemically synthesized
taccttgcctattttagacc

SEQ ID NO: 193220 - DNA, 20 bp, Artificial Sequence
  chemically synthesized
ttgtttgctctcaaaaagct

SEQ ID NO: 193221 - DNA, 20 bp, Artificial Sequence
  chemically synthesized
tattttagacccagcttttt

SEQ ID NO: 193222 - DNA, 20 bp, Artificial Sequence
  chemically synthesized
attgtttgctctcaaaaagc

SEQ ID NO: 193223 - DNA, 20 bp, Artificial Sequence
  chemically synthesized
ttttagacccagctttttga

SEQ ID NO: 193224 - DNA, 20 bp, Artificial Sequence
  chemically synthesized
cttgattgtttgctctcaaa

SEQ ID NO: 193225 - DNA, 20 bp, Artificial Sequence
  chemically synthesized
ctttttgagagcaaacaatc

SEQ ID NO: 193226 - DNA, 20 bp, Artificial Sequence
  chemically synthesized
caatcaagttttgtttttgt

SEQ ID NO: 193227 - DNA, 20 bp, Artificial Sequence
  chemically synthesized
gtttttgttagtttcttctc

SEQ ID NO: 193228 - DNA, 20 bp, Artificial Sequence
  chemically synthesized
gccctgggataagtcttgag

SEQ ID NO: 193229 - DNA, 20 bp, Artificial Sequence
  chemically synthesized
aaagccctgggataagtctt

SEQ ID NO: 193230 - DNA, 20 bp, Artificial Sequence
  chemically synthesized
tttcttctcaagacttatcc

SEQ ID NO: 193231 - DNA, 20 bp, Artificial Sequence
  chemically synthesized
ttcttctcaagacttatccc

SEQ ID NO: 193232 - DNA, 20 bp, Artificial Sequence
  chemically synthesized
tcttctcaagacttatccca

SEQ ID NO: 193233 - DNA, 20 bp, Artificial Sequence
  chemically synthesized
tataagaaaagccctgggat

SEQ ID NO: 193234 - DNA, 20 bp, Artificial Sequence
  chemically synthesized
cttattataagaaaagccct

SEQ ID NO: 193235 - DNA, 20 bp, Artificial Sequence
  chemically synthesized
acttattataagaaaagccc

SEQ ID NO: 193236 - DNA, 20 bp, Artificial Sequence
  chemically synthesized
ccacccacttattataagaa

SEQ ID NO: 193237 - DNA, 20 bp, Artificial Sequence
  chemically synthesized
cccagggcttttcttataat

SEQ ID NO: 193238 - DNA, 20 bp, Artificial Sequence
  chemically synthesized
atttaccacccacttattat

SEQ ID NO: 193239 - DNA, 20 bp, Artificial Sequence
  chemically synthesized
agggcttttcttataataag

SEQ ID NO: 193240 - DNA, 20 bp, Artificial Sequence
  chemically synthesized
gggcttttcttataataagt

SEQ ID NO: 193241 - DNA, 20 bp, Artificial Sequence
  chemically synthesized
cttttcttataataagtggg

SEQ ID NO: 193242 - DNA, 20 bp, Artificial Sequence
  chemically synthesized
aagagtccccataatttatt

SEQ ID NO: 193243 - DNA, 20 bp, Artificial Sequence
  chemically synthesized
aataattgctgaataaatta

SEQ ID NO: 193244 - DNA, 20 bp, Artificial Sequence
  chemically synthesized
ataattgctgaataaattat

SEQ ID NO: 193245 - DNA, 20 bp, Artificial Sequence
  chemically synthesized
taattgctgaataaattatg

SEQ ID NO: 193246 - DNA, 20 bp, Artificial Sequence
  chemically synthesized
gaataaattatggggactct

SEQ ID NO: 193247 - DNA, 20 bp, Artificial Sequence
  chemically synthesized
ataaattatggggactctta

SEQ ID NO: 193248 - DNA, 20 bp, Artificial Sequence
  chemically synthesized
tctatcttttatagctctaa

SEQ ID NO: 193249 - DNA, 20 bp, Artificial Sequence
  chemically synthesized
attctatcttttatagctct

SEQ ID NO: 193250 - DNA, 20 bp, Artificial Sequence
  chemically synthesized
ggggactcttagagctataa

SEQ ID NO: 193251 - DNA, 20 bp, Artificial Sequence
  chemically synthesized
actcttagagctataaaaga

SEQ ID NO: 193252 - DNA, 20 bp, Artificial Sequence
  chemically synthesized
atcccaaattctatctttta

SEQ ID NO: 193253 - DNA, 20 bp, Artificial Sequence
  chemically synthesized
gagctataaaagatagaatt

SEQ ID NO: 193254 - DNA, 20 bp, Artificial Sequence
  chemically synthesized
agctataaaagatagaattt

SEQ ID NO: 193255 - DNA, 20 bp, Artificial Sequence
  chemically synthesized
acttttctaataagcaacac

SEQ ID NO: 193256 - DNA, 20 bp, Artificial Sequence
  chemically synthesized
aacttttctaataagcaaca

SEQ ID NO: 193257 - DNA, 20 bp, Artificial Sequence
  chemically synthesized
ggattacctgtgttgcttat

SEQ ID NO: 193258 - DNA, 20 bp, Artificial Sequence
  chemically synthesized
acctgtgttgcttattagaa

SEQ ID NO: 193259 - DNA, 20 bp, Artificial Sequence
  chemically synthesized
aatttaaaaacttttctaat

SEQ ID NO: 193260 - DNA, 20 bp, Artificial Sequence
  chemically synthesized
tatatcctcacaaaatgatt

SEQ ID NO: 193261 - DNA, 20 bp, Artificial Sequence
  chemically synthesized
aattaactaaatcattttgt

SEQ ID NO: 193262 - DNA, 20 bp, Artificial Sequence
  chemically synthesized
attaactaaatcattttgtg

SEQ ID NO: 193263 - DNA, 20 bp, Artificial Sequence
  chemically synthesized
tgtgaggatatatatgaact

SEQ ID NO: 193264 - DNA, 20 bp, Artificial Sequence
  chemically synthesized
aggatatatatgaactcagt

SEQ ID NO: 193265 - DNA, 20 bp, Artificial Sequence
  chemically synthesized
aggcaaatgtgaggccaact

SEQ ID NO: 193266 - DNA, 20 bp, Artificial Sequence
  chemically synthesized
aaaacttcaaggcaaatgtg

SEQ ID NO: 193267 - DNA, 20 bp, Artificial Sequence
  chemically synthesized
taaaacttcaaggcaaatgt

SEQ ID NO: 193268 - DNA, 20 bp, Artificial Sequence
  chemically synthesized
ttggcctcacatttgccttg

SEQ ID NO: 193269 - DNA, 20 bp, Artificial Sequence
  chemically synthesized
tgcaggaacataaaacttca

SEQ ID NO: 193270 - DNA, 20 bp, Artificial Sequence
  chemically synthesized
gtgcaggaacataaaacttc

SEQ ID NO: 193271 - DNA, 20 bp, Artificial Sequence
  chemically synthesized
agcactgttgatttaagtgc

SEQ ID NO: 193272 - DNA, 20 bp, Artificial Sequence
  chemically synthesized
aagcactgttgatttaagtg

SEQ ID NO: 193273 - DNA, 20 bp, Artificial Sequence
  chemically synthesized
tgttcctgcacttaaatcaa

SEQ ID NO: 193274 - DNA, 20 bp, Artificial Sequence
  chemically synthesized
agaaaaagcactgttgattt

SEQ ID NO: 193275 - DNA, 20 bp, Artificial Sequence
  chemically synthesized
gaaatgaaaataatgagaaa

SEQ ID NO: 193276 - DNA, 20 bp, Artificial Sequence
  chemically synthesized
tctgaagaaatgaaaataat

SEQ ID NO: 193277 - DNA, 20 bp, Artificial Sequence
  chemically synthesized
tctcattattttcatttctt

SEQ ID NO: 193278 - DNA, 20 bp, Artificial Sequence
  chemically synthesized
tgttaggggaaaaaagtctg

SEQ ID NO: 193279 - DNA, 20 bp, Artificial Sequence
  chemically synthesized
tcaactatgttaggggaaaa

SEQ ID NO: 193280 - DNA, 20 bp, Artificial Sequence
  chemically synthesized
cagacttttttcccctaaca

SEQ ID NO: 193281 - DNA, 20 bp, Artificial Sequence
  chemically synthesized
aattttatcaactatgttag

SEQ ID NO: 193282 - DNA, 20 bp, Artificial Sequence
  chemically synthesized
gaattttatcaactatgtta

SEQ ID NO: 193283 - DNA, 20 bp, Artificial Sequence
  chemically synthesized
ggaattttatcaactatgtt

SEQ ID NO: 193284 - DNA, 20 bp, Artificial Sequence
  chemically synthesized
aggaattttatcaactatgt

SEQ ID NO: 193285 - DNA, 20 bp, Artificial Sequence
  chemically synthesized
aaagattcagtgtgggcaga

SEQ ID NO: 193286 - DNA, 20 bp, Artificial Sequence
  chemically synthesized
taaagattcagtgtgggcag

SEQ ID NO: 193287 - DNA, 20 bp, Artificial Sequence
  chemically synthesized
ttttaaagattcagtgtggg

SEQ ID NO: 193288 - DNA, 20 bp, Artificial Sequence
  chemically synthesized
tgtttttaaagattcagtgt

SEQ ID NO: 193289 - DNA, 20 bp, Artificial Sequence
  chemically synthesized
gtgtttttaaagattcagtg

SEQ ID NO: 193290 - DNA, 20 bp, Artificial Sequence
  chemically synthesized
actctgtgtttttaaagatt

SEQ ID NO: 193291 - DNA, 20 bp, Artificial Sequence
  chemically synthesized
ccaactactctgtgttttta

SEQ ID NO: 193292 - DNA, 20 bp, Artificial Sequence
  chemically synthesized
acactgaatctttaaaaaca

SEQ ID NO: 193293 - DNA, 20 bp, Artificial Sequence
  chemically synthesized
actgaatctttaaaaacaca

SEQ ID NO: 193294 - DNA, 20 bp, Artificial Sequence
  chemically synthesized
gaatctttaaaaacacagag

SEQ ID NO: 193295 - DNA, 20 bp, Artificial Sequence
  chemically synthesized
ctttaaaaacacagagtagt

SEQ ID NO: 193296 - DNA, 20 bp, Artificial Sequence
  chemically synthesized
atacacatatagcaaaacac

SEQ ID NO: 193297 - DNA, 20 bp, Artificial Sequence
  chemically synthesized
gaatactaattatacacata

SEQ ID NO: 193298 - DNA, 20 bp, Artificial Sequence
  chemically synthesized
ttttgctatatgtgtataat

SEQ ID NO: 193299 - DNA, 20 bp, Artificial Sequence
  chemically synthesized
tataattagtattctgtata

SEQ ID NO: 193300 - DNA, 20 bp, Artificial Sequence
  chemically synthesized
actacggtcatttctttata

SEQ ID NO: 193301 - DNA, 20 bp, Artificial Sequence
  chemically synthesized
tctgtataaagaaatgaccg

SEQ ID NO: 193302 - DNA, 20 bp, Artificial Sequence
  chemically synthesized
atctggattcaagagaacta

SEQ ID NO: 193303 - DNA, 20 bp, Artificial Sequence
  chemically synthesized
gaccgtagttctcttgaatc

SEQ ID NO: 193304 - DNA, 20 bp, Artificial Sequence
  chemically synthesized
cacgcagcatctggattcaa

SEQ ID NO: 193305 - DNA, 20 bp, Artificial Sequence
  chemically synthesized
cccacgcagcatctggattc

SEQ ID NO: 193306 - DNA, 20 bp, Artificial Sequence
  chemically synthesized
tttaacccccacgcagcatc

SEQ ID NO: 193307 - DNA, 20 bp, Artificial Sequence
  chemically synthesized
tcttgaatccagatgctgcg

SEQ ID NO: 193308 - DNA, 20 bp, Artificial Sequence
  chemically synthesized
cttgaatccagatgctgcgt

SEQ ID NO: 193309 - DNA, 20 bp, Artificial Sequence
  chemically synthesized
ttgaatccagatgctgcgtg

SEQ ID NO: 193310 - DNA, 20 bp, Artificial Sequence
  chemically synthesized
tgaatccagatgctgcgtgg

SEQ ID NO: 193311 - DNA, 20 bp, Artificial Sequence
  chemically synthesized
tgtaaaatttaacccccacg

SEQ ID NO: 193312 - DNA, 20 bp, Artificial Sequence
  chemically synthesized
tgcgtgggggttaaatttta

SEQ ID NO: 193313 - DNA, 20 bp, Artificial Sequence
  chemically synthesized
ggggttaaattttacagatt

SEQ ID NO: 193314 - DNA, 20 bp, Artificial Sequence
  chemically synthesized
tacagattcagccatttgct

SEQ ID NO: 193315 - DNA, 20 bp, Artificial Sequence
  chemically synthesized
accttatttttcttagcaaa

SEQ ID NO: 193316 - DNA, 20 bp, Artificial Sequence
  chemically synthesized
aattttgaccttatttttct

SEQ ID NO: 193317 - DNA, 20 bp, Artificial Sequence
  chemically synthesized
agccatttgctaagaaaaat

SEQ ID NO: 193318 - DNA, 20 bp, Artificial Sequence
  chemically synthesized
gccatttgctaagaaaaata

SEQ ID NO: 193319 - DNA, 20 bp, Artificial Sequence
  chemically synthesized
gaaaaataaggtcaaaattt

SEQ ID NO: 193320 - DNA, 20 bp, Artificial Sequence
  chemically synthesized
aaaaataaggtcaaaatttt

SEQ ID NO: 193321 - DNA, 20 bp, Artificial Sequence
  chemically synthesized
aaaataaggtcaaaatttta

SEQ ID NO: 193322 - DNA, 20 bp, Artificial Sequence
  chemically synthesized
taaggtcaaaattttagggt

SEQ ID NO: 193323 - DNA, 20 bp, Artificial Sequence
  chemically synthesized
ttttagggtaagaaaataat

SEQ ID NO: 193324 - DNA, 20 bp, Artificial Sequence
  chemically synthesized
gagaatgatttaaacttgta

SEQ ID NO: 193325 - DNA, 20 bp, Artificial Sequence
  chemically synthesized
taaactgaaatgtactatac

SEQ ID NO: 193326 - DNA, 20 bp, Artificial Sequence
  chemically synthesized
taaacttgtatagtacattt

SEQ ID NO: 193327 - DNA, 20 bp, Artificial Sequence
  chemically synthesized
gtttataaatttctttctaa

SEQ ID NO: 193328 - DNA, 20 bp, Artificial Sequence
  chemically synthesized
attagaaagaaacttttaga

SEQ ID NO: 193329 - DNA, 20 bp, Artificial Sequence
  chemically synthesized
ctatattagaaagaaacttt

SEQ ID NO: 193330 - DNA, 20 bp, Artificial Sequence
  chemically synthesized
ctaaaagtttctttctaata

SEQ ID NO: 193331 - DNA, 20 bp, Artificial Sequence
  chemically synthesized
aaataaaatactatattaga

SEQ ID NO: 193332 - DNA, 20 bp, Artificial Sequence
  chemically synthesized
aattaaataaaatactatat

SEQ ID NO: 193333 - DNA, 20 bp, Artificial Sequence
  chemically synthesized
ttgacaacaaaactgtgatg

SEQ ID NO: 193334 - DNA, 20 bp, Artificial Sequence
  chemically synthesized
tggcacacctatccacatca

SEQ ID NO: 193335 - DNA, 20 bp, Artificial Sequence
  chemically synthesized
caacaaaactgtgatgtgga

SEQ ID NO: 193336 - DNA, 20 bp, Artificial Sequence
  chemically synthesized
aacaaaactgtgatgtggat

SEQ ID NO: 193337 - DNA, 20 bp, Artificial Sequence
  chemically synthesized
tggataggtgtgccacttta

SEQ ID NO: 193338 - DNA, 20 bp, Artificial Sequence
  chemically synthesized
tttagcttttttctataaag

SEQ ID NO: 193339 - DNA, 20 bp, Artificial Sequence
  chemically synthesized
ttgtttagcttttttctata

SEQ ID NO: 193340 - DNA, 20 bp, Artificial Sequence
  chemically synthesized
gtgtgccactttatagaaaa

SEQ ID NO: 193341 - DNA, 20 bp, Artificial Sequence
  chemically synthesized
ttcctgaatcttagtttgtt

SEQ ID NO: 193342 - DNA, 20 bp, Artificial Sequence
  chemically synthesized
agaaaaaagctaaacaaact

SEQ ID NO: 193343 - DNA, 20 bp, Artificial Sequence
  chemically synthesized
aagctaaacaaactaagatt

SEQ ID NO: 193344 - DNA, 20 bp, Artificial Sequence
  chemically synthesized
agctaaacaaactaagattc

SEQ ID NO: 193345 - DNA, 20 bp, Artificial Sequence
  chemically synthesized
ttacttagcttcctgaatct

SEQ ID NO: 193346 - DNA, 20 bp, Artificial Sequence
  chemically synthesized
taaacaaactaagattcagg

SEQ ID NO: 193347 - DNA, 20 bp, Artificial Sequence
  chemically synthesized
aaactaagattcaggaagct

SEQ ID NO: 193348 - DNA, 20 bp, Artificial Sequence
  chemically synthesized
gtgaccttaaataagttact

SEQ ID NO: 193349 - DNA, 20 bp, Artificial Sequence
  chemically synthesized
ggaagctaagtaacttattt

SEQ ID NO: 193350 - DNA, 20 bp, Artificial Sequence
  chemically synthesized
gaagctaagtaacttattta

SEQ ID NO: 193351 - DNA, 20 bp, Artificial Sequence
  chemically synthesized
ctaggtgtgtgaccttaaat

SEQ ID NO: 193352 - DNA, 20 bp, Artificial Sequence
  chemically synthesized
cttatttaaggtcacacacc

SEQ ID NO: 193353 - DNA, 20 bp, Artificial Sequence
  chemically synthesized
aaggtcacacacctagtttt

SEQ ID NO: 193354 - DNA, 20 bp, Artificial Sequence
  chemically synthesized
atatgtctctgccaaaaact

SEQ ID NO: 193355 - DNA, 20 bp, Artificial Sequence
  chemically synthesized
catatgtctctgccaaaaac

SEQ ID NO: 193356 - DNA, 20 bp, Artificial Sequence
  chemically synthesized
gtcacacacctagtttttgg

SEQ ID NO: 193357 - DNA, 20 bp, Artificial Sequence
  chemically synthesized
cacacacctagtttttggca

SEQ ID NO: 193358 - DNA, 20 bp, Artificial Sequence
  chemically synthesized
tttggcagagacatatgttc

SEQ ID NO: 193359 - DNA, 20 bp, Artificial Sequence
  chemically synthesized
gagacatatgttctggcttc

SEQ ID NO: 193360 - DNA, 20 bp, Artificial Sequence
  chemically synthesized
aaggattttgaacttgaagc

SEQ ID NO: 193361 - DNA, 20 bp, Artificial Sequence
  chemically synthesized
tggaaaggattttgaacttg

SEQ ID NO: 193362 - DNA, 20 bp, Artificial Sequence
  chemically synthesized
gtaattgtagtatagtggaa

SEQ ID NO: 193363 - DNA, 20 bp, Artificial Sequence
  chemically synthesized
ggtaattgtagtatagtgga

SEQ ID NO: 193364 - DNA, 20 bp, Artificial Sequence
  chemically synthesized
taggggtaattgtagtatag

SEQ ID NO: 193365 - DNA, 20 bp, Artificial Sequence
  chemically synthesized
aagtaggggtaattgtagta

SEQ ID NO: 193366 - DNA, 20 bp, Artificial Sequence
  chemically synthesized
atgtaaagtaggggtaattg

SEQ ID NO: 193367 - DNA, 20 bp, Artificial Sequence
  chemically synthesized
tgtttttagatgtaaagtag

SEQ ID NO: 193368 - DNA, 20 bp, Artificial Sequence
  chemically synthesized
gtgtttttagatgtaaagta

SEQ ID NO: 193369 - DNA, 20 bp, Artificial Sequence
  chemically synthesized
agtgtttttagatgtaaagt

SEQ ID NO: 193370 - DNA, 20 bp, Artificial Sequence
  chemically synthesized
aagtgtttttagatgtaaag

SEQ ID NO: 193371 - DNA, 20 bp, Artificial Sequence
  chemically synthesized
aggaagtgtttttagatgta

SEQ ID NO: 193372 - DNA, 20 bp, Artificial Sequence
  chemically synthesized
gcatttctaggaagtgtttt

SEQ ID NO: 193373 - DNA, 20 bp, Artificial Sequence
  chemically synthesized
ttacatctaaaaacacttcc

SEQ ID NO: 193374 - DNA, 20 bp, Artificial Sequence
  chemically synthesized
ttatcttacgcatttctagg

SEQ ID NO: 193375 - DNA, 20 bp, Artificial Sequence
  chemically synthesized
cctttatcttacgcatttct

SEQ ID NO: 193376 - DNA, 20 bp, Artificial Sequence
  chemically synthesized
acctttatcttacgcatttc

SEQ ID NO: 193377 - DNA, 20 bp, Artificial Sequence
  chemically synthesized
aacacttcctagaaatgcgt

SEQ ID NO: 193378 - DNA, 20 bp, Artificial Sequence
  chemically synthesized
tcctagaaatgcgtaagata

SEQ ID NO: 193379 - DNA, 20 bp, Artificial Sequence
  chemically synthesized
cctagaaatgcgtaagataa

SEQ ID NO: 193380 - DNA, 20 bp, Artificial Sequence
  chemically synthesized
agaaatgcgtaagataaagg

SEQ ID NO: 193381 - DNA, 20 bp, Artificial Sequence
  chemically synthesized
tttttgttttattcctaaaa

SEQ ID NO: 193382 - DNA, 20 bp, Artificial Sequence
  chemically synthesized
atacatgattaatctatttt

SEQ ID NO: 193383 - DNA, 20 bp, Artificial Sequence
  chemically synthesized
tatacatgattaatctattt

SEQ ID NO: 193384 - DNA, 20 bp, Artificial Sequence
  chemically synthesized
aatagattaatcatgtatat

SEQ ID NO: 193385 - DNA, 20 bp, Artificial Sequence
  chemically synthesized
tagattaatcatgtatatca

SEQ ID NO: 193386 - DNA, 20 bp, Artificial Sequence
  chemically synthesized
atgtatatcagagatattac

SEQ ID NO: 193387 - DNA, 20 bp, Artificial Sequence
  chemically synthesized
tatcagagatattacaagtt

SEQ ID NO: 193388 - DNA, 20 bp, Artificial Sequence
  chemically synthesized
agatattacaagttgagaat

SEQ ID NO: 193389 - DNA, 20 bp, Artificial Sequence
  chemically synthesized
tattacaagttgagaattag

SEQ ID NO: 193390 - DNA, 20 bp, Artificial Sequence
  chemically synthesized
attacaagttgagaattagc

SEQ ID NO: 193391 - DNA, 20 bp, Artificial Sequence
  chemically synthesized
ttagcaggatgaaattttga

SEQ ID NO: 193392 - DNA, 20 bp, Artificial Sequence
  chemically synthesized
gaaattttgacagaaccaac

SEQ ID NO: 193393 - DNA, 20 bp, Artificial Sequence
  chemically synthesized
tatctcagtttgcatcttgt

SEQ ID NO: 193394 - DNA, 20 bp, Artificial Sequence
  chemically synthesized
gaaccaacaagatgcaaact

SEQ ID NO: 193395 - DNA, 20 bp, Artificial Sequence
  chemically synthesized
caacaagatgcaaactgaga

SEQ ID NO: 193396 - DNA, 20 bp, Artificial Sequence
  chemically synthesized
ctgttattataaaactatct

SEQ ID NO: 193397 - DNA, 20 bp, Artificial Sequence
  chemically synthesized
ctgagatagttttataataa

SEQ ID NO: 193398 - DNA, 20 bp, Artificial Sequence
  chemically synthesized
ttcactctgtaatttattaa

SEQ ID NO: 193399 - DNA, 20 bp, Artificial Sequence
  chemically synthesized
gtatgtcttttaataaatta

SEQ ID NO: 193400 - DNA, 20 bp, Artificial Sequence
  chemically synthesized
atgtcttttaataaattaca

SEQ ID NO: 193401 - DNA, 20 bp, Artificial Sequence
  chemically synthesized
ttaataaattacagagtgaa

SEQ ID NO: 193402 - DNA, 20 bp, Artificial Sequence
  chemically synthesized
gtgaatagtttaccaaatgt

SEQ ID NO: 193403 - DNA, 20 bp, Artificial Sequence
  chemically synthesized
tgaatagtttaccaaatgtt

SEQ ID NO: 193404 - DNA, 20 bp, Artificial Sequence
  chemically synthesized
gtttgctttaacccaacatt

SEQ ID NO: 193405 - DNA, 20 bp, Artificial Sequence
  chemically synthesized
gtttaccaaatgttgggtta

SEQ ID NO: 193406 - DNA, 20 bp, Artificial Sequence
  chemically synthesized
gttgggttaaagcaaacttt

SEQ ID NO: 193407 - DNA, 20 bp, Artificial Sequence
  chemically synthesized
agattcaatcttgtggctga

SEQ ID NO: 193408 - DNA, 20 bp, Artificial Sequence
  chemically synthesized
taaagcaaactttcagccac

SEQ ID NO: 193409 - DNA, 20 bp, Artificial Sequence
  chemically synthesized
aaacagcagattcaatcttg

SEQ ID NO: 193410 - DNA, 20 bp, Artificial Sequence
  chemically synthesized
catatctgtggataaaacag

SEQ ID NO: 193411 - DNA, 20 bp, Artificial Sequence
  chemically synthesized
ccacatatctgtggataaaa

SEQ ID NO: 193412 - DNA, 20 bp, Artificial Sequence
  chemically synthesized
tgaatctgctgttttatcca

SEQ ID NO: 193413 - DNA, 20 bp, Artificial Sequence
  chemically synthesized
caataaaaaccacatatctg

SEQ ID NO: 193414 - DNA, 20 bp, Artificial Sequence
  chemically synthesized
ctgttttatccacagatatg

SEQ ID NO: 193415 - DNA, 20 bp, Artificial Sequence
  chemically synthesized
ttaaaataaaatggaagtat

SEQ ID NO: 193416 - DNA, 20 bp, Artificial Sequence
  chemically synthesized
tacattttaaaataaaatgg

SEQ ID NO: 193417 - DNA, 20 bp, Artificial Sequence
  chemically synthesized
atgtacattttaaaataaaa

SEQ ID NO: 193418 - DNA, 20 bp, Artificial Sequence
  chemically synthesized
tacattttatgttaccatcc

SEQ ID NO: 193419 - DNA, 20 bp, Artificial Sequence
  chemically synthesized
acattttatgttaccatcct

SEQ ID NO: 193420 - DNA, 20 bp, Artificial Sequence
  chemically synthesized
aagttactttgatcccagga

SEQ ID NO: 193421 - DNA, 20 bp, Artificial Sequence
  chemically synthesized
atgttaccatcctgggatca

SEQ ID NO: 193422 - DNA, 20 bp, Artificial Sequence
  chemically synthesized
tttcaagttactttgatccc

SEQ ID NO: 193423 - DNA, 20 bp, Artificial Sequence
  chemically synthesized
atttcaagttactttgatcc

SEQ ID NO: 193424 - DNA, 20 bp, Artificial Sequence
  chemically synthesized
atcaaagtaacttgaaataa

SEQ ID NO: 193425 - DNA, 20 bp, Artificial Sequence
  chemically synthesized
acctaaggtcctattatttc

SEQ ID NO: 193426 - DNA, 20 bp, Artificial Sequence
  chemically synthesized
tcaaagtaacttgaaataat

SEQ ID NO: 193427 - DNA, 20 bp, Artificial Sequence
  chemically synthesized
aacttgaaataataggacct

SEQ ID NO: 193428 - DNA, 20 bp, Artificial Sequence
  chemically synthesized
acttgaaataataggacctt

SEQ ID NO: 193429 - DNA, 20 bp, Artificial Sequence
  chemically synthesized
cagaaggatttatttaccta

SEQ ID NO: 193430 - DNA, 20 bp, Artificial Sequence
  chemically synthesized
acagaaggatttatttacct

SEQ ID NO: 193431 - DNA, 20 bp, Artificial Sequence
  chemically synthesized
aggtaaataaatccttctgt

SEQ ID NO: 193432 - DNA, 20 bp, Artificial Sequence
  chemically synthesized
ggtaaataaatccttctgtt

SEQ ID NO: 193433 - DNA, 20 bp, Artificial Sequence
  chemically synthesized
ttcatccttatcccaacaga

SEQ ID NO: 193434 - DNA, 20 bp, Artificial Sequence
  chemically synthesized
gttcatccttatcccaacag

SEQ ID NO: 193435 - DNA, 20 bp, Artificial Sequence
  chemically synthesized
ataaatccttctgttgggat

SEQ ID NO: 193436 - DNA, 20 bp, Artificial Sequence
  chemically synthesized
catgttcatccttatcccaa

SEQ ID NO: 193437 - DNA, 20 bp, Artificial Sequence
  chemically synthesized
taaatccttctgttgggata

SEQ ID NO: 193438 - DNA, 20 bp, Artificial Sequence
  chemically synthesized
ataaggatgaacatgtccat

SEQ ID NO: 193439 - DNA, 20 bp, Artificial Sequence
  chemically synthesized
aaggatgaacatgtccatca

SEQ ID NO: 193440 - DNA, 20 bp, Artificial Sequence
  chemically synthesized
ggaaaaagagacaactctga

SEQ ID NO: 193441 - DNA, 20 bp, Artificial Sequence
  chemically synthesized
gttaaaaagcaaaggaaaaa

SEQ ID NO: 193442 - DNA, 20 bp, Artificial Sequence
  chemically synthesized
aagttaaaaagcaaaggaaa

SEQ ID NO: 193443 - DNA, 20 bp, Artificial Sequence
  chemically synthesized
taacacaagttaaaaagcaa

SEQ ID NO: 193444 - DNA, 20 bp, Artificial Sequence
  chemically synthesized
ctaacacaagttaaaaagca

SEQ ID NO: 193445 - DNA, 20 bp, Artificial Sequence
  chemically synthesized
cttgcctaacacaagttaaa

SEQ ID NO: 193446 - DNA, 20 bp, Artificial Sequence
  chemically synthesized
ctttgctttttaacttgtgt

SEQ ID NO: 193447 - DNA, 20 bp, Artificial Sequence
  chemically synthesized
tttgctttttaacttgtgtt

SEQ ID NO: 193448 - DNA, 20 bp, Artificial Sequence
  chemically synthesized
ttctgtcacttgcctaacac

SEQ ID NO: 193449 - DNA, 20 bp, Artificial Sequence
  chemically synthesized
ctttttaacttgtgttaggc

SEQ ID NO: 193450 - DNA, 20 bp, Artificial Sequence
  chemically synthesized
aacttgtgttaggcaagtga

SEQ ID NO: 193451 - DNA, 20 bp, Artificial Sequence
  chemically synthesized
tttttgttgttctctgatcc

SEQ ID NO: 193452 - DNA, 20 bp, Artificial Sequence
  chemically synthesized
aaagaataaaactgggatca

SEQ ID NO: 193453 - DNA, 20 bp, Artificial Sequence
  chemically synthesized
acaaagaataaaactgggat

SEQ ID NO: 193454 - DNA, 20 bp, Artificial Sequence
  chemically synthesized
aagtgacaaagaataaaact

SEQ ID NO: 193455 - DNA, 20 bp, Artificial Sequence
  chemically synthesized
aaagtgacaaagaataaaac

SEQ ID NO: 193456 - DNA, 20 bp, Artificial Sequence
  chemically synthesized
ggcagaaaaaaaaagtgaca

SEQ ID NO: 193457 - DNA, 20 bp, Artificial Sequence
  chemically synthesized
atctgtttggcagaaaaaaa

SEQ ID NO: 193458 - DNA, 20 bp, Artificial Sequence
  chemically synthesized
cactttttttttctgccaaa

SEQ ID NO: 193459 - DNA, 20 bp, Artificial Sequence
  chemically synthesized
aacatactgcatctgtttgg

SEQ ID NO: 193460 - DNA, 20 bp, Artificial Sequence
  chemically synthesized
tgaaacatactgcatctgtt

SEQ ID NO: 193461 - DNA, 20 bp, Artificial Sequence
  chemically synthesized
ttttttctgccaaacagatg

SEQ ID NO: 193462 - DNA, 20 bp, Artificial Sequence
  chemically synthesized
acagatgcagtatgtttcaa

SEQ ID NO: 193463 - DNA, 20 bp, Artificial Sequence
  chemically synthesized
atgcagtatgtttcaacaga

SEQ ID NO: 193464 - DNA, 20 bp, Artificial Sequence
  chemically synthesized
gcagtatgtttcaacagaaa

SEQ ID NO: 193465 - DNA, 20 bp, Artificial Sequence
  chemically synthesized
tcataatgattaaagatttg

SEQ ID NO: 193466 - DNA, 20 bp, Artificial Sequence
  chemically synthesized
tttcataatgattaaagatt

SEQ ID NO: 193467 - DNA, 20 bp, Artificial Sequence
  chemically synthesized
tgtgtttttcataatgatta

SEQ ID NO: 193468 - DNA, 20 bp, Artificial Sequence
  chemically synthesized
tttaatcattatgaaaaaca

SEQ ID NO: 193469 - DNA, 20 bp, Artificial Sequence
  chemically synthesized
aactttaaaatacaaggtca

SEQ ID NO: 193470 - DNA, 20 bp, Artificial Sequence
  chemically synthesized
taactttaaaatacaaggtc

SEQ ID NO: 193471 - DNA, 20 bp, Artificial Sequence
  chemically synthesized
ccatttaactttaaaataca

SEQ ID NO: 193472 - DNA, 20 bp, Artificial Sequence
  chemically synthesized
tccatttaactttaaaatac

SEQ ID NO: 193473 - DNA, 20 bp, Artificial Sequence
  chemically synthesized
taccttgaccttgtatttta

SEQ ID NO: 193474 - DNA, 20 bp, Artificial Sequence
  chemically synthesized
ccttgtattttaaagttaaa

SEQ ID NO: 193475 - DNA, 20 bp, Artificial Sequence
  chemically synthesized
ttgtattttaaagttaaatg

SEQ ID NO: 193476 - DNA, 20 bp, Artificial Sequence
  chemically synthesized
tattttaaagttaaatggag

SEQ ID NO: 193477 - DNA, 20 bp, Artificial Sequence
  chemically synthesized
tggcattataaaaattaaat

SEQ ID NO: 193478 - DNA, 20 bp, Artificial Sequence
  chemically synthesized
aggatattatggaaatgagc

SEQ ID NO: 193479 - DNA, 20 bp, Artificial Sequence
  chemically synthesized
ttagaggatattatggaaat

SEQ ID NO: 193480 - DNA, 20 bp, Artificial Sequence
  chemically synthesized
aggctttttagaggatatta

SEQ ID NO: 193481 - DNA, 20 bp, Artificial Sequence
  chemically synthesized
tttccataatatcctctaaa

SEQ ID NO: 193482 - DNA, 20 bp, Artificial Sequence
  chemically synthesized
ggttaggcaaggctttttag

SEQ ID NO: 193483 - DNA, 20 bp, Artificial Sequence
  chemically synthesized
aggttaggcaaggcttttta

SEQ ID NO: 193484 - DNA, 20 bp, Artificial Sequence
  chemically synthesized
ctaggttaggcaaggctttt

SEQ ID NO: 193485 - DNA, 20 bp, Artificial Sequence
  chemically synthesized
catccactctaggttaggca

SEQ ID NO: 193486 - DNA, 20 bp, Artificial Sequence
  chemically synthesized
acatccactctaggttaggc

SEQ ID NO: 193487 - DNA, 20 bp, Artificial Sequence
  chemically synthesized
ctaaaaagccttgcctaacc

SEQ ID NO: 193488 - DNA, 20 bp, Artificial Sequence
  chemically synthesized
aaaaagccttgcctaaccta

SEQ ID NO: 193489 - DNA, 20 bp, Artificial Sequence
  chemically synthesized
taggacatccactctaggtt

SEQ ID NO: 193490 - DNA, 20 bp, Artificial Sequence
  chemically synthesized
ataggacatccactctaggt

SEQ ID NO: 193491 - DNA, 20 bp, Artificial Sequence
  chemically synthesized
aagccttgcctaacctagag

SEQ ID NO: 193492 - DNA, 20 bp, Artificial Sequence
  chemically synthesized
agaaataggacatccactct

SEQ ID NO: 193493 - DNA, 20 bp, Artificial Sequence
  chemically synthesized
aagaaataggacatccactc

SEQ ID NO: 193494 - DNA, 20 bp, Artificial Sequence
  chemically synthesized
atcaagaaagataaagaaat

SEQ ID NO: 193495 - DNA, 20 bp, Artificial Sequence
  chemically synthesized
catcaagaaagataaagaaa

SEQ ID NO: 193496 - DNA, 20 bp, Artificial Sequence
  chemically synthesized
agagatcatcaagaaagata

SEQ ID NO: 193497 - DNA, 20 bp, Artificial Sequence
  chemically synthesized
ggcatgagagatcatcaaga

SEQ ID NO: 193498 - DNA, 20 bp, Artificial Sequence
  chemically synthesized
tgcaggcatgagagatcatc

SEQ ID NO: 193499 - DNA, 20 bp, Artificial Sequence
  chemically synthesized
gagctgacttgcaggcatga

SEQ ID NO: 193500 - DNA, 20 bp, Artificial Sequence
  chemically synthesized
acgagctgacttgcaggcat

SEQ ID NO: 193501 - DNA, 20 bp, Artificial Sequence
  chemically synthesized
tgatgatctctcatgcctgc

SEQ ID NO: 193502 - DNA, 20 bp, Artificial Sequence
  chemically synthesized
gatctctcatgcctgcaagt

SEQ ID NO: 193503 - DNA, 20 bp, Artificial Sequence
  chemically synthesized
agaaaaacgagctgacttgc

SEQ ID NO: 193504 - DNA, 20 bp, Artificial Sequence
  chemically synthesized
aagaaaaacgagctgacttg

SEQ ID NO: 193505 - DNA, 20 bp, Artificial Sequence
  chemically synthesized
agtcttcagcaaagaaaaac

SEQ ID NO: 193506 - DNA, 20 bp, Artificial Sequence
  chemically synthesized
cagctcgtttttctttgctg

SEQ ID NO: 193507 - DNA, 20 bp, Artificial Sequence
  chemically synthesized
gtggggtgcagtcttcagca

SEQ ID NO: 193508 - DNA, 20 bp, Artificial Sequence
  chemically synthesized
cagcagtggggtgcagtctt

SEQ ID NO: 193509 - DNA, 20 bp, Artificial Sequence
  chemically synthesized
gtgcatgcagcagtggggtg

SEQ ID NO: 193510 - DNA, 20 bp, Artificial Sequence
  chemically synthesized
ttagagtgcatgcagcagtg

SEQ ID NO: 193511 - DNA, 20 bp, Artificial Sequence
  chemically synthesized
tttagagtgcatgcagcagt

SEQ ID NO: 193512 - DNA, 20 bp, Artificial Sequence
  chemically synthesized
ttttagagtgcatgcagcag

SEQ ID NO: 193513 - DNA, 20 bp, Artificial Sequence
  chemically synthesized
aacttttagagtgcatgcag

SEQ ID NO: 193514 - DNA, 20 bp, Artificial Sequence
  chemically synthesized
tggaacttttagagtgcatg

SEQ ID NO: 193515 - DNA, 20 bp, Artificial Sequence
  chemically synthesized
cactgctgcatgcactctaa

SEQ ID NO: 193516 - DNA, 20 bp, Artificial Sequence
  chemically synthesized
agattttaatggaactttta

SEQ ID NO: 193517 - DNA, 20 bp, Artificial Sequence
  chemically synthesized
ctagattttaatggaacttt

SEQ ID NO: 193518 - DNA, 20 bp, Artificial Sequence
  chemically synthesized
gatgatgccctagattttaa

SEQ ID NO: 193519 - DNA, 20 bp, Artificial Sequence
  chemically synthesized
ctaaaagttccattaaaatc

SEQ ID NO: 193520 - DNA, 20 bp, Artificial Sequence
  chemically synthesized
taaaagttccattaaaatct

SEQ ID NO: 193521 - DNA, 20 bp, Artificial Sequence
  chemically synthesized
aaaagttccattaaaatcta

SEQ ID NO: 193522 - DNA, 20 bp, Artificial Sequence
  chemically synthesized
aagaatgagtgatgatgccc

SEQ ID NO: 193523 - DNA, 20 bp, Artificial Sequence
  chemically synthesized
agcctgctgcagataagaat

SEQ ID NO: 193524 - DNA, 20 bp, Artificial Sequence
  chemically synthesized
tcatcactcattcttatctg

SEQ ID NO: 193525 - DNA, 20 bp, Artificial Sequence
  chemically synthesized
ctcagcagcctgctgcagat

SEQ ID NO: 193526 - DNA, 20 bp, Artificial Sequence
  chemically synthesized
tcactcattcttatctgcag

SEQ ID NO: 193527 - DNA, 20 bp, Artificial Sequence
  chemically synthesized
cactcattcttatctgcagc

SEQ ID NO: 193528 - DNA, 20 bp, Artificial Sequence
  chemically synthesized
cactgctcagcagcctgctg

SEQ ID NO: 193529 - DNA, 20 bp, Artificial Sequence
  chemically synthesized
cttatctgcagcaggctgct

SEQ ID NO: 193530 - DNA, 20 bp, Artificial Sequence
  chemically synthesized
atctgcagcaggctgctgag

SEQ ID NO: 193531 - DNA, 20 bp, Artificial Sequence
  chemically synthesized
gctggtatggcactgctcag

SEQ ID NO: 193532 - DNA, 20 bp, Artificial Sequence
  chemically synthesized
gttgctggtatggcactgct

SEQ ID NO: 193533 - DNA, 20 bp, Artificial Sequence
  chemically synthesized
gctgctgagcagtgccatac

SEQ ID NO: 193534 - DNA, 20 bp, Artificial Sequence
  chemically synthesized
tttgcatgcagttgctggta

SEQ ID NO: 193535 - DNA, 20 bp, Artificial Sequence
  chemically synthesized
gctagtttgcatgcagttgc

SEQ ID NO: 193536 - DNA, 20 bp, Artificial Sequence
  chemically synthesized
ctttgaggctagtttgcatg

SEQ ID NO: 193537 - DNA, 20 bp, Artificial Sequence
  chemically synthesized
accagcaactgcatgcaaac

SEQ ID NO: 193538 - DNA, 20 bp, Artificial Sequence
  chemically synthesized
ctgcatgcaaactagcctca

SEQ ID NO: 193539 - DNA, 20 bp, Artificial Sequence
  chemically synthesized
tgcatgcaaactagcctcaa

SEQ ID NO: 193540 - DNA, 20 bp, Artificial Sequence
  chemically synthesized
ctaatattgtcctttgaggc

SEQ ID NO: 193541 - DNA, 20 bp, Artificial Sequence
  chemically synthesized
atagctaatattgtcctttg

SEQ ID NO: 193542 - DNA, 20 bp, Artificial Sequence
  chemically synthesized
tatagctaatattgtccttt

SEQ ID NO: 193543 - DNA, 20 bp, Artificial Sequence
  chemically synthesized
ctagcctcaaaggacaatat

SEQ ID NO: 193544 - DNA, 20 bp, Artificial Sequence
  chemically synthesized
ttacagaatgacaatgtata

SEQ ID NO: 193545 - DNA, 20 bp, Artificial Sequence
  chemically synthesized
atatacattgtcattctgta

SEQ ID NO: 193546 - DNA, 20 bp, Artificial Sequence
  chemically synthesized
atacattgtcattctgtaaa

SEQ ID NO: 193547 - DNA, 20 bp, Artificial Sequence
  chemically synthesized
cattgtcattctgtaaagag

SEQ ID NO: 193548 - DNA, 20 bp, Artificial Sequence
  chemically synthesized
caggtggaatcttctcttta

SEQ ID NO: 193549 - DNA, 20 bp, Artificial Sequence
  chemically synthesized
tgtaaagagaagattccacc

SEQ ID NO: 193550 - DNA, 20 bp, Artificial Sequence
  chemically synthesized
gagataaggtaagatccagg

SEQ ID NO: 193551 - DNA, 20 bp, Artificial Sequence
  chemically synthesized
tgggagataaggtaagatcc

SEQ ID NO: 193552 - DNA, 20 bp, Artificial Sequence
  chemically synthesized
ctgggagataaggtaagatc

SEQ ID NO: 193553 - DNA, 20 bp, Artificial Sequence
  chemically synthesized
tatgctctgggagataaggt

SEQ ID NO: 193554 - DNA, 20 bp, Artificial Sequence
  chemically synthesized
ctggatcttaccttatctcc

SEQ ID NO: 193555 - DNA, 20 bp, Artificial Sequence
  chemically synthesized
tagatatgctctgggagata

SEQ ID NO: 193556 - DNA, 20 bp, Artificial Sequence
  chemically synthesized
ctagatatgctctgggagat

SEQ ID NO: 193557 - DNA, 20 bp, Artificial Sequence
  chemically synthesized
ggatcttaccttatctccca

SEQ ID NO: 193558 - DNA, 20 bp, Artificial Sequence
  chemically synthesized
aaaggctagatatgctctgg

SEQ ID NO: 193559 - DNA, 20 bp, Artificial Sequence
  chemically synthesized
ggaaaggctagatatgctct

SEQ ID NO: 193560 - DNA, 20 bp, Artificial Sequence
  chemically synthesized
tggaaaggctagatatgctc

SEQ ID NO: 193561 - DNA, 20 bp, Artificial Sequence
  chemically synthesized
cttatctcccagagcatatc

SEQ ID NO: 193562 - DNA, 20 bp, Artificial Sequence
  chemically synthesized
gggagccatgttggaaaggc

SEQ ID NO: 193563 - DNA, 20 bp, Artificial Sequence
  chemically synthesized
cactgggagccatgttggaa

SEQ ID NO: 193564 - DNA, 20 bp, Artificial Sequence
  chemically synthesized
catatctagcctttccaaca

SEQ ID NO: 193565 - DNA, 20 bp, Artificial Sequence
  chemically synthesized
acactgggagccatgttgga

SEQ ID NO: 193566 - DNA, 20 bp, Artificial Sequence
  chemically synthesized
gctgacactgggagccatgt

SEQ ID NO: 193567 - DNA, 20 bp, Artificial Sequence
  chemically synthesized
agcctttccaacatggctcc

SEQ ID NO: 193568 - DNA, 20 bp, Artificial Sequence
  chemically synthesized
tccaacatggctcccagtgt

SEQ ID NO: 193569 - DNA, 20 bp, Artificial Sequence
  chemically synthesized
attcatagcgctgacactgg

SEQ ID NO: 193570 - DNA, 20 bp, Artificial Sequence
  chemically synthesized
ccattcatagcgctgacact

SEQ ID NO: 193571 - DNA, 20 bp, Artificial Sequence
  chemically synthesized
cccattcatagcgctgacac

SEQ ID NO: 193572 - DNA, 20 bp, Artificial Sequence
  chemically synthesized
cccagtgtcagcgctatgaa

SEQ ID NO: 193573 - DNA, 20 bp, Artificial Sequence
  chemically synthesized
ccagtgtcagcgctatgaat

SEQ ID NO: 193574 - DNA, 20 bp, Artificial Sequence
  chemically synthesized
tgttgcaagagacccattca

SEQ ID NO: 193575 - DNA, 20 bp, Artificial Sequence
  chemically synthesized
tatgaatgggtctcttgcaa

SEQ ID NO: 193576 - DNA, 20 bp, Artificial Sequence
  chemically synthesized
agtaatccttgctgttgcaa

SEQ ID NO: 193577 - DNA, 20 bp, Artificial Sequence
  chemically synthesized
taagtaatccttgctgttgc

SEQ ID NO: 193578 - DNA, 20 bp, Artificial Sequence
  chemically synthesized
aatgggtctcttgcaacagc

SEQ ID NO: 193579 - DNA, 20 bp, Artificial Sequence
  chemically synthesized
atgggtctcttgcaacagca

SEQ ID NO: 193580 - DNA, 20 bp, Artificial Sequence
  chemically synthesized
aacagcaaggattacttaaa

SEQ ID NO: 193581 - DNA, 20 bp, Artificial Sequence
  chemically synthesized
ttgctggtaaattgcttttt

SEQ ID NO: 193582 - DNA, 20 bp, Artificial Sequence
  chemically synthesized
ttacttaaaaagcaatttac

SEQ ID NO: 193583 - DNA, 20 bp, Artificial Sequence
  chemically synthesized
ttaaaaagcaatttaccagc

SEQ ID NO: 193584 - DNA, 20 bp, Artificial Sequence
  chemically synthesized
ataaaaagctaatttcttgc

SEQ ID NO: 193585 - DNA, 20 bp, Artificial Sequence
  chemically synthesized
gcaatttaccagcaagaaat

SEQ ID NO: 193586 - DNA, 20 bp, Artificial Sequence
  chemically synthesized
agcaagaaattagcttttta

SEQ ID NO: 193587 - DNA, 20 bp, Artificial Sequence
  chemically synthesized
gcaagaaattagctttttat

SEQ ID NO: 193588 - DNA, 20 bp, Artificial Sequence
  chemically synthesized
aataaagggtgtcctataaa

SEQ ID NO: 193589 - DNA, 20 bp, Artificial Sequence
  chemically synthesized
ctcacaccaagtttaataaa

SEQ ID NO: 193590 - DNA, 20 bp, Artificial Sequence
  chemically synthesized
tctcacaccaagtttaataa

SEQ ID NO: 193591 - DNA, 20 bp, Artificial Sequence
  chemically synthesized
atctcacaccaagtttaata

SEQ ID NO: 193592 - DNA, 20 bp, Artificial Sequence
  chemically synthesized
aggacaccctttattaaact

SEQ ID NO: 193593 - DNA, 20 bp, Artificial Sequence
  chemically synthesized
ccctttattaaacttggtgt

SEQ ID NO: 193594 - DNA, 20 bp, Artificial Sequence
  chemically synthesized
atgctagctcatctcacacc

SEQ ID NO: 193595 - DNA, 20 bp, Artificial Sequence
  chemically synthesized
tattaaacttggtgtgagat

SEQ ID NO: 193596 - DNA, 20 bp, Artificial Sequence
  chemically synthesized
aaacttggtgtgagatgagc

SEQ ID NO: 193597 - DNA, 20 bp, Artificial Sequence
  chemically synthesized
aagggggaaattcaggatgc

SEQ ID NO: 193598 - DNA, 20 bp, Artificial Sequence
  chemically synthesized
tgggctcaagggggaaattc

SEQ ID NO: 193599 - DNA, 20 bp, Artificial Sequence
  chemically synthesized
gtgggctcaagggggaaatt

SEQ ID NO: 193600 - DNA, 20 bp, Artificial Sequence
  chemically synthesized
gcatcctgaatttccccctt

SEQ ID NO: 193601 - DNA, 20 bp, Artificial Sequence
  chemically synthesized
tggtctcagtgggctcaagg

SEQ ID NO: 193602 - DNA, 20 bp, Artificial Sequence
  chemically synthesized
gtggtctcagtgggctcaag

SEQ ID NO: 193603 - DNA, 20 bp, Artificial Sequence
  chemically synthesized
cgtggtctcagtgggctcaa

SEQ ID NO: 193604 - DNA, 20 bp, Artificial Sequence
  chemically synthesized
gcgtggtctcagtgggctca

SEQ ID NO: 193605 - DNA, 20 bp, Artificial Sequence
  chemically synthesized
cgcgtggtctcagtgggctc

SEQ ID NO: 193606 - DNA, 20 bp, Artificial Sequence
  chemically synthesized
atttcccccttgagcccact

SEQ ID NO: 193607 - DNA, 20 bp, Artificial Sequence
  chemically synthesized
ttggcccgcgtggtctcagt

SEQ ID NO: 193608 - DNA, 20 bp, Artificial Sequence
  chemically synthesized
tttggcccgcgtggtctcag

SEQ ID NO: 193609 - DNA, 20 bp, Artificial Sequence
  chemically synthesized
gcttttggcccgcgtggtct

SEQ ID NO: 193610 - DNA, 20 bp, Artificial Sequence
  chemically synthesized
ttgagcccactgagaccacg

SEQ ID NO: 193611 - DNA, 20 bp, Artificial Sequence
  chemically synthesized
tgagcccactgagaccacgc

SEQ ID NO: 193612 - DNA, 20 bp, Artificial Sequence
  chemically synthesized
gaaacagcttttggcccgcg

SEQ ID NO: 193613 - DNA, 20 bp, Artificial Sequence
  chemically synthesized
actgagaccacgcgggccaa

SEQ ID NO: 193614 - DNA, 20 bp, Artificial Sequence
  chemically synthesized
atttaaaatgaaacagcttt

SEQ ID NO: 193615 - DNA, 20 bp, Artificial Sequence
  chemically synthesized
gtacagtatttaaaatgaaa

SEQ ID NO: 193616 - DNA, 20 bp, Artificial Sequence
  chemically synthesized
acgtataattttttatagta

SEQ ID NO: 193617 - DNA, 20 bp, Artificial Sequence
  chemically synthesized
ggaatacgtataatttttta

SEQ ID NO: 193618 - DNA, 20 bp, Artificial Sequence
  chemically synthesized
agaattcatcaagatcagag

SEQ ID NO: 193619 - DNA, 20 bp, Artificial Sequence
  chemically synthesized
aagaattcatcaagatcaga

SEQ ID NO: 193620 - DNA, 20 bp, Artificial Sequence
  chemically synthesized
gaaagaattcatcaagatca

SEQ ID NO: 193621 - DNA, 20 bp, Artificial Sequence
  chemically synthesized
aagaaagaattcatcaagat

SEQ ID NO: 193622 - DNA, 20 bp, Artificial Sequence
  chemically synthesized
atcccaagaaagaattcatc

SEQ ID NO: 193623 - DNA, 20 bp, Artificial Sequence
  chemically synthesized
gatcttgatgaattctttct

SEQ ID NO: 193624 - DNA, 20 bp, Artificial Sequence
  chemically synthesized
atcttgatgaattctttctt

SEQ ID NO: 193625 - DNA, 20 bp, Artificial Sequence
  chemically synthesized
ataacacatccatcccaaga

SEQ ID NO: 193626 - DNA, 20 bp, Artificial Sequence
  chemically synthesized
tgatgaattctttcttggga

SEQ ID NO: 193627 - DNA, 20 bp, Artificial Sequence
  chemically synthesized
cctaataacacatccatccc

SEQ ID NO: 193628 - DNA, 20 bp, Artificial Sequence
  chemically synthesized
tcttgggatggatgtgttat

SEQ ID NO: 193629 - DNA, 20 bp, Artificial Sequence
  chemically synthesized
cttgggatggatgtgttatt

SEQ ID NO: 193630 - DNA, 20 bp, Artificial Sequence
  chemically synthesized
ggatgtgttattaggataat

SEQ ID NO: 193631 - DNA, 20 bp, Artificial Sequence
  chemically synthesized
gatgtgttattaggataata

SEQ ID NO: 193632 - DNA, 20 bp, Artificial Sequence
  chemically synthesized
ttattaggataataaggctt

SEQ ID NO: 193633 - DNA, 20 bp, Artificial Sequence
  chemically synthesized
attaggataataaggcttga

SEQ ID NO: 193634 - DNA, 20 bp, Artificial Sequence
  chemically synthesized
tagcccattgttcaactctc

SEQ ID NO: 193635 - DNA, 20 bp, Artificial Sequence
  chemically synthesized
aaggcttgagagttgaacaa

SEQ ID NO: 193636 - DNA, 20 bp, Artificial Sequence
  chemically synthesized
aggcttgagagttgaacaat

SEQ ID NO: 193637 - DNA, 20 bp, Artificial Sequence
  chemically synthesized
ttgagagttgaacaatgggc

SEQ ID NO: 193638 - DNA, 20 bp, Artificial Sequence
  chemically synthesized
tgagagttgaacaatgggct

SEQ ID NO: 193639 - DNA, 20 bp, Artificial Sequence
  chemically synthesized
ttgaacaatgggctaggatt

SEQ ID NO: 193640 - DNA, 20 bp, Artificial Sequence
  chemically synthesized
acaggaacagtgccaaatcc

SEQ ID NO: 193641 - DNA, 20 bp, Artificial Sequence
  chemically synthesized
acatttcaggacaacaggaa

SEQ ID NO: 193642 - DNA, 20 bp, Artificial Sequence
  chemically synthesized
tcttcacatttcaggacaac

SEQ ID NO: 193643 - DNA, 20 bp, Artificial Sequence
  chemically synthesized
ttcttcacatttcaggacaa

SEQ ID NO: 193644 - DNA, 20 bp, Artificial Sequence
  chemically synthesized
tcaacatttcttcacatttc

SEQ ID NO: 193645 - DNA, 20 bp, Artificial Sequence
  chemically synthesized
tcctgttgtcctgaaatgtg

SEQ ID NO: 193646 - DNA, 20 bp, Artificial Sequence
  chemically synthesized
atcaacatttcttcacattt

SEQ ID NO: 193647 - DNA, 20 bp, Artificial Sequence
  chemically synthesized
gttgatgtaacttactcaat

SEQ ID NO: 193648 - DNA, 20 bp, Artificial Sequence
  chemically synthesized
tagggaacatctcattgagt

SEQ ID NO: 193649 - DNA, 20 bp, Artificial Sequence
  chemically synthesized
tggttagggaacatctcatt

SEQ ID NO: 193650 - DNA, 20 bp, Artificial Sequence
  chemically synthesized
atgagatgttccctaaccac

SEQ ID NO: 193651 - DNA, 20 bp, Artificial Sequence
  chemically synthesized
tgaactattcccagtggtta

SEQ ID NO: 193652 - DNA, 20 bp, Artificial Sequence
  chemically synthesized
tgagatgttccctaaccact

SEQ ID NO: 193653 - DNA, 20 bp, Artificial Sequence
  chemically synthesized
gtgaactattcccagtggtt

SEQ ID NO: 193654 - DNA, 20 bp, Artificial Sequence
  chemically synthesized
agtgaactattcccagtggt

SEQ ID NO: 193655 - DNA, 20 bp, Artificial Sequence
  chemically synthesized
tgttccctaaccactgggaa

SEQ ID NO: 193656 - DNA, 20 bp, Artificial Sequence
  chemically synthesized
aggcagtgaactattcccag

SEQ ID NO: 193657 - DNA, 20 bp, Artificial Sequence
  chemically synthesized
cccaggcagtgaactattcc

SEQ ID NO: 193658 - DNA, 20 bp, Artificial Sequence
  chemically synthesized
actgggaatagttcactgcc

SEQ ID NO: 193659 - DNA, 20 bp, Artificial Sequence
  chemically synthesized
ctgggaatagttcactgcct

SEQ ID NO: 193660 - DNA, 20 bp, Artificial Sequence
  chemically synthesized
tgggaatagttcactgcctg

SEQ ID NO: 193661 - DNA, 20 bp, Artificial Sequence
  chemically synthesized
tctcctctggtgtccccagg

SEQ ID NO: 193662 - DNA, 20 bp, Artificial Sequence
  chemically synthesized
agttctcctctggtgtcccc

SEQ ID NO: 193663 - DNA, 20 bp, Artificial Sequence
  chemically synthesized
agttcactgcctggggacac

SEQ ID NO: 193664 - DNA, 20 bp, Artificial Sequence
  chemically synthesized
tagttctcctctggtgtccc

SEQ ID NO: 193665 - DNA, 20 bp, Artificial Sequence
  chemically synthesized
ttcactgcctggggacacca

SEQ ID NO: 193666 - DNA, 20 bp, Artificial Sequence
  chemically synthesized
tcactgcctggggacaccag

SEQ ID NO: 193667 - DNA, 20 bp, Artificial Sequence
  chemically synthesized
actgcctggggacaccagag

SEQ ID NO: 193668 - DNA, 20 bp, Artificial Sequence
  chemically synthesized
ccatctctgtagttctcctc

SEQ ID NO: 193669 - DNA, 20 bp, Artificial Sequence
  chemically synthesized
gggacaccagaggagaacta

SEQ ID NO: 193670 - DNA, 20 bp, Artificial Sequence
  chemically synthesized
gacaccagaggagaactaca

SEQ ID NO: 193671 - DNA, 20 bp, Artificial Sequence
  chemically synthesized
ccagaggagaactacagaga

SEQ ID NO: 193672 - DNA, 20 bp, Artificial Sequence
  chemically synthesized
cagaggagaactacagagat

SEQ ID NO: 193673 - DNA, 20 bp, Artificial Sequence
  chemically synthesized
accaatctcccccatctctg

SEQ ID NO: 193674 - DNA, 20 bp, Artificial Sequence
  chemically synthesized
agaggagaactacagagatg

SEQ ID NO: 193675 - DNA, 20 bp, Artificial Sequence
  chemically synthesized
gaggagaactacagagatgg

SEQ ID NO: 193676 - DNA, 20 bp, Artificial Sequence
  chemically synthesized
ggagaactacagagatgggg

SEQ ID NO: 193677 - DNA, 20 bp, Artificial Sequence
  chemically synthesized
actacagagatgggggagat

SEQ ID NO: 193678 - DNA, 20 bp, Artificial Sequence
  chemically synthesized
gagatgggggagattggtga

SEQ ID NO: 193679 - DNA, 20 bp, Artificial Sequence
  chemically synthesized
gatgggggagattggtgaaa

SEQ ID NO: 193680 - DNA, 20 bp, Artificial Sequence
  chemically synthesized
ggggagattggtgaaagagc

SEQ ID NO: 193681 - DNA, 20 bp, Artificial Sequence
  chemically synthesized
gggagattggtgaaagagct

SEQ ID NO: 193682 - DNA, 20 bp, Artificial Sequence
  chemically synthesized
ggagattggtgaaagagctg

SEQ ID NO: 193683 - DNA, 20 bp, Artificial Sequence
  chemically synthesized
ggtgaaagagctggggtata

SEQ ID NO: 193684 - DNA, 20 bp, Artificial Sequence
  chemically synthesized
ttttttgtatctttataccc

SEQ ID NO: 193685 - DNA, 20 bp, Artificial Sequence
  chemically synthesized
gtataaagatacaaaaaata

SEQ ID NO: 193686 - DNA, 20 bp, Artificial Sequence
  chemically synthesized
tataataaagaaggaaaagg

SEQ ID NO: 193687 - DNA, 20 bp, Artificial Sequence
  chemically synthesized
tgatataataaagaaggaaa

SEQ ID NO: 193688 - DNA, 20 bp, Artificial Sequence
  chemically synthesized
ttgatataataaagaaggaa

SEQ ID NO: 193689 - DNA, 20 bp, Artificial Sequence
  chemically synthesized
gatatttgatataataaaga

SEQ ID NO: 193690 - DNA, 20 bp, Artificial Sequence
  chemically synthesized
tgatatttgatataataaag

SEQ ID NO: 193691 - DNA, 20 bp, Artificial Sequence
  chemically synthesized
aaatgatatttgatataata

SEQ ID NO: 193692 - DNA, 20 bp, Artificial Sequence
  chemically synthesized
gaagtactctgttattggtt

SEQ ID NO: 193693 - DNA, 20 bp, Artificial Sequence
  chemically synthesized
tcatttttctaaaccaataa

SEQ ID NO: 193694 - DNA, 20 bp, Artificial Sequence
  chemically synthesized
atttttctaaaccaataaca

SEQ ID NO: 193695 - DNA, 20 bp, Artificial Sequence
  chemically synthesized
ccacagaagtactctgttat

SEQ ID NO: 193696 - DNA, 20 bp, Artificial Sequence
  chemically synthesized
ccaataacagagtacttctg

SEQ ID NO: 193697 - DNA, 20 bp, Artificial Sequence
  chemically synthesized
caataacagagtacttctgt

SEQ ID NO: 193698 - DNA, 20 bp, Artificial Sequence
  chemically synthesized
ttttttattcgttcccacag

SEQ ID NO: 193699 - DNA, 20 bp, Artificial Sequence
  chemically synthesized
atcttttttattcgttccca

SEQ ID NO: 193700 - DNA, 20 bp, Artificial Sequence
  chemically synthesized
ttctgtgggaacgaataaaa

SEQ ID NO: 193701 - DNA, 20 bp, Artificial Sequence
  chemically synthesized
aaatggagaaataagtcatc

SEQ ID NO: 193702 - DNA, 20 bp, Artificial Sequence
  chemically synthesized
gttatataaaatggagaaat

SEQ ID NO: 193703 - DNA, 20 bp, Artificial Sequence
  chemically synthesized
actacaagttatataaaatg

SEQ ID NO: 193704 - DNA, 20 bp, Artificial Sequence
  chemically synthesized
gtactacaagttatataaaa

SEQ ID NO: 193705 - DNA, 20 bp, Artificial Sequence
  chemically synthesized
tctccattttatataacttg

SEQ ID NO: 193706 - DNA, 20 bp, Artificial Sequence
  chemically synthesized
ctacttaatgatggtactac

SEQ ID NO: 193707 - DNA, 20 bp, Artificial Sequence
  chemically synthesized
taacttgtagtaccatcatt

SEQ ID NO: 193708 - DNA, 20 bp, Artificial Sequence
  chemically synthesized
tatttaatactacttaatga

SEQ ID NO: 193709 - DNA, 20 bp, Artificial Sequence
  chemically synthesized
cttgtagtaccatcattaag

SEQ ID NO: 193710 - DNA, 20 bp, Artificial Sequence
  chemically synthesized
atcattaagtagtattaaat

SEQ ID NO: 193711 - DNA, 20 bp, Artificial Sequence
  chemically synthesized
aaataagatacccatataca

SEQ ID NO: 193712 - DNA, 20 bp, Artificial Sequence
  chemically synthesized
atttatagtaccatgtatat

SEQ ID NO: 193713 - DNA, 20 bp, Artificial Sequence
  chemically synthesized
tatttatagtaccatgtata

SEQ ID NO: 193714 - DNA, 20 bp, Artificial Sequence
  chemically synthesized
acttgtcaggaaattattta

SEQ ID NO: 193715 - DNA, 20 bp, Artificial Sequence
  chemically synthesized
actataaataatttcctgac

SEQ ID NO: 193716 - DNA, 20 bp, Artificial Sequence
  chemically synthesized
caagaagtaaaatacttgtc

SEQ ID NO: 193717 - DNA, 20 bp, Artificial Sequence
  chemically synthesized
acaagaagtaaaatacttgt

SEQ ID NO: 193718 - DNA, 20 bp, Artificial Sequence
  chemically synthesized
acttcacttcattagacaag

SEQ ID NO: 193719 - DNA, 20 bp, Artificial Sequence
  chemically synthesized
ttcacttcacttcattagac

SEQ ID NO: 193720 - DNA, 20 bp, Artificial Sequence
  chemically synthesized
attttacttcttgtctaatg

SEQ ID NO: 193721 - DNA, 20 bp, Artificial Sequence
  chemically synthesized
agtgcttcacttcacttcat

SEQ ID NO: 193722 - DNA, 20 bp, Artificial Sequence
  chemically synthesized
acttcttgtctaatgaagtg

SEQ ID NO: 193723 - DNA, 20 bp, Artificial Sequence
  chemically synthesized
ttgtctaatgaagtgaagtg

SEQ ID NO: 193724 - DNA, 20 bp, Artificial Sequence
  chemically synthesized
tgaagtgaagcactttaatg

SEQ ID NO: 193725 - DNA, 20 bp, Artificial Sequence
  chemically synthesized
gtacacccaccacttcatta

SEQ ID NO: 193726 - DNA, 20 bp, Artificial Sequence
  chemically synthesized
agtgaagcactttaatgaag

SEQ ID NO: 193727 - DNA, 20 bp, Artificial Sequence
  chemically synthesized
gaagcactttaatgaagtgg

SEQ ID NO: 193728 - DNA, 20 bp, Artificial Sequence
  chemically synthesized
aagcactttaatgaagtggt

SEQ ID NO: 193729 - DNA, 20 bp, Artificial Sequence
  chemically synthesized
taatgaagtggtgggtgtac

SEQ ID NO: 193730 - DNA, 20 bp, Artificial Sequence
  chemically synthesized
agtggtgggtgtaccagtct

SEQ ID NO: 193731 - DNA, 20 bp, Artificial Sequence
  chemically synthesized
cttcggaatgtttctgagac

SEQ ID NO: 193732 - DNA, 20 bp, Artificial Sequence
  chemically synthesized
tcagtcttcggaatgtttct

SEQ ID NO: 193733 - DNA, 20 bp, Artificial Sequence
  chemically synthesized
ccagtctcagaaacattccg

SEQ ID NO: 193734 - DNA, 20 bp, Artificial Sequence
  chemically synthesized
agacttaggaaatcagtctt

SEQ ID NO: 193735 - DNA, 20 bp, Artificial Sequence
  chemically synthesized
attccgaagactgatttcct

SEQ ID NO: 193736 - DNA, 20 bp, Artificial Sequence
  chemically synthesized
tattggaagacttaggaaat

SEQ ID NO: 193737 - DNA, 20 bp, Artificial Sequence
  chemically synthesized
taaagtttattggaagactt

SEQ ID NO: 193738 - DNA, 20 bp, Artificial Sequence
  chemically synthesized
ctaaagtttattggaagact

SEQ ID NO: 193739 - DNA, 20 bp, Artificial Sequence
  chemically synthesized
ctaaagctaaagtttattgg

SEQ ID NO: 193740 - DNA, 20 bp, Artificial Sequence
  chemically synthesized
cgtctaaagctaaagtttat

SEQ ID NO: 193741 - DNA, 20 bp, Artificial Sequence
  chemically synthesized
ctaagtcttccaataaactt

SEQ ID NO: 193742 - DNA, 20 bp, Artificial Sequence
  chemically synthesized
cttccaataaactttagctt

SEQ ID NO: 193743 - DNA, 20 bp, Artificial Sequence
  chemically synthesized
ccacccaccgtctaaagcta

SEQ ID NO: 193744 - DNA, 20 bp, Artificial Sequence
  chemically synthesized
caataaactttagctttaga

SEQ ID NO: 193745 - DNA, 20 bp, Artificial Sequence
  chemically synthesized
taaactttagctttagacgg

SEQ ID NO: 193746 - DNA, 20 bp, Artificial Sequence
  chemically synthesized
tgcaccccacccaccgtcta

SEQ ID NO: 193747 - DNA, 20 bp, Artificial Sequence
  chemically synthesized
aaactttagctttagacggt

SEQ ID NO: 193748 - DNA, 20 bp, Artificial Sequence
  chemically synthesized
ctttagctttagacggtggg

SEQ ID NO: 193749 - DNA, 20 bp, Artificial Sequence
  chemically synthesized
tttagctttagacggtgggt

SEQ ID NO: 193750 - DNA, 20 bp, Artificial Sequence
  chemically synthesized
ttagctttagacggtgggtg

SEQ ID NO: 193751 - DNA, 20 bp, Artificial Sequence
  chemically synthesized
tttagacggtgggtggggtg

SEQ ID NO: 193752 - DNA, 20 bp, Artificial Sequence
  chemically synthesized
ttagacggtgggtggggtgc

SEQ ID NO: 193753 - DNA, 20 bp, Artificial Sequence
  chemically synthesized
gacggtgggtggggtgcagg

SEQ ID NO: 193754 - DNA, 20 bp, Artificial Sequence
  chemically synthesized
gtgggtggggtgcaggtggt

SEQ ID NO: 193755 - DNA, 20 bp, Artificial Sequence
  chemically synthesized
ggtgcaggtggttagattgt

SEQ ID NO: 193756 - DNA, 20 bp, Artificial Sequence
  chemically synthesized
ggtggttagattgtcagtaa

SEQ ID NO: 193757 - DNA, 20 bp, Artificial Sequence
  chemically synthesized
gattgtcagtaaaagcacct

SEQ ID NO: 193758 - DNA, 20 bp, Artificial Sequence
  chemically synthesized
cagtaaaagcacctaagccc

SEQ ID NO: 193759 - DNA, 20 bp, Artificial Sequence
  chemically synthesized
agtaaaagcacctaagccct

SEQ ID NO: 193760 - DNA, 20 bp, Artificial Sequence
  chemically synthesized
ggagaatttacccagggctt

SEQ ID NO: 193761 - DNA, 20 bp, Artificial Sequence
  chemically synthesized
tggagaatttacccagggct

SEQ ID NO: 193762 - DNA, 20 bp, Artificial Sequence
  chemically synthesized
atgtctggagaatttaccca

SEQ ID NO: 193763 - DNA, 20 bp, Artificial Sequence
  chemically synthesized
tatgtctggagaatttaccc

SEQ ID NO: 193764 - DNA, 20 bp, Artificial Sequence
  chemically synthesized
ttatgtctggagaatttacc

SEQ ID NO: 193765 - DNA, 20 bp, Artificial Sequence
  chemically synthesized
taagccctgggtaaattctc

SEQ ID NO: 193766 - DNA, 20 bp, Artificial Sequence
  chemically synthesized
agtcagtcttattatgtctg

SEQ ID NO: 193767 - DNA, 20 bp, Artificial Sequence
  chemically synthesized
agagtcagtcttattatgtc

SEQ ID NO: 193768 - DNA, 20 bp, Artificial Sequence
  chemically synthesized
gtaaattctccagacataat

SEQ ID NO: 193769 - DNA, 20 bp, Artificial Sequence
  chemically synthesized
cataataagactgactctga

SEQ ID NO: 193770 - DNA, 20 bp, Artificial Sequence
  chemically synthesized
caacaaagatctttcagagt

SEQ ID NO: 193771 - DNA, 20 bp, Artificial Sequence
  chemically synthesized
ctttcaacaaagatctttca

SEQ ID NO: 193772 - DNA, 20 bp, Artificial Sequence
  chemically synthesized
acctttcaacaaagatcttt

SEQ ID NO: 193773 - DNA, 20 bp, Artificial Sequence
  chemically synthesized
ctctgaaagatctttgttga

SEQ ID NO: 193774 - DNA, 20 bp, Artificial Sequence
  chemically synthesized
tctgaaagatctttgttgaa

SEQ ID NO: 193775 - DNA, 20 bp, Artificial Sequence
  chemically synthesized
gtatccagcacctttcaaca

SEQ ID NO: 193776 - DNA, 20 bp, Artificial Sequence
  chemically synthesized
agatctttgttgaaaggtgc

SEQ ID NO: 193777 - DNA, 20 bp, Artificial Sequence
  chemically synthesized
agatatggcagagtggtatc

SEQ ID NO: 193778 - DNA, 20 bp, Artificial Sequence
  chemically synthesized
attacatagatatggcagag

SEQ ID NO: 193779 - DNA, 20 bp, Artificial Sequence
  chemically synthesized
actattacatagatatggca

SEQ ID NO: 193780 - DNA, 20 bp, Artificial Sequence
  chemically synthesized
atactattacatagatatgg

SEQ ID NO: 193781 - DNA, 20 bp, Artificial Sequence
  chemically synthesized
tggatactattacatagata

SEQ ID NO: 193782 - DNA, 20 bp, Artificial Sequence
  chemically synthesized
actctgccatatctatgtaa

SEQ ID NO: 193783 - DNA, 20 bp, Artificial Sequence
  chemically synthesized
gaagaatggatactattaca

SEQ ID NO: 193784 - DNA, 20 bp, Artificial Sequence
  chemically synthesized
atatatagctgttggaagaa

SEQ ID NO: 193785 - DNA, 20 bp, Artificial Sequence
  chemically synthesized
aatagtatccattcttccaa

SEQ ID NO: 193786 - DNA, 20 bp, Artificial Sequence
  chemically synthesized
tctagatatatagctgttgg

SEQ ID NO: 193787 - DNA, 20 bp, Artificial Sequence
  chemically synthesized
gattctagatatatagctgt

SEQ ID NO: 193788 - DNA, 20 bp, Artificial Sequence
  chemically synthesized
tcttccaacagctatatatc

SEQ ID NO: 193789 - DNA, 20 bp, Artificial Sequence
  chemically synthesized
cagagttgattctagatata

SEQ ID NO: 193790 - DNA, 20 bp, Artificial Sequence
  chemically synthesized
aaatattgcagagttgattc

SEQ ID NO: 193791 - DNA, 20 bp, Artificial Sequence
  chemically synthesized
ctttcatgtgaaatattgca

SEQ ID NO: 193792 - DNA, 20 bp, Artificial Sequence
  chemically synthesized
gtctttcatgtgaaatattg

SEQ ID NO: 193793 - DNA, 20 bp, Artificial Sequence
  chemically synthesized
ctctgcaatatttcacatga

SEQ ID NO: 193794 - DNA, 20 bp, Artificial Sequence
  chemically synthesized
acatgaaagactctttttct

SEQ ID NO: 193795 - DNA, 20 bp, Artificial Sequence
  chemically synthesized
aactaaatctctaagaaaaa

SEQ ID NO: 193796 - DNA, 20 bp, Artificial Sequence
  chemically synthesized
atgaaagactctttttctta

SEQ ID NO: 193797 - DNA, 20 bp, Artificial Sequence
  chemically synthesized
gaaactaaatctctaagaaa

SEQ ID NO: 193798 - DNA, 20 bp, Artificial Sequence
  chemically synthesized
gactctttttcttagagatt

SEQ ID NO: 193799 - DNA, 20 bp, Artificial Sequence
  chemically synthesized
acaatggaaactaaatctct

SEQ ID NO: 193800 - DNA, 20 bp, Artificial Sequence
  chemically synthesized
acagctacaggaaataacaa

SEQ ID NO: 193801 - DNA, 20 bp, Artificial Sequence
  chemically synthesized
gtttccattgttatttcctg

SEQ ID NO: 193802 - DNA, 20 bp, Artificial Sequence
  chemically synthesized
gacaccatccagacagctac

SEQ ID NO: 193803 - DNA, 20 bp, Artificial Sequence
  chemically synthesized
tgacaccatccagacagcta

SEQ ID NO: 193804 - DNA, 20 bp, Artificial Sequence
  chemically synthesized
tgttatttcctgtagctgtc

SEQ ID NO: 193805 - DNA, 20 bp, Artificial Sequence
  chemically synthesized
atttcctgtagctgtctgga

SEQ ID NO: 193806 - DNA, 20 bp, Artificial Sequence
  chemically synthesized
cttggttgacaccatccaga

SEQ ID NO: 193807 - DNA, 20 bp, Artificial Sequence
  chemically synthesized
tcaccttggttgacaccatc

SEQ ID NO: 193808 - DNA, 20 bp, Artificial Sequence
  chemically synthesized
ctgtctggatggtgtcaacc

SEQ ID NO: 193809 - DNA, 20 bp, Artificial Sequence
  chemically synthesized
tgtctggatggtgtcaacca

SEQ ID NO: 193810 - DNA, 20 bp, Artificial Sequence
  chemically synthesized
atttagaccaaagttcacct

SEQ ID NO: 193811 - DNA, 20 bp, Artificial Sequence
  chemically synthesized
gtgtcaaccaaggtgaactt

SEQ ID NO: 193812 - DNA, 20 bp, Artificial Sequence
  chemically synthesized
aggaaaaatcatttagacca

SEQ ID NO: 193813 - DNA, 20 bp, Artificial Sequence
  chemically synthesized
ataactgaggaaaaatcatt

SEQ ID NO: 193814 - DNA, 20 bp, Artificial Sequence
  chemically synthesized
tggtctaaatgatttttcct

SEQ ID NO: 193815 - DNA, 20 bp, Artificial Sequence
  chemically synthesized
ttcacactacttaataactg

SEQ ID NO: 193816 - DNA, 20 bp, Artificial Sequence
  chemically synthesized
atgatttttcctcagttatt

SEQ ID NO: 193817 - DNA, 20 bp, Artificial Sequence
  chemically synthesized
cttcacactacttaataact

SEQ ID NO: 193818 - DNA, 20 bp, Artificial Sequence
  chemically synthesized
atttttcctcagttattaag

SEQ ID NO: 193819 - DNA, 20 bp, Artificial Sequence
  chemically synthesized
ctcagttattaagtagtgtg

SEQ ID NO: 193820 - DNA, 20 bp, Artificial Sequence
  chemically synthesized
aaaaataataaaataaatgt

SEQ ID NO: 193821 - DNA, 20 bp, Artificial Sequence
  chemically synthesized
aaaataataaaataaatgtt

SEQ ID NO: 193822 - DNA, 20 bp, Artificial Sequence
  chemically synthesized
aaaataaatgttgggaaatt

SEQ ID NO: 193823 - DNA, 20 bp, Artificial Sequence
  chemically synthesized
aataaatgttgggaaattga

SEQ ID NO: 193824 - DNA, 20 bp, Artificial Sequence
  chemically synthesized
ataaatgttgggaaattgag

SEQ ID NO: 193825 - DNA, 20 bp, Artificial Sequence
  chemically synthesized
aattgagaggtatgctgctt

SEQ ID NO: 193826 - DNA, 20 bp, Artificial Sequence
  chemically synthesized
aatagattccataactgaag

SEQ ID NO: 193827 - DNA, 20 bp, Artificial Sequence
  chemically synthesized
gaggtatgctgcttcagtta

SEQ ID NO: 193828 - DNA, 20 bp, Artificial Sequence
  chemically synthesized
tgaaatagattccataactg

SEQ ID NO: 193829 - DNA, 20 bp, Artificial Sequence
  chemically synthesized
aataactattttatgtgaaa

SEQ ID NO: 193830 - DNA, 20 bp, Artificial Sequence
  chemically synthesized
ggaatctatttcacataaaa

SEQ ID NO: 193831 - DNA, 20 bp, Artificial Sequence
  chemically synthesized
tcacataaaatagttattcc

SEQ ID NO: 193832 - DNA, 20 bp, Artificial Sequence
  chemically synthesized
tttattattatttttagact

SEQ ID NO: 193833 - DNA, 20 bp, Artificial Sequence
  chemically synthesized
tttggatttattattatttt

SEQ ID NO: 193834 - DNA, 20 bp, Artificial Sequence
  chemically synthesized
cacatccgatattttggttt

SEQ ID NO: 193835 - DNA, 20 bp, Artificial Sequence
  chemically synthesized
taaatccaaaaccaaaatat

SEQ ID NO: 193836 - DNA, 20 bp, Artificial Sequence
  chemically synthesized
aaactacacatccgatattt

SEQ ID NO: 193837 - DNA, 20 bp, Artificial Sequence
  chemically synthesized
aaaccaaaatatcggatgtg

SEQ ID NO: 193838 - DNA, 20 bp, Artificial Sequence
  chemically synthesized
tcggatgtgtagttttaatc

SEQ ID NO: 193839 - DNA, 20 bp, Artificial Sequence
  chemically synthesized
tcaagcaaataaatgtttta

SEQ ID NO: 193840 - DNA, 20 bp, Artificial Sequence
  chemically synthesized
caagcaaataaatgttttat

SEQ ID NO: 193841 - DNA, 20 bp, Artificial Sequence
  chemically synthesized
aagcaaataaatgttttata

SEQ ID NO: 193842 - DNA, 20 bp, Artificial Sequence
  chemically synthesized
ttttatagggccttttgatt

SEQ ID NO: 193843 - DNA, 20 bp, Artificial Sequence
  chemically synthesized
actgtgagctcttaatcaaa

SEQ ID NO: 193844 - DNA, 20 bp, Artificial Sequence
  chemically synthesized
cactgtgagctcttaatcaa

SEQ ID NO: 193845 - DNA, 20 bp, Artificial Sequence
  chemically synthesized
ttatagggccttttgattaa

SEQ ID NO: 193846 - DNA, 20 bp, Artificial Sequence
  chemically synthesized
gccttttgattaagagctca

SEQ ID NO: 193847 - DNA, 20 bp, Artificial Sequence
  chemically synthesized
tttgattaagagctcacagt

SEQ ID NO: 193848 - DNA, 20 bp, Artificial Sequence
  chemically synthesized
ttactaaaaagtctcactgt

SEQ ID NO: 193849 - DNA, 20 bp, Artificial Sequence
  chemically synthesized
gagctcacagtgagactttt

SEQ ID NO: 193850 - DNA, 20 bp, Artificial Sequence
  chemically synthesized
cacggttataaattactaaa

SEQ ID NO: 193851 - DNA, 20 bp, Artificial Sequence
  chemically synthesized
attagtgtggaaagtattca

SEQ ID NO: 193852 - DNA, 20 bp, Artificial Sequence
  chemically synthesized
ttctgataaattagtgtgga

SEQ ID NO: 193853 - DNA, 20 bp, Artificial Sequence
  chemically synthesized
aggcttctgataaattagtg

SEQ ID NO: 193854 - DNA, 20 bp, Artificial Sequence
  chemically synthesized
tactttccacactaatttat

SEQ ID NO: 193855 - DNA, 20 bp, Artificial Sequence
  chemically synthesized
aataaaggcttctgataaat

SEQ ID NO: 193856 - DNA, 20 bp, Artificial Sequence
  chemically synthesized
tttccacactaatttatcag

SEQ ID NO: 193857 - DNA, 20 bp, Artificial Sequence
  chemically synthesized
tctggaaaatgtagtaataa

SEQ ID NO: 193858 - DNA, 20 bp, Artificial Sequence
  chemically synthesized
ttctggaaaatgtagtaata

SEQ ID NO: 193859 - DNA, 20 bp, Artificial Sequence
  chemically synthesized
gcctttattactacattttc

SEQ ID NO: 193860 - DNA, 20 bp, Artificial Sequence
  chemically synthesized
cttgaaaattctggaaaatg

SEQ ID NO: 193861 - DNA, 20 bp, Artificial Sequence
  chemically synthesized
cacatcccccttgaaaattc

SEQ ID NO: 193862 - DNA, 20 bp, Artificial Sequence
  chemically synthesized
ctacattttccagaattttc

SEQ ID NO: 193863 - DNA, 20 bp, Artificial Sequence
  chemically synthesized
tacattttccagaattttca

SEQ ID NO: 193864 - DNA, 20 bp, Artificial Sequence
  chemically synthesized
acattttccagaattttcaa

SEQ ID NO: 193865 - DNA, 20 bp, Artificial Sequence
  chemically synthesized
cattttccagaattttcaag

SEQ ID NO: 193866 - DNA, 20 bp, Artificial Sequence
  chemically synthesized
attttccagaattttcaagg

SEQ ID NO: 193867 - DNA, 20 bp, Artificial Sequence
  chemically synthesized
cagaattttcaagggggatg

SEQ ID NO: 193868 - DNA, 20 bp, Artificial Sequence
  chemically synthesized
aattttcaagggggatgtgg

SEQ ID NO: 193869 - DNA, 20 bp, Artificial Sequence
  chemically synthesized
attttcaagggggatgtggt

SEQ ID NO: 193870 - DNA, 20 bp, Artificial Sequence
  chemically synthesized
gggggatgtggtgggatgaa

SEQ ID NO: 193871 - DNA, 20 bp, Artificial Sequence
  chemically synthesized
gatgaatagtttcccctgaa

SEQ ID NO: 193872 - DNA, 20 bp, Artificial Sequence
  chemically synthesized
agggacatgtgactattcag

SEQ ID NO: 193873 - DNA, 20 bp, Artificial Sequence
  chemically synthesized
cagggacatgtgactattca

SEQ ID NO: 193874 - DNA, 20 bp, Artificial Sequence
  chemically synthesized
tcagggacatgtgactattc

SEQ ID NO: 193875 - DNA, 20 bp, Artificial Sequence
  chemically synthesized
ttcagggacatgtgactatt

SEQ ID NO: 193876 - DNA, 20 bp, Artificial Sequence
  chemically synthesized
tggtgacattcaaggtttca

SEQ ID NO: 193877 - DNA, 20 bp, Artificial Sequence
  chemically synthesized
ctggtgacattcaaggtttc

SEQ ID NO: 193878 - DNA, 20 bp, Artificial Sequence
  chemically synthesized
tctggtgacattcaaggttt

SEQ ID NO: 193879 - DNA, 20 bp, Artificial Sequence
  chemically synthesized
tccaaatctggtgacattca

SEQ ID NO: 193880 - DNA, 20 bp, Artificial Sequence
  chemically synthesized
ttccaaatctggtgacattc

SEQ ID NO: 193881 - DNA, 20 bp, Artificial Sequence
  chemically synthesized
cctgaaaccttgaatgtcac

SEQ ID NO: 193882 - DNA, 20 bp, Artificial Sequence
  chemically synthesized
accttgaatgtcaccagatt

SEQ ID NO: 193883 - DNA, 20 bp, Artificial Sequence
  chemically synthesized
aaagaccctatttccaaatc

SEQ ID NO: 193884 - DNA, 20 bp, Artificial Sequence
  chemically synthesized
aatgtcaccagatttggaaa

SEQ ID NO: 193885 - DNA, 20 bp, Artificial Sequence
  chemically synthesized
atgtcaccagatttggaaat

SEQ ID NO: 193886 - DNA, 20 bp, Artificial Sequence
  chemically synthesized
tgtcaccagatttggaaata

SEQ ID NO: 193887 - DNA, 20 bp, Artificial Sequence
  chemically synthesized
atttggaaatagggtctttg

SEQ ID NO: 193888 - DNA, 20 bp, Artificial Sequence
  chemically synthesized
cttaactaattacatcttca

SEQ ID NO: 193889 - DNA, 20 bp, Artificial Sequence
  chemically synthesized
agggtctttgaagatgtaat

SEQ ID NO: 193890 - DNA, 20 bp, Artificial Sequence
  chemically synthesized
ctttgaagatgtaattagtt

SEQ ID NO: 193891 - DNA, 20 bp, Artificial Sequence
  chemically synthesized
aaatgacatcaccatgaatt

SEQ ID NO: 193892 - DNA, 20 bp, Artificial Sequence
  chemically synthesized
aatgacatcaccatgaattt

SEQ ID NO: 193893 - DNA, 20 bp, Artificial Sequence
  chemically synthesized
tagagcccaccctaaattca

SEQ ID NO: 193894 - DNA, 20 bp, Artificial Sequence
  chemically synthesized
atgacatcaccatgaattta

SEQ ID NO: 193895 - DNA, 20 bp, Artificial Sequence
  chemically synthesized
acatcaccatgaatttaggg

SEQ ID NO: 193896 - DNA, 20 bp, Artificial Sequence
  chemically synthesized
catcaccatgaatttagggt

SEQ ID NO: 193897 - DNA, 20 bp, Artificial Sequence
  chemically synthesized
gacaccagtctttggattta

SEQ ID NO: 193898 - DNA, 20 bp, Artificial Sequence
  chemically synthesized
tagggtgggctctaaatcca

SEQ ID NO: 193899 - DNA, 20 bp, Artificial Sequence
  chemically synthesized
aggacaccagtctttggatt

SEQ ID NO: 193900 - DNA, 20 bp, Artificial Sequence
  chemically synthesized
tgggctctaaatccaaagac

SEQ ID NO: 193901 - DNA, 20 bp, Artificial Sequence
  chemically synthesized
cgcaaaaggacaccagtctt

SEQ ID NO: 193902 - DNA, 20 bp, Artificial Sequence
  chemically synthesized
atagtgccgcaaaaggacac

SEQ ID NO: 193903 - DNA, 20 bp, Artificial Sequence
  chemically synthesized
caaagactggtgtccttttg

SEQ ID NO: 193904 - DNA, 20 bp, Artificial Sequence
  chemically synthesized
attgtgaatagtgccgcaaa

SEQ ID NO: 193905 - DNA, 20 bp, Artificial Sequence
  chemically synthesized
tattgtgaatagtgccgcaa

SEQ ID NO: 193906 - DNA, 20 bp, Artificial Sequence
  chemically synthesized
ttttgcggcactattcacaa

SEQ ID NO: 193907 - DNA, 20 bp, Artificial Sequence
  chemically synthesized
caagtctttgctattgtgaa

SEQ ID NO: 193908 - DNA, 20 bp, Artificial Sequence
  chemically synthesized
cggcactattcacaatagca

SEQ ID NO: 193909 - DNA, 20 bp, Artificial Sequence
  chemically synthesized
tattcacaatagcaaagact

SEQ ID NO: 193910 - DNA, 20 bp, Artificial Sequence
  chemically synthesized
tggacatttgggttggttcc

SEQ ID NO: 193911 - DNA, 20 bp, Artificial Sequence
  chemically synthesized
tcattgttggacatttgggt

SEQ ID NO: 193912 - DNA, 20 bp, Artificial Sequence
  chemically synthesized
tctatcattgttggacattt

SEQ ID NO: 193913 - DNA, 20 bp, Artificial Sequence
  chemically synthesized
gtctatcattgttggacatt

SEQ ID NO: 193914 - DNA, 20 bp, Artificial Sequence
  chemically synthesized
acccaaatgtccaacaatga

SEQ ID NO: 193915 - DNA, 20 bp, Artificial Sequence
  chemically synthesized
ttaatccagtctatcattgt

SEQ ID NO: 193916 - DNA, 20 bp, Artificial Sequence
  chemically synthesized
aatgtccaacaatgatagac

SEQ ID NO: 193917 - DNA, 20 bp, Artificial Sequence
  chemically synthesized
caacaatgatagactggatt

SEQ ID NO: 193918 - DNA, 20 bp, Artificial Sequence
  chemically synthesized
tgtgccacattttcttaatc

SEQ ID NO: 193919 - DNA, 20 bp, Artificial Sequence
  chemically synthesized
tagactggattaagaaaatg

SEQ ID NO: 193920 - DNA, 20 bp, Artificial Sequence
  chemically synthesized
aatgtggcacatatacacca

SEQ ID NO: 193921 - DNA, 20 bp, Artificial Sequence
  chemically synthesized
tatggctgcatagtattcca

SEQ ID NO: 193922 - DNA, 20 bp, Artificial Sequence
  chemically synthesized
atacaccatggaatactatg

SEQ ID NO: 193923 - DNA, 20 bp, Artificial Sequence
  chemically synthesized
atcatttttttatggctgca

SEQ ID NO: 193924 - DNA, 20 bp, Artificial Sequence
  chemically synthesized
atgaactcatcattttttta

SEQ ID NO: 193925 - DNA, 20 bp, Artificial Sequence
  chemically synthesized
tgcagccataaaaaaatgat

SEQ ID NO: 193926 - DNA, 20 bp, Artificial Sequence
  chemically synthesized
tgatgagttcatgttctttg

SEQ ID NO: 193927 - DNA, 20 bp, Artificial Sequence
  chemically synthesized
atgagttcatgttctttgta

SEQ ID NO: 193928 - DNA, 20 bp, Artificial Sequence
  chemically synthesized
atttcatccatgtctctaca

SEQ ID NO: 193929 - DNA, 20 bp, Artificial Sequence
  chemically synthesized
tcatgttctttgtagagaca

SEQ ID NO: 193930 - DNA, 20 bp, Artificial Sequence
  chemically synthesized
tgtagagacatggatgaaat

SEQ ID NO: 193931 - DNA, 20 bp, Artificial Sequence
  chemically synthesized
aaattggaaatcatcattct

SEQ ID NO: 193932 - DNA, 20 bp, Artificial Sequence
  chemically synthesized
tgttcttgcgatagtttact

SEQ ID NO: 193933 - DNA, 20 bp, Artificial Sequence
  chemically synthesized
cattctcagtaaactatcgc

SEQ ID NO: 193934 - DNA, 20 bp, Artificial Sequence
  chemically synthesized
ttggttttttgttcttgcga

SEQ ID NO: 193935 - DNA, 20 bp, Artificial Sequence
  chemically synthesized
gagtgagagtatgcagtgtt

SEQ ID NO: 193936 - DNA, 20 bp, Artificial Sequence
  chemically synthesized
cacctgtgagtgagagtatg

SEQ ID NO: 193937 - DNA, 20 bp, Artificial Sequence
  chemically synthesized
acactgcatactctcactca

SEQ ID NO: 193938 - DNA, 20 bp, Artificial Sequence
  chemically synthesized
caattcccacctgtgagtga

SEQ ID NO: 193939 - DNA, 20 bp, Artificial Sequence
  chemically synthesized
cactgcatactctcactcac

SEQ ID NO: 193940 - DNA, 20 bp, Artificial Sequence
  chemically synthesized
ttcaattcccacctgtgagt

SEQ ID NO: 193941 - DNA, 20 bp, Artificial Sequence
  chemically synthesized
tgcatactctcactcacagg

SEQ ID NO: 193942 - DNA, 20 bp, Artificial Sequence
  chemically synthesized
gcatactctcactcacaggt

SEQ ID NO: 193943 - DNA, 20 bp, Artificial Sequence
  chemically synthesized
attgttcaattcccacctgt

SEQ ID NO: 193944 - DNA, 20 bp, Artificial Sequence
  chemically synthesized
acaggtgggaattgaacaat

SEQ ID NO: 193945 - DNA, 20 bp, Artificial Sequence
  chemically synthesized
aattgaacaatgagaacaca

SEQ ID NO: 193946 - DNA, 20 bp, Artificial Sequence
  chemically synthesized
acaatgagaacacatggaca

SEQ ID NO: 193947 - DNA, 20 bp, Artificial Sequence
  chemically synthesized
caatgagaacacatggacac

SEQ ID NO: 193948 - DNA, 20 bp, Artificial Sequence
  chemically synthesized
agaacacatggacacaggaa

SEQ ID NO: 193949 - DNA, 20 bp, Artificial Sequence
  chemically synthesized
gaacacatggacacaggaat

SEQ ID NO: 193950 - DNA, 20 bp, Artificial Sequence
  chemically synthesized
ggaatgggaacatcacactc

SEQ ID NO: 193951 - DNA, 20 bp, Artificial Sequence
  chemically synthesized
gaatgggaacatcacactct

SEQ ID NO: 193952 - DNA, 20 bp, Artificial Sequence
  chemically synthesized
aatgggaacatcacactctg

SEQ ID NO: 193953 - DNA, 20 bp, Artificial Sequence
  chemically synthesized
ccaccccacaacagtcccca

SEQ ID NO: 193954 - DNA, 20 bp, Artificial Sequence
  chemically synthesized
ccccaccccacaacagtccc

SEQ ID NO: 193955 - DNA, 20 bp, Artificial Sequence
  chemically synthesized
tcacactctggggactgttg

SEQ ID NO: 193956 - DNA, 20 bp, Artificial Sequence
  chemically synthesized
cacactctggggactgttgt

SEQ ID NO: 193957 - DNA, 20 bp, Artificial Sequence
  chemically synthesized
acactctggggactgttgtg

SEQ ID NO: 193958 - DNA, 20 bp, Artificial Sequence
  chemically synthesized
cccctccccccaccccacaa

SEQ ID NO: 193959 - DNA, 20 bp, Artificial Sequence
  chemically synthesized
ctctggggactgttgtgggg

SEQ ID NO: 193960 - DNA, 20 bp, Artificial Sequence
  chemically synthesized
tctggggactgttgtggggt

SEQ ID NO: 193961 - DNA, 20 bp, Artificial Sequence
  chemically synthesized
ctggggactgttgtggggtg

SEQ ID NO: 193962 - DNA, 20 bp, Artificial Sequence
  chemically synthesized
tggggactgttgtggggtgg

SEQ ID NO: 193963 - DNA, 20 bp, Artificial Sequence
  chemically synthesized
ggggactgttgtggggtggg

SEQ ID NO: 193964 - DNA, 20 bp, Artificial Sequence
  chemically synthesized
ggactgttgtggggtggggg

SEQ ID NO: 193965 - DNA, 20 bp, Artificial Sequence
  chemically synthesized
gactgttgtggggtgggggg

SEQ ID NO: 193966 - DNA, 20 bp, Artificial Sequence
  chemically synthesized
actgttgtggggtgggggga

SEQ ID NO: 193967 - DNA, 20 bp, Artificial Sequence
  chemically synthesized
ctgttgtggggtggggggag

SEQ ID NO: 193968 - DNA, 20 bp, Artificial Sequence
  chemically synthesized
tgttgtggggtggggggagg

SEQ ID NO: 193969 - DNA, 20 bp, Artificial Sequence
  chemically synthesized
gttgtggggtggggggaggg

SEQ ID NO: 193970 - DNA, 20 bp, Artificial Sequence
  chemically synthesized
ttgtggggtggggggagggg

SEQ ID NO: 193971 - DNA, 20 bp, Artificial Sequence
  chemically synthesized
gtggggtggggggagggggg

SEQ ID NO: 193972 - DNA, 20 bp, Artificial Sequence
  chemically synthesized
tggggtggggggaggggggg

SEQ ID NO: 193973 - DNA, 20 bp, Artificial Sequence
  chemically synthesized
ggggtggggggaggggggga

SEQ ID NO: 193974 - DNA, 20 bp, Artificial Sequence
  chemically synthesized
tggggggagggggggaggga

SEQ ID NO: 193975 - DNA, 20 bp, Artificial Sequence
  chemically synthesized
gagggggggagggatagcat

SEQ ID NO: 193976 - DNA, 20 bp, Artificial Sequence
  chemically synthesized
agggggggagggatagcatt

SEQ ID NO: 193977 - DNA, 20 bp, Artificial Sequence
  chemically synthesized
ggggggagggatagcattag

SEQ ID NO: 193978 - DNA, 20 bp, Artificial Sequence
  chemically synthesized
ttagctcatcatttagcatt

SEQ ID NO: 193979 - DNA, 20 bp, Artificial Sequence
  chemically synthesized
attagctcatcatttagcat

SEQ ID NO: 193980 - DNA, 20 bp, Artificial Sequence
  chemically synthesized
tatacctaatgctaaatgat

SEQ ID NO: 193981 - DNA, 20 bp, Artificial Sequence
  chemically synthesized
gcacccattagctcatcatt

SEQ ID NO: 193982 - DNA, 20 bp, Artificial Sequence
  chemically synthesized
aatgctaaatgatgagctaa

SEQ ID NO: 193983 - DNA, 20 bp, Artificial Sequence
  chemically synthesized
atgctaaatgatgagctaat

SEQ ID NO: 193984 - DNA, 20 bp, Artificial Sequence
  chemically synthesized
aaatgatgagctaatgggtg

SEQ ID NO: 193985 - DNA, 20 bp, Artificial Sequence
  chemically synthesized
tgctggtgtgctgcacccat

SEQ ID NO: 193986 - DNA, 20 bp, Artificial Sequence
  chemically synthesized
agctaatgggtgcagcacac

SEQ ID NO: 193987 - DNA, 20 bp, Artificial Sequence
  chemically synthesized
atgggtgcagcacaccagca

SEQ ID NO: 193988 - DNA, 20 bp, Artificial Sequence
  chemically synthesized
tatgtatgcatgtgccatgc

SEQ ID NO: 193989 - DNA, 20 bp, Artificial Sequence
  chemically synthesized
catgtgcacaatgtgcaggt

SEQ ID NO: 193990 - DNA, 20 bp, Artificial Sequence
  chemically synthesized
ggtacatgtgcacaatgtgc

SEQ ID NO: 193991 - DNA, 20 bp, Artificial Sequence
  chemically synthesized
gggtacatgtgcacaatgtg

SEQ ID NO: 193992 - DNA, 20 bp, Artificial Sequence
  chemically synthesized
ttattatactttaagtttta

SEQ ID NO: 193993 - DNA, 20 bp, Artificial Sequence
  chemically synthesized
attattatactttaagtttt

SEQ ID NO: 193994 - DNA, 20 bp, Artificial Sequence
  chemically synthesized
cacatgtaccctaaaactta

SEQ ID NO: 193995 - DNA, 20 bp, Artificial Sequence
  chemically synthesized
tattattatactttaagttt

SEQ ID NO: 193996 - DNA, 20 bp, Artificial Sequence
  chemically synthesized
tattattattattatacttt

SEQ ID NO: 193997 - DNA, 20 bp, Artificial Sequence
  chemically synthesized
taataataataataataata

SEQ ID NO: 193998 - DNA, 20 bp, Artificial Sequence
  chemically synthesized
ataataataataataaagaa

SEQ ID NO: 193999 - DNA, 20 bp, Artificial Sequence
  chemically synthesized
aataataataataaagaaaa

SEQ ID NO: 194000 - DNA, 20 bp, Artificial Sequence
  chemically synthesized
aataataataaagaaaagag

SEQ ID NO: 194001 - DNA, 20 bp, Artificial Sequence
  chemically synthesized
aataaagaaaagagtggaca

SEQ ID NO: 194002 - DNA, 20 bp, Artificial Sequence
  chemically synthesized
aagaaaagagtggacacaga

SEQ ID NO: 194003 - DNA, 20 bp, Artificial Sequence
  chemically synthesized
tggacacagaaagacacaca

SEQ ID NO: 194004 - DNA, 20 bp, Artificial Sequence
  chemically synthesized
acacagaaagacacacaaag

SEQ ID NO: 194005 - DNA, 20 bp, Artificial Sequence
  chemically synthesized
acagaaagacacacaaagaa

SEQ ID NO: 194006 - DNA, 20 bp, Artificial Sequence
  chemically synthesized
cagaaagacacacaaagaag

SEQ ID NO: 194007 - DNA, 20 bp, Artificial Sequence
  chemically synthesized
agaaagacacacaaagaaga

SEQ ID NO: 194008 - DNA, 20 bp, Artificial Sequence
  chemically synthesized
cacaaagaagagggttatgt

SEQ ID NO: 194009 - DNA, 20 bp, Artificial Sequence
  chemically synthesized
acaaagaagagggttatgtg

SEQ ID NO: 194010 - DNA, 20 bp, Artificial Sequence
  chemically synthesized
agaagagggttatgtgaggt

SEQ ID NO: 194011 - DNA, 20 bp, Artificial Sequence
  chemically synthesized
gaagagggttatgtgaggtc

SEQ ID NO: 194012 - DNA, 20 bp, Artificial Sequence
  chemically synthesized
agagggttatgtgaggtcag

SEQ ID NO: 194013 - DNA, 20 bp, Artificial Sequence
  chemically synthesized
gggttatgtgaggtcaggag

SEQ ID NO: 194014 - DNA, 20 bp, Artificial Sequence
  chemically synthesized
tccttgatttcaagcagcac

SEQ ID NO: 194015 - DNA, 20 bp, Artificial Sequence
  chemically synthesized
aggtgttccttgatttcaag

SEQ ID NO: 194016 - DNA, 20 bp, Artificial Sequence
  chemically synthesized
aacttgtgctgcttgaaatc

SEQ ID NO: 194017 - DNA, 20 bp, Artificial Sequence
  chemically synthesized
acttgtgctgcttgaaatca

SEQ ID NO: 194018 - DNA, 20 bp, Artificial Sequence
  chemically synthesized
cccaggtgttccttgatttc

SEQ ID NO: 194019 - DNA, 20 bp, Artificial Sequence
  chemically synthesized
gcttgaaatcaaggaacacc

SEQ ID NO: 194020 - DNA, 20 bp, Artificial Sequence
  chemically synthesized
cttgaaatcaaggaacacct

SEQ ID NO: 194021 - DNA, 20 bp, Artificial Sequence
  chemically synthesized
ttgaaatcaaggaacacctg

SEQ ID NO: 194022 - DNA, 20 bp, Artificial Sequence
  chemically synthesized
ttccagcttctggtagcccc

SEQ ID NO: 194023 - DNA, 20 bp, Artificial Sequence
  chemically synthesized
caaggaacacctggggctac

SEQ ID NO: 194024 - DNA, 20 bp, Artificial Sequence
  chemically synthesized
cttccagcttctggtagccc

SEQ ID NO: 194025 - DNA, 20 bp, Artificial Sequence
  chemically synthesized
ggaacacctggggctaccag

SEQ ID NO: 194026 - DNA, 20 bp, Artificial Sequence
  chemically synthesized
ttgcctcttccagcttctgg

SEQ ID NO: 194027 - DNA, 20 bp, Artificial Sequence
  chemically synthesized
cacctggggctaccagaagc

SEQ ID NO: 194028 - DNA, 20 bp, Artificial Sequence
  chemically synthesized
tccttgcctcttccagcttc

SEQ ID NO: 194029 - DNA, 20 bp, Artificial Sequence
  chemically synthesized
ctggggctaccagaagctgg

SEQ ID NO: 194030 - DNA, 20 bp, Artificial Sequence
  chemically synthesized
ggggctaccagaagctggaa

SEQ ID NO: 194031 - DNA, 20 bp, Artificial Sequence
  chemically synthesized
gggctaccagaagctggaag

SEQ ID NO: 194032 - DNA, 20 bp, Artificial Sequence
  chemically synthesized
gaattcttccttgcctcttc

SEQ ID NO: 194033 - DNA, 20 bp, Artificial Sequence
  chemically synthesized
taccagaagctggaagaggc

SEQ ID NO: 194034 - DNA, 20 bp, Artificial Sequence
  chemically synthesized
accagaagctggaagaggca

SEQ ID NO: 194035 - DNA, 20 bp, Artificial Sequence
  chemically synthesized
agaagctggaagaggcaagg

SEQ ID NO: 194036 - DNA, 20 bp, Artificial Sequence
  chemically synthesized
ggcaaggaagaattcttccc

SEQ ID NO: 194037 - DNA, 20 bp, Artificial Sequence
  chemically synthesized
caaggaagaattcttcccca

SEQ ID NO: 194038 - DNA, 20 bp, Artificial Sequence
  chemically synthesized
tccctctgaaggctctgggg

SEQ ID NO: 194039 - DNA, 20 bp, Artificial Sequence
  chemically synthesized
ttatccctctgaaggctctg

SEQ ID NO: 194040 - DNA, 20 bp, Artificial Sequence
  chemically synthesized
attatccctctgaaggctct

SEQ ID NO: 194041 - DNA, 20 bp, Artificial Sequence
  chemically synthesized
gaattcttccccagagcctt

SEQ ID NO: 194042 - DNA, 20 bp, Artificial Sequence
  chemically synthesized
aattatccctctgaaggctc

SEQ ID NO: 194043 - DNA, 20 bp, Artificial Sequence
  chemically synthesized
attcttccccagagccttca

SEQ ID NO: 194044 - DNA, 20 bp, Artificial Sequence
  chemically synthesized
ttcttccccagagccttcag

SEQ ID NO: 194045 - DNA, 20 bp, Artificial Sequence
  chemically synthesized
tcttccccagagccttcaga

SEQ ID NO: 194046 - DNA, 20 bp, Artificial Sequence
  chemically synthesized
aaggtcaattatccctctga

SEQ ID NO: 194047 - DNA, 20 bp, Artificial Sequence
  chemically synthesized
caaggtcaattatccctctg

SEQ ID NO: 194048 - DNA, 20 bp, Artificial Sequence
  chemically synthesized
gggataattgaccttgattt

SEQ ID NO: 194049 - DNA, 20 bp, Artificial Sequence
  chemically synthesized
aagctaggtgtccaaaatca

SEQ ID NO: 194050 - DNA, 20 bp, Artificial Sequence
  chemically synthesized
gaagctaggtgtccaaaatc

SEQ ID NO: 194051 - DNA, 20 bp, Artificial Sequence
  chemically synthesized
tgaccttgattttggacacc

SEQ ID NO: 194052 - DNA, 20 bp, Artificial Sequence
  chemically synthesized
gattttggacacctagcttc

SEQ ID NO: 194053 - DNA, 20 bp, Artificial Sequence
  chemically synthesized
ctctcacaaatctggaagct

SEQ ID NO: 194054 - DNA, 20 bp, Artificial Sequence
  chemically synthesized
tctctcacaaatctggaagc

SEQ ID NO: 194055 - DNA, 20 bp, Artificial Sequence
  chemically synthesized
ttattctctcacaaatctgg

SEQ ID NO: 194056 - DNA, 20 bp, Artificial Sequence
  chemically synthesized
cacctagcttccagatttgt

SEQ ID NO: 194057 - DNA, 20 bp, Artificial Sequence
  chemically synthesized
catttattctctcacaaatc

SEQ ID NO: 194058 - DNA, 20 bp, Artificial Sequence
  chemically synthesized
cctagcttccagatttgtga

SEQ ID NO: 194059 - DNA, 20 bp, Artificial Sequence
  chemically synthesized
tgagagaataaatgtctatt

SEQ ID NO: 194060 - DNA, 20 bp, Artificial Sequence
  chemically synthesized
ccacaagctgggtggcttaa

SEQ ID NO: 194061 - DNA, 20 bp, Artificial Sequence
  chemically synthesized
taaatgtctattaagccacc

SEQ ID NO: 194062 - DNA, 20 bp, Artificial Sequence
  chemically synthesized
acaaattaccacaagctggg

SEQ ID NO: 194063 - DNA, 20 bp, Artificial Sequence
  chemically synthesized
ctattaagccacccagcttg

SEQ ID NO: 194064 - DNA, 20 bp, Artificial Sequence
  chemically synthesized
gtaacaaattaccacaagct

SEQ ID NO: 194065 - DNA, 20 bp, Artificial Sequence
  chemically synthesized
tgtaacaaattaccacaagc

SEQ ID NO: 194066 - DNA, 20 bp, Artificial Sequence
  chemically synthesized
cagatgtaacaaattaccac

SEQ ID NO: 194067 - DNA, 20 bp, Artificial Sequence
  chemically synthesized
gtaatttgttacatctgtgt

SEQ ID NO: 194068 - DNA, 20 bp, Artificial Sequence
  chemically synthesized
taatttgttacatctgtgtt

SEQ ID NO: 194069 - DNA, 20 bp, Artificial Sequence
  chemically synthesized
cctgcaattgtttcctaaca

SEQ ID NO: 194070 - DNA, 20 bp, Artificial Sequence
  chemically synthesized
tctgtgttaggaaacaattg

SEQ ID NO: 194071 - DNA, 20 bp, Artificial Sequence
  chemically synthesized
ctgtgttaggaaacaattgc

SEQ ID NO: 194072 - DNA, 20 bp, Artificial Sequence
  chemically synthesized
tgtgttaggaaacaattgca

SEQ ID NO: 194073 - DNA, 20 bp, Artificial Sequence
  chemically synthesized
tgttaggaaacaattgcagg

SEQ ID NO: 194074 - DNA, 20 bp, Artificial Sequence
  chemically synthesized
ggaaacaattgcagggagta

SEQ ID NO: 194075 - DNA, 20 bp, Artificial Sequence
  chemically synthesized
tcgtatgcacttggcaatat

SEQ ID NO: 194076 - DNA, 20 bp, Artificial Sequence
  chemically synthesized
tgttattatcctatattgcc

SEQ ID NO: 194077 - DNA, 20 bp, Artificial Sequence
  chemically synthesized
ttcgtatgcacttggcaata

SEQ ID NO: 194078 - DNA, 20 bp, Artificial Sequence
  chemically synthesized
aaccaaatttcgtatgcact

SEQ ID NO: 194079 - DNA, 20 bp, Artificial Sequence
  chemically synthesized
tgccaagtgcatacgaaatt

SEQ ID NO: 194080 - DNA, 20 bp, Artificial Sequence
  chemically synthesized
agtgcatacgaaatttggtt

SEQ ID NO: 194081 - DNA, 20 bp, Artificial Sequence
  chemically synthesized
aaatttggtttagcatctat

SEQ ID NO: 194082 - DNA, 20 bp, Artificial Sequence
  chemically synthesized
acgtgtctctgggagaccaa

SEQ ID NO: 194083 - DNA, 20 bp, Artificial Sequence
  chemically synthesized
tttagcatctattggtctcc

SEQ ID NO: 194084 - DNA, 20 bp, Artificial Sequence
  chemically synthesized
tagcatctattggtctccca

SEQ ID NO: 194085 - DNA, 20 bp, Artificial Sequence
  chemically synthesized
taagattgacgtgtctctgg

SEQ ID NO: 194086 - DNA, 20 bp, Artificial Sequence
  chemically synthesized
tttaagattgacgtgtctct

SEQ ID NO: 194087 - DNA, 20 bp, Artificial Sequence
  chemically synthesized
ctttaagattgacgtgtctc

SEQ ID NO: 194088 - DNA, 20 bp, Artificial Sequence
  chemically synthesized
ccagagacacgtcaatctta

SEQ ID NO: 194089 - DNA, 20 bp, Artificial Sequence
  chemically synthesized
cagagacacgtcaatcttaa

SEQ ID NO: 194090 - DNA, 20 bp, Artificial Sequence
  chemically synthesized
accagcttttagcatccttt

SEQ ID NO: 194091 - DNA, 20 bp, Artificial Sequence
  chemically synthesized
tcaatcttaaaggatgctaa

SEQ ID NO: 194092 - DNA, 20 bp, Artificial Sequence
  chemically synthesized
tcttaaaggatgctaaaagc

SEQ ID NO: 194093 - DNA, 20 bp, Artificial Sequence
  chemically synthesized
acctaaagcctaccagcttt

SEQ ID NO: 194094 - DNA, 20 bp, Artificial Sequence
  chemically synthesized
taaaggatgctaaaagctgg

SEQ ID NO: 194095 - DNA, 20 bp, Artificial Sequence
  chemically synthesized
aaaggatgctaaaagctggt

SEQ ID NO: 194096 - DNA, 20 bp, Artificial Sequence
  chemically synthesized
tctttggacctaaagcctac

SEQ ID NO: 194097 - DNA, 20 bp, Artificial Sequence
  chemically synthesized
tgctaaaagctggtaggctt

SEQ ID NO: 194098 - DNA, 20 bp, Artificial Sequence
  chemically synthesized
gctaaaagctggtaggcttt

SEQ ID NO: 194099 - DNA, 20 bp, Artificial Sequence
  chemically synthesized
ctagtcaatctttggaccta

SEQ ID NO: 194100 - DNA, 20 bp, Artificial Sequence
  chemically synthesized
gctggtaggctttaggtcca

SEQ ID NO: 194101 - DNA, 20 bp, Artificial Sequence
  chemically synthesized
ctttacttctagtcaatctt

SEQ ID NO: 194102 - DNA, 20 bp, Artificial Sequence
  chemically synthesized
ctttaggtccaaagattgac

SEQ ID NO: 194103 - DNA, 20 bp, Artificial Sequence
  chemically synthesized
taggtccaaagattgactag

SEQ ID NO: 194104 - DNA, 20 bp, Artificial Sequence
  chemically synthesized
ccaaagattgactagaagta

SEQ ID NO: 194105 - DNA, 20 bp, Artificial Sequence
  chemically synthesized
tggcctgaaatctttacttc

SEQ ID NO: 194106 - DNA, 20 bp, Artificial Sequence
  chemically synthesized
ttgactagaagtaaagattt

SEQ ID NO: 194107 - DNA, 20 bp, Artificial Sequence
  chemically synthesized
tgactagaagtaaagatttc

SEQ ID NO: 194108 - DNA, 20 bp, Artificial Sequence
  chemically synthesized
aagatttcaggccaaataca

SEQ ID NO: 194109 - DNA, 20 bp, Artificial Sequence
  chemically synthesized
aacctgtgctgctgtgtatt

SEQ ID NO: 194110 - DNA, 20 bp, Artificial Sequence
  chemically synthesized
atttcaggccaaatacacag

SEQ ID NO: 194111 - DNA, 20 bp, Artificial Sequence
  chemically synthesized
aggccaaatacacagcagca

SEQ ID NO: 194112 - DNA, 20 bp, Artificial Sequence
  chemically synthesized
ggccaaatacacagcagcac

SEQ ID NO: 194113 - DNA, 20 bp, Artificial Sequence
  chemically synthesized
aatacacagcagcacaggtt

SEQ ID NO: 194114 - DNA, 20 bp, Artificial Sequence
  chemically synthesized
atacacagcagcacaggttt

SEQ ID NO: 194115 - DNA, 20 bp, Artificial Sequence
  chemically synthesized
tacacagcagcacaggtttg

SEQ ID NO: 194116 - DNA, 20 bp, Artificial Sequence
  chemically synthesized
acacagcagcacaggtttgg

SEQ ID NO: 194117 - DNA, 20 bp, Artificial Sequence
  chemically synthesized
cacagcagcacaggtttggg

SEQ ID NO: 194118 - DNA, 20 bp, Artificial Sequence
  chemically synthesized
agcacaggtttggggggacg

SEQ ID NO: 194119 - DNA, 20 bp, Artificial Sequence
  chemically synthesized
acaggtttggggggacgtgg

SEQ ID NO: 194120 - DNA, 20 bp, Artificial Sequence
  chemically synthesized
caggtttggggggacgtggt

SEQ ID NO: 194121 - DNA, 20 bp, Artificial Sequence
  chemically synthesized
aggtttggggggacgtggtg

SEQ ID NO: 194122 - DNA, 20 bp, Artificial Sequence
  chemically synthesized
gtttggggggacgtggtggg

SEQ ID NO: 194123 - DNA, 20 bp, Artificial Sequence
  chemically synthesized
tggtggggagaaatcttgta

SEQ ID NO: 194124 - DNA, 20 bp, Artificial Sequence
  chemically synthesized
aaatggattgttgactttac

SEQ ID NO: 194125 - DNA, 20 bp, Artificial Sequence
  chemically synthesized
aaagtcaacaatccattttc

SEQ ID NO: 194126 - DNA, 20 bp, Artificial Sequence
  chemically synthesized
actagacagtaactagaaaa

SEQ ID NO: 194127 - DNA, 20 bp, Artificial Sequence
  chemically synthesized
atgcgtgactagacagtaac

SEQ ID NO: 194128 - DNA, 20 bp, Artificial Sequence
  chemically synthesized
tccattttctagttactgtc

SEQ ID NO: 194129 - DNA, 20 bp, Artificial Sequence
  chemically synthesized
atttataatgcgtgactaga

SEQ ID NO: 194130 - DNA, 20 bp, Artificial Sequence
  chemically synthesized
tgtcatttataatgcgtgac

SEQ ID NO: 194131 - DNA, 20 bp, Artificial Sequence
  chemically synthesized
cgcattataaatgacacaaa

SEQ ID NO: 194132 - DNA, 20 bp, Artificial Sequence
  chemically synthesized
acacaaacagctcacccttg

SEQ ID NO: 194133 - DNA, 20 bp, Artificial Sequence
  chemically synthesized
aatgttaagacttcaagggt

SEQ ID NO: 194134 - DNA, 20 bp, Artificial Sequence
  chemically synthesized
tcataatgttaagacttcaa

SEQ ID NO: 194135 - DNA, 20 bp, Artificial Sequence
  chemically synthesized
ttcataatgttaagacttca

SEQ ID NO: 194136 - DNA, 20 bp, Artificial Sequence
  chemically synthesized
gttcataatgttaagacttc

SEQ ID NO: 194137 - DNA, 20 bp, Artificial Sequence
  chemically synthesized
tttatgaggttcataatgtt

SEQ ID NO: 194138 - DNA, 20 bp, Artificial Sequence
  chemically synthesized
tctgatttttaaaatttatg

SEQ ID NO: 194139 - DNA, 20 bp, Artificial Sequence
  chemically synthesized
ttctgatttttaaaatttat

SEQ ID NO: 194140 - DNA, 20 bp, Artificial Sequence
  chemically synthesized
acctcataaattttaaaaat

SEQ ID NO: 194141 - DNA, 20 bp, Artificial Sequence
  chemically synthesized
aaattttaaaaatcagaata

SEQ ID NO: 194142 - DNA, 20 bp, Artificial Sequence
  chemically synthesized
tactgttagctgaatattca

SEQ ID NO: 194143 - DNA, 20 bp, Artificial Sequence
  chemically synthesized
gaataaagtctctgaatatt

SEQ ID NO: 194144 - DNA, 20 bp, Artificial Sequence
  chemically synthesized
tttactgttagctgaatatt

SEQ ID NO: 194145 - DNA, 20 bp, Artificial Sequence
  chemically synthesized
gtctctgaatattcagctaa

SEQ ID NO: 194146 - DNA, 20 bp, Artificial Sequence
  chemically synthesized
tgaatattcagctaacagta

SEQ ID NO: 194147 - DNA, 20 bp, Artificial Sequence
  chemically synthesized
tagattaaagactttactgt

SEQ ID NO: 194148 - DNA, 20 bp, Artificial Sequence
  chemically synthesized
ttcatcatccatttagatta

SEQ ID NO: 194149 - DNA, 20 bp, Artificial Sequence
  chemically synthesized
agtaaagtctttaatctaaa

SEQ ID NO: 194150 - DNA, 20 bp, Artificial Sequence
  chemically synthesized
ctccattttcatcatccatt

SEQ ID NO: 194151 - DNA, 20 bp, Artificial Sequence
  chemically synthesized
atctaaatggatgatgaaaa

SEQ ID NO: 194152 - DNA, 20 bp, Artificial Sequence
  chemically synthesized
ctaaatggatgatgaaaatg

SEQ ID NO: 194153 - DNA, 20 bp, Artificial Sequence
  chemically synthesized
aaatggatgatgaaaatgga

SEQ ID NO: 194154 - DNA, 20 bp, Artificial Sequence
  chemically synthesized
aaaatggagagaatttatgt

SEQ ID NO: 194155 - DNA, 20 bp, Artificial Sequence
  chemically synthesized
tggagagaatttatgttagc

SEQ ID NO: 194156 - DNA, 20 bp, Artificial Sequence
  chemically synthesized
tttatgttagctagaaaatt

SEQ ID NO: 194157 - DNA, 20 bp, Artificial Sequence
  chemically synthesized
attcagtagtcttaattttc

SEQ ID NO: 194158 - DNA, 20 bp, Artificial Sequence
  chemically synthesized
ctgaaagaaaaattattcag

SEQ ID NO: 194159 - DNA, 20 bp, Artificial Sequence
  chemically synthesized
tagctgaaagaaaaattatt

SEQ ID NO: 194160 - DNA, 20 bp, Artificial Sequence
  chemically synthesized
ctactgaataatttttcttt

SEQ ID NO: 194161 - DNA, 20 bp, Artificial Sequence
  chemically synthesized
tgaataatttttctttcagc

SEQ ID NO: 194162 - DNA, 20 bp, Artificial Sequence
  chemically synthesized
ttatatggaacactagctga

SEQ ID NO: 194163 - DNA, 20 bp, Artificial Sequence
  chemically synthesized
atcaccattatatggaacac

SEQ ID NO: 194164 - DNA, 20 bp, Artificial Sequence
  chemically synthesized
tcagctagtgttccatataa

SEQ ID NO: 194165 - DNA, 20 bp, Artificial Sequence
  chemically synthesized
gccaaaatatcaccattata

SEQ ID NO: 194166 - DNA, 20 bp, Artificial Sequence
  chemically synthesized
tccatataatggtgatattt

SEQ ID NO: 194167 - DNA, 20 bp, Artificial Sequence
  chemically synthesized
tgatattttggcatatatgt

SEQ ID NO: 194168 - DNA, 20 bp, Artificial Sequence
  chemically synthesized
taagataacacttactaaaa

SEQ ID NO: 194169 - DNA, 20 bp, Artificial Sequence
  chemically synthesized
cagataatttcttttttagt

SEQ ID NO: 194170 - DNA, 20 bp, Artificial Sequence
  chemically synthesized
gcatcagataatttcttttt

SEQ ID NO: 194171 - DNA, 20 bp, Artificial Sequence
  chemically synthesized
ctctaaattttcacatgcat

SEQ ID NO: 194172 - DNA, 20 bp, Artificial Sequence
  chemically synthesized
atctgatgcatgtgaaaatt

SEQ ID NO: 194173 - DNA, 20 bp, Artificial Sequence
  chemically synthesized
ctgatgcatgtgaaaattta

SEQ ID NO: 194174 - DNA, 20 bp, Artificial Sequence
  chemically synthesized
tgcatgtgaaaatttagaga

SEQ ID NO: 194175 - DNA, 20 bp, Artificial Sequence
  chemically synthesized
gcatgtgaaaatttagagac

SEQ ID NO: 194176 - DNA, 20 bp, Artificial Sequence
  chemically synthesized
acaggtcattactaccgatc

SEQ ID NO: 194177 - DNA, 20 bp, Artificial Sequence
  chemically synthesized
tagcaaatcatcttgatcgg

SEQ ID NO: 194178 - DNA, 20 bp, Artificial Sequence
  chemically synthesized
cagtagcaaatcatcttgat

SEQ ID NO: 194179 - DNA, 20 bp, Artificial Sequence
  chemically synthesized
ttatactctcaaatgggcag

SEQ ID NO: 194180 - DNA, 20 bp, Artificial Sequence
  chemically synthesized
tgatttgctactgcccattt

SEQ ID NO: 194181 - DNA, 20 bp, Artificial Sequence
  chemically synthesized
cccttatactctcaaatggg

SEQ ID NO: 194182 - DNA, 20 bp, Artificial Sequence
  chemically synthesized
atttgctactgcccatttga

SEQ ID NO: 194183 - DNA, 20 bp, Artificial Sequence
  chemically synthesized
gtccccttatactctcaaat

SEQ ID NO: 194184 - DNA, 20 bp, Artificial Sequence
  chemically synthesized
tgtccccttatactctcaaa

SEQ ID NO: 194185 - DNA, 20 bp, Artificial Sequence
  chemically synthesized
tactgcccatttgagagtat

SEQ ID NO: 194186 - DNA, 20 bp, Artificial Sequence
  chemically synthesized
actgcccatttgagagtata

SEQ ID NO: 194187 - DNA, 20 bp, Artificial Sequence
  chemically synthesized
ctgcccatttgagagtataa

SEQ ID NO: 194188 - DNA, 20 bp, Artificial Sequence
  chemically synthesized
tgcccatttgagagtataag

SEQ ID NO: 194189 - DNA, 20 bp, Artificial Sequence
  chemically synthesized
catttgagagtataagggga

SEQ ID NO: 194190 - DNA, 20 bp, Artificial Sequence
  chemically synthesized
ttgagagtataaggggacag

SEQ ID NO: 194191 - DNA, 20 bp, Artificial Sequence
  chemically synthesized
tgagagtataaggggacagt

SEQ ID NO: 194192 - DNA, 20 bp, Artificial Sequence
  chemically synthesized
tataaggggacagtgggctc

SEQ ID NO: 194193 - DNA, 20 bp, Artificial Sequence
  chemically synthesized
atatgttcatagtcacaccg

SEQ ID NO: 194194 - DNA, 20 bp, Artificial Sequence
  chemically synthesized
gcatatgttcatagtcacac

SEQ ID NO: 194195 - DNA, 20 bp, Artificial Sequence
  chemically synthesized
ttactgagggcatatgttca

SEQ ID NO: 194196 - DNA, 20 bp, Artificial Sequence
  chemically synthesized
tgactatgaacatatgccct

SEQ ID NO: 194197 - DNA, 20 bp, Artificial Sequence
  chemically synthesized
tatgaacatatgccctcagt

SEQ ID NO: 194198 - DNA, 20 bp, Artificial Sequence
  chemically synthesized
caagctgccctgcttactga

SEQ ID NO: 194199 - DNA, 20 bp, Artificial Sequence
  chemically synthesized
gaacatatgccctcagtaag

SEQ ID NO: 194200 - DNA, 20 bp, Artificial Sequence
  chemically synthesized
gcaagctgccctgcttactg

SEQ ID NO: 194201 - DNA, 20 bp, Artificial Sequence
  chemically synthesized
aacatatgccctcagtaagc

SEQ ID NO: 194202 - DNA, 20 bp, Artificial Sequence
  chemically synthesized
tgcaagctgccctgcttact

SEQ ID NO: 194203 - DNA, 20 bp, Artificial Sequence
  chemically synthesized
acatatgccctcagtaagca

SEQ ID NO: 194204 - DNA, 20 bp, Artificial Sequence
  chemically synthesized
tatgccctcagtaagcaggg

SEQ ID NO: 194205 - DNA, 20 bp, Artificial Sequence
  chemically synthesized
catttacttctcagggatgc

SEQ ID NO: 194206 - DNA, 20 bp, Artificial Sequence
  chemically synthesized
gcagggcagcttgcatccct

SEQ ID NO: 194207 - DNA, 20 bp, Artificial Sequence
  chemically synthesized
gggcagcttgcatccctgag

SEQ ID NO: 194208 - DNA, 20 bp, Artificial Sequence
  chemically synthesized
ctatactcatttacttctca

SEQ ID NO: 194209 - DNA, 20 bp, Artificial Sequence
  chemically synthesized
tctatactcatttacttctc

SEQ ID NO: 194210 - DNA, 20 bp, Artificial Sequence
  chemically synthesized
atctatactcatttacttct

SEQ ID NO: 194211 - DNA, 20 bp, Artificial Sequence
  chemically synthesized
tgcatccctgagaagtaaat

SEQ ID NO: 194212 - DNA, 20 bp, Artificial Sequence
  chemically synthesized
ccctgagaagtaaatgagta

SEQ ID NO: 194213 - DNA, 20 bp, Artificial Sequence
  chemically synthesized
tatagatgtgctctcctcaa

SEQ ID NO: 194214 - DNA, 20 bp, Artificial Sequence
  chemically synthesized
gaagggaaagcttttgagga

SEQ ID NO: 194215 - DNA, 20 bp, Artificial Sequence
  chemically synthesized
gggaagggaaagcttttgag

SEQ ID NO: 194216 - DNA, 20 bp, Artificial Sequence
  chemically synthesized
gtgggaagggaaagcttttg

SEQ ID NO: 194217 - DNA, 20 bp, Artificial Sequence
  chemically synthesized
ggtgggaagggaaagctttt

SEQ ID NO: 194218 - DNA, 20 bp, Artificial Sequence
  chemically synthesized
acactcctggtgggaaggga

SEQ ID NO: 194219 - DNA, 20 bp, Artificial Sequence
  chemically synthesized
caaaagctttcccttcccac

SEQ ID NO: 194220 - DNA, 20 bp, Artificial Sequence
  chemically synthesized
acaaacactcctggtgggaa

SEQ ID NO: 194221 - DNA, 20 bp, Artificial Sequence
  chemically synthesized
aaaagctttcccttcccacc

SEQ ID NO: 194222 - DNA, 20 bp, Artificial Sequence
  chemically synthesized
tacaaacactcctggtggga

SEQ ID NO: 194223 - DNA, 20 bp, Artificial Sequence
  chemically synthesized
ttacaaacactcctggtggg

SEQ ID NO: 194224 - DNA, 20 bp, Artificial Sequence
  chemically synthesized
aagctttcccttcccaccag

SEQ ID NO: 194225 - DNA, 20 bp, Artificial Sequence
  chemically synthesized
catttacaaacactcctggt

SEQ ID NO: 194226 - DNA, 20 bp, Artificial Sequence
  chemically synthesized
acatttacaaacactcctgg

SEQ ID NO: 194227 - DNA, 20 bp, Artificial Sequence
  chemically synthesized
tcaacatttacaaacactcc

SEQ ID NO: 194228 - DNA, 20 bp, Artificial Sequence
  chemically synthesized
caggagtgtttgtaaatgtt

SEQ ID NO: 194229 - DNA, 20 bp, Artificial Sequence
  chemically synthesized
aggagtgtttgtaaatgttg

SEQ ID NO: 194230 - DNA, 20 bp, Artificial Sequence
  chemically synthesized
gtgtttgtaaatgttgaggc

SEQ ID NO: 194231 - DNA, 20 bp, Artificial Sequence
  chemically synthesized
tgtttgtaaatgttgaggct

SEQ ID NO: 194232 - DNA, 20 bp, Artificial Sequence
  chemically synthesized
ttgtaaatgttgaggctagg

SEQ ID NO: 194233 - DNA, 20 bp, Artificial Sequence
  chemically synthesized
aaatgttgaggctaggtgga

SEQ ID NO: 194234 - DNA, 20 bp, Artificial Sequence
  chemically synthesized
ctattccaactctttccacc

SEQ ID NO: 194235 - DNA, 20 bp, Artificial Sequence
  chemically synthesized
atgttgaggctaggtggaaa

SEQ ID NO: 194236 - DNA, 20 bp, Artificial Sequence
  chemically synthesized
tgaggctaggtggaaagagt

SEQ ID NO: 194237 - DNA, 20 bp, Artificial Sequence
  chemically synthesized
ctaggtggaaagagttggaa

SEQ ID NO: 194238 - DNA, 20 bp, Artificial Sequence
  chemically synthesized
taggtggaaagagttggaat

SEQ ID NO: 194239 - DNA, 20 bp, Artificial Sequence
  chemically synthesized
acatttttgcaaatgatata

SEQ ID NO: 194240 - DNA, 20 bp, Artificial Sequence
  chemically synthesized
atttttgcaaatgatataaa

SEQ ID NO: 194241 - DNA, 20 bp, Artificial Sequence
  chemically synthesized
tttttgcaaatgatataaag

SEQ ID NO: 194242 - DNA, 20 bp, Artificial Sequence
  chemically synthesized
ttttgcaaatgatataaaga

SEQ ID NO: 194243 - DNA, 20 bp, Artificial Sequence
  chemically synthesized
taaagagggtgatatgaata

SEQ ID NO: 194244 - DNA, 20 bp, Artificial Sequence
  chemically synthesized
gtgatatgaatacagaattg

SEQ ID NO: 194245 - DNA, 20 bp, Artificial Sequence
  chemically synthesized
gatatgaatacagaattgtg

SEQ ID NO: 194246 - DNA, 20 bp, Artificial Sequence
  chemically synthesized
tacagaattgtggagctttg

SEQ ID NO: 194247 - DNA, 20 bp, Artificial Sequence
  chemically synthesized
cagaattgtggagctttgaa

SEQ ID NO: 194248 - DNA, 20 bp, Artificial Sequence
  chemically synthesized
cattattccctttctcttca

SEQ ID NO: 194249 - DNA, 20 bp, Artificial Sequence
  chemically synthesized
attgtggagctttgaagaga

SEQ ID NO: 194250 - DNA, 20 bp, Artificial Sequence
  chemically synthesized
ttgtggagctttgaagagaa

SEQ ID NO: 194251 - DNA, 20 bp, Artificial Sequence
  chemically synthesized
tgtggagctttgaagagaaa

SEQ ID NO: 194252 - DNA, 20 bp, Artificial Sequence
  chemically synthesized
aagagaaagggaataatgat

SEQ ID NO: 194253 - DNA, 20 bp, Artificial Sequence
  chemically synthesized
aataatgattagcatttact

SEQ ID NO: 194254 - DNA, 20 bp, Artificial Sequence
  chemically synthesized
tttggcacaaaatcggtact

SEQ ID NO: 194255 - DNA, 20 bp, Artificial Sequence
  chemically synthesized
aacaagatttggcacaaaat

SEQ ID NO: 194256 - DNA, 20 bp, Artificial Sequence
  chemically synthesized
taaaaatgctcaacaagatt

SEQ ID NO: 194257 - DNA, 20 bp, Artificial Sequence
  chemically synthesized
attttgtgccaaatcttgtt

SEQ ID NO: 194258 - DNA, 20 bp, Artificial Sequence
  chemically synthesized
gtgtattaaaaatgctcaac

SEQ ID NO: 194259 - DNA, 20 bp, Artificial Sequence
  chemically synthesized
cttgttggaattaaataaat

SEQ ID NO: 194260 - DNA, 20 bp, Artificial Sequence
  chemically synthesized
ctcatttatttaattccaac

SEQ ID NO: 194261 - DNA, 20 bp, Artificial Sequence
  chemically synthesized
catttatttaattccaacaa

SEQ ID NO: 194262 - DNA, 20 bp, Artificial Sequence
  chemically synthesized
tcatactgcagaactcttgt

SEQ ID NO: 194263 - DNA, 20 bp, Artificial Sequence
  chemically synthesized
taattccaacaagagttctg

SEQ ID NO: 194264 - DNA, 20 bp, Artificial Sequence
  chemically synthesized
caacaagagttctgcagtat

SEQ ID NO: 194265 - DNA, 20 bp, Artificial Sequence
  chemically synthesized
aataggtactactcatactg

SEQ ID NO: 194266 - DNA, 20 bp, Artificial Sequence
  chemically synthesized
caagagttctgcagtatgag

SEQ ID NO: 194267 - DNA, 20 bp, Artificial Sequence
  chemically synthesized
tatgagtagtacctatttta

SEQ ID NO: 194268 - DNA, 20 bp, Artificial Sequence
  chemically synthesized
atgagtagtacctattttac

SEQ ID NO: 194269 - DNA, 20 bp, Artificial Sequence
  chemically synthesized
aattacctcacctgtaaaat

SEQ ID NO: 194270 - DNA, 20 bp, Artificial Sequence
  chemically synthesized
caattacctcacctgtaaaa

SEQ ID NO: 194271 - DNA, 20 bp, Artificial Sequence
  chemically synthesized
gtagtacctattttacaggt

SEQ ID NO: 194272 - DNA, 20 bp, Artificial Sequence
  chemically synthesized
tagtacctattttacaggtg

SEQ ID NO: 194273 - DNA, 20 bp, Artificial Sequence
  chemically synthesized
attttacaggtgaggtaatt

SEQ ID NO: 194274 - DNA, 20 bp, Artificial Sequence
  chemically synthesized
ttttacaggtgaggtaattg

SEQ ID NO: 194275 - DNA, 20 bp, Artificial Sequence
  chemically synthesized
ggtgaggtaattgaggatca

SEQ ID NO: 194276 - DNA, 20 bp, Artificial Sequence
  chemically synthesized
gtgaggtaattgaggatcat

SEQ ID NO: 194277 - DNA, 20 bp, Artificial Sequence
  chemically synthesized
cacacatactgtgtaaattc

SEQ ID NO: 194278 - DNA, 20 bp, Artificial Sequence
  chemically synthesized
ccacacatactgtgtaaatt

SEQ ID NO: 194279 - DNA, 20 bp, Artificial Sequence
  chemically synthesized
aaaaattacctgaatttaca

SEQ ID NO: 194280 - DNA, 20 bp, Artificial Sequence
  chemically synthesized
ctgaatttacacagtatgtg

SEQ ID NO: 194281 - DNA, 20 bp, Artificial Sequence
  chemically synthesized
aagaatacaagagaatggca

SEQ ID NO: 194282 - DNA, 20 bp, Artificial Sequence
  chemically synthesized
ggtccaagaatacaagagaa

SEQ ID NO: 194283 - DNA, 20 bp, Artificial Sequence
  chemically synthesized
ttttaggtccaagaatacaa

SEQ ID NO: 194284 - DNA, 20 bp, Artificial Sequence
  chemically synthesized
ttgccattctcttgtattct

SEQ ID NO: 194285 - DNA, 20 bp, Artificial Sequence
  chemically synthesized
tcttttaggtccaagaatac

SEQ ID NO: 194286 - DNA, 20 bp, Artificial Sequence
  chemically synthesized
ccgttaggtcttttaggtcc

SEQ ID NO: 194287 - DNA, 20 bp, Artificial Sequence
  chemically synthesized
tcttgtattcttggacctaa

SEQ ID NO: 194288 - DNA, 20 bp, Artificial Sequence
  chemically synthesized
accacaccgttaggtctttt

SEQ ID NO: 194289 - DNA, 20 bp, Artificial Sequence
  chemically synthesized
aaccacaccgttaggtcttt

SEQ ID NO: 194290 - DNA, 20 bp, Artificial Sequence
  chemically synthesized
cttggacctaaaagacctaa

SEQ ID NO: 194291 - DNA, 20 bp, Artificial Sequence
  chemically synthesized
acctaaaagacctaacggtg

SEQ ID NO: 194292 - DNA, 20 bp, Artificial Sequence
  chemically synthesized
gcttatacaaccacaccgtt

SEQ ID NO: 194293 - DNA, 20 bp, Artificial Sequence
  chemically synthesized
tgcttatacaaccacaccgt

SEQ ID NO: 194294 - DNA, 20 bp, Artificial Sequence
  chemically synthesized
acctaacggtgtggttgtat

SEQ ID NO: 194295 - DNA, 20 bp, Artificial Sequence
  chemically synthesized
gtgtggttgtataagcaaaa

SEQ ID NO: 194296 - DNA, 20 bp, Artificial Sequence
  chemically synthesized
ggttgtataagcaaaatgga

SEQ ID NO: 194297 - DNA, 20 bp, Artificial Sequence
  chemically synthesized
agcaaaatggatagacttga

SEQ ID NO: 194298 - DNA, 20 bp, Artificial Sequence
  chemically synthesized
ttattcatactaaaactttc

SEQ ID NO: 194299 - DNA, 20 bp, Artificial Sequence
  chemically synthesized
atggatagacttgaaagttt

SEQ ID NO: 194300 - DNA, 20 bp, Artificial Sequence
  chemically synthesized
ttgaaagttttagtatgaat

SEQ ID NO: 194301 - DNA, 20 bp, Artificial Sequence
  chemically synthesized
gaaagttttagtatgaataa

SEQ ID NO: 194302 - DNA, 20 bp, Artificial Sequence
  chemically synthesized
ttagtatgaataagagactg

SEQ ID NO: 194303 - DNA, 20 bp, Artificial Sequence
  chemically synthesized
gtatgaataagagactgtgg

SEQ ID NO: 194304 - DNA, 20 bp, Artificial Sequence
  chemically synthesized
taaaaaatgtttttctacca

SEQ ID NO: 194305 - DNA, 20 bp, Artificial Sequence
  chemically synthesized
aaaaacattttttaaaactg

SEQ ID NO: 194306 - DNA, 20 bp, Artificial Sequence
  chemically synthesized
ttgagacttaattaaatcta

SEQ ID NO: 194307 - DNA, 20 bp, Artificial Sequence
  chemically synthesized
ttaaaactgtagatttaatt

SEQ ID NO: 194308 - DNA, 20 bp, Artificial Sequence
  chemically synthesized
atttttcatgcagcattttt

SEQ ID NO: 194309 - DNA, 20 bp, Artificial Sequence
  chemically synthesized
tatagcacttatttttcatg

SEQ ID NO: 194310 - DNA, 20 bp, Artificial Sequence
  chemically synthesized
aaaaatgctgcatgaaaaat

SEQ ID NO: 194311 - DNA, 20 bp, Artificial Sequence
  chemically synthesized
tgcatgaaaaataagtgcta

SEQ ID NO: 194312 - DNA, 20 bp, Artificial Sequence
  chemically synthesized
gcatgaaaaataagtgctat

SEQ ID NO: 194313 - DNA, 20 bp, Artificial Sequence
  chemically synthesized
atgaaaaataagtgctatag

SEQ ID NO: 194314 - DNA, 20 bp, Artificial Sequence
  chemically synthesized
tgaaaaataagtgctatagg

SEQ ID NO: 194315 - DNA, 20 bp, Artificial Sequence
  chemically synthesized
ctcccacctcttacctccta

SEQ ID NO: 194316 - DNA, 20 bp, Artificial Sequence
  chemically synthesized
aaataagtgctataggaggt

SEQ ID NO: 194317 - DNA, 20 bp, Artificial Sequence
  chemically synthesized
ataagtgctataggaggtaa

SEQ ID NO: 194318 - DNA, 20 bp, Artificial Sequence
  chemically synthesized
taagtgctataggaggtaag

SEQ ID NO: 194319 - DNA, 20 bp, Artificial Sequence
  chemically synthesized
gtgctataggaggtaagagg

SEQ ID NO: 194320 - DNA, 20 bp, Artificial Sequence
  chemically synthesized
tgctataggaggtaagaggt

SEQ ID NO: 194321 - DNA, 20 bp, Artificial Sequence
  chemically synthesized
ctataggaggtaagaggtgg

SEQ ID NO: 194322 - DNA, 20 bp, Artificial Sequence
  chemically synthesized
gagaatcatttaactgttca

SEQ ID NO: 194323 - DNA, 20 bp, Artificial Sequence
  chemically synthesized
gaatcatttaactgttcaca

SEQ ID NO: 194324 - DNA, 20 bp, Artificial Sequence
  chemically synthesized
aatcatttaactgttcacag

SEQ ID NO: 194325 - DNA, 20 bp, Artificial Sequence
  chemically synthesized
cagccacactcctctgtgaa

SEQ ID NO: 194326 - DNA, 20 bp, Artificial Sequence
  chemically synthesized
tcatttaactgttcacagag

SEQ ID NO: 194327 - DNA, 20 bp, Artificial Sequence
  chemically synthesized
taactgttcacagaggagtg

SEQ ID NO: 194328 - DNA, 20 bp, Artificial Sequence
  chemically synthesized
tcacagaggagtgtggctgt

SEQ ID NO: 194329 - DNA, 20 bp, Artificial Sequence
  chemically synthesized
aggagtgtggctgtgagctg

SEQ ID NO: 194330 - DNA, 20 bp, Artificial Sequence
  chemically synthesized
aatcctccatcttcagctca

SEQ ID NO: 194331 - DNA, 20 bp, Artificial Sequence
  chemically synthesized
gtgtggctgtgagctgaaga

SEQ ID NO: 194332 - DNA, 20 bp, Artificial Sequence
  chemically synthesized
gtggctgtgagctgaagatg

SEQ ID NO: 194333 - DNA, 20 bp, Artificial Sequence
  chemically synthesized
tggctgtgagctgaagatgg

SEQ ID NO: 194334 - DNA, 20 bp, Artificial Sequence
  chemically synthesized
ctcttttaatcctccatctt

SEQ ID NO: 194335 - DNA, 20 bp, Artificial Sequence
  chemically synthesized
agctgaagatggaggattaa

SEQ ID NO: 194336 - DNA, 20 bp, Artificial Sequence
  chemically synthesized
ctgaagatggaggattaaaa

SEQ ID NO: 194337 - DNA, 20 bp, Artificial Sequence
  chemically synthesized
aagatggaggattaaaagag

SEQ ID NO: 194338 - DNA, 20 bp, Artificial Sequence
  chemically synthesized
atggaggattaaaagagaag

SEQ ID NO: 194339 - DNA, 20 bp, Artificial Sequence
  chemically synthesized
tggaggattaaaagagaagc

SEQ ID NO: 194340 - DNA, 20 bp, Artificial Sequence
  chemically synthesized
aaaagagaagcaggatatca

SEQ ID NO: 194341 - DNA, 20 bp, Artificial Sequence
  chemically synthesized
gcaggatatcatagtctatg

SEQ ID NO: 194342 - DNA, 20 bp, Artificial Sequence
  chemically synthesized
aggatatcatagtctatgtg

SEQ ID NO: 194343 - DNA, 20 bp, Artificial Sequence
  chemically synthesized
tcctctatgtagactccaca

SEQ ID NO: 194344 - DNA, 20 bp, Artificial Sequence
  chemically synthesized
tagtctatgtggagtctaca

SEQ ID NO: 194345 - DNA, 20 bp, Artificial Sequence
  chemically synthesized
gtctatgtggagtctacata

SEQ ID NO: 194346 - DNA, 20 bp, Artificial Sequence
  chemically synthesized
tctatgtggagtctacatag

SEQ ID NO: 194347 - DNA, 20 bp, Artificial Sequence
  chemically synthesized
ctcctgcctcttcctctatg

SEQ ID NO: 194348 - DNA, 20 bp, Artificial Sequence
  chemically synthesized
atgtggagtctacatagagg

SEQ ID NO: 194349 - DNA, 20 bp, Artificial Sequence
  chemically synthesized
gtggagtctacatagaggaa

SEQ ID NO: 194350 - DNA, 20 bp, Artificial Sequence
  chemically synthesized
tggagtctacatagaggaag

SEQ ID NO: 194351 - DNA, 20 bp, Artificial Sequence
  chemically synthesized
agtctacatagaggaagagg

SEQ ID NO: 194352 - DNA, 20 bp, Artificial Sequence
  chemically synthesized
gtctacatagaggaagaggc

SEQ ID NO: 194353 - DNA, 20 bp, Artificial Sequence
  chemically synthesized
ctacatagaggaagaggcag

SEQ ID NO: 194354 - DNA, 20 bp, Artificial Sequence
  chemically synthesized
ggaagaggcaggagaacttc

SEQ ID NO: 194355 - DNA, 20 bp, Artificial Sequence
  chemically synthesized
atgctcatgtttcaagccag

SEQ ID NO: 194356 - DNA, 20 bp, Artificial Sequence
  chemically synthesized
atcatgctcatgtttcaagc

SEQ ID NO: 194357 - DNA, 20 bp, Artificial Sequence
  chemically synthesized
gaacttctggcttgaaacat

SEQ ID NO: 194358 - DNA, 20 bp, Artificial Sequence
  chemically synthesized
ttccatcatgctcatgtttc

SEQ ID NO: 194359 - DNA, 20 bp, Artificial Sequence
  chemically synthesized
ggcttgaaacatgagcatga

SEQ ID NO: 194360 - DNA, 20 bp, Artificial Sequence
  chemically synthesized
acatgagcatgatggaacct

SEQ ID NO: 194361 - DNA, 20 bp, Artificial Sequence
  chemically synthesized
catgagcatgatggaacctg

SEQ ID NO: 194362 - DNA, 20 bp, Artificial Sequence
  chemically synthesized
atgagcatgatggaacctga

SEQ ID NO: 194363 - DNA, 20 bp, Artificial Sequence
  chemically synthesized
acctacttaggaggaccctc

SEQ ID NO: 194364 - DNA, 20 bp, Artificial Sequence
  chemically synthesized
tacctacttaggaggaccct

SEQ ID NO: 194365 - DNA, 20 bp, Artificial Sequence
  chemically synthesized
tggaacctgagggtcctcct

SEQ ID NO: 194366 - DNA, 20 bp, Artificial Sequence
  chemically synthesized
aacctgagggtcctcctaag

SEQ ID NO: 194367 - DNA, 20 bp, Artificial Sequence
  chemically synthesized
acctgagggtcctcctaagt

SEQ ID NO: 194368 - DNA, 20 bp, Artificial Sequence
  chemically synthesized
ccctcttatacctacttagg

SEQ ID NO: 194369 - DNA, 20 bp, Artificial Sequence
  chemically synthesized
tccctcttatacctacttag

SEQ ID NO: 194370 - DNA, 20 bp, Artificial Sequence
  chemically synthesized
tttccctcttatacctactt

SEQ ID NO: 194371 - DNA, 20 bp, Artificial Sequence
  chemically synthesized
ctttccctcttatacctact

SEQ ID NO: 194372 - DNA, 20 bp, Artificial Sequence
  chemically synthesized
gggtcctcctaagtaggtat

SEQ ID NO: 194373 - DNA, 20 bp, Artificial Sequence
  chemically synthesized
gtcctcctaagtaggtataa

SEQ ID NO: 194374 - DNA, 20 bp, Artificial Sequence
  chemically synthesized
tcctcctaagtaggtataag

SEQ ID NO: 194375 - DNA, 20 bp, Artificial Sequence
  chemically synthesized
cctcctaagtaggtataaga

SEQ ID NO: 194376 - DNA, 20 bp, Artificial Sequence
  chemically synthesized
ctaagtaggtataagaggga

SEQ ID NO: 194377 - DNA, 20 bp, Artificial Sequence
  chemically synthesized
gtataagagggaaagttgaa

SEQ ID NO: 194378 - DNA, 20 bp, Artificial Sequence
  chemically synthesized
ttgaaaagtttgcatgaacc

SEQ ID NO: 194379 - DNA, 20 bp, Artificial Sequence
  chemically synthesized
tattctgactttcatattct

SEQ ID NO: 194380 - DNA, 20 bp, Artificial Sequence
  chemically synthesized
atattctgactttcatattc

SEQ ID NO: 194381 - DNA, 20 bp, Artificial Sequence
  chemically synthesized
tgcatgaacccagaatatga

SEQ ID NO: 194382 - DNA, 20 bp, Artificial Sequence
  chemically synthesized
tgaacccagaatatgaaagt

SEQ ID NO: 194383 - DNA, 20 bp, Artificial Sequence
  chemically synthesized
aatatgaaagtcagaatatg

SEQ ID NO: 194384 - DNA, 20 bp, Artificial Sequence
  chemically synthesized
cagaatatgcagattaactt

SEQ ID NO: 194385 - DNA, 20 bp, Artificial Sequence
  chemically synthesized
tttctagtcctcacaggctc

SEQ ID NO: 194386 - DNA, 20 bp, Artificial Sequence
  chemically synthesized
gcagattaacttgagcctgt

SEQ ID NO: 194387 - DNA, 20 bp, Artificial Sequence
  chemically synthesized
cagattaacttgagcctgtg

SEQ ID NO: 194388 - DNA, 20 bp, Artificial Sequence
  chemically synthesized
agtggctttctagtcctcac

SEQ ID NO: 194389 - DNA, 20 bp, Artificial Sequence
  chemically synthesized
taacttgagcctgtgaggac

SEQ ID NO: 194390 - DNA, 20 bp, Artificial Sequence
  chemically synthesized
cagtggctttctagtcctca

SEQ ID NO: 194391 - DNA, 20 bp, Artificial Sequence
  chemically synthesized
ttgagcctgtgaggactaga

SEQ ID NO: 194392 - DNA, 20 bp, Artificial Sequence
  chemically synthesized
aaaacgtatcagtggctttc

SEQ ID NO: 194393 - DNA, 20 bp, Artificial Sequence
  chemically synthesized
accagctcaaaacgtatcag

SEQ ID NO: 194394 - DNA, 20 bp, Artificial Sequence
  chemically synthesized
gttaccagctcaaaacgtat

SEQ ID NO: 194395 - DNA, 20 bp, Artificial Sequence
  chemically synthesized
gaaagccactgatacgtttt

SEQ ID NO: 194396 - DNA, 20 bp, Artificial Sequence
  chemically synthesized
gccactgatacgttttgagc

SEQ ID NO: 194397 - DNA, 20 bp, Artificial Sequence
  chemically synthesized
aggttcattacattagttac

SEQ ID NO: 194398 - DNA, 20 bp, Artificial Sequence
  chemically synthesized
atatatcaggttcattacat

SEQ ID NO: 194399 - DNA, 20 bp, Artificial Sequence
  chemically synthesized
atcttcctgagaaatatatc

SEQ ID NO: 194400 - DNA, 20 bp, Artificial Sequence
  chemically synthesized
aatcttcctgagaaatatat

SEQ ID NO: 194401 - DNA, 20 bp, Artificial Sequence
  chemically synthesized
aatgaacctgatatatttct

SEQ ID NO: 194402 - DNA, 20 bp, Artificial Sequence
  chemically synthesized
atgaacctgatatatttctc

SEQ ID NO: 194403 - DNA, 20 bp, Artificial Sequence
  chemically synthesized
aacctgatatatttctcagg

SEQ ID NO: 194404 - DNA, 20 bp, Artificial Sequence
  chemically synthesized
gctatgttattaatcttcct

SEQ ID NO: 194405 - DNA, 20 bp, Artificial Sequence
  chemically synthesized
tctcaggaagattaataaca

SEQ ID NO: 194406 - DNA, 20 bp, Artificial Sequence
  chemically synthesized
caggaagattaataacatag

SEQ ID NO: 194407 - DNA, 20 bp, Artificial Sequence
  chemically synthesized
agattaataacatagcggta

SEQ ID NO: 194408 - DNA, 20 bp, Artificial Sequence
  chemically synthesized
taataacatagcggtatagt

SEQ ID NO: 194409 - DNA, 20 bp, Artificial Sequence
  chemically synthesized
ataacatagcggtatagtga

SEQ ID NO: 194410 - DNA, 20 bp, Artificial Sequence
  chemically synthesized
atagcggtatagtgagagat

SEQ ID NO: 194411 - DNA, 20 bp, Artificial Sequence
  chemically synthesized
gtatagtgagagattggtaa

SEQ ID NO: 194412 - DNA, 20 bp, Artificial Sequence
  chemically synthesized
tatagtgagagattggtaat

SEQ ID NO: 194413 - DNA, 20 bp, Artificial Sequence
  chemically synthesized
atagtgagagattggtaatg

SEQ ID NO: 194414 - DNA, 20 bp, Artificial Sequence
  chemically synthesized
agtgagagattggtaatggg

SEQ ID NO: 194415 - DNA, 20 bp, Artificial Sequence
  chemically synthesized
agagattggtaatggggaga

SEQ ID NO: 194416 - DNA, 20 bp, Artificial Sequence
  chemically synthesized
gagattggtaatggggagat

SEQ ID NO: 194417 - DNA, 20 bp, Artificial Sequence
  chemically synthesized
attggtaatggggagatggg

SEQ ID NO: 194418 - DNA, 20 bp, Artificial Sequence
  chemically synthesized
ttggtaatggggagatggga

SEQ ID NO: 194419 - DNA, 20 bp, Artificial Sequence
  chemically synthesized
gtaatggggagatgggaagg

SEQ ID NO: 194420 - DNA, 20 bp, Artificial Sequence
  chemically synthesized
atcatgtttgaatataggat

SEQ ID NO: 194421 - DNA, 20 bp, Artificial Sequence
  chemically synthesized
aaataatcatgtttgaatat

SEQ ID NO: 194422 - DNA, 20 bp, Artificial Sequence
  chemically synthesized
aaaataatcatgtttgaata

SEQ ID NO: 194423 - DNA, 20 bp, Artificial Sequence
  chemically synthesized
tattcaaacatgattatttt

SEQ ID NO: 194424 - DNA, 20 bp, Artificial Sequence
  chemically synthesized
tgattatttttagaaacaaa

SEQ ID NO: 194425 - DNA, 20 bp, Artificial Sequence
  chemically synthesized
tttttagaaacaaatagaaa

SEQ ID NO: 194426 - DNA, 20 bp, Artificial Sequence
  chemically synthesized
tttagaaacaaatagaaaca

SEQ ID NO: 194427 - DNA, 20 bp, Artificial Sequence
  chemically synthesized
ttagaaacaaatagaaacag

SEQ ID NO: 194428 - DNA, 20 bp, Artificial Sequence
  chemically synthesized
acaaatagaaacagaggaaa

SEQ ID NO: 194429 - DNA, 20 bp, Artificial Sequence
  chemically synthesized
cagaggaaatagaaaataac

SEQ ID NO: 194430 - DNA, 20 bp, Artificial Sequence
  chemically synthesized
gaggaaatagaaaataacaa

SEQ ID NO: 194431 - DNA, 20 bp, Artificial Sequence
  chemically synthesized
aggaaatagaaaataacaag

SEQ ID NO: 194432 - DNA, 20 bp, Artificial Sequence
  chemically synthesized
aaatagaaaataacaagagg

SEQ ID NO: 194433 - DNA, 20 bp, Artificial Sequence
  chemically synthesized
aatagaaaataacaagagga

SEQ ID NO: 194434 - DNA, 20 bp, Artificial Sequence
  chemically synthesized
agaaaataacaagaggaagg

SEQ ID NO: 194435 - DNA, 20 bp, Artificial Sequence
  chemically synthesized
aaaataacaagaggaaggaa

SEQ ID NO: 194436 - DNA, 20 bp, Artificial Sequence
  chemically synthesized
aggaaggaagagatatccac

SEQ ID NO: 194437 - DNA, 20 bp, Artificial Sequence
  chemically synthesized
tctagtcatgtgcaatcttg

SEQ ID NO: 194438 - DNA, 20 bp, Artificial Sequence
  chemically synthesized
tccacaagattgcacatgac

SEQ ID NO: 194439 - DNA, 20 bp, Artificial Sequence
  chemically synthesized
caagattgcacatgactaga

SEQ ID NO: 194440 - DNA, 20 bp, Artificial Sequence
  chemically synthesized
aagattgcacatgactagaa

SEQ ID NO: 194441 - DNA, 20 bp, Artificial Sequence
  chemically synthesized
gacctcttcctgtgcctttc

SEQ ID NO: 194442 - DNA, 20 bp, Artificial Sequence
  chemically synthesized
tgcacatgactagaaaggca

SEQ ID NO: 194443 - DNA, 20 bp, Artificial Sequence
  chemically synthesized
gcacatgactagaaaggcac

SEQ ID NO: 194444 - DNA, 20 bp, Artificial Sequence
  chemically synthesized
catgactagaaaggcacagg

SEQ ID NO: 194445 - DNA, 20 bp, Artificial Sequence
  chemically synthesized
tgactagaaaggcacaggaa

SEQ ID NO: 194446 - DNA, 20 bp, Artificial Sequence
  chemically synthesized
gactagaaaggcacaggaag

SEQ ID NO: 194447 - DNA, 20 bp, Artificial Sequence
  chemically synthesized
aaggcacaggaagaggtcaa

SEQ ID NO: 194448 - DNA, 20 bp, Artificial Sequence
  chemically synthesized
gaagaggtcaaaagtgtctg

SEQ ID NO: 194449 - DNA, 20 bp, Artificial Sequence
  chemically synthesized
aagaggtcaaaagtgtctga

SEQ ID NO: 194450 - DNA, 20 bp, Artificial Sequence
  chemically synthesized
ctttattttcagttatcctt

SEQ ID NO: 194451 - DNA, 20 bp, Artificial Sequence
  chemically synthesized
ctgaaggataactgaaaata

SEQ ID NO: 194452 - DNA, 20 bp, Artificial Sequence
  chemically synthesized
tgaaggataactgaaaataa

SEQ ID NO: 194453 - DNA, 20 bp, Artificial Sequence
  chemically synthesized
tgactgactccctttatttt

SEQ ID NO: 194454 - DNA, 20 bp, Artificial Sequence
  chemically synthesized
gaaggataactgaaaataaa

SEQ ID NO: 194455 - DNA, 20 bp, Artificial Sequence
  chemically synthesized
aggataactgaaaataaagg

SEQ ID NO: 194456 - DNA, 20 bp, Artificial Sequence
  chemically synthesized
taactgaaaataaagggagt

SEQ ID NO: 194457 - DNA, 20 bp, Artificial Sequence
  chemically synthesized
aagggagtcagtcaatcttt

SEQ ID NO: 194458 - DNA, 20 bp, Artificial Sequence
  chemically synthesized
cccccagcaatagcagctaa

SEQ ID NO: 194459 - DNA, 20 bp, Artificial Sequence
  chemically synthesized
aatcttttagctgctattgc

SEQ ID NO: 194460 - DNA, 20 bp, Artificial Sequence
  chemically synthesized
acagagacccccagcaatag

SEQ ID NO: 194461 - DNA, 20 bp, Artificial Sequence
  chemically synthesized
atcttttagctgctattgct

SEQ ID NO: 194462 - DNA, 20 bp, Artificial Sequence
  chemically synthesized
tcttttagctgctattgctg

SEQ ID NO: 194463 - DNA, 20 bp, Artificial Sequence
  chemically synthesized
cttttagctgctattgctgg

SEQ ID NO: 194464 - DNA, 20 bp, Artificial Sequence
  chemically synthesized
tttacagagacccccagcaa

SEQ ID NO: 194465 - DNA, 20 bp, Artificial Sequence
  chemically synthesized
aacttatttacagagacccc

SEQ ID NO: 194466 - DNA, 20 bp, Artificial Sequence
  chemically synthesized
tgctgggggtctctgtaaat

SEQ ID NO: 194467 - DNA, 20 bp, Artificial Sequence
  chemically synthesized
tggaaagcaacttatttaca

SEQ ID NO: 194468 - DNA, 20 bp, Artificial Sequence
  chemically synthesized
cttggaaagcaacttattta

SEQ ID NO: 194469 - DNA, 20 bp, Artificial Sequence
  chemically synthesized
ctgtaaataagttgctttcc

SEQ ID NO: 194470 - DNA, 20 bp, Artificial Sequence
  chemically synthesized
tcaaaggccatgaacttgga

SEQ ID NO: 194471 - DNA, 20 bp, Artificial Sequence
  chemically synthesized
taagttgctttccaagttca

SEQ ID NO: 194472 - DNA, 20 bp, Artificial Sequence
  chemically synthesized
tgcttcaaaggccatgaact

SEQ ID NO: 194473 - DNA, 20 bp, Artificial Sequence
  chemically synthesized
ttccaagttcatggcctttg

SEQ ID NO: 194474 - DNA, 20 bp, Artificial Sequence
  chemically synthesized
tgtaatgaagggtgcttcaa

SEQ ID NO: 194475 - DNA, 20 bp, Artificial Sequence
  chemically synthesized
ttgtaatgaagggtgcttca

SEQ ID NO: 194476 - DNA, 20 bp, Artificial Sequence
  chemically synthesized
aacgcactgattgtaatgaa

SEQ ID NO: 194477 - DNA, 20 bp, Artificial Sequence
  chemically synthesized
aaacgcactgattgtaatga

SEQ ID NO: 194478 - DNA, 20 bp, Artificial Sequence
  chemically synthesized
aaaacgcactgattgtaatg

SEQ ID NO: 194479 - DNA, 20 bp, Artificial Sequence
  chemically synthesized
gaagcacccttcattacaat

SEQ ID NO: 194480 - DNA, 20 bp, Artificial Sequence
  chemically synthesized
tatgataacgttgtgtgtta

SEQ ID NO: 194481 - DNA, 20 bp, Artificial Sequence
  chemically synthesized
ttatcataattttgttttat

SEQ ID NO: 194482 - DNA, 20 bp, Artificial Sequence
  chemically synthesized
tatcataattttgttttatg

SEQ ID NO: 194483 - DNA, 20 bp, Artificial Sequence
  chemically synthesized
taattttgttttatgaggca

SEQ ID NO: 194484 - DNA, 20 bp, Artificial Sequence
  chemically synthesized
aattttgttttatgaggcat

SEQ ID NO: 194485 - DNA, 20 bp, Artificial Sequence
  chemically synthesized
attttgttttatgaggcata

SEQ ID NO: 194486 - DNA, 20 bp, Artificial Sequence
  chemically synthesized
gttttatgaggcatagggca

SEQ ID NO: 194487 - DNA, 20 bp, Artificial Sequence
  chemically synthesized
tttatgaggcatagggcaaa

SEQ ID NO: 194488 - DNA, 20 bp, Artificial Sequence
  chemically synthesized
ttatgaggcatagggcaaag

SEQ ID NO: 194489 - DNA, 20 bp, Artificial Sequence
  chemically synthesized
aagaggcaatatgcattttt

SEQ ID NO: 194490 - DNA, 20 bp, Artificial Sequence
  chemically synthesized
taaagacatgcatagatttc

SEQ ID NO: 194491 - DNA, 20 bp, Artificial Sequence
  chemically synthesized
tactaacttaaagacatgca

SEQ ID NO: 194492 - DNA, 20 bp, Artificial Sequence
  chemically synthesized
tgaaatctatgcatgtcttt

SEQ ID NO: 194493 - DNA, 20 bp, Artificial Sequence
  chemically synthesized
atctatgcatgtctttaagt

SEQ ID NO: 194494 - DNA, 20 bp, Artificial Sequence
  chemically synthesized
tatttatgtctactaactta

SEQ ID NO: 194495 - DNA, 20 bp, Artificial Sequence
  chemically synthesized
tatgcatgtctttaagttag

SEQ ID NO: 194496 - DNA, 20 bp, Artificial Sequence
  chemically synthesized
ttacttcaattcaatcgtga

SEQ ID NO: 194497 - DNA, 20 bp, Artificial Sequence
  chemically synthesized
attacttcaattcaatcgtg

SEQ ID NO: 194498 - DNA, 20 bp, Artificial Sequence
  chemically synthesized
aatccttcacgattgaattg

SEQ ID NO: 194499 - DNA, 20 bp, Artificial Sequence
  chemically synthesized
agtaattttcattgaatatg

SEQ ID NO: 194500 - DNA, 20 bp, Artificial Sequence
  chemically synthesized
attttctttagagaataatg

SEQ ID NO: 194501 - DNA, 20 bp, Artificial Sequence
  chemically synthesized
aattacttcattattctcta

SEQ ID NO: 194502 - DNA, 20 bp, Artificial Sequence
  chemically synthesized
atctctgtccattttcttta

SEQ ID NO: 194503 - DNA, 20 bp, Artificial Sequence
  chemically synthesized
tcattattctctaaagaaaa

SEQ ID NO: 194504 - DNA, 20 bp, Artificial Sequence
  chemically synthesized
taatctctgtccattttctt

SEQ ID NO: 194505 - DNA, 20 bp, Artificial Sequence
  chemically synthesized
tattctctaaagaaaatgga

SEQ ID NO: 194506 - DNA, 20 bp, Artificial Sequence
  chemically synthesized
ttctctaaagaaaatggaca

SEQ ID NO: 194507 - DNA, 20 bp, Artificial Sequence
  chemically synthesized
tttctttctccaaataaaaa

SEQ ID NO: 194508 - DNA, 20 bp, Artificial Sequence
  chemically synthesized
cagagattactatttttatt

SEQ ID NO: 194509 - DNA, 20 bp, Artificial Sequence
  chemically synthesized
gagattactatttttatttg

SEQ ID NO: 194510 - DNA, 20 bp, Artificial Sequence
  chemically synthesized
ttactatttttatttggaga

SEQ ID NO: 194511 - DNA, 20 bp, Artificial Sequence
  chemically synthesized
atttggagaaagaaacactt

SEQ ID NO: 194512 - DNA, 20 bp, Artificial Sequence
  chemically synthesized
gaaagaaacacttaagtcta

SEQ ID NO: 194513 - DNA, 20 bp, Artificial Sequence
  chemically synthesized
cctttcaggcccatagactt

SEQ ID NO: 194514 - DNA, 20 bp, Artificial Sequence
  chemically synthesized
aaagaaacacttaagtctat

SEQ ID NO: 194515 - DNA, 20 bp, Artificial Sequence
  chemically synthesized
tattaaccctttcaggccca

SEQ ID NO: 194516 - DNA, 20 bp, Artificial Sequence
  chemically synthesized
acttaagtctatgggcctga

SEQ ID NO: 194517 - DNA, 20 bp, Artificial Sequence
  chemically synthesized
cttaagtctatgggcctgaa

SEQ ID NO: 194518 - DNA, 20 bp, Artificial Sequence
  chemically synthesized
ttaagtctatgggcctgaaa

SEQ ID NO: 194519 - DNA, 20 bp, Artificial Sequence
  chemically synthesized
ttaattgtattaaccctttc

SEQ ID NO: 194520 - DNA, 20 bp, Artificial Sequence
  chemically synthesized
attaattgtattaacccttt

SEQ ID NO: 194521 - DNA, 20 bp, Artificial Sequence
  chemically synthesized
tacaattaatgcatttttaa

SEQ ID NO: 194522 - DNA, 20 bp, Artificial Sequence
  chemically synthesized
gttatcatctgagagtaata

SEQ ID NO: 194523 - DNA, 20 bp, Artificial Sequence
  chemically synthesized
ttaaaagtctatattactct

SEQ ID NO: 194524 - DNA, 20 bp, Artificial Sequence
  chemically synthesized
gtgaattagttatcatctga

SEQ ID NO: 194525 - DNA, 20 bp, Artificial Sequence
  chemically synthesized
aagtgaattagttatcatct

SEQ ID NO: 194526 - DNA, 20 bp, Artificial Sequence
  chemically synthesized
actaagttcttcaagtgaat

SEQ ID NO: 194527 - DNA, 20 bp, Artificial Sequence
  chemically synthesized
gatgataactaattcacttg

SEQ ID NO: 194528 - DNA, 20 bp, Artificial Sequence
  chemically synthesized
tgtatcaaactaagttcttc

SEQ ID NO: 194529 - DNA, 20 bp, Artificial Sequence
  chemically synthesized
actaattcacttgaagaact

SEQ ID NO: 194530 - DNA, 20 bp, Artificial Sequence
  chemically synthesized
gcctctaaatgtatcaaact

SEQ ID NO: 194531 - DNA, 20 bp, Artificial Sequence
  chemically synthesized
agaacttagtttgatacatt

SEQ ID NO: 194532 - DNA, 20 bp, Artificial Sequence
  chemically synthesized
aacttagtttgatacattta

SEQ ID NO: 194533 - DNA, 20 bp, Artificial Sequence
  chemically synthesized
acttagtttgatacatttag

SEQ ID NO: 194534 - DNA, 20 bp, Artificial Sequence
  chemically synthesized
tgatacatttagaggctcct

SEQ ID NO: 194535 - DNA, 20 bp, Artificial Sequence
  chemically synthesized
atacatttagaggctccttg

SEQ ID NO: 194536 - DNA, 20 bp, Artificial Sequence
  chemically synthesized
ctcttttgaagaactccaag

SEQ ID NO: 194537 - DNA, 20 bp, Artificial Sequence
  chemically synthesized
acctcttttgaagaactcca

SEQ ID NO: 194538 - DNA, 20 bp, Artificial Sequence
  chemically synthesized
aacctcttttgaagaactcc

SEQ ID NO: 194539 - DNA, 20 bp, Artificial Sequence
  chemically synthesized
ggctccttggagttcttcaa

SEQ ID NO: 194540 - DNA, 20 bp, Artificial Sequence
  chemically synthesized
ctccttggagttcttcaaaa

SEQ ID NO: 194541 - DNA, 20 bp, Artificial Sequence
  chemically synthesized
tccttggagttcttcaaaag

SEQ ID NO: 194542 - DNA, 20 bp, Artificial Sequence
  chemically synthesized
ctctgtagcaacctcttttg

SEQ ID NO: 194543 - DNA, 20 bp, Artificial Sequence
  chemically synthesized
ttcttcaaaagaggttgcta

SEQ ID NO: 194544 - DNA, 20 bp, Artificial Sequence
  chemically synthesized
cttcaaaagaggttgctaca

SEQ ID NO: 194545 - DNA, 20 bp, Artificial Sequence
  chemically synthesized
tataataccctggaactctg

SEQ ID NO: 194546 - DNA, 20 bp, Artificial Sequence
  chemically synthesized
aagaggttgctacagagttc

SEQ ID NO: 194547 - DNA, 20 bp, Artificial Sequence
  chemically synthesized
agaggttgctacagagttcc

SEQ ID NO: 194548 - DNA, 20 bp, Artificial Sequence
  chemically synthesized
gaggttgctacagagttcca

SEQ ID NO: 194549 - DNA, 20 bp, Artificial Sequence
  chemically synthesized
taataatgattataataccc

SEQ ID NO: 194550 - DNA, 20 bp, Artificial Sequence
  chemically synthesized
attataatcattattaattg

SEQ ID NO: 194551 - DNA, 20 bp, Artificial Sequence
  chemically synthesized
ttattaattgcagtatttta

SEQ ID NO: 194552 - DNA, 20 bp, Artificial Sequence
  chemically synthesized
cagtattttaaagttcacac

SEQ ID NO: 194553 - DNA, 20 bp, Artificial Sequence
  chemically synthesized
ttttaaagttcacaccagat

SEQ ID NO: 194554 - DNA, 20 bp, Artificial Sequence
  chemically synthesized
atttttcttggaagctcatc

SEQ ID NO: 194555 - DNA, 20 bp, Artificial Sequence
  chemically synthesized
ttcacaccagatgagcttcc

SEQ ID NO: 194556 - DNA, 20 bp, Artificial Sequence
  chemically synthesized
atttgggtcatttttcttgg

SEQ ID NO: 194557 - DNA, 20 bp, Artificial Sequence
  chemically synthesized
taaatttgggtcatttttct

SEQ ID NO: 194558 - DNA, 20 bp, Artificial Sequence
  chemically synthesized
gtgacctttcaaataaattt

SEQ ID NO: 194559 - DNA, 20 bp, Artificial Sequence
  chemically synthesized
tgtgacctttcaaataaatt

SEQ ID NO: 194560 - DNA, 20 bp, Artificial Sequence
  chemically synthesized
aatgacccaaatttatttga

SEQ ID NO: 194561 - DNA, 20 bp, Artificial Sequence
  chemically synthesized
atgacccaaatttatttgaa

SEQ ID NO: 194562 - DNA, 20 bp, Artificial Sequence
  chemically synthesized
ttatcaccatgtggttggat

SEQ ID NO: 194563 - DNA, 20 bp, Artificial Sequence
  chemically synthesized
attttacttatccaaccaca

SEQ ID NO: 194564 - DNA, 20 bp, Artificial Sequence
  chemically synthesized
tatttttatcaccatgtggt

SEQ ID NO: 194565 - DNA, 20 bp, Artificial Sequence
  chemically synthesized
tccctatttttatcaccatg

SEQ ID NO: 194566 - DNA, 20 bp, Artificial Sequence
  chemically synthesized
caaccacatggtgataaaaa

SEQ ID NO: 194567 - DNA, 20 bp, Artificial Sequence
  chemically synthesized
aaccacatggtgataaaaat

SEQ ID NO: 194568 - DNA, 20 bp, Artificial Sequence
  chemically synthesized
accacatggtgataaaaata

SEQ ID NO: 194569 - DNA, 20 bp, Artificial Sequence
  chemically synthesized
agttgagctggattttatca

SEQ ID NO: 194570 - DNA, 20 bp, Artificial Sequence
  chemically synthesized
agggaaaccatgataaaatc

SEQ ID NO: 194571 - DNA, 20 bp, Artificial Sequence
  chemically synthesized
atgataaaatccagctcaac

SEQ ID NO: 194572 - DNA, 20 bp, Artificial Sequence
  chemically synthesized
tactacctacctagttgagc

SEQ ID NO: 194573 - DNA, 20 bp, Artificial Sequence
  chemically synthesized
tgataaaatccagctcaact

SEQ ID NO: 194574 - DNA, 20 bp, Artificial Sequence
  chemically synthesized
taaaatccagctcaactagg

SEQ ID NO: 194575 - DNA, 20 bp, Artificial Sequence
  chemically synthesized
accatactacctacctagtt

SEQ ID NO: 194576 - DNA, 20 bp, Artificial Sequence
  chemically synthesized
aaaatccagctcaactaggt

SEQ ID NO: 194577 - DNA, 20 bp, Artificial Sequence
  chemically synthesized
atccagctcaactaggtagg

SEQ ID NO: 194578 - DNA, 20 bp, Artificial Sequence
  chemically synthesized
gctataccatactacctacc

SEQ ID NO: 194579 - DNA, 20 bp, Artificial Sequence
  chemically synthesized
gctcaactaggtaggtagta

SEQ ID NO: 194580 - DNA, 20 bp, Artificial Sequence
  chemically synthesized
actaggtaggtagtatggta

SEQ ID NO: 194581 - DNA, 20 bp, Artificial Sequence
  chemically synthesized
aggtaggtagtatggtatag

SEQ ID NO: 194582 - DNA, 20 bp, Artificial Sequence
  chemically synthesized
tagtatggtatagcagaaac

SEQ ID NO: 194583 - DNA, 20 bp, Artificial Sequence
  chemically synthesized
gtatagcagaaacgagtccc

SEQ ID NO: 194584 - DNA, 20 bp, Artificial Sequence
  chemically synthesized
gctctcagattttaaatcca

SEQ ID NO: 194585 - DNA, 20 bp, Artificial Sequence
  chemically synthesized
agctctcagattttaaatcc

SEQ ID NO: 194586 - DNA, 20 bp, Artificial Sequence
  chemically synthesized
cagctctcagattttaaatc

SEQ ID NO: 194587 - DNA, 20 bp, Artificial Sequence
  chemically synthesized
agtccctggatttaaaatct

SEQ ID NO: 194588 - DNA, 20 bp, Artificial Sequence
  chemically synthesized
tccctggatttaaaatctga

SEQ ID NO: 194589 - DNA, 20 bp, Artificial Sequence
  chemically synthesized
tcaaagaggaaatcagctct

SEQ ID NO: 194590 - DNA, 20 bp, Artificial Sequence
  chemically synthesized
gaaggaatcaaagaggaaat

SEQ ID NO: 194591 - DNA, 20 bp, Artificial Sequence
  chemically synthesized
ggtacatgaaggaatcaaag

SEQ ID NO: 194592 - DNA, 20 bp, Artificial Sequence
  chemically synthesized
tggtacatgaaggaatcaaa

SEQ ID NO: 194593 - DNA, 20 bp, Artificial Sequence
  chemically synthesized
attggtacatgaaggaatca

SEQ ID NO: 194594 - DNA, 20 bp, Artificial Sequence
  chemically synthesized
atcacacaattggtacatga

SEQ ID NO: 194595 - DNA, 20 bp, Artificial Sequence
  chemically synthesized
aatcacacaattggtacatg

SEQ ID NO: 194596 - DNA, 20 bp, Artificial Sequence
  chemically synthesized
tatagttaaaatcacacaat

SEQ ID NO: 194597 - DNA, 20 bp, Artificial Sequence
  chemically synthesized
catatgaggattaagcagta

SEQ ID NO: 194598 - DNA, 20 bp, Artificial Sequence
  chemically synthesized
taagacatatgaggattaag

SEQ ID NO: 194599 - DNA, 20 bp, Artificial Sequence
  chemically synthesized
aattaagacatatgaggatt

SEQ ID NO: 194600 - DNA, 20 bp, Artificial Sequence
  chemically synthesized
ctgagaaattaagacatatg

SEQ ID NO: 194601 - DNA, 20 bp, Artificial Sequence
  chemically synthesized
gctgagaaattaagacatat

SEQ ID NO: 194602 - DNA, 20 bp, Artificial Sequence
  chemically synthesized
cctcatatgtcttaatttct

SEQ ID NO: 194603 - DNA, 20 bp, Artificial Sequence
  chemically synthesized
cattttacagctgagaaatt

SEQ ID NO: 194604 - DNA, 20 bp, Artificial Sequence
  chemically synthesized
attatgcccattttacagct

SEQ ID NO: 194605 - DNA, 20 bp, Artificial Sequence
  chemically synthesized
ttaatttctcagctgtaaaa

SEQ ID NO: 194606 - DNA, 20 bp, Artificial Sequence
  chemically synthesized
taatttctcagctgtaaaat

SEQ ID NO: 194607 - DNA, 20 bp, Artificial Sequence
  chemically synthesized
acattattatgcccatttta

SEQ ID NO: 194608 - DNA, 20 bp, Artificial Sequence
  chemically synthesized
taataatgtttgtcttacct

SEQ ID NO: 194609 - DNA, 20 bp, Artificial Sequence
  chemically synthesized
aaatttgtcctcactgaggt

SEQ ID NO: 194610 - DNA, 20 bp, Artificial Sequence
  chemically synthesized
aatgtttgtcttacctcagt

SEQ ID NO: 194611 - DNA, 20 bp, Artificial Sequence
  chemically synthesized
atgtttgtcttacctcagtg

SEQ ID NO: 194612 - DNA, 20 bp, Artificial Sequence
  chemically synthesized
aaaaaaatttgtcctcactg

SEQ ID NO: 194613 - DNA, 20 bp, Artificial Sequence
  chemically synthesized
aaaaaaaatttgtcctcact

SEQ ID NO: 194614 - DNA, 20 bp, Artificial Sequence
  chemically synthesized
tgaggacaaatttttttttt

SEQ ID NO: 194615 - DNA, 20 bp, Artificial Sequence
  chemically synthesized
ttttttcagtgctgtaattc

SEQ ID NO: 194616 - DNA, 20 bp, Artificial Sequence
  chemically synthesized
agttctagctgctggaatta

SEQ ID NO: 194617 - DNA, 20 bp, Artificial Sequence
  chemically synthesized
tttcagtgctgtaattccag

SEQ ID NO: 194618 - DNA, 20 bp, Artificial Sequence
  chemically synthesized
agtgctgtaattccagcagc

SEQ ID NO: 194619 - DNA, 20 bp, Artificial Sequence
  chemically synthesized
ccaaacgcagttctagctgc

SEQ ID NO: 194620 - DNA, 20 bp, Artificial Sequence
  chemically synthesized
ctctgtgccaaacgcagttc

SEQ ID NO: 194621 - DNA, 20 bp, Artificial Sequence
  chemically synthesized
ccagcagctagaactgcgtt

SEQ ID NO: 194622 - DNA, 20 bp, Artificial Sequence
  chemically synthesized
cctctgctctgtgccaaacg

SEQ ID NO: 194623 - DNA, 20 bp, Artificial Sequence
  chemically synthesized
agctagaactgcgtttggca

SEQ ID NO: 194624 - DNA, 20 bp, Artificial Sequence
  chemically synthesized
ctagaactgcgtttggcaca

SEQ ID NO: 194625 - DNA, 20 bp, Artificial Sequence
  chemically synthesized
gaactgcgtttggcacagag

SEQ ID NO: 194626 - DNA, 20 bp, Artificial Sequence
  chemically synthesized
actgcgtttggcacagagca

SEQ ID NO: 194627 - DNA, 20 bp, Artificial Sequence
  chemically synthesized
ctgcgtttggcacagagcag

SEQ ID NO: 194628 - DNA, 20 bp, Artificial Sequence
  chemically synthesized
tttggcacagagcagaggct

SEQ ID NO: 194629 - DNA, 20 bp, Artificial Sequence
  chemically synthesized
ttaatttaacaaacatttct

SEQ ID NO: 194630 - DNA, 20 bp, Artificial Sequence
  chemically synthesized
taaattaacacgtgaatgaa

SEQ ID NO: 194631 - DNA, 20 bp, Artificial Sequence
  chemically synthesized
taatgaatgttgtgcgcatt

SEQ ID NO: 194632 - DNA, 20 bp, Artificial Sequence
  chemically synthesized
tgtgcgcattcagtaacatg

SEQ ID NO: 194633 - DNA, 20 bp, Artificial Sequence
  chemically synthesized
cagatggtatttaatagata

SEQ ID NO: 194634 - DNA, 20 bp, Artificial Sequence
  chemically synthesized
aatatccagatggtatttaa

SEQ ID NO: 194635 - DNA, 20 bp, Artificial Sequence
  chemically synthesized
catatctattaaataccatc

SEQ ID NO: 194636 - DNA, 20 bp, Artificial Sequence
  chemically synthesized
taatagataaaatatccaga

SEQ ID NO: 194637 - DNA, 20 bp, Artificial Sequence
  chemically synthesized
gatataatagataaaatatc

SEQ ID NO: 194638 - DNA, 20 bp, Artificial Sequence
  chemically synthesized
gatattttatctattatatc

SEQ ID NO: 194639 - DNA, 20 bp, Artificial Sequence
  chemically synthesized
ttttcattacccagatataa

SEQ ID NO: 194640 - DNA, 20 bp, Artificial Sequence
  chemically synthesized
atattttatctattatatct

SEQ ID NO: 194641 - DNA, 20 bp, Artificial Sequence
  chemically synthesized
gtatagttattttcattacc

SEQ ID NO: 194642 - DNA, 20 bp, Artificial Sequence
  chemically synthesized
ggcagtagcacagcattgta

SEQ ID NO: 194643 - DNA, 20 bp, Artificial Sequence
  chemically synthesized
gaaagaaacgggcagtagca

SEQ ID NO: 194644 - DNA, 20 bp, Artificial Sequence
  chemically synthesized
aattggaaagaaacgggcag

SEQ ID NO: 194645 - DNA, 20 bp, Artificial Sequence
  chemically synthesized
cagaattggaaagaaacggg

SEQ ID NO: 194646 - DNA, 20 bp, Artificial Sequence
  chemically synthesized
atgcagaattggaaagaaac

SEQ ID NO: 194647 - DNA, 20 bp, Artificial Sequence
  chemically synthesized
aatgcagaattggaaagaaa

SEQ ID NO: 194648 - DNA, 20 bp, Artificial Sequence
  chemically synthesized
tcattgaatgcagaattgga

SEQ ID NO: 194649 - DNA, 20 bp, Artificial Sequence
  chemically synthesized
gacgtcattgaatgcagaat

SEQ ID NO: 194650 - DNA, 20 bp, Artificial Sequence
  chemically synthesized
cagtgtgacgtcattgaatg

SEQ ID NO: 194651 - DNA, 20 bp, Artificial Sequence
  chemically synthesized
tgcattcaatgacgtcacac

SEQ ID NO: 194652 - DNA, 20 bp, Artificial Sequence
  chemically synthesized
attcaatgacgtcacactgg

SEQ ID NO: 194653 - DNA, 20 bp, Artificial Sequence
  chemically synthesized
catagccaatttcaagctac

SEQ ID NO: 194654 - DNA, 20 bp, Artificial Sequence
  chemically synthesized
tcacactggtagcttgaaat

SEQ ID NO: 194655 - DNA, 20 bp, Artificial Sequence
  chemically synthesized
gctccagcatagccaatttc

SEQ ID NO: 194656 - DNA, 20 bp, Artificial Sequence
  chemically synthesized
tagcttgaaattggctatgc

SEQ ID NO: 194657 - DNA, 20 bp, Artificial Sequence
  chemically synthesized
gcttgaaattggctatgctg

SEQ ID NO: 194658 - DNA, 20 bp, Artificial Sequence
  chemically synthesized
gttgcacaaatgctccagca

SEQ ID NO: 194659 - DNA, 20 bp, Artificial Sequence
  chemically synthesized
attttgttgcacaaatgctc

SEQ ID NO: 194660 - DNA, 20 bp, Artificial Sequence
  chemically synthesized
agtgtctgatttgcagcatt

SEQ ID NO: 194661 - DNA, 20 bp, Artificial Sequence
  chemically synthesized
atttgccaaatgctgcaaat

SEQ ID NO: 194662 - DNA, 20 bp, Artificial Sequence
  chemically synthesized
gagagagagtgtctgatttg

SEQ ID NO: 194663 - DNA, 20 bp, Artificial Sequence
  chemically synthesized
aggctcttggcggggagaga

SEQ ID NO: 194664 - DNA, 20 bp, Artificial Sequence
  chemically synthesized
agaggctcttggcggggaga

SEQ ID NO: 194665 - DNA, 20 bp, Artificial Sequence
  chemically synthesized
caagaggctcttggcgggga

SEQ ID NO: 194666 - DNA, 20 bp, Artificial Sequence
  chemically synthesized
agacactctctctccccgcc

SEQ ID NO: 194667 - DNA, 20 bp, Artificial Sequence
  chemically synthesized
aacaagaggctcttggcggg

SEQ ID NO: 194668 - DNA, 20 bp, Artificial Sequence
  chemically synthesized
acactctctctccccgccaa

SEQ ID NO: 194669 - DNA, 20 bp, Artificial Sequence
  chemically synthesized
ttaacaagaggctcttggcg

SEQ ID NO: 194670 - DNA, 20 bp, Artificial Sequence
  chemically synthesized
tttaacaagaggctcttggc

SEQ ID NO: 194671 - DNA, 20 bp, Artificial Sequence
  chemically synthesized
gtttaacaagaggctcttgg

SEQ ID NO: 194672 - DNA, 20 bp, Artificial Sequence
  chemically synthesized
aatgtttaacaagaggctct

SEQ ID NO: 194673 - DNA, 20 bp, Artificial Sequence
  chemically synthesized
gctggtaaatgtttaacaag

SEQ ID NO: 194674 - DNA, 20 bp, Artificial Sequence
  chemically synthesized
tgctggtaaatgtttaacaa

SEQ ID NO: 194675 - DNA, 20 bp, Artificial Sequence
  chemically synthesized
tttgctggtaaatgtttaac

SEQ ID NO: 194676 - DNA, 20 bp, Artificial Sequence
  chemically synthesized
gcctcttgttaaacatttac

SEQ ID NO: 194677 - DNA, 20 bp, Artificial Sequence
  chemically synthesized
gacctggaacagtggtttgc

SEQ ID NO: 194678 - DNA, 20 bp, Artificial Sequence
  chemically synthesized
ttaccagcaaaccactgttc

SEQ ID NO: 194679 - DNA, 20 bp, Artificial Sequence
  chemically synthesized
taccagcaaaccactgttcc

SEQ ID NO: 194680 - DNA, 20 bp, Artificial Sequence
  chemically synthesized
ataatgaggacctggaacag

SEQ ID NO: 194681 - DNA, 20 bp, Artificial Sequence
  chemically synthesized
cagataatgaggacctggaa

SEQ ID NO: 194682 - DNA, 20 bp, Artificial Sequence
  chemically synthesized
gaggccagataatgaggacc

SEQ ID NO: 194683 - DNA, 20 bp, Artificial Sequence
  chemically synthesized
tgttccaggtcctcattatc

SEQ ID NO: 194684 - DNA, 20 bp, Artificial Sequence
  chemically synthesized
taagcagaggccagataatg

SEQ ID NO: 194685 - DNA, 20 bp, Artificial Sequence
  chemically synthesized
ataagcagaggccagataat

SEQ ID NO: 194686 - DNA, 20 bp, Artificial Sequence
  chemically synthesized
aacaaagtataagcagaggc

SEQ ID NO: 194687 - DNA, 20 bp, Artificial Sequence
  chemically synthesized
agacaacaaagtataagcag

SEQ ID NO: 194688 - DNA, 20 bp, Artificial Sequence
  chemically synthesized
aagacaacaaagtataagca

SEQ ID NO: 194689 - DNA, 20 bp, Artificial Sequence
  chemically synthesized
agaagacaacaaagtataag

SEQ ID NO: 194690 - DNA, 20 bp, Artificial Sequence
  chemically synthesized
gatagaagacaacaaagtat

SEQ ID NO: 194691 - DNA, 20 bp, Artificial Sequence
  chemically synthesized
agagaagatagaagacaaca

SEQ ID NO: 194692 - DNA, 20 bp, Artificial Sequence
  chemically synthesized
aaaagttgtagagaagatag

SEQ ID NO: 194693 - DNA, 20 bp, Artificial Sequence
  chemically synthesized
agcaaaagttgtagagaaga

SEQ ID NO: 194694 - DNA, 20 bp, Artificial Sequence
  chemically synthesized
cttcagcaaaagttgtagag

SEQ ID NO: 194695 - DNA, 20 bp, Artificial Sequence
  chemically synthesized
tgacttcagcaaaagttgta

SEQ ID NO: 194696 - DNA, 20 bp, Artificial Sequence
  chemically synthesized
aatgacttcagcaaaagttg

SEQ ID NO: 194697 - DNA, 20 bp, Artificial Sequence
  chemically synthesized
cttctctacaacttttgctg

SEQ ID NO: 194698 - DNA, 20 bp, Artificial Sequence
  chemically synthesized
tttcagaatgacttcagcaa

SEQ ID NO: 194699 - DNA, 20 bp, Artificial Sequence
  chemically synthesized
ctagtatttcagaatgactt

SEQ ID NO: 194700 - DNA, 20 bp, Artificial Sequence
  chemically synthesized
ctgaagtcattctgaaatac

SEQ ID NO: 194701 - DNA, 20 bp, Artificial Sequence
  chemically synthesized
tttggtgactgctagtattt

SEQ ID NO: 194702 - DNA, 20 bp, Artificial Sequence
  chemically synthesized
aagtcattctgaaatactag

SEQ ID NO: 194703 - DNA, 20 bp, Artificial Sequence
  chemically synthesized
tggattattttggtgactgc

SEQ ID NO: 194704 - DNA, 20 bp, Artificial Sequence
  chemically synthesized
gcccagagcctggattattt

SEQ ID NO: 194705 - DNA, 20 bp, Artificial Sequence
  chemically synthesized
tagcagtcaccaaaataatc

SEQ ID NO: 194706 - DNA, 20 bp, Artificial Sequence
  chemically synthesized
agcagtcaccaaaataatcc

SEQ ID NO: 194707 - DNA, 20 bp, Artificial Sequence
  chemically synthesized
caccaaaataatccaggctc

SEQ ID NO: 194708 - DNA, 20 bp, Artificial Sequence
  chemically synthesized
accaaaataatccaggctct

SEQ ID NO: 194709 - DNA, 20 bp, Artificial Sequence
  chemically synthesized
gtgcagtgacgcccagagcc

SEQ ID NO: 194710 - DNA, 20 bp, Artificial Sequence
  chemically synthesized
agattgtgcagtgacgccca

SEQ ID NO: 194711 - DNA, 20 bp, Artificial Sequence
  chemically synthesized
ggagattgtgcagtgacgcc

SEQ ID NO: 194712 - DNA, 20 bp, Artificial Sequence
  chemically synthesized
aaggcaaggtggagattgtg

SEQ ID NO: 194713 - DNA, 20 bp, Artificial Sequence
  chemically synthesized
gaaattttcaaggcaaggtg

SEQ ID NO: 194714 - DNA, 20 bp, Artificial Sequence
  chemically synthesized
gggaaattttcaaggcaagg

SEQ ID NO: 194715 - DNA, 20 bp, Artificial Sequence
  chemically synthesized
ggagggaaattttcaaggca

SEQ ID NO: 194716 - DNA, 20 bp, Artificial Sequence
  chemically synthesized
aggagggaaattttcaaggc

SEQ ID NO: 194717 - DNA, 20 bp, Artificial Sequence
  chemically synthesized
ttctaggagggaaattttca

SEQ ID NO: 194718 - DNA, 20 bp, Artificial Sequence
  chemically synthesized
tttctaggagggaaattttc

SEQ ID NO: 194719 - DNA, 20 bp, Artificial Sequence
  chemically synthesized
tgccttgaaaatttccctcc

SEQ ID NO: 194720 - DNA, 20 bp, Artificial Sequence
  chemically synthesized
catgatacgtatttctagga

SEQ ID NO: 194721 - DNA, 20 bp, Artificial Sequence
  chemically synthesized
acatgatacgtatttctagg

SEQ ID NO: 194722 - DNA, 20 bp, Artificial Sequence
  chemically synthesized
gacatgatacgtatttctag

SEQ ID NO: 194723 - DNA, 20 bp, Artificial Sequence
  chemically synthesized
aagacatgatacgtatttct

SEQ ID NO: 194724 - DNA, 20 bp, Artificial Sequence
  chemically synthesized
taagacatgatacgtatttc

SEQ ID NO: 194725 - DNA, 20 bp, Artificial Sequence
  chemically synthesized
tagaaatacgtatcatgtct

SEQ ID NO: 194726 - DNA, 20 bp, Artificial Sequence
  chemically synthesized
tatccgagtaagtgttagct

SEQ ID NO: 194727 - DNA, 20 bp, Artificial Sequence
  chemically synthesized
aaggatatccgagtaagtgt

SEQ ID NO: 194728 - DNA, 20 bp, Artificial Sequence
  chemically synthesized
tgtcttagctaacacttact

SEQ ID NO: 194729 - DNA, 20 bp, Artificial Sequence
  chemically synthesized
gctttcaaggatatccgagt

SEQ ID NO: 194730 - DNA, 20 bp, Artificial Sequence
  chemically synthesized
gactgctttcaaggatatcc

SEQ ID NO: 194731 - DNA, 20 bp, Artificial Sequence
  chemically synthesized
acttactcggatatccttga

SEQ ID NO: 194732 - DNA, 20 bp, Artificial Sequence
  chemically synthesized
tactcggatatccttgaaag

SEQ ID NO: 194733 - DNA, 20 bp, Artificial Sequence
  chemically synthesized
gtagtcagagactgctttca

SEQ ID NO: 194734 - DNA, 20 bp, Artificial Sequence
  chemically synthesized
ggtagtcagagactgctttc

SEQ ID NO: 194735 - DNA, 20 bp, Artificial Sequence
  chemically synthesized
agtctaacttggggtagtca

SEQ ID NO: 194736 - DNA, 20 bp, Artificial Sequence
  chemically synthesized
caagtctaacttggggtagt

SEQ ID NO: 194737 - DNA, 20 bp, Artificial Sequence
  chemically synthesized
aagcagtctctgactacccc

SEQ ID NO: 194738 - DNA, 20 bp, Artificial Sequence
  chemically synthesized
tacccaagtctaacttgggg

SEQ ID NO: 194739 - DNA, 20 bp, Artificial Sequence
  chemically synthesized
agtctctgactaccccaagt

SEQ ID NO: 194740 - DNA, 20 bp, Artificial Sequence
  chemically synthesized
aggtacccaagtctaacttg

SEQ ID NO: 194741 - DNA, 20 bp, Artificial Sequence
  chemically synthesized
gaggtacccaagtctaactt

SEQ ID NO: 194742 - DNA, 20 bp, Artificial Sequence
  chemically synthesized
agaggtacccaagtctaact

SEQ ID NO: 194743 - DNA, 20 bp, Artificial Sequence
  chemically synthesized
tgactaccccaagttagact

SEQ ID NO: 194744 - DNA, 20 bp, Artificial Sequence
  chemically synthesized
gactaccccaagttagactt

SEQ ID NO: 194745 - DNA, 20 bp, Artificial Sequence
  chemically synthesized
aacacatggaagaggtaccc

SEQ ID NO: 194746 - DNA, 20 bp, Artificial Sequence
  chemically synthesized
gatagccaaacacatggaag

SEQ ID NO: 194747 - DNA, 20 bp, Artificial Sequence
  chemically synthesized
tgatagccaaacacatggaa

SEQ ID NO: 194748 - DNA, 20 bp, Artificial Sequence
  chemically synthesized
agtgatagccaaacacatgg

SEQ ID NO: 194749 - DNA, 20 bp, Artificial Sequence
  chemically synthesized
gggtacctcttccatgtgtt

SEQ ID NO: 194750 - DNA, 20 bp, Artificial Sequence
  chemically synthesized
ctgagtgatagccaaacaca

SEQ ID NO: 194751 - DNA, 20 bp, Artificial Sequence
  chemically synthesized
ccatgtgtttggctatcact

SEQ ID NO: 194752 - DNA, 20 bp, Artificial Sequence
  chemically synthesized
tggtgataaccactgagtga

SEQ ID NO: 194753 - DNA, 20 bp, Artificial Sequence
  chemically synthesized
tgtgtttggctatcactcag

SEQ ID NO: 194754 - DNA, 20 bp, Artificial Sequence
  chemically synthesized
ccgtcatggtgataaccact

SEQ ID NO: 194755 - DNA, 20 bp, Artificial Sequence
  chemically synthesized
ctcagtggttatcaccatga

SEQ ID NO: 194756 - DNA, 20 bp, Artificial Sequence
  chemically synthesized
acgttaggataataccgtca

SEQ ID NO: 194757 - DNA, 20 bp, Artificial Sequence
  chemically synthesized
agcaattattatcatacgtt

SEQ ID NO: 194758 - DNA, 20 bp, Artificial Sequence
  chemically synthesized
aagcaattattatcatacgt

SEQ ID NO: 194759 - DNA, 20 bp, Artificial Sequence
  chemically synthesized
ggggaggcacacaagtaaac

SEQ ID NO: 194760 - DNA, 20 bp, Artificial Sequence
  chemically synthesized
agctctcaggggaggcacac

SEQ ID NO: 194761 - DNA, 20 bp, Artificial Sequence
  chemically synthesized
tttacttgtgtgcctcccct

SEQ ID NO: 194762 - DNA, 20 bp, Artificial Sequence
  chemically synthesized
tacttgtgtgcctcccctga

SEQ ID NO: 194763 - DNA, 20 bp, Artificial Sequence
  chemically synthesized
cttcaaagagctctcagggg

SEQ ID NO: 194764 - DNA, 20 bp, Artificial Sequence
  chemically synthesized
acttcaaagagctctcaggg

SEQ ID NO: 194765 - DNA, 20 bp, Artificial Sequence
  chemically synthesized
gtacttcaaagagctctcag

SEQ ID NO: 194766 - DNA, 20 bp, Artificial Sequence
  chemically synthesized
tgtacttcaaagagctctca

SEQ ID NO: 194767 - DNA, 20 bp, Artificial Sequence
  chemically synthesized
ctgtacttcaaagagctctc

SEQ ID NO: 194768 - DNA, 20 bp, Artificial Sequence
  chemically synthesized
cctgtacttcaaagagctct

SEQ ID NO: 194769 - DNA, 20 bp, Artificial Sequence
  chemically synthesized
cctcccctgagagctctttg

SEQ ID NO: 194770 - DNA, 20 bp, Artificial Sequence
  chemically synthesized
gacagtccctgtacttcaaa

SEQ ID NO: 194771 - DNA, 20 bp, Artificial Sequence
  chemically synthesized
cctgagagctctttgaagta

SEQ ID NO: 194772 - DNA, 20 bp, Artificial Sequence
  chemically synthesized
aagacagtccctgtacttca

SEQ ID NO: 194773 - DNA, 20 bp, Artificial Sequence
  chemically synthesized
ctgagagctctttgaagtac

SEQ ID NO: 194774 - DNA, 20 bp, Artificial Sequence
  chemically synthesized
tgagagctctttgaagtaca

SEQ ID NO: 194775 - DNA, 20 bp, Artificial Sequence
  chemically synthesized
aactctaattaggaataaga

SEQ ID NO: 194776 - DNA, 20 bp, Artificial Sequence
  chemically synthesized
cagaaactctaattaggaat

SEQ ID NO: 194777 - DNA, 20 bp, Artificial Sequence
  chemically synthesized
gggactgtcttattcctaat

SEQ ID NO: 194778 - DNA, 20 bp, Artificial Sequence
  chemically synthesized
gactgtcttattcctaatta

SEQ ID NO: 194779 - DNA, 20 bp, Artificial Sequence
  chemically synthesized
aagatacagaaactctaatt

SEQ ID NO: 194780 - DNA, 20 bp, Artificial Sequence
  chemically synthesized
caagatacagaaactctaat

SEQ ID NO: 194781 - DNA, 20 bp, Artificial Sequence
  chemically synthesized
gctcctgtagaagcaagata

SEQ ID NO: 194782 - DNA, 20 bp, Artificial Sequence
  chemically synthesized
gtttctgtatcttgcttcta

SEQ ID NO: 194783 - DNA, 20 bp, Artificial Sequence
  chemically synthesized
tgggtagctcctgtagaagc

SEQ ID NO: 194784 - DNA, 20 bp, Artificial Sequence
  chemically synthesized
tttctgtatcttgcttctac

SEQ ID NO: 194785 - DNA, 20 bp, Artificial Sequence
  chemically synthesized
tctgtatcttgcttctacag

SEQ ID NO: 194786 - DNA, 20 bp, Artificial Sequence
  chemically synthesized
ttattgggtagctcctgtag

SEQ ID NO: 194787 - DNA, 20 bp, Artificial Sequence
  chemically synthesized
catttattgggtagctcctg

SEQ ID NO: 194788 - DNA, 20 bp, Artificial Sequence
  chemically synthesized
tggaactatcatttattggg

SEQ ID NO: 194789 - DNA, 20 bp, Artificial Sequence
  chemically synthesized
tcatggaactatcatttatt

SEQ ID NO: 194790 - DNA, 20 bp, Artificial Sequence
  chemically synthesized
ttcatggaactatcatttat

SEQ ID NO: 194791 - DNA, 20 bp, Artificial Sequence
  chemically synthesized
aggagctacccaataaatga

SEQ ID NO: 194792 - DNA, 20 bp, Artificial Sequence
  chemically synthesized
tggggttttttagttgttca

SEQ ID NO: 194793 - DNA, 20 bp, Artificial Sequence
  chemically synthesized
aaaaccagattggggttttt

SEQ ID NO: 194794 - DNA, 20 bp, Artificial Sequence
  chemically synthesized
acaactaaaaaaccccaatc

SEQ ID NO: 194795 - DNA, 20 bp, Artificial Sequence
  chemically synthesized
acatgtacaaaaccagattg

SEQ ID NO: 194796 - DNA, 20 bp, Artificial Sequence
  chemically synthesized
aacatgtacaaaaccagatt

SEQ ID NO: 194797 - DNA, 20 bp, Artificial Sequence
  chemically synthesized
caacatgtacaaaaccagat

SEQ ID NO: 194798 - DNA, 20 bp, Artificial Sequence
  chemically synthesized
attgccaacatgtacaaaac

SEQ ID NO: 194799 - DNA, 20 bp, Artificial Sequence
  chemically synthesized
caatctggttttgtacatgt

SEQ ID NO: 194800 - DNA, 20 bp, Artificial Sequence
  chemically synthesized
ttttgtacatgttggcaatt

SEQ ID NO: 194801 - DNA, 20 bp, Artificial Sequence
  chemically synthesized
tttgtacatgttggcaattc

SEQ ID NO: 194802 - DNA, 20 bp, Artificial Sequence
  chemically synthesized
gtacatgttggcaattcagg

SEQ ID NO: 194803 - DNA, 20 bp, Artificial Sequence
  chemically synthesized
tacatgttggcaattcagga

SEQ ID NO: 194804 - DNA, 20 bp, Artificial Sequence
  chemically synthesized
gttggcaattcaggaaggct

SEQ ID NO: 194805 - DNA, 20 bp, Artificial Sequence
  chemically synthesized
tcttggactaataacacact

SEQ ID NO: 194806 - DNA, 20 bp, Artificial Sequence
  chemically synthesized
aggaaggctaagtgtgttat

SEQ ID NO: 194807 - DNA, 20 bp, Artificial Sequence
  chemically synthesized
gctaagtgtgttattagtcc

SEQ ID NO: 194808 - DNA, 20 bp, Artificial Sequence
  chemically synthesized
tgttattagtccaagaaatg

SEQ ID NO: 194809 - DNA, 20 bp, Artificial Sequence
  chemically synthesized
tgtctattcactacatttct

SEQ ID NO: 194810 - DNA, 20 bp, Artificial Sequence
  chemically synthesized
agtccaagaaatgtagtgaa

SEQ ID NO: 194811 - DNA, 20 bp, Artificial Sequence
  chemically synthesized
acagagtgcctatgtaagag

SEQ ID NO: 194812 - DNA, 20 bp, Artificial Sequence
  chemically synthesized
tagacacaaccactcttaca

SEQ ID NO: 194813 - DNA, 20 bp, Artificial Sequence
  chemically synthesized
agacacaaccactcttacat

SEQ ID NO: 194814 - DNA, 20 bp, Artificial Sequence
  chemically synthesized
agcacagagtgcctatgtaa

SEQ ID NO: 194815 - DNA, 20 bp, Artificial Sequence
  chemically synthesized
caagcacagagtgcctatgt

SEQ ID NO: 194816 - DNA, 20 bp, Artificial Sequence
  chemically synthesized
aggaaatcatgtcaagcaca

SEQ ID NO: 194817 - DNA, 20 bp, Artificial Sequence
  chemically synthesized
tcaggaaatcatgtcaagca

SEQ ID NO: 194818 - DNA, 20 bp, Artificial Sequence
  chemically synthesized
aacattcaggaaatcatgtc

SEQ ID NO: 194819 - DNA, 20 bp, Artificial Sequence
  chemically synthesized
tgacatgatttcctgaatgt

SEQ ID NO: 194820 - DNA, 20 bp, Artificial Sequence
  chemically synthesized
ggattcccccactaacattc

SEQ ID NO: 194821 - DNA, 20 bp, Artificial Sequence
  chemically synthesized
cggattcccccactaacatt

SEQ ID NO: 194822 - DNA, 20 bp, Artificial Sequence
  chemically synthesized
catgatttcctgaatgttag

SEQ ID NO: 194823 - DNA, 20 bp, Artificial Sequence
  chemically synthesized
atgatttcctgaatgttagt

SEQ ID NO: 194824 - DNA, 20 bp, Artificial Sequence
  chemically synthesized
tgatttcctgaatgttagtg

SEQ ID NO: 194825 - DNA, 20 bp, Artificial Sequence
  chemically synthesized
gatttcctgaatgttagtgg

SEQ ID NO: 194826 - DNA, 20 bp, Artificial Sequence
  chemically synthesized
acttgtgtggattagtgtaa

SEQ ID NO: 194827 - DNA, 20 bp, Artificial Sequence
  chemically synthesized
ttacgactacttgtgtggat

SEQ ID NO: 194828 - DNA, 20 bp, Artificial Sequence
  chemically synthesized
tccgttacactaatccacac

SEQ ID NO: 194829 - DNA, 20 bp, Artificial Sequence
  chemically synthesized
gttacactaatccacacaag

SEQ ID NO: 194830 - DNA, 20 bp, Artificial Sequence
  chemically synthesized
cagcattacgactacttgtg

SEQ ID NO: 194831 - DNA, 20 bp, Artificial Sequence
  chemically synthesized
acaagtagtcgtaatgctgc

SEQ ID NO: 194832 - DNA, 20 bp, Artificial Sequence
  chemically synthesized
aatgtctgggaaattgccag

SEQ ID NO: 194833 - DNA, 20 bp, Artificial Sequence
  chemically synthesized
gttaatgtctgggaaattgc

SEQ ID NO: 194834 - DNA, 20 bp, Artificial Sequence
  chemically synthesized
taatgctgctggcaatttcc

SEQ ID NO: 194835 - DNA, 20 bp, Artificial Sequence
  chemically synthesized
gatcttcattgttaatgtct

SEQ ID NO: 194836 - DNA, 20 bp, Artificial Sequence
  chemically synthesized
cgatcttcattgttaatgtc

SEQ ID NO: 194837 - DNA, 20 bp, Artificial Sequence
  chemically synthesized
tttcccagacattaacaatg

SEQ ID NO: 194838 - DNA, 20 bp, Artificial Sequence
  chemically synthesized
acattaacaatgaagatcgt

SEQ ID NO: 194839 - DNA, 20 bp, Artificial Sequence
  chemically synthesized
aggcgtcaatgatttgcatt

SEQ ID NO: 194840 - DNA, 20 bp, Artificial Sequence
  chemically synthesized
caaatcattgacgcctgtga

SEQ ID NO: 194841 - DNA, 20 bp, Artificial Sequence
  chemically synthesized
atattgacttgatctgtcac

SEQ ID NO: 194842 - DNA, 20 bp, Artificial Sequence
  chemically synthesized
aatattgacttgatctgtca

SEQ ID NO: 194843 - DNA, 20 bp, Artificial Sequence
  chemically synthesized
attgacgcctgtgacagatc

SEQ ID NO: 194844 - DNA, 20 bp, Artificial Sequence
  chemically synthesized
tcacaagaaaagtatcagac

SEQ ID NO: 194845 - DNA, 20 bp, Artificial Sequence
  chemically synthesized
gtcacaagaaaagtatcaga

SEQ ID NO: 194846 - DNA, 20 bp, Artificial Sequence
  chemically synthesized
aaatgtcacaagaaaagtat

SEQ ID NO: 194847 - DNA, 20 bp, Artificial Sequence
  chemically synthesized
gacttcaaatgtcacaagaa

SEQ ID NO: 194848 - DNA, 20 bp, Artificial Sequence
  chemically synthesized
gagatgacttcaaatgtcac

SEQ ID NO: 194849 - DNA, 20 bp, Artificial Sequence
  chemically synthesized
tacttttcttgtgacatttg

SEQ ID NO: 194850 - DNA, 20 bp, Artificial Sequence
  chemically synthesized
taagatttttagacaaaaca

SEQ ID NO: 194851 - DNA, 20 bp, Artificial Sequence
  chemically synthesized
aataagatttttagacaaaa

SEQ ID NO: 194852 - DNA, 20 bp, Artificial Sequence
  chemically synthesized
tgtcctacgaataagatttt

SEQ ID NO: 194853 - DNA, 20 bp, Artificial Sequence
  chemically synthesized
ttgtctaaaaatcttattcg

SEQ ID NO: 194854 - DNA, 20 bp, Artificial Sequence
  chemically synthesized
tgtctaaaaatcttattcgt

SEQ ID NO: 194855 - DNA, 20 bp, Artificial Sequence
  chemically synthesized
taggtggctgtcctacgaat

SEQ ID NO: 194856 - DNA, 20 bp, Artificial Sequence
  chemically synthesized
taaaaatcttattcgtagga

SEQ ID NO: 194857 - DNA, 20 bp, Artificial Sequence
  chemically synthesized
attcgtaggacagccaccta

SEQ ID NO: 194858 - DNA, 20 bp, Artificial Sequence
  chemically synthesized
ttcgtaggacagccacctac

SEQ ID NO: 194859 - DNA, 20 bp, Artificial Sequence
  chemically synthesized
tcgtaggacagccacctaca

SEQ ID NO: 194860 - DNA, 20 bp, Artificial Sequence
  chemically synthesized
attctgggtggccctgtagg

SEQ ID NO: 194861 - DNA, 20 bp, Artificial Sequence
  chemically synthesized
gccattctgggtggccctgt

SEQ ID NO: 194862 - DNA, 20 bp, Artificial Sequence
  chemically synthesized
agccattctgggtggccctg

SEQ ID NO: 194863 - DNA, 20 bp, Artificial Sequence
  chemically synthesized
cagccacctacagggccacc

SEQ ID NO: 194864 - DNA, 20 bp, Artificial Sequence
  chemically synthesized
acctacagggccacccagaa

SEQ ID NO: 194865 - DNA, 20 bp, Artificial Sequence
  chemically synthesized
gcttaatgagccattctggg

SEQ ID NO: 194866 - DNA, 20 bp, Artificial Sequence
  chemically synthesized
ttggcttaatgagccattct

SEQ ID NO: 194867 - DNA, 20 bp, Artificial Sequence
  chemically synthesized
gttggcttaatgagccattc

SEQ ID NO: 194868 - DNA, 20 bp, Artificial Sequence
  chemically synthesized
gccacccagaatggctcatt

SEQ ID NO: 194869 - DNA, 20 bp, Artificial Sequence
  chemically synthesized
aagaaatgtgttggcttaat

SEQ ID NO: 194870 - DNA, 20 bp, Artificial Sequence
  chemically synthesized
aagatgcaaaagaaatgtgt

SEQ ID NO: 194871 - DNA, 20 bp, Artificial Sequence
  chemically synthesized
cttcatgcacaaagatgcaa

SEQ ID NO: 194872 - DNA, 20 bp, Artificial Sequence
  chemically synthesized
tctagatcccttcatgcaca

SEQ ID NO: 194873 - DNA, 20 bp, Artificial Sequence
  chemically synthesized
cttttgcatctttgtgcatg

SEQ ID NO: 194874 - DNA, 20 bp, Artificial Sequence
  chemically synthesized
ttttgcatctttgtgcatga

SEQ ID NO: 194875 - DNA, 20 bp, Artificial Sequence
  chemically synthesized
tttgcatctttgtgcatgaa

SEQ ID NO: 194876 - DNA, 20 bp, Artificial Sequence
  chemically synthesized
tctttgtgcatgaagggatc

SEQ ID NO: 194877 - DNA, 20 bp, Artificial Sequence
  chemically synthesized
tttgtgcatgaagggatcta

SEQ ID NO: 194878 - DNA, 20 bp, Artificial Sequence
  chemically synthesized
ggaataatatagtttttctc

SEQ ID NO: 194879 - DNA, 20 bp, Artificial Sequence
  chemically synthesized
gggaaaaaacaggaataata

SEQ ID NO: 194880 - DNA, 20 bp, Artificial Sequence
  chemically synthesized
tgaggcaggagggaaaaaac

SEQ ID NO: 194881 - DNA, 20 bp, Artificial Sequence
  chemically synthesized
gtgaggcaggagggaaaaaa

SEQ ID NO: 194882 - DNA, 20 bp, Artificial Sequence
  chemically synthesized
ctgacctgtgtgaggcagga

SEQ ID NO: 194883 - DNA, 20 bp, Artificial Sequence
  chemically synthesized
actgacctgtgtgaggcagg

SEQ ID NO: 194884 - DNA, 20 bp, Artificial Sequence
  chemically synthesized
aactgacctgtgtgaggcag

SEQ ID NO: 194885 - DNA, 20 bp, Artificial Sequence
  chemically synthesized
acaactgacctgtgtgaggc

SEQ ID NO: 194886 - DNA, 20 bp, Artificial Sequence
  chemically synthesized
tttttccctcctgcctcaca

SEQ ID NO: 194887 - DNA, 20 bp, Artificial Sequence
  chemically synthesized
aacaactgacctgtgtgagg

SEQ ID NO: 194888 - DNA, 20 bp, Artificial Sequence
  chemically synthesized
ttttccctcctgcctcacac

SEQ ID NO: 194889 - DNA, 20 bp, Artificial Sequence
  chemically synthesized
tgcaacaactgacctgtgtg

SEQ ID NO: 194890 - DNA, 20 bp, Artificial Sequence
  chemically synthesized
gtgcaacaactgacctgtgt

SEQ ID NO: 194891 - DNA, 20 bp, Artificial Sequence
  chemically synthesized
ccctcctgcctcacacaggt

SEQ ID NO: 194892 - DNA, 20 bp, Artificial Sequence
  chemically synthesized
acacaggtcagttgttgcac

SEQ ID NO: 194893 - DNA, 20 bp, Artificial Sequence
  chemically synthesized
taagggaaatagacaatgac

SEQ ID NO: 194894 - DNA, 20 bp, Artificial Sequence
  chemically synthesized
ggacatgatcttaagggaaa

SEQ ID NO: 194895 - DNA, 20 bp, Artificial Sequence
  chemically synthesized
agtcattgtctatttccctt

SEQ ID NO: 194896 - DNA, 20 bp, Artificial Sequence
  chemically synthesized
ccagggggacatgatcttaa

SEQ ID NO: 194897 - DNA, 20 bp, Artificial Sequence
  chemically synthesized
cccagggggacatgatctta

SEQ ID NO: 194898 - DNA, 20 bp, Artificial Sequence
  chemically synthesized
tcccagggggacatgatctt

SEQ ID NO: 194899 - DNA, 20 bp, Artificial Sequence
  chemically synthesized
cccttaagatcatgtccccc

SEQ ID NO: 194900 - DNA, 20 bp, Artificial Sequence
  chemically synthesized
ccttaagatcatgtccccct

SEQ ID NO: 194901 - DNA, 20 bp, Artificial Sequence
  chemically synthesized
tgggaaatgtagttcccagg

SEQ ID NO: 194902 - DNA, 20 bp, Artificial Sequence
  chemically synthesized
ctgggaaatgtagttcccag

SEQ ID NO: 194903 - DNA, 20 bp, Artificial Sequence
  chemically synthesized
tctgggaaatgtagttccca

SEQ ID NO: 194904 - DNA, 20 bp, Artificial Sequence
  chemically synthesized
gtctgggaaatgtagttccc

SEQ ID NO: 194905 - DNA, 20 bp, Artificial Sequence
  chemically synthesized
agtctgggaaatgtagttcc

SEQ ID NO: 194906 - DNA, 20 bp, Artificial Sequence
  chemically synthesized
cccctgggaactacatttcc

SEQ ID NO: 194907 - DNA, 20 bp, Artificial Sequence
  chemically synthesized
gcatatgagtctgggaaatg

SEQ ID NO: 194908 - DNA, 20 bp, Artificial Sequence
  chemically synthesized
gtccattggcatatgagtct

SEQ ID NO: 194909 - DNA, 20 bp, Artificial Sequence
  chemically synthesized
agtccattggcatatgagtc

SEQ ID NO: 194910 - DNA, 20 bp, Artificial Sequence
  chemically synthesized
agagaagtccattggcatat

SEQ ID NO: 194911 - DNA, 20 bp, Artificial Sequence
  chemically synthesized
ttcccagactcatatgccaa

SEQ ID NO: 194912 - DNA, 20 bp, Artificial Sequence
  chemically synthesized
ttccatccagagaagtccat

SEQ ID NO: 194913 - DNA, 20 bp, Artificial Sequence
  chemically synthesized
catatgccaatggacttctc

SEQ ID NO: 194914 - DNA, 20 bp, Artificial Sequence
  chemically synthesized
tgccaatggacttctctgga

SEQ ID NO: 194915 - DNA, 20 bp, Artificial Sequence
  chemically synthesized
ttgacgtattccatccagag

SEQ ID NO: 194916 - DNA, 20 bp, Artificial Sequence
  chemically synthesized
acattgacgtattccatcca

SEQ ID NO: 194917 - DNA, 20 bp, Artificial Sequence
  chemically synthesized
acacattgacgtattccatc

SEQ ID NO: 194918 - DNA, 20 bp, Artificial Sequence
  chemically synthesized
ggatggaatacgtcaatgtg

SEQ ID NO: 194919 - DNA, 20 bp, Artificial Sequence
  chemically synthesized
aatacgtcaatgtgtggcaa

SEQ ID NO: 194920 - DNA, 20 bp, Artificial Sequence
  chemically synthesized
acgtcaatgtgtggcaatag

SEQ ID NO: 194921 - DNA, 20 bp, Artificial Sequence
  chemically synthesized
cgtcaatgtgtggcaatagc

SEQ ID NO: 194922 - DNA, 20 bp, Artificial Sequence
  chemically synthesized
gtcaatgtgtggcaatagca

SEQ ID NO: 194923 - DNA, 20 bp, Artificial Sequence
  chemically synthesized
ggcaatagcagggaactaaa

SEQ ID NO: 194924 - DNA, 20 bp, Artificial Sequence
  chemically synthesized
aatagcagggaactaaatgg

SEQ ID NO: 194925 - DNA, 20 bp, Artificial Sequence
  chemically synthesized
atagcagggaactaaatggc

SEQ ID NO: 194926 - DNA, 20 bp, Artificial Sequence
  chemically synthesized
tagcagggaactaaatggca

SEQ ID NO: 194927 - DNA, 20 bp, Artificial Sequence
  chemically synthesized
tccgtattttccctgccatt

SEQ ID NO: 194928 - DNA, 20 bp, Artificial Sequence
  chemically synthesized
actaaatggcagggaaaata

SEQ ID NO: 194929 - DNA, 20 bp, Artificial Sequence
  chemically synthesized
ggcagggaaaatacggaatt

SEQ ID NO: 194930 - DNA, 20 bp, Artificial Sequence
  chemically synthesized
gcagggaaaatacggaattc

SEQ ID NO: 194931 - DNA, 20 bp, Artificial Sequence
  chemically synthesized
cagggaaaatacggaattca

SEQ ID NO: 194932 - DNA, 20 bp, Artificial Sequence
  chemically synthesized
ccttccagagcagagagaag

SEQ ID NO: 194933 - DNA, 20 bp, Artificial Sequence
  chemically synthesized
taccttccagagcagagaga

SEQ ID NO: 194934 - DNA, 20 bp, Artificial Sequence
  chemically synthesized
ataccttccagagcagagag

SEQ ID NO: 194935 - DNA, 20 bp, Artificial Sequence
  chemically synthesized
atttctccttctctctgctc

SEQ ID NO: 194936 - DNA, 20 bp, Artificial Sequence
  chemically synthesized
aaaataccttccagagcaga

SEQ ID NO: 194937 - DNA, 20 bp, Artificial Sequence
  chemically synthesized
acaaaataccttccagagca

SEQ ID NO: 194938 - DNA, 20 bp, Artificial Sequence
  chemically synthesized
tctccttctctctgctctgg

SEQ ID NO: 194939 - DNA, 20 bp, Artificial Sequence
  chemically synthesized
ctccttctctctgctctgga

SEQ ID NO: 194940 - DNA, 20 bp, Artificial Sequence
  chemically synthesized
ccacaaaataccttccagag

SEQ ID NO: 194941 - DNA, 20 bp, Artificial Sequence
  chemically synthesized
aagccacaaaataccttcca

SEQ ID NO: 194942 - DNA, 20 bp, Artificial Sequence
  chemically synthesized
ataagccacaaaataccttc

SEQ ID NO: 194943 - DNA, 20 bp, Artificial Sequence
  chemically synthesized
ctgctctggaaggtattttg

SEQ ID NO: 194944 - DNA, 20 bp, Artificial Sequence
  chemically synthesized
ggaaggtattttgtggctta

SEQ ID NO: 194945 - DNA, 20 bp, Artificial Sequence
  chemically synthesized
acaagaggggattcagccat

SEQ ID NO: 194946 - DNA, 20 bp, Artificial Sequence
  chemically synthesized
ttggaacacaagaggggatt

SEQ ID NO: 194947 - DNA, 20 bp, Artificial Sequence
  chemically synthesized
agaaagttggaacacaagag

SEQ ID NO: 194948 - DNA, 20 bp, Artificial Sequence
  chemically synthesized
cagaaagttggaacacaaga

SEQ ID NO: 194949 - DNA, 20 bp, Artificial Sequence
  chemically synthesized
gcagaaagttggaacacaag

SEQ ID NO: 194950 - DNA, 20 bp, Artificial Sequence
  chemically synthesized
agcagaaagttggaacacaa

SEQ ID NO: 194951 - DNA, 20 bp, Artificial Sequence
  chemically synthesized
caagcagaaagttggaacac

SEQ ID NO: 194952 - DNA, 20 bp, Artificial Sequence
  chemically synthesized
ggatgcgtcaagcagaaagt

SEQ ID NO: 194953 - DNA, 20 bp, Artificial Sequence
  chemically synthesized
aggaggatgcgtcaagcaga

SEQ ID NO: 194954 - DNA, 20 bp, Artificial Sequence
  chemically synthesized
caggaggaggatgcgtcaag

SEQ ID NO: 194955 - DNA, 20 bp, Artificial Sequence
  chemically synthesized
ccacaggaggaggatgcgtc

SEQ ID NO: 194956 - DNA, 20 bp, Artificial Sequence
  chemically synthesized
cttgacgcatcctcctcctg

SEQ ID NO: 194957 - DNA, 20 bp, Artificial Sequence
  chemically synthesized
ggacctgcaaccacaggagg

SEQ ID NO: 194958 - DNA, 20 bp, Artificial Sequence
  chemically synthesized
aggacctgcaaccacaggag

SEQ ID NO: 194959 - DNA, 20 bp, Artificial Sequence
  chemically synthesized
gcaggacctgcaaccacagg

SEQ ID NO: 194960 - DNA, 20 bp, Artificial Sequence
  chemically synthesized
ggcaggacctgcaaccacag

SEQ ID NO: 194961 - DNA, 20 bp, Artificial Sequence
  chemically synthesized
gcatcctcctcctgtggttg

SEQ ID NO: 194962 - DNA, 20 bp, Artificial Sequence
  chemically synthesized
tcggcaggacctgcaaccac

SEQ ID NO: 194963 - DNA, 20 bp, Artificial Sequence
  chemically synthesized
catcctcctcctgtggttgc

SEQ ID NO: 194964 - DNA, 20 bp, Artificial Sequence
  chemically synthesized
ttcggcaggacctgcaacca

SEQ ID NO: 194965 - DNA, 20 bp, Artificial Sequence
  chemically synthesized
tggttgcaggtcctgccgaa

SEQ ID NO: 194966 - DNA, 20 bp, Artificial Sequence
  chemically synthesized
ggttgcaggtcctgccgaac

SEQ ID NO: 194967 - DNA, 20 bp, Artificial Sequence
  chemically synthesized
tggggcctgtcctgttcggc

SEQ ID NO: 194968 - DNA, 20 bp, Artificial Sequence
  chemically synthesized
gtggggcctgtcctgttcgg

SEQ ID NO: 194969 - DNA, 20 bp, Artificial Sequence
  chemically synthesized
gcaggtcctgccgaacagga

SEQ ID NO: 194970 - DNA, 20 bp, Artificial Sequence
  chemically synthesized
caggtggggcctgtcctgtt

SEQ ID NO: 194971 - DNA, 20 bp, Artificial Sequence
  chemically synthesized
caggtcctgccgaacaggac

SEQ ID NO: 194972 - DNA, 20 bp, Artificial Sequence
  chemically synthesized
gaggcagctaggatcaggtg

SEQ ID NO: 194973 - DNA, 20 bp, Artificial Sequence
  chemically synthesized
ggaggcagctaggatcaggt

SEQ ID NO: 194974 - DNA, 20 bp, Artificial Sequence
  chemically synthesized
tggaggcagctaggatcagg

SEQ ID NO: 194975 - DNA, 20 bp, Artificial Sequence
  chemically synthesized
ggacaggccccacctgatcc

SEQ ID NO: 194976 - DNA, 20 bp, Artificial Sequence
  chemically synthesized
gtctggaggcagctaggatc

SEQ ID NO: 194977 - DNA, 20 bp, Artificial Sequence
  chemically synthesized
cgtctggaggcagctaggat

SEQ ID NO: 194978 - DNA, 20 bp, Artificial Sequence
  chemically synthesized
gaagtcgtctggaggcagct

SEQ ID NO: 194979 - DNA, 20 bp, Artificial Sequence
  chemically synthesized
tgaagtcgtctggaggcagc

SEQ ID NO: 194980 - DNA, 20 bp, Artificial Sequence
  chemically synthesized
cacctgatcctagctgcctc

SEQ ID NO: 194981 - DNA, 20 bp, Artificial Sequence
  chemically synthesized
aatttgaagtcgtctggagg

SEQ ID NO: 194982 - DNA, 20 bp, Artificial Sequence
  chemically synthesized
cagaatttgaagtcgtctgg

SEQ ID NO: 194983 - DNA, 20 bp, Artificial Sequence
  chemically synthesized
tcagaatttgaagtcgtctg

SEQ ID NO: 194984 - DNA, 20 bp, Artificial Sequence
  chemically synthesized
tttcagaatttgaagtcgtc

SEQ ID NO: 194985 - DNA, 20 bp, Artificial Sequence
  chemically synthesized
acatgagatttcagaatttg

SEQ ID NO: 194986 - DNA, 20 bp, Artificial Sequence
  chemically synthesized
cacaaggtgacatgagattt

SEQ ID NO: 194987 - DNA, 20 bp, Artificial Sequence
  chemically synthesized
ctttaagcacaaggtgacat

SEQ ID NO: 194988 - DNA, 20 bp, Artificial Sequence
  chemically synthesized
tggctggggctttaagcaca

SEQ ID NO: 194989 - DNA, 20 bp, Artificial Sequence
  chemically synthesized
ctcatgtcaccttgtgctta

SEQ ID NO: 194990 - DNA, 20 bp, Artificial Sequence
  chemically synthesized
atggctggggctttaagcac

SEQ ID NO: 194991 - DNA, 20 bp, Artificial Sequence
  chemically synthesized
tcaccttgtgcttaaagccc

SEQ ID NO: 194992 - DNA, 20 bp, Artificial Sequence
  chemically synthesized
tcacttatggctggggcttt

SEQ ID NO: 194993 - DNA, 20 bp, Artificial Sequence
  chemically synthesized
gtgcttaaagccccagccat

SEQ ID NO: 194994 - DNA, 20 bp, Artificial Sequence
  chemically synthesized
gctgttctcacttatggctg

SEQ ID NO: 194995 - DNA, 20 bp, Artificial Sequence
  chemically synthesized
agctgttctcacttatggct

SEQ ID NO: 194996 - DNA, 20 bp, Artificial Sequence
  chemically synthesized
aagctgttctcacttatggc

SEQ ID NO: 194997 - DNA, 20 bp, Artificial Sequence
  chemically synthesized
ttaaagccccagccataagt

SEQ ID NO: 194998 - DNA, 20 bp, Artificial Sequence
  chemically synthesized
caggaagctgttctcactta

SEQ ID NO: 194999 - DNA, 20 bp, Artificial Sequence
  chemically synthesized
gccccagccataagtgagaa

SEQ ID NO: 195000 - DNA, 20 bp, Artificial Sequence
  chemically synthesized
cagggattggcagtcgcagg

SEQ ID NO: 195001 - DNA, 20 bp, Artificial Sequence
  chemically synthesized
acccagggattggcagtcgc

SEQ ID NO: 195002 - DNA, 20 bp, Artificial Sequence
  chemically synthesized
aacccagggattggcagtcg

SEQ ID NO: 195003 - DNA, 20 bp, Artificial Sequence
  chemically synthesized
caaaacaacccagggattgg

SEQ ID NO: 195004 - DNA, 20 bp, Artificial Sequence
  chemically synthesized
ttcctgcgactgccaatccc

SEQ ID NO: 195005 - DNA, 20 bp, Artificial Sequence
  chemically synthesized
tcctgcgactgccaatccct

SEQ ID NO: 195006 - DNA, 20 bp, Artificial Sequence
  chemically synthesized
gatcaaaacaacccagggat

SEQ ID NO: 195007 - DNA, 20 bp, Artificial Sequence
  chemically synthesized
gaaaagatcaaaacaaccca

SEQ ID NO: 195008 - DNA, 20 bp, Artificial Sequence
  chemically synthesized
agaaaagatcaaaacaaccc

SEQ ID NO: 195009 - DNA, 20 bp, Artificial Sequence
  chemically synthesized
gagaaaagatcaaaacaacc

SEQ ID NO: 195010 - DNA, 20 bp, Artificial Sequence
  chemically synthesized
cctgagaagccaaacgagaa

SEQ ID NO: 195011 - DNA, 20 bp, Artificial Sequence
  chemically synthesized
tgttttgatcttttctcgtt

SEQ ID NO: 195012 - DNA, 20 bp, Artificial Sequence
  chemically synthesized
agagtcctgagaagccaaac

SEQ ID NO: 195013 - DNA, 20 bp, Artificial Sequence
  chemically synthesized
tcttttctcgtttggcttct

SEQ ID NO: 195014 - DNA, 20 bp, Artificial Sequence
  chemically synthesized
cttttctcgtttggcttctc

SEQ ID NO: 195015 - DNA, 20 bp, Artificial Sequence
  chemically synthesized
taggtgatgagagtcctgag

SEQ ID NO: 195016 - DNA, 20 bp, Artificial Sequence
  chemically synthesized
ccgtaggtgatgagagtcct

SEQ ID NO: 195017 - DNA, 20 bp, Artificial Sequence
  chemically synthesized
attaattccgtaggtgatga

SEQ ID NO: 195018 - DNA, 20 bp, Artificial Sequence
  chemically synthesized
aaattaattccgtaggtgat

SEQ ID NO: 195019 - DNA, 20 bp, Artificial Sequence
  chemically synthesized
ctcaggactctcatcaccta

SEQ ID NO: 195020 - DNA, 20 bp, Artificial Sequence
  chemically synthesized
atagaggaaattaattccgt

SEQ ID NO: 195021 - DNA, 20 bp, Artificial Sequence
  chemically synthesized
aatagaggaaattaattccg

SEQ ID NO: 195022 - DNA, 20 bp, Artificial Sequence
  chemically synthesized
caagggagggagtttaatag

SEQ ID NO: 195023 - DNA, 20 bp, Artificial Sequence
  chemically synthesized
ccaagggagggagtttaata

SEQ ID NO: 195024 - DNA, 20 bp, Artificial Sequence
  chemically synthesized
taccaagggagggagtttaa

SEQ ID NO: 195025 - DNA, 20 bp, Artificial Sequence
  chemically synthesized
ctctattaaactccctccct

SEQ ID NO: 195026 - DNA, 20 bp, Artificial Sequence
  chemically synthesized
ccaaatagtaccaagggagg

SEQ ID NO: 195027 - DNA, 20 bp, Artificial Sequence
  chemically synthesized
ctccaaatagtaccaaggga

SEQ ID NO: 195028 - DNA, 20 bp, Artificial Sequence
  chemically synthesized
cctccaaatagtaccaaggg

SEQ ID NO: 195029 - DNA, 20 bp, Artificial Sequence
  chemically synthesized
tcctccaaatagtaccaagg

SEQ ID NO: 195030 - DNA, 20 bp, Artificial Sequence
  chemically synthesized
actcctccaaatagtaccaa

SEQ ID NO: 195031 - DNA, 20 bp, Artificial Sequence
  chemically synthesized
aactcctccaaatagtacca

SEQ ID NO: 195032 - DNA, 20 bp, Artificial Sequence
  chemically synthesized
gaactcctccaaatagtacc

SEQ ID NO: 195033 - DNA, 20 bp, Artificial Sequence
  chemically synthesized
ctccctcccttggtactatt

SEQ ID NO: 195034 - DNA, 20 bp, Artificial Sequence
  chemically synthesized
ccctcccttggtactatttg

SEQ ID NO: 195035 - DNA, 20 bp, Artificial Sequence
  chemically synthesized
cctcccttggtactatttgg

SEQ ID NO: 195036 - DNA, 20 bp, Artificial Sequence
  chemically synthesized
tcccttggtactatttggag

SEQ ID NO: 195037 - DNA, 20 bp, Artificial Sequence
  chemically synthesized
ataaagagaactcctccaaa

SEQ ID NO: 195038 - DNA, 20 bp, Artificial Sequence
  chemically synthesized
taaaaaacaataataataaa

SEQ ID NO: 195039 - DNA, 20 bp, Artificial Sequence
  chemically synthesized
gttaaaaaacaataataata

SEQ ID NO: 195040 - DNA, 20 bp, Artificial Sequence
  chemically synthesized
gtagtactatgaagaaaaaa

SEQ ID NO: 195041 - DNA, 20 bp, Artificial Sequence
  chemically synthesized
ttttaaccattttttcttca

SEQ ID NO: 195042 - DNA, 20 bp, Artificial Sequence
  chemically synthesized
aataagatagtagtactatg

SEQ ID NO: 195043 - DNA, 20 bp, Artificial Sequence
  chemically synthesized
ttcatcaccaaataagatag

SEQ ID NO: 195044 - DNA, 20 bp, Artificial Sequence
  chemically synthesized
catagtactactatcttatt

SEQ ID NO: 195045 - DNA, 20 bp, Artificial Sequence
  chemically synthesized
attttcatcaccaaataaga

SEQ ID NO: 195046 - DNA, 20 bp, Artificial Sequence
  chemically synthesized
tttgattttcatcaccaaat

SEQ ID NO: 195047 - DNA, 20 bp, Artificial Sequence
  chemically synthesized
ataggaagccaaagataatt

SEQ ID NO: 195048 - DNA, 20 bp, Artificial Sequence
  chemically synthesized
aaaatattctgaattatctt

SEQ ID NO: 195049 - DNA, 20 bp, Artificial Sequence
  chemically synthesized
tcagataaaataggaagcca

SEQ ID NO: 195050 - DNA, 20 bp, Artificial Sequence
  chemically synthesized
gaggagtcagataaaatagg

SEQ ID NO: 195051 - DNA, 20 bp, Artificial Sequence
  chemically synthesized
cttgaggagtcagataaaat

SEQ ID NO: 195052 - DNA, 20 bp, Artificial Sequence
  chemically synthesized
acttgaggagtcagataaaa

SEQ ID NO: 195053 - DNA, 20 bp, Artificial Sequence
  chemically synthesized
cctattttatctgactcctc

SEQ ID NO: 195054 - DNA, 20 bp, Artificial Sequence
  chemically synthesized
actgtttagacttgaggagt

SEQ ID NO: 195055 - DNA, 20 bp, Artificial Sequence
  chemically synthesized
gacaactgtttagacttgag

SEQ ID NO: 195056 - DNA, 20 bp, Artificial Sequence
  chemically synthesized
ttgacaactgtttagacttg

SEQ ID NO: 195057 - DNA, 20 bp, Artificial Sequence
  chemically synthesized
cttgacaactgtttagactt

SEQ ID NO: 195058 - DNA, 20 bp, Artificial Sequence
  chemically synthesized
tctgactcctcaagtctaaa

SEQ ID NO: 195059 - DNA, 20 bp, Artificial Sequence
  chemically synthesized
gggggggcttgacaactgtt

SEQ ID NO: 195060 - DNA, 20 bp, Artificial Sequence
  chemically synthesized
ctcaagtctaaacagttgtc

SEQ ID NO: 195061 - DNA, 20 bp, Artificial Sequence
  chemically synthesized
aaacagttgtcaagcccccc

SEQ ID NO: 195062 - DNA, 20 bp, Artificial Sequence
  chemically synthesized
gaaagttgaaaggactgggg

SEQ ID NO: 195063 - DNA, 20 bp, Artificial Sequence
  chemically synthesized
tgaaagttgaaaggactggg

SEQ ID NO: 195064 - DNA, 20 bp, Artificial Sequence
  chemically synthesized
atgaaagttgaaaggactgg

SEQ ID NO: 195065 - DNA, 20 bp, Artificial Sequence
  chemically synthesized
aatgaaagttgaaaggactg

SEQ ID NO: 195066 - DNA, 20 bp, Artificial Sequence
  chemically synthesized
taatgaaagttgaaaggact

SEQ ID NO: 195067 - DNA, 20 bp, Artificial Sequence
  chemically synthesized
ataatgaaagttgaaaggac

SEQ ID NO: 195068 - DNA, 20 bp, Artificial Sequence
  chemically synthesized
agaagataatgaaagttgaa

SEQ ID NO: 195069 - DNA, 20 bp, Artificial Sequence
  chemically synthesized
aagaagataatgaaagttga

SEQ ID NO: 195070 - DNA, 20 bp, Artificial Sequence
  chemically synthesized
gaaatgaaagaagataatga

SEQ ID NO: 195071 - DNA, 20 bp, Artificial Sequence
  chemically synthesized
aatgagaatagaaatgaaag

SEQ ID NO: 195072 - DNA, 20 bp, Artificial Sequence
  chemically synthesized
aggaatgagaatagaaatga

SEQ ID NO: 195073 - DNA, 20 bp, Artificial Sequence
  chemically synthesized
tgttgtcccaggaatgagaa

SEQ ID NO: 195074 - DNA, 20 bp, Artificial Sequence
  chemically synthesized
ttcatttctattctcattcc

SEQ ID NO: 195075 - DNA, 20 bp, Artificial Sequence
  chemically synthesized
tcatttctattctcattcct

SEQ ID NO: 195076 - DNA, 20 bp, Artificial Sequence
  chemically synthesized
cacattgttgtcccaggaat

SEQ ID NO: 195077 - DNA, 20 bp, Artificial Sequence
  chemically synthesized
ggccatcacattgttgtccc

SEQ ID NO: 195078 - DNA, 20 bp, Artificial Sequence
  chemically synthesized
tggccatcacattgttgtcc

SEQ ID NO: 195079 - DNA, 20 bp, Artificial Sequence
  chemically synthesized
ttcctgggacaacaatgtga

SEQ ID NO: 195080 - DNA, 20 bp, Artificial Sequence
  chemically synthesized
atatttcagggaaaaggcaa

SEQ ID NO: 195081 - DNA, 20 bp, Artificial Sequence
  chemically synthesized
attgcaatatttcagggaaa

SEQ ID NO: 195082 - DNA, 20 bp, Artificial Sequence
  chemically synthesized
tattgcaatatttcagggaa

SEQ ID NO: 195083 - DNA, 20 bp, Artificial Sequence
  chemically synthesized
taggctattgcaatatttca

SEQ ID NO: 195084 - DNA, 20 bp, Artificial Sequence
  chemically synthesized
gtaggctattgcaatatttc

SEQ ID NO: 195085 - DNA, 20 bp, Artificial Sequence
  chemically synthesized
agtaggctattgcaatattt

SEQ ID NO: 195086 - DNA, 20 bp, Artificial Sequence
  chemically synthesized
ttttccctgaaatattgcaa

SEQ ID NO: 195087 - DNA, 20 bp, Artificial Sequence
  chemically synthesized
tattgcaatagcctactaat

SEQ ID NO: 195088 - DNA, 20 bp, Artificial Sequence
  chemically synthesized
attgcaatagcctactaatt

SEQ ID NO: 195089 - DNA, 20 bp, Artificial Sequence
  chemically synthesized
aggcaaaggccccaattagt

SEQ ID NO: 195090 - DNA, 20 bp, Artificial Sequence
  chemically synthesized
ttgcaatagcctactaattg

SEQ ID NO: 195091 - DNA, 20 bp, Artificial Sequence
  chemically synthesized
aaggcaaaggccccaattag

SEQ ID NO: 195092 - DNA, 20 bp, Artificial Sequence
  chemically synthesized
ctgaaggcaaaggccccaat

SEQ ID NO: 195093 - DNA, 20 bp, Artificial Sequence
  chemically synthesized
ctaattggggcctttgcctt

SEQ ID NO: 195094 - DNA, 20 bp, Artificial Sequence
  chemically synthesized
gggaaagagactgaaggcaa

SEQ ID NO: 195095 - DNA, 20 bp, Artificial Sequence
  chemically synthesized
agggaaagagactgaaggca

SEQ ID NO: 195096 - DNA, 20 bp, Artificial Sequence
  chemically synthesized
agagaagggaaagagactga

SEQ ID NO: 195097 - DNA, 20 bp, Artificial Sequence
  chemically synthesized
cagagaagggaaagagactg

SEQ ID NO: 195098 - DNA, 20 bp, Artificial Sequence
  chemically synthesized
tagtaaacagagaagggaaa

SEQ ID NO: 195099 - DNA, 20 bp, Artificial Sequence
  chemically synthesized
cctagtaaacagagaaggga

SEQ ID NO: 195100 - DNA, 20 bp, Artificial Sequence
  chemically synthesized
tattcctagtaaacagagaa

SEQ ID NO: 195101 - DNA, 20 bp, Artificial Sequence
  chemically synthesized
atattcctagtaaacagaga

SEQ ID NO: 195102 - DNA, 20 bp, Artificial Sequence
  chemically synthesized
catattcctagtaaacagag

SEQ ID NO: 195103 - DNA, 20 bp, Artificial Sequence
  chemically synthesized
tctttcccttctctgtttac

SEQ ID NO: 195104 - DNA, 20 bp, Artificial Sequence
  chemically synthesized
atccatattcctagtaaaca

SEQ ID NO: 195105 - DNA, 20 bp, Artificial Sequence
  chemically synthesized
ctttcccttctctgtttact

SEQ ID NO: 195106 - DNA, 20 bp, Artificial Sequence
  chemically synthesized
tgatccatattcctagtaaa

SEQ ID NO: 195107 - DNA, 20 bp, Artificial Sequence
  chemically synthesized
ttctctgtttactaggaata

SEQ ID NO: 195108 - DNA, 20 bp, Artificial Sequence
  chemically synthesized
aagtctatgatccatattcc

SEQ ID NO: 195109 - DNA, 20 bp, Artificial Sequence
  chemically synthesized
tttactaggaatatggatca

SEQ ID NO: 195110 - DNA, 20 bp, Artificial Sequence
  chemically synthesized
atggatcatagactttactt

SEQ ID NO: 195111 - DNA, 20 bp, Artificial Sequence
  chemically synthesized
catccaagctggcttaagta

SEQ ID NO: 195112 - DNA, 20 bp, Artificial Sequence
  chemically synthesized
atcatagactttacttaagc

SEQ ID NO: 195113 - DNA, 20 bp, Artificial Sequence
  chemically synthesized
ctatccatccaagctggctt

SEQ ID NO: 195114 - DNA, 20 bp, Artificial Sequence
  chemically synthesized
agactttacttaagccagct

SEQ ID NO: 195115 - DNA, 20 bp, Artificial Sequence
  chemically synthesized
tttacttaagccagcttgga

SEQ ID NO: 195116 - DNA, 20 bp, Artificial Sequence
  chemically synthesized
atctttctatccatccaagc

SEQ ID NO: 195117 - DNA, 20 bp, Artificial Sequence
  chemically synthesized
cttaagccagcttggatgga

SEQ ID NO: 195118 - DNA, 20 bp, Artificial Sequence
  chemically synthesized
ttctatctttctatccatcc

SEQ ID NO: 195119 - DNA, 20 bp, Artificial Sequence
  chemically synthesized
agccagcttggatggataga

SEQ ID NO: 195120 - DNA, 20 bp, Artificial Sequence
  chemically synthesized
agcttggatggatagaaaga

SEQ ID NO: 195121 - DNA, 20 bp, Artificial Sequence
  chemically synthesized
ttggatggatagaaagatag

SEQ ID NO: 195122 - DNA, 20 bp, Artificial Sequence
  chemically synthesized
tggatggatagaaagataga

SEQ ID NO: 195123 - DNA, 20 bp, Artificial Sequence
  chemically synthesized
ggatggatagaaagatagaa

SEQ ID NO: 195124 - DNA, 20 bp, Artificial Sequence
  chemically synthesized
aagatagaagggattattgt

SEQ ID NO: 195125 - DNA, 20 bp, Artificial Sequence
  chemically synthesized
agatagaagggattattgta

SEQ ID NO: 195126 - DNA, 20 bp, Artificial Sequence
  chemically synthesized
aagggattattgtaaggttt

SEQ ID NO: 195127 - DNA, 20 bp, Artificial Sequence
  chemically synthesized
agggattattgtaaggtttg

SEQ ID NO: 195128 - DNA, 20 bp, Artificial Sequence
  chemically synthesized
attattgtaaggtttgaggt

SEQ ID NO: 195129 - DNA, 20 bp, Artificial Sequence
  chemically synthesized
aaggtttgaggtgagacgat

SEQ ID NO: 195130 - DNA, 20 bp, Artificial Sequence
  chemically synthesized
aggtttgaggtgagacgata

SEQ ID NO: 195131 - DNA, 20 bp, Artificial Sequence
  chemically synthesized
ggtttgaggtgagacgataa

SEQ ID NO: 195132 - DNA, 20 bp, Artificial Sequence
  chemically synthesized
tttgaggtgagacgataagg

SEQ ID NO: 195133 - DNA, 20 bp, Artificial Sequence
  chemically synthesized
tgagacgataagggagtctc

SEQ ID NO: 195134 - DNA, 20 bp, Artificial Sequence
  chemically synthesized
gagacgataagggagtctct

SEQ ID NO: 195135 - DNA, 20 bp, Artificial Sequence
  chemically synthesized
agacgataagggagtctctg

SEQ ID NO: 195136 - DNA, 20 bp, Artificial Sequence
  chemically synthesized
tgctgttattgaattcccca

SEQ ID NO: 195137 - DNA, 20 bp, Artificial Sequence
  chemically synthesized
gatgctgttattgaattccc

SEQ ID NO: 195138 - DNA, 20 bp, Artificial Sequence
  chemically synthesized
gtctctggggaattcaataa

SEQ ID NO: 195139 - DNA, 20 bp, Artificial Sequence
  chemically synthesized
tgtcatgctcagagttatga

SEQ ID NO: 195140 - DNA, 20 bp, Artificial Sequence
  chemically synthesized
acagcatctgtcataactct

SEQ ID NO: 195141 - DNA, 20 bp, Artificial Sequence
  chemically synthesized
ttcattctttgtcatgctca

SEQ ID NO: 195142 - DNA, 20 bp, Artificial Sequence
  chemically synthesized
tgttcattctttgtcatgct

SEQ ID NO: 195143 - DNA, 20 bp, Artificial Sequence
  chemically synthesized
tcataactctgagcatgaca

SEQ ID NO: 195144 - DNA, 20 bp, Artificial Sequence
  chemically synthesized
catgacaaagaatgaacata

SEQ ID NO: 195145 - DNA, 20 bp, Artificial Sequence
  chemically synthesized
atgacaaagaatgaacatat

SEQ ID NO: 195146 - DNA, 20 bp, Artificial Sequence
  chemically synthesized
acaaagaatgaacatatagg

SEQ ID NO: 195147 - DNA, 20 bp, Artificial Sequence
  chemically synthesized
aatgaacatataggtggtcc

SEQ ID NO: 195148 - DNA, 20 bp, Artificial Sequence
  chemically synthesized
atataggtggtcctggattc

SEQ ID NO: 195149 - DNA, 20 bp, Artificial Sequence
  chemically synthesized
tataggtggtcctggattca

SEQ ID NO: 195150 - DNA, 20 bp, Artificial Sequence
  chemically synthesized
tctactgttgccttgaatcc

SEQ ID NO: 195151 - DNA, 20 bp, Artificial Sequence
  chemically synthesized
ttctactgttgccttgaatc

SEQ ID NO: 195152 - DNA, 20 bp, Artificial Sequence
  chemically synthesized
tggtcctggattcaaggcaa

SEQ ID NO: 195153 - DNA, 20 bp, Artificial Sequence
  chemically synthesized
tcctggattcaaggcaacag

SEQ ID NO: 195154 - DNA, 20 bp, Artificial Sequence
  chemically synthesized
ggcaacagtagaaatctcat

SEQ ID NO: 195155 - DNA, 20 bp, Artificial Sequence
  chemically synthesized
acagtagaaatctcatcagt

SEQ ID NO: 195156 - DNA, 20 bp, Artificial Sequence
  chemically synthesized
ttgcttgaactcttactgat

SEQ ID NO: 195157 - DNA, 20 bp, Artificial Sequence
  chemically synthesized
agtagaaatctcatcagtaa

SEQ ID NO: 195158 - DNA, 20 bp, Artificial Sequence
  chemically synthesized
aatctcatcagtaagagttc

SEQ ID NO: 195159 - DNA, 20 bp, Artificial Sequence
  chemically synthesized
acaataatggaagagaagtg

SEQ ID NO: 195160 - DNA, 20 bp, Artificial Sequence
  chemically synthesized
gaggcacaataatggaagag

SEQ ID NO: 195161 - DNA, 20 bp, Artificial Sequence
  chemically synthesized
actgaggcacaataatggaa

SEQ ID NO: 195162 - DNA, 20 bp, Artificial Sequence
  chemically synthesized
tgactgaggcacaataatgg

SEQ ID NO: 195163 - DNA, 20 bp, Artificial Sequence
  chemically synthesized
gggtgactgaggcacaataa

SEQ ID NO: 195164 - DNA, 20 bp, Artificial Sequence
  chemically synthesized
tctcttccattattgtgcct

SEQ ID NO: 195165 - DNA, 20 bp, Artificial Sequence
  chemically synthesized
agacacctagggggtgactg

SEQ ID NO: 195166 - DNA, 20 bp, Artificial Sequence
  chemically synthesized
gagacacctagggggtgact

SEQ ID NO: 195167 - DNA, 20 bp, Artificial Sequence
  chemically synthesized
attgtgcctcagtcaccccc

SEQ ID NO: 195168 - DNA, 20 bp, Artificial Sequence
  chemically synthesized
ttgtgcctcagtcaccccct

SEQ ID NO: 195169 - DNA, 20 bp, Artificial Sequence
  chemically synthesized
aaatgagggagacacctagg

SEQ ID NO: 195170 - DNA, 20 bp, Artificial Sequence
  chemically synthesized
caaatgagggagacacctag

SEQ ID NO: 195171 - DNA, 20 bp, Artificial Sequence
  chemically synthesized
acaaatgagggagacaccta

SEQ ID NO: 195172 - DNA, 20 bp, Artificial Sequence
  chemically synthesized
aacaaatgagggagacacct

SEQ ID NO: 195173 - DNA, 20 bp, Artificial Sequence
  chemically synthesized
aaacaaatgagggagacacc

SEQ ID NO: 195174 - DNA, 20 bp, Artificial Sequence
  chemically synthesized
aaatgcagaaacaaatgagg

SEQ ID NO: 195175 - DNA, 20 bp, Artificial Sequence
  chemically synthesized
gtaaatgcagaaacaaatga

SEQ ID NO: 195176 - DNA, 20 bp, Artificial Sequence
  chemically synthesized
ggtaaatgcagaaacaaatg

SEQ ID NO: 195177 - DNA, 20 bp, Artificial Sequence
  chemically synthesized
gggtaaatgcagaaacaaat

SEQ ID NO: 195178 - DNA, 20 bp, Artificial Sequence
  chemically synthesized
cagtagcagccgggtaaatg

SEQ ID NO: 195179 - DNA, 20 bp, Artificial Sequence
  chemically synthesized
catttgtttctgcatttacc

SEQ ID NO: 195180 - DNA, 20 bp, Artificial Sequence
  chemically synthesized
ttgaagaaacagtagcagcc

SEQ ID NO: 195181 - DNA, 20 bp, Artificial Sequence
  chemically synthesized
attgaagaaacagtagcagc

SEQ ID NO: 195182 - DNA, 20 bp, Artificial Sequence
  chemically synthesized
agaaattgaagaaacagtag

SEQ ID NO: 195183 - DNA, 20 bp, Artificial Sequence
  chemically synthesized
agaagaaattgaagaaacag

SEQ ID NO: 195184 - DNA, 20 bp, Artificial Sequence
  chemically synthesized
gggagaagaaattgaagaaa

SEQ ID NO: 195185 - DNA, 20 bp, Artificial Sequence
  chemically synthesized
ttatgagggagaagaaattg

SEQ ID NO: 195186 - DNA, 20 bp, Artificial Sequence
  chemically synthesized
aattcagaattatgagggag

SEQ ID NO: 195187 - DNA, 20 bp, Artificial Sequence
  chemically synthesized
tacaattcagaattatgagg

SEQ ID NO: 195188 - DNA, 20 bp, Artificial Sequence
  chemically synthesized
tgtacaattcagaattatga

SEQ ID NO: 195189 - DNA, 20 bp, Artificial Sequence
  chemically synthesized
atgtacaattcagaattatg

SEQ ID NO: 195190 - DNA, 20 bp, Artificial Sequence
  chemically synthesized
tatgtacaattcagaattat

SEQ ID NO: 195191 - DNA, 20 bp, Artificial Sequence
  chemically synthesized
cttgaaagctatgtacaatt

SEQ ID NO: 195192 - DNA, 20 bp, Artificial Sequence
  chemically synthesized
tcataattctgaattgtaca

SEQ ID NO: 195193 - DNA, 20 bp, Artificial Sequence
  chemically synthesized
ctgaattgtacatagctttc

SEQ ID NO: 195194 - DNA, 20 bp, Artificial Sequence
  chemically synthesized
tgaattgtacatagctttca

SEQ ID NO: 195195 - DNA, 20 bp, Artificial Sequence
  chemically synthesized
tgacagagttgtagccttga

SEQ ID NO: 195196 - DNA, 20 bp, Artificial Sequence
  chemically synthesized
ttaataacatgacagagttg

SEQ ID NO: 195197 - DNA, 20 bp, Artificial Sequence
  chemically synthesized
atagctttaataacatgaca

SEQ ID NO: 195198 - DNA, 20 bp, Artificial Sequence
  chemically synthesized
gtatagctttaataacatga

SEQ ID NO: 195199 - DNA, 20 bp, Artificial Sequence
  chemically synthesized
acaactctgtcatgttatta

SEQ ID NO: 195200 - DNA, 20 bp, Artificial Sequence
  chemically synthesized
gtcatgttattaaagctata

SEQ ID NO: 195201 - DNA, 20 bp, Artificial Sequence
  chemically synthesized
gaatagatacagaagctgta

SEQ ID NO: 195202 - DNA, 20 bp, Artificial Sequence
  chemically synthesized
gaatttcagaatagatacag

SEQ ID NO: 195203 - DNA, 20 bp, Artificial Sequence
  chemically synthesized
caagaatttcagaatagata

SEQ ID NO: 195204 - DNA, 20 bp, Artificial Sequence
  chemically synthesized
aaaacccaagaatttcagaa

SEQ ID NO: 195205 - DNA, 20 bp, Artificial Sequence
  chemically synthesized
tgtatctattctgaaattct

SEQ ID NO: 195206 - DNA, 20 bp, Artificial Sequence
  chemically synthesized
cttggaaaacccaagaattt

SEQ ID NO: 195207 - DNA, 20 bp, Artificial Sequence
  chemically synthesized
gtatctattctgaaattctt

SEQ ID NO: 195208 - DNA, 20 bp, Artificial Sequence
  chemically synthesized
tttctattcttggaaaaccc

SEQ ID NO: 195209 - DNA, 20 bp, Artificial Sequence
  chemically synthesized
ctgaaattcttgggttttcc

SEQ ID NO: 195210 - DNA, 20 bp, Artificial Sequence
  chemically synthesized
attcttgggttttccaagaa

SEQ ID NO: 195211 - DNA, 20 bp, Artificial Sequence
  chemically synthesized
aacaatcagatttctattct

SEQ ID NO: 195212 - DNA, 20 bp, Artificial Sequence
  chemically synthesized
agaatagaaatctgattgtt

SEQ ID NO: 195213 - DNA, 20 bp, Artificial Sequence
  chemically synthesized
taagaagttagctgaacaat

SEQ ID NO: 195214 - DNA, 20 bp, Artificial Sequence
  chemically synthesized
agagcttggcattaagaagt

SEQ ID NO: 195215 - DNA, 20 bp, Artificial Sequence
  chemically synthesized
aaccagagcttggcattaag

SEQ ID NO: 195216 - DNA, 20 bp, Artificial Sequence
  chemically synthesized
tcagctaacttcttaatgcc

SEQ ID NO: 195217 - DNA, 20 bp, Artificial Sequence
  chemically synthesized
tgaaaccagagcttggcatt

SEQ ID NO: 195218 - DNA, 20 bp, Artificial Sequence
  chemically synthesized
aacttcttaatgccaagctc

SEQ ID NO: 195219 - DNA, 20 bp, Artificial Sequence
  chemically synthesized
ggttgattgaaaccagagct

SEQ ID NO: 195220 - DNA, 20 bp, Artificial Sequence
  chemically synthesized
tacatggttgattgaaacca

SEQ ID NO: 195221 - DNA, 20 bp, Artificial Sequence
  chemically synthesized
actacatggttgattgaaac

SEQ ID NO: 195222 - DNA, 20 bp, Artificial Sequence
  chemically synthesized
tctggtttcaatcaaccatg

SEQ ID NO: 195223 - DNA, 20 bp, Artificial Sequence
  chemically synthesized
ggtttcaatcaaccatgtag

SEQ ID NO: 195224 - DNA, 20 bp, Artificial Sequence
  chemically synthesized
tttcaatcaaccatgtagtg

SEQ ID NO: 195225 - DNA, 20 bp, Artificial Sequence
  chemically synthesized
tcgtaactgcctccactaca

SEQ ID NO: 195226 - DNA, 20 bp, Artificial Sequence
  chemically synthesized
ttcaatcaaccatgtagtgg

SEQ ID NO: 195227 - DNA, 20 bp, Artificial Sequence
  chemically synthesized
aatcaaccatgtagtggagg

SEQ ID NO: 195228 - DNA, 20 bp, Artificial Sequence
  chemically synthesized
atgtagtggaggcagttacg

SEQ ID NO: 195229 - DNA, 20 bp, Artificial Sequence
  chemically synthesized
tgtagtggaggcagttacga

SEQ ID NO: 195230 - DNA, 20 bp, Artificial Sequence
  chemically synthesized
gtagtggaggcagttacgaa

SEQ ID NO: 195231 - DNA, 20 bp, Artificial Sequence
  chemically synthesized
cccagtaaaagggtgcattc

SEQ ID NO: 195232 - DNA, 20 bp, Artificial Sequence
  chemically synthesized
tcccagtaaaagggtgcatt

SEQ ID NO: 195233 - DNA, 20 bp, Artificial Sequence
  chemically synthesized
gcccgaatgcacccttttac

SEQ ID NO: 195234 - DNA, 20 bp, Artificial Sequence
  chemically synthesized
cccgaatgcacccttttact

SEQ ID NO: 195235 - DNA, 20 bp, Artificial Sequence
  chemically synthesized
tgtgtcctatcccagtaaaa

SEQ ID NO: 195236 - DNA, 20 bp, Artificial Sequence
  chemically synthesized
ctgtgtcctatcccagtaaa

SEQ ID NO: 195237 - DNA, 20 bp, Artificial Sequence
  chemically synthesized
cctgtgtcctatcccagtaa

SEQ ID NO: 195238 - DNA, 20 bp, Artificial Sequence
  chemically synthesized
aatgcacccttttactggga

SEQ ID NO: 195239 - DNA, 20 bp, Artificial Sequence
  chemically synthesized
atgcacccttttactgggat

SEQ ID NO: 195240 - DNA, 20 bp, Artificial Sequence
  chemically synthesized
aactgccctgtgtcctatcc

SEQ ID NO: 195241 - DNA, 20 bp, Artificial Sequence
  chemically synthesized
ccttttactgggataggaca

SEQ ID NO: 195242 - DNA, 20 bp, Artificial Sequence
  chemically synthesized
cttttactgggataggacac

SEQ ID NO: 195243 - DNA, 20 bp, Artificial Sequence
  chemically synthesized
ttttactgggataggacaca

SEQ ID NO: 195244 - DNA, 20 bp, Artificial Sequence
  chemically synthesized
tactgggataggacacaggg

SEQ ID NO: 195245 - DNA, 20 bp, Artificial Sequence
  chemically synthesized
aggacacagggcagttcatt

SEQ ID NO: 195246 - DNA, 20 bp, Artificial Sequence
  chemically synthesized
ggacacagggcagttcattt

SEQ ID NO: 195247 - DNA, 20 bp, Artificial Sequence
  chemically synthesized
cagggcagttcatttaggaa

SEQ ID NO: 195248 - DNA, 20 bp, Artificial Sequence
  chemically synthesized
gggcagttcatttaggaaca

SEQ ID NO: 195249 - DNA, 20 bp, Artificial Sequence
  chemically synthesized
aaatatccttgtttggataa

SEQ ID NO: 195250 - DNA, 20 bp, Artificial Sequence
  chemically synthesized
tgataatctattatccaaac

SEQ ID NO: 195251 - DNA, 20 bp, Artificial Sequence
  chemically synthesized
gataatctattatccaaaca

SEQ ID NO: 195252 - DNA, 20 bp, Artificial Sequence
  chemically synthesized
ctctcaaaaatatccttgtt

SEQ ID NO: 195253 - DNA, 20 bp, Artificial Sequence
  chemically synthesized
atccaaacaaggatattttt

SEQ ID NO: 195254 - DNA, 20 bp, Artificial Sequence
  chemically synthesized
ccaaacaaggatatttttga

SEQ ID NO: 195255 - DNA, 20 bp, Artificial Sequence
  chemically synthesized
aaggatatttttgagagcaa

SEQ ID NO: 195256 - DNA, 20 bp, Artificial Sequence
  chemically synthesized
aggatatttttgagagcaaa

SEQ ID NO: 195257 - DNA, 20 bp, Artificial Sequence
  chemically synthesized
gatatttttgagagcaaaag

SEQ ID NO: 195258 - DNA, 20 bp, Artificial Sequence
  chemically synthesized
atatttttgagagcaaaagg

SEQ ID NO: 195259 - DNA, 20 bp, Artificial Sequence
  chemically synthesized
atcctatgtaatcatttatt

SEQ ID NO: 195260 - DNA, 20 bp, Artificial Sequence
  chemically synthesized
tatcctatgtaatcatttat

SEQ ID NO: 195261 - DNA, 20 bp, Artificial Sequence
  chemically synthesized
aggcccaataaatgattaca

SEQ ID NO: 195262 - DNA, 20 bp, Artificial Sequence
  chemically synthesized
ggcccaataaatgattacat

SEQ ID NO: 195263 - DNA, 20 bp, Artificial Sequence
  chemically synthesized
aatgattacataggataaac

SEQ ID NO: 195264 - DNA, 20 bp, Artificial Sequence
  chemically synthesized
gattacataggataaacaag

SEQ ID NO: 195265 - DNA, 20 bp, Artificial Sequence
  chemically synthesized
acataggataaacaagtaga

SEQ ID NO: 195266 - DNA, 20 bp, Artificial Sequence
  chemically synthesized
taggataaacaagtagaaag

SEQ ID NO: 195267 - DNA, 20 bp, Artificial Sequence
  chemically synthesized
aggataaacaagtagaaagt

SEQ ID NO: 195268 - DNA, 20 bp, Artificial Sequence
  chemically synthesized
gtagaaagtgggattgttct

SEQ ID NO: 195269 - DNA, 20 bp, Artificial Sequence
  chemically synthesized
actgtaagttgcagtttact

SEQ ID NO: 195270 - DNA, 20 bp, Artificial Sequence
  chemically synthesized
tctgagtaaactgcaactta

SEQ ID NO: 195271 - DNA, 20 bp, Artificial Sequence
  chemically synthesized
tatacgttgactgtaagttg

SEQ ID NO: 195272 - DNA, 20 bp, Artificial Sequence
  chemically synthesized
gtactctatacgttgactgt

SEQ ID NO: 195273 - DNA, 20 bp, Artificial Sequence
  chemically synthesized
tgcaacttacagtcaacgta

SEQ ID NO: 195274 - DNA, 20 bp, Artificial Sequence
  chemically synthesized
caacttacagtcaacgtata

SEQ ID NO: 195275 - DNA, 20 bp, Artificial Sequence
  chemically synthesized
agtcaacgtatagagtactc

SEQ ID NO: 195276 - DNA, 20 bp, Artificial Sequence
  chemically synthesized
gtcaacgtatagagtactcc

SEQ ID NO: 195277 - DNA, 20 bp, Artificial Sequence
  chemically synthesized
aacgtatagagtactccagg

SEQ ID NO: 195278 - DNA, 20 bp, Artificial Sequence
  chemically synthesized
acgtatagagtactccaggc

SEQ ID NO: 195279 - DNA, 20 bp, Artificial Sequence
  chemically synthesized
ttacaatacttgcctgcctg

SEQ ID NO: 195280 - DNA, 20 bp, Artificial Sequence
  chemically synthesized
atagagtactccaggcaggc

SEQ ID NO: 195281 - DNA, 20 bp, Artificial Sequence
  chemically synthesized
atttacaatacttgcctgcc

SEQ ID NO: 195282 - DNA, 20 bp, Artificial Sequence
  chemically synthesized
gcaggcaagtattgtaaatt

SEQ ID NO: 195283 - DNA, 20 bp, Artificial Sequence
  chemically synthesized
gagaaactaacaagtggaaa

SEQ ID NO: 195284 - DNA, 20 bp, Artificial Sequence
  chemically synthesized
ttgagtctatttccacttgt

SEQ ID NO: 195285 - DNA, 20 bp, Artificial Sequence
  chemically synthesized
gcagtagagaaactaacaag

SEQ ID NO: 195286 - DNA, 20 bp, Artificial Sequence
  chemically synthesized
agagcagtagagaaactaac

SEQ ID NO: 195287 - DNA, 20 bp, Artificial Sequence
  chemically synthesized
tatatatatgaagagcagta

SEQ ID NO: 195288 - DNA, 20 bp, Artificial Sequence
  chemically synthesized
agtatatatatgaagagcag

SEQ ID NO: 195289 - DNA, 20 bp, Artificial Sequence
  chemically synthesized
ttcagtatatatatgaagag

SEQ ID NO: 195290 - DNA, 20 bp, Artificial Sequence
  chemically synthesized
atattcagtatatatatgaa

SEQ ID NO: 195291 - DNA, 20 bp, Artificial Sequence
  chemically synthesized
agatattcagtatatatatg

SEQ ID NO: 195292 - DNA, 20 bp, Artificial Sequence
  chemically synthesized
tacactgagaaagagatatt

SEQ ID NO: 195293 - DNA, 20 bp, Artificial Sequence
  chemically synthesized
tatactgaatatctctttct

SEQ ID NO: 195294 - DNA, 20 bp, Artificial Sequence
  chemically synthesized
tgacattctacactgagaaa

SEQ ID NO: 195295 - DNA, 20 bp, Artificial Sequence
  chemically synthesized
aatgacattctacactgaga

SEQ ID NO: 195296 - DNA, 20 bp, Artificial Sequence
  chemically synthesized
tgaatatctctttctcagtg

SEQ ID NO: 195297 - DNA, 20 bp, Artificial Sequence
  chemically synthesized
aatgaatgacattctacact

SEQ ID NO: 195298 - DNA, 20 bp, Artificial Sequence
  chemically synthesized
ggatcaggctgatgttaggg

SEQ ID NO: 195299 - DNA, 20 bp, Artificial Sequence
  chemically synthesized
cattcattcttccctaacat

SEQ ID NO: 195300 - DNA, 20 bp, Artificial Sequence
  chemically synthesized
gtgggatcaggctgatgtta

SEQ ID NO: 195301 - DNA, 20 bp, Artificial Sequence
  chemically synthesized
agtgggatcaggctgatgtt

SEQ ID NO: 195302 - DNA, 20 bp, Artificial Sequence
  chemically synthesized
cagtgggatcaggctgatgt

SEQ ID NO: 195303 - DNA, 20 bp, Artificial Sequence
  chemically synthesized
cttgacgtagcagtgggatc

SEQ ID NO: 195304 - DNA, 20 bp, Artificial Sequence
  chemically synthesized
acttgacgtagcagtgggat

SEQ ID NO: 195305 - DNA, 20 bp, Artificial Sequence
  chemically synthesized
cacacacttgacgtagcagt

SEQ ID NO: 195306 - DNA, 20 bp, Artificial Sequence
  chemically synthesized
acacacacttgacgtagcag

SEQ ID NO: 195307 - DNA, 20 bp, Artificial Sequence
  chemically synthesized
cctgatcccactgctacgtc

SEQ ID NO: 195308 - DNA, 20 bp, Artificial Sequence
  chemically synthesized
tcaacacacacttgacgtag

SEQ ID NO: 195309 - DNA, 20 bp, Artificial Sequence
  chemically synthesized
atttcaacacacacttgacg

SEQ ID NO: 195310 - DNA, 20 bp, Artificial Sequence
  chemically synthesized
gaaatatttttttctccatg

SEQ ID NO: 195311 - DNA, 20 bp, Artificial Sequence
  chemically synthesized
aaatcaaggaaggcttcatg

SEQ ID NO: 195312 - DNA, 20 bp, Artificial Sequence
  chemically synthesized
ctaaatcaaggaaggcttca

SEQ ID NO: 195313 - DNA, 20 bp, Artificial Sequence
  chemically synthesized
cctgttagctaaatcaagga

SEQ ID NO: 195314 - DNA, 20 bp, Artificial Sequence
  chemically synthesized
tcctgttagctaaatcaagg

SEQ ID NO: 195315 - DNA, 20 bp, Artificial Sequence
  chemically synthesized
ccatgaagccttccttgatt

SEQ ID NO: 195316 - DNA, 20 bp, Artificial Sequence
  chemically synthesized
atttcctgttagctaaatca

SEQ ID NO: 195317 - DNA, 20 bp, Artificial Sequence
  chemically synthesized
aatttcctgttagctaaatc

SEQ ID NO: 195318 - DNA, 20 bp, Artificial Sequence
  chemically synthesized
gccttccttgatttagctaa

SEQ ID NO: 195319 - DNA, 20 bp, Artificial Sequence
  chemically synthesized
ccttccttgatttagctaac

SEQ ID NO: 195320 - DNA, 20 bp, Artificial Sequence
  chemically synthesized
agaaaagattaatttcctgt

SEQ ID NO: 195321 - DNA, 20 bp, Artificial Sequence
  chemically synthesized
aaaaaaaggaaagaaaagaa

SEQ ID NO: 195322 - DNA, 20 bp, Artificial Sequence
  chemically synthesized
aaaaaaaaaaaaggaaagaa

SEQ ID NO: 195323 - DNA, 20 bp, Artificial Sequence
  chemically synthesized
tctcaaaaaaaaaaaaagga

SEQ ID NO: 195324 - DNA, 20 bp, Artificial Sequence
  chemically synthesized
tccatctcaaaaaaaaaaaa

SEQ ID NO: 195325 - DNA, 20 bp, Artificial Sequence
  chemically synthesized
ttccatctcaaaaaaaaaaa

SEQ ID NO: 195326 - DNA, 20 bp, Artificial Sequence
  chemically synthesized
tctttccttttttttttttt

SEQ ID NO: 195327 - DNA, 20 bp, Artificial Sequence
  chemically synthesized
tcctttttttttttttgaga

SEQ ID NO: 195328 - DNA, 20 bp, Artificial Sequence
  chemically synthesized
actccagcctgggcaacagc

SEQ ID NO: 195329 - DNA, 20 bp, Artificial Sequence
  chemically synthesized
gatggaatcttgctgttgcc

SEQ ID NO: 195330 - DNA, 20 bp, Artificial Sequence
  chemically synthesized
atggaatcttgctgttgccc

SEQ ID NO: 195331 - DNA, 20 bp, Artificial Sequence
  chemically synthesized
ttgcactccagcctgggcaa

SEQ ID NO: 195332 - DNA, 20 bp, Artificial Sequence
  chemically synthesized
aatcttgctgttgcccaggc

SEQ ID NO: 195333 - DNA, 20 bp, Artificial Sequence
  chemically synthesized
tcttgctgttgcccaggctg

SEQ ID NO: 195334 - DNA, 20 bp, Artificial Sequence
  chemically synthesized
tggccattgcactccagcct

SEQ ID NO: 195335 - DNA, 20 bp, Artificial Sequence
  chemically synthesized
ctggccattgcactccagcc

SEQ ID NO: 195336 - DNA, 20 bp, Artificial Sequence
  chemically synthesized
aagatctggccattgcactc

SEQ ID NO: 195337 - DNA, 20 bp, Artificial Sequence
  chemically synthesized
ttgcccaggctggagtgcaa

SEQ ID NO: 195338 - DNA, 20 bp, Artificial Sequence
  chemically synthesized
ccaggctggagtgcaatggc

SEQ ID NO: 195339 - DNA, 20 bp, Artificial Sequence
  chemically synthesized
ggagtgcaatggccagatct

SEQ ID NO: 195340 - DNA, 20 bp, Artificial Sequence
  chemically synthesized
ggttgcagtgagccaagatc

SEQ ID NO: 195341 - DNA, 20 bp, Artificial Sequence
  chemically synthesized
ggtggaggttgcagtgagcc

SEQ ID NO: 195342 - DNA, 20 bp, Artificial Sequence
  chemically synthesized
tgggaggtggaggttgcagt

SEQ ID NO: 195343 - DNA, 20 bp, Artificial Sequence
  chemically synthesized
aacctgggaggtggaggttg

SEQ ID NO: 195344 - DNA, 20 bp, Artificial Sequence
  chemically synthesized
tgtttgaacctgggaggtgg

SEQ ID NO: 195345 - DNA, 20 bp, Artificial Sequence
  chemically synthesized
tcactgcaacctccacctcc

SEQ ID NO: 195346 - DNA, 20 bp, Artificial Sequence
  chemically synthesized
ttgtttgaacctgggaggtg

SEQ ID NO: 195347 - DNA, 20 bp, Artificial Sequence
  chemically synthesized
cactgcaacctccacctccc

SEQ ID NO: 195348 - DNA, 20 bp, Artificial Sequence
  chemically synthesized
aattgtttgaacctgggagg

SEQ ID NO: 195349 - DNA, 20 bp, Artificial Sequence
  chemically synthesized
gagaattgtttgaacctggg

SEQ ID NO: 195350 - DNA, 20 bp, Artificial Sequence
  chemically synthesized
ggagaattgtttgaacctgg

SEQ ID NO: 195351 - DNA, 20 bp, Artificial Sequence
  chemically synthesized
caggagaattgtttgaacct

SEQ ID NO: 195352 - DNA, 20 bp, Artificial Sequence
  chemically synthesized
gcaggagaattgtttgaacc

SEQ ID NO: 195353 - DNA, 20 bp, Artificial Sequence
  chemically synthesized
ttcaaacaattctcctgcct

SEQ ID NO: 195354 - DNA, 20 bp, Artificial Sequence
  chemically synthesized
tacttagcaggctgaggcag

SEQ ID NO: 195355 - DNA, 20 bp, Artificial Sequence
  chemically synthesized
gctacttagcaggctgaggc

SEQ ID NO: 195356 - DNA, 20 bp, Artificial Sequence
  chemically synthesized
agctacttagcaggctgagg

SEQ ID NO: 195357 - DNA, 20 bp, Artificial Sequence
  chemically synthesized
cccagctacttagcaggctg

SEQ ID NO: 195358 - DNA, 20 bp, Artificial Sequence
  chemically synthesized
tcccagctacttagcaggct

SEQ ID NO: 195359 - DNA, 20 bp, Artificial Sequence
  chemically synthesized
ttctcctgcctcagcctgct

SEQ ID NO: 195360 - DNA, 20 bp, Artificial Sequence
  chemically synthesized
tcctgcctcagcctgctaag

SEQ ID NO: 195361 - DNA, 20 bp, Artificial Sequence
  chemically synthesized
tgtaatcccagctacttagc

SEQ ID NO: 195362 - DNA, 20 bp, Artificial Sequence
  chemically synthesized
ctgtaatcccagctacttag

SEQ ID NO: 195363 - DNA, 20 bp, Artificial Sequence
  chemically synthesized
gcctcagcctgctaagtagc

SEQ ID NO: 195364 - DNA, 20 bp, Artificial Sequence
  chemically synthesized
cctcagcctgctaagtagct

SEQ ID NO: 195365 - DNA, 20 bp, Artificial Sequence
  chemically synthesized
cacctgtaatcccagctact

SEQ ID NO: 195366 - DNA, 20 bp, Artificial Sequence
  chemically synthesized
ctgctaagtagctgggatta

SEQ ID NO: 195367 - DNA, 20 bp, Artificial Sequence
  chemically synthesized
tgctaagtagctgggattac

SEQ ID NO: 195368 - DNA, 20 bp, Artificial Sequence
  chemically synthesized
gtggtatgcacctgtaatcc

SEQ ID NO: 195369 - DNA, 20 bp, Artificial Sequence
  chemically synthesized
caggtgcataccaccaaacc

SEQ ID NO: 195370 - DNA, 20 bp, Artificial Sequence
  chemically synthesized
caaaaattagccgggtttgg

SEQ ID NO: 195371 - DNA, 20 bp, Artificial Sequence
  chemically synthesized
atacaaaaattagccgggtt

SEQ ID NO: 195372 - DNA, 20 bp, Artificial Sequence
  chemically synthesized
taaatatacaaaaattagcc

SEQ ID NO: 195373 - DNA, 20 bp, Artificial Sequence
  chemically synthesized
ctaaatatacaaaaattagc

SEQ ID NO: 195374 - DNA, 20 bp, Artificial Sequence
  chemically synthesized
tctactaaatatacaaaaat

SEQ ID NO: 195375 - DNA, 20 bp, Artificial Sequence
  chemically synthesized
ccggctaatttttgtatatt

SEQ ID NO: 195376 - DNA, 20 bp, Artificial Sequence
  chemically synthesized
gctaatttttgtatatttag

SEQ ID NO: 195377 - DNA, 20 bp, Artificial Sequence
  chemically synthesized
taatttttgtatatttagta

SEQ ID NO: 195378 - DNA, 20 bp, Artificial Sequence
  chemically synthesized
ttttgtatatttagtagaga

SEQ ID NO: 195379 - DNA, 20 bp, Artificial Sequence
  chemically synthesized
ttgtatatttagtagagata

SEQ ID NO: 195380 - DNA, 20 bp, Artificial Sequence
  chemically synthesized
gagatagagtttcaccatgt

SEQ ID NO: 195381 - DNA, 20 bp, Artificial Sequence
  chemically synthesized
tagagtttcaccatgttggc

SEQ ID NO: 195382 - DNA, 20 bp, Artificial Sequence
  chemically synthesized
cgagaccatcctggccaaca

SEQ ID NO: 195383 - DNA, 20 bp, Artificial Sequence
  chemically synthesized
agagtttcaccatgttggcc

SEQ ID NO: 195384 - DNA, 20 bp, Artificial Sequence
  chemically synthesized
tttcaccatgttggccagga

SEQ ID NO: 195385 - DNA, 20 bp, Artificial Sequence
  chemically synthesized
tcaggagttcgagaccatcc

SEQ ID NO: 195386 - DNA, 20 bp, Artificial Sequence
  chemically synthesized
gatcacgaggtcaggagttc

SEQ ID NO: 195387 - DNA, 20 bp, Artificial Sequence
  chemically synthesized
tgggcagatcacgaggtcag

SEQ ID NO: 195388 - DNA, 20 bp, Artificial Sequence
  chemically synthesized
ggtgggcagatcacgaggtc

SEQ ID NO: 195389 - DNA, 20 bp, Artificial Sequence
  chemically synthesized
aggtgggcagatcacgaggt

SEQ ID NO: 195390 - DNA, 20 bp, Artificial Sequence
  chemically synthesized
gccaaggtgggcagatcacg

SEQ ID NO: 195391 - DNA, 20 bp, Artificial Sequence
  chemically synthesized
ggccaaggtgggcagatcac

SEQ ID NO: 195392 - DNA, 20 bp, Artificial Sequence
  chemically synthesized
acctcgtgatctgcccacct

SEQ ID NO: 195393 - DNA, 20 bp, Artificial Sequence
  chemically synthesized
ctttgggaggccaaggtggg

SEQ ID NO: 195394 - DNA, 20 bp, Artificial Sequence
  chemically synthesized
gcactttgggaggccaaggt

SEQ ID NO: 195395 - DNA, 20 bp, Artificial Sequence
  chemically synthesized
agcactttgggaggccaagg

SEQ ID NO: 195396 - DNA, 20 bp, Artificial Sequence
  chemically synthesized
cccagcactttgggaggcca

SEQ ID NO: 195397 - DNA, 20 bp, Artificial Sequence
  chemically synthesized
tcccagcactttgggaggcc

SEQ ID NO: 195398 - DNA, 20 bp, Artificial Sequence
  chemically synthesized
ctgcccaccttggcctccca

SEQ ID NO: 195399 - DNA, 20 bp, Artificial Sequence
  chemically synthesized
tgtaatcccagcactttggg

SEQ ID NO: 195400 - DNA, 20 bp, Artificial Sequence
  chemically synthesized
ctgtaatcccagcactttgg

SEQ ID NO: 195401 - DNA, 20 bp, Artificial Sequence
  chemically synthesized
accttggcctcccaaagtgc

SEQ ID NO: 195402 - DNA, 20 bp, Artificial Sequence
  chemically synthesized
gcctgtaatcccagcacttt

SEQ ID NO: 195403 - DNA, 20 bp, Artificial Sequence
  chemically synthesized
ccttggcctcccaaagtgct

SEQ ID NO: 195404 - DNA, 20 bp, Artificial Sequence
  chemically synthesized
cgcctgtaatcccagcactt

SEQ ID NO: 195405 - DNA, 20 bp, Artificial Sequence
  chemically synthesized
ctcccaaagtgctgggatta

SEQ ID NO: 195406 - DNA, 20 bp, Artificial Sequence
  chemically synthesized
tcccaaagtgctgggattac

SEQ ID NO: 195407 - DNA, 20 bp, Artificial Sequence
  chemically synthesized
gtggctcacgcctgtaatcc

SEQ ID NO: 195408 - DNA, 20 bp, Artificial Sequence
  chemically synthesized
agtgctgggattacaggcgt

SEQ ID NO: 195409 - DNA, 20 bp, Artificial Sequence
  chemically synthesized
caggcgtgagccaccgtgcc

SEQ ID NO: 195410 - DNA, 20 bp, Artificial Sequence
  chemically synthesized
gatgaattggctgggcacgg

SEQ ID NO: 195411 - DNA, 20 bp, Artificial Sequence
  chemically synthesized
aaagatgaattggctgggca

SEQ ID NO: 195412 - DNA, 20 bp, Artificial Sequence
  chemically synthesized
aaaagaaagatgaattggct

SEQ ID NO: 195413 - DNA, 20 bp, Artificial Sequence
  chemically synthesized
aaaaagaaagatgaattggc

SEQ ID NO: 195414 - DNA, 20 bp, Artificial Sequence
  chemically synthesized
ttataaaaagaaagatgaat

SEQ ID NO: 195415 - DNA, 20 bp, Artificial Sequence
  chemically synthesized
ttgcatttattataaaaaga

SEQ ID NO: 195416 - DNA, 20 bp, Artificial Sequence
  chemically synthesized
cgatttgcatttattataaa

SEQ ID NO: 195417 - DNA, 20 bp, Artificial Sequence
  chemically synthesized
agccctagaatgcacagttg

SEQ ID NO: 195418 - DNA, 20 bp, Artificial Sequence
  chemically synthesized
cgtacttcaactgtgcattc

SEQ ID NO: 195419 - DNA, 20 bp, Artificial Sequence
  chemically synthesized
aatacaagccctagaatgca

SEQ ID NO: 195420 - DNA, 20 bp, Artificial Sequence
  chemically synthesized
gtacttcaactgtgcattct

SEQ ID NO: 195421 - DNA, 20 bp, Artificial Sequence
  chemically synthesized
tacttcaactgtgcattcta

SEQ ID NO: 195422 - DNA, 20 bp, Artificial Sequence
  chemically synthesized
tagaaaataaatacaagccc

SEQ ID NO: 195423 - DNA, 20 bp, Artificial Sequence
  chemically synthesized
gtataatagaaaataaatac

SEQ ID NO: 195424 - DNA, 20 bp, Artificial Sequence
  chemically synthesized
ataaaaattataatgtataa

SEQ ID NO: 195425 - DNA, 20 bp, Artificial Sequence
  chemically synthesized
tatgcatgtactttgtctaa

SEQ ID NO: 195426 - DNA, 20 bp, Artificial Sequence
  chemically synthesized
gaacttacacctattagaca

SEQ ID NO: 195427 - DNA, 20 bp, Artificial Sequence
  chemically synthesized
atgcatgtactttgtctaat

SEQ ID NO: 195428 - DNA, 20 bp, Artificial Sequence
  chemically synthesized
ccctaagaacttacacctat

SEQ ID NO: 195429 - DNA, 20 bp, Artificial Sequence
  chemically synthesized
gtactttgtctaataggtgt

SEQ ID NO: 195430 - DNA, 20 bp, Artificial Sequence
  chemically synthesized
gtctaataggtgtaagttct

SEQ ID NO: 195431 - DNA, 20 bp, Artificial Sequence
  chemically synthesized
tctaataggtgtaagttctt

SEQ ID NO: 195432 - DNA, 20 bp, Artificial Sequence
  chemically synthesized
ctaataggtgtaagttctta

SEQ ID NO: 195433 - DNA, 20 bp, Artificial Sequence
  chemically synthesized
aataggtgtaagttcttagg

SEQ ID NO: 195434 - DNA, 20 bp, Artificial Sequence
  chemically synthesized
aaatatggctcattctccct

SEQ ID NO: 195435 - DNA, 20 bp, Artificial Sequence
  chemically synthesized
tgtaagttcttagggagaat

SEQ ID NO: 195436 - DNA, 20 bp, Artificial Sequence
  chemically synthesized
atacaaaaatgtattaaata

SEQ ID NO: 195437 - DNA, 20 bp, Artificial Sequence
  chemically synthesized
acatttttgtataccccaca

SEQ ID NO: 195438 - DNA, 20 bp, Artificial Sequence
  chemically synthesized
agtattggctaggccatgtg

SEQ ID NO: 195439 - DNA, 20 bp, Artificial Sequence
  chemically synthesized
aagtattggctaggccatgt

SEQ ID NO: 195440 - DNA, 20 bp, Artificial Sequence
  chemically synthesized
tttgtataccccacatggcc

SEQ ID NO: 195441 - DNA, 20 bp, Artificial Sequence
  chemically synthesized
aaagtattggctaggccatg

SEQ ID NO: 195442 - DNA, 20 bp, Artificial Sequence
  chemically synthesized
ctataagcaaagtattggct

SEQ ID NO: 195443 - DNA, 20 bp, Artificial Sequence
  chemically synthesized
actataagcaaagtattggc

SEQ ID NO: 195444 - DNA, 20 bp, Artificial Sequence
  chemically synthesized
accaactataagcaaagtat

SEQ ID NO: 195445 - DNA, 20 bp, Artificial Sequence
  chemically synthesized
cctagccaatactttgctta

SEQ ID NO: 195446 - DNA, 20 bp, Artificial Sequence
  chemically synthesized
ttgcctaccaactataagca

SEQ ID NO: 195447 - DNA, 20 bp, Artificial Sequence
  chemically synthesized
gccaatactttgcttatagt

SEQ ID NO: 195448 - DNA, 20 bp, Artificial Sequence
  chemically synthesized
attcattgcctaccaactat

SEQ ID NO: 195449 - DNA, 20 bp, Artificial Sequence
  chemically synthesized
aatactttgcttatagttgg

SEQ ID NO: 195450 - DNA, 20 bp, Artificial Sequence
  chemically synthesized
atactttgcttatagttggt

SEQ ID NO: 195451 - DNA, 20 bp, Artificial Sequence
  chemically synthesized
ttattaaacgaatgattgct

SEQ ID NO: 195452 - DNA, 20 bp, Artificial Sequence
  chemically synthesized
aatgatgttttcagaaaact

SEQ ID NO: 195453 - DNA, 20 bp, Artificial Sequence
  chemically synthesized
aatggcaagaatgatgtttt

SEQ ID NO: 195454 - DNA, 20 bp, Artificial Sequence
  chemically synthesized
gagctcaaaacaacaatggc

SEQ ID NO: 195455 - DNA, 20 bp, Artificial Sequence
  chemically synthesized
gagtgagctcaaaacaacaa

SEQ ID NO: 195456 - DNA, 20 bp, Artificial Sequence
  chemically synthesized
attcttgccattgttgtttt

SEQ ID NO: 195457 - DNA, 20 bp, Artificial Sequence
  chemically synthesized
aggatccagaataattgagt

SEQ ID NO: 195458 - DNA, 20 bp, Artificial Sequence
  chemically synthesized
catcaggatccagaataatt

SEQ ID NO: 195459 - DNA, 20 bp, Artificial Sequence
  chemically synthesized
ttgagctcactcaattattc

SEQ ID NO: 195460 - DNA, 20 bp, Artificial Sequence
  chemically synthesized
atttcatagacatcaggatc

SEQ ID NO: 195461 - DNA, 20 bp, Artificial Sequence
  chemically synthesized
ttttgcatttcatagacatc

SEQ ID NO: 195462 - DNA, 20 bp, Artificial Sequence
  chemically synthesized
tttttgcatttcatagacat

SEQ ID NO: 195463 - DNA, 20 bp, Artificial Sequence
  chemically synthesized
tcttatctttttgcatttca

SEQ ID NO: 195464 - DNA, 20 bp, Artificial Sequence
  chemically synthesized
tgatgtctatgaaatgcaaa

SEQ ID NO: 195465 - DNA, 20 bp, Artificial Sequence
  chemically synthesized
tctatgaaatgcaaaaagat

SEQ ID NO: 195466 - DNA, 20 bp, Artificial Sequence
  chemically synthesized
gatattgatcacgtctaaat

SEQ ID NO: 195467 - DNA, 20 bp, Artificial Sequence
  chemically synthesized
attgatcacgtctaaattag

SEQ ID NO: 195468 - DNA, 20 bp, Artificial Sequence
  chemically synthesized
atctcaccactcttctaatt

SEQ ID NO: 195469 - DNA, 20 bp, Artificial Sequence
  chemically synthesized
tgatcacgtctaaattagaa

SEQ ID NO: 195470 - DNA, 20 bp, Artificial Sequence
  chemically synthesized
tcacgtctaaattagaagag

SEQ ID NO: 195471 - DNA, 20 bp, Artificial Sequence
  chemically synthesized
gtctaaattagaagagtggt

SEQ ID NO: 195472 - DNA, 20 bp, Artificial Sequence
  chemically synthesized
tagaagagtggtgagataaa

SEQ ID NO: 195473 - DNA, 20 bp, Artificial Sequence
  chemically synthesized
gtggtgagataaacagaaat

SEQ ID NO: 195474 - DNA, 20 bp, Artificial Sequence
  chemically synthesized
ggtgagataaacagaaataa

SEQ ID NO: 195475 - DNA, 20 bp, Artificial Sequence
  chemically synthesized
gtgagataaacagaaataag

SEQ ID NO: 195476 - DNA, 20 bp, Artificial Sequence
  chemically synthesized
ataaacagaaataagaggat

SEQ ID NO: 195477 - DNA, 20 bp, Artificial Sequence
  chemically synthesized
aacagaaataagaggattgg

SEQ ID NO: 195478 - DNA, 20 bp, Artificial Sequence
  chemically synthesized
attcttcagattatgtaaat

SEQ ID NO: 195479 - DNA, 20 bp, Artificial Sequence
  chemically synthesized
taacttatttacataatctg

SEQ ID NO: 195480 - DNA, 20 bp, Artificial Sequence
  chemically synthesized
atttccagttaaacattctt

SEQ ID NO: 195481 - DNA, 20 bp, Artificial Sequence
  chemically synthesized
taatctgaagaatgtttaac

SEQ ID NO: 195482 - DNA, 20 bp, Artificial Sequence
  chemically synthesized
tcttctgtccgttttatttc

SEQ ID NO: 195483 - DNA, 20 bp, Artificial Sequence
  chemically synthesized
atgtttaactggaaataaaa

SEQ ID NO: 195484 - DNA, 20 bp, Artificial Sequence
  chemically synthesized
ttaactggaaataaaacgga

SEQ ID NO: 195485 - DNA, 20 bp, Artificial Sequence
  chemically synthesized
actggaaataaaacggacag

SEQ ID NO: 195486 - DNA, 20 bp, Artificial Sequence
  chemically synthesized
cagaagacattttgcttctg

SEQ ID NO: 195487 - DNA, 20 bp, Artificial Sequence
  chemically synthesized
gaagacattttgcttctgaa

SEQ ID NO: 195488 - DNA, 20 bp, Artificial Sequence
  chemically synthesized
ttccttgtttatctcttcag

SEQ ID NO: 195489 - DNA, 20 bp, Artificial Sequence
  chemically synthesized
ggattccttgtttatctctt

SEQ ID NO: 195490 - DNA, 20 bp, Artificial Sequence
  chemically synthesized
ttgcttctgaagagataaac

SEQ ID NO: 195491 - DNA, 20 bp, Artificial Sequence
  chemically synthesized
tgcttctgaagagataaaca

SEQ ID NO: 195492 - DNA, 20 bp, Artificial Sequence
  chemically synthesized
aagagataaacaaggaatcc

SEQ ID NO: 195493 - DNA, 20 bp, Artificial Sequence
  chemically synthesized
tccttttctttcaattatct

SEQ ID NO: 195494 - DNA, 20 bp, Artificial Sequence
  chemically synthesized
ttccttttctttcaattatc

SEQ ID NO: 195495 - DNA, 20 bp, Artificial Sequence
  chemically synthesized
aaggaatcctagataattga

SEQ ID NO: 195496 - DNA, 20 bp, Artificial Sequence
  chemically synthesized
atcctagataattgaaagaa

SEQ ID NO: 195497 - DNA, 20 bp, Artificial Sequence
  chemically synthesized
tcctagataattgaaagaaa

SEQ ID NO: 195498 - DNA, 20 bp, Artificial Sequence
  chemically synthesized
gaatacatttatttctcaat

SEQ ID NO: 195499 - DNA, 20 bp, Artificial Sequence
  chemically synthesized
ggattgaacaaatactcatt

SEQ ID NO: 195500 - DNA, 20 bp, Artificial Sequence
  chemically synthesized
ttgtctaaataaatcatgta

SEQ ID NO: 195501 - DNA, 20 bp, Artificial Sequence
  chemically synthesized
caatccatacatgatttatt

SEQ ID NO: 195502 - DNA, 20 bp, Artificial Sequence
  chemically synthesized
aaccaaggggatgttcaaat

SEQ ID NO: 195503 - DNA, 20 bp, Artificial Sequence
  chemically synthesized
atctaatttgaacatcccct

SEQ ID NO: 195504 - DNA, 20 bp, Artificial Sequence
  chemically synthesized
tataaattatagaaaccaag

SEQ ID NO: 195505 - DNA, 20 bp, Artificial Sequence
  chemically synthesized
ttataaattatagaaaccaa

SEQ ID NO: 195506 - DNA, 20 bp, Artificial Sequence
  chemically synthesized
gttataaattatagaaacca

SEQ ID NO: 195507 - DNA, 20 bp, Artificial Sequence
  chemically synthesized
tgttataaattatagaaacc

SEQ ID NO: 195508 - DNA, 20 bp, Artificial Sequence
  chemically synthesized
gtaaatgatgttataaatta

SEQ ID NO: 195509 - DNA, 20 bp, Artificial Sequence
  chemically synthesized
taatttataacatcatttac

SEQ ID NO: 195510 - DNA, 20 bp, Artificial Sequence
  chemically synthesized
caagttcaatttaatgtata

SEQ ID NO: 195511 - DNA, 20 bp, Artificial Sequence
  chemically synthesized
tttaatgtatatggaaatca

SEQ ID NO: 195512 - DNA, 20 bp, Artificial Sequence
  chemically synthesized
atggaaatcatagtgcatat

SEQ ID NO: 195513 - DNA, 20 bp, Artificial Sequence
  chemically synthesized
atcagttttgctatttttaa

SEQ ID NO: 195514 - DNA, 20 bp, Artificial Sequence
  chemically synthesized
ttaggaagcacttttaaaaa

SEQ ID NO: 195515 - DNA, 20 bp, Artificial Sequence
  chemically synthesized
tatcagaacttttcattagg

SEQ ID NO: 195516 - DNA, 20 bp, Artificial Sequence
  chemically synthesized
taaaagtgcttcctaatgaa

SEQ ID NO: 195517 - DNA, 20 bp, Artificial Sequence
  chemically synthesized
aaatatcagaacttttcatt

SEQ ID NO: 195518 - DNA, 20 bp, Artificial Sequence
  chemically synthesized
gaaatatcagaacttttcat

SEQ ID NO: 195519 - DNA, 20 bp, Artificial Sequence
  chemically synthesized
aatgaaaagttctgatattt

SEQ ID NO: 195520 - DNA, 20 bp, Artificial Sequence
  chemically synthesized
gtaaatgttttctgaaatat

SEQ ID NO: 195521 - DNA, 20 bp, Artificial Sequence
  chemically synthesized
aaacatttacattcttacat

SEQ ID NO: 195522 - DNA, 20 bp, Artificial Sequence
  chemically synthesized
catttacattcttacataag

SEQ ID NO: 195523 - DNA, 20 bp, Artificial Sequence
  chemically synthesized
tatttaactgcttcttatgt

SEQ ID NO: 195524 - DNA, 20 bp, Artificial Sequence
  chemically synthesized
ttacattcttacataagaag

SEQ ID NO: 195525 - DNA, 20 bp, Artificial Sequence
  chemically synthesized
ttacataagaagcagttaaa

SEQ ID NO: 195526 - DNA, 20 bp, Artificial Sequence
  chemically synthesized
gttaaatagtaaacttccat

SEQ ID NO: 195527 - DNA, 20 bp, Artificial Sequence
  chemically synthesized
aaatagtaaacttccattag

SEQ ID NO: 195528 - DNA, 20 bp, Artificial Sequence
  chemically synthesized
tcttaattaactactaatgg

SEQ ID NO: 195529 - DNA, 20 bp, Artificial Sequence
  chemically synthesized
gcttcttaattaactactaa

SEQ ID NO: 195530 - DNA, 20 bp, Artificial Sequence
  chemically synthesized
acttccattagtagttaatt

SEQ ID NO: 195531 - DNA, 20 bp, Artificial Sequence
  chemically synthesized
tccattagtagttaattaag

SEQ ID NO: 195532 - DNA, 20 bp, Artificial Sequence
  chemically synthesized
atacactaacaaatatagaa

SEQ ID NO: 195533 - DNA, 20 bp, Artificial Sequence
  chemically synthesized
acatacactaacaaatatag

SEQ ID NO: 195534 - DNA, 20 bp, Artificial Sequence
  chemically synthesized
tatcactcttctatatttgt

SEQ ID NO: 195535 - DNA, 20 bp, Artificial Sequence
  chemically synthesized
gttacatacactaacaaata

SEQ ID NO: 195536 - DNA, 20 bp, Artificial Sequence
  chemically synthesized
agtgtatgtaacatgaatca

SEQ ID NO: 195537 - DNA, 20 bp, Artificial Sequence
  chemically synthesized
acatgaatcaaagccacctg

SEQ ID NO: 195538 - DNA, 20 bp, Artificial Sequence
  chemically synthesized
accccatgaattacttcagg

SEQ ID NO: 195539 - DNA, 20 bp, Artificial Sequence
  chemically synthesized
atgaccccatgaattacttc

SEQ ID NO: 195540 - DNA, 20 bp, Artificial Sequence
  chemically synthesized
tatgaccccatgaattactt

SEQ ID NO: 195541 - DNA, 20 bp, Artificial Sequence
  chemically synthesized
aagccacctgaagtaattca

SEQ ID NO: 195542 - DNA, 20 bp, Artificial Sequence
  chemically synthesized
agccacctgaagtaattcat

SEQ ID NO: 195543 - DNA, 20 bp, Artificial Sequence
  chemically synthesized
gccacctgaagtaattcatg

SEQ ID NO: 195544 - DNA, 20 bp, Artificial Sequence
  chemically synthesized
ggggtcataacgtgcacttt

SEQ ID NO: 195545 - DNA, 20 bp, Artificial Sequence
  chemically synthesized
taacatgcatcatacactaa

SEQ ID NO: 195546 - DNA, 20 bp, Artificial Sequence
  chemically synthesized
atttaatttcaattaaaatg

SEQ ID NO: 195547 - DNA, 20 bp, Artificial Sequence
  chemically synthesized
tttcaattaaaatgaagttt

SEQ ID NO: 195548 - DNA, 20 bp, Artificial Sequence
  chemically synthesized
agtttcagttgttcttcaca

SEQ ID NO: 195549 - DNA, 20 bp, Artificial Sequence
  chemically synthesized
gtttcagttgttcttcacac

SEQ ID NO: 195550 - DNA, 20 bp, Artificial Sequence
  chemically synthesized
aagggaaaaaggcctgtgtg

SEQ ID NO: 195551 - DNA, 20 bp, Artificial Sequence
  chemically synthesized
tctgtattattaagggaaaa

SEQ ID NO: 195552 - DNA, 20 bp, Artificial Sequence
  chemically synthesized
atctgtattattaagggaaa

SEQ ID NO: 195553 - DNA, 20 bp, Artificial Sequence
  chemically synthesized
aaatgaatctgtattattaa

SEQ ID NO: 195554 - DNA, 20 bp, Artificial Sequence
  chemically synthesized
gaaatgaatctgtattatta

SEQ ID NO: 195555 - DNA, 20 bp, Artificial Sequence
  chemically synthesized
gcctttttcccttaataata

SEQ ID NO: 195556 - DNA, 20 bp, Artificial Sequence
  chemically synthesized
ggaaatgaatctgtattatt

SEQ ID NO: 195557 - DNA, 20 bp, Artificial Sequence
  chemically synthesized
acatatcacctaaagtatta

SEQ ID NO: 195558 - DNA, 20 bp, Artificial Sequence
  chemically synthesized
gattcatttccataatactt

SEQ ID NO: 195559 - DNA, 20 bp, Artificial Sequence
  chemically synthesized
attcatttccataatacttt

SEQ ID NO: 195560 - DNA, 20 bp, Artificial Sequence
  chemically synthesized
acaatcatacatatcaccta

SEQ ID NO: 195561 - DNA, 20 bp, Artificial Sequence
  chemically synthesized
tatgattgtatgatacataa

SEQ ID NO: 195562 - DNA, 20 bp, Artificial Sequence
  chemically synthesized
atgattgtatgatacataat

SEQ ID NO: 195563 - DNA, 20 bp, Artificial Sequence
  chemically synthesized
tatgatacataataggtttt

SEQ ID NO: 195564 - DNA, 20 bp, Artificial Sequence
  chemically synthesized
cttggattcctggatatgta

SEQ ID NO: 195565 - DNA, 20 bp, Artificial Sequence
  chemically synthesized
ttaatacaactctacatatc

SEQ ID NO: 195566 - DNA, 20 bp, Artificial Sequence
  chemically synthesized
taatacaactctacatatcc

SEQ ID NO: 195567 - DNA, 20 bp, Artificial Sequence
  chemically synthesized
tgcttggattcctggatatg

SEQ ID NO: 195568 - DNA, 20 bp, Artificial Sequence
  chemically synthesized
ctctacatatccaggaatcc

SEQ ID NO: 195569 - DNA, 20 bp, Artificial Sequence
  chemically synthesized
atttccaatgcttggattcc

SEQ ID NO: 195570 - DNA, 20 bp, Artificial Sequence
  chemically synthesized
atatccaggaatccaagcat

SEQ ID NO: 195571 - DNA, 20 bp, Artificial Sequence
  chemically synthesized
aggggtcaatttccaatgct

SEQ ID NO: 195572 - DNA, 20 bp, Artificial Sequence
  chemically synthesized
agcattggaaattgacccct

SEQ ID NO: 195573 - DNA, 20 bp, Artificial Sequence
  chemically synthesized
gcattggaaattgacccctt

SEQ ID NO: 195574 - DNA, 20 bp, Artificial Sequence
  chemically synthesized
tgatttggtcgaggcccaag

SEQ ID NO: 195575 - DNA, 20 bp, Artificial Sequence
  chemically synthesized
ttgatttggtcgaggcccaa

SEQ ID NO: 195576 - DNA, 20 bp, Artificial Sequence
  chemically synthesized
cttgatttggtcgaggccca

SEQ ID NO: 195577 - DNA, 20 bp, Artificial Sequence
  chemically synthesized
acttgatttggtcgaggccc

SEQ ID NO: 195578 - DNA, 20 bp, Artificial Sequence
  chemically synthesized
tcacgtacttgatttggtcg

SEQ ID NO: 195579 - DNA, 20 bp, Artificial Sequence
  chemically synthesized
ctcacgtacttgatttggtc

SEQ ID NO: 195580 - DNA, 20 bp, Artificial Sequence
  chemically synthesized
ccttgggcctcgaccaaatc

SEQ ID NO: 195581 - DNA, 20 bp, Artificial Sequence
  chemically synthesized
tttgtctcacgtacttgatt

SEQ ID NO: 195582 - DNA, 20 bp, Artificial Sequence
  chemically synthesized
ctcgaccaaatcaagtacgt

SEQ ID NO: 195583 - DNA, 20 bp, Artificial Sequence
  chemically synthesized
caagtacgtgagacaaatat

SEQ ID NO: 195584 - DNA, 20 bp, Artificial Sequence
  chemically synthesized
gtgagacaaatatgagcctt

SEQ ID NO: 195585 - DNA, 20 bp, Artificial Sequence
  chemically synthesized
atctactctagttgtaccga

SEQ ID NO: 195586 - DNA, 20 bp, Artificial Sequence
  chemically synthesized
aatctactctagttgtaccg

SEQ ID NO: 195587 - DNA, 20 bp, Artificial Sequence
  chemically synthesized
atatgagccttcggtacaac

SEQ ID NO: 195588 - DNA, 20 bp, Artificial Sequence
  chemically synthesized
atgagccttcggtacaacta

SEQ ID NO: 195589 - DNA, 20 bp, Artificial Sequence
  chemically synthesized
agccttcggtacaactagag

SEQ ID NO: 195590 - DNA, 20 bp, Artificial Sequence
  chemically synthesized
ggaataaaataaatctactc

SEQ ID NO: 195591 - DNA, 20 bp, Artificial Sequence
  chemically synthesized
gctaaagggagcataatggt

SEQ ID NO: 195592 - DNA, 20 bp, Artificial Sequence
  chemically synthesized
gacagctaaagggagcataa

SEQ ID NO: 195593 - DNA, 20 bp, Artificial Sequence
  chemically synthesized
tccaaccattatgctccctt

SEQ ID NO: 195594 - DNA, 20 bp, Artificial Sequence
  chemically synthesized
taatatgtgacagctaaagg

SEQ ID NO: 195595 - DNA, 20 bp, Artificial Sequence
  chemically synthesized
cataatatgtgacagctaaa

SEQ ID NO: 195596 - DNA, 20 bp, Artificial Sequence
  chemically synthesized
tcataatatgtgacagctaa

SEQ ID NO: 195597 - DNA, 20 bp, Artificial Sequence
  chemically synthesized
gtcataatatgtgacagcta

SEQ ID NO: 195598 - DNA, 20 bp, Artificial Sequence
  chemically synthesized
tcccaggtcataatatgtga

SEQ ID NO: 195599 - DNA, 20 bp, Artificial Sequence
  chemically synthesized
agctgtcacatattatgacc

SEQ ID NO: 195600 - DNA, 20 bp, Artificial Sequence
  chemically synthesized
gctgtcacatattatgacct

SEQ ID NO: 195601 - DNA, 20 bp, Artificial Sequence
  chemically synthesized
cacatattatgacctgggaa

SEQ ID NO: 195602 - DNA, 20 bp, Artificial Sequence
  chemically synthesized
agaagttagcaacttttccc

SEQ ID NO: 195603 - DNA, 20 bp, Artificial Sequence
  chemically synthesized
gagaagttagcaacttttcc

SEQ ID NO: 195604 - DNA, 20 bp, Artificial Sequence
  chemically synthesized
aaactgtactatagagaagt

SEQ ID NO: 195605 - DNA, 20 bp, Artificial Sequence
  chemically synthesized
aaaagttgctaacttctcta

SEQ ID NO: 195606 - DNA, 20 bp, Artificial Sequence
  chemically synthesized
gagaaaactgtactatagag

SEQ ID NO: 195607 - DNA, 20 bp, Artificial Sequence
  chemically synthesized
ttgctaacttctctatagta

SEQ ID NO: 195608 - DNA, 20 bp, Artificial Sequence
  chemically synthesized
ggtgagaaaactgtactata

SEQ ID NO: 195609 - DNA, 20 bp, Artificial Sequence
  chemically synthesized
caggtgagaaaactgtacta

SEQ ID NO: 195610 - DNA, 20 bp, Artificial Sequence
  chemically synthesized
gtacagttttctcacctgat

SEQ ID NO: 195611 - DNA, 20 bp, Artificial Sequence
  chemically synthesized
atcctccttgcttatcaggt

SEQ ID NO: 195612 - DNA, 20 bp, Artificial Sequence
  chemically synthesized
agttttctcacctgataagc

SEQ ID NO: 195613 - DNA, 20 bp, Artificial Sequence
  chemically synthesized
agggatcctccttgcttatc

SEQ ID NO: 195614 - DNA, 20 bp, Artificial Sequence
  chemically synthesized
gttttctcacctgataagca

SEQ ID NO: 195615 - DNA, 20 bp, Artificial Sequence
  chemically synthesized
tagggatcctccttgcttat

SEQ ID NO: 195616 - DNA, 20 bp, Artificial Sequence
  chemically synthesized
tttctcacctgataagcaag

SEQ ID NO: 195617 - DNA, 20 bp, Artificial Sequence
  chemically synthesized
ttctcacctgataagcaagg

SEQ ID NO: 195618 - DNA, 20 bp, Artificial Sequence
  chemically synthesized
gctctgggaggtagaaggta

SEQ ID NO: 195619 - DNA, 20 bp, Artificial Sequence
  chemically synthesized
agctctgggaggtagaaggt

SEQ ID NO: 195620 - DNA, 20 bp, Artificial Sequence
  chemically synthesized
cagctctgggaggtagaagg

SEQ ID NO: 195621 - DNA, 20 bp, Artificial Sequence
  chemically synthesized
catcagctctgggaggtaga

SEQ ID NO: 195622 - DNA, 20 bp, Artificial Sequence
  chemically synthesized
acatcagctctgggaggtag

SEQ ID NO: 195623 - DNA, 20 bp, Artificial Sequence
  chemically synthesized
gatccctaccttctacctcc

SEQ ID NO: 195624 - DNA, 20 bp, Artificial Sequence
  chemically synthesized
tccctaccttctacctccca

SEQ ID NO: 195625 - DNA, 20 bp, Artificial Sequence
  chemically synthesized
atcacatcagctctgggagg

SEQ ID NO: 195626 - DNA, 20 bp, Artificial Sequence
  chemically synthesized
ataatcacatcagctctggg

SEQ ID NO: 195627 - DNA, 20 bp, Artificial Sequence
  chemically synthesized
aataatcacatcagctctgg

SEQ ID NO: 195628 - DNA, 20 bp, Artificial Sequence
  chemically synthesized
ttaataatcacatcagctct

SEQ ID NO: 195629 - DNA, 20 bp, Artificial Sequence
  chemically synthesized
tttaataatcacatcagctc

SEQ ID NO: 195630 - DNA, 20 bp, Artificial Sequence
  chemically synthesized
ctggcttttaataatcacat

SEQ ID NO: 195631 - DNA, 20 bp, Artificial Sequence
  chemically synthesized
agagctgatgtgattattaa

SEQ ID NO: 195632 - DNA, 20 bp, Artificial Sequence
  chemically synthesized
ctgatgtgattattaaaagc

SEQ ID NO: 195633 - DNA, 20 bp, Artificial Sequence
  chemically synthesized
tgtgattattaaaagccagt

SEQ ID NO: 195634 - DNA, 20 bp, Artificial Sequence
  chemically synthesized
tactatgtgaagattctaac

SEQ ID NO: 195635 - DNA, 20 bp, Artificial Sequence
  chemically synthesized
agccagttagaatcttcaca

SEQ ID NO: 195636 - DNA, 20 bp, Artificial Sequence
  chemically synthesized
tattgaacacttactatgtg

SEQ ID NO: 195637 - DNA, 20 bp, Artificial Sequence
  chemically synthesized
agttagaatcttcacatagt

SEQ ID NO: 195638 - DNA, 20 bp, Artificial Sequence
  chemically synthesized
ttactagtaatagtaatggc

SEQ ID NO: 195639 - DNA, 20 bp, Artificial Sequence
  chemically synthesized
tgtgttactagtaatagtaa

SEQ ID NO: 195640 - DNA, 20 bp, Artificial Sequence
  chemically synthesized
acacttgccattactattac

SEQ ID NO: 195641 - DNA, 20 bp, Artificial Sequence
  chemically synthesized
tcttcgtgtgttactagtaa

SEQ ID NO: 195642 - DNA, 20 bp, Artificial Sequence
  chemically synthesized
cagggttcttcgtgtgttac

SEQ ID NO: 195643 - DNA, 20 bp, Artificial Sequence
  chemically synthesized
actattactagtaacacacg

SEQ ID NO: 195644 - DNA, 20 bp, Artificial Sequence
  chemically synthesized
taacacacgaagaaccctga

SEQ ID NO: 195645 - DNA, 20 bp, Artificial Sequence
  chemically synthesized
ccttcacttatgttctttca

SEQ ID NO: 195646 - DNA, 20 bp, Artificial Sequence
  chemically synthesized
accttcacttatgttctttc

SEQ ID NO: 195647 - DNA, 20 bp, Artificial Sequence
  chemically synthesized
gaccttcacttatgttcttt

SEQ ID NO: 195648 - DNA, 20 bp, Artificial Sequence
  chemically synthesized
gaagaaccctgaaagaacat

SEQ ID NO: 195649 - DNA, 20 bp, Artificial Sequence
  chemically synthesized
accctgaaagaacataagtg

SEQ ID NO: 195650 - DNA, 20 bp, Artificial Sequence
  chemically synthesized
ccctgaaagaacataagtga

SEQ ID NO: 195651 - DNA, 20 bp, Artificial Sequence
  chemically synthesized
gaaagaacataagtgaaggt

SEQ ID NO: 195652 - DNA, 20 bp, Artificial Sequence
  chemically synthesized
agaacataagtgaaggtcag

SEQ ID NO: 195653 - DNA, 20 bp, Artificial Sequence
  chemically synthesized
ataagtgaaggtcagaagac

SEQ ID NO: 195654 - DNA, 20 bp, Artificial Sequence
  chemically synthesized
taagtgaaggtcagaagaca

SEQ ID NO: 195655 - DNA, 20 bp, Artificial Sequence
  chemically synthesized
gtgaaggtcagaagacaagg

SEQ ID NO: 195656 - DNA, 20 bp, Artificial Sequence
  chemically synthesized
gaaggtcagaagacaaggtg

SEQ ID NO: 195657 - DNA, 20 bp, Artificial Sequence
  chemically synthesized
ttttctaaacattttcataa

SEQ ID NO: 195658 - DNA, 20 bp, Artificial Sequence
  chemically synthesized
gagactattatgaaaatgtt

SEQ ID NO: 195659 - DNA, 20 bp, Artificial Sequence
  chemically synthesized
tattatgaaaatgtttagaa

SEQ ID NO: 195660 - DNA, 20 bp, Artificial Sequence
  chemically synthesized
gaaaatgtttagaaaagttc

SEQ ID NO: 195661 - DNA, 20 bp, Artificial Sequence
  chemically synthesized
atgtttagaaaagttctagt

SEQ ID NO: 195662 - DNA, 20 bp, Artificial Sequence
  chemically synthesized
tgtttagaaaagttctagtt

SEQ ID NO: 195663 - DNA, 20 bp, Artificial Sequence
  chemically synthesized
tagaaaagttctagttgggt

SEQ ID NO: 195664 - DNA, 20 bp, Artificial Sequence
  chemically synthesized
tctttaatctctgacccaac

SEQ ID NO: 195665 - DNA, 20 bp, Artificial Sequence
  chemically synthesized
gaaaagttctagttgggtca

SEQ ID NO: 195666 - DNA, 20 bp, Artificial Sequence
  chemically synthesized
tctagttgggtcagagatta

SEQ ID NO: 195667 - DNA, 20 bp, Artificial Sequence
  chemically synthesized
agattaaagattaaaacgtt

SEQ ID NO: 195668 - DNA, 20 bp, Artificial Sequence
  chemically synthesized
aatttgtcttttaattaagt

SEQ ID NO: 195669 - DNA, 20 bp, Artificial Sequence
  chemically synthesized
aaatttgtcttttaattaag

SEQ ID NO: 195670 - DNA, 20 bp, Artificial Sequence
  chemically synthesized
gtttagacccacttaattaa

SEQ ID NO: 195671 - DNA, 20 bp, Artificial Sequence
  chemically synthesized
ttaaaatttgtcttttaatt

SEQ ID NO: 195672 - DNA, 20 bp, Artificial Sequence
  chemically synthesized
aaagacaaattttaacatat

SEQ ID NO: 195673 - DNA, 20 bp, Artificial Sequence
  chemically synthesized
aattttaacatattagtaat

SEQ ID NO: 195674 - DNA, 20 bp, Artificial Sequence
  chemically synthesized
attagtaataagcctcatat

SEQ ID NO: 195675 - DNA, 20 bp, Artificial Sequence
  chemically synthesized
tgcttagtagtactaatatg

SEQ ID NO: 195676 - DNA, 20 bp, Artificial Sequence
  chemically synthesized
atgcttagtagtactaatat

SEQ ID NO: 195677 - DNA, 20 bp, Artificial Sequence
  chemically synthesized
agcctcatattagtactact

SEQ ID NO: 195678 - DNA, 20 bp, Artificial Sequence
  chemically synthesized
cctattttgagtatgcttag

SEQ ID NO: 195679 - DNA, 20 bp, Artificial Sequence
  chemically synthesized
ttacctattttgagtatgct

SEQ ID NO: 195680 - DNA, 20 bp, Artificial Sequence
  chemically synthesized
actactaagcatactcaaaa

SEQ ID NO: 195681 - DNA, 20 bp, Artificial Sequence
  chemically synthesized
ctactaagcatactcaaaat

SEQ ID NO: 195682 - DNA, 20 bp, Artificial Sequence
  chemically synthesized
tcagtagtcttacctatttt

SEQ ID NO: 195683 - DNA, 20 bp, Artificial Sequence
  chemically synthesized
taagcatactcaaaataggt

SEQ ID NO: 195684 - DNA, 20 bp, Artificial Sequence
  chemically synthesized
caaaataggtaagactactg

SEQ ID NO: 195685 - DNA, 20 bp, Artificial Sequence
  chemically synthesized
aaaataggtaagactactga

SEQ ID NO: 195686 - DNA, 20 bp, Artificial Sequence
  chemically synthesized
tgctttgattttaccttcag

SEQ ID NO: 195687 - DNA, 20 bp, Artificial Sequence
  chemically synthesized
tactgctttgattttacctt

SEQ ID NO: 195688 - DNA, 20 bp, Artificial Sequence
  chemically synthesized
gactactgaaggtaaaatca

SEQ ID NO: 195689 - DNA, 20 bp, Artificial Sequence
  chemically synthesized
tactgaaggtaaaatcaaag

SEQ ID NO: 195690 - DNA, 20 bp, Artificial Sequence
  chemically synthesized
aggtaaaatcaaagcagtac

SEQ ID NO: 195691 - DNA, 20 bp, Artificial Sequence
  chemically synthesized
agaatgtgcctcagatattc

SEQ ID NO: 195692 - DNA, 20 bp, Artificial Sequence
  chemically synthesized
aaagcagtaccagaatatct

SEQ ID NO: 195693 - DNA, 20 bp, Artificial Sequence
  chemically synthesized
aagcagtaccagaatatctg

SEQ ID NO: 195694 - DNA, 20 bp, Artificial Sequence
  chemically synthesized
cgcaaaaggagaatgtgcct

SEQ ID NO: 195695 - DNA, 20 bp, Artificial Sequence
  chemically synthesized
aactaccatcttcgcaaaag

SEQ ID NO: 195696 - DNA, 20 bp, Artificial Sequence
  chemically synthesized
aggcacattctccttttgcg

SEQ ID NO: 195697 - DNA, 20 bp, Artificial Sequence
  chemically synthesized
agaactaccatcttcgcaaa

SEQ ID NO: 195698 - DNA, 20 bp, Artificial Sequence
  chemically synthesized
aagaactaccatcttcgcaa

SEQ ID NO: 195699 - DNA, 20 bp, Artificial Sequence
  chemically synthesized
acattctccttttgcgaaga

SEQ ID NO: 195700 - DNA, 20 bp, Artificial Sequence
  chemically synthesized
ttctccttttgcgaagatgg

SEQ ID NO: 195701 - DNA, 20 bp, Artificial Sequence
  chemically synthesized
aggcaaatcacaagggtgtt

SEQ ID NO: 195702 - DNA, 20 bp, Artificial Sequence
  chemically synthesized
agatcttaggcaaatcacaa

SEQ ID NO: 195703 - DNA, 20 bp, Artificial Sequence
  chemically synthesized
aagatcttaggcaaatcaca

SEQ ID NO: 195704 - DNA, 20 bp, Artificial Sequence
  chemically synthesized
taagatcttaggcaaatcac

SEQ ID NO: 195705 - DNA, 20 bp, Artificial Sequence
  chemically synthesized
aacacccttgtgatttgcct

SEQ ID NO: 195706 - DNA, 20 bp, Artificial Sequence
  chemically synthesized
tgagagtatgttaagatctt

SEQ ID NO: 195707 - DNA, 20 bp, Artificial Sequence
  chemically synthesized
ttgagagtatgttaagatct

SEQ ID NO: 195708 - DNA, 20 bp, Artificial Sequence
  chemically synthesized
aatgtgtttgagagtatgtt

SEQ ID NO: 195709 - DNA, 20 bp, Artificial Sequence
  chemically synthesized
taaaggattaatgtgtttga

SEQ ID NO: 195710 - DNA, 20 bp, Artificial Sequence
  chemically synthesized
attaaaggattaatgtgttt

SEQ ID NO: 195711 - DNA, 20 bp, Artificial Sequence
  chemically synthesized
acacattaatcctttaatcc

SEQ ID NO: 195712 - DNA, 20 bp, Artificial Sequence
  chemically synthesized
aaacactgttctaggattaa

SEQ ID NO: 195713 - DNA, 20 bp, Artificial Sequence
  chemically synthesized
gaaacactgttctaggatta

SEQ ID NO: 195714 - DNA, 20 bp, Artificial Sequence
  chemically synthesized
ttaatcctttaatcctagaa

SEQ ID NO: 195715 - DNA, 20 bp, Artificial Sequence
  chemically synthesized
aggttgagaaacactgttct

SEQ ID NO: 195716 - DNA, 20 bp, Artificial Sequence
  chemically synthesized
aaggttgagaaacactgttc

SEQ ID NO: 195717 - DNA, 20 bp, Artificial Sequence
  chemically synthesized
agaacagtgtttctcaacct

SEQ ID NO: 195718 - DNA, 20 bp, Artificial Sequence
  chemically synthesized
cccagagtgtagctaaggtt

SEQ ID NO: 195719 - DNA, 20 bp, Artificial Sequence
  chemically synthesized
atgatcccagagtgtagcta

SEQ ID NO: 195720 - DNA, 20 bp, Artificial Sequence
  chemically synthesized
aatgatcccagagtgtagct

SEQ ID NO: 195721 - DNA, 20 bp, Artificial Sequence
  chemically synthesized
tctcaaccttagctacactc

SEQ ID NO: 195722 - DNA, 20 bp, Artificial Sequence
  chemically synthesized
ctcaaccttagctacactct

SEQ ID NO: 195723 - DNA, 20 bp, Artificial Sequence
  chemically synthesized
tcttgaatgatcccagagtg

SEQ ID NO: 195724 - DNA, 20 bp, Artificial Sequence
  chemically synthesized
atatttcttgaatgatccca

SEQ ID NO: 195725 - DNA, 20 bp, Artificial Sequence
  chemically synthesized
aaatatttcttgaatgatcc

SEQ ID NO: 195726 - DNA, 20 bp, Artificial Sequence
  chemically synthesized
gctacactctgggatcattc

SEQ ID NO: 195727 - DNA, 20 bp, Artificial Sequence
  chemically synthesized
tattttaaaatactgatgtc

SEQ ID NO: 195728 - DNA, 20 bp, Artificial Sequence
  chemically synthesized
attttaaaatactgatgtct

SEQ ID NO: 195729 - DNA, 20 bp, Artificial Sequence
  chemically synthesized
tggaggcaggacccagacat

SEQ ID NO: 195730 - DNA, 20 bp, Artificial Sequence
  chemically synthesized
gaatctatggaggcaggacc

SEQ ID NO: 195731 - DNA, 20 bp, Artificial Sequence
  chemically synthesized
atgtctgggtcctgcctcca

SEQ ID NO: 195732 - DNA, 20 bp, Artificial Sequence
  chemically synthesized
gaatcagaatctatggaggc

SEQ ID NO: 195733 - DNA, 20 bp, Artificial Sequence
  chemically synthesized
tgaatcagaatctatggagg

SEQ ID NO: 195734 - DNA, 20 bp, Artificial Sequence
  chemically synthesized
aattgaatcagaatctatgg

SEQ ID NO: 195735 - DNA, 20 bp, Artificial Sequence
  chemically synthesized
caattgaatcagaatctatg

SEQ ID NO: 195736 - DNA, 20 bp, Artificial Sequence
  chemically synthesized
accaattgaatcagaatcta

SEQ ID NO: 195737 - DNA, 20 bp, Artificial Sequence
  chemically synthesized
tccatagattctgattcaat

SEQ ID NO: 195738 - DNA, 20 bp, Artificial Sequence
  chemically synthesized
cacatctagaccaattgaat

SEQ ID NO: 195739 - DNA, 20 bp, Artificial Sequence
  chemically synthesized
agattctgattcaattggtc

SEQ ID NO: 195740 - DNA, 20 bp, Artificial Sequence
  chemically synthesized
ttccgggcccagatcacatc

SEQ ID NO: 195741 - DNA, 20 bp, Artificial Sequence
  chemically synthesized
caattggtctagatgtgatc

SEQ ID NO: 195742 - DNA, 20 bp, Artificial Sequence
  chemically synthesized
aattggtctagatgtgatct

SEQ ID NO: 195743 - DNA, 20 bp, Artificial Sequence
  chemically synthesized
gtctagatgtgatctgggcc

SEQ ID NO: 195744 - DNA, 20 bp, Artificial Sequence
  chemically synthesized
cagttgagctattccgggcc

SEQ ID NO: 195745 - DNA, 20 bp, Artificial Sequence
  chemically synthesized
gatgtgatctgggcccggaa

SEQ ID NO: 195746 - DNA, 20 bp, Artificial Sequence
  chemically synthesized
ggagacagttgagctattcc

SEQ ID NO: 195747 - DNA, 20 bp, Artificial Sequence
  chemically synthesized
gggagacagttgagctattc

SEQ ID NO: 195748 - DNA, 20 bp, Artificial Sequence
  chemically synthesized
aatcacctggggagacagtt

SEQ ID NO: 195749 - DNA, 20 bp, Artificial Sequence
  chemically synthesized
gaatagctcaactgtctccc

SEQ ID NO: 195750 - DNA, 20 bp, Artificial Sequence
  chemically synthesized
aatagctcaactgtctcccc

SEQ ID NO: 195751 - DNA, 20 bp, Artificial Sequence
  chemically synthesized
atctgaatcacctggggaga

SEQ ID NO: 195752 - DNA, 20 bp, Artificial Sequence
  chemically synthesized
gcgtatctgaatcacctggg

SEQ ID NO: 195753 - DNA, 20 bp, Artificial Sequence
  chemically synthesized
ttgcgtatctgaatcacctg

SEQ ID NO: 195754 - DNA, 20 bp, Artificial Sequence
  chemically synthesized
attgcgtatctgaatcacct

SEQ ID NO: 195755 - DNA, 20 bp, Artificial Sequence
  chemically synthesized
aactgtctccccaggtgatt

SEQ ID NO: 195756 - DNA, 20 bp, Artificial Sequence
  chemically synthesized
gattgcgtatctgaatcacc

SEQ ID NO: 195757 - DNA, 20 bp, Artificial Sequence
  chemically synthesized
gtgattcagatacgcaatca

SEQ ID NO: 195758 - DNA, 20 bp, Artificial Sequence
  chemically synthesized
tcagatacgcaatcaaagct

SEQ ID NO: 195759 - DNA, 20 bp, Artificial Sequence
  chemically synthesized
tcgatcgaactgttggttct

SEQ ID NO: 195760 - DNA, 20 bp, Artificial Sequence
  chemically synthesized
caatcaaagctgagaaccaa

SEQ ID NO: 195761 - DNA, 20 bp, Artificial Sequence
  chemically synthesized
aaaagcgtcgatcgaactgt

SEQ ID NO: 195762 - DNA, 20 bp, Artificial Sequence
  chemically synthesized
tattcatgtcaaaatttgaa

SEQ ID NO: 195763 - DNA, 20 bp, Artificial Sequence
  chemically synthesized
tttcaaattttgacatgaat

SEQ ID NO: 195764 - DNA, 20 bp, Artificial Sequence
  chemically synthesized
tgacatgaataagaatcact

SEQ ID NO: 195765 - DNA, 20 bp, Artificial Sequence
  chemically synthesized
acatgaataagaatcacttg

SEQ ID NO: 195766 - DNA, 20 bp, Artificial Sequence
  chemically synthesized
tgtgggttaacaaggtctcc

SEQ ID NO: 195767 - DNA, 20 bp, Artificial Sequence
  chemically synthesized
aagaaaactgtgggttaaca

SEQ ID NO: 195768 - DNA, 20 bp, Artificial Sequence
  chemically synthesized
caagaaaactgtgggttaac

SEQ ID NO: 195769 - DNA, 20 bp, Artificial Sequence
  chemically synthesized
ttggagaccttgttaaccca

SEQ ID NO: 195770 - DNA, 20 bp, Artificial Sequence
  chemically synthesized
agtagggccaagaaaactgt

SEQ ID NO: 195771 - DNA, 20 bp, Artificial Sequence
  chemically synthesized
gagtagggccaagaaaactg

SEQ ID NO: 195772 - DNA, 20 bp, Artificial Sequence
  chemically synthesized
ttgttaacccacagttttct

SEQ ID NO: 195773 - DNA, 20 bp, Artificial Sequence
  chemically synthesized
gagtttttgggagtagggcc

SEQ ID NO: 195774 - DNA, 20 bp, Artificial Sequence
  chemically synthesized
aatcagagtttttgggagta

SEQ ID NO: 195775 - DNA, 20 bp, Artificial Sequence
  chemically synthesized
aaatcagagtttttgggagt

SEQ ID NO: 195776 - DNA, 20 bp, Artificial Sequence
  chemically synthesized
taaatcagagtttttgggag

SEQ ID NO: 195777 - DNA, 20 bp, Artificial Sequence
  chemically synthesized
tactaaatcagagtttttgg

SEQ ID NO: 195778 - DNA, 20 bp, Artificial Sequence
  chemically synthesized
cctactaaatcagagttttt

SEQ ID NO: 195779 - DNA, 20 bp, Artificial Sequence
  chemically synthesized
gcctactaaatcagagtttt

SEQ ID NO: 195780 - DNA, 20 bp, Artificial Sequence
  chemically synthesized
tactcccaaaaactctgatt

SEQ ID NO: 195781 - DNA, 20 bp, Artificial Sequence
  chemically synthesized
accccaagcctactaaatca

SEQ ID NO: 195782 - DNA, 20 bp, Artificial Sequence
  chemically synthesized
tcccaaaaactctgatttag

SEQ ID NO: 195783 - DNA, 20 bp, Artificial Sequence
  chemically synthesized
cccaaaaactctgatttagt

SEQ ID NO: 195784 - DNA, 20 bp, Artificial Sequence
  chemically synthesized
ccaccccaagcctactaaat

SEQ ID NO: 195785 - DNA, 20 bp, Artificial Sequence
  chemically synthesized
aaactctgatttagtaggct

SEQ ID NO: 195786 - DNA, 20 bp, Artificial Sequence
  chemically synthesized
aactctgatttagtaggctt

SEQ ID NO: 195787 - DNA, 20 bp, Artificial Sequence
  chemically synthesized
actctgatttagtaggcttg

SEQ ID NO: 195788 - DNA, 20 bp, Artificial Sequence
  chemically synthesized
ctgatttagtaggcttgggg

SEQ ID NO: 195789 - DNA, 20 bp, Artificial Sequence
  chemically synthesized
tgatttagtaggcttggggt

SEQ ID NO: 195790 - DNA, 20 bp, Artificial Sequence
  chemically synthesized
gatttagtaggcttggggtg

SEQ ID NO: 195791 - DNA, 20 bp, Artificial Sequence
  chemically synthesized
gaaagtcttggccccacccc

SEQ ID NO: 195792 - DNA, 20 bp, Artificial Sequence
  chemically synthesized
agtaggcttggggtggggcc

SEQ ID NO: 195793 - DNA, 20 bp, Artificial Sequence
  chemically synthesized
ttgttagaactagaaagtct

SEQ ID NO: 195794 - DNA, 20 bp, Artificial Sequence
  chemically synthesized
ggggtggggccaagactttc

SEQ ID NO: 195795 - DNA, 20 bp, Artificial Sequence
  chemically synthesized
gaaagcttgttagaactaga

SEQ ID NO: 195796 - DNA, 20 bp, Artificial Sequence
  chemically synthesized
acctgaaagcttgttagaac

SEQ ID NO: 195797 - DNA, 20 bp, Artificial Sequence
  chemically synthesized
caagactttctagttctaac

SEQ ID NO: 195798 - DNA, 20 bp, Artificial Sequence
  chemically synthesized
ggcatcacctgaaagcttgt

SEQ ID NO: 195799 - DNA, 20 bp, Artificial Sequence
  chemically synthesized
ttctagttctaacaagcttt

SEQ ID NO: 195800 - DNA, 20 bp, Artificial Sequence
  chemically synthesized
tctagttctaacaagctttc

SEQ ID NO: 195801 - DNA, 20 bp, Artificial Sequence
  chemically synthesized
tcatgctcggcatcacctga

SEQ ID NO: 195802 - DNA, 20 bp, Artificial Sequence
  chemically synthesized
acaagctttcaggtgatgcc

SEQ ID NO: 195803 - DNA, 20 bp, Artificial Sequence
  chemically synthesized
tcaggtgatgccgagcatga

SEQ ID NO: 195804 - DNA, 20 bp, Artificial Sequence
  chemically synthesized
tactcacaggccatcatgct

SEQ ID NO: 195805 - DNA, 20 bp, Artificial Sequence
  chemically synthesized
tgccgagcatgatggcctgt

SEQ ID NO: 195806 - DNA, 20 bp, Artificial Sequence
  chemically synthesized
cgagcatgatggcctgtgag

SEQ ID NO: 195807 - DNA, 20 bp, Artificial Sequence
  chemically synthesized
agtttcagaacgctactcac

SEQ ID NO: 195808 - DNA, 20 bp, Artificial Sequence
  chemically synthesized
aagtttcagaacgctactca

SEQ ID NO: 195809 - DNA, 20 bp, Artificial Sequence
  chemically synthesized
cactccaaatgttcaagttt

SEQ ID NO: 195810 - DNA, 20 bp, Artificial Sequence
  chemically synthesized
cgttctgaaacttgaacatt

SEQ ID NO: 195811 - DNA, 20 bp, Artificial Sequence
  chemically synthesized
ttctgacactccaaatgttc

SEQ ID NO: 195812 - DNA, 20 bp, Artificial Sequence
  chemically synthesized
ttctgaaacttgaacatttg

SEQ ID NO: 195813 - DNA, 20 bp, Artificial Sequence
  chemically synthesized
aacttgaacatttggagtgt

SEQ ID NO: 195814 - DNA, 20 bp, Artificial Sequence
  chemically synthesized
tttggagtgtcagaaccccc

SEQ ID NO: 195815 - DNA, 20 bp, Artificial Sequence
  chemically synthesized
tggagtgtcagaaccccctg

SEQ ID NO: 195816 - DNA, 20 bp, Artificial Sequence
  chemically synthesized
gagtgtcagaaccccctgga

SEQ ID NO: 195817 - DNA, 20 bp, Artificial Sequence
  chemically synthesized
gttgtgaccagctctccagg

SEQ ID NO: 195818 - DNA, 20 bp, Artificial Sequence
  chemically synthesized
tgttgtgaccagctctccag

SEQ ID NO: 195819 - DNA, 20 bp, Artificial Sequence
  chemically synthesized
ttgttgtgaccagctctcca

SEQ ID NO: 195820 - DNA, 20 bp, Artificial Sequence
  chemically synthesized
gtcagaaccccctggagagc

SEQ ID NO: 195821 - DNA, 20 bp, Artificial Sequence
  chemically synthesized
tttgttgtgaccagctctcc

SEQ ID NO: 195822 - DNA, 20 bp, Artificial Sequence
  chemically synthesized
ctttgttgtgaccagctctc

SEQ ID NO: 195823 - DNA, 20 bp, Artificial Sequence
  chemically synthesized
ccggcagtctttgttgtgac

SEQ ID NO: 195824 - DNA, 20 bp, Artificial Sequence
  chemically synthesized
ctggagagctggtcacaaca

SEQ ID NO: 195825 - DNA, 20 bp, Artificial Sequence
  chemically synthesized
ctggtcacaacaaagactgc

SEQ ID NO: 195826 - DNA, 20 bp, Artificial Sequence
  chemically synthesized
tggtcacaacaaagactgcc

SEQ ID NO: 195827 - DNA, 20 bp, Artificial Sequence
  chemically synthesized
ctctagggggtgtagcccgg

SEQ ID NO: 195828 - DNA, 20 bp, Artificial Sequence
  chemically synthesized
aaactctagggggtgtagcc

SEQ ID NO: 195829 - DNA, 20 bp, Artificial Sequence
  chemically synthesized
gactgccgggctacaccccc

SEQ ID NO: 195830 - DNA, 20 bp, Artificial Sequence
  chemically synthesized
cttgaaaactctagggggtg

SEQ ID NO: 195831 - DNA, 20 bp, Artificial Sequence
  chemically synthesized
ctgccgggctacacccccta

SEQ ID NO: 195832 - DNA, 20 bp, Artificial Sequence
  chemically synthesized
tctcacttgaaaactctagg

SEQ ID NO: 195833 - DNA, 20 bp, Artificial Sequence
  chemically synthesized
atctcacttgaaaactctag

SEQ ID NO: 195834 - DNA, 20 bp, Artificial Sequence
  chemically synthesized
gatctcacttgaaaactcta

SEQ ID NO: 195835 - DNA, 20 bp, Artificial Sequence
  chemically synthesized
agatctcacttgaaaactct

SEQ ID NO: 195836 - DNA, 20 bp, Artificial Sequence
  chemically synthesized
cagatctcacttgaaaactc

SEQ ID NO: 195837 - DNA, 20 bp, Artificial Sequence
  chemically synthesized
ctacaccccctagagttttc

SEQ ID NO: 195838 - DNA, 20 bp, Artificial Sequence
  chemically synthesized
accccctagagttttcaagt

SEQ ID NO: 195839 - DNA, 20 bp, Artificial Sequence
  chemically synthesized
tagagttttcaagtgagatc

SEQ ID NO: 195840 - DNA, 20 bp, Artificial Sequence
  chemically synthesized
ttttcaagtgagatctggaa

SEQ ID NO: 195841 - DNA, 20 bp, Artificial Sequence
  chemically synthesized
tttcaagtgagatctggaat

SEQ ID NO: 195842 - DNA, 20 bp, Artificial Sequence
  chemically synthesized
ttcaagtgagatctggaatg

SEQ ID NO: 195843 - DNA, 20 bp, Artificial Sequence
  chemically synthesized
gacctgcatgggccccattc

SEQ ID NO: 195844 - DNA, 20 bp, Artificial Sequence
  chemically synthesized
gatctggaatggggcccatg

SEQ ID NO: 195845 - DNA, 20 bp, Artificial Sequence
  chemically synthesized
atctggaatggggcccatgc

SEQ ID NO: 195846 - DNA, 20 bp, Artificial Sequence
  chemically synthesized
ttgggaacttagacctgcat

SEQ ID NO: 195847 - DNA, 20 bp, Artificial Sequence
  chemically synthesized
cttgggaacttagacctgca

SEQ ID NO: 195848 - DNA, 20 bp, Artificial Sequence
  chemically synthesized
aatggggcccatgcaggtct

SEQ ID NO: 195849 - DNA, 20 bp, Artificial Sequence
  chemically synthesized
ccatgcaggtctaagttccc

SEQ ID NO: 195850 - DNA, 20 bp, Artificial Sequence
  chemically synthesized
gttagcatcacttgggaact

SEQ ID NO: 195851 - DNA, 20 bp, Artificial Sequence
  chemically synthesized
cagcagcgttagcatcactt

SEQ ID NO: 195852 - DNA, 20 bp, Artificial Sequence
  chemically synthesized
tcagcagcgttagcatcact

SEQ ID NO: 195853 - DNA, 20 bp, Artificial Sequence
  chemically synthesized
ggtcccgggatcagcagcgt

SEQ ID NO: 195854 - DNA, 20 bp, Artificial Sequence
  chemically synthesized
gatgctaacgctgctgatcc

SEQ ID NO: 195855 - DNA, 20 bp, Artificial Sequence
  chemically synthesized
aagggaggtcccgggatcag

SEQ ID NO: 195856 - DNA, 20 bp, Artificial Sequence
  chemically synthesized
atgctaacgctgctgatccc

SEQ ID NO: 195857 - DNA, 20 bp, Artificial Sequence
  chemically synthesized
tcaaagggaggtcccgggat

SEQ ID NO: 195858 - DNA, 20 bp, Artificial Sequence
  chemically synthesized
agttctcaaagggaggtccc

SEQ ID NO: 195859 - DNA, 20 bp, Artificial Sequence
  chemically synthesized
tagttctcaaagggaggtcc

SEQ ID NO: 195860 - DNA, 20 bp, Artificial Sequence
  chemically synthesized
tgatcccgggacctcccttt

SEQ ID NO: 195861 - DNA, 20 bp, Artificial Sequence
  chemically synthesized
gagtagtagttctcaaaggg

SEQ ID NO: 195862 - DNA, 20 bp, Artificial Sequence
  chemically synthesized
agagtagtagttctcaaagg

SEQ ID NO: 195863 - DNA, 20 bp, Artificial Sequence
  chemically synthesized
ctagagtagtagttctcaaa

SEQ ID NO: 195864 - DNA, 20 bp, Artificial Sequence
  chemically synthesized
tctagagtagtagttctcaa

SEQ ID NO: 195865 - DNA, 20 bp, Artificial Sequence
  chemically synthesized
atctagagtagtagttctca

SEQ ID NO: 195866 - DNA, 20 bp, Artificial Sequence
  chemically synthesized
ccctttgagaactactactc

SEQ ID NO: 195867 - DNA, 20 bp, Artificial Sequence
  chemically synthesized
gtactttttatctagagtag

SEQ ID NO: 195868 - DNA, 20 bp, Artificial Sequence
  chemically synthesized
taagtactttttatctagag

SEQ ID NO: 195869 - DNA, 20 bp, Artificial Sequence
  chemically synthesized
gagtaagtactttttatcta

SEQ ID NO: 195870 - DNA, 20 bp, Artificial Sequence
  chemically synthesized
gaactactactctagataaa

SEQ ID NO: 195871 - DNA, 20 bp, Artificial Sequence
  chemically synthesized
gagagtaagtactttttatc

SEQ ID NO: 195872 - DNA, 20 bp, Artificial Sequence
  chemically synthesized
taaaaatgcagatggagagt

SEQ ID NO: 195873 - DNA, 20 bp, Artificial Sequence
  chemically synthesized
tttttaaaaatgcagatgga

SEQ ID NO: 195874 - DNA, 20 bp, Artificial Sequence
  chemically synthesized
tgtttttaaaaatgcagatg

SEQ ID NO: 195875 - DNA, 20 bp, Artificial Sequence
  chemically synthesized
gatgtttttaaaaatgcaga

SEQ ID NO: 195876 - DNA, 20 bp, Artificial Sequence
  chemically synthesized
aagtgatgtttttaaaaatg

SEQ ID NO: 195877 - DNA, 20 bp, Artificial Sequence
  chemically synthesized
tgaaagccagtagattatta

SEQ ID NO: 195878 - DNA, 20 bp, Artificial Sequence
  chemically synthesized
acatcactttaataatctac

SEQ ID NO: 195879 - DNA, 20 bp, Artificial Sequence
  chemically synthesized
gaaaatgtcttgaaagccag

SEQ ID NO: 195880 - DNA, 20 bp, Artificial Sequence
  chemically synthesized
ttaataatctactggctttc

SEQ ID NO: 195881 - DNA, 20 bp, Artificial Sequence
  chemically synthesized
ggtgaaaatgtcttgaaagc

SEQ ID NO: 195882 - DNA, 20 bp, Artificial Sequence
  chemically synthesized
tagtggtgaaaatgtcttga

SEQ ID NO: 195883 - DNA, 20 bp, Artificial Sequence
  chemically synthesized
tgctatgataaggtgtttag

SEQ ID NO: 195884 - DNA, 20 bp, Artificial Sequence
  chemically synthesized
agctgctatgataaggtgtt

SEQ ID NO: 195885 - DNA, 20 bp, Artificial Sequence
  chemically synthesized
caccactaaacaccttatca

SEQ ID NO: 195886 - DNA, 20 bp, Artificial Sequence
  chemically synthesized
ccgtggaagctgctatgata

SEQ ID NO: 195887 - DNA, 20 bp, Artificial Sequence
  chemically synthesized
cactaaacaccttatcatag

SEQ ID NO: 195888 - DNA, 20 bp, Artificial Sequence
  chemically synthesized
tccgtggaagctgctatgat

SEQ ID NO: 195889 - DNA, 20 bp, Artificial Sequence
  chemically synthesized
ccttatcatagcagcttcca

SEQ ID NO: 195890 - DNA, 20 bp, Artificial Sequence
  chemically synthesized
aaaggcacagcaatccgtgg

SEQ ID NO: 195891 - DNA, 20 bp, Artificial Sequence
  chemically synthesized
tccaaaggcacagcaatccg

SEQ ID NO: 195892 - DNA, 20 bp, Artificial Sequence
  chemically synthesized
tccacggattgctgtgcctt

SEQ ID NO: 195893 - DNA, 20 bp, Artificial Sequence
  chemically synthesized
gtttctctaatccaaaggca

SEQ ID NO: 195894 - DNA, 20 bp, Artificial Sequence
  chemically synthesized
ggattgctgtgcctttggat

SEQ ID NO: 195895 - DNA, 20 bp, Artificial Sequence
  chemically synthesized
tacttgtttctctaatccaa

SEQ ID NO: 195896 - DNA, 20 bp, Artificial Sequence
  chemically synthesized
attgctgtgcctttggatta

SEQ ID NO: 195897 - DNA, 20 bp, Artificial Sequence
  chemically synthesized
gtacttgtttctctaatcca

SEQ ID NO: 195898 - DNA, 20 bp, Artificial Sequence
  chemically synthesized
tgcctttggattagagaaac

SEQ ID NO: 195899 - DNA, 20 bp, Artificial Sequence
  chemically synthesized
gattagagaaacaagtacat

SEQ ID NO: 195900 - DNA, 20 bp, Artificial Sequence
  chemically synthesized
attagagaaacaagtacata

SEQ ID NO: 195901 - DNA, 20 bp, Artificial Sequence
  chemically synthesized
agaaacaagtacataaggca

SEQ ID NO: 195902 - DNA, 20 bp, Artificial Sequence
  chemically synthesized
gaaacaagtacataaggcaa

SEQ ID NO: 195903 - DNA, 20 bp, Artificial Sequence
  chemically synthesized
tgtgcatccaagtagacagg

SEQ ID NO: 195904 - DNA, 20 bp, Artificial Sequence
  chemically synthesized
gctgtgcatccaagtagaca

SEQ ID NO: 195905 - DNA, 20 bp, Artificial Sequence
  chemically synthesized
atatattctccctgtctact

SEQ ID NO: 195906 - DNA, 20 bp, Artificial Sequence
  chemically synthesized
agctgtgcatccaagtagac

SEQ ID NO: 195907 - DNA, 20 bp, Artificial Sequence
  chemically synthesized
cagctgtgcatccaagtaga

SEQ ID NO: 195908 - DNA, 20 bp, Artificial Sequence
  chemically synthesized
tgggcagctgtgcatccaag

SEQ ID NO: 195909 - DNA, 20 bp, Artificial Sequence
  chemically synthesized
tccctgtctacttggatgca

SEQ ID NO: 195910 - DNA, 20 bp, Artificial Sequence
  chemically synthesized
tgctgggcagctgtgcatcc

SEQ ID NO: 195911 - DNA, 20 bp, Artificial Sequence
  chemically synthesized
tacttggatgcacagctgcc

SEQ ID NO: 195912 - DNA, 20 bp, Artificial Sequence
  chemically synthesized
gatggtttctgggtgctggg

SEQ ID NO: 195913 - DNA, 20 bp, Artificial Sequence
  chemically synthesized
atgcacagctgcccagcacc

SEQ ID NO: 195914 - DNA, 20 bp, Artificial Sequence
  chemically synthesized
tcagatggtttctgggtgct

SEQ ID NO: 195915 - DNA, 20 bp, Artificial Sequence
  chemically synthesized
atcagatggtttctgggtgc

SEQ ID NO: 195916 - DNA, 20 bp, Artificial Sequence
  chemically synthesized
aatggtatcagatggtttct

SEQ ID NO: 195917 - DNA, 20 bp, Artificial Sequence
  chemically synthesized
gaatggtatcagatggtttc

SEQ ID NO: 195918 - DNA, 20 bp, Artificial Sequence
  chemically synthesized
gcttggtgaatggtatcaga

SEQ ID NO: 195919 - DNA, 20 bp, Artificial Sequence
  chemically synthesized
atcagcttggtgaatggtat

SEQ ID NO: 195920 - DNA, 20 bp, Artificial Sequence
  chemically synthesized
accatctgataccattcacc

SEQ ID NO: 195921 - DNA, 20 bp, Artificial Sequence
  chemically synthesized
caatccatcagcttggtgaa

SEQ ID NO: 195922 - DNA, 20 bp, Artificial Sequence
  chemically synthesized
gataccattcaccaagctga

SEQ ID NO: 195923 - DNA, 20 bp, Artificial Sequence
  chemically synthesized
caacacacaatccatcagct

SEQ ID NO: 195924 - DNA, 20 bp, Artificial Sequence
  chemically synthesized
atgaacaacacacaatccat

SEQ ID NO: 195925 - DNA, 20 bp, Artificial Sequence
  chemically synthesized
aagaactattagataaggag

SEQ ID NO: 195926 - DNA, 20 bp, Artificial Sequence
  chemically synthesized
taaaagaactattagataag

SEQ ID NO: 195927 - DNA, 20 bp, Artificial Sequence
  chemically synthesized
tcattctgctccttatctaa

SEQ ID NO: 195928 - DNA, 20 bp, Artificial Sequence
  chemically synthesized
aataaaagaactattagata

SEQ ID NO: 195929 - DNA, 20 bp, Artificial Sequence
  chemically synthesized
aaataaaagaactattagat

SEQ ID NO: 195930 - DNA, 20 bp, Artificial Sequence
  chemically synthesized
tagttaaataaaagaactat

SEQ ID NO: 195931 - DNA, 20 bp, Artificial Sequence
  chemically synthesized
tacagtcattagttaaataa

SEQ ID NO: 195932 - DNA, 20 bp, Artificial Sequence
  chemically synthesized
ctaatgagaattacagtcat

SEQ ID NO: 195933 - DNA, 20 bp, Artificial Sequence
  chemically synthesized
tcagcatctaatgagaatta

SEQ ID NO: 195934 - DNA, 20 bp, Artificial Sequence
  chemically synthesized
ctaatgactgtaattctcat

SEQ ID NO: 195935 - DNA, 20 bp, Artificial Sequence
  chemically synthesized
gtgttctatcagcatctaat

SEQ ID NO: 195936 - DNA, 20 bp, Artificial Sequence
  chemically synthesized
taattctcattagatgctga

SEQ ID NO: 195937 - DNA, 20 bp, Artificial Sequence
  chemically synthesized
aaaaaaacttagtgttctat

SEQ ID NO: 195938 - DNA, 20 bp, Artificial Sequence
  chemically synthesized
ttagatgctgatagaacact

SEQ ID NO: 195939 - DNA, 20 bp, Artificial Sequence
  chemically synthesized
caagttccacaaaaaaaact

SEQ ID NO: 195940 - DNA, 20 bp, Artificial Sequence
  chemically synthesized
agaacactaagttttttttg

SEQ ID NO: 195941 - DNA, 20 bp, Artificial Sequence
  chemically synthesized
taagttttttttgtggaact

SEQ ID NO: 195942 - DNA, 20 bp, Artificial Sequence
  chemically synthesized
ctgccatgagtagttttgcc

SEQ ID NO: 195943 - DNA, 20 bp, Artificial Sequence
  chemically synthesized
gaacttggcaaaactactca

SEQ ID NO: 195944 - DNA, 20 bp, Artificial Sequence
  chemically synthesized
cttggcaaaactactcatgg

SEQ ID NO: 195945 - DNA, 20 bp, Artificial Sequence
  chemically synthesized
aactgatgtcctgccatgag

SEQ ID NO: 195946 - DNA, 20 bp, Artificial Sequence
  chemically synthesized
ttggcaaaactactcatggc

SEQ ID NO: 195947 - DNA, 20 bp, Artificial Sequence
  chemically synthesized
accaactgatgtcctgccat

SEQ ID NO: 195948 - DNA, 20 bp, Artificial Sequence
  chemically synthesized
aactactcatggcaggacat

SEQ ID NO: 195949 - DNA, 20 bp, Artificial Sequence
  chemically synthesized
actcatggcaggacatcagt

SEQ ID NO: 195950 - DNA, 20 bp, Artificial Sequence
  chemically synthesized
atggcaggacatcagttggt

SEQ ID NO: 195951 - DNA, 20 bp, Artificial Sequence
  chemically synthesized
atcagttggtgagcattacc

SEQ ID NO: 195952 - DNA, 20 bp, Artificial Sequence
  chemically synthesized
tcagttggtgagcattacct

SEQ ID NO: 195953 - DNA, 20 bp, Artificial Sequence
  chemically synthesized
gttggtgagcattacctagg

SEQ ID NO: 195954 - DNA, 20 bp, Artificial Sequence
  chemically synthesized
agggttgggtgttgctgcct

SEQ ID NO: 195955 - DNA, 20 bp, Artificial Sequence
  chemically synthesized
gagggttgggtgttgctgcc

SEQ ID NO: 195956 - DNA, 20 bp, Artificial Sequence
  chemically synthesized
ctcaggccagcgggagggtt

SEQ ID NO: 195957 - DNA, 20 bp, Artificial Sequence
  chemically synthesized
gctcaggccagcgggagggt

SEQ ID NO: 195958 - DNA, 20 bp, Artificial Sequence
  chemically synthesized
gcaacacccaaccctcccgc

SEQ ID NO: 195959 - DNA, 20 bp, Artificial Sequence
  chemically synthesized
tgctgctcaggccagcggga

SEQ ID NO: 195960 - DNA, 20 bp, Artificial Sequence
  chemically synthesized
ctgctgctcaggccagcggg

SEQ ID NO: 195961 - DNA, 20 bp, Artificial Sequence
  chemically synthesized
cctgctgctcaggccagcgg

SEQ ID NO: 195962 - DNA, 20 bp, Artificial Sequence
  chemically synthesized
cacctgctgctcaggccagc

SEQ ID NO: 195963 - DNA, 20 bp, Artificial Sequence
  chemically synthesized
cccaaccctcccgctggcct

SEQ ID NO: 195964 - DNA, 20 bp, Artificial Sequence
  chemically synthesized
gcacctgctgctcaggccag

SEQ ID NO: 195965 - DNA, 20 bp, Artificial Sequence
  chemically synthesized
aaccctcccgctggcctgag

SEQ ID NO: 195966 - DNA, 20 bp, Artificial Sequence
  chemically synthesized
ccagcacctgctgctcaggc

SEQ ID NO: 195967 - DNA, 20 bp, Artificial Sequence
  chemically synthesized
cctcccgctggcctgagcag

SEQ ID NO: 195968 - DNA, 20 bp, Artificial Sequence
  chemically synthesized
ctcccgctggcctgagcagc

SEQ ID NO: 195969 - DNA, 20 bp, Artificial Sequence
  chemically synthesized
agcaccagcacctgctgctc

SEQ ID NO: 195970 - DNA, 20 bp, Artificial Sequence
  chemically synthesized
cagcaccagcacctgctgct

SEQ ID NO: 195971 - DNA, 20 bp, Artificial Sequence
  chemically synthesized
ctggcctgagcagcaggtgc

SEQ ID NO: 195972 - DNA, 20 bp, Artificial Sequence
  chemically synthesized
gcagcaggtgctggtgctgt

SEQ ID NO: 195973 - DNA, 20 bp, Artificial Sequence
  chemically synthesized
gtcgacattactaacagcac

SEQ ID NO: 195974 - DNA, 20 bp, Artificial Sequence
  chemically synthesized
ccttatgtcgacattactaa

SEQ ID NO: 195975 - DNA, 20 bp, Artificial Sequence
  chemically synthesized
gctgttagtaatgtcgacat

SEQ ID NO: 195976 - DNA, 20 bp, Artificial Sequence
  chemically synthesized
ctgttagtaatgtcgacata

SEQ ID NO: 195977 - DNA, 20 bp, Artificial Sequence
  chemically synthesized
gttagtaatgtcgacataag

SEQ ID NO: 195978 - DNA, 20 bp, Artificial Sequence
  chemically synthesized
ttagtaatgtcgacataagg

SEQ ID NO: 195979 - DNA, 20 bp, Artificial Sequence
  chemically synthesized
atgtcgacataaggaggcaa

SEQ ID NO: 195980 - DNA, 20 bp, Artificial Sequence
  chemically synthesized
taaggaggcaatggtttctc

SEQ ID NO: 195981 - DNA, 20 bp, Artificial Sequence
  chemically synthesized
ggcaatggtttctctggcca

SEQ ID NO: 195982 - DNA, 20 bp, Artificial Sequence
  chemically synthesized
caacatatcttccatggcca

SEQ ID NO: 195983 - DNA, 20 bp, Artificial Sequence
  chemically synthesized
aatggtttctctggccatgg

SEQ ID NO: 195984 - DNA, 20 bp, Artificial Sequence
  chemically synthesized
cacaacatatcttccatggc

SEQ ID NO: 195985 - DNA, 20 bp, Artificial Sequence
  chemically synthesized
aaatcacaacatatcttcca

SEQ ID NO: 195986 - DNA, 20 bp, Artificial Sequence
  chemically synthesized
gatatgttgtgatttaattc

SEQ ID NO: 195987 - DNA, 20 bp, Artificial Sequence
  chemically synthesized
atttaattcaagaattcctt

SEQ ID NO: 195988 - DNA, 20 bp, Artificial Sequence
  chemically synthesized
attcaagaattccttcagtt

SEQ ID NO: 195989 - DNA, 20 bp, Artificial Sequence
  chemically synthesized
ttaatagacctctaaactga

SEQ ID NO: 195990 - DNA, 20 bp, Artificial Sequence
  chemically synthesized
tcaagaattccttcagttta

SEQ ID NO: 195991 - DNA, 20 bp, Artificial Sequence
  chemically synthesized
tttaatagacctctaaactg

SEQ ID NO: 195992 - DNA, 20 bp, Artificial Sequence
  chemically synthesized
caagaattccttcagtttag

SEQ ID NO: 195993 - DNA, 20 bp, Artificial Sequence
  chemically synthesized
cataacagaaggtcatttaa

SEQ ID NO: 195994 - DNA, 20 bp, Artificial Sequence
  chemically synthesized
actgcagattgcataacaga

SEQ ID NO: 195995 - DNA, 20 bp, Artificial Sequence
  chemically synthesized
gactgcagattgcataacag

SEQ ID NO: 195996 - DNA, 20 bp, Artificial Sequence
  chemically synthesized
catgactgcagattgcataa

SEQ ID NO: 195997 - DNA, 20 bp, Artificial Sequence
  chemically synthesized
accttctgttatgcaatctg

SEQ ID NO: 195998 - DNA, 20 bp, Artificial Sequence
  chemically synthesized
tctttaagatttcatgactg

SEQ ID NO: 195999 - DNA, 20 bp, Artificial Sequence
  chemically synthesized
tctgcagtcatgaaatctta

SEQ ID NO: 196000 - DNA, 20 bp, Artificial Sequence
  chemically synthesized
gcagtcatgaaatcttaaag

SEQ ID NO: 196001 - DNA, 20 bp, Artificial Sequence
  chemically synthesized
agtcatgaaatcttaaagaa

SEQ ID NO: 196002 - DNA, 20 bp, Artificial Sequence
  chemically synthesized
aaaggtgttttctcttcttt

SEQ ID NO: 196003 - DNA, 20 bp, Artificial Sequence
  chemically synthesized
aagagaaaacacctttgttt

SEQ ID NO: 196004 - DNA, 20 bp, Artificial Sequence
  chemically synthesized
tctccattaggctaaaacaa

SEQ ID NO: 196005 - DNA, 20 bp, Artificial Sequence
  chemically synthesized
ttctccattaggctaaaaca

SEQ ID NO: 196006 - DNA, 20 bp, Artificial Sequence
  chemically synthesized
acacctttgttttagcctaa

SEQ ID NO: 196007 - DNA, 20 bp, Artificial Sequence
  chemically synthesized
acctttgttttagcctaatg

SEQ ID NO: 196008 - DNA, 20 bp, Artificial Sequence
  chemically synthesized
ccttgggattgttctccatt

SEQ ID NO: 196009 - DNA, 20 bp, Artificial Sequence
  chemically synthesized
tccttgggattgttctccat

SEQ ID NO: 196010 - DNA, 20 bp, Artificial Sequence
  chemically synthesized
gcctaatggagaacaatccc

SEQ ID NO: 196011 - DNA, 20 bp, Artificial Sequence
  chemically synthesized
cctaatggagaacaatccca

SEQ ID NO: 196012 - DNA, 20 bp, Artificial Sequence
  chemically synthesized
ggagaacaatcccaaggatc

SEQ ID NO: 196013 - DNA, 20 bp, Artificial Sequence
  chemically synthesized
aatagtattcccagatcctt

SEQ ID NO: 196014 - DNA, 20 bp, Artificial Sequence
  chemically synthesized
gagaacaatcccaaggatct

SEQ ID NO: 196015 - DNA, 20 bp, Artificial Sequence
  chemically synthesized
taatagtattcccagatcct

SEQ ID NO: 196016 - DNA, 20 bp, Artificial Sequence
  chemically synthesized
atagagtataatagtattcc

SEQ ID NO: 196017 - DNA, 20 bp, Artificial Sequence
  chemically synthesized
taaggtgaaatagagtataa

SEQ ID NO: 196018 - DNA, 20 bp, Artificial Sequence
  chemically synthesized
gaggacattaaggtgaaata

SEQ ID NO: 196019 - DNA, 20 bp, Artificial Sequence
  chemically synthesized
gcgaggacattaaggtgaaa

SEQ ID NO: 196020 - DNA, 20 bp, Artificial Sequence
  chemically synthesized
caacaagtgcgaggacatta

SEQ ID NO: 196021 - DNA, 20 bp, Artificial Sequence
  chemically synthesized
acaacaagtgcgaggacatt

SEQ ID NO: 196022 - DNA, 20 bp, Artificial Sequence
  chemically synthesized
ctttcagaacaacaagtgcg

SEQ ID NO: 196023 - DNA, 20 bp, Artificial Sequence
  chemically synthesized
gctttcagaacaacaagtgc

SEQ ID NO: 196024 - DNA, 20 bp, Artificial Sequence
  chemically synthesized
ggaggggctttcagaacaac

SEQ ID NO: 196025 - DNA, 20 bp, Artificial Sequence
  chemically synthesized
cctcgcacttgttgttctga

SEQ ID NO: 196026 - DNA, 20 bp, Artificial Sequence
  chemically synthesized
gagggaaagggaggggcttt

SEQ ID NO: 196027 - DNA, 20 bp, Artificial Sequence
  chemically synthesized
gaagcaggagggaaagggag

SEQ ID NO: 196028 - DNA, 20 bp, Artificial Sequence
  chemically synthesized
ggaagcaggagggaaaggga

SEQ ID NO: 196029 - DNA, 20 bp, Artificial Sequence
  chemically synthesized
cggaagcaggagggaaaggg

SEQ ID NO: 196030 - DNA, 20 bp, Artificial Sequence
  chemically synthesized
ccggaagcaggagggaaagg

SEQ ID NO: 196031 - DNA, 20 bp, Artificial Sequence
  chemically synthesized
acccggaagcaggagggaaa

SEQ ID NO: 196032 - DNA, 20 bp, Artificial Sequence
  chemically synthesized
gacccggaagcaggagggaa

SEQ ID NO: 196033 - DNA, 20 bp, Artificial Sequence
  chemically synthesized
tgacccggaagcaggaggga

SEQ ID NO: 196034 - DNA, 20 bp, Artificial Sequence
  chemically synthesized
agggtgacccggaagcagga

SEQ ID NO: 196035 - DNA, 20 bp, Artificial Sequence
  chemically synthesized
aagggtgacccggaagcagg

SEQ ID NO: 196036 - DNA, 20 bp, Artificial Sequence
  chemically synthesized
ctccctttccctcctgcttc

SEQ ID NO: 196037 - DNA, 20 bp, Artificial Sequence
  chemically synthesized
taagggtgacccggaagcag

SEQ ID NO: 196038 - DNA, 20 bp, Artificial Sequence
  chemically synthesized
tccctttccctcctgcttcc

SEQ ID NO: 196039 - DNA, 20 bp, Artificial Sequence
  chemically synthesized
agtaagggtgacccggaagc

SEQ ID NO: 196040 - DNA, 20 bp, Artificial Sequence
  chemically synthesized
gagtaagggtgacccggaag

SEQ ID NO: 196041 - DNA, 20 bp, Artificial Sequence
  chemically synthesized
gatgagtaagggtgacccgg

SEQ ID NO: 196042 - DNA, 20 bp, Artificial Sequence
  chemically synthesized
atagatgagtaagggtgacc

SEQ ID NO: 196043 - DNA, 20 bp, Artificial Sequence
  chemically synthesized
tagatgtgatagatgagtaa

SEQ ID NO: 196044 - DNA, 20 bp, Artificial Sequence
  chemically synthesized
atagatgtgatagatgagta

SEQ ID NO: 196045 - DNA, 20 bp, Artificial Sequence
  chemically synthesized
aatagatgtgatagatgagt

SEQ ID NO: 196046 - DNA, 20 bp, Artificial Sequence
  chemically synthesized
ctaaaatagatgtgatagat

SEQ ID NO: 196047 - DNA, 20 bp, Artificial Sequence
  chemically synthesized
gggtgctaaaatagatgtga

SEQ ID NO: 196048 - DNA, 20 bp, Artificial Sequence
  chemically synthesized
ctcatctatcacatctattt

SEQ ID NO: 196049 - DNA, 20 bp, Artificial Sequence
  chemically synthesized
tcttagtctgggtgctaaaa

SEQ ID NO: 196050 - DNA, 20 bp, Artificial Sequence
  chemically synthesized
atcacatctattttagcacc

SEQ ID NO: 196051 - DNA, 20 bp, Artificial Sequence
  chemically synthesized
tctattttagcacccagact

SEQ ID NO: 196052 - DNA, 20 bp, Artificial Sequence
  chemically synthesized
gggtggtactatcttagtct

SEQ ID NO: 196053 - DNA, 20 bp, Artificial Sequence
  chemically synthesized
cgggtggtactatcttagtc

SEQ ID NO: 196054 - DNA, 20 bp, Artificial Sequence
  chemically synthesized
ttttagcacccagactaaga

SEQ ID NO: 196055 - DNA, 20 bp, Artificial Sequence
  chemically synthesized
tcactcgggtggtactatct

SEQ ID NO: 196056 - DNA, 20 bp, Artificial Sequence
  chemically synthesized
agactaagatagtaccaccc

SEQ ID NO: 196057 - DNA, 20 bp, Artificial Sequence
  chemically synthesized
tgagaaagacttcactcggg

SEQ ID NO: 196058 - DNA, 20 bp, Artificial Sequence
  chemically synthesized
aagatagtaccacccgagtg

SEQ ID NO: 196059 - DNA, 20 bp, Artificial Sequence
  chemically synthesized
atttgagaaagacttcactc

SEQ ID NO: 196060 - DNA, 20 bp, Artificial Sequence
  chemically synthesized
catttgagaaagacttcact

SEQ ID NO: 196061 - DNA, 20 bp, Artificial Sequence
  chemically synthesized
cagagataggacatttgaga

SEQ ID NO: 196062 - DNA, 20 bp, Artificial Sequence
  chemically synthesized
tgaccagagataggacattt

SEQ ID NO: 196063 - DNA, 20 bp, Artificial Sequence
  chemically synthesized
tttctcaaatgtcctatctc

SEQ ID NO: 196064 - DNA, 20 bp, Artificial Sequence
  chemically synthesized
taggcagcatgaccagagat

SEQ ID NO: 196065 - DNA, 20 bp, Artificial Sequence
  chemically synthesized
ctaggcagcatgaccagaga

SEQ ID NO: 196066 - DNA, 20 bp, Artificial Sequence
  chemically synthesized
agaactaggcagcatgacca

SEQ ID NO: 196067 - DNA, 20 bp, Artificial Sequence
  chemically synthesized
caagaactaggcagcatgac

SEQ ID NO: 196068 - DNA, 20 bp, Artificial Sequence
  chemically synthesized
ctatctctggtcatgctgcc

SEQ ID NO: 196069 - DNA, 20 bp, Artificial Sequence
  chemically synthesized
aatgcactccaagaactagg

SEQ ID NO: 196070 - DNA, 20 bp, Artificial Sequence
  chemically synthesized
tggtcatgctgcctagttct

SEQ ID NO: 196071 - DNA, 20 bp, Artificial Sequence
  chemically synthesized
ggaaatgcactccaagaact

SEQ ID NO: 196072 - DNA, 20 bp, Artificial Sequence
  chemically synthesized
gtcatgctgcctagttcttg

SEQ ID NO: 196073 - DNA, 20 bp, Artificial Sequence
  chemically synthesized
cggaaatgcactccaagaac

SEQ ID NO: 196074 - DNA, 20 bp, Artificial Sequence
  chemically synthesized
ccatgacggaaatgcactcc

SEQ ID NO: 196075 - DNA, 20 bp, Artificial Sequence
  chemically synthesized
cttggagtgcatttccgtca

SEQ ID NO: 196076 - DNA, 20 bp, Artificial Sequence
  chemically synthesized
cagtgtaatgagtaccatga

SEQ ID NO: 196077 - DNA, 20 bp, Artificial Sequence
  chemically synthesized
cagttctcatgcagtgtaat

SEQ ID NO: 196078 - DNA, 20 bp, Artificial Sequence
  chemically synthesized
tggtactcattacactgcat

SEQ ID NO: 196079 - DNA, 20 bp, Artificial Sequence
  chemically synthesized
ggataatcccagttctcatg

SEQ ID NO: 196080 - DNA, 20 bp, Artificial Sequence
  chemically synthesized
tcattacactgcatgagaac

SEQ ID NO: 196081 - DNA, 20 bp, Artificial Sequence
  chemically synthesized
cattacactgcatgagaact

SEQ ID NO: 196082 - DNA, 20 bp, Artificial Sequence
  chemically synthesized
ggaggtgagtaggataatcc

SEQ ID NO: 196083 - DNA, 20 bp, Artificial Sequence
  chemically synthesized
tgctttgtggggaggtgagt

SEQ ID NO: 196084 - DNA, 20 bp, Artificial Sequence
  chemically synthesized
gtgctttgtggggaggtgag

SEQ ID NO: 196085 - DNA, 20 bp, Artificial Sequence
  chemically synthesized
cttgtgctttgtggggaggt

SEQ ID NO: 196086 - DNA, 20 bp, Artificial Sequence
  chemically synthesized
atcctactcacctccccaca

SEQ ID NO: 196087 - DNA, 20 bp, Artificial Sequence
  chemically synthesized
tgtgcttgtgctttgtgggg

SEQ ID NO: 196088 - DNA, 20 bp, Artificial Sequence
  chemically synthesized
atgtgcttgtgctttgtggg

SEQ ID NO: 196089 - DNA, 20 bp, Artificial Sequence
  chemically synthesized
ctatgtgcttgtgctttgtg

SEQ ID NO: 196090 - DNA, 20 bp, Artificial Sequence
  chemically synthesized
cctatgtgcttgtgctttgt

SEQ ID NO: 196091 - DNA, 20 bp, Artificial Sequence
  chemically synthesized
tcctatgtgcttgtgctttg

SEQ ID NO: 196092 - DNA, 20 bp, Artificial Sequence
  chemically synthesized
ctcacctccccacaaagcac

SEQ ID NO: 196093 - DNA, 20 bp, Artificial Sequence
  chemically synthesized
ccccacaaagcacaagcaca

SEQ ID NO: 196094 - DNA, 20 bp, Artificial Sequence
  chemically synthesized
cccacaaagcacaagcacat

SEQ ID NO: 196095 - DNA, 20 bp, Artificial Sequence
  chemically synthesized
caaagcacaagcacatagga

SEQ ID NO: 196096 - DNA, 20 bp, Artificial Sequence
  chemically synthesized
aagcacaagcacataggaca

SEQ ID NO: 196097 - DNA, 20 bp, Artificial Sequence
  chemically synthesized
agcacaagcacataggacag

SEQ ID NO: 196098 - DNA, 20 bp, Artificial Sequence
  chemically synthesized
acaagcacataggacagagg

SEQ ID NO: 196099 - DNA, 20 bp, Artificial Sequence
  chemically synthesized
cataggacagaggcggtatc

SEQ ID NO: 196100 - DNA, 20 bp, Artificial Sequence
  chemically synthesized
ctggagagaaaaagatgtgc

SEQ ID NO: 196101 - DNA, 20 bp, Artificial Sequence
  chemically synthesized
taggaagtgctggagagaaa

SEQ ID NO: 196102 - DNA, 20 bp, Artificial Sequence
  chemically synthesized
ctagcacatctttttctctc

SEQ ID NO: 196103 - DNA, 20 bp, Artificial Sequence
  chemically synthesized
cactgctaggaagtgctgga

SEQ ID NO: 196104 - DNA, 20 bp, Artificial Sequence
  chemically synthesized
ggcactgctaggaagtgctg

SEQ ID NO: 196105 - DNA, 20 bp, Artificial Sequence
  chemically synthesized
caggcactgctaggaagtgc

SEQ ID NO: 196106 - DNA, 20 bp, Artificial Sequence
  chemically synthesized
tttttctctccagcacttcc

SEQ ID NO: 196107 - DNA, 20 bp, Artificial Sequence
  chemically synthesized
ttctctccagcacttcctag

SEQ ID NO: 196108 - DNA, 20 bp, Artificial Sequence
  chemically synthesized
ctgtgccaggcactgctagg

SEQ ID NO: 196109 - DNA, 20 bp, Artificial Sequence
  chemically synthesized
tctctgtgccaggcactgct

SEQ ID NO: 196110 - DNA, 20 bp, Artificial Sequence
  chemically synthesized
ttctctgtgccaggcactgc

SEQ ID NO: 196111 - DNA, 20 bp, Artificial Sequence
  chemically synthesized
cagcacttcctagcagtgcc

SEQ ID NO: 196112 - DNA, 20 bp, Artificial Sequence
  chemically synthesized
cttcctagcagtgcctggca

SEQ ID NO: 196113 - DNA, 20 bp, Artificial Sequence
  chemically synthesized
tcctagcagtgcctggcaca

SEQ ID NO: 196114 - DNA, 20 bp, Artificial Sequence
  chemically synthesized
gtatgtaccttctctgtgcc

SEQ ID NO: 196115 - DNA, 20 bp, Artificial Sequence
  chemically synthesized
cgtatgtaccttctctgtgc

SEQ ID NO: 196116 - DNA, 20 bp, Artificial Sequence
  chemically synthesized
tagcagtgcctggcacagag

SEQ ID NO: 196117 - DNA, 20 bp, Artificial Sequence
  chemically synthesized
agcagtgcctggcacagaga

SEQ ID NO: 196118 - DNA, 20 bp, Artificial Sequence
  chemically synthesized
acatacgtaacatcttccac

SEQ ID NO: 196119 - DNA, 20 bp, Artificial Sequence
  chemically synthesized
tacgtaacatcttccacaag

SEQ ID NO: 196120 - DNA, 20 bp, Artificial Sequence
  chemically synthesized
cttcaaagaacttcttgtgg

SEQ ID NO: 196121 - DNA, 20 bp, Artificial Sequence
  chemically synthesized
gtgcttcaaagaacttcttg

SEQ ID NO: 196122 - DNA, 20 bp, Artificial Sequence
  chemically synthesized
cttccacaagaagttctttg

SEQ ID NO: 196123 - DNA, 20 bp, Artificial Sequence
  chemically synthesized
atggtgggattggtgcttca

SEQ ID NO: 196124 - DNA, 20 bp, Artificial Sequence
  chemically synthesized
agtatagcagatggtgggat

SEQ ID NO: 196125 - DNA, 20 bp, Artificial Sequence
  chemically synthesized
tagcaagtatagcagatggt

SEQ ID NO: 196126 - DNA, 20 bp, Artificial Sequence
  chemically synthesized
ctagcaagtatagcagatgg

SEQ ID NO: 196127 - DNA, 20 bp, Artificial Sequence
  chemically synthesized
acactagcaagtatagcaga

SEQ ID NO: 196128 - DNA, 20 bp, Artificial Sequence
  chemically synthesized
ggaaacactagcaagtatag

SEQ ID NO: 196129 - DNA, 20 bp, Artificial Sequence
  chemically synthesized
ccaccatctgctatacttgc

SEQ ID NO: 196130 - DNA, 20 bp, Artificial Sequence
  chemically synthesized
cttggaaacactagcaagta

SEQ ID NO: 196131 - DNA, 20 bp, Artificial Sequence
  chemically synthesized
agtatcttggaaacactagc

SEQ ID NO: 196132 - DNA, 20 bp, Artificial Sequence
  chemically synthesized
cagaagtatcttggaaacac

SEQ ID NO: 196133 - DNA, 20 bp, Artificial Sequence
  chemically synthesized
ctatacttgctagtgtttcc

SEQ ID NO: 196134 - DNA, 20 bp, Artificial Sequence
  chemically synthesized
cgagggatccagaagtatct

SEQ ID NO: 196135 - DNA, 20 bp, Artificial Sequence
  chemically synthesized
tagtgtttccaagatacttc

SEQ ID NO: 196136 - DNA, 20 bp, Artificial Sequence
  chemically synthesized
agaaataccgagggatccag

SEQ ID NO: 196137 - DNA, 20 bp, Artificial Sequence
  chemically synthesized
caagatacttctggatccct

SEQ ID NO: 196138 - DNA, 20 bp, Artificial Sequence
  chemically synthesized
ggaagaaataccgagggatc

SEQ ID NO: 196139 - DNA, 20 bp, Artificial Sequence
  chemically synthesized
acatttggaagaaataccga

SEQ ID NO: 196140 - DNA, 20 bp, Artificial Sequence
  chemically synthesized
tacatttggaagaaataccg

SEQ ID NO: 196141 - DNA, 20 bp, Artificial Sequence
  chemically synthesized
ctacatttggaagaaatacc

SEQ ID NO: 196142 - DNA, 20 bp, Artificial Sequence
  chemically synthesized
ctcggtatttcttccaaatg

SEQ ID NO: 196143 - DNA, 20 bp, Artificial Sequence
  chemically synthesized
ggcataaacactacatttgg

SEQ ID NO: 196144 - DNA, 20 bp, Artificial Sequence
  chemically synthesized
aaaggcataaacactacatt

SEQ ID NO: 196145 - DNA, 20 bp, Artificial Sequence
  chemically synthesized
aaatgatcactgatgatcaa

SEQ ID NO: 196146 - DNA, 20 bp, Artificial Sequence
  chemically synthesized
gtgtttatgcctttgatcat

SEQ ID NO: 196147 - DNA, 20 bp, Artificial Sequence
  chemically synthesized
gaaatgatcactgatgatca

SEQ ID NO: 196148 - DNA, 20 bp, Artificial Sequence
  chemically synthesized
atcatcagtgatcatttcac

SEQ ID NO: 196149 - DNA, 20 bp, Artificial Sequence
  chemically synthesized
catttcacaagtgtgtgtgc

SEQ ID NO: 196150 - DNA, 20 bp, Artificial Sequence
  chemically synthesized
atggtgcttatggtcagggc

SEQ ID NO: 196151 - DNA, 20 bp, Artificial Sequence
  chemically synthesized
tgtgtgctagccctgaccat

SEQ ID NO: 196152 - DNA, 20 bp, Artificial Sequence
  chemically synthesized
tctcatggtgcttatggtca

SEQ ID NO: 196153 - DNA, 20 bp, Artificial Sequence
  chemically synthesized
ttctcatggtgcttatggtc

SEQ ID NO: 196154 - DNA, 20 bp, Artificial Sequence
  chemically synthesized
attctcatggtgcttatggt

SEQ ID NO: 196155 - DNA, 20 bp, Artificial Sequence
  chemically synthesized
atagattctcatggtgctta

SEQ ID NO: 196156 - DNA, 20 bp, Artificial Sequence
  chemically synthesized
gccctgaccataagcaccat

SEQ ID NO: 196157 - DNA, 20 bp, Artificial Sequence
  chemically synthesized
gtgaacacaatagattctca

SEQ ID NO: 196158 - DNA, 20 bp, Artificial Sequence
  chemically synthesized
tgataaaactgtgaacacaa

SEQ ID NO: 196159 - DNA, 20 bp, Artificial Sequence
  chemically synthesized
atgagaatctattgtgttca

SEQ ID NO: 196160 - DNA, 20 bp, Artificial Sequence
  chemically synthesized
tgtgttcacagttttatcat

SEQ ID NO: 196161 - DNA, 20 bp, Artificial Sequence
  chemically synthesized
agttttatcatcagcatttt

SEQ ID NO: 196162 - DNA, 20 bp, Artificial Sequence
  chemically synthesized
atcagcatttttagaatata

SEQ ID NO: 196163 - DNA, 20 bp, Artificial Sequence
  chemically synthesized
ttagaatatatggcacttgc

SEQ ID NO: 196164 - DNA, 20 bp, Artificial Sequence
  chemically synthesized
gatatttactgagaacttgc

SEQ ID NO: 196165 - DNA, 20 bp, Artificial Sequence
  chemically synthesized
atatggcacttgcaagttct

SEQ ID NO: 196166 - DNA, 20 bp, Artificial Sequence
  chemically synthesized
tcatcaggcagatatttact

SEQ ID NO: 196167 - DNA, 20 bp, Artificial Sequence
  chemically synthesized
aacttatttgtttcatcagg

SEQ ID NO: 196168 - DNA, 20 bp, Artificial Sequence
  chemically synthesized
agaaacttatttgtttcatc

SEQ ID NO: 196169 - DNA, 20 bp, Artificial Sequence
  chemically synthesized
cagaaacttatttgtttcat

SEQ ID NO: 196170 - DNA, 20 bp, Artificial Sequence
  chemically synthesized
atctgcctgatgaaacaaat

SEQ ID NO: 196171 - DNA, 20 bp, Artificial Sequence
  chemically synthesized
acaaataagtttctgtaaaa

SEQ ID NO: 196172 - DNA, 20 bp, Artificial Sequence
  chemically synthesized
caaataagtttctgtaaaat

SEQ ID NO: 196173 - DNA, 20 bp, Artificial Sequence
  chemically synthesized
gtgtttaacagcccatttta

SEQ ID NO: 196174 - DNA, 20 bp, Artificial Sequence
  chemically synthesized
gtaaaatgggctgttaaaca

SEQ ID NO: 196175 - DNA, 20 bp, Artificial Sequence
  chemically synthesized
aacttttcatctgtgtttaa

SEQ ID NO: 196176 - DNA, 20 bp, Artificial Sequence
  chemically synthesized
ggctgttaaacacagatgaa

SEQ ID NO: 196177 - DNA, 20 bp, Artificial Sequence
  chemically synthesized
tgaaaagtttttaaaaacat

SEQ ID NO: 196178 - DNA, 20 bp, Artificial Sequence
  chemically synthesized
gaaaagtttttaaaaacatc

SEQ ID NO: 196179 - DNA, 20 bp, Artificial Sequence
  chemically synthesized
aaaagtttttaaaaacatca

SEQ ID NO: 196180 - DNA, 20 bp, Artificial Sequence
  chemically synthesized
ttttaaaaacatcagggctt

SEQ ID NO: 196181 - DNA, 20 bp, Artificial Sequence
  chemically synthesized
aaaacatcagggcttcagtt

SEQ ID NO: 196182 - DNA, 20 bp, Artificial Sequence
  chemically synthesized
cccaaatatttacttaactg

SEQ ID NO: 196183 - DNA, 20 bp, Artificial Sequence
  chemically synthesized
gcttcagttaagtaaatatt

SEQ ID NO: 196184 - DNA, 20 bp, Artificial Sequence
  chemically synthesized
cttcagttaagtaaatattt

SEQ ID NO: 196185 - DNA, 20 bp, Artificial Sequence
  chemically synthesized
gttaagtaaatatttgggat

SEQ ID NO: 196186 - DNA, 20 bp, Artificial Sequence
  chemically synthesized
aagtaaatatttgggataag

SEQ ID NO: 196187 - DNA, 20 bp, Artificial Sequence
  chemically synthesized
gcactcgacgttagtattta

SEQ ID NO: 196188 - DNA, 20 bp, Artificial Sequence
  chemically synthesized
aagctgtaaatactaacgtc

SEQ ID NO: 196189 - DNA, 20 bp, Artificial Sequence
  chemically synthesized
atatttgttgcactcgacgt

SEQ ID NO: 196190 - DNA, 20 bp, Artificial Sequence
  chemically synthesized
tgcaacaaatatgtcaacac

SEQ ID NO: 196191 - DNA, 20 bp, Artificial Sequence
  chemically synthesized
aacaaatatgtcaacacaag

SEQ ID NO: 196192 - DNA, 20 bp, Artificial Sequence
  chemically synthesized
tgtcaacacaagaagtcatt

SEQ ID NO: 196193 - DNA, 20 bp, Artificial Sequence
  chemically synthesized
caacacaagaagtcattgag

SEQ ID NO: 196194 - DNA, 20 bp, Artificial Sequence
  chemically synthesized
cacaagaagtcattgagtag

SEQ ID NO: 196195 - DNA, 20 bp, Artificial Sequence
  chemically synthesized
agtattgtcataaaatgtgt

SEQ ID NO: 196196 - DNA, 20 bp, Artificial Sequence
  chemically synthesized
gtattgtcataaaatgtgtt

SEQ ID NO: 196197 - DNA, 20 bp, Artificial Sequence
  chemically synthesized
attgtcataaaatgtgttgg

SEQ ID NO: 196198 - DNA, 20 bp, Artificial Sequence
  chemically synthesized
gcattttatgggagcataaa

SEQ ID NO: 196199 - DNA, 20 bp, Artificial Sequence
  chemically synthesized
gctccccaagcattttatgg

SEQ ID NO: 196200 - DNA, 20 bp, Artificial Sequence
  chemically synthesized
ttgctccccaagcattttat

SEQ ID NO: 196201 - DNA, 20 bp, Artificial Sequence
  chemically synthesized
attgctccccaagcatttta

SEQ ID NO: 196202 - DNA, 20 bp, Artificial Sequence
  chemically synthesized
ttatgctcccataaaatgct

SEQ ID NO: 196203 - DNA, 20 bp, Artificial Sequence
  chemically synthesized
tatgctcccataaaatgctt

SEQ ID NO: 196204 - DNA, 20 bp, Artificial Sequence
  chemically synthesized
atgctcccataaaatgcttg

SEQ ID NO: 196205 - DNA, 20 bp, Artificial Sequence
  chemically synthesized
gctcccataaaatgcttggg

SEQ ID NO: 196206 - DNA, 20 bp, Artificial Sequence
  chemically synthesized
atgcaaaaggattgctcccc

SEQ ID NO: 196207 - DNA, 20 bp, Artificial Sequence
  chemically synthesized
aaatggtctctaaatgcaaa

SEQ ID NO: 196208 - DNA, 20 bp, Artificial Sequence
  chemically synthesized
gggagcaatccttttgcatt

SEQ ID NO: 196209 - DNA, 20 bp, Artificial Sequence
  chemically synthesized
taaatggtctctaaatgcaa

SEQ ID NO: 196210 - DNA, 20 bp, Artificial Sequence
  chemically synthesized
gagcaatccttttgcattta

SEQ ID NO: 196211 - DNA, 20 bp, Artificial Sequence
  chemically synthesized
ttttgcatttagagaccatt

SEQ ID NO: 196212 - DNA, 20 bp, Artificial Sequence
  chemically synthesized
tttccaaaagaaatactaaa

SEQ ID NO: 196213 - DNA, 20 bp, Artificial Sequence
  chemically synthesized
agaccatttagtatttcttt

SEQ ID NO: 196214 - DNA, 20 bp, Artificial Sequence
  chemically synthesized
tttagtatttcttttggaaa

SEQ ID NO: 196215 - DNA, 20 bp, Artificial Sequence
  chemically synthesized
tcaaacaaagccgtttccaa

SEQ ID NO: 196216 - DNA, 20 bp, Artificial Sequence
  chemically synthesized
atggaatgggaattcaaaca

SEQ ID NO: 196217 - DNA, 20 bp, Artificial Sequence
  chemically synthesized
aagaagcccgtaaatggaat

SEQ ID NO: 196218 - DNA, 20 bp, Artificial Sequence
  chemically synthesized
gaagaagcccgtaaatggaa

SEQ ID NO: 196219 - DNA, 20 bp, Artificial Sequence
  chemically synthesized
ttgaattcccattccattta

SEQ ID NO: 196220 - DNA, 20 bp, Artificial Sequence
  chemically synthesized
tgaattcccattccatttac

SEQ ID NO: 196221 - DNA, 20 bp, Artificial Sequence
  chemically synthesized
ctttggaagaagcccgtaaa

SEQ ID NO: 196222 - DNA, 20 bp, Artificial Sequence
  chemically synthesized
ccatttacgggcttcttcca

SEQ ID NO: 196223 - DNA, 20 bp, Artificial Sequence
  chemically synthesized
gagaagaaattctttggaag

SEQ ID NO: 196224 - DNA, 20 bp, Artificial Sequence
  chemically synthesized
tctgagaagaaattctttgg

SEQ ID NO: 196225 - DNA, 20 bp, Artificial Sequence
  chemically synthesized
atatctgagaagaaattctt

SEQ ID NO: 196226 - DNA, 20 bp, Artificial Sequence
  chemically synthesized
tcttccaaagaatttcttct

SEQ ID NO: 196227 - DNA, 20 bp, Artificial Sequence
  chemically synthesized
agattccagacatatctgag

SEQ ID NO: 196228 - DNA, 20 bp, Artificial Sequence
  chemically synthesized
aggagattccagacatatct

SEQ ID NO: 196229 - DNA, 20 bp, Artificial Sequence
  chemically synthesized
aatttcttctcagatatgtc

SEQ ID NO: 196230 - DNA, 20 bp, Artificial Sequence
  chemically synthesized
aaaaggtaaaaaggagattc

SEQ ID NO: 196231 - DNA, 20 bp, Artificial Sequence
  chemically synthesized
accaatcaaaaggtaaaaag

SEQ ID NO: 196232 - DNA, 20 bp, Artificial Sequence
  chemically synthesized
taaccaatcaaaaggtaaaa

SEQ ID NO: 196233 - DNA, 20 bp, Artificial Sequence
  chemically synthesized
ataaccaatcaaaaggtaaa

SEQ ID NO: 196234 - DNA, 20 bp, Artificial Sequence
  chemically synthesized
tctcctttttaccttttgat

SEQ ID NO: 196235 - DNA, 20 bp, Artificial Sequence
  chemically synthesized
ccaaacaataaccaatcaaa

SEQ ID NO: 196236 - DNA, 20 bp, Artificial Sequence
  chemically synthesized
cccaaacaataaccaatcaa

SEQ ID NO: 196237 - DNA, 20 bp, Artificial Sequence
  chemically synthesized
ccttttgattggttattgtt

SEQ ID NO: 196238 - DNA, 20 bp, Artificial Sequence
  chemically synthesized
cttttgattggttattgttt

SEQ ID NO: 196239 - DNA, 20 bp, Artificial Sequence
  chemically synthesized
atcagttgctagttgacaat

SEQ ID NO: 196240 - DNA, 20 bp, Artificial Sequence
  chemically synthesized
ggcaaacactcattgtcaac

SEQ ID NO: 196241 - DNA, 20 bp, Artificial Sequence
  chemically synthesized
tccctttacttatcagttgc

SEQ ID NO: 196242 - DNA, 20 bp, Artificial Sequence
  chemically synthesized
attgtcaactagcaactgat

SEQ ID NO: 196243 - DNA, 20 bp, Artificial Sequence
  chemically synthesized
caactagcaactgataagta

SEQ ID NO: 196244 - DNA, 20 bp, Artificial Sequence
  chemically synthesized
gtatttttccctttacttat

SEQ ID NO: 196245 - DNA, 20 bp, Artificial Sequence
  chemically synthesized
aactagcaactgataagtaa

SEQ ID NO: 196246 - DNA, 20 bp, Artificial Sequence
  chemically synthesized
actagcaactgataagtaaa

SEQ ID NO: 196247 - DNA, 20 bp, Artificial Sequence
  chemically synthesized
aaagggaaaaatacaattac

SEQ ID NO: 196248 - DNA, 20 bp, Artificial Sequence
  chemically synthesized
cttcaaaattattgaaaaac

SEQ ID NO: 196249 - DNA, 20 bp, Artificial Sequence
  chemically synthesized
ccagtttttcaataattttg

SEQ ID NO: 196250 - DNA, 20 bp, Artificial Sequence
  chemically synthesized
caataattttgaagcatcaa

SEQ ID NO: 196251 - DNA, 20 bp, Artificial Sequence
  chemically synthesized
ttttgaagcatcaatagaaa

SEQ ID NO: 196252 - DNA, 20 bp, Artificial Sequence
  chemically synthesized
aatatcacattgccttcaaa

SEQ ID NO: 196253 - DNA, 20 bp, Artificial Sequence
  chemically synthesized
atatcacattgccttcaaaa

SEQ ID NO: 196254 - DNA, 20 bp, Artificial Sequence
  chemically synthesized
tatcacattgccttcaaaaa

SEQ ID NO: 196255 - DNA, 20 bp, Artificial Sequence
  chemically synthesized
ttaccttggcccctttttga

SEQ ID NO: 196256 - DNA, 20 bp, Artificial Sequence
  chemically synthesized
atcacattgccttcaaaaag

SEQ ID NO: 196257 - DNA, 20 bp, Artificial Sequence
  chemically synthesized
cttaccttggcccctttttg

SEQ ID NO: 196258 - DNA, 20 bp, Artificial Sequence
  chemically synthesized
attgccttcaaaaaggggcc

SEQ ID NO: 196259 - DNA, 20 bp, Artificial Sequence
  chemically synthesized
ttgccttcaaaaaggggcca

SEQ ID NO: 196260 - DNA, 20 bp, Artificial Sequence
  chemically synthesized
cttcaaaaaggggccaaggt

SEQ ID NO: 196261 - DNA, 20 bp, Artificial Sequence
  chemically synthesized
ttcaaaaaggggccaaggta

SEQ ID NO: 196262 - DNA, 20 bp, Artificial Sequence
  chemically synthesized
tcaaaaaggggccaaggtaa

SEQ ID NO: 196263 - DNA, 20 bp, Artificial Sequence
  chemically synthesized
ctcttttatctcccttacct

SEQ ID NO: 196264 - DNA, 20 bp, Artificial Sequence
  chemically synthesized
aaaaaggggccaaggtaagg

SEQ ID NO: 196265 - DNA, 20 bp, Artificial Sequence
  chemically synthesized
ggccaaggtaagggagataa

SEQ ID NO: 196266 - DNA, 20 bp, Artificial Sequence
  chemically synthesized
ccaaggtaagggagataaaa

SEQ ID NO: 196267 - DNA, 20 bp, Artificial Sequence
  chemically synthesized
caaggtaagggagataaaag

SEQ ID NO: 196268 - DNA, 20 bp, Artificial Sequence
  chemically synthesized
agggagataaaagaggcaaa

SEQ ID NO: 196269 - DNA, 20 bp, Artificial Sequence
  chemically synthesized
gggagataaaagaggcaaat

SEQ ID NO: 196270 - DNA, 20 bp, Artificial Sequence
  chemically synthesized
gagataaaagaggcaaatgg

SEQ ID NO: 196271 - DNA, 20 bp, Artificial Sequence
  chemically synthesized
aaaagaggcaaatgggagtt

SEQ ID NO: 196272 - DNA, 20 bp, Artificial Sequence
  chemically synthesized
agaggcaaatgggagtttgg

SEQ ID NO: 196273 - DNA, 20 bp, Artificial Sequence
  chemically synthesized
gagtttggaagctctgctca

SEQ ID NO: 196274 - DNA, 20 bp, Artificial Sequence
  chemically synthesized
cattcataatactttgagca

SEQ ID NO: 196275 - DNA, 20 bp, Artificial Sequence
  chemically synthesized
aacattcataatactttgag

SEQ ID NO: 196276 - DNA, 20 bp, Artificial Sequence
  chemically synthesized
taaaacattcataatacttt

SEQ ID NO: 196277 - DNA, 20 bp, Artificial Sequence
  chemically synthesized
gaatgttttacaatgtattt

SEQ ID NO: 196278 - DNA, 20 bp, Artificial Sequence
  chemically synthesized
aatgttttacaatgtatttc

SEQ ID NO: 196279 - DNA, 20 bp, Artificial Sequence
  chemically synthesized
tatttcaggtcaacaaacat

SEQ ID NO: 196280 - DNA, 20 bp, Artificial Sequence
  chemically synthesized
ggcatcgtcgttgcattttt

SEQ ID NO: 196281 - DNA, 20 bp, Artificial Sequence
  chemically synthesized
cgtcgttgcatttttcagaa

SEQ ID NO: 196282 - DNA, 20 bp, Artificial Sequence
  chemically synthesized
catttttcagaaaagaatgt

SEQ ID NO: 196283 - DNA, 20 bp, Artificial Sequence
  chemically synthesized
tttcagaaaagaatgtaagc

SEQ ID NO: 196284 - DNA, 20 bp, Artificial Sequence
  chemically synthesized
ttcagaaaagaatgtaagct

SEQ ID NO: 196285 - DNA, 20 bp, Artificial Sequence
  chemically synthesized
aagaatgtaagctgggaaaa

SEQ ID NO: 196286 - DNA, 20 bp, Artificial Sequence
  chemically synthesized
ttgcctctaaacttttttcc

SEQ ID NO: 196287 - DNA, 20 bp, Artificial Sequence
  chemically synthesized
tgtaagctgggaaaaaagtt

SEQ ID NO: 196288 - DNA, 20 bp, Artificial Sequence
  chemically synthesized
taagctgggaaaaaagttta

SEQ ID NO: 196289 - DNA, 20 bp, Artificial Sequence
  chemically synthesized
aagctgggaaaaaagtttag

SEQ ID NO: 196290 - DNA, 20 bp, Artificial Sequence
  chemically synthesized
aaaaagtttagaggcaaatt

SEQ ID NO: 196291 - DNA, 20 bp, Artificial Sequence
  chemically synthesized
ttagaggcaaattaagactt

SEQ ID NO: 196292 - DNA, 20 bp, Artificial Sequence
  chemically synthesized
agaggcaaattaagacttga

SEQ ID NO: 196293 - DNA, 20 bp, Artificial Sequence
  chemically synthesized
gcaaattaagacttgagaga

SEQ ID NO: 196294 - DNA, 20 bp, Artificial Sequence
  chemically synthesized
tccacttagaactgtctctc

SEQ ID NO: 196295 - DNA, 20 bp, Artificial Sequence
  chemically synthesized
aagacttgagagacagttct

SEQ ID NO: 196296 - DNA, 20 bp, Artificial Sequence
  chemically synthesized
acttgagagacagttctaag

SEQ ID NO: 196297 - DNA, 20 bp, Artificial Sequence
  chemically synthesized
ccatcccccttatttccact

SEQ ID NO: 196298 - DNA, 20 bp, Artificial Sequence
  chemically synthesized
agacagttctaagtggaaat

SEQ ID NO: 196299 - DNA, 20 bp, Artificial Sequence
  chemically synthesized
gacagttctaagtggaaata

SEQ ID NO: 196300 - DNA, 20 bp, Artificial Sequence
  chemically synthesized
acagttctaagtggaaataa

SEQ ID NO: 196301 - DNA, 20 bp, Artificial Sequence
  chemically synthesized
cagttctaagtggaaataag

SEQ ID NO: 196302 - DNA, 20 bp, Artificial Sequence
  chemically synthesized
agttctaagtggaaataagg

SEQ ID NO: 196303 - DNA, 20 bp, Artificial Sequence
  chemically synthesized
ctaagtggaaataaggggga

SEQ ID NO: 196304 - DNA, 20 bp, Artificial Sequence
  chemically synthesized
taagtggaaataagggggat

SEQ ID NO: 196305 - DNA, 20 bp, Artificial Sequence
  chemically synthesized
ggaaataagggggatgggaa

SEQ ID NO: 196306 - DNA, 20 bp, Artificial Sequence
  chemically synthesized
atcaatgatgtttcaataca

SEQ ID NO: 196307 - DNA, 20 bp, Artificial Sequence
  chemically synthesized
aatcaatgatgtttcaatac

SEQ ID NO: 196308 - DNA, 20 bp, Artificial Sequence
  chemically synthesized
aaatcaatgatgtttcaata

SEQ ID NO: 196309 - DNA, 20 bp, Artificial Sequence
  chemically synthesized
gtgtaggtttatgggtgaga

SEQ ID NO: 196310 - DNA, 20 bp, Artificial Sequence
  chemically synthesized
agtgtaggtttatgggtgag

SEQ ID NO: 196311 - DNA, 20 bp, Artificial Sequence
  chemically synthesized
cagagtgtaggtttatgggt

SEQ ID NO: 196312 - DNA, 20 bp, Artificial Sequence
  chemically synthesized
ttagcagagtgtaggtttat

SEQ ID NO: 196313 - DNA, 20 bp, Artificial Sequence
  chemically synthesized
tttagcagagtgtaggttta

SEQ ID NO: 196314 - DNA, 20 bp, Artificial Sequence
  chemically synthesized
aacacattttagcagagtgt

SEQ ID NO: 196315 - DNA, 20 bp, Artificial Sequence
  chemically synthesized
taacacattttagcagagtg

SEQ ID NO: 196316 - DNA, 20 bp, Artificial Sequence
  chemically synthesized
gcagttaacacattttagca

SEQ ID NO: 196317 - DNA, 20 bp, Artificial Sequence
  chemically synthesized
ctgcagttaacacattttag

SEQ ID NO: 196318 - DNA, 20 bp, Artificial Sequence
  chemically synthesized
ttgctgcagttaacacattt

SEQ ID NO: 196319 - DNA, 20 bp, Artificial Sequence
  chemically synthesized
ctgctaaaatgtgttaactg

SEQ ID NO: 196320 - DNA, 20 bp, Artificial Sequence
  chemically synthesized
ccgagttaatcattttgctg

SEQ ID NO: 196321 - DNA, 20 bp, Artificial Sequence
  chemically synthesized
ctgcagcaaaatgattaact

SEQ ID NO: 196322 - DNA, 20 bp, Artificial Sequence
  chemically synthesized
agcaaaatgattaactcggt

SEQ ID NO: 196323 - DNA, 20 bp, Artificial Sequence
  chemically synthesized
tcccacatgctagactcacc

SEQ ID NO: 196324 - DNA, 20 bp, Artificial Sequence
  chemically synthesized
aatgattaactcggtgagtc

SEQ ID NO: 196325 - DNA, 20 bp, Artificial Sequence
  chemically synthesized
aactcggtgagtctagcatg

SEQ ID NO: 196326 - DNA, 20 bp, Artificial Sequence
  chemically synthesized
actcggtgagtctagcatgt

SEQ ID NO: 196327 - DNA, 20 bp, Artificial Sequence
  chemically synthesized
gtcatttacttcccacatgc

SEQ ID NO: 196328 - DNA, 20 bp, Artificial Sequence
  chemically synthesized
cggtgagtctagcatgtggg

SEQ ID NO: 196329 - DNA, 20 bp, Artificial Sequence
  chemically synthesized
aagtaaatgacatatgtaac

SEQ ID NO: 196330 - DNA, 20 bp, Artificial Sequence
  chemically synthesized
agtaaatgacatatgtaacg

SEQ ID NO: 196331 - DNA, 20 bp, Artificial Sequence
  chemically synthesized
tgacatatgtaacgaggaac

SEQ ID NO: 196332 - DNA, 20 bp, Artificial Sequence
  chemically synthesized
tatgtaacgaggaactggcc

SEQ ID NO: 196333 - DNA, 20 bp, Artificial Sequence
  chemically synthesized
tgtaacgaggaactggcctg

SEQ ID NO: 196334 - DNA, 20 bp, Artificial Sequence
  chemically synthesized
gtaacgaggaactggcctgg

SEQ ID NO: 196335 - DNA, 20 bp, Artificial Sequence
  chemically synthesized
ttctggcgctacctccaggc

SEQ ID NO: 196336 - DNA, 20 bp, Artificial Sequence
  chemically synthesized
acgaggaactggcctggagg

SEQ ID NO: 196337 - DNA, 20 bp, Artificial Sequence
  chemically synthesized
atacttctggcgctacctcc

SEQ ID NO: 196338 - DNA, 20 bp, Artificial Sequence
  chemically synthesized
tatacttctggcgctacctc

SEQ ID NO: 196339 - DNA, 20 bp, Artificial Sequence
  chemically synthesized
aactggcctggaggtagcgc

SEQ ID NO: 196340 - DNA, 20 bp, Artificial Sequence
  chemically synthesized
tggcctggaggtagcgccag

SEQ ID NO: 196341 - DNA, 20 bp, Artificial Sequence
  chemically synthesized
tgccatcttggatatacttc

SEQ ID NO: 196342 - DNA, 20 bp, Artificial Sequence
  chemically synthesized
gtagcgccagaagtatatcc

SEQ ID NO: 196343 - DNA, 20 bp, Artificial Sequence
  chemically synthesized
cgccagaagtatatccaaga

SEQ ID NO: 196344 - DNA, 20 bp, Artificial Sequence
  chemically synthesized
agaagtatatccaagatggc

SEQ ID NO: 196345 - DNA, 20 bp, Artificial Sequence
  chemically synthesized
cttgcttcatcttgccatct

SEQ ID NO: 196346 - DNA, 20 bp, Artificial Sequence
  chemically synthesized
atatccaagatggcaagatg

SEQ ID NO: 196347 - DNA, 20 bp, Artificial Sequence
  chemically synthesized
ccaagatggcaagatgaagc

SEQ ID NO: 196348 - DNA, 20 bp, Artificial Sequence
  chemically synthesized
aagatggcaagatgaagcaa

SEQ ID NO: 196349 - DNA, 20 bp, Artificial Sequence
  chemically synthesized
gcaagagtacaacaacttcc

SEQ ID NO: 196350 - DNA, 20 bp, Artificial Sequence
  chemically synthesized
agtacaacaacttcctggtg

SEQ ID NO: 196351 - DNA, 20 bp, Artificial Sequence
  chemically synthesized
ctgaaaggcactacaccagg

SEQ ID NO: 196352 - DNA, 20 bp, Artificial Sequence
  chemically synthesized
tttctgaaaggcactacacc

SEQ ID NO: 196353 - DNA, 20 bp, Artificial Sequence
  chemically synthesized
ttttctgaaaggcactacac

SEQ ID NO: 196354 - DNA, 20 bp, Artificial Sequence
  chemically synthesized
cttcctggtgtagtgccttt

SEQ ID NO: 196355 - DNA, 20 bp, Artificial Sequence
  chemically synthesized
acagagggagattttctgaa

SEQ ID NO: 196356 - DNA, 20 bp, Artificial Sequence
  chemically synthesized
aacagagggagattttctga

SEQ ID NO: 196357 - DNA, 20 bp, Artificial Sequence
  chemically synthesized
catgtgcaacaaaacagagg

SEQ ID NO: 196358 - DNA, 20 bp, Artificial Sequence
  chemically synthesized
gtcatgtgcaacaaaacaga

SEQ ID NO: 196359 - DNA, 20 bp, Artificial Sequence
  chemically synthesized
agtcatgtgcaacaaaacag

SEQ ID NO: 196360 - DNA, 20 bp, Artificial Sequence
  chemically synthesized
aagtcatgtgcaacaaaaca

SEQ ID NO: 196361 - DNA, 20 bp, Artificial Sequence
  chemically synthesized
agaagtcatgtgcaacaaaa

SEQ ID NO: 196362 - DNA, 20 bp, Artificial Sequence
  chemically synthesized
atgagttgagtaagataaag

SEQ ID NO: 196363 - DNA, 20 bp, Artificial Sequence
  chemically synthesized
acaatgagttgagtaagata

SEQ ID NO: 196364 - DNA, 20 bp, Artificial Sequence
  chemically synthesized
tattacacaatgagttgagt

SEQ ID NO: 196365 - DNA, 20 bp, Artificial Sequence
  chemically synthesized
accttattacacaatgagtt

SEQ ID NO: 196366 - DNA, 20 bp, Artificial Sequence
  chemically synthesized
cttctaccttattacacaat

SEQ ID NO: 196367 - DNA, 20 bp, Artificial Sequence
  chemically synthesized
tactcaactcattgtgtaat

SEQ ID NO: 196368 - DNA, 20 bp, Artificial Sequence
  chemically synthesized
actcaactcattgtgtaata

SEQ ID NO: 196369 - DNA, 20 bp, Artificial Sequence
  chemically synthesized
caactcattgtgtaataagg

SEQ ID NO: 196370 - DNA, 20 bp, Artificial Sequence
  chemically synthesized
ctcattgtgtaataaggtag

SEQ ID NO: 196371 - DNA, 20 bp, Artificial Sequence
  chemically synthesized
attgtgtaataaggtagaag

SEQ ID NO: 196372 - DNA, 20 bp, Artificial Sequence
  chemically synthesized
tgtaataaggtagaagtaga

SEQ ID NO: 196373 - DNA, 20 bp, Artificial Sequence
  chemically synthesized
tcactttccaataattttga

SEQ ID NO: 196374 - DNA, 20 bp, Artificial Sequence
  chemically synthesized
gtcactttccaataattttg

SEQ ID NO: 196375 - DNA, 20 bp, Artificial Sequence
  chemically synthesized
agaacatccttcaaaattat

SEQ ID NO: 196376 - DNA, 20 bp, Artificial Sequence
  chemically synthesized
catccttcaaaattattgga

SEQ ID NO: 196377 - DNA, 20 bp, Artificial Sequence
  chemically synthesized
tcaaaattattggaaagtga

SEQ ID NO: 196378 - DNA, 20 bp, Artificial Sequence
  chemically synthesized
tggaaagtgacagaatgttt

SEQ ID NO: 196379 - DNA, 20 bp, Artificial Sequence
  chemically synthesized
aaagtgacagaatgtttgag

SEQ ID NO: 196380 - DNA, 20 bp, Artificial Sequence
  chemically synthesized
tgacagaatgtttgagtgga

SEQ ID NO: 196381 - DNA, 20 bp, Artificial Sequence
  chemically synthesized
aacattttcaacagtttgca

SEQ ID NO: 196382 - DNA, 20 bp, Artificial Sequence
  chemically synthesized
tgaggatgaaacattttcaa

SEQ ID NO: 196383 - DNA, 20 bp, Artificial Sequence
  chemically synthesized
agaaatgtcatttggtattg

SEQ ID NO: 196384 - DNA, 20 bp, Artificial Sequence
  chemically synthesized
cagaaatgtcatttggtatt

SEQ ID NO: 196385 - DNA, 20 bp, Artificial Sequence
  chemically synthesized
atgctagcagaaatgtcatt

SEQ ID NO: 196386 - DNA, 20 bp, Artificial Sequence
  chemically synthesized
ataccaaatgacatttctgc

SEQ ID NO: 196387 - DNA, 20 bp, Artificial Sequence
  chemically synthesized
aaagcatggcattatgctag

SEQ ID NO: 196388 - DNA, 20 bp, Artificial Sequence
  chemically synthesized
aaaaaagcatggcattatgc

SEQ ID NO: 196389 - DNA, 20 bp, Artificial Sequence
  chemically synthesized
ttagaagggggaaaaaagca

SEQ ID NO: 196390 - DNA, 20 bp, Artificial Sequence
  chemically synthesized
tagtattagaagggggaaaa

SEQ ID NO: 196391 - DNA, 20 bp, Artificial Sequence
  chemically synthesized
tattgtatagtattagaagg

SEQ ID NO: 196392 - DNA, 20 bp, Artificial Sequence
  chemically synthesized
atattgtatagtattagaag

SEQ ID NO: 196393 - DNA, 20 bp, Artificial Sequence
  chemically synthesized
aatattgtatagtattagaa

SEQ ID NO: 196394 - DNA, 20 bp, Artificial Sequence
  chemically synthesized
taatattgtatagtattaga

SEQ ID NO: 196395 - DNA, 20 bp, Artificial Sequence
  chemically synthesized
ctaatattgtatagtattag

SEQ ID NO: 196396 - DNA, 20 bp, Artificial Sequence
  chemically synthesized
aatctaatattgtatagtat

SEQ ID NO: 196397 - DNA, 20 bp, Artificial Sequence
  chemically synthesized
atgcaaaatctaatattgta

SEQ ID NO: 196398 - DNA, 20 bp, Artificial Sequence
  chemically synthesized
cttctaatactatacaatat

SEQ ID NO: 196399 - DNA, 20 bp, Artificial Sequence
  chemically synthesized
atacaatattagattttgca

SEQ ID NO: 196400 - DNA, 20 bp, Artificial Sequence
  chemically synthesized
aattgtcaaatggatgcatg

SEQ ID NO: 196401 - DNA, 20 bp, Artificial Sequence
  chemically synthesized
taaattgtcaaatggatgca

SEQ ID NO: 196402 - DNA, 20 bp, Artificial Sequence
  chemically synthesized
gtactcgataaattgtcaaa

SEQ ID NO: 196403 - DNA, 20 bp, Artificial Sequence
  chemically synthesized
catccatttgacaatttatc

SEQ ID NO: 196404 - DNA, 20 bp, Artificial Sequence
  chemically synthesized
atttatcgagtacctgtttc

SEQ ID NO: 196405 - DNA, 20 bp, Artificial Sequence
  chemically synthesized
cagtacatagcacttgaaac

SEQ ID NO: 196406 - DNA, 20 bp, Artificial Sequence
  chemically synthesized
tcagtacatagcacttgaaa

SEQ ID NO: 196407 - DNA, 20 bp, Artificial Sequence
  chemically synthesized
tgtttcaagtgctatgtact

SEQ ID NO: 196408 - DNA, 20 bp, Artificial Sequence
  chemically synthesized
gtgggcgcattctcagtaca

SEQ ID NO: 196409 - DNA, 20 bp, Artificial Sequence
  chemically synthesized
catgttcgtgggcgcattct

SEQ ID NO: 196410 - DNA, 20 bp, Artificial Sequence
  chemically synthesized
atattatctgtcatgttcgt

SEQ ID NO: 196411 - DNA, 20 bp, Artificial Sequence
  chemically synthesized
tatattatctgtcatgttcg

SEQ ID NO: 196412 - DNA, 20 bp, Artificial Sequence
  chemically synthesized
gaatgcgcccacgaacatga

SEQ ID NO: 196413 - DNA, 20 bp, Artificial Sequence
  chemically synthesized
actggactgtaaattatgtg

SEQ ID NO: 196414 - DNA, 20 bp, Artificial Sequence
  chemically synthesized
atatatctgcacataattta

SEQ ID NO: 196415 - DNA, 20 bp, Artificial Sequence
  chemically synthesized
tctgcacataatttacagtc

SEQ ID NO: 196416 - DNA, 20 bp, Artificial Sequence
  chemically synthesized
cacataatttacagtccagt

SEQ ID NO: 196417 - DNA, 20 bp, Artificial Sequence
  chemically synthesized
agctaagctgtaattcttac

SEQ ID NO: 196418 - DNA, 20 bp, Artificial Sequence
  chemically synthesized
ttacagtccagtaagaatta

SEQ ID NO: 196419 - DNA, 20 bp, Artificial Sequence
  chemically synthesized
gtccagtaagaattacagct

SEQ ID NO: 196420 - DNA, 20 bp, Artificial Sequence
  chemically synthesized
gagtaagacaggaagaagct

SEQ ID NO: 196421 - DNA, 20 bp, Artificial Sequence
  chemically synthesized
atctggagtaagacaggaag

SEQ ID NO: 196422 - DNA, 20 bp, Artificial Sequence
  chemically synthesized
tttatctggagtaagacagg

SEQ ID NO: 196423 - DNA, 20 bp, Artificial Sequence
  chemically synthesized
gtctttatctggagtaagac

SEQ ID NO: 196424 - DNA, 20 bp, Artificial Sequence
  chemically synthesized
ggtctttatctggagtaaga

SEQ ID NO: 196425 - DNA, 20 bp, Artificial Sequence
  chemically synthesized
agcttcttcctgtcttactc

SEQ ID NO: 196426 - DNA, 20 bp, Artificial Sequence
  chemically synthesized
aaagggtctttatctggagt

SEQ ID NO: 196427 - DNA, 20 bp, Artificial Sequence
  chemically synthesized
ttcctgtcttactccagata

SEQ ID NO: 196428 - DNA, 20 bp, Artificial Sequence
  chemically synthesized
gggaaaagggtctttatctg

SEQ ID NO: 196429 - DNA, 20 bp, Artificial Sequence
  chemically synthesized
gagggaaaagggtctttatc

SEQ ID NO: 196430 - DNA, 20 bp, Artificial Sequence
  chemically synthesized
gagggtggaatgagggaaaa

SEQ ID NO: 196431 - DNA, 20 bp, Artificial Sequence
  chemically synthesized
agagggtggaatgagggaaa

SEQ ID NO: 196432 - DNA, 20 bp, Artificial Sequence
  chemically synthesized
gagagggtggaatgagggaa

SEQ ID NO: 196433 - DNA, 20 bp, Artificial Sequence
  chemically synthesized
accttgagagggtggaatga

SEQ ID NO: 196434 - DNA, 20 bp, Artificial Sequence
  chemically synthesized
caccttgagagggtggaatg

SEQ ID NO: 196435 - DNA, 20 bp, Artificial Sequence
  chemically synthesized
gcaccttgagagggtggaat

SEQ ID NO: 196436 - DNA, 20 bp, Artificial Sequence
  chemically synthesized
ttccctcattccaccctctc

SEQ ID NO: 196437 - DNA, 20 bp, Artificial Sequence
  chemically synthesized
agttatgcaccttgagaggg

SEQ ID NO: 196438 - DNA, 20 bp, Artificial Sequence
  chemically synthesized
tccctcattccaccctctca

SEQ ID NO: 196439 - DNA, 20 bp, Artificial Sequence
  chemically synthesized
ttaagttatgcaccttgaga

SEQ ID NO: 196440 - DNA, 20 bp, Artificial Sequence
  chemically synthesized
attaagttatgcaccttgag

SEQ ID NO: 196441 - DNA, 20 bp, Artificial Sequence
  chemically synthesized
tattaagttatgcaccttga

SEQ ID NO: 196442 - DNA, 20 bp, Artificial Sequence
  chemically synthesized
cttattaagttatgcacctt

SEQ ID NO: 196443 - DNA, 20 bp, Artificial Sequence
  chemically synthesized
ctcaaggtgcataacttaat

SEQ ID NO: 196444 - DNA, 20 bp, Artificial Sequence
  chemically synthesized
aggtgcataacttaataagt

SEQ ID NO: 196445 - DNA, 20 bp, Artificial Sequence
  chemically synthesized
attaagcatgctgacttatt

SEQ ID NO: 196446 - DNA, 20 bp, Artificial Sequence
  chemically synthesized
caattagatcgaacagtatt

SEQ ID NO: 196447 - DNA, 20 bp, Artificial Sequence
  chemically synthesized
ctcaagacaattagatcgaa

SEQ ID NO: 196448 - DNA, 20 bp, Artificial Sequence
  chemically synthesized
aatgacattctcaagacaat

SEQ ID NO: 196449 - DNA, 20 bp, Artificial Sequence
  chemically synthesized
ctgttcgatctaattgtctt

SEQ ID NO: 196450 - DNA, 20 bp, Artificial Sequence
  chemically synthesized
gggaagaaaatgacattctc

SEQ ID NO: 196451 - DNA, 20 bp, Artificial Sequence
  chemically synthesized
tttgaaaaaggtgggatggg

SEQ ID NO: 196452 - DNA, 20 bp, Artificial Sequence
  chemically synthesized
acttttgaaaaaggtgggat

SEQ ID NO: 196453 - DNA, 20 bp, Artificial Sequence
  chemically synthesized
tacttttgaaaaaggtggga

SEQ ID NO: 196454 - DNA, 20 bp, Artificial Sequence
  chemically synthesized
taaatacttttgaaaaaggt

SEQ ID NO: 196455 - DNA, 20 bp, Artificial Sequence
  chemically synthesized
ttaaatacttttgaaaaagg

SEQ ID NO: 196456 - DNA, 20 bp, Artificial Sequence
  chemically synthesized
tcccatcccacctttttcaa

SEQ ID NO: 196457 - DNA, 20 bp, Artificial Sequence
  chemically synthesized
tcattaaatacttttgaaaa

SEQ ID NO: 196458 - DNA, 20 bp, Artificial Sequence
  chemically synthesized
gtcattaaatacttttgaaa

SEQ ID NO: 196459 - DNA, 20 bp, Artificial Sequence
  chemically synthesized
gtgaacctctgtgcaaaaag

SEQ ID NO: 196460 - DNA, 20 bp, Artificial Sequence
  chemically synthesized
tttaatgactcctttttgca

SEQ ID NO: 196461 - DNA, 20 bp, Artificial Sequence
  chemically synthesized
atgtgaacctctgtgcaaaa

SEQ ID NO: 196462 - DNA, 20 bp, Artificial Sequence
  chemically synthesized
aatgtgaacctctgtgcaaa

SEQ ID NO: 196463 - DNA, 20 bp, Artificial Sequence
  chemically synthesized
taatgactcctttttgcaca

SEQ ID NO: 196464 - DNA, 20 bp, Artificial Sequence
  chemically synthesized
aatgactcctttttgcacag

SEQ ID NO: 196465 - DNA, 20 bp, Artificial Sequence
  chemically synthesized
ttgcacagaggttcacattc

SEQ ID NO: 196466 - DNA, 20 bp, Artificial Sequence
  chemically synthesized
aggttcacattcaagctcct

SEQ ID NO: 196467 - DNA, 20 bp, Artificial Sequence
  chemically synthesized
ggttcacattcaagctcctc

SEQ ID NO: 196468 - DNA, 20 bp, Artificial Sequence
  chemically synthesized
ggatgagttgttagcctgag

SEQ ID NO: 196469 - DNA, 20 bp, Artificial Sequence
  chemically synthesized
tgggatgagttgttagcctg

SEQ ID NO: 196470 - DNA, 20 bp, Artificial Sequence
  chemically synthesized
gtgggatgagttgttagcct

SEQ ID NO: 196471 - DNA, 20 bp, Artificial Sequence
  chemically synthesized
tttacagtgggatgagttgt

SEQ ID NO: 196472 - DNA, 20 bp, Artificial Sequence
  chemically synthesized
atacaaatttacagtgggat

SEQ ID NO: 196473 - DNA, 20 bp, Artificial Sequence
  chemically synthesized
gattaatacaaatttacagt

SEQ ID NO: 196474 - DNA, 20 bp, Artificial Sequence
  chemically synthesized
tgattaatacaaatttacag

SEQ ID NO: 196475 - DNA, 20 bp, Artificial Sequence
  chemically synthesized
atatgattaatacaaattta

SEQ ID NO: 196476 - DNA, 20 bp, Artificial Sequence
  chemically synthesized
gagggacaaaagaggacaat

SEQ ID NO: 196477 - DNA, 20 bp, Artificial Sequence
  chemically synthesized
cccatgttgagggacaaaag

SEQ ID NO: 196478 - DNA, 20 bp, Artificial Sequence
  chemically synthesized
gcccatgttgagggacaaaa

SEQ ID NO: 196479 - DNA, 20 bp, Artificial Sequence
  chemically synthesized
aggcccatgttgagggacaa

SEQ ID NO: 196480 - DNA, 20 bp, Artificial Sequence
  chemically synthesized
tcctcttttgtccctcaaca

SEQ ID NO: 196481 - DNA, 20 bp, Artificial Sequence
  chemically synthesized
cctcttttgtccctcaacat

SEQ ID NO: 196482 - DNA, 20 bp, Artificial Sequence
  chemically synthesized
gagtggcaggcccatgttga

SEQ ID NO: 196483 - DNA, 20 bp, Artificial Sequence
  chemically synthesized
agagtggcaggcccatgttg

SEQ ID NO: 196484 - DNA, 20 bp, Artificial Sequence
  chemically synthesized
cagagtggcaggcccatgtt

SEQ ID NO: 196485 - DNA, 20 bp, Artificial Sequence
  chemically synthesized
tcaacatgggcctgccactc

SEQ ID NO: 196486 - DNA, 20 bp, Artificial Sequence
  chemically synthesized
caaggagtgaccagagtggc

SEQ ID NO: 196487 - DNA, 20 bp, Artificial Sequence
  chemically synthesized
ccaaggagtgaccagagtgg

SEQ ID NO: 196488 - DNA, 20 bp, Artificial Sequence
  chemically synthesized
cagccaaggagtgaccagag

SEQ ID NO: 196489 - DNA, 20 bp, Artificial Sequence
  chemically synthesized
gagcagccaaggagtgacca

SEQ ID NO: 196490 - DNA, 20 bp, Artificial Sequence
  chemically synthesized
ttgagcagccaaggagtgac

SEQ ID NO: 196491 - DNA, 20 bp, Artificial Sequence
  chemically synthesized
ctgccactctggtcactcct

SEQ ID NO: 196492 - DNA, 20 bp, Artificial Sequence
  chemically synthesized
tggtatattgagcagccaag

SEQ ID NO: 196493 - DNA, 20 bp, Artificial Sequence
  chemically synthesized
ggtggtatattgagcagcca

SEQ ID NO: 196494 - DNA, 20 bp, Artificial Sequence
  chemically synthesized
gggtggtatattgagcagcc

SEQ ID NO: 196495 - DNA, 20 bp, Artificial Sequence
  chemically synthesized
aacacgggtggtatattgag

SEQ ID NO: 196496 - DNA, 20 bp, Artificial Sequence
  chemically synthesized
aagaacacgggtggtatatt

SEQ ID NO: 196497 - DNA, 20 bp, Artificial Sequence
  chemically synthesized
tcccccgcaaagaacacggg

SEQ ID NO: 196498 - DNA, 20 bp, Artificial Sequence
  chemically synthesized
agctcccccgcaaagaacac

SEQ ID NO: 196499 - DNA, 20 bp, Artificial Sequence
  chemically synthesized
gagctcccccgcaaagaaca

SEQ ID NO: 196500 - DNA, 20 bp, Artificial Sequence
  chemically synthesized
tataccacccgtgttctttg

SEQ ID NO: 196501 - DNA, 20 bp, Artificial Sequence
  chemically synthesized
ataccacccgtgttctttgc

SEQ ID NO: 196502 - DNA, 20 bp, Artificial Sequence
  chemically synthesized
taccacccgtgttctttgcg

SEQ ID NO: 196503 - DNA, 20 bp, Artificial Sequence
  chemically synthesized
accacccgtgttctttgcgg

SEQ ID NO: 196504 - DNA, 20 bp, Artificial Sequence
  chemically synthesized
cacccgtgttctttgcgggg

SEQ ID NO: 196505 - DNA, 20 bp, Artificial Sequence
  chemically synthesized
atgacttgagctcccccgca

SEQ ID NO: 196506 - DNA, 20 bp, Artificial Sequence
  chemically synthesized
tgttctttgcgggggagctc

SEQ ID NO: 196507 - DNA, 20 bp, Artificial Sequence
  chemically synthesized
aaggaaaaaacaaatgactt

SEQ ID NO: 196508 - DNA, 20 bp, Artificial Sequence
  chemically synthesized
caaatgtgtcttcagatgaa

SEQ ID NO: 196509 - DNA, 20 bp, Artificial Sequence
  chemically synthesized
ttgttttttcctttcatctg

SEQ ID NO: 196510 - DNA, 20 bp, Artificial Sequence
  chemically synthesized
ccaaatgtgtcttcagatga

SEQ ID NO: 196511 - DNA, 20 bp, Artificial Sequence
  chemically synthesized
gtctcacccaaatgtgtctt

SEQ ID NO: 196512 - DNA, 20 bp, Artificial Sequence
  chemically synthesized
ctttcatctgaagacacatt

SEQ ID NO: 196513 - DNA, 20 bp, Artificial Sequence
  chemically synthesized
tttcatctgaagacacattt

SEQ ID NO: 196514 - DNA, 20 bp, Artificial Sequence
  chemically synthesized
atctgaagacacatttgggt

SEQ ID NO: 196515 - DNA, 20 bp, Artificial Sequence
  chemically synthesized
agacacatttgggtgagact

SEQ ID NO: 196516 - DNA, 20 bp, Artificial Sequence
  chemically synthesized
gacacatttgggtgagactt

SEQ ID NO: 196517 - DNA, 20 bp, Artificial Sequence
  chemically synthesized
acacatttgggtgagacttg

SEQ ID NO: 196518 - DNA, 20 bp, Artificial Sequence
  chemically synthesized
gcttaaacatacaaatcccc

SEQ ID NO: 196519 - DNA, 20 bp, Artificial Sequence
  chemically synthesized
acttggggatttgtatgttt

SEQ ID NO: 196520 - DNA, 20 bp, Artificial Sequence
  chemically synthesized
gatttgtatgtttaagcacc

SEQ ID NO: 196521 - DNA, 20 bp, Artificial Sequence
  chemically synthesized
tttgtatgtttaagcaccca

SEQ ID NO: 196522 - DNA, 20 bp, Artificial Sequence
  chemically synthesized
tggtatgtcagagtcactct

SEQ ID NO: 196523 - DNA, 20 bp, Artificial Sequence
  chemically synthesized
gtggtatgtcagagtcactc

SEQ ID NO: 196524 - DNA, 20 bp, Artificial Sequence
  chemically synthesized
gatagagtagtggtatgtca

SEQ ID NO: 196525 - DNA, 20 bp, Artificial Sequence
  chemically synthesized
tagatagagtagtggtatgt

SEQ ID NO: 196526 - DNA, 20 bp, Artificial Sequence
  chemically synthesized
agagtttatagatagagtag

SEQ ID NO: 196527 - DNA, 20 bp, Artificial Sequence
  chemically synthesized
agcagagtttatagatagag

SEQ ID NO: 196528 - DNA, 20 bp, Artificial Sequence
  chemically synthesized
gtaagcagagtttatagata

SEQ ID NO: 196529 - DNA, 20 bp, Artificial Sequence
  chemically synthesized
ttgtaagcagagtttataga

SEQ ID NO: 196530 - DNA, 20 bp, Artificial Sequence
  chemically synthesized
taggttgtaagcagagttta

SEQ ID NO: 196531 - DNA, 20 bp, Artificial Sequence
  chemically synthesized
ttggccttaggttgtaagca

SEQ ID NO: 196532 - DNA, 20 bp, Artificial Sequence
  chemically synthesized
aattggccttaggttgtaag

SEQ ID NO: 196533 - DNA, 20 bp, Artificial Sequence
  chemically synthesized
ataaactctgcttacaacct

SEQ ID NO: 196534 - DNA, 20 bp, Artificial Sequence
  chemically synthesized
ctgaattggccttaggttgt

SEQ ID NO: 196535 - DNA, 20 bp, Artificial Sequence
  chemically synthesized
taaactctgcttacaaccta

SEQ ID NO: 196536 - DNA, 20 bp, Artificial Sequence
  chemically synthesized
gtaggatctgaattggcctt

SEQ ID NO: 196537 - DNA, 20 bp, Artificial Sequence
  chemically synthesized
agtaggatctgaattggcct

SEQ ID NO: 196538 - DNA, 20 bp, Artificial Sequence
  chemically synthesized
cttacaacctaaggccaatt

SEQ ID NO: 196539 - DNA, 20 bp, Artificial Sequence
  chemically synthesized
agaaagagtaggatctgaat

SEQ ID NO: 196540 - DNA, 20 bp, Artificial Sequence
  chemically synthesized
gaatgttttctagaaagagt

SEQ ID NO: 196541 - DNA, 20 bp, Artificial Sequence
  chemically synthesized
aattcagatcctactctttc

SEQ ID NO: 196542 - DNA, 20 bp, Artificial Sequence
  chemically synthesized
tgaatgttttctagaaagag

SEQ ID NO: 196543 - DNA, 20 bp, Artificial Sequence
  chemically synthesized
taatgaatgttttctagaaa

SEQ ID NO: 196544 - DNA, 20 bp, Artificial Sequence
  chemically synthesized
gttaatgaatgttttctaga

SEQ ID NO: 196545 - DNA, 20 bp, Artificial Sequence
  chemically synthesized
aacagttaatgaatgttttc

SEQ ID NO: 196546 - DNA, 20 bp, Artificial Sequence
  chemically synthesized
gaaatcatgatgagaagtaa

SEQ ID NO: 196547 - DNA, 20 bp, Artificial Sequence
  chemically synthesized
aatgaagaaatcatgatgag

SEQ ID NO: 196548 - DNA, 20 bp, Artificial Sequence
  chemically synthesized
aagaatgaagaaatcatgat

SEQ ID NO: 196549 - DNA, 20 bp, Artificial Sequence
  chemically synthesized
ttattgtactataaagaatg

SEQ ID NO: 196550 - DNA, 20 bp, Artificial Sequence
  chemically synthesized
catgatttcttcattcttta

SEQ ID NO: 196551 - DNA, 20 bp, Artificial Sequence
  chemically synthesized
gtaagtgttattgtactata

SEQ ID NO: 196552 - DNA, 20 bp, Artificial Sequence
  chemically synthesized
gccgaaataaatgagacagt

SEQ ID NO: 196553 - DNA, 20 bp, Artificial Sequence
  chemically synthesized
atatgccgaaataaatgaga

SEQ ID NO: 196554 - DNA, 20 bp, Artificial Sequence
  chemically synthesized
ctatatatgccgaaataaat

SEQ ID NO: 196555 - DNA, 20 bp, Artificial Sequence
  chemically synthesized
acttactgtctcatttattt

SEQ ID NO: 196556 - DNA, 20 bp, Artificial Sequence
  chemically synthesized
ctcatttatttcggcatata

SEQ ID NO: 196557 - DNA, 20 bp, Artificial Sequence
  chemically synthesized
tatttcggcatatatagttc

SEQ ID NO: 196558 - DNA, 20 bp, Artificial Sequence
  chemically synthesized
tttcggcatatatagttcca

SEQ ID NO: 196559 - DNA, 20 bp, Artificial Sequence
  chemically synthesized
caggcgtaattacatagctc

SEQ ID NO: 196560 - DNA, 20 bp, Artificial Sequence
  chemically synthesized
atgaaacaggcgtaattaca

SEQ ID NO: 196561 - DNA, 20 bp, Artificial Sequence
  chemically synthesized
atgtaattacgcctgtttca

SEQ ID NO: 196562 - DNA, 20 bp, Artificial Sequence
  chemically synthesized
aagacctgtgtctatgaaac

SEQ ID NO: 196563 - DNA, 20 bp, Artificial Sequence
  chemically synthesized
taagacctgtgtctatgaaa

SEQ ID NO: 196564 - DNA, 20 bp, Artificial Sequence
  chemically synthesized
ttacgcctgtttcatagaca

SEQ ID NO: 196565 - DNA, 20 bp, Artificial Sequence
  chemically synthesized
tacgcctgtttcatagacac

SEQ ID NO: 196566 - DNA, 20 bp, Artificial Sequence
  chemically synthesized
tgtcttctcattggagggat

SEQ ID NO: 196567 - DNA, 20 bp, Artificial Sequence
  chemically synthesized
acaggtcttatccctccaat

SEQ ID NO: 196568 - DNA, 20 bp, Artificial Sequence
  chemically synthesized
gaacatgtcttctcattgga

SEQ ID NO: 196569 - DNA, 20 bp, Artificial Sequence
  chemically synthesized
agaacatgtcttctcattgg

SEQ ID NO: 196570 - DNA, 20 bp, Artificial Sequence
  chemically synthesized
ggtcttatccctccaatgag

SEQ ID NO: 196571 - DNA, 20 bp, Artificial Sequence
  chemically synthesized
tagaacatgtcttctcattg

SEQ ID NO: 196572 - DNA, 20 bp, Artificial Sequence
  chemically synthesized
tatagaacatgtcttctcat

SEQ ID NO: 196573 - DNA, 20 bp, Artificial Sequence
  chemically synthesized
caatgagaagacatgttcta

SEQ ID NO: 196574 - DNA, 20 bp, Artificial Sequence
  chemically synthesized
aatgagaagacatgttctat

SEQ ID NO: 196575 - DNA, 20 bp, Artificial Sequence
  chemically synthesized
tgagaagacatgttctatag

SEQ ID NO: 196576 - DNA, 20 bp, Artificial Sequence
  chemically synthesized
gaagacatgttctataggag

SEQ ID NO: 196577 - DNA, 20 bp, Artificial Sequence
  chemically synthesized
gataatagctgcttctccta

SEQ ID NO: 196578 - DNA, 20 bp, Artificial Sequence
  chemically synthesized
gacatgttctataggagaag

SEQ ID NO: 196579 - DNA, 20 bp, Artificial Sequence
  chemically synthesized
aggagaagcagctattatct

SEQ ID NO: 196580 - DNA, 20 bp, Artificial Sequence
  chemically synthesized
tcaatacaggtccaagataa

SEQ ID NO: 196581 - DNA, 20 bp, Artificial Sequence
  chemically synthesized
gagaagttcaatacaggtcc

SEQ ID NO: 196582 - DNA, 20 bp, Artificial Sequence
  chemically synthesized
gcggttgagaagttcaatac

SEQ ID NO: 196583 - DNA, 20 bp, Artificial Sequence
  chemically synthesized
tgcggttgagaagttcaata

SEQ ID NO: 196584 - DNA, 20 bp, Artificial Sequence
  chemically synthesized
ccatgctaggtgcggttgag

SEQ ID NO: 196585 - DNA, 20 bp, Artificial Sequence
  chemically synthesized
gagccatgctaggtgcggtt

SEQ ID NO: 196586 - DNA, 20 bp, Artificial Sequence
  chemically synthesized
ttgaacttctcaaccgcacc

SEQ ID NO: 196587 - DNA, 20 bp, Artificial Sequence
  chemically synthesized
acttagagccatgctaggtg

SEQ ID NO: 196588 - DNA, 20 bp, Artificial Sequence
  chemically synthesized
cttctcaaccgcacctagca

SEQ ID NO: 196589 - DNA, 20 bp, Artificial Sequence
  chemically synthesized
agtatacttagagccatgct

SEQ ID NO: 196590 - DNA, 20 bp, Artificial Sequence
  chemically synthesized
aagtatacttagagccatgc

SEQ ID NO: 196591 - DNA, 20 bp, Artificial Sequence
  chemically synthesized
accgcacctagcatggctct

SEQ ID NO: 196592 - DNA, 20 bp, Artificial Sequence
  chemically synthesized
gtatgctgcaagtatactta

SEQ ID NO: 196593 - DNA, 20 bp, Artificial Sequence
  chemically synthesized
atgtatgctgcaagtatact

SEQ ID NO: 196594 - DNA, 20 bp, Artificial Sequence
  chemically synthesized
catggctctaagtatacttg

SEQ ID NO: 196595 - DNA, 20 bp, Artificial Sequence
  chemically synthesized
aagtacacaatgtatgctgc

SEQ ID NO: 196596 - DNA, 20 bp, Artificial Sequence
  chemically synthesized
tcatgatgttaaaataaaat

SEQ ID NO: 196597 - DNA, 20 bp, Artificial Sequence
  chemically synthesized
ttttaacatcatgactcttc

SEQ ID NO: 196598 - DNA, 20 bp, Artificial Sequence
  chemically synthesized
actcacaaaagttgctagaa

SEQ ID NO: 196599 - DNA, 20 bp, Artificial Sequence
  chemically synthesized
caactcacaaaagttgctag

SEQ ID NO: 196600 - DNA, 20 bp, Artificial Sequence
  chemically synthesized
atgcaactcacaaaagttgc

SEQ ID NO: 196601 - DNA, 20 bp, Artificial Sequence
  chemically synthesized
actcttctagcaacttttgt

SEQ ID NO: 196602 - DNA, 20 bp, Artificial Sequence
  chemically synthesized
aagttaaatgcaactcacaa

SEQ ID NO: 196603 - DNA, 20 bp, Artificial Sequence
  chemically synthesized
tgagttgcatttaacttttt

SEQ ID NO: 196604 - DNA, 20 bp, Artificial Sequence
  chemically synthesized
aagccctacagagactgaaa

SEQ ID NO: 196605 - DNA, 20 bp, Artificial Sequence
  chemically synthesized
tttaactttttcagtctctg

SEQ ID NO: 196606 - DNA, 20 bp, Artificial Sequence
  chemically synthesized
ttaactttttcagtctctgt

SEQ ID NO: 196607 - DNA, 20 bp, Artificial Sequence
  chemically synthesized
taactttttcagtctctgta

SEQ ID NO: 196608 - DNA, 20 bp, Artificial Sequence
  chemically synthesized
attgtgaagtaagccctaca

SEQ ID NO: 196609 - DNA, 20 bp, Artificial Sequence
  chemically synthesized
ctattgtgaagtaagcccta

SEQ ID NO: 196610 - DNA, 20 bp, Artificial Sequence
  chemically synthesized
actgagacctattgtgaagt

SEQ ID NO: 196611 - DNA, 20 bp, Artificial Sequence
  chemically synthesized
ctgtagggcttacttcacaa

SEQ ID NO: 196612 - DNA, 20 bp, Artificial Sequence
  chemically synthesized
tgtagggcttacttcacaat

SEQ ID NO: 196613 - DNA, 20 bp, Artificial Sequence
  chemically synthesized
attcactgagacctattgtg

SEQ ID NO: 196614 - DNA, 20 bp, Artificial Sequence
  chemically synthesized
gcttacttcacaataggtct

SEQ ID NO: 196615 - DNA, 20 bp, Artificial Sequence
  chemically synthesized
taagggttaattcattcact

SEQ ID NO: 196616 - DNA, 20 bp, Artificial Sequence
  chemically synthesized
tcagtgaatgaattaaccct

SEQ ID NO: 196617 - DNA, 20 bp, Artificial Sequence
  chemically synthesized
agtgaatgaattaaccctta

SEQ ID NO: 196618 - DNA, 20 bp, Artificial Sequence
  chemically synthesized
agatgaaacggacactctaa

SEQ ID NO: 196619 - DNA, 20 bp, Artificial Sequence
  chemically synthesized
tagatgaaacggacactcta

SEQ ID NO: 196620 - DNA, 20 bp, Artificial Sequence
  chemically synthesized
ttagatgaaacggacactct

SEQ ID NO: 196621 - DNA, 20 bp, Artificial Sequence
  chemically synthesized
caatcctcctttagatgaaa

SEQ ID NO: 196622 - DNA, 20 bp, Artificial Sequence
  chemically synthesized
tagagtgtccgtttcatcta

SEQ ID NO: 196623 - DNA, 20 bp, Artificial Sequence
  chemically synthesized
agagtgtccgtttcatctaa

SEQ ID NO: 196624 - DNA, 20 bp, Artificial Sequence
  chemically synthesized
agtgtccgtttcatctaaag

SEQ ID NO: 196625 - DNA, 20 bp, Artificial Sequence
  chemically synthesized
gtgtccgtttcatctaaagg

SEQ ID NO: 196626 - DNA, 20 bp, Artificial Sequence
  chemically synthesized
aaaaacaggcaatcctcctt

SEQ ID NO: 196627 - DNA, 20 bp, Artificial Sequence
  chemically synthesized
atgctggaacttgcaaaaac

SEQ ID NO: 196628 - DNA, 20 bp, Artificial Sequence
  chemically synthesized
ggaggattgcctgtttttgc

SEQ ID NO: 196629 - DNA, 20 bp, Artificial Sequence
  chemically synthesized
gatgctggaacttgcaaaaa

SEQ ID NO: 196630 - DNA, 20 bp, Artificial Sequence
  chemically synthesized
ttgcctgtttttgcaagttc

SEQ ID NO: 196631 - DNA, 20 bp, Artificial Sequence
  chemically synthesized
caaggtgaaacattagatgc

SEQ ID NO: 196632 - DNA, 20 bp, Artificial Sequence
  chemically synthesized
tatttttcaaggtgaaacat

SEQ ID NO: 196633 - DNA, 20 bp, Artificial Sequence
  chemically synthesized
atcagggttaatatttttca

SEQ ID NO: 196634 - DNA, 20 bp, Artificial Sequence
  chemically synthesized
catcagggttaatatttttc

SEQ ID NO: 196635 - DNA, 20 bp, Artificial Sequence
  chemically synthesized
gaaaaatattaaccctgatg

SEQ ID NO: 196636 - DNA, 20 bp, Artificial Sequence
  chemically synthesized
aaaaatattaaccctgatgt

SEQ ID NO: 196637 - DNA, 20 bp, Artificial Sequence
  chemically synthesized
catatatttgacctacatca

SEQ ID NO: 196638 - DNA, 20 bp, Artificial Sequence
  chemically synthesized
acatatatttgacctacatc

SEQ ID NO: 196639 - DNA, 20 bp, Artificial Sequence
  chemically synthesized
tacatatatttgacctacat

SEQ ID NO: 196640 - DNA, 20 bp, Artificial Sequence
  chemically synthesized
atgtaggtcaaatatatgta

SEQ ID NO: 196641 - DNA, 20 bp, Artificial Sequence
  chemically synthesized
tttgaaaaacaaagttaata

SEQ ID NO: 196642 - DNA, 20 bp, Artificial Sequence
  chemically synthesized
gatgatgtctttgaaaaaca

SEQ ID NO: 196643 - DNA, 20 bp, Artificial Sequence
  chemically synthesized
tgtattaactttgtttttca

SEQ ID NO: 196644 - DNA, 20 bp, Artificial Sequence
  chemically synthesized
aaaagccctcacagagaaaa

SEQ ID NO: 196645 - DNA, 20 bp, Artificial Sequence
  chemically synthesized
tttttttcttttttctctgt

SEQ ID NO: 196646 - DNA, 20 bp, Artificial Sequence
  chemically synthesized
ttttttcttttttctctgtg

SEQ ID NO: 196647 - DNA, 20 bp, Artificial Sequence
  chemically synthesized
tttttcttttttctctgtga

SEQ ID NO: 196648 - DNA, 20 bp, Artificial Sequence
  chemically synthesized
gaaaaaaaaaagccctcaca

SEQ ID NO: 196649 - DNA, 20 bp, Artificial Sequence
  chemically synthesized
aagaaaaaaaaaagccctca

SEQ ID NO: 196650 - DNA, 20 bp, Artificial Sequence
  chemically synthesized
actttataaaagaaaaaaaa

SEQ ID NO: 196651 - DNA, 20 bp, Artificial Sequence
  chemically synthesized
gcttttttttttcttttata

SEQ ID NO: 196652 - DNA, 20 bp, Artificial Sequence
  chemically synthesized
aaattatttttactttataa

SEQ ID NO: 196653 - DNA, 20 bp, Artificial Sequence
  chemically synthesized
tcatattgttctcttgtgat

SEQ ID NO: 196654 - DNA, 20 bp, Artificial Sequence
  chemically synthesized
tatgtgctttctcatcacaa

SEQ ID NO: 196655 - DNA, 20 bp, Artificial Sequence
  chemically synthesized
tgtatgtgctttctcatcac

SEQ ID NO: 196656 - DNA, 20 bp, Artificial Sequence
  chemically synthesized
attgttctcttgtgatgaga

SEQ ID NO: 196657 - DNA, 20 bp, Artificial Sequence
  chemically synthesized
gcacatacaaaattttattt

SEQ ID NO: 196658 - DNA, 20 bp, Artificial Sequence
  chemically synthesized
gaacaatttgatgcgtgttc

SEQ ID NO: 196659 - DNA, 20 bp, Artificial Sequence
  chemically synthesized
agttttctctttttgtcaaa

SEQ ID NO: 196660 - DNA, 20 bp, Artificial Sequence
  chemically synthesized
tagttttctctttttgtcaa

SEQ ID NO: 196661 - DNA, 20 bp, Artificial Sequence
  chemically synthesized
aaattgttccctttgacaaa

SEQ ID NO: 196662 - DNA, 20 bp, Artificial Sequence
  chemically synthesized
gtagttttctctttttgtca

SEQ ID NO: 196663 - DNA, 20 bp, Artificial Sequence
  chemically synthesized
attgttccctttgacaaaaa

SEQ ID NO: 196664 - DNA, 20 bp, Artificial Sequence
  chemically synthesized
aaaagagaaaactacttgtc

SEQ ID NO: 196665 - DNA, 20 bp, Artificial Sequence
  chemically synthesized
aaagagaaaactacttgtct

SEQ ID NO: 196666 - DNA, 20 bp, Artificial Sequence
  chemically synthesized
atctagtgagcccagacaag

SEQ ID NO: 196667 - DNA, 20 bp, Artificial Sequence
  chemically synthesized
gtaatctagtgagcccagac

SEQ ID NO: 196668 - DNA, 20 bp, Artificial Sequence
  chemically synthesized
aactacttgtctgggctcac

SEQ ID NO: 196669 - DNA, 20 bp, Artificial Sequence
  chemically synthesized
acatggtaatctagtgagcc

SEQ ID NO: 196670 - DNA, 20 bp, Artificial Sequence
  chemically synthesized
atagtacatggtaatctagt

SEQ ID NO: 196671 - DNA, 20 bp, Artificial Sequence
  chemically synthesized
tgacatagtacatggtaatc

SEQ ID NO: 196672 - DNA, 20 bp, Artificial Sequence
  chemically synthesized
attcgtcgtgacatagtaca

SEQ ID NO: 196673 - DNA, 20 bp, Artificial Sequence
  chemically synthesized
gaaatatattcgtcgtgaca

SEQ ID NO: 196674 - DNA, 20 bp, Artificial Sequence
  chemically synthesized
tcacgacgaatatatttcta

SEQ ID NO: 196675 - DNA, 20 bp, Artificial Sequence
  chemically synthesized
taaattttcatgtttggctt

SEQ ID NO: 196676 - DNA, 20 bp, Artificial Sequence
  chemically synthesized
gataattaaattttcatgtt

SEQ ID NO: 196677 - DNA, 20 bp, Artificial Sequence
  chemically synthesized
catgaaaatttaattatctt

SEQ ID NO: 196678 - DNA, 20 bp, Artificial Sequence
  chemically synthesized
gaagaacaattatgtagctc

SEQ ID NO: 196679 - DNA, 20 bp, Artificial Sequence
  chemically synthesized
gccaaagaagaacaattatg

SEQ ID NO: 196680 - DNA, 20 bp, Artificial Sequence
  chemically synthesized
gctacataattgttcttctt

SEQ ID NO: 196681 - DNA, 20 bp, Artificial Sequence
  chemically synthesized
aattcggcaagaagccaaag

SEQ ID NO: 196682 - DNA, 20 bp, Artificial Sequence
  chemically synthesized
taaaattcggcaagaagcca

SEQ ID NO: 196683 - DNA, 20 bp, Artificial Sequence
  chemically synthesized
aaattataaaattcggcaag

SEQ ID NO: 196684 - DNA, 20 bp, Artificial Sequence
  chemically synthesized
aaaaaattataaaattcggc

SEQ ID NO: 196685 - DNA, 20 bp, Artificial Sequence
  chemically synthesized
attgaaaaaattataaaatt

SEQ ID NO: 196686 - DNA, 20 bp, Artificial Sequence
  chemically synthesized
gaattttataattttttcaa

SEQ ID NO: 196687 - DNA, 20 bp, Artificial Sequence
  chemically synthesized
atagatcgaactgaatttac

SEQ ID NO: 196688 - DNA, 20 bp, Artificial Sequence
  chemically synthesized
caaagattatcttgtaaatt

SEQ ID NO: 196689 - DNA, 20 bp, Artificial Sequence
  chemically synthesized
tgtactttgttttaaattca

SEQ ID NO: 196690 - DNA, 20 bp, Artificial Sequence
  chemically synthesized
taatctttgaatttaaaaca

SEQ ID NO: 196691 - DNA, 20 bp, Artificial Sequence
  chemically synthesized
aacaaagtacattacttttt

SEQ ID NO: 196692 - DNA, 20 bp, Artificial Sequence
  chemically synthesized
aagtacattactttttaagc

SEQ ID NO: 196693 - DNA, 20 bp, Artificial Sequence
  chemically synthesized
ttttaacttactggcttaaa

SEQ ID NO: 196694 - DNA, 20 bp, Artificial Sequence
  chemically synthesized
acattactttttaagccagt

SEQ ID NO: 196695 - DNA, 20 bp, Artificial Sequence
  chemically synthesized
gaattggaattttaacttac

SEQ ID NO: 196696 - DNA, 20 bp, Artificial Sequence
  chemically synthesized
gcactgtaatattttagaat

SEQ ID NO: 196697 - DNA, 20 bp, Artificial Sequence
  chemically synthesized
gggagtgcactgtaatattt

SEQ ID NO: 196698 - DNA, 20 bp, Artificial Sequence
  chemically synthesized
attccaattctaaaatatta

SEQ ID NO: 196699 - DNA, 20 bp, Artificial Sequence
  chemically synthesized
aatattacagtgcactccca

SEQ ID NO: 196700 - DNA, 20 bp, Artificial Sequence
  chemically synthesized
tttaaaccacaatgctttgg

SEQ ID NO: 196701 - DNA, 20 bp, Artificial Sequence
  chemically synthesized
attttaaaccacaatgcttt

SEQ ID NO: 196702 - DNA, 20 bp, Artificial Sequence
  chemically synthesized
tattttaaaccacaatgctt

SEQ ID NO: 196703 - DNA, 20 bp, Artificial Sequence
  chemically synthesized
agtgcactcccaaagcattg

SEQ ID NO: 196704 - DNA, 20 bp, Artificial Sequence
  chemically synthesized
aaattatataatgataatct

SEQ ID NO: 196705 - DNA, 20 bp, Artificial Sequence
  chemically synthesized
ccttaaaactgaaaagcact

SEQ ID NO: 196706 - DNA, 20 bp, Artificial Sequence
  chemically synthesized
atgataatctcagtgctttt

SEQ ID NO: 196707 - DNA, 20 bp, Artificial Sequence
  chemically synthesized
atgaataccttaaaactgaa

SEQ ID NO: 196708 - DNA, 20 bp, Artificial Sequence
  chemically synthesized
tctcagtgcttttcagtttt

SEQ ID NO: 196709 - DNA, 20 bp, Artificial Sequence
  chemically synthesized
ctcagtgcttttcagtttta

SEQ ID NO: 196710 - DNA, 20 bp, Artificial Sequence
  chemically synthesized
gttttaaggtattcatgttt

SEQ ID NO: 196711 - DNA, 20 bp, Artificial Sequence
  chemically synthesized
tgtaagaaagatacgaataa

SEQ ID NO: 196712 - DNA, 20 bp, Artificial Sequence
  chemically synthesized
gctttgaaacatgtgtaaga

SEQ ID NO: 196713 - DNA, 20 bp, Artificial Sequence
  chemically synthesized
acgagctttgaaacatgtgt

SEQ ID NO: 196714 - DNA, 20 bp, Artificial Sequence
  chemically synthesized
tctttcttacacatgtttca

SEQ ID NO: 196715 - DNA, 20 bp, Artificial Sequence
  chemically synthesized
aaataagataattattttac

SEQ ID NO: 196716 - DNA, 20 bp, Artificial Sequence
  chemically synthesized
aaggaagttttagaacaaat

SEQ ID NO: 196717 - DNA, 20 bp, Artificial Sequence
  chemically synthesized
cagcatacgtaaggaagttt

SEQ ID NO: 196718 - DNA, 20 bp, Artificial Sequence
  chemically synthesized
aaagtacagcatacgtaagg

SEQ ID NO: 196719 - DNA, 20 bp, Artificial Sequence
  chemically synthesized
gacaaagtacagcatacgta

SEQ ID NO: 196720 - DNA, 20 bp, Artificial Sequence
  chemically synthesized
ggacaaagtacagcatacgt

SEQ ID NO: 196721 - DNA, 20 bp, Artificial Sequence
  chemically synthesized
cattgagatgggacaaagta

SEQ ID NO: 196722 - DNA, 20 bp, Artificial Sequence
  chemically synthesized
aatttcattgagatgggaca

SEQ ID NO: 196723 - DNA, 20 bp, Artificial Sequence
  chemically synthesized
gcatgtaatttcattgagat

SEQ ID NO: 196724 - DNA, 20 bp, Artificial Sequence
  chemically synthesized
tgcatgtaatttcattgaga

SEQ ID NO: 196725 - DNA, 20 bp, Artificial Sequence
  chemically synthesized
ttgctgcatgtaatttcatt

SEQ ID NO: 196726 - DNA, 20 bp, Artificial Sequence
  chemically synthesized
catctcaatgaaattacatg

SEQ ID NO: 196727 - DNA, 20 bp, Artificial Sequence
  chemically synthesized
catgcagcaaatttgttcct

SEQ ID NO: 196728 - DNA, 20 bp, Artificial Sequence
  chemically synthesized
cagtgttgaacacaagactt

SEQ ID NO: 196729 - DNA, 20 bp, Artificial Sequence
  chemically synthesized
tcagtgttgaacacaagact

SEQ ID NO: 196730 - DNA, 20 bp, Artificial Sequence
  chemically synthesized
acagtctcagtgttgaacac

SEQ ID NO: 196731 - DNA, 20 bp, Artificial Sequence
  chemically synthesized
taagtcttgtgttcaacact

SEQ ID NO: 196732 - DNA, 20 bp, Artificial Sequence
  chemically synthesized
agcgtcaggaattacagtct

SEQ ID NO: 196733 - DNA, 20 bp, Artificial Sequence
  chemically synthesized
aatgacagcgtcaggaatta

SEQ ID NO: 196734 - DNA, 20 bp, Artificial Sequence
  chemically synthesized
aaaagtagaatgacagcgtc

SEQ ID NO: 196735 - DNA, 20 bp, Artificial Sequence
  chemically synthesized
aaaaagtagaatgacagcgt

SEQ ID NO: 196736 - DNA, 20 bp, Artificial Sequence
  chemically synthesized
attttcaaaaagtagaatga

SEQ ID NO: 196737 - DNA, 20 bp, Artificial Sequence
  chemically synthesized
aatgtaaaattttcaaaaag

SEQ ID NO: 196738 - DNA, 20 bp, Artificial Sequence
  chemically synthesized
ttgaatgtaaaattttcaaa

SEQ ID NO: 196739 - DNA, 20 bp, Artificial Sequence
  chemically synthesized
ttgaaaattttacattcaaa

SEQ ID NO: 196740 - DNA, 20 bp, Artificial Sequence
  chemically synthesized
acagacaaatagaaagagtt

SEQ ID NO: 196741 - DNA, 20 bp, Artificial Sequence
  chemically synthesized
tgaagacagacaaatagaaa

SEQ ID NO: 196742 - DNA, 20 bp, Artificial Sequence
  chemically synthesized
tctgaagacagacaaataga

SEQ ID NO: 196743 - DNA, 20 bp, Artificial Sequence
  chemically synthesized
gttatctgaagacagacaaa

SEQ ID NO: 196744 - DNA, 20 bp, Artificial Sequence
  chemically synthesized
tctttctatttgtctgtctt

SEQ ID NO: 196745 - DNA, 20 bp, Artificial Sequence
  chemically synthesized
taaaataagttatctgaaga

SEQ ID NO: 196746 - DNA, 20 bp, Artificial Sequence
  chemically synthesized
aaactaaaataagttatctg

SEQ ID NO: 196747 - DNA, 20 bp, Artificial Sequence
  chemically synthesized
tgtcttcagataacttattt

SEQ ID NO: 196748 - DNA, 20 bp, Artificial Sequence
  chemically synthesized
gagatttaacaaactaaaat

SEQ ID NO: 196749 - DNA, 20 bp, Artificial Sequence
  chemically synthesized
tattttagtttgttaaatct

SEQ ID NO: 196750 - DNA, 20 bp, Artificial Sequence
  chemically synthesized
atgaatagggtgaaaattct

SEQ ID NO: 196751 - DNA, 20 bp, Artificial Sequence
  chemically synthesized
cagaattttcaccctattca

SEQ ID NO: 196752 - DNA, 20 bp, Artificial Sequence
  chemically synthesized
agaattttcaccctattcat

SEQ ID NO: 196753 - DNA, 20 bp, Artificial Sequence
  chemically synthesized
tcaacttagccccatgaata

SEQ ID NO: 196754 - DNA, 20 bp, Artificial Sequence
  chemically synthesized
gaattttcaccctattcatg

SEQ ID NO: 196755 - DNA, 20 bp, Artificial Sequence
  chemically synthesized
ttcaacttagccccatgaat

SEQ ID NO: 196756 - DNA, 20 bp, Artificial Sequence
  chemically synthesized
attcaacttagccccatgaa

SEQ ID NO: 196757 - DNA, 20 bp, Artificial Sequence
  chemically synthesized
ttcaccctattcatggggct

SEQ ID NO: 196758 - DNA, 20 bp, Artificial Sequence
  chemically synthesized
atttaagaattaattcaact

SEQ ID NO: 196759 - DNA, 20 bp, Artificial Sequence
  chemically synthesized
tgaattaattcttaaattgt

SEQ ID NO: 196760 - DNA, 20 bp, Artificial Sequence
  chemically synthesized
tctccaaatcctcacaattt

SEQ ID NO: 196761 - DNA, 20 bp, Artificial Sequence
  chemically synthesized
gaattaattcttaaattgtg

SEQ ID NO: 196762 - DNA, 20 bp, Artificial Sequence
  chemically synthesized
attcttaaattgtgaggatt

SEQ ID NO: 196763 - DNA, 20 bp, Artificial Sequence
  chemically synthesized
tcttaaattgtgaggatttg

SEQ ID NO: 196764 - DNA, 20 bp, Artificial Sequence
  chemically synthesized
gtgaggatttggagaaatta

SEQ ID NO: 196765 - DNA, 20 bp, Artificial Sequence
  chemically synthesized
tggagaaattatagatatta

SEQ ID NO: 196766 - DNA, 20 bp, Artificial Sequence
  chemically synthesized
aattatagatattaaagccc

SEQ ID NO: 196767 - DNA, 20 bp, Artificial Sequence
  chemically synthesized
atgtttcagaatttgtgcta

SEQ ID NO: 196768 - DNA, 20 bp, Artificial Sequence
  chemically synthesized
tatgtttcagaatttgtgct

SEQ ID NO: 196769 - DNA, 20 bp, Artificial Sequence
  chemically synthesized
ctatgtttcagaatttgtgc

SEQ ID NO: 196770 - DNA, 20 bp, Artificial Sequence
  chemically synthesized
ctagcacaaattctgaaaca

SEQ ID NO: 196771 - DNA, 20 bp, Artificial Sequence
  chemically synthesized
gcaaaaaagccgctatgttt

SEQ ID NO: 196772 - DNA, 20 bp, Artificial Sequence
  chemically synthesized
gcacaaattctgaaacatag

SEQ ID NO: 196773 - DNA, 20 bp, Artificial Sequence
  chemically synthesized
caaaatgaacatttgcaaaa

SEQ ID NO: 196774 - DNA, 20 bp, Artificial Sequence
  chemically synthesized
gcaaatgttcattttgccta

SEQ ID NO: 196775 - DNA, 20 bp, Artificial Sequence
  chemically synthesized
caccttgcaggtggatccat

SEQ ID NO: 196776 - DNA, 20 bp, Artificial Sequence
  chemically synthesized
ccaccttgcaggtggatcca

SEQ ID NO: 196777 - DNA, 20 bp, Artificial Sequence
  chemically synthesized
ttgcctatggatccacctgc

SEQ ID NO: 196778 - DNA, 20 bp, Artificial Sequence
  chemically synthesized
tgcctatggatccacctgca

SEQ ID NO: 196779 - DNA, 20 bp, Artificial Sequence
  chemically synthesized
ttccttgcccaccttgcagg

SEQ ID NO: 196780 - DNA, 20 bp, Artificial Sequence
  chemically synthesized
ctatggatccacctgcaagg

SEQ ID NO: 196781 - DNA, 20 bp, Artificial Sequence
  chemically synthesized
tatggatccacctgcaaggt

SEQ ID NO: 196782 - DNA, 20 bp, Artificial Sequence
  chemically synthesized
cctttccttgcccaccttgc

SEQ ID NO: 196783 - DNA, 20 bp, Artificial Sequence
  chemically synthesized
ccctttccttgcccaccttg

SEQ ID NO: 196784 - DNA, 20 bp, Artificial Sequence
  chemically synthesized
gatccacctgcaaggtgggc

SEQ ID NO: 196785 - DNA, 20 bp, Artificial Sequence
  chemically synthesized
atccacctgcaaggtgggca

SEQ ID NO: 196786 - DNA, 20 bp, Artificial Sequence
  chemically synthesized
acctgcaaggtgggcaagga

SEQ ID NO: 196787 - DNA, 20 bp, Artificial Sequence
  chemically synthesized
cctgcaaggtgggcaaggaa

SEQ ID NO: 196788 - DNA, 20 bp, Artificial Sequence
  chemically synthesized
ctgcaaggtgggcaaggaaa

SEQ ID NO: 196789 - DNA, 20 bp, Artificial Sequence
  chemically synthesized
gtgggcaaggaaagggtttg

SEQ ID NO: 196790 - DNA, 20 bp, Artificial Sequence
  chemically synthesized
ggtttgtagttctattgcat

SEQ ID NO: 196791 - DNA, 20 bp, Artificial Sequence
  chemically synthesized
gtttgtagttctattgcata

SEQ ID NO: 196792 - DNA, 20 bp, Artificial Sequence
  chemically synthesized
aatttcaaagccttatgcaa

SEQ ID NO: 196793 - DNA, 20 bp, Artificial Sequence
  chemically synthesized
tgatctactagtgaatttca

SEQ ID NO: 196794 - DNA, 20 bp, Artificial Sequence
  chemically synthesized
cataaggctttgaaattcac

SEQ ID NO: 196795 - DNA, 20 bp, Artificial Sequence
  chemically synthesized
aaggctttgaaattcactag

SEQ ID NO: 196796 - DNA, 20 bp, Artificial Sequence
  chemically synthesized
atccactgatcgtgatctac

SEQ ID NO: 196797 - DNA, 20 bp, Artificial Sequence
  chemically synthesized
attcactagtagatcacgat

SEQ ID NO: 196798 - DNA, 20 bp, Artificial Sequence
  chemically synthesized
cactagtagatcacgatcag

SEQ ID NO: 196799 - DNA, 20 bp, Artificial Sequence
  chemically synthesized
taacgtagatagtaaggcag

SEQ ID NO: 196800 - DNA, 20 bp, Artificial Sequence
  chemically synthesized
ctttaacgtagatagtaagg

SEQ ID NO: 196801 - DNA, 20 bp, Artificial Sequence
  chemically synthesized
tggctttaacgtagatagta

SEQ ID NO: 196802 - DNA, 20 bp, Artificial Sequence
  chemically synthesized
ctggctttaacgtagatagt

SEQ ID NO: 196803 - DNA, 20 bp, Artificial Sequence
  chemically synthesized
ataactggctttaacgtaga

SEQ ID NO: 196804 - DNA, 20 bp, Artificial Sequence
  chemically synthesized
ctgccttactatctacgtta

SEQ ID NO: 196805 - DNA, 20 bp, Artificial Sequence
  chemically synthesized
actgataactggctttaacg

SEQ ID NO: 196806 - DNA, 20 bp, Artificial Sequence
  chemically synthesized
cttactatctacgttaaagc

SEQ ID NO: 196807 - DNA, 20 bp, Artificial Sequence
  chemically synthesized
tctacgttaaagccagttat

SEQ ID NO: 196808 - DNA, 20 bp, Artificial Sequence
  chemically synthesized
gtgccagcaagactgataac

SEQ ID NO: 196809 - DNA, 20 bp, Artificial Sequence
  chemically synthesized
aagccagttatcagtcttgc

SEQ ID NO: 196810 - DNA, 20 bp, Artificial Sequence
  chemically synthesized
ggctttgttgatgtgccagc

SEQ ID NO: 196811 - DNA, 20 bp, Artificial Sequence
  chemically synthesized
gacaggctttgttgatgtgc

SEQ ID NO: 196812 - DNA, 20 bp, Artificial Sequence
  chemically synthesized
gtcttgctggcacatcaaca

SEQ ID NO: 196813 - DNA, 20 bp, Artificial Sequence
  chemically synthesized
cttttaattgaaagaaagac

SEQ ID NO: 196814 - DNA, 20 bp, Artificial Sequence
  chemically synthesized
acttttaattgaaagaaaga

SEQ ID NO: 196815 - DNA, 20 bp, Artificial Sequence
  chemically synthesized
tgcaacttttaattgaaaga

SEQ ID NO: 196816 - DNA, 20 bp, Artificial Sequence
  chemically synthesized
taattgcaacttttaattga

SEQ ID NO: 196817 - DNA, 20 bp, Artificial Sequence
  chemically synthesized
cctgtctttctttcaattaa

SEQ ID NO: 196818 - DNA, 20 bp, Artificial Sequence
  chemically synthesized
cgagaggtttaaaagaaagc

SEQ ID NO: 196819 - DNA, 20 bp, Artificial Sequence
  chemically synthesized
actacgagaggtttaaaaga

SEQ ID NO: 196820 - DNA, 20 bp, Artificial Sequence
  chemically synthesized
aatcactacgagaggtttaa

SEQ ID NO: 196821 - DNA, 20 bp, Artificial Sequence
  chemically synthesized
gctttcttttaaacctctcg

SEQ ID NO: 196822 - DNA, 20 bp, Artificial Sequence
  chemically synthesized
gtaggttgaatcactacgag

SEQ ID NO: 196823 - DNA, 20 bp, Artificial Sequence
  chemically synthesized
agtaggttgaatcactacga

SEQ ID NO: 196824 - DNA, 20 bp, Artificial Sequence
  chemically synthesized
caagtaggttgaatcactac

SEQ ID NO: 196825 - DNA, 20 bp, Artificial Sequence
  chemically synthesized
aatacgctttggggacaagt

SEQ ID NO: 196826 - DNA, 20 bp, Artificial Sequence
  chemically synthesized
aaatacgctttggggacaag

SEQ ID NO: 196827 - DNA, 20 bp, Artificial Sequence
  chemically synthesized
attcaacctacttgtcccca

SEQ ID NO: 196828 - DNA, 20 bp, Artificial Sequence
  chemically synthesized
atcaaatacgctttggggac

SEQ ID NO: 196829 - DNA, 20 bp, Artificial Sequence
  chemically synthesized
tttcaatcaaatacgctttg

SEQ ID NO: 196830 - DNA, 20 bp, Artificial Sequence
  chemically synthesized
ttttcaatcaaatacgcttt

SEQ ID NO: 196831 - DNA, 20 bp, Artificial Sequence
  chemically synthesized
attttcaatcaaatacgctt

SEQ ID NO: 196832 - DNA, 20 bp, Artificial Sequence
  chemically synthesized
tatttgattgaaaatcatgc

SEQ ID NO: 196833 - DNA, 20 bp, Artificial Sequence
  chemically synthesized
atttgattgaaaatcatgct

SEQ ID NO: 196834 - DNA, 20 bp, Artificial Sequence
  chemically synthesized
gattgaaaatcatgctgggc

SEQ ID NO: 196835 - DNA, 20 bp, Artificial Sequence
  chemically synthesized
tgaaatttgttgggccggcc

SEQ ID NO: 196836 - DNA, 20 bp, Artificial Sequence
  chemically synthesized
aagtgtgaaatttgttgggc

SEQ ID NO: 196837 - DNA, 20 bp, Artificial Sequence
  chemically synthesized
tcataagtgtgaaatttgtt

SEQ ID NO: 196838 - DNA, 20 bp, Artificial Sequence
  chemically synthesized
ctcataagtgtgaaatttgt

SEQ ID NO: 196839 - DNA, 20 bp, Artificial Sequence
  chemically synthesized
ccaacaaatttcacacttat

SEQ ID NO: 196840 - DNA, 20 bp, Artificial Sequence
  chemically synthesized
agggttggtgaatttctcat

SEQ ID NO: 196841 - DNA, 20 bp, Artificial Sequence
  chemically synthesized
gctgatgatatgagaagggt

SEQ ID NO: 196842 - DNA, 20 bp, Artificial Sequence
  chemically synthesized
ataagctgatgatatgagaa

SEQ ID NO: 196843 - DNA, 20 bp, Artificial Sequence
  chemically synthesized
aataagctgatgatatgaga

SEQ ID NO: 196844 - DNA, 20 bp, Artificial Sequence
  chemically synthesized
gaataagctgatgatatgag

SEQ ID NO: 196845 - DNA, 20 bp, Artificial Sequence
  chemically synthesized
accaacccttctcatatcat

SEQ ID NO: 196846 - DNA, 20 bp, Artificial Sequence
  chemically synthesized
ggggaataagctgatgatat

SEQ ID NO: 196847 - DNA, 20 bp, Artificial Sequence
  chemically synthesized
tgtcttttggatgggggaat

SEQ ID NO: 196848 - DNA, 20 bp, Artificial Sequence
  chemically synthesized
tgggaatgtcttttggatgg

SEQ ID NO: 196849 - DNA, 20 bp, Artificial Sequence
  chemically synthesized
cagcttattcccccatccaa

SEQ ID NO: 196850 - DNA, 20 bp, Artificial Sequence
  chemically synthesized
ctgggaatgtcttttggatg

SEQ ID NO: 196851 - DNA, 20 bp, Artificial Sequence
  chemically synthesized
actgggaatgtcttttggat

SEQ ID NO: 196852 - DNA, 20 bp, Artificial Sequence
  chemically synthesized
tactgggaatgtcttttgga

SEQ ID NO: 196853 - DNA, 20 bp, Artificial Sequence
  chemically synthesized
actttactgggaatgtcttt

SEQ ID NO: 196854 - DNA, 20 bp, Artificial Sequence
  chemically synthesized
ccccatccaaaagacattcc

SEQ ID NO: 196855 - DNA, 20 bp, Artificial Sequence
  chemically synthesized
tccaaaagacattcccagta

SEQ ID NO: 196856 - DNA, 20 bp, Artificial Sequence
  chemically synthesized
acagttaatgttactttact

SEQ ID NO: 196857 - DNA, 20 bp, Artificial Sequence
  chemically synthesized
aacagttaatgttactttac

SEQ ID NO: 196858 - DNA, 20 bp, Artificial Sequence
  chemically synthesized
gtaaagtaacattaactgtt

SEQ ID NO: 196859 - DNA, 20 bp, Artificial Sequence
  chemically synthesized
atggtctttaattaactaaa

SEQ ID NO: 196860 - DNA, 20 bp, Artificial Sequence
  chemically synthesized
attaactgtttagttaatta

SEQ ID NO: 196861 - DNA, 20 bp, Artificial Sequence
  chemically synthesized
agttaattaaagaccatctt

SEQ ID NO: 196862 - DNA, 20 bp, Artificial Sequence
  chemically synthesized
cagtttctatattctgaaga

SEQ ID NO: 196863 - DNA, 20 bp, Artificial Sequence
  chemically synthesized
taaagaccatcttcagaata

SEQ ID NO: 196864 - DNA, 20 bp, Artificial Sequence
  chemically synthesized
ataacagtttctatattctg

SEQ ID NO: 196865 - DNA, 20 bp, Artificial Sequence
  chemically synthesized
tcagaatatagaaactgtta

SEQ ID NO: 196866 - DNA, 20 bp, Artificial Sequence
  chemically synthesized
agacctacttcagtccataa

SEQ ID NO: 196867 - DNA, 20 bp, Artificial Sequence
  chemically synthesized
atagaaactgttatggactg

SEQ ID NO: 196868 - DNA, 20 bp, Artificial Sequence
  chemically synthesized
gaaactgttatggactgaag

SEQ ID NO: 196869 - DNA, 20 bp, Artificial Sequence
  chemically synthesized
aaactgttatggactgaagt

SEQ ID NO: 196870 - DNA, 20 bp, Artificial Sequence
  chemically synthesized
ggggttgaggagacctactt

SEQ ID NO: 196871 - DNA, 20 bp, Artificial Sequence
  chemically synthesized
aacatatgaatggggttgag

SEQ ID NO: 196872 - DNA, 20 bp, Artificial Sequence
  chemically synthesized
tcaacatatgaatggggttg

SEQ ID NO: 196873 - DNA, 20 bp, Artificial Sequence
  chemically synthesized
ttcaacatatgaatggggtt

SEQ ID NO: 196874 - DNA, 20 bp, Artificial Sequence
  chemically synthesized
aaaacttcaacatatgaatg

SEQ ID NO: 196875 - DNA, 20 bp, Artificial Sequence
  chemically synthesized
taaaacttcaacatatgaat

SEQ ID NO: 196876 - DNA, 20 bp, Artificial Sequence
  chemically synthesized
ttaaaacttcaacatatgaa

SEQ ID NO: 196877 - DNA, 20 bp, Artificial Sequence
  chemically synthesized
tcaaccccattcatatgttg

SEQ ID NO: 196878 - DNA, 20 bp, Artificial Sequence
  chemically synthesized
gttgaagttttaacccctgc

SEQ ID NO: 196879 - DNA, 20 bp, Artificial Sequence
  chemically synthesized
gaagttttaacccctgcaag

SEQ ID NO: 196880 - DNA, 20 bp, Artificial Sequence
  chemically synthesized
ggccctacctccacttgcag

SEQ ID NO: 196881 - DNA, 20 bp, Artificial Sequence
  chemically synthesized
aggccctacctccacttgca

SEQ ID NO: 196882 - DNA, 20 bp, Artificial Sequence
  chemically synthesized
agttttaacccctgcaagtg

SEQ ID NO: 196883 - DNA, 20 bp, Artificial Sequence
  chemically synthesized
aaggccctacctccacttgc

SEQ ID NO: 196884 - DNA, 20 bp, Artificial Sequence
  chemically synthesized
gttttaacccctgcaagtgg

SEQ ID NO: 196885 - DNA, 20 bp, Artificial Sequence
  chemically synthesized
aaaggccctacctccacttg

SEQ ID NO: 196886 - DNA, 20 bp, Artificial Sequence
  chemically synthesized
ttaacccctgcaagtggagg

SEQ ID NO: 196887 - DNA, 20 bp, Artificial Sequence
  chemically synthesized
taacccctgcaagtggaggt

SEQ ID NO: 196888 - DNA, 20 bp, Artificial Sequence
  chemically synthesized
aacccctgcaagtggaggta

SEQ ID NO: 196889 - DNA, 20 bp, Artificial Sequence
  chemically synthesized
aagtggaggtagggccttta

SEQ ID NO: 196890 - DNA, 20 bp, Artificial Sequence
  chemically synthesized
agtggaggtagggcctttaa

SEQ ID NO: 196891 - DNA, 20 bp, Artificial Sequence
  chemically synthesized
gtggaggtagggcctttaaa

SEQ ID NO: 196892 - DNA, 20 bp, Artificial Sequence
  chemically synthesized
tggaggtagggcctttaaag

SEQ ID NO: 196893 - DNA, 20 bp, Artificial Sequence
  chemically synthesized
aaccttaattacccctttaa

SEQ ID NO: 196894 - DNA, 20 bp, Artificial Sequence
  chemically synthesized
taaccttaattaccccttta

SEQ ID NO: 196895 - DNA, 20 bp, Artificial Sequence
  chemically synthesized
gggcctttaaaggggtaatt

SEQ ID NO: 196896 - DNA, 20 bp, Artificial Sequence
  chemically synthesized
ggcctttaaaggggtaatta

SEQ ID NO: 196897 - DNA, 20 bp, Artificial Sequence
  chemically synthesized
aggggtaattaaggttaaat

SEQ ID NO: 196898 - DNA, 20 bp, Artificial Sequence
  chemically synthesized
taaggttaaatgagttcata

SEQ ID NO: 196899 - DNA, 20 bp, Artificial Sequence
  chemically synthesized
aaggttaaatgagttcatat

SEQ ID NO: 196900 - DNA, 20 bp, Artificial Sequence
  chemically synthesized
gttaaatgagttcatatggg

SEQ ID NO: 196901 - DNA, 20 bp, Artificial Sequence
  chemically synthesized
ttaaatgagttcatatgggt

SEQ ID NO: 196902 - DNA, 20 bp, Artificial Sequence
  chemically synthesized
acattagacttattggatta

SEQ ID NO: 196903 - DNA, 20 bp, Artificial Sequence
  chemically synthesized
gacattagacttattggatt

SEQ ID NO: 196904 - DNA, 20 bp, Artificial Sequence
  chemically synthesized
gggtaggaccttaatccaat

SEQ ID NO: 196905 - DNA, 20 bp, Artificial Sequence
  chemically synthesized
tatgaggacattagacttat

SEQ ID NO: 196906 - DNA, 20 bp, Artificial Sequence
  chemically synthesized
tcttccttttatgaggacat

SEQ ID NO: 196907 - DNA, 20 bp, Artificial Sequence
  chemically synthesized
taagtctaatgtcctcataa

SEQ ID NO: 196908 - DNA, 20 bp, Artificial Sequence
  chemically synthesized
aagtctaatgtcctcataaa

SEQ ID NO: 196909 - DNA, 20 bp, Artificial Sequence
  chemically synthesized
tagctgttcttccttttatg

SEQ ID NO: 196910 - DNA, 20 bp, Artificial Sequence
  chemically synthesized
gtagctgttcttccttttat

SEQ ID NO: 196911 - DNA, 20 bp, Artificial Sequence
  chemically synthesized
tctaatgtcctcataaaagg

SEQ ID NO: 196912 - DNA, 20 bp, Artificial Sequence
  chemically synthesized
tgtcctcataaaaggaagaa

SEQ ID NO: 196913 - DNA, 20 bp, Artificial Sequence
  chemically synthesized
ataaaaggaagaacagctac

SEQ ID NO: 196914 - DNA, 20 bp, Artificial Sequence
  chemically synthesized
taaaaggaagaacagctaca

SEQ ID NO: 196915 - DNA, 20 bp, Artificial Sequence
  chemically synthesized
aaaaggaagaacagctacaa

SEQ ID NO: 196916 - DNA, 20 bp, Artificial Sequence
  chemically synthesized
ctgtgtatgtgcatcccttg

SEQ ID NO: 196917 - DNA, 20 bp, Artificial Sequence
  chemically synthesized
ctacaagggatgcacataca

SEQ ID NO: 196918 - DNA, 20 bp, Artificial Sequence
  chemically synthesized
acaagggatgcacatacaca

SEQ ID NO: 196919 - DNA, 20 bp, Artificial Sequence
  chemically synthesized
caagggatgcacatacacag

SEQ ID NO: 196920 - DNA, 20 bp, Artificial Sequence
  chemically synthesized
ggatgcacatacacagagga

SEQ ID NO: 196921 - DNA, 20 bp, Artificial Sequence
  chemically synthesized
gatgcacatacacagaggaa

SEQ ID NO: 196922 - DNA, 20 bp, Artificial Sequence
  chemically synthesized
tacacagaggaaaggtcatg

SEQ ID NO: 196923 - DNA, 20 bp, Artificial Sequence
  chemically synthesized
acacagaggaaaggtcatga

SEQ ID NO: 196924 - DNA, 20 bp, Artificial Sequence
  chemically synthesized
acagaggaaaggtcatgaag

SEQ ID NO: 196925 - DNA, 20 bp, Artificial Sequence
  chemically synthesized
gaggaaaggtcatgaaggag

SEQ ID NO: 196926 - DNA, 20 bp, Artificial Sequence
  chemically synthesized
aggaaaggtcatgaaggaga

SEQ ID NO: 196927 - DNA, 20 bp, Artificial Sequence
  chemically synthesized
aaaggtcatgaaggagaagg

SEQ ID NO: 196928 - DNA, 20 bp, Artificial Sequence
  chemically synthesized
aggagaaggcggctatctgc

SEQ ID NO: 196929 - DNA, 20 bp, Artificial Sequence
  chemically synthesized
ctcccccattggcttgcaga

SEQ ID NO: 196930 - DNA, 20 bp, Artificial Sequence
  chemically synthesized
agtcctcccccattggcttg

SEQ ID NO: 196931 - DNA, 20 bp, Artificial Sequence
  chemically synthesized
ggcggctatctgcaagccaa

SEQ ID NO: 196932 - DNA, 20 bp, Artificial Sequence
  chemically synthesized
gcggctatctgcaagccaat

SEQ ID NO: 196933 - DNA, 20 bp, Artificial Sequence
  chemically synthesized
cggctatctgcaagccaatg

SEQ ID NO: 196934 - DNA, 20 bp, Artificial Sequence
  chemically synthesized
ggctatctgcaagccaatgg

SEQ ID NO: 196935 - DNA, 20 bp, Artificial Sequence
  chemically synthesized
ctatctgcaagccaatgggg

SEQ ID NO: 196936 - DNA, 20 bp, Artificial Sequence
  chemically synthesized
tatctgcaagccaatggggg

SEQ ID NO: 196937 - DNA, 20 bp, Artificial Sequence
  chemically synthesized
tctggtgagtcctcccccat

SEQ ID NO: 196938 - DNA, 20 bp, Artificial Sequence
  chemically synthesized
gccaatgggggaggactcac

SEQ ID NO: 196939 - DNA, 20 bp, Artificial Sequence
  chemically synthesized
tgacagggttggtttctggt

SEQ ID NO: 196940 - DNA, 20 bp, Artificial Sequence
  chemically synthesized
gtgatgacagggttggtttc

SEQ ID NO: 196941 - DNA, 20 bp, Artificial Sequence
  chemically synthesized
gattaaggtgatgacagggt

SEQ ID NO: 196942 - DNA, 20 bp, Artificial Sequence
  chemically synthesized
ctaagattaaggtgatgaca

SEQ ID NO: 196943 - DNA, 20 bp, Artificial Sequence
  chemically synthesized
tctaagattaaggtgatgac

SEQ ID NO: 196944 - DNA, 20 bp, Artificial Sequence
  chemically synthesized
gtctaagattaaggtgatga

SEQ ID NO: 196945 - DNA, 20 bp, Artificial Sequence
  chemically synthesized
ccctgtcatcaccttaatct

SEQ ID NO: 196946 - DNA, 20 bp, Artificial Sequence
  chemically synthesized
aagttgaacgtctaagatta

SEQ ID NO: 196947 - DNA, 20 bp, Artificial Sequence
  chemically synthesized
gaagttgaacgtctaagatt

SEQ ID NO: 196948 - DNA, 20 bp, Artificial Sequence
  chemically synthesized
gttccggaagttgaacgtct

SEQ ID NO: 196949 - DNA, 20 bp, Artificial Sequence
  chemically synthesized
aatcttagacgttcaacttc

SEQ ID NO: 196950 - DNA, 20 bp, Artificial Sequence
  chemically synthesized
tgtatttcttgcagttccgg

SEQ ID NO: 196951 - DNA, 20 bp, Artificial Sequence
  chemically synthesized
cgttcaacttccggaactgc

SEQ ID NO: 196952 - DNA, 20 bp, Artificial Sequence
  chemically synthesized
aaatgtatttcttgcagttc

SEQ ID NO: 196953 - DNA, 20 bp, Artificial Sequence
  chemically synthesized
caacagaaatgtatttcttg

SEQ ID NO: 196954 - DNA, 20 bp, Artificial Sequence
  chemically synthesized
gaaatacatttctgttgctt

SEQ ID NO: 196955 - DNA, 20 bp, Artificial Sequence
  chemically synthesized
ccactgggtggcttaagcaa

SEQ ID NO: 196956 - DNA, 20 bp, Artificial Sequence
  chemically synthesized
aaacacccactgggtggctt

SEQ ID NO: 196957 - DNA, 20 bp, Artificial Sequence
  chemically synthesized
tttctgttgcttaagccacc

SEQ ID NO: 196958 - DNA, 20 bp, Artificial Sequence
  chemically synthesized
ctgttgcttaagccacccag

SEQ ID NO: 196959 - DNA, 20 bp, Artificial Sequence
  chemically synthesized
tgttgcttaagccacccagt

SEQ ID NO: 196960 - DNA, 20 bp, Artificial Sequence
  chemically synthesized
caaggtaaacacccactggg

SEQ ID NO: 196961 - DNA, 20 bp, Artificial Sequence
  chemically synthesized
aagcaaggtaaacacccact

SEQ ID NO: 196962 - DNA, 20 bp, Artificial Sequence
  chemically synthesized
taagcaaggtaaacacccac

SEQ ID NO: 196963 - DNA, 20 bp, Artificial Sequence
  chemically synthesized
agtgggtgtttaccttgctt

SEQ ID NO: 196964 - DNA, 20 bp, Artificial Sequence
  chemically synthesized
aaatatccatgacttaagca

SEQ ID NO: 196965 - DNA, 20 bp, Artificial Sequence
  chemically synthesized
aaaatatccatgacttaagc

SEQ ID NO: 196966 - DNA, 20 bp, Artificial Sequence
  chemically synthesized
tgtttaccttgcttaagtca

SEQ ID NO: 196967 - DNA, 20 bp, Artificial Sequence
  chemically synthesized
tttcaaaatatccatgactt

SEQ ID NO: 196968 - DNA, 20 bp, Artificial Sequence
  chemically synthesized
aaatttttatatacaaacaa

SEQ ID NO: 196969 - DNA, 20 bp, Artificial Sequence
  chemically synthesized
aaatagatataattattaat

SEQ ID NO: 196970 - DNA, 20 bp, Artificial Sequence
  chemically synthesized
atatatagctagttgttaaa

SEQ ID NO: 196971 - DNA, 20 bp, Artificial Sequence
  chemically synthesized
aattatatctatttaacaac

SEQ ID NO: 196972 - DNA, 20 bp, Artificial Sequence
  chemically synthesized
ggatatataaaatatatagc

SEQ ID NO: 196973 - DNA, 20 bp, Artificial Sequence
  chemically synthesized
ctttggatatataaaatata

SEQ ID NO: 196974 - DNA, 20 bp, Artificial Sequence
  chemically synthesized
ctatatattttatatatcca

SEQ ID NO: 196975 - DNA, 20 bp, Artificial Sequence
  chemically synthesized
tcaattcggttgattaactt

SEQ ID NO: 196976 - DNA, 20 bp, Artificial Sequence
  chemically synthesized
ttacacttactgggtcaatt

SEQ ID NO: 196977 - DNA, 20 bp, Artificial Sequence
  chemically synthesized
gttaatcaaccgaattgacc

SEQ ID NO: 196978 - DNA, 20 bp, Artificial Sequence
  chemically synthesized
atcaaccgaattgacccagt

SEQ ID NO: 196979 - DNA, 20 bp, Artificial Sequence
  chemically synthesized
aagcaaagattacacttact

SEQ ID NO: 196980 - DNA, 20 bp, Artificial Sequence
  chemically synthesized
taagcaaagattacacttac

SEQ ID NO: 196981 - DNA, 20 bp, Artificial Sequence
  chemically synthesized
ttgtattgtttacataagca

SEQ ID NO: 196982 - DNA, 20 bp, Artificial Sequence
  chemically synthesized
agggtttgtattgtttacat

SEQ ID NO: 196983 - DNA, 20 bp, Artificial Sequence
  chemically synthesized
atgtaaacaatacaaaccct

SEQ ID NO: 196984 - DNA, 20 bp, Artificial Sequence
  chemically synthesized
agccaatctaaatgagctaa

SEQ ID NO: 196985 - DNA, 20 bp, Artificial Sequence
  chemically synthesized
gagccaatctaaatgagcta

SEQ ID NO: 196986 - DNA, 20 bp, Artificial Sequence
  chemically synthesized
ggagccaatctaaatgagct

SEQ ID NO: 196987 - DNA, 20 bp, Artificial Sequence
  chemically synthesized
atacaaacccttagctcatt

SEQ ID NO: 196988 - DNA, 20 bp, Artificial Sequence
  chemically synthesized
ttattggagccaatctaaat

SEQ ID NO: 196989 - DNA, 20 bp, Artificial Sequence
  chemically synthesized
aacccttagctcatttagat

SEQ ID NO: 196990 - DNA, 20 bp, Artificial Sequence
  chemically synthesized
atttaaaaaatattttattg

SEQ ID NO: 196991 - DNA, 20 bp, Artificial Sequence
  chemically synthesized
gaatttaaaaaatattttat

SEQ ID NO: 196992 - DNA, 20 bp, Artificial Sequence
  chemically synthesized
aataaaatattttttaaatt

SEQ ID NO: 196993 - DNA, 20 bp, Artificial Sequence
  chemically synthesized
atattttttaaattcagtta

SEQ ID NO: 196994 - DNA, 20 bp, Artificial Sequence
  chemically synthesized
ttcagttaaagtcttaaaca

SEQ ID NO: 196995 - DNA, 20 bp, Artificial Sequence
  chemically synthesized
tatgtaagtgatccatgttt

SEQ ID NO: 196996 - DNA, 20 bp, Artificial Sequence
  chemically synthesized
ttaaacatggatcacttaca

SEQ ID NO: 196997 - DNA, 20 bp, Artificial Sequence
  chemically synthesized
tgcacacatatttgctatgt

SEQ ID NO: 196998 - DNA, 20 bp, Artificial Sequence
  chemically synthesized
tatgtgtgcactacaaattg

SEQ ID NO: 196999 - DNA, 20 bp, Artificial Sequence
  chemically synthesized
gattgattagctgcaatttg

SEQ ID NO: 197000 - DNA, 20 bp, Artificial Sequence
  chemically synthesized
cataaatagaaatgattgat

SEQ ID NO: 197001 - DNA, 20 bp, Artificial Sequence
  chemically synthesized
atagggtatgcacacataaa

SEQ ID NO: 197002 - DNA, 20 bp, Artificial Sequence
  chemically synthesized
agtagtattgtcaggtcata

SEQ ID NO: 197003 - DNA, 20 bp, Artificial Sequence
  chemically synthesized
tagtagtattgtcaggtcat

SEQ ID NO: 197004 - DNA, 20 bp, Artificial Sequence
  chemically synthesized
ctagtagtattgtcaggtca

SEQ ID NO: 197005 - DNA, 20 bp, Artificial Sequence
  chemically synthesized
tattcgctagtagtattgtc

SEQ ID NO: 197006 - DNA, 20 bp, Artificial Sequence
  chemically synthesized
gtattcgctagtagtattgt

SEQ ID NO: 197007 - DNA, 20 bp, Artificial Sequence
  chemically synthesized
ctatgacctgacaatactac

SEQ ID NO: 197008 - DNA, 20 bp, Artificial Sequence
  chemically synthesized
ttctcaacagtattcgctag

SEQ ID NO: 197009 - DNA, 20 bp, Artificial Sequence
  chemically synthesized
aatttctcaacagtattcgc

SEQ ID NO: 197010 - DNA, 20 bp, Artificial Sequence
  chemically synthesized
tactactagcgaatactgtt

SEQ ID NO: 197011 - DNA, 20 bp, Artificial Sequence
  chemically synthesized
catgtttaaaaatttctcaa

SEQ ID NO: 197012 - DNA, 20 bp, Artificial Sequence
  chemically synthesized
gtgttcttgtatatgtttta

SEQ ID NO: 197013 - DNA, 20 bp, Artificial Sequence
  chemically synthesized
atgcactataaaacatatac

SEQ ID NO: 197014 - DNA, 20 bp, Artificial Sequence
  chemically synthesized
acaagaacacatgtgtgttg

SEQ ID NO: 197015 - DNA, 20 bp, Artificial Sequence
  chemically synthesized
ttacatgcgtatggacattt

SEQ ID NO: 197016 - DNA, 20 bp, Artificial Sequence
  chemically synthesized
tttacatgcgtatggacatt

SEQ ID NO: 197017 - DNA, 20 bp, Artificial Sequence
  chemically synthesized
gtatatattttacatgcgta

SEQ ID NO: 197018 - DNA, 20 bp, Artificial Sequence
  chemically synthesized
ttgtgttatatacatacaat

SEQ ID NO: 197019 - DNA, 20 bp, Artificial Sequence
  chemically synthesized
gaacgtaaatatgtaaaaca

SEQ ID NO: 197020 - DNA, 20 bp, Artificial Sequence
  chemically synthesized
aatatgtaaaacatagtatt

SEQ ID NO: 197021 - DNA, 20 bp, Artificial Sequence
  chemically synthesized
tatgtaaaacatagtattga

SEQ ID NO: 197022 - DNA, 20 bp, Artificial Sequence
  chemically synthesized
aaaacatagtattgagagaa

SEQ ID NO: 197023 - DNA, 20 bp, Artificial Sequence
  chemically synthesized
tattgagagaaaagaattca

SEQ ID NO: 197024 - DNA, 20 bp, Artificial Sequence
  chemically synthesized
ttgagagaaaagaattcaca

SEQ ID NO: 197025 - DNA, 20 bp, Artificial Sequence
  chemically synthesized
agagaaaagaattcacagag

SEQ ID NO: 197026 - DNA, 20 bp, Artificial Sequence
  chemically synthesized
aaagaattcacagagaagat

SEQ ID NO: 197027 - DNA, 20 bp, Artificial Sequence
  chemically synthesized
agaattcacagagaagatta

SEQ ID NO: 197028 - DNA, 20 bp, Artificial Sequence
  chemically synthesized
ttcacagagaagattagaga

SEQ ID NO: 197029 - DNA, 20 bp, Artificial Sequence
  chemically synthesized
tcacagagaagattagagat

SEQ ID NO: 197030 - DNA, 20 bp, Artificial Sequence
  chemically synthesized
cacagagaagattagagatg

SEQ ID NO: 197031 - DNA, 20 bp, Artificial Sequence
  chemically synthesized
agagaagattagagatgggg

SEQ ID NO: 197032 - DNA, 20 bp, Artificial Sequence
  chemically synthesized
ggatttgaactttatattaa

SEQ ID NO: 197033 - DNA, 20 bp, Artificial Sequence
  chemically synthesized
ggggtggttcccttaatata

SEQ ID NO: 197034 - DNA, 20 bp, Artificial Sequence
  chemically synthesized
tggatttgaactttatatta

SEQ ID NO: 197035 - DNA, 20 bp, Artificial Sequence
  chemically synthesized
ctggatttgaactttatatt

SEQ ID NO: 197036 - DNA, 20 bp, Artificial Sequence
  chemically synthesized
cttaatataaagttcaaatc

SEQ ID NO: 197037 - DNA, 20 bp, Artificial Sequence
  chemically synthesized
ttaatataaagttcaaatcc

SEQ ID NO: 197038 - DNA, 20 bp, Artificial Sequence
  chemically synthesized
gtagctagttttagtttgcc

SEQ ID NO: 197039 - DNA, 20 bp, Artificial Sequence
  chemically synthesized
aaatccaggcaaactaaaac

SEQ ID NO: 197040 - DNA, 20 bp, Artificial Sequence
  chemically synthesized
ctttaaagagtagctagttt

SEQ ID NO: 197041 - DNA, 20 bp, Artificial Sequence
  chemically synthesized
ttgtatctttaaagagtagc

SEQ ID NO: 197042 - DNA, 20 bp, Artificial Sequence
  chemically synthesized
ctaaaactagctactcttta

SEQ ID NO: 197043 - DNA, 20 bp, Artificial Sequence
  chemically synthesized
gtatttgtatctttaaagag

SEQ ID NO: 197044 - DNA, 20 bp, Artificial Sequence
  chemically synthesized
cctgtatttgtatctttaaa

SEQ ID NO: 197045 - DNA, 20 bp, Artificial Sequence
  chemically synthesized
cacctgtatttgtatcttta

SEQ ID NO: 197046 - DNA, 20 bp, Artificial Sequence
  chemically synthesized
actctttaaagatacaaata

SEQ ID NO: 197047 - DNA, 20 bp, Artificial Sequence
  chemically synthesized
ctctttaaagatacaaatac

SEQ ID NO: 197048 - DNA, 20 bp, Artificial Sequence
  chemically synthesized
acatacgttttttaaaaaat

SEQ ID NO: 197049 - DNA, 20 bp, Artificial Sequence
  chemically synthesized
aaaaaatgagcattgtttac

SEQ ID NO: 197050 - DNA, 20 bp, Artificial Sequence
  chemically synthesized
gcattgtttactagaaattc

SEQ ID NO: 197051 - DNA, 20 bp, Artificial Sequence
  chemically synthesized
taaccattatcttgaatttc

SEQ ID NO: 197052 - DNA, 20 bp, Artificial Sequence
  chemically synthesized
ttactagaaattcaagataa

SEQ ID NO: 197053 - DNA, 20 bp, Artificial Sequence
  chemically synthesized
ttcaagataatggttacttt

SEQ ID NO: 197054 - DNA, 20 bp, Artificial Sequence
  chemically synthesized
ataatggttacttttggctc

SEQ ID NO: 197055 - DNA, 20 bp, Artificial Sequence
  chemically synthesized
ttccttccccccagagccaa

SEQ ID NO: 197056 - DNA, 20 bp, Artificial Sequence
  chemically synthesized
taatggttacttttggctct

SEQ ID NO: 197057 - DNA, 20 bp, Artificial Sequence
  chemically synthesized
aatggttacttttggctctg

SEQ ID NO: 197058 - DNA, 20 bp, Artificial Sequence
  chemically synthesized
atggttacttttggctctgg

SEQ ID NO: 197059 - DNA, 20 bp, Artificial Sequence
  chemically synthesized
tggttacttttggctctggg

SEQ ID NO: 197060 - DNA, 20 bp, Artificial Sequence
  chemically synthesized
ttacttttggctctgggggg

SEQ ID NO: 197061 - DNA, 20 bp, Artificial Sequence
  chemically synthesized
aatcaccttccttcccccca

SEQ ID NO: 197062 - DNA, 20 bp, Artificial Sequence
  chemically synthesized
tacttttggctctgggggga

SEQ ID NO: 197063 - DNA, 20 bp, Artificial Sequence
  chemically synthesized
ctaatcaccttccttccccc

SEQ ID NO: 197064 - DNA, 20 bp, Artificial Sequence
  chemically synthesized
ttttggctctggggggaagg

SEQ ID NO: 197065 - DNA, 20 bp, Artificial Sequence
  chemically synthesized
tttggctctggggggaagga

SEQ ID NO: 197066 - DNA, 20 bp, Artificial Sequence
  chemically synthesized
ctggggggaaggaaggtgat

SEQ ID NO: 197067 - DNA, 20 bp, Artificial Sequence
  chemically synthesized
ggggaaggaaggtgattagc

SEQ ID NO: 197068 - DNA, 20 bp, Artificial Sequence
  chemically synthesized
gggaaggaaggtgattagca

SEQ ID NO: 197069 - DNA, 20 bp, Artificial Sequence
  chemically synthesized
ggaaggaaggtgattagcaa

SEQ ID NO: 197070 - DNA, 20 bp, Artificial Sequence
  chemically synthesized
gaaggaaggtgattagcaag

SEQ ID NO: 197071 - DNA, 20 bp, Artificial Sequence
  chemically synthesized
gtgattagcaaggggtaaca

SEQ ID NO: 197072 - DNA, 20 bp, Artificial Sequence
  chemically synthesized
tgattagcaaggggtaacat

SEQ ID NO: 197073 - DNA, 20 bp, Artificial Sequence
  chemically synthesized
gattagcaaggggtaacata

SEQ ID NO: 197074 - DNA, 20 bp, Artificial Sequence
  chemically synthesized
ttagcaaggggtaacatagg

SEQ ID NO: 197075 - DNA, 20 bp, Artificial Sequence
  chemically synthesized
caccatcagtattttgggag

SEQ ID NO: 197076 - DNA, 20 bp, Artificial Sequence
  chemically synthesized
gaacaccatcagtattttgg

SEQ ID NO: 197077 - DNA, 20 bp, Artificial Sequence
  chemically synthesized
aagaacaccatcagtatttt

SEQ ID NO: 197078 - DNA, 20 bp, Artificial Sequence
  chemically synthesized
gaagaacaccatcagtattt

SEQ ID NO: 197079 - DNA, 20 bp, Artificial Sequence
  chemically synthesized
agcttctcccaaaatactga

SEQ ID NO: 197080 - DNA, 20 bp, Artificial Sequence
  chemically synthesized
tcaaataagaagaacaccat

SEQ ID NO: 197081 - DNA, 20 bp, Artificial Sequence
  chemically synthesized
cattctgagtttcaaataag

SEQ ID NO: 197082 - DNA, 20 bp, Artificial Sequence
  chemically synthesized
caacattctgagtttcaaat

SEQ ID NO: 197083 - DNA, 20 bp, Artificial Sequence
  chemically synthesized
tgttcttcttatttgaaact

SEQ ID NO: 197084 - DNA, 20 bp, Artificial Sequence
  chemically synthesized
ttatttgaaactcagaatgt

SEQ ID NO: 197085 - DNA, 20 bp, Artificial Sequence
  chemically synthesized
catctgtgttccaacattct

SEQ ID NO: 197086 - DNA, 20 bp, Artificial Sequence
  chemically synthesized
aaactcagaatgttggaaca

SEQ ID NO: 197087 - DNA, 20 bp, Artificial Sequence
  chemically synthesized
tgttggacagcacaggttta

SEQ ID NO: 197088 - DNA, 20 bp, Artificial Sequence
  chemically synthesized
gctaccgtgttggacagcac

SEQ ID NO: 197089 - DNA, 20 bp, Artificial Sequence
  chemically synthesized
ggctaccgtgttggacagca

SEQ ID NO: 197090 - DNA, 20 bp, Artificial Sequence
  chemically synthesized
taaacctgtgctgtccaaca

SEQ ID NO: 197091 - DNA, 20 bp, Artificial Sequence
  chemically synthesized
ctaatggctaccgtgttgga

SEQ ID NO: 197092 - DNA, 20 bp, Artificial Sequence
  chemically synthesized
acctgtgctgtccaacacgg

SEQ ID NO: 197093 - DNA, 20 bp, Artificial Sequence
  chemically synthesized
gtggctaatggctaccgtgt

SEQ ID NO: 197094 - DNA, 20 bp, Artificial Sequence
  chemically synthesized
ctgtccaacacggtagccat

SEQ ID NO: 197095 - DNA, 20 bp, Artificial Sequence
  chemically synthesized
caatagccacaggtggctaa

SEQ ID NO: 197096 - DNA, 20 bp, Artificial Sequence
  chemically synthesized
cggtagccattagccacctg

SEQ ID NO: 197097 - DNA, 20 bp, Artificial Sequence
  chemically synthesized
aattgttcaatagccacagg

SEQ ID NO: 197098 - DNA, 20 bp, Artificial Sequence
  chemically synthesized
ttgaattgttcaatagccac

SEQ ID NO: 197099 - DNA, 20 bp, Artificial Sequence
  chemically synthesized
tttgaattgttcaatagcca

SEQ ID NO: 197100 - DNA, 20 bp, Artificial Sequence
  chemically synthesized
gtcacatttgaattgttcaa

SEQ ID NO: 197101 - DNA, 20 bp, Artificial Sequence
  chemically synthesized
tggcacattgcaatttgcat

SEQ ID NO: 197102 - DNA, 20 bp, Artificial Sequence
  chemically synthesized
tagtgtatattttacattta

SEQ ID NO: 197103 - DNA, 20 bp, Artificial Sequence
  chemically synthesized
cataaatgtaaaatatacac

SEQ ID NO: 197104 - DNA, 20 bp, Artificial Sequence
  chemically synthesized
gtaaaatatacactagattt

SEQ ID NO: 197105 - DNA, 20 bp, Artificial Sequence
  chemically synthesized
aaaatatacactagatttca

SEQ ID NO: 197106 - DNA, 20 bp, Artificial Sequence
  chemically synthesized
tttagtaagtctctgaaatc

SEQ ID NO: 197107 - DNA, 20 bp, Artificial Sequence
  chemically synthesized
tagatttcagagacttacta

SEQ ID NO: 197108 - DNA, 20 bp, Artificial Sequence
  chemically synthesized
atttaacctttttctttagt

SEQ ID NO: 197109 - DNA, 20 bp, Artificial Sequence
  chemically synthesized
tcagagacttactaaagaaa

SEQ ID NO: 197110 - DNA, 20 bp, Artificial Sequence
  chemically synthesized
cagagacttactaaagaaaa

SEQ ID NO: 197111 - DNA, 20 bp, Artificial Sequence
  chemically synthesized
atgtatttaacctttttctt

SEQ ID NO: 197112 - DNA, 20 bp, Artificial Sequence
  chemically synthesized
aaaaaggttaaatacataat

SEQ ID NO: 197113 - DNA, 20 bp, Artificial Sequence
  chemically synthesized
atatttaaataattgtgatt

SEQ ID NO: 197114 - DNA, 20 bp, Artificial Sequence
  chemically synthesized
taattgtgatttggatatac

SEQ ID NO: 197115 - DNA, 20 bp, Artificial Sequence
  chemically synthesized
aattgtgatttggatatact

SEQ ID NO: 197116 - DNA, 20 bp, Artificial Sequence
  chemically synthesized
ataggatactttatttagcc

SEQ ID NO: 197117 - DNA, 20 bp, Artificial Sequence
  chemically synthesized
tggatatactaggctaaata

SEQ ID NO: 197118 - DNA, 20 bp, Artificial Sequence
  chemically synthesized
atgtaataggatactttatt

SEQ ID NO: 197119 - DNA, 20 bp, Artificial Sequence
  chemically synthesized
aacagagaaattaatgtaat

SEQ ID NO: 197120 - DNA, 20 bp, Artificial Sequence
  chemically synthesized
aaacagagaaattaatgtaa

SEQ ID NO: 197121 - DNA, 20 bp, Artificial Sequence
  chemically synthesized
ccatattagaaaaagaaaca

SEQ ID NO: 197122 - DNA, 20 bp, Artificial Sequence
  chemically synthesized
agccatattagaaaaagaaa

SEQ ID NO: 197123 - DNA, 20 bp, Artificial Sequence
  chemically synthesized
tctactagccatattagaaa

SEQ ID NO: 197124 - DNA, 20 bp, Artificial Sequence
  chemically synthesized
ctctgtttctttttctaata

SEQ ID NO: 197125 - DNA, 20 bp, Artificial Sequence
  chemically synthesized
gtttctttttctaatatggc

SEQ ID NO: 197126 - DNA, 20 bp, Artificial Sequence
  chemically synthesized
caattttctactagccatat

SEQ ID NO: 197127 - DNA, 20 bp, Artificial Sequence
  chemically synthesized
tctttttctaatatggctag

SEQ ID NO: 197128 - DNA, 20 bp, Artificial Sequence
  chemically synthesized
cgtagttttcaattttctac

SEQ ID NO: 197129 - DNA, 20 bp, Artificial Sequence
  chemically synthesized
tataatgtgagtcaaatacg

SEQ ID NO: 197130 - DNA, 20 bp, Artificial Sequence
  chemically synthesized
gtccaatggaaatataatgt

SEQ ID NO: 197131 - DNA, 20 bp, Artificial Sequence
  chemically synthesized
gactcacattatatttccat

SEQ ID NO: 197132 - DNA, 20 bp, Artificial Sequence
  chemically synthesized
tttaaagtggtgttgtccaa

SEQ ID NO: 197133 - DNA, 20 bp, Artificial Sequence
  chemically synthesized
tttacagggagtgtttaaag

SEQ ID NO: 197134 - DNA, 20 bp, Artificial Sequence
  chemically synthesized
acgtttacagggagtgttta

SEQ ID NO: 197135 - DNA, 20 bp, Artificial Sequence
  chemically synthesized
acaatataaacgtttacagg

SEQ ID NO: 197136 - DNA, 20 bp, Artificial Sequence
  chemically synthesized
tcacaatataaacgtttaca

SEQ ID NO: 197137 - DNA, 20 bp, Artificial Sequence
  chemically synthesized
atcacaatataaacgtttac

SEQ ID NO: 197138 - DNA, 20 bp, Artificial Sequence
  chemically synthesized
tatcacaatataaacgttta

SEQ ID NO: 197139 - DNA, 20 bp, Artificial Sequence
  chemically synthesized
gttaattgtataataaaatc

SEQ ID NO: 197140 - DNA, 20 bp, Artificial Sequence
  chemically synthesized
ttaattgtataataaaatcc

SEQ ID NO: 197141 - DNA, 20 bp, Artificial Sequence
  chemically synthesized
tatccttaagggtgaaaacc

SEQ ID NO: 197142 - DNA, 20 bp, Artificial Sequence
  chemically synthesized
aaatccaggttttcaccctt

SEQ ID NO: 197143 - DNA, 20 bp, Artificial Sequence
  chemically synthesized
aatccaggttttcaccctta

SEQ ID NO: 197144 - DNA, 20 bp, Artificial Sequence
  chemically synthesized
actactccttttatccttaa

SEQ ID NO: 197145 - DNA, 20 bp, Artificial Sequence
  chemically synthesized
aactactccttttatcctta

SEQ ID NO: 197146 - DNA, 20 bp, Artificial Sequence
  chemically synthesized
aaactactccttttatcctt

SEQ ID NO: 197147 - DNA, 20 bp, Artificial Sequence
  chemically synthesized
gttttcacccttaaggataa

SEQ ID NO: 197148 - DNA, 20 bp, Artificial Sequence
  chemically synthesized
ttttcacccttaaggataaa

SEQ ID NO: 197149 - DNA, 20 bp, Artificial Sequence
  chemically synthesized
ttcacccttaaggataaaag

SEQ ID NO: 197150 - DNA, 20 bp, Artificial Sequence
  chemically synthesized
acccttaaggataaaaggag

SEQ ID NO: 197151 - DNA, 20 bp, Artificial Sequence
  chemically synthesized
ggtttatattgtatttagaa

SEQ ID NO: 197152 - DNA, 20 bp, Artificial Sequence
  chemically synthesized
tggtttatattgtatttaga

SEQ ID NO: 197153 - DNA, 20 bp, Artificial Sequence
  chemically synthesized
gaactggtttatattgtatt

SEQ ID NO: 197154 - DNA, 20 bp, Artificial Sequence
  chemically synthesized
tttctaaatacaatataaac

SEQ ID NO: 197155 - DNA, 20 bp, Artificial Sequence
  chemically synthesized
tacaatataaaccagttcaa

SEQ ID NO: 197156 - DNA, 20 bp, Artificial Sequence
  chemically synthesized
ttttataagttccattgaac

SEQ ID NO: 197157 - DNA, 20 bp, Artificial Sequence
  chemically synthesized
gaaggtgtccatagttttat

SEQ ID NO: 197158 - DNA, 20 bp, Artificial Sequence
  chemically synthesized
caatggaacttataaaacta

SEQ ID NO: 197159 - DNA, 20 bp, Artificial Sequence
  chemically synthesized
acttacttagaaggtgtcca

SEQ ID NO: 197160 - DNA, 20 bp, Artificial Sequence
  chemically synthesized
taaaactatggacaccttct

SEQ ID NO: 197161 - DNA, 20 bp, Artificial Sequence
  chemically synthesized
actatggacaccttctaagt

SEQ ID NO: 197162 - DNA, 20 bp, Artificial Sequence
  chemically synthesized
aaaaaaatgacttacttaga

SEQ ID NO: 197163 - DNA, 20 bp, Artificial Sequence
  chemically synthesized
aaaaaaaatgacttacttag

SEQ ID NO: 197164 - DNA, 20 bp, Artificial Sequence
  chemically synthesized
tttaaaaaaaatgacttact

SEQ ID NO: 197165 - DNA, 20 bp, Artificial Sequence
  chemically synthesized
taagtaagtcatttttttta

SEQ ID NO: 197166 - DNA, 20 bp, Artificial Sequence
  chemically synthesized
gtaagtcattttttttaaag

SEQ ID NO: 197167 - DNA, 20 bp, Artificial Sequence
  chemically synthesized
agtcattttttttaaagtag

SEQ ID NO: 197168 - DNA, 20 bp, Artificial Sequence
  chemically synthesized
gtcattttttttaaagtagt

SEQ ID NO: 197169 - DNA, 20 bp, Artificial Sequence
  chemically synthesized
tcattgcttttgaatgattg

SEQ ID NO: 197170 - DNA, 20 bp, Artificial Sequence
  chemically synthesized
ctcattgcttttgaatgatt

SEQ ID NO: 197171 - DNA, 20 bp, Artificial Sequence
  chemically synthesized
acattacctcaatcattcaa

SEQ ID NO: 197172 - DNA, 20 bp, Artificial Sequence
  chemically synthesized
ctcaatcattcaaaagcaat

SEQ ID NO: 197173 - DNA, 20 bp, Artificial Sequence
  chemically synthesized
cattcaaaagcaatgagatg

SEQ ID NO: 197174 - DNA, 20 bp, Artificial Sequence
  chemically synthesized
ggttaatttcaacacatata

SEQ ID NO: 197175 - DNA, 20 bp, Artificial Sequence
  chemically synthesized
ttttagagcagattttaaaa

SEQ ID NO: 197176 - DNA, 20 bp, Artificial Sequence
  chemically synthesized
ccttttctggatttttagag

SEQ ID NO: 197177 - DNA, 20 bp, Artificial Sequence
  chemically synthesized
gccccttttctggattttta

SEQ ID NO: 197178 - DNA, 20 bp, Artificial Sequence
  chemically synthesized
taaaatctgctctaaaaatc

SEQ ID NO: 197179 - DNA, 20 bp, Artificial Sequence
  chemically synthesized
aggccccttttctggatttt

SEQ ID NO: 197180 - DNA, 20 bp, Artificial Sequence
  chemically synthesized
tctgctctaaaaatccagaa

SEQ ID NO: 197181 - DNA, 20 bp, Artificial Sequence
  chemically synthesized
ctgctctaaaaatccagaaa

SEQ ID NO: 197182 - DNA, 20 bp, Artificial Sequence
  chemically synthesized
tgctctaaaaatccagaaaa

SEQ ID NO: 197183 - DNA, 20 bp, Artificial Sequence
  chemically synthesized
gctctaaaaatccagaaaag

SEQ ID NO: 197184 - DNA, 20 bp, Artificial Sequence
  chemically synthesized
gaaaatccaggccccttttc

SEQ ID NO: 197185 - DNA, 20 bp, Artificial Sequence
  chemically synthesized
aaaaatccagaaaaggggcc

SEQ ID NO: 197186 - DNA, 20 bp, Artificial Sequence
  chemically synthesized
atttgcctttgggaaaatcc

SEQ ID NO: 197187 - DNA, 20 bp, Artificial Sequence
  chemically synthesized
gatttgcctttgggaaaatc

SEQ ID NO: 197188 - DNA, 20 bp, Artificial Sequence
  chemically synthesized
aaggggcctggattttccca

SEQ ID NO: 197189 - DNA, 20 bp, Artificial Sequence
  chemically synthesized
aggggcctggattttcccaa

SEQ ID NO: 197190 - DNA, 20 bp, Artificial Sequence
  chemically synthesized
caccactcagatttgccttt

SEQ ID NO: 197191 - DNA, 20 bp, Artificial Sequence
  chemically synthesized
tcaccactcagatttgcctt

SEQ ID NO: 197192 - DNA, 20 bp, Artificial Sequence
  chemically synthesized
attttcccaaaggcaaatct

SEQ ID NO: 197193 - DNA, 20 bp, Artificial Sequence
  chemically synthesized
ttcccaaaggcaaatctgag

SEQ ID NO: 197194 - DNA, 20 bp, Artificial Sequence
  chemically synthesized
caaaggcaaatctgagtggt

SEQ ID NO: 197195 - DNA, 20 bp, Artificial Sequence
  chemically synthesized
caatatatcaactcaccact

SEQ ID NO: 197196 - DNA, 20 bp, Artificial Sequence
  chemically synthesized
tgatatattgaattatcact

SEQ ID NO: 197197 - DNA, 20 bp, Artificial Sequence
  chemically synthesized
atattgaattatcactgaga

SEQ ID NO: 197198 - DNA, 20 bp, Artificial Sequence
  chemically synthesized
ttgaattttggtttctttct

SEQ ID NO: 197199 - DNA, 20 bp, Artificial Sequence
  chemically synthesized
attaagatttcattgaattt

SEQ ID NO: 197200 - DNA, 20 bp, Artificial Sequence
  chemically synthesized
aattcaatgaaatcttaata

SEQ ID NO: 197201 - DNA, 20 bp, Artificial Sequence
  chemically synthesized
ttgtccacgtaggctatatt

SEQ ID NO: 197202 - DNA, 20 bp, Artificial Sequence
  chemically synthesized
aaatcttaatatagcctacg

SEQ ID NO: 197203 - DNA, 20 bp, Artificial Sequence
  chemically synthesized
ttttgtatacttgtccacgt

SEQ ID NO: 197204 - DNA, 20 bp, Artificial Sequence
  chemically synthesized
ttaatatagcctacgtggac

SEQ ID NO: 197205 - DNA, 20 bp, Artificial Sequence
  chemically synthesized
attttgtatacttgtccacg

SEQ ID NO: 197206 - DNA, 20 bp, Artificial Sequence
  chemically synthesized
tggacaagtatacaaaattt

SEQ ID NO: 197207 - DNA, 20 bp, Artificial Sequence
  chemically synthesized
aagtatacaaaatttgagca

SEQ ID NO: 197208 - DNA, 20 bp, Artificial Sequence
  chemically synthesized
gcatagcaacgatacaattt

SEQ ID NO: 197209 - DNA, 20 bp, Artificial Sequence
  chemically synthesized
catagcaacgatacaattta

SEQ ID NO: 197210 - DNA, 20 bp, Artificial Sequence
  chemically synthesized
ctaattattgaattagttta

SEQ ID NO: 197211 - DNA, 20 bp, Artificial Sequence
  chemically synthesized
ccctaattattgaattagtt

SEQ ID NO: 197212 - DNA, 20 bp, Artificial Sequence
  chemically synthesized
agcttccctaattattgaat

SEQ ID NO: 197213 - DNA, 20 bp, Artificial Sequence
  chemically synthesized
ctctaaactaattcaataat

SEQ ID NO: 197214 - DNA, 20 bp, Artificial Sequence
  chemically synthesized
tctaaactaattcaataatt

SEQ ID NO: 197215 - DNA, 20 bp, Artificial Sequence
  chemically synthesized
ctaaactaattcaataatta

SEQ ID NO: 197216 - DNA, 20 bp, Artificial Sequence
  chemically synthesized
aactaattcaataattaggg

SEQ ID NO: 197217 - DNA, 20 bp, Artificial Sequence
  chemically synthesized
ttcaataattagggaagcta

SEQ ID NO: 197218 - DNA, 20 bp, Artificial Sequence
  chemically synthesized
tttttaatataggcattctg

SEQ ID NO: 197219 - DNA, 20 bp, Artificial Sequence
  chemically synthesized
ggagagataatttttaatat

SEQ ID NO: 197220 - DNA, 20 bp, Artificial Sequence
  chemically synthesized
aggagagataatttttaata

SEQ ID NO: 197221 - DNA, 20 bp, Artificial Sequence
  chemically synthesized
taaaaattatctctcctttg

SEQ ID NO: 197222 - DNA, 20 bp, Artificial Sequence
  chemically synthesized
agattgagttccacaaagga

SEQ ID NO: 197223 - DNA, 20 bp, Artificial Sequence
  chemically synthesized
tcagattgagttccacaaag

SEQ ID NO: 197224 - DNA, 20 bp, Artificial Sequence
  chemically synthesized
ggtcagattgagttccacaa

SEQ ID NO: 197225 - DNA, 20 bp, Artificial Sequence
  chemically synthesized
tggtcagattgagttccaca

SEQ ID NO: 197226 - DNA, 20 bp, Artificial Sequence
  chemically synthesized
gcaaattgtatggtcagatt

SEQ ID NO: 197227 - DNA, 20 bp, Artificial Sequence
  chemically synthesized
tgctttgcaaattgtatggt

SEQ ID NO: 197228 - DNA, 20 bp, Artificial Sequence
  chemically synthesized
tatctgctttgcaaattgta

SEQ ID NO: 197229 - DNA, 20 bp, Artificial Sequence
  chemically synthesized
atctgaccatacaatttgca

SEQ ID NO: 197230 - DNA, 20 bp, Artificial Sequence
  chemically synthesized
tgaccatacaatttgcaaag

SEQ ID NO: 197231 - DNA, 20 bp, Artificial Sequence
  chemically synthesized
agcagataaattacataatt

SEQ ID NO: 197232 - DNA, 20 bp, Artificial Sequence
  chemically synthesized
cataccttactattcagatg

SEQ ID NO: 197233 - DNA, 20 bp, Artificial Sequence
  chemically synthesized
cattgaatacttcatctgaa

SEQ ID NO: 197234 - DNA, 20 bp, Artificial Sequence
  chemically synthesized
gaatacttcatctgaatagt

SEQ ID NO: 197235 - DNA, 20 bp, Artificial Sequence
  chemically synthesized
aatacttcatctgaatagta

SEQ ID NO: 197236 - DNA, 20 bp, Artificial Sequence
  chemically synthesized
gatattcataccttactatt

SEQ ID NO: 197237 - DNA, 20 bp, Artificial Sequence
  chemically synthesized
agtaaggtatgaatatctaa

SEQ ID NO: 197238 - DNA, 20 bp, Artificial Sequence
  chemically synthesized
ttagaaaacagagaggccat

SEQ ID NO: 197239 - DNA, 20 bp, Artificial Sequence
  chemically synthesized
gcagattttagaaaacagag

SEQ ID NO: 197240 - DNA, 20 bp, Artificial Sequence
  chemically synthesized
agcagattttagaaaacaga

SEQ ID NO: 197241 - DNA, 20 bp, Artificial Sequence
  chemically synthesized
ctagcagattttagaaaaca

SEQ ID NO: 197242 - DNA, 20 bp, Artificial Sequence
  chemically synthesized
ctctagcagattttagaaaa

SEQ ID NO: 197243 - DNA, 20 bp, Artificial Sequence
  chemically synthesized
attctgactctagcagattt

SEQ ID NO: 197244 - DNA, 20 bp, Artificial Sequence
  chemically synthesized
ctctgttttctaaaatctgc

SEQ ID NO: 197245 - DNA, 20 bp, Artificial Sequence
  chemically synthesized
ctgttttctaaaatctgcta

SEQ ID NO: 197246 - DNA, 20 bp, Artificial Sequence
  chemically synthesized
tttctaaaatctgctagagt

SEQ ID NO: 197247 - DNA, 20 bp, Artificial Sequence
  chemically synthesized
acatgacattctgactctag

SEQ ID NO: 197248 - DNA, 20 bp, Artificial Sequence
  chemically synthesized
tgtacatgacattctgactc

SEQ ID NO: 197249 - DNA, 20 bp, Artificial Sequence
  chemically synthesized
agagtcagaatgtcatgtac

SEQ ID NO: 197250 - DNA, 20 bp, Artificial Sequence
  chemically synthesized
aatgtcatgtacaagttcta

SEQ ID NO: 197251 - DNA, 20 bp, Artificial Sequence
  chemically synthesized
tttttctcttaaaaattctt

SEQ ID NO: 197252 - DNA, 20 bp, Artificial Sequence
  chemically synthesized
acaagttctaaagaattttt

SEQ ID NO: 197253 - DNA, 20 bp, Artificial Sequence
  chemically synthesized
aagttctaaagaatttttaa

SEQ ID NO: 197254 - DNA, 20 bp, Artificial Sequence
  chemically synthesized
taaagaatttttaagagaaa

SEQ ID NO: 197255 - DNA, 20 bp, Artificial Sequence
  chemically synthesized
aaagaatttttaagagaaaa

SEQ ID NO: 197256 - DNA, 20 bp, Artificial Sequence
  chemically synthesized
aagaatttttaagagaaaaa

SEQ ID NO: 197257 - DNA, 20 bp, Artificial Sequence
  chemically synthesized
ttaagagaaaaagggaatta

SEQ ID NO: 197258 - DNA, 20 bp, Artificial Sequence
  chemically synthesized
taagagaaaaagggaattaa

SEQ ID NO: 197259 - DNA, 20 bp, Artificial Sequence
  chemically synthesized
aaagggaattaaaggttatt

SEQ ID NO: 197260 - DNA, 20 bp, Artificial Sequence
  chemically synthesized
actgataaaaatagatttca

SEQ ID NO: 197261 - DNA, 20 bp, Artificial Sequence
  chemically synthesized
actttgaaatctatttttat

SEQ ID NO: 197262 - DNA, 20 bp, Artificial Sequence
  chemically synthesized
ccagtgtcaactgataaaaa

SEQ ID NO: 197263 - DNA, 20 bp, Artificial Sequence
  chemically synthesized
ctatttttatcagttgacac

SEQ ID NO: 197264 - DNA, 20 bp, Artificial Sequence
  chemically synthesized
tttttatcagttgacactgg

SEQ ID NO: 197265 - DNA, 20 bp, Artificial Sequence
  chemically synthesized
tttatcagttgacactggaa

SEQ ID NO: 197266 - DNA, 20 bp, Artificial Sequence
  chemically synthesized
gtatacccacgtttctcttc

SEQ ID NO: 197267 - DNA, 20 bp, Artificial Sequence
  chemically synthesized
ttgacactggaagagaaacg

SEQ ID NO: 197268 - DNA, 20 bp, Artificial Sequence
  chemically synthesized
tgacactggaagagaaacgt

SEQ ID NO: 197269 - DNA, 20 bp, Artificial Sequence
  chemically synthesized
tatataaactataaagacag

SEQ ID NO: 197270 - DNA, 20 bp, Artificial Sequence
  chemically synthesized
acatatatcttctgtcttta

SEQ ID NO: 197271 - DNA, 20 bp, Artificial Sequence
  chemically synthesized
atctatataaactataaaga

SEQ ID NO: 197272 - DNA, 20 bp, Artificial Sequence
  chemically synthesized
ttgaatctatataaactata

SEQ ID NO: 197273 - DNA, 20 bp, Artificial Sequence
  chemically synthesized
ttctgtctttatagtttata

SEQ ID NO: 197274 - DNA, 20 bp, Artificial Sequence
  chemically synthesized
tatagtttatatagattcaa

SEQ ID NO: 197275 - DNA, 20 bp, Artificial Sequence
  chemically synthesized
gattcaatggaaaataaatt

SEQ ID NO: 197276 - DNA, 20 bp, Artificial Sequence
  chemically synthesized
gcctgatcaaaattcatttt

SEQ ID NO: 197277 - DNA, 20 bp, Artificial Sequence
  chemically synthesized
atctgaaaatgaattttgat

SEQ ID NO: 197278 - DNA, 20 bp, Artificial Sequence
  chemically synthesized
tctgaaaatgaattttgatc

SEQ ID NO: 197279 - DNA, 20 bp, Artificial Sequence
  chemically synthesized
aatgaattttgatcaggcca

SEQ ID NO: 197280 - DNA, 20 bp, Artificial Sequence
  chemically synthesized
atgaattttgatcaggccac

SEQ ID NO: 197281 - DNA, 20 bp, Artificial Sequence
  chemically synthesized
tctgtgtatcacacatcctg

SEQ ID NO: 197282 - DNA, 20 bp, Artificial Sequence
  chemically synthesized
gccacaggatgtgtgataca

SEQ ID NO: 197283 - DNA, 20 bp, Artificial Sequence
  chemically synthesized
aggatgtgtgatacacagaa

SEQ ID NO: 197284 - DNA, 20 bp, Artificial Sequence
  chemically synthesized
ggatgtgtgatacacagaat

SEQ ID NO: 197285 - DNA, 20 bp, Artificial Sequence
  chemically synthesized
gatgtgtgatacacagaatg

SEQ ID NO: 197286 - DNA, 20 bp, Artificial Sequence
  chemically synthesized
cacagaatggggaatgcaaa

SEQ ID NO: 197287 - DNA, 20 bp, Artificial Sequence
  chemically synthesized
acagaatggggaatgcaaac

SEQ ID NO: 197288 - DNA, 20 bp, Artificial Sequence
  chemically synthesized
cagaatggggaatgcaaaca

SEQ ID NO: 197289 - DNA, 20 bp, Artificial Sequence
  chemically synthesized
caatgtcatatattgcaaaa

SEQ ID NO: 197290 - DNA, 20 bp, Artificial Sequence
  chemically synthesized
aatgtcatatattgcaaaaa

SEQ ID NO: 197291 - DNA, 20 bp, Artificial Sequence
  chemically synthesized
attgcaaaaaaggatttgtt

SEQ ID NO: 197292 - DNA, 20 bp, Artificial Sequence
  chemically synthesized
ttgcaaaaaaggatttgttt

SEQ ID NO: 197293 - DNA, 20 bp, Artificial Sequence
  chemically synthesized
aaaaaggatttgtttgggct

SEQ ID NO: 197294 - DNA, 20 bp, Artificial Sequence
  chemically synthesized
tttgtttgggcttggaatca

SEQ ID NO: 197295 - DNA, 20 bp, Artificial Sequence
  chemically synthesized
accgagttctctttgattcc

SEQ ID NO: 197296 - DNA, 20 bp, Artificial Sequence
  chemically synthesized
tgtttgggcttggaatcaaa

SEQ ID NO: 197297 - DNA, 20 bp, Artificial Sequence
  chemically synthesized
gcttggaatcaaagagaact

SEQ ID NO: 197298 - DNA, 20 bp, Artificial Sequence
  chemically synthesized
aaaaaaaagaggattatacc

SEQ ID NO: 197299 - DNA, 20 bp, Artificial Sequence
  chemically synthesized
aaaaaaaaaaaaaaaaaaag

SEQ ID NO: 197300 - DNA, 20 bp, Artificial Sequence
  chemically synthesized
gaaaaaaaaaaaaaaaaaaa

SEQ ID NO: 197301 - DNA, 20 bp, Artificial Sequence
  chemically synthesized
aagaaaaaaaaaaaaaaaaa

SEQ ID NO: 197302 - DNA, 20 bp, Artificial Sequence
  chemically synthesized
tttttttttttttttcttct

SEQ ID NO: 197303 - DNA, 20 bp, Artificial Sequence
  chemically synthesized
tttttttttttcttctgaga

SEQ ID NO: 197304 - DNA, 20 bp, Artificial Sequence
  chemically synthesized
agagcaaaactccgtctcag

SEQ ID NO: 197305 - DNA, 20 bp, Artificial Sequence
  chemically synthesized
tttttttttcttctgagacg

SEQ ID NO: 197306 - DNA, 20 bp, Artificial Sequence
  chemically synthesized
acaagagcaaaactccgtct

SEQ ID NO: 197307 - DNA, 20 bp, Artificial Sequence
  chemically synthesized
cactccagcctgggcgacaa

SEQ ID NO: 197308 - DNA, 20 bp, Artificial Sequence
  chemically synthesized
ggagttttgctcttgtcgcc

SEQ ID NO: 197309 - DNA, 20 bp, Artificial Sequence
  chemically synthesized
gagttttgctcttgtcgccc

SEQ ID NO: 197310 - DNA, 20 bp, Artificial Sequence
  chemically synthesized
tgcactccagcctgggcgac

SEQ ID NO: 197311 - DNA, 20 bp, Artificial Sequence
  chemically synthesized
tttgctcttgtcgcccaggc

SEQ ID NO: 197312 - DNA, 20 bp, Artificial Sequence
  chemically synthesized
tgctcttgtcgcccaggctg

SEQ ID NO: 197313 - DNA, 20 bp, Artificial Sequence
  chemically synthesized
gtgccattgcactccagcct

SEQ ID NO: 197314 - DNA, 20 bp, Artificial Sequence
  chemically synthesized
cgtgccattgcactccagcc

SEQ ID NO: 197315 - DNA, 20 bp, Artificial Sequence
  chemically synthesized
gagatcgtgccattgcactc

SEQ ID NO: 197316 - DNA, 20 bp, Artificial Sequence
  chemically synthesized
tcgcccaggctggagtgcaa

SEQ ID NO: 197317 - DNA, 20 bp, Artificial Sequence
  chemically synthesized
ggagtgcaatggcacgatct

SEQ ID NO: 197318 - DNA, 20 bp, Artificial Sequence
  chemically synthesized
ggcggagtttgcagtgagcc

SEQ ID NO: 197319 - DNA, 20 bp, Artificial Sequence
  chemically synthesized
cgggaggcggagtttgcagt

SEQ ID NO: 197320 - DNA, 20 bp, Artificial Sequence
  chemically synthesized
aacccgggaggcggagtttg

SEQ ID NO: 197321 - DNA, 20 bp, Artificial Sequence
  chemically synthesized
tcactgcaaactccgcctcc

SEQ ID NO: 197322 - DNA, 20 bp, Artificial Sequence
  chemically synthesized
tcacttgaacccgggaggcg

SEQ ID NO: 197323 - DNA, 20 bp, Artificial Sequence
  chemically synthesized
cactgcaaactccgcctccc

SEQ ID NO: 197324 - DNA, 20 bp, Artificial Sequence
  chemically synthesized
aatcacttgaacccgggagg

SEQ ID NO: 197325 - DNA, 20 bp, Artificial Sequence
  chemically synthesized
gagaatcacttgaacccggg

SEQ ID NO: 197326 - DNA, 20 bp, Artificial Sequence
  chemically synthesized
ggagaatcacttgaacccgg

SEQ ID NO: 197327 - DNA, 20 bp, Artificial Sequence
  chemically synthesized
aaactccgcctcccgggttc

SEQ ID NO: 197328 - DNA, 20 bp, Artificial Sequence
  chemically synthesized
taggagaatcacttgaaccc

SEQ ID NO: 197329 - DNA, 20 bp, Artificial Sequence
  chemically synthesized
gtaggagaatcacttgaacc

SEQ ID NO: 197330 - DNA, 20 bp, Artificial Sequence
  chemically synthesized
ttcaagtgattctcctacct

SEQ ID NO: 197331 - DNA, 20 bp, Artificial Sequence
  chemically synthesized
tactcgggaggctgaggtag

SEQ ID NO: 197332 - DNA, 20 bp, Artificial Sequence
  chemically synthesized
gctactcgggaggctgaggt

SEQ ID NO: 197333 - DNA, 20 bp, Artificial Sequence
  chemically synthesized
agctactcgggaggctgagg

SEQ ID NO: 197334 - DNA, 20 bp, Artificial Sequence
  chemically synthesized
ctcagctactcgggaggctg

SEQ ID NO: 197335 - DNA, 20 bp, Artificial Sequence
  chemically synthesized
tctcagctactcgggaggct

SEQ ID NO: 197336 - DNA, 20 bp, Artificial Sequence
  chemically synthesized
ttctcctacctcagcctccc

SEQ ID NO: 197337 - DNA, 20 bp, Artificial Sequence
  chemically synthesized
tcctacctcagcctcccgag

SEQ ID NO: 197338 - DNA, 20 bp, Artificial Sequence
  chemically synthesized
tgtaatctcagctactcggg

SEQ ID NO: 197339 - DNA, 20 bp, Artificial Sequence
  chemically synthesized
ctgtaatctcagctactcgg

SEQ ID NO: 197340 - DNA, 20 bp, Artificial Sequence
  chemically synthesized
acctgtaatctcagctactc

SEQ ID NO: 197341 - DNA, 20 bp, Artificial Sequence
  chemically synthesized
cctcagcctcccgagtagct

SEQ ID NO: 197342 - DNA, 20 bp, Artificial Sequence
  chemically synthesized
cacctgtaatctcagctact

SEQ ID NO: 197343 - DNA, 20 bp, Artificial Sequence
  chemically synthesized
ctcccgagtagctgagatta

SEQ ID NO: 197344 - DNA, 20 bp, Artificial Sequence
  chemically synthesized
tcccgagtagctgagattac

SEQ ID NO: 197345 - DNA, 20 bp, Artificial Sequence
  chemically synthesized
gtggcacgcacctgtaatct

SEQ ID NO: 197346 - DNA, 20 bp, Artificial Sequence
  chemically synthesized
caggtgcgtgccaccacgcc

SEQ ID NO: 197347 - DNA, 20 bp, Artificial Sequence
  chemically synthesized
gtaaaattagctgggcgtgg

SEQ ID NO: 197348 - DNA, 20 bp, Artificial Sequence
  chemically synthesized
atagtaaaattagctgggcg

SEQ ID NO: 197349 - DNA, 20 bp, Artificial Sequence
  chemically synthesized
taaaaatagtaaaattagct

SEQ ID NO: 197350 - DNA, 20 bp, Artificial Sequence
  chemically synthesized
ctaaaaatagtaaaattagc

SEQ ID NO: 197351 - DNA, 20 bp, Artificial Sequence
  chemically synthesized
tttactaaaaatagtaaaat

SEQ ID NO: 197352 - DNA, 20 bp, Artificial Sequence
  chemically synthesized
ccagctaattttactatttt

SEQ ID NO: 197353 - DNA, 20 bp, Artificial Sequence
  chemically synthesized
gaccccgtctttactaaaaa

SEQ ID NO: 197354 - DNA, 20 bp, Artificial Sequence
  chemically synthesized
taattttactatttttagta

SEQ ID NO: 197355 - DNA, 20 bp, Artificial Sequence
  chemically synthesized
tttactatttttagtaaaga

SEQ ID NO: 197356 - DNA, 20 bp, Artificial Sequence
  chemically synthesized
ttactatttttagtaaagac

SEQ ID NO: 197357 - DNA, 20 bp, Artificial Sequence
  chemically synthesized
tactatttttagtaaagacg

SEQ ID NO: 197358 - DNA, 20 bp, Artificial Sequence
  chemically synthesized
aagacggggtctcaccatgt

SEQ ID NO: 197359 - DNA, 20 bp, Artificial Sequence
  chemically synthesized
accatcctggccaacatggt

SEQ ID NO: 197360 - DNA, 20 bp, Artificial Sequence
  chemically synthesized
cggggtctcaccatgttggc

SEQ ID NO: 197361 - DNA, 20 bp, Artificial Sequence
  chemically synthesized
tgagaccatcctggccaaca

SEQ ID NO: 197362 - DNA, 20 bp, Artificial Sequence
  chemically synthesized
ggggtctcaccatgttggcc

SEQ ID NO: 197363 - DNA, 20 bp, Artificial Sequence
  chemically synthesized
tctcaccatgttggccagga

SEQ ID NO: 197364 - DNA, 20 bp, Artificial Sequence
  chemically synthesized
tcaagagattgagaccatcc

SEQ ID NO: 197365 - DNA, 20 bp, Artificial Sequence
  chemically synthesized
gatcatgaggtcaagagatt

SEQ ID NO: 197366 - DNA, 20 bp, Artificial Sequence
  chemically synthesized
cgggcggatcatgaggtcaa

SEQ ID NO: 197367 - DNA, 20 bp, Artificial Sequence
  chemically synthesized
ggcgggcggatcatgaggtc

SEQ ID NO: 197368 - DNA, 20 bp, Artificial Sequence
  chemically synthesized
gccgaggcgggcggatcatg

SEQ ID NO: 197369 - DNA, 20 bp, Artificial Sequence
  chemically synthesized
ggccgaggcgggcggatcat

SEQ ID NO: 197370 - DNA, 20 bp, Artificial Sequence
  chemically synthesized
acctcatgatccgcccgcct

SEQ ID NO: 197371 - DNA, 20 bp, Artificial Sequence
  chemically synthesized
cttcaggaggccgaggcggg

SEQ ID NO: 197372 - DNA, 20 bp, Artificial Sequence
  chemically synthesized
gcgcttcaggaggccgaggc

SEQ ID NO: 197373 - DNA, 20 bp, Artificial Sequence
  chemically synthesized
agcgcttcaggaggccgagg

SEQ ID NO: 197374 - DNA, 20 bp, Artificial Sequence
  chemically synthesized
ctcagcgcttcaggaggccg

SEQ ID NO: 197375 - DNA, 20 bp, Artificial Sequence
  chemically synthesized
tctcagcgcttcaggaggcc

SEQ ID NO: 197376 - DNA, 20 bp, Artificial Sequence
  chemically synthesized
ccgcccgcctcggcctcctg

SEQ ID NO: 197377 - DNA, 20 bp, Artificial Sequence
  chemically synthesized
tgtaatctcagcgcttcagg

SEQ ID NO: 197378 - DNA, 20 bp, Artificial Sequence
  chemically synthesized
ctgtaatctcagcgcttcag

SEQ ID NO: 197379 - DNA, 20 bp, Artificial Sequence
  chemically synthesized
gcctgtaatctcagcgcttc

SEQ ID NO: 197380 - DNA, 20 bp, Artificial Sequence
  chemically synthesized
cctcggcctcctgaagcgct

SEQ ID NO: 197381 - DNA, 20 bp, Artificial Sequence
  chemically synthesized
tgcctgtaatctcagcgctt

SEQ ID NO: 197382 - DNA, 20 bp, Artificial Sequence
  chemically synthesized
ctcctgaagcgctgagatta

SEQ ID NO: 197383 - DNA, 20 bp, Artificial Sequence
  chemically synthesized
tcctgaagcgctgagattac

SEQ ID NO: 197384 - DNA, 20 bp, Artificial Sequence
  chemically synthesized
gtagctcatgcctgtaatct

SEQ ID NO: 197385 - DNA, 20 bp, Artificial Sequence
  chemically synthesized
agcgctgagattacaggcat

SEQ ID NO: 197386 - DNA, 20 bp, Artificial Sequence
  chemically synthesized
caggcatgagctactgcgcc

SEQ ID NO: 197387 - DNA, 20 bp, Artificial Sequence
  chemically synthesized
caagttctggccgggcgcag

SEQ ID NO: 197388 - DNA, 20 bp, Artificial Sequence
  chemically synthesized
taccaagttctggccgggcg

SEQ ID NO: 197389 - DNA, 20 bp, Artificial Sequence
  chemically synthesized
catgagctactgcgcccggc

SEQ ID NO: 197390 - DNA, 20 bp, Artificial Sequence
  chemically synthesized
aattataccaagttctggcc

SEQ ID NO: 197391 - DNA, 20 bp, Artificial Sequence
  chemically synthesized
gaattataccaagttctggc

SEQ ID NO: 197392 - DNA, 20 bp, Artificial Sequence
  chemically synthesized
tactgcgcccggccagaact

SEQ ID NO: 197393 - DNA, 20 bp, Artificial Sequence
  chemically synthesized
ggaagaattataccaagttc

SEQ ID NO: 197394 - DNA, 20 bp, Artificial Sequence
  chemically synthesized
gtgaatggaagaattatacc

SEQ ID NO: 197395 - DNA, 20 bp, Artificial Sequence
  chemically synthesized
gttgcaaagaaagtgaatgg

SEQ ID NO: 197396 - DNA, 20 bp, Artificial Sequence
  chemically synthesized
gaagttgcaaagaaagtgaa

SEQ ID NO: 197397 - DNA, 20 bp, Artificial Sequence
  chemically synthesized
tttttccgaagttgcaaaga

SEQ ID NO: 197398 - DNA, 20 bp, Artificial Sequence
  chemically synthesized
gaaatttttccgaagttgca

SEQ ID NO: 197399 - DNA, 20 bp, Artificial Sequence
  chemically synthesized
attcactttctttgcaactt

SEQ ID NO: 197400 - DNA, 20 bp, Artificial Sequence
  chemically synthesized
ataagttagaaatttttccg

SEQ ID NO: 197401 - DNA, 20 bp, Artificial Sequence
  chemically synthesized
gaaaactgatgttcataagt

SEQ ID NO: 197402 - DNA, 20 bp, Artificial Sequence
  chemically synthesized
ttgagaaaactgatgttcat

SEQ ID NO: 197403 - DNA, 20 bp, Artificial Sequence
  chemically synthesized
aatttctaacttatgaacat

SEQ ID NO: 197404 - DNA, 20 bp, Artificial Sequence
  chemically synthesized
atagttattatacagtaatt

SEQ ID NO: 197405 - DNA, 20 bp, Artificial Sequence
  chemically synthesized
gtgatagcatagttattata

SEQ ID NO: 197406 - DNA, 20 bp, Artificial Sequence
  chemically synthesized
aatccttcaaagtgatagca

SEQ ID NO: 197407 - DNA, 20 bp, Artificial Sequence
  chemically synthesized
ctaggaatccttcaaagtga

SEQ ID NO: 197408 - DNA, 20 bp, Artificial Sequence
  chemically synthesized
ataactatgctatcactttg

SEQ ID NO: 197409 - DNA, 20 bp, Artificial Sequence
  chemically synthesized
taactatgctatcactttga

SEQ ID NO: 197410 - DNA, 20 bp, Artificial Sequence
  chemically synthesized
atgctcctaggaatccttca

SEQ ID NO: 197411 - DNA, 20 bp, Artificial Sequence
  chemically synthesized
ctatcactttgaaggattcc

SEQ ID NO: 197412 - DNA, 20 bp, Artificial Sequence
  chemically synthesized
tatcactttgaaggattcct

SEQ ID NO: 197413 - DNA, 20 bp, Artificial Sequence
  chemically synthesized
tcactttgaaggattcctag

SEQ ID NO: 197414 - DNA, 20 bp, Artificial Sequence
  chemically synthesized
accctacatttaatgctcct

SEQ ID NO: 197415 - DNA, 20 bp, Artificial Sequence
  chemically synthesized
caccctacatttaatgctcc

SEQ ID NO: 197416 - DNA, 20 bp, Artificial Sequence
  chemically synthesized
attcctaggagcattaaatg

SEQ ID NO: 197417 - DNA, 20 bp, Artificial Sequence
  chemically synthesized
ttcctaggagcattaaatgt

SEQ ID NO: 197418 - DNA, 20 bp, Artificial Sequence
  chemically synthesized
tcctaggagcattaaatgta

SEQ ID NO: 197419 - DNA, 20 bp, Artificial Sequence
  chemically synthesized
ttagatacctgcagtaggac

SEQ ID NO: 197420 - DNA, 20 bp, Artificial Sequence
  chemically synthesized
cttagatacctgcagtagga

SEQ ID NO: 197421 - DNA, 20 bp, Artificial Sequence
  chemically synthesized
gtagggtgcctgtcctactg

SEQ ID NO: 197422 - DNA, 20 bp, Artificial Sequence
  chemically synthesized
tagggtgcctgtcctactgc

SEQ ID NO: 197423 - DNA, 20 bp, Artificial Sequence
  chemically synthesized
aggtcttagatacctgcagt

SEQ ID NO: 197424 - DNA, 20 bp, Artificial Sequence
  chemically synthesized
caggtcttagatacctgcag

SEQ ID NO: 197425 - DNA, 20 bp, Artificial Sequence
  chemically synthesized
ccccaggtcttagatacctg

SEQ ID NO: 197426 - DNA, 20 bp, Artificial Sequence
  chemically synthesized
ctgtcctactgcaggtatct

SEQ ID NO: 197427 - DNA, 20 bp, Artificial Sequence
  chemically synthesized
tactgcaggtatctaagacc

SEQ ID NO: 197428 - DNA, 20 bp, Artificial Sequence
  chemically synthesized
actgcaggtatctaagacct

SEQ ID NO: 197429 - DNA, 20 bp, Artificial Sequence
  chemically synthesized
ctgcaggtatctaagacctg

SEQ ID NO: 197430 - DNA, 20 bp, Artificial Sequence
  chemically synthesized
tgataataccccccaggtct

SEQ ID NO: 197431 - DNA, 20 bp, Artificial Sequence
  chemically synthesized
tgcaggtatctaagacctgg

SEQ ID NO: 197432 - DNA, 20 bp, Artificial Sequence
  chemically synthesized
gcaggtatctaagacctggg

SEQ ID NO: 197433 - DNA, 20 bp, Artificial Sequence
  chemically synthesized
ctaagatgataatacccccc

SEQ ID NO: 197434 - DNA, 20 bp, Artificial Sequence
  chemically synthesized
actaagatgataataccccc

SEQ ID NO: 197435 - DNA, 20 bp, Artificial Sequence
  chemically synthesized
cctggggggtattatcatct

SEQ ID NO: 197436 - DNA, 20 bp, Artificial Sequence
  chemically synthesized
gcattatttgatgataaact

SEQ ID NO: 197437 - DNA, 20 bp, Artificial Sequence
  chemically synthesized
agtttatcatcaaataatgc

SEQ ID NO: 197438 - DNA, 20 bp, Artificial Sequence
  chemically synthesized
tttatcatcaaataatgcta

SEQ ID NO: 197439 - DNA, 20 bp, Artificial Sequence
  chemically synthesized
atcatcaaataatgctagag

SEQ ID NO: 197440 - DNA, 20 bp, Artificial Sequence
  chemically synthesized
tcatcaaataatgctagaga

SEQ ID NO: 197441 - DNA, 20 bp, Artificial Sequence
  chemically synthesized
ctaatgctggtttccttctc

SEQ ID NO: 197442 - DNA, 20 bp, Artificial Sequence
  chemically synthesized
ataatgctagagaaggaaac

SEQ ID NO: 197443 - DNA, 20 bp, Artificial Sequence
  chemically synthesized
ctagagaaggaaaccagcat

SEQ ID NO: 197444 - DNA, 20 bp, Artificial Sequence
  chemically synthesized
tagaacagcagaactaatgc

SEQ ID NO: 197445 - DNA, 20 bp, Artificial Sequence
  chemically synthesized
tagtgaagagggtagaacag

SEQ ID NO: 197446 - DNA, 20 bp, Artificial Sequence
  chemically synthesized
tgttagtgaagagggtagaa

SEQ ID NO: 197447 - DNA, 20 bp, Artificial Sequence
  chemically synthesized
aattctgttagtgaagaggg

SEQ ID NO: 197448 - DNA, 20 bp, Artificial Sequence
  chemically synthesized
tcaaattctgttagtgaaga

SEQ ID NO: 197449 - DNA, 20 bp, Artificial Sequence
  chemically synthesized
atcaaattctgttagtgaag

SEQ ID NO: 197450 - DNA, 20 bp, Artificial Sequence
  chemically synthesized
tatcaaattctgttagtgaa

SEQ ID NO: 197451 - DNA, 20 bp, Artificial Sequence
  chemically synthesized
tgttctaccctcttcactaa

SEQ ID NO: 197452 - DNA, 20 bp, Artificial Sequence
  chemically synthesized
attatcaaattctgttagtg

SEQ ID NO: 197453 - DNA, 20 bp, Artificial Sequence
  chemically synthesized
tgtagattatcaaattctgt

SEQ ID NO: 197454 - DNA, 20 bp, Artificial Sequence
  chemically synthesized
gaatttgataatctacattt

SEQ ID NO: 197455 - DNA, 20 bp, Artificial Sequence
  chemically synthesized
ttagaggtctcactcaaatg

SEQ ID NO: 197456 - DNA, 20 bp, Artificial Sequence
  chemically synthesized
ttgataatctacatttgagt

SEQ ID NO: 197457 - DNA, 20 bp, Artificial Sequence
  chemically synthesized
gcatgtcttctattatttag

SEQ ID NO: 197458 - DNA, 20 bp, Artificial Sequence
  chemically synthesized
tgagtgagacctctaaataa

SEQ ID NO: 197459 - DNA, 20 bp, Artificial Sequence
  chemically synthesized
tgcatgtcttctattattta

SEQ ID NO: 197460 - DNA, 20 bp, Artificial Sequence
  chemically synthesized
gctgcatgtcttctattatt

SEQ ID NO: 197461 - DNA, 20 bp, Artificial Sequence
  chemically synthesized
gtgagacctctaaataatag

SEQ ID NO: 197462 - DNA, 20 bp, Artificial Sequence
  chemically synthesized
tctaaataatagaagacatg

SEQ ID NO: 197463 - DNA, 20 bp, Artificial Sequence
  chemically synthesized
aataatagaagacatgcagc

SEQ ID NO: 197464 - DNA, 20 bp, Artificial Sequence
  chemically synthesized
atacacgtcgatattgtgac

SEQ ID NO: 197465 - DNA, 20 bp, Artificial Sequence
  chemically synthesized
tgcagttttattgacagagt

SEQ ID NO: 197466 - DNA, 20 bp, Artificial Sequence
  chemically synthesized
taagtgcagttttattgaca

SEQ ID NO: 197467 - DNA, 20 bp, Artificial Sequence
  chemically synthesized
tgtaagtgcagttttattga

SEQ ID NO: 197468 - DNA, 20 bp, Artificial Sequence
  chemically synthesized
cttttctgtttttgtaagtg

SEQ ID NO: 197469 - DNA, 20 bp, Artificial Sequence
  chemically synthesized
taaaactgcacttacaaaaa

SEQ ID NO: 197470 - DNA, 20 bp, Artificial Sequence
  chemically synthesized
ttttgcttttctgtttttgt

SEQ ID NO: 197471 - DNA, 20 bp, Artificial Sequence
  chemically synthesized
ctgcacttacaaaaacagaa

SEQ ID NO: 197472 - DNA, 20 bp, Artificial Sequence
  chemically synthesized
atattttatttataatgtta

SEQ ID NO: 197473 - DNA, 20 bp, Artificial Sequence
  chemically synthesized
tattttatttataatgttaa

SEQ ID NO: 197474 - DNA, 20 bp, Artificial Sequence
  chemically synthesized
tttatttataatgttaaagg

SEQ ID NO: 197475 - DNA, 20 bp, Artificial Sequence
  chemically synthesized
tatttataatgttaaaggaa

SEQ ID NO: 197476 - DNA, 20 bp, Artificial Sequence
  chemically synthesized
ataatgttaaaggaagagaa

SEQ ID NO: 197477 - DNA, 20 bp, Artificial Sequence
  chemically synthesized
aagagaatggtgctcctaaa

SEQ ID NO: 197478 - DNA, 20 bp, Artificial Sequence
  chemically synthesized
tatgtcccttttctttttag

SEQ ID NO: 197479 - DNA, 20 bp, Artificial Sequence
  chemically synthesized
tttatgtcccttttcttttt

SEQ ID NO: 197480 - DNA, 20 bp, Artificial Sequence
  chemically synthesized
aatggtgctcctaaaaagaa

SEQ ID NO: 197481 - DNA, 20 bp, Artificial Sequence
  chemically synthesized
atttatgtcccttttctttt

SEQ ID NO: 197482 - DNA, 20 bp, Artificial Sequence
  chemically synthesized
atggtgctcctaaaaagaaa

SEQ ID NO: 197483 - DNA, 20 bp, Artificial Sequence
  chemically synthesized
tggtgctcctaaaaagaaaa

SEQ ID NO: 197484 - DNA, 20 bp, Artificial Sequence
  chemically synthesized
taaattgacataaatatgtc

SEQ ID NO: 197485 - DNA, 20 bp, Artificial Sequence
  chemically synthesized
aattgacataaatatgtcaa

SEQ ID NO: 197486 - DNA, 20 bp, Artificial Sequence
  chemically synthesized
attgacataaatatgtcaag

SEQ ID NO: 197487 - DNA, 20 bp, Artificial Sequence
  chemically synthesized
taaatatgtcaagaggaaaa

SEQ ID NO: 197488 - DNA, 20 bp, Artificial Sequence
  chemically synthesized
tactttttggtatattcaaa

SEQ ID NO: 197489 - DNA, 20 bp, Artificial Sequence
  chemically synthesized
tgtactttttggtatattca

SEQ ID NO: 197490 - DNA, 20 bp, Artificial Sequence
  chemically synthesized
ttctctttgaatataccaaa

SEQ ID NO: 197491 - DNA, 20 bp, Artificial Sequence
  chemically synthesized
gtgatgttatatgtactttt

SEQ ID NO: 197492 - DNA, 20 bp, Artificial Sequence
  chemically synthesized
aaaaagtacatataacatca

SEQ ID NO: 197493 - DNA, 20 bp, Artificial Sequence
  chemically synthesized
catcacagcactattcacaa

SEQ ID NO: 197494 - DNA, 20 bp, Artificial Sequence
  chemically synthesized
catgtctttgccattgtgaa

SEQ ID NO: 197495 - DNA, 20 bp, Artificial Sequence
  chemically synthesized
cagcactattcacaatggca

SEQ ID NO: 197496 - DNA, 20 bp, Artificial Sequence
  chemically synthesized
gcaaagacatgcaatcaacc

SEQ ID NO: 197497 - DNA, 20 bp, Artificial Sequence
  chemically synthesized
caaagacatgcaatcaacct

SEQ ID NO: 197498 - DNA, 20 bp, Artificial Sequence
  chemically synthesized
tccaccattaatgggcacct

SEQ ID NO: 197499 - DNA, 20 bp, Artificial Sequence
  chemically synthesized
gtccaccattaatgggcacc

SEQ ID NO: 197500 - DNA, 20 bp, Artificial Sequence
  chemically synthesized
tcaacctaggtgcccattaa

SEQ ID NO: 197501 - DNA, 20 bp, Artificial Sequence
  chemically synthesized
ttatcctgtccaccattaat

SEQ ID NO: 197502 - DNA, 20 bp, Artificial Sequence
  chemically synthesized
acctaggtgcccattaatgg

SEQ ID NO: 197503 - DNA, 20 bp, Artificial Sequence
  chemically synthesized
tttatcctgtccaccattaa

SEQ ID NO: 197504 - DNA, 20 bp, Artificial Sequence
  chemically synthesized
aggtgcccattaatggtgga

SEQ ID NO: 197505 - DNA, 20 bp, Artificial Sequence
  chemically synthesized
ggtgcccattaatggtggac

SEQ ID NO: 197506 - DNA, 20 bp, Artificial Sequence
  chemically synthesized
cattaatggtggacaggata

SEQ ID NO: 197507 - DNA, 20 bp, Artificial Sequence
  chemically synthesized
ggtggacaggataaagaatg

SEQ ID NO: 197508 - DNA, 20 bp, Artificial Sequence
  chemically synthesized
aatgtggcgcgtatacacca

SEQ ID NO: 197509 - DNA, 20 bp, Artificial Sequence
  chemically synthesized
tatggctgtgtagtattcca

SEQ ID NO: 197510 - DNA, 20 bp, Artificial Sequence
  chemically synthesized
atacaccatggaatactaca

SEQ ID NO: 197511 - DNA, 20 bp, Artificial Sequence
  chemically synthesized
tgttagtttttatggctgtg

SEQ ID NO: 197512 - DNA, 20 bp, Artificial Sequence
  chemically synthesized
catgattttgttagttttta

SEQ ID NO: 197513 - DNA, 20 bp, Artificial Sequence
  chemically synthesized
tgcacaggccatgattttgt

SEQ ID NO: 197514 - DNA, 20 bp, Artificial Sequence
  chemically synthesized
cataaaaactaacaaaatca

SEQ ID NO: 197515 - DNA, 20 bp, Artificial Sequence
  chemically synthesized
ttgcatccatgttgttgcac

SEQ ID NO: 197516 - DNA, 20 bp, Artificial Sequence
  chemically synthesized
attgcatccatgttgttgca

SEQ ID NO: 197517 - DNA, 20 bp, Artificial Sequence
  chemically synthesized
tcatggcctgtgcaacaaca

SEQ ID NO: 197518 - DNA, 20 bp, Artificial Sequence
  chemically synthesized
tgcaacaacatggatgcaat

SEQ ID NO: 197519 - DNA, 20 bp, Artificial Sequence
  chemically synthesized
caacaacatggatgcaattg

SEQ ID NO: 197520 - DNA, 20 bp, Artificial Sequence
  chemically synthesized
aacaacatggatgcaattgg

SEQ ID NO: 197521 - DNA, 20 bp, Artificial Sequence
  chemically synthesized
caattggaggccactatcct

SEQ ID NO: 197522 - DNA, 20 bp, Artificial Sequence
  chemically synthesized
cgttaacgtgcttaggatag

SEQ ID NO: 197523 - DNA, 20 bp, Artificial Sequence
  chemically synthesized
ctgcgttaacgtgcttagga

SEQ ID NO: 197524 - DNA, 20 bp, Artificial Sequence
  chemically synthesized
gttcctgcgttaacgtgctt

SEQ ID NO: 197525 - DNA, 20 bp, Artificial Sequence
  chemically synthesized
tgttcctgcgttaacgtgct

SEQ ID NO: 197526 - DNA, 20 bp, Artificial Sequence
  chemically synthesized
ctatcctaagcacgttaacg

SEQ ID NO: 197527 - DNA, 20 bp, Artificial Sequence
  chemically synthesized
tatcctaagcacgttaacgc

SEQ ID NO: 197528 - DNA, 20 bp, Artificial Sequence
  chemically synthesized
taagcacgttaacgcaggaa

SEQ ID NO: 197529 - DNA, 20 bp, Artificial Sequence
  chemically synthesized
ttaacgcaggaacagacaac

SEQ ID NO: 197530 - DNA, 20 bp, Artificial Sequence
  chemically synthesized
cacttttaagcgagaacatg

SEQ ID NO: 197531 - DNA, 20 bp, Artificial Sequence
  chemically synthesized
tactgcatgttctcgcttaa

SEQ ID NO: 197532 - DNA, 20 bp, Artificial Sequence
  chemically synthesized
tttagctcccacttttaagc

SEQ ID NO: 197533 - DNA, 20 bp, Artificial Sequence
  chemically synthesized
tgcatgttctcgcttaaaag

SEQ ID NO: 197534 - DNA, 20 bp, Artificial Sequence
  chemically synthesized
gcatgttctcgcttaaaagt

SEQ ID NO: 197535 - DNA, 20 bp, Artificial Sequence
  chemically synthesized
aatgtttagctcccactttt

SEQ ID NO: 197536 - DNA, 20 bp, Artificial Sequence
  chemically synthesized
atgttctcgcttaaaagtgg

SEQ ID NO: 197537 - DNA, 20 bp, Artificial Sequence
  chemically synthesized
aaaagtgggagctaaacatt

SEQ ID NO: 197538 - DNA, 20 bp, Artificial Sequence
  chemically synthesized
gtccatgtgcactcaatgtt

SEQ ID NO: 197539 - DNA, 20 bp, Artificial Sequence
  chemically synthesized
agctaaacattgagtgcaca

SEQ ID NO: 197540 - DNA, 20 bp, Artificial Sequence
  chemically synthesized
attgagtgcacatggacata

SEQ ID NO: 197541 - DNA, 20 bp, Artificial Sequence
  chemically synthesized
agtgcacatggacataaaga

SEQ ID NO: 197542 - DNA, 20 bp, Artificial Sequence
  chemically synthesized
gtgcacatggacataaagac

SEQ ID NO: 197543 - DNA, 20 bp, Artificial Sequence
  chemically synthesized
ggacataaagacaggaacaa

SEQ ID NO: 197544 - DNA, 20 bp, Artificial Sequence
  chemically synthesized
aagacaggaacaatagacac

SEQ ID NO: 197545 - DNA, 20 bp, Artificial Sequence
  chemically synthesized
agacaggaacaatagacact

SEQ ID NO: 197546 - DNA, 20 bp, Artificial Sequence
  chemically synthesized
gacaggaacaatagacactg

SEQ ID NO: 197547 - DNA, 20 bp, Artificial Sequence
  chemically synthesized
acaatagacactggggacta

SEQ ID NO: 197548 - DNA, 20 bp, Artificial Sequence
  chemically synthesized
cctccttcctctgtagtccc

SEQ ID NO: 197549 - DNA, 20 bp, Artificial Sequence
  chemically synthesized
aatagacactggggactaca

SEQ ID NO: 197550 - DNA, 20 bp, Artificial Sequence
  chemically synthesized
atagacactggggactacag

SEQ ID NO: 197551 - DNA, 20 bp, Artificial Sequence
  chemically synthesized
gacactggggactacagagg

SEQ ID NO: 197552 - DNA, 20 bp, Artificial Sequence
  chemically synthesized
acactggggactacagagga

SEQ ID NO: 197553 - DNA, 20 bp, Artificial Sequence
  chemically synthesized
cttcctccctccttcctctg

SEQ ID NO: 197554 - DNA, 20 bp, Artificial Sequence
  chemically synthesized
actggggactacagaggaag

SEQ ID NO: 197555 - DNA, 20 bp, Artificial Sequence
  chemically synthesized
ctggggactacagaggaagg

SEQ ID NO: 197556 - DNA, 20 bp, Artificial Sequence
  chemically synthesized
tggggactacagaggaagga

SEQ ID NO: 197557 - DNA, 20 bp, Artificial Sequence
  chemically synthesized
gggactacagaggaaggagg

SEQ ID NO: 197558 - DNA, 20 bp, Artificial Sequence
  chemically synthesized
ggactacagaggaaggaggg

SEQ ID NO: 197559 - DNA, 20 bp, Artificial Sequence
  chemically synthesized
ctacagaggaaggagggagg

SEQ ID NO: 197560 - DNA, 20 bp, Artificial Sequence
  chemically synthesized
tacagaggaaggagggagga

SEQ ID NO: 197561 - DNA, 20 bp, Artificial Sequence
  chemically synthesized
acagaggaaggagggaggaa

SEQ ID NO: 197562 - DNA, 20 bp, Artificial Sequence
  chemically synthesized
ggaaggagggaggaagggaa

SEQ ID NO: 197563 - DNA, 20 bp, Artificial Sequence
  chemically synthesized
gaaggagggaggaagggaac

SEQ ID NO: 197564 - DNA, 20 bp, Artificial Sequence
  chemically synthesized
gagggaggaagggaacaggc

SEQ ID NO: 197565 - DNA, 20 bp, Artificial Sequence
  chemically synthesized
agggaggaagggaacaggca

SEQ ID NO: 197566 - DNA, 20 bp, Artificial Sequence
  chemically synthesized
gggaggaagggaacaggcaa

SEQ ID NO: 197567 - DNA, 20 bp, Artificial Sequence
  chemically synthesized
aagggaacaggcaagggttg

SEQ ID NO: 197568 - DNA, 20 bp, Artificial Sequence
  chemically synthesized
acaggcaagggttgaagaac

SEQ ID NO: 197569 - DNA, 20 bp, Artificial Sequence
  chemically synthesized
ggcaagggttgaagaactag

SEQ ID NO: 197570 - DNA, 20 bp, Artificial Sequence
  chemically synthesized
gtagcgagcatggtaaccac

SEQ ID NO: 197571 - DNA, 20 bp, Artificial Sequence
  chemically synthesized
caccacccaggtagcgagca

SEQ ID NO: 197572 - DNA, 20 bp, Artificial Sequence
  chemically synthesized
tggttaccatgctcgctacc

SEQ ID NO: 197573 - DNA, 20 bp, Artificial Sequence
  chemically synthesized
ggttaccatgctcgctacct

SEQ ID NO: 197574 - DNA, 20 bp, Artificial Sequence
  chemically synthesized
gatcccaccacccaggtagc

SEQ ID NO: 197575 - DNA, 20 bp, Artificial Sequence
  chemically synthesized
taccatgctcgctacctggg

SEQ ID NO: 197576 - DNA, 20 bp, Artificial Sequence
  chemically synthesized
gaatgatcccaccacccagg

SEQ ID NO: 197577 - DNA, 20 bp, Artificial Sequence
  chemically synthesized
catgctcgctacctgggtgg

SEQ ID NO: 197578 - DNA, 20 bp, Artificial Sequence
  chemically synthesized
atgctcgctacctgggtggt

SEQ ID NO: 197579 - DNA, 20 bp, Artificial Sequence
  chemically synthesized
tatgaatgatcccaccaccc

SEQ ID NO: 197580 - DNA, 20 bp, Artificial Sequence
  chemically synthesized
atatgaatgatcccaccacc

SEQ ID NO: 197581 - DNA, 20 bp, Artificial Sequence
  chemically synthesized
gggtggtgggatcattcata

SEQ ID NO: 197582 - DNA, 20 bp, Artificial Sequence
  chemically synthesized
ggatatagtgcatgatgatg

SEQ ID NO: 197583 - DNA, 20 bp, Artificial Sequence
  chemically synthesized
tggatatagtgcatgatgat

SEQ ID NO: 197584 - DNA, 20 bp, Artificial Sequence
  chemically synthesized
tcatcatcatgcactatatc

SEQ ID NO: 197585 - DNA, 20 bp, Artificial Sequence
  chemically synthesized
catcatcatgcactatatcc

SEQ ID NO: 197586 - DNA, 20 bp, Artificial Sequence
  chemically synthesized
atcatcatgcactatatcca

SEQ ID NO: 197587 - DNA, 20 bp, Artificial Sequence
  chemically synthesized
gggtacatgttccctggata

SEQ ID NO: 197588 - DNA, 20 bp, Artificial Sequence
  chemically synthesized
ttcagcgggtacatgttccc

SEQ ID NO: 197589 - DNA, 20 bp, Artificial Sequence
  chemically synthesized
acttttattttagattcagc

SEQ ID NO: 197590 - DNA, 20 bp, Artificial Sequence
  chemically synthesized
aacttttattttagattcag

SEQ ID NO: 197591 - DNA, 20 bp, Artificial Sequence
  chemically synthesized
ttcaacttttattttagatt

SEQ ID NO: 197592 - DNA, 20 bp, Artificial Sequence
  chemically synthesized
acccgctgaatctaaaataa

SEQ ID NO: 197593 - DNA, 20 bp, Artificial Sequence
  chemically synthesized
tataatttcaacttttattt

SEQ ID NO: 197594 - DNA, 20 bp, Artificial Sequence
  chemically synthesized
ataaaagttgaaattataaa

SEQ ID NO: 197595 - DNA, 20 bp, Artificial Sequence
  chemically synthesized
tgaaattataaaaagaaaaa

SEQ ID NO: 197596 - DNA, 20 bp, Artificial Sequence
  chemically synthesized
ttccaaagaatgttagtatg

SEQ ID NO: 197597 - DNA, 20 bp, Artificial Sequence
  chemically synthesized
tttccaaagaatgttagtat

SEQ ID NO: 197598 - DNA, 20 bp, Artificial Sequence
  chemically synthesized
taactgtttccaaagaatgt

SEQ ID NO: 197599 - DNA, 20 bp, Artificial Sequence
  chemically synthesized
aacctcatactaacattctt

SEQ ID NO: 197600 - DNA, 20 bp, Artificial Sequence
  chemically synthesized
atactaacattctttggaaa

SEQ ID NO: 197601 - DNA, 20 bp, Artificial Sequence
  chemically synthesized
atttcatttaactgtttcca

SEQ ID NO: 197602 - DNA, 20 bp, Artificial Sequence
  chemically synthesized
cagttaaatgaaattattaa

SEQ ID NO: 197603 - DNA, 20 bp, Artificial Sequence
  chemically synthesized
atacataaatattttaagcg

SEQ ID NO: 197604 - DNA, 20 bp, Artificial Sequence
  chemically synthesized
ggcccatacataaatatttt

SEQ ID NO: 197605 - DNA, 20 bp, Artificial Sequence
  chemically synthesized
tcgcttaaaatatttatgta

SEQ ID NO: 197606 - DNA, 20 bp, Artificial Sequence
  chemically synthesized
cgcttaaaatatttatgtat

SEQ ID NO: 197607 - DNA, 20 bp, Artificial Sequence
  chemically synthesized
taaaatatttatgtatgggc

SEQ ID NO: 197608 - DNA, 20 bp, Artificial Sequence
  chemically synthesized
aaaatatttatgtatgggcc

SEQ ID NO: 197609 - DNA, 20 bp, Artificial Sequence
  chemically synthesized
atttatgtatgggccgggtg

SEQ ID NO: 197610 - DNA, 20 bp, Artificial Sequence
  chemically synthesized
tatgtatgggccgggtgtag

SEQ ID NO: 197611 - DNA, 20 bp, Artificial Sequence
  chemically synthesized
catgcatgagccactacacc

SEQ ID NO: 197612 - DNA, 20 bp, Artificial Sequence
  chemically synthesized
agtgctgggattacatgcat

SEQ ID NO: 197613 - DNA, 20 bp, Artificial Sequence
  chemically synthesized
gtggctcatgcatgtaatcc

SEQ ID NO: 197614 - DNA, 20 bp, Artificial Sequence
  chemically synthesized
tgcatgtaatcccagcactg

SEQ ID NO: 197615 - DNA, 20 bp, Artificial Sequence
  chemically synthesized
ccttggcctcccacagtgct

SEQ ID NO: 197616 - DNA, 20 bp, Artificial Sequence
  chemically synthesized
gcatgtaatcccagcactgt

SEQ ID NO: 197617 - DNA, 20 bp, Artificial Sequence
  chemically synthesized
gccttggcctcccacagtgc

SEQ ID NO: 197618 - DNA, 20 bp, Artificial Sequence
  chemically synthesized
atgtaatcccagcactgtgg

SEQ ID NO: 197619 - DNA, 20 bp, Artificial Sequence
  chemically synthesized
tgtaatcccagcactgtggg

SEQ ID NO: 197620 - DNA, 20 bp, Artificial Sequence
  chemically synthesized
ccgcccgccttggcctccca

SEQ ID NO: 197621 - DNA, 20 bp, Artificial Sequence
  chemically synthesized
tcccagcactgtgggaggcc

SEQ ID NO: 197622 - DNA, 20 bp, Artificial Sequence
  chemically synthesized
cccagcactgtgggaggcca

SEQ ID NO: 197623 - DNA, 20 bp, Artificial Sequence
  chemically synthesized
agcactgtgggaggccaagg

SEQ ID NO: 197624 - DNA, 20 bp, Artificial Sequence
  chemically synthesized
gcactgtgggaggccaaggc

SEQ ID NO: 197625 - DNA, 20 bp, Artificial Sequence
  chemically synthesized
ctgtgggaggccaaggcggg

SEQ ID NO: 197626 - DNA, 20 bp, Artificial Sequence
  chemically synthesized
ctctggcagtccgcccgcct

SEQ ID NO: 197627 - DNA, 20 bp, Artificial Sequence
  chemically synthesized
ggccaaggcgggcggactgc

SEQ ID NO: 197628 - DNA, 20 bp, Artificial Sequence
  chemically synthesized
ccaaggcgggcggactgcca

SEQ ID NO: 197629 - DNA, 20 bp, Artificial Sequence
  chemically synthesized
ctcgagttcctcagctctgg

SEQ ID NO: 197630 - DNA, 20 bp, Artificial Sequence
  chemically synthesized
gcgggcggactgccagagct

SEQ ID NO: 197631 - DNA, 20 bp, Artificial Sequence
  chemically synthesized
cgggcggactgccagagctg

SEQ ID NO: 197632 - DNA, 20 bp, Artificial Sequence
  chemically synthesized
ggtctcgagttcctcagctc

SEQ ID NO: 197633 - DNA, 20 bp, Artificial Sequence
  chemically synthesized
caggctggtctcgagttcct

SEQ ID NO: 197634 - DNA, 20 bp, Artificial Sequence
  chemically synthesized
ctgccagagctgaggaactc

SEQ ID NO: 197635 - DNA, 20 bp, Artificial Sequence
  chemically synthesized
agagctgaggaactcgagac

SEQ ID NO: 197636 - DNA, 20 bp, Artificial Sequence
  chemically synthesized
atgttgaccaggctggtctc

SEQ ID NO: 197637 - DNA, 20 bp, Artificial Sequence
  chemically synthesized
tgaggaactcgagaccagcc

SEQ ID NO: 197638 - DNA, 20 bp, Artificial Sequence
  chemically synthesized
cttcaccatgttgaccaggc

SEQ ID NO: 197639 - DNA, 20 bp, Artificial Sequence
  chemically synthesized
agggcttcaccatgttgacc

SEQ ID NO: 197640 - DNA, 20 bp, Artificial Sequence
  chemically synthesized
cgagaccagcctggtcaaca

SEQ ID NO: 197641 - DNA, 20 bp, Artificial Sequence
  chemically synthesized
cagggcttcaccatgttgac

SEQ ID NO: 197642 - DNA, 20 bp, Artificial Sequence
  chemically synthesized
ccagcctggtcaacatggtg

SEQ ID NO: 197643 - DNA, 20 bp, Artificial Sequence
  chemically synthesized
ttgtgttttcagtagagaca

SEQ ID NO: 197644 - DNA, 20 bp, Artificial Sequence
  chemically synthesized
tttgtgttttcagtagagac

SEQ ID NO: 197645 - DNA, 20 bp, Artificial Sequence
  chemically synthesized
ttttgtgttttcagtagaga

SEQ ID NO: 197646 - DNA, 20 bp, Artificial Sequence
  chemically synthesized
taatttttgtgttttcagta

SEQ ID NO: 197647 - DNA, 20 bp, Artificial Sequence
  chemically synthesized
gctaatttttgtgttttcag

SEQ ID NO: 197648 - DNA, 20 bp, Artificial Sequence
  chemically synthesized
ctggctaatttttgtgtttt

SEQ ID NO: 197649 - DNA, 20 bp, Artificial Sequence
  chemically synthesized
tctactgaaaacacaaaaat

SEQ ID NO: 197650 - DNA, 20 bp, Artificial Sequence
  chemically synthesized
ctgaaaacacaaaaattagc

SEQ ID NO: 197651 - DNA, 20 bp, Artificial Sequence
  chemically synthesized
tgaaaacacaaaaattagcc

SEQ ID NO: 197652 - DNA, 20 bp, Artificial Sequence
  chemically synthesized
acacaaaaattagccaggca

SEQ ID NO: 197653 - DNA, 20 bp, Artificial Sequence
  chemically synthesized
caaaaattagccaggcatgg

SEQ ID NO: 197654 - DNA, 20 bp, Artificial Sequence
  chemically synthesized
taggtgcccaccaccatgcc

SEQ ID NO: 197655 - DNA, 20 bp, Artificial Sequence
  chemically synthesized
aaattagccaggcatggtgg

SEQ ID NO: 197656 - DNA, 20 bp, Artificial Sequence
  chemically synthesized
aattagccaggcatggtggt

SEQ ID NO: 197657 - DNA, 20 bp, Artificial Sequence
  chemically synthesized
gtggtgggcacctattatcc

SEQ ID NO: 197658 - DNA, 20 bp, Artificial Sequence
  chemically synthesized
tccgaagtacctgggataat

SEQ ID NO: 197659 - DNA, 20 bp, Artificial Sequence
  chemically synthesized
tggtgggcacctattatccc

SEQ ID NO: 197660 - DNA, 20 bp, Artificial Sequence
  chemically synthesized
ctccgaagtacctgggataa

SEQ ID NO: 197661 - DNA, 20 bp, Artificial Sequence
  chemically synthesized
cctcagcctccgaagtacct

SEQ ID NO: 197662 - DNA, 20 bp, Artificial Sequence
  chemically synthesized
acctattatcccaggtactt

SEQ ID NO: 197663 - DNA, 20 bp, Artificial Sequence
  chemically synthesized
gcctcagcctccgaagtacc

SEQ ID NO: 197664 - DNA, 20 bp, Artificial Sequence
  chemically synthesized
ctattatcccaggtacttcg

SEQ ID NO: 197665 - DNA, 20 bp, Artificial Sequence
  chemically synthesized
tattatcccaggtacttcgg

SEQ ID NO: 197666 - DNA, 20 bp, Artificial Sequence
  chemically synthesized
ttcccctgcctcagcctccg

SEQ ID NO: 197667 - DNA, 20 bp, Artificial Sequence
  chemically synthesized
tcccaggtacttcggaggct

SEQ ID NO: 197668 - DNA, 20 bp, Artificial Sequence
  chemically synthesized
cccaggtacttcggaggctg

SEQ ID NO: 197669 - DNA, 20 bp, Artificial Sequence
  chemically synthesized
aggtacttcggaggctgagg

SEQ ID NO: 197670 - DNA, 20 bp, Artificial Sequence
  chemically synthesized
ggtacttcggaggctgaggc

SEQ ID NO: 197671 - DNA, 20 bp, Artificial Sequence
  chemically synthesized
gtacttcggaggctgaggca

SEQ ID NO: 197672 - DNA, 20 bp, Artificial Sequence
  chemically synthesized
tacttcggaggctgaggcag

SEQ ID NO: 197673 - DNA, 20 bp, Artificial Sequence
  chemically synthesized
ttcgagtgattcccctgcct

SEQ ID NO: 197674 - DNA, 20 bp, Artificial Sequence
  chemically synthesized
gcaggggaatcactcgaacc

SEQ ID NO: 197675 - DNA, 20 bp, Artificial Sequence
  chemically synthesized
cctctgcccccaccaggttc

SEQ ID NO: 197676 - DNA, 20 bp, Artificial Sequence
  chemically synthesized
ggggaatcactcgaacctgg

SEQ ID NO: 197677 - DNA, 20 bp, Artificial Sequence
  chemically synthesized
gggaatcactcgaacctggt

SEQ ID NO: 197678 - DNA, 20 bp, Artificial Sequence
  chemically synthesized
ggaatcactcgaacctggtg

SEQ ID NO: 197679 - DNA, 20 bp, Artificial Sequence
  chemically synthesized
gaatcactcgaacctggtgg

SEQ ID NO: 197680 - DNA, 20 bp, Artificial Sequence
  chemically synthesized
ctgtaacctctgcccccacc

SEQ ID NO: 197681 - DNA, 20 bp, Artificial Sequence
  chemically synthesized
tcactcgaacctggtggggg

SEQ ID NO: 197682 - DNA, 20 bp, Artificial Sequence
  chemically synthesized
actgtaacctctgcccccac

SEQ ID NO: 197683 - DNA, 20 bp, Artificial Sequence
  chemically synthesized
actcgaacctggtgggggca

SEQ ID NO: 197684 - DNA, 20 bp, Artificial Sequence
  chemically synthesized
ctcgaacctggtgggggcag

SEQ ID NO: 197685 - DNA, 20 bp, Artificial Sequence
  chemically synthesized
cctggtgggggcagaggtta

SEQ ID NO: 197686 - DNA, 20 bp, Artificial Sequence
  chemically synthesized
gtgggggcagaggttacagt

SEQ ID NO: 197687 - DNA, 20 bp, Artificial Sequence
  chemically synthesized
ggcagaggttacagtcagct

SEQ ID NO: 197688 - DNA, 20 bp, Artificial Sequence
  chemically synthesized
ggagtgaggtggcgcaatct

SEQ ID NO: 197689 - DNA, 20 bp, Artificial Sequence
  chemically synthesized
tcgcccaggctggagtgagg

SEQ ID NO: 197690 - DNA, 20 bp, Artificial Sequence
  chemically synthesized
gagattgcgccacctcactc

SEQ ID NO: 197691 - DNA, 20 bp, Artificial Sequence
  chemically synthesized
ctttcgcccaggctggagtg

SEQ ID NO: 197692 - DNA, 20 bp, Artificial Sequence
  chemically synthesized
tctttcgcccaggctggagt

SEQ ID NO: 197693 - DNA, 20 bp, Artificial Sequence
  chemically synthesized
tgcgccacctcactccagcc

SEQ ID NO: 197694 - DNA, 20 bp, Artificial Sequence
  chemically synthesized
gcgccacctcactccagcct

SEQ ID NO: 197695 - DNA, 20 bp, Artificial Sequence
  chemically synthesized
tcgctctttcgcccaggctg

SEQ ID NO: 197696 - DNA, 20 bp, Artificial Sequence
  chemically synthesized
tttcgctctttcgcccaggc

SEQ ID NO: 197697 - DNA, 20 bp, Artificial Sequence
  chemically synthesized
cctcactccagcctgggcga

SEQ ID NO: 197698 - DNA, 20 bp, Artificial Sequence
  chemically synthesized
ggagtttcgctctttcgccc

SEQ ID NO: 197699 - DNA, 20 bp, Artificial Sequence
  chemically synthesized
tcactccagcctgggcgaaa

SEQ ID NO: 197700 - DNA, 20 bp, Artificial Sequence
  chemically synthesized
gggagtttcgctctttcgcc

SEQ ID NO: 197701 - DNA, 20 bp, Artificial Sequence
  chemically synthesized
ttttttttttttttgagagg

SEQ ID NO: 197702 - DNA, 20 bp, Artificial Sequence
  chemically synthesized
ttttttttttttttttgaga

SEQ ID NO: 197703 - DNA, 20 bp, Artificial Sequence
  chemically synthesized
tttttttttttttttttgag

SEQ ID NO: 197704 - DNA, 20 bp, Artificial Sequence
  chemically synthesized
ttttttttttttttttttga

SEQ ID NO: 197705 - DNA, 20 bp, Artificial Sequence
  chemically synthesized
tttttttttttttttttttt

SEQ ID NO: 197706 - DNA, 20 bp, Artificial Sequence
  chemically synthesized
aaaaaaaaaaaaaaaaaaaa

SEQ ID NO: 197707 - DNA, 20 bp, Artificial Sequence
  chemically synthesized
aaaaaagtatgaaacaaaca

SEQ ID NO: 197708 - DNA, 20 bp, Artificial Sequence
  chemically synthesized
aatatattattttactattt

SEQ ID NO: 197709 - DNA, 20 bp, Artificial Sequence
  chemically synthesized
atattattttactattttag

SEQ ID NO: 197710 - DNA, 20 bp, Artificial Sequence
  chemically synthesized
agagcttttctcttctaaaa

SEQ ID NO: 197711 - DNA, 20 bp, Artificial Sequence
  chemically synthesized
attattttactattttagaa

SEQ ID NO: 197712 - DNA, 20 bp, Artificial Sequence
  chemically synthesized
tttactattttagaagagaa

SEQ ID NO: 197713 - DNA, 20 bp, Artificial Sequence
  chemically synthesized
attttagaagagaaaagctc

SEQ ID NO: 197714 - DNA, 20 bp, Artificial Sequence
  chemically synthesized
ttttagaagagaaaagctct

SEQ ID NO: 197715 - DNA, 20 bp, Artificial Sequence
  chemically synthesized
agaagagaaaagctctagga

SEQ ID NO: 197716 - DNA, 20 bp, Artificial Sequence
  chemically synthesized
gaagagaaaagctctaggat

SEQ ID NO: 197717 - DNA, 20 bp, Artificial Sequence
  chemically synthesized
atgttatgctgcctatccta

SEQ ID NO: 197718 - DNA, 20 bp, Artificial Sequence
  chemically synthesized
gagaaaagctctaggatagg

SEQ ID NO: 197719 - DNA, 20 bp, Artificial Sequence
  chemically synthesized
atatgttatgctgcctatcc

SEQ ID NO: 197720 - DNA, 20 bp, Artificial Sequence
  chemically synthesized
aggataggcagcataacata

SEQ ID NO: 197721 - DNA, 20 bp, Artificial Sequence
  chemically synthesized
taggcagcataacatatggt

SEQ ID NO: 197722 - DNA, 20 bp, Artificial Sequence
  chemically synthesized
gcagcataacatatggtcag

SEQ ID NO: 197723 - DNA, 20 bp, Artificial Sequence
  chemically synthesized
gcataacatatggtcagaag

SEQ ID NO: 197724 - DNA, 20 bp, Artificial Sequence
  chemically synthesized
cataacatatggtcagaagc

SEQ ID NO: 197725 - DNA, 20 bp, Artificial Sequence
  chemically synthesized
ataacatatggtcagaagca

SEQ ID NO: 197726 - DNA, 20 bp, Artificial Sequence
  chemically synthesized
atggtcagaagcagggacac

SEQ ID NO: 197727 - DNA, 20 bp, Artificial Sequence
  chemically synthesized
ggtcagaagcagggacacta

SEQ ID NO: 197728 - DNA, 20 bp, Artificial Sequence
  chemically synthesized
tactgccaagacagtggctc

SEQ ID NO: 197729 - DNA, 20 bp, Artificial Sequence
  chemically synthesized
ggacactagagccactgtct

SEQ ID NO: 197730 - DNA, 20 bp, Artificial Sequence
  chemically synthesized
aggtcatactgccaagacag

SEQ ID NO: 197731 - DNA, 20 bp, Artificial Sequence
  chemically synthesized
cactagagccactgtcttgg

SEQ ID NO: 197732 - DNA, 20 bp, Artificial Sequence
  chemically synthesized
ccaaggtcatactgccaaga

SEQ ID NO: 197733 - DNA, 20 bp, Artificial Sequence
  chemically synthesized
ttgcccaaggtcatactgcc

SEQ ID NO: 197734 - DNA, 20 bp, Artificial Sequence
  chemically synthesized
ctgtcttggcagtatgacct

SEQ ID NO: 197735 - DNA, 20 bp, Artificial Sequence
  chemically synthesized
tgtcttggcagtatgacctt

SEQ ID NO: 197736 - DNA, 20 bp, Artificial Sequence
  chemically synthesized
ttggcagtatgaccttgggc

SEQ ID NO: 197737 - DNA, 20 bp, Artificial Sequence
  chemically synthesized
taggttaagttacttgccca

SEQ ID NO: 197738 - DNA, 20 bp, Artificial Sequence
  chemically synthesized
ctaggttaagttacttgccc

SEQ ID NO: 197739 - DNA, 20 bp, Artificial Sequence
  chemically synthesized
cttgggcaagtaacttaacc

SEQ ID NO: 197740 - DNA, 20 bp, Artificial Sequence
  chemically synthesized
gcaaatgatataactaggtt

SEQ ID NO: 197741 - DNA, 20 bp, Artificial Sequence
  chemically synthesized
agctagcaaatgatataact

SEQ ID NO: 197742 - DNA, 20 bp, Artificial Sequence
  chemically synthesized
tagctagcaaatgatataac

SEQ ID NO: 197743 - DNA, 20 bp, Artificial Sequence
  chemically synthesized
aacctagttatatcatttgc

SEQ ID NO: 197744 - DNA, 20 bp, Artificial Sequence
  chemically synthesized
atatcatttgctagctaaat

SEQ ID NO: 197745 - DNA, 20 bp, Artificial Sequence
  chemically synthesized
tattattatacttatttagc

SEQ ID NO: 197746 - DNA, 20 bp, Artificial Sequence
  chemically synthesized
gttttattattatacttatt

SEQ ID NO: 197747 - DNA, 20 bp, Artificial Sequence
  chemically synthesized
taataataaaacctgtcctg

SEQ ID NO: 197748 - DNA, 20 bp, Artificial Sequence
  chemically synthesized
aataataaaacctgtcctgt

SEQ ID NO: 197749 - DNA, 20 bp, Artificial Sequence
  chemically synthesized
tcacaacaatcccacaggac

SEQ ID NO: 197750 - DNA, 20 bp, Artificial Sequence
  chemically synthesized
atcacaacaatcccacagga

SEQ ID NO: 197751 - DNA, 20 bp, Artificial Sequence
  chemically synthesized
aatcatcacaacaatcccac

SEQ ID NO: 197752 - DNA, 20 bp, Artificial Sequence
  chemically synthesized
caatcatcacaacaatccca

SEQ ID NO: 197753 - DNA, 20 bp, Artificial Sequence
  chemically synthesized
tactttctctacattaattc

SEQ ID NO: 197754 - DNA, 20 bp, Artificial Sequence
  chemically synthesized
ttactttctctacattaatt

SEQ ID NO: 197755 - DNA, 20 bp, Artificial Sequence
  chemically synthesized
gatgattgcctgaattaatg

SEQ ID NO: 197756 - DNA, 20 bp, Artificial Sequence
  chemically synthesized
tgattgcctgaattaatgta

SEQ ID NO: 197757 - DNA, 20 bp, Artificial Sequence
  chemically synthesized
tgcctgaattaatgtagaga

SEQ ID NO: 197758 - DNA, 20 bp, Artificial Sequence
  chemically synthesized
aaagtaatttgactaacgtc

SEQ ID NO: 197759 - DNA, 20 bp, Artificial Sequence
  chemically synthesized
gcttcttctgagccagacgt

SEQ ID NO: 197760 - DNA, 20 bp, Artificial Sequence
  chemically synthesized
aatttgactaacgtctggct

SEQ ID NO: 197761 - DNA, 20 bp, Artificial Sequence
  chemically synthesized
ttgactaacgtctggctcag

SEQ ID NO: 197762 - DNA, 20 bp, Artificial Sequence
  chemically synthesized
tagtaatgcttcttctgagc

SEQ ID NO: 197763 - DNA, 20 bp, Artificial Sequence
  chemically synthesized
actaacgtctggctcagaag

SEQ ID NO: 197764 - DNA, 20 bp, Artificial Sequence
  chemically synthesized
gttgtagtaatgcttcttct

SEQ ID NO: 197765 - DNA, 20 bp, Artificial Sequence
  chemically synthesized
agaagcattactacaacact

SEQ ID NO: 197766 - DNA, 20 bp, Artificial Sequence
  chemically synthesized
atgatgatgcctaagtgttg

SEQ ID NO: 197767 - DNA, 20 bp, Artificial Sequence
  chemically synthesized
gaagcattactacaacactt

SEQ ID NO: 197768 - DNA, 20 bp, Artificial Sequence
  chemically synthesized
taataatcatgatgatgcct

SEQ ID NO: 197769 - DNA, 20 bp, Artificial Sequence
  chemically synthesized
agcaatagtaataatgatga

SEQ ID NO: 197770 - DNA, 20 bp, Artificial Sequence
  chemically synthesized
gttcatattcatttcagcaa

SEQ ID NO: 197771 - DNA, 20 bp, Artificial Sequence
  chemically synthesized
atttctgttcatattcattt

SEQ ID NO: 197772 - DNA, 20 bp, Artificial Sequence
  chemically synthesized
attgctgaaatgaatatgaa

SEQ ID NO: 197773 - DNA, 20 bp, Artificial Sequence
  chemically synthesized
aatgaatatgaacagaaatt

SEQ ID NO: 197774 - DNA, 20 bp, Artificial Sequence
  chemically synthesized
acagaaattaagtctctgaa

SEQ ID NO: 197775 - DNA, 20 bp, Artificial Sequence
  chemically synthesized
gaaattaagtctctgaaaag

SEQ ID NO: 197776 - DNA, 20 bp, Artificial Sequence
  chemically synthesized
gtggggcttcctgcttttca

SEQ ID NO: 197777 - DNA, 20 bp, Artificial Sequence
  chemically synthesized
aaattaagtctctgaaaagc

SEQ ID NO: 197778 - DNA, 20 bp, Artificial Sequence
  chemically synthesized
aagtggggcttcctgctttt

SEQ ID NO: 197779 - DNA, 20 bp, Artificial Sequence
  chemically synthesized
ttaagtctctgaaaagcagg

SEQ ID NO: 197780 - DNA, 20 bp, Artificial Sequence
  chemically synthesized
acatgatccctcataaagtg

SEQ ID NO: 197781 - DNA, 20 bp, Artificial Sequence
  chemically synthesized
agcaggaagccccactttat

SEQ ID NO: 197782 - DNA, 20 bp, Artificial Sequence
  chemically synthesized
cacatgatccctcataaagt

SEQ ID NO: 197783 - DNA, 20 bp, Artificial Sequence
  chemically synthesized
gcaggaagccccactttatg

SEQ ID NO: 197784 - DNA, 20 bp, Artificial Sequence
  chemically synthesized
acacatgatccctcataaag

SEQ ID NO: 197785 - DNA, 20 bp, Artificial Sequence
  chemically synthesized
caggaagccccactttatga

SEQ ID NO: 197786 - DNA, 20 bp, Artificial Sequence
  chemically synthesized
tggacacatgatccctcata

SEQ ID NO: 197787 - DNA, 20 bp, Artificial Sequence
  chemically synthesized
ttatgagggatcatgtgtcc

SEQ ID NO: 197788 - DNA, 20 bp, Artificial Sequence
  chemically synthesized
tgagggatcatgtgtccaag

SEQ ID NO: 197789 - DNA, 20 bp, Artificial Sequence
  chemically synthesized
gatcatgtgtccaagaagaa

SEQ ID NO: 197790 - DNA, 20 bp, Artificial Sequence
  chemically synthesized
ttgaaagcaactgttcttct

SEQ ID NO: 197791 - DNA, 20 bp, Artificial Sequence
  chemically synthesized
gcaaccaaaaagatatttga

SEQ ID NO: 197792 - DNA, 20 bp, Artificial Sequence
  chemically synthesized
gttgctttcaaatatctttt

SEQ ID NO: 197793 - DNA, 20 bp, Artificial Sequence
  chemically synthesized
aaaaaaactttgcaaccaaa

SEQ ID NO: 197794 - DNA, 20 bp, Artificial Sequence
  chemically synthesized
caaatatctttttggttgca

SEQ ID NO: 197795 - DNA, 20 bp, Artificial Sequence
  chemically synthesized
ccctgttgcatttattgaag

SEQ ID NO: 197796 - DNA, 20 bp, Artificial Sequence
  chemically synthesized
atcccctgttgcatttattg

SEQ ID NO: 197797 - DNA, 20 bp, Artificial Sequence
  chemically synthesized
ttcttcttcaataaatgcaa

SEQ ID NO: 197798 - DNA, 20 bp, Artificial Sequence
  chemically synthesized
tcttcttcaataaatgcaac

SEQ ID NO: 197799 - DNA, 20 bp, Artificial Sequence
  chemically synthesized
cttcttcaataaatgcaaca

SEQ ID NO: 197800 - DNA, 20 bp, Artificial Sequence
  chemically synthesized
ttcttcaataaatgcaacag

SEQ ID NO: 197801 - DNA, 20 bp, Artificial Sequence
  chemically synthesized
tctgatttaattgtagtatt

SEQ ID NO: 197802 - DNA, 20 bp, Artificial Sequence
  chemically synthesized
ctctgatttaattgtagtat

SEQ ID NO: 197803 - DNA, 20 bp, Artificial Sequence
  chemically synthesized
aatgcactctgatttaattg

SEQ ID NO: 197804 - DNA, 20 bp, Artificial Sequence
  chemically synthesized
tcccaatactacaattaaat

SEQ ID NO: 197805 - DNA, 20 bp, Artificial Sequence
  chemically synthesized
ccaatactacaattaaatca

SEQ ID NO: 197806 - DNA, 20 bp, Artificial Sequence
  chemically synthesized
caattaaatcagagtgcatt

SEQ ID NO: 197807 - DNA, 20 bp, Artificial Sequence
  chemically synthesized
agagtgcatttagttgaacc

SEQ ID NO: 197808 - DNA, 20 bp, Artificial Sequence
  chemically synthesized
tgcatttagttgaacctggt

SEQ ID NO: 197809 - DNA, 20 bp, Artificial Sequence
  chemically synthesized
atttagttgaacctggttgg

SEQ ID NO: 197810 - DNA, 20 bp, Artificial Sequence
  chemically synthesized
aggacttgaggctaccaacc

SEQ ID NO: 197811 - DNA, 20 bp, Artificial Sequence
  chemically synthesized
gaggacttgaggctaccaac

SEQ ID NO: 197812 - DNA, 20 bp, Artificial Sequence
  chemically synthesized
tgaacctggttggtagcctc

SEQ ID NO: 197813 - DNA, 20 bp, Artificial Sequence
  chemically synthesized
aacacacacatgaggacttg

SEQ ID NO: 197814 - DNA, 20 bp, Artificial Sequence
  chemically synthesized
aaacacacacatgaggactt

SEQ ID NO: 197815 - DNA, 20 bp, Artificial Sequence
  chemically synthesized
tggaaagaaacacacacatg

SEQ ID NO: 197816 - DNA, 20 bp, Artificial Sequence
  chemically synthesized
gtggaaagaaacacacacat

SEQ ID NO: 197817 - DNA, 20 bp, Artificial Sequence
  chemically synthesized
agaacaccaagtatagtgga

SEQ ID NO: 197818 - DNA, 20 bp, Artificial Sequence
  chemically synthesized
gtgtttctttccactatact

SEQ ID NO: 197819 - DNA, 20 bp, Artificial Sequence
  chemically synthesized
tcagagaacaccaagtatag

SEQ ID NO: 197820 - DNA, 20 bp, Artificial Sequence
  chemically synthesized
gcttcagagaacaccaagta

SEQ ID NO: 197821 - DNA, 20 bp, Artificial Sequence
  chemically synthesized
gacttgcttcagagaacacc

SEQ ID NO: 197822 - DNA, 20 bp, Artificial Sequence
  chemically synthesized
actatacttggtgttctctg

SEQ ID NO: 197823 - DNA, 20 bp, Artificial Sequence
  chemically synthesized
tacttggtgttctctgaagc

SEQ ID NO: 197824 - DNA, 20 bp, Artificial Sequence
  chemically synthesized
cttgatattgacttgcttca

SEQ ID NO: 197825 - DNA, 20 bp, Artificial Sequence
  chemically synthesized
tacttgatattgacttgctt

SEQ ID NO: 197826 - DNA, 20 bp, Artificial Sequence
  chemically synthesized
ctctgaagcaagtcaatatc

SEQ ID NO: 197827 - DNA, 20 bp, Artificial Sequence
  chemically synthesized
tgaagcaagtcaatatcaag

SEQ ID NO: 197828 - DNA, 20 bp, Artificial Sequence
  chemically synthesized
caagtcaatatcaagtagaa

SEQ ID NO: 197829 - DNA, 20 bp, Artificial Sequence
  chemically synthesized
agtcaatatcaagtagaaca

SEQ ID NO: 197830 - DNA, 20 bp, Artificial Sequence
  chemically synthesized
gtcaatatcaagtagaacag

SEQ ID NO: 197831 - DNA, 20 bp, Artificial Sequence
  chemically synthesized
atttaatgttaaaataaaac

SEQ ID NO: 197832 - DNA, 20 bp, Artificial Sequence
  chemically synthesized
tgttaaaataaaactagaat

SEQ ID NO: 197833 - DNA, 20 bp, Artificial Sequence
  chemically synthesized
gttaaaataaaactagaata

SEQ ID NO: 197834 - DNA, 20 bp, Artificial Sequence
  chemically synthesized
tgttctttgttgccttattc

SEQ ID NO: 197835 - DNA, 20 bp, Artificial Sequence
  chemically synthesized
aaaactagaataaggcaaca

SEQ ID NO: 197836 - DNA, 20 bp, Artificial Sequence
  chemically synthesized
aggcaacaaagaacatgtat

SEQ ID NO: 197837 - DNA, 20 bp, Artificial Sequence
  chemically synthesized
ggcaacaaagaacatgtata

SEQ ID NO: 197838 - DNA, 20 bp, Artificial Sequence
  chemically synthesized
aacatgtataaggatgcatg

SEQ ID NO: 197839 - DNA, 20 bp, Artificial Sequence
  chemically synthesized
ggatgcatgaagattgtctc

SEQ ID NO: 197840 - DNA, 20 bp, Artificial Sequence
  chemically synthesized
gatgcatgaagattgtctct

SEQ ID NO: 197841 - DNA, 20 bp, Artificial Sequence
  chemically synthesized
atgaagattgtctctgggtt

SEQ ID NO: 197842 - DNA, 20 bp, Artificial Sequence
  chemically synthesized
ttaatagtactctcaaccca

SEQ ID NO: 197843 - DNA, 20 bp, Artificial Sequence
  chemically synthesized
gaagattgtctctgggttga

SEQ ID NO: 197844 - DNA, 20 bp, Artificial Sequence
  chemically synthesized
ttttaatagtactctcaacc

SEQ ID NO: 197845 - DNA, 20 bp, Artificial Sequence
  chemically synthesized
ggttgagagtactattaaaa

SEQ ID NO: 197846 - DNA, 20 bp, Artificial Sequence
  chemically synthesized
atgcaagatttctgttttaa

SEQ ID NO: 197847 - DNA, 20 bp, Artificial Sequence
  chemically synthesized
agtgatacgaagtcaaatgc

SEQ ID NO: 197848 - DNA, 20 bp, Artificial Sequence
  chemically synthesized
aagtgcttttaagtgatacg

SEQ ID NO: 197849 - DNA, 20 bp, Artificial Sequence
  chemically synthesized
tttgacttcgtatcacttaa

SEQ ID NO: 197850 - DNA, 20 bp, Artificial Sequence
  chemically synthesized
aaatagttctaagtgctttt

SEQ ID NO: 197851 - DNA, 20 bp, Artificial Sequence
  chemically synthesized
tcgtatcacttaaaagcact

SEQ ID NO: 197852 - DNA, 20 bp, Artificial Sequence
  chemically synthesized
ttttaaattaaaatagttct

SEQ ID NO: 197853 - DNA, 20 bp, Artificial Sequence
  chemically synthesized
gtaggatttttaaattaaaa

SEQ ID NO: 197854 - DNA, 20 bp, Artificial Sequence
  chemically synthesized
ctaaacctatttttaatagt

SEQ ID NO: 197855 - DNA, 20 bp, Artificial Sequence
  chemically synthesized
actaaacctatttttaatag

SEQ ID NO: 197856 - DNA, 20 bp, Artificial Sequence
  chemically synthesized
aaaaatcctactattaaaaa

SEQ ID NO: 197857 - DNA, 20 bp, Artificial Sequence
  chemically synthesized
aatactaaacctatttttaa

SEQ ID NO: 197858 - DNA, 20 bp, Artificial Sequence
  chemically synthesized
aaaatcctactattaaaaat

SEQ ID NO: 197859 - DNA, 20 bp, Artificial Sequence
  chemically synthesized
cctactattaaaaataggtt

SEQ ID NO: 197860 - DNA, 20 bp, Artificial Sequence
  chemically synthesized
aaaaataggtttagtattta

SEQ ID NO: 197861 - DNA, 20 bp, Artificial Sequence
  chemically synthesized
aaataggtttagtatttaaa

SEQ ID NO: 197862 - DNA, 20 bp, Artificial Sequence
  chemically synthesized
aataggtttagtatttaaag

SEQ ID NO: 197863 - DNA, 20 bp, Artificial Sequence
  chemically synthesized
atactgcagttatagaaaat

SEQ ID NO: 197864 - DNA, 20 bp, Artificial Sequence
  chemically synthesized
attctaattttctataactg

SEQ ID NO: 197865 - DNA, 20 bp, Artificial Sequence
  chemically synthesized
gtcatcagatactgcagtta

SEQ ID NO: 197866 - DNA, 20 bp, Artificial Sequence
  chemically synthesized
gtggttgtcatcagatactg

SEQ ID NO: 197867 - DNA, 20 bp, Artificial Sequence
  chemically synthesized
atgcggctagtggttgtcat

SEQ ID NO: 197868 - DNA, 20 bp, Artificial Sequence
  chemically synthesized
cagtatctgatgacaaccac

SEQ ID NO: 197869 - DNA, 20 bp, Artificial Sequence
  chemically synthesized
caaaagccgcatgcggctag

SEQ ID NO: 197870 - DNA, 20 bp, Artificial Sequence
  chemically synthesized
tttcaaaagccgcatgcggc

SEQ ID NO: 197871 - DNA, 20 bp, Artificial Sequence
  chemically synthesized
tgacaaccactagccgcatg

SEQ ID NO: 197872 - DNA, 20 bp, Artificial Sequence
  chemically synthesized
taaatttcaaaagccgcatg

SEQ ID NO: 197873 - DNA, 20 bp, Artificial Sequence
  chemically synthesized
aaataacgtttaaatttcaa

SEQ ID NO: 197874 - DNA, 20 bp, Artificial Sequence
  chemically synthesized
tttaatattaaataaaaatt

SEQ ID NO: 197875 - DNA, 20 bp, Artificial Sequence
  chemically synthesized
taaataaaaatttagttcct

SEQ ID NO: 197876 - DNA, 20 bp, Artificial Sequence
  chemically synthesized
taatatggccagggacacta

SEQ ID NO: 197877 - DNA, 20 bp, Artificial Sequence
  chemically synthesized
gtaatatggccagggacact

SEQ ID NO: 197878 - DNA, 20 bp, Artificial Sequence
  chemically synthesized
atttagttccttagtgtccc

SEQ ID NO: 197879 - DNA, 20 bp, Artificial Sequence
  chemically synthesized
gagcaatggtaatatggcca

SEQ ID NO: 197880 - DNA, 20 bp, Artificial Sequence
  chemically synthesized
tgagcaatggtaatatggcc

SEQ ID NO: 197881 - DNA, 20 bp, Artificial Sequence
  chemically synthesized
ctgagcaatggtaatatggc

SEQ ID NO: 197882 - DNA, 20 bp, Artificial Sequence
  chemically synthesized
actactgagcaatggtaata

SEQ ID NO: 197883 - DNA, 20 bp, Artificial Sequence
  chemically synthesized
ctggccatattaccattgct

SEQ ID NO: 197884 - DNA, 20 bp, Artificial Sequence
  chemically synthesized
tacacatgactactgagcaa

SEQ ID NO: 197885 - DNA, 20 bp, Artificial Sequence
  chemically synthesized
gccatattaccattgctcag

SEQ ID NO: 197886 - DNA, 20 bp, Artificial Sequence
  chemically synthesized
actagatacacatgactact

SEQ ID NO: 197887 - DNA, 20 bp, Artificial Sequence
  chemically synthesized
gctcagtagtcatgtgtatc

SEQ ID NO: 197888 - DNA, 20 bp, Artificial Sequence
  chemically synthesized
cagtagtcatgtgtatctag

SEQ ID NO: 197889 - DNA, 20 bp, Artificial Sequence
  chemically synthesized
ctgtccaatacaacagccac

SEQ ID NO: 197890 - DNA, 20 bp, Artificial Sequence
  chemically synthesized
gtatctagtggctgttgtat

SEQ ID NO: 197891 - DNA, 20 bp, Artificial Sequence
  chemically synthesized
ctctgtgctgtccaatacaa

SEQ ID NO: 197892 - DNA, 20 bp, Artificial Sequence
  chemically synthesized
ctagtggctgttgtattgga

SEQ ID NO: 197893 - DNA, 20 bp, Artificial Sequence
  chemically synthesized
ggctgttgtattggacagca

SEQ ID NO: 197894 - DNA, 20 bp, Artificial Sequence
  chemically synthesized
ctgttgtattggacagcaca

SEQ ID NO: 197895 - DNA, 20 bp, Artificial Sequence
  chemically synthesized
tgtattggacagcacagaga

SEQ ID NO: 197896 - DNA, 20 bp, Artificial Sequence
  chemically synthesized
aacatttttatcatcacaca

SEQ ID NO: 197897 - DNA, 20 bp, Artificial Sequence
  chemically synthesized
atcatcacacaaagttatat

SEQ ID NO: 197898 - DNA, 20 bp, Artificial Sequence
  chemically synthesized
tatattggacattgctgatt

SEQ ID NO: 197899 - DNA, 20 bp, Artificial Sequence
  chemically synthesized
atattggacattgctgattt

SEQ ID NO: 197900 - DNA, 20 bp, Artificial Sequence
  chemically synthesized
tgtaacaaaatgtcctaaat

SEQ ID NO: 197901 - DNA, 20 bp, Artificial Sequence
  chemically synthesized
atttaggacattttgttaca

SEQ ID NO: 197902 - DNA, 20 bp, Artificial Sequence
  chemically synthesized
gaaaattatgctgacaatat

SEQ ID NO: 197903 - DNA, 20 bp, Artificial Sequence
  chemically synthesized
ttctgcacacctaatattgt

SEQ ID NO: 197904 - DNA, 20 bp, Artificial Sequence
  chemically synthesized
aaaattatgctgacaatatt

SEQ ID NO: 197905 - DNA, 20 bp, Artificial Sequence
  chemically synthesized
tgctgacaatattaggtgtg

SEQ ID NO: 197906 - DNA, 20 bp, Artificial Sequence
  chemically synthesized
ggtgtgcagaatattaccat

SEQ ID NO: 197907 - DNA, 20 bp, Artificial Sequence
  chemically synthesized
cagaatattaccataagcaa

SEQ ID NO: 197908 - DNA, 20 bp, Artificial Sequence
  chemically synthesized
tagtattttgctattgctta

SEQ ID NO: 197909 - DNA, 20 bp, Artificial Sequence
  chemically synthesized
agcaatagcaaaatactaca

SEQ ID NO: 197910 - DNA, 20 bp, Artificial Sequence
  chemically synthesized
gcaatagcaaaatactacat

SEQ ID NO: 197911 - DNA, 20 bp, Artificial Sequence
  chemically synthesized
aaagtgttcccaaacccatg

SEQ ID NO: 197912 - DNA, 20 bp, Artificial Sequence
  chemically synthesized
agcaaaatactacatgggtt

SEQ ID NO: 197913 - DNA, 20 bp, Artificial Sequence
  chemically synthesized
gcaaaatactacatgggttt

SEQ ID NO: 197914 - DNA, 20 bp, Artificial Sequence
  chemically synthesized
gcagtgcataaagaaaggaa

SEQ ID NO: 197915 - DNA, 20 bp, Artificial Sequence
  chemically synthesized
taactgcagtgcataaagaa

SEQ ID NO: 197916 - DNA, 20 bp, Artificial Sequence
  chemically synthesized
ttaactgcagtgcataaaga

SEQ ID NO: 197917 - DNA, 20 bp, Artificial Sequence
  chemically synthesized
ttcattaactgcagtgcata

SEQ ID NO: 197918 - DNA, 20 bp, Artificial Sequence
  chemically synthesized
tttcctttctttatgcactg

SEQ ID NO: 197919 - DNA, 20 bp, Artificial Sequence
  chemically synthesized
ttaagttgtttcattaactg

SEQ ID NO: 197920 - DNA, 20 bp, Artificial Sequence
  chemically synthesized
tcctccagagaattacattt

SEQ ID NO: 197921 - DNA, 20 bp, Artificial Sequence
  chemically synthesized
acaacttaaatgtaattctc

SEQ ID NO: 197922 - DNA, 20 bp, Artificial Sequence
  chemically synthesized
aacttaaatgtaattctctg

SEQ ID NO: 197923 - DNA, 20 bp, Artificial Sequence
  chemically synthesized
acttaaatgtaattctctgg

SEQ ID NO: 197924 - DNA, 20 bp, Artificial Sequence
  chemically synthesized
taagaaaataaattcctcca

SEQ ID NO: 197925 - DNA, 20 bp, Artificial Sequence
  chemically synthesized
cttaagaaaataaattcctc

SEQ ID NO: 197926 - DNA, 20 bp, Artificial Sequence
  chemically synthesized
ctggaggaatttattttctt

SEQ ID NO: 197927 - DNA, 20 bp, Artificial Sequence
  chemically synthesized
acactttaagagaagtactt

SEQ ID NO: 197928 - DNA, 20 bp, Artificial Sequence
  chemically synthesized
tttcttaagtacttctctta

SEQ ID NO: 197929 - DNA, 20 bp, Artificial Sequence
  chemically synthesized
tattgcagacactttaagag

SEQ ID NO: 197930 - DNA, 20 bp, Artificial Sequence
  chemically synthesized
tcatattgcagacactttaa

SEQ ID NO: 197931 - DNA, 20 bp, Artificial Sequence
  chemically synthesized
aatcatattgcagacacttt

SEQ ID NO: 197932 - DNA, 20 bp, Artificial Sequence
  chemically synthesized
ctcaggtaaaaatcatattg

SEQ ID NO: 197933 - DNA, 20 bp, Artificial Sequence
  chemically synthesized
ctgcaatatgatttttacct

SEQ ID NO: 197934 - DNA, 20 bp, Artificial Sequence
  chemically synthesized
caatatgatttttacctgag

SEQ ID NO: 197935 - DNA, 20 bp, Artificial Sequence
  chemically synthesized
cctactgtgccacacttctc

SEQ ID NO: 197936 - DNA, 20 bp, Artificial Sequence
  chemically synthesized
tgatttttacctgagaagtg

SEQ ID NO: 197937 - DNA, 20 bp, Artificial Sequence
  chemically synthesized
tcctactgtgccacacttct

SEQ ID NO: 197938 - DNA, 20 bp, Artificial Sequence
  chemically synthesized
tttacctgagaagtgtggca

SEQ ID NO: 197939 - DNA, 20 bp, Artificial Sequence
  chemically synthesized
acctgagaagtgtggcacag

SEQ ID NO: 197940 - DNA, 20 bp, Artificial Sequence
  chemically synthesized
cctgagaagtgtggcacagt

SEQ ID NO: 197941 - DNA, 20 bp, Artificial Sequence
  chemically synthesized
gcacagtaggaataaaaaca

SEQ ID NO: 197942 - DNA, 20 bp, Artificial Sequence
  chemically synthesized
agtaggaataaaaacacggt

SEQ ID NO: 197943 - DNA, 20 bp, Artificial Sequence
  chemically synthesized
taggaataaaaacacggtca

SEQ ID NO: 197944 - DNA, 20 bp, Artificial Sequence
  chemically synthesized
aataaaaacacggtcagagt

SEQ ID NO: 197945 - DNA, 20 bp, Artificial Sequence
  chemically synthesized
ttgacttctcaaggtcatga

SEQ ID NO: 197946 - DNA, 20 bp, Artificial Sequence
  chemically synthesized
cttgacttctcaaggtcatg

SEQ ID NO: 197947 - DNA, 20 bp, Artificial Sequence
  chemically synthesized
gttagcaccttcatgacctt

SEQ ID NO: 197948 - DNA, 20 bp, Artificial Sequence
  chemically synthesized
agcaccttcatgaccttgag

SEQ ID NO: 197949 - DNA, 20 bp, Artificial Sequence
  chemically synthesized
ggagacttcttgacttctca

SEQ ID NO: 197950 - DNA, 20 bp, Artificial Sequence
  chemically synthesized
gggagacttcttgacttctc

SEQ ID NO: 197951 - DNA, 20 bp, Artificial Sequence
  chemically synthesized
cttcatgaccttgagaagtc

SEQ ID NO: 197952 - DNA, 20 bp, Artificial Sequence
  chemically synthesized
catgaccttgagaagtcaag

SEQ ID NO: 197953 - DNA, 20 bp, Artificial Sequence
  chemically synthesized
agaagtcaagaagtctccct

SEQ ID NO: 197954 - DNA, 20 bp, Artificial Sequence
  chemically synthesized
tggagcccctgggtcttagg

SEQ ID NO: 197955 - DNA, 20 bp, Artificial Sequence
  chemically synthesized
caagaagtctccctaagacc

SEQ ID NO: 197956 - DNA, 20 bp, Artificial Sequence
  chemically synthesized
cctggagcccctgggtctta

SEQ ID NO: 197957 - DNA, 20 bp, Artificial Sequence
  chemically synthesized
aagaagtctccctaagaccc

SEQ ID NO: 197958 - DNA, 20 bp, Artificial Sequence
  chemically synthesized
acctggagcccctgggtctt

SEQ ID NO: 197959 - DNA, 20 bp, Artificial Sequence
  chemically synthesized
agaagtctccctaagaccca

SEQ ID NO: 197960 - DNA, 20 bp, Artificial Sequence
  chemically synthesized
tacctggagcccctgggtct

SEQ ID NO: 197961 - DNA, 20 bp, Artificial Sequence
  chemically synthesized
gaagtctccctaagacccag

SEQ ID NO: 197962 - DNA, 20 bp, Artificial Sequence
  chemically synthesized
ccctgttacctggagcccct

SEQ ID NO: 197963 - DNA, 20 bp, Artificial Sequence
  chemically synthesized
tccctaagacccaggggctc

SEQ ID NO: 197964 - DNA, 20 bp, Artificial Sequence
  chemically synthesized
tccctgttacctggagcccc

SEQ ID NO: 197965 - DNA, 20 bp, Artificial Sequence
  chemically synthesized
ccctaagacccaggggctcc

SEQ ID NO: 197966 - DNA, 20 bp, Artificial Sequence
  chemically synthesized
gacccaggggctccaggtaa

SEQ ID NO: 197967 - DNA, 20 bp, Artificial Sequence
  chemically synthesized
gtcattatccctgttacctg

SEQ ID NO: 197968 - DNA, 20 bp, Artificial Sequence
  chemically synthesized
acccaggggctccaggtaac

SEQ ID NO: 197969 - DNA, 20 bp, Artificial Sequence
  chemically synthesized
cccaggggctccaggtaaca

SEQ ID NO: 197970 - DNA, 20 bp, Artificial Sequence
  chemically synthesized
ctgtcattatccctgttacc

SEQ ID NO: 197971 - DNA, 20 bp, Artificial Sequence
  chemically synthesized
ccaggtaacagggataatga

SEQ ID NO: 197972 - DNA, 20 bp, Artificial Sequence
  chemically synthesized
atgacagttgtccaccaaac

SEQ ID NO: 197973 - DNA, 20 bp, Artificial Sequence
  chemically synthesized
cttcatgtaaactggtttgg

SEQ ID NO: 197974 - DNA, 20 bp, Artificial Sequence
  chemically synthesized
gttcttcatgtaaactggtt

SEQ ID NO: 197975 - DNA, 20 bp, Artificial Sequence
  chemically synthesized
cacttgttcttcatgtaaac

SEQ ID NO: 197976 - DNA, 20 bp, Artificial Sequence
  chemically synthesized
ccaccaaaccagtttacatg

SEQ ID NO: 197977 - DNA, 20 bp, Artificial Sequence
  chemically synthesized
aaccagtttacatgaagaac

SEQ ID NO: 197978 - DNA, 20 bp, Artificial Sequence
  chemically synthesized
agtttacatgaagaacaagt

SEQ ID NO: 197979 - DNA, 20 bp, Artificial Sequence
  chemically synthesized
tacatgaagaacaagtgaga

SEQ ID NO: 197980 - DNA, 20 bp, Artificial Sequence
  chemically synthesized
agaacaagtgagaaagtgaa

SEQ ID NO: 197981 - DNA, 20 bp, Artificial Sequence
  chemically synthesized
aggatttcagagtttacgaa

SEQ ID NO: 197982 - DNA, 20 bp, Artificial Sequence
  chemically synthesized
taggatttcagagtttacga

SEQ ID NO: 197983 - DNA, 20 bp, Artificial Sequence
  chemically synthesized
ttaggatttcagagtttacg

SEQ ID NO: 197984 - DNA, 20 bp, Artificial Sequence
  chemically synthesized
aacatttgtttaggatttca

SEQ ID NO: 197985 - DNA, 20 bp, Artificial Sequence
  chemically synthesized
gtaacatttgtttaggattt

SEQ ID NO: 197986 - DNA, 20 bp, Artificial Sequence
  chemically synthesized
ataataagtaacatttgttt

SEQ ID NO: 197987 - DNA, 20 bp, Artificial Sequence
  chemically synthesized
cataataagtaacatttgtt

SEQ ID NO: 197988 - DNA, 20 bp, Artificial Sequence
  chemically synthesized
catgtagaaatgatcataat

SEQ ID NO: 197989 - DNA, 20 bp, Artificial Sequence
  chemically synthesized
ccagatgaaaaaaatacatg

SEQ ID NO: 197990 - DNA, 20 bp, Artificial Sequence
  chemically synthesized
ctacatgtatttttttcatc

SEQ ID NO: 197991 - DNA, 20 bp, Artificial Sequence
  chemically synthesized
acacttcattcacattcatc

SEQ ID NO: 197992 - DNA, 20 bp, Artificial Sequence
  chemically synthesized
catctggatgaatgtgaatg

SEQ ID NO: 197993 - DNA, 20 bp, Artificial Sequence
  chemically synthesized
aatgaagtgtataatttctg

SEQ ID NO: 197994 - DNA, 20 bp, Artificial Sequence
  chemically synthesized
gaagtgtataatttctgtag

SEQ ID NO: 197995 - DNA, 20 bp, Artificial Sequence
  chemically synthesized
gtgtataatttctgtagaag

SEQ ID NO: 197996 - DNA, 20 bp, Artificial Sequence
  chemically synthesized
gactagctcgactacttcta

SEQ ID NO: 197997 - DNA, 20 bp, Artificial Sequence
  chemically synthesized
taatttctgtagaagtagtc

SEQ ID NO: 197998 - DNA, 20 bp, Artificial Sequence
  chemically synthesized
ttctgtagaagtagtcgagc

SEQ ID NO: 197999 - DNA, 20 bp, Artificial Sequence
  chemically synthesized
gaagtagtcgagctagtcta

SEQ ID NO: 198000 - DNA, 20 bp, Artificial Sequence
  chemically synthesized
tgtgacattttgctttagac

SEQ ID NO: 198001 - DNA, 20 bp, Artificial Sequence
  chemically synthesized
ttaactgtgacattttgctt

SEQ ID NO: 198002 - DNA, 20 bp, Artificial Sequence
  chemically synthesized
tagtctaaagcaaaatgtca

SEQ ID NO: 198003 - DNA, 20 bp, Artificial Sequence
  chemically synthesized
aaagcaaaatgtcacagtta

SEQ ID NO: 198004 - DNA, 20 bp, Artificial Sequence
  chemically synthesized
atgtcacagttaaagcattt

SEQ ID NO: 198005 - DNA, 20 bp, Artificial Sequence
  chemically synthesized
acagttaaagcatttgagat

SEQ ID NO: 198006 - DNA, 20 bp, Artificial Sequence
  chemically synthesized
cagttaaagcatttgagata

SEQ ID NO: 198007 - DNA, 20 bp, Artificial Sequence
  chemically synthesized
tttgagataaggcacatttg

SEQ ID NO: 198008 - DNA, 20 bp, Artificial Sequence
  chemically synthesized
taaggcacatttgtggtcca

SEQ ID NO: 198009 - DNA, 20 bp, Artificial Sequence
  chemically synthesized
catttgtggtccaaagactc

SEQ ID NO: 198010 - DNA, 20 bp, Artificial Sequence
  chemically synthesized
atcagtagccctggagtctt

SEQ ID NO: 198011 - DNA, 20 bp, Artificial Sequence
  chemically synthesized
atttgtggtccaaagactcc

SEQ ID NO: 198012 - DNA, 20 bp, Artificial Sequence
  chemically synthesized
tttgtggtccaaagactcca

SEQ ID NO: 198013 - DNA, 20 bp, Artificial Sequence
  chemically synthesized
ttctctaatcagtagccctg

SEQ ID NO: 198014 - DNA, 20 bp, Artificial Sequence
  chemically synthesized
ttttctctaatcagtagccc

SEQ ID NO: 198015 - DNA, 20 bp, Artificial Sequence
  chemically synthesized
aagactccagggctactgat

SEQ ID NO: 198016 - DNA, 20 bp, Artificial Sequence
  chemically synthesized
gactccagggctactgatta

SEQ ID NO: 198017 - DNA, 20 bp, Artificial Sequence
  chemically synthesized
atgcatttttctctaatcag

SEQ ID NO: 198018 - DNA, 20 bp, Artificial Sequence
  chemically synthesized
gacatgcatttttctctaat

SEQ ID NO: 198019 - DNA, 20 bp, Artificial Sequence
  chemically synthesized
attagagaaaaatgcatgtc

SEQ ID NO: 198020 - DNA, 20 bp, Artificial Sequence
  chemically synthesized
atcatataaatgtatttaac

SEQ ID NO: 198021 - DNA, 20 bp, Artificial Sequence
  chemically synthesized
tacatttatatgataattac

SEQ ID NO: 198022 - DNA, 20 bp, Artificial Sequence
  chemically synthesized
atgataattactagataatc

SEQ ID NO: 198023 - DNA, 20 bp, Artificial Sequence
  chemically synthesized
attataaagtccagattatc

SEQ ID NO: 198024 - DNA, 20 bp, Artificial Sequence
  chemically synthesized
tatatctgaattataaagtc

SEQ ID NO: 198025 - DNA, 20 bp, Artificial Sequence
  chemically synthesized
ataatctggactttataatt

SEQ ID NO: 198026 - DNA, 20 bp, Artificial Sequence
  chemically synthesized
tattttatatctgaattata

SEQ ID NO: 198027 - DNA, 20 bp, Artificial Sequence
  chemically synthesized
cagttgatgaaatggagatg

SEQ ID NO: 198028 - DNA, 20 bp, Artificial Sequence
  chemically synthesized
tcagttgatgaaatggagat

SEQ ID NO: 198029 - DNA, 20 bp, Artificial Sequence
  chemically synthesized
atgtctcagttgatgaaatg

SEQ ID NO: 198030 - DNA, 20 bp, Artificial Sequence
  chemically synthesized
aaatgtctcagttgatgaaa

SEQ ID NO: 198031 - DNA, 20 bp, Artificial Sequence
  chemically synthesized
tcatctccatttcatcaact

SEQ ID NO: 198032 - DNA, 20 bp, Artificial Sequence
  chemically synthesized
taaagtcaaaataaatgtct

SEQ ID NO: 198033 - DNA, 20 bp, Artificial Sequence
  chemically synthesized
tgagacatttattttgactt

SEQ ID NO: 198034 - DNA, 20 bp, Artificial Sequence
  chemically synthesized
atttattttgactttagctt

SEQ ID NO: 198035 - DNA, 20 bp, Artificial Sequence
  chemically synthesized
gcttattatctctaaagcta

SEQ ID NO: 198036 - DNA, 20 bp, Artificial Sequence
  chemically synthesized
ttattttgactttagcttta

SEQ ID NO: 198037 - DNA, 20 bp, Artificial Sequence
  chemically synthesized
ctcttagcttattatctcta

SEQ ID NO: 198038 - DNA, 20 bp, Artificial Sequence
  chemically synthesized
actttagctttagagataat

SEQ ID NO: 198039 - DNA, 20 bp, Artificial Sequence
  chemically synthesized
agctttagagataataagct

SEQ ID NO: 198040 - DNA, 20 bp, Artificial Sequence
  chemically synthesized
ctttagagataataagctaa

SEQ ID NO: 198041 - DNA, 20 bp, Artificial Sequence
  chemically synthesized
tgcttctaagtggcagctct

SEQ ID NO: 198042 - DNA, 20 bp, Artificial Sequence
  chemically synthesized
ataagctaagagctgccact

SEQ ID NO: 198043 - DNA, 20 bp, Artificial Sequence
  chemically synthesized
tttaatatgcttctaagtgg

SEQ ID NO: 198044 - DNA, 20 bp, Artificial Sequence
  chemically synthesized
agctaagagctgccacttag

SEQ ID NO: 198045 - DNA, 20 bp, Artificial Sequence
  chemically synthesized
agttttaatatgcttctaag

SEQ ID NO: 198046 - DNA, 20 bp, Artificial Sequence
  chemically synthesized
tgaagttttaatatgcttct

SEQ ID NO: 198047 - DNA, 20 bp, Artificial Sequence
  chemically synthesized
aagcatattaaaacttcacg

SEQ ID NO: 198048 - DNA, 20 bp, Artificial Sequence
  chemically synthesized
gcatgttgtaaaacttcgtg

SEQ ID NO: 198049 - DNA, 20 bp, Artificial Sequence
  chemically synthesized
aagctaataaagcattaaat

SEQ ID NO: 198050 - DNA, 20 bp, Artificial Sequence
  chemically synthesized
atgctaatttaatgctttat

SEQ ID NO: 198051 - DNA, 20 bp, Artificial Sequence
  chemically synthesized
ttaaatgaaataagctaata

SEQ ID NO: 198052 - DNA, 20 bp, Artificial Sequence
  chemically synthesized
tttgtaatcttaaatgaaat

SEQ ID NO: 198053 - DNA, 20 bp, Artificial Sequence
  chemically synthesized
tttattagcttatttcattt

SEQ ID NO: 198054 - DNA, 20 bp, Artificial Sequence
  chemically synthesized
ttatttcatttaagattaca

SEQ ID NO: 198055 - DNA, 20 bp, Artificial Sequence
  chemically synthesized
acacttcaccaagatcattt

SEQ ID NO: 198056 - DNA, 20 bp, Artificial Sequence
  chemically synthesized
acaaagaactaaaatgatct

SEQ ID NO: 198057 - DNA, 20 bp, Artificial Sequence
  chemically synthesized
gaactaaaatgatcttggtg

SEQ ID NO: 198058 - DNA, 20 bp, Artificial Sequence
  chemically synthesized
gattggatcaacacttcacc

SEQ ID NO: 198059 - DNA, 20 bp, Artificial Sequence
  chemically synthesized
gtcccattgtggaatgagat

SEQ ID NO: 198060 - DNA, 20 bp, Artificial Sequence
  chemically synthesized
attaagtcccattgtggaat

SEQ ID NO: 198061 - DNA, 20 bp, Artificial Sequence
  chemically synthesized
gatccaatctcattccacaa

SEQ ID NO: 198062 - DNA, 20 bp, Artificial Sequence
  chemically synthesized
atccaatctcattccacaat

SEQ ID NO: 198063 - DNA, 20 bp, Artificial Sequence
  chemically synthesized
gcagaaattaagtcccattg

SEQ ID NO: 198064 - DNA, 20 bp, Artificial Sequence
  chemically synthesized
ttgccttctaggcagaaatt

SEQ ID NO: 198065 - DNA, 20 bp, Artificial Sequence
  chemically synthesized
aatgggacttaatttctgcc

SEQ ID NO: 198066 - DNA, 20 bp, Artificial Sequence
  chemically synthesized
gggacttaatttctgcctag

SEQ ID NO: 198067 - DNA, 20 bp, Artificial Sequence
  chemically synthesized
ggacttaatttctgcctaga

SEQ ID NO: 198068 - DNA, 20 bp, Artificial Sequence
  chemically synthesized
gtctaagtttgccttctagg

SEQ ID NO: 198069 - DNA, 20 bp, Artificial Sequence
  chemically synthesized
aatgtctaagtttgccttct

SEQ ID NO: 198070 - DNA, 20 bp, Artificial Sequence
  chemically synthesized
aaatgtctaagtttgccttc

SEQ ID NO: 198071 - DNA, 20 bp, Artificial Sequence
  chemically synthesized
ttctgcctagaaggcaaact

SEQ ID NO: 198072 - DNA, 20 bp, Artificial Sequence
  chemically synthesized
atttccaaatttaaatgtct

SEQ ID NO: 198073 - DNA, 20 bp, Artificial Sequence
  chemically synthesized
caaacttagacatttaaatt

SEQ ID NO: 198074 - DNA, 20 bp, Artificial Sequence
  chemically synthesized
catttaaatttggaaattaa

SEQ ID NO: 198075 - DNA, 20 bp, Artificial Sequence
  chemically synthesized
taaatttggaaattaaaaga

SEQ ID NO: 198076 - DNA, 20 bp, Artificial Sequence
  chemically synthesized
ttagtaacactgatatataa

SEQ ID NO: 198077 - DNA, 20 bp, Artificial Sequence
  chemically synthesized
agaaagaaactgttatatat

SEQ ID NO: 198078 - DNA, 20 bp, Artificial Sequence
  chemically synthesized
atcagtgttactaaaccctg

SEQ ID NO: 198079 - DNA, 20 bp, Artificial Sequence
  chemically synthesized
atgtttttgtcttcagggtt

SEQ ID NO: 198080 - DNA, 20 bp, Artificial Sequence
  chemically synthesized
tatatatgtttttgtcttca

SEQ ID NO: 198081 - DNA, 20 bp, Artificial Sequence
  chemically synthesized
ctatatatgtttttgtcttc

SEQ ID NO: 198082 - DNA, 20 bp, Artificial Sequence
  chemically synthesized
tctatatatgtttttgtctt

SEQ ID NO: 198083 - DNA, 20 bp, Artificial Sequence
  chemically synthesized
cctgaagacaaaaacatata

SEQ ID NO: 198084 - DNA, 20 bp, Artificial Sequence
  chemically synthesized
tgaagacaaaaacatatata

SEQ ID NO: 198085 - DNA, 20 bp, Artificial Sequence
  chemically synthesized
tagagaattgaaaattaatg

SEQ ID NO: 198086 - DNA, 20 bp, Artificial Sequence
  chemically synthesized
aattgaaaattaatgtagtt

SEQ ID NO: 198087 - DNA, 20 bp, Artificial Sequence
  chemically synthesized
ttaatgtagttcagctgcct

SEQ ID NO: 198088 - DNA, 20 bp, Artificial Sequence
  chemically synthesized
gcagcatattaaatctcagg

SEQ ID NO: 198089 - DNA, 20 bp, Artificial Sequence
  chemically synthesized
ttggcagcatattaaatctc

SEQ ID NO: 198090 - DNA, 20 bp, Artificial Sequence
  chemically synthesized
tttggcagcatattaaatct

SEQ ID NO: 198091 - DNA, 20 bp, Artificial Sequence
  chemically synthesized
tgaataatattttgttttgg

SEQ ID NO: 198092 - DNA, 20 bp, Artificial Sequence
  chemically synthesized
ttatgaataatattttgttt

SEQ ID NO: 198093 - DNA, 20 bp, Artificial Sequence
  chemically synthesized
atttagtctctacaattgaa

SEQ ID NO: 198094 - DNA, 20 bp, Artificial Sequence
  chemically synthesized
cataaaacacttttcaattg

SEQ ID NO: 198095 - DNA, 20 bp, Artificial Sequence
  chemically synthesized
taaaacacttttcaattgta

SEQ ID NO: 198096 - DNA, 20 bp, Artificial Sequence
  chemically synthesized
tatttaggaggaaaataatt

SEQ ID NO: 198097 - DNA, 20 bp, Artificial Sequence
  chemically synthesized
gagaaagaaacatatttagg

SEQ ID NO: 198098 - DNA, 20 bp, Artificial Sequence
  chemically synthesized
ggagaaagaaacatatttag

SEQ ID NO: 198099 - DNA, 20 bp, Artificial Sequence
  chemically synthesized
ggggagaaagaaacatattt

SEQ ID NO: 198100 - DNA, 20 bp, Artificial Sequence
  chemically synthesized
aggggagaaagaaacatatt

SEQ ID NO: 198101 - DNA, 20 bp, Artificial Sequence
  chemically synthesized
ttaatcgttgaaaggggaga

SEQ ID NO: 198102 - DNA, 20 bp, Artificial Sequence
  chemically synthesized
ttttttaatcgttgaaaggg

SEQ ID NO: 198103 - DNA, 20 bp, Artificial Sequence
  chemically synthesized
cattttttaatcgttgaaag

SEQ ID NO: 198104 - DNA, 20 bp, Artificial Sequence
  chemically synthesized
acattttttaatcgttgaaa

SEQ ID NO: 198105 - DNA, 20 bp, Artificial Sequence
  chemically synthesized
tacattttttaatcgttgaa

SEQ ID NO: 198106 - DNA, 20 bp, Artificial Sequence
  chemically synthesized
atacattttttaatcgttga

SEQ ID NO: 198107 - DNA, 20 bp, Artificial Sequence
  chemically synthesized
ctatgtgctacaaagaggaa

SEQ ID NO: 198108 - DNA, 20 bp, Artificial Sequence
  chemically synthesized
aatgtatctattcctctttg

SEQ ID NO: 198109 - DNA, 20 bp, Artificial Sequence
  chemically synthesized
tacagctatgtgctacaaag

SEQ ID NO: 198110 - DNA, 20 bp, Artificial Sequence
  chemically synthesized
atacagctatgtgctacaaa

SEQ ID NO: 198111 - DNA, 20 bp, Artificial Sequence
  chemically synthesized
acatacagctatgtgctaca

SEQ ID NO: 198112 - DNA, 20 bp, Artificial Sequence
  chemically synthesized
ctattcctctttgtagcaca

SEQ ID NO: 198113 - DNA, 20 bp, Artificial Sequence
  chemically synthesized
taacctcttacgtatacata

SEQ ID NO: 198114 - DNA, 20 bp, Artificial Sequence
  chemically synthesized
acatagctgtatgtatacgt

SEQ ID NO: 198115 - DNA, 20 bp, Artificial Sequence
  chemically synthesized
atagctgtatgtatacgtaa

SEQ ID NO: 198116 - DNA, 20 bp, Artificial Sequence
  chemically synthesized
tagctgtatgtatacgtaag

SEQ ID NO: 198117 - DNA, 20 bp, Artificial Sequence
  chemically synthesized
tatacgtaagaggttaatgc

SEQ ID NO: 198118 - DNA, 20 bp, Artificial Sequence
  chemically synthesized
acgtaagaggttaatgccag

SEQ ID NO: 198119 - DNA, 20 bp, Artificial Sequence
  chemically synthesized
gatctctttgttatagctac

SEQ ID NO: 198120 - DNA, 20 bp, Artificial Sequence
  chemically synthesized
taatgccagtagctataaca

SEQ ID NO: 198121 - DNA, 20 bp, Artificial Sequence
  chemically synthesized
atgccagtagctataacaaa

SEQ ID NO: 198122 - DNA, 20 bp, Artificial Sequence
  chemically synthesized
attgtgggatctctttgtta

SEQ ID NO: 198123 - DNA, 20 bp, Artificial Sequence
  chemically synthesized
acaaagagatcccacaattt

SEQ ID NO: 198124 - DNA, 20 bp, Artificial Sequence
  chemically synthesized
tcttaagccactaaaattgt

SEQ ID NO: 198125 - DNA, 20 bp, Artificial Sequence
  chemically synthesized
ttcttaagccactaaaattg

SEQ ID NO: 198126 - DNA, 20 bp, Artificial Sequence
  chemically synthesized
aagagatcccacaattttag

SEQ ID NO: 198127 - DNA, 20 bp, Artificial Sequence
  chemically synthesized
tcccacaattttagtggctt

SEQ ID NO: 198128 - DNA, 20 bp, Artificial Sequence
  chemically synthesized
caattttagtggcttaagaa

SEQ ID NO: 198129 - DNA, 20 bp, Artificial Sequence
  chemically synthesized
gtagtattctttcttttctt

SEQ ID NO: 198130 - DNA, 20 bp, Artificial Sequence
  chemically synthesized
tttagtggcttaagaaaaga

SEQ ID NO: 198131 - DNA, 20 bp, Artificial Sequence
  chemically synthesized
aaagaaagaatactacaaaa

SEQ ID NO: 198132 - DNA, 20 bp, Artificial Sequence
  chemically synthesized
aagaaagaatactacaaaat

SEQ ID NO: 198133 - DNA, 20 bp, Artificial Sequence
  chemically synthesized
agatgggaatgcccattttg

SEQ ID NO: 198134 - DNA, 20 bp, Artificial Sequence
  chemically synthesized
gagaaaagctgtttgcagat

SEQ ID NO: 198135 - DNA, 20 bp, Artificial Sequence
  chemically synthesized
agagaaaagctgtttgcaga

SEQ ID NO: 198136 - DNA, 20 bp, Artificial Sequence
  chemically synthesized
tgggcattcccatctgcaaa

SEQ ID NO: 198137 - DNA, 20 bp, Artificial Sequence
  chemically synthesized
gggtagagaaaagctgtttg

SEQ ID NO: 198138 - DNA, 20 bp, Artificial Sequence
  chemically synthesized
ctgaattactgggtagagaa

SEQ ID NO: 198139 - DNA, 20 bp, Artificial Sequence
  chemically synthesized
gcaaacagcttttctctacc

SEQ ID NO: 198140 - DNA, 20 bp, Artificial Sequence
  chemically synthesized
agtccctgaattactgggta

SEQ ID NO: 198141 - DNA, 20 bp, Artificial Sequence
  chemically synthesized
agagtccctgaattactggg

SEQ ID NO: 198142 - DNA, 20 bp, Artificial Sequence
  chemically synthesized
cttttctctacccagtaatt

SEQ ID NO: 198143 - DNA, 20 bp, Artificial Sequence
  chemically synthesized
ctcagagtccctgaattact

SEQ ID NO: 198144 - DNA, 20 bp, Artificial Sequence
  chemically synthesized
ttttctctacccagtaattc

SEQ ID NO: 198145 - DNA, 20 bp, Artificial Sequence
  chemically synthesized
actcagagtccctgaattac

SEQ ID NO: 198146 - DNA, 20 bp, Artificial Sequence
  chemically synthesized
tttctctacccagtaattca

SEQ ID NO: 198147 - DNA, 20 bp, Artificial Sequence
  chemically synthesized
cccagtaattcagggactct

SEQ ID NO: 198148 - DNA, 20 bp, Artificial Sequence
  chemically synthesized
gcctaaaatggaaggactca

SEQ ID NO: 198149 - DNA, 20 bp, Artificial Sequence
  chemically synthesized
aagcctaaaatggaaggact

SEQ ID NO: 198150 - DNA, 20 bp, Artificial Sequence
  chemically synthesized
gactctgagtccttccattt

SEQ ID NO: 198151 - DNA, 20 bp, Artificial Sequence
  chemically synthesized
atgaaaaagcctaaaatgga

SEQ ID NO: 198152 - DNA, 20 bp, Artificial Sequence
  chemically synthesized
actctgagtccttccatttt

SEQ ID NO: 198153 - DNA, 20 bp, Artificial Sequence
  chemically synthesized
gatgaaaaagcctaaaatgg

SEQ ID NO: 198154 - DNA, 20 bp, Artificial Sequence
  chemically synthesized
ggagatgaaaaagcctaaaa

SEQ ID NO: 198155 - DNA, 20 bp, Artificial Sequence
  chemically synthesized
caaagacctaggagatgaaa

SEQ ID NO: 198156 - DNA, 20 bp, Artificial Sequence
  chemically synthesized
ttttaggctttttcatctcc

SEQ ID NO: 198157 - DNA, 20 bp, Artificial Sequence
  chemically synthesized
tttaggctttttcatctcct

SEQ ID NO: 198158 - DNA, 20 bp, Artificial Sequence
  chemically synthesized
aaagagtcccaaagacctag

SEQ ID NO: 198159 - DNA, 20 bp, Artificial Sequence
  chemically synthesized
tttttcatctcctaggtctt

SEQ ID NO: 198160 - DNA, 20 bp, Artificial Sequence
  chemically synthesized
gaaaagagtcccaaagacct

SEQ ID NO: 198161 - DNA, 20 bp, Artificial Sequence
  chemically synthesized
ttttcatctcctaggtcttt

SEQ ID NO: 198162 - DNA, 20 bp, Artificial Sequence
  chemically synthesized
ggaaaagagtcccaaagacc

SEQ ID NO: 198163 - DNA, 20 bp, Artificial Sequence
  chemically synthesized
ccttatggaaaagagtccca

SEQ ID NO: 198164 - DNA, 20 bp, Artificial Sequence
  chemically synthesized
tttgctaaccttatggaaaa

SEQ ID NO: 198165 - DNA, 20 bp, Artificial Sequence
  chemically synthesized
tctttgggactcttttccat

SEQ ID NO: 198166 - DNA, 20 bp, Artificial Sequence
  chemically synthesized
ctttgggactcttttccata

SEQ ID NO: 198167 - DNA, 20 bp, Artificial Sequence
  chemically synthesized
catttgctaaccttatggaa

SEQ ID NO: 198168 - DNA, 20 bp, Artificial Sequence
  chemically synthesized
gggactcttttccataaggt

SEQ ID NO: 198169 - DNA, 20 bp, Artificial Sequence
  chemically synthesized
cttcccatttgctaacctta

SEQ ID NO: 198170 - DNA, 20 bp, Artificial Sequence
  chemically synthesized
ttttccataaggttagcaaa

SEQ ID NO: 198171 - DNA, 20 bp, Artificial Sequence
  chemically synthesized
tttccataaggttagcaaat

SEQ ID NO: 198172 - DNA, 20 bp, Artificial Sequence
  chemically synthesized
ccataaggttagcaaatggg

SEQ ID NO: 198173 - DNA, 20 bp, Artificial Sequence
  chemically synthesized
aaggttagcaaatgggaagt

SEQ ID NO: 198174 - DNA, 20 bp, Artificial Sequence
  chemically synthesized
gttagcaaatgggaagtaag

SEQ ID NO: 198175 - DNA, 20 bp, Artificial Sequence
  chemically synthesized
gcaaatgggaagtaagaaga

SEQ ID NO: 198176 - DNA, 20 bp, Artificial Sequence
  chemically synthesized
tgggaagtaagaagatggaa

SEQ ID NO: 198177 - DNA, 20 bp, Artificial Sequence
  chemically synthesized
gggaagtaagaagatggaaa

SEQ ID NO: 198178 - DNA, 20 bp, Artificial Sequence
  chemically synthesized
gtgagtgggagttatgttgc

SEQ ID NO: 198179 - DNA, 20 bp, Artificial Sequence
  chemically synthesized
tgtgagtgggagttatgttg

SEQ ID NO: 198180 - DNA, 20 bp, Artificial Sequence
  chemically synthesized
gaccaattgaatgtgagtgg

SEQ ID NO: 198181 - DNA, 20 bp, Artificial Sequence
  chemically synthesized
gtgaccaattgaatgtgagt

SEQ ID NO: 198182 - DNA, 20 bp, Artificial Sequence
  chemically synthesized
tgtgaccaattgaatgtgag

SEQ ID NO: 198183 - DNA, 20 bp, Artificial Sequence
  chemically synthesized
agttgtgaccaattgaatgt

SEQ ID NO: 198184 - DNA, 20 bp, Artificial Sequence
  chemically synthesized
aactcccactcacattcaat

SEQ ID NO: 198185 - DNA, 20 bp, Artificial Sequence
  chemically synthesized
cacattcaattggtcacaac

SEQ ID NO: 198186 - DNA, 20 bp, Artificial Sequence
  chemically synthesized
attggtcacaactagtcaca

SEQ ID NO: 198187 - DNA, 20 bp, Artificial Sequence
  chemically synthesized
tctagttagagccatgtgac

SEQ ID NO: 198188 - DNA, 20 bp, Artificial Sequence
  chemically synthesized
actagtcacatggctctaac

SEQ ID NO: 198189 - DNA, 20 bp, Artificial Sequence
  chemically synthesized
gccccactggcatctagtta

SEQ ID NO: 198190 - DNA, 20 bp, Artificial Sequence
  chemically synthesized
cagccccactggcatctagt

SEQ ID NO: 198191 - DNA, 20 bp, Artificial Sequence
  chemically synthesized
acatggctctaactagatgc

SEQ ID NO: 198192 - DNA, 20 bp, Artificial Sequence
  chemically synthesized
ttcccagccccactggcatc

SEQ ID NO: 198193 - DNA, 20 bp, Artificial Sequence
  chemically synthesized
tggctctaactagatgccag

SEQ ID NO: 198194 - DNA, 20 bp, Artificial Sequence
  chemically synthesized
ggctctaactagatgccagt

SEQ ID NO: 198195 - DNA, 20 bp, Artificial Sequence
  chemically synthesized
gctctaactagatgccagtg

SEQ ID NO: 198196 - DNA, 20 bp, Artificial Sequence
  chemically synthesized
taactagatgccagtggggc

SEQ ID NO: 198197 - DNA, 20 bp, Artificial Sequence
  chemically synthesized
actacatttcccagccccac

SEQ ID NO: 198198 - DNA, 20 bp, Artificial Sequence
  chemically synthesized
aactagatgccagtggggct

SEQ ID NO: 198199 - DNA, 20 bp, Artificial Sequence
  chemically synthesized
gccagtggggctgggaaatg

SEQ ID NO: 198200 - DNA, 20 bp, Artificial Sequence
  chemically synthesized
aagccagcaactacatttcc

SEQ ID NO: 198201 - DNA, 20 bp, Artificial Sequence
  chemically synthesized
gggctgggaaatgtagttgc

SEQ ID NO: 198202 - DNA, 20 bp, Artificial Sequence
  chemically synthesized
gaaatgtagttgctggcttg

SEQ ID NO: 198203 - DNA, 20 bp, Artificial Sequence
  chemically synthesized
gctaggatccagctgcaagc

SEQ ID NO: 198204 - DNA, 20 bp, Artificial Sequence
  chemically synthesized
tgtagttgctggcttgcagc

SEQ ID NO: 198205 - DNA, 20 bp, Artificial Sequence
  chemically synthesized
tcttgctaggatccagctgc

SEQ ID NO: 198206 - DNA, 20 bp, Artificial Sequence
  chemically synthesized
gctggcttgcagctggatcc

SEQ ID NO: 198207 - DNA, 20 bp, Artificial Sequence
  chemically synthesized
atagagttcttgctaggatc

SEQ ID NO: 198208 - DNA, 20 bp, Artificial Sequence
  chemically synthesized
gcttgcagctggatcctagc

SEQ ID NO: 198209 - DNA, 20 bp, Artificial Sequence
  chemically synthesized
catagtatagagttcttgct

SEQ ID NO: 198210 - DNA, 20 bp, Artificial Sequence
  chemically synthesized
tcatagtatagagttcttgc

SEQ ID NO: 198211 - DNA, 20 bp, Artificial Sequence
  chemically synthesized
ggtccctctttcatagtata

SEQ ID NO: 198212 - DNA, 20 bp, Artificial Sequence
  chemically synthesized
gtggtccctctttcatagta

SEQ ID NO: 198213 - DNA, 20 bp, Artificial Sequence
  chemically synthesized
gcaagaactctatactatga

SEQ ID NO: 198214 - DNA, 20 bp, Artificial Sequence
  chemically synthesized
aagaactctatactatgaaa

SEQ ID NO: 198215 - DNA, 20 bp, Artificial Sequence
  chemically synthesized
agaactctatactatgaaag

SEQ ID NO: 198216 - DNA, 20 bp, Artificial Sequence
  chemically synthesized
gaactctatactatgaaaga

SEQ ID NO: 198217 - DNA, 20 bp, Artificial Sequence
  chemically synthesized
aattcgtggtccctctttca

SEQ ID NO: 198218 - DNA, 20 bp, Artificial Sequence
  chemically synthesized
caagtgtacatcaaaattcg

SEQ ID NO: 198219 - DNA, 20 bp, Artificial Sequence
  chemically synthesized
gcatatgttgtggcagagac

SEQ ID NO: 198220 - DNA, 20 bp, Artificial Sequence
  chemically synthesized
ttcaagcatatgttgtggca

SEQ ID NO: 198221 - DNA, 20 bp, Artificial Sequence
  chemically synthesized
ctttcaagcatatgttgtgg

SEQ ID NO: 198222 - DNA, 20 bp, Artificial Sequence
  chemically synthesized
tttctttcaagcatatgttg

SEQ ID NO: 198223 - DNA, 20 bp, Artificial Sequence
  chemically synthesized
ctgccacaacatatgcttga

SEQ ID NO: 198224 - DNA, 20 bp, Artificial Sequence
  chemically synthesized
acaacatatgcttgaaagaa

SEQ ID NO: 198225 - DNA, 20 bp, Artificial Sequence
  chemically synthesized
ctcaacctttcttttctttc

SEQ ID NO: 198226 - DNA, 20 bp, Artificial Sequence
  chemically synthesized
catatgcttgaaagaaaaga

SEQ ID NO: 198227 - DNA, 20 bp, Artificial Sequence
  chemically synthesized
atatgcttgaaagaaaagaa

SEQ ID NO: 198228 - DNA, 20 bp, Artificial Sequence
  chemically synthesized
cttgaaagaaaagaaaggtt

SEQ ID NO: 198229 - DNA, 20 bp, Artificial Sequence
  chemically synthesized
tgcacacacacacacacaca

SEQ ID NO: 198230 - DNA, 20 bp, Artificial Sequence
  chemically synthesized
cacacacacacacacacaca

SEQ ID NO: 198231 - DNA, 20 bp, Artificial Sequence
  chemically synthesized
cacacacacacacacacaga

SEQ ID NO: 198232 - DNA, 20 bp, Artificial Sequence
  chemically synthesized
cacacacacacacacagaga

SEQ ID NO: 198233 - DNA, 20 bp, Artificial Sequence
  chemically synthesized
cacacacacacacagagaga

SEQ ID NO: 198234 - DNA, 20 bp, Artificial Sequence
  chemically synthesized
cacacacacacagagagaga

SEQ ID NO: 198235 - DNA, 20 bp, Artificial Sequence
  chemically synthesized
cacacacacagagagagaga

SEQ ID NO: 198236 - DNA, 20 bp, Artificial Sequence
  chemically synthesized
cacacacagagagagagaga

SEQ ID NO: 198237 - DNA, 20 bp, Artificial Sequence
  chemically synthesized
cacacagagagagagagaga

SEQ ID NO: 198238 - DNA, 20 bp, Artificial Sequence
  chemically synthesized
cacagagagagagagagaga

SEQ ID NO: 198239 - DNA, 20 bp, Artificial Sequence
  chemically synthesized
cagagagagagagagagaga

SEQ ID NO: 198240 - DNA, 20 bp, Artificial Sequence
  chemically synthesized
agagagagagagagagagag

SEQ ID NO: 198241 - DNA, 20 bp, Artificial Sequence
  chemically synthesized
gagagagagagagagagaag

SEQ ID NO: 198242 - DNA, 20 bp, Artificial Sequence
  chemically synthesized
agagagagagagagagaagc

SEQ ID NO: 198243 - DNA, 20 bp, Artificial Sequence
  chemically synthesized
gagagagagagagagaagcg

SEQ ID NO: 198244 - DNA, 20 bp, Artificial Sequence
  chemically synthesized
agagagagagagagaagcgg

SEQ ID NO: 198245 - DNA, 20 bp, Artificial Sequence
  chemically synthesized
gagagagagagaagcggggg

SEQ ID NO: 198246 - DNA, 20 bp, Artificial Sequence
  chemically synthesized
agagagagagaagcggggga

SEQ ID NO: 198247 - DNA, 20 bp, Artificial Sequence
  chemically synthesized
agagagaagcgggggaaggc

SEQ ID NO: 198248 - DNA, 20 bp, Artificial Sequence
  chemically synthesized
gagagaagcgggggaaggct

SEQ ID NO: 198249 - DNA, 20 bp, Artificial Sequence
  chemically synthesized
agagaagcgggggaaggctg

SEQ ID NO: 198250 - DNA, 20 bp, Artificial Sequence
  chemically synthesized
agaagcgggggaaggctggg

SEQ ID NO: 198251 - DNA, 20 bp, Artificial Sequence
  chemically synthesized
aagcgggggaaggctgggga

SEQ ID NO: 198252 - DNA, 20 bp, Artificial Sequence
  chemically synthesized
gcgggggaaggctggggaga

SEQ ID NO: 198253 - DNA, 20 bp, Artificial Sequence
  chemically synthesized
tctctctctctctctctccc

SEQ ID NO: 198254 - DNA, 20 bp, Artificial Sequence
  chemically synthesized
gggggaaggctggggagaga

SEQ ID NO: 198255 - DNA, 20 bp, Artificial Sequence
  chemically synthesized
gggaaggctggggagagaga

SEQ ID NO: 198256 - DNA, 20 bp, Artificial Sequence
  chemically synthesized
gaaggctggggagagagaga

SEQ ID NO: 198257 - DNA, 20 bp, Artificial Sequence
  chemically synthesized
aggctggggagagagagaga

SEQ ID NO: 198258 - DNA, 20 bp, Artificial Sequence
  chemically synthesized
gctggggagagagagagaga

SEQ ID NO: 198259 - DNA, 20 bp, Artificial Sequence
  chemically synthesized
gaaaggtatgaaaaatatga

SEQ ID NO: 198260 - DNA, 20 bp, Artificial Sequence
  chemically synthesized
atgctagagaacaggatgaa

SEQ ID NO: 198261 - DNA, 20 bp, Artificial Sequence
  chemically synthesized
gatgctagagaacaggatga

SEQ ID NO: 198262 - DNA, 20 bp, Artificial Sequence
  chemically synthesized
atacctttcatcctgttctc

SEQ ID NO: 198263 - DNA, 20 bp, Artificial Sequence
  chemically synthesized
ttacttagatgctagagaac

SEQ ID NO: 198264 - DNA, 20 bp, Artificial Sequence
  chemically synthesized
tttacttagatgctagagaa

SEQ ID NO: 198265 - DNA, 20 bp, Artificial Sequence
  chemically synthesized
ttctatttacttagatgcta

SEQ ID NO: 198266 - DNA, 20 bp, Artificial Sequence
  chemically synthesized
catcctgttctctagcatct

SEQ ID NO: 198267 - DNA, 20 bp, Artificial Sequence
  chemically synthesized
atttctatttacttagatgc

SEQ ID NO: 198268 - DNA, 20 bp, Artificial Sequence
  chemically synthesized
ttctctagcatctaagtaaa

SEQ ID NO: 198269 - DNA, 20 bp, Artificial Sequence
  chemically synthesized
gtacagcatttctatttact

SEQ ID NO: 198270 - DNA, 20 bp, Artificial Sequence
  chemically synthesized
agttaacagaaggggaggta

SEQ ID NO: 198271 - DNA, 20 bp, Artificial Sequence
  chemically synthesized
aaatgagttaacagaagggg

SEQ ID NO: 198272 - DNA, 20 bp, Artificial Sequence
  chemically synthesized
aaaatgagttaacagaaggg

SEQ ID NO: 198273 - DNA, 20 bp, Artificial Sequence
  chemically synthesized
gaaaaatgagttaacagaag

SEQ ID NO: 198274 - DNA, 20 bp, Artificial Sequence
  chemically synthesized
agaaaaatgagttaacagaa

SEQ ID NO: 198275 - DNA, 20 bp, Artificial Sequence
  chemically synthesized
gagaaaaatgagttaacaga

SEQ ID NO: 198276 - DNA, 20 bp, Artificial Sequence
  chemically synthesized
ggagaaaaatgagttaacag

SEQ ID NO: 198277 - DNA, 20 bp, Artificial Sequence
  chemically synthesized
aagggagaaaaatgagttaa

SEQ ID NO: 198278 - DNA, 20 bp, Artificial Sequence
  chemically synthesized
catgtttaagggagaaaaat

SEQ ID NO: 198279 - DNA, 20 bp, Artificial Sequence
  chemically synthesized
tgtcttctacatgtttaagg

SEQ ID NO: 198280 - DNA, 20 bp, Artificial Sequence
  chemically synthesized
tttgtcttctacatgtttaa

SEQ ID NO: 198281 - DNA, 20 bp, Artificial Sequence
  chemically synthesized
ctttgtcttctacatgttta

SEQ ID NO: 198282 - DNA, 20 bp, Artificial Sequence
  chemically synthesized
atttttctcccttaaacatg

SEQ ID NO: 198283 - DNA, 20 bp, Artificial Sequence
  chemically synthesized
actttgtcttctacatgttt

SEQ ID NO: 198284 - DNA, 20 bp, Artificial Sequence
  chemically synthesized
tttctcccttaaacatgtag

SEQ ID NO: 198285 - DNA, 20 bp, Artificial Sequence
  chemically synthesized
ccttaaacatgtagaagaca

SEQ ID NO: 198286 - DNA, 20 bp, Artificial Sequence
  chemically synthesized
aaacatgtagaagacaaagt

SEQ ID NO: 198287 - DNA, 20 bp, Artificial Sequence
  chemically synthesized
gtagaagacaaagtaagtcc

SEQ ID NO: 198288 - DNA, 20 bp, Artificial Sequence
  chemically synthesized
gaagacaaagtaagtcctgg

SEQ ID NO: 198289 - DNA, 20 bp, Artificial Sequence
  chemically synthesized
agacaaagtaagtcctggca

SEQ ID NO: 198290 - DNA, 20 bp, Artificial Sequence
  chemically synthesized
ccaagctttttttctctgcc

SEQ ID NO: 198291 - DNA, 20 bp, Artificial Sequence
  chemically synthesized
accaagctttttttctctgc

SEQ ID NO: 198292 - DNA, 20 bp, Artificial Sequence
  chemically synthesized
taagtcctggcagagaaaaa

SEQ ID NO: 198293 - DNA, 20 bp, Artificial Sequence
  chemically synthesized
cctggcagagaaaaaaagct

SEQ ID NO: 198294 - DNA, 20 bp, Artificial Sequence
  chemically synthesized
gagaaaaaaagcttggtgta

SEQ ID NO: 198295 - DNA, 20 bp, Artificial Sequence
  chemically synthesized
attcctttcttctttacacc

SEQ ID NO: 198296 - DNA, 20 bp, Artificial Sequence
  chemically synthesized
aaaaaaagcttggtgtaaag

SEQ ID NO: 198297 - DNA, 20 bp, Artificial Sequence
  chemically synthesized
aaagcttggtgtaaagaaga

SEQ ID NO: 198298 - DNA, 20 bp, Artificial Sequence
  chemically synthesized
aagcttggtgtaaagaagaa

SEQ ID NO: 198299 - DNA, 20 bp, Artificial Sequence
  chemically synthesized
aaagaagaaaggaattcttg

SEQ ID NO: 198300 - DNA, 20 bp, Artificial Sequence
  chemically synthesized
aagaaaggaattcttgaagt

SEQ ID NO: 198301 - DNA, 20 bp, Artificial Sequence
  chemically synthesized
agaaaggaattcttgaagtt

SEQ ID NO: 198302 - DNA, 20 bp, Artificial Sequence
  chemically synthesized
gaaaggaattcttgaagttg

SEQ ID NO: 198303 - DNA, 20 bp, Artificial Sequence
  chemically synthesized
tctctagtgtccccaacttc

SEQ ID NO: 198304 - DNA, 20 bp, Artificial Sequence
  chemically synthesized
attcttgaagttggggacac

SEQ ID NO: 198305 - DNA, 20 bp, Artificial Sequence
  chemically synthesized
tcttgaagttggggacacta

SEQ ID NO: 198306 - DNA, 20 bp, Artificial Sequence
  chemically synthesized
taaaaacaactgataatctc

SEQ ID NO: 198307 - DNA, 20 bp, Artificial Sequence
  chemically synthesized
ttggggacactagagattat

SEQ ID NO: 198308 - DNA, 20 bp, Artificial Sequence
  chemically synthesized
aagaatccaggtttgatgca

SEQ ID NO: 198309 - DNA, 20 bp, Artificial Sequence
  chemically synthesized
aaagaatccaggtttgatgc

SEQ ID NO: 198310 - DNA, 20 bp, Artificial Sequence
  chemically synthesized
gaaagaatccaggtttgatg

SEQ ID NO: 198311 - DNA, 20 bp, Artificial Sequence
  chemically synthesized
atttttccctgcatcaaacc

SEQ ID NO: 198312 - DNA, 20 bp, Artificial Sequence
  chemically synthesized
ggggtattaggaaagaatcc

SEQ ID NO: 198313 - DNA, 20 bp, Artificial Sequence
  chemically synthesized
aggggtattaggaaagaatc

SEQ ID NO: 198314 - DNA, 20 bp, Artificial Sequence
  chemically synthesized
caaaccaaggggtattagga

SEQ ID NO: 198315 - DNA, 20 bp, Artificial Sequence
  chemically synthesized
actacaaaccaaggggtatt

SEQ ID NO: 198316 - DNA, 20 bp, Artificial Sequence
  chemically synthesized
aactacaaaccaaggggtat

SEQ ID NO: 198317 - DNA, 20 bp, Artificial Sequence
  chemically synthesized
gattctttcctaatacccct

SEQ ID NO: 198318 - DNA, 20 bp, Artificial Sequence
  chemically synthesized
aatgagaactacaaaccaag

SEQ ID NO: 198319 - DNA, 20 bp, Artificial Sequence
  chemically synthesized
taatgagaactacaaaccaa

SEQ ID NO: 198320 - DNA, 20 bp, Artificial Sequence
  chemically synthesized
tcctaataccccttggtttg

SEQ ID NO: 198321 - DNA, 20 bp, Artificial Sequence
  chemically synthesized
ataatgagaactacaaacca

SEQ ID NO: 198322 - DNA, 20 bp, Artificial Sequence
  chemically synthesized
gataatgagaactacaaacc

SEQ ID NO: 198323 - DNA, 20 bp, Artificial Sequence
  chemically synthesized
tggtttgtagttctcattat

SEQ ID NO: 198324 - DNA, 20 bp, Artificial Sequence
  chemically synthesized
tttcatttcatgctgataat

SEQ ID NO: 198325 - DNA, 20 bp, Artificial Sequence
  chemically synthesized
tcattatcagcatgaaatga

SEQ ID NO: 198326 - DNA, 20 bp, Artificial Sequence
  chemically synthesized
attatcagcatgaaatgaaa

SEQ ID NO: 198327 - DNA, 20 bp, Artificial Sequence
  chemically synthesized
ttatcagcatgaaatgaaag

SEQ ID NO: 198328 - DNA, 20 bp, Artificial Sequence
  chemically synthesized
aaatgaaagaggatgtaatt

SEQ ID NO: 198329 - DNA, 20 bp, Artificial Sequence
  chemically synthesized
aatgaaagaggatgtaattc

SEQ ID NO: 198330 - DNA, 20 bp, Artificial Sequence
  chemically synthesized
atgaaagaggatgtaattca

SEQ ID NO: 198331 - DNA, 20 bp, Artificial Sequence
  chemically synthesized
gaggatgtaattcagggtta

SEQ ID NO: 198332 - DNA, 20 bp, Artificial Sequence
  chemically synthesized
tcagggttatagccccacca

SEQ ID NO: 198333 - DNA, 20 bp, Artificial Sequence
  chemically synthesized
cagggttatagccccaccat

SEQ ID NO: 198334 - DNA, 20 bp, Artificial Sequence
  chemically synthesized
agttcagggttcctatggtg

SEQ ID NO: 198335 - DNA, 20 bp, Artificial Sequence
  chemically synthesized
tagttcagggttcctatggt

SEQ ID NO: 198336 - DNA, 20 bp, Artificial Sequence
  chemically synthesized
gtagttcagggttcctatgg

SEQ ID NO: 198337 - DNA, 20 bp, Artificial Sequence
  chemically synthesized
actgtagttcagggttccta

SEQ ID NO: 198338 - DNA, 20 bp, Artificial Sequence
  chemically synthesized
accataggaaccctgaacta

SEQ ID NO: 198339 - DNA, 20 bp, Artificial Sequence
  chemically synthesized
tttcttaagactgtagttca

SEQ ID NO: 198340 - DNA, 20 bp, Artificial Sequence
  chemically synthesized
ctttcttaagactgtagttc

SEQ ID NO: 198341 - DNA, 20 bp, Artificial Sequence
  chemically synthesized
actttcttaagactgtagtt

SEQ ID NO: 198342 - DNA, 20 bp, Artificial Sequence
  chemically synthesized
gaaccctgaactacagtctt

SEQ ID NO: 198343 - DNA, 20 bp, Artificial Sequence
  chemically synthesized
cttaaactttcttaagactg

SEQ ID NO: 198344 - DNA, 20 bp, Artificial Sequence
  chemically synthesized
cctgaactacagtcttaaga

SEQ ID NO: 198345 - DNA, 20 bp, Artificial Sequence
  chemically synthesized
gttcagtcttaaactttctt

SEQ ID NO: 198346 - DNA, 20 bp, Artificial Sequence
  chemically synthesized
ctacagtcttaagaaagttt

SEQ ID NO: 198347 - DNA, 20 bp, Artificial Sequence
  chemically synthesized
aagtttaagactgaaccctt

SEQ ID NO: 198348 - DNA, 20 bp, Artificial Sequence
  chemically synthesized
aggtaacaggctaaagggtt

SEQ ID NO: 198349 - DNA, 20 bp, Artificial Sequence
  chemically synthesized
gtgtaaggtaacaggctaaa

SEQ ID NO: 198350 - DNA, 20 bp, Artificial Sequence
  chemically synthesized
tgtgtaaggtaacaggctaa

SEQ ID NO: 198351 - DNA, 20 bp, Artificial Sequence
  chemically synthesized
ttgtgtaaggtaacaggcta

SEQ ID NO: 198352 - DNA, 20 bp, Artificial Sequence
  chemically synthesized
agtgctttgtgtaaggtaac

SEQ ID NO: 198353 - DNA, 20 bp, Artificial Sequence
  chemically synthesized
cagtgctttgtgtaaggtaa

SEQ ID NO: 198354 - DNA, 20 bp, Artificial Sequence
  chemically synthesized
ttagcctgttaccttacaca

SEQ ID NO: 198355 - DNA, 20 bp, Artificial Sequence
  chemically synthesized
actccacagtgctttgtgta

SEQ ID NO: 198356 - DNA, 20 bp, Artificial Sequence
  chemically synthesized
gactccacagtgctttgtgt

SEQ ID NO: 198357 - DNA, 20 bp, Artificial Sequence
  chemically synthesized
ttaccttacacaaagcactg

SEQ ID NO: 198358 - DNA, 20 bp, Artificial Sequence
  chemically synthesized
accttacacaaagcactgtg

SEQ ID NO: 198359 - DNA, 20 bp, Artificial Sequence
  chemically synthesized
ctcaagttcaagggactcca

SEQ ID NO: 198360 - DNA, 20 bp, Artificial Sequence
  chemically synthesized
gagggatctctcaagttcaa

SEQ ID NO: 198361 - DNA, 20 bp, Artificial Sequence
  chemically synthesized
ctgtggagtcccttgaactt

SEQ ID NO: 198362 - DNA, 20 bp, Artificial Sequence
  chemically synthesized
tgagggatctctcaagttca

SEQ ID NO: 198363 - DNA, 20 bp, Artificial Sequence
  chemically synthesized
ctgagggatctctcaagttc

SEQ ID NO: 198364 - DNA, 20 bp, Artificial Sequence
  chemically synthesized
gtggagtcccttgaacttga

SEQ ID NO: 198365 - DNA, 20 bp, Artificial Sequence
  chemically synthesized
ggtaatctgagggatctctc

SEQ ID NO: 198366 - DNA, 20 bp, Artificial Sequence
  chemically synthesized
cttgaacttgagagatccct

SEQ ID NO: 198367 - DNA, 20 bp, Artificial Sequence
  chemically synthesized
aggctgccacggtaatctga

SEQ ID NO: 198368 - DNA, 20 bp, Artificial Sequence
  chemically synthesized
gaggctgccacggtaatctg

SEQ ID NO: 198369 - DNA, 20 bp, Artificial Sequence
  chemically synthesized
agaggctgccacggtaatct

SEQ ID NO: 198370 - DNA, 20 bp, Artificial Sequence
  chemically synthesized
agagatccctcagattaccg

SEQ ID NO: 198371 - DNA, 20 bp, Artificial Sequence
  chemically synthesized
gatccctcagattaccgtgg

SEQ ID NO: 198372 - DNA, 20 bp, Artificial Sequence
  chemically synthesized
tgtgaaataagaggctgcca

SEQ ID NO: 198373 - DNA, 20 bp, Artificial Sequence
  chemically synthesized
cataacttttgtgaaataag

SEQ ID NO: 198374 - DNA, 20 bp, Artificial Sequence
  chemically synthesized
acataacttttgtgaaataa

SEQ ID NO: 198375 - DNA, 20 bp, Artificial Sequence
  chemically synthesized
tgacataacttttgtgaaat

SEQ ID NO: 198376 - DNA, 20 bp, Artificial Sequence
  chemically synthesized
ggcagcctcttatttcacaa

SEQ ID NO: 198377 - DNA, 20 bp, Artificial Sequence
  chemically synthesized
aagttatgtcatttgaaata

SEQ ID NO: 198378 - DNA, 20 bp, Artificial Sequence
  chemically synthesized
cattattcctcaagagaaga

SEQ ID NO: 198379 - DNA, 20 bp, Artificial Sequence
  chemically synthesized
caatacatccatcttctctt

SEQ ID NO: 198380 - DNA, 20 bp, Artificial Sequence
  chemically synthesized
aatacatccatcttctcttg

SEQ ID NO: 198381 - DNA, 20 bp, Artificial Sequence
  chemically synthesized
ctcgcattattcctcaagag

SEQ ID NO: 198382 - DNA, 20 bp, Artificial Sequence
  chemically synthesized
gcactcgcattattcctcaa

SEQ ID NO: 198383 - DNA, 20 bp, Artificial Sequence
  chemically synthesized
cagcactcgcattattcctc

SEQ ID NO: 198384 - DNA, 20 bp, Artificial Sequence
  chemically synthesized
cttctcttgaggaataatgc

SEQ ID NO: 198385 - DNA, 20 bp, Artificial Sequence
  chemically synthesized
gtcctttagtaggcatttga

SEQ ID NO: 198386 - DNA, 20 bp, Artificial Sequence
  chemically synthesized
gtgctgtcaaatgcctacta

SEQ ID NO: 198387 - DNA, 20 bp, Artificial Sequence
  chemically synthesized
tgctgtcaaatgcctactaa

SEQ ID NO: 198388 - DNA, 20 bp, Artificial Sequence
  chemically synthesized
agctacatcagtcctttagt

SEQ ID NO: 198389 - DNA, 20 bp, Artificial Sequence
  chemically synthesized
tagctacatcagtcctttag

SEQ ID NO: 198390 - DNA, 20 bp, Artificial Sequence
  chemically synthesized
ggatagctacatcagtcctt

SEQ ID NO: 198391 - DNA, 20 bp, Artificial Sequence
  chemically synthesized
tgcctactaaaggactgatg

SEQ ID NO: 198392 - DNA, 20 bp, Artificial Sequence
  chemically synthesized
tgcagtcaggatagctacat

SEQ ID NO: 198393 - DNA, 20 bp, Artificial Sequence
  chemically synthesized
aggacattttgcagtcagga

SEQ ID NO: 198394 - DNA, 20 bp, Artificial Sequence
  chemically synthesized
aagaaggacattttgcagtc

SEQ ID NO: 198395 - DNA, 20 bp, Artificial Sequence
  chemically synthesized
caagaaggacattttgcagt

SEQ ID NO: 198396 - DNA, 20 bp, Artificial Sequence
  chemically synthesized
gtgtcaagaaggacattttg

SEQ ID NO: 198397 - DNA, 20 bp, Artificial Sequence
  chemically synthesized
tgctctttgttgtgtcaaga

SEQ ID NO: 198398 - DNA, 20 bp, Artificial Sequence
  chemically synthesized
gtgctctttgttgtgtcaag

SEQ ID NO: 198399 - DNA, 20 bp, Artificial Sequence
  chemically synthesized
gatgtgctctttgttgtgtc

SEQ ID NO: 198400 - DNA, 20 bp, Artificial Sequence
  chemically synthesized
atgtccttcttgacacaaca

SEQ ID NO: 198401 - DNA, 20 bp, Artificial Sequence
  chemically synthesized
gtccttcttgacacaacaaa

SEQ ID NO: 198402 - DNA, 20 bp, Artificial Sequence
  chemically synthesized
tgacacaacaaagagcacat

SEQ ID NO: 198403 - DNA, 20 bp, Artificial Sequence
  chemically synthesized
aaagagcacatcagaccatt

SEQ ID NO: 198404 - DNA, 20 bp, Artificial Sequence
  chemically synthesized
caagttgtataaatactgaa

SEQ ID NO: 198405 - DNA, 20 bp, Artificial Sequence
  chemically synthesized
tctgtggtagatgaaagaac

SEQ ID NO: 198406 - DNA, 20 bp, Artificial Sequence
  chemically synthesized
agtaaatctgtggtagatga

SEQ ID NO: 198407 - DNA, 20 bp, Artificial Sequence
  chemically synthesized
acttgttctttcatctacca

SEQ ID NO: 198408 - DNA, 20 bp, Artificial Sequence
  chemically synthesized
ggtgctcagtaaatctgtgg

SEQ ID NO: 198409 - DNA, 20 bp, Artificial Sequence
  chemically synthesized
gcaggtgctcagtaaatctg

SEQ ID NO: 198410 - DNA, 20 bp, Artificial Sequence
  chemically synthesized
tcatctaccacagatttact

SEQ ID NO: 198411 - DNA, 20 bp, Artificial Sequence
  chemically synthesized
cttaacgcatagcaggtgct

SEQ ID NO: 198412 - DNA, 20 bp, Artificial Sequence
  chemically synthesized
cctagggcttaacgcatagc

SEQ ID NO: 198413 - DNA, 20 bp, Artificial Sequence
  chemically synthesized
gcctagggcttaacgcatag

SEQ ID NO: 198414 - DNA, 20 bp, Artificial Sequence
  chemically synthesized
ctgagcacctgctatgcgtt

SEQ ID NO: 198415 - DNA, 20 bp, Artificial Sequence
  chemically synthesized
ccggcctagggcttaacgca

SEQ ID NO: 198416 - DNA, 20 bp, Artificial Sequence
  chemically synthesized
acctgctatgcgttaagccc

SEQ ID NO: 198417 - DNA, 20 bp, Artificial Sequence
  chemically synthesized
cctgctatgcgttaagccct

SEQ ID NO: 198418 - DNA, 20 bp, Artificial Sequence
  chemically synthesized
ctatgcgttaagccctaggc

SEQ ID NO: 198419 - DNA, 20 bp, Artificial Sequence
  chemically synthesized
tatccataacttccggccta

SEQ ID NO: 198420 - DNA, 20 bp, Artificial Sequence
  chemically synthesized
tgcgttaagccctaggccgg

SEQ ID NO: 198421 - DNA, 20 bp, Artificial Sequence
  chemically synthesized
gtatccataacttccggcct

SEQ ID NO: 198422 - DNA, 20 bp, Artificial Sequence
  chemically synthesized
tgtatccataacttccggcc

SEQ ID NO: 198423 - DNA, 20 bp, Artificial Sequence
  chemically synthesized
aagccctaggccggaagtta

SEQ ID NO: 198424 - DNA, 20 bp, Artificial Sequence
  chemically synthesized
gtctttgtatccataacttc

SEQ ID NO: 198425 - DNA, 20 bp, Artificial Sequence
  chemically synthesized
ggccggaagttatggataca

SEQ ID NO: 198426 - DNA, 20 bp, Artificial Sequence
  chemically synthesized
atggatacaaagacaaacat

SEQ ID NO: 198427 - DNA, 20 bp, Artificial Sequence
  chemically synthesized
gatacaaagacaaacatgag

SEQ ID NO: 198428 - DNA, 20 bp, Artificial Sequence
  chemically synthesized
atacaaagacaaacatgagt

SEQ ID NO: 198429 - DNA, 20 bp, Artificial Sequence
  chemically synthesized
acaaacatgagtgggtcttt

SEQ ID NO: 198430 - DNA, 20 bp, Artificial Sequence
  chemically synthesized
acatgagtgggtctttaagc

SEQ ID NO: 198431 - DNA, 20 bp, Artificial Sequence
  chemically synthesized
catgagtgggtctttaagca

SEQ ID NO: 198432 - DNA, 20 bp, Artificial Sequence
  chemically synthesized
atgagtgggtctttaagcaa

SEQ ID NO: 198433 - DNA, 20 bp, Artificial Sequence
  chemically synthesized
ccttataactcccttgctta

SEQ ID NO: 198434 - DNA, 20 bp, Artificial Sequence
  chemically synthesized
gagtgggtctttaagcaagg

SEQ ID NO: 198435 - DNA, 20 bp, Artificial Sequence
  chemically synthesized
tctttaagcaagggagttat

SEQ ID NO: 198436 - DNA, 20 bp, Artificial Sequence
  chemically synthesized
ctttaagcaagggagttata

SEQ ID NO: 198437 - DNA, 20 bp, Artificial Sequence
  chemically synthesized
ggtcatatttgcattaataa

SEQ ID NO: 198438 - DNA, 20 bp, Artificial Sequence
  chemically synthesized
cattaataaaagtcactatg

SEQ ID NO: 198439 - DNA, 20 bp, Artificial Sequence
  chemically synthesized
ttaataaaagtcactatgaa

SEQ ID NO: 198440 - DNA, 20 bp, Artificial Sequence
  chemically synthesized
ataaaagtcactatgaagag

SEQ ID NO: 198441 - DNA, 20 bp, Artificial Sequence
  chemically synthesized
aatttattctctactcttca

SEQ ID NO: 198442 - DNA, 20 bp, Artificial Sequence
  chemically synthesized
aaaagtcactatgaagagta

SEQ ID NO: 198443 - DNA, 20 bp, Artificial Sequence
  chemically synthesized
gaagagtagagaataaattg

SEQ ID NO: 198444 - DNA, 20 bp, Artificial Sequence
  chemically synthesized
aagagtagagaataaattga

SEQ ID NO: 198445 - DNA, 20 bp, Artificial Sequence
  chemically synthesized
gagtagagaataaattgaag

SEQ ID NO: 198446 - DNA, 20 bp, Artificial Sequence
  chemically synthesized
agagaataaattgaaggagc

SEQ ID NO: 198447 - DNA, 20 bp, Artificial Sequence
  chemically synthesized
gaataaattgaaggagcaag

SEQ ID NO: 198448 - DNA, 20 bp, Artificial Sequence
  chemically synthesized
ataaattgaaggagcaagaa

SEQ ID NO: 198449 - DNA, 20 bp, Artificial Sequence
  chemically synthesized
aaattgaaggagcaagaaga

SEQ ID NO: 198450 - DNA, 20 bp, Artificial Sequence
  chemically synthesized
aattgaaggagcaagaagag

SEQ ID NO: 198451 - DNA, 20 bp, Artificial Sequence
  chemically synthesized
tgaaggagcaagaagagagg

SEQ ID NO: 198452 - DNA, 20 bp, Artificial Sequence
  chemically synthesized
gaaggagcaagaagagaggc

SEQ ID NO: 198453 - DNA, 20 bp, Artificial Sequence
  chemically synthesized
aggagcaagaagagaggcag

SEQ ID NO: 198454 - DNA, 20 bp, Artificial Sequence
  chemically synthesized
gagcaagaagagaggcagga

SEQ ID NO: 198455 - DNA, 20 bp, Artificial Sequence
  chemically synthesized
agcaagaagagaggcaggag

SEQ ID NO: 198456 - DNA, 20 bp, Artificial Sequence
  chemically synthesized
gcaagaagagaggcaggaga

SEQ ID NO: 198457 - DNA, 20 bp, Artificial Sequence
  chemically synthesized
aagaagagaggcaggagagg

SEQ ID NO: 198458 - DNA, 20 bp, Artificial Sequence
  chemically synthesized
agaagagaggcaggagaggg

SEQ ID NO: 198459 - DNA, 20 bp, Artificial Sequence
  chemically synthesized
gaagagaggcaggagaggga

SEQ ID NO: 198460 - DNA, 20 bp, Artificial Sequence
  chemically synthesized
agagaggcaggagagggagg

SEQ ID NO: 198461 - DNA, 20 bp, Artificial Sequence
  chemically synthesized
agaggcaggagagggaggga

SEQ ID NO: 198462 - DNA, 20 bp, Artificial Sequence
  chemically synthesized
gcaggagagggagggagagc

SEQ ID NO: 198463 - DNA, 20 bp, Artificial Sequence
  chemically synthesized
ggagagggagggagagccag

SEQ ID NO: 198464 - DNA, 20 bp, Artificial Sequence
  chemically synthesized
gggagggagagccagtggtg

SEQ ID NO: 198465 - DNA, 20 bp, Artificial Sequence
  chemically synthesized
ttcagcagtctcttcaccac

SEQ ID NO: 198466 - DNA, 20 bp, Artificial Sequence
  chemically synthesized
gagggagagccagtggtgaa

SEQ ID NO: 198467 - DNA, 20 bp, Artificial Sequence
  chemically synthesized
ttctacctgcattgattcag

SEQ ID NO: 198468 - DNA, 20 bp, Artificial Sequence
  chemically synthesized
accttctacctgcattgatt

SEQ ID NO: 198469 - DNA, 20 bp, Artificial Sequence
  chemically synthesized
aagagactgctgaatcaatg

SEQ ID NO: 198470 - DNA, 20 bp, Artificial Sequence
  chemically synthesized
agagactgctgaatcaatgc

SEQ ID NO: 198471 - DNA, 20 bp, Artificial Sequence
  chemically synthesized
gactgctgaatcaatgcagg

SEQ ID NO: 198472 - DNA, 20 bp, Artificial Sequence
  chemically synthesized
tgctgaatcaatgcaggtag

SEQ ID NO: 198473 - DNA, 20 bp, Artificial Sequence
  chemically synthesized
gctgaatcaatgcaggtaga

SEQ ID NO: 198474 - DNA, 20 bp, Artificial Sequence
  chemically synthesized
atcaatgcaggtagaaggtg

SEQ ID NO: 198475 - DNA, 20 bp, Artificial Sequence
  chemically synthesized
tcaatgcaggtagaaggtgc

SEQ ID NO: 198476 - DNA, 20 bp, Artificial Sequence
  chemically synthesized
ggtagaaggtgcaggctacc

SEQ ID NO: 198477 - DNA, 20 bp, Artificial Sequence
  chemically synthesized
gtagaaggtgcaggctaccc

SEQ ID NO: 198478 - DNA, 20 bp, Artificial Sequence
  chemically synthesized
cagtcatttctttacctggg

SEQ ID NO: 198479 - DNA, 20 bp, Artificial Sequence
  chemically synthesized
aggtgcaggctacccaggta

SEQ ID NO: 198480 - DNA, 20 bp, Artificial Sequence
  chemically synthesized
gaacagtcatttctttacct

SEQ ID NO: 198481 - DNA, 20 bp, Artificial Sequence
  chemically synthesized
tgaacagtcatttctttacc

SEQ ID NO: 198482 - DNA, 20 bp, Artificial Sequence
  chemically synthesized
tccacttgttttcatttgaa

SEQ ID NO: 198483 - DNA, 20 bp, Artificial Sequence
  chemically synthesized
atgactgttcaaatgaaaac

SEQ ID NO: 198484 - DNA, 20 bp, Artificial Sequence
  chemically synthesized
actgttcaaatgaaaacaag

SEQ ID NO: 198485 - DNA, 20 bp, Artificial Sequence
  chemically synthesized
gaaaacaagtggataaattc

SEQ ID NO: 198486 - DNA, 20 bp, Artificial Sequence
  chemically synthesized
aaacaagtggataaattcaa

SEQ ID NO: 198487 - DNA, 20 bp, Artificial Sequence
  chemically synthesized
acaagtggataaattcaaga

SEQ ID NO: 198488 - DNA, 20 bp, Artificial Sequence
  chemically synthesized
aaattcaagagagtttattg

SEQ ID NO: 198489 - DNA, 20 bp, Artificial Sequence
  chemically synthesized
aagagagtttattgtagatt

SEQ ID NO: 198490 - DNA, 20 bp, Artificial Sequence
  chemically synthesized
agagtttattgtagatttgg

SEQ ID NO: 198491 - DNA, 20 bp, Artificial Sequence
  chemically synthesized
gagtttattgtagatttggt

SEQ ID NO: 198492 - DNA, 20 bp, Artificial Sequence
  chemically synthesized
gtaaggcacgttcatttatc

SEQ ID NO: 198493 - DNA, 20 bp, Artificial Sequence
  chemically synthesized
agtaaggcacgttcatttat

SEQ ID NO: 198494 - DNA, 20 bp, Artificial Sequence
  chemically synthesized
taaatgaacgtgccttactc

SEQ ID NO: 198495 - DNA, 20 bp, Artificial Sequence
  chemically synthesized
ggcaccaccatactcgagta

SEQ ID NO: 198496 - DNA, 20 bp, Artificial Sequence
  chemically synthesized
tggcaccaccatactcgagt

SEQ ID NO: 198497 - DNA, 20 bp, Artificial Sequence
  chemically synthesized
gaacgtgccttactcgagta

SEQ ID NO: 198498 - DNA, 20 bp, Artificial Sequence
  chemically synthesized
acaatggcaccaccatactc

SEQ ID NO: 198499 - DNA, 20 bp, Artificial Sequence
  chemically synthesized
cgtgccttactcgagtatgg

SEQ ID NO: 198500 - DNA, 20 bp, Artificial Sequence
  chemically synthesized
tgcttctttgtttcagacaa

SEQ ID NO: 198501 - DNA, 20 bp, Artificial Sequence
  chemically synthesized
tggtgccattgtctgaaaca

SEQ ID NO: 198502 - DNA, 20 bp, Artificial Sequence
  chemically synthesized
cttcttttgcttctttgttt

SEQ ID NO: 198503 - DNA, 20 bp, Artificial Sequence
  chemically synthesized
tgccattgtctgaaacaaag

SEQ ID NO: 198504 - DNA, 20 bp, Artificial Sequence
  chemically synthesized
tgtctgaaacaaagaagcaa

SEQ ID NO: 198505 - DNA, 20 bp, Artificial Sequence
  chemically synthesized
ctgaaacaaagaagcaaaag

SEQ ID NO: 198506 - DNA, 20 bp, Artificial Sequence
  chemically synthesized
aaaagaagaaccccgctcga

SEQ ID NO: 198507 - DNA, 20 bp, Artificial Sequence
  chemically synthesized
ctttcccctaccatcgagcg

SEQ ID NO: 198508 - DNA, 20 bp, Artificial Sequence
  chemically synthesized
gctttcccctaccatcgagc

SEQ ID NO: 198509 - DNA, 20 bp, Artificial Sequence
  chemically synthesized
agctttcccctaccatcgag

SEQ ID NO: 198510 - DNA, 20 bp, Artificial Sequence
  chemically synthesized
agaagaaccccgctcgatgg

SEQ ID NO: 198511 - DNA, 20 bp, Artificial Sequence
  chemically synthesized
gaagaaccccgctcgatggt

SEQ ID NO: 198512 - DNA, 20 bp, Artificial Sequence
  chemically synthesized
aagaaccccgctcgatggta

SEQ ID NO: 198513 - DNA, 20 bp, Artificial Sequence
  chemically synthesized
acaagctttcccctaccatc

SEQ ID NO: 198514 - DNA, 20 bp, Artificial Sequence
  chemically synthesized
agaaccccgctcgatggtag

SEQ ID NO: 198515 - DNA, 20 bp, Artificial Sequence
  chemically synthesized
ccccgctcgatggtagggga

SEQ ID NO: 198516 - DNA, 20 bp, Artificial Sequence
  chemically synthesized
gatggtaggggaaagcttgt

SEQ ID NO: 198517 - DNA, 20 bp, Artificial Sequence
  chemically synthesized
taggggaaagcttgtgagct

SEQ ID NO: 198518 - DNA, 20 bp, Artificial Sequence
  chemically synthesized
agatcaaaaactcagctcac

SEQ ID NO: 198519 - DNA, 20 bp, Artificial Sequence
  chemically synthesized
tttctataagatcaaaaact

SEQ ID NO: 198520 - DNA, 20 bp, Artificial Sequence
  chemically synthesized
gagctgagtttttgatctta

SEQ ID NO: 198521 - DNA, 20 bp, Artificial Sequence
  chemically synthesized
accaaccttttaatttctat

SEQ ID NO: 198522 - DNA, 20 bp, Artificial Sequence
  chemically synthesized
tttgatcttatagaaattaa

SEQ ID NO: 198523 - DNA, 20 bp, Artificial Sequence
  chemically synthesized
ttgatcttatagaaattaaa

SEQ ID NO: 198524 - DNA, 20 bp, Artificial Sequence
  chemically synthesized
tcttatagaaattaaaaggt

SEQ ID NO: 198525 - DNA, 20 bp, Artificial Sequence
  chemically synthesized
tagaaattaaaaggttggtc

SEQ ID NO: 198526 - DNA, 20 bp, Artificial Sequence
  chemically synthesized
aggttggtcaagtgtatgaa

SEQ ID NO: 198527 - DNA, 20 bp, Artificial Sequence
  chemically synthesized
ttggtcaagtgtatgaatgg

SEQ ID NO: 198528 - DNA, 20 bp, Artificial Sequence
  chemically synthesized
gtcaagtgtatgaatggaag

SEQ ID NO: 198529 - DNA, 20 bp, Artificial Sequence
  chemically synthesized
atggaagcagttgcatatac

SEQ ID NO: 198530 - DNA, 20 bp, Artificial Sequence
  chemically synthesized
agcagttgcatatacaagtc

SEQ ID NO: 198531 - DNA, 20 bp, Artificial Sequence
  chemically synthesized
agttgcatatacaagtctgg

SEQ ID NO: 198532 - DNA, 20 bp, Artificial Sequence
  chemically synthesized
gcatatacaagtctggaaga

SEQ ID NO: 198533 - DNA, 20 bp, Artificial Sequence
  chemically synthesized
tcctggcatcttctttcttc

SEQ ID NO: 198534 - DNA, 20 bp, Artificial Sequence
  chemically synthesized
tatacaagtctggaagaaag

SEQ ID NO: 198535 - DNA, 20 bp, Artificial Sequence
  chemically synthesized
gtctggaagaaagaagatgc

SEQ ID NO: 198536 - DNA, 20 bp, Artificial Sequence
  chemically synthesized
tctggaagaaagaagatgcc

SEQ ID NO: 198537 - DNA, 20 bp, Artificial Sequence
  chemically synthesized
gaagaaagaagatgccagga

SEQ ID NO: 198538 - DNA, 20 bp, Artificial Sequence
  chemically synthesized
agaaagaagatgccaggatg

SEQ ID NO: 198539 - DNA, 20 bp, Artificial Sequence
  chemically synthesized
gaaagaagatgccaggatgg

SEQ ID NO: 198540 - DNA, 20 bp, Artificial Sequence
  chemically synthesized
aaagaagatgccaggatgga

SEQ ID NO: 198541 - DNA, 20 bp, Artificial Sequence
  chemically synthesized
actacattttccctccatcc

SEQ ID NO: 198542 - DNA, 20 bp, Artificial Sequence
  chemically synthesized
gccaggatggagggaaaatg

SEQ ID NO: 198543 - DNA, 20 bp, Artificial Sequence
  chemically synthesized
ggatggagggaaaatgtagt

SEQ ID NO: 198544 - DNA, 20 bp, Artificial Sequence
  chemically synthesized
ggaaaatgtagttggaatca

SEQ ID NO: 198545 - DNA, 20 bp, Artificial Sequence
  chemically synthesized
atgtagttggaatcacggaa

SEQ ID NO: 198546 - DNA, 20 bp, Artificial Sequence
  chemically synthesized
gttggaatcacggaatggat

SEQ ID NO: 198547 - DNA, 20 bp, Artificial Sequence
  chemically synthesized
ttggaatcacggaatggatg

SEQ ID NO: 198548 - DNA, 20 bp, Artificial Sequence
  chemically synthesized
ggaatggatgaggatgacca

SEQ ID NO: 198549 - DNA, 20 bp, Artificial Sequence
  chemically synthesized
gaatggatgaggatgaccaa

SEQ ID NO: 198550 - DNA, 20 bp, Artificial Sequence
  chemically synthesized
ggatgaggatgaccaaagga

SEQ ID NO: 198551 - DNA, 20 bp, Artificial Sequence
  chemically synthesized
tcatattacagactttcctt

SEQ ID NO: 198552 - DNA, 20 bp, Artificial Sequence
  chemically synthesized
ttcctggacttttcatatta

SEQ ID NO: 198553 - DNA, 20 bp, Artificial Sequence
  chemically synthesized
aggaaagtctgtaatatgaa

SEQ ID NO: 198554 - DNA, 20 bp, Artificial Sequence
  chemically synthesized
agtctgtaatatgaaaagtc

SEQ ID NO: 198555 - DNA, 20 bp, Artificial Sequence
  chemically synthesized
gtctgtaatatgaaaagtcc

SEQ ID NO: 198556 - DNA, 20 bp, Artificial Sequence
  chemically synthesized
tcaaaaagttggatttttcc

SEQ ID NO: 198557 - DNA, 20 bp, Artificial Sequence
  chemically synthesized
caggaaaaatccaacttttt

SEQ ID NO: 198558 - DNA, 20 bp, Artificial Sequence
  chemically synthesized
tttaatattcctcaaaaagt

SEQ ID NO: 198559 - DNA, 20 bp, Artificial Sequence
  chemically synthesized
aggaaaaatccaactttttg

SEQ ID NO: 198560 - DNA, 20 bp, Artificial Sequence
  chemically synthesized
tccctttaatattcctcaaa

SEQ ID NO: 198561 - DNA, 20 bp, Artificial Sequence
  chemically synthesized
caactttttgaggaatatta

SEQ ID NO: 198562 - DNA, 20 bp, Artificial Sequence
  chemically synthesized
aactttttgaggaatattaa

SEQ ID NO: 198563 - DNA, 20 bp, Artificial Sequence
  chemically synthesized
actttttgaggaatattaaa

SEQ ID NO: 198564 - DNA, 20 bp, Artificial Sequence
  chemically synthesized
tttttgaggaatattaaagg

SEQ ID NO: 198565 - DNA, 20 bp, Artificial Sequence
  chemically synthesized
tttgaggaatattaaaggga

SEQ ID NO: 198566 - DNA, 20 bp, Artificial Sequence
  chemically synthesized
aatattaaagggagagatgc

SEQ ID NO: 198567 - DNA, 20 bp, Artificial Sequence
  chemically synthesized
aagggagagatgccagaaaa

SEQ ID NO: 198568 - DNA, 20 bp, Artificial Sequence
  chemically synthesized
agggagagatgccagaaaat

SEQ ID NO: 198569 - DNA, 20 bp, Artificial Sequence
  chemically synthesized
tcctttttgagcccattttc

SEQ ID NO: 198570 - DNA, 20 bp, Artificial Sequence
  chemically synthesized
tgccagaaaatgggctcaaa

SEQ ID NO: 198571 - DNA, 20 bp, Artificial Sequence
  chemically synthesized
gccagaaaatgggctcaaaa

SEQ ID NO: 198572 - DNA, 20 bp, Artificial Sequence
  chemically synthesized
cagaaaatgggctcaaaaag

SEQ ID NO: 198573 - DNA, 20 bp, Artificial Sequence
  chemically synthesized
agaaaatgggctcaaaaagg

SEQ ID NO: 198574 - DNA, 20 bp, Artificial Sequence
  chemically synthesized
cttagtaatccctccttttt

SEQ ID NO: 198575 - DNA, 20 bp, Artificial Sequence
  chemically synthesized
gaaaatgggctcaaaaagga

SEQ ID NO: 198576 - DNA, 20 bp, Artificial Sequence
  chemically synthesized
ctcaaaaaggagggattact

SEQ ID NO: 198577 - DNA, 20 bp, Artificial Sequence
  chemically synthesized
aaggagggattactaagact

SEQ ID NO: 198578 - DNA, 20 bp, Artificial Sequence
  chemically synthesized
aggagggattactaagactt

SEQ ID NO: 198579 - DNA, 20 bp, Artificial Sequence
  chemically synthesized
aacatgtactgcctaagtct

SEQ ID NO: 198580 - DNA, 20 bp, Artificial Sequence
  chemically synthesized
agggattactaagacttagg

SEQ ID NO: 198581 - DNA, 20 bp, Artificial Sequence
  chemically synthesized
tgaatgaacatgtactgcct

SEQ ID NO: 198582 - DNA, 20 bp, Artificial Sequence
  chemically synthesized
gcagtacatgttcattcaac

SEQ ID NO: 198583 - DNA, 20 bp, Artificial Sequence
  chemically synthesized
cagtacatgttcattcaaca

SEQ ID NO: 198584 - DNA, 20 bp, Artificial Sequence
  chemically synthesized
gtacatgttcattcaacaag

SEQ ID NO: 198585 - DNA, 20 bp, Artificial Sequence
  chemically synthesized
ttcattcaacaaggagattc

SEQ ID NO: 198586 - DNA, 20 bp, Artificial Sequence
  chemically synthesized
acaaggagattctggtacta

SEQ ID NO: 198587 - DNA, 20 bp, Artificial Sequence
  chemically synthesized
gaatttagcttctgtagtac

SEQ ID NO: 198588 - DNA, 20 bp, Artificial Sequence
  chemically synthesized
aggagattctggtactacag

SEQ ID NO: 198589 - DNA, 20 bp, Artificial Sequence
  chemically synthesized
ttaagggaatttagcttctg

SEQ ID NO: 198590 - DNA, 20 bp, Artificial Sequence
  chemically synthesized
ccttccttcttaagggaatt

SEQ ID NO: 198591 - DNA, 20 bp, Artificial Sequence
  chemically synthesized
tacagaagctaaattccctt

SEQ ID NO: 198592 - DNA, 20 bp, Artificial Sequence
  chemically synthesized
agaagctaaattcccttaag

SEQ ID NO: 198593 - DNA, 20 bp, Artificial Sequence
  chemically synthesized
gaagctaaattcccttaaga

SEQ ID NO: 198594 - DNA, 20 bp, Artificial Sequence
  chemically synthesized
gaaaatgccttccttcttaa

SEQ ID NO: 198595 - DNA, 20 bp, Artificial Sequence
  chemically synthesized
tgaaaatgccttccttctta

SEQ ID NO: 198596 - DNA, 20 bp, Artificial Sequence
  chemically synthesized
gctaaattcccttaagaagg

SEQ ID NO: 198597 - DNA, 20 bp, Artificial Sequence
  chemically synthesized
gtgaaaatgccttccttctt

SEQ ID NO: 198598 - DNA, 20 bp, Artificial Sequence
  chemically synthesized
ctaaattcccttaagaagga

SEQ ID NO: 198599 - DNA, 20 bp, Artificial Sequence
  chemically synthesized
aaggaaggcattttcaccca

SEQ ID NO: 198600 - DNA, 20 bp, Artificial Sequence
  chemically synthesized
attctgtagcaaaatgctgt

SEQ ID NO: 198601 - DNA, 20 bp, Artificial Sequence
  chemically synthesized
cattctgtagcaaaatgctg

SEQ ID NO: 198602 - DNA, 20 bp, Artificial Sequence
  chemically synthesized
tcacccacagcattttgcta

SEQ ID NO: 198603 - DNA, 20 bp, Artificial Sequence
  chemically synthesized
gattatactcgagcattctg

SEQ ID NO: 198604 - DNA, 20 bp, Artificial Sequence
  chemically synthesized
cattttgctacagaatgctc

SEQ ID NO: 198605 - DNA, 20 bp, Artificial Sequence
  chemically synthesized
ttttagtgctgattatactc

SEQ ID NO: 198606 - DNA, 20 bp, Artificial Sequence
  chemically synthesized
acagaatgctcgagtataat

SEQ ID NO: 198607 - DNA, 20 bp, Artificial Sequence
  chemically synthesized
caaacctgacaaatgttttt

SEQ ID NO: 198608 - DNA, 20 bp, Artificial Sequence
  chemically synthesized
cagcactaaaaaacatttgt

SEQ ID NO: 198609 - DNA, 20 bp, Artificial Sequence
  chemically synthesized
agcactaaaaaacatttgtc

SEQ ID NO: 198610 - DNA, 20 bp, Artificial Sequence
  chemically synthesized
taaaaaacatttgtcaggtt

SEQ ID NO: 198611 - DNA, 20 bp, Artificial Sequence
  chemically synthesized
catttgtcaggtttggcaac

SEQ ID NO: 198612 - DNA, 20 bp, Artificial Sequence
  chemically synthesized
tgtcaggtttggcaacaaga

SEQ ID NO: 198613 - DNA, 20 bp, Artificial Sequence
  chemically synthesized
gttcacttcaagaaggacgg

SEQ ID NO: 198614 - DNA, 20 bp, Artificial Sequence
  chemically synthesized
tcagttcacttcaagaagga

SEQ ID NO: 198615 - DNA, 20 bp, Artificial Sequence
  chemically synthesized
agttgctgccgtccttcttg

SEQ ID NO: 198616 - DNA, 20 bp, Artificial Sequence
  chemically synthesized
tccttcagttcacttcaaga

SEQ ID NO: 198617 - DNA, 20 bp, Artificial Sequence
  chemically synthesized
ttccttcagttcacttcaag

SEQ ID NO: 198618 - DNA, 20 bp, Artificial Sequence
  chemically synthesized
cctttccttcagttcacttc

SEQ ID NO: 198619 - DNA, 20 bp, Artificial Sequence
  chemically synthesized
gtccttcttgaagtgaactg

SEQ ID NO: 198620 - DNA, 20 bp, Artificial Sequence
  chemically synthesized
tccttcttgaagtgaactga

SEQ ID NO: 198621 - DNA, 20 bp, Artificial Sequence
  chemically synthesized
tcttgaagtgaactgaagga

SEQ ID NO: 198622 - DNA, 20 bp, Artificial Sequence
  chemically synthesized
cttgaagtgaactgaaggaa

SEQ ID NO: 198623 - DNA, 20 bp, Artificial Sequence
  chemically synthesized
ttcaatttcctcctttcctt

SEQ ID NO: 198624 - DNA, 20 bp, Artificial Sequence
  chemically synthesized
tgaagtgaactgaaggaaag

SEQ ID NO: 198625 - DNA, 20 bp, Artificial Sequence
  chemically synthesized
gaagtgaactgaaggaaagg

SEQ ID NO: 198626 - DNA, 20 bp, Artificial Sequence
  chemically synthesized
attgaaatttattgaacaca

SEQ ID NO: 198627 - DNA, 20 bp, Artificial Sequence
  chemically synthesized
ttgaaatttattgaacacaa

SEQ ID NO: 198628 - DNA, 20 bp, Artificial Sequence
  chemically synthesized
aaatttattgaacacaaagg

SEQ ID NO: 198629 - DNA, 20 bp, Artificial Sequence
  chemically synthesized
tgaacacaaaggaagtgtct

SEQ ID NO: 198630 - DNA, 20 bp, Artificial Sequence
  chemically synthesized
gaacacaaaggaagtgtctg

SEQ ID NO: 198631 - DNA, 20 bp, Artificial Sequence
  chemically synthesized
cacaaaggaagtgtctgagg

SEQ ID NO: 198632 - DNA, 20 bp, Artificial Sequence
  chemically synthesized
tcattaataagacacttcct

SEQ ID NO: 198633 - DNA, 20 bp, Artificial Sequence
  chemically synthesized
tgaggaagtgtcttattaat

SEQ ID NO: 198634 - DNA, 20 bp, Artificial Sequence
  chemically synthesized
cgcattgggatctcattaat

SEQ ID NO: 198635 - DNA, 20 bp, Artificial Sequence
  chemically synthesized
ttattaatgagatcccaatg

SEQ ID NO: 198636 - DNA, 20 bp, Artificial Sequence
  chemically synthesized
cttgcttatgatgccgcatt

SEQ ID NO: 198637 - DNA, 20 bp, Artificial Sequence
  chemically synthesized
acttgcttatgatgccgcat

SEQ ID NO: 198638 - DNA, 20 bp, Artificial Sequence
  chemically synthesized
agatcccaatgcggcatcat

SEQ ID NO: 198639 - DNA, 20 bp, Artificial Sequence
  chemically synthesized
cccaatgcggcatcataagc

SEQ ID NO: 198640 - DNA, 20 bp, Artificial Sequence
  chemically synthesized
gcggcatcataagcaagtga

SEQ ID NO: 198641 - DNA, 20 bp, Artificial Sequence
  chemically synthesized
gcatcataagcaagtgatgg

SEQ ID NO: 198642 - DNA, 20 bp, Artificial Sequence
  chemically synthesized
aaaaaaaaatggtatatgca

SEQ ID NO: 198643 - DNA, 20 bp, Artificial Sequence
  chemically synthesized
caaaaaaaaaatggtatatg

SEQ ID NO: 198644 - DNA, 20 bp, Artificial Sequence
  chemically synthesized
aacactgcacaaaaaaaaaa

SEQ ID NO: 198645 - DNA, 20 bp, Artificial Sequence
  chemically synthesized
tataccattttttttttgtg

SEQ ID NO: 198646 - DNA, 20 bp, Artificial Sequence
  chemically synthesized
aagtgttttgtttgataata

SEQ ID NO: 198647 - DNA, 20 bp, Artificial Sequence
  chemically synthesized
tgtgaggatgaagaaaaaga

SEQ ID NO: 198648 - DNA, 20 bp, Artificial Sequence
  chemically synthesized
tgtatgtgaggatgaagaaa

SEQ ID NO: 198649 - DNA, 20 bp, Artificial Sequence
  chemically synthesized
aaaatgtgtatgtgaggatg

SEQ ID NO: 198650 - DNA, 20 bp, Artificial Sequence
  chemically synthesized
aaaatgaaaatgtgtatgtg

SEQ ID NO: 198651 - DNA, 20 bp, Artificial Sequence
  chemically synthesized
taaaatgaaaatgtgtatgt

SEQ ID NO: 198652 - DNA, 20 bp, Artificial Sequence
  chemically synthesized
tcacatacacattttcattt

SEQ ID NO: 198653 - DNA, 20 bp, Artificial Sequence
  chemically synthesized
atacacattttcattttaga

SEQ ID NO: 198654 - DNA, 20 bp, Artificial Sequence
  chemically synthesized
aaagtcaacgtgcttttact

SEQ ID NO: 198655 - DNA, 20 bp, Artificial Sequence
  chemically synthesized
tatttactagtactaagtaa

SEQ ID NO: 198656 - DNA, 20 bp, Artificial Sequence
  chemically synthesized
aacgtgcttttacttagtac

SEQ ID NO: 198657 - DNA, 20 bp, Artificial Sequence
  chemically synthesized
aagacatatttactagtact

SEQ ID NO: 198658 - DNA, 20 bp, Artificial Sequence
  chemically synthesized
ttttggcaagacatatttac

SEQ ID NO: 198659 - DNA, 20 bp, Artificial Sequence
  chemically synthesized
agtaaatatgtcttgccaaa

SEQ ID NO: 198660 - DNA, 20 bp, Artificial Sequence
  chemically synthesized
cacaattttagctttttggc

SEQ ID NO: 198661 - DNA, 20 bp, Artificial Sequence
  chemically synthesized
tttacacaattttagctttt

SEQ ID NO: 198662 - DNA, 20 bp, Artificial Sequence
  chemically synthesized
tttgatgatttacacaattt

SEQ ID NO: 198663 - DNA, 20 bp, Artificial Sequence
  chemically synthesized
aaaattgtgtaaatcatcaa

SEQ ID NO: 198664 - DNA, 20 bp, Artificial Sequence
  chemically synthesized
acagagcattaatattatta

SEQ ID NO: 198665 - DNA, 20 bp, Artificial Sequence
  chemically synthesized
gcttcagtatgttcaaaaca

SEQ ID NO: 198666 - DNA, 20 bp, Artificial Sequence
  chemically synthesized
gggcttcagtatgttcaaaa

SEQ ID NO: 198667 - DNA, 20 bp, Artificial Sequence
  chemically synthesized
gctctgttttgaacatactg

SEQ ID NO: 198668 - DNA, 20 bp, Artificial Sequence
  chemically synthesized
gttttgaacatactgaagcc

SEQ ID NO: 198669 - DNA, 20 bp, Artificial Sequence
  chemically synthesized
ttttgaacatactgaagccc

SEQ ID NO: 198670 - DNA, 20 bp, Artificial Sequence
  chemically synthesized
ataaggcaattcctgggctt

SEQ ID NO: 198671 - DNA, 20 bp, Artificial Sequence
  chemically synthesized
ggggaaataaggcaattcct

SEQ ID NO: 198672 - DNA, 20 bp, Artificial Sequence
  chemically synthesized
gggggaaataaggcaattcc

SEQ ID NO: 198673 - DNA, 20 bp, Artificial Sequence
  chemically synthesized
cagggttgttgggggaaata

SEQ ID NO: 198674 - DNA, 20 bp, Artificial Sequence
  chemically synthesized
gcagggttgttgggggaaat

SEQ ID NO: 198675 - DNA, 20 bp, Artificial Sequence
  chemically synthesized
aaaagctgcagggttgttgg

SEQ ID NO: 198676 - DNA, 20 bp, Artificial Sequence
  chemically synthesized
gaaaagctgcagggttgttg

SEQ ID NO: 198677 - DNA, 20 bp, Artificial Sequence
  chemically synthesized
agaaaagctgcagggttgtt

SEQ ID NO: 198678 - DNA, 20 bp, Artificial Sequence
  chemically synthesized
cagaaaagctgcagggttgt

SEQ ID NO: 198679 - DNA, 20 bp, Artificial Sequence
  chemically synthesized
tatttcccccaacaaccctg

SEQ ID NO: 198680 - DNA, 20 bp, Artificial Sequence
  chemically synthesized
ttctcttcagaaaagctgca

SEQ ID NO: 198681 - DNA, 20 bp, Artificial Sequence
  chemically synthesized
tttctcttcagaaaagctgc

SEQ ID NO: 198682 - DNA, 20 bp, Artificial Sequence
  chemically synthesized
gtttctcttcagaaaagctg

SEQ ID NO: 198683 - DNA, 20 bp, Artificial Sequence
  chemically synthesized
acaaccctgcagcttttctg

SEQ ID NO: 198684 - DNA, 20 bp, Artificial Sequence
  chemically synthesized
aaccctgcagcttttctgaa

SEQ ID NO: 198685 - DNA, 20 bp, Artificial Sequence
  chemically synthesized
cctcaggtttctcttcagaa

SEQ ID NO: 198686 - DNA, 20 bp, Artificial Sequence
  chemically synthesized
gtgaacctcaggtttctctt

SEQ ID NO: 198687 - DNA, 20 bp, Artificial Sequence
  chemically synthesized
gcttttctgaagagaaacct

SEQ ID NO: 198688 - DNA, 20 bp, Artificial Sequence
  chemically synthesized
cttttctgaagagaaacctg

SEQ ID NO: 198689 - DNA, 20 bp, Artificial Sequence
  chemically synthesized
atttactatccgtgaacctc

SEQ ID NO: 198690 - DNA, 20 bp, Artificial Sequence
  chemically synthesized
gaagagaaacctgaggttca

SEQ ID NO: 198691 - DNA, 20 bp, Artificial Sequence
  chemically synthesized
aatttactatccgtgaacct

SEQ ID NO: 198692 - DNA, 20 bp, Artificial Sequence
  chemically synthesized
agaaacctgaggttcacgga

SEQ ID NO: 198693 - DNA, 20 bp, Artificial Sequence
  chemically synthesized
acggatagtaaattatatgc

SEQ ID NO: 198694 - DNA, 20 bp, Artificial Sequence
  chemically synthesized
ggatagtaaattatatgcca

SEQ ID NO: 198695 - DNA, 20 bp, Artificial Sequence
  chemically synthesized
taaattatatgccagagatc

SEQ ID NO: 198696 - DNA, 20 bp, Artificial Sequence
  chemically synthesized
cttcccacctgcttgatctc

SEQ ID NO: 198697 - DNA, 20 bp, Artificial Sequence
  chemically synthesized
attatatgccagagatcaag

SEQ ID NO: 198698 - DNA, 20 bp, Artificial Sequence
  chemically synthesized
ttatatgccagagatcaagc

SEQ ID NO: 198699 - DNA, 20 bp, Artificial Sequence
  chemically synthesized
tatgccagagatcaagcagg

SEQ ID NO: 198700 - DNA, 20 bp, Artificial Sequence
  chemically synthesized
atgccagagatcaagcaggt

SEQ ID NO: 198701 - DNA, 20 bp, Artificial Sequence
  chemically synthesized
ccagagatcaagcaggtggg

SEQ ID NO: 198702 - DNA, 20 bp, Artificial Sequence
  chemically synthesized
tcaagcaggtgggaagatga

SEQ ID NO: 198703 - DNA, 20 bp, Artificial Sequence
  chemically synthesized
aagcaggtgggaagatgata

SEQ ID NO: 198704 - DNA, 20 bp, Artificial Sequence
  chemically synthesized
gatagagatgaattttatcc

SEQ ID NO: 198705 - DNA, 20 bp, Artificial Sequence
  chemically synthesized
aggaaagaaccagcagagct

SEQ ID NO: 198706 - DNA, 20 bp, Artificial Sequence
  chemically synthesized
gaattttatcccagctctgc

SEQ ID NO: 198707 - DNA, 20 bp, Artificial Sequence
  chemically synthesized
gaggaaagaaccagcagagc

SEQ ID NO: 198708 - DNA, 20 bp, Artificial Sequence
  chemically synthesized
tgaggaggaaagaaccagca

SEQ ID NO: 198709 - DNA, 20 bp, Artificial Sequence
  chemically synthesized
aatgaggaggaaagaaccag

SEQ ID NO: 198710 - DNA, 20 bp, Artificial Sequence
  chemically synthesized
ttaaatgaggaggaaagaac

SEQ ID NO: 198711 - DNA, 20 bp, Artificial Sequence
  chemically synthesized
ggaacgttaaatgaggagga

SEQ ID NO: 198712 - DNA, 20 bp, Artificial Sequence
  chemically synthesized
tggtggaacgttaaatgagg

SEQ ID NO: 198713 - DNA, 20 bp, Artificial Sequence
  chemically synthesized
gtggtggaacgttaaatgag

SEQ ID NO: 198714 - DNA, 20 bp, Artificial Sequence
  chemically synthesized
aggtggtggaacgttaaatg

SEQ ID NO: 198715 - DNA, 20 bp, Artificial Sequence
  chemically synthesized
aaggtggtggaacgttaaat

SEQ ID NO: 198716 - DNA, 20 bp, Artificial Sequence
  chemically synthesized
agcttaaaggaataaggtgg

SEQ ID NO: 198717 - DNA, 20 bp, Artificial Sequence
  chemically synthesized
tggagcttaaaggaataagg

SEQ ID NO: 198718 - DNA, 20 bp, Artificial Sequence
  chemically synthesized
acttggagcttaaaggaata

SEQ ID NO: 198719 - DNA, 20 bp, Artificial Sequence
  chemically synthesized
tacttggagcttaaaggaat

SEQ ID NO: 198720 - DNA, 20 bp, Artificial Sequence
  chemically synthesized
ttccaccaccttattccttt

SEQ ID NO: 198721 - DNA, 20 bp, Artificial Sequence
  chemically synthesized
gattggtacttggagcttaa

SEQ ID NO: 198722 - DNA, 20 bp, Artificial Sequence
  chemically synthesized
agattggtacttggagctta

SEQ ID NO: 198723 - DNA, 20 bp, Artificial Sequence
  chemically synthesized
accttattcctttaagctcc

SEQ ID NO: 198724 - DNA, 20 bp, Artificial Sequence
  chemically synthesized
aatctctagattggtacttg

SEQ ID NO: 198725 - DNA, 20 bp, Artificial Sequence
  chemically synthesized
aaaatctctagattggtact

SEQ ID NO: 198726 - DNA, 20 bp, Artificial Sequence
  chemically synthesized
ttaagctccaagtaccaatc

SEQ ID NO: 198727 - DNA, 20 bp, Artificial Sequence
  chemically synthesized
aagctccaagtaccaatcta

SEQ ID NO: 198728 - DNA, 20 bp, Artificial Sequence
  chemically synthesized
aattataaaaatctctagat

SEQ ID NO: 198729 - DNA, 20 bp, Artificial Sequence
  chemically synthesized
gaattaattataaaaatctc

SEQ ID NO: 198730 - DNA, 20 bp, Artificial Sequence
  chemically synthesized
gtcaggtttcatcagacatt

SEQ ID NO: 198731 - DNA, 20 bp, Artificial Sequence
  chemically synthesized
ggtcaggtttcatcagacat

SEQ ID NO: 198732 - DNA, 20 bp, Artificial Sequence
  chemically synthesized
tgaggtcggtcaggtttcat

SEQ ID NO: 198733 - DNA, 20 bp, Artificial Sequence
  chemically synthesized
atttttgcatgaggtcggtc

SEQ ID NO: 198734 - DNA, 20 bp, Artificial Sequence
  chemically synthesized
tatttttgcatgaggtcggt

SEQ ID NO: 198735 - DNA, 20 bp, Artificial Sequence
  chemically synthesized
ttaatatttttgcatgaggt

SEQ ID NO: 198736 - DNA, 20 bp, Artificial Sequence
  chemically synthesized
ttctttaatatttttgcatg

SEQ ID NO: 198737 - DNA, 20 bp, Artificial Sequence
  chemically synthesized
attctttaatatttttgcat

SEQ ID NO: 198738 - DNA, 20 bp, Artificial Sequence
  chemically synthesized
gacctcatgcaaaaatatta

SEQ ID NO: 198739 - DNA, 20 bp, Artificial Sequence
  chemically synthesized
cttggattgatttattcaat

SEQ ID NO: 198740 - DNA, 20 bp, Artificial Sequence
  chemically synthesized
cttattgaataaatcaatcc

SEQ ID NO: 198741 - DNA, 20 bp, Artificial Sequence
  chemically synthesized
ttacattttcaattgtatct

SEQ ID NO: 198742 - DNA, 20 bp, Artificial Sequence
  chemically synthesized
aattgaaaatgtaatttaat

SEQ ID NO: 198743 - DNA, 20 bp, Artificial Sequence
  chemically synthesized
attgaaaatgtaatttaatt

SEQ ID NO: 198744 - DNA, 20 bp, Artificial Sequence
  chemically synthesized
gaaaatgtaatttaattagg

SEQ ID NO: 198745 - DNA, 20 bp, Artificial Sequence
  chemically synthesized
aaatgtaatttaattaggta

SEQ ID NO: 198746 - DNA, 20 bp, Artificial Sequence
  chemically synthesized
aatgtaatttaattaggtag

SEQ ID NO: 198747 - DNA, 20 bp, Artificial Sequence
  chemically synthesized
agaggtcaaacttcacaaaa

SEQ ID NO: 198748 - DNA, 20 bp, Artificial Sequence
  chemically synthesized
atgttatattctgttttgtg

SEQ ID NO: 198749 - DNA, 20 bp, Artificial Sequence
  chemically synthesized
aacataaataatcaacacca

SEQ ID NO: 198750 - DNA, 20 bp, Artificial Sequence
  chemically synthesized
acataaataatcaacaccat

SEQ ID NO: 198751 - DNA, 20 bp, Artificial Sequence
  chemically synthesized
gatgtctatcttattgccta

SEQ ID NO: 198752 - DNA, 20 bp, Artificial Sequence
  chemically synthesized
taatcaacaccataggcaat

SEQ ID NO: 198753 - DNA, 20 bp, Artificial Sequence
  chemically synthesized
caacaccataggcaataaga

SEQ ID NO: 198754 - DNA, 20 bp, Artificial Sequence
  chemically synthesized
cctgcagaaattgaggcaat

SEQ ID NO: 198755 - DNA, 20 bp, Artificial Sequence
  chemically synthesized
tttatcccctgcagaaattg

SEQ ID NO: 198756 - DNA, 20 bp, Artificial Sequence
  chemically synthesized
atttatcccctgcagaaatt

SEQ ID NO: 198757 - DNA, 20 bp, Artificial Sequence
  chemically synthesized
tcttattgcctcaatttctg

SEQ ID NO: 198758 - DNA, 20 bp, Artificial Sequence
  chemically synthesized
cttattgcctcaatttctgc

SEQ ID NO: 198759 - DNA, 20 bp, Artificial Sequence
  chemically synthesized
ttattgcctcaatttctgca

SEQ ID NO: 198760 - DNA, 20 bp, Artificial Sequence
  chemically synthesized
tattgcctcaatttctgcag

SEQ ID NO: 198761 - DNA, 20 bp, Artificial Sequence
  chemically synthesized
atttcccaatttatcccctg

SEQ ID NO: 198762 - DNA, 20 bp, Artificial Sequence
  chemically synthesized
aatttctgcaggggataaat

SEQ ID NO: 198763 - DNA, 20 bp, Artificial Sequence
  chemically synthesized
atttctgcaggggataaatt

SEQ ID NO: 198764 - DNA, 20 bp, Artificial Sequence
  chemically synthesized
caggggataaattgggaaat

SEQ ID NO: 198765 - DNA, 20 bp, Artificial Sequence
  chemically synthesized
aggggataaattgggaaata

SEQ ID NO: 198766 - DNA, 20 bp, Artificial Sequence
  chemically synthesized
ttgggaaataaggaacacct

SEQ ID NO: 198767 - DNA, 20 bp, Artificial Sequence
  chemically synthesized
aataaggaacacctaagaat

SEQ ID NO: 198768 - DNA, 20 bp, Artificial Sequence
  chemically synthesized
ctacctcatttctgattctt

SEQ ID NO: 198769 - DNA, 20 bp, Artificial Sequence
  chemically synthesized
tctacctcatttctgattct

SEQ ID NO: 198770 - DNA, 20 bp, Artificial Sequence
  chemically synthesized
aacacctaagaatcagaaat

SEQ ID NO: 198771 - DNA, 20 bp, Artificial Sequence
  chemically synthesized
acacctaagaatcagaaatg

SEQ ID NO: 198772 - DNA, 20 bp, Artificial Sequence
  chemically synthesized
cctaagaatcagaaatgagg

SEQ ID NO: 198773 - DNA, 20 bp, Artificial Sequence
  chemically synthesized
attgaaataaaaacttgatc

SEQ ID NO: 198774 - DNA, 20 bp, Artificial Sequence
  chemically synthesized
gaaataaaaacttgatctag

SEQ ID NO: 198775 - DNA, 20 bp, Artificial Sequence
  chemically synthesized
ttactgtgatcttctagatc

SEQ ID NO: 198776 - DNA, 20 bp, Artificial Sequence
  chemically synthesized
aagaacttactgtgatcttc

SEQ ID NO: 198777 - DNA, 20 bp, Artificial Sequence
  chemically synthesized
aaacttgatctagaagatca

SEQ ID NO: 198778 - DNA, 20 bp, Artificial Sequence
  chemically synthesized
ttgatctagaagatcacagt

SEQ ID NO: 198779 - DNA, 20 bp, Artificial Sequence
  chemically synthesized
cacagtaagttcttaaaacg

SEQ ID NO: 198780 - DNA, 20 bp, Artificial Sequence
  chemically synthesized
tcctaggaggaccgcgtttt

SEQ ID NO: 198781 - DNA, 20 bp, Artificial Sequence
  chemically synthesized
ttcttaaaacgcggtcctcc

SEQ ID NO: 198782 - DNA, 20 bp, Artificial Sequence
  chemically synthesized
tcttaaaacgcggtcctcct

SEQ ID NO: 198783 - DNA, 20 bp, Artificial Sequence
  chemically synthesized
gtgttgtgctgggtcctagg

SEQ ID NO: 198784 - DNA, 20 bp, Artificial Sequence
  chemically synthesized
cgtgttgtgctgggtcctag

SEQ ID NO: 198785 - DNA, 20 bp, Artificial Sequence
  chemically synthesized
aacgcggtcctcctaggacc

SEQ ID NO: 198786 - DNA, 20 bp, Artificial Sequence
  chemically synthesized
tacgtgttgtgctgggtcct

SEQ ID NO: 198787 - DNA, 20 bp, Artificial Sequence
  chemically synthesized
ttacgtgttgtgctgggtcc

SEQ ID NO: 198788 - DNA, 20 bp, Artificial Sequence
  chemically synthesized
catttattacgtgttgtgct

SEQ ID NO: 198789 - DNA, 20 bp, Artificial Sequence
  chemically synthesized
gcatttattacgtgttgtgc

SEQ ID NO: 198790 - DNA, 20 bp, Artificial Sequence
  chemically synthesized
aacacgtaataaatgctgcc

SEQ ID NO: 198791 - DNA, 20 bp, Artificial Sequence
  chemically synthesized
taagttcaattcaaaccagg

SEQ ID NO: 198792 - DNA, 20 bp, Artificial Sequence
  chemically synthesized
ccttaagttcaattcaaacc

SEQ ID NO: 198793 - DNA, 20 bp, Artificial Sequence
  chemically synthesized
accttaagttcaattcaaac

SEQ ID NO: 198794 - DNA, 20 bp, Artificial Sequence
  chemically synthesized
gcctggtttgaattgaactt

SEQ ID NO: 198795 - DNA, 20 bp, Artificial Sequence
  chemically synthesized
cctggtttgaattgaactta

SEQ ID NO: 198796 - DNA, 20 bp, Artificial Sequence
  chemically synthesized
ggtttgaattgaacttaagg

SEQ ID NO: 198797 - DNA, 20 bp, Artificial Sequence
  chemically synthesized
gttcttgttaatgctacctt

SEQ ID NO: 198798 - DNA, 20 bp, Artificial Sequence
  chemically synthesized
gaacttaaggtagcattaac

SEQ ID NO: 198799 - DNA, 20 bp, Artificial Sequence
  chemically synthesized
aggtagcattaacaagaact

SEQ ID NO: 198800 - DNA, 20 bp, Artificial Sequence
  chemically synthesized
ggtagcattaacaagaactt

SEQ ID NO: 198801 - DNA, 20 bp, Artificial Sequence
  chemically synthesized
agcattaacaagaacttggg

SEQ ID NO: 198802 - DNA, 20 bp, Artificial Sequence
  chemically synthesized
attttgtgtcagcacttccc

SEQ ID NO: 198803 - DNA, 20 bp, Artificial Sequence
  chemically synthesized
taagagaatccattttgtgt

SEQ ID NO: 198804 - DNA, 20 bp, Artificial Sequence
  chemically synthesized
tgggaagtgctgacacaaaa

SEQ ID NO: 198805 - DNA, 20 bp, Artificial Sequence
  chemically synthesized
caaaatggattctcttattc

SEQ ID NO: 198806 - DNA, 20 bp, Artificial Sequence
  chemically synthesized
acaagaattgtctagaataa

SEQ ID NO: 198807 - DNA, 20 bp, Artificial Sequence
  chemically synthesized
gtacaagaattgtctagaat

SEQ ID NO: 198808 - DNA, 20 bp, Artificial Sequence
  chemically synthesized
cattcagtacaagaattgtc

SEQ ID NO: 198809 - DNA, 20 bp, Artificial Sequence
  chemically synthesized
aaattaagttcattcagtac

SEQ ID NO: 198810 - DNA, 20 bp, Artificial Sequence
  chemically synthesized
tgaaagaaattaagttcatt

SEQ ID NO: 198811 - DNA, 20 bp, Artificial Sequence
  chemically synthesized
tgccagaactgaaagaaatt

SEQ ID NO: 198812 - DNA, 20 bp, Artificial Sequence
  chemically synthesized
tgaatgaacttaatttcttt

SEQ ID NO: 198813 - DNA, 20 bp, Artificial Sequence
  chemically synthesized
aacttaatttctttcagttc

SEQ ID NO: 198814 - DNA, 20 bp, Artificial Sequence
  chemically synthesized
ccaaactatgccagaactga

SEQ ID NO: 198815 - DNA, 20 bp, Artificial Sequence
  chemically synthesized
aatttctttcagttctggca

SEQ ID NO: 198816 - DNA, 20 bp, Artificial Sequence
  chemically synthesized
aagattcatccaaactatgc

SEQ ID NO: 198817 - DNA, 20 bp, Artificial Sequence
  chemically synthesized
ctttcagttctggcatagtt

SEQ ID NO: 198818 - DNA, 20 bp, Artificial Sequence
  chemically synthesized
acaaccagatggttatgagg

SEQ ID NO: 198819 - DNA, 20 bp, Artificial Sequence
  chemically synthesized
aagacaaccagatggttatg

SEQ ID NO: 198820 - DNA, 20 bp, Artificial Sequence
  chemically synthesized
gaagacaaccagatggttat

SEQ ID NO: 198821 - DNA, 20 bp, Artificial Sequence
  chemically synthesized
gaatcttcctcataaccatc

SEQ ID NO: 198822 - DNA, 20 bp, Artificial Sequence
  chemically synthesized
attgaaggaagacaaccaga

SEQ ID NO: 198823 - DNA, 20 bp, Artificial Sequence
  chemically synthesized
cagaattgaaggaagacaac

SEQ ID NO: 198824 - DNA, 20 bp, Artificial Sequence
  chemically synthesized
tagcagcacagaattgaagg

SEQ ID NO: 198825 - DNA, 20 bp, Artificial Sequence
  chemically synthesized
gtttagcagcacagaattga

SEQ ID NO: 198826 - DNA, 20 bp, Artificial Sequence
  chemically synthesized
tgtttagcagcacagaattg

SEQ ID NO: 198827 - DNA, 20 bp, Artificial Sequence
  chemically synthesized
cagaagtttgtttagcagca

SEQ ID NO: 198828 - DNA, 20 bp, Artificial Sequence
  chemically synthesized
aaaaacagaagtttgtttag

SEQ ID NO: 198829 - DNA, 20 bp, Artificial Sequence
  chemically synthesized
attaaaaacagaagtttgtt

SEQ ID NO: 198830 - DNA, 20 bp, Artificial Sequence
  chemically synthesized
gcaaaacaaattaaaaacag

SEQ ID NO: 198831 - DNA, 20 bp, Artificial Sequence
  chemically synthesized
ttagcaaaacaaattaaaaa

SEQ ID NO: 198832 - DNA, 20 bp, Artificial Sequence
  chemically synthesized
tgtttttaatttgttttgct

SEQ ID NO: 198833 - DNA, 20 bp, Artificial Sequence
  chemically synthesized
tcctcatgactaagtttact

SEQ ID NO: 198834 - DNA, 20 bp, Artificial Sequence
  chemically synthesized
tttgttttgctaagtaaact

SEQ ID NO: 198835 - DNA, 20 bp, Artificial Sequence
  chemically synthesized
tgctaagtaaacttagtcat

SEQ ID NO: 198836 - DNA, 20 bp, Artificial Sequence
  chemically synthesized
gctaagtaaacttagtcatg

SEQ ID NO: 198837 - DNA, 20 bp, Artificial Sequence
  chemically synthesized
ctaacattttcctcatgact

SEQ ID NO: 198838 - DNA, 20 bp, Artificial Sequence
  chemically synthesized
cttagtcatgaggaaaatgt

SEQ ID NO: 198839 - DNA, 20 bp, Artificial Sequence
  chemically synthesized
gaggaaaatgttagtctatg

SEQ ID NO: 198840 - DNA, 20 bp, Artificial Sequence
  chemically synthesized
aaaatgttagtctatgtgga

SEQ ID NO: 198841 - DNA, 20 bp, Artificial Sequence
  chemically synthesized
atattacacgaccatccaca

SEQ ID NO: 198842 - DNA, 20 bp, Artificial Sequence
  chemically synthesized
gatggtcgtgtaatattctc

SEQ ID NO: 198843 - DNA, 20 bp, Artificial Sequence
  chemically synthesized
taatgggggaaaggttaccg

SEQ ID NO: 198844 - DNA, 20 bp, Artificial Sequence
  chemically synthesized
tgtaatgggggaaaggttac

SEQ ID NO: 198845 - DNA, 20 bp, Artificial Sequence
  chemically synthesized
gattatttgtaatgggggaa

SEQ ID NO: 198846 - DNA, 20 bp, Artificial Sequence
  chemically synthesized
tgattatttgtaatggggga

SEQ ID NO: 198847 - DNA, 20 bp, Artificial Sequence
  chemically synthesized
aatgtgattatttgtaatgg

SEQ ID NO: 198848 - DNA, 20 bp, Artificial Sequence
  chemically synthesized
caatgtgattatttgtaatg

SEQ ID NO: 198849 - DNA, 20 bp, Artificial Sequence
  chemically synthesized
tcaatgtgattatttgtaat

SEQ ID NO: 198850 - DNA, 20 bp, Artificial Sequence
  chemically synthesized
gtcaatgtgattatttgtaa

SEQ ID NO: 198851 - DNA, 20 bp, Artificial Sequence
  chemically synthesized
ggttcaaactagtggataat

SEQ ID NO: 198852 - DNA, 20 bp, Artificial Sequence
  chemically synthesized
acattgtgctcattatccac

SEQ ID NO: 198853 - DNA, 20 bp, Artificial Sequence
  chemically synthesized
accccataggttcaaactag

SEQ ID NO: 198854 - DNA, 20 bp, Artificial Sequence
  chemically synthesized
tgaaccccataggttcaaac

SEQ ID NO: 198855 - DNA, 20 bp, Artificial Sequence
  chemically synthesized
tatccactagtttgaaccta

SEQ ID NO: 198856 - DNA, 20 bp, Artificial Sequence
  chemically synthesized
atccactagtttgaacctat

SEQ ID NO: 198857 - DNA, 20 bp, Artificial Sequence
  chemically synthesized
tccactagtttgaacctatg

SEQ ID NO: 198858 - DNA, 20 bp, Artificial Sequence
  chemically synthesized
atttcttcattgaaccccat

SEQ ID NO: 198859 - DNA, 20 bp, Artificial Sequence
  chemically synthesized
catttcttcattgaacccca

SEQ ID NO: 198860 - DNA, 20 bp, Artificial Sequence
  chemically synthesized
tgaacctatggggttcaatg

SEQ ID NO: 198861 - DNA, 20 bp, Artificial Sequence
  chemically synthesized
ggttgctaagcatgtagaca

SEQ ID NO: 198862 - DNA, 20 bp, Artificial Sequence
  chemically synthesized
catttctatgtctacatgct

SEQ ID NO: 198863 - DNA, 20 bp, Artificial Sequence
  chemically synthesized
ggatctggttgctaagcatg

SEQ ID NO: 198864 - DNA, 20 bp, Artificial Sequence
  chemically synthesized
atgtctacatgcttagcaac

SEQ ID NO: 198865 - DNA, 20 bp, Artificial Sequence
  chemically synthesized
gagaccaggatctggttgct

SEQ ID NO: 198866 - DNA, 20 bp, Artificial Sequence
  chemically synthesized
catgcttagcaaccagatcc

SEQ ID NO: 198867 - DNA, 20 bp, Artificial Sequence
  chemically synthesized
ttatctctgagaccaggatc

SEQ ID NO: 198868 - DNA, 20 bp, Artificial Sequence
  chemically synthesized
tagcaaccagatcctggtct

SEQ ID NO: 198869 - DNA, 20 bp, Artificial Sequence
  chemically synthesized
gcaaccagatcctggtctca

SEQ ID NO: 198870 - DNA, 20 bp, Artificial Sequence
  chemically synthesized
ggcattttatctctgagacc

SEQ ID NO: 198871 - DNA, 20 bp, Artificial Sequence
  chemically synthesized
tggcattttatctctgagac

SEQ ID NO: 198872 - DNA, 20 bp, Artificial Sequence
  chemically synthesized
cttcctggcattttatctct

SEQ ID NO: 198873 - DNA, 20 bp, Artificial Sequence
  chemically synthesized
tggtctcagagataaaatgc

SEQ ID NO: 198874 - DNA, 20 bp, Artificial Sequence
  chemically synthesized
ggtctcagagataaaatgcc

SEQ ID NO: 198875 - DNA, 20 bp, Artificial Sequence
  chemically synthesized
ctcagagataaaatgccagg

SEQ ID NO: 198876 - DNA, 20 bp, Artificial Sequence
  chemically synthesized
atcgtcgagtgatttcttcc

SEQ ID NO: 198877 - DNA, 20 bp, Artificial Sequence
  chemically synthesized
tgagacgtggatttatcgtc

SEQ ID NO: 198878 - DNA, 20 bp, Artificial Sequence
  chemically synthesized
tcgacgataaatccacgtct

SEQ ID NO: 198879 - DNA, 20 bp, Artificial Sequence
  chemically synthesized
ttagagcaaattctgagacg

SEQ ID NO: 198880 - DNA, 20 bp, Artificial Sequence
  chemically synthesized
tcaggcttagagcaaattct

SEQ ID NO: 198881 - DNA, 20 bp, Artificial Sequence
  chemically synthesized
cacgtctcagaatttgctct

SEQ ID NO: 198882 - DNA, 20 bp, Artificial Sequence
  chemically synthesized
tcagaatttgctctaagcct

SEQ ID NO: 198883 - DNA, 20 bp, Artificial Sequence
  chemically synthesized
gtcatctcctctcaggctta

SEQ ID NO: 198884 - DNA, 20 bp, Artificial Sequence
  chemically synthesized
agaatttgctctaagcctga

SEQ ID NO: 198885 - DNA, 20 bp, Artificial Sequence
  chemically synthesized
ccgtcatctcctctcaggct

SEQ ID NO: 198886 - DNA, 20 bp, Artificial Sequence
  chemically synthesized
gaatttgctctaagcctgag

SEQ ID NO: 198887 - DNA, 20 bp, Artificial Sequence
  chemically synthesized
atttgctctaagcctgagag

SEQ ID NO: 198888 - DNA, 20 bp, Artificial Sequence
  chemically synthesized
taactccgtcatctcctctc

SEQ ID NO: 198889 - DNA, 20 bp, Artificial Sequence
  chemically synthesized
ataactccgtcatctcctct

SEQ ID NO: 198890 - DNA, 20 bp, Artificial Sequence
  chemically synthesized
ctaagcctgagaggagatga

SEQ ID NO: 198891 - DNA, 20 bp, Artificial Sequence
  chemically synthesized
aagcctgagaggagatgacg

SEQ ID NO: 198892 - DNA, 20 bp, Artificial Sequence
  chemically synthesized
gaggagatgacggagttatg

SEQ ID NO: 198893 - DNA, 20 bp, Artificial Sequence
  chemically synthesized
atgacggagttatgaagtgc

SEQ ID NO: 198894 - DNA, 20 bp, Artificial Sequence
  chemically synthesized
cacataagagtttcaacatc

SEQ ID NO: 198895 - DNA, 20 bp, Artificial Sequence
  chemically synthesized
gatgttgaaactcttatgtg

SEQ ID NO: 198896 - DNA, 20 bp, Artificial Sequence
  chemically synthesized
ctcaagaagtctgcacataa

SEQ ID NO: 198897 - DNA, 20 bp, Artificial Sequence
  chemically synthesized
ttctcaagaagtctgcacat

SEQ ID NO: 198898 - DNA, 20 bp, Artificial Sequence
  chemically synthesized
ctcttatgtgcagacttctt

SEQ ID NO: 198899 - DNA, 20 bp, Artificial Sequence
  chemically synthesized
tttttaactccattctcaag

SEQ ID NO: 198900 - DNA, 20 bp, Artificial Sequence
  chemically synthesized
atgtgcagacttcttgagaa

SEQ ID NO: 198901 - DNA, 20 bp, Artificial Sequence
  chemically synthesized
gtgcagacttcttgagaatg

SEQ ID NO: 198902 - DNA, 20 bp, Artificial Sequence
  chemically synthesized
tattttttaactccattctc

SEQ ID NO: 198903 - DNA, 20 bp, Artificial Sequence
  chemically synthesized
atggagttaaaaaataaaaa

SEQ ID NO: 198904 - DNA, 20 bp, Artificial Sequence
  chemically synthesized
ggagttaaaaaataaaaaca

SEQ ID NO: 198905 - DNA, 20 bp, Artificial Sequence
  chemically synthesized
aataaaaacagagaaaatca

SEQ ID NO: 198906 - DNA, 20 bp, Artificial Sequence
  chemically synthesized
aacagagaaaatcaaagtca

SEQ ID NO: 198907 - DNA, 20 bp, Artificial Sequence
  chemically synthesized
agtcaaagatataaaatgtt

SEQ ID NO: 198908 - DNA, 20 bp, Artificial Sequence
  chemically synthesized
agaaatcaaacacctgacat

SEQ ID NO: 198909 - DNA, 20 bp, Artificial Sequence
  chemically synthesized
catttctcatagctaatgtc

SEQ ID NO: 198910 - DNA, 20 bp, Artificial Sequence
  chemically synthesized
acatttctcatagctaatgt

SEQ ID NO: 198911 - DNA, 20 bp, Artificial Sequence
  chemically synthesized
aaacacctgacattagctat

SEQ ID NO: 198912 - DNA, 20 bp, Artificial Sequence
  chemically synthesized
tttgccataaacatttctca

SEQ ID NO: 198913 - DNA, 20 bp, Artificial Sequence
  chemically synthesized
ttagctatgagaaatgttta

SEQ ID NO: 198914 - DNA, 20 bp, Artificial Sequence
  chemically synthesized
tgttgggagaaagcgaggat

SEQ ID NO: 198915 - DNA, 20 bp, Artificial Sequence
  chemically synthesized
cagcttgttgggagaaagcg

SEQ ID NO: 198916 - DNA, 20 bp, Artificial Sequence
  chemically synthesized
acagcttgttgggagaaagc

SEQ ID NO: 198917 - DNA, 20 bp, Artificial Sequence
  chemically synthesized
gataacagcttgttgggaga

SEQ ID NO: 198918 - DNA, 20 bp, Artificial Sequence
  chemically synthesized
gatcctcgctttctcccaac

SEQ ID NO: 198919 - DNA, 20 bp, Artificial Sequence
  chemically synthesized
attagataacagcttgttgg

SEQ ID NO: 198920 - DNA, 20 bp, Artificial Sequence
  chemically synthesized
caattagataacagcttgtt

SEQ ID NO: 198921 - DNA, 20 bp, Artificial Sequence
  chemically synthesized
acaattagataacagcttgt

SEQ ID NO: 198922 - DNA, 20 bp, Artificial Sequence
  chemically synthesized
aacaaataacaattagataa

SEQ ID NO: 198923 - DNA, 20 bp, Artificial Sequence
  chemically synthesized
atcacacaacaaataacaat

SEQ ID NO: 198924 - DNA, 20 bp, Artificial Sequence
  chemically synthesized
tttgattgaaatggtggata

SEQ ID NO: 198925 - DNA, 20 bp, Artificial Sequence
  chemically synthesized
tcatgctttgattgaaatgg

SEQ ID NO: 198926 - DNA, 20 bp, Artificial Sequence
  chemically synthesized
tgctcatgctttgattgaaa

SEQ ID NO: 198927 - DNA, 20 bp, Artificial Sequence
  chemically synthesized
tatatccaccatttcaatca

SEQ ID NO: 198928 - DNA, 20 bp, Artificial Sequence
  chemically synthesized
caccatttcaatcaaagcat

SEQ ID NO: 198929 - DNA, 20 bp, Artificial Sequence
  chemically synthesized
atttcaatcaaagcatgagc

SEQ ID NO: 198930 - DNA, 20 bp, Artificial Sequence
  chemically synthesized
atgagcaagacttatttcaa

SEQ ID NO: 198931 - DNA, 20 bp, Artificial Sequence
  chemically synthesized
aatgctatggctattgaaat

SEQ ID NO: 198932 - DNA, 20 bp, Artificial Sequence
  chemically synthesized
aagacttatttcaatagcca

SEQ ID NO: 198933 - DNA, 20 bp, Artificial Sequence
  chemically synthesized
tttgtctgggagcaatgcta

SEQ ID NO: 198934 - DNA, 20 bp, Artificial Sequence
  chemically synthesized
aatagccatagcattgctcc

SEQ ID NO: 198935 - DNA, 20 bp, Artificial Sequence
  chemically synthesized
gaatgaataagtttgtctgg

SEQ ID NO: 198936 - DNA, 20 bp, Artificial Sequence
  chemically synthesized
aggaatgaataagtttgtct

SEQ ID NO: 198937 - DNA, 20 bp, Artificial Sequence
  chemically synthesized
gaggaatgaataagtttgtc

SEQ ID NO: 198938 - DNA, 20 bp, Artificial Sequence
  chemically synthesized
tgaatggaggaggaatgaat

SEQ ID NO: 198939 - DNA, 20 bp, Artificial Sequence
  chemically synthesized
ctaaatataatgaatggagg

SEQ ID NO: 198940 - DNA, 20 bp, Artificial Sequence
  chemically synthesized
gctaaatataatgaatggag

SEQ ID NO: 198941 - DNA, 20 bp, Artificial Sequence
  chemically synthesized
gagctaaatataatgaatgg

SEQ ID NO: 198942 - DNA, 20 bp, Artificial Sequence
  chemically synthesized
agagctaaatataatgaatg

SEQ ID NO: 198943 - DNA, 20 bp, Artificial Sequence
  chemically synthesized
acagagctaaatataatgaa

SEQ ID NO: 198944 - DNA, 20 bp, Artificial Sequence
  chemically synthesized
cctcctccattcattatatt

SEQ ID NO: 198945 - DNA, 20 bp, Artificial Sequence
  chemically synthesized
cattatatttagctctgtta

SEQ ID NO: 198946 - DNA, 20 bp, Artificial Sequence
  chemically synthesized
ccacagttgatgctgtaaca

SEQ ID NO: 198947 - DNA, 20 bp, Artificial Sequence
  chemically synthesized
ttccacagttgatgctgtaa

SEQ ID NO: 198948 - DNA, 20 bp, Artificial Sequence
  chemically synthesized
ctctgttacagcatcaactg

SEQ ID NO: 198949 - DNA, 20 bp, Artificial Sequence
  chemically synthesized
agaattatttcaggattcca

SEQ ID NO: 198950 - DNA, 20 bp, Artificial Sequence
  chemically synthesized
acatgtaagagaattatttc

SEQ ID NO: 198951 - DNA, 20 bp, Artificial Sequence
  chemically synthesized
gacatgtaagagaattattt

SEQ ID NO: 198952 - DNA, 20 bp, Artificial Sequence
  chemically synthesized
tgaaggaggcagacatgtaa

SEQ ID NO: 198953 - DNA, 20 bp, Artificial Sequence
  chemically synthesized
ggtgaaggaggcagacatgt

SEQ ID NO: 198954 - DNA, 20 bp, Artificial Sequence
  chemically synthesized
ccacaatctggtgaaggagg

SEQ ID NO: 198955 - DNA, 20 bp, Artificial Sequence
  chemically synthesized
tacatgtctgcctccttcac

SEQ ID NO: 198956 - DNA, 20 bp, Artificial Sequence
  chemically synthesized
actccacaatctggtgaagg

SEQ ID NO: 198957 - DNA, 20 bp, Artificial Sequence
  chemically synthesized
gactccacaatctggtgaag

SEQ ID NO: 198958 - DNA, 20 bp, Artificial Sequence
  chemically synthesized
cagactccacaatctggtga

SEQ ID NO: 198959 - DNA, 20 bp, Artificial Sequence
  chemically synthesized
acagactccacaatctggtg

SEQ ID NO: 198960 - DNA, 20 bp, Artificial Sequence
  chemically synthesized
ctgcctccttcaccagattg

SEQ ID NO: 198961 - DNA, 20 bp, Artificial Sequence
  chemically synthesized
gcctccttcaccagattgtg

SEQ ID NO: 198962 - DNA, 20 bp, Artificial Sequence
  chemically synthesized
ccttcacagactccacaatc

SEQ ID NO: 198963 - DNA, 20 bp, Artificial Sequence
  chemically synthesized
accagattgtggagtctgtg

SEQ ID NO: 198964 - DNA, 20 bp, Artificial Sequence
  chemically synthesized
ccagattgtggagtctgtga

SEQ ID NO: 198965 - DNA, 20 bp, Artificial Sequence
  chemically synthesized
agagtacataatttccttca

SEQ ID NO: 198966 - DNA, 20 bp, Artificial Sequence
  chemically synthesized
gtgttcaataaatatttgta

SEQ ID NO: 198967 - DNA, 20 bp, Artificial Sequence
  chemically synthesized
aggtgttcaataaatatttg

SEQ ID NO: 198968 - DNA, 20 bp, Artificial Sequence
  chemically synthesized
tatttattgaacacctaata

SEQ ID NO: 198969 - DNA, 20 bp, Artificial Sequence
  chemically synthesized
aacagtctctggtccatatt

SEQ ID NO: 198970 - DNA, 20 bp, Artificial Sequence
  chemically synthesized
aaacagtctctggtccatat

SEQ ID NO: 198971 - DNA, 20 bp, Artificial Sequence
  chemically synthesized
attgaacacctaatatggac

SEQ ID NO: 198972 - DNA, 20 bp, Artificial Sequence
  chemically synthesized
tgaacacctaatatggacca

SEQ ID NO: 198973 - DNA, 20 bp, Artificial Sequence
  chemically synthesized
ttatcatctaaaacagtctc

SEQ ID NO: 198974 - DNA, 20 bp, Artificial Sequence
  chemically synthesized
atatggaccagagactgttt

SEQ ID NO: 198975 - DNA, 20 bp, Artificial Sequence
  chemically synthesized
tatctccttatcatctaaaa

SEQ ID NO: 198976 - DNA, 20 bp, Artificial Sequence
  chemically synthesized
cagagactgttttagatgat

SEQ ID NO: 198977 - DNA, 20 bp, Artificial Sequence
  chemically synthesized
agagactgttttagatgata

SEQ ID NO: 198978 - DNA, 20 bp, Artificial Sequence
  chemically synthesized
agactgttttagatgataag

SEQ ID NO: 198979 - DNA, 20 bp, Artificial Sequence
  chemically synthesized
tgttttagatgataaggaga

SEQ ID NO: 198980 - DNA, 20 bp, Artificial Sequence
  chemically synthesized
tttagatgataaggagatag

SEQ ID NO: 198981 - DNA, 20 bp, Artificial Sequence
  chemically synthesized
aggagatagcagtgatcaaa

SEQ ID NO: 198982 - DNA, 20 bp, Artificial Sequence
  chemically synthesized
aagtgtaagattcacatgga

SEQ ID NO: 198983 - DNA, 20 bp, Artificial Sequence
  chemically synthesized
cttgaagtgtaagattcaca

SEQ ID NO: 198984 - DNA, 20 bp, Artificial Sequence
  chemically synthesized
ccatgtgaatcttacacttc

SEQ ID NO: 198985 - DNA, 20 bp, Artificial Sequence
  chemically synthesized
tcccccattacttgaagtgt

SEQ ID NO: 198986 - DNA, 20 bp, Artificial Sequence
  chemically synthesized
gaatcttacacttcaagtaa

SEQ ID NO: 198987 - DNA, 20 bp, Artificial Sequence
  chemically synthesized
acatcatcccccattacttg

SEQ ID NO: 198988 - DNA, 20 bp, Artificial Sequence
  chemically synthesized
aatcttacacttcaagtaat

SEQ ID NO: 198989 - DNA, 20 bp, Artificial Sequence
  chemically synthesized
atcttacacttcaagtaatg

SEQ ID NO: 198990 - DNA, 20 bp, Artificial Sequence
  chemically synthesized
tcttacacttcaagtaatgg

SEQ ID NO: 198991 - DNA, 20 bp, Artificial Sequence
  chemically synthesized
aatgggggatgatgtaaatt

SEQ ID NO: 198992 - DNA, 20 bp, Artificial Sequence
  chemically synthesized
atgatgtaaatttggcattg

SEQ ID NO: 198993 - DNA, 20 bp, Artificial Sequence
  chemically synthesized
gatgtaaatttggcattgaa

SEQ ID NO: 198994 - DNA, 20 bp, Artificial Sequence
  chemically synthesized
atgtaaatttggcattgaag

SEQ ID NO: 198995 - DNA, 20 bp, Artificial Sequence
  chemically synthesized
aatttggcattgaagaggtt

SEQ ID NO: 198996 - DNA, 20 bp, Artificial Sequence
  chemically synthesized
aagaggtttggcttgtaact

SEQ ID NO: 198997 - DNA, 20 bp, Artificial Sequence
  chemically synthesized
aaataatgattccaagttac

SEQ ID NO: 198998 - DNA, 20 bp, Artificial Sequence
  chemically synthesized
agctagaaaataatgattcc

SEQ ID NO: 198999 - DNA, 20 bp, Artificial Sequence
  chemically synthesized
aacttggaatcattattttc

SEQ ID NO: 199000 - DNA, 20 bp, Artificial Sequence
  chemically synthesized
ctttaccaaggtcatagagc

SEQ ID NO: 199001 - DNA, 20 bp, Artificial Sequence
  chemically synthesized
gtgactttaccaaggtcata

SEQ ID NO: 199002 - DNA, 20 bp, Artificial Sequence
  chemically synthesized
attttctagctctatgacct

SEQ ID NO: 199003 - DNA, 20 bp, Artificial Sequence
  chemically synthesized
aagtgactttaccaaggtca

SEQ ID NO: 199004 - DNA, 20 bp, Artificial Sequence
  chemically synthesized
ctagctctatgaccttggta

SEQ ID NO: 199005 - DNA, 20 bp, Artificial Sequence
  chemically synthesized
ttggtcaagtgactttacca

SEQ ID NO: 199006 - DNA, 20 bp, Artificial Sequence
  chemically synthesized
tttggtcaagtgactttacc

SEQ ID NO: 199007 - DNA, 20 bp, Artificial Sequence
  chemically synthesized
agacagctcaagttttggtc

SEQ ID NO: 199008 - DNA, 20 bp, Artificial Sequence
  chemically synthesized
aagtcacttgaccaaaactt

SEQ ID NO: 199009 - DNA, 20 bp, Artificial Sequence
  chemically synthesized
aaataagacagctcaagttt

SEQ ID NO: 199010 - DNA, 20 bp, Artificial Sequence
  chemically synthesized
atttataaataagacagctc

SEQ ID NO: 199011 - DNA, 20 bp, Artificial Sequence
  chemically synthesized
tcctcaatttataaataaga

SEQ ID NO: 199012 - DNA, 20 bp, Artificial Sequence
  chemically synthesized
atgatcctcaatttataaat

SEQ ID NO: 199013 - DNA, 20 bp, Artificial Sequence
  chemically synthesized
agctgtcttatttataaatt

SEQ ID NO: 199014 - DNA, 20 bp, Artificial Sequence
  chemically synthesized
gctgtcttatttataaattg

SEQ ID NO: 199015 - DNA, 20 bp, Artificial Sequence
  chemically synthesized
ttgaggatcataatacctta

SEQ ID NO: 199016 - DNA, 20 bp, Artificial Sequence
  chemically synthesized
gatcataataccttatagca

SEQ ID NO: 199017 - DNA, 20 bp, Artificial Sequence
  chemically synthesized
aatcttatagccatgctata

SEQ ID NO: 199018 - DNA, 20 bp, Artificial Sequence
  chemically synthesized
aaatcttatagccatgctat

SEQ ID NO: 199019 - DNA, 20 bp, Artificial Sequence
  chemically synthesized
ataccttatagcatggctat

SEQ ID NO: 199020 - DNA, 20 bp, Artificial Sequence
  chemically synthesized
atcatttcattaaaatctta

SEQ ID NO: 199021 - DNA, 20 bp, Artificial Sequence
  chemically synthesized
tttaatgaaatgatatcata

SEQ ID NO: 199022 - DNA, 20 bp, Artificial Sequence
  chemically synthesized
tatcatatggcctaataaaa

SEQ ID NO: 199023 - DNA, 20 bp, Artificial Sequence
  chemically synthesized
agcttagctacttttttatt

SEQ ID NO: 199024 - DNA, 20 bp, Artificial Sequence
  chemically synthesized
aagcttagctacttttttat

SEQ ID NO: 199025 - DNA, 20 bp, Artificial Sequence
  chemically synthesized
catatggcctaataaaaaag

SEQ ID NO: 199026 - DNA, 20 bp, Artificial Sequence
  chemically synthesized
ggcctaataaaaaagtagct

SEQ ID NO: 199027 - DNA, 20 bp, Artificial Sequence
  chemically synthesized
aacaggtatacagtaaagct

SEQ ID NO: 199028 - DNA, 20 bp, Artificial Sequence
  chemically synthesized
tataaaacaggtatacagta

SEQ ID NO: 199029 - DNA, 20 bp, Artificial Sequence
  chemically synthesized
gctactataaaacaggtata

SEQ ID NO: 199030 - DNA, 20 bp, Artificial Sequence
  chemically synthesized
tttactgtatacctgtttta

SEQ ID NO: 199031 - DNA, 20 bp, Artificial Sequence
  chemically synthesized
caacagtgctactataaaac

SEQ ID NO: 199032 - DNA, 20 bp, Artificial Sequence
  chemically synthesized
acaacagtgctactataaaa

SEQ ID NO: 199033 - DNA, 20 bp, Artificial Sequence
  chemically synthesized
actgtatacctgttttatag

SEQ ID NO: 199034 - DNA, 20 bp, Artificial Sequence
  chemically synthesized
ttgtaagatttaaagcacaa

SEQ ID NO: 199035 - DNA, 20 bp, Artificial Sequence
  chemically synthesized
aagacttgttgtaagattta

SEQ ID NO: 199036 - DNA, 20 bp, Artificial Sequence
  chemically synthesized
tgtgctttaaatcttacaac

SEQ ID NO: 199037 - DNA, 20 bp, Artificial Sequence
  chemically synthesized
ctatcttgaagacttgttgt

SEQ ID NO: 199038 - DNA, 20 bp, Artificial Sequence
  chemically synthesized
aaatcttacaacaagtcttc

SEQ ID NO: 199039 - DNA, 20 bp, Artificial Sequence
  chemically synthesized
cttacaacaagtcttcaaga

SEQ ID NO: 199040 - DNA, 20 bp, Artificial Sequence
  chemically synthesized
ttacaacaagtcttcaagat

SEQ ID NO: 199041 - DNA, 20 bp, Artificial Sequence
  chemically synthesized
ctataatcatacctatcttg

SEQ ID NO: 199042 - DNA, 20 bp, Artificial Sequence
  chemically synthesized
cttcaagataggtatgatta

SEQ ID NO: 199043 - DNA, 20 bp, Artificial Sequence
  chemically synthesized
ttcaagataggtatgattat

SEQ ID NO: 199044 - DNA, 20 bp, Artificial Sequence
  chemically synthesized
aagataggtatgattatagg

SEQ ID NO: 199045 - DNA, 20 bp, Artificial Sequence
  chemically synthesized
agataggtatgattatagga

SEQ ID NO: 199046 - DNA, 20 bp, Artificial Sequence
  chemically synthesized
tataggaaggttaaattact

SEQ ID NO: 199047 - DNA, 20 bp, Artificial Sequence
  chemically synthesized
ggaaggttaaattacttaga

SEQ ID NO: 199048 - DNA, 20 bp, Artificial Sequence
  chemically synthesized
tagctaacttgtgactatct

SEQ ID NO: 199049 - DNA, 20 bp, Artificial Sequence
  chemically synthesized
taaattacttagatagtcac

SEQ ID NO: 199050 - DNA, 20 bp, Artificial Sequence
  chemically synthesized
ttacttagatagtcacaagt

SEQ ID NO: 199051 - DNA, 20 bp, Artificial Sequence
  chemically synthesized
ttagatagtcacaagttagc

SEQ ID NO: 199052 - DNA, 20 bp, Artificial Sequence
  chemically synthesized
gatagtcacaagttagctag

SEQ ID NO: 199053 - DNA, 20 bp, Artificial Sequence
  chemically synthesized
agtcacaagttagctagtgg

SEQ ID NO: 199054 - DNA, 20 bp, Artificial Sequence
  chemically synthesized
tcacaagttagctagtggaa

SEQ ID NO: 199055 - DNA, 20 bp, Artificial Sequence
  chemically synthesized
ttaaattctagctcttccac

SEQ ID NO: 199056 - DNA, 20 bp, Artificial Sequence
  chemically synthesized
aagttagctagtggaagagc

SEQ ID NO: 199057 - DNA, 20 bp, Artificial Sequence
  chemically synthesized
taaactgcctgtttaaattc

SEQ ID NO: 199058 - DNA, 20 bp, Artificial Sequence
  chemically synthesized
tggaagagctagaatttaaa

SEQ ID NO: 199059 - DNA, 20 bp, Artificial Sequence
  chemically synthesized
ggaagagctagaatttaaac

SEQ ID NO: 199060 - DNA, 20 bp, Artificial Sequence
  chemically synthesized
agagctagaatttaaacagg

SEQ ID NO: 199061 - DNA, 20 bp, Artificial Sequence
  chemically synthesized
gagcccagtgaataacaggg

SEQ ID NO: 199062 - DNA, 20 bp, Artificial Sequence
  chemically synthesized
gtagagcccagtgaataaca

SEQ ID NO: 199063 - DNA, 20 bp, Artificial Sequence
  chemically synthesized
agtagagcccagtgaataac

SEQ ID NO: 199064 - DNA, 20 bp, Artificial Sequence
  chemically synthesized
gagtagagcccagtgaataa

SEQ ID NO: 199065 - DNA, 20 bp, Artificial Sequence
  chemically synthesized
acatctgccctgttattcac

SEQ ID NO: 199066 - DNA, 20 bp, Artificial Sequence
  chemically synthesized
catctgccctgttattcact

SEQ ID NO: 199067 - DNA, 20 bp, Artificial Sequence
  chemically synthesized
gcagtatacagagtagagcc

SEQ ID NO: 199068 - DNA, 20 bp, Artificial Sequence
  chemically synthesized
agaaagcagtatacagagta

SEQ ID NO: 199069 - DNA, 20 bp, Artificial Sequence
  chemically synthesized
aaagaaagcagtatacagag

SEQ ID NO: 199070 - DNA, 20 bp, Artificial Sequence
  chemically synthesized
actaaagaaagcagtataca

SEQ ID NO: 199071 - DNA, 20 bp, Artificial Sequence
  chemically synthesized
atactaaagaaagcagtata

SEQ ID NO: 199072 - DNA, 20 bp, Artificial Sequence
  chemically synthesized
actctgtatactgctttctt

SEQ ID NO: 199073 - DNA, 20 bp, Artificial Sequence
  chemically synthesized
ctttgtgatactaaagaaag

SEQ ID NO: 199074 - DNA, 20 bp, Artificial Sequence
  chemically synthesized
gcactttgtgatactaaaga

SEQ ID NO: 199075 - DNA, 20 bp, Artificial Sequence
  chemically synthesized
gcaggcactttgtgatacta

SEQ ID NO: 199076 - DNA, 20 bp, Artificial Sequence
  chemically synthesized
ctgctttctttagtatcaca

SEQ ID NO: 199077 - DNA, 20 bp, Artificial Sequence
  chemically synthesized
atcacaaagtgcctgccgta

SEQ ID NO: 199078 - DNA, 20 bp, Artificial Sequence
  chemically synthesized
acaactgccctctatacggc

SEQ ID NO: 199079 - DNA, 20 bp, Artificial Sequence
  chemically synthesized
cacaaagtgcctgccgtata

SEQ ID NO: 199080 - DNA, 20 bp, Artificial Sequence
  chemically synthesized
cacaactgccctctatacgg

SEQ ID NO: 199081 - DNA, 20 bp, Artificial Sequence
  chemically synthesized
acaaagtgcctgccgtatag

SEQ ID NO: 199082 - DNA, 20 bp, Artificial Sequence
  chemically synthesized
caaagtgcctgccgtataga

SEQ ID NO: 199083 - DNA, 20 bp, Artificial Sequence
  chemically synthesized
tgtcacaactgccctctata

SEQ ID NO: 199084 - DNA, 20 bp, Artificial Sequence
  chemically synthesized
agtgcctgccgtatagaggg

SEQ ID NO: 199085 - DNA, 20 bp, Artificial Sequence
  chemically synthesized
cgtatagagggcagttgtga

SEQ ID NO: 199086 - DNA, 20 bp, Artificial Sequence
  chemically synthesized
tagagggcagttgtgacagt

SEQ ID NO: 199087 - DNA, 20 bp, Artificial Sequence
  chemically synthesized
agagggcagttgtgacagtg

SEQ ID NO: 199088 - DNA, 20 bp, Artificial Sequence
  chemically synthesized
tgtgacagtgaggatgctat

SEQ ID NO: 199089 - DNA, 20 bp, Artificial Sequence
  chemically synthesized
tttatgttatgagcaactaa

SEQ ID NO: 199090 - DNA, 20 bp, Artificial Sequence
  chemically synthesized
tgagtgcagctttatgttat

SEQ ID NO: 199091 - DNA, 20 bp, Artificial Sequence
  chemically synthesized
tattagttgctcataacata

SEQ ID NO: 199092 - DNA, 20 bp, Artificial Sequence
  chemically synthesized
gtttttgattaatttgagtg

SEQ ID NO: 199093 - DNA, 20 bp, Artificial Sequence
  chemically synthesized
ttactgtttttgattaattt

SEQ ID NO: 199094 - DNA, 20 bp, Artificial Sequence
  chemically synthesized
gcactcaaattaatcaaaaa

SEQ ID NO: 199095 - DNA, 20 bp, Artificial Sequence
  chemically synthesized
ttaatcaaaaacagtaaaca

SEQ ID NO: 199096 - DNA, 20 bp, Artificial Sequence
  chemically synthesized
taatcaaaaacagtaaacaa

SEQ ID NO: 199097 - DNA, 20 bp, Artificial Sequence
  chemically synthesized
aatcaaaaacagtaaacaaa

SEQ ID NO: 199098 - DNA, 20 bp, Artificial Sequence
  chemically synthesized
agtaaacaaagggattctac

SEQ ID NO: 199099 - DNA, 20 bp, Artificial Sequence
  chemically synthesized
ttttcaatgacgtgaaccag

SEQ ID NO: 199100 - DNA, 20 bp, Artificial Sequence
  chemically synthesized
cagttttcaatgacgtgaac

SEQ ID NO: 199101 - DNA, 20 bp, Artificial Sequence
  chemically synthesized
gttcacgtcattgaaaactg

SEQ ID NO: 199102 - DNA, 20 bp, Artificial Sequence
  chemically synthesized
cacgtcattgaaaactgcag

SEQ ID NO: 199103 - DNA, 20 bp, Artificial Sequence
  chemically synthesized
acgtcattgaaaactgcaga

SEQ ID NO: 199104 - DNA, 20 bp, Artificial Sequence
  chemically synthesized
cgtcattgaaaactgcagaa

SEQ ID NO: 199105 - DNA, 20 bp, Artificial Sequence
  chemically synthesized
gtcattgaaaactgcagaag

SEQ ID NO: 199106 - DNA, 20 bp, Artificial Sequence
  chemically synthesized
tcattgaaaactgcagaagg

SEQ ID NO: 199107 - DNA, 20 bp, Artificial Sequence
  chemically synthesized
tcacttgcagcccccttctg

SEQ ID NO: 199108 - DNA, 20 bp, Artificial Sequence
  chemically synthesized
aaactgcagaagggggctgc

SEQ ID NO: 199109 - DNA, 20 bp, Artificial Sequence
  chemically synthesized
gcagaagggggctgcaagtg

SEQ ID NO: 199110 - DNA, 20 bp, Artificial Sequence
  chemically synthesized
ccctgattgaacttcacttg

SEQ ID NO: 199111 - DNA, 20 bp, Artificial Sequence
  chemically synthesized
ggctgcaagtgaagttcaat

SEQ ID NO: 199112 - DNA, 20 bp, Artificial Sequence
  chemically synthesized
gctgcaagtgaagttcaatc

SEQ ID NO: 199113 - DNA, 20 bp, Artificial Sequence
  chemically synthesized
ctgcaagtgaagttcaatca

SEQ ID NO: 199114 - DNA, 20 bp, Artificial Sequence
  chemically synthesized
tgcaagtgaagttcaatcag

SEQ ID NO: 199115 - DNA, 20 bp, Artificial Sequence
  chemically synthesized
gcaagtgaagttcaatcagg

SEQ ID NO: 199116 - DNA, 20 bp, Artificial Sequence
  chemically synthesized
agtactgagagatatggagc

SEQ ID NO: 199117 - DNA, 20 bp, Artificial Sequence
  chemically synthesized
gagtactgagagatatggag

SEQ ID NO: 199118 - DNA, 20 bp, Artificial Sequence
  chemically synthesized
taagagtactgagagatatg

SEQ ID NO: 199119 - DNA, 20 bp, Artificial Sequence
  chemically synthesized
gggtcctgctccatatctct

SEQ ID NO: 199120 - DNA, 20 bp, Artificial Sequence
  chemically synthesized
cctaagagtactgagagata

SEQ ID NO: 199121 - DNA, 20 bp, Artificial Sequence
  chemically synthesized
gggagacctaagagtactga

SEQ ID NO: 199122 - DNA, 20 bp, Artificial Sequence
  chemically synthesized
gagggagacctaagagtact

SEQ ID NO: 199123 - DNA, 20 bp, Artificial Sequence
  chemically synthesized
tccatatctctcagtactct

SEQ ID NO: 199124 - DNA, 20 bp, Artificial Sequence
  chemically synthesized
ccatatctctcagtactctt

SEQ ID NO: 199125 - DNA, 20 bp, Artificial Sequence
  chemically synthesized
gacacaagagggagacctaa

SEQ ID NO: 199126 - DNA, 20 bp, Artificial Sequence
  chemically synthesized
cagacacaagagggagacct

SEQ ID NO: 199127 - DNA, 20 bp, Artificial Sequence
  chemically synthesized
aggctgacagacacaagagg

SEQ ID NO: 199128 - DNA, 20 bp, Artificial Sequence
  chemically synthesized
taaggctgacagacacaaga

SEQ ID NO: 199129 - DNA, 20 bp, Artificial Sequence
  chemically synthesized
ataaggctgacagacacaag

SEQ ID NO: 199130 - DNA, 20 bp, Artificial Sequence
  chemically synthesized
aataaggctgacagacacaa

SEQ ID NO: 199131 - DNA, 20 bp, Artificial Sequence
  chemically synthesized
gaaataaggctgacagacac

SEQ ID NO: 199132 - DNA, 20 bp, Artificial Sequence
  chemically synthesized
ggtctccctcttgtgtctgt

SEQ ID NO: 199133 - DNA, 20 bp, Artificial Sequence
  chemically synthesized
ataacctgaaataaggctga

SEQ ID NO: 199134 - DNA, 20 bp, Artificial Sequence
  chemically synthesized
tgtgtctgtcagccttattt

SEQ ID NO: 199135 - DNA, 20 bp, Artificial Sequence
  chemically synthesized
gtgtctgtcagccttatttc

SEQ ID NO: 199136 - DNA, 20 bp, Artificial Sequence
  chemically synthesized
acagaagataacctgaaata

SEQ ID NO: 199137 - DNA, 20 bp, Artificial Sequence
  chemically synthesized
gacagaagataacctgaaat

SEQ ID NO: 199138 - DNA, 20 bp, Artificial Sequence
  chemically synthesized
tttcaggttatcttctgtca

SEQ ID NO: 199139 - DNA, 20 bp, Artificial Sequence
  chemically synthesized
cctttgtaataccatgacag

SEQ ID NO: 199140 - DNA, 20 bp, Artificial Sequence
  chemically synthesized
cagcctttgtaataccatga

SEQ ID NO: 199141 - DNA, 20 bp, Artificial Sequence
  chemically synthesized
tcttctgtcatggtattaca

SEQ ID NO: 199142 - DNA, 20 bp, Artificial Sequence
  chemically synthesized
cttctgtcatggtattacaa

SEQ ID NO: 199143 - DNA, 20 bp, Artificial Sequence
  chemically synthesized
tcatggtattacaaaggctg

SEQ ID NO: 199144 - DNA, 20 bp, Artificial Sequence
  chemically synthesized
atatgtgatagttagagctg

SEQ ID NO: 199145 - DNA, 20 bp, Artificial Sequence
  chemically synthesized
atatacatatgtgatagtta

SEQ ID NO: 199146 - DNA, 20 bp, Artificial Sequence
  chemically synthesized
taatatacatatgtgatagt

SEQ ID NO: 199147 - DNA, 20 bp, Artificial Sequence
  chemically synthesized
taagtaatatacatatgtga

SEQ ID NO: 199148 - DNA, 20 bp, Artificial Sequence
  chemically synthesized
tatcacatatgtatattact

SEQ ID NO: 199149 - DNA, 20 bp, Artificial Sequence
  chemically synthesized
tttttctcttgcgttgaact

SEQ ID NO: 199150 - DNA, 20 bp, Artificial Sequence
  chemically synthesized
tatattacttagttcaacgc

SEQ ID NO: 199151 - DNA, 20 bp, Artificial Sequence
  chemically synthesized
tattacttagttcaacgcaa

SEQ ID NO: 199152 - DNA, 20 bp, Artificial Sequence
  chemically synthesized
ttagttcaacgcaagagaaa

SEQ ID NO: 199153 - DNA, 20 bp, Artificial Sequence
  chemically synthesized
gcaagagaaaaagaatttcc

SEQ ID NO: 199154 - DNA, 20 bp, Artificial Sequence
  chemically synthesized
gacctactgcaaaggtttct

SEQ ID NO: 199155 - DNA, 20 bp, Artificial Sequence
  chemically synthesized
agacctactgcaaaggtttc

SEQ ID NO: 199156 - DNA, 20 bp, Artificial Sequence
  chemically synthesized
gaatttcccagaaacctttg

SEQ ID NO: 199157 - DNA, 20 bp, Artificial Sequence
  chemically synthesized
tttcccagaaacctttgcag

SEQ ID NO: 199158 - DNA, 20 bp, Artificial Sequence
  chemically synthesized
ttcccagaaacctttgcagt

SEQ ID NO: 199159 - DNA, 20 bp, Artificial Sequence
  chemically synthesized
atcaaggagacctactgcaa

SEQ ID NO: 199160 - DNA, 20 bp, Artificial Sequence
  chemically synthesized
aatcaaggagacctactgca

SEQ ID NO: 199161 - DNA, 20 bp, Artificial Sequence
  chemically synthesized
gtggactaataaaaatcaag

SEQ ID NO: 199162 - DNA, 20 bp, Artificial Sequence
  chemically synthesized
ctgtggactaataaaaatca

SEQ ID NO: 199163 - DNA, 20 bp, Artificial Sequence
  chemically synthesized
actgtggactaataaaaatc

SEQ ID NO: 199164 - DNA, 20 bp, Artificial Sequence
  chemically synthesized
taggtctccttgatttttat

SEQ ID NO: 199165 - DNA, 20 bp, Artificial Sequence
  chemically synthesized
ccttgatttttattagtcca

SEQ ID NO: 199166 - DNA, 20 bp, Artificial Sequence
  chemically synthesized
tgatttttattagtccacag

SEQ ID NO: 199167 - DNA, 20 bp, Artificial Sequence
  chemically synthesized
gatttttattagtccacagt

SEQ ID NO: 199168 - DNA, 20 bp, Artificial Sequence
  chemically synthesized
gatgacctcatgacctactg

SEQ ID NO: 199169 - DNA, 20 bp, Artificial Sequence
  chemically synthesized
attagtccacagtaggtcat

SEQ ID NO: 199170 - DNA, 20 bp, Artificial Sequence
  chemically synthesized
ttagtccacagtaggtcatg

SEQ ID NO: 199171 - DNA, 20 bp, Artificial Sequence
  chemically synthesized
aatctacagtaacaggttca

SEQ ID NO: 199172 - DNA, 20 bp, Artificial Sequence
  chemically synthesized
catctttgaacctgttactg

SEQ ID NO: 199173 - DNA, 20 bp, Artificial Sequence
  chemically synthesized
ccagtgcaatctacagtaac

SEQ ID NO: 199174 - DNA, 20 bp, Artificial Sequence
  chemically synthesized
accagtgcaatctacagtaa

SEQ ID NO: 199175 - DNA, 20 bp, Artificial Sequence
  chemically synthesized
agatgaaccagtgcaatcta

SEQ ID NO: 199176 - DNA, 20 bp, Artificial Sequence
  chemically synthesized
cctgttactgtagattgcac

SEQ ID NO: 199177 - DNA, 20 bp, Artificial Sequence
  chemically synthesized
gtagattgcactggttcatc

SEQ ID NO: 199178 - DNA, 20 bp, Artificial Sequence
  chemically synthesized
tacctcaggcccagatgaac

SEQ ID NO: 199179 - DNA, 20 bp, Artificial Sequence
  chemically synthesized
tagattgcactggttcatct

SEQ ID NO: 199180 - DNA, 20 bp, Artificial Sequence
  chemically synthesized
gcactggttcatctgggcct

SEQ ID NO: 199181 - DNA, 20 bp, Artificial Sequence
  chemically synthesized
cactggttcatctgggcctg

SEQ ID NO: 199182 - DNA, 20 bp, Artificial Sequence
  chemically synthesized
taaagcatatacctcaggcc

SEQ ID NO: 199183 - DNA, 20 bp, Artificial Sequence
  chemically synthesized
aggaataaagcatatacctc

SEQ ID NO: 199184 - DNA, 20 bp, Artificial Sequence
  chemically synthesized
taggaataaagcatatacct

SEQ ID NO: 199185 - DNA, 20 bp, Artificial Sequence
  chemically synthesized
tgaggtatatgctttattcc

SEQ ID NO: 199186 - DNA, 20 bp, Artificial Sequence
  chemically synthesized
atggtattgctctaggaata

SEQ ID NO: 199187 - DNA, 20 bp, Artificial Sequence
  chemically synthesized
aggtatatgctttattccta

SEQ ID NO: 199188 - DNA, 20 bp, Artificial Sequence
  chemically synthesized
agcgcaaatggtattgctct

SEQ ID NO: 199189 - DNA, 20 bp, Artificial Sequence
  chemically synthesized
gagcgcaaatggtattgctc

SEQ ID NO: 199190 - DNA, 20 bp, Artificial Sequence
  chemically synthesized
actctcctctggagcgcaaa

SEQ ID NO: 199191 - DNA, 20 bp, Artificial Sequence
  chemically synthesized
gagcaataccatttgcgctc

SEQ ID NO: 199192 - DNA, 20 bp, Artificial Sequence
  chemically synthesized
gcaataccatttgcgctcca

SEQ ID NO: 199193 - DNA, 20 bp, Artificial Sequence
  chemically synthesized
caataccatttgcgctccag

SEQ ID NO: 199194 - DNA, 20 bp, Artificial Sequence
  chemically synthesized
ataccatttgcgctccagag

SEQ ID NO: 199195 - DNA, 20 bp, Artificial Sequence
  chemically synthesized
accatttgcgctccagagga

SEQ ID NO: 199196 - DNA, 20 bp, Artificial Sequence
  chemically synthesized
gtggtaagaactctcctctg

SEQ ID NO: 199197 - DNA, 20 bp, Artificial Sequence
  chemically synthesized
cggtggtaagaactctcctc

SEQ ID NO: 199198 - DNA, 20 bp, Artificial Sequence
  chemically synthesized
atgtggatttttgcggtggt

SEQ ID NO: 199199 - DNA, 20 bp, Artificial Sequence
  chemically synthesized
gaatatgtggatttttgcgg

SEQ ID NO: 199200 - DNA, 20 bp, Artificial Sequence
  chemically synthesized
ggtgaatatgtggatttttg

SEQ ID NO: 199201 - DNA, 20 bp, Artificial Sequence
  chemically synthesized
agattcccttggtgaatatg

SEQ ID NO: 199202 - DNA, 20 bp, Artificial Sequence
  chemically synthesized
caaaaatccacatattcacc

SEQ ID NO: 199203 - DNA, 20 bp, Artificial Sequence
  chemically synthesized
aaaaatccacatattcacca

SEQ ID NO: 199204 - DNA, 20 bp, Artificial Sequence
  chemically synthesized
aaaatccacatattcaccaa

SEQ ID NO: 199205 - DNA, 20 bp, Artificial Sequence
  chemically synthesized
ctgtgtgagagagattccct

SEQ ID NO: 199206 - DNA, 20 bp, Artificial Sequence
  chemically synthesized
ccaagggaatctctctcaca

SEQ ID NO: 199207 - DNA, 20 bp, Artificial Sequence
  chemically synthesized
actatattgactgtgtgaga

SEQ ID NO: 199208 - DNA, 20 bp, Artificial Sequence
  chemically synthesized
aaactatattgactgtgtga

SEQ ID NO: 199209 - DNA, 20 bp, Artificial Sequence
  chemically synthesized
ctaaactatattgactgtgt

SEQ ID NO: 199210 - DNA, 20 bp, Artificial Sequence
  chemically synthesized
tctctctcacacagtcaata

SEQ ID NO: 199211 - DNA, 20 bp, Artificial Sequence
  chemically synthesized
ctcacacagtcaatatagtt

SEQ ID NO: 199212 - DNA, 20 bp, Artificial Sequence
  chemically synthesized
gaactgcttaatttattttt

SEQ ID NO: 199213 - DNA, 20 bp, Artificial Sequence
  chemically synthesized
taatgtctcaaaaataaatt

SEQ ID NO: 199214 - DNA, 20 bp, Artificial Sequence
  chemically synthesized
tgtctcaaaaataaattaag

SEQ ID NO: 199215 - DNA, 20 bp, Artificial Sequence
  chemically synthesized
aatactgtctacaaatatgt

SEQ ID NO: 199216 - DNA, 20 bp, Artificial Sequence
  chemically synthesized
aagcagttctcacatatttg

SEQ ID NO: 199217 - DNA, 20 bp, Artificial Sequence
  chemically synthesized
agttctcacatatttgtaga

SEQ ID NO: 199218 - DNA, 20 bp, Artificial Sequence
  chemically synthesized
tcgttatttcatttagtagt

SEQ ID NO: 199219 - DNA, 20 bp, Artificial Sequence
  chemically synthesized
actttcgttatttcatttag

SEQ ID NO: 199220 - DNA, 20 bp, Artificial Sequence
  chemically synthesized
tttactttcgttatttcatt

SEQ ID NO: 199221 - DNA, 20 bp, Artificial Sequence
  chemically synthesized
actactaaatgaaataacga

SEQ ID NO: 199222 - DNA, 20 bp, Artificial Sequence
  chemically synthesized
aatgaaataacgaaagtaaa

SEQ ID NO: 199223 - DNA, 20 bp, Artificial Sequence
  chemically synthesized
gaaataacgaaagtaaaaag

SEQ ID NO: 199224 - DNA, 20 bp, Artificial Sequence
  chemically synthesized
aaataacgaaagtaaaaaga

SEQ ID NO: 199225 - DNA, 20 bp, Artificial Sequence
  chemically synthesized
cgaaagtaaaaagaaggcaa

SEQ ID NO: 199226 - DNA, 20 bp, Artificial Sequence
  chemically synthesized
aagtaaaaagaaggcaaaag

SEQ ID NO: 199227 - DNA, 20 bp, Artificial Sequence
  chemically synthesized
caaaagaagaaatactcttt

SEQ ID NO: 199228 - DNA, 20 bp, Artificial Sequence
  chemically synthesized
actacatgagattgcttaaa

SEQ ID NO: 199229 - DNA, 20 bp, Artificial Sequence
  chemically synthesized
ttactacatgagattgctta

SEQ ID NO: 199230 - DNA, 20 bp, Artificial Sequence
  chemically synthesized
actctttaagcaatctcatg

SEQ ID NO: 199231 - DNA, 20 bp, Artificial Sequence
  chemically synthesized
gtgaatgaatattactacat

SEQ ID NO: 199232 - DNA, 20 bp, Artificial Sequence
  chemically synthesized
ttcattcacgtaatcattcc

SEQ ID NO: 199233 - DNA, 20 bp, Artificial Sequence
  chemically synthesized
atttcaaacagaaatatgcc

SEQ ID NO: 199234 - DNA, 20 bp, Artificial Sequence
  chemically synthesized
aatttcaaacagaaatatgc

SEQ ID NO: 199235 - DNA, 20 bp, Artificial Sequence
  chemically synthesized
gtagatgactgaatttcaaa

SEQ ID NO: 199236 - DNA, 20 bp, Artificial Sequence
  chemically synthesized
gcatatttctgtttgaaatt

SEQ ID NO: 199237 - DNA, 20 bp, Artificial Sequence
  chemically synthesized
ttgaaattcagtcatctaca

SEQ ID NO: 199238 - DNA, 20 bp, Artificial Sequence
  chemically synthesized
ccccttccgctgtttccatg

SEQ ID NO: 199239 - DNA, 20 bp, Artificial Sequence
  chemically synthesized
ttcagtcatctacatggaaa

SEQ ID NO: 199240 - DNA, 20 bp, Artificial Sequence
  chemically synthesized
agtcatctacatggaaacag

SEQ ID NO: 199241 - DNA, 20 bp, Artificial Sequence
  chemically synthesized
catctacatggaaacagcgg

SEQ ID NO: 199242 - DNA, 20 bp, Artificial Sequence
  chemically synthesized
atctacatggaaacagcgga

SEQ ID NO: 199243 - DNA, 20 bp, Artificial Sequence
  chemically synthesized
tctacatggaaacagcggaa

SEQ ID NO: 199244 - DNA, 20 bp, Artificial Sequence
  chemically synthesized
ctacatggaaacagcggaag

SEQ ID NO: 199245 - DNA, 20 bp, Artificial Sequence
  chemically synthesized
acatggaaacagcggaaggg

SEQ ID NO: 199246 - DNA, 20 bp, Artificial Sequence
  chemically synthesized
gaaacagcggaaggggagct

SEQ ID NO: 199247 - DNA, 20 bp, Artificial Sequence
  chemically synthesized
aaacagcggaaggggagctc

SEQ ID NO: 199248 - DNA, 20 bp, Artificial Sequence
  chemically synthesized
tattaatggcatattgtcct

SEQ ID NO: 199249 - DNA, 20 bp, Artificial Sequence
  chemically synthesized
gattgtgtatgaaatattaa

SEQ ID NO: 199250 - DNA, 20 bp, Artificial Sequence
  chemically synthesized
atgaattgtttagtgttaaa

SEQ ID NO: 199251 - DNA, 20 bp, Artificial Sequence
  chemically synthesized
tcctataaaaatgaattgtt

SEQ ID NO: 199252 - DNA, 20 bp, Artificial Sequence
  chemically synthesized
cactaaacaattcattttta

SEQ ID NO: 199253 - DNA, 20 bp, Artificial Sequence
  chemically synthesized
actaaacaattcatttttat

SEQ ID NO: 199254 - DNA, 20 bp, Artificial Sequence
  chemically synthesized
taaacaattcatttttatag

SEQ ID NO: 199255 - DNA, 20 bp, Artificial Sequence
  chemically synthesized
catttgaatttgtgggagat

SEQ ID NO: 199256 - DNA, 20 bp, Artificial Sequence
  chemically synthesized
acaaacatttgaatttgtgg

SEQ ID NO: 199257 - DNA, 20 bp, Artificial Sequence
  chemically synthesized
agacaaacatttgaatttgt

SEQ ID NO: 199258 - DNA, 20 bp, Artificial Sequence
  chemically synthesized
aagacaaacatttgaatttg

SEQ ID NO: 199259 - DNA, 20 bp, Artificial Sequence
  chemically synthesized
tttaaatatgaaaaattagc

SEQ ID NO: 199260 - DNA, 20 bp, Artificial Sequence
  chemically synthesized
aaattttaaatatgaaaaat

SEQ ID NO: 199261 - DNA, 20 bp, Artificial Sequence
  chemically synthesized
catatttaaaatttgctttt

SEQ ID NO: 199262 - DNA, 20 bp, Artificial Sequence
  chemically synthesized
tttaaaatttgcttttcagc

SEQ ID NO: 199263 - DNA, 20 bp, Artificial Sequence
  chemically synthesized
gtgaatgaatgctagctgaa

SEQ ID NO: 199264 - DNA, 20 bp, Artificial Sequence
  chemically synthesized
accttttagtgaatgaatgc

SEQ ID NO: 199265 - DNA, 20 bp, Artificial Sequence
  chemically synthesized
agctagcattcattcactaa

SEQ ID NO: 199266 - DNA, 20 bp, Artificial Sequence
  chemically synthesized
gctagcattcattcactaaa

SEQ ID NO: 199267 - DNA, 20 bp, Artificial Sequence
  chemically synthesized
ttaggtgtacaaagaccttt

SEQ ID NO: 199268 - DNA, 20 bp, Artificial Sequence
  chemically synthesized
ctcgaagtattaggtgtaca

SEQ ID NO: 199269 - DNA, 20 bp, Artificial Sequence
  chemically synthesized
gagcttgaactcgaagtatt

SEQ ID NO: 199270 - DNA, 20 bp, Artificial Sequence
  chemically synthesized
ctttgtacacctaatacttc

SEQ ID NO: 199271 - DNA, 20 bp, Artificial Sequence
  chemically synthesized
tgagcttgaactcgaagtat

SEQ ID NO: 199272 - DNA, 20 bp, Artificial Sequence
  chemically synthesized
acacctaatacttcgagttc

SEQ ID NO: 199273 - DNA, 20 bp, Artificial Sequence
  chemically synthesized
tctgcatgagcttgaactcg

SEQ ID NO: 199274 - DNA, 20 bp, Artificial Sequence
  chemically synthesized
acttcgagttcaagctcatg

SEQ ID NO: 199275 - DNA, 20 bp, Artificial Sequence
  chemically synthesized
ataataaaatagttctgcat

SEQ ID NO: 199276 - DNA, 20 bp, Artificial Sequence
  chemically synthesized
cctactagaaaataataaaa

SEQ ID NO: 199277 - DNA, 20 bp, Artificial Sequence
  chemically synthesized
agaactattttattattttc

SEQ ID NO: 199278 - DNA, 20 bp, Artificial Sequence
  chemically synthesized
actattttattattttctag

SEQ ID NO: 199279 - DNA, 20 bp, Artificial Sequence
  chemically synthesized
ctattttattattttctagt

SEQ ID NO: 199280 - DNA, 20 bp, Artificial Sequence
  chemically synthesized
ttttattattttctagtagg

SEQ ID NO: 199281 - DNA, 20 bp, Artificial Sequence
  chemically synthesized
tgtttatctgttcttcctac

SEQ ID NO: 199282 - DNA, 20 bp, Artificial Sequence
  chemically synthesized
ttattttctagtaggaagaa

SEQ ID NO: 199283 - DNA, 20 bp, Artificial Sequence
  chemically synthesized
taaacatttcgttgcaaatg

SEQ ID NO: 199284 - DNA, 20 bp, Artificial Sequence
  chemically synthesized
acatttcgttgcaaatgtgg

SEQ ID NO: 199285 - DNA, 20 bp, Artificial Sequence
  chemically synthesized
atttcgttgcaaatgtggta

SEQ ID NO: 199286 - DNA, 20 bp, Artificial Sequence
  chemically synthesized
gataatattggcgttaaaaa

SEQ ID NO: 199287 - DNA, 20 bp, Artificial Sequence
  chemically synthesized
gcattgaacacagataatat

SEQ ID NO: 199288 - DNA, 20 bp, Artificial Sequence
  chemically synthesized
aagagataatgcattgaaca

SEQ ID NO: 199289 - DNA, 20 bp, Artificial Sequence
  chemically synthesized
ttcaatgcattatctcttat

SEQ ID NO: 199290 - DNA, 20 bp, Artificial Sequence
  chemically synthesized
caaaaatatgtagctcataa

SEQ ID NO: 199291 - DNA, 20 bp, Artificial Sequence
  chemically synthesized
cccaaaaatatgtagctcat

SEQ ID NO: 199292 - DNA, 20 bp, Artificial Sequence
  chemically synthesized
taatcccccccaaaaatatg

SEQ ID NO: 199293 - DNA, 20 bp, Artificial Sequence
  chemically synthesized
tcttatgagctacatatttt

SEQ ID NO: 199294 - DNA, 20 bp, Artificial Sequence
  chemically synthesized
cttatgagctacatattttt

SEQ ID NO: 199295 - DNA, 20 bp, Artificial Sequence
  chemically synthesized
ttatgagctacatatttttg

SEQ ID NO: 199296 - DNA, 20 bp, Artificial Sequence
  chemically synthesized
tatgagctacatatttttgg

SEQ ID NO: 199297 - DNA, 20 bp, Artificial Sequence
  chemically synthesized
atgagctacatatttttggg

SEQ ID NO: 199298 - DNA, 20 bp, Artificial Sequence
  chemically synthesized
tgagctacatatttttgggg

SEQ ID NO: 199299 - DNA, 20 bp, Artificial Sequence
  chemically synthesized
ttgggggggattatattttt

SEQ ID NO: 199300 - DNA, 20 bp, Artificial Sequence
  chemically synthesized
attttttagatgtacctatt

SEQ ID NO: 199301 - DNA, 20 bp, Artificial Sequence
  chemically synthesized
acctaattggaacactaaat

SEQ ID NO: 199302 - DNA, 20 bp, Artificial Sequence
  chemically synthesized
aacctaattggaacactaaa

SEQ ID NO: 199303 - DNA, 20 bp, Artificial Sequence
  chemically synthesized
tacctatttagtgttccaat

SEQ ID NO: 199304 - DNA, 20 bp, Artificial Sequence
  chemically synthesized
acctatttagtgttccaatt

SEQ ID NO: 199305 - DNA, 20 bp, Artificial Sequence
  chemically synthesized
tcggtcagcattaacctaat

SEQ ID NO: 199306 - DNA, 20 bp, Artificial Sequence
  chemically synthesized
attaggttaatgctgaccga

SEQ ID NO: 199307 - DNA, 20 bp, Artificial Sequence
  chemically synthesized
gttgtataaaatctttcggt

SEQ ID NO: 199308 - DNA, 20 bp, Artificial Sequence
  chemically synthesized
tttagttgtataaaatcttt

SEQ ID NO: 199309 - DNA, 20 bp, Artificial Sequence
  chemically synthesized
caatcaatttaattttattt

SEQ ID NO: 199310 - DNA, 20 bp, Artificial Sequence
  chemically synthesized
aaataaaattaaattgattg

SEQ ID NO: 199311 - DNA, 20 bp, Artificial Sequence
  chemically synthesized
tatttgaaacaatacttcat

SEQ ID NO: 199312 - DNA, 20 bp, Artificial Sequence
  chemically synthesized
ctaaaatcatatcacttatg

SEQ ID NO: 199313 - DNA, 20 bp, Artificial Sequence
  chemically synthesized
cttcataagtgatatgattt

SEQ ID NO: 199314 - DNA, 20 bp, Artificial Sequence
  chemically synthesized
atgaaaatgtgaaatggaga

SEQ ID NO: 199315 - DNA, 20 bp, Artificial Sequence
  chemically synthesized
aaaaatgaaaatgtgaaatg

SEQ ID NO: 199316 - DNA, 20 bp, Artificial Sequence
  chemically synthesized
ctaaaaatgaaaatgtgaaa

SEQ ID NO: 199317 - DNA, 20 bp, Artificial Sequence
  chemically synthesized
ccatttcacattttcatttt

SEQ ID NO: 199318 - DNA, 20 bp, Artificial Sequence
  chemically synthesized
atttcacattttcattttta

SEQ ID NO: 199319 - DNA, 20 bp, Artificial Sequence
  chemically synthesized
tcagtgactaaataacaata

SEQ ID NO: 199320 - DNA, 20 bp, Artificial Sequence
  chemically synthesized
tagagtactttattgttatt

SEQ ID NO: 199321 - DNA, 20 bp, Artificial Sequence
  chemically synthesized
cgagggatgtggaaaagatt

SEQ ID NO: 199322 - DNA, 20 bp, Artificial Sequence
  chemically synthesized
aacttacgagggatgtggaa

SEQ ID NO: 199323 - DNA, 20 bp, Artificial Sequence
  chemically synthesized
gattgaacttacgagggatg

SEQ ID NO: 199324 - DNA, 20 bp, Artificial Sequence
  chemically synthesized
atcttttccacatccctcgt

SEQ ID NO: 199325 - DNA, 20 bp, Artificial Sequence
  chemically synthesized
attccagattgaacttacga

SEQ ID NO: 199326 - DNA, 20 bp, Artificial Sequence
  chemically synthesized
cattccagattgaacttacg

SEQ ID NO: 199327 - DNA, 20 bp, Artificial Sequence
  chemically synthesized
acattccagattgaacttac

SEQ ID NO: 199328 - DNA, 20 bp, Artificial Sequence
  chemically synthesized
catccctcgtaagttcaatc

SEQ ID NO: 199329 - DNA, 20 bp, Artificial Sequence
  chemically synthesized
aatcactagcatatacattc

SEQ ID NO: 199330 - DNA, 20 bp, Artificial Sequence
  chemically synthesized
tcaatctggaatgtatatgc

SEQ ID NO: 199331 - DNA, 20 bp, Artificial Sequence
  chemically synthesized
ttacatgtttaacaaatcac

SEQ ID NO: 199332 - DNA, 20 bp, Artificial Sequence
  chemically synthesized
ttgttaaacatgtaaaatta

SEQ ID NO: 199333 - DNA, 20 bp, Artificial Sequence
  chemically synthesized
aatgtgtatatatttattta

SEQ ID NO: 199334 - DNA, 20 bp, Artificial Sequence
  chemically synthesized
ttatttatagtgatatataa

SEQ ID NO: 199335 - DNA, 20 bp, Artificial Sequence
  chemically synthesized
atataacagttgtatgtata

SEQ ID NO: 199336 - DNA, 20 bp, Artificial Sequence
  chemically synthesized
tataacagttgtatgtatat

SEQ ID NO: 199337 - DNA, 20 bp, Artificial Sequence
  chemically synthesized
ataacagttgtatgtatatg

SEQ ID NO: 199338 - DNA, 20 bp, Artificial Sequence
  chemically synthesized
taacagttgtatgtatatgg

SEQ ID NO: 199339 - DNA, 20 bp, Artificial Sequence
  chemically synthesized
aagtatcaaaatatcacatg

SEQ ID NO: 199340 - DNA, 20 bp, Artificial Sequence
  chemically synthesized
tgtgatattttgatactttt

SEQ ID NO: 199341 - DNA, 20 bp, Artificial Sequence
  chemically synthesized
tgatcattgagcaatctaaa

SEQ ID NO: 199342 - DNA, 20 bp, Artificial Sequence
  chemically synthesized
attaccctgatttgatcatt

SEQ ID NO: 199343 - DNA, 20 bp, Artificial Sequence
  chemically synthesized
agattgctcaatgatcaaat

SEQ ID NO: 199344 - DNA, 20 bp, Artificial Sequence
  chemically synthesized
gattgctcaatgatcaaatc

SEQ ID NO: 199345 - DNA, 20 bp, Artificial Sequence
  chemically synthesized
attgctcaatgatcaaatca

SEQ ID NO: 199346 - DNA, 20 bp, Artificial Sequence
  chemically synthesized
atgatcaaatcagggtaatt

SEQ ID NO: 199347 - DNA, 20 bp, Artificial Sequence
  chemically synthesized
cttcttacaaaataaaaaat

SEQ ID NO: 199348 - DNA, 20 bp, Artificial Sequence
  chemically synthesized
atgctgattttttattttgt

SEQ ID NO: 199349 - DNA, 20 bp, Artificial Sequence
  chemically synthesized
ctgattttttattttgtaag

SEQ ID NO: 199350 - DNA, 20 bp, Artificial Sequence
  chemically synthesized
ttttattttgtaagaagtaa

SEQ ID NO: 199351 - DNA, 20 bp, Artificial Sequence
  chemically synthesized
tttgtaagaagtaacagaaa

SEQ ID NO: 199352 - DNA, 20 bp, Artificial Sequence
  chemically synthesized
ttgtaagaagtaacagaaat

SEQ ID NO: 199353 - DNA, 20 bp, Artificial Sequence
  chemically synthesized
agaagtaacagaaatgggaa

SEQ ID NO: 199354 - DNA, 20 bp, Artificial Sequence
  chemically synthesized
agtaacagaaatgggaaaag

SEQ ID NO: 199355 - DNA, 20 bp, Artificial Sequence
  chemically synthesized
gaaatgggaaaagaagcaca

SEQ ID NO: 199356 - DNA, 20 bp, Artificial Sequence
  chemically synthesized
tgggaaaagaagcacatgga

SEQ ID NO: 199357 - DNA, 20 bp, Artificial Sequence
  chemically synthesized
agaagcacatggaaagcgct

SEQ ID NO: 199358 - DNA, 20 bp, Artificial Sequence
  chemically synthesized
cactcaagtagtttacatct

SEQ ID NO: 199359 - DNA, 20 bp, Artificial Sequence
  chemically synthesized
cgcttagatgtaaactactt

SEQ ID NO: 199360 - DNA, 20 bp, Artificial Sequence
  chemically synthesized
cagaggcagtgacactcaag

SEQ ID NO: 199361 - DNA, 20 bp, Artificial Sequence
  chemically synthesized
acccagaggcagtgacactc

SEQ ID NO: 199362 - DNA, 20 bp, Artificial Sequence
  chemically synthesized
tacttgagtgtcactgcctc

SEQ ID NO: 199363 - DNA, 20 bp, Artificial Sequence
  chemically synthesized
acttgagtgtcactgcctct

SEQ ID NO: 199364 - DNA, 20 bp, Artificial Sequence
  chemically synthesized
aaattgggctaacccagagg

SEQ ID NO: 199365 - DNA, 20 bp, Artificial Sequence
  chemically synthesized
gagtgtcactgcctctgggt

SEQ ID NO: 199366 - DNA, 20 bp, Artificial Sequence
  chemically synthesized
cctaaattgggctaacccag

SEQ ID NO: 199367 - DNA, 20 bp, Artificial Sequence
  chemically synthesized
gcctaaattgggctaaccca

SEQ ID NO: 199368 - DNA, 20 bp, Artificial Sequence
  chemically synthesized
tggcctaaattgggctaacc

SEQ ID NO: 199369 - DNA, 20 bp, Artificial Sequence
  chemically synthesized
gcctctgggttagcccaatt

SEQ ID NO: 199370 - DNA, 20 bp, Artificial Sequence
  chemically synthesized
cctctgggttagcccaattt

SEQ ID NO: 199371 - DNA, 20 bp, Artificial Sequence
  chemically synthesized
atgtgtagatggcctaaatt

SEQ ID NO: 199372 - DNA, 20 bp, Artificial Sequence
  chemically synthesized
tatgtgtagatggcctaaat

SEQ ID NO: 199373 - DNA, 20 bp, Artificial Sequence
  chemically synthesized
atcgagcttttatgtgtaga

SEQ ID NO: 199374 - DNA, 20 bp, Artificial Sequence
  chemically synthesized
tttaggccatctacacataa

SEQ ID NO: 199375 - DNA, 20 bp, Artificial Sequence
  chemically synthesized
ccacatcgagcttttatgtg

SEQ ID NO: 199376 - DNA, 20 bp, Artificial Sequence
  chemically synthesized
ctacacataaaagctcgatg

SEQ ID NO: 199377 - DNA, 20 bp, Artificial Sequence
  chemically synthesized
ttttctgaaataaccacatc

SEQ ID NO: 199378 - DNA, 20 bp, Artificial Sequence
  chemically synthesized
aaagctcgatgtggttattt

SEQ ID NO: 199379 - DNA, 20 bp, Artificial Sequence
  chemically synthesized
gttatttcagaaaaaaaatt

SEQ ID NO: 199380 - DNA, 20 bp, Artificial Sequence
  chemically synthesized
aaaaaaatttagaccttaac

SEQ ID NO: 199381 - DNA, 20 bp, Artificial Sequence
  chemically synthesized
aaaatttagaccttaacaag

SEQ ID NO: 199382 - DNA, 20 bp, Artificial Sequence
  chemically synthesized
ggcaaggaccctacttgtta

SEQ ID NO: 199383 - DNA, 20 bp, Artificial Sequence
  chemically synthesized
aaatttagaccttaacaagt

SEQ ID NO: 199384 - DNA, 20 bp, Artificial Sequence
  chemically synthesized
gggcaaggaccctacttgtt

SEQ ID NO: 199385 - DNA, 20 bp, Artificial Sequence
  chemically synthesized
aatttagaccttaacaagta

SEQ ID NO: 199386 - DNA, 20 bp, Artificial Sequence
  chemically synthesized
acaagtagggtccttgccct

SEQ ID NO: 199387 - DNA, 20 bp, Artificial Sequence
  chemically synthesized
caagtagggtccttgccctt

SEQ ID NO: 199388 - DNA, 20 bp, Artificial Sequence
  chemically synthesized
aagcatggggcccaagggca

SEQ ID NO: 199389 - DNA, 20 bp, Artificial Sequence
  chemically synthesized
aaagcatggggcccaagggc

SEQ ID NO: 199390 - DNA, 20 bp, Artificial Sequence
  chemically synthesized
tttgaaagcatggggcccaa

SEQ ID NO: 199391 - DNA, 20 bp, Artificial Sequence
  chemically synthesized
ctttgaaagcatggggccca

SEQ ID NO: 199392 - DNA, 20 bp, Artificial Sequence
  chemically synthesized
cctttgaaagcatggggccc

SEQ ID NO: 199393 - DNA, 20 bp, Artificial Sequence
  chemically synthesized
gctttgcctttgaaagcatg

SEQ ID NO: 199394 - DNA, 20 bp, Artificial Sequence
  chemically synthesized
agctttgcctttgaaagcat

SEQ ID NO: 199395 - DNA, 20 bp, Artificial Sequence
  chemically synthesized
gagctttgcctttgaaagca

SEQ ID NO: 199396 - DNA, 20 bp, Artificial Sequence
  chemically synthesized
ccttgggccccatgctttca

SEQ ID NO: 199397 - DNA, 20 bp, Artificial Sequence
  chemically synthesized
cttgggccccatgctttcaa

SEQ ID NO: 199398 - DNA, 20 bp, Artificial Sequence
  chemically synthesized
aatcagagctttgcctttga

SEQ ID NO: 199399 - DNA, 20 bp, Artificial Sequence
  chemically synthesized
gccccatgctttcaaaggca

SEQ ID NO: 199400 - DNA, 20 bp, Artificial Sequence
  chemically synthesized
ttcaaaggcaaagctctgat

SEQ ID NO: 199401 - DNA, 20 bp, Artificial Sequence
  chemically synthesized
tcaaaggcaaagctctgatt

SEQ ID NO: 199402 - DNA, 20 bp, Artificial Sequence
  chemically synthesized
aaaggcaaagctctgattag

SEQ ID NO: 199403 - DNA, 20 bp, Artificial Sequence
  chemically synthesized
gtcctacagactcctaatca

SEQ ID NO: 199404 - DNA, 20 bp, Artificial Sequence
  chemically synthesized
tggtcctacagactcctaat

SEQ ID NO: 199405 - DNA, 20 bp, Artificial Sequence
  chemically synthesized
aagctctgattaggagtctg

SEQ ID NO: 199406 - DNA, 20 bp, Artificial Sequence
  chemically synthesized
agctctgattaggagtctgt

SEQ ID NO: 199407 - DNA, 20 bp, Artificial Sequence
  chemically synthesized
gattaggagtctgtaggacc

SEQ ID NO: 199408 - DNA, 20 bp, Artificial Sequence
  chemically synthesized
agcatgttggcttggtccta

SEQ ID NO: 199409 - DNA, 20 bp, Artificial Sequence
  chemically synthesized
ttctagtgagcatgttggct

SEQ ID NO: 199410 - DNA, 20 bp, Artificial Sequence
  chemically synthesized
ggggcttctagtgagcatgt

SEQ ID NO: 199411 - DNA, 20 bp, Artificial Sequence
  chemically synthesized
gaccaagccaacatgctcac

SEQ ID NO: 199412 - DNA, 20 bp, Artificial Sequence
  chemically synthesized
caagccaacatgctcactag

SEQ ID NO: 199413 - DNA, 20 bp, Artificial Sequence
  chemically synthesized
atgggagcggggcttctagt

SEQ ID NO: 199414 - DNA, 20 bp, Artificial Sequence
  chemically synthesized
gatcatgggagcggggcttc

SEQ ID NO: 199415 - DNA, 20 bp, Artificial Sequence
  chemically synthesized
aatgccagatcatgggagcg

SEQ ID NO: 199416 - DNA, 20 bp, Artificial Sequence
  chemically synthesized
gaatgccagatcatgggagc

SEQ ID NO: 199417 - DNA, 20 bp, Artificial Sequence
  chemically synthesized
tgaatgccagatcatgggag

SEQ ID NO: 199418 - DNA, 20 bp, Artificial Sequence
  chemically synthesized
ttctgaatgccagatcatgg

SEQ ID NO: 199419 - DNA, 20 bp, Artificial Sequence
  chemically synthesized
gaagccccgctcccatgatc

SEQ ID NO: 199420 - DNA, 20 bp, Artificial Sequence
  chemically synthesized
gattctgaatgccagatcat

SEQ ID NO: 199421 - DNA, 20 bp, Artificial Sequence
  chemically synthesized
ggattctgaatgccagatca

SEQ ID NO: 199422 - DNA, 20 bp, Artificial Sequence
  chemically synthesized
cgctcccatgatctggcatt

SEQ ID NO: 199423 - DNA, 20 bp, Artificial Sequence
  chemically synthesized
agttgagggattctgaatgc

SEQ ID NO: 199424 - DNA, 20 bp, Artificial Sequence
  chemically synthesized
acatttgcccagggagttga

SEQ ID NO: 199425 - DNA, 20 bp, Artificial Sequence
  chemically synthesized
aacatttgcccagggagttg

SEQ ID NO: 199426 - DNA, 20 bp, Artificial Sequence
  chemically synthesized
ttcagaatccctcaactccc

SEQ ID NO: 199427 - DNA, 20 bp, Artificial Sequence
  chemically synthesized
aaacatttgcccagggagtt

SEQ ID NO: 199428 - DNA, 20 bp, Artificial Sequence
  chemically synthesized
tcagaatccctcaactccct

SEQ ID NO: 199429 - DNA, 20 bp, Artificial Sequence
  chemically synthesized
ctttgaaacatttgcccagg

SEQ ID NO: 199430 - DNA, 20 bp, Artificial Sequence
  chemically synthesized
gactttgaaacatttgccca

SEQ ID NO: 199431 - DNA, 20 bp, Artificial Sequence
  chemically synthesized
tgactttgaaacatttgccc

SEQ ID NO: 199432 - DNA, 20 bp, Artificial Sequence
  chemically synthesized
ctgactttgaaacatttgcc

SEQ ID NO: 199433 - DNA, 20 bp, Artificial Sequence
  chemically synthesized
ctccctgggcaaatgtttca

SEQ ID NO: 199434 - DNA, 20 bp, Artificial Sequence
  chemically synthesized
ctgggcaaatgtttcaaagt

SEQ ID NO: 199435 - DNA, 20 bp, Artificial Sequence
  chemically synthesized
aatgtttcaaagtcagttac

SEQ ID NO: 199436 - DNA, 20 bp, Artificial Sequence
  chemically synthesized
atgtttcaaagtcagttact

SEQ ID NO: 199437 - DNA, 20 bp, Artificial Sequence
  chemically synthesized
tcaaagtcagttactgggta

SEQ ID NO: 199438 - DNA, 20 bp, Artificial Sequence
  chemically synthesized
atttaccccttagccatacc

SEQ ID NO: 199439 - DNA, 20 bp, Artificial Sequence
  chemically synthesized
gtcagttactgggtatggct

SEQ ID NO: 199440 - DNA, 20 bp, Artificial Sequence
  chemically synthesized
tcagttactgggtatggcta

SEQ ID NO: 199441 - DNA, 20 bp, Artificial Sequence
  chemically synthesized
cagttactgggtatggctaa

SEQ ID NO: 199442 - DNA, 20 bp, Artificial Sequence
  chemically synthesized
agttactgggtatggctaag

SEQ ID NO: 199443 - DNA, 20 bp, Artificial Sequence
  chemically synthesized
tcatgcaaagatttacccct

SEQ ID NO: 199444 - DNA, 20 bp, Artificial Sequence
  chemically synthesized
taaggggtaaatctttgcat

SEQ ID NO: 199445 - DNA, 20 bp, Artificial Sequence
  chemically synthesized
aaggggtaaatctttgcatg

SEQ ID NO: 199446 - DNA, 20 bp, Artificial Sequence
  chemically synthesized
tttcccactcacctcatgca

SEQ ID NO: 199447 - DNA, 20 bp, Artificial Sequence
  chemically synthesized
ggtaaatctttgcatgaggt

SEQ ID NO: 199448 - DNA, 20 bp, Artificial Sequence
  chemically synthesized
aaatctttgcatgaggtgag

SEQ ID NO: 199449 - DNA, 20 bp, Artificial Sequence
  chemically synthesized
aatctttgcatgaggtgagt

SEQ ID NO: 199450 - DNA, 20 bp, Artificial Sequence
  chemically synthesized
gtgggaaaaacttgaacatg

SEQ ID NO: 199451 - DNA, 20 bp, Artificial Sequence
  chemically synthesized
catttcccacccacatgttc

SEQ ID NO: 199452 - DNA, 20 bp, Artificial Sequence
  chemically synthesized
tgggaaaaacttgaacatgt

SEQ ID NO: 199453 - DNA, 20 bp, Artificial Sequence
  chemically synthesized
gaaaaacttgaacatgtggg

SEQ ID NO: 199454 - DNA, 20 bp, Artificial Sequence
  chemically synthesized
aaaaacttgaacatgtgggt

SEQ ID NO: 199455 - DNA, 20 bp, Artificial Sequence
  chemically synthesized
ttgaacatgtgggtgggaaa

SEQ ID NO: 199456 - DNA, 20 bp, Artificial Sequence
  chemically synthesized
tgaacatgtgggtgggaaat

SEQ ID NO: 199457 - DNA, 20 bp, Artificial Sequence
  chemically synthesized
gaacatgtgggtgggaaatg

SEQ ID NO: 199458 - DNA, 20 bp, Artificial Sequence
  chemically synthesized
tgggtgggaaatggggcgac

SEQ ID NO: 199459 - DNA, 20 bp, Artificial Sequence
  chemically synthesized
gaactctgtgcacatagatc

SEQ ID NO: 199460 - DNA, 20 bp, Artificial Sequence
  chemically synthesized
ggcgaccagatctatgtgca

SEQ ID NO: 199461 - DNA, 20 bp, Artificial Sequence
  chemically synthesized
tgtgaggaactctgtgcaca

SEQ ID NO: 199462 - DNA, 20 bp, Artificial Sequence
  chemically synthesized
cgaccagatctatgtgcaca

SEQ ID NO: 199463 - DNA, 20 bp, Artificial Sequence
  chemically synthesized
tatgtgcacagagttcctca

SEQ ID NO: 199464 - DNA, 20 bp, Artificial Sequence
  chemically synthesized
gcacagagttcctcacagtg

SEQ ID NO: 199465 - DNA, 20 bp, Artificial Sequence
  chemically synthesized
ttactccatcctgcactgtg

SEQ ID NO: 199466 - DNA, 20 bp, Artificial Sequence
  chemically synthesized
cacagagttcctcacagtgc

SEQ ID NO: 199467 - DNA, 20 bp, Artificial Sequence
  chemically synthesized
tttactccatcctgcactgt

SEQ ID NO: 199468 - DNA, 20 bp, Artificial Sequence
  chemically synthesized
gagttcctcacagtgcagga

SEQ ID NO: 199469 - DNA, 20 bp, Artificial Sequence
  chemically synthesized
gttcctcacagtgcaggatg

SEQ ID NO: 199470 - DNA, 20 bp, Artificial Sequence
  chemically synthesized
tcacagtgcaggatggagta

SEQ ID NO: 199471 - DNA, 20 bp, Artificial Sequence
  chemically synthesized
cacagtgcaggatggagtaa

SEQ ID NO: 199472 - DNA, 20 bp, Artificial Sequence
  chemically synthesized
cagtgcaggatggagtaaag

SEQ ID NO: 199473 - DNA, 20 bp, Artificial Sequence
  chemically synthesized
agtgcaggatggagtaaagg

SEQ ID NO: 199474 - DNA, 20 bp, Artificial Sequence
  chemically synthesized
gcaggatggagtaaaggagg

SEQ ID NO: 199475 - DNA, 20 bp, Artificial Sequence
  chemically synthesized
caggatggagtaaaggaggt

SEQ ID NO: 199476 - DNA, 20 bp, Artificial Sequence
  chemically synthesized
aggatggagtaaaggaggta

SEQ ID NO: 199477 - DNA, 20 bp, Artificial Sequence
  chemically synthesized
agtaaaggaggtagggaaaa

SEQ ID NO: 199478 - DNA, 20 bp, Artificial Sequence
  chemically synthesized
gtaaaggaggtagggaaaaa

SEQ ID NO: 199479 - DNA, 20 bp, Artificial Sequence
  chemically synthesized
gaggtagggaaaaaaggcaa

SEQ ID NO: 199480 - DNA, 20 bp, Artificial Sequence
  chemically synthesized
aaaaggcaacagattcacaa

SEQ ID NO: 199481 - DNA, 20 bp, Artificial Sequence
  chemically synthesized
gcaacagattcacaatagct

SEQ ID NO: 199482 - DNA, 20 bp, Artificial Sequence
  chemically synthesized
gattcacaatagctaagatg

SEQ ID NO: 199483 - DNA, 20 bp, Artificial Sequence
  chemically synthesized
tttaggttgtttctgcatct

SEQ ID NO: 199484 - DNA, 20 bp, Artificial Sequence
  chemically synthesized
tcatctgccaatgggcattt

SEQ ID NO: 199485 - DNA, 20 bp, Artificial Sequence
  chemically synthesized
ttcatctgccaatgggcatt

SEQ ID NO: 199486 - DNA, 20 bp, Artificial Sequence
  chemically synthesized
gaaacaacctaaatgcccat

SEQ ID NO: 199487 - DNA, 20 bp, Artificial Sequence
  chemically synthesized
acaacctaaatgcccattgg

SEQ ID NO: 199488 - DNA, 20 bp, Artificial Sequence
  chemically synthesized
ttatctattcatctgccaat

SEQ ID NO: 199489 - DNA, 20 bp, Artificial Sequence
  chemically synthesized
tttatctattcatctgccaa

SEQ ID NO: 199490 - DNA, 20 bp, Artificial Sequence
  chemically synthesized
aatgcccattggcagatgaa

SEQ ID NO: 199491 - DNA, 20 bp, Artificial Sequence
  chemically synthesized
ggcagatgaatagataaatg

SEQ ID NO: 199492 - DNA, 20 bp, Artificial Sequence
  chemically synthesized
aatgtggtatatatacacaa

SEQ ID NO: 199493 - DNA, 20 bp, Artificial Sequence
  chemically synthesized
atacacaatggaatactatt

SEQ ID NO: 199494 - DNA, 20 bp, Artificial Sequence
  chemically synthesized
ttccttttataaaggctgaa

SEQ ID NO: 199495 - DNA, 20 bp, Artificial Sequence
  chemically synthesized
atactattcagcctttataa

SEQ ID NO: 199496 - DNA, 20 bp, Artificial Sequence
  chemically synthesized
tactattcagcctttataaa

SEQ ID NO: 199497 - DNA, 20 bp, Artificial Sequence
  chemically synthesized
tgcagaatttccttttataa

SEQ ID NO: 199498 - DNA, 20 bp, Artificial Sequence
  chemically synthesized
ttgcagaatttccttttata

SEQ ID NO: 199499 - DNA, 20 bp, Artificial Sequence
  chemically synthesized
atccatattgtttcatattg

SEQ ID NO: 199500 - DNA, 20 bp, Artificial Sequence
  chemically synthesized
ttctgcaatatgaaacaata

SEQ ID NO: 199501 - DNA, 20 bp, Artificial Sequence
  chemically synthesized
gcaatatgaaacaatatgga

SEQ ID NO: 199502 - DNA, 20 bp, Artificial Sequence
  chemically synthesized
aaacaatatggatggacctt

SEQ ID NO: 199503 - DNA, 20 bp, Artificial Sequence
  chemically synthesized
tttcacttagcgtaatctta

SEQ ID NO: 199504 - DNA, 20 bp, Artificial Sequence
  chemically synthesized
gtttcacttagcgtaatctt

SEQ ID NO: 199505 - DNA, 20 bp, Artificial Sequence
  chemically synthesized
atggaccttaagattacgct

SEQ ID NO: 199506 - DNA, 20 bp, Artificial Sequence
  chemically synthesized
tgtgtctgtcttgtttcact

SEQ ID NO: 199507 - DNA, 20 bp, Artificial Sequence
  chemically synthesized
aagattacgctaagtgaaac

SEQ ID NO: 199508 - DNA, 20 bp, Artificial Sequence
  chemically synthesized
ttacgctaagtgaaacaaga

SEQ ID NO: 199509 - DNA, 20 bp, Artificial Sequence
  chemically synthesized
taagtgaaacaagacagaca

SEQ ID NO: 199510 - DNA, 20 bp, Artificial Sequence
  chemically synthesized
ttcaagtaagtggaatcatg

SEQ ID NO: 199511 - DNA, 20 bp, Artificial Sequence
  chemically synthesized
gataccttatttcaagtaag

SEQ ID NO: 199512 - DNA, 20 bp, Artificial Sequence
  chemically synthesized
ttagataccttatttcaagt

SEQ ID NO: 199513 - DNA, 20 bp, Artificial Sequence
  chemically synthesized
tgattccacttacttgaaat

SEQ ID NO: 199514 - DNA, 20 bp, Artificial Sequence
  chemically synthesized
gattccacttacttgaaata

SEQ ID NO: 199515 - DNA, 20 bp, Artificial Sequence
  chemically synthesized
tgttttagataccttatttc

SEQ ID NO: 199516 - DNA, 20 bp, Artificial Sequence
  chemically synthesized
ttgaaataaggtatctaaaa

SEQ ID NO: 199517 - DNA, 20 bp, Artificial Sequence
  chemically synthesized
ttttatgagtttgactgttt

SEQ ID NO: 199518 - DNA, 20 bp, Artificial Sequence
  chemically synthesized
agtccagtctttgattttat

SEQ ID NO: 199519 - DNA, 20 bp, Artificial Sequence
  chemically synthesized
cagtcaaactcataaaatca

SEQ ID NO: 199520 - DNA, 20 bp, Artificial Sequence
  chemically synthesized
aaactcataaaatcaaagac

SEQ ID NO: 199521 - DNA, 20 bp, Artificial Sequence
  chemically synthesized
cataaaatcaaagactggac

SEQ ID NO: 199522 - DNA, 20 bp, Artificial Sequence
  chemically synthesized
aaaatcaaagactggactgg

SEQ ID NO: 199523 - DNA, 20 bp, Artificial Sequence
  chemically synthesized
gcccctggcaaccaccagtc

SEQ ID NO: 199524 - DNA, 20 bp, Artificial Sequence
  chemically synthesized
ccccagcccctggcaaccac

SEQ ID NO: 199525 - DNA, 20 bp, Artificial Sequence
  chemically synthesized
aagactggactggtggttgc

SEQ ID NO: 199526 - DNA, 20 bp, Artificial Sequence
  chemically synthesized
agactggactggtggttgcc

SEQ ID NO: 199527 - DNA, 20 bp, Artificial Sequence
  chemically synthesized
gactggactggtggttgcca

SEQ ID NO: 199528 - DNA, 20 bp, Artificial Sequence
  chemically synthesized
actggactggtggttgccag

SEQ ID NO: 199529 - DNA, 20 bp, Artificial Sequence
  chemically synthesized
gactggtggttgccaggggc

SEQ ID NO: 199530 - DNA, 20 bp, Artificial Sequence
  chemically synthesized
actggtggttgccaggggct

SEQ ID NO: 199531 - DNA, 20 bp, Artificial Sequence
  chemically synthesized
ctggtggttgccaggggctg

SEQ ID NO: 199532 - DNA, 20 bp, Artificial Sequence
  chemically synthesized
ttcgccctatccccagcccc

SEQ ID NO: 199533 - DNA, 20 bp, Artificial Sequence
  chemically synthesized
tggttgccaggggctgggga

SEQ ID NO: 199534 - DNA, 20 bp, Artificial Sequence
  chemically synthesized
ggttgccaggggctggggat

SEQ ID NO: 199535 - DNA, 20 bp, Artificial Sequence
  chemically synthesized
gttgccaggggctggggata

SEQ ID NO: 199536 - DNA, 20 bp, Artificial Sequence
  chemically synthesized
ttcctatttcgccctatccc

SEQ ID NO: 199537 - DNA, 20 bp, Artificial Sequence
  chemically synthesized
gggctggggatagggcgaaa

SEQ ID NO: 199538 - DNA, 20 bp, Artificial Sequence
  chemically synthesized
ggctggggatagggcgaaat

SEQ ID NO: 199539 - DNA, 20 bp, Artificial Sequence
  chemically synthesized
tggggatagggcgaaatagg

SEQ ID NO: 199540 - DNA, 20 bp, Artificial Sequence
  chemically synthesized
aataggaagttactaatcaa

SEQ ID NO: 199541 - DNA, 20 bp, Artificial Sequence
  chemically synthesized
gaaatgtaatgtctgttgat

SEQ ID NO: 199542 - DNA, 20 bp, Artificial Sequence
  chemically synthesized
aatcaacagacattacattt

SEQ ID NO: 199543 - DNA, 20 bp, Artificial Sequence
  chemically synthesized
acagacattacatttcagtt

SEQ ID NO: 199544 - DNA, 20 bp, Artificial Sequence
  chemically synthesized
gacattacatttcagttaag

SEQ ID NO: 199545 - DNA, 20 bp, Artificial Sequence
  chemically synthesized
acattacatttcagttaagt

SEQ ID NO: 199546 - DNA, 20 bp, Artificial Sequence
  chemically synthesized
ttcagttaagtaggatgaat

SEQ ID NO: 199547 - DNA, 20 bp, Artificial Sequence
  chemically synthesized
taagtaggatgaattagctc

SEQ ID NO: 199548 - DNA, 20 bp, Artificial Sequence
  chemically synthesized
agtaggatgaattagctcta

SEQ ID NO: 199549 - DNA, 20 bp, Artificial Sequence
  chemically synthesized
tgttggacagcagatctcta

SEQ ID NO: 199550 - DNA, 20 bp, Artificial Sequence
  chemically synthesized
aatgttggacagcagatctc

SEQ ID NO: 199551 - DNA, 20 bp, Artificial Sequence
  chemically synthesized
ctaggtagaatgttggacag

SEQ ID NO: 199552 - DNA, 20 bp, Artificial Sequence
  chemically synthesized
actctaggtagaatgttgga

SEQ ID NO: 199553 - DNA, 20 bp, Artificial Sequence
  chemically synthesized
attgactctaggtagaatgt

SEQ ID NO: 199554 - DNA, 20 bp, Artificial Sequence
  chemically synthesized
ctgctgtccaacattctacc

SEQ ID NO: 199555 - DNA, 20 bp, Artificial Sequence
  chemically synthesized
gctgtccaacattctaccta

SEQ ID NO: 199556 - DNA, 20 bp, Artificial Sequence
  chemically synthesized
acattattattgactctagg

SEQ ID NO: 199557 - DNA, 20 bp, Artificial Sequence
  chemically synthesized
aatacattattattgactct

SEQ ID NO: 199558 - DNA, 20 bp, Artificial Sequence
  chemically synthesized
caatacattattattgactc

SEQ ID NO: 199559 - DNA, 20 bp, Artificial Sequence
  chemically synthesized
ataataatgtattgtgcatg

SEQ ID NO: 199560 - DNA, 20 bp, Artificial Sequence
  chemically synthesized
ttgtgcatgtagtatttatt

SEQ ID NO: 199561 - DNA, 20 bp, Artificial Sequence
  chemically synthesized
tgtagtatttattaagatga

SEQ ID NO: 199562 - DNA, 20 bp, Artificial Sequence
  chemically synthesized
gtgttaatgacatttaacat

SEQ ID NO: 199563 - DNA, 20 bp, Artificial Sequence
  chemically synthesized
catgttaaatgtcattaaca

SEQ ID NO: 199564 - DNA, 20 bp, Artificial Sequence
  chemically synthesized
aacacagtaaaatttttttt

SEQ ID NO: 199565 - DNA, 20 bp, Artificial Sequence
  chemically synthesized
gtaaaattttttttaagctt

SEQ ID NO: 199566 - DNA, 20 bp, Artificial Sequence
  chemically synthesized
attttttttaagcttaagaa

SEQ ID NO: 199567 - DNA, 20 bp, Artificial Sequence
  chemically synthesized
aggatacattggcttttctt

SEQ ID NO: 199568 - DNA, 20 bp, Artificial Sequence
  chemically synthesized
gcctgttatttaggatacat

SEQ ID NO: 199569 - DNA, 20 bp, Artificial Sequence
  chemically synthesized
agccaatgtatcctaaataa

SEQ ID NO: 199570 - DNA, 20 bp, Artificial Sequence
  chemically synthesized
gccaatgtatcctaaataac

SEQ ID NO: 199571 - DNA, 20 bp, Artificial Sequence
  chemically synthesized
taaccctaagcctgttattt

SEQ ID NO: 199572 - DNA, 20 bp, Artificial Sequence
  chemically synthesized
ctaaccctaagcctgttatt

SEQ ID NO: 199573 - DNA, 20 bp, Artificial Sequence
  chemically synthesized
tgtatcctaaataacaggct

SEQ ID NO: 199574 - DNA, 20 bp, Artificial Sequence
  chemically synthesized
gtatcctaaataacaggctt

SEQ ID NO: 199575 - DNA, 20 bp, Artificial Sequence
  chemically synthesized
tatcctaaataacaggctta

SEQ ID NO: 199576 - DNA, 20 bp, Artificial Sequence
  chemically synthesized
ctaaataacaggcttagggt

SEQ ID NO: 199577 - DNA, 20 bp, Artificial Sequence
  chemically synthesized
gcttggttagagctaaccct

SEQ ID NO: 199578 - DNA, 20 bp, Artificial Sequence
  chemically synthesized
gcttagggttagctctaacc

SEQ ID NO: 199579 - DNA, 20 bp, Artificial Sequence
  chemically synthesized
ggaatgaggcagcttggtta

SEQ ID NO: 199580 - DNA, 20 bp, Artificial Sequence
  chemically synthesized
ctggaatgaggcagcttggt

SEQ ID NO: 199581 - DNA, 20 bp, Artificial Sequence
  chemically synthesized
tgtactggaatgaggcagct

SEQ ID NO: 199582 - DNA, 20 bp, Artificial Sequence
  chemically synthesized
agttttgtactggaatgagg

SEQ ID NO: 199583 - DNA, 20 bp, Artificial Sequence
  chemically synthesized
ctaaccaagctgcctcattc

SEQ ID NO: 199584 - DNA, 20 bp, Artificial Sequence
  chemically synthesized
tagagttttgtactggaatg

SEQ ID NO: 199585 - DNA, 20 bp, Artificial Sequence
  chemically synthesized
ttagagttttgtactggaat

SEQ ID NO: 199586 - DNA, 20 bp, Artificial Sequence
  chemically synthesized
aattccttagagttttgtac

SEQ ID NO: 199587 - DNA, 20 bp, Artificial Sequence
  chemically synthesized
tcattccagtacaaaactct

SEQ ID NO: 199588 - DNA, 20 bp, Artificial Sequence
  chemically synthesized
cattccagtacaaaactcta

SEQ ID NO: 199589 - DNA, 20 bp, Artificial Sequence
  chemically synthesized
acaataaaataaattcctta

SEQ ID NO: 199590 - DNA, 20 bp, Artificial Sequence
  chemically synthesized
atacaataaaataaattcct

SEQ ID NO: 199591 - DNA, 20 bp, Artificial Sequence
  chemically synthesized
ggaatttattttattgtatc

SEQ ID NO: 199592 - DNA, 20 bp, Artificial Sequence
  chemically synthesized
atttattttattgtatcaag

SEQ ID NO: 199593 - DNA, 20 bp, Artificial Sequence
  chemically synthesized
tatcaagtggtttgctattt

SEQ ID NO: 199594 - DNA, 20 bp, Artificial Sequence
  chemically synthesized
gaatttggaaaaaactcaaa

SEQ ID NO: 199595 - DNA, 20 bp, Artificial Sequence
  chemically synthesized
ttattccctggcaaggaatt

SEQ ID NO: 199596 - DNA, 20 bp, Artificial Sequence
  chemically synthesized
gttttttccaaattccttgc

SEQ ID NO: 199597 - DNA, 20 bp, Artificial Sequence
  chemically synthesized
ttttttccaaattccttgcc

SEQ ID NO: 199598 - DNA, 20 bp, Artificial Sequence
  chemically synthesized
tttttccaaattccttgcca

SEQ ID NO: 199599 - DNA, 20 bp, Artificial Sequence
  chemically synthesized
aagcagtttattccctggca

SEQ ID NO: 199600 - DNA, 20 bp, Artificial Sequence
  chemically synthesized
caagcagtttattccctggc

SEQ ID NO: 199601 - DNA, 20 bp, Artificial Sequence
  chemically synthesized
agtgcaagcagtttattccc

SEQ ID NO: 199602 - DNA, 20 bp, Artificial Sequence
  chemically synthesized
gtttttttaaatagtgcaag

SEQ ID NO: 199603 - DNA, 20 bp, Artificial Sequence
  chemically synthesized
cttgtttttttaaatagtgc

SEQ ID NO: 199604 - DNA, 20 bp, Artificial Sequence
  chemically synthesized
gtctgtcttgtttttttaaa

SEQ ID NO: 199605 - DNA, 20 bp, Artificial Sequence
  chemically synthesized
cttgcactatttaaaaaaac

SEQ ID NO: 199606 - DNA, 20 bp, Artificial Sequence
  chemically synthesized
cactatttaaaaaaacaaga

SEQ ID NO: 199607 - DNA, 20 bp, Artificial Sequence
  chemically synthesized
atttaaaaaaacaagacaga

SEQ ID NO: 199608 - DNA, 20 bp, Artificial Sequence
  chemically synthesized
aaaaaaacaagacagacaga

SEQ ID NO: 199609 - DNA, 20 bp, Artificial Sequence
  chemically synthesized
aaacaagacagacagacaga

SEQ ID NO: 199610 - DNA, 20 bp, Artificial Sequence
  chemically synthesized
aagacagacagacagacaga

SEQ ID NO: 199611 - DNA, 20 bp, Artificial Sequence
  chemically synthesized
cagacagacagacagaaaga

SEQ ID NO: 199612 - DNA, 20 bp, Artificial Sequence
  chemically synthesized
cagacagacagaaagaaaga

SEQ ID NO: 199613 - DNA, 20 bp, Artificial Sequence
  chemically synthesized
cagacagaaagaaagaaaga

SEQ ID NO: 199614 - DNA, 20 bp, Artificial Sequence
  chemically synthesized
cagaaagaaagaaagaaaga

SEQ ID NO: 199615 - DNA, 20 bp, Artificial Sequence
  chemically synthesized
aagaaagaaagaaagaaaga

SEQ ID NO: 199616 - DNA, 20 bp, Artificial Sequence
  chemically synthesized
aagaaagaaagaaagaaaga

SEQ ID NO: 199617 - DNA, 20 bp, Artificial Sequence
  chemically synthesized
aagaaagaaagaaagaaaga

SEQ ID NO: 199618 - DNA, 20 bp, Artificial Sequence
  chemically synthesized
aagaaagaaagaaagaaaga

SEQ ID NO: 199619 - DNA, 20 bp, Artificial Sequence
  chemically synthesized
aagaaagaaagaaagaaaga

SEQ ID NO: 199620 - DNA, 20 bp, Artificial Sequence
  chemically synthesized
aagaaagaaagaaagaaaga

SEQ ID NO: 199621 - DNA, 20 bp, Artificial Sequence
  chemically synthesized
aagaaagaaagaaagaaaga

SEQ ID NO: 199622 - DNA, 20 bp, Artificial Sequence
  chemically synthesized
aaagaaagaaagaaagaaag

SEQ ID NO: 199623 - DNA, 20 bp, Artificial Sequence
  chemically synthesized
aaagaaagaaagaaagaaga

SEQ ID NO: 199624 - DNA, 20 bp, Artificial Sequence
  chemically synthesized
aaagaaagaaagaagaaaga

SEQ ID NO: 199625 - DNA, 20 bp, Artificial Sequence
  chemically synthesized
aaagaaagaagaaagaaaga

SEQ ID NO: 199626 - DNA, 20 bp, Artificial Sequence
  chemically synthesized
aaagaagaaagaaagaaaga

SEQ ID NO: 199627 - DNA, 20 bp, Artificial Sequence
  chemically synthesized
aagaagaaagaaagaaagaa

SEQ ID NO: 199628 - DNA, 20 bp, Artificial Sequence
  chemically synthesized
aagaaagaaagaaagaaagg

SEQ ID NO: 199629 - DNA, 20 bp, Artificial Sequence
  chemically synthesized
agaaagaaagaaagaaagga

SEQ ID NO: 199630 - DNA, 20 bp, Artificial Sequence
  chemically synthesized
agaaagaaagaaaggaagga

SEQ ID NO: 199631 - DNA, 20 bp, Artificial Sequence
  chemically synthesized
agaaagaaaggaaggaaaga

SEQ ID NO: 199632 - DNA, 20 bp, Artificial Sequence
  chemically synthesized
agaaaggaaggaaagaaaga

SEQ ID NO: 199633 - DNA, 20 bp, Artificial Sequence
  chemically synthesized
aaaggaaggaaagaaagaaa

SEQ ID NO: 199634 - DNA, 20 bp, Artificial Sequence
  chemically synthesized
gaaggaaagaaagaaagaga

SEQ ID NO: 199635 - DNA, 20 bp, Artificial Sequence
  chemically synthesized
gaaagaaagaaagagaaaga

SEQ ID NO: 199636 - DNA, 20 bp, Artificial Sequence
  chemically synthesized
gaaagaaagagaaagaaaga

SEQ ID NO: 199637 - DNA, 20 bp, Artificial Sequence
  chemically synthesized
agaaagagaaagaaagaaag

SEQ ID NO: 199638 - DNA, 20 bp, Artificial Sequence
  chemically synthesized
agaaagaaagaaagaagaaa

SEQ ID NO: 199639 - DNA, 20 bp, Artificial Sequence
  chemically synthesized
agaaagaagaaaaagaaaat

SEQ ID NO: 199640 - DNA, 20 bp, Artificial Sequence
  chemically synthesized
aaagaagaaaaagaaaatga

SEQ ID NO: 199641 - DNA, 20 bp, Artificial Sequence
  chemically synthesized
agaagaaaaagaaaatgaga

SEQ ID NO: 199642 - DNA, 20 bp, Artificial Sequence
  chemically synthesized
aagaaaaagaaaatgagaga

SEQ ID NO: 199643 - DNA, 20 bp, Artificial Sequence
  chemically synthesized
gaaaaagaaaatgagagaga

SEQ ID NO: 199644 - DNA, 20 bp, Artificial Sequence
  chemically synthesized
atggacatctagattcgatt

SEQ ID NO: 199645 - DNA, 20 bp, Artificial Sequence
  chemically synthesized
agagaattctaaatcgaatc

SEQ ID NO: 199646 - DNA, 20 bp, Artificial Sequence
  chemically synthesized
atcataatgatatggacatc

SEQ ID NO: 199647 - DNA, 20 bp, Artificial Sequence
  chemically synthesized
attatacaatcataatgata

SEQ ID NO: 199648 - DNA, 20 bp, Artificial Sequence
  chemically synthesized
attatgattgtataattgtc

SEQ ID NO: 199649 - DNA, 20 bp, Artificial Sequence
  chemically synthesized
ttatgattgtataattgtca

SEQ ID NO: 199650 - DNA, 20 bp, Artificial Sequence
  chemically synthesized
gattgtataattgtcaagga

SEQ ID NO: 199651 - DNA, 20 bp, Artificial Sequence
  chemically synthesized
tgtataattgtcaaggaaag

SEQ ID NO: 199652 - DNA, 20 bp, Artificial Sequence
  chemically synthesized
taattgtcaaggaaagcaga

SEQ ID NO: 199653 - DNA, 20 bp, Artificial Sequence
  chemically synthesized
aattgtcaaggaaagcagat

SEQ ID NO: 199654 - DNA, 20 bp, Artificial Sequence
  chemically synthesized
agcagataggatatatttaa

SEQ ID NO: 199655 - DNA, 20 bp, Artificial Sequence
  chemically synthesized
tttataaggtataaagtcaa

SEQ ID NO: 199656 - DNA, 20 bp, Artificial Sequence
  chemically synthesized
tttaatatttataaggtata

SEQ ID NO: 199657 - DNA, 20 bp, Artificial Sequence
  chemically synthesized
ccacatatttaatatttata

SEQ ID NO: 199658 - DNA, 20 bp, Artificial Sequence
  chemically synthesized
gccacatatttaatatttat

SEQ ID NO: 199659 - DNA, 20 bp, Artificial Sequence
  chemically synthesized
ccttataaatattaaatatg

SEQ ID NO: 199660 - DNA, 20 bp, Artificial Sequence
  chemically synthesized
aatattaaatatgtggcatg

SEQ ID NO: 199661 - DNA, 20 bp, Artificial Sequence
  chemically synthesized
atattaaatatgtggcatgc

SEQ ID NO: 199662 - DNA, 20 bp, Artificial Sequence
  chemically synthesized
gcctatagtaagtgtgcaaa

SEQ ID NO: 199663 - DNA, 20 bp, Artificial Sequence
  chemically synthesized
aaccatttgcacacttacta

SEQ ID NO: 199664 - DNA, 20 bp, Artificial Sequence
  chemically synthesized
accatttgcacacttactat

SEQ ID NO: 199665 - DNA, 20 bp, Artificial Sequence
  chemically synthesized
acttttgcagggcctatagt

SEQ ID NO: 199666 - DNA, 20 bp, Artificial Sequence
  chemically synthesized
cataacttttgcagggccta

SEQ ID NO: 199667 - DNA, 20 bp, Artificial Sequence
  chemically synthesized
acttactataggccctgcaa

SEQ ID NO: 199668 - DNA, 20 bp, Artificial Sequence
  chemically synthesized
actgccccataacttttgca

SEQ ID NO: 199669 - DNA, 20 bp, Artificial Sequence
  chemically synthesized
aactgccccataacttttgc

SEQ ID NO: 199670 - DNA, 20 bp, Artificial Sequence
  chemically synthesized
gaactgccccataacttttg

SEQ ID NO: 199671 - DNA, 20 bp, Artificial Sequence
  chemically synthesized
tataggccctgcaaaagtta

SEQ ID NO: 199672 - DNA, 20 bp, Artificial Sequence
  chemically synthesized
ataggccctgcaaaagttat

SEQ ID NO: 199673 - DNA, 20 bp, Artificial Sequence
  chemically synthesized
taggccctgcaaaagttatg

SEQ ID NO: 199674 - DNA, 20 bp, Artificial Sequence
  chemically synthesized
gccctgcaaaagttatgggg

SEQ ID NO: 199675 - DNA, 20 bp, Artificial Sequence
  chemically synthesized
tctgcatagtcatatgaggt

SEQ ID NO: 199676 - DNA, 20 bp, Artificial Sequence
  chemically synthesized
gtcttctgcatagtcatatg

SEQ ID NO: 199677 - DNA, 20 bp, Artificial Sequence
  chemically synthesized
agtcttctgcatagtcatat

SEQ ID NO: 199678 - DNA, 20 bp, Artificial Sequence
  chemically synthesized
tctaacctcatatgactatg

SEQ ID NO: 199679 - DNA, 20 bp, Artificial Sequence
  chemically synthesized
aacctcatatgactatgcag

SEQ ID NO: 199680 - DNA, 20 bp, Artificial Sequence
  chemically synthesized
gtatcacatagtcttctgca

SEQ ID NO: 199681 - DNA, 20 bp, Artificial Sequence
  chemically synthesized
atgcagaagactatgtgata

SEQ ID NO: 199682 - DNA, 20 bp, Artificial Sequence
  chemically synthesized
ttttgataatctgtatcaca

SEQ ID NO: 199683 - DNA, 20 bp, Artificial Sequence
  chemically synthesized
tatgtgatacagattatcaa

SEQ ID NO: 199684 - DNA, 20 bp, Artificial Sequence
  chemically synthesized
atgacaattttttaaattcc

SEQ ID NO: 199685 - DNA, 20 bp, Artificial Sequence
  chemically synthesized
aattttttaaattcccagac

SEQ ID NO: 199686 - DNA, 20 bp, Artificial Sequence
  chemically synthesized
attttttaaattcccagacc

SEQ ID NO: 199687 - DNA, 20 bp, Artificial Sequence
  chemically synthesized
tcctcataccatcctggtct

SEQ ID NO: 199688 - DNA, 20 bp, Artificial Sequence
  chemically synthesized
ctcctcataccatcctggtc

SEQ ID NO: 199689 - DNA, 20 bp, Artificial Sequence
  chemically synthesized
tttaaattcccagaccagga

SEQ ID NO: 199690 - DNA, 20 bp, Artificial Sequence
  chemically synthesized
tctcactcctcataccatcc

SEQ ID NO: 199691 - DNA, 20 bp, Artificial Sequence
  chemically synthesized
ttcccagaccaggatggtat

SEQ ID NO: 199692 - DNA, 20 bp, Artificial Sequence
  chemically synthesized
tcccagaccaggatggtatg

SEQ ID NO: 199693 - DNA, 20 bp, Artificial Sequence
  chemically synthesized
ccagaccaggatggtatgag

SEQ ID NO: 199694 - DNA, 20 bp, Artificial Sequence
  chemically synthesized
accaggatggtatgaggagt

SEQ ID NO: 199695 - DNA, 20 bp, Artificial Sequence
  chemically synthesized
aggatggtatgaggagtgag

SEQ ID NO: 199696 - DNA, 20 bp, Artificial Sequence
  chemically synthesized
tgaggagtgagaagcttttt

SEQ ID NO: 199697 - DNA, 20 bp, Artificial Sequence
  chemically synthesized
ctatgcattggtgtctaaaa

SEQ ID NO: 199698 - DNA, 20 bp, Artificial Sequence
  chemically synthesized
cttttttagacaccaatgca

SEQ ID NO: 199699 - DNA, 20 bp, Artificial Sequence
  chemically synthesized
cagctgtaagagctatgcat

SEQ ID NO: 199700 - DNA, 20 bp, Artificial Sequence
  chemically synthesized
acaccaatgcatagctctta

SEQ ID NO: 199701 - DNA, 20 bp, Artificial Sequence
  chemically synthesized
caatgcatagctcttacagc

SEQ ID NO: 199702 - DNA, 20 bp, Artificial Sequence
  chemically synthesized
ggagagcatcccagctgtaa

SEQ ID NO: 199703 - DNA, 20 bp, Artificial Sequence
  chemically synthesized
aatgcatagctcttacagct

SEQ ID NO: 199704 - DNA, 20 bp, Artificial Sequence
  chemically synthesized
tcggagagcatcccagctgt

SEQ ID NO: 199705 - DNA, 20 bp, Artificial Sequence
  chemically synthesized
aatgccttcggagagcatcc

SEQ ID NO: 199706 - DNA, 20 bp, Artificial Sequence
  chemically synthesized
tacagctgggatgctctccg

SEQ ID NO: 199707 - DNA, 20 bp, Artificial Sequence
  chemically synthesized
acagctgggatgctctccga

SEQ ID NO: 199708 - DNA, 20 bp, Artificial Sequence
  chemically synthesized
ggaataataatgccttcgga

SEQ ID NO: 199709 - DNA, 20 bp, Artificial Sequence
  chemically synthesized
aaggaataataatgccttcg

SEQ ID NO: 199710 - DNA, 20 bp, Artificial Sequence
  chemically synthesized
aaaaggaataataatgcctt

SEQ ID NO: 199711 - DNA, 20 bp, Artificial Sequence
  chemically synthesized
cattattattcctttttctt

SEQ ID NO: 199712 - DNA, 20 bp, Artificial Sequence
  chemically synthesized
gcttcattcccttaagaaaa

SEQ ID NO: 199713 - DNA, 20 bp, Artificial Sequence
  chemically synthesized
attattattcctttttctta

SEQ ID NO: 199714 - DNA, 20 bp, Artificial Sequence
  chemically synthesized
ggcttcattcccttaagaaa

SEQ ID NO: 199715 - DNA, 20 bp, Artificial Sequence
  chemically synthesized
ttattattcctttttcttaa

SEQ ID NO: 199716 - DNA, 20 bp, Artificial Sequence
  chemically synthesized
atgtctggcttcattccctt

SEQ ID NO: 199717 - DNA, 20 bp, Artificial Sequence
  chemically synthesized
tcctttttcttaagggaatg

SEQ ID NO: 199718 - DNA, 20 bp, Artificial Sequence
  chemically synthesized
ttttcttaagggaatgaagc

SEQ ID NO: 199719 - DNA, 20 bp, Artificial Sequence
  chemically synthesized
cttataacttgtgttatgtc

SEQ ID NO: 199720 - DNA, 20 bp, Artificial Sequence
  chemically synthesized
aatgaagccagacataacac

SEQ ID NO: 199721 - DNA, 20 bp, Artificial Sequence
  chemically synthesized
ccagacataacacaagttat

SEQ ID NO: 199722 - DNA, 20 bp, Artificial Sequence
  chemically synthesized
taacacaagttataagttac

SEQ ID NO: 199723 - DNA, 20 bp, Artificial Sequence
  chemically synthesized
acaagttataagttacgagt

SEQ ID NO: 199724 - DNA, 20 bp, Artificial Sequence
  chemically synthesized
agttataagttacgagttag

SEQ ID NO: 199725 - DNA, 20 bp, Artificial Sequence
  chemically synthesized
ttttgaatgtgttcaagtca

SEQ ID NO: 199726 - DNA, 20 bp, Artificial Sequence
  chemically synthesized
aaatgcttttgaatgtgttc

SEQ ID NO: 199727 - DNA, 20 bp, Artificial Sequence
  chemically synthesized
catgacttgaacacattcaa

SEQ ID NO: 199728 - DNA, 20 bp, Artificial Sequence
  chemically synthesized
cacattcaaaagcatttccc

SEQ ID NO: 199729 - DNA, 20 bp, Artificial Sequence
  chemically synthesized
cacattagaaatgtatgcca

SEQ ID NO: 199730 - DNA, 20 bp, Artificial Sequence
  chemically synthesized
acacattagaaatgtatgcc

SEQ ID NO: 199731 - DNA, 20 bp, Artificial Sequence
  chemically synthesized
cacacattagaaatgtatgc

SEQ ID NO: 199732 - DNA, 20 bp, Artificial Sequence
  chemically synthesized
atcccaaaagattcacacat

SEQ ID NO: 199733 - DNA, 20 bp, Artificial Sequence
  chemically synthesized
tttctaatgtgtgaatcttt

SEQ ID NO: 199734 - DNA, 20 bp, Artificial Sequence
  chemically synthesized
ttctaatgtgtgaatctttt

SEQ ID NO: 199735 - DNA, 20 bp, Artificial Sequence
  chemically synthesized
aagaaacaaatggatcccaa

SEQ ID NO: 199736 - DNA, 20 bp, Artificial Sequence
  chemically synthesized
gccagaaataaagaaacaaa

SEQ ID NO: 199737 - DNA, 20 bp, Artificial Sequence
  chemically synthesized
tccatttgtttctttatttc

SEQ ID NO: 199738 - DNA, 20 bp, Artificial Sequence
  chemically synthesized
taattatattgccagaaata

SEQ ID NO: 199739 - DNA, 20 bp, Artificial Sequence
  chemically synthesized
tagaaacttaattatattgc

SEQ ID NO: 199740 - DNA, 20 bp, Artificial Sequence
  chemically synthesized
ttatttctggcaatataatt

SEQ ID NO: 199741 - DNA, 20 bp, Artificial Sequence
  chemically synthesized
ataattaagtttctaactct

SEQ ID NO: 199742 - DNA, 20 bp, Artificial Sequence
  chemically synthesized
ttaattgttgagcttagagt

SEQ ID NO: 199743 - DNA, 20 bp, Artificial Sequence
  chemically synthesized
caatttaattgttgagctta

SEQ ID NO: 199744 - DNA, 20 bp, Artificial Sequence
  chemically synthesized
atcaatttaattgttgagct

SEQ ID NO: 199745 - DNA, 20 bp, Artificial Sequence
  chemically synthesized
gaactatcaatttaattgtt

SEQ ID NO: 199746 - DNA, 20 bp, Artificial Sequence
  chemically synthesized
aagctcaacaattaaattga

SEQ ID NO: 199747 - DNA, 20 bp, Artificial Sequence
  chemically synthesized
caattaaattgatagttcat

SEQ ID NO: 199748 - DNA, 20 bp, Artificial Sequence
  chemically synthesized
ttgatagttcattagcattt

SEQ ID NO: 199749 - DNA, 20 bp, Artificial Sequence
  chemically synthesized
atagttcattagcattttag

SEQ ID NO: 199750 - DNA, 20 bp, Artificial Sequence
  chemically synthesized
aaagctaaatttgttgtttg

SEQ ID NO: 199751 - DNA, 20 bp, Artificial Sequence
  chemically synthesized
aacacttcaaacaacaaatt

SEQ ID NO: 199752 - DNA, 20 bp, Artificial Sequence
  chemically synthesized
tcaaacaacaaatttagctt

SEQ ID NO: 199753 - DNA, 20 bp, Artificial Sequence
  chemically synthesized
caacaaatttagctttagaa

SEQ ID NO: 199754 - DNA, 20 bp, Artificial Sequence
  chemically synthesized
attttacctgttcttttcta

SEQ ID NO: 199755 - DNA, 20 bp, Artificial Sequence
  chemically synthesized
aatttagctttagaaaagaa

SEQ ID NO: 199756 - DNA, 20 bp, Artificial Sequence
  chemically synthesized
atttagctttagaaaagaac

SEQ ID NO: 199757 - DNA, 20 bp, Artificial Sequence
  chemically synthesized
tacatttaaaataattaatt

SEQ ID NO: 199758 - DNA, 20 bp, Artificial Sequence
  chemically synthesized
agtttatgtttataggacat

SEQ ID NO: 199759 - DNA, 20 bp, Artificial Sequence
  chemically synthesized
aagtttatgtttataggaca

SEQ ID NO: 199760 - DNA, 20 bp, Artificial Sequence
  chemically synthesized
atagtcaagtttatgtttat

SEQ ID NO: 199761 - DNA, 20 bp, Artificial Sequence
  chemically synthesized
tatagtcaagtttatgttta

SEQ ID NO: 199762 - DNA, 20 bp, Artificial Sequence
  chemically synthesized
tataaacataaacttgacta

SEQ ID NO: 199763 - DNA, 20 bp, Artificial Sequence
  chemically synthesized
taaacataaacttgactata

SEQ ID NO: 199764 - DNA, 20 bp, Artificial Sequence
  chemically synthesized
aaaattatgactctatagtc

SEQ ID NO: 199765 - DNA, 20 bp, Artificial Sequence
  chemically synthesized
gtttaaaaattatgactcta

SEQ ID NO: 199766 - DNA, 20 bp, Artificial Sequence
  chemically synthesized
agtcataatttttaaacact

SEQ ID NO: 199767 - DNA, 20 bp, Artificial Sequence
  chemically synthesized
tggtaatttatgaagagact

SEQ ID NO: 199768 - DNA, 20 bp, Artificial Sequence
  chemically synthesized
atagtgtggtaatttatgaa

SEQ ID NO: 199769 - DNA, 20 bp, Artificial Sequence
  chemically synthesized
atatagtgtggtaatttatg

SEQ ID NO: 199770 - DNA, 20 bp, Artificial Sequence
  chemically synthesized
tctcagtgaaaaatatagtg

SEQ ID NO: 199771 - DNA, 20 bp, Artificial Sequence
  chemically synthesized
taatttctcagtgaaaaata

SEQ ID NO: 199772 - DNA, 20 bp, Artificial Sequence
  chemically synthesized
accacactatatttttcact

SEQ ID NO: 199773 - DNA, 20 bp, Artificial Sequence
  chemically synthesized
atatcatagttttaatttct

SEQ ID NO: 199774 - DNA, 20 bp, Artificial Sequence
  chemically synthesized
acattttagctaaaatatca

SEQ ID NO: 199775 - DNA, 20 bp, Artificial Sequence
  chemically synthesized
aaattaaaactatgatattt

SEQ ID NO: 199776 - DNA, 20 bp, Artificial Sequence
  chemically synthesized
ggtttcaaaatgatacattt

SEQ ID NO: 199777 - DNA, 20 bp, Artificial Sequence
  chemically synthesized
tcattttgaaacccaaaata

SEQ ID NO: 199778 - DNA, 20 bp, Artificial Sequence
  chemically synthesized
aaaagtgaaatctatatttt

SEQ ID NO: 199779 - DNA, 20 bp, Artificial Sequence
  chemically synthesized
gaaaagtgaaatctatattt

SEQ ID NO: 199780 - DNA, 20 bp, Artificial Sequence
  chemically synthesized
aataatctcaagaacatgaa

SEQ ID NO: 199781 - DNA, 20 bp, Artificial Sequence
  chemically synthesized
atttcacttttcatgttctt

SEQ ID NO: 199782 - DNA, 20 bp, Artificial Sequence
  chemically synthesized
tctacaggaaaaataatctc

SEQ ID NO: 199783 - DNA, 20 bp, Artificial Sequence
  chemically synthesized
tcttgagattatttttcctg

SEQ ID NO: 199784 - DNA, 20 bp, Artificial Sequence
  chemically synthesized
tcagcatatacgttttctac

SEQ ID NO: 199785 - DNA, 20 bp, Artificial Sequence
  chemically synthesized
ttcagcatatacgttttcta

SEQ ID NO: 199786 - DNA, 20 bp, Artificial Sequence
  chemically synthesized
gtagaaaacgtatatgctga

SEQ ID NO: 199787 - DNA, 20 bp, Artificial Sequence
  chemically synthesized
gaaaacgtatatgctgaaag

SEQ ID NO: 199788 - DNA, 20 bp, Artificial Sequence
  chemically synthesized
attattttaatgaccacttt

SEQ ID NO: 199789 - DNA, 20 bp, Artificial Sequence
  chemically synthesized
agtggtcattaaaataatta

SEQ ID NO: 199790 - DNA, 20 bp, Artificial Sequence
  chemically synthesized
agcaatgttttgcagtttta

SEQ ID NO: 199791 - DNA, 20 bp, Artificial Sequence
  chemically synthesized
ttagcaatgttttgcagttt

SEQ ID NO: 199792 - DNA, 20 bp, Artificial Sequence
  chemically synthesized
agtatgttagcaatgttttg

SEQ ID NO: 199793 - DNA, 20 bp, Artificial Sequence
  chemically synthesized
caaaacattgctaacatact

SEQ ID NO: 199794 - DNA, 20 bp, Artificial Sequence
  chemically synthesized
tgtattagatcttagtatgt

SEQ ID NO: 199795 - DNA, 20 bp, Artificial Sequence
  chemically synthesized
catgaaactgtattagatct

SEQ ID NO: 199796 - DNA, 20 bp, Artificial Sequence
  chemically synthesized
taacatactaagatctaata

SEQ ID NO: 199797 - DNA, 20 bp, Artificial Sequence
  chemically synthesized
ttgacaccatgaaactgtat

SEQ ID NO: 199798 - DNA, 20 bp, Artificial Sequence
  chemically synthesized
taagatctaatacagtttca

SEQ ID NO: 199799 - DNA, 20 bp, Artificial Sequence
  chemically synthesized
cagtttcatggtgtcaaaaa

SEQ ID NO: 199800 - DNA, 20 bp, Artificial Sequence
  chemically synthesized
gtttcatggtgtcaaaaata

SEQ ID NO: 199801 - DNA, 20 bp, Artificial Sequence
  chemically synthesized
gtcaaaaatagagtatttca

SEQ ID NO: 199802 - DNA, 20 bp, Artificial Sequence
  chemically synthesized
aaaaatagagtatttcaaag

SEQ ID NO: 199803 - DNA, 20 bp, Artificial Sequence
  chemically synthesized
atttcaaagaagatttaaaa

SEQ ID NO: 199804 - DNA, 20 bp, Artificial Sequence
  chemically synthesized
tatgtgtgaaatttatgttt

SEQ ID NO: 199805 - DNA, 20 bp, Artificial Sequence
  chemically synthesized
aacgctggcttttgttaaaa

SEQ ID NO: 199806 - DNA, 20 bp, Artificial Sequence
  chemically synthesized
atattttgcttttttaacaa

SEQ ID NO: 199807 - DNA, 20 bp, Artificial Sequence
  chemically synthesized
tttgcttttttaacaaaagc

SEQ ID NO: 199808 - DNA, 20 bp, Artificial Sequence
  chemically synthesized
tacattttgggcagtaacgc

SEQ ID NO: 199809 - DNA, 20 bp, Artificial Sequence
  chemically synthesized
cagaacatttacattttggg

SEQ ID NO: 199810 - DNA, 20 bp, Artificial Sequence
  chemically synthesized
taccagaacatttacatttt

SEQ ID NO: 199811 - DNA, 20 bp, Artificial Sequence
  chemically synthesized
ttaccagaacatttacattt

SEQ ID NO: 199812 - DNA, 20 bp, Artificial Sequence
  chemically synthesized
tgcccaaaatgtaaatgttc

SEQ ID NO: 199813 - DNA, 20 bp, Artificial Sequence
  chemically synthesized
aaaatgtaaatgttctggta

SEQ ID NO: 199814 - DNA, 20 bp, Artificial Sequence
  chemically synthesized
aaatgtaaatgttctggtaa

SEQ ID NO: 199815 - DNA, 20 bp, Artificial Sequence
  chemically synthesized
tgtaaatgttctggtaaagg

SEQ ID NO: 199816 - DNA, 20 bp, Artificial Sequence
  chemically synthesized
gcgtacatatcttcctttac

SEQ ID NO: 199817 - DNA, 20 bp, Artificial Sequence
  chemically synthesized
tgaaaattaattggtgaaaa

SEQ ID NO: 199818 - DNA, 20 bp, Artificial Sequence
  chemically synthesized
ttctttttatgaaaattaat

SEQ ID NO: 199819 - DNA, 20 bp, Artificial Sequence
  chemically synthesized
caccaattaattttcataaa

SEQ ID NO: 199820 - DNA, 20 bp, Artificial Sequence
  chemically synthesized
caattaattttcataaaaag

SEQ ID NO: 199821 - DNA, 20 bp, Artificial Sequence
  chemically synthesized
aattttcataaaaagaagcc

SEQ ID NO: 199822 - DNA, 20 bp, Artificial Sequence
  chemically synthesized
ataaaaagaagcctagtaaa

SEQ ID NO: 199823 - DNA, 20 bp, Artificial Sequence
  chemically synthesized
tattttatgttctatttact

SEQ ID NO: 199824 - DNA, 20 bp, Artificial Sequence
  chemically synthesized
ttattttatgttctatttac

SEQ ID NO: 199825 - DNA, 20 bp, Artificial Sequence
  chemically synthesized
aattaattttttagtattta

SEQ ID NO: 199826 - DNA, 20 bp, Artificial Sequence
  chemically synthesized
taattaattttttagtattt

SEQ ID NO: 199827 - DNA, 20 bp, Artificial Sequence
  chemically synthesized
taggaagataattaattttt

SEQ ID NO: 199828 - DNA, 20 bp, Artificial Sequence
  chemically synthesized
aaaaaattaattatcttcct

SEQ ID NO: 199829 - DNA, 20 bp, Artificial Sequence
  chemically synthesized
aaaaattaattatcttccta

SEQ ID NO: 199830 - DNA, 20 bp, Artificial Sequence
  chemically synthesized
ttttgtcacagttccttagg

SEQ ID NO: 199831 - DNA, 20 bp, Artificial Sequence
  chemically synthesized
tctttttgtcacagttcctt

SEQ ID NO: 199832 - DNA, 20 bp, Artificial Sequence
  chemically synthesized
ttctttttgtcacagttcct

SEQ ID NO: 199833 - DNA, 20 bp, Artificial Sequence
  chemically synthesized
tcctaaggaactgtgacaaa

SEQ ID NO: 199834 - DNA, 20 bp, Artificial Sequence
  chemically synthesized
tcacatttttctttttgtca

SEQ ID NO: 199835 - DNA, 20 bp, Artificial Sequence
  chemically synthesized
aaatgtgatttcttgctttg

SEQ ID NO: 199836 - DNA, 20 bp, Artificial Sequence
  chemically synthesized
aatgtgatttcttgctttgt

SEQ ID NO: 199837 - DNA, 20 bp, Artificial Sequence
  chemically synthesized
agtattttgacctacaaagc

SEQ ID NO: 199838 - DNA, 20 bp, Artificial Sequence
  chemically synthesized
ataaagtattttgacctaca

SEQ ID NO: 199839 - DNA, 20 bp, Artificial Sequence
  chemically synthesized
gaaaatttaagtagcaaata

SEQ ID NO: 199840 - DNA, 20 bp, Artificial Sequence
  chemically synthesized
aatggaattgaaaatttaag

SEQ ID NO: 199841 - DNA, 20 bp, Artificial Sequence
  chemically synthesized
ttgaatggaattgaaaattt

SEQ ID NO: 199842 - DNA, 20 bp, Artificial Sequence
  chemically synthesized
gtcagtaaatagttgttgaa

SEQ ID NO: 199843 - DNA, 20 bp, Artificial Sequence
  chemically synthesized
tataagaacaagtcagtaaa

SEQ ID NO: 199844 - DNA, 20 bp, Artificial Sequence
  chemically synthesized
tctggcatataagaacaagt

SEQ ID NO: 199845 - DNA, 20 bp, Artificial Sequence
  chemically synthesized
agggtctggcatataagaac

SEQ ID NO: 199846 - DNA, 20 bp, Artificial Sequence
  chemically synthesized
actgacttgttcttatatgc

SEQ ID NO: 199847 - DNA, 20 bp, Artificial Sequence
  chemically synthesized
taacacagggtctggcatat

SEQ ID NO: 199848 - DNA, 20 bp, Artificial Sequence
  chemically synthesized
cacagttctaacacagggtc

SEQ ID NO: 199849 - DNA, 20 bp, Artificial Sequence
  chemically synthesized
ttatatgccagaccctgtgt

SEQ ID NO: 199850 - DNA, 20 bp, Artificial Sequence
  chemically synthesized
gtgtacacagttctaacaca

SEQ ID NO: 199851 - DNA, 20 bp, Artificial Sequence
  chemically synthesized
tgtgtacacagttctaacac

SEQ ID NO: 199852 - DNA, 20 bp, Artificial Sequence
  chemically synthesized
ttgtgtacacagttctaaca

SEQ ID NO: 199853 - DNA, 20 bp, Artificial Sequence
  chemically synthesized
atcacattaatttgtgtaca

SEQ ID NO: 199854 - DNA, 20 bp, Artificial Sequence
  chemically synthesized
ttggactatggatatgaaca

SEQ ID NO: 199855 - DNA, 20 bp, Artificial Sequence
  chemically synthesized
attgtccatgttcatatcca

SEQ ID NO: 199856 - DNA, 20 bp, Artificial Sequence
  chemically synthesized
ccctaagatgggttggacta

SEQ ID NO: 199857 - DNA, 20 bp, Artificial Sequence
  chemically synthesized
ttaaactccctaagatgggt

SEQ ID NO: 199858 - DNA, 20 bp, Artificial Sequence
  chemically synthesized
atccatagtccaacccatct

SEQ ID NO: 199859 - DNA, 20 bp, Artificial Sequence
  chemically synthesized
tccatagtccaacccatctt

SEQ ID NO: 199860 - DNA, 20 bp, Artificial Sequence
  chemically synthesized
ccatagtccaacccatctta

SEQ ID NO: 199861 - DNA, 20 bp, Artificial Sequence
  chemically synthesized
cttcttaaactccctaagat

SEQ ID NO: 199862 - DNA, 20 bp, Artificial Sequence
  chemically synthesized
atagtccaacccatcttagg

SEQ ID NO: 199863 - DNA, 20 bp, Artificial Sequence
  chemically synthesized
gcttcttaaactccctaaga

SEQ ID NO: 199864 - DNA, 20 bp, Artificial Sequence
  chemically synthesized
aagtgcttcttaaactccct

SEQ ID NO: 199865 - DNA, 20 bp, Artificial Sequence
  chemically synthesized
caacccatcttagggagttt

SEQ ID NO: 199866 - DNA, 20 bp, Artificial Sequence
  chemically synthesized
cccatcttagggagtttaag

SEQ ID NO: 199867 - DNA, 20 bp, Artificial Sequence
  chemically synthesized
tttaagaagcacttcatctt

SEQ ID NO: 199868 - DNA, 20 bp, Artificial Sequence
  chemically synthesized
atagctttagtcttaagatg

SEQ ID NO: 199869 - DNA, 20 bp, Artificial Sequence
  chemically synthesized
agcacttcatcttaagacta

SEQ ID NO: 199870 - DNA, 20 bp, Artificial Sequence
  chemically synthesized
aaaataatagctttagtctt

SEQ ID NO: 199871 - DNA, 20 bp, Artificial Sequence
  chemically synthesized
cacacctaaaataatagctt

SEQ ID NO: 199872 - DNA, 20 bp, Artificial Sequence
  chemically synthesized
taagactaaagctattattt

SEQ ID NO: 199873 - DNA, 20 bp, Artificial Sequence
  chemically synthesized
aagactaaagctattatttt

SEQ ID NO: 199874 - DNA, 20 bp, Artificial Sequence
  chemically synthesized
tataaacacacctaaaataa

SEQ ID NO: 199875 - DNA, 20 bp, Artificial Sequence
  chemically synthesized
tgtatttcagaattttgatt

SEQ ID NO: 199876 - DNA, 20 bp, Artificial Sequence
  chemically synthesized
tttgcaaaataattgtattt

SEQ ID NO: 199877 - DNA, 20 bp, Artificial Sequence
  chemically synthesized
gaaatacaattattttgcaa

SEQ ID NO: 199878 - DNA, 20 bp, Artificial Sequence
  chemically synthesized
tattttgcaaaagacgacaa

SEQ ID NO: 199879 - DNA, 20 bp, Artificial Sequence
  chemically synthesized
ttaaaacttcaggatcagtt

SEQ ID NO: 199880 - DNA, 20 bp, Artificial Sequence
  chemically synthesized
attttactcaactgatcctg

SEQ ID NO: 199881 - DNA, 20 bp, Artificial Sequence
  chemically synthesized
atgccttaaaacttcaggat

SEQ ID NO: 199882 - DNA, 20 bp, Artificial Sequence
  chemically synthesized
caaatatgccttaaaacttc

SEQ ID NO: 199883 - DNA, 20 bp, Artificial Sequence
  chemically synthesized
tcaactgatcctgaagtttt

SEQ ID NO: 199884 - DNA, 20 bp, Artificial Sequence
  chemically synthesized
tcaaatatgccttaaaactt

SEQ ID NO: 199885 - DNA, 20 bp, Artificial Sequence
  chemically synthesized
caactgatcctgaagtttta

SEQ ID NO: 199886 - DNA, 20 bp, Artificial Sequence
  chemically synthesized
ttgatttaaaaaatttaaaa

SEQ ID NO: 199887 - DNA, 20 bp, Artificial Sequence
  chemically synthesized
tttaaaaaatttaaaaaaga

SEQ ID NO: 199888 - DNA, 20 bp, Artificial Sequence
  chemically synthesized
aaatttaaaaaagaaagaat

SEQ ID NO: 199889 - DNA, 20 bp, Artificial Sequence
  chemically synthesized
aatttaaaaaagaaagaatt

SEQ ID NO: 199890 - DNA, 20 bp, Artificial Sequence
  chemically synthesized
atttaaaaaagaaagaattg

SEQ ID NO: 199891 - DNA, 20 bp, Artificial Sequence
  chemically synthesized
aaaaaagaaagaattggggt

SEQ ID NO: 199892 - DNA, 20 bp, Artificial Sequence
  chemically synthesized
aaaaagaaagaattggggtt

SEQ ID NO: 199893 - DNA, 20 bp, Artificial Sequence
  chemically synthesized
agaaagaattggggttggga

SEQ ID NO: 199894 - DNA, 20 bp, Artificial Sequence
  chemically synthesized
gaaagaattggggttgggaa

SEQ ID NO: 199895 - DNA, 20 bp, Artificial Sequence
  chemically synthesized
aaagaattggggttgggaaa

SEQ ID NO: 199896 - DNA, 20 bp, Artificial Sequence
  chemically synthesized
aagaattggggttgggaaag

SEQ ID NO: 199897 - DNA, 20 bp, Artificial Sequence
  chemically synthesized
gaattggggttgggaaaggg

SEQ ID NO: 199898 - DNA, 20 bp, Artificial Sequence
  chemically synthesized
ttgagtgatttttatatcat

SEQ ID NO: 199899 - DNA, 20 bp, Artificial Sequence
  chemically synthesized
gatataaaaatcactcaatt

SEQ ID NO: 199900 - DNA, 20 bp, Artificial Sequence
  chemically synthesized
tccttactagagtctaaatt

SEQ ID NO: 199901 - DNA, 20 bp, Artificial Sequence
  chemically synthesized
aaatcactcaatttagactc

SEQ ID NO: 199902 - DNA, 20 bp, Artificial Sequence
  chemically synthesized
cactcaatttagactctagt

SEQ ID NO: 199903 - DNA, 20 bp, Artificial Sequence
  chemically synthesized
actcaatttagactctagta

SEQ ID NO: 199904 - DNA, 20 bp, Artificial Sequence
  chemically synthesized
taattcttgtgtccttacta

SEQ ID NO: 199905 - DNA, 20 bp, Artificial Sequence
  chemically synthesized
ggtaattcttgtgtccttac

SEQ ID NO: 199906 - DNA, 20 bp, Artificial Sequence
  chemically synthesized
ttagactctagtaaggacac

SEQ ID NO: 199907 - DNA, 20 bp, Artificial Sequence
  chemically synthesized
ggacacaagaattaccaaaa

SEQ ID NO: 199908 - DNA, 20 bp, Artificial Sequence
  chemically synthesized
taaatgagaagtaactgttt

SEQ ID NO: 199909 - DNA, 20 bp, Artificial Sequence
  chemically synthesized
aaccaaaatgattaaatgag

SEQ ID NO: 199910 - DNA, 20 bp, Artificial Sequence
  chemically synthesized
acaaaccaaaatgattaaat

SEQ ID NO: 199911 - DNA, 20 bp, Artificial Sequence
  chemically synthesized
tacttctcatttaatcattt

SEQ ID NO: 199912 - DNA, 20 bp, Artificial Sequence
  chemically synthesized
tttggtttgtttaaactctt

SEQ ID NO: 199913 - DNA, 20 bp, Artificial Sequence
  chemically synthesized
ttctttcccaaataactaaa

SEQ ID NO: 199914 - DNA, 20 bp, Artificial Sequence
  chemically synthesized
atttctttcccaaataacta

SEQ ID NO: 199915 - DNA, 20 bp, Artificial Sequence
  chemically synthesized
gtttaaactctttagttatt

SEQ ID NO: 199916 - DNA, 20 bp, Artificial Sequence
  chemically synthesized
tttaaactctttagttattt

SEQ ID NO: 199917 - DNA, 20 bp, Artificial Sequence
  chemically synthesized
aactctttagttatttggga

SEQ ID NO: 199918 - DNA, 20 bp, Artificial Sequence
  chemically synthesized
atttgggaaagaaatgtatt

SEQ ID NO: 199919 - DNA, 20 bp, Artificial Sequence
  chemically synthesized
caccatatctaacacacagc

SEQ ID NO: 199920 - DNA, 20 bp, Artificial Sequence
  chemically synthesized
gcaccatatctaacacacag

SEQ ID NO: 199921 - DNA, 20 bp, Artificial Sequence
  chemically synthesized
attgagtacctgctgtgtgt

SEQ ID NO: 199922 - DNA, 20 bp, Artificial Sequence
  chemically synthesized
ctagcaccatatctaacaca

SEQ ID NO: 199923 - DNA, 20 bp, Artificial Sequence
  chemically synthesized
tacctgctgtgtgttagata

SEQ ID NO: 199924 - DNA, 20 bp, Artificial Sequence
  chemically synthesized
ctgtgtgttagatatggtgc

SEQ ID NO: 199925 - DNA, 20 bp, Artificial Sequence
  chemically synthesized
tgtgtgttagatatggtgct

SEQ ID NO: 199926 - DNA, 20 bp, Artificial Sequence
  chemically synthesized
acacatccacatataggacc

SEQ ID NO: 199927 - DNA, 20 bp, Artificial Sequence
  chemically synthesized
atggtgctaggtcctatatg

SEQ ID NO: 199928 - DNA, 20 bp, Artificial Sequence
  chemically synthesized
catatcacacatccacatat

SEQ ID NO: 199929 - DNA, 20 bp, Artificial Sequence
  chemically synthesized
tcatatcacacatccacata

SEQ ID NO: 199930 - DNA, 20 bp, Artificial Sequence
  chemically synthesized
gatgtgtgatatgactgatc

SEQ ID NO: 199931 - DNA, 20 bp, Artificial Sequence
  chemically synthesized
cggtaggataagaactggat

SEQ ID NO: 199932 - DNA, 20 bp, Artificial Sequence
  chemically synthesized
agttacggtaggataagaac

SEQ ID NO: 199933 - DNA, 20 bp, Artificial Sequence
  chemically synthesized
aatgtaagttacggtaggat

SEQ ID NO: 199934 - DNA, 20 bp, Artificial Sequence
  chemically synthesized
actagaatgtaagttacggt

SEQ ID NO: 199935 - DNA, 20 bp, Artificial Sequence
  chemically synthesized
tactagaatgtaagttacgg

SEQ ID NO: 199936 - DNA, 20 bp, Artificial Sequence
  chemically synthesized
gcctactagaatgtaagtta

SEQ ID NO: 199937 - DNA, 20 bp, Artificial Sequence
  chemically synthesized
tcctaccgtaacttacattc

SEQ ID NO: 199938 - DNA, 20 bp, Artificial Sequence
  chemically synthesized
gcaattgcctactagaatgt

SEQ ID NO: 199939 - DNA, 20 bp, Artificial Sequence
  chemically synthesized
taccgtaacttacattctag

SEQ ID NO: 199940 - DNA, 20 bp, Artificial Sequence
  chemically synthesized
accgtaacttacattctagt

SEQ ID NO: 199941 - DNA, 20 bp, Artificial Sequence
  chemically synthesized
actctcatgcaattgcctac

SEQ ID NO: 199942 - DNA, 20 bp, Artificial Sequence
  chemically synthesized
attctagtaggcaattgcat

SEQ ID NO: 199943 - DNA, 20 bp, Artificial Sequence
  chemically synthesized
tctagtaggcaattgcatga

SEQ ID NO: 199944 - DNA, 20 bp, Artificial Sequence
  chemically synthesized
caattgcatgagagttcctt

SEQ ID NO: 199945 - DNA, 20 bp, Artificial Sequence
  chemically synthesized
attgcatgagagttccttaa

SEQ ID NO: 199946 - DNA, 20 bp, Artificial Sequence
  chemically synthesized
ttctgctattatagctctta

SEQ ID NO: 199947 - DNA, 20 bp, Artificial Sequence
  chemically synthesized
tttctgctattatagctctt

SEQ ID NO: 199948 - DNA, 20 bp, Artificial Sequence
  chemically synthesized
gagttccttaagagctataa

SEQ ID NO: 199949 - DNA, 20 bp, Artificial Sequence
  chemically synthesized
ttccttaagagctataatag

SEQ ID NO: 199950 - DNA, 20 bp, Artificial Sequence
  chemically synthesized
agcctgtatttctgctatta

SEQ ID NO: 199951 - DNA, 20 bp, Artificial Sequence
  chemically synthesized
gagctataatagcagaaata

SEQ ID NO: 199952 - DNA, 20 bp, Artificial Sequence
  chemically synthesized
agctataatagcagaaatac

SEQ ID NO: 199953 - DNA, 20 bp, Artificial Sequence
  chemically synthesized
tatttctttctgttttttag

SEQ ID NO: 199954 - DNA, 20 bp, Artificial Sequence
  chemically synthesized
aaatacaggcttctaaaaaa

SEQ ID NO: 199955 - DNA, 20 bp, Artificial Sequence
  chemically synthesized
gtgtatttctttctgttttt

SEQ ID NO: 199956 - DNA, 20 bp, Artificial Sequence
  chemically synthesized
acaggcttctaaaaaacaga

SEQ ID NO: 199957 - DNA, 20 bp, Artificial Sequence
  chemically synthesized
taacactctagtagaggaga

SEQ ID NO: 199958 - DNA, 20 bp, Artificial Sequence
  chemically synthesized
ctaacactctagtagaggag

SEQ ID NO: 199959 - DNA, 20 bp, Artificial Sequence
  chemically synthesized
aaatacaccttctcctctac

SEQ ID NO: 199960 - DNA, 20 bp, Artificial Sequence
  chemically synthesized
tttctaacactctagtagag

SEQ ID NO: 199961 - DNA, 20 bp, Artificial Sequence
  chemically synthesized
atacaccttctcctctacta

SEQ ID NO: 199962 - DNA, 20 bp, Artificial Sequence
  chemically synthesized
tttttctaacactctagtag

SEQ ID NO: 199963 - DNA, 20 bp, Artificial Sequence
  chemically synthesized
gtttttctaacactctagta

SEQ ID NO: 199964 - DNA, 20 bp, Artificial Sequence
  chemically synthesized
gtgtttttctaacactctag

SEQ ID NO: 199965 - DNA, 20 bp, Artificial Sequence
  chemically synthesized
cttctcctctactagagtgt

SEQ ID NO: 199966 - DNA, 20 bp, Artificial Sequence
  chemically synthesized
tatgtgtttttctaacactc

SEQ ID NO: 199967 - DNA, 20 bp, Artificial Sequence
  chemically synthesized
gagtgttagaaaaacacata

SEQ ID NO: 199968 - DNA, 20 bp, Artificial Sequence
  chemically synthesized
atagtaatattaaatatata

SEQ ID NO: 199969 - DNA, 20 bp, Artificial Sequence
  chemically synthesized
aatatatacagatacctaat

SEQ ID NO: 199970 - DNA, 20 bp, Artificial Sequence
  chemically synthesized
ccaaaccaataagtctgatt

SEQ ID NO: 199971 - DNA, 20 bp, Artificial Sequence
  chemically synthesized
tccaaaccaataagtctgat

SEQ ID NO: 199972 - DNA, 20 bp, Artificial Sequence
  chemically synthesized
agatacctaatcagacttat

SEQ ID NO: 199973 - DNA, 20 bp, Artificial Sequence
  chemically synthesized
cctaatcagacttattggtt

SEQ ID NO: 199974 - DNA, 20 bp, Artificial Sequence
  chemically synthesized
atcccactgtccaaaccaat

SEQ ID NO: 199975 - DNA, 20 bp, Artificial Sequence
  chemically synthesized
atcagacttattggtttgga

SEQ ID NO: 199976 - DNA, 20 bp, Artificial Sequence
  chemically synthesized
agacttattggtttggacag

SEQ ID NO: 199977 - DNA, 20 bp, Artificial Sequence
  chemically synthesized
gacttattggtttggacagt

SEQ ID NO: 199978 - DNA, 20 bp, Artificial Sequence
  chemically synthesized
ggtttggacagtgggataat

SEQ ID NO: 199979 - DNA, 20 bp, Artificial Sequence
  chemically synthesized
gtttggacagtgggataata

SEQ ID NO: 199980 - DNA, 20 bp, Artificial Sequence
  chemically synthesized
ggacagtgggataataaggc

SEQ ID NO: 199981 - DNA, 20 bp, Artificial Sequence
  chemically synthesized
ttctaccaggaaatcattac

SEQ ID NO: 199982 - DNA, 20 bp, Artificial Sequence
  chemically synthesized
taaggctagtaatgatttcc

SEQ ID NO: 199983 - DNA, 20 bp, Artificial Sequence
  chemically synthesized
ggctagtaatgatttcctgg

SEQ ID NO: 199984 - DNA, 20 bp, Artificial Sequence
  chemically synthesized
ttacatattttttttctacc

SEQ ID NO: 199985 - DNA, 20 bp, Artificial Sequence
  chemically synthesized
cttacatattttttttctac

SEQ ID NO: 199986 - DNA, 20 bp, Artificial Sequence
  chemically synthesized
ctggtagaaaaaaaatatgt

SEQ ID NO: 199987 - DNA, 20 bp, Artificial Sequence
  chemically synthesized
aaaaaaatatgtaagtcttc

SEQ ID NO: 199988 - DNA, 20 bp, Artificial Sequence
  chemically synthesized
aaaaatatgtaagtcttcaa

SEQ ID NO: 199989 - DNA, 20 bp, Artificial Sequence
  chemically synthesized
tgagcttatccatactcttg

SEQ ID NO: 199990 - DNA, 20 bp, Artificial Sequence
  chemically synthesized
tatgtaagtcttcaagagta

SEQ ID NO: 199991 - DNA, 20 bp, Artificial Sequence
  chemically synthesized
aagtcttcaagagtatggat

SEQ ID NO: 199992 - DNA, 20 bp, Artificial Sequence
  chemically synthesized
ttcaagagtatggataagct

SEQ ID NO: 199993 - DNA, 20 bp, Artificial Sequence
  chemically synthesized
agtatggataagctcagata

SEQ ID NO: 199994 - DNA, 20 bp, Artificial Sequence
  chemically synthesized
ctcccattcctactttatct

SEQ ID NO: 199995 - DNA, 20 bp, Artificial Sequence
  chemically synthesized
atggataagctcagataaag

SEQ ID NO: 199996 - DNA, 20 bp, Artificial Sequence
  chemically synthesized
tggataagctcagataaagt

SEQ ID NO: 199997 - DNA, 20 bp, Artificial Sequence
  chemically synthesized
aagctcagataaagtaggaa

SEQ ID NO: 199998 - DNA, 20 bp, Artificial Sequence
  chemically synthesized
agctcagataaagtaggaat

SEQ ID NO: 199999 - DNA, 20 bp, Artificial Sequence
  chemically synthesized
ctcagataaagtaggaatgg

SEQ ID NO: 200000 - DNA, 20 bp, Artificial Sequence
  chemically synthesized
cagataaagtaggaatggga

SEQ ID NO: 200001 - DNA, 20 bp, Artificial Sequence
  chemically synthesized
taaagtaggaatgggagaga

SEQ ID NO: 200002 - DNA, 20 bp, Artificial Sequence
  chemically synthesized
aaagtaggaatgggagagat

SEQ ID NO: 200003 - DNA, 20 bp, Artificial Sequence
  chemically synthesized
gtaggaatgggagagatagg

SEQ ID NO: 200004 - DNA, 20 bp, Artificial Sequence
  chemically synthesized
taggaatgggagagataggc

SEQ ID NO: 200005 - DNA, 20 bp, Artificial Sequence
  chemically synthesized
aggaatgggagagataggca

SEQ ID NO: 200006 - DNA, 20 bp, Artificial Sequence
  chemically synthesized
ggaatgggagagataggcag

SEQ ID NO: 200007 - DNA, 20 bp, Artificial Sequence
  chemically synthesized
atgggagagataggcagggg

SEQ ID NO: 200008 - DNA, 20 bp, Artificial Sequence
  chemically synthesized
taggcaggggtggtgatgtt

SEQ ID NO: 200009 - DNA, 20 bp, Artificial Sequence
  chemically synthesized
ggcaggggtggtgatgttta

SEQ ID NO: 200010 - DNA, 20 bp, Artificial Sequence
  chemically synthesized
ggacatgaattcattcacag

SEQ ID NO: 200011 - DNA, 20 bp, Artificial Sequence
  chemically synthesized
ttgggacatgaattcattca

SEQ ID NO: 200012 - DNA, 20 bp, Artificial Sequence
  chemically synthesized
tccctgttgtttttttcgtt

SEQ ID NO: 200013 - DNA, 20 bp, Artificial Sequence
  chemically synthesized
ttccctgttgtttttttcgt

SEQ ID NO: 200014 - DNA, 20 bp, Artificial Sequence
  chemically synthesized
tgtcccaacgaaaaaaacaa

SEQ ID NO: 200015 - DNA, 20 bp, Artificial Sequence
  chemically synthesized
gtcccaacgaaaaaaacaac

SEQ ID NO: 200016 - DNA, 20 bp, Artificial Sequence
  chemically synthesized
tcccaacgaaaaaaacaaca

SEQ ID NO: 200017 - DNA, 20 bp, Artificial Sequence
  chemically synthesized
aaaaaaacaacagggaacgt

SEQ ID NO: 200018 - DNA, 20 bp, Artificial Sequence
  chemically synthesized
aaaaaacaacagggaacgtt

SEQ ID NO: 200019 - DNA, 20 bp, Artificial Sequence
  chemically synthesized
aacgttaggatcgctgattc

SEQ ID NO: 200020 - DNA, 20 bp, Artificial Sequence
  chemically synthesized
acgttaggatcgctgattcc

SEQ ID NO: 200021 - DNA, 20 bp, Artificial Sequence
  chemically synthesized
gtctgtacaattcccggaat

SEQ ID NO: 200022 - DNA, 20 bp, Artificial Sequence
  chemically synthesized
aaaaaggtctgtacaattcc

SEQ ID NO: 200023 - DNA, 20 bp, Artificial Sequence
  chemically synthesized
cgctgattccgggaattgta

SEQ ID NO: 200024 - DNA, 20 bp, Artificial Sequence
  chemically synthesized
cttagcttacgcaaggaaaa

SEQ ID NO: 200025 - DNA, 20 bp, Artificial Sequence
  chemically synthesized
acttagcttacgcaaggaaa

SEQ ID NO: 200026 - DNA, 20 bp, Artificial Sequence
  chemically synthesized
acagacctttttccttgcgt

SEQ ID NO: 200027 - DNA, 20 bp, Artificial Sequence
  chemically synthesized
aaaactacttagcttacgca

SEQ ID NO: 200028 - DNA, 20 bp, Artificial Sequence
  chemically synthesized
aaaaactacttagcttacgc

SEQ ID NO: 200029 - DNA, 20 bp, Artificial Sequence
  chemically synthesized
cctttttccttgcgtaagct

SEQ ID NO: 200030 - DNA, 20 bp, Artificial Sequence
  chemically synthesized
ttttccttgcgtaagctaag

SEQ ID NO: 200031 - DNA, 20 bp, Artificial Sequence
  chemically synthesized
ttgtaactctaaaaactact

SEQ ID NO: 200032 - DNA, 20 bp, Artificial Sequence
  chemically synthesized
tgcgtaagctaagtagtttt

SEQ ID NO: 200033 - DNA, 20 bp, Artificial Sequence
  chemically synthesized
cgtaagctaagtagttttta

SEQ ID NO: 200034 - DNA, 20 bp, Artificial Sequence
  chemically synthesized
taagtagtttttagagttac

SEQ ID NO: 200035 - DNA, 20 bp, Artificial Sequence
  chemically synthesized
aagtagtttttagagttaca

SEQ ID NO: 200036 - DNA, 20 bp, Artificial Sequence
  chemically synthesized
gtttttagagttacaaggaa

SEQ ID NO: 200037 - DNA, 20 bp, Artificial Sequence
  chemically synthesized
ttttagagttacaaggaaaa

SEQ ID NO: 200038 - DNA, 20 bp, Artificial Sequence
  chemically synthesized
gttacaaggaaaagagatgt

SEQ ID NO: 200039 - DNA, 20 bp, Artificial Sequence
  chemically synthesized
tacaaggaaaagagatgtaa

SEQ ID NO: 200040 - DNA, 20 bp, Artificial Sequence
  chemically synthesized
ggaaaagagatgtaagagac

SEQ ID NO: 200041 - DNA, 20 bp, Artificial Sequence
  chemically synthesized
aaaagagatgtaagagactg

SEQ ID NO: 200042 - DNA, 20 bp, Artificial Sequence
  chemically synthesized
aaagagatgtaagagactgg

SEQ ID NO: 200043 - DNA, 20 bp, Artificial Sequence
  chemically synthesized
gagatgtaagagactggagg

SEQ ID NO: 200044 - DNA, 20 bp, Artificial Sequence
  chemically synthesized
ttcttaaatgtttcttcctc

SEQ ID NO: 200045 - DNA, 20 bp, Artificial Sequence
  chemically synthesized
gactggaggaagaaacattt

SEQ ID NO: 200046 - DNA, 20 bp, Artificial Sequence
  chemically synthesized
agaaacatttaagaatctga

SEQ ID NO: 200047 - DNA, 20 bp, Artificial Sequence
  chemically synthesized
gaaacatttaagaatctgaa

SEQ ID NO: 200048 - DNA, 20 bp, Artificial Sequence
  chemically synthesized
cagatggacttaagtccttt

SEQ ID NO: 200049 - DNA, 20 bp, Artificial Sequence
  chemically synthesized
ttaagaatctgaaaggactt

SEQ ID NO: 200050 - DNA, 20 bp, Artificial Sequence
  chemically synthesized
tttccttcccagatggactt

SEQ ID NO: 200051 - DNA, 20 bp, Artificial Sequence
  chemically synthesized
tgaaaggacttaagtccatc

SEQ ID NO: 200052 - DNA, 20 bp, Artificial Sequence
  chemically synthesized
gaaaggacttaagtccatct

SEQ ID NO: 200053 - DNA, 20 bp, Artificial Sequence
  chemically synthesized
aggacttaagtccatctggg

SEQ ID NO: 200054 - DNA, 20 bp, Artificial Sequence
  chemically synthesized
ggacttaagtccatctggga

SEQ ID NO: 200055 - DNA, 20 bp, Artificial Sequence
  chemically synthesized
tttcccttttccttcccaga

SEQ ID NO: 200056 - DNA, 20 bp, Artificial Sequence
  chemically synthesized
tccctttcccttttccttcc

SEQ ID NO: 200057 - DNA, 20 bp, Artificial Sequence
  chemically synthesized
taagtccatctgggaaggaa

SEQ ID NO: 200058 - DNA, 20 bp, Artificial Sequence
  chemically synthesized
aagtccatctgggaaggaaa

SEQ ID NO: 200059 - DNA, 20 bp, Artificial Sequence
  chemically synthesized
agtccatctgggaaggaaaa

SEQ ID NO: 200060 - DNA, 20 bp, Artificial Sequence
  chemically synthesized
catctgggaaggaaaaggga

SEQ ID NO: 200061 - DNA, 20 bp, Artificial Sequence
  chemically synthesized
atctgggaaggaaaagggaa

SEQ ID NO: 200062 - DNA, 20 bp, Artificial Sequence
  chemically synthesized
tctgggaaggaaaagggaaa

SEQ ID NO: 200063 - DNA, 20 bp, Artificial Sequence
  chemically synthesized
tgggaaggaaaagggaaagg

SEQ ID NO: 200064 - DNA, 20 bp, Artificial Sequence
  chemically synthesized
gggaaggaaaagggaaaggg

SEQ ID NO: 200065 - DNA, 20 bp, Artificial Sequence
  chemically synthesized
ggaaaagggaaagggaggaa

SEQ ID NO: 200066 - DNA, 20 bp, Artificial Sequence
  chemically synthesized
agggaaagggaggaatggca

SEQ ID NO: 200067 - DNA, 20 bp, Artificial Sequence
  chemically synthesized
gggaaagggaggaatggcaa

SEQ ID NO: 200068 - DNA, 20 bp, Artificial Sequence
  chemically synthesized
aagggaggaatggcaaaggt

SEQ ID NO: 200069 - DNA, 20 bp, Artificial Sequence
  chemically synthesized
agggaggaatggcaaaggtt

SEQ ID NO: 200070 - DNA, 20 bp, Artificial Sequence
  chemically synthesized
gggaggaatggcaaaggtta

SEQ ID NO: 200071 - DNA, 20 bp, Artificial Sequence
  chemically synthesized
gaatggcaaaggttagggcg

SEQ ID NO: 200072 - DNA, 20 bp, Artificial Sequence
  chemically synthesized
aaggttagggcgaagtgtgt

SEQ ID NO: 200073 - DNA, 20 bp, Artificial Sequence
  chemically synthesized
aggttagggcgaagtgtgtt

SEQ ID NO: 200074 - DNA, 20 bp, Artificial Sequence
  chemically synthesized
ggttagggcgaagtgtgtta

SEQ ID NO: 200075 - DNA, 20 bp, Artificial Sequence
  chemically synthesized
gttagggcgaagtgtgttag

SEQ ID NO: 200076 - DNA, 20 bp, Artificial Sequence
  chemically synthesized
ttagggcgaagtgtgttagg

SEQ ID NO: 200077 - DNA, 20 bp, Artificial Sequence
  chemically synthesized
agggcgaagtgtgttagggg

SEQ ID NO: 200078 - DNA, 20 bp, Artificial Sequence
  chemically synthesized
gcgaagtgtgttagggggag

SEQ ID NO: 200079 - DNA, 20 bp, Artificial Sequence
  chemically synthesized
gtgtgttagggggagtagac

SEQ ID NO: 200080 - DNA, 20 bp, Artificial Sequence
  chemically synthesized
gttagggggagtagacaagt

SEQ ID NO: 200081 - DNA, 20 bp, Artificial Sequence
  chemically synthesized
tagggggagtagacaagtga

SEQ ID NO: 200082 - DNA, 20 bp, Artificial Sequence
  chemically synthesized
gggggagtagacaagtgaga

SEQ ID NO: 200083 - DNA, 20 bp, Artificial Sequence
  chemically synthesized
acaagtgagagagtcctttg

SEQ ID NO: 200084 - DNA, 20 bp, Artificial Sequence
  chemically synthesized
agctagttctttaaccacaa

SEQ ID NO: 200085 - DNA, 20 bp, Artificial Sequence
  chemically synthesized
tagctagttctttaaccaca

SEQ ID NO: 200086 - DNA, 20 bp, Artificial Sequence
  chemically synthesized
gagagagtcctttgtggtta

SEQ ID NO: 200087 - DNA, 20 bp, Artificial Sequence
  chemically synthesized
gtcctttgtggttaaagaac

SEQ ID NO: 200088 - DNA, 20 bp, Artificial Sequence
  chemically synthesized
ttcagacctagtttattagc

SEQ ID NO: 200089 - DNA, 20 bp, Artificial Sequence
  chemically synthesized
taaagaactagctaataaac

SEQ ID NO: 200090 - DNA, 20 bp, Artificial Sequence
  chemically synthesized
aaagaactagctaataaact

SEQ ID NO: 200091 - DNA, 20 bp, Artificial Sequence
  chemically synthesized
aactttcagacctagtttat

SEQ ID NO: 200092 - DNA, 20 bp, Artificial Sequence
  chemically synthesized
agctaataaactaggtctga

SEQ ID NO: 200093 - DNA, 20 bp, Artificial Sequence
  chemically synthesized
agagtaacaactttcagacc

SEQ ID NO: 200094 - DNA, 20 bp, Artificial Sequence
  chemically synthesized
agggatagagtaacaacttt

SEQ ID NO: 200095 - DNA, 20 bp, Artificial Sequence
  chemically synthesized
gaaagttgttactctatccc

SEQ ID NO: 200096 - DNA, 20 bp, Artificial Sequence
  chemically synthesized
tatttgttcttccagggata

SEQ ID NO: 200097 - DNA, 20 bp, Artificial Sequence
  chemically synthesized
agttgttactctatccctgg

SEQ ID NO: 200098 - DNA, 20 bp, Artificial Sequence
  chemically synthesized
cttatttgttcttccaggga

SEQ ID NO: 200099 - DNA, 20 bp, Artificial Sequence
  chemically synthesized
aattcttatttgttcttcca

SEQ ID NO: 200100 - DNA, 20 bp, Artificial Sequence
  chemically synthesized
taattcttatttgttcttcc

SEQ ID NO: 200101 - DNA, 20 bp, Artificial Sequence
  chemically synthesized
gtaattcttatttgttcttc

SEQ ID NO: 200102 - DNA, 20 bp, Artificial Sequence
  chemically synthesized
ctatccctggaagaacaaat

SEQ ID NO: 200103 - DNA, 20 bp, Artificial Sequence
  chemically synthesized
agaacaaataagaattactg

SEQ ID NO: 200104 - DNA, 20 bp, Artificial Sequence
  chemically synthesized
gaacaaataagaattactga

SEQ ID NO: 200105 - DNA, 20 bp, Artificial Sequence
  chemically synthesized
attttctgcctaaaagcctt

SEQ ID NO: 200106 - DNA, 20 bp, Artificial Sequence
  chemically synthesized
taagaattactgaaggcttt

SEQ ID NO: 200107 - DNA, 20 bp, Artificial Sequence
  chemically synthesized
aagaattactgaaggctttt

SEQ ID NO: 200108 - DNA, 20 bp, Artificial Sequence
  chemically synthesized
aattactgaaggcttttagg

SEQ ID NO: 200109 - DNA, 20 bp, Artificial Sequence
  chemically synthesized
tgtgttcattttctgcctaa

SEQ ID NO: 200110 - DNA, 20 bp, Artificial Sequence
  chemically synthesized
aggcagaaaatgaacacatt

SEQ ID NO: 200111 - DNA, 20 bp, Artificial Sequence
  chemically synthesized
tgttttttaaaaaattactc

SEQ ID NO: 200112 - DNA, 20 bp, Artificial Sequence
  chemically synthesized
ctatttctacacaaaagcta

SEQ ID NO: 200113 - DNA, 20 bp, Artificial Sequence
  chemically synthesized
atctatttctacacaaaagc

SEQ ID NO: 200114 - DNA, 20 bp, Artificial Sequence
  chemically synthesized
aaattactctagcttttgtg

SEQ ID NO: 200115 - DNA, 20 bp, Artificial Sequence
  chemically synthesized
tccaatctatttctacacaa

SEQ ID NO: 200116 - DNA, 20 bp, Artificial Sequence
  chemically synthesized
ctctagcttttgtgtagaaa

SEQ ID NO: 200117 - DNA, 20 bp, Artificial Sequence
  chemically synthesized
gcttttgtgtagaaatagat

SEQ ID NO: 200118 - DNA, 20 bp, Artificial Sequence
  chemically synthesized
ttttgtgtagaaatagattg

SEQ ID NO: 200119 - DNA, 20 bp, Artificial Sequence
  chemically synthesized
ttgtgtagaaatagattgga

SEQ ID NO: 200120 - DNA, 20 bp, Artificial Sequence
  chemically synthesized
tgtgtagaaatagattggag

SEQ ID NO: 200121 - DNA, 20 bp, Artificial Sequence
  chemically synthesized
tgtagaaatagattggagag

SEQ ID NO: 200122 - DNA, 20 bp, Artificial Sequence
  chemically synthesized
gaaatagattggagaggagc

SEQ ID NO: 200123 - DNA, 20 bp, Artificial Sequence
  chemically synthesized
gaggagcaagactgaaattc

SEQ ID NO: 200124 - DNA, 20 bp, Artificial Sequence
  chemically synthesized
caccctagactctggaattt

SEQ ID NO: 200125 - DNA, 20 bp, Artificial Sequence
  chemically synthesized
ggagcaagactgaaattcca

SEQ ID NO: 200126 - DNA, 20 bp, Artificial Sequence
  chemically synthesized
aagactgaaattccagagtc

SEQ ID NO: 200127 - DNA, 20 bp, Artificial Sequence
  chemically synthesized
agactgaaattccagagtct

SEQ ID NO: 200128 - DNA, 20 bp, Artificial Sequence
  chemically synthesized
gactgaaattccagagtcta

SEQ ID NO: 200129 - DNA, 20 bp, Artificial Sequence
  chemically synthesized
tatttctacaccctagactc

SEQ ID NO: 200130 - DNA, 20 bp, Artificial Sequence
  chemically synthesized
aaattccagagtctagggtg

SEQ ID NO: 200131 - DNA, 20 bp, Artificial Sequence
  chemically synthesized
tccaatctatttctacaccc

SEQ ID NO: 200132 - DNA, 20 bp, Artificial Sequence
  chemically synthesized
cagagtctagggtgtagaaa

SEQ ID NO: 200133 - DNA, 20 bp, Artificial Sequence
  chemically synthesized
tctagggtgtagaaatagat

SEQ ID NO: 200134 - DNA, 20 bp, Artificial Sequence
  chemically synthesized
tagggtgtagaaatagattg

SEQ ID NO: 200135 - DNA, 20 bp, Artificial Sequence
  chemically synthesized
gggtgtagaaatagattgga

SEQ ID NO: 200136 - DNA, 20 bp, Artificial Sequence
  chemically synthesized
ggtgtagaaatagattggag

SEQ ID NO: 200137 - DNA, 20 bp, Artificial Sequence
  chemically synthesized
tgtagaaatagattggagag

SEQ ID NO: 200138 - DNA, 20 bp, Artificial Sequence
  chemically synthesized
gaaatagattggagaggagc

SEQ ID NO: 200139 - DNA, 20 bp, Artificial Sequence
  chemically synthesized
gaggagcaagactgaaattc

SEQ ID NO: 200140 - DNA, 20 bp, Artificial Sequence
  chemically synthesized
ttgcctagactctggaattt

SEQ ID NO: 200141 - DNA, 20 bp, Artificial Sequence
  chemically synthesized
ggagcaagactgaaattcca

SEQ ID NO: 200142 - DNA, 20 bp, Artificial Sequence
  chemically synthesized
aagactgaaattccagagtc

SEQ ID NO: 200143 - DNA, 20 bp, Artificial Sequence
  chemically synthesized
agactgaaattccagagtct

SEQ ID NO: 200144 - DNA, 20 bp, Artificial Sequence
  chemically synthesized
actatctcttgcctagactc

SEQ ID NO: 200145 - DNA, 20 bp, Artificial Sequence
  chemically synthesized
tgaaattccagagtctaggc

SEQ ID NO: 200146 - DNA, 20 bp, Artificial Sequence
  chemically synthesized
aaattccagagtctaggcaa

SEQ ID NO: 200147 - DNA, 20 bp, Artificial Sequence
  chemically synthesized
tcaaaacactatctcttgcc

SEQ ID NO: 200148 - DNA, 20 bp, Artificial Sequence
  chemically synthesized
tccagagtctaggcaagaga

SEQ ID NO: 200149 - DNA, 20 bp, Artificial Sequence
  chemically synthesized
gagatagtgttttgaaatct

SEQ ID NO: 200150 - DNA, 20 bp, Artificial Sequence
  chemically synthesized
atagtgttttgaaatctaag

SEQ ID NO: 200151 - DNA, 20 bp, Artificial Sequence
  chemically synthesized
tagtgttttgaaatctaagc

SEQ ID NO: 200152 - DNA, 20 bp, Artificial Sequence
  chemically synthesized
gtgttttgaaatctaagcag

SEQ ID NO: 200153 - DNA, 20 bp, Artificial Sequence
  chemically synthesized
gatgaccctgatctcctgct

SEQ ID NO: 200154 - DNA, 20 bp, Artificial Sequence
  chemically synthesized
ttgaaatctaagcaggagat

SEQ ID NO: 200155 - DNA, 20 bp, Artificial Sequence
  chemically synthesized
tgaaatctaagcaggagatc

SEQ ID NO: 200156 - DNA, 20 bp, Artificial Sequence
  chemically synthesized
gaaatctaagcaggagatca

SEQ ID NO: 200157 - DNA, 20 bp, Artificial Sequence
  chemically synthesized
gatcagggtcatctgacttt

SEQ ID NO: 200158 - DNA, 20 bp, Artificial Sequence
  chemically synthesized
ttacacccaaaaccaaaagt

SEQ ID NO: 200159 - DNA, 20 bp, Artificial Sequence
  chemically synthesized
ggtcatctgacttttggttt

SEQ ID NO: 200160 - DNA, 20 bp, Artificial Sequence
  chemically synthesized
atctttacacccaaaaccaa

SEQ ID NO: 200161 - DNA, 20 bp, Artificial Sequence
  chemically synthesized
gtcatctgacttttggtttt

SEQ ID NO: 200162 - DNA, 20 bp, Artificial Sequence
  chemically synthesized
gacttttggttttgggtgta

SEQ ID NO: 200163 - DNA, 20 bp, Artificial Sequence
  chemically synthesized
tttggttttgggtgtaaaga

SEQ ID NO: 200164 - DNA, 20 bp, Artificial Sequence
  chemically synthesized
ttggttttgggtgtaaagat

SEQ ID NO: 200165 - DNA, 20 bp, Artificial Sequence
  chemically synthesized
tggttttgggtgtaaagatg

SEQ ID NO: 200166 - DNA, 20 bp, Artificial Sequence
  chemically synthesized
ggtgtaaagatggggaaaat

SEQ ID NO: 200167 - DNA, 20 bp, Artificial Sequence
  chemically synthesized
atggggaaaataagacattc

SEQ ID NO: 200168 - DNA, 20 bp, Artificial Sequence
  chemically synthesized
ggggaaaataagacattcta

SEQ ID NO: 200169 - DNA, 20 bp, Artificial Sequence
  chemically synthesized
ggaaaataagacattctaga

SEQ ID NO: 200170 - DNA, 20 bp, Artificial Sequence
  chemically synthesized
acgttcttacattttctctc

SEQ ID NO: 200171 - DNA, 20 bp, Artificial Sequence
  chemically synthesized
acattctagagagaaaatgt

SEQ ID NO: 200172 - DNA, 20 bp, Artificial Sequence
  chemically synthesized
acgtatttaacaacaaaact

SEQ ID NO: 200173 - DNA, 20 bp, Artificial Sequence
  chemically synthesized
tatacctccaattaatcact

SEQ ID NO: 200174 - DNA, 20 bp, Artificial Sequence
  chemically synthesized
aacaaaacttagtgattaat

SEQ ID NO: 200175 - DNA, 20 bp, Artificial Sequence
  chemically synthesized
caaaacttagtgattaattg

SEQ ID NO: 200176 - DNA, 20 bp, Artificial Sequence
  chemically synthesized
aaaacttagtgattaattgg

SEQ ID NO: 200177 - DNA, 20 bp, Artificial Sequence
  chemically synthesized
ttagtgattaattggaggta

SEQ ID NO: 200178 - DNA, 20 bp, Artificial Sequence
  chemically synthesized
tgattaattggaggtataga

SEQ ID NO: 200179 - DNA, 20 bp, Artificial Sequence
  chemically synthesized
ttggaggtatagatggtgtc

SEQ ID NO: 200180 - DNA, 20 bp, Artificial Sequence
  chemically synthesized
tggaggtatagatggtgtcc

SEQ ID NO: 200181 - DNA, 20 bp, Artificial Sequence
  chemically synthesized
agttgaataaagcagaagcc

SEQ ID NO: 200182 - DNA, 20 bp, Artificial Sequence
  chemically synthesized
cacttagttgaataaagcag

SEQ ID NO: 200183 - DNA, 20 bp, Artificial Sequence
  chemically synthesized
atccacttagttgaataaag

SEQ ID NO: 200184 - DNA, 20 bp, Artificial Sequence
  chemically synthesized
accatccacttagttgaata

SEQ ID NO: 200185 - DNA, 20 bp, Artificial Sequence
  chemically synthesized
ggcttctgctttattcaact

SEQ ID NO: 200186 - DNA, 20 bp, Artificial Sequence
  chemically synthesized
ttctgctttattcaactaag

SEQ ID NO: 200187 - DNA, 20 bp, Artificial Sequence
  chemically synthesized
gctttattcaactaagtgga

SEQ ID NO: 200188 - DNA, 20 bp, Artificial Sequence
  chemically synthesized
taatatgaccaccatccact

SEQ ID NO: 200189 - DNA, 20 bp, Artificial Sequence
  chemically synthesized
ttattcaactaagtggatgg

SEQ ID NO: 200190 - DNA, 20 bp, Artificial Sequence
  chemically synthesized
ggtggtcatattaaataaat

SEQ ID NO: 200191 - DNA, 20 bp, Artificial Sequence
  chemically synthesized
gtggtcatattaaataaatc

SEQ ID NO: 200192 - DNA, 20 bp, Artificial Sequence
  chemically synthesized
tggtcatattaaataaatca

SEQ ID NO: 200193 - DNA, 20 bp, Artificial Sequence
  chemically synthesized
gtcatattaaataaatcagg

SEQ ID NO: 200194 - DNA, 20 bp, Artificial Sequence
  chemically synthesized
tattaaataaatcagggagc

SEQ ID NO: 200195 - DNA, 20 bp, Artificial Sequence
  chemically synthesized
attaaataaatcagggagcc

SEQ ID NO: 200196 - DNA, 20 bp, Artificial Sequence
  chemically synthesized
ttaaataaatcagggagcca

SEQ ID NO: 200197 - DNA, 20 bp, Artificial Sequence
  chemically synthesized
aaataaatcagggagccagg

SEQ ID NO: 200198 - DNA, 20 bp, Artificial Sequence
  chemically synthesized
aataaatcagggagccaggg

SEQ ID NO: 200199 - DNA, 20 bp, Artificial Sequence
  chemically synthesized
taaatcagggagccagggag

SEQ ID NO: 200200 - DNA, 20 bp, Artificial Sequence
  chemically synthesized
taaattctgcttctcctccc

SEQ ID NO: 200201 - DNA, 20 bp, Artificial Sequence
  chemically synthesized
atcagggagccagggaggag

SEQ ID NO: 200202 - DNA, 20 bp, Artificial Sequence
  chemically synthesized
agggagccagggaggagaag

SEQ ID NO: 200203 - DNA, 20 bp, Artificial Sequence
  chemically synthesized
gggaggagaagcagaattta

SEQ ID NO: 200204 - DNA, 20 bp, Artificial Sequence
  chemically synthesized
gagaagcagaatttatagat

SEQ ID NO: 200205 - DNA, 20 bp, Artificial Sequence
  chemically synthesized
agaagcagaatttatagatg

SEQ ID NO: 200206 - DNA, 20 bp, Artificial Sequence
  chemically synthesized
gaatttatagatgaggtgat

SEQ ID NO: 200207 - DNA, 20 bp, Artificial Sequence
  chemically synthesized
tatagatgaggtgatgagct

SEQ ID NO: 200208 - DNA, 20 bp, Artificial Sequence
  chemically synthesized
atagatgaggtgatgagctc

SEQ ID NO: 200209 - DNA, 20 bp, Artificial Sequence
  chemically synthesized
atgaggtgatgagctcaggt

SEQ ID NO: 200210 - DNA, 20 bp, Artificial Sequence
  chemically synthesized
caagcttaaaatactcacct

SEQ ID NO: 200211 - DNA, 20 bp, Artificial Sequence
  chemically synthesized
tgagctcaggtgagtatttt

SEQ ID NO: 200212 - DNA, 20 bp, Artificial Sequence
  chemically synthesized
aggtgagtattttaagcttg

SEQ ID NO: 200213 - DNA, 20 bp, Artificial Sequence
  chemically synthesized
agatgtccctcaggtgcttc

SEQ ID NO: 200214 - DNA, 20 bp, Artificial Sequence
  chemically synthesized
attttaagcttgaagcacct

SEQ ID NO: 200215 - DNA, 20 bp, Artificial Sequence
  chemically synthesized
ttttaagcttgaagcacctg

SEQ ID NO: 200216 - DNA, 20 bp, Artificial Sequence
  chemically synthesized
tttaagcttgaagcacctga

SEQ ID NO: 200217 - DNA, 20 bp, Artificial Sequence
  chemically synthesized
tctctatttagatgtccctc

SEQ ID NO: 200218 - DNA, 20 bp, Artificial Sequence
  chemically synthesized
atctctatttagatgtccct

SEQ ID NO: 200219 - DNA, 20 bp, Artificial Sequence
  chemically synthesized
gcacctgagggacatctaaa

SEQ ID NO: 200220 - DNA, 20 bp, Artificial Sequence
  chemically synthesized
acctgagggacatctaaata

SEQ ID NO: 200221 - DNA, 20 bp, Artificial Sequence
  chemically synthesized
atgtctaatagatctctatt

SEQ ID NO: 200222 - DNA, 20 bp, Artificial Sequence
  chemically synthesized
acatctaaatagagatctat

SEQ ID NO: 200223 - DNA, 20 bp, Artificial Sequence
  chemically synthesized
aagaatacacaaatgtctaa

SEQ ID NO: 200224 - DNA, 20 bp, Artificial Sequence
  chemically synthesized
tagacatttgtgtattcttg

SEQ ID NO: 200225 - DNA, 20 bp, Artificial Sequence
  chemically synthesized
catttttctgaggaagctac

SEQ ID NO: 200226 - DNA, 20 bp, Artificial Sequence
  chemically synthesized
gtgtattcttgtagcttcct

SEQ ID NO: 200227 - DNA, 20 bp, Artificial Sequence
  chemically synthesized
cccaaatcatttttctgagg

SEQ ID NO: 200228 - DNA, 20 bp, Artificial Sequence
  chemically synthesized
cagcccaaatcatttttctg

SEQ ID NO: 200229 - DNA, 20 bp, Artificial Sequence
  chemically synthesized
ccagcccaaatcatttttct

SEQ ID NO: 200230 - DNA, 20 bp, Artificial Sequence
  chemically synthesized
gcttcctcagaaaaatgatt

SEQ ID NO: 200231 - DNA, 20 bp, Artificial Sequence
  chemically synthesized
cttcctcagaaaaatgattt

SEQ ID NO: 200232 - DNA, 20 bp, Artificial Sequence
  chemically synthesized
ctcagaaaaatgatttgggc

SEQ ID NO: 200233 - DNA, 20 bp, Artificial Sequence
  chemically synthesized
aatgatttgggctggaatta

SEQ ID NO: 200234 - DNA, 20 bp, Artificial Sequence
  chemically synthesized
tgacccttaagctataattc

SEQ ID NO: 200235 - DNA, 20 bp, Artificial Sequence
  chemically synthesized
ttgggctggaattatagctt

SEQ ID NO: 200236 - DNA, 20 bp, Artificial Sequence
  chemically synthesized
tgggctggaattatagctta

SEQ ID NO: 200237 - DNA, 20 bp, Artificial Sequence
  chemically synthesized
gggctggaattatagcttaa

SEQ ID NO: 200238 - DNA, 20 bp, Artificial Sequence
  chemically synthesized
ttcttatgttgatgaccctt

SEQ ID NO: 200239 - DNA, 20 bp, Artificial Sequence
  chemically synthesized
agcttaagggtcatcaacat

SEQ ID NO: 200240 - DNA, 20 bp, Artificial Sequence
  chemically synthesized
aagggtcatcaacataagaa

SEQ ID NO: 200241 - DNA, 20 bp, Artificial Sequence
  chemically synthesized
aagaatggtaattgcgttca

SEQ ID NO: 200242 - DNA, 20 bp, Artificial Sequence
  chemically synthesized
tggtaattgcgttcaaagac

SEQ ID NO: 200243 - DNA, 20 bp, Artificial Sequence
  chemically synthesized
cctcttacttgacattatgt

SEQ ID NO: 200244 - DNA, 20 bp, Artificial Sequence
  chemically synthesized
tcctcttacttgacattatg

SEQ ID NO: 200245 - DNA, 20 bp, Artificial Sequence
  chemically synthesized
aagattacccacataatgtc

SEQ ID NO: 200246 - DNA, 20 bp, Artificial Sequence
  chemically synthesized
ttacccacataatgtcaagt

SEQ ID NO: 200247 - DNA, 20 bp, Artificial Sequence
  chemically synthesized
acccacataatgtcaagtaa

SEQ ID NO: 200248 - DNA, 20 bp, Artificial Sequence
  chemically synthesized
cccacataatgtcaagtaag

SEQ ID NO: 200249 - DNA, 20 bp, Artificial Sequence
  chemically synthesized
ataatgtcaagtaagaggaa

SEQ ID NO: 200250 - DNA, 20 bp, Artificial Sequence
  chemically synthesized
aatgtcaagtaagaggaaaa

SEQ ID NO: 200251 - DNA, 20 bp, Artificial Sequence
  chemically synthesized
atgtcaagtaagaggaaaag

SEQ ID NO: 200252 - DNA, 20 bp, Artificial Sequence
  chemically synthesized
agtaagaggaaaagaggtcc

SEQ ID NO: 200253 - DNA, 20 bp, Artificial Sequence
  chemically synthesized
atccttcatagttttgatct

SEQ ID NO: 200254 - DNA, 20 bp, Artificial Sequence
  chemically synthesized
catccttcatagttttgatc

SEQ ID NO: 200255 - DNA, 20 bp, Artificial Sequence
  chemically synthesized
ggtcctagatcaaaactatg

SEQ ID NO: 200256 - DNA, 20 bp, Artificial Sequence
  chemically synthesized
gtcctagatcaaaactatga

SEQ ID NO: 200257 - DNA, 20 bp, Artificial Sequence
  chemically synthesized
agtattgacgacatccttca

SEQ ID NO: 200258 - DNA, 20 bp, Artificial Sequence
  chemically synthesized
aggatgtcgtcaatacttaa

SEQ ID NO: 200259 - DNA, 20 bp, Artificial Sequence
  chemically synthesized
atgtcgtcaatacttaatgg

SEQ ID NO: 200260 - DNA, 20 bp, Artificial Sequence
  chemically synthesized
tgtcgtcaatacttaatgga

SEQ ID NO: 200261 - DNA, 20 bp, Artificial Sequence
  chemically synthesized
gtcgtcaatacttaatggaa

SEQ ID NO: 200262 - DNA, 20 bp, Artificial Sequence
  chemically synthesized
tcctcatctgcccttccatt

SEQ ID NO: 200263 - DNA, 20 bp, Artificial Sequence
  chemically synthesized
gtcaatacttaatggaaggg

SEQ ID NO: 200264 - DNA, 20 bp, Artificial Sequence
  chemically synthesized
tacttaatggaagggcagat

SEQ ID NO: 200265 - DNA, 20 bp, Artificial Sequence
  chemically synthesized
acttaatggaagggcagatg

SEQ ID NO: 200266 - DNA, 20 bp, Artificial Sequence
  chemically synthesized
gggcagatgaggaattcaca

SEQ ID NO: 200267 - DNA, 20 bp, Artificial Sequence
  chemically synthesized
ggcagatgaggaattcacaa

SEQ ID NO: 200268 - DNA, 20 bp, Artificial Sequence
  chemically synthesized
cagatgaggaattcacaaag

SEQ ID NO: 200269 - DNA, 20 bp, Artificial Sequence
  chemically synthesized
gaggaattcacaaaggagtt

SEQ ID NO: 200270 - DNA, 20 bp, Artificial Sequence
  chemically synthesized
ggaattcacaaaggagttaa

SEQ ID NO: 200271 - DNA, 20 bp, Artificial Sequence
  chemically synthesized
tcacaaaggagttaagagtg

SEQ ID NO: 200272 - DNA, 20 bp, Artificial Sequence
  chemically synthesized
acaaaggagttaagagtgta

SEQ ID NO: 200273 - DNA, 20 bp, Artificial Sequence
  chemically synthesized
ttaagagtgtagagtcatat

SEQ ID NO: 200274 - DNA, 20 bp, Artificial Sequence
  chemically synthesized
gagtgtagagtcatataagc

SEQ ID NO: 200275 - DNA, 20 bp, Artificial Sequence
  chemically synthesized
agtgtagagtcatataagca

SEQ ID NO: 200276 - DNA, 20 bp, Artificial Sequence
  chemically synthesized
agagtcatataagcaaggaa

SEQ ID NO: 200277 - DNA, 20 bp, Artificial Sequence
  chemically synthesized
agtcatataagcaaggaaca

SEQ ID NO: 200278 - DNA, 20 bp, Artificial Sequence
  chemically synthesized
agcaaggaacagagtgtttt

SEQ ID NO: 200279 - DNA, 20 bp, Artificial Sequence
  chemically synthesized
aaggaacagagtgttttaag

SEQ ID NO: 200280 - DNA, 20 bp, Artificial Sequence
  chemically synthesized
acagagtgttttaagcagaa

SEQ ID NO: 200281 - DNA, 20 bp, Artificial Sequence
  chemically synthesized
agagtgttttaagcagaaca

SEQ ID NO: 200282 - DNA, 20 bp, Artificial Sequence
  chemically synthesized
tttaagcagaacagagttga

SEQ ID NO: 200283 - DNA, 20 bp, Artificial Sequence
  chemically synthesized
aagcagaacagagttgacag

SEQ ID NO: 200284 - DNA, 20 bp, Artificial Sequence
  chemically synthesized
agttgacagtggtccataat

SEQ ID NO: 200285 - DNA, 20 bp, Artificial Sequence
  chemically synthesized
gttgacagtggtccataata

SEQ ID NO: 200286 - DNA, 20 bp, Artificial Sequence
  chemically synthesized
tatcctagttcaccttatta

SEQ ID NO: 200287 - DNA, 20 bp, Artificial Sequence
  chemically synthesized
tggtccataataaggtgaac

SEQ ID NO: 200288 - DNA, 20 bp, Artificial Sequence
  chemically synthesized
ggtccataataaggtgaact

SEQ ID NO: 200289 - DNA, 20 bp, Artificial Sequence
  chemically synthesized
taataaggtgaactaggata

SEQ ID NO: 200290 - DNA, 20 bp, Artificial Sequence
  chemically synthesized
gtcctctacagtctttatcc

SEQ ID NO: 200291 - DNA, 20 bp, Artificial Sequence
  chemically synthesized
gtgaactaggataaagactg

SEQ ID NO: 200292 - DNA, 20 bp, Artificial Sequence
  chemically synthesized
gaactaggataaagactgta

SEQ ID NO: 200293 - DNA, 20 bp, Artificial Sequence
  chemically synthesized
aactaggataaagactgtag

SEQ ID NO: 200294 - DNA, 20 bp, Artificial Sequence
  chemically synthesized
taaatttggtgggtcctcta

SEQ ID NO: 200295 - DNA, 20 bp, Artificial Sequence
  chemically synthesized
ctcatgttgctaaatttggt

SEQ ID NO: 200296 - DNA, 20 bp, Artificial Sequence
  chemically synthesized
tgtagaggacccaccaaatt

SEQ ID NO: 200297 - DNA, 20 bp, Artificial Sequence
  chemically synthesized
cctcatgttgctaaatttgg

SEQ ID NO: 200298 - DNA, 20 bp, Artificial Sequence
  chemically synthesized
ggtcctcatgttgctaaatt

SEQ ID NO: 200299 - DNA, 20 bp, Artificial Sequence
  chemically synthesized
cccaccaaatttagcaacat

SEQ ID NO: 200300 - DNA, 20 bp, Artificial Sequence
  chemically synthesized
ccaccaaatttagcaacatg

SEQ ID NO: 200301 - DNA, 20 bp, Artificial Sequence
  chemically synthesized
tttagcaacatgaggaccat

SEQ ID NO: 200302 - DNA, 20 bp, Artificial Sequence
  chemically synthesized
actctcatcaaggacactga

SEQ ID NO: 200303 - DNA, 20 bp, Artificial Sequence
  chemically synthesized
ggaccatcagtgtccttgat

SEQ ID NO: 200304 - DNA, 20 bp, Artificial Sequence
  chemically synthesized
accatcagtgtccttgatga

SEQ ID NO: 200305 - DNA, 20 bp, Artificial Sequence
  chemically synthesized
catgggaggtactctcatca

SEQ ID NO: 200306 - DNA, 20 bp, Artificial Sequence
  chemically synthesized
tcatgggaggtactctcatc

SEQ ID NO: 200307 - DNA, 20 bp, Artificial Sequence
  chemically synthesized
ttgatgagagtacctcccat

SEQ ID NO: 200308 - DNA, 20 bp, Artificial Sequence
  chemically synthesized
tagcagcaaaggctcatggg

SEQ ID NO: 200309 - DNA, 20 bp, Artificial Sequence
  chemically synthesized
ctagcagcaaaggctcatgg

SEQ ID NO: 200310 - DNA, 20 bp, Artificial Sequence
  chemically synthesized
ttctagcagcaaaggctcat

SEQ ID NO: 200311 - DNA, 20 bp, Artificial Sequence
  chemically synthesized
cttctagcagcaaaggctca

SEQ ID NO: 200312 - DNA, 20 bp, Artificial Sequence
  chemically synthesized
ctcccatgagcctttgctgc

SEQ ID NO: 200313 - DNA, 20 bp, Artificial Sequence
  chemically synthesized
acattgacttctagcagcaa

SEQ ID NO: 200314 - DNA, 20 bp, Artificial Sequence
  chemically synthesized
cacattgacttctagcagca

SEQ ID NO: 200315 - DNA, 20 bp, Artificial Sequence
  chemically synthesized
ccatgagcctttgctgctag

SEQ ID NO: 200316 - DNA, 20 bp, Artificial Sequence
  chemically synthesized
cactgcacattgacttctag

SEQ ID NO: 200317 - DNA, 20 bp, Artificial Sequence
  chemically synthesized
acacactgcacattgacttc

SEQ ID NO: 200318 - DNA, 20 bp, Artificial Sequence
  chemically synthesized
tgctgctagaagtcaatgtg

SEQ ID NO: 200319 - DNA, 20 bp, Artificial Sequence
  chemically synthesized
agtcaatgtgcagtgtgtta

SEQ ID NO: 200320 - DNA, 20 bp, Artificial Sequence
  chemically synthesized
caatgtgcagtgtgttaaag

SEQ ID NO: 200321 - DNA, 20 bp, Artificial Sequence
  chemically synthesized
aatgtgcagtgtgttaaagc

SEQ ID NO: 200322 - DNA, 20 bp, Artificial Sequence
  chemically synthesized
atgtgcagtgtgttaaagca

SEQ ID NO: 200323 - DNA, 20 bp, Artificial Sequence
  chemically synthesized
gcagtgtgttaaagcagggc

SEQ ID NO: 200324 - DNA, 20 bp, Artificial Sequence
  chemically synthesized
ttgtctccacatcatgttgc

SEQ ID NO: 200325 - DNA, 20 bp, Artificial Sequence
  chemically synthesized
gcagggctggcaacatgatg

SEQ ID NO: 200326 - DNA, 20 bp, Artificial Sequence
  chemically synthesized
agggctggcaacatgatgtg

SEQ ID NO: 200327 - DNA, 20 bp, Artificial Sequence
  chemically synthesized
tgatgtggagacaacaaata

SEQ ID NO: 200328 - DNA, 20 bp, Artificial Sequence
  chemically synthesized
gtggagacaacaaatataga

SEQ ID NO: 200329 - DNA, 20 bp, Artificial Sequence
  chemically synthesized
tggagacaacaaatatagat

SEQ ID NO: 200330 - DNA, 20 bp, Artificial Sequence
  chemically synthesized
tatagataggttgtttatga

SEQ ID NO: 200331 - DNA, 20 bp, Artificial Sequence
  chemically synthesized
tagataggttgtttatgata

SEQ ID NO: 200332 - DNA, 20 bp, Artificial Sequence
  chemically synthesized
agataggttgtttatgatag

SEQ ID NO: 200333 - DNA, 20 bp, Artificial Sequence
  chemically synthesized
gataggttgtttatgataga

SEQ ID NO: 200334 - DNA, 20 bp, Artificial Sequence
  chemically synthesized
atgatagagggttatctgta

SEQ ID NO: 200335 - DNA, 20 bp, Artificial Sequence
  chemically synthesized
tgatagagggttatctgtaa

SEQ ID NO: 200336 - DNA, 20 bp, Artificial Sequence
  chemically synthesized
agagggttatctgtaaagga

SEQ ID NO: 200337 - DNA, 20 bp, Artificial Sequence
  chemically synthesized
tccctcttgactttccttta

SEQ ID NO: 200338 - DNA, 20 bp, Artificial Sequence
  chemically synthesized
gttatctgtaaaggaaagtc

SEQ ID NO: 200339 - DNA, 20 bp, Artificial Sequence
  chemically synthesized
tatctgtaaaggaaagtcaa

SEQ ID NO: 200340 - DNA, 20 bp, Artificial Sequence
  chemically synthesized
atctgtaaaggaaagtcaag

SEQ ID NO: 200341 - DNA, 20 bp, Artificial Sequence
  chemically synthesized
tctgtaaaggaaagtcaaga

SEQ ID NO: 200342 - DNA, 20 bp, Artificial Sequence
  chemically synthesized
aaagtcaagagggaaataac

SEQ ID NO: 200343 - DNA, 20 bp, Artificial Sequence
  chemically synthesized
caagagggaaataaccagtg

SEQ ID NO: 200344 - DNA, 20 bp, Artificial Sequence
  chemically synthesized
ttgaagtctatgtgctacac

SEQ ID NO: 200345 - DNA, 20 bp, Artificial Sequence
  chemically synthesized
gaaataaccagtgtagcaca

SEQ ID NO: 200346 - DNA, 20 bp, Artificial Sequence
  chemically synthesized
cagtgtagcacatagacttc

SEQ ID NO: 200347 - DNA, 20 bp, Artificial Sequence
  chemically synthesized
agtgtagcacatagacttca

SEQ ID NO: 200348 - DNA, 20 bp, Artificial Sequence
  chemically synthesized
gtgtagcacatagacttcaa

SEQ ID NO: 200349 - DNA, 20 bp, Artificial Sequence
  chemically synthesized
aatcattaaaacaacccttg

SEQ ID NO: 200350 - DNA, 20 bp, Artificial Sequence
  chemically synthesized
taatgattaaacaaaaatac

SEQ ID NO: 200351 - DNA, 20 bp, Artificial Sequence
  chemically synthesized
atgattaaacaaaaatacta

SEQ ID NO: 200352 - DNA, 20 bp, Artificial Sequence
  chemically synthesized
atgagcatttgaacattctc

SEQ ID NO: 200353 - DNA, 20 bp, Artificial Sequence
  chemically synthesized
agagaatgttcaaatgctca

SEQ ID NO: 200354 - DNA, 20 bp, Artificial Sequence
  chemically synthesized
agattgatcccatattctat

SEQ ID NO: 200355 - DNA, 20 bp, Artificial Sequence
  chemically synthesized
gttcaaatgctcatagaata

SEQ ID NO: 200356 - DNA, 20 bp, Artificial Sequence
  chemically synthesized
ttcaaatgctcatagaatat

SEQ ID NO: 200357 - DNA, 20 bp, Artificial Sequence
  chemically synthesized
cctatcagtattttgagaaa

SEQ ID NO: 200358 - DNA, 20 bp, Artificial Sequence
  chemically synthesized
atcctatcagtattttgaga

SEQ ID NO: 200359 - DNA, 20 bp, Artificial Sequence
  chemically synthesized
catcatcctatcagtatttt

SEQ ID NO: 200360 - DNA, 20 bp, Artificial Sequence
  chemically synthesized
tctctttctcaaaatactga

SEQ ID NO: 200361 - DNA, 20 bp, Artificial Sequence
  chemically synthesized
ctctttctcaaaatactgat

SEQ ID NO: 200362 - DNA, 20 bp, Artificial Sequence
  chemically synthesized
gatttttcacatcatcctat

SEQ ID NO: 200363 - DNA, 20 bp, Artificial Sequence
  chemically synthesized
gtgaaaaatcatgtcttcat

SEQ ID NO: 200364 - DNA, 20 bp, Artificial Sequence
  chemically synthesized
aaaatcatgtcttcatgagc

SEQ ID NO: 200365 - DNA, 20 bp, Artificial Sequence
  chemically synthesized
ctccacattgcttgctcatg

SEQ ID NO: 200366 - DNA, 20 bp, Artificial Sequence
  chemically synthesized
gtcttcatgagcaagcaatg

SEQ ID NO: 200367 - DNA, 20 bp, Artificial Sequence
  chemically synthesized
cttcatgagcaagcaatgtg

SEQ ID NO: 200368 - DNA, 20 bp, Artificial Sequence
  chemically synthesized
ttcatgagcaagcaatgtgg

SEQ ID NO: 200369 - DNA, 20 bp, Artificial Sequence
  chemically synthesized
atgagcaagcaatgtggagg

SEQ ID NO: 200370 - DNA, 20 bp, Artificial Sequence
  chemically synthesized
gtggaggcagtatattccca

SEQ ID NO: 200371 - DNA, 20 bp, Artificial Sequence
  chemically synthesized
cttccatgaatatgttctgt

SEQ ID NO: 200372 - DNA, 20 bp, Artificial Sequence
  chemically synthesized
acttccatgaatatgttctg

SEQ ID NO: 200373 - DNA, 20 bp, Artificial Sequence
  chemically synthesized
attcccacagaacatattca

SEQ ID NO: 200374 - DNA, 20 bp, Artificial Sequence
  chemically synthesized
cccacagaacatattcatgg

SEQ ID NO: 200375 - DNA, 20 bp, Artificial Sequence
  chemically synthesized
ttaacacaaaatattttacc

SEQ ID NO: 200376 - DNA, 20 bp, Artificial Sequence
  chemically synthesized
ttttagagatggtcattact

SEQ ID NO: 200377 - DNA, 20 bp, Artificial Sequence
  chemically synthesized
tacaaatgtgattttagaga

SEQ ID NO: 200378 - DNA, 20 bp, Artificial Sequence
  chemically synthesized
tttttacaaatgtgatttta

SEQ ID NO: 200379 - DNA, 20 bp, Artificial Sequence
  chemically synthesized
agtttttacaaatgtgattt

SEQ ID NO: 200380 - DNA, 20 bp, Artificial Sequence
  chemically synthesized
aaaatcacatttgtaaaaac

SEQ ID NO: 200381 - DNA, 20 bp, Artificial Sequence
  chemically synthesized
gaagatttaataaagcacgc

SEQ ID NO: 200382 - DNA, 20 bp, Artificial Sequence
  chemically synthesized
ttgcccatgaagatttaata

SEQ ID NO: 200383 - DNA, 20 bp, Artificial Sequence
  chemically synthesized
cgtgctttattaaatcttca

SEQ ID NO: 200384 - DNA, 20 bp, Artificial Sequence
  chemically synthesized
gtgctttattaaatcttcat

SEQ ID NO: 200385 - DNA, 20 bp, Artificial Sequence
  chemically synthesized
tttattaaatcttcatgggc

SEQ ID NO: 200386 - DNA, 20 bp, Artificial Sequence
  chemically synthesized
atcagttaatcttgcccatg

SEQ ID NO: 200387 - DNA, 20 bp, Artificial Sequence
  chemically synthesized
tcatgggcaagattaactga

SEQ ID NO: 200388 - DNA, 20 bp, Artificial Sequence
  chemically synthesized
gcaagattaactgatagaca

SEQ ID NO: 200389 - DNA, 20 bp, Artificial Sequence
  chemically synthesized
aataaatgctctgtgtctat

SEQ ID NO: 200390 - DNA, 20 bp, Artificial Sequence
  chemically synthesized
aagattaactgatagacaca

SEQ ID NO: 200391 - DNA, 20 bp, Artificial Sequence
  chemically synthesized
catttatttgttcaaatgtt

SEQ ID NO: 200392 - DNA, 20 bp, Artificial Sequence
  chemically synthesized
aatgttgagaattacaaatt

SEQ ID NO: 200393 - DNA, 20 bp, Artificial Sequence
  chemically synthesized
atgttgagaattacaaattg

SEQ ID NO: 200394 - DNA, 20 bp, Artificial Sequence
  chemically synthesized
ggaataattatttctaatga

SEQ ID NO: 200395 - DNA, 20 bp, Artificial Sequence
  chemically synthesized
gagttttaagaatctatcat

SEQ ID NO: 200396 - DNA, 20 bp, Artificial Sequence
  chemically synthesized
tctttaataataagagtttt

SEQ ID NO: 200397 - DNA, 20 bp, Artificial Sequence
  chemically synthesized
tattatatctttaataataa

SEQ ID NO: 200398 - DNA, 20 bp, Artificial Sequence
  chemically synthesized
tcttaaaactcttattatta

SEQ ID NO: 200399 - DNA, 20 bp, Artificial Sequence
  chemically synthesized
tgtattatatctttaataat

SEQ ID NO: 200400 - DNA, 20 bp, Artificial Sequence
  chemically synthesized
ataactgaaaattattgttt

SEQ ID NO: 200401 - DNA, 20 bp, Artificial Sequence
  chemically synthesized
tacactaaaacaataatttt

SEQ ID NO: 200402 - DNA, 20 bp, Artificial Sequence
  chemically synthesized
aaaacaataattttcagtta

SEQ ID NO: 200403 - DNA, 20 bp, Artificial Sequence
  chemically synthesized
tcgtttgaatcaatggaagg

SEQ ID NO: 200404 - DNA, 20 bp, Artificial Sequence
  chemically synthesized
ttcgtttgaatcaatggaag

SEQ ID NO: 200405 - DNA, 20 bp, Artificial Sequence
  chemically synthesized
ctttcgtttgaatcaatgga

SEQ ID NO: 200406 - DNA, 20 bp, Artificial Sequence
  chemically synthesized
tctttcgtttgaatcaatgg

SEQ ID NO: 200407 - DNA, 20 bp, Artificial Sequence
  chemically synthesized
gtgtctttcgtttgaatcaa

SEQ ID NO: 200408 - DNA, 20 bp, Artificial Sequence
  chemically synthesized
ccttccattgattcaaacga

SEQ ID NO: 200409 - DNA, 20 bp, Artificial Sequence
  chemically synthesized
attcaaacgaaagacacaca

SEQ ID NO: 200410 - DNA, 20 bp, Artificial Sequence
  chemically synthesized
agcttgacagtatttatgca

SEQ ID NO: 200411 - DNA, 20 bp, Artificial Sequence
  chemically synthesized
aaccgtgcataaatactgtc

SEQ ID NO: 200412 - DNA, 20 bp, Artificial Sequence
  chemically synthesized
cgatattcctcaaagcttga

SEQ ID NO: 200413 - DNA, 20 bp, Artificial Sequence
  chemically synthesized
cataaatactgtcaagcttt

SEQ ID NO: 200414 - DNA, 20 bp, Artificial Sequence
  chemically synthesized
ataaatactgtcaagctttg

SEQ ID NO: 200415 - DNA, 20 bp, Artificial Sequence
  chemically synthesized
ccagaaatcgatattcctca

SEQ ID NO: 200416 - DNA, 20 bp, Artificial Sequence
  chemically synthesized
ctttgaggaatatcgatttc

SEQ ID NO: 200417 - DNA, 20 bp, Artificial Sequence
  chemically synthesized
ccaataaaacggaggatttc

SEQ ID NO: 200418 - DNA, 20 bp, Artificial Sequence
  chemically synthesized
tctcggtaccaataaaacgg

SEQ ID NO: 200419 - DNA, 20 bp, Artificial Sequence
  chemically synthesized
atctcggtaccaataaaacg

SEQ ID NO: 200420 - DNA, 20 bp, Artificial Sequence
  chemically synthesized
ctggaaatcctccgttttat

SEQ ID NO: 200421 - DNA, 20 bp, Artificial Sequence
  chemically synthesized
aaatctcggtaccaataaaa

SEQ ID NO: 200422 - DNA, 20 bp, Artificial Sequence
  chemically synthesized
tcctccgttttattggtacc

SEQ ID NO: 200423 - DNA, 20 bp, Artificial Sequence
  chemically synthesized
tgagtttctgtggaaaatct

SEQ ID NO: 200424 - DNA, 20 bp, Artificial Sequence
  chemically synthesized
attggtaccgagattttcca

SEQ ID NO: 200425 - DNA, 20 bp, Artificial Sequence
  chemically synthesized
tggtgcttagtgagtttctg

SEQ ID NO: 200426 - DNA, 20 bp, Artificial Sequence
  chemically synthesized
attttccacagaaactcact

SEQ ID NO: 200427 - DNA, 20 bp, Artificial Sequence
  chemically synthesized
tacaaaaagtggtgcttagt

SEQ ID NO: 200428 - DNA, 20 bp, Artificial Sequence
  chemically synthesized
tagttacaaaaagtggtgct

SEQ ID NO: 200429 - DNA, 20 bp, Artificial Sequence
  chemically synthesized
catgggatagttacaaaaag

SEQ ID NO: 200430 - DNA, 20 bp, Artificial Sequence
  chemically synthesized
tatcatgggatagttacaaa

SEQ ID NO: 200431 - DNA, 20 bp, Artificial Sequence
  chemically synthesized
gtataatgagtatcatggga

SEQ ID NO: 200432 - DNA, 20 bp, Artificial Sequence
  chemically synthesized
gcacgtataatgagtatcat

SEQ ID NO: 200433 - DNA, 20 bp, Artificial Sequence
  chemically synthesized
ggcacgtataatgagtatca

SEQ ID NO: 200434 - DNA, 20 bp, Artificial Sequence
  chemically synthesized
gtgtgcatggcacgtataat

SEQ ID NO: 200435 - DNA, 20 bp, Artificial Sequence
  chemically synthesized
cattatacgtgccatgcaca

SEQ ID NO: 200436 - DNA, 20 bp, Artificial Sequence
  chemically synthesized
ctagaaattgaccgtgtgca

SEQ ID NO: 200437 - DNA, 20 bp, Artificial Sequence
  chemically synthesized
ccatgcacacggtcaatttc

SEQ ID NO: 200438 - DNA, 20 bp, Artificial Sequence
  chemically synthesized
acggtcaatttctagtaaat

SEQ ID NO: 200439 - DNA, 20 bp, Artificial Sequence
  chemically synthesized
ctagttactttctaatttac

SEQ ID NO: 200440 - DNA, 20 bp, Artificial Sequence
  chemically synthesized
tcaatttctagtaaattaga

SEQ ID NO: 200441 - DNA, 20 bp, Artificial Sequence
  chemically synthesized
ctagtaaattagaaagtaac

SEQ ID NO: 200442 - DNA, 20 bp, Artificial Sequence
  chemically synthesized
aataaataataggattatgc

SEQ ID NO: 200443 - DNA, 20 bp, Artificial Sequence
  chemically synthesized
attgaaattaaataaataat

SEQ ID NO: 200444 - DNA, 20 bp, Artificial Sequence
  chemically synthesized
cattgaaattaaataaataa

SEQ ID NO: 200445 - DNA, 20 bp, Artificial Sequence
  chemically synthesized
tgatgttatcattgaatctc

SEQ ID NO: 200446 - DNA, 20 bp, Artificial Sequence
  chemically synthesized
aaagaatttctagaatactg

SEQ ID NO: 200447 - DNA, 20 bp, Artificial Sequence
  chemically synthesized
tcattgaatctccagtattc

SEQ ID NO: 200448 - DNA, 20 bp, Artificial Sequence
  chemically synthesized
acaaagaatttctagaatac

SEQ ID NO: 200449 - DNA, 20 bp, Artificial Sequence
  chemically synthesized
cactggaaacaaagaatttc

SEQ ID NO: 200450 - DNA, 20 bp, Artificial Sequence
  chemically synthesized
ttctagaaattctttgtttc

SEQ ID NO: 200451 - DNA, 20 bp, Artificial Sequence
  chemically synthesized
atgaatatacactggaaaca

SEQ ID NO: 200452 - DNA, 20 bp, Artificial Sequence
  chemically synthesized
ttccatatatgaatatacac

SEQ ID NO: 200453 - DNA, 20 bp, Artificial Sequence
  chemically synthesized
ttccagtgtatattcatata

SEQ ID NO: 200454 - DNA, 20 bp, Artificial Sequence
  chemically synthesized
ctataatttaaaataaatag

SEQ ID NO: 200455 - DNA, 20 bp, Artificial Sequence
  chemically synthesized
ttgctataatttaaaataaa

SEQ ID NO: 200456 - DNA, 20 bp, Artificial Sequence
  chemically synthesized
ccactatttattttaaatta

SEQ ID NO: 200457 - DNA, 20 bp, Artificial Sequence
  chemically synthesized
attttaaattatagcaattt

SEQ ID NO: 200458 - DNA, 20 bp, Artificial Sequence
  chemically synthesized
catgaaaaattggaataatg

SEQ ID NO: 200459 - DNA, 20 bp, Artificial Sequence
  chemically synthesized
acatgaaaaattggaataat

SEQ ID NO: 200460 - DNA, 20 bp, Artificial Sequence
  chemically synthesized
gtctgcagaacatgaaaaat

SEQ ID NO: 200461 - DNA, 20 bp, Artificial Sequence
  chemically synthesized
ttccaatttttcatgttctg

SEQ ID NO: 200462 - DNA, 20 bp, Artificial Sequence
  chemically synthesized
gttcagttgtgagatgtctg

SEQ ID NO: 200463 - DNA, 20 bp, Artificial Sequence
  chemically synthesized
agcctgggaagttcagttgt

SEQ ID NO: 200464 - DNA, 20 bp, Artificial Sequence
  chemically synthesized
catctcacaactgaacttcc

SEQ ID NO: 200465 - DNA, 20 bp, Artificial Sequence
  chemically synthesized
aagttgtagcctgggaagtt

SEQ ID NO: 200466 - DNA, 20 bp, Artificial Sequence
  chemically synthesized
atctcacaactgaacttccc

SEQ ID NO: 200467 - DNA, 20 bp, Artificial Sequence
  chemically synthesized
cattaaagttgtagcctggg

SEQ ID NO: 200468 - DNA, 20 bp, Artificial Sequence
  chemically synthesized
ccacattaaagttgtagcct

SEQ ID NO: 200469 - DNA, 20 bp, Artificial Sequence
  chemically synthesized
gccacattaaagttgtagcc

SEQ ID NO: 200470 - DNA, 20 bp, Artificial Sequence
  chemically synthesized
tgtttgccacattaaagttg

SEQ ID NO: 200471 - DNA, 20 bp, Artificial Sequence
  chemically synthesized
cccaggctacaactttaatg

SEQ ID NO: 200472 - DNA, 20 bp, Artificial Sequence
  chemically synthesized
gttatgtgtttgccacatta

SEQ ID NO: 200473 - DNA, 20 bp, Artificial Sequence
  chemically synthesized
gcaaacacataaccaaacca

SEQ ID NO: 200474 - DNA, 20 bp, Artificial Sequence
  chemically synthesized
cggtcagttctactttggtt

SEQ ID NO: 200475 - DNA, 20 bp, Artificial Sequence
  chemically synthesized
aacacataaccaaaccaaag

SEQ ID NO: 200476 - DNA, 20 bp, Artificial Sequence
  chemically synthesized
cagtccggtcagttctactt

SEQ ID NO: 200477 - DNA, 20 bp, Artificial Sequence
  chemically synthesized
caaaccaaagtagaactgac

SEQ ID NO: 200478 - DNA, 20 bp, Artificial Sequence
  chemically synthesized
gtgctctgccacagtccggt

SEQ ID NO: 200479 - DNA, 20 bp, Artificial Sequence
  chemically synthesized
aagtagaactgaccggactg

SEQ ID NO: 200480 - DNA, 20 bp, Artificial Sequence
  chemically synthesized
ccatgtgctctgccacagtc

SEQ ID NO: 200481 - DNA, 20 bp, Artificial Sequence
  chemically synthesized
tagaactgaccggactgtgg

SEQ ID NO: 200482 - DNA, 20 bp, Artificial Sequence
  chemically synthesized
gaactgaccggactgtggca

SEQ ID NO: 200483 - DNA, 20 bp, Artificial Sequence
  chemically synthesized
aatgaccatgtgctctgcca

SEQ ID NO: 200484 - DNA, 20 bp, Artificial Sequence
  chemically synthesized
ccggactgtggcagagcaca

SEQ ID NO: 200485 - DNA, 20 bp, Artificial Sequence
  chemically synthesized
tggtcatttgttcaatcact

SEQ ID NO: 200486 - DNA, 20 bp, Artificial Sequence
  chemically synthesized
aagacgtttgttgaatgacc

SEQ ID NO: 200487 - DNA, 20 bp, Artificial Sequence
  chemically synthesized
ttcaacaaacgtcttctaat

SEQ ID NO: 200488 - DNA, 20 bp, Artificial Sequence
  chemically synthesized
cacatattctagctgattag

SEQ ID NO: 200489 - DNA, 20 bp, Artificial Sequence
  chemically synthesized
acaaacgtcttctaatcagc

SEQ ID NO: 200490 - DNA, 20 bp, Artificial Sequence
  chemically synthesized
tggcacatattctagctgat

SEQ ID NO: 200491 - DNA, 20 bp, Artificial Sequence
  chemically synthesized
ccagaccttggcacatattc

SEQ ID NO: 200492 - DNA, 20 bp, Artificial Sequence
  chemically synthesized
aatcagctagaatatgtgcc

SEQ ID NO: 200493 - DNA, 20 bp, Artificial Sequence
  chemically synthesized
atcagctagaatatgtgcca

SEQ ID NO: 200494 - DNA, 20 bp, Artificial Sequence
  chemically synthesized
ctagaatatgtgccaaggtc

SEQ ID NO: 200495 - DNA, 20 bp, Artificial Sequence
  chemically synthesized
cttatgttaaggccagacct

SEQ ID NO: 200496 - DNA, 20 bp, Artificial Sequence
  chemically synthesized
tgtatctcttatgttaaggc

SEQ ID NO: 200497 - DNA, 20 bp, Artificial Sequence
  chemically synthesized
ccaaggtctggccttaacat

SEQ ID NO: 200498 - DNA, 20 bp, Artificial Sequence
  chemically synthesized
tctttgtatctcttatgtta

SEQ ID NO: 200499 - DNA, 20 bp, Artificial Sequence
  chemically synthesized
aaggtctggccttaacataa

SEQ ID NO: 200500 - DNA, 20 bp, Artificial Sequence
  chemically synthesized
ctctttgtatctcttatgtt

SEQ ID NO: 200501 - DNA, 20 bp, Artificial Sequence
  chemically synthesized
gccttaacataagagataca

SEQ ID NO: 200502 - DNA, 20 bp, Artificial Sequence
  chemically synthesized
cttaacataagagatacaaa

SEQ ID NO: 200503 - DNA, 20 bp, Artificial Sequence
  chemically synthesized
ttaacataagagatacaaag

SEQ ID NO: 200504 - DNA, 20 bp, Artificial Sequence
  chemically synthesized
aaagaggaataaactgtaaa

SEQ ID NO: 200505 - DNA, 20 bp, Artificial Sequence
  chemically synthesized
tagagagcaatgactattta

SEQ ID NO: 200506 - DNA, 20 bp, Artificial Sequence
  chemically synthesized
tgtaaatagtcattgctctc

SEQ ID NO: 200507 - DNA, 20 bp, Artificial Sequence
  chemically synthesized
gtaaatagtcattgctctct

SEQ ID NO: 200508 - DNA, 20 bp, Artificial Sequence
  chemically synthesized
taaatagtcattgctctcta

SEQ ID NO: 200509 - DNA, 20 bp, Artificial Sequence
  chemically synthesized
ctccctagatttgccctaga

SEQ ID NO: 200510 - DNA, 20 bp, Artificial Sequence
  chemically synthesized
tcctccctagatttgcccta

SEQ ID NO: 200511 - DNA, 20 bp, Artificial Sequence
  chemically synthesized
attcctccctagatttgccc

SEQ ID NO: 200512 - DNA, 20 bp, Artificial Sequence
  chemically synthesized
attgctctctagggcaaatc

SEQ ID NO: 200513 - DNA, 20 bp, Artificial Sequence
  chemically synthesized
ttgctctctagggcaaatct

SEQ ID NO: 200514 - DNA, 20 bp, Artificial Sequence
  chemically synthesized
tgctctctagggcaaatcta

SEQ ID NO: 200515 - DNA, 20 bp, Artificial Sequence
  chemically synthesized
ctctctagggcaaatctagg

SEQ ID NO: 200516 - DNA, 20 bp, Artificial Sequence
  chemically synthesized
tctctagggcaaatctaggg

SEQ ID NO: 200517 - DNA, 20 bp, Artificial Sequence
  chemically synthesized
tttttgtctgaattcctccc

SEQ ID NO: 200518 - DNA, 20 bp, Artificial Sequence
  chemically synthesized
ggcaaatctagggaggaatt

SEQ ID NO: 200519 - DNA, 20 bp, Artificial Sequence
  chemically synthesized
ttttctactattattatatg

SEQ ID NO: 200520 - DNA, 20 bp, Artificial Sequence
  chemically synthesized
gttttctactattattatat

SEQ ID NO: 200521 - DNA, 20 bp, Artificial Sequence
  chemically synthesized
aataaatcctcatataataa

SEQ ID NO: 200522 - DNA, 20 bp, Artificial Sequence
  chemically synthesized
aaatcctcatataataatag

SEQ ID NO: 200523 - DNA, 20 bp, Artificial Sequence
  chemically synthesized
aataatagtagaaaactcaa

SEQ ID NO: 200524 - DNA, 20 bp, Artificial Sequence
  chemically synthesized
ataatagtagaaaactcaaa

SEQ ID NO: 200525 - DNA, 20 bp, Artificial Sequence
  chemically synthesized
taatagtagaaaactcaaaa

SEQ ID NO: 200526 - DNA, 20 bp, Artificial Sequence
  chemically synthesized
tccgtcttaatgtccctttt

SEQ ID NO: 200527 - DNA, 20 bp, Artificial Sequence
  chemically synthesized
gaaaactcaaaagggacatt

SEQ ID NO: 200528 - DNA, 20 bp, Artificial Sequence
  chemically synthesized
actcaaaagggacattaaga

SEQ ID NO: 200529 - DNA, 20 bp, Artificial Sequence
  chemically synthesized
tcatggcttaaggcagtcga

SEQ ID NO: 200530 - DNA, 20 bp, Artificial Sequence
  chemically synthesized
acggatctatcgactgcctt

SEQ ID NO: 200531 - DNA, 20 bp, Artificial Sequence
  chemically synthesized
tccaacatcatggcttaagg

SEQ ID NO: 200532 - DNA, 20 bp, Artificial Sequence
  chemically synthesized
tagtccaacatcatggctta

SEQ ID NO: 200533 - DNA, 20 bp, Artificial Sequence
  chemically synthesized
ctagtccaacatcatggctt

SEQ ID NO: 200534 - DNA, 20 bp, Artificial Sequence
  chemically synthesized
actgccttaagccatgatgt

SEQ ID NO: 200535 - DNA, 20 bp, Artificial Sequence
  chemically synthesized
atctccctagtccaacatca

SEQ ID NO: 200536 - DNA, 20 bp, Artificial Sequence
  chemically synthesized
cttaagccatgatgttggac

SEQ ID NO: 200537 - DNA, 20 bp, Artificial Sequence
  chemically synthesized
ttaagccatgatgttggact

SEQ ID NO: 200538 - DNA, 20 bp, Artificial Sequence
  chemically synthesized
taagccatgatgttggacta

SEQ ID NO: 200539 - DNA, 20 bp, Artificial Sequence
  chemically synthesized
agccatgatgttggactagg

SEQ ID NO: 200540 - DNA, 20 bp, Artificial Sequence
  chemically synthesized
aacctagtgtataatctccc

SEQ ID NO: 200541 - DNA, 20 bp, Artificial Sequence
  chemically synthesized
ggactagggagattatacac

SEQ ID NO: 200542 - DNA, 20 bp, Artificial Sequence
  chemically synthesized
gactagggagattatacact

SEQ ID NO: 200543 - DNA, 20 bp, Artificial Sequence
  chemically synthesized
agacctttcccagacgaacc

SEQ ID NO: 200544 - DNA, 20 bp, Artificial Sequence
  chemically synthesized
gattatacactaggttcgtc

SEQ ID NO: 200545 - DNA, 20 bp, Artificial Sequence
  chemically synthesized
attatacactaggttcgtct

SEQ ID NO: 200546 - DNA, 20 bp, Artificial Sequence
  chemically synthesized
tacactaggttcgtctggga

SEQ ID NO: 200547 - DNA, 20 bp, Artificial Sequence
  chemically synthesized
acactaggttcgtctgggaa

SEQ ID NO: 200548 - DNA, 20 bp, Artificial Sequence
  chemically synthesized
gctgtacaccagacctttcc

SEQ ID NO: 200549 - DNA, 20 bp, Artificial Sequence
  chemically synthesized
aggttcgtctgggaaaggtc

SEQ ID NO: 200550 - DNA, 20 bp, Artificial Sequence
  chemically synthesized
tctgggaaaggtctggtgta

SEQ ID NO: 200551 - DNA, 20 bp, Artificial Sequence
  chemically synthesized
cacgggacaaagctgtacac

SEQ ID NO: 200552 - DNA, 20 bp, Artificial Sequence
  chemically synthesized
gtaggaaaggtcacgggaca

SEQ ID NO: 200553 - DNA, 20 bp, Artificial Sequence
  chemically synthesized
aaaagtgtaggaaaggtcac

SEQ ID NO: 200554 - DNA, 20 bp, Artificial Sequence
  chemically synthesized
aaaaagtgtaggaaaggtca

SEQ ID NO: 200555 - DNA, 20 bp, Artificial Sequence
  chemically synthesized
gagaataaaaagtgtaggaa

SEQ ID NO: 200556 - DNA, 20 bp, Artificial Sequence
  chemically synthesized
tgagaataaaaagtgtagga

SEQ ID NO: 200557 - DNA, 20 bp, Artificial Sequence
  chemically synthesized
attttgagaataaaaagtgt

SEQ ID NO: 200558 - DNA, 20 bp, Artificial Sequence
  chemically synthesized
tattttgagaataaaaagtg

SEQ ID NO: 200559 - DNA, 20 bp, Artificial Sequence
  chemically synthesized
gtatttattttgagaataaa

SEQ ID NO: 200560 - DNA, 20 bp, Artificial Sequence
  chemically synthesized
attgctaatgtatttatttt

SEQ ID NO: 200561 - DNA, 20 bp, Artificial Sequence
  chemically synthesized
tattctcaaaataaatacat

SEQ ID NO: 200562 - DNA, 20 bp, Artificial Sequence
  chemically synthesized
tacattagcaatgatcttgt

SEQ ID NO: 200563 - DNA, 20 bp, Artificial Sequence
  chemically synthesized
acattagcaatgatcttgta

SEQ ID NO: 200564 - DNA, 20 bp, Artificial Sequence
  chemically synthesized
ggacttttgtttcaccttac

SEQ ID NO: 200565 - DNA, 20 bp, Artificial Sequence
  chemically synthesized
gatcttgtaaggtgaaacaa

SEQ ID NO: 200566 - DNA, 20 bp, Artificial Sequence
  chemically synthesized
aaggtgaaacaaaagtccat

SEQ ID NO: 200567 - DNA, 20 bp, Artificial Sequence
  chemically synthesized
aggtgaaacaaaagtccatc

SEQ ID NO: 200568 - DNA, 20 bp, Artificial Sequence
  chemically synthesized
gccaactcctgttttcctga

SEQ ID NO: 200569 - DNA, 20 bp, Artificial Sequence
  chemically synthesized
acaaaagtccatcaggaaaa

SEQ ID NO: 200570 - DNA, 20 bp, Artificial Sequence
  chemically synthesized
caaaagtccatcaggaaaac

SEQ ID NO: 200571 - DNA, 20 bp, Artificial Sequence
  chemically synthesized
aaagtccatcaggaaaacag

SEQ ID NO: 200572 - DNA, 20 bp, Artificial Sequence
  chemically synthesized
tccatcaggaaaacaggagt

SEQ ID NO: 200573 - DNA, 20 bp, Artificial Sequence
  chemically synthesized
atcaggaaaacaggagttgg

SEQ ID NO: 200574 - DNA, 20 bp, Artificial Sequence
  chemically synthesized
tcaggaaaacaggagttggc

SEQ ID NO: 200575 - DNA, 20 bp, Artificial Sequence
  chemically synthesized
ggaaaacaggagttggcggg

SEQ ID NO: 200576 - DNA, 20 bp, Artificial Sequence
  chemically synthesized
gaaaacaggagttggcgggt

SEQ ID NO: 200577 - DNA, 20 bp, Artificial Sequence
  chemically synthesized
aggagttggcgggtgggaaa

SEQ ID NO: 200578 - DNA, 20 bp, Artificial Sequence
  chemically synthesized
gtgggaaatggtaccttatg

SEQ ID NO: 200579 - DNA, 20 bp, Artificial Sequence
  chemically synthesized
gggaaatggtaccttatgaa

SEQ ID NO: 200580 - DNA, 20 bp, Artificial Sequence
  chemically synthesized
tttcctttgttctcttcata

SEQ ID NO: 200581 - DNA, 20 bp, Artificial Sequence
  chemically synthesized
gtttcctttgttctcttcat

SEQ ID NO: 200582 - DNA, 20 bp, Artificial Sequence
  chemically synthesized
ggtaccttatgaagagaaca

SEQ ID NO: 200583 - DNA, 20 bp, Artificial Sequence
  chemically synthesized
gtaccttatgaagagaacaa

SEQ ID NO: 200584 - DNA, 20 bp, Artificial Sequence
  chemically synthesized
gaagagaacaaaggaaacaa

SEQ ID NO: 200585 - DNA, 20 bp, Artificial Sequence
  chemically synthesized
gaacaaaggaaacaatagca

SEQ ID NO: 200586 - DNA, 20 bp, Artificial Sequence
  chemically synthesized
aacaaaggaaacaatagcat

SEQ ID NO: 200587 - DNA, 20 bp, Artificial Sequence
  chemically synthesized
gaaacaatagcatgggatat

SEQ ID NO: 200588 - DNA, 20 bp, Artificial Sequence
  chemically synthesized
aacaatagcatgggatatca

SEQ ID NO: 200589 - DNA, 20 bp, Artificial Sequence
  chemically synthesized
atgggatatcagagaaactc

SEQ ID NO: 200590 - DNA, 20 bp, Artificial Sequence
  chemically synthesized
ccagctatactgtgttgcta

SEQ ID NO: 200591 - DNA, 20 bp, Artificial Sequence
  chemically synthesized
tcagagaaactctagcaaca

SEQ ID NO: 200592 - DNA, 20 bp, Artificial Sequence
  chemically synthesized
ccccagctatactgtgttgc

SEQ ID NO: 200593 - DNA, 20 bp, Artificial Sequence
  chemically synthesized
gaaactctagcaacacagta

SEQ ID NO: 200594 - DNA, 20 bp, Artificial Sequence
  chemically synthesized
ctctagcaacacagtatagc

SEQ ID NO: 200595 - DNA, 20 bp, Artificial Sequence
  chemically synthesized
tctagcaacacagtatagct

SEQ ID NO: 200596 - DNA, 20 bp, Artificial Sequence
  chemically synthesized
ctagcaacacagtatagctg

SEQ ID NO: 200597 - DNA, 20 bp, Artificial Sequence
  chemically synthesized
aacacagtatagctggggtg

SEQ ID NO: 200598 - DNA, 20 bp, Artificial Sequence
  chemically synthesized
cacagtatagctggggtgaa

SEQ ID NO: 200599 - DNA, 20 bp, Artificial Sequence
  chemically synthesized
cccagagatactcttcaccc

SEQ ID NO: 200600 - DNA, 20 bp, Artificial Sequence
  chemically synthesized
gctggggtgaagagtatctc

SEQ ID NO: 200601 - DNA, 20 bp, Artificial Sequence
  chemically synthesized
ctggggtgaagagtatctct

SEQ ID NO: 200602 - DNA, 20 bp, Artificial Sequence
  chemically synthesized
ggtgaagagtatctctgggc

SEQ ID NO: 200603 - DNA, 20 bp, Artificial Sequence
  chemically synthesized
gtgaagagtatctctgggcg

SEQ ID NO: 200604 - DNA, 20 bp, Artificial Sequence
  chemically synthesized
gtccctgatgacctcgccca

SEQ ID NO: 200605 - DNA, 20 bp, Artificial Sequence
  chemically synthesized
ttgtccctgatgacctcgcc

SEQ ID NO: 200606 - DNA, 20 bp, Artificial Sequence
  chemically synthesized
gtatctctgggcgaggtcat

SEQ ID NO: 200607 - DNA, 20 bp, Artificial Sequence
  chemically synthesized
tatctctgggcgaggtcatc

SEQ ID NO: 200608 - DNA, 20 bp, Artificial Sequence
  chemically synthesized
atctctgggcgaggtcatca

SEQ ID NO: 200609 - DNA, 20 bp, Artificial Sequence
  chemically synthesized
gggcgaggtcatcagggaca

SEQ ID NO: 200610 - DNA, 20 bp, Artificial Sequence
  chemically synthesized
tcatcagggacaaagtcaat

SEQ ID NO: 200611 - DNA, 20 bp, Artificial Sequence
  chemically synthesized
atcagggacaaagtcaatta

SEQ ID NO: 200612 - DNA, 20 bp, Artificial Sequence
  chemically synthesized
tcagggacaaagtcaattag

SEQ ID NO: 200613 - DNA, 20 bp, Artificial Sequence
  chemically synthesized
cagggacaaagtcaattaga

SEQ ID NO: 200614 - DNA, 20 bp, Artificial Sequence
  chemically synthesized
gacaaagtcaattagaggga

SEQ ID NO: 200615 - DNA, 20 bp, Artificial Sequence
  chemically synthesized
aagtcaattagagggataga

SEQ ID NO: 200616 - DNA, 20 bp, Artificial Sequence
  chemically synthesized
gtcaattagagggatagaca

SEQ ID NO: 200617 - DNA, 20 bp, Artificial Sequence
  chemically synthesized
agagggatagacagagttcc

SEQ ID NO: 200618 - DNA, 20 bp, Artificial Sequence
  chemically synthesized
atagacagagttccaagtgt

SEQ ID NO: 200619 - DNA, 20 bp, Artificial Sequence
  chemically synthesized
tagacagagttccaagtgtc

SEQ ID NO: 200620 - DNA, 20 bp, Artificial Sequence
  chemically synthesized
agacagagttccaagtgtca

SEQ ID NO: 200621 - DNA, 20 bp, Artificial Sequence
  chemically synthesized
ccaacaaggtccctgacact

SEQ ID NO: 200622 - DNA, 20 bp, Artificial Sequence
  chemically synthesized
ccaagtgtcagggaccttgt

SEQ ID NO: 200623 - DNA, 20 bp, Artificial Sequence
  chemically synthesized
gtgtcagggaccttgttggt

SEQ ID NO: 200624 - DNA, 20 bp, Artificial Sequence
  chemically synthesized
attgcttagtctgaccaaca

SEQ ID NO: 200625 - DNA, 20 bp, Artificial Sequence
  chemically synthesized
gattgcttagtctgaccaac

SEQ ID NO: 200626 - DNA, 20 bp, Artificial Sequence
  chemically synthesized
gggaccttgttggtcagact

SEQ ID NO: 200627 - DNA, 20 bp, Artificial Sequence
  chemically synthesized
tccaaatagttcagattgct

SEQ ID NO: 200628 - DNA, 20 bp, Artificial Sequence
  chemically synthesized
actaagcaatctgaactatt

SEQ ID NO: 200629 - DNA, 20 bp, Artificial Sequence
  chemically synthesized
tgtttgctttccaaatagtt

SEQ ID NO: 200630 - DNA, 20 bp, Artificial Sequence
  chemically synthesized
agcaatctgaactatttgga

SEQ ID NO: 200631 - DNA, 20 bp, Artificial Sequence
  chemically synthesized
taccttgtttgctttccaaa

SEQ ID NO: 200632 - DNA, 20 bp, Artificial Sequence
  chemically synthesized
gaactatttggaaagcaaac

SEQ ID NO: 200633 - DNA, 20 bp, Artificial Sequence
  chemically synthesized
aactatttggaaagcaaaca

SEQ ID NO: 200634 - DNA, 20 bp, Artificial Sequence
  chemically synthesized
gaaagcaaacaaggtaaccc

SEQ ID NO: 200635 - DNA, 20 bp, Artificial Sequence
  chemically synthesized
aagcaaacaaggtaaccctg

SEQ ID NO: 200636 - DNA, 20 bp, Artificial Sequence
  chemically synthesized
agcaaacaaggtaaccctgg

SEQ ID NO: 200637 - DNA, 20 bp, Artificial Sequence
  chemically synthesized
tgaaattcaggaatcctcca

SEQ ID NO: 200638 - DNA, 20 bp, Artificial Sequence
  chemically synthesized
ttgaaattcaggaatcctcc

SEQ ID NO: 200639 - DNA, 20 bp, Artificial Sequence
  chemically synthesized
attgaaattcaggaatcctc

SEQ ID NO: 200640 - DNA, 20 bp, Artificial Sequence
  chemically synthesized
gtgattctagattgaaattc

SEQ ID NO: 200641 - DNA, 20 bp, Artificial Sequence
  chemically synthesized
tgtgattctagattgaaatt

SEQ ID NO: 200642 - DNA, 20 bp, Artificial Sequence
  chemically synthesized
aggattcctgaatttcaatc

SEQ ID NO: 200643 - DNA, 20 bp, Artificial Sequence
  chemically synthesized
aaaagtatagtgtgtgattc

SEQ ID NO: 200644 - DNA, 20 bp, Artificial Sequence
  chemically synthesized
aattgaaaaaaaaaaaagta

SEQ ID NO: 200645 - DNA, 20 bp, Artificial Sequence
  chemically synthesized
tgcaaaattgaaaaaaaaaa

SEQ ID NO: 200646 - DNA, 20 bp, Artificial Sequence
  chemically synthesized
tcaattttgcatgacgactt

SEQ ID NO: 200647 - DNA, 20 bp, Artificial Sequence
  chemically synthesized
caattttgcatgacgacttc

SEQ ID NO: 200648 - DNA, 20 bp, Artificial Sequence
  chemically synthesized
aattttgcatgacgacttca

SEQ ID NO: 200649 - DNA, 20 bp, Artificial Sequence
  chemically synthesized
ttcattggcatgtttccctg

SEQ ID NO: 200650 - DNA, 20 bp, Artificial Sequence
  chemically synthesized
atttaacttgattttttcat

SEQ ID NO: 200651 - DNA, 20 bp, Artificial Sequence
  chemically synthesized
aacatgccaatgaaaaaatc

SEQ ID NO: 200652 - DNA, 20 bp, Artificial Sequence
  chemically synthesized
attacattaataaatttact

SEQ ID NO: 200653 - DNA, 20 bp, Artificial Sequence
  chemically synthesized
attaataaatttacttagtc

SEQ ID NO: 200654 - DNA, 20 bp, Artificial Sequence
  chemically synthesized
ttaataaatttacttagtct

SEQ ID NO: 200655 - DNA, 20 bp, Artificial Sequence
  chemically synthesized
aatattccaaatcctagact

SEQ ID NO: 200656 - DNA, 20 bp, Artificial Sequence
  chemically synthesized
aatttacttagtctaggatt

SEQ ID NO: 200657 - DNA, 20 bp, Artificial Sequence
  chemically synthesized
gcaataaatattccaaatcc

SEQ ID NO: 200658 - DNA, 20 bp, Artificial Sequence
  chemically synthesized
ggatttggaatatttattgc

SEQ ID NO: 200659 - DNA, 20 bp, Artificial Sequence
  chemically synthesized
tgcaagtcaaactaacctgt

SEQ ID NO: 200660 - DNA, 20 bp, Artificial Sequence
  chemically synthesized
atatgcaatgactaacaggt

SEQ ID NO: 200661 - DNA, 20 bp, Artificial Sequence
  chemically synthesized
gtttatatgcaatgactaac

SEQ ID NO: 200662 - DNA, 20 bp, Artificial Sequence
  chemically synthesized
tgtttatatgcaatgactaa

SEQ ID NO: 200663 - DNA, 20 bp, Artificial Sequence
  chemically synthesized
tgttagtcattgcatataaa

SEQ ID NO: 200664 - DNA, 20 bp, Artificial Sequence
  chemically synthesized
gttagtcattgcatataaac

SEQ ID NO: 200665 - DNA, 20 bp, Artificial Sequence
  chemically synthesized
gtcattgcatataaacaggt

SEQ ID NO: 200666 - DNA, 20 bp, Artificial Sequence
  chemically synthesized
tacattttaaaatttgattt

SEQ ID NO: 200667 - DNA, 20 bp, Artificial Sequence
  chemically synthesized
taaaatcaaattttaaaatg

SEQ ID NO: 200668 - DNA, 20 bp, Artificial Sequence
  chemically synthesized
ttttaaaatgtagatatcaa

SEQ ID NO: 200669 - DNA, 20 bp, Artificial Sequence
  chemically synthesized
tttaaaatgtagatatcaat

SEQ ID NO: 200670 - DNA, 20 bp, Artificial Sequence
  chemically synthesized
aaaatgtagatatcaatagg

SEQ ID NO: 200671 - DNA, 20 bp, Artificial Sequence
  chemically synthesized
ttgtaagccctttgagagca

SEQ ID NO: 200672 - DNA, 20 bp, Artificial Sequence
  chemically synthesized
ataggtagtctctgctctca

SEQ ID NO: 200673 - DNA, 20 bp, Artificial Sequence
  chemically synthesized
taggtagtctctgctctcaa

SEQ ID NO: 200674 - DNA, 20 bp, Artificial Sequence
  chemically synthesized
aattgtaagccctttgagag

SEQ ID NO: 200675 - DNA, 20 bp, Artificial Sequence
  chemically synthesized
aggtagtctctgctctcaaa

SEQ ID NO: 200676 - DNA, 20 bp, Artificial Sequence
  chemically synthesized
ggaaattgtaagccctttga

SEQ ID NO: 200677 - DNA, 20 bp, Artificial Sequence
  chemically synthesized
agggaaattgtaagcccttt

SEQ ID NO: 200678 - DNA, 20 bp, Artificial Sequence
  chemically synthesized
cacgattacagggaaattgt

SEQ ID NO: 200679 - DNA, 20 bp, Artificial Sequence
  chemically synthesized
atccaagtgacacgattaca

SEQ ID NO: 200680 - DNA, 20 bp, Artificial Sequence
  chemically synthesized
gatccaagtgacacgattac

SEQ ID NO: 200681 - DNA, 20 bp, Artificial Sequence
  chemically synthesized
tgatccaagtgacacgatta

SEQ ID NO: 200682 - DNA, 20 bp, Artificial Sequence
  chemically synthesized
ttccctgtaatcgtgtcact

SEQ ID NO: 200683 - DNA, 20 bp, Artificial Sequence
  chemically synthesized
tgtaatcgtgtcacttggat

SEQ ID NO: 200684 - DNA, 20 bp, Artificial Sequence
  chemically synthesized
taatctgtgtaagctgatcc

SEQ ID NO: 200685 - DNA, 20 bp, Artificial Sequence
  chemically synthesized
gtcacttggatcagcttaca

SEQ ID NO: 200686 - DNA, 20 bp, Artificial Sequence
  chemically synthesized
cttctgattataatctgtgt

SEQ ID NO: 200687 - DNA, 20 bp, Artificial Sequence
  chemically synthesized
cagcttacacagattataat

SEQ ID NO: 200688 - DNA, 20 bp, Artificial Sequence
  chemically synthesized
cttacacagattataatcag

SEQ ID NO: 200689 - DNA, 20 bp, Artificial Sequence
  chemically synthesized
acacagattataatcagaag

SEQ ID NO: 200690 - DNA, 20 bp, Artificial Sequence
  chemically synthesized
acagattataatcagaagca

SEQ ID NO: 200691 - DNA, 20 bp, Artificial Sequence
  chemically synthesized
attataatcagaagcagaga

SEQ ID NO: 200692 - DNA, 20 bp, Artificial Sequence
  chemically synthesized
ataatcagaagcagagacag

SEQ ID NO: 200693 - DNA, 20 bp, Artificial Sequence
  chemically synthesized
aatcagaagcagagacagca

SEQ ID NO: 200694 - DNA, 20 bp, Artificial Sequence
  chemically synthesized
cagcagagataactcctgaa

SEQ ID NO: 200695 - DNA, 20 bp, Artificial Sequence
  chemically synthesized
gcagagataactcctgaata

SEQ ID NO: 200696 - DNA, 20 bp, Artificial Sequence
  chemically synthesized
aacctagtttctctattcag

SEQ ID NO: 200697 - DNA, 20 bp, Artificial Sequence
  chemically synthesized
ttaacctagtttctctattc

SEQ ID NO: 200698 - DNA, 20 bp, Artificial Sequence
  chemically synthesized
cttaacctagtttctctatt

SEQ ID NO: 200699 - DNA, 20 bp, Artificial Sequence
  chemically synthesized
taactcctgaatagagaaac

SEQ ID NO: 200700 - DNA, 20 bp, Artificial Sequence
  chemically synthesized
aactcctgaatagagaaact

SEQ ID NO: 200701 - DNA, 20 bp, Artificial Sequence
  chemically synthesized
ctgaatagagaaactaggtt

SEQ ID NO: 200702 - DNA, 20 bp, Artificial Sequence
  chemically synthesized
tatgcccattattcttaacc

SEQ ID NO: 200703 - DNA, 20 bp, Artificial Sequence
  chemically synthesized
agaaactaggttaagaataa

SEQ ID NO: 200704 - DNA, 20 bp, Artificial Sequence
  chemically synthesized
gaaactaggttaagaataat

SEQ ID NO: 200705 - DNA, 20 bp, Artificial Sequence
  chemically synthesized
taggttaagaataatgggca

SEQ ID NO: 200706 - DNA, 20 bp, Artificial Sequence
  chemically synthesized
aaaacacacacatacacaca

SEQ ID NO: 200707 - DNA, 20 bp, Artificial Sequence
  chemically synthesized
gtgtgtgtatgtgtgtgttt

SEQ ID NO: 200708 - DNA, 20 bp, Artificial Sequence
  chemically synthesized
tgtatgtgtgtgttttagat

SEQ ID NO: 200709 - DNA, 20 bp, Artificial Sequence
  chemically synthesized
aacttaggctcagagaagat

SEQ ID NO: 200710 - DNA, 20 bp, Artificial Sequence
  chemically synthesized
ataagttactgatcttctct

SEQ ID NO: 200711 - DNA, 20 bp, Artificial Sequence
  chemically synthesized
gagaaaacttaggctcagag

SEQ ID NO: 200712 - DNA, 20 bp, Artificial Sequence
  chemically synthesized
tactgatcttctctgagcct

SEQ ID NO: 200713 - DNA, 20 bp, Artificial Sequence
  chemically synthesized
tctgagaaaacttaggctca

SEQ ID NO: 200714 - DNA, 20 bp, Artificial Sequence
  chemically synthesized
catctgagaaaacttaggct

SEQ ID NO: 200715 - DNA, 20 bp, Artificial Sequence
  chemically synthesized
attttcatctgagaaaactt

SEQ ID NO: 200716 - DNA, 20 bp, Artificial Sequence
  chemically synthesized
cattttcatctgagaaaact

SEQ ID NO: 200717 - DNA, 20 bp, Artificial Sequence
  chemically synthesized
tctctgagcctaagttttct

SEQ ID NO: 200718 - DNA, 20 bp, Artificial Sequence
  chemically synthesized
catggttctcattttcatct

SEQ ID NO: 200719 - DNA, 20 bp, Artificial Sequence
  chemically synthesized
aagttttctcagatgaaaat

SEQ ID NO: 200720 - DNA, 20 bp, Artificial Sequence
  chemically synthesized
agatgaaaatgagaaccatg

SEQ ID NO: 200721 - DNA, 20 bp, Artificial Sequence
  chemically synthesized
accctgtaaggaaggcttca

SEQ ID NO: 200722 - DNA, 20 bp, Artificial Sequence
  chemically synthesized
gaaccatgaagccttcctta

SEQ ID NO: 200723 - DNA, 20 bp, Artificial Sequence
  chemically synthesized
aaccatgaagccttccttac

SEQ ID NO: 200724 - DNA, 20 bp, Artificial Sequence
  chemically synthesized
cattattcaccctgtaagga

SEQ ID NO: 200725 - DNA, 20 bp, Artificial Sequence
  chemically synthesized
accatgaagccttccttaca

SEQ ID NO: 200726 - DNA, 20 bp, Artificial Sequence
  chemically synthesized
ccattattcaccctgtaagg

SEQ ID NO: 200727 - DNA, 20 bp, Artificial Sequence
  chemically synthesized
ttgccattattcaccctgta

SEQ ID NO: 200728 - DNA, 20 bp, Artificial Sequence
  chemically synthesized
attgccattattcaccctgt

SEQ ID NO: 200729 - DNA, 20 bp, Artificial Sequence
  chemically synthesized
cttccttacagggtgaataa

SEQ ID NO: 200730 - DNA, 20 bp, Artificial Sequence
  chemically synthesized
aataatggcaatccaatgta

SEQ ID NO: 200731 - DNA, 20 bp, Artificial Sequence
  chemically synthesized
ataatggcaatccaatgtaa

SEQ ID NO: 200732 - DNA, 20 bp, Artificial Sequence
  chemically synthesized
tatccccccctcctttacat

SEQ ID NO: 200733 - DNA, 20 bp, Artificial Sequence
  chemically synthesized
aatggcaatccaatgtaaag

SEQ ID NO: 200734 - DNA, 20 bp, Artificial Sequence
  chemically synthesized
atggcaatccaatgtaaagg

SEQ ID NO: 200735 - DNA, 20 bp, Artificial Sequence
  chemically synthesized
tggcaatccaatgtaaagga

SEQ ID NO: 200736 - DNA, 20 bp, Artificial Sequence
  chemically synthesized
ggcaatccaatgtaaaggag

SEQ ID NO: 200737 - DNA, 20 bp, Artificial Sequence
  chemically synthesized
gcaatccaatgtaaaggagg

SEQ ID NO: 200738 - DNA, 20 bp, Artificial Sequence
  chemically synthesized
caatccaatgtaaaggaggg

SEQ ID NO: 200739 - DNA, 20 bp, Artificial Sequence
  chemically synthesized
aatccaatgtaaaggagggg

SEQ ID NO: 200740 - DNA, 20 bp, Artificial Sequence
  chemically synthesized
ggagggggggatatttattc

SEQ ID NO: 200741 - DNA, 20 bp, Artificial Sequence
  chemically synthesized
gagggggggatatttattcc

SEQ ID NO: 200742 - DNA, 20 bp, Artificial Sequence
  chemically synthesized
cttctcttgttcgtttttcc

SEQ ID NO: 200743 - DNA, 20 bp, Artificial Sequence
  chemically synthesized
ttattccaggaaaaacgaac

SEQ ID NO: 200744 - DNA, 20 bp, Artificial Sequence
  chemically synthesized
attccaggaaaaacgaacaa

SEQ ID NO: 200745 - DNA, 20 bp, Artificial Sequence
  chemically synthesized
ccaggaaaaacgaacaagag

SEQ ID NO: 200746 - DNA, 20 bp, Artificial Sequence
  chemically synthesized
ggaaaaacgaacaagagaag

SEQ ID NO: 200747 - DNA, 20 bp, Artificial Sequence
  chemically synthesized
agaagtagaaacaacacata

SEQ ID NO: 200748 - DNA, 20 bp, Artificial Sequence
  chemically synthesized
caacacatacagtgcttgca

SEQ ID NO: 200749 - DNA, 20 bp, Artificial Sequence
  chemically synthesized
aggcctattatacactttgc

SEQ ID NO: 200750 - DNA, 20 bp, Artificial Sequence
  chemically synthesized
agtgcttgcaaagtgtataa

SEQ ID NO: 200751 - DNA, 20 bp, Artificial Sequence
  chemically synthesized
gtgcttgcaaagtgtataat

SEQ ID NO: 200752 - DNA, 20 bp, Artificial Sequence
  chemically synthesized
aaagtgtataataggccttc

SEQ ID NO: 200753 - DNA, 20 bp, Artificial Sequence
  chemically synthesized
taataattctcatttcttga

SEQ ID NO: 200754 - DNA, 20 bp, Artificial Sequence
  chemically synthesized
ataataattctcatttcttg

SEQ ID NO: 200755 - DNA, 20 bp, Artificial Sequence
  chemically synthesized
ataataggccttcaagaaat

SEQ ID NO: 200756 - DNA, 20 bp, Artificial Sequence
  chemically synthesized
agaattattatgctatgtca

SEQ ID NO: 200757 - DNA, 20 bp, Artificial Sequence
  chemically synthesized
aatgagatcagactgtgaca

SEQ ID NO: 200758 - DNA, 20 bp, Artificial Sequence
  chemically synthesized
atgtcacagtctgatctcat

SEQ ID NO: 200759 - DNA, 20 bp, Artificial Sequence
  chemically synthesized
ttgagagtatctaatgagat

SEQ ID NO: 200760 - DNA, 20 bp, Artificial Sequence
  chemically synthesized
ggccattgagagtatctaat

SEQ ID NO: 200761 - DNA, 20 bp, Artificial Sequence
  chemically synthesized
atctcattagatactctcaa

SEQ ID NO: 200762 - DNA, 20 bp, Artificial Sequence
  chemically synthesized
ccttctcatgaggccattga

SEQ ID NO: 200763 - DNA, 20 bp, Artificial Sequence
  chemically synthesized
atccttctcatgaggccatt

SEQ ID NO: 200764 - DNA, 20 bp, Artificial Sequence
  chemically synthesized
gatactctcaatggcctcat

SEQ ID NO: 200765 - DNA, 20 bp, Artificial Sequence
  chemically synthesized
actctcaatggcctcatgag

SEQ ID NO: 200766 - DNA, 20 bp, Artificial Sequence
  chemically synthesized
ctctcaatggcctcatgaga

SEQ ID NO: 200767 - DNA, 20 bp, Artificial Sequence
  chemically synthesized
cctttctcatccttctcatg

SEQ ID NO: 200768 - DNA, 20 bp, Artificial Sequence
  chemically synthesized
tcctttctcatccttctcat

SEQ ID NO: 200769 - DNA, 20 bp, Artificial Sequence
  chemically synthesized
aatggcctcatgagaaggat

SEQ ID NO: 200770 - DNA, 20 bp, Artificial Sequence
  chemically synthesized
gcctcatgagaaggatgaga

SEQ ID NO: 200771 - DNA, 20 bp, Artificial Sequence
  chemically synthesized
cctcatgagaaggatgagaa

SEQ ID NO: 200772 - DNA, 20 bp, Artificial Sequence
  chemically synthesized
tgccctcgcctgtaaaatgg

SEQ ID NO: 200773 - DNA, 20 bp, Artificial Sequence
  chemically synthesized
aatacatttctcccatttta

SEQ ID NO: 200774 - DNA, 20 bp, Artificial Sequence
  chemically synthesized
atacatttctcccattttac

SEQ ID NO: 200775 - DNA, 20 bp, Artificial Sequence
  chemically synthesized
tgtgccctcgcctgtaaaat

SEQ ID NO: 200776 - DNA, 20 bp, Artificial Sequence
  chemically synthesized
ttgtgccctcgcctgtaaaa

SEQ ID NO: 200777 - DNA, 20 bp, Artificial Sequence
  chemically synthesized
atttctcccattttacaggc

SEQ ID NO: 200778 - DNA, 20 bp, Artificial Sequence
  chemically synthesized
tttctcccattttacaggcg

SEQ ID NO: 200779 - DNA, 20 bp, Artificial Sequence
  chemically synthesized
ttctcccattttacaggcga

SEQ ID NO: 200780 - DNA, 20 bp, Artificial Sequence
  chemically synthesized
attttacaggcgagggcaca

SEQ ID NO: 200781 - DNA, 20 bp, Artificial Sequence
  chemically synthesized
tttacaggcgagggcacaaa

SEQ ID NO: 200782 - DNA, 20 bp, Artificial Sequence
  chemically synthesized
ataaatagctgtataatttg

SEQ ID NO: 200783 - DNA, 20 bp, Artificial Sequence
  chemically synthesized
attatttgcttcaaattata

SEQ ID NO: 200784 - DNA, 20 bp, Artificial Sequence
  chemically synthesized
caaattatacagctatttat

SEQ ID NO: 200785 - DNA, 20 bp, Artificial Sequence
  chemically synthesized
gcccaagtgtttccaataaa

SEQ ID NO: 200786 - DNA, 20 bp, Artificial Sequence
  chemically synthesized
agctatttattggaaacact

SEQ ID NO: 200787 - DNA, 20 bp, Artificial Sequence
  chemically synthesized
gctatttattggaaacactt

SEQ ID NO: 200788 - DNA, 20 bp, Artificial Sequence
  chemically synthesized
aacgggatatttttgagccc

SEQ ID NO: 200789 - DNA, 20 bp, Artificial Sequence
  chemically synthesized
cttggaaacgggatattttt

SEQ ID NO: 200790 - DNA, 20 bp, Artificial Sequence
  chemically synthesized
ctcaaaaatatcccgtttcc

SEQ ID NO: 200791 - DNA, 20 bp, Artificial Sequence
  chemically synthesized
aagggtaaagacttggaaac

SEQ ID NO: 200792 - DNA, 20 bp, Artificial Sequence
  chemically synthesized
aaagggtaaagacttggaaa

SEQ ID NO: 200793 - DNA, 20 bp, Artificial Sequence
  chemically synthesized
ttttagaaagggtaaagact

SEQ ID NO: 200794 - DNA, 20 bp, Artificial Sequence
  chemically synthesized
tgtgcattttagaaagggta

SEQ ID NO: 200795 - DNA, 20 bp, Artificial Sequence
  chemically synthesized
gacagtgtgcattttagaaa

SEQ ID NO: 200796 - DNA, 20 bp, Artificial Sequence
  chemically synthesized
ggacagtgtgcattttagaa

SEQ ID NO: 200797 - DNA, 20 bp, Artificial Sequence
  chemically synthesized
cggacagtgtgcattttaga

SEQ ID NO: 200798 - DNA, 20 bp, Artificial Sequence
  chemically synthesized
ttcacggacagtgtgcattt

SEQ ID NO: 200799 - DNA, 20 bp, Artificial Sequence
  chemically synthesized
aatttggcatgtttcacgga

SEQ ID NO: 200800 - DNA, 20 bp, Artificial Sequence
  chemically synthesized
aatcaatttggcatgtttca

SEQ ID NO: 200801 - DNA, 20 bp, Artificial Sequence
  chemically synthesized
tagtgatgataaaatcaatt

SEQ ID NO: 200802 - DNA, 20 bp, Artificial Sequence
  chemically synthesized
aaattgattttatcatcact

SEQ ID NO: 200803 - DNA, 20 bp, Artificial Sequence
  chemically synthesized
atctatggataagttcatct

SEQ ID NO: 200804 - DNA, 20 bp, Artificial Sequence
  chemically synthesized
cactaagatgaacttatcca

SEQ ID NO: 200805 - DNA, 20 bp, Artificial Sequence
  chemically synthesized
gggcacaaggatctatggat

SEQ ID NO: 200806 - DNA, 20 bp, Artificial Sequence
  chemically synthesized
tttgggggcacaaggatcta

SEQ ID NO: 200807 - DNA, 20 bp, Artificial Sequence
  chemically synthesized
cagtgagatttgggggcaca

SEQ ID NO: 200808 - DNA, 20 bp, Artificial Sequence
  chemically synthesized
acagtgagatttgggggcac

SEQ ID NO: 200809 - DNA, 20 bp, Artificial Sequence
  chemically synthesized
actgagacagtgagatttgg

SEQ ID NO: 200810 - DNA, 20 bp, Artificial Sequence
  chemically synthesized
aactgagacagtgagatttg

SEQ ID NO: 200811 - DNA, 20 bp, Artificial Sequence
  chemically synthesized
gaactgagacagtgagattt

SEQ ID NO: 200812 - DNA, 20 bp, Artificial Sequence
  chemically synthesized
agaactgagacagtgagatt

SEQ ID NO: 200813 - DNA, 20 bp, Artificial Sequence
  chemically synthesized
gcccccaaatctcactgtct

SEQ ID NO: 200814 - DNA, 20 bp, Artificial Sequence
  chemically synthesized
cacccaagaactgagacagt

SEQ ID NO: 200815 - DNA, 20 bp, Artificial Sequence
  chemically synthesized
gaggcacccaagaactgaga

SEQ ID NO: 200816 - DNA, 20 bp, Artificial Sequence
  chemically synthesized
aatctcactgtctcagttct

SEQ ID NO: 200817 - DNA, 20 bp, Artificial Sequence
  chemically synthesized
atctcactgtctcagttctt

SEQ ID NO: 200818 - DNA, 20 bp, Artificial Sequence
  chemically synthesized
acttgaggcacccaagaact

SEQ ID NO: 200819 - DNA, 20 bp, Artificial Sequence
  chemically synthesized
aacttggacttgaggcaccc

SEQ ID NO: 200820 - DNA, 20 bp, Artificial Sequence
  chemically synthesized
tctcagttcttgggtgcctc

SEQ ID NO: 200821 - DNA, 20 bp, Artificial Sequence
  chemically synthesized
ttcttgggtgcctcaagtcc

SEQ ID NO: 200822 - DNA, 20 bp, Artificial Sequence
  chemically synthesized
gccctgggaacttggacttg

SEQ ID NO: 200823 - DNA, 20 bp, Artificial Sequence
  chemically synthesized
tgccctgggaacttggactt

SEQ ID NO: 200824 - DNA, 20 bp, Artificial Sequence
  chemically synthesized
gtgcctcaagtccaagttcc

SEQ ID NO: 200825 - DNA, 20 bp, Artificial Sequence
  chemically synthesized
tgcctcaagtccaagttccc

SEQ ID NO: 200826 - DNA, 20 bp, Artificial Sequence
  chemically synthesized
agacagatgccctgggaact

SEQ ID NO: 200827 - DNA, 20 bp, Artificial Sequence
  chemically synthesized
gcctcaagtccaagttccca

SEQ ID NO: 200828 - DNA, 20 bp, Artificial Sequence
  chemically synthesized
tactcatagacagatgccct

SEQ ID NO: 200829 - DNA, 20 bp, Artificial Sequence
  chemically synthesized
ctactcatagacagatgccc

SEQ ID NO: 200830 - DNA, 20 bp, Artificial Sequence
  chemically synthesized
ttcccagggcatctgtctat

SEQ ID NO: 200831 - DNA, 20 bp, Artificial Sequence
  chemically synthesized
gtgaatatcctactcataga

SEQ ID NO: 200832 - DNA, 20 bp, Artificial Sequence
  chemically synthesized
ccagggcatctgtctatgag

SEQ ID NO: 200833 - DNA, 20 bp, Artificial Sequence
  chemically synthesized
cagggcatctgtctatgagt

SEQ ID NO: 200834 - DNA, 20 bp, Artificial Sequence
  chemically synthesized
cactgtgaatatcctactca

SEQ ID NO: 200835 - DNA, 20 bp, Artificial Sequence
  chemically synthesized
gtctatgagtaggatattca

SEQ ID NO: 200836 - DNA, 20 bp, Artificial Sequence
  chemically synthesized
atgagtaggatattcacagt

SEQ ID NO: 200837 - DNA, 20 bp, Artificial Sequence
  chemically synthesized
ggatattcacagtgagtaaa

SEQ ID NO: 200838 - DNA, 20 bp, Artificial Sequence
  chemically synthesized
gatattcacagtgagtaaaa

SEQ ID NO: 200839 - DNA, 20 bp, Artificial Sequence
  chemically synthesized
aacccacacctagattttta

SEQ ID NO: 200840 - DNA, 20 bp, Artificial Sequence
  chemically synthesized
aaggtaatgccataaaaatc

SEQ ID NO: 200841 - DNA, 20 bp, Artificial Sequence
  chemically synthesized
aggtaatgccataaaaatct

SEQ ID NO: 200842 - DNA, 20 bp, Artificial Sequence
  chemically synthesized
atgccataaaaatctaggtg

SEQ ID NO: 200843 - DNA, 20 bp, Artificial Sequence
  chemically synthesized
tgccataaaaatctaggtgt

SEQ ID NO: 200844 - DNA, 20 bp, Artificial Sequence
  chemically synthesized
ggattctactaacccacacc

SEQ ID NO: 200845 - DNA, 20 bp, Artificial Sequence
  chemically synthesized
ataaaaatctaggtgtgggt

SEQ ID NO: 200846 - DNA, 20 bp, Artificial Sequence
  chemically synthesized
aaaatctaggtgtgggttag

SEQ ID NO: 200847 - DNA, 20 bp, Artificial Sequence
  chemically synthesized
gatgttctatatcgtttatt

SEQ ID NO: 200848 - DNA, 20 bp, Artificial Sequence
  chemically synthesized
tagaatccaaataaacgata

SEQ ID NO: 200849 - DNA, 20 bp, Artificial Sequence
  chemically synthesized
tagttaacatatttgaatat

SEQ ID NO: 200850 - DNA, 20 bp, Artificial Sequence
  chemically synthesized
atattcaaatatgttaacta

SEQ ID NO: 200851 - DNA, 20 bp, Artificial Sequence
  chemically synthesized
gtaataggaaatcattactt

SEQ ID NO: 200852 - DNA, 20 bp, Artificial Sequence
  chemically synthesized
agtaatgatttcctattact

SEQ ID NO: 200853 - DNA, 20 bp, Artificial Sequence
  chemically synthesized
agaccctcactctaagtaat

SEQ ID NO: 200854 - DNA, 20 bp, Artificial Sequence
  chemically synthesized
taatgatttcctattactta

SEQ ID NO: 200855 - DNA, 20 bp, Artificial Sequence
  chemically synthesized
gagaccctcactctaagtaa

SEQ ID NO: 200856 - DNA, 20 bp, Artificial Sequence
  chemically synthesized
gatttcctattacttagagt

SEQ ID NO: 200857 - DNA, 20 bp, Artificial Sequence
  chemically synthesized
atttcctattacttagagtg

SEQ ID NO: 200858 - DNA, 20 bp, Artificial Sequence
  chemically synthesized
tttcctattacttagagtga

SEQ ID NO: 200859 - DNA, 20 bp, Artificial Sequence
  chemically synthesized
cattttgagaccctcactct

SEQ ID NO: 200860 - DNA, 20 bp, Artificial Sequence
  chemically synthesized
atctatttcaggaacatttt

SEQ ID NO: 200861 - DNA, 20 bp, Artificial Sequence
  chemically synthesized
gtctcaaaatgttcctgaaa

SEQ ID NO: 200862 - DNA, 20 bp, Artificial Sequence
  chemically synthesized
tacattttgagatctatttc

SEQ ID NO: 200863 - DNA, 20 bp, Artificial Sequence
  chemically synthesized
atacattttgagatctattt

SEQ ID NO: 200864 - DNA, 20 bp, Artificial Sequence
  chemically synthesized
agacagagggaatacatttt

SEQ ID NO: 200865 - DNA, 20 bp, Artificial Sequence
  chemically synthesized
caaaatgtattccctctgtc

SEQ ID NO: 200866 - DNA, 20 bp, Artificial Sequence
  chemically synthesized
caaagtttcaactagacaga

SEQ ID NO: 200867 - DNA, 20 bp, Artificial Sequence
  chemically synthesized
acaaagtttcaactagacag

SEQ ID NO: 200868 - DNA, 20 bp, Artificial Sequence
  chemically synthesized
tacaaagtttcaactagaca

SEQ ID NO: 200869 - DNA, 20 bp, Artificial Sequence
  chemically synthesized
attacaaagtttcaactaga

SEQ ID NO: 200870 - DNA, 20 bp, Artificial Sequence
  chemically synthesized
aaagattacaaagtttcaac

SEQ ID NO: 200871 - DNA, 20 bp, Artificial Sequence
  chemically synthesized
gttactgttcaaagattaca

SEQ ID NO: 200872 - DNA, 20 bp, Artificial Sequence
  chemically synthesized
gaaactttgtaatctttgaa

SEQ ID NO: 200873 - DNA, 20 bp, Artificial Sequence
  chemically synthesized
gaatagagagttactgttca

SEQ ID NO: 200874 - DNA, 20 bp, Artificial Sequence
  chemically synthesized
aggtggagtgagggaataga

SEQ ID NO: 200875 - DNA, 20 bp, Artificial Sequence
  chemically synthesized
ggaggtggagtgagggaata

SEQ ID NO: 200876 - DNA, 20 bp, Artificial Sequence
  chemically synthesized
tgggaggtggagtgagggaa

SEQ ID NO: 200877 - DNA, 20 bp, Artificial Sequence
  chemically synthesized
aggcttgggaggtggagtga

SEQ ID NO: 200878 - DNA, 20 bp, Artificial Sequence
  chemically synthesized
gaggcttgggaggtggagtg

SEQ ID NO: 200879 - DNA, 20 bp, Artificial Sequence
  chemically synthesized
agaggcttgggaggtggagt

SEQ ID NO: 200880 - DNA, 20 bp, Artificial Sequence
  chemically synthesized
taacagaggcttgggaggtg

SEQ ID NO: 200881 - DNA, 20 bp, Artificial Sequence
  chemically synthesized
attccctcactccacctccc

SEQ ID NO: 200882 - DNA, 20 bp, Artificial Sequence
  chemically synthesized
gttaacagaggcttgggagg

SEQ ID NO: 200883 - DNA, 20 bp, Artificial Sequence
  chemically synthesized
atggttaacagaggcttggg

SEQ ID NO: 200884 - DNA, 20 bp, Artificial Sequence
  chemically synthesized
catggttaacagaggcttgg

SEQ ID NO: 200885 - DNA, 20 bp, Artificial Sequence
  chemically synthesized
atcatggttaacagaggctt

SEQ ID NO: 200886 - DNA, 20 bp, Artificial Sequence
  chemically synthesized
aatcatggttaacagaggct

SEQ ID NO: 200887 - DNA, 20 bp, Artificial Sequence
  chemically synthesized
agtagaatcatggttaacag

SEQ ID NO: 200888 - DNA, 20 bp, Artificial Sequence
  chemically synthesized
gagtagaatcatggttaaca

SEQ ID NO: 200889 - DNA, 20 bp, Artificial Sequence
  chemically synthesized
tagagtagaatcatggttaa

SEQ ID NO: 200890 - DNA, 20 bp, Artificial Sequence
  chemically synthesized
agagatgtagagtagaatca

SEQ ID NO: 200891 - DNA, 20 bp, Artificial Sequence
  chemically synthesized
gaattcatagagatgtagag

SEQ ID NO: 200892 - DNA, 20 bp, Artificial Sequence
  chemically synthesized
gttgaattcatagagatgta

SEQ ID NO: 200893 - DNA, 20 bp, Artificial Sequence
  chemically synthesized
aagttgaattcatagagatg

SEQ ID NO: 200894 - DNA, 20 bp, Artificial Sequence
  chemically synthesized
taagaaaagttgaattcata

SEQ ID NO: 200895 - DNA, 20 bp, Artificial Sequence
  chemically synthesized
tgtaagaaaagttgaattca

SEQ ID NO: 200896 - DNA, 20 bp, Artificial Sequence
  chemically synthesized
ttaaatgtgcaatgtaagaa

SEQ ID NO: 200897 - DNA, 20 bp, Artificial Sequence
  chemically synthesized
gtcacttaaatgtgcaatgt

SEQ ID NO: 200898 - DNA, 20 bp, Artificial Sequence
  chemically synthesized
ttttcttacattgcacattt

SEQ ID NO: 200899 - DNA, 20 bp, Artificial Sequence
  chemically synthesized
cacatttaagtgacatcatg

SEQ ID NO: 200900 - DNA, 20 bp, Artificial Sequence
  chemically synthesized
atttttcccccaggcacaga

SEQ ID NO: 200901 - DNA, 20 bp, Artificial Sequence
  chemically synthesized
ggtatttgtctttctgtgcc

SEQ ID NO: 200902 - DNA, 20 bp, Artificial Sequence
  chemically synthesized
gtatttgtctttctgtgcct

SEQ ID NO: 200903 - DNA, 20 bp, Artificial Sequence
  chemically synthesized
tatttgtctttctgtgcctg

SEQ ID NO: 200904 - DNA, 20 bp, Artificial Sequence
  chemically synthesized
atttgtctttctgtgcctgg

SEQ ID NO: 200905 - DNA, 20 bp, Artificial Sequence
  chemically synthesized
gaacatttttcccccaggca

SEQ ID NO: 200906 - DNA, 20 bp, Artificial Sequence
  chemically synthesized
tacatgaacatttttccccc

SEQ ID NO: 200907 - DNA, 20 bp, Artificial Sequence
  chemically synthesized
gtacatgaacatttttcccc

SEQ ID NO: 200908 - DNA, 20 bp, Artificial Sequence
  chemically synthesized
ggaaaaatgttcatgtacct

SEQ ID NO: 200909 - DNA, 20 bp, Artificial Sequence
  chemically synthesized
aaaatgttcatgtacctcag

SEQ ID NO: 200910 - DNA, 20 bp, Artificial Sequence
  chemically synthesized
ttaaaatgtgtttacttctg

SEQ ID NO: 200911 - DNA, 20 bp, Artificial Sequence
  chemically synthesized
cttaaaatgtgtttacttct

SEQ ID NO: 200912 - DNA, 20 bp, Artificial Sequence
  chemically synthesized
ctcagaagtaaacacatttt

SEQ ID NO: 200913 - DNA, 20 bp, Artificial Sequence
  chemically synthesized
tgtgaatatatatttatata

SEQ ID NO: 200914 - DNA, 20 bp, Artificial Sequence
  chemically synthesized
ctgtgaatatatatttatat

SEQ ID NO: 200915 - DNA, 20 bp, Artificial Sequence
  chemically synthesized
tctgtgaatatatatttata

SEQ ID NO: 200916 - DNA, 20 bp, Artificial Sequence
  chemically synthesized
cctatataaatatatattca

SEQ ID NO: 200917 - DNA, 20 bp, Artificial Sequence
  chemically synthesized
attttaaattacattgacac

SEQ ID NO: 200918 - DNA, 20 bp, Artificial Sequence
  chemically synthesized
ttacattgacactagttttg

SEQ ID NO: 200919 - DNA, 20 bp, Artificial Sequence
  chemically synthesized
gtaagttgtgtctacaaaac

SEQ ID NO: 200920 - DNA, 20 bp, Artificial Sequence
  chemically synthesized
ttatagtgtatgtgatgtgt

SEQ ID NO: 200921 - DNA, 20 bp, Artificial Sequence
  chemically synthesized
tattttgattgtatatttta

SEQ ID NO: 200922 - DNA, 20 bp, Artificial Sequence
  chemically synthesized
acaatcaaaatattaatttc

SEQ ID NO: 200923 - DNA, 20 bp, Artificial Sequence
  chemically synthesized
aatcaaaatattaatttcta

SEQ ID NO: 200924 - DNA, 20 bp, Artificial Sequence
  chemically synthesized
aatattaatttctagagaac

SEQ ID NO: 200925 - DNA, 20 bp, Artificial Sequence
  chemically synthesized
tttttatttatcttgttctc

SEQ ID NO: 200926 - DNA, 20 bp, Artificial Sequence
  chemically synthesized
tagagaacaagataaataaa

SEQ ID NO: 200927 - DNA, 20 bp, Artificial Sequence
  chemically synthesized
tgctaaacagttggggtagt

SEQ ID NO: 200928 - DNA, 20 bp, Artificial Sequence
  chemically synthesized
tgcgtgctaaacagttgggg

SEQ ID NO: 200929 - DNA, 20 bp, Artificial Sequence
  chemically synthesized
atatgcgtgctaaacagttg

SEQ ID NO: 200930 - DNA, 20 bp, Artificial Sequence
  chemically synthesized
ttctcactaccccaactgtt

SEQ ID NO: 200931 - DNA, 20 bp, Artificial Sequence
  chemically synthesized
aatatgcgtgctaaacagtt

SEQ ID NO: 200932 - DNA, 20 bp, Artificial Sequence
  chemically synthesized
taatatgcgtgctaaacagt

SEQ ID NO: 200933 - DNA, 20 bp, Artificial Sequence
  chemically synthesized
ccaataatatgcgtgctaaa

SEQ ID NO: 200934 - DNA, 20 bp, Artificial Sequence
  chemically synthesized
ctgtttagcacgcatattat

SEQ ID NO: 200935 - DNA, 20 bp, Artificial Sequence
  chemically synthesized
tgtttagcacgcatattatt

SEQ ID NO: 200936 - DNA, 20 bp, Artificial Sequence
  chemically synthesized
tgggcatgtacattccactt

SEQ ID NO: 200937 - DNA, 20 bp, Artificial Sequence
  chemically synthesized
taggtcagttgttaccaaag

SEQ ID NO: 200938 - DNA, 20 bp, Artificial Sequence
  chemically synthesized
atctaggtcagttgttacca

SEQ ID NO: 200939 - DNA, 20 bp, Artificial Sequence
  chemically synthesized
cactttggtaacaactgacc

SEQ ID NO: 200940 - DNA, 20 bp, Artificial Sequence
  chemically synthesized
ttgaatttgattatctaggt

SEQ ID NO: 200941 - DNA, 20 bp, Artificial Sequence
  chemically synthesized
gaccttgaatttgattatct

SEQ ID NO: 200942 - DNA, 20 bp, Artificial Sequence
  chemically synthesized
cgaccttgaatttgattatc

SEQ ID NO: 200943 - DNA, 20 bp, Artificial Sequence
  chemically synthesized
tgacctagataatcaaattc

SEQ ID NO: 200944 - DNA, 20 bp, Artificial Sequence
  chemically synthesized
gacctagataatcaaattca

SEQ ID NO: 200945 - DNA, 20 bp, Artificial Sequence
  chemically synthesized
ataatcaaattcaaggtcgt

SEQ ID NO: 200946 - DNA, 20 bp, Artificial Sequence
  chemically synthesized
aatcaaattcaaggtcgttg

SEQ ID NO: 200947 - DNA, 20 bp, Artificial Sequence
  chemically synthesized
acacaccagtgaagttatga

SEQ ID NO: 200948 - DNA, 20 bp, Artificial Sequence
  chemically synthesized
cacacaccagtgaagttatg

SEQ ID NO: 200949 - DNA, 20 bp, Artificial Sequence
  chemically synthesized
aaaatccttcataacttcac

SEQ ID NO: 200950 - DNA, 20 bp, Artificial Sequence
  chemically synthesized
cttacacacacacaccagtg

SEQ ID NO: 200951 - DNA, 20 bp, Artificial Sequence
  chemically synthesized
acacgcttacacacacacac

SEQ ID NO: 200952 - DNA, 20 bp, Artificial Sequence
  chemically synthesized
cttcactggtgtgtgtgtgt

SEQ ID NO: 200953 - DNA, 20 bp, Artificial Sequence
  chemically synthesized
taaaatctagtggggattgt

SEQ ID NO: 200954 - DNA, 20 bp, Artificial Sequence
  chemically synthesized
tgtgtgcttacaatccccac

SEQ ID NO: 200955 - DNA, 20 bp, Artificial Sequence
  chemically synthesized
tttgagtttaaaatctagtg

SEQ ID NO: 200956 - DNA, 20 bp, Artificial Sequence
  chemically synthesized
ttttgagtttaaaatctagt

SEQ ID NO: 200957 - DNA, 20 bp, Artificial Sequence
  chemically synthesized
cttttgagtttaaaatctag

SEQ ID NO: 200958 - DNA, 20 bp, Artificial Sequence
  chemically synthesized
tctcttttgagtttaaaatc

SEQ ID NO: 200959 - DNA, 20 bp, Artificial Sequence
  chemically synthesized
ccactagattttaaactcaa

SEQ ID NO: 200960 - DNA, 20 bp, Artificial Sequence
  chemically synthesized
actagattttaaactcaaaa

SEQ ID NO: 200961 - DNA, 20 bp, Artificial Sequence
  chemically synthesized
ggcattgttggttctctttt

SEQ ID NO: 200962 - DNA, 20 bp, Artificial Sequence
  chemically synthesized
aaaaaatatgaaggcattgt

SEQ ID NO: 200963 - DNA, 20 bp, Artificial Sequence
  chemically synthesized
agagagaagaaaaaatatga

SEQ ID NO: 200964 - DNA, 20 bp, Artificial Sequence
  chemically synthesized
gagagagaagaaaaaatatg

SEQ ID NO: 200965 - DNA, 20 bp, Artificial Sequence
  chemically synthesized
aacacagattgaagagagag

SEQ ID NO: 200966 - DNA, 20 bp, Artificial Sequence
  chemically synthesized
gggaacacagattgaagaga

SEQ ID NO: 200967 - DNA, 20 bp, Artificial Sequence
  chemically synthesized
cagggaacacagattgaaga

SEQ ID NO: 200968 - DNA, 20 bp, Artificial Sequence
  chemically synthesized
ctcagggaacacagattgaa

SEQ ID NO: 200969 - DNA, 20 bp, Artificial Sequence
  chemically synthesized
atctcagggaacacagattg

SEQ ID NO: 200970 - DNA, 20 bp, Artificial Sequence
  chemically synthesized
gaaaaggatctcagggaaca

SEQ ID NO: 200971 - DNA, 20 bp, Artificial Sequence
  chemically synthesized
ctcttcaatctgtgttccct

SEQ ID NO: 200972 - DNA, 20 bp, Artificial Sequence
  chemically synthesized
ccaaatagaaaaggatctca

SEQ ID NO: 200973 - DNA, 20 bp, Artificial Sequence
  chemically synthesized
accaaatagaaaaggatctc

SEQ ID NO: 200974 - DNA, 20 bp, Artificial Sequence
  chemically synthesized
aaccaaatagaaaaggatct

SEQ ID NO: 200975 - DNA, 20 bp, Artificial Sequence
  chemically synthesized
gccagtgaaccaaatagaaa

SEQ ID NO: 200976 - DNA, 20 bp, Artificial Sequence
  chemically synthesized
ccctgagatccttttctatt

SEQ ID NO: 200977 - DNA, 20 bp, Artificial Sequence
  chemically synthesized
ggccagtgaaccaaatagaa

SEQ ID NO: 200978 - DNA, 20 bp, Artificial Sequence
  chemically synthesized
taaagggccagtgaaccaaa

SEQ ID NO: 200979 - DNA, 20 bp, Artificial Sequence
  chemically synthesized
tccttttctatttggttcac

SEQ ID NO: 200980 - DNA, 20 bp, Artificial Sequence
  chemically synthesized
ctgctttggggttaaagggc

SEQ ID NO: 200981 - DNA, 20 bp, Artificial Sequence
  chemically synthesized
gaaactgctttggggttaaa

SEQ ID NO: 200982 - DNA, 20 bp, Artificial Sequence
  chemically synthesized
ggaaactgctttggggttaa

SEQ ID NO: 200983 - DNA, 20 bp, Artificial Sequence
  chemically synthesized
tggaaactgctttggggtta

SEQ ID NO: 200984 - DNA, 20 bp, Artificial Sequence
  chemically synthesized
tcactggccctttaacccca

SEQ ID NO: 200985 - DNA, 20 bp, Artificial Sequence
  chemically synthesized
ctggccctttaaccccaaag

SEQ ID NO: 200986 - DNA, 20 bp, Artificial Sequence
  chemically synthesized
acagagtggaaactgctttg

SEQ ID NO: 200987 - DNA, 20 bp, Artificial Sequence
  chemically synthesized
cacagagtggaaactgcttt

SEQ ID NO: 200988 - DNA, 20 bp, Artificial Sequence
  chemically synthesized
ccacagagtggaaactgctt

SEQ ID NO: 200989 - DNA, 20 bp, Artificial Sequence
  chemically synthesized
ccaaagcagtttccactctg

SEQ ID NO: 200990 - DNA, 20 bp, Artificial Sequence
  chemically synthesized
tatttccttcttccacagag

SEQ ID NO: 200991 - DNA, 20 bp, Artificial Sequence
  chemically synthesized
aagcagtttccactctgtgg

SEQ ID NO: 200992 - DNA, 20 bp, Artificial Sequence
  chemically synthesized
aactatttccttcttccaca

SEQ ID NO: 200993 - DNA, 20 bp, Artificial Sequence
  chemically synthesized
cagtttccactctgtggaag

SEQ ID NO: 200994 - DNA, 20 bp, Artificial Sequence
  chemically synthesized
agtttccactctgtggaaga

SEQ ID NO: 200995 - DNA, 20 bp, Artificial Sequence
  chemically synthesized
gaaactatttccttcttcca

SEQ ID NO: 200996 - DNA, 20 bp, Artificial Sequence
  chemically synthesized
cactctgtggaagaaggaaa

SEQ ID NO: 200997 - DNA, 20 bp, Artificial Sequence
  chemically synthesized
gaaatagtttcattatattt

SEQ ID NO: 200998 - DNA, 20 bp, Artificial Sequence
  chemically synthesized
gtttcattatattttggctc

SEQ ID NO: 200999 - DNA, 20 bp, Artificial Sequence
  chemically synthesized
tttcattatattttggctct

SEQ ID NO: 201000 - DNA, 20 bp, Artificial Sequence
  chemically synthesized
ttaaatgaagaaacaaccca

SEQ ID NO: 201001 - DNA, 20 bp, Artificial Sequence
  chemically synthesized
ttttaaatgaagaaacaacc

SEQ ID NO: 201002 - DNA, 20 bp, Artificial Sequence
  chemically synthesized
tttagctacggttttaaatg

SEQ ID NO: 201003 - DNA, 20 bp, Artificial Sequence
  chemically synthesized
tgtttcttcatttaaaaccg

SEQ ID NO: 201004 - DNA, 20 bp, Artificial Sequence
  chemically synthesized
ttcatttaaaaccgtagcta

SEQ ID NO: 201005 - DNA, 20 bp, Artificial Sequence
  chemically synthesized
tctggtctggactttagcta

SEQ ID NO: 201006 - DNA, 20 bp, Artificial Sequence
  chemically synthesized
ttaaaaccgtagctaaagtc

SEQ ID NO: 201007 - DNA, 20 bp, Artificial Sequence
  chemically synthesized
tcattctctggtctggactt

SEQ ID NO: 201008 - DNA, 20 bp, Artificial Sequence
  chemically synthesized
accgtagctaaagtccagac

SEQ ID NO: 201009 - DNA, 20 bp, Artificial Sequence
  chemically synthesized
cgtagctaaagtccagacca

SEQ ID NO: 201010 - DNA, 20 bp, Artificial Sequence
  chemically synthesized
tttcaaatcattctctggtc

SEQ ID NO: 201011 - DNA, 20 bp, Artificial Sequence
  chemically synthesized
atggttttcaaatcattctc

SEQ ID NO: 201012 - DNA, 20 bp, Artificial Sequence
  chemically synthesized
tgatttgaaaaccatacctt

SEQ ID NO: 201013 - DNA, 20 bp, Artificial Sequence
  chemically synthesized
aaaaactcattcttaaggta

SEQ ID NO: 201014 - DNA, 20 bp, Artificial Sequence
  chemically synthesized
gaaaaccataccttaagaat

SEQ ID NO: 201015 - DNA, 20 bp, Artificial Sequence
  chemically synthesized
ctaggaaaaactcattctta

SEQ ID NO: 201016 - DNA, 20 bp, Artificial Sequence
  chemically synthesized
actaggaaaaactcattctt

SEQ ID NO: 201017 - DNA, 20 bp, Artificial Sequence
  chemically synthesized
ccttaagaatgagtttttcc

SEQ ID NO: 201018 - DNA, 20 bp, Artificial Sequence
  chemically synthesized
agaatgagtttttcctagta

SEQ ID NO: 201019 - DNA, 20 bp, Artificial Sequence
  chemically synthesized
atgagtttttcctagtacag

SEQ ID NO: 201020 - DNA, 20 bp, Artificial Sequence
  chemically synthesized
gttcttatgtctactgtact

SEQ ID NO: 201021 - DNA, 20 bp, Artificial Sequence
  chemically synthesized
agttcttatgtctactgtac

SEQ ID NO: 201022 - DNA, 20 bp, Artificial Sequence
  chemically synthesized
tttcctagtacagtagacat

SEQ ID NO: 201023 - DNA, 20 bp, Artificial Sequence
  chemically synthesized
cagtagacataagaactctc

SEQ ID NO: 201024 - DNA, 20 bp, Artificial Sequence
  chemically synthesized
agacataagaactctctgga

SEQ ID NO: 201025 - DNA, 20 bp, Artificial Sequence
  chemically synthesized
gacataagaactctctggat

SEQ ID NO: 201026 - DNA, 20 bp, Artificial Sequence
  chemically synthesized
ttgactcccccccatccaga

SEQ ID NO: 201027 - DNA, 20 bp, Artificial Sequence
  chemically synthesized
acataagaactctctggatg

SEQ ID NO: 201028 - DNA, 20 bp, Artificial Sequence
  chemically synthesized
cataagaactctctggatgg

SEQ ID NO: 201029 - DNA, 20 bp, Artificial Sequence
  chemically synthesized
ttttgactcccccccatcca

SEQ ID NO: 201030 - DNA, 20 bp, Artificial Sequence
  chemically synthesized
ataagaactctctggatggg

SEQ ID NO: 201031 - DNA, 20 bp, Artificial Sequence
  chemically synthesized
taagaactctctggatgggg

SEQ ID NO: 201032 - DNA, 20 bp, Artificial Sequence
  chemically synthesized
ctttttgactcccccccatc

SEQ ID NO: 201033 - DNA, 20 bp, Artificial Sequence
  chemically synthesized
agaactctctggatgggggg

SEQ ID NO: 201034 - DNA, 20 bp, Artificial Sequence
  chemically synthesized
ctggatgggggggagtcaaa

SEQ ID NO: 201035 - DNA, 20 bp, Artificial Sequence
  chemically synthesized
atgggggggagtcaaaaaga

SEQ ID NO: 201036 - DNA, 20 bp, Artificial Sequence
  chemically synthesized
gggggagtcaaaaagaaagt

SEQ ID NO: 201037 - DNA, 20 bp, Artificial Sequence
  chemically synthesized
ggggagtcaaaaagaaagtt

SEQ ID NO: 201038 - DNA, 20 bp, Artificial Sequence
  chemically synthesized
gggagtcaaaaagaaagttg

SEQ ID NO: 201039 - DNA, 20 bp, Artificial Sequence
  chemically synthesized
gagtcaaaaagaaagttggg

SEQ ID NO: 201040 - DNA, 20 bp, Artificial Sequence
  chemically synthesized
agtcaaaaagaaagttgggg

SEQ ID NO: 201041 - DNA, 20 bp, Artificial Sequence
  chemically synthesized
caaaaagaaagttggggagg

SEQ ID NO: 201042 - DNA, 20 bp, Artificial Sequence
  chemically synthesized
aagaaagttggggaggaagc

SEQ ID NO: 201043 - DNA, 20 bp, Artificial Sequence
  chemically synthesized
tggggaggaagcaagaaaat

SEQ ID NO: 201044 - DNA, 20 bp, Artificial Sequence
  chemically synthesized
gcaagaaaattagatgcttg

SEQ ID NO: 201045 - DNA, 20 bp, Artificial Sequence
  chemically synthesized
caagaaaattagatgcttgt

SEQ ID NO: 201046 - DNA, 20 bp, Artificial Sequence
  chemically synthesized
ccccctcttcggaaacctac

SEQ ID NO: 201047 - DNA, 20 bp, Artificial Sequence
  chemically synthesized
tagatgcttgtaggtttccg

SEQ ID NO: 201048 - DNA, 20 bp, Artificial Sequence
  chemically synthesized
gatgcttgtaggtttccgaa

SEQ ID NO: 201049 - DNA, 20 bp, Artificial Sequence
  chemically synthesized
atgcttgtaggtttccgaag

SEQ ID NO: 201050 - DNA, 20 bp, Artificial Sequence
  chemically synthesized
tgcttgtaggtttccgaaga

SEQ ID NO: 201051 - DNA, 20 bp, Artificial Sequence
  chemically synthesized
gcttgtaggtttccgaagag

SEQ ID NO: 201052 - DNA, 20 bp, Artificial Sequence
  chemically synthesized
cttgtaggtttccgaagagg

SEQ ID NO: 201053 - DNA, 20 bp, Artificial Sequence
  chemically synthesized
gccacatcaggccccctctt

SEQ ID NO: 201054 - DNA, 20 bp, Artificial Sequence
  chemically synthesized
tccgaagagggggcctgatg

SEQ ID NO: 201055 - DNA, 20 bp, Artificial Sequence
  chemically synthesized
gaagagggggcctgatgtgg

SEQ ID NO: 201056 - DNA, 20 bp, Artificial Sequence
  chemically synthesized
tgatgaaatactgccacatc

SEQ ID NO: 201057 - DNA, 20 bp, Artificial Sequence
  chemically synthesized
ctgatgaaatactgccacat

SEQ ID NO: 201058 - DNA, 20 bp, Artificial Sequence
  chemically synthesized
ctgatgtggcagtatttcat

SEQ ID NO: 201059 - DNA, 20 bp, Artificial Sequence
  chemically synthesized
tgtggcagtatttcatcagc

SEQ ID NO: 201060 - DNA, 20 bp, Artificial Sequence
  chemically synthesized
ggcagtatttcatcagcaag

SEQ ID NO: 201061 - DNA, 20 bp, Artificial Sequence
  chemically synthesized
gcagtatttcatcagcaaga

SEQ ID NO: 201062 - DNA, 20 bp, Artificial Sequence
  chemically synthesized
cagtatttcatcagcaagaa

SEQ ID NO: 201063 - DNA, 20 bp, Artificial Sequence
  chemically synthesized
tttcatcagcaagaagggca

SEQ ID NO: 201064 - DNA, 20 bp, Artificial Sequence
  chemically synthesized
ttcatcagcaagaagggcaa

SEQ ID NO: 201065 - DNA, 20 bp, Artificial Sequence
  chemically synthesized
atcagcaagaagggcaaagg

SEQ ID NO: 201066 - DNA, 20 bp, Artificial Sequence
  chemically synthesized
ctctgaggcctcaagaaatt

SEQ ID NO: 201067 - DNA, 20 bp, Artificial Sequence
  chemically synthesized
gcagattcactaaatttctt

SEQ ID NO: 201068 - DNA, 20 bp, Artificial Sequence
  chemically synthesized
cagattcactaaatttcttg

SEQ ID NO: 201069 - DNA, 20 bp, Artificial Sequence
  chemically synthesized
cactaaatttcttgaggcct

SEQ ID NO: 201070 - DNA, 20 bp, Artificial Sequence
  chemically synthesized
tggctgcactctgaggcctc

SEQ ID NO: 201071 - DNA, 20 bp, Artificial Sequence
  chemically synthesized
ctaaatttcttgaggcctca

SEQ ID NO: 201072 - DNA, 20 bp, Artificial Sequence
  chemically synthesized
tttcttgaggcctcagagtg

SEQ ID NO: 201073 - DNA, 20 bp, Artificial Sequence
  chemically synthesized
cacttgctggctgcactctg

SEQ ID NO: 201074 - DNA, 20 bp, Artificial Sequence
  chemically synthesized
ccacttgctggctgcactct

SEQ ID NO: 201075 - DNA, 20 bp, Artificial Sequence
  chemically synthesized
ttgaggcctcagagtgcagc

SEQ ID NO: 201076 - DNA, 20 bp, Artificial Sequence
  chemically synthesized
ggcctcagagtgcagccagc

SEQ ID NO: 201077 - DNA, 20 bp, Artificial Sequence
  chemically synthesized
ctcagagtgcagccagcaag

SEQ ID NO: 201078 - DNA, 20 bp, Artificial Sequence
  chemically synthesized
ggaaaaatgtagccacttgc

SEQ ID NO: 201079 - DNA, 20 bp, Artificial Sequence
  chemically synthesized
tttcagggacaggaaaaatg

SEQ ID NO: 201080 - DNA, 20 bp, Artificial Sequence
  chemically synthesized
cccacactcttttcagggac

SEQ ID NO: 201081 - DNA, 20 bp, Artificial Sequence
  chemically synthesized
tcccacactcttttcaggga

SEQ ID NO: 201082 - DNA, 20 bp, Artificial Sequence
  chemically synthesized
acatttttcctgtccctgaa

SEQ ID NO: 201083 - DNA, 20 bp, Artificial Sequence
  chemically synthesized
atttttcctgtccctgaaaa

SEQ ID NO: 201084 - DNA, 20 bp, Artificial Sequence
  chemically synthesized
caactcccacactcttttca

SEQ ID NO: 201085 - DNA, 20 bp, Artificial Sequence
  chemically synthesized
tcaactcccacactcttttc

SEQ ID NO: 201086 - DNA, 20 bp, Artificial Sequence
  chemically synthesized
gtcaactcccacactctttt

SEQ ID NO: 201087 - DNA, 20 bp, Artificial Sequence
  chemically synthesized
tcctgtccctgaaaagagtg

SEQ ID NO: 201088 - DNA, 20 bp, Artificial Sequence
  chemically synthesized
cctgtccctgaaaagagtgt

SEQ ID NO: 201089 - DNA, 20 bp, Artificial Sequence
  chemically synthesized
tgtccctgaaaagagtgtgg

SEQ ID NO: 201090 - DNA, 20 bp, Artificial Sequence
  chemically synthesized
aaagagtgtgggagttgact

SEQ ID NO: 201091 - DNA, 20 bp, Artificial Sequence
  chemically synthesized
aagagtgtgggagttgactg

SEQ ID NO: 201092 - DNA, 20 bp, Artificial Sequence
  chemically synthesized
tgtgggagttgactgaggaa

SEQ ID NO: 201093 - DNA, 20 bp, Artificial Sequence
  chemically synthesized
tgggagttgactgaggaaaa

SEQ ID NO: 201094 - DNA, 20 bp, Artificial Sequence
  chemically synthesized
ctatgaccaactcttttcct

SEQ ID NO: 201095 - DNA, 20 bp, Artificial Sequence
  chemically synthesized
agttgactgaggaaaagagt

SEQ ID NO: 201096 - DNA, 20 bp, Artificial Sequence
  chemically synthesized
ctgaggaaaagagttggtca

SEQ ID NO: 201097 - DNA, 20 bp, Artificial Sequence
  chemically synthesized
ggaaaagagttggtcatagc

SEQ ID NO: 201098 - DNA, 20 bp, Artificial Sequence
  chemically synthesized
aaaagagttggtcatagcaa

SEQ ID NO: 201099 - DNA, 20 bp, Artificial Sequence
  chemically synthesized
gcaagagatgcttaactgaa

SEQ ID NO: 201100 - DNA, 20 bp, Artificial Sequence
  chemically synthesized
gcccatgcagcttttcagtt

SEQ ID NO: 201101 - DNA, 20 bp, Artificial Sequence
  chemically synthesized
gcatggcccatgcagctttt

SEQ ID NO: 201102 - DNA, 20 bp, Artificial Sequence
  chemically synthesized
tgcttaactgaaaagctgca

SEQ ID NO: 201103 - DNA, 20 bp, Artificial Sequence
  chemically synthesized
gcttaactgaaaagctgcat

SEQ ID NO: 201104 - DNA, 20 bp, Artificial Sequence
  chemically synthesized
ttaacactgcatggcccatg

SEQ ID NO: 201105 - DNA, 20 bp, Artificial Sequence
  chemically synthesized
gaaaagctgcatgggccatg

SEQ ID NO: 201106 - DNA, 20 bp, Artificial Sequence
  chemically synthesized
ttcttgagtttaacactgca

SEQ ID NO: 201107 - DNA, 20 bp, Artificial Sequence
  chemically synthesized
ggccatgcagtgttaaactc

SEQ ID NO: 201108 - DNA, 20 bp, Artificial Sequence
  chemically synthesized
tctcaaggcctcaatttctt

SEQ ID NO: 201109 - DNA, 20 bp, Artificial Sequence
  chemically synthesized
agtgttaaactcaagaaatt

SEQ ID NO: 201110 - DNA, 20 bp, Artificial Sequence
  chemically synthesized
gtgttaaactcaagaaattg

SEQ ID NO: 201111 - DNA, 20 bp, Artificial Sequence
  chemically synthesized
actcaagaaattgaggcctt

SEQ ID NO: 201112 - DNA, 20 bp, Artificial Sequence
  chemically synthesized
caagaaattgaggccttgag

SEQ ID NO: 201113 - DNA, 20 bp, Artificial Sequence
  chemically synthesized
aagaaattgaggccttgaga

SEQ ID NO: 201114 - DNA, 20 bp, Artificial Sequence
  chemically synthesized
agaaattgaggccttgagaa

SEQ ID NO: 201115 - DNA, 20 bp, Artificial Sequence
  chemically synthesized
gaaattgaggccttgagaag

SEQ ID NO: 201116 - DNA, 20 bp, Artificial Sequence
  chemically synthesized
gcccatgggtccccttctca

SEQ ID NO: 201117 - DNA, 20 bp, Artificial Sequence
  chemically synthesized
tgcccatgggtccccttctc

SEQ ID NO: 201118 - DNA, 20 bp, Artificial Sequence
  chemically synthesized
ggccttgagaaggggaccca

SEQ ID NO: 201119 - DNA, 20 bp, Artificial Sequence
  chemically synthesized
gccttgagaaggggacccat

SEQ ID NO: 201120 - DNA, 20 bp, Artificial Sequence
  chemically synthesized
ttgagaaggggacccatggg

SEQ ID NO: 201121 - DNA, 20 bp, Artificial Sequence
  chemically synthesized
actcttgagcatctgcccat

SEQ ID NO: 201122 - DNA, 20 bp, Artificial Sequence
  chemically synthesized
tactcttgagcatctgccca

SEQ ID NO: 201123 - DNA, 20 bp, Artificial Sequence
  chemically synthesized
ggacccatgggcagatgctc

SEQ ID NO: 201124 - DNA, 20 bp, Artificial Sequence
  chemically synthesized
acccatgggcagatgctcaa

SEQ ID NO: 201125 - DNA, 20 bp, Artificial Sequence
  chemically synthesized
tgggcagatgctcaagagta

SEQ ID NO: 201126 - DNA, 20 bp, Artificial Sequence
  chemically synthesized
ttctgaatgtctttactctt

SEQ ID NO: 201127 - DNA, 20 bp, Artificial Sequence
  chemically synthesized
tgctcaagagtaaagacatt

SEQ ID NO: 201128 - DNA, 20 bp, Artificial Sequence
  chemically synthesized
gagtaaagacattcagaacc

SEQ ID NO: 201129 - DNA, 20 bp, Artificial Sequence
  chemically synthesized
agtaaagacattcagaacca

SEQ ID NO: 201130 - DNA, 20 bp, Artificial Sequence
  chemically synthesized
agacattcagaaccaaggtg

SEQ ID NO: 201131 - DNA, 20 bp, Artificial Sequence
  chemically synthesized
gcacggttttgtctgcacct

SEQ ID NO: 201132 - DNA, 20 bp, Artificial Sequence
  chemically synthesized
attgttatcttatggatgca

SEQ ID NO: 201133 - DNA, 20 bp, Artificial Sequence
  chemically synthesized
agacaaaaccgtgcatccat

SEQ ID NO: 201134 - DNA, 20 bp, Artificial Sequence
  chemically synthesized
ctgtatacattgttatctta

SEQ ID NO: 201135 - DNA, 20 bp, Artificial Sequence
  chemically synthesized
ccataagataacaatgtata

SEQ ID NO: 201136 - DNA, 20 bp, Artificial Sequence
  chemically synthesized
gtatacagacacatcccctg

SEQ ID NO: 201137 - DNA, 20 bp, Artificial Sequence
  chemically synthesized
tatacagacacatcccctga

SEQ ID NO: 201138 - DNA, 20 bp, Artificial Sequence
  chemically synthesized
gaagcacgtatggccttcag

SEQ ID NO: 201139 - DNA, 20 bp, Artificial Sequence
  chemically synthesized
tgaagcacgtatggccttca

SEQ ID NO: 201140 - DNA, 20 bp, Artificial Sequence
  chemically synthesized
atgaagcacgtatggccttc

SEQ ID NO: 201141 - DNA, 20 bp, Artificial Sequence
  chemically synthesized
catgaagcacgtatggcctt

SEQ ID NO: 201142 - DNA, 20 bp, Artificial Sequence
  chemically synthesized
aagtgttcatgaagcacgta

SEQ ID NO: 201143 - DNA, 20 bp, Artificial Sequence
  chemically synthesized
ccagttcccaagtgttcatg

SEQ ID NO: 201144 - DNA, 20 bp, Artificial Sequence
  chemically synthesized
atacgtgcttcatgaacact

SEQ ID NO: 201145 - DNA, 20 bp, Artificial Sequence
  chemically synthesized
tacgtgcttcatgaacactt

SEQ ID NO: 201146 - DNA, 20 bp, Artificial Sequence
  chemically synthesized
cttcatgaacacttgggaac

SEQ ID NO: 201147 - DNA, 20 bp, Artificial Sequence
  chemically synthesized
ttcatgaacacttgggaact

SEQ ID NO: 201148 - DNA, 20 bp, Artificial Sequence
  chemically synthesized
gtgtaggcatcccagttccc

SEQ ID NO: 201149 - DNA, 20 bp, Artificial Sequence
  chemically synthesized
ttctttctgtgtaggcatcc

SEQ ID NO: 201150 - DNA, 20 bp, Artificial Sequence
  chemically synthesized
tgggaactgggatgcctaca

SEQ ID NO: 201151 - DNA, 20 bp, Artificial Sequence
  chemically synthesized
aactgggatgcctacacaga

SEQ ID NO: 201152 - DNA, 20 bp, Artificial Sequence
  chemically synthesized
tccccatcttctttctgtgt

SEQ ID NO: 201153 - DNA, 20 bp, Artificial Sequence
  chemically synthesized
ctccccatcttctttctgtg

SEQ ID NO: 201154 - DNA, 20 bp, Artificial Sequence
  chemically synthesized
tgggatgcctacacagaaag

SEQ ID NO: 201155 - DNA, 20 bp, Artificial Sequence
  chemically synthesized
atgcctacacagaaagaaga

SEQ ID NO: 201156 - DNA, 20 bp, Artificial Sequence
  chemically synthesized
tgcctacacagaaagaagat

SEQ ID NO: 201157 - DNA, 20 bp, Artificial Sequence
  chemically synthesized
gcctacacagaaagaagatg

SEQ ID NO: 201158 - DNA, 20 bp, Artificial Sequence
  chemically synthesized
ctacacagaaagaagatggg

SEQ ID NO: 201159 - DNA, 20 bp, Artificial Sequence
  chemically synthesized
tacacagaaagaagatgggg

SEQ ID NO: 201160 - DNA, 20 bp, Artificial Sequence
  chemically synthesized
tggggaggaacaatcctaaa

SEQ ID NO: 201161 - DNA, 20 bp, Artificial Sequence
  chemically synthesized
ttcttcattggtttccattt

SEQ ID NO: 201162 - DNA, 20 bp, Artificial Sequence
  chemically synthesized
tttcttcattggtttccatt

SEQ ID NO: 201163 - DNA, 20 bp, Artificial Sequence
  chemically synthesized
atcctaaatggaaaccaatg

SEQ ID NO: 201164 - DNA, 20 bp, Artificial Sequence
  chemically synthesized
tgatttcaggttttcttcat

SEQ ID NO: 201165 - DNA, 20 bp, Artificial Sequence
  chemically synthesized
aacataaccatattgatttc

SEQ ID NO: 201166 - DNA, 20 bp, Artificial Sequence
  chemically synthesized
aaacataaccatattgattt

SEQ ID NO: 201167 - DNA, 20 bp, Artificial Sequence
  chemically synthesized
aagaaaacctgaaatcaata

SEQ ID NO: 201168 - DNA, 20 bp, Artificial Sequence
  chemically synthesized
tggttatgttttctgtcttc

SEQ ID NO: 201169 - DNA, 20 bp, Artificial Sequence
  chemically synthesized
gacccctttctacttgaaga

SEQ ID NO: 201170 - DNA, 20 bp, Artificial Sequence
  chemically synthesized
ttatgttttctgtcttcaag

SEQ ID NO: 201171 - DNA, 20 bp, Artificial Sequence
  chemically synthesized
acatgacccctttctacttg

SEQ ID NO: 201172 - DNA, 20 bp, Artificial Sequence
  chemically synthesized
gttttctgtcttcaagtaga

SEQ ID NO: 201173 - DNA, 20 bp, Artificial Sequence
  chemically synthesized
ttttctgtcttcaagtagaa

SEQ ID NO: 201174 - DNA, 20 bp, Artificial Sequence
  chemically synthesized
tttctgtcttcaagtagaaa

SEQ ID NO: 201175 - DNA, 20 bp, Artificial Sequence
  chemically synthesized
ttctgtcttcaagtagaaag

SEQ ID NO: 201176 - DNA, 20 bp, Artificial Sequence
  chemically synthesized
tagccattcttttgaatgga

SEQ ID NO: 201177 - DNA, 20 bp, Artificial Sequence
  chemically synthesized
ggtcatgtccatccattcaa

SEQ ID NO: 201178 - DNA, 20 bp, Artificial Sequence
  chemically synthesized
atcttagccattcttttgaa

SEQ ID NO: 201179 - DNA, 20 bp, Artificial Sequence
  chemically synthesized
tgtccatccattcaaaagaa

SEQ ID NO: 201180 - DNA, 20 bp, Artificial Sequence
  chemically synthesized
atccattcaaaagaatggct

SEQ ID NO: 201181 - DNA, 20 bp, Artificial Sequence
  chemically synthesized
ttcaaaagaatggctaagat

SEQ ID NO: 201182 - DNA, 20 bp, Artificial Sequence
  chemically synthesized
atgcaagattaatctcatct

SEQ ID NO: 201183 - DNA, 20 bp, Artificial Sequence
  chemically synthesized
aaaatgcatccgggaaatgc

SEQ ID NO: 201184 - DNA, 20 bp, Artificial Sequence
  chemically synthesized
gagattaatcttgcatttcc

SEQ ID NO: 201185 - DNA, 20 bp, Artificial Sequence
  chemically synthesized
aacttggggaaaatgcatcc

SEQ ID NO: 201186 - DNA, 20 bp, Artificial Sequence
  chemically synthesized
caacttggggaaaatgcatc

SEQ ID NO: 201187 - DNA, 20 bp, Artificial Sequence
  chemically synthesized
ttcccggatgcattttcccc

SEQ ID NO: 201188 - DNA, 20 bp, Artificial Sequence
  chemically synthesized
cggatgcattttccccaagt

SEQ ID NO: 201189 - DNA, 20 bp, Artificial Sequence
  chemically synthesized
gatgcattttccccaagttg

SEQ ID NO: 201190 - DNA, 20 bp, Artificial Sequence
  chemically synthesized
ctggcttacactccaacttg

SEQ ID NO: 201191 - DNA, 20 bp, Artificial Sequence
  chemically synthesized
gctggcttacactccaactt

SEQ ID NO: 201192 - DNA, 20 bp, Artificial Sequence
  chemically synthesized
agctggcttacactccaact

SEQ ID NO: 201193 - DNA, 20 bp, Artificial Sequence
  chemically synthesized
ttttccccaagttggagtgt

SEQ ID NO: 201194 - DNA, 20 bp, Artificial Sequence
  chemically synthesized
ccccaagttggagtgtaagc

SEQ ID NO: 201195 - DNA, 20 bp, Artificial Sequence
  chemically synthesized
tggagtgtaagccagctctt

SEQ ID NO: 201196 - DNA, 20 bp, Artificial Sequence
  chemically synthesized
gttctaaagctccaaagagc

SEQ ID NO: 201197 - DNA, 20 bp, Artificial Sequence
  chemically synthesized
gagtgtaagccagctctttg

SEQ ID NO: 201198 - DNA, 20 bp, Artificial Sequence
  chemically synthesized
cttagttctaaagctccaaa

SEQ ID NO: 201199 - DNA, 20 bp, Artificial Sequence
  chemically synthesized
tgcttagttctaaagctcca

SEQ ID NO: 201200 - DNA, 20 bp, Artificial Sequence
  chemically synthesized
aagccagctctttggagctt

SEQ ID NO: 201201 - DNA, 20 bp, Artificial Sequence
  chemically synthesized
ctctttggagctttagaact

SEQ ID NO: 201202 - DNA, 20 bp, Artificial Sequence
  chemically synthesized
agagatgatgcttagttcta

SEQ ID NO: 201203 - DNA, 20 bp, Artificial Sequence
  chemically synthesized
aaggaagaagagatgatgct

SEQ ID NO: 201204 - DNA, 20 bp, Artificial Sequence
  chemically synthesized
catatgtcagcaaggaagaa

SEQ ID NO: 201205 - DNA, 20 bp, Artificial Sequence
  chemically synthesized
aacatatgtcagcaaggaag

SEQ ID NO: 201206 - DNA, 20 bp, Artificial Sequence
  chemically synthesized
tagaacatatgtcagcaagg

SEQ ID NO: 201207 - DNA, 20 bp, Artificial Sequence
  chemically synthesized
caatagaacatatgtcagca

SEQ ID NO: 201208 - DNA, 20 bp, Artificial Sequence
  chemically synthesized
tcaatagaacatatgtcagc

SEQ ID NO: 201209 - DNA, 20 bp, Artificial Sequence
  chemically synthesized
atgttcaatagaacatatgt

SEQ ID NO: 201210 - DNA, 20 bp, Artificial Sequence
  chemically synthesized
ttttgagaaaagatgttcaa

SEQ ID NO: 201211 - DNA, 20 bp, Artificial Sequence
  chemically synthesized
aaacaggtctattttgagaa

SEQ ID NO: 201212 - DNA, 20 bp, Artificial Sequence
  chemically synthesized
ttgaacatcttttctcaaaa

SEQ ID NO: 201213 - DNA, 20 bp, Artificial Sequence
  chemically synthesized
gggcgaaacaggtctatttt

SEQ ID NO: 201214 - DNA, 20 bp, Artificial Sequence
  chemically synthesized
attttcaatgtgggcgaaac

SEQ ID NO: 201215 - DNA, 20 bp, Artificial Sequence
  chemically synthesized
gattttcaatgtgggcgaaa

SEQ ID NO: 201216 - DNA, 20 bp, Artificial Sequence
  chemically synthesized
ccttgacagattttcaatgt

SEQ ID NO: 201217 - DNA, 20 bp, Artificial Sequence
  chemically synthesized
gccttgacagattttcaatg

SEQ ID NO: 201218 - DNA, 20 bp, Artificial Sequence
  chemically synthesized
gcccacattgaaaatctgtc

SEQ ID NO: 201219 - DNA, 20 bp, Artificial Sequence
  chemically synthesized
cccacattgaaaatctgtca

SEQ ID NO: 201220 - DNA, 20 bp, Artificial Sequence
  chemically synthesized
acattgaaaatctgtcaagg

SEQ ID NO: 201221 - DNA, 20 bp, Artificial Sequence
  chemically synthesized
cattgaaaatctgtcaaggc

SEQ ID NO: 201222 - DNA, 20 bp, Artificial Sequence
  chemically synthesized
gggggagagacctgccttga

SEQ ID NO: 201223 - DNA, 20 bp, Artificial Sequence
  chemically synthesized
agatcaccaggaagggggga

SEQ ID NO: 201224 - DNA, 20 bp, Artificial Sequence
  chemically synthesized
ggagatcaccaggaaggggg

SEQ ID NO: 201225 - DNA, 20 bp, Artificial Sequence
  chemically synthesized
gcaggtctctccccccttcc

SEQ ID NO: 201226 - DNA, 20 bp, Artificial Sequence
  chemically synthesized
gtggagatcaccaggaaggg

SEQ ID NO: 201227 - DNA, 20 bp, Artificial Sequence
  chemically synthesized
tgtggagatcaccaggaagg

SEQ ID NO: 201228 - DNA, 20 bp, Artificial Sequence
  chemically synthesized
ttgtggagatcaccaggaag

SEQ ID NO: 201229 - DNA, 20 bp, Artificial Sequence
  chemically synthesized
cttgtggagatcaccaggaa

SEQ ID NO: 201230 - DNA, 20 bp, Artificial Sequence
  chemically synthesized
acttgtggagatcaccagga

SEQ ID NO: 201231 - DNA, 20 bp, Artificial Sequence
  chemically synthesized
cacttgtggagatcaccagg

SEQ ID NO: 201232 - DNA, 20 bp, Artificial Sequence
  chemically synthesized
caacacttgtggagatcacc

SEQ ID NO: 201233 - DNA, 20 bp, Artificial Sequence
  chemically synthesized
ccaacacttgtggagatcac

SEQ ID NO: 201234 - DNA, 20 bp, Artificial Sequence
  chemically synthesized
cccttcctggtgatctccac

SEQ ID NO: 201235 - DNA, 20 bp, Artificial Sequence
  chemically synthesized
catcccttccaacacttgtg

SEQ ID NO: 201236 - DNA, 20 bp, Artificial Sequence
  chemically synthesized
ctggtgatctccacaagtgt

SEQ ID NO: 201237 - DNA, 20 bp, Artificial Sequence
  chemically synthesized
gacatcccttccaacacttg

SEQ ID NO: 201238 - DNA, 20 bp, Artificial Sequence
  chemically synthesized
gtgatctccacaagtgttgg

SEQ ID NO: 201239 - DNA, 20 bp, Artificial Sequence
  chemically synthesized
tgatctccacaagtgttgga

SEQ ID NO: 201240 - DNA, 20 bp, Artificial Sequence
  chemically synthesized
gatctccacaagtgttggaa

SEQ ID NO: 201241 - DNA, 20 bp, Artificial Sequence
  chemically synthesized
aagtgttggaagggatgtcc

SEQ ID NO: 201242 - DNA, 20 bp, Artificial Sequence
  chemically synthesized
tgttggaagggatgtcctgg

SEQ ID NO: 201243 - DNA, 20 bp, Artificial Sequence
  chemically synthesized
tgggcaggtccacgactgcc

SEQ ID NO: 201244 - DNA, 20 bp, Artificial Sequence
  chemically synthesized
aagggatgtcctggcagtcg

SEQ ID NO: 201245 - DNA, 20 bp, Artificial Sequence
  chemically synthesized
gtgggcaggtccacgactgc

SEQ ID NO: 201246 - DNA, 20 bp, Artificial Sequence
  chemically synthesized
ccacctggcagtaagtgggc

SEQ ID NO: 201247 - DNA, 20 bp, Artificial Sequence
  chemically synthesized
accacctggcagtaagtggg

SEQ ID NO: 201248 - DNA, 20 bp, Artificial Sequence
  chemically synthesized
ggcaccacctggcagtaagt

SEQ ID NO: 201249 - DNA, 20 bp, Artificial Sequence
  chemically synthesized
cggcaccacctggcagtaag

SEQ ID NO: 201250 - DNA, 20 bp, Artificial Sequence
  chemically synthesized
tggacctgcccacttactgc

SEQ ID NO: 201251 - DNA, 20 bp, Artificial Sequence
  chemically synthesized
ggacctgcccacttactgcc

SEQ ID NO: 201252 - DNA, 20 bp, Artificial Sequence
  chemically synthesized
aatcggcaccacctggcagt

SEQ ID NO: 201253 - DNA, 20 bp, Artificial Sequence
  chemically synthesized
cctgcccacttactgccagg

SEQ ID NO: 201254 - DNA, 20 bp, Artificial Sequence
  chemically synthesized
gttgaatcggcaccacctgg

SEQ ID NO: 201255 - DNA, 20 bp, Artificial Sequence
  chemically synthesized
ccagttgaatcggcaccacc

SEQ ID NO: 201256 - DNA, 20 bp, Artificial Sequence
  chemically synthesized
ccaggtggtgccgattcaac

SEQ ID NO: 201257 - DNA, 20 bp, Artificial Sequence
  chemically synthesized
ggctctgcgcccagttgaat

SEQ ID NO: 201258 - DNA, 20 bp, Artificial Sequence
  chemically synthesized
caggtggtgccgattcaact

SEQ ID NO: 201259 - DNA, 20 bp, Artificial Sequence
  chemically synthesized
ggtgccgattcaactgggcg

SEQ ID NO: 201260 - DNA, 20 bp, Artificial Sequence
  chemically synthesized
tgccgattcaactgggcgca

SEQ ID NO: 201261 - DNA, 20 bp, Artificial Sequence
  chemically synthesized
tgccatatgggctctgcgcc

SEQ ID NO: 201262 - DNA, 20 bp, Artificial Sequence
  chemically synthesized
aactgggcgcagagcccata

SEQ ID NO: 201263 - DNA, 20 bp, Artificial Sequence
  chemically synthesized
tcaagccacagatgccatat

SEQ ID NO: 201264 - DNA, 20 bp, Artificial Sequence
  chemically synthesized
ctcaagccacagatgccata

SEQ ID NO: 201265 - DNA, 20 bp, Artificial Sequence
  chemically synthesized
cagagcccatatggcatctg

SEQ ID NO: 201266 - DNA, 20 bp, Artificial Sequence
  chemically synthesized
ccatatggcatctgtggctt

SEQ ID NO: 201267 - DNA, 20 bp, Artificial Sequence
  chemically synthesized
gatacttatgtctcaagcca

SEQ ID NO: 201268 - DNA, 20 bp, Artificial Sequence
  chemically synthesized
gcatctgtggcttgagacat

SEQ ID NO: 201269 - DNA, 20 bp, Artificial Sequence
  chemically synthesized
gctgatgatacttatgtctc

SEQ ID NO: 201270 - DNA, 20 bp, Artificial Sequence
  chemically synthesized
gcttgagacataagtatcat

SEQ ID NO: 201271 - DNA, 20 bp, Artificial Sequence
  chemically synthesized
gacataagtatcatcagcca

SEQ ID NO: 201272 - DNA, 20 bp, Artificial Sequence
  chemically synthesized
taagaatttggggaatactg

SEQ ID NO: 201273 - DNA, 20 bp, Artificial Sequence
  chemically synthesized
agaaggtttttaagaatttg

SEQ ID NO: 201274 - DNA, 20 bp, Artificial Sequence
  chemically synthesized
cagaaggtttttaagaattt

SEQ ID NO: 201275 - DNA, 20 bp, Artificial Sequence
  chemically synthesized
gcagaaggtttttaagaatt

SEQ ID NO: 201276 - DNA, 20 bp, Artificial Sequence
  chemically synthesized
tcagaaagcagaaggttttt

SEQ ID NO: 201277 - DNA, 20 bp, Artificial Sequence
  chemically synthesized
atgttaactcagaaagcaga

SEQ ID NO: 201278 - DNA, 20 bp, Artificial Sequence
  chemically synthesized
aatgttaactcagaaagcag

SEQ ID NO: 201279 - DNA, 20 bp, Artificial Sequence
  chemically synthesized
ttaaaaaccttctgctttct

SEQ ID NO: 201280 - DNA, 20 bp, Artificial Sequence
  chemically synthesized
cccaatgttaactcagaaag

SEQ ID NO: 201281 - DNA, 20 bp, Artificial Sequence
  chemically synthesized
aagcccaatgttaactcaga

SEQ ID NO: 201282 - DNA, 20 bp, Artificial Sequence
  chemically synthesized
caataagcccaatgttaact

SEQ ID NO: 201283 - DNA, 20 bp, Artificial Sequence
  chemically synthesized
tctgctttctgagttaacat

SEQ ID NO: 201284 - DNA, 20 bp, Artificial Sequence
  chemically synthesized
ctgctttctgagttaacatt

SEQ ID NO: 201285 - DNA, 20 bp, Artificial Sequence
  chemically synthesized
caacagtactagatgacaat

SEQ ID NO: 201286 - DNA, 20 bp, Artificial Sequence
  chemically synthesized
acattgggcttattgtcatc

SEQ ID NO: 201287 - DNA, 20 bp, Artificial Sequence
  chemically synthesized
tagaataaaagcaacagtac

SEQ ID NO: 201288 - DNA, 20 bp, Artificial Sequence
  chemically synthesized
tacagctagaataaaagcaa

SEQ ID NO: 201289 - DNA, 20 bp, Artificial Sequence
  chemically synthesized
tagtactgttgcttttattc

SEQ ID NO: 201290 - DNA, 20 bp, Artificial Sequence
  chemically synthesized
tgagtatacagctagaataa

SEQ ID NO: 201291 - DNA, 20 bp, Artificial Sequence
  chemically synthesized
caaacatatgagtatacagc

SEQ ID NO: 201292 - DNA, 20 bp, Artificial Sequence
  chemically synthesized
cactcaaacatatgagtata

SEQ ID NO: 201293 - DNA, 20 bp, Artificial Sequence
  chemically synthesized
aacaaaacactcaaacatat

SEQ ID NO: 201294 - DNA, 20 bp, Artificial Sequence
  chemically synthesized
agctgtatactcatatgttt

SEQ ID NO: 201295 - DNA, 20 bp, Artificial Sequence
  chemically synthesized
aacaaaaactgaggaagtat

SEQ ID NO: 201296 - DNA, 20 bp, Artificial Sequence
  chemically synthesized
tttgtttactgatacttcct

SEQ ID NO: 201297 - DNA, 20 bp, Artificial Sequence
  chemically synthesized
gaaagaaacaaaaactgagg

SEQ ID NO: 201298 - DNA, 20 bp, Artificial Sequence
  chemically synthesized
caggaaagaaacaaaaactg

SEQ ID NO: 201299 - DNA, 20 bp, Artificial Sequence
  chemically synthesized
acaggaaagaaacaaaaact

SEQ ID NO: 201300 - DNA, 20 bp, Artificial Sequence
  chemically synthesized
tgttacagtgatgtacagga

SEQ ID NO: 201301 - DNA, 20 bp, Artificial Sequence
  chemically synthesized
ctgctgttacagtgatgtac

SEQ ID NO: 201302 - DNA, 20 bp, Artificial Sequence
  chemically synthesized
gctgctgttacagtgatgta

SEQ ID NO: 201303 - DNA, 20 bp, Artificial Sequence
  chemically synthesized
tttcctgtacatcactgtaa

SEQ ID NO: 201304 - DNA, 20 bp, Artificial Sequence
  chemically synthesized
cctgtacatcactgtaacag

SEQ ID NO: 201305 - DNA, 20 bp, Artificial Sequence
  chemically synthesized
tggagaatgtgctgctgtta

SEQ ID NO: 201306 - DNA, 20 bp, Artificial Sequence
  chemically synthesized
aatgagtctttcaatgtgtg

SEQ ID NO: 201307 - DNA, 20 bp, Artificial Sequence
  chemically synthesized
acaatgagtctttcaatgtg

SEQ ID NO: 201308 - DNA, 20 bp, Artificial Sequence
  chemically synthesized
gcacattctccacacattga

SEQ ID NO: 201309 - DNA, 20 bp, Artificial Sequence
  chemically synthesized
gatgctcaaggacagacaat

SEQ ID NO: 201310 - DNA, 20 bp, Artificial Sequence
  chemically synthesized
aagactcattgtctgtcctt

SEQ ID NO: 201311 - DNA, 20 bp, Artificial Sequence
  chemically synthesized
gtagagatgatgctcaagga

SEQ ID NO: 201312 - DNA, 20 bp, Artificial Sequence
  chemically synthesized
gacagtagagatgatgctca

SEQ ID NO: 201313 - DNA, 20 bp, Artificial Sequence
  chemically synthesized
tgacagtagagatgatgctc

SEQ ID NO: 201314 - DNA, 20 bp, Artificial Sequence
  chemically synthesized
agggctatcatttgacagta

SEQ ID NO: 201315 - DNA, 20 bp, Artificial Sequence
  chemically synthesized
cgagggctatcatttgacag

SEQ ID NO: 201316 - DNA, 20 bp, Artificial Sequence
  chemically synthesized
gtacgagggctatcatttga

SEQ ID NO: 201317 - DNA, 20 bp, Artificial Sequence
  chemically synthesized
tcatctctactgtcaaatga

SEQ ID NO: 201318 - DNA, 20 bp, Artificial Sequence
  chemically synthesized
tgtagtggatgcatgtacga

SEQ ID NO: 201319 - DNA, 20 bp, Artificial Sequence
  chemically synthesized
atgtagtggatgcatgtacg

SEQ ID NO: 201320 - DNA, 20 bp, Artificial Sequence
  chemically synthesized
aatgtagtggatgcatgtac

SEQ ID NO: 201321 - DNA, 20 bp, Artificial Sequence
  chemically synthesized
tgagacaatgatgaatgtag

SEQ ID NO: 201322 - DNA, 20 bp, Artificial Sequence
  chemically synthesized
tagtgagacaatgatgaatg

SEQ ID NO: 201323 - DNA, 20 bp, Artificial Sequence
  chemically synthesized
agttacaaaacataaatagt

SEQ ID NO: 201324 - DNA, 20 bp, Artificial Sequence
  chemically synthesized
tgagagttacaaaacataaa

SEQ ID NO: 201325 - DNA, 20 bp, Artificial Sequence
  chemically synthesized
aagacctataataataatga

SEQ ID NO: 201326 - DNA, 20 bp, Artificial Sequence
  chemically synthesized
tgaagacctataataataat

SEQ ID NO: 201327 - DNA, 20 bp, Artificial Sequence
  chemically synthesized
tgtaactctcattattatta

SEQ ID NO: 201328 - DNA, 20 bp, Artificial Sequence
  chemically synthesized
gtaactctcattattattat

SEQ ID NO: 201329 - DNA, 20 bp, Artificial Sequence
  chemically synthesized
tcattattattataggtctt

SEQ ID NO: 201330 - DNA, 20 bp, Artificial Sequence
  chemically synthesized
tttgaaagtgttagaaactg

SEQ ID NO: 201331 - DNA, 20 bp, Artificial Sequence
  chemically synthesized
cagtgctaatttgaaagtgt

SEQ ID NO: 201332 - DNA, 20 bp, Artificial Sequence
  chemically synthesized
agtttctaacactttcaaat

SEQ ID NO: 201333 - DNA, 20 bp, Artificial Sequence
  chemically synthesized
caacgacagtgctaatttga

SEQ ID NO: 201334 - DNA, 20 bp, Artificial Sequence
  chemically synthesized
aattatgcctaattcaacga

SEQ ID NO: 201335 - DNA, 20 bp, Artificial Sequence
  chemically synthesized
aattagcactgtcgttgaat

SEQ ID NO: 201336 - DNA, 20 bp, Artificial Sequence
  chemically synthesized
attagcactgtcgttgaatt

SEQ ID NO: 201337 - DNA, 20 bp, Artificial Sequence
  chemically synthesized
gtcgttgaattaggcataat

SEQ ID NO: 201338 - DNA, 20 bp, Artificial Sequence
  chemically synthesized
ttagatttaaaattttgcta

SEQ ID NO: 201339 - DNA, 20 bp, Artificial Sequence
  chemically synthesized
tccttagttgtggagtactt

SEQ ID NO: 201340 - DNA, 20 bp, Artificial Sequence
  chemically synthesized
tgctaaagtactccacaact

SEQ ID NO: 201341 - DNA, 20 bp, Artificial Sequence
  chemically synthesized
cctgttcttccttagttgtg

SEQ ID NO: 201342 - DNA, 20 bp, Artificial Sequence
  chemically synthesized
gctaaagtactccacaacta

SEQ ID NO: 201343 - DNA, 20 bp, Artificial Sequence
  chemically synthesized
gccctgttcttccttagttg

SEQ ID NO: 201344 - DNA, 20 bp, Artificial Sequence
  chemically synthesized
aaagtactccacaactaagg

SEQ ID NO: 201345 - DNA, 20 bp, Artificial Sequence
  chemically synthesized
cttggagccctgttcttcct

SEQ ID NO: 201346 - DNA, 20 bp, Artificial Sequence
  chemically synthesized
actccacaactaaggaagaa

SEQ ID NO: 201347 - DNA, 20 bp, Artificial Sequence
  chemically synthesized
ctccacaactaaggaagaac

SEQ ID NO: 201348 - DNA, 20 bp, Artificial Sequence
  chemically synthesized
tccacaactaaggaagaaca

SEQ ID NO: 201349 - DNA, 20 bp, Artificial Sequence
  chemically synthesized
ctaaggaagaacagggctcc

SEQ ID NO: 201350 - DNA, 20 bp, Artificial Sequence
  chemically synthesized
aggaagaacagggctccaag

SEQ ID NO: 201351 - DNA, 20 bp, Artificial Sequence
  chemically synthesized
aagttaatgttaaccacttg

SEQ ID NO: 201352 - DNA, 20 bp, Artificial Sequence
  chemically synthesized
caaagttaatgttaaccact

SEQ ID NO: 201353 - DNA, 20 bp, Artificial Sequence
  chemically synthesized
caagtggttaacattaactt

SEQ ID NO: 201354 - DNA, 20 bp, Artificial Sequence
  chemically synthesized
gtggttaacattaactttgg

SEQ ID NO: 201355 - DNA, 20 bp, Artificial Sequence
  chemically synthesized
tggttaacattaactttggt

SEQ ID NO: 201356 - DNA, 20 bp, Artificial Sequence
  chemically synthesized
ggttaacattaactttggtg

SEQ ID NO: 201357 - DNA, 20 bp, Artificial Sequence
  chemically synthesized
gttaacattaactttggtgg

SEQ ID NO: 201358 - DNA, 20 bp, Artificial Sequence
  chemically synthesized
ctcctatcatacccccacca

SEQ ID NO: 201359 - DNA, 20 bp, Artificial Sequence
  chemically synthesized
taactttggtgggggtatga

SEQ ID NO: 201360 - DNA, 20 bp, Artificial Sequence
  chemically synthesized
aactttggtgggggtatgat

SEQ ID NO: 201361 - DNA, 20 bp, Artificial Sequence
  chemically synthesized
ctttggtgggggtatgatag

SEQ ID NO: 201362 - DNA, 20 bp, Artificial Sequence
  chemically synthesized
ttggtgggggtatgatagga

SEQ ID NO: 201363 - DNA, 20 bp, Artificial Sequence
  chemically synthesized
agtgttgacgaacctgtact

SEQ ID NO: 201364 - DNA, 20 bp, Artificial Sequence
  chemically synthesized
tgttgacgaacctgtacttg

SEQ ID NO: 201365 - DNA, 20 bp, Artificial Sequence
  chemically synthesized
ataaaactagctccaagtac

SEQ ID NO: 201366 - DNA, 20 bp, Artificial Sequence
  chemically synthesized
aataaaactagctccaagta

SEQ ID NO: 201367 - DNA, 20 bp, Artificial Sequence
  chemically synthesized
gacgaacctgtacttggagc

SEQ ID NO: 201368 - DNA, 20 bp, Artificial Sequence
  chemically synthesized
atagaaataaaactagctcc

SEQ ID NO: 201369 - DNA, 20 bp, Artificial Sequence
  chemically synthesized
agcctaaatagaaataaaac

SEQ ID NO: 201370 - DNA, 20 bp, Artificial Sequence
  chemically synthesized
gagctagttttatttctatt

SEQ ID NO: 201371 - DNA, 20 bp, Artificial Sequence
  chemically synthesized
agctagttttatttctattt

SEQ ID NO: 201372 - DNA, 20 bp, Artificial Sequence
  chemically synthesized
agagagagtaatagcctaaa

SEQ ID NO: 201373 - DNA, 20 bp, Artificial Sequence
  chemically synthesized
catggagaaagagagagtaa

SEQ ID NO: 201374 - DNA, 20 bp, Artificial Sequence
  chemically synthesized
gggaagcatggagaaagaga

SEQ ID NO: 201375 - DNA, 20 bp, Artificial Sequence
  chemically synthesized
gagggaagcatggagaaaga

SEQ ID NO: 201376 - DNA, 20 bp, Artificial Sequence
  chemically synthesized
gggagggaagcatggagaaa

SEQ ID NO: 201377 - DNA, 20 bp, Artificial Sequence
  chemically synthesized
gagggagggaagcatggaga

SEQ ID NO: 201378 - DNA, 20 bp, Artificial Sequence
  chemically synthesized
gagagagggagggaagcatg

SEQ ID NO: 201379 - DNA, 20 bp, Artificial Sequence
  chemically synthesized
gggagagagggagggaagca

SEQ ID NO: 201380 - DNA, 20 bp, Artificial Sequence
  chemically synthesized
aggaagggagagagggaggg

SEQ ID NO: 201381 - DNA, 20 bp, Artificial Sequence
  chemically synthesized
gggaggaagggagagaggga

SEQ ID NO: 201382 - DNA, 20 bp, Artificial Sequence
  chemically synthesized
agggaggaagggagagaggg

SEQ ID NO: 201383 - DNA, 20 bp, Artificial Sequence
  chemically synthesized
gagggaggaagggagagagg

SEQ ID NO: 201384 - DNA, 20 bp, Artificial Sequence
  chemically synthesized
gagagggaggaagggagaga

SEQ ID NO: 201385 - DNA, 20 bp, Artificial Sequence
  chemically synthesized
agagagggaggaagggagag

SEQ ID NO: 201386 - DNA, 20 bp, Artificial Sequence
  chemically synthesized
gagagagggaggaagggaga

SEQ ID NO: 201387 - DNA, 20 bp, Artificial Sequence
  chemically synthesized
gagagagagggaggaaggga

SEQ ID NO: 201388 - DNA, 20 bp, Artificial Sequence
  chemically synthesized
gagagagagagggaggaagg

SEQ ID NO: 201389 - DNA, 20 bp, Artificial Sequence
  chemically synthesized
gagagagagagagggaggaa

SEQ ID NO: 201390 - DNA, 20 bp, Artificial Sequence
  chemically synthesized
agagagagagagagggagga

SEQ ID NO: 201391 - DNA, 20 bp, Artificial Sequence
  chemically synthesized
gagagagagagagagggagg

SEQ ID NO: 201392 - DNA, 20 bp, Artificial Sequence
  chemically synthesized
agagagagagagagagaggg

SEQ ID NO: 201393 - DNA, 20 bp, Artificial Sequence
  chemically synthesized
cagagagagagagagagagg

SEQ ID NO: 201394 - DNA, 20 bp, Artificial Sequence
  chemically synthesized
aacagagagagagagagaga

SEQ ID NO: 201395 - DNA, 20 bp, Artificial Sequence
  chemically synthesized
gaacagagagagagagagag

SEQ ID NO: 201396 - DNA, 20 bp, Artificial Sequence
  chemically synthesized
tgaacagagagagagagaga

SEQ ID NO: 201397 - DNA, 20 bp, Artificial Sequence
  chemically synthesized
tatgaacagagagagagaga

SEQ ID NO: 201398 - DNA, 20 bp, Artificial Sequence
  chemically synthesized
tatatgaacagagagagaga

SEQ ID NO: 201399 - DNA, 20 bp, Artificial Sequence
  chemically synthesized
tatatatgaacagagagaga

SEQ ID NO: 201400 - DNA, 20 bp, Artificial Sequence
  chemically synthesized
tatatatatgaacagagaga

SEQ ID NO: 201401 - DNA, 20 bp, Artificial Sequence
  chemically synthesized
tatatatatatgaacagaga

SEQ ID NO: 201402 - DNA, 20 bp, Artificial Sequence
  chemically synthesized
tatatatatatatgaacaga

SEQ ID NO: 201403 - DNA, 20 bp, Artificial Sequence
  chemically synthesized
tatatatatatatatgaaca

SEQ ID NO: 201404 - DNA, 20 bp, Artificial Sequence
  chemically synthesized
tatatatatatatatatgaa

SEQ ID NO: 201405 - DNA, 20 bp, Artificial Sequence
  chemically synthesized
acacacatatatgtgcaata

SEQ ID NO: 201406 - DNA, 20 bp, Artificial Sequence
  chemically synthesized
tgtgcaataaagaactgcct

SEQ ID NO: 201407 - DNA, 20 bp, Artificial Sequence
  chemically synthesized
ataaattacccagtctcagg

SEQ ID NO: 201408 - DNA, 20 bp, Artificial Sequence
  chemically synthesized
aataaagaactgcctgagac

SEQ ID NO: 201409 - DNA, 20 bp, Artificial Sequence
  chemically synthesized
ataaagaactgcctgagact

SEQ ID NO: 201410 - DNA, 20 bp, Artificial Sequence
  chemically synthesized
tttataaattacccagtctc

SEQ ID NO: 201411 - DNA, 20 bp, Artificial Sequence
  chemically synthesized
ctttataaattacccagtct

SEQ ID NO: 201412 - DNA, 20 bp, Artificial Sequence
  chemically synthesized
cctttcctttataaattacc

SEQ ID NO: 201413 - DNA, 20 bp, Artificial Sequence
  chemically synthesized
ctgagactgggtaatttata

SEQ ID NO: 201414 - DNA, 20 bp, Artificial Sequence
  chemically synthesized
tgagactgggtaatttataa

SEQ ID NO: 201415 - DNA, 20 bp, Artificial Sequence
  chemically synthesized
actgggtaatttataaagga

SEQ ID NO: 201416 - DNA, 20 bp, Artificial Sequence
  chemically synthesized
ctgggtaatttataaaggaa

SEQ ID NO: 201417 - DNA, 20 bp, Artificial Sequence
  chemically synthesized
tgggtaatttataaaggaaa

SEQ ID NO: 201418 - DNA, 20 bp, Artificial Sequence
  chemically synthesized
aaagggatttaattgactca

SEQ ID NO: 201419 - DNA, 20 bp, Artificial Sequence
  chemically synthesized
gatttaattgactcatagtt

SEQ ID NO: 201420 - DNA, 20 bp, Artificial Sequence
  chemically synthesized
ccccagccatgctgaactat

SEQ ID NO: 201421 - DNA, 20 bp, Artificial Sequence
  chemically synthesized
aattgactcatagttcagca

SEQ ID NO: 201422 - DNA, 20 bp, Artificial Sequence
  chemically synthesized
gactcatagttcagcatggc

SEQ ID NO: 201423 - DNA, 20 bp, Artificial Sequence
  chemically synthesized
actcatagttcagcatggct

SEQ ID NO: 201424 - DNA, 20 bp, Artificial Sequence
  chemically synthesized
ctcatagttcagcatggctg

SEQ ID NO: 201425 - DNA, 20 bp, Artificial Sequence
  chemically synthesized
catagttcagcatggctggg

SEQ ID NO: 201426 - DNA, 20 bp, Artificial Sequence
  chemically synthesized
taagtttcctgaggtctccc

SEQ ID NO: 201427 - DNA, 20 bp, Artificial Sequence
  chemically synthesized
cagcatggctggggagacct

SEQ ID NO: 201428 - DNA, 20 bp, Artificial Sequence
  chemically synthesized
agcatggctggggagacctc

SEQ ID NO: 201429 - DNA, 20 bp, Artificial Sequence
  chemically synthesized
ctatgattgtaagtttcctg

SEQ ID NO: 201430 - DNA, 20 bp, Artificial Sequence
  chemically synthesized
actatgattgtaagtttcct

SEQ ID NO: 201431 - DNA, 20 bp, Artificial Sequence
  chemically synthesized
cctcaggaaacttacaatca

SEQ ID NO: 201432 - DNA, 20 bp, Artificial Sequence
  chemically synthesized
tcaccttctactatgattgt

SEQ ID NO: 201433 - DNA, 20 bp, Artificial Sequence
  chemically synthesized
caggaaacttacaatcatag

SEQ ID NO: 201434 - DNA, 20 bp, Artificial Sequence
  chemically synthesized
gaaacttacaatcatagtag

SEQ ID NO: 201435 - DNA, 20 bp, Artificial Sequence
  chemically synthesized
aaacttacaatcatagtaga

SEQ ID NO: 201436 - DNA, 20 bp, Artificial Sequence
  chemically synthesized
tacaatcatagtagaaggtg

SEQ ID NO: 201437 - DNA, 20 bp, Artificial Sequence
  chemically synthesized
acaatcatagtagaaggtga

SEQ ID NO: 201438 - DNA, 20 bp, Artificial Sequence
  chemically synthesized
caatcatagtagaaggtgaa

SEQ ID NO: 201439 - DNA, 20 bp, Artificial Sequence
  chemically synthesized
atagtagaaggtgaagggca

SEQ ID NO: 201440 - DNA, 20 bp, Artificial Sequence
  chemically synthesized
gtagaaggtgaagggcatag

SEQ ID NO: 201441 - DNA, 20 bp, Artificial Sequence
  chemically synthesized
aaggtgaagggcatagtaga

SEQ ID NO: 201442 - DNA, 20 bp, Artificial Sequence
  chemically synthesized
aggtgaagggcatagtagaa

SEQ ID NO: 201443 - DNA, 20 bp, Artificial Sequence
  chemically synthesized
ggtgaagggcatagtagaaa

SEQ ID NO: 201444 - DNA, 20 bp, Artificial Sequence
  chemically synthesized
agggcatagtagaaagggca

SEQ ID NO: 201445 - DNA, 20 bp, Artificial Sequence
  chemically synthesized
gcatagtagaaagggcatag

SEQ ID NO: 201446 - DNA, 20 bp, Artificial Sequence
  chemically synthesized
agtagaaagggcatagtaga

SEQ ID NO: 201447 - DNA, 20 bp, Artificial Sequence
  chemically synthesized
gaaagggcatagtagaaagc

SEQ ID NO: 201448 - DNA, 20 bp, Artificial Sequence
  chemically synthesized
aaagggcatagtagaaagca

SEQ ID NO: 201449 - DNA, 20 bp, Artificial Sequence
  chemically synthesized
aagcaaggcacctcctttac

SEQ ID NO: 201450 - DNA, 20 bp, Artificial Sequence
  chemically synthesized
ttcttgccaccttgtaaagg

SEQ ID NO: 201451 - DNA, 20 bp, Artificial Sequence
  chemically synthesized
agcaaggcacctcctttaca

SEQ ID NO: 201452 - DNA, 20 bp, Artificial Sequence
  chemically synthesized
cttcttgccaccttgtaaag

SEQ ID NO: 201453 - DNA, 20 bp, Artificial Sequence
  chemically synthesized
tccttcttgccaccttgtaa

SEQ ID NO: 201454 - DNA, 20 bp, Artificial Sequence
  chemically synthesized
aaggcacctcctttacaagg

SEQ ID NO: 201455 - DNA, 20 bp, Artificial Sequence
  chemically synthesized
ctccttcttgccaccttgta

SEQ ID NO: 201456 - DNA, 20 bp, Artificial Sequence
  chemically synthesized
cacctcctttacaaggtggc

SEQ ID NO: 201457 - DNA, 20 bp, Artificial Sequence
  chemically synthesized
ctcctttacaaggtggcaag

SEQ ID NO: 201458 - DNA, 20 bp, Artificial Sequence
  chemically synthesized
tcctttacaaggtggcaaga

SEQ ID NO: 201459 - DNA, 20 bp, Artificial Sequence
  chemically synthesized
ctttacaaggtggcaagaag

SEQ ID NO: 201460 - DNA, 20 bp, Artificial Sequence
  chemically synthesized
aaggtggcaagaaggagaat

SEQ ID NO: 201461 - DNA, 20 bp, Artificial Sequence
  chemically synthesized
tggcaagaaggagaatgagt

SEQ ID NO: 201462 - DNA, 20 bp, Artificial Sequence
  chemically synthesized
ggcaagaaggagaatgagtg

SEQ ID NO: 201463 - DNA, 20 bp, Artificial Sequence
  chemically synthesized
caagaaggagaatgagtgag

SEQ ID NO: 201464 - DNA, 20 bp, Artificial Sequence
  chemically synthesized
aagaaggagaatgagtgagg

SEQ ID NO: 201465 - DNA, 20 bp, Artificial Sequence
  chemically synthesized
agaaggagaatgagtgagga

SEQ ID NO: 201466 - DNA, 20 bp, Artificial Sequence
  chemically synthesized
aggagaatgagtgaggaggg

SEQ ID NO: 201467 - DNA, 20 bp, Artificial Sequence
  chemically synthesized
ggagaatgagtgaggaggga

SEQ ID NO: 201468 - DNA, 20 bp, Artificial Sequence
  chemically synthesized
gagaatgagtgaggagggaa

SEQ ID NO: 201469 - DNA, 20 bp, Artificial Sequence
  chemically synthesized
agaatgagtgaggagggaag

SEQ ID NO: 201470 - DNA, 20 bp, Artificial Sequence
  chemically synthesized
gaatgagtgaggagggaagg

SEQ ID NO: 201471 - DNA, 20 bp, Artificial Sequence
  chemically synthesized
tgagtgaggagggaaggggg

SEQ ID NO: 201472 - DNA, 20 bp, Artificial Sequence
  chemically synthesized
agtgaggagggaagggggaa

SEQ ID NO: 201473 - DNA, 20 bp, Artificial Sequence
  chemically synthesized
agatcagatggttttataaa

SEQ ID NO: 201474 - DNA, 20 bp, Artificial Sequence
  chemically synthesized
gagatcagatggttttataa

SEQ ID NO: 201475 - DNA, 20 bp, Artificial Sequence
  chemically synthesized
tgagatcagatggttttata

SEQ ID NO: 201476 - DNA, 20 bp, Artificial Sequence
  chemically synthesized
tagtgaatcatgagatcaga

SEQ ID NO: 201477 - DNA, 20 bp, Artificial Sequence
  chemically synthesized
ctgatagtgaatcatgagat

SEQ ID NO: 201478 - DNA, 20 bp, Artificial Sequence
  chemically synthesized
ttctcctgatagtgaatcat

SEQ ID NO: 201479 - DNA, 20 bp, Artificial Sequence
  chemically synthesized
ctgatctcatgattcactat

SEQ ID NO: 201480 - DNA, 20 bp, Artificial Sequence
  chemically synthesized
tgatctcatgattcactatc

SEQ ID NO: 201481 - DNA, 20 bp, Artificial Sequence
  chemically synthesized
atctcatgattcactatcag

SEQ ID NO: 201482 - DNA, 20 bp, Artificial Sequence
  chemically synthesized
tgcccatgctgttctcctga

SEQ ID NO: 201483 - DNA, 20 bp, Artificial Sequence
  chemically synthesized
atgattcactatcaggagaa

SEQ ID NO: 201484 - DNA, 20 bp, Artificial Sequence
  chemically synthesized
tcactatcaggagaacagca

SEQ ID NO: 201485 - DNA, 20 bp, Artificial Sequence
  chemically synthesized
cactatcaggagaacagcat

SEQ ID NO: 201486 - DNA, 20 bp, Artificial Sequence
  chemically synthesized
gcatgggcaaaaccaccctc

SEQ ID NO: 201487 - DNA, 20 bp, Artificial Sequence
  chemically synthesized
aggcaattggatcttgaggg

SEQ ID NO: 201488 - DNA, 20 bp, Artificial Sequence
  chemically synthesized
tggaggcaattggatcttga

SEQ ID NO: 201489 - DNA, 20 bp, Artificial Sequence
  chemically synthesized
gtggaggcaattggatcttg

SEQ ID NO: 201490 - DNA, 20 bp, Artificial Sequence
  chemically synthesized
ggtggaggcaattggatctt

SEQ ID NO: 201491 - DNA, 20 bp, Artificial Sequence
  chemically synthesized
agagaccaggtggaggcaat

SEQ ID NO: 201492 - DNA, 20 bp, Artificial Sequence
  chemically synthesized
aagatccaattgcctccacc

SEQ ID NO: 201493 - DNA, 20 bp, Artificial Sequence
  chemically synthesized
tcaagggagagaccaggtgg

SEQ ID NO: 201494 - DNA, 20 bp, Artificial Sequence
  chemically synthesized
gtcaagggagagaccaggtg

SEQ ID NO: 201495 - DNA, 20 bp, Artificial Sequence
  chemically synthesized
gtgtcaagggagagaccagg

SEQ ID NO: 201496 - DNA, 20 bp, Artificial Sequence
  chemically synthesized
cgtgtgtcaagggagagacc

SEQ ID NO: 201497 - DNA, 20 bp, Artificial Sequence
  chemically synthesized
ccgtgtgtcaagggagagac

SEQ ID NO: 201498 - DNA, 20 bp, Artificial Sequence
  chemically synthesized
aatccccgtgtgtcaaggga

SEQ ID NO: 201499 - DNA, 20 bp, Artificial Sequence
  chemically synthesized
ataatccccgtgtgtcaagg

SEQ ID NO: 201500 - DNA, 20 bp, Artificial Sequence
  chemically synthesized
ttataatccccgtgtgtcaa

SEQ ID NO: 201501 - DNA, 20 bp, Artificial Sequence
  chemically synthesized
ctggtctctcccttgacaca

SEQ ID NO: 201502 - DNA, 20 bp, Artificial Sequence
  chemically synthesized
attataatccccgtgtgtca

SEQ ID NO: 201503 - DNA, 20 bp, Artificial Sequence
  chemically synthesized
tggtctctcccttgacacac

SEQ ID NO: 201504 - DNA, 20 bp, Artificial Sequence
  chemically synthesized
aattataatccccgtgtgtc

SEQ ID NO: 201505 - DNA, 20 bp, Artificial Sequence
  chemically synthesized
ggtctctcccttgacacacg

SEQ ID NO: 201506 - DNA, 20 bp, Artificial Sequence
  chemically synthesized
cggggattataattcaaaat

SEQ ID NO: 201507 - DNA, 20 bp, Artificial Sequence
  chemically synthesized
tataattcaaaatgagattt

SEQ ID NO: 201508 - DNA, 20 bp, Artificial Sequence
  chemically synthesized
aattcaaaatgagatttgag

SEQ ID NO: 201509 - DNA, 20 bp, Artificial Sequence
  chemically synthesized
attcaaaatgagatttgagt

SEQ ID NO: 201510 - DNA, 20 bp, Artificial Sequence
  chemically synthesized
ttcaaaatgagatttgagtg

SEQ ID NO: 201511 - DNA, 20 bp, Artificial Sequence
  chemically synthesized
aaatgagatttgagtgggga

SEQ ID NO: 201512 - DNA, 20 bp, Artificial Sequence
  chemically synthesized
gagatttgagtggggacaga

SEQ ID NO: 201513 - DNA, 20 bp, Artificial Sequence
  chemically synthesized
acacacacattgatatggtt

SEQ ID NO: 201514 - DNA, 20 bp, Artificial Sequence
  chemically synthesized
tacacacacattgatatggt

SEQ ID NO: 201515 - DNA, 20 bp, Artificial Sequence
  chemically synthesized
attatacacacacattgata

SEQ ID NO: 201516 - DNA, 20 bp, Artificial Sequence
  chemically synthesized
gtgtgtgtataatttatttc

SEQ ID NO: 201517 - DNA, 20 bp, Artificial Sequence
  chemically synthesized
tgtgtataatttatttctgg

SEQ ID NO: 201518 - DNA, 20 bp, Artificial Sequence
  chemically synthesized
tgatgaacatgttcatctac

SEQ ID NO: 201519 - DNA, 20 bp, Artificial Sequence
  chemically synthesized
cagttaatattgtgattata

SEQ ID NO: 201520 - DNA, 20 bp, Artificial Sequence
  chemically synthesized
ttcttaaaagtcagatattt

SEQ ID NO: 201521 - DNA, 20 bp, Artificial Sequence
  chemically synthesized
aactgaaatatctgactttt

SEQ ID NO: 201522 - DNA, 20 bp, Artificial Sequence
  chemically synthesized
tatttaaagttcttaaaagt

SEQ ID NO: 201523 - DNA, 20 bp, Artificial Sequence
  chemically synthesized
aaaatatttaaagttcttaa

SEQ ID NO: 201524 - DNA, 20 bp, Artificial Sequence
  chemically synthesized
ggcaacctctaaaatattta

SEQ ID NO: 201525 - DNA, 20 bp, Artificial Sequence
  chemically synthesized
tttaagaactttaaatattt

SEQ ID NO: 201526 - DNA, 20 bp, Artificial Sequence
  chemically synthesized
taagaactttaaatatttta

SEQ ID NO: 201527 - DNA, 20 bp, Artificial Sequence
  chemically synthesized
aagaactttaaatattttag

SEQ ID NO: 201528 - DNA, 20 bp, Artificial Sequence
  chemically synthesized
aatattttagaggttgccta

SEQ ID NO: 201529 - DNA, 20 bp, Artificial Sequence
  chemically synthesized
ttatttacttgtacagccgt

SEQ ID NO: 201530 - DNA, 20 bp, Artificial Sequence
  chemically synthesized
tttatttacttgtacagccg

SEQ ID NO: 201531 - DNA, 20 bp, Artificial Sequence
  chemically synthesized
gaggttgcctacggctgtac

SEQ ID NO: 201532 - DNA, 20 bp, Artificial Sequence
  chemically synthesized
tatcaatttatttacttgta

SEQ ID NO: 201533 - DNA, 20 bp, Artificial Sequence
  chemically synthesized
tgtacaagtaaataaattga

SEQ ID NO: 201534 - DNA, 20 bp, Artificial Sequence
  chemically synthesized
tacaagtaaataaattgata

SEQ ID NO: 201535 - DNA, 20 bp, Artificial Sequence
  chemically synthesized
tcctctcattttatatttaa

SEQ ID NO: 201536 - DNA, 20 bp, Artificial Sequence
  chemically synthesized
cattcttttaaatataaaat

SEQ ID NO: 201537 - DNA, 20 bp, Artificial Sequence
  chemically synthesized
ttcttttaaatataaaatga

SEQ ID NO: 201538 - DNA, 20 bp, Artificial Sequence
  chemically synthesized
tcttttaaatataaaatgag

SEQ ID NO: 201539 - DNA, 20 bp, Artificial Sequence
  chemically synthesized
aaatataaaatgagaggaaa

SEQ ID NO: 201540 - DNA, 20 bp, Artificial Sequence
  chemically synthesized
tgagaggaaatagtcttaat

SEQ ID NO: 201541 - DNA, 20 bp, Artificial Sequence
  chemically synthesized
gaaaatgtagtaatctaatt

SEQ ID NO: 201542 - DNA, 20 bp, Artificial Sequence
  chemically synthesized
acacatccatggggaaaatg

SEQ ID NO: 201543 - DNA, 20 bp, Artificial Sequence
  chemically synthesized
agattactacattttcccca

SEQ ID NO: 201544 - DNA, 20 bp, Artificial Sequence
  chemically synthesized
tgtactatgacacatccatg

SEQ ID NO: 201545 - DNA, 20 bp, Artificial Sequence
  chemically synthesized
atgtactatgacacatccat

SEQ ID NO: 201546 - DNA, 20 bp, Artificial Sequence
  chemically synthesized
aatgtactatgacacatcca

SEQ ID NO: 201547 - DNA, 20 bp, Artificial Sequence
  chemically synthesized
ttttccccatggatgtgtca

SEQ ID NO: 201548 - DNA, 20 bp, Artificial Sequence
  chemically synthesized
ggatgtgtcatagtacattc

SEQ ID NO: 201549 - DNA, 20 bp, Artificial Sequence
  chemically synthesized
atgtgtcatagtacattcta

SEQ ID NO: 201550 - DNA, 20 bp, Artificial Sequence
  chemically synthesized
tgtgtcatagtacattctag

SEQ ID NO: 201551 - DNA, 20 bp, Artificial Sequence
  chemically synthesized
aatcaattacttttttcctc

SEQ ID NO: 201552 - DNA, 20 bp, Artificial Sequence
  chemically synthesized
tagtacattctagaggaaaa

SEQ ID NO: 201553 - DNA, 20 bp, Artificial Sequence
  chemically synthesized
aaaaagtaattgattatatg

SEQ ID NO: 201554 - DNA, 20 bp, Artificial Sequence
  chemically synthesized
gtaattgattatatgaagat

SEQ ID NO: 201555 - DNA, 20 bp, Artificial Sequence
  chemically synthesized
tgattatatgaagattagaa

SEQ ID NO: 201556 - DNA, 20 bp, Artificial Sequence
  chemically synthesized
gattatatgaagattagaat

SEQ ID NO: 201557 - DNA, 20 bp, Artificial Sequence
  chemically synthesized
ttagaataggtatatttaac

SEQ ID NO: 201558 - DNA, 20 bp, Artificial Sequence
  chemically synthesized
gaataggtatatttaacaag

SEQ ID NO: 201559 - DNA, 20 bp, Artificial Sequence
  chemically synthesized
aataggtatatttaacaagc

SEQ ID NO: 201560 - DNA, 20 bp, Artificial Sequence
  chemically synthesized
aggtatatttaacaagcagg

SEQ ID NO: 201561 - DNA, 20 bp, Artificial Sequence
  chemically synthesized
taacaagcaggtagtgtttg

SEQ ID NO: 201562 - DNA, 20 bp, Artificial Sequence
  chemically synthesized
agtgtttgtggaaatgttct

SEQ ID NO: 201563 - DNA, 20 bp, Artificial Sequence
  chemically synthesized
gtggaaatgttctaagatgt

SEQ ID NO: 201564 - DNA, 20 bp, Artificial Sequence
  chemically synthesized
ttcttatttttctaacatct

SEQ ID NO: 201565 - DNA, 20 bp, Artificial Sequence
  chemically synthesized
ttctaagatgttagaaaaat

SEQ ID NO: 201566 - DNA, 20 bp, Artificial Sequence
  chemically synthesized
gatgttagaaaaataagaat

SEQ ID NO: 201567 - DNA, 20 bp, Artificial Sequence
  chemically synthesized
cctattgtgctatgaaacag

SEQ ID NO: 201568 - DNA, 20 bp, Artificial Sequence
  chemically synthesized
gaataagatctactgtttca

SEQ ID NO: 201569 - DNA, 20 bp, Artificial Sequence
  chemically synthesized
aaccctattgtgctatgaaa

SEQ ID NO: 201570 - DNA, 20 bp, Artificial Sequence
  chemically synthesized
tctactgtttcatagcacaa

SEQ ID NO: 201571 - DNA, 20 bp, Artificial Sequence
  chemically synthesized
ctactgtttcatagcacaat

SEQ ID NO: 201572 - DNA, 20 bp, Artificial Sequence
  chemically synthesized
tactgtttcatagcacaata

SEQ ID NO: 201573 - DNA, 20 bp, Artificial Sequence
  chemically synthesized
atagcacaatagggttgcta

SEQ ID NO: 201574 - DNA, 20 bp, Artificial Sequence
  chemically synthesized
cacaatagggttgctatagt

SEQ ID NO: 201575 - DNA, 20 bp, Artificial Sequence
  chemically synthesized
cattaagttattactgacta

SEQ ID NO: 201576 - DNA, 20 bp, Artificial Sequence
  chemically synthesized
tatagtcagtaataacttaa

SEQ ID NO: 201577 - DNA, 20 bp, Artificial Sequence
  chemically synthesized
ttattttaaaatgtaccatt

SEQ ID NO: 201578 - DNA, 20 bp, Artificial Sequence
  chemically synthesized
gtacattttaaaataactaa

SEQ ID NO: 201579 - DNA, 20 bp, Artificial Sequence
  chemically synthesized
acattttaaaataactaaca

SEQ ID NO: 201580 - DNA, 20 bp, Artificial Sequence
  chemically synthesized
acattctaattatactctgt

SEQ ID NO: 201581 - DNA, 20 bp, Artificial Sequence
  chemically synthesized
aataactaacagagtataat

SEQ ID NO: 201582 - DNA, 20 bp, Artificial Sequence
  chemically synthesized
attagaatgtttgtaataca

SEQ ID NO: 201583 - DNA, 20 bp, Artificial Sequence
  chemically synthesized
atacaaagcacaaatgcttg

SEQ ID NO: 201584 - DNA, 20 bp, Artificial Sequence
  chemically synthesized
tacaaagcacaaatgcttga

SEQ ID NO: 201585 - DNA, 20 bp, Artificial Sequence
  chemically synthesized
acaaagcacaaatgcttgaa

SEQ ID NO: 201586 - DNA, 20 bp, Artificial Sequence
  chemically synthesized
agcacaaatgcttgaaggga

SEQ ID NO: 201587 - DNA, 20 bp, Artificial Sequence
  chemically synthesized
aatgggttatctatcccttc

SEQ ID NO: 201588 - DNA, 20 bp, Artificial Sequence
  chemically synthesized
atagtcacatcatggagaat

SEQ ID NO: 201589 - DNA, 20 bp, Artificial Sequence
  chemically synthesized
aatagtcacatcatggagaa

SEQ ID NO: 201590 - DNA, 20 bp, Artificial Sequence
  chemically synthesized
tatgaaatagtcacatcatg

SEQ ID NO: 201591 - DNA, 20 bp, Artificial Sequence
  chemically synthesized
aatatgaaatagtcacatca

SEQ ID NO: 201592 - DNA, 20 bp, Artificial Sequence
  chemically synthesized
cacaagcattcaatatgaaa

SEQ ID NO: 201593 - DNA, 20 bp, Artificial Sequence
  chemically synthesized
tacaagagaggttttaacac

SEQ ID NO: 201594 - DNA, 20 bp, Artificial Sequence
  chemically synthesized
atattgatggggtacaagag

SEQ ID NO: 201595 - DNA, 20 bp, Artificial Sequence
  chemically synthesized
tatattgatggggtacaaga

SEQ ID NO: 201596 - DNA, 20 bp, Artificial Sequence
  chemically synthesized
tatatattgatggggtacaa

SEQ ID NO: 201597 - DNA, 20 bp, Artificial Sequence
  chemically synthesized
tgtatatattgatggggtac

SEQ ID NO: 201598 - DNA, 20 bp, Artificial Sequence
  chemically synthesized
ggaaggtgtatatattgatg

SEQ ID NO: 201599 - DNA, 20 bp, Artificial Sequence
  chemically synthesized
aggaaggtgtatatattgat

SEQ ID NO: 201600 - DNA, 20 bp, Artificial Sequence
  chemically synthesized
gaggaaggtgtatatattga

SEQ ID NO: 201601 - DNA, 20 bp, Artificial Sequence
  chemically synthesized
gtcaacggggtacatgagga

SEQ ID NO: 201602 - DNA, 20 bp, Artificial Sequence
  chemically synthesized
tgtcaacggggtacatgagg

SEQ ID NO: 201603 - DNA, 20 bp, Artificial Sequence
  chemically synthesized
atatgtcaacggggtacatg

SEQ ID NO: 201604 - DNA, 20 bp, Artificial Sequence
  chemically synthesized
tatatgtcaacggggtacat

SEQ ID NO: 201605 - DNA, 20 bp, Artificial Sequence
  chemically synthesized
ggtaggtgtatatgtcaacg

SEQ ID NO: 201606 - DNA, 20 bp, Artificial Sequence
  chemically synthesized
tggtaggtgtatatgtcaac

SEQ ID NO: 201607 - DNA, 20 bp, Artificial Sequence
  chemically synthesized
atggtaggtgtatatgtcaa

SEQ ID NO: 201608 - DNA, 20 bp, Artificial Sequence
  chemically synthesized
tatctttgtgagtacatggt

SEQ ID NO: 201609 - DNA, 20 bp, Artificial Sequence
  chemically synthesized
ttatctttgtgagtacatgg

SEQ ID NO: 201610 - DNA, 20 bp, Artificial Sequence
  chemically synthesized
tttttatctttgtgagtaca

SEQ ID NO: 201611 - DNA, 20 bp, Artificial Sequence
  chemically synthesized
acacctaccatgtactcaca

SEQ ID NO: 201612 - DNA, 20 bp, Artificial Sequence
  chemically synthesized
aatgggttttttatctttgt

SEQ ID NO: 201613 - DNA, 20 bp, Artificial Sequence
  chemically synthesized
aaagataaaaaacccattga

SEQ ID NO: 201614 - DNA, 20 bp, Artificial Sequence
  chemically synthesized
tttaagttttttctttcaat

SEQ ID NO: 201615 - DNA, 20 bp, Artificial Sequence
  chemically synthesized
ttttaagttttttctttcaa

SEQ ID NO: 201616 - DNA, 20 bp, Artificial Sequence
  chemically synthesized
cattgaaagaaaaaacttaa

SEQ ID NO: 201617 - DNA, 20 bp, Artificial Sequence
  chemically synthesized
agcatttccatttttctttt

SEQ ID NO: 201618 - DNA, 20 bp, Artificial Sequence
  chemically synthesized
gaaaaaacttaaaagaaaaa

SEQ ID NO: 201619 - DNA, 20 bp, Artificial Sequence
  chemically synthesized
aagaaaaatggaaatgctct

SEQ ID NO: 201620 - DNA, 20 bp, Artificial Sequence
  chemically synthesized
gaaaaatggaaatgctctaa

SEQ ID NO: 201621 - DNA, 20 bp, Artificial Sequence
  chemically synthesized
ttacctgtcgtcatctctta

SEQ ID NO: 201622 - DNA, 20 bp, Artificial Sequence
  chemically synthesized
tattacctgtcgtcatctct

SEQ ID NO: 201623 - DNA, 20 bp, Artificial Sequence
  chemically synthesized
aatgctctaagagatgacga

SEQ ID NO: 201624 - DNA, 20 bp, Artificial Sequence
  chemically synthesized
atgctctaagagatgacgac

SEQ ID NO: 201625 - DNA, 20 bp, Artificial Sequence
  chemically synthesized
acgacaggtaatatacgtct

SEQ ID NO: 201626 - DNA, 20 bp, Artificial Sequence
  chemically synthesized
aacacatacataaatgcact

SEQ ID NO: 201627 - DNA, 20 bp, Artificial Sequence
  chemically synthesized
atgtatgtgtttatttttgc

SEQ ID NO: 201628 - DNA, 20 bp, Artificial Sequence
  chemically synthesized
gtatgtgtttatttttgcaa

SEQ ID NO: 201629 - DNA, 20 bp, Artificial Sequence
  chemically synthesized
gtgtttatttttgcaagaga

SEQ ID NO: 201630 - DNA, 20 bp, Artificial Sequence
  chemically synthesized
caagagatagacataactgt

SEQ ID NO: 201631 - DNA, 20 bp, Artificial Sequence
  chemically synthesized
gagctgtgtccaggggctga

SEQ ID NO: 201632 - DNA, 20 bp, Artificial Sequence
  chemically synthesized
tagacataactgtcagcccc

SEQ ID NO: 201633 - DNA, 20 bp, Artificial Sequence
  chemically synthesized
taactgtcagcccctggaca

SEQ ID NO: 201634 - DNA, 20 bp, Artificial Sequence
  chemically synthesized
atccactgagctgtgtccag

SEQ ID NO: 201635 - DNA, 20 bp, Artificial Sequence
  chemically synthesized
tatccactgagctgtgtcca

SEQ ID NO: 201636 - DNA, 20 bp, Artificial Sequence
  chemically synthesized
ctatccactgagctgtgtcc

SEQ ID NO: 201637 - DNA, 20 bp, Artificial Sequence
  chemically synthesized
actatccactgagctgtgtc

SEQ ID NO: 201638 - DNA, 20 bp, Artificial Sequence
  chemically synthesized
gtcagcccctggacacagct

SEQ ID NO: 201639 - DNA, 20 bp, Artificial Sequence
  chemically synthesized
agcccctggacacagctcag

SEQ ID NO: 201640 - DNA, 20 bp, Artificial Sequence
  chemically synthesized
cctggacacagctcagtgga

SEQ ID NO: 201641 - DNA, 20 bp, Artificial Sequence
  chemically synthesized
agcaaaagtcactatccact

SEQ ID NO: 201642 - DNA, 20 bp, Artificial Sequence
  chemically synthesized
aatccattaagtgttagcaa

SEQ ID NO: 201643 - DNA, 20 bp, Artificial Sequence
  chemically synthesized
atatggaatccattaagtgt

SEQ ID NO: 201644 - DNA, 20 bp, Artificial Sequence
  chemically synthesized
tgacttttgctaacacttaa

SEQ ID NO: 201645 - DNA, 20 bp, Artificial Sequence
  chemically synthesized
ttgaacatatggaatccatt

SEQ ID NO: 201646 - DNA, 20 bp, Artificial Sequence
  chemically synthesized
atgattttttattgaacata

SEQ ID NO: 201647 - DNA, 20 bp, Artificial Sequence
  chemically synthesized
gttcaataaaaaatcattat

SEQ ID NO: 201648 - DNA, 20 bp, Artificial Sequence
  chemically synthesized
aataaaaaatcattatgaga

SEQ ID NO: 201649 - DNA, 20 bp, Artificial Sequence
  chemically synthesized
gttagtttgtataaaaggtt

SEQ ID NO: 201650 - DNA, 20 bp, Artificial Sequence
  chemically synthesized
gcatggttagtttgtataaa

SEQ ID NO: 201651 - DNA, 20 bp, Artificial Sequence
  chemically synthesized
tgcatggttagtttgtataa

SEQ ID NO: 201652 - DNA, 20 bp, Artificial Sequence
  chemically synthesized
tgaattgagctttgcatggt

SEQ ID NO: 201653 - DNA, 20 bp, Artificial Sequence
  chemically synthesized
ttatacaaactaaccatgca

SEQ ID NO: 201654 - DNA, 20 bp, Artificial Sequence
  chemically synthesized
tttttgaattgagctttgca

SEQ ID NO: 201655 - DNA, 20 bp, Artificial Sequence
  chemically synthesized
cctaggtgcctttttgaatt

SEQ ID NO: 201656 - DNA, 20 bp, Artificial Sequence
  chemically synthesized
catgcaaagctcaattcaaa

SEQ ID NO: 201657 - DNA, 20 bp, Artificial Sequence
  chemically synthesized
atgcaaagctcaattcaaaa

SEQ ID NO: 201658 - DNA, 20 bp, Artificial Sequence
  chemically synthesized
gctcaattcaaaaaggcacc

SEQ ID NO: 201659 - DNA, 20 bp, Artificial Sequence
  chemically synthesized
ctcaattcaaaaaggcacct

SEQ ID NO: 201660 - DNA, 20 bp, Artificial Sequence
  chemically synthesized
aattcaaaaaggcacctagg

SEQ ID NO: 201661 - DNA, 20 bp, Artificial Sequence
  chemically synthesized
aagtattgcattcacttcct

SEQ ID NO: 201662 - DNA, 20 bp, Artificial Sequence
  chemically synthesized
caagtattgcattcacttcc

SEQ ID NO: 201663 - DNA, 20 bp, Artificial Sequence
  chemically synthesized
tcatgtcaaaggaaatatgc

SEQ ID NO: 201664 - DNA, 20 bp, Artificial Sequence
  chemically synthesized
tttgtatttattcatgtcaa

SEQ ID NO: 201665 - DNA, 20 bp, Artificial Sequence
  chemically synthesized
ctttgtatttattcatgtca

SEQ ID NO: 201666 - DNA, 20 bp, Artificial Sequence
  chemically synthesized
ctttgacatgaataaataca

SEQ ID NO: 201667 - DNA, 20 bp, Artificial Sequence
  chemically synthesized
tttgacatgaataaatacaa

SEQ ID NO: 201668 - DNA, 20 bp, Artificial Sequence
  chemically synthesized
aaaggcattttattttaatt

SEQ ID NO: 201669 - DNA, 20 bp, Artificial Sequence
  chemically synthesized
attttattttaattgagtta

SEQ ID NO: 201670 - DNA, 20 bp, Artificial Sequence
  chemically synthesized
ttaattgagttaaagcataa

SEQ ID NO: 201671 - DNA, 20 bp, Artificial Sequence
  chemically synthesized
tattttaattatttatgcaa

SEQ ID NO: 201672 - DNA, 20 bp, Artificial Sequence
  chemically synthesized
tctattttaattatttatgc

SEQ ID NO: 201673 - DNA, 20 bp, Artificial Sequence
  chemically synthesized
tcttgcataaataattaaaa

SEQ ID NO: 201674 - DNA, 20 bp, Artificial Sequence
  chemically synthesized
gcataaataattaaaataga

SEQ ID NO: 201675 - DNA, 20 bp, Artificial Sequence
  chemically synthesized
aattaaaatagaaagaaaaa

SEQ ID NO: 201676 - DNA, 20 bp, Artificial Sequence
  chemically synthesized
tagaaagaaaaatagcatat

SEQ ID NO: 201677 - DNA, 20 bp, Artificial Sequence
  chemically synthesized
agaaagaaaaatagcatata

SEQ ID NO: 201678 - DNA, 20 bp, Artificial Sequence
  chemically synthesized
aaagaaaaatagcatataag

SEQ ID NO: 201679 - DNA, 20 bp, Artificial Sequence
  chemically synthesized
ggacagtgcctgatatcagt

SEQ ID NO: 201680 - DNA, 20 bp, Artificial Sequence
  chemically synthesized
ataaggagacttactgatat

SEQ ID NO: 201681 - DNA, 20 bp, Artificial Sequence
  chemically synthesized
taaggagacttactgatatc

SEQ ID NO: 201682 - DNA, 20 bp, Artificial Sequence
  chemically synthesized
cttaggacagtgcctgatat

SEQ ID NO: 201683 - DNA, 20 bp, Artificial Sequence
  chemically synthesized
ctgatatcaggcactgtcct

SEQ ID NO: 201684 - DNA, 20 bp, Artificial Sequence
  chemically synthesized
tgtatataatatacttagga

SEQ ID NO: 201685 - DNA, 20 bp, Artificial Sequence
  chemically synthesized
tcagtgtatataatatactt

SEQ ID NO: 201686 - DNA, 20 bp, Artificial Sequence
  chemically synthesized
ttcagtgtatataatatact

SEQ ID NO: 201687 - DNA, 20 bp, Artificial Sequence
  chemically synthesized
gcttgttttgatagatattt

SEQ ID NO: 201688 - DNA, 20 bp, Artificial Sequence
  chemically synthesized
actgaaatatctatcaaaac

SEQ ID NO: 201689 - DNA, 20 bp, Artificial Sequence
  chemically synthesized
ctctcataggcttgttttga

SEQ ID NO: 201690 - DNA, 20 bp, Artificial Sequence
  chemically synthesized
atctatcaaaacaagcctat

SEQ ID NO: 201691 - DNA, 20 bp, Artificial Sequence
  chemically synthesized
ctatcaaaacaagcctatga

SEQ ID NO: 201692 - DNA, 20 bp, Artificial Sequence
  chemically synthesized
atctaataatcgtctctcat

SEQ ID NO: 201693 - DNA, 20 bp, Artificial Sequence
  chemically synthesized
gatctaataatcgtctctca

SEQ ID NO: 201694 - DNA, 20 bp, Artificial Sequence
  chemically synthesized
agcctatgagagacgattat

SEQ ID NO: 201695 - DNA, 20 bp, Artificial Sequence
  chemically synthesized
gacgattattagatcaattt

SEQ ID NO: 201696 - DNA, 20 bp, Artificial Sequence
  chemically synthesized
cgattattagatcaatttga

SEQ ID NO: 201697 - DNA, 20 bp, Artificial Sequence
  chemically synthesized
atttgagagaaaaattaact

SEQ ID NO: 201698 - DNA, 20 bp, Artificial Sequence
  chemically synthesized
tttgagagaaaaattaactg

SEQ ID NO: 201699 - DNA, 20 bp, Artificial Sequence
  chemically synthesized
gagttaacctacgtaagcct

SEQ ID NO: 201700 - DNA, 20 bp, Artificial Sequence
  chemically synthesized
aaaattaactgaggcttacg

SEQ ID NO: 201701 - DNA, 20 bp, Artificial Sequence
  chemically synthesized
aaattaactgaggcttacgt

SEQ ID NO: 201702 - DNA, 20 bp, Artificial Sequence
  chemically synthesized
ctatgggagttaacctacgt

SEQ ID NO: 201703 - DNA, 20 bp, Artificial Sequence
  chemically synthesized
cttacgtaggttaactccca

SEQ ID NO: 201704 - DNA, 20 bp, Artificial Sequence
  chemically synthesized
ttacgtaggttaactcccat

SEQ ID NO: 201705 - DNA, 20 bp, Artificial Sequence
  chemically synthesized
actattagtataacctatgg

SEQ ID NO: 201706 - DNA, 20 bp, Artificial Sequence
  chemically synthesized
tcactattagtataacctat

SEQ ID NO: 201707 - DNA, 20 bp, Artificial Sequence
  chemically synthesized
atcactattagtataaccta

SEQ ID NO: 201708 - DNA, 20 bp, Artificial Sequence
  chemically synthesized
actcccataggttatactaa

SEQ ID NO: 201709 - DNA, 20 bp, Artificial Sequence
  chemically synthesized
ctggtttattgcatcactat

SEQ ID NO: 201710 - DNA, 20 bp, Artificial Sequence
  chemically synthesized
ctaatagtgatgcaataaac

SEQ ID NO: 201711 - DNA, 20 bp, Artificial Sequence
  chemically synthesized
taatagtgatgcaataaacc

SEQ ID NO: 201712 - DNA, 20 bp, Artificial Sequence
  chemically synthesized
atagtgatgcaataaaccag

SEQ ID NO: 201713 - DNA, 20 bp, Artificial Sequence
  chemically synthesized
tactgcctaggtgaaactcc

SEQ ID NO: 201714 - DNA, 20 bp, Artificial Sequence
  chemically synthesized
aataaaccaggagtttcacc

SEQ ID NO: 201715 - DNA, 20 bp, Artificial Sequence
  chemically synthesized
ataaaccaggagtttcacct

SEQ ID NO: 201716 - DNA, 20 bp, Artificial Sequence
  chemically synthesized
aaccaggagtttcacctagg

SEQ ID NO: 201717 - DNA, 20 bp, Artificial Sequence
  chemically synthesized
gggctttgggcatactgcct

SEQ ID NO: 201718 - DNA, 20 bp, Artificial Sequence
  chemically synthesized
tgggctttgggcatactgcc

SEQ ID NO: 201719 - DNA, 20 bp, Artificial Sequence
  chemically synthesized
tcacctaggcagtatgccca

SEQ ID NO: 201720 - DNA, 20 bp, Artificial Sequence
  chemically synthesized
gattaaaatacatgggcttt

SEQ ID NO: 201721 - DNA, 20 bp, Artificial Sequence
  chemically synthesized
tgattaaaatacatgggctt

SEQ ID NO: 201722 - DNA, 20 bp, Artificial Sequence
  chemically synthesized
ttataatgattaaaatacat

SEQ ID NO: 201723 - DNA, 20 bp, Artificial Sequence
  chemically synthesized
attataatgattaaaataca

SEQ ID NO: 201724 - DNA, 20 bp, Artificial Sequence
  chemically synthesized
tgtattttaatcattataat

SEQ ID NO: 201725 - DNA, 20 bp, Artificial Sequence
  chemically synthesized
atcagtggtatgtaatgtag

SEQ ID NO: 201726 - DNA, 20 bp, Artificial Sequence
  chemically synthesized
aaatcagtggtatgtaatgt

SEQ ID NO: 201727 - DNA, 20 bp, Artificial Sequence
  chemically synthesized
aaaatcagtggtatgtaatg

SEQ ID NO: 201728 - DNA, 20 bp, Artificial Sequence
  chemically synthesized
tctttccaaattaaaatcag

SEQ ID NO: 201729 - DNA, 20 bp, Artificial Sequence
  chemically synthesized
ttatctttccaaattaaaat

SEQ ID NO: 201730 - DNA, 20 bp, Artificial Sequence
  chemically synthesized
acataccactgattttaatt

SEQ ID NO: 201731 - DNA, 20 bp, Artificial Sequence
  chemically synthesized
accactgattttaatttgga

SEQ ID NO: 201732 - DNA, 20 bp, Artificial Sequence
  chemically synthesized
ttggaaagataatttttttc

SEQ ID NO: 201733 - DNA, 20 bp, Artificial Sequence
  chemically synthesized
atactattgagaaacatttc

SEQ ID NO: 201734 - DNA, 20 bp, Artificial Sequence
  chemically synthesized
tttctagaaatgtttctcaa

SEQ ID NO: 201735 - DNA, 20 bp, Artificial Sequence
  chemically synthesized
tattagaacaaaatactatt

SEQ ID NO: 201736 - DNA, 20 bp, Artificial Sequence
  chemically synthesized
aaaggtgttcacatttgtat

SEQ ID NO: 201737 - DNA, 20 bp, Artificial Sequence
  chemically synthesized
taacacttttaggattttaa

SEQ ID NO: 201738 - DNA, 20 bp, Artificial Sequence
  chemically synthesized
ttaacacttttaggatttta

SEQ ID NO: 201739 - DNA, 20 bp, Artificial Sequence
  chemically synthesized
gaacacctttaaaatcctaa

SEQ ID NO: 201740 - DNA, 20 bp, Artificial Sequence
  chemically synthesized
ccaacttgtttaacactttt

SEQ ID NO: 201741 - DNA, 20 bp, Artificial Sequence
  chemically synthesized
cccaacttgtttaacacttt

SEQ ID NO: 201742 - DNA, 20 bp, Artificial Sequence
  chemically synthesized
aaatcctaaaagtgttaaac

SEQ ID NO: 201743 - DNA, 20 bp, Artificial Sequence
  chemically synthesized
cctaaaagtgttaaacaagt

SEQ ID NO: 201744 - DNA, 20 bp, Artificial Sequence
  chemically synthesized
ctaaaagtgttaaacaagtt

SEQ ID NO: 201745 - DNA, 20 bp, Artificial Sequence
  chemically synthesized
taaaagtgttaaacaagttg

SEQ ID NO: 201746 - DNA, 20 bp, Artificial Sequence
  chemically synthesized
aaaagtgttaaacaagttgg

SEQ ID NO: 201747 - DNA, 20 bp, Artificial Sequence
  chemically synthesized
aaagtgttaaacaagttggg

SEQ ID NO: 201748 - DNA, 20 bp, Artificial Sequence
  chemically synthesized
ccccttacctgggagaatgt

SEQ ID NO: 201749 - DNA, 20 bp, Artificial Sequence
  chemically synthesized
gtaataatctgacattctcc

SEQ ID NO: 201750 - DNA, 20 bp, Artificial Sequence
  chemically synthesized
taataatctgacattctccc

SEQ ID NO: 201751 - DNA, 20 bp, Artificial Sequence
  chemically synthesized
aatctgacattctcccaggt

SEQ ID NO: 201752 - DNA, 20 bp, Artificial Sequence
  chemically synthesized
atctgacattctcccaggta

SEQ ID NO: 201753 - DNA, 20 bp, Artificial Sequence
  chemically synthesized
ttcgaaatccccttacctgg

SEQ ID NO: 201754 - DNA, 20 bp, Artificial Sequence
  chemically synthesized
tctgacattctcccaggtaa

SEQ ID NO: 201755 - DNA, 20 bp, Artificial Sequence
  chemically synthesized
ctgacattctcccaggtaag

SEQ ID NO: 201756 - DNA, 20 bp, Artificial Sequence
  chemically synthesized
tattcgaaatccccttacct

SEQ ID NO: 201757 - DNA, 20 bp, Artificial Sequence
  chemically synthesized
ttattcgaaatccccttacc

SEQ ID NO: 201758 - DNA, 20 bp, Artificial Sequence
  chemically synthesized
caggtaaggggatttcgaat

SEQ ID NO: 201759 - DNA, 20 bp, Artificial Sequence
  chemically synthesized
aggtaaggggatttcgaata

SEQ ID NO: 201760 - DNA, 20 bp, Artificial Sequence
  chemically synthesized
tttcgaataaggtcttccta

SEQ ID NO: 201761 - DNA, 20 bp, Artificial Sequence
  chemically synthesized
taatgttgccatgccatagg

SEQ ID NO: 201762 - DNA, 20 bp, Artificial Sequence
  chemically synthesized
aataaggtcttcctatggca

SEQ ID NO: 201763 - DNA, 20 bp, Artificial Sequence
  chemically synthesized
ctttaatgttgccatgccat

SEQ ID NO: 201764 - DNA, 20 bp, Artificial Sequence
  chemically synthesized
actttaatgttgccatgcca

SEQ ID NO: 201765 - DNA, 20 bp, Artificial Sequence
  chemically synthesized
cctatggcatggcaacatta

SEQ ID NO: 201766 - DNA, 20 bp, Artificial Sequence
  chemically synthesized
gcaacattaaagtcctcact

SEQ ID NO: 201767 - DNA, 20 bp, Artificial Sequence
  chemically synthesized
aaataacatgttgcttagtg

SEQ ID NO: 201768 - DNA, 20 bp, Artificial Sequence
  chemically synthesized
taaataacatgttgcttagt

SEQ ID NO: 201769 - DNA, 20 bp, Artificial Sequence
  chemically synthesized
aagttaaataacatgttgct

SEQ ID NO: 201770 - DNA, 20 bp, Artificial Sequence
  chemically synthesized
actctcttcccagtgtcatg

SEQ ID NO: 201771 - DNA, 20 bp, Artificial Sequence
  chemically synthesized
gttatttaacttcatgacac

SEQ ID NO: 201772 - DNA, 20 bp, Artificial Sequence
  chemically synthesized
ttatttaacttcatgacact

SEQ ID NO: 201773 - DNA, 20 bp, Artificial Sequence
  chemically synthesized
tttaacttcatgacactggg

SEQ ID NO: 201774 - DNA, 20 bp, Artificial Sequence
  chemically synthesized
taacttcatgacactgggaa

SEQ ID NO: 201775 - DNA, 20 bp, Artificial Sequence
  chemically synthesized
acttcatgacactgggaaga

SEQ ID NO: 201776 - DNA, 20 bp, Artificial Sequence
  chemically synthesized
gctggcaaatactctcttcc

SEQ ID NO: 201777 - DNA, 20 bp, Artificial Sequence
  chemically synthesized
actgggaagagagtatttgc

SEQ ID NO: 201778 - DNA, 20 bp, Artificial Sequence
  chemically synthesized
aagagagtatttgccagctt

SEQ ID NO: 201779 - DNA, 20 bp, Artificial Sequence
  chemically synthesized
taacatttgctttctaaagc

SEQ ID NO: 201780 - DNA, 20 bp, Artificial Sequence
  chemically synthesized
gagtatttgccagctttaga

SEQ ID NO: 201781 - DNA, 20 bp, Artificial Sequence
  chemically synthesized
ttcttaacatttgctttcta

SEQ ID NO: 201782 - DNA, 20 bp, Artificial Sequence
  chemically synthesized
agctttagaaagcaaatgtt

SEQ ID NO: 201783 - DNA, 20 bp, Artificial Sequence
  chemically synthesized
atagtccccttgataatgtt

SEQ ID NO: 201784 - DNA, 20 bp, Artificial Sequence
  chemically synthesized
ttaagaatctaaacattatc

SEQ ID NO: 201785 - DNA, 20 bp, Artificial Sequence
  chemically synthesized
taagaatctaaacattatca

SEQ ID NO: 201786 - DNA, 20 bp, Artificial Sequence
  chemically synthesized
aagaatctaaacattatcaa

SEQ ID NO: 201787 - DNA, 20 bp, Artificial Sequence
  chemically synthesized
agaatctaaacattatcaag

SEQ ID NO: 201788 - DNA, 20 bp, Artificial Sequence
  chemically synthesized
aagctcaaaattaagcaaaa

SEQ ID NO: 201789 - DNA, 20 bp, Artificial Sequence
  chemically synthesized
ggactattttgcttaatttt

SEQ ID NO: 201790 - DNA, 20 bp, Artificial Sequence
  chemically synthesized
agtgttgaaagctcaaaatt

SEQ ID NO: 201791 - DNA, 20 bp, Artificial Sequence
  chemically synthesized
atatacttctttagtgttga

SEQ ID NO: 201792 - DNA, 20 bp, Artificial Sequence
  chemically synthesized
attttgagctttcaacacta

SEQ ID NO: 201793 - DNA, 20 bp, Artificial Sequence
  chemically synthesized
ttgagctttcaacactaaag

SEQ ID NO: 201794 - DNA, 20 bp, Artificial Sequence
  chemically synthesized
tgttcctttatatacttctt

SEQ ID NO: 201795 - DNA, 20 bp, Artificial Sequence
  chemically synthesized
caacactaaagaagtatata

SEQ ID NO: 201796 - DNA, 20 bp, Artificial Sequence
  chemically synthesized
aacactaaagaagtatataa

SEQ ID NO: 201797 - DNA, 20 bp, Artificial Sequence
  chemically synthesized
aagaagtatataaaggaaca

SEQ ID NO: 201798 - DNA, 20 bp, Artificial Sequence
  chemically synthesized
agaagtatataaaggaacat

SEQ ID NO: 201799 - DNA, 20 bp, Artificial Sequence
  chemically synthesized
ggacccttacataatcattg

SEQ ID NO: 201800 - DNA, 20 bp, Artificial Sequence
  chemically synthesized
gtatacttcaatgattatgt

SEQ ID NO: 201801 - DNA, 20 bp, Artificial Sequence
  chemically synthesized
tatacttcaatgattatgta

SEQ ID NO: 201802 - DNA, 20 bp, Artificial Sequence
  chemically synthesized
atacttcaatgattatgtaa

SEQ ID NO: 201803 - DNA, 20 bp, Artificial Sequence
  chemically synthesized
tcaatgattatgtaagggtc

SEQ ID NO: 201804 - DNA, 20 bp, Artificial Sequence
  chemically synthesized
caatgattatgtaagggtcc

SEQ ID NO: 201805 - DNA, 20 bp, Artificial Sequence
  chemically synthesized
cagtgatgatttgattagcc

SEQ ID NO: 201806 - DNA, 20 bp, Artificial Sequence
  chemically synthesized
cacctcagtgatgatttgat

SEQ ID NO: 201807 - DNA, 20 bp, Artificial Sequence
  chemically synthesized
aggctaatcaaatcatcact

SEQ ID NO: 201808 - DNA, 20 bp, Artificial Sequence
  chemically synthesized
ggctaatcaaatcatcactg

SEQ ID NO: 201809 - DNA, 20 bp, Artificial Sequence
  chemically synthesized
taatcaaatcatcactgagg

SEQ ID NO: 201810 - DNA, 20 bp, Artificial Sequence
  chemically synthesized
ggtgtgtgtaatagccacct

SEQ ID NO: 201811 - DNA, 20 bp, Artificial Sequence
  chemically synthesized
tatatgtttggtgtgtgtaa

SEQ ID NO: 201812 - DNA, 20 bp, Artificial Sequence
  chemically synthesized
caattttctgattatatgtt

SEQ ID NO: 201813 - DNA, 20 bp, Artificial Sequence
  chemically synthesized
acacacaccaaacatataat

SEQ ID NO: 201814 - DNA, 20 bp, Artificial Sequence
  chemically synthesized
aacatataatcagaaaattg

SEQ ID NO: 201815 - DNA, 20 bp, Artificial Sequence
  chemically synthesized
atcagaaaattgtggctcat

SEQ ID NO: 201816 - DNA, 20 bp, Artificial Sequence
  chemically synthesized
agaaaattgtggctcatgag

SEQ ID NO: 201817 - DNA, 20 bp, Artificial Sequence
  chemically synthesized
gcttaagttaaacttctcat

SEQ ID NO: 201818 - DNA, 20 bp, Artificial Sequence
  chemically synthesized
gctcatgagaagtttaactt

SEQ ID NO: 201819 - DNA, 20 bp, Artificial Sequence
  chemically synthesized
ctattgaataggaagggctt

SEQ ID NO: 201820 - DNA, 20 bp, Artificial Sequence
  chemically synthesized
catcccctattgaataggaa

SEQ ID NO: 201821 - DNA, 20 bp, Artificial Sequence
  chemically synthesized
acatcccctattgaatagga

SEQ ID NO: 201822 - DNA, 20 bp, Artificial Sequence
  chemically synthesized
gacatcccctattgaatagg

SEQ ID NO: 201823 - DNA, 20 bp, Artificial Sequence
  chemically synthesized
cttaagcccttcctattcaa

SEQ ID NO: 201824 - DNA, 20 bp, Artificial Sequence
  chemically synthesized
ttaagcccttcctattcaat

SEQ ID NO: 201825 - DNA, 20 bp, Artificial Sequence
  chemically synthesized
taagacatcccctattgaat

SEQ ID NO: 201826 - DNA, 20 bp, Artificial Sequence
  chemically synthesized
taagcccttcctattcaata

SEQ ID NO: 201827 - DNA, 20 bp, Artificial Sequence
  chemically synthesized
ctaagacatcccctattgaa

SEQ ID NO: 201828 - DNA, 20 bp, Artificial Sequence
  chemically synthesized
aagcccttcctattcaatag

SEQ ID NO: 201829 - DNA, 20 bp, Artificial Sequence
  chemically synthesized
ctattcaataggggatgtct

SEQ ID NO: 201830 - DNA, 20 bp, Artificial Sequence
  chemically synthesized
tattcaataggggatgtctt

SEQ ID NO: 201831 - DNA, 20 bp, Artificial Sequence
  chemically synthesized
aataggggatgtcttaggac

SEQ ID NO: 201832 - DNA, 20 bp, Artificial Sequence
  chemically synthesized
ataggggatgtcttaggacc

SEQ ID NO: 201833 - DNA, 20 bp, Artificial Sequence
  chemically synthesized
tcatcaaacatcctggtcct

SEQ ID NO: 201834 - DNA, 20 bp, Artificial Sequence
  chemically synthesized
agggatatcatcaaacatcc

SEQ ID NO: 201835 - DNA, 20 bp, Artificial Sequence
  chemically synthesized
taataggcattgtgatttca

SEQ ID NO: 201836 - DNA, 20 bp, Artificial Sequence
  chemically synthesized
ttaataggcattgtgatttc

SEQ ID NO: 201837 - DNA, 20 bp, Artificial Sequence
  chemically synthesized
attaataggcattgtgattt

SEQ ID NO: 201838 - DNA, 20 bp, Artificial Sequence
  chemically synthesized
aataggctgttaacattaat

SEQ ID NO: 201839 - DNA, 20 bp, Artificial Sequence
  chemically synthesized
taataggctgttaacattaa

SEQ ID NO: 201840 - DNA, 20 bp, Artificial Sequence
  chemically synthesized
acaatgcctattaatgttaa

SEQ ID NO: 201841 - DNA, 20 bp, Artificial Sequence
  chemically synthesized
gtgtaggttttttttttaat

SEQ ID NO: 201842 - DNA, 20 bp, Artificial Sequence
  chemically synthesized
tgtgtaggttttttttttaa

SEQ ID NO: 201843 - DNA, 20 bp, Artificial Sequence
  chemically synthesized
aacgataaaaggatatgtgt

SEQ ID NO: 201844 - DNA, 20 bp, Artificial Sequence
  chemically synthesized
taacgataaaaggatatgtg

SEQ ID NO: 201845 - DNA, 20 bp, Artificial Sequence
  chemically synthesized
aaataaataataacgataaa

SEQ ID NO: 201846 - DNA, 20 bp, Artificial Sequence
  chemically synthesized
taaataaataataacgataa

SEQ ID NO: 201847 - DNA, 20 bp, Artificial Sequence
  chemically synthesized
atttatttaatttttttttt

SEQ ID NO: 201848 - DNA, 20 bp, Artificial Sequence
  chemically synthesized
ttaattttttttttgagatg

SEQ ID NO: 201849 - DNA, 20 bp, Artificial Sequence
  chemically synthesized
tccaacctgggcgacagagc

SEQ ID NO: 201850 - DNA, 20 bp, Artificial Sequence
  chemically synthesized
tgaagtctcgctctgtcgcc

SEQ ID NO: 201851 - DNA, 20 bp, Artificial Sequence
  chemically synthesized
gcactccaacctgggcgaca

SEQ ID NO: 201852 - DNA, 20 bp, Artificial Sequence
  chemically synthesized
gaagtctcgctctgtcgccc

SEQ ID NO: 201853 - DNA, 20 bp, Artificial Sequence
  chemically synthesized
ctgcactccaacctgggcga

SEQ ID NO: 201854 - DNA, 20 bp, Artificial Sequence
  chemically synthesized
tctcgctctgtcgcccaggt

SEQ ID NO: 201855 - DNA, 20 bp, Artificial Sequence
  chemically synthesized
tcgctctgtcgcccaggttg

SEQ ID NO: 201856 - DNA, 20 bp, Artificial Sequence
  chemically synthesized
gtgccactgcactccaacct

SEQ ID NO: 201857 - DNA, 20 bp, Artificial Sequence
  chemically synthesized
cgtgccactgcactccaacc

SEQ ID NO: 201858 - DNA, 20 bp, Artificial Sequence
  chemically synthesized
ctgtcgcccaggttggagtg

SEQ ID NO: 201859 - DNA, 20 bp, Artificial Sequence
  chemically synthesized
tcgcccaggttggagtgcag

SEQ ID NO: 201860 - DNA, 20 bp, Artificial Sequence
  chemically synthesized
ggagtgcagtggcacgatct

SEQ ID NO: 201861 - DNA, 20 bp, Artificial Sequence
  chemically synthesized
tgcagagcttgcagtgagcc

SEQ ID NO: 201862 - DNA, 20 bp, Artificial Sequence
  chemically synthesized
gcacgatctcggctcactgc

SEQ ID NO: 201863 - DNA, 20 bp, Artificial Sequence
  chemically synthesized
tgggatgcagagcttgcagt

SEQ ID NO: 201864 - DNA, 20 bp, Artificial Sequence
  chemically synthesized
aacctgggatgcagagcttg

SEQ ID NO: 201865 - DNA, 20 bp, Artificial Sequence
  chemically synthesized
tcactgcaagctctgcatcc

SEQ ID NO: 201866 - DNA, 20 bp, Artificial Sequence
  chemically synthesized
tggcgtgaacctgggatgca

SEQ ID NO: 201867 - DNA, 20 bp, Artificial Sequence
  chemically synthesized
cactgcaagctctgcatccc

SEQ ID NO: 201868 - DNA, 20 bp, Artificial Sequence
  chemically synthesized
aatggcgtgaacctgggatg

SEQ ID NO: 201869 - DNA, 20 bp, Artificial Sequence
  chemically synthesized
caggagaatggcgtgaacct

SEQ ID NO: 201870 - DNA, 20 bp, Artificial Sequence
  chemically synthesized
gcaggagaatggcgtgaacc

SEQ ID NO: 201871 - DNA, 20 bp, Artificial Sequence
  chemically synthesized
gggaggctgaggcaggagaa

SEQ ID NO: 201872 - DNA, 20 bp, Artificial Sequence
  chemically synthesized
ttcacgccattctcctgcct

SEQ ID NO: 201873 - DNA, 20 bp, Artificial Sequence
  chemically synthesized
tacttgggaggctgaggcag

SEQ ID NO: 201874 - DNA, 20 bp, Artificial Sequence
  chemically synthesized
gctacttgggaggctgaggc

SEQ ID NO: 201875 - DNA, 20 bp, Artificial Sequence
  chemically synthesized
agctacttgggaggctgagg

SEQ ID NO: 201876 - DNA, 20 bp, Artificial Sequence
  chemically synthesized
ctcagctacttgggaggctg

SEQ ID NO: 201877 - DNA, 20 bp, Artificial Sequence
  chemically synthesized
tctcagctacttgggaggct

SEQ ID NO: 201878 - DNA, 20 bp, Artificial Sequence
  chemically synthesized
ttctcctgcctcagcctccc

SEQ ID NO: 201879 - DNA, 20 bp, Artificial Sequence
  chemically synthesized
tcctgcctcagcctcccaag

SEQ ID NO: 201880 - DNA, 20 bp, Artificial Sequence
  chemically synthesized
tgtagtctcagctacttggg

SEQ ID NO: 201881 - DNA, 20 bp, Artificial Sequence
  chemically synthesized
ctgtagtctcagctacttgg

SEQ ID NO: 201882 - DNA, 20 bp, Artificial Sequence
  chemically synthesized
acctgtagtctcagctactt

SEQ ID NO: 201883 - DNA, 20 bp, Artificial Sequence
  chemically synthesized
cctcagcctcccaagtagct

SEQ ID NO: 201884 - DNA, 20 bp, Artificial Sequence
  chemically synthesized
cacctgtagtctcagctact

SEQ ID NO: 201885 - DNA, 20 bp, Artificial Sequence
  chemically synthesized
ctcccaagtagctgagacta

SEQ ID NO: 201886 - DNA, 20 bp, Artificial Sequence
  chemically synthesized
tcccaagtagctgagactac

SEQ ID NO: 201887 - DNA, 20 bp, Artificial Sequence
  chemically synthesized
gtggcaggcacctgtagtct

SEQ ID NO: 201888 - DNA, 20 bp, Artificial Sequence
  chemically synthesized
ggcatggtggcaggcacctg

SEQ ID NO: 201889 - DNA, 20 bp, Artificial Sequence
  chemically synthesized
aattagctgggcatggtggc

SEQ ID NO: 201890 - DNA, 20 bp, Artificial Sequence
  chemically synthesized
aaattagctgggcatggtgg

SEQ ID NO: 201891 - DNA, 20 bp, Artificial Sequence
  chemically synthesized
caggtgcctgccaccatgcc

SEQ ID NO: 201892 - DNA, 20 bp, Artificial Sequence
  chemically synthesized
aaaaaattagctgggcatgg

SEQ ID NO: 201893 - DNA, 20 bp, Artificial Sequence
  chemically synthesized
acaaaaaaattagctgggca

SEQ ID NO: 201894 - DNA, 20 bp, Artificial Sequence
  chemically synthesized
aaaatacaaaaaaattagct

SEQ ID NO: 201895 - DNA, 20 bp, Artificial Sequence
  chemically synthesized
aaaaatacaaaaaaattagc

SEQ ID NO: 201896 - DNA, 20 bp, Artificial Sequence
  chemically synthesized
tactaaaaatacaaaaaaat

SEQ ID NO: 201897 - DNA, 20 bp, Artificial Sequence
  chemically synthesized
agctaatttttttgtatttt

SEQ ID NO: 201898 - DNA, 20 bp, Artificial Sequence
  chemically synthesized
taatttttttgtatttttag

SEQ ID NO: 201899 - DNA, 20 bp, Artificial Sequence
  chemically synthesized
atttttttgtatttttagta

SEQ ID NO: 201900 - DNA, 20 bp, Artificial Sequence
  chemically synthesized
ttttgtatttttagtagaga

SEQ ID NO: 201901 - DNA, 20 bp, Artificial Sequence
  chemically synthesized
tttgtatttttagtagagac

SEQ ID NO: 201902 - DNA, 20 bp, Artificial Sequence
  chemically synthesized
ttgtatttttagtagagacg

SEQ ID NO: 201903 - DNA, 20 bp, Artificial Sequence
  chemically synthesized
gagacggggtttcactgtgt

SEQ ID NO: 201904 - DNA, 20 bp, Artificial Sequence
  chemically synthesized
cggggtttcactgtgttagc

SEQ ID NO: 201905 - DNA, 20 bp, Artificial Sequence
  chemically synthesized
cgagaccatcctggctaaca

SEQ ID NO: 201906 - DNA, 20 bp, Artificial Sequence
  chemically synthesized
ggggtttcactgtgttagcc

SEQ ID NO: 201907 - DNA, 20 bp, Artificial Sequence
  chemically synthesized
tttcactgtgttagccagga

SEQ ID NO: 201908 - DNA, 20 bp, Artificial Sequence
  chemically synthesized
tcaggagatcgagaccatcc

SEQ ID NO: 201909 - DNA, 20 bp, Artificial Sequence
  chemically synthesized
gatcatgatgtcaggagatc

SEQ ID NO: 201910 - DNA, 20 bp, Artificial Sequence
  chemically synthesized
cgggcggatcatgatgtcag

SEQ ID NO: 201911 - DNA, 20 bp, Artificial Sequence
  chemically synthesized
ggcgggcggatcatgatgtc

SEQ ID NO: 201912 - DNA, 20 bp, Artificial Sequence
  chemically synthesized
aggcgggcggatcatgatgt

SEQ ID NO: 201913 - DNA, 20 bp, Artificial Sequence
  chemically synthesized
acatcatgatccgcccgcct

SEQ ID NO: 201914 - DNA, 20 bp, Artificial Sequence
  chemically synthesized
ctttgggaggccaaggcggg

SEQ ID NO: 201915 - DNA, 20 bp, Artificial Sequence
  chemically synthesized
gcactttgggaggccaaggc

SEQ ID NO: 201916 - DNA, 20 bp, Artificial Sequence
  chemically synthesized
agcactttgggaggccaagg

SEQ ID NO: 201917 - DNA, 20 bp, Artificial Sequence
  chemically synthesized
cccagcactttgggaggcca

SEQ ID NO: 201918 - DNA, 20 bp, Artificial Sequence
  chemically synthesized
tcccagcactttgggaggcc

SEQ ID NO: 201919 - DNA, 20 bp, Artificial Sequence
  chemically synthesized
ccgcccgccttggcctccca

SEQ ID NO: 201920 - DNA, 20 bp, Artificial Sequence
  chemically synthesized
tgtaatcccagcactttggg

SEQ ID NO: 201921 - DNA, 20 bp, Artificial Sequence
  chemically synthesized
ctgtaatcccagcactttgg

SEQ ID NO: 201922 - DNA, 20 bp, Artificial Sequence
  chemically synthesized
gccttggcctcccaaagtgc

SEQ ID NO: 201923 - DNA, 20 bp, Artificial Sequence
  chemically synthesized
gcctgtaatcccagcacttt

SEQ ID NO: 201924 - DNA, 20 bp, Artificial Sequence
  chemically synthesized
ccttggcctcccaaagtgct

SEQ ID NO: 201925 - DNA, 20 bp, Artificial Sequence
  chemically synthesized
cgcctgtaatcccagcactt

SEQ ID NO: 201926 - DNA, 20 bp, Artificial Sequence
  chemically synthesized
ctcccaaagtgctgggatta

SEQ ID NO: 201927 - DNA, 20 bp, Artificial Sequence
  chemically synthesized
tcccaaagtgctgggattac

SEQ ID NO: 201928 - DNA, 20 bp, Artificial Sequence
  chemically synthesized
gaggctcacgcctgtaatcc

SEQ ID NO: 201929 - DNA, 20 bp, Artificial Sequence
  chemically synthesized
agtgctgggattacaggcgt

SEQ ID NO: 201930 - DNA, 20 bp, Artificial Sequence
  chemically synthesized
caggcgtgagcctccgcacc

SEQ ID NO: 201931 - DNA, 20 bp, Artificial Sequence
  chemically synthesized
atgatataggctgggtgcgg

SEQ ID NO: 201932 - DNA, 20 bp, Artificial Sequence
  chemically synthesized
aatgatataggctgggtgcg

SEQ ID NO: 201933 - DNA, 20 bp, Artificial Sequence
  chemically synthesized
acaatgatataggctgggtg

SEQ ID NO: 201934 - DNA, 20 bp, Artificial Sequence
  chemically synthesized
taataacaatgatataggct

SEQ ID NO: 201935 - DNA, 20 bp, Artificial Sequence
  chemically synthesized
gtaataacaatgatataggc

SEQ ID NO: 201936 - DNA, 20 bp, Artificial Sequence
  chemically synthesized
gatagtaataacaatgatat

SEQ ID NO: 201937 - DNA, 20 bp, Artificial Sequence
  chemically synthesized
cgatagtaataacaatgata

SEQ ID NO: 201938 - DNA, 20 bp, Artificial Sequence
  chemically synthesized
aataatagtagtaataacga

SEQ ID NO: 201939 - DNA, 20 bp, Artificial Sequence
  chemically synthesized
tattaacattggaataatag

SEQ ID NO: 201940 - DNA, 20 bp, Artificial Sequence
  chemically synthesized
ccatattaacattggaataa

SEQ ID NO: 201941 - DNA, 20 bp, Artificial Sequence
  chemically synthesized
agtgggcaccatattaacat

SEQ ID NO: 201942 - DNA, 20 bp, Artificial Sequence
  chemically synthesized
ctattattccaatgttaata

SEQ ID NO: 201943 - DNA, 20 bp, Artificial Sequence
  chemically synthesized
catttctactttaaaacagt

SEQ ID NO: 201944 - DNA, 20 bp, Artificial Sequence
  chemically synthesized
gcatttctactttaaaacag

SEQ ID NO: 201945 - DNA, 20 bp, Artificial Sequence
  chemically synthesized
atatggtgcccactgtttta

SEQ ID NO: 201946 - DNA, 20 bp, Artificial Sequence
  chemically synthesized
atagcatttctactttaaaa

SEQ ID NO: 201947 - DNA, 20 bp, Artificial Sequence
  chemically synthesized
tggtgcccactgttttaaag

SEQ ID NO: 201948 - DNA, 20 bp, Artificial Sequence
  chemically synthesized
aacacaagaagattaaataa

SEQ ID NO: 201949 - DNA, 20 bp, Artificial Sequence
  chemically synthesized
ttattgaatacgaacacaag

SEQ ID NO: 201950 - DNA, 20 bp, Artificial Sequence
  chemically synthesized
tctttattgaatacgaacac

SEQ ID NO: 201951 - DNA, 20 bp, Artificial Sequence
  chemically synthesized
tcttgtgttcgtattcaata

SEQ ID NO: 201952 - DNA, 20 bp, Artificial Sequence
  chemically synthesized
tattcaataaagaaaaatat

SEQ ID NO: 201953 - DNA, 20 bp, Artificial Sequence
  chemically synthesized
aaaaatataagtattatgac

SEQ ID NO: 201954 - DNA, 20 bp, Artificial Sequence
  chemically synthesized
aaaatataagtattatgaca

SEQ ID NO: 201955 - DNA, 20 bp, Artificial Sequence
  chemically synthesized
atataagtattatgacaagg

SEQ ID NO: 201956 - DNA, 20 bp, Artificial Sequence
  chemically synthesized
attatgacaaggcagtgatt

SEQ ID NO: 201957 - DNA, 20 bp, Artificial Sequence
  chemically synthesized
tgacaaggcagtgatttgga

SEQ ID NO: 201958 - DNA, 20 bp, Artificial Sequence
  chemically synthesized
gacaaggcagtgatttggac

SEQ ID NO: 201959 - DNA, 20 bp, Artificial Sequence
  chemically synthesized
tggacaggatgtttcgaatg

SEQ ID NO: 201960 - DNA, 20 bp, Artificial Sequence
  chemically synthesized
ggacaggatgtttcgaatgc

SEQ ID NO: 201961 - DNA, 20 bp, Artificial Sequence
  chemically synthesized
caggcatgttgacatataac

SEQ ID NO: 201962 - DNA, 20 bp, Artificial Sequence
  chemically synthesized
gttgacatataactggacat

SEQ ID NO: 201963 - DNA, 20 bp, Artificial Sequence
  chemically synthesized
actatatcagggctcatgtc

SEQ ID NO: 201964 - DNA, 20 bp, Artificial Sequence
  chemically synthesized
actggacatgagccctgata

SEQ ID NO: 201965 - DNA, 20 bp, Artificial Sequence
  chemically synthesized
caaatatccaaactatatca

SEQ ID NO: 201966 - DNA, 20 bp, Artificial Sequence
  chemically synthesized
gcaaatatccaaactatatc

SEQ ID NO: 201967 - DNA, 20 bp, Artificial Sequence
  chemically synthesized
ggcaaatatccaaactatat

SEQ ID NO: 201968 - DNA, 20 bp, Artificial Sequence
  chemically synthesized
acatgagccctgatatagtt

SEQ ID NO: 201969 - DNA, 20 bp, Artificial Sequence
  chemically synthesized
tccacttgagatttgagtgg

SEQ ID NO: 201970 - DNA, 20 bp, Artificial Sequence
  chemically synthesized
atttccacttgagatttgag

SEQ ID NO: 201971 - DNA, 20 bp, Artificial Sequence
  chemically synthesized
tttgccgccactcaaatctc

SEQ ID NO: 201972 - DNA, 20 bp, Artificial Sequence
  chemically synthesized
tatatttccacttgagattt

SEQ ID NO: 201973 - DNA, 20 bp, Artificial Sequence
  chemically synthesized
gccgccactcaaatctcaag

SEQ ID NO: 201974 - DNA, 20 bp, Artificial Sequence
  chemically synthesized
tgggaattatatttccactt

SEQ ID NO: 201975 - DNA, 20 bp, Artificial Sequence
  chemically synthesized
ggaaatataattcccaatgt

SEQ ID NO: 201976 - DNA, 20 bp, Artificial Sequence
  chemically synthesized
caggccccaccaccaacatt

SEQ ID NO: 201977 - DNA, 20 bp, Artificial Sequence
  chemically synthesized
aatataattcccaatgttgg

SEQ ID NO: 201978 - DNA, 20 bp, Artificial Sequence
  chemically synthesized
ccaggccccaccaccaacat

SEQ ID NO: 201979 - DNA, 20 bp, Artificial Sequence
  chemically synthesized
ataattcccaatgttggtgg

SEQ ID NO: 201980 - DNA, 20 bp, Artificial Sequence
  chemically synthesized
taattcccaatgttggtggt

SEQ ID NO: 201981 - DNA, 20 bp, Artificial Sequence
  chemically synthesized
aattcccaatgttggtggtg

SEQ ID NO: 201982 - DNA, 20 bp, Artificial Sequence
  chemically synthesized
ccaatgttggtggtggggcc

SEQ ID NO: 201983 - DNA, 20 bp, Artificial Sequence
  chemically synthesized
atgttggtggtggggcctgg

SEQ ID NO: 201984 - DNA, 20 bp, Artificial Sequence
  chemically synthesized
tgttggtggtggggcctggc

SEQ ID NO: 201985 - DNA, 20 bp, Artificial Sequence
  chemically synthesized
ttggtggtggggcctggcgg

SEQ ID NO: 201986 - DNA, 20 bp, Artificial Sequence
  chemically synthesized
tggtggtggggcctggcggg

SEQ ID NO: 201987 - DNA, 20 bp, Artificial Sequence
  chemically synthesized
tgacccaaaaacctcccgcc

SEQ ID NO: 201988 - DNA, 20 bp, Artificial Sequence
  chemically synthesized
atgacccaaaaacctcccgc

SEQ ID NO: 201989 - DNA, 20 bp, Artificial Sequence
  chemically synthesized
ggggcctggcgggaggtttt

SEQ ID NO: 201990 - DNA, 20 bp, Artificial Sequence
  chemically synthesized
gggcctggcgggaggttttt

SEQ ID NO: 201991 - DNA, 20 bp, Artificial Sequence
  chemically synthesized
ggcgggaggtttttgggtca

SEQ ID NO: 201992 - DNA, 20 bp, Artificial Sequence
  chemically synthesized
gcgggaggtttttgggtcat

SEQ ID NO: 201993 - DNA, 20 bp, Artificial Sequence
  chemically synthesized
cgggaggtttttgggtcatg

SEQ ID NO: 201994 - DNA, 20 bp, Artificial Sequence
  chemically synthesized
aggtttttgggtcatgggga

SEQ ID NO: 201995 - DNA, 20 bp, Artificial Sequence
  chemically synthesized
tcatggggacagatccctca

SEQ ID NO: 201996 - DNA, 20 bp, Artificial Sequence
  chemically synthesized
aggacaatacaaaaccatga

SEQ ID NO: 201997 - DNA, 20 bp, Artificial Sequence
  chemically synthesized
gaggacaatacaaaaccatg

SEQ ID NO: 201998 - DNA, 20 bp, Artificial Sequence
  chemically synthesized
tgaggacaatacaaaaccat

SEQ ID NO: 201999 - DNA, 20 bp, Artificial Sequence
  chemically synthesized
tcatggttttgtattgtcct

SEQ ID NO: 202000 - DNA, 20 bp, Artificial Sequence
  chemically synthesized
gttttgtattgtcctcagtg

SEQ ID NO: 202001 - DNA, 20 bp, Artificial Sequence
  chemically synthesized
aaaactcactcactacactg

SEQ ID NO: 202002 - DNA, 20 bp, Artificial Sequence
  chemically synthesized
gaaaactcactcactacact

SEQ ID NO: 202003 - DNA, 20 bp, Artificial Sequence
  chemically synthesized
tgtattgtcctcagtgtagt

SEQ ID NO: 202004 - DNA, 20 bp, Artificial Sequence
  chemically synthesized
ttgtcctcagtgtagtgagt

SEQ ID NO: 202005 - DNA, 20 bp, Artificial Sequence
  chemically synthesized
tgtagtgagtgagttttcat

SEQ ID NO: 202006 - DNA, 20 bp, Artificial Sequence
  chemically synthesized
gagtgagttttcatgagatc

SEQ ID NO: 202007 - DNA, 20 bp, Artificial Sequence
  chemically synthesized
cacacactttaaaaaaaaac

SEQ ID NO: 202008 - DNA, 20 bp, Artificial Sequence
  chemically synthesized
tgagatctggttttttttta

SEQ ID NO: 202009 - DNA, 20 bp, Artificial Sequence
  chemically synthesized
tggtttttttttaaagtgtg

SEQ ID NO: 202010 - DNA, 20 bp, Artificial Sequence
  chemically synthesized
ggtttttttttaaagtgtgt

SEQ ID NO: 202011 - DNA, 20 bp, Artificial Sequence
  chemically synthesized
gagtttttgctcatggcaga

SEQ ID NO: 202012 - DNA, 20 bp, Artificial Sequence
  chemically synthesized
tgggcatcaccttctgccat

SEQ ID NO: 202013 - DNA, 20 bp, Artificial Sequence
  chemically synthesized
ggagtttttgctcatggcag

SEQ ID NO: 202014 - DNA, 20 bp, Artificial Sequence
  chemically synthesized
cagggagtttttgctcatgg

SEQ ID NO: 202015 - DNA, 20 bp, Artificial Sequence
  chemically synthesized
cctcagggagtttttgctca

SEQ ID NO: 202016 - DNA, 20 bp, Artificial Sequence
  chemically synthesized
gccatgagcaaaaactccct

SEQ ID NO: 202017 - DNA, 20 bp, Artificial Sequence
  chemically synthesized
ccatgagcaaaaactccctg

SEQ ID NO: 202018 - DNA, 20 bp, Artificial Sequence
  chemically synthesized
gctcctggggaggcctcagg

SEQ ID NO: 202019 - DNA, 20 bp, Artificial Sequence
  chemically synthesized
tggctcctggggaggcctca

SEQ ID NO: 202020 - DNA, 20 bp, Artificial Sequence
  chemically synthesized
ttggctcctggggaggcctc

SEQ ID NO: 202021 - DNA, 20 bp, Artificial Sequence
  chemically synthesized
cttggctcctggggaggcct

SEQ ID NO: 202022 - DNA, 20 bp, Artificial Sequence
  chemically synthesized
aaaactccctgaggcctccc

SEQ ID NO: 202023 - DNA, 20 bp, Artificial Sequence
  chemically synthesized
aaactccctgaggcctcccc

SEQ ID NO: 202024 - DNA, 20 bp, Artificial Sequence
  chemically synthesized
actccctgaggcctccccag

SEQ ID NO: 202025 - DNA, 20 bp, Artificial Sequence
  chemically synthesized
catttgcttggctcctgggg

SEQ ID NO: 202026 - DNA, 20 bp, Artificial Sequence
  chemically synthesized
gcatttgcttggctcctggg

SEQ ID NO: 202027 - DNA, 20 bp, Artificial Sequence
  chemically synthesized
aggcatttgcttggctcctg

SEQ ID NO: 202028 - DNA, 20 bp, Artificial Sequence
  chemically synthesized
ctgaggcctccccaggagcc

SEQ ID NO: 202029 - DNA, 20 bp, Artificial Sequence
  chemically synthesized
caggcatttgcttggctcct

SEQ ID NO: 202030 - DNA, 20 bp, Artificial Sequence
  chemically synthesized
acaggcatttgcttggctcc

SEQ ID NO: 202031 - DNA, 20 bp, Artificial Sequence
  chemically synthesized
gtgtggcacaggcatttgct

SEQ ID NO: 202032 - DNA, 20 bp, Artificial Sequence
  chemically synthesized
ctgtacaggaagtgtggcac

SEQ ID NO: 202033 - DNA, 20 bp, Artificial Sequence
  chemically synthesized
gctgtacaggaagtgtggca

SEQ ID NO: 202034 - DNA, 20 bp, Artificial Sequence
  chemically synthesized
tgcaggctgtacaggaagtg

SEQ ID NO: 202035 - DNA, 20 bp, Artificial Sequence
  chemically synthesized
cctgtgccacacttcctgta

SEQ ID NO: 202036 - DNA, 20 bp, Artificial Sequence
  chemically synthesized
ggttctgcaggctgtacagg

SEQ ID NO: 202037 - DNA, 20 bp, Artificial Sequence
  chemically synthesized
gatggttctgcaggctgtac

SEQ ID NO: 202038 - DNA, 20 bp, Artificial Sequence
  chemically synthesized
tgatggttctgcaggctgta

SEQ ID NO: 202039 - DNA, 20 bp, Artificial Sequence
  chemically synthesized
cacacttcctgtacagcctg

SEQ ID NO: 202040 - DNA, 20 bp, Artificial Sequence
  chemically synthesized
taattggctgatggttctgc

SEQ ID NO: 202041 - DNA, 20 bp, Artificial Sequence
  chemically synthesized
ttaattggctgatggttctg

SEQ ID NO: 202042 - DNA, 20 bp, Artificial Sequence
  chemically synthesized
tgtacagcctgcagaaccat

SEQ ID NO: 202043 - DNA, 20 bp, Artificial Sequence
  chemically synthesized
aaaaaagtttaattggctga

SEQ ID NO: 202044 - DNA, 20 bp, Artificial Sequence
  chemically synthesized
aacaagaaaaaaagtttaat

SEQ ID NO: 202045 - DNA, 20 bp, Artificial Sequence
  chemically synthesized
ttatatttcaacaagaaaaa

SEQ ID NO: 202046 - DNA, 20 bp, Artificial Sequence
  chemically synthesized
acttggcattatatttcaac

SEQ ID NO: 202047 - DNA, 20 bp, Artificial Sequence
  chemically synthesized
tcttgttgaaatataatgcc

SEQ ID NO: 202048 - DNA, 20 bp, Artificial Sequence
  chemically synthesized
tgaaatataatgccaagtgt

SEQ ID NO: 202049 - DNA, 20 bp, Artificial Sequence
  chemically synthesized
caggccccaagtccaacact

SEQ ID NO: 202050 - DNA, 20 bp, Artificial Sequence
  chemically synthesized
ataatgccaagtgttggact

SEQ ID NO: 202051 - DNA, 20 bp, Artificial Sequence
  chemically synthesized
taatgccaagtgttggactt

SEQ ID NO: 202052 - DNA, 20 bp, Artificial Sequence
  chemically synthesized
aatgccaagtgttggacttg

SEQ ID NO: 202053 - DNA, 20 bp, Artificial Sequence
  chemically synthesized
caagtgttggacttggggcc

SEQ ID NO: 202054 - DNA, 20 bp, Artificial Sequence
  chemically synthesized
aacatctcacaccaggcccc

SEQ ID NO: 202055 - DNA, 20 bp, Artificial Sequence
  chemically synthesized
ttggacttggggcctggtgt

SEQ ID NO: 202056 - DNA, 20 bp, Artificial Sequence
  chemically synthesized
tgactcaaacatctcacacc

SEQ ID NO: 202057 - DNA, 20 bp, Artificial Sequence
  chemically synthesized
gtgactcaaacatctcacac

SEQ ID NO: 202058 - DNA, 20 bp, Artificial Sequence
  chemically synthesized
gggcctggtgtgagatgttt

SEQ ID NO: 202059 - DNA, 20 bp, Artificial Sequence
  chemically synthesized
ggtgtgagatgtttgagtca

SEQ ID NO: 202060 - DNA, 20 bp, Artificial Sequence
  chemically synthesized
tgtgagatgtttgagtcacg

SEQ ID NO: 202061 - DNA, 20 bp, Artificial Sequence
  chemically synthesized
gtgagatgtttgagtcacgg

SEQ ID NO: 202062 - DNA, 20 bp, Artificial Sequence
  chemically synthesized
agatgtttgagtcacggagg

SEQ ID NO: 202063 - DNA, 20 bp, Artificial Sequence
  chemically synthesized
tcacggaggtggatccctca

SEQ ID NO: 202064 - DNA, 20 bp, Artificial Sequence
  chemically synthesized
aggacagcatcaagctgtga

SEQ ID NO: 202065 - DNA, 20 bp, Artificial Sequence
  chemically synthesized
gaggacagcatcaagctgtg

SEQ ID NO: 202066 - DNA, 20 bp, Artificial Sequence
  chemically synthesized
tgaggacagcatcaagctgt

SEQ ID NO: 202067 - DNA, 20 bp, Artificial Sequence
  chemically synthesized
gctatcatgaggacagcatc

SEQ ID NO: 202068 - DNA, 20 bp, Artificial Sequence
  chemically synthesized
ctcagctgctatcatgagga

SEQ ID NO: 202069 - DNA, 20 bp, Artificial Sequence
  chemically synthesized
gcttgatgctgtcctcatga

SEQ ID NO: 202070 - DNA, 20 bp, Artificial Sequence
  chemically synthesized
agaactcagctgctatcatg

SEQ ID NO: 202071 - DNA, 20 bp, Artificial Sequence
  chemically synthesized
tgatgctgtcctcatgatag

SEQ ID NO: 202072 - DNA, 20 bp, Artificial Sequence
  chemically synthesized
aagaactcagctgctatcat

SEQ ID NO: 202073 - DNA, 20 bp, Artificial Sequence
  chemically synthesized
ctgtcctcatgatagcagct

SEQ ID NO: 202074 - DNA, 20 bp, Artificial Sequence
  chemically synthesized
atgatagcagctgagttctt

SEQ ID NO: 202075 - DNA, 20 bp, Artificial Sequence
  chemically synthesized
aaacagatcgctcaagaact

SEQ ID NO: 202076 - DNA, 20 bp, Artificial Sequence
  chemically synthesized
aaaaacaaaacagatcgctc

SEQ ID NO: 202077 - DNA, 20 bp, Artificial Sequence
  chemically synthesized
taaaaaaaaaaaaaacaaaa

SEQ ID NO: 202078 - DNA, 20 bp, Artificial Sequence
  chemically synthesized
tttttttttttttaaatgtg

SEQ ID NO: 202079 - DNA, 20 bp, Artificial Sequence
  chemically synthesized
aatgtgtggcaacctccccc

SEQ ID NO: 202080 - DNA, 20 bp, Artificial Sequence
  chemically synthesized
ccagagcagaagccaggggg

SEQ ID NO: 202081 - DNA, 20 bp, Artificial Sequence
  chemically synthesized
gccagagcagaagccagggg

SEQ ID NO: 202082 - DNA, 20 bp, Artificial Sequence
  chemically synthesized
tggccagagcagaagccagg

SEQ ID NO: 202083 - DNA, 20 bp, Artificial Sequence
  chemically synthesized
atggccagagcagaagccag

SEQ ID NO: 202084 - DNA, 20 bp, Artificial Sequence
  chemically synthesized
catggccagagcagaagcca

SEQ ID NO: 202085 - DNA, 20 bp, Artificial Sequence
  chemically synthesized
acatggccagagcagaagcc

SEQ ID NO: 202086 - DNA, 20 bp, Artificial Sequence
  chemically synthesized
cacatggccagagcagaagc

SEQ ID NO: 202087 - DNA, 20 bp, Artificial Sequence
  chemically synthesized
cctccccctggcttctgctc

SEQ ID NO: 202088 - DNA, 20 bp, Artificial Sequence
  chemically synthesized
atgtcacatggccagagcag

SEQ ID NO: 202089 - DNA, 20 bp, Artificial Sequence
  chemically synthesized
agcatgtcacatggccagag

SEQ ID NO: 202090 - DNA, 20 bp, Artificial Sequence
  chemically synthesized
gtaagcatgtcacatggcca

SEQ ID NO: 202091 - DNA, 20 bp, Artificial Sequence
  chemically synthesized
gagtaagcatgtcacatggc

SEQ ID NO: 202092 - DNA, 20 bp, Artificial Sequence
  chemically synthesized
acaggagtaagcatgtcaca

SEQ ID NO: 202093 - DNA, 20 bp, Artificial Sequence
  chemically synthesized
gtggaagatgaaacaggagt

SEQ ID NO: 202094 - DNA, 20 bp, Artificial Sequence
  chemically synthesized
catagtggaagatgaaacag

SEQ ID NO: 202095 - DNA, 20 bp, Artificial Sequence
  chemically synthesized
ctcatagtggaagatgaaac

SEQ ID NO: 202096 - DNA, 20 bp, Artificial Sequence
  chemically synthesized
actcatagtggaagatgaaa

SEQ ID NO: 202097 - DNA, 20 bp, Artificial Sequence
  chemically synthesized
cctgtttcatcttccactat

SEQ ID NO: 202098 - DNA, 20 bp, Artificial Sequence
  chemically synthesized
ggagcttttactcatagtgg

SEQ ID NO: 202099 - DNA, 20 bp, Artificial Sequence
  chemically synthesized
ccgggagcttttactcatag

SEQ ID NO: 202100 - DNA, 20 bp, Artificial Sequence
  chemically synthesized
tcatcttccactatgagtaa

SEQ ID NO: 202101 - DNA, 20 bp, Artificial Sequence
  chemically synthesized
cctccgggagcttttactca

SEQ ID NO: 202102 - DNA, 20 bp, Artificial Sequence
  chemically synthesized
ccactatgagtaaaagctcc

SEQ ID NO: 202103 - DNA, 20 bp, Artificial Sequence
  chemically synthesized
actatgagtaaaagctcccg

SEQ ID NO: 202104 - DNA, 20 bp, Artificial Sequence
  chemically synthesized
ctatgagtaaaagctcccgg

SEQ ID NO: 202105 - DNA, 20 bp, Artificial Sequence
  chemically synthesized
gcttctggggaggcctccgg

SEQ ID NO: 202106 - DNA, 20 bp, Artificial Sequence
  chemically synthesized
cagcttctggggaggcctcc

SEQ ID NO: 202107 - DNA, 20 bp, Artificial Sequence
  chemically synthesized
tcagcttctggggaggcctc

SEQ ID NO: 202108 - DNA, 20 bp, Artificial Sequence
  chemically synthesized
aaagctcccggaggcctccc

SEQ ID NO: 202109 - DNA, 20 bp, Artificial Sequence
  chemically synthesized
gctcccggaggcctccccag

SEQ ID NO: 202110 - DNA, 20 bp, Artificial Sequence
  chemically synthesized
catctactcagcttctgggg

SEQ ID NO: 202111 - DNA, 20 bp, Artificial Sequence
  chemically synthesized
gcatctactcagcttctggg

SEQ ID NO: 202112 - DNA, 20 bp, Artificial Sequence
  chemically synthesized
cagcatctactcagcttctg

SEQ ID NO: 202113 - DNA, 20 bp, Artificial Sequence
  chemically synthesized
cggaggcctccccagaagct

SEQ ID NO: 202114 - DNA, 20 bp, Artificial Sequence
  chemically synthesized
ccagcatctactcagcttct

SEQ ID NO: 202115 - DNA, 20 bp, Artificial Sequence
  chemically synthesized
accagcatctactcagcttc

SEQ ID NO: 202116 - DNA, 20 bp, Artificial Sequence
  chemically synthesized
aggcctccccagaagctgag

SEQ ID NO: 202117 - DNA, 20 bp, Artificial Sequence
  chemically synthesized
gcaggacaccagcatctact

SEQ ID NO: 202118 - DNA, 20 bp, Artificial Sequence
  chemically synthesized
cccagaagctgagtagatgc

SEQ ID NO: 202119 - DNA, 20 bp, Artificial Sequence
  chemically synthesized
ttgtacaggaagcaggacac

SEQ ID NO: 202120 - DNA, 20 bp, Artificial Sequence
  chemically synthesized
ctgcaggttgtacaggaagc

SEQ ID NO: 202121 - DNA, 20 bp, Artificial Sequence
  chemically synthesized
tctgcaggttgtacaggaag

SEQ ID NO: 202122 - DNA, 20 bp, Artificial Sequence
  chemically synthesized
gattctgcaggttgtacagg

SEQ ID NO: 202123 - DNA, 20 bp, Artificial Sequence
  chemically synthesized
catgattctgcaggttgtac

SEQ ID NO: 202124 - DNA, 20 bp, Artificial Sequence
  chemically synthesized
tcatgattctgcaggttgta

SEQ ID NO: 202125 - DNA, 20 bp, Artificial Sequence
  chemically synthesized
cctgcttcctgtacaacctg

SEQ ID NO: 202126 - DNA, 20 bp, Artificial Sequence
  chemically synthesized
taatcgattcatgattctgc

SEQ ID NO: 202127 - DNA, 20 bp, Artificial Sequence
  chemically synthesized
ttaatcgattcatgattctg

SEQ ID NO: 202128 - DNA, 20 bp, Artificial Sequence
  chemically synthesized
gcagaatcatgaatcgatta

SEQ ID NO: 202129 - DNA, 20 bp, Artificial Sequence
  chemically synthesized
gggtaatgtatttttaaaaa

SEQ ID NO: 202130 - DNA, 20 bp, Artificial Sequence
  chemically synthesized
ctgggtaatgtatttttaaa

SEQ ID NO: 202131 - DNA, 20 bp, Artificial Sequence
  chemically synthesized
ctttttaaaaatacattacc

SEQ ID NO: 202132 - DNA, 20 bp, Artificial Sequence
  chemically synthesized
aaaaatacattacccagtct

SEQ ID NO: 202133 - DNA, 20 bp, Artificial Sequence
  chemically synthesized
atgaagaaatagccgagact

SEQ ID NO: 202134 - DNA, 20 bp, Artificial Sequence
  chemically synthesized
tatgaagaaatagccgagac

SEQ ID NO: 202135 - DNA, 20 bp, Artificial Sequence
  chemically synthesized
attgctatgaagaaatagcc

SEQ ID NO: 202136 - DNA, 20 bp, Artificial Sequence
  chemically synthesized
catgtattgctatgaagaaa

SEQ ID NO: 202137 - DNA, 20 bp, Artificial Sequence
  chemically synthesized
cagtctcggctatttcttca

SEQ ID NO: 202138 - DNA, 20 bp, Artificial Sequence
  chemically synthesized
tgttagcatgtattgctatg

SEQ ID NO: 202139 - DNA, 20 bp, Artificial Sequence
  chemically synthesized
catagcaatacatgctaaca

SEQ ID NO: 202140 - DNA, 20 bp, Artificial Sequence
  chemically synthesized
cggggagggtgggtctgtgt

SEQ ID NO: 202141 - DNA, 20 bp, Artificial Sequence
  chemically synthesized
caaggacagacggggagggt

SEQ ID NO: 202142 - DNA, 20 bp, Artificial Sequence
  chemically synthesized
tcaaggacagacggggaggg

SEQ ID NO: 202143 - DNA, 20 bp, Artificial Sequence
  chemically synthesized
gtatcaaggacagacgggga

SEQ ID NO: 202144 - DNA, 20 bp, Artificial Sequence
  chemically synthesized
agtatcaaggacagacgggg

SEQ ID NO: 202145 - DNA, 20 bp, Artificial Sequence
  chemically synthesized
gagtatcaaggacagacggg

SEQ ID NO: 202146 - DNA, 20 bp, Artificial Sequence
  chemically synthesized
aagagtatcaaggacagacg

SEQ ID NO: 202147 - DNA, 20 bp, Artificial Sequence
  chemically synthesized
caagagtatcaaggacagac

SEQ ID NO: 202148 - DNA, 20 bp, Artificial Sequence
  chemically synthesized
acaagagtatcaaggacaga

SEQ ID NO: 202149 - DNA, 20 bp, Artificial Sequence
  chemically synthesized
aaaaacaagagtatcaagga

SEQ ID NO: 202150 - DNA, 20 bp, Artificial Sequence
  chemically synthesized
gcagaaaaacaagagtatca

SEQ ID NO: 202151 - DNA, 20 bp, Artificial Sequence
  chemically synthesized
ggcagaaaaacaagagtatc

SEQ ID NO: 202152 - DNA, 20 bp, Artificial Sequence
  chemically synthesized
taaaatcggcagaaaaacaa

SEQ ID NO: 202153 - DNA, 20 bp, Artificial Sequence
  chemically synthesized
aataaaatcggcagaaaaac

SEQ ID NO: 202154 - DNA, 20 bp, Artificial Sequence
  chemically synthesized
tacaataggaataaaatcgg

SEQ ID NO: 202155 - DNA, 20 bp, Artificial Sequence
  chemically synthesized
agatacaataggaataaaat

SEQ ID NO: 202156 - DNA, 20 bp, Artificial Sequence
  chemically synthesized
aaacaaagagtagatacaat

SEQ ID NO: 202157 - DNA, 20 bp, Artificial Sequence
  chemically synthesized
caaacaaagagtagatacaa

SEQ ID NO: 202158 - DNA, 20 bp, Artificial Sequence
  chemically synthesized
tcttaacatcaaacaaagag

SEQ ID NO: 202159 - DNA, 20 bp, Artificial Sequence
  chemically synthesized
ttttcttaacatcaaacaaa

SEQ ID NO: 202160 - DNA, 20 bp, Artificial Sequence
  chemically synthesized
cattttcttaacatcaaaca

SEQ ID NO: 202161 - DNA, 20 bp, Artificial Sequence
  chemically synthesized
tctactctttgtttgatgtt

SEQ ID NO: 202162 - DNA, 20 bp, Artificial Sequence
  chemically synthesized
taatttgaatttttgaagca

SEQ ID NO: 202163 - DNA, 20 bp, Artificial Sequence
  chemically synthesized
gattataatttgaatttttg

SEQ ID NO: 202164 - DNA, 20 bp, Artificial Sequence
  chemically synthesized
aattcaaattataatcctgc

SEQ ID NO: 202165 - DNA, 20 bp, Artificial Sequence
  chemically synthesized
acttatatcaaagagcttgc

SEQ ID NO: 202166 - DNA, 20 bp, Artificial Sequence
  chemically synthesized
cacttatatcaaagagcttg

SEQ ID NO: 202167 - DNA, 20 bp, Artificial Sequence
  chemically synthesized
aattgaacacttatatcaaa

SEQ ID NO: 202168 - DNA, 20 bp, Artificial Sequence
  chemically synthesized
tcctgcaagctctttgatat

SEQ ID NO: 202169 - DNA, 20 bp, Artificial Sequence
  chemically synthesized
taaattgaacacttatatca

SEQ ID NO: 202170 - DNA, 20 bp, Artificial Sequence
  chemically synthesized
agtgttcaatttaaattaaa

SEQ ID NO: 202171 - DNA, 20 bp, Artificial Sequence
  chemically synthesized
gtgttcaatttaaattaaaa

SEQ ID NO: 202172 - DNA, 20 bp, Artificial Sequence
  chemically synthesized
taaaaaggcaaaaccaaaat

SEQ ID NO: 202173 - DNA, 20 bp, Artificial Sequence
  chemically synthesized
tcttatgcttagtcttattt

SEQ ID NO: 202174 - DNA, 20 bp, Artificial Sequence
  chemically synthesized
ggcaaaaccaaaataagact

SEQ ID NO: 202175 - DNA, 20 bp, Artificial Sequence
  chemically synthesized
accaaaataagactaagcat

SEQ ID NO: 202176 - DNA, 20 bp, Artificial Sequence
  chemically synthesized
gtgtattattttcttatgct

SEQ ID NO: 202177 - DNA, 20 bp, Artificial Sequence
  chemically synthesized
gaaaataatacactttccct

SEQ ID NO: 202178 - DNA, 20 bp, Artificial Sequence
  chemically synthesized
tcactctggtaactaaggga

SEQ ID NO: 202179 - DNA, 20 bp, Artificial Sequence
  chemically synthesized
tatatcactctggtaactaa

SEQ ID NO: 202180 - DNA, 20 bp, Artificial Sequence
  chemically synthesized
atacactttcccttagttac

SEQ ID NO: 202181 - DNA, 20 bp, Artificial Sequence
  chemically synthesized
atatatcactctggtaacta

SEQ ID NO: 202182 - DNA, 20 bp, Artificial Sequence
  chemically synthesized
aatatatcactctggtaact

SEQ ID NO: 202183 - DNA, 20 bp, Artificial Sequence
  chemically synthesized
acactttcccttagttacca

SEQ ID NO: 202184 - DNA, 20 bp, Artificial Sequence
  chemically synthesized
aatgttcaaatatatcactc

SEQ ID NO: 202185 - DNA, 20 bp, Artificial Sequence
  chemically synthesized
ttagaaatttgattttttga

SEQ ID NO: 202186 - DNA, 20 bp, Artificial Sequence
  chemically synthesized
attaagtagaggtaacagtt

SEQ ID NO: 202187 - DNA, 20 bp, Artificial Sequence
  chemically synthesized
gtgggattaagtagaggtaa

SEQ ID NO: 202188 - DNA, 20 bp, Artificial Sequence
  chemically synthesized
acctctgtgggattaagtag

SEQ ID NO: 202189 - DNA, 20 bp, Artificial Sequence
  chemically synthesized
cacctctgtgggattaagta

SEQ ID NO: 202190 - DNA, 20 bp, Artificial Sequence
  chemically synthesized
atcacctctgtgggattaag

SEQ ID NO: 202191 - DNA, 20 bp, Artificial Sequence
  chemically synthesized
gttacctctacttaatccca

SEQ ID NO: 202192 - DNA, 20 bp, Artificial Sequence
  chemically synthesized
tttatcacctctgtgggatt

SEQ ID NO: 202193 - DNA, 20 bp, Artificial Sequence
  chemically synthesized
tacctctacttaatcccaca

SEQ ID NO: 202194 - DNA, 20 bp, Artificial Sequence
  chemically synthesized
acctctacttaatcccacag

SEQ ID NO: 202195 - DNA, 20 bp, Artificial Sequence
  chemically synthesized
aataattttatcacctctgt

SEQ ID NO: 202196 - DNA, 20 bp, Artificial Sequence
  chemically synthesized
caataattttatcacctctg

SEQ ID NO: 202197 - DNA, 20 bp, Artificial Sequence
  chemically synthesized
cacagaggtgataaaattat

SEQ ID NO: 202198 - DNA, 20 bp, Artificial Sequence
  chemically synthesized
attggcaattgatgatcatg

SEQ ID NO: 202199 - DNA, 20 bp, Artificial Sequence
  chemically synthesized
gaataaatgaatgaaattgt

SEQ ID NO: 202200 - DNA, 20 bp, Artificial Sequence
  chemically synthesized
ttcattcatttattcattaa

SEQ ID NO: 202201 - DNA, 20 bp, Artificial Sequence
  chemically synthesized
gggatacatacatcaatgag

SEQ ID NO: 202202 - DNA, 20 bp, Artificial Sequence
  chemically synthesized
ttgggatacatacatcaatg

SEQ ID NO: 202203 - DNA, 20 bp, Artificial Sequence
  chemically synthesized
tttgggatacatacatcaat

SEQ ID NO: 202204 - DNA, 20 bp, Artificial Sequence
  chemically synthesized
gagaaggaaaggagacattt

SEQ ID NO: 202205 - DNA, 20 bp, Artificial Sequence
  chemically synthesized
agagaaggaaaggagacatt

SEQ ID NO: 202206 - DNA, 20 bp, Artificial Sequence
  chemically synthesized
cccctttgagagaaggaaag

SEQ ID NO: 202207 - DNA, 20 bp, Artificial Sequence
  chemically synthesized
tgcccctttgagagaaggaa

SEQ ID NO: 202208 - DNA, 20 bp, Artificial Sequence
  chemically synthesized
ttgcccctttgagagaagga

SEQ ID NO: 202209 - DNA, 20 bp, Artificial Sequence
  chemically synthesized
tgtctcctttccttctctca

SEQ ID NO: 202210 - DNA, 20 bp, Artificial Sequence
  chemically synthesized
ttgcttgcccctttgagaga

SEQ ID NO: 202211 - DNA, 20 bp, Artificial Sequence
  chemically synthesized
gtctcctttccttctctcaa

SEQ ID NO: 202212 - DNA, 20 bp, Artificial Sequence
  chemically synthesized
tttgcttgcccctttgagag

SEQ ID NO: 202213 - DNA, 20 bp, Artificial Sequence
  chemically synthesized
tctcctttccttctctcaaa

SEQ ID NO: 202214 - DNA, 20 bp, Artificial Sequence
  chemically synthesized
ctcctttccttctctcaaag

SEQ ID NO: 202215 - DNA, 20 bp, Artificial Sequence
  chemically synthesized
tcctttgcttgcccctttga

SEQ ID NO: 202216 - DNA, 20 bp, Artificial Sequence
  chemically synthesized
tttcctttgcttgccccttt

SEQ ID NO: 202217 - DNA, 20 bp, Artificial Sequence
  chemically synthesized
tttccttctctcaaaggggc

SEQ ID NO: 202218 - DNA, 20 bp, Artificial Sequence
  chemically synthesized
ttctctcaaaggggcaagca

SEQ ID NO: 202219 - DNA, 20 bp, Artificial Sequence
  chemically synthesized
tctctcaaaggggcaagcaa

SEQ ID NO: 202220 - DNA, 20 bp, Artificial Sequence
  chemically synthesized
aaaggggcaagcaaaggaaa

SEQ ID NO: 202221 - DNA, 20 bp, Artificial Sequence
  chemically synthesized
aaaggaaatggaaactgtaa

SEQ ID NO: 202222 - DNA, 20 bp, Artificial Sequence
  chemically synthesized
gtatatggcttttactgtta

SEQ ID NO: 202223 - DNA, 20 bp, Artificial Sequence
  chemically synthesized
aatggaaactgtaacagtaa

SEQ ID NO: 202224 - DNA, 20 bp, Artificial Sequence
  chemically synthesized
aatgtccaccttagagtata

SEQ ID NO: 202225 - DNA, 20 bp, Artificial Sequence
  chemically synthesized
cagtaaaagccatatactct

SEQ ID NO: 202226 - DNA, 20 bp, Artificial Sequence
  chemically synthesized
agtaaaagccatatactcta

SEQ ID NO: 202227 - DNA, 20 bp, Artificial Sequence
  chemically synthesized
aaaagccatatactctaagg

SEQ ID NO: 202228 - DNA, 20 bp, Artificial Sequence
  chemically synthesized
actttctaatgtccacctta

SEQ ID NO: 202229 - DNA, 20 bp, Artificial Sequence
  chemically synthesized
agactttctaatgtccacct

SEQ ID NO: 202230 - DNA, 20 bp, Artificial Sequence
  chemically synthesized
atatactctaaggtggacat

SEQ ID NO: 202231 - DNA, 20 bp, Artificial Sequence
  chemically synthesized
actctaaggtggacattaga

SEQ ID NO: 202232 - DNA, 20 bp, Artificial Sequence
  chemically synthesized
gtggacattagaaagtctct

SEQ ID NO: 202233 - DNA, 20 bp, Artificial Sequence
  chemically synthesized
aaaaacgacctgtagaccaa

SEQ ID NO: 202234 - DNA, 20 bp, Artificial Sequence
  chemically synthesized
ttagaaagtctcttggtcta

SEQ ID NO: 202235 - DNA, 20 bp, Artificial Sequence
  chemically synthesized
tagaaagtctcttggtctac

SEQ ID NO: 202236 - DNA, 20 bp, Artificial Sequence
  chemically synthesized
ttaaaaacgacctgtagacc

SEQ ID NO: 202237 - DNA, 20 bp, Artificial Sequence
  chemically synthesized
ttaggattaaaaacgacctg

SEQ ID NO: 202238 - DNA, 20 bp, Artificial Sequence
  chemically synthesized
acaggtcgtttttaatccta

SEQ ID NO: 202239 - DNA, 20 bp, Artificial Sequence
  chemically synthesized
gtcgtttttaatcctaaaga

SEQ ID NO: 202240 - DNA, 20 bp, Artificial Sequence
  chemically synthesized
aggtagattattctgtcttt

SEQ ID NO: 202241 - DNA, 20 bp, Artificial Sequence
  chemically synthesized
taggtagattattctgtctt

SEQ ID NO: 202242 - DNA, 20 bp, Artificial Sequence
  chemically synthesized
gacagaataatctacctata

SEQ ID NO: 202243 - DNA, 20 bp, Artificial Sequence
  chemically synthesized
tttaatgatttctatatagg

SEQ ID NO: 202244 - DNA, 20 bp, Artificial Sequence
  chemically synthesized
ttgtttaatgatttctatat

SEQ ID NO: 202245 - DNA, 20 bp, Artificial Sequence
  chemically synthesized
tttgtttaatgatttctata

SEQ ID NO: 202246 - DNA, 20 bp, Artificial Sequence
  chemically synthesized
tatagaaatcattaaacaaa

SEQ ID NO: 202247 - DNA, 20 bp, Artificial Sequence
  chemically synthesized
tagaaattttgccttataaa

SEQ ID NO: 202248 - DNA, 20 bp, Artificial Sequence
  chemically synthesized
gtattttcctactatttata

SEQ ID NO: 202249 - DNA, 20 bp, Artificial Sequence
  chemically synthesized
tgtattttcctactatttat

SEQ ID NO: 202250 - DNA, 20 bp, Artificial Sequence
  chemically synthesized
aaattttgccttataaatag

SEQ ID NO: 202251 - DNA, 20 bp, Artificial Sequence
  chemically synthesized
aattttgccttataaatagt

SEQ ID NO: 202252 - DNA, 20 bp, Artificial Sequence
  chemically synthesized
aaaatacatacctacattta

SEQ ID NO: 202253 - DNA, 20 bp, Artificial Sequence
  chemically synthesized
ggttttcaggccataaatgt

SEQ ID NO: 202254 - DNA, 20 bp, Artificial Sequence
  chemically synthesized
tggttttcaggccataaatg

SEQ ID NO: 202255 - DNA, 20 bp, Artificial Sequence
  chemically synthesized
tacatttatggcctgaaaac

SEQ ID NO: 202256 - DNA, 20 bp, Artificial Sequence
  chemically synthesized
catagctgatgctggttttc

SEQ ID NO: 202257 - DNA, 20 bp, Artificial Sequence
  chemically synthesized
acatagctgatgctggtttt

SEQ ID NO: 202258 - DNA, 20 bp, Artificial Sequence
  chemically synthesized
tatggcctgaaaaccagcat

SEQ ID NO: 202259 - DNA, 20 bp, Artificial Sequence
  chemically synthesized
aactataacatagctgatgc

SEQ ID NO: 202260 - DNA, 20 bp, Artificial Sequence
  chemically synthesized
aaccagcatcagctatgtta

SEQ ID NO: 202261 - DNA, 20 bp, Artificial Sequence
  chemically synthesized
ctatgtggacaactataaca

SEQ ID NO: 202262 - DNA, 20 bp, Artificial Sequence
  chemically synthesized
ctatgttatagttgtccaca

SEQ ID NO: 202263 - DNA, 20 bp, Artificial Sequence
  chemically synthesized
tacattatattagttctatg

SEQ ID NO: 202264 - DNA, 20 bp, Artificial Sequence
  chemically synthesized
ttctacccagtacattatat

SEQ ID NO: 202265 - DNA, 20 bp, Artificial Sequence
  chemically synthesized
atagaactaatataatgtac

SEQ ID NO: 202266 - DNA, 20 bp, Artificial Sequence
  chemically synthesized
tagaactaatataatgtact

SEQ ID NO: 202267 - DNA, 20 bp, Artificial Sequence
  chemically synthesized
aactaatataatgtactggg

SEQ ID NO: 202268 - DNA, 20 bp, Artificial Sequence
  chemically synthesized
aatataatgtactgggtaga

SEQ ID NO: 202269 - DNA, 20 bp, Artificial Sequence
  chemically synthesized
aaaaatggtcactttctacc

SEQ ID NO: 202270 - DNA, 20 bp, Artificial Sequence
  chemically synthesized
agggtcaaaatggagaaaaa

SEQ ID NO: 202271 - DNA, 20 bp, Artificial Sequence
  chemically synthesized
tgatgacaagggtcaaaatg

SEQ ID NO: 202272 - DNA, 20 bp, Artificial Sequence
  chemically synthesized
agtgatgacaagggtcaaaa

SEQ ID NO: 202273 - DNA, 20 bp, Artificial Sequence
  chemically synthesized
tgttcttccagtgatgacaa

SEQ ID NO: 202274 - DNA, 20 bp, Artificial Sequence
  chemically synthesized
atgttcttccagtgatgaca

SEQ ID NO: 202275 - DNA, 20 bp, Artificial Sequence
  chemically synthesized
catgttcttccagtgatgac

SEQ ID NO: 202276 - DNA, 20 bp, Artificial Sequence
  chemically synthesized
attttgacccttgtcatcac

SEQ ID NO: 202277 - DNA, 20 bp, Artificial Sequence
  chemically synthesized
ttgacccttgtcatcactgg

SEQ ID NO: 202278 - DNA, 20 bp, Artificial Sequence
  chemically synthesized
taatggaatccatgttcttc

SEQ ID NO: 202279 - DNA, 20 bp, Artificial Sequence
  chemically synthesized
ttgtcatcactggaagaaca

SEQ ID NO: 202280 - DNA, 20 bp, Artificial Sequence
  chemically synthesized
ggaagaacatggattccatt

SEQ ID NO: 202281 - DNA, 20 bp, Artificial Sequence
  chemically synthesized
gaagaacatggattccatta

SEQ ID NO: 202282 - DNA, 20 bp, Artificial Sequence
  chemically synthesized
aatgaatgtgggaaccttaa

SEQ ID NO: 202283 - DNA, 20 bp, Artificial Sequence
  chemically synthesized
aggagaagggtaatgaatgt

SEQ ID NO: 202284 - DNA, 20 bp, Artificial Sequence
  chemically synthesized
gaggagaagggtaatgaatg

SEQ ID NO: 202285 - DNA, 20 bp, Artificial Sequence
  chemically synthesized
gcatttctgtgtgaggagaa

SEQ ID NO: 202286 - DNA, 20 bp, Artificial Sequence
  chemically synthesized
tgcatttctgtgtgaggaga

SEQ ID NO: 202287 - DNA, 20 bp, Artificial Sequence
  chemically synthesized
ttgcatttctgtgtgaggag

SEQ ID NO: 202288 - DNA, 20 bp, Artificial Sequence
  chemically synthesized
tcattacccttctcctcaca

SEQ ID NO: 202289 - DNA, 20 bp, Artificial Sequence
  chemically synthesized
tgtttgcatttctgtgtgag

SEQ ID NO: 202290 - DNA, 20 bp, Artificial Sequence
  chemically synthesized
aatgtttgcatttctgtgtg

SEQ ID NO: 202291 - DNA, 20 bp, Artificial Sequence
  chemically synthesized
caatgtttgcatttctgtgt

SEQ ID NO: 202292 - DNA, 20 bp, Artificial Sequence
  chemically synthesized
acagaaatgcaaacattgaa

SEQ ID NO: 202293 - DNA, 20 bp, Artificial Sequence
  chemically synthesized
aacattgaaaagtttcttcg

SEQ ID NO: 202294 - DNA, 20 bp, Artificial Sequence
  chemically synthesized
cattgaaaagtttcttcgtg

SEQ ID NO: 202295 - DNA, 20 bp, Artificial Sequence
  chemically synthesized
ttgaaaagtttcttcgtgga

SEQ ID NO: 202296 - DNA, 20 bp, Artificial Sequence
  chemically synthesized
acaaaatagaactctccacg

SEQ ID NO: 202297 - DNA, 20 bp, Artificial Sequence
  chemically synthesized
gcaaaaagaacaaaacaaaa

SEQ ID NO: 202298 - DNA, 20 bp, Artificial Sequence
  chemically synthesized
tattgaacttttaatgcaaa

SEQ ID NO: 202299 - DNA, 20 bp, Artificial Sequence
  chemically synthesized
ttttgttctttttgcattaa

SEQ ID NO: 202300 - DNA, 20 bp, Artificial Sequence
  chemically synthesized
aagttcaatactatttattc

SEQ ID NO: 202301 - DNA, 20 bp, Artificial Sequence
  chemically synthesized
gcttgataaacttgaataaa

SEQ ID NO: 202302 - DNA, 20 bp, Artificial Sequence
  chemically synthesized
actatttattcaagtttatc

SEQ ID NO: 202303 - DNA, 20 bp, Artificial Sequence
  chemically synthesized
taataggccatttgttcatt

SEQ ID NO: 202304 - DNA, 20 bp, Artificial Sequence
  chemically synthesized
tatcaagctgaatgaacaaa

SEQ ID NO: 202305 - DNA, 20 bp, Artificial Sequence
  chemically synthesized
atatgaaatgcaattataat

SEQ ID NO: 202306 - DNA, 20 bp, Artificial Sequence
  chemically synthesized
aatatgaaatgcaattataa

SEQ ID NO: 202307 - DNA, 20 bp, Artificial Sequence
  chemically synthesized
tataattgcatttcatattt

SEQ ID NO: 202308 - DNA, 20 bp, Artificial Sequence
  chemically synthesized
ataattgcatttcatatttt

SEQ ID NO: 202309 - DNA, 20 bp, Artificial Sequence
  chemically synthesized
acgtagatttcgaaatttaa

SEQ ID NO: 202310 - DNA, 20 bp, Artificial Sequence
  chemically synthesized
aacgtagatttcgaaattta

SEQ ID NO: 202311 - DNA, 20 bp, Artificial Sequence
  chemically synthesized
aaacgtagatttcgaaattt

SEQ ID NO: 202312 - DNA, 20 bp, Artificial Sequence
  chemically synthesized
taactttctctttggaaacg

SEQ ID NO: 202313 - DNA, 20 bp, Artificial Sequence
  chemically synthesized
tttcgaaatctacgtttcca

SEQ ID NO: 202314 - DNA, 20 bp, Artificial Sequence
  chemically synthesized
tcgaaatctacgtttccaaa

SEQ ID NO: 202315 - DNA, 20 bp, Artificial Sequence
  chemically synthesized
aatctacgtttccaaagaga

SEQ ID NO: 202316 - DNA, 20 bp, Artificial Sequence
  chemically synthesized
cctgtttttaactttctctt

SEQ ID NO: 202317 - DNA, 20 bp, Artificial Sequence
  chemically synthesized
tccaaagagaaagttaaaaa

SEQ ID NO: 202318 - DNA, 20 bp, Artificial Sequence
  chemically synthesized
ccaaagagaaagttaaaaac

SEQ ID NO: 202319 - DNA, 20 bp, Artificial Sequence
  chemically synthesized
caaagagaaagttaaaaaca

SEQ ID NO: 202320 - DNA, 20 bp, Artificial Sequence
  chemically synthesized
aaagagaaagttaaaaacag

SEQ ID NO: 202321 - DNA, 20 bp, Artificial Sequence
  chemically synthesized
aagctcatcaaataatttag

SEQ ID NO: 202322 - DNA, 20 bp, Artificial Sequence
  chemically synthesized
atgaagctcatcaaataatt

SEQ ID NO: 202323 - DNA, 20 bp, Artificial Sequence
  chemically synthesized
atgctgctaaattatttgat

SEQ ID NO: 202324 - DNA, 20 bp, Artificial Sequence
  chemically synthesized
atgagagcatcacaaatatg

SEQ ID NO: 202325 - DNA, 20 bp, Artificial Sequence
  chemically synthesized
tatttgtgatgctctcattt

SEQ ID NO: 202326 - DNA, 20 bp, Artificial Sequence
  chemically synthesized
ccttaatgtaactaaaatga

SEQ ID NO: 202327 - DNA, 20 bp, Artificial Sequence
  chemically synthesized
tgccttaatgtaactaaaat

SEQ ID NO: 202328 - DNA, 20 bp, Artificial Sequence
  chemically synthesized
gctctcattttagttacatt

SEQ ID NO: 202329 - DNA, 20 bp, Artificial Sequence
  chemically synthesized
ctctcattttagttacatta

SEQ ID NO: 202330 - DNA, 20 bp, Artificial Sequence
  chemically synthesized
tttagttacattaaggcaaa

SEQ ID NO: 202331 - DNA, 20 bp, Artificial Sequence
  chemically synthesized
caagccttgggattttattt

SEQ ID NO: 202332 - DNA, 20 bp, Artificial Sequence
  chemically synthesized
aaaagccaaaataaaatccc

SEQ ID NO: 202333 - DNA, 20 bp, Artificial Sequence
  chemically synthesized
aaagccaaaataaaatccca

SEQ ID NO: 202334 - DNA, 20 bp, Artificial Sequence
  chemically synthesized
caaaataaaatcccaaggct

SEQ ID NO: 202335 - DNA, 20 bp, Artificial Sequence
  chemically synthesized
tgtttcaaactccaagcctt

SEQ ID NO: 202336 - DNA, 20 bp, Artificial Sequence
  chemically synthesized
aaataaaatcccaaggcttg

SEQ ID NO: 202337 - DNA, 20 bp, Artificial Sequence
  chemically synthesized
ttgtttcaaactccaagcct

SEQ ID NO: 202338 - DNA, 20 bp, Artificial Sequence
  chemically synthesized
caccacttgtttcaaactcc

SEQ ID NO: 202339 - DNA, 20 bp, Artificial Sequence
  chemically synthesized
caaggcttggagtttgaaac

SEQ ID NO: 202340 - DNA, 20 bp, Artificial Sequence
  chemically synthesized
ggcttggagtttgaaacaag

SEQ ID NO: 202341 - DNA, 20 bp, Artificial Sequence
  chemically synthesized
gagtttgaaacaagtggtga

SEQ ID NO: 202342 - DNA, 20 bp, Artificial Sequence
  chemically synthesized
agtttgaaacaagtggtgaa

SEQ ID NO: 202343 - DNA, 20 bp, Artificial Sequence
  chemically synthesized
gtttgaaacaagtggtgaaa

SEQ ID NO: 202344 - DNA, 20 bp, Artificial Sequence
  chemically synthesized
tgaaacaagtggtgaaaggg

SEQ ID NO: 202345 - DNA, 20 bp, Artificial Sequence
  chemically synthesized
gaaacaagtggtgaaaggga

SEQ ID NO: 202346 - DNA, 20 bp, Artificial Sequence
  chemically synthesized
aaacaagtggtgaaagggaa

SEQ ID NO: 202347 - DNA, 20 bp, Artificial Sequence
  chemically synthesized
acaagtggtgaaagggaagg

SEQ ID NO: 202348 - DNA, 20 bp, Artificial Sequence
  chemically synthesized
aaagggaagggagcattgat

SEQ ID NO: 202349 - DNA, 20 bp, Artificial Sequence
  chemically synthesized
agggaagggagcattgataa

SEQ ID NO: 202350 - DNA, 20 bp, Artificial Sequence
  chemically synthesized
ggaagggagcattgataaga

SEQ ID NO: 202351 - DNA, 20 bp, Artificial Sequence
  chemically synthesized
gaagggagcattgataagag

SEQ ID NO: 202352 - DNA, 20 bp, Artificial Sequence
  chemically synthesized
gggagcattgataagagagg

SEQ ID NO: 202353 - DNA, 20 bp, Artificial Sequence
  chemically synthesized
ggagcattgataagagaggc

SEQ ID NO: 202354 - DNA, 20 bp, Artificial Sequence
  chemically synthesized
cattgataagagaggcagga

SEQ ID NO: 202355 - DNA, 20 bp, Artificial Sequence
  chemically synthesized
gataagagaggcaggaaaga

SEQ ID NO: 202356 - DNA, 20 bp, Artificial Sequence
  chemically synthesized
ggcaggaaagatagatttaa

SEQ ID NO: 202357 - DNA, 20 bp, Artificial Sequence
  chemically synthesized
ttttgttttaaataatgctt

SEQ ID NO: 202358 - DNA, 20 bp, Artificial Sequence
  chemically synthesized
tgttttaaataatgcttaag

SEQ ID NO: 202359 - DNA, 20 bp, Artificial Sequence
  chemically synthesized
taaacataatttttcttctt

SEQ ID NO: 202360 - DNA, 20 bp, Artificial Sequence
  chemically synthesized
aaaattatgtttattacact

SEQ ID NO: 202361 - DNA, 20 bp, Artificial Sequence
  chemically synthesized
cttccacagggaaataaact

SEQ ID NO: 202362 - DNA, 20 bp, Artificial Sequence
  chemically synthesized
acactcagtttatttccctg

SEQ ID NO: 202363 - DNA, 20 bp, Artificial Sequence
  chemically synthesized
ctcagtttatttccctgtgg

SEQ ID NO: 202364 - DNA, 20 bp, Artificial Sequence
  chemically synthesized
gaaaaggttgttcttccaca

SEQ ID NO: 202365 - DNA, 20 bp, Artificial Sequence
  chemically synthesized
ggaaaaggttgttcttccac

SEQ ID NO: 202366 - DNA, 20 bp, Artificial Sequence
  chemically synthesized
aggaaaaggttgttcttcca

SEQ ID NO: 202367 - DNA, 20 bp, Artificial Sequence
  chemically synthesized
tccagactgaggagaggaaa

SEQ ID NO: 202368 - DNA, 20 bp, Artificial Sequence
  chemically synthesized
ttccagactgaggagaggaa

SEQ ID NO: 202369 - DNA, 20 bp, Artificial Sequence
  chemically synthesized
gaacaaccttttcctctcct

SEQ ID NO: 202370 - DNA, 20 bp, Artificial Sequence
  chemically synthesized
atgagttccagactgaggag

SEQ ID NO: 202371 - DNA, 20 bp, Artificial Sequence
  chemically synthesized
tatgagttccagactgagga

SEQ ID NO: 202372 - DNA, 20 bp, Artificial Sequence
  chemically synthesized
accttttcctctcctcagtc

SEQ ID NO: 202373 - DNA, 20 bp, Artificial Sequence
  chemically synthesized
agtatgagttccagactgag

SEQ ID NO: 202374 - DNA, 20 bp, Artificial Sequence
  chemically synthesized
agagtatgagttccagactg

SEQ ID NO: 202375 - DNA, 20 bp, Artificial Sequence
  chemically synthesized
aagagtatgagttccagact

SEQ ID NO: 202376 - DNA, 20 bp, Artificial Sequence
  chemically synthesized
gtggcaaagagtatgagttc

SEQ ID NO: 202377 - DNA, 20 bp, Artificial Sequence
  chemically synthesized
ggtcatgtggcaaagagtat

SEQ ID NO: 202378 - DNA, 20 bp, Artificial Sequence
  chemically synthesized
cccacaggtcatgtggcaaa

SEQ ID NO: 202379 - DNA, 20 bp, Artificial Sequence
  chemically synthesized
ttcccacaggtcatgtggca

SEQ ID NO: 202380 - DNA, 20 bp, Artificial Sequence
  chemically synthesized
tcaatttcccacaggtcatg

SEQ ID NO: 202381 - DNA, 20 bp, Artificial Sequence
  chemically synthesized
actctttgccacatgacctg

SEQ ID NO: 202382 - DNA, 20 bp, Artificial Sequence
  chemically synthesized
ctctttgccacatgacctgt

SEQ ID NO: 202383 - DNA, 20 bp, Artificial Sequence
  chemically synthesized
tgttcaagtcaatttcccac

SEQ ID NO: 202384 - DNA, 20 bp, Artificial Sequence
  chemically synthesized
ctgttcaagtcaatttccca

SEQ ID NO: 202385 - DNA, 20 bp, Artificial Sequence
  chemically synthesized
ctgtgggaaattgacttgaa

SEQ ID NO: 202386 - DNA, 20 bp, Artificial Sequence
  chemically synthesized
tgaaaccaaaacatctgttc

SEQ ID NO: 202387 - DNA, 20 bp, Artificial Sequence
  chemically synthesized
attgacttgaacagatgttt

SEQ ID NO: 202388 - DNA, 20 bp, Artificial Sequence
  chemically synthesized
gaattacgcaaaataatttg

SEQ ID NO: 202389 - DNA, 20 bp, Artificial Sequence
  chemically synthesized
aattattttgcgtaattccc

SEQ ID NO: 202390 - DNA, 20 bp, Artificial Sequence
  chemically synthesized
attatagtagatgggcacta

SEQ ID NO: 202391 - DNA, 20 bp, Artificial Sequence
  chemically synthesized
aattatagtagatgggcact

SEQ ID NO: 202392 - DNA, 20 bp, Artificial Sequence
  chemically synthesized
aaattatagtagatgggcac

SEQ ID NO: 202393 - DNA, 20 bp, Artificial Sequence
  chemically synthesized
tcataaaaattatagtagat

SEQ ID NO: 202394 - DNA, 20 bp, Artificial Sequence
  chemically synthesized
atcataaaaattatagtaga

SEQ ID NO: 202395 - DNA, 20 bp, Artificial Sequence
  chemically synthesized
agacatcataaaaattatag

SEQ ID NO: 202396 - DNA, 20 bp, Artificial Sequence
  chemically synthesized
tagagacatcataaaaatta

SEQ ID NO: 202397 - DNA, 20 bp, Artificial Sequence
  chemically synthesized
tatgtaaaaaacaaagagta

SEQ ID NO: 202398 - DNA, 20 bp, Artificial Sequence
  chemically synthesized
agtatgtaaaaaacaaagag

SEQ ID NO: 202399 - DNA, 20 bp, Artificial Sequence
  chemically synthesized
catagtatgtaaaaaacaaa

SEQ ID NO: 202400 - DNA, 20 bp, Artificial Sequence
  chemically synthesized
gtcatagtatgtaaaaaaca

SEQ ID NO: 202401 - DNA, 20 bp, Artificial Sequence
  chemically synthesized
ttttttacatactatgacaa

SEQ ID NO: 202402 - DNA, 20 bp, Artificial Sequence
  chemically synthesized
gtcttatgactcttttgtca

SEQ ID NO: 202403 - DNA, 20 bp, Artificial Sequence
  chemically synthesized
ttttacatactatgacaaaa

SEQ ID NO: 202404 - DNA, 20 bp, Artificial Sequence
  chemically synthesized
tactatgacaaaagagtcat

SEQ ID NO: 202405 - DNA, 20 bp, Artificial Sequence
  chemically synthesized
gacaaaagagtcataagaca

SEQ ID NO: 202406 - DNA, 20 bp, Artificial Sequence
  chemically synthesized
gagtcataagacatagtgcc

SEQ ID NO: 202407 - DNA, 20 bp, Artificial Sequence
  chemically synthesized
cataagacatagtgcctagt

SEQ ID NO: 202408 - DNA, 20 bp, Artificial Sequence
  chemically synthesized
cagtgagccaattactgact

SEQ ID NO: 202409 - DNA, 20 bp, Artificial Sequence
  chemically synthesized
tcagtgagccaattactgac

SEQ ID NO: 202410 - DNA, 20 bp, Artificial Sequence
  chemically synthesized
catagtgcctagtcagtaat

SEQ ID NO: 202411 - DNA, 20 bp, Artificial Sequence
  chemically synthesized
taaactctaagcatttcagt

SEQ ID NO: 202412 - DNA, 20 bp, Artificial Sequence
  chemically synthesized
aattggctcactgaaatgct

SEQ ID NO: 202413 - DNA, 20 bp, Artificial Sequence
  chemically synthesized
tatataaactctaagcattt

SEQ ID NO: 202414 - DNA, 20 bp, Artificial Sequence
  chemically synthesized
ttggctcactgaaatgctta

SEQ ID NO: 202415 - DNA, 20 bp, Artificial Sequence
  chemically synthesized
cttacaaatatataaactct

SEQ ID NO: 202416 - DNA, 20 bp, Artificial Sequence
  chemically synthesized
cttagagtttatatatttgt

SEQ ID NO: 202417 - DNA, 20 bp, Artificial Sequence
  chemically synthesized
ttcctgcttgaaattttgtg

SEQ ID NO: 202418 - DNA, 20 bp, Artificial Sequence
  chemically synthesized
gtaagaccacacaaaatttc

SEQ ID NO: 202419 - DNA, 20 bp, Artificial Sequence
  chemically synthesized
agaccacacaaaatttcaag

SEQ ID NO: 202420 - DNA, 20 bp, Artificial Sequence
  chemically synthesized
gaccacacaaaatttcaagc

SEQ ID NO: 202421 - DNA, 20 bp, Artificial Sequence
  chemically synthesized
aatttcaagcaggaaccttt

SEQ ID NO: 202422 - DNA, 20 bp, Artificial Sequence
  chemically synthesized
taaagattgtgataactgaa

SEQ ID NO: 202423 - DNA, 20 bp, Artificial Sequence
  chemically synthesized
ataaagattgtgataactga

SEQ ID NO: 202424 - DNA, 20 bp, Artificial Sequence
  chemically synthesized
atttcaagagagtattaata

SEQ ID NO: 202425 - DNA, 20 bp, Artificial Sequence
  chemically synthesized
aaaaagtgtcaatttcaaga

SEQ ID NO: 202426 - DNA, 20 bp, Artificial Sequence
  chemically synthesized
ctaaaaagtgtcaatttcaa

SEQ ID NO: 202427 - DNA, 20 bp, Artificial Sequence
  chemically synthesized
gcctaaaaagtgtcaatttc

SEQ ID NO: 202428 - DNA, 20 bp, Artificial Sequence
  chemically synthesized
ctcttgaaattgacactttt

SEQ ID NO: 202429 - DNA, 20 bp, Artificial Sequence
  chemically synthesized
tcttgaaattgacacttttt

SEQ ID NO: 202430 - DNA, 20 bp, Artificial Sequence
  chemically synthesized
tttggcatatgaagcctaaa

SEQ ID NO: 202431 - DNA, 20 bp, Artificial Sequence
  chemically synthesized
ctcatgttttttggcatatg

SEQ ID NO: 202432 - DNA, 20 bp, Artificial Sequence
  chemically synthesized
attattactctcatgttttt

SEQ ID NO: 202433 - DNA, 20 bp, Artificial Sequence
  chemically synthesized
cttcatatgccaaaaaacat

SEQ ID NO: 202434 - DNA, 20 bp, Artificial Sequence
  chemically synthesized
tcatatgccaaaaaacatga

SEQ ID NO: 202435 - DNA, 20 bp, Artificial Sequence
  chemically synthesized
taataattgaccttatgctt

SEQ ID NO: 202436 - DNA, 20 bp, Artificial Sequence
  chemically synthesized
gaaacatgtcctaaagcata

SEQ ID NO: 202437 - DNA, 20 bp, Artificial Sequence
  chemically synthesized
aataattgaccttatgcttt

SEQ ID NO: 202438 - DNA, 20 bp, Artificial Sequence
  chemically synthesized
agaaacatgtcctaaagcat

SEQ ID NO: 202439 - DNA, 20 bp, Artificial Sequence
  chemically synthesized
ttaagaagaaacatgtccta

SEQ ID NO: 202440 - DNA, 20 bp, Artificial Sequence
  chemically synthesized
taaaataagaagtatttaag

SEQ ID NO: 202441 - DNA, 20 bp, Artificial Sequence
  chemically synthesized
tattaaaataagaagtattt

SEQ ID NO: 202442 - DNA, 20 bp, Artificial Sequence
  chemically synthesized
gttactaatattaaaataag

SEQ ID NO: 202443 - DNA, 20 bp, Artificial Sequence
  chemically synthesized
attgttactaatattaaaat

SEQ ID NO: 202444 - DNA, 20 bp, Artificial Sequence
  chemically synthesized
aatacttcttattttaatat

SEQ ID NO: 202445 - DNA, 20 bp, Artificial Sequence
  chemically synthesized
accatagatattattagtag

SEQ ID NO: 202446 - DNA, 20 bp, Artificial Sequence
  chemically synthesized
tgaaccatagatattattag

SEQ ID NO: 202447 - DNA, 20 bp, Artificial Sequence
  chemically synthesized
caatgaaccatagatattat

SEQ ID NO: 202448 - DNA, 20 bp, Artificial Sequence
  chemically synthesized
tctactactaataatatcta

SEQ ID NO: 202449 - DNA, 20 bp, Artificial Sequence
  chemically synthesized
gactagcattcaatgaacca

SEQ ID NO: 202450 - DNA, 20 bp, Artificial Sequence
  chemically synthesized
atctatggttcattgaatgc

SEQ ID NO: 202451 - DNA, 20 bp, Artificial Sequence
  chemically synthesized
tcattgaatgctagtctaca

SEQ ID NO: 202452 - DNA, 20 bp, Artificial Sequence
  chemically synthesized
atctatgcacctatgtagac

SEQ ID NO: 202453 - DNA, 20 bp, Artificial Sequence
  chemically synthesized
cattgaatgctagtctacat

SEQ ID NO: 202454 - DNA, 20 bp, Artificial Sequence
  chemically synthesized
caggtatctatgcacctatg

SEQ ID NO: 202455 - DNA, 20 bp, Artificial Sequence
  chemically synthesized
tgctagtctacataggtgca

SEQ ID NO: 202456 - DNA, 20 bp, Artificial Sequence
  chemically synthesized
tacataggtgcatagatacc

SEQ ID NO: 202457 - DNA, 20 bp, Artificial Sequence
  chemically synthesized
ggtgcatagatacctggata

SEQ ID NO: 202458 - DNA, 20 bp, Artificial Sequence
  chemically synthesized
tctatttatcatctatatcc

SEQ ID NO: 202459 - DNA, 20 bp, Artificial Sequence
  chemically synthesized
atctatttatcatctatatc

SEQ ID NO: 202460 - DNA, 20 bp, Artificial Sequence
  chemically synthesized
acctggatatagatgataaa

SEQ ID NO: 202461 - DNA, 20 bp, Artificial Sequence
  chemically synthesized
tatagatgataaatagatga

SEQ ID NO: 202462 - DNA, 20 bp, Artificial Sequence
  chemically synthesized
tagatgataaatagatgaca

SEQ ID NO: 202463 - DNA, 20 bp, Artificial Sequence
  chemically synthesized
tgataaatagatgacagaga

SEQ ID NO: 202464 - DNA, 20 bp, Artificial Sequence
  chemically synthesized
ataaatagatgacagagaaa

SEQ ID NO: 202465 - DNA, 20 bp, Artificial Sequence
  chemically synthesized
atagatgacagagaaagaga

SEQ ID NO: 202466 - DNA, 20 bp, Artificial Sequence
  chemically synthesized
atgacagagaaagagaaaga

SEQ ID NO: 202467 - DNA, 20 bp, Artificial Sequence
  chemically synthesized
gagaaagagaaagatagaaa

SEQ ID NO: 202468 - DNA, 20 bp, Artificial Sequence
  chemically synthesized
gaaagagaaagatagaaaca

SEQ ID NO: 202469 - DNA, 20 bp, Artificial Sequence
  chemically synthesized
gagataatgtatttcattca

SEQ ID NO: 202470 - DNA, 20 bp, Artificial Sequence
  chemically synthesized
aggtggttattaggatggga

SEQ ID NO: 202471 - DNA, 20 bp, Artificial Sequence
  chemically synthesized
gaaggtggttattaggatgg

SEQ ID NO: 202472 - DNA, 20 bp, Artificial Sequence
  chemically synthesized
tggaaggtggttattaggat

SEQ ID NO: 202473 - DNA, 20 bp, Artificial Sequence
  chemically synthesized
ttggaaggtggttattagga

SEQ ID NO: 202474 - DNA, 20 bp, Artificial Sequence
  chemically synthesized
tatcttggaaggtggttatt

SEQ ID NO: 202475 - DNA, 20 bp, Artificial Sequence
  chemically synthesized
ttatcttggaaggtggttat

SEQ ID NO: 202476 - DNA, 20 bp, Artificial Sequence
  chemically synthesized
catcctaataaccaccttcc

SEQ ID NO: 202477 - DNA, 20 bp, Artificial Sequence
  chemically synthesized
tgtgaacttatcttggaagg

SEQ ID NO: 202478 - DNA, 20 bp, Artificial Sequence
  chemically synthesized
agatgtgaacttatcttgga

SEQ ID NO: 202479 - DNA, 20 bp, Artificial Sequence
  chemically synthesized
taataaccaccttccaagat

SEQ ID NO: 202480 - DNA, 20 bp, Artificial Sequence
  chemically synthesized
aagatgtgaacttatcttgg

SEQ ID NO: 202481 - DNA, 20 bp, Artificial Sequence
  chemically synthesized
aataagatgtgaacttatct

SEQ ID NO: 202482 - DNA, 20 bp, Artificial Sequence
  chemically synthesized
ataagttcacatcttattat

SEQ ID NO: 202483 - DNA, 20 bp, Artificial Sequence
  chemically synthesized
aagttcacatcttattatta

SEQ ID NO: 202484 - DNA, 20 bp, Artificial Sequence
  chemically synthesized
atcttctcatctctaataat

SEQ ID NO: 202485 - DNA, 20 bp, Artificial Sequence
  chemically synthesized
cacatcttattattagagat

SEQ ID NO: 202486 - DNA, 20 bp, Artificial Sequence
  chemically synthesized
atcttattattagagatgag

SEQ ID NO: 202487 - DNA, 20 bp, Artificial Sequence
  chemically synthesized
ttattagagatgagaagatt

SEQ ID NO: 202488 - DNA, 20 bp, Artificial Sequence
  chemically synthesized
agaagatttagttttaacaa

SEQ ID NO: 202489 - DNA, 20 bp, Artificial Sequence
  chemically synthesized
acacctgtgtatttcaagtt

SEQ ID NO: 202490 - DNA, 20 bp, Artificial Sequence
  chemically synthesized
tttacacacctgtgtatttc

SEQ ID NO: 202491 - DNA, 20 bp, Artificial Sequence
  chemically synthesized
ttgactgaacttgaaataca

SEQ ID NO: 202492 - DNA, 20 bp, Artificial Sequence
  chemically synthesized
tgactgaacttgaaatacac

SEQ ID NO: 202493 - DNA, 20 bp, Artificial Sequence
  chemically synthesized
taattatctgcaaagatttt

SEQ ID NO: 202494 - DNA, 20 bp, Artificial Sequence
  chemically synthesized
ctaattatctgcaaagattt

SEQ ID NO: 202495 - DNA, 20 bp, Artificial Sequence
  chemically synthesized
aaacattcctaaaatctttg

SEQ ID NO: 202496 - DNA, 20 bp, Artificial Sequence
  chemically synthesized
actctttctaattatctgca

SEQ ID NO: 202497 - DNA, 20 bp, Artificial Sequence
  chemically synthesized
ctaaaatctttgcagataat

SEQ ID NO: 202498 - DNA, 20 bp, Artificial Sequence
  chemically synthesized
aatctttgcagataattaga

SEQ ID NO: 202499 - DNA, 20 bp, Artificial Sequence
  chemically synthesized
tctttgcagataattagaaa

SEQ ID NO: 202500 - DNA, 20 bp, Artificial Sequence
  chemically synthesized
gcagataattagaaagagtc

SEQ ID NO: 202501 - DNA, 20 bp, Artificial Sequence
  chemically synthesized
ttattacagataatgtttgc

SEQ ID NO: 202502 - DNA, 20 bp, Artificial Sequence
  chemically synthesized
aaatatatatgtttttatta

SEQ ID NO: 202503 - DNA, 20 bp, Artificial Sequence
  chemically synthesized
aaaaacatatatatttaatt

SEQ ID NO: 202504 - DNA, 20 bp, Artificial Sequence
  chemically synthesized
cacaaaataccacaaaatta

SEQ ID NO: 202505 - DNA, 20 bp, Artificial Sequence
  chemically synthesized
tggaatgtgctttaattttg

SEQ ID NO: 202506 - DNA, 20 bp, Artificial Sequence
  chemically synthesized
gcaagggacaaggaacagag

SEQ ID NO: 202507 - DNA, 20 bp, Artificial Sequence
  chemically synthesized
caggcaagggacaaggaaca

SEQ ID NO: 202508 - DNA, 20 bp, Artificial Sequence
  chemically synthesized
cacaggcaagggacaaggaa

SEQ ID NO: 202509 - DNA, 20 bp, Artificial Sequence
  chemically synthesized
ctaatcacaggcaagggaca

SEQ ID NO: 202510 - DNA, 20 bp, Artificial Sequence
  chemically synthesized
actaatcacaggcaagggac

SEQ ID NO: 202511 - DNA, 20 bp, Artificial Sequence
  chemically synthesized
tattcactaatcacaggcaa

SEQ ID NO: 202512 - DNA, 20 bp, Artificial Sequence
  chemically synthesized
atattcactaatcacaggca

SEQ ID NO: 202513 - DNA, 20 bp, Artificial Sequence
  chemically synthesized
tatattcactaatcacaggc

SEQ ID NO: 202514 - DNA, 20 bp, Artificial Sequence
  chemically synthesized
ccttgtcccttgcctgtgat

SEQ ID NO: 202515 - DNA, 20 bp, Artificial Sequence
  chemically synthesized
actctatattcactaatcac

SEQ ID NO: 202516 - DNA, 20 bp, Artificial Sequence
  chemically synthesized
cactctatattcactaatca

SEQ ID NO: 202517 - DNA, 20 bp, Artificial Sequence
  chemically synthesized
ttgcctgtgattagtgaata

SEQ ID NO: 202518 - DNA, 20 bp, Artificial Sequence
  chemically synthesized
gcctgtgattagtgaatata

SEQ ID NO: 202519 - DNA, 20 bp, Artificial Sequence
  chemically synthesized
cctccagagatagtggataa

SEQ ID NO: 202520 - DNA, 20 bp, Artificial Sequence
  chemically synthesized
acacttttatccactatctc

SEQ ID NO: 202521 - DNA, 20 bp, Artificial Sequence
  chemically synthesized
catttgtcctccagagatag

SEQ ID NO: 202522 - DNA, 20 bp, Artificial Sequence
  chemically synthesized
acttttatccactatctctg

SEQ ID NO: 202523 - DNA, 20 bp, Artificial Sequence
  chemically synthesized
cttttatccactatctctgg

SEQ ID NO: 202524 - DNA, 20 bp, Artificial Sequence
  chemically synthesized
tcacatttgtcctccagaga

SEQ ID NO: 202525 - DNA, 20 bp, Artificial Sequence
  chemically synthesized
tacttcacatttgtcctcca

SEQ ID NO: 202526 - DNA, 20 bp, Artificial Sequence
  chemically synthesized
actacttcacatttgtcctc

SEQ ID NO: 202527 - DNA, 20 bp, Artificial Sequence
  chemically synthesized
atctctggaggacaaatgtg

SEQ ID NO: 202528 - DNA, 20 bp, Artificial Sequence
  chemically synthesized
tctggaggacaaatgtgaag

SEQ ID NO: 202529 - DNA, 20 bp, Artificial Sequence
  chemically synthesized
acaaatgtgaagtagttgcc

SEQ ID NO: 202530 - DNA, 20 bp, Artificial Sequence
  chemically synthesized
aactgcctaaagtagagtct

SEQ ID NO: 202531 - DNA, 20 bp, Artificial Sequence
  chemically synthesized
tagttgccaagactctactt

SEQ ID NO: 202532 - DNA, 20 bp, Artificial Sequence
  chemically synthesized
agttgccaagactctacttt

SEQ ID NO: 202533 - DNA, 20 bp, Artificial Sequence
  chemically synthesized
atgtgaaactgcctaaagta

SEQ ID NO: 202534 - DNA, 20 bp, Artificial Sequence
  chemically synthesized
tgccaagactctactttagg

SEQ ID NO: 202535 - DNA, 20 bp, Artificial Sequence
  chemically synthesized
atatgtgaaactgcctaaag

SEQ ID NO: 202536 - DNA, 20 bp, Artificial Sequence
  chemically synthesized
atgatatgtgaaactgccta

SEQ ID NO: 202537 - DNA, 20 bp, Artificial Sequence
  chemically synthesized
atcattaaaacaaaaattta

SEQ ID NO: 202538 - DNA, 20 bp, Artificial Sequence
  chemically synthesized
tttgttattgtcatatttca

SEQ ID NO: 202539 - DNA, 20 bp, Artificial Sequence
  chemically synthesized
gaaatatgacaataacaaat

SEQ ID NO: 202540 - DNA, 20 bp, Artificial Sequence
  chemically synthesized
atatgacaataacaaattgg

SEQ ID NO: 202541 - DNA, 20 bp, Artificial Sequence
  chemically synthesized
tatgacaataacaaattgga

SEQ ID NO: 202542 - DNA, 20 bp, Artificial Sequence
  chemically synthesized
caataacaaattggaaggct

SEQ ID NO: 202543 - DNA, 20 bp, Artificial Sequence
  chemically synthesized
aataacaaattggaaggctg

SEQ ID NO: 202544 - DNA, 20 bp, Artificial Sequence
  chemically synthesized
ataacaaattggaaggctga

SEQ ID NO: 202545 - DNA, 20 bp, Artificial Sequence
  chemically synthesized
ttatgtgtaaaattagccct

SEQ ID NO: 202546 - DNA, 20 bp, Artificial Sequence
  chemically synthesized
tgcaaaattatgtgtaaaat

SEQ ID NO: 202547 - DNA, 20 bp, Artificial Sequence
  chemically synthesized
attttgcaaatctgtttgtt

SEQ ID NO: 202548 - DNA, 20 bp, Artificial Sequence
  chemically synthesized
gcatactcattcttaacaaa

SEQ ID NO: 202549 - DNA, 20 bp, Artificial Sequence
  chemically synthesized
caaatctgtttgttaagaat

SEQ ID NO: 202550 - DNA, 20 bp, Artificial Sequence
  chemically synthesized
caattcatacattgacattc

SEQ ID NO: 202551 - DNA, 20 bp, Artificial Sequence
  chemically synthesized
ttcatacattgacattctgg

SEQ ID NO: 202552 - DNA, 20 bp, Artificial Sequence
  chemically synthesized
tttataaactgatgaactac

SEQ ID NO: 202553 - DNA, 20 bp, Artificial Sequence
  chemically synthesized
ttgacattctggtagttcat

SEQ ID NO: 202554 - DNA, 20 bp, Artificial Sequence
  chemically synthesized
agttcatcagtttataaaac

SEQ ID NO: 202555 - DNA, 20 bp, Artificial Sequence
  chemically synthesized
agtttataaaactagtgaaa

SEQ ID NO: 202556 - DNA, 20 bp, Artificial Sequence
  chemically synthesized
aatgcattcttccatttcac

SEQ ID NO: 202557 - DNA, 20 bp, Artificial Sequence
  chemically synthesized
ttataaaactagtgaaatgg

SEQ ID NO: 202558 - DNA, 20 bp, Artificial Sequence
  chemically synthesized
atgcattgaaatttaattgt

SEQ ID NO: 202559 - DNA, 20 bp, Artificial Sequence
  chemically synthesized
atatagtcagcaaaagtgtg

SEQ ID NO: 202560 - DNA, 20 bp, Artificial Sequence
  chemically synthesized
tgttttaatatagtcagcaa

SEQ ID NO: 202561 - DNA, 20 bp, Artificial Sequence
  chemically synthesized
tgtatctgttttaatatagt

SEQ ID NO: 202562 - DNA, 20 bp, Artificial Sequence
  chemically synthesized
tcaatgtatctgttttaata

SEQ ID NO: 202563 - DNA, 20 bp, Artificial Sequence
  chemically synthesized
ttttgctgactatattaaaa

SEQ ID NO: 202564 - DNA, 20 bp, Artificial Sequence
  chemically synthesized
taaaacagatacattgaact

SEQ ID NO: 202565 - DNA, 20 bp, Artificial Sequence
  chemically synthesized
aacagatacattgaactgag

SEQ ID NO: 202566 - DNA, 20 bp, Artificial Sequence
  chemically synthesized
tattaggaggcgggaccact

SEQ ID NO: 202567 - DNA, 20 bp, Artificial Sequence
  chemically synthesized
gttataaattattaggaggc

SEQ ID NO: 202568 - DNA, 20 bp, Artificial Sequence
  chemically synthesized
tgttataaattattaggagg

SEQ ID NO: 202569 - DNA, 20 bp, Artificial Sequence
  chemically synthesized
agatgttataaattattagg

SEQ ID NO: 202570 - DNA, 20 bp, Artificial Sequence
  chemically synthesized
aagatgttataaattattag

SEQ ID NO: 202571 - DNA, 20 bp, Artificial Sequence
  chemically synthesized
tgaagatgttataaattatt

SEQ ID NO: 202572 - DNA, 20 bp, Artificial Sequence
  chemically synthesized
ctgaagatgttataaattat

SEQ ID NO: 202573 - DNA, 20 bp, Artificial Sequence
  chemically synthesized
ctaataatttataacatctt

SEQ ID NO: 202574 - DNA, 20 bp, Artificial Sequence
  chemically synthesized
aatattagtggcagaaactg

SEQ ID NO: 202575 - DNA, 20 bp, Artificial Sequence
  chemically synthesized
ataatgataaatattagtgg

SEQ ID NO: 202576 - DNA, 20 bp, Artificial Sequence
  chemically synthesized
aagataatgataaatattag

SEQ ID NO: 202577 - DNA, 20 bp, Artificial Sequence
  chemically synthesized
cataagataatgataaatat

SEQ ID NO: 202578 - DNA, 20 bp, Artificial Sequence
  chemically synthesized
atttatcattatcttatgaa

SEQ ID NO: 202579 - DNA, 20 bp, Artificial Sequence
  chemically synthesized
tttatcattatcttatgaac

SEQ ID NO: 202580 - DNA, 20 bp, Artificial Sequence
  chemically synthesized
caatgcacagacctgttcat

SEQ ID NO: 202581 - DNA, 20 bp, Artificial Sequence
  chemically synthesized
tttattattatttcaatgca

SEQ ID NO: 202582 - DNA, 20 bp, Artificial Sequence
  chemically synthesized
gaaataataataaaaacgat

SEQ ID NO: 202583 - DNA, 20 bp, Artificial Sequence
  chemically synthesized
aaataataataaaaacgata

SEQ ID NO: 202584 - DNA, 20 bp, Artificial Sequence
  chemically synthesized
aaaaacgataaggaaataaa

SEQ ID NO: 202585 - DNA, 20 bp, Artificial Sequence
  chemically synthesized
ataatacactgaataaataa

SEQ ID NO: 202586 - DNA, 20 bp, Artificial Sequence
  chemically synthesized
agacataactattatttatt

SEQ ID NO: 202587 - DNA, 20 bp, Artificial Sequence
  chemically synthesized
tatttattcagtgtattatt

SEQ ID NO: 202588 - DNA, 20 bp, Artificial Sequence
  chemically synthesized
ttaagtgtatgatataatgc

SEQ ID NO: 202589 - DNA, 20 bp, Artificial Sequence
  chemically synthesized
taagtgtatgatataatgcc

SEQ ID NO: 202590 - DNA, 20 bp, Artificial Sequence
  chemically synthesized
tgatataatgccaggcatcc

SEQ ID NO: 202591 - DNA, 20 bp, Artificial Sequence
  chemically synthesized
gatgatatatctaggatgcc

SEQ ID NO: 202592 - DNA, 20 bp, Artificial Sequence
  chemically synthesized
gtaaatgagatgatatatct

SEQ ID NO: 202593 - DNA, 20 bp, Artificial Sequence
  chemically synthesized
agtaaatgagatgatatatc

SEQ ID NO: 202594 - DNA, 20 bp, Artificial Sequence
  chemically synthesized
gttcattgtgaggagtaaat

SEQ ID NO: 202595 - DNA, 20 bp, Artificial Sequence
  chemically synthesized
cttaataggttcattgtgag

SEQ ID NO: 202596 - DNA, 20 bp, Artificial Sequence
  chemically synthesized
tacttaataggttcattgtg

SEQ ID NO: 202597 - DNA, 20 bp, Artificial Sequence
  chemically synthesized
ctacttaataggttcattgt

SEQ ID NO: 202598 - DNA, 20 bp, Artificial Sequence
  chemically synthesized
ctcctcacaatgaacctatt

SEQ ID NO: 202599 - DNA, 20 bp, Artificial Sequence
  chemically synthesized
ctcacaatgaacctattaag

SEQ ID NO: 202600 - DNA, 20 bp, Artificial Sequence
  chemically synthesized
cacaaggacatctacttaat

SEQ ID NO: 202601 - DNA, 20 bp, Artificial Sequence
  chemically synthesized
gcacaaggacatctacttaa

SEQ ID NO: 202602 - DNA, 20 bp, Artificial Sequence
  chemically synthesized
tcatttttaaaataggcaca

SEQ ID NO: 202603 - DNA, 20 bp, Artificial Sequence
  chemically synthesized
ctcatttttaaaataggcac

SEQ ID NO: 202604 - DNA, 20 bp, Artificial Sequence
  chemically synthesized
atcttcctcatttttaaaat

SEQ ID NO: 202605 - DNA, 20 bp, Artificial Sequence
  chemically synthesized
tatcttcctcatttttaaaa

SEQ ID NO: 202606 - DNA, 20 bp, Artificial Sequence
  chemically synthesized
cttgtgcctattttaaaaat

SEQ ID NO: 202607 - DNA, 20 bp, Artificial Sequence
  chemically synthesized
ttgtgcctattttaaaaatg

SEQ ID NO: 202608 - DNA, 20 bp, Artificial Sequence
  chemically synthesized
tgcctattttaaaaatgagg

SEQ ID NO: 202609 - DNA, 20 bp, Artificial Sequence
  chemically synthesized
aatgaggaagataaaacgta

SEQ ID NO: 202610 - DNA, 20 bp, Artificial Sequence
  chemically synthesized
agaaatttaacattttgccc

SEQ ID NO: 202611 - DNA, 20 bp, Artificial Sequence
  chemically synthesized
ttagtttgctttgcaatctt

SEQ ID NO: 202612 - DNA, 20 bp, Artificial Sequence
  chemically synthesized
tttagtttgctttgcaatct

SEQ ID NO: 202613 - DNA, 20 bp, Artificial Sequence
  chemically synthesized
acattttgcccaagattgca

SEQ ID NO: 202614 - DNA, 20 bp, Artificial Sequence
  chemically synthesized
caaatccttgttcatgcatt

SEQ ID NO: 202615 - DNA, 20 bp, Artificial Sequence
  chemically synthesized
agcaaactaaatgcatgaac

SEQ ID NO: 202616 - DNA, 20 bp, Artificial Sequence
  chemically synthesized
gcaaactaaatgcatgaaca

SEQ ID NO: 202617 - DNA, 20 bp, Artificial Sequence
  chemically synthesized
ccagatgaaaaaaaaaaaca

SEQ ID NO: 202618 - DNA, 20 bp, Artificial Sequence
  chemically synthesized
ctgtgtttttttttttcatc

SEQ ID NO: 202619 - DNA, 20 bp, Artificial Sequence
  chemically synthesized
gtgtttttttttttcatctg

SEQ ID NO: 202620 - DNA, 20 bp, Artificial Sequence
  chemically synthesized
tgtttttttttttcatctgg

SEQ ID NO: 202621 - DNA, 20 bp, Artificial Sequence
  chemically synthesized
tgcttgggaacggaggcctc

SEQ ID NO: 202622 - DNA, 20 bp, Artificial Sequence
  chemically synthesized
aaaagcatgcttgggaacgg

SEQ ID NO: 202623 - DNA, 20 bp, Artificial Sequence
  chemically synthesized
atctggaggcctccgttccc

SEQ ID NO: 202624 - DNA, 20 bp, Artificial Sequence
  chemically synthesized
taaaagcatgcttgggaacg

SEQ ID NO: 202625 - DNA, 20 bp, Artificial Sequence
  chemically synthesized
tttaaaagcatgcttgggaa

SEQ ID NO: 202626 - DNA, 20 bp, Artificial Sequence
  chemically synthesized
aaaaatttaaaagcatgctt

SEQ ID NO: 202627 - DNA, 20 bp, Artificial Sequence
  chemically synthesized
aaaaaatttaaaagcatgct

SEQ ID NO: 202628 - DNA, 20 bp, Artificial Sequence
  chemically synthesized
aagagaaaaaaaaaatttaa

SEQ ID NO: 202629 - DNA, 20 bp, Artificial Sequence
  chemically synthesized
aaccttatgatatgtgtcaa

SEQ ID NO: 202630 - DNA, 20 bp, Artificial Sequence
  chemically synthesized
gaaaccttatgatatgtgtc

SEQ ID NO: 202631 - DNA, 20 bp, Artificial Sequence
  chemically synthesized
tttctcttgacacatatcat

SEQ ID NO: 202632 - DNA, 20 bp, Artificial Sequence
  chemically synthesized
ttctcttgacacatatcata

SEQ ID NO: 202633 - DNA, 20 bp, Artificial Sequence
  chemically synthesized
gatatgatgtgaaaaatgag

SEQ ID NO: 202634 - DNA, 20 bp, Artificial Sequence
  chemically synthesized
gttgatatgatgtgaaaaat

SEQ ID NO: 202635 - DNA, 20 bp, Artificial Sequence
  chemically synthesized
atttttcacatcatatcaac

SEQ ID NO: 202636 - DNA, 20 bp, Artificial Sequence
  chemically synthesized
tccaggaacagcaaagagac

SEQ ID NO: 202637 - DNA, 20 bp, Artificial Sequence
  chemically synthesized
gctgttccaggaacagcaaa

SEQ ID NO: 202638 - DNA, 20 bp, Artificial Sequence
  chemically synthesized
atgctgttccaggaacagca

SEQ ID NO: 202639 - DNA, 20 bp, Artificial Sequence
  chemically synthesized
accagtctctttgctgttcc

SEQ ID NO: 202640 - DNA, 20 bp, Artificial Sequence
  chemically synthesized
tgaatatgctgttccaggaa

SEQ ID NO: 202641 - DNA, 20 bp, Artificial Sequence
  chemically synthesized
tctctttgctgttcctggaa

SEQ ID NO: 202642 - DNA, 20 bp, Artificial Sequence
  chemically synthesized
agatgtgaatatgctgttcc

SEQ ID NO: 202643 - DNA, 20 bp, Artificial Sequence
  chemically synthesized
gagatgtgaatatgctgttc

SEQ ID NO: 202644 - DNA, 20 bp, Artificial Sequence
  chemically synthesized
gaacagcatattcacatctc

SEQ ID NO: 202645 - DNA, 20 bp, Artificial Sequence
  chemically synthesized
aacagcatattcacatctct

SEQ ID NO: 202646 - DNA, 20 bp, Artificial Sequence
  chemically synthesized
atattcacatctctgggcct

SEQ ID NO: 202647 - DNA, 20 bp, Artificial Sequence
  chemically synthesized
ctagtaagagccgaggccca

SEQ ID NO: 202648 - DNA, 20 bp, Artificial Sequence
  chemically synthesized
aactagtaagagccgaggcc

SEQ ID NO: 202649 - DNA, 20 bp, Artificial Sequence
  chemically synthesized
taaggaactagtaagagccg

SEQ ID NO: 202650 - DNA, 20 bp, Artificial Sequence
  chemically synthesized
ataaggaactagtaagagcc

SEQ ID NO: 202651 - DNA, 20 bp, Artificial Sequence
  chemically synthesized
ctctgggcctcggctcttac

SEQ ID NO: 202652 - DNA, 20 bp, Artificial Sequence
  chemically synthesized
tcaggataaggaactagtaa

SEQ ID NO: 202653 - DNA, 20 bp, Artificial Sequence
  chemically synthesized
agtcaggataaggaactagt

SEQ ID NO: 202654 - DNA, 20 bp, Artificial Sequence
  chemically synthesized
aatgagtcaggataaggaac

SEQ ID NO: 202655 - DNA, 20 bp, Artificial Sequence
  chemically synthesized
taaagaaatgagtcaggata

SEQ ID NO: 202656 - DNA, 20 bp, Artificial Sequence
  chemically synthesized
ctaaagaaatgagtcaggat

SEQ ID NO: 202657 - DNA, 20 bp, Artificial Sequence
  chemically synthesized
actatctaaagaaatgagtc

SEQ ID NO: 202658 - DNA, 20 bp, Artificial Sequence
  chemically synthesized
tactatctaaagaaatgagt

SEQ ID NO: 202659 - DNA, 20 bp, Artificial Sequence
  chemically synthesized
cttatcctgactcatttctt

SEQ ID NO: 202660 - DNA, 20 bp, Artificial Sequence
  chemically synthesized
atgctactatctaaagaaat

SEQ ID NO: 202661 - DNA, 20 bp, Artificial Sequence
  chemically synthesized
tcctgactcatttctttaga

SEQ ID NO: 202662 - DNA, 20 bp, Artificial Sequence
  chemically synthesized
tgactcatttctttagatag

SEQ ID NO: 202663 - DNA, 20 bp, Artificial Sequence
  chemically synthesized
atgaaacatgctactatcta

SEQ ID NO: 202664 - DNA, 20 bp, Artificial Sequence
  chemically synthesized
cagagacctaaatcaagtca

SEQ ID NO: 202665 - DNA, 20 bp, Artificial Sequence
  chemically synthesized
gcagagacctaaatcaagtc

SEQ ID NO: 202666 - DNA, 20 bp, Artificial Sequence
  chemically synthesized
tttcattccttgacttgatt

SEQ ID NO: 202667 - DNA, 20 bp, Artificial Sequence
  chemically synthesized
ttcattccttgacttgattt

SEQ ID NO: 202668 - DNA, 20 bp, Artificial Sequence
  chemically synthesized
tctgagcagagacctaaatc

SEQ ID NO: 202669 - DNA, 20 bp, Artificial Sequence
  chemically synthesized
acttgatttaggtctctgct

SEQ ID NO: 202670 - DNA, 20 bp, Artificial Sequence
  chemically synthesized
gagagtgtgacatctgagca

SEQ ID NO: 202671 - DNA, 20 bp, Artificial Sequence
  chemically synthesized
ctgagagtgtgacatctgag

SEQ ID NO: 202672 - DNA, 20 bp, Artificial Sequence
  chemically synthesized
aggctgagagtgtgacatct

SEQ ID NO: 202673 - DNA, 20 bp, Artificial Sequence
  chemically synthesized
ctgctcagatgtcacactct

SEQ ID NO: 202674 - DNA, 20 bp, Artificial Sequence
  chemically synthesized
tggtgaagagaggaggctga

SEQ ID NO: 202675 - DNA, 20 bp, Artificial Sequence
  chemically synthesized
agtggtgaagagaggaggct

SEQ ID NO: 202676 - DNA, 20 bp, Artificial Sequence
  chemically synthesized
gcaagagtggtgaagagagg

SEQ ID NO: 202677 - DNA, 20 bp, Artificial Sequence
  chemically synthesized
agcaagagtggtgaagagag

SEQ ID NO: 202678 - DNA, 20 bp, Artificial Sequence
  chemically synthesized
ttagcaagagtggtgaagag

SEQ ID NO: 202679 - DNA, 20 bp, Artificial Sequence
  chemically synthesized
tttagcaagagtggtgaaga

SEQ ID NO: 202680 - DNA, 20 bp, Artificial Sequence
  chemically synthesized
attttagcaagagtggtgaa

SEQ ID NO: 202681 - DNA, 20 bp, Artificial Sequence
  chemically synthesized
gtattttagcaagagtggtg

SEQ ID NO: 202682 - DNA, 20 bp, Artificial Sequence
  chemically synthesized
aagcagtattttagcaagag

SEQ ID NO: 202683 - DNA, 20 bp, Artificial Sequence
  chemically synthesized
gggaagcagtattttagcaa

SEQ ID NO: 202684 - DNA, 20 bp, Artificial Sequence
  chemically synthesized
aagggaagcagtattttagc

SEQ ID NO: 202685 - DNA, 20 bp, Artificial Sequence
  chemically synthesized
gaaaaagggaagcagtattt

SEQ ID NO: 202686 - DNA, 20 bp, Artificial Sequence
  chemically synthesized
gggtaaaggaaaaagggaag

SEQ ID NO: 202687 - DNA, 20 bp, Artificial Sequence
  chemically synthesized
tcagggtaaaggaaaaaggg

SEQ ID NO: 202688 - DNA, 20 bp, Artificial Sequence
  chemically synthesized
tcatcagggtaaaggaaaaa

SEQ ID NO: 202689 - DNA, 20 bp, Artificial Sequence
  chemically synthesized
atcatcagggtaaaggaaaa

SEQ ID NO: 202690 - DNA, 20 bp, Artificial Sequence
  chemically synthesized
aatcatcagggtaaaggaaa

SEQ ID NO: 202691 - DNA, 20 bp, Artificial Sequence
  chemically synthesized
gaaaaaaatcatcagggtaa

SEQ ID NO: 202692 - DNA, 20 bp, Artificial Sequence
  chemically synthesized
tgaaaaaaatcatcagggta

SEQ ID NO: 202693 - DNA, 20 bp, Artificial Sequence
  chemically synthesized
tacgatgaaaaaaatcatca

SEQ ID NO: 202694 - DNA, 20 bp, Artificial Sequence
  chemically synthesized
gtacgatgaaaaaaatcatc

SEQ ID NO: 202695 - DNA, 20 bp, Artificial Sequence
  chemically synthesized
agtacgatgaaaaaaatcat

SEQ ID NO: 202696 - DNA, 20 bp, Artificial Sequence
  chemically synthesized
atgataaaatatcagattaa

SEQ ID NO: 202697 - DNA, 20 bp, Artificial Sequence
  chemically synthesized
caataaatatgataaaatat

SEQ ID NO: 202698 - DNA, 20 bp, Artificial Sequence
  chemically synthesized
tgatattttatcatatttat

SEQ ID NO: 202699 - DNA, 20 bp, Artificial Sequence
  chemically synthesized
gatattttatcatatttatt

SEQ ID NO: 202700 - DNA, 20 bp, Artificial Sequence
  chemically synthesized
acattttagcaggggaggca

SEQ ID NO: 202701 - DNA, 20 bp, Artificial Sequence
  chemically synthesized
aatttacattttagcagggg

SEQ ID NO: 202702 - DNA, 20 bp, Artificial Sequence
  chemically synthesized
gaatttacattttagcaggg

SEQ ID NO: 202703 - DNA, 20 bp, Artificial Sequence
  chemically synthesized
tggaatttacattttagcag

SEQ ID NO: 202704 - DNA, 20 bp, Artificial Sequence
  chemically synthesized
gtggaatttacattttagca

SEQ ID NO: 202705 - DNA, 20 bp, Artificial Sequence
  chemically synthesized
tgtggaatttacattttagc

SEQ ID NO: 202706 - DNA, 20 bp, Artificial Sequence
  chemically synthesized
ttgtggaatttacattttag

SEQ ID NO: 202707 - DNA, 20 bp, Artificial Sequence
  chemically synthesized
ttgttgtggaatttacattt

SEQ ID NO: 202708 - DNA, 20 bp, Artificial Sequence
  chemically synthesized
aaaatgtaaattccacaaca

SEQ ID NO: 202709 - DNA, 20 bp, Artificial Sequence
  chemically synthesized
aaatgtaaattccacaacaa

SEQ ID NO: 202710 - DNA, 20 bp, Artificial Sequence
  chemically synthesized
aatgtaaattccacaacaaa

SEQ ID NO: 202711 - DNA, 20 bp, Artificial Sequence
  chemically synthesized
aaaacaacgtccctttgttg

SEQ ID NO: 202712 - DNA, 20 bp, Artificial Sequence
  chemically synthesized
aagggacgttgttttcttta

SEQ ID NO: 202713 - DNA, 20 bp, Artificial Sequence
  chemically synthesized
gacgttgttttctttatgga

SEQ ID NO: 202714 - DNA, 20 bp, Artificial Sequence
  chemically synthesized
gtaccaggtatccatccata

SEQ ID NO: 202715 - DNA, 20 bp, Artificial Sequence
  chemically synthesized
tttctttatggatggatacc

SEQ ID NO: 202716 - DNA, 20 bp, Artificial Sequence
  chemically synthesized
caggttttgttgcaggtacc

SEQ ID NO: 202717 - DNA, 20 bp, Artificial Sequence
  chemically synthesized
ccaggttttgttgcaggtac

SEQ ID NO: 202718 - DNA, 20 bp, Artificial Sequence
  chemically synthesized
cctgtgccaggttttgttgc

SEQ ID NO: 202719 - DNA, 20 bp, Artificial Sequence
  chemically synthesized
gcctgtgccaggttttgttg

SEQ ID NO: 202720 - DNA, 20 bp, Artificial Sequence
  chemically synthesized
ctggtacctgcaacaaaacc

SEQ ID NO: 202721 - DNA, 20 bp, Artificial Sequence
  chemically synthesized
acctgcaacaaaacctggca

SEQ ID NO: 202722 - DNA, 20 bp, Artificial Sequence
  chemically synthesized
cctgcaacaaaacctggcac

SEQ ID NO: 202723 - DNA, 20 bp, Artificial Sequence
  chemically synthesized
ctagtcaatcagcctgtgcc

SEQ ID NO: 202724 - DNA, 20 bp, Artificial Sequence
  chemically synthesized
actagtcaatcagcctgtgc

SEQ ID NO: 202725 - DNA, 20 bp, Artificial Sequence
  chemically synthesized
cctggcacaggctgattgac

SEQ ID NO: 202726 - DNA, 20 bp, Artificial Sequence
  chemically synthesized
ttcaaccaatactagtcaat

SEQ ID NO: 202727 - DNA, 20 bp, Artificial Sequence
  chemically synthesized
acaggctgattgactagtat

SEQ ID NO: 202728 - DNA, 20 bp, Artificial Sequence
  chemically synthesized
tgctcttattcaaccaatac

SEQ ID NO: 202729 - DNA, 20 bp, Artificial Sequence
  chemically synthesized
ttgactagtattggttgaat

SEQ ID NO: 202730 - DNA, 20 bp, Artificial Sequence
  chemically synthesized
gactagtattggttgaataa

SEQ ID NO: 202731 - DNA, 20 bp, Artificial Sequence
  chemically synthesized
agcaaaaatgaatgactact

SEQ ID NO: 202732 - DNA, 20 bp, Artificial Sequence
  chemically synthesized
aattttagggtaaatctcag

SEQ ID NO: 202733 - DNA, 20 bp, Artificial Sequence
  chemically synthesized
gaaaattttagggtaaatct

SEQ ID NO: 202734 - DNA, 20 bp, Artificial Sequence
  chemically synthesized
caaaatatttgaaaatttta

SEQ ID NO: 202735 - DNA, 20 bp, Artificial Sequence
  chemically synthesized
tcaaaatatttgaaaatttt

SEQ ID NO: 202736 - DNA, 20 bp, Artificial Sequence
  chemically synthesized
atcaaaatatttgaaaattt

SEQ ID NO: 202737 - DNA, 20 bp, Artificial Sequence
  chemically synthesized
aatattttgatgtataaaaa

SEQ ID NO: 202738 - DNA, 20 bp, Artificial Sequence
  chemically synthesized
acacagtttggttacattca

SEQ ID NO: 202739 - DNA, 20 bp, Artificial Sequence
  chemically synthesized
atgaatgtaaccaaactgtg

SEQ ID NO: 202740 - DNA, 20 bp, Artificial Sequence
  chemically synthesized
cagcctctgtccacacagtt

SEQ ID NO: 202741 - DNA, 20 bp, Artificial Sequence
  chemically synthesized
atgtaaccaaactgtgtgga

SEQ ID NO: 202742 - DNA, 20 bp, Artificial Sequence
  chemically synthesized
cccatcagcctctgtccaca

SEQ ID NO: 202743 - DNA, 20 bp, Artificial Sequence
  chemically synthesized
gtaaccaaactgtgtggaca

SEQ ID NO: 202744 - DNA, 20 bp, Artificial Sequence
  chemically synthesized
taaccaaactgtgtggacag

SEQ ID NO: 202745 - DNA, 20 bp, Artificial Sequence
  chemically synthesized
actgtgtggacagaggctga

SEQ ID NO: 202746 - DNA, 20 bp, Artificial Sequence
  chemically synthesized
ctgtgtggacagaggctgat

SEQ ID NO: 202747 - DNA, 20 bp, Artificial Sequence
  chemically synthesized
tgtgtggacagaggctgatg

SEQ ID NO: 202748 - DNA, 20 bp, Artificial Sequence
  chemically synthesized
cacaccacttgagaccccat

SEQ ID NO: 202749 - DNA, 20 bp, Artificial Sequence
  chemically synthesized
acagaggctgatggggtctc

SEQ ID NO: 202750 - DNA, 20 bp, Artificial Sequence
  chemically synthesized
gaggctgatggggtctcaag

SEQ ID NO: 202751 - DNA, 20 bp, Artificial Sequence
  chemically synthesized
ttcacatacacacaccactt

SEQ ID NO: 202752 - DNA, 20 bp, Artificial Sequence
  chemically synthesized
tcaagtggtgtgtgtatgtg

SEQ ID NO: 202753 - DNA, 20 bp, Artificial Sequence
  chemically synthesized
caagtggtgtgtgtatgtga

SEQ ID NO: 202754 - DNA, 20 bp, Artificial Sequence
  chemically synthesized
aagtggtgtgtgtatgtgaa

SEQ ID NO: 202755 - DNA, 20 bp, Artificial Sequence
  chemically synthesized
ggtgtgtgtatgtgaagggt

SEQ ID NO: 202756 - DNA, 20 bp, Artificial Sequence
  chemically synthesized
atgtgaagggtaagacattt

SEQ ID NO: 202757 - DNA, 20 bp, Artificial Sequence
  chemically synthesized
tgaagggtaagacattttag

SEQ ID NO: 202758 - DNA, 20 bp, Artificial Sequence
  chemically synthesized
agggtaagacattttagaag

SEQ ID NO: 202759 - DNA, 20 bp, Artificial Sequence
  chemically synthesized
tttagaagaagtacctatgc

SEQ ID NO: 202760 - DNA, 20 bp, Artificial Sequence
  chemically synthesized
agagtttcaaaatccagcat

SEQ ID NO: 202761 - DNA, 20 bp, Artificial Sequence
  chemically synthesized
cagagtttcaaaatccagca

SEQ ID NO: 202762 - DNA, 20 bp, Artificial Sequence
  chemically synthesized
cctttcagagtttcaaaatc

SEQ ID NO: 202763 - DNA, 20 bp, Artificial Sequence
  chemically synthesized
gctggattttgaaactctga

SEQ ID NO: 202764 - DNA, 20 bp, Artificial Sequence
  chemically synthesized
ctggattttgaaactctgaa

SEQ ID NO: 202765 - DNA, 20 bp, Artificial Sequence
  chemically synthesized
tccattcgtttgtcctttca

SEQ ID NO: 202766 - DNA, 20 bp, Artificial Sequence
  chemically synthesized
cctccattcgtttgtccttt

SEQ ID NO: 202767 - DNA, 20 bp, Artificial Sequence
  chemically synthesized
actctgaaaggacaaacgaa

SEQ ID NO: 202768 - DNA, 20 bp, Artificial Sequence
  chemically synthesized
tctgaaaggacaaacgaatg

SEQ ID NO: 202769 - DNA, 20 bp, Artificial Sequence
  chemically synthesized
ctgaaaggacaaacgaatgg

SEQ ID NO: 202770 - DNA, 20 bp, Artificial Sequence
  chemically synthesized
tgaaaggacaaacgaatgga

SEQ ID NO: 202771 - DNA, 20 bp, Artificial Sequence
  chemically synthesized
aaggacaaacgaatggaggg

SEQ ID NO: 202772 - DNA, 20 bp, Artificial Sequence
  chemically synthesized
aaacgaatggagggaagaaa

SEQ ID NO: 202773 - DNA, 20 bp, Artificial Sequence
  chemically synthesized
cgaatggagggaagaaacag

SEQ ID NO: 202774 - DNA, 20 bp, Artificial Sequence
  chemically synthesized
agggaagaaacagtagactg

SEQ ID NO: 202775 - DNA, 20 bp, Artificial Sequence
  chemically synthesized
gggaagaaacagtagactgc

SEQ ID NO: 202776 - DNA, 20 bp, Artificial Sequence
  chemically synthesized
tctcgttctcaagtatcccg

SEQ ID NO: 202777 - DNA, 20 bp, Artificial Sequence
  chemically synthesized
cagtagactgcgggatactt

SEQ ID NO: 202778 - DNA, 20 bp, Artificial Sequence
  chemically synthesized
actgcgggatacttgagaac

SEQ ID NO: 202779 - DNA, 20 bp, Artificial Sequence
  chemically synthesized
gtttgtttcttctcgttctc

SEQ ID NO: 202780 - DNA, 20 bp, Artificial Sequence
  chemically synthesized
gcgggatacttgagaacgag

SEQ ID NO: 202781 - DNA, 20 bp, Artificial Sequence
  chemically synthesized
caaacaaacaaaatgaatga

SEQ ID NO: 202782 - DNA, 20 bp, Artificial Sequence
  chemically synthesized
aaatgaatgaaagccactgt

SEQ ID NO: 202783 - DNA, 20 bp, Artificial Sequence
  chemically synthesized
tgtgttccaagaactgacag

SEQ ID NO: 202784 - DNA, 20 bp, Artificial Sequence
  chemically synthesized
ctctgtgttccaagaactga

SEQ ID NO: 202785 - DNA, 20 bp, Artificial Sequence
  chemically synthesized
tgaaagccactgtcagttct

SEQ ID NO: 202786 - DNA, 20 bp, Artificial Sequence
  chemically synthesized
cactgtcagttcttggaaca

SEQ ID NO: 202787 - DNA, 20 bp, Artificial Sequence
  chemically synthesized
ttttcccaactctgtgttcc

SEQ ID NO: 202788 - DNA, 20 bp, Artificial Sequence
  chemically synthesized
ctgtcagttcttggaacaca

SEQ ID NO: 202789 - DNA, 20 bp, Artificial Sequence
  chemically synthesized
cagttcttggaacacagagt

SEQ ID NO: 202790 - DNA, 20 bp, Artificial Sequence
  chemically synthesized
agttcttggaacacagagtt

SEQ ID NO: 202791 - DNA, 20 bp, Artificial Sequence
  chemically synthesized
gaaaatgtattatctatatc

SEQ ID NO: 202792 - DNA, 20 bp, Artificial Sequence
  chemically synthesized
aaatgtattatctatatctg

SEQ ID NO: 202793 - DNA, 20 bp, Artificial Sequence
  chemically synthesized
cttgagtatttctccagata

SEQ ID NO: 202794 - DNA, 20 bp, Artificial Sequence
  chemically synthesized
ccctgacttgagtatttctc

SEQ ID NO: 202795 - DNA, 20 bp, Artificial Sequence
  chemically synthesized
ctatatctggagaaatactc

SEQ ID NO: 202796 - DNA, 20 bp, Artificial Sequence
  chemically synthesized
atctggagaaatactcaagt

SEQ ID NO: 202797 - DNA, 20 bp, Artificial Sequence
  chemically synthesized
tctggagaaatactcaagtc

SEQ ID NO: 202798 - DNA, 20 bp, Artificial Sequence
  chemically synthesized
ctggagaaatactcaagtca

SEQ ID NO: 202799 - DNA, 20 bp, Artificial Sequence
  chemically synthesized
tggagaaatactcaagtcag

SEQ ID NO: 202800 - DNA, 20 bp, Artificial Sequence
  chemically synthesized
tgttctccttcccctgactt

SEQ ID NO: 202801 - DNA, 20 bp, Artificial Sequence
  chemically synthesized
agaaatactcaagtcagggg

SEQ ID NO: 202802 - DNA, 20 bp, Artificial Sequence
  chemically synthesized
gaaatactcaagtcagggga

SEQ ID NO: 202803 - DNA, 20 bp, Artificial Sequence
  chemically synthesized
aatactcaagtcaggggaag

SEQ ID NO: 202804 - DNA, 20 bp, Artificial Sequence
  chemically synthesized
tcaagtcaggggaaggagaa

SEQ ID NO: 202805 - DNA, 20 bp, Artificial Sequence
  chemically synthesized
ggggaaggagaacagatgac

SEQ ID NO: 202806 - DNA, 20 bp, Artificial Sequence
  chemically synthesized
agaacagatgactggcaatg

SEQ ID NO: 202807 - DNA, 20 bp, Artificial Sequence
  chemically synthesized
gaacagatgactggcaatga

SEQ ID NO: 202808 - DNA, 20 bp, Artificial Sequence
  chemically synthesized
ctttgaggtcccttcattgc

SEQ ID NO: 202809 - DNA, 20 bp, Artificial Sequence
  chemically synthesized
aacagatgactggcaatgaa

SEQ ID NO: 202810 - DNA, 20 bp, Artificial Sequence
  chemically synthesized
ctggcaatgaagggacctca

SEQ ID NO: 202811 - DNA, 20 bp, Artificial Sequence
  chemically synthesized
caatgaagggacctcaaagc

SEQ ID NO: 202812 - DNA, 20 bp, Artificial Sequence
  chemically synthesized
aatgaagggacctcaaagca

SEQ ID NO: 202813 - DNA, 20 bp, Artificial Sequence
  chemically synthesized
ctcaattagaccttgctttg

SEQ ID NO: 202814 - DNA, 20 bp, Artificial Sequence
  chemically synthesized
tctcaattagaccttgcttt

SEQ ID NO: 202815 - DNA, 20 bp, Artificial Sequence
  chemically synthesized
cctcaaagcaaggtctaatt

SEQ ID NO: 202816 - DNA, 20 bp, Artificial Sequence
  chemically synthesized
ctgttgtctcaaatctcaat

SEQ ID NO: 202817 - DNA, 20 bp, Artificial Sequence
  chemically synthesized
gcaaggtctaattgagattt

SEQ ID NO: 202818 - DNA, 20 bp, Artificial Sequence
  chemically synthesized
ctaattgagatttgagacaa

SEQ ID NO: 202819 - DNA, 20 bp, Artificial Sequence
  chemically synthesized
gacaacagcatgcatccact

SEQ ID NO: 202820 - DNA, 20 bp, Artificial Sequence
  chemically synthesized
caacagcatgcatccacttg

SEQ ID NO: 202821 - DNA, 20 bp, Artificial Sequence
  chemically synthesized
ctctttgtaagaactccaag

SEQ ID NO: 202822 - DNA, 20 bp, Artificial Sequence
  chemically synthesized
ttcctctttgtaagaactcc

SEQ ID NO: 202823 - DNA, 20 bp, Artificial Sequence
  chemically synthesized
atccacttggagttcttaca

SEQ ID NO: 202824 - DNA, 20 bp, Artificial Sequence
  chemically synthesized
ccacttggagttcttacaaa

SEQ ID NO: 202825 - DNA, 20 bp, Artificial Sequence
  chemically synthesized
cacttggagttcttacaaag

SEQ ID NO: 202826 - DNA, 20 bp, Artificial Sequence
  chemically synthesized
aacatagtattcctctttgt

SEQ ID NO: 202827 - DNA, 20 bp, Artificial Sequence
  chemically synthesized
atgtacgagtcagttgaaca

SEQ ID NO: 202828 - DNA, 20 bp, Artificial Sequence
  chemically synthesized
cgtattacaaatgtacgagt

SEQ ID NO: 202829 - DNA, 20 bp, Artificial Sequence
  chemically synthesized
cggacgtattacaaatgtac

SEQ ID NO: 202830 - DNA, 20 bp, Artificial Sequence
  chemically synthesized
tagcaatagggtttttttaa

SEQ ID NO: 202831 - DNA, 20 bp, Artificial Sequence
  chemically synthesized
actcatttccaatagcaata

SEQ ID NO: 202832 - DNA, 20 bp, Artificial Sequence
  chemically synthesized
tactcatttccaatagcaat

SEQ ID NO: 202833 - DNA, 20 bp, Artificial Sequence
  chemically synthesized
taaaaaaaccctattgctat

SEQ ID NO: 202834 - DNA, 20 bp, Artificial Sequence
  chemically synthesized
atactcatttccaatagcaa

SEQ ID NO: 202835 - DNA, 20 bp, Artificial Sequence
  chemically synthesized
ctttccatactcatttccaa

SEQ ID NO: 202836 - DNA, 20 bp, Artificial Sequence
  chemically synthesized
accctattgctattggaaat

SEQ ID NO: 202837 - DNA, 20 bp, Artificial Sequence
  chemically synthesized
attgctattggaaatgagta

SEQ ID NO: 202838 - DNA, 20 bp, Artificial Sequence
  chemically synthesized
ctattggaaatgagtatgga

SEQ ID NO: 202839 - DNA, 20 bp, Artificial Sequence
  chemically synthesized
aaatgagtatggaaagcttt

SEQ ID NO: 202840 - DNA, 20 bp, Artificial Sequence
  chemically synthesized
agtatggaaagctttcagaa

SEQ ID NO: 202841 - DNA, 20 bp, Artificial Sequence
  chemically synthesized
gaataaaacttccattctga

SEQ ID NO: 202842 - DNA, 20 bp, Artificial Sequence
  chemically synthesized
atggaaagctttcagaatgg

SEQ ID NO: 202843 - DNA, 20 bp, Artificial Sequence
  chemically synthesized
tggaagttttattccattgt

SEQ ID NO: 202844 - DNA, 20 bp, Artificial Sequence
  chemically synthesized
attgcaccccttaccaacaa

SEQ ID NO: 202845 - DNA, 20 bp, Artificial Sequence
  chemically synthesized
agttttattccattgttggt

SEQ ID NO: 202846 - DNA, 20 bp, Artificial Sequence
  chemically synthesized
gttttattccattgttggta

SEQ ID NO: 202847 - DNA, 20 bp, Artificial Sequence
  chemically synthesized
ttttattccattgttggtaa

SEQ ID NO: 202848 - DNA, 20 bp, Artificial Sequence
  chemically synthesized
tttattccattgttggtaag

SEQ ID NO: 202849 - DNA, 20 bp, Artificial Sequence
  chemically synthesized
tcatgcataaccgcaactac

SEQ ID NO: 202850 - DNA, 20 bp, Artificial Sequence
  chemically synthesized
tgcccatttccttgtagttg

SEQ ID NO: 202851 - DNA, 20 bp, Artificial Sequence
  chemically synthesized
catgcataaccgcaactaca

SEQ ID NO: 202852 - DNA, 20 bp, Artificial Sequence
  chemically synthesized
tctttatgcccatttccttg

SEQ ID NO: 202853 - DNA, 20 bp, Artificial Sequence
  chemically synthesized
taaccgcaactacaaggaaa

SEQ ID NO: 202854 - DNA, 20 bp, Artificial Sequence
  chemically synthesized
aaccgcaactacaaggaaat

SEQ ID NO: 202855 - DNA, 20 bp, Artificial Sequence
  chemically synthesized
actacaaggaaatgggcata

SEQ ID NO: 202856 - DNA, 20 bp, Artificial Sequence
  chemically synthesized
tacaaggaaatgggcataaa

SEQ ID NO: 202857 - DNA, 20 bp, Artificial Sequence
  chemically synthesized
acaaggaaatgggcataaag

SEQ ID NO: 202858 - DNA, 20 bp, Artificial Sequence
  chemically synthesized
ggaaatgggcataaagaggt

SEQ ID NO: 202859 - DNA, 20 bp, Artificial Sequence
  chemically synthesized
gaaatgggcataaagaggtg

SEQ ID NO: 202860 - DNA, 20 bp, Artificial Sequence
  chemically synthesized
tgggcataaagaggtgaggt

SEQ ID NO: 202861 - DNA, 20 bp, Artificial Sequence
  chemically synthesized
gcataaagaggtgaggtaag

SEQ ID NO: 202862 - DNA, 20 bp, Artificial Sequence
  chemically synthesized
cataaagaggtgaggtaagt

SEQ ID NO: 202863 - DNA, 20 bp, Artificial Sequence
  chemically synthesized
gaggtgaggtaagtaggaat

SEQ ID NO: 202864 - DNA, 20 bp, Artificial Sequence
  chemically synthesized
aggtaagtaggaataagtgc

SEQ ID NO: 202865 - DNA, 20 bp, Artificial Sequence
  chemically synthesized
tttagtaattatatatgcac

SEQ ID NO: 202866 - DNA, 20 bp, Artificial Sequence
  chemically synthesized
gtgcatatataattactaaa

SEQ ID NO: 202867 - DNA, 20 bp, Artificial Sequence
  chemically synthesized
cttgtcaaaccatttccatt

SEQ ID NO: 202868 - DNA, 20 bp, Artificial Sequence
  chemically synthesized
atataattactaaatggaaa

SEQ ID NO: 202869 - DNA, 20 bp, Artificial Sequence
  chemically synthesized
ctaaatggaaatggtttgac

SEQ ID NO: 202870 - DNA, 20 bp, Artificial Sequence
  chemically synthesized
tttgacaagtctgatacaaa

SEQ ID NO: 202871 - DNA, 20 bp, Artificial Sequence
  chemically synthesized
tccagagagcctttttgtat

SEQ ID NO: 202872 - DNA, 20 bp, Artificial Sequence
  chemically synthesized
ttgacaagtctgatacaaaa

SEQ ID NO: 202873 - DNA, 20 bp, Artificial Sequence
  chemically synthesized
tctgatacaaaaaggctctc

SEQ ID NO: 202874 - DNA, 20 bp, Artificial Sequence
  chemically synthesized
atttgaaattggggtccaga

SEQ ID NO: 202875 - DNA, 20 bp, Artificial Sequence
  chemically synthesized
ttatttgaaattggggtcca

SEQ ID NO: 202876 - DNA, 20 bp, Artificial Sequence
  chemically synthesized
ttttatttgaaattggggtc

SEQ ID NO: 202877 - DNA, 20 bp, Artificial Sequence
  chemically synthesized
aggtcttttatttgaaattg

SEQ ID NO: 202878 - DNA, 20 bp, Artificial Sequence
  chemically synthesized
caggtcttttatttgaaatt

SEQ ID NO: 202879 - DNA, 20 bp, Artificial Sequence
  chemically synthesized
tcaggtcttttatttgaaat

SEQ ID NO: 202880 - DNA, 20 bp, Artificial Sequence
  chemically synthesized
tggaccccaatttcaaataa

SEQ ID NO: 202881 - DNA, 20 bp, Artificial Sequence
  chemically synthesized
aatttcaaataaaagacctg

SEQ ID NO: 202882 - DNA, 20 bp, Artificial Sequence
  chemically synthesized
aggaataaatgtatcacttc

SEQ ID NO: 202883 - DNA, 20 bp, Artificial Sequence
  chemically synthesized
aaggaataaatgtatcactt

SEQ ID NO: 202884 - DNA, 20 bp, Artificial Sequence
  chemically synthesized
atggagactctgaagggata

SEQ ID NO: 202885 - DNA, 20 bp, Artificial Sequence
  chemically synthesized
acatttattccttatccctt

SEQ ID NO: 202886 - DNA, 20 bp, Artificial Sequence
  chemically synthesized
aatggagactctgaagggat

SEQ ID NO: 202887 - DNA, 20 bp, Artificial Sequence
  chemically synthesized
atttattccttatcccttca

SEQ ID NO: 202888 - DNA, 20 bp, Artificial Sequence
  chemically synthesized
tagaaaatggagactctgaa

SEQ ID NO: 202889 - DNA, 20 bp, Artificial Sequence
  chemically synthesized
atagaaaatggagactctga

SEQ ID NO: 202890 - DNA, 20 bp, Artificial Sequence
  chemically synthesized
tatagaaaatggagactctg

SEQ ID NO: 202891 - DNA, 20 bp, Artificial Sequence
  chemically synthesized
gggctcgcttatagaaaatg

SEQ ID NO: 202892 - DNA, 20 bp, Artificial Sequence
  chemically synthesized
gggggctcgcttatagaaaa

SEQ ID NO: 202893 - DNA, 20 bp, Artificial Sequence
  chemically synthesized
tcagagtctccattttctat

SEQ ID NO: 202894 - DNA, 20 bp, Artificial Sequence
  chemically synthesized
agtctccattttctataagc

SEQ ID NO: 202895 - DNA, 20 bp, Artificial Sequence
  chemically synthesized
ttgtggagggggctcgctta

SEQ ID NO: 202896 - DNA, 20 bp, Artificial Sequence
  chemically synthesized
taatggtgcgtttgtggagg

SEQ ID NO: 202897 - DNA, 20 bp, Artificial Sequence
  chemically synthesized
ttaatggtgcgtttgtggag

SEQ ID NO: 202898 - DNA, 20 bp, Artificial Sequence
  chemically synthesized
tttaatggtgcgtttgtgga

SEQ ID NO: 202899 - DNA, 20 bp, Artificial Sequence
  chemically synthesized
gtttaatggtgcgtttgtgg

SEQ ID NO: 202900 - DNA, 20 bp, Artificial Sequence
  chemically synthesized
ggtttaatggtgcgtttgtg

SEQ ID NO: 202901 - DNA, 20 bp, Artificial Sequence
  chemically synthesized
caggtttaatggtgcgtttg

SEQ ID NO: 202902 - DNA, 20 bp, Artificial Sequence
  chemically synthesized
catagattgtacaggtttaa

SEQ ID NO: 202903 - DNA, 20 bp, Artificial Sequence
  chemically synthesized
attgttgtcatagattgtac

SEQ ID NO: 202904 - DNA, 20 bp, Artificial Sequence
  chemically synthesized
cattgttgtcatagattgta

SEQ ID NO: 202905 - DNA, 20 bp, Artificial Sequence
  chemically synthesized
ataaattcccattgttgtca

SEQ ID NO: 202906 - DNA, 20 bp, Artificial Sequence
  chemically synthesized
tgtacaatctatgacaacaa

SEQ ID NO: 202907 - DNA, 20 bp, Artificial Sequence
  chemically synthesized
gtacaatctatgacaacaat

SEQ ID NO: 202908 - DNA, 20 bp, Artificial Sequence
  chemically synthesized
acaacaatgggaatttatcc

SEQ ID NO: 202909 - DNA, 20 bp, Artificial Sequence
  chemically synthesized
atgggaatttatccaagatg

SEQ ID NO: 202910 - DNA, 20 bp, Artificial Sequence
  chemically synthesized
tcacttctacgtctacatct

SEQ ID NO: 202911 - DNA, 20 bp, Artificial Sequence
  chemically synthesized
atttatccaagatgtagacg

SEQ ID NO: 202912 - DNA, 20 bp, Artificial Sequence
  chemically synthesized
tatccaagatgtagacgtag

SEQ ID NO: 202913 - DNA, 20 bp, Artificial Sequence
  chemically synthesized
agatgtagacgtagaagtga

SEQ ID NO: 202914 - DNA, 20 bp, Artificial Sequence
  chemically synthesized
gatgtagacgtagaagtgat

SEQ ID NO: 202915 - DNA, 20 bp, Artificial Sequence
  chemically synthesized
gacgtagaagtgatgggtca

SEQ ID NO: 202916 - DNA, 20 bp, Artificial Sequence
  chemically synthesized
tgatgggtcaaagtgatcca

SEQ ID NO: 202917 - DNA, 20 bp, Artificial Sequence
  chemically synthesized
atggtatctgatgtgaactg

SEQ ID NO: 202918 - DNA, 20 bp, Artificial Sequence
  chemically synthesized
aagtgatccacagttcacat

SEQ ID NO: 202919 - DNA, 20 bp, Artificial Sequence
  chemically synthesized
agttcacatcagataccatt

SEQ ID NO: 202920 - DNA, 20 bp, Artificial Sequence
  chemically synthesized
agagctataaaaacacttaa

SEQ ID NO: 202921 - DNA, 20 bp, Artificial Sequence
  chemically synthesized
gataccattaagtgttttta

SEQ ID NO: 202922 - DNA, 20 bp, Artificial Sequence
  chemically synthesized
cttatactagaggaggtaaa

SEQ ID NO: 202923 - DNA, 20 bp, Artificial Sequence
  chemically synthesized
tccttatactagaggaggta

SEQ ID NO: 202924 - DNA, 20 bp, Artificial Sequence
  chemically synthesized
ttatagctctttacctcctc

SEQ ID NO: 202925 - DNA, 20 bp, Artificial Sequence
  chemically synthesized
ttgagtccttatactagagg

SEQ ID NO: 202926 - DNA, 20 bp, Artificial Sequence
  chemically synthesized
tttgagtccttatactagag

SEQ ID NO: 202927 - DNA, 20 bp, Artificial Sequence
  chemically synthesized
ctctttacctcctctagtat

SEQ ID NO: 202928 - DNA, 20 bp, Artificial Sequence
  chemically synthesized
tttttgagtccttatactag

SEQ ID NO: 202929 - DNA, 20 bp, Artificial Sequence
  chemically synthesized
tctttacctcctctagtata

SEQ ID NO: 202930 - DNA, 20 bp, Artificial Sequence
  chemically synthesized
atttttgagtccttatacta

SEQ ID NO: 202931 - DNA, 20 bp, Artificial Sequence
  chemically synthesized
gtatttttgagtccttatac

SEQ ID NO: 202932 - DNA, 20 bp, Artificial Sequence
  chemically synthesized
agtataaggactcaaaaata

SEQ ID NO: 202933 - DNA, 20 bp, Artificial Sequence
  chemically synthesized
atcattcaagctgtattttt

SEQ ID NO: 202934 - DNA, 20 bp, Artificial Sequence
  chemically synthesized
ttcaattttctggatcattc

SEQ ID NO: 202935 - DNA, 20 bp, Artificial Sequence
  chemically synthesized
aaaatacagcttgaatgatc

SEQ ID NO: 202936 - DNA, 20 bp, Artificial Sequence
  chemically synthesized
gcctgataccttcaattttc

SEQ ID NO: 202937 - DNA, 20 bp, Artificial Sequence
  chemically synthesized
ttgaatgatccagaaaattg

SEQ ID NO: 202938 - DNA, 20 bp, Artificial Sequence
  chemically synthesized
tgaatgatccagaaaattga

SEQ ID NO: 202939 - DNA, 20 bp, Artificial Sequence
  chemically synthesized
atccagaaaattgaaggtat

SEQ ID NO: 202940 - DNA, 20 bp, Artificial Sequence
  chemically synthesized
tccagaaaattgaaggtatc

SEQ ID NO: 202941 - DNA, 20 bp, Artificial Sequence
  chemically synthesized
aaattgaaggtatcaggctt

SEQ ID NO: 202942 - DNA, 20 bp, Artificial Sequence
  chemically synthesized
ctaattgttaggtatcacta

SEQ ID NO: 202943 - DNA, 20 bp, Artificial Sequence
  chemically synthesized
ctttagtgatacctaacaat

SEQ ID NO: 202944 - DNA, 20 bp, Artificial Sequence
  chemically synthesized
acctcatccaactaattgtt

SEQ ID NO: 202945 - DNA, 20 bp, Artificial Sequence
  chemically synthesized
aacctcatccaactaattgt

SEQ ID NO: 202946 - DNA, 20 bp, Artificial Sequence
  chemically synthesized
agtgatacctaacaattagt

SEQ ID NO: 202947 - DNA, 20 bp, Artificial Sequence
  chemically synthesized
tacctaacaattagttggat

SEQ ID NO: 202948 - DNA, 20 bp, Artificial Sequence
  chemically synthesized
acctaacaattagttggatg

SEQ ID NO: 202949 - DNA, 20 bp, Artificial Sequence
  chemically synthesized
tggatgaggttctgcacttg

SEQ ID NO: 202950 - DNA, 20 bp, Artificial Sequence
  chemically synthesized
ggatgaggttctgcacttga

SEQ ID NO: 202951 - DNA, 20 bp, Artificial Sequence
  chemically synthesized
aaccaagtgcccttcaagtg

SEQ ID NO: 202952 - DNA, 20 bp, Artificial Sequence
  chemically synthesized
gatgaggttctgcacttgaa

SEQ ID NO: 202953 - DNA, 20 bp, Artificial Sequence
  chemically synthesized
tgaaaaaccaagtgcccttc

SEQ ID NO: 202954 - DNA, 20 bp, Artificial Sequence
  chemically synthesized
ttctgcacttgaagggcact

SEQ ID NO: 202955 - DNA, 20 bp, Artificial Sequence
  chemically synthesized
ttgaagggcacttggttttt

SEQ ID NO: 202956 - DNA, 20 bp, Artificial Sequence
  chemically synthesized
atcttccttcctgaaaaacc

SEQ ID NO: 202957 - DNA, 20 bp, Artificial Sequence
  chemically synthesized
tgaagggcacttggtttttc

SEQ ID NO: 202958 - DNA, 20 bp, Artificial Sequence
  chemically synthesized
agggcacttggtttttcagg

SEQ ID NO: 202959 - DNA, 20 bp, Artificial Sequence
  chemically synthesized
gggcacttggtttttcagga

SEQ ID NO: 202960 - DNA, 20 bp, Artificial Sequence
  chemically synthesized
cacttggtttttcaggaagg

SEQ ID NO: 202961 - DNA, 20 bp, Artificial Sequence
  chemically synthesized
caggaaggaagatttttttt

SEQ ID NO: 202962 - DNA, 20 bp, Artificial Sequence
  chemically synthesized
agtaatttttgtattcttac

SEQ ID NO: 202963 - DNA, 20 bp, Artificial Sequence
  chemically synthesized
gtaatttttgtattcttact

SEQ ID NO: 202964 - DNA, 20 bp, Artificial Sequence
  chemically synthesized
taatttttgtattcttactg

SEQ ID NO: 202965 - DNA, 20 bp, Artificial Sequence
  chemically synthesized
agtgtaaggaacaccccagt

SEQ ID NO: 202966 - DNA, 20 bp, Artificial Sequence
  chemically synthesized
atacagtgtaaggaacaccc

SEQ ID NO: 202967 - DNA, 20 bp, Artificial Sequence
  chemically synthesized
tagggatggaatacagtgta

SEQ ID NO: 202968 - DNA, 20 bp, Artificial Sequence
  chemically synthesized
ttagggatggaatacagtgt

SEQ ID NO: 202969 - DNA, 20 bp, Artificial Sequence
  chemically synthesized
attttcttagggatggaata

SEQ ID NO: 202970 - DNA, 20 bp, Artificial Sequence
  chemically synthesized
ttacactgtattccatccct

SEQ ID NO: 202971 - DNA, 20 bp, Artificial Sequence
  chemically synthesized
aagtagcattttcttaggga

SEQ ID NO: 202972 - DNA, 20 bp, Artificial Sequence
  chemically synthesized
gaaaaagtagcattttctta

SEQ ID NO: 202973 - DNA, 20 bp, Artificial Sequence
  chemically synthesized
tgaaaaagtagcattttctt

SEQ ID NO: 202974 - DNA, 20 bp, Artificial Sequence
  chemically synthesized
atgaaaaagtagcattttct

SEQ ID NO: 202975 - DNA, 20 bp, Artificial Sequence
  chemically synthesized
tacaactgataatgaaaaag

SEQ ID NO: 202976 - DNA, 20 bp, Artificial Sequence
  chemically synthesized
caatacaactgataatgaaa

SEQ ID NO: 202977 - DNA, 20 bp, Artificial Sequence
  chemically synthesized
aaatgctactttttcattat

SEQ ID NO: 202978 - DNA, 20 bp, Artificial Sequence
  chemically synthesized
tgtattgccaattagatgtc

SEQ ID NO: 202979 - DNA, 20 bp, Artificial Sequence
  chemically synthesized
attgtatcttgacatctaat

SEQ ID NO: 202980 - DNA, 20 bp, Artificial Sequence
  chemically synthesized
aaatgtggtgtattgccaat

SEQ ID NO: 202981 - DNA, 20 bp, Artificial Sequence
  chemically synthesized
agataatttatagagaaatg

SEQ ID NO: 202982 - DNA, 20 bp, Artificial Sequence
  chemically synthesized
tttaaacgagataatttata

SEQ ID NO: 202983 - DNA, 20 bp, Artificial Sequence
  chemically synthesized
tgtttaaacgagataattta

SEQ ID NO: 202984 - DNA, 20 bp, Artificial Sequence
  chemically synthesized
tataaattatctcgtttaaa

SEQ ID NO: 202985 - DNA, 20 bp, Artificial Sequence
  chemically synthesized
aggaaagtaactgtttaaac

SEQ ID NO: 202986 - DNA, 20 bp, Artificial Sequence
  chemically synthesized
cgtttaaacagttactttcc

SEQ ID NO: 202987 - DNA, 20 bp, Artificial Sequence
  chemically synthesized
ttaaatatacttaactagga

SEQ ID NO: 202988 - DNA, 20 bp, Artificial Sequence
  chemically synthesized
aaacagttactttcctagtt

SEQ ID NO: 202989 - DNA, 20 bp, Artificial Sequence
  chemically synthesized
gttgttaaatatacttaact

SEQ ID NO: 202990 - DNA, 20 bp, Artificial Sequence
  chemically synthesized
agttgttaaatatacttaac

SEQ ID NO: 202991 - DNA, 20 bp, Artificial Sequence
  chemically synthesized
gttaagtatatttaacaact

SEQ ID NO: 202992 - DNA, 20 bp, Artificial Sequence
  chemically synthesized
ttaaaaaactgtcagaatct

SEQ ID NO: 202993 - DNA, 20 bp, Artificial Sequence
  chemically synthesized
tttaacaacttagattctga

SEQ ID NO: 202994 - DNA, 20 bp, Artificial Sequence
  chemically synthesized
tacgtttattaaaaaactgt

SEQ ID NO: 202995 - DNA, 20 bp, Artificial Sequence
  chemically synthesized
gttttttaataaacgtattt

SEQ ID NO: 202996 - DNA, 20 bp, Artificial Sequence
  chemically synthesized
ttggtatttttaattaaaat

SEQ ID NO: 202997 - DNA, 20 bp, Artificial Sequence
  chemically synthesized
gtatttttaattaaaatcag

SEQ ID NO: 202998 - DNA, 20 bp, Artificial Sequence
  chemically synthesized
atttttaattaaaatcagta

SEQ ID NO: 202999 - DNA, 20 bp, Artificial Sequence
  chemically synthesized
atcagtagagtataaacaaa

SEQ ID NO: 203000 - DNA, 20 bp, Artificial Sequence
  chemically synthesized
aaacaaatagaaacacacta

SEQ ID NO: 203001 - DNA, 20 bp, Artificial Sequence
  chemically synthesized
ttaaaatgcataattgtctt

SEQ ID NO: 203002 - DNA, 20 bp, Artificial Sequence
  chemically synthesized
attttaataaaacaaatgtg

SEQ ID NO: 203003 - DNA, 20 bp, Artificial Sequence
  chemically synthesized
ttttaataaaacaaatgtgc

SEQ ID NO: 203004 - DNA, 20 bp, Artificial Sequence
  chemically synthesized
ataaaacaaatgtgcaggtc

SEQ ID NO: 203005 - DNA, 20 bp, Artificial Sequence
  chemically synthesized
caagagtctatgaacatttc

SEQ ID NO: 203006 - DNA, 20 bp, Artificial Sequence
  chemically synthesized
tgcaggtccggaaatgttca

SEQ ID NO: 203007 - DNA, 20 bp, Artificial Sequence
  chemically synthesized
ctaaaggtaaataaaatcaa

SEQ ID NO: 203008 - DNA, 20 bp, Artificial Sequence
  chemically synthesized
tactaaaggtaaataaaatc

SEQ ID NO: 203009 - DNA, 20 bp, Artificial Sequence
  chemically synthesized
ctcttgattttatttacctt

SEQ ID NO: 203010 - DNA, 20 bp, Artificial Sequence
  chemically synthesized
cacatttggtataatactaa

SEQ ID NO: 203011 - DNA, 20 bp, Artificial Sequence
  chemically synthesized
tcacatttggtataatacta

SEQ ID NO: 203012 - DNA, 20 bp, Artificial Sequence
  chemically synthesized
gaaaaatgactggtcacatt

SEQ ID NO: 203013 - DNA, 20 bp, Artificial Sequence
  chemically synthesized
agtattataccaaatgtgac

SEQ ID NO: 203014 - DNA, 20 bp, Artificial Sequence
  chemically synthesized
gctcaaatttgaaaaatgac

SEQ ID NO: 203015 - DNA, 20 bp, Artificial Sequence
  chemically synthesized
accagtcatttttcaaattt

SEQ ID NO: 203016 - DNA, 20 bp, Artificial Sequence
  chemically synthesized
tcatttttcaaatttgagca

SEQ ID NO: 203017 - DNA, 20 bp, Artificial Sequence
  chemically synthesized
cctatactatttgatatagg

SEQ ID NO: 203018 - DNA, 20 bp, Artificial Sequence
  chemically synthesized
acccctatactatttgatat

SEQ ID NO: 203019 - DNA, 20 bp, Artificial Sequence
  chemically synthesized
ttttttctgcctatatcaaa

SEQ ID NO: 203020 - DNA, 20 bp, Artificial Sequence
  chemically synthesized
gacccctatactatttgata

SEQ ID NO: 203021 - DNA, 20 bp, Artificial Sequence
  chemically synthesized
tctgcctatatcaaatagta

SEQ ID NO: 203022 - DNA, 20 bp, Artificial Sequence
  chemically synthesized
ctgcctatatcaaatagtat

SEQ ID NO: 203023 - DNA, 20 bp, Artificial Sequence
  chemically synthesized
tgcctatatcaaatagtata

SEQ ID NO: 203024 - DNA, 20 bp, Artificial Sequence
  chemically synthesized
gcctatatcaaatagtatag

SEQ ID NO: 203025 - DNA, 20 bp, Artificial Sequence
  chemically synthesized
aatagtataggggtccaaaa

SEQ ID NO: 203026 - DNA, 20 bp, Artificial Sequence
  chemically synthesized
atagtataggggtccaaaac

SEQ ID NO: 203027 - DNA, 20 bp, Artificial Sequence
  chemically synthesized
aactccctaaaaacctgttt

SEQ ID NO: 203028 - DNA, 20 bp, Artificial Sequence
  chemically synthesized
aggggtccaaaacaggtttt

SEQ ID NO: 203029 - DNA, 20 bp, Artificial Sequence
  chemically synthesized
ggggtccaaaacaggttttt

SEQ ID NO: 203030 - DNA, 20 bp, Artificial Sequence
  chemically synthesized
gggtccaaaacaggttttta

SEQ ID NO: 203031 - DNA, 20 bp, Artificial Sequence
  chemically synthesized
gtccaaaacaggtttttagg

SEQ ID NO: 203032 - DNA, 20 bp, Artificial Sequence
  chemically synthesized
caggtttttagggagttatt

SEQ ID NO: 203033 - DNA, 20 bp, Artificial Sequence
  chemically synthesized
ttagggagttattaagtcta

SEQ ID NO: 203034 - DNA, 20 bp, Artificial Sequence
  chemically synthesized
cctaaaagcataattttcta

SEQ ID NO: 203035 - DNA, 20 bp, Artificial Sequence
  chemically synthesized
tctatagaaaattatgcttt

SEQ ID NO: 203036 - DNA, 20 bp, Artificial Sequence
  chemically synthesized
ctatagaaaattatgctttt

SEQ ID NO: 203037 - DNA, 20 bp, Artificial Sequence
  chemically synthesized
tagaaaattatgcttttagg

SEQ ID NO: 203038 - DNA, 20 bp, Artificial Sequence
  chemically synthesized
ataagcacaacacttcctaa

SEQ ID NO: 203039 - DNA, 20 bp, Artificial Sequence
  chemically synthesized
ggaagtgttgtgcttatgcc

SEQ ID NO: 203040 - DNA, 20 bp, Artificial Sequence
  chemically synthesized
atgcttctcccacttggcat

SEQ ID NO: 203041 - DNA, 20 bp, Artificial Sequence
  chemically synthesized
agtgttgtgcttatgccaag

SEQ ID NO: 203042 - DNA, 20 bp, Artificial Sequence
  chemically synthesized
gtgttgtgcttatgccaagt

SEQ ID NO: 203043 - DNA, 20 bp, Artificial Sequence
  chemically synthesized
gttgtgcttatgccaagtgg

SEQ ID NO: 203044 - DNA, 20 bp, Artificial Sequence
  chemically synthesized
attattatgcttctcccact

SEQ ID NO: 203045 - DNA, 20 bp, Artificial Sequence
  chemically synthesized
gtgcttatgccaagtgggag

SEQ ID NO: 203046 - DNA, 20 bp, Artificial Sequence
  chemically synthesized
aagcataataataaaataca

SEQ ID NO: 203047 - DNA, 20 bp, Artificial Sequence
  chemically synthesized
agtttacaaattatactgcc

SEQ ID NO: 203048 - DNA, 20 bp, Artificial Sequence
  chemically synthesized
gtttacaaattatactgcct

SEQ ID NO: 203049 - DNA, 20 bp, Artificial Sequence
  chemically synthesized
tagtaattgtataacctagg

SEQ ID NO: 203050 - DNA, 20 bp, Artificial Sequence
  chemically synthesized
atgtagtaattgtataacct

SEQ ID NO: 203051 - DNA, 20 bp, Artificial Sequence
  chemically synthesized
tatgtagtaattgtataacc

SEQ ID NO: 203052 - DNA, 20 bp, Artificial Sequence
  chemically synthesized
aaattttattttcaattatg

SEQ ID NO: 203053 - DNA, 20 bp, Artificial Sequence
  chemically synthesized
tagataaatgatgtacacag

SEQ ID NO: 203054 - DNA, 20 bp, Artificial Sequence
  chemically synthesized
atatagataaatgatgtaca

SEQ ID NO: 203055 - DNA, 20 bp, Artificial Sequence
  chemically synthesized
tacatcatttatctatatca

SEQ ID NO: 203056 - DNA, 20 bp, Artificial Sequence
  chemically synthesized
aagcataggtaactttgata

SEQ ID NO: 203057 - DNA, 20 bp, Artificial Sequence
  chemically synthesized
agtgatttcaaattaagcat

SEQ ID NO: 203058 - DNA, 20 bp, Artificial Sequence
  chemically synthesized
cagtgatttcaaattaagca

SEQ ID NO: 203059 - DNA, 20 bp, Artificial Sequence
  chemically synthesized
tattacagtgatttcaaatt

SEQ ID NO: 203060 - DNA, 20 bp, Artificial Sequence
  chemically synthesized
ttcatttatcagcattatta

SEQ ID NO: 203061 - DNA, 20 bp, Artificial Sequence
  chemically synthesized
aattcaattctttcatttat

SEQ ID NO: 203062 - DNA, 20 bp, Artificial Sequence
  chemically synthesized
gtaataatgctgataaatga

SEQ ID NO: 203063 - DNA, 20 bp, Artificial Sequence
  chemically synthesized
tttaattgtacattttaatg

SEQ ID NO: 203064 - DNA, 20 bp, Artificial Sequence
  chemically synthesized
agtacagttgcatatttagc

SEQ ID NO: 203065 - DNA, 20 bp, Artificial Sequence
  chemically synthesized
aagtacagttgcatatttag

SEQ ID NO: 203066 - DNA, 20 bp, Artificial Sequence
  chemically synthesized
aaaaagtacagttgcatatt

SEQ ID NO: 203067 - DNA, 20 bp, Artificial Sequence
  chemically synthesized
aaaggcacatataaaaagta

SEQ ID NO: 203068 - DNA, 20 bp, Artificial Sequence
  chemically synthesized
acaataaaggcacatataaa

SEQ ID NO: 203069 - DNA, 20 bp, Artificial Sequence
  chemically synthesized
ttttatatgtgcctttattg

SEQ ID NO: 203070 - DNA, 20 bp, Artificial Sequence
  chemically synthesized
ttctatccttactacaataa

SEQ ID NO: 203071 - DNA, 20 bp, Artificial Sequence
  chemically synthesized
tttctatccttactacaata

SEQ ID NO: 203072 - DNA, 20 bp, Artificial Sequence
  chemically synthesized
atatgtgcctttattgtagt

SEQ ID NO: 203073 - DNA, 20 bp, Artificial Sequence
  chemically synthesized
tatgtgcctttattgtagta

SEQ ID NO: 203074 - DNA, 20 bp, Artificial Sequence
  chemically synthesized
tgcctttattgtagtaagga

SEQ ID NO: 203075 - DNA, 20 bp, Artificial Sequence
  chemically synthesized
atcattccttatagaacata

SEQ ID NO: 203076 - DNA, 20 bp, Artificial Sequence
  chemically synthesized
aatcattccttatagaacat

SEQ ID NO: 203077 - DNA, 20 bp, Artificial Sequence
  chemically synthesized
atgtaaaccttatgttctat

SEQ ID NO: 203078 - DNA, 20 bp, Artificial Sequence
  chemically synthesized
tgtaaaccttatgttctata

SEQ ID NO: 203079 - DNA, 20 bp, Artificial Sequence
  chemically synthesized
ttttaagaaatcattcctta

SEQ ID NO: 203080 - DNA, 20 bp, Artificial Sequence
  chemically synthesized
ataaggaatgatttcttaaa

SEQ ID NO: 203081 - DNA, 20 bp, Artificial Sequence
  chemically synthesized
taaggaatgatttcttaaaa

SEQ ID NO: 203082 - DNA, 20 bp, Artificial Sequence
  chemically synthesized
aaggaatgatttcttaaaaa

SEQ ID NO: 203083 - DNA, 20 bp, Artificial Sequence
  chemically synthesized
ggaatgatttcttaaaaagg

SEQ ID NO: 203084 - DNA, 20 bp, Artificial Sequence
  chemically synthesized
ttgtaatagactcccttttt

SEQ ID NO: 203085 - DNA, 20 bp, Artificial Sequence
  chemically synthesized
aaaagggagtctattacaat

SEQ ID NO: 203086 - DNA, 20 bp, Artificial Sequence
  chemically synthesized
tatgatattactgattgtaa

SEQ ID NO: 203087 - DNA, 20 bp, Artificial Sequence
  chemically synthesized
agtaatatcataaaatttta

SEQ ID NO: 203088 - DNA, 20 bp, Artificial Sequence
  chemically synthesized
tcataaaattttaaagataa

SEQ ID NO: 203089 - DNA, 20 bp, Artificial Sequence
  chemically synthesized
gataatagatgtttttcatc

SEQ ID NO: 203090 - DNA, 20 bp, Artificial Sequence
  chemically synthesized
catggtgaagcattttgaac

SEQ ID NO: 203091 - DNA, 20 bp, Artificial Sequence
  chemically synthesized
gttcaaaatgcttcaccatg

SEQ ID NO: 203092 - DNA, 20 bp, Artificial Sequence
  chemically synthesized
atcaaaaagcccacatggtg

SEQ ID NO: 203093 - DNA, 20 bp, Artificial Sequence
  chemically synthesized
ttcaaaatgcttcaccatgt

SEQ ID NO: 203094 - DNA, 20 bp, Artificial Sequence
  chemically synthesized
ataggatcaaaaagcccaca

SEQ ID NO: 203095 - DNA, 20 bp, Artificial Sequence
  chemically synthesized
tttttaaagataggatcaaa

SEQ ID NO: 203096 - DNA, 20 bp, Artificial Sequence
  chemically synthesized
acacaaaagtttttaaagat

SEQ ID NO: 203097 - DNA, 20 bp, Artificial Sequence
  chemically synthesized
gacacaaaagtttttaaaga

SEQ ID NO: 203098 - DNA, 20 bp, Artificial Sequence
  chemically synthesized
catggacacaaaagttttta

SEQ ID NO: 203099 - DNA, 20 bp, Artificial Sequence
  chemically synthesized
tatacttctcatggacacaa

SEQ ID NO: 203100 - DNA, 20 bp, Artificial Sequence
  chemically synthesized
ttaaaaacttttgtgtccat

SEQ ID NO: 203101 - DNA, 20 bp, Artificial Sequence
  chemically synthesized
aaaacttttgtgtccatgag

SEQ ID NO: 203102 - DNA, 20 bp, Artificial Sequence
  chemically synthesized
tacctaacttatacttctca

SEQ ID NO: 203103 - DNA, 20 bp, Artificial Sequence
  chemically synthesized
tttgtgtccatgagaagtat

SEQ ID NO: 203104 - DNA, 20 bp, Artificial Sequence
  chemically synthesized
tgtccatgagaagtataagt

SEQ ID NO: 203105 - DNA, 20 bp, Artificial Sequence
  chemically synthesized
gtccatgagaagtataagtt

SEQ ID NO: 203106 - DNA, 20 bp, Artificial Sequence
  chemically synthesized
atgagaagtataagttaggt

SEQ ID NO: 203107 - DNA, 20 bp, Artificial Sequence
  chemically synthesized
ataagttaggtaagttttct

SEQ ID NO: 203108 - DNA, 20 bp, Artificial Sequence
  chemically synthesized
tgtttttatttcagttaact

SEQ ID NO: 203109 - DNA, 20 bp, Artificial Sequence
  chemically synthesized
aattcaatgtgtttttattt

SEQ ID NO: 203110 - DNA, 20 bp, Artificial Sequence
  chemically synthesized
cattgaatttcttaaaatcc

SEQ ID NO: 203111 - DNA, 20 bp, Artificial Sequence
  chemically synthesized
cactattttgctaggatttt

SEQ ID NO: 203112 - DNA, 20 bp, Artificial Sequence
  chemically synthesized
ttcttaaaatcctagcaaaa

SEQ ID NO: 203113 - DNA, 20 bp, Artificial Sequence
  chemically synthesized
ttattttacactattttgct

SEQ ID NO: 203114 - DNA, 20 bp, Artificial Sequence
  chemically synthesized
gttattttacactattttgc

SEQ ID NO: 203115 - DNA, 20 bp, Artificial Sequence
  chemically synthesized
agtgtaaaataacgtaccta

SEQ ID NO: 203116 - DNA, 20 bp, Artificial Sequence
  chemically synthesized
gatgtgccagagaagactat

SEQ ID NO: 203117 - DNA, 20 bp, Artificial Sequence
  chemically synthesized
agatgtgccagagaagacta

SEQ ID NO: 203118 - DNA, 20 bp, Artificial Sequence
  chemically synthesized
aacgtacctatagtcttctc

SEQ ID NO: 203119 - DNA, 20 bp, Artificial Sequence
  chemically synthesized
catataaagatgtgccagag

SEQ ID NO: 203120 - DNA, 20 bp, Artificial Sequence
  chemically synthesized
attcatataaagatgtgcca

SEQ ID NO: 203121 - DNA, 20 bp, Artificial Sequence
  chemically synthesized
ttattcatataaagatgtgc

SEQ ID NO: 203122 - DNA, 20 bp, Artificial Sequence
  chemically synthesized
tgattcacgttattcatata

SEQ ID NO: 203123 - DNA, 20 bp, Artificial Sequence
  chemically synthesized
taaatgaaatacatatttca

SEQ ID NO: 203124 - DNA, 20 bp, Artificial Sequence
  chemically synthesized
gtaaatgaaatacatatttc

SEQ ID NO: 203125 - DNA, 20 bp, Artificial Sequence
  chemically synthesized
gtatttcatttacattgcct

SEQ ID NO: 203126 - DNA, 20 bp, Artificial Sequence
  chemically synthesized
tatttcatttacattgcctc

SEQ ID NO: 203127 - DNA, 20 bp, Artificial Sequence
  chemically synthesized
aaaaagaggaagttagcctg

SEQ ID NO: 203128 - DNA, 20 bp, Artificial Sequence
  chemically synthesized
aaaaaagaggaagttagcct

SEQ ID NO: 203129 - DNA, 20 bp, Artificial Sequence
  chemically synthesized
aaaaaaaaaaaagaggaagt

SEQ ID NO: 203130 - DNA, 20 bp, Artificial Sequence
  chemically synthesized
gggaaaaaaaaaaaaagagg

SEQ ID NO: 203131 - DNA, 20 bp, Artificial Sequence
  chemically synthesized
agggggaaaaaaaaaaaaag

SEQ ID NO: 203132 - DNA, 20 bp, Artificial Sequence
  chemically synthesized
tagggggaaaaaaaaaaaaa

SEQ ID NO: 203133 - DNA, 20 bp, Artificial Sequence
  chemically synthesized
attagggggaaaaaaaaaaa

SEQ ID NO: 203134 - DNA, 20 bp, Artificial Sequence
  chemically synthesized
ttttttttttttccccctaa

SEQ ID NO: 203135 - DNA, 20 bp, Artificial Sequence
  chemically synthesized
ttttttttttccccctaata

SEQ ID NO: 203136 - DNA, 20 bp, Artificial Sequence
  chemically synthesized
gagagcctgtctctattagg

SEQ ID NO: 203137 - DNA, 20 bp, Artificial Sequence
  chemically synthesized
tgagagcctgtctctattag

SEQ ID NO: 203138 - DNA, 20 bp, Artificial Sequence
  chemically synthesized
gtgagagcctgtctctatta

SEQ ID NO: 203139 - DNA, 20 bp, Artificial Sequence
  chemically synthesized
agtgagagcctgtctctatt

SEQ ID NO: 203140 - DNA, 20 bp, Artificial Sequence
  chemically synthesized
ttttttccccctaatagaga

SEQ ID NO: 203141 - DNA, 20 bp, Artificial Sequence
  chemically synthesized
cagtgagagcctgtctctat

SEQ ID NO: 203142 - DNA, 20 bp, Artificial Sequence
  chemically synthesized
tttttccccctaatagagac

SEQ ID NO: 203143 - DNA, 20 bp, Artificial Sequence
  chemically synthesized
cagcctgggcaacacagtga

SEQ ID NO: 203144 - DNA, 20 bp, Artificial Sequence
  chemically synthesized
accagcctgggcaacacagt

SEQ ID NO: 203145 - DNA, 20 bp, Artificial Sequence
  chemically synthesized
caggctctcactgtgttgcc

SEQ ID NO: 203146 - DNA, 20 bp, Artificial Sequence
  chemically synthesized
caaaaccagcctgggcaaca

SEQ ID NO: 203147 - DNA, 20 bp, Artificial Sequence
  chemically synthesized
aggctctcactgtgttgccc

SEQ ID NO: 203148 - DNA, 20 bp, Artificial Sequence
  chemically synthesized
tctcactgtgttgcccaggc

SEQ ID NO: 203149 - DNA, 20 bp, Artificial Sequence
  chemically synthesized
caggagttcaaaaccagcct

SEQ ID NO: 203150 - DNA, 20 bp, Artificial Sequence
  chemically synthesized
ccaggagttcaaaaccagcc

SEQ ID NO: 203151 - DNA, 20 bp, Artificial Sequence
  chemically synthesized
tgagcccaggagttcaaaac

SEQ ID NO: 203152 - DNA, 20 bp, Artificial Sequence
  chemically synthesized
ccaggctggttttgaactcc

SEQ ID NO: 203153 - DNA, 20 bp, Artificial Sequence
  chemically synthesized
caggctggttttgaactcct

SEQ ID NO: 203154 - DNA, 20 bp, Artificial Sequence
  chemically synthesized
ggattatcgattgagcccag

SEQ ID NO: 203155 - DNA, 20 bp, Artificial Sequence
  chemically synthesized
tgggattatcgattgagccc

SEQ ID NO: 203156 - DNA, 20 bp, Artificial Sequence
  chemically synthesized
gtgggattatcgattgagcc

SEQ ID NO: 203157 - DNA, 20 bp, Artificial Sequence
  chemically synthesized
ccaaggtgggattatcgatt

SEQ ID NO: 203158 - DNA, 20 bp, Artificial Sequence
  chemically synthesized
ctcaatcgataatcccacct

SEQ ID NO: 203159 - DNA, 20 bp, Artificial Sequence
  chemically synthesized
gcatttttggaggccaaggt

SEQ ID NO: 203160 - DNA, 20 bp, Artificial Sequence
  chemically synthesized
agcatttttggaggccaagg

SEQ ID NO: 203161 - DNA, 20 bp, Artificial Sequence
  chemically synthesized
cccagcatttttggaggcca

SEQ ID NO: 203162 - DNA, 20 bp, Artificial Sequence
  chemically synthesized
tcccagcatttttggaggcc

SEQ ID NO: 203163 - DNA, 20 bp, Artificial Sequence
  chemically synthesized
tgtaatcccagcatttttgg

SEQ ID NO: 203164 - DNA, 20 bp, Artificial Sequence
  chemically synthesized
ctgtaatcccagcatttttg

SEQ ID NO: 203165 - DNA, 20 bp, Artificial Sequence
  chemically synthesized
accttggcctccaaaaatgc

SEQ ID NO: 203166 - DNA, 20 bp, Artificial Sequence
  chemically synthesized
acctgtaatcccagcatttt

SEQ ID NO: 203167 - DNA, 20 bp, Artificial Sequence
  chemically synthesized
ccttggcctccaaaaatgct

SEQ ID NO: 203168 - DNA, 20 bp, Artificial Sequence
  chemically synthesized
ctccaaaaatgctgggatta

SEQ ID NO: 203169 - DNA, 20 bp, Artificial Sequence
  chemically synthesized
tccaaaaatgctgggattac

SEQ ID NO: 203170 - DNA, 20 bp, Artificial Sequence
  chemically synthesized
gtgactcacacctgtaatcc

SEQ ID NO: 203171 - DNA, 20 bp, Artificial Sequence
  chemically synthesized
aatgctgggattacaggtgt

SEQ ID NO: 203172 - DNA, 20 bp, Artificial Sequence
  chemically synthesized
gagtcacatcacccgacttt

SEQ ID NO: 203173 - DNA, 20 bp, Artificial Sequence
  chemically synthesized
agtcacatcacccgactttc

SEQ ID NO: 203174 - DNA, 20 bp, Artificial Sequence
  chemically synthesized
aagagggcagcctgaaagtc

SEQ ID NO: 203175 - DNA, 20 bp, Artificial Sequence
  chemically synthesized
caagagggcagcctgaaagt

SEQ ID NO: 203176 - DNA, 20 bp, Artificial Sequence
  chemically synthesized
tgatcaagagggcagcctga

SEQ ID NO: 203177 - DNA, 20 bp, Artificial Sequence
  chemically synthesized
tgtgggtgtgatcaagaggg

SEQ ID NO: 203178 - DNA, 20 bp, Artificial Sequence
  chemically synthesized
aattgtgggtgtgatcaaga

SEQ ID NO: 203179 - DNA, 20 bp, Artificial Sequence
  chemically synthesized
taattgtgggtgtgatcaag

SEQ ID NO: 203180 - DNA, 20 bp, Artificial Sequence
  chemically synthesized
gtaattgtgggtgtgatcaa

SEQ ID NO: 203181 - DNA, 20 bp, Artificial Sequence
  chemically synthesized
cagtaattgtgggtgtgatc

SEQ ID NO: 203182 - DNA, 20 bp, Artificial Sequence
  chemically synthesized
gaaaaaaaatcagtaattgt

SEQ ID NO: 203183 - DNA, 20 bp, Artificial Sequence
  chemically synthesized
tgaaaaaaaatcagtaattg

SEQ ID NO: 203184 - DNA, 20 bp, Artificial Sequence
  chemically synthesized
atttccatttgaaaaaaaat

SEQ ID NO: 203185 - DNA, 20 bp, Artificial Sequence
  chemically synthesized
attactgattttttttcaaa

SEQ ID NO: 203186 - DNA, 20 bp, Artificial Sequence
  chemically synthesized
gaaatgtattttctaacata

SEQ ID NO: 203187 - DNA, 20 bp, Artificial Sequence
  chemically synthesized
gtctaacctatactttatgt

SEQ ID NO: 203188 - DNA, 20 bp, Artificial Sequence
  chemically synthesized
gtattttctaacataaagta

SEQ ID NO: 203189 - DNA, 20 bp, Artificial Sequence
  chemically synthesized
tattttctaacataaagtat

SEQ ID NO: 203190 - DNA, 20 bp, Artificial Sequence
  chemically synthesized
ttctaacataaagtataggt

SEQ ID NO: 203191 - DNA, 20 bp, Artificial Sequence
  chemically synthesized
acagaagggaatttaacatt

SEQ ID NO: 203192 - DNA, 20 bp, Artificial Sequence
  chemically synthesized
agagatgactagacacagaa

SEQ ID NO: 203193 - DNA, 20 bp, Artificial Sequence
  chemically synthesized
cagagatgactagacacaga

SEQ ID NO: 203194 - DNA, 20 bp, Artificial Sequence
  chemically synthesized
gttaaattcccttctgtgtc

SEQ ID NO: 203195 - DNA, 20 bp, Artificial Sequence
  chemically synthesized
acagagatgactagacacag

SEQ ID NO: 203196 - DNA, 20 bp, Artificial Sequence
  chemically synthesized
attacagagatgactagaca

SEQ ID NO: 203197 - DNA, 20 bp, Artificial Sequence
  chemically synthesized
ttcataattacagagatgac

SEQ ID NO: 203198 - DNA, 20 bp, Artificial Sequence
  chemically synthesized
tttgtctcttcataattaca

SEQ ID NO: 203199 - DNA, 20 bp, Artificial Sequence
  chemically synthesized
actttgtctcttcataatta

SEQ ID NO: 203200 - DNA, 20 bp, Artificial Sequence
  chemically synthesized
tagtcatctctgtaattatg

SEQ ID NO: 203201 - DNA, 20 bp, Artificial Sequence
  chemically synthesized
gtcatctctgtaattatgaa

SEQ ID NO: 203202 - DNA, 20 bp, Artificial Sequence
  chemically synthesized
tctgtaattatgaagagaca

SEQ ID NO: 203203 - DNA, 20 bp, Artificial Sequence
  chemically synthesized
gacaaagtttaataatatga

SEQ ID NO: 203204 - DNA, 20 bp, Artificial Sequence
  chemically synthesized
taataatatgaaagctgatg

SEQ ID NO: 203205 - DNA, 20 bp, Artificial Sequence
  chemically synthesized
tggggttattttttcttcat

SEQ ID NO: 203206 - DNA, 20 bp, Artificial Sequence
  chemically synthesized
atgcacatttataaattatg

SEQ ID NO: 203207 - DNA, 20 bp, Artificial Sequence
  chemically synthesized
aatgcacatttataaattat

SEQ ID NO: 203208 - DNA, 20 bp, Artificial Sequence
  chemically synthesized
gaatgcacatttataaatta

SEQ ID NO: 203209 - DNA, 20 bp, Artificial Sequence
  chemically synthesized
atttataaatgtgcattccc

SEQ ID NO: 203210 - DNA, 20 bp, Artificial Sequence
  chemically synthesized
ttataaatgtgcattcccca

SEQ ID NO: 203211 - DNA, 20 bp, Artificial Sequence
  chemically synthesized
caagagccattttcactctg

SEQ ID NO: 203212 - DNA, 20 bp, Artificial Sequence
  chemically synthesized
ccaagagccattttcactct

SEQ ID NO: 203213 - DNA, 20 bp, Artificial Sequence
  chemically synthesized
accaagagccattttcactc

SEQ ID NO: 203214 - DNA, 20 bp, Artificial Sequence
  chemically synthesized
tgcattccccagagtgaaaa

SEQ ID NO: 203215 - DNA, 20 bp, Artificial Sequence
  chemically synthesized
cccagagtgaaaatggctct

SEQ ID NO: 203216 - DNA, 20 bp, Artificial Sequence
  chemically synthesized
attaaaaatgaagttaccaa

SEQ ID NO: 203217 - DNA, 20 bp, Artificial Sequence
  chemically synthesized
aaattaaaaatgaagttacc

SEQ ID NO: 203218 - DNA, 20 bp, Artificial Sequence
  chemically synthesized
cataattgaaattaaaaatg

SEQ ID NO: 203219 - DNA, 20 bp, Artificial Sequence
  chemically synthesized
ttcaattatgtattttatat

SEQ ID NO: 203220 - DNA, 20 bp, Artificial Sequence
  chemically synthesized
tcaattatgtattttatata

SEQ ID NO: 203221 - DNA, 20 bp, Artificial Sequence
  chemically synthesized
tataaggaaaaatcacaaaa

SEQ ID NO: 203222 - DNA, 20 bp, Artificial Sequence
  chemically synthesized
ataaggaaaaatcacaaaat

SEQ ID NO: 203223 - DNA, 20 bp, Artificial Sequence
  chemically synthesized
acaaaataggctgcttactg

SEQ ID NO: 203224 - DNA, 20 bp, Artificial Sequence
  chemically synthesized
tatttcaacactacagtaag

SEQ ID NO: 203225 - DNA, 20 bp, Artificial Sequence
  chemically synthesized
ctatatttcaacactacagt

SEQ ID NO: 203226 - DNA, 20 bp, Artificial Sequence
  chemically synthesized
tacactatatttcaacacta

SEQ ID NO: 203227 - DNA, 20 bp, Artificial Sequence
  chemically synthesized
cttactgtagtgttgaaata

SEQ ID NO: 203228 - DNA, 20 bp, Artificial Sequence
  chemically synthesized
gttgaaatatagtgtaatga

SEQ ID NO: 203229 - DNA, 20 bp, Artificial Sequence
  chemically synthesized
aatgatagaatgtaatttta

SEQ ID NO: 203230 - DNA, 20 bp, Artificial Sequence
  chemically synthesized
aaatgtttaaataaataatt

SEQ ID NO: 203231 - DNA, 20 bp, Artificial Sequence
  chemically synthesized
ataatttagaaaactaaaaa

SEQ ID NO: 203232 - DNA, 20 bp, Artificial Sequence
  chemically synthesized
cataaaaagtaggccatttt

SEQ ID NO: 203233 - DNA, 20 bp, Artificial Sequence
  chemically synthesized
tacttaacatcataaaaagt

SEQ ID NO: 203234 - DNA, 20 bp, Artificial Sequence
  chemically synthesized
atacttaacatcataaaaag

SEQ ID NO: 203235 - DNA, 20 bp, Artificial Sequence
  chemically synthesized
catatacttaacatcataaa

SEQ ID NO: 203236 - DNA, 20 bp, Artificial Sequence
  chemically synthesized
ggcctactttttatgatgtt

SEQ ID NO: 203237 - DNA, 20 bp, Artificial Sequence
  chemically synthesized
tttttatgatgttaagtata

SEQ ID NO: 203238 - DNA, 20 bp, Artificial Sequence
  chemically synthesized
agtatatggaatgctgaatt

SEQ ID NO: 203239 - DNA, 20 bp, Artificial Sequence
  chemically synthesized
tatatggaatgctgaattaa

SEQ ID NO: 203240 - DNA, 20 bp, Artificial Sequence
  chemically synthesized
aaaaatttactctcttaatt

SEQ ID NO: 203241 - DNA, 20 bp, Artificial Sequence
  chemically synthesized
tatggaatgctgaattaaga

SEQ ID NO: 203242 - DNA, 20 bp, Artificial Sequence
  chemically synthesized
ttaagagagtaaatttttct

SEQ ID NO: 203243 - DNA, 20 bp, Artificial Sequence
  chemically synthesized
agtaaatttttcttggcaaa

SEQ ID NO: 203244 - DNA, 20 bp, Artificial Sequence
  chemically synthesized
tagtgtgtctactatttgcc

SEQ ID NO: 203245 - DNA, 20 bp, Artificial Sequence
  chemically synthesized
aaatttttcttggcaaatag

SEQ ID NO: 203246 - DNA, 20 bp, Artificial Sequence
  chemically synthesized
ttggcaaatagtagacacac

SEQ ID NO: 203247 - DNA, 20 bp, Artificial Sequence
  chemically synthesized
aatagtagacacactagata

SEQ ID NO: 203248 - DNA, 20 bp, Artificial Sequence
  chemically synthesized
atagtagacacactagatat

SEQ ID NO: 203249 - DNA, 20 bp, Artificial Sequence
  chemically synthesized
tcattcacttcacctatatc

SEQ ID NO: 203250 - DNA, 20 bp, Artificial Sequence
  chemically synthesized
agacacactagatataggtg

SEQ ID NO: 203251 - DNA, 20 bp, Artificial Sequence
  chemically synthesized
aggtgaagtgaatgaatatg

SEQ ID NO: 203252 - DNA, 20 bp, Artificial Sequence
  chemically synthesized
tgaatgaatatgtagaaaat

SEQ ID NO: 203253 - DNA, 20 bp, Artificial Sequence
  chemically synthesized
atgtagaaaatcagttcctt

SEQ ID NO: 203254 - DNA, 20 bp, Artificial Sequence
  chemically synthesized
gaaaatcagttccttaagaa

SEQ ID NO: 203255 - DNA, 20 bp, Artificial Sequence
  chemically synthesized
tcatcattgagccgttctta

SEQ ID NO: 203256 - DNA, 20 bp, Artificial Sequence
  chemically synthesized
atcatcattgagccgttctt

SEQ ID NO: 203257 - DNA, 20 bp, Artificial Sequence
  chemically synthesized
agattctaaatatcatcatt

SEQ ID NO: 203258 - DNA, 20 bp, Artificial Sequence
  chemically synthesized
aacggctcaatgatgatatt

SEQ ID NO: 203259 - DNA, 20 bp, Artificial Sequence
  chemically synthesized
caatgatgatatttagaatc

SEQ ID NO: 203260 - DNA, 20 bp, Artificial Sequence
  chemically synthesized
aactaagtttcaattatcac

SEQ ID NO: 203261 - DNA, 20 bp, Artificial Sequence
  chemically synthesized
atctagtgataattgaaact

SEQ ID NO: 203262 - DNA, 20 bp, Artificial Sequence
  chemically synthesized
ataattgaaacttagtttaa

SEQ ID NO: 203263 - DNA, 20 bp, Artificial Sequence
  chemically synthesized
tcttagttcacttttaaact

SEQ ID NO: 203264 - DNA, 20 bp, Artificial Sequence
  chemically synthesized
acttagtttaaaagtgaact

SEQ ID NO: 203265 - DNA, 20 bp, Artificial Sequence
  chemically synthesized
tgaaaatattttagttatct

SEQ ID NO: 203266 - DNA, 20 bp, Artificial Sequence
  chemically synthesized
ataagcacatgaaaatattt

SEQ ID NO: 203267 - DNA, 20 bp, Artificial Sequence
  chemically synthesized
tatgccttgattatgtgaat

SEQ ID NO: 203268 - DNA, 20 bp, Artificial Sequence
  chemically synthesized
atgtgcttattcacataatc

SEQ ID NO: 203269 - DNA, 20 bp, Artificial Sequence
  chemically synthesized
tgtgcttattcacataatca

SEQ ID NO: 203270 - DNA, 20 bp, Artificial Sequence
  chemically synthesized
ttattcacataatcaaggca

SEQ ID NO: 203271 - DNA, 20 bp, Artificial Sequence
  chemically synthesized
tattcacataatcaaggcat

SEQ ID NO: 203272 - DNA, 20 bp, Artificial Sequence
  chemically synthesized
ttcacataatcaaggcatag

SEQ ID NO: 203273 - DNA, 20 bp, Artificial Sequence
  chemically synthesized
ataatcaaggcataggagtt

SEQ ID NO: 203274 - DNA, 20 bp, Artificial Sequence
  chemically synthesized
taatcaaggcataggagtta

SEQ ID NO: 203275 - DNA, 20 bp, Artificial Sequence
  chemically synthesized
aatcaaggcataggagttaa

SEQ ID NO: 203276 - DNA, 20 bp, Artificial Sequence
  chemically synthesized
tctagggctgtcgatgacag

SEQ ID NO: 203277 - DNA, 20 bp, Artificial Sequence
  chemically synthesized
tctctagggctgtcgatgac

SEQ ID NO: 203278 - DNA, 20 bp, Artificial Sequence
  chemically synthesized
taagggtctcctgtcatcga

SEQ ID NO: 203279 - DNA, 20 bp, Artificial Sequence
  chemically synthesized
ttctctagggctgtcgatga

SEQ ID NO: 203280 - DNA, 20 bp, Artificial Sequence
  chemically synthesized
tctcctgtcatcgacagccc

SEQ ID NO: 203281 - DNA, 20 bp, Artificial Sequence
  chemically synthesized
tcctgtcatcgacagcccta

SEQ ID NO: 203282 - DNA, 20 bp, Artificial Sequence
  chemically synthesized
tgtcatcgacagccctagag

SEQ ID NO: 203283 - DNA, 20 bp, Artificial Sequence
  chemically synthesized
tgtctttcgtaacttctcta

SEQ ID NO: 203284 - DNA, 20 bp, Artificial Sequence
  chemically synthesized
ttgtctttcgtaacttctct

SEQ ID NO: 203285 - DNA, 20 bp, Artificial Sequence
  chemically synthesized
tttgtctttcgtaacttctc

SEQ ID NO: 203286 - DNA, 20 bp, Artificial Sequence
  chemically synthesized
cagccctagagaagttacga

SEQ ID NO: 203287 - DNA, 20 bp, Artificial Sequence
  chemically synthesized
aagttacgaaagacaaatat

SEQ ID NO: 203288 - DNA, 20 bp, Artificial Sequence
  chemically synthesized
aaaatatctgatatcattaa

SEQ ID NO: 203289 - DNA, 20 bp, Artificial Sequence
  chemically synthesized
tatgagacttttaatgatat

SEQ ID NO: 203290 - DNA, 20 bp, Artificial Sequence
  chemically synthesized
tttaatgatatcagatattt

SEQ ID NO: 203291 - DNA, 20 bp, Artificial Sequence
  chemically synthesized
ttaatgatatcagatatttt

SEQ ID NO: 203292 - DNA, 20 bp, Artificial Sequence
  chemically synthesized
taatgatatcagatattttg

SEQ ID NO: 203293 - DNA, 20 bp, Artificial Sequence
  chemically synthesized
tgcttaaaaggatgacagtg

SEQ ID NO: 203294 - DNA, 20 bp, Artificial Sequence
  chemically synthesized
tagtttgcttaaaaggatga

SEQ ID NO: 203295 - DNA, 20 bp, Artificial Sequence
  chemically synthesized
cactgcactgtcatcctttt

SEQ ID NO: 203296 - DNA, 20 bp, Artificial Sequence
  chemically synthesized
gagaatctagtttgcttaaa

SEQ ID NO: 203297 - DNA, 20 bp, Artificial Sequence
  chemically synthesized
agagaatctagtttgcttaa

SEQ ID NO: 203298 - DNA, 20 bp, Artificial Sequence
  chemically synthesized
tgtcatccttttaagcaaac

SEQ ID NO: 203299 - DNA, 20 bp, Artificial Sequence
  chemically synthesized
cttgtggtggagagagaatc

SEQ ID NO: 203300 - DNA, 20 bp, Artificial Sequence
  chemically synthesized
gggtttgcttgtggtggaga

SEQ ID NO: 203301 - DNA, 20 bp, Artificial Sequence
  chemically synthesized
tagggtttgcttgtggtgga

SEQ ID NO: 203302 - DNA, 20 bp, Artificial Sequence
  chemically synthesized
ctagattctctctccaccac

SEQ ID NO: 203303 - DNA, 20 bp, Artificial Sequence
  chemically synthesized
cttagggtttgcttgtggtg

SEQ ID NO: 203304 - DNA, 20 bp, Artificial Sequence
  chemically synthesized
cacttagggtttgcttgtgg

SEQ ID NO: 203305 - DNA, 20 bp, Artificial Sequence
  chemically synthesized
tcccacttagggtttgcttg

SEQ ID NO: 203306 - DNA, 20 bp, Artificial Sequence
  chemically synthesized
ctccaccacaagcaaaccct

SEQ ID NO: 203307 - DNA, 20 bp, Artificial Sequence
  chemically synthesized
caccacaagcaaaccctaag

SEQ ID NO: 203308 - DNA, 20 bp, Artificial Sequence
  chemically synthesized
accacaagcaaaccctaagt

SEQ ID NO: 203309 - DNA, 20 bp, Artificial Sequence
  chemically synthesized
cacaagcaaaccctaagtgg

SEQ ID NO: 203310 - DNA, 20 bp, Artificial Sequence
  chemically synthesized
gtacttgcatctcccactta

SEQ ID NO: 203311 - DNA, 20 bp, Artificial Sequence
  chemically synthesized
tgtacttgcatctcccactt

SEQ ID NO: 203312 - DNA, 20 bp, Artificial Sequence
  chemically synthesized
gtgtacttgcatctcccact

SEQ ID NO: 203313 - DNA, 20 bp, Artificial Sequence
  chemically synthesized
aaaccctaagtgggagatgc

SEQ ID NO: 203314 - DNA, 20 bp, Artificial Sequence
  chemically synthesized
gatccagagtttaaagaaca

SEQ ID NO: 203315 - DNA, 20 bp, Artificial Sequence
  chemically synthesized
agatccagagtttaaagaac

SEQ ID NO: 203316 - DNA, 20 bp, Artificial Sequence
  chemically synthesized
acaccttgttctttaaactc

SEQ ID NO: 203317 - DNA, 20 bp, Artificial Sequence
  chemically synthesized
atacaaagatccagagttta

SEQ ID NO: 203318 - DNA, 20 bp, Artificial Sequence
  chemically synthesized
cctgtgaatacaaagatcca

SEQ ID NO: 203319 - DNA, 20 bp, Artificial Sequence
  chemically synthesized
gtcctgtgaatacaaagatc

SEQ ID NO: 203320 - DNA, 20 bp, Artificial Sequence
  chemically synthesized
aatgttgtcctgtgaataca

SEQ ID NO: 203321 - DNA, 20 bp, Artificial Sequence
  chemically synthesized
actctggatctttgtattca

SEQ ID NO: 203322 - DNA, 20 bp, Artificial Sequence
  chemically synthesized
ctctggatctttgtattcac

SEQ ID NO: 203323 - DNA, 20 bp, Artificial Sequence
  chemically synthesized
ttcacaggacaacattcaat

SEQ ID NO: 203324 - DNA, 20 bp, Artificial Sequence
  chemically synthesized
tcacaggacaacattcaata

SEQ ID NO: 203325 - DNA, 20 bp, Artificial Sequence
  chemically synthesized
tctccattacaatggacagg

SEQ ID NO: 203326 - DNA, 20 bp, Artificial Sequence
  chemically synthesized
tgatctccattacaatggac

SEQ ID NO: 203327 - DNA, 20 bp, Artificial Sequence
  chemically synthesized
atgatctccattacaatgga

SEQ ID NO: 203328 - DNA, 20 bp, Artificial Sequence
  chemically synthesized
aggccacctgtccattgtaa

SEQ ID NO: 203329 - DNA, 20 bp, Artificial Sequence
  chemically synthesized
tttcatgatctccattacaa

SEQ ID NO: 203330 - DNA, 20 bp, Artificial Sequence
  chemically synthesized
gccacctgtccattgtaatg

SEQ ID NO: 203331 - DNA, 20 bp, Artificial Sequence
  chemically synthesized
tggagatcatgaaataacct

SEQ ID NO: 203332 - DNA, 20 bp, Artificial Sequence
  chemically synthesized
ttacttcaaaaagtaaactt

SEQ ID NO: 203333 - DNA, 20 bp, Artificial Sequence
  chemically synthesized
attacttcaaaaagtaaact

SEQ ID NO: 203334 - DNA, 20 bp, Artificial Sequence
  chemically synthesized
taacctaagtttactttttg

SEQ ID NO: 203335 - DNA, 20 bp, Artificial Sequence
  chemically synthesized
atttcccaaattacttcaaa

SEQ ID NO: 203336 - DNA, 20 bp, Artificial Sequence
  chemically synthesized
gtttactttttgaagtaatt

SEQ ID NO: 203337 - DNA, 20 bp, Artificial Sequence
  chemically synthesized
tttactttttgaagtaattt

SEQ ID NO: 203338 - DNA, 20 bp, Artificial Sequence
  chemically synthesized
ttgaagtaatttgggaaatg

SEQ ID NO: 203339 - DNA, 20 bp, Artificial Sequence
  chemically synthesized
aatgtagaaaaatatgttcc

SEQ ID NO: 203340 - DNA, 20 bp, Artificial Sequence
  chemically synthesized
atgtagaaaaatatgttccc

SEQ ID NO: 203341 - DNA, 20 bp, Artificial Sequence
  chemically synthesized
tacccaatacgaaaattcct

SEQ ID NO: 203342 - DNA, 20 bp, Artificial Sequence
  chemically synthesized
ctacccaatacgaaaattcc

SEQ ID NO: 203343 - DNA, 20 bp, Artificial Sequence
  chemically synthesized
gttcccaggaattttcgtat

SEQ ID NO: 203344 - DNA, 20 bp, Artificial Sequence
  chemically synthesized
ttcccaggaattttcgtatt

SEQ ID NO: 203345 - DNA, 20 bp, Artificial Sequence
  chemically synthesized
ccaggaattttcgtattggg

SEQ ID NO: 203346 - DNA, 20 bp, Artificial Sequence
  chemically synthesized
agaaatatatgcttttctgc

SEQ ID NO: 203347 - DNA, 20 bp, Artificial Sequence
  chemically synthesized
tttatactgcacttgcagaa

SEQ ID NO: 203348 - DNA, 20 bp, Artificial Sequence
  chemically synthesized
tatatgcttttctgcaagtg

SEQ ID NO: 203349 - DNA, 20 bp, Artificial Sequence
  chemically synthesized
atacttttatactgcacttg

SEQ ID NO: 203350 - DNA, 20 bp, Artificial Sequence
  chemically synthesized
tttctgcaagtgcagtataa

SEQ ID NO: 203351 - DNA, 20 bp, Artificial Sequence
  chemically synthesized
cagtataaaagtatgaaaaa

SEQ ID NO: 203352 - DNA, 20 bp, Artificial Sequence
  chemically synthesized
agtataaaagtatgaaaaat

SEQ ID NO: 203353 - DNA, 20 bp, Artificial Sequence
  chemically synthesized
taaaagtatgaaaaatagga

SEQ ID NO: 203354 - DNA, 20 bp, Artificial Sequence
  chemically synthesized
aaagtatgaaaaataggatg

SEQ ID NO: 203355 - DNA, 20 bp, Artificial Sequence
  chemically synthesized
tgaaaaataggatggagtaa

SEQ ID NO: 203356 - DNA, 20 bp, Artificial Sequence
  chemically synthesized
gaaaaataggatggagtaac

SEQ ID NO: 203357 - DNA, 20 bp, Artificial Sequence
  chemically synthesized
ggatggagtaacaggaaaat

SEQ ID NO: 203358 - DNA, 20 bp, Artificial Sequence
  chemically synthesized
aacaggaaaataagttttct

SEQ ID NO: 203359 - DNA, 20 bp, Artificial Sequence
  chemically synthesized
ggaaaataagttttcttagt

SEQ ID NO: 203360 - DNA, 20 bp, Artificial Sequence
  chemically synthesized
gaaaataagttttcttagtt

SEQ ID NO: 203361 - DNA, 20 bp, Artificial Sequence
  chemically synthesized
aataagttttcttagttggg

SEQ ID NO: 203362 - DNA, 20 bp, Artificial Sequence
  chemically synthesized
cctagatggtctgcccaact

SEQ ID NO: 203363 - DNA, 20 bp, Artificial Sequence
  chemically synthesized
tcttagttgggcagaccatc

SEQ ID NO: 203364 - DNA, 20 bp, Artificial Sequence
  chemically synthesized
cttagttgggcagaccatct

SEQ ID NO: 203365 - DNA, 20 bp, Artificial Sequence
  chemically synthesized
actcaggttctatgcctaga

SEQ ID NO: 203366 - DNA, 20 bp, Artificial Sequence
  chemically synthesized
ttgggcagaccatctaggca

SEQ ID NO: 203367 - DNA, 20 bp, Artificial Sequence
  chemically synthesized
acttactcaggttctatgcc

SEQ ID NO: 203368 - DNA, 20 bp, Artificial Sequence
  chemically synthesized
accatctaggcatagaacct

SEQ ID NO: 203369 - DNA, 20 bp, Artificial Sequence
  chemically synthesized
tctaggcatagaacctgagt

SEQ ID NO: 203370 - DNA, 20 bp, Artificial Sequence
  chemically synthesized
ttgggggaatttacttactc

SEQ ID NO: 203371 - DNA, 20 bp, Artificial Sequence
  chemically synthesized
attgggggaatttacttact

SEQ ID NO: 203372 - DNA, 20 bp, Artificial Sequence
  chemically synthesized
accttaagattaattattgg

SEQ ID NO: 203373 - DNA, 20 bp, Artificial Sequence
  chemically synthesized
aaccttaagattaattattg

SEQ ID NO: 203374 - DNA, 20 bp, Artificial Sequence
  chemically synthesized
gaaccttaagattaattatt

SEQ ID NO: 203375 - DNA, 20 bp, Artificial Sequence
  chemically synthesized
tgaaccttaagattaattat

SEQ ID NO: 203376 - DNA, 20 bp, Artificial Sequence
  chemically synthesized
ttcccccaataattaatctt

SEQ ID NO: 203377 - DNA, 20 bp, Artificial Sequence
  chemically synthesized
tcccccaataattaatctta

SEQ ID NO: 203378 - DNA, 20 bp, Artificial Sequence
  chemically synthesized
ctatgtgaaaagtgaacctt

SEQ ID NO: 203379 - DNA, 20 bp, Artificial Sequence
  chemically synthesized
cttaaggttcacttttcaca

SEQ ID NO: 203380 - DNA, 20 bp, Artificial Sequence
  chemically synthesized
tgacttaacttctatgtgaa

SEQ ID NO: 203381 - DNA, 20 bp, Artificial Sequence
  chemically synthesized
aaggttcacttttcacatag

SEQ ID NO: 203382 - DNA, 20 bp, Artificial Sequence
  chemically synthesized
tcacttttcacatagaagtt

SEQ ID NO: 203383 - DNA, 20 bp, Artificial Sequence
  chemically synthesized
catagaagttaagtcacata

SEQ ID NO: 203384 - DNA, 20 bp, Artificial Sequence
  chemically synthesized
tttaatagctagaggagcaa

SEQ ID NO: 203385 - DNA, 20 bp, Artificial Sequence
  chemically synthesized
aagatacactcttgctcctc

SEQ ID NO: 203386 - DNA, 20 bp, Artificial Sequence
  chemically synthesized
ggtttaatagctagaggagc

SEQ ID NO: 203387 - DNA, 20 bp, Artificial Sequence
  chemically synthesized
ccttggtttaatagctagag

SEQ ID NO: 203388 - DNA, 20 bp, Artificial Sequence
  chemically synthesized
gaccttggtttaatagctag

SEQ ID NO: 203389 - DNA, 20 bp, Artificial Sequence
  chemically synthesized
ggaccttggtttaatagcta

SEQ ID NO: 203390 - DNA, 20 bp, Artificial Sequence
  chemically synthesized
atggaccttggtttaatagc

SEQ ID NO: 203391 - DNA, 20 bp, Artificial Sequence
  chemically synthesized
gctcctctagctattaaacc

SEQ ID NO: 203392 - DNA, 20 bp, Artificial Sequence
  chemically synthesized
aattatggaccttggtttaa

SEQ ID NO: 203393 - DNA, 20 bp, Artificial Sequence
  chemically synthesized
ctcctctagctattaaacca

SEQ ID NO: 203394 - DNA, 20 bp, Artificial Sequence
  chemically synthesized
aaaaaaaaaattatggacct

SEQ ID NO: 203395 - DNA, 20 bp, Artificial Sequence
  chemically synthesized
ctaagtaaaaaaaaaaatta

SEQ ID NO: 203396 - DNA, 20 bp, Artificial Sequence
  chemically synthesized
ccataatttttttttttact

SEQ ID NO: 203397 - DNA, 20 bp, Artificial Sequence
  chemically synthesized
tatccctgggagtggaaact

SEQ ID NO: 203398 - DNA, 20 bp, Artificial Sequence
  chemically synthesized
ttttacttagtttccactcc

SEQ ID NO: 203399 - DNA, 20 bp, Artificial Sequence
  chemically synthesized
tttacttagtttccactccc

SEQ ID NO: 203400 - DNA, 20 bp, Artificial Sequence
  chemically synthesized
ttacttagtttccactccca

SEQ ID NO: 203401 - DNA, 20 bp, Artificial Sequence
  chemically synthesized
aaatttcatatccctgggag

SEQ ID NO: 203402 - DNA, 20 bp, Artificial Sequence
  chemically synthesized
tctaaatttcatatccctgg

SEQ ID NO: 203403 - DNA, 20 bp, Artificial Sequence
  chemically synthesized
aatctaaatttcatatccct

SEQ ID NO: 203404 - DNA, 20 bp, Artificial Sequence
  chemically synthesized
gaatctaaatttcatatccc

SEQ ID NO: 203405 - DNA, 20 bp, Artificial Sequence
  chemically synthesized
actcccagggatatgaaatt

SEQ ID NO: 203406 - DNA, 20 bp, Artificial Sequence
  chemically synthesized
gttaagattcatttggggtc

SEQ ID NO: 203407 - DNA, 20 bp, Artificial Sequence
  chemically synthesized
catgtgttaagattcatttg

SEQ ID NO: 203408 - DNA, 20 bp, Artificial Sequence
  chemically synthesized
ccatgtgttaagattcattt

SEQ ID NO: 203409 - DNA, 20 bp, Artificial Sequence
  chemically synthesized
tccatgtgttaagattcatt

SEQ ID NO: 203410 - DNA, 20 bp, Artificial Sequence
  chemically synthesized
cccaaatgaatcttaacaca

SEQ ID NO: 203411 - DNA, 20 bp, Artificial Sequence
  chemically synthesized
aagtgtttcatccatgtgtt

SEQ ID NO: 203412 - DNA, 20 bp, Artificial Sequence
  chemically synthesized
catggatgaaacacttcaaa

SEQ ID NO: 203413 - DNA, 20 bp, Artificial Sequence
  chemically synthesized
gaaagaaactatactttttg

SEQ ID NO: 203414 - DNA, 20 bp, Artificial Sequence
  chemically synthesized
atgaaacacttcaaaaagta

SEQ ID NO: 203415 - DNA, 20 bp, Artificial Sequence
  chemically synthesized
aggtgactggtgaaacagga

SEQ ID NO: 203416 - DNA, 20 bp, Artificial Sequence
  chemically synthesized
tagtttctttcctgtttcac

SEQ ID NO: 203417 - DNA, 20 bp, Artificial Sequence
  chemically synthesized
ggtcaggtgactggtgaaac

SEQ ID NO: 203418 - DNA, 20 bp, Artificial Sequence
  chemically synthesized
tggtcaggtgactggtgaaa

SEQ ID NO: 203419 - DNA, 20 bp, Artificial Sequence
  chemically synthesized
aggtgatttggtcaggtgac

SEQ ID NO: 203420 - DNA, 20 bp, Artificial Sequence
  chemically synthesized
ggtgataaggtgatttggtc

SEQ ID NO: 203421 - DNA, 20 bp, Artificial Sequence
  chemically synthesized
gggtgataaggtgatttggt

SEQ ID NO: 203422 - DNA, 20 bp, Artificial Sequence
  chemically synthesized
taaggggtgataaggtgatt
